United States Patent 9,624,556 (VIRAL AND VIRAL ASSOCIATED MIRNAS AND USES THEREOF) - sequence listing, part 5

SEQ ID NO: 118506 - RNA, 64 nt, Human
caccagaaauuaccucgagucagcauugacgauauuggaggagcugccgugcugcugauacggg

SEQ ID NO: 118507 - RNA, 64 nt, Human
guccugugaauggaagcaaagugcuggauuguccuuggaggaaacuuaagaugaauacaugcgu

SEQ ID NO: 118508 - RNA, 64 nt, Human
gccuguguacacggcuauuugggaaacuuaaguguuggaggaggcaggggcugaaggugucaaa

SEQ ID NO: 118509 - RNA, 64 nt, Human
caauuacaaaaucuaaguauuuuggcccuucaauuuggaggagggcaaaaguuggaaguaagaa

SEQ ID NO: 118510 - RNA, 64 nt, Human
agaggggcguauuuuucacucuguagugaaaggcuuggaggaguuucuacuuuuuauuuuaauu

SEQ ID NO: 118511 - RNA, 64 nt, Human
acagucacaccccagcagcagugagugggcagguuuggaggagccccgaguggcccaggagucc

SEQ ID NO: 118512 - RNA, 64 nt, Human
agaggcuuggaauugggccuggcccccauggggcuuggaggaccgagccacugacagguauccc

SEQ ID NO: 118513 - RNA, 64 nt, Human
augauugaaaccaaguugaaaaauagcauaugccuuggaggaaaugugcucaaauuacuaauga

SEQ ID NO: 118514 - RNA, 64 nt, Human
gugggagcuauucauacacagugacuugauguucuuggaggaucaacaaaacugcccugggaaa

SEQ ID NO: 118515 - RNA, 52 nt, Human
aaaaacacuguucucauuaaaauuggaggaguuugcaugucucaugauaacc

SEQ ID NO: 118516 - RNA, 64 nt, Human
ggaaguuuccaguggucuuauagacuccauguucuuggaggacaggcuguaugucagauuuacc

SEQ ID NO: 118517 - RNA, 64 nt, Human
acuggacuuaaaauauuuaaagaagcuaauccuguuggaggaacuuccagucuguagcacccua

SEQ ID NO: 118518 - RNA, 64 nt, Human
auccuagagggguugagccuucuuccuccuuggguuggaggagaccagggugccucuuaucucc

SEQ ID NO: 118519 - RNA, 64 nt, Human
cagagagaauucgugggcugagggcaauucugucuuggaggaagaagcuggacauucagccugu

SEQ ID NO: 118520 - RNA, 64 nt, Human
cacacagucaggcuuccagcacauucucccccauuuggaggauacucgaaugucagguuuuugg

SEQ ID NO: 118521 - RNA, 64 nt, Human
uccuuaccucaaagucccuuuagguccuucugguuuggaggaaguggagccuccacgaacucuc

SEQ ID NO: 118522 - RNA, 64 nt, Human
cuuucuucauuuugaaggggggaaugccagcauuuuggaggaaauucuacuaaaaguuuuaugc

SEQ ID NO: 118523 - RNA, 64 nt, Human
uuucuuuuuuuuccccagaaauauuuggaaauuauuggaggaauaugcaccccagaugaaaaug

SEQ ID NO: 118524 - RNA, 64 nt, Human
agacuuacucaucuggaauaguuucucacuuguuuuggaggaaaaugaugcuuauucuuauaaa

SEQ ID NO: 118525 - RNA, 64 nt, Human
ggcaggacugcagagcagauggcagaugcacauguuggaggagagagccuugggagccacugcc

SEQ ID NO: 118526 - RNA, 64 nt, Human
uuguagggcagccuuguggcaccuuauguccaacuuggaggauaguauauggcuucuuugugcc

SEQ ID NO: 118527 - RNA, 64 nt, Human
gauggaauuagagaauacaaucaaacuuuaccacuuggaggacacgggguuaguccaggaccaa

SEQ ID NO: 118528 - RNA, 64 nt, Human
cuuguaacuuucuucaaaaagcauuuuaaugauauuggaggaauacuucugauaauuuauuguc

SEQ ID NO: 118529 - RNA, 64 nt, Human
uugagguuauuccuaaaccuauuuauuugguguuuuggaggagaucacacacuaagagaacguu

SEQ ID NO: 118530 - RNA, 64 nt, Human
gaugcugaccucccacuauggggaaaaggguugcuuggaggaccugggguggcagccccccgac

SEQ ID NO: 118531 - RNA, 64 nt, Human
ggccaggugacaggggcccugcuccucucugugguuggaggaaagaugagugaagggaucaacu

SEQ ID NO: 118532 - RNA, 64 nt, Human
auacauuggucuugccugagcucuuccccaaagcuuggaggaacgggggaggcccgggaauguc

SEQ ID NO: 118533 - RNA, 64 nt, Human
auuuuaugucuguaaucauguacuuuggcaucuuuuggaggaaaggggcaggauaacucacugg

SEQ ID NO: 118534 - RNA, 64 nt, Human
gguugccugcaucuuuggcucugcugugaucugauuggaggagggacaguuucugguacccauc

SEQ ID NO: 118535 - RNA, 64 nt, Human
cuuggagcuccuagcuggugauacggagagggcuuuggaggacuugggacagcagggccaauuu

SEQ ID NO: 118536 - RNA, 64 nt, Human
cuggagggugggcaaggcugggagggauaucaacuuggaggagaacaccuagacccaaggacuu

SEQ ID NO: 118537 - RNA, 64 nt, Human
uauggaucuggcagauucuuuauccuuuguggacuuggaggaauuauuagcuguggcacaacac

SEQ ID NO: 118538 - RNA, 64 nt, Human
ugggugagcugauuuacaucuuuauauaguuggcuuggaggaaguacuucuaugggaaagugaa

SEQ ID NO: 118539 - RNA, 64 nt, Human
uucuggcuaaccauauucaagauucuucugaaacuuggaggauguaaagaauccauuugauuug

SEQ ID NO: 118540 - RNA, 64 nt, Human
aaugggacuaaaaccugaugggacaauaacgccuuuggaggaagcacucaaccaguacucuguc

SEQ ID NO: 118541 - RNA, 64 nt, Human
ccuuuuaaaggucacucagguuccagguugacaguuggaggacuucaccguaccaacccugaag

SEQ ID NO: 118542 - RNA, 64 nt, Human
caaaguucuucaguccugagcccuacaugugggguuggaggagaacuauaacggaaaaaccucu

SEQ ID NO: 118543 - RNA, 64 nt, Human
ccucuuguucuuaaaaaagcaagugucuuugguguuggaggacaaaauccccuaccauuuucac

SEQ ID NO: 118544 - RNA, 64 nt, Human
aagauccaagcaaaacuuuacuuucagcguuggcuuggaggacaaauaagaaaugaaacauccu

SEQ ID NO: 118545 - RNA, 64 nt, Human
agcaggacagacugagcuuucuguugcaaauaccuuggaggagaaaguaauuucuaaauauaca

SEQ ID NO: 118546 - RNA, 64 nt, Human
auagaaaagaaaucuuuggggcacugcaucuguuuuggaggagaugagaucagaacucugggga

SEQ ID NO: 118547 - RNA, 64 nt, Human
cucccccgauuauucugccuggccccauguccucuuggaggauuuuucugccauguagaugcuc

SEQ ID NO: 118548 - RNA, 64 nt, Human
aggagggagggacacuuacccaaggcucuucuccuuggaggacagugggaacuggagggugaga

SEQ ID NO: 118549 - RNA, 64 nt, Human
aagcaguggcugaauuuauccccugaaagugguuuuggaggaaccgggauggaggaggccuucc

SEQ ID NO: 118550 - RNA, 64 nt, Human
ugagccagagcugagcuaaauugaaucccuguccuuggaggaaaaccacauuuccagaagcaug

SEQ ID NO: 118551 - RNA, 64 nt, Human
uguaauuaccaaaagauuuagaagugcaugugcuuuggaggauuuguauugagcuuuuacagua

SEQ ID NO: 118552 - RNA, 64 nt, Human
ugauccuguuucccugugcuguccccaugcuguguuggaggaggaaguggcucuccuuccacca

SEQ ID NO: 118553 - RNA, 64 nt, Human
ucugagggacucugaaaucacagaaagugggagcuuggaggaucccuccauggcgauggccgug

SEQ ID NO: 118554 - RNA, 64 nt, Human
uauuaaaccagauuauucacaguaggaauagggguuggaggauuaagaggguuuuucuuaaaua

SEQ ID NO: 118555 - RNA, 64 nt, Human
uguuuacacaccuggaccuggugugaagggagguuuggaggaggguagcucccugaccauuugu

SEQ ID NO: 118556 - RNA, 64 nt, Human
acauucauuguuaagagaagaaugacaguauauuuuggaggaaauaaugaauuuacuaauuaaa

SEQ ID NO: 118557 - RNA, 64 nt, Human
ugacuggcuucuccuuguccucauuuaugcauguuuggaggagcugauuccugaacucauauuu

SEQ ID NO: 118558 - RNA, 64 nt, Human
uugauguguuuauuaucugccucagaagccaggguuggaggaagaacuuuagauauggauauua

SEQ ID NO: 118559 - RNA, 64 nt, Human
gaauucaugugacuagcgccuggccuuguguggcuuggaggaaaugguacugcccaaauaggag

SEQ ID NO: 118560 - RNA, 64 nt, Human
aaccuccauacacugaggcagaaacuugugucaguuggaggaaaauagacuugaguagucuuug

SEQ ID NO: 118561 - RNA, 64 nt, Human
agagaaaacggaagagagaggaaaugaggugggguuggaggaaacccauggggacagauuccca

SEQ ID NO: 118562 - RNA, 64 nt, Human
caucuugcucuucuaggucccguuucuuccucucuuggaggacaugaaauuauagaaauguuga

SEQ ID NO: 118563 - RNA, 64 nt, Human
gaaacaucagagccagcuaagagaaaagaaauauuuggaggaaauugaaaguguggaaaaaaag

SEQ ID NO: 118564 - RNA, 64 nt, Human
cuggggagcugaaggauuuuauggagcuggugcuuuggaggaaucuuaagggaaaggaguagaa

SEQ ID NO: 118565 - RNA, 64 nt, Human
gccuccuccucccuuucucccuuguggggaauguuuggaggaaucacuggcauuugauggggaa

SEQ ID NO: 118566 - RNA, 64 nt, Human
ugggaggagaaaugagaacauagaggaaagccucuuggaggaaaggugcuuggaccaagucuca

SEQ ID NO: 118567 - RNA, 64 nt, Human
ggcgccgcccguccugggcccggccaggccccgcuuggaggaggcaucgucggcauuuucguuu

SEQ ID NO: 118568 - RNA, 64 nt, Human
aaaaccuacccucagugagcaugguacuuggccuuuggaggaacaaucggcugcauugaagauc

SEQ ID NO: 118569 - RNA, 64 nt, Human
ucccuaauuuguagccaguccaaccuuucauuccuuggaggauuuaguuuugggauaaaauuuu

SEQ ID NO: 118570 - RNA, 64 nt, Human
aaccauggcacugaggugccgugugacgguggccuuggaggacccagcacugacccauagaggg

SEQ ID NO: 118571 - RNA, 64 nt, Human
ccuucacugaaggcugcagugcuguucugagagcuuggaggaggcaccagcgaggaugacguuu

SEQ ID NO: 118572 - RNA, 64 nt, Human
uucaagccacuggcaaugcuucuguccucgugucuuggaggaaaaucaccuggggggaggggac

SEQ ID NO: 118573 - RNA, 64 nt, Human
cugagcuugugaaaagaaagugguuggucugagguuggaggaagcugaauggaaucugacgguu

SEQ ID NO: 118574 - RNA, 64 nt, Human
ccgcccaguccugccugcaagcccagggcgaguauuggaggaggggcagccacgggcagagcac

SEQ ID NO: 118575 - RNA, 64 nt, Human; identical to SEQ ID NO: 118563

SEQ ID NO: 118576 - RNA, 64 nt, Human
aauuuuuuuuucaguaaaagggaauauuacaauguuggaggagagauaaguuauagggagcugg

SEQ ID NO: 118577 - RNA, 58 nt, Human
augcuguuccccggagguaacccaccccuuggaggagagagaccccgcacccggcucg

SEQ ID NO: 118578 - RNA, 64 nt, Human
gucauauccuagguaucaucauuuauccaaguacuuggaggaauacaaguauauauaaauacag

SEQ ID NO: 118579 - RNA, 64 nt, Human
uccacagggcuuguuuuccaaagaaaaguauuguuuggaggagcaaaguuaaaagccuaccuaa

SEQ ID NO: 118580 - RNA, 64 nt, Human
uaaaaaaaaaaaaaggaaacacucauaccuguaguuggaggaugaauacuggagacggguuacc

SEQ ID NO: 118581 - RNA, 64 nt, Human
agggacuuggaucuccuuauauugaauaagcuguuuggaggaaggugucugucugggaggaugg

SEQ ID NO: 118582 - RNA, 64 nt, Human
guaguguauuaaucucuguguguuuucuuugguuuuggaggagggguaugaaguaucuuugaca

SEQ ID NO: 118583 - RNA, 64 nt, Human
guaccagacuagauggaccugccugcauaggaguuuggaggaaguuggaguuuuguuuccucug

SEQ ID NO: 118584 - RNA, 64 nt, Human
ugaggccuaaaaaggaagugaguuuauacugcaguuggaggaacugccugcagccuugaggaaa

SEQ ID NO: 118585 - RNA, 64 nt, Human
aaauaaauucacauuuucucaaagucucauagcuuuggaggagccaucugcuuuuuuggcugcu

SEQ ID NO: 118586 - RNA, 64 nt, Human
cucaucaccucuugugggccuuuggaaauguauguuggaggagacauuuuggauuguugcaaug

SEQ ID NO: 118587 - RNA, 64 nt, Human
uauaaaguuaaguuaacauacuaacauuucuccuuuggaggaaguuuuaaucuacuucaggaug

SEQ ID NO: 118588 - RNA, 64 nt, Human
gggccuguaaucccagcauuuuaggaggccaagguuggaggaucauuugagcccaggaauugga

SEQ ID NO: 118589 - RNA, 64 nt, Human
gggggucuuauguuuguuuugccucuucuguuucuuggaggagaguugaggcuuuucuuaggug

SEQ ID NO: 118590 - RNA, 64 nt, Human
gaaguaacaguaacgcaggggaaacguuuucuguuuggaggagcaaaggcugagaacacuguga

SEQ ID NO: 118591 - RNA, 64 nt, Human
gcacugccaaauucagggaacagugguggccagcuuggaggauggacauuucuggauacacaua

SEQ ID NO: 118592 - RNA, 64 nt, Human
uggcaauaaaaugagcuaaaugggcuaggugaauuuggaggacuacuucaguccuaacuuauag

SEQ ID NO: 118593 - RNA, 64 nt, Human
agucccaagccuggcaccaagccugaggggccucuuggaggaggagguguucaucugcaccaca

SEQ ID NO: 118594 - RNA, 64 nt, Human
uuggggaaagccuuggguguaaaucaguguaaacuuggaggagagauuuuucuaucauguagag

SEQ ID NO: 118595 - RNA, 64 nt, Human
uccccccaggcucugccugggcagaagacucaccuuggaggagugggcccuggaguccuguccc

SEQ ID NO: 118596 - RNA, 64 nt, Human
ggcucaaacagcaauagggucuuccucacugaccuuggaggaugccuguggccuugugauaaaa

SEQ ID NO: 118597 - RNA, 64 nt, Human
aacugugaauucugcccuggacagggcuuugcccuuggaggauccccagguggccuuacccgug

SEQ ID NO: 118598 - RNA, 64 nt, Human
cccagacacacccccacgcccccacuggacggcauuggaggaagggacagcugcuuggguucua

SEQ ID NO: 118599 - RNA, 64 nt, Human
uucuccuuagcaccugugagaauaugaacuucucuuggaggaaugaaugcaaccaguguaaggc

SEQ ID NO: 118600 - RNA, 64 nt, Human
gaaguguggcugguguccccuuccccugcugaccuuggaggaaugacaauaaaucccaugaaca

SEQ ID NO: 118601 - RNA, 64 nt, Human
ggugccgcucugcaggguauuugaaccuguggaauuggaggaggccauuucacucccugaaccc

SEQ ID NO: 118602 - RNA, 64 nt, Human
caggugcuaggaacacuccuucacagaugggugcuuggaggaaggaaacccagcucugguccau

SEQ ID NO: 118603 - RNA, 51 nt, Human
cagcaaagggaaagaaaugacuuggaggaggcuccuggugucugaaacggc

SEQ ID NO: 118604 - RNA, 64 nt, Human
uacuaccuguucuuguagaucuagcuccucagaguuggaggaaggcugacagagaaggucuccu

SEQ ID NO: 118605 - RNA, 64 nt, Human
uccauuagcugcguccuucagcuauuccuuuagauuggaggaaguggauaugaagauggauuga

SEQ ID NO: 118606 - RNA, 64 nt, Human
auguuggauagucauccacgcucaguuuggaccauuggaggaacuuagugucacgcacaaaugg

SEQ ID NO: 118607 - RNA, 64 nt, Human
gaacugucuucccuugguccuucugguccaggccuuggaggaaagcagaggaugaucccugccu

SEQ ID NO: 118608 - RNA, 64 nt, Human
gguccugcccgugguuacuaugaauguauugcuguuggaggacaucucgauccaaagaacagcc

SEQ ID NO: 118609 - RNA, 64 nt, Human
ggaugccaagaggccuaggaacccagaaacccccuuggaggagcuguguaugcgggggugccag

SEQ ID NO: 118610 - RNA, 64 nt, Human
uuguuuuccuuuuaccauuuuaucuuaucuugcuuuggaggaccuuaaaugcuacugaaacuua

SEQ ID NO: 118611 - RNA, 64 nt, Human
uugaagggggaggaauagaaaaagacaaacugccuuggaggagauaaaccaauuuuaugucuau

SEQ ID NO: 118612 - RNA, 64 nt, Human
ucaggaucaaugaccccuguaaggggccagagccuuggaggacacuaagaggaggcaggaggag

SEQ ID NO: 118613 - RNA, 64 nt, Human
auccagaaaaaugcaagcaaguccacauggagauuuggaggacacugguuaaagaauuuauuuc

SEQ ID NO: 118614 - RNA, 64 nt, Human
caucccagcuugcccccgcuuagccccgcugagcuuggaggaaguaugagugcugauucaaacc

SEQ ID NO: 118615 - RNA, 64 nt, Human
cugaguuuccuggaugcuaauuucacacuuucgguuggaggagaucuccauuguuccuaccccu

SEQ ID NO: 118616 - RNA, 64 nt, Human
ccaggcacccaaggauccugccagacagcacacuuuggaggaaggucugcagggagcagcugag

SEQ ID NO: 118617 - RNA, 64 nt, Human
acaugaugaaaggaacagaaacaguguuauuagguuggaggacaccgacuaauuugggaaacgg

SEQ ID NO: 118618 - RNA, 64 nt, Human
uggggauccugccuaagguugucuacgggggcacuuggaggaccuggcgugcucagacccaaca

SEQ ID NO: 118619 - RNA, 63 nt, Human
gaguguuuuguuguuucagaacaccgaaaagcuuuggaggauuucacucuugauaauauucuu

SEQ ID NO: 118620 - RNA, 64 nt, Human
auguaaaggcagguuugggaagguguuuaaagaguuggaggaauuggggauugaguuguaaaga

SEQ ID NO: 118621 - RNA, 64 nt, Human
gucuccagucauugguugagccacagccuagggguuggaggaagacuccacucuggguacaccc

SEQ ID NO: 118622 - RNA, 64 nt, Human
acaagggcuuuuggccacagguguggguguccuguuggaggagggcuuguuuggagaagggagg

SEQ ID NO: 118623 - RNA, 64 nt, Human
ggcaccucucucuaacccucauugucagagggaauuggaggauauccacagucuguuccuguuc

SEQ ID NO: 118624 - RNA, 64 nt, Human
ucuuccuccagcuggcucccuugucuccagggcuuuggaggaucaggguagggagggcucuguc

SEQ ID NO: 118625 - RNA, 64 nt, Human
uuggagaggagagaaucuggacauggcuuuggacuuggaggauaucuuggauuggauugcacaa

SEQ ID NO: 118626 - RNA, 64 nt, Human
ucucuuuuuaaaccaccauagacucucacuuauuuuggaggaguguaugugcauguguacacau

SEQ ID NO: 118627 - RNA, 64 nt, Human
aacgggucgugauggcguggcaacccucacuguguuggaggauggcacuccggccaccuccucc

SEQ ID NO: 118628 - RNA, 64 nt, Human
aaaagaagauucaggcccugagaggucucagcucuuggaggagggcuaaggcuuuagcauugug

SEQ ID NO: 118629 - RNA, 64 nt, Human
ucaagaaugcaaagaggccgcuucccuaagaggcuuggaggagcugggcucuaucccacaccca

SEQ ID NO: 118630 - RNA, 64 nt, Human
uucuuuuuccauuaguuaaacauuuuuuucuccuuuggaggaagggaaugaaacauuuauggcc

SEQ ID NO: 118631 - RNA, 64 nt, Human
uauuuuugaaaagugccuucacguugcauuuuuauuggaggaaaaccucgcucguucaguaagc

SEQ ID NO: 118632 - RNA, 64 nt, Human
auccucucagcccuauucccaugccucccucucauuggaggagcugaccaaagcagcccuaacg

SEQ ID NO: 118633 - RNA, 64 nt, Human
gguauucuugguucuccuuucuaacccucaguucuuggaggacaagauaccuggugauuuaaaa

SEQ ID NO: 118634 - RNA, 64 nt, Human
ugggacuuagaacuucggaguugcugccuugcaauuggaggaaggaccuggggccccuauaggc

SEQ ID NO: 118635 - RNA, 64 nt, Human
cugaggccuggauugggaggcacaguggccacauuuggaggaaguucacauuuccuggcaugca

SEQ ID NO: 118636 - RNA, 64 nt, Human
uacugaaaauggcuggguaagcaagucaaggguguuggaggaggucaagagagagcucaguuuc

SEQ ID NO: 118637 - RNA, 64 nt, Human
cuagcuuuggaaguaagccuuuauuuauuacuuuuuggaggaaaucagagaagugucaauggac

SEQ ID NO: 118638 - RNA, 64 nt, Human
caaccaagaaauaauaguaugaagcggaugcuguuuggaggacaggaaaauuuaucgggaaaau

SEQ ID NO: 118639 - RNA, 64 nt, Human
ucgggaccuaauguucucuacaugaacugcucauuuggaggacagcagugagguccugccauag

SEQ ID NO: 118640 - RNA, 64 nt, Human
aaacaaaauaagucaaaauggacagucauuuuauuuggaggaaauauuugaacaagugucucca

SEQ ID NO: 118641 - RNA, 64 nt, Human
uucguagaaaacuagaaaguaugauaaacaacaguuggaggaauccauggaaaauagacgagaa

SEQ ID NO: 118642 - RNA, 64 nt, Human
gauuguuucuucuuuuccuugucuuugaacuuccuuggaggagagcuugggagacgucccgggg

SEQ ID NO: 118643 - RNA, 64 nt, Human
gguccugcaagcaguggggaagggggccaagguauuggaggacucccucccagcuuuggaagcc

SEQ ID NO: 118644 - RNA, 64 nt, Human
gcaaucuugccucccaggggaaauuuugcaauguuuggaggauguugucacagcuaguagcggg

SEQ ID NO: 118645 - RNA, 64 nt, Human
ccuucacaaggcucagugacaaaccugaagaagauuggaggaaccuugaagagugagaaacacc

SEQ ID NO: 118646 - RNA, 64 nt, Human
uuagaaagacaaguggguggcuuugauggacgguuuggaggaggcaagacuggaggugggaaaa

SEQ ID NO: 118647 - RNA, 64 nt, Human
cuggccccgugacacucaggaguuaauaaaugccuuggaggaaaacaucaggggugucuuguaa

SEQ ID NO: 118648 - RNA, 64 nt, Human
uagguuuugggguccaggccauuuuuuuuaccccuuggaggaaauaagaugagggagaaaggag

SEQ ID NO: 118649 - RNA, 64 nt, Human
aaaucuuuaguuagaauucacaccuagcacaacauuggaggacucaggagaaaaaccuuacaaa

SEQ ID NO: 118650 - RNA, 64 nt, Human
gacaaggcagacaucuguguguucucuuaagucuuuggaggaaaucuugagcagucuaagccuu

SEQ ID NO: 118651 - RNA, 64 nt, Human
caacaugcucagggaggcagaguucuuccauuaguuggaggaaagcacgaguagucuaagcucu

SEQ ID NO: 118652 - RNA, 64 nt, Human
ccggugcccgaaccgccgcuggggccucggagacuuggaggaggacgcucuggaaccaucaucc

SEQ ID NO: 118653 - RNA, 64 nt, Human
uauuuggaggcccugucucuggugguuuuuaggauuggaggacaucaugaagauggaggccuug

SEQ ID NO: 118654 - RNA, 64 nt, Human
ucaacugcagaauaaaucacacccuagcccuggcuuggaggauccccgcuuucacagaugcugg

SEQ ID NO: 118655 - RNA, 64 nt, Human
aauaggauuguugcaaggaguaaguaguuaauacuuggaggaaucacagucauauagcauguau

SEQ ID NO: 118656 - RNA, 64 nt, Human
caaccuguacacagaaagcauuuuuugcauguguuuggaggagcuuuuacccccauacagacau

SEQ ID NO: 118657 - RNA, 64 nt, Human
cucuaaaauuguacucagaagaauucugcaaggcuuggaggauauauaaguuagucauauggcc

SEQ ID NO: 118658 - RNA, 64 nt, Human
uuuuuaagcgcauuuuuuaaaacuuaaaauguauuuggaggagaaauccugcaaguaaucuuaa

SEQ ID NO: 118659 - RNA, 64 nt, Human
accuuaccugguauucuuugaauuuuuuuuuuuuuuggaggaggaagagagcaacaaauuugau

SEQ ID NO: 118660 - RNA, 64 nt, Human
aggcgaggcagauacaccuguguucucccaacccuuggaggaaauuccuugagcagucugagcc

SEQ ID NO: 118661 - RNA, 64 nt, Human
aaagauaauuacaaacgggucacagguacuagucuuggaggaggaacuuuuuuuggucucugcu

SEQ ID NO: 118662 - RNA, 64 nt, Human
aacuuguguaauaggaugcuuuucuaguguuacuuuggaggagcuaauuauacaacaucauuga

SEQ ID NO: 118663 - RNA, 64 nt, Human
ugggcguccccugggguugggggggcacaagguuuuggaggaagaagacaacuucccucauucc

SEQ ID NO: 118664 - RNA, 64 nt, Human
gaaaagcaaauuucuaauucaccagcaauaaaaauuggaggaggcuuggcccucagcccuuaua

SEQ ID NO: 118665 - RNA, 64 nt, Human
uguucagggccuuaguuggccccaguaauucuccuuggaggacuugggagaagaauuuccacaa

SEQ ID NO: 118666 - RNA, 64 nt, Human
uuaaauguccaaaugcaaaccuuugugacuuccuuuggaggacuuggcagcacagcaugccccc

SEQ ID NO: 118667 - RNA, 64 nt, Human
ccuccucccacuuacuuguucuaaauagagcuguuuggaggauguucucugcgcucccaggccg

SEQ ID NO: 118668 - RNA, 64 nt, Human
gccaacagcaugaacucagagcauuguuuuaggguuggaggaggaacacgcuuucuuuacauca

SEQ ID NO: 118669 - RNA, 61 nt, Human
cacgagaucagagcaucugaacugcccugccuuggaggagagacuuuugggugagguccaa

SEQ ID NO: 118670 - RNA, 64 nt, Human
cucaggaucucccuggggcaggaaguggguggacuuggaggaggaacggcaagggccggucccc

SEQ ID NO: 118671 - RNA, 64 nt, Human
guuccuucuuucccuuggacgcccagugcuggccuuggaggacggucagcuggaggauggcggu

SEQ ID NO: 118672 - RNA, 64 nt, Human
auaaaaugguguuuucauguaaauaaauacauucuuggaggagcaccauugugcuggugugaau

SEQ ID NO: 118673 - RNA, 64 nt, Human
caaugucgcuguaaauuuuauggcacuauuuuuauuggaggauuuggucagaaugcaguuguug

SEQ ID NO: 118674 - RNA, 64 nt, Human
guuuuuguuuuuucuuauugcuguggaaccucuuuuggaggacguuaaaggcguguuuuacuug

SEQ ID NO: 118675 - RNA, 64 nt, Human
ugugaaugggguggggcugugggggcagcugggguuggaggaugagagcuccugaggggcagag

SEQ ID NO: 118676 - RNA, 64 nt, Human
cagugucaggggaccugggaagcuggguggcuuguuggaggaggcuguguucuaaucagaaggu

SEQ ID NO: 118677 - RNA, 64 nt, Human
agcaaggcugcugcccgugccuugggugcuggaguuggaggaggcuguucucagcccuuucccu

SEQ ID NO: 118678 - RNA, 64 nt, Human
agcuaucacagggagauaggcaaugcuguggguguuggaggaaggugagagccuguugcuaaca

SEQ ID NO: 118679 - RNA, 64 nt, Human
accuugguuugacuuacacgggacauuuguguuuuuggaggaaaagauacccugauucuuugaa

SEQ ID NO: 118680 - RNA, 64 nt, Human
ggggcucuucagaccacacagcccugaccgggccuuggaggagagccauggacaggcuccucca

SEQ ID NO: 118681 - RNA, 64 nt, Human
ucauuaguuggugggagaagggacacauccacucuuggaggaauauauuuacucaauaauggca

SEQ ID NO: 118682 - RNA, 64 nt, Human
uguuuuuguuuugguagaucuucaauuuggauauuuggaggagugaacaucguuguuuugcugg

SEQ ID NO: 118683 - RNA, 64 nt, Human
aguguuaacuccuuucuuuuuaaauaaauguuuauuggaggaaaaaagcacucaguuguuccau

SEQ ID NO: 118684 - RNA, 55 nt, Human
gauaccugcagcaucuuuagucaaguuggaggagaaagacaacacuuggucuaag

SEQ ID NO: 118685 - RNA, 64 nt, Human
uccacaguucugugauuucuguccuugcuuacauuuggaggacagggacaaggacugagcaaaa

SEQ ID NO: 118686 - RNA, 64 nt, Human
uacuuaagcuaaaucaauuucaaagaagaaaaacuuggaggacucauuuuaccugacuucaaga

SEQ ID NO: 118687 - RNA, 64 nt, Human
uccuucaaucuaccuagcaugcauuuuacacacauuggaggagucguaugcacuguuuuucugu

SEQ ID NO: 118688 - RNA, 64 nt, Human
uuuauuccaagaaucuacaaugacauugaaguuguuggaggaauguacuguauuuaaaaaaacc

SEQ ID NO: 118689 - RNA, 64 nt, Human
cucugucagaaauauccagauuuaaauuucauaauuggaggagagggaccaaagagaaucauuu

SEQ ID NO: 118690 - RNA, 64 nt, Human
uugggguaaaguuguagcuuauaugcaauacuacuuggaggaauucuucuacuaauuuguauuu

SEQ ID NO: 118691 - RNA, 64 nt, Human
caccccaaccucuguuccccacccaguucuucauuuggaggaaucaccccauuucagaguuauc

SEQ ID NO: 118692 - RNA, 64 nt, Human
aaaacuggaagccuucccccagcaaggcagaagcuuggaggaggguuguaaaagcauauuguac

SEQ ID NO: 118693 - RNA, 64 nt, Human
gcaagcuggauccgaguagauucccuagggcuuguuggaggaacuaguuugacucccuuauacu

SEQ ID NO: 118694 - RNA, 64 nt, Human
augcccaagccuuugaccacgguuuuguagccuguuggaggaagcuacuuuuagcuggcuacac

SEQ ID NO: 118695 - RNA, 64 nt, Human
auguguuauguuuucgaaaaucaaaugguaucuuuuggaggaagauacauuuuagugguagcau

SEQ ID NO: 118696 - RNA, 64 nt, Human
ugugggcacaagaggacaucuaaccaccugcuccuuggaggaggcccccaggggugguagaggc

SEQ ID NO: 118697 - RNA, 64 nt, Human
agggggcuggagacaaggauaaguuauagagcaguuggaggaagcauccaaagauugcaaccca

SEQ ID NO: 118698 - RNA, 64 nt, Human; identical to SEQ ID NO: 73703

SEQ ID NO: 118699 - RNA, 64 nt, Human; identical to SEQ ID NO: 73704

SEQ ID NO: 118700 - RNA, 64 nt, Human; identical to SEQ ID NO: 73705

SEQ ID NO: 118701 - RNA, 64 nt, Human; identical to SEQ ID NO: 73706

SEQ ID NO: 118702 - RNA, 64 nt, Human; identical to SEQ ID NO: 73707

SEQ ID NO: 118703 - RNA, 64 nt, Human; identical to SEQ ID NO: 73708

SEQ ID NO: 118704 - RNA, 64 nt, Human; identical to SEQ ID NO: 73709

SEQ ID NO: 118705 - RNA, 64 nt, Human; identical to SEQ ID NO: 73710

SEQ ID NO: 118706 - RNA, 64 nt, Human; identical to SEQ ID NO: 73711

SEQ ID NO: 118707 - RNA, 64 nt, Human; identical to SEQ ID NO: 73712

SEQ ID NO: 118708 - RNA, 64 nt, Human; identical to SEQ ID NO: 73713

SEQ ID NO: 118709 - RNA, 64 nt, Human; identical to SEQ ID NO: 73714

SEQ ID NO: 118710 - RNA, 64 nt, Human; identical to SEQ ID NO: 73715

SEQ ID NO: 118711 - RNA, 64 nt, Human; identical to SEQ ID NO: 73716

SEQ ID NO: 118712 - RNA, 64 nt, Human; identical to SEQ ID NO: 73717

SEQ ID NO: 118713 - RNA, 64 nt, Human; identical to SEQ ID NO: 73718

SEQ ID NO: 118714 - RNA, 64 nt, Human; identical to SEQ ID NO: 73719

SEQ ID NO: 118715 - RNA, 64 nt, Human; identical to SEQ ID NO: 73720

SEQ ID NO: 118716 - RNA, 64 nt, Human; identical to SEQ ID NO: 73721

SEQ ID NO: 118717 - RNA, 64 nt, Human; identical to SEQ ID NO: 73722

SEQ ID NO: 118718 - RNA, 64 nt, Human; identical to SEQ ID NO: 73723

SEQ ID NO: 118719 - RNA, 64 nt, Human; identical to SEQ ID NO: 73724

SEQ ID NO: 118720 - RNA, 64 nt, Human; identical to SEQ ID NO: 73725

SEQ ID NO: 118721 - RNA, 64 nt, Human; identical to SEQ ID NO: 73726

SEQ ID NO: 118722 - RNA, 64 nt, Human; identical to SEQ ID NO: 73727

SEQ ID NO: 118723 - RNA, 64 nt, Human; identical to SEQ ID NO: 73728

SEQ ID NO: 118724 - RNA, 64 nt, Human; identical to SEQ ID NO: 73729

SEQ ID NO: 118725 - RNA, 64 nt, Human; identical to SEQ ID NO: 73730

SEQ ID NO: 118726 - RNA, 64 nt, Human; identical to SEQ ID NO: 73731

SEQ ID NO: 118727 - RNA, 64 nt, Human; identical to SEQ ID NO: 73732

SEQ ID NO: 118728 - RNA, 64 nt, Human; identical to SEQ ID NO: 73733

SEQ ID NO: 118729 - RNA, 64 nt, Human; identical to SEQ ID NO: 73734

SEQ ID NO: 118730 - RNA, 64 nt, Human; identical to SEQ ID NO: 73735

SEQ ID NO: 118731 - RNA, 64 nt, Human; identical to SEQ ID NO: 73736

SEQ ID NO: 118732 - RNA, 64 nt, Human; identical to SEQ ID NO: 73737

SEQ ID NO: 118733 - RNA, 64 nt, Human; identical to SEQ ID NO: 73738

SEQ ID NO: 118734 - RNA, 64 nt, Human; identical to SEQ ID NO: 73739

SEQ ID NO: 118735 - RNA, 64 nt, Human; identical to SEQ ID NO: 73740

SEQ ID NO: 118736 - RNA, 64 nt, Human; identical to SEQ ID NO: 73741

SEQ ID NO: 118737 - RNA, 64 nt, Human; identical to SEQ ID NO: 73742

SEQ ID NO: 118738 - RNA, 64 nt, Human; identical to SEQ ID NO: 73743

SEQ ID NO: 118739 - RNA, 64 nt, Human; identical to SEQ ID NO: 73744

SEQ ID NO: 118740 - RNA, 64 nt, Human; identical to SEQ ID NO: 73745

SEQ ID NO: 118741 - RNA, 64 nt, Human; identical to SEQ ID NO: 73746

SEQ ID NO: 118742 - RNA, 64 nt, Human; identical to SEQ ID NO: 73747

SEQ ID NO: 118743 - RNA, 64 nt, Human; identical to SEQ ID NO: 73748

SEQ ID NO: 118744 - RNA, 64 nt, Human; identical to SEQ ID NO: 73749

SEQ ID NO: 118745 - RNA, 64 nt, Human; identical to SEQ ID NO: 73750

SEQ ID NO: 118746 - RNA, 64 nt, Human; identical to SEQ ID NO: 73751

SEQ ID NO: 118747 - RNA, 64 nt, Human; identical to SEQ ID NO: 73752

SEQ ID NO: 118748 - RNA, 64 nt, Human; identical to SEQ ID NO: 73753

SEQ ID NO: 118749 - RNA, 64 nt, Human; identical to SEQ ID NO: 73754

SEQ ID NO: 118750 - RNA, 64 nt, Human; identical to SEQ ID NO: 73755

SEQ ID NO: 118751 - RNA, 64 nt, Human; identical to SEQ ID NO: 73756

SEQ ID NO: 118752 - RNA, 64 nt, Human; identical to SEQ ID NO: 73757

SEQ ID NO: 118753 - RNA, 64 nt, Human; identical to SEQ ID NO: 73758

SEQ ID NO: 118754 - RNA, 64 nt, Human; identical to SEQ ID NO: 73759

SEQ ID NO: 118755 - RNA, 64 nt, Human; identical to SEQ ID NO: 73760

SEQ ID NO: 118756 - RNA, 64 nt, Human; identical to SEQ ID NO: 73761

SEQ ID NO: 118757 - RNA, 64 nt, Human; identical to SEQ ID NO: 73762

SEQ ID NO: 118758 - RNA, 64 nt, Human; identical to SEQ ID NO: 73763

SEQ ID NO: 118759 - RNA, 64 nt, Human; identical to SEQ ID NO: 73764

SEQ ID NO: 118760 - RNA, 53 nt, Human; identical to SEQ ID NO: 73765

SEQ ID NO: 118761 - RNA, 64 nt, Human; identical to SEQ ID NO: 73766

SEQ ID NO: 118762 - RNA, 64 nt, Human; identical to SEQ ID NO: 73767

SEQ ID NO: 118763 - RNA, 64 nt, Human; identical to SEQ ID NO: 73768

SEQ ID NO: 118764 - RNA, 64 nt, Human; identical to SEQ ID NO: 73769

SEQ ID NO: 118765 - RNA, 64 nt, Human; identical to SEQ ID NO: 73770

SEQ ID NO: 118766 - RNA, 64 nt, Human; identical to SEQ ID NO: 73771

SEQ ID NO: 118767 - RNA, 64 nt, Human; identical to SEQ ID NO: 73772

SEQ ID NO: 118768 - RNA, 64 nt, Human; identical to SEQ ID NO: 73773

SEQ ID NO: 118769 - RNA, 64 nt, Human; identical to SEQ ID NO: 73774

SEQ ID NO: 118770 - RNA, 64 nt, Human; identical to SEQ ID NO: 73775

SEQ ID NO: 118771 - RNA, 64 nt, Human; identical to SEQ ID NO: 73776

SEQ ID NO: 118772 - RNA, 64 nt, Human; identical to SEQ ID NO: 73777

SEQ ID NO: 118773 - RNA, 64 nt, Human; identical to SEQ ID NO: 73778

SEQ ID NO: 118774 - RNA, 64 nt, Human; identical to SEQ ID NO: 73779

SEQ ID NO: 118775 - RNA, 64 nt, Human; identical to SEQ ID NO: 73780

SEQ ID NO: 118776 - RNA, 64 nt, Human; identical to SEQ ID NO: 73781

SEQ ID NO: 118777 - RNA, 64 nt, Human; identical to SEQ ID NO: 73782

SEQ ID NO: 118778 - RNA, 64 nt, Human; identical to SEQ ID NO: 73783

SEQ ID NO: 118779 - RNA, 64 nt, Human; identical to SEQ ID NO: 73784

SEQ ID NO: 118780 - RNA, 64 nt, Human; identical to SEQ ID NO: 73785

SEQ ID NO: 118781 - RNA, 64 nt, Human; identical to SEQ ID NO: 73786

SEQ ID NO: 118782 - RNA, 64 nt, Human; identical to SEQ ID NO: 73787

SEQ ID NO: 118783 - RNA, 64 nt, Human; identical to SEQ ID NO: 73788

SEQ ID NO: 118784 - RNA, 64 nt, Human; identical to SEQ ID NO: 73789

SEQ ID NO: 118785 - RNA, 64 nt, Human; identical to SEQ ID NO: 73790

SEQ ID NO: 118786 - RNA, 64 nt, Human; identical to SEQ ID NO: 73791

SEQ ID NO: 118787 - RNA, 64 nt, Human; identical to SEQ ID NO: 73792

SEQ ID NO: 118788 - RNA, 61 nt, Human; identical to SEQ ID NO: 73793

SEQ ID NO: 118789 - RNA, 64 nt, Human; identical to SEQ ID NO: 73794

SEQ ID NO: 118790 - RNA, 64 nt, Human; identical to SEQ ID NO: 73795

SEQ ID NO: 118791 - RNA, 64 nt, Human; identical to SEQ ID NO: 73796

SEQ ID NO: 118792 - RNA, 64 nt, Human; identical to SEQ ID NO: 73797

SEQ ID NO: 118793 - RNA, 64 nt, Human; identical to SEQ ID NO: 73798

SEQ ID NO: 118794 - RNA, 64 nt, Human; identical to SEQ ID NO: 73799

SEQ ID NO: 118795 - RNA, 64 nt, Human; identical to SEQ ID NO: 73800

SEQ ID NO: 118796 - RNA, 64 nt, Human; identical to SEQ ID NO: 73801

SEQ ID NO: 118797 - RNA, 64 nt, Human; identical to SEQ ID NO: 73802

SEQ ID NO: 118798 - RNA, 64 nt, Human; identical to SEQ ID NO: 73803

SEQ ID NO: 118799 - RNA, 64 nt, Human; identical to SEQ ID NO: 73804

SEQ ID NO: 118800 - RNA, 64 nt, Human; identical to SEQ ID NO: 73805

SEQ ID NO: 118801 - RNA, 64 nt, Human; identical to SEQ ID NO: 73806

SEQ ID NO: 118802 - RNA, 64 nt, Human; identical to SEQ ID NO: 73807

SEQ ID NO: 118803 - RNA, 64 nt, Human; identical to SEQ ID NO: 73808

SEQ ID NO: 118804 - RNA, 64 nt, Human; identical to SEQ ID NO: 73809

SEQ ID NO: 118805 - RNA, 64 nt, Human; identical to SEQ ID NO: 73810

SEQ ID NO: 118806 - RNA, 64 nt, Human; identical to SEQ ID NO: 73811

SEQ ID NO: 118807 - RNA, 64 nt, Human; identical to SEQ ID NO: 73812

SEQ ID NO: 118808 - RNA, 64 nt, Human; identical to SEQ ID NO: 73813

SEQ ID NO: 118809 - RNA, 64 nt, Human; identical to SEQ ID NO: 73814

SEQ ID NO: 118810 - RNA, 64 nt, Human; identical to SEQ ID NO: 73815

SEQ ID NO: 118811 - RNA, 64 nt, Human; identical to SEQ ID NO: 73816

SEQ ID NO: 118812 - RNA, 64 nt, Human; identical to SEQ ID NO: 73817

SEQ ID NO: 118813 - RNA, 64 nt, Human; identical to SEQ ID NO: 73818

SEQ ID NO: 118814 - RNA, 64 nt, Human; identical to SEQ ID NO: 73819

SEQ ID NO: 118815 - RNA, 64 nt, Human; identical to SEQ ID NO: 73820

SEQ ID NO: 118816 - RNA, 64 nt, Human; identical to SEQ ID NO: 73821

SEQ ID NO: 118817 - RNA, 64 nt, Human; identical to SEQ ID NO: 73822

SEQ ID NO: 118818 - RNA, 64 nt, Human; identical to SEQ ID NO: 73823

SEQ ID NO: 118819 - RNA, 64 nt, Human; identical to SEQ ID NO: 73824

SEQ ID NO: 118820 - RNA, 64 nt, Human; identical to SEQ ID NO: 73825

SEQ ID NO: 118821 - RNA, 64 nt, Human; identical to SEQ ID NO: 73826

SEQ ID NO: 118822 - RNA, 64 nt, Human; identical to SEQ ID NO: 73827

SEQ ID NO: 118823 - RNA, 64 nt, Human; identical to SEQ ID NO: 73828

SEQ ID NO: 118824 - RNA, 64 nt, Human; identical to SEQ ID NO: 73829

SEQ ID NO: 118825 - RNA, 64 nt, Human; identical to SEQ ID NO: 73830

SEQ ID NO: 118826 - RNA, 64 nt, Human; identical to SEQ ID NO: 73831

SEQ ID NO: 118827 - RNA, 64 nt, Human; identical to SEQ ID NO: 73832

SEQ ID NO: 118828 - RNA, 64 nt, Human; identical to SEQ ID NO: 73833

SEQ ID NO: 118829 - RNA, 64 nt, Human; identical to SEQ ID NO: 73834

SEQ ID NO: 118830 - RNA, 64 nt, Human; identical to SEQ ID NO: 73835

SEQ ID NO: 118831 - RNA, 64 nt, Human; identical to SEQ ID NO: 73836

SEQ ID NO: 118832 - RNA, 64 nt, Human; identical to SEQ ID NO: 73837

SEQ ID NO: 118833 - RNA, 64 nt, Human; identical to SEQ ID NO: 73838

SEQ ID NO: 118834 - RNA, 64 nt, Human; identical to SEQ ID NO: 73839

SEQ ID NO: 118835 - RNA, 64 nt, Human; identical to SEQ ID NO: 73840

SEQ ID NO: 118836 - RNA, 64 nt, Human; identical to SEQ ID NO: 73841

SEQ ID NO: 118837 - RNA, 64 nt, Human; identical to SEQ ID NO: 73842

SEQ ID NO: 118838 - RNA, 64 nt, Human; identical to SEQ ID NO: 73843

SEQ ID NO: 118839 - RNA, 64 nt, Human; identical to SEQ ID NO: 73844

SEQ ID NO: 118840 - RNA, 64 nt, Human; identical to SEQ ID NO: 73845

SEQ ID NO: 118841 - RNA, 64 nt, Human; identical to SEQ ID NO: 73846

SEQ ID NO: 118842 - RNA, 64 nt, Human; identical to SEQ ID NO: 73847

SEQ ID NO: 118843 - RNA, 64 nt, Human; identical to SEQ ID NO: 73848

SEQ ID NO: 118844 - RNA, 64 nt, Human; identical to SEQ ID NO: 73849

SEQ ID NO: 118845 - RNA, 64 nt, Human; identical to SEQ ID NO: 73850

SEQ ID NO: 118846 - RNA, 64 nt, Human; identical to SEQ ID NO: 73851

SEQ ID NO: 118847 - RNA, 64 nt, Human; identical to SEQ ID NO: 73852

SEQ ID NO: 118848 - RNA, 64 nt, Human; identical to SEQ ID NO: 73853

SEQ ID NO: 118849 - RNA, 64 nt, Human; identical to SEQ ID NO: 73854

SEQ ID NO: 118850 - RNA, 64 nt, Human; identical to SEQ ID NO: 73855

SEQ ID NO: 118851 - RNA, 64 nt, Human; identical to SEQ ID NO: 73856

SEQ ID NO: 118852 - RNA, 64 nt, Human; identical to SEQ ID NO: 73857

SEQ ID NO: 118853 - RNA, 64 nt, Human; identical to SEQ ID NO: 73858

SEQ ID NO: 118854 - RNA, 64 nt, Human; identical to SEQ ID NO: 73859

SEQ ID NO: 118855 - RNA, 64 nt, Human; identical to SEQ ID NO: 73860

SEQ ID NO: 118856 - RNA, 64 nt, Human; identical to SEQ ID NO: 73861

SEQ ID NO: 118857 - RNA, 64 nt, Human; identical to SEQ ID NO: 73862

SEQ ID NO: 118858 - RNA, 64 nt, Human; identical to SEQ ID NO: 73863

SEQ ID NO: 118859 - RNA, 64 nt, Human; identical to SEQ ID NO: 73864

SEQ ID NO: 118860 - RNA, 64 nt, Human; identical to SEQ ID NO: 73865

SEQ ID NO: 118861 - RNA, 64 nt, Human; identical to SEQ ID NO: 73866

SEQ ID NO: 118862 - RNA, 64 nt, Human; identical to SEQ ID NO: 73867

SEQ ID NO: 118863 - RNA, 64 nt, Human; identical to SEQ ID NO: 73868

SEQ ID NO: 118864 - RNA, 64 nt, Human; identical to SEQ ID NO: 73869

SEQ ID NO: 118865 - RNA, 64 nt, Human; identical to SEQ ID NO: 73870

SEQ ID NO: 118866 - RNA, 64 nt, Human; identical to SEQ ID NO: 73871

SEQ ID NO: 118867 - RNA, 64 nt, Human; identical to SEQ ID NO: 73872

SEQ ID NO: 118868 - RNA, 64 nt, Human; identical to SEQ ID NO: 73873

SEQ ID NO: 118869 - RNA, 64 nt, Human; identical to SEQ ID NO: 73874

SEQ ID NO: 118870 - RNA, 64 nt, Human; identical to SEQ ID NO: 73875

SEQ ID NO: 118871 - RNA, 64 nt, Human; identical to SEQ ID NO: 73876

SEQ ID NO: 118872 - RNA, 64 nt, Human; identical to SEQ ID NO: 73877

SEQ ID NO: 118873 - RNA, 64 nt, Human; identical to SEQ ID NO: 73878

SEQ ID NO: 118874 - RNA, 64 nt, Human; identical to SEQ ID NO: 73879

SEQ ID NO: 118875 - RNA, 64 nt, Human; identical to SEQ ID NO: 73880

SEQ ID NO: 118876 - RNA, 64 nt, Human; identical to SEQ ID NO: 73881

SEQ ID NO: 118877 - RNA, 64 nt, Human; identical to SEQ ID NO: 73882

SEQ ID NO: 118878 - RNA, 64 nt, Human; identical to SEQ ID NO: 73883

SEQ ID NO: 118879 - RNA, 64 nt, Human; identical to SEQ ID NO: 73884

SEQ ID NO: 118880 - RNA, 64 nt, Human; identical to SEQ ID NO: 73885

SEQ ID NO: 118881 - RNA, 64 nt, Human; identical to SEQ ID NO: 73886

SEQ ID NO: 118882 - RNA, 64 nt, Human; identical to SEQ ID NO: 73887

SEQ ID NO: 118883 - RNA, 64 nt, Human; identical to SEQ ID NO: 73888

SEQ ID NO: 118884 - RNA, 64 nt, Human; identical to SEQ ID NO: 73889

SEQ ID NO: 118885 - RNA, 64 nt, Human; identical to SEQ ID NO: 73890

SEQ ID NO: 118886 - RNA, 64 nt, Human; identical to SEQ ID NO: 73891

SEQ ID NO: 118887 - RNA, 52 nt, Human; identical to SEQ ID NO: 73892

SEQ ID NO: 118888 - RNA, 64 nt, Human; identical to SEQ ID NO: 73893

SEQ ID NO: 118889 - RNA, 64 nt, Human; identical to SEQ ID NO: 73894

SEQ ID NO: 118890 - RNA, 64 nt, Human; identical to SEQ ID NO: 73895

SEQ ID NO: 118891 - RNA, 64 nt, Human; identical to SEQ ID NO: 73896

SEQ ID NO: 118892 - RNA, 64 nt, Human; identical to SEQ ID NO: 73897

SEQ ID NO: 118893 - RNA, 54 nt, Human; identical to SEQ ID NO: 73898

SEQ ID NO: 118894 - RNA, 64 nt, Human; identical to SEQ ID NO: 73899

SEQ ID NO: 118895 - RNA, 64 nt, Human; identical to SEQ ID NO: 73900

SEQ ID NO: 118896 - RNA, 64 nt, Human; identical to SEQ ID NO: 73901

SEQ ID NO: 118897 - RNA, 64 nt, Human; identical to SEQ ID NO: 73902

SEQ ID NO: 118898 - RNA, 64 nt, Human; identical to SEQ ID NO: 73903

SEQ ID NO: 118899 - RNA, 64 nt, Human; identical to SEQ ID NO: 73904

SEQ ID NO: 118900 - RNA, 64 nt, Human; identical to SEQ ID NO: 73905

SEQ ID NO: 118901 - RNA, 64 nt, Human; identical to SEQ ID NO: 73906

SEQ ID NO: 118902 - RNA, 64 nt, Human; identical to SEQ ID NO: 73907

SEQ ID NO: 118903 - RNA, 64 nt, Human; identical to SEQ ID NO: 73908

SEQ ID NO: 118904 - RNA, 64 nt, Human; identical to SEQ ID NO: 73909

SEQ ID NO: 118905 - RNA, 63 nt, Human; identical to SEQ ID NO: 73910

SEQ ID NO: 118906 - RNA, 64 nt, Human; identical to SEQ ID NO: 73911

SEQ ID NO: 118907 - RNA, 64 nt, Human; identical to SEQ ID NO: 73912

SEQ ID NO: 118908 - RNA, 64 nt, Human; identical to SEQ ID NO: 73913

SEQ ID NO: 118909 - RNA, 64 nt, Human; identical to SEQ ID NO: 73914

SEQ ID NO: 118910 - RNA, 64 nt, Human; identical to SEQ ID NO: 73915

SEQ ID NO: 118911 - RNA, 64 nt, Human; identical to SEQ ID NO: 73916

SEQ ID NO: 118912 - RNA, 64 nt, Human; identical to SEQ ID NO: 73917

SEQ ID NO: 118913 - RNA, 64 nt, Human; identical to SEQ ID NO: 73918

SEQ ID NO: 118914 - RNA, 64 nt, Human; identical to SEQ ID NO: 73919

SEQ ID NO: 118915 - RNA, 64 nt, Human; identical to SEQ ID NO: 73920

SEQ ID NO: 118916 - RNA, 64 nt, Human; identical to SEQ ID NO: 73921

SEQ ID NO: 118917 - RNA, 64 nt, Human; identical to SEQ ID NO: 73922

SEQ ID NO: 118918 - RNA, 64 nt, Human; identical to SEQ ID NO: 73923

SEQ ID NO: 118919 - RNA, 64 nt, Human; identical to SEQ ID NO: 73924

SEQ ID NO: 118920 - RNA, 64 nt, Human; identical to SEQ ID NO: 73925

SEQ ID NO: 118921 - RNA, 64 nt, Human; identical to SEQ ID NO: 73926

SEQ ID NO: 118922 - RNA, 64 nt, Human; identical to SEQ ID NO: 73927

SEQ ID NO: 118923 - RNA, 64 nt, Human; identical to SEQ ID NO: 73928

SEQ ID NO: 118924 - RNA, 64 nt, Human; identical to SEQ ID NO: 73929

SEQ ID NO: 118925 - RNA, 64 nt, Human; identical to SEQ ID NO: 73930

SEQ ID NO: 118926 - RNA, 64 nt, Human; identical to SEQ ID NO: 73931

SEQ ID NO: 118927 - RNA, 64 nt, Human; identical to SEQ ID NO: 73932

SEQ ID NO: 118928 - RNA, 64 nt, Human; identical to SEQ ID NO: 73933

SEQ ID NO: 118929 - RNA, 64 nt, Human; identical to SEQ ID NO: 73934

SEQ ID NO: 118930 - RNA, 64 nt, Human; identical to SEQ ID NO: 73935

SEQ ID NO: 118931 - RNA, 64 nt, Human; identical to SEQ ID NO: 73936

SEQ ID NO: 118932 - RNA, 64 nt, Human; identical to SEQ ID NO: 73937

SEQ ID NO: 118933 - RNA, 64 nt, Human; identical to SEQ ID NO: 73938

SEQ ID NO: 118934 - RNA, 64 nt, Human; identical to SEQ ID NO: 73939

SEQ ID NO: 118935 - RNA, 64 nt, Human; identical to SEQ ID NO: 73940

SEQ ID NO: 118936 - RNA, 64 nt, Human; identical to SEQ ID NO: 73941

SEQ ID NO: 118937 - RNA, 64 nt, Human; identical to SEQ ID NO: 73942

SEQ ID NO: 118938 - RNA, 64 nt, Human; identical to SEQ ID NO: 73943

SEQ ID NO: 118939 - RNA, 64 nt, Human; identical to SEQ ID NO: 73944

SEQ ID NO: 118940 - RNA, 64 nt, Human; identical to SEQ ID NO: 73945

SEQ ID NO: 118941 - RNA, 58 nt, Human; identical to SEQ ID NO: 73946

SEQ ID NO: 118942 - RNA, 64 nt, Human; identical to SEQ ID NO: 73947

SEQ ID NO: 118943 - RNA, 64 nt, Human; identical to SEQ ID NO: 73948

SEQ ID NO: 118944 - RNA, 64 nt, Human; identical to SEQ ID NO: 73949

SEQ ID NO: 118945 - RNA, 64 nt, Human; identical to SEQ ID NO: 73950

SEQ ID NO: 118946 - RNA, 64 nt, Human; identical to SEQ ID NO: 73951

SEQ ID NO: 118947 - RNA, 64 nt, Human; identical to SEQ ID NO: 73952

SEQ ID NO: 118948 - RNA, 64 nt, Human; identical to SEQ ID NO: 73953

SEQ ID NO: 118949 - RNA, 64 nt, Human; identical to SEQ ID NO: 73954

SEQ ID NO: 118950 - RNA, 64 nt, Human; identical to SEQ ID NO: 73955

SEQ ID NO: 118951 - RNA, 64 nt, Human; identical to SEQ ID NO: 73956

SEQ ID NO: 118952 - RNA, 64 nt, Human; identical to SEQ ID NO: 73957

SEQ ID NO: 118953 - RNA, 64 nt, Human; identical to SEQ ID NO: 73958

SEQ ID NO: 118954 - RNA, 64 nt, Human; identical to SEQ ID NO: 73959

SEQ ID NO: 118955 - RNA, 64 nt, Human; identical to SEQ ID NO: 73960

SEQ ID NO: 118956 - RNA, 64 nt, Human; identical to SEQ ID NO: 73961

SEQ ID NO: 118957 - RNA, 64 nt, Human; identical to SEQ ID NO: 73962

SEQ ID NO: 118958 - RNA, 64 nt, Human; identical to SEQ ID NO: 73963

SEQ ID NO: 118959 - RNA, 64 nt, Human; identical to SEQ ID NO: 73964

SEQ ID NO: 118960 - RNA, 64 nt, Human; identical to SEQ ID NO: 73965

SEQ ID NO: 118961 - RNA, 64 nt, Human; identical to SEQ ID NO: 73966

SEQ ID NO: 118962 - RNA, 64 nt, Human; identical to SEQ ID NO: 73967

SEQ ID NO: 118963 - RNA, 58 nt, Human; identical to SEQ ID NO: 73946

SEQ ID NO: 118964 - RNA, 64 nt, Human; identical to SEQ ID NO: 73969

SEQ ID NO: 118965 - RNA, 64 nt, Human; identical to SEQ ID NO: 73970

SEQ ID NO: 118966 - RNA, 64 nt, Human; identical to SEQ ID NO: 73971

SEQ ID NO: 118967 - RNA, 64 nt, Human; identical to SEQ ID NO: 73972

SEQ ID NO: 118968 - RNA, 64 nt, Human; identical to SEQ ID NO: 73973

SEQ ID NO: 118969 - RNA, 64 nt, Human; identical to SEQ ID NO: 73974

SEQ ID NO: 118970 - RNA, 64 nt, Human; identical to SEQ ID NO: 73975

SEQ ID NO: 118971 - RNA, 64 nt, Human; identical to SEQ ID NO: 73976

SEQ ID NO: 118972 - RNA, 64 nt, Human; identical to SEQ ID NO: 73977

SEQ ID NO: 118973 - RNA, 64 nt, Human; identical to SEQ ID NO: 73978

SEQ ID NO: 118974 - RNA, 64 nt, Human; identical to SEQ ID NO: 73979

SEQ ID NO: 118975 - RNA, 64 nt, Human; identical to SEQ ID NO: 73980

SEQ ID NO: 118976 - RNA, 64 nt, Human; identical to SEQ ID NO: 73981

SEQ ID NO: 118977 - RNA, 64 nt, Human; identical to SEQ ID NO: 73982

SEQ ID NO: 118978 - RNA, 64 nt, Human; identical to SEQ ID NO: 73983

SEQ ID NO: 118979 - RNA, 64 nt, Human; identical to SEQ ID NO: 73984

SEQ ID NO: 118980 - RNA, 64 nt, Human; identical to SEQ ID NO: 73985

SEQ ID NO: 118981 - RNA, 64 nt, Human; identical to SEQ ID NO: 73986

SEQ ID NO: 118982 - RNA, 64 nt, Human; identical to SEQ ID NO: 73987

SEQ ID NO: 118983 - RNA, 64 nt, Human; identical to SEQ ID NO: 73988

SEQ ID NO: 118984 - RNA, 64 nt, Human; identical to SEQ ID NO: 73989

SEQ ID NO: 118985 - RNA, 64 nt, Human; identical to SEQ ID NO: 73990

SEQ ID NO: 118986 - RNA, 64 nt, Human; identical to SEQ ID NO: 73991

SEQ ID NO: 118987 - RNA, 64 nt, Human; identical to SEQ ID NO: 73992

SEQ ID NO: 118988 - RNA, 64 nt, Human; identical to SEQ ID NO: 73993

SEQ ID NO: 118989 - RNA, 64 nt, Human; identical to SEQ ID NO: 73994

SEQ ID NO: 118990 - RNA, 64 nt, Human; identical to SEQ ID NO: 73995

SEQ ID NO: 118991 - RNA, 64 nt, Human; identical to SEQ ID NO: 73996

SEQ ID NO: 118992 - RNA, 64 nt, Human; identical to SEQ ID NO: 73997

SEQ ID NO: 118993 - RNA, 64 nt, Human; identical to SEQ ID NO: 73998

SEQ ID NO: 118994 - RNA, 64 nt, Human; identical to SEQ ID NO: 73999

SEQ ID NO: 118995 - RNA, 64 nt, Human; identical to SEQ ID NO: 74000

SEQ ID NO: 118996 - RNA, 64 nt, Human; identical to SEQ ID NO: 74001

SEQ ID NO: 118997 - RNA, 64 nt, Human; identical to SEQ ID NO: 74002

SEQ ID NO: 118998 - RNA, 64 nt, Human; identical to SEQ ID NO: 74003

SEQ ID NO: 118999 - RNA, 64 nt, Human; identical to SEQ ID NO: 74004

SEQ ID NO: 119000 - RNA, 64 nt, Human; identical to SEQ ID NO: 74005

SEQ ID NO: 119001 - RNA, 64 nt, Human; identical to SEQ ID NO: 74006

SEQ ID NO: 119002 - RNA, 64 nt, Human; identical to SEQ ID NO: 74007

SEQ ID NO: 119003 - RNA, 64 nt, Human; identical to SEQ ID NO: 74008

SEQ ID NO: 119004 - RNA, 64 nt, Human; identical to SEQ ID NO: 74009

SEQ ID NO: 119005 - RNA, 64 nt, Human; identical to SEQ ID NO: 74010

SEQ ID NO: 119006 - RNA, 64 nt, Human; identical to SEQ ID NO: 74011

SEQ ID NO: 119007 - RNA, 64 nt, Human; identical to SEQ ID NO: 74012

SEQ ID NO: 119008 - RNA, 64 nt, Human; identical to SEQ ID NO: 74013

SEQ ID NO: 119009 - RNA, 64 nt, Human; identical to SEQ ID NO: 74014

SEQ ID NO: 119010 - RNA, 64 nt, Human; identical to SEQ ID NO: 74015

SEQ ID NO: 119011 - RNA, 64 nt, Human; identical to SEQ ID NO: 74016

SEQ ID NO: 119012 - RNA, 64 nt, Human; identical to SEQ ID NO: 74017

SEQ ID NO: 119013 - RNA, 64 nt, Human; identical to SEQ ID NO: 74018

SEQ ID NO: 119014 - RNA, 64 nt, Human; identical to SEQ ID NO: 74019

SEQ ID NO: 119015 - RNA, 64 nt, Human; identical to SEQ ID NO: 74020

SEQ ID NO: 119016 - RNA, 64 nt, Human; identical to SEQ ID NO: 74021

SEQ ID NO: 119017 - RNA, 64 nt, Human; identical to SEQ ID NO: 74022

SEQ ID NO: 119018 - RNA, 64 nt, Human; identical to SEQ ID NO: 74023

SEQ ID NO: 119019 - RNA, 64 nt, Human; identical to SEQ ID NO: 74024

SEQ ID NO: 119020 - RNA, 64 nt, Human; identical to SEQ ID NO: 74025

SEQ ID NO: 119021 - RNA, 64 nt, Human; identical to SEQ ID NO: 74026

SEQ ID NO: 119022 - RNA, 64 nt, Human; identical to SEQ ID NO: 74027

SEQ ID NO: 119023 - RNA, 64 nt, Human; identical to SEQ ID NO: 74028

SEQ ID NO: 119024 - RNA, 64 nt, Human; identical to SEQ ID NO: 74029

SEQ ID NO: 119025 - RNA, 64 nt, Human; identical to SEQ ID NO: 74030

SEQ ID NO: 119026 - RNA, 64 nt, Human; identical to SEQ ID NO: 74031

SEQ ID NO: 119027 - RNA, 64 nt, Human; identical to SEQ ID NO: 74032

SEQ ID NO: 119028 - RNA, 64 nt, Human; identical to SEQ ID NO: 74033

SEQ ID NO: 119029 - RNA, 64 nt, Human; identical to SEQ ID NO: 74034

SEQ ID NO: 119030 - RNA, 64 nt, Human; identical to SEQ ID NO: 74035

SEQ ID NO: 119031 - RNA, 64 nt, Human; identical to SEQ ID NO: 74036

SEQ ID NO: 119032 - RNA, 64 nt, Human; identical to SEQ ID NO: 74037

SEQ ID NO: 119033 - RNA, 64 nt, Human; identical to SEQ ID NO: 74038

SEQ ID NO: 119034 - RNA, 64 nt, Human; identical to SEQ ID NO: 74039

SEQ ID NO: 119035 - RNA, 64 nt, Human; identical to SEQ ID NO: 74040

SEQ ID NO: 119036 - RNA, 64 nt, Human; identical to SEQ ID NO: 74041

SEQ ID NO: 119037 - RNA, 64 nt, Human; identical to SEQ ID NO: 74042

SEQ ID NO: 119038 - RNA, 64 nt, Human; identical to SEQ ID NO: 74043

SEQ ID NO: 119039 - RNA, 64 nt, Human; identical to SEQ ID NO: 74044

SEQ ID NO: 119040 - RNA, 64 nt, Human; identical to SEQ ID NO: 74045

SEQ ID NO: 119041 - RNA, 64 nt, Human; identical to SEQ ID NO: 74046

SEQ ID NO: 119042 - RNA, 64 nt, Human; identical to SEQ ID NO: 74047

SEQ ID NO: 119043 - RNA, 64 nt, Human; identical to SEQ ID NO: 74048

SEQ ID NO: 119044 - RNA, 64 nt, Human; identical to SEQ ID NO: 74049

SEQ ID NO: 119045 - RNA, 64 nt, Human; identical to SEQ ID NO: 74050

SEQ ID NO: 119046 - RNA, 64 nt, Human; identical to SEQ ID NO: 74051

SEQ ID NO: 119047 - RNA, 64 nt, Human; identical to SEQ ID NO: 74052

SEQ ID NO: 119048 - RNA, 64 nt, Human; identical to SEQ ID NO: 74053

SEQ ID NO: 119049 - RNA, 64 nt, Human; identical to SEQ ID NO: 74054

SEQ ID NO: 119050 - RNA, 64 nt, Human; identical to SEQ ID NO: 74055

SEQ ID NO: 119051 - RNA, 64 nt, Human; identical to SEQ ID NO: 74056

SEQ ID NO: 119052 - RNA, 64 nt, Human; identical to SEQ ID NO: 74057

SEQ ID NO: 119053 - RNA, 64 nt, Human; identical to SEQ ID NO: 74058

SEQ ID NO: 119054 - RNA, 64 nt, Human; identical to SEQ ID NO: 74059

SEQ ID NO: 119055 - RNA, 64 nt, Human; identical to SEQ ID NO: 74060

SEQ ID NO: 119056 - RNA, 64 nt, Human; identical to SEQ ID NO: 74061

SEQ ID NO: 119057 - RNA, 64 nt, Human; identical to SEQ ID NO: 74062

SEQ ID NO: 119058 - RNA, 64 nt, Human; identical to SEQ ID NO: 74063

SEQ ID NO: 119059 - RNA, 64 nt, Human; identical to SEQ ID NO: 74064

SEQ ID NO: 119060 - RNA, 64 nt, Human; identical to SEQ ID NO: 74065

SEQ ID NO: 119061 - RNA, 64 nt, Human; identical to SEQ ID NO: 74066

SEQ ID NO: 119062 - RNA, 64 nt, Human; identical to SEQ ID NO: 74067

SEQ ID NO: 119063 - RNA, 64 nt, Human; identical to SEQ ID NO: 74068

SEQ ID NO: 119064 - RNA, 64 nt, Human; identical to SEQ ID NO: 74069

SEQ ID NO: 119065 - RNA, 64 nt, Human; identical to SEQ ID NO: 74070

SEQ ID NO: 119066 - RNA, 64 nt, Human; identical to SEQ ID NO: 74071

SEQ ID NO: 119067 - RNA, 64 nt, Human; identical to SEQ ID NO: 74072

SEQ ID NO: 119068 - RNA, 64 nt, Human; identical to SEQ ID NO: 74073

SEQ ID NO: 119069 - RNA, 64 nt, Human; identical to SEQ ID NO: 74074

SEQ ID NO: 119070 - RNA, 64 nt, Human; identical to SEQ ID NO: 74075

SEQ ID NO: 119071 - RNA, 64 nt, Human; identical to SEQ ID NO: 74076

SEQ ID NO: 119072 - RNA, 64 nt, Human; identical to SEQ ID NO: 74077

SEQ ID NO: 119073 - RNA, 64 nt, Human; identical to SEQ ID NO: 74078

SEQ ID NO: 119074 - RNA, 64 nt, Human; identical to SEQ ID NO: 74079

SEQ ID NO: 119075 - RNA, 64 nt, Human; identical to SEQ ID NO: 74080

SEQ ID NO: 119076 - RNA, 64 nt, Human; identical to SEQ ID NO: 74081

SEQ ID NO: 119077 - RNA, 64 nt, Human; identical to SEQ ID NO: 74082

SEQ ID NO: 119078 - RNA, 64 nt, Human; identical to SEQ ID NO: 74083

SEQ ID NO: 119079 - RNA, 64 nt, Human; identical to SEQ ID NO: 74084

SEQ ID NO: 119080 - RNA, 64 nt, Human; identical to SEQ ID NO: 74085

SEQ ID NO: 119081 - RNA, 64 nt, Human; identical to SEQ ID NO: 74086

SEQ ID NO: 119082 - RNA, 64 nt, Human; identical to SEQ ID NO: 74087

SEQ ID NO: 119083 - RNA, 64 nt, Human; identical to SEQ ID NO: 74088

SEQ ID NO: 119084 - RNA, 64 nt, Human; identical to SEQ ID NO: 74089

SEQ ID NO: 119085 - RNA, 64 nt, Human; identical to SEQ ID NO: 74090

SEQ ID NO: 119086 - RNA, 64 nt, Human; identical to SEQ ID NO: 74091

SEQ ID NO: 119087 - RNA, 64 nt, Human; identical to SEQ ID NO: 74092

SEQ ID NO: 119088 - RNA, 64 nt, Human; identical to SEQ ID NO: 74093

SEQ ID NO: 119089 - RNA, 64 nt, Human; identical to SEQ ID NO: 74094

SEQ ID NO: 119090 - RNA, 64 nt, Human; identical to SEQ ID NO: 74095

SEQ ID NO: 119091 - RNA, 64 nt, Human; identical to SEQ ID NO: 74096

SEQ ID NO: 119092 - RNA, 64 nt, Human; identical to SEQ ID NO: 74097

SEQ ID NO: 119093 - RNA, 64 nt, Human; identical to SEQ ID NO: 74098

SEQ ID NO: 119094 - RNA, 64 nt, Human; identical to SEQ ID NO: 74099

SEQ ID NO: 119095 - RNA, 64 nt, Human; identical to SEQ ID NO: 74100

SEQ ID NO: 119096 - RNA, 64 nt, Human; identical to SEQ ID NO: 74101

SEQ ID NO: 119097 - RNA, 64 nt, Human; identical to SEQ ID NO: 74102

SEQ ID NO: 119098 - RNA, 64 nt, Human; identical to SEQ ID NO: 74103

SEQ ID NO: 119099 - RNA, 64 nt, Human; identical to SEQ ID NO: 74104

SEQ ID NO: 119100 - RNA, 64 nt, Human; identical to SEQ ID NO: 74105

SEQ ID NO: 119101 - RNA, 64 nt, Human; identical to SEQ ID NO: 74106

SEQ ID NO: 119102 - RNA, 64 nt, Human; identical to SEQ ID NO: 74107

SEQ ID NO: 119103 - RNA, 64 nt, Human; identical to SEQ ID NO: 74108

SEQ ID NO: 119104 - RNA, 64 nt, Human; identical to SEQ ID NO: 74109

SEQ ID NO: 119105 - RNA, 64 nt, Human; identical to SEQ ID NO: 74110

SEQ ID NO: 119106 - RNA, 64 nt, Human; identical to SEQ ID NO: 74111

SEQ ID NO: 119107 - RNA, 64 nt, Human; identical to SEQ ID NO: 74112

SEQ ID NO: 119108 - RNA, 64 nt, Human; identical to SEQ ID NO: 74113

SEQ ID NO: 119109 - RNA, 64 nt, Human; identical to SEQ ID NO: 74114

SEQ ID NO: 119110 - RNA, 64 nt, Human; identical to SEQ ID NO: 74115

SEQ ID NO: 119111 - RNA, 64 nt, Human; identical to SEQ ID NO: 74116

SEQ ID NO: 119112 - RNA, 64 nt, Human; identical to SEQ ID NO: 74117

SEQ ID NO: 119113 - RNA, 64 nt, Human; identical to SEQ ID NO: 74118

SEQ ID NO: 119114 - RNA, 64 nt, Human; identical to SEQ ID NO: 74119

SEQ ID NO: 119115 - RNA, 64 nt, Human; identical to SEQ ID NO: 74120

SEQ ID NO: 119116 - RNA, 64 nt, Human; identical to SEQ ID NO: 74121

SEQ ID NO: 119117 - RNA, 64 nt, Human; identical to SEQ ID NO: 74122

SEQ ID NO: 119118 - RNA, 64 nt, Human; identical to SEQ ID NO: 74123

SEQ ID NO: 119119 - RNA, 64 nt, Human; identical to SEQ ID NO: 74124

SEQ ID NO: 119120 - RNA, 64 nt, Human; identical to SEQ ID NO: 74125

SEQ ID NO: 119121 - RNA, 59 nt, Human; identical to SEQ ID NO: 106365

SEQ ID NO: 119122 - RNA, 59 nt, Human; identical to SEQ ID NO: 106366

SEQ ID NO: 119123 - RNA, 59 nt, Human; identical to SEQ ID NO: 106367

SEQ ID NO: 119124 - RNA, 59 nt, Human; identical to SEQ ID NO: 106368

SEQ ID NO: 119125 - RNA, 59 nt, Human; identical to SEQ ID NO: 106369

SEQ ID NO: 119126 - RNA, 59 nt, Human; identical to SEQ ID NO: 106370

SEQ ID NO: 119127 - RNA, 59 nt, Human; identical to SEQ ID NO: 106371

SEQ ID NO: 119128 - RNA, 59 nt, Human; identical to SEQ ID NO: 106372

SEQ ID NO: 119129 - RNA, 59 nt, Human; identical to SEQ ID NO: 106373

SEQ ID NO: 119130 - RNA, 59 nt, Human; identical to SEQ ID NO: 106374

SEQ ID NO: 119131 - RNA, 59 nt, Human; identical to SEQ ID NO: 106375

SEQ ID NO: 119132 - RNA, 59 nt, Human; identical to SEQ ID NO: 106376

SEQ ID NO: 119133 - RNA, 59 nt, Human; identical to SEQ ID NO: 106377

SEQ ID NO: 119134 - RNA, 59 nt, Human; identical to SEQ ID NO: 106378

SEQ ID NO: 119135 - RNA, 59 nt, Human; identical to SEQ ID NO: 106379

SEQ ID NO: 119136 - RNA, 59 nt, Human; identical to SEQ ID NO: 106380

SEQ ID NO: 119137 - RNA, 59 nt, Human; identical to SEQ ID NO: 106381

SEQ ID NO: 119138 - RNA, 59 nt, Human; identical to SEQ ID NO: 106382

SEQ ID NO: 119139 - RNA, 59 nt, Human; identical to SEQ ID NO: 106383

SEQ ID NO: 119140 - RNA, 59 nt, Human; identical to SEQ ID NO: 106384

SEQ ID NO: 119141 - RNA, 59 nt, Human; identical to SEQ ID NO: 106385

SEQ ID NO: 119142 - RNA, 59 nt, Human; identical to SEQ ID NO: 106386

SEQ ID NO: 119143 - RNA, 59 nt, Human; identical to SEQ ID NO: 106387

SEQ ID NO: 119144 - RNA, 59 nt, Human; identical to SEQ ID NO: 106388

SEQ ID NO: 119145 - RNA, 59 nt, Human; identical to SEQ ID NO: 106389

SEQ ID NO: 119146 - RNA, 59 nt, Human; identical to SEQ ID NO: 106390

SEQ ID NO: 119147 - RNA, 51 nt, Human; identical to SEQ ID NO: 106391

SEQ ID NO: 119148 - RNA, 59 nt, Human; identical to SEQ ID NO: 106392

SEQ ID NO: 119149 - RNA, 59 nt, Human; identical to SEQ ID NO: 106393

SEQ ID NO: 119150 - RNA, 59 nt, Human; identical to SEQ ID NO: 106394

SEQ ID NO: 119151 - RNA, 59 nt, Human; identical to SEQ ID NO: 106395

SEQ ID NO: 119152 - RNA, 59 nt, Human; identical to SEQ ID NO: 106396

SEQ ID NO: 119153 - RNA, 59 nt, Human; identical to SEQ ID NO: 106397

SEQ ID NO: 119154 - RNA, 59 nt, Human; identical to SEQ ID NO: 106398

SEQ ID NO: 119155 - RNA, 59 nt, Human; identical to SEQ ID NO: 106399

SEQ ID NO: 119156 - RNA, 59 nt, Human; identical to SEQ ID NO: 106400

SEQ ID NO: 119157 - RNA, 59 nt, Human; identical to SEQ ID NO: 106401

SEQ ID NO: 119158 - RNA, 59 nt, Human; identical to SEQ ID NO: 106402

SEQ ID NO: 119159 - RNA, 59 nt, Human; identical to SEQ ID NO: 106403

SEQ ID NO: 119160 - RNA, 59 nt, Human; identical to SEQ ID NO: 106404

SEQ ID NO: 119161 - RNA, 59 nt, Human; identical to SEQ ID NO: 106405

SEQ ID NO: 119162 - RNA, 59 nt, Human; identical to SEQ ID NO: 106406

SEQ ID NO: 119163 - RNA, 59 nt, Human; identical to SEQ ID NO: 106407

SEQ ID NO: 119164 - RNA, 59 nt, Human; identical to SEQ ID NO: 106408

SEQ ID NO: 119165 - RNA, 59 nt, Human; identical to SEQ ID NO: 106409

SEQ ID NO: 119166 - RNA, 58 nt, Human; identical to SEQ ID NO: 106410

SEQ ID NO: 119167 - RNA, 59 nt, Human; identical to SEQ ID NO: 106411

SEQ ID NO: 119168 - RNA, 59 nt, Human; identical to SEQ ID NO: 106412

SEQ ID NO: 119169 - RNA, 59 nt, Human; identical to SEQ ID NO: 106413

SEQ ID NO: 119170 - RNA, 59 nt, Human; identical to SEQ ID NO: 106414

SEQ ID NO: 119171 - RNA, 55 nt, Human; identical to SEQ ID NO: 106415

SEQ ID NO: 119172 - RNA, 59 nt, Human; identical to SEQ ID NO: 106416

SEQ ID NO: 119173 - RNA, 59 nt, Human; identical to SEQ ID NO: 106417

SEQ ID NO: 119174 - RNA, 59 nt, Human; identical to SEQ ID NO: 106418

SEQ ID NO: 119175 - RNA, 59 nt, Human; identical to SEQ ID NO: 106419

SEQ ID NO: 119176 - RNA, 59 nt, Human; identical to SEQ ID NO: 106420

SEQ ID NO: 119177 - RNA, 59 nt, Human; identical to SEQ ID NO: 106421

SEQ ID NO: 119178 - RNA, 59 nt, Human; identical to SEQ ID NO: 106422

SEQ ID NO: 119179 - RNA, 59 nt, Human; identical to SEQ ID NO: 106423

SEQ ID NO: 119180 - RNA, 59 nt, Human; identical to SEQ ID NO: 106424

SEQ ID NO: 119181 - RNA, 59 nt, Human; identical to SEQ ID NO: 106425

SEQ ID NO: 119182 - RNA, 59 nt, Human; identical to SEQ ID NO: 106426

SEQ ID NO: 119183 - RNA, 59 nt, Human; identical to SEQ ID NO: 106427

SEQ ID NO: 119184 - RNA, 59 nt, Human; identical to SEQ ID NO: 106428

SEQ ID NO: 119185 - RNA, 59 nt, Human; identical to SEQ ID NO: 106429

SEQ ID NO: 119186 - RNA, 59 nt, Human; identical to SEQ ID NO: 106430

SEQ ID NO: 119187 - RNA, 59 nt, Human; identical to SEQ ID NO: 106431

SEQ ID NO: 119188 - RNA, 59 nt, Human; identical to SEQ ID NO: 106432

SEQ ID NO: 119189 - RNA, 59 nt, Human; identical to SEQ ID NO: 106433

SEQ ID NO: 119190 - RNA, 59 nt, Human; identical to SEQ ID NO: 106434

SEQ ID NO: 119191 - RNA, 59 nt, Human; identical to SEQ ID NO: 106435

SEQ ID NO: 119192 - RNA, 59 nt, Human; identical to SEQ ID NO: 106436

SEQ ID NO: 119193 - RNA, 59 nt, Human; identical to SEQ ID NO: 106437

SEQ ID NO: 119194 - RNA, 59 nt, Human; identical to SEQ ID NO: 106438

SEQ ID NO: 119195 - RNA, 59 nt, Human; identical to SEQ ID NO: 106439

SEQ ID NO: 119196 - RNA, 59 nt, Human; identical to SEQ ID NO: 106440

SEQ ID NO: 119197 - RNA, 59 nt, Human; identical to SEQ ID NO: 106441

SEQ ID NO: 119198 - RNA, 59 nt, Human; identical to SEQ ID NO: 106442

SEQ ID NO: 119199 - RNA, 59 nt, Human; identical to SEQ ID NO: 106443

SEQ ID NO: 119200 - RNA, 59 nt, Human; identical to SEQ ID NO: 106444

SEQ ID NO: 119201 - RNA, 59 nt, Human; identical to SEQ ID NO: 106445

SEQ ID NO: 119202 - RNA, 59 nt, Human; identical to SEQ ID NO: 106446

SEQ ID NO: 119203 - RNA, 59 nt, Human; identical to SEQ ID NO: 106447

SEQ ID NO: 119204 - RNA, 59 nt, Human; identical to SEQ ID NO: 106448

SEQ ID NO: 119205 - RNA, 59 nt, Human; identical to SEQ ID NO: 106449

SEQ ID NO: 119206 - RNA, 59 nt, Human; identical to SEQ ID NO: 106450

SEQ ID NO: 119207 - RNA, 59 nt, Human; identical to SEQ ID NO: 106451

SEQ ID NO: 119208 - RNA, 59 nt, Human; identical to SEQ ID NO: 106452

SEQ ID NO: 119209 - RNA, 59 nt, Human; identical to SEQ ID NO: 106453

SEQ ID NO: 119210 - RNA, 59 nt, Human; identical to SEQ ID NO: 106454

SEQ ID NO: 119211 - RNA, 59 nt, Human; identical to SEQ ID NO: 106455

SEQ ID NO: 119212 - RNA, 59 nt, Human; identical to SEQ ID NO: 106456

SEQ ID NO: 119213 - RNA, 59 nt, Human; identical to SEQ ID NO: 106457

SEQ ID NO: 119214 - RNA, 59 nt, Human; identical to SEQ ID NO: 106458

SEQ ID NO: 119215 - RNA, 59 nt, Human; identical to SEQ ID NO: 106459

SEQ ID NO: 119216 - RNA, 59 nt, Human; identical to SEQ ID NO: 106460

SEQ ID NO: 119217 - RNA, 59 nt, Human; identical to SEQ ID NO: 106461

SEQ ID NO: 119218 - RNA, 59 nt, Human; identical to SEQ ID NO: 106462

SEQ ID NO: 119219 - RNA, 59 nt, Human; identical to SEQ ID NO: 106463

SEQ ID NO: 119220 - RNA, 59 nt, Human; identical to SEQ ID NO: 106464

SEQ ID NO: 119221 - RNA, 59 nt, Human; identical to SEQ ID NO: 106465

SEQ ID NO: 119222 - RNA, 59 nt, Human; identical to SEQ ID NO: 106466

SEQ ID NO: 119223 - RNA, 59 nt, Human; identical to SEQ ID NO: 106467

SEQ ID NO: 119224 - RNA, 59 nt, Human; identical to SEQ ID NO: 106468

SEQ ID NO: 119225 - RNA, 59 nt, Human; identical to SEQ ID NO: 106467

SEQ ID NO: 119226 - RNA, 59 nt, Human; identical to SEQ ID NO: 106470

SEQ ID NO: 119227 - RNA, 59 nt, Human; identical to SEQ ID NO: 106471

SEQ ID NO: 119228 - RNA, 59 nt, Human; identical to SEQ ID NO: 106472

SEQ ID NO: 119229 - RNA, 59 nt, Human; identical to SEQ ID NO: 106473

SEQ ID NO: 119230 - RNA, 59 nt, Human; identical to SEQ ID NO: 106474

SEQ ID NO: 119231 - RNA, 59 nt, Human; identical to SEQ ID NO: 106475

SEQ ID NO: 119232 - RNA, 59 nt, Human; identical to SEQ ID NO: 106476

SEQ ID NO: 119233 - RNA, 59 nt, Human; identical to SEQ ID NO: 106477

SEQ ID NO: 119234 - RNA, 59 nt, Human; identical to SEQ ID NO: 106478

SEQ ID NO: 119235 - RNA, 59 nt, Human; identical to SEQ ID NO: 106479

SEQ ID NO: 119236 - RNA, 59 nt, Human; identical to SEQ ID NO: 106480

SEQ ID NO: 119237 - RNA, 59 nt, Human; identical to SEQ ID NO: 106481

SEQ ID NO: 119238 - RNA, 59 nt, Human; identical to SEQ ID NO: 106482

SEQ ID NO: 119239 - RNA, 59 nt, Human; identical to SEQ ID NO: 106483

SEQ ID NO: 119240 - RNA, 59 nt, Human; identical to SEQ ID NO: 106484

SEQ ID NO: 119241 - RNA, 59 nt, Human; identical to SEQ ID NO: 106485

SEQ ID NO: 119242 - RNA, 59 nt, Human; identical to SEQ ID NO: 106486

SEQ ID NO: 119243 - RNA, 59 nt, Human; identical to SEQ ID NO: 106487

SEQ ID NO: 119244 - RNA, 59 nt, Human; identical to SEQ ID NO: 106488

SEQ ID NO: 119245 - RNA, 59 nt, Human; identical to SEQ ID NO: 106489

SEQ ID NO: 119246 - RNA, 59 nt, Human; identical to SEQ ID NO: 106490

SEQ ID NO: 119247 - RNA, 59 nt, Human; identical to SEQ ID NO: 106491

SEQ ID NO: 119248 - RNA, 59 nt, Human; identical to SEQ ID NO: 106492

SEQ ID NO: 119249 - RNA, 59 nt, Human; identical to SEQ ID NO: 106493

SEQ ID NO: 119250 - RNA, 59 nt, Human; identical to SEQ ID NO: 106494

SEQ ID NO: 119251 - RNA, 59 nt, Human; identical to SEQ ID NO: 106495

SEQ ID NO: 119252 - RNA, 59 nt, Human; identical to SEQ ID NO: 106496

SEQ ID NO: 119253 - RNA, 59 nt, Human; identical to SEQ ID NO: 106497

SEQ ID NO: 119254 - RNA, 59 nt, Human; identical to SEQ ID NO: 106498

SEQ ID NO: 119255 - RNA, 59 nt, Human; identical to SEQ ID NO: 106499

SEQ ID NO: 119256 - RNA, 59 nt, Human; identical to SEQ ID NO: 106500

SEQ ID NO: 119257 - RNA, 59 nt, Human; identical to SEQ ID NO: 106501

SEQ ID NO: 119258 - RNA, 59 nt, Human; identical to SEQ ID NO: 106502

SEQ ID NO: 119259 - RNA, 59 nt, Human; identical to SEQ ID NO: 106503

SEQ ID NO: 119260 - RNA, 59 nt, Human; identical to SEQ ID NO: 106504

SEQ ID NO: 119261 - RNA, 59 nt, Human; identical to SEQ ID NO: 106505

SEQ ID NO: 119262 - RNA, 59 nt, Human; identical to SEQ ID NO: 106506

SEQ ID NO: 119263 - RNA, 59 nt, Human; identical to SEQ ID NO: 106507

SEQ ID NO: 119264 - RNA, 59 nt, Human; identical to SEQ ID NO: 106508

SEQ ID NO: 119265 - RNA, 59 nt, Human; identical to SEQ ID NO: 106509

SEQ ID NO: 119266 - RNA, 59 nt, Human; identical to SEQ ID NO: 106510

SEQ ID NO: 119267 - RNA, 59 nt, Human; identical to SEQ ID NO: 106511

SEQ ID NO: 119268 - RNA, 59 nt, Human; identical to SEQ ID NO: 106512

SEQ ID NO: 119269 - RNA, 59 nt, Human; identical to SEQ ID NO: 106513

SEQ ID NO: 119270 - RNA, 59 nt, Human; identical to SEQ ID NO: 106514

SEQ ID NO: 119271 - RNA, 59 nt, Human; identical to SEQ ID NO: 106515

SEQ ID NO: 119272 - RNA, 59 nt, Human; identical to SEQ ID NO: 106516

SEQ ID NO: 119273 - RNA, 59 nt, Human; identical to SEQ ID NO: 106517

SEQ ID NO: 119274 - RNA, 59 nt, Human; identical to SEQ ID NO: 106518

SEQ ID NO: 119275 - RNA, 59 nt, Human; identical to SEQ ID NO: 106519

SEQ ID NO: 119276 - RNA, 59 nt, Human; identical to SEQ ID NO: 106520

SEQ ID NO: 119277 - RNA, 59 nt, Human; identical to SEQ ID NO: 106521

SEQ ID NO: 119278 - RNA, 59 nt, Human; identical to SEQ ID NO: 106473

SEQ ID NO: 119279 - RNA, 59 nt, Human; identical to SEQ ID NO: 106523

SEQ ID NO: 119280 - RNA, 59 nt, Human; identical to SEQ ID NO: 106524

SEQ ID NO: 119281 - RNA, 59 nt, Human; identical to SEQ ID NO: 106525

SEQ ID NO: 119282 - RNA, 59 nt, Human; identical to SEQ ID NO: 106526

SEQ ID NO: 119283 - RNA, 59 nt, Human; identical to SEQ ID NO: 106527

SEQ ID NO: 119284 - RNA, 59 nt, Human; identical to SEQ ID NO: 106528

SEQ ID NO: 119285 - RNA, 59 nt, Human; identical to SEQ ID NO: 106529

SEQ ID NO: 119286 - RNA, 59 nt, Human; identical to SEQ ID NO: 106530

SEQ ID NO: 119287 - RNA, 59 nt, Human; identical to SEQ ID NO: 106531

SEQ ID NO: 119288 - RNA, 59 nt, Human; identical to SEQ ID NO: 106532

SEQ ID NO: 119289 - RNA, 59 nt, Human; identical to SEQ ID NO: 106533

SEQ ID NO: 119290 - RNA, 59 nt, Human; identical to SEQ ID NO: 106534

SEQ ID NO: 119291 - RNA, 59 nt, Human; identical to SEQ ID NO: 106535

SEQ ID NO: 119292 - RNA, 59 nt, Human; identical to SEQ ID NO: 106536

SEQ ID NO: 119293 - RNA, 59 nt, Human; identical to SEQ ID NO: 106537

SEQ ID NO: 119294 - RNA, 59 nt, Human; identical to SEQ ID NO: 106538

SEQ ID NO: 119295 - RNA, 59 nt, Human; identical to SEQ ID NO: 106539

SEQ ID NO: 119296 - RNA, 59 nt, Human; identical to SEQ ID NO: 106540

SEQ ID NO: 119297 - RNA, 59 nt, Human; identical to SEQ ID NO: 106541

SEQ ID NO: 119298 - RNA, 59 nt, Human; identical to SEQ ID NO: 106542

SEQ ID NO: 119299 - RNA, 59 nt, Human; identical to SEQ ID NO: 106543

SEQ ID NO: 119300 - RNA, 59 nt, Human; identical to SEQ ID NO: 106544

SEQ ID NO: 119301 - RNA, 59 nt, Human; identical to SEQ ID NO: 106545

SEQ ID NO: 119302 - RNA, 59 nt, Human; identical to SEQ ID NO: 106546

SEQ ID NO: 119303 - RNA, 59 nt, Human; identical to SEQ ID NO: 106547

SEQ ID NO: 119304 - RNA, 59 nt, Human; identical to SEQ ID NO: 106548

SEQ ID NO: 119305 - RNA, 59 nt, Human; identical to SEQ ID NO: 106549

SEQ ID NO: 119306 - RNA, 59 nt, Human; identical to SEQ ID NO: 106550

SEQ ID NO: 119307 - RNA, 59 nt, Human; identical to SEQ ID NO: 106551

SEQ ID NO: 119308 - RNA, 59 nt, Human; identical to SEQ ID NO: 106552

SEQ ID NO: 119309 - RNA, 59 nt, Human; identical to SEQ ID NO: 106553

SEQ ID NO: 119310 - RNA, 59 nt, Human; identical to SEQ ID NO: 106554

SEQ ID NO: 119311 - RNA, 59 nt, Human; identical to SEQ ID NO: 106555

SEQ ID NO: 119312 - RNA, 59 nt, Human; identical to SEQ ID NO: 106556

SEQ ID NO: 119313 - RNA, 59 nt, Human; identical to SEQ ID NO: 106557

SEQ ID NO: 119314 - RNA, 59 nt, Human; identical to SEQ ID NO: 106558

SEQ ID NO: 119315 - RNA, 59 nt, Human; identical to SEQ ID NO: 106559

SEQ ID NO: 119316 - RNA, 59 nt, Human; identical to SEQ ID NO: 106560

SEQ ID NO: 119317 - RNA, 59 nt, Human; identical to SEQ ID NO: 106561

SEQ ID NO: 119318 - RNA, 59 nt, Human; identical to SEQ ID NO: 106562

SEQ ID NO: 119319 - RNA, 59 nt, Human; identical to SEQ ID NO: 106563

SEQ ID NO: 119320 - RNA, 59 nt, Human; identical to SEQ ID NO: 106564

SEQ ID NO: 119321 - RNA, 59 nt, Human; identical to SEQ ID NO: 106565

SEQ ID NO: 119322 - RNA, 59 nt, Human; identical to SEQ ID NO: 106566

SEQ ID NO: 119323 - RNA, 59 nt, Human; identical to SEQ ID NO: 106567

SEQ ID NO: 119324 - RNA, 59 nt, Human; identical to SEQ ID NO: 106568

SEQ ID NO: 119325 - RNA, 59 nt, Human; identical to SEQ ID NO: 106569

SEQ ID NO: 119326 - RNA, 59 nt, Human; identical to SEQ ID NO: 106570

SEQ ID NO: 119327 - RNA, 59 nt, Human; identical to SEQ ID NO: 106571

SEQ ID NO: 119328 - RNA, 59 nt, Human; identical to SEQ ID NO: 106572

SEQ ID NO: 119329 - RNA, 59 nt, Human; identical to SEQ ID NO: 106573

SEQ ID NO: 119330 - RNA, 59 nt, Human; identical to SEQ ID NO: 106574

SEQ ID NO: 119331 - RNA, 59 nt, Human; identical to SEQ ID NO: 106575

SEQ ID NO: 119332 - RNA, 59 nt, Human; identical to SEQ ID NO: 106576

SEQ ID NO: 119333 - RNA, 59 nt, Human; identical to SEQ ID NO: 106577

SEQ ID NO: 119334 - RNA, 59 nt, Human; identical to SEQ ID NO: 106578

SEQ ID NO: 119335 - RNA, 59 nt, Human; identical to SEQ ID NO: 106579

SEQ ID NO: 119336 - RNA, 53 nt, Human; identical to SEQ ID NO: 106580

SEQ ID NO: 119337 - RNA, 59 nt, Human; identical to SEQ ID NO: 106581

SEQ ID NO: 119338 - RNA, 59 nt, Human; identical to SEQ ID NO: 106582

SEQ ID NO: 119339 - RNA, 59 nt, Human; identical to SEQ ID NO: 106583

SEQ ID NO: 119340 - RNA, 59 nt, Human; identical to SEQ ID NO: 106584

SEQ ID NO: 119341 - RNA, 59 nt, Human; identical to SEQ ID NO: 106585

SEQ ID NO: 119342 - RNA, 59 nt, Human; identical to SEQ ID NO: 106586

SEQ ID NO: 119343 - RNA, 59 nt, Human; identical to SEQ ID NO: 106587

SEQ ID NO: 119344 - RNA, 59 nt, Human; identical to SEQ ID NO: 106588

SEQ ID NO: 119345 - RNA, 59 nt, Human; identical to SEQ ID NO: 106589

SEQ ID NO: 119346 - RNA, 59 nt, Human; identical to SEQ ID NO: 106590

SEQ ID NO: 119347 - RNA, 59 nt, Human; identical to SEQ ID NO: 106591

SEQ ID NO: 119348 - RNA, 59 nt, Human; identical to SEQ ID NO: 106592

SEQ ID NO: 119349 - RNA, 59 nt, Human; identical to SEQ ID NO: 106593

SEQ ID NO: 119350 - RNA, 59 nt, Human; identical to SEQ ID NO: 106594

SEQ ID NO: 119351 - RNA, 59 nt, Human; identical to SEQ ID NO: 106595

SEQ ID NO: 119352 - RNA, 59 nt, Human; identical to SEQ ID NO: 106596

SEQ ID NO: 119353 - RNA, 59 nt, Human; identical to SEQ ID NO: 106597

SEQ ID NO: 119354 - RNA, 59 nt, Human; identical to SEQ ID NO: 106598

SEQ ID NO: 119355 - RNA, 59 nt, Human; identical to SEQ ID NO: 106599

SEQ ID NO: 119356 - RNA, 59 nt, Human; identical to SEQ ID NO: 106600

SEQ ID NO: 119357 - RNA, 59 nt, Human; identical to SEQ ID NO: 106601

SEQ ID NO: 119358 - RNA, 59 nt, Human; identical to SEQ ID NO: 106602

SEQ ID NO: 119359 - RNA, 59 nt, Human; identical to SEQ ID NO: 106603

SEQ ID NO: 119360 - RNA, 59 nt, Human; identical to SEQ ID NO: 106604

SEQ ID NO: 119361 - RNA, 59 nt, Human; identical to SEQ ID NO: 106605

SEQ ID NO: 119362 - RNA, 59 nt, Human; identical to SEQ ID NO: 106606

SEQ ID NO: 119363 - RNA, 59 nt, Human; identical to SEQ ID NO: 106607

SEQ ID NO: 119364 - RNA, 59 nt, Human; identical to SEQ ID NO: 106608

SEQ ID NO: 119365 - RNA, 59 nt, Human; identical to SEQ ID NO: 106609

SEQ ID NO: 119366 - RNA, 59 nt, Human; identical to SEQ ID NO: 106610

SEQ ID NO: 119367 - RNA, 59 nt, Human; identical to SEQ ID NO: 106611

SEQ ID NO: 119368 - RNA, 59 nt, Human; identical to SEQ ID NO: 106612

SEQ ID NO: 119369 - RNA, 59 nt, Human; identical to SEQ ID NO: 106613

SEQ ID NO: 119370 - RNA, 59 nt, Human; identical to SEQ ID NO: 106614

SEQ ID NO: 119371 - RNA, 59 nt, Human; identical to SEQ ID NO: 106615

SEQ ID NO: 119372 - RNA, 59 nt, Human; identical to SEQ ID NO: 106616

SEQ ID NO: 119373 - RNA, 59 nt, Human; identical to SEQ ID NO: 106617

SEQ ID NO: 119374 - RNA, 59 nt, Human; identical to SEQ ID NO: 106618

SEQ ID NO: 119375 - RNA, 59 nt, Human; identical to SEQ ID NO: 106619

SEQ ID NO: 119376 - RNA, 59 nt, Human; identical to SEQ ID NO: 106620

SEQ ID NO: 119377 - RNA, 59 nt, Human; identical to SEQ ID NO: 106621

SEQ ID NO: 119378 - RNA, 59 nt, Human; identical to SEQ ID NO: 106622

SEQ ID NO: 119379 - RNA, 59 nt, Human; identical to SEQ ID NO: 106623

SEQ ID NO: 119380 - RNA, 59 nt, Human; identical to SEQ ID NO: 106624

SEQ ID NO: 119381 - RNA, 59 nt, Human; identical to SEQ ID NO: 106625

SEQ ID NO: 119382 - RNA, 59 nt, Human; identical to SEQ ID NO: 106626

SEQ ID NO: 119383 - RNA, 59 nt, Human; identical to SEQ ID NO: 106627

SEQ ID NO: 119384 - RNA, 59 nt, Human; identical to SEQ ID NO: 106628

SEQ ID NO: 119385 - RNA, 59 nt, Human; identical to SEQ ID NO: 106629

SEQ ID NO: 119386 - RNA, 59 nt, Human; identical to SEQ ID NO: 106630

SEQ ID NO: 119387 - RNA, 59 nt, Human; identical to SEQ ID NO: 106631

SEQ ID NO: 119388 - RNA, 59 nt, Human; identical to SEQ ID NO: 106632

SEQ ID NO: 119389 - RNA, 59 nt, Human; identical to SEQ ID NO: 106633

SEQ ID NO: 119390 - RNA, 59 nt, Human; identical to SEQ ID NO: 106634

SEQ ID NO: 119391 - RNA, 59 nt, Human; identical to SEQ ID NO: 106635

SEQ ID NO: 119392 - RNA, 59 nt, Human; identical to SEQ ID NO: 106636

SEQ ID NO: 119393 - RNA, 59 nt, Human; identical to SEQ ID NO: 106637

SEQ ID NO: 119394 - RNA, 59 nt, Human; identical to SEQ ID NO: 106638

SEQ ID NO: 119395 - RNA, 59 nt, Human; identical to SEQ ID NO: 106639

SEQ ID NO: 119396 - RNA, 59 nt, Human; identical to SEQ ID NO: 106640

SEQ ID NO: 119397 - RNA, 59 nt, Human; identical to SEQ ID NO: 106641

SEQ ID NO: 119398 - RNA, 59 nt, Human; identical to SEQ ID NO: 106642

SEQ ID NO: 119399 - RNA, 59 nt, Human; identical to SEQ ID NO: 106643

SEQ ID NO: 119400 - RNA, 59 nt, Human; identical to SEQ ID NO: 106644

SEQ ID NO: 119401 - RNA, 59 nt, Human; identical to SEQ ID NO: 106645

SEQ ID NO: 119402 - RNA, 59 nt, Human; identical to SEQ ID NO: 106646

SEQ ID NO: 119403 - RNA, 59 nt, Human; identical to SEQ ID NO: 106647

SEQ ID NO: 119404 - RNA, 59 nt, Human; identical to SEQ ID NO: 106648

SEQ ID NO: 119405 - RNA, 59 nt, Human; identical to SEQ ID NO: 106649

SEQ ID NO: 119406 - RNA, 59 nt, Human; identical to SEQ ID NO: 106650

SEQ ID NO: 119407 - RNA, 59 nt, Human; identical to SEQ ID NO: 106651

SEQ ID NO: 119408 - RNA, 59 nt, Human; identical to SEQ ID NO: 106652

SEQ ID NO: 119409 - RNA, 59 nt, Human; identical to SEQ ID NO: 106653

SEQ ID NO: 119410 - RNA, 59 nt, Human; identical to SEQ ID NO: 106654

SEQ ID NO: 119411 - RNA, 59 nt, Human; identical to SEQ ID NO: 106655

SEQ ID NO: 119412 - RNA, 59 nt, Human; identical to SEQ ID NO: 106656

SEQ ID NO: 119413 - RNA, 59 nt, Human; identical to SEQ ID NO: 106657

SEQ ID NO: 119414 - RNA, 59 nt, Human; identical to SEQ ID NO: 106658

SEQ ID NO: 119415 - RNA, 59 nt, Human; identical to SEQ ID NO: 106659

SEQ ID NO: 119416 - RNA, 59 nt, Human; identical to SEQ ID NO: 106660

SEQ ID NO: 119417 - RNA, 59 nt, Human; identical to SEQ ID NO: 106661

SEQ ID NO: 119418 - RNA, 59 nt, Human; identical to SEQ ID NO: 106662

SEQ ID NO: 119419 - RNA, 59 nt, Human; identical to SEQ ID NO: 106663

SEQ ID NO: 119420 - RNA, 59 nt, Human; identical to SEQ ID NO: 106664

SEQ ID NO: 119421 - RNA, 59 nt, Human; identical to SEQ ID NO: 106665

SEQ ID NO: 119422 - RNA, 59 nt, Human; identical to SEQ ID NO: 106666

SEQ ID NO: 119423 - RNA, 59 nt, Human; identical to SEQ ID NO: 106667

SEQ ID NO: 119424 - RNA, 59 nt, Human; identical to SEQ ID NO: 106668

SEQ ID NO: 119425 - RNA, 59 nt, Human; identical to SEQ ID NO: 106669

SEQ ID NO: 119426 - RNA, 59 nt, Human; identical to SEQ ID NO: 106670

SEQ ID NO: 119427 - RNA, 59 nt, Human; identical to SEQ ID NO: 106671

SEQ ID NO: 119428 - RNA, 59 nt, Human; identical to SEQ ID NO: 106672

SEQ ID NO: 119429 - RNA, 59 nt, Human; identical to SEQ ID NO: 106673

SEQ ID NO: 119430 - RNA, 59 nt, Human; identical to SEQ ID NO: 106674

SEQ ID NO: 119431 - RNA, 59 nt, Human; identical to SEQ ID NO: 106675

SEQ ID NO: 119432 - RNA, 59 nt, Human; identical to SEQ ID NO: 106676

SEQ ID NO: 119433 - RNA, 59 nt, Human; identical to SEQ ID NO: 106677

SEQ ID NO: 119434 - RNA, 59 nt, Human; identical to SEQ ID NO: 106678

SEQ ID NO: 119435 - RNA, 59 nt, Human; identical to SEQ ID NO: 106679

SEQ ID NO: 119436 - RNA, 59 nt, Human; identical to SEQ ID NO: 106680

SEQ ID NO: 119437 - RNA, 59 nt, Human; identical to SEQ ID NO: 106681

SEQ ID NO: 119438 - RNA, 59 nt, Human; identical to SEQ ID NO: 106682

SEQ ID NO: 119439 - RNA, 59 nt, Human; identical to SEQ ID NO: 106683

SEQ ID NO: 119440 - RNA, 59 nt, Human; identical to SEQ ID NO: 106684

SEQ ID NO: 119441 - RNA, 59 nt, Human; identical to SEQ ID NO: 106685

SEQ ID NO: 119442 - RNA, 59 nt, Human; identical to SEQ ID NO: 106681

SEQ ID NO: 119443 - RNA, 59 nt, Human; identical to SEQ ID NO: 106687

SEQ ID NO: 119444 - RNA, 59 nt, Human; identical to SEQ ID NO: 106688

SEQ ID NO: 119445 - RNA, 59 nt, Human; identical to SEQ ID NO: 106689

SEQ ID NO: 119446 - RNA, 59 nt, Human; identical to SEQ ID NO: 106690

SEQ ID NO: 119447 - RNA, 59 nt, Human; identical to SEQ ID NO: 106691

SEQ ID NO: 119448 - RNA, 59 nt, Human; identical to SEQ ID NO: 106692

SEQ ID NO: 119449 - RNA, 59 nt, Human; identical to SEQ ID NO: 106693

SEQ ID NO: 119450 - RNA, 59 nt, Human; identical to SEQ ID NO: 106694

SEQ ID NO: 119451 - RNA, 59 nt, Human; identical to SEQ ID NO: 106695

SEQ ID NO: 119452 - RNA, 59 nt, Human; identical to SEQ ID NO: 106696

SEQ ID NO: 119453 - RNA, 59 nt, Human; identical to SEQ ID NO: 106697

SEQ ID NO: 119454 - RNA, 59 nt, Human; identical to SEQ ID NO: 106698

SEQ ID NO: 119455 - RNA, 59 nt, Human; identical to SEQ ID NO: 106699

SEQ ID NO: 119456 - RNA, 59 nt, Human; identical to SEQ ID NO: 106700

SEQ ID NO: 119457 - RNA, 59 nt, Human; identical to SEQ ID NO: 106701

SEQ ID NO: 119458 - RNA, 59 nt, Human; identical to SEQ ID NO: 106702

SEQ ID NO: 119459 - RNA, 59 nt, Human; identical to SEQ ID NO: 106703

SEQ ID NO: 119460 - RNA, 59 nt, Human; identical to SEQ ID NO: 106704

SEQ ID NO: 119461 - RNA, 59 nt, Human; identical to SEQ ID NO: 106705

SEQ ID NO: 119462 - RNA, 59 nt, Human; identical to SEQ ID NO: 106706

SEQ ID NO: 119463 - RNA, 59 nt, Human; identical to SEQ ID NO: 106707

SEQ ID NO: 119464 - RNA, 59 nt, Human; identical to SEQ ID NO: 106708

SEQ ID NO: 119465 - RNA, 59 nt, Human; identical to SEQ ID NO: 106709

SEQ ID NO: 119466 - RNA, 59 nt, Human; identical to SEQ ID NO: 106710

SEQ ID NO: 119467 - RNA, 59 nt, Human; identical to SEQ ID NO: 106711

SEQ ID NO: 119468 - RNA, 59 nt, Human; identical to SEQ ID NO: 106712

SEQ ID NO: 119469 - RNA, 59 nt, Human; identical to SEQ ID NO: 106713

SEQ ID NO: 119470 - RNA, 59 nt, Human; identical to SEQ ID NO: 106714

SEQ ID NO: 119471 - RNA, 59 nt, Human; identical to SEQ ID NO: 106715

SEQ ID NO: 119472 - RNA, 59 nt, Human; identical to SEQ ID NO: 106716

SEQ ID NO: 119473 - RNA, 59 nt, Human; identical to SEQ ID NO: 106717

SEQ ID NO: 119474 - RNA, 59 nt, Human; identical to SEQ ID NO: 106718

SEQ ID NO: 119475 - RNA, 59 nt, Human; identical to SEQ ID NO: 106719

SEQ ID NO: 119476 - RNA, 59 nt, Human; identical to SEQ ID NO: 106720

SEQ ID NO: 119477 - RNA, 59 nt, Human; identical to SEQ ID NO: 106721

SEQ ID NO: 119478 - RNA, 59 nt, Human; identical to SEQ ID NO: 106722

SEQ ID NO: 119479 - RNA, 59 nt, Human; identical to SEQ ID NO: 106723

SEQ ID NO: 119480 - RNA, 59 nt, Human; identical to SEQ ID NO: 106724

SEQ ID NO: 119481 - RNA, 59 nt, Human; identical to SEQ ID NO: 106725

SEQ ID NO: 119482 - RNA, 59 nt, Human; identical to SEQ ID NO: 106726

SEQ ID NO: 119483 - RNA, 59 nt, Human; identical to SEQ ID NO: 106727

SEQ ID NO: 119484 - RNA, 59 nt, Human; identical to SEQ ID NO: 106728

SEQ ID NO: 119485 - RNA, 59 nt, Human; identical to SEQ ID NO: 106729

SEQ ID NO: 119486 - RNA, 59 nt, Human; identical to SEQ ID NO: 106730

SEQ ID NO: 119487 - RNA, 59 nt, Human; identical to SEQ ID NO: 106731

SEQ ID NO: 119488 - RNA, 59 nt, Human; identical to SEQ ID NO: 106732

SEQ ID NO: 119489 - RNA, 59 nt, Human; identical to SEQ ID NO: 106733

SEQ ID NO: 119490 - RNA, 59 nt, Human; identical to SEQ ID NO: 106734

SEQ ID NO: 119491 - RNA, 59 nt, Human; identical to SEQ ID NO: 106735

SEQ ID NO: 119492 - RNA, 59 nt, Human; identical to SEQ ID NO: 106736

SEQ ID NO: 119493 - RNA, 59 nt, Human; identical to SEQ ID NO: 106737

SEQ ID NO: 119494 - RNA, 59 nt, Human; identical to SEQ ID NO: 106738

SEQ ID NO: 119495 - RNA, 59 nt, Human; identical to SEQ ID NO: 106739

SEQ ID NO: 119496 - RNA, 59 nt, Human; identical to SEQ ID NO: 106740

SEQ ID NO: 119497 - RNA, 59 nt, Human; identical to SEQ ID NO: 106741

SEQ ID NO: 119498 - RNA, 59 nt, Human; identical to SEQ ID NO: 106742

SEQ ID NO: 119499 - RNA, 59 nt, Human; identical to SEQ ID NO: 106743

SEQ ID NO: 119500 - RNA, 59 nt, Human; identical to SEQ ID NO: 106744

SEQ ID NO: 119501 - RNA, 59 nt, Human; identical to SEQ ID NO: 106745

SEQ ID NO: 119502 - RNA, 59 nt, Human; identical to SEQ ID NO: 106746

SEQ ID NO: 119503 - RNA, 59 nt, Human; identical to SEQ ID NO: 106747

SEQ ID NO: 119504 - RNA, 59 nt, Human; identical to SEQ ID NO: 106748

SEQ ID NO: 119505 - RNA, 59 nt, Human; identical to SEQ ID NO: 106749

SEQ ID NO: 119506 - RNA, 59 nt, Human; identical to SEQ ID NO: 106750

SEQ ID NO: 119507 - RNA, 59 nt, Human; identical to SEQ ID NO: 106751

SEQ ID NO: 119508 - RNA, 59 nt, Human; identical to SEQ ID NO: 106752

SEQ ID NO: 119509 - RNA, 59 nt, Human; identical to SEQ ID NO: 106753

SEQ ID NO: 119510 - RNA, 59 nt, Human; identical to SEQ ID NO: 106754

SEQ ID NO: 119511 - RNA, 59 nt, Human; identical to SEQ ID NO: 106755

SEQ ID NO: 119512 - RNA, 59 nt, Human; identical to SEQ ID NO: 106756

SEQ ID NO: 119513 - RNA, 59 nt, Human; identical to SEQ ID NO: 106757

SEQ ID NO: 119514 - RNA, 59 nt, Human; identical to SEQ ID NO: 106758

SEQ ID NO: 119515 - RNA, 59 nt, Human; identical to SEQ ID NO: 106759

SEQ ID NO: 119516 - RNA, 59 nt, Human; identical to SEQ ID NO: 106760

SEQ ID NO: 119517 - RNA, 59 nt, Human; identical to SEQ ID NO: 106761

SEQ ID NO: 119518 - RNA, 59 nt, Human; identical to SEQ ID NO: 106762

SEQ ID NO: 119519 - RNA, 59 nt, Human; identical to SEQ ID NO: 106763

SEQ ID NO: 119520 - RNA, 59 nt, Human; identical to SEQ ID NO: 106764

SEQ ID NO: 119521 - RNA, 59 nt, Human; identical to SEQ ID NO: 106765

SEQ ID NO: 119522 - RNA, 59 nt, Human; identical to SEQ ID NO: 106766

SEQ ID NO: 119523 - RNA, 59 nt, Human; identical to SEQ ID NO: 106767

SEQ ID NO: 119524 - RNA, 59 nt, Human; identical to SEQ ID NO: 106768

SEQ ID NO: 119525 - RNA, 59 nt, Human; identical to SEQ ID NO: 106769

SEQ ID NO: 119526 - RNA, 59 nt, Human; identical to SEQ ID NO: 106770

SEQ ID NO: 119527 - RNA, 59 nt, Human; identical to SEQ ID NO: 106771

SEQ ID NO: 119528 - RNA, 59 nt, Human; identical to SEQ ID NO: 106772

SEQ ID NO: 119529 - RNA, 59 nt, Human; identical to SEQ ID NO: 106773

SEQ ID NO: 119530 - RNA, 59 nt, Human; identical to SEQ ID NO: 106774

SEQ ID NO: 119531 - RNA, 59 nt, Human; identical to SEQ ID NO: 106775

SEQ ID NO: 119532 - RNA, 59 nt, Human; identical to SEQ ID NO: 106776

SEQ ID NO: 119533 - RNA, 59 nt, Human; identical to SEQ ID NO: 106777

SEQ ID NO: 119534 - RNA, 59 nt, Human; identical to SEQ ID NO: 106778

SEQ ID NO: 119535 - RNA, 59 nt, Human; identical to SEQ ID NO: 106779

SEQ ID NO: 119536 - RNA, 59 nt, Human; identical to SEQ ID NO: 106780

SEQ ID NO: 119537 - RNA, 59 nt, Human; identical to SEQ ID NO: 106781

SEQ ID NO: 119538 - RNA, 59 nt, Human; identical to SEQ ID NO: 106782

SEQ ID NO: 119539 - RNA, 59 nt, Human; identical to SEQ ID NO: 106783

SEQ ID NO: 119540 - RNA, 59 nt, Human; identical to SEQ ID NO: 106784

SEQ ID NO: 119541 - RNA, 59 nt, Human; identical to SEQ ID NO: 106785

SEQ ID NO: 119542 - RNA, 59 nt, Human; identical to SEQ ID NO: 106786

SEQ ID NO: 119543 - RNA, 59 nt, Human; identical to SEQ ID NO: 106787

SEQ ID NO: 119544 - RNA, 59 nt, Human; identical to SEQ ID NO: 106788

SEQ ID NO: 119545 - RNA, 59 nt, Human; identical to SEQ ID NO: 106789

SEQ ID NO: 119546 - RNA, 59 nt, Human; identical to SEQ ID NO: 106790

SEQ ID NO: 119547 - RNA, 59 nt, Human; identical to SEQ ID NO: 106791

SEQ ID NO: 119548 - RNA, 59 nt, Human; identical to SEQ ID NO: 106792

SEQ ID NO: 119549 - RNA, 59 nt, Human; identical to SEQ ID NO: 106793

SEQ ID NO: 119550 - RNA, 59 nt, Human; identical to SEQ ID NO: 106794

SEQ ID NO: 119551 - RNA, 59 nt, Human; identical to SEQ ID NO: 106795

SEQ ID NO: 119552 - RNA, 59 nt, Human; identical to SEQ ID NO: 106796

SEQ ID NO: 119553 - RNA, 59 nt, Human; identical to SEQ ID NO: 106797

SEQ ID NO: 119554 - RNA, 59 nt, Human; identical to SEQ ID NO: 106798

SEQ ID NO: 119555 - RNA, 59 nt, Human; identical to SEQ ID NO: 106799

SEQ ID NO: 119556 - RNA, 59 nt, Human; identical to SEQ ID NO: 106800

SEQ ID NO: 119557 - RNA, 59 nt, Human; identical to SEQ ID NO: 106801

SEQ ID NO: 119558 - RNA, 59 nt, Human; identical to SEQ ID NO: 106802

SEQ ID NO: 119559 - RNA, 59 nt, Human; identical to SEQ ID NO: 106803

SEQ ID NO: 119560 - RNA, 59 nt, Human; identical to SEQ ID NO: 106804

SEQ ID NO: 119561 - RNA, 59 nt, Human; identical to SEQ ID NO: 106805

SEQ ID NO: 119562 - RNA, 59 nt, Human; identical to SEQ ID NO: 106806

SEQ ID NO: 119563 - RNA, 59 nt, Human; identical to SEQ ID NO: 106807

SEQ ID NO: 119564 - RNA, 59 nt, Human; identical to SEQ ID NO: 106808

SEQ ID NO: 119565 - RNA, 59 nt, Human; identical to SEQ ID NO: 106809

SEQ ID NO: 119566 - RNA, 59 nt, Human; identical to SEQ ID NO: 106810

SEQ ID NO: 119567 - RNA, 59 nt, Human; identical to SEQ ID NO: 106811

SEQ ID NO: 119568 - RNA, 59 nt, Human; identical to SEQ ID NO: 106812

SEQ ID NO: 119569 - RNA, 59 nt, Human; identical to SEQ ID NO: 106813

SEQ ID NO: 119570 - RNA, 59 nt, Human; identical to SEQ ID NO: 106814

SEQ ID NO: 119571 - RNA, 59 nt, Human; identical to SEQ ID NO: 106815

SEQ ID NO: 119572 - RNA, 59 nt, Human; identical to SEQ ID NO: 106816

SEQ ID NO: 119573 - RNA, 59 nt, Human; identical to SEQ ID NO: 106817

SEQ ID NO: 119574 - RNA, 59 nt, Human; identical to SEQ ID NO: 106818

SEQ ID NO: 119575 - RNA, 59 nt, Human; identical to SEQ ID NO: 106819

SEQ ID NO: 119576 - RNA, 59 nt, Human; identical to SEQ ID NO: 106820

SEQ ID NO: 119577 - RNA, 59 nt, Human; identical to SEQ ID NO: 106821

SEQ ID NO: 119578 - RNA, 59 nt, Human; identical to SEQ ID NO: 106822

SEQ ID NO: 119579 - RNA, 59 nt, Human; identical to SEQ ID NO: 106823

SEQ ID NO: 119580 - RNA, 59 nt, Human; identical to SEQ ID NO: 106824

SEQ ID NO: 119581 - RNA, 59 nt, Human; identical to SEQ ID NO: 106825

SEQ ID NO: 119582 - RNA, 59 nt, Human; identical to SEQ ID NO: 106826

SEQ ID NO: 119583 - RNA, 59 nt, Human; identical to SEQ ID NO: 106827

SEQ ID NO: 119584 - RNA, 59 nt, Human; identical to SEQ ID NO: 106828

SEQ ID NO: 119585 - RNA, 59 nt, Human; identical to SEQ ID NO: 106829

SEQ ID NO: 119586 - RNA, 59 nt, Human; identical to SEQ ID NO: 106830

SEQ ID NO: 119587 - RNA, 59 nt, Human; identical to SEQ ID NO: 106831

SEQ ID NO: 119588 - RNA, 59 nt, Human; identical to SEQ ID NO: 106832

SEQ ID NO: 119589 - RNA, 59 nt, Human; identical to SEQ ID NO: 106833

SEQ ID NO: 119590 - RNA, 59 nt, Human; identical to SEQ ID NO: 106834

SEQ ID NO: 119591 - RNA, 59 nt, Human; identical to SEQ ID NO: 106835

SEQ ID NO: 119592 - RNA, 59 nt, Human; identical to SEQ ID NO: 106836

SEQ ID NO: 119593 - RNA, 59 nt, Human; identical to SEQ ID NO: 106837

SEQ ID NO: 119594 - RNA, 59 nt, Human; identical to SEQ ID NO: 106838

SEQ ID NO: 119595 - RNA, 59 nt, Human; identical to SEQ ID NO: 106839

SEQ ID NO: 119596 - RNA, 59 nt, Human; identical to SEQ ID NO: 106840

SEQ ID NO: 119597 - RNA, 59 nt, Human; identical to SEQ ID NO: 106841

SEQ ID NO: 119598 - RNA, 59 nt, Human; identical to SEQ ID NO: 106842

SEQ ID NO: 119599 - RNA, 59 nt, Human; identical to SEQ ID NO: 106843

SEQ ID NO: 119600 - RNA, 59 nt, Human; identical to SEQ ID NO: 106844

SEQ ID NO: 119601 - RNA, 59 nt, Human; identical to SEQ ID NO: 106845

SEQ ID NO: 119602 - RNA, 59 nt, Human; identical to SEQ ID NO: 106846

SEQ ID NO: 119603 - RNA, 59 nt, Human; identical to SEQ ID NO: 106847

SEQ ID NO: 119604 - RNA, 59 nt, Human; identical to SEQ ID NO: 106848

SEQ ID NO: 119605 - RNA, 59 nt, Human; identical to SEQ ID NO: 106849

SEQ ID NO: 119606 - RNA, 59 nt, Human; identical to SEQ ID NO: 106850

SEQ ID NO: 119607 - RNA, 59 nt, Human; identical to SEQ ID NO: 106851

SEQ ID NO: 119608 - RNA, 59 nt, Human; identical to SEQ ID NO: 106852

SEQ ID NO: 119609 - RNA, 59 nt, Human; identical to SEQ ID NO: 106853

SEQ ID NO: 119610 - RNA, 59 nt, Human; identical to SEQ ID NO: 106854

SEQ ID NO: 119611 - RNA, 59 nt, Human; identical to SEQ ID NO: 106855

SEQ ID NO: 119612 - RNA, 59 nt, Human; identical to SEQ ID NO: 106856

SEQ ID NO: 119613 - RNA, 59 nt, Human; identical to SEQ ID NO: 106857

SEQ ID NO: 119614 - RNA, 59 nt, Human; identical to SEQ ID NO: 106858

SEQ ID NO: 119615 - RNA, 59 nt, Human; identical to SEQ ID NO: 106859

SEQ ID NO: 119616 - RNA, 59 nt, Human; identical to SEQ ID NO: 106860

SEQ ID NO: 119617 - RNA, 59 nt, Human; identical to SEQ ID NO: 106861

SEQ ID NO: 119618 - RNA, 59 nt, Human; identical to SEQ ID NO: 106862

SEQ ID NO: 119619 - RNA, 59 nt, Human; identical to SEQ ID NO: 106863

SEQ ID NO: 119620 - RNA, 59 nt, Human; identical to SEQ ID NO: 106864

SEQ ID NO: 119621 - RNA, 59 nt, Human; identical to SEQ ID NO: 106865

SEQ ID NO: 119622 - RNA, 59 nt, Human; identical to SEQ ID NO: 106866

SEQ ID NO: 119623 - RNA, 59 nt, Human; identical to SEQ ID NO: 106867

SEQ ID NO: 119624 - RNA, 59 nt, Human; identical to SEQ ID NO: 106868

SEQ ID NO: 119625 - RNA, 59 nt, Human; identical to SEQ ID NO: 106869

SEQ ID NO: 119626 - RNA, 59 nt, Human; identical to SEQ ID NO: 106870

SEQ ID NO: 119627 - RNA, 59 nt, Human; identical to SEQ ID NO: 106871

SEQ ID NO: 119628 - RNA, 59 nt, Human; identical to SEQ ID NO: 106872

SEQ ID NO: 119629 - RNA, 59 nt, Human; identical to SEQ ID NO: 106873

SEQ ID NO: 119630 - RNA, 59 nt, Human; identical to SEQ ID NO: 106874

SEQ ID NO: 119631 - RNA, 59 nt, Human; identical to SEQ ID NO: 106875

SEQ ID NO: 119632 - RNA, 59 nt, Human; identical to SEQ ID NO: 106876

SEQ ID NO: 119633 - RNA, 59 nt, Human; identical to SEQ ID NO: 106877

SEQ ID NO: 119634 - RNA, 59 nt, Human; identical to SEQ ID NO: 106878

SEQ ID NO: 119635 - RNA, 59 nt, Human; identical to SEQ ID NO: 106879

SEQ ID NO: 119636 - RNA, 59 nt, Human; identical to SEQ ID NO: 106880

SEQ ID NO: 119637 - RNA, 59 nt, Human; identical to SEQ ID NO: 106881

SEQ ID NO: 119638 - RNA, 59 nt, Human; identical to SEQ ID NO: 106881

SEQ ID NO: 119639 - RNA, 59 nt, Human; identical to SEQ ID NO: 106883

SEQ ID NO: 119640 - RNA, 59 nt, Human; identical to SEQ ID NO: 106884

SEQ ID NO: 119641 - RNA, 59 nt, Human; identical to SEQ ID NO: 106885

SEQ ID NO: 119642 - RNA, 59 nt, Human; identical to SEQ ID NO: 106886

SEQ ID NO: 119643 - RNA, 59 nt, Human; identical to SEQ ID NO: 106887

SEQ ID NO: 119644 - RNA, 59 nt, Human; identical to SEQ ID NO: 106888

SEQ ID NO: 119645 - RNA, 59 nt, Human; identical to SEQ ID NO: 106889

SEQ ID NO: 119646 - RNA, 59 nt, Human; identical to SEQ ID NO: 106890

SEQ ID NO: 119647 - RNA, 59 nt, Human; identical to SEQ ID NO: 106891

SEQ ID NO: 119648 - RNA, 59 nt, Human; identical to SEQ ID NO: 106892

SEQ ID NO: 119649 - RNA, 59 nt, Human; identical to SEQ ID NO: 106893

SEQ ID NO: 119650 - RNA, 64 nt, Human
cucagugccagcuguuauucugcuuccacuguguuggggagagguguucgguuuccccagccug

SEQ ID NO: 119651 - RNA, 64 nt, Human
acguacacacacauacaaaaucccucugcaguuuuggggagaucagcugcaggauuuuaacagg

SEQ ID NO: 119652 - RNA, 64 nt, Human
gaaaauaauagaugacucaccacaccucuacggcuggggagaucaggcccagccccauaaagga

SEQ ID NO: 119653 - RNA, 64 nt, Human
uguaaguguaucaggacuuaugugacuuauauuuuggggagaugaggguuggguuuuuuuuuua

SEQ ID NO: 119654 - RNA, 64 nt, Human
aaaugugugagagggacuuggccaaggcaaaagcuggggagaugccagugacaacauacaguuc

SEQ ID NO: 119655 - RNA, 64 nt, Human
guuccuccuugagaggcugagccguagccaggauuggggagagcccuugucucuggucagcccu

SEQ ID NO: 119656 - RNA, 64 nt, Human
uuuucagaguguuuuggggaggaguuuuagggcuuggggagagggaggacacaucuggaggaaa

SEQ ID NO: 119657 - RNA, 64 nt, Human
cugcuucauuaagaagcuggggguaggguggggguggggagaacacuuaacaacauggggacca

SEQ ID NO: 119658 - RNA, 64 nt, Human
ucucagcacccagcccaccccuuccuguagcauauggggagacuaaggccuggagagaggggug

SEQ ID NO: 119659 - RNA, 64 nt, Human
ucuuuuuuuuuuuuuuuucaaguauuggaagggguggggagauauauaaauaaaucaugaaauc

SEQ ID NO: 119660 - RNA, 64 nt, Human
aggagucuccugcugaugcgugauagcuuaagcuuggggagaaggucuuuuccacugccuagcu

SEQ ID NO: 119661 - RNA, 64 nt, Human
gagaaggucuuuuccacugccuagcuaagcagucuggggagagcauggggaucauuucuaugug

SEQ ID NO: 119662 - RNA, 64 nt, Human
caccacucugggcagagcagagcaggguaugggguggggagagaggguggaggguuuuauaaac

SEQ ID NO: 119663 - RNA, 64 nt, Human
ccugggguucucccccuuucucuccagccugacuuggggagauggaguucuugugccauaguca

SEQ ID NO: 119664 - RNA, 64 nt, Human
cccccuccagcucaugacacuguuuggccuuucuuggggagaaggcgggguauucccacucacc

SEQ ID NO: 119665 - RNA, 64 nt, Human
gcuaauggagagcucccugggguuguccuggcucuggggagagagacggagccuuuaguacagc

SEQ ID NO: 119666 - RNA, 64 nt, Human
ccagggcugggugcagccagcuguccugcagcucuggggagaccagcacagaacugaggaacau

SEQ ID NO: 119667 - RNA, 64 nt, Human
caaugcuucuaugaauauuuccauguauuuugacuggggagaggcauggagaagaaacucucau

SEQ ID NO: 119668 - RNA, 64 nt, Human
uuuaaauuucuuauugccaaaagaacguguuuuauggggagaaacaaacucuuugaagccaguu

SEQ ID NO: 119669 - RNA, 64 nt, Human
cccugacaccucacaccuuaucuaagucugaagcuggggagaaagggguucauuuagacuucau

SEQ ID NO: 119670 - RNA, 64 nt, Human
ugcuauuguugaggaauaauucagugggucaaaauggggagauguacuggguaugaguggaagg

SEQ ID NO: 119671 - RNA, 64 nt, Human
uuuacaacccaagccauuccacccccuccccugcuggggagaaugacacaucaagcugcuaaca

SEQ ID NO: 119672 - RNA, 64 nt, Human
gcucaucucucccuucuguuuuaugugauuuguuuggggagaaagcuaaaaaaaccugaaacca

SEQ ID NO: 119673 - RNA, 64 nt, Human
uuuccuguggacucuggugauucauagagccggauggggagagucaacaggaaaaaaggaggga

SEQ ID NO: 119674 - RNA, 64 nt, Human
cuccaagugcggcacugcaaagagacgcuucaaguggggagaagcggcgauaccauagagucca

SEQ ID NO: 119675 - RNA, 64 nt, Human
ggaucccuucuccaccuccaaaggcccuaaaggguggggagagaucaccacucuaaccucggcc

SEQ ID NO: 119676 - RNA, 64 nt, Human
aucugugaggccagcaaauauuuucuuaaacucauggggagacagcagauucuugccuugguga

SEQ ID NO: 119677 - RNA, 64 nt, Human
ggcaacggaagacauuuauuucuccuuuggauuuuggggagaaccaagcccugguagggaagag

SEQ ID NO: 119678 - RNA, 64 nt, Human
auggaaauaacggguggcauuggguggcaacauuuggggagagauaaugaggcaacucagcagg

SEQ ID NO: 119679 - RNA, 64 nt, Human
cuauaaaaaaauuugugauaaguuucuaucaaaauggggagauugcagaaaaggcuucccuugg

SEQ ID NO: 119680 - RNA, 64 nt, Human
caagauaccaaauacaagauuuuaaaagcaaccauggggagaaaaagaucagugaaagcaagac

SEQ ID NO: 119681 - RNA, 64 nt, Human
aaaugacaugaauucaauaucuaaugucaaccaauggggagagccacaacuccaggagagguuc

SEQ ID NO: 119682 - RNA, 64 nt, Human
gucuuuccugcccaaguaaagcuuacagacuaacuggggagauguagugugcauacaaaacagu

SEQ ID NO: 119683 - RNA, 64 nt, Human
ccaaaauggugcuuuggauuugaaaagggucugauggggagaaggagaacguaucauccuagcu

SEQ ID NO: 119684 - RNA, 64 nt, Human
ugacugggaagggcugcuucucucguaagggucuuggggagaaguaagcccgcagccugccucu

SEQ ID NO: 119685 - RNA, 64 nt, Human
cagguacugcuccuccaugcccauggcugggccguggggagaagaagcucucauacgccuuccc

SEQ ID NO: 119686 - RNA, 64 nt, Human
ccaaugguuggugugucauggugccucaucauucuggggagacugaaaauaccuucaucacuga

SEQ ID NO: 119687 - RNA, 64 nt, Human
ccgaugugcacagcugccacagggagggaggucuuggggagaugggcagucagguggcccgucc

SEQ ID NO: 119688 - RNA, 64 nt, Human
cuccuguuuucuauuugucaugaaacaguguauuuggggagaugcugugggaggauguaaauau

SEQ ID NO: 119689 - RNA, 64 nt, Human
ggcuuuuugccugaggcugcacucuuggaaggcguggggagaguucugccuggagggggacugg

SEQ ID NO: 119690 - RNA, 64 nt, Human
ccuaucucccuggcucacuggcaggugugggaucuggggagagcggcuggagaaagaugcaguc

SEQ ID NO: 119691 - RNA, 64 nt, Human
cagaacagcugaaacauuccgaagagggaauggauggggagaauggucaauacacauaagaccg

SEQ ID NO: 119692 - RNA, 64 nt, Human
aggucuucauggcagaccaggccuucacagcuaauggggagaggaacucauguuaccucugcag

SEQ ID NO: 119693 - RNA, 64 nt, Human
cucgccuuuccugccccagccggcagaagcuguguggggagauaugaaugguacgggugaggag

SEQ ID NO: 119694 - RNA, 64 nt, Human
gcugagagggagcucaacuccccaccccgccacguggggagacagcccuucccacuggcucccu

SEQ ID NO: 119695 - RNA, 64 nt, Human
cugggaagccagccaugguaagggcuggugagguuggggagaaaggaagagcuuuauguuucuc

SEQ ID NO: 119696 - RNA, 64 nt, Human
ggaguuauuggcaagauuugugcaaaauaaaauauggggagacuugggaguugucuuugugguu

SEQ ID NO: 119697 - RNA, 64 nt, Human
auacgcccauuguggugugagcaggauggguugguggggagauucugccccaggagagguaaug

SEQ ID NO: 119698 - RNA, 64 nt, Human
ggaucgaaaucuaauugcuuuuuuuuuuaauuguuggggagaggaggaugagcagaacuccuau

SEQ ID NO: 119699 - RNA, 64 nt, Human
acucauagugugccuucuuagcugcuggagaauuuggggagaggauguacacagcacuggugcc

SEQ ID NO: 119700 - RNA, 64 nt, Human
cucucugcccuuggacccauuuauuauucacagauggggagaaccuaucugcauggaccucugu

SEQ ID NO: 119701 - RNA, 64 nt, Human
aggaagcaggggcccuccuggcagcuccucugaguggggagagguugggcagugagugagggac

SEQ ID NO: 119702 - RNA, 64 nt, Human
uuuuguuuccuuuucuugaaucagacuugugauuuggggagagcaacuucagggcuucuccaua

SEQ ID NO: 119703 - RNA, 64 nt, Human
aauaccucauugcauuucccuuugggcuucggcuuggggagauggaucaagcucagagacuggc

SEQ ID NO: 119704 - RNA, 64 nt, Human
ggguugggggagaggcugaggagagugugacauguggggagaggaccagcugggugcuugggca

SEQ ID NO: 119705 - RNA, 64 nt, Human
acugagaacucccucuggaauucuugggggguguuggggagagacugugggccuggagauaaaa

SEQ ID NO: 119706 - RNA, 64 nt, Human
gaauugaauugugcaauguugcuguucuggggacuggggagauuagcaucccauuugcccacac

SEQ ID NO: 119707 - RNA, 64 nt, Human
aucuuuaccucugauagaggucagaaugagguccuggggagaaucuaagcccuccgaugugugu

SEQ ID NO: 119708 - RNA, 64 nt, Human
ccacgcuuuugggaaaacugggugggauggaugcuggggagaagugagggcugggcagcugauu

SEQ ID NO: 119709 - RNA, 64 nt, Human
gcccuguaaagcuggccacagugugcagggagaauggggagagggucuucagugagguggcugg

SEQ ID NO: 119710 - RNA, 64 nt, Human
auuucuauaguucuccuggcagagccuuugagaauggggagaaacagccugggcuggggcuaca

SEQ ID NO: 119711 - RNA, 64 nt, Human
cugaagcuuuuuagugcauuaguggggaggaggguggggagacauaaccacugcuuccauuuaa

SEQ ID NO: 119712 - RNA, 64 nt, Human
acccugcuugagccaaagacaaggugaugagagauggggagaggccauuggcucccagagggaa

SEQ ID NO: 119713 - RNA, 64 nt, Human
ucuaguuauuuccuucccccucaccuuuuggccauggggagaauuugacauuuauucacuauag

SEQ ID NO: 119714 - RNA, 64 nt, Human
ccccuucuggggaggauuaaaagugaugauggucuggggagagauuuuauuaaaaaaaaaaaga

SEQ ID NO: 119715 - RNA, 64 nt, Human
gccccagagcuugcuguccccugagaccccauccuggggagaggggaggacuccucucccuacg

SEQ ID NO: 119716 - RNA, 64 nt, Human
ccucagaaauaugaggaagccuguaaaacucuaguggggagauauuaacuuggagaccuaaugc

SEQ ID NO: 119717 - RNA, 64 nt, Human
gggagccaugccaguguaguggaaaaguaguacauggggagauggggaguuuuuuugaaaacca

SEQ ID NO: 119718 - RNA, 64 nt, Human
uggguagugagauggaaauggugccugcagaaguuggggagaaggauacuuuugcacagccucc

SEQ ID NO: 119719 - RNA, 64 nt, Human
gaugcuuguucgcucagcuucuccauuuaugagauggggagaauagucacagccuccucaaagg

SEQ ID NO: 119720 - RNA, 64 nt, Human
uuccuuucuuuucuauuuuagauaccuggagggguggggagaaguaagaauuguaagggagguu

SEQ ID NO: 119721 - RNA, 64 nt, Human
uuaaccaauggaugagggggguggccacaggagauggggagaggagucugaacuaaaccccugg

SEQ ID NO: 119722 - RNA, 64 nt, Human
cucuuccuguucugcuccccugagaacagugugguggggagaggcagggcugagguggucuacg

SEQ ID NO: 119723 - RNA, 64 nt, Human
uucauuuauaagaagagaaccagccauauacacuuggggagauuugccacaucuuaaacuugaa

SEQ ID NO: 119724 - RNA, 64 nt, Human
gagcggggaaaccgcagcucagcccaggcccagcuggggagaaggcgcuaccugcgugggaccc

SEQ ID NO: 119725 - RNA, 64 nt, Human
aacauuucuuaugauuuuuaaaaguugcuaguacuggggagaaauaauuguugauuaauuugag

SEQ ID NO: 119726 - RNA, 64 nt, Human
auuugcuuccaguguuuaaaaauuaaaaaaagaauggggagaagguuaugagaagagcauuauu

SEQ ID NO: 119727 - RNA, 64 nt, Human
guuuucucuaaaguuaagaguuaggacaauccucuggggagagucuaguucacugcccucccuc

SEQ ID NO: 119728 - RNA, 64 nt, Human
cacauaaugaucaguaugcugugccagcuucauuuggggagaaauaacuaguagaaaguucugg

SEQ ID NO: 119729 - RNA, 64 nt, Human
ucauuuaaacuuuaaaaauauuuuaaauggacuuuggggagacauuuuuuguguguuuuaagaa

SEQ ID NO: 119730 - RNA, 64 nt, Human
auggguauuuguagggccggagggaugguagugauggggagaaggugaggaagggucacccucu

SEQ ID NO: 119731 - RNA, 64 nt, Human
aguagcccaggucggcuugucacucgcugugagauggggagauuuugucuuuugauuuaucccu

SEQ ID NO: 119732 - RNA, 64 nt, Human
guagaugauggugccagagggcagggagcucgccuggggagagggcugugccccguagggacag

SEQ ID NO: 119733 - RNA, 64 nt, Human
gacucacccagaccuggccagggaaugauguaucuggggagagaaugagcuggaggagggggcc

SEQ ID NO: 119734 - RNA, 64 nt, Human
agccccuccccugggcucucccaggcagggagaauggggagagggaccuccuugugucuggcag

SEQ ID NO: 119735 - RNA, 64 nt, Human
guuggaggaacgaaggcgagguuccuccuugcuuuggggagaaaaguauucaggaagugggugu

SEQ ID NO: 119736 - RNA, 64 nt, Human
uucauguuauuuauucgcggagcucuguucguguuggggagaugcccucgccugagccgucugg

SEQ ID NO: 119737 - RNA, 64 nt, Human
uucuuccccccaaccccuggcuauuuuauauuaauggggagaggggauuuuuaaaugucauaaa

SEQ ID NO: 119738 - RNA, 64 nt, Human
agcaaauccaucagcagggaucuguccccucuguuggggagagaggaagagugugugugucuac

SEQ ID NO: 119739 - RNA, 64 nt, Human
ccaagcccuggcccgucugugcacucuuggcuccuggggagauauaucugccuucuaagaaggc

SEQ ID NO: 119740 - RNA, 64 nt, Human
ggauuuauuuuuuucccccuuuucuuuauuuugcuggggagaggcuaaagggaaagguaguagg

SEQ ID NO: 119741 - RNA, 64 nt, Human
guuuaaaauuauugcuacucccaauuuagaaaaauggggagaaagcuggaagaacaaaugacau

SEQ ID NO: 119742 - RNA, 64 nt, Human
cugaaggacuaccagaauaaaacagggucuacaauggggagaacuuguuuuauagaugaggaaa

SEQ ID NO: 119743 - RNA, 64 nt, Human
uuugacaaggcagacgucguacccagccauguguuggggagacaucaaaaccacccuaaccucg

SEQ ID NO: 119744 - RNA, 64 nt, Human
gaauccacaccccaucaauuaucuuacuuucuucuggggagauagauagauauacuaucucacu

SEQ ID NO: 119745 - RNA, 64 nt, Human
uaaaauuucugaaaaccaaugcgacaaauaaaguuggggagaugggaaucuuugacaaacaaau

SEQ ID NO: 119746 - RNA, 64 nt, Human
gccucccaaaugggaguucuggcugagcccaggguggggagauccugggaagggaggcacugga

SEQ ID NO: 119747 - RNA, 64 nt, Human
gggccaauuucggaggagagaagaaagugcaacguggggagagggaagugaauugcagagggga

SEQ ID NO: 119748 - RNA, 64 nt, Human
uaccaggaagaaggacuuguuucccuuuccuguguggggagaggugugugacguuuuuccaguu

SEQ ID NO: 119749 - RNA, 64 nt, Human
cagccucauuuguaagcagcacugccucucuguuuggggagauguaaugcuggaagaucuuaag

SEQ ID NO: 119750 - RNA, 64 nt, Human
cuucaccuggaggggccagagggucaccuggagcuggggagacacaucugccuuccucugcagg

SEQ ID NO: 119751 - RNA, 64 nt, Human
guuuucugaaggggcgacuuaaaacuguggagaguggggagaguucggaaagaaauauguuuuu

SEQ ID NO: 119752 - RNA, 64 nt, Human
uaucagggcagcucugccuccuccucccaugagguggggagaggcaacagggcagcccccagag

SEQ ID NO: 119753 - RNA, 64 nt, Human
ccuggagcuaauggcgaucaucuuugccaccaccuggggagagccugcuugggaaugaaauuaa

SEQ ID NO: 119754 - RNA, 64 nt, Human
ccucuggcgucagucuuuucccucauccacucacuggggagauuggacuagaggaguccugaga

SEQ ID NO: 119755 - RNA, 64 nt, Human
cuucacccucaguuuccucacuugaggagugggauggggagaacagagaguagcuguguuugaa

SEQ ID NO: 119756 - RNA, 64 nt, Human
agagcaauuuauacuuuacccucaggcuguccucuggggagaaggugccauggucuuagguguc

SEQ ID NO: 119757 - RNA, 64 nt, Human
gagggugagggcugagugcccuggcuuccucacuuggggagaccaugggucucuguagaaauuc

SEQ ID NO: 119758 - RNA, 64 nt, Human
augccccuaauuugcuuccucaucuuggaggguuuggggagaaguuggcgugccacccccacaa

SEQ ID NO: 119759 - RNA, 64 nt, Human
guaaauguguuuaaaacaggucuuugucuugcuauggggagaaaagacaugaauaugauuagua

SEQ ID NO: 119760 - RNA, 64 nt, Human
gguuucaaauaacccaugugucccugguuggggcuggggagagugagaagcugagauacugggc

SEQ ID NO: 119761 - RNA, 64 nt, Human
agguugcccuuuccuuuuaaaaggcccuguggucuggggagaaaucccucagaucccacuaaag

SEQ ID NO: 119762 - RNA, 64 nt, Human
agcugaaaacaaacaagaggacuguguuguggucuggggagaauguaaucauuccuuccacaac

SEQ ID NO: 119763 - RNA, 64 nt, Human
ucugcauuuucuaaaaaauuccaugcagguguuuuggggagagguauuuuuuaagcaaugaaaa

SEQ ID NO: 119764 - RNA, 64 nt, Human
ggcccaggagaaccagagaugaucccgaggcagcuggggagaggccccgccucuggugggcuug

SEQ ID NO: 119765 - RNA, 64 nt, Human
aaguagcacuguucugguucuguuugcacgccaguggggagagaauaaagaggaaaauuuaaca

SEQ ID NO: 119766 - RNA, 64 nt, Human
ucuuauaugguauaaauuaaaguucaggcauuuauggggagaaaaggcccuccccaccgacccg

SEQ ID NO: 119767 - RNA, 64 nt, Human
gucacugugggcuggggugauggugucugaccaguggggagauuggaaugggauuacuuuggcc

SEQ ID NO: 119768 - RNA, 64 nt, Human
gcagcccuguucccuucgccucuacugcgaggccuggggagauguuguuuucaugcugcuucca

SEQ ID NO: 119769 - RNA, 64 nt, Human
uucgaaggguauccaagguucuguauuuauuuauuggggagacacuaacccuucaaagaagcag

SEQ ID NO: 119770 - RNA, 64 nt, Human
ggcuugggguguguagaaugauuuugcgggggaguggggagaaagaugaaagaggucuuauuug

SEQ ID NO: 119771 - RNA, 64 nt, Human
gccauggugagggcuaucugcugcaggggggucuuggggagaguggugacuccauugacccagc

SEQ ID NO: 119772 - RNA, 64 nt, Human
uuccagagaguggcuggaagagacuccaggccccuggggagacuguacuguuccugaacacugg

SEQ ID NO: 119773 - RNA, 64 nt, Human
guggcuucauuauacugagccaugugucagaggauggggagacaggcaggaccuugucucaccu

SEQ ID NO: 119774 - RNA, 64 nt, Human
ucuucaggggucuuuuguuuugaaauacucaggauggggagagguuuauuuaagaacgaauuau

SEQ ID NO: 119775 - RNA, 64 nt, Human
guguuuaagcaccauggccuugaugauucacuguuggggagaagaaacaagaaaaguaacuggu

SEQ ID NO: 119776 - RNA, 64 nt, Human
ggacacaccuucccugagacucaugacaugagccuggggagaccucauuugguuuccguucaga

SEQ ID NO: 119777 - RNA, 64 nt, Human
gcugaguuauuaauagccagagccacugggagacuggggagacuggcuguaacccccuucacac

SEQ ID NO: 119778 - RNA, 64 nt, Human
cucagcacccacaccuccuccaacaagcuccugcuggggagagggcuguuaagguuucuguuuu

SEQ ID NO: 119779 - RNA, 64 nt, Human
cacuggacuagaaccuaaggguccugaaagaguguggggagaaauaagaauggaaagguggcuu

SEQ ID NO: 119780 - RNA, 64 nt, Human
uuggcgaggaggcgugugcugcagcuacgggcccuggggagaguuucgugaaggcuggcacgug

SEQ ID NO: 119781 - RNA, 64 nt, Human
aaggaaucaccugagccuguccguccaccaggaguggggagaugcccccauccaguccuggagg

SEQ ID NO: 119782 - RNA, 64 nt, Human
gugcucagggacuggggaacaagacggggugggguggggagaugggcauuuggagagucucaug

SEQ ID NO: 119783 - RNA, 64 nt, Human
auuaauuugguugucaaguuuugggggugggcuguggggagauugcuuuuguuuuccugcuggu

SEQ ID NO: 119784 - RNA, 64 nt, Human
aaacacuucugccccacuucaaauuacaagauuauggggagaacccaauuagguaggaaacaug

SEQ ID NO: 119785 - RNA, 64 nt, Human
cacacaacacuuauguaugcaccccaaagacuaauggggagagggagggccgggaagccaggaa

SEQ ID NO: 119786 - RNA, 64 nt, Human
gaugagaaugaaaaauuccaaaagugcugagcuuuggggagaaauaaucuuagaaagaaauugu

SEQ ID NO: 119787 - RNA, 64 nt, Human
gccucuucucccaaucaagguugaggaguggggcuggggagaggacuuaacugacuuaagaagu

SEQ ID NO: 119788 - RNA, 64 nt, Human
uguuuucuuuacgagagggucucacccaaauuuauggggagaaaucuauuucucaaaaaaaaaa

SEQ ID NO: 119789 - RNA, 64 nt, Human
ugguuagaaguaguugagggagagauugggggaauggggagaugaugaugauggucaaagggug

SEQ ID NO: 119790 - RNA, 64 nt, Human
aaguguuuuuaguaugcuuuuagucucuuguaacuggggagaagcaguguuuuuuuuuuaggaa

SEQ ID NO: 119791 - RNA, 64 nt, Human
ggcuaaacaacaugcaucucauuucuucuuggaguggggagaugcgggaagcugacccaguggu

SEQ ID NO: 119792 - RNA, 64 nt, Human
gaugugcucccugaaacagacaaccacacgcuguuggggagagaaggauggagauaggauggag

SEQ ID NO: 119793 - RNA, 64 nt, Human
ccacuguuuuccuugcuguuauuuuuccaagucuuggggagaaaacauccuccucugauggcca

SEQ ID NO: 119794 - RNA, 64 nt, Human
cagcucuguggaucauguuccuaaaagaugcucauggggagaaaauguuuacagacaaauaauu

SEQ ID NO: 119795 - RNA, 50 nt, Human
agaggcccgacgaauggugauggggagagccugaaaggcaggcucuguua

SEQ ID NO: 119796 - RNA, 64 nt, Human
agaguaacugaaagaccugcgggacugauucacguggggagaauguucacagcacugucacccg

SEQ ID NO: 119797 - RNA, 64 nt, Human
uucucugugggagggagggaguccuguguguuuguggggagagggaaggaggaagucaguuauu

SEQ ID NO: 119798 - RNA, 64 nt, Human
guaauaaacuuacucuuauacaaaguggacacuguggggagauacagagaaauggaagauacgg

SEQ ID NO: 119799 - RNA, 64 nt, Human
aaauuuguuucaaauaugcaggaauguuuggauuuggggagaguagaaggagagauuugcuuga

SEQ ID NO: 119800 - RNA, 64 nt, Human
uauugaaucaucaaauaaaagaauguggcuauuuuggggagaaaauuaugugugugugugcuca

SEQ ID NO: 119801 - RNA, 64 nt, Human
uuuucuauaaaaaucuggaagcaaagaauggggauggggagagcuacgugguaguauguuuuua

SEQ ID NO: 119802 - RNA, 64 nt, Human
gcuauuacuuaaacucguauuugaauaagucucuuggggagaauuauagaauguuuguuuuugu

SEQ ID NO: 119803 - RNA, 64 nt, Human
cgaggcccuggggaucaaaggucaaugaguuagguggggagaaagaucccugggggcuccugua

SEQ ID NO: 119804 - RNA, 64 nt, Human
uaacugcagccaccagguaugaaaaggagccugguggggagaccacugcacccaaaacaaaucc

SEQ ID NO: 119805 - RNA, 64 nt, Human
acauaguaguagcgguggucagacauggaaaugguggggagacaaaaauauacaugugaaauaa

SEQ ID NO: 119806 - RNA, 64 nt, Human
agaggguggcaggcagugguuguggcaguggagcuggggagauguggucggauuagggagguag

SEQ ID NO: 119807 - RNA, 64 nt, Human
ucugaaaagacaguugugugcauggaugugugcguggggagaaagaacguggguaagauguccc

SEQ ID NO: 119808 - RNA, 64 nt, Human
uccagucccacuccugucaccccacgcucugcacuggggagaaaacgggaggugcucgugcugg

SEQ ID NO: 119809 - RNA, 64 nt, Human
acacccaggcggcccgcccuugccugucugcaccuggggagaagccggcgcuccugcucccucc

SEQ ID NO: 119810 - RNA, 64 nt, Human
gauaaacauugaaugagggugagggcaucccugcuggggagaaaccucugucccuaggaagagu

SEQ ID NO: 119811 - RNA, 64 nt, Human
acaaaaagauaauuuagagucucaaaguaagauuuggggagauguccauuggagacagaagugg

SEQ ID NO: 119812 - RNA, 64 nt, Human
ggcaaaauggugcauguaauacuuuugcaaguguuggggagaucgguauguuuugaaaagagua

SEQ ID NO: 119813 - RNA, 64 nt, Human
uuauuuuaaugaaacccugauugacgcacagcaguggggagaacagcgucuuuuaccugucacc

SEQ ID NO: 119814 - RNA, 64 nt, Human
uggggagggugggcccagcucagcagggacaguuuggggagaguccgagaggcugggcugauuc

SEQ ID NO: 119815 - RNA, 64 nt, Human
cccacucuggaugccagggucacugggguugggcuggggagaggaacaggccuugggaaucagg

SEQ ID NO: 119816 - RNA, 64 nt, Human
ccccagcaggggagucggaagagcuuggaagagcuggggagaggguaggggaaagguuuuucca

SEQ ID NO: 119817 - RNA, 64 nt, Human
cccagaaucuaggauucucucccuggcugacagguggggagaccgaaucccucccugggaagau

SEQ ID NO: 119818 - RNA, 64 nt, Human
cucccuucccccuaagccaaccgcacugaaggaguggggagaagagcauacgccaggagccucc

SEQ ID NO: 119819 - RNA, 64 nt, Human
ggcuagaaugcccgggcuggugcccaccaggggcuggggagaaggagggguggcaugaugagga

SEQ ID NO: 119820 - RNA, 64 nt, Human
aguguuuucagugcccugaaucaaacuauaaauguggggagaaaucaccuccaucaaacaguug

SEQ ID NO: 119821 - RNA, 64 nt, Human
uaaucacauuaugaucuugacaggugcacuuuacuggggagaauaaaaaggaccauacgguaaa

SEQ ID NO: 119822 - RNA, 64 nt, Human
gaggauaugaguagccccaacccaaaccuggagauggggagaaaccuacagaauacuagccaga

SEQ ID NO: 119823 - RNA, 64 nt, Human
gugucuguguucguguaggcauaaugugaggagguggggagaccaccccacccccauguccacc

SEQ ID NO: 119824 - RNA, 64 nt, Human
cgauuauggguaagauuggccagagguaggaauguggggagaaggagaggcugaaaagaaagca

SEQ ID NO: 119825 - RNA, 64 nt, Human
cuccacccuccucuagccaucccuuggggaaggguggggagaaauauaggauagacacuggaca

SEQ ID NO: 119826 - RNA, 64 nt, Human
gucuucuuggcagcuuaacauugacuucuugguuuggggagaaauaaauuuuguuucagaauuu

SEQ ID NO: 119827 - RNA, 64 nt, Human
uguaggaauccuuugagaaugugauuccuuuugauggggagaaagggcaaauuauuuuaauauu

SEQ ID NO: 119828 - RNA, 64 nt, Human
uuuuucauaggggaguuuuggacaaaacagucacuggggagaucacugccauuuuuacacacuu

SEQ ID NO: 119829 - RNA, 64 nt, Human
agauggugcgaacagcagagcaggcaagggaaacuggggagauggggauggaggaggaaggcug

SEQ ID NO: 119830 - RNA, 64 nt, Human
gggccagccagguucugcugggaagggaagggaauggggagaagggagaagcaagcagugucug

SEQ ID NO: 119831 - RNA, 64 nt, Human
aaagagcccuggcucugccccucagggggccagcuggggagaugggggcuucuuccucacacug

SEQ ID NO: 119832 - RNA, 64 nt, Human
aggagagcuaugaggccucacugggggcagaacuuggggagaccgaagccggcccuuccacucc

SEQ ID NO: 119833 - RNA, 64 nt, Human
aaauuaaaagcccuaccuaaaacugagguggggauggggagaggcuuugccuccaccauuccca

SEQ ID NO: 119834 - RNA, 64 nt, Human
cucagaacuguugcauggauccuguguuugcaacuggggagacagaaacugugguugauagcca

SEQ ID NO: 119835 - RNA, 64 nt, Human
augccacagugaccagggccauggccggucccucuggggagaugggacacggcuccuggcagca

SEQ ID NO: 119836 - RNA, 64 nt, Human
uuuggccauaagcucauaugcugcccccaaagacuggggagagcugugugccucaguguugcag

SEQ ID NO: 119837 - RNA, 64 nt, Human
augaacaucucauuggaccucagaaaacccacccuggggagaagccccagcaagugugaaaaaa

SEQ ID NO: 119838 - RNA, 64 nt, Human
agaagucugauaucuugggcagcuugcugcuuacuggggagaccagcaugcuuagacacuuauu

SEQ ID NO: 119839 - RNA, 64 nt, Human
aucaucccagcuaaguucauuauuccucaugggguggggagaugcugaaagggguauuguauau

SEQ ID NO: 119840 - RNA, 59 nt, Human
uuucuccagcagccaagugauggccacgcuggggagaagguggacagauuugggaggcc

SEQ ID NO: 119841 - RNA, 64 nt, Human
acaccaugguuaggugauagggucugaacccaguuggggagacagagggguucagacuugggaa

SEQ ID NO: 119842 - RNA, 64 nt, Human
uucucauuuuggguuuucucuucuccugcuuuccuggggagagauuaagcgcucauuaagcaga

SEQ ID NO: 119843 - RNA, 64 nt, Human
ggcuggagcagcgagaaugcuucacggaggauguuggggagagaggauuugauuugccgagugg

SEQ ID NO: 119844 - RNA, 64 nt, Human
guggacagccagaggggccacuucaggauggauguggggagaguggaagaggcagggaguaauc

SEQ ID NO: 119845 - RNA, 64 nt, Human
ucuguauggaggcugcucaccccacagacacugguggggagaccauggcucagaggaagggugg

SEQ ID NO: 119846 - RNA, 64 nt, Human
aucagccaccgagucuccuggucugucuccaggcuggggagagaagggugaccaggcgaggagg

SEQ ID NO: 119847 - RNA, 64 nt, Human
ucagggaaaacagaagcaaaggagagcuuggggguggggagaaaagacaaaugugcucuauguc

SEQ ID NO: 119848 - RNA, 64 nt, Human
uucagaguugaugcuggauguucagauuccuaaguggggagagaguuuggacaucucacucaaa

SEQ ID NO: 119849 - RNA, 64 nt, Human
gauaguuuuaugauucacacagguuugaggaugcuggggagagggggagggggcugugguggug

SEQ ID NO: 119850 - RNA, 64 nt, Human
gcagcaggugcuggcguaggcggcccagcccuccuggggagacgugacucugguggacgcagag

SEQ ID NO: 119851 - RNA, 64 nt, Human
ugaauuuuuuauagguuaaaugucauuuuagagauggggagagggauuauacugcaggcagcuu

SEQ ID NO: 119852 - RNA, 64 nt, Human
uuuaguuauaagugaagcaugguugaauaccagcuggggagacacuagggaagggagcuuugua

SEQ ID NO: 119853 - RNA, 64 nt, Human
aguuucugccugggcaauggccaggggccaggaguggggagaguugugauggaggggagagggg

SEQ ID NO: 119854 - RNA, 64 nt, Human
ggaugcuaccucucccuuucccacuugaggacccuggggagagaugggggcggggaaaauggag

SEQ ID NO: 119855 - RNA, 64 nt, Human
aauacagagcuguccacucuugaacuggaccgucuggggagaauugagaagcugccucucacug

SEQ ID NO: 119856 - RNA, 64 nt, Human
cuuuguguagaguccagggcagcuggagcuuuguuggggagacuucuggacccaaagggagcuu

SEQ ID NO: 119857 - RNA, 64 nt, Human
acucaauccuuaguacacauaagaaaauucauacuggggagaaaccccacaaauguggagaaug

SEQ ID NO: 119858 - RNA, 64 nt, Human
cacaaaaauaaguuaaaaagaaauauuugugccuuggggagaagaaacauggugaaaacaggcu

SEQ ID NO: 119859 - RNA, 64 nt, Human
gggcgccaagcagugacuucugaccaacagaguguggggagaagggauguguauuagccccgga

SEQ ID NO: 119860 - RNA, 64 nt, Human
ucagcugcgugaccacggaaacucacugguacaguggggagaccuguaaccagggcacccagaa

SEQ ID NO: 119861 - RNA, 64 nt, Human
uggguauuaagugcagucacucuccuagaugcuguggggagaaggcaaguuacaaagauagacc

SEQ ID NO: 119862 - RNA, 64 nt, Human
cacaggaaauucuauuugagccacccuuccgcacuggggagaaucuaugcaagccucgucaaca

SEQ ID NO: 119863 - RNA, 64 nt, Human
aggaagccauagaugcuggcuggguuccagguuauggggagaagaaauacagucaauaaaaggu

SEQ ID NO: 119864 - RNA, 64 nt, Human
cccgugcuuaugcucuucuaugagagagaugaauuggggagaauugucuccauuuuauagauua

SEQ ID NO: 119865 - RNA, 64 nt, Human
ccugacaagugaaguuguaaacacagugugguuauggggagagggcauauaaauuccccauauu

SEQ ID NO: 119866 - RNA, 64 nt, Human
aaccucgggcuccugccuggaccagugacagcauuggggagagaagcacugggggucuucagac

SEQ ID NO: 119867 - RNA, 64 nt, Human
guaagcaguucccaaagaacauaggacuuauguuuggggagaggguuguuuuuauuacaguaca

SEQ ID NO: 119868 - RNA, 64 nt, Human
cucacccaggucuccagcaaacggaggacugaacuggggagagucacccugagccagcccuucc

SEQ ID NO: 119869 - RNA, 64 nt, Human
gagauacuguuguccccuucuggggcacggucuuuggggagaggggagugcauuuagacuuaug

SEQ ID NO: 119870 - RNA, 64 nt, Human
gcugggcgagcugggcgagcugggcgagcugggcuggggagagccugugaggaccgagaggaga

SEQ ID NO: 119871 - RNA, 64 nt, Human
ugauuaauuuaaaauguuauuaagggccuugagauggggagauuauccugaauuacuuuggagg

SEQ ID NO: 119872 - RNA, 64 nt, Human
ggguaagaagaggauguaaggcagcugguguuaauggggagaaaagcucagagagaugcauuuu

SEQ ID NO: 119873 - RNA, 64 nt, Human
acuguccaggcucuggggucuugugaugagggucuggggagaaagugggcccggggggaccccg

SEQ ID NO: 119874 - RNA, 64 nt, Human
gaaugcacacaaagacagcaacuuuuguacagaguggggagagacuuuuucuuguauaugcuua

SEQ ID NO: 119875 - RNA, 64 nt, Human
aguaugaugacuaggaagccuacugucaugagaguggggagacaggcagcaaagcuuaugaagg

SEQ ID NO: 119876 - RNA, 64 nt, Human
acauuacagccuuagaagaaagauugugaaaagcuggggagaaaaugcuuaaggacaugcuagg

SEQ ID NO: 119877 - RNA, 64 nt, Human
cuugggcgcucggucuccaccccagggucauaaguggggagagagcccuucccagggcacccag

SEQ ID NO: 119878 - RNA, 64 nt, Human
cuggacuucugggagaaugaacccgagguugguuuggggagacaggugaggcggucggaucuac

SEQ ID NO: 119879 - RNA, 64 nt, Human
cuggcaagcacucagcccagccucgagguccuucuggggagaguguaaguggacagaguccugg

SEQ ID NO: 119880 - RNA, 64 nt, Human
gagacuccagccucuccuccuggggccacccaaguggggagaaccccuaguguccugccacaac

SEQ ID NO: 119881 - RNA, 64 nt, Human
caccgcagggacaagcccuggagaaaugggagcuuggggagaggaugggagugggcagaggugg

SEQ ID NO: 119882 - RNA, 64 nt, Human
ugcuuuuuucuguuccccuccgcuuucugaagccuggggagaaaucagugacagagguguuuug

SEQ ID NO: 119883 - RNA, 64 nt, Human
cagaacauuuugagucaccuugggagauucaggauggggagagcaaauuugaacaaaagguuuu

SEQ ID NO: 119884 - RNA, 64 nt, Human
cgggcccaggcccuggcagagaaacagggaggccuggggagagcuacccgccagcuugggcugc

SEQ ID NO: 119885 - RNA, 64 nt, Human
aacuaagccaggccuggcuggaggagcagcagcuuggggagagggauuucccugcagaccucaa

SEQ ID NO: 119886 - RNA, 64 nt, Human
ucaccgcuggcccuuagagaccccgagguagggguggggagaugcuucucuccuugccccccgc

SEQ ID NO: 119887 - RNA, 64 nt, Human
ugcuuucucguggguccuuuggcaggccucccuuuggggagagggaggggagagaccacagccg

SEQ ID NO: 119888 - RNA, 64 nt, Human
gucucucugggaugagucaggaggccuggaggcuuggggagagguguggagaaggagagaacau

SEQ ID NO: 119889 - RNA, 64 nt, Human
gcuucccucuuaggccucagggcaguuugaucuguggggagaaagagcagccaucgcugagccu

SEQ ID NO: 119890 - RNA, 64 nt, Human
gggcugcgugcaugucgauaagcagagcuguucuuggggagaaggagggaggucucgggagugu

SEQ ID NO: 119891 - RNA, 64 nt, Human
uauuuugaaggauaaaauguuuauaauuggggaguggggagagaagaagaaauuauuguucaug

SEQ ID NO: 119892 - RNA, 64 nt, Human
accucuccauauuuaauuuauaugauaaaauagguggggagagucugaaccuuaacugucaugu

SEQ ID NO: 119893 - RNA, 64 nt, Human
uggggacaacguccccccacugcugcccuagagcuggggagacgcugggaaagguucaaccucc

SEQ ID NO: 119894 - RNA, 64 nt, Human
gaccaugccggggugcugccugggcaggccauguuggggagacuccagcaccguggggcugccc

SEQ ID NO: 119895 - RNA, 64 nt, Human
cgucuccaaagccaggauucugaggaaaguccuguggggagauucugaccacugucccauagga

SEQ ID NO: 119896 - RNA, 64 nt, Human
ugaaaugcuuuuuguuugcuucaguuuuuuaucauggggagaucuuuuuccucagaauuguuuu

SEQ ID NO: 119897 - RNA, 64 nt, Human
ucagcugaagccuggccuaguugcugagaggggcuggggagauggggcgggagggccagacuca

SEQ ID NO: 119898 - RNA, 64 nt, Human
agagcugggcugccuggggggagugggagggagguggggagagcuagcccaggccaggggucaa

SEQ ID NO: 119899 - RNA, 64 nt, Human
uuucccagcaccgcggagcugcacugcacaccuguggggagacuuuuccagcugggccaaggga

SEQ ID NO: 119900 - RNA, 64 nt, Human
cuaauguuuaauuacauaugguaacccuaaggccuggggagaaaagcuuuuaaaucuugccuuc

SEQ ID NO: 119901 - RNA, 64 nt, Human
auggcagaaacugcugagaccuauuucccuuucuuggggagagaauaagugacagcugauuaaa

SEQ ID NO: 119902 - RNA, 64 nt, Human
gcugugaaaacccuagacgcacccgcagggaggguggggagagcuggcaggcccagggcuuguc

SEQ ID NO: 119903 - RNA, 64 nt, Human
ucggguuggggcccaagggagguguggugucaucuggggagaacaggagggcaugucccuuugg

SEQ ID NO: 119904 - RNA, 64 nt, Human
uacuuuuuaguuguucagcaacugucuuauuuaauggggagauuuuaaguaacauaacuagugg

SEQ ID NO: 119905 - RNA, 64 nt, Human
aggaaagguagggcagaguuguuuuguucuggcuuggggagagugggauccauccucauccugg

SEQ ID NO: 119906 - RNA, 64 nt, Human
cccccugaggccccucuccaagaggagcacacuuuggggagauguccugguuuccugccuccau

SEQ ID NO: 119907 - RNA, 64 nt, Human
cguccuguccucgagaucaccgcgucacgacuuuuggggagacucacccccaccaacaccgucc

SEQ ID NO: 119908 - RNA, 64 nt, Human
acccaacggaaccauuuuccaguuugauacagaauggggagaaaagaaagcguuugaaauuauu

SEQ ID NO: 119909 - RNA, 64 nt, Human
ucuggaucauauagcugauguguaguuacacauauggggagacacuuuugagaguguuuaagca

SEQ ID NO: 119910 - RNA, 64 nt, Human; identical to SEQ ID NO: 119837

SEQ ID NO: 119911 - RNA, 64 nt, Human
cccuuugcaagucuuuacaaaagaaaaaaggcaguggggagagagaguguuuugguuacaucag

SEQ ID NO: 119912 - RNA, 64 nt, Human
gcuuaucucuucauagaaauuauacaaagagaauuggggagacagcuaagaagaaaacaaagaa

SEQ ID NO: 119913 - RNA, 64 nt, Human
cccagacuaggaggcagcggggauagacagggaauggggagaagaaagacccccauugguuugg

SEQ ID NO: 119914 - RNA, 64 nt, Human
gccccggaugacuuggggacaccccagaauccccuggggagaacccuuccugcgcgcuuucauu

SEQ ID NO: 119915 - RNA, 64 nt, Human
gcuuuggguggaaaacagccagcuuuggcgcuguuggggagacuccuccagaccaggaacccca

SEQ ID NO: 119916 - RNA, 64 nt, Human
uuaacuuguuuguuggugacacaguuguucagaguggggagaauucaccccauucugucccugc

SEQ ID NO: 119917 - RNA, 64 nt, Human
cgguugaaucuuagagaaaaaagcccgggagggguggggagaauuucgaagauguauuucaucu

SEQ ID NO: 119918 - RNA, 64 nt, Human
caugcagugugaguagaaggaagucaacaauauguggggagagcacucgguugucuuuacuuuu

SEQ ID NO: 119919 - RNA, 64 nt, Human
agccuuucugaaucuauaauaaugguacuucuacuggggagaguguaauauuuuggacugcugu

SEQ ID NO: 119920 - RNA, 64 nt, Human
gugguauucaaggcaguuuuguagcaccuguaauuggggagagggagugugccccucggggcag

SEQ ID NO: 119921 - RNA, 64 nt, Human
acgagaaacacugcuucuccaggcccgggguuguuggggagagaggcagaggcagcuggagcgc

SEQ ID NO: 119922 - RNA, 64 nt, Human
ggauucgggaggcugauguuucuucugaggggaauggggagagagaggaagcgacugagcccuu

SEQ ID NO: 119923 - RNA, 64 nt, Human
cuuuagguacuucaguuaugaaguaggcuuuucauggggagagauugggauuaugcucucuguu

SEQ ID NO: 119924 - RNA, 64 nt, Human
agcuuucagagucuucacuggcaguagggggagauggggagaggaaugaucucugcccagcccc

SEQ ID NO: 119925 - RNA, 64 nt, Human
aagagagaguggguuugggaagagugagggugguuggggagaggggaccgaugugccucauugu

SEQ ID NO: 119926 - RNA, 64 nt, Human
aggaggauuggugguagggggcaggcagaggggguggggagaaguuuccugggcuccaucaaug

SEQ ID NO: 119927 - RNA, 64 nt, Human
uauuaaacaugggaaacugaagcccuugaagguuuggggagagggggguaucaggcagggaggg

SEQ ID NO: 119928 - RNA, 64 nt, Human
ugccauugcccagggguagcccuucgguaugggcuggggagaaggguuggucuucugccagggu

SEQ ID NO: 119929 - RNA, 64 nt, Human
ggccccccagccagggaucccagaggcugaggguuggggagaggaagccaucaucucauuaccu

SEQ ID NO: 119930 - RNA, 64 nt, Human
gcugccaagagccccucaagagaagggcugaaccuggggagaugucacugccagggugaggugg

SEQ ID NO: 119931 - RNA, 64 nt, Human
uuguuugauuaacagcagcugauccugaaagucuuggggagaucuugagaguccugaagcaggc

SEQ ID NO: 119932 - RNA, 64 nt, Human
gaaggcugggugcuucuugcucugacagccagucuggggagaugacucuuacguugcuugaguc

SEQ ID NO: 119933 - RNA, 64 nt, Human
cucgccugcagagcagcccagaaagagcccugacuggggagagaacauuuuagaaucucuagug

SEQ ID NO: 119934 - RNA, 51 nt, Human
aagcaaaaggccuguucugaguggggagacgccagaggagccucacgguca

SEQ ID NO: 119935 - RNA, 64 nt, Human
guggaucuuuuacaccacaucacagugaacacacuggggagacgugcuuuuuuggaaaacucaa

SEQ ID NO: 119936 - RNA, 64 nt, Human
gcuccuggguuuuguauucucugagcugugcagguggggagacugggcugagggagccuggccc

SEQ ID NO: 119937 - RNA, 64 nt, Human
acucgaccccaggagcagaguacaggagacaccauggggagagacccugguguguccuucaagg

SEQ ID NO: 119938 - RNA, 64 nt, Human
agcccuaggcagaauaaagcauuaaaauuucuuuuggggagagacugucuaguaauuuaaaaug

SEQ ID NO: 119939 - RNA, 64 nt, Human
acaaugaaaugugaaauuacuugucugaaccccguggggagaaauaaauaauuuucccaaaguu

SEQ ID NO: 119940 - RNA, 64 nt, Human
uuguaagugacaaaacuccagcugaugcugggaauggggagagggcccuugagggacuuugugg

SEQ ID NO: 119941 - RNA, 64 nt, Human
ccucugcuucaccaaagcccgagcccucagccccuggggagaacaaauggcugagcuuugauac

SEQ ID NO: 119942 - RNA, 64 nt, Human
uuucuugguuuccaacagaagucaaauguguuuguggggagaacguuuugcuaggauuuugaca

SEQ ID NO: 119943 - RNA, 64 nt, Human
cccauucccugcccaccagaaacucagaggugauuggggagacugacacaggaaaaugaacuua

SEQ ID NO: 119944 - RNA, 64 nt, Human
cugggagcgaccacuuuggcugcggggaggcgcguggggagagaucucaaccagagaaguuacc

SEQ ID NO: 119945 - RNA, 64 nt, Human
uuuuugcuaauaggaaaaucacauuacuacaaaauggggagaaaacuguuugccugugguagac

SEQ ID NO: 119946 - RNA, 64 nt, Human
agagagugaacccagcagaggugugacgggaggcuggggagagaccccagcaccuugagcacac

SEQ ID NO: 119947 - RNA, 64 nt, Human
uuucaaauuaauugcaguaaaaacaaaagaguaguggggagagaaaaacaauccaauacauauu

SEQ ID NO: 119948 - RNA, 64 nt, Human
agauguuuugaguuauuucccuuaaguguuucacuggggagagaacagggagugcuccuccagc

SEQ ID NO: 119949 - RNA, 64 nt, Human
cucagaauguguggacaggucagcuuagaagagauggggagauucaggaucccccugugccaga

SEQ ID NO: 119950 - RNA, 64 nt, Human
ccccauuuuagccuaauuuggcuuaaacgcaguauggggagaauuguucccauuccauguguuc

SEQ ID NO: 119951 - RNA, 64 nt, Human
ggccgcuggcccaggguaggggaggguggggcaauggggagaggcaaaugcaguuuauuguaau

SEQ ID NO: 119952 - RNA, 64 nt, Human
cucugcuggugcuaagugugauuaggaagaagccuggggagaggugagucuggaauuuugguca

SEQ ID NO: 119953 - RNA, 64 nt, Human
gaccuaaauuaagcucauuuuuaggcuuugauuuuggggagacaaagggaaaugcagccauaga

SEQ ID NO: 119954 - RNA, 64 nt, Human
ucuucugccucccuuccuacuccuuuugguuuuguggggagaggggaaggaucagggggccagg

SEQ ID NO: 119955 - RNA, 64 nt, Human
uuucaccugaccaggcugggguuuggaguggcuguggggagacccguccuggcuggcuggcugg

SEQ ID NO: 119956 - RNA, 64 nt, Human
gaccuggacacuagggucaggcggggugcugugguggggagaggcauggcuggggugggggugg

SEQ ID NO: 119957 - RNA, 64 nt, Human
gcugugguggggagaggcauggcugggguggggguggggagaccugguuggccgugguccagcu

SEQ ID NO: 119958 - RNA, 64 nt, Human
ucucugcucucuccuuagggagcucgaguccugguggggagaacaggaguaaacaaggacuuga

SEQ ID NO: 119959 - RNA, 64 nt, Human
uacagcccuauccccccuccuugcuucugugaaauggggagacaaagcacuuuugcucuccaaa

SEQ ID NO: 119960 - RNA, 64 nt, Human
ucugaagcugaugcuuauuaaaacaaaugauguauggggagaggagaaggaagggcaaggaagg

SEQ ID NO: 119961 - RNA, 64 nt, Human
uguccucaguggaaggugaugggggccggugcuguggggagaguagaaagagggguuggcauga

SEQ ID NO: 119962 - RNA, 64 nt, Human
uuuuucacaaucucagccagccugcggugugaccuggggagaaaguugagugucaggggacaug

SEQ ID NO: 119963 - RNA, 64 nt, Human
cuaaaguaaaacccuuuugagggaagagggagacuggggagaagggaaaagagagaaggcaggg

SEQ ID NO: 119964 - RNA, 64 nt, Human
uguguuaucugcgccuucgaugaagugagacccuuggggagaacgggcuguggaugaaggagug

SEQ ID NO: 119965 - RNA, 64 nt, Human
ccuguugcucacugaccugugaccagguccaauguggggagaaauaugaaggagguagcagccc

SEQ ID NO: 119966 - RNA, 64 nt, Human
uagcagaguccagugccuugcagagccugaagccuggggagaaggcccagccugggacccucug

SEQ ID NO: 119967 - RNA, 64 nt, Human
gaagggaaggucuccugccccuagcucagguggcuggggagaacuaaaacaccuucacuggugg

SEQ ID NO: 119968 - RNA, 64 nt, Human
uaguccucuaaagcaaaaucugagugccacuaaauggggagauggggcuguuaagcuguccaaa

SEQ ID NO: 119969 - RNA, 64 nt, Human
gaauaugagaaaggcuuagggaaaauucaagucauggggagauuccugcuaggugaugccagga

SEQ ID NO: 119970 - RNA, 64 nt, Human
gaucuccugggcuuucaggcuugacaugcuggucuggggagagacagggccucugcugcccugu

SEQ ID NO: 119971 - RNA, 64 nt, Human
uuguuuuuaucuuaaaaucaguuucuauuauccuuggggagaccaucccuaacaaaguacaggu

SEQ ID NO: 119972 - RNA, 64 nt, Human
cucugcugcuucccaaggauggcuguuuauaauuuggggagagauagggugggaggcagggcaa

SEQ ID NO: 119973 - RNA, 64 nt, Human
ugcucuccuguugguguguaugucacuagggcaguggggagacgucuuaacucugcugcuuccc

SEQ ID NO: 119974 - RNA, 64 nt, Human
ggggacucuggauaggguccccacauccagggcguggggagaccauuggcauuugggaaccauu

SEQ ID NO: 119975 - RNA, 64 nt, Human
uuuguguguccgggguagugaccuuagcguggaguggggagagggcaguugggugugcuggcug

SEQ ID NO: 119976 - RNA, 64 nt, Human
ucagugccaagaagcugaaacugugagcuggaguuggggagaggucuggaagaggaccaucugg

SEQ ID NO: 119977 - RNA, 61 nt, Human
acaacguggaacugaccuaggggggccaaauuggggagacugcccacuccccccuccaugc

SEQ ID NO: 119978 - RNA, 64 nt, Human
ccuugguagcgugcacgguguugaacugggacacuggggagaaaggggcuuucaugucguuucc

SEQ ID NO: 119979 - RNA, 64 nt, Human
gaggggcagcucagugcucugcagagaggggcccuggggagaagcaggaugggauugaugggca

SEQ ID NO: 119980 - RNA, 64 nt, Human
aaauccuaaaugcuggugugggaggucuaaaacauggggagaguuuuuggaucuggaguugaga

SEQ ID NO: 119981 - RNA, 64 nt, Human
gaaucagcaacugcccugaugggccaugagaugcuggggagaucuggcgaugacuguggcuccc

SEQ ID NO: 119982 - RNA, 64 nt, Human
caauacuuuuccugcauuauuugaaauugugggcuggggagaaacaguagucaaagcuuucuga

SEQ ID NO: 119983 - RNA, 64 nt, Human
guacugccaagucccagagaaaacccuuuuacucuggggagaacccacugauggcucauuagau

SEQ ID NO: 119984 - RNA, 64 nt, Human
uguggguuuuguagguuuuuaaaauaaccuuuuuuggggagagaauuguccucuaaugagguau

SEQ ID NO: 119985 - RNA, 64 nt, Human
uggggucuuagaggcaccagugggaaagcaggacuggggagagauccaggacugagccagccuc

SEQ ID NO: 119986 - RNA, 64 nt, Human
ggagcccucaucuugaagggcccaggagggucuauggggagaggaacuccuuggccuagcccac

SEQ ID NO: 119987 - RNA, 64 nt, Human
uuucucuuuguggggcuuggcguggagcaggcgguggggagagauggacaguucacacccugca

SEQ ID NO: 119988 - RNA, 64 nt, Human
uaucaggggaauagaagggagaaagagaauaucauggggagaacaugugauggugugugaauau

SEQ ID NO: 119989 - RNA, 64 nt, Human
gcagcccgaauaaaccccugauguuagagaggccuggggagagcagccgauggggcucagacua

SEQ ID NO: 119990 - RNA, 64 nt, Human
ccaaucccugccucugcccaucagauugccaauuuggggagacagcaauaucaucugggagauu

SEQ ID NO: 119991 - RNA, 64 nt, Human
gagaaaccugccaugcucugggacgugugggcccuggggagaggagagaaagggcucccaccug

SEQ ID NO: 119992 - RNA, 64 nt, Human
ccucaccuucucugauugugggaguggcaagaacuggggagacguccuccauaaguggagcaca

SEQ ID NO: 119993 - RNA, 64 nt, Human
ggacuuuuacucauggaaaaauugucuccuaauuuggggagaugaaccaaccaaucaaugacaa

SEQ ID NO: 119994 - RNA, 64 nt, Human
ucuggccgagaguagggcagcugccuccagacucuggggagacgggcgcuagauuuggggcuca

SEQ ID NO: 119995 - RNA, 64 nt, Human
gagcagcuuggauucuucucaguuguccccugcauggggagauacacuaacccccagaaaugac

SEQ ID NO: 119996 - RNA, 64 nt, Human
cagagccaaaccuuuaguguuggugguaggaggauggggagaggaaaaaagagcuggcaaagaa

SEQ ID NO: 119997 - RNA, 64 nt, Human
acugaggggauucucuacugccaagccccugcccuggggagaaaguaguuggcuaguacuuuga

SEQ ID NO: 119998 - RNA, 64 nt, Human
cuaaaaugggcauaauaguuuaccucauagaguuuggggagaauugagugaauuaaugugugug

SEQ ID NO: 119999 - RNA, 64 nt, Human
agugacugugguuuaaagcacaaaugccccaagguggggagacuucucucugugauuauuguug

SEQ ID NO: 120000 - RNA, 64 nt, Human
acucauagcugccgcuuguuagguuaggguuagauggggagagacagggcacagaggaccuguc

SEQ ID NO: 120001 - RNA, 64 nt, Human
aucacaccuguaagguacuaauuacugcccagccuggggagaucaggagaggucugcauaguua

SEQ ID NO: 120002 - RNA, 64 nt, Human
cccaccucugccacucuuaacacuaagugagaguuggggagaaacugaagccguguuuuuggcc

SEQ ID NO: 120003 - RNA, 64 nt, Human
uccucagcuuuacuugcucccccgcccuuagccuuggggagaaauggcccguggugggcugacc

SEQ ID NO: 120004 - RNA, 64 nt, Human
uucuaugacucugcgagggacaggcccacgcguguggggagaacaucucccuuccggggcugcc

SEQ ID NO: 120005 - RNA, 64 nt, Human
agcagccauaccuggagcuggaucugacccugauuggggagagcugagugcugagccuugggag

SEQ ID NO: 120006 - RNA, 64 nt, Human
ggggugggguggggugggggaggggggggugggguggggagaaaucacauaaccuuaaaaagga

SEQ ID NO: 120007 - RNA, 64 nt, Human
acuggguaggccucucccaccaugugcagucucauggggagaggcuucuuucguuuccucguca

SEQ ID NO: 120008 - RNA, 56 nt, Human
gcuaccugaaauuggaauaaaggggguggggagagggagagaaucaugcuuuuuaa

SEQ ID NO: 120009 - RNA, 64 nt, Human
ucucaucccugggauggagcaauggggaugggguuggggagacguuuacaaagagguugaucau

SEQ ID NO: 120010 - RNA, 64 nt, Human
guuauguuaaaguuauuuuuucaaauacaggauuuggggagagaagccaauuuugcauggcuag

SEQ ID NO: 120011 - RNA, 64 nt, Human
agugucccugauucuuggaaaagccuggagaagcuggggagaugcgguucacaaugccucggua

SEQ ID NO: 120012 - RNA, 64 nt, Human
cccagggcauuauguacagugcuuuuuauuacuguggggagagggcagugcuaaauaaauuaau

SEQ ID NO: 120013 - RNA, 64 nt, Human
uuagcaaacaauuggaaggaaguugcuugaauguuggggagaggaaaaucuauuggcucucgug

SEQ ID NO: 120014 - RNA, 64 nt, Human
uauauauauugaaacaagaaauauuaauaccacauggggagaaccccaaccaaagaaaucugaa

SEQ ID NO: 120015 - RNA, 64 nt, Human
uuuaugaacugauguucucgugaaauguugaggguggggagaaaagacuuuaagggaggagagc

SEQ ID NO: 120016 - RNA, 64 nt, Human
agcagccuuacgggagggauggagggaggcaggcuggggagaagagaacauuagacucagggaa

SEQ ID NO: 120017 - RNA, 64 nt, Human
ggccccaaguuaaaggguuaaagccgcuggagcuuggggagagaacauuguggaauggaaggga

SEQ ID NO: 120018 - RNA, 64 nt, Human
gggugagaagggcagggguguccugaugcaaagguggggagaagggauccuaaucccuuccucu

SEQ ID NO: 120019 - RNA, 64 nt, Human
gcugaguuuccagccuuuucugaaacucaguagcuggggagagggcagggaggcuuccugggcc

SEQ ID NO: 120020 - RNA, 64 nt, Human
gcaauauuugaagaaagaauuuaacaggcacugauggggagaaagcuagcuguagguaauguga

SEQ ID NO: 120021 - RNA, 64 nt, Human
uuuaacaugcagacauacccauauuuaaaugaaauggggagauauuuacauuccguacuuugua

SEQ ID NO: 120022 - RNA, 64 nt, Human
uguccuagaagccggaaaaggaguaaaaacacauuggggagaucaugccuaaaaguaauauauu

SEQ ID NO: 120023 - RNA, 64 nt, Human
ccauaauuguucuaguuagaaaggguucagggcauggggagaggagugggaaauugauuaaagg

SEQ ID NO: 120024 - RNA, 64 nt, Human
agcacuuccucuugcccuccuggcuuuauguuuauggggagaggacucaauagcuccaccccuu

SEQ ID NO: 120025 - RNA, 64 nt, Human
ucacuuuccugccuugucauuucuggaaagauuuuggggagauauuuuauugcauauuaauuaa

SEQ ID NO: 120026 - RNA, 64 nt, Human
ggacuggauagacaaaacugcagaagguguauguuggggagaacugaaagggaaaacaaaauac

SEQ ID NO: 120027 - RNA, 64 nt, Human
uuacaugcuguuugccaaaucuuguuucuuagcuuggggagaugauggacuuagcuuccucaag

SEQ ID NO: 120028 - RNA, 64 nt, Human
aauuuguugauuaccucuuuuauuaaagaaauguuggggagaggguaauauauugugacaauuu

SEQ ID NO: 120029 - RNA, 64 nt, Human
uuaagcuagguaggcuuucagccagcagacaugauggggagagccuucuaauaagagggaagag

SEQ ID NO: 120030 - RNA, 64 nt, Human
gcauggucugguaguuugcaaaauggugugcuuuuggggagauacacuagcaauuuuuuuaaaa

SEQ ID NO: 120031 - RNA, 64 nt, Human
gaucagcagaauguugaauauuagcucacugggguggggagaagccacuaccauuuuuuaggug

SEQ ID NO: 120032 - RNA, 64 nt, Human
cgaguuuugguuugguugguuucagucauuuguuuggggagauauaaaaggcucaggagagcag

SEQ ID NO: 120033 - RNA, 64 nt, Human
uggguagcaaauggaauagaacuuacuuaaaaauuggggagauuuauuugaaaaccagcuguaa

SEQ ID NO: 120034 - RNA, 64 nt, Human
aguucuuugcaaucccuuuauugagcuccuccacuggggagauauaagaaugggaugcauguau

SEQ ID NO: 120035 - RNA, 64 nt, Human
aagagauaagaaagacucaagucuguauguacacuggggagaagcagccuguugaguaagauga

SEQ ID NO: 120036 - RNA, 64 nt, Human
uugcaaacucaggaugcuuuccaaagccaaucacuggggagaccgagcacagggaggaccaagg

SEQ ID NO: 120037 - RNA, 64 nt, Human
ccugaaguuuccuagggguugccucaggaguccuuggggagaugaaggggguggggagcugagc

SEQ ID NO: 120038 - RNA, 64 nt, Human
cgcugucgcccaaagacagcuugcaccacagcgcuggggagagggaugaaggcucggcggccca

SEQ ID NO: 120039 - RNA, 64 nt, Human
cuaacaagguguggagugucagcgaggugcaauguggggagaauacauuguagaauauaagguu

SEQ ID NO: 120040 - RNA, 64 nt, Human
ugguggacgcagaccuugagaacaaccuaaauuauggggagaauuuuaaaauguuaaacuguaa

SEQ ID NO: 120041 - RNA, 64 nt, Human
cugggugguagcugggaugucccaccuacgugccuggggagagaagcaagagcaggcuggaguc

SEQ ID NO: 120042 - RNA, 64 nt, Human
acccuggucauuuguaagggaaaagagcuggagguggggagagaaagaucuccuucaguuggga

SEQ ID NO: 120043 - RNA, 64 nt, Human
aaggagaaagagugagggcaaugaagggcgaugguggggagacucggugggugaauggggagac

SEQ ID NO: 120044 - RNA, 64 nt, Human
ugaagggcgaugguggggagacucggugggugaauggggagaccagaaagaaagaguccacaga

SEQ ID NO: 120045 - RNA, 64 nt, Human
cuauagccaggguaguuguuaauaccugcuuguuuggggagauauguuugauuauagagagacu

SEQ ID NO: 120046 - RNA, 64 nt, Human
ucccuagaacucugaauggaugaauuuuuaaaaguggggagaauguuuggggaugugucugggc

SEQ ID NO: 120047 - RNA, 64 nt, Human
cccagagcuguggcagauugcaggagccaucguguggggagaauuuaauaaaagcccuuuugaa

SEQ ID NO: 120048 - RNA, 64 nt, Human
gggaaagaacagacaagccaugggaaguuggcaguggggagauuuccacuguggaaaccgccug

SEQ ID NO: 120049 - RNA, 64 nt, Human
caccuucugagccucaguuuccucaucuguaaaguggggagaaaagucuguuugccucaggagu

SEQ ID NO: 120050 - RNA, 64 nt, Human
uacacuucuagcuuuauaaacagauuaaccaagauggggagaggggagggccucagggcucccu

SEQ ID NO: 120051 - RNA, 64 nt, Human
gauuuuuuuuuuuuuuugaagggaggacgggagcuggggagaggaaagagucuucaacauaacc

SEQ ID NO: 120052 - RNA, 64 nt, Human
uuuaggauggugauacugggggaccggguagugcuggggagagauauuuucuuauguuuauucg

SEQ ID NO: 120053 - RNA, 64 nt, Human
gacaauugaauaugccuuuuucugcgggaguagguggggagaaacuuaaagguucacuuguaaa

SEQ ID NO: 120054 - RNA, 64 nt, Human
cagcuuuuuugggcaauacaaguuaaguucuuaauggggagacauuaucauggcaugacuuaag

SEQ ID NO: 120055 - RNA, 64 nt, Human
ugggugagagaaugggacuuccucuuugagagucuggggagagaaaagguggccaggauccuag

SEQ ID NO: 120056 - RNA, 64 nt, Human
uccagccaaccaagugauucuucuucauucuugauggggagaaguacauacaaaguuuguucug

SEQ ID NO: 120057 - RNA, 64 nt, Human
ggcccaacugucagaccagaccccucacucaugguggggagacuugacuuccucgggcucuuca

SEQ ID NO: 120058 - RNA, 64 nt, Human
ccacggcgcgcuucugccugcguuccaugcugucuggggagagcagcacacuggccgcccagca

SEQ ID NO: 120059 - RNA, 64 nt, Human
acuauauguauguacuuuaucacaaaguggccuuuggggagaaagucauguauuuguucgcaau

SEQ ID NO: 120060 - RNA, 64 nt, Human
ugauccaggcagcccccucugcagagaaaaggguuggggagaagccucugcaguccuggaagau

SEQ ID NO: 120061 - RNA, 64 nt, Human
uacugcaaguaagacucaacagaccuaauuuggauggggagaaaaacucucaucccugacccuu

SEQ ID NO: 120062 - RNA, 64 nt, Human
uuaggcuacauaaaaugggcugaggguaccuuuuuggggagaugggguggccugcagugacaca

SEQ ID NO: 120063 - RNA, 64 nt, Human
aggacgguguccuguggagaccagacucugcaaguggggagaccacccccgcaagccagugaca

SEQ ID NO: 120064 - RNA, 64 nt, Human
cuggguaccugguccccacugcugagcuggcccuuggggagaggugauucucagggcuggagcc

SEQ ID NO: 120065 - RNA, 64 nt, Human
aagaaaagcggguuuugggucugguguugcugcguggggagaacuugguauccaugacugugga

SEQ ID NO: 120066 - RNA, 64 nt, Human
uauuagaagcccagacuggaagugagaggcaugauggggagagaccagacugaaucuacgggug

SEQ ID NO: 120067 - RNA, 64 nt, Human
cuauguuaguacacagaauacuucauuguuguuuuggggagaagggccauaugucacuaauaga

SEQ ID NO: 120068 - RNA, 64 nt, Human
uuccccauugguaaucugaauuggcuaagaugauuggggagauuuucuguaccuguagguaauu

SEQ ID NO: 120069 - RNA, 64 nt, Human
cgggucugugccaagggacugaagaaguguaagauggggagaacuguaugucauggaguccucu

SEQ ID NO: 120070 - RNA, 64 nt, Human
ugaugaugaagcaucucccauggggaggugaugguggggagaugaugggcuaaacaggcaacuu

SEQ ID NO: 120071 - RNA, 64 nt, Human
acuggcaaaacauuccagaaugaagagagcugucuggggagagcccuucuucccuucuccaccu

SEQ ID NO: 120072 - RNA, 64 nt, Human
uuugaagguauaacagguuccugccagugagaaauggggagaauaagccagaaaaguacccuag

SEQ ID NO: 120073 - RNA, 64 nt, Human
guucagggcucaggccucacccauugcccacuccuggggagaccaucaccuggcucaucguuuc

SEQ ID NO: 120074 - RNA, 64 nt, Human
aacuggacacaauaggucuuucucucagugaagguggggagaagcugaaccggcuucccugccc

SEQ ID NO: 120075 - RNA, 64 nt, Human
guggacgucagaagaaucucuaugcccuguuaaauggggagacaaagggguggugggggcuuca

SEQ ID NO: 120076 - RNA, 64 nt, Human
gcuaugagccugucucuacaguagaaggagauuguggggagagaaaucuuaagucauaaugaau

SEQ ID NO: 120077 - RNA, 64 nt, Human
agcuguuuaaauaguguuuaauauugauuggggguggggagaaagaaaaaguguauuacuuaaa

SEQ ID NO: 120078 - RNA, 64 nt, Human
guacagaauguuugaagaagagaauagugacaaguggggagaaagccacuuuguuucucauuuc

SEQ ID NO: 120079 - RNA, 64 nt, Human
cgcaccccuggguggaccuggagcacaugcccaguggggagagucuggggcgagcagugagcag

SEQ ID NO: 120080 - RNA, 64 nt, Human
ggccuggguggaaauccugcccuggaggaaguuguggggagauccacugggacccccaacauuc

SEQ ID NO: 120081 - RNA, 64 nt, Human
gggugccaacuacugaggaggaauacuugcacuuuggggagaaggcugacucugagaaccaagc

SEQ ID NO: 120082 - RNA, 64 nt, Human
gcccagcgacacagaaggggguggggcgggucuauggggagaaagggagcgaggucagaggagg

SEQ ID NO: 120083 - RNA, 64 nt, Human
gagcccccagcccgguccauccacgucuggagucuggggagaggagcagggucuuaggacucuc

SEQ ID NO: 120084 - RNA, 64 nt, Human
aggcaggacacagagcacagcugugcuggaaguguggggagaacccggacagcucaguccugcc

SEQ ID NO: 120085 - RNA, 64 nt, Human
cugggagcagccaacugcagccauugccauccaguggggagauggguuagggaggaggacgggc

SEQ ID NO: 120086 - RNA, 64 nt, Human
cguggcuuuaauuggagcacucggcugggcugcuuggggagacucuuccgugcguucuuccucu

SEQ ID NO: 120087 - RNA, 64 nt, Human
gccuguguaggggcagcucggccucuggucgccuuggggagaccaaaagucggacaggaaacau

SEQ ID NO: 120088 - RNA, 64 nt, Human
ccaacuccccaaagcggggaggagauauuuauuuuggggagaguuuggaggggagggagaauuu

SEQ ID NO: 120089 - RNA, 64 nt, Human
uacuaaaugacaaaaccauaaaaaccuuccaauguggggagaaaggaagcuuuccgaggccuga

SEQ ID NO: 120090 - RNA, 64 nt, Human
agccccauucugccugcccaggccccugccacccuggggagaaaguacuucuuuuuuuuuauuu

SEQ ID NO: 120091 - RNA, 64 nt, Human
auacuccugccugagaauagagacagaguggugguggggagagugaagaaagagauagaauaca

SEQ ID NO: 120092 - RNA, 64 nt, Human
uauuuuccgcagcaugucagcuaaguagacccaauggggagagaaaaugccugcuuucuuuccc

SEQ ID NO: 120093 - RNA, 64 nt, Human
accccacucccuguuugacggcccagccuggacuuggggagaaugacuuucccuuuuuugcccc

SEQ ID NO: 120094 - RNA, 64 nt, Human
acuucuuucucccacucacccccagcaaggugccuggggagacuugagcagauguuucauuuug

SEQ ID NO: 120095 - RNA, 64 nt, Human
gccccagugccggguccucccucccuuccuggcuuggggagaccaguuucuggggagcuuccaa

SEQ ID NO: 120096 - RNA, 64 nt, Human
cuaccauuucuuccucuggcucaaaauucuucccuggggagagaguuauauucccuuauuuauu

SEQ ID NO: 120097 - RNA, 64 nt, Human
cuagauggguucuuagcuugucugugaucucugcuggggagauaaaaagauuaagccccaacau

SEQ ID NO: 120098 - RNA, 64 nt, Human
ucucggugaugagcacacgcgugcuggggugguuuggggagagggcugagauuugucaccagug

SEQ ID NO: 120099 - RNA, 64 nt, Human
auccugaccaagacugagccagcuuagcaacugcuggggagacaaaucucagaaccuuguccca

SEQ ID NO: 120100 - RNA, 64 nt, Human
gguccaggacagugaccaucugggucuguguagcuggggagaggaugaggcugcagagaugggg

SEQ ID NO: 120101 - RNA, 64 nt, Human
uucaaggagaagcuauuauauuuuguuaagaaaguggggagaaaaaaaccaagaggccaccgug

SEQ ID NO: 120102 - RNA, 64 nt, Human
acaucuggagccaaaggcccgagggacccucagguggggagagcuacaggaaucucuuuggaug

SEQ ID NO: 120103 - RNA, 64 nt, Human
guaaccggucccuggcaauucuguuuacaugaaauggggagaaagucaccgaaaugggugccgc

SEQ ID NO: 120104 - RNA, 64 nt, Human
gccaggcaccacccugaaggagcuucuuuuccucuggggagaagcaaauucaugaugugugugc

SEQ ID NO: 120105 - RNA, 64 nt, Human
ccaaagccccggcccucaugcagcugauuucuaguggggagaguagacaagcagacaagagaaa

SEQ ID NO: 120106 - RNA, 64 nt, Human
aaguggggaccugucccaaggacuggcccagccguggggagaucaccuucagagacuaucagau

SEQ ID NO: 120107 - RNA, 64 nt, Human
cugccucuuccgguuggaggcucucaugucucuuuggggagagcuggcagugugcggagcugau

SEQ ID NO: 120108 - RNA, 64 nt, Human
aagaaguggugaaucacacugagauacgucgauuuggggagagacccccuuuugaacuucaaag

SEQ ID NO: 120109 - RNA, 64 nt, Human
ccuuuggacuugucccgggacaccuaggcuaggguggggagagacgggcccuggugguggcucg

SEQ ID NO: 120110 - RNA, 64 nt, Human
uguacacuagcaggaugggucuugggaguuggcauggggagauuguaagggcuguaucuccgcg

SEQ ID NO: 120111 - RNA, 64 nt, Human
ggagagaggagugaccgggacuggagccagggucuggggagagcaacagcaccaggcuuuuccu

SEQ ID NO: 120112 - RNA, 64 nt, Human
gguaucagaaauugccacccucuuaauuucucacuggggagagcagggguggcagauccuggcu

SEQ ID NO: 120113 - RNA, 64 nt, Human
agaacaaggucccgacagggguagacguuccaccuggggagaucccaccugccguaggcacaug

SEQ ID NO: 120114 - RNA, 64 nt, Human
aaagaaaggagccuugaaugguggagggaggcaguggggagaaaggucucaccggacagguugg

SEQ ID NO: 120115 - RNA, 64 nt, Human
ccugauccucucacagaaacacugggccaaacaguggggagagauuggagagcggguguggcug

SEQ ID NO: 120116 - RNA, 64 nt, Human
caaccuuggccgacaugcagcauccacccccggcuggggagaggccccgcggucgcucaggggc

SEQ ID NO: 120117 - RNA, 64 nt, Human
ggcuagcugcggugcuccuugcugguuuuuaacuuggggagaaacaccggguuucagcuuucuu

SEQ ID NO: 120118 - RNA, 64 nt, Human
ccaaacucagcacaugagucuccccuagcucucguggggagagggaugcuauuuauucaguuug

SEQ ID NO: 120119 - RNA, 64 nt, Human
ugagccaccaugccuggccaggacauauuugaaauggggagauuuuaaaaauucugaugauuag

SEQ ID NO: 120120 - RNA, 64 nt, Human
gugggcucagcuuuggcugugcauuggaaucaccuggggagauuuguaagcuucugcugucugg

SEQ ID NO: 120121 - RNA, 64 nt, Human
uggaccugucacaugaaauggaucagcacuugaauggggagaaguggagggagaggcccugggc

SEQ ID NO: 120122 - RNA, 64 nt, Human
uuguuugcacuauuggacuuaggagugccgaggguggggagauggagcugcccgucucagugug

SEQ ID NO: 120123 - RNA, 64 nt, Human
cuucuguucucugcugagggccaauacccuacuguggggagagauggcacaccagaugcuuuug

SEQ ID NO: 120124 - RNA, 64 nt, Human
uaaucacucugagucacaggugugggauggagaguggggagaggcacuuaaucuguaaccccca

SEQ ID NO: 120125 - RNA, 64 nt, Human
cccagcccagcugcucugcccagagcugggugaguggggagacaccucagagccccgcaaaacc

SEQ ID NO: 120126 - RNA, 64 nt, Human
uguccuuuccaguggccuggcuccgcuguguggauggggagaucggggccagaggcagaacccu

SEQ ID NO: 120127 - RNA, 64 nt, Human
ugaaauuauuuguagacuuguauguacauuuuucuggggagaagguucaagagauucauaagau

SEQ ID NO: 120128 - RNA, 64 nt, Human
cuccuuccaggauccuggaggugaugggauagacuggggagacgaugcuguugcuuugcagauc

SEQ ID NO: 120129 - RNA, 64 nt, Human
auagguacaauacggaaugaagaagaggggaaaauggggagaaagaugguuaaaauacauaaua

SEQ ID NO: 120130 - RNA, 64 nt, Human
cuguccuuccucccaucggagggagaagggguccuggggagagagaauuuauccagaggccugc

SEQ ID NO: 120131 - RNA, 64 nt, Human
aguguugaauggauuggcuugcaaaggggguagguggggagagauaggagggcccagggacuca

SEQ ID NO: 120132 - RNA, 64 nt, Human
uucacccuaaaagucucacaaaagaaugaguucauggggagauucuguaaagugaugaacugag

SEQ ID NO: 120133 - RNA, 64 nt, Human
agaaccaaagugcauuugggugacauuugaagauuggggagacaagaugggguagauuguggca

SEQ ID NO: 120134 - RNA, 64 nt, Human
cugugacuguugcugacuccaggggugggagggauggggagacuccccucuugcuguguguacu

SEQ ID NO: 120135 - RNA, 64 nt, Human
agccccauaggaacgucuggaauugcuugggaguuggggagaacugucaagaagagugaagaga

SEQ ID NO: 120136 - RNA, 64 nt, Human
cccaggccuggcuuauuccaagaggcugagccaauggggagaaagauggaggacucacugcaca

SEQ ID NO: 120137 - RNA, 64 nt, Human
uucucaccccuuccucgauggggcuuuaaagcucuggggagaagagcugcuccccacucaugcc

SEQ ID NO: 120138 - RNA, 64 nt, Human
cugccuccuacccauugccaagagaggaugcaucuggggagagcaaagcacuaaggaauucagc

SEQ ID NO: 120139 - RNA, 64 nt, Human
gucccuuccugcuuccuguuaccugucuugcuccuggggagaaagaggggccugaugagacucc

SEQ ID NO: 120140 - RNA, 64 nt, Human
uaagguccaggccucucccucccgagugcauuuuuggggagauaguaaauguuuuauucgggug

SEQ ID NO: 120141 - RNA, 64 nt, Human
ccuuuuggguaaacacugggaacuccagaaguuguggggagaguggggaaucagacagccgccu

SEQ ID NO: 120142 - RNA, 64 nt, Human
ccaccagaacccugaugaccuugaauuuggggaguggggagaguggauggacuagacugugcug

SEQ ID NO: 120143 - RNA, 64 nt, Human
gccgcagagcuugguuugggagguugaagugcucuggggagaauucguagaucauccucagaaa

SEQ ID NO: 120144 - RNA, 64 nt, Human
uaaagauuacaacccaaagucucccaggaagcuguggggagaccagaggaucaagcugaaguga

SEQ ID NO: 120145 - RNA, 64 nt, Human
gagagauggagaggaggggagagagaaagagagguggggagaggggagagagauaugaggagag

SEQ ID NO: 120146 - RNA, 64 nt, Human
gagccagcucugcauuaucugaggucacagggccuggggagauggaggaaagugauauccccca

SEQ ID NO: 120147 - RNA, 64 nt, Human
ucugauaaaaguagacuggauccccugggguauuuggggagaaaguaacuacuuuggcucuacc

SEQ ID NO: 120148 - RNA, 64 nt, Human
auaugauggggaagggcaggaacuuauggcaggguggggagaggguuugccuggaaguuaagag

SEQ ID NO: 120149 - RNA, 64 nt, Human
auuugcugauucucaguuuggucacugcuuuucuuggggagaaaacagagaagaggcaauuucg

SEQ ID NO: 120150 - RNA, 64 nt, Human
agacccuggggccuggcuggggaagguccgcaccuggggagagcugggagcuguugaagguuug

SEQ ID NO: 120151 - RNA, 64 nt, Human
ugaucuaacauuuauuugcugccauuuuuuacucuggggagaagcagccccaacucaucacugg

SEQ ID NO: 120152 - RNA, 64 nt, Human
gaaaaccaggccuuaucuccaagaccagagauaguggggagacuucuuggcuuggugaggaaaa

SEQ ID NO: 120153 - RNA, 64 nt, Human
uuccaacccugcuuggcuuugaugccuucaggguuggggagacagaccucuuuccucucucugg

SEQ ID NO: 120154 - RNA, 64 nt, Human
ggcccugccaccaaguugagagcuggaggggagguggggagagaacaucacagagcagccagcc

SEQ ID NO: 120155 - RNA, 64 nt, Human
augccuguaaucccagcuacuuuggaggcugagguggggagaauugcuugaaccugggaggugg

SEQ ID NO: 120156 - RNA, 64 nt, Human
uaucaaacucagcccaaaacucuguuuacauggguggggagauggagcagggaaguacagagug

SEQ ID NO: 120157 - RNA, 64 nt, Human
acugcccaccuccgccugccagcccaccccagccuggggagaggucgcggcggcggguuugcuu

SEQ ID NO: 120158 - RNA, 64 nt, Human
ugccugggugggaggagcgaaaguggggguguccuggggagaccaggaaccugccaagcccagg

SEQ ID NO: 120159 - RNA, 64 nt, Human
uccacuaccaacccagcuccacccagcaguguccuggggagaaggaaggcugagccucucccca

SEQ ID NO: 120160 - RNA, 64 nt, Human
gccuguuuucaaggggaguaagauugguaacauuuggggagacuguaucugucuacuuagcgug

SEQ ID NO: 120161 - RNA, 64 nt, Human
ccagagaaugucagugugcaaugugucuggaggguggggagaggaauucugugagccuuuucau

SEQ ID NO: 120162 - RNA, 64 nt, Human
cucugugaccccuuuacuccucuggagggcucuguggggagagauacagggaaaggagcuguuc

SEQ ID NO: 120163 - RNA, 64 nt, Human
auccaugaagaaaacgucaugaucugccucggaguggggagaaacaggcccuccuuguccuugu

SEQ ID NO: 120164 - RNA, 56 nt, Human
cuuuccuuucccaccucuaagguggcuggggagaugucaggggaaagauagauagu

SEQ ID NO: 120165 - RNA, 64 nt, Human
cccuuuauugauucaucgaggagaacuugguagauggggagaaaacacaguugguuuuuuuuuc

SEQ ID NO: 120166 - RNA, 64 nt, Human
guguaagggucaaugugcuugcuuggagguggacuggggagacagccuuggugcagcaagaaca

SEQ ID NO: 120167 - RNA, 64 nt, Human
auaaugcaggcguggguaaggggccccccugggauggggagaagggcuucgaagauaaacugag

SEQ ID NO: 120168 - RNA, 64 nt, Human
agaauaccagacuuuucuuccucucgacauaguuuggggagaagcaguacuagaaacuuuccaa

SEQ ID NO: 120169 - RNA, 64 nt, Human
agcucuugcuggaugaaaccccuccaggugggguuggggagacuugauauucacauccaacagu

SEQ ID NO: 120170 - RNA, 64 nt, Human
ugauggggacuuuucuagagcaccccaaaugucauggggagagagggacucuuucugcucccuc

SEQ ID NO: 120171 - RNA, 64 nt, Human
ugaagggagaugaccugugauuagacugggcggcuggggagaaacaguucagugcauuguuguu

SEQ ID NO: 120172 - RNA, 64 nt, Human
agaucuuuguguucacauauguuuucauuucuguuggggagauuccuaggcuagaaauugcugg

SEQ ID NO: 120173 - RNA, 64 nt, Human
ucauauuucauuuccaacucagguuaaguguuucuggggagagauguuguguuuacguuacacu

SEQ ID NO: 120174 - RNA, 64 nt, Human
ccaaaucacaauaaaauugucauuuaggauaaacuggggagaauagacugaacauaugguuaua

SEQ ID NO: 120175 - RNA, 64 nt, Human
aaaaauuggaugcguaaaguaauauuuacagauguggggagauguaauaaaacaauauuaacuu

SEQ ID NO: 120176 - RNA, 64 nt, Human
gggagcugaggggaggaucuuacugaaagcacccuggggagauugauuguccuuaaaccuaagc

SEQ ID NO: 120177 - RNA, 64 nt, Human
uagauguacgaauuaaauauguucuucaaaaucuuggggagaauuauguucuuagaacauaguu

SEQ ID NO: 120178 - RNA, 64 nt, Human
ggcugugugugcacgcgugugcaggagcggcagauggggagacaacgugcucuuuguuuugugu

SEQ ID NO: 120179 - RNA, 64 nt, Human
uugccuuaaaggauuugaaguaagaacauaauuuuggggagaguuuuuuagugauucacaguau

SEQ ID NO: 120180 - RNA, 64 nt, Human
aaugauuucagaacaggauuugcgaccagguuuauggggagauugaaucaacgauuggucucaa

SEQ ID NO: 120181 - RNA, 64 nt, Human
uugagaguaauacacuauugaaaguuaucuuggauggggagaaaaaaaaauagugguuuuccuu

SEQ ID NO: 120182 - RNA, 64 nt, Human
cauuggggaagcuggcuuucuggcugcuggaggcuggggagaagguguucauucacuugcauuu

SEQ ID NO: 120183 - RNA, 64 nt, Human
uaagcuaccuacaugcugucauugaacagagauguggggagaaauguaaacaaucagcucacag

SEQ ID NO: 120184 - RNA, 64 nt, Human
ugccugcguguaaaccacagccucagaccagcuauggggagaggacaacacggaggauauccag

SEQ ID NO: 120185 - RNA, 64 nt, Human
gcuaccucuugggggagcgugguggcagcgaugauggggagacgccuggaagcucacagaacuu

SEQ ID NO: 120186 - RNA, 64 nt, Human
gagacaccagccucugauggcucaggaggacuuguggggagaggcugggggcacccauguggug

SEQ ID NO: 120187 - RNA, 64 nt, Human
uucuggggcccaggaggaucugggcugguuugucuggggagacagacaggauguuguggagcug

SEQ ID NO: 120188 - RNA, 64 nt, Human
cagugagucaugaucgcaccacugcacccaaaccuggggagagagcuagacucuugucucaaaa

SEQ ID NO: 120189 - RNA, 64 nt, Human
ccaguucuuuucaauaucaugaaaggacucacacuggggagaaaccguaucaauguaagcaaug

SEQ ID NO: 120190 - RNA, 64 nt, Human
ccaggacuguguguggguccgggggguggggggguggggagaagggucgggcagggggugcagg

SEQ ID NO: 120191 - RNA, 64 nt, Human
acaccuuucccaugccuccucuggagccuucgccuggggagacagaacccagagagaaacaaga

SEQ ID NO: 120192 - RNA, 64 nt, Human
uuguggguuggccaggagguucccccgaccagguuggggagacuuggggccagcgcuucugguc

SEQ ID NO: 120193 - RNA, 64 nt, Human
accggcagugcuggggcaggacccgagccagcgguggggagagauauagucagagaacccagca

SEQ ID NO: 120194 - RNA, 64 nt, Human
ucccguagcccugcgcccccuuucuguggcuggauggggagacaggucagggccccccacccuc

SEQ ID NO: 120195 - RNA, 64 nt, Human
aaggaggggacuucuccugcaccccaagaagugguggggagauugcugccccuauagccauauc

SEQ ID NO: 120196 - RNA, 64 nt, Human
auuggugaacagaugcaggcgcugcuggaccaucuggggagagugacaguccaugucuucacca

SEQ ID NO: 120197 - RNA, 64 nt, Human
aggguuugguugcaacagccaguguggguaccucuggggagagaggaccuccucugacaaacug

SEQ ID NO: 120198 - RNA, 64 nt, Human
caaucauucauaucuacucaccuaacagcaacacuggggagagccuggagcauccggacuugcc

SEQ ID NO: 120199 - RNA, 64 nt, Human
ucagaagcccgaggaacucuuugcuccccugcuuuggggagaucucaaaccauggacguggagc

SEQ ID NO: 120200 - RNA, 64 nt, Human
caagggugaggaggccagugggaccccacagaguuggggagauaaaggaacauugguugcuuug

SEQ ID NO: 120201 - RNA, 64 nt, Human
cagaagaucaggaaagaggucggggcuggacagauggggagagcgcagauagauuuaagagagu

SEQ ID NO: 120202 - RNA, 64 nt, Human
cuuuucucuccugcagaaggaaagccacgcaaguuggggagaaaacccccaaggaugaaucugc

SEQ ID NO: 120203 - RNA, 64 nt, Human
aagccauccccgaaagaggugaaagagaucacuuuggggagagcuggagaacaggauucuaggc

SEQ ID NO: 120204 - RNA, 64 nt, Human
uuggcuggaguagaauuaagucagagccaacagguggggagagacagagaagugggcaggggca

SEQ ID NO: 120205 - RNA, 64 nt, Human
ggguugggggggucauaucuguguuuccagguucuggggagaacaaugauccacgggucaacgu

SEQ ID NO: 120206 - RNA, 64 nt, Human
uuuuguucagaaccaugcugggcuagcuaaaggguggggagagggaagaugggccccaccacgc

SEQ ID NO: 120207 - RNA, 64 nt, Human
caagaagaggguucgagcccuugguggggacagcuggggagauggcagugcaggcuggaaccug

SEQ ID NO: 120208 - RNA, 64 nt, Human
gaggaaaagacuggcaguucuagauuccucuauauggggagaccuggauuguugaccaggguga

SEQ ID NO: 120209 - RNA, 64 nt, Human
gguguccacccuccaacccccacaagucccucuuuggggagacacuggggggccuuuggcuguc

SEQ ID NO: 120210 - RNA, 64 nt, Human
gaggagaaauggccucccgucuugugaacuucaauggggagaaauaauuagaaugagcaauaga

SEQ ID NO: 120211 - RNA, 64 nt, Human
gcuagcagaugagcaccguauauucauuccacccuggggagauuccugauaagcaccacauaug

SEQ ID NO: 120212 - RNA, 64 nt, Human
aaauugauaaauauugagugugaguaauugggauuggggagauuguggcaaacuagaggggaag

SEQ ID NO: 120213 - RNA, 64 nt, Human
ccugcaggccaggggucccccagcgucacccuguuggggagagaagaaaggggguucagaggcc

SEQ ID NO: 120214 - RNA, 64 nt, Human
uccuaggacugcgggugcccuuagcugaaggggguggggagaagcguggacugggcagccugug

SEQ ID NO: 120215 - RNA, 64 nt, Human
ccaggccucucccaccucaggcccugcccgacccuggggagagagggcaucugcaauaggaggg

SEQ ID NO: 120216 - RNA, 64 nt, Human
gaccgagccacaggccacggacaggggccgggguuggggagacuaugucgccagaugccaggac

SEQ ID NO: 120217 - RNA, 64 nt, Human
ugucccuguucucucugaagacaugaaaacucacuggggagaaacccuaugaauguaaaaaugu

SEQ ID NO: 120218 - RNA, 64 nt, Human
ccucaugccuaaguaugcaugaaagaauucacacuggggagaaauacuaugaauguaaggauau

SEQ ID NO: 120219 - RNA, 64 nt, Human
acaguucuuaucuaagacaugaaagaacacguacuggggagaaacuguaugaauguaagcagug

SEQ ID NO: 120220 - RNA, 64 nt, Human
ugguuccugcugugugaugcugaggguuuuaagguggggagagauaagggcucucucgggccau

SEQ ID NO: 120221 - RNA, 64 nt, Human
augcacaucuaaugagacaucagagaauucacaguggggagaaacccuaugaauguaaugaaug

SEQ ID NO: 120222 - RNA, 64 nt, Human
aucucugguucuggacaauuaucaaauauaucaguggggagagagaagcgguguguguguugug

SEQ ID NO: 120223 - RNA, 64 nt, Human
cauuuccugccaggggcgggggguggggcagcuguggggagacgggggucuuccuucaccagcu

SEQ ID NO: 120224 - RNA, 64 nt, Human
ggcugcaagaugagaacugggggggugcaggugguggggagacagauggagaagcuggcagaug

SEQ ID NO: 120225 - RNA, 64 nt, Human
cccuccacaauaacagaaacacucccagggacucuggggagaggcugaggacaaauaccugcug

SEQ ID NO: 120226 - RNA, 64 nt, Human
cagagacgcagaagagaggaacagaaauccagaguggggagacagagaccaagagcaggggaua

SEQ ID NO: 120227 - RNA, 64 nt, Human
ggaggguccuccagcucaccucaugcuucuuauuuggggagagggcugugauguaaagggguug

SEQ ID NO: 120228 - RNA, 64 nt, Human
gaaaaaaaaaaaaaagccuuuguguccccugauuuggggagaauaaacagauaugaguuuauua

SEQ ID NO: 120229 - RNA, 64 nt, Human
ggccguuugcaccucgguuuuuccacgugagaaauggggagaacgcugcuguuaggaggaaguu

SEQ ID NO: 120230 - RNA, 64 nt, Human
uccugugugccuccugccaucccugcacacagccuggggagaagccugugccuccccgugugga

SEQ ID NO: 120231 - RNA, 64 nt, Human
ggcuuugugguuuuuagaguugcaucuaugaaccuggggagauuaugugcuuucccaagcguuc

SEQ ID NO: 120232 - RNA, 64 nt, Human
aggacaacguucuaaaaguacaauuauuucuuauuggggagauuacagguaguuuggcaaagca

SEQ ID NO: 120233 - RNA, 64 nt, Human
cucucuucuguaacuggauguuuuggcaacuuuguggggagagacugcuggauuucuuaaagca

SEQ ID NO: 120234 - RNA, 64 nt, Human
uaacucaaacugccacaugcucguguccuuucaguggggagagugguucauuagaggggguugc

SEQ ID NO: 120235 - RNA, 64 nt, Human
uucucccacaggccucucuuucuuucuagguugcuggggagaaauggguacccuaugauccccc

SEQ ID NO: 120236 - RNA, 64 nt, Human
cgagaucaucacuuccuugcccccauuucacccauggggagacaguugagagcggggaugugac

SEQ ID NO: 120237 - RNA, 64 nt, Human
gucugggagggcaugggagcagugagcaggcccauggggagaaauuggccaauuuaauucagag

SEQ ID NO: 120238 - RNA, 64 nt, Human
gcuggucacauuuggcagcaaaauggauuucuccuggggagaacaaaguuaagggacacugaga

SEQ ID NO: 120239 - RNA, 64 nt, Human
ccaacagcccuggcuggggaggugucagggcagcuggggagaggugggcucugcuuuucagagg

SEQ ID NO: 120240 - RNA, 64 nt, Human
uugacgcccugcucuggauaacaagacuuugacuuggggagaccucuacugccuuggacaacuu

SEQ ID NO: 120241 - RNA, 64 nt, Human
cccuauauucagggaaguugcgugaacacugcaguggggagaauugagaauagucaggccuauc

SEQ ID NO: 120242 - RNA, 64 nt, Human
guaaggaagggacugacaagaagcucccagaugcuggggagaaugaagagcuaaaauagauccu

SEQ ID NO: 120243 - RNA, 64 nt, Human
caauuguaucugacccuucuuuaaguuauguguguggggagaaauagaauggugcucuuaucuu

SEQ ID NO: 120244 - RNA, 64 nt, Human
ggcucagggcuggaacugcugccugauuccuguguggggagaagcucaguggccguuugcugcc

SEQ ID NO: 120245 - RNA, 64 nt, Human
ucaaaccacuguauuuuucuguugagccuguacuuggggagagaucaguagcauuugaggaagu

SEQ ID NO: 120246 - RNA, 64 nt, Human
uccccucuccuaggagacggaugucacgcacaaauggggagagaaguguuuauuuuguaggcac

SEQ ID NO: 120247 - RNA, 64 nt, Human
aaauuaaaagcccuaccuaaaacugagguggggauggggagagccuuugccuccaccauuccca

SEQ ID NO: 120248 - RNA, 64 nt, Human
ccccagaguauauugaauagaaauucugcauguguggggagaauggacaaggacuuaggaaaaa

SEQ ID NO: 120249 - RNA, 64 nt, Human
ugaugacuuaaauggcaggggguggggauuaucuuggggagaggcugaaaagcacaaaagauag

SEQ ID NO: 120250 - RNA, 64 nt, Human
ggacaagugagagagcaagugggggucgagacuuuggggagacgguguugcagagacgcaaggg

SEQ ID NO: 120251 - RNA, 64 nt, Human
gcguggcacaguggggaauccaagggucacaguauggggagaggugcacccugccaccugcuaa

SEQ ID NO: 120252 - RNA, 64 nt, Human
cucugggaccuccuuagcccugucugcuaggcgcuggggagacugauaacuuggggaggcaaga

SEQ ID NO: 120253 - RNA, 64 nt, Human
gucuccugucuuggccuccccuuucaugagauacuggggagaagagaacauuccuccuggcuua

SEQ ID NO: 120254 - RNA, 64 nt, Human
gcuguaagacggccuuggacggggacacggccucuggggagaccgaguguggagcugcuuccag

SEQ ID NO: 120255 - RNA, 64 nt, Human
uuaagaaucuuggcuuucauauuuaaaaugcuuuuggggagacauauauuaaaauuuuagccaa

SEQ ID NO: 120256 - RNA, 64 nt, Human
gagcuuuacugaaagacuugguuaucaagucuuuuggggagagaaugacauuuuuuuuuugaga

SEQ ID NO: 120257 - RNA, 64 nt, Human
cgagaacauaauuaggcaucgggccuaaguguccuggggagauuggaggggacggcagcguucu

SEQ ID NO: 120258 - RNA, 64 nt, Human
acuacagacauuaaauaaucgaaguaauuuuggguggggagaagaggcagauucaauuuucuuu

SEQ ID NO: 120259 - RNA, 64 nt, Human
uuauaguggaucagaauaaagguuauucuaacuguggggagaaaaaaaaaauuguaucaaguuc

SEQ ID NO: 120260 - RNA, 64 nt, Human
uauucuugaguuuugauaccacgcagaccuuggguggggagagcuuccugcacagcucucagcg

SEQ ID NO: 120261 - RNA, 64 nt, Human
gcggguacuccagcuuguggcauucccaugugacuggggagaagacaaaauugguguuuagauu

SEQ ID NO: 120262 - RNA, 64 nt, Human
acuaacaauucaacagugauguucuuugcauuuguggggagaugugugauguucuugguuuucu

SEQ ID NO: 120263 - RNA, 64 nt, Human
guuaugagccugugggaacuucagggguucccaguggggagagcaguggcagugggaggcaucu

SEQ ID NO: 120264 - RNA, 64 nt, Human
gccacggcucagugaugggcucaccacccagaaguggggagagacuuugggccucccacccagu

SEQ ID NO: 120265 - RNA, 64 nt, Human
uucuacuggaucacuugucaagaugcgcccucucuggggagaagggaacgugacuggauucccu

SEQ ID NO: 120266 - RNA, 64 nt, Human
cuguguucuaggcccgcccaccccaaccuucugguggggagaaauaaacgguuuagagacuagg

SEQ ID NO: 120267 - RNA, 64 nt, Human
gcagcugguggggaauaggcagggcagcuguggcuggggagagacuuuaggcagaagcugugau

SEQ ID NO: 120268 - RNA, 64 nt, Human
aguggcagcuccgagcugguuguggcacaguagcuggggagaccucagcagggcugcucagugc

SEQ ID NO: 120269 - RNA, 64 nt, Human
gcggagcccaggcugacuccggauucaacguugcuggggagagaaaagcaguauagacuccacc

SEQ ID NO: 120270 - RNA, 64 nt, Human
uuguuggcuuguuugccaugaagguagauguggguggggagaagacacaaggcaguuuguucug

SEQ ID NO: 120271 - RNA, 64 nt, Human
uuuaacuuuggcacauugaucuaucuaaaccugguggggagaauuauccccacauugucucaug

SEQ ID NO: 120272 - RNA, 64 nt, Human
ccucuucccccuguccuguuucucacccagcaccuggggagaucggugcuaccaaggaagagag

SEQ ID NO: 120273 - RNA, 64 nt, Human
ggccugagacacaccccuugagaagaagcugcucuggggagacgaggguaugaguggaaagagg

SEQ ID NO: 120274 - RNA, 64 nt, Human
ggagcaccugucuguuguagaaaacaccggucccuggggagacuugaaaggccccugucccagc

SEQ ID NO: 120275 - RNA, 64 nt, Human
agaacgcugugggugcaggugagccggcguguccuggggagaugcugccagcacacaggggccc

SEQ ID NO: 120276 - RNA, 64 nt, Human
ggcagauguugacuugaggaguuaaugugaucuuuggggagauacaucuuauagaguuagaaau

SEQ ID NO: 120277 - RNA, 64 nt, Human
acauggcaguccccaaaaacaaaauggagucugauggggagaagaaguacccaugcccugaaug

SEQ ID NO: 120278 - RNA, 64 nt, Human
gaugcuuuuuaauaauuaugcuucccaucauaacuggggagaaagggaagucaggguucuaggg

SEQ ID NO: 120279 - RNA, 64 nt, Human
gaaggccagggagguccccggggaccuggcauucuggggagacccugcuucuaucuuggcugcc

SEQ ID NO: 120280 - RNA, 64 nt, Human
ugguccuggggcagcaaggaagaagcucagaggguggggagaagcaugaagcagugagcagagc

SEQ ID NO: 120281 - RNA, 64 nt, Human
ggguguagagagaagcuuguguuuuuguuuguaauggggagaagcguggccaggcagguggcac

SEQ ID NO: 120282 - RNA, 64 nt, Human
aauuuccacggggggacuaggagggcagcauugcuggggagaggggcuccuguucugccgugga

SEQ ID NO: 120283 - RNA, 64 nt, Human
gggaguguaaaaguugggaguguaguguagcaucuggggagacagcaggaucacagugugggau

SEQ ID NO: 120284 - RNA, 64 nt, Human
uacuagcuuuuugcuucucuuuuagaaauacuuguggggagagaaaaaaggaugguuugggcau

SEQ ID NO: 120285 - RNA, 64 nt, Human
gccaauuccuuuuuauaugugcccacaacagagguggggagacacggagcacccuggguccuuc

SEQ ID NO: 120286 - RNA, 64 nt, Human
cagccaugguugcccuuuugauaggccauuagcauggggagauugaauccaucuaaucaggagu

SEQ ID NO: 120287 - RNA, 64 nt, Human
agacauggccgaauaggcuacugccacccggcuuuggggagaugggcgauaaguguugagguag

SEQ ID NO: 120288 - RNA, 64 nt, Human
ccucuucccuccucccucuucauuccuguccccauggggagaacaaaugcuacuguucuugucc

SEQ ID NO: 120289 - RNA, 64 nt, Human
cuacagacaauaaauauuaggagacacagggaaguggggagagguggggaguaauaguaaacac

SEQ ID NO: 120290 - RNA, 64 nt, Human
ccaccuuacgcaaccgcgcugcaggggugaggaguggggagaaaccagaaugcuucugaaacuc

SEQ ID NO: 120291 - RNA, 64 nt, Human
ugugacuuuuuaaagagguggggcucacugcaacuggggagaacacuuagcauauggauaugau

SEQ ID NO: 120292 - RNA, 64 nt, Human
uuggauaaagagcuauaugcuuuucccuggagaguggggagaugagaccaguguuccucacacu

SEQ ID NO: 120293 - RNA, 64 nt, Human
gcauuccuaaagaggcccugaaaacugcuggugguggggagacucuucaaguuaauaucugcau

SEQ ID NO: 120294 - RNA, 64 nt, Human
caggcugcacaggaagcauggcagcaucugcuucuggggagaccucggggagcuuuugcucaug

SEQ ID NO: 120295 - RNA, 64 nt, Human
cuguagcugauuaaauuuuucccaacaaccucacuggggagaaaguguguucauguuuugucca

SEQ ID NO: 120296 - RNA, 64 nt, Human
acgaccuuucuuucuuuauuucucagccugcccuuggggagaugagggagcccugucugcguuu

SEQ ID NO: 120297 - RNA, 64 nt, Human
accucgcuggggcaggggcacccagcaucagcccuggggagagaggcucccaaagggccaccau

SEQ ID NO: 120298 - RNA, 64 nt, Human
agacuuguauuauaagucaaggaugagccugaucuggggagagggccggggcucgggacuggcc

SEQ ID NO: 120299 - RNA, 64 nt, Human
ugguaugcacaauuccaugacaauaugcccuuucuggggagauaguccauaauguucugcuaaa

SEQ ID NO: 120300 - RNA, 64 nt, Human
uucagccccucccuggaauagugaguugggaggauggggagacagcuaaccaacugcauuaccc

SEQ ID NO: 120301 - RNA, 64 nt, Human
ugggagagaggguacugaucagcagacugggagguggggagaaguccgcugguguuguuuuagu

SEQ ID NO: 120302 - RNA, 64 nt, Human
gggaagcaggguugguuaguaaagacaggaauguuggggagaggugaguaguuccuuccucuuu

SEQ ID NO: 120303 - RNA, 64 nt, Human
ggguuuguuguccagcaccaauucuggcugucaauggggagaaauaaaccaacaacuuauaauu

SEQ ID NO: 120304 - RNA, 64 nt, Human
guccucuaguuuguggccuucagaaaucagaucuuggggagagucccuuccuaccugacugacc

SEQ ID NO: 120305 - RNA, 64 nt, Human
cauuucugcaccggagaugaguuuuauccuguguuggggagaggugcucacccuccacccugug

SEQ ID NO: 120306 - RNA, 64 nt, Human
gcgcgcuuccuuuccuccccgcugccgcccacccuggggagagacuuuugcggggagggaaggc

SEQ ID NO: 120307 - RNA, 64 nt, Human
auccaggcgugagaguguucucuugggaaaugacuggggagacaccugaaaggagcaaccucca

SEQ ID NO: 120308 - RNA, 64 nt, Human
agugugcauggauguguguugcaggguggagaaguggggagaaguguauaguaguacacggggg

SEQ ID NO: 120309 - RNA, 64 nt, Human
gcggguucucugccuccgugaagacaagcugggcuggggagaacggugucuaggagggaugacc

SEQ ID NO: 120310 - RNA, 64 nt, Human
agcccccuccacagacacccgcggggcucagugcccccgucacagcucuguagagacaaucaac

SEQ ID NO: 120311 - RNA, 64 nt, Human
cccucagcuguaggcaagcuugcacauaaauaacccccgucaguggaguguucgggaugcaggg

SEQ ID NO: 120312 - RNA, 64 nt, Human
cucucagucccucaucagaucgagacucuauuucccccgucagucugggggcuucacaagggca

SEQ ID NO: 120313 - RNA, 64 nt, Human
uguuguggagaaggaagcagaugugaucacaucaccccgucauugggcaccgcugacuccagca

SEQ ID NO: 120314 - RNA, 64 nt, Human
agcuuuauacuaaaugggcuccuucauggugacgccccgucaaccacaaucaagaacugaggcc

SEQ ID NO: 120315 - RNA, 51 nt, Human
cuuugucucacucccuguaagccccgucacguucucaaaauccuuugcacc

SEQ ID NO: 120316 - RNA, 64 nt, Human
auucauguuauuuauuguguacugacuccaucugccccgucaaauaaaaaaccacaagguucga

SEQ ID NO: 120317 - RNA, 64 nt, Human
cucugcccugugccacucucagccauuucagcagccccgucaaccgcugcuccgucccuuuccc

SEQ ID NO: 120318 - RNA, 64 nt, Human
ccuuugcggcucaguaccgcuccagcagccugggccccgucacggugagugaggggugccggga

SEQ ID NO: 120319 - RNA, 64 nt, Human
aaagcaauagguuugggggacgcccagcccccacccccgucaccccgcucuucccaaguccucg

SEQ ID NO: 120320 - RNA, 64 nt, Human
cuucaccgcaccccaucugcuuaagugcucggaaccccgucaccuaauuaaaguuucucggcuu

SEQ ID NO: 120321 - RNA, 64 nt, Human
cugaaccugagccuggggcgucucggagcuggauccccgucagcucauccaggcuggacaaacc

SEQ ID NO: 120322 - RNA, 64 nt, Human
ggaguucgagaccagccuggccaacauggugaaaccccgucacuacuaaaaauacaaaaaauaa

SEQ ID NO: 120323 - RNA, 64 nt, Human
aaguccaccuccaacauuaaccugcccaccccacccccgucaucccuggagaauuccagcuuug

SEQ ID NO: 120324 - RNA, 64 nt, Human
ggaccagcuuucuugucaccuugagguccccucgccccgucacaccguuaugcauuacucugug

SEQ ID NO: 120325 - RNA, 64 nt, Human
aggccaggcccccgucuuccgccugccucugcuuccccgucaugcaugguggugguguuucuac

SEQ ID NO: 120326 - RNA, 64 nt, Human
agauaggcugguccucaccuccagagccagccagccccgucaggggccaaacuuacuaccuuga

SEQ ID NO: 120327 - RNA, 52 nt, Human
cgaagaacuuuccaguuuagguccccgucacugucuccacgccgugauggca

SEQ ID NO: 120328 - RNA, 64 nt, Human
accuugauucauucacccuugauucauuucucgcccccgucacugauuauuuccuugagcauau

SEQ ID NO: 120329 - RNA, 64 nt, Human
ggcaggcagcccaggcccugggccugaucucuaaccccgucaugcugcugcugaccacacccag

SEQ ID NO: 120330 - RNA, 64 nt, Human
caacaacaaggcugcugggggccuguucuucagcccccgucagggcggggccagccucucuguc

SEQ ID NO: 120331 - RNA, 64 nt, Human
ugcuuagagggaugcuuuaaccaacccucuuccuccccgucauuguacuguaacugggacagaa

SEQ ID NO: 120332 - RNA, 64 nt, Human
ucuccaucaacacugcgccggguaccauggacggccccgucagccacaccugucagcccaagca

SEQ ID NO: 120333 - RNA, 52 nt, Human
ccauuguggccgaugacugaauccccgucacucuuggaggacuccugugacg

SEQ ID NO: 120334 - RNA, 64 nt, Human
cuuccuaaguaaauccaaacauugucuccauccuccccgucauuagugcucuuucaaugugaug

SEQ ID NO: 120335 - RNA, 64 nt, Human
ggaccccuucacguggccacagccccagcccugcccccgucacacugcugugccuuagucaugu

SEQ ID NO: 120336 - RNA, 64 nt, Human
accgucacccccaguauaggauaugcuuguauccccccgucacuccuccgccuguuuuuuaaac

SEQ ID NO: 120337 - RNA, 64 nt, Human
gacuggggcaauguuaauuuaguggaaaaggcacccccgucaagagugaauucccucacucguc

SEQ ID NO: 120338 - RNA, 64 nt, Human
auaugaggcacccuuugcuccacccacagcagggccccgucagacucugccagcgcguccugcc

SEQ ID NO: 120339 - RNA, 64 nt, Human
gcucacccaggcgccucaacaguagcccccgggcccccgucagcccccucaaguucuccccuuu

SEQ ID NO: 120340 - RNA, 64 nt, Human
gugacugguagggcuguguuuacagucagggccaccccgucacauauacaaaggagcugccugc

SEQ ID NO: 120341 - RNA, 64 nt, Human
uuaaagacugaacuacuguguguguaaccguuucccccgucaaccaaaaucaguguuuauagag

SEQ ID NO: 120342 - RNA, 64 nt, Human
gcagguggccucgcuuugccggguccgagaggcuccccgucaauuuugcacgggauccuagcuc

SEQ ID NO: 120343 - RNA, 64 nt, Human
cugggugacacuccagccugggugacaaaggagaccccgucaaaaaaaaaaguacuugucccaa

SEQ ID NO: 120344 - RNA, 64 nt, Human
cucaguuugaacaaacuagcaacaauuaagugacccccgucaacccacugccucccaccccgac

SEQ ID NO: 120345 - RNA, 64 nt, Human
agagaaaauauuuguucaggguuguccccccgccccccgucacugcauaauuucuccucuuaca

SEQ ID NO: 120346 - RNA, 64 nt, Human
gccuccccuucuucccugggcuuuagaccuuuguccccgucacugccagcgcuugggcugaagg

SEQ ID NO: 120347 - RNA, 64 nt, Human
gugccggggaggagaaauugggcugaugugagcuccccgucacccgccauggagccggcugugu

SEQ ID NO: 120348 - RNA, 64 nt, Human
guaccagcuggacaagguguuuggggcaugcugcccccgucaccgaggaucuguguggguagcc

SEQ ID NO: 120349 - RNA, 64 nt, Human
uacccugcugaucucccugagccugccuuugagcccccgucacguugggcacugcugccaaaga

SEQ ID NO: 120350 - RNA, 64 nt, Human
ugcagacuucaggagaacucauguuauuuuuuaaccccgucaacaaaucuaggaaaauauuuug

SEQ ID NO: 120351 - RNA, 64 nt, Human
ccucaucccgucaccucguccccacauccccuugccccgucaccucguccucauguccccuugu

SEQ ID NO: 120352 - RNA, 64 nt, Human
uggcaguggggacauucagcugaugcauuauauaccccgucagagcacacuuguaucuuuuacc

SEQ ID NO: 120353 - RNA, 64 nt, Human
gcugugaggccugcuccccugcgaccgcccugccccccgucaccgaaucggacacucauccuuu

SEQ ID NO: 120354 - RNA, 64 nt, Human
ccccccccgcagccagugcuccuugucaagcuccccccgucacuccaggugggagccaccccgg

SEQ ID NO: 120355 - RNA, 64 nt, Human
ccccugaccccaccccacccacagagcacgagggccccgucagcucagucugugucagccccga

SEQ ID NO: 120356 - RNA, 64 nt, Human
cucaaaaugaagauacugacaccaccuuugcccuccccgucaccgcgcacccacccugaccccu

SEQ ID NO: 120357 - RNA, 57 nt, Human
guguuucgccccaggacuagccugcgcccccgucaccuccaccucaccugugcugcc

SEQ ID NO: 120358 - RNA, 57 nt, Human
cccuagaaguguggacauaguugaggcccccgucagggagaggucaccagcugcugu

SEQ ID NO: 120359 - RNA, 64 nt, Human
caggcacuggcugaacuuggagagggggccggacccccgucagcugcuucugcugccuagguuc

SEQ ID NO: 120360 - RNA, 64 nt, Human
uguaguggcaaagccgagaccgagucuccuaaguccccgucagugugguuuucaccacaggacu

SEQ ID NO: 120361 - RNA, 64 nt, Human
aagugccccugcugccuccccaacccugccccugccccgucaccaucucaggccaccugccccc

SEQ ID NO: 120362 - RNA, 64 nt, Human
uccuuuacagcucuucucaacccucaccuccaucccccgucacccaggcaccuucgcuuccaga

SEQ ID NO: 120363 - RNA, 64 nt, Human
agcagggagaggagucuuuccuccugccagcuucccccgucagccccaaccccagcccacacau

SEQ ID NO: 120364 - RNA, 64 nt, Human
cccuggccuuccuuuccucuuuccuccucacucuccccgucaugcucccucugccccgcccuca

SEQ ID NO: 120365 - RNA, 64 nt, Human
ggugaccgugaacauccuuccucaucgggucuguccccgucauuuccucccggagucgucgcag

SEQ ID NO: 120366 - RNA, 64 nt, Human
cugcugcccuuucugugccccccagguucuaucuccccgucacacccgaggccuggcuucagga

SEQ ID NO: 120367 - RNA, 64 nt, Human
ccacagaggacucacuugcccacaccgagggcgaccccgucacagccucaagucacucccaagc

SEQ ID NO: 120368 - RNA, 64 nt, Human
acugcuccugggggaugagguccugguuuuaaagccccgucauuucaagcgggucgaucuucca

SEQ ID NO: 120369 - RNA, 64 nt, Human
ccccuuuaacucagaugucaagccaccgggcaaaccccgucaauaccucccaccaaggaaugag

SEQ ID NO: 120370 - RNA, 64 nt, Human
gcccggucccuggccaucagcgacgcuguccgccccccgucagaucccaugugugccauguuua

SEQ ID NO: 120371 - RNA, 64 nt, Human
caucaggguggcacgucaggcccugcacgaugugccccgucaccucccugcccucccgucauuu

SEQ ID NO: 120372 - RNA, 64 nt, Human
guuaggccccgcccuccccaaagucccgccccgcccccgucacgugcgcugggcacuucccugc

SEQ ID NO: 120373 - RNA, 64 nt, Human
gacguauuuauggcuccaccuccccaccucccucccccgucagugggaugacugggggaggguu

SEQ ID NO: 120374 - RNA, 64 nt, Human
cagccccccuuuucccccauggucauggugucacccccgucacccucugacugcaggccugggc

SEQ ID NO: 120375 - RNA, 64 nt, Human
acccugggcgcugaaaaugggacccaggaaucccccccgucaauaucuuggccucagauggcuc

SEQ ID NO: 120376 - RNA, 64 nt, Human
ccgccuggagguccccaucucacgugugaugccaccccgucaccccuccccuccugagcaggga

SEQ ID NO: 120377 - RNA, 64 nt, Human
gaguccagccucauaguggccgagccaucccuguccccgucagcagugucugugugucugcaua

SEQ ID NO: 120378 - RNA, 64 nt, Human
gccugccgggguggcagagugaguugucucaggaccccgucacugcgacguugacacuccucuc

SEQ ID NO: 120379 - RNA, 64 nt, Human
uugccagagcucccaucugccccacucgccuuugccccgucaucgaugauucaggcagagccag

SEQ ID NO: 120380 - RNA, 64 nt, Human
uucauaaucuggaggcaagguucgacugcagccgccccgucagccugugcuaggcauggugucu

SEQ ID NO: 120381 - RNA, 64 nt, Human
gggccaagagcagcuuugaagcuccagagaaccaccccgucagguuccuuguggaagcuccccu

SEQ ID NO: 120382 - RNA, 64 nt, Human
acucucagcccuggcacuggcaccccaggguuggccccgucagcagaggcuuggcuuucgagcc

SEQ ID NO: 120383 - RNA, 64 nt, Human
ucagcgauucuuugacugcggacccugugggaaaccccgucaauaaauguuaaagacacacucc

SEQ ID NO: 120384 - RNA, 64 nt, Human
gguacagcccgcaaugggccuguaaauaguccggccccgucagcgugugcugguccagccagcg

SEQ ID NO: 120385 - RNA, 64 nt, Human
acagaagacccagacggucuguguggccuauuucccccgucagguugcacaggugcaugcaaga

SEQ ID NO: 120386 - RNA, 64 nt, Human
auguggcuucuggaaucauuguccagagcugcuuccccgucaccugggcgucaucugguccugg

SEQ ID NO: 120387 - RNA, 64 nt, Human
auagauuaaaaaaaaaauagccgugcacucuugaccccgucagcguccaacguggaaaaggcgu

SEQ ID NO: 120388 - RNA, 64 nt, Human
gaguuucacuuuuguugcccaggcuggaguguaguggcgcgaucucggcucagccucccgagua

SEQ ID NO: 120389 - RNA, 64 nt, Human
gaguuucgcucuuguugcccaagcuggagugcaguggcgcgaucucggcucacugcaaccuccg

SEQ ID NO: 120390 - RNA, 64 nt, Human
agggucucacucugucacccaggcugcagugcaauggcgcgaucucagcucacugcaaccucca

SEQ ID NO: 120391 - RNA, 64 nt, Human
agagucucacucugucacccaggcuggagugcaguggcgcgaucucagcucacugcaaccucug

SEQ ID NO: 120392 - RNA, 64 nt, Human
ggagucuugcucuguugccuaggcuggagugcaguggcgcgaucuuggcccccugcaaccuccg

SEQ ID NO: 120393 - RNA, 64 nt, Human
guaucauuggagcugccugucugcauguauccucuggcgcgaaugcucucuguuggcucugcag

SEQ ID NO: 120394 - RNA, 64 nt, Human
agagucucguucggucccccagcuuggagugcaguggcgcgaucucggcucacugcaaccuccg

SEQ ID NO: 120395 - RNA, 64 nt, Human
gaguuucgcucuuggugcccaggcuagagugcaauggcgcgaucucagcucaccucaaccuccg

SEQ ID NO: 120396 - RNA, 64 nt, Human
ggugucucacgcuaucgcccaggcuggagugcaguggcgcgaacucggcucacugcaaccuccg

SEQ ID NO: 120397 - RNA, 64 nt, Human
ggaggcucggggccgcccaugcagacuuuuggccuggcgcgaucccccaagaaccccuccaggg

SEQ ID NO: 120398 - RNA, 64 nt, Human
gagucucacacagucacccgggauuggaaugcaauggcgcgaucucagcucacugcaaccucug

SEQ ID NO: 120399 - RNA, 64 nt, Human
agagucucacucugucgcccaggcuagagugcaguggcgcgauuuuggcucacugcaaccuccg

SEQ ID NO: 120400 - RNA, 64 nt, Human
gagucucacucuuguugcccaggcuggacaacaauggcgcgaucucggcucacugcaaccucca

SEQ ID NO: 120401 - RNA, 64 nt, Human
ggagccuugcucugucgcccaggcuggagugcaguggcgcgaucucggcucuaugcaaccucca

SEQ ID NO: 120402 - RNA, 64 nt, Human
gaguuucacucuuguugcccaggcuggagugcaauggcgcgaucucagcucacugcagccacug

SEQ ID NO: 120403 - RNA, 64 nt, Human
ggagucucacucuguuacccaggcuagagugcaguggcgcgaucuccgcucacugcaagcucug

SEQ ID NO: 120404 - RNA, 64 nt, Human
acagggucucacucuugccuaggcuggagugcgguggcgcgaucuuggcuuacugcacccucug

SEQ ID NO: 120405 - RNA, 64 nt, Human
ggagucucgcucuguugcccaggcuggagugcaguggcgcgaucucagcucacugcaagcucca

SEQ ID NO: 120406 - RNA, 64 nt, Human
gaguuucucucuuguugcccaggcuggagugcauuggcgcgaucucggcucaccgcaaaguccg

SEQ ID NO: 120407 - RNA, 64 nt, Human
cagagucucgcucugucgccaggcuagagugcgguggcgcgaucuugacucacugcaaucucca

SEQ ID NO: 120408 - RNA, 64 nt, Human
ggagucucgcuuuguugcccagacuggagggcaguggcgcgaucucggcucacugcaaccucug

SEQ ID NO: 120409 - RNA, 64 nt, Human
ggagucucgcucugucgcccaggcuggagugcaguggcgcgaucucagcucacugcaaccuccg

SEQ ID NO: 120410 - RNA, 64 nt, Human
uuugucucgcucuguugcccaggcuggaguacaguggcgcgaucucagcucacugcaagcuccg

SEQ ID NO: 120411 - RNA, 64 nt, Human
augguauccgagccugguagggaagggacccgcguggcgcgacccugaccgaucccaccucaac

SEQ ID NO: 120412 - RNA, 64 nt, Human
uuagaagagcuuuuacuugggcgcccgccgucucuggcgcgaacacuggaaugcauauacuacu

SEQ ID NO: 120413 - RNA, 64 nt, Human
ggagucucgcucugucgcccaggcuggagugcaguggcgcgaucucggcucacugcaagcuccg

SEQ ID NO: 120414 - RNA, 64 nt, Human
agagucucacucugucacccaggcuggagugcaguggcgcgaucuuagcucucugcaaccucug

SEQ ID NO: 120415 - RNA, 50 nt, Human
ucacucaggcuggaguauaguggcgcgaucucagcucacugcaaccuccg

SEQ ID NO: 120416 - RNA, 64 nt, Human
ggaguuucgcucugucgcccaggcuggagugcaguggcgcgaucucgacucacugcaagcuccg

SEQ ID NO: 120417 - RNA, 64 nt, Human
ggagucucgcucugucacccaggcuggagugcaguggcgcgaugucggcucacugcaagcuccg

SEQ ID NO: 120418 - RNA, 64 nt, Human
ugaggauuaucagaacucagcauccauccaucaguggcgcgaguccaggaaggucauggguagg

SEQ ID NO: 120419 - RNA, 64 nt, Human
ugggagugugcauuuaacuguuucaugcgcuuguuggcgcgacuguggcucgagcuggcccgca

SEQ ID NO: 120420 - RNA, 64 nt, Human
ugaaucucacuccaucguccaggcuggagugcaguggcgcgaucucggcucacugcaaccucug

SEQ ID NO: 120421 - RNA, 64 nt, Human
gaguuucgcuuuuguugcccaggcuggagugcaauggcgcgaucuuggcucaccauaaccuccg

SEQ ID NO: 120422 - RNA, 64 nt, Human
ggagucuugcacugucacccaggcuggagugcaguggcgcgaucuuggcucacugcaacccccg

SEQ ID NO: 120423 - RNA, 64 nt, Human
gaguuuugcucuugucgcccaggcuggagugcaguggcgcgaucucggcucacugcaaccucug

SEQ ID NO: 120424 - RNA, 64 nt, Human
gaguuucgcuuuuguugcccgggcuggaaugcaauggcgcgauucagcucacugcaaucuccgc

SEQ ID NO: 120425 - RNA, 64 nt, Human
gagucuugcucuuguuguccaggcuggagugcaguggcgcgaucuaggcucacugcaaccuccu

SEQ ID NO: 120426 - RNA, 64 nt, Human
aaguuuugcucuuguugcccaggcuguaucgcaauggcgcgaucucugcucacugcaacaucca

SEQ ID NO: 120427 - RNA, 64 nt, Human
ggagucuugcucugucgcccaggcuggaaugcaguggcgcgaucucggcucacugcaaacucug

SEQ ID NO: 120428 - RNA, 64 nt, Human
ucugucuuacucugucacccaggcuagagugcaguggcgcgaucucagcucacugcagccuuga

SEQ ID NO: 120429 - RNA, 64 nt, Human
ggagucuugcucugucgcccaggcuggagugcgguggcgcgaucuaggcuuacugcaagcuccg

SEQ ID NO: 120430 - RNA, 64 nt, Human
ggagucucgcucugucgcccaggcuugagugcaguggcgcgaucucggcucacugcaagcucug

SEQ ID NO: 120431 - RNA, 64 nt, Human
uggggucucgcucugucaccaggcuggagugcaguggcgcgaucucggcucacugcaaccucca

SEQ ID NO: 120432 - RNA, 64 nt, Human
uggagucucgcucugucaccaggcuggagugcaguggcgcgaucucggcacaccuccgccuucu

SEQ ID NO: 120433 - RNA, 64 nt, Human
agagucucacucugucccccaggcuggagugcaguggcgcgaucuuggcccaccacgcccgccu

SEQ ID NO: 120434 - RNA, 64 nt, Human
agagucucacucugucacccagacuggagugcaguggcgcgaucucggcucacugcaagcucag

SEQ ID NO: 120435 - RNA, 64 nt, Human
ggagucucacucugucgccgaguuuggaguguauuggcgcgaucucggcucacuguaaccuccg

SEQ ID NO: 120436 - RNA, 64 nt, Human
cagagucuugcuuuguugccaggcuggagugcaguggcgcgaucucggcucaccacaaucgcug

SEQ ID NO: 120437 - RNA, 64 nt, Human
gaguuucacucuuguugcccaggcuggagggcaauggcgcgaucucagcucacugcaaccuccg

SEQ ID NO: 120438 - RNA, 64 nt, Human
ccaggagagcuccaggaagggcacugagcgcugcuggcgcgaggccucggacauccgcaggcac

SEQ ID NO: 120439 - RNA, 64 nt, Human
cagagucuuacucuguugccaggcuggagugcaguggcgcgaucucagcucacuacaaccuccg

SEQ ID NO: 120440 - RNA, 64 nt, Human
ggcaucuugcucugucgcccaggauggagugcaguggcgcgaucuuagcucacugcaagcuccg

SEQ ID NO: 120441 - RNA, 64 nt, Human
aggguggaagcuggaagcugagacacagguuagguggcgcgaggcugcccugcgcuccgcuuug

SEQ ID NO: 120442 - RNA, 64 nt, Human
gggcagggucucugucgcccaggcuggggugcaguggcgcgaucccagcacugcagccucaacc

SEQ ID NO: 120443 - RNA, 64 nt, Human
ggagucuugcucugucgcccaugcuggagugcaguggcgcgaucucggcucacugcaaccucca

SEQ ID NO: 120444 - RNA, 64 nt, Human
ccgagucacucuugucacccaggcuggagugcaguggcgcgaucucggcucacugcaagcucca

SEQ ID NO: 120445 - RNA, 64 nt, Human
ggagucucgcacuguugcccaggcuggagagcaguggcgcgaucuuggcucacugcaagcuccg

SEQ ID NO: 120446 - RNA, 64 nt, Human
ccggccaccgaacucaguguugcaacucacuuuguggcgcgauuaaagguuagcaauggacaga

SEQ ID NO: 120447 - RNA, 64 nt, Human
ggagucucgcucugucgcccaggcuggagugcaguggcgcgaucucggcucacugcaagcucug

SEQ ID NO: 120448 - RNA, 64 nt, Human
agagucucucucugucacccaggcuggagugcaauggcgcgaucuuggcucacuguaacuucca

SEQ ID NO: 120449 - RNA, 64 nt, Human
gaguuucgcccuugucacccaggcuguagugcgguggcgcgaucucggcucacugcaaccuccg

SEQ ID NO: 120450 - RNA, 64 nt, Human
agucucgcucuguugcccaggcuggcgagugcaauggcgcgaucuuggcucacugcagccucca

SEQ ID NO: 120451 - RNA, 64 nt, Human
agucccagcuacucaggaggcugaggcaggagaauggcgcgaacaugggaggcguagcuugcag

SEQ ID NO: 120452 - RNA, 64 nt, Human; identical to SEQ ID NO: 120447

SEQ ID NO: 120453 - RNA, 64 nt, Human
uggggucuugcucugucgccaggcuggagugcaguggcgcgaucuaggcucacugcaacuuccg

SEQ ID NO: 120454 - RNA, 64 nt, Human
gaguuucacucuugucgcucaggcuggagugccauggcgcgaucuuggcucacugcaaccucug

SEQ ID NO: 120455 - RNA, 64 nt, Human
uugagacggaguccuugcccaggcuggagugcaguggcgcgaucucagcucacugcaagcuccg

SEQ ID NO: 120456 - RNA, 64 nt, Human
uucuugugcaugacgcccugcucuggggagcgucuggcgcgaucucugccugcuuacucgggaa

SEQ ID NO: 120457 - RNA, 64 nt, Human
ggagucuugcucuguagcccaggccagagugcaguggcgcgaucucagcucacugcaagcucug

SEQ ID NO: 120458 - RNA, 64 nt, Human
gaguuucacucuuguugcccaagcuggagugcaauggcgcgaucucggcucaccacaacauccg

SEQ ID NO: 120459 - RNA, 64 nt, Human
agagucuugcucugucacccaggcuggagugcaguggcgcgaucuuggcucacugcaagcuccg

SEQ ID NO: 120460 - RNA, 64 nt, Human
ggccccacccugggcaguauagagacgucggacuucacgaaaagacaacuggcagugcagaguu

SEQ ID NO: 120461 - RNA, 64 nt, Human
cuugcccguggggaguaagaguuaauaaacacacucacgaaaaguucugaauagugucugugaa

SEQ ID NO: 120462 - RNA, 64 nt, Human
auuauaaaguucagauguuucaucaaugcaguucucacgaaaguauuuacuuuuuaaaaauaac

SEQ ID NO: 120463 - RNA, 64 nt, Human
ugccacaguggcuuccuuccauccuauuccccagucacgaaagggcugguccccagagcucacc

SEQ ID NO: 120464 - RNA, 64 nt, Human
uuggaugauauuuauuaaauagcuucuaagaguccggcggcaucugucuugucccuauuccugc

SEQ ID NO: 120465 - RNA, 64 nt, Human
ccucuuugaugcucugauacuguucuguuuuucuucacgaaauacccuuuggauagcuaaagug

SEQ ID NO: 120466 - RNA, 64 nt, Human
uucaaggucuaggucuccaucaucuagaucucauucacgaaauaaauacagugaucauucacag

SEQ ID NO: 120467 - RNA, 64 nt, Human
uuuagguugcagaauggacuccucaucuuuauauucacgaaaaagcaaucugaagaaaacaaau

SEQ ID NO: 120468 - RNA, 64 nt, Human
uauuuugauccugagagaguccaaaaugcacuggucacgaaacgucuaauacuaugacuguuaa

SEQ ID NO: 120469 - RNA, 64 nt, Human
augaggauuaaacuccaguucugcccgauucucaucacgaaauccuuaucccaugccucauugu

SEQ ID NO: 120470 - RNA, 64 nt, Human
gucagauagccagaagaaauuccauugcugguuuucacgaaauucacuugucuuuugcuaauaa

SEQ ID NO: 120471 - RNA, 64 nt, Human
uuuuccuacagcuucuccccaucuuucaaaagaaucacgaaauuucuucugcaccuuggcuauu

SEQ ID NO: 120472 - RNA, 64 nt, Human
aaacaaacgaaacaacugacuucauaccccugccucacgaaaacccaaaagacacagcugccuc

SEQ ID NO: 120473 - RNA, 64 nt, Human
uauagaggcaacagucugaacucuccuggccagcucacgaaaguuaauuauacauuauucuaca

SEQ ID NO: 120474 - RNA, 64 nt, Human
acgcuggguccuccucucugggacacagggguacucacgaaaacugggccgcgugguuugguga

SEQ ID NO: 120475 - RNA, 64 nt, Human
uucauucacuucagccacuaagaaaaguuuagaaucacgaaagcuuaacugcugugguuuaaag

SEQ ID NO: 120476 - RNA, 64 nt, Human
gccuuuacaauuacccaguucugaggguucagguucacgaaaagaaaugcaacuugggauaauc

SEQ ID NO: 120477 - RNA, 64 nt, Human
uuuuaagcuaccaggaaggaaagggaagaagagaucacgaaacugggacccccagaagggagga

SEQ ID NO: 120478 - RNA, 64 nt, Human
ccacagcucuguuaaauaaaugggagaaaucacaucacgaaaauucugugccugucgucagugu

SEQ ID NO: 120479 - RNA, 64 nt, Human
uagcggggaagauguugaccaagguggagaagaaucacgaaaaggagaagucacagcaccuaga

SEQ ID NO: 120480 - RNA, 64 nt, Human
ccaccaaaaacaaauacaaggggacuucaaaaguucacgaaaaaauugaauuaaaagauaaaaa

SEQ ID NO: 120481 - RNA, 64 nt, Human
aaccccucccuggugucugaucagggcuguggcaucacgaaacauuggaucaugacaugucggg

SEQ ID NO: 120482 - RNA, 64 nt, Human
uaagguuucaaggaguaucugauggguuaggaagucacgaaaugaggaguucuugccacauuug

SEQ ID NO: 120483 - RNA, 64 nt, Human
auagaguuacauuuuaauagcaacuguguacaugucacgaaaccauuucccuuaucaaagaugu

SEQ ID NO: 120484 - RNA, 64 nt, Human
cucuuauaaaaauguauuugauacugugauauguucacgaaaaguauucuuuaauuauucuuug

SEQ ID NO: 120485 - RNA, 64 nt, Human
aacaagugaugaaaacaucucaauuggguucagaucacgaaaacacggaagaagucucuaugag

SEQ ID NO: 120486 - RNA, 64 nt, Human
aaaaauaaaugcuuguuuaguaucaaauuuuauuucacgaaaguuuuuuuaaagaacagaaacu

SEQ ID NO: 120487 - RNA, 64 nt, Human
cugcauuaguguuagugcucagaaaucaccauaaucacgaaaauaauaauaauaaaucuuuaac

SEQ ID NO: 120488 - RNA, 64 nt, Human
ucuaagagguuggaaaaugaacuacucaagauagucacgaaaauacugaaaguuugauuuuucu

SEQ ID NO: 120489 - RNA, 64 nt, Human
uuuggucuaaggaauaaauagcuuuuacacuggcucacgaaaaucugcccugcuagaauuugcu

SEQ ID NO: 120490 - RNA, 64 nt, Human
guucuuaauagugaaugcuuuaaaauuaaagucaucacgaaauggaaguuuucccaggguggaa

SEQ ID NO: 120491 - RNA, 64 nt, Human
cacaaacacacaaauaaacagacauaagaugucaucacgaaacugcccacggaucuuuaggcuu

SEQ ID NO: 120492 - RNA, 64 nt, Human
ugugcuuguaguucagggguuuggccaagaaucaucacgaaagggucggugguaaccagguugu

SEQ ID NO: 120493 - RNA, 64 nt, Human
ugccccuggcaaaugcacacaccucaugcuagccucacgaaacuggaauaagccuucgaaaaga

SEQ ID NO: 120494 - RNA, 64 nt, Human
uaguauaucaaaguuuuaguaguuuccuccacauucacgaaauuaccacagugagagcuaagca

SEQ ID NO: 120495 - RNA, 64 nt, Human
ugaagauuuuacucacaaaaaaaaucaacaaaaaucacgaaacuagaaaacuuuuuuuuuccuc

SEQ ID NO: 120496 - RNA, 64 nt, Human
cccucuuuuacagcuggacagaaagaagucaaugucacgaaaugauuuucuauuguagauacuu

SEQ ID NO: 120497 - RNA, 64 nt, Human
uuaugcacacuguaagagaagccauuuuggaaauucacgaaaguacugcuccaccccaguugag

SEQ ID NO: 120498 - RNA, 64 nt, Human
aaacaaucacggugcgaaauguccgcauggaugaucacgaaacaaucacggugcagaauguccg

SEQ ID NO: 120499 - RNA, 64 nt, Human
ccgggugggcauuccaaaauguccgcauggacgaucacgaaacaaucacggugcgaaauguccg

SEQ ID NO: 120500 - RNA, 64 nt, Human
gggaggaggaauggcuuuguggucgucguugugcucacgaaaggaaaaauggggaggucuuuuu

SEQ ID NO: 120501 - RNA, 64 nt, Human
aaccugaagucaucuagauuauggggaaacugcucagcuucaauaaaccuguccaaaugacucu

SEQ ID NO: 120502 - RNA, 64 nt, Human
gagugcccucuacuguccgacuccagcacugcaacagcuucaaguucaaaaccaagaggcguuu

SEQ ID NO: 120503 - RNA, 64 nt, Human
aaugacaugagggccaaggcuugugggaaaaugacagcuucacagccccuugaggagugaccaa

SEQ ID NO: 120504 - RNA, 64 nt, Human
aaguuagcugaaagcagggcacuccuggauaaagcagcuucacucaacucuggggaaugcuacc

SEQ ID NO: 120505 - RNA, 64 nt, Human
cauccuugcugggggcccauggcuuguggcaguucagcuucacccucaggaguggcccgaaccc

SEQ ID NO: 120506 - RNA, 64 nt, Human
ugcuacaggaggggucucauguccugcuggcuuccagcuucaggcaccagcauccaccuuggcu

SEQ ID NO: 120507 - RNA, 64 nt, Human
gaugaggagauagccuuuucaggcaaggacaagccagcuucagagaauagugaggagaagcuga

SEQ ID NO: 120508 - RNA, 64 nt, Human
aauggcagccacagaggguccccucugggagaaacagcuucaccccagccucagggcccugggc

SEQ ID NO: 120509 - RNA, 64 nt, Human
uagagcuguugggguggcacaguggcccaaagagcagcuucagagauaauuccuugguucuaug

SEQ ID NO: 120510 - RNA, 64 nt, Human
uuucuaaaguaaguuacccacauugaccaaaaugcagcuucaacguugaguaaagggauuucug

SEQ ID NO: 120511 - RNA, 64 nt, Human
ugugcccugggcaucacugagcagaggggugcggcagcuucaggaggcagaaacgagaggggug

SEQ ID NO: 120512 - RNA, 64 nt, Human
aggcuuaggccauugauaucgcaguucuuccuaucagcuucagugacccagggucugaacugcc

SEQ ID NO: 120513 - RNA, 64 nt, Human
caacaugggucucgcuaugaaguuacaaaaucuucagcuucagccaggcaacgcuaagcucuga

SEQ ID NO: 120514 - RNA, 64 nt, Human
ccugagccaccagacaggaaaggguagcagaaaacagcuucacuccucaggaaguaccauggac

SEQ ID NO: 120515 - RNA, 64 nt, Human
aggugugggaaaacuugaucugaaagaaaauuaucagcuucaauuggcgauugauucagugccc

SEQ ID NO: 120516 - RNA, 64 nt, Human
ucaaauugcuaaaacccugaaucugcuuauucuucagcuucaccucugcacuaaccccuuaccc

SEQ ID NO: 120517 - RNA, 64 nt, Human
cccaggguggauugcagcugaucauagcucacugcagcuucaaacucuugggcucaagccaucc

SEQ ID NO: 120518 - RNA, 64 nt, Human
aaaauggaagacugauuuuugacucuauuauaaucagcuucagagauuccuuaaaccuuccuaa

SEQ ID NO: 120519 - RNA, 64 nt, Human
cugccccccacccccagcggcccaccccaugccucagcuucaugucugucccauuccuauacca

SEQ ID NO: 120520 - RNA, 64 nt, Human
ucuuuaacccccugaccuuucuugacuuccccuucagcuucagaccccuuccccaccaggcuag

SEQ ID NO: 120521 - RNA, 64 nt, Human
caggaucuccugccagcccagcuggccuggcccccagcuucaccucugggaccccagcugcucu

SEQ ID NO: 120522 - RNA, 64 nt, Human
uaauagaggaacucugagucacccaugccagcaucagcuucagccccagacccugcaguuugag

SEQ ID NO: 120523 - RNA, 64 nt, Human
ccagcaagaggcagcaucagucauggcuuuauaacagcuucauggugccucaaagacuguugag

SEQ ID NO: 120524 - RNA, 64 nt, Human
gugccucuuggccuggcuuucccuuggccuuccucagcuucaccuugauacugggccucuuccu

SEQ ID NO: 120525 - RNA, 64 nt, Human
gcauucagaaacccuacaaccaaaaguccauccacagcuucaugacccacccugaauucgccau

SEQ ID NO: 120526 - RNA, 64 nt, Human
guucacacaaaaacucgcacaugacuguuuauagcagcuucauucauaauuaccaaaaacuaga

SEQ ID NO: 120527 - RNA, 64 nt, Human
uguccuuccccaguuuccucgcccuccaccccuccagcuucaugcucaguguugugcuuaauaa

SEQ ID NO: 120528 - RNA, 64 nt, Human
uaugaagguuugcuugggaugaaaaaggauauugcagcuucagcaguguugaacuguguguuua

SEQ ID NO: 120529 - RNA, 64 nt, Human
ccacccuccaaggugcauugucuuccaguaucuacagcuucagacuugagcuaaguaaaugcuu

SEQ ID NO: 120530 - RNA, 64 nt, Human
gggcuacucuguguuuccagugugggaaaaaacacagcuucaccaggagguucuccacuguggu

SEQ ID NO: 120531 - RNA, 64 nt, Human
uacgccguuccaccaauuuuuuuuuuagccccaccagcuucaggacuucugccaauuuugaaug

SEQ ID NO: 120532 - RNA, 64 nt, Human
ccagccagggcaacugccugacguugcacgauuucagcuucauuccucugauagaacaaagcga

SEQ ID NO: 120533 - RNA, 64 nt, Human
cccagccucggccguaaagugaaagagaccggaccagcuucagcuuucggacucugguucuugg

SEQ ID NO: 120534 - RNA, 64 nt, Human
ugcaugcgucacugguaguaggaggagccugucccagcuucaucuuguccugagauuuauccac

SEQ ID NO: 120535 - RNA, 64 nt, Human
uuuaauuugaugaaagcugauuacugucaauaaacagcuucaugccuuuguaaguuauuucuug

SEQ ID NO: 120536 - RNA, 64 nt, Human
caagauauguuuuugguagcaaaacugagaaaaucagcuucaggucugcaaucaaauucuguuc

SEQ ID NO: 120537 - RNA, 64 nt, Human
cagagaaccuuuagaauaucuuuucaaguuuccccagcuucaucuuugggaaagcuuacuguuu

SEQ ID NO: 120538 - RNA, 64 nt, Human
gugcagaccaagagcaccacagacuacaacugcccagcuucaucuaaauacuuguuaaccucuu

SEQ ID NO: 120539 - RNA, 64 nt, Human
aauaggaaacagucucuaaaugugaggcugaauacagcuucagucuggcucucuaauaggacaa

SEQ ID NO: 120540 - RNA, 64 nt, Human
aaagaaaaugacaugaaucuuuauuuuucacugccagcuucaaggaaagaaaauuuuuucuaca

SEQ ID NO: 120541 - RNA, 50 nt, Human
guccacccaagagcaaguaacagcuucaggauucaucaggagcaugagag

SEQ ID NO: 120542 - RNA, 50 nt, Human
auccaccgaagagcaaguaacagcuucagaauucaucaggaccaagaaag

SEQ ID NO: 120543 - RNA, 64 nt, Human
cagauucucacucauguuuaagaucuuguuauuucagcuucauaagaucaaagaggagucuuuc

SEQ ID NO: 120544 - RNA, 64 nt, Human
ucagauaaaaauuuccagggugcacuuccagaaccagcuucaacauaugucuacauugccccca

SEQ ID NO: 120545 - RNA, 64 nt, Human
uucuuuuauaaguaaaguuuacccaggcauggaccagcuucagccagggacaaaauccccuccc

SEQ ID NO: 120546 - RNA, 64 nt, Human
caggacaaggacugaaaauaaugucuacaguccacagcuucagcauuuccagagaccacaugug

SEQ ID NO: 120547 - RNA, 50 nt, Human
gggggggccugcagcagugacagcuucaagaacuuaacagccuugcuccu

SEQ ID NO: 120548 - RNA, 64 nt, Human
gaaagguaaagcaacaccaaauaaaagcccacagcagcuucaucuuuacgauaacucagugcau

SEQ ID NO: 120549 - RNA, 64 nt, Human
gccaugugagcccccugaugccaccgagcaggggcagcuucaugaccgaugucuggcugaggcu

SEQ ID NO: 120550 - RNA, 64 nt, Human
cccucugagggcaaaguggcaggacacugcagaacagcuucauguucccaaaaucaccguacga

SEQ ID NO: 120551 - RNA, 64 nt, Human
ggggaagacauuugcaacugacuuggggaggacacagcuucagcacagccucuccugcgggcca

SEQ ID NO: 120552 - RNA, 64 nt, Human
uaccugggcagcaccucugccgacgccgucccaccagcuucacucucuccgucuguuuuugcaa

SEQ ID NO: 120553 - RNA, 64 nt, Human
uggucuccaaagauccuucaaaaauacaucaagccagcuucauucacucacuuuacuuagaaca

SEQ ID NO: 120554 - RNA, 64 nt, Human
uuuacuuagguaccccacgaguuguccacauaagcagcuucaucuuuaccuugccagaguugac

SEQ ID NO: 120555 - RNA, 64 nt, Human
uuaggauuuauucaaaaacagacuauucuguuuucagcuucagaauuguucuuugaauccuaag

SEQ ID NO: 120556 - RNA, 64 nt, Human
cauaaugaguaaugcagacauuuacauguucuuccagcuucaaucaguagaccugauuuucaaa

SEQ ID NO: 120557 - RNA, 64 nt, Human
auagugccagggugcggccugagauauuuuucuacagcuucauagagcaaccagucaaaaccag

SEQ ID NO: 120558 - RNA, 64 nt, Human
ggauggaguacaguggcauggucaaggcucacugcagcuucaaucuucugggcucaaguaaucc

SEQ ID NO: 120559 - RNA, 64 nt, Human
ugaaaaauaccacauaaugaucaguaugcugugccagcuucauuuggggagaaauaacuaguag

SEQ ID NO: 120560 - RNA, 64 nt, Human
ggcgugaucuuggcucacugcaaccucugccucccagcuucaagcgauucuccuguaucagccu

SEQ ID NO: 120561 - RNA, 64 nt, Human
uguucgaacugccaaacugacuccaguuucugcccagcuucaagauauugaaggaaaaauugac

SEQ ID NO: 120562 - RNA, 64 nt, Human
ucgauaucagcuuuugugauggcauuguggucaucagcuucaugacauuuuacccauuugcagu

SEQ ID NO: 120563 - RNA, 64 nt, Human
uagcuuguuuaggguacaagaagccuguucuguccagcuucagugacacaagcugcuuuagcua

SEQ ID NO: 120564 - RNA, 64 nt, Human
gggugugugggcuggaaccagugggucacuguggcagcuucaucugagccgaaggugugggucc

SEQ ID NO: 120565 - RNA, 64 nt, Human
ggaaacccaggcccgccggccacgacucugcccucagcuucacagucaccgaagaaaugaaguu

SEQ ID NO: 120566 - RNA, 64 nt, Human
gacugcgcucucuuggggcugagggagcaccaugcagcuucaccccucacaaagccaugcacgc

SEQ ID NO: 120567 - RNA, 64 nt, Human
gcccaaggccaauauaggauuaauaucuguguuccagcuucagccagaacgauaugucugucca

SEQ ID NO: 120568 - RNA, 64 nt, Human
cgaucaagaucuaucucucuucguagaucaagaucagcuucacucagaagaucuaggucugguu

SEQ ID NO: 120569 - RNA, 64 nt, Human
gcuggucuuguuuggaggaggccaagugaaugugcagcuucaaagaggagaguucguugucucc

SEQ ID NO: 120570 - RNA, 64 nt, Human
cauuugucauguucacuuaccugcugauggaauccagcuucaagagcauacucuguacuagggc

SEQ ID NO: 120571 - RNA, 64 nt, Human
aaaaauuguaaacaucacuuauauuacuuuauugcagcuucaucaccaguacauuauauguugu

SEQ ID NO: 120572 - RNA, 64 nt, Human
cacccugggguuuuccacucuuucagagaaaccucagcuucaucacaucaaaguuacuccagag

SEQ ID NO: 120573 - RNA, 64 nt, Human
gucucccggaugauuuccgucaugcucccaaaugcagcuucaggugagccaaggggucugcucc

SEQ ID NO: 120574 - RNA, 64 nt, Human
guagaaacguggguuaagcucuuccugccccguucagcuucacucccacccuuucagcguccug

SEQ ID NO: 120575 - RNA, 64 nt, Human
cggaucugcacugccaacugggauuggguucgaacagcuucauaaacaucuucagcauuuugua

SEQ ID NO: 120576 - RNA, 64 nt, Human
aguauauuuuuauauaugaugugauguagggguccagcuucauucuuuugcuuguggaucucca

SEQ ID NO: 120577 - RNA, 64 nt, Human
cuuucuuuucgccgacacgauggcagccaaacugcagcuucaaacgcucacacuuggcuggguu

SEQ ID NO: 120578 - RNA, 64 nt, Human
aguguuaagaggguaacauggguuaccuuugcaccagcuucaguguuaagcucacccuguucuu

SEQ ID NO: 120579 - RNA, 64 nt, Human
guccuuucgauaguuugcugagaaugaugguuuccagcuucauccauguuccuacaaaggacau

SEQ ID NO: 120580 - RNA, 64 nt, Human
uuuuauaauguggauuuccuauuuuaaaaccaugcagcuucaucaauuuuuauacauaucagaa

SEQ ID NO: 120581 - RNA, 64 nt, Human
uuucuuguccaaugauccuugcguggccgagauccagcuucaacgaaccagcuagaagcugccc

SEQ ID NO: 120582 - RNA, 64 nt, Human
ugggauauggguuuuaaauggacauugucuguaccagcuucauuaaaauaaacaauauuuguaa

SEQ ID NO: 120583 - RNA, 64 nt, Human
acaugaaggggcacuuuaaaucaggaaaaucucucagcuucauagaacggguaacuagugcagg

SEQ ID NO: 120584 - RNA, 64 nt, Human
cuuucuuaagcccuuugcucuggaggaaguucuccagcuucagcucaacucacagcuucuccaa

SEQ ID NO: 120585 - RNA, 64 nt, Human
augcagcuugcuucucucuacagauugagaaguccagcuucaaaaguuacuugccacuuaagca

SEQ ID NO: 120586 - RNA, 64 nt, Human
cacaaguaaaaggaaaugcuccuccagggagucucagcuucacccugaggugagcaucaucuuc

SEQ ID NO: 120587 - RNA, 64 nt, Human
cucauucuuuucaugagcccgaccucucucggagcagcuucaggccucugccaguguccccagc

SEQ ID NO: 120588 - RNA, 64 nt, Human
cagggggaggcacguuucaucugucagcucacuccagcuucacaaaugugcugagagcauuacu

SEQ ID NO: 120589 - RNA, 64 nt, Human
agcagaugcugaggcaguucauuaaaccaggccucagcuucagugccucaucuugccaucuccc

SEQ ID NO: 120590 - RNA, 64 nt, Human
gccacuccaagggcgguccucggugcagcagcaucagcuucacuugugggggggugggggaagg

SEQ ID NO: 120591 - RNA, 64 nt, Human
ggugucucccuucgacauugagccuucgaguggccagcuucacucucugggggagugcagggug

SEQ ID NO: 120592 - RNA, 64 nt, Human
gauuucagacauuucaucagccuuuucacuuucccagcuucaauggagguauauaugucauuuu

SEQ ID NO: 120593 - RNA, 64 nt, Human
uccuugaaaacuccuacaauauuauauuuggaggcagcuucagacuguuuuauuggugguagcu

SEQ ID NO: 120594 - RNA, 64 nt, Human
acauuccaguggccccugggguuccagccuguagcagcuucaucugugcuuugugcacuugguu

SEQ ID NO: 120595 - RNA, 64 nt, Human
aguaacccacagaacaucugugaucuuucuacagcagcuucaguuuugugccaacauuccaugu

SEQ ID NO: 120596 - RNA, 64 nt, Human
caagccccuccagaugagugccccggccccaggccagcuucacugccgucucuucacacagagc

SEQ ID NO: 120597 - RNA, 64 nt, Human
agcaguccuguggugcaguuacugccuguguggccagcuucacaggcagcagauaauuugugga

SEQ ID NO: 120598 - RNA, 64 nt, Human
augucucuagccccugcacacugcaggccccucucagcuucacauaccccucuccauguaugag

SEQ ID NO: 120599 - RNA, 64 nt, Human
gucuucuacugucuucagcaaccaucucaucuuccagcuucaccugauuguccaguuaucauac

SEQ ID NO: 120600 - RNA, 64 nt, Human
agauagugaggucauugaaccuccuucucuaccucagcuucagaccccccuggccagugagcug

SEQ ID NO: 120601 - RNA, 64 nt, Human
ggucucuccacaaucaaauggaggaucccccaagcagcuucauuacagagugauauugggaaag

SEQ ID NO: 120602 - RNA, 64 nt, Human
aaaaaaaaaaaaaaaaaaaaaaaacuuuuccaggcagcuucaugaugugcaggcaguagccaga

SEQ ID NO: 120603 - RNA, 64 nt, Human
ccccauuuuaaaggcuuauuguuguauuuuguagcagcuucaagugaccaaaagacuaaaaucu

SEQ ID NO: 120604 - RNA, 64 nt, Human
aaucuaaacuuauccccucuuugcagaugucuagcagcuucagacauuugguuaagaacccaug

SEQ ID NO: 120605 - RNA, 64 nt, Human
agcuugaucuguggcaaaaccaaguguggucuuucagcuucaguguguuagcaucccagcaccu

SEQ ID NO: 120606 - RNA, 57 nt, Human
ugucuacuggcuccaaauagaccaugucagcuucacccccuggcuuugugucuaugg

SEQ ID NO: 120607 - RNA, 64 nt, Human
ccugagugugggcuucugaaacuucauaaauguucagcuucagacuuuuaucaaaaucccuauu

SEQ ID NO: 120608 - RNA, 64 nt, Human
caggucgcuggggccucggcaguaggcagcugugcagcuucaccucuuggcgaggaggcgugug

SEQ ID NO: 120609 - RNA, 64 nt, Human
auuacaucauuggacaugaaggaguuucaacauccagcuucaucuagguggucaugauuaccug

SEQ ID NO: 120610 - RNA, 64 nt, Human
aacuuauucuguagauucuguggaacaagccuaucagcuucagaauggcauuguacucaaugga

SEQ ID NO: 120611 - RNA, 64 nt, Human
aagcaaacuaaccgaaaaaccgaaaauauacaaacagcuucacacacacacacacacacacaca

SEQ ID NO: 120612 - RNA, 64 nt, Human
ugucuucagaguucugaagaaaaauuacuggacacagcuucagcuauacuuacacuguauugaa

SEQ ID NO: 120613 - RNA, 64 nt, Human
gaguuuaaauaauuucaguaauucuuagaugauucagcuucaucauuaagaauaucuuuuguuu

SEQ ID NO: 120614 - RNA, 64 nt, Human
ucaucccgucauuuucaguuuguuggacauuuuacagcuucaccaggagaaugugcaacuuuau

SEQ ID NO: 120615 - RNA, 64 nt, Human
ugugugugucugguguuuggaaacugggauauuucagcuucauuauuuccacuugcaggccagc

SEQ ID NO: 120616 - RNA, 64 nt, Human
uugccuuaaguguguuguuaaaugaaaguacagacagcuucauuguuguauuguuaauaauugu

SEQ ID NO: 120617 - RNA, 64 nt, Human
cuuaggaaagggcuucucaugagcucugcugcggcagcuucagcuggcagagaggcuuucccag

SEQ ID NO: 120618 - RNA, 64 nt, Human
aaauauuauuuuguuaugccaaaaauauagcgagcagcuucaugguuaauaauacauuuauguu

SEQ ID NO: 120619 - RNA, 64 nt, Human
auccgucacagacuaaggagauggcaggcauugacagcuucacuccaugaaggccaucucuguu

SEQ ID NO: 120620 - RNA, 64 nt, Human
uugauacacaaaaggaacucuggagagaaaacuacagcuucagucuguacagaucaaagaagac

SEQ ID NO: 120621 - RNA, 64 nt, Human
guguaauaauagaaaaguagagcaaagagccauucagcuucagucuuuacauaccaugaauaaa

SEQ ID NO: 120622 - RNA, 64 nt, Human
ggccaaaucagaagauauucauccugcuucaagucagcuucagaaauguuuuaaaagggacuuu

SEQ ID NO: 120623 - RNA, 64 nt, Human
guuuccaugacugaacaaagagaauauauuuauucagcuucacuugcagaucacuagugaaugu

SEQ ID NO: 120624 - RNA, 64 nt, Human
aguuuugguuuguacagaacaaaauaauauguagcagcuucauugcuauuggaaaaaucaguua

SEQ ID NO: 120625 - RNA, 64 nt, Human
aggauuuaguuaggucauuaagauguugaucacacagcuucaaucacaauaugccaaguauaac

SEQ ID NO: 120626 - RNA, 64 nt, Human
acuucacuguuauaacugagaagacuguucucugcagcuucagcuaauucagcaucuucaguag

SEQ ID NO: 120627 - RNA, 64 nt, Human
ugaccaagugaauaccuaccuaccucuuaggacucagcuucagugauucuguuuucauaggcuu

SEQ ID NO: 120628 - RNA, 64 nt, Human
uagaagccagccugcuaaucagauugcuacuucacagcuucauuuuuguuucauucagugguac

SEQ ID NO: 120629 - RNA, 64 nt, Human
cucaacuguagacugugucccaguaagagagucacagcuucagguguuugcugaauccaggucu

SEQ ID NO: 120630 - RNA, 64 nt, Human
uccaacaaaacuguccagaccgcagcugcaaaugcagcuucaacugcagcaucuagugcagcuc

SEQ ID NO: 120631 - RNA, 64 nt, Human
gcccugccuauaggagagaauauuuggagauaggcagcuucaggaugcauugcaaucauccuuu

SEQ ID NO: 120632 - RNA, 64 nt, Human
cauaaucagaacacacuuuuuuuccucuuucucccagcuucaaaugcaaauucaucauugggcu

SEQ ID NO: 120633 - RNA, 64 nt, Human
ugccucacgaagcaucccuguagacauuuggccccagcuucacugcuuggaagcaugucccucc

SEQ ID NO: 120634 - RNA, 64 nt, Human
ucacacgggguauuuuaggcagggauuugaggagcagcuucaguuguuuucccgagcaaagucu

SEQ ID NO: 120635 - RNA, 64 nt, Human
cagguguuguauauagaguggaaucucuuggaugcagcuucaagaauaaauuuuucuucucuuu

SEQ ID NO: 120636 - RNA, 64 nt, Human
gcuacaugagauuuugccuuuugugcugacuugacagcuucacuucugccuaagaugcgccucc

SEQ ID NO: 120637 - RNA, 64 nt, Human
gagcuuuaugucaggagacugugaccuucauguccagcuucaaagaguugugcaugaacucggu

SEQ ID NO: 120638 - RNA, 64 nt, Human
gucacacuaauacuaucaacuaucagucuucccacagcuucaaucacugucauuauucuaaucc

SEQ ID NO: 120639 - RNA, 64 nt, Human
uuguauuuuaacuccuaauuuacccuucaggucucagcuucagaacauucacuuauaaagaaac

SEQ ID NO: 120640 - RNA, 64 nt, Human
gaaauaagcauuucuuuguuuaauuaaggauugccagcuucaguuaagacaagaccuaucagua

SEQ ID NO: 120641 - RNA, 64 nt, Human
ucgcagaagccaugcgacucccacacgacacgggcagcuucacaagccaucucuuucauuucug

SEQ ID NO: 120642 - RNA, 64 nt, Human
ucucucuggccugcugcucucucaacaucacauacagcuucagcugccuggaggccagaaggaa

SEQ ID NO: 120643 - RNA, 64 nt, Human
uuucuggaauacagguuugaggauacaguguuggcagcuucaagaagagaagaccuucuugcca

SEQ ID NO: 120644 - RNA, 64 nt, Human
aucacaggagucaaagggccuugcucaagguccccagcuucagccccaggcccuaagccagcgu

SEQ ID NO: 120645 - RNA, 64 nt, Human
cggaucugcugggcucugccuuaaacacacauugcagcuucaacuuuucucuuuaguguucugu

SEQ ID NO: 120646 - RNA, 64 nt, Human
gaaagugauuuagcuuugaccacuuuucauccuacagcuucaauaucaaacugguuaggaaagc

SEQ ID NO: 120647 - RNA, 64 nt, Human
gauuuaccaaauagggcaaagaaucaacagugaacagcuucacuuaaaaucaaauuuuucuggg

SEQ ID NO: 120648 - RNA, 64 nt, Human
cgccuucuccaaggggucugauuugcugagacaccagcuucaccuucuuaacaagguuauuucu

SEQ ID NO: 120649 - RNA, 64 nt, Human
accuguuucagcugcuacuucagccaaaauucuucagcuucauauugucuugaaaaccuaugau

SEQ ID NO: 120650 - RNA, 64 nt, Human
aguuaacucaucacuucucccaagcacucgaucccagcuucacccacugguguugcuuugcuug

SEQ ID NO: 120651 - RNA, 64 nt, Human
gcagaaacacaauaggcuucuccuugugugaucucagcuucaagcaggugaaacugcugugcag

SEQ ID NO: 120652 - RNA, 64 nt, Human
uuccugagcuccuguccaugccugccauaccugccagcuucagacauuuagggaaaaggggcag

SEQ ID NO: 120653 - RNA, 64 nt, Human
acucaugcaguaauuucugcaguugggagauguucagcuucaguccccggcccuauggccguuc

SEQ ID NO: 120654 - RNA, 64 nt, Human
gagaacugcuucugucucuggagagacagaagugcagcuucaguaauucucagugugugagcug

SEQ ID NO: 120655 - RNA, 64 nt, Human
uuagagccgacugucuccucugccuuuuguuuuucagcuucagagacagauccaauauaguccc

SEQ ID NO: 120656 - RNA, 64 nt, Human
ucaucacucagaagccugccucugauuuacccuacagcuucaggcccagcugccccccagucuu

SEQ ID NO: 120657 - RNA, 64 nt, Human
ucacuaaauuucuaaguauguccauuucccaucucagcuucaagggaggugucagcaguauuau

SEQ ID NO: 120658 - RNA, 64 nt, Human
cuccccccgcuggggagcgaaaguuucuuggucucagcuucauuuccgugaagggcaccgagaa

SEQ ID NO: 120659 - RNA, 64 nt, Human
cccucugcucgcaccauuguuuuaauacggcaggcagcuucaccugcggcugcccccaugaccu

SEQ ID NO: 120660 - RNA, 64 nt, Human
uggugcccacacugacucaaccagaacuggcuaccagcuucagaaauguguuacuuauguucaa

SEQ ID NO: 120661 - RNA, 64 nt, Human
ggccucuuauggaauccugcagauccaguggcugcagcuucaaucccagugcugcaaucacaca

SEQ ID NO: 120662 - RNA, 64 nt, Human
ggggccugagagagccccagguccauucuacccccagcuucacucagcacuggagcuggcagag

SEQ ID NO: 120663 - RNA, 64 nt, Human
gugccaggcucaaugggcggccagugugugaggacagcuucagccaggaggugagggugaacgu

SEQ ID NO: 120664 - RNA, 64 nt, Human
gaauguucucuuaagaaaaugaugcuggucaucccagcuucagcaucuccuguuuuuugaugcu

SEQ ID NO: 120665 - RNA, 64 nt, Human
uguuugacauuccauguuaaacuacggucauguucagcuucauugcauguaauguagaccuagu

SEQ ID NO: 120666 - RNA, 64 nt, Human
cccagaaggguaaaacucccagccuacccugcuccagcuucagcccagguaguuggugugucuc

SEQ ID NO: 120667 - RNA, 64 nt, Human
aagcuguugaugcacaggcgucuuguggcaagcccagcuucaguuuauguuagacaaucaguac

SEQ ID NO: 120668 - RNA, 64 nt, Human
gaugcaauuuauuuuuaaaauaggccuuguuuuucagcuucaucugcaguucuaugugaagauu

SEQ ID NO: 120669 - RNA, 64 nt, Human
agaaagcccucccucccugaacuugcaguaaggucagcuucaggaccuguuccagugggcacug

SEQ ID NO: 120670 - RNA, 64 nt, Human
caacuagcuccauuuacagccauuucuaaaauggcagcuucaguucuagagaagaaagaacaac

SEQ ID NO: 120671 - RNA, 64 nt, Human
gggcucaucugcuucucguccaggacgacauuuccagcuucaucuuugaucuuaacccucccgg

SEQ ID NO: 120672 - RNA, 64 nt, Human
cugaggaggaggaggccgggugccuguuugguggcagcuucagccuagggauaccugaagcugu

SEQ ID NO: 120673 - RNA, 64 nt, Human
ugcagggaaagcagcucacagacgccguuaaaaccagcuucaucuuuccuucaggaucauccuu

SEQ ID NO: 120674 - RNA, 64 nt, Human
gggguucccacgugcaaaaucaacaucaggaacccagcuucagggcaucgcggagacgcgucag

SEQ ID NO: 120675 - RNA, 64 nt, Human
cauauaaaaugcugauauuuacuggaaaccuagccagcuucacgauuaugacuaaaguaccaga

SEQ ID NO: 120676 - RNA, 64 nt, Human
agugaacccccauguacuccauguagccaccauccagcuucaacaucaacauuuugcuaaucuu

SEQ ID NO: 120677 - RNA, 59 nt, Human
uauuccagaagaugcugugauccaccacccagcuucaccccucacccccagcggcucac

SEQ ID NO: 120678 - RNA, 64 nt, Human
gggguaagggagcugugaggguguggaugggaggcagcuucaccuuucccugcccuuuccagug

SEQ ID NO: 120679 - RNA, 64 nt, Human
cgagcuggcuauggacuugggugucuggcaaacacagcuucagucucacuacuucugacacucu

SEQ ID NO: 120680 - RNA, 64 nt, Human
gcugcagaaggacucaaccacuccccuaagacuccagcuucauagacuccucuguaucacugcc

SEQ ID NO: 120681 - RNA, 64 nt, Human
aaaaccacugcuggcacaagcagugacuguuuggcagcuucaaguuuagagcugugaagacagg

SEQ ID NO: 120682 - RNA, 64 nt, Human
ugggucugugaauuucuuuaaugucuaagaaauccagcuucauaauuuccaugauacaaagauc

SEQ ID NO: 120683 - RNA, 64 nt, Human
aggcccccuccagcagggccucucuccguugccccagcuucacucucucccucagcaccugccc

SEQ ID NO: 120684 - RNA, 64 nt, Human
aguggaaaacacucugauguaauuucugcccagucagcuucaucccucaguauaauuguaaauc

SEQ ID NO: 120685 - RNA, 64 nt, Human
auuuuagagauggggagagggauuauacugcaggcagcuucagccauguugugaaacugauaaa

SEQ ID NO: 120686 - RNA, 64 nt, Human
auagauucagaaauacauuuucauuauccaaaaucagcuucaacaaaugguuucuggagacaaa

SEQ ID NO: 120687 - RNA, 64 nt, Human
gugccucuguguggagcuagggucaagcccugagcagcuucacuuccccugcgccuuuuauguc

SEQ ID NO: 120688 - RNA, 64 nt, Human
gagagagccuuggccugaccuggcacagaaagggcagcuucagucucugcaguguccauuaucu

SEQ ID NO: 120689 - RNA, 64 nt, Human
agccguguguggugucagguuccucuccccaccccagcuucaagcagaggccucgggguggggg

SEQ ID NO: 120690 - RNA, 64 nt, Human
uaaugagccugggaggguggcagggaggaggggacagcuucacccuuggaaguccugggguuuu

SEQ ID NO: 120691 - RNA, 64 nt, Human
aguuguaaaacuguauccaaauuuucagaaaagacagcuucagcuugcaaauucuauccucuaa

SEQ ID NO: 120692 - RNA, 64 nt, Human
cgaucaaaccauaagauuuuauacugcagauagucagcuucaccaaagccgcagaggaaacaug

SEQ ID NO: 120693 - RNA, 64 nt, Human
gaagacguuaauaaacuaccuaacauuauuuauucagcuucauuugugucaaugggcaaugaca

SEQ ID NO: 120694 - RNA, 64 nt, Human
gucuucacuugaaacucaaaacugacacuaggaacagcuucaugaguucaguagaaguaagcuu

SEQ ID NO: 120695 - RNA, 64 nt, Human
aagugggauacaguuuucucauuuguauuaucuccagcuucaaccucauuuauccuuuuuccua

SEQ ID NO: 120696 - RNA, 64 nt, Human
uggaucauuccucauguauaaugugccccaaaugcagcuucauuuuccagauaccuugacgcag

SEQ ID NO: 120697 - RNA, 64 nt, Human
aauaggagaggaugagagcccagagguaacagaacagcuucagguuaucgaaauaacaauguua

SEQ ID NO: 120698 - RNA, 64 nt, Human
uuucuccccgccugcucccaucugggggcuuccgcagcuucaggggagcccggagcuuugcaag

SEQ ID NO: 120699 - RNA, 64 nt, Human
gaacccaagguugagugcaacugggguugcacuucagcuucaucuccuuggcagggacacuaaa

SEQ ID NO: 120700 - RNA, 64 nt, Human
cccuucuauaggcauggaguuggcacugacaucacagcuucauaaccccaccaccgccagcuuc

SEQ ID NO: 120701 - RNA, 64 nt, Human
agacuccacauaaguccauuaacugcuuuccacccagcuucaaagcuuaaaaagagcucaggcu

SEQ ID NO: 120702 - RNA, 64 nt, Human
gaaagucaaucaggaagagaauggaaaacuuauacagcuucauucuguugcccucaaaugggca

SEQ ID NO: 120703 - RNA, 64 nt, Human
uuguauaagcuauuuagagugaggcuggagguggcagcuucacagaacuggagaaccaggccaa

SEQ ID NO: 120704 - RNA, 64 nt, Human
uguggucaguauaucaguuaugacgcccauugcccagcuucaguccauccauguuagauggaca

SEQ ID NO: 120705 - RNA, 64 nt, Human
uauucguccaaacuguguuagucuaggcuuaggacagcuucagaaucugacaccuugccuugcu

SEQ ID NO: 120706 - RNA, 64 nt, Human
uguuuauaguaguguacuaacaaagucucccuugcagcuucagacuguuaucuauaggcuuauc

SEQ ID NO: 120707 - RNA, 64 nt, Human
ugaaaguauuuugagaacaaugaauugcaauaaccagcuucacacaagcauaacugauaaacgc

SEQ ID NO: 120708 - RNA, 64 nt, Human
gcaaaaagaacaaagcuggaggcaucacgcuacccagcuucaaacuauacuacaaggcuacagu

SEQ ID NO: 120709 - RNA, 64 nt, Human
gagauaaacuaaaguguguugaugccagaauguucagcuucaguaaauauaauaagcucuugug

SEQ ID NO: 120710 - RNA, 64 nt, Human
agccauaugacaauuucaaaaugcaugugauuggcagcuucaaaacagaacggguucucccaug

SEQ ID NO: 120711 - RNA, 64 nt, Human
aguuaaugcaaaguagccaaguccagcuauauagcagcuucagaaacauaccugaccaaaaaau

SEQ ID NO: 120712 - RNA, 64 nt, Human
ugcuggaaauggauagaaguucaaucagacaguucagcuucacgaacugaugucucucuguauu

SEQ ID NO: 120713 - RNA, 64 nt, Human
guucuugcgauaguuuacugagaaugaugauuuccagcuucauccaugucccuacaaaggacau

SEQ ID NO: 120714 - RNA, 64 nt, Human
uacauuuuucccuucccuagcaauuacuuuuuuccagcuucaacucuucuuaguuacuaauacu

SEQ ID NO: 120715 - RNA, 64 nt, Human
cagcgagcccugggaccacucaucccugcccagccagcuucagugcccggggccgcuugucccu

SEQ ID NO: 120716 - RNA, 64 nt, Human
gugaucuguauuugaugaggaggagccgaggccccagcuucauccagcuucaaccaaugccugg

SEQ ID NO: 120717 - RNA, 64 nt, Human
uuugaugaggaggagccgaggccccagcuucauccagcuucaaccaaugccuggaccuguccac

SEQ ID NO: 120718 - RNA, 64 nt, Human
ggagaaaccagcuuuuacuguuuuugaaaaauuacagcuucacccugucaaguuaacaaggaau

SEQ ID NO: 120719 - RNA, 64 nt, Human
acagugcugggaaucuaguugcuccaauaugaggcagcuucaugugcagcuuagcacuuguugu

SEQ ID NO: 120720 - RNA, 64 nt, Human
uugugguuucuuguuugguuugguuugcuuuugacagcuucauuuuauuuuugacgucacuuuu

SEQ ID NO: 120721 - RNA, 64 nt, Human
uuucccaaccccccucacuucccaagacaacccccagcuucagguccucauggggaggggaggg

SEQ ID NO: 120722 - RNA, 64 nt, Human
gcucucuaaaugggaauucucagguaggaagcaacagcuucagaaagagcucaaaauaaauugg

SEQ ID NO: 120723 - RNA, 64 nt, Human
uuuaaggacauuaaaagcuaucaggccaagaccccagcuucauuaugcagcugaggucuguuuu

SEQ ID NO: 120724 - RNA, 64 nt, Human
aagaauuguugaaaaaaaauuuuuuuuuuuuggacagcuucaaggagauguuagcaauuucaga

SEQ ID NO: 120725 - RNA, 64 nt, Human
uggggacacggcccaggacagcccgggggcccugcagcuucaggucccuaugggcgcagcugcu

SEQ ID NO: 120726 - RNA, 64 nt, Human
gagaagcugccaugcaaagguggacaccauucuccagcuucaggggauaugcucgucccgggca

SEQ ID NO: 120727 - RNA, 64 nt, Human
gaaaagaaagcguuugaaauuauugcuuggauaccagcuucaugcaccuucuaguuguacaaaa

SEQ ID NO: 120728 - RNA, 64 nt, Human
gugagcagcaaaugccuuucaagaaaauagguggcagcuucacuccaugucauauauggaguga

SEQ ID NO: 120729 - RNA, 64 nt, Human
uugcugucuuaggccauucuuguuauuaagcugacagcuucacuuucuuguggaagaccaagaa

SEQ ID NO: 120730 - RNA, 64 nt, Human
uucaaagccgcaguuaggcaaaaugacagugugacagcuucaaagccacugacucaugacacag

SEQ ID NO: 120731 - RNA, 64 nt, Human
agcagcucgcucacucccuaaagaaaccuauuggcagcuucaacaggcaggcaauaaucucuuc

SEQ ID NO: 120732 - RNA, 64 nt, Human
caccgugagucuggcucagcagcccccucccgggcagcuucaccccacacccaggggccaggcu

SEQ ID NO: 120733 - RNA, 64 nt, Human
gccaggcuucccaugcccucccccaacagucccucagcuucacccagcggggcuuccaggccag

SEQ ID NO: 120734 - RNA, 64 nt, Human
agugaccugggacgguguugugguuuaccgucuccagcuucagccuuuccagaaacccuugugg

SEQ ID NO: 120735 - RNA, 64 nt, Human
caccuuccccucuggcccagccaccacugccucucagcuucaacaggugacaggcugcuuucgu

SEQ ID NO: 120736 - RNA, 64 nt, Human
uuuaagguauaaaauuaaauguaaaaauuaauuucagcuucauuucguauuucgaagcaaucua

SEQ ID NO: 120737 - RNA, 64 nt, Human
ggauuuguauuacucuccaaaucuacuguacugucagcuucacuccaccugagaaaaaagaaaa

SEQ ID NO: 120738 - RNA, 64 nt, Human
ccacaucuaagcauuagugauggguagcugaugucagcuucauguggauuuuaagcacucuaga

SEQ ID NO: 120739 - RNA, 64 nt, Human
ggaaacuucauggucccaaaaugucauugccauacagcuucacuagaguucuuugaaccacagc

SEQ ID NO: 120740 - RNA, 64 nt, Human
gacaguguucuggauagaucuauuaugugaaaggcagcuucacccaguuuucuggacucucaug

SEQ ID NO: 120741 - RNA, 64 nt, Human
cuaagugacugugucaaauguugcaguagaugggcagcuucaagagaagaauuuaaacucuuug

SEQ ID NO: 120742 - RNA, 64 nt, Human
accgcuccagcugcacugcagccaggggggauaccagcuucauuccucagaguaaaccaaccuu

SEQ ID NO: 120743 - RNA, 64 nt, Human
cugggagagacccacuucuaggguaugggggaugcagcuucaagcccagugcccagugucuccc

SEQ ID NO: 120744 - RNA, 64 nt, Human
uucacuuuacccaucccgaugcucuuccuuccugcagcuucaugcuccaaugagggcugauuuu

SEQ ID NO: 120745 - RNA, 64 nt, Human
aacauuucacauggaaaugcugcccaaucuucaccagcuucagaaaucugaccuuugccgaugc

SEQ ID NO: 120746 - RNA, 64 nt, Human
auguaaagaacauaaauaacaaaucucaagcaaacagcuucacaaauucucacacacauacaua

SEQ ID NO: 120747 - RNA, 64 nt, Human
ggacucucagaagaaagacaagcugcucugcagccagcuucagguagcggauuuccugcagaac

SEQ ID NO: 120748 - RNA, 64 nt, Human
uucucaagcccugcagucacagcuacacagaucacagcuucagccaggagcugggcagaaggcc

SEQ ID NO: 120749 - RNA, 64 nt, Human
cccuuuuuuguuguuuuuuuuuugguucaaggcccagcuucaguuaaucccuucaucucuaugc

SEQ ID NO: 120750 - RNA, 64 nt, Human
auccucuccuuuuagaggcuuugcauucugcacccagcuucacuaacagugggcugaaaacauc

SEQ ID NO: 120751 - RNA, 64 nt, Human
uuaucucuuuaguaugaacauuuucaaaaacacacagcuucaacaauugucaccauauggccaa

SEQ ID NO: 120752 - RNA, 64 nt, Human
agguggcgggcuguagcagcuucagcgagguguccagcuucaugccuauccugaaggcuguccu

SEQ ID NO: 120753 - RNA, 64 nt, Human
gccuugcagugcaugcccagguggcgggcuguagcagcuucagcgagguguccagcuucaugcc

SEQ ID NO: 120754 - RNA, 64 nt, Human
ugcucccccaggaguuccaggagaacucagccugcagcuucagcaccugccaccugagaagaug

SEQ ID NO: 120755 - RNA, 64 nt, Human
cuggcuaagagugcagcagagacugaggcauagccagcuucaaaagcgaucugacaugaaaguc

SEQ ID NO: 120756 - RNA, 64 nt, Human
aaacgagcuuguuucccugaaccucagaaauccucagcuucaaacauggggaaacaggccagag

SEQ ID NO: 120757 - RNA, 64 nt, Human
uuauagaauucagucaaagauacacaaucugaaacagcuucaugggguggacucuaacaguagu

SEQ ID NO: 120758 - RNA, 64 nt, Human
ucccaaaggccaaggcaguggguggcucucgcugcagcuucaaggcugguggcugggacccucc

SEQ ID NO: 120759 - RNA, 64 nt, Human
ccgaaaucuccuuugaagcccagacaucuuucuccagcuucagacuuguagauauaacucguuc

SEQ ID NO: 120760 - RNA, 64 nt, Human
ucaccauaaccucuggggaccccaaccucagaggcagcuucaagugccuuuugcugcgcaccaa

SEQ ID NO: 120761 - RNA, 64 nt, Human
uuuuuucuuuuuugccaaauugacugucacgcggcagcuucagggagcucgcauucucuugugu

SEQ ID NO: 120762 - RNA, 64 nt, Human
cacguuagcaguguguacacuacuguaucaucaucagcuucaucacccuguaaaccaggcuccu

SEQ ID NO: 120763 - RNA, 64 nt, Human
aaccgagcaaagaucaaaauaaaaagugacacagcagcuucaccagagcauuuccaacaccaca

SEQ ID NO: 120764 - RNA, 64 nt, Human
uaugcccuugccuucuaguuccaaauauuuuagccagcuucacuguggcaauagucuuucagag

SEQ ID NO: 120765 - RNA, 64 nt, Human
acucacaaggagacaucaaccucuagacagggaacagcuucaggauacuuccaggagacagagc

SEQ ID NO: 120766 - RNA, 64 nt, Human
gaacuggcucugagcacccugccgcccgcggccccagcuucaggacaagccccugcuugcugaa

SEQ ID NO: 120767 - RNA, 64 nt, Human
cagaguaugcaacucugacguugaucccagagagcagcuucagugacaaacauauccuuucaag

SEQ ID NO: 120768 - RNA, 64 nt, Human
aaauaggcuguuacauauccuaaagacugcucaacagcuucaaguugaaaguggccaaggacag

SEQ ID NO: 120769 - RNA, 64 nt, Human
uugggagaaugagcugcagaagaugacccgggggcagcuucaggaugaguuagagaaaggugaa

SEQ ID NO: 120770 - RNA, 64 nt, Human
uccugacaucugcauguaccucguggaauucagccagcuucauguugcaaaucagaaagcugac

SEQ ID NO: 120771 - RNA, 64 nt, Human
uaggccaagaggcccuaugaagguggcgggaacucagcuucaaccucgaugucuucagggucuu

SEQ ID NO: 120772 - RNA, 64 nt, Human
uucuuuuuuggcccuaggcugguugggaccucuacagcuucauucuuucaccauuaaauagugg

SEQ ID NO: 120773 - RNA, 64 nt, Human
aacuguguaaucuuuuacuauucaagcuauaauucagcuucaaaguagaguagaaaaaaaauug

SEQ ID NO: 120774 - RNA, 64 nt, Human
uuccugauccaguugggaaugcaucuugugggagcagcuucacucccaccacggaccaaugccu

SEQ ID NO: 120775 - RNA, 64 nt, Human
cuaggcucagcccccaaaacccccugcccagccccagcuucagggcugccuguggucccaaggu

SEQ ID NO: 120776 - RNA, 53 nt, Human
cgucccacgaaucccaauaaugacagcuucagacuuuguuuuuuuaacaauuu

SEQ ID NO: 120777 - RNA, 64 nt, Human
guggagaacuuuguugucaggcccugagcgcucacagcuucauuuggcccagguugaagacaag

SEQ ID NO: 120778 - RNA, 64 nt, Human
gcuggcccaggcgucuaaggagucaaaagagaaacagcuucaagcagaacguaaaaggaaagcg

SEQ ID NO: 120779 - RNA, 64 nt, Human
ucaugggcuugggggccuacagcagccucaccuucagcuucaugccucuuccacacagcguuuc

SEQ ID NO: 120780 - RNA, 64 nt, Human
uuuggcccugcagcaugucaugcucccagaauuucagcuucagcuuaacugacagacguuaaag

SEQ ID NO: 120781 - RNA, 64 nt, Human
gggaaaacaaaguguuuauuuccccaaaacaacccagcuucaccccaugucccuucuacacgcu

SEQ ID NO: 120782 - RNA, 64 nt, Human
acaccuagacucacuucauggauuccaaagcucucagcuucauuuuauuaguuacguuagguaa

SEQ ID NO: 120783 - RNA, 64 nt, Human
cauuaagggcaguaccucuaacaaggacgccuuccagcuucagcgauguuacuuacguuugaug

SEQ ID NO: 120784 - RNA, 64 nt, Human
aucuaccucagcauuuacugagcauuuuaaaacucagcuucacagagaugucuuugugauguga

SEQ ID NO: 120785 - RNA, 64 nt, Human
ggccggccagcauggcagagagguccugcaugaacagcuucaccugggggggcccagcacgaag

SEQ ID NO: 120786 - RNA, 64 nt, Human
ucaaaccugugugucaaugcagaaggucuggagacagcuucauuuuguuuauuuauuuuaauuu

SEQ ID NO: 120787 - RNA, 64 nt, Human
auggugggagcuacgccuaugccaucaaccccaacagcuucauccugggucugaagcagcagau

SEQ ID NO: 120788 - RNA, 64 nt, Human
cagaaacuauuuagagcuuccaggauauauuucacagcuucaggcaugugaucaguuagagccg

SEQ ID NO: 120789 - RNA, 64 nt, Human
gcaccagcgccgccuuuccauggagacucguaagcagcuucaucugacacgggcaucccuggcu

SEQ ID NO: 120790 - RNA, 64 nt, Human
gaugaaggcuugaucuaaaauaguauaaggucuccagcuucaguaaaaguuuuuaguguuuacu

SEQ ID NO: 120791 - RNA, 64 nt, Human
accuuacgguuguguuuuaaguauucauugaaaccagcuucagaaaacaagaugccauaguaaa

SEQ ID NO: 120792 - RNA, 64 nt, Human
gccgggcugcacagacuauuccccaccugcuucccagcuucacaauaaacggcugcgucuccuc

SEQ ID NO: 120793 - RNA, 64 nt, Human
auauuuaucagaguucacacuauauaaaacccaacagcuucaacuauugcccuuucaacaguuu

SEQ ID NO: 120794 - RNA, 64 nt, Human
uuguuucauuuuuaagauucuuggaucucccagucagcuucauuucccaguaaucagaaacagc

SEQ ID NO: 120795 - RNA, 64 nt, Human
augauggccauuccguucaaauccuagaucguuacagcuucagggaauucauauuuuguuaugu

SEQ ID NO: 120796 - RNA, 64 nt, Human
gcagugguauuaauuuugauauaaucuuucaaaccagcuucauguggcuucccuuuucuuuguu

SEQ ID NO: 120797 - RNA, 64 nt, Human
ggauuucugguuguggcccagcaauuaacaaaaacagcuucaacuguucgaauuuuaugaacca

SEQ ID NO: 120798 - RNA, 64 nt, Human
aaaauguuuucaacucuggguccuuaccuuuuuccagcuucauauuugcaagugguaaauugga

SEQ ID NO: 120799 - RNA, 64 nt, Human
gucuggaguccccuccuccagccgcuggcaacaacagcuucaguccauggguaauccguucaua

SEQ ID NO: 120800 - RNA, 64 nt, Human
ggauguuaacuuuggaacucgcaguccucuagaacagcuucagauuauggcuuuuucuuuugag

SEQ ID NO: 120801 - RNA, 64 nt, Human
gcuuccgcgcucugaugggaaauuccgucuccagcagcuucacccgggucucccugucucagca

SEQ ID NO: 120802 - RNA, 64 nt, Human
augaccagaguuuccagaugauacacguucuuuucagcuucauuaaauaggcaacuauguuucu

SEQ ID NO: 120803 - RNA, 64 nt, Human
cuuuacaaaauuaucuuaauaaguucuauauggucagcuucaucuuccuuuuuuuuuuuuuuga

SEQ ID NO: 120804 - RNA, 64 nt, Human
cugggcuuacaggccugagccaccacgcucagcucagcuucacccugucugcaaagaaaaguuu

SEQ ID NO: 120805 - RNA, 64 nt, Human
cugguaagaaguauuaaugaaguagcuaauauuacagcuucauuuucuacuagcaccuaucaua

SEQ ID NO: 120806 - RNA, 64 nt, Human
auugacuguccucacagcggcuuuucauagcuuucagcuucagcuuuacgaggcuucuccucuc

SEQ ID NO: 120807 - RNA, 64 nt, Human
cugugagaccucaauguaauaagaaaauuaaauucagcuucaggccuuuaaacugcagcaagau

SEQ ID NO: 120808 - RNA, 64 nt, Human
ccugcaaggcuggauuugggggccauuaucugagcagcuucaaagaccccugagcugccaacca

SEQ ID NO: 120809 - RNA, 64 nt, Human
cuucugcaugcaguuugucuuucuguucugcaggcagcuucagaauugaggucauuugugagca

SEQ ID NO: 120810 - RNA, 64 nt, Human
ccgcccugccacacaucccgcccccucccggaggcagcuucaggacaggacaccaggcuggcug

SEQ ID NO: 120811 - RNA, 64 nt, Human
gugcaauauguucacaguuuauuaaugcuuuaaacagcuucauguuuuagaauuuguguauugu

SEQ ID NO: 120812 - RNA, 64 nt, Human
uguaccugcugcucuuugucccacagagcagaaacagcuucacaaaaggaccucccagaguuau

SEQ ID NO: 120813 - RNA, 64 nt, Human
cuuuggaggcaccuguccagaagccuggccuaggcagcuucaaccuuugaacuuacuuuuugaa

SEQ ID NO: 120814 - RNA, 64 nt, Human
agcccugcgugccaaguguccagagccuuggaagcagcuucagguucugcuccuguaguacaga

SEQ ID NO: 120815 - RNA, 64 nt, Human
cuaaugaucuugcuaauaaaugcuacaauagcaucagcuucauuuuggguuuuugccuccuccc

SEQ ID NO: 120816 - RNA, 64 nt, Human
uuguauuuuaaaugucaaugugccugagaaaugucagcuucaccacgcucuugcuuccuaaugc

SEQ ID NO: 120817 - RNA, 64 nt, Human
acuccauccugaguaaucucccuuuauuuuugaccagcuucauuugucagcuuugcucagauca

SEQ ID NO: 120818 - RNA, 64 nt, Human
gguaauggagaguuugcaaacacacagcggcccacagcuucacgugguggugugcagugugagg

SEQ ID NO: 120819 - RNA, 64 nt, Human
gcuggucuccacagauaccugcuguucucagcuccagcuucaaaccucgagucucgagagggcc

SEQ ID NO: 120820 - RNA, 64 nt, Human
gcugcugugugccugguuuccucacauccugccucagcuucaccacccuggcuuauguggaaca

SEQ ID NO: 120821 - RNA, 64 nt, Human
ccucugcugcagguaagucagagcagcuuuaccacagcuucaggccacgagagccccuucaccc

SEQ ID NO: 120822 - RNA, 64 nt, Human
uguauguguuaaccaguauuaagggaaaaugauccagcuucagcuaucuaauucacaaauuaau

SEQ ID NO: 120823 - RNA, 64 nt, Human
uauucugagcacacggucucuuuuguucuaacuucagcuucacugacacuggguugagcacuac

SEQ ID NO: 120824 - RNA, 64 nt, Human
aggaggcaguauggcugugcaggagccuucauuucagcuucaauuaauagggaagaauuuauga

SEQ ID NO: 120825 - RNA, 64 nt, Human
cagucacggguagguggaguggagaggcugguuacagcuucagucccuuugucugucuguccau

SEQ ID NO: 120826 - RNA, 64 nt, Human
ggagggggugacggaaccagcacuguguggagaccagcuucaaggagcggaaggcuggcuugag

SEQ ID NO: 120827 - RNA, 64 nt, Human
guaguuuguuucuguuguucacuuggaguggauccagcuucacugucaugugcgaacacaguga

SEQ ID NO: 120828 - RNA, 64 nt, Human
augaacuuuuggcugaaccucaucacucgaacuccagcuucaagaauguguuuucaugcccggc

SEQ ID NO: 120829 - RNA, 64 nt, Human
aaugauuuagaucuuggugcuggggcaaggccaucagcuucagagaccuugccaggcccaggcu

SEQ ID NO: 120830 - RNA, 64 nt, Human
gggcuucggccaggggcuuuccacuugaggauagcagcuucacuaggcuggccggccagcucca

SEQ ID NO: 120831 - RNA, 64 nt, Human
uaacuguaaaugugacauugauuugcucuuacuacagcuucagugauugggggaggaaaagucc

SEQ ID NO: 120832 - RNA, 64 nt, Human
cuagcgcugugcuaugcucugggguaagaguugucagcuucagagaagcugaguccugauccuc

SEQ ID NO: 120833 - RNA, 64 nt, Human
gaaacacaagaaauuggccacugguaaaacucugcagcuucaacuguacuucauuuaaugccau

SEQ ID NO: 120834 - RNA, 64 nt, Human
guuucuguuguuggcuaauugaaguuauuaggcucagcuucagucauguguaaguuuugcagug

SEQ ID NO: 120835 - RNA, 64 nt, Human
agacagcuggaagggucuugguuuucugaaacuccagcuucaugugacccugggucccugcucu

SEQ ID NO: 120836 - RNA, 64 nt, Human
ugaaaaacagacucacaaggggcuucuuggccugcagcuucauuugcgagagcgccgaggcagg

SEQ ID NO: 120837 - RNA, 64 nt, Human
aauggggcggugagaggggaacagacuggaagcacagcuucauuuccugugucuuuuuucacua

SEQ ID NO: 120838 - RNA, 64 nt, Human
uuaacuuaaaauuaccaguucccuuucuugcagucagcuucauaccauuuuuaaagucaauacg

SEQ ID NO: 120839 - RNA, 64 nt, Human
uccuugccugaguccuugaauaccccagcuucugcagcuucacuugcuggagugccaaguagau

SEQ ID NO: 120840 - RNA, 64 nt, Human
gauagaaucagauauguuaucgaaauguuagcagcagcuucauccuccuucugauuaaaguaag

SEQ ID NO: 120841 - RNA, 64 nt, Human
uuuuuuuuuuguacuucuagauguuuugguuauacagcuucauuuuagaugagcauucuuauuu

SEQ ID NO: 120842 - RNA, 64 nt, Human
ccguggggagcauguacagagcucuguguauacacagcuucacacccaccagauuguuacuaca

SEQ ID NO: 120843 - RNA, 64 nt, Human
cugugcuuguauccccagccacgaagagcuggaccagcuucaaguacauguccacagcaacaug

SEQ ID NO: 120844 - RNA, 64 nt, Human
ugggugaagguacagcuggcuccuuucgggggugcagcuucaacucucucggcgguagggcggu

SEQ ID NO: 120845 - RNA, 64 nt, Human
ccagcccaagugaggcagccgaggucccugcugccagcuucaggugacccccccccaucccccg

SEQ ID NO: 120846 - RNA, 64 nt, Human
accaggguuuggaggcugcgaccgccccggagagcagcuucacacuggcgccacagaggagccc

SEQ ID NO: 120847 - RNA, 64 nt, Human
ucccaaggacacaagcuguugggaugcuacuucucagcuucacgcugucccuuuaagguguuua

SEQ ID NO: 120848 - RNA, 64 nt, Human
gggccuggccaccucucuccuuugcugaggccuccagcuucaggcaggccaaggccuucuccuc

SEQ ID NO: 120849 - RNA, 64 nt, Human
uccagcgcugccggaaccacagggaggaaggcaucagcuucagugagacagcagcagccgaugc

SEQ ID NO: 120850 - RNA, 64 nt, Human
ccagcgccuaccaccucaacagacaccuccagcacagcuucaccaggggcuuuucaggugugcu

SEQ ID NO: 120851 - RNA, 64 nt, Human
ggcccagcguuuuucccaggcagauaacauugcacagcuucaaaaaaacauugugacccuugcc

SEQ ID NO: 120852 - RNA, 64 nt, Human
gugguuucugccauccugggcagaagcugaaggccagcuucacauuucugcugagagaagguga

SEQ ID NO: 120853 - RNA, 64 nt, Human
uguuuuucauagauucuuugagaugcugauggaccagcuucagcauguuugagguugucugaaa

SEQ ID NO: 120854 - RNA, 64 nt, Human
gggggagggccccaggacaccccucaccuacuuucagcuucaaccccaggcccucagaaaccag

SEQ ID NO: 120855 - RNA, 64 nt, Human
cggaccagacagaugcuuagggaagguugauaaccagcuucagucucuacuggauuagcccuac

SEQ ID NO: 120856 - RNA, 64 nt, Human
uucucuuuuuccuuacaccuuguggaucaugugccagcuucaucuguucucaaguuugagucau

SEQ ID NO: 120857 - RNA, 64 nt, Human
accacagccucgaccaugccugcucccucugacccagcuucaccucauggacaacccuucuugg

SEQ ID NO: 120858 - RNA, 64 nt, Human
gcgcggggggcaaauaagaccccaccccucccugcagcuucacagggacgcuuccuucccuccc

SEQ ID NO: 120859 - RNA, 64 nt, Human
ucauuuaccacaggccuaccagcccugggcacagcagcuucauggcaagacauaaaaugacacu

SEQ ID NO: 120860 - RNA, 64 nt, Human
ggauaccaguauagcuauaucaaauagacaaaaacagcuucacuuuagcaaugaucagauuguu

SEQ ID NO: 120861 - RNA, 64 nt, Human
agccucuccaaagagcuuucggagcugacacugacagcuucaguuucccccagcacccaggaga

SEQ ID NO: 120862 - RNA, 64 nt, Human
gcaggagucacugauugaugggugugccgaccagcagcuucacaaaugucugcugcaaggggaa

SEQ ID NO: 120863 - RNA, 64 nt, Human
ucucacaucacgacccggagguccccuucaaccacagcuucaucgagccgcccucugccggcug

SEQ ID NO: 120864 - RNA, 64 nt, Human
cgugucugcucccaggccucccacuagucaggaccagcuucagccacuucuuuucucugagugg

SEQ ID NO: 120865 - RNA, 64 nt, Human
agccaggcagcuuugaguggcagcguggugcuagcagcuucagcggaacagggugagaguuaau

SEQ ID NO: 120866 - RNA, 64 nt, Human
cugcuucacccucacccccuccuggcaaucaauacagcuucauuaucugaguugcauaauucuc

SEQ ID NO: 120867 - RNA, 64 nt, Human
agcagcaacccugagucaauaaggagcaggaccucagcuucauuguccuugagcaggacaauuc

SEQ ID NO: 120868 - RNA, 64 nt, Human
agugagcagaaucacuguggucagucuccugucccagcuucaguucaugaauacuccuguuccu

SEQ ID NO: 120869 - RNA, 64 nt, Human
acagagauccuaccgggccggaugaaucuggaaacagcuucagagauacugcuucucagcgucu

SEQ ID NO: 120870 - RNA, 64 nt, Human
uauaucuuuuuacuacagugaucugugacagcagcagcuucauguuguauuuuuuuuacugaaa

SEQ ID NO: 120871 - RNA, 64 nt, Human
ccuuuuuauuuuucagcaucaagagaaaaccaaucagcuucaucaaaacagaagaaaaaggcua

SEQ ID NO: 120872 - RNA, 64 nt, Human
uuuuuguuguuaauaugacauuuggauuaaucuccagcuucaacaguacuucuuuuguccauaa

SEQ ID NO: 120873 - RNA, 64 nt, Human
gcacugccagcccacccccuuugacucuggggugcagcuucacccaccaggccagcucaggaau

SEQ ID NO: 120874 - RNA, 64 nt, Human
agcugccaccaugccuaugugcccaagagcugcccagcuucagcuuggggacuggaggaccagc

SEQ ID NO: 120875 - RNA, 64 nt, Human
ggccaccagaugucgcccuacucaccugagcgcucagcuucaagaaauuacuggaaggcuucca

SEQ ID NO: 120876 - RNA, 64 nt, Human
ucuggcuuggggaggagucccucuagguagaacacagcuucagaaacuagcuuuaagaaauaau

SEQ ID NO: 120877 - RNA, 64 nt, Human
acugcuuauuagaggacaagaucaggacugcuuucagcuucagaacacuuuugguucagaacag

SEQ ID NO: 120878 - RNA, 64 nt, Human
cucuuugugacauggaaguucauugucauagcuucagcuucagaagcuguuuguggcauuugua

SEQ ID NO: 120879 - RNA, 64 nt, Human
gcuuuucccgagacaaggaccccccaugucacggcagcuucacagacgcggcucgcgcccaccg

SEQ ID NO: 120880 - RNA, 64 nt, Human
ggcuggaguccaguggcgugaucauaccucacugcagcuucaacuuccugggcucaaguaaucc

SEQ ID NO: 120881 - RNA, 64 nt, Human
gacugagccccaagacgccucuguaaccucgcugcagcuucaguaguaaacuggguccuguuuu

SEQ ID NO: 120882 - RNA, 64 nt, Human
gggaccgggugagccagugacccccuguagcccccagcuucaggccucagugucugccagucaa

SEQ ID NO: 120883 - RNA, 64 nt, Human
uuucucccuggcccuuggcuucucacuugauggacagcuucacacacccuuaagcgguggacuc

SEQ ID NO: 120884 - RNA, 64 nt, Human
cugagaauuuccaaaacuuuaaugaacuaacugacagcuucaugaaacuguccaccaagaucaa

SEQ ID NO: 120885 - RNA, 64 nt, Human
gcacccuggccggacucagcguggagcacgugcacagcuucacgcccuggauccaggcccacgg

SEQ ID NO: 120886 - RNA, 64 nt, Human
uugaguucuguucauccuacccuaaugccaguuccagcuucaucuacccuugagucauauugag

SEQ ID NO: 120887 - RNA, 64 nt, Human
ucacaaauccaggcuucugaaacuucggaccaaccagcuucaaucaggguucccacuacccccu

SEQ ID NO: 120888 - RNA, 64 nt, Human
caaagcacgugggggaaagggguggcugugggcacagcuucagcagacuuaaacauuccugccu

SEQ ID NO: 120889 - RNA, 64 nt, Human
aagccucaggauggacaagaggaaacccacagcucagcuucaggcuucuuauguuucugaaaac

SEQ ID NO: 120890 - RNA, 64 nt, Human
ugaggacucaccugccugggacggucaccuguugcagcuucaccugccuggggauucaccuacc

SEQ ID NO: 120891 - RNA, 64 nt, Human
acuggcaccuaccccgagcaucucucucuguaagcagcuucaggggcaguccguuucucugugc

SEQ ID NO: 120892 - RNA, 64 nt, Human
gugccagagccgcccacccggagccgcccgcaugcagcuucaccuccccuuuccaggcgccacu

SEQ ID NO: 120893 - RNA, 64 nt, Human
aggaguuccggaaagccaaggccagcuccacaggcagcuucacagcaccugaucccggccugaa

SEQ ID NO: 120894 - RNA, 64 nt, Human
agaaucuuauauugaacuccagcggccucaucaccagcuucaagaauuaucagcucauggccaa

SEQ ID NO: 120895 - RNA, 64 nt, Human
uaagccauugaggaaaacauuaacuccuggauuucagcuucacuuuuaaccugcagacuaaauu

SEQ ID NO: 120896 - RNA, 64 nt, Human
ugcccacacaucuccagccagccagggcccugcccagcuucaauuuacagaccugacucuccuc

SEQ ID NO: 120897 - RNA, 64 nt, Human
ccucacaccugccucugguucccgccugguccuccagcuucaggaccccaccuccaaaggcccc

SEQ ID NO: 120898 - RNA, 64 nt, Human
gugaacaaugugacaaaguuuucauucacaaauccagcuucaaauacauaggagaauucacacu

SEQ ID NO: 120899 - RNA, 64 nt, Human
gaguugacaguacaaagggucguggccagcccugcagcuucagcaccugccccacccagagugg

SEQ ID NO: 120900 - RNA, 64 nt, Human
cauagggucuggaacaccaggcugagguccugaucagcuucaaggaguaugcagggagcugggc

SEQ ID NO: 120901 - RNA, 64 nt, Human
aggcaucuguguccccucuugaagagaaaacacacagcuucacacauccaggcauagggggcaa

SEQ ID NO: 120902 - RNA, 64 nt, Human
auauagaaagagcauaaugaagccugcaugugcccagcuucaauaauuaccaauaucuugccag

SEQ ID NO: 120903 - RNA, 64 nt, Human
acaguccuguaucaaaacugaagaugguuugaaacagcuucacaagguaauaugucuuucaaga

SEQ ID NO: 120904 - RNA, 64 nt, Human
uguuaauuaacacauuuagaugggccaguuaaaacagcuucauaaguuuuaaauuaauuguaaa

SEQ ID NO: 120905 - RNA, 64 nt, Human
agguggaugacuucuuuacaaaggaaaaugguagcagcuucagugagaaacugcccuuacaaac

SEQ ID NO: 120906 - RNA, 64 nt, Human
gaauguucucuuaagaaaaugaugcuggucaucgcagcuucagcaucuccuguuuuuugaugcu

SEQ ID NO: 120907 - RNA, 64 nt, Human
agcagaauuccagucuugagaaacaggucaaggacagcuucaaaagagauucuaaauaaauguu

SEQ ID NO: 120908 - RNA, 64 nt, Human
aggugaugcccacuggaacucuccucacaccuggcagcuucauggauguuguaucugaacuaag

SEQ ID NO: 120909 - RNA, 64 nt, Human
guuccugcguuacuuugcugaggauaacggcuuccagcuucauccaugucccugcaaaggacgu

SEQ ID NO: 120910 - RNA, 64 nt, Human
uuuugcuuuugucuuuuuugaugagggcucacuccagcuucauauggugccaagacguugcugc

SEQ ID NO: 120911 - RNA, 64 nt, Human
uuuguaaauguuccaauuuuucuuuuguuauugccagcuucauuccauuguguucagagaugau

SEQ ID NO: 120912 - RNA, 64 nt, Human
cucaugacaacucaguguugaagcccaguguccucagcuucauguccaguggauggcagaaguu

SEQ ID NO: 120913 - RNA, 64 nt, Human
uccccuggaacccaguaugcacccagaggggacucagcuucaaagcugcuccaccaugcugggu

SEQ ID NO: 120914 - RNA, 64 nt, Human
caccaccccauauugaaaaacaguugucuggcaucagcuucaggagcggguccggucauucuga

SEQ ID NO: 120915 - RNA, 64 nt, Human
uuaauuucagagccauacaaaaauaagccacaaccagcuucagaauuaauucccaaucccccau

SEQ ID NO: 120916 - RNA, 64 nt, Human
gcaacuuuuguuccuccucccccacccccgcccccagcuucaugcuucucuuccgcacucagcc

SEQ ID NO: 120917 - RNA, 64 nt, Human
guauugcaagugaaauaauauugauuucugcccucagcuucaaauaaaguaaauugaaauggga

SEQ ID NO: 120918 - RNA, 64 nt, Human
uagguauuucuuugauacuuguaauuuuaaauuucagcuucacgauauaaaauaauauaagaac

SEQ ID NO: 120919 - RNA, 64 nt, Human
guguuccgaaaccaaagaagaaacuucgccuuaucagcuucauacuucaugaaauccuggguuu

SEQ ID NO: 120920 - RNA, 64 nt, Human
agaccuccagccacucacagcucuuuuuaaaaaacagcuucaaaauaugcagcaaaaaccaaua

SEQ ID NO: 120921 - RNA, 64 nt, Human
uuuaucuuucccucuugccccagucccuucucuccagcuucaugugaagcucugcacagacaag

SEQ ID NO: 120922 - RNA, 64 nt, Human
cagugaagaggggcucaggcagcucacggaaguacagcuucagcgugccugcgauggcguucau

SEQ ID NO: 120923 - RNA, 64 nt, Human
gaaucccuauguaugagaggagggaggcaggcugcagcuucagccacagaauggggacuaugga

SEQ ID NO: 120924 - RNA, 64 nt, Human
caaguugagaguucaaauagucuugaaggggaaucagcuucaggauggaaggacccaggagagg

SEQ ID NO: 120925 - RNA, 64 nt, Human
cugguugaggagggaggggccuggcugaccccuccagcuucagccuccagcuuuaacuucuguc

SEQ ID NO: 120926 - RNA, 64 nt, Human
uggcggcgcaccugcugcaggagcggccacgucucagcuucauuauaccauggccugcgcacgu

SEQ ID NO: 120927 - RNA, 64 nt, Human
cauucugugucaaggugaaugccuguguccuccccagcuucaugccucugucaugggggaagga

SEQ ID NO: 120928 - RNA, 64 nt, Human
gagcuggcugacaauaagaacguggccaccugcccagcuucacaccucccccgacuucagcccu

SEQ ID NO: 120929 - RNA, 64 nt, Human
guuuguaagacuuacaaaaaaagauuuaaaguggcagcuucacucgacauuuggugagagaagu

SEQ ID NO: 120930 - RNA, 64 nt, Human
gggugugcgugguuccuagguccuguggacaucacagcuucaggccugaagagcagagaagccc

SEQ ID NO: 120931 - RNA, 64 nt, Human
ccagccacccaggacucacccaugccugguguuccagcuucagggggugugcgugguuccuagg

SEQ ID NO: 120932 - RNA, 64 nt, Human
cagcguggcccuaggacaggaggagcuucgggcccagcuucacccugcgguggggcugaggggu

SEQ ID NO: 120933 - RNA, 64 nt, Human
gucugucaggcaggaaggacccaggauuugaacccagcuucagugugcaggcucugaggcugcc

SEQ ID NO: 120934 - RNA, 64 nt, Human
uuggcccuuucuaaccuaugugcauaauuaaaaccagcuucauuuguugcuccgagaguguuuc

SEQ ID NO: 120935 - RNA, 51 nt, Human
gcuucaacgaggcccagugagcagcuucaagagcaacuucuccacauguug

SEQ ID NO: 120936 - RNA, 64 nt, Human
cucaaccuaggugcaauccugucaugugagguuucagcuucaguccuccuugggagacggggca

SEQ ID NO: 120937 - RNA, 64 nt, Human
ugaauauuuaucauauugauacaaacugugaccucagcuucagagugucagggccucacuugua

SEQ ID NO: 120938 - RNA, 64 nt, Human
uagacuuaauuagagaaauuuagacccagaauugcagcuucaacaacacaaaacaggaaagcua

SEQ ID NO: 120939 - RNA, 64 nt, Human
cuuauucuuauuuuggauugauuuuccaaaaccacagcuucagcagcaacaaucagaaugucca

SEQ ID NO: 120940 - RNA, 64 nt, Human
cuaaaggcaaacauuccugcaaacagguuuuucucagcuucaggcagaggagacaacauggaag

SEQ ID NO: 120941 - RNA, 64 nt, Human
uucauggaacuggauuuggauuucuugaagcaggcagcuucauauuauaccgauuuguucucug

SEQ ID NO: 120942 - RNA, 64 nt, Human
gcaggugaccacuggcacauucuccugcuugucucagcuucagguucuucaccucuaagauggg

SEQ ID NO: 120943 - RNA, 64 nt, Human
ggguguuccugauaauugugcacaccugaguucacagcuucaccacuuguccauugcguuauuu

SEQ ID NO: 120944 - RNA, 64 nt, Human
ggggucuguuucucaucuccauggacaucuucaacagcuucaccugacaacgacuguuccuaug

SEQ ID NO: 120945 - RNA, 64 nt, Human
cucaguucauaagguuauuuagcacaaaguauagcagcuucaccuggagagcugcuuuugcuca

SEQ ID NO: 120946 - RNA, 64 nt, Human
ggcuucauauuugcaacuuugaugauucuauguccagcuucagagcugcuuucccagaaauuca

SEQ ID NO: 120947 - RNA, 64 nt, Human
uuuggcuaguaaaggagcccagccaacuggccagcagcuucagcucaucacagcuuuguuguuc

SEQ ID NO: 120948 - RNA, 64 nt, Human
acgaggaugacugacguccucucgccuuaagauucagcuucaggaaaacauuuagggaaaagaa

SEQ ID NO: 120949 - RNA, 64 nt, Human
ugaucccuuccaccugcucugcugaugacccccccagcuucacuucugacucuuccccaggaag

SEQ ID NO: 120950 - RNA, 64 nt, Human
agauguuucuagauagaauguuuucauacaauuucagcuucauaucauaaauuuuucuggaaag

SEQ ID NO: 120951 - RNA, 64 nt, Human
guuucugcccgcagguaaaauuuugucauauacccagcuucagauaccaugcaauaauacaacu

SEQ ID NO: 120952 - RNA, 64 nt, Human
acgaggcgcugcggcuccaccugaccagugggucagcaggcacggcuggcagccuucucugccc

SEQ ID NO: 120953 - RNA, 64 nt, Human
uuuccuuaaguuuugaucuccgucuuccugaugaagcaggcagagcucagaggaucuuggcauc

SEQ ID NO: 120954 - RNA, 64 nt, Human
uaucuucccccaccuucuacaugguauuagucccagcaggcaucccuggggcagacgugcuuug

SEQ ID NO: 120955 - RNA, 64 nt, Human
gucaugccagcggcagaggacgugaggggcuggcagcaggcagggcggccccaggccucugccc

SEQ ID NO: 120956 - RNA, 64 nt, Human
gggaauuagacaauggaagucgagcacuggggaaagcaggcauucugcguggggaagagcuccc

SEQ ID NO: 120957 - RNA, 64 nt, Human
ggggcuauucuuuugcuaucaggaaguuuugaggagcaggcagaguggagaaagugggaauagg

SEQ ID NO: 120958 - RNA, 64 nt, Human
cugauccugcugcaccacaagcacccagaacggaagcaggcaccacuaacuuaugaaaaggagg

SEQ ID NO: 120959 - RNA, 64 nt, Human
aagggaggaaggggaggagagaaggagaaaggcaagcaggcagacagcuaugggucuagcaucu

SEQ ID NO: 120960 - RNA, 64 nt, Human
gagccuagaacaucccugggcaaguggauggcccagcaggcaggcacuguggcccuucugucca

SEQ ID NO: 120961 - RNA, 64 nt, Human
gggauuacccugaaucggggauuuuaaugauggaagcaggcagagccuggugggugauucuguc

SEQ ID NO: 120962 - RNA, 64 nt, Human
gccaagauccuugaaggacccuggaaggagggagagcaggcagcccuucacaggauaggauccg

SEQ ID NO: 120963 - RNA, 64 nt, Human
uucauaacaaaaaugaaaagcugcaugcaucuacagcaggcauggauuguuuaugucguaugau

SEQ ID NO: 120964 - RNA, 64 nt, Human
gaaacaauaauuggcccaaaugcagacaucaagaagcaggcaggaaaauggaaaaacugagaua

SEQ ID NO: 120965 - RNA, 64 nt, Human
gccaggcaaaguucaccagcuugcucuaagagcaagcaggcaaugccguaaagccugagccugc

SEQ ID NO: 120966 - RNA, 64 nt, Human
uuuuccuuuuguuuccaggauuaacuuacagagaagcaggcaagaugaccuugcugccuggggc

SEQ ID NO: 120967 - RNA, 64 nt, Human
agggcucuaaccuuguaugcgggcaggcccagggagcaggcagcaguguucuuccccucagagu

SEQ ID NO: 120968 - RNA, 64 nt, Human
uaagguauguucugcuuucuugauucaaaaaugaagcaggcauugucuagcucuuaggugaagg

SEQ ID NO: 120969 - RNA, 64 nt, Human
cuuagccucugacuuccuaauguaggagguggucagcaggcaaucuccugggccuuaaaggaug

SEQ ID NO: 120970 - RNA, 64 nt, Human
uucuggaccagaugaucccuuccaauguggugcuagcaggcaggaucccuucuccaccuccaaa

SEQ ID NO: 120971 - RNA, 64 nt, Human
aggugugaaugaccuuaguccgcaaguucagggaagcaggcagagcggggaggugccugagcug

SEQ ID NO: 120972 - RNA, 64 nt, Human
uguaggcgccccugggguggguuuagcaggcugcagcaggcagaggagaguaccccccugagag

SEQ ID NO: 120973 - RNA, 64 nt, Human
ugccuggagagcagauugcguaaaacaucuguauagcaggcaucagcgagcuucuuauaaaugu

SEQ ID NO: 120974 - RNA, 64 nt, Human
aucagaaaguguacgccaacuaagggacccacaaagcaggcagagguaaugcagaaaucuguuu

SEQ ID NO: 120975 - RNA, 64 nt, Human
gcuccgguaccauguaaaccuaggaagguaaaggagcaggcaaccuccucguggccuguguguu

SEQ ID NO: 120976 - RNA, 64 nt, Human
uaaaugaauuuccaccugaucacccuguguucacagcaggcagaagcccacugguaugggccuc

SEQ ID NO: 120977 - RNA, 64 nt, Human
uaccaguggggggccuguggccccggcucuucacagcaggcagaagcguaugaucccagggagg

SEQ ID NO: 120978 - RNA, 64 nt, Human
gcaguccacgcugaacaugggaaacaaccugaaaagcaggcaggccucccggucagggagccuc

SEQ ID NO: 120979 - RNA, 64 nt, Human
ucuuucccugcgagacgcacacagcugagcacuuagcaggcaccgccacgucccagcaucccug

SEQ ID NO: 120980 - RNA, 64 nt, Human
ggugagucccacuugagcgcuuccuguugaauaaagcaggcacuugaccuggcuguagccuagg

SEQ ID NO: 120981 - RNA, 60 nt, Human
ucuuccccaaggggcaguaacaccagggccagcaggcagcgccuguccccucacagacuc

SEQ ID NO: 120982 - RNA, 64 nt, Human
ucguuggacuaaacccacagguuaguucagucaaagcaggcaacccccuugugggcacugaccc

SEQ ID NO: 120983 - RNA, 64 nt, Human
gcccagaccccucuccugcccucugcacaccagcagcaggcaugaaccuugggucugggaaaaa

SEQ ID NO: 120984 - RNA, 64 nt, Human
gugcacagccuugauucuucccuggagccuacagagcaggcaggcuaggccaagccaggcucaa

SEQ ID NO: 120985 - RNA, 64 nt, Human
uagugaccagauguuguaaugggcuauacaguccagcaggcaguaugcaccuagaaauuucucc

SEQ ID NO: 120986 - RNA, 64 nt, Human
uccccugccccuggguuccugccuucccuccucaagcaggcacccaggcuuuagagaaguauag

SEQ ID NO: 120987 - RNA, 64 nt, Human
guccccuggaaaccuguguggcuaaagucugcugagcaggcagcagccucugcucuguggcucc

SEQ ID NO: 120988 - RNA, 64 nt, Human
gugugugauccccccuucuccgagacgcugagagagcaggcauugcaggcgggaagaugccaga

SEQ ID NO: 120989 - RNA, 64 nt, Human
cuuuuagcuguugcaaaucagaaggagccagagaagcaggcagucucaugcaugagagguuacc

SEQ ID NO: 120990 - RNA, 64 nt, Human
acuuuuauuauaccauuaugugcauguuauugguagcaggcauaguuuauuauuuaguacugaa

SEQ ID NO: 120991 - RNA, 64 nt, Human
auuguuaagcugauauuuuaaagauuucugagcuagcaggcaugugggaaggaaggcucugucu

SEQ ID NO: 120992 - RNA, 64 nt, Human
accauguaaauauguacauauguagucuaguaaaagcaggcaaacacauaucuuucugauaaaa

SEQ ID NO: 120993 - RNA, 64 nt, Human
cucuacuggacucuggccugcuuggagagguggcagcaggcaccuggucuucagaaauuguuuc

SEQ ID NO: 120994 - RNA, 64 nt, Human
gugacauguuggaagccuucucaucccggggcaaagcaggcaucaaaaccagaauaggccaauc

SEQ ID NO: 120995 - RNA, 64 nt, Human
caacauugcuucaaagaugcccaacccccguaguagcaggcaguucccaaguggagggucgggg

SEQ ID NO: 120996 - RNA, 64 nt, Human
ccuuacaacugcucuagauuaguagaugcaucuaagcaggcagcaggaacuuuaaauuuuuuaa

SEQ ID NO: 120997 - RNA, 64 nt, Human
cagaccaaccaaccaccuugcuggaacccuugcuagcaggcauucuuauaaaagaaacuuucga

SEQ ID NO: 120998 - RNA, 64 nt, Human
cccugugccugaucuguguguuccccaggaagagagcaggcagccucugagcaagcacuguguu

SEQ ID NO: 120999 - RNA, 64 nt, Human
cauaucucuauauguauguguucccaguugugggagcaggcacuaaugaaauccugugccugga

SEQ ID NO: 121000 - RNA, 64 nt, Human
caacacccaucaccacuucaauagaucaaaguccagcaggcaaggacggccuucaacugaaaag

SEQ ID NO: 121001 - RNA, 64 nt, Human
gccaagcucagcugugugucugagcccacucagcagcaggcaugaucagggcagggcccagcgc

SEQ ID NO: 121002 - RNA, 64 nt, Human
uacuguauuuaaaauguaaaauaaacuuuuaaaaagcaggcacuaauauauauuucuuccagcc

SEQ ID NO: 121003 - RNA, 64 nt, Human
cagggacuccuuggguccuggcagugcaugugccagcaggcaggacaaacucuguguaccugug

SEQ ID NO: 121004 - RNA, 64 nt, Human
gagccugagcuuugggagaauauacaaaggaaaaagcaggcauaguuuccacuuuaaagggaag

SEQ ID NO: 121005 - RNA, 64 nt, Human
caggcgaggggggcuugggggcauggggccggaaagcaggcagaagcccguccuggguggugcu

SEQ ID NO: 121006 - RNA, 64 nt, Human
agcauuuuugaaauucaaauugucuguccuguggagcaggcagugauuuuguuccaaaacuuug

SEQ ID NO: 121007 - RNA, 56 nt, Human
acucacagccucggaacugaauucagagcaggcagagcaccagcaagugcugcuuu

SEQ ID NO: 121008 - RNA, 64 nt, Human
ggagugggucccagccugggagccugcugucaggagcaggcagaccuggacucacagccuggcu

SEQ ID NO: 121009 - RNA, 64 nt, Human
uggcgauuuaaaccaguugagaaacacugccaucagcaggcaguuucagacucacucaaguugu

SEQ ID NO: 121010 - RNA, 64 nt, Human
ccagauugaaguuugacuuuuauugucacaaaucagcaggcacaagaacuguccaugaagaugg

SEQ ID NO: 121011 - RNA, 64 nt, Human
cuuuccaaccccagguucccuacacccugcucucagcaggcagugagugucacacaccuguuaa

SEQ ID NO: 121012 - RNA, 64 nt, Human
uccguauccaucgaagcagaugcucugaacccugagcaggcacccacuucccugcaggacagua

SEQ ID NO: 121013 - RNA, 64 nt, Human
aggauuggagcaaaacaucaggagcuaagggaaaagcaggcaagaggucuucuugauuaugcua

SEQ ID NO: 121014 - RNA, 64 nt, Human
guuuuauuuacuuaguagcaucacugugugucuuagcaggcaggcagugucuggccauuauugc

SEQ ID NO: 121015 - RNA, 64 nt, Human
aacgguaacuugacucuuccaucuuuucacccacagcaggcaccuaagucugccuuuccuaggc

SEQ ID NO: 121016 - RNA, 64 nt, Human
uuuaaggagacuuuuaacaguccuucgugaauagagcaggcaagaaauacaaaccuucauuccu

SEQ ID NO: 121017 - RNA, 64 nt, Human
ugggcuucaaaaucaaaacaaaaaccccaaaaacagcaggcaaaugcuuuuuaacucugacacc

SEQ ID NO: 121018 - RNA, 64 nt, Human
acuuggaggaaaguugcagguggguugggcagggagcaggcaugguucugcuuugcuguuuguc

SEQ ID NO: 121019 - RNA, 64 nt, Human
acuuuugugacugucacccaugagguauggaaggagcaggcacuggccugagcaugcagccugg

SEQ ID NO: 121020 - RNA, 64 nt, Human
agcccuggcagaacugaagagcggcaccgggcccagcaggcaaagagagaggccucccuggcuu

SEQ ID NO: 121021 - RNA, 64 nt, Human
uucacagcacaguggugaggaauugagcucaugaagcaggcaaggaccgaacaccuccacccca

SEQ ID NO: 121022 - RNA, 64 nt, Human
cgugugucagaacuggguuuuuguggagguucagagcaggcaacaccauaaguugcucucagau

SEQ ID NO: 121023 - RNA, 64 nt, Human
gaggugcaguggcacccccagagccaacagagggagcaggcagagggugggggaccuggcggga

SEQ ID NO: 121024 - RNA, 64 nt, Human
cugcugauggucagcucugagacagugguuugagagcaggcagaacggucuugggacuuguuug

SEQ ID NO: 121025 - RNA, 64 nt, Human
cacaggaccgcgcuuccuuuagcagugcugaguaagcaggcagcggcacucugagaucccgggg

SEQ ID NO: 121026 - RNA, 64 nt, Human
agucagaccgagcuuucugcuaacauggggagguagcaggcacuggcauagcacgguagugguu

SEQ ID NO: 121027 - RNA, 64 nt, Human
ucaccagcagacacacugggcauggaccccucaaagcaggcacacccaaaacacaagucugugg

SEQ ID NO: 121028 - RNA, 64 nt, Human
ggcugccacagguggggacgaggcugagagagucagcaggcagagccagaugccaugcuuggca

SEQ ID NO: 121029 - RNA, 64 nt, Human
agaggcuuuuggucauccucugcgugucaguaaaagcaggcagcccauacgagcugugguaugc

SEQ ID NO: 121030 - RNA, 64 nt, Human
uuuaucucaagaugugucauaccgucuguaaugaagcaggcaugcccucuuuaggcuaacauau

SEQ ID NO: 121031 - RNA, 64 nt, Human
uacaggcaccccacagccccagagcauggggcacagcaggcaugcgagugagaggaugaagggg

SEQ ID NO: 121032 - RNA, 64 nt, Human
uuucauuauugucauuguagaagcggucacuauuagcaggcauacuuuuccacacaucuuugga

SEQ ID NO: 121033 - RNA, 64 nt, Human
gacucuacuuacacucauuuuuaucuuggcugacagcaggcaagcuucaguuugggcuguggac

SEQ ID NO: 121034 - RNA, 64 nt, Human
auuauuauuauugcugaagugguugcauucuacuagcaggcaaugcuguacuuuucuucagucc

SEQ ID NO: 121035 - RNA, 64 nt, Human
ggaagcuuauagucaugacagaaggugaagggggagcaggcacaucacaugacaaaagcaggaa

SEQ ID NO: 121036 - RNA, 64 nt, Human
ggccacaaggccaguggcaccugccagaggggaaagcaggcaugacaggauagcaucucccagg

SEQ ID NO: 121037 - RNA, 64 nt, Human
uuccaucagugaagaaucaaccggaccuguugcuagcaggcaaucuccauuucucagugacaga

SEQ ID NO: 121038 - RNA, 64 nt, Human
uaacuggucugugaucuuuuguggccaagagaauagcaggcaagaauuagggccuugacagaau

SEQ ID NO: 121039 - RNA, 64 nt, Human
cucuggauuccacacugcacuguuaauaacucucagcaggcaaagaccgauugcauaggaauug

SEQ ID NO: 121040 - RNA, 64 nt, Human
uguuggcuacaugaguauuuagaggaaguaagguagcaggcaguccagcccugauguggagaca

SEQ ID NO: 121041 - RNA, 64 nt, Human
cugucuucaggcugccaggggaggaggagaagccagcaggcaccacuuuucugcucccuuucuc

SEQ ID NO: 121042 - RNA, 64 nt, Human
acccugagguaacagggucaacuggcgaagccugagcaggcaggggcuuggcugccccauucca

SEQ ID NO: 121043 - RNA, 64 nt, Human
ucaacacacuggauuccagguggacuggaccaagagcaggcaaagacacgggaacugaaaaacu

SEQ ID NO: 121044 - RNA, 64 nt, Human
ggugaccucuuguacccccagguggaaggcagacagcaggcagcgccaagugcgugccguguga

SEQ ID NO: 121045 - RNA, 64 nt, Human
ccugcucgccucccucaccccacaccugacacagagcaggcacucaauaaaugcuaccgaaggc

SEQ ID NO: 121046 - RNA, 64 nt, Human
cucuuucaggugggaguuuuggggccuccagggcagcaggcaccaccuccauaucccggcccac

SEQ ID NO: 121047 - RNA, 64 nt, Human
gaagcccuucauuuaaguuggcuugaaucucaucagcaggcagccucaugcaaccaugagggau

SEQ ID NO: 121048 - RNA, 64 nt, Human
uugagaaauucacccucacaaaccuuccuucaggagcaggcauugguagugcagaggcacagau

SEQ ID NO: 121049 - RNA, 64 nt, Human
ccagagaggcugaaugacaugcucacagucacacagcaggcaguggcaggcaguagugaagucg

SEQ ID NO: 121050 - RNA, 64 nt, Human
uucagaaguuguugguucccugauuuuugucuugagcaggcaccaucccuguccccuugcuugc

SEQ ID NO: 121051 - RNA, 64 nt, Human
uguuuucaacacuguccuuaaagacuaacuugaaagcaggcacaguuugaugaagggcuagaga

SEQ ID NO: 121052 - RNA, 64 nt, Human
ggaccauagagcaagggggggaggggaguguugcagcaggcauucucuucuggaaggagucgcu

SEQ ID NO: 121053 - RNA, 59 nt, Human
aaacuguucagcaaagguagucauuagggagcaggcacuaccacuaagauaucccagaa

SEQ ID NO: 121054 - RNA, 64 nt, Human
ucccuuuggggugcgggggugggguccagcccagagcaggcacugagugaaugcccccuggcug

SEQ ID NO: 121055 - RNA, 64 nt, Human
caggaaccaucgccuucuauaaaccgugaacucaagcaggcauuuuuuuuuucuuaccgaaagg

SEQ ID NO: 121056 - RNA, 64 nt, Human
ucacaggggaauucccaguacugucauggagcagagcaggcagugggugcugaugugugugcau

SEQ ID NO: 121057 - RNA, 64 nt, Human
ucucagaacccacccguugaguuuguggguaaccagcaggcaggccaaagacuggugcuuuuca

SEQ ID NO: 121058 - RNA, 64 nt, Human
acagaaugagugcacagcuaagagaucaaguuucagcaggcagcuuuaucucaaccuggacaua

SEQ ID NO: 121059 - RNA, 64 nt, Human
guauuagaguuuguauuuucacagagugcuuuguagcaggcauuacaauuaaucuguuuuguac

SEQ ID NO: 121060 - RNA, 64 nt, Human
ugacgcagauaacugguuacucagcucccuggaaagcaggcaagcauguugaauguaucuagug

SEQ ID NO: 121061 - RNA, 64 nt, Human
cuccuggaggcccuggucagcuugcuuggaauccagcaggcagcuggggcugagugaaaacauc

SEQ ID NO: 121062 - RNA, 64 nt, Human
uauuuuaaagauuagauuuagucaaauaagucuuagcaggcaauaaaguuucugugguggcaua

SEQ ID NO: 121063 - RNA, 64 nt, Human
guacagcaacaggaaucucagagacagguggccuagcaggcacaggacaccuggccgccuccag

SEQ ID NO: 121064 - RNA, 64 nt, Human
ggccuccaugguggcaugggucagcagagcauggagcaggcagaggaagccuaucuguggggcu

SEQ ID NO: 121065 - RNA, 64 nt, Human
ucugauuuuagauaaaguaagccuagguguugucagcaggcaggcuggggaggccaguguugug

SEQ ID NO: 121066 - RNA, 64 nt, Human
ggagcccugaggguggcaggagcuaaccccaaccagcaggcaacuaacacggaauuggccccac

SEQ ID NO: 121067 - RNA, 64 nt, Human
cuaugguuuccauguggacauacagugccuauguagcaggcacuuagaguaaauggacuugccu

SEQ ID NO: 121068 - RNA, 64 nt, Human
caguccccauggcacccugcuccauguuaccuagagcaggcacuugauuccuugcugggcagua

SEQ ID NO: 121069 - RNA, 64 nt, Human
auaaucccagggggagggggucaggugucgaaccagcaggcaaggcgaggugcccgcucagcuc

SEQ ID NO: 121070 - RNA, 64 nt, Human
uuguagacacuguuacuuucccccuccccuagucagcaggcaauagauggggccccagcugccg

SEQ ID NO: 121071 - RNA, 64 nt, Human
ccugaacgaacugcguguggggccggcacauccuagcaggcagccccuggcgccugcugccuca

SEQ ID NO: 121072 - RNA, 64 nt, Human
ugucaccacguggcuugggaacuucuggagccacagcaggcaucacggugcgacgugagaugcc

SEQ ID NO: 121073 - RNA, 64 nt, Human
aaccaggucagaugauguaacagccccaaggagcagcaggcaugggucccuccauccuugggcu

SEQ ID NO: 121074 - RNA, 64 nt, Human
cccuggcuccccaccacagccccagcugccucagagcaggcacagcacaaggcaggcccagccc

SEQ ID NO: 121075 - RNA, 64 nt, Human
aggaggagcaaaucaugucuuauacauggauggcagcaggcaaagagagaacuugugcagggga

SEQ ID NO: 121076 - RNA, 64 nt, Human
cugcagucuuagucccauuccccuuugaucucacagcaggcagggcacccaggccuuauaggaa

SEQ ID NO: 121077 - RNA, 64 nt, Human
gcuagguggggccuagauccacacacagaggaagagcaggcacauggaggagcuugggggauga

SEQ ID NO: 121078 - RNA, 64 nt, Human
ugggaguucccgagaugcucggguuugagcagggagcaggcagagcugcagucagagacauuag

SEQ ID NO: 121079 - RNA, 64 nt, Human
ugaguuaguggacaccggcuaaaugaggaagagcagcaggcauugucauggugaaugccccgcu

SEQ ID NO: 121080 - RNA, 64 nt, Human
caggugagaacccagagagaggggccugcaggugagcaggcagggcugggccaggucuccgggg

SEQ ID NO: 121081 - RNA, 64 nt, Human
cuccucucaggcguucagauggugcgaacagcagagcaggcaagggaaacuggggagaugggga

SEQ ID NO: 121082 - RNA, 64 nt, Human
gaagaccaguauuucagaacuuugagaauuggagagcaggcacaucaacugaucucauuucuag

SEQ ID NO: 121083 - RNA, 60 nt, Human
cccugcacacgcacaucugaaccuggucucagcaggcagguggcuggggccugggagagg

SEQ ID NO: 121084 - RNA, 64 nt, Human
ccacugcuuagagcgagagcagagcaaacugcgcagcaggcaccuccagaaagguaaugguggc

SEQ ID NO: 121085 - RNA, 64 nt, Human
aaaaacaggaauccgugauuuuauaccagaacucagcaggcauuggcuccuagaaaucaaguua

SEQ ID NO: 121086 - RNA, 64 nt, Human
ugcacauugcacagaggaggagauucauggggacagcaggcacugguuaggcacagcgggaagg

SEQ ID NO: 121087 - RNA, 64 nt, Human
agcccaggggcuuaccucacugagagugcuccccagcaggcauccacuaccccagggcccccca

SEQ ID NO: 121088 - RNA, 64 nt, Human
caggcauggccuguggcccgagggccaaccaccgagcaggcacagcacagcagugacucgguga

SEQ ID NO: 121089 - RNA, 64 nt, Human
uuucagaggcuucuuuugaagauuccccaagucaagcaggcaagaugccuagaucuucuguuau

SEQ ID NO: 121090 - RNA, 64 nt, Human
cagcaaaucucuauugaguucuucagugagaaggagcaggcacugggccuggaauggaaggcgg

SEQ ID NO: 121091 - RNA, 64 nt, Human
uggcagagccaggggugaagggagaagcucuuggagcaggcaggaugcccaccgcugcuucagc

SEQ ID NO: 121092 - RNA, 64 nt, Human
gcauugcagcugggauugaaaguaaucagucgugagcaggcaggcaggagguccuguuagcccu

SEQ ID NO: 121093 - RNA, 64 nt, Human
uauaaguaugaaggauucucucuccugagauuguagcaggcagccaaacauuuucaaaugaugc

SEQ ID NO: 121094 - RNA, 64 nt, Human
uagcauaaagggcuacuggugagauugagaucugagcaggcaaagcucaaaagagaguuuggag

SEQ ID NO: 121095 - RNA, 64 nt, Human
cuuuggcuuugcuggugagaucagagcccuccugagcaggcagcgccacuccaggguucagaca

SEQ ID NO: 121096 - RNA, 64 nt, Human
uaauacaagcaacauuaacaucuucagaaaaggaagcaggcaugguccuggaaaauuggggaau

SEQ ID NO: 121097 - RNA, 64 nt, Human
uggcuccagcaagagccccaggcaggacaaagggagcaggcagcagcugcagaaacagcccuag

SEQ ID NO: 121098 - RNA, 64 nt, Human
ccccuccuuuagccaagucaggaucuuaggccucagcaggcagggacccuuccaggccacagua

SEQ ID NO: 121099 - RNA, 64 nt, Human
uacggugugcuacccuuucuaaacuguucuaagaagcaggcaguugauguauguuuauauuuua

SEQ ID NO: 121100 - RNA, 54 nt, Human
ggccucaggcgaugacauagccgcagcaggcaggaggcguccucuucagcguag

SEQ ID NO: 121101 - RNA, 64 nt, Human
ugugcaugcugaaaagaguaugaaaaauccccucagcaggcauaggauagaaacguauuguugu

SEQ ID NO: 121102 - RNA, 64 nt, Human
cuauuauagaugaaaacugcacaaggccagaaccagcaggcacucaauaaacguucauguccuu

SEQ ID NO: 121103 - RNA, 64 nt, Human
uaggccugggauugagcuaaccugaaacaaagguagcaggcaggaccuaaugaccagagguuaa

SEQ ID NO: 121104 - RNA, 64 nt, Human
ggccaacauuggugucccuguccccagagggaggagcaggcaggagagagaggggaaggaggua

SEQ ID NO: 121105 - RNA, 64 nt, Human
acacaagauucuaaaaugcaaauguuuauuuugaagcaggcauugacaacacaaaaacugugua

SEQ ID NO: 121106 - RNA, 64 nt, Human
cguaggagagggagaugauccagagacauguggcagcaggcauggcuuccccuuggccucucug

SEQ ID NO: 121107 - RNA, 64 nt, Human
accaguagcuggugccaggacagagcucugggacagcaggcagaggccgagccugggccacagc

SEQ ID NO: 121108 - RNA, 64 nt, Human
aaauuuauuuacagcucuuaaugcaguugaaaagagcaggcaaaagaauccucgaagcuuaugu

SEQ ID NO: 121109 - RNA, 64 nt, Human
uucucuggagaaguuuuuguaaaccaaacagacaagcaggcaggcagccugagagcuggcccag

SEQ ID NO: 121110 - RNA, 64 nt, Human
gccugcugcccuccacggagcagcagcacccuccagcaggcagcccagcaugccaggggugugu

SEQ ID NO: 121111 - RNA, 64 nt, Human
ggccugcaggggcuccauaugucccuacgcgugcagcaggcaaacaagaaagaccauccugagc

SEQ ID NO: 121112 - RNA, 64 nt, Human
caaaaugaagauacacauuacagccaggugugguagcaggcaccuguagucuuagcuacucgag

SEQ ID NO: 121113 - RNA, 53 nt, Human
ugggcccugugcccuccuagaggagcaggcaccucccccagacuugggguggg

SEQ ID NO: 121114 - RNA, 64 nt, Human
uuuagccaaguuaccugacgggugagaagaaaagagcaggcaaaauuagugauuuuuuuagaag

SEQ ID NO: 121115 - RNA, 64 nt, Human
cauaaauacaaagcagcuuccaucaggaacauggagcaggcagggacuccauuuuacagaauua

SEQ ID NO: 121116 - RNA, 64 nt, Human
gcaggggccggagugagggggcugcuggcuuaacagcaggcaucugggcaggccaguccucaaa

SEQ ID NO: 121117 - RNA, 64 nt, Human
gcauguugguaggucacuggaccagagcuugugaagcaggcaaccucugggguaagacuacuga

SEQ ID NO: 121118 - RNA, 64 nt, Human
cuccucuccuuuccauucucucuauggggaggggagcaggcaggaggagcagaaauugccaaca

SEQ ID NO: 121119 - RNA, 64 nt, Human
ggaccugacagcccaaacugucagagaggaggaaagcaggcauuugauuuugguaauugugcca

SEQ ID NO: 121120 - RNA, 64 nt, Human
cucggggcagacccuccccguccucguggagcuuagcaggcagcugggcauggaggugcugggg

SEQ ID NO: 121121 - RNA, 64 nt, Human
guucaagauuaagaagcauaaugacaacaaaaaaagcaggcagaauuuaugaauaaguguuguu

SEQ ID NO: 121122 - RNA, 64 nt, Human
ucugugucuacagcggaggccgccauguggagagagcaggcaggcccacugcugcugagaacag

SEQ ID NO: 121123 - RNA, 64 nt, Human
gagucugcaggagcgcagacaggcacagcccuggagcaggcaggccgagggcugcggcacugga

SEQ ID NO: 121124 - RNA, 64 nt, Human
aaaaagagaguuuuuagugaaguaucuuucagauagcaggcagggaagcaauguaguguggugg

SEQ ID NO: 121125 - RNA, 64 nt, Human
uuccaaagacagugacagcugacugagggcaaagagcaggcaccacucagaacguggugaguac

SEQ ID NO: 121126 - RNA, 64 nt, Human
gugcccuguucucuuguccccaccaccaaccuauagcaggcaccaaagcaagugcccgguaaau

SEQ ID NO: 121127 - RNA, 64 nt, Human
agcggccauguaccucaucagcaagcgacucaagagcaggcaccgccuccaggacaacgugcgc

SEQ ID NO: 121128 - RNA, 64 nt, Human
cugcagccucagaaaccaggccucucacuccagcagcaggcagaaccgugucuguggucgggug

SEQ ID NO: 121129 - RNA, 64 nt, Human
cugugggagcagacccgugggccucagggcagccagcaggcaggucuuguugccaauuuacaaa

SEQ ID NO: 121130 - RNA, 64 nt, Human
ugcagagcgggagccugccuaccugggccuggccagcaggcagggcugccuucugcuuuuucaa

SEQ ID NO: 121131 - RNA, 64 nt, Human
aagauuguuguuauaaagaauugguuucuuggaaagcaggcaagacuuuuucucuguguuagga

SEQ ID NO: 121132 - RNA, 64 nt, Human
ucuuagucuagcucugcucaugaaugaacaaagaagcaggcauguaaaauggauccuuguccua

SEQ ID NO: 121133 - RNA, 64 nt, Human
gaaggcgcuggagccugcggggcagcaggggccaagcaggcacucuggggcuggcaccagcagg

SEQ ID NO: 121134 - RNA, 64 nt, Human
gcaggggccaagcaggcacucuggggcuggcaccagcaggcacugaagcugcggcccugaucuc

SEQ ID NO: 121135 - RNA, 64 nt, Human
cugaaagaugccagagccggagaugucugcuggcagcaggcaggguucauucuggugacacagc

SEQ ID NO: 121136 - RNA, 64 nt, Human
augagcaaaccccuaaggcccccagcucagacucagcaggcauucaggucaacucaggcagacu

SEQ ID NO: 121137 - RNA, 64 nt, Human
gguguucugugauauaaguguguguuuuucauaaagcaggcagaacucaucuagguaaauuaca

SEQ ID NO: 121138 - RNA, 64 nt, Human
uucugccgccacuccgcaagauggacagggagccagcaggcaggcgggaagggccaaguacagg

SEQ ID NO: 121139 - RNA, 64 nt, Human
uuaggagccucacaucuacucugccaagcgccccagcaggcacugugcugggcuuaggggcuac

SEQ ID NO: 121140 - RNA, 64 nt, Human
ccuguuaauaugcucauugaaaacauggcauugaagcaggcacuugcguggauguuucucacuu

SEQ ID NO: 121141 - RNA, 64 nt, Human
uaccuuuggaucugugagaaggugaauacaaagcagcaggcagaguaaaaucugcugggacugc

SEQ ID NO: 121142 - RNA, 64 nt, Human
uaaaauuagcucuauguauuuucuacugcaccugagcaggcaggucccagauuucuuaaggcuu

SEQ ID NO: 121143 - RNA, 64 nt, Human
uggcucaucuagaccuggcaagaauguauauagaagcaggcaaucacagaaaagcugaagagaa

SEQ ID NO: 121144 - RNA, 64 nt, Human
uaagcaaccuuugaauccagcucuagucagucuaagcaggcaaagguaacugaugacuaaauuu

SEQ ID NO: 121145 - RNA, 64 nt, Human
ggcacuacgcgccaccaguucccgguacccagggagcaggcagccacacacgggccuugcaacc

SEQ ID NO: 121146 - RNA, 64 nt, Human
auguguauguguacauuggguccugaaagcuagaagcaggcaugcuagccuaguauguucugac

SEQ ID NO: 121147 - RNA, 64 nt, Human
uuaccuuuuguuuaccaagggccccuucauaaauagcaggcaaaugccuagcuuugggagaaaa

SEQ ID NO: 121148 - RNA, 64 nt, Human
cccagacccccaggugcccaaggccugcugcuggagcaggcaccuugggcugggccugcucccc

SEQ ID NO: 121149 - RNA, 64 nt, Human
gacaggguguuucagaaacuuggaaaccugaagcagcaggcagaacaggagcgggacaagcugc

SEQ ID NO: 121150 - RNA, 64 nt, Human
uaagcaguacgugccuccaaguuaccuccagaucagcaggcacaggugggcauugccagguauu

SEQ ID NO: 121151 - RNA, 64 nt, Human
cucauccacuugagggcgccugagggccaggagcagcaggcaaggagccugggucuaggcuaag

SEQ ID NO: 121152 - RNA, 64 nt, Human
ccgggggggacucaacagcagagcucugagcagcagcaggcaacuucgagaacggauccagaaa

SEQ ID NO: 121153 - RNA, 64 nt, Human
cugggagaggcagcccaggaagucucaucuggggagcaggcagccagcaucugggccuuggccu

SEQ ID NO: 121154 - RNA, 64 nt, Human
gacuguuuuaaagagccaucccaaggccucuccuagcaggcagaagccacuccucugauaacgg

SEQ ID NO: 121155 - RNA, 64 nt, Human
gagcugcuuugugaugcugaaggauacugccggcagcaggcagaggagggagggggccuagggc

SEQ ID NO: 121156 - RNA, 64 nt, Human
aggaggugccccccacauugguguccccaugggcagcaggcagacagcucacccccaccagcau

SEQ ID NO: 121157 - RNA, 64 nt, Human
gcaggaacaacuauccucgucugucccaacacugagcaggcacucgguaaacacgaaugaaugg

SEQ ID NO: 121158 - RNA, 64 nt, Human
uugguaugaaauagaagguggcuuuguaggggcaagcaggcaaagaguacuauccacauggcag

SEQ ID NO: 121159 - RNA, 64 nt, Human
aacguacuuccaccagauguguccccagauccacagcaggcacauaucucuccaagggaugacc

SEQ ID NO: 121160 - RNA, 64 nt, Human
ggaaucugggauuugccaguugcuggcaauguagagcaggcauggaauuuuauaugcuagugag

SEQ ID NO: 121161 - RNA, 64 nt, Human
ugcuccugccagcacaggggccagggacuccuggagcaggcacauagugagcccgggcagcccu

SEQ ID NO: 121162 - RNA, 64 nt, Human
cccucccucuagguccagggacuaucacagaagaagcaggcauguaagauuuuaaggacugguu

SEQ ID NO: 121163 - RNA, 64 nt, Human
gaauagaaauggaaagugggacugagagggagucagcaggcaugcugcgguggcggucacuccc

SEQ ID NO: 121164 - RNA, 64 nt, Human
gucuuugguuaccccccagccccaguaggaggagagcaggcagagcuugucauccccagccugg

SEQ ID NO: 121165 - RNA, 64 nt, Human
agcacuuuaggaaguaagugaaaguaccuaaaauagcaggcacccaauugaugauuuuauaucu

SEQ ID NO: 121166 - RNA, 64 nt, Human
agggcuugggacaagaagucugucauguuaguuaagcaggcaagaaauccuacuaauccaguuu

SEQ ID NO: 121167 - RNA, 64 nt, Human
accacaauuaauaggaauccucaacauacuaaauagcaggcacuugaaaauggguguguuuucu

SEQ ID NO: 121168 - RNA, 64 nt, Human
gugggugcccuccagagaggggcugcuaccucccagcaggcaugggaagagcacuggugugggg

SEQ ID NO: 121169 - RNA, 64 nt, Human
aaaugggccugucuggcauuucagagucaggcaaagcaggcagggccagggagcuucugugggu

SEQ ID NO: 121170 - RNA, 64 nt, Human
gugggguucacaacaagagacgucauuguucaguagcaggcaaagagggagcacacagcauuau

SEQ ID NO: 121171 - RNA, 64 nt, Human
aggcugcugggagaugccauucuccaguuucagaagcaggcagggcaaaggucaagacuguggu

SEQ ID NO: 121172 - RNA, 64 nt, Human
ccuucccaaaucccuccaggccagaacugacuggagcaggcauggcccaccaggcuucaggagu

SEQ ID NO: 121173 - RNA, 64 nt, Human
cauagaaauucugugaaccagaaugagacaaggcagcaggcauacagaagguuuguccugcucu

SEQ ID NO: 121174 - RNA, 64 nt, Human
cuaucugcacuuuuuauuuauuagcugaaauguaagcaggcauauucacucacuuuucuuugcc

SEQ ID NO: 121175 - RNA, 64 nt, Human
acaggacuuagaaguaguauguuauuccugguuaagcaggcauugcuuugcccuggagcagcua

SEQ ID NO: 121176 - RNA, 64 nt, Human
gaggaggagaagccaaagaggaggaggcaggagaagcaggcagccugccccuucuacaaccacg

SEQ ID NO: 121177 - RNA, 64 nt, Human
gcagccaugaccaguucuggccaggagcuggaggagcaggcagugggugggagcuccuuuuagg

SEQ ID NO: 121178 - RNA, 64 nt, Human
ggcaccauggcaugaggaagaaacaaggucccugagcaggcacaaguccugacagucaagggac

SEQ ID NO: 121179 - RNA, 64 nt, Human
uuucuguggugagggagaaccucuccaaagaggaagcaggcauaugagugcgcacgccuucacg

SEQ ID NO: 121180 - RNA, 64 nt, Human
agggagaccugggagaucaagucggcacuggggaagcaggcagcggucccagagccacccugug

SEQ ID NO: 121181 - RNA, 64 nt, Human
augaggccaaaaagugugcauuggauaggggaacagcaggcagggcucugggugacgcaugccu

SEQ ID NO: 121182 - RNA, 64 nt, Human
uuggggaaguugaggagugcccuucagagccaguagcaggcagggguggguaggcacccuccuu

SEQ ID NO: 121183 - RNA, 64 nt, Human
gguggguagagagagcaaggagggcaggacacuuagcaggcacugagcaagcaggcccccaccu

SEQ ID NO: 121184 - RNA, 64 nt, Human
ccuagggcuaagggccugcaccuugcgugcaugcagcaggcaacaacugccccuucuuuaugca

SEQ ID NO: 121185 - RNA, 64 nt, Human
caccgcucuccucccugccccaggacuucaucggagcaggcaggguggagcgaaggagcuccuu

SEQ ID NO: 121186 - RNA, 64 nt, Human
uccaaggccaggucucagucggugucacccagcaagcaggcagcgccccggcccgcggcccccg

SEQ ID NO: 121187 - RNA, 64 nt, Human
caaagccaaagcgagcuccugcuuagggaaggucagcaggcacugugcccaggaagagccugcg

SEQ ID NO: 121188 - RNA, 64 nt, Human
aggcucagugcaccccaagccucugagugaggacagcaggcagggacuguucugcuccucauag

SEQ ID NO: 121189 - RNA, 64 nt, Human
uuccaggucaaggucuggcgucccaaaugaaagaagcaggcaaagggaaggagccccugagaac

SEQ ID NO: 121190 - RNA, 64 nt, Human
uguacucaaaaugcaaaaauuagccaggcgugguagcaggcaccuguaaucccagcuacuuggg

SEQ ID NO: 121191 - RNA, 64 nt, Human
ggcucaugccaguaaucccagcacuuugggcugaagcaggcagauauuuugagcccaggaccag

SEQ ID NO: 121192 - RNA, 64 nt, Human
caaggcucuccguggaguggacucgagucccuggagcaggcaguguggaggcagccauccccug

SEQ ID NO: 121193 - RNA, 64 nt, Human
uggagccaugaggaggggcugggacuggagcuggagcaggcacuugcagccgggaaagccaggg

SEQ ID NO: 121194 - RNA, 64 nt, Human
uccugaccucuucccaggcagugccuagcuccagagcaggcacagccugccucagcaugcuucg

SEQ ID NO: 121195 - RNA, 64 nt, Human
gaagugguggagccucagggccagggcaggcaggagcaggcacugaugcuagagggugaugacc

SEQ ID NO: 121196 - RNA, 64 nt, Human
uuucuccacucaccugcacccagaagcagagaaaagcaggcacuguucacuuuuccuuuauucu

SEQ ID NO: 121197 - RNA, 64 nt, Human
cacucuccacaguccugcacugugauuccuucucagcaggcacaugucaauucugcaguguuca

SEQ ID NO: 121198 - RNA, 64 nt, Human
ggagggugcuguggagggggcugcagggcugaccagcaggcagccucaucuggucgggggcggg

SEQ ID NO: 121199 - RNA, 64 nt, Human
uauuccuucagggcucgggguagcuugaauuuguagcaggcacaugacagaaauuguauguauu

SEQ ID NO: 121200 - RNA, 64 nt, Human
uccugcccucuccucucucaggagggggagggugagcaggcacauugacuuucuguugagguac

SEQ ID NO: 121201 - RNA, 64 nt, Human
guggagacugugcacgugccucuuccuggcccccagcaggcaaggaggggggucacaggccuug

SEQ ID NO: 121202 - RNA, 64 nt, Human
cuuacaauguggaaaugaaagcuaauuuauacacagcaggcauaugaaacuccacucauugcag

SEQ ID NO: 121203 - RNA, 64 nt, Human
auaccagcuccucccugccgugccccugccacggagcaggcauugugaacuggcugguguuugc

SEQ ID NO: 121204 - RNA, 64 nt, Human
cuuuuagaguaggaaucagcauagugggaugcccagcaggcacaaaccauggguccagggaguc

SEQ ID NO: 121205 - RNA, 64 nt, Human
aggacacuuacacaaucauggcagaaaaaggagaagcaggcaccuuuuucacagggcggcagga

SEQ ID NO: 121206 - RNA, 64 nt, Human
aauucugaacuuuucaggagguacugugaggaagagcaggcaccagcagcagaauggggaaugg

SEQ ID NO: 121207 - RNA, 64 nt, Human
auauauugagaaaagcauauguuuauuuuagguuagcaggcacauacugucaaguuguaaagau

SEQ ID NO: 121208 - RNA, 64 nt, Human
acacuuucauuacaagucagauuuuucuuaaacuagcaggcaaaaacaguacuuccaaauuuua

SEQ ID NO: 121209 - RNA, 51 nt, Human
gaacaaugaagcgccucuaacagcaggcaugagacuaaccuuccucugggc

SEQ ID NO: 121210 - RNA, 64 nt, Human
acuuuguaacuuuguauaugaaucaaaacaaacgagcaggcauuucugugauguguugggcgug

SEQ ID NO: 121211 - RNA, 64 nt, Human
acacaucuggcugcacaggcugaaauauccacccagcaggcagaguggcguggccuccccaugg

SEQ ID NO: 121212 - RNA, 64 nt, Human
gucuccucagcaucagacgggcuuccaggaccgcagcaggcaggccccagcgccgagacuccug

SEQ ID NO: 121213 - RNA, 64 nt, Human
cuucuaagacaggaaggaaagugaaggcagagugagcaggcaaaguagaaaauucgaaaagguc

SEQ ID NO: 121214 - RNA, 64 nt, Human
auuguugcaaugacuugggagugccauagcaccuagcaggcagaagccagaaacaccaaauguc

SEQ ID NO: 121215 - RNA, 64 nt, Human
ugaaauacaaccuaguuuuaucaccauauccaccagcaggcauggauaauuauuuuaacaaugc

SEQ ID NO: 121216 - RNA, 64 nt, Human
auaacuccacagcuccuccuggacccugcgcgggagcaggcagcuccugugcuguaaagaaaau

SEQ ID NO: 121217 - RNA, 64 nt, Human
gacccaccucagagccugcuuugcaucacugggaagcaggcagugucuugggugggggcuuggu

SEQ ID NO: 121218 - RNA, 64 nt, Human
ucuugcccugcaucugggggucugaauuuuugggagcaggcaauaucugaaggugcaaacaggc

SEQ ID NO: 121219 - RNA, 64 nt, Human
cugccucucccgccuguggccaaagucguguugcagcaggcaggcugcuuggagcuucccauga

SEQ ID NO: 121220 - RNA, 64 nt, Human
ugggcagcuugagaaggcguucagcaccacgccuagcaggcagaccuugaagccucaccuuuag

SEQ ID NO: 121221 - RNA, 64 nt, Human
gaggaucuaaagcagccgguguggcagcuccgauagcaggcacagggaaucuguuaaccagacg

SEQ ID NO: 121222 - RNA, 64 nt, Human
guggaucugccauccauucugcagucuccagcagagcaggcagucaggccccagcgugccucca

SEQ ID NO: 121223 - RNA, 64 nt, Human
augauacgaggcgaaugggugacggccgggcaggagcaggcaugauaacccaacauucaaggua

SEQ ID NO: 121224 - RNA, 64 nt, Human
gaggacccgcccucugcagacugggcuuagcgugagcaggcacuucccauguacgugccaaggg

SEQ ID NO: 121225 - RNA, 64 nt, Human
uuuuaaaacuuggcuuuagccagugccgaagaggagcaggcacagcuacaugggcagcugaagg

SEQ ID NO: 121226 - RNA, 64 nt, Human
cagcacuagagggagggagggggagggaggagggagcaggcaggucccaaaugcaaaagccaga

SEQ ID NO: 121227 - RNA, 64 nt, Human
cgcaggguacuucugugcuugcccucgcccugccagcaggcagcugugccccuggccugcccuu

SEQ ID NO: 121228 - RNA, 64 nt, Human
ccccagcccugcuggggauccccgccuggccaggagcaggcacgggugguccccguuccacccc

SEQ ID NO: 121229 - RNA, 64 nt, Human
aggaacguggucacagagcugcuuccccacgagcagcaggcaacggcguccaaggagacuagga

SEQ ID NO: 121230 - RNA, 64 nt, Human
agcaguguuuugcagaaugagccagaguucaccaagcaggcaaggcaaggaaggguguugcaga

SEQ ID NO: 121231 - RNA, 64 nt, Human
ugcucagccacccugugggccgggcaauccagacagcaggcauaaggcaccaguuacccugcau

SEQ ID NO: 121232 - RNA, 64 nt, Human
ucugggccucagugucuugauguaucauucauggagcaggcaaaaccagacgucugggaagacc

SEQ ID NO: 121233 - RNA, 64 nt, Human
gagggagagacagagacagagccgauggggccagagcaggcagaacaggcggagcgcggcgagu

SEQ ID NO: 121234 - RNA, 64 nt, Human
ccagccaaacccuccuucuuccuagagcccagccagcaggcaggaguuccuggacccucaggac

SEQ ID NO: 121235 - RNA, 64 nt, Human
gucccagauuucuguuucccaaggagcaggggugagcaggcaggcuccccucccgaguccugag

SEQ ID NO: 121236 - RNA, 64 nt, Human
cugccccagggugcuccauggaucucccuguggcagcaggcauggagagucagggcugccuuca

SEQ ID NO: 121237 - RNA, 64 nt, Human
ugacaucagacccaacccaugaaggcuggaaggcagcaggcauuugcuaaggcagcugauccag

SEQ ID NO: 121238 - RNA, 64 nt, Human
ugccgugauccugagccaaggaggugaggagcagagcaggcaauuucaccaccaaaugccaaga

SEQ ID NO: 121239 - RNA, 64 nt, Human
augccggagagacagccccuugugcugugagcagagcaggcaguggcucuggaggcugccugug

SEQ ID NO: 121240 - RNA, 64 nt, Human
caagguuuccucucuucccccaggaccugggcagagcaggcaugagcugggcuguggugcagag

SEQ ID NO: 121241 - RNA, 64 nt, Human
ucaggugauuuccuagggagagguucccagucccagcaggcagaaugcccaaaaccaggagcac

SEQ ID NO: 121242 - RNA, 64 nt, Human
ccagagcugagcgugaggacgugcuugccgggacagcaggcaguggccaccugguacaccacac

SEQ ID NO: 121243 - RNA, 64 nt, Human
ccaggcagaauggcugcacguagguuccccagagagcaggcaggggcaucugucugucuguggg

SEQ ID NO: 121244 - RNA, 64 nt, Human
aagcaaacccuugacucuggcaggauuugcaggcagcaggcagcaccccucugccagccgggcc

SEQ ID NO: 121245 - RNA, 64 nt, Human
acgaucaggaggaagugagcagucgccugccugcagcaggcagcuucuacuccugccucaugcg

SEQ ID NO: 121246 - RNA, 64 nt, Human
cccaaagcuuugcugcuauugauuuguccccgacagcaggcaaagccucacauugcccucaauu

SEQ ID NO: 121247 - RNA, 64 nt, Human
gggacagcccacggucuggaggccgaggaccaccagcaggcagguggacugacuguguugggca

SEQ ID NO: 121248 - RNA, 64 nt, Human
gaaauucaugcuugcaccgaguacaaggacagacagcaggcacggcccgcagccuggcaucugu

SEQ ID NO: 121249 - RNA, 64 nt, Human
acguggucccaggccguucagccugaccucaggcagcaggcaccaagcugccagaagcccaggg

SEQ ID NO: 121250 - RNA, 64 nt, Human
auuuccccgaugacccuggauuguaggaaaguuaagcaggcaccauccuggaagucuaccccua

SEQ ID NO: 121251 - RNA, 64 nt, Human
uaucccauaucccaaauucuuaugagccacucacagcaggcagcauauguugaaauaaguuauu

SEQ ID NO: 121252 - RNA, 64 nt, Human
ccagggcuccuccccagccggugacuuacuguacagcaggcaggagggugggcaggcaaccucc

SEQ ID NO: 121253 - RNA, 64 nt, Human
ccagcuucgcgaaggcuguaggcacaccgcggccagcaggcaccuggcacccaccuucccugcu

SEQ ID NO: 121254 - RNA, 64 nt, Human
uccuguggccagggcuccguggccuaugugccccagcaggcauggauccagaacugcacucuuc

SEQ ID NO: 121255 - RNA, 64 nt, Human
guuugguagcaggagaaaugaaggaagaugaaaaagcaggcagggaaggggguaguaaaggacu

SEQ ID NO: 121256 - RNA, 64 nt, Human
cuuguucagcaccccaaacagccugccuguuuaaagcaggcagcaggcuuaggccuucccugca

SEQ ID NO: 121257 - RNA, 64 nt, Human
uuuauaguggcaauuauuuucucacagucuggugagcaggcaauuaauuaggaguaagggggcc

SEQ ID NO: 121258 - RNA, 64 nt, Human
ugcuuucuguuccucugauuggauggaguccgccagcaggcauggggcuacauuccagugccug

SEQ ID NO: 121259 - RNA, 64 nt, Human
ccagccugaaaugcgaucaccccguaggaaauaaagcaggcaucucuggaccucauccacccug

SEQ ID NO: 121260 - RNA, 64 nt, Human
uuagcugggccagggauugacccaagcgcgaugcagcaggcaggcucagaagacgaugcggggc

SEQ ID NO: 121261 - RNA, 64 nt, Human
uccauuuucuauuaccuggaaagggccauaaggaagcaggcagggcuuagguagcuugguuacc

SEQ ID NO: 121262 - RNA, 64 nt, Human
auacaaagguauccauggagguagcaccacaggaagcaggcaucacacuugaggcuugggaaca

SEQ ID NO: 121263 - RNA, 64 nt, Human
gggcagggagagggccaaggacaauugggagggcagcaggcagcccgcagaugguggccaugug

SEQ ID NO: 121264 - RNA, 64 nt, Human
cugugaggggagccaccugagggcuguggaacccagcaggcaugagaugaaccgcagugcccau

SEQ ID NO: 121265 - RNA, 64 nt, Human
ccaacugaagagccccaagcucuccauggcccacagcaggcacaggucugagcucuauguccuu

SEQ ID NO: 121266 - RNA, 64 nt, Human
cccuccccugacugcauguggaagggcacacagcagcaggcagggaggaggcggagguggcaaa

SEQ ID NO: 121267 - RNA, 64 nt, Human
gccugcagaagucccaagacccuagugaaaauacagcaggcagaacucuccuuggauaauuccc

SEQ ID NO: 121268 - RNA, 64 nt, Human
gcaucgugcuggugccucuggccccguggaguggagcaggcagauaccguuaagcgcugugcua

SEQ ID NO: 121269 - RNA, 64 nt, Human
cccagucccugccuuggcaccgucacagaugccaagcaggcagcacuuagggaucucccagcug

SEQ ID NO: 121270 - RNA, 64 nt, Human
ggcagccacagauacuucugaacccuucacagagagcaggcaggggcuucggugccgcgugggc

SEQ ID NO: 121271 - RNA, 64 nt, Human
gaacggacuagagagaguugcgggagagagaaggagcaggcacgcugggccucgcguguccccg

SEQ ID NO: 121272 - RNA, 64 nt, Human
cucugcuucucugucucaugcucccaggcugcacagcaggcagggagggaggcaaggcagggga

SEQ ID NO: 121273 - RNA, 64 nt, Human
aggacagguggacaugguccugagcucuggacggagcaggcacccugaucucauucugaggucc

SEQ ID NO: 121274 - RNA, 64 nt, Human
cacccgcccgcccugcugcagauacaugcggcacagcaggcacgugccuggagagaacagcucc

SEQ ID NO: 121275 - RNA, 64 nt, Human
aaaaaaaaaaacccaaaccaaaaacgcaaaccaaagcaggcaggcagacagcugcugggggaaa

SEQ ID NO: 121276 - RNA, 64 nt, Human
uuuagcugaggcuuuggaguacgaauaggagcucagcaggcagacgaaugaggaauaaagguca

SEQ ID NO: 121277 - RNA, 64 nt, Human
cgucacaggagaaggugcccuugcuggcugccccagcaggcacccaccucccugccaggccaag

SEQ ID NO: 121278 - RNA, 64 nt, Human
aggcugcucuggagaacaaugagguccucauagcagcaggcagcuccuguguuuucuugagggu

SEQ ID NO: 121279 - RNA, 64 nt, Human
gaagaacccaggcgccugagccccagcuccgggaagcaggcacuggggagggggcuucaaggag

SEQ ID NO: 121280 - RNA, 50 nt, Human
ggaagcuccuggaagccugaagcaggcagggccgguggacuucgucggau

SEQ ID NO: 121281 - RNA, 64 nt, Human
ggcuucacacccauuucuuuaaaaaggaucccguagcaggcagaaaagccccuuccauccugcu

SEQ ID NO: 121282 - RNA, 58 nt, Human
ugacauccaccgacuucugacuccuuccagcaggcagcuggccucuccaaggaauaag

SEQ ID NO: 121283 - RNA, 64 nt, Human
uuggccacaaugagaaaaauaaaaaugaaaaaagagcaggcauccauuuccauacaggaacaaa

SEQ ID NO: 121284 - RNA, 64 nt, Human
acuguaagggagauggcagccccaggguacagccagcaggcauugagcagccuuagcauugucc

SEQ ID NO: 121285 - RNA, 64 nt, Human
aaagccuucagucaccaacauauuguggcuggacagcaggcaguacacacuggagaaagacuga

SEQ ID NO: 121286 - RNA, 64 nt, Human
ggagccccgccuggcccgaagccguuuccaccgcagcaggcagaggggcuggacaggcacuguc

SEQ ID NO: 121287 - RNA, 64 nt, Human
aacagccaccaggaaagcagccggagagccggacagcaggcagccugucuggguuccugaggcc

SEQ ID NO: 121288 - RNA, 64 nt, Human
aucagcccccgcccugucccuccgaaggacacccagcaggcaccccccggggaggcaggggcag

SEQ ID NO: 121289 - RNA, 64 nt, Human
aaaggggaaaggaacacgcggguagaugauuucuagcaggcaggaaguccugugcggugucacc

SEQ ID NO: 121290 - RNA, 64 nt, Human
auauauauauaaauaauauacuuuuccucagaggagcaggcaacagugugggauaaacagaguc

SEQ ID NO: 121291 - RNA, 64 nt, Human
uugguuucuuagguuaagaugcucucgagcguugagcaggcacagcucugucgaggucccuguc

SEQ ID NO: 121292 - RNA, 59 nt, Human
ggcccaagaacagcuccugagcaccagggagcaggcaggggccucaggcuccucuccuc

SEQ ID NO: 121293 - RNA, 64 nt, Human
ccccggcccagugcccccugguggaaugcgggggagcaggcaguggggcuggaagcagaaacaa

SEQ ID NO: 121294 - RNA, 64 nt, Human
ucccuucucuuugccagccauguguacaguaaaaagcaggcaacauagugucagccaaagcuca

SEQ ID NO: 121295 - RNA, 64 nt, Human
aaggagugcggccacaagccggugccagcaugagagcaggcacagaaggaccagugaggaaguc

SEQ ID NO: 121296 - RNA, 64 nt, Human
gccaaacucuuguguggaacacagcugggucuucagcaggcaucugucacugccgugaggucag

SEQ ID NO: 121297 - RNA, 64 nt, Human
uagcuuuuaaaacuagaaaccauuguucuaacaaagcaggcaacuuuauucuauaaacacaacu

SEQ ID NO: 121298 - RNA, 64 nt, Human
cuccuugaaguuugcugcuuagaguuggaagugcagcaggcaggugaucaugcugcaaguucuu

SEQ ID NO: 121299 - RNA, 64 nt, Human
ccucaacugcugagcgcccccacucccggccgcgagcaggcagggcuucggggacgcggggcgc

SEQ ID NO: 121300 - RNA, 64 nt, Human
acucccugguuucuuccuggcaugguguuugggcagcaggcaucauuuuccuuuucuagcuuca

SEQ ID NO: 121301 - RNA, 64 nt, Human
caguaauaagaaucuaggaggaauuccaaaccgaagcaggcagggucuggaacccaaaggacag

SEQ ID NO: 121302 - RNA, 64 nt, Human
ccacccucccugacuggccugggauaucuuuacaagcaggcacuguauuuuuuuauucgccauc

SEQ ID NO: 121303 - RNA, 64 nt, Human
cucagcacgcucacuaacccagcaugccacuuccagcaggcaugcaguccuggcccagcucuau

SEQ ID NO: 121304 - RNA, 64 nt, Human
gguucuugcaagagcgcguggggacaguucuuccagcaggcacugguuuuguugccccagggcu

SEQ ID NO: 121305 - RNA, 64 nt, Human
uguccgccucugcccgcagagcccacgcccgacuagcaggcaugccgcgguagguaagggccgc

SEQ ID NO: 121306 - RNA, 64 nt, Human
uggcucuuccauugccacugagcaaugcccaggaagcaggcacauugccaaggacugggggcau

SEQ ID NO: 121307 - RNA, 64 nt, Human
cagcuggacaggcuuggcacugcccgggaagugcagcaggcagcuuuucuuuggggugggacuu

SEQ ID NO: 121308 - RNA, 64 nt, Human
accauauuguuugaucuacuucauagcuccuuggagcaggcaaaaaagggacagcaugccccuu

SEQ ID NO: 121309 - RNA, 64 nt, Human
aagcuuuauaaaccugccuccaagccauucaugaagcaggcaugagccagagggaggaaguuga

SEQ ID NO: 121310 - RNA, 64 nt, Human
ccgcggccucuggagcugggauuugggaggacacagcaggcagcgcuggccuucuccagggaug

SEQ ID NO: 121311 - RNA, 64 nt, Human
ggaaagaaaaggaaaauaguagcaagagcugcaaagcaggcaggaagggaggaggagagccagg

SEQ ID NO: 121312 - RNA, 64 nt, Human
acuuuugaguuaaucagcguaaggggauuucuaaagcaggcaaucccuguagccgcagagaaua

SEQ ID NO: 121313 - RNA, 64 nt, Human
gucgcgguagaugauguggaaacaaagcaggaccagcaggcacagcaccuccagaacagugccc

SEQ ID NO: 121314 - RNA, 64 nt, Human
ugcucuugugggaggcgacgggggggcaggcgggagcaggcacgggggugaugcugccacaggg

SEQ ID NO: 121315 - RNA, 64 nt, Human
gacagaaccugacccguggagacugggagagcccagcaggcaccuguauugcagggcuccgacu

SEQ ID NO: 121316 - RNA, 64 nt, Human
uuuauuaaaguacaaccauagaggauggucuuacagcaggcaguauccuguuugaggaaagcaa

SEQ ID NO: 121317 - RNA, 64 nt, Human
caugcacuggggcagggcagccagguuccagagcagcaggcaugugcauuaugggugccaggug

SEQ ID NO: 121318 - RNA, 64 nt, Human
agcccagcucuccacuuguuccuugugugagcugagcaggcagugcaccucugagugucccuuu

SEQ ID NO: 121319 - RNA, 64 nt, Human
uuaugccacagccgaagaauccguggggccggcaagcaggcaccuucccccagcugcgcuagcg

SEQ ID NO: 121320 - RNA, 64 nt, Human
gagugacccuucuggagcuggccagguccucugcagcaggcaagaccaaucaaucacugaaccu

SEQ ID NO: 121321 - RNA, 64 nt, Human
ccuaccaagaaaaacagucucauuacucauauacagcaggcaaagagacagaaaauuaacugaa

SEQ ID NO: 121322 - RNA, 64 nt, Human
uuuggagggcacuguugcugggcugaccuggcugagcaggcaaaaggugggugcagacuggccu

SEQ ID NO: 121323 - RNA, 64 nt, Human
acgugcaugcuuuaaaaaacacagucacgcaccaagcaggcaaauagcuuuaguccuucucacc

SEQ ID NO: 121324 - RNA, 64 nt, Human
ccggauaguaagaaaacaaacagcccaagugaaaagcaggcaaaagacuugaauagacacuuca

SEQ ID NO: 121325 - RNA, 64 nt, Human
ugcaggugcagaugcaggcaguggagguggccugagcaggcagaaggacaccaagcgcccuaug

SEQ ID NO: 121326 - RNA, 64 nt, Human
ggacaccgaguucuaagccacagaccgaggccccagcaggcagcggcuggagggaugccacacc

SEQ ID NO: 121327 - RNA, 64 nt, Human
cugcugccccaaagguauggggaagcaaccccagagcaggcagacaucagaggccagagugccu

SEQ ID NO: 121328 - RNA, 64 nt, Human
ccuucuuggaaggcagggcuggacacugauggacagcaggcagggagacaguccccuggcccug

SEQ ID NO: 121329 - RNA, 64 nt, Human
cugacugcagggguuauguggaaguguguguggcagcaggcagcggggaggggaggaacaggga

SEQ ID NO: 121330 - RNA, 64 nt, Human
gaggugucuggggugagggaguuagggagagagaagcaggcagauaaguuggagcagggguugg

SEQ ID NO: 121331 - RNA, 64 nt, Human
cuaguccugguagcugagcacccuguaaggcaggagcaggcagcucagcuugagcagacauugg

SEQ ID NO: 121332 - RNA, 64 nt, Human
cucaaaaaacccuuagcguaucuugccaugugucagcaggcaaacuugaggaagcccugguucu

SEQ ID NO: 121333 - RNA, 64 nt, Human
ucuuccuucauggaacuggauuuggauuucuugaagcaggcagcuucauauuauaccgauuugu

SEQ ID NO: 121334 - RNA, 64 nt, Human
aaagcagcuaacauuucuugaggcucuaccacauagcaggcacugucacagaguaauggcauua

SEQ ID NO: 121335 - RNA, 64 nt, Human
agccauuuuggcugcuguucuuuaaucuuccucuagcaggcaugcaguccaaggaauaucaaaa

SEQ ID NO: 121336 - RNA, 64 nt, Human
aaccauuuuggcugcugcucuuuaauuuuccucuagcaggcaugcaguccaaggaauaucaaaa

SEQ ID NO: 121337 - RNA, 64 nt, Human
cuuucccaaaggcaucacgagucagucgccuuucagcaggcagccuuggcgguuuaucgcccug

SEQ ID NO: 121338 - RNA, 64 nt, Human
acccugacgucccccagcaaaggaagacguugcaagcaggcaaaaugcgucgauuuuuuuuuuu

SEQ ID NO: 121339 - RNA, 64 nt, Human
ccucagccauggcaaguccaucuggaguccaggaagcaggcaacuggccugacccaugagaccg

SEQ ID NO: 121340 - RNA, 64 nt, Human
ugagaugggggacgccagacaugugaggacgcuguccuccgagagguguccccggcuguuagcc

SEQ ID NO: 121341 - RNA, 64 nt, Human
gggugcggggucccuggccccuuuuccacacuccuccuccgacagcagcucccugggcaguggc

SEQ ID NO: 121342 - RNA, 63 nt, Human
acaacccccgaacccucugaugcucccggagacuccuccgacuccacaccucucgcggcagcu

SEQ ID NO: 121343 - RNA, 64 nt, Human
uauucaaucccacugcuuugcucggcaaugguucuccuccgaauugcugccgucuggccucugg

SEQ ID NO: 121344 - RNA, 64 nt, Human
gacaccuuagagguccgugcuacaucgucacaguuccuccgaauaaccuuaggugguaguguua

SEQ ID NO: 121345 - RNA, 64 nt, Human
gagacccuggggcauuuaccucaggcaucugcacuccuccgagcccgguggagaaugcaggcug

SEQ ID NO: 121346 - RNA, 64 nt, Human
gacaccuuagagguccgugcuacaucuucacaguuccuccgaauaaccuuaggugguaguguua

SEQ ID NO: 121347 - RNA, 64 nt, Human
guccagucgugcuuggguuuggccgcagccaugauccuccgaaucugguugggcauccagcaua

SEQ ID NO: 121348 - RNA, 64 nt, Human
guagacauccaucagugcaacucgagcuccauccuccuccgauuucuaagguuccaguuuucug

SEQ ID NO: 121349 - RNA, 64 nt, Human
cagauuuuaaaauguagaagucguugggcugcauuccuccgaggaccagucugaucgcccagga

SEQ ID NO: 121350 - RNA, 64 nt, Human
ccucggcggcggcagaaaggggacaaccagggccuccuccgaggagcccgagggguguccuggg

SEQ ID NO: 121351 - RNA, 64 nt, Human
cucccuccaucaagaauggggaucacagagacauuccuccgagccggggaguuucuuuccugcc

SEQ ID NO: 121352 - RNA, 64 nt, Human
ccaccagcugugggcagucaguagcagaggacgauccuccgaugaaagcagccauuucuccuuu

SEQ ID NO: 121353 - RNA, 64 nt, Human
cagggaccugccugggggcagagagcugucuuccuccuccgaggcucugggcugcacccacagg

SEQ ID NO: 121354 - RNA, 64 nt, Human
uuccagguuucuuccacccacgagcacuuuauucuccuccgagacccccuuuucuuccccuucc

SEQ ID NO: 121355 - RNA, 64 nt, Human
ccuggguccauugucacuugggugcaucagguuguccuccgauuuuuagaugaguuuccugucu

SEQ ID NO: 121356 - RNA, 64 nt, Human
guguccuuacaaguuaaguccuaagcucacaggauccuccgagcauguccaucaccugcucuuu

SEQ ID NO: 121357 - RNA, 64 nt, Human
caugaaauagcugagcccagauguuccuucugcauccuccgaaucccagggcuggguguaggua

SEQ ID NO: 121358 - RNA, 64 nt, Human
aaucucugccuacaccuccugcggcgccuugcccuccuccgaccccuuuccagccaaagucccc

SEQ ID NO: 121359 - RNA, 64 nt, Human
cacggcccuggcguucggcacuagacugcuaguguccuccgauaugaaguccuggagcacuguc

SEQ ID NO: 121360 - RNA, 64 nt, Human
aaagggacaugauuuaacuccaguuugaugaaccuccuccgaguuuacuuuauugucuucaaau

SEQ ID NO: 121361 - RNA, 64 nt, Human
auggaaauauuuuuucugaauuuuuuuuuauauuuccuccgacuuaccucuuuuugaaaagaga

SEQ ID NO: 121362 - RNA, 64 nt, Human
gacgcgaugcucagacagaagggacuguggucgcuccuccgacuguuauccagguuccaagccu

SEQ ID NO: 121363 - RNA, 64 nt, Human
gccaugccccacccuggacugaaguucugcaaaguccuccgaggaccggaacacguuucugcga

SEQ ID NO: 121364 - RNA, 64 nt, Human
ugcaguggugcgaucauggaucacugcagcagcauccuccgaguucaagcuauccuuccaccuc

SEQ ID NO: 121365 - RNA, 64 nt, Human
cccuaaaaggaggcagugaggaccaggcacuauuuccuccgagguuacuucuacccagaugaca

SEQ ID NO: 121366 - RNA, 64 nt, Human
uagcucuccgcggcagccucggaaggcccuggucuccuccgagucguaccugcagcggcucucc

SEQ ID NO: 121367 - RNA, 64 nt, Human
ccgcccuccucacccucgcucucccuccuccuccuccuccgagcugcuagcugacaaauacaau

SEQ ID NO: 121368 - RNA, 64 nt, Human
cucacuguuggacucuaccucacuggucuggaaguccuccgaagacauuauuuuuccaaaggaa

SEQ ID NO: 121369 - RNA, 64 nt, Human
agguaaauuauuucuacaagggcaacagguaugguccuccgauauuuacauuaagaagaguuaa

SEQ ID NO: 121370 - RNA, 64 nt, Human
gcacugggggcaauugacuuccuccaauccccacuccuccgagacccaggagacaaacagcccu

SEQ ID NO: 121371 - RNA, 64 nt, Human
acaguggauagcucauacuuuauggugguucuucuccuccgaaauaauauacugcagaaauccc

SEQ ID NO: 121372 - RNA, 64 nt, Human
auuuugcacaguaguuuaaaucuuuuguuaaugcuccuccgaaguuuuucaggggguaaaagua

SEQ ID NO: 121373 - RNA, 64 nt, Human
gcaagggcuguagacagcagggugggacagucaguccuccgagcagcaggaaucaucccgucac

SEQ ID NO: 121374 - RNA, 64 nt, Human
cugucuggccaggccucuuggcagucacaucucuuccuccgaggccaguaccuuuccauuuauu

SEQ ID NO: 121375 - RNA, 64 nt, Human
cgugguguggccaccguccguguccucucggccuuccuccgaguccagguggacucuguggaug

SEQ ID NO: 121376 - RNA, 52 nt, Human
uagcgauggaggugacguagcuuccuccgaguggaacugcagccuggggacu

SEQ ID NO: 121377 - RNA, 64 nt, Human
agaguuugagaagcaaggaccuaggcuggggauguccuccgagcagagggugaaguuucucuca

SEQ ID NO: 121378 - RNA, 64 nt, Human
ccuaagucaugcaccaaggacuucagaaaguucuuccuccgagucagucaguggugccgggacc

SEQ ID NO: 121379 - RNA, 64 nt, Human
acucacaggugcuggugcuuggauuuagccaggcuccuccgagcaccucaugcaugucccagcc

SEQ ID NO: 121380 - RNA, 64 nt, Human
aggcagcggauccaggcagcgaugcugagccaccuccuccgagccuuccuuucacacagaccac

SEQ ID NO: 121381 - RNA, 64 nt, Human
gcccaagaguucuugcuguuggcguacuggacccuccuccgaacugccuuacccugcuuauucc

SEQ ID NO: 121382 - RNA, 64 nt, Human
aggaaggggcugugaacccuaagugggugucaucuccuccgaccgaggcuucucacccuggaga

SEQ ID NO: 121383 - RNA, 64 nt, Human
gggcuuggagcuggccccauaagggcuggcggcuuccuccgacgccgccccuccccacagcuuc

SEQ ID NO: 121384 - RNA, 64 nt, Human
gccgucuuuuccgucuccagccccuuaccucuuuuccuccgagggccuuuggaugugcuuguuc

SEQ ID NO: 121385 - RNA, 64 nt, Human
gaggcaagccuuugcaugccgucagucuggaguuuccuccgagucucucauggcaucuccagcu

SEQ ID NO: 121386 - RNA, 64 nt, Human
acaagcaacccagcaucccccgaccccuugacacuccuccgaggccugagccgcaaugccugcc

SEQ ID NO: 121387 - RNA, 64 nt, Human
ugacaaacuguguacauagcggacuccuccuuucuccuccgaggugguuuuaaaggcuuuuugg

SEQ ID NO: 121388 - RNA, 64 nt, Human
acucaacucggaaucggaagacuacuccccaagcuccuccgagacuguucgcuccccuaacucg

SEQ ID NO: 121389 - RNA, 64 nt, Human
aacaauaaugagagcaaaugcaaaaauaaccaaguccuccgaaggcaucucacggaaccguaga

SEQ ID NO: 121390 - RNA, 64 nt, Human
cacucugucaccuuaauagccaaguucuccugguuccuccgaucuuacaggcucauccagguuc

SEQ ID NO: 121391 - RNA, 64 nt, Human
gugacaacugggagagccucagcauauacucuucuccuccgaucucacagccugucaugcugcu

SEQ ID NO: 121392 - RNA, 64 nt, Human
gcccaguacagcugugcggacccccaguggcauguccuccgaguggcagguugggcccccugca

SEQ ID NO: 121393 - RNA, 64 nt, Human
uggugucacagagcccgcgugugcaggagccugcuccuccgagauacguggcguguagguugcu

SEQ ID NO: 121394 - RNA, 64 nt, Human
cugaccacccuauacccugaggaaagggagacuuuccuccgauguuuauuuagcuguugcaaac

SEQ ID NO: 121395 - RNA, 64 nt, Human
aaagcaaaaaagggucccagaucccuuggcccuuuccuccgaggacuucuauccuccccaggcc

SEQ ID NO: 121396 - RNA, 64 nt, Human
gagcaacggccccagcgcgcaacgcucugcgcguuccuccgaaucccgucggcuucucgaccca

SEQ ID NO: 121397 - RNA, 64 nt, Human
auugcacaagaagagccgcugccaaccauccuuguccuccgauugcaaaaugacaccccaguaa

SEQ ID NO: 121398 - RNA, 64 nt, Human
cagccagacggaaaggcggcugcuugccucuccauccuccgaaaaaccccugaggacccccccc

SEQ ID NO: 121399 - RNA, 64 nt, Human
gaauugagaaccugucuucccauuuggugugcuuuccuccgauugaucccaacccuucaccuau

SEQ ID NO: 121400 - RNA, 64 nt, Human
gaacaugaaccuuccgcuccuggcugccacaggguccuccgaugcuggccuuugcgccucuaga

SEQ ID NO: 121401 - RNA, 64 nt, Human
gcagugguuguccccucaaagcugucccacacccuccuccgaggacccuuuguguaucuccucc

SEQ ID NO: 121402 - RNA, 64 nt, Human
ucacagccuccaagucuguggcucuucccuucuguccuccgaggggcuugccuucucucguguc

SEQ ID NO: 121403 - RNA, 64 nt, Human
ggaccccgcccugcgcagcaagcugguccgccuguccuccgacucuuucgcccgccugguggag

SEQ ID NO: 121404 - RNA, 64 nt, Human
cacccuccucggccuccuccucuucucucauccuuccuccgacaccucggcuggggaaaccgag

SEQ ID NO: 121405 - RNA, 64 nt, Human
cccgcuucggcgguuuggauauuuauugaccucguccuccgacucgcugacaggcuacaggacc

SEQ ID NO: 121406 - RNA, 64 nt, Human
ccccucucucccggcuccgcccgcagacucuggcuccuccgacuacacccgggggaaccuaguc

SEQ ID NO: 121407 - RNA, 64 nt, Human
acgaaccccuugccgaucccgaucccugucgggcuccuccgacuccucgggcuggacaccgaaa

SEQ ID NO: 121408 - RNA, 61 nt, Human
aggacaugagccuggacugagccacgcgccguccuccgaggaacugggcgcuugcagugcg

SEQ ID NO: 121409 - RNA, 64 nt, Human
cacugacuuccauuuuaagcuuucuaccuucuuuuccuccgaccguccccuucccucacaugcc

SEQ ID NO: 121410 - RNA, 51 nt, Human
gggccuguggcugccacuagcuccuccgagaauucagacccuuuggggcca

SEQ ID NO: 121411 - RNA, 64 nt, Human
gcccggcggggaggcgcgagguccuucugggggcuccuccgacgccugagggcgcugcuucccc

SEQ ID NO: 121412 - RNA, 64 nt, Human
gcugccugggccccgaagccaagcccuuuccagcuccuccgaugaaggcagccccugcccuggc

SEQ ID NO: 121413 - RNA, 64 nt, Human
cggcuccacuacagacccagccccagguucaauguccuccgaagaaugaagucuuucccuggug

SEQ ID NO: 121414 - RNA, 64 nt, Human
ucucaaacccugagcgggcugccggccuccaaguuccuccgacaagaugaugguacuaauuaug

SEQ ID NO: 121415 - RNA, 64 nt, Human
uucuggcuggucaacuauaugaaaccuuguucauuccuccgaguacuguaauguucacacuugu

SEQ ID NO: 121416 - RNA, 64 nt, Human
ucaguugcucugagacuaugggguacaaguuugauccuccgaaucuggagauguuguagagcug

SEQ ID NO: 121417 - RNA, 64 nt, Human
cgcgugcacacgagugcggcuggacgugccgacacgcggugauguacccaugcuccgugugucu

SEQ ID NO: 121418 - RNA, 64 nt, Human
aaaaagguuucucugacggccccacggcccgagccgcggugagcgucguguugcaugagccugg

SEQ ID NO: 121419 - RNA, 64 nt, Human
gcgcuggcguguccaacauaguggcggugcaugccgcggugacggggcucuccguggaggaagu

SEQ ID NO: 121420 - RNA, 64 nt, Human
guucucugcggcgggccgcguccccgcugagccucgcggugacagccgccuuuggcagcgagcg

SEQ ID NO: 121421 - RNA, 64 nt, Human
cuaccccaugaggccugaggagccgcccgaaggucgcggugaccuggugccuuuuuaaauaaau

SEQ ID NO: 121422 - RNA, 64 nt, Human
gagaaguaggcuaagagaagacaagagggccgggcgcggugacucacgccuauaaucccagcac

SEQ ID NO: 121423 - RNA, 64 nt, Human
uccagcagccaguggguccggaccugcuugaugccgcggugagggacggcgcccacauaggcga

SEQ ID NO: 121424 - RNA, 64 nt, Human
ccgagggcacaggggguuucgcgcugcuccugaccgcggugaggccgcgccgaccaucucugca

SEQ ID NO: 121425 - RNA, 64 nt, Human
gggaggcacccggccggcuggacuaaucugggaucgcggugauuugcagcguggaaaagaaaug

SEQ ID NO: 121426 - RNA, 64 nt, Human
agccaaggaaaauacucaugcaaccagccugagucgcggugaggggacgagagguuguacacac

SEQ ID NO: 121427 - RNA, 64 nt, Human
uggugucugaacccuuggggacgagggccugggccgcggugaggccaccagaggcaggaguggc

SEQ ID NO: 121428 - RNA, 64 nt, Human
acgugcgggacgguuccacacagccccggccuuucgcggugacacaaugguuagggaacgguua

SEQ ID NO: 121429 - RNA, 64 nt, Human
caggaguggcuggggaagaaucuggagauggagccgcggugagggugggcgggaggccucagag

SEQ ID NO: 121430 - RNA, 64 nt, Human
gaauccuauaugauuuguaauuccuauggaaagucgcggugaaugcgugcaugucucaaugucc

SEQ ID NO: 121431 - RNA, 64 nt, Human
gaggcucaaagugcuggugccaggccugaggccucgcggugaccccucucucugguucccagca

SEQ ID NO: 121432 - RNA, 64 nt, Human
gaauggacuguuugcaugcuucgugccacacgcccgcggugaucccagccagggccccgagcgc

SEQ ID NO: 121433 - RNA, 64 nt, Human
gaaggguuugccggcccuaacgcugcagcgcgugcgcggugagaggcccuuuuugagccuguuu

SEQ ID NO: 121434 - RNA, 64 nt, Human
uaggccgcguagaggcaugcaccggguagguuuccgcggugaccccgcggcggccugagggacg

SEQ ID NO: 121435 - RNA, 64 nt, Human
caaccaaaucuuauuaaacucacccuaggcuggccgcggugacucaugccuauaaucccccagc

SEQ ID NO: 121436 - RNA, 64 nt, Human
acagaaguggggcggccugaacccugcuuccagccauggccaggggccacggaacccggcaggg

SEQ ID NO: 121437 - RNA, 64 nt, Human
uggacagggaugcgacggggcagcuggcuguguccauggccagguggccagggucagggcugca

SEQ ID NO: 121438 - RNA, 64 nt, Human
guuugcugagugucuugacuaccgugacaccacgcauggccagagcuagcgucccuacugccuc

SEQ ID NO: 121439 - RNA, 64 nt, Human
caaguugcccagaaagacugucugggugagaagccauggccagagcuucucccaggcacaggug

SEQ ID NO: 121440 - RNA, 64 nt, Human
ugggccccaaacgggcugcccugccacuuugguacauggccagugugaucccaagugccagucu

SEQ ID NO: 121441 - RNA, 64 nt, Human
aagacuuggagacucagcgaugucaggccagggccauggccacacuggcccacacauuccuuuc

SEQ ID NO: 121442 - RNA, 64 nt, Human
cucccaggaggagggauucccugacuuugacacacauggccaccuuggcacaaaagccuugugg

SEQ ID NO: 121443 - RNA, 64 nt, Human
caccaggguucuuguuuggacccugccccugggccauggccaggugaccauggcuacauugcca

SEQ ID NO: 121444 - RNA, 64 nt, Human
ugaucuaagcaguggcaucugagugggcccagcacauggccauagaggcccaggcaccaccagg

SEQ ID NO: 121445 - RNA, 64 nt, Human
uggucuaaccaguuacguaugucuggcuugauuacauggccagagcaacauaaaagcccugcug

SEQ ID NO: 121446 - RNA, 64 nt, Human
uggccauguguacugacuugaggagaucuugcaacauggccaugugcaaggcuuuaaggaguga

SEQ ID NO: 121447 - RNA, 64 nt, Human
gguuccuuucaccuauguaaccgcaucccucaggcauggccaggaggccgacuucauccuccuu

SEQ ID NO: 121448 - RNA, 64 nt, Human
uaucaccuucccccaagauuaccugaacaggguccauggccacucaaccugucagcuugcacca

SEQ ID NO: 121449 - RNA, 64 nt, Human
caugugccaacaauagcccugcacagggcaucaacauggccaacagcauugccaaccugagacu

SEQ ID NO: 121450 - RNA, 64 nt, Human
cucaggucaacugaccugaccccauuccugaucccauggccaggugguugucuuauugcaccau

SEQ ID NO: 121451 - RNA, 64 nt, Human
cccaggcagcucaagcugaauaaauagcugcagacauggccaacaacauggggcucaggucugu

SEQ ID NO: 121452 - RNA, 64 nt, Human
gacaauauccauuugcaaacacaagaacuauacacauggccaggcgcgguggcucacacccgua

SEQ ID NO: 121453 - RNA, 64 nt, Human
aaauauauggacuaaacguagcccugugcuguaucauggccauaguauauuguaaccuuugucu

SEQ ID NO: 121454 - RNA, 64 nt, Human
gcugcccaagacucuuguugccuuucuuccaagccauggccaugcccuuuuucucaaaugggag

SEQ ID NO: 121455 - RNA, 64 nt, Human
gcugaacccacccggcccauaucccugguugccucauggccagcgccccucagccucugccacu

SEQ ID NO: 121456 - RNA, 64 nt, Human
ccauggaacuuacuuguucaccuggcuaagaacucauggccacuguggaaaucuugguuaggga

SEQ ID NO: 121457 - RNA, 51 nt, Human
ucucuuuccugaaagaauaaucauggccauccccacucccuuuguauuucc

SEQ ID NO: 121458 - RNA, 64 nt, Human
aucaccccggacgggcguccaggacccugagggccauggccaaaaggcuccugagugugccugg

SEQ ID NO: 121459 - RNA, 64 nt, Human
cucaagccugaccacaagagacaugauggaguuucauggccaugaauggugcccuuauuagcaa

SEQ ID NO: 121460 - RNA, 64 nt, Human
cacugacuucaggauagaugcugggaugccugggcauggccacauguuacauguacagaacuuu

SEQ ID NO: 121461 - RNA, 64 nt, Human
ucaggcucugguuugagaucgugcuggggaggaacauggccacuaccccuuaucccaucggcca

SEQ ID NO: 121462 - RNA, 64 nt, Human
ccccaccucucccaccaagaggccaccugucacucauggccaggagagugacaccauggagggu

SEQ ID NO: 121463 - RNA, 64 nt, Human
ggaccgaggacaggggccggacauuggggcauuacauggccaggugagcugucccccgacaucc

SEQ ID NO: 121464 - RNA, 64 nt, Human
uccagcccagcccugaccucaggaagugucagagcauggccaguaguuggcagcccgaaagaca

SEQ ID NO: 121465 - RNA, 64 nt, Human
accaacuucucucccaucucuagguggcucaguccauggccacucccugcccccagccuggcug

SEQ ID NO: 121466 - RNA, 64 nt, Human
gcuggugaggggcagggucccuggccagaaggggcauggccaccucccaaccugaugaccucuc

SEQ ID NO: 121467 - RNA, 64 nt, Human
cuauauucacaauuauauccagagcauaauuuuccauggccauaguuugagccacagagaaagc

SEQ ID NO: 121468 - RNA, 64 nt, Human
aaagcuaucaauguccaagugaagugagaugaugcauggccacauuauugcuuugacccucaca

SEQ ID NO: 121469 - RNA, 64 nt, Human
ccucuguguccagauguuugacugguuugacuaccauggccacauguguaucuccuuugagcuu

SEQ ID NO: 121470 - RNA, 64 nt, Human
cugcuuuuugaaaaccugcagugaaaccuauugacauggccacgcuguggaaugaugugaauug

SEQ ID NO: 121471 - RNA, 64 nt, Human
ccuuccagguauuugugauuuugucacagccugacauggccagguucucacacuggcccagaga

SEQ ID NO: 121472 - RNA, 64 nt, Human
gcuugguucuccccucccuucccuggccggcugccauggccaggagcuaagugccuuuuugugu

SEQ ID NO: 121473 - RNA, 64 nt, Human
gugugggcuugcaaauacaagcuuggaggugagacauggccagacaugacuccugcuuccccuu

SEQ ID NO: 121474 - RNA, 64 nt, Human
gcaaagauaugugggugcuccucuucugccucgucauggccagcugccaguacucccugcuaaa

SEQ ID NO: 121475 - RNA, 64 nt, Human
cauucucuucuguggucucuccccuggcuugcuucauggccacugaaccaaucacuuuguaugc

SEQ ID NO: 121476 - RNA, 64 nt, Human
aaaauuguagaugcuugcuuuuuguuuuuucaaucauggccauauuaugaaaauacuaacagga

SEQ ID NO: 121477 - RNA, 64 nt, Human
gaaaggaauugagcuggccuaucuagagcagcugcauggccaacacgaagccuggcuuauucac

SEQ ID NO: 121478 - RNA, 64 nt, Human
ugagaaugucaucuaggacacguccaaaggagugcauggccacagccaccuccacccccaagaa

SEQ ID NO: 121479 - RNA, 64 nt, Human
ucuaccccaagcccaaagccugcugggugucccccauggccaaggucccagccgagagccccac

SEQ ID NO: 121480 - RNA, 64 nt, Human
aauucccuugauccagcccaagagaccaggcagccauggccacugccuuccucucugaugaacc

SEQ ID NO: 121481 - RNA, 64 nt, Human
gacagauccagggccuuucaaacauccccaaagucauggccauacucaccauuagccaguuucu

SEQ ID NO: 121482 - RNA, 64 nt, Human
auccaugaagugcucucguucucaguagcggcaucauggccaguagugucuuugaggaguucac

SEQ ID NO: 121483 - RNA, 64 nt, Human
gcuaucgagagguuuuucaaguaucuuugaguuucauggccaaaguguuaacuaguuuuacuac

SEQ ID NO: 121484 - RNA, 64 nt, Human
cuuuucauauuucuuuugacuuagaguauuaauacauggccaaaauaauuuaguuacuaccuca

SEQ ID NO: 121485 - RNA, 64 nt, Human
ugguaccuuuaccuccuccucugggaguuggcugcauggccagcacugccgacuugaugggagc

SEQ ID NO: 121486 - RNA, 64 nt, Human
ucccggagcaacuuucccaacuacccaaccccaccauggccaggacaugugcaaugccagcccc

SEQ ID NO: 121487 - RNA, 64 nt, Human
cgucacaucuuuaacccacuaacuggcuaauuagcauggccacaucugagccccgaaucugaca

SEQ ID NO: 121488 - RNA, 64 nt, Human
gcaccugaccccacccuguccccgugggccguggcauggccacaccccaccccacuucuccccc

SEQ ID NO: 121489 - RNA, 64 nt, Human
acacuccucuccuugccugcaggcugcccucucccauggccacccuagacagagacccacccgu

SEQ ID NO: 121490 - RNA, 64 nt, Human
cuuggcuggccagagggucucugagggcaagagacauggccaaccaagggcaaggagugacccu

SEQ ID NO: 121491 - RNA, 64 nt, Human
ugggggcuguggggaagacacccccugccugggccauggccagcucuagguggauucugauuca

SEQ ID NO: 121492 - RNA, 64 nt, Human
cacacggguguaucgccugggccccaggcuucuccauggccacauggguccuggguguaugugu

SEQ ID NO: 121493 - RNA, 64 nt, Human
accucugggucuguucugaccauucccuagucuccauggccaagcacucaaggauugauggaca

SEQ ID NO: 121494 - RNA, 64 nt, Human
acagaggcuguggucagagagggaagcugaggcccauggccacauccucauggcccaucagggg

SEQ ID NO: 121495 - RNA, 64 nt, Human
guggccuccaccccagcucuggucugugcagacucauggccaccaggaggccugcagauccagc

SEQ ID NO: 121496 - RNA, 64 nt, Human
agccuaugccuaucuuucaaauugguguggauuucauggccauaguacuuuaccuguugaacuc

SEQ ID NO: 121497 - RNA, 64 nt, Human
acaagucucccugagaagccugccuagucccuuucauggccaaugagacuccaaaauucccuuc

SEQ ID NO: 121498 - RNA, 64 nt, Human
auauaggcucgcaggcccaauacuugcacacauucauggccaucacacacgcggcaaaagugga

SEQ ID NO: 121499 - RNA, 64 nt, Human
uguuucauccauggggaaguuccaagaagcccagcauggccaucagugaggacuucaggguaga

SEQ ID NO: 121500 - RNA, 64 nt, Human
uauguaauuugucuagucuuaaagacauuuggagcauggccaacaggaaggucagcuucuuacu

SEQ ID NO: 121501 - RNA, 64 nt, Human
gggcuacccucagggagauccagagacucaugcccauggccauccaugcguggacgcugugugg

SEQ ID NO: 121502 - RNA, 64 nt, Human
cguaccaguauguggucugaaggaccccgaccggcauggccacucagacacaaguccacaccac

SEQ ID NO: 121503 - RNA, 64 nt, Human
acacagaagcuuccacugucagcucucaagagcccauggccaggaaggcccaugcugagcuuuc

SEQ ID NO: 121504 - RNA, 64 nt, Human
caucaucagaaagaagguggccuaaaaacugacacauggccagugcccggaggggucuggaggc

SEQ ID NO: 121505 - RNA, 64 nt, Human
caccaaaucaaugaguuuaugcuagaauuuuucacauggccacuggaccauuguggaaguagac

SEQ ID NO: 121506 - RNA, 64 nt, Human
gccucugaaaagguagcucugacucuugucuuuccauggccagagugggucgucaaccucgugu

SEQ ID NO: 121507 - RNA, 64 nt, Human
cuccccauguccucuggaacagcugggcaugggucauggccauucaugacccuuaagugccacc

SEQ ID NO: 121508 - RNA, 64 nt, Human
ccugacccauguacugcuauagucccacuugaaccauggccaguccacuacagccaaaucuaaa

SEQ ID NO: 121509 - RNA, 64 nt, Human
gcccagaguugcaguuguaacuguugccaggacacauggccauaaauaauagaaagaaagcuac

SEQ ID NO: 121510 - RNA, 64 nt, Human
aagaaacucuugaauacugccugcauccgggcaccauggccagguugccuaggaguggggucca

SEQ ID NO: 121511 - RNA, 64 nt, Human
guucccaggcccuccugaggucugugucacgggccauggccacucauauuuggcucagaauaaa

SEQ ID NO: 121512 - RNA, 64 nt, Human
cuuagaaacauaauaagcuaaaaucccauucacacauggccaggcuauccaaaaagaaaggagc

SEQ ID NO: 121513 - RNA, 64 nt, Human
guguaacugaguauuagauuucggauggagucaucauggccaauuauaggaccuaauugcucuc

SEQ ID NO: 121514 - RNA, 64 nt, Human
ccucugggugggguggccuccccgcacucggcagcauggccaggcuggccagggcgugggcagg

SEQ ID NO: 121515 - RNA, 64 nt, Human
uuacagugaggagaucacaguguguggagacuuacauggccaauuggaugacuuaaucuuuaua

SEQ ID NO: 121516 - RNA, 64 nt, Human
uuuccaaaaucuaaaagcuguagcuggagaagcccauggccacgaggaagcagcaauuaauuag

SEQ ID NO: 121517 - RNA, 64 nt, Human
gaauguuuagaagaaacacuucaaagggauacaucauggccaggcaugguggcucacaccugua

SEQ ID NO: 121518 - RNA, 64 nt, Human
gauugaggcuguugaccugggcaguagcuccucccauggccaguggucagugggagggugugcc

SEQ ID NO: 121519 - RNA, 64 nt, Human
uggucagugggagggugugcccugcgccugucugcauggccacugggcauguguguugggagca

SEQ ID NO: 121520 - RNA, 64 nt, Human
ccaggugcuggccagaugccuugaucacagccuccauggccaggggccugucaagccaggggcc

SEQ ID NO: 121521 - RNA, 64 nt, Human
cuuacacauuuuauccccucagaacacgauaaaccauggccaauucaguuucacuuuggggcca

SEQ ID NO: 121522 - RNA, 64 nt, Human
aaucuugucugcaguuugguauugauaauauuagcauggccacuuaugcuaaauacacaauaag

SEQ ID NO: 121523 - RNA, 64 nt, Human
uccaggagccccgugaacccagaccacccagugccauggccacuuagggcugggaacccgaacc

SEQ ID NO: 121524 - RNA, 64 nt, Human
gcacaaccucucugugccaugaagauaagucuuccauggccaaaucggucauccgcacugcccu

SEQ ID NO: 121525 - RNA, 64 nt, Human
ucugaggaaagcuguccugucucuggacauuuggcauggccagacucugaccccacugcccuag

SEQ ID NO: 121526 - RNA, 64 nt, Human
cuucugccaagaaaugguuaucagcaccagccgccauggccaagccugauuguuccagcuccag

SEQ ID NO: 121527 - RNA, 64 nt, Human
ggcucucaggagugugaccagaguagacuuggggcauggccauuggggucauauguuuauuuuu

SEQ ID NO: 121528 - RNA, 64 nt, Human
cuuuccuugagcucucuggacacugcagaggacccauggccauggaacccugaagaagcauguc

SEQ ID NO: 121529 - RNA, 64 nt, Human
agacgccacugucccgcuaggugccugcuaggugcauggccacagagcaugggcugggccuggg

SEQ ID NO: 121530 - RNA, 64 nt, Human
augaccacauagcaugaggccacugcugcuucuccauggccaccuuuucagcgauguaugcagc

SEQ ID NO: 121531 - RNA, 64 nt, Human
gugcagauggugauaggaccagugggucccacagcauggccacacugcaccuccuucgcuguca

SEQ ID NO: 121532 - RNA, 64 nt, Human
ggaugcccuguggcagggucuggagcugcuacagcauggccaggccugguuugaagaccaucug

SEQ ID NO: 121533 - RNA, 51 nt, Human
ugaauuuuuuaccccucuagccauggccacugagcccucugcugcccugcc

SEQ ID NO: 121534 - RNA, 64 nt, Human
ucuggggcacaugguuugagcucuggacuucccacauggccagcuuucuugucuauacagaucc

SEQ ID NO: 121535 - RNA, 64 nt, Human
gggucccacaccaugcuggaggaagugccaucugcauggccacucuugcccccaagggcccagg

SEQ ID NO: 121536 - RNA, 58 nt, Human
ucggggaggggugcuccugaaggccaggcauggccaccacgugacgcuguucuuaguu

SEQ ID NO: 121537 - RNA, 64 nt, Human
uccacagccuggaguaccuuucaaggucaaagugcauggccagcuccauugagacauuccauuu

SEQ ID NO: 121538 - RNA, 64 nt, Human
aguuuugaauaaguaaccaucaaaguuacuaaaacauggccaggcgcaguggcucaugccugua

SEQ ID NO: 121539 - RNA, 64 nt, Human
gccacggcacacugcuuggcuuggguggcggguucauggccaguuggugucaucagcaaagaga

SEQ ID NO: 121540 - RNA, 64 nt, Human
ugugcccaucccucaaccuccucagugaucaacucauggccaaucuuguuuccuauucuucaac

SEQ ID NO: 121541 - RNA, 64 nt, Human
uuaagugcauccuaucaaggggcagcuccguccccauggccauuggaucaugagacacucugaa

SEQ ID NO: 121542 - RNA, 64 nt, Human
aaaacggcugucagguuugaucucaguguaacaacauggccagugccuguuccccacucccuug

SEQ ID NO: 121543 - RNA, 64 nt, Human
cccagcugacaagcguggggcuggugggcuggggcauggccacgccagggagucugucaccugg

SEQ ID NO: 121544 - RNA, 64 nt, Human
cacagucaaucaaacuuacauuccugccaagaugcauggccaaaaaacuaaguaucaaagcagc

SEQ ID NO: 121545 - RNA, 64 nt, Human
cuuuguugcaaguggcagaaaguaagguuaugugcauggccauguguuuguaggugcauguguu

SEQ ID NO: 121546 - RNA, 58 nt, Human
augcuccaggcacagucugacccaaagccauggccaccacccucagucccugcagccu

SEQ ID NO: 121547 - RNA, 64 nt, Human
uguggaaagcccuccucagugaggauagcuacaccauggccauggcgcaucagauagucucugu

SEQ ID NO: 121548 - RNA, 64 nt, Human
acaccuacuggggcaucuggcuggugccugcugccauggccagcccccacucucacccugcaca

SEQ ID NO: 121549 - RNA, 64 nt, Human
agggagaggaggggcugggggugaggggccaggccauggccaaggggccagcugccccucauuu

SEQ ID NO: 121550 - RNA, 64 nt, Human
ucucaggggggcccugugacccccucuccacaaccauggccagcaucggcuucuugcugcaccu

SEQ ID NO: 121551 - RNA, 64 nt, Human
ucccacuucacucucucugucucuccugcuccaacauggccagacgugccugcuuccccuucgc

SEQ ID NO: 121552 - RNA, 64 nt, Human
uggcccuuccccgggugaggccguuuggaauuaacauggccaguguuucacacaagauuggguu

SEQ ID NO: 121553 - RNA, 64 nt, Human
cccuauccuacuugcccauaugagcacggcuccccauggccacauacuccugcaaagcuuuuau

SEQ ID NO: 121554 - RNA, 64 nt, Human
agagcuggguguugcauccugggcgccacaugcucauggccagaaucuuaaaccuauuugguag

SEQ ID NO: 121555 - RNA, 64 nt, Human
uggggcugcuccguccggaaccuagaagaggcuucauggccagggcuauggauucuuugcucug

SEQ ID NO: 121556 - RNA, 64 nt, Human
gaaaugacaagcugguugaagcugguaaucaaugcauggccauauuuauucauuuuccacacac

SEQ ID NO: 121557 - RNA, 64 nt, Human
gaaaaaaaugaaaaagaauaagucacauugguuccauggccacaaaccauucagaucagccacu

SEQ ID NO: 121558 - RNA, 64 nt, Human
agaaauauuauuugcuaauuaaaaaguuaaucuucauggccauagcuuuuauucauuagcugug

SEQ ID NO: 121559 - RNA, 64 nt, Human
agugaaaagcaaccaaaggcaacagagucuagcucauggccaccagaccaaaagcauccagcuu

SEQ ID NO: 121560 - RNA, 64 nt, Human
cacccugugcccuggcgccgcugcaacagccccucauggccaggagccccccauggccuggggc

SEQ ID NO: 121561 - RNA, 64 nt, Human
gcauuccuagguuucaucauuuuuggcuccuuagcauggccacuuacaauuuuuuaacaugaga

SEQ ID NO: 121562 - RNA, 64 nt, Human
gaagggccugggcuugaaugugacucuguugagacauggccagcaauucuggcacuuggcuguc

SEQ ID NO: 121563 - RNA, 64 nt, Human
cagucuggggcaugguuugugugcuggacuuucucauggccaucaucaguaugcuuauggauuu

SEQ ID NO: 121564 - RNA, 64 nt, Human
auuccgauggaauuucaguucaucagauguucaccauggccaccgcagaacaccgaaguaauuc

SEQ ID NO: 121565 - RNA, 64 nt, Human
ugagaaucugugcagucaucaacaaaagggagaacauggccaauagucauaugugaagacagag

SEQ ID NO: 121566 - RNA, 64 nt, Human
ggagcccacuuaccguguggccagccgcgagacccauggccacgcaccuucucucaggccuucg

SEQ ID NO: 121567 - RNA, 64 nt, Human
aagcaauuuuguaauuucagagaguguuuugagccauggccacguugucauugugagucuauag

SEQ ID NO: 121568 - RNA, 64 nt, Human
uuuccauuaccacagauguaagaaagugauaagccauggccaugagcugcccugagcuuugguc

SEQ ID NO: 121569 - RNA, 64 nt, Human
agaacgauguugaccuguuaaguauucucugaaacauggccaaaaugcauuuuaugagcuuuuu

SEQ ID NO: 121570 - RNA, 64 nt, Human
cagugguucuguaccaaaacuugccaaauuccuccauggccaaguguuaaaaucuguguuugga

SEQ ID NO: 121571 - RNA, 64 nt, Human
uauuuacuaauguuccauuggacaaagcaaaucacauggccaagucuagagucagaaugagggg

SEQ ID NO: 121572 - RNA, 64 nt, Human
ucugagaaaucacauucacaaauuagaagucaaacauggccaggcacaguggcucacaccugua

SEQ ID NO: 121573 - RNA, 64 nt, Human
gccuagccgcuguucuagggaacggaaaagaguucauggccaagcgucuaaccuaaagucccag

SEQ ID NO: 121574 - RNA, 64 nt, Human
uaucuauaaauacucauauauauacacaccuacacauggccaaccgccucgccucuagcgcugg

SEQ ID NO: 121575 - RNA, 64 nt, Human
ugcagauccugucagaccuggccaccaccuugggcauggccacucugcccucuggaccugucuu

SEQ ID NO: 121576 - RNA, 64 nt, Human
gcugugccuuagggcccuucucauagcuguuccucauggccaugacuggaacagggaugcaacc

SEQ ID NO: 121577 - RNA, 64 nt, Human
uaauauaucguaggaaaacauuaaagagcagaugcauggccauuuuucuuugauguucuccaga

SEQ ID NO: 121578 - RNA, 64 nt, Human
gccaccugccuggcuucacccuccaaggccuccccauggccacagugggcccacaccacacccu

SEQ ID NO: 121579 - RNA, 64 nt, Human
ggguauagguuaaauggaagaagaaacagaacuucauggccaaaguagaccuauagauuuugau

SEQ ID NO: 121580 - RNA, 64 nt, Human
ucugggcccaggcugugaguuccaggucugugcucauggccaccaggcccuacugcucagggug

SEQ ID NO: 121581 - RNA, 64 nt, Human
ugugcuggcagcuuuaccuuugucauuucauccucauggccacccuggagguggcauuguguaa

SEQ ID NO: 121582 - RNA, 64 nt, Human
ucauugggguugcaacaauaauucaucaaguaaucauggccagcgauuauugaucaaaaucaaa

SEQ ID NO: 121583 - RNA, 64 nt, Human
aagaugcuuaccugcaggaacugaaaacaucagccauggccaggcccccagaagacaaaagaag

SEQ ID NO: 121584 - RNA, 64 nt, Human
uggcuucaucaagcuccuugcgggguuggggcugcauggccaggguggcaggaagacauccccc

SEQ ID NO: 121585 - RNA, 64 nt, Human
ucaaccaacaucauuaugaaauuaauuagauucccauggccauaaaauggcuuuaaagaauaua

SEQ ID NO: 121586 - RNA, 64 nt, Human
ggcaggagggaagagcuguccaugcagccacgcccauggccagguuggccucuucucagccucc

SEQ ID NO: 121587 - RNA, 64 nt, Human
cccucguuaccuccaguucgacucagaaccuugacauggccauaacagaaggaggugccucuga

SEQ ID NO: 121588 - RNA, 64 nt, Human
gccaggacagucgcaaucuuuguuuuaaguuucacauggccauggagaaugugcccaagaagaa

SEQ ID NO: 121589 - RNA, 64 nt, Human
cagcauggcacucccuccagcacaaacacaaggucauggccacacugugacacacuacaccaca

SEQ ID NO: 121590 - RNA, 64 nt, Human
ccacucuccuuggcacccugacaccgggaggccucauggccaacaauggacaccuccagagccu

SEQ ID NO: 121591 - RNA, 64 nt, Human
aucaaauucuacaugacacaggacaugucacucccauggccagaaagccuaaauugggaaacag

SEQ ID NO: 121592 - RNA, 64 nt, Human
uuauuuauuuaaaauuuagauuuauuagagggagcauggccauaaaauaaaauaaaauaaaauu

SEQ ID NO: 121593 - RNA, 64 nt, Human
aguagcgcuuagcccuuacccaggaaauauccuucauggccacagaaauggagggcgcccagga

SEQ ID NO: 121594 - RNA, 64 nt, Human
gaacauggugauggaggguugcaucagcuccacccauggccaacagcccuuguugagugacggg

SEQ ID NO: 121595 - RNA, 64 nt, Human
aaauuuacucugagcucccaguuccaucuucauccauggccacaggcccugccuacaacgcacu

SEQ ID NO: 121596 - RNA, 64 nt, Human
ugcuaaggucuuggaacuugccugccuuuccauccauggccagcagcaccugcccuaccugccc

SEQ ID NO: 121597 - RNA, 64 nt, Human
caggucccucucauuuagccuguccugucaucaucauggccagcuggaggcaggggcuuccugg

SEQ ID NO: 121598 - RNA, 64 nt, Human
gcuuuccuuuuuacaggacucccggaaggccacucauggccaugccaggagcuuucucagaaac

SEQ ID NO: 121599 - RNA, 64 nt, Human
gaagcaagaagggugcaugccaguccuucuccgacauggccaggggguaccaggccuugugcgc

SEQ ID NO: 121600 - RNA, 64 nt, Human
ccauuaggugauuuugcauaggggccauaucauucauggccaaaaaaaaccaaaaagcaaaaaa

SEQ ID NO: 121601 - RNA, 64 nt, Human
ggccagggcaguuguugggugaauguggagagcacauggccaugucuugcccccggaguaccac

SEQ ID NO: 121602 - RNA, 64 nt, Human
ugucccuggugauguuggaacauuaaugauggaacauggccaaacuucagucaugauccugaag

SEQ ID NO: 121603 - RNA, 64 nt, Human
accaaagugcuuuuuccuucaggaaguggagaugcauggccaucucccccucccuuuuuccuuc

SEQ ID NO: 121604 - RNA, 64 nt, Human
agcaaacucccagggaagaaaacggcccugucuccauggccagguucuugugguguccagugcg

SEQ ID NO: 121605 - RNA, 64 nt, Human
gcucuggucucgccugguggugaguuuugccagccauggccaggguuuggcuccacugguggca

SEQ ID NO: 121606 - RNA, 64 nt, Human
cccuuuagugcuuugccugaaagagacacagucacauggccagaugagaacuugcgauacuagc

SEQ ID NO: 121607 - RNA, 64 nt, Human
acaaccugcagucccuguccucagacagugccaccauggccaugcagcaggcuaugauggcugc

SEQ ID NO: 121608 - RNA, 64 nt, Human
caagaucugauuucuggcuuugcaggacucuuaccauggccaggcauuccugcccagccuuuac

SEQ ID NO: 121609 - RNA, 64 nt, Human
agcagagcugggauguggugcaugccuuuguguacauggccacaguacagucugguccuuuucc

SEQ ID NO: 121610 - RNA, 64 nt, Human
uggccuucucagccuacagcaguguggucucuuacauggccacaaagggacacacagugacaaa

SEQ ID NO: 121611 - RNA, 64 nt, Human
cgaguagaagccacagucauugaaaagacagaaucauggccaagaaucauuaugagauucagga

SEQ ID NO: 121612 - RNA, 64 nt, Human
uaggaagagagaucauggguuugaccucugcccacauggccauggagucagccucagcccuguc

SEQ ID NO: 121613 - RNA, 64 nt, Human
cugccagcugugaggggaccccguuuuuaagaugcauggccaagcucucugcaaauggaaaugc

SEQ ID NO: 121614 - RNA, 64 nt, Human
uccugaauuugcacagaggaaagcgggugcccggcauggccauccugauguugcuggcgggauc

SEQ ID NO: 121615 - RNA, 64 nt, Human
uguggacucgcuuucccaggcaggggcugagccacauggccaucugcuccucccugcccccgug

SEQ ID NO: 121616 - RNA, 64 nt, Human
ggccccugacucaccccggucaccucccaggguccauggccagggccucuguguuuggggggcc

SEQ ID NO: 121617 - RNA, 64 nt, Human
uccauuccccuggacccagggacaugcagcccuacauggccacccacuguuugcagugucucug

SEQ ID NO: 121618 - RNA, 64 nt, Human
guggagauaccgccccagcgggggcugcgacauccauggccaccauggggcaccuggcggggcg

SEQ ID NO: 121619 - RNA, 64 nt, Human
auuuugugccuuaaagauuaacuacaaagauaaacauggccaaaaauaaauaaauaaauauggc

SEQ ID NO: 121620 - RNA, 64 nt, Human
uagcaucagauuauaccucauuauuaaaaggaggcauggccacacaugaagaaauggucauucu

SEQ ID NO: 121621 - RNA, 64 nt, Human
acugcucacucucuggucucaauuuaaaaugauccauggccacagggcuccugcccaggggcuu

SEQ ID NO: 121622 - RNA, 64 nt, Human
cacugugcccaucccucagccucuggauucucuucauggccagguggcugccagggagcgggga

SEQ ID NO: 121623 - RNA, 64 nt, Human
gaagaaaggggcuguagaccccuauuccccaccccauggccacagggcaucuggcaauaagacu

SEQ ID NO: 121624 - RNA, 64 nt, Human
uccacgggaccaucugcugaacauuccccagugccauggccaguugccaggccccagcgccagc

SEQ ID NO: 121625 - RNA, 64 nt, Human
cccaguuugaauugcaguuuuuuuuuuucugacacauggccaggcuguggugccagcuuaaugg

SEQ ID NO: 121626 - RNA, 64 nt, Human
uuucuuccgugcagagcaaaaucacucaggaucucauggccaaagucagagcgaugcuugcagc

SEQ ID NO: 121627 - RNA, 64 nt, Human
ucauucacaaguauuccagacaccaggcuucaggcauggccaugagcaagaccagcaaauaaca

SEQ ID NO: 121628 - RNA, 64 nt, Human
acaacucaaauguguaaagaaggaagagcaagaacauggccacacccaccgccccacacgagaa

SEQ ID NO: 121629 - RNA, 64 nt, Human
uccuguucuuccuacauaaaaugcaagaaaacagcauggccaguaaacugagcaagggccuugg

SEQ ID NO: 121630 - RNA, 64 nt, Human
aggugaaccacaccauccugcaguacuaucgcugcauggccagcgagcuuguccgugucaacau

SEQ ID NO: 121631 - RNA, 64 nt, Human
aacuucuacaggaucagagaggaucuugcucauucauggccauauccacaugcccauggccacu

SEQ ID NO: 121632 - RNA, 64 nt, Human
ggaucuugcucauucauggccauauccacaugcccauggccacucaguagauuguugaaaaagc

SEQ ID NO: 121633 - RNA, 64 nt, Human
ggagagggcucacagagucuccucuguacguggccauggccagacaccccagucccuucaccac

SEQ ID NO: 121634 - RNA, 61 nt, Human
acgaccucucggugcucugagccgcggucgccauggccacugcggucgccauggucaccgc

SEQ ID NO: 121635 - RNA, 64 nt, Human
cccgggaccuuuagccaagaggagcugcagggaccauggccagguuaccaaaaugcccugcucu

SEQ ID NO: 121636 - RNA, 64 nt, Human
auagggaugggacaggggcaaugacagccucuaacauggccacuucucagcacguccaagaagu

SEQ ID NO: 121637 - RNA, 64 nt, Human
ggaagcucugcucaggccuccagcguuggcuggccauggccacagccagauggaggagcccauc

SEQ ID NO: 121638 - RNA, 64 nt, Human
uugguuuauucccucauguuuuacucaaaauaaacauggccaugaacucaggggccauugggau

SEQ ID NO: 121639 - RNA, 64 nt, Human
gguucacauuuuggaaaucagagauuacagauuacauggccauagcuuaucuguguuaaaacaa

SEQ ID NO: 121640 - RNA, 64 nt, Human
ucccagccagcacccuacucacccuguccagccccauggccacccccaccccugccucgccccc

SEQ ID NO: 121641 - RNA, 64 nt, Human
cucccaggaggagggauuuccugacuuugacacacauggccaccuuggcacaaaagccuugugg

SEQ ID NO: 121642 - RNA, 64 nt, Human
ggcagcacgucuuccucaugagccgagccagguccauggccaccacguggcuggccccuuccuc

SEQ ID NO: 121643 - RNA, 64 nt, Human
accaaggaaaaauaaguaaaauuuccaacccuugcauggccagucacuuacuuaauuccugucc

SEQ ID NO: 121644 - RNA, 64 nt, Human
auauauauucucagcugcugcgggagguagguaccauggccauucagcacagccuugauuuccu

SEQ ID NO: 121645 - RNA, 64 nt, Human
ccaaacccauauuucacuggugguuggagaaaaccauggccaaaacgauuguggcaggucucaa

SEQ ID NO: 121646 - RNA, 64 nt, Human
ccagugucugugcacaucccugucuguuggucuccauggccacuguggaccgggacccuugggg

SEQ ID NO: 121647 - RNA, 64 nt, Human
cugggccucaggcugccuguccauaaaauggggacauggccagcugacggacaacugagucucc

SEQ ID NO: 121648 - RNA, 64 nt, Human
gucccaggaagagggauucccugacuuugauacacauggccaccuugguauaaaagccuugugg

SEQ ID NO: 121649 - RNA, 64 nt, Human
ccugcaggccaugaagagccacucagaaaaggcccauggccauggagcuucaaggaaagaaacc

SEQ ID NO: 121650 - RNA, 64 nt, Human
gguuauccuguuugaagaaaaaggacaaauaaaacauggccagcaaauacagcuccuguuucac

SEQ ID NO: 121651 - RNA, 64 nt, Human
aaaagaaaacauauauuuuauguaaaaacacauacauggccaaaugcaauacugaagagacaau

SEQ ID NO: 121652 - RNA, 64 nt, Human
ggucauacacagggcuggaccucacgcagacuggcauggccauggguccagaggauacuacugg

SEQ ID NO: 121653 - RNA, 64 nt, Human
uuccagaugguuccauggaguucugaucuuugggcauggccaggggaagcagaagggagacucu

SEQ ID NO: 121654 - RNA, 64 nt, Human
cuggccagcgccucuguguagggcuggcuccaggcauggccaccugccuuccccuggucagccu

SEQ ID NO: 121655 - RNA, 64 nt, Human
cucccgaguagcugggacuauaggcaugcgccaccauggccagcuaauuuuuguauuuuuagua

SEQ ID NO: 121656 - RNA, 64 nt, Human
cucggaagucuggucgcaguggcaaagccagcaccauggccagcagagcggugagcagcacucc

SEQ ID NO: 121657 - RNA, 64 nt, Human
ugcagaauggcaggaaggacucgcuagagauugucauggccagagaucauaggucacuucaggu

SEQ ID NO: 121658 - RNA, 64 nt, Human
ugaugcacauauuucaccacgguaucauguacuucauggccaguguuuuaucucagcagggaac

SEQ ID NO: 121659 - RNA, 64 nt, Human
ucaaauauauccacauucuuuaucagcaagcauucauggccauucagaagaaauaaauuaggua

SEQ ID NO: 121660 - RNA, 64 nt, Human
ggauccucugcugggugccuccuugccuugggaccauggccaccccagagccauccgaucgaug

SEQ ID NO: 121661 - RNA, 64 nt, Human
uaugcuuucuuggauauaaccaugaucagagugccauggccacuaccccacuguuugcucuccu

SEQ ID NO: 121662 - RNA, 64 nt, Human
ccaccuucuaguucaggacuccuguucuucccagcauggccacuauuuugaugauggcugaugu

SEQ ID NO: 121663 - RNA, 64 nt, Human
gccuccuagcugcccuggaaguggcuucagcugccauggccaagguuugugccagugggagggg

SEQ ID NO: 121664 - RNA, 64 nt, Human
gaugccuuucaagccucacugggccucucugggacauggccaccugaccuguguguggcuggug

SEQ ID NO: 121665 - RNA, 64 nt, Human
agcgccugauggcagcuauguacacaugugacaucauggccacuggugauguucucgguaagga

SEQ ID NO: 121666 - RNA, 64 nt, Human
guuuacuuugcuugcuuugacucaugccuuacuccauggccacccucucccaaagagggggcuc

SEQ ID NO: 121667 - RNA, 64 nt, Human
aguugaucauuuccucucaugguacucugcucagcauggccacguagguuuuuuguuuguuuug

SEQ ID NO: 121668 - RNA, 64 nt, Human
uggguguggcccggugguggugcacuggugacuucauggccacgccagcugcggggacgcacuu

SEQ ID NO: 121669 - RNA, 64 nt, Human
ccucuaccuccuguccucaggccgugcggcacgacauggccagcacgcagaaggagcccucccg

SEQ ID NO: 121670 - RNA, 64 nt, Human
uuucagggccucgguccauagagaacaccaccaccauggccagguggaaggguuuauuaguccc

SEQ ID NO: 121671 - RNA, 64 nt, Human
gcccgacagccuggcacagggcagugggacagggcauggccagguggccacuccagaccccugg

SEQ ID NO: 121672 - RNA, 64 nt, Human
ugccuccugguccuggccucuccccuaccccucacauggccacgcaugacccacacugaccaca

SEQ ID NO: 121673 - RNA, 64 nt, Human
ggcacagggaggagcagcucuguaaaucugugcacauggccacucuuggccuaauaaaggaggu

SEQ ID NO: 121674 - RNA, 64 nt, Human
ugugguguuuggugcacagggguuggucaggggccauggccaaggcccugccacgcacgcccau

SEQ ID NO: 121675 - RNA, 64 nt, Human
ccaccccaagaggggucugagugggaccucaaagcauggccagugcaauucugaggcuagggga

SEQ ID NO: 121676 - RNA, 64 nt, Human
guaacuagguaagugggaaagccuuuugauguggcauggccaagguccagccacaagugcaacu

SEQ ID NO: 121677 - RNA, 64 nt, Human
aaauucaugaugugugugcuggagaucuggcacucauggccagugcuuuccaguaucuugaacu

SEQ ID NO: 121678 - RNA, 64 nt, Human
ggguugggugucugccuggcucgcacuugguacccauggccaccuccccauuuucugugccuua

SEQ ID NO: 121679 - RNA, 64 nt, Human
uuuggagaaacuacagcaucauggaugcuguggacauggccaucgcaugggaggagcucaaacc

SEQ ID NO: 121680 - RNA, 64 nt, Human
guccacgacccugacagucccagcccugcugccccauggccacgugcccacagaugugcuguug

SEQ ID NO: 121681 - RNA, 64 nt, Human
ccaggcagacucggauauuuuuauaaauuuuuaacauggccacuugcagaagagcuugaauggg

SEQ ID NO: 121682 - RNA, 64 nt, Human
cugaugacugggcccuagcagguggcagguauaacauggccauggacacucuucuuuuuuaaau

SEQ ID NO: 121683 - RNA, 64 nt, Human
ucaggcccagagguccaagcuauacugugcaggacauggccaggccugguggacacaggaagcc

SEQ ID NO: 121684 - RNA, 64 nt, Human
aguaauaaaauauuuaaaaaaaaacauucaaaaacauggccacauccaacauuuccucaggcaa

SEQ ID NO: 121685 - RNA, 64 nt, Human
cuucuccaacaggguucuuggugaugcuggcagccauggccauggcagcggguggcauccaggc

SEQ ID NO: 121686 - RNA, 64 nt, Human
ccuucuucaacgccaucuccacucuuguggucaucauggccagcacgccgcucuucacuguggu

SEQ ID NO: 121687 - RNA, 64 nt, Human
uuuaaaaaacaaaaaguaaaguaaugcauuugagcauggccagacuauucccuaggacaaggaa

SEQ ID NO: 121688 - RNA, 64 nt, Human
aagugcaacauccagugggcagaugaaaaugaugcauggccaaguucaguguuuacagauaaaa

SEQ ID NO: 121689 - RNA, 64 nt, Human
acccggaugugaauggcaugcugaaacucgaagucauggccaccuccagggacaaagaggagcu

SEQ ID NO: 121690 - RNA, 64 nt, Human
gcuggaacaagcaggacccuaacuaccuggccaccauggccauggauggaauggaggugagcac

SEQ ID NO: 121691 - RNA, 64 nt, Human
cguuuguaaccuugcagacccucaaccagacuugcauggccauggcagggccucgggaagaccu

SEQ ID NO: 121692 - RNA, 64 nt, Human
gguugcggugucuccacggugcucucgcccugcccauggccaccccagacucugaucuccagga

SEQ ID NO: 121693 - RNA, 64 nt, Human
agcccuggagugggcagagaguauuguggggaggcauggccagugggacuaguguucccuccau

SEQ ID NO: 121694 - RNA, 64 nt, Human
uagagcgagcccagcagcccuaaaaggcugccuucauggccaucuagccccaguucagggcagc

SEQ ID NO: 121695 - RNA, 64 nt, Human
cuuaugcaaaugaacuuuuaauacuugaaaaucacauggccauggcaguauauguauuugguuc

SEQ ID NO: 121696 - RNA, 64 nt, Human
cuccggaguagcugggaccacagguucaugccaccauggccagccaacuuuugcauguuuugua

SEQ ID NO: 121697 - RNA, 64 nt, Human
cuguauuuaaaaaacuaacacccagucuguuccccauggccacuugggucuucccuguaugauu

SEQ ID NO: 121698 - RNA, 64 nt, Human
ggcccagccaucugcacccacuuuugcuuguagucauggccagggccaaauagcuaugcagagc

SEQ ID NO: 121699 - RNA, 64 nt, Human
caagucaaggucuugcuuagaaaguccuucacuacauggccaggugcaguggcucacgccugua

SEQ ID NO: 121700 - RNA, 64 nt, Human
aaggcgccaccugggcggacagccaggagcucuccauggccaggcugccugugugcauguuccc

SEQ ID NO: 121701 - RNA, 64 nt, Human
cacugauguguuuaugcaccuguacacaggagcgcauggccauggcuuuggaaaggagaaugga

SEQ ID NO: 121702 - RNA, 64 nt, Human
aagaaacucacccccaaggggcagucuggaggggcauggccagcagcuugcguuagaaugagga

SEQ ID NO: 121703 - RNA, 63 nt, Human
cccaggccuuccggccauagcaaccaugaguggcauggccaccaccacgguggucacuggaac

SEQ ID NO: 121704 - RNA, 64 nt, Human
ugggccagggcuccaaggcuugccccagaggccacauggccaccagccccagcugccaucagau

SEQ ID NO: 121705 - RNA, 64 nt, Human
gaagccugacuguccuuuggcugcaucucccgaccauggccaaggagggcuuuucugugggaug

SEQ ID NO: 121706 - RNA, 64 nt, Human
cagccaggcugcagggagugaggcacacggugaacauggccacugacuuuucugccacucuaac

SEQ ID NO: 121707 - RNA, 64 nt, Human
aaggagacuuaacaggaacccagucaaggccauucauggccaugggaccacgcauaaauggaga

SEQ ID NO: 121708 - RNA, 64 nt, Human
cuccagcuuuagcaacucauauaucagucucucacauggccacaauucuagacaaaaaccaaag

SEQ ID NO: 121709 - RNA, 64 nt, Human
aaauuggaaagcuggacagccggauaacuggggucauggccaugggccaggagaagacugugcu

SEQ ID NO: 121710 - RNA, 64 nt, Human
uacuuuuaaggccaucguuuguacccagagucggcauggccaccuaagucuucauuuaauuuau

SEQ ID NO: 121711 - RNA, 64 nt, Human
cucgaagcagcagucucucuggaagcaucugugucauggccaucgcccggcggucagugggcuu

SEQ ID NO: 121712 - RNA, 64 nt, Human
cuuggcggcggccagccccacagggggccaggggcauggccacaggccccccuccccacuuggc

SEQ ID NO: 121713 - RNA, 64 nt, Human
agccccaggccuuggccuccugugcuuggguaaccauggccacugggaaaagcaaggaccgugu

SEQ ID NO: 121714 - RNA, 64 nt, Human
gaucgggaacaagcacguuguacccuuggcuggacauggccaagacacaaggcauuccacggcg

SEQ ID NO: 121715 - RNA, 64 nt, Human
aaggcugcaccugcugcccuucgauccuuccacacauggccaggacacugccacaauccucggg

SEQ ID NO: 121716 - RNA, 64 nt, Human
gcucagccaaaggagaugccccaagugggagcaacauggccacccaauaugcccaccuauuccc

SEQ ID NO: 121717 - RNA, 64 nt, Human
gagggacuagaggacaucucggucguuugaggggcauggccagucguggcaggccggccuucag

SEQ ID NO: 121718 - RNA, 64 nt, Human
cauaggucacuugaggucaagaguuugaaacaagcauggccaagagaugugagccaguuuuccc

SEQ ID NO: 121719 - RNA, 64 nt, Human
acugauccagaauaggggucagcaaacuaugacucauggccacagucucacugacuguuuuugu

SEQ ID NO: 121720 - RNA, 62 nt, Human
gcccuggugauggccccugaggcuggagcccccauggccagcccagccuggcucuguucucu

SEQ ID NO: 121721 - RNA, 64 nt, Human
accccccaaucccccaacacgccugucccucccgcauggccaccaaggagcuggaccuuggaug

SEQ ID NO: 121722 - RNA, 64 nt, Human
uggaguggacgccugugcccacccgagccuggagcauggccaagagccagcuugcaccacccac

SEQ ID NO: 121723 - RNA, 64 nt, Human
cacggaugcuggauucccccucaccccaccucugcauggccacccccucccagcccugugggga

SEQ ID NO: 121724 - RNA, 64 nt, Human
cccucguagggacgcguacacucacacggacacacauggccacacgcaugugcgggugccauaa

SEQ ID NO: 121725 - RNA, 64 nt, Human
gcggccucaucaccagcuucaagaauuaucagcucauggccaaucuugcuuugucuguguaccc

SEQ ID NO: 121726 - RNA, 64 nt, Human
ggcccugcugauccgcaccccauuccuccccucccauggccaaaaaccccacugucuccuucuc

SEQ ID NO: 121727 - RNA, 64 nt, Human
aaaucugccgacacccaucugccccaccuccugccauggccaugaaccgcgacccccacuaaau

SEQ ID NO: 121728 - RNA, 64 nt, Human
cauaggucacuugaggucagaaguuugaaaccagcauggccaacagaugucagccacuuuuccc

SEQ ID NO: 121729 - RNA, 64 nt, Human
auuaacuacuaguuauuugugauagcaacauacacauggccaguaaugcucuuguccaggaaga

SEQ ID NO: 121730 - RNA, 64 nt, Human
gcaagaaucucaugagacaccugucauuuagcuccauggccacucacuguuguggucauacuua

SEQ ID NO: 121731 - RNA, 64 nt, Human
ucugugaaugcuccugccaggccuucagaaauugcauggccacuccagcgucaucggacucucu

SEQ ID NO: 121732 - RNA, 64 nt, Human
auggcaaccuccuuggggccagccuucaaggcuucauggccauaucaugaacccaggacaggca

SEQ ID NO: 121733 - RNA, 64 nt, Human
agggauuuuuauuuguagucuaauuuugucaaaucauggccaaaucgcagugauaguugacuuu

SEQ ID NO: 121734 - RNA, 64 nt, Human
guguccucugccugggcucuggaagaggccuucccauggccauuucuguggagggagggcagcu

SEQ ID NO: 121735 - RNA, 64 nt, Human
ccagccagcugccuggccucccuccuguguuucccauggccaguggccaugccccauggggauc

SEQ ID NO: 121736 - RNA, 64 nt, Human
uccaugcccugaacccugaguagacagccccaagcauggccaggaaggccugccccuccucuuc

SEQ ID NO: 121737 - RNA, 64 nt, Human
ccaguaaacuggccucuacuaucuuuaacucaugcauggccacugaaccucucucuaguagccu

SEQ ID NO: 121738 - RNA, 64 nt, Human
aggccaggaguucaagaucaaccaaccuggguaacauggccagaccccaucucuauuuauauau

SEQ ID NO: 121739 - RNA, 64 nt, Human
gaugcuucucccuacagcauguccacucccccggcauggccagguggggccccuggggcaaugg

SEQ ID NO: 121740 - RNA, 64 nt, Human
uucucaguuuacuucuaaguaaucacagauaauacauggccaguaaucccaggcuggccauuca

SEQ ID NO: 121741 - RNA, 64 nt, Human
aaagaagacaguuucccugaguaaucaucaccuacauggccauuagaguaucuaucggugauaa

SEQ ID NO: 121742 - RNA, 64 nt, Human
ccucaugcacauaacccuggaagggucuuccagucauggccauccugcccggagaggcgccugu

SEQ ID NO: 121743 - RNA, 64 nt, Human
ggugaaucaccugaagucaggaguucgagaucagcauggccaacauggugaaaccccaucucua

SEQ ID NO: 121744 - RNA, 64 nt, Human
ccuuaggguggaggcuuuaguguacagggacagccauggccacacagcacacauguggagcagc

SEQ ID NO: 121745 - RNA, 64 nt, Human
ccccugccaggccacgaauaucaggcuagagacccauggccaucuuuguggcugugggcaccag

SEQ ID NO: 121746 - RNA, 64 nt, Human
uuugcagaacuuaagaauauugauuuauaaagggcauggccauugacccaguccaucuuaugca

SEQ ID NO: 121747 - RNA, 64 nt, Human
uggccaggccuccccgguggccagagccagccagcauggccacccucaagaggcgagaugagcc

SEQ ID NO: 121748 - RNA, 64 nt, Human
agcggcuucugccaaccauggggggcuggaccaccauggccacugacccagccccucagaaucc

SEQ ID NO: 121749 - RNA, 64 nt, Human
ccugcgcggcaagaaugucuagccugcccgcccgcauggccagccaguggcaagcugccgcccc

SEQ ID NO: 121750 - RNA, 64 nt, Human
ccccugcuugaacacugaagggcagguggugggccauggccaugguccccagcugaggagcagg

SEQ ID NO: 121751 - RNA, 64 nt, Human
ccacaagugccucagugcccacugggucggcccccauggccaggagggcucaggacaauccucu

SEQ ID NO: 121752 - RNA, 64 nt, Human
ucucagugacugugaaaggacauugugucugagccauggccagccgcuggcuggcccccugauc

SEQ ID NO: 121753 - RNA, 64 nt, Human
aaaugaagacaaaauacucagaaguugcauuugccauggccacuggcuccagcugggguuuggu

SEQ ID NO: 121754 - RNA, 64 nt, Human
guuagaggcagggaaugaagaagguacugugggccauggccacaccugaugcguuuuugguggg

SEQ ID NO: 121755 - RNA, 64 nt, Human
uaacacuggguauuucagcugaucagaagcucagcauggccauuaugccuaguuuugaugaaua

SEQ ID NO: 121756 - RNA, 64 nt, Human
gucccuaaagugagcccacuacugguugcuuguccauggccaacaccagaaauccccugagcac

SEQ ID NO: 121757 - RNA, 64 nt, Human
gguauugguagguuacucaauuucaaaagggccccauggccaaauauguuuaggaaccgcuguu

SEQ ID NO: 121758 - RNA, 64 nt, Human
ccccugcuugaacccugaaggccagguaaugagccauggccauuguccccagcugaggaccagg

SEQ ID NO: 121759 - RNA, 64 nt, Human
ccccugcuugaacccugagaggcaggugguaggccauggccacaauccccagcugaggagcagg

SEQ ID NO: 121760 - RNA, 64 nt, Human
aucucuggugcucacagccgaggagccguggcuccauggccagaugacggaaacagggucugac

SEQ ID NO: 121761 - RNA, 64 nt, Human
ugggugugagaauaacacuggcuuuggguagugccauggccaggaguggguuucccugcgucuc

SEQ ID NO: 121762 - RNA, 64 nt, Human
ccuaccagaccccgcagacccgggcacuucucagcauggccaucuucuccacgggcgucugggu

SEQ ID NO: 121763 - RNA, 64 nt, Human
gccuggccgccaacuuccacccugacggccgcgccauggccaccaaguuugcacacuugaagcu

SEQ ID NO: 121764 - RNA, 64 nt, Human
agcaggcugguaggcagacaggcagagagaaggucauggccaccgugauggggccaacagcaag

SEQ ID NO: 121765 - RNA, 64 nt, Human
agcagagugaggggguaaagcaguuccugucccacauggccaucuucuuucuuccacccacaaa

SEQ ID NO: 121766 - RNA, 64 nt, Human
agugugcgugucucugugugugcacgugcacgcucauggccaaaugugcgcacucuacauaaag

SEQ ID NO: 121767 - RNA, 64 nt, Human
uugauugcucucacuccccuuggcuguugugcuucauggccagcacucuugaugagggucuugg

SEQ ID NO: 121768 - RNA, 64 nt, Human
uuuuuuaggaaaaauggaaggugccggggguaaucauggccagucaauaauuauauaaaggagu

SEQ ID NO: 121769 - RNA, 64 nt, Human
aggccauaauugacaccacagaugaugcuacugccauggccagugcaagccccagugucauguc

SEQ ID NO: 121770 - RNA, 64 nt, Human
gaaauggggggagggggcaggccaaugaggucugcauggccaggggaccuucaaggugcguaaa

SEQ ID NO: 121771 - RNA, 64 nt, Human
cuggagagaucaagcaaggagaaccuggggcugccauggccaaagcaacucaacagaugccaau

SEQ ID NO: 121772 - RNA, 64 nt, Human
agaaaccagaauccaagaccuccauucacaacuucauggccacgcccgaguuucugaucaauga

SEQ ID NO: 121773 - RNA, 64 nt, Human
gacucuguucagaaaaaaaauuguccaaagacaacauggccaaggagagagcaucuucauugac

SEQ ID NO: 121774 - RNA, 64 nt, Human
cuggccuggcccccaauggucagaagagccaucccauggccaugucacagggauagauggacau

SEQ ID NO: 121775 - RNA, 64 nt, Human
cagccccaaaacuggggcuucaggccagagcauccauggccaauuucaaauugugaacccagag

SEQ ID NO: 121776 - RNA, 64 nt, Human
uucuuccacgcaccaccaccaccaccaccaccaucauggccauagccacgguggccugggggug

SEQ ID NO: 121777 - RNA, 57 nt, Human
acuggagcaagucagauuaggcaagcucauggccacaugaagaagauacauuguccc

SEQ ID NO: 121778 - RNA, 64 nt, Human
gaaaugggaccuaaauuaaggcuuaaagaaugagcauggccacacugucagugaguguucuuua

SEQ ID NO: 121779 - RNA, 64 nt, Human
cuagcacagcuggugccaagagauguccuaaggacauggccaccuggguccacuccagcgacag

SEQ ID NO: 121780 - RNA, 64 nt, Human
caagagacaugguauugacucaacaguuuccagucauggccaaauguucaauaugagucucaau

SEQ ID NO: 121781 - RNA, 64 nt, Human
acuugugucguccaguaaagaagauaaccucaaucauggccauaccgagcagguuaguuuuuga

SEQ ID NO: 121782 - RNA, 64 nt, Human
ugaccuuuagccacgugggugaaguggcaaaggccauggccauaucuguugucccaggccaaag

SEQ ID NO: 121783 - RNA, 64 nt, Human
ccuggauguccccugucccaccaacucugcacuccauggccaccccgugccacccguaggcagc

SEQ ID NO: 121784 - RNA, 64 nt, Human
uccccgaucacuggcauucacccccugcaaaaaucggggcgacaauagcucacugccuacuugc

SEQ ID NO: 121785 - RNA, 64 nt, Human
auaauuuucuacaaccuaagauguucugccuuaucggggcgaaccuuuuaggauuccaugugaa

SEQ ID NO: 121786 - RNA, 64 nt, Human
cuggugucacuuacuguuucugucaggagagcagcggggcgaagcccaggccccuuuucacucc

SEQ ID NO: 121787 - RNA, 64 nt, Human
aggagcacagccauagcagacggggggcugcgggcggggcgagggcggcggggccugggucccc

SEQ ID NO: 121788 - RNA, 64 nt, Human
guuccaaagccagugaaaugugaaggaaauccuucggggcgaugcucccucagccucagaggag

SEQ ID NO: 121789 - RNA, 64 nt, Human
gcggcuggguggugaaggacccuggcucuucucucggggcgaccccucagugcucggcagucau

SEQ ID NO: 121790 - RNA, 64 nt, Human
gggauuucagaugccccugcccucuugucugccacggggcgagucuggcaccucuuucuucuga

SEQ ID NO: 121791 - RNA, 64 nt, Human
accacgggugcucgggacggcugggcgccagcuccggggcgaguucagcacugcggggugcgac

SEQ ID NO: 121792 - RNA, 64 nt, Human
caguggcaguaguauucaucucuacaauacccggcggggcgagaaggaggagugcuuugagcgg

SEQ ID NO: 121793 - RNA, 64 nt, Human
uucaguaggaagagcugaggcugccugggaggcccggggcgaccggaaaagggcucucucaagu

SEQ ID NO: 121794 - RNA, 64 nt, Human
ccagcacagagacgugccaggcgguguuggcgcucggggcgagaugcugcccuucuuugcacga

SEQ ID NO: 121795 - RNA, 64 nt, Human
auuuaacacccaccuggacuucagcagagugguccggggcgaaccagccaugggacggucaccc

SEQ ID NO: 121796 - RNA, 64 nt, Human
uuuugagacauguccaguacaucacaaaggagaucggggcgaccccugcagauguggagccauu

SEQ ID NO: 121797 - RNA, 55 nt, Human
ucacccucacgcccugcuaagcucccggggcgacgaggcugcugcguucacacua

SEQ ID NO: 121798 - RNA, 64 nt, Human
cuuccggacacgcucuucuaaagcgugugcagcacggggcgaaguccgcgcugcgggggcagcg

SEQ ID NO: 121799 - RNA, 64 nt, Human
accaaugcccagcaggggaggugaggggggcuggcggggcgaaguuugggggguguuuuguggg

SEQ ID NO: 121800 - RNA, 64 nt, Human
ggaccagaaccccugccuccaucuuuccaagcaccggggcgaaaaaccacaaaggaaaggaaga

SEQ ID NO: 121801 - RNA, 64 nt, Human
cucccgccccagccuagccccaagacuuuggauccggggcgagaugaagggaagaggguuguuu

SEQ ID NO: 121802 - RNA, 64 nt, Human
guccuuaguucugugggaggacuagaaacagccgcggggcgaaggcccccugaggaccacuacu

SEQ ID NO: 121803 - RNA, 64 nt, Human
ggugacccggcacccccugcagcuuguagccagccggggcgaguggcacguuuauuuaacuuuu

SEQ ID NO: 121804 - RNA, 64 nt, Human
ugccugugcucuccucucaggggcagcaugcuaacggggcgacguccuaauccaacugggagaa

SEQ ID NO: 121805 - RNA, 64 nt, Human
gggagcccccgcgcccccggcccagcgcgggaggcggggcgagccgagggaaagccccuccccg

SEQ ID NO: 121806 - RNA, 64 nt, Human
ccccauccccgcucacaacuuggguucuucucagcggggcgagcugagaagcggucaugagcac

SEQ ID NO: 121807 - RNA, 64 nt, Human
cguccccggugcuggguuggccgugacucgggggcggggcgaucgggucucagccccugccuuc

SEQ ID NO: 121808 - RNA, 64 nt, Human
agccagugaagagcccaccuguggaaggacauggcggggcgaggcacagccagugcauuccugc

SEQ ID NO: 121809 - RNA, 64 nt, Human
ggaggggccgguaaccccugggcuaucuucuagacggggcgaaccaggggucauugaccugccc

SEQ ID NO: 121810 - RNA, 64 nt, Human
uuuuuugagcagguagagucacgcauccggcaggcggggcgagcuccccucugucuggggcagg

SEQ ID NO: 121811 - RNA, 64 nt, Human
cccuccugccucaccccugcggagagcaccguggcggggcgacagcgcaugcaggaacgggggu

SEQ ID NO: 121812 - RNA, 64 nt, Human
gugcauccagcagccccuucaagacauaagagggcggggcgagguacuggcugcagagucgccu

SEQ ID NO: 121813 - RNA, 64 nt, Human
gggcugcgcagugggcucggggguuggggggugccggggcgaugcuuccacccuggacugagug

SEQ ID NO: 121814 - RNA, 64 nt, Human
ccaagaaagcggagaccucgaggugcaggacugucggggcgagguggccgaggcaggucaaagc

SEQ ID NO: 121815 - RNA, 64 nt, Human
gacaccuucuccugacccaggcaccaccugcuuucggggcgauggccguagccuccucccaggc

SEQ ID NO: 121816 - RNA, 64 nt, Human
caagaagcaccaggugucuucagccuccaaccuccggggcgaccuucucuuccagccacagucc

SEQ ID NO: 121817 - RNA, 64 nt, Human
cggcugagggcugccucacugcaaauccuccccacagcgucagugaaagucguccuugucucag

SEQ ID NO: 121818 - RNA, 64 nt, Human
uuauacaugauuuuuaggaagcuauugccuaaaucagcgucaacaugcaguaaagguugucuuc

SEQ ID NO: 121819 - RNA, 64 nt, Human
cgggauguguggccagcugcugcaggcaggacuccagcgucaggauguugccacuuggaguaug

SEQ ID NO: 121820 - RNA, 64 nt, Human
gggacaggaggauugauggugcuccccuuccugccagcgucagaggcccuggagaggggcuguc

SEQ ID NO: 121821 - RNA, 64 nt, Human
aaaguguccuucuugcucccccucaauagaucuccagcgucagcugcucccuggcauucaacaa

SEQ ID NO: 121822 - RNA, 64 nt, Human
gcuggguaagugguagcucuuguugcuucccguucagcgucacaucugcaguggagccugaaaa

SEQ ID NO: 121823 - RNA, 64 nt, Human
uacuuauguuuugcucaucuaacuucauuguacccagcgucauuuugacaugucauuuccuauc

SEQ ID NO: 121824 - RNA, 64 nt, Human
aggggggcaauaccagugacacccagucauccagcagcgucaacaucgugaugggccccucagc

SEQ ID NO: 121825 - RNA, 64 nt, Human
ucuuauuuccuaacauugaauucguuagaaaaaacagcgucaccucacucuucaccugucaugu

SEQ ID NO: 121826 - RNA, 64 nt, Human
uuucaccuucccucgacuugacccuuuccucccccagcgucaguuucacucccucuugguuuuu

SEQ ID NO: 121827 - RNA, 64 nt, Human
uuuucuuuuaggacauacagcaaaugcugcucaucagcgucaaaauaguucaaauaauuuuacg

SEQ ID NO: 121828 - RNA, 64 nt, Human
ggaguaucugccggcgcuguccagguccuuuagucagcgucacuccaucugaugugcagaagcu

SEQ ID NO: 121829 - RNA, 64 nt, Human
caccagaagugaaaaggcugccuccuuuaaacugcagcgucagaaucguguugacagcaaagaa

SEQ ID NO: 121830 - RNA, 64 nt, Human
ucagagacacugccuagcccaagccugucuuucccagcgucauguuugugucacaaaagcaguu

SEQ ID NO: 121831 - RNA, 64 nt, Human
aucugaaaugaccucaauacacuaaugccaaccucagcgucaugccagaaugcacagggcagcc

SEQ ID NO: 121832 - RNA, 64 nt, Human
gacccuagcaguguaccugucuugccagcacugccagcgucagucccaggaguccacacugguc

SEQ ID NO: 121833 - RNA, 64 nt, Human
ugaucaaauuuggguauaugcaguaugcuacccacagcgucauuuugaaucaucaugugacgcu

SEQ ID NO: 121834 - RNA, 64 nt, Human
ucgugccucccccucacaggguggccaccugcaccagcgucagggcccagggugcugugaccga

SEQ ID NO: 121835 - RNA, 64 nt, Human
gguuuuuucuuucuucaagucuccaagggcucuucagcgucacaagccagcaacucucuuugca

SEQ ID NO: 121836 - RNA, 64 nt, Human
acagagaaacugugguccuuuauaaauagccagccagcgucacccucuucuccaauuuguaggu

SEQ ID NO: 121837 - RNA, 64 nt, Human
ucaagguccccagcuucagccccaggcccuaagccagcgucagaacagucaaucugcauuuuuc

SEQ ID NO: 121838 - RNA, 64 nt, Human
cgugugcagcucucugcgucccuccugggcccuccagcgucagacacuaaugggaguucccgag

SEQ ID NO: 121839 - RNA, 64 nt, Human
cggcccgcugggcccgugccuacauccuuuuccucagcgucaggaucuuaguccccaugauugc

SEQ ID NO: 121840 - RNA, 64 nt, Human
ccgauacaggcccuugguguuuuaccacagaccccagcgucaggugggaguacugcaaccugac

SEQ ID NO: 121841 - RNA, 64 nt, Human
uucucuagugucuaaaaccugguauggguuuggccagcgucauggaaagaugugguuacugaga

SEQ ID NO: 121842 - RNA, 62 nt, Human
aagccugcgugauuaguuagaaccgaugaauacagcgucagaaggaugccauaaccauucug

SEQ ID NO: 121843 - RNA, 64 nt, Human
gccaacaugcacugcccacagcaggagcuggauccagcgucagugugucgaugggaacugaaga

SEQ ID NO: 121844 - RNA, 64 nt, Human
aguccauaugugaauacuaaauguuaaacuucaucagcgucagaccuauuguaucauauuagag

SEQ ID NO: 121845 - RNA, 64 nt, Human
cagcuggcuggcucuccgugucugacgaccucaccagcgucaccaaccauggcuaccgcgugca

SEQ ID NO: 121846 - RNA, 64 nt, Human
gccagggcuggggcuugcaugucauugucuaugacagcgucaagacuggcccuuggcaccgugc

SEQ ID NO: 121847 - RNA, 64 nt, Human
uuuggggauggaccucggcccccgccccugcagucagcgucagugcucaucuacguuaauaaag

SEQ ID NO: 121848 - RNA, 64 nt, Human
gaccccagggacauuuccccucugcagcugcggacagcgucaggggcagaggggcacacaacuu

SEQ ID NO: 121849 - RNA, 64 nt, Human
agaucacagaucccaugugagaaagagagaguuucagcgucauccuugaacgcaggauccggga

SEQ ID NO: 121850 - RNA, 64 nt, Human
uuguacuauauuggcugccaugauaggguucucacagcgucauccaugaucguaagggagaaug

SEQ ID NO: 121851 - RNA, 64 nt, Human
agccaggggucugggugggcaccacccugacccacagcgucaccccacucccucugucuuauga

SEQ ID NO: 121852 - RNA, 64 nt, Human
gagccucuccucgacccugcacgggcucugaggccagcgucacacucccucucugcucuccugu

SEQ ID NO: 121853 - RNA, 64 nt, Human
ccaacaccaguggggagcccgcaggccuauguggcagcgucaccacaggaguugugggccuagg

SEQ ID NO: 121854 - RNA, 64 nt, Human
uccaucucauccauuuccuuuucaauggagacuacagcgucagccagcucagccuuggcuuuua

SEQ ID NO: 121855 - RNA, 64 nt, Human
cuucauguggaccuugucaagcugcucccucccccagcgucaaauuguuaucaggugccaaaca

SEQ ID NO: 121856 - RNA, 64 nt, Human
ugucccaguuugguuuccaugggaaccugaguggcagcgucaucacuuugcugaggugaaaugc

SEQ ID NO: 121857 - RNA, 64 nt, Human
gaggaugaugaccugugagaaugaagcuggagcccagcgucagaagucuaguuuuauaggcagc

SEQ ID NO: 121858 - RNA, 64 nt, Human
uuucuugagagaguucaguuaaaaaagaaaaaaucagcgucauuuguucccugccaagcaucgu

SEQ ID NO: 121859 - RNA, 64 nt, Human
aagggaccucgagacgcuuuccuuccccaccccccagcgucaucuccccagccugcuguucccg

SEQ ID NO: 121860 - RNA, 64 nt, Human
uaacagaucaguuuggggugcauguaugauuuugcagcgucaaauuggaguaagggaagauuuc

SEQ ID NO: 121861 - RNA, 64 nt, Human
agaccuucaggugcuuuuguggcuaaaaagauuacagcgucaucugguugaacucuggaaaaaa

SEQ ID NO: 121862 - RNA, 64 nt, Human
ucgccacaggggccagggagcuggagauggccuccagcgucagugccaagacugagcgggcccu

SEQ ID NO: 121863 - RNA, 64 nt, Human
cucgguucccgggcccugcaggggcaggcccaggcagcgucagccggagagcuucuccccgacc

SEQ ID NO: 121864 - RNA, 64 nt, Human
ucccgucagaagagaugaggcuccugggacaggucagcgucaggggcagccugcugucugcucu

SEQ ID NO: 121865 - RNA, 64 nt, Human
ccuucuccccagccagagguggagccaagugguccagcgucacuccagugcucagcuguggcug

SEQ ID NO: 121866 - RNA, 64 nt, Human
cucugguggccacuucauuccagcagcugcaccccagcgucaggccuaccucaaguucuuggac

SEQ ID NO: 121867 - RNA, 64 nt, Human
ccugagcggaguccuagcauccccuugggagcagcagcgucaguggacccagugcugagaaaag

SEQ ID NO: 121868 - RNA, 64 nt, Human
cuugggagcugcugggcuagguccagauccgcuccagcgucaagguggcauccgaaggugucuc

SEQ ID NO: 121869 - RNA, 64 nt, Human
caggccuuguaggaaaaggccccgcccgagguuccagcgucaacggccacuguguguggcugcu

SEQ ID NO: 121870 - RNA, 64 nt, Human
agccugucugcuccccagcucuguaguggcagaccagcgucaccuuugaaguauacgugagaga

SEQ ID NO: 121871 - RNA, 64 nt, Human
gggcuggcuuccuuggcuuuuggggacucggccucagcgucacccugagauuccccccgagaca

SEQ ID NO: 121872 - RNA, 64 nt, Human
cuguccuggcccaggccucugcccucugcccacccagcgucagcccccagaaaaaaggcaauaa

SEQ ID NO: 121873 - RNA, 64 nt, Human
ccaguucuuccaagugucuaacuagucuucgcugcagcgucagccaaagcuggccccugaacca

SEQ ID NO: 121874 - RNA, 64 nt, Human
cagugcgucucgccugcugagcccaccgcuuucucagcgucagagccccuagcucuucucuagc

SEQ ID NO: 121875 - RNA, 64 nt, Human
augggaagcaggaccuagagccgggcacagcccucagcgucagacagcaaggaacugucaccag

SEQ ID NO: 121876 - RNA, 64 nt, Human
ggagaccugaccuggggccaaaaauaaagugagccagcgucaugaacgcaugcuauuuagggac

SEQ ID NO: 121877 - RNA, 64 nt, Human
gcugccaccaccacccagguccucccuaguccuccagcgucaacacuaucccuugggaguugua

SEQ ID NO: 121878 - RNA, 64 nt, Human
aguauggcccacggugaccauuuuuuuguguguacagcgucauauaggcuuugccuuuaaugau

SEQ ID NO: 121879 - RNA, 64 nt, Human
cauccaacaguuugaaaagggagagcucaauucccagcgucaccccauggcuuguguugccugc

SEQ ID NO: 121880 - RNA, 64 nt, Human
gggaaagguuuuguauuuuuuaaaacacuaaaagcagcgucacucuaccuaaugucucacuguu

SEQ ID NO: 121881 - RNA, 64 nt, Human
aaacucccaaaauaguguguauauauguaauaaacagcgucacguaaauacauauaugcagugc

SEQ ID NO: 121882 - RNA, 64 nt, Human
uugggaucacacccuguaaucgggcccguggaagcagcgucaaagaggggucuuggagcuccua

SEQ ID NO: 121883 - RNA, 64 nt, Human
aaugagauauguggaccucacugcucccccaacccagcgucaggcugggacacgccaacgcugu

SEQ ID NO: 121884 - RNA, 64 nt, Human
cugcccgucucagggccaccaagucugacccacacagcgucacucacucccacacacacccccu

SEQ ID NO: 121885 - RNA, 64 nt, Human
cguccagagggcucccugcaggccaggggucccccagcgucacccuguuggggagagaagaaag

SEQ ID NO: 121886 - RNA, 64 nt, Human
ugaccuugccucaccuuucaccccccaccccccacagcgucagcuccuaccucugaccccagcu

SEQ ID NO: 121887 - RNA, 64 nt, Human
ccagugggggagggagggacagagacccagagggcagcgucagacacccagaguuggagacaga

SEQ ID NO: 121888 - RNA, 64 nt, Human
uccugccaggccuucagaaauugcauggccacuccagcgucaucggacucucucuuauuacaaa

SEQ ID NO: 121889 - RNA, 64 nt, Human
gcccaaggcagagcuggagcuggcgccacccagacagcgucagguguggcugggguagguuugg

SEQ ID NO: 121890 - RNA, 64 nt, Human
aacacaaagugugccuuagacauucucaagucaucagcgucacccuuccagaauguucacgucc

SEQ ID NO: 121891 - RNA, 64 nt, Human
uguccacccaaccccgagagcccuagcgugcagucagcgucagcacggcgcucccagaugaggg

SEQ ID NO: 121892 - RNA, 64 nt, Human
uggccucgccuucugcaaaccaccgcagccaccacagcgucaggguggagaucuggguuucuag

SEQ ID NO: 121893 - RNA, 64 nt, Human
gacaugauggggggugcagggggcugugggcauccagcgucauccuccagaaccucacaucuga

SEQ ID NO: 121894 - RNA, 64 nt, Human
cugcaggaucaguagacaaagagagcgacaguuacagcgucagccccucgcaagacacagguag

SEQ ID NO: 121895 - RNA, 64 nt, Human
gccugagagagcccugguacgugguggagaaggacagcgucaagggugacguguuuguggugag

SEQ ID NO: 121896 - RNA, 64 nt, Human
ccgcugcucaguggcucugaccacacuccccucgcagcgucagugguacgacccuuccagccgg

SEQ ID NO: 121897 - RNA, 64 nt, Human
uagccaaguccuccucaggcuuggagaacuuccucagcgucaccuccuucauugagccuucucu

SEQ ID NO: 121898 - RNA, 64 nt, Human
auggcucuauauuuuuuaaagcuauguaauuguucagcgucacuuuucuaaguacuuauacaua

SEQ ID NO: 121899 - RNA, 64 nt, Human
ccuacugccgcccagaaaaggggcagggcucugcagccgccaggacagacgagcaccccaugcc

SEQ ID NO: 121900 - RNA, 64 nt, Human
auccaaggaggguguaauggagcaucaagccacucggcggcagcauggagcuauaacuaagcau

SEQ ID NO: 121901 - RNA, 64 nt, Human
gcccuuucugcccuccuucccaucccacaugcugagccgccacaaagaccaaagaagugauggc

SEQ ID NO: 121902 - RNA, 64 nt, Human
ccauuaacgagaaagugccugcccacugcaacggagccgccagcaccuccuccccuccagaucc

SEQ ID NO: 121903 - RNA, 64 nt, Human
caggugggauggauuuccagccaaagccuccuccagccgccaugcuccuggcccacugcaucgu

SEQ ID NO: 121904 - RNA, 64 nt, Human
aucucuuggaccagcgggcaucacauucuccagcagccgccaucucacacgccucccuccugug

SEQ ID NO: 121905 - RNA, 64 nt, Human
ccccaggcccccagcugaggccggcaacucacccagccgccaccucugcccucucccagcugga

SEQ ID NO: 121906 - RNA, 64 nt, Human
ucucagucacguggaagccacgggacugcuccgaagccgccauaauaaaaucugauuguucagc

SEQ ID NO: 121907 - RNA, 64 nt, Human
cuccauaaauccuucuugggugaagccuagacaaagccgccaggucuuguggcuccaggcacca

SEQ ID NO: 121908 - RNA, 64 nt, Human
gccagcgcugccaccccacccagcgcugccagggagccgccauccgagcuugagcugggcgcac

SEQ ID NO: 121909 - RNA, 64 nt, Human
gcccaugcugagcucaucuggccccaucuuagagagccgccaaacauuccuccagacguccacc

SEQ ID NO: 121910 - RNA, 64 nt, Human
gccugccagcagugaugucccacccuguucacccagccgccagucauggacacagggcacugcc

SEQ ID NO: 121911 - RNA, 64 nt, Human
ucuucacaauccuucucaaauuacaauuccaaagagccgccacucaacagucagaugaacccaa

SEQ ID NO: 121912 - RNA, 64 nt, Human
aggguuuuuggaggaagggauuagauagugacuaagccgccagaauugagguggccauuccuuu

SEQ ID NO: 121913 - RNA, 64 nt, Human
uuugguugccagcucuuucuuauucuacuacacaagccgccaacucaacugagagcuaaagaga

SEQ ID NO: 121914 - RNA, 64 nt, Human
caccuccgggcguccugcccuguuccccguccugagccgccacuuccagcgaacacacacaggu

SEQ ID NO: 121915 - RNA, 64 nt, Human
aauugugucucagaccgguguaaacaaaccagccagccgccaccuugcuaaaccuauaagcuuu

SEQ ID NO: 121916 - RNA, 64 nt, Human
uucuagaagguacuaagaagacagaaacaagcaaagccgccaccacagagcccgaaacaaccca

SEQ ID NO: 121917 - RNA, 64 nt, Human
cuccucucugugaaucacagacacgcgggaccccagccgccaaaacuuuucaaggcagaaguuu

SEQ ID NO: 121918 - RNA, 64 nt, Human
accuccgagaggcagccagacccagagcccucugagccgccacucccgggccaagacagaugga

SEQ ID NO: 121919 - RNA, 57 nt, Human
aguaugaguaccccuccuagaggacccagccgccaucagcccaacgggaagcaaccu

SEQ ID NO: 121920 - RNA, 64 nt, Human
auugacccuaucauuauuucaccaagccaauaccagccgccauccuucuccagaauucuuguaa

SEQ ID NO: 121921 - RNA, 64 nt, Human
gugcucaucggagacugccccacggcccugucagagccgccacuccuauccccaggccaggucc

SEQ ID NO: 121922 - RNA, 64 nt, Human
aguggcaaaauaagauuuaguuguguuuucucagagccgccacaagauugaacaaaauguuuuc

SEQ ID NO: 121923 - RNA, 64 nt, Human
ugacacaguaaaacaaggaaaguucuacccuaagagccgccaucacuucaggccgcugguuugu

SEQ ID NO: 121924 - RNA, 64 nt, Human
aguuuccagaggaagacuagcgcggccaccgcgaagccgccaacccaccggagagggggcuucu

SEQ ID NO: 121925 - RNA, 64 nt, Human
cgggcacuucugccaagaaaugguuaucagcaccagccgccauggccaagccugauuguuccag

SEQ ID NO: 121926 - RNA, 64 nt, Human
ucccuacacaguccugcugcugccgcuggggacaagccgccaagacccaggggcccagagcuuc

SEQ ID NO: 121927 - RNA, 64 nt, Human
auuuuuuugacuucuacuuuacuggcugagugugagccgccaugccuggccauaaucuacauuu

SEQ ID NO: 121928 - RNA, 64 nt, Human
augagauccaagucuaaacgcaagagcuagauugagccgccauugaagacuccuuccccucggg

SEQ ID NO: 121929 - RNA, 64 nt, Human
guguuuccgaauguuuuaguuagccuuuugguggagccgccagcugacaggacaucuuacaaga

SEQ ID NO: 121930 - RNA, 64 nt, Human
gcguaaagcaaaccuaccccggaucucuggcuucagccgccagggggcaguggcagcccugggg

SEQ ID NO: 121931 - RNA, 64 nt, Human
cacagccuggugaguccccgggcagccguccugcagccgccacuccugcgccugccauuggccu

SEQ ID NO: 121932 - RNA, 64 nt, Human
ugaggugucuggccugaggucaauggugcaaaggagccgccaccgggcaugucugccuggagug

SEQ ID NO: 121933 - RNA, 64 nt, Human
uuaccugacuuaugaaacuugaaaccgccucuggagccgccauucugcagaguauuuggaaaaa

SEQ ID NO: 121934 - RNA, 64 nt, Human
ucuguccuuccaccaaucgccucccgcagccccgagccgccacucccagucccccgagucccug

SEQ ID NO: 121935 - RNA, 64 nt, Human
gagucagcauggagagccccugcuaauggaguacagccgccaggagcuacucaggaagguggga

SEQ ID NO: 121936 - RNA, 64 nt, Human
ucuucgugaacuggggcaaaugcuggcauccaggagccgccaauacuaacaggacagguuccau

SEQ ID NO: 121937 - RNA, 64 nt, Human
cagcauugcauucugggggaacgauccuggccacagccgccaaacaaacauucacuaggccucu

SEQ ID NO: 121938 - RNA, 64 nt, Human
cuaaggaagcgcggcgcgcccccugguggugguaagccgccaacgcaccugggggcugcaaccc

SEQ ID NO: 121939 - RNA, 64 nt, Human
aggcucgguggacacccuggcccucucggggcagagccgccaguguuucucagggaugugacug

SEQ ID NO: 121940 - RNA, 64 nt, Human
gcucgucugccugcccccggccccgcgccccuacagccgccaaccucguauaacagucauugcu

SEQ ID NO: 121941 - RNA, 64 nt, Human
gccccccgcgcucgcccagcaggagagacugagcagccgccagcugggagcacuggugugaacu

SEQ ID NO: 121942 - RNA, 64 nt, Human
gcccacagcugccccuuugcccccagcucagucaagccgccacaugcccacaaccucaccagag

SEQ ID NO: 121943 - RNA, 64 nt, Human
uggcccaacggugcggugguggccgaccccaugcagccgccaccaaucgcggaggagauugacc

SEQ ID NO: 121944 - RNA, 64 nt, Human
aguccccaccuucucuauagccggcacugggagcagccgccagcagggaaaucuggccugagca

SEQ ID NO: 121945 - RNA, 64 nt, Human
ccuugggaaggaaggcagugccugcucugcugugagccgccaggaacccuccuccugucaaugg

SEQ ID NO: 121946 - RNA, 64 nt, Human
uaugagaaauacuaugcauagcaaggagaugcagagccgccaggaaaauucugaguuccagcac

SEQ ID NO: 121947 - RNA, 64 nt, Human
uguguuucuuuggggguuagaccacuuucugauuagccgccaccugccugcaucugugaaaagg

SEQ ID NO: 121948 - RNA, 64 nt, Human
agacugggaaggaggccacauuccugucugcagcagccgccagcgauggucuucagcaauaaaa

SEQ ID NO: 121949 - RNA, 64 nt, Human
ugccaaucaacacacugccaaugcgggugggcuaagccgccaggaugccugcagcagauggacg

SEQ ID NO: 121950 - RNA, 64 nt, Human
guggcuccuuccaaccccacuccccguucagcacagccgccaucugcaaggaaggccuaaucau

SEQ ID NO: 121951 - RNA, 64 nt, Human
uacggcacgccgcaccggagcacggcaccgagggagccgccacacggucaccugcaaggacguc

SEQ ID NO: 121952 - RNA, 64 nt, Human
cacuacggccaaccaggacggcagggucauccugagccgccaagguaaucaggugguucuuggc

SEQ ID NO: 121953 - RNA, 64 nt, Human
aaaggagaugugcguguuggaaucugcuuuuccaagccgccaggguccugacggcagcaggacg

SEQ ID NO: 121954 - RNA, 64 nt, Human
cauuucauucaaaccugacaagucuaucucuaagagccgccagauuuccaugugugcaguauua

SEQ ID NO: 121955 - RNA, 50 nt, Human
agccggccugugacaccugaagccgccagcucgccacaggggccagggag

SEQ ID NO: 121956 - RNA, 64 nt, Human
ugccucaaccucccaaguagcugggauuacagaaagccgccaccgugcccagcuaauuuuugua

SEQ ID NO: 121957 - RNA, 64 nt, Human
cgagaagaaaggaagagaaaugcaaagugugggcagccgccaagagugaaaauagagggaagug

SEQ ID NO: 121958 - RNA, 64 nt, Human
cugcccccgccccacgcgcccuggcagcaccaugagccgccagcuucugccuguacugcugcug

SEQ ID NO: 121959 - RNA, 64 nt, Human
ggaaauccccaaggaggaugggaucuuggugcugagccgccacacccugggccuggcccugcgg

SEQ ID NO: 121960 - RNA, 64 nt, Human
gccacagaacuaggggcucagagccagagcuggcagccgccagccaaaaugaugccauugccug

SEQ ID NO: 121961 - RNA, 64 nt, Human
ggucugagggcccaccgaugagagagaugguggcagccgccaggcgagcaggcugcuuucccug

SEQ ID NO: 121962 - RNA, 64 nt, Human
ccugcagcuccacgagaccuuuaccccgggaagaagccgccacccaugaaagcauuucugaagc

SEQ ID NO: 121963 - RNA, 64 nt, Human
aguggcccugcugucccggcuccaucuugguucuagccgccaccugcaugaacacaguggcccg

SEQ ID NO: 121964 - RNA, 64 nt, Human
uacccacgacaaggagacagaggagcugguagccagccgccagaugagcuuccuaaagcugacc

SEQ ID NO: 121965 - RNA, 64 nt, Human
caucccaucuaggaagugaggagcgccucuucccagccgccaucccaucuaggaagugaggagc

SEQ ID NO: 121966 - RNA, 64 nt, Human
auccguguguauguguaugugugugagugugugaagccgccaguucaucuuuuuauaugggguu

SEQ ID NO: 121967 - RNA, 64 nt, Human
ccaaggccugccuuccccucccucccacuggagaagccgccagccccuuucucccucugccuga

SEQ ID NO: 121968 - RNA, 64 nt, Human
uugauaacuagggaagaaagcagaacaguuaagcagccgccacauccccgcuggcugggggccu

SEQ ID NO: 121969 - RNA, 64 nt, Human
caagaacagcaggcccaccuaccuucaaagcugaagccgccaggaccgccaaagaaugccuuga

SEQ ID NO: 121970 - RNA, 64 nt, Human
accacauugaaaauccugccacagcagcagccgcagccgccaacagcagcgcuguuagugagcu

SEQ ID NO: 121971 - RNA, 64 nt, Human
aggaguuagcccuuauccccacugaccaggcgggagccgccaggccugcagcugggccagugcc

SEQ ID NO: 121972 - RNA, 64 nt, Human
cagaguucggcggacccaccccaacccaacucccagccgccagccaaagccacugggugagcag

SEQ ID NO: 121973 - RNA, 64 nt, Human
gauacaauaaauugcuaauguugcuggaucaggaagccgccaguacuugucauauguagccuuc

SEQ ID NO: 121974 - RNA, 64 nt, Human
gugugcuggcucccucacuucuggcugcagugggagccgccagucugacccuugucaccgcacg

SEQ ID NO: 121975 - RNA, 64 nt, Human
gggccgcuuaccauccccucugcccugcagagccagccgccaagguugaccucagcuucggagc

SEQ ID NO: 121976 - RNA, 64 nt, Human
cugauggcgcgcgccuggucugucugauuccccuagccgccaccccacguuucuguaccggguc

SEQ ID NO: 121977 - RNA, 64 nt, Human
uuuguggaacuccgagagccgcccugacagucccagccgccacccaaggagccccauccgccca

SEQ ID NO: 121978 - RNA, 64 nt, Human
acaagggacuggggaucagggucugggcucugucagccgccaccucugggaaagagaaaagguu

SEQ ID NO: 121979 - RNA, 64 nt, Human
cucagcuucccaaguagcggggaucacaggcaugagccgccacacccggccaucacaccuggau

SEQ ID NO: 121980 - RNA, 64 nt, Human
uucuacaggaauaccucugagccugcccaccgggagccgccacaucacagcacaaguggcugca

SEQ ID NO: 121981 - RNA, 64 nt, Human
cagagcccacggagggcccuucccgcaaagcagaagccgccagggcaggggccggggcucucau

SEQ ID NO: 121982 - RNA, 64 nt, Human
gcgccugggcaguccucugggcuggccucgggaaagccgccaccugugguggcgguggggcucu

SEQ ID NO: 121983 - RNA, 64 nt, Human
cuuggccucccaaagugcucagauuagagaugugagccgccaugucuggccagauaaauuaagu

SEQ ID NO: 121984 - RNA, 64 nt, Human
ucucuugcccuuaggauucacugcucucuccuacagccgccaggccugggguccugaaaggacc

SEQ ID NO: 121985 - RNA, 64 nt, Human
gugaagaagggaagcuggggcagguaacacgcagagccgccacguggaacggucuguccgccgg

SEQ ID NO: 121986 - RNA, 64 nt, Human
cacccccuucucugcuccaccacauccuccguccagccgccauugccaccaggagaaccacuac

SEQ ID NO: 121987 - RNA, 64 nt, Human
guuuacuaaaagucuucauacagaguacaagugcagccgccagaggagaaaauugagauucuug

SEQ ID NO: 121988 - RNA, 64 nt, Human
cuccccagccugcugccagcacucacugugcucaagccgccagggcucaucaugguagcuggga

SEQ ID NO: 121989 - RNA, 64 nt, Human
aggugcagauucaaagugagcggcuccugaggagagccgccaaggcugcucgccuucuccgugg

SEQ ID NO: 121990 - RNA, 64 nt, Human
ucggccuuccaaagugcugggauaauaggcauggagccgccacacccagccaaugugccgaaga

SEQ ID NO: 121991 - RNA, 64 nt, Human
gccucuagagcugggcuccguccucggcguugccagccgccauggcugaugaagaggcuccgcu

SEQ ID NO: 121992 - RNA, 64 nt, Human
ccgccugccuggagaggccuggcccugggcaaacagccgccaucaggguucaccucgguggggg

SEQ ID NO: 121993 - RNA, 64 nt, Human
ucgccuggcacuuaaccacacccugguuuuguguagccgccagcucucuucugguugggccuuu

SEQ ID NO: 121994 - RNA, 64 nt, Human
ggccagccugcgccagggaugcugcugagcugggagccgccaugccuggccuuguuucuggacc

SEQ ID NO: 121995 - RNA, 64 nt, Human
ccuaucuccgagagcagcgacuaaguucaggcccagccgccagaccucagagaucucaccagcg

SEQ ID NO: 121996 - RNA, 64 nt, Human
guggaccgagcaccagugcuggcuuuggcaguggagccgccagucuuggugccuguggcuucuc

SEQ ID NO: 121997 - RNA, 64 nt, Human
cccugcggccgucaccccgccagccuacacugccagccgccaccggggcacacgggccucugcu

SEQ ID NO: 121998 - RNA, 64 nt, Human; identical to SEQ ID NO: 121995

SEQ ID NO: 121999 - RNA, 60 nt, Human
ucuccgagagcaccgacuaaguucaggcccagccgccagaccucagagaucucaccagcg

SEQ ID NO: 122000 - RNA, 64 nt, Human
uuuccuggagucaccaaccagcuuugggagacacagccgccacucccccagucuacuucuuuaa

SEQ ID NO: 122001 - RNA, 64 nt, Human
cgcucccuucauuuugggacugaggcugcagcauuggaacaaaagagcauuauuucaauuuuuc

SEQ ID NO: 122002 - RNA, 64 nt, Human
gauuguaugcgucagugagccuucuaucaccuucuggaacaaagucacuugaaaucucuugaug

SEQ ID NO: 122003 - RNA, 64 nt, Human
ucagcgcaggauguaaauagcacuaacgaucgacuggaacaaagugaccgcuguguaaaacuac

SEQ ID NO: 122004 - RNA, 64 nt, Human
cuggcagggcgcucagagcuggggauuuccugccuggaacaagggaccuggagaauguuuuugc

SEQ ID NO: 122005 - RNA, 64 nt, Human
uuccuuuuucaaauuaagugugcaugauuguauauggaacaaauacuaaggucccaggguggga

SEQ ID NO: 122006 - RNA, 64 nt, Human
aauuuaacuguccuuggguuacacuaccauuuauuggaacaagccccagaggcaguauuugauu

SEQ ID NO: 122007 - RNA, 64 nt, Human
agagcacaaugagaaacggcagcgccgacaggagcggcggcagaugaagcgguuauagccauug

SEQ ID NO: 122008 - RNA, 64 nt, Human
cuuauuaacaggaaaugcuaagguaccuucucuguggaacaaucugcaaugucuaaaucgccuu

SEQ ID NO: 122009 - RNA, 64 nt, Human
uccaagagccuccgccaaauuguagccauguaauuggaacaacccauaaggccugcuucccagu

SEQ ID NO: 122010 - RNA, 64 nt, Human
ucccuuuucaguaagcgcaaagccucagaagaccuggaacaagauucugccaucucugugaucc

SEQ ID NO: 122011 - RNA, 64 nt, Human
gcggggccacccgccugcgcuccgccgacgcccuuggaacaaucggcuggagcccugaaacccg

SEQ ID NO: 122012 - RNA, 64 nt, Human
uagccuggaguuaaauugagacuucuaaaaugauuggaacaaagacuaaguugugccagaugua

SEQ ID NO: 122013 - RNA, 64 nt, Human
gguaacuucuuugaaguuauuuagaaauauccuuuggaacaauuauuuuauugucuaauaaaua

SEQ ID NO: 122014 - RNA, 64 nt, Human
agucugucauggggaaacuauauuuuugagcacauggaacaaauuauacuuccucauucauauu

SEQ ID NO: 122015 - RNA, 64 nt, Human
uaucgugccaagccucaaaaauaggcuuauuccauggaacaagaauuaaaaaugaauaagcuau

SEQ ID NO: 122016 - RNA, 64 nt, Human
aaugucuuauuaaaaaacaacaaaaaaagacaaauggaacaaagaagcugugaccccagcagga

SEQ ID NO: 122017 - RNA, 64 nt, Human
cgugucugggguucaccggaaauaaaugauucacuggaacaauucuacugucaaaacaaagggg

SEQ ID NO: 122018 - RNA, 64 nt, Human
ggauucaguacuccucaaccacucuccuaaugauuggaacaaaagcaaacaaaaaagaaaucuc

SEQ ID NO: 122019 - RNA, 64 nt, Human
gagggagggcuggugaggggcucagaggaauacuuggaacaacagcaguguuauuguagugugg

SEQ ID NO: 122020 - RNA, 64 nt, Human
acagcgacaccugguucuuaagcaaauucuagauuggaacaauuagaagaucugacugauguua

SEQ ID NO: 122021 - RNA, 64 nt, Human
uucccaugaaucuucugcucuuguuugugugacauggaacaaauaacuucuuugccaccacuuu

SEQ ID NO: 122022 - RNA, 64 nt, Human
cuuuuaaugaggaccaauguacaguugaaauaacuggaacaaauuauuuuuggugugugugaca

SEQ ID NO: 122023 - RNA, 64 nt, Human
uaacccaaggcauaacugaaacaauuuuagaauuuggaacaagugucacuauauuugauaauaa

SEQ ID NO: 122024 - RNA, 64 nt, Human
cuaaccaaggcauaauugaaacaauuuuagaauuuggaacaagcgucacuacauuugauaauaa

SEQ ID NO: 122025 - RNA, 64 nt, Human
aauugauguguaacuguaugcagacugguuguaguggaacaaaucugauaacuaugcagguuua

SEQ ID NO: 122026 - RNA, 64 nt, Human
cugcucccucucgcucucucacuccacuacuuuuuggaacaaagugauggcagaaugcgguggu

SEQ ID NO: 122027 - RNA, 64 nt, Human
aguuagacuuugggaagccaccuucaacguuuucuggaacaaggcagguacaaauaaaaaaaua

SEQ ID NO: 122028 - RNA, 64 nt, Human
ucuuccccuagaguucugugacuaggcucccauauggaacaaccauauucuuugaggggucacu

SEQ ID NO: 122029 - RNA, 64 nt, Human
uauucuggcuucuguuuuauuccaagaagcuucuuggaacaaaucaguaggaauugaaaagaaa

SEQ ID NO: 122030 - RNA, 64 nt, Human
aucuuugcaaucaacaacuuuacuagugacuuucuggaacaauuuccuuucaggaauacauauu

SEQ ID NO: 122031 - RNA, 64 nt, Human
cacaaaaggaucaugugugucagcaggggccguuuggaacaaaccuagucauuaaugaguaaga

SEQ ID NO: 122032 - RNA, 64 nt, Human
ggaguggcuuuuccagcucucaugccccgcaguguggaacaaggcagaaaaggauccuaggaaa

SEQ ID NO: 122033 - RNA, 64 nt, Human
ggcauggcucagagguugugagaaaggcauggacuggaacaaucauguccagaggggucuggag

SEQ ID NO: 122034 - RNA, 64 nt, Human
cuauagaaauuuauuuuauuaggaaauuugucuuuggaacaaaguggcagcuauaaaauuauuu

SEQ ID NO: 122035 - RNA, 64 nt, Human
uaaaauuuuguaaaguaaugugaauuaaaaauuuuggaacaauuagaauucauucacuauugua

SEQ ID NO: 122036 - RNA, 64 nt, Human
agaucagcccuauguaaguuaagaucauaauauguggaacaaauggaauuguaagugcuuucaa

SEQ ID NO: 122037 - RNA, 64 nt, Human
aguuucuguucucuggcaaauucuucacugagucuggaacaauaauacccuaugauuagaacug

SEQ ID NO: 122038 - RNA, 64 nt, Human
gaggugcugcacugguugcugauuauggucaugauggaacaaagacagauaccuucagaguaug

SEQ ID NO: 122039 - RNA, 64 nt, Human
ugcuguuacuuauucagauaaacauggugccuauuggaacaauagcggauagagcuacaggugu

SEQ ID NO: 122040 - RNA, 64 nt, Human
cugucccaagccacccaaauucucagaucuuuucuggaacaaggcagaauauaaaauaaauaua

SEQ ID NO: 122041 - RNA, 64 nt, Human
uguguauuuuagaaauaguaacuucuaaagagucuggaacaaaguggugauuaaaauuccuaau

SEQ ID NO: 122042 - RNA, 64 nt, Human
accaggcuguaaaagcaaaaccucguaucagcucuggaacaauaccugcaguuauucuucagcu

SEQ ID NO: 122043 - RNA, 64 nt, Human
aaaccuauuugucucuauguaaauuuuuuccucauggaacaagggugugaaaugaaaauauuuu

SEQ ID NO: 122044 - RNA, 64 nt, Human
cucaguucuuggcugccguccuguggcagcuuaauggaacaaaaauuacagacuuuggugaacc

SEQ ID NO: 122045 - RNA, 64 nt, Human
guuuccaaacugcuuuuaacaaugguagugcuccuggaacaauccuuccaagcuccucuaagga

SEQ ID NO: 122046 - RNA, 64 nt, Human
gauggauggaugguagggauguuaauaauuuuaguggaacaaagccugugaaaugauuguacau

SEQ ID NO: 122047 - RNA, 64 nt, Human
cacaguuuauugauuucaaauugucugguacuauuggaacaaauauuuagaauaaaaaaauuuc

SEQ ID NO: 122048 - RNA, 64 nt, Human
gauuuuuacauuuuuuaaacugcuauuuucugaauggaacaagcugggccaaggggcccaggcc

SEQ ID NO: 122049 - RNA, 64 nt, Human
cgugaagauuuccuuuuccauuuucaauaaacuuuggaacaaccuucucguaucuccccuagag

SEQ ID NO: 122050 - RNA, 64 nt, Human
cuguuuugaaauucgguaucucacugagcuaaucuggaacaaaccucucaccucaggccagaag

SEQ ID NO: 122051 - RNA, 64 nt, Human
auaacucugguauccaacuggguguauucuaguguggaacaaaaaacagugaacacaagugcuu

SEQ ID NO: 122052 - RNA, 64 nt, Human
uuacaagcagcuucugagucaaguguucuaauuuuggaacaaagcagguuuuacugcuuuucca

SEQ ID NO: 122053 - RNA, 64 nt, Human
uccugccaugccuugccaauaguaagcugcaggguggaacaagaaaucacuugcucugggggga

SEQ ID NO: 122054 - RNA, 64 nt, Human
uacagaaaugacugccggucauuugaaugagaccuggaacaaaucguuucucagaaguacuuuu

SEQ ID NO: 122055 - RNA, 64 nt, Human
cgaauuuaguucaugcauuggucuuagagggugauggaacaagagaaguacuaucuuuguguug

SEQ ID NO: 122056 - RNA, 64 nt, Human
gugugaaauuuaaaaaagggauguuuuuccaggcuggaacaauaaauguggcugugcaguuuaa

SEQ ID NO: 122057 - RNA, 64 nt, Human
ugcgugucaguucuucuugcagaaugugcucugguggaacaaguugggagaggcugggggggcc

SEQ ID NO: 122058 - RNA, 64 nt, Human
auguuuuaaugccuuuugaugaagcagcagauuuuggaacaaucuuuuaacucaauuuguauuu

SEQ ID NO: 122059 - RNA, 64 nt, Human
cuguugccuugcuaggauccacccuccuauaauauggaacaaauaucugaaugaaauccacccu

SEQ ID NO: 122060 - RNA, 64 nt, Human
cauugggauaaaugugaagaaggcuuuuaagauguggaacaacagcaagucacccaucagauac

SEQ ID NO: 122061 - RNA, 64 nt, Human
cuccaagauauuuuucacaaaauagaaacucauauggaacaaaauaagaaaccccagccaugaa

SEQ ID NO: 122062 - RNA, 64 nt, Human
uuaaaggccugguucuaaguccuuuuuaaagccauggaacaaaaccugauacaucacccuaaca

SEQ ID NO: 122063 - RNA, 64 nt, Human
gagcuccuauuuuguacuccuggcuagaaugcuguggaacaaauacaaagugaaaaaaguucuc

SEQ ID NO: 122064 - RNA, 64 nt, Human
agagaaguucuucaggccuguagaaagaggaguauggaacaaccuuacauuuguugaaauaacu

SEQ ID NO: 122065 - RNA, 64 nt, Human
aacuguguccuuuuaauuuuugcuuagaauagaauggaacaaguuuaaauuucaaggaaauaug

SEQ ID NO: 122066 - RNA, 64 nt, Human
uccugacuguggaguugggauguggaaguggggcuggaacaaagcuucugccuagggaggagcu

SEQ ID NO: 122067 - RNA, 64 nt, Human
cccccaagauggaacaucccugcugcauucacacuggaacaagccccuccagaugagugccccg

SEQ ID NO: 122068 - RNA, 64 nt, Human
uucaccugacuuugauuccuuaacccccggcuuuuggaacaagccauguuugcccuaguccagg

SEQ ID NO: 122069 - RNA, 64 nt, Human
auaaaaggaaaacauguuucuucaaauugcauaauggaacaaauggcaaugugaguagguuaca

SEQ ID NO: 122070 - RNA, 64 nt, Human
cuauuuagcauuccuuuuugggucucaagauuuauggaacaauaaaugucauuuaaugcugugu

SEQ ID NO: 122071 - RNA, 64 nt, Human
ugggagcagcuuuuuuuuccccccuagaaacguuuggaacaaucuaaaaguuuaaagcucgaaa

SEQ ID NO: 122072 - RNA, 64 nt, Human
gcacagaagggaaaggucucaaggaagagucaacuggaacaagcacaagcccaccggacauggc

SEQ ID NO: 122073 - RNA, 64 nt, Human
uaucaauuuaagggaucuuaaaaggauuuggaaauggaacaaguagcuuccagaccagauacua

SEQ ID NO: 122074 - RNA, 64 nt, Human
cuauuuggaagcuucaaaagguuucuauauguaauggaacaaaaggggaauucucuuuuccuau

SEQ ID NO: 122075 - RNA, 64 nt, Human
ucauguaacuguccuguaauaaggugcuuauaaauggaacaacuacacagccuaguuuugccac

SEQ ID NO: 122076 - RNA, 64 nt, Human
auguggaaaucaaauuuaaccaagaaaaaaagauuggaacaaaugcucucuuacauuuuauuau

SEQ ID NO: 122077 - RNA, 64 nt, Human
uaaacacucugauugaaucugggguuccagaagguggaacaagcaggaaugggauccaaagaga

SEQ ID NO: 122078 - RNA, 64 nt, Human
ucuuuuagcugaugaacuuauucuguagauucuguggaacaagccuaucagcuucagaauggca

SEQ ID NO: 122079 - RNA, 64 nt, Human
ugauugaggauacugaagacuggcguccaaggacuggaacaacucagucucgcucuuuccgaau

SEQ ID NO: 122080 - RNA, 64 nt, Human
aauaggugacucacugaaaugccuuuauaaauacuggaacaaauccugcugcaaaaaugaaagc

SEQ ID NO: 122081 - RNA, 64 nt, Human
gcuuguaaauucacauuguuuggaaaaauucuuuuggaacaaaaaauuagguacaugauaacug

SEQ ID NO: 122082 - RNA, 64 nt, Human
agaguauaucauugcaagggcagcacuuguccuguggaacaacuacuuauaaugccuuagaauu

SEQ ID NO: 122083 - RNA, 64 nt, Human
caaugguuuacacuuuaacaagaaauuuuggauauggaacaaagaauucuuagacuuguauucc

SEQ ID NO: 122084 - RNA, 64 nt, Human
uccucauguucuagaaagaucacuaauggucaaguggaacaagcacuacacgacuaaccccuau

SEQ ID NO: 122085 - RNA, 64 nt, Human
uaaaauauuuucacaaccagaguagaaaacgugcuggaacaaaauugcgaaggcuuuugccucc

SEQ ID NO: 122086 - RNA, 64 nt, Human
uuacugcuuuuguuguaguugucauaauuacauuuggaacaaaaggugugggcuuuggggucuu

SEQ ID NO: 122087 - RNA, 64 nt, Human
ucuaacuggcucuggaaagcugaaagggcugcacuggaacaacacagaugagauauucuacaca

SEQ ID NO: 122088 - RNA, 64 nt, Human
gggaaacaugaggccccuuaugggaccccccaaauggaacaacuucacuuucucuuuuauguau

SEQ ID NO: 122089 - RNA, 64 nt, Human
acauguccaguccacauuuaaagagcacuuacuguggaacaagccuucagccaaacaaugggga

SEQ ID NO: 122090 - RNA, 64 nt, Human
uuacugcuguugcgcugcuuuauuuaaugcacuguggaacaaaauauaaggguacuguuggggu

SEQ ID NO: 122091 - RNA, 64 nt, Human
uauuuuguguccccaccuugauguuacaugacucuggaacaauaugaacuggauuuaagaaugu

SEQ ID NO: 122092 - RNA, 64 nt, Human
uucuuuuacuuaaccaggcuuauggcaugaucucuggaacaaauuuguaggaaaaaauuacucc

SEQ ID NO: 122093 - RNA, 64 nt, Human
accugauacagcagugcugcguguuguacauacuuggaacaacaaacuagaaauacuguacuuc

SEQ ID NO: 122094 - RNA, 64 nt, Human
uucucagcugagcugugagggcuuccagggaaaauggaacaaaaugguguucuuagguaauggg

SEQ ID NO: 122095 - RNA, 64 nt, Human
cauucccuccuuuuguucuuccuuccugccuuaguggaacaaaaaccaacacauaguuuuaagc

SEQ ID NO: 122096 - RNA, 64 nt, Human
aggagcguccauuccucuggagucucuccuuguuuggaacaaaucgcuucgccuuuuucuacuu

SEQ ID NO: 122097 - RNA, 64 nt, Human
ucuauuuucuuucauuuuaaaagcauaaugacaguggaacaauaaugggauaugcagaagcacc

SEQ ID NO: 122098 - RNA, 64 nt, Human
uuggauauaacauuauuauuauuuugauaaaauauggaacaaaucaauucuauuaauaaguggu

SEQ ID NO: 122099 - RNA, 64 nt, Human
aaaacaaugauaaauuucucagcuuguccagaccuggaacaaaauuucuggaauaagaaauuug

SEQ ID NO: 122100 - RNA, 64 nt, Human
gggaguugaacugguaccugauucacggguggacuggaacaaacaggaauguaccagaccuaug

SEQ ID NO: 122101 - RNA, 64 nt, Human
ugagcgagggcauaaauacagcuagccccagggguggaacaacucugggagucuuggguacucg

SEQ ID NO: 122102 - RNA, 64 nt, Human
ucaacaucucugguguuuuaagauguuauuuuauuggaacaacugacaaaugagggauguuagc

SEQ ID NO: 122103 - RNA, 64 nt, Human
uuguggcaagauacuuugguugguuaaaauaauauggaacaaaggauccacugaagugaucucu

SEQ ID NO: 122104 - RNA, 64 nt, Human
aauacagcagcuguuauaacacgaccagucaauguggaacaaacuguuucugugcaaccccuuu

SEQ ID NO: 122105 - RNA, 64 nt, Human
acuucuuaccugcugaaggaucuugcucaguagcuggaacaaugcugcugucacacagucucuu

SEQ ID NO: 122106 - RNA, 64 nt, Human
cuuugugggggaggggggagagaggggaaggaaauggaacaaguuguguuuguguuagcaugug

SEQ ID NO: 122107 - RNA, 64 nt, Human
aagaaacaaauacauuuuaauuaaacaaucuauauggaacaaacauucccaaauucuaagaaua

SEQ ID NO: 122108 - RNA, 64 nt, Human
uaccccacauuggccaguggacucauccauucuuuggaacaaaucccccccacuccaaagucca

SEQ ID NO: 122109 - RNA, 64 nt, Human
ccccaagaucaccuguagggaaaugaguguucccuggaacaaggaggugggggcaguguggccc

SEQ ID NO: 122110 - RNA, 64 nt, Human
aaguuauuuccuuuuauaauacuuuucuuccccauggaacaaaugggaucaauuugugaguuuu

SEQ ID NO: 122111 - RNA, 64 nt, Human
gguucacugagggguggcacgggaccacuccagguggaacaaacagaaaugacuguggugugga

SEQ ID NO: 122112 - RNA, 64 nt, Human
uacuuucuccaguaaaugaggaaccguaacucuuuggaacaaaccaaaauauagcagauguaau

SEQ ID NO: 122113 - RNA, 64 nt, Human
ugcauuuuauuugauauauuuuauaauccagguuuggaacaaggaaacaaaauuaaaaggacag

SEQ ID NO: 122114 - RNA, 64 nt, Human
uugauuaaaaucgaacuuuauuacauacugauucuggaacaaaacaguuagaaaaacuuuaaaa

SEQ ID NO: 122115 - RNA, 64 nt, Human
ugggauaugcucccuauaaaaugaaauguuuuccuggaacaaugcuaauuaggauugcauuccu

SEQ ID NO: 122116 - RNA, 64 nt, Human
uccauuuuuuuggcuacucugaaauguugcaguguggaacaauggaaagagccuggguguuugg

SEQ ID NO: 122117 - RNA, 64 nt, Human
aaaaacaaaauaacuacuacuuuuggaggaaacuuggaacaagaagaguacauaguuugaucca

SEQ ID NO: 122118 - RNA, 64 nt, Human
aacggauguaacauuucaugugaucgugcaccacuggaacaaaaccaaaaugugaccauaacug

SEQ ID NO: 122119 - RNA, 64 nt, Human
aaucccacuucaauacacacucaugaacuccugauggaacaauaacaggcccaagccuguggua

SEQ ID NO: 122120 - RNA, 64 nt, Human
uguuuucaucuagucagagauucaguaagugccuuggaacaauauugaauucucuuagcuugug

SEQ ID NO: 122121 - RNA, 64 nt, Human
ucaagauccagucaggguuucucuugaauuauuuuggaacaaugccaggauccaaacugauuaa

SEQ ID NO: 122122 - RNA, 64 nt, Human
augaaaagaacuacugaaauauuacacuauaacauggaacaauaaagguacugguauguuaaug

SEQ ID NO: 122123 - RNA, 64 nt, Human
aauuaacaagaaguaugcaggugcaaaaaagugguggaacaaauaccaacauccauccaaaaug

SEQ ID NO: 122124 - RNA, 64 nt, Human
cccccgaccuucaggaauggcagccugcagcaacuggaacaaggccccaccguaaagcucugug

SEQ ID NO: 122125 - RNA, 64 nt, Human
uuuccuucuuuuuaguuuuggggaucauuuugaguggaacaaagugaccucuugcauccauaac

SEQ ID NO: 122126 - RNA, 64 nt, Human
ccaagagagaacaguuguccaggaugcuggcugguggaacaaccugcuggcccgaaacaaggcu

SEQ ID NO: 122127 - RNA, 64 nt, Human
acugucauuuuguuuauucuacugcaguagccaguggaacaaaguuuguaguuauuuugccacu

SEQ ID NO: 122128 - RNA, 64 nt, Human
gagcugggaggaucugcagacuuucacggauucauggaacaagaaaagaagcauagguacuuuu

SEQ ID NO: 122129 - RNA, 64 nt, Human
ucuuuugaauuuuagaaaaaacauaugaaucagauggaacaaucugaaugugauaugcuccaug

SEQ ID NO: 122130 - RNA, 62 nt, Human
gugcccuugggggcaggugaugggagcacagcuggaacaaugugcucggcccccagugcucu

SEQ ID NO: 122131 - RNA, 64 nt, Human
gaagaguauuuuugacagaauauguuucaaacuuuggaacaagaugguucuagcauggcauauu

SEQ ID NO: 122132 - RNA, 64 nt, Human
caacacagguucuaaauuuaaaacaaauaauaauuggaacaaauaaagguucuuguacccagag

SEQ ID NO: 122133 - RNA, 64 nt, Human
uguguuccaggaaccagaucacgauuuuuagccauggaacaauauaucccaugggagaagaccu

SEQ ID NO: 122134 - RNA, 64 nt, Human
aacucugacagacucuuuaauauuuaccccugguuggaacaauauuugaaaugucccagauauu

SEQ ID NO: 122135 - RNA, 64 nt, Human
aguuauuuaacuucaauuuaccuuaccuguaaaauggaacaaauaauaucuccuuaagauugcu

SEQ ID NO: 122136 - RNA, 64 nt, Human
auguaugcauaaaaucauaggacauauguacuuguggaacaaguuggauuuuuuauacaauauu

SEQ ID NO: 122137 - RNA, 64 nt, Human
uuuguggaacacauuccacacuuugaaaucuucguggaacaaaagauauuuguggaaccaaucu

SEQ ID NO: 122138 - RNA, 64 nt, Human
cucuuuggguccauucagaugaauagauggaauuuggaacaauagaauaaucuauuauuuggag

SEQ ID NO: 122139 - RNA, 64 nt, Human
ucugauagaauucuggucaucagauguacugcaauggaacaaaacucaucuggcugcaucccag

SEQ ID NO: 122140 - RNA, 64 nt, Human
aaaguguuuaaauuugagaucaaggagaagauaguggaacaaaauguuauauagauaauauuuu

SEQ ID NO: 122141 - RNA, 64 nt, Human
aauaaucauuaagccuauuguuuaaugcaaaauauggaacaaaugugaacugguaaaggucgau

SEQ ID NO: 122142 - RNA, 64 nt, Human
acagcggaugguaugacucauugggggccauugauggaacaaucuuaccacacaaggacaaauu

SEQ ID NO: 122143 - RNA, 64 nt, Human
aaaaggugggauucaugucgaggcuagaggcauuuggaacaacaaaucuacguaguuaacuuga

SEQ ID NO: 122144 - RNA, 64 nt, Human
gaugugcaaaagaccuuuuuguagccaaacaaguuggaacaaaacucucggugaaugaaccacu

SEQ ID NO: 122145 - RNA, 64 nt, Human
ccuuggauacuguucuagaauuuucugaaaaaauuggaacaaucuuuuaugugcguuugcuguc

SEQ ID NO: 122146 - RNA, 64 nt, Human
auuacuguuugcauaucagguugaacaaaaugcuuggaacaaaauuaagcauuauuucuagacc

SEQ ID NO: 122147 - RNA, 64 nt, Human
aagacaaaguagauucuuacaaggcccuuuccuuuggaacaagacagccuucacuuuucugagu

SEQ ID NO: 122148 - RNA, 64 nt, Human
acagucuacauugugcuacauuauccagcuucuuuggaacaaugugugcucuguaugguuuuuu

SEQ ID NO: 122149 - RNA, 64 nt, Human
ccccccccaacacaccuauaaaaacccaaauuuuuggaacaaagauaauggaaccuccauuuuc

SEQ ID NO: 122150 - RNA, 64 nt, Human
uuuaauuuccaggguugcuugaucauuauaucauuggaacaacugauacuucacuacuuuaaua

SEQ ID NO: 122151 - RNA, 64 nt, Human
ugugccuuuuuucuccuuagaaaaucuaauuacuuggaacaaguucagauuucacuggucaguc

SEQ ID NO: 122152 - RNA, 64 nt, Human
auaggacuuugaauagcaaugauaggaaaaacaauggaacaaggguggguuugcacagauugga

SEQ ID NO: 122153 - RNA, 64 nt, Human
uuugauuuuuauugcacaugguuuucccaacauguggaacaauaaauauccaugccaauggaca

SEQ ID NO: 122154 - RNA, 64 nt, Human
gauauuaugcauacugagcuagaccagaagagucuggaacaaaauaaacacagccuuuauaauc

SEQ ID NO: 122155 - RNA, 64 nt, Human
uaagggcugagcuuucugugcuucuagguggagcuggaacaauucagauucacccgcccugaug

SEQ ID NO: 122156 - RNA, 64 nt, Human
uggucguauuuuuuuaaaaaguauuucacaagaauggaacaaaucuacuuauccaguuauaccu

SEQ ID NO: 122157 - RNA, 64 nt, Human
aggugggguuaguugcauggaccaggugaggugguggaacaaaaggccagguagaggaagaaua

SEQ ID NO: 122158 - RNA, 64 nt, Human
guuaauuauaaguuauguaagaaucaucgccuuguggaacaagucaaucagugacuagcuuccu

SEQ ID NO: 122159 - RNA, 64 nt, Human
uuugaaucuauuucauuguguuuguuuuucauguuggaacaaucucucuggaagugccucuucu

SEQ ID NO: 122160 - RNA, 64 nt, Human
uccuuaagauuguuuaucuggagcccacauaguguggaacaaaaagucaccuagaaagcauccu

SEQ ID NO: 122161 - RNA, 64 nt, Human
cuggauacacgaggaaaaggaaagagucucagaguggaacaaagagugggaagaggugaucugu

SEQ ID NO: 122162 - RNA, 64 nt, Human
ggugagaaggaagggagaagguggcauaacuuuuuggaacaaaagaaaacacaaaauccuagcu

SEQ ID NO: 122163 - RNA, 64 nt, Human
acuuggaaaccggugggugcaaugcccgaggcuguggaacaaucagcccaucucuuugugaccu

SEQ ID NO: 122164 - RNA, 64 nt, Human
auuuauuguauuuuuauguucugaaaauuacccauggaacaauaugcuuaggauuacaggaagc

SEQ ID NO: 122165 - RNA, 64 nt, Human
cauugcauuuuuauucacauacacauuguuaauguggaacaauuuaacacuaaucucaucagag

SEQ ID NO: 122166 - RNA, 64 nt, Human
ucuguuuacaggcauuauauuuauuuggcacuccuggaacaaguauaucuaacccauucuugau

SEQ ID NO: 122167 - RNA, 64 nt, Human
cuuuuaugaauuagcugauaaggcuguauguuucuggaacaaaauauuggucaucuaaaaacuu

SEQ ID NO: 122168 - RNA, 64 nt, Human
uucuaaccuguucuaaccucuaagcauuuucuaauggaacaaaauagaugagguggaugaacau

SEQ ID NO: 122169 - RNA, 64 nt, Human
gauuuuugcucuucucaguuuacucauuguccccuggaacaaaucacugacaucuacaaccauu

SEQ ID NO: 122170 - RNA, 64 nt, Human
gauauacuucagaauuugagagcagaaguuaauguggaacaaaaguuuucaccaucucucaagc

SEQ ID NO: 122171 - RNA, 64 nt, Human
ggacgaggcccuauuccaugccccucuuuaaugguggaacaaauguuaaacugcucaucuaaag

SEQ ID NO: 122172 - RNA, 64 nt, Human
acaaaaauaucuucauacuuccucauccccucauuggaacaaaaccuuaaacugggagaaccuu

SEQ ID NO: 122173 - RNA, 64 nt, Human
ccuccccacuuugguucagucugucuugugcaccuggaacaacuguucucccuugugacuaauu

SEQ ID NO: 122174 - RNA, 64 nt, Human
ggaugaauuucuaaaauauccuccaaugugugcauggaacaaauaaucaaaagaaccagacugu

SEQ ID NO: 122175 - RNA, 64 nt, Human
agaacuacuacucacaguuaccacuuggggucaguggaacaaaaugcauauaugguuuugacau

SEQ ID NO: 122176 - RNA, 64 nt, Human
guaaauaaugaggaaaaugaauuagcuccagugcuggaacaacuaacuaacuugguguuaccug

SEQ ID NO: 122177 - RNA, 64 nt, Human
acauacuguuacugaagaaagcaccaagucuuaauggaacaaagaccauagaaugaauuauuuu

SEQ ID NO: 122178 - RNA, 64 nt, Human
cagaauccaauuuccuuccuucccuccacagguuuggaacaaacucucccuucacuuguugccc

SEQ ID NO: 122179 - RNA, 64 nt, Human
gucaccagucucaagcccaugugguaggcggugauggaacaacugucaaaucaguuuuagcaug

SEQ ID NO: 122180 - RNA, 64 nt, Human
cucagcucugcuguguuaacuuugugaaacuggauggaacaaacuuuaacuuaccaagcaccaa

SEQ ID NO: 122181 - RNA, 64 nt, Human
aggaaacagugaccauuuucagaguaaucaaaucuggaacaaaugaaacaucuuuuagccacca

SEQ ID NO: 122182 - RNA, 64 nt, Human
gccaguuucugcaguugguaguucguguacauauuggaacaauccacagcagaucauagcauga

SEQ ID NO: 122183 - RNA, 64 nt, Human
cauagcacuuagacaggacuuucaugacccaauauggaacaauuugaguaccagaauaggagau

SEQ ID NO: 122184 - RNA, 64 nt, Human
cugaugaugaauauaaaaaaguaaccaaccucauuggaacaaguauuaacauuuuggaauaugu

SEQ ID NO: 122185 - RNA, 64 nt, Human
ucaaauaauucaauugcuacaaaugccgugacauuggaacaaggucaucauagcucuaacuuua

SEQ ID NO: 122186 - RNA, 64 nt, Human
accaauccuuccacauacuguuaagauguagacuuggaacaaagcuguugggacccagagcaau

SEQ ID NO: 122187 - RNA, 64 nt, Human
gucacugcaggggcagccaaacauaugccccauuuggaacaauccucacucuacagacaaggca

SEQ ID NO: 122188 - RNA, 64 nt, Human
ugcguagugcugaacauuaagcuuucugggccacuggaacaaagaacuaggaucucacaggaaa

SEQ ID NO: 122189 - RNA, 64 nt, Human
gucagagggggaagaguuagaaugggucaguggcuggaacaaaguucugguuaaggaggaaauu

SEQ ID NO: 122190 - RNA, 64 nt, Human
auuuuagauuauagaacauggauucaaaagugacuggaacaaauuggcugacaccuuacuggua

SEQ ID NO: 122191 - RNA, 61 nt, Human
acgaagucacucuuaauuaauaucuguauccuggaacaauauuuuaugguuauguuuuucu

SEQ ID NO: 122192 - RNA, 64 nt, Human
aguguuuuaaauguuugugugaagaaugaguuuguggaacaauuugauuugcuguggccucuau

SEQ ID NO: 122193 - RNA, 64 nt, Human
cugagaggcaggucuuccguccucagagccuuucuggaacaaggagaaugccugugcaggugga

SEQ ID NO: 122194 - RNA, 64 nt, Human
cguuguuuagaaaguuggguggcuucauucagcauggaacaagcuaauggcacaggagacauca

SEQ ID NO: 122195 - RNA, 50 nt, Human
ccagcagccugaguuucugauggaacaagagcccaggcuaccagagcacc

SEQ ID NO: 122196 - RNA, 64 nt, Human
uugauuuugaaaugcuuugauauucuaauugacauggaacaaguuuuuucccugcuccccaaau

SEQ ID NO: 122197 - RNA, 64 nt, Human
aagauagcccuaaauguacucuugaacuucuuacuggaacaauguuugauacucuaguauguaa

SEQ ID NO: 122198 - RNA, 64 nt, Human
ugauugauaaaaccugggaguaagguaagaaaaauggaacaaauuuuuaucuaaaaauuccugu

SEQ ID NO: 122199 - RNA, 64 nt, Human
uuuaagaucugauaugcuaucauugccuuaauaauggaacaaaauagaagcauaucuaacacuu

SEQ ID NO: 122200 - RNA, 64 nt, Human
uauuugaaaguuauuggaaauuuuauucaaaccguggaacaaauguaugugauuuuguuauacu

SEQ ID NO: 122201 - RNA, 64 nt, Human
aauguuggcuacauguauuauuaaagaggauuuuuggaacaacuuagguauugagacugaacug

SEQ ID NO: 122202 - RNA, 64 nt, Human
aaaaaguauuacgaugaaauuguuaggguauuaauggaacaaacccaguuucacucucuugaca

SEQ ID NO: 122203 - RNA, 64 nt, Human
auuuuuggaaggaucgaucuuauuuaacuauguguggaacaacccaguaauaucagacucgaau

SEQ ID NO: 122204 - RNA, 64 nt, Human
uuaugacacagccaacauuuugugaaacaaugacuggaacaaaacagcagccauacuuaccuuu

SEQ ID NO: 122205 - RNA, 64 nt, Human
cauuuccucgggcaccaaaguagguucccuuuguuggaacaauuacacuggccaugccauaaug

SEQ ID NO: 122206 - RNA, 64 nt, Human
caugcccuuuugggauaagaaaccacaaaacgcauggaacaacuauccauggcucuuagccaga

SEQ ID NO: 122207 - RNA, 64 nt, Human
gcaugucagaaaagugcaguagaagcaaagcuacuggaacaaagauagaccuugacaacauaga

SEQ ID NO: 122208 - RNA, 64 nt, Human
cuuuuagcgguuugcaaacaaaaugaugggaaaguggaacaaugcgucgguuguaggacuaaau

SEQ ID NO: 122209 - RNA, 64 nt, Human
accuucauggauagucuuuaaucucugaucuuuuuggaacaaacuguuuuacauuccuuucauu

SEQ ID NO: 122210 - RNA, 64 nt, Human
ugccauuucuaccacuagacccuuggaccaccauuggaacaaccaagcagaauguacuugauau

SEQ ID NO: 122211 - RNA, 64 nt, Human
uggaaagcucaaccugcaggaguuccaccaccucuggaacaagauuaaggccuggcagguggga

SEQ ID NO: 122212 - RNA, 64 nt, Human
cugagaaacaaaucuuuguucucuuaggcugcaauggaacaacuuuaccaggguuuuggcauuu

SEQ ID NO: 122213 - RNA, 64 nt, Human
gucugugcaaacuggaggacuccuuccaacuuccuggaacaaagcgacaucgccagcagcaggc

SEQ ID NO: 122214 - RNA, 64 nt, Human
gacagugugcucacucucagagccauggauuaccuggaacaaagugcagauuagugcccacggu

SEQ ID NO: 122215 - RNA, 64 nt, Human
uaaauguaggccgggugccccuguucuccggguuuggaacaauacgagguuggugcugauggga

SEQ ID NO: 122216 - RNA, 64 nt, Human
acccugcccagccugaugccaccuccucuguucuuggaacaacgcauaggaaaagaaucuccuu

SEQ ID NO: 122217 - RNA, 64 nt, Human
agaggcugggcuucuuucucucauuuguuccuuguggaacaaaugggcaaaagaagugugaaaa

SEQ ID NO: 122218 - RNA, 64 nt, Human
uccccauuuggacauuacuggcuaucuugugcccuggaacaacucugaauuaauuagacucaug

SEQ ID NO: 122219 - RNA, 54 nt, Human
auguagacuuugcauuauaaauucuggaacaacgcgccagacgugugaauuuca

SEQ ID NO: 122220 - RNA, 64 nt, Human
ugaacgaagagcaggaagagguugcugagauuguuggaacaagacgagagguuguuggagcaag

SEQ ID NO: 122221 - RNA, 64 nt, Human
gccugggagcacgcagaggccuguguucacucuuuggaacaagcugauggacugcgcaucucug

SEQ ID NO: 122222 - RNA, 64 nt, Human
uuuuuacacuccuuaaaacaguuuuuaagucguuuggaacaagauauuuuuucuuuccuggcag

SEQ ID NO: 122223 - RNA, 64 nt, Human
agcagugaggcagauguauaauaauaggcccucuuggaacaagucuugcuuuucgaacauggua

SEQ ID NO: 122224 - RNA, 64 nt, Human
gcccuuccccagaggaauuguggagacugucccauggaacaaacccucaggcaccagcacaggg

SEQ ID NO: 122225 - RNA, 64 nt, Human
cugguuugaugaaccagcuguaaaaacacauuucuggaacaacuggagaaaccggaguaugccc

SEQ ID NO: 122226 - RNA, 64 nt, Human
gcaccggcucugcuuaccuguccgcccaccugucuggaacaagggccagguuaagaccacaugc

SEQ ID NO: 122227 - RNA, 64 nt, Human
guccagugauauauuucucauagcauucauucuauggaacaagaaauuagauauugcuguuaau

SEQ ID NO: 122228 - RNA, 64 nt, Human
ccuaauaagauuauuaauuugacuugaaaacugcuggaacaauagugauuaauaaagauaugua

SEQ ID NO: 122229 - RNA, 64 nt, Human
augaguagucggccucgugucuguccucccaucuuggaacaaccuuaucaacaggccgcacugc

SEQ ID NO: 122230 - RNA, 64 nt, Human
gcuauggagguggaguaagcugaggcuuagagcuuggaacaagggggaauaaacccagaaaaua

SEQ ID NO: 122231 - RNA, 64 nt, Human
cuuacuucauuuuuucccucuaauuauuuaagauuggaacaaaaguauaaauauuauuuauuug

SEQ ID NO: 122232 - RNA, 64 nt, Human
aguuuacagauguuuuuaauucuaguauuuuaucuggaacaacuuguagcagcuauauauuucc

SEQ ID NO: 122233 - RNA, 64 nt, Human
cgggcuaggccggcacuggagaggccggagccuuuggaacaaaccgugcggaacgcguccaggg

SEQ ID NO: 122234 - RNA, 64 nt, Human
cugacaacagcgugagauuucaacagaacuuguuuggaacaaauacucacuuaaaacuucagca

SEQ ID NO: 122235 - RNA, 64 nt, Human
agacccacagcaucacccacugcuucgccucugcuggaacaagcaggacccuaacuaccuggcc

SEQ ID NO: 122236 - RNA, 64 nt, Human
aguuguggauugcaagaaacucuuuuauuaaacuuggaacaaccauuuaaaugaaggauuuugu

SEQ ID NO: 122237 - RNA, 64 nt, Human
uacuaaaaaauguugagugguuaucuuuguaugguggaacaaagucacuguaauuuucaucuuu

SEQ ID NO: 122238 - RNA, 64 nt, Human
aguaccuacaacuaauguacucugcuuuagaaauuggaacaaggaugguacuaccacaaucacc

SEQ ID NO: 122239 - RNA, 64 nt, Human
uaaauugcaguagcuugagguuaacauuuagacuuggaacaaugcuaaaggaaagcauuuggca

SEQ ID NO: 122240 - RNA, 64 nt, Human
agguucuucaagaaugguguuugcaagugccagauggaacaauaaaagacguugccuauaacag

SEQ ID NO: 122241 - RNA, 64 nt, Human
ugucauacaguacaauucuuagugaaguguauuguggaacaauuuagaaacuuccuuuuuuucc

SEQ ID NO: 122242 - RNA, 64 nt, Human
cuuugcuuacuucauuuuuuucucuaaucaagacuggaacaaaaguauaaauauuauuuauuuc

SEQ ID NO: 122243 - RNA, 64 nt, Human
ucauucaggcaacgcacaaaacagaaaaugaagguggaacaagcacagauguucuucaacuguu

SEQ ID NO: 122244 - RNA, 64 nt, Human
ugacccgcuuuucuagaaaguucauaaucagcucuggaacaagcacacuugauuccucacugug

SEQ ID NO: 122245 - RNA, 64 nt, Human
aaaaggaccacauaguccaucgaagaagaguccuuggaacaagcaacuggcuauugaaaagguu

SEQ ID NO: 122246 - RNA, 64 nt, Human
aagacacauagguggguuuauguuucaccucauuuggaacaaaagaggacagaagcagaccacu

SEQ ID NO: 122247 - RNA, 64 nt, Human
gccagggaaucuaauauccccaaauuagggcaauuggaacaaagugaaggacauagagguauau

SEQ ID NO: 122248 - RNA, 64 nt, Human
ucacaaaugcagccaagucauguaauuagucaucuggaacaaagacuaaaaacagcagagaauu

SEQ ID NO: 122249 - RNA, 64 nt, Human
ucauuuuacaaguugcaauauauuguuucguucauggaacaaauauaggcugaauucaaacaug

SEQ ID NO: 122250 - RNA, 64 nt, Human
gucuaaccucugaacauaaauuuggucaaauaauuggaacaaagggaaacagauacuugauaug

SEQ ID NO: 122251 - RNA, 64 nt, Human
acagaauauucucccauaaacacugaauuaaauauggaacaacugcuuuuaggagaaaguguau

SEQ ID NO: 122252 - RNA, 64 nt, Human
uuguuggacgaggccgauuuuuuuuuuuuuaacauggaacaaugaaaccaacaacaaacauuuu

SEQ ID NO: 122253 - RNA, 64 nt, Human
aaugguauuuggaauuccgaauugacagguuaucuggaacaaaggagcuucuuuuuuuuucuag

SEQ ID NO: 122254 - RNA, 64 nt, Human
gcaauugucagucuuuuuagagaaggggccaggguggaacaaucccagugaguaaauuauuucu

SEQ ID NO: 122255 - RNA, 64 nt, Human
augguugucacacuuuagguaagauaauucauauuggaacaaacuacaagugcaaacaaugugg

SEQ ID NO: 122256 - RNA, 64 nt, Human
uuucuuucaacaaauauaaaauaaaaaacaacuuuggaacaaugacuugucuuucaucguggcu

SEQ ID NO: 122257 - RNA, 64 nt, Human
augcauaugaccuugggaauagggaaacauuccuuggaacaauuugagaaauacuuagcgguuc

SEQ ID NO: 122258 - RNA, 64 nt, Human
uuagugcuauguuauagaaccuacaaaaaagaaauggaacaaauguaguggauccagggaacgc

SEQ ID NO: 122259 - RNA, 64 nt, Human
agccagugagcuaggguggaggggcuguguuuauuggaacaaagggugguaccaaaaugcaucc

SEQ ID NO: 122260 - RNA, 64 nt, Human
gagcuucaguauaaaagacaaaacuuccuguuuguggaacaaaaguucgaaagaaaaaacaaaa

SEQ ID NO: 122261 - RNA, 64 nt, Human
agucaucccuuaagacgcacuggaaaucacacaauggaacaacacucagaaaugcggaauaccc

SEQ ID NO: 122262 - RNA, 64 nt, Human
aauucugaagaaaucuuggggagggaaggggaguuggaacaaaugucuguucccuggaggccag

SEQ ID NO: 122263 - RNA, 64 nt, Human
cagcaagagauuuaaaacaauaauaaacauaauauggaacaauuauaacaauauacuguaauca

SEQ ID NO: 122264 - RNA, 64 nt, Human
uaacaguagagcuauuuuuuauaaauuagccugauggaacaaucccuuaugauuaaagauucau

SEQ ID NO: 122265 - RNA, 64 nt, Human
agguuucugacaagacuugggagugauucacaccuggaacaacauacuggacuucacacuggag

SEQ ID NO: 122266 - RNA, 64 nt, Human
cuuacucauaauuaauuaacauuuacuucugguauggaacaacuagaaauacugcuggaaauaa

SEQ ID NO: 122267 - RNA, 64 nt, Human
cuucccuaacuuaacauugcaucaugaaacucuuuggaacaacagcuaucuagauagcugacuc

SEQ ID NO: 122268 - RNA, 64 nt, Human
auggcaugggaaagagugccugaggauccuugccuggaacaaguuauggaaagaaagucuuaca

SEQ ID NO: 122269 - RNA, 64 nt, Human
agaaagcacugcuucuguaugucucuugugguauuggaacaauaaacccguacaaccugcaguu

SEQ ID NO: 122270 - RNA, 64 nt, Human
auuuuuugucccuaauguucuuccuuuuacauccuggaacaacaauaaaaacauuuuuuuaaac

SEQ ID NO: 122271 - RNA, 64 nt, Human
ccugcaggaggcucugaaccucuucaagagcaucuggaacaacagguuuguggagugaccgccc

SEQ ID NO: 122272 - RNA, 64 nt, Human
ucuguuuucauuuaauucaguuuuguguuaaggguggaacaaagcucuguucuagagggaaagu

SEQ ID NO: 122273 - RNA, 64 nt, Human
auagucuucauugccaauuuguucuuguagcaaauggaacaaugugguauggcuaauuucuuau

SEQ ID NO: 122274 - RNA, 64 nt, Human
gacaguccuccuggcuucagcuagagaaggaugcuggaacaagcggcugguguugaaagagugg

SEQ ID NO: 122275 - RNA, 64 nt, Human
caauccauuggggucuaguuuggaaucugacaacuggaacaaaaagaaccuugaauccggugca

SEQ ID NO: 122276 - RNA, 64 nt, Human
cuuaaauauauuugccuaguugauaaagaggcuguggaacaacugaaggagaacuuucagaccc

SEQ ID NO: 122277 - RNA, 64 nt, Human
cuuauuuaccuuuuaaauaugccccuuuagcaauuggaacaaguuaaauuguuaacuaaaaaca

SEQ ID NO: 122278 - RNA, 64 nt, Human
guagaaggacauaaccguguuuucaguguuucuauggaacaaacuuguacauuuuauuucacuu

SEQ ID NO: 122279 - RNA, 64 nt, Human
agagcugacaguagcccagggcuuuccaccugcauggaacaagggccugucugccgccagcgcu

SEQ ID NO: 122280 - RNA, 64 nt, Human
uaaaagaaaguggccauaagaaggagacagcaucuggaacaagcuugggauauggggaguaugu

SEQ ID NO: 122281 - RNA, 64 nt, Human
aagacugccuaauuuaacagggauuucugcauucuggaacaagccuccauuuuccccaagcagg

SEQ ID NO: 122282 - RNA, 64 nt, Human
ggcaagacucaugaugagcaagucaaccccaaucuggaacaaugucccuccucuuagaaugucc

SEQ ID NO: 122283 - RNA, 64 nt, Human
caaaaaaacaacuguucuuugccuaauaaagaacuggaacaaccaucacagcugcugagcagca

SEQ ID NO: 122284 - RNA, 64 nt, Human
ucuguguccccaugcugccucugaaauagcgcccuggaacaacccugccccugcacccagcaug

SEQ ID NO: 122285 - RNA, 64 nt, Human
gaagugugcuccucuggccucaguucuccucuuuuggaacaacauaaaacaaauuuaauuuucu

SEQ ID NO: 122286 - RNA, 64 nt, Human
cucugccauccuucauccuuuuauccucccuuuuuggaacaaguguucagagcagacagaagca

SEQ ID NO: 122287 - RNA, 64 nt, Human
acuuuuauuagcucuugugggcuaucaagagaauuggaacaaaaccuugugacuuuuagguaag

SEQ ID NO: 122288 - RNA, 64 nt, Human
cagcuugcugggcuuugggaaguuugcugugcuuuggaacaaucacagggaauggccacaaacc

SEQ ID NO: 122289 - RNA, 64 nt, Human
gggucuuguuuuguugauuuuucuuuuuuaauuuuggaacaaaugcuuuuccaacccaugagug

SEQ ID NO: 122290 - RNA, 64 nt, Human
ucaagacaugggacauuuaaauccucaaggaguuuggaacaaaauaaacagaucuaaaaauuug

SEQ ID NO: 122291 - RNA, 64 nt, Human
uuucaugcuagaaacaggaagauuggaaucugccuggaacaaagaacugcaccuaagcagacca

SEQ ID NO: 122292 - RNA, 64 nt, Human
auuugcgcagccuguuugccccaccuucaccguguggaacaagugucugacgauuaucacuggg

SEQ ID NO: 122293 - RNA, 64 nt, Human
ucaaacagcugccuuacaauucacucauuccauguggaacaaacauuuaucagaugccuauuau

SEQ ID NO: 122294 - RNA, 64 nt, Human
auguuucuuguuuccagaguagaaaaagaaagaguggaacaauagcuuuguucauccuaacuuu

SEQ ID NO: 122295 - RNA, 64 nt, Human
uggggaggggauguuuuuuaacaggacuuuuuauuggaacaauguacuacuugaguaauaccau

SEQ ID NO: 122296 - RNA, 64 nt, Human
aaaagagauuuuuuuucccugcagguaguugaguuggaacaacauguucuaccguggauuugua

SEQ ID NO: 122297 - RNA, 64 nt, Human
uuuuacaaugugcaauaacucagcaguuaaauaguggaacaaaauugaaggguggucaguaguu

SEQ ID NO: 122298 - RNA, 64 nt, Human
cugcccucugcccuuuugccuguccucaggccgcuggaacaaaggaaggacagcucauuccuca

SEQ ID NO: 122299 - RNA, 64 nt, Human
aaaacucucaguuguuuauuauccugaucaagcauggaacaaagcauguuucaggaucagauca

SEQ ID NO: 122300 - RNA, 64 nt, Human; identical to SEQ ID NO: 122291

SEQ ID NO: 122301 - RNA, 64 nt, Human
auagagguuaauuuaaucaaaaugagcuaaaacauggaacaaucacugaauaauuuaaaaagag

SEQ ID NO: 122302 - RNA, 62 nt, Human
ggcccagaucacagaaguaauugugccauauguggaacaagcagcuaagcaauagauaacau

SEQ ID NO: 122303 - RNA, 64 nt, Human; identical to SEQ ID NO: 83251

SEQ ID NO: 122304 - RNA, 64 nt, Human; identical to SEQ ID NO: 83252

SEQ ID NO: 122305 - RNA, 64 nt, Human; identical to SEQ ID NO: 83253

SEQ ID NO: 122306 - RNA, 64 nt, Human; identical to SEQ ID NO: 83254

SEQ ID NO: 122307 - RNA, 64 nt, Human; identical to SEQ ID NO: 83255

SEQ ID NO: 122308 - RNA, 64 nt, Human; identical to SEQ ID NO: 83256

SEQ ID NO: 122309 - RNA, 64 nt, Human; identical to SEQ ID NO: 83257

SEQ ID NO: 122310 - RNA, 64 nt, Human; identical to SEQ ID NO: 83258

SEQ ID NO: 122311 - RNA, 64 nt, Human; identical to SEQ ID NO: 83259

SEQ ID NO: 122312 - RNA, 64 nt, Human; identical to SEQ ID NO: 83260

SEQ ID NO: 122313 - RNA, 64 nt, Human; identical to SEQ ID NO: 83261

SEQ ID NO: 122314 - RNA, 64 nt, Human; identical to SEQ ID NO: 83262

SEQ ID NO: 122315 - RNA, 64 nt, Human; identical to SEQ ID NO: 83263

SEQ ID NO: 122316 - RNA, 64 nt, Human; identical to SEQ ID NO: 83264

SEQ ID NO: 122317 - RNA, 64 nt, Human; identical to SEQ ID NO: 83265

SEQ ID NO: 122318 - RNA, 64 nt, Human; identical to SEQ ID NO: 83266

SEQ ID NO: 122319 - RNA, 64 nt, Human; identical to SEQ ID NO: 83267

SEQ ID NO: 122320 - RNA, 64 nt, Human; identical to SEQ ID NO: 83268

SEQ ID NO: 122321 - RNA, 64 nt, Human; identical to SEQ ID NO: 83269

SEQ ID NO: 122322 - RNA, 64 nt, Human; identical to SEQ ID NO: 83270

SEQ ID NO: 122323 - RNA, 64 nt, Human; identical to SEQ ID NO: 83271

SEQ ID NO: 122324 - RNA, 64 nt, Human; identical to SEQ ID NO: 83272

SEQ ID NO: 122325 - RNA, 64 nt, Human; identical to SEQ ID NO: 83273

SEQ ID NO: 122326 - RNA, 53 nt, Human; identical to SEQ ID NO: 83274

SEQ ID NO: 122327 - RNA, 64 nt, Human; identical to SEQ ID NO: 83275

SEQ ID NO: 122328 - RNA, 64 nt, Human; identical to SEQ ID NO: 83276

SEQ ID NO: 122329 - RNA, 64 nt, Human; identical to SEQ ID NO: 83277

SEQ ID NO: 122330 - RNA, 64 nt, Human; identical to SEQ ID NO: 83278

SEQ ID NO: 122331 - RNA, 64 nt, Human; identical to SEQ ID NO: 83251

SEQ ID NO: 122332 - RNA, 64 nt, Human; identical to SEQ ID NO: 83252

SEQ ID NO: 122333 - RNA, 64 nt, Human; identical to SEQ ID NO: 83253

SEQ ID NO: 122334 - RNA, 64 nt, Human; identical to SEQ ID NO: 83254

SEQ ID NO: 122335 - RNA, 64 nt, Human; identical to SEQ ID NO: 83255

SEQ ID NO: 122336 - RNA, 64 nt, Human; identical to SEQ ID NO: 83256

SEQ ID NO: 122337 - RNA, 64 nt, Human; identical to SEQ ID NO: 83257

SEQ ID NO: 122338 - RNA, 64 nt, Human; identical to SEQ ID NO: 83258

SEQ ID NO: 122339 - RNA, 64 nt, Human; identical to SEQ ID NO: 83259

SEQ ID NO: 122340 - RNA, 64 nt, Human; identical to SEQ ID NO: 83260

SEQ ID NO: 122341 - RNA, 64 nt, Human; identical to SEQ ID NO: 83261

SEQ ID NO: 122342 - RNA, 64 nt, Human; identical to SEQ ID NO: 83262

SEQ ID NO: 122343 - RNA, 64 nt, Human; identical to SEQ ID NO: 83263

SEQ ID NO: 122344 - RNA, 64 nt, Human; identical to SEQ ID NO: 83264

SEQ ID NO: 122345 - RNA, 64 nt, Human; identical to SEQ ID NO: 83265

SEQ ID NO: 122346 - RNA, 64 nt, Human; identical to SEQ ID NO: 83266

SEQ ID NO: 122347 - RNA, 64 nt, Human; identical to SEQ ID NO: 83267

SEQ ID NO: 122348 - RNA, 64 nt, Human; identical to SEQ ID NO: 83268

SEQ ID NO: 122349 - RNA, 64 nt, Human; identical to SEQ ID NO: 83269

SEQ ID NO: 122350 - RNA, 64 nt, Human; identical to SEQ ID NO: 83270

SEQ ID NO: 122351 - RNA, 64 nt, Human; identical to SEQ ID NO: 83271

SEQ ID NO: 122352 - RNA, 64 nt, Human; identical to SEQ ID NO: 83272

SEQ ID NO: 122353 - RNA, 64 nt, Human; identical to SEQ ID NO: 83273

SEQ ID NO: 122354 - RNA, 53 nt, Human; identical to SEQ ID NO: 83274

SEQ ID NO: 122355 - RNA, 64 nt, Human; identical to SEQ ID NO: 83275

SEQ ID NO: 122356 - RNA, 64 nt, Human; identical to SEQ ID NO: 83276

SEQ ID NO: 122357 - RNA, 64 nt, Human; identical to SEQ ID NO: 83277

SEQ ID NO: 122358 - RNA, 64 nt, Human; identical to SEQ ID NO: 83278

SEQ ID NO: 122359 - RNA, 64 nt, Human; identical to SEQ ID NO: 83251

SEQ ID NO: 122360 - RNA, 64 nt, Human; identical to SEQ ID NO: 83252

SEQ ID NO: 122361 - RNA, 64 nt, Human; identical to SEQ ID NO: 83253

SEQ ID NO: 122362 - RNA, 64 nt, Human; identical to SEQ ID NO: 83254

SEQ ID NO: 122363 - RNA, 64 nt, Human; identical to SEQ ID NO: 83255

SEQ ID NO: 122364 - RNA, 64 nt, Human; identical to SEQ ID NO: 83256

SEQ ID NO: 122365 - RNA, 64 nt, Human; identical to SEQ ID NO: 83257

SEQ ID NO: 122366 - RNA, 64 nt, Human; identical to SEQ ID NO: 83258

SEQ ID NO: 122367 - RNA, 64 nt, Human; identical to SEQ ID NO: 83259

SEQ ID NO: 122368 - RNA, 64 nt, Human; identical to SEQ ID NO: 83260

SEQ ID NO: 122369 - RNA, 64 nt, Human; identical to SEQ ID NO: 83261

SEQ ID NO: 122370 - RNA, 64 nt, Human; identical to SEQ ID NO: 83262

SEQ ID NO: 122371 - RNA, 64 nt, Human; identical to SEQ ID NO: 83263

SEQ ID NO: 122372 - RNA, 64 nt, Human; identical to SEQ ID NO: 83264

SEQ ID NO: 122373 - RNA, 64 nt, Human; identical to SEQ ID NO: 83265

SEQ ID NO: 122374 - RNA, 64 nt, Human; identical to SEQ ID NO: 83266

SEQ ID NO: 122375 - RNA, 64 nt, Human; identical to SEQ ID NO: 83267

SEQ ID NO: 122376 - RNA, 64 nt, Human; identical to SEQ ID NO: 83268

SEQ ID NO: 122377 - RNA, 64 nt, Human; identical to SEQ ID NO: 83269

SEQ ID NO: 122378 - RNA, 64 nt, Human; identical to SEQ ID NO: 83270

SEQ ID NO: 122379 - RNA, 64 nt, Human; identical to SEQ ID NO: 83271

SEQ ID NO: 122380 - RNA, 64 nt, Human; identical to SEQ ID NO: 83272

SEQ ID NO: 122381 - RNA, 64 nt, Human; identical to SEQ ID NO: 83273

SEQ ID NO: 122382 - RNA, 53 nt, Human; identical to SEQ ID NO: 83274

SEQ ID NO: 122383 - RNA, 64 nt, Human; identical to SEQ ID NO: 83275

SEQ ID NO: 122384 - RNA, 64 nt, Human; identical to SEQ ID NO: 83276

SEQ ID NO: 122385 - RNA, 64 nt, Human; identical to SEQ ID NO: 83277

SEQ ID NO: 122386 - RNA, 64 nt, Human; identical to SEQ ID NO: 83278

SEQ ID NO: 122387 - RNA, 64 nt, Human
aucugggugucuucgggggcccgucuggaagggcugcagcaauuccccugugucuccagguaac

SEQ ID NO: 122388 - RNA, 64 nt, Human
gugauaagccucucuucggcaucugaggagcagcugcagcaaaaucuagggguguaaguguauc

SEQ ID NO: 122389 - RNA, 64 nt, Human
cuuuuucucccaaagucuucucaagucuuaggauugcagcaacacgcucggcugcccaaaccca

SEQ ID NO: 122390 - RNA, 64 nt, Human
ggucgugggaaauaaaaggcaguucuacacagacugcagcaacgguugcaucugcauauccuaa

SEQ ID NO: 122391 - RNA, 64 nt, Human
agaauggagaucuccucucaucagucucaccuccugcagcaacugaacgagcagcgcaggcaag

SEQ ID NO: 122392 - RNA, 64 nt, Human
ccccuuccacuuccaucagggcuauuccgcagcuugcagcaagcacagagugugaccucccagg

SEQ ID NO: 122393 - RNA, 64 nt, Human
augacucagccugggggcuggugccggccuugccugcagcaauguagcugaggacuggucugaa

SEQ ID NO: 122394 - RNA, 64 nt, Human
cuuuugaaagugucccaguaacaacgcacccagcugcagcaaggagguggggaaggagggcacc

SEQ ID NO: 122395 - RNA, 64 nt, Human
agccagaggaugucagcugccaauuguguuuuccugcagcaauuccauaaacacauccuggugu

SEQ ID NO: 122396 - RNA, 64 nt, Human
uguugcaacuuuucacuucucuuguguccagguaugcagcaaaauucugcaauuucaccuuaaa

SEQ ID NO: 122397 - RNA, 64 nt, Human
gccuccaccuccuggauucaagagauuccaggggugcagcaagugcuuucuaugcguuucuuca

SEQ ID NO: 122398 - RNA, 64 nt, Human
gcaggagaaucgcuugaacccgggagguggagguugcagcaagccgagauugugccacuguacu

SEQ ID NO: 122399 - RNA, 64 nt, Human
ucugugggauuuucaaaaugcuaaagacucacacugcagcaaucaucccagaugauuaaauuca

SEQ ID NO: 122400 - RNA, 64 nt, Human
aggggacucgacuugcgggaugcaguuuugccauugcagcaaaguucauugaggaaaauuguac

SEQ ID NO: 122401 - RNA, 64 nt, Human
cucugggaugccagcucuccccuuugugcuucccugcagcaacccauggagggcccagggugcc

SEQ ID NO: 122402 - RNA, 64 nt, Human
uggccaugcaggaguucaugguccucccagucggugcagcaaacuucagggaagccaugcccau

SEQ ID NO: 122403 - RNA, 64 nt, Human
cucaaugcuugguguucuaguucaacuuuuauccugcagcaaguaagccuagauaacucuacac

SEQ ID NO: 122404 - RNA, 64 nt, Human
agaccaaguauggggaaaaccaggcaccagccucugcagcaaugggucccucuagccuguggac

SEQ ID NO: 122405 - RNA, 64 nt, Human
uuuuuaaaaaguuucacgucuucgccaaucacagugcagcaaggccaauucucgcagaaacccc

SEQ ID NO: 122406 - RNA, 64 nt, Human
cgcauugagggccucagcuuuauauaguucaaaaugcagcaaacuuuucagaaagccacguaaa

SEQ ID NO: 122407 - RNA, 64 nt, Human
gcuuuacagagaagcauauauuuuuuauuaacagugcagcaauaucuauaaugacugagaggau

SEQ ID NO: 122408 - RNA, 64 nt, Human
uacuaggaaaggagcacuuaggaggcucuugggaugcagcaagucccaggcaaugccagcauuu

SEQ ID NO: 122409 - RNA, 64 nt, Human
caauauacccuguauuucuuacacgccacuuauaugcagcaaggaguaaauguguuacuagauu

SEQ ID NO: 122410 - RNA, 64 nt, Human
uuacaauggguagagcacaccgcaugucagucuaugcagcaaaagcacagagacuuaagacuac

SEQ ID NO: 122411 - RNA, 64 nt, Human
agagccccgagaauuccucuucuggaucccaguuugcagcaaaccccacaccccagcucacaca

SEQ ID NO: 122412 - RNA, 64 nt, Human
aggagcagcaucauucagcaaaugccuuuucaaaugcagcaaucccacuuagcagggacaggag

SEQ ID NO: 122413 - RNA, 64 nt, Human
guaaauacuacuuuagccauccaaggccaccuucugcagcaaaaggcuuuuguggagaaccuuu

SEQ ID NO: 122414 - RNA, 64 nt, Human
cacaccauucucccccccucaacagcacacucagugcagcaagacugaccccugacccccuccc

SEQ ID NO: 122415 - RNA, 54 nt, Human
acuuugauguuuauuccuaguugcugcagcaauucucaccuuucuugcacauca

SEQ ID NO: 122416 - RNA, 64 nt, Human
gugauuuauguuuaauuacagaagccuauugccuugcagcaauuuuguuguuauaauacugauu

SEQ ID NO: 122417 - RNA, 64 nt, Human
guugugaugagcagccccuuggaggcugugagguugcagcaaaguuuuaaguuuaccuuguguc

SEQ ID NO: 122418 - RNA, 64 nt, Human
acuugccaaaauugagaaucagagauguguaaaaugcagcaaauuaauuauaauguaaguuaag

SEQ ID NO: 122419 - RNA, 64 nt, Human
cauugucaugcaguaguaguaaaaacaucaaagaugcagcaagcuuauuaaguauuauuuucua

SEQ ID NO: 122420 - RNA, 64 nt, Human
ugaauucaacuggacacucuguaaaaugcugcacugcagcaaaaacaaaaccaccaccacccca

SEQ ID NO: 122421 - RNA, 64 nt, Human
gggcaacugccuggugaaugugucuugcggcagcugcagcaaguggaggggcugaacuacuggc

SEQ ID NO: 122422 - RNA, 64 nt, Human
uuccugauucccaugagaaaucagaacugcuuucugcagcaaaucagggcuucccccuaacauc

SEQ ID NO: 122423 - RNA, 64 nt, Human
agucaggagcccgcuuuguauuagcagguuugcaugcagcaaaaaaacaguuaugugagcaguu

SEQ ID NO: 122424 - RNA, 64 nt, Human
guagagggaguaaaaaagugcauggauaaaugacugcagcaaaucacaaauuuugaacuuugac

SEQ ID NO: 122425 - RNA, 64 nt, Human
guuuuaaguugcucaguuuuggucuaacuuguuaugcagcaauagauaaauaauaugcagagaa

SEQ ID NO: 122426 - RNA, 64 nt, Human
ucugcuuucugauguugccuuaauauucugcuauugcagcaauuaaaaauugucuucauguaca

SEQ ID NO: 122427 - RNA, 64 nt, Human
aaaggaaauuucauggauuaaaccauggguuuaaugcagcaaggaaacuuacaaugucccuuua

SEQ ID NO: 122428 - RNA, 64 nt, Human
ccgcgccaaccucccucccccccagugccuaugacggcggcacagcagccagcgggugggggac

SEQ ID NO: 122429 - RNA, 64 nt, Human
agucucucaaauuaggccagauucuaaaacaugcugcagcaagaggaccccgcucucuucagga

SEQ ID NO: 122430 - RNA, 64 nt, Human
cccagauaaguguguguuuuauacugcaacaauaugcagcaaugguaagcguaaaguuuuuuuu

SEQ ID NO: 122431 - RNA, 64 nt, Human
uagucacucugggucaucagcaugucccagucacugcagcaacgccuuguguuuguuucauuuu

SEQ ID NO: 122432 - RNA, 64 nt, Human
uuguuucuugcugugacugaaacaagaagguuauugcagcaaaaaucaguaacaaaaaauagua

SEQ ID NO: 122433 - RNA, 64 nt, Human
guucucuccccugccgcugagagggccucuccccugcagcaaacguuugccugggcauugaggc

SEQ ID NO: 122434 - RNA, 64 nt, Human
gacuacauguauuacaaagucucuuuggcaagauugcagcaagaucaugugcauaucaucccau

SEQ ID NO: 122435 - RNA, 64 nt, Human
auguaaaaaaaaaaaaaaaaaagacucuacuucgugcagcaauugcuacucuauacgaauuguc

SEQ ID NO: 122436 - RNA, 64 nt, Human
auuugacccauuuuaauguguacaacuuuaaaagugcagcaauuuauuaauuaaucuuauuuga

SEQ ID NO: 122437 - RNA, 64 nt, Human
cccaugggugaccucuggaggcaguggaccaagaugcagcaaggagaggaugcagaacagcuuc

SEQ ID NO: 122438 - RNA, 64 nt, Human
ucccaaaucaggguagcaaucuuguugccacaugugcagcaaacaaaguggaaguauagaucuu

SEQ ID NO: 122439 - RNA, 64 nt, Human
uuuugucugguccugaucccagacucaccccaucugcagcaagacccuuggcuggcuuccuccg

SEQ ID NO: 122440 - RNA, 64 nt, Human
acuguaauguuaauaauagucaccugcuguuggaugcagcaauaauuucuguaugguccauagc

SEQ ID NO: 122441 - RNA, 64 nt, Human
aacuauuuuguggaaacaagccaacuaguaacaaugcagcaacacuucugguuuagcuaaauua

SEQ ID NO: 122442 - RNA, 64 nt, Human
uacaguucuuuucaaccuacuuucauacugaagaugcagcaaaaugugaaugggaaaagagaug

SEQ ID NO: 122443 - RNA, 64 nt, Human
uguuguauacuguaaauuacaguauaaugccaaaugcagcaaaaucuuccagcuguacguuaca

SEQ ID NO: 122444 - RNA, 64 nt, Human
uuuagaagcgcucaucuggcuuuucgcuugcuucugcagcaacucccacgacuguuguacaagc

SEQ ID NO: 122445 - RNA, 64 nt, Human
cgggcccgccuggagcugcguuucgcggcggcggcggcggcagccccggagggcggcugggagc

SEQ ID NO: 122446 - RNA, 64 nt, Human
auuuccucaaguuuccaugugcgguucuccuagcugcagcaauacuuugacauuuaaagagaaa

SEQ ID NO: 122447 - RNA, 64 nt, Human
agaggagagaggccugagucaccuagcauaggguugcagcaagcccuggauucagaguguuaaa

SEQ ID NO: 122448 - RNA, 64 nt, Human
cagagggucgguggaggggucauucaccugccccugcagcaagcaaaaguugucuguggugcca

SEQ ID NO: 122449 - RNA, 64 nt, Human
aauuccuccagagacacugagccagucuuugaacugcagcaaucacaaaggcugacauucacug

SEQ ID NO: 122450 - RNA, 64 nt, Human
acaaccaaagugagcuggaucuuugaagcacaaaugcagcaaauccuucacccugcuuuauaag

SEQ ID NO: 122451 - RNA, 64 nt, Human
auuagaagggcugaauaaagggaacaugcagcucugcagcaauauucugauaauguauugcagu

SEQ ID NO: 122452 - RNA, 64 nt, Human
uuucuuuuuuucuuuucuuuucuuuuuuuuuuuuugcagcaaccauuaauaaaugccaccacau

SEQ ID NO: 122453 - RNA, 64 nt, Human
aaaccugaauguaccuacuagggcaccauaauacugcagcaagaccaaagugguaaagaaacac

SEQ ID NO: 122454 - RNA, 64 nt, Human
guagaccauaauucaguccuuuagauuuauuuuaugcagcaaaaagaagcucuuuuuuuuuuuu

SEQ ID NO: 122455 - RNA, 64 nt, Human
gaaggagcugcauuaauucuggaagacgacuccaugcagcaacuacugaagaaaggaccagacu

SEQ ID NO: 122456 - RNA, 64 nt, Human
guguaccuuuuugcuaaaacacuuauuacccuucugcagcaaaggcauuaaaagcgcuaagcau

SEQ ID NO: 122457 - RNA, 64 nt, Human
gauuuuucuguaacugucaccugaaauaauacauugcagcaagcaauaaacacaacauuuugua

SEQ ID NO: 122458 - RNA, 64 nt, Human
auucaaucaccaccagguaucaaaucaacuuuuaugcagcaaauauaugauucuagugucugac

SEQ ID NO: 122459 - RNA, 64 nt, Human
gauucucucccuacuacagcuggcaaaguugguuugcagcaagaagauagugggagggggccag

SEQ ID NO: 122460 - RNA, 64 nt, Human
gaacacggcucuagauaaggaggggcagauuuucugcagcaagcacugucaagacagcggcagg

SEQ ID NO: 122461 - RNA, 64 nt, Human
cagacccccgccauccucgcagagugggagaggcugcagcaaggcuuugccucugcagacccca

SEQ ID NO: 122462 - RNA, 64 nt, Human
ggaaggaguggcugcucuccaaacuaugccaaggcggcggcagagcuggucuucuggucuccuu

SEQ ID NO: 122463 - RNA, 64 nt, Human
aaauaaaacagaggauacuacaggcugggaaagcugcagcaaagggagacuagagagagauuug

SEQ ID NO: 122464 - RNA, 64 nt, Human
cauauucaccuuuugucauuuguuugcuuucucuugcagcaaaaauaauaugaggucaucaagg

SEQ ID NO: 122465 - RNA, 64 nt, Human
agaugaugcucuugcacuugagaugacaucuucuugcagcaagagugcugauaucccaagagga

SEQ ID NO: 122466 - RNA, 64 nt, Human
gcugggcuucauaccugggugaugagaugaucugugcagcaaagcaccaugguacauguuuacc

SEQ ID NO: 122467 - RNA, 50 nt, Human
gcaugcugagaugugaaugaugcagcaaccuggauuuggcuuugacuaua

SEQ ID NO: 122468 - RNA, 64 nt, Human
ugauuuaaagcauuauccaaauuaaauuaucauuugcagcaaacuguacaacagcaggaaggau

SEQ ID NO: 122469 - RNA, 64 nt, Human
cucaggaugaacucucugagcagggaccugcuccugcagcaaccaaacuuggagugguuauugc

SEQ ID NO: 122470 - RNA, 64 nt, Human
cccacuuaguccacucugagucgauuaaccugcaugcagcaacacccaaguccaccccaauuaa

SEQ ID NO: 122471 - RNA, 64 nt, Human
ugaucugaauccaugggcauaccuguguugcaggugcagcaauugcuuggugagcugugcagaa

SEQ ID NO: 122472 - RNA, 64 nt, Human
ugcacaauaaacagaaaacuuugcuuauuucuuuugcagcaauaagcaugcauaauaagucaca

SEQ ID NO: 122473 - RNA, 64 nt, Human
ggguuucaaugugcccuuaaaauugugcuggggcugcagcaaauaaauaauauugggacucaua

SEQ ID NO: 122474 - RNA, 64 nt, Human
auucuacuuaauuauuugugaaucaguaaccagaugcagcaaauaucuaggcaauguggacuac

SEQ ID NO: 122475 - RNA, 64 nt, Human
ccaucucuuucauuucugcuugaagccccuuggcugcagcaauccugucugccauagguuucuu

SEQ ID NO: 122476 - RNA, 64 nt, Human
ggaaaccugguucucuucugacaucuaagaagacugcagcaaggucagagguuuuagccuccug

SEQ ID NO: 122477 - RNA, 64 nt, Human
acaagacaaaccaagucggaacagcagauaacaaugcagcaaggcccugcugcccaaucuccau

SEQ ID NO: 122478 - RNA, 64 nt, Human
uguacuucauagcuggagaauggggaaagaaaucugcagcaaaggggucucacucuguugccag

SEQ ID NO: 122479 - RNA, 64 nt, Human
ggcccugguuucgagucucugucacagccucuuccggcggcagcgugcaccgggcgggccuccg

SEQ ID NO: 122480 - RNA, 64 nt, Human
gcauuguggugagccugccuguuguccacguggcugcagcaagcaaacauggguuuuccuugga

SEQ ID NO: 122481 - RNA, 64 nt, Human
caugucuuugaggucugcuaauauggaauggaacugcagcaaaugcaaacuugaagucaugcaa

SEQ ID NO: 122482 - RNA, 64 nt, Human
caaggcgaagggcaaguagaagccuggauuaguuugcagcaacucaaucccaaaggaaccaaag

SEQ ID NO: 122483 - RNA, 64 nt, Human
aagcucuuaaggagaauuguauuucuccagaagcugcagcaagagguacagcucaacaaaggaa

SEQ ID NO: 122484 - RNA, 64 nt, Human
cuuuuaaacuucauaaccuuuuuauaaaaguuguugcagcaaaauaauagccucgguucuaugc

SEQ ID NO: 122485 - RNA, 64 nt, Human
ugaaaccaaaggcaguggggguccaaacucguggugcagcaagucacaccagacaggaaacgaa

SEQ ID NO: 122486 - RNA, 64 nt, Human
caguuccugacauaguaaaguuugcuuucauaacugcagcaaaaaaggucaacuugccaaguca

SEQ ID NO: 122487 - RNA, 64 nt, Human
ccuagcuugccguaaugauucuauaaugccaucaugcagcaauuaugagaggcuaggucaucca

SEQ ID NO: 122488 - RNA, 64 nt, Human
caaaagauguuuuuagaguuguaaaaaccauauuugcagcaaagauuuacaaaggcguaucaga

SEQ ID NO: 122489 - RNA, 64 nt, Human
uuucaucccuucacaaaauuuuguuucacauucaugcagcaaauaugggcugaggugccagacc

SEQ ID NO: 122490 - RNA, 64 nt, Human
cuuauuuugaucacugucucaaauuuaaaaauucugcagcaaccuggcucugugugguguuuuc

SEQ ID NO: 122491 - RNA, 64 nt, Human
ucaaaacagagggcucuauacuccuuagugugacugcagcaaacuuugguguaaaauuccacca

SEQ ID NO: 122492 - RNA, 64 nt, Human
auucucacaguaaauauuuacggaguuuucaaauugcagcaaauauacuguaugagaaaauauu

SEQ ID NO: 122493 - RNA, 64 nt, Human
aauuauaaucaaaauuaguuuuauugaugcuugcugcagcaagagagacugcacaccacugggg

SEQ ID NO: 122494 - RNA, 64 nt, Human
uuguagguccagaagagugaaagagagggaggggugcagcaacaugugcacaggcacgcacaug

SEQ ID NO: 122495 - RNA, 64 nt, Human
ccccucacccugcaucacugaagagcggcgccucugcagcaagcagggcuucaggaggugcccg

SEQ ID NO: 122496 - RNA, 64 nt, Human; identical to SEQ ID NO: 120464

SEQ ID NO: 122497 - RNA, 64 nt, Human
cuccggcuuggcagacucagccugucaccccaaaugcagcaauggccuggugauucccacacau

SEQ ID NO: 122498 - RNA, 64 nt, Human
guacuuauauauggaucucuguagacuagagucuugcagcaacacagaauguaauauaaggcaa

SEQ ID NO: 122499 - RNA, 64 nt, Human
agaaagaagaaacaauaaauauucugcagauuaaugcagcaaagaaagaagguugguagugaaa

SEQ ID NO: 122500 - RNA, 64 nt, Human
gcagcuugucccccgaccuucaggaauggcagccugcagcaacuggaacaaggccccaccguaa

SEQ ID NO: 122501 - RNA, 64 nt, Human
uacuaaaaaguuagaauaaugugcaugggaacagugcagcaacaugcuagaaaauccucacugc

SEQ ID NO: 122502 - RNA, 64 nt, Human
cgacugugucacuuaaaauauuaguaaaccaugaugcagcaacugcuaagagcuaaacuaacaa

SEQ ID NO: 122503 - RNA, 64 nt, Human
agagauguuccccugagcugauucccagugacagugcagcaagacuagugggacuccucuuucc

SEQ ID NO: 122504 - RNA, 64 nt, Human
acugguaaaggcugauuucuaaauuuucuguaauugcagcaaccuuucucuccugucuacccuu

SEQ ID NO: 122505 - RNA, 64 nt, Human
agaucaucucccauccuccccagcgccaucugugugcagcaaccagaaagggaugaacuuggcc

SEQ ID NO: 122506 - RNA, 64 nt, Human
uaagauaccuuuuuuuuccuuucuuuguguguagugcagcaacaguuuggucugcauuuguuag

SEQ ID NO: 122507 - RNA, 64 nt, Human
cccacugccugacuuccugccacacgguuaaugcugcagcaacaccgacugcuucaucuucccu

SEQ ID NO: 122508 - RNA, 64 nt, Human
guuccaccgggaauuagaaauaccaucugccauaugcagcaagggaucugcagacuuuuuuucu

SEQ ID NO: 122509 - RNA, 64 nt, Human
uccuucccuccuuuuaaaauuuuguguuccuuuuugcagcaauuacucacuaaagggcuucauu

SEQ ID NO: 122510 - RNA, 64 nt, Human
cuggauugccaugggaaacauuuuuuggcauuaaugcagcaacauaauacucacuuuagguauu

SEQ ID NO: 122511 - RNA, 64 nt, Human
gcaucccacagacuauuucccucauccuauuuacugcagcaaaucucuccuuaguugaugagac

SEQ ID NO: 122512 - RNA, 64 nt, Human
cccuguaauuuaauuugaagauucuuuaacagauugcagcaaaguucauuauaaaacuguuaug

SEQ ID NO: 122513 - RNA, 64 nt, Human; identical to SEQ ID NO: 121900

SEQ ID NO: 122514 - RNA, 64 nt, Human
uagaaaugcgagcugugguuaggcuugguuagagugcagcaagcaacaugacagaugguggcac

SEQ ID NO: 122515 - RNA, 64 nt, Human
uacauggaguuagugucuauucuuuuuccccuuuugcagcaacuuacacagcauuuuuaacacc

SEQ ID NO: 122516 - RNA, 64 nt, Human
aaacaagcuugauuuuucuagcauccucuuaaugugcagcaaaagcaggcgacaaaaucuccug

SEQ ID NO: 122517 - RNA, 64 nt, Human
gguuuguuguuuaaccuuagcgagauccuuuaacugcagcaauauucaagccagauauuuggaa

SEQ ID NO: 122518 - RNA, 64 nt, Human
cgcuauaauguaaaaucagauuucagaaggaaaaugcagcaaggacugacuguaguccuauuuc

SEQ ID NO: 122519 - RNA, 64 nt, Human
agccagcacuugcucccuggaguucggaagccauugcagcaaccuuccuucucagccagccuac

SEQ ID NO: 122520 - RNA, 64 nt, Human
uuuaagugccgggugaauuuuggaccucuggaugugcagcaaguuuuuaugcaauaagccuucc

SEQ ID NO: 122521 - RNA, 64 nt, Human
uccugguucauaagauggauuuggagguuauuucugcagcaaacuuggguccuguguguucaaa

SEQ ID NO: 122522 - RNA, 64 nt, Human
uguggcuuuugucaagcacuuagauggauauaaaugcagcaacuuguuuuaaaaaaaugcacaa

SEQ ID NO: 122523 - RNA, 64 nt, Human
cuuuaaucugugaccauugggcaaaaaauuuuccugcagcaaaagucugaggcuguugggacca

SEQ ID NO: 122524 - RNA, 64 nt, Human
uccauccagcgacaagccaugggcaugcauacaaugcagcaagaccaacacaagagcaauauug

SEQ ID NO: 122525 - RNA, 64 nt, Human
gacucuagcuacuuaaugguucuguucuuuuauaugcagcaaacacaccguccauuucugaaga

SEQ ID NO: 122526 - RNA, 64 nt, Human
uggaggaacuaccuggccaaaacacuggccaggaugcagcaagcagcagcaggggcugacagca

SEQ ID NO: 122527 - RNA, 64 nt, Human
gccuggccacagaggagccuccuaaggcagcagcugcagcaagcgcacccucuccccacucucc

SEQ ID NO: 122528 - RNA, 64 nt, Human
uuccuucauccucugagggcuauuuuguacuuucugcagcaaucagcuuaauaacaacacuuau

SEQ ID NO: 122529 - RNA, 64 nt, Human
cugagauuucuaauuguguugugaaaaugauaaaugcagcaaaucuagcuuucaguauuccuaa

SEQ ID NO: 122530 - RNA, 64 nt, Human
acgaugaccuugaauaaaaauugcacacacucagugcagcaauauauuaccagcaagaauaaaa

SEQ ID NO: 122531 - RNA, 64 nt, Human
gguuuccuaaacuggaacuggacccaggaugcuuugcagcaacgcccuaggauuugcagugaau

SEQ ID NO: 122532 - RNA, 64 nt, Human
cauagcuccgucaagcugccuggaugagcgcccaugcagcaaggcuuggaggaagcgucagugc

SEQ ID NO: 122533 - RNA, 64 nt, Human
caucaugauuuuuagauuucccaguuggaacuugugcagcaaaguuugggagcuacugauggac

SEQ ID NO: 122534 - RNA, 64 nt, Human
cuuuuacagaauugaugugcuaacugaauaucauugcagcaacuagacuaagauauucaagauc

SEQ ID NO: 122535 - RNA, 64 nt, Human
gccuuuucauuucaagcauaaggcaauaaauaccugcagcaacgugggagaaagaaguugcugg

SEQ ID NO: 122536 - RNA, 64 nt, Human
acgucugugcuaauuuaaacugccaaauauugacugcagcaaacaagaauuauauucagaauuu

SEQ ID NO: 122537 - RNA, 64 nt, Human
ccaaaaucacugaagaaaaucgcuggcaucagugugcagcaaauuuguucuuuugguuucauca

SEQ ID NO: 122538 - RNA, 64 nt, Human
gguuuccuaaacuggaacuggacccaggaugcuuugcagcaacgcccuaggguuugcagugaau

SEQ ID NO: 122539 - RNA, 64 nt, Human
auucauagcuuauccuucagagcaaugaccugcaugcagcaauaucaaacaucagcuaaccgaa

SEQ ID NO: 122540 - RNA, 64 nt, Human
uugccaccaccuuuccuuccaggcccuaagcacgugcagcaaagcacaccacagcaccuuugau

SEQ ID NO: 122541 - RNA, 64 nt, Human
uugagacuacucacugguuggaagaauauaguauugcagcaaauccuguaugaaagagagaugu

SEQ ID NO: 122542 - RNA, 64 nt, Human
cuauaauaagauaccguggcucuuaugcagauauugcagcaagccuuguuugguuuggauuuuu

SEQ ID NO: 122543 - RNA, 64 nt, Human
uuacagguuuugugagauugagagaacuaugaccugcagcaacucuggaaaccuggccugacag

SEQ ID NO: 122544 - RNA, 64 nt, Human
guguugaaugaaaauauguggacugucauuuuguugcagcaaaaaaguguuaauaaaaugcucu

SEQ ID NO: 122545 - RNA, 64 nt, Human
aacucaccaagaaagaauucaauacugugaaauaugcagcaagaagauuggucuuuaccuaggc

SEQ ID NO: 122546 - RNA, 64 nt, Human
auuaacuuucccugaugccgacgccccugcccccugcagcaauaagaugcucggauucacucug

SEQ ID NO: 122547 - RNA, 64 nt, Human
gacugcuguuugacuccugcauaccaagauauucugcagcaaugucuuuaaacagugccgguag

SEQ ID NO: 122548 - RNA, 64 nt, Human
ccaagucucauaaaugauaugagugaucuaaauuugcagcaaugauacuaaacaacucucugaa

SEQ ID NO: 122549 - RNA, 64 nt, Human
acuucccauaggaagcaccugagagauaguaaacugcagcaaguaacuauguguaaguccucau

SEQ ID NO: 122550 - RNA, 64 nt, Human
guguuacaguauuauuuuaauuggccucaaugguugcagcaaucagagucccagcguuuguacu

SEQ ID NO: 122551 - RNA, 64 nt, Human
acauuuugaaaggauguauguuagauauauuauuugcagcaagaaguucauucugugcaauaug

SEQ ID NO: 122552 - RNA, 64 nt, Human
agaagccauaacaaagcuguguacuaauaaagacugcagcaagcacuuguguuauuuaaauuau

SEQ ID NO: 122553 - RNA, 64 nt, Human
agaaaggauguuuaggggaacaugaggcuggcucugcagcaacaaccaggcuccccugcauccc

SEQ ID NO: 122554 - RNA, 64 nt, Human
ccagcuccuuucccccuggguuuccuuggcuuccugcagcaaauugggcaguucucugccccuu

SEQ ID NO: 122555 - RNA, 64 nt, Human
cugaggcccuguaaaaggagugaguuaggacagaugcagcaagauauuaggacagauuucgccc

SEQ ID NO: 122556 - RNA, 64 nt, Human
guuuccuaggucugaaucugcgaguagaugaaccugcagcaagcagcguuuauggugcuuccuu

SEQ ID NO: 122557 - RNA, 64 nt, Human
aaauuucaggaacaccagcguuagcuguaaaaguugcagcaauuuauuggcuagucauagaaaa

SEQ ID NO: 122558 - RNA, 64 nt, Human
acugggcccaaauauucuuuguaaagaaaaucgcugcagcaaaaacuguuacuguguuuauuau

SEQ ID NO: 122559 - RNA, 64 nt, Human
uguuauaugucaaguuuaaagcagggcacauuguugcagcaaaauguguauuugacaaauuaua

SEQ ID NO: 122560 - RNA, 64 nt, Human
aaacuuguaaagaaaaagauuccaguucaguauuugcagcaagaagcuugaaugcuguucuuuu

SEQ ID NO: 122561 - RNA, 64 nt, Human
guucauuuugcaggcgcauucgcccuuccuaguuugcagcaauuaaagauaacggaguguaaag

SEQ ID NO: 122562 - RNA, 64 nt, Human; identical to SEQ ID NO: 122007

SEQ ID NO: 122563 - RNA, 64 nt, Human
ccuugcugccagggggcagggaugcuuuccagccugcagcaacagaacacuugaccuuaaaagu

SEQ ID NO: 122564 - RNA, 64 nt, Human
agaaaaggagccaagaacuggcggguggugugugugcagcaaaggcauugggggcacgggugag

SEQ ID NO: 122565 - RNA, 64 nt, Human
gcuaagaaccugcugcaagucacugccuuccaagugcagcaacccagcccauggagauugccuc

SEQ ID NO: 122566 - RNA, 64 nt, Human
acacuagcuguucugcucauauaugaauuuuuaaugcagcaauguugacuuuguuucauacugc

SEQ ID NO: 122567 - RNA, 64 nt, Human
ucuaaaccuauuuuuauagauguuauuuaaauaaugcagcaauaucaccucuuauugacaauac

SEQ ID NO: 122568 - RNA, 64 nt, Human
ucaccccuguaagccagacaguuuguucaaaaccugcagcaaagagaagcaucagucuaacaag

SEQ ID NO: 122569 - RNA, 64 nt, Human
gaacacucaagcuuuuuucaggguguuuggcucuugcagcaaaacaauugagaugcuaacaggg

SEQ ID NO: 122570 - RNA, 64 nt, Human
auaucugcaggggugucuaaaaguguguucauuuugcagcaauguuuaggugcauaguucuacc

SEQ ID NO: 122571 - RNA, 64 nt, Human
aaggguauguuucacuucuugacaauauaaaugcugcagcaaagaugagaggugaaguaaaacc

SEQ ID NO: 122572 - RNA, 64 nt, Human
gaucaaguaguuguggagagaugagaagaauauaugcagcaaaggugcugugagcccaguucca

SEQ ID NO: 122573 - RNA, 64 nt, Human
caucaaguuuguacacucuuuucucucccuguuuugcagcaacaaauugcgaagugcuuuuguu

SEQ ID NO: 122574 - RNA, 64 nt, Human
gaaaauauccuaucacgcugauuuuugaccucacugcagcaauuuucaguuauuccagauuauc

SEQ ID NO: 122575 - RNA, 64 nt, Human
cacacccaaaaucaagggccuggaugccagcagcugcagcaagcagguuuuuccucccuguuga

SEQ ID NO: 122576 - RNA, 64 nt, Human
uauaagaucgaauuuaauuuccuuucccucauucugcagcaaucagaauacacaaucuuaacca

SEQ ID NO: 122577 - RNA, 64 nt, Human
acaaaaucaggaauaacuuuguuuuuauacugauugcagcaauguuggcuacauguauuauuaa

SEQ ID NO: 122578 - RNA, 64 nt, Human
aagaaauuuguauguuuguuaaaguugcauuuauugcagcaaguuacaaagggaaaguguugaa

SEQ ID NO: 122579 - RNA, 64 nt, Human; identical to SEQ ID NO: 122428

SEQ ID NO: 122580 - RNA, 64 nt, Human
ggcaaaaacugccaauaggaggacugcccgacacugcagcaagauugaggauaagauggaaggc

SEQ ID NO: 122581 - RNA, 64 nt, Human
uaagaaaauuaaauucagcuucaggccuuuaaacugcagcaagauggugguguagggguguggg

SEQ ID NO: 122582 - RNA, 64 nt, Human
auuuuagccaaaacaacugguuauaugccucccuugcagcaagcacuacaauguaugugaucgu

SEQ ID NO: 122583 - RNA, 64 nt, Human
ugaagucaagguuuauuuucacaugaguccagcuugcagcaaguaaucuucaaauauuccagua

SEQ ID NO: 122584 - RNA, 64 nt, Human
aagagaucuggaaaucuuuuaaucaguuaaauugugcagcaauagauuuuuaacuuuaacugac

SEQ ID NO: 122585 - RNA, 64 nt, Human
ucagaccaaccaucauuaauguuaauagaggaaaugcagcaacgucaaaagcaaggcagguugg

SEQ ID NO: 122586 - RNA, 64 nt, Human
ucaaguuugguugccaaauggaaggggccauagcugcagcaauugcugacauauuaaaugacuc

SEQ ID NO: 122587 - RNA, 64 nt, Human
ugaacuacuucauaacuugucaagaaaagcaguuugcagcaagggcauguggugugcaccuagu

SEQ ID NO: 122588 - RNA, 64 nt, Human
cauuuuuugggcucuggauaaggaauuaaaggagugcagcaauaacugcacugucuaaaaguuu

SEQ ID NO: 122589 - RNA, 64 nt, Human
uuuggcaacaucagaacuugccacauguagcuacugcagcaaggcuucuguguacuugccugaa

SEQ ID NO: 122590 - RNA, 64 nt, Human
ccuaggcagugaguaaauaccucagauguccuccugcagcaagugucuauauguugugguuauu

SEQ ID NO: 122591 - RNA, 64 nt, Human
aaacuaaauccuucuguguccccggcagccucagugcagcaacagaagccaagggagaaugcug

SEQ ID NO: 122592 - RNA, 64 nt, Human
accacccaacuucauccaggaauacagucugcagugcagcaacagaaccgcuuaccaagaacug

SEQ ID NO: 122593 - RNA, 64 nt, Human
cuccuguaccucuugagccuugaacuuugaccucugcagcaauaaagcagcguuucuaugacac

SEQ ID NO: 122594 - RNA, 64 nt, Human
uuccucugggcucacgggguguuuuccaccccccugcagcaacuaagauggugggggagagggg

SEQ ID NO: 122595 - RNA, 64 nt, Human
uuugcaccuguccccacccuccacucagcuguccugcagcaaacacuccacccuccaccuucca

SEQ ID NO: 122596 - RNA, 64 nt, Human; identical to SEQ ID NO: 122445

SEQ ID NO: 122597 - RNA, 64 nt, Human
aaacagcagcgaccucggccccuauccagagaggugcagcaagagagccauuucccugugacau

SEQ ID NO: 122598 - RNA, 64 nt, Human
gccgccgugugggucagagauggagaaggcugagugcagcaagguggggggugacugggaccca

SEQ ID NO: 122599 - RNA, 64 nt, Human
aaguaccgccugucucaggaugaccgcgauggccugcagcaacucuaugguagggggagaggga

SEQ ID NO: 122600 - RNA, 64 nt, Human
gcacaggccgucacccugggagcagucggcacagugcagcaagccuggcccccgacccagcucu

SEQ ID NO: 122601 - RNA, 64 nt, Human
cuagcauaagcugagguagaacuuaucuuuaagcugcagcaaaaucaaggagugacuuuugucc

SEQ ID NO: 122602 - RNA, 64 nt, Human
uggauuccuauauaaagauuauuuuuauacuuuuugcagcaaaaggaaauuguaauauuuguac

SEQ ID NO: 122603 - RNA, 64 nt, Human
ucccgagaagauggggcccuggcuuuccagggagugcagcaagcagccggccugcaggugagca

SEQ ID NO: 122604 - RNA, 64 nt, Human
ugggggcugaggggcagccccuaugcccucacagugcagcaaccuugguuagcucacccaucag

SEQ ID NO: 122605 - RNA, 64 nt, Human
cccagccacgucuccaaaugcuuccuggcccccaugcagcaacugcauuuagcugccuucccag

SEQ ID NO: 122606 - RNA, 64 nt, Human
gcaauccauggcgaaaaaacacucacuuugucucugcagcaaagaguugccccuucuuucuacu

SEQ ID NO: 122607 - RNA, 64 nt, Human
cuggugcuauuuuuauacagugaagcaacagcuuugcagcaaaauaauaaaauacuucuucguu

SEQ ID NO: 122608 - RNA, 64 nt, Human
caagcgcaugaguaaagagacguggggcuauuucugcagcaaguggaaccuucuggagcuggcc

SEQ ID NO: 122609 - RNA, 64 nt, Human
acagggcaacuggaaccuacacaaaccaauugcuugcagcaagcagaguuuuauauauuuauag

SEQ ID NO: 122610 - RNA, 64 nt, Human
augcagccauaaaaaagaaugggaucauguccugugcagcaacguggauggagcuggaagccau

SEQ ID NO: 122611 - RNA, 64 nt, Human
gacccaagagaccaguagucacccugcuuguuucugcagcaaugacugguccugucuuuugagu

SEQ ID NO: 122612 - RNA, 64 nt, Human
acagacccuuuuauacagugaucugucuuguuccugcagcaaaaauccucuauggacauaggag

SEQ ID NO: 122613 - RNA, 64 nt, Human
aaacugaagaccauuuuagaacuagucaguucucugcagcaaagggaacaggagccauuugaac

SEQ ID NO: 122614 - RNA, 64 nt, Human
uggggagcgccggauuugcucccaccacggggucugcagcaaugaagggaagugcaucugucag

SEQ ID NO: 122615 - RNA, 64 nt, Human
ucacugaagaagcagauugccaagugccagcagcugcagcaagaauacagccgcaaggaggagg

SEQ ID NO: 122616 - RNA, 64 nt, Human
ucaaaccccuacugaccuggcuggugacagaacaugcagcaaggggacaucuuaggcuggccag

SEQ ID NO: 122617 - RNA, 64 nt, Human
gaaauguggcagcccauuccagcacacaggcuucugcagcaaucucugaggguaaagccggugg

SEQ ID NO: 122618 - RNA, 64 nt, Human
uaaauauauaugggcuuaaucauuuaaaauuuguugcagcaagaacuuuccuaccuguaggcaa

SEQ ID NO: 122619 - RNA, 64 nt, Human
ugucucuguauggcagcaaauguggcccauggccugcagcaaaacguccuauauguagauucca

SEQ ID NO: 122620 - RNA, 64 nt, Human
ucaggguuggugggggucagucacuugaaaucuuugcagcaaugaguugggaaaaacugaccga

SEQ ID NO: 122621 - RNA, 64 nt, Human
gcuagggaacaccaguaagugcuacccaccccucugcagcaacaucuccaaacugucaaguuua

SEQ ID NO: 122622 - RNA, 64 nt, Human
gugacggugucuccuugcaucccagccucgucuaugcagcaagagaccagggacuucaccaaag

SEQ ID NO: 122623 - RNA, 64 nt, Human
aucucugcagguccucauucauguuguaaauuuuugcagcaagcagucaacauuccacaaacga

SEQ ID NO: 122624 - RNA, 64 nt, Human
gagaaauaccugauguagaugauggguugaugggugcagcaaaguaccauggcacauguauacc

SEQ ID NO: 122625 - RNA, 64 nt, Human
uuuguuuuugccuuguaaacuagcgccaaggaacugcagcaaauaaacuccaacucugcccaag

SEQ ID NO: 122626 - RNA, 64 nt, Human
cagugccugagacuuuucuaccaagccacacagcugcagcaacugcagauacugcgggcugagc

SEQ ID NO: 122627 - RNA, 64 nt, Human
cuugcuuggagguggacuggggagacagccuuggugcagcaagaacauucaacucaggaagcau

SEQ ID NO: 122628 - RNA, 64 nt, Human
auacaauaauuuuuuuaaaaagugcaauuugcguugcagcaaucaguguuaaaucauuugcaua

SEQ ID NO: 122629 - RNA, 64 nt, Human
acucagcuguauguugcccucugaccuuggcccagaccuucagaggcucagucuguugagucug

SEQ ID NO: 122630 - RNA, 64 nt, Human
ccccacugcacaccuuccucaagucauagcugcuugcagcaacuugauuuccccaaguccugug

SEQ ID NO: 122631 - RNA, 64 nt, Human
acugacagugcuacauuaaucauagggguuugucugcagcaaacgccucauaucccaaaaacgg

SEQ ID NO: 122632 - RNA, 64 nt, Human
aggagauuuccgaaacucuguugcuaguucauucugcagcaaauaauuauuaugucugauguug

SEQ ID NO: 122633 - RNA, 64 nt, Human
gcuggcagcucuucccagugauguugagagcaccugcagcaaucugguccccagucgcacaacu

SEQ ID NO: 122634 - RNA, 64 nt, Human
ucccagggcaugcagaggaugcaccuagagacguugcagcaaguggacaaguggccgcugugcg

SEQ ID NO: 122635 - RNA, 64 nt, Human
aaaauaaucaugcagucauuccucaauuacugccugcagcaauuccuccauuuuuaugaaucuu

SEQ ID NO: 122636 - RNA, 64 nt, Human
ggaaauaaacuggagacaaaucucauuuaagagaugcagcaaaguguucacuaagaguguuuau

SEQ ID NO: 122637 - RNA, 64 nt, Human
agacaggucagggccccccacccucuccagccccugcagcaaaugacuacugcaccuggacagc

SEQ ID NO: 122638 - RNA, 64 nt, Human
cuggcccggacaucuggucccucagaguggcagcugcagcaagaggcagcugaagcccucgugg

SEQ ID NO: 122639 - RNA, 64 nt, Human
uuuaggauuggcacagcuagagaaguccccaagaugcagcaaggagguaaauacaugagagaac

SEQ ID NO: 122640 - RNA, 64 nt, Human
ccaaaaaguucacacuagggaaagaacuuacaaaugcagcaaaugugggaaauuuuuuauggac

SEQ ID NO: 122641 - RNA, 62 nt, Human
aaaaaugucauaacacauagaggccucaugaaugcagcaaauguggaagcgccuucaacuca

SEQ ID NO: 122642 - RNA, 64 nt, Human
cagggccauguuacuguuaggucaaggucacuggugcagcaacgaauguaguuuuucuagauuc

SEQ ID NO: 122643 - RNA, 64 nt, Human
acagaucacaccuccauccccaaagagguagcacugcagcaacaucagggggaggacguggugg

SEQ ID NO: 122644 - RNA, 64 nt, Human
gacauggggaacuuggcaugacgucacaccgagaugcagcaacgacgucacgggccaugucgac

SEQ ID NO: 122645 - RNA, 64 nt, Human
cucauacuaaugagaaaccuaugaaugucaggaaugcagcaaggccuuuaagcagagagcccau

SEQ ID NO: 122646 - RNA, 64 nt, Human
agacaugcaaagauccuaggagacaguccccauagaccuucagacauuaaaaagggagccguac

SEQ ID NO: 122647 - RNA, 64 nt, Human
agagacucaggccuguuugagggcucacgaccccugcagcaaagaagcccgagacugauuccuu

SEQ ID NO: 122648 - RNA, 64 nt, Human
uuggagaauacacaccugaguaagauccugugauugcagcaaauguggaaaauguuuacccaaa

SEQ ID NO: 122649 - RNA, 64 nt, Human
cucuccuuugugaugccuuaggacauguuugaacugcagcaaaaaacaaaaacaaaaaacagug

SEQ ID NO: 122650 - RNA, 64 nt, Human
ugucaaugcacacagaauacaaccucaugcucccugcagcaagaccccugaaagugauucaugc

SEQ ID NO: 122651 - RNA, 64 nt, Human
aaaaguaauugugguuuuugccauaaccuuuaauugcagcaaaaaccgcaauuacuuuugcucc

SEQ ID NO: 122652 - RNA, 64 nt, Human
uuccugcucugucuuuuauuaucuuaugucagagugcagcaaaaucucauuucauaagacuuac

SEQ ID NO: 122653 - RNA, 64 nt, Human
ucacagaaauggaccaguucuguucuccaaagacugcagcaaugauauuucagucugugaacuu

SEQ ID NO: 122654 - RNA, 64 nt, Human
cacuuucuuugcuccuuuuuacagucuuugucuuugcagcaagcaaaugaaauuaagccacuuu

SEQ ID NO: 122655 - RNA, 64 nt, Human
gggcagggcaggcagggggggcuucccgcccuccugcagcaaagggcaaccacccucggaugau

SEQ ID NO: 122656 - RNA, 64 nt, Human
auauaauuucccccuuggugguuuuucagacaccugcagcaagaagaaauacugacugacuagg

SEQ ID NO: 122657 - RNA, 64 nt, Human
aaacaaucaaauaauucuuuucuguaauccaauaugcagcaagcaagggugaccuccaguggcc

SEQ ID NO: 122658 - RNA, 64 nt, Human
uugaaaugcccaguucagacugaauaauuccugcugcagcaaggaaaguaccuacuauaauaga

SEQ ID NO: 122659 - RNA, 64 nt, Human
uguaaaaaugauuguaacagauaaaaaauguaucugcagcaacucugcagguuugugaaauagg

SEQ ID NO: 122660 - RNA, 64 nt, Human
aacccaaaccuauuuuuuucaaucugaauauugcugcagcaaaaccaacuccaccaaaaagcca

SEQ ID NO: 122661 - RNA, 64 nt, Human
gaaaacauugaagucguuacacaccagaucacugugcagcaagagcaacugcaguuguuagagg

SEQ ID NO: 122662 - RNA, 64 nt, Human
uccucaguagcacuuuaaacgccgaagacagcccugcagcaagccugcacacgggcuugggugg

SEQ ID NO: 122663 - RNA, 64 nt, Human
cucacagcucuuuuuaaaaaacagcuucaaaauaugcagcaaaaaccaauacaacaaaacgagu

SEQ ID NO: 122664 - RNA, 64 nt, Human
agcacagcaggggagggguuaaugcagauggcagugcagcaaggagaaggcaggaacauuggag

SEQ ID NO: 122665 - RNA, 64 nt, Human
agcccagucccucggagcugcagacagcagguccugcagcaacaauaccugcacggcuuugcac

SEQ ID NO: 122666 - RNA, 64 nt, Human
ggaggccuccgugcacugagagauguacuaggauugcagcaaagguggucagggugaugggccg

SEQ ID NO: 122667 - RNA, 64 nt, Human
gagggacaaguagccugccccagccugcccuggcugcagcaagggcagggccacacucucgccg

SEQ ID NO: 122668 - RNA, 64 nt, Human
agcuuguggaaauaccuuggcugauguugcagccugcagcaagugcuuccgucuccggaauccu

SEQ ID NO: 122669 - RNA, 64 nt, Human
cuccaaguagaccuguggcuuaaaauaaagaaaaugcagcaaaaagaaugcuauagaaauauuu

SEQ ID NO: 122670 - RNA, 64 nt, Human
augacggaauaagagaccuguuuuaaaaaggaacugcagcaaucuuugaaagacuuccaaagaa

SEQ ID NO: 122671 - RNA, 64 nt, Human
aguuacaacuccuuggugccacugccuuuaugauugcagcaaaauuugaggugagucugagucc

SEQ ID NO: 122672 - RNA, 64 nt, Human
ggguggggggugguugaggggggaggcagcacagugcagcaaauguuucuugggaggaagaagc

SEQ ID NO: 122673 - RNA, 64 nt, Human
agugaucauauuagcauuuagcaaaaagcaacccugcagcaaagugaauuucuguccggcugca

SEQ ID NO: 122674 - RNA, 64 nt, Human
gaaaaacacugaagugcuuuucaugaagcacagcugcagcaaagccuugcaaucccaggcuggg

SEQ ID NO: 122675 - RNA, 64 nt, Human
ucgcaauuacuuaaauuuauuuuuuugaaacagcugcagcaagaguuggcacuuauucagaugu

SEQ ID NO: 122676 - RNA, 64 nt, Human
ugcuuuuguacccuuuaaaucauuugccaaacauugcagcaaacaagugugcguauguaacaag

SEQ ID NO: 122677 - RNA, 64 nt, Human
aauguuuuuguuuaaaaaaaacuguucccauaggugcagcaaaccaccauggcacauguauacc

SEQ ID NO: 122678 - RNA, 64 nt, Human
augcgggguuuaauaccuaggugauggguugaggugcagcaaaaccaccauggcacacguucac

SEQ ID NO: 122679 - RNA, 64 nt, Human
cuucugagacucccggagucuucucgagcuacgagaccuucacagagacacguggcagccacac

SEQ ID NO: 122680 - RNA, 63 nt, Human
gcaugauccgcaaacaguagauagugguggcagugcagcaaccagagcacuguauaccccgug

SEQ ID NO: 122681 - RNA, 64 nt, Human
ccuacaagaugugggaaucagcauaacagggcaaugcagcaauuaaccccacaucguuuucugu

SEQ ID NO: 122682 - RNA, 64 nt, Human
auucuccuaacguucaauaaucucaauguugaguugcagcaacagacuguauuuuugugacgcc

SEQ ID NO: 122683 - RNA, 58 nt, Human
uugacugguggggcaacugaaucugcuuugcagcaaagucacccuuacaaagaagcua

SEQ ID NO: 122684 - RNA, 64 nt, Human
ugaggacaggaagagaguguuagaaaggguaggacugagaaacagccuauaaucuccaaagaaa

SEQ ID NO: 122685 - RNA, 64 nt, Human
cauacaguucaugacuagguuuaggaauugggcacugagaaaauucucaauauuucagagaguc

SEQ ID NO: 122686 - RNA, 64 nt, Human
ccucugggguugucugguucccagugagaggcuccugagaaaaauaaagcugguucccagagcu

SEQ ID NO: 122687 - RNA, 64 nt, Human
guaaggaaggcucuucuagcaauacuagaucccacugagaaaauccacccuggcaucugggcuc

SEQ ID NO: 122688 - RNA, 64 nt, Human
uuggagucugaauggaucuguuuuccaagagauucugagaaauuuuuguauucagcaguuggaa

SEQ ID NO: 122689 - RNA, 64 nt, Human
aguccugagauggaaacagcaacuuguacaguggcugagaaaauaggauauaguuuugauuuuu

SEQ ID NO: 122690 - RNA, 64 nt, Human
augugcaaaugaaaauugaaggaaagaauaugaacugagaaauguucuuuggcagugauauagu

SEQ ID NO: 122691 - RNA, 64 nt, Human
ucccucuguggcaguuacgauuuugacuucaguccugagaaaaacuucagguuuugaaaaucag

SEQ ID NO: 122692 - RNA, 64 nt, Human
uuggaucaucaaaaaaauaaaguaaaauagaaaacugagaaaacucaauccaugaccagggaga

SEQ ID NO: 122693 - RNA, 64 nt, Human
ucaacugucugauguaauugagugaagguuugcacugagaaauuagcauucaggccuuaccccc

SEQ ID NO: 122694 - RNA, 64 nt, Human
uuucaucuuauuuuuuguccacaugcuggugaugcugagaaacaauaauuggcccaaaugcaga

SEQ ID NO: 122695 - RNA, 64 nt, Human
uuuuaggguggguuaggaguauccuuucuggagacugagaaagggguguauuuaauuccaucag

SEQ ID NO: 122696 - RNA, 64 nt, Human
aacaugcuggauugcccuagucuucagaaugguccugagaaaacaucacuacuucgauguucua

SEQ ID NO: 122697 - RNA, 64 nt, Human
cucguaaaaguagcacaagcccacuuaugaaucacugagaaaaagugaaaaacuugaguuggca

SEQ ID NO: 122698 - RNA, 64 nt, Human
auucauccuuaauuccaagugaagcagcacagugcugagaaacaguucauccauggugccaugu

SEQ ID NO: 122699 - RNA, 64 nt, Human
auuuuuugucccuacauagcaauuuucuguggcacugagaaaccauguaugaccacaauaaaaa

SEQ ID NO: 122700 - RNA, 64 nt, Human
cuuuagauuuaagaguucauaauuccauccacugcugagaaaucuccucaaacccagaagguuu

SEQ ID NO: 122701 - RNA, 64 nt, Human
aaggaucacuugagaccaggaguucaagaccagccugagaaacauagugagcccuugucucuac

SEQ ID NO: 122702 - RNA, 64 nt, Human
caguggccccuuguuugccaaaggcagaguggggcugagaaacaggcugcggugauugcaauua

SEQ ID NO: 122703 - RNA, 64 nt, Human
aacagcaacaauguacccaaaagaggguagaauucugagaaaaacuauuagcuuagaauuugca

SEQ ID NO: 122704 - RNA, 64 nt, Human
aaggggcuuauaugugaugucaauauuucuuccucugagaaaugguauauauauguguauaaug

SEQ ID NO: 122705 - RNA, 64 nt, Human
cggcccagccauuuccacccucgggaggcggcuccugagaaacagggaggaaggggcggagcac

SEQ ID NO: 122706 - RNA, 64 nt, Human
cuugggagaggccaaagagccauucuagcaugaucugagaaaaccuuccugcagaggccagaaa

SEQ ID NO: 122707 - RNA, 64 nt, Human
ggaaagcagugccugccagcuguugugcaccuuccugagaaauaaauauccucuaaauuuucaa

SEQ ID NO: 122708 - RNA, 64 nt, Human
uuuucaaagcagggcugguuuuccaacccagccucugagaaaccauuucuuugcuauccucugc

SEQ ID NO: 122709 - RNA, 64 nt, Human
aaauauguguaucuaguagagcuuguuuaggaaacugagaaacguacacuaucauugcuaaacu

SEQ ID NO: 122710 - RNA, 64 nt, Human
cugccagccacagcaugaggccugugaaggcugacugagaaauccucugcugaagaccccuggu

SEQ ID NO: 122711 - RNA, 64 nt, Human
ugcaaaccaugccuuuuuuuuaaggagcaaaaaucugagaaaaaaagugagagaccucugccua

SEQ ID NO: 122712 - RNA, 64 nt, Human
cucagucucagagaggcuggcacggccuggcagucugagaaaagcgucaguuaggcacaccugc

SEQ ID NO: 122713 - RNA, 64 nt, Human
gcgugucggagccacccaggucccgcagcugccgcugagaaaaugcaaauauuuguugugacaa

SEQ ID NO: 122714 - RNA, 64 nt, Human
cgauuuugugcauaguaaugacacagcaccauuccugagaaauaggaaauauauguguguggua

SEQ ID NO: 122715 - RNA, 64 nt, Human
gguucugugcguguaccauguugccugacacguccugagaaaucuucuuaaacucugaguuuau

SEQ ID NO: 122716 - RNA, 64 nt, Human
ggaagguuuagagcaguugugagaugcuguuaugcugagaaacccugacuuuguuaguguugga

SEQ ID NO: 122717 - RNA, 64 nt, Human
uccaagaauuguuuaaaaaaaaaaaagugcuacccugagaaaaguacucuuaauacucuugaaa

SEQ ID NO: 122718 - RNA, 64 nt, Human
agaguucauacggacuaagcuguaauuaugauggcugagaaaugauucauuugaagauacaauu

SEQ ID NO: 122719 - RNA, 64 nt, Human
uggcuuuacauuucaaaagugaacuugauucaaccugagaaaacugauuaaaaaauuaguuuaa

SEQ ID NO: 122720 - RNA, 64 nt, Human
ccccagugaaaaacauacuggggaaauaaaaccucugagaaaagguucaagcaccuuuuccaaa

SEQ ID NO: 122721 - RNA, 64 nt, Human
auucucuggucacagguuuuugcccagggaaauucugagaaauucacaauuucuuaccagauaa

SEQ ID NO: 122722 - RNA, 64 nt, Human
ccacucuugacucucccggcucugccacuguuuucugagaaauguagcauccgcugcagcuggc

SEQ ID NO: 122723 - RNA, 64 nt, Human
uaagccuguggcuguggagacaaugucugcagcccugagaaagcccugucgggcuuugugugaa

SEQ ID NO: 122724 - RNA, 64 nt, Human
cauacuccagcaagauauguuuuugguagcaaaacugagaaaaucagcuucaggucugcaauca

SEQ ID NO: 122725 - RNA, 64 nt, Human
acggccauaugucacuuaaggauggagauauguucugagaaaugugucauuaggcgauuuuguc

SEQ ID NO: 122726 - RNA, 64 nt, Human
ucauuucccccguagcagauggaaggagaaaccucugagaaaaugaaaacauccuuaaccacua

SEQ ID NO: 122727 - RNA, 64 nt, Human
cuuuccagcaagguuuuuguagcuauuugcuugccugagaaaugaaauugaaaacauaccccug

SEQ ID NO: 122728 - RNA, 64 nt, Human
guggggaacccugagcacuuuuuuacaauuggcucugagaaaaagggagacauuuuaaauucuu

SEQ ID NO: 122729 - RNA, 64 nt, Human
auaaguuuuuaagguuccuucuugcuuuagcauucugagaaaugucuaauugguaguaagacaa

SEQ ID NO: 122730 - RNA, 64 nt, Human
uucugccuuggagguuucaguccauaccuggacucugagaaaaugagcugaauaaggaguacag

SEQ ID NO: 122731 - RNA, 64 nt, Human
auaccugccaaucacccaaagaaaauaauagcuucugagaaagcucaauucacuguagcaacug

SEQ ID NO: 122732 - RNA, 64 nt, Human
uccuacuuuuccaggcucagcagggagcugcuggcugagaaagagccugaagucuugcaggacu

SEQ ID NO: 122733 - RNA, 64 nt, Human
aaauguaguguguuucccuaacuuucuguuuuuccugagaaaaaaaaauaaaucuuuuauucaa

SEQ ID NO: 122734 - RNA, 64 nt, Human
uggggaaagugguuagggagggagaggaggaagacugagaaaucucugcauccccagaacucag

SEQ ID NO: 122735 - RNA, 64 nt, Human
gggguccagggcacccucccuagagggcccuugucugagaaaccccaaaccaggaaaccccacc

SEQ ID NO: 122736 - RNA, 64 nt, Human
uaacauuaugggauugcaaccagcaaaacauaaacugagaaaaaguucuauagggcaaaucacc

SEQ ID NO: 122737 - RNA, 64 nt, Human
ucuagggaauucagugggaccaaugaaagcauggcugagaaauagcagguaguccaggauaguc

SEQ ID NO: 122738 - RNA, 64 nt, Human
gaccaguucaaauuuuaauagcgauagguagccccugagaaauuuaucacuauaacuccacagg

SEQ ID NO: 122739 - RNA, 64 nt, Human
agccccugcagagccugggagcugcaggaacugucugagaaaaucucccuaauaggggaguggg

SEQ ID NO: 122740 - RNA, 64 nt, Human
gaugucugaggagggaauaguauugcagggaagacugagaaaacaguaggaugacaguuuugag

SEQ ID NO: 122741 - RNA, 64 nt, Human
ucaucaggaguacagccuauuauauucccacauccugagaaaggucauuucucccacacacgac

SEQ ID NO: 122742 - RNA, 64 nt, Human
uuuugccucucuuuuacuuuucaccuaaguuucucugagaaauagagacaggauucucucuuua

SEQ ID NO: 122743 - RNA, 64 nt, Human
uugccccggcagcucuggccugugguuccagaagcugagaaaacuccacuggggcuugcagaau

SEQ ID NO: 122744 - RNA, 64 nt, Human
uggaggcucacugaguagagggcuguugucuaaacugagaaaauggccuaugcuuaagaggaaa

SEQ ID NO: 122745 - RNA, 64 nt, Human
agcaguggagcccucugacaauuugcaaggcccucugagaaaggaagcugcuuagagccagggg

SEQ ID NO: 122746 - RNA, 64 nt, Human
uccauguugcauguaaugaaaauaaaucccugcucugagaaaagcucuuugaagcaaaaaccaa

SEQ ID NO: 122747 - RNA, 64 nt, Human
aaguuuuuguagauaguagaaaggggggcaucaccugagaaagagcugauuuuguauuucaggu

SEQ ID NO: 122748 - RNA, 64 nt, Human
uugagccgccugaaaguacagcuggagcccuucccugagaaacucuuacaggccaggaagccag

SEQ ID NO: 122749 - RNA, 64 nt, Human
aaaaaucaaugaaacuacgaguuuuaggccaaaucugagaaaagaccaaagaugacuauguuug

SEQ ID NO: 122750 - RNA, 64 nt, Human
agucugcugguaaagcuucugaauauugaguuugcugagaaauaaaaaucaaaacuucuuuaag

SEQ ID NO: 122751 - RNA, 64 nt, Human
aaaaaaaaaguugaccuugagaauuuauaauauucugagaaaacuggaagcaugcauaaagccc

SEQ ID NO: 122752 - RNA, 64 nt, Human
gucuucucagaaaccaccaaccuugaagugucuucugagaaaccaccaggcuugaagguaauga

SEQ ID NO: 122753 - RNA, 64 nt, Human
aacaaggauggagaaaaaucuaggacagugucuucugagaaaccaccaggcuugaagguaauga

SEQ ID NO: 122754 - RNA, 64 nt, Human
ugcgagcccucucugcaccugcucaagagaaacccugagaaaccccaguaggugugagcuccug

SEQ ID NO: 122755 - RNA, 64 nt, Human
gaugucaggaagucugugaaucuugauggauuuucugagaaaccugacucaauggcauauauaa

SEQ ID NO: 122756 - RNA, 64 nt, Human
acggugcccagcacacauuaauguuagcuucuuucugagaaaaaaauaccucuuccaggcccug

SEQ ID NO: 122757 - RNA, 64 nt, Human
augcccucccacuuuuaucaguuuaguaguaguacugagaaaaaucccuucagcucuaagaaca

SEQ ID NO: 122758 - RNA, 64 nt, Human
ugugugaugagagugaucaauggucaagagauuacugagaaacucuuuuucuauaauacuaaau

SEQ ID NO: 122759 - RNA, 64 nt, Human
uaacaagaaggagcaucacugucuacucagaagacugagaaaccugcuguucauuauguaguuc

SEQ ID NO: 122760 - RNA, 64 nt, Human
auuuuuuauuccauuucaauauuaaccaaauaggcugagaaauucauagcaauugaauuaagac

SEQ ID NO: 122761 - RNA, 64 nt, Human
aaggcaaauaaccccucucuuguuaauuaugaugcugagaaagccucugucucuuuauuucacc

SEQ ID NO: 122762 - RNA, 64 nt, Human
aaaacacauuuauuaauggaugcuaaagugauuccugagaaaaauaauguguaugguuaauaug

SEQ ID NO: 122763 - RNA, 64 nt, Human
cagucuaauuuuacgcuguagcagaaccagauggcugagaaaauucuggaacuauggaucuuga

SEQ ID NO: 122764 - RNA, 64 nt, Human
cugccauaucagugaaccuuuagaaacucaaaaacugagaaauuuacuacaguaguuagaauua

SEQ ID NO: 122765 - RNA, 64 nt, Human
aagcccaccacaugauucugauguacucuaaauacugagaaaaccuguucuagacaaauaccca

SEQ ID NO: 122766 - RNA, 64 nt, Human
aagugcccuucaggacugugugagccaaacagcccugagaaaagcuggggaaacagucugagcu

SEQ ID NO: 122767 - RNA, 64 nt, Human
caguaauucagguacccauuucauagacauuuuacugagaaaugaccugcauuuguaugaagug

SEQ ID NO: 122768 - RNA, 64 nt, Human
cuuugaauucagauuaauguucuacuacuugugacugagaaaaguuuaaugccggcaugguaaa

SEQ ID NO: 122769 - RNA, 64 nt, Human
uccaaauggcgacaguugcuucuuagcuauugcucugagaaaguacaaacuucuccuaugucuu

SEQ ID NO: 122770 - RNA, 64 nt, Human
agaagaaaacgggaaacuuagaccaaguucuccccugagaaaucuuguuaaaacacauuaagua

SEQ ID NO: 122771 - RNA, 64 nt, Human
gcccagcagguuaaucuucacacaucucuggguucugagaaaagccuggaaaaaucacacuucu

SEQ ID NO: 122772 - RNA, 64 nt, Human
uagagacuguaagaguuaggaaaauaucagagcucugagaaaagggacaaagcaaguguuuuga

SEQ ID NO: 122773 - RNA, 64 nt, Human
agagaugggcagaauggcccuagaguucuuuucccugagaaaggagaaaaagaugggauugcca

SEQ ID NO: 122774 - RNA, 64 nt, Human
uaacguuaccuaccuuaaacuccacucaucaaaucugagaaaaguauccacugguccccagggu

SEQ ID NO: 122775 - RNA, 64 nt, Human
aacugaaaagcuuaauucagauaguagcuuuuggcugagaaaaggaauccaaaauauuaauaaa

SEQ ID NO: 122776 - RNA, 64 nt, Human
gcagggugucaugcaugggugcagaggauggaggcugagaaagguagacagcuacccaugaucu

SEQ ID NO: 122777 - RNA, 64 nt, Human
acuugagauguauaaaacuagagcugaaaagaagcugagaaaucaccuugucuggugauuuucu

SEQ ID NO: 122778 - RNA, 64 nt, Human
gcucaucccuuauuaagcaucagaaaauucauaccugagaaaaaccugugaauguggguaaugu

SEQ ID NO: 122779 - RNA, 54 nt, Human
uuaaaaaagccaccaacugaucaucugagaaaccaacacauuuuuuccugugaa

SEQ ID NO: 122780 - RNA, 64 nt, Human
agauuucugacaccugaaaugauucuucacaucccugagaaaggucaaaguuacaaacugauuu

SEQ ID NO: 122781 - RNA, 64 nt, Human
aauuaccccucccaaaaugucagaagugcugaggcugagaaacccugauguaaagaucaguccc

SEQ ID NO: 122782 - RNA, 64 nt, Human
ugucaggaauggggaaggggagugggggcacaaucugagaaaggacaccugugcuguucuaggc

SEQ ID NO: 122783 - RNA, 61 nt, Human
agucuaugaugcauuuauaaacuaacuggaacugagaaauucucaugcccacuaaaggaaa

SEQ ID NO: 122784 - RNA, 64 nt, Human
cauuuacaaaagagauaccugacauccugagacacugagaaauguccugaagucacacagcuaa

SEQ ID NO: 122785 - RNA, 64 nt, Human
cugugagccagaaaacucuccuuggauacguuuucugagaaaaaauagcaugaagccuaaagcc

SEQ ID NO: 122786 - RNA, 64 nt, Human
gaagagcuguucacagccagacuggcacaguuuucugagaaagacuauucaaacagucucagga

SEQ ID NO: 122787 - RNA, 64 nt, Human
acuuuaaggauuuguaagguuaauccauagauugcugagaaaaauggaaauauuuuuauuuuua

SEQ ID NO: 122788 - RNA, 64 nt, Human
ggaucugccaaguggauacuggggugccacuccccugagaaaagacugagccaggaacuacaag

SEQ ID NO: 122789 - RNA, 64 nt, Human
aggggcauugaggagcuuccucauucugggaaaacugagaaaacccauauucuccuaauacaac

SEQ ID NO: 122790 - RNA, 64 nt, Human
gagaagaaaugaaggugucaaagaguccauucaccugagaaaugugugaagacauacuuaucag

SEQ ID NO: 122791 - RNA, 64 nt, Human
gaauuggucacugcaucuuguaucgauuaugguucugagaaaagcaaauaucacuuuuggcugc

SEQ ID NO: 122792 - RNA, 64 nt, Human
uuguucccagggcagagaguuucugugagucccacugagaaaaucccaugggguggggguaucc

SEQ ID NO: 122793 - RNA, 64 nt, Human
acugaaauguacaguucuuuuggaauaguuucaccugagaaaacauaguuggcuauuaucuauc

SEQ ID NO: 122794 - RNA, 64 nt, Human
uuaguacuuacugugcagggaaccaaaccaaggucugagaaaugcggacaccccgagcgagcac

SEQ ID NO: 122795 - RNA, 64 nt, Human
agacaaaaaagauguuuaaagaccaaaaacugugcugagaaaguaugccccaccuaucuuuggu

SEQ ID NO: 122796 - RNA, 64 nt, Human
cuugggaaugaaauuaacacaaaggaaguccaaccugagaaauggccaaauauauuuccugaua

SEQ ID NO: 122797 - RNA, 64 nt, Human
aguaaccuguuuuuguaguuuggaugaauauguccugagaaauuuccauccacuuugguucagc

SEQ ID NO: 122798 - RNA, 64 nt, Human
ccaguaugaagaaagauuauucacucuagcuccacugagaaacauuuuccuaagugaaaacaau

SEQ ID NO: 122799 - RNA, 64 nt, Human
uuguuuaaaaguugauucauauucuuaccuugugcugagaaagguugcauugcugccccuuaua

SEQ ID NO: 122800 - RNA, 64 nt, Human
auguuucguacacaugcuuuauuuuacuugggcucugagaaauguguggcuuuccuucagcauu

SEQ ID NO: 122801 - RNA, 64 nt, Human
guaugcaaaucugugauuguuggcagugucaucucugagaaacagauaaauaaaguuuauuuac

SEQ ID NO: 122802 - RNA, 64 nt, Human
uguuuuguacgcauuaaaauaauuucaaagauaucugagaaaagccgauauuugccauucuucc

SEQ ID NO: 122803 - RNA, 64 nt, Human
ugguagacucccuuugcuggcuugugcagugauacugagaaaauacaugaacagaaacugccca

SEQ ID NO: 122804 - RNA, 64 nt, Human
agaaagcauagagagguaagcauuaguggcacagcugagaaaauauaaaagguaguucugucuc

SEQ ID NO: 122805 - RNA, 64 nt, Human
ggaaggcaaagcuuuuguggagucaggggggagacugagaaaaaaugaauuaacccuguguugu

SEQ ID NO: 122806 - RNA, 64 nt, Human
aacaaugaaaccauaaaagauaauauucuaaaaacugagaaauccagugaagaggaccuuucag

SEQ ID NO: 122807 - RNA, 64 nt, Human
gugugugcccuacccuggcucaggcuucugggcucugagaaauaaacuaugagagcaauuuccu

SEQ ID NO: 122808 - RNA, 64 nt, Human
augacuucaccucacucagccuuggcuucuaaggcugagaaaugggacuuaaugcuuuauuuua

SEQ ID NO: 122809 - RNA, 64 nt, Human
gucaauguccuggugauuuuaugagacugccccacugagaaaacuuacuuacuucaggcaucca

SEQ ID NO: 122810 - RNA, 64 nt, Human
auauauaaauaagagaauuuuggcccuucugugucugagaaaauuaauuauauagcaaggaaug

SEQ ID NO: 122811 - RNA, 64 nt, Human
ucgcuuaccgagaguagaaauggcuuuggaggcucugagaaaugucauaaaauacaauccaggu

SEQ ID NO: 122812 - RNA, 64 nt, Human
gcuguguagcuguaauuugucauguaauugaagacugagaaaauguuggguccagucgugcuug

SEQ ID NO: 122813 - RNA, 58 nt, Human
aacagcaugcauugaacugaaaagauaacugagaaaaugaaagcucacucuggauucc

SEQ ID NO: 122814 - RNA, 64 nt, Human
gugcaggcucccgaccagugcugcccuguuugcccugagaaacaagaugucagagacuugccag

SEQ ID NO: 122815 - RNA, 64 nt, Human
gggcagaggaggcagcagaaaaccaaacauuucacugagaaagcccccucccugcucuaagaag

SEQ ID NO: 122816 - RNA, 64 nt, Human
aacuagaggcaguaaccugucauuccagaggaugcugagaaauguguaggggcacuuuuuuggu

SEQ ID NO: 122817 - RNA, 64 nt, Human
guaguuucccaacuuuaagacuuaucuaauuuaacugagaaagaaagccuuuuucauauauaua

SEQ ID NO: 122818 - RNA, 64 nt, Human
auuucagcuuaaaagaaauaauuggcaccauguucugagaaagauuuugagauauacauuguuu

SEQ ID NO: 122819 - RNA, 64 nt, Human
ccauccuggagccucauggaacaggaugauggcacugagaaagccaaugaccgaaucucuuuuc

SEQ ID NO: 122820 - RNA, 64 nt, Human
gagccauugagagaaaagcaugguccagugccuucugagaaaggccagagcuuugggcuuuccu

SEQ ID NO: 122821 - RNA, 64 nt, Human
ggguauucagcuuuguucaugaaauaaggcaucucugagaaaguggccccagggagagaaugga

SEQ ID NO: 122822 - RNA, 64 nt, Human
aaauguuccuuuggccaaaagcugaagggaguuacugagaaaauaguuaacaauuacugucagg

SEQ ID NO: 122823 - RNA, 64 nt, Human
uagaggcaaaugacaagcgauaggcuauugcaaccugagaaagagaacugcuccuucaucguaa

SEQ ID NO: 122824 - RNA, 64 nt, Human
acugucagacaaaaaguuuauuggcucugaggaacugagaaauguugggaaccugguuucugcu

SEQ ID NO: 122825 - RNA, 64 nt, Human
aagcucaggaccuucguggagcugcuucuccaaccugagaaacucaagacccauccucccgcug

SEQ ID NO: 122826 - RNA, 64 nt, Human
cuucucuuugaaggagaaaaauguaaaauaugcacugagaaagccagccccgccugcuuaguca

SEQ ID NO: 122827 - RNA, 64 nt, Human
gcccauuaccugcaugcaggcaccagagcagggacugagaaaccccaaggaugggucaucuaag

SEQ ID NO: 122828 - RNA, 64 nt, Human
gggcuucgguggcccuacccgguaccaguucuuucugagaaacuggagaugucuuguuagcaua

SEQ ID NO: 122829 - RNA, 64 nt, Human
guugaauaaaaaggaugguccgcuuucuauugagcugagaaaucuuugaagugggaguuauuau

SEQ ID NO: 122830 - RNA, 64 nt, Human
uggaacuauuuacaaggaugaaacaaccguauaccugagaaauaacuugcucuggugucaauuc

SEQ ID NO: 122831 - RNA, 64 nt, Human
aauuguaaauuaguuaaauuuuauguggaauuugcugagaaaagaauauagacuacugaaaugu

SEQ ID NO: 122832 - RNA, 64 nt, Human
guaaaaagggcuacaggucacagaucgucagugccugagaaagaacauugacuuacucuauauc

SEQ ID NO: 122833 - RNA, 64 nt, Human
caugcucagugggguuuuaggcugucacaugcagcugagaaaagguauguucaagucauaagua

SEQ ID NO: 122834 - RNA, 64 nt, Human
agaaaugugcccuaaaagcauaaaugaguaucaccugagaaaauuaggcauucccgucuuggaa

SEQ ID NO: 122835 - RNA, 59 nt, Human
gccuugaagcacaucuguaggcaagauggcugagaaauacaggagaggcgucugcuuuu

SEQ ID NO: 122836 - RNA, 64 nt, Human
cgaccuuaauuuaacuuuccagucuuagcugaggcugagaaagcuaaaguuugguuuugacagg

SEQ ID NO: 122837 - RNA, 64 nt, Human
acuuucuauuuuuaugaugacaaucaaagccggccugagaaacacuauuugugacuuuuuaaac

SEQ ID NO: 122838 - RNA, 64 nt, Human
acccuccucagucccaguuucugaaaggacucagcugagaaaggacaacuggguuccgcuuucc

SEQ ID NO: 122839 - RNA, 64 nt, Human
ggccaauuauaggaccuaauugcucucagcaggccugagaaaugaguugaaaugugcagaacug

SEQ ID NO: 122840 - RNA, 64 nt, Human
guuacagaaugcuacacacuuaccuuuuuauuggcugagaaaucugguuauuucaucuuaaucu

SEQ ID NO: 122841 - RNA, 64 nt, Human
cuuauuaggccauagugagcuaugcucugcacaacugagaaauuagguauuuagaaggcauaua

SEQ ID NO: 122842 - RNA, 64 nt, Human
uuggucaaaaacaucaauaccuuuccaauuaacacugagaaauuaagguuaagauucuccuuuu

SEQ ID NO: 122843 - RNA, 64 nt, Human
ggccacccccgccauugcgagccacaugucugcacugagaaacugcauuucaguagcauuuguc

SEQ ID NO: 122844 - RNA, 64 nt, Human
uuugucuucagucaacagcggcugaaacugaccacugagaaaugggugugggcacugacaguuc

SEQ ID NO: 122845 - RNA, 64 nt, Human
ugugaaaacacuuugagcgcuuuaagagauuagccugagaaauaauuaaauaucuuuucucuuc

SEQ ID NO: 122846 - RNA, 64 nt, Human
accauuuaaaaaaaaaucuuaaagccuguaauuucugagaaaagaguacagcauuuacucuuau

SEQ ID NO: 122847 - RNA, 64 nt, Human
ugugcaaaugccaaauauuaauuguaagucauaucugagaaaucauucuuggcugucuuucuag

SEQ ID NO: 122848 - RNA, 64 nt, Human
agaaaccuugugaugucuugacuguugcaccaggcugagaaagcagcaauauugauauuauaaa

SEQ ID NO: 122849 - RNA, 64 nt, Human
aauuuacagcuaaaauauuuuuuaaaaugcauugcugagaaacguugcuuucaucaaacaagaa

SEQ ID NO: 122850 - RNA, 64 nt, Human
uuuuagaaugucguugucaagggucuccuuuuaacugagaaacuuuuugaacucacaaaguguu

SEQ ID NO: 122851 - RNA, 64 nt, Human
aaaguuuugggauaacuuauuuguauguugguagcugagaaaaauaucaucagucuagaauuga

SEQ ID NO: 122852 - RNA, 64 nt, Human
uuaauuuauaaaucuagacuuggagaauuaaggacugagaaaugaccauaucuuaaacuaucua

SEQ ID NO: 122853 - RNA, 64 nt, Human
gaaaccaagaaaaagaagccaagcaaaaaucaggcugagaaaaagcaaaagaaaagcaaaaaaa

SEQ ID NO: 122854 - RNA, 64 nt, Human
gucauucccacgcuuggcugaaaaucaggaucaucugagaaacuuaaacaauuucugcauucuu

SEQ ID NO: 122855 - RNA, 64 nt, Human
uaguaguuuguuugguccccucuaguaugugucacugagaaauuuuuuaaagacaugguagauc

SEQ ID NO: 122856 - RNA, 64 nt, Human
aaaucgaaagauaaagugaaaguuuauuucaggacugagaaauaucuugaagguuauuuauuag

SEQ ID NO: 122857 - RNA, 64 nt, Human
uguuuguuuccaacgaagcugcuguuaaacgaaacugagaaaaacuuugccccggaauagcacu

SEQ ID NO: 122858 - RNA, 64 nt, Human
ggauguaaaaaagccuauuucuacauuauaccaacugagaaaaaaauggucgguaaaguguucu

SEQ ID NO: 122859 - RNA, 64 nt, Human
ugacuguacaauaggacgaaaguugccucugugucugagaaaguaucuuaguuguuggcugcuc

SEQ ID NO: 122860 - RNA, 64 nt, Human
auccugagaggaguaaaguguuuagauucugaaccugagaaaagagaacuuucucuuaagaagu

SEQ ID NO: 122861 - RNA, 64 nt, Human
uuccauaucagcuuauauuaaauacugugacacucugagaaaguuuaucaucaugauagcugua

SEQ ID NO: 122862 - RNA, 64 nt, Human
aaggaaaagaacagcaaaagucaggagcaguaaucugagaaaguuaacuccaggauagguaggu

SEQ ID NO: 122863 - RNA, 64 nt, Human
ugaaccaaauccaucagcauaaugacuguguguucugagaaaugcaaacaacuuuaugaaagug

SEQ ID NO: 122864 - RNA, 64 nt, Human
ucuagcucuaguucaaauuauuuggaaguguucccugagaaacccaccagccuaagaagcucug

SEQ ID NO: 122865 - RNA, 64 nt, Human
uagagacugcuucuuguguuugugucauucuguccugagaaaugaagucaucugaaaaauaaaa

SEQ ID NO: 122866 - RNA, 64 nt, Human
uuguaacauauaaugggaaacaguaauacguacucugagaaaaauugcaaagcacagauaaaug

SEQ ID NO: 122867 - RNA, 64 nt, Human
gacuaaagaauuaagguaacaucaauaccuaggccugagaaauaaccccauccuuguugggcag

SEQ ID NO: 122868 - RNA, 64 nt, Human
cugauuccagugucgaggccauuucucuuugccacugagaaaugcagcgugacugacucuguug

SEQ ID NO: 122869 - RNA, 64 nt, Human
ggaugaaauguaauauucaucagaacaaggaucacugagaaaaaauauucagaaacaacuuuaa

SEQ ID NO: 122870 - RNA, 54 nt, Human
gucaagaaucauggaaguaaacaucugagaaaccuguugaagauuauuucauuc

SEQ ID NO: 122871 - RNA, 64 nt, Human
aacucuucaguuaauucuuagauacacuaaaaaucugagaaacucuacauguaacuauuucuuc

SEQ ID NO: 122872 - RNA, 64 nt, Human
ccuuuuuuuuagcccaggagagguggauguuugucugagaaaacaauggccucaagggaggggc

SEQ ID NO: 122873 - RNA, 64 nt, Human
aauguuaaaaccuguugagaggaauugaugguuucugagaaauacuagguacauucauccucac

SEQ ID NO: 122874 - RNA, 64 nt, Human
aguaaggcaccccacagaaauuaacuuggagagccugagaaauucccaguggccuuggcauagc

SEQ ID NO: 122875 - RNA, 64 nt, Human
agcccucauccugcaggcagagccccucagugcucugagaaaccugcccugaacucaccgccuc

SEQ ID NO: 122876 - RNA, 64 nt, Human
ugggagcacaguacugggaaaugggcauacaguacugagaaaugggagcacacaguacugggaa

SEQ ID NO: 122877 - RNA, 64 nt, Human
ugggagcacaguacugagaaaugggaguacacuacugagaaaugggagcacaguacugggaaau

SEQ ID NO: 122878 - RNA, 64 nt, Human
ugggagcacaguacugagaagugggagcacaguacugagaaaugggaguacacuacugagaaau

SEQ ID NO: 122879 - RNA, 64 nt, Human
ucaugcuucugggguuggagcuuaaagauccaaacugagaaagcaggccgggcaugguggcuca

SEQ ID NO: 122880 - RNA, 64 nt, Human
cccauuuuucuaauuagaaaaaggcuuggugaggcugagaaaccagcccacaauuacacaaaga

SEQ ID NO: 122881 - RNA, 64 nt, Human
uuuaugauaaaggaagugugugauuucccucccucugagaaauauacugcgcuuaauauuugcu

SEQ ID NO: 122882 - RNA, 64 nt, Human
caccaugggauuaagaacuauaucaggaacaucccugagaaacgguuuuaaguguagcaacuac

SEQ ID NO: 122883 - RNA, 64 nt, Human
caugauucugaggccuccccagccauguggaacucugagaaaccugaacggacuccauuuggcu

SEQ ID NO: 122884 - RNA, 64 nt, Human
gaauauauauguuuuguuucuuagggaaaacagucugagaaaugaauaaaaagcaugaaguacg

SEQ ID NO: 122885 - RNA, 64 nt, Human
gauuuugcuauaucauaaccucuugguucauaugcugagaaauuuuucagaaaguccauuuuug

SEQ ID NO: 122886 - RNA, 64 nt, Human
ggaacuaaaauucugucagggguuucuucaagagcugagaaacauuauuagcacuucccgcccc

SEQ ID NO: 122887 - RNA, 64 nt, Human
ugucuacaaggaaaugggagguggagccuccuggcugagaaauuguuuugcaaauggaucuauu

SEQ ID NO: 122888 - RNA, 64 nt, Human
uaugccuaugaaguccccaggagcuacacugauacugagaaaaccaggcucuuuggggcuagac

SEQ ID NO: 122889 - RNA, 64 nt, Human
uggguguuccuuggaauggcauuguauuuaccaccugagaaacucuguacugucucuugaucug

SEQ ID NO: 122890 - RNA, 64 nt, Human
auuaaaaugcaauaaggaaucaauucuuuucugccugagaaagagaaccagacgcaggaagaug

SEQ ID NO: 122891 - RNA, 64 nt, Human
cauuaaauacuuucuuccugguuuggagacuaagcugagaaacuuuuuuuaaacuuaagcauug

SEQ ID NO: 122892 - RNA, 64 nt, Human
cagguuuuaaguaauuaacuuaaaagcuucuccucugagaaacauuucuguugcgcuacugacu

SEQ ID NO: 122893 - RNA, 64 nt, Human
aagguagauuuuaagaauggucucaguguuaauacugagaaaaaguccugucaguucagaaaaa

SEQ ID NO: 122894 - RNA, 64 nt, Human
gcacuuuuguuuuaauguauggauucagauuagacugagaaaaauggaugguauuuucuuaaaa

SEQ ID NO: 122895 - RNA, 64 nt, Human
aguccuggaggcuaccagacuuacugaguucuaccugagaaacagccaagcaaagugugagaga

SEQ ID NO: 122896 - RNA, 64 nt, Human
aaauuugggggacuuacaugauucauuuuaacaucugagaaaagcuuugaacccugggacgugg

SEQ ID NO: 122897 - RNA, 64 nt, Human
gguuuuacuuuagucccuccaugucaaagugggccugagaaaagcucauacaugccucauguga

SEQ ID NO: 122898 - RNA, 64 nt, Human
acuauaauaugacugucugaaacuuauuuucucucugagaaauaaauguucuaaugggcaguag

SEQ ID NO: 122899 - RNA, 64 nt, Human
caagcuucugcagggggugauuuuugcucuuguccugagaaauaacagugcuguuuuaaaaaac

SEQ ID NO: 122900 - RNA, 64 nt, Human
cuuuaucuuuaauauuuuaucuuuacagauuucccugagaaagggaauuaugaaauuuuuaaua

SEQ ID NO: 122901 - RNA, 64 nt, Human
uaucacuguuaaagccauugacuccuuuaguacacugagaaaaaucuuauaguaaaacuagccu

SEQ ID NO: 122902 - RNA, 64 nt, Human
uuugcacucugaggugcaacuuaacagggagggccugagaaaagaaugggagggggcuauuaau

SEQ ID NO: 122903 - RNA, 64 nt, Human
cacucauuuaguaauguaccuugaguuaaaaagccugagaaaccaaacacagcuaaugcuaugg

SEQ ID NO: 122904 - RNA, 64 nt, Human
gcuauauuugcagauucucugggauuuuaaggaacugagaaaacagcaaaguugacuaaauuuu

SEQ ID NO: 122905 - RNA, 64 nt, Human
uacuauauuguggaaaagacugaagaauacaauucugagaaauauaaaaaaauuuuaaugguau

SEQ ID NO: 122906 - RNA, 64 nt, Human
cacccugcgcaucaggacugcuucaucgucuuggcugagaaagggaaaagacacacaagucgcg

SEQ ID NO: 122907 - RNA, 64 nt, Human
ggucuuuuuuuuuucuguaaacauuuaauuuggucugagaaaagcugaauguuugggugugacg

SEQ ID NO: 122908 - RNA, 64 nt, Human
acaaauuuuucagggaaucauauucuuaacuucacugagaaaaauguguuacucuuuuggacaa

SEQ ID NO: 122909 - RNA, 64 nt, Human
aauaauguggugacagucacuagauccucacaugcugagaaacagccucuacucucucugcccc

SEQ ID NO: 122910 - RNA, 64 nt, Human
aacuguacagacuguuuacuaaggagcuaaaccacugagaaaacguuauuaaaauuguaauacc

SEQ ID NO: 122911 - RNA, 64 nt, Human
gauuuguguacaauauacccauugaauguauauccugagaaaaauuggggccaaagaagcagga

SEQ ID NO: 122912 - RNA, 64 nt, Human
aguaugaaaaugauuuuuacaauguaaagagagucugagaaaugcaauugcuauucuuuuuaua

SEQ ID NO: 122913 - RNA, 64 nt, Human
aagaaacacagauaguaguaaaaauucugaguaacugagaaaauaaucaguuggaaaugauuag

SEQ ID NO: 122914 - RNA, 64 nt, Human
cacauaggugaaaaaacccauacuuaccuugagucugagaaaaccuuugguagaagcuccuguc

SEQ ID NO: 122915 - RNA, 64 nt, Human
gaauugucuacauuacccaucuccucuuuugccucugagaaagaguauauaagcuucuguaccc

SEQ ID NO: 122916 - RNA, 64 nt, Human
gagaaggagaaccgugaacuggaaaagaucauugcugagaaagaggagcgugucucugaacugc

SEQ ID NO: 122917 - RNA, 64 nt, Human
uauaugucagugagaacaauuuauaugucuuacacugagaaauaaaacugcucauaagugaaaa

SEQ ID NO: 122918 - RNA, 64 nt, Human
gagacuaccguaauugagacuacuguagugacaucugagaaaugggauggaagagugaccaugu

SEQ ID NO: 122919 - RNA, 61 nt, Human
ccccagucccaggaggcugagccugauuguccugagaaaugggaaggaucagauaugacuc

SEQ ID NO: 122920 - RNA, 64 nt, Human
gggcugaugcuuugguguggccagcacucugaaacugagaaauguucagaauguacggaaagau

SEQ ID NO: 122921 - RNA, 64 nt, Human
uggggcagugaagugccacugguuuaccagacagcugagaaauccagcccugugggaacuggug

SEQ ID NO: 122922 - RNA, 64 nt, Human
gucaaguggucaaguucuguuuucuuuuuacccucugagaaacaugaaucccacugggacagau

SEQ ID NO: 122923 - RNA, 64 nt, Human
ugggagcgggacugcaacaagcaaugccagauaacugagaaaucauguucuuuguggacuauuu

SEQ ID NO: 122924 - RNA, 64 nt, Human
gcugagggcccuggggccccuccccucccgaacacugagaaauagugcacuccaagaaacgugg

SEQ ID NO: 122925 - RNA, 64 nt, Human
caaaacuguaaaaaucauggaaaauaagggaauccugagaaacaaucacagaccacaugagacu

SEQ ID NO: 122926 - RNA, 64 nt, Human
gauuuggcaucuacuuagauuuaacauauacuagcugagaaauuguaggcauguuugauacaca

SEQ ID NO: 122927 - RNA, 64 nt, Human
caugugugucugggccaccagaccgaaaugguugcugagaaacuugucuguucaugucccaagg

SEQ ID NO: 122928 - RNA, 64 nt, Human
cggggacagaggaggaauucacgggaucagagcacugagaaacuccagaggcuucugguucacc

SEQ ID NO: 122929 - RNA, 64 nt, Human
cccaaccagguuucugaagauaauuuucauauuccugagaaacuggacuuuuuacaagucuuua

SEQ ID NO: 122930 - RNA, 64 nt, Human
aaacuucuuaacgaaauuuccauucccaaaauaacugagaaagagagagauacaucuuauaaac

SEQ ID NO: 122931 - RNA, 64 nt, Human
cauaggauuucuuaaaauucugaauucgucuuuucugagaaacauaaauuuacauauuuuucaa

SEQ ID NO: 122932 - RNA, 64 nt, Human
ggaaaugugagaaaugucuaauagcccauaaagucugagaaauagguaucaaaauaguuuagga

SEQ ID NO: 122933 - RNA, 64 nt, Human
uucuauauaggugauuuuaccagguuuaguuauccugagaaaacaucuggacuuaagaguuucu

SEQ ID NO: 122934 - RNA, 64 nt, Human
cgucuucuuauguugacuaaaauuauaguuagagcugagaaaaaaaaaauagcaucuaguccaa

SEQ ID NO: 122935 - RNA, 64 nt, Human
cugaagcagaaagaaaaauuuuugaaugacauaacugagaaaauuagagguagcucuagcuuug

SEQ ID NO: 122936 - RNA, 64 nt, Human
gcuuauccacuuaagacaauagguaaaaggggaucugagaaauuauguaauagggagugggaau

SEQ ID NO: 122937 - RNA, 64 nt, Human
cgagcauccaugcaguucguggggaauuaagcaacugagaaaaugccucuuggugccccgaccc

SEQ ID NO: 122938 - RNA, 64 nt, Human
cugcugaagaggagggaggccucguggacugcugcugagaaaccgaguucagaccgagcagguu

SEQ ID NO: 122939 - RNA, 64 nt, Human
guugccuguuuucugaccaucuguguuauugucacugagaaacuaaaauaguaaauuuacuaaa

SEQ ID NO: 122940 - RNA, 64 nt, Human
ucuuaaaaagugacugcaacaaauaaaccuucuacugagaaaauacaucacagauagaagauua

SEQ ID NO: 122941 - RNA, 64 nt, Human
accguucuagaacaacgucacuucacacaggcagcugagaaagguucucuugcuuuuccaguau

SEQ ID NO: 122942 - RNA, 64 nt, Human
ucccaccuuaauaaaugggagagcaucccuaacacugagaaauccuauaaaugugauguaugug

SEQ ID NO: 122943 - RNA, 64 nt, Human
guucacuggcaauuacuaaauguauuuuguugcucugagaaacucagcaguguacugagaugug

SEQ ID NO: 122944 - RNA, 64 nt, Human
caguggaucagaacuuacaaaccaaacuuuuauucugagaaacuggcuguacaauaucuaaaaa

SEQ ID NO: 122945 - RNA, 64 nt, Human
agguuguuuuguauuaauggucagucuuuguucucugagaaauuauguuggaagcagcauacuu

SEQ ID NO: 122946 - RNA, 64 nt, Human
uguguucuguuuaaucuguccauacaaguuauuacugagaaaguguuuaugccauauacuauua

SEQ ID NO: 122947 - RNA, 64 nt, Human
ugugcaaccuuacuaugugcaauauuuuuaaauccugagaaaugugugcuuuuguuuucggaua

SEQ ID NO: 122948 - RNA, 64 nt, Human
agacucuguaaccaccucucugucuuuuuccuuccugagaaacguccaucucucucccuuacua

SEQ ID NO: 122949 - RNA, 64 nt, Human
cauuccaagcugguccccucuguguaucacucuacugagaaauccugccuaguguguuuuggga

SEQ ID NO: 122950 - RNA, 64 nt, Human
uaacuuucucauccucggucucuggaaagucaggcugagaaauccuuucccaggccaggccgcu

SEQ ID NO: 122951 - RNA, 64 nt, Human
uuguuacugauaccucaaaucggaaguuuuaguucugagaaaggcaagucagcguucuugaaau

SEQ ID NO: 122952 - RNA, 64 nt, Human
uuuugagaguucuucauuccuugcugcucacauucugagaaacaaaaagaaauaaaguuuuuau

SEQ ID NO: 122953 - RNA, 64 nt, Human
uggggagcagaauucuugucaucuaugagggguccugagaaagacuugucauuuuuuuuccugg

SEQ ID NO: 122954 - RNA, 64 nt, Human
cguaauguaaagcuuggaugauguuccugauuaucugagaaacagauauagaaaaauugugccg

SEQ ID NO: 122955 - RNA, 64 nt, Human
ccacugugguccagaaaaggaggccuuucgaugucugagaaagaggccccacgcuguagagucc

SEQ ID NO: 122956 - RNA, 64 nt, Human
uaaggaguuccaugcaacugcggauggagccccucugagaaacacaugccccuccaaguggggu

SEQ ID NO: 122957 - RNA, 64 nt, Human
agaggaggagaaagaauccaaagauucucacugccugagaaaacccaggcaauacuauuuuaaa

SEQ ID NO: 122958 - RNA, 64 nt, Human
caaucugguauugaucuuuucacaaauaacagaacugagaaacuuuuauauauaacugaugauc

SEQ ID NO: 122959 - RNA, 64 nt, Human
uuauuugaaucugucuuagccaguuccuguagaacugagaaauaagauugacuuugaaucugca

SEQ ID NO: 122960 - RNA, 64 nt, Human
guaauauaauucauauuuuuaugauauuggcacacugagaaauucauuuuguagagcuauggau

SEQ ID NO: 122961 - RNA, 64 nt, Human
aaaucauuucugcauuguuguuccagagaauuugcugagaaaucaaagccauggucaucuggug

SEQ ID NO: 122962 - RNA, 64 nt, Human
uaguggacaggggucugaaguacacuggaauuuacugagaaacuuguuuguaaaaacuauaguu

SEQ ID NO: 122963 - RNA, 64 nt, Human
uuuuacgaucuagccuuuccaguacaggcacuuucugagaaaccuuuguccucacuugaggcau

SEQ ID NO: 122964 - RNA, 64 nt, Human
aucauguugauuuugcucuuugcuuuuucguugucugagaaauuguuggcguagauuuggcuuc

SEQ ID NO: 122965 - RNA, 64 nt, Human
gccaucccccaucuucccuagacacagcagacaucugagaaagcuucagcauuucucuugcuaa

SEQ ID NO: 122966 - RNA, 64 nt, Human
acagaaugggagaaaauuguugcaaacuaugcaucugagaaaggucugaaauccagcaucuaua

SEQ ID NO: 122967 - RNA, 64 nt, Human
uuucgcuauacucucuucuuggcucguguaguaucugagaaauaggauauaauucuuuuuugcu

SEQ ID NO: 122968 - RNA, 64 nt, Human
cuauugauuuaaacuucaucaguuuugcauccuacugagaaauguuagugauuuugauacuuaa

SEQ ID NO: 122969 - RNA, 64 nt, Human
auaucauugucucaccuuuugccuggguggcugccugagaaaggucuuucuuuuuauagaaaag

SEQ ID NO: 122970 - RNA, 64 nt, Human
guaggaagccauaggagagugaccacgggauucccugagaaacagggccggccccccaacuuca

SEQ ID NO: 122971 - RNA, 64 nt, Human
acagaagccauuacuugcaauuuuuuuuuuuuuucugagaaagucucgcugugucacccaggcu

SEQ ID NO: 122972 - RNA, 64 nt, Human
cagcucuguaaaggucacaggaaucgugaaggagcugagaaaucuuccucuccggcccacuguc

SEQ ID NO: 122973 - RNA, 64 nt, Human
aagagccccaagggcuuaaugaccccauuuguaacugagaaaugauucuuguuuuaguaaucau

SEQ ID NO: 122974 - RNA, 64 nt, Human
auuguguaggacucuguaaucuuuugauuaguuucugagaaaacacaaugaagcacuucacuuu

SEQ ID NO: 122975 - RNA, 64 nt, Human
cuauguuuguuucacuaaacuuucuaaauaaaaacugagaaaaaaaaaaucacugaaaccaggu

SEQ ID NO: 122976 - RNA, 64 nt, Human
caggugucuugaaacauuagcuucuuuuaccaaccugagaaaauuaggaugaccuggcaaauaa

SEQ ID NO: 122977 - RNA, 64 nt, Human
acacauuugggaguauuuaaucagguguggcuaucugagaaaucaacuuugggggaaauguaag

SEQ ID NO: 122978 - RNA, 64 nt, Human
cucucucucuguuuuguucuagccaugaauuugccugagaaacuuguaaccuaugugccucaau

SEQ ID NO: 122979 - RNA, 64 nt, Human
aaucaaccaacauaucugaaaaggaucaugaaaccugagaaaugcuaauggagauuugcuggua

SEQ ID NO: 122980 - RNA, 64 nt, Human
aaaucaauaauguugugaaguaaaacaaucaguacugagaaaccugguuugccacagaacaaag

SEQ ID NO: 122981 - RNA, 64 nt, Human
auuucucuguuaagaugcagccauccauggggagcugagaaaucagacucaaaguuccaccaaa

SEQ ID NO: 122982 - RNA, 64 nt, Human
auccagccacagacagcucccgaugcgcugcccccugagaaaacacuugaauugacgcaauaua

SEQ ID NO: 122983 - RNA, 64 nt, Human
uuucaguauguauccuccagcucuuaaagcuuaccugagaaagcuuuaaaugagaaaaggacca

SEQ ID NO: 122984 - RNA, 64 nt, Human
agauauuuuuauuggaaaauguuaggguagaggccugagaaaguuagcaaaugcuauugacuga

SEQ ID NO: 122985 - RNA, 64 nt, Human
acuguuaucauccuccuagcagaagauaguccuacugagaaaaugagcacuuugaucauucagu

SEQ ID NO: 122986 - RNA, 64 nt, Human
ugcuacaucaacaaauuaaggacauuuucacaaacugagaaauaaacaaauaugccaauucgua

SEQ ID NO: 122987 - RNA, 64 nt, Human
agaaauaccagguaggaaagaagaguuacuauuccugagaaauaaucaagaacauauuuaauuu

SEQ ID NO: 122988 - RNA, 64 nt, Human
agaaccauuuauacauagaggaagggcuuauggacugagaaagggagaacaugguagggauuau

SEQ ID NO: 122989 - RNA, 64 nt, Human
guucuucauuacugcauugaaaaggaaaaccugucugagaaaaugccugacaguuuaauuuaaa

SEQ ID NO: 122990 - RNA, 64 nt, Human
auaugaaauauaaauuaucugaauauuagaugcucugagaaauugaauguaccuuauuuaaaag

SEQ ID NO: 122991 - RNA, 64 nt, Human
gggugggggugggaacucacguggggagcgguggcugagaaaauguaaggauucuggaauacau

SEQ ID NO: 122992 - RNA, 64 nt, Human
uauaauacaaaucaaaaaaucuuccuucuuauaacugagaaauguuucacccaaauuuccuuug

SEQ ID NO: 122993 - RNA, 64 nt, Human
aacacuaguaaccaucuuuccacuaguucauauacugagaaacaguaaauaccuuuccuuucca

SEQ ID NO: 122994 - RNA, 64 nt, Human
cagucagaacaguacuuggguuugcaacagcuuucugagaaaagcuagguguuuaauaguuuaa

SEQ ID NO: 122995 - RNA, 64 nt, Human
cccuuucacuggcaugggagacccuugacaccugcugagaaaacaugccucugccaaaggaugu

SEQ ID NO: 122996 - RNA, 64 nt, Human
aauucagaguauuagacaguuuuaaggcauucaacugagaaaacuuuauuugucaaagucagaa

SEQ ID NO: 122997 - RNA, 64 nt, Human
uuguacugucauugaagguguuuuauagagaaaucugagaaaucacauucacaaauuagaaguc

SEQ ID NO: 122998 - RNA, 64 nt, Human
cguacaaugugguuuauaaaaauaagcuuaacaucugagaaaauguaccaagugguuguguguc

SEQ ID NO: 122999 - RNA, 64 nt, Human
gacugaaacaaacagguucauagagaugaauuuucugagaaacauauaucuacauguuguauaa

SEQ ID NO: 123000 - RNA, 64 nt, Human
augucacaaacacaaucuauucuacaugaggaggcugagaaaggggaagagaaaaacaaaccaa

SEQ ID NO: 123001 - RNA, 64 nt, Human
auucaacacaggaucgguaaaacuguuguaaauacugagaaacauuuugaauguucuucaucuu

SEQ ID NO: 123002 - RNA, 64 nt, Human
cggacaugccgacucaggacaggugggugaggaucugagaaaugcuaaaggcuugaaagcaucu

SEQ ID NO: 123003 - RNA, 64 nt, Human
auuuuaacuuaccaugacuuugcuccuuccuuuccugagaaaauauuuccacuggauuuuuucc

SEQ ID NO: 123004 - RNA, 64 nt, Human
ucacggcaaagucagcagcacugguaagccaagacugagaaauacaagguugcuugucugaccc

SEQ ID NO: 123005 - RNA, 64 nt, Human
gcagacauccccgauugaaagaaccagagaggcucugagaaaccucgggaaacuuagaucauca

SEQ ID NO: 123006 - RNA, 64 nt, Human
uaaaaauacauguucauggguuuaccacuaacuccugagaaauguuaaagguucacagggguuc

SEQ ID NO: 123007 - RNA, 64 nt, Human
uucaucucauguuuaauuuguacgcauagaauugcugagaaauaaaauguucuguucaacuuau

SEQ ID NO: 123008 - RNA, 64 nt, Human
gcccugacuuuacagggggaacacucaugcugagcugagaaagcagagaaguggcgugggagcc

SEQ ID NO: 123009 - RNA, 64 nt, Human
caaggcagcuauuuuauuaaauuuuucacuuagucugagaaauagcagauagucucauauuuag

SEQ ID NO: 123010 - RNA, 64 nt, Human
auugucucuucaaauacguauggacuggauaacucugagaaacacaucuaguauaacugaauaa

SEQ ID NO: 123011 - RNA, 64 nt, Human
aaacaaaaaaauaauaaucaaaugccuucaauuucugagaaaaugaggcagagcauggaaaagg

SEQ ID NO: 123012 - RNA, 64 nt, Human
aaaauuccaggaacuuuucaccugagccuuucuucugagaaaugcugcagucagaagggugugc

SEQ ID NO: 123013 - RNA, 64 nt, Human; identical to SEQ ID NO: 122914

SEQ ID NO: 123014 - RNA, 64 nt, Human
uggacagaguuuuaagcacuaugcugcaggaauccugagaaaaaggggaaauuaauucuauuag

SEQ ID NO: 123015 - RNA, 64 nt, Human
agcuguaguuagauaacaccuagugauuaauuggcugagaaaacccuggaguggagggaggcuc

SEQ ID NO: 123016 - RNA, 64 nt, Human
cagugucaucuaaauauuccgaauguuuggccuucugagaaaagagcuucuaguaauugaacca

SEQ ID NO: 123017 - RNA, 64 nt, Human
cuacuaauuaggcuauaaccaggucuuuccuggccugagaaauauucucuuaaaaugaccuuug

SEQ ID NO: 123018 - RNA, 64 nt, Human
uuacuaaugaugcuuuuauagcugcuuggauucucugagaaaugauggggagugagugaucacu

SEQ ID NO: 123019 - RNA, 64 nt, Human
ccuuccugcgcgcuuucauuuuuugaccucaucacugagaaaggcucaauuuggugcucacgug

SEQ ID NO: 123020 - RNA, 64 nt, Human
uccaguuagcuccagcucaggucugagacccgugcugagaaaggucugagcaccgaccgugccc

SEQ ID NO: 123021 - RNA, 64 nt, Human
aggcucguugcgguuuaaagaucccucuaggucacugagaaaugccacagaaugugcaggaagc

SEQ ID NO: 123022 - RNA, 64 nt, Human
gcugaaaccuucgaccguuugagcuggaggggcccugagaaaucagagucuacguaucauuuac

SEQ ID NO: 123023 - RNA, 64 nt, Human
guugacaaauaagucaucaugaucacgaaggacacugagaaaaaauaauuuagaacccugguuu

SEQ ID NO: 123024 - RNA, 64 nt, Human
ucaagccacuuaccuacugaacugcuacuguugccugagaaaaaugugauuuuuauucugcuug

SEQ ID NO: 123025 - RNA, 64 nt, Human
cccgagggcuggaaaaacgcuuucaucucuaaaacugagaaaucaucauaauugugcuuucacu

SEQ ID NO: 123026 - RNA, 64 nt, Human
uuuaucuggccccagguagaaacuuuuaucuauucugagaaaacaagcaaguucugagagccag

SEQ ID NO: 123027 - RNA, 64 nt, Human
agucaucuccggugauccuuaaaugaacugcaggcugagaaaagaaggaaaaaggucacagccu

SEQ ID NO: 123028 - RNA, 64 nt, Human
gccccucucuccucccaccuggacuuggggggaacugagaaacacuuuccuggagcugcuggcu

SEQ ID NO: 123029 - RNA, 64 nt, Human
uguuuagaauuacaaaauaguuuuuaaauauugucugagaaaagccaaaguuaaugcaaccuag

SEQ ID NO: 123030 - RNA, 64 nt, Human
cuccaaaucuacuguacugucagcuucacuccaccugagaaaaaagaaaaaaaaauugauagcu

SEQ ID NO: 123031 - RNA, 64 nt, Human
cguaaguacugaggguaguuucccuaagucuguccugagaaaaagcauacuuaguacuccugua

SEQ ID NO: 123032 - RNA, 64 nt, Human
aacugggccuguagcucaagagaaaaguugacaccugagaaacaucuagaaauugccuauccug

SEQ ID NO: 123033 - RNA, 64 nt, Human
uuuaaagauuguugcagugaagaaaaaccuuuaacugagaaauauggaaaccgucuuaauuuuc

SEQ ID NO: 123034 - RNA, 64 nt, Human
cuaauagagaacaugcccucagcuaagcccccuacugagaaacuuccuuugagaauugugcgac

SEQ ID NO: 123035 - RNA, 64 nt, Human
aaggaucacuugagaccaggaguucgagaccagccugagaaacauagugagcccuugucucuac

SEQ ID NO: 123036 - RNA, 64 nt, Human
gcccuuuuguuuuagaacacacauccuucagcagcugagaaacgaacacgaauccaucccaacc

SEQ ID NO: 123037 - RNA, 64 nt, Human
ugcugguuuuaguugcaacuuuguauaaaagggacugagaaauuuauaaacuuuuuucuuacug

SEQ ID NO: 123038 - RNA, 64 nt, Human
ucagauccugugaagaauggcaaaacagccugaccugagaaacgugacugagaagcauuggaag

SEQ ID NO: 123039 - RNA, 64 nt, Human
cuccaggaagggcucuggcucagguugcagacagcugagaaaagauggcccugucagccacccu

SEQ ID NO: 123040 - RNA, 64 nt, Human
ugauauaaacacuucuuuuaacuccgaaaaucuucugagaaaucacaaaauucacgguaugcuu

SEQ ID NO: 123041 - RNA, 64 nt, Human
auuccacaccacauguacuguauauucuaaucugcugagaaagguggucaggcccuucuaaaug

SEQ ID NO: 123042 - RNA, 64 nt, Human
ugacuuguccuaggccgauuucucuauggcuucccugagaaaggugaggcccaaaggagagagg

SEQ ID NO: 123043 - RNA, 64 nt, Human
uuuccauagugagaaaauucaauguagcagacuacugagaaacuacuguguugcucaggcuuug

SEQ ID NO: 123044 - RNA, 64 nt, Human
guugucuccuuccuuuucugugaaaguccucauacugagaaauuuguauauuuuauauuaaauc

SEQ ID NO: 123045 - RNA, 64 nt, Human
ccucucuaaaaggaaaaacuugauauuuaucagucugagaaaauauuuuuuucuaaagaaggca

SEQ ID NO: 123046 - RNA, 64 nt, Human
ggagucuucuucccaacacgagcgcauccauguccugagaaaaagucugugguuuagaaaauau

SEQ ID NO: 123047 - RNA, 64 nt, Human
gucugcacagaaagucccaguacaacuuccauugcugagaaaauccucagaggacuuucccacu

SEQ ID NO: 123048 - RNA, 64 nt, Human
cccagaagggcaaauuguuugagucaguaaugagcugagaaaagacagagcauaucuguguauu

SEQ ID NO: 123049 - RNA, 64 nt, Human
ccaguuccuacugccuguguugcuacuuuaagagcugagaaaaacauuccaaugagcuauccau

SEQ ID NO: 123050 - RNA, 64 nt, Human
ucaagcagggcauguuucccuuuguucacauucucugagaaauugaaacucugguuucucuuca

SEQ ID NO: 123051 - RNA, 64 nt, Human
agagggcacucugcuuguuauuagagauuaccuccugagaaaaaagguuccgcuuggagcagag

SEQ ID NO: 123052 - RNA, 64 nt, Human
uguauuagaauuguuuuuucuaaaguuauguuaccugagaaauuaaggacugcaccugguuuaa

SEQ ID NO: 123053 - RNA, 64 nt, Human
aagaaguuuaccuuuugacuggaaccagauggcacugagaaaaagaaugagaaccaccuuauuc

SEQ ID NO: 123054 - RNA, 64 nt, Human
guggguggaccaguacuccaggugauggggcaugcugagaaauagagaaaagagaccauguuua

SEQ ID NO: 123055 - RNA, 64 nt, Human
gaaauaaaugcagcuuuaccaugaaccugcuccacugagaaaagccaggcagaucgauuuuuag

SEQ ID NO: 123056 - RNA, 64 nt, Human
uuuagugcauaucugcuggcuucagcccuggcagcugagaaauuguuuucuauauguagaagga

SEQ ID NO: 123057 - RNA, 64 nt, Human
uccgaguguuugccaggcuuaaggagaggagaaacugagaaaugaaugcugagacccccggagc

SEQ ID NO: 123058 - RNA, 64 nt, Human
ggagcauugauguuggguggcuuuuguucuuucacugagaaauucggaauacauuugucucacc

SEQ ID NO: 123059 - RNA, 64 nt, Human
acuuaguguugucaaguaacaguuacugaaagagcugagaaaaagaacaaugaacagcaacgau

SEQ ID NO: 123060 - RNA, 64 nt, Human
agaaaacagcaauagugaaugaaugcaaaaggugcugagaaauuccacacaugaguauugugau

SEQ ID NO: 123061 - RNA, 64 nt, Human
auauauaauuaaacuacucugcccuggacacucucugagaaacagaucuacugggcccuuuuuc

SEQ ID NO: 123062 - RNA, 64 nt, Human
augagcaaaaagccgagagccagaccuguuuguccugagaaaacuguccgcucuucacuugaaa

SEQ ID NO: 123063 - RNA, 59 nt, Human
ugcagcagcuacagcacuaagagaagccccugagaaaaacccucuagaaaaacagcugu

SEQ ID NO: 123064 - RNA, 64 nt, Human
ccaaagccaggcccugaggccugggaguccuggacugagaaaggggguuccugggcccaccugc

SEQ ID NO: 123065 - RNA, 64 nt, Human
aguuuuucauagccuuacaguaucuggcuuuguacugagaaauaaaacacauuuucauauuugg

SEQ ID NO: 123066 - RNA, 64 nt, Human
gagcagaggacacauggccuugcgugugugaaagcugagaaaaugggagcugugcuucagcuac

SEQ ID NO: 123067 - RNA, 64 nt, Human
acuuuguuguuuggauuccucacagccuuggcuccugagaaaggugaggagggcaguccaagag

SEQ ID NO: 123068 - RNA, 64 nt, Human
uucagugcuuaacacuuuucuagcguugguacaucugagaaaugagugcucagguggauuuuau

SEQ ID NO: 123069 - RNA, 64 nt, Human
uuaauauuuucaaagagacuaugauggaccagcccugagaaagaaugaguauuuuugaauugag

SEQ ID NO: 123070 - RNA, 64 nt, Human
cuuaccuauuuaaaaaacuaaacuugcacugcaacugagaaauuauuuguaaaucauguggcau

SEQ ID NO: 123071 - RNA, 64 nt, Human
auauucccaugccuggagcauggcauagaggaagcugagaaauguggggucugaggaagccauu

SEQ ID NO: 123072 - RNA, 64 nt, Human
auauuaagauuacuggaaugguuaagucaugguucugagaaagaagcuguacguuuucuuuaug

SEQ ID NO: 123073 - RNA, 64 nt, Human
guauucccuuuuuaaaugagcuuucaggaaguugcugagaaaugggguggaauagggaacugua

SEQ ID NO: 123074 - RNA, 64 nt, Human
acaucugaccucccagcaccagccagcagcaggacugagaaagacucacccugcagcucugacc

SEQ ID NO: 123075 - RNA, 64 nt, Human
guuaucaaaaccacacugaaagaagauacaguuacugagaaacuccaaagcagugcauccucaa

SEQ ID NO: 123076 - RNA, 64 nt, Human
aguaugugcauaugagauaagccugcaaccucuugaccuucagcuccuaugcaggcuucucuug

SEQ ID NO: 123077 - RNA, 64 nt, Human
gaguugcagagcauauaauaaauuuggaugucaacugagaaaggagugagaaggaagaaacaau

SEQ ID NO: 123078 - RNA, 64 nt, Human
cuggcccugcuggggcugaaggucagaaguaauccugagaaauguuucaggccuggggagggag

SEQ ID NO: 123079 - RNA, 64 nt, Human
accaccaauaucuuauuucaaccucacaguugaccugagaaaucgagauuaucacuccacuuuu

SEQ ID NO: 123080 - RNA, 64 nt, Human
ucucugucugcaccagggaguaguacccccagcucugagaaagaggcggcauccccuaggccaa

SEQ ID NO: 123081 - RNA, 64 nt, Human
gaagggucauucggggcgggagacccugagccugcugagaaauccuuuuagcgccagcaagccc

SEQ ID NO: 123082 - RNA, 64 nt, Human
agaggcuggcuccuccccaagguuaguccccagacugagaaagugaaaccuuauugggaaaaau

SEQ ID NO: 123083 - RNA, 64 nt, Human
aaaggaagaaaauguagauuagaaaauaagacuucugagaaaaaguucaaggaauaaagauugu

SEQ ID NO: 123084 - RNA, 64 nt, Human
uuaucaaaccuuuuauuacagaaaaaaaucugaacugagaaaggagcucugaauuuauuugaca

SEQ ID NO: 123085 - RNA, 64 nt, Human
accugucaguauccccuucugcuuaacacacccacugagaaaacccuguuuguaguucacuuug

SEQ ID NO: 123086 - RNA, 64 nt, Human
uaagaagaaauagaagauaauauauuuaauggcacugagaaacaugcaagauacaggaaaaaug

SEQ ID NO: 123087 - RNA, 64 nt, Human
caugcucuguaaguugcuuccuaacauccuuggacugagaaauuauacuuacuucuggcauaac

SEQ ID NO: 123088 - RNA, 64 nt, Human
uuucaaacaaagauaaaggaauuuauuuuuuaaccugagaaacugauugcaaaaaggaaaaaaa

SEQ ID NO: 123089 - RNA, 64 nt, Human
uggccggcgggaagaccagccccgacagcaccuccugagaaagucagccaagggccuacccuga

SEQ ID NO: 123090 - RNA, 64 nt, Human
uggccugagcuaugccuguugaggcaucuggagacugagaaagaaucaaaggcagagaagacca

SEQ ID NO: 123091 - RNA, 64 nt, Human
agauuacccaacauaccauuauagucucuucuuucugagaaaaugugaaaccagaauugcaaga

SEQ ID NO: 123092 - RNA, 64 nt, Human
uucuagggucuuaauaguagucaagaaaagggaucugagaaaaguacucuuucaggagggacua

SEQ ID NO: 123093 - RNA, 64 nt, Human
ggaauccuggguuucuaggaggcagaaagguuuucugagaaacaaggcuuuuggaaggaaggug

SEQ ID NO: 123094 - RNA, 64 nt, Human
uggauucugcugccacgugccauaguggagcacccugagaaagguucacuccaggguuccaagg

SEQ ID NO: 123095 - RNA, 56 nt, Human
aauuuaucacccaugacugacugagucugagaaaaggcagaagaaggggggcacaa

SEQ ID NO: 123096 - RNA, 64 nt, Human
uauauccuguauucuugguuuauuuguuuuauuucugagaaauauguguuaagaucucucgcug

SEQ ID NO: 123097 - RNA, 64 nt, Human
auaaauacagacauaaaaagaggaguacaacauacugagaaaagagcuccaguaacaaauauug

SEQ ID NO: 123098 - RNA, 64 nt, Human
agcucaaagggaugugggcgaaaucuugagucuucugagaaaacuguacaagacacuacgggaa

SEQ ID NO: 123099 - RNA, 64 nt, Human
uuccagacucauagcaucaguggauaccauguggcugagaaaagaacuguuugagugccauuaa

SEQ ID NO: 123100 - RNA, 64 nt, Human
uuuaaacauauguaagaaauuaaguggcaaagaacugagaaagcuuaagaccugcuucaaaagc

SEQ ID NO: 123101 - RNA, 64 nt, Human
ccauuaguaucacccccaguucuuacaguaaucccugagaaaucuccuucaagcaucaccaaac

SEQ ID NO: 123102 - RNA, 64 nt, Human
uugaugagcagaucuguggaagaacaauccagggcugagaaaucguagagcagugaggcaggcu

SEQ ID NO: 123103 - RNA, 64 nt, Human
aggcagaagagacagacgaggcagagacaaaacacugagaaagagacugaaauggaguaauaaa

SEQ ID NO: 123104 - RNA, 64 nt, Human
uuuggcuugcagacugccuucuaucccagaacagcugagaaaucuaugaagcugagauucugaa

SEQ ID NO: 123105 - RNA, 64 nt, Human
ggggguguugugguuuuuuguuuuuguuuugcuucugagaaagcauuugccuuucuuccucucc

SEQ ID NO: 123106 - RNA, 64 nt, Human
cuaaaugcuggggcacauuucacauaucgacuaccugagaaauugcuuugugucccacuguuau

SEQ ID NO: 123107 - RNA, 64 nt, Human
uugggguggggguuggguaagggaauggucaagacugagaaaggaaugaaauccauucaggaaa

SEQ ID NO: 123108 - RNA, 64 nt, Human
ucucucuuucccccuccagguacaggcugagaggcugagaaaucauccccugaauaacuuuuuc

SEQ ID NO: 123109 - RNA, 64 nt, Human
auaugacaguggagguuguauuccuuuuauauugcugagaaaacuaguuaaaugaucagauucu

SEQ ID NO: 123110 - RNA, 64 nt, Human
aggcuccucucuggaucccaccuuuucaucccuucugagaaauguacccuauuauuuccuucau

SEQ ID NO: 123111 - RNA, 64 nt, Human
aauaaaacaaaauauugcauucuuuguuuggauucugagaaaugucugggcuucccauuguuuc

SEQ ID NO: 123112 - RNA, 64 nt, Human
gcuuggcugaacuggaaagagaacauacaaagcucugagaaauguguucaauugugggauuaua

SEQ ID NO: 123113 - RNA, 64 nt, Human
gggcuccagccucacucagucccuaauuaugggacugagaaaagcuuggaaagaaucuugguuu

SEQ ID NO: 123114 - RNA, 64 nt, Human
gagaacuuuucuuguaaugcagcuuuuucucuuccugagaaacaguguguucuaaugggauucc

SEQ ID NO: 123115 - RNA, 64 nt, Human
uuuuauuuaucaaaauguaauggauuuuuaaaggcugagaaauuuuccuuauaccuaccuuuuc

SEQ ID NO: 123116 - RNA, 64 nt, Human
aguccccuggcuaugacccugcuuuguucuuucccugagaaacaguucagcagugaccaccacc

SEQ ID NO: 123117 - RNA, 64 nt, Human
caaggcacuaugcuagaucuggugccuagaagcccugagaaagaacuuaaagagcuaggaggac

SEQ ID NO: 123118 - RNA, 64 nt, Human
gcaguagaaucccaggcucuuucacggauuuaggcugagaaacuucagcagcaguauuggacuu

SEQ ID NO: 123119 - RNA, 64 nt, Human
ggagauguugguaggaaaguuucaaguuacgcagcugagaaacagggaccaaauagugcuccug

SEQ ID NO: 123120 - RNA, 64 nt, Human
auggagagagccagguggaaugccauaaaucacacugagaaaauauuucuggcaaacagcuccu

SEQ ID NO: 123121 - RNA, 64 nt, Human
guguuguacagaauuuaucauggauuauugacugcugagaaagggacaguggaauuuagccaua

SEQ ID NO: 123122 - RNA, 64 nt, Human
uaaugcagcugcugagaagauuuuuuuuuaaugacugagaaaacuuguuuacagcuccagcaua

SEQ ID NO: 123123 - RNA, 64 nt, Human
uugauguaacuauagcugcaauuuuugugcaggacugagaaacacagugcauuauuuauugcgg

SEQ ID NO: 123124 - RNA, 64 nt, Human
cccgcccuccccuuuuauaccugcucuuguucuacugagaaaagccucuccagcaauaauguuu

SEQ ID NO: 123125 - RNA, 64 nt, Human
guuuucaaaaaugaaggcaaaauaaagacuguuucugagaaacuaaaucaaagguaauuuuauu

SEQ ID NO: 123126 - RNA, 64 nt, Human
uuuuuucuuuuuucuuuuuccuuucuuucgugggcugagaaaggggcaggcaaaaugaagcugg

SEQ ID NO: 123127 - RNA, 64 nt, Human
cuaaccugcaucccauuuccagccucuuuucaagcugagaaaaaaaaaaaaaaacacguuugau

SEQ ID NO: 123128 - RNA, 64 nt, Human
gauugcugucugugauuucucacauuuuuauuugcugagaaacauucagaaaauuauuccaaaa

SEQ ID NO: 123129 - RNA, 64 nt, Human
gagugagcaaguugauaauggccucaucucugaccugagaaaaaacaacuuugacccuuguucu

SEQ ID NO: 123130 - RNA, 64 nt, Human
gggaguggauccaggacaggggagguuguaaccccugagaaaugaacauugguaggagcauuua

SEQ ID NO: 123131 - RNA, 64 nt, Human
aauuauccagccccaaaugccaauagggcucaaacugagaaacauugaguuauauggcuauuag

SEQ ID NO: 123132 - RNA, 64 nt, Human
cauauauuuguguguuuauaugcucacagguggacugagaaaucaguuacaucuuaagugaccu

SEQ ID NO: 123133 - RNA, 64 nt, Human
uguaaguuuaaagagcuaaagcucuaaaacuguucugagaaacaaugaauaguacauguauaug

SEQ ID NO: 123134 - RNA, 64 nt, Human
gauauaccgggaccucaugcagcuuggcagauaucugagaaaugguuuaauucaugcucaggag

SEQ ID NO: 123135 - RNA, 64 nt, Human
auuauugagguucauauucuucugguauaucauucugagaaauuguggcuaauuuagaacauug

SEQ ID NO: 123136 - RNA, 64 nt, Human
cacucacuggggaggaagcaaggaagcaaacagucugagaaaaugaugcaagaaaaucaaaugg

SEQ ID NO: 123137 - RNA, 64 nt, Human
aacaauaaugcaacuuuagaaguauuccacacugcugagaaauguugcuuugaguuugcuuuac

SEQ ID NO: 123138 - RNA, 64 nt, Human
ugcucuaaagcaccuaagaaaagaacugcaaagucugagaaauaggaaaaaugucugagacagc

SEQ ID NO: 123139 - RNA, 64 nt, Human
caaaaggagggaaagugugaagaauaaaguagaucugagaaauucugagccaaucaggcuucuu

SEQ ID NO: 123140 - RNA, 64 nt, Human
aauauucauucuaauaauuagacuaagugaaaaucugagaaagaguuaauugcaaugugauagu

SEQ ID NO: 123141 - RNA, 64 nt, Human
aguggacaaguccgcuuugugagaugaauacuuccugagaaacuugacaaguaucucuccauuu

SEQ ID NO: 123142 - RNA, 64 nt, Human
caugcacacacacacguuaucccaugauguuccacugagaaaacaccaaaaaauuuugaaaaag

SEQ ID NO: 123143 - RNA, 64 nt, Human
cagaaagcugggaaaggggauggguagaacaagacugagaaauccacaugcuucagaauucaga

SEQ ID NO: 123144 - RNA, 64 nt, Human
aagcagcugaaaaagugcaucaacuccucuuuuucugagaaacauggagcagcgcacgcccagg

SEQ ID NO: 123145 - RNA, 64 nt, Human
cuuuuuguaggggacgagaaagaucauugaaauucugagaaaacuucuuuuaaaccucaccuuu

SEQ ID NO: 123146 - RNA, 64 nt, Human
auuuccaaaugugauuucuaauagcucaguguggcugagaaagugcggaacuccacuaaaaacu

SEQ ID NO: 123147 - RNA, 64 nt, Human
gauacuguuuuaggugagcugagcuauuucguuacugagaaaaugauaaguauccauuuagaau

SEQ ID NO: 123148 - RNA, 64 nt, Human
aagagaaaaguuuguauuuuaaaugucaaugugccugagaaaugucagcuucaccacgcucuug

SEQ ID NO: 123149 - RNA, 64 nt, Human
auguaagagacacaaaugaagaagaacaaagagccugagaaagcagcaagaggacaugaugaaa

SEQ ID NO: 123150 - RNA, 64 nt, Human
agggucugccugucuacauauuuuuuauuuuuuucugagaaauucugaacacauagaucucuuu

SEQ ID NO: 123151 - RNA, 64 nt, Human
gagguagaggaaaaucaaugcuuuaucugauaugcugagaaauuauuagauugccaauacucau

SEQ ID NO: 123152 - RNA, 64 nt, Human
aagcuaucuugaaaauguuuuggaacugcgauaacugagaaacucuuaccaguccacaugcaau

SEQ ID NO: 123153 - RNA, 64 nt, Human
uccggagccccacggggcacgcguuaggaaaccacugagaaaagacgaaaauggcaccagcguu

SEQ ID NO: 123154 - RNA, 64 nt, Human
cagcggcccagccuugcugcccugucugcugauucugagaaaucccagaacagcccauuaccag

SEQ ID NO: 123155 - RNA, 64 nt, Human
ugaaaggccaauaccagaacacaggcugaugcuucugagaaagucuuuuccuaguauuuaacag

SEQ ID NO: 123156 - RNA, 64 nt, Human
auucaagugucagaaaguaaaagucaguucaggacugagaaaggaaagaucagugcugauuuua

SEQ ID NO: 123157 - RNA, 64 nt, Human
ccccucuuggagaagucucagcuaagcucacguccugagaaagcucaaagguuuggaaggagca

SEQ ID NO: 123158 - RNA, 64 nt, Human
cauucugcugcugaaugccacacauccauccagucugagaaagugagagaggcaaucaugccaa

SEQ ID NO: 123159 - RNA, 64 nt, Human
agccagugagcagcccugccagacuacugccagacugagaaacccagaagcugguagucaugug

SEQ ID NO: 123160 - RNA, 64 nt, Human
gggaaacuuauuuuuauuugccugauuuaagugucugagaaacaaaucuuuguucucuuaggcu

SEQ ID NO: 123161 - RNA, 64 nt, Human
ggccauccaucaaguccaucaaggcccagcccugcugagaaaugugcuucugcuucuacagcaa

SEQ ID NO: 123162 - RNA, 64 nt, Human
augaauuuuauaaaaugaauuuuguaauuuuuuucugagaaaaaaaaguucuuaaauacaauaa

SEQ ID NO: 123163 - RNA, 64 nt, Human
caggaagccaccgcacccccaaagucacugggcccugagaaaagccauuguggagccaacucca

SEQ ID NO: 123164 - RNA, 64 nt, Human
caggggcagccguggccuaggcccaaacucugcucugagaaaauaaauaucuguaccaccuguc

SEQ ID NO: 123165 - RNA, 64 nt, Human
uuucagauacuguuggacccagaagagaagggcacugagaaaaagcaaaagguauaggcccugg

SEQ ID NO: 123166 - RNA, 64 nt, Human
gaucuacccugaaaaucucuucuccuuccccuuucugagaaacgucauccccaccaguuaacgu

SEQ ID NO: 123167 - RNA, 64 nt, Human
acagucacaugucacuuaaugauagggaaacauucugagaaaugcauuguaaggugacuuuauu

SEQ ID NO: 123168 - RNA, 64 nt, Human
uuuaccuuuaguucagccaagucauuuucaaguccugagaaaugacaucaucuucaggauaaaa

SEQ ID NO: 123169 - RNA, 64 nt, Human
gguaggauuagaggcuucccacuuaaaacuauuucugagaaaucuuagguuuuaucacugcuau

SEQ ID NO: 123170 - RNA, 64 nt, Human
acuuugaaggugcuuugugagguuuggacucaugcugagaaacccacaggaaagcacuguccag

SEQ ID NO: 123171 - RNA, 64 nt, Human
cagucagaaagucccuauaggauagagcuggcagcugagaaauuuuaaagguaauugauaauua

SEQ ID NO: 123172 - RNA, 64 nt, Human
caagccucugucaaaaaagaagagaaaagaucgucugagaaaucugaaaaaaaagaaagcaagg

SEQ ID NO: 123173 - RNA, 64 nt, Human
cauuugcagguaauaucaagcagcaaacuaaauucugagaaauaaacgagucuauuacuguguu

SEQ ID NO: 123174 - RNA, 64 nt, Human
agcauggaacguguugggauuuagagaacauuaucugagaaaagaguucacuuccugcucccag

SEQ ID NO: 123175 - RNA, 64 nt, Human
uuggagccacugauggguccacucauggccucagcugagaaaggagacgaugaacguguagcug

SEQ ID NO: 123176 - RNA, 64 nt, Human
ccugacagcagagaaguauuauuugguggggagucugagaaagccuggcuuguauuaucugucc

SEQ ID NO: 123177 - RNA, 64 nt, Human
ugcugaaugacauucaagcugauuuucuagaccacugagaaaaucuuuauuuacaauaaauuuc

SEQ ID NO: 123178 - RNA, 64 nt, Human
uggcguccugcccuugcuccagccugacaacagccugagaaauccccccguaacuuauuaucac

SEQ ID NO: 123179 - RNA, 64 nt, Human
ccuccuccuagcucagggacccagccccuccucucugagaaacucugaccuucauguccuuagg

SEQ ID NO: 123180 - RNA, 64 nt, Human
ccuuugaacagaagggccuggaaggccccuggggcugagaaaggguccgcccgguggccuggag

SEQ ID NO: 123181 - RNA, 64 nt, Human
uucuguuccggugccuuuccuauccaggcaccaccugagaaaguugucauuugaggucgcacuu

SEQ ID NO: 123182 - RNA, 64 nt, Human
uuucuuuggggguggaaaaggaaaacaauucaagcugagaaaaguauucucaaagaugcauuuu

SEQ ID NO: 123183 - RNA, 64 nt, Human
acuguuucauauuugaaucagagggcuucuuguucugagaaauagguucaaaaucauuggaacc

SEQ ID NO: 123184 - RNA, 64 nt, Human
gaguacugucuuaggaauuauuaggaguugauuccugagaaacaacacauuuuuccccaugaac

SEQ ID NO: 123185 - RNA, 64 nt, Human
ggaaugcgguucaaacccaguggcuugaaacuuccugagaaacuguagcauauccagcccccua

SEQ ID NO: 123186 - RNA, 64 nt, Human
agcgacacacacucaccuuccucuucucauccaccugagaaaaaagcucguccauguccgccau

SEQ ID NO: 123187 - RNA, 64 nt, Human
gugacucacgggcccugugcugugauguugagagcugagaaaaaccuccaaggcccugagcccc

SEQ ID NO: 123188 - RNA, 64 nt, Human
acacuuucugggcuaacauaguccucacacagggcugagaaagaaagugucuccuuuccuggaa

SEQ ID NO: 123189 - RNA, 64 nt, Human
gggcccuuggggcccuccaaccucaggugaugagcugagaaagauguucacgucuaagcgucca

SEQ ID NO: 123190 - RNA, 64 nt, Human
auuugaacuuucguaagagaccucagcaguuagacugagaaaaguuagagugcuguaguuauga

SEQ ID NO: 123191 - RNA, 64 nt, Human
uggugugcaccuguagucccagcucuucaggaggcugagaaaagagaauuguuugaaccuggaa

SEQ ID NO: 123192 - RNA, 64 nt, Human
cugcacugucuuacugauuuacaaacugaaaucacugagaaaugucuuuaguucagugagaaga

SEQ ID NO: 123193 - RNA, 64 nt, Human
uuuauuuggaauggaugcuacucuaggccuuaaacugagaaaugccaggcuauuguagcuauua

SEQ ID NO: 123194 - RNA, 64 nt, Human
ucuagugaauguauuuuaaccacaguguccuaaacugagaaaacuagagaggaaaaagugggug

SEQ ID NO: 123195 - RNA, 64 nt, Human
ggacaccauaggguaggaauagccuuuccucagucugagaaauuggucucuuuuaaaagacgaa

SEQ ID NO: 123196 - RNA, 64 nt, Human
ggggccaguggaccugacaguaccuuaccuggcucugagaaacucgcaauccuaguuugcacaa

SEQ ID NO: 123197 - RNA, 64 nt, Human
cuuucucaccccagcucuggcuaugcccaguucucugagaaaggagcucaguggggaggugguc

SEQ ID NO: 123198 - RNA, 64 nt, Human
ccccuugggagcagcagcgucaguggacccagugcugagaaaagcccccacaucccggaaaacc

SEQ ID NO: 123199 - RNA, 64 nt, Human
aguauggaugaaggucagauuuucuugucaguuucugagaaaccuggcagccugcuguuaacaa

SEQ ID NO: 123200 - RNA, 63 nt, Human
cugcaaagaaagugggaggucaggaaacuuuuaacugagaaaucucaauuguaagagaggaug

SEQ ID NO: 123201 - RNA, 64 nt, Human
cagacuuuuaaaacuaugagccguuucagcaaaacugagaaaaaaagaagauuaauuaauuucc

SEQ ID NO: 123202 - RNA, 64 nt, Human
agccaaaacuacacuuugcugguuccuguccccucugagaaaggggauagaaagcuccuuccuc

SEQ ID NO: 123203 - RNA, 64 nt, Human
cuccaccccacucacagagacacagggcauccaacugagaaaacgaaacugcucuaagcacacg

SEQ ID NO: 123204 - RNA, 64 nt, Human
cauacuguaguccuauugagaagacauuucgucucugagaaaaaaggauggaacuauggguucu

SEQ ID NO: 123205 - RNA, 64 nt, Human
gcaacaaggcugcacagcucaacggaagaggcugcugagaaagagaaugagaagaggcugcugc

SEQ ID NO: 123206 - RNA, 64 nt, Human
aagucugccccagaaacucucacacuuccagacccugagaaaaaagccacccugaauuuacccg

SEQ ID NO: 123207 - RNA, 64 nt, Human
cgcuggaaaccucuggaggucaucucggcuguuccugagaaauaaaaagccugucauuucaaac

SEQ ID NO: 123208 - RNA, 64 nt, Human
ugcuggaugccgccugauagacaugcuggccuggcugagaaaccccugagcagguaacccaggg

SEQ ID NO: 123209 - RNA, 64 nt, Human
gacgcgccaccggugaaugugccucugguggcugcugagaaaaauacacugugcagcucagugu

SEQ ID NO: 123210 - RNA, 64 nt, Human
ggaaccgccgggugacaccugcguggaggcugagcugagaaagggccuccgcuuagagcugcgg

SEQ ID NO: 123211 - RNA, 64 nt, Human
aacgugagaacaggcuaugggaaggcugcaaaggcugagaaaugcaaaggcucauauuuauaaa

SEQ ID NO: 123212 - RNA, 64 nt, Human
ccacccugcugcacuaggacuugguaagaugacucugagaaaaugcgagacucugauggaaugu

SEQ ID NO: 123213 - RNA, 64 nt, Human
cccguuucugguugaaaucaagguuaggaugcaacugagaaaauaaaagacugcacuuuggaga

SEQ ID NO: 123214 - RNA, 64 nt, Human
aacaaaguggcaguggggaccaggguguccccugcugagaaauggagagcucuuuuccccugua

SEQ ID NO: 123215 - RNA, 64 nt, Human
gcccagaccggggcccagcagagcucucaggaggcugagaaaccuccagggcagacagaaaguu

SEQ ID NO: 123216 - RNA, 64 nt, Human
ucagucagcugccaccugcuucucauuuugcccucugagaaaaggcaugguuucuuaauugagg

SEQ ID NO: 123217 - RNA, 64 nt, Human
agagucacgcaucacuuaaugacagagauauguucugagaaaugcaucguuaggugauauuguc

SEQ ID NO: 123218 - RNA, 64 nt, Human
gugaauaggauuuuuacucccuuuguacaguauucugagaaacgcaaauaaaagggcaacaugu

SEQ ID NO: 123219 - RNA, 64 nt, Human
agggucgugggaaaggggaguaggugggggaacacugagaaagaggcagggaccuaaagggacu

SEQ ID NO: 123220 - RNA, 64 nt, Human
ugcugcucgagucuccugcacugugucucccacacugagaaaccccccaacccacucccucugu

SEQ ID NO: 123221 - RNA, 64 nt, Human
uauugggggaaaaacuacaagugcuguacauaugcugagaaacugcagagcauaauacugccac

SEQ ID NO: 123222 - RNA, 64 nt, Human
ccaggauuucacaccugagcccugccccacccugcugagaaaacacuccgccacgugaagagac

SEQ ID NO: 123223 - RNA, 64 nt, Human
cuuaaaaucacaaacaugacauugcugauaguggcugagaaauucagaugagaagacaaauugg

SEQ ID NO: 123224 - RNA, 64 nt, Human
gcccuagaugagcccagcccuguucugggugcagcugagaaaaugagugacuagacguucauuu

SEQ ID NO: 123225 - RNA, 64 nt, Human
ccagugccuucccccguggaauaaacgguguguccugagaaaccacacacaggcucguggcauc

SEQ ID NO: 123226 - RNA, 64 nt, Human
uaaaaaucuuaaaacacuuuuuuucuaaccuagacugagaaauucauguuuacuuuucuaggug

SEQ ID NO: 123227 - RNA, 64 nt, Human
uagaaggaaagcaugucucugcuuccauggcuuccugagaaagcccaccugggcugggcgcggu

SEQ ID NO: 123228 - RNA, 64 nt, Human
agggcugugccccaauggaaacugaguucauuuucugagaaagguuuggaugacugaaauauuu

SEQ ID NO: 123229 - RNA, 64 nt, Human
guuuacacguccaguuaggcuacaguucuauguacugagaaaccuuuaagcugaacuugagaua

SEQ ID NO: 123230 - RNA, 64 nt, Human
cuugucaaugguauacgaauauuaggagaugauucugagaaaggaaaggccuuguuggcaguac

SEQ ID NO: 123231 - RNA, 64 nt, Human
cucaucuuuuuaaaguauaguuacugaacugauucugagaaaucuuuagagagaaaaaacucaa

SEQ ID NO: 123232 - RNA, 64 nt, Human
auuauucacugccugucacaagccucaguguggccugagaaaucccuauguaccuuugugaaau

SEQ ID NO: 123233 - RNA, 64 nt, Human
aacucagauucauuucaaaaggacagugaacaagcugagaaauuauuuuaucaaagggcugagu

SEQ ID NO: 123234 - RNA, 64 nt, Human
accgacuuuucccuuugagccucaguuucucuagcugagaaauggagauguacuacucucuccu

SEQ ID NO: 123235 - RNA, 64 nt, Human
acugacagaucagcagaugucaccacaugggcuucugagaaagcucuugaauggggaucguucu

SEQ ID NO: 123236 - RNA, 64 nt, Human
cucugccucaaagacucuuguccucuugucccuccugagaaaaaagaaaacgaaaagugggguu

SEQ ID NO: 123237 - RNA, 64 nt, Human
uggccgagcuguaccuggcacggcccauccuggacugagaaacuggaaccucagaggaacccgu

SEQ ID NO: 123238 - RNA, 64 nt, Human
aaugcccccuccacaccccugguagcucuguguccugagaaauccagagugugggagacaucac

SEQ ID NO: 123239 - RNA, 64 nt, Human
acccgacggccgccugcugcugccgcucccuccccugagaaaagacucgggauggguguggggu

SEQ ID NO: 123240 - RNA, 64 nt, Human
auuuaaauuuuucauauuucaucuuugaaaaagucugagaaaaauccauaauauuuucugguau

SEQ ID NO: 123241 - RNA, 64 nt, Human
ggcuugauuuguaguagccaaaaauuagaaacaacugagaaagcccaucacgaacaauauggga

SEQ ID NO: 123242 - RNA, 64 nt, Human
cagcaaauuucuugauaucaaggaaaguggggcacugagaaaggcagggacuugcccaagggca

SEQ ID NO: 123243 - RNA, 64 nt, Human
gcuucccugcaguuuagaucccgggauggcauuccugagaaagcaacccgaaccagcuguccuu

SEQ ID NO: 123244 - RNA, 64 nt, Human
agagcaggucuucaucaugccuugucuuuuuuaacugagaaaggagauuuuuugaaaagaguac

SEQ ID NO: 123245 - RNA, 64 nt, Human
aaagcaacagacuucucaauaaucaaugaaguagcugagaaaacuaagucagaaagugcauuaa

SEQ ID NO: 123246 - RNA, 64 nt, Human
agaaagucuggaccaucauucgggaaaccgucuacugagaaagucgagaaggggaggcuugggu

SEQ ID NO: 123247 - RNA, 64 nt, Human
gccucuccaaccccuaccucagcuccugucugcacugagaaaccuccccgggugaugucugcaa

SEQ ID NO: 123248 - RNA, 64 nt, Human
cacaugguacuucuaacuuuaauucuuugaugaacugagaaacuuuuccauaaaacuugcaccg

SEQ ID NO: 123249 - RNA, 64 nt, Human
guacccuagaccuuuggaaggugagagcagggcccugagaaaaggcagccaccuccucucccug

SEQ ID NO: 123250 - RNA, 64 nt, Human
aggugugcauucucuuucucaaggauguuccuugcugagaaaaagaauucagugauauuucucc

SEQ ID NO: 123251 - RNA, 64 nt, Human
gaaugugggaaagcauucauuaauuuuauuuuaccugagaaaauuaaacaaaucacauuggaaa

SEQ ID NO: 123252 - RNA, 64 nt, Human
agagaaauaacuauuacuuuagaucuuuccaaaucugagaaagggaggcuagcauguguucaag

SEQ ID NO: 123253 - RNA, 64 nt, Human
gaaggccagugcugugcuggcaggaaaauagggacugagaaaaagcagauccuauacuauaggg

SEQ ID NO: 123254 - RNA, 64 nt, Human
ugguacugaguucaugauaccaugguggacacagcugagaaaaucccugcccucauggugcuca

SEQ ID NO: 123255 - RNA, 64 nt, Human
ugaggucgggauuuugagaccagccugaccaacacugagaaaccccaucucuauuaaagauaca

SEQ ID NO: 123256 - RNA, 64 nt, Human
uuuggauugccaaaauauucacaguagaggaaaacugagaaaacguaggaaaccauucuuuaua

SEQ ID NO: 123257 - RNA, 64 nt, Human
cagagucucagucaugacugcaacaacugagacacugagaaaaagaacaggcugauaccuucau

SEQ ID NO: 123258 - RNA, 64 nt, Human
aauauuuuaggacauuaugucuaaaaauuguauacugagaaaaauccuaugaauguggcagacu

SEQ ID NO: 123259 - RNA, 64 nt, Human
gaggugauugaaucauggaaguggauuucucaaacugagaaagauguagcgucauccccuuggu

SEQ ID NO: 123260 - RNA, 64 nt, Human
aaugaagccacagacuucucaauaaaucaaugagcugagaaaacugaaacagaaauuagagcau

SEQ ID NO: 123261 - RNA, 64 nt, Human
ccagcccgucucugugcagucccuggaaggggcgcugagaaaggcaccagcuccuuggacccca

SEQ ID NO: 123262 - RNA, 64 nt, Human
acaaauuugauuauauuuuuaagugucuuagauccugagaaagauuuauugugcauuauuugaa

SEQ ID NO: 123263 - RNA, 64 nt, Human
gaucuaacauuguuuaacucuugaaacuccaaaccugagaaaagccuuagaccugcagggaaug

SEQ ID NO: 123264 - RNA, 64 nt, Human
cacaaagguuuuccauauaauauuauuuaaaaugcugagaaaaugaaaaaaucuaaauggugaa

SEQ ID NO: 123265 - RNA, 64 nt, Human
cugaucucuccagaaugaucagcccagaggaaugcugagaaaucaccuggaggagggagcagaa

SEQ ID NO: 123266 - RNA, 64 nt, Human
cauuuuuuuugugaguuuccuugcaucaaggacacugagaaacacagucauugucuuagguguu

SEQ ID NO: 123267 - RNA, 64 nt, Human
uaagcaacaucucgcuguggacgccuguaaauuacugagaaaugugaaacgugcaaucuugaaa

SEQ ID NO: 123268 - RNA, 64 nt, Human
caccggccugucuggaggagcagcuggcucugcucugagaaacucuggcaaguggacgccauuc

SEQ ID NO: 123269 - RNA, 64 nt, Human
gugcucuggguagugagggaugaccagucuuguccugagaaauguuucucuuagucuuuaaguu

SEQ ID NO: 123270 - RNA, 64 nt, Human
ugggacagcuuuccccucauuuuuuuuuuuguuucugagaaaagaacguauuuuaaaagccaca

SEQ ID NO: 123271 - RNA, 64 nt, Human
ucuuucugccccguugaagaggugcagccucaggcugagaaacacugauagaccaagagguggc

SEQ ID NO: 123272 - RNA, 64 nt, Human
gaacccauuucuccagacuuuuaccuacccgugccugagaaagcauacuugacaacuguggacu

SEQ ID NO: 123273 - RNA, 64 nt, Human
ggccccccaacccucuuccucccuugccccaacccugagaaaggguccagccacuacccuguug

SEQ ID NO: 123274 - RNA, 64 nt, Human
cauuggaagguuaacuuuaaaaugagcccuaucacugagaaauacguguuucaugauuuaacuc

SEQ ID NO: 123275 - RNA, 64 nt, Human
cuugugagucuguaacaguucuuaaaaagaauaucugagaaacuacucuguuuuagaccuuuga

SEQ ID NO: 123276 - RNA, 64 nt, Human
gugauccuguuccucaacaagcaagaucugcucgcugagaaaguccuugcugggaaaucgaaga

SEQ ID NO: 123277 - RNA, 64 nt, Human
aaaauagcagguagauggaugacaguugcucauucugagaaacuucacucuuuucacuuaugca

SEQ ID NO: 123278 - RNA, 64 nt, Human
gccacuuugccuucucuggacucaguuuccccgucugagaaaugagagucgaaugcuacaguau

SEQ ID NO: 123279 - RNA, 64 nt, Human
uaagagaguucuaauuaauaacacuaaauucuuccugagaaaugacuccucuugguuugguuug

SEQ ID NO: 123280 - RNA, 64 nt, Human
uagccaggggcuuuuagauaauugucugugaagucugagaaaagacuaagauaaccaagaugaa

SEQ ID NO: 123281 - RNA, 64 nt, Human
uuuacagggguuagaauagacuguuaaggggcaacugagaaagaacagagaagugacagcuagg

SEQ ID NO: 123282 - RNA, 64 nt, Human
uguuuaaacgugagagucugguaggcaaagcagucugagaaagaaauaggaaaugcagaaauag

SEQ ID NO: 123283 - RNA, 64 nt, Human
uggggcggcccaggcugaagccaucuccgggugucugagaaaccacccagugccucaccuccag

SEQ ID NO: 123284 - RNA, 64 nt, Human
uucucuucuuccucagcuucuccauguuuaggaacugagaaagaaacugccuaagcagcacuuc

SEQ ID NO: 123285 - RNA, 64 nt, Human
cucauacccaccugcugaaucuucucuucacuugcugagaaagucagaggaggggauccaguag

SEQ ID NO: 123286 - RNA, 64 nt, Human
ugguagugagccucccaggaucacucaugcuguccugagaaaugagauucaaaagcugcauucc

SEQ ID NO: 123287 - RNA, 64 nt, Human
aguucaaagcccagguaucucucagaucugcugccugagaaauaagcuccuuuaucaguuagcu

SEQ ID NO: 123288 - RNA, 64 nt, Human
auuuccagcagaccugugguauuggccaggaggccugagaaagcaagcacgcacucucagucaa

SEQ ID NO: 123289 - RNA, 64 nt, Human
gucaccacacccccucuauucaugagaaguaaagcugagaaaggaccagauugaccaagcgcca

SEQ ID NO: 123290 - RNA, 64 nt, Human
uagaaucuggacacuuucuaugaauguaauucggcugagaaacauguugcugagaugcaauccu

SEQ ID NO: 123291 - RNA, 64 nt, Human
ucagucaaaaaaccauuuugacagcaaguaucuucugagaaauuuugaaaaguaaauagaucuc

SEQ ID NO: 123292 - RNA, 64 nt, Human
cuacucacagcccuuaaguuguuaugucuggaagcugagaaauuguaaguuucacauguguugg

SEQ ID NO: 123293 - RNA, 64 nt, Human
gguuuggcugucugugacuuacgggaccguccugcugagaaauugcacugaagagaugccccca

SEQ ID NO: 123294 - RNA, 64 nt, Human
gucagggcaccacaacacgccaccgggagagaugcugagaaaaacccaagaccgcucgggaaau

SEQ ID NO: 123295 - RNA, 64 nt, Human
cugguucucaacagacccagugagcccuucacuccugagaaaaaggaaagaugaaauaaauaaa

SEQ ID NO: 123296 - RNA, 64 nt, Human
cugcuguucgugacucagaaacagaagaaaaacacugagaaaaagcauuaaaaauaagccaaaa

SEQ ID NO: 123297 - RNA, 64 nt, Human
aucgcugaauucuuuuucucagcaaggaacaucccugagaaagagaaugcaccccugagggugg

SEQ ID NO: 123298 - RNA, 64 nt, Human
gauccaauucugugccaauaaccucauucuuugucugagaaacagcccccaguccuccuccacu

SEQ ID NO: 123299 - RNA, 64 nt, Human
ugacugacuuucauuuggacuuggcgaaguguaucugagaaacaccucggcuguggucucucug

SEQ ID NO: 123300 - RNA, 64 nt, Human
caucagagaacagucauguaugcaaguuuugugacugagaaauuucugugcuuccaauccacaa

SEQ ID NO: 123301 - RNA, 64 nt, Human
aagauucgucaacuuucuuagcucaagagagaggcugagaaaugcagagaagaauaagacauaa

SEQ ID NO: 123302 - RNA, 64 nt, Human
caguugggaagugccuguaggaaaauggcgauggcugagaaaagcccggaggagaugcuccuag

SEQ ID NO: 123303 - RNA, 64 nt, Human
aacaggcuguaaauggguugccaacauaagcuggcugagaaauaaaagaaaacaagacaguugu

SEQ ID NO: 123304 - RNA, 64 nt, Human
aaagaucacaccaauuuagaaugaauauuaaagucugagaaauuuacaaaagggacucuaugga

SEQ ID NO: 123305 - RNA, 64 nt, Human
cacauggcacuuggaagaaaaagacccacugaaucugagaaaguacuuucugguggcaaaugaa

SEQ ID NO: 123306 - RNA, 64 nt, Human
cuuugacuaaagauaaugugcugucauaucuuggcugagaaacuguugagucaggcuagaggac

SEQ ID NO: 123307 - RNA, 64 nt, Human
guauuccagcuucuuaaguggaaggaaaagagugcugagaaauggcucuguauaaucuauggcu

SEQ ID NO: 123308 - RNA, 64 nt, Human
gaaguaagcauauugguguuuucucaauuagucacugagaaaauuaacacuuuaggcaguggcu

SEQ ID NO: 123309 - RNA, 64 nt, Human
aacaucaccaacuuaauuuucuuccauagcaaaacugagaaaauaccuuguuucaguauaacac

SEQ ID NO: 123310 - RNA, 64 nt, Human
auuaugucacacacacaaaaaauccuuuucaauccugagaaaauuaaaggcguuuuacucacau

SEQ ID NO: 123311 - RNA, 64 nt, Human
cauuucugacuggacaaaguucuuccaaacaauucugagaaacaaaaacacacacgcagaauua

SEQ ID NO: 123312 - RNA, 64 nt, Human
ggauaauuagcaucucagguuaagugugaguaaucugagaaacaaugacuaauucuugcauauu

SEQ ID NO: 123313 - RNA, 64 nt, Human
uagguuuaccaaacauugguggaauuccaucuuucugagaaaaagggaagaucauagcuaauuu

SEQ ID NO: 123314 - RNA, 64 nt, Human
gaacaugcaggugauuugggaaguguagaaagaccugagaaaacgagccuguuucagaggaaca

SEQ ID NO: 123315 - RNA, 64 nt, Human
aagaaugggaagcacuugugauaaagacaggcuccugagaaaugcaacaaguggucuuacauau

SEQ ID NO: 123316 - RNA, 64 nt, Human
acaaagguuuguguauuaguccauuuucacacugcugagaaagacauacccaagacugggcaau

SEQ ID NO: 123317 - RNA, 64 nt, Human
uaaggauaauauauuuuccccaucaaugcugauucugagaaaagagcaauuuaucaaaauuaaa

SEQ ID NO: 123318 - RNA, 64 nt, Human
gggaacaguaagguucaggccacuauuuaggggacugagaaagcacaggcuucaugaguguaau

SEQ ID NO: 123319 - RNA, 64 nt, Human
ucagugaaaucaagaaauaaugaucccagccagacugagaaaauguaagcagacagugccacag

SEQ ID NO: 123320 - RNA, 64 nt, Human
gauggucuccaguuucugaaugaaaaagcuacagcugagaaauaaaauaaaaugucaugcugca

SEQ ID NO: 123321 - RNA, 64 nt, Human
augcauuaaaaauuguaaaguaccaugcuuagaacugagaaaacugcuuuuugugagccaacau

SEQ ID NO: 123322 - RNA, 64 nt, Human
guagaaaaucugcuggaaugguuguuguuuuccacugagaaagcuaagcccuacauuucuauuc

SEQ ID NO: 123323 - RNA, 64 nt, Human
uaaaagaaggaaaaaaaaagcccaaacuuaaccucugagaaaagaacauaagaacucaaggaga

SEQ ID NO: 123324 - RNA, 64 nt, Human
cugcauuucaacauagagucacauaaaugucccccugagaaaccaaucccacuucuuucuagga

SEQ ID NO: 123325 - RNA, 64 nt, Human
caagcaagaacacauauccaaauggaauuuuacccugagaaauuaucauuuuaaagggcauagc

SEQ ID NO: 123326 - RNA, 64 nt, Human
gcaaaucaaagaagauaauauuggaaaucagcugcugagaaagauggguuggacuggugguggu

SEQ ID NO: 123327 - RNA, 64 nt, Human
guuccacacauacauagaaaaagauuauuauguucugagaaagcuuuacagugcuacugugccu

SEQ ID NO: 123328 - RNA, 64 nt, Human
gagugucuaaaacugagccauuugucaucuucagcugagaaacugguacuugggagcuuaaaaa

SEQ ID NO: 123329 - RNA, 60 nt, Human
ugcagagagaguggagauaauucucaaacucugagaaaaaguguucaucaaaaaguuaaa

SEQ ID NO: 123330 - RNA, 64 nt, Human
gagauccuaauaugaaagaaaaauggaucccaaucugagaaaaggcaaaagaauggcuacuuuu

SEQ ID NO: 123331 - RNA, 64 nt, Human
uaucuauugauacuaauuauuuuagguauuaagacugagaaauauuuaaagcucaagaagaaca

SEQ ID NO: 123332 - RNA, 64 nt, Human
aacaucaccaacuugauuuucuuccauagcaaaacugagaaaauaccuuguuucaguauaacac

SEQ ID NO: 123333 - RNA, 64 nt, Human
uuaugucacacacacaaaaaaauccuuuucaauccugagaaaauuaaagguguuuuacucacau

SEQ ID NO: 123334 - RNA, 64 nt, Human
uaagucccuuucaaaauggaaaauuaauucuaaacugagaaaaauguuccuacuaccuauugcu

SEQ ID NO: 123335 - RNA, 64 nt, Human; identical to SEQ ID NO: 123334

SEQ ID NO: 123336 - RNA, 64 nt, Human
uuuacauucucgugcaagcagggaccucuugcuucugagaaauggggaagagaccuuuuagcca

SEQ ID NO: 123337 - RNA, 64 nt, Human
cugcccuggggagcaaucccagcggaucgcuccgggccaccaagccgcaccugugccugagacu

SEQ ID NO: 123338 - RNA, 58 nt, Human
ccgaggacugugacacauagcccauucuggccaccagagcccacuuggccccaccccu

SEQ ID NO: 123339 - RNA, 64 nt, Human
gggggcuuccccuucauguggcaccuuugugccaggccaccaggcagacucuucccaccuucuc

SEQ ID NO: 123340 - RNA, 64 nt, Human
ggugugaaagucagaugcccagagggcccaggcaggccaccauauucagugcuguggccugggc

SEQ ID NO: 123341 - RNA, 64 nt, Human
gauagucucaaaggcacuuuguuucucccaaguaggccaccaggcagccucuagaguugcuuua

SEQ ID NO: 123342 - RNA, 64 nt, Human
ucuugggggagucuuggcacuuugcaaacauccuggccaccaugggcaccaggacacagggaug

SEQ ID NO: 123343 - RNA, 64 nt, Human
ggcugccuuggaggguacaagauccacugaggguggccaccacagccuuggcuccaugguggcg

SEQ ID NO: 123344 - RNA, 64 nt, Human
gaagaauggagggaggagcaggcuaggaagacggggccaccacccucuccuugcuuucagcccu

SEQ ID NO: 123345 - RNA, 64 nt, Human
caguauauuggagucugucagaaacucuauaauaggccaccaguuuuuauuauuuaacauuuuu

SEQ ID NO: 123346 - RNA, 64 nt, Human
uauuguagcaugcuugaggaguuuuucccuuacuggccaccaaaguucugaaccacuugcaggu

SEQ ID NO: 123347 - RNA, 64 nt, Human
gccacaagcuuaccuguggguuucaguccugagaggccaccaccaguucccaucagcacugucu

SEQ ID NO: 123348 - RNA, 64 nt, Human
uuaacaccccuuugcuuuuucuaugggaccuccaggccaccauauuuagaacuaguuaccuuau

SEQ ID NO: 123349 - RNA, 64 nt, Human
cuuccauccccguccaugcucaagaugggucccuggccaccauggucaucaccacccuuccagg

SEQ ID NO: 123350 - RNA, 64 nt, Human
acucagcauucuaccuggggaaauggaaaacagaggccaccacccaugaaggcauaacacccau

SEQ ID NO: 123351 - RNA, 64 nt, Human
cccacuuguccaggccuggccucuuucuugagguggccaccaggcccaggccaggcccuuugcc

SEQ ID NO: 123352 - RNA, 64 nt, Human
ccauucgaaaugcuaugggcucccuggccucccaggccaccaaggacggcaagaaggacaagaa

SEQ ID NO: 123353 - RNA, 64 nt, Human
guaaugugguccacagccaugcccuugaggagccggccaccagaugcugaauccccuaucccau

SEQ ID NO: 123354 - RNA, 64 nt, Human
uggggacggcugcgggcaucugcaggguggagggggccaccauccaguguagggcacaacccug

SEQ ID NO: 123355 - RNA, 64 nt, Human
ccugugcuagcggccaaugacaaauccagucauuggccaccagccaccucugcaguggggacca

SEQ ID NO: 123356 - RNA, 64 nt, Human
ggaggagccuuggaguguaauuaccugucaucugggccaccagcuccacuggccugcccguugc

SEQ ID NO: 123357 - RNA, 64 nt, Human
ugggcgccgccgugcucaugcugccgugacaacaggccaccacauaccucaaccuggggaacug

SEQ ID NO: 123358 - RNA, 64 nt, Human
guggaugaggaacgcaccuuagaggagugggaaaggccaccaggguugggcccuguuuagguaa

SEQ ID NO: 123359 - RNA, 64 nt, Human
uagagaaugccacuuuggcugaacuacaaguguaggccaccauuauaauuuauaaauacagcau

SEQ ID NO: 123360 - RNA, 64 nt, Human
agccugaggagugacgggaugggggagggaggugggccaccauguuuggacccggggggcugcu

SEQ ID NO: 123361 - RNA, 64 nt, Human
cucagucuccugaguagcuggaacuacaaggaagggccaccacaccugacuaacuuuuuuguuu

SEQ ID NO: 123362 - RNA, 64 nt, Human
ugaacuuguggccugaagagccagagcuagcucuggccaccagcugggcgacgucacccugcuc

SEQ ID NO: 123363 - RNA, 64 nt, Human
ggucucacacuccuccugccagcucugucacccuggccaccacccaaccuguccuuacucagag

SEQ ID NO: 123364 - RNA, 64 nt, Human
auagccuguccgggcaucaacccucucuggcgguggccaccaguccuugccaauccccagagcu

SEQ ID NO: 123365 - RNA, 64 nt, Human
agccugcucaccccacuccagggccuuccccagcggccaccaacugaccuggggcgcugcuccc

SEQ ID NO: 123366 - RNA, 63 nt, Human
agcgcuaccugcggaaauaacagccucagccggggccaccagcacugcugccacuucuuccag

SEQ ID NO: 123367 - RNA, 64 nt, Human
acacacauacacacacacacacacacacaccugaggccaccagaagacacuuccaucccucggg

SEQ ID NO: 123368 - RNA, 58 nt, Human
auggagccggcccucggugaugggucugggccaccaggaucagccaggagggcguucu

SEQ ID NO: 123369 - RNA, 64 nt, Human
ucugucacuugucauggucuuucuugguauuaaaggccaccauuugcacaaauguuccuguuuu

SEQ ID NO: 123370 - RNA, 56 nt, Human
ugcuccagggaagggugugaggaggaggccaccagauucagaauucagaauuuuag

SEQ ID NO: 123371 - RNA, 64 nt, Human
augccaggaagagaagaaagggggugcagucugaggccaccaccccccuuccuaucuaagggag

SEQ ID NO: 123372 - RNA, 64 nt, Human
accauuagucugcccaccuuucuaggcugggcuuggccaccauuaaacacggggugggggugag

SEQ ID NO: 123373 - RNA, 64 nt, Human
ucccugcaucucauaccuuuaccucuggccaguuggccaccagggggagugggcugaagggaga

SEQ ID NO: 123374 - RNA, 64 nt, Human
aguuaacuaacaauacagugcauucuacccguagggccaccaugcccuucugccccuggcugau

SEQ ID NO: 123375 - RNA, 64 nt, Human
gccucacagaagagauacuugcaguuccaggccuggccaccaggugacgccuuccuucucuccu

SEQ ID NO: 123376 - RNA, 50 nt, Human
ccuugguccacucugagugaggccaccaucacccaccacacccugcccac

SEQ ID NO: 123377 - RNA, 64 nt, Human
cgcaguuggcauggguugcccuacaggcccacagggccaccagcacacccccgcacgcugggca

SEQ ID NO: 123378 - RNA, 64 nt, Human
cucagccucucaaguagcugggacuacagaugugggccaccaugucuggcuaauuuuuuuuuuu

SEQ ID NO: 123379 - RNA, 64 nt, Human
ugugucacugaggugaccugcgugucacugagguggccaccaugcuggccugcggcaugugcag

SEQ ID NO: 123380 - RNA, 64 nt, Human
uccuggagggcuacagcauccuggacaacaacgcggccaccaugcugcagguguuugaccuccg

SEQ ID NO: 123381 - RNA, 64 nt, Human
acucucuucaccgcccucugccccagccacucccggccaccaggacaugcuucaaugccuggug

SEQ ID NO: 123382 - RNA, 64 nt, Human
ucuuucaggagugacuggcugcaggcaagaccaaggccaccacugugggcccuccuuccaguca

SEQ ID NO: 123383 - RNA, 64 nt, Human
ccucugggugaguggcugacagagcaggucugcaggccaccagcugcuggaugucaccaagaag

SEQ ID NO: 123384 - RNA, 64 nt, Human
uucuguaacuaguugcucucauuuuaauuucacuggccaccaucaucuuugcauauaaugcaca

SEQ ID NO: 123385 - RNA, 64 nt, Human
gaaaagaaaagaacaaucuuccauuucugggcuuggccaccaucacccuggucggaccuguccu

SEQ ID NO: 123386 - RNA, 64 nt, Human
cgccccuacugggaagugaggagccccucugcccggccaccaccccgucugggagguguaccca

SEQ ID NO: 123387 - RNA, 64 nt, Human
gccaucuccagccggccaccucaggccccuguugggccaccaaugccaauuuuucucgagugac

SEQ ID NO: 123388 - RNA, 64 nt, Human
acucuacacucaguguaagaucugcugggaacagggccaccaggaguggcuggaucucagucuc

SEQ ID NO: 123389 - RNA, 64 nt, Human
gguccuuggcuggcccaggcccaguuaagccuguggccaccaagcagcucaucugagcacuuug

SEQ ID NO: 123390 - RNA, 64 nt, Human
acacacggcugcaugaccagucccacccccccguggccaccaauggcuaugacaucauuggagc

SEQ ID NO: 123391 - RNA, 64 nt, Human
ugaagcaggccuaguuucuucaucuauguuuaccggccaccaaacaccuuagggucuuagacuc

SEQ ID NO: 123392 - RNA, 64 nt, Human
gcaguggcccgucucaggcccugcucacucccggggccaccaaacgggccccucucucggggga

SEQ ID NO: 123393 - RNA, 64 nt, Human
ucauuucaaggcugcugaaaugcugcauuucaggggccaccauggagcagccguuauuuauaga

SEQ ID NO: 123394 - RNA, 64 nt, Human
ugcccuccagggccuccuuggcaaugcauuugauggccaccagcuucugcguccucuuaucuuc

SEQ ID NO: 123395 - RNA, 64 nt, Human
ugcugcgggcgcuggacgcgcggccuuucgcagaggccaccagcuggggccgccuuggggcgcg

SEQ ID NO: 123396 - RNA, 54 nt, Human
gcuucaucaagggcagauaaucgcggccaccaccuguaggaccuccucccaccc

SEQ ID NO: 123397 - RNA, 52 nt, Human
agaaggagacgcacuucugagcggccaccagccaucuggggcucuucuuccu

SEQ ID NO: 123398 - RNA, 64 nt, Human
auauuauucagaccuuaguacagcaagacacucuggccaccauaaaaaacgcagaaaagaaaaa

SEQ ID NO: 123399 - RNA, 64 nt, Human
aagaccuuuucuucagaaguugcuuuccuuuugaggccaccaaaguaauuuagggaaacagcag

SEQ ID NO: 123400 - RNA, 64 nt, Human
caucccuuuccugagucauggccucaaaaaucagggccaccauugucucaauucaaauccauag

SEQ ID NO: 123401 - RNA, 64 nt, Human
acggggacgugcacauccgugaugacgggcgccgggccaccaucucacugagcgacagugaccu

SEQ ID NO: 123402 - RNA, 64 nt, Human
ucccucggggccauacuucuguuuccaucugcugggccaccagccacuuuagugaccccugccu

SEQ ID NO: 123403 - RNA, 64 nt, Human
gagaauguugacuuagaagcaauagggggcagcaggccaccaagagcacaaccccagggcgagg

SEQ ID NO: 123404 - RNA, 64 nt, Human
gccuccaccccagcucuggucugugcagacucauggccaccaggaggccugcagauccagccuu

SEQ ID NO: 123405 - RNA, 64 nt, Human
cuugcccagaacuuuggucaccugcuuguucacaggccaccauaucuuacuucacugaagucau

SEQ ID NO: 123406 - RNA, 64 nt, Human
aagcaguucccacaugggcguguggcuggggcguggccaccacagagcacauggcugugucuag

SEQ ID NO: 123407 - RNA, 50 nt, Human
gccgcgaaggcuuccucuagggccaccaggcugaggacucgcccaggaca

SEQ ID NO: 123408 - RNA, 64 nt, Human
cgcccaggacauggacuggucucucagaccccugggccaccauguaggccaccacuccaggccg

SEQ ID NO: 123409 - RNA, 64 nt, Human
ggacuggucucucagaccccugggccaccauguaggccaccacuccaggccguggacuuccccc

SEQ ID NO: 123410 - RNA, 64 nt, Human
caaaugagaacauguguuuucauaaagggguugaggccaccaguacugcagcgaauuuccuuuu

SEQ ID NO: 123411 - RNA, 64 nt, Human
gucccucugaggcccacaggucugucaucccauaggccaccacacagagaaaugcuggcugagg

SEQ ID NO: 123412 - RNA, 64 nt, Human
guucuagagacuuaaggggaaaagcugcuuucaaggccaccacaugucugugcuccccaaccag

SEQ ID NO: 123413 - RNA, 64 nt, Human
accuucagcuccugcaccgacaucaggaacccacggccaccaccuccuccccucaaggcaugcu

SEQ ID NO: 123414 - RNA, 64 nt, Human
guuggccuuucugugcccacccagacuugguuugggccaccagaggcugaaguguauuuccugu

SEQ ID NO: 123415 - RNA, 64 nt, Human
cugccaggauaauuucugcuugccaugggcaucuggccaccaaggaauuucgcacccugacgau

SEQ ID NO: 123416 - RNA, 64 nt, Human
ccucagccuucucuggugacagaggcucagcuguggccaccaacacacaaccacacacacacaa

SEQ ID NO: 123417 - RNA, 64 nt, Human
aaucuccacgcuagacacucaauacagguaaauaggccaccaguuaauauucuuguuuuuauuu

SEQ ID NO: 123418 - RNA, 64 nt, Human
uucagggccgcaccgcccagacuggcucagcccaggccaccaacuucaucgccuuugcggcuca

SEQ ID NO: 123419 - RNA, 64 nt, Human
cucccuccacuccuugggagcccaggugguccuuggccaccauucaggcuuuccaagaagccaa

SEQ ID NO: 123420 - RNA, 64 nt, Human
ugggucggguuuaccaaucagccaggacgcccggggccaccagcucagcuaccacuuccccuuc

SEQ ID NO: 123421 - RNA, 60 nt, Human
augugguugacuguaugugauuugaguucuggccaccaacaauuuagucauaucugauag

SEQ ID NO: 123422 - RNA, 64 nt, Human
cauacacagaaucaggaccagcaugugcagagcuggccaccagcacaggcuuagggcaguucag

SEQ ID NO: 123423 - RNA, 64 nt, Human
aaggaaauauauuuuaccauacauuuaaaguuuuggccaccacauguaucacgggucacuugaa

SEQ ID NO: 123424 - RNA, 54 nt, Human
accuccagaacaccagguagccguggccaccacagccagacugaacguuuguga

SEQ ID NO: 123425 - RNA, 64 nt, Human
uccuggauaucuggguuauuguccucaucauccuggccaccauugucaucaugaccucguuguu

SEQ ID NO: 123426 - RNA, 64 nt, Human
ucaagugacagccaggaagagaccugaagguuggggccaccacaaugccaaaucguuucuaaag

SEQ ID NO: 123427 - RNA, 64 nt, Human
uaaauaauaacaauagcauugucaguggaggcugggccaccauggcagaccuuccaaaaguagu

SEQ ID NO: 123428 - RNA, 64 nt, Human
acuucccaacagcccccaucaagggaccccaagaggccaccaugcucuuaucucgcacuuucuu

SEQ ID NO: 123429 - RNA, 64 nt, Human
gcucgagaccuugcuuggugacaugugccacuuuggccaccacccacagucugucaccacgugg

SEQ ID NO: 123430 - RNA, 64 nt, Human
gggccugaccaaacagccaacuagccccugggguggccaccaguaugacaguauuauacgcugg

SEQ ID NO: 123431 - RNA, 64 nt, Human
ggcucuccugucugcaccuguccgguuacuacuuggccaccacgcagccuuggcuccuacagcc

SEQ ID NO: 123432 - RNA, 63 nt, Human
ugcuuccucacaguuaccaagaauaaagaaagcuggccaccauuguucauugugguuuguuca

SEQ ID NO: 123433 - RNA, 64 nt, Human
uccagcugcuuaagaugggugcuuccuuguacccggccaccagaaaaccccuggaacuccucuu

SEQ ID NO: 123434 - RNA, 64 nt, Human
uccagcccauuuuaauuagacuaugucauugugaggccaccaguccauucauuugaauucugug

SEQ ID NO: 123435 - RNA, 64 nt, Human
agaacaagcaagccggggcuaccugcccccagguggccaccaaguuguggaagcacauuucuaa

SEQ ID NO: 123436 - RNA, 61 nt, Human
ucggggaggggugcuccugaaggccaggcauggccaccacgugacgcuguucuuaguucac

SEQ ID NO: 123437 - RNA, 64 nt, Human
cagcguuuaccacugcugucaagccacagcccuuggccaccauacgggccauccucagugaggc

SEQ ID NO: 123438 - RNA, 64 nt, Human
uuuaauccuaaagguggcuguaaucaugaaccuaggccaccauggggaccugagagggaagggg

SEQ ID NO: 123439 - RNA, 64 nt, Human
cuucccugucggaaaagucaccacuuuagucccuggccaccagcacaccccaggagggugagug

SEQ ID NO: 123440 - RNA, 64 nt, Human
uccuucucccgcaaaggcggcagaacuacaucggggccaccaaaucaccacucuucagccccau

SEQ ID NO: 123441 - RNA, 64 nt, Human
ugcuuuguacauagggugugguccccuggcacguggccaccaucaugucuaggccuaugcuagg

SEQ ID NO: 123442 - RNA, 64 nt, Human
ccagggaccagcccagccugcauacuugccacuuggccaccaggacuccuuguucugcucuggc

SEQ ID NO: 123443 - RNA, 64 nt, Human
aucaggauuugcuauuuaaguggcuugacaacugggccaccaaagaacuugaacuucaccuuuu

SEQ ID NO: 123444 - RNA, 64 nt, Human
cuucaauagacuugcccuuguuacugcccagugaggccaccaaggaccaagaacaguugagcuc

SEQ ID NO: 123445 - RNA, 64 nt, Human
ccuuuugagucaguucuaaucccaugugugucugggccaccagaccgaaaugguugcugagaaa

SEQ ID NO: 123446 - RNA, 64 nt, Human
aagaacagcuguggaaagaagucacaaaacacugggccaccaggaacacaccuguagcccagca

SEQ ID NO: 123447 - RNA, 64 nt, Human
uacucacucucaccuucugguugaacuuugcuuaggccaccauugucugccucaucaggaacua

SEQ ID NO: 123448 - RNA, 61 nt, Human
augcuccaggcacagucugacccaaagccauggccaccacccucagucccugcagccuccu

SEQ ID NO: 123449 - RNA, 64 nt, Human
ggguagugcgaccucgguucugugggcucuggaaggccaccaggguagggucuccccagggcuc

SEQ ID NO: 123450 - RNA, 64 nt, Human
cuuuuuucuuuuucucuugcuucuaaggggugguggccaccacuguuuagaaugacccuuggga

SEQ ID NO: 123451 - RNA, 64 nt, Human
auaaaagugauuacagauguuggcucaaguucagggccaccaucauauaccuaacaagaguuca

SEQ ID NO: 123452 - RNA, 64 nt, Human
cacugcuaggcgagugccaggacuccccaggccaggccaccaggauggcccuucccacuggagg

SEQ ID NO: 123453 - RNA, 64 nt, Human
ggaugccaaagccugcucaaguuauggacauuguggccaccauguggcuuaaaugauuuuuucu

SEQ ID NO: 123454 - RNA, 64 nt, Human
cugucuuaauguuacuuuugaaaaucugcugagcggccaccauaugcaggcugagagcugggca

SEQ ID NO: 123455 - RNA, 64 nt, Human
gaacccuuggggacgagggccugggccgcggugaggccaccagaggcaggaguggcccuggggg

SEQ ID NO: 123456 - RNA, 64 nt, Human
ccccaugcgucccggagccuggugugugggcgucggccaccagccuggguuccucaccuuguga

SEQ ID NO: 123457 - RNA, 64 nt, Human
gcgaugugaacugccccuccccucgcaucccccaggccaccaacggcaguccuucugccuuguc

SEQ ID NO: 123458 - RNA, 64 nt, Human
ccaagggggacugcaagggacagggaugagugggggccaccaggcucagcgcaagaggaagcag

SEQ ID NO: 123459 - RNA, 64 nt, Human
cuugcuuugguucuuguugaagugaaccaagcccggccaccacgcauggcaugcugugcuuggc

SEQ ID NO: 123460 - RNA, 64 nt, Human
gaaaagcaaccaaaggcaacagagucuagcucauggccaccagaccaaaagcauccagcuucug

SEQ ID NO: 123461 - RNA, 64 nt, Human
caccggggaggagggccucucaugggaaagcccuggccaccacaccggccugugccccuugaag

SEQ ID NO: 123462 - RNA, 64 nt, Human
cauaggaugugggaccuuugagccgaugugcacuggccaccaccaggguugggggcgccacagc

SEQ ID NO: 123463 - RNA, 64 nt, Human
ugcagccggaagggaagggacaccaaggaucuccggccaccagcagaagccagcagagaggcau

SEQ ID NO: 123464 - RNA, 64 nt, Human
cccuggagaggaacugagugucacccugaucucaggccaccagccucugccggccucccagccg

SEQ ID NO: 123465 - RNA, 64 nt, Human
gaccagugaccgccaccuucacaccgucugcccuggccaccauccugggccugggggcugccca

SEQ ID NO: 123466 - RNA, 64 nt, Human
aaaagaggcauacacacagcagugugaauagccuggccaccagccauccucccuccaccucaag

SEQ ID NO: 123467 - RNA, 64 nt, Human
aggccgcccucccaguccugggugaagauauuugggccaccagggcucccuuggccccuucacg

SEQ ID NO: 123468 - RNA, 64 nt, Human
uuugugggauggggguuagcgucuauguguggaaggccaccaaucuagggacaggaguccuggg

SEQ ID NO: 123469 - RNA, 64 nt, Human
cagaaaaccaaguguccggauggcaggggccagcggccaccaagcucaugggacacccagagca

SEQ ID NO: 123470 - RNA, 64 nt, Human
acuaaucacgucucugcacccagggucccagccuggccaccagccucccuuucugccugacccc

SEQ ID NO: 123471 - RNA, 64 nt, Human
acuagucuugcaucugcacccagggucccagccuggccaccagcuucccucugccugaccccag

SEQ ID NO: 123472 - RNA, 64 nt, Human
ggugccagcggaccaucggcuggcagagcccagcggccaccacccgucaacccugccaggagcu

SEQ ID NO: 123473 - RNA, 64 nt, Human
aaacuuucaaaguuuaguaaguuuuucuucaugaggccaccaguaaaagacauuaaugagaauu

SEQ ID NO: 123474 - RNA, 64 nt, Human
auagucuucugcugcugguaccugggugggcaauggccaccaugucugcacacaccagaaaugg

SEQ ID NO: 123475 - RNA, 64 nt, Human
cccaaggcuugaaauccagcaggauggaggacuuggccaccaguucaggcuucuuggccuucuu

SEQ ID NO: 123476 - RNA, 64 nt, Human
uggcacacagugcuuaucugcauaaauaaacacuggccaccagcagugggcgcagccucgguga

SEQ ID NO: 123477 - RNA, 64 nt, Human
aggcuagagacagaugcugguggaggaagggcugggccaccagggaucacagaccacaggaaga

SEQ ID NO: 123478 - RNA, 51 nt, Human
augggccaaauguggccugagggccaccaauuugugaccucugcauuagua

SEQ ID NO: 123479 - RNA, 64 nt, Human
guuguuggcagggacugcagauccugucagaccuggccaccaccuugggcauggccacucugcc

SEQ ID NO: 123480 - RNA, 64 nt, Human
ggccccugcagccgggcccagcucuucuguccuuggccaccagagacugcagcccacaacccuu

SEQ ID NO: 123481 - RNA, 64 nt, Human
gcgaggagggggcugugaguccucagaggcccugggccaccacauuucuggcagcguuucccag

SEQ ID NO: 123482 - RNA, 64 nt, Human
uugggggcagccaggcacagccggcucacggaggggccaccacgcugggccagggucucacugu

SEQ ID NO: 123483 - RNA, 64 nt, Human
uuagucacucaacauaaccacaggccaauuuguuggccaccagaaaaccgcuuuuuaaaaaaac

SEQ ID NO: 123484 - RNA, 64 nt, Human
aggauaaggguggcuucucccagcugaguaauguggccaccauguccaagguggacucggugug

SEQ ID NO: 123485 - RNA, 64 nt, Human
gggcccaggcugugaguuccaggucugugcucauggccaccaggcccuacugcucagggugaau

SEQ ID NO: 123486 - RNA, 64 nt, Human
agcccuucuccacucugggggaggaggugggaagggccaccaggcccccagcugccaggccagc

SEQ ID NO: 123487 - RNA, 64 nt, Human
ugcacugcagcaugguggcuuucugaguccuguuggccaccaagugucagccucagcacucccg

SEQ ID NO: 123488 - RNA, 64 nt, Human
cagccccggccacucccugccaacuccaugaccaggccaccaucuguacccugcuucccaaacu

SEQ ID NO: 123489 - RNA, 64 nt, Human
cccgccaccugugaccagcagcugaugccuccuuggccaccagaccaugggccaagagccgccg

SEQ ID NO: 123490 - RNA, 64 nt, Human
guuuuugaggaaaaccugagguccccuaaucuguggccaccaccccccccccccgccacgccuu

SEQ ID NO: 123491 - RNA, 64 nt, Human
caagaguccagugucgugcccucagccaguucuuggccaccacaaugggagcagcccuggccga

SEQ ID NO: 123492 - RNA, 64 nt, Human
acccggaccuccuccaggauacagcacuggaguuggccaccaccucuucuacuugcugucugaa

SEQ ID NO: 123493 - RNA, 64 nt, Human
cggggugccugccuggcuggucuucaucaccugaggccaccaggcucaagccacugcuguugca

SEQ ID NO: 123494 - RNA, 64 nt, Human
gcagccugccgcagaugcacaggccccaggugcaggccaccaccuccgggucggcaccaggacu

SEQ ID NO: 123495 - RNA, 64 nt, Human
accucugcugcaaaggaaucucuugcugaguccaggccaccaaucaggcaaauagcccauacau

SEQ ID NO: 123496 - RNA, 64 nt, Human
uuauucaucauagcucucugcuuugggcucugcaggccaccagauacacaugaggccccuacuu

SEQ ID NO: 123497 - RNA, 64 nt, Human
acagucaguuuaguuaaggauggaaccugggaaaggccaccauuccugcuugauggggcucuga

SEQ ID NO: 123498 - RNA, 64 nt, Human
cucggcuucccaaagugcugagauuacaggcaugggccaccacgcccagcuaguuccucuuuug

SEQ ID NO: 123499 - RNA, 64 nt, Human
cuguuugaagagacaugaguucuggaaggagcaaggccaccagguccagagaaccuggcaugca

SEQ ID NO: 123500 - RNA, 64 nt, Human
cagggcccugguggaggcugcugugggacggucaggccaccaccgcaaagaggcagccggagcu

SEQ ID NO: 123501 - RNA, 64 nt, Human
gcuggggccccugugugcaucuuugaggguccugggccaccaggaggggcagggucuuauagcu

SEQ ID NO: 123502 - RNA, 50 nt, Human
caccacuuaaugagguuugaggccaccaaaagaucaacagacaaaugcuc

SEQ ID NO: 123503 - RNA, 64 nt, Human
ccuuuuuuaauaaaagcucuuucaucuauaguuuggccaccauacaguggccucaaagcaacca

SEQ ID NO: 123504 - RNA, 64 nt, Human
cgccucagucccagcccuguagcugugugucuugggccaccaguggccugcaggacgaagguac

SEQ ID NO: 123505 - RNA, 64 nt, Human
uccugcuggugcuccaucccccaauaccaggcugggccaccacucugaggaggguaggaggggc

SEQ ID NO: 123506 - RNA, 64 nt, Human
uacacauugccaagauuucacacaugugaccaggggccaccaaagucccugugaccuuugugac

SEQ ID NO: 123507 - RNA, 64 nt, Human
aggggaaccauggggcuuucuggaguuguggugaggccaccaggcugaagucagcucagaccca

SEQ ID NO: 123508 - RNA, 64 nt, Human
gagcacagacguguagggccagagcccguccagaggccaccaggagcugagacagugccaccac

SEQ ID NO: 123509 - RNA, 64 nt, Human
acaggcccucauccacccucuggcacaacucugaggccaccaaccucguccacacccggggggc

SEQ ID NO: 123510 - RNA, 64 nt, Human
ugcugggggcuucgguguccaggcgcccagguguggccaccagcaccgguuucugccuucgcgu

SEQ ID NO: 123511 - RNA, 64 nt, Human
cugggcagccucggacuaugacuggcuacggggaggccaccaccaggccccagcucuccacccu

SEQ ID NO: 123512 - RNA, 64 nt, Human
cucagccucccaaguagcugggauuacaggcgcaggccaccaugcccggcuaauuuuuuguauu

SEQ ID NO: 123513 - RNA, 64 nt, Human
cuguaggcacucucuggcuaaaaacaaacucugaggccaccagcagaucaucuuuaagcuaagu

SEQ ID NO: 123514 - RNA, 64 nt, Human
uaauacuucaccuaccucauaggggagguugugaggccaccaucaccugaccugggggucaagg

SEQ ID NO: 123515 - RNA, 64 nt, Human
ggcugcuuggagcaaagggugcauuucaggguguggccaccaggugcugugaguuucuguggcu

SEQ ID NO: 123516 - RNA, 64 nt, Human
gaccauauugugcuucacaguagagccagcuuggggccaccaaagcugcccacuguuucucuug

SEQ ID NO: 123517 - RNA, 64 nt, Human
cccuaaucugagaagucagccucuuggcuccucaggccaccauuuaggccugacugggguaaga

SEQ ID NO: 123518 - RNA, 64 nt, Human
cucagguggcacaucuggagggcagggguugaggggccaccaccacacaugccuuucuggggug

SEQ ID NO: 123519 - RNA, 64 nt, Human
uuuuagggguguggaggaggggaagggaggaaugggccaccauauuuggccuuacaggaauuaa

SEQ ID NO: 123520 - RNA, 64 nt, Human
gguggaggguggaagguccugugcaggacagggaggccaccaaaggggcugcugucuccugcac

SEQ ID NO: 123521 - RNA, 64 nt, Human
gugggggauuuugcauugggguugguuccauuucggccaccaggacugccccucccccacuccu

SEQ ID NO: 123522 - RNA, 64 nt, Human
ggccuccccaugccaccacaaaggcccuuuuaagggccaccaccgcccucauggaaagagcuga

SEQ ID NO: 123523 - RNA, 64 nt, Human
gagauaccgccccagcgggggcugcgacauccauggccaccauggggcaccuggcggggcgggg

SEQ ID NO: 123524 - RNA, 64 nt, Human
guuucagcacaccuauacccccgaucucagagggggccaccaauaucuagcuauggaucgugug

SEQ ID NO: 123525 - RNA, 64 nt, Human
cuuccaccgacagccgucagacaucaggcuccccggccaccaugauugggaucucuguggcacu

SEQ ID NO: 123526 - RNA, 64 nt, Human
auuugaugaaugugggggaacucagaggaacuggggccaccaagguuggaaaaggguuugguuc

SEQ ID NO: 123527 - RNA, 64 nt, Human
uuguaaagaacucuccucauaggugagaucaagaggccaccaguuguacuucagcaccaaugug

SEQ ID NO: 123528 - RNA, 64 nt, Human
ucaccuuugcaagcguuuauuuacugauguaugcggccaccacugugaccaccaucacuuaccg

SEQ ID NO: 123529 - RNA, 64 nt, Human
uuguaggaguguggguauuccagagcaagacuguggccaccaucuuccccucuugguguuuucc

SEQ ID NO: 123530 - RNA, 64 nt, Human
uuucuagggugagaguucccaauuuggauagaacggccaccauauugguuacugaaucucucuc

SEQ ID NO: 123531 - RNA, 64 nt, Human
aaucacuggaaaggcuggaggagcagaaggcagaggccaccacuggacuauugguuucaauauu

SEQ ID NO: 123532 - RNA, 64 nt, Human
caucaaagaacagagaggaggaggagggagaaauggccaccacaucaccccagagaaauuucug

SEQ ID NO: 123533 - RNA, 64 nt, Human
accuugguaggggacuaauucacuggcgaggugcggccaccacccuacuucauuuucagaguga

SEQ ID NO: 123534 - RNA, 64 nt, Human
ccucccacuugagacuggucuuugggaggcaauaggccaccaugccuggucagcaccaauucaa

SEQ ID NO: 123535 - RNA, 64 nt, Human
guuuaggacacaagucauauuccccauugcucucggccaccauuuucauuugugcaguguauuu

SEQ ID NO: 123536 - RNA, 64 nt, Human
ugcuggccaaggcaaauugaacucaguucaagauggccaccacugguagacguguagauagaaa

SEQ ID NO: 123537 - RNA, 64 nt, Human
guuugacaauucugagaguuguccugcaguuggaggccaccagagguaucugagcucccugcuu

SEQ ID NO: 123538 - RNA, 64 nt, Human
cgccccugaacuuguucccagugaaggucaacagggccaccaaccaggguugaggaaccaucuc

SEQ ID NO: 123539 - RNA, 64 nt, Human
aaaucgagacccucugacgacuugccgacuaacuggccaccacaagcugcagucuguagcacug

SEQ ID NO: 123540 - RNA, 64 nt, Human
cucagccucccgaguagcugggauuacaggcaugggccaccacacccagcuaauuuuuuguguu

SEQ ID NO: 123541 - RNA, 64 nt, Human
uaaaauggaugccuugaauaauaagcaggauguuggccaccaggugccuuucaaauuuagaaac

SEQ ID NO: 123542 - RNA, 64 nt, Human
guggaugccacaugcugcuguuuccugcuugcccggccaccacccaugcccuccauagggugag

SEQ ID NO: 123543 - RNA, 64 nt, Human
auaguuguuuuuuaaaauccaaaucagaggugcaggccaccaguuaaaugccgucuaucagguu

SEQ ID NO: 123544 - RNA, 64 nt, Human
ucccccacccagcccacccauugaagucuccuugggccaccaaaggugguggccaugguaccgg

SEQ ID NO: 123545 - RNA, 64 nt, Human
aggaaagguuuucaaaguucugcccauuucuggaggccaccacuccugucucuuccucuuuucc

SEQ ID NO: 123546 - RNA, 64 nt, Human
agagccuaacugcagggugaaaaagucccugcacggccaccacccucgagacugccucuucuac

SEQ ID NO: 123547 - RNA, 64 nt, Human
aaaugaaagaaccagaguuggaaggcacuugacuggccaccagaccaacucugcuguuacugac

SEQ ID NO: 123548 - RNA, 64 nt, Human
aaagcucaauaggagggauguuccaguggaugagggccaccaggaagcacagguccaaggcugg

SEQ ID NO: 123549 - RNA, 64 nt, Human
agcacgucuuccucaugagccgagccagguccauggccaccacguggcuggccccuuccucugc

SEQ ID NO: 123550 - RNA, 64 nt, Human
cacuggaauugucacacggcgagcacagagggccggccaccaguccucgaugcuucugaacccu

SEQ ID NO: 123551 - RNA, 64 nt, Human
augaaguguuuuaaaaauccauucuucgcaguguggccaccacaccgcccugagcccucccacg

SEQ ID NO: 123552 - RNA, 64 nt, Human
aaaucuaaauuuggaaaggagcuaguagcuuuaaggccaccaccauauuuuacuuuuuuaggau

SEQ ID NO: 123553 - RNA, 64 nt, Human
ucugcuuggccacagcuuugcucuuugguccucaggccaccagaccccucacagcauggcccuu

SEQ ID NO: 123554 - RNA, 64 nt, Human
acccaccccugugcuccgugccuccaccaccacuggccaccaggcuggcgcagccaaggccgaa

SEQ ID NO: 123555 - RNA, 64 nt, Human
gcugcauggcacauaccaaagcugcugcacagcuggccaccauggcacccugcaccaggccauc

SEQ ID NO: 123556 - RNA, 64 nt, Human
guauacaagauuauacaaucucuuuauuacugagggccaccaaauagccuaggaagugcccucg

SEQ ID NO: 123557 - RNA, 64 nt, Human
cagaugaggugaagaucacugucaucuaaaagcaggccaccaaauuuaaaaaaaaaaaguuaug

SEQ ID NO: 123558 - RNA, 64 nt, Human
agugcuggcauuacaggugugagccaccgugcccggccaccagaauccuuugguauagccaagc

SEQ ID NO: 123559 - RNA, 64 nt, Human
aacggcucuuccugccuggaugcaggagggcaggggccaccacagauuaaagcuguuacugcac

SEQ ID NO: 123560 - RNA, 64 nt, Human
cccgcuguggccugcuuccagggagcaacagagaggccaccaagcagaggcccguggggcugag

SEQ ID NO: 123561 - RNA, 64 nt, Human
cccugacuaaggccaccuugcagccgcuuuccagggccaccaagggcucugcuccagccucuca

SEQ ID NO: 123562 - RNA, 64 nt, Human
ucagcagaucuucaagugcaaagggaccuuugugggccaccagggcccuguguggugucucugc

SEQ ID NO: 123563 - RNA, 64 nt, Human
uguggagacuggagagaucaagagagaguauggcggccaccagaaggcuguugucugccuggcc

SEQ ID NO: 123564 - RNA, 64 nt, Human
ggccuuugcgcagagagcagagaggaugacuugcggccaccaaguuucugucuccgcgggaguc

SEQ ID NO: 123565 - RNA, 64 nt, Human
uugugagccggccuccugucugcaugcccccuguggccaccaggcuccgaggggccguggugac

SEQ ID NO: 123566 - RNA, 64 nt, Human
ugauuuccuaaaugcuacccuuugaucauuuccuggccaccaucacaauacuaaggggcucaga

SEQ ID NO: 123567 - RNA, 64 nt, Human
gcccaucugggcagcagcaucugguugaccagauggccaccagaacccacuguucauucuuauc

SEQ ID NO: 123568 - RNA, 64 nt, Human
accccucccuccaugugguaaaccacuccagaauggccaccaggcuucccagaguucuaugguc

SEQ ID NO: 123569 - RNA, 64 nt, Human
ggaucaccugaggccaggaguuggagaccagccaggccaccauggugaaacccugucucuacca

SEQ ID NO: 123570 - RNA, 64 nt, Human
cugagguccccucgucccauccagcuaccaccacggccaccacugcagccgggggcuggccuuc

SEQ ID NO: 123571 - RNA, 64 nt, Human
gucacuaggcgggcagcccacacccaccccagacggccaccacacugaggccacacguuggcca

SEQ ID NO: 123572 - RNA, 64 nt, Human
ugugugccgccaugcccagucucuuuuuugguagggccaccacucacuggguuuaggguccccc

SEQ ID NO: 123573 - RNA, 64 nt, Human
ucacacuugcagcagcuggacagugauuuuagaaggccaccaguccccauagcuaugugacaau

SEQ ID NO: 123574 - RNA, 64 nt, Human
ccuggccuucugcacggcccaaggagaaccuggaggccaccacuaaagcugaaugaccuguguc

SEQ ID NO: 123575 - RNA, 64 nt, Human
cgucccugagacugggguugaggggacugacgggggccaccaccgccccgcccuccagcgccuc

SEQ ID NO: 123576 - RNA, 64 nt, Human
cacccaugcugguuggugcuggcuaggcugagggggccaccacuuuuccuggcuagaagcuacu

SEQ ID NO: 123577 - RNA, 64 nt, Human
cugacuucccucuggagaaugacuauggacagaaggccaccauccuccacagagcacccugucc

SEQ ID NO: 123578 - RNA, 64 nt, Human
gcucaguggccgggucccugagcucccuagagucggccaccacagauucagacuuggacuauga

SEQ ID NO: 123579 - RNA, 64 nt, Human
aucagaaccagccaaagaagcacuuccugggcacggccaccagcucucccgccuccaguguggg

SEQ ID NO: 123580 - RNA, 64 nt, Human
ccauccgagacaaguuugcccggcucucccagauggccaccauccucaaucuggagcggguagg

SEQ ID NO: 123581 - RNA, 64 nt, Human
ccuggaagugguguguucacauacagugacccuuggccaccagaccacagaggauggagccugg

SEQ ID NO: 123582 - RNA, 64 nt, Human
cuguguauucagcaaacacucacuaggugacagcggccaccaggcucugugcugggggacgaua

SEQ ID NO: 123583 - RNA, 64 nt, Human
ucugugcagggaguuggccagcugccgcaucaucggccaccaagggcacaagaggcggaggcuc

SEQ ID NO: 123584 - RNA, 64 nt, Human
cgccccuacugggaagugaggagccccucugccuggccaccaccccaucugggaggugugccca

SEQ ID NO: 123585 - RNA, 64 nt, Human
ccgggccucacacucacacuguaaaugucucucuggccaccaugcguuacguguacccguguau

SEQ ID NO: 123586 - RNA, 64 nt, Human
ugaggccaagggcuuucuggccaucucagggaggggccaccagguuccuccccucaccccauau

SEQ ID NO: 123587 - RNA, 64 nt, Human
uuuaucauaaguuaugccucugacaguccacaggggccaccaccuuuggcugguagcagcaggc

SEQ ID NO: 123588 - RNA, 64 nt, Human
gggugccuuugggugguggucggcuugccucugaggccaccacggcaccagcagaauacguauu

SEQ ID NO: 123589 - RNA, 64 nt, Human
gccucugcuggaacaagcaggacccuaacuaccuggccaccauggccauggauggaauggaggu

SEQ ID NO: 123590 - RNA, 64 nt, Human
gauuucagggccuucccucccugccugggugucgggccaccagaaggcucugccggacgccaag

SEQ ID NO: 123591 - RNA, 64 nt, Human
ugcuuccccugugcccacugcuguaugaucugggggccaccacccugugccgguggccucuggg

SEQ ID NO: 123592 - RNA, 64 nt, Human
cauccacaucauuucacccugcagugagggaagaggccaccagguggcagcacagccacacccg

SEQ ID NO: 123593 - RNA, 64 nt, Human
gaaccugaguaugagaauguuguacccaucuccaggccaccagaacccugaugaccuugaauuu

SEQ ID NO: 123594 - RNA, 64 nt, Human
cuggggccccccccccguggaaccguuccugaaaggccaccaggcgcccaguguagcacggaag

SEQ ID NO: 123595 - RNA, 64 nt, Human
aagaaggcagggaaugccuggaggguaacuggggggccaccaugaccccuucucucuccagaaa

SEQ ID NO: 123596 - RNA, 64 nt, Human
gguagggauggcugugggguggcuuccaggagggggccaccauugccgcaucuacuucuagacu

SEQ ID NO: 123597 - RNA, 64 nt, Human
cccaguucuguguagcuugcccugccccaugaagggccaccagccaagggcccuggccacgugu

SEQ ID NO: 123598 - RNA, 64 nt, Human
accaaauaaggcacuggggcaugggguaggggugggccaccaaguauacugaauucuaaggcua

SEQ ID NO: 123599 - RNA, 64 nt, Human
agagccuccugaagccucugggaacuccuccuguggccaccaccaaaggaugaggaaucugagu

SEQ ID NO: 123600 - RNA, 51 nt, Human
ccucugccgucaccaguuagaggccaccauggugugaggagaccaucaccu

SEQ ID NO: 123601 - RNA, 64 nt, Human
ugccuccaaggacugucuggcaaugacuuguauuggccaccaacuguagauguauauauggugc

SEQ ID NO: 123602 - RNA, 64 nt, Human
cucaggcuccugaguagcugggauuacaggcgucggccaccacaccuggcuaauuuuuguauuu

SEQ ID NO: 123603 - RNA, 64 nt, Human
aacguagggaugguggaccacagaaggcuauaaaggccaccauagaaagcugaagagccauuua

SEQ ID NO: 123604 - RNA, 64 nt, Human
gaagacagacaaggaagguggaauguucuguuuuggccaccaggaaaugggguggggugggcau

SEQ ID NO: 123605 - RNA, 64 nt, Human
ggagggccuggggcugggcagccugguauucaguggccaccagaagagcagggccagccccggu

SEQ ID NO: 123606 - RNA, 64 nt, Human
gaauccacucuaaccaaucgcacuuaacgacucgggccaccacugggggggcagggggaggggu

SEQ ID NO: 123607 - RNA, 64 nt, Human
agcgaagggagaaguugggaagcuacguucuguuggccaccagacuugcauuucagccucuguc

SEQ ID NO: 123608 - RNA, 64 nt, Human
cucagccuccugaguagcugggacuacaggcacaggccaccaaaccuggcuaauguuuaaauuu

SEQ ID NO: 123609 - RNA, 64 nt, Human
ggcccuccccccaccccucugcugcaggaggcguggccaccaccagaugcucccugucuggggc

SEQ ID NO: 123610 - RNA, 64 nt, Human
caggccuuccggccauagcaaccaugaguggcauggccaccaccacgguggucacuggaacuca

SEQ ID NO: 123611 - RNA, 64 nt, Human
gccagggcuccaaggcuugccccagaggccacauggccaccagccccagcugccaucagauuca

SEQ ID NO: 123612 - RNA, 64 nt, Human
uccagaaaccucgaccgcuagcuccaccugccuuggccaccagggcagccccgggggauccggg

SEQ ID NO: 123613 - RNA, 64 nt, Human
gcuuccuuccucucugcaaugaccuucaacaaccggccaccagaugucgcccuacucaccugag

SEQ ID NO: 123614 - RNA, 64 nt, Human
gaaagggcuccuugggcugcuggugaacuucuguggccaccaccuccugcuccugaccucccug

SEQ ID NO: 123615 - RNA, 64 nt, Human
aggccccaacauaaaggccuucccucgcuguugaggccaccaugccuuacugcauccagccagg

SEQ ID NO: 123616 - RNA, 64 nt, Human
uggccaggacccccuucggcacccaguugcccuuggccaccaccuguggcaggacucaagcucc

SEQ ID NO: 123617 - RNA, 64 nt, Human
guuaacaguuggucuguauuugcauguaaaagugggccaccagagaacccuuauugauuacuua

SEQ ID NO: 123618 - RNA, 64 nt, Human
uuugguuaccugcaauggcugcuuuugccagcgaggccaccauucauuggucaucuugguauuu

SEQ ID NO: 123619 - RNA, 64 nt, Human
cccggccaccuggggaagccgcgccugccaaggaggccaccagagggcagugcaggcuucugcc

SEQ ID NO: 123620 - RNA, 64 nt, Human
guucuguccagauaggaccagggggucucacuuuggccaccaguucuucggccagcaccucugc

SEQ ID NO: 123621 - RNA, 64 nt, Human
aaccccuucuccacaccugaacaguuggcucaagggccaccagaagcauuucuuuauuauuauu

SEQ ID NO: 123622 - RNA, 64 nt, Human
cuuuggguggacggucuccuacauguucaguggaggccaccaggagcauccaugagcggggaag

SEQ ID NO: 123623 - RNA, 64 nt, Human
aacgccccgcccacgccgcggccaccgggcccacggccaccagaaugcaauugagaaaucguuu

SEQ ID NO: 123624 - RNA, 64 nt, Human
ugggacaagagcccugguuuucuacgcugcccuuggccaccacacugccugccccacgagcugg

SEQ ID NO: 123625 - RNA, 64 nt, Human
gggagcggaggaggggccggcccgcgggagccgcggccaccaggaggccccgcuccgucccauc

SEQ ID NO: 123626 - RNA, 64 nt, Human
acaggcagggcugucaauaacccccuuccucacuggccaccaccugacaucagcaccagugaca

SEQ ID NO: 123627 - RNA, 64 nt, Human
caagauggccauauacucccuaggaacccaagauggccaccaucuugauuuuacuuuccuuaaa

SEQ ID NO: 123628 - RNA, 64 nt, Human
guccagggccccagugcuuccagaccaagacuugggccaccacuuguccaauaaaguacauccc

SEQ ID NO: 123629 - RNA, 64 nt, Human
cuuuacugcauagcagaccacacagaagggugugggccaccagagaauuuugguaaaaauuugg

SEQ ID NO: 123630 - RNA, 64 nt, Human
ugaggaacuaaagaaagcugaaggugcccaccugggccaccagaaggugacacccccagaaucc

SEQ ID NO: 123631 - RNA, 64 nt, Human
ggauguuauuggcuaauccacugcaugguuugauggccaccaucucgguuggcccuuugggugu

SEQ ID NO: 123632 - RNA, 64 nt, Human
uuuuugguguacuuggcacaguaggugccaaguuggccaccauucuguguaacaccuuuuuugg

SEQ ID NO: 123633 - RNA, 64 nt, Human
uggacaucauacuggguaggugacaacgucagugggccaccaugugccaugauggcugcugcag

SEQ ID NO: 123634 - RNA, 64 nt, Human
ucaagccagcauccccuugguaaagacccccgcaggccaccaggcauucuggacacgcacacac

SEQ ID NO: 123635 - RNA, 54 nt, Human
uggcugaccuucuugucugagccaggccaccaaagccaugccguaagcauacuc

SEQ ID NO: 123636 - RNA, 64 nt, Human
cgagacccggccugugcugcccugcccgucucagggccaccaagucugacccacacagcgucac

SEQ ID NO: 123637 - RNA, 64 nt, Human
acagugggguguggggcccgugggaugggccucaggccaccaggcaauaaccacagggccugca

SEQ ID NO: 123638 - RNA, 64 nt, Human
ccccaaucccccaacacgccugucccucccgcauggccaccaaggagcuggaccuuggaugcgc

SEQ ID NO: 123639 - RNA, 64 nt, Human
acugauucccucccgggugcugaguccccuccccggccaccauccugcgugaauauccugaaau

SEQ ID NO: 123640 - RNA, 64 nt, Human
gguccugggaauggcggcgggcccguccagcgugggccaccacuggggccgggggccacgggcu

SEQ ID NO: 123641 - RNA, 64 nt, Human
ugaggugacccugggccuugcccccagccaacugggccaccagcuucccucccuugacucuggg

SEQ ID NO: 123642 - RNA, 64 nt, Human
ccagcucugauuccuucaaggcccggccuguccgggccaccauuccacaccuugcgguuugaaa

SEQ ID NO: 123643 - RNA, 64 nt, Human
cauccguccacuugcccuccuggcagguggguggggccaccaugcucauccuacaaacggggag

SEQ ID NO: 123644 - RNA, 64 nt, Human
agcagcagcaggcgguggccaggccgggccgggcggccaccagcggcccucggagguacccagg

SEQ ID NO: 123645 - RNA, 64 nt, Human
agcaguucaaggauuuccagcggcggauccugguggccaccaaucuguuuggccgggggaugga

SEQ ID NO: 123646 - RNA, 64 nt, Human
uguccugcguggguagcccucggccggggagugaggccaccaaccaaagucaguuccuucccac

SEQ ID NO: 123647 - RNA, 64 nt, Human
acacaacccccucccgccgcccccaaccacccagggccaccaucagacaacucccugcaugcaa

SEQ ID NO: 123648 - RNA, 64 nt, Human
gaggaagaugccaccgccgcagcaaggucccugcggccaccaccuccuccuccuccuggcccug

SEQ ID NO: 123649 - RNA, 64 nt, Human
cuuguuucuucccacugcacuguggugcuucaguggccaccagccucgucacauacaccagcau

SEQ ID NO: 123650 - RNA, 64 nt, Human
ugaagcugcccagggcuccggaggugcagcuaaaggccaccaaggcagaacaggcagaagggau

SEQ ID NO: 123651 - RNA, 64 nt, Human
caagccagccaccugcccagccgggccugggaugggccaccacaccacuggauauuccugggag

SEQ ID NO: 123652 - RNA, 64 nt, Human
auacagagcaggccacgcucaggcccggcaugcgggccaccaaguucuggaaaccacguggugu

SEQ ID NO: 123653 - RNA, 64 nt, Human
uuucacaccuaugacauacauggaauagcaccugggccaccaugcacucaauaaagaaugaauu

SEQ ID NO: 123654 - RNA, 64 nt, Human
ccugaaaugaggggacccugacuggagaggugggggccaccaaaaacccacaaaggccccggag

SEQ ID NO: 123655 - RNA, 64 nt, Human
ucugugcacacccugagcucugcuccucuggccuggccaccaguccuugucugagugccccagg

SEQ ID NO: 123656 - RNA, 64 nt, Human
ccaaccugcacggggcauuccugcuucucucucaggccaccacagagggcaggggaugguuagu

SEQ ID NO: 123657 - RNA, 64 nt, Human
ggauguagugcuuuuuagaggagccacugggcaaggccaccaagaacaaaugcaugacauuuua

SEQ ID NO: 123658 - RNA, 64 nt, Human
guuuggcauuuggggugacagggagugacccagaggccaccacugcuuuucaugcaggaguuac

SEQ ID NO: 123659 - RNA, 64 nt, Human
caaguccaagcacagccaugcugaguggaagcgaggccaccaucugaguggauuggucccaagu

SEQ ID NO: 123660 - RNA, 64 nt, Human
gccacagucccagaaccaagcucucggugucucgggccaccauccgcccaccucgggcugaccc

SEQ ID NO: 123661 - RNA, 64 nt, Human
uggaggaggccauacuccccuaguuggccacuggggccaccacccugaccaccacugugccccu

SEQ ID NO: 123662 - RNA, 64 nt, Human
cucucucucucuuucucagccugacaggagcaauggccaccagcaggugaagggcaucgcugcc

SEQ ID NO: 123663 - RNA, 64 nt, Human
aaccugaaucccugggggagacagaaggggcaggggccaccagccuccccuucuuguggugaga

SEQ ID NO: 123664 - RNA, 64 nt, Human
gugaagugaccaggcuuagcuuguggaguuuaugggccaccaggguuuggggaaaucaccaucc

SEQ ID NO: 123665 - RNA, 64 nt, Human
uaucuauugaauguuaaacaucucuaauaaagauggccaccacuuaauguguggaaagugaugg

SEQ ID NO: 123666 - RNA, 64 nt, Human
ggucaucagccaggcagcccucccagugcccaagggccaccaaccccagggaaacagggccagc

SEQ ID NO: 123667 - RNA, 64 nt, Human
cauggauuugcggccagcucuccuggggguagggggccaccaggacucaccucccucuucauuu

SEQ ID NO: 123668 - RNA, 64 nt, Human
caccagcucuggacaucaccgccccuggaacuggggccaccagcccugggcacgagauuugcuc

SEQ ID NO: 123669 - RNA, 64 nt, Human
ucagugcacaugcaauuuggguuuuagagaagauggccaccagcuggcuuccuagauauuuuaa

SEQ ID NO: 123670 - RNA, 64 nt, Human
cuggcccuccuccuuuuccacagccacucacuggggccaccaaaacccagagauggcaggugug

SEQ ID NO: 123671 - RNA, 64 nt, Human
ggacauuccauccuucacccccuccucuggcacaggccaccacugcggugcugugccuucagau

SEQ ID NO: 123672 - RNA, 64 nt, Human
ucuuuaacagaaaaaagguauugaaauauuaaauggccaccaaguuuacuuugaagcccauuuu

SEQ ID NO: 123673 - RNA, 64 nt, Human
cgugcugagcacacaacaggcuguguguggaaauggccaccaccauucuccuuccccaccccac

SEQ ID NO: 123674 - RNA, 64 nt, Human
cucagccucccaaauagcugggacuacaggcacaggccaccacaccuggcuaauuuuuuuguau

SEQ ID NO: 123675 - RNA, 64 nt, Human
uucagccucccacagugcugggauuacaggcaugggccaccacgccuagccucacgcuccuuuc

SEQ ID NO: 123676 - RNA, 58 nt, Human
cucuggagcauaauguguaggugugcucggccaccaggguuuuggugaaaaugccggu

SEQ ID NO: 123677 - RNA, 64 nt, Human
gcagugcuacccaccacacacaccuugcuggcccggccaccacugcuggcuucagccccuugag

SEQ ID NO: 123678 - RNA, 64 nt, Human
gcuucagggccaucugcucccagggcaggggacaggccaccaaggaccuuuggcaaaugaaggu

SEQ ID NO: 123679 - RNA, 64 nt, Human
gcugggcaggacacaggcgagcucaggugaugccggccaccagcaaugccuggccugguagcuc

SEQ ID NO: 123680 - RNA, 64 nt, Human
gcccacccucaccacccaaggggucaucaucucuggccaccacuccaccagaugggcagagcag

SEQ ID NO: 123681 - RNA, 64 nt, Human
ccgacccgccacggcccucaguugccagggauggggccaccacugucacacuguggaauacaag

SEQ ID NO: 123682 - RNA, 64 nt, Human
ugugcaagcuggccaggagguagguggagggcaaggccaccagaccuggcuucgcgcuguccac

SEQ ID NO: 123683 - RNA, 64 nt, Human
uccaggcgcagcuggggcugaggaugucucaagaggccaccauggcuuuggcaaggacuggauu

SEQ ID NO: 123684 - RNA, 64 nt, Human
gccuucauuuaucuucuaaaauuccucaucucaaggccaccaguccccaguuaucacccuugga

SEQ ID NO: 123685 - RNA, 64 nt, Human
uaggcucaccuggcacaguggccaagcaggaaggggccaccagugcauagcccaugcugaagau

SEQ ID NO: 123686 - RNA, 64 nt, Human
ugguuuagcuuuugcuuucgaaguggccagcugcggccaccaggucucagcacaagagcgcuuc

SEQ ID NO: 123687 - RNA, 50 nt, Human
ccgcagguggaaggcuuuagggccaccauggcgcagcgccuggugcgcgu

SEQ ID NO: 123688 - RNA, 64 nt, Human
ugcaccgccucaggguuuugggguccugggcuggggccaccaucccugauggcagaacucccac

SEQ ID NO: 123689 - RNA, 64 nt, Human
gucaggagcauuugcaugcaguggguggagagucggccaccaaaggaccgaguugcgcucggaa

SEQ ID NO: 123690 - RNA, 64 nt, Human
cuuuaagcgugaucggagggaagacacacagcagggccaccauuccaugaaugggagguguaca

SEQ ID NO: 123691 - RNA, 64 nt, Human
uggccgccaacuuccacccugacggccgcgccauggccaccaaguuugcacacuugaagcuguu

SEQ ID NO: 123692 - RNA, 64 nt, Human
gucuuccagccugccaaucaacccuccuggguguggccaccauaugugugugccuagguccucc

SEQ ID NO: 123693 - RNA, 64 nt, Human
ugccccuagcuuagagccucccucaauucccccuggccaccaccccccacucugugccugaccu

SEQ ID NO: 123694 - RNA, 64 nt, Human
ugcccagagaaaacuauggcgacaaaggggaaaaggccaccacucguuuucucacugauucaug

SEQ ID NO: 123695 - RNA, 64 nt, Human
aaaugaucucagcccugcaacuugacccagguagggccaccacuacgccuucacuugucaccca

SEQ ID NO: 123696 - RNA, 64 nt, Human
uaggguuuuguuucuucugcuuguuucuguacagggccaccagacuccuggagagaucaagcaa

SEQ ID NO: 123697 - RNA, 64 nt, Human
ucuuuggguaaauugaggaacauggaaaauggagggccaccacuuagguuccauggagaauaug

SEQ ID NO: 123698 - RNA, 64 nt, Human
uaagaaaauagaugaaaaauuaggguacacagcuggccaccaaaugcgaagucaaucugcuacu

SEQ ID NO: 123699 - RNA, 64 nt, Human
ccagcaucagcccuggggagagaggcucccaaagggccaccaugagcccaagauauccuuccug

SEQ ID NO: 123700 - RNA, 64 nt, Human
ccagcagcaggcgcggcugggggcccuggaucccggccaccagggggcuccuacucccaccccc

SEQ ID NO: 123701 - RNA, 64 nt, Human
gccugaucuggggagagggccggggcucgggacuggccaccacuguucagcacaugaccuaacu

SEQ ID NO: 123702 - RNA, 64 nt, Human
guguguguugcuuauguuguuuuguacagaugugggccaccauugcaacaaaauacauucuuuu

SEQ ID NO: 123703 - RNA, 64 nt, Human
aagaggagggagaguggggucagaagauucuccuggccaccaagugccagcauugcccacaaau

SEQ ID NO: 123704 - RNA, 64 nt, Human
ugucacccacaagggaggcuagggcaauggagcaggccaccagcagcagcugugcagcauggaa

SEQ ID NO: 123705 - RNA, 64 nt, Human
ugccucccucugcguugguaucugcuacaucccaggccaccaccuccgaggaugaaaagauggc

SEQ ID NO: 123706 - RNA, 64 nt, Human
gaccucccugcgugcacggccuaggaggugcacgggccaccauagucacacuggcacugaaaag

SEQ ID NO: 123707 - RNA, 64 nt, Human
cuggacgcacaauauccagcgagagaaagaguuucugcggaagcuggugaaagcucgcgucauc

SEQ ID NO: 123708 - RNA, 64 nt, Human
cccaaaaagcuccauggaaacaggcaccugguagcugcggaacacccguggacuuguguauaug

SEQ ID NO: 123709 - RNA, 64 nt, Human
gcugggggcaggaggagguggggaggggcacugccugcggaagguaggauuagaucauuagcuc

SEQ ID NO: 123710 - RNA, 64 nt, Human
gggggguuagcuucguuccaggugggugaccaagcugcggaagcccaggacaguucgcugggac

SEQ ID NO: 123711 - RNA, 64 nt, Human
ggagcgcggcaguauccagaacaauaagcagguccugcggaacuugauuaacuccuccugcgau

SEQ ID NO: 123712 - RNA, 64 nt, Human
acugucaccuuagcaucagagucggauuaaugaacugcggaacaagagguugugagaaucuaag

SEQ ID NO: 123713 - RNA, 57 nt, Human
uuguguuucaggauggcugacuucaggcugcggaaacugaaggcaauaauguuggcu

SEQ ID NO: 123714 - RNA, 64 nt, Human
cccgcgcuccaugccucccccucgacucccggugcugcggaagaacugaagguugcgaugccuu

SEQ ID NO: 123715 - RNA, 64 nt, Human
agcugggaaaagacgauguaauuauuucggggcucugcggaaccuucucuguacagcgcccccu

SEQ ID NO: 123716 - RNA, 64 nt, Human
cuuucuucucuacguuguuucuaaggaucugcugcugcggaacccaaagaugugcuccugucuc

SEQ ID NO: 123717 - RNA, 64 nt, Human
auccggucaccucucugggccucaguuaaugcaucugcggaaugagaggauugcauuagaagau

SEQ ID NO: 123718 - RNA, 64 nt, Human
aaagccggcggcuggacuggcgccccucagagaccugcggaaagcccccucccugagucgucgc

SEQ ID NO: 123719 - RNA, 64 nt, Human
ccggaaggaggagagcgcacacccaggcagcccucugcggaaacuuuccuugguuucuuuuuau

SEQ ID NO: 123720 - RNA, 64 nt, Human
cucagccucagaagcagacucugaagccggagagcugcggaagcccacucaggaggaguggagg

SEQ ID NO: 123721 - RNA, 64 nt, Human
agguccuccaugccagccccacggugguccaugacugcggaacugcccagacauaagcaggagc

SEQ ID NO: 123722 - RNA, 64 nt, Human
cccuccccaacaggcuugguccgggcagccugcucugcggaagguggcagccuccuggugcugg

SEQ ID NO: 123723 - RNA, 64 nt, Human
ucuaaugauucagcccacaggacuguugaaacuacugcggaaguuuuucuaucugaaagaaggu

SEQ ID NO: 123724 - RNA, 64 nt, Human
cugccaagcugagccacugaggaaccacacugugcugcggaaacauagacgugggggcauaggc

SEQ ID NO: 123725 - RNA, 56 nt, Human
acggcaugaaggccauguagcccggccugcggaacccggggcuccagggucugggg

SEQ ID NO: 123726 - RNA, 64 nt, Human
aaaaaucauugcuuugaagcaguugugucagcuacugcggaaaaggaaggaaacuccugacagu

SEQ ID NO: 123727 - RNA, 64 nt, Human
uaggacaaggguccuacccaaggcuaggaccgcccugcggaaacagaaacauagacugagaaca

SEQ ID NO: 123728 - RNA, 64 nt, Human
ucccaaaaaagccaaauuguggcaggacuucuuucugcggaaauguguguguauacuuaugugu

SEQ ID NO: 123729 - RNA, 64 nt, Human
cugaagucaacagaagauccaaguuuaaaauugccugcggaaugugugcaguaucuagaaaaau

SEQ ID NO: 123730 - RNA, 64 nt, Human
cuagaacaugagaaucaagccucuuaauuuuaaacugcggaauguggccucugcuuccuccguc

SEQ ID NO: 123731 - RNA, 64 nt, Human
accccgcucuuggcucugcagcccucuggggagccugcggaaucuuuucugaaggcuacaugga

SEQ ID NO: 123732 - RNA, 61 nt, Human
ggaccaaggaagagcuuugaaggccugaggucugcggaaggugggaggaggcagacgcccu

SEQ ID NO: 123733 - RNA, 64 nt, Human
cuaguucucacauuuagucaacaucuagaaagcgcugcggaaggcucugguucucuagggacuu

SEQ ID NO: 123734 - RNA, 64 nt, Human
ccuugccccccucuuuuuuuuuuuuuuuuaauaucugcggaauaaacccaaugguuaauuuuug

SEQ ID NO: 123735 - RNA, 64 nt, Human
cuuuguacgcagcugccgaacucugacucuaguucugcggaagaaaaggaugcgguauuugcuu

SEQ ID NO: 123736 - RNA, 64 nt, Human
ggaugaagccacgcuccaggccauggacgagaagcugcggaaguggaagguggaacucuagccc

SEQ ID NO: 123737 - RNA, 64 nt, Human
caggagagaaaacugccugaccuuugggacuaagcugcggaaucuucuuacuaagcuugaagag

SEQ ID NO: 123738 - RNA, 64 nt, Human
auucuguuugucucguggggggagguggacaguccugcggaaaugugucuugucuccauuugga

SEQ ID NO: 123739 - RNA, 64 nt, Human
ggaacucuacuuucugagccaaacugcuaauuuucugcggaacugucuagaagaucauucaaga

SEQ ID NO: 123740 - RNA, 64 nt, Human
gauaaauacuaccacugcaagugacugcuguccgcugcggaaucuguucuugguggaagcacag

SEQ ID NO: 123741 - RNA, 64 nt, Human
cggacccccccugggagggguggccacgugcuggcugcggaacccagggcaggggugggagggg

SEQ ID NO: 123742 - RNA, 64 nt, Human
gcaguggugugcuggugauuuugcacagugagcucugcggaaggggucaggcucaacugcugau

SEQ ID NO: 123743 - RNA, 64 nt, Human
cuacacguuggugcgugagauccggcagcacaagcugcggaagcugaacccuccugaugagagu

SEQ ID NO: 123744 - RNA, 64 nt, Human
gaguguguagaaacacagccuaugguuuugcugucugcggaaguuaccauacccuguaaaagac

SEQ ID NO: 123745 - RNA, 64 nt, Human
aguacagaagcuguacucaucggcacgcguccaccugcggaaccuguguuuccuggcgcaggag

SEQ ID NO: 123746 - RNA, 64 nt, Human
uccugguagcccagguucagggcuggggaggagccugcggaaggggccgcagccauucagggga

SEQ ID NO: 123747 - RNA, 64 nt, Human
gcaaguaagguugagccugacuguaaaccuagaacugcggaaggacugggacuuuuguacaaau

SEQ ID NO: 123748 - RNA, 64 nt, Human
cuggugaggcugagccccuaccccaacccaagcucugcggaaaucaacagccccagagccacuu

SEQ ID NO: 123749 - RNA, 64 nt, Human
cuucgccaaugaggaggaggaggcagagguguaccugcggaagcugcagcagguguacaagcug

SEQ ID NO: 123750 - RNA, 64 nt, Human
cagcgaccuggucucccagaacaucaaugucuuccugcggaacacagucaaggucacgggcgug

SEQ ID NO: 123751 - RNA, 64 nt, Human
agggccuugcacauaggaaacuuuugauaaguaucugcggaaaaacaaacaugaauccugugau

SEQ ID NO: 123752 - RNA, 64 nt, Human
ugggccuccugccuccgggcaggcaagguuuacacugcggaagccaaaggcagcuaagauagaa

SEQ ID NO: 123753 - RNA, 64 nt, Human
gauaaguuaaacuuuuguuuguacuaccuguuuucugcggaacugacggaucacaaagaacuga

SEQ ID NO: 123754 - RNA, 64 nt, Human
aaagcucuuccagaaguucaagcagcagaaggagcugcggaaucagggcucaacacagggugac

SEQ ID NO: 123755 - RNA, 64 nt, Human
cccguucaaaggugagaaagugaagcuggugcggcugcggaauccguggggccagguggagugg

SEQ ID NO: 123756 - RNA, 64 nt, Human
gguggagcagcagcuacaagcagaggcugaacaccugcggaaggagcuggagaaucugacagga

SEQ ID NO: 123757 - RNA, 64 nt, Human
gguggaacagcagcuacaagcagaggcugaacaccugcggaaggagcuggagaaucuggcagga

SEQ ID NO: 123758 - RNA, 64 nt, Human
ggauggcucugucaaugucaggcccgagaacagccugcggaaugacagccugggguccuugugc

SEQ ID NO: 123759 - RNA, 64 nt, Human
ggccccugcugguucaggguuggccccugcccggcugcggaaugaaccacaucuugcucugcug

SEQ ID NO: 123760 - RNA, 64 nt, Human
ggcaacuugugauagguaccugagugacggcaaccugcggaaggagguucucccagcccaucug

SEQ ID NO: 123761 - RNA, 64 nt, Human
gauggggagcgucggcgcugaccacacgcgggagcugcggaagcccagcgguucacacaggccu

SEQ ID NO: 123762 - RNA, 64 nt, Human
caucuaccucuaccucugggggcccggacggcugcugcggaaaggaaacccccuccccgacccg

SEQ ID NO: 123763 - RNA, 64 nt, Human
ccacagaacagcagcagacgugucgggagguuagcugcggaaagaaaucgggaugccgcggagc

SEQ ID NO: 123764 - RNA, 64 nt, Human
ggcugaguggcucuuuuauuaaccagucauuacacugcggaacagccaacauagaguacuugcu

SEQ ID NO: 123765 - RNA, 64 nt, Human
acucccuaaucucaaguacccagggacacaaacacugcggaaggcggcaggguccucugccuag

SEQ ID NO: 123766 - RNA, 60 nt, Human
gagaagagaugccccucuagccccucagaucugcggaaccagcccuacauccgcgcagac

SEQ ID NO: 123767 - RNA, 64 nt, Human
uguguguggugcccuccacguggcagaugugagccugcggaauagcgucucuaacuuccuucac

SEQ ID NO: 123768 - RNA, 64 nt, Human
aguggggucagugcagcuacccuuucuuucccuccugcggaacagcggacccagcaagagcauc

SEQ ID NO: 123769 - RNA, 64 nt, Human
ggugcacagggaagaaacggcuuuagacagcagucugcggaaucuugcagagguagcuccgaaa

SEQ ID NO: 123770 - RNA, 64 nt, Human
ugcagaagauacccaagguccaaaagcacaaggucugcggaaaguucugguugucggccgggca

SEQ ID NO: 123771 - RNA, 64 nt, Human
cucucacggacuuggauccagugcgcacacuugccugcggaaaagggcucuccccagccacccg

SEQ ID NO: 123772 - RNA, 64 nt, Human
ugggauuucacaugcuggcuuccaggagcguccccugcggaagccuggccugcuggggaugucu

SEQ ID NO: 123773 - RNA, 64 nt, Human
gcagccccacggacgacgcgagggccccacgucccugcggaagccacagggugagcacucuggg

SEQ ID NO: 123774 - RNA, 64 nt, Human
cugggaacccaugaaauugacccccaaauacauccugcggaaggaauucaggaauaucuguucc

SEQ ID NO: 123775 - RNA, 64 nt, Human
ugaaccccaggaaaaggaagaggucgaaccaacccugcggaaggagcaugguuucaggaguuua

SEQ ID NO: 123776 - RNA, 64 nt, Human
augugcauccguggucaaaagucagcugccagcccugcggaaccagagccucaggcugggaugg

SEQ ID NO: 123777 - RNA, 64 nt, Human
uccaguggaccauuuuguagaaccaugcagcucccugcggaaggugggguagggugggaaagag

SEQ ID NO: 123778 - RNA, 64 nt, Human
uagaggagccacagcccaggggcagaugaaggggcugcggaagacgggggcaguccugggggug

SEQ ID NO: 123779 - RNA, 64 nt, Human
aagguggaacugcacuucuguugagcucucaguucugcggaauuugguacucauuaccguauuc

SEQ ID NO: 123780 - RNA, 64 nt, Human
ggugagcacgugaccaugccgaccacaaaggugucugcggaaacucgaggacauucaccacgau

SEQ ID NO: 123781 - RNA, 64 nt, Human
gcuguccuuuuucuccuugagggaggaaauaaaacugcggaauacaauguccuuccauagcaug

SEQ ID NO: 123782 - RNA, 64 nt, Human
acucuccagaauccaggggcuauagcgauggggacugcggaauuacgagggcuggcuguuuuac

SEQ ID NO: 123783 - RNA, 64 nt, Human
gccaggggguuugaggacccucccagguuucccacugcggaacaggagugacucuggcugccaa

SEQ ID NO: 123784 - RNA, 64 nt, Human
aacucugcaugccucuaucucagaacucugcauccugcggaacuguuuuaauuacaauuauacu

SEQ ID NO: 123785 - RNA, 64 nt, Human
uuuaguuuugguuuguuacgccagcccagucugucugcggaacacugacucugcucucuaauga

SEQ ID NO: 123786 - RNA, 64 nt, Human
uuuacuaccaugcuccuuccuucaucccgagaggcugcggaacggguguggauuugaaugugga

SEQ ID NO: 123787 - RNA, 64 nt, Human; identical to SEQ ID NO: 123707

SEQ ID NO: 123788 - RNA, 64 nt, Human; identical to SEQ ID NO: 123708

SEQ ID NO: 123789 - RNA, 64 nt, Human; identical to SEQ ID NO: 123709

SEQ ID NO: 123790 - RNA, 64 nt, Human; identical to SEQ ID NO: 123710

SEQ ID NO: 123791 - RNA, 64 nt, Human; identical to SEQ ID NO: 123711

SEQ ID NO: 123792 - RNA, 64 nt, Human; identical to SEQ ID NO: 123712

SEQ ID NO: 123793 - RNA, 57 nt, Human; identical to SEQ ID NO: 123713

SEQ ID NO: 123794 - RNA, 64 nt, Human; identical to SEQ ID NO: 123714

SEQ ID NO: 123795 - RNA, 64 nt, Human; identical to SEQ ID NO: 123715

SEQ ID NO: 123796 - RNA, 64 nt, Human; identical to SEQ ID NO: 123716

SEQ ID NO: 123797 - RNA, 64 nt, Human; identical to SEQ ID NO: 123717

SEQ ID NO: 123798 - RNA, 64 nt, Human; identical to SEQ ID NO: 123718

SEQ ID NO: 123799 - RNA, 64 nt, Human; identical to SEQ ID NO: 123719

SEQ ID NO: 123800 - RNA, 64 nt, Human; identical to SEQ ID NO: 123720

SEQ ID NO: 123801 - RNA, 64 nt, Human; identical to SEQ ID NO: 123721

SEQ ID NO: 123802 - RNA, 64 nt, Human; identical to SEQ ID NO: 123722

SEQ ID NO: 123803 - RNA, 64 nt, Human; identical to SEQ ID NO: 123723

SEQ ID NO: 123804 - RNA, 64 nt, Human; identical to SEQ ID NO: 123724

SEQ ID NO: 123805 - RNA, 56 nt, Human; identical to SEQ ID NO: 123725

SEQ ID NO: 123806 - RNA, 64 nt, Human; identical to SEQ ID NO: 123726

SEQ ID NO: 123807 - RNA, 64 nt, Human; identical to SEQ ID NO: 123727

SEQ ID NO: 123808 - RNA, 64 nt, Human; identical to SEQ ID NO: 123728

SEQ ID NO: 123809 - RNA, 64 nt, Human; identical to SEQ ID NO: 123729

SEQ ID NO: 123810 - RNA, 64 nt, Human; identical to SEQ ID NO: 123730

SEQ ID NO: 123811 - RNA, 64 nt, Human; identical to SEQ ID NO: 123731

SEQ ID NO: 123812 - RNA, 61 nt, Human; identical to SEQ ID NO: 123732

SEQ ID NO: 123813 - RNA, 64 nt, Human; identical to SEQ ID NO: 123733

SEQ ID NO: 123814 - RNA, 64 nt, Human; identical to SEQ ID NO: 123734

SEQ ID NO: 123815 - RNA, 64 nt, Human; identical to SEQ ID NO: 123735

SEQ ID NO: 123816 - RNA, 64 nt, Human; identical to SEQ ID NO: 123736

SEQ ID NO: 123817 - RNA, 64 nt, Human; identical to SEQ ID NO: 123737

SEQ ID NO: 123818 - RNA, 64 nt, Human; identical to SEQ ID NO: 123738

SEQ ID NO: 123819 - RNA, 64 nt, Human; identical to SEQ ID NO: 123739

SEQ ID NO: 123820 - RNA, 64 nt, Human; identical to SEQ ID NO: 123740

SEQ ID NO: 123821 - RNA, 64 nt, Human; identical to SEQ ID NO: 123741

SEQ ID NO: 123822 - RNA, 64 nt, Human; identical to SEQ ID NO: 123742

SEQ ID NO: 123823 - RNA, 64 nt, Human; identical to SEQ ID NO: 123743

SEQ ID NO: 123824 - RNA, 64 nt, Human; identical to SEQ ID NO: 123744

SEQ ID NO: 123825 - RNA, 64 nt, Human; identical to SEQ ID NO: 123745

SEQ ID NO: 123826 - RNA, 64 nt, Human; identical to SEQ ID NO: 123746

SEQ ID NO: 123827 - RNA, 64 nt, Human; identical to SEQ ID NO: 123747

SEQ ID NO: 123828 - RNA, 64 nt, Human; identical to SEQ ID NO: 123748

SEQ ID NO: 123829 - RNA, 64 nt, Human; identical to SEQ ID NO: 123749

SEQ ID NO: 123830 - RNA, 64 nt, Human; identical to SEQ ID NO: 123750

SEQ ID NO: 123831 - RNA, 64 nt, Human; identical to SEQ ID NO: 123751

SEQ ID NO: 123832 - RNA, 64 nt, Human; identical to SEQ ID NO: 123752

SEQ ID NO: 123833 - RNA, 64 nt, Human; identical to SEQ ID NO: 123753

SEQ ID NO: 123834 - RNA, 64 nt, Human; identical to SEQ ID NO: 123754

SEQ ID NO: 123835 - RNA, 64 nt, Human; identical to SEQ ID NO: 123755

SEQ ID NO: 123836 - RNA, 64 nt, Human; identical to SEQ ID NO: 123756

SEQ ID NO: 123837 - RNA, 64 nt, Human; identical to SEQ ID NO: 123757

SEQ ID NO: 123838 - RNA, 64 nt, Human; identical to SEQ ID NO: 123758

SEQ ID NO: 123839 - RNA, 64 nt, Human; identical to SEQ ID NO: 123759

SEQ ID NO: 123840 - RNA, 64 nt, Human; identical to SEQ ID NO: 123760

SEQ ID NO: 123841 - RNA, 64 nt, Human; identical to SEQ ID NO: 123761

SEQ ID NO: 123842 - RNA, 64 nt, Human; identical to SEQ ID NO: 123762

SEQ ID NO: 123843 - RNA, 64 nt, Human; identical to SEQ ID NO: 123763

SEQ ID NO: 123844 - RNA, 64 nt, Human; identical to SEQ ID NO: 123764

SEQ ID NO: 123845 - RNA, 64 nt, Human; identical to SEQ ID NO: 123765

SEQ ID NO: 123846 - RNA, 60 nt, Human; identical to SEQ ID NO: 123766

SEQ ID NO: 123847 - RNA, 64 nt, Human; identical to SEQ ID NO: 123767

SEQ ID NO: 123848 - RNA, 64 nt, Human; identical to SEQ ID NO: 123768

SEQ ID NO: 123849 - RNA, 64 nt, Human; identical to SEQ ID NO: 123769

SEQ ID NO: 123850 - RNA, 64 nt, Human; identical to SEQ ID NO: 123770

SEQ ID NO: 123851 - RNA, 64 nt, Human; identical to SEQ ID NO: 123771

SEQ ID NO: 123852 - RNA, 64 nt, Human; identical to SEQ ID NO: 123772

SEQ ID NO: 123853 - RNA, 64 nt, Human; identical to SEQ ID NO: 123773

SEQ ID NO: 123854 - RNA, 64 nt, Human; identical to SEQ ID NO: 123774

SEQ ID NO: 123855 - RNA, 64 nt, Human; identical to SEQ ID NO: 123775

SEQ ID NO: 123856 - RNA, 64 nt, Human; identical to SEQ ID NO: 123776

SEQ ID NO: 123857 - RNA, 64 nt, Human; identical to SEQ ID NO: 123777

SEQ ID NO: 123858 - RNA, 64 nt, Human; identical to SEQ ID NO: 123778

SEQ ID NO: 123859 - RNA, 64 nt, Human; identical to SEQ ID NO: 123779

SEQ ID NO: 123860 - RNA, 64 nt, Human; identical to SEQ ID NO: 123780

SEQ ID NO: 123861 - RNA, 64 nt, Human; identical to SEQ ID NO: 123781

SEQ ID NO: 123862 - RNA, 64 nt, Human; identical to SEQ ID NO: 123782

SEQ ID NO: 123863 - RNA, 64 nt, Human; identical to SEQ ID NO: 123783

SEQ ID NO: 123864 - RNA, 64 nt, Human; identical to SEQ ID NO: 123784

SEQ ID NO: 123865 - RNA, 64 nt, Human; identical to SEQ ID NO: 123785

SEQ ID NO: 123866 - RNA, 64 nt, Human; identical to SEQ ID NO: 123786

SEQ ID NO: 123867 - RNA, 64 nt, Human; identical to SEQ ID NO: 123707

SEQ ID NO: 123868 - RNA, 64 nt, Human; identical to SEQ ID NO: 123708

SEQ ID NO: 123869 - RNA, 64 nt, Human; identical to SEQ ID NO: 123709

SEQ ID NO: 123870 - RNA, 64 nt, Human; identical to SEQ ID NO: 123710

SEQ ID NO: 123871 - RNA, 64 nt, Human; identical to SEQ ID NO: 123711

SEQ ID NO: 123872 - RNA, 64 nt, Human; identical to SEQ ID NO: 123712

SEQ ID NO: 123873 - RNA, 57 nt, Human; identical to SEQ ID NO: 123713

SEQ ID NO: 123874 - RNA, 64 nt, Human; identical to SEQ ID NO: 123714

SEQ ID NO: 123875 - RNA, 64 nt, Human; identical to SEQ ID NO: 123715

SEQ ID NO: 123876 - RNA, 64 nt, Human; identical to SEQ ID NO: 123716

SEQ ID NO: 123877 - RNA, 64 nt, Human; identical to SEQ ID NO: 123717

SEQ ID NO: 123878 - RNA, 64 nt, Human; identical to SEQ ID NO: 123718

SEQ ID NO: 123879 - RNA, 64 nt, Human; identical to SEQ ID NO: 123719

SEQ ID NO: 123880 - RNA, 64 nt, Human; identical to SEQ ID NO: 123720

SEQ ID NO: 123881 - RNA, 64 nt, Human; identical to SEQ ID NO: 123721

SEQ ID NO: 123882 - RNA, 64 nt, Human; identical to SEQ ID NO: 123722

SEQ ID NO: 123883 - RNA, 64 nt, Human; identical to SEQ ID NO: 123723

SEQ ID NO: 123884 - RNA, 64 nt, Human; identical to SEQ ID NO: 123724

SEQ ID NO: 123885 - RNA, 56 nt, Human; identical to SEQ ID NO: 123725

SEQ ID NO: 123886 - RNA, 64 nt, Human; identical to SEQ ID NO: 123726

SEQ ID NO: 123887 - RNA, 64 nt, Human; identical to SEQ ID NO: 123727

SEQ ID NO: 123888 - RNA, 64 nt, Human; identical to SEQ ID NO: 123728

SEQ ID NO: 123889 - RNA, 64 nt, Human; identical to SEQ ID NO: 123729

SEQ ID NO: 123890 - RNA, 64 nt, Human; identical to SEQ ID NO: 123730

SEQ ID NO: 123891 - RNA, 64 nt, Human; identical to SEQ ID NO: 123731

SEQ ID NO: 123892 - RNA, 61 nt, Human; identical to SEQ ID NO: 123732

SEQ ID NO: 123893 - RNA, 64 nt, Human; identical to SEQ ID NO: 123733

SEQ ID NO: 123894 - RNA, 64 nt, Human; identical to SEQ ID NO: 123734

SEQ ID NO: 123895 - RNA, 64 nt, Human; identical to SEQ ID NO: 123735

SEQ ID NO: 123896 - RNA, 64 nt, Human; identical to SEQ ID NO: 123736

SEQ ID NO: 123897 - RNA, 64 nt, Human; identical to SEQ ID NO: 123737

SEQ ID NO: 123898 - RNA, 64 nt, Human; identical to SEQ ID NO: 123738

SEQ ID NO: 123899 - RNA, 64 nt, Human; identical to SEQ ID NO: 123739

SEQ ID NO: 123900 - RNA, 64 nt, Human; identical to SEQ ID NO: 123740

SEQ ID NO: 123901 - RNA, 64 nt, Human; identical to SEQ ID NO: 123741

SEQ ID NO: 123902 - RNA, 64 nt, Human; identical to SEQ ID NO: 123742

SEQ ID NO: 123903 - RNA, 64 nt, Human; identical to SEQ ID NO: 123743

SEQ ID NO: 123904 - RNA, 64 nt, Human; identical to SEQ ID NO: 123744

SEQ ID NO: 123905 - RNA, 64 nt, Human; identical to SEQ ID NO: 123745

SEQ ID NO: 123906 - RNA, 64 nt, Human; identical to SEQ ID NO: 123746

SEQ ID NO: 123907 - RNA, 64 nt, Human; identical to SEQ ID NO: 123747

SEQ ID NO: 123908 - RNA, 64 nt, Human; identical to SEQ ID NO: 123748

SEQ ID NO: 123909 - RNA, 64 nt, Human; identical to SEQ ID NO: 123749

SEQ ID NO: 123910 - RNA, 64 nt, Human; identical to SEQ ID NO: 123750

SEQ ID NO: 123911 - RNA, 64 nt, Human; identical to SEQ ID NO: 123751

SEQ ID NO: 123912 - RNA, 64 nt, Human; identical to SEQ ID NO: 123752

SEQ ID NO: 123913 - RNA, 64 nt, Human; identical to SEQ ID NO: 123753

SEQ ID NO: 123914 - RNA, 64 nt, Human; identical to SEQ ID NO: 123754

SEQ ID NO: 123915 - RNA, 64 nt, Human; identical to SEQ ID NO: 123755

SEQ ID NO: 123916 - RNA, 64 nt, Human; identical to SEQ ID NO: 123756

SEQ ID NO: 123917 - RNA, 64 nt, Human; identical to SEQ ID NO: 123757

SEQ ID NO: 123918 - RNA, 64 nt, Human; identical to SEQ ID NO: 123758

SEQ ID NO: 123919 - RNA, 64 nt, Human; identical to SEQ ID NO: 123759

SEQ ID NO: 123920 - RNA, 64 nt, Human; identical to SEQ ID NO: 123760

SEQ ID NO: 123921 - RNA, 64 nt, Human; identical to SEQ ID NO: 123761

SEQ ID NO: 123922 - RNA, 64 nt, Human; identical to SEQ ID NO: 123762

SEQ ID NO: 123923 - RNA, 64 nt, Human; identical to SEQ ID NO: 123763

SEQ ID NO: 123924 - RNA, 64 nt, Human; identical to SEQ ID NO: 123764

SEQ ID NO: 123925 - RNA, 64 nt, Human; identical to SEQ ID NO: 123765

SEQ ID NO: 123926 - RNA, 60 nt, Human; identical to SEQ ID NO: 123766

SEQ ID NO: 123927 - RNA, 64 nt, Human; identical to SEQ ID NO: 123767

SEQ ID NO: 123928 - RNA, 64 nt, Human; identical to SEQ ID NO: 123768

SEQ ID NO: 123929 - RNA, 64 nt, Human; identical to SEQ ID NO: 123769

SEQ ID NO: 123930 - RNA, 64 nt, Human; identical to SEQ ID NO: 123770

SEQ ID NO: 123931 - RNA, 64 nt, Human; identical to SEQ ID NO: 123771

SEQ ID NO: 123932 - RNA, 64 nt, Human; identical to SEQ ID NO: 123772

SEQ ID NO: 123933 - RNA, 64 nt, Human; identical to SEQ ID NO: 123773

SEQ ID NO: 123934 - RNA, 64 nt, Human; identical to SEQ ID NO: 123774

SEQ ID NO: 123935 - RNA, 64 nt, Human; identical to SEQ ID NO: 123775

SEQ ID NO: 123936 - RNA, 64 nt, Human; identical to SEQ ID NO: 123776

SEQ ID NO: 123937 - RNA, 64 nt, Human; identical to SEQ ID NO: 123777

SEQ ID NO: 123938 - RNA, 64 nt, Human; identical to SEQ ID NO: 123778

SEQ ID NO: 123939 - RNA, 64 nt, Human; identical to SEQ ID NO: 123779

SEQ ID NO: 123940 - RNA, 64 nt, Human; identical to SEQ ID NO: 123780

SEQ ID NO: 123941 - RNA, 64 nt, Human; identical to SEQ ID NO: 123781

SEQ ID NO: 123942 - RNA, 64 nt, Human; identical to SEQ ID NO: 123782

SEQ ID NO: 123943 - RNA, 64 nt, Human; identical to SEQ ID NO: 123783

SEQ ID NO: 123944 - RNA, 64 nt, Human; identical to SEQ ID NO: 123784

SEQ ID NO: 123945 - RNA, 64 nt, Human; identical to SEQ ID NO: 123785

SEQ ID NO: 123946 - RNA, 64 nt, Human; identical to SEQ ID NO: 123786

SEQ ID NO: 123947 - RNA, 64 nt, Human
aagacaacaggcaguaguggcuccucccagcccugggcccaagaggaggcggcugcgggucgug

SEQ ID NO: 123948 - RNA, 64 nt, Human
gaucucaagucaggcugaaggcagcgaagccucggggcccaagccccuccccagcccccucucc

SEQ ID NO: 123949 - RNA, 64 nt, Human
uccagcuuuccuucugcccuuccuccaggagaaggggcccaagguccccguggauggucuccac

SEQ ID NO: 123950 - RNA, 64 nt, Human
gaagggagagcaggaguauuggggcugggcccuggggcccaaggaccagcuggguccccuuugc

SEQ ID NO: 123951 - RNA, 64 nt, Human
cuaaacuaaacuaaugugaacaguagggaagcaagggcccaaaugcauaaguuucuuugcacug

SEQ ID NO: 123952 - RNA, 64 nt, Human
ugucagcauucugacuacuuaccacaucaaaucugggcccaaacagccucaguuaacugcauaa

SEQ ID NO: 123953 - RNA, 64 nt, Human
ccccaagaagcaacagcaugggguccagcaguuggggcccaaaagacagucugaagaggaagga

SEQ ID NO: 123954 - RNA, 64 nt, Human
uuacugaaaaaaaaaaaagaaggaaaaauaagaugggcccaaaggucuaucuacuaaacuagcu

SEQ ID NO: 123955 - RNA, 64 nt, Human
augaaaugacuguuccugacagggaggaauagcagggcccaaucuucugagauggcuucugggu

SEQ ID NO: 123956 - RNA, 64 nt, Human
ucugaaguuugagacgagggauuauuucaggguggggcccaaugugaucuaaugcccagcuggg

SEQ ID NO: 123957 - RNA, 64 nt, Human
ggcacagcccggcagagugguuccaccuccccaugggcccaaggaugcgccucucuggaguuca

SEQ ID NO: 123958 - RNA, 64 nt, Human
agcagcuggauaugggguuccuugauuuuccucugggcccaaauauagcccucacacucuugga

SEQ ID NO: 123959 - RNA, 64 nt, Human
ccaagagagccuuggauucagugguacacuccuugggcccaagggcuuuagcagcuggauaugg

SEQ ID NO: 123960 - RNA, 64 nt, Human
ccagaagccaaggaucucucuagugauggucagagggcccaaauggcagggauacccagugaug

SEQ ID NO: 123961 - RNA, 64 nt, Human
cugaggguaaggaaaagaagagacuaggaaagcugggcccaaaacuggagacuguuugucuuuc

SEQ ID NO: 123962 - RNA, 64 nt, Human
acguuguacacauaugcugcaggaaggggguggggggcccaauaaggccuuugggaaaggacag

SEQ ID NO: 123963 - RNA, 64 nt, Human
ccauggagagggaauguguggcucuggcugcccagggcccaacucgguucacacggaucgugcu

SEQ ID NO: 123964 - RNA, 64 nt, Human
ugacagcaacuaacuauggggauucaggggcuuugggcccaagaacugcagauagcccaggagc

SEQ ID NO: 123965 - RNA, 64 nt, Human
ugugggaaaauggcagaaagauggagaggcaugggggcccaaaggggagcguggggaggggcug

SEQ ID NO: 123966 - RNA, 64 nt, Human
caccuauugguuccccaaaauccacauucucccugggcccaaaugacuuugucucccugggccc

SEQ ID NO: 123967 - RNA, 64 nt, Human
ugcuccacccauggaagaaaggcuggcuguccuugggcccaagaaagucaagcauuauccacgu

SEQ ID NO: 123968 - RNA, 64 nt, Human
uacuuauucugccugaaaacaauguauuaccccagggcccaacaguaaaagauuguggacuuuu

SEQ ID NO: 123969 - RNA, 64 nt, Human
cugcauuucucagucgguguguaaucacguuccagggcccaaagcccagcucuuuguucaguug

SEQ ID NO: 123970 - RNA, 64 nt, Human
guucagugaacccauguuucugggugggugaaaggggcccaacccugcccacuucagcccagcc

SEQ ID NO: 123971 - RNA, 64 nt, Human
ugcgaagaauggcacagggaaaaguagccucucugggcccaauaaaacaacacacauuuuuaaa

SEQ ID NO: 123972 - RNA, 64 nt, Human
agagugcugcuugcugcuggccaggccccugcgugggcccaagcuggacucuggccacucccug

SEQ ID NO: 123973 - RNA, 64 nt, Human
aagacaaagagggugaggucuucaugagucuccugggcccaaagccaucuucugauggaaggaa

SEQ ID NO: 123974 - RNA, 64 nt, Human
acagguaugaccuucuaggaagcuccaguucgaugggcccaauucuuacaaacaugugguuaau

SEQ ID NO: 123975 - RNA, 64 nt, Human
ggcuggucugucauaagacagaaagaaagacgcugggcccaauuuugacuuggccaggggacac

SEQ ID NO: 123976 - RNA, 55 nt, Human
cucgcugccucauccucugaacaccgggcccaaccugaucugauccagaucuuga

SEQ ID NO: 123977 - RNA, 64 nt, Human
gacagagugggagagauuacggcauggcauggaggggcccaaggagcaggggcuguugacaaag

SEQ ID NO: 123978 - RNA, 64 nt, Human
acccaccugcgcuucugcuggaggaggggaagcugggcccaaaggcccagggaggcagcguggg

SEQ ID NO: 123979 - RNA, 64 nt, Human
ugcccaccuggcaguggccgcagccuggcccucugggcccaacgcaggaggcccucagcacccg

SEQ ID NO: 123980 - RNA, 64 nt, Human
cuucugggagauuuuuuugagucaaagacuuaaagggcccaaugaauuauuauauacauacugc

SEQ ID NO: 123981 - RNA, 64 nt, Human
agggaagggcucagagcaagggaaauugagaaaagggcccaaggaggagauggugucuuagaug

SEQ ID NO: 123982 - RNA, 64 nt, Human
aggaacuuggggggauggcgaaugguuccugcccgggcccaaggggugcacagggcaccuccau

SEQ ID NO: 123983 - RNA, 64 nt, Human
ccugucucugccucccugucuaccggacuggccagggcccaagacccccgcugcuccacugcgg

SEQ ID NO: 123984 - RNA, 64 nt, Human
ggguaggguuaccuugaacgaaacagaacuugaggggcccaagccuuaucucagccuuuccuca

SEQ ID NO: 123985 - RNA, 64 nt, Human
uuugugcucccugcuccuucccgcguagccaggugggcccaagggugccuggcagggagcacua

SEQ ID NO: 123986 - RNA, 64 nt, Human
gugggcaggaaggacaugcaccgagaccaggcaggggcccaacuuucacguccagcccuggccu

SEQ ID NO: 123987 - RNA, 64 nt, Human
gauuagaagggcuggacaaagagagaauucaauggggcccaaauuagaaugcuuauaaugagac

SEQ ID NO: 123988 - RNA, 64 nt, Human
caggccccuguugaaauuucauuuguccugcucugggcccaaaggugguggugguuugggucau

SEQ ID NO: 123989 - RNA, 64 nt, Human
caaauuggugaccaccagucaugccuaggaccuggggcccaaaagccgggcaaccucuggcuac

SEQ ID NO: 123990 - RNA, 62 nt, Human
ggugcugugucauucucugacagcagcugccugggcccaaggggugaugaggcauccuuucc

SEQ ID NO: 123991 - RNA, 64 nt, Human
uaaugcuucuuccuucagaaaguagaggaacuaggggcccaauuagcaucaucuaggggaaucu

SEQ ID NO: 123992 - RNA, 64 nt, Human
gcauggugacagucucccccaaacauggccugcugggcccaagugaggagugccagcucaaguu

SEQ ID NO: 123993 - RNA, 64 nt, Human
cgaagucucccuggucugaccaccaggaucccaggggcccaaggcggccccucccgccccuucc

SEQ ID NO: 123994 - RNA, 64 nt, Human
cugcuggccuguaugaccuccacagccaggcccugggcccaagccccuugucccuucuccacug

SEQ ID NO: 123995 - RNA, 64 nt, Human
cacggacuucugagagccaggaauccugcggucugggcccaacacugcauagcacugugcauag

SEQ ID NO: 123996 - RNA, 64 nt, Human
uuaccucagccaucggucuagcauaucagucacugggcccaacauauccauuuuuaaacccuuu

SEQ ID NO: 123997 - RNA, 64 nt, Human
aagaaaauaaguaauuugaggccauuuggaagaugggcccaauuucuuaagugaugagagagca

SEQ ID NO: 123998 - RNA, 64 nt, Human
acguuaacauaaugagucacuaggcuucuggggagggcccaacuucacccaugcaugagagacu

SEQ ID NO: 123999 - RNA, 64 nt, Human
acuaaagguauuaauaaguccaguggaccacagagggcccaaucccucuuggccgcuaaggcua

SEQ ID NO: 124000 - RNA, 64 nt, Human
acacaaagccuuaugagaguauuccuucccucuagggcccaaagaggcugcuaaccagcaggaa

SEQ ID NO: 124001 - RNA, 64 nt, Human
uauuccacccccaaguugaucugaguaucgucaggggcccaaaguacagaauuguucuuugcuu

SEQ ID NO: 124002 - RNA, 64 nt, Human
gaguaaugacaugaauggggccauauucuuccuggggcccaaaugcuggcuggccuuguggucc

SEQ ID NO: 124003 - RNA, 64 nt, Human
accuucaaugggcugggggacuuccugcuggucggggcccaagacgggaacuccuccuuccugc

SEQ ID NO: 124004 - RNA, 64 nt, Human
gaaagggugccagaccauucucuggcggggaccagggcccaaggccccagggcuggaaggagac

SEQ ID NO: 124005 - RNA, 64 nt, Human
guaccagccugacuagguacaggcaagcuugugugggcccaacaggcccuugguagagcuggug

SEQ ID NO: 124006 - RNA, 64 nt, Human
agcacuucgggaggccaaggugggcaguucgcuugggcccaagaguucgagaccagccugggca

SEQ ID NO: 124007 - RNA, 64 nt, Human
uuucaggcaagcccaagacuuuguaauuuuuaaagggcccaagauuuuuuuuuuuuuuuuuuuu

SEQ ID NO: 124008 - RNA, 64 nt, Human
gaguucagcaauaugauagggaacaggugcugaugggcccaagagugacaagcauacacaacua

SEQ ID NO: 124009 - RNA, 64 nt, Human
guuugcuguaaaauaggcaguagaguuguggcaugggcccaacccugcauucaaguguaacagc

SEQ ID NO: 124010 - RNA, 64 nt, Human
uuacuucauggacuuccacugccauccucccaaggggcccaaauucuuucaguggcuaccuaca

SEQ ID NO: 124011 - RNA, 64 nt, Human
gaaaauaaauacacauaauuuuucacaaaauuuugggcccaauuccccuaaaagaauugaggau

SEQ ID NO: 124012 - RNA, 64 nt, Human
uuuccuguguugcccaggcugaccuccaacuccugggcccaagcaauccugccucagccugcca

SEQ ID NO: 124013 - RNA, 64 nt, Human
ugcucuggaguuucacuccccuucugggucccaagggcccaauggccugacuuuuagaauugcu

SEQ ID NO: 124014 - RNA, 64 nt, Human
accccauggcagggguggcgucuucaugagggaggggcccaaagcccuugugggcggaccuccc

SEQ ID NO: 124015 - RNA, 64 nt, Human
ucuuuggcccuccuuuucaacugguuccucuguugggcccaaagguugggaguaggagacagua

SEQ ID NO: 124016 - RNA, 64 nt, Human
cccugcugcccugggcucaggcugcuacccucuggggcccaaagcugucccuucucagugcuug

SEQ ID NO: 124017 - RNA, 64 nt, Human
gaggcggcgguggcacugaagagauagcuuucaagggcccaacacuuugcacuucggcuggcug

SEQ ID NO: 124018 - RNA, 64 nt, Human
gaggacaagcauugcuaccaaccgccucaucugagggcccaacugauaugauuugauuuauccu

SEQ ID NO: 124019 - RNA, 64 nt, Human
cuuggaaaugcacauucuuguauccaucuuacaggggcccaagaugauaaauaguaaacucaaa

SEQ ID NO: 124020 - RNA, 64 nt, Human
ccgacgcuuuucagggcauuucucccuccagccagggcccaacucccaccugccugggcgaauc

SEQ ID NO: 124021 - RNA, 64 nt, Human
guggggccugggaggguuccccuggccuuaaaaggggcccaagccccaucucauccuggcacgc

SEQ ID NO: 124022 - RNA, 64 nt, Human
cugccccuaggaugcugcagcagagugagcaagggggcccaaaucgaccauaaaggguguaggg

SEQ ID NO: 124023 - RNA, 64 nt, Human
gaacauucauccguaaauggaaucugauaaucuggggcccaaauucuguuuacuuaacauguga

SEQ ID NO: 124024 - RNA, 64 nt, Human
cagccuugcgcugucccaggcaugcagcugccuggggcccaaguugcagugagcaggguggggu

SEQ ID NO: 124025 - RNA, 64 nt, Human
auuuggcaaacaugacaacauuuuuuuuggcccugggcccaacaguuuguacuucaugaaacau

SEQ ID NO: 124026 - RNA, 64 nt, Human
acacaaggagacaugggcuagggaaggcagaacugggcccaaagacacacacccccuuggugaa

SEQ ID NO: 124027 - RNA, 64 nt, Human
gcacauuauaaaauuguuuuucuaauacuuuauagggcccaacuucagaaaauacuucgcuuuu

SEQ ID NO: 124028 - RNA, 64 nt, Human
agagaaacacacaugccuuaaaauuuaaaaagcagggcccaaagcuuauuaguuuaaauuaggg

SEQ ID NO: 124029 - RNA, 64 nt, Human
aauauuucauguccuauuuuaauagaaaaccucagggcccaaguaacagugauagaaguuagaa

SEQ ID NO: 124030 - RNA, 64 nt, Human
gaaaacagucuuccauagauuuuuaaggaagaaagggcccaagccaggagaucgcuugguuuuc

SEQ ID NO: 124031 - RNA, 64 nt, Human
gcccucccccaaaaguuauaaaaccauuuuaucagggcccaacauguggcaugcaaugaagaga

SEQ ID NO: 124032 - RNA, 64 nt, Human
gugcagacagcauggacacaaagaugaccacaaggggcccaaaacagaaaagagaaacacaagc

SEQ ID NO: 124033 - RNA, 64 nt, Human
cugcuguuccuucgaggguuccaggcuguguguggggcccaagcaugccccacccaccccuccu

SEQ ID NO: 124034 - RNA, 64 nt, Human
aggagaggacucagccuccuguguuuuggagaaggggcccaauguguguugacgauggcugggg

SEQ ID NO: 124035 - RNA, 64 nt, Human
uggugaucacggcucacucuagccuugaauuccugggcccaagcaauucucccaccucagccuc

SEQ ID NO: 124036 - RNA, 64 nt, Human
aaaugccagugagaaucuucuuauagaauaaccugggcccaagugauuuuaguacaaaacuugc

SEQ ID NO: 124037 - RNA, 64 nt, Human
agcuggccuagcaagaugugcucucagaauggccgggcccaagagaugaaggaaaggagugaaa

SEQ ID NO: 124038 - RNA, 64 nt, Human
ccuccuccuucucuuuccuccuccuccucaccaagggcccaaccgugugcauacaucgucugcg

SEQ ID NO: 124039 - RNA, 64 nt, Human
ucucguugccagcaguugauuuacaguggucacagggcccaauucuagacauaaaacaaaggau

SEQ ID NO: 124040 - RNA, 64 nt, Human
gaaaauccucgcaagaggucuacgagaaggaugagggcccaagucuagggucuaaacaaagcca

SEQ ID NO: 124041 - RNA, 64 nt, Human
cuaauuugaaagaaaauugauaagaaaacuuugagggcccaaguccacaauuuggugagaccac

SEQ ID NO: 124042 - RNA, 64 nt, Human
cugucaggucauuaucaggcauaggcagccuauagggcccaaagaaggcaaaaagauaagauuu

SEQ ID NO: 124043 - RNA, 64 nt, Human
ugaugcagucagaggcaccugcggguuagcccaggggcccaagcccuggauuuggccugcggag

SEQ ID NO: 124044 - RNA, 64 nt, Human
ccgagauggcuucuggaggaaggcgccccuccgagggcccaacacuggccagggaugacaaccu

SEQ ID NO: 124045 - RNA, 64 nt, Human
uccucuuaggaaaggcuaauacuaggguauccuugggcccaaugaauuaggggugaggccccag

SEQ ID NO: 124046 - RNA, 64 nt, Human
aauaucugacuaccccugaauccacccagaaagggggcccaacacccuuguccauuuaugggua

SEQ ID NO: 124047 - RNA, 64 nt, Human
uauauuccauaaaaauacaaaguaacccugacuagggcccaacuuuaauuuugaaugcauuucc

SEQ ID NO: 124048 - RNA, 64 nt, Human
auauuuggaauugaacgacuguauauugcuaagagggcccaaagaauuggaauccuccuuaauu

SEQ ID NO: 124049 - RNA, 64 nt, Human
agugagcccaccuugcugcaacauugguucugaggggcccaagagauggcgucuuggucauuug

SEQ ID NO: 124050 - RNA, 64 nt, Human
gcccgccugccaguccuagcugcacagggcagcugggcccaacccugucuguagagggcccugg

SEQ ID NO: 124051 - RNA, 64 nt, Human
ccaguacuuugccauccuugcacuucuguuaucagggcccaaauaacaguggcaagcuaccaac

SEQ ID NO: 124052 - RNA, 64 nt, Human
caaacuguucagauucaagauuauuccaagcgcagggcccaaauguuauagccaaagaaagucu

SEQ ID NO: 124053 - RNA, 64 nt, Human
acagccugcccaguguggaugucucuuacagagggggcccaaggaaucaccaccccgcuucagu

SEQ ID NO: 124054 - RNA, 64 nt, Human
agggccuguggcagccuaacagggagaggccacggggcccaaaaacgcaacacgucucaaggca

SEQ ID NO: 124055 - RNA, 64 nt, Human
agccaugucauuuuacuuuuagaaacauacaauugggcccaauaugggaauuuucauaauaguu

SEQ ID NO: 124056 - RNA, 64 nt, Human
ggccccgugggguccccacugccccgguacgagggggcccaagacccuggcaggucaggggccc

SEQ ID NO: 124057 - RNA, 64 nt, Human
acuaggggauggagcaagccugugacuccaagcugggcccaagcccagagccccugccugcccc

SEQ ID NO: 124058 - RNA, 64 nt, Human
cccacagaugucuguagucggucggugugaaugugggcccaaguccccaggcaucuucuccgug

SEQ ID NO: 124059 - RNA, 64 nt, Human
augggcuugagggggcucagagcauaaggcuucagggcccaaguugggagaagugaccaaagug

SEQ ID NO: 124060 - RNA, 64 nt, Human
ggggugacuucccugcaguccugggggccuagaugggcccaagacugggugagagucuuggcag

SEQ ID NO: 124061 - RNA, 52 nt, Human
agauucuggacuacgugugacagggcccaaggcugggccucccugacccggc

SEQ ID NO: 124062 - RNA, 64 nt, Human
ugggagaauggggcugagaggaggcuucggguuggggcccaagggagguguggugucaucuggg

SEQ ID NO: 124063 - RNA, 64 nt, Human
cauuugcugacguagugcucucaugggcucaccugggcccaaggcacagccagggcacaguuag

SEQ ID NO: 124064 - RNA, 64 nt, Human
gggagacucaagucuuacuccccaggagcucccagggcccaaggaggagaaugcugccuccuuu

SEQ ID NO: 124065 - RNA, 64 nt, Human
gugcgugccacuaccaaagccuucugggcugucggggcccaaccugcccaaccccagcacuccc

SEQ ID NO: 124066 - RNA, 64 nt, Human
aagagacgggccaccuuugaccccaaggccuggagggcccaaugucgcugcaaacacagccacg

SEQ ID NO: 124067 - RNA, 64 nt, Human
cuuguauaguggccugugaggugacagauuggcagggcccaaggccccagguuuucauuuuuca

SEQ ID NO: 124068 - RNA, 64 nt, Human
aaagaaagauugugcacuuuaaccucucucaucagggcccaagggcuggcugggauuuuuuuuu

SEQ ID NO: 124069 - RNA, 64 nt, Human
uuccacagggacaacgguuuagcuaugaaauuuggggcccaaaauuucacacuucaugugccuu

SEQ ID NO: 124070 - RNA, 64 nt, Human
cugugcuaggcgcugacauuaacaggagcaaccagggcccaauuccuggccuuggagcucaaau

SEQ ID NO: 124071 - RNA, 64 nt, Human
uccagggauuuuuuuuuuuuuuuuuaacccuccugggcccaagugauccuuccaccucagucuc

SEQ ID NO: 124072 - RNA, 64 nt, Human
caucuagaaugacccugaaaugacugacagccccgggcccaagaaaaacccauaaccaccucag

SEQ ID NO: 124073 - RNA, 64 nt, Human
uaagcaucuaaggacaagguaaggagggucacuggggcccaagagucuggggaccagcuuggcu

SEQ ID NO: 124074 - RNA, 64 nt, Human
ucccugugcugucccggcucucauucaugccgaagggcccaacccauuggcuguguucuguuug

SEQ ID NO: 124075 - RNA, 64 nt, Human
gagcgaggagaagguugucaccuaugaccacauugggcccaacgucugcaugggagaccacaag

SEQ ID NO: 124076 - RNA, 64 nt, Human
cacagccuggccagcuccagggaccccaguugcagggcccaagcaggugggaguggacaccagg

SEQ ID NO: 124077 - RNA, 64 nt, Human
gcuguucuacagaaccuacccucucaaugggcaugggcccaaccauccaguuuuccucuuuuac

SEQ ID NO: 124078 - RNA, 64 nt, Human
cuuuauauuuuguauuaugucaaauguuauggcagggcccaaauagcauagccacaaguuuggu

SEQ ID NO: 124079 - RNA, 64 nt, Human
ccgugcccugguauuuaggccaucacauaugguggggcccaagagagccccauaugcacacugc

SEQ ID NO: 124080 - RNA, 64 nt, Human
ggcccuccagaggguaagccauguccggagucucgggcccaaggaacgauuuggagggugcuug

SEQ ID NO: 124081 - RNA, 64 nt, Human
caauuuguaaaaacagcauugcuuucugaaauuagggcccaauuaauaaucagcaagaauuuga

SEQ ID NO: 124082 - RNA, 64 nt, Human
acagguugacuguguacccccaaccaaggagcuggggcccaaggccaguccugccccagagaca

SEQ ID NO: 124083 - RNA, 64 nt, Human
cccaaucauguguucaguagccguccucugagcagggcccaaggcagccaggggccuggagggg

SEQ ID NO: 124084 - RNA, 64 nt, Human
ucucuuucucuucuuauacagacccucauuacuggggcccaagaugugggauacuacuguuagu

SEQ ID NO: 124085 - RNA, 64 nt, Human
ggaguuauuuaacaaugagcccagugacucaauagggcccaaaccuuuuuauuuuacaauauga

SEQ ID NO: 124086 - RNA, 64 nt, Human
accuguagguccccccagcucaccugcccuacuggggcccaacacuguacccagcugguuggga

SEQ ID NO: 124087 - RNA, 64 nt, Human
ccagcucaaaucaggguccagugggaacugaagagggcccaagucggagcucggagggggcugc

SEQ ID NO: 124088 - RNA, 64 nt, Human
aaaggguggaugaaaaugcauuccgaaucugugagggcccaaaacagaauuuagggguggguga

SEQ ID NO: 124089 - RNA, 64 nt, Human
ucuacaaaccaagcucagggccccaacccuagaagggcccaaaugagagaaugguacuuaggga

SEQ ID NO: 124090 - RNA, 64 nt, Human
cgauaagauguaguucauguuuuucuguagcacugggcccaaauauucuuuguaaagaaaaucg

SEQ ID NO: 124091 - RNA, 64 nt, Human
gggaccuuaggcacgccccaagcaccaggcaccagggcccaaggacgcgcagguguuggggcac

SEQ ID NO: 124092 - RNA, 64 nt, Human
aguggugcaaacacagcucucuccacaaccucuugggcccaagugauacucccaccucugccuu

SEQ ID NO: 124093 - RNA, 64 nt, Human
cugggagcuuccaagcccuugagguccagcuguggggcccaaaugacagccuuacaaggguucu

SEQ ID NO: 124094 - RNA, 64 nt, Human
uuugccaccauggucaauuugauaaauuagaauugggcccaaagccagugagauaauucaaugu

SEQ ID NO: 124095 - RNA, 64 nt, Human
guaaucaauaaguauucuggcugggaaagaccgugggcccaaugaucaaagucuucuuggugcu

SEQ ID NO: 124096 - RNA, 64 nt, Human
agguucagccugugagggcugggauggguuucgugggcccaagggcagaccuuucuuugggacu

SEQ ID NO: 124097 - RNA, 64 nt, Human
caaauaguucuuauuugccaaagaacagugaauugggcccaaagaucaaacacagcauuucaug

SEQ ID NO: 124098 - RNA, 64 nt, Human
ccucucccucauucccggacccuuccaccccacugggcccaaccaugggcucaggacccuggaa

SEQ ID NO: 124099 - RNA, 64 nt, Human
aauaauagauuuaaaaggaccaagugguaaaauugggcccaagcugaaguacaggcaaacuuga

SEQ ID NO: 124100 - RNA, 64 nt, Human
guggucuuuucaagaguaaaccagaaauacuuuugggcccaacacuugcaguugccuuccugau

SEQ ID NO: 124101 - RNA, 64 nt, Human
ugcaauguucucagagugacuuucgaaauaaauugggcccaagagcuuuaacucggucuuaaaa

SEQ ID NO: 124102 - RNA, 64 nt, Human
auuaaacaguauuugaaacagagaacgugucccagggcccaaaagucagaagggccccaccagc

SEQ ID NO: 124103 - RNA, 64 nt, Human
cacccagaacagugguggcaacauucauugccaagggcccaaagaaagagcuaccuggaccuuu

SEQ ID NO: 124104 - RNA, 64 nt, Human
guggucccccgagggcuuggugucuacuaccgaagggcccaagaccuccuggguccucucaggc

SEQ ID NO: 124105 - RNA, 64 nt, Human
aagugccuuuggcccaggcuccacggcgacaguugggcccaaaucagaaaggagagagggggcc

SEQ ID NO: 124106 - RNA, 64 nt, Human
agcacuuugggaggcugaagugggaggacugcuugggcccaagaauucaggaccagucugggca

SEQ ID NO: 124107 - RNA, 64 nt, Human
uuggucacagggcgguucugggcacuugaacucagggcccaagcagaagcacaggcccaguccu

SEQ ID NO: 124108 - RNA, 64 nt, Human
acccuccccucucuugcacccgccucucccgucagggcccaagucccuguuuucugagcccggg

SEQ ID NO: 124109 - RNA, 64 nt, Human
auuggacugucccauuugcugguuaaaaggauuggggcccaaauccucuggccuagcauuucuc

SEQ ID NO: 124110 - RNA, 64 nt, Human
ugauaucacucauccuagacauccucgagaggcagggcccaauccuuccagacccaccagcugg

SEQ ID NO: 124111 - RNA, 64 nt, Human
cacccgggcguccugagcacuuugcaagagagaugggcccaaggaauucagaagagcuugcagg

SEQ ID NO: 124112 - RNA, 64 nt, Human
ggccuccuucacaaugugaagcugugggugcagugggcccaagggcucuugcuccugucucugc

SEQ ID NO: 124113 - RNA, 64 nt, Human
accccggcuggggcacaagagcaccagggggguagggcccaaagggaucaggggaagccucugg

SEQ ID NO: 124114 - RNA, 64 nt, Human
gggcuagccugcacugccugggaaagucggccgagggcccaaagcugcugaggggucugaggcu

SEQ ID NO: 124115 - RNA, 64 nt, Human
uucugcugugaggaggcccagaaaaggccaaccagggcccaaccgugcaugaugacagggugaa

SEQ ID NO: 124116 - RNA, 64 nt, Human
ugacuaguacaagcagcccaagaaacucugaacggggcccaauggaggcaaacuugagcaaaua

SEQ ID NO: 124117 - RNA, 64 nt, Human
ccgaggguuucacccacacugccagccuggguuggggcccaaggaugugaccuugagugucaag

SEQ ID NO: 124118 - RNA, 64 nt, Human
cagccuucccaaagcagcaggcgccuccaggcuggggcccaaccuagaaggcaggggucaaucu

SEQ ID NO: 124119 - RNA, 64 nt, Human
ggggucacucuggcagcucagagagggugggagugggcccaaugcacuuuguucuggcucuucc

SEQ ID NO: 124120 - RNA, 64 nt, Human
gccaaccagcaaaauccugauaacaagacucugugggcccaacucuccugaauuaaaggagccu

SEQ ID NO: 124121 - RNA, 64 nt, Human
cucucagcugucaauggcuuggagaacaucucaugggcccaagucaucaaauaaccuguuccuc

SEQ ID NO: 124122 - RNA, 64 nt, Human
ccugggccuggggcagccuccuuccuguaggcgagggcccaagucugggggcagaaccugagug

SEQ ID NO: 124123 - RNA, 64 nt, Human
ggccuccuguucucagggaucacaccugggugaggggcccaagccccucccggaaccaaaggug

SEQ ID NO: 124124 - RNA, 64 nt, Human
aauuuccugcaugcucacacagcccuucccucuggggcccaacaaugccacagccuguucuauc

SEQ ID NO: 124125 - RNA, 64 nt, Human
ugaacucaccuggccugggaagcaccgucugcccgggcccaagcccugccccuccagaguccag

SEQ ID NO: 124126 - RNA, 64 nt, Human
aggcagucuuccugccagcgagcccacuguaucugggcccaaggccagagggcccagagagaag

SEQ ID NO: 124127 - RNA, 64 nt, Human
ucccgcagggugccugggcggagaugucuuuuaggggcccaagaaaaugucuucagaucuuaaa

SEQ ID NO: 124128 - RNA, 64 nt, Human
ggaagacauuucugcacaugguucaccaugcagugggcccaagcaaggggccuaugagggccuc

SEQ ID NO: 124129 - RNA, 64 nt, Human
auuuguacuugagaccaccucacacaaucuguaugggcccaacccugaucucaaaccuccuucc

SEQ ID NO: 124130 - RNA, 64 nt, Human
uuccccaaagacgaccagcauuuaaccaaccuaagggcccaaaggccuuggacaacugcaugga

SEQ ID NO: 124131 - RNA, 64 nt, Human
uugaaggucgguggcggaggggguggcucucacagggcccaacucuaaaguggaagaaccuugu

SEQ ID NO: 124132 - RNA, 55 nt, Human
cuuugcgccucugcaggugacucucgggcccaagcaaccuucuggaaaacggguu

SEQ ID NO: 124133 - RNA, 64 nt, Human
ccagauaaaaaguuguggggcuucagggugaccugggcccaaagguucugaagggcaguuccug

SEQ ID NO: 124134 - RNA, 64 nt, Human
gaggcagagccagcagguggacagguguuugcaggggcccaacuuccccuggagcucagaggug

SEQ ID NO: 124135 - RNA, 64 nt, Human
gggaggcaugaagggggcaagguccguccucugugggcccaaaccuauuuguaaccaaagagcu

SEQ ID NO: 124136 - RNA, 64 nt, Human
cccagccucuccuccuacaccggccuacccaucugggcccaagagcugcacucacacuccuaca

SEQ ID NO: 124137 - RNA, 64 nt, Human
cucugugcagggucugcagggaucuggauugcaagggcccaagucugcaggucuggaagcaucu

SEQ ID NO: 124138 - RNA, 64 nt, Human
caggacuuccggacaacuuagcugggcccuacuugggcccaaguuucagaauaguguuccccua

SEQ ID NO: 124139 - RNA, 64 nt, Human
augaggcccccccccccagcaauaucccaggggcgggcccaaugcccacuguacaugaggcugc

SEQ ID NO: 124140 - RNA, 64 nt, Human
ccuccaggcugcugugagagugucaaguguguaagggcccaaacucagguucagugcagaacca

SEQ ID NO: 124141 - RNA, 64 nt, Human
uguauuucucugugaauccaugggucuggcuagagggcccaaagcuuguaaauauggggauagu

SEQ ID NO: 124142 - RNA, 64 nt, Human
aaaaagaaaauguaucguacaaguuaaaaugcacgggcccaagggggauuuuuuuuuucaccuc

SEQ ID NO: 124143 - RNA, 64 nt, Human
aacagccacuguguuggcuggagagggauggggugggcccaacggggacacaaggaggcagagg

SEQ ID NO: 124144 - RNA, 64 nt, Human
uugagauagagagguuauucuugcugauucaggugggcccaaaauaucaccacaaggguccuca

SEQ ID NO: 124145 - RNA, 64 nt, Human
acaggccccucugcugugccccuaugcccugugugggcccaaccaguggacaauggagucuggg

SEQ ID NO: 124146 - RNA, 64 nt, Human
cucagucuuccagccgccuggggagucucuaccugggcccaagcagguguggggccuccuucug

SEQ ID NO: 124147 - RNA, 64 nt, Human
agagaacagcacuggggcuggaaugaucuuuaaugggcccaaggccaacaggcauaugccucac

SEQ ID NO: 124148 - RNA, 64 nt, Human
ucucaguacuuguuacccagcuucucaacauccagggcccaauuugcccugccuggaguucccc

SEQ ID NO: 124149 - RNA, 64 nt, Human
ggcugcucccuccccuuuuuccugcccagucgcggggcccaagucuuccuucuucguccgaaag

SEQ ID NO: 124150 - RNA, 64 nt, Human
cugcucugggacugggcacccacaagggcucagugggcccaaacccuugaaauccgugaaaccg

SEQ ID NO: 124151 - RNA, 64 nt, Human
caccugcuaggagccucacccgcugggaggcacagggcccaagggagcuggauguguugcccaa

SEQ ID NO: 124152 - RNA, 64 nt, Human
cggcacuccccgccaggcccagggugggguggaugggcccaaaggcccagccccacacuccuuu

SEQ ID NO: 124153 - RNA, 64 nt, Human
gagagagagagaaagagagagagagagagagaaggggcccaagagagacagcacaggcagcccc

SEQ ID NO: 124154 - RNA, 64 nt, Human
gcggcugccgcuaacccggggcgggcagggacgcgggcccaacaauaaaugccgcguggucugc

SEQ ID NO: 124155 - RNA, 64 nt, Human
cuccuagggaucucuugaaccuuaggggugaccugggcccaagucucucaucagcccccaaucc

SEQ ID NO: 124156 - RNA, 54 nt, Human
ugcugaagacucggcugugacccggggcccaaagccaccaccguccuuccaaag

SEQ ID NO: 124157 - RNA, 64 nt, Human
ccuugcucaucuuuaugccccagcacuagguacggggcccaacacgugguaggcacuccaucag

SEQ ID NO: 124158 - RNA, 64 nt, Human
ccagaaacuugccccgaguuucucuggggcccucgggcccaacuucugcuuugcacuauguuca

SEQ ID NO: 124159 - RNA, 64 nt, Human
ccucugcuuccuugggucccuccaagacucccuggggcccaacuguguugcuccacccggaccc

SEQ ID NO: 124160 - RNA, 64 nt, Human
acuuaagcgucuguuuaccaaagaccgggaacaggggcccaaacauguccaguccucuucuucc

SEQ ID NO: 124161 - RNA, 64 nt, Human
cccaucuggagacucuuucucccuugcuggcuuugggcccaaguuugauguuuaugaggaugau

SEQ ID NO: 124162 - RNA, 64 nt, Human
aaagggacugugaguaauggcugucacuugucgggggcccaaguggggugcucuggucugaccg

SEQ ID NO: 124163 - RNA, 64 nt, Human
gugcaggccucaucccugacugcagcuugacucugggcccaacccccauuucccuucaggagac

SEQ ID NO: 124164 - RNA, 64 nt, Human
cccuggcucccaugaccauacugagggaccaacugggcccaagacagaugccccagagcuguuu

SEQ ID NO: 124165 - RNA, 64 nt, Human
aggcuuccuuuucaaccuaaccagccacagccaagggcccaagcagaaguacacccacaagcaa

SEQ ID NO: 124166 - RNA, 64 nt, Human
uucuacaaaagauuguaaaacccuuuuuaggcaagggcccaaggacagugccuuaguuuggauc

SEQ ID NO: 124167 - RNA, 57 nt, Human
ucacccuggccgaugacugagccccgagggcccaacacagaucauggauuugcggcc

SEQ ID NO: 124168 - RNA, 64 nt, Human
cgagcaccaggccagccugggacuggccagagcugggcccaagcugcgcuggaaucgcagcagg

SEQ ID NO: 124169 - RNA, 64 nt, Human
cuacugcuggaaacaauuuuauguaauaagcaaugggcccaaaagucuaggaguuuuuuuguac

SEQ ID NO: 124170 - RNA, 64 nt, Human
gcucaugcacauuuuuaccaucaguaagacgcuggggcccaagaucaucauugugaagcggaug

SEQ ID NO: 124171 - RNA, 64 nt, Human
agaacccugcugcccuuucuaggcagccuccuuggggcccaagcucugcucccuggaucugcca

SEQ ID NO: 124172 - RNA, 64 nt, Human
gggcugacuuccaccucccaguggugagcagugggggcccaaacccaguuuccuucucauuuuu

SEQ ID NO: 124173 - RNA, 64 nt, Human
gccuccagcuuuaacuucugucugcuccuaaugggggcccaaagcucagggcuggggagccugg

SEQ ID NO: 124174 - RNA, 64 nt, Human
acgccagcgcguggcccauguaugaggagugaaggggcccaacgcaauaaccacgucccccacc

SEQ ID NO: 124175 - RNA, 64 nt, Human
guuuccuggauggaugugaaguugggccucccaugggcccaagggaguaggaagccccauuccc

SEQ ID NO: 124176 - RNA, 64 nt, Human
ugauuguuucacgcaugcugcuaacccagagccugggcccaaagcuaguuaguacucaauaaac

SEQ ID NO: 124177 - RNA, 64 nt, Human
acuggaaacuuuugggaacucuccucgaaugugugggcccaaggcccccaccucugugaccccc

SEQ ID NO: 124178 - RNA, 64 nt, Human
ugguugaugauaccaccaccaccugccuacccaugggcccaaguuucuguggcucauuacaggg

SEQ ID NO: 124179 - RNA, 64 nt, Human
cucagagugcuuggcugcuguaucuuuaaugcuggggcccaaguaagggcacagauccccccac

SEQ ID NO: 124180 - RNA, 64 nt, Human
uccaguccuguaggggagacaaaaccagauuggggggcccaaggggagcauggaaaaggccggc

SEQ ID NO: 124181 - RNA, 64 nt, Human
gugagagagaagaaaaugguggccggagaugggagggcccaaggaaccuccugggagggggccu

SEQ ID NO: 124182 - RNA, 64 nt, Human
cuaucuugauccuuuccuggccaaauauccucuugggcccaaaugaacauuguaccauagucuu

SEQ ID NO: 124183 - RNA, 56 nt, Human
cugcugcugacgagccauaagaccuggggcccaacugccucuccagcauuggccuu

SEQ ID NO: 124184 - RNA, 64 nt, Human
agugugcuaugcacccacccagguggccgccucugggcccaaggcacaugcugugagcuuccug

SEQ ID NO: 124185 - RNA, 64 nt, Human
auuaaguaaggcgaggccauacugcauuuacaaugggcccaauccagugucccuaugagagacg

SEQ ID NO: 124186 - RNA, 64 nt, Human
agugccccacguucugagaaggggccggccggagggaggggacccggcagggagauuucgguuu

SEQ ID NO: 124187 - RNA, 64 nt, Human
guagagacuuccauagaauuaagaggguucucauggaggggauaggaaguagguuuaaagccua

SEQ ID NO: 124188 - RNA, 64 nt, Human
ggcugcagacucaggcccaggacacucaaccccaggaggggagccgcucggcgaaugagcuggg

SEQ ID NO: 124189 - RNA, 64 nt, Human
ucugugcacagcucgaucuucuacuugccuguggggaggggagugacagguccacacaccacac

SEQ ID NO: 124190 - RNA, 64 nt, Human
cccuugggaagggcagggaauggggacgguguauggaggggagggaucuccugcgcccuucauu

SEQ ID NO: 124191 - RNA, 64 nt, Human
uggcuuccuuggcuugccuggugggggaaggggaggaggggaagaaggaaagggaagagucuuc

SEQ ID NO: 124192 - RNA, 64 nt, Human
gcugucugccaccuuguguggcuugacccccuguggaggggagugccugguuggaucccacacu

SEQ ID NO: 124193 - RNA, 64 nt, Human
cagagguuaauaaccacgcuccuuggagcaaggaggaggggagccuuucugacuagcugaagua

SEQ ID NO: 124194 - RNA, 64 nt, Human
cuuucugggagcagaaacagccauugcggccccaggaggggaacugagucacgcuggggcucuc

SEQ ID NO: 124195 - RNA, 64 nt, Human
ccccugacuauccccagcccugaaaaaaagagcaggaggggacaccccuccauaugcccccccc

SEQ ID NO: 124196 - RNA, 63 nt, Human
uggagggcuuccagcuauaauaucugccuccagggaggggaggggaugggaagcaccaccagc

SEQ ID NO: 124197 - RNA, 64 nt, Human
gggcuuccagcuauaauaucugccuccagggaggggaggggaugggaagcaccaccagccagcg

SEQ ID NO: 124198 - RNA, 64 nt, Human
uugagcagacgguauauuccagaggugggaggugggaggggaagggagaaauccaaaacaaagu

SEQ ID NO: 124199 - RNA, 64 nt, Human
gggagucaugcccaggggaggagacuuuuuaucuggaggggagagaaggauucuaggggugugg

SEQ ID NO: 124200 - RNA, 64 nt, Human
uauacagucuacuucguguucugucacccuuuggggaggggaguucuccugggacagugggcuc

SEQ ID NO: 124201 - RNA, 64 nt, Human
ccccucuccuccgccacccccgccguggggcuccggaggggacccagcuccucugagccauacc

SEQ ID NO: 124202 - RNA, 64 nt, Human
auucucagcucuugggaacccccuugcucccaggggaggggaaaccuuuuucauucaacauugu

SEQ ID NO: 124203 - RNA, 64 nt, Human
gcuuuggugcgcccccugcugaggagcagccccaggaggggaccagaggggaugcugugucgcu

SEQ ID NO: 124204 - RNA, 64 nt, Human
ugaagaggcacccuggcaagcagcagugauugggggaggggacaggaucuaacaaugucacuug

SEQ ID NO: 124205 - RNA, 64 nt, Human
gguggcauuuugagaaugguaaagaaauacacagggaggggaugaugacuauuaguggacucuu

SEQ ID NO: 124206 - RNA, 64 nt, Human
auguuuuauuuaucaaaauguagcuuuuggggagggaggggaaauguaauacuggaauaauuug

SEQ ID NO: 124207 - RNA, 64 nt, Human
agccugaccugcgugggagaggcguagcgaggucggaggggaaagggagaucccacgugcaagu

SEQ ID NO: 124208 - RNA, 64 nt, Human
gucagagcccugggucaaaaccacucagcccaggggaggggaugaggcauugucacccuagacc

SEQ ID NO: 124209 - RNA, 59 nt, Human
ugucgauggagauggacuaggcuggcccgggaggggagugacagagggacguucuagga

SEQ ID NO: 124210 - RNA, 64 nt, Human
ccccuaacuuaaagcuagagaauucugaaacugaggaggggauccucuguuaaucagugagcac

SEQ ID NO: 124211 - RNA, 64 nt, Human
acgacucaagcccugaccuuccgguacaggauaaggaggggaccugaauuggugagauggaauc

SEQ ID NO: 124212 - RNA, 64 nt, Human
ccaucucuuguaccagcccaggcaauaguguugaggaggggagcaaggcugcuaaguggaagac

SEQ ID NO: 124213 - RNA, 64 nt, Human
accgggcuggccugacacaaugguagcucugaagggaggggaagagagaggccugggugugacc

SEQ ID NO: 124214 - RNA, 64 nt, Human
acccccauugcucuccuccaggggcagaacauggggaggggacuagaugggcaaggggcagcac

SEQ ID NO: 124215 - RNA, 64 nt, Human
ucuaauccccgggggccaagcuggggagggauguggaggggaaaaagaugacagagaaguggac

SEQ ID NO: 124216 - RNA, 64 nt, Human
cacccccguccuaggcucccauccuuuccaucaagaccuucauuagcuuaugauauuugcugcc

SEQ ID NO: 124217 - RNA, 64 nt, Human
ugcgggccucggaccccggcuggcccggcggcggggaggggaggcgggggcgccuccggcggcg

SEQ ID NO: 124218 - RNA, 64 nt, Human
acucgguuuggaauggggagggaggagggcggggggaggggaggguugcccucagcccuuuccg

SEQ ID NO: 124219 - RNA, 64 nt, Human
aaugcaaaugcagaagacuuaccuuaguucaaggggaggggacaaagaccccacagcccaacag

SEQ ID NO: 124220 - RNA, 64 nt, Human
gcauuaacuuauugucuaggccagagcgggggugggaggggaaugccacagugaagggaguggc

SEQ ID NO: 124221 - RNA, 64 nt, Human
ggagcuuuuaggaugugggaguaaaacuuuaaugggaggggagggcuggcugcuggaagaagga

SEQ ID NO: 124222 - RNA, 64 nt, Human
uacacaguguuauugaaagaagagagguggggguggaggggaauuagucugucccagcuagagg

SEQ ID NO: 124223 - RNA, 64 nt, Human
aacuauaggagccuuuggaaggccucuuauguuuggaggggaaggguguugagauugucaccau

SEQ ID NO: 124224 - RNA, 64 nt, Human
uagcuaaugggcggcccacuucagcacugggcaaggaggggauccaugaaucugggguacaaag

SEQ ID NO: 124225 - RNA, 64 nt, Human
ugcucaucuuuggagggugccagguagaagcuagggaggggagugucuucucucuccagguuuc

SEQ ID NO: 124226 - RNA, 64 nt, Human
agugcucuuuugguauauggcauacagcuccauuggaggggacacaucacuggcuuuaucuggu

SEQ ID NO: 124227 - RNA, 64 nt, Human
ccccggcugggggcugugcaguccggucagggcgggaggggaaaugcaccgcugcaugugaacc

SEQ ID NO: 124228 - RNA, 64 nt, Human
aaaugaagucagugcaaggaggaaugagagguggggaggggagauuguugagagauggacuagg

SEQ ID NO: 124229 - RNA, 64 nt, Human
gggggauccuggagccccugugucggggggcgagggaggggagguggccgucgaguugaccuuc

SEQ ID NO: 124230 - RNA, 64 nt, Human
ccacccaggcacagccaccacuuugcaagugggaggaggggagaaggggagacaaaaccacugc

SEQ ID NO: 124231 - RNA, 64 nt, Human
cucugcucucccagcacugacucacuccugccugggaggggaaugcagcauucaugcugugugu

SEQ ID NO: 124232 - RNA, 63 nt, Human
gcgcgcuuggcugcuuauagacuguacuagggcggaggggauccgggccuugcgugcagccuc

SEQ ID NO: 124233 - RNA, 64 nt, Human
uccccauggguuuugauugugucuaagcuaugaugaccuucauauaaucagcauaaacauaaaa

SEQ ID NO: 124234 - RNA, 64 nt, Human
ugugacaguguauggggcugcaguuggucucccuggaggggacuuccacaccuccugccuuuag

SEQ ID NO: 124235 - RNA, 64 nt, Human
cgguguacaauacccauauaagguacauugugcaggaggggaauugcuggcugcuuuuacuucc

SEQ ID NO: 124236 - RNA, 64 nt, Human
cuuacaagucuauaauuuaaagaugugaugguggggaggggaggauggggaagcuuuuuauaua

SEQ ID NO: 124237 - RNA, 64 nt, Human
ucuugguuucgucucccacauacagaagcaggguggaggggaagggugggucucaguuagcagg

SEQ ID NO: 124238 - RNA, 64 nt, Human
cugguaaggacgaagcggagagagccaagacggaggaggggaaggggcugaggacgagaccccc

SEQ ID NO: 124239 - RNA, 64 nt, Human
uaaaucauguuuacauaugagauuuauagucgugggaggggaauaaaguucuguuauauuuccu

SEQ ID NO: 124240 - RNA, 64 nt, Human
ucacuucagcuaugagccaaauguucccuuuccuggaggggagaggcuucuuacuagguaagag

SEQ ID NO: 124241 - RNA, 64 nt, Human
caugugaucaucccaaaagagcuggagugacaugggaggggaggcggaucugaggggcugggug

SEQ ID NO: 124242 - RNA, 64 nt, Human
agccuguccgucccugucccgggcuggggaggggggaggggaacuuuguugggaauaaacuuca

SEQ ID NO: 124243 - RNA, 64 nt, Human
uuaaaucgcaguauacuguauuuaucggggccccggaggggaggucgcgagagccgcgucugug

SEQ ID NO: 124244 - RNA, 64 nt, Human
cugggcccugugguugcugggccucccaccucaaggaggggaagguuguacagcccgaacccgu

SEQ ID NO: 124245 - RNA, 64 nt, Human
agaugacugccauguacacugcagucaagggcagggaggggaggaaugacacaaauggcaggga

SEQ ID NO: 124246 - RNA, 64 nt, Human
gagguccaaggucuuuguccuagaaucagaguggggaggggacagccuggggcugcccagagac

SEQ ID NO: 124247 - RNA, 64 nt, Human
gcuggaugggguuuugggagcuauagguugcuaaggaggggagucagauuguggucaggugccu

SEQ ID NO: 124248 - RNA, 64 nt, Human
gguucucauggccuucgucacgauaccaggauacggaggggagcccagggccauccauacccac

SEQ ID NO: 124249 - RNA, 64 nt, Human
ugcccucccaugcucccuaccuguccccucacagggaggggagcaggggagggaaagaaaccag

SEQ ID NO: 124250 - RNA, 64 nt, Human
agcagcaagauaaacccgcuccacccgacccgccgaccuucagcuuugugggacuaucaggaaa

SEQ ID NO: 124251 - RNA, 64 nt, Human
uggaggagucagacuaccaugacaucguagggaaggaggggagauuuuuuuguaguuuuuaauu

SEQ ID NO: 124252 - RNA, 64 nt, Human
gggcuuaggacaccccaagugguuugggaaaggaggaggggagugguggguuuauagggggagg

SEQ ID NO: 124253 - RNA, 64 nt, Human
ggcagaagucagcccgaaugccugucaguuucauggaggggaaacgcaaaaccugcaguuccug

SEQ ID NO: 124254 - RNA, 64 nt, Human
ugggguggggugagggguaaguuuaggcuuucgcggaggggaggagacauggagccugggaacu

SEQ ID NO: 124255 - RNA, 64 nt, Human
ccaucugcccggcacuggggacuuaggggugcggggaggggaaggacgccuccaagcccgcucc

SEQ ID NO: 124256 - RNA, 64 nt, Human
aggaccaggaagagaggaacucggaggacaauagggaggggaagucuuggaaaaucuaccacuu

SEQ ID NO: 124257 - RNA, 64 nt, Human
gggacagucagauucuucuaaaucaggccaggaaggaggggaaaagagugagagaaugguauuc

SEQ ID NO: 124258 - RNA, 64 nt, Human
gucauuccauugagaaagcugacaacugggauagggaggggauuagauaauagauggggucaaa

SEQ ID NO: 124259 - RNA, 64 nt, Human
uuuacugcagaaugaacugcaaguucagcauaguggaggggagaggcagaacuggaggagaggu

SEQ ID NO: 124260 - RNA, 64 nt, Human
agagccuggcucugcuuugugcuguggcuuagccggaggggacguggccaagggugagguggcc

SEQ ID NO: 124261 - RNA, 64 nt, Human
cacucccacagccaaaagaaugagugggagaaauggaggggacaaucuccugggagcuaugcgc

SEQ ID NO: 124262 - RNA, 64 nt, Human
cacucagccccccagugucgaaggccaagguuggggaggggaacaggagagaggcaaugaugag

SEQ ID NO: 124263 - RNA, 64 nt, Human
gauugccaguaaugcaagaaacacuccuugagagggaggggaaaagacuuucuuaaauauuuca

SEQ ID NO: 124264 - RNA, 64 nt, Human
ggauggcaugguguuuguggacugguucagggaaggaggggaaaagggaggugcagagagcucu

SEQ ID NO: 124265 - RNA, 64 nt, Human
gagaaaaugggugcugggccugaguacucccgucggaggggauggacagucaccccucccguug

SEQ ID NO: 124266 - RNA, 64 nt, Human
augauggugguguugaugguggcggugguaggguggaggggagagaagaagaugcugaugauau

SEQ ID NO: 124267 - RNA, 64 nt, Human
gacauuuugcauauaugaagauuuucugaaauaggaccuucaagauccuaggggguuuuguuug

SEQ ID NO: 124268 - RNA, 64 nt, Human
gugauugcaacaaaggcagagggggcggggcgggggaggggagguaggacccgcuccggaaggc

SEQ ID NO: 124269 - RNA, 64 nt, Human
gucacaauguucgcugaggccccaggugugguggggaggggaggcagguguggguagcgcacau

SEQ ID NO: 124270 - RNA, 64 nt, Human
ucccuugucuguaacauagaccccggguacugcgggaggggagggcugcuggggaggauggggg

SEQ ID NO: 124271 - RNA, 64 nt, Human
ucauguuauuuauucuaauauagaggcauugagaggaggggaguguaugucuagaguuacccca

SEQ ID NO: 124272 - RNA, 64 nt, Human
cagagacccugcugguacccagacccccaccuucggaggggacuucauguuccguguacguuug

SEQ ID NO: 124273 - RNA, 64 nt, Human
ucauuacuuaauguuaaauuaacauucuguguagggaggggaggcuuauucaauucuucugacc

SEQ ID NO: 124274 - RNA, 64 nt, Human
gaggcugcuucgcacuuugcccucugccugguggggaggggagagcucagcccccgacucacuc

SEQ ID NO: 124275 - RNA, 64 nt, Human
caugccuguaaucccagcuacucuggagacagguggaggggauugcuugagccugggaagcuga

SEQ ID NO: 124276 - RNA, 64 nt, Human
cacacucgagcccacccggccggccagcuuuagaggaggggaggagcagggcgaguucacauua

SEQ ID NO: 124277 - RNA, 64 nt, Human
gaggaugggggguguccccucagcggaggccaagggaggggagcagccuaguuggucuuggaga

SEQ ID NO: 124278 - RNA, 64 nt, Human
cugcgagagauccggggaccugugggcagcuggcggaggggagacucagcagacggacccucuc

SEQ ID NO: 124279 - RNA, 64 nt, Human
cuggacucgguuucccagcgcggucaacgcaucuggaggggacuggaggaaacccccuuguugg

SEQ ID NO: 124280 - RNA, 64 nt, Human
cagaaagcagaacagugauuaccagggacugaggggaggggagcaugggaagugacgguuuaau

SEQ ID NO: 124281 - RNA, 64 nt, Human
cccaagcgggcaucauccccccacacugcucaggggaggggagggaucaggcgaugagacugug

SEQ ID NO: 124282 - RNA, 64 nt, Human
cgcccagcuuucccaggggcacagcucuaggcugggaggggagaaccagccccucccccugccc

SEQ ID NO: 124283 - RNA, 64 nt, Human
agggccccuaccaaccuuugccucugccuuggagggaggggaggucuguuaccacuggggaagg

SEQ ID NO: 124284 - RNA, 64 nt, Human
gccgggacagcacugggugcucaggcuggccaaggaccuucauugccuggcaagagcugcccag

SEQ ID NO: 124285 - RNA, 64 nt, Human
gggauaggaccgggggaccccagagggaggccuaggaggggacugcacccauacugcuucccua

SEQ ID NO: 124286 - RNA, 64 nt, Human
guuccaacaggacagcgccuucccccaugcgcugggaggggacccuccauuucucccccucacc

SEQ ID NO: 124287 - RNA, 64 nt, Human
cuccuccucccugccuggggagcccaguggccagggaggggagugguggagccagucgcuguaa

SEQ ID NO: 124288 - RNA, 64 nt, Human
acauuuguaaauauuuagggaaagccggguggggggaggggauacagauguagaagguggguag

SEQ ID NO: 124289 - RNA, 64 nt, Human
ggcagcuggcacucaccaggccugggucagguggggaggggacaccaagggcccauuuccuccc

SEQ ID NO: 124290 - RNA, 64 nt, Human
auggaaucuacuauacaggaggaugcagugggcuggaggggaugggcgaaaaugggagcaggaa

SEQ ID NO: 124291 - RNA, 64 nt, Human
agaacaagccccaggcaagcuggaacuuggguggggaggggacaugaggaggauaaacagcuga

SEQ ID NO: 124292 - RNA, 64 nt, Human
uguccugguggcacaagggauggggacgcgagggggaggggaggcgaggaacaaggagaagggg

SEQ ID NO: 124293 - RNA, 64 nt, Human
gaggggccacugacccaccugcgcuucugcuggaggaggggaagcugggcccaaaggcccaggg

SEQ ID NO: 124294 - RNA, 64 nt, Human
ggccucagccccagauuguaccuccugcccuguaggaggggagggggcaaagccuucugacuuc

SEQ ID NO: 124295 - RNA, 64 nt, Human
caaacugaagcagccucuccccagguccagcucuggaggggagggggauccgacugcuuuggac

SEQ ID NO: 124296 - RNA, 64 nt, Human
acgccagugaccucugcugggucacagccacucaggaggggaagggucaggaugagaggcugca

SEQ ID NO: 124297 - RNA, 64 nt, Human
uuuuuuuuuuaguuuguguguggggguggguaagggaggggaugguuuauguugaauguuuagu

SEQ ID NO: 124298 - RNA, 64 nt, Human
uuucugucauuugccuacuggggaagaaagugaaggaggggaaacuguuuaauaucacaugaag

SEQ ID NO: 124299 - RNA, 64 nt, Human
uggccagcccagauggcucccugggcuggcauggggaggggagagaagguggucugcaccccac

SEQ ID NO: 124300 - RNA, 61 nt, Human
ccauggcugaagacuacugaagggagggagaggaggggagccaagacacucaugccacucu

SEQ ID NO: 124301 - RNA, 64 nt, Human
uuacaauuuuugaagcucuuucacagucuuauuugaccuucacagucauucugccuuagacugu

SEQ ID NO: 124302 - RNA, 64 nt, Human
uuuuaggaguauagacagauauaucuuauuguggggaggggaaagaaauccaucugcucaugaa

SEQ ID NO: 124303 - RNA, 64 nt, Human
ggcaccgagggaguuuucuggguguagagagaauggaggggaccaaaaagaguccuuccugggg

SEQ ID NO: 124304 - RNA, 64 nt, Human
ccaaggagggcggggcauguugggagagggggagggaggggagacagagccuuuaacccuuuuu

SEQ ID NO: 124305 - RNA, 64 nt, Human
uucagcacaagacauacgauuuuagaaggugaggggaggggaggcuuuuucuaccugagaaggg

SEQ ID NO: 124306 - RNA, 64 nt, Human
cgcucccacucuucuccugcucccccccugcccuggaggggaggggcgauaaauaccuuugauu

SEQ ID NO: 124307 - RNA, 64 nt, Human
uaaaugccauguuuaucacccuaauuaauagaauggaggggacuccaaagcuggaacugaaguc

SEQ ID NO: 124308 - RNA, 64 nt, Human
aacauagcccagagaagagaggcucugaaagaaaggaggggagcagcagaagccacggcaggga

SEQ ID NO: 124309 - RNA, 64 nt, Human
uccugaggcugggagagacuaggaaggcuugguaggaggggaaaaaagucaggaaaauauauca

SEQ ID NO: 124310 - RNA, 64 nt, Human
uucuguuccuggaauugugugagcuaggaauggaggaggggagacuuucaaugguuaaggcucc

SEQ ID NO: 124311 - RNA, 64 nt, Human
uccagucaugugugcaucaugucucuuugccaagggaggggagaaaggaacuuuuaaacugcag

SEQ ID NO: 124312 - RNA, 64 nt, Human
cccagggccagugccauggggaaggggcuuguggggaggggacccaugaauccugaccacucuu

SEQ ID NO: 124313 - RNA, 64 nt, Human
cuuucacuuuuuuucuucuaggucuccaggucccggaggggauuuguggaccucucuugucucc

SEQ ID NO: 124314 - RNA, 64 nt, Human
agcugagaggaccugaucauguagggagggacggggaggggagccaggacccaggagcugcaug

SEQ ID NO: 124315 - RNA, 64 nt, Human
aauguuguguguuuuuuuuuugugugugcuggagggaggggauuuaauuuuaauuuuaaaaugu

SEQ ID NO: 124316 - RNA, 64 nt, Human
ugggcggcgggcgcgacgugaucguggaccugugggaggggaggcacguggcgcgcgugggccc

SEQ ID NO: 124317 - RNA, 64 nt, Human
aauuuuaagccaaaaacaaacgaaaggaaagcggggaggggaaaacagacccucccacuggugc

SEQ ID NO: 124318 - RNA, 64 nt, Human
aaaggggccacuucuggcuuuguuagcaauaacugaccuucaguuuacccuucugaaggagcag

SEQ ID NO: 124319 - RNA, 64 nt, Human
cuccacucauauggccucucccuccccagcuaguggaggggaagcagucuggacuuagaaagga

SEQ ID NO: 124320 - RNA, 64 nt, Human
agguugugccuacguugcagggaacuaggaacauggaggggaaccaacaacagcaucuuagaag

SEQ ID NO: 124321 - RNA, 64 nt, Human
gguagcguguguguguguggcggggggugcugagggaggggagugagucacaggagccuguccc

SEQ ID NO: 124322 - RNA, 64 nt, Human
gcucauguucuggcagcaacuucacuuuuccuaaggaggggaggaggcagcagggaagcaaccc

SEQ ID NO: 124323 - RNA, 64 nt, Human
acacaagguaagcccuuuccaauuugugggaacaggaggggagaggaaacaaaugugaaguugu

SEQ ID NO: 124324 - RNA, 64 nt, Human
ugcuggccaggagcugauggcucacugggcucuuggaggggaaugugaagaaaccaaggaguca

SEQ ID NO: 124325 - RNA, 64 nt, Human
acuguuuugcagaggauuugugugugcugccucaggaggggagggcugguaggagggggggaga

SEQ ID NO: 124326 - RNA, 64 nt, Human
ugcguuuuggcucaaggaugacugccugcuuucuggaggggagggucuggaggucuuugcugca

SEQ ID NO: 124327 - RNA, 64 nt, Human
agcuaccuucuccacuugguggcacaagagguagggaggggaguauggguucauuuggcuucgc

SEQ ID NO: 124328 - RNA, 64 nt, Human
ugcccuaauuaaaaacugugauuuuuaucacaagggaggggaggccgagagucagacugauaga

SEQ ID NO: 124329 - RNA, 64 nt, Human
gcucuuucuuauuuuccucauaaucagcuacccuggaggggagggagaacucauuuuacagaac

SEQ ID NO: 124330 - RNA, 64 nt, Human
agugaguuagguugggcugaugggauagaaggugggaggggaaugcuauacagcugggaacagc

SEQ ID NO: 124331 - RNA, 64 nt, Human
aagaauguuggccaugagacuaucauucagaggaggaggggauuucucucuucaaggccguaac

SEQ ID NO: 124332 - RNA, 64 nt, Human
uaaauuaaaggaaaauuaccaaaugcuuacuuugggaggggacgccgaacucgagcuuguagac

SEQ ID NO: 124333 - RNA, 64 nt, Human
uaggcggagagcagucccucccucaggaacuggaggaggggacuccaggaauggggaaauguga

SEQ ID NO: 124334 - RNA, 64 nt, Human
ucuuuugcuuaagccccuuuggaaucucccauuuggaggggauuuguaaaggacacucaguccu

SEQ ID NO: 124335 - RNA, 64 nt, Human
ccacagcuucgggguccugucaucacauccccugggaggggaggcaggaggaggccgagggccc

SEQ ID NO: 124336 - RNA, 64 nt, Human
gaucuggguuuggggugauggcuugucgggggugggaggggaaggugggcagagacugauguau

SEQ ID NO: 124337 - RNA, 64 nt, Human
gacucuucugcuuugacaaagaaaaugacauuggggaggggaggugcuccgccucccagcuuuu

SEQ ID NO: 124338 - RNA, 64 nt, Human
acccugcuguaguuggggagcaggaguaccuuugggaggggaggacuuuauuuaaacagugguu

SEQ ID NO: 124339 - RNA, 64 nt, Human
ugaugcugacaccagcggccuggagucgugggaaggaggggagccuuaccaagacuccugcaaa

SEQ ID NO: 124340 - RNA, 64 nt, Human
cgggcuccagccaucucaugaggggagaggagacggaggggaguagagaaguuacacagaaaug

SEQ ID NO: 124341 - RNA, 64 nt, Human
ggcuuggcccuaagaauguuuugcacugacagugggaggggauaagguggcagaaggaaccuga

SEQ ID NO: 124342 - RNA, 64 nt, Human
aguaagcagaacuaagcagucuuggagggcaaggggaggggaauggugagauccgagcccugug

SEQ ID NO: 124343 - RNA, 64 nt, Human
auccauaccagcucgcaccccccuguucuaagggggaggggaagucccugggaggccccuucuc

SEQ ID NO: 124344 - RNA, 64 nt, Human
uggcuuugcaccaaauccuccaccccuccaauugggaggggacuguucaccaccuugugguaag

SEQ ID NO: 124345 - RNA, 64 nt, Human
gggcaaucugcccacccucacccagucgcacccuggaggggacaucagccccagcuggacuugg

SEQ ID NO: 124346 - RNA, 64 nt, Human
agaggaggaaaggaugggggcugaagagcagaagggaggggagacagaggggauuaaagagggg

SEQ ID NO: 124347 - RNA, 64 nt, Human
gauucccuccauuaaaacaaccaagacaaagaaaggaggggaaaaaaagauaaaaagcaagcca

SEQ ID NO: 124348 - RNA, 64 nt, Human
ggccucgagaaggugagaggaaggcaaaggccagggaggggacccagagaggccuggcacacaa

SEQ ID NO: 124349 - RNA, 64 nt, Human
ggagaacaacaaggacaacuuuauguagagaaaaggaggggacgggacagacgaaggcaaccau

SEQ ID NO: 124350 - RNA, 64 nt, Human
cgcugccgggagagcagucuucucuguaguccccggaggggacuccucggaggaaggaugaguc

SEQ ID NO: 124351 - RNA, 64 nt, Human
ugccacccagccucaugcaagucauccccgacaugaccuucacgaccgcaaugcaaggagggga

SEQ ID NO: 124352 - RNA, 64 nt, Human
gugcucugugggcuucuccaggagcagggaggguggaggggagggauggggggcacaggagcug

SEQ ID NO: 124353 - RNA, 64 nt, Human
uuccccuuucauagauaacauuucuugaaggcugggaggggaaggagggccuggcagauggcag

SEQ ID NO: 124354 - RNA, 64 nt, Human
gcguaugagaaguugggaccauagagcaagggggggaggggaguguugcagcaggcauucucuu

SEQ ID NO: 124355 - RNA, 64 nt, Human
agccucccuucaaaaagacagcgccccuagucagggaggggauggcgguccuuugauaagaccc

SEQ ID NO: 124356 - RNA, 64 nt, Human
agaccggccaggaauguuugcaugaccuaccucaggaggggaggcgaggaagaguaauauuuag

SEQ ID NO: 124357 - RNA, 64 nt, Human
gccucuggggccugaccaggcgacagguaggggcggaggggagcugagucuccgaagccuuggc

SEQ ID NO: 124358 - RNA, 64 nt, Human
uucuaauuacuuagaaccugaccagauguggcucggaggggaauccagacccgcugcugucuug

SEQ ID NO: 124359 - RNA, 64 nt, Human
ucaagccuucacagugagcugauggucucuacagggaggggagucuagggaauuuauuugguau

SEQ ID NO: 124360 - RNA, 64 nt, Human
gcuguggccucugucagggaucccugguggaaggggaggggagggaggaacccauauagucaac

SEQ ID NO: 124361 - RNA, 64 nt, Human
agcuuugccuugguggcuggggcuugauugggaaggaggggauuaccagcuuacugggugccca

SEQ ID NO: 124362 - RNA, 64 nt, Human
gucucuggauuccugucauagggaagguauaucaggaggggaagaggccuuucuagaauuuucu

SEQ ID NO: 124363 - RNA, 64 nt, Human
aaacaaaauaaaacaacaaaauuaauaaugaaauggaggggaauucuagaauuauaugcuaaau

SEQ ID NO: 124364 - RNA, 64 nt, Human
gaaagcuuuuauucacagagguuggguaguguugggaggggaguuuaauuacucagauuggccu

SEQ ID NO: 124365 - RNA, 64 nt, Human
agccauggcuuaggacuccaacagccacucugagggaggggagaagggagcagaggccacgcag

SEQ ID NO: 124366 - RNA, 64 nt, Human
gggacgcaccacacagaacugugauuguggaucaggaggggaaugucaggauucgcaaaaugga

SEQ ID NO: 124367 - RNA, 64 nt, Human
cauccccgacaugaccuucacgaccgcaaugcaaggaggggaagaaagucacagcacugaugag

SEQ ID NO: 124368 - RNA, 64 nt, Human
gaacuguccugugagcuuuaugucaggagacugugaccuucauguccagcuucaaagaguugug

SEQ ID NO: 124369 - RNA, 64 nt, Human
gggugggggugcccgauucgggugcugaauguaaggaggggagccuccaaguguggugcaagcc

SEQ ID NO: 124370 - RNA, 64 nt, Human
ucuuuuguuaacuuaaaugaagaaaggaguggagggaggggaucuaaaacccccccguuuagau

SEQ ID NO: 124371 - RNA, 64 nt, Human
guaucuucauaaucuuuagucaucgaaucccaguggaggggacccuuuuacuugcccugaacau

SEQ ID NO: 124372 - RNA, 64 nt, Human
accucaauguagguacauuacacucuuguugcggggaggggauuuaccagaauacaguuuauuu

SEQ ID NO: 124373 - RNA, 64 nt, Human
acacgggcgccuucccgggggagugggaggagagggaggggagggauuuuuuauguucuucugu

SEQ ID NO: 124374 - RNA, 64 nt, Human
ccaguuaaccaagucagcccaacaggcaggugccggaggggaggacagggaacaguauuuccac

SEQ ID NO: 124375 - RNA, 64 nt, Human
cuaaaggccagagaaaaaucacagcuuccuugucggaggggaaaaggacaggugaucuggggaa

SEQ ID NO: 124376 - RNA, 55 nt, Human
guaaccaugagaacauguaaaaaauggaggggaaaaaggccacagcaaucuguac

SEQ ID NO: 124377 - RNA, 64 nt, Human
uuuucuaccaguaaaagacauagaccaauggggaggaggggaggagagauggauauuucagccc

SEQ ID NO: 124378 - RNA, 64 nt, Human
uguguguuuuuucuuuuuuuuuaaguucuuaugaggaggggaggguaaauaaaccacugugcgu

SEQ ID NO: 124379 - RNA, 64 nt, Human
uuauucucugcuauauauaaaacggugcugugagggaggggaaaagcauuuuucaauauauuga

SEQ ID NO: 124380 - RNA, 64 nt, Human
aguuaauauauagaaggguaccuugaacacugggggaggggacauugaacaaguuguuucauug

SEQ ID NO: 124381 - RNA, 64 nt, Human
aagauuucuuagucaguuuuuaggggauuuucggggaggggaaauagguaauguauggagcauu

SEQ ID NO: 124382 - RNA, 64 nt, Human
aaauaaucugacacuaccuuaucaggcaaauuggggaggggaggguguaucuagcucuaguuca

SEQ ID NO: 124383 - RNA, 64 nt, Human
acaaagacaaauaaacagcggaaguuaucaguauggaggggaaguguaaacuuaaagggaccag

SEQ ID NO: 124384 - RNA, 64 nt, Human
cagcccuacuuugcggauggacauauuaaggccaggaggggagggacuugccccaggucgcaug

SEQ ID NO: 124385 - RNA, 55 nt, Human
guggaaaggacaaaacuugaaaaaagaccuucagcagucaacugaauuagaguug

SEQ ID NO: 124386 - RNA, 64 nt, Human
accugccucucugagggaucuaaacaacugggagggaggggaccgcucccccuuucucuguggg

SEQ ID NO: 124387 - RNA, 64 nt, Human
cuugcuagacaaacauaaaggggcaggguuguggggaggggaacguuuuugguggugugugcag

SEQ ID NO: 124388 - RNA, 64 nt, Human
uaucaguagguccugggacuugacaaaguaugugggaggggaaggaaggacagaacuugacugg

SEQ ID NO: 124389 - RNA, 64 nt, Human
uuaucuuguuaccuauaguuuacuuugggugauuggaggggaaugacuuaguuaugacuggaca

SEQ ID NO: 124390 - RNA, 64 nt, Human
caggacacuggugcgaaugacacaacucaaguugggaggggaacagggaaggaagggauggaug

SEQ ID NO: 124391 - RNA, 64 nt, Human
gcugcugcugacuagggcugcaugggagagccagggaggggaguuucuggaagaggaaagccau

SEQ ID NO: 124392 - RNA, 64 nt, Human
gcccuagccauuggugcacaggaugggggcaaugggaggggaugcuacugaugggaaugauuaa

SEQ ID NO: 124393 - RNA, 64 nt, Human
gcucugcuuccuuucaaugugucagugccuggggggaggggaggagcacccccucagccccccu

SEQ ID NO: 124394 - RNA, 64 nt, Human
ugaacaaacaagcugcccccaggguaccauuuggggaggggaaaucuuuucuuucuuucccccu

SEQ ID NO: 124395 - RNA, 64 nt, Human
gaucagggaugugaggcugcuguuggggguggggggaggggaaugggcaggcaagccagucuuc

SEQ ID NO: 124396 - RNA, 64 nt, Human
auuugauacaacuuggacaauaccuaguuuggagggaggggaauggaagggcauggaaguuuuu

SEQ ID NO: 124397 - RNA, 64 nt, Human
gcaccucccagccugccuuucggagcagcacccaggaggggaugccgcgcuccagcaacaccag

SEQ ID NO: 124398 - RNA, 64 nt, Human
uuuacuacucuuagaggacacaugccuuaaaaaaggaggggaggaaccacgcugccaccaaagc

SEQ ID NO: 124399 - RNA, 64 nt, Human
aucgcgcagggcaucaugucaccaugucagguccggaggggagguauuaagaauagauacgaua

SEQ ID NO: 124400 - RNA, 64 nt, Human
ggacugucuggucuguagcuaaaggaaaaaguuaggaggggaauauuuauuuaaaucuaucagu

SEQ ID NO: 124401 - RNA, 64 nt, Human
ggcuggagguggcauccacacuggacagcagggaggaggggagugaggguaacauuuccauuuc

SEQ ID NO: 124402 - RNA, 64 nt, Human
agcaaaguggccgccggggaacgggugguccgaagaccuucauaccuagaccuguuccgcacac

SEQ ID NO: 124403 - RNA, 64 nt, Human
auagcgcuucucaaugugugucacccggaaccugggaggggagggaacacugggguuuaggacc

SEQ ID NO: 124404 - RNA, 64 nt, Human
cuggucccucagcuggggggcagugcuguccaguggaggggagggcuuucacgcccacccaccc

SEQ ID NO: 124405 - RNA, 64 nt, Human
gguguuguuuugugcaauauacagccccagguagggaggggagaguaugaggagggugacuggc

SEQ ID NO: 124406 - RNA, 64 nt, Human
cagucuuucaugauccaugccggcgguuggguggggaggggaaucauugguugggggaagggag

SEQ ID NO: 124407 - RNA, 64 nt, Human
cugcuggggagcuccugucucugggcugccggugggaggggaugucgccuccccagagaugccu

SEQ ID NO: 124408 - RNA, 64 nt, Human
ugguuuuguuuuauuuugcuucuuggucaagaaaggaggggagaacccagcgcaccccuccccc

SEQ ID NO: 124409 - RNA, 64 nt, Human
acauaucuuguuaacuuuuacggugacuuuuggaggaggggaguuuggaaauuguaaaauguua

SEQ ID NO: 124410 - RNA, 64 nt, Human
gguuuggcuugcuggguuguggguggacacgcaaggaggggauuuuuauuuggccagcagucuc

SEQ ID NO: 124411 - RNA, 64 nt, Human
cacauggaggagcuugggggaugacuagaggcagggaggggacuauuuaugaaggcaaaaaaau

SEQ ID NO: 124412 - RNA, 64 nt, Human
gcugacagaggcaggaugggugcaaggcagggguggaggggagggaccagcccgggcugcacca

SEQ ID NO: 124413 - RNA, 64 nt, Human
ugcucaucauugcucagcuccucagagugggccgggaggggacuagaagagcugcaugauggug

SEQ ID NO: 124414 - RNA, 63 nt, Human
gggcuccuggcaaggccugaccccaugguggggggaggggaggggaggggagggaaugaggca

SEQ ID NO: 124415 - RNA, 64 nt, Human
uccuggcaaggccugaccccaugguggggggaggggaggggaggggagggaaugaggcagcucu

SEQ ID NO: 124416 - RNA, 64 nt, Human
gcaaggccugaccccaugguggggggaggggaggggaggggagggaaugaggcagcucuaggau

SEQ ID NO: 124417 - RNA, 64 nt, Human
cccauuuuggccuccccugccccccuuguuauggggaggggaccccgggugagggggcccuauu

SEQ ID NO: 124418 - RNA, 64 nt, Human
uaggauggaugggguuugggguggguaggccaugggaggggagaagccccuccuuggcaccccc

SEQ ID NO: 124419 - RNA, 64 nt, Human
aaacagacccugaguuaauuggguugaaaauuuggaccuucacugacuuaugcagggcguauau

SEQ ID NO: 124420 - RNA, 64 nt, Human
ccacauaugauagacagccccucuguugagauauggaggggacagauacuggaaucgggggugg

SEQ ID NO: 124421 - RNA, 64 nt, Human
cuugcuccccuguccuaugaaagagaauaguuuuggaggggagaagugggacaaaaaagaugca

SEQ ID NO: 124422 - RNA, 64 nt, Human
ggcccaucaaggaagugggucuggugggaaacggggaggggaaagaagggcuucugccauuaua

SEQ ID NO: 124423 - RNA, 64 nt, Human
ggcagguccuccccucucuugucagaugcccgagggaggggaagcuucugucuccagcuucccg

SEQ ID NO: 124424 - RNA, 64 nt, Human
cuuccgcuccugcccagccugggggaaggagaaaggaggggagaaagcgggcucucacccccuc

SEQ ID NO: 124425 - RNA, 64 nt, Human
auucaccgggcccugugugugucaccgaggugcgggaggggaggagcauuaaagcugaaagauc

SEQ ID NO: 124426 - RNA, 64 nt, Human
caaggcccagggaagaguguauuuggggagcaggggaggggaggguguugagaaagcugaacug

SEQ ID NO: 124427 - RNA, 64 nt, Human
ugaaauuugggggcaggggaaggggaggcgggagggaggggaagcucgcaagcccggggagaga

SEQ ID NO: 124428 - RNA, 64 nt, Human
ucacuggggguguaugggguagauggguggagagggaggggauaagagaggugcauguugguau

SEQ ID NO: 124429 - RNA, 64 nt, Human
uuuuucuauagucauugauggaguagaucaugauggaggggaaaucacuggagaucaaauaugu

SEQ ID NO: 124430 - RNA, 64 nt, Human
ucaaaguggaugcaauuuuucuuucuuuuguuggggaggggaaugggaggggaaaugggaauau

SEQ ID NO: 124431 - RNA, 64 nt, Human
gcaauuuuucuuucuuuuguuggggaggggaaugggaggggaaaugggaauauaauauugucuc

SEQ ID NO: 124432 - RNA, 64 nt, Human
gcugucauauuugcucuagaagaaaaaaaaaaaaggaggggaaaugcauuuuccccagagauaa

SEQ ID NO: 124433 - RNA, 64 nt, Human
ucuacuuauuaaaacaaauaauuucccuuggguuggaggggaagugauuucauaaauuaauuag

SEQ ID NO: 124434 - RNA, 64 nt, Human
ugugugcguucugagcguguuggccaguggcuguggaggggaccaccugccacccacggucacc

SEQ ID NO: 124435 - RNA, 64 nt, Human
guuggagaaggaauggacgaauucuugagcaaaaggaggggaagagacaaucuccagccacccg

SEQ ID NO: 124436 - RNA, 64 nt, Human
ucccugagacugagggguuuacgggcugugaauggaccuucagcccugcccacccucccucccc

SEQ ID NO: 124437 - RNA, 64 nt, Human
augcucugucaucucccuacugggucuccugggaggaggggagccauccagggugcaaacucaa

SEQ ID NO: 124438 - RNA, 64 nt, Human
gaggugccugcccuucuaggaaugggggacagggggaggggaggagcuagggaaagaaaaccug

SEQ ID NO: 124439 - RNA, 64 nt, Human
uaggcaguaguugggagagagccucaauauugggggaggggagaguguagggaaaaggauccac

SEQ ID NO: 124440 - RNA, 64 nt, Human
ugccagcgaucucgcagcacuguguuuacaggggggaggggagggguucguacgggagcaauaa

SEQ ID NO: 124441 - RNA, 64 nt, Human
ccuggggaguuggggaaaggaacgaacccuggcuggaggggauaggagggcuuuuaauuuauuu

SEQ ID NO: 124442 - RNA, 64 nt, Human
ucccccucaucuccagugacucagccuacacaagggaggggaacauuccauccccaguggaguc

SEQ ID NO: 124443 - RNA, 64 nt, Human
guucaccagggggaacuggcaaaaguguguguggggaggggaagggugugugagugguucugag

SEQ ID NO: 124444 - RNA, 64 nt, Human
gcugcugggagcaacuagugacuuugauucccauggaggggacuguguuucuuuaaggaugcug

SEQ ID NO: 124445 - RNA, 64 nt, Human
uuuguuuuuuuuguuguuguuuuuuuuuugcgggggaggggaugguacagacuaaacgugggga

SEQ ID NO: 124446 - RNA, 64 nt, Human
ugcaauucuaaacugcagugacugggaugggaggggaggggagcaguguugaugccaaaauacc

SEQ ID NO: 124447 - RNA, 64 nt, Human
uggcaugcaauucuaaacugcagugacugggaugggaggggaggggagcaguguugaugccaaa

SEQ ID NO: 124448 - RNA, 64 nt, Human
uaucuugcaauuuuucugucugauuuuuacaaugggaggggagcuaagauugcaguccuguccu

SEQ ID NO: 124449 - RNA, 64 nt, Human
ggcucacaggaaagaaccugcaggaucaggggugggaggggaggccccugaggugcucuccagg

SEQ ID NO: 124450 - RNA, 64 nt, Human
cgcuccugugguuuuucugagcgugcgggcgccgggaggggaugcugaggcugauggagcugcc

SEQ ID NO: 124451 - RNA, 64 nt, Human
gaccaaaaagggggaauaugggagggcagaguggggaggggaguccaugggccuggggccccaa

SEQ ID NO: 124452 - RNA, 64 nt, Human
aaucaaaagggguucaaaccccaccucaguagguggaggggagcgccugccauugguuguauuu

SEQ ID NO: 124453 - RNA, 64 nt, Human
guucugggaagaggacggucuuuuuuucucuucagaccuucaccugacuggaucaagcccacua

SEQ ID NO: 124454 - RNA, 64 nt, Human
uccacguagggggcaggggcaggggcgggcggagggaggggaggggugaaauccauacuguaga

SEQ ID NO: 124455 - RNA, 64 nt, Human
accccuggccacagccuucccucugcauugaccuggaggggagaggucagccuugaccuaauga

SEQ ID NO: 124456 - RNA, 64 nt, Human
auggccaggggccaggaguggggagaguugugauggaggggagaggggucacacccacccccug

SEQ ID NO: 124457 - RNA, 64 nt, Human
ggcaagaacugggggaacacaggaaccuaggggaggaggggagcgcugggcauccucaggcugg

SEQ ID NO: 124458 - RNA, 64 nt, Human
ugcagguggaauuaggguuagggaucuaaggaugggaggggaacuugguuuaucugggugggcu

SEQ ID NO: 124459 - RNA, 64 nt, Human
agccacucugucccuuccugggcaaagaagaaacggaggggauggaauucuuccuuagacuuac

SEQ ID NO: 124460 - RNA, 64 nt, Human
ugcuguuuucuguuuuccguguucguaacagaagggaggggaaagcgcagcuacugacaaguag

SEQ ID NO: 124461 - RNA, 64 nt, Human
aaggacacuaaugagccugggaggguggcagggaggaggggacagcuucacccuuggaaguccu

SEQ ID NO: 124462 - RNA, 64 nt, Human
uacgaguucccauaggggcugcucccucaaaaagggaggggacagauggggagcuuuucuuacc

SEQ ID NO: 124463 - RNA, 64 nt, Human
cucccccuagccagccaggcagcuucucugccugggaggggagccuggaccccccucuuucucc

SEQ ID NO: 124464 - RNA, 50 nt, Human
aauuuggcuacagccgcuaaggaggggaucggguuuggcccccagccccg

SEQ ID NO: 124465 - RNA, 64 nt, Human
cuucccuuuguuauucagugugaccaggauggcgggaggggaucugugucacuguagguacugu

SEQ ID NO: 124466 - RNA, 64 nt, Human
cuucacuggagagaaagaacuggaauuucgcucuggaggggauguggaccacaguacucuaguc

SEQ ID NO: 124467 - RNA, 64 nt, Human
gugggagcagagugacccuuugcugaugcuggggggaggggaucuaaauccucauuuaucucuu

SEQ ID NO: 124468 - RNA, 64 nt, Human
aggaccacggacauuggacucacuguggcuggacggaggggacccguggaugggggggcucugg

SEQ ID NO: 124469 - RNA, 64 nt, Human
gcaagcccuuggggcagaugcagaagcagaagagggaggggaaaccugccucugggucacccug

SEQ ID NO: 124470 - RNA, 64 nt, Human
cuugugaaaccucagcgugaagggacauaucacugaccuucauaaccacuccacaaccaugaau

SEQ ID NO: 124471 - RNA, 64 nt, Human
cugugcugggcaggcucucguggggcaggagaugggaggggagagaccagcucuccagccuggc

SEQ ID NO: 124472 - RNA, 64 nt, Human
gcuggccagucagggagggcuagggggcagguggggaggggaagccauggaaauacaagucaaa

SEQ ID NO: 124473 - RNA, 64 nt, Human
cuucuuuggggcaggggugaggcagguugaggggggaggggacugggacuggcggugagguuuu

SEQ ID NO: 124474 - RNA, 64 nt, Human
ccggcccagaggggcuucuguccuguguguugugggaggggaugggaggcgccccucgagugug

SEQ ID NO: 124475 - RNA, 64 nt, Human
aaugguuucaaauaugcuaagaaauugacucugcggaggggaucuuaaaaugccuguuuacuca

SEQ ID NO: 124476 - RNA, 64 nt, Human
gguugaccgcuuguuucuuguuauuaccaaaacaggaggggaaaaaauuaacugcuccaaauuu

SEQ ID NO: 124477 - RNA, 64 nt, Human
uggagagacaggauuuggggguucugccauaauaggaggggaaaaucaccccccagccaccucg

SEQ ID NO: 124478 - RNA, 64 nt, Human
gcccucugcugccucccguacccggccugcggagggaggggacagcuggacccgcaggggaggu

SEQ ID NO: 124479 - RNA, 64 nt, Human
ggguucagauuugaaagggggugguaugggugggggaggggaauugccaacaaaagaacacuga

SEQ ID NO: 124480 - RNA, 64 nt, Human
acuacggguucuccagcuccuuuccaggcagagaggaggggagguccugaggggacugcugccc

SEQ ID NO: 124481 - RNA, 64 nt, Human
cuguacugaggacagcgguggaggccgaggugguggaggggaugcaccccaguguccacuuuug

SEQ ID NO: 124482 - RNA, 64 nt, Human
uuaaaaagauggcuguggccugcccggcguggugggaggggagcugguuuccuggugaacuuuc

SEQ ID NO: 124483 - RNA, 64 nt, Human
uuucuuucaaaucugaguguugccugcugaacucggaggggaguuuggagaaauuuuagacagc

SEQ ID NO: 124484 - RNA, 64 nt, Human
aaaauuuuuaucccagaggggugggggggaggggggaggggaagccagaguccacuuuugucac

SEQ ID NO: 124485 - RNA, 64 nt, Human
agugcugagccagccgugcaaaaggaaaucuucaggaggggacuucucacguugcucagacuga

SEQ ID NO: 124486 - RNA, 55 nt, Human
accaguacccuuacauauaaacacuggaggggagggagggagggagggagggaga

SEQ ID NO: 124487 - RNA, 64 nt, Human
auuucuuaacauuguguucuaugauuauuuguaagaccuucaccaaguucugauaucuuuuaaa

SEQ ID NO: 124488 - RNA, 64 nt, Human
aaagagagauuuguggaaaaauccaguuacggguggaggggaaucgguucaucaauuuucacuu

SEQ ID NO: 124489 - RNA, 64 nt, Human
ggagacaaccagaucaggagagcaaggucaugaaggaggggaccucuccacacagguguuccgu

SEQ ID NO: 124490 - RNA, 64 nt, Human
cccuucuuaauccaaggacugggcugggguggcgggaggggagccagauccccgagggaggacc

SEQ ID NO: 124491 - RNA, 64 nt, Human
ccugcuaaugagaaccuuggugcagcugcagccaggaggggagcgggcccaggagccaggcuca

SEQ ID NO: 124492 - RNA, 64 nt, Human
gagcaguggcugauggggacacugagauaagaucggaggggagcugucaaugccagaagugguu

SEQ ID NO: 124493 - RNA, 64 nt, Human
ggcggugguggggaggaggggugcgccauggccuggaggggaguguguguuggggugugugugu

SEQ ID NO: 124494 - RNA, 64 nt, Human
cugagaccucucggugcaccuggugacccuggguggaggggacuugcugugaagucuuccucgc

SEQ ID NO: 124495 - RNA, 64 nt, Human
cugguuuccugucacucagagcugauucacaggaggaggggagguuggggggcgggagacaaaa

SEQ ID NO: 124496 - RNA, 64 nt, Human
uaugggcccucugcuccccaaugccuuagagagaggaggggacggcacggccgcucaccggaag

SEQ ID NO: 124497 - RNA, 64 nt, Human
caaggucucuguauuuuucuuucaguugucuuugggaggggauguuaagucaaaucacuaaaac

SEQ ID NO: 124498 - RNA, 64 nt, Human
ugaaaggcagcucuagacaucaaccaguccugggggaggggagugggaaccgggcacaacuagg

SEQ ID NO: 124499 - RNA, 64 nt, Human
cccaucacagaagguggacagggccuacccagguggaggggaccacccugcgaucagguguuug

SEQ ID NO: 124500 - RNA, 64 nt, Human
agggccugagcuggacaggggagcuccuaguaggggaggggaggggaugcugggaucuagguga

SEQ ID NO: 124501 - RNA, 64 nt, Human
cugagcuggacaggggagcuccuaguaggggaggggaggggaugcugggaucuaggugacaugc

SEQ ID NO: 124502 - RNA, 64 nt, Human
cagcccagugaccuuucuccugcugcacuuggagggaggggacauacacacagucucccaucuc

SEQ ID NO: 124503 - RNA, 64 nt, Human
ccccccuugacacucucgcuggugaagccaagcgggaggggagcugcgcccucccugaccuccc

SEQ ID NO: 124504 - RNA, 64 nt, Human
ccacugggcucucccucccccagccuggagcacgggaggggaggugacggcuggugacugaugg

SEQ ID NO: 124505 - RNA, 64 nt, Human
caacuugauagcuaaugcaccuuuucugugaggaggaggggaucgugauuucagaaugaauuau

SEQ ID NO: 124506 - RNA, 64 nt, Human
cccacaugccugcgccugcugccugcugagaugaggaggggagcgucugggaacuugcgagucc

SEQ ID NO: 124507 - RNA, 64 nt, Human
ucagggcugucccagccccggcaagccacaggaaggaggggagagacaggcagcccagcagugu

SEQ ID NO: 124508 - RNA, 64 nt, Human
guggguccuuuggcaggccucccuuuggggagagggaggggagagaccacagccgggugugugu

SEQ ID NO: 124509 - RNA, 64 nt, Human
cgcacauucagauuguuguguccauggaguuuuaggaggggauggccuuuccggucuucgcacu

SEQ ID NO: 124510 - RNA, 64 nt, Human
gaaagccccacggugggucagaaggcggaaggagggaggggaacgugugggcaagagacuuccu

SEQ ID NO: 124511 - RNA, 64 nt, Human
caucucaucgaggugugguaaagccauuggaugaggaggggacugccauggaaaggagaguuug

SEQ ID NO: 124512 - RNA, 64 nt, Human
ucccaagacaacccccagcuucagguccucauggggaggggagggcacguucuugacacauggg

SEQ ID NO: 124513 - RNA, 64 nt, Human
gaaaacacuggcucauguuuucuuuccaugugagggaggggagguuucuagaugauacuaaaag

SEQ ID NO: 124514 - RNA, 64 nt, Human
gaggccgagccccaggccacugucacucuuugugggaggggacggggagugagguugggcagug

SEQ ID NO: 124515 - RNA, 64 nt, Human
gcagccuuugucucuucccucuuguggggagcaaggaggggaugagcgguaccuugggagaccc

SEQ ID NO: 124516 - RNA, 64 nt, Human
uuaaauacguuugauuucugaaaagccuacaaauggaggggaaaugagauugugcuaauguuga

SEQ ID NO: 124517 - RNA, 64 nt, Human
auuaagguguuguauaaauaauauucuuuuggggggaggggaacuauauugaauuuuauauuuc

SEQ ID NO: 124518 - RNA, 64 nt, Human
aucggagcuuuuuaaagaacugauguagaaugagggaggggaaaguuuaaaaucccagcugggc

SEQ ID NO: 124519 - RNA, 64 nt, Human
uuuccuuaugugucuuacaggcuuugauagaaggggaggggaggagagaugcauacccguuucu

SEQ ID NO: 124520 - RNA, 57 nt, Human
gggauaacauggcuggaugaaagaaaugaccuucauucugagaccaaaguagauuua

SEQ ID NO: 124521 - RNA, 64 nt, Human
cauugagcgacuuugaggaauccggcugagugggggaggggaagcaagaagggaugggggucaa

SEQ ID NO: 124522 - RNA, 64 nt, Human
cgaaacuucagagauaagucauggagaggacauuggaggggagaaaugcaguugcugacuggga

SEQ ID NO: 124523 - RNA, 64 nt, Human
ucauguuucccuguuucaaagggauccuggggaaggaggggaacaugcuugcaguaucucuccc

SEQ ID NO: 124524 - RNA, 64 nt, Human
uggggaugaggguggggggggacccccaggucccggaggggaagugaagcaacagcccagcugg

SEQ ID NO: 124525 - RNA, 64 nt, Human
ugccccuguacugcccugccaucucaggccaaagggaggggagcaaguggggaccuggccaugg

SEQ ID NO: 124526 - RNA, 64 nt, Human
uauuugauaccccucccccccuuuuuuuggcaaaggaggggaaaggaagguuuaaaauaauuga

SEQ ID NO: 124527 - RNA, 64 nt, Human
agaguucuugccugugugucuguauuuuggguaaggaggggaggucugaaaaagacuuuggggc

SEQ ID NO: 124528 - RNA, 64 nt, Human
gaagcccauucuuucauguuaaauacuuggggugggaggggagaaagggaaccuuuucuuaaaa

SEQ ID NO: 124529 - RNA, 64 nt, Human
auuauuuuuucuuuguuuuucuuuuuuugggggaggaggggaaaaaagcagcaauacuguguuu

SEQ ID NO: 124530 - RNA, 64 nt, Human
ucuagucauaagggguuccuuauaaggagcaggcggaggggaguacacuuucaugugauuuaau

SEQ ID NO: 124531 - RNA, 64 nt, Human
cacagagcucugaggggcaggaaagcagcauucuggaggggagagcuuugugcuugucauucca

SEQ ID NO: 124532 - RNA, 64 nt, Human
auguaucugcugaaauguauuuuauuuucaagguggaggggaaaaucgucuguuuccuaaaucc

SEQ ID NO: 124533 - RNA, 64 nt, Human
ugaagggaccauccagacccucccuucuugcuggggaggggacgaguucuacccaccuccccac

SEQ ID NO: 124534 - RNA, 64 nt, Human
ugcccaaguucacugggcuccacccccaccuccaggaggggaggagaggaccugacaucuguag

SEQ ID NO: 124535 - RNA, 64 nt, Human
cucucccugggccgggguggccugggugccaggaggaggggagcauaccccacacccucccugc

SEQ ID NO: 124536 - RNA, 64 nt, Human
gugaggcaugucuuuccagaacuuucccuggcagggaggggauggcagaaacucagggaggggc

SEQ ID NO: 124537 - RNA, 64 nt, Human
agaaaucaaggggacccccgccuccuugggcuggggaggggauuucaagauaguucaugacucu

SEQ ID NO: 124538 - RNA, 64 nt, Human
ggcucuccuggagguccucgaguggcaggggugaggaggggauuaucugaggcaucuggagaug

SEQ ID NO: 124539 - RNA, 64 nt, Human
gcccagccagcccgugacagcuucccccuaaucaggaggggacagcugggggcgcaagcuggug

SEQ ID NO: 124540 - RNA, 64 nt, Human
ggaccugcagccaucugugaggcccgcggggaugggaggggaggaggguggccuguugguuucc

SEQ ID NO: 124541 - RNA, 64 nt, Human
cuucaggcccagugugagccugcucugcaagaagggaggggacagcuggcuucagccaggcucg

SEQ ID NO: 124542 - RNA, 64 nt, Human
ucuuuuuuuuuucuuuuuuccuuuuuuuuuaaguggaggggaaaagaagagauaaacaaggaau

SEQ ID NO: 124543 - RNA, 64 nt, Human
auuaaguaaaauuuuacaucuuguaaagugguggggaggggaaacagaaauaaaauuuuugcac

SEQ ID NO: 124544 - RNA, 64 nt, Human
agcaaagcauucaucccuuuccauauaacaggagggaggggaagaaggaaguuuccaugugcag

SEQ ID NO: 124545 - RNA, 64 nt, Human
uguauacagcugcuucugcuauugcugguuugggggaggggacuggaaagcugagacugaaaau

SEQ ID NO: 124546 - RNA, 64 nt, Human
cucuucucuccucuccuuuccauucucucuauggggaggggagcaggcaggaggagcagaaauu

SEQ ID NO: 124547 - RNA, 64 nt, Human
ccaaccccagacagaagccaaucacaucuuugggggaggggaggggcaggaagaggugagaaga

SEQ ID NO: 124548 - RNA, 64 nt, Human
ucaaagcuaaagagauauacauucuggauacuugggaggggaauaaauuaaaguuuucacacug

SEQ ID NO: 124549 - RNA, 64 nt, Human
aguaagagcaugcuuacacccuacugugaaaaggggaggggaugugguaagcggaaacagaaga

SEQ ID NO: 124550 - RNA, 64 nt, Human
ugcaggucugcggaggggaaguguccugagugaaggaggggacccccauccugggggaugcugg

SEQ ID NO: 124551 - RNA, 64 nt, Human
ugaaaugagaaaggcccagaacgugcaggucugcggaggggaaguguccugagugaaggagggg

SEQ ID NO: 124552 - RNA, 64 nt, Human
ucuggcagccccuggggacugggcgcugccccugggaggggagagccuggccagggcugguguu

SEQ ID NO: 124553 - RNA, 64 nt, Human
gccgcccugauccgugagguaugaguaugacucugaccuucagcccucccuacagccgggggug

SEQ ID NO: 124554 - RNA, 64 nt, Human
cuuggggagcugccuagcagccucuccucgggcaggaggggagguggcuuccuccaaaggacac

SEQ ID NO: 124555 - RNA, 64 nt, Human
cacaguaacgcggcaugggaacagugagacagggggaggggaggcgcaguuacaaaggcagggc

SEQ ID NO: 124556 - RNA, 64 nt, Human
ggcuagggccugauucgggaagaugccuuugcagggaggggaggauaagugggaucuaccaauu

SEQ ID NO: 124557 - RNA, 64 nt, Human
agcagaugcugucccaggaagggcuagggacaucggaggggaccugcccccacacccucugcuc

SEQ ID NO: 124558 - RNA, 64 nt, Human
ggagggagguaacgggugccugcugcggcagacgggaggggaaaggcugccgaggacccucccc

SEQ ID NO: 124559 - RNA, 64 nt, Human
aauauaaggaaauggcccaaugaacgugguugugggaggggaaagaggaaacagagcuagucag

SEQ ID NO: 124560 - RNA, 64 nt, Human
ggccuggggguagugucaaugccccuccagggcuggaggggaagaggggccccgaggaugggcc

SEQ ID NO: 124561 - RNA, 64 nt, Human
augccacaagaucacucugauuugagaaaagggaggaggggaagauagucugaauggaaaucug

SEQ ID NO: 124562 - RNA, 64 nt, Human
ugagagaaaagggugggagggugagagaggggagggaggggaauaaggugugggcaguagaggg

SEQ ID NO: 124563 - RNA, 64 nt, Human
acugcccucgggcgucuggcagccugagguggguggaggggacaguguucuggauagaucuauu

SEQ ID NO: 124564 - RNA, 64 nt, Human
cagugaggugugcaagggugcacugaggguggugggaggggaucaccuggguuccaggccaucc

SEQ ID NO: 124565 - RNA, 64 nt, Human
gggaaauggaucagucuuugagguuucuauuuggggaggggaguacuuaagaugagucaaaaga

SEQ ID NO: 124566 - RNA, 64 nt, Human
uucucuuucuuccccagggaauucucuagcagagggaggggacccaccccagugaggaaguaga

SEQ ID NO: 124567 - RNA, 64 nt, Human
gauucaaggcagugaggucaggccgcaugaaccuggaggggaaucggggacuucaugcgaaacu

SEQ ID NO: 124568 - RNA, 64 nt, Human
uccuccccacccuccuggccucagacugcacccaggaggggaacacugcccucgcacggccccg

SEQ ID NO: 124569 - RNA, 64 nt, Human
uuuccguuaguugaauaagagguauuaugaucauggaggggacauuuauggugcuuuggauugu

SEQ ID NO: 124570 - RNA, 64 nt, Human
cuuuuauauaauagaugcuaugaaaaccuuuuaugaccuucaucaacucaauccuaaggauaua

SEQ ID NO: 124571 - RNA, 64 nt, Human
cagggagggggcagaggcaaaucaccgggcagagggaggggaggagaggaggccgcacucuccc

SEQ ID NO: 124572 - RNA, 64 nt, Human
acuauuccggcuuuuuauauggcaccuuucugagggaggggauuuuacagccgagggaccucca

SEQ ID NO: 124573 - RNA, 64 nt, Human
cugccuguuuuuacuuagaaagcaggcuugggcaggaggggaaauggauuugaaccaucucaga

SEQ ID NO: 124574 - RNA, 64 nt, Human
gugaaggauagugauucuugagagggcaaacucaggaggggagcccugugauuguccagcucau

SEQ ID NO: 124575 - RNA, 64 nt, Human
ugugaggccccccggggaccggcaguguguccagggaggggauggcccugagcccagcggcucc

SEQ ID NO: 124576 - RNA, 64 nt, Human
ugacuuuuuaaugcuuuacaacuucaggcuaaagggaggggauguugggaggagaaaccaucac

SEQ ID NO: 124577 - RNA, 52 nt, Human
ugccauugucccaggucugagcggaggggagggggcgcccaggagggguggg

SEQ ID NO: 124578 - RNA, 64 nt, Human
uaaauaacagggcagggcccugcuuuggggagggggaggggagaguaucaugggagaugguauc

SEQ ID NO: 124579 - RNA, 64 nt, Human
uaauuagaggguuauccuuuuguugugaaaggaaggaggggacugaaaucucccaaagugcaaa

SEQ ID NO: 124580 - RNA, 64 nt, Human
agggucagacgcagccgcucagcacaggagggguggaggggaaaugagaguugcugguagcagg

SEQ ID NO: 124581 - RNA, 64 nt, Human
cuuccuuugagccugaggcccuugguaaccucguggaggggauggauuuccauaaguuuuacuu

SEQ ID NO: 124582 - RNA, 64 nt, Human
ccgggagggcgagcgagggagaggagggagagggggaggggaggaguccagggagaggcgggau

SEQ ID NO: 124583 - RNA, 64 nt, Human
gguuuuacaauucuuuccuggggaaauuauuucuggaggggaaaaagauccauucuacguaucc

SEQ ID NO: 124584 - RNA, 64 nt, Human
aacauuuucaagccucaguuuuugcuuuuuuaaaggaggggaaauauuugccucaugucauaau

SEQ ID NO: 124585 - RNA, 64 nt, Human
caagccaaccugggaaucagagagagaaggagaaggaggggagccuguccguucagagccucug

SEQ ID NO: 124586 - RNA, 64 nt, Human
cauucugcuugagggagggaauagaaaggggcagggaggggacaucugagggcuucacagggcu

SEQ ID NO: 124587 - RNA, 64 nt, Human
caacucacaccuguuuaaagaguguuucugauuugaccuucaucccuuaguuuacuggcguuaa

SEQ ID NO: 124588 - RNA, 64 nt, Human
cagcuaggcccagcugccuugggcuggggccugcggaggggaagcccacccacaaugcauggag

SEQ ID NO: 124589 - RNA, 50 nt, Human
gccccgaugagggguccugaggaggggauggggcugggggaugggccuga

SEQ ID NO: 124590 - RNA, 64 nt, Human
augucaccuucacuagaaaugucccaucaucgugggaggggagcagggcacaggggauggugug

SEQ ID NO: 124591 - RNA, 64 nt, Human
uugccaguuuucccuggaacuccuggccuuuuguggaggggagggauggagagaauaggaaucu

SEQ ID NO: 124592 - RNA, 64 nt, Human
caagcagagucugggcuaccucuugacagcugguggaggggaguuggggagcuggacuggauga

SEQ ID NO: 124593 - RNA, 64 nt, Human
uuuuuuuuuauuuggggcagugggcauguuauggggaggggaggggguucuuccagccucaggu

SEQ ID NO: 124594 - RNA, 64 nt, Human
caggauuuuggggggggggaggugggagggcaagggaggggagcuucuuuuuaaaaucaagaga

SEQ ID NO: 124595 - RNA, 64 nt, Human
aguguauucugcgcguguguguggagggagggagggaggggagcauggugucucccgcuccacc

SEQ ID NO: 124596 - RNA, 64 nt, Human
guuuuuuuuuuuuuuuuuuuuuuuuugaagguggggaggggaauauacacauugcuuuuauauu

SEQ ID NO: 124597 - RNA, 64 nt, Human
auuacacuggcaauuuaauuucaagaugaguuuuggaggggacauucaaaccauagcagugcua

SEQ ID NO: 124598 - RNA, 64 nt, Human
aguggcaggaugugaguggcuaccuggcucaacuggaggggaccccuugggcccucuggggcuu

SEQ ID NO: 124599 - RNA, 64 nt, Human
agugaacacagacacugcagagccugggagcaggggaggggaauaguugagugugcuguuuggg

SEQ ID NO: 124600 - RNA, 64 nt, Human
gaagaaacacagccucaugggacagaaauuugagggaggggaacaaagaauacuuuggggggaa

SEQ ID NO: 124601 - RNA, 64 nt, Human
ggggcggggggcaccaacacuuggagauuuuuccggaggggagaggauuuucuaagggcacaga

SEQ ID NO: 124602 - RNA, 64 nt, Human
aagcugcucuuguuagcacuuugaugaggggguaggaggggaagaagacagcccuaugcugagc

SEQ ID NO: 124603 - RNA, 64 nt, Human
gcuuugugauguaaauccuuaaggaguuauacaaggaggggaaaaauuaauuuuauuugggguu

SEQ ID NO: 124604 - RNA, 64 nt, Human
cuuguguucuguuccuuucacaaaagcucucugggaccuucacuugcaauuagugguuagggaa

SEQ ID NO: 124605 - RNA, 64 nt, Human
gagaacccagaggaucuaggcccuguuggggaggggaggggagcucaagguuuggguggggacu

SEQ ID NO: 124606 - RNA, 64 nt, Human
gcauggagaacccagaggaucuaggcccuguuggggaggggaggggagcucaagguuugggugg

SEQ ID NO: 124607 - RNA, 64 nt, Human
gucuuuauagauguacauaccuccuugcacaaauggaggggaauucauuuucaucacugggagu

SEQ ID NO: 124608 - RNA, 64 nt, Human
gaaguggcaggagagaacaacaggggcugggaauggaggggagaauuucuaggggaaguuuccu

SEQ ID NO: 124609 - RNA, 64 nt, Human
ucugucccuugagggaggaaguccugggacccagggaggggaggggccuuugucuagggaaggg

SEQ ID NO: 124610 - RNA, 58 nt, Human
ugcaguuuguguuggccuaaggcuguggggaggggaggagaacugcucacuccuuuuc

SEQ ID NO: 124611 - RNA, 64 nt, Human
aggcccagucacugcuccugggacccaguccccuggaggggagguggaaaaucagugcuacggg

SEQ ID NO: 124612 - RNA, 64 nt, Human
gugggagagaguguggugggaagucuugagcggaggaggggaucugcccuucuccacuccucuc

SEQ ID NO: 124613 - RNA, 64 nt, Human
gccacucccucuccagcccccgauguggacccggggaggggaggcugaggcguuuggccccggc

SEQ ID NO: 124614 - RNA, 64 nt, Human
augcacaacgcccggccugagcccccugccauagggaggggaggacccugagggcucagccagg

SEQ ID NO: 124615 - RNA, 64 nt, Human
uaggaggaaaagacagagccuccacuuaguuuugggaggggauggcagacagucaaggagauga

SEQ ID NO: 124616 - RNA, 64 nt, Human
gcucggauccauacucggggggccucagcccuugggaggggacaccugaggcagccagcgcccc

SEQ ID NO: 124617 - RNA, 64 nt, Human
uaaaaauuuugccucccuuugugaaaggggauggggaggggaagaguaaacagauaacaggugg

SEQ ID NO: 124618 - RNA, 64 nt, Human
aagcugcuggaggagcagggguggggggugggagggaggggaaaggcaaaugcagauauauauu

SEQ ID NO: 124619 - RNA, 64 nt, Human
aaguaauccugagaaauguuucaggccuggggagggaggggagcccccgacgccucugcaauaa

SEQ ID NO: 124620 - RNA, 64 nt, Human
cauuugcacgcccggccgggaggcagagacggggggaggggaagccucaccauuucucaagguc

SEQ ID NO: 124621 - RNA, 64 nt, Human
ucucucaucaauuucugcuucuucauggaaugcugaccuucauugcuccauuuguagauuuuug

SEQ ID NO: 124622 - RNA, 64 nt, Human
ucucagggaauugccugcuggggugaugcagggaggaggggaggugcagggaagaggggccggc

SEQ ID NO: 124623 - RNA, 64 nt, Human
guuacaguggcaaucgcauuucaacgugagcgugggaggggacaaacauucaaaccauagcagg

SEQ ID NO: 124624 - RNA, 64 nt, Human
acaagauggguguuauucucauuuuacagaggagggaggggagacgcgaagggauugccugguc

SEQ ID NO: 124625 - RNA, 64 nt, Human
aguuagucaaagcacaaagucacgauuccacaauggaggggagaccuggccaagggagccagcc

SEQ ID NO: 124626 - RNA, 64 nt, Human
cuggaagggcagcauauaaaaacaucagucccgaggaggggacaacaauacuaccucacuacua

SEQ ID NO: 124627 - RNA, 64 nt, Human
accaucuggccuggccuggcccugcccugaggaaggaggggaagcugcagcuugggagagcccc

SEQ ID NO: 124628 - RNA, 64 nt, Human
ucugagcaaaucggagauauuuuagggguguggaggaggggaagggaggaaugggccaccauau

SEQ ID NO: 124629 - RNA, 64 nt, Human
uuuuauauaaguggacaaauuuugaguugccacaggaggggaaguagggaggggggaaauacag

SEQ ID NO: 124630 - RNA, 64 nt, Human
caaauuuuggaauguucuugcgcuuugugcacuuggaggggaaaacccaacuacauaugcacuu

SEQ ID NO: 124631 - RNA, 64 nt, Human
acuggacagcucuggaggaacaggccugcugaggggaggggagcauggacuuggccucuggagu

SEQ ID NO: 124632 - RNA, 64 nt, Human
ucaagugcugguuggcugucgccagcccaugguaggaggggaggaauggcuuaagaugagguaa

SEQ ID NO: 124633 - RNA, 64 nt, Human
gcguggacguuauacugucuucccccacccccggggaggggaagcuugagcugcugcugucacu

SEQ ID NO: 124634 - RNA, 64 nt, Human
uuuuuuuuaaauguuuuauuuugcuuucccagcgggaggggaggaagaagaguguuuacaaagu

SEQ ID NO: 124635 - RNA, 64 nt, Human
ggaagagacgugugugcaggaaacggggacguggggaggggaccugcaggggcagcccccugaa

SEQ ID NO: 124636 - RNA, 64 nt, Human
cacggaggucugacccaugcaggcagggccugcaggaggggagcacugagcuaacagucucuua

SEQ ID NO: 124637 - RNA, 64 nt, Human
cauaugagccgugaacugugcauagugcugggauggaggggaguguugggcaugugaucacgcc

SEQ ID NO: 124638 - RNA, 64 nt, Human
uuaaaaauccuaaguugaaucauuguuaguccgggaccuucaguacugccaagucccagagaaa

SEQ ID NO: 124639 - RNA, 64 nt, Human
aauuuauaaugaauacuuucuuagauuuuagguaggaggggagcagaggaauuaugaacugggg

SEQ ID NO: 124640 - RNA, 64 nt, Human
uuucuugucuccuuauuuccucuuuaccauuuuuggaggggaagcuauuuuuuuuccuugaucu

SEQ ID NO: 124641 - RNA, 64 nt, Human
ggaggcuugaccuuuuguccugaccaggugggcuggaggggacaagcccuaucccuggcauuac

SEQ ID NO: 124642 - RNA, 64 nt, Human
aaaccacccuacucccuggggugaggaaagaacaggaggggaggaggaggagugugcucugcac

SEQ ID NO: 124643 - RNA, 64 nt, Human
uuaaacuugaacuguggcuauauugaacuguuuuggaggggaggggguagccaggaaggaaaca

SEQ ID NO: 124644 - RNA, 64 nt, Human
guaaccugcagaccgggcccuuuugggggcggggggaggggaaaauuauuuuauuuuauuuuua

SEQ ID NO: 124645 - RNA, 64 nt, Human
agaaagcuggggguuuucagagcccuauguguggggaggggaguggauuccuucagggcauggu

SEQ ID NO: 124646 - RNA, 64 nt, Human
gagcagagacuggaagggcaagaccaggugcuaaggaggggagagggggcauccugucucucuc

SEQ ID NO: 124647 - RNA, 64 nt, Human
uggccaugucgcccacuccuuccacucugggggcggaggggaauggcuucucgggacccucagc

SEQ ID NO: 124648 - RNA, 64 nt, Human
cuuguagcccagcuugccagagguccaaauauugggaggggagaagaucuaaccagcaacaggg

SEQ ID NO: 124649 - RNA, 64 nt, Human
cugcaagaagccuggagucuguuucaggccaggaggaggggauuugcugagggccaaggggguu

SEQ ID NO: 124650 - RNA, 64 nt, Human
cugucugugauuuuccaggguuugguggggguagggaggggagaguuaaccugcuggcugugag

SEQ ID NO: 124651 - RNA, 64 nt, Human
cacugccccuuggugcuguguggucccaguggaaggaggggaagauuuuggaaaccugguagcc

SEQ ID NO: 124652 - RNA, 64 nt, Human
gaagacuaugugcacugaaguaaaugggguugggggaggggacauuucauauuuauaaugugcu

SEQ ID NO: 124653 - RNA, 64 nt, Human
cccagaaacccaggugcuggaccagggcccucagggaggggacccugcggcuagagugggcuag

SEQ ID NO: 124654 - RNA, 64 nt, Human
agcaugucggaauauaagaauaaaaaggauuaugggaggggaacauuagggaaauccagagaag

SEQ ID NO: 124655 - RNA, 64 nt, Human
gaaauaaauagcuuucuauauaugaguugcuggggaccuucacauucucuuuuagaaagcugug

SEQ ID NO: 124656 - RNA, 64 nt, Human
ccucucagagccgcccaaacugccguugauguguggaggggaagcaagauggguaagggcucag

SEQ ID NO: 124657 - RNA, 64 nt, Human
gccccaaagaguuggaggccaagggaaggggcagggaggggaguggcugaggcgaaguacccau

SEQ ID NO: 124658 - RNA, 64 nt, Human
ccauguuguaaaggaacagccccagugcacugggggaggggagggagugaggggcaguggugcc

SEQ ID NO: 124659 - RNA, 64 nt, Human
gcaggggcuccuuggccuccagcucccgugacuuggaggggacugugggacugaggagcacaga

SEQ ID NO: 124660 - RNA, 64 nt, Human
aagugugccucugugucuccuuccucggggguaaggaggggacagugcuucccaaguuccagcu

SEQ ID NO: 124661 - RNA, 64 nt, Human
uacuaaugaucacucuggaaaugcaaauagaauaggaggggaaaaaacaaaaucauguuaaugc

SEQ ID NO: 124662 - RNA, 64 nt, Human
uguccugccugaucacugaauaaagaacugagauggaggggagugaacagugccuauuguugaa

SEQ ID NO: 124663 - RNA, 64 nt, Human
cuccaaaauucuuaaaguugauuuuuuuaaagggggaggggaaggcuuuaauguguucuagauc

SEQ ID NO: 124664 - RNA, 64 nt, Human
ggggaaggggugggagagaagauacagacauggaggaggggaggcugcucuggcaaagucuuca

SEQ ID NO: 124665 - RNA, 64 nt, Human
ugggccaucagguacuucauuagucauggcagaaggaggggaaaagacuuguuuuccagacaga

SEQ ID NO: 124666 - RNA, 64 nt, Human
ccuauuuguuccaguuuuugcuugguuuuaguuuggaggggaacuuaaguacacagauccuuau

SEQ ID NO: 124667 - RNA, 64 nt, Human
ccccagccagaagcugugaaaccucaaguccuauggaggggagaaggacuggaauguaccccau

SEQ ID NO: 124668 - RNA, 51 nt, Human
aagaaacagcaaagagcuaaaggaggggauggucucugucauuucucuuug

SEQ ID NO: 124669 - RNA, 64 nt, Human
agcgcuuccgugaacacccccguccuccguagggggaggggagcaggcgggauccugggucccu

SEQ ID NO: 124670 - RNA, 64 nt, Human
gagcagcccacacuggcuugauggaucacccccaggaggggaaaaugguggcaaugccuuuuau

SEQ ID NO: 124671 - RNA, 55 nt, Human
agcgagccagcucccaauaaauggaggaggggaaagggacugucacagaaggagc

SEQ ID NO: 124672 - RNA, 64 nt, Human
caggacucagcaucgcuuucaauaggcuuuucaggaccuucacugcauuaaaacaauauuuuug

SEQ ID NO: 124673 - RNA, 64 nt, Human
ggcuaaaauaguuugcaaaggaccagguaauuggggaggggagagaggugggggcaagggggaa

SEQ ID NO: 124674 - RNA, 64 nt, Human
accccguugugggacaucuaggcaccucaacugaggaggggaagaaaguucuacguaauggagg

SEQ ID NO: 124675 - RNA, 64 nt, Human
uaauuccuaaucuuggagaauaaaaaagggcgguggaggggaaaacauuaagaauuuauucauu

SEQ ID NO: 124676 - RNA, 64 nt, Human
ccgguuaaagcucauagcugucagcucugaaugaggaggggagaagccccugggucuuucuuug

SEQ ID NO: 124677 - RNA, 64 nt, Human
gaguuuuuggucugguccuugagccacaagaaguggaggggagaccaugccugggaacagaccc

SEQ ID NO: 124678 - RNA, 64 nt, Human
cacuggacaugguugcagcugggagugggcugggggaggggaacaggaugcccagcccaggggg

SEQ ID NO: 124679 - RNA, 64 nt, Human
cuuaccaugguuugaacaaaaaaaggggaaauggggaggggaaaagggugggauuguccagcau

SEQ ID NO: 124680 - RNA, 64 nt, Human
cucggagcccagcacuccugggucucggggucggggaggggacgggggcacccacuuccuuguc

SEQ ID NO: 124681 - RNA, 64 nt, Human
caaggauaaguauguaaauacggggcgggcucugggaggggagagacuuuacaaaaaugagggc

SEQ ID NO: 124682 - RNA, 64 nt, Human
uguucccucuguugggaugccaguuguggcagggggaggggaaccuguccaguuuguacgauuu

SEQ ID NO: 124683 - RNA, 64 nt, Human
uuacucaggggauguuuaccuggugcucgggaagggaggggaaggggccggggagggggcacgg

SEQ ID NO: 124684 - RNA, 64 nt, Human
ugcucucauuguccaagcucugauuugggaggugggaggggacgucuuauuaacaaacgggggc

SEQ ID NO: 124685 - RNA, 64 nt, Human
aaacaaaaacagaauguuguacgugaagauucuaggaggggagggaccagcaaaucugagagaa

SEQ ID NO: 124686 - RNA, 64 nt, Human
aaccccaaaccaguauauuuuaguauuuguuuggggaggggaacaagccaauaaagauguuuag

SEQ ID NO: 124687 - RNA, 64 nt, Human
cuuuguaaauucccuggggaaaacuugcagcuaaggaggggaaaaaaauguuguuuccuaauau

SEQ ID NO: 124688 - RNA, 64 nt, Human
cagccacgucucaacauggguaagggguggggguggaggggagugugugcagcguuuuuaccua

SEQ ID NO: 124689 - RNA, 64 nt, Human
uugcuuuagguuuaauaaauagccuuaacuauuuggaggggaaaaaaugggucaacuuuuuuuu

SEQ ID NO: 124690 - RNA, 64 nt, Human
ugauauauauuguuuauaaaugcaagcuauuucuggaggggaaaaauguguguggcucuuacgu

SEQ ID NO: 124691 - RNA, 64 nt, Human
uggcuucccuuuucuuuguucaagaugagggccaggaggggaaacaucacaccugcccuaaacc

SEQ ID NO: 124692 - RNA, 64 nt, Human
ugcagggcaggggcgggggcugcuguuuuauuggggaggggagcauccuaaaaaugggguccag

SEQ ID NO: 124693 - RNA, 64 nt, Human
cgugccugccagggcugaagcugccugguauccaggaggggaaugcugguauccccauaugucu

SEQ ID NO: 124694 - RNA, 64 nt, Human
cugaggcccaaaggcagaacagccagagggggcaggaggggaccaaaaaggaaaaugaggacgu

SEQ ID NO: 124695 - RNA, 64 nt, Human
cuguuggucccuguccuugcugcccaggcagcguggaggggaaggguagggcagccagagaaag

SEQ ID NO: 124696 - RNA, 64 nt, Human
guaggcgauuggaagagugagcaggacacagaggggaggggaauguuuuggcaaguuuaggggc

SEQ ID NO: 124697 - RNA, 64 nt, Human
cagguaguaggugccagccuaggggagcuuccaaggaggggaaggcaaagcccuggccccugcc

SEQ ID NO: 124698 - RNA, 64 nt, Human
ccaggauguggcuucucaugaagcucuggccagaggaggggaacuuauugggggagggggggug

SEQ ID NO: 124699 - RNA, 64 nt, Human
ccagaggaggggaacuuauugggggaggggggguggaggggaggaaucuggaccucuaagucau

SEQ ID NO: 124700 - RNA, 64 nt, Human
acuuaagagaucugauucugacgaacugccuggaggaggggaauauauaaaaauaaaauuggug

SEQ ID NO: 124701 - RNA, 64 nt, Human
cuuuaaaaaaguagauauuuaauaucuaagcaggggaggggacaggacagaaagccugcacuga

SEQ ID NO: 124702 - RNA, 64 nt, Human
guaaagcugagaucuaaauggggacaaggcagguggaggggaggccaguguacauguaaaugcc

SEQ ID NO: 124703 - RNA, 64 nt, Human
uagauuuucugccagaggggugggucagagcaguggaggggagacaucgcccaugugcuucugc

SEQ ID NO: 124704 - RNA, 64 nt, Human
cuguccucgugucuuggaggaaaaucaccuggggggaggggacuucuugugguaagagcaagug

SEQ ID NO: 124705 - RNA, 64 nt, Human
gcccggggaggcugcagcaggucagcgagugaguggaggggaagucaagaugcuaacugcuucu

SEQ ID NO: 124706 - RNA, 64 nt, Human
ucagacucucccuacuugucccauauuugcaaggggaggggauuuggggcuggggcuccauuca

SEQ ID NO: 124707 - RNA, 63 nt, Human
augugaucauacaagacugaguggggagcugggggaggggaggucuguuacugaaagaugaac

SEQ ID NO: 124708 - RNA, 64 nt, Human
caucagaaucuugugaaaugggaaaacaacagaaggaggggaucaaagauagcugaucucacau

SEQ ID NO: 124709 - RNA, 64 nt, Human
guuuuccuuguaagguuuugccuacuuuaccaaaggaggggagaccuuaagaauuuugacacag

SEQ ID NO: 124710 - RNA, 64 nt, Human
cagcgugcucuuguaccgaaggcggccgcaccugggaggggagcuugguggcccccguggcugc

SEQ ID NO: 124711 - RNA, 64 nt, Human
aaaggcuuagccuuguucuguuuuguuguuuuuuggaggggaagguuagucaggccugaguauu

SEQ ID NO: 124712 - RNA, 64 nt, Human
uuuccucauuugucucuaaguugaaggcuuuguuggaggggacagagcacaggaacagccuuga

SEQ ID NO: 124713 - RNA, 64 nt, Human
gcgggcuggugcgcggagggggcgggggugggguggaggggagggggaagagguacaggcggug

SEQ ID NO: 124714 - RNA, 64 nt, Human
cacggccuggcuggugggaaggccggcagcgggcggaggggauccagccacuucccccucuucu

SEQ ID NO: 124715 - RNA, 64 nt, Human
ucuggccauacuuaagcaaugggagggagagggaggaggggaagaucugggcaauuuuggccuu

SEQ ID NO: 124716 - RNA, 64 nt, Human
gugugucacacgucuauaguaaaccaguucucugggaggggaaaaaagcccugauuuauugcau

SEQ ID NO: 124717 - RNA, 64 nt, Human
gcugaugaaugcuuuucucuccuuauguguggaaggaggggagcacuuagacauuugcuaacuc

SEQ ID NO: 124718 - RNA, 64 nt, Human
ucugcucaucaagugccaauucaauggagcaggaggaggggauaucauauauuuaggggaaaga

SEQ ID NO: 124719 - RNA, 64 nt, Human
cucacaucuggaggauuccagcaggagggguuuuggaggggaccugcuugcgaccugcugaggg

SEQ ID NO: 124720 - RNA, 64 nt, Human
uuuuguuuauuuaaugcuguggcaugggugaagaggaggggaagaggccuguuuggccucucua

SEQ ID NO: 124721 - RNA, 64 nt, Human
ccuuuagguuuccagacuggcuugcucuuuggcugaccuucaauucccucuccaggacuccgca

SEQ ID NO: 124722 - RNA, 64 nt, Human
gggguuugcccuggaggugaggugagugcucgagggaggggagugcuuucugccccaugccucc

SEQ ID NO: 124723 - RNA, 64 nt, Human
aguccuuugggguugagggagaugggagcuagggggaggggagggagaugucuuguugugggga

SEQ ID NO: 124724 - RNA, 64 nt, Human
ugucucaaaccaaaguuaacagggagaggaugggggaggggacaaauuagaauaggauagcauc

SEQ ID NO: 124725 - RNA, 64 nt, Human
aaagggcacucugauagggcaaaaacggaacaugggaggggacaaauaagggaauaaaaucugg

SEQ ID NO: 124726 - RNA, 64 nt, Human
ugcaggagcugcagccacccaaagugggaggcagggaggggagcaucugucugccacugagacc

SEQ ID NO: 124727 - RNA, 64 nt, Human
auagccugaaugggauuucagguuaggcagggugggaggggaggcucucuggcuuuaguuuugu

SEQ ID NO: 124728 - RNA, 64 nt, Human
cuaggagggaugcagucuauccaugcacuuggguggaggggagucucugugccugggaauuagg

SEQ ID NO: 124729 - RNA, 64 nt, Human
aguuuugagaccuuuggcguuguuucuugaugugggaggggagguguuagugcaugcaaggguu

SEQ ID NO: 124730 - RNA, 64 nt, Human
gucauuugcuaguagaauuuguaaucaaacaauaggaggggaaucugugaacgccuagaaaaug

SEQ ID NO: 124731 - RNA, 64 nt, Human
ugcacaacauccucagaaccauucacuggcaaauggaggggaacgugcugacugggacucccag

SEQ ID NO: 124732 - RNA, 64 nt, Human
uagucauuucuugaaaaagauuggcuucaagaauggaggggaaaugcaguuucuauuuaccuuu

SEQ ID NO: 124733 - RNA, 64 nt, Human
acauggggcagaggagcuccaggcacagaccaggggaggggauauuuaggggcuccccuuacaa

SEQ ID NO: 124734 - RNA, 64 nt, Human
acugcacaucuuuuggugaucggggucaggcaaaggaggggaaacaaugaaaacaaauaaaagu

SEQ ID NO: 124735 - RNA, 64 nt, Human
ccgugcaggagagggcuggguggggcagaggccaggaggggaccuggugugucaccugcccacc

SEQ ID NO: 124736 - RNA, 64 nt, Human
ccccacagaugguuugauggcugugcuguauacuggaggggagggcaggacucugggagaacag

SEQ ID NO: 124737 - RNA, 64 nt, Human
cuuuucccaaaggguuuuggguauagccugcccuggaggggaaggaaguccaugcaagcaaaga

SEQ ID NO: 124738 - RNA, 64 nt, Human
ucauuccaaauaguuuugugccauugaaaaacuugaccuucaaaaaaauuuguuuuucagaaua

SEQ ID NO: 124739 - RNA, 64 nt, Human
ccagcuccgggcuggcuuuuugcagggcgcagguggaggggacaggucugccgauggggguggg

SEQ ID NO: 124740 - RNA, 64 nt, Human
gaggaaaagacaccugucaaaugucacagaucugggaggggacuuaagaccuaucaugccaaga

SEQ ID NO: 124741 - RNA, 64 nt, Human
cuggcgcuggacuugggcgaccugggaggcacagggaggggagagaugggcggccccgccccag

SEQ ID NO: 124742 - RNA, 64 nt, Human
ccuccuuggaaggagcucuugcuggccaguguuuggaggggaggaugagugccugucacugagg

SEQ ID NO: 124743 - RNA, 64 nt, Human
ugcggguguucccugugagcccgaguccgcuucaggaggggagccugcaggugccggcugguga

SEQ ID NO: 124744 - RNA, 64 nt, Human
cagggagugcggggaugcggaucagcugggaggaggaggggaggggaacuuccacccgagggga

SEQ ID NO: 124745 - RNA, 64 nt, Human
agugcggggaugcggaucagcugggaggaggaggggaggggaacuuccacccgaggggaagaug

SEQ ID NO: 124746 - RNA, 64 nt, Human
uuuggggugggagggaaugcagaugggaguugggggaggggaggauacaguucaggauacccca

SEQ ID NO: 124747 - RNA, 64 nt, Human
ccucaaacaggcugaggagguuccgaggcucaaaggaggggaaggagccccgaggaggcucuga

SEQ ID NO: 124748 - RNA, 64 nt, Human
agcggggaggagauauuuauuuuggggagaguuuggaggggagggagaauuuauuaauaaaaga

SEQ ID NO: 124749 - RNA, 64 nt, Human
ggugggggucgcugacuauagacuguagcugggaggaggggaugcucccagggcuggggcugcc

SEQ ID NO: 124750 - RNA, 64 nt, Human
uuuguggggagggagcauuuuugguggucuugggggaggggaggggagggaagggcugguguug

SEQ ID NO: 124751 - RNA, 64 nt, Human
ggggagggagcauuuuugguggucuugggggaggggaggggagggaagggcugguguugauuuu

SEQ ID NO: 124752 - RNA, 64 nt, Human
ugguggcuggguuggagggugucccaaaaagaaaggaggggauagagagagaccacuuuucaua

SEQ ID NO: 124753 - RNA, 64 nt, Human
auguuuuguguugguguuuccuauuuucugcacuggaggggaggggacuguugagguucugucu

SEQ ID NO: 124754 - RNA, 64 nt, Human
uuguguugguguuuccuauuuucugcacuggaggggaggggacuguugagguucugucuuuuuu

SEQ ID NO: 124755 - RNA, 64 nt, Human
uaaaaaaacaacaacaacaacuuauuuaguuuggggaggggaagcauuuuuaaguguguuguaa

SEQ ID NO: 124756 - RNA, 64 nt, Human
augugcgugucaaauauucaucuaguccccugggggaggggaagggugggucuagacauacuau

SEQ ID NO: 124757 - RNA, 64 nt, Human
guggccuuaacuacaguggagguggaacuucccaggaggggaagggacagaccagccccagccg

SEQ ID NO: 124758 - RNA, 64 nt, Human
gccucggccuucuuugcuuuuugugggggagaggggaggggacgggcagggucucugucgccca

SEQ ID NO: 124759 - RNA, 64 nt, Human
caggccuccggggggccggggcuuaccauguaggggaggggagaucuauccacauaccucaggu

SEQ ID NO: 124760 - RNA, 64 nt, Human
uuuaauaaagucaguucugguggcccuggacuuuggaggggaaggggaggccaagagcggaugu

SEQ ID NO: 124761 - RNA, 64 nt, Human
cgucauccuuuggcucaaagccagauguccguguggaggggacauagacacugcauggcccuau

SEQ ID NO: 124762 - RNA, 64 nt, Human
agaccuuucugauccuugggucuggguuuuuugaggaggggacauaguggccucugggcugcca

SEQ ID NO: 124763 - RNA, 64 nt, Human
cccauaaagucauguuucucucccuuuagaauagggaggggaagggaucagguguguuguccug

SEQ ID NO: 124764 - RNA, 64 nt, Human
uuuugucuaaguugucaucuuacuuacucacaaaggaggggaaaacguuauuuucauagcugcu

SEQ ID NO: 124765 - RNA, 64 nt, Human
uccucugaccugaugguguugggguuuggguaggggaggggagcucggcugucagaacuccaug

SEQ ID NO: 124766 - RNA, 64 nt, Human
gcugucagaacuccauggauauguuucuuuggauggaggggagggccuuuguuaccuuuugcac

SEQ ID NO: 124767 - RNA, 64 nt, Human
gagugccaggcuugugagaugagaccaagagggaggaggggaaggacuccaugggccaucgugg

SEQ ID NO: 124768 - RNA, 64 nt, Human
uaugccuguuuccuuuucccagcaccaugccuguggaggggacagucagacccagagguccuuu

SEQ ID NO: 124769 - RNA, 64 nt, Human
ccgugcaauaccugcugggccuccugcccgcgcgggaggggagggcgccccgggaccagggaug

SEQ ID NO: 124770 - RNA, 53 nt, Human
cuaccaagaauuacgucugacguggaggggaaugggggcuccgcuggcgcuag

SEQ ID NO: 124771 - RNA, 64 nt, Human
gaccagacucaacugccaccaguccccagcugcagaccuucauccccuucaucucccacuaggg

SEQ ID NO: 124772 - RNA, 64 nt, Human
gcacacagcagcacccuuccccugaggccgguggggaggggacaagugucagcaggauuggcgu

SEQ ID NO: 124773 - RNA, 64 nt, Human
gucacaugaauugaaaaggagacgcugcucccacggaggggagcaggaaugcugcacuguuuac

SEQ ID NO: 124774 - RNA, 64 nt, Human
acuagcaagugucccaauuuuuuccaaacguuggggaggggaaaauucacuguaucaugaaacc

SEQ ID NO: 124775 - RNA, 64 nt, Human
cgggaaauguagucccaagcuuucacucgcgaguggaggggaaggauuuaugucaccagugggg

SEQ ID NO: 124776 - RNA, 64 nt, Human
gaaaaggaacucuugguucgauaccuggagcagaggaggggaaaguccagggcuauagggugug

SEQ ID NO: 124777 - RNA, 64 nt, Human
guagggauggugaggagacgcguagggauggugaggaggggagaggagggagaccugcuggugc

SEQ ID NO: 124778 - RNA, 64 nt, Human
uuuugugggaggcaagcacaucugggcuucuuguggaggggaagguagagugaaagaaagaggg

SEQ ID NO: 124779 - RNA, 64 nt, Human
gagugacugcaccaagcucuucagccagggcauuggaggggagcaggcccaggccaaguuugac

SEQ ID NO: 124780 - RNA, 64 nt, Human
ucauuuaaagaaacauuccucaguguaacauuugggaggggauucuuuccucuugcuaguuuaa

SEQ ID NO: 124781 - RNA, 64 nt, Human
ggcagggcccagccauugggcaccucugggaaggggaggggaccaugaggcagccagccccugg

SEQ ID NO: 124782 - RNA, 64 nt, Human
cugucaccuucaaagcugacugugccccgcugcgggaggggacggcaccccagugguggcagag

SEQ ID NO: 124783 - RNA, 64 nt, Human
gaucaacucugcuaggaagcggggugggaagaagggaggggaugggguugggagaggugagggc

SEQ ID NO: 124784 - RNA, 64 nt, Human
accccuuuagauggggagggaagaggaggagaggggaggggaccugcccccuccucaggcaucu

SEQ ID NO: 124785 - RNA, 64 nt, Human
uucucuaguauuucuggggcuggggggcggggcuggaggggaaggaguguccacgcaucaauaa

SEQ ID NO: 124786 - RNA, 64 nt, Human
cauuaaagaccagaaaagacuugcuuuuacccagggaggggacauucccccaauccugugucug

SEQ ID NO: 124787 - RNA, 64 nt, Human
ccuaauccccacuucccugcagaaucaaucugagggaggggauaaagaggaagcaauaaaaaaa

SEQ ID NO: 124788 - RNA, 64 nt, Human
cagguggcacccagggcgaauggggcccagggcagaccuucagggccagagcccuggcggagga

SEQ ID NO: 124789 - RNA, 64 nt, Human
ggaagacccaccccauucccacuccucugagcccggaggggacaccccaagcuccaagcuccaa

SEQ ID NO: 124790 - RNA, 64 nt, Human
acccucaccgaccaccuguccugggaccaggcugggaggggaguguggcagggaggaggaagag

SEQ ID NO: 124791 - RNA, 64 nt, Human
gccuccccccugagggcuggaggcccaaggucggggaggggagggaaaagcagcacccacaggg

SEQ ID NO: 124792 - RNA, 64 nt, Human
cuggguguucaaauuuauuuuaagagauagggagggaggggacauaaagggaaugcauacauug

SEQ ID NO: 124793 - RNA, 64 nt, Human
uugccuuucuuaauuuuagggacagcuaccggaaggaggggaacaaggaguucucuuccgcagc

SEQ ID NO: 124794 - RNA, 64 nt, Human
auaggcacccagccugcaucucccaggaggaaguggaggggacaucgcuguuccccagaaaccc

SEQ ID NO: 124795 - RNA, 64 nt, Human
cgcccugggcugggcccuuccuggcuaggacuguggaggggagcugcuggccauggcugcuuug

SEQ ID NO: 124796 - RNA, 64 nt, Human
cccgggcaggguccuggccagcagugugggagcaggaggggaaggauaguucuguguacuccuu

SEQ ID NO: 124797 - RNA, 64 nt, Human
uuuaggaggcuggcaugaccaggacuuaugggugggaggggagcauuuuuagugaagcaagaaa

SEQ ID NO: 124798 - RNA, 64 nt, Human
cucagcagcuauuugaaugagaugauucagaaggggaggggagacagguaacgucuguaagcug

SEQ ID NO: 124799 - RNA, 64 nt, Human
auucagaauaaauggguaacacugauuacuuuugggaggggaaccaguagguugaggacaggag

SEQ ID NO: 124800 - RNA, 64 nt, Human
uuggacaacugcauggagcugcacucuaggagaaggaggggaaccagauguuagaucaggggag

SEQ ID NO: 124801 - RNA, 64 nt, Human
cuccuuucccuguucugcccacucuggggaauagggaggggaggagaggagaggagagggagga

SEQ ID NO: 124802 - RNA, 64 nt, Human
uggaucuguucugugugucugucuguggguggggggaggggagggaagucuugugaaaccgcug

SEQ ID NO: 124803 - RNA, 64 nt, Human
cugugcuggggcacggcgggauccuccacagagaggaggggaccaauucuggacagacagaugu

SEQ ID NO: 124804 - RNA, 64 nt, Human
gcagacuagggaaaccuuugcuugcuuacuauuaggaggggaagucuucaguagggaacacgau

SEQ ID NO: 124805 - RNA, 64 nt, Human
uccucgcuguccccucucuguagugacuggcccugaccuucaggagugcacuuuccacucuacc

SEQ ID NO: 124806 - RNA, 64 nt, Human
ugaaauggucaucacaucugaccuuggucaguggggaggggaacugguauccugccaagccugg

SEQ ID NO: 124807 - RNA, 64 nt, Human
uccuucugaccccucauaagaggaguguggugagggaggggacuggguaggggucaucccagga

SEQ ID NO: 124808 - RNA, 64 nt, Human
ugcuucugacuggccagcccccuccccugcuggaggaggggagaagccccgcucugguccuacc

SEQ ID NO: 124809 - RNA, 64 nt, Human
ccuuuacuccaccagcccgacgacccaugacugaggaggggauuucuacagucucaggauuuag

SEQ ID NO: 124810 - RNA, 64 nt, Human
aacaaggcaaccacgaccuugcuagguucucugaggaggggacuuucuauguucacgucccacc

SEQ ID NO: 124811 - RNA, 64 nt, Human
uuaauuaauguacacaugucauuagaaugcagacggaggggacucaccaugaauaucugggguu

SEQ ID NO: 124812 - RNA, 64 nt, Human
ucugcaucuucucuuggagugagggaggcuaccuggaggggaucagcccacugacagaccuuaa

SEQ ID NO: 124813 - RNA, 64 nt, Human
uggcccugcucaccccuacgccucgcccuugccaggaggggaguggcagugaggagggggccag

SEQ ID NO: 124814 - RNA, 64 nt, Human
acacauugccacgacaggagccuccaaguaugugggaggggacgggcgggacgagcuuggcugu

SEQ ID NO: 124815 - RNA, 64 nt, Human
cuuuggucccugucuugcaggggcugaggugucaggaggggacuucuggcccaccuugccuuca

SEQ ID NO: 124816 - RNA, 64 nt, Human
ggggcaggggccugggccggcgagggggccggggggaggggacagagcugaggauuuccuggag

SEQ ID NO: 124817 - RNA, 64 nt, Human
ccuccggagccucauguucucuucccaggccuuuggaggggaaauggggaaagcagaacugaag

SEQ ID NO: 124818 - RNA, 64 nt, Human
cgggggacggagguaagcuggauauccugggggaggaggggaaugcgcucuggaaacacccuuc

SEQ ID NO: 124819 - RNA, 64 nt, Human
gggcaguccccuggucagagggggugggggugggggaggggagagggguaccuagaacccagag

SEQ ID NO: 124820 - RNA, 64 nt, Human
guguguaugaaggggggugacaaggucccccuggggaggggaccaaccuugucugguggaugag

SEQ ID NO: 124821 - RNA, 64 nt, Human
caugugguccccuuugucccuagcaccuuuaaggggaggggaagaauuggagggcagcuugccu

SEQ ID NO: 124822 - RNA, 64 nt, Human
ccagacuugcauggccauggcagggccucgggaagaccuucaggaguggggaaggguuucuccu

SEQ ID NO: 124823 - RNA, 64 nt, Human
cagggagggaaaggaggagggagagagauggagaggaggggagagagaaagagagguggggaga

SEQ ID NO: 124824 - RNA, 64 nt, Human
accaggaaggaagucagcaugccucuagaggcaaggaggggaggaacacugcacucuuaagcuu

SEQ ID NO: 124825 - RNA, 64 nt, Human
cgcgguggcucacaccuguaaucucaacgcuuugggaggggaggcaggcagauaacuugagauc

SEQ ID NO: 124826 - RNA, 64 nt, Human
cuggggagagcugggagcuguugaagguuuggggggaggggaaacggguuguguuucuucauuu

SEQ ID NO: 124827 - RNA, 64 nt, Human
gccacacggcgggaggaagggcucugagcccaggggaggggagggagcgaggggcucacaccug

SEQ ID NO: 124828 - RNA, 64 nt, Human
ccuuuuuguguccucggcccuccacccuugguggggaggggacccaggaccauaggaagguccu

SEQ ID NO: 124829 - RNA, 64 nt, Human
cccuugcccaugccuggaccuugcuucuggccagggaggggaucaggcccccuuguccacucca

SEQ ID NO: 124830 - RNA, 64 nt, Human
ccagucuccgcguuuugcgauuuuaauuuuggcgggaggggaaguggauugagaggaaagagag

SEQ ID NO: 124831 - RNA, 64 nt, Human
uugcucugccccugaccccuugucccucuuugagggaggggagcuaugcuaggacuccaaccuc

SEQ ID NO: 124832 - RNA, 64 nt, Human
aguauuuggggguggguggguaagggggggagugggaggggacggaaccaacuuuuucuguauu

SEQ ID NO: 124833 - RNA, 64 nt, Human
gcagggugccggcccugccaccaaguugagagcuggaggggagguggggagagaacaucacaga

SEQ ID NO: 124834 - RNA, 64 nt, Human
uagaggcuggaaaguguccccugcauucuggaggggaggggagauaauaaggagggcugcuggg

SEQ ID NO: 124835 - RNA, 64 nt, Human
caacguagaggcuggaaaguguccccugcauucuggaggggaggggagauaauaaggagggcug

SEQ ID NO: 124836 - RNA, 64 nt, Human
uggaggauccacuacugucuuuaagaugcagaguggaggggaggugggcacccacccugcgauu

SEQ ID NO: 124837 - RNA, 64 nt, Human
acacagagaaacagguagaccccacagaggagaaggaggggauucaacagcuuuauugucugga

SEQ ID NO: 124838 - RNA, 64 nt, Human
aggucaagcccaggaggacugccccgugcagacuggaggggacgcugguagagauggaggagga

SEQ ID NO: 124839 - RNA, 64 nt, Human
aagccucuaaguuucugacuguuaugcuugauuugaccuucaaaauuacauauuaacuguucuu

SEQ ID NO: 124840 - RNA, 64 nt, Human
cggaucccccagaguggaggaggccucuccaugaggaggggagcagcccaaggcaccuguccuc

SEQ ID NO: 124841 - RNA, 64 nt, Human
uucugaucauggggugggggagagaggaaaggagggaggggagaagcccagcagaagcugagcc

SEQ ID NO: 124842 - RNA, 64 nt, Human
uuacugguguauuauuugggggagggagggauggggaggggagaaagggagauggguagcauca

SEQ ID NO: 124843 - RNA, 64 nt, Human
uuucaagcuguauaguuugcacacccaucccaguggaggggaaaggggauaaguguuucaaggc

SEQ ID NO: 124844 - RNA, 64 nt, Human
cacuuccaccgugggguugggggugggcaacagaggaggggagcaaguagggaaggggguggcc

SEQ ID NO: 124845 - RNA, 64 nt, Human
ccacacuuuauauacgaauaaacgcagaagagggggaggggaagcuuuauuuauagaaaugaca

SEQ ID NO: 124846 - RNA, 64 nt, Human
gagcuggagaaugucgggugagguguaugggagaggaggggagaguuagaacuugugccuuugg

SEQ ID NO: 124847 - RNA, 64 nt, Human
aauuccccaagaggucccaaggauugggagcaugggaggggagcuggcgggagggugggaggug

SEQ ID NO: 124848 - RNA, 64 nt, Human
gaugaacucucuagagaagcaccuuccuccuacaggaggggaaacugagcccacagugaguaug

SEQ ID NO: 124849 - RNA, 64 nt, Human
gccagagggcugccucuccagcggcuugggccggggaggggacacuccaguucucuagcauggc

SEQ ID NO: 124850 - RNA, 64 nt, Human
gugggaauugaacaaugagaauacauggacacagggaggggaacaccacacccuggggccuguu

SEQ ID NO: 124851 - RNA, 64 nt, Human
gccccggcccccagcagggaagggaugaguguugggaggggaagggcuggguccgucugagugg

SEQ ID NO: 124852 - RNA, 64 nt, Human
cgcucgaugccuuugcuguuuagcuuccuccagaggaggggacuuguaggaaucugccuuccag

SEQ ID NO: 124853 - RNA, 64 nt, Human
cuaccccucccaucggggcugugcuggggcuuggggaggggagggggcgccuuguucucccucc

SEQ ID NO: 124854 - RNA, 64 nt, Human
ggggucuuugccuggccccaucccuagggggcggggaggggacguaaaucccuaaucuuuaagc

SEQ ID NO: 124855 - RNA, 64 nt, Human
caaagugaucuuacagaacagugccugugacaccggaggggauuguucugucuuugugagugaa

SEQ ID NO: 124856 - RNA, 64 nt, Human
gagcagcccuuagccuggggccaugggucaggcugaccuucaacaauuauuucuagaugauuuc

SEQ ID NO: 124857 - RNA, 64 nt, Human
gcccuuccuccguuuuaagggggaagcaacauuuggaggggauggaugggcuggucagcugguc

SEQ ID NO: 124858 - RNA, 64 nt, Human
cucuguugauuuuguuuccguuuggauuuuugggggaggggagcacuguguuuaugcuggaaua

SEQ ID NO: 124859 - RNA, 64 nt, Human
aagcaacauggacauuuccuucuaguccuuccaaggaggggagagaaguguaugugcauuugug

SEQ ID NO: 124860 - RNA, 64 nt, Human
ccacaaaauggccuuuaguguaugaaaugcacauggaggggauguaguugcauuuuugcuaaaa

SEQ ID NO: 124861 - RNA, 64 nt, Human
aggguuguuaccauucuuaucugaguaguugggaggaggggaauaccacuuuaguucauuugga

SEQ ID NO: 124862 - RNA, 64 nt, Human
gaccucaucagcuccccaggcaaaaacaaaagugggaggggacacaugcucauuaucagggugc

SEQ ID NO: 124863 - RNA, 64 nt, Human
agccaacccuccuccacagcgccauauuaauggaggaggggaggaaggugaaaucuacugcaug

SEQ ID NO: 124864 - RNA, 64 nt, Human
cagaacggagauuuggauauuaagaugcagagggggaggggaagggaugguagagauagacagc

SEQ ID NO: 124865 - RNA, 64 nt, Human
caauucucugccccaggcuaauauuagggacuggggaggggaccaccagaggggagagggaagc

SEQ ID NO: 124866 - RNA, 64 nt, Human
gucaggccucagcaucucacauccaccaccuccaggaggggagaccacugguaaguccuccucc

SEQ ID NO: 124867 - RNA, 64 nt, Human
aacuggucuccugugauggcugggacuccucgcgggaggggacugcgcugcuauagcucuugcu

SEQ ID NO: 124868 - RNA, 64 nt, Human
uuaauacacucaaguguggggagucaugggguguggaggggaggaaaggaaagguauuuuguuu

SEQ ID NO: 124869 - RNA, 64 nt, Human
acuacucuuuugguuuuguuugaaaguaagaaagggaggggaaacuuugcucuuuuaauaauua

SEQ ID NO: 124870 - RNA, 64 nt, Human
uaaguuuaguuuucagacauagaauuucacuuuuggaggggacccuugaauguuaguuucauuc

SEQ ID NO: 124871 - RNA, 58 nt, Human
ucaucuucaacagccgguagccgcgugcggaggggacagagcgugagcugagcaggcc

SEQ ID NO: 124872 - RNA, 64 nt, Human
cagggugggagcggccggcccaccuguccccucgggaggggagcugagcccgacuucuaccggg

SEQ ID NO: 124873 - RNA, 64 nt, Human
agaaugcuuuguuccuuuaaaagacugaaaagcugaccuucaauggauugaggcacuuuugcuu

SEQ ID NO: 124874 - RNA, 64 nt, Human
acauucccgccacucggggacagaugggcacaagggaggggaaacuccaucaggaagugcuccc

SEQ ID NO: 124875 - RNA, 64 nt, Human
ucccugcagggucagggaccagaccacgcccagaggaggggaggcacuggcccccgccacagga

SEQ ID NO: 124876 - RNA, 52 nt, Human
aggacuuuguguuuuuauaaagggaggggaugaggggaaagauacaacacua

SEQ ID NO: 124877 - RNA, 64 nt, Human
cgugacacaauccucaaacauggaagaugaaaggggaggggaugucaggcccagagaagcaagu

SEQ ID NO: 124878 - RNA, 64 nt, Human
cauauugaauauaauauauuuguguauuuaacagggaggggaagagggggcgaucgcggcggag

SEQ ID NO: 124879 - RNA, 64 nt, Human
cugcaggccaggagggccuccuuccugccacgagggaggggagucgggccccaggucgcccccg

SEQ ID NO: 124880 - RNA, 64 nt, Human
cuguccagagggucuucagaagccccccugggagggaggggaggaugagcacgcccagcucccc

SEQ ID NO: 124881 - RNA, 64 nt, Human
agcuggcggagggagggaagaggagggagugacgggaggggaggaggucagcgaccuggggccg

SEQ ID NO: 124882 - RNA, 64 nt, Human
gagaccaguugcuggugaaacugggccaaucuggggaggggaacauccuugccagggaguuucu

SEQ ID NO: 124883 - RNA, 64 nt, Human
gugaaacacauuuuccaagucuugggcuuucucuggaggggaagguggaugcuggcgggugacu

SEQ ID NO: 124884 - RNA, 64 nt, Human
acugacuucaaaggcagcuucuggacagguggugggaggggacccuucccaagaggaaccaaua

SEQ ID NO: 124885 - RNA, 64 nt, Human
cggcacuucuaguggucucaccuggaggcaagagggaggggacagaggcccugccacgucccgc

SEQ ID NO: 124886 - RNA, 64 nt, Human
cucuggagguacugagacagggugcugaugggaaggaggggagccuuuggggggccacccgggg

SEQ ID NO: 124887 - RNA, 64 nt, Human
ucccuuccucccaaaaguaucgggggcuggggcaggaggggagugaggcaggugacagugaggu

SEQ ID NO: 124888 - RNA, 64 nt, Human
gcuccucucuaaccuccuuuacccucaucugucuggaggggagcucugucuguccguguuauuu

SEQ ID NO: 124889 - RNA, 56 nt, Human
auuucuacaccaugcucugagggacaggaggggaaggcaacauacacaccccggac

SEQ ID NO: 124890 - RNA, 64 nt, Human
ggccugagggcugagugauucuguaaccaccugagaccuucacguuugcugccguugggggcuc

SEQ ID NO: 124891 - RNA, 64 nt, Human
ugugaccgcccugucgccaagaggacuggggaagggaggggagacuaugugugagcuuuuuuua

SEQ ID NO: 124892 - RNA, 64 nt, Human
uuucugaugguggcuggggcuggggugagcucagggaggggaagaggagaauacaugcagaguc

SEQ ID NO: 124893 - RNA, 64 nt, Human
aagucaccugauauucuggccccaggggugggagggaggggagcuuggaaggcuaguccuguag

SEQ ID NO: 124894 - RNA, 64 nt, Human
cacugaggacgcgugacauggugggcaccggaaaggaggggacuucuccugcaccccaagaagu

SEQ ID NO: 124895 - RNA, 64 nt, Human
gguccccuggaccauccagggugcuagggggcagggaggggacacccccuccccgccuuuaccu

SEQ ID NO: 124896 - RNA, 64 nt, Human
agccacuccccuccacucucuaccagauaacugaggaggggagaggugggccguaacgggcacg

SEQ ID NO: 124897 - RNA, 64 nt, Human
uggaaaggagggaccccgccaccccagcagcugaggaggggauucuggaacugaauggcgcuuc

SEQ ID NO: 124898 - RNA, 64 nt, Human
acucuuccucucccuugucgccuucacuucuacaggaggggaaggggccagggaggggauucuc

SEQ ID NO: 124899 - RNA, 64 nt, Human
ucgccuucacuucuacaggaggggaaggggccagggaggggauucucccuuuaucaucaccuca

SEQ ID NO: 124900 - RNA, 64 nt, Human
cugggcuugccccauuuggggcagcuauuuaaggggaggggaugucucaccgggcuggggguga

SEQ ID NO: 124901 - RNA, 64 nt, Human
ucgcggggcccaagucuuccuucuucguccgaaaggaggggaggggggacucgcugcuacaagc

SEQ ID NO: 124902 - RNA, 64 nt, Human
cucaagcccagcacgcagugcaccuugaacagagggaggggaggacccauggcucuccccccua

SEQ ID NO: 124903 - RNA, 64 nt, Human
cuuguggggugagucaucccuacucccaacaucuggaggggaaaggugagugaagacccuaauu

SEQ ID NO: 124904 - RNA, 64 nt, Human
uuuauuuuuugccucagagggaugggauuggggaggaggggaugggcagcggaggguugggggc

SEQ ID NO: 124905 - RNA, 64 nt, Human
gaccccucugcccugaccccacggggccggggagggaggggaccccccuccaccccccuuccgu

SEQ ID NO: 124906 - RNA, 64 nt, Human
cuuuugcauccagggagugggugcagccacauuuggaggggaugggcuuuacuugaugcaaccu

SEQ ID NO: 124907 - RNA, 64 nt, Human
auggugugggaugggagugcauagaaauucucaggaccuucagacaucuguaucuccuguggcc

SEQ ID NO: 124908 - RNA, 64 nt, Human
ccugggaccuggauugggucagaugccuguccuuggaggggacaagguugacugcuuaggaggc

SEQ ID NO: 124909 - RNA, 64 nt, Human
gggcggggguugggggguugggggguuagggcagggaggggacuggggaagugcgcacacagcc

SEQ ID NO: 124910 - RNA, 64 nt, Human
accuccccggagagaaacuggacauggggccuggggaggggagcuggccagaggaggaccccuu

SEQ ID NO: 124911 - RNA, 64 nt, Human
aucucuguuucuucagcgggaaaguggagcugguggaggggagggaggagacaucucccucuuu

SEQ ID NO: 124912 - RNA, 64 nt, Human
ugcaauuuuaucucaggaauuauuuuuaaaaggaggaggggacauagaaaaaaugaaaugcaag

SEQ ID NO: 124913 - RNA, 64 nt, Human
gagucuggagaugccuggguagcccucagcauuuggaggggaaccuguucccgucgguccccaa

SEQ ID NO: 124914 - RNA, 64 nt, Human
aaugccugguaucugcccccaguccaggccaggcggaggggaggggcuguccggcugccucucc

SEQ ID NO: 124915 - RNA, 64 nt, Human
ccuugcccccagaggagcagucauugcccucugcggaggggaccaggguucagcagugacguag

SEQ ID NO: 124916 - RNA, 64 nt, Human
ggaagagcuggcaaaaggagccucacacccccaaggaggggacggugccacuuccagacaagac

SEQ ID NO: 124917 - RNA, 64 nt, Human
uuuugacccaaagguccugacgguugcguccgggggaggggaaggaagggccgcugucgccaag

SEQ ID NO: 124918 - RNA, 64 nt, Human
accugucacaacaauaagcagggaggggagauguggaggggacacaucugguugccuuggaggc

SEQ ID NO: 124919 - RNA, 64 nt, Human
gucccgucguaagaccugucacaacaauaagcagggaggggagauguggaggggacacaucugg

SEQ ID NO: 124920 - RNA, 64 nt, Human
ucaguuccugacugugcaaggccaacagggcaggggaggggaagaccuggggaaggaagaauga

SEQ ID NO: 124921 - RNA, 64 nt, Human
acgggcugagcguuccagguaaacugaggcucggggaggggaaggacaggcuggccucuccuuc

SEQ ID NO: 124922 - RNA, 64 nt, Human
ugcccgacccuggggagagagggcaucugcaauaggaggggacccgagccuguccuggcugcug

SEQ ID NO: 124923 - RNA, 64 nt, Human
ccucuuucuuguuuaagugaugugaugucuccgaggaggggagagaagacuuuguuuccgacuc

SEQ ID NO: 124924 - RNA, 64 nt, Human
uccugccuccagacgagcuggaaaaguuuauggagaccuucaaggcccugaaggugagccagga

SEQ ID NO: 124925 - RNA, 64 nt, Human
cagcccacccuaccccuccuccaugggcccugcaggaggggagacccaccuugaagugggggau

SEQ ID NO: 124926 - RNA, 64 nt, Human
ugcaauucccgcuuggcugagaggagggggagaaggaggggaagagagaggagccccacuucac

SEQ ID NO: 124927 - RNA, 64 nt, Human
cucugccaggacggcugcaagaccagcuggcccgggaggggacaacgggcuguugcgggugcgc

SEQ ID NO: 124928 - RNA, 64 nt, Human
acauagugagacccccccuccagggugggucuggggaggggacagcuguucaccccagcacccu

SEQ ID NO: 124929 - RNA, 64 nt, Human
cccggaccgggaacggaggcggccagcggcgcccggaggggaggaaggggccgggccagacguu

SEQ ID NO: 124930 - RNA, 64 nt, Human
accgaggccuaggccccugccacccccaagacugggaggggacuucuuuuucuaaaacacaaaa

SEQ ID NO: 124931 - RNA, 64 nt, Human
gaagcagaaacaaaaugaaaaaaaaaggggggugggaggggaagaaaaacucuauuuuuguaaa

SEQ ID NO: 124932 - RNA, 64 nt, Human
uguuccccaccuaccucagcugggucaggcacagggaggggagggaucagccaaauugggcggc

SEQ ID NO: 124933 - RNA, 64 nt, Human
cccaugaggcccagugacuccacaaccucccugaggaggggauggaggggucaaaucucagaga

SEQ ID NO: 124934 - RNA, 64 nt, Human
uuucauuucacacccccgaagggaggggaggccaggaggggagcugcuccugccagaagcuggu

SEQ ID NO: 124935 - RNA, 64 nt, Human
uuccacuccaucauuucauuucacacccccgaagggaggggaggccaggaggggagcugcuccu

SEQ ID NO: 124936 - RNA, 64 nt, Human
gcccugagccgggggugagggucaccuguugucgggaggggagccacuccuucucccccaacuc

SEQ ID NO: 124937 - RNA, 64 nt, Human
ggagucuccauccccgcucagccuggguugcacuggaggggaggaagaaaguuguuuucagcau

SEQ ID NO: 124938 - RNA, 64 nt, Human
ggccuguccccgauagaauugaagcaguccacggggaggggaugauacaaggaguaaaccuuuc

SEQ ID NO: 124939 - RNA, 64 nt, Human
cuucccgaggcuacagcagacccccaugagagaaggaggggagcaggcccguggcaggaggagg

SEQ ID NO: 124940 - RNA, 64 nt, Human
gaugagggggccaggcgguggcuucucccugcgaggaggggagaauucuuggggcugagcuggg

SEQ ID NO: 124941 - RNA, 64 nt, Human
ugucuuauuuuaccaaaagauggugcaaaucuaugaccuucacauuuuuuccaccacacccacc

SEQ ID NO: 124942 - RNA, 64 nt, Human
aucuaccaaacugaaggggucuccagauuaucuuggaggggacaggaggauggcagagaaacaa

SEQ ID NO: 124943 - RNA, 64 nt, Human
ucaagaguauaucgcgauaagacagugcacagguggaggggaaaaaaagggggagggggaagcu

SEQ ID NO: 124944 - RNA, 64 nt, Human
acaaaaaaccacacacacauuuuguacgggguggggaggggaauggggaggggguuuggcaauc

SEQ ID NO: 124945 - RNA, 64 nt, Human
uggcuuggaguggguuggcuugcugauggcugcuggaggggacgcuggcuaaaguggguaggcc

SEQ ID NO: 124946 - RNA, 64 nt, Human
cuuucccuuccacuucuagagcagggaggcuuggggaggggaaaauuuagcucuggguagcucu

SEQ ID NO: 124947 - RNA, 64 nt, Human
cagggggcguggucugguccccauugcgggcccgggaggggaaugguuucuauggccaaaguuu

SEQ ID NO: 124948 - RNA, 64 nt, Human
gggagggagggcaggguggagggcaaggcuggggggaggggauuggguuuaggaagagcuaggu

SEQ ID NO: 124949 - RNA, 64 nt, Human
aggaaaggaaggaaggaaggaaaaggaggggagaggaggggaaggggaggcagaggaggaacau

SEQ ID NO: 124950 - RNA, 64 nt, Human
cagugcuccaaggaaaggaaggaaggaaggaaaaggaggggagaggaggggaaggggaggcaga

SEQ ID NO: 124951 - RNA, 64 nt, Human
gagaagccauagccccccugggaccuccggacugggaggggagcagaguccccaggagccgagg

SEQ ID NO: 124952 - RNA, 64 nt, Human
ggcuggaugcuuggguaacuggggcagggcagguggaggggagaccuccauucagguggagguc

SEQ ID NO: 124953 - RNA, 64 nt, Human
uuuaagcaauuacuuuucauguugggguggggacggaggggaaagggaagccuggguuuuugua

SEQ ID NO: 124954 - RNA, 64 nt, Human
gugggaggcagguggacuccuggguccccgaggaggaggggacuggggucccggauucuugggu

SEQ ID NO: 124955 - RNA, 64 nt, Human
gcucggccccgggccacuucacggggcgggaaggggaggggaagaagagucucagacuguggga

SEQ ID NO: 124956 - RNA, 64 nt, Human
aaggcaggagguacaccagcuggacaaauugcagggaggggagggagcgagggccaacccggcc

SEQ ID NO: 124957 - RNA, 64 nt, Human
caccaaaguggauaaacuaguacgagauauuuauggaggggacuaugagagguuuggacugcca

SEQ ID NO: 124958 - RNA, 64 nt, Human
cuuggucagagccaaauccuggcaaacgcugccugaccuucacucugugguuggggcggugaga

SEQ ID NO: 124959 - RNA, 64 nt, Human
ggugaaauggcaauuauucucuccaugcuggggaggaggggaggagggucucagacagcuuucg

SEQ ID NO: 124960 - RNA, 64 nt, Human
gagagagggcgcccagcccaggccugguggagggggaggggagaagccaagggacacaggagac

SEQ ID NO: 124961 - RNA, 64 nt, Human
ccugcugugagucugccuaugccagaaggauuaaggaggggagguuacccaagaaacaaagccu

SEQ ID NO: 124962 - RNA, 64 nt, Human
gcaaacauucccuuccauggucagccugccaggaggaggggagucaccuuggggcuggaggccu

SEQ ID NO: 124963 - RNA, 64 nt, Human
ggguuuuuucuauagguuuggcggggggccacagggaggggacccugacaauaaagagauugga

SEQ ID NO: 124964 - RNA, 64 nt, Human
uucuucucccacaucugcccacugaagauuugagggaggggagauggagaggagagguggacaa

SEQ ID NO: 124965 - RNA, 64 nt, Human
ugugccagggacuauucucaggcugaagaaggugggaggggagggcggaaccugaggagccacc

SEQ ID NO: 124966 - RNA, 64 nt, Human
ccuucuacggagaugcaggcagugccacgagggaggaggggaccugcaaagcuagaaucuaggg

SEQ ID NO: 124967 - RNA, 64 nt, Human
ccuaguuucugauuauucggggaugggggggaugggaggggacagggauucacgauccaucgcg

SEQ ID NO: 124968 - RNA, 64 nt, Human
gucucauuaccacugccaaugugguuuuagcaggggaggggaccugcuaagcugagacccauag

SEQ ID NO: 124969 - RNA, 64 nt, Human
cuuuccagcagcugcagcugccguuucucucuggggaggggagcccaagggcuguuucugccac

SEQ ID NO: 124970 - RNA, 64 nt, Human
aggaauugcugauuuggggggugccuggugaugaggaggggauggguuugucuugucuucuuuu

SEQ ID NO: 124971 - RNA, 64 nt, Human
ugcuauggggcauccagggcugugggggucuggaggaggggacaugaggugagagguauccugg

SEQ ID NO: 124972 - RNA, 64 nt, Human
uaggagacagcuuaggguuuggugcgggccacggggaggggaccgggaagcgcuggggcuuguu

SEQ ID NO: 124973 - RNA, 64 nt, Human
gacaugucccugaggggccccuaagaaagaaaguggaggggacacuccagaggcugucguggga

SEQ ID NO: 124974 - RNA, 64 nt, Human
ccugccuguggugugcccggcucugccacucccgggaggggaagggcugcucagcucaaggugu

SEQ ID NO: 124975 - RNA, 64 nt, Human
acacgggagcuucugaagagcugaacauguggagggaggggaacgagaacuuguccaugugcca

SEQ ID NO: 124976 - RNA, 64 nt, Human
ucccacccgccagccccacagaugacuggaggaaggaggggaaauguguagaaagaggcuucgc

SEQ ID NO: 124977 - RNA, 64 nt, Human
gguugugagugugugucccuguguguguguugcgggaggggaggacuggggcuggaaguccagc

SEQ ID NO: 124978 - RNA, 64 nt, Human
auuuauuuuuuuuaauuguauuuuuguuguugggggaggggagacuuugaugucagcaguugcu

SEQ ID NO: 124979 - RNA, 64 nt, Human
cuucacucgcugggaacgucaacccagcgagaaaggaggggaagccccuucuccggggaccuua

SEQ ID NO: 124980 - RNA, 64 nt, Human
ggcugggggagggggcccacccuuaaaggcggcgggaggggagggagggagaguggaggguuug

SEQ ID NO: 124981 - RNA, 64 nt, Human
cggggggagaaguucuugauucagccaaaugcagggaggggaggcagauggagcccauaggcca

SEQ ID NO: 124982 - RNA, 64 nt, Human
cugcccuguuagcuuuccaaggaagcagaagacgggaggggaggcauugacauaggucauaaag

SEQ ID NO: 124983 - RNA, 64 nt, Human
ucguuuuugacuauaaaggagcuuuuuuauuuugggaggggaggagugucauuuuugagaaucu

SEQ ID NO: 124984 - RNA, 64 nt, Human
cauccccauuucaaagcagggagcugagguccugggaggggaaagugcuugccugaggucccac

SEQ ID NO: 124985 - RNA, 64 nt, Human
cugaaucuucucuucacuugcugagaaagucagaggaggggauccaguagcccuuuccacauac

SEQ ID NO: 124986 - RNA, 64 nt, Human
uggccgccuuguguugcuggagacgugggggcagggaggggacagugugggccuggccucuccu

SEQ ID NO: 124987 - RNA, 64 nt, Human
agggccugagagguggccagccaggguuggagcuggaggggauggagccccaccugaggugccg

SEQ ID NO: 124988 - RNA, 64 nt, Human
aaaaaauuaccuucuuuggguggggauugaggguggaggggaggguguuugggaaagauaaaua

SEQ ID NO: 124989 - RNA, 64 nt, Human
ugaauuaauguugacaucugcuccaaagccuuuuggaggggauugggugaggacaguggucuuu

SEQ ID NO: 124990 - RNA, 64 nt, Human
ggagguugugggcaacgguggaggaggagagacgggaggggaccauuugggauggaggggccuc

SEQ ID NO: 124991 - RNA, 64 nt, Human
cugugacuggacucuuccguucuggcuccagccagaccuucagugguccugccuggccgugggg

SEQ ID NO: 124992 - RNA, 64 nt, Human
uaugucuggaaaagcguaggcauccggaggcuuuggaggggagucuggcagcccggcuggccca

SEQ ID NO: 124993 - RNA, 64 nt, Human
ucuuagguggacacagcccugggggcuccuuccaggaggggacccucagcccugugccccccac

SEQ ID NO: 124994 - RNA, 64 nt, Human
cacaguccgcucuuccaaguggacggcagaccugggaggggacgccugugucacgagcccuuuu

SEQ ID NO: 124995 - RNA, 64 nt, Human
ugacuugaaccacucccacgugcugccucccuuaggaggggacacugaugaugaggucucggag

SEQ ID NO: 124996 - RNA, 64 nt, Human
auuaggcaucgggccuaaguguccuggggagauuggaggggacggcagcguucugcaugaugga

SEQ ID NO: 124997 - RNA, 64 nt, Human
cagcucacaggagcgugaaccaugagggcccucaggaggggaacgugguaaaacccaagacauu

SEQ ID NO: 124998 - RNA, 64 nt, Human
cucacaucagaccuggggcaggugcgcaguguggggaggggauggggugcgucagggcccagca

SEQ ID NO: 124999 - RNA, 64 nt, Human
cuccaaggcucuagaggguguucagguacacugaggaggggacggcuccgucuucacauugugc

SEQ ID NO: 125000 - RNA, 64 nt, Human
ggguucagaacacuuuuuaugacaaaaauuggguggaggggauaacuuucauaucuggcucaac

SEQ ID NO: 125001 - RNA, 64 nt, Human
agauaauugaggggcgugucugggggcgggggcaggaggggagcgggguggagggaacacgugc

SEQ ID NO: 125002 - RNA, 64 nt, Human
ggguccucagcugcucccacacuugugccagcccggaggggacuggucccggucaccgcggacg

SEQ ID NO: 125003 - RNA, 64 nt, Human
gacaguguggcuugucacaggccuagagucugagggaggggagugggagucucagcaaucucuu

SEQ ID NO: 125004 - RNA, 64 nt, Human
ugcucccauuucacagaggauaccaccgagacucggaggggacacgaugagcaccaggccccac

SEQ ID NO: 125005 - RNA, 64 nt, Human
cucugagaauccucggggcggucaggggaugucaggaggggaaggagccgcccucccuaucuug

SEQ ID NO: 125006 - RNA, 64 nt, Human
ccaaaagcucucugguuguaaccuggagacauguggaggggaauggcgaugggauuauaggacu

SEQ ID NO: 125007 - RNA, 64 nt, Human
gcuggggucccaggcagcgcugccugggggcuggggaggggaggcccagaggagggcuggccau

SEQ ID NO: 125008 - RNA, 64 nt, Human
gccugcacaggcuggggaguccucaggaccuuaggaccuucauccaggggcugggcuucggguc

SEQ ID NO: 125009 - RNA, 64 nt, Human
cgcgcgcugacacagugaugggcugcccagggcuggaggggacgcuguuccucccgccgccacu

SEQ ID NO: 125010 - RNA, 64 nt, Human
ugcagaguuugggugcuggugguguggcuguaggggaggggagaccacacccaaggugggggcu

SEQ ID NO: 125011 - RNA, 64 nt, Human
ggagacuccaccuggauccccuguaggaggccagggaggggaacucagcaguucaggagccacc

SEQ ID NO: 125012 - RNA, 64 nt, Human
ucaauacugcuccucucuucucagcucagggagaggaggggauccauucucuaaggaccaaacu

SEQ ID NO: 125013 - RNA, 64 nt, Human
acaaaggcaggguccagccugcagggaggccccaggaggggaucuggccagucaaggguccaca

SEQ ID NO: 125014 - RNA, 50 nt, Human
agaaugacauccccuacugaggaggggaccuucgagggccucugccccau

SEQ ID NO: 125015 - RNA, 64 nt, Human
gauccaguacuaucagaaugacauccccuacugaggaggggaccuucgagggccucugccccau

SEQ ID NO: 125016 - RNA, 64 nt, Human
aaagcuguuccuggccgggcaucccagggaagaaggaggggacugcguguaucuccuccaccuc

SEQ ID NO: 125017 - RNA, 64 nt, Human
ugcccaccugccccucaacccuguagcugcagggggaggggacuucauucauggguuggugguc

SEQ ID NO: 125018 - RNA, 64 nt, Human
ccagccuguucucugacuaacgccauccaggcugggaggggaagagugcucugcuacacucguc

SEQ ID NO: 125019 - RNA, 64 nt, Human
aacuugggaucugggaauggaaggugcucccaucggaggggacccucagagcccuggagacugc

SEQ ID NO: 125020 - RNA, 64 nt, Human
caggaccugagaagggccugcucacccuccucggggaggggaagcaccaggguugguggcaucg

SEQ ID NO: 125021 - RNA, 64 nt, Human
gcuggcagaaguuacccuggauagggaagggggaggaggggacuuuuagagccagcaggcccca

SEQ ID NO: 125022 - RNA, 64 nt, Human
cccucauuuuacagaugaggaagcugaagcccggggaggggagcgacccucaaggccacccagc

SEQ ID NO: 125023 - RNA, 64 nt, Human
gaaucaccacccaucuccagcuguggagcccuguggaggggaaggggaagcuugggguucagag

SEQ ID NO: 125024 - RNA, 64 nt, Human
cuuuccuuuguguguauuaagcuuuucaaacaauggaggggauggagagcccugguguccugac

SEQ ID NO: 125025 - RNA, 64 nt, Human
uccccaggguggaugggggaaauggugccuucaagaccuucaccaaacauacuagaagggcauu

SEQ ID NO: 125026 - RNA, 64 nt, Human
ccucuggcccguuggaggggcaggcugaggcuguggaggggacaagcacgccccccagaacgca

SEQ ID NO: 125027 - RNA, 64 nt, Human
cggugagcaguagggagguagaauaucuugguggggaggggauguuaucagcuucugggagaug

SEQ ID NO: 125028 - RNA, 64 nt, Human
ucagaaucauuggccuagaaagucucugauauuuggaggggaacaaaaaucacucacaagcaau

SEQ ID NO: 125029 - RNA, 64 nt, Human
auauuaucuuauuaaggaagaguguuggucuucaggaggggaaguuugcuguauuggaugccau

SEQ ID NO: 125030 - RNA, 64 nt, Human
aucugugcuuccuaaaaggaaauaugcagcacguggaggggaacacauacaugucuugaaaaua

SEQ ID NO: 125031 - RNA, 64 nt, Human
agagggagcugauaucaugaggauaacauuggcgggaggggaguuaacuggcaggcauggcaag

SEQ ID NO: 125032 - RNA, 64 nt, Human
ggucugacggaaugggcaacuuucgccccuguggggaggggacggggaaggaagaaagaauuua

SEQ ID NO: 125033 - RNA, 64 nt, Human
cauaccccaucccuagagugcucuuuucagcuggggaggggaagaggugcuggcuccuuuccag

SEQ ID NO: 125034 - RNA, 64 nt, Human
agagcauccugauaccauucuauucuccagacauggaggggaugauaaaggaaauaggaucucc

SEQ ID NO: 125035 - RNA, 64 nt, Human
ugccccaucuggggacgauauggggagggagaugggaggggaaaggggagaggguuuuucucac

SEQ ID NO: 125036 - RNA, 64 nt, Human
gccuggaauuagcuuggggccagggaagggacugggaggggagagaagagaaggagggaaggau

SEQ ID NO: 125037 - RNA, 64 nt, Human
guuauguggaaguguguguggcagcaggcagcggggaggggaggaacagggaagggggagcugg

SEQ ID NO: 125038 - RNA, 64 nt, Human
gccauguggcaucauugagcagcaggaggcugaaggaggggagaacaaaauuguccaaaccaug

SEQ ID NO: 125039 - RNA, 64 nt, Human
uuuauugcuuuugguauaauuuuucccuggggaaggaggggaaauuaugaaagaacuaguaacu

SEQ ID NO: 125040 - RNA, 64 nt, Human
uuuguuuaauuuauacugguaacuuauuuaggggggaggggacaugaagguagguaaauaggua

SEQ ID NO: 125041 - RNA, 64 nt, Human
uacaaugaugcuauuugcaauuccugcuccuaggggaggggagauaagaaacccucacucucua

SEQ ID NO: 125042 - RNA, 64 nt, Human
gauggucucaggguucugaucuugccuucauguggaccuucaucacuaccucuggccgcaauuc

SEQ ID NO: 125043 - RNA, 64 nt, Human
agcagccccgcuaucuugagauuaguguugacagggaggggaggauugugaggugagggguuaa

SEQ ID NO: 125044 - RNA, 64 nt, Human
acccacgggugucccugcccacucguguggcaagggaggggagggcaggagggcucggccugag

SEQ ID NO: 125045 - RNA, 64 nt, Human
ggagauggggucucagagcgagagcugcggagggggaggggaagaagaaggccucacuuuugcu

SEQ ID NO: 125046 - RNA, 64 nt, Human
cuuucccugacacuuuuggggucugccugggggaggaggggagaaagcaccaugagugcucacu

SEQ ID NO: 125047 - RNA, 64 nt, Human
gacaugcauuccuccuuuugucaucuuguuggggggaggggauuaaccaaaggccacccugacu

SEQ ID NO: 125048 - RNA, 64 nt, Human
gcugcagaugccucugcgcaccaaggaauggagaggaggggacccauguaauccuuuuguuuag

SEQ ID NO: 125049 - RNA, 64 nt, Human
gagacaugagaaccugguaacccugauuaccuugggaggggaaggggcagugguggcugggggg

SEQ ID NO: 125050 - RNA, 64 nt, Human
caauuacuaaaauguaaauaaucacguauuguggggaggggaguuccaagugugcccuccucuc

SEQ ID NO: 125051 - RNA, 64 nt, Human
guugcacuuuacuggguuuuauccaguuuuaggaggaggggaggcaaugucaaaauguacaccu

SEQ ID NO: 125052 - RNA, 64 nt, Human
uugacaugcuucuucgaggguuggcagcacaccgggaggggaugcuuggacaaguuucugggcc

SEQ ID NO: 125053 - RNA, 64 nt, Human
uuuaaucuuugaaaauuauuuuuaagcgaauuggggaggggaguauuuuaaucaucuuaaauga

SEQ ID NO: 125054 - RNA, 64 nt, Human
aauuuggcaagaaugaaauggugucauaaagaugggaggggaggguguuuugauaaaauaaaau

SEQ ID NO: 125055 - RNA, 51 nt, Human
cgcuuggugauuccauguaaaggaggggagagugcucagaguccagaguac

SEQ ID NO: 125056 - RNA, 64 nt, Human
guucuuguuuugagggugaggacaaggguuguggggaggggauguuuuuuaacaggacuuuuua

SEQ ID NO: 125057 - RNA, 64 nt, Human
ugccuuuucccgaggcuggggcuggggguggcugggaggggaagggaagggagaggcaagcugg

SEQ ID NO: 125058 - RNA, 64 nt, Human
caccccauccccagcuagcccaagcuccaggucaggaggggagggugcugggccugacauggcu

SEQ ID NO: 125059 - RNA, 64 nt, Human
ccucccccaaaucgucauggaaaggguggagaauggaggggaaccaggcguccuuggaggcagc

SEQ ID NO: 125060 - RNA, 64 nt, Human
gugcguuccugagggccaggucgggggcaggcauggaggggaggaaaggcgucccucuuggccc

SEQ ID NO: 125061 - RNA, 64 nt, Human
gaggcugaggacgugaaccgcgggcuuuggaaagggaggggagggagacccgaaccucccacgu

SEQ ID NO: 125062 - RNA, 64 nt, Human
aacgggggcgggagagaguggugaucuguggucagugggucagugaccugcacggugauucucc

SEQ ID NO: 125063 - RNA, 64 nt, Human
ggacuacacgaggcgcugcggcuccaccugaccagugggucagcaggcacggcuggcagccuuc

SEQ ID NO: 125064 - RNA, 64 nt, Human
agacuuuuaaagauuuuccucccuccuguuucaggugggucacauucugaugaauguuucccuu

SEQ ID NO: 125065 - RNA, 64 nt, Human
augcuuaaacauaagcgaaaccaguagcaaguaugugggucagcuuaaaaauuuugauuguuaa

SEQ ID NO: 125066 - RNA, 64 nt, Human
uggcuggcaucuggcacuugcaauuuuggauuuugugggucaguuuuacguacauagggcauuu

SEQ ID NO: 125067 - RNA, 64 nt, Human
gaaaccaaagcugcuauuguugaggaauaauucagugggucaaaauggggagauguacugggua

SEQ ID NO: 125068 - RNA, 64 nt, Human
gugccaggagaacccccgcuccgagucagccugugugggucaugaggcuggggcccaggagaca

SEQ ID NO: 125069 - RNA, 64 nt, Human
agcuguccacauuuuugcuguguauuaaauagcugugggucaucaguugcugucuuacuugugu

SEQ ID NO: 125070 - RNA, 64 nt, Human
caauaguaucuucaaggccuuggggaaacuugcagugggucaguggucugugccaaccaaacga

SEQ ID NO: 125071 - RNA, 64 nt, Human
aacuuuguuggagaauuucccccacccccauccagugggucacccaggaguaaugucccuccag

SEQ ID NO: 125072 - RNA, 64 nt, Human
ccuguaaucccagcacuuugggaggccaaggugggugggucaucugaggucaggaguucaagac

SEQ ID NO: 125073 - RNA, 64 nt, Human
agauguggcucuaccuacuaugaugaaaauugaagugggucaaaagaauuagauguacagugaa

SEQ ID NO: 125074 - RNA, 64 nt, Human
uuaguuauuaugaguguaggacacugagccauccgugggucaggaugcaauuauuuauaaaagu

SEQ ID NO: 125075 - RNA, 64 nt, Human
gaagucuucccucagauuuccauuguguggccuggugggucagggggagucuuugcaccaaaga

SEQ ID NO: 125076 - RNA, 64 nt, Human
uggggucagggaaggaagaucuaaagaacccacugugggucaggggaaugggaccagcaggaca

SEQ ID NO: 125077 - RNA, 64 nt, Human
gucguccuggggcaguuuuaguucuuuauauuuagugggucagugccaagugcuaccacuuccc

SEQ ID NO: 125078 - RNA, 64 nt, Human
gcaguagcaaggagaggggggaucauuuuagagagugggucauuggcagggagugcuccggagg

SEQ ID NO: 125079 - RNA, 64 nt, Human
ccaugcuucccugcccuuaaacgcagagcuuuuagugggucacagagcgggaacuacacacaag

SEQ ID NO: 125080 - RNA, 64 nt, Human
agucuuguucucuugucuguggucuguuuaauaugugggucacuaggguauuuauucuuucucc

SEQ ID NO: 125081 - RNA, 64 nt, Human
aaguauuuuauaaauguauuuaugcugcuagacugugggucaaauguuuccauuuucaaauuau

SEQ ID NO: 125082 - RNA, 64 nt, Human
acugugaaauauaucaguuggugagccgggcguggugggucacgccuguaaucccagcacuuug

SEQ ID NO: 125083 - RNA, 64 nt, Human
ucaccuacuagaagagaaaugcccagucuuagaggugggucagguguagagcuggagggggucc

SEQ ID NO: 125084 - RNA, 64 nt, Human
ccuguagagacaauacaguaagcauaguuaaggggugggucagaacauguuaagauaacuuacu

SEQ ID NO: 125085 - RNA, 64 nt, Human
gaggggcuggccagagggagaggcagcagggaacgugggucaggguggggcaacaguggcauca

SEQ ID NO: 125086 - RNA, 64 nt, Human
aaaaggccucugccuuccucaggagggacacauagugggucaucacccuuucucacaccugcuu

SEQ ID NO: 125087 - RNA, 64 nt, Human
uagucacuaucagcacaauuagguuaauaaagaagugggucauuauauucaaagagugcucagg

SEQ ID NO: 125088 - RNA, 64 nt, Human
acuugggauuaauauggggaugcagcauuaugaugugggucaaggaauuaaguuagggaauggc

SEQ ID NO: 125089 - RNA, 64 nt, Human
accaaccacuguggggcaugugggagucacacacgugggucacacugagucuuaucagccacgu

SEQ ID NO: 125090 - RNA, 64 nt, Human
acccccaaccccuugugucacaaaugggcucugugugggucaccccagcugacccguguaugug

SEQ ID NO: 125091 - RNA, 64 nt, Human
aucucuuggauugagggugugugggcuggaaccagugggucacuguggcagcuucaucugagcc

SEQ ID NO: 125092 - RNA, 59 nt, Human
ccuccaagaucaaaugcuaaauagaaccugugggucacaaggacccuaggcccagcggc

SEQ ID NO: 125093 - RNA, 64 nt, Human
uaggccaucuccugaggccuuuucccucgcccaugugggucagugggagcugcaggugucagcu

SEQ ID NO: 125094 - RNA, 64 nt, Human
cgaggucccucaguccuccccugucccuuccaaggugggucaggagguucuggccccgcugggg

SEQ ID NO: 125095 - RNA, 64 nt, Human
uucugugugugaugugcaugggagcaacuuguucgugggucaucgggaauacuagggagaaggu

SEQ ID NO: 125096 - RNA, 64 nt, Human
gaugggggcuugagaaaucaacaggugcagcccagugggucagaggaaagcgugcucgaaggau

SEQ ID NO: 125097 - RNA, 64 nt, Human
cagugaucuuagcuuccuugcuuacaauuguucagugggucaucuaaauucuucuauguccuga

SEQ ID NO: 125098 - RNA, 64 nt, Human
acauuggacuauaauguaaaaugugucuuuuauugugggucauagucacugaaguuugaaaaac

SEQ ID NO: 125099 - RNA, 64 nt, Human
ccuuuuuuuugugcuguacaaugucuacuguacugugggucauuuagaugagaugaaaaacuua

SEQ ID NO: 125100 - RNA, 64 nt, Human
aucaaccuacugaaguuguguggagggauggaaagugggucaguggagaagggauucagaaaau

SEQ ID NO: 125101 - RNA, 64 nt, Human
auuuuuuuuuuuaagaaauaaagggagcuguguagugggucaguggcuagguagguuagugaag

SEQ ID NO: 125102 - RNA, 64 nt, Human
ccuguaaucccagcacucugggaggucgaggugggugggucaccugagguugggaguucgagac

SEQ ID NO: 125103 - RNA, 64 nt, Human
gaggccagcuccuggcaggcccucgcgaugagcagugggucagcugcggugugggaugcuggag

SEQ ID NO: 125104 - RNA, 64 nt, Human
cagcaaaacagauucaaagcgaacaguccaaucagugggucauauguuuauucaaaauauuuua

SEQ ID NO: 125105 - RNA, 64 nt, Human
ccaccuccuuggaggagagagacauacaaggacagugggucauggguaguaccagccucaaauu

SEQ ID NO: 125106 - RNA, 64 nt, Human
aucugaaguggguacauuuuuuaaauuuugcugugugggucacacaaggucuacauuacaaaag

SEQ ID NO: 125107 - RNA, 64 nt, Human
agggaugcagacuugaagagucugaggaacugaagugggucagcaagaccucugaaauccuggg

SEQ ID NO: 125108 - RNA, 64 nt, Human
gaacuuccagaguagccacugcucccaguuaaaggugggucaguagccuugcagaacuguccug

SEQ ID NO: 125109 - RNA, 64 nt, Human
caaagaguuuggucucuaaguugauuuguacccagugggucaacuucugcaaaauuccguaaug

SEQ ID NO: 125110 - RNA, 64 nt, Human
auagaccugucuuccugcacacuuucaguuggaugugggucauuguggagacagaggugucugc

SEQ ID NO: 125111 - RNA, 64 nt, Human
uacuccccauggcagcauggaggaggcaagaccugugggucaauuuugaacuggccuuacuuug

SEQ ID NO: 125112 - RNA, 64 nt, Human
aaauuuugacagcucuuuaagcccacaugcagcagugggucagauaacccuguggcagugacac

SEQ ID NO: 125113 - RNA, 64 nt, Human
cugcuggcgcccaauacaaaacccauacauccaggugggucacaucuacuucuggcggccgcag

SEQ ID NO: 125114 - RNA, 64 nt, Human
caaauugcuucaauuuucucuguggcccaaacuugugggucacaaacccuguugagauaaagcu

SEQ ID NO: 125115 - RNA, 64 nt, Human
cuuugauuaaaaaaaagacccccagcaauaaaaagugggucacucuaugcccucugugcacauu

SEQ ID NO: 125116 - RNA, 64 nt, Human
uguggggaaagagaagagcagucauggcccugaggugggucagcuacucuccugaagaaauagg

SEQ ID NO: 125117 - RNA, 64 nt, Human
uaaggcaaugcuucucuucccuggauuccuuagugugggucacaguacuguguucuuaguugcu

SEQ ID NO: 125118 - RNA, 64 nt, Human
caggcgaggacccugcaccuggaugggggucccugugggucaaauuggggggaggugcuguggg

SEQ ID NO: 125119 - RNA, 64 nt, Human
uuaaauaagauaaaauaaaaauuggccgggcguggugggucacgccgguaaucccagcacuuug

SEQ ID NO: 125120 - RNA, 64 nt, Human
cagcauacuugaauauuagagaaggagaggagcugugggucaggaaucagagagaccugcuaaa

SEQ ID NO: 125121 - RNA, 64 nt, Human
aggggcugggguagggcauguaggagggaggugggugggucaggugaguggaagggguguugua

SEQ ID NO: 125122 - RNA, 64 nt, Human
guuccccauguccuugccgugggucauccuugcugugggucauccuugcuguggagauccauuc

SEQ ID NO: 125123 - RNA, 64 nt, Human
gguggcugugauacagguuccccauguccuugccgugggucauccuugcugugggucauccuug

SEQ ID NO: 125124 - RNA, 64 nt, Human
acaggacacaguuuacugaucucuguucuagugagugggucaaaaagcauaugcauccuuaucc

SEQ ID NO: 125125 - RNA, 64 nt, Human
aaaggggcuuccuugucagggccugguggaguuggugggucaucggggcucacugccuccugcc

SEQ ID NO: 125126 - RNA, 64 nt, Human
uacuacccuucccacauacaccugagccacuguggugggucacaguguggcuauguuaucuaug

SEQ ID NO: 125127 - RNA, 64 nt, Human
cucaaagcuggcauccuccuaugucaccuagagugugggucaaagcaauacaccuacauguaga

SEQ ID NO: 125128 - RNA, 64 nt, Human
ggucuccggggaggcagggguccugcagguccuggugggucagcccagcaccugcucccagugg

SEQ ID NO: 125129 - RNA, 64 nt, Human
ggacucugaaauaucccggggguggggggugggggugggucagaacccugccauggaacuguuu

SEQ ID NO: 125130 - RNA, 64 nt, Human
cuccugacugucguguuuccuuuuuauuacagaggugggucacuguuuaccuuguuucaggggu

SEQ ID NO: 125131 - RNA, 64 nt, Human
aaucuauggacaugcccauauaugaaggagaugggugggucaaaaagggauaucaaaugaagug

SEQ ID NO: 125132 - RNA, 64 nt, Human
aagagaaaauauauuuacuauucauuaaauggaagugggucaacauaaaagucuucauucucau

SEQ ID NO: 125133 - RNA, 60 nt, Human
ucaagcagauguauggcuaaccggaaacaggugggucaccuccugcaagaaguggggccu

SEQ ID NO: 125134 - RNA, 64 nt, Human
agauacccagaagcuuguucugggagaagcuagggugggucagaguagaccugauggguaacuc

SEQ ID NO: 125135 - RNA, 64 nt, Human
aaaaaaaaaaaaaaaaaauuaaaguuauuuguuugugggucagucauguaaccacuugugugcc

SEQ ID NO: 125136 - RNA, 64 nt, Human
ccagccuuucaaagcugacucuucucaaucaucugugggucauuugacuugauuuuuuaagcua

SEQ ID NO: 125137 - RNA, 64 nt, Human
aggaccuuaaauauuggaaagcauucucaaaacugugggucagugaguagaacuacaaaacaau

SEQ ID NO: 125138 - RNA, 64 nt, Human
gaggcuucugguucaccgcccugauuccacagaugugggucagaggcagagauggaaguuggaa

SEQ ID NO: 125139 - RNA, 64 nt, Human
gucucucagaaguugcaucauuagccaguaguaggugggucacauaguaccugguguacacauc

SEQ ID NO: 125140 - RNA, 64 nt, Human
cgacacgcugcugugagggucccggugagauggagugggucacaccuggcaagcuggaagaaag

SEQ ID NO: 125141 - RNA, 64 nt, Human
cugugcaaaaaugguuugggauaggcugggugccgugggucacgccuguaaucccagcacuuug

SEQ ID NO: 125142 - RNA, 64 nt, Human
cgagggagagucuuggggccaagaagggcccagggugggucaggcgugugcacuguggaacaga

SEQ ID NO: 125143 - RNA, 64 nt, Human
uggacucaccugaggaaagaggcuccagcauggggugggucagagaugugcuugcaagguccag

SEQ ID NO: 125144 - RNA, 64 nt, Human
auucuuaacacuacauggaauucacuggguaauugugggucauuuauuuccugaaagucacgug

SEQ ID NO: 125145 - RNA, 64 nt, Human
cguguuuacauggucacacguguguguaucaccagugggucaacugcuugucauuccucccgug

SEQ ID NO: 125146 - RNA, 64 nt, Human
agagugauguuucuccuaaggccaaaccccaggggugggucauuugagaggaguuccagcuguu

SEQ ID NO: 125147 - RNA, 64 nt, Human
gcagcaggauagagacgccgagagaggaguauaugugggucacagcagugagcucccacccgcc

SEQ ID NO: 125148 - RNA, 64 nt, Human
gucuuucagaaguugcaucauuagccaguaguaggugggucacauaguaccugguguacacauc

SEQ ID NO: 125149 - RNA, 64 nt, Human
acugauaaaggcuuuauuagguauaucugaggaagugggucacaugaaauguaaaaagggaaug

SEQ ID NO: 125150 - RNA, 64 nt, Human
aggaauacuuugcuaugccucacugcccaauagggugggucaucaauuaggagaaaucccaaau

SEQ ID NO: 125151 - RNA, 64 nt, Human
ccaaaagaccucuuacuuugggaggccaaggugggugggucacuugaacccaggaguuugacau

SEQ ID NO: 125152 - RNA, 64 nt, Human
auugcauuuugcuuugguaaugaguuuacagagagugggucaucuuugaagcaucaaauccuga

SEQ ID NO: 125153 - RNA, 64 nt, Human
auggcuucauagugaagugccucccacagggcgggugggucagcguugacucuuuccagcugca

SEQ ID NO: 125154 - RNA, 64 nt, Human
aggaugugggcagggacgggguacagaggauagugugggucagaggugccaguaguauaauauu

SEQ ID NO: 125155 - RNA, 64 nt, Human
gcaacuaaagggauaccucaggcuuucuuucccagugggucauuuuuguccuaguucagugugu

SEQ ID NO: 125156 - RNA, 64 nt, Human
ccuaguuaagagaaaaaaaaaguaaaaacaaauugugggucaaaguaaauguauacaguuuuau

SEQ ID NO: 125157 - RNA, 64 nt, Human
gguguuuuggcagcaaagcaggaagcaauuuugugugggucauuguucugucaauuuguggaaa

SEQ ID NO: 125158 - RNA, 64 nt, Human
cacugaaaugaccaagacagguucagguaggggugugggucaaaccaagaagugggugcccuug

SEQ ID NO: 125159 - RNA, 64 nt, Human
ucugagaggaggggccacauaggaaagccccacggugggucagaaggcggaaggagggagggga

SEQ ID NO: 125160 - RNA, 64 nt, Human
gugggagcgggggggacagugccccgggaacccggugggucacacacacgcacugcgccuguca

SEQ ID NO: 125161 - RNA, 64 nt, Human
cucuuuagucuuuuccaccuuucacauccaaggggugggucaagugcagccagcaauuuauuuu

SEQ ID NO: 125162 - RNA, 64 nt, Human
acaaguugcuaagcacuuaggaccauuugagcuugugggucacccacucuggaagaaauaguca

SEQ ID NO: 125163 - RNA, 64 nt, Human
aucaagaucuuauuuuacugaugcauaaguccuagugggucaagacuaggcauaugcuuucaga

SEQ ID NO: 125164 - RNA, 64 nt, Human
gcagcugucaccuucucuuuauuggugguccuaagugggucacuuaagaaaaaaaaguguaaca

SEQ ID NO: 125165 - RNA, 64 nt, Human
acagcggcaaccaagaggccuugcagcccuggaagugggucagggcccuugguggucaccuuuu

SEQ ID NO: 125166 - RNA, 64 nt, Human
auuauguccaaaugcaguauccuugaggaauauagugggucaguuaaauaucuagagacauaca

SEQ ID NO: 125167 - RNA, 64 nt, Human
cagggggccugcaggccccagccaagugccuuccgugggucaucccagcaccugccagggcccg

SEQ ID NO: 125168 - RNA, 64 nt, Human
caccucuguacacuucccugacaccuucccaggugugggucacugccaccugugcccaugggca

SEQ ID NO: 125169 - RNA, 64 nt, Human
auuuaucuaaauuaaauuggcccaggguuggcuggugggucacccagcagaggcuucuccccau

SEQ ID NO: 125170 - RNA, 64 nt, Human
agauuagcugugaacaugugggagcccgaugcaugugggucagggaucugggggcccccccagc

SEQ ID NO: 125171 - RNA, 64 nt, Human
caagaguugccuggacagggcaagucauguuagcgugggucacacuuccaagauauuuaaagca

SEQ ID NO: 125172 - RNA, 64 nt, Human
aaaaggaaaaagcuccaugugccucuuugucugcgugggucagaagaguugugcacgcagauua

SEQ ID NO: 125173 - RNA, 64 nt, Human
aucaggcaagacucuagguuccacacuaaauuaagugggucaguaccaacaaugaacacauuau

SEQ ID NO: 125174 - RNA, 64 nt, Human
uuagaauuuuaaaauaaaauaauugggaaagaaggugggucauguauuaaucagugaacagaga

SEQ ID NO: 125175 - RNA, 64 nt, Human
agccauucucccaaacuaaugauucuugggugcugugggucaccaacaggcuguuuacaaagca

SEQ ID NO: 125176 - RNA, 64 nt, Human
ccgcacgaggacggagaacacaaacuccgcaucugugggucaggcaguuugagaggcuuuugag

SEQ ID NO: 125177 - RNA, 64 nt, Human
ucucagcaccugccaguuaugcaaaugccaaaaugugggucaucauauaguauauuugaaaccu

SEQ ID NO: 125178 - RNA, 64 nt, Human
guuaggagguugaggcacagccugugcagagagggugggucacccccccagauccaaggagaaa

SEQ ID NO: 125179 - RNA, 64 nt, Human
gccuaaucuuugaaguuuguucuuugguauugaugugggucagaaggagccucauccuaaucuc

SEQ ID NO: 125180 - RNA, 64 nt, Human
gcuuuuaacucuucuuccuucugugccucucuaagugggucaguauccuaaggaagccuucuua

SEQ ID NO: 125181 - RNA, 64 nt, Human
cacacuaccuuguaguuuuuaauguggggguagagugggucagcaggagggagcugguuuuaug

SEQ ID NO: 125182 - RNA, 64 nt, Human
accagaguggcugcaggccaggccuggaguccccgugggucaagcauuugucuugacuugcuuu

SEQ ID NO: 125183 - RNA, 64 nt, Human
uuguucuguuugguuuugguuuuguuuggggugggugggucauugcggucuuagauuauguuuc

SEQ ID NO: 125184 - RNA, 64 nt, Human
ggugucugucuauggccacagccaaccagaaugagugggucaucuuauaaccuuucugaagcuc

SEQ ID NO: 125185 - RNA, 64 nt, Human
gaccagaaggccugcuguaaucagugugacuacugugggucagcuuauauucagauaagcuguu

SEQ ID NO: 125186 - RNA, 64 nt, Human
guccuggugaauuagucucagcacaggaauugaggugggucaggugaaggaagaguguauguuc

SEQ ID NO: 125187 - RNA, 64 nt, Human
cucagguuggcccuuucccaagcacuguaagugagugggucaggcaaagccccaaauggagggu

SEQ ID NO: 125188 - RNA, 64 nt, Human
cuuaccuacaaaauacuccuuugcaaugauaauugugggucaggaaucuucuuccuguguggca

SEQ ID NO: 125189 - RNA, 64 nt, Human
gauguugcuucuugauuuuuuuuuuuuuuuaggggugggucaggguugugacacaccagcccag

SEQ ID NO: 125190 - RNA, 64 nt, Human
ccugcuuguguugggccccagggaacuaaagggugugggucagggaggggucuagaggcuauuc

SEQ ID NO: 125191 - RNA, 64 nt, Human
ggauuguccacaaauguccucagagggucccuaggugggucaacuccaaggcaaauguccaagc

SEQ ID NO: 125192 - RNA, 64 nt, Human
auaaggguccccuccucacuggagacuacaaguggugggucaggugguccuaggacccagggga

SEQ ID NO: 125193 - RNA, 64 nt, Human
auuuauccggugggugggacaggaguguguucaagugggucauguuuuugcuguggugacacau

SEQ ID NO: 125194 - RNA, 64 nt, Human
ggugugacaugaggaccguuccuaggaugggacagugggucaggcaggacaaggagaaagcagg

SEQ ID NO: 125195 - RNA, 64 nt, Human
ggccuuggggcugacugcauguggcagaaaacgggugggucagcccuugaaaagucuugagaua

SEQ ID NO: 125196 - RNA, 64 nt, Human
ccuggagacaguaacauuucauuaaccaaagaaagugggucaccugaccucugaagagcugagu

SEQ ID NO: 125197 - RNA, 64 nt, Human
gcuuuugaaggaucuauaguaucauuuuaguuaagugggucaaacagaaucaaaacaaaaccca

SEQ ID NO: 125198 - RNA, 64 nt, Human
uccuucccucuccagccugcuguauaaguaacaugugggucauaccuugaaccccccuccgccc

SEQ ID NO: 125199 - RNA, 64 nt, Human
ggugccuaauugggaaccagggcaugggaaaggagugggucaaaauucuucucuuucuccucca

SEQ ID NO: 125200 - RNA, 64 nt, Human
gaauauggccauuccuacacaggugggguagagagugggucagcagccuggcaccucacagagg

SEQ ID NO: 125201 - RNA, 64 nt, Human
uugcauuguuaaggagguuuuuuguuuuuaaauggugggucaaggagcuaguuuacaggcuuac

SEQ ID NO: 125202 - RNA, 64 nt, Human
uuguaauccuaguucuaugaagcugugugagcaggugggucaaaugccauugccuccacuuuuc

SEQ ID NO: 125203 - RNA, 64 nt, Human
aggcuccuuugggcaaaaggcaagacucuggcaggugggucaaugcucucuccuuggagcaaga

SEQ ID NO: 125204 - RNA, 64 nt, Human
accuggcaugggcuucguggccugcucucaggaagugggucaagcccugggaacccucauccau

SEQ ID NO: 125205 - RNA, 64 nt, Human
ggggcucuacucauaguggcacaaccuuuuagaggugggucagccuccccuccaccacuuccuu

SEQ ID NO: 125206 - RNA, 64 nt, Human
aguuaccuaacguucuucuugaauaacuaauacagugggucaaauauuauaaaauaggcaaaca

SEQ ID NO: 125207 - RNA, 64 nt, Human
cauuuuguagcuuguuagauuuucugccagaggggugggucagagcaguggaggggagacaucg

SEQ ID NO: 125208 - RNA, 64 nt, Human
cgacuccgcaccccaguucgcagugaggcccugggugggucaccugcccucucuggacuuguuu

SEQ ID NO: 125209 - RNA, 64 nt, Human
cuuuugcaaacuguccucuacaucaauuaacaucgugggucacuacagggagaaaauccagguc

SEQ ID NO: 125210 - RNA, 64 nt, Human
aaauucacagaguuucacccuuaagcuguagagagugggucacauuuguuagccacggaaacau

SEQ ID NO: 125211 - RNA, 64 nt, Human
cuauaauaccucuuaauuuaccuuuuuaaaagcugugggucagucuugcacucccaucaacaua

SEQ ID NO: 125212 - RNA, 64 nt, Human
ccaugucuugguuauagguuuuauguuuuguuuugugggucauagggagcacauuucaccugug

SEQ ID NO: 125213 - RNA, 64 nt, Human
cccauccaaccacuguacacacccgccugacaccgugggucauuacaaaaaaacacguggagau

SEQ ID NO: 125214 - RNA, 64 nt, Human
uucugacccucaccagggcuguggaagggugggggugggucauuauaguauucaggauuuacag

SEQ ID NO: 125215 - RNA, 64 nt, Human
cccagaaggggccagugcgggcagccagggccuagugggucauuggccaucuccgccugccuaa

SEQ ID NO: 125216 - RNA, 64 nt, Human
ugaaagcuccaugauaagcacagagaugggcagugugggucagaaggugggccgcuuccugugg

SEQ ID NO: 125217 - RNA, 64 nt, Human
gauggaguccgaggagacugcugggagccgccgugugggucagagauggagaaggcugagugca

SEQ ID NO: 125218 - RNA, 64 nt, Human
augccauugccugagcugacagccaagcccuucugugggucaccuuucuccucacccagccccu

SEQ ID NO: 125219 - RNA, 64 nt, Human
aaugaaagugagagauuucuaaacuuuugcgaaagugggucauuuuuuguuugacuauaauagc

SEQ ID NO: 125220 - RNA, 64 nt, Human
acauccagccagacccgaccagcuccgggauggggugggucacagcaaaaggaccagaugcugg

SEQ ID NO: 125221 - RNA, 64 nt, Human
caauuguggcccacuaaaaucuacagaaguuaaugugggucaccauuuuggucagaagcauaca

SEQ ID NO: 125222 - RNA, 64 nt, Human
cugcuaccugcuucauuguccauccccugggggagugggucagagguacuggagggugcugagc

SEQ ID NO: 125223 - RNA, 64 nt, Human
ggacuggccucugcugauccucccaggcuuccgugugggucaguggggcccauggaugugcuug

SEQ ID NO: 125224 - RNA, 64 nt, Human
gagcuucuuggcaggacaucaguaccaacuagaagugggucauagauagauuaccagggaugca

SEQ ID NO: 125225 - RNA, 64 nt, Human
cugccacccugcccuagggucucacuaguaccaagugggucagcacagggcugaggauggggcu

SEQ ID NO: 125226 - RNA, 64 nt, Human
accaggcuuuguuuacacuuggagccaccuuggugugggucaccgggacaguguacuccucucc

SEQ ID NO: 125227 - RNA, 64 nt, Human
cccuguggcacguuaccauggaagccgcuccagggugggucagggugcaagcugcuggugaggu

SEQ ID NO: 125228 - RNA, 64 nt, Human
caaaccagagcccagccaucccuccgguaucggggugggucagaaaaagucucaccucaauuug

SEQ ID NO: 125229 - RNA, 64 nt, Human
ccuguaaucucagcacuuugggaggccaaggcaggugggucaccuggggucaggaguucgagac

SEQ ID NO: 125230 - RNA, 64 nt, Human
ggcugucaggggcguuugcgccaccugcaagggcgugggucagagaguuuuuaugggggucugu

SEQ ID NO: 125231 - RNA, 64 nt, Human
ugaaggguuucugcaaccuggaccccaucugggugugggucagacccugugacccacaugccac

SEQ ID NO: 125232 - RNA, 64 nt, Human
agcuugggaucagaagucagaaguuuggaauguggugggucaaaggacaauaugggugggcauu

SEQ ID NO: 125233 - RNA, 64 nt, Human
uagaggaucugcuccacugucuccuggggcaguugugggucacugucccuuccagcugccccag

SEQ ID NO: 125234 - RNA, 64 nt, Human
caaaacaaaaaaaaaaagcuauccaccuuuccaugugggucaaacuaaaauuagaaaugucccc

SEQ ID NO: 125235 - RNA, 64 nt, Human
gccuguccuugguggccgggggugggggccugcugugggucagugugccacccucugcagggca

SEQ ID NO: 125236 - RNA, 64 nt, Human
aaaccucucagcacuaauuaguguccaacuccaagugggucaauuccuuaguauaauauuaagg

SEQ ID NO: 125237 - RNA, 64 nt, Human
gcucuguaccacgcuggccaucugucuccuguaugugggucaaagugcggcugccauuggagcc

SEQ ID NO: 125238 - RNA, 64 nt, Human
gaaggacuuucucccaggggaagcccccagcccugugggucauggucugugagagguggcagga

SEQ ID NO: 125239 - RNA, 64 nt, Human
cucccaugucaugaaguuaccuagucagguucccgugggucacuugcuacuccuaagggaaguu

SEQ ID NO: 125240 - RNA, 64 nt, Human
gaauuuuaccugauuaacauuccugacaccaucugugggucauccuuucccuggaccguucagu

SEQ ID NO: 125241 - RNA, 64 nt, Human
gagccucugcccucccaaaacuaagcgggggggcgugggucaaaucauagccaagugacuuguu

SEQ ID NO: 125242 - RNA, 64 nt, Human
acucugcagagaccagcggcuucgugggaggccugugggucacacguaggggcuagagccagcc

SEQ ID NO: 125243 - RNA, 64 nt, Human
ugcacauuugaacuagucacucucccagacuugcgugggucaguucuuucugaguagaggacuu

SEQ ID NO: 125244 - RNA, 64 nt, Human
ggcagcuggagccgaagagcaccacucccuguaggugggucauucucucucuccuaccauaauc

SEQ ID NO: 125245 - RNA, 64 nt, Human
gcuaagucccagcaauacaaaggacauaagaaaagugggucaccacgugguguucacauacauu

SEQ ID NO: 125246 - RNA, 64 nt, Human
ucuucagaguaaucucucugcuaaaaugguacaugugggucacagauugguuuaugccacugac

SEQ ID NO: 125247 - RNA, 64 nt, Human
gacccaguuuccagagagcaggcggggccgcccagugggucaggcacagggagccccgguccua

SEQ ID NO: 125248 - RNA, 64 nt, Human
uuuuauugaaugcuuauagguuuuuuuuaaauaagugggucaaguacaccagccaccuccagac

SEQ ID NO: 125249 - RNA, 64 nt, Human
aguaaugauauuuaaauauuuugagugagggggagugggucaaagaggaaguagagguguaauc

SEQ ID NO: 125250 - RNA, 64 nt, Human
ucuggagaccucgacagccugcccuaggcccugggugggucaggacaaaggccucucaucaccg

SEQ ID NO: 125251 - RNA, 64 nt, Human
agaaacaacacaugcuuauuaucucauagauucugugggucaagagccugggugcagguuggcu

SEQ ID NO: 125252 - RNA, 64 nt, Human
gauuuucaaaaggggagggagugugcaaauaggugugggucacagacaucaaguacuuuacaag

SEQ ID NO: 125253 - RNA, 64 nt, Human
cucuggcuccagugaagcugaauguccucacuuugugggucacacucuuuacauuucuguaagg

SEQ ID NO: 125254 - RNA, 64 nt, Human
guaaaaacuauucuuagcuguacagaaacagauggugggucagauuugacucacugcccauagu

SEQ ID NO: 125255 - RNA, 56 nt, Human
auggcuccauugcuguauagggccuugugggucaggacgcuuggcugccuuccugc

SEQ ID NO: 125256 - RNA, 64 nt, Human
gcccccaccccgagucacaccagaaagcuaggucgugggucagcucugaggauguauaccccug

SEQ ID NO: 125257 - RNA, 64 nt, Human
cuucugaagaugguaaaggacuuggccagauguggugggucacacuuguaaucccacuacuuug

SEQ ID NO: 125258 - RNA, 64 nt, Human
ccgucuacuccuguucuggccugagaccaccggugugggucacgagggcccuggcccacagugu

SEQ ID NO: 125259 - RNA, 64 nt, Human
aaggcauccccaggcccugcucuuccucagcugugugggucauaccguguaccucaguucccuc

SEQ ID NO: 125260 - RNA, 64 nt, Human
cacuuucucuguuaaguuuucucauuuguaaaaugugggucauaauucugccuuccucuagggg

SEQ ID NO: 125261 - RNA, 64 nt, Human
caucuugacuaggaagcuccucguuugugugagcgugggucagaccgccaaaguaggacuucau

SEQ ID NO: 125262 - RNA, 64 nt, Human
uuuuaaauuaagccacugugcugccuuagauuccgugggucaugagccaugaguccugggacau

SEQ ID NO: 125263 - RNA, 64 nt, Human
uuccagcccugugcugggccuguagagcugacaggugggucacacucagaccuggggacagagg

SEQ ID NO: 125264 - RNA, 64 nt, Human
gagcgggcagaggccgcagggcuggcucgggcaggugggucacguggucugcagaaccaaagag

SEQ ID NO: 125265 - RNA, 64 nt, Human
cuuaccaacauguaaagcuguucauuuuuccaccgugggucaccaaugccagaaaaccagacau

SEQ ID NO: 125266 - RNA, 64 nt, Human
cgccuggcuucuggagugcuucaagcagagcauggugggucauugaggagacccaggaaucuca

SEQ ID NO: 125267 - RNA, 64 nt, Human
caugguaagagucacaauuugcaaauuuaggaccgugggucaugcagcgaaggggcuggauggu

SEQ ID NO: 125268 - RNA, 64 nt, Human
ucaucgaucuaggcaccugcugucugaagggaccgugggucagaaucauuucguugugcuccua

SEQ ID NO: 125269 - RNA, 64 nt, Human
accucugcuggucccaagggagaagggagugagcgugggucaccuggggaaaaucucaucugau

SEQ ID NO: 125270 - RNA, 64 nt, Human
ccugugcuuuggaagggaagggaggugggcagcagugggucagagauagaccuuuguucucuua

SEQ ID NO: 125271 - RNA, 64 nt, Human
gugucuccuucauuacuuaaagauauucaugagggugggucacuacagauguuggggagcaagg

SEQ ID NO: 125272 - RNA, 64 nt, Human
cccaguucagccccagucacccucuuuuacacaugugggucaaccacugugugcucagaggguc

SEQ ID NO: 125273 - RNA, 64 nt, Human
cucugagagcccuuccccuguguccugccaccaugugggucagauguacucucugucacaugag

SEQ ID NO: 125274 - RNA, 64 nt, Human
cacgcaggucacaccaucugggccugagguagcagugggucacuuugauccacuuugcaggacu

SEQ ID NO: 125275 - RNA, 64 nt, Human
gcccugcagccggagaucugaggugcucuggucugugggucaguccucuuuccuugucccagga

SEQ ID NO: 125276 - RNA, 64 nt, Human
ccgaucuccauggggaggagggacuuaagcccaagugggucaggccuggcccagguccuuauac

SEQ ID NO: 125277 - RNA, 64 nt, Human
ucucuucguuuucuugugccgcuggaauuggcuugugggucacuuguugugcaaaagugaauua

SEQ ID NO: 125278 - RNA, 64 nt, Human
cggcuccuacacagagaaggaugccagccaucuggugggucagguccuuggcgccgucuccuac

SEQ ID NO: 125279 - RNA, 64 nt, Human
cagugaguuuguucugaaacaucucuugcuaaaugugggucaugcuagacacagcauaaacuga

SEQ ID NO: 125280 - RNA, 64 nt, Human
cacacacacacacacacacacacauacacagacaaaaacacaaaaacucugaggggaucuggug

SEQ ID NO: 125281 - RNA, 64 nt, Human
aggauuaaaacuaaccgugaccacuacuccaaacaaaacacaauaugccuaggggcacggauga

SEQ ID NO: 125282 - RNA, 64 nt, Human
ucuauuuucucuacggcuuaggcuaugugagggcaaaacacaaaucccuuugcuaaaaagaacc

SEQ ID NO: 125283 - RNA, 64 nt, Human
cagugaaauuaucuugagucuacacauuauuuuuaaaacacaaaaauuguucggcuggaacuga

SEQ ID NO: 125284 - RNA, 64 nt, Human
uaacaguuuaucaugcucauuaauuugggauuucaaaacacaaaugaaaacucacacccaccca

SEQ ID NO: 125285 - RNA, 64 nt, Human
caucuggaggaaauggccuucuuuuuaaaagcaaaaaacacaaaaccucacaacugccuggcaa

SEQ ID NO: 125286 - RNA, 64 nt, Human
agaaugcguuauccauccuauauaaaagaaagauaaaacacaggucaccaauuuucucauuuca

SEQ ID NO: 125287 - RNA, 64 nt, Human
caagacucugucucaaacaaaacaaaacaaaacaaaaacacacuacuguauuuuggauggauca

SEQ ID NO: 125288 - RNA, 64 nt, Human
uuuauaauaaaaaaaagaaguugaguaaaaaaaaaaaacacacaaaccuguuaguuucaaaaau

SEQ ID NO: 125289 - RNA, 64 nt, Human
auuagggccuuagaaaugucaauggggcaggaagaaaacacaauuucuaacugccuguuuuugu

SEQ ID NO: 125290 - RNA, 64 nt, Human
acuuacuaaaauauauauagaaauauauacgaacaaaacacacgcgcgcacacacacacauaca

SEQ ID NO: 125291 - RNA, 64 nt, Human
cauuacuguagugcugagguuauugaaguuauacaaaacacaucucagucucuguuucuuggaa

SEQ ID NO: 125292 - RNA, 64 nt, Human
guugaauauugaacucuaacaguuuucuacauacaaaacacagugucaugaagguuauucauaa

SEQ ID NO: 125293 - RNA, 64 nt, Human
cuuuaaaauuuuccuuuauguuccauuccauaggaaaacacacauaugcacacaaaacucaguu

SEQ ID NO: 125294 - RNA, 64 nt, Human
cucacaucacagaagauuaaaauucagaaaggagaaaacacagaccaaagagaaguaucuaaga

SEQ ID NO: 125295 - RNA, 64 nt, Human
agauacaguuuaaaagugcuuacccaggcaagaaaaaacacagcuaggcuaagucaacaacaga

SEQ ID NO: 125296 - RNA, 64 nt, Human
uaucacaccuaaucuucccaauguuugggauauuaaaacacaaaguccuuaacaugccaggcuc

SEQ ID NO: 125297 - RNA, 64 nt, Human
aaaaguuuaaggauaagacauguguauauguaacaaaacacauugcaucuagaaaucaaaacuu

SEQ ID NO: 125298 - RNA, 64 nt, Human
gguuaaaagcugcacugaccaaagcuguacuuuuaaaacacaaccccugggcuagugaugucuc

SEQ ID NO: 125299 - RNA, 64 nt, Human
cauaagaagcaccaagucaggcucagaugcaacuaaaacacaucuuugagccuuuucuuuuucc

SEQ ID NO: 125300 - RNA, 64 nt, Human
ggguggcaccagcagccuggacccuguggaugauaaaacacaaacgggcucagcaaaagaugcu

SEQ ID NO: 125301 - RNA, 64 nt, Human
aaguuauuuucuacagugguuuuauacugaaggaaaaacacaagcaaaaaaaaaaaaaagcauc

SEQ ID NO: 125302 - RNA, 64 nt, Human
ugucaacuaguggacuaauuaacccuccaccaaaaaaacacaaagugcuucugugagaccaauu

SEQ ID NO: 125303 - RNA, 64 nt, Human
ccagugugcguuggaaucaccuggagggcuugguaaaacacagauuuuugggcuccacuccaag

SEQ ID NO: 125304 - RNA, 64 nt, Human
gaacugcccuuuaaauuuuaagugacacuacagaaaaacacaaaaaggugauggguuguguuau

SEQ ID NO: 125305 - RNA, 64 nt, Human
guugaauuaucuaucuggauauuacuagaguuguaaaacacaacuuggaaacuggaauuuaugu

SEQ ID NO: 125306 - RNA, 64 nt, Human
caaccucuaguaccuuuccagccgaaaacaggagaaaacacauaacacauuuuccgagcucuuc

SEQ ID NO: 125307 - RNA, 64 nt, Human
uaucuguaauaucuuuccauuugaaaaaaaucucaaaacacagauuaaaaccacaauaggcugu

SEQ ID NO: 125308 - RNA, 64 nt, Human
uguauggauucagaauauacuaaauuaacuuuuuaaaacacaacuuuuaaaaaauguaucaaaa

SEQ ID NO: 125309 - RNA, 64 nt, Human
cuguuuguauguggguuuuacacuaaaaaaaugcaaaacacauuuuauucuucuaauuaacagc

SEQ ID NO: 125310 - RNA, 64 nt, Human
ucauccacuuccaguuugcuggucucccugcuagaaaacacauuguacugugcuuuuucuggaa

SEQ ID NO: 125311 - RNA, 64 nt, Human
guguuuguuuuauagagugcagcgcagcuuggacaaaacacauuucaagugcccaguagucagu

SEQ ID NO: 125312 - RNA, 64 nt, Human
gaaacagggcuacucuguguuuccagugugggaaaaaacacagcuucaccaggagguucuccac

SEQ ID NO: 125313 - RNA, 64 nt, Human
guaaaaaugcauuuacaaccuuucauuuaaccgaaaaacacagaccgcuuuaaccucuuuauuu

SEQ ID NO: 125314 - RNA, 64 nt, Human
cucuguagcccugacauaaggaacagaacacaacaaaacacagcaaaccaugugcccaaacugc

SEQ ID NO: 125315 - RNA, 64 nt, Human
uuuuuucugguuccuaugaagauuuggaacauagaaaacacaaaaacucaccuuaaaauuugag

SEQ ID NO: 125316 - RNA, 64 nt, Human
ccuguuguuagagaaccuaucuuuguuuuuggucaaaacacacauagaaaacaaaaugauccaa

SEQ ID NO: 125317 - RNA, 64 nt, Human
uuaauauguuuaauucaccuaucacacucuguuaaaaacacauagaaucaucaauaaaaacuca

SEQ ID NO: 125318 - RNA, 64 nt, Human
augaaaaagaucaggcuuucugacuuccauccccaaaacacauuuaccagcauacuccaaacug

SEQ ID NO: 125319 - RNA, 64 nt, Human
caaaaccucuucuguauuuuuuuuuuccauuaguaaaacacaagacuucagauucagccgaauu

SEQ ID NO: 125320 - RNA, 64 nt, Human
agaaauggugagcuuuaagugguuuguaaaccauaaaacacaucauaaaaguucuaucuauagu

SEQ ID NO: 125321 - RNA, 64 nt, Human
uccagcaacauacuauagaaaacaccugcuacucaaaacacaacuucucagugucauccauugc

SEQ ID NO: 125322 - RNA, 64 nt, Human
auggauuccuauaaugggagcaucaccacuuauuaaaacacacauagaaugaugaauuaaaaaa

SEQ ID NO: 125323 - RNA, 64 nt, Human
uguucauagacuugugauaauaugguguuaugggaaaacacauuuugugcgcaugaugaagaga

SEQ ID NO: 125324 - RNA, 64 nt, Human
acauucccaaaagcugacauuuucacgauucuuaaaaacacaaaguuacacuuacuaaaauuag

SEQ ID NO: 125325 - RNA, 64 nt, Human
uuuguugacacgaaaauuuuggaggaaccaauugaaaacacacuuccagucuagaugaugcuuu

SEQ ID NO: 125326 - RNA, 64 nt, Human
uuuggaaacccccagaugaacuucuauacaugugaaaacacaagucuuugagugugcacuaaaa

SEQ ID NO: 125327 - RNA, 64 nt, Human
caggcagacuuuaccagagugucagacauuaccuaaaacacauacguuagccaugcugcuggua

SEQ ID NO: 125328 - RNA, 64 nt, Human
ggcucaaauaaacaaucaagaauaauuaugagagaaaacacaaaucuaaaguauguuugauuuu

SEQ ID NO: 125329 - RNA, 64 nt, Human
gaaaaacagaagacaaaaaauagagaucagcaagaaaacacacgcccugcccugccaccucccc

SEQ ID NO: 125330 - RNA, 64 nt, Human
uuaauuuccccaccuaagucgaaacaguauuaucaaaacacaugugcacacagauuauuuuuug

SEQ ID NO: 125331 - RNA, 64 nt, Human
aaaagucaguacggauuuuaauagccuggggaggaaaacacauucuuugccacagacaggcaaa

SEQ ID NO: 125332 - RNA, 64 nt, Human
uccuccuagaacuuacauuuuaauggaaauagacaaaacacaucuucuuaacggauggugaccu

SEQ ID NO: 125333 - RNA, 64 nt, Human
uugguugcuuuucaauauaauugcaaacaaauuaaaaacacaguuaaacuaauauguuuauaag

SEQ ID NO: 125334 - RNA, 64 nt, Human
gaaagggaaaagucagggaaggggagaagaaagaaaaacacauuuggccuuaaaauagcaugca

SEQ ID NO: 125335 - RNA, 64 nt, Human
aauccagauaauaaagacuuuguaaaacaugaauaaaacacauuuuauucuauaauuuuguaau

SEQ ID NO: 125336 - RNA, 64 nt, Human
guagaauuuaaauugguugguugauuguuuauauaaaacacacuaaaauuauauuuuaaaaguu

SEQ ID NO: 125337 - RNA, 64 nt, Human
ggguccucaccccucgccaccuuucacccucaugaaaacacacauacacgcaaauacacuccag

SEQ ID NO: 125338 - RNA, 64 nt, Human
gcccaaaagagagcucccuuagggaaaaaugaccaaaacacacacacacauuuacaauggacug

SEQ ID NO: 125339 - RNA, 64 nt, Human
cucugaaaauacauuauguuuuuuuucuuuaaacaaaacacacaacauguaagcauguaagagu

SEQ ID NO: 125340 - RNA, 64 nt, Human
cuuuucuguaauggguacaaugaagaaguuucuaaaaacacacacaaagcacauugggccaacu

SEQ ID NO: 125341 - RNA, 64 nt, Human
cuucuggaaucauguucgcuuggcuuccugauuaaaaacacaguuuuauugcucucugcacugc

SEQ ID NO: 125342 - RNA, 64 nt, Human
uuguuuaauaaaaguaaucccugcuggucauaggaaaacacacgguucuaauuaagugugaagg

SEQ ID NO: 125343 - RNA, 64 nt, Human
cuuucugauuaaaggguuuucuuucuuuuuuaauaaaacacaucugucugguaugguaugaauu

SEQ ID NO: 125344 - RNA, 64 nt, Human
auuauagaaaauuauuuguaugaauaaugaaaauaaaacacaccucguggcauggcuggcgugg

SEQ ID NO: 125345 - RNA, 64 nt, Human
cuuuuauuuggaauaauaauuuuccuccuaaacaaaaacacauugaguuuaagucucugacucu

SEQ ID NO: 125346 - RNA, 64 nt, Human
uuaauggcauguaauauucugagcacgggcaaagaaaacacacaaaagauuauguauuggcauu

SEQ ID NO: 125347 - RNA, 64 nt, Human
uaauuaaaaaagaaaaauucauauaaucguguuuaaaacacaaaugaagucaguauuugccuuu

SEQ ID NO: 125348 - RNA, 64 nt, Human
uccauuuguugacauguagacuguuuacaaaaaaaaaacacaugguuaaauguuaaauuuuaau

SEQ ID NO: 125349 - RNA, 64 nt, Human
aaaacaaaacaacaacagcaaaaaacaacaaaacaaaacacaaauacucucacagggcauggag

SEQ ID NO: 125350 - RNA, 64 nt, Human
uucuggcauuagaagaaaaacaagcaagcaaacaaaaacacagccuccgaugccaaacauguuc

SEQ ID NO: 125351 - RNA, 64 nt, Human
uugagggggauacucuguuuaugaaaaagaauaaaaaacacaaccacgaagccacuagagccuu

SEQ ID NO: 125352 - RNA, 64 nt, Human
uuagccacuuauaaaaaaaaaaaaaaggaugaucaaaacacacaguguuuauguuggaaucuuu

SEQ ID NO: 125353 - RNA, 64 nt, Human
gaauugaaaguuuuaaaaauccuuuuaguauucuaaaacacaauuguuucuaauucguuucuag

SEQ ID NO: 125354 - RNA, 64 nt, Human
ucaaaugcauacaaguuucauucucccuuucacuaaaacacacaggugcaacagacuugaaugc

SEQ ID NO: 125355 - RNA, 64 nt, Human
uguauugccacuagagaauucuacaaaacaagcaaaaacacauccugagacaccucagggcugc

SEQ ID NO: 125356 - RNA, 64 nt, Human
cagaaagcaaaguaauaaaaucacaaauguuuggaaaacacaaaaguaacuuguuuaucucagu

SEQ ID NO: 125357 - RNA, 64 nt, Human
agaaauucuacacuuggaugucucgcuucacaauaaaacacagcuuaaaaauaaaauaacugaa

SEQ ID NO: 125358 - RNA, 64 nt, Human
gccuggccaauacggcaaaaccucaucauuacuaaaaacacaaaaauuagccagguguggcggc

SEQ ID NO: 125359 - RNA, 64 nt, Human
cuaagauaguuccagggauuaaaagguuaagaggaaaacacaaaucaccaaauuucugauuuau

SEQ ID NO: 125360 - RNA, 64 nt, Human
auaucacguuuuuguuuucgaauuagacuucuuuaaaacacacacacacacacacacacacaca

SEQ ID NO: 125361 - RNA, 64 nt, Human
ugcugacugaauucuuaaaacuuugggaauagaaaaaacacauuuauuaauggaugcuaaagug

SEQ ID NO: 125362 - RNA, 64 nt, Human
gccuggccaacguggugaauccccgucucuacugaaaacacaaaaauuagacgggcaugguggc

SEQ ID NO: 125363 - RNA, 64 nt, Human
caugugaaaagaauuuuuuugugugugaauuaucaaaacacaacucaacuaugaaucuucaauu

SEQ ID NO: 125364 - RNA, 64 nt, Human
ugagguagcgacacaaaguuaaacaaacaaacaaaaaacacaaaacauaauaaaacaccaagaa

SEQ ID NO: 125365 - RNA, 64 nt, Human
acuuagaccaaguucuccccugagaaaucuuguuaaaacacauuaaguagucaaaauaguaauc

SEQ ID NO: 125366 - RNA, 64 nt, Human
gaccgcauuggaagaauuuucuugggccacauguaaaacacacuaacacuaaccauaguugaug

SEQ ID NO: 125367 - RNA, 64 nt, Human
uaaaauaacuggccuuuuuccucagguaguuugaaaaacacacucuagagaugcacuguccaau

SEQ ID NO: 125368 - RNA, 64 nt, Human
guaaaagcaaugaauccccuuuacaagaaaaucgaaaacacagaagaaugaaggacaugccagu

SEQ ID NO: 125369 - RNA, 64 nt, Human
cuuuuuaacaauuuguauacagggguuggacuuaaaaacacacauacaaacaaaacucuuuuca

SEQ ID NO: 125370 - RNA, 64 nt, Human
uagcuuuauugugucuuaaaaacaaaagcgaauuaaaacacaacaaaaaaccccaccccacaac

SEQ ID NO: 125371 - RNA, 64 nt, Human
ugaagugcagcucauguuuuuaacuuuuaauuuaaaaacacaaaaaaaauuuuagcucuuccca

SEQ ID NO: 125372 - RNA, 64 nt, Human
uucuuugguagguuagggagguuguauaacauaaaaaacacaucacuauauguaggaaauauac

SEQ ID NO: 125373 - RNA, 64 nt, Human
uuugagaccagccuggccaacacuaucuguacuaaaaacacaaaauuagcugggcgugguagug

SEQ ID NO: 125374 - RNA, 64 nt, Human
uuacgaccuuguauauauuuaauuucagguaaggaaaacacauacguguagcgaucucuauuug

SEQ ID NO: 125375 - RNA, 64 nt, Human
aaucuguaaaccuugagggauagcuuucugcuuaaaaacacacacacacacacacacacacaca

SEQ ID NO: 125376 - RNA, 64 nt, Human
cagacacgagcaggagggagagacagagaaaagaaaaacacagcaugagaacacaguaaaugaa

SEQ ID NO: 125377 - RNA, 64 nt, Human
uacugauaaccccuacaauuuucgacuuaacuucaaaacacaguauuguguuaucuaucacaua

SEQ ID NO: 125378 - RNA, 64 nt, Human
uuaccuauaaaaauugucaauuuucauucuuuaaaaaacacauggacuuacuauaaaagccuuu

SEQ ID NO: 125379 - RNA, 64 nt, Human
cccccaggugccaguuauggcuauaggugcuacaaaaacacagcaagggugaugggaaagcauu

SEQ ID NO: 125380 - RNA, 64 nt, Human
uucaucaaaaagccuuauuuuuuuaucuauguggaaaacacaauaaaaaauccucaacacuauu

SEQ ID NO: 125381 - RNA, 64 nt, Human
aguucuaauaugaaggguaguuuuucauuauuuaaaaacacauggaaaaauaugagacauauuu

SEQ ID NO: 125382 - RNA, 64 nt, Human
cacaugcgcagggucugugauuuuacauguauguaaaacacauaggaagcugacuuaggaaaaa

SEQ ID NO: 125383 - RNA, 64 nt, Human
gguuuuguuuaaaauuaccauuacuuguuuuuuaaaaacacaugaccacauauguauauguaua

SEQ ID NO: 125384 - RNA, 64 nt, Human
aauguaaggaaauguucugaaauaaagacuaaagaaaacacacuggcauauuugcucucuuuga

SEQ ID NO: 125385 - RNA, 64 nt, Human
auugugguuuuuucuuccuaauguaaaauaaaauaaaacacaucugccuucuugauauuuauag

SEQ ID NO: 125386 - RNA, 64 nt, Human
aacuacccuaugaaauguaagcugcagaauagauaaaacacagguuuccacuaauaaaagacau

SEQ ID NO: 125387 - RNA, 64 nt, Human
aacucuuugcacauaaauugguauaauaaaaagaaaaacacaaacauucaaagcuuagggauag

SEQ ID NO: 125388 - RNA, 64 nt, Human
aaaacccugucucuacugaaaaacaacaaaaacaaaaacacaaauuagucgggugugguggcac

SEQ ID NO: 125389 - RNA, 64 nt, Human
caucucauuaaaaaaaacgaaaacaaaaacaaaaaaaacacaaaccaucaucacagaagaugca

SEQ ID NO: 125390 - RNA, 64 nt, Human
aauuaugaaaguauuuuauuguucauagaaauaaaaaacacaguuacuuugcauuugguuuccu

SEQ ID NO: 125391 - RNA, 64 nt, Human
gcugaccucguugcauggaauuaaaagagaaggaaaaacacaaggaugaagucuuuccgaauuc

SEQ ID NO: 125392 - RNA, 64 nt, Human
uuuugcuuauauuguuuucaggugcucaaaaugcaaaacacaaaacaaauccugcauuuagaua

SEQ ID NO: 125393 - RNA, 64 nt, Human
uuuuaaagguuauuuuguuuuaguuuuaaauagcaaaacacaagcugcauuuuuauuuauuuug

SEQ ID NO: 125394 - RNA, 64 nt, Human
gucuggccaauauggagaaaccuugucucuacuaaaaacacaaaaauuaucugggcaugguggg

SEQ ID NO: 125395 - RNA, 64 nt, Human
cacugggcauggaccccucaaagcaggcacacccaaaacacaagucuguggcuagaaccugaug

SEQ ID NO: 125396 - RNA, 64 nt, Human
ggugccugugcuauaaaugaguuucuucacaugaaaaacacagccagcccaagaugacuuaucu

SEQ ID NO: 125397 - RNA, 64 nt, Human
ugccauguaaaugaaaacgucuuuauuuaucaaaaaaacacagaggcuauuuuuauauccuugg

SEQ ID NO: 125398 - RNA, 64 nt, Human
agauaauuucccugcccacaaaggcauaaacuugaaaacacaugagauugaaucaacaugcuuu

SEQ ID NO: 125399 - RNA, 64 nt, Human
uuuugauuuuuuuuucuuuuaugugaucuuugggaaaacacauucagaauuauaucucguuucu

SEQ ID NO: 125400 - RNA, 64 nt, Human
ucuugaucuccucaaucuggaguccccugcccucaaaacacagugauguucagaacagaacaca

SEQ ID NO: 125401 - RNA, 64 nt, Human
ucaucucaccauuguauugcuaugcccucccauaaaaacacauugaucccuagcaagauuauug

SEQ ID NO: 125402 - RNA, 64 nt, Human
caauauggugaaaccccgucucuccugaaaaaaaaaaacacaaaaauuagccaggcaugguggc

SEQ ID NO: 125403 - RNA, 64 nt, Human
uguaaugggguuguauuuaugggcgccuagaaagaaaacacaaggacuugguaggccaggaaga

SEQ ID NO: 125404 - RNA, 64 nt, Human
agcaccuaaaaacacugcuugauauuauaaauuuaaaacacaagugaaaguuuagccaugguuu

SEQ ID NO: 125405 - RNA, 64 nt, Human
augucaauccuuugcauuugaaugaagacuuugcaaaacacaccaaguuuggaaauacaauugu

SEQ ID NO: 125406 - RNA, 64 nt, Human
acuugaggcaaaucguaaggaagcuguuucuuuuaaaacacaaaccaccaccaaaaauuuaaau

SEQ ID NO: 125407 - RNA, 64 nt, Human
gacaauuuucuguacuagaaucuuccacugccagaaaacacagugccaguaagguucuacauac

SEQ ID NO: 125408 - RNA, 64 nt, Human
auauagaugguaggaagcagaaugccauuuuauuaaaacacaggagaaguuauaucucucugau

SEQ ID NO: 125409 - RNA, 64 nt, Human
gguggagaagacucuugcuuccuccaaguguuugaaaacacaaaaugcgauaugaaaagaagaa

SEQ ID NO: 125410 - RNA, 64 nt, Human
ugcuccuccuaguuucaccauguucuggcaauaaaaaacacauauuauauccugguuuucucua

SEQ ID NO: 125411 - RNA, 64 nt, Human
ggcaccagaagaacaguaggugacacuauaguuuaaaacacauugccuaacuacuaguuuuuac

SEQ ID NO: 125412 - RNA, 64 nt, Human
cuccacuugaagccaaagaaagaaacucacacuuaaaacacaugccaguugggaaggucugaaa

SEQ ID NO: 125413 - RNA, 64 nt, Human
gugauuccuugaacguucacuaaaucuucaagcaaaaacacauuuuuacauuauuuuuacguug

SEQ ID NO: 125414 - RNA, 64 nt, Human
cagguuuuugaagacauauagguaacuuccacagaaaacacaaacauguauuuaaaggcaaguc

SEQ ID NO: 125415 - RNA, 64 nt, Human
aguagagaguuaguggaauauagacaggacucugaaaacacaacuuccagccauuuuuuuaguu

SEQ ID NO: 125416 - RNA, 64 nt, Human
cugcgaaugaagcaauauaccacuaaccugcagaaaaacacaaacaaaaacagacucccacugu

SEQ ID NO: 125417 - RNA, 64 nt, Human
gauuggauuuuaccauaugaaauguuucauauugaaaacacaagaugaccuuucuaaugagcug

SEQ ID NO: 125418 - RNA, 64 nt, Human
gagugcucacugagauacuugcuggagaccucagaaaacacaagugccuucuccacggugcaau

SEQ ID NO: 125419 - RNA, 64 nt, Human
aaauuauaucuaaacaaaaaagaauaagaaacaaaaaacacauuaaaauuuuaaguuguauuuu

SEQ ID NO: 125420 - RNA, 64 nt, Human
aaacucucuugccauagagaauacaccaucaaagaaaacacaacccuuucccuuugguguacag

SEQ ID NO: 125421 - RNA, 64 nt, Human
caguuaauuaaaugaguacguaaauaaauuaauuaaaacacauagaucugcuuuguguuuuuau

SEQ ID NO: 125422 - RNA, 64 nt, Human
uauaaaaaaguuaaacacgcuuuuuuuccugccuaaaacacaaauacaacugccaguauguauu

SEQ ID NO: 125423 - RNA, 64 nt, Human
uugccuguaagaauuugcacaugaauguuaauggaaaacacaaaacuuaagauggcccaaaaca

SEQ ID NO: 125424 - RNA, 64 nt, Human
ccacuucauauaaagguuacuccagaccauguacaaaacacagccacucuugaaaucacaaguc

SEQ ID NO: 125425 - RNA, 64 nt, Human
uaaccugagauuucuaugguuugacuccaggaucaaaacacaagggacuuuguauuauuucacu

SEQ ID NO: 125426 - RNA, 64 nt, Human
cuagaaguuaaacaagagcuaagacaaacaaaacaaaacacagcuuaucuaaucuaaugagaaa

SEQ ID NO: 125427 - RNA, 64 nt, Human
uaguuauacauuuguauaagaaccuguauuuugaaaaacacauucauguauauuuauuccugga

SEQ ID NO: 125428 - RNA, 64 nt, Human
gaauuacacaacguuuuccucaagaaaaugguacaaaacacaaccgaggagcguauacaguuga

SEQ ID NO: 125429 - RNA, 64 nt, Human
uguuugauauuucuuaaugucugcucugagccuuaaaacacagauugaagaagaaaagaaagaa

SEQ ID NO: 125430 - RNA, 64 nt, Human
agauaaauauguaucuacacagaguaauaauaauaaaacacaguaaacauucuauuucucuaug

SEQ ID NO: 125431 - RNA, 64 nt, Human
gcuucuuugcccagacauuuacaaaguuguuuuuaaaacacacucauaaguaaguuuggcaagu

SEQ ID NO: 125432 - RNA, 64 nt, Human
cuggucaguuaauguagaaauuuaaauaguaaauaaaacacaacauaaucaaagacaacucacu

SEQ ID NO: 125433 - RNA, 64 nt, Human
ugauguucuuccuggaauucaugaaaauauaauuaaaacacauuuuuaaacacuuggugaacuu

SEQ ID NO: 125434 - RNA, 64 nt, Human
ugcauucuuguugguagcauguacucuguugaguaaaacacauauucaaauuccguauaccaaa

SEQ ID NO: 125435 - RNA, 64 nt, Human
cagggcguuaaauucacagauuuuuuuaacgagaaaaacacacagaagaagcuaccucaggugu

SEQ ID NO: 125436 - RNA, 64 nt, Human
gagugguguagagacauccaaauuuaaagaaaaaaaaacacaaaacagaauguuaaaaaaugua

SEQ ID NO: 125437 - RNA, 64 nt, Human
agauggacacaggccguuucucauccaguuuaggaaaacacacaugcucaggaauucagaauaa

SEQ ID NO: 125438 - RNA, 64 nt, Human
uucaacaacaaaacauuugcucuggggggcagggaaaacacagauguguugcaaagguagguug

SEQ ID NO: 125439 - RNA, 64 nt, Human
uggcacauccuagcuuguuagagggcacuuccgaaaaacacagcccugacagcaaaauaaaggu

SEQ ID NO: 125440 - RNA, 64 nt, Human
ggauauuuggcacacucaugcgucauucauucacaaaacacaaacccaggacuuucugccuaag

SEQ ID NO: 125441 - RNA, 64 nt, Human
ucacugugauuuacugcauugcaggcuguaugauaaaacacacauaauuuaaagagagaaggcu

SEQ ID NO: 125442 - RNA, 64 nt, Human
gccuggccaacauggugaaauccugucuccacuaaaaacacaaaaauuagucaggcgugguagu

SEQ ID NO: 125443 - RNA, 64 nt, Human
gguuuuugugguuugacuucuaugguguuuuaaaaaaacacagauuuuuaguguuaauauugug

SEQ ID NO: 125444 - RNA, 64 nt, Human
agauauacacauucccaugcacugacauaaguugaaaacacauaguacuuucuagauggaauuu

SEQ ID NO: 125445 - RNA, 64 nt, Human
augagaaugccacaaacuugaauaccuuaugcacaaaacacaaacauuguuaugcauaauguac

SEQ ID NO: 125446 - RNA, 64 nt, Human
aucuguuuguaaucauuaucucacuuuguaaauaaaaacacaccuuaaaacaugaacaagccaa

SEQ ID NO: 125447 - RNA, 64 nt, Human
caagaccaaccuggugaaaccccgucucuacaaaaaaacacaaaaaauagccaggcaugguggc

SEQ ID NO: 125448 - RNA, 64 nt, Human
cuguuggauucagaaauuuaaacaaaaaaaaaaaaaaacacacacaccuugguaacauacuguu

SEQ ID NO: 125449 - RNA, 64 nt, Human
gauuaguauuuuccacgucacuguuuauuuuuuuaaaacacaaauucuaaagcuacaacaaaua

SEQ ID NO: 125450 - RNA, 64 nt, Human
ccugagacuuucagugcacuguauauagaagucuaaaacacaccuaagagaaaaagaucgaauu

SEQ ID NO: 125451 - RNA, 64 nt, Human
aguuugauucagaccugcuccacuauguguugcuaaaacacaugcuaugagcacuccaggaaac

SEQ ID NO: 125452 - RNA, 64 nt, Human
ggaguucaucuugaauuguaaggaaugauuaauuaaaacacaacaucuuuuucuacucgaguua

SEQ ID NO: 125453 - RNA, 64 nt, Human
cuuucauuuuucucuuccugggauucauuuuuucaaaacacaaugcuggaaaaaaaagauuugu

SEQ ID NO: 125454 - RNA, 64 nt, Human
uagaauuccugcacaugaucaaacagauccuccuaaaacacaccuuuugaaauguugaacauaa

SEQ ID NO: 125455 - RNA, 64 nt, Human
uugcuaugaaaagaaaacacuguauuccuuaugcaaaacacauguaucuuucauuauuuauaag

SEQ ID NO: 125456 - RNA, 64 nt, Human
uuuauuauuguaaaugggggcuguggaaggugagaaaacacaugcuuucuuaaaacagaagcuc

SEQ ID NO: 125457 - RNA, 64 nt, Human
aguauacucuagucaauuuauguuaacuuuauuuaaaacacaauuuauuuggccgggcacggug

SEQ ID NO: 125458 - RNA, 64 nt, Human
uauuugaagagaaaaacugacuuuuguauaguauaaaacacaggcuuucacaaauuuuguauug

SEQ ID NO: 125459 - RNA, 57 nt, Human
agaucaaaaaauaugucuaauguaauuaaaacacaaguucacagauuuacagugaac

SEQ ID NO: 125460 - RNA, 64 nt, Human
ggagaguggcaucuucuuugcauccuaaggacgaaaaacacagugcacucagagcugcugagga

SEQ ID NO: 125461 - RNA, 64 nt, Human
uucacuucgcagcaucaacuuucaagcauaaguaaaaacacaacuugcauacuuugauggagcu

SEQ ID NO: 125462 - RNA, 64 nt, Human
uauacuuuaaggaaacaagauuacaacaauuaaaaaaacacauaguuccaguuucuauggccuu

SEQ ID NO: 125463 - RNA, 64 nt, Human
ugguaaaaaguauuuuuccccacuaaaaaacuuuaaaacacaaaucuucauauauacuuaauuu

SEQ ID NO: 125464 - RNA, 64 nt, Human
guauggugcaggaaaagaagauuggaaaaagaccaaaacacacuucuccagcaacacuccauca

SEQ ID NO: 125465 - RNA, 64 nt, Human
auuuuaguccuauuuguauuauuuuaugcauuuaaaaacacaguccugagagggauggaccaga

SEQ ID NO: 125466 - RNA, 64 nt, Human
uuucagcccuauuuguauuauuuugugcauuuaaaaaacacaaucuuaaggggauagacuagac

SEQ ID NO: 125467 - RNA, 64 nt, Human
guguuggugauuccaguggacuguaucucugugaaaaacacaauuuugccuuuuuguaauucua

SEQ ID NO: 125468 - RNA, 64 nt, Human
gguagugauuauuagugcuucauccccauuuaaaaaaacacaguacuaauggguaacacauaug

SEQ ID NO: 125469 - RNA, 64 nt, Human
uuaucauucugguaaaaaaacaaaaaauagaagcaaaacacauuguauugccauuauuuuguau

SEQ ID NO: 125470 - RNA, 63 nt, Human
uaauugcaucuucauuaggaaaaauaaaaagcauaaaacacaauuucugguuacuaugaauaa

SEQ ID NO: 125471 - RNA, 64 nt, Human
aacuuucuaaaacuaaaagagucuuuuuauuuuuaaaacacaaguagaaugauuuaaauaggau

SEQ ID NO: 125472 - RNA, 64 nt, Human
caauauggggcauuaauauucuuuuguuauuaaaaaaacacaaaaaaauaauaaaaaaauauau

SEQ ID NO: 125473 - RNA, 64 nt, Human
aucguaaaacugacaaaauauuuuaaaaauauauaaaacacaaaauuaaaauaaaguugcuggu

SEQ ID NO: 125474 - RNA, 64 nt, Human
gcaaagcuuauuuucuuuuaucugggcaaaaauuaaaacacauuccuuggaacagagcuauuac

SEQ ID NO: 125475 - RNA, 64 nt, Human
uauuuuuuucccaaggaguaaccaauuucuuucuaaaacacauuuaaaauuuuaaaacuauuua

SEQ ID NO: 125476 - RNA, 64 nt, Human
ccucccuucugauaagacuggaaaauaguccuccaaaacacaagggaggauuuuggguggccaa

SEQ ID NO: 125477 - RNA, 64 nt, Human
uuaaugaauauugauguuaacaagaggggaaaacaaaacacagguuuuuucaauuuaugcugcu

SEQ ID NO: 125478 - RNA, 64 nt, Human
agaaaauguguaauucaaaagauuaauguguauuaaaacacauuauguaucuuaguuacauuuc

SEQ ID NO: 125479 - RNA, 64 nt, Human
ccaguuacuguauucuacaaauauuuuuauguucaaaacacacaguacagacagcauggauauu

SEQ ID NO: 125480 - RNA, 64 nt, Human
uuaguaacaaacacaauuuauauaaugacccagcaaaacacaucacaucuuacugucgaaauua

SEQ ID NO: 125481 - RNA, 64 nt, Human
gcaagacugaagauggcuuuuccuggacagcuagaaaacacaaaaucuuguaggucauugcacc

SEQ ID NO: 125482 - RNA, 64 nt, Human
aguuguacugcaucuuaguuuacuggauaaauuuaaaacacaguauuguagaaagcuaauacaa

SEQ ID NO: 125483 - RNA, 64 nt, Human
guauagucuaauuugguuaauccuugugacauuaaaaacacauacacuuuuuaaaaaauuacuc

SEQ ID NO: 125484 - RNA, 64 nt, Human
auuuuuuaaguacuuauguggaagcuagucucccaaaacacaaucuuuagagagaaaagacaug

SEQ ID NO: 125485 - RNA, 64 nt, Human
aaaccuugugacauucccuugguacauaggacauaaaacacagaggcauugcuauuugguaagu

SEQ ID NO: 125486 - RNA, 64 nt, Human
aaaacaaaauauuuuaauuuuuaaauuuucccuuaaaacacacuuuuggaauaugcuacaauau

SEQ ID NO: 125487 - RNA, 64 nt, Human
auacaaaagaauauaguuuaauauguauugaaauaaaacacaauaaaauuaacacuugauccag

SEQ ID NO: 125488 - RNA, 64 nt, Human
guccuacuguuguuauuaaaaacagaacaaaaacaaaacacacacacacacaaaaacagaaaca

SEQ ID NO: 125489 - RNA, 64 nt, Human
aggggaaaucuuuucuuucuuucccccuuaaaaaaaaacacaucugccccgaacacuuucccac

SEQ ID NO: 125490 - RNA, 64 nt, Human
aaggagggcaacuucuacucuucaaccucuacugaaaacacaaacaacaaagcagaagacuccu

SEQ ID NO: 125491 - RNA, 64 nt, Human
cuaauuuaaauuucauuuuagcuuuacaaguccaaaaacacagaauuuauauauucagauacuc

SEQ ID NO: 125492 - RNA, 64 nt, Human
ugcuguucugcuuuaauaagcgagaccuaauuaaaaaacacaucuggccuaauguuccagaucc

SEQ ID NO: 125493 - RNA, 64 nt, Human
uguuuuauuaacuuucuccuacagcauuuuguauaaaacacaaugagggagugaaauguuaccc

SEQ ID NO: 125494 - RNA, 64 nt, Human
aauguguaaggcuugcuaaaaaacaaaacaaaacaaaacacaguccugcauacucaccaccaag

SEQ ID NO: 125495 - RNA, 64 nt, Human
uauaauguucuaaccaagucucaaaccuugaugaaaaacacaaaauuuuuccauaaacuuauca

SEQ ID NO: 125496 - RNA, 61 nt, Human
agcaauuaguaaacuucuaggagauggguauaaaacacaucuucuucaaauguuuauauca

SEQ ID NO: 125497 - RNA, 64 nt, Human
gcuugggcaacauggcaaagccccaucucuacaaaaaacacaaaaauuagcugggcauuguggc

SEQ ID NO: 125498 - RNA, 64 nt, Human
cugaaggauuuauuuauaaaaagugcaauuuuucaaaacacauuauuauuuuuuaauuucccaa

SEQ ID NO: 125499 - RNA, 64 nt, Human
auuuauuuuuauacagaguuacuuaauuaccuccaaaacacauauguuggaaaucgcuuuugcu

SEQ ID NO: 125500 - RNA, 64 nt, Human
aaguucaacuuccagaauugaucauagguauuucaaaacacaucuuuccugucugcacaaguga

SEQ ID NO: 125501 - RNA, 64 nt, Human
cagaccugugccuucaaagcccacguaaagccucaaaacacagcacacacacacacgagcacac

SEQ ID NO: 125502 - RNA, 64 nt, Human
aaaaaccucagacaucuacaaacaaccuggcuggaaaacacacagcaaaaacaauaaaaacuau

SEQ ID NO: 125503 - RNA, 64 nt, Human
uaacagcauggguaguaagcaugguuucuugcagaaaacacaaaguucucagcuaacacauuaa

SEQ ID NO: 125504 - RNA, 64 nt, Human
gacguggccagacuggguuugcguuccaaccugcaaaacacaaauacauuuuuuaaaaucaaga

SEQ ID NO: 125505 - RNA, 64 nt, Human
gguagaccaaaaggugaccucgcuuaguauauugaaaacacacaccacacaucacacacagaac

SEQ ID NO: 125506 - RNA, 64 nt, Human
auguucuugaacauuucagaaggagugguagaaaaaaacacacauucagccaaccacuuauaug

SEQ ID NO: 125507 - RNA, 64 nt, Human
gucuuagucuuagucaccuuauuauccugacacaaaaacacaugagcauacaugucuacacaug

SEQ ID NO: 125508 - RNA, 64 nt, Human
ugaaugaggcaugugaaaauauguuuugagaauaaaaacacagcagaaaagauuaaguacuacu

SEQ ID NO: 125509 - RNA, 64 nt, Human
ucaaaccaguuguacagccugauguaggacuuggaaaacacaucaauccaggacaaaagugacg

SEQ ID NO: 125510 - RNA, 64 nt, Human
aauuccaucugugauggagaccaacaaaaauaauaaaacacaaagagccaggcuuugagacuca

SEQ ID NO: 125511 - RNA, 64 nt, Human
uaaaaugacuuguuccuggggaaugccuucaaccaaaacacagcuaguauuucuaugccccaaa

SEQ ID NO: 125512 - RNA, 64 nt, Human
caaaucuucaaaaucaguagacauuucuggacauaaaacacagaugaggaaagggcuucaauua

SEQ ID NO: 125513 - RNA, 64 nt, Human
uuuuuuuguuuuugcuucuggaacuuugaaacacaaaacacaaguuggcacuuacaauuuuaaa

SEQ ID NO: 125514 - RNA, 64 nt, Human
ccacacaaagauuuucuaaggaaugcacaaauugaaaacacacucaaaagacaaacaugcaagu

SEQ ID NO: 125515 - RNA, 64 nt, Human
uaauugaauugaaaauaucccuuaggaaaaaaaaaaaacacacaaaaaaccacaagagccccag

SEQ ID NO: 125516 - RNA, 64 nt, Human
ucuccagaucccauuuagaaccaaccaggugcugaaaacacauguagauaauggccaucauccu

SEQ ID NO: 125517 - RNA, 64 nt, Human
gaauuuuuuaaauuuuuuaaaaauuaaaauaaaaaaaacacauggcucacccuuccacccacuc

SEQ ID NO: 125518 - RNA, 64 nt, Human
cuuuagucucaaaacaagagacuaggaaagauccaaaacacagagcaggaguccacaggggaac

SEQ ID NO: 125519 - RNA, 64 nt, Human
uaucuccuggggagcuuuuaaagaguacuggugaaaaacacauaguaaauuaauuuuaaaaaug

SEQ ID NO: 125520 - RNA, 64 nt, Human
uauauucuuccagagaucucugucuauacaagcaaaaacacauguggucuuuuuccuugcuuug

SEQ ID NO: 125521 - RNA, 64 nt, Human
aggcaugugaugugcaaggaaaauaauaggauauaaaacacaucaaguagaaaauuucuuauac

SEQ ID NO: 125522 - RNA, 64 nt, Human
gaacaguagugaccccuggcagcaauucauuaccaaaacacagacaaaccaaagguaaccagcu

SEQ ID NO: 125523 - RNA, 64 nt, Human
uuggccugugauggaaaggaaggcuucuaauuagaaaacacagcaacagaagaccuauaccccg

SEQ ID NO: 125524 - RNA, 64 nt, Human
gcuuccgcgagugaaugagugcuucuuaauccuaaaaacacaauggcugaauuaucuuucucca

SEQ ID NO: 125525 - RNA, 64 nt, Human
augcuuuaaaauguucugucuguagguaacaucuaaaacacaaguggguuuauuuaaauuuuua

SEQ ID NO: 125526 - RNA, 64 nt, Human
gguaugugccauuuguaaaauaaaauagagcagaaaaacacaaaaagagaacacugguucagac

SEQ ID NO: 125527 - RNA, 64 nt, Human
uuuuauauucagcauaaaggagaauaaauuccagaaaacacauauucugaaaauggaguguuug

SEQ ID NO: 125528 - RNA, 64 nt, Human
guuccauuuagcuuacauguaaauguaauuauuuaaaacacacacacugcucugcguuguauag

SEQ ID NO: 125529 - RNA, 64 nt, Human
aagacguuaaauauaauaaaguggggauauauagaaaacacacaguguuagcacacaguaagau

SEQ ID NO: 125530 - RNA, 64 nt, Human
gccuggccaacauagugaaaccccgucucuacuaaaaacacaaaaauuagccaggcuugguggc

SEQ ID NO: 125531 - RNA, 64 nt, Human
auuuuuguaaaacugcagucaucuuggaccuuuuaaaacacaaauuuuaaacucaaccaagcug

SEQ ID NO: 125532 - RNA, 64 nt, Human
gugauuucacucugucuaucaugggcaguauuagaaaacacacugguuuucacuaucugguuua

SEQ ID NO: 125533 - RNA, 64 nt, Human
aacuauuucccugaaauuccguaaguacauagucaaaacacaaugugaagaauuuguuuaaaaa

SEQ ID NO: 125534 - RNA, 64 nt, Human
ggugguacucaacagccuuauucaugaggcuuagaaaacacaaagacauuagaauaccuagguu

SEQ ID NO: 125535 - RNA, 64 nt, Human
uguucuucacaagugcuuugugccccuuuaauuaaaaacacaugaaaugaauaacaaaacaaga

SEQ ID NO: 125536 - RNA, 64 nt, Human
uuacugcaccucuuguuagacucugugcauuaauaaaacacaccuagagucuguugucauuuca

SEQ ID NO: 125537 - RNA, 64 nt, Human
auagaacaauccaucagcaugagacuuugaaaaaaaaacacaugaucagcuucucauguuccau

SEQ ID NO: 125538 - RNA, 64 nt, Human
cagaccggggagagaagaggggcaccugggcugaaaaacacaccuguuggguaucaugcuuacu

SEQ ID NO: 125539 - RNA, 64 nt, Human
gaaacaugguugugcaaguuggacauuacaauguaaaacacauuuucuucaaacacguuuuccc

SEQ ID NO: 125540 - RNA, 64 nt, Human
uccuaaguagcucuucagagucugaccguaaguaaaaacacacagaauuguguugacuggggga

SEQ ID NO: 125541 - RNA, 64 nt, Human
caucaccacuagcguaaaagcaaaaagcuuuuacaaaacacagccaaaaauucucaagaugcag

SEQ ID NO: 125542 - RNA, 64 nt, Human
gugcgcuaaucguaaaaugagcaucuuagucuuuaaaacacaucagaauugaauacgaauaauc

SEQ ID NO: 125543 - RNA, 64 nt, Human
gugacuaugcuuaaguguuuaauuuaguuugcuuaaaacacacacaccacacacacacacacac

SEQ ID NO: 125544 - RNA, 64 nt, Human
cccugcacccuucugacugacaguucauccccacaaaacacauugguuuugagaggugaugcaa

SEQ ID NO: 125545 - RNA, 64 nt, Human
cuucaagcaugacuguuaauggcuccucugugacaaaacacaaguuggaccaaggagaaagccc

SEQ ID NO: 125546 - RNA, 64 nt, Human
uugacuggauccacuaaaccaacacuaagaugggaaaacacacaugguuuggagcaauaggaac

SEQ ID NO: 125547 - RNA, 64 nt, Human
uaauaucacuauuuacaacucauguggacucagaaaaacacacaccaccuuuuggcuuacuucg

SEQ ID NO: 125548 - RNA, 64 nt, Human
gccaccacaccaggcccgagaaaugcuuuuuuaaaaaacacacaucuuauggcauucaccuucu

SEQ ID NO: 125549 - RNA, 64 nt, Human
acauguugcaaaagagaaaaaaggaaaaaaaaucaaaacacaaaaaagccaaaacgaaaacaaa

SEQ ID NO: 125550 - RNA, 64 nt, Human
uacaggaauucuggugauauuaaggugaaauaacaaaacacaaaaggcccuauuuuaacaguug

SEQ ID NO: 125551 - RNA, 64 nt, Human
ccacgcaaagccacauugaauuuuugccaaaugaaaaacacauccaacaaucaaguuucuaaga

SEQ ID NO: 125552 - RNA, 64 nt, Human
agaauuucaaggcaggggauuuuaucccccaccaaaaacacagugaaaggccugcuuuuguguc

SEQ ID NO: 125553 - RNA, 64 nt, Human
aguggggaaguacuuucauuacccaagccucagaaaaacacacaagaacaauaacacagcaaac

SEQ ID NO: 125554 - RNA, 64 nt, Human
ccccaccuggcagcaccuagaccugagcucuacaaaaacacacugcuucacuuuguuuuaggac

SEQ ID NO: 125555 - RNA, 64 nt, Human
aguguuuuaaccuguauuuguuaaaaaagaaaaaaaaacacacauaaaguuccauguguaagcu

SEQ ID NO: 125556 - RNA, 64 nt, Human
uuaaauucaaugcuugauguuacaagguguuguuaaaacacaaaaugaauaaaagugagaguag

SEQ ID NO: 125557 - RNA, 64 nt, Human
accucagugguaucagcacauuguaaauuacguuaaaacacacaacucacugugaucuauggga

SEQ ID NO: 125558 - RNA, 64 nt, Human
cagguucucguuuaaacuguuuaauuuuauucuuaaaacacaaaguuuuuaccaacuuuucaaa

SEQ ID NO: 125559 - RNA, 64 nt, Human
gauccaagcauauaaaaagccuguauauuuuuuaaaaacacaucuuaacuccacgcuuuacgau

SEQ ID NO: 125560 - RNA, 64 nt, Human
uuguuuacucauguuaaaaaaaaaaaaaacagacaaaacacacugaaauuuccuaacuacaucu

SEQ ID NO: 125561 - RNA, 64 nt, Human
ccugaccagcaugguggaacccccaucucuacuaaaaacacaaaaaauuagccgggcguggugg

SEQ ID NO: 125562 - RNA, 64 nt, Human
cucaauuaaugcuaaauaaagcuauuguuuuuccaaaacacaaaucuacacugggucucaauau

SEQ ID NO: 125563 - RNA, 64 nt, Human
ucuagguuuauagagugauguaauucaacugaagaaaacacacacaugcuuuuggugcuuauuc

SEQ ID NO: 125564 - RNA, 64 nt, Human
agaacuacaguuuagcauuccucaggcuacugugaaaacacaaccguuauggucuuugucucca

SEQ ID NO: 125565 - RNA, 64 nt, Human
acugguuaggcacagcgggaagguuaucgaagacaaaacacauuucuacccaaguuuaaaugac

SEQ ID NO: 125566 - RNA, 64 nt, Human
ccaaucagauacaauauugugucuacaauugcaaaaaacacaguaacaggaugaauauuaucug

SEQ ID NO: 125567 - RNA, 64 nt, Human
aguucacacuauuucuguuuuacagcaguuuugaaaaacacauacuaugccaccaauugucaua

SEQ ID NO: 125568 - RNA, 64 nt, Human
uagcagagacuugauacugucucaacuuuuuucaaaaacacaauuucuuaaauuuuuugguaau

SEQ ID NO: 125569 - RNA, 64 nt, Human
gugaaagguguacuuugugcucauuucagaaaauaaaacacaaccuuucucuugaugcaacagu

SEQ ID NO: 125570 - RNA, 64 nt, Human
ugggacacccgguggucuuucccaaaccucccccaaaacacaccuggagccagagccuucugcc

SEQ ID NO: 125571 - RNA, 64 nt, Human
uacuuacaucuucaauguggauaagauaaagaacaaaacacaugcaucuaaacugcugggcaau

SEQ ID NO: 125572 - RNA, 64 nt, Human
auauguuacugccuuguacuuuucucauacaccaaaaacacaccaaaaaaaucaauaaaauaag

SEQ ID NO: 125573 - RNA, 64 nt, Human
cgauggcgaggaagccagccccaaggaaacacugaaaacacauaucacgccaaugccguguggu

SEQ ID NO: 125574 - RNA, 64 nt, Human
aacuuccauaagauacugcuaaugcaccaguauuaaaacacaucgacguaaguagcucauuuag

SEQ ID NO: 125575 - RNA, 64 nt, Human
cagccugggcgacagagcaggacucucucucaaaaaaacacaaaaaaacaaaaacaaaaaacca

SEQ ID NO: 125576 - RNA, 64 nt, Human
guggaaagauaucuaugaaauauggugguuuuuuaaaacacaaaaauuauagaauaugggaucc

SEQ ID NO: 125577 - RNA, 64 nt, Human
uuuuauuuuaaaagccaugucuguuaaacaagaaaaaacacaaaagaacuccagauuccugguu

SEQ ID NO: 125578 - RNA, 64 nt, Human
ugggaaggaagaguaccucuuaucgagguaguauaaaacacauagggucuuguuucuuaaaaug

SEQ ID NO: 125579 - RNA, 64 nt, Human
aucgaucaguuuaugaucauugacaugugauuucaaaacacaguguucuuuuaaaaaucuauaa

SEQ ID NO: 125580 - RNA, 64 nt, Human
uccuggccaacauggugaaaccccgucucuacuaaaaacacaaaaguuagcugagcgugguggc

SEQ ID NO: 125581 - RNA, 64 nt, Human
caaaauucugaauaucuucaaauuaaauucgguaaaaacacauuauuuuuucauaugugaugua

SEQ ID NO: 125582 - RNA, 64 nt, Human
uccugcuugggugucccagcgggcgccuauggcaaaaacacagcgguugcaauuguguggcagc

SEQ ID NO: 125583 - RNA, 64 nt, Human
gaaguaacuauaacaaaaaaagaaaagagaaaaaaaaacacacaaaaagucccccuucaaucuc

SEQ ID NO: 125584 - RNA, 64 nt, Human
aacuggaacaccuagcuaacaggagagaggaaugaaaacacacccacgccuuggaaccguccuu

SEQ ID NO: 125585 - RNA, 64 nt, Human
gccugaccaacauggagaaaccccaucucuacuaaaaacacaaauuagccaggcguggugguac

SEQ ID NO: 125586 - RNA, 64 nt, Human
auauggucauccucuaaugaguguaaaagugcgcaaaacacauccuuauuguuccugaucucuu

SEQ ID NO: 125587 - RNA, 64 nt, Human
uucacuccagucacuagggacaauagaaaccugcaaaacacagauucauucguaaauauuauua

SEQ ID NO: 125588 - RNA, 64 nt, Human
uucagaaccacaugugugcgggacacccagacagaaaacacaaaugcaaagucaaguggagggc

SEQ ID NO: 125589 - RNA, 64 nt, Human
uuugcuuauaacuacaauuuaauuucacguugacaaaacacagugaaaagacaacuuugugaag

SEQ ID NO: 125590 - RNA, 64 nt, Human
uugcuuuaauccaguguauuuguuuauggaaagaaaaacacaaaggcagacuguugaguaaaaa

SEQ ID NO: 125591 - RNA, 64 nt, Human
uauguaaaaacucagaaggaaggcuccucugauaaaaacacagcuccuuuauuaugcugcuuuu

SEQ ID NO: 125592 - RNA, 64 nt, Human
agaaaagugacugggacgaugcuuccucucauccaaaacacaugcagagucacauccucauccu

SEQ ID NO: 125593 - RNA, 64 nt, Human
auauuuuuuaaaauuuacuuaguaaugcacauucaaaacacacaucaagucuucaggauaaagu

SEQ ID NO: 125594 - RNA, 64 nt, Human
uuuaacucuauuagcuuaaguaaugucauaauagaaaacacaagcauuugaccaaaugagaucc

SEQ ID NO: 125595 - RNA, 64 nt, Human
gcuacaguaaccaaaacagcauaguacuggcacaaaaacacacguagacugauggaacagaaua

SEQ ID NO: 125596 - RNA, 64 nt, Human
ucuaucagcugacuuuucaggguauccuuaaaaaaaaacacacacgaaaaacaaaaguuugcuu

SEQ ID NO: 125597 - RNA, 64 nt, Human
gguugauccugcuguguugaaggcugugguuaauaaaacacaaguaugauaaacaggaccuagc

SEQ ID NO: 125598 - RNA, 64 nt, Human
guagcaaaagccuuuccuggcugagaugaugcuuaaaacacaccucacuuauuguacauguugg

SEQ ID NO: 125599 - RNA, 64 nt, Human
agccugggagagagagaggaccugucuguugaaaaaaacacaaaaacaaaugaaugcauguggc

SEQ ID NO: 125600 - RNA, 64 nt, Human
aggcuuaaugauuuauugaaccauaaugucaauaaaaacacaacuuuugaggcuuuucugugug

SEQ ID NO: 125601 - RNA, 64 nt, Human
ggauauggggacaggagagauuaaagcagguucaaaaacacaugaacugcagaugccauaggcc

SEQ ID NO: 125602 - RNA, 64 nt, Human
agguagcuucaggaaauggcucagguuaauucucaaaacacaaauuguugcuggccaggcaugg

SEQ ID NO: 125603 - RNA, 64 nt, Human
uugaacugucucaaauguucucccaaagaugcuaaaaacacagccucuccuuuuagcaaguuaa

SEQ ID NO: 125604 - RNA, 64 nt, Human
guaggacucuguaaucuuuugauuaguuucugagaaaacacaaugaagcacuucacuuuuuuuu

SEQ ID NO: 125605 - RNA, 64 nt, Human
gcacuucacuuuuuuuuauucaaagccauuuaauaaaacacaguuggucagcccagugcaaagc

SEQ ID NO: 125606 - RNA, 62 nt, Human
agugcacggagaagccuuaaacacacccccgaaaaacacaagaccgacccaaaaucuagagg

SEQ ID NO: 125607 - RNA, 64 nt, Human
cucuggggacuaggugucagcaugugaauuuuggaaaacacaaaaauucagaacauagcaaaua

SEQ ID NO: 125608 - RNA, 64 nt, Human
guggugguguacacaggauagaacacccuuuuuuaaaacacagucuuuccccuugcucauugua

SEQ ID NO: 125609 - RNA, 53 nt, Human
uggcagcuugggcuaccuaaacuaaaacacauuuuugauaccuaaauuaauga

SEQ ID NO: 125610 - RNA, 64 nt, Human
cuaagauuacuugguuuugauuaccagugaaaagaaaacacaauacaaucaggaguuuucaaau

SEQ ID NO: 125611 - RNA, 64 nt, Human
accauccugucuaaugguuaagacaccaguaacaaaaacacaugauuuggaaauacuuuggcuu

SEQ ID NO: 125612 - RNA, 64 nt, Human
ccuuaauuuuaauugguaauuacagccccuaaaaaaaacacauuucaaauaggcuucccacuaa

SEQ ID NO: 125613 - RNA, 64 nt, Human
cuccgcuaacuguucucuucuuuuccuuauuaauaaaacacacaaugccuagcuggggggucgg

SEQ ID NO: 125614 - RNA, 64 nt, Human
auugauuuguacugguaguuuaugaaauuuaauuaaaacacaggccaugaauggaaggugguau

SEQ ID NO: 125615 - RNA, 64 nt, Human
gcaggaaaaggcuaagaaaaaggaaaaccauucuaaaacacaacaagaaacuguccaaaugcuu

SEQ ID NO: 125616 - RNA, 64 nt, Human
guuuguuguauggaaauuuugggggaaaaaauccaaaacacaaacuguggguugaaauauuaac

SEQ ID NO: 125617 - RNA, 64 nt, Human
ccccaaacugggggcucuguauauagcuaugaagaaaacacaaaguguauaaaucugaguauau

SEQ ID NO: 125618 - RNA, 64 nt, Human
cggcgauuuucgggcugagaaggcaguaguuuucaaaacacauaguuaaaaaagaaacaaauga

SEQ ID NO: 125619 - RNA, 64 nt, Human
gugacaaaccauuuccaacagcaacacagccacuaaaacacaaaaagggggauugggcggaaag

SEQ ID NO: 125620 - RNA, 64 nt, Human
uauuuuuaaaagggaggaaaaaaauaacaagaacaaaacacaggagaauguauuaaaaguauuu

SEQ ID NO: 125621 - RNA, 64 nt, Human
uaccaaauacaguaaaaacaaauguaaauaaaagaaaacacaucaucaauaaaacuguuauuau

SEQ ID NO: 125622 - RNA, 64 nt, Human
aagagagaaccuaacuguaucuugaggugguaguaaaacacagagggccaguaacgggucguaa

SEQ ID NO: 125623 - RNA, 64 nt, Human
cuaguccuagauuacuuauugauuuaaaaacaaaaaaacacaaaaaaauaguaaaauauaaaaa

SEQ ID NO: 125624 - RNA, 64 nt, Human
cuggauaaacuauuucauccgcuguuuccuccccaaaacacacacacagagcaaacucccuuuc

SEQ ID NO: 125625 - RNA, 64 nt, Human
uuuucaaaaaaaaaaaaaaaacaaaaacaaaaaaaaaacacaaaagcugcaugucuaaaauuac

SEQ ID NO: 125626 - RNA, 64 nt, Human
aacauaucuuucaugacuauuuugacaaaaguuuaaaacacauaugaaguucaaauuucaggaa

SEQ ID NO: 125627 - RNA, 64 nt, Human
augaugucaugcauaauuuuaagagacaagggagaaaacacaauguauagccagagaaggagaa

SEQ ID NO: 125628 - RNA, 64 nt, Human
aauguucccaccucccgacgggacgugcauuuggaaaacacagaaucagcccucagggugcacu

SEQ ID NO: 125629 - RNA, 64 nt, Human
cuagcugugaaucuucugagagugaaagcaacacaaaacacaagugugguuuuaaagccuugaa

SEQ ID NO: 125630 - RNA, 64 nt, Human
gcacacggaacuaccucccacccccuuuuuguacaaaacacaaggaaaaacauuuuuugcuuga

SEQ ID NO: 125631 - RNA, 64 nt, Human
uagugccagacaaacauaugauaucaugguguaaaaaacacacacauacacaaauauuuguaac

SEQ ID NO: 125632 - RNA, 64 nt, Human
uuguuucaaauugcaguuuuuauaaaacauuuuuaaaacacaaauggcauguaugcuaaugaga

SEQ ID NO: 125633 - RNA, 64 nt, Human
aucauguguguuaacccagugcuuuccauucgugaaaacacauuugcuuuuugugauaugcaca

SEQ ID NO: 125634 - RNA, 64 nt, Human
ucuuuauucugagggucucgggauugcagguugaaaaacacaaccuuaaucagcaguaaauucu

SEQ ID NO: 125635 - RNA, 64 nt, Human
uucuggcauuaaaagaaaaacaagcaagcaaacaaaaacacagccuccgaugccaaacauguuc

SEQ ID NO: 125636 - RNA, 64 nt, Human
uguaauauagcuaacuccguauuuacagaacaaaaaaacacaguucccccuccuguaguauaaa

SEQ ID NO: 125637 - RNA, 64 nt, Human
ucuacuaaaugcuauugauuucucucugauuacuaaaacacauuguuuauucucaguaguuucc

SEQ ID NO: 125638 - RNA, 64 nt, Human
cagcagaggaggguuugcagagaccucccucugaaaaacacaaagaauggacucucuccuggga

SEQ ID NO: 125639 - RNA, 64 nt, Human
ggacuucagagccaggccugcagcauuuuguuugaaaacacaaucagcucugacaguuagacau

SEQ ID NO: 125640 - RNA, 64 nt, Human
aaaaguagcauauucucuuaugaaauagcaugagaaaacacagggcauuucuaggacaguaaaa

SEQ ID NO: 125641 - RNA, 64 nt, Human
aaugcauauuuuucauuauuuauaauuuguguaaaaaacacaccuucaccuuacaaggugcuga

SEQ ID NO: 125642 - RNA, 64 nt, Human
ugcagggacaaccauccccauuuggcuucuccuuaaaacacaauugcagcugcauucugcaucg

SEQ ID NO: 125643 - RNA, 64 nt, Human
uguuuuuuaaaaucaucuuccaauucuauacuucaaaacacacaguugcucaaugucaaacugu

SEQ ID NO: 125644 - RNA, 64 nt, Human
ggccauuuuauucaaaugcuugcuauacaaucugaaaacacacuggcaggugcuccucuccuug

SEQ ID NO: 125645 - RNA, 64 nt, Human
uucagaauauuugcaauaagagucuggauuuuaaaaaacacaugcauacacacaauuaagagcu

SEQ ID NO: 125646 - RNA, 64 nt, Human
gaauuuauacauuggguaccagagcuaaaucuggaaaacacauuuggaaugagcuuccacacuu

SEQ ID NO: 125647 - RNA, 64 nt, Human
uuuaggagcuugacuuauuuuuuucucucucauaaaaacacauuuguuuuaauuguaggagaaa

SEQ ID NO: 125648 - RNA, 64 nt, Human
gcuagauccaguugugccucagggcagaggaaacaaaacacagcuauccuguuggccuguguug

SEQ ID NO: 125649 - RNA, 64 nt, Human
uuuaaggaaucauaaucauuuguauuuauacuuaaaaacacacaauguuaaaaaaaauaaagca

SEQ ID NO: 125650 - RNA, 64 nt, Human
uguagcaaaagaguauuuauacaucccaccaaucaaaacacagcuuuauuaccucaugcgaacu

SEQ ID NO: 125651 - RNA, 64 nt, Human
gcuggagcaggcuguucagaccgacguugccaucaaaacacauacacccagaaagaaacaacag

SEQ ID NO: 125652 - RNA, 64 nt, Human
uacugaacauuaggacaaacacaaaauaaaaaacaaaacacagacaacggugcugauucuggug

SEQ ID NO: 125653 - RNA, 64 nt, Human; identical to SEQ ID NO: 125635

SEQ ID NO: 125654 - RNA, 64 nt, Human
ggugugaucuuuuugguaguuguaauuuaacagaaaaacacaaaauuucaaccauucuuaaugu

SEQ ID NO: 125655 - RNA, 64 nt, Human
uuauguuucguuuauucacuaaaguagcugacacaaaacacaccaaaaccuagagcgguaguuu

SEQ ID NO: 125656 - RNA, 64 nt, Human
guuuccauucccaaauauguagcugugguucuugaaaacacauccuacauugcauaugggcaua

SEQ ID NO: 125657 - RNA, 64 nt, Human
uugguccauuuuacacuuuuuuaaaggggauuaaaaaacacagccucucccccaaagggugucc

SEQ ID NO: 125658 - RNA, 64 nt, Human
gaccaugagaaggaugcuuauuuuuuuuaaaaagaaaacacaucuaaaagcccaggaacugauu

SEQ ID NO: 125659 - RNA, 64 nt, Human
uaaacauuauucuucauuugaaauuccuucaauaaaaacacagucaccauucuucaucuucuug

SEQ ID NO: 125660 - RNA, 64 nt, Human
gucuuguagagucuuguuauaguuguauaaaucaaaaacacagaauaaggaacauauuuaacuu

SEQ ID NO: 125661 - RNA, 64 nt, Human
gccucuguucuuucaacuccuuugaggcucaaaaaaaacacaaagaucagaagccuucagauag

SEQ ID NO: 125662 - RNA, 64 nt, Human
aacaguucaauaaugaggaaacaggugagcccugaaaacacaaaaggacaguucuguguugaaa

SEQ ID NO: 125663 - RNA, 64 nt, Human
aaaaaaucaaaaggcacugugaacuauuuugaagaaaacacaacauuuuaauacagauugaaag

SEQ ID NO: 125664 - RNA, 64 nt, Human
aacagggaaaacagcuagcuugaaaacuugcugaaaaacacaacuuguguuuauggcauuuagu

SEQ ID NO: 125665 - RNA, 64 nt, Human
aucaagacuauuuauuuaaauacaaaaaaaggggaaaacacacacacggaaaaaaaauuguaag

SEQ ID NO: 125666 - RNA, 64 nt, Human
auuaaaauauacugcagggcaaauaauauucucuaaaacacaggaacugcuuuucguaaagaag

SEQ ID NO: 125667 - RNA, 64 nt, Human
acucuuucuuuaaauaaauuaagucucuacaauaaaaacacaacugcaaaguaccuucauaaua

SEQ ID NO: 125668 - RNA, 64 nt, Human
cacacaauacaugcaugcauuguauuaguguuagaaaacacagcugcguaaauaaacagcacgg

SEQ ID NO: 125669 - RNA, 64 nt, Human
uguggaugccagggccgaccagaggagccuuuuuaaaacacauguuuuuauacaaaauaagaac

SEQ ID NO: 125670 - RNA, 64 nt, Human
aagcugcaagggugcaaagggccugugccagaagaaaacacacacagggaaaccgcuuuuuuua

SEQ ID NO: 125671 - RNA, 64 nt, Human
uguguaaaguaaaaacuaaaaaaauacaaaauacaaaacacacacacacacacacacacacaca

SEQ ID NO: 125672 - RNA, 64 nt, Human
auccagaaaacuuuaacauucuucaaagaaauagaaaacacaauccuaaaauuuauaugggaac

SEQ ID NO: 125673 - RNA, 64 nt, Human
uacuuggugagugauuuaaaaauaaaaccaaaacaaaacacaaaaagauauuccacaggacaug

SEQ ID NO: 125674 - RNA, 64 nt, Human
aagauguguucauuguggacucuaaaaacaaaacaaaacacaaaauccccuguucaaauaaaca

SEQ ID NO: 125675 - RNA, 64 nt, Human
cuguuacauaacaccccaaauuaacucccaaauuaaaacacaguugugcugucaauaccucaua

SEQ ID NO: 125676 - RNA, 64 nt, Human
guuacugaugaauaugggccccuuauagagcugcaaaacacacacaugcguauagacauacaua

SEQ ID NO: 125677 - RNA, 61 nt, Human
agaagccagacuuccacugauggaagagcugaaaacacaagcccaggagugcagacacugc

SEQ ID NO: 125678 - RNA, 64 nt, Human
cuuguuuuaucaacguuuuggagacuacacaaugaaaacacaucuguuggggugaucagaccca

SEQ ID NO: 125679 - RNA, 64 nt, Human
caaauguagguaaggggagagcaaggaugcacagaaaacacacugacugugggacugugccagg

SEQ ID NO: 125680 - RNA, 64 nt, Human
uaugaaguauguucagcaaaggcauaauuuucuaaaaacacacacagaaaucgcuugagugagg

SEQ ID NO: 125681 - RNA, 64 nt, Human
gaacuaauuuuacuaauacaauacuguguucuuuaaaacacagcauuuacacugaauacaauuu

SEQ ID NO: 125682 - RNA, 64 nt, Human
guucccucuguauagccucugggacaagaaaaagaaaacacaagaauguauacacuggaagauu

SEQ ID NO: 125683 - RNA, 64 nt, Human
gcuauagaugaagguagagggcugucagcccugaaaaacacacaggucagacauuuaaaaggca

SEQ ID NO: 125684 - RNA, 64 nt, Human
uccauaaaaaaaaauagaugucuuuuauaguggaaaaacacauggggaaaaaaaucaucuauuu

SEQ ID NO: 125685 - RNA, 64 nt, Human
uuugcacuuggcaaaaagaaucccaauguuugacaaaacacagccaaggggauauuuacugcuc

SEQ ID NO: 125686 - RNA, 64 nt, Human
aucuauggucagugucuuugguuaaaaaaaaaaaaaaacacaggcaguucuuuacauaaaaacg

SEQ ID NO: 125687 - RNA, 64 nt, Human
aguuuaccaaagcauuuuuuguuuucuuaccuugaaaacacagaaccguuaauuccuugguuua

SEQ ID NO: 125688 - RNA, 64 nt, Human
aaggcaagggaaagaugcugccagucucuuugcuaaaacacagcaagagucaccuuuacuccag

SEQ ID NO: 125689 - RNA, 64 nt, Human
agacagugaaauuuuuauggaauacugcaccuauaaaacacaugccaaucuguuagcaguccug

SEQ ID NO: 125690 - RNA, 64 nt, Human
uggaaaaccucaugauuuauggggcacuggguagaaaacacaagugagaaacccuagaugggca

SEQ ID NO: 125691 - RNA, 64 nt, Human
uauguguucuuaauuuuuaacugcuggaaguguuaaaacacacacacacacacacacacauuuu

SEQ ID NO: 125692 - RNA, 64 nt, Human
aucaaagaagucuuuacaaccugaauccaggucuaaaacacacuagaguagcuggugacuauaa

SEQ ID NO: 125693 - RNA, 64 nt, Human
uaacauuaaaaacagcagcuuuaugauagagaaaaaaacacaaacauagacgauuguaccauug

SEQ ID NO: 125694 - RNA, 64 nt, Human
ucagcuguguguccaucaacacacaaauucguaaaaaacacacauggccucgccaucgugggua

SEQ ID NO: 125695 - RNA, 64 nt, Human
aaagaaauugccuguuucagccagaagacuggugaaaacacauacaucagacuauguugugagc

SEQ ID NO: 125696 - RNA, 64 nt, Human
acugguaucacugauuaacuguaaauaacaauuaaaaacacauuuucaguguuuaugauauguu

SEQ ID NO: 125697 - RNA, 64 nt, Human
caguuguuagcaaacccuuucaaccaucuaaaugaaaacacacaaauugaaaaugcacagaaug

SEQ ID NO: 125698 - RNA, 64 nt, Human
uuuuuaccuacuaauguagauugcuuuguauaauaaaacacaggguuuggaagguuuuguuaca

SEQ ID NO: 125699 - RNA, 64 nt, Human
ccugggggucaaguauuuuaagauaagagggggaaaaacacauaaagucaaacaaauguuuuaa

SEQ ID NO: 125700 - RNA, 64 nt, Human
gccacuggguauacugcugacaaccgcaacaacaaaaacacaaauccuuggcacuggcuagucu

SEQ ID NO: 125701 - RNA, 64 nt, Human
ugucaaaaugcagagaauggaaaacagugaacggaaaacacagaguaaacccuagugucaacuc

SEQ ID NO: 125702 - RNA, 64 nt, Human
uucagauuaguauucggacaugaauccauucuauaaaacacaucguguucaugauaguguauau

SEQ ID NO: 125703 - RNA, 64 nt, Human
cagccaggguuucucugccuucugccuggcagagaaaacacacugcuauggggaaaaucacagg

SEQ ID NO: 125704 - RNA, 64 nt, Human
uguucugguucccaaagucauuucacuucgaaauaaaacacagcuccuucaaacagcacuuuuu

SEQ ID NO: 125705 - RNA, 64 nt, Human
ccuuccuaaaaacaugucauuccacuugugaaagaaaacacaaugugcauguuucaaugauacu

SEQ ID NO: 125706 - RNA, 64 nt, Human
ugcugacacagcggggacugcucagcacucccuaaaaacacaccauggaggccacuggugacug

SEQ ID NO: 125707 - RNA, 64 nt, Human
auuuugaauauucccaauuuucgaagucaguaaaaaaacacaaaaacuguaugaaugacuuugu

SEQ ID NO: 125708 - RNA, 64 nt, Human
uaaaagagaggguccuucaaaaaaauuauuuuuuaaaacacagagguguucugaccugcaacuu

SEQ ID NO: 125709 - RNA, 64 nt, Human
uucuaaugcugacuuuuuaauauguuaucacuguaaaacacagaaaagugauuaaugaaugaua

SEQ ID NO: 125710 - RNA, 64 nt, Human
acuucuuuuuaucucuuuaguaugaacauuuucaaaaacacacagcuucaacaauugucaccau

SEQ ID NO: 125711 - RNA, 64 nt, Human
uauguaacuauucuaauccaguggaaucuuacggaaaacacagagaaaaccccuuuuaucauuu

SEQ ID NO: 125712 - RNA, 64 nt, Human
ccccuuucucuagagcaguuuuaugucauuuguaaaaacacauauuagcaaauucguuugcgua

SEQ ID NO: 125713 - RNA, 64 nt, Human
uauuuuguaaaguaagaaauauaccagaucuaauaaaacacaauggcuaugcacaggcugccgu

SEQ ID NO: 125714 - RNA, 63 nt, Human
cugcucuuguucaaauguaaaaacgcuggcaggaaaacacaaggccaaaucaaucauuuaaaa

SEQ ID NO: 125715 - RNA, 64 nt, Human
uagcccuguauacaguguagauacuauuuuuguaaaaacacaaggcuaaauuaaugaacaagaa

SEQ ID NO: 125716 - RNA, 64 nt, Human
agcugucuggagcuccaccuuugcaaagaaaggaaaaacacaaauugcccccagauuggcccag

SEQ ID NO: 125717 - RNA, 64 nt, Human
uaaguggcuugauuaaauggcugaucaaaacuuaaaaacacacuaggucaauguuuuucaagau

SEQ ID NO: 125718 - RNA, 64 nt, Human
agggagaagguggcauaacuuuuuggaacaaaagaaaacacaaaauccuagcuugggauuccca

SEQ ID NO: 125719 - RNA, 64 nt, Human
agcaagggacuauagauacucgugucccaauuccaaaacacaaugcacaagcugaacuugggcu

SEQ ID NO: 125720 - RNA, 64 nt, Human
gagccaggauuuuuaucugggucugucugacuuuaaaacacauacucuucuccuagcauauucu

SEQ ID NO: 125721 - RNA, 64 nt, Human
guuaauaaauacuucauuuggagauguaugguguaaaacacacaaacacacacaaaaaagcaca

SEQ ID NO: 125722 - RNA, 64 nt, Human
ggaacguccauccuggcucucugcggcuggugggaaaacacacccugcccugaggggcugucca

SEQ ID NO: 125723 - RNA, 64 nt, Human
aauccaauacauauuuuucucucagaauagaaagaaaacacaaagagaaaauaugaacaauaua

SEQ ID NO: 125724 - RNA, 64 nt, Human
auuuuucuuaacaauuugacccuccacuccuugaaaaacacaggauuauaaaauggugccgcca

SEQ ID NO: 125725 - RNA, 64 nt, Human
uuaaucugauucacaggauuauguuuaaucgccaaaaacacacuggccaguguaccauaauaug

SEQ ID NO: 125726 - RNA, 64 nt, Human
cagcacuguucaucuggccaaacaacugugguuaaaaacacauguaaaaugcuuuuuaacagcu

SEQ ID NO: 125727 - RNA, 64 nt, Human
aaaacugaagcugccaauacuuuggacacaaaccaaaacacacaccaaauaaucagaaacaaag

SEQ ID NO: 125728 - RNA, 64 nt, Human
uucuucagggauugaacucaguaucuuucauuaaaaaacacagcaguuuuccuugcuuuuuaua

SEQ ID NO: 125729 - RNA, 64 nt, Human
aaaaaaagauauuguuaaaaugaggccuccaugcaaaacacauacuucccucccauuuauuuaa

SEQ ID NO: 125730 - RNA, 64 nt, Human
auuucaaauugaugugguauuaauaaaaaaaaaaaaaacacaaacaaugacuguggcaucauuc

SEQ ID NO: 125731 - RNA, 64 nt, Human
gagaauuggugucuuucuaaaacauacuuauuuaaaaacacauacccacuuacuaauguggaau

SEQ ID NO: 125732 - RNA, 64 nt, Human
uagccuuacaguaucuggcuuuguacugagaaauaaaacacauuuucauauuugguuauuuuca

SEQ ID NO: 125733 - RNA, 64 nt, Human
aaagcaguccucuuauuccuaagguaauccuauuaaaacacagcuuuacaacuuccauacuaca

SEQ ID NO: 125734 - RNA, 64 nt, Human
ggguguguauauaucugauuugggaagaauuuaaaaaacacauagcuuuuuaauuuguuugaaa

SEQ ID NO: 125735 - RNA, 64 nt, Human
agcagaguguggccuucggacaacucagucccuaaaaacacagacauucugccaggcccccaag

SEQ ID NO: 125736 - RNA, 64 nt, Human
ccugggagacagaacgagacuccuaaucaaaaaaaaaacacaagaaaauagagugaggcuuuuu

SEQ ID NO: 125737 - RNA, 64 nt, Human
gauaauaaacuguccucuuucagaaaacagaaaaaaaacacacacacacacaacaaaaauuuga

SEQ ID NO: 125738 - RNA, 64 nt, Human
uccucaaucuggcccucuccacaugcacacccugaaaacacacacagacacacaacacacacac

SEQ ID NO: 125739 - RNA, 64 nt, Human
accucgugucccaaaagacuuugccuaucccagcaaaacacacacacacacacacacacacaca

SEQ ID NO: 125740 - RNA, 64 nt, Human
gaaucuuucagguggaauaaagucacaugaaaacaaaacacaacuauauauauuuucaguuuuu

SEQ ID NO: 125741 - RNA, 64 nt, Human
uucauaaugcagcaguuucuccaaaaacaaaaacaaaacacacaccacacacacgcgcuuuucc

SEQ ID NO: 125742 - RNA, 64 nt, Human
uuccaaaagaggucaccagaugcacaugggccgcaaaacacacagucaggcuuccagcacauuc

SEQ ID NO: 125743 - RNA, 64 nt, Human
ugcaggaaaaauugaacauuacuaauuugaauggaaaacacauggugugaguccaaagaaggug

SEQ ID NO: 125744 - RNA, 64 nt, Human
uuauacacuggaaauguugcguuuaugcuuuuuaaaaacacacguuaacuucagaggaaggaug

SEQ ID NO: 125745 - RNA, 64 nt, Human
agauauucaacagaaaauauugacccugcauugcaaaacacagguucggguucccuaaguccca

SEQ ID NO: 125746 - RNA, 64 nt, Human
ggcuggcuuuccuuagcagcaagaacuugagagaaaaacacaucugucucugcaaugcaaagug

SEQ ID NO: 125747 - RNA, 64 nt, Human
acuguauuuuaaaaaaagacagaaauuuaagggaaaaacacaagaaggcauuuugcuucaauau

SEQ ID NO: 125748 - RNA, 64 nt, Human
aguuugccccuuuuggaaugaucucugaauauauaaaacacacacacaaagagcaauaguuugc

SEQ ID NO: 125749 - RNA, 64 nt, Human
aguuugccccuuuuggaacgaccccugaauauauaaaacacacacacaccccgcgcacucucac

SEQ ID NO: 125750 - RNA, 64 nt, Human
gccugcgcugcaggagggcgggggcucugguuguaaaacacacuuccugcugcgaaagacccac

SEQ ID NO: 125751 - RNA, 64 nt, Human
ggacuuuuagcuguuaaaugguaucucauuuuuuaaaacacauuucacauuuaaagucauacau

SEQ ID NO: 125752 - RNA, 64 nt, Human
ucccacccaggaaacugaagauaaaagauuugggaaaacacaccaagaaaaaggggcaguuuuc

SEQ ID NO: 125753 - RNA, 64 nt, Human
gccacccaugacauuuaacauguugugaugcuugaaaacacaggaguagagaaaaucgaugaag

SEQ ID NO: 125754 - RNA, 64 nt, Human
cacaggugaggcauggcaauucuggaagcugauuaaaacacacauaaaccaaaaccaaacaaca

SEQ ID NO: 125755 - RNA, 64 nt, Human
gggacuauguacuacuguuaauaucucuaagaacaaaacacauugaacauccuuccagaaaguc

SEQ ID NO: 125756 - RNA, 64 nt, Human
uucuucaucucauccugugggauucugcaaucauaaaacacaggaaaggggaauucugugaugg

SEQ ID NO: 125757 - RNA, 64 nt, Human
cauucuuacauuaguuaagcuaagcagcaaaaagaaaacacacacacacacucacauuuagccc

SEQ ID NO: 125758 - RNA, 64 nt, Human
cguuggcgccgaggccaagacuuugauuuaaaagaaaacacaccucggcgacaaugucuugcug

SEQ ID NO: 125759 - RNA, 64 nt, Human
cagggggaaggagggaggcugacaagccuugaauaaaacacaagccuccguuucucuguggugu

SEQ ID NO: 125760 - RNA, 64 nt, Human
cuguuccccaugcgcacacacauacacacaccccaaaacacauacauugaaagugccucaucug

SEQ ID NO: 125761 - RNA, 64 nt, Human
aguuacacuuuuauuuccuguauguuguacaaucaaaacacacuacuaccucuuaagucccagu

SEQ ID NO: 125762 - RNA, 64 nt, Human
uuagugcaauuuucagauauuuauuuuugcacagaaaacacauuaucuggagagaaagaaagga

SEQ ID NO: 125763 - RNA, 64 nt, Human
acuuuauacucacuuaaaaucaagaaucccaucuaaaacacauagguaccuuaucugaaacucu

SEQ ID NO: 125764 - RNA, 64 nt, Human
uggaaaaaaugaucauggcuuuaaaaaaaaaacaaaaacacacacacaugaacucagauuugca

SEQ ID NO: 125765 - RNA, 64 nt, Human
gcccaggcugcagucuccacaccaaacagucaacaaaacacaaacccugaaggaaaaccuuuuc

SEQ ID NO: 125766 - RNA, 64 nt, Human
caacuuugucagguucacguccuauaacgguuaaaaaacacacacacacauacacaaaccguuu

SEQ ID NO: 125767 - RNA, 64 nt, Human
guucuuauggaaaaauacacacgcaauagcuaggaaaacacagggaaagaagaguucugagcag

SEQ ID NO: 125768 - RNA, 64 nt, Human
aucuugaugaaaauguugcacauucuauaguugcaaaacacauaaaaggggacuuaacauuuca

SEQ ID NO: 125769 - RNA, 64 nt, Human
uucacaaugauuaaugaacaaaaacaaagagaaaaaaacacacaucaauuaaaggagacaaaaa

SEQ ID NO: 125770 - RNA, 64 nt, Human
ucuuauuagcacugcaaaagcuccugagaauuuaaaaacacaguaauucucuggauguuaggac

SEQ ID NO: 125771 - RNA, 64 nt, Human
cuugccucuagaguaggccaaaugccaacucuguaaaacacacuuacauuaucgguuacagaau

SEQ ID NO: 125772 - RNA, 64 nt, Human
ggaacuuuccuaagaaaccgcugauaaccaggacaaaacacaaccaaggguacacgcaggcaug

SEQ ID NO: 125773 - RNA, 64 nt, Human
uucuuaaaagucuaagauagcagaaaauacaguaaaaacacaggagaagaagcugagcuauugg

SEQ ID NO: 125774 - RNA, 64 nt, Human
ucuacauuucagaccgagcuugucagcuuuuuugaaaacacaucaguagaaaccaagauuuuaa

SEQ ID NO: 125775 - RNA, 64 nt, Human
uaauaaaauauugugcaauauauucaaagaaaagaaaacacaaauaagcagaaaacauacuuau

SEQ ID NO: 125776 - RNA, 64 nt, Human
gaauuaccaagacgucugcuuuugugacagucagaaaacacaccuggaauacgaugcagcccac

SEQ ID NO: 125777 - RNA, 64 nt, Human
cuuuuauuguggcugaauuuuugugccuaucuauaaaacacacuuucaaauuauuugaauuacc

SEQ ID NO: 125778 - RNA, 64 nt, Human
aacaccuuaauaaucucaguuaauacuguauuucaaaacacauuuaacuguuuucuaaugcuuu

SEQ ID NO: 125779 - RNA, 64 nt, Human
aagaaaaagaagaggagaaaaaaacuucuuuaaaaaaacacauaauuuuucuuuuuuuuuuuug

SEQ ID NO: 125780 - RNA, 64 nt, Human
uguuauaaauauuguuauuuaaaaaacaaaaaacaaaacacacguacauuagguccugggugga

SEQ ID NO: 125781 - RNA, 64 nt, Human
uucuuaaaaucaaaaacaaaacaaaaaaacacaaaaaacacauucuaaauacuagagauaacuu

SEQ ID NO: 125782 - RNA, 64 nt, Human
aagaauuccuucuuaaaaucaaaaacaaaacaaaaaaacacaaaaaacacauucuaaauacuag

SEQ ID NO: 125783 - RNA, 64 nt, Human
cagauccuuaucucuccccauccccuagccucacaaaacacaguugagagucuuuuaaguaccu

SEQ ID NO: 125784 - RNA, 64 nt, Human
cuuagaucugcaguaggacuugcgaucaaaaaguaaaacacauucugaaagacuauugagccau

SEQ ID NO: 125785 - RNA, 64 nt, Human
gcauuggcuugaagcaauauaauauauuguaaacaaaacacagcucuuaccuaauaaacauuuu

SEQ ID NO: 125786 - RNA, 64 nt, Human
uaucuaucagacucaaaaucauuuaaagacuaacaaaacacaaucaugauauucuaacuguggu

SEQ ID NO: 125787 - RNA, 64 nt, Human
aagaagaaugagucagcuggugaugugcuuggucaaaacacacagucauacaugcauauacaua

SEQ ID NO: 125788 - RNA, 64 nt, Human
aacaaucuuacugguggaaagucuuuguaaggaaaaaacacauagcaaggagcaaauuuccaca

SEQ ID NO: 125789 - RNA, 64 nt, Human
gauggauagcacauaauggcacuugucuauguacaaaacacaaacuuuagagcaagaagaccuc

SEQ ID NO: 125790 - RNA, 64 nt, Human
uuuaauacuauaaauaauauucuauucauuuugaaaaacacaaugauuccuucuuuucuaggca

SEQ ID NO: 125791 - RNA, 64 nt, Human
gagaacucauaaaggagcauauaaggcuaaauguaaaacacaagacugucauuagaauugaauu

SEQ ID NO: 125792 - RNA, 64 nt, Human
uccuaccucuguucucgcugcgcuuuuuauuuuuaaaacacacgaaugaccaaggcuuguucca

SEQ ID NO: 125793 - RNA, 64 nt, Human
gucucuauuuaaggagaaaucaucaugcuaugauaaaacacagaagcaugaguggcaaguggcg

SEQ ID NO: 125794 - RNA, 64 nt, Human
uauuuccaggucacagaauugcuguuaacacuagaaaacacacuuccugcaccaacaccaauac

SEQ ID NO: 125795 - RNA, 64 nt, Human
aagggagggggggauuuaaagggaaggagugggcaaaacacauaaaaugaauuuauuauaucua

SEQ ID NO: 125796 - RNA, 64 nt, Human
cccuagaaacccaauucuaagcagaaaaagaaaaaaaacacaaaaaauaaaaaaccccuacaaa

SEQ ID NO: 125797 - RNA, 64 nt, Human
acauaccucuguccuagaagccggaaaaggaguaaaaacacauuggggagaucaugccuaaaag

SEQ ID NO: 125798 - RNA, 64 nt, Human
auaagaguaauauauguucauuguaaaaauuuuuaaaacacagaaacuauaugcaaagaaaaaa

SEQ ID NO: 125799 - RNA, 64 nt, Human
ugucaggauaugcauuagauucucuccugaaccaaaaacacaacagucauuaucugugaaccau

SEQ ID NO: 125800 - RNA, 64 nt, Human
acauaugauauguuuauuaaaauugaaauaauguaaaacacaugaauaaauuugcaaaaccaag

SEQ ID NO: 125801 - RNA, 64 nt, Human
aagcuauauuaauuguguuuugcauaaaauugccaaaacacaguaauguguauauagugguaua

SEQ ID NO: 125802 - RNA, 64 nt, Human
accugccuuucuuccuucucucauaaacguacucaaaacacacgaagcauaauauguaaaaagu

SEQ ID NO: 125803 - RNA, 64 nt, Human
uguaagaaaugagugguauuugauguauuuacucaaaacacaauuugcacuguacacuagugaa

SEQ ID NO: 125804 - RNA, 64 nt, Human
caaccaaaccaauucaccaacacaguugggacccaaaacacaggaagucagucacguuuccuuu

SEQ ID NO: 125805 - RNA, 64 nt, Human
uuugagucuugcauuacuuuuuguuccuuuuuuaaaaacacaagagcacugaaucaaaagaauu

SEQ ID NO: 125806 - RNA, 64 nt, Human
ccaaaugauaagaacaacagcaacaaaaggcuccaaaacacacaugccucuuuguuuugaugcu

SEQ ID NO: 125807 - RNA, 64 nt, Human
ggcuuggaggaaaugguacugcccaaauaggaggaaaacacagccucccugagccugcauucug

SEQ ID NO: 125808 - RNA, 64 nt, Human
caaacuguuggucauauguacaguauauaaacauaaaacacacaaggaagguauuauguaugca

SEQ ID NO: 125809 - RNA, 64 nt, Human
acaucaaugcaaaagguccugauuuuguuccagcaaaacacagugcaauguucucagagugacu

SEQ ID NO: 125810 - RNA, 64 nt, Human
uuagaucaccugcaauucauuugcaaauugcaauaaaacacauuuuagaaaaaaggaaccuuca

SEQ ID NO: 125811 - RNA, 64 nt, Human
ugugcuuaauuaucgguaaguauaaauauuugagaaaacacauggucuggauauuuaaaacccu

SEQ ID NO: 125812 - RNA, 64 nt, Human
auuaauucaaugggagauaguauaaaauacauagaaaacacaaguaacagaaaccugguugaaa

SEQ ID NO: 125813 - RNA, 64 nt, Human
uccuaucugaggucuuucaucuccucacuucaggaaaacacaguucagcaaagucuucagaugc

SEQ ID NO: 125814 - RNA, 64 nt, Human
acugcaaaucaugucaguguaguacaaaauucugaaaacacauaagggcugguuauuuaccucc

SEQ ID NO: 125815 - RNA, 64 nt, Human
aaaauuuuaaauuauuucacauuagccauuuguuaaaacacagcaucauaacucagcaggcugg

SEQ ID NO: 125816 - RNA, 64 nt, Human
auagaugacacugaugguuuuacuccuuuuuuuaaaaacacaugcgcgcgcacacacacaugcu

SEQ ID NO: 125817 - RNA, 64 nt, Human
uaucgguauacaaauuccauuucuuuuuauaagaaaaacacauaaaccauuaucauuuauucau

SEQ ID NO: 125818 - RNA, 64 nt, Human
auuauuaauuuauuuuuacuuucuauaccauuucaaaacacauuacacuaagggggaaccaaga

SEQ ID NO: 125819 - RNA, 64 nt, Human
ggucacacaagccaaccaugucaugccagaguacaaaacacauaguucuuuccccgccccgaau

SEQ ID NO: 125820 - RNA, 64 nt, Human
uuaauucuagauacuuuugagacaacaccuucagaaaacacauaauuuaaucuuugccauccuu

SEQ ID NO: 125821 - RNA, 64 nt, Human
cuauuuuguaaacagaugauguauuucuccauugaaaacacaauaaaaaaaaaacagcacaauc

SEQ ID NO: 125822 - RNA, 64 nt, Human
aagaugcucuaucuugcucuguaaucucguuucaaaaacacaguguuuuuguaaaguguggucc

SEQ ID NO: 125823 - RNA, 64 nt, Human
acaugauuuuucuuccuuaaacuugaacaccaaaaaaacacacacacacacacacguggggaua

SEQ ID NO: 125824 - RNA, 64 nt, Human
cuaaaaaauaaaaaucaagucuuuaggagaguagaaaacacaauuaacuaaaaagcagggacau

SEQ ID NO: 125825 - RNA, 64 nt, Human
auuguauugaaguuuuucugcauuauacaacccuaaaacacagagaucucacugacccguugcc

SEQ ID NO: 125826 - RNA, 64 nt, Human
auuaagaagauugacuauaccaaacauuauauuaaaaacacaaaauaaaaacuauaaaaaugua

SEQ ID NO: 125827 - RNA, 64 nt, Human
cuguauuucagaguaaaaucuccuaaaggaaauaaaaacacagaguuguaaauacacaugcuug

SEQ ID NO: 125828 - RNA, 64 nt, Human
aagguuauuaagaauacuuagugcagaaggugguaaaacacaaaagugauuuuuuuacucuaac

SEQ ID NO: 125829 - RNA, 64 nt, Human
uucuaugaaguaugcauuuuguguaacuaauguaaaaacacaaauuuuauaaaauuguacaguu

SEQ ID NO: 125830 - RNA, 64 nt, Human
caaguauuucuuuauagcaaugcaagaauggccuaaaacacaaggcaaaacaacuuugauaugg

SEQ ID NO: 125831 - RNA, 64 nt, Human
gcuuauuuauuuacuguuaauaaacagaucuuccaaaacacacaguuaccugguucacagauag

SEQ ID NO: 125832 - RNA, 64 nt, Human
agaaucuauauuccaagcacauuuacugaaauguaaaacacaacaggaagcaaagcaaucuccc

SEQ ID NO: 125833 - RNA, 64 nt, Human
uauuuuuguaaauguuaugcacucucugaaaggaaaaacacacacaaaagaaaaagacuuuuuu

SEQ ID NO: 125834 - RNA, 64 nt, Human
uguuuuggaaguaugcaugcaggccuauaaaugaaaaacacaauucuuuauguguauagcaugu

SEQ ID NO: 125835 - RNA, 64 nt, Human
cuggaugggaaagugcagucuuguuguucauauaaaaacacacuucuuauuaguuuaccacuug

SEQ ID NO: 125836 - RNA, 64 nt, Human
auuuuauaauugauugguuacuuauuuaagaagcaaaacacagcaccuuuacccuuagucuccu

SEQ ID NO: 125837 - RNA, 64 nt, Human
uuuuuuuaauuuggcaggauaaaauauugcaaaaaaaacacauuuguauguuaaguccuauugu

SEQ ID NO: 125838 - RNA, 64 nt, Human
uuaaaacuucaugaaguucuaaugucuguguuccaaaacacaucacauuauuaggauguaggga

SEQ ID NO: 125839 - RNA, 64 nt, Human
caggugucaaaguaaauuuguuaaaaaaacaaaaaaaacacaaaaauuucaaaaaacaccaccc

SEQ ID NO: 125840 - RNA, 64 nt, Human
gaugggugccuguggguguuuuuagacaccagagaaaacacagucucugcuagagagcacuccc

SEQ ID NO: 125841 - RNA, 64 nt, Human
augauguacacuuugugcuuggcauuaaaagaaaaaaacacacauccuggaagucuguaaguug

SEQ ID NO: 125842 - RNA, 64 nt, Human
aaggagauacugucucugaacaaaaauagcuggaaaaacacauaacuguuaacuaaggguugcc

SEQ ID NO: 125843 - RNA, 64 nt, Human
uuuuuuuuaugaucaaggaaaagaucauuaaaaaaaaacacaaagaaguuuuucuuuguguuug

SEQ ID NO: 125844 - RNA, 64 nt, Human
auuuauugauuugaagauuuuaaagaugaaugguaaaacacacucuuaauacugauuacaugga

SEQ ID NO: 125845 - RNA, 64 nt, Human
agaggauuguaaaaugcacccaucagugcucuguaaaacacaccaaucagcgcucuguagcuag

SEQ ID NO: 125846 - RNA, 64 nt, Human
gaaaauaauuaauauauuauucuauuuagcuuguaaaacacauggaaucuguuuaagauagccc

SEQ ID NO: 125847 - RNA, 64 nt, Human
uauuuucaaguuuuucauacuguacacauuucuuaaaacacaugauaccagcagcaacugaaaa

SEQ ID NO: 125848 - RNA, 64 nt, Human
aagaaguucaaauuuuuuucugucacuguaacagaaaacacaauauguauauaacauuuaugua

SEQ ID NO: 125849 - RNA, 64 nt, Human
agcuagcuuaaaaagaaaacauauauuuuauguaaaaacacauacauggccaaaugcaauacug

SEQ ID NO: 125850 - RNA, 64 nt, Human
uggggagaugaugggcuaaacaggcaacuuuucaaaaacacagcuaucauagaaaagaaacuug

SEQ ID NO: 125851 - RNA, 64 nt, Human
auuuaauuaugguuuucuugaaacguguaaauuaaaaacacaaucaguguucaggcuucaguua

SEQ ID NO: 125852 - RNA, 64 nt, Human
caucuuguccuugcuuuuagaacacccauggaagaaaacacagaguagauauugcugucauuua

SEQ ID NO: 125853 - RNA, 64 nt, Human
cacaugaggaccacgguuugccucaguuucugguaaaacacaaggucuggagugccccugcaaa

SEQ ID NO: 125854 - RNA, 64 nt, Human
cgaaagucucugugugauggaaaacaucaagguuaaaacacaaaugacagauauggaagaaaau

SEQ ID NO: 125855 - RNA, 64 nt, Human
ccuugcugcccgcgggagacagcuucucugcaguaaaacacauuugggauguuccuuuuuucaa

SEQ ID NO: 125856 - RNA, 64 nt, Human
ucauuguaggggagggauuuuuuauauauauauaaaaacacacaccacaugcuugaaggucuua

SEQ ID NO: 125857 - RNA, 64 nt, Human; identical to SEQ ID NO: 125838

SEQ ID NO: 125858 - RNA, 64 nt, Human
agggugaagugaagacaaugacuuacuguacaugaaaacacauuuuucuuagggaaggauacaa

SEQ ID NO: 125859 - RNA, 64 nt, Human
uuaaaacuucaugaaguucuaaugucuguguuccaaaacacaucacauuauuagguuguaggga

SEQ ID NO: 125860 - RNA, 64 nt, Human
uucauacauauaaaugguggugaaauaaagaaauaaaacacaauacuuuuacuugaaauguaaa

SEQ ID NO: 125861 - RNA, 64 nt, Human
gcuauuuaaccaaaugaggagguuuaaucaacagaaaacacagaauugaucaucacauuuugau

SEQ ID NO: 125862 - RNA, 64 nt, Human
uuugccuaacaggaaucugaaauauaacuugccaaaaacacacaguugguguggaauggucauu

SEQ ID NO: 125863 - RNA, 64 nt, Human
uaaacacagaguguagagugaaaacacuagagugaaaacacaugcuacaaugaggcagcaucag

SEQ ID NO: 125864 - RNA, 64 nt, Human
uagccuaggugacagagugagacucugucucaaaaaaacacaaaaguuucucuuuucaaaacau

SEQ ID NO: 125865 - RNA, 64 nt, Human
cucacauccccaucuuacuuuccuacauguucucaaaacacaguaguaccagccuuaccuuucu

SEQ ID NO: 125866 - RNA, 64 nt, Human
aggggauccucguugaaaggagcccuuuuuacucaaaacacaugggcuaguacuugagguguuc

SEQ ID NO: 125867 - RNA, 64 nt, Human
aaggcagaggcaugcacauuccucacugaaaaagaaaacacacacccacccacacacacacaca

SEQ ID NO: 125868 - RNA, 64 nt, Human
cuagacuggacccugguuugaugaaccagcuguaaaaacacauuucuggaacaacuggagaaac

SEQ ID NO: 125869 - RNA, 64 nt, Human
ucagcauuuuucauggaaguuuaaugccaaauguaaaacacaugaaaauuuuuaaaaauaugcu

SEQ ID NO: 125870 - RNA, 64 nt, Human
uggacuuaagauucaaccucuaucuggagaggugaaaacacaaaggcuuaaggacaacaguuuc

SEQ ID NO: 125871 - RNA, 64 nt, Human
cuaugaauuuagugguuuuauguggauaugccacaaaacacaagugguaugcuuuagaucugca

SEQ ID NO: 125872 - RNA, 64 nt, Human
aggaaugaaguagaagguaguuauuuaaaaauaaaaaacacaguccgucccuaccaauagagga

SEQ ID NO: 125873 - RNA, 64 nt, Human
uucacacagacugaaagugaguucgggcuuguguaaaacacaugagauuggauuugaccccuug

SEQ ID NO: 125874 - RNA, 64 nt, Human
uuguauaccacuauucauaaguuaggguaaagugaaaacacaauuuucuggauauauugggccu

SEQ ID NO: 125875 - RNA, 64 nt, Human
aaauuccugugaucuguaaaaaaaaaaaaaaaaaaaaacacaaaacccacaagcacuuaucuug

SEQ ID NO: 125876 - RNA, 64 nt, Human
gagaaaccuaauacuguaauuugauuugagccauaaaacacauuuuaauauuagcuuguauuau

SEQ ID NO: 125877 - RNA, 64 nt, Human
gagaaccaguuccuuuacuaaacauccauuuuauaaaacacaagguuucaauuugagcccaucu

SEQ ID NO: 125878 - RNA, 64 nt, Human
guauuuaaaaaauaucuaggaggagcuaaaugacaaaacacagcaguguuuugagggagaaagg

SEQ ID NO: 125879 - RNA, 64 nt, Human
ugauuauucagcauacuguugauucgucauuugcaaaacacacauaauaccgucagagugcugu

SEQ ID NO: 125880 - RNA, 64 nt, Human
aacuccugggaaccucgauauucugacauuuggaaaaacacauuuaauuuaucuccuguguuuc

SEQ ID NO: 125881 - RNA, 64 nt, Human
agagcguuuugcggucaucagacuuccucaucugaaaacacagaacauacugacccuuucaagu

SEQ ID NO: 125882 - RNA, 64 nt, Human
uauuugauggcucuaagggcuauaaauuacaaacaaaacacaucccagacauuaggaguucaua

SEQ ID NO: 125883 - RNA, 64 nt, Human
uuggaaaaaccaaaauauguaauuuuaaaaaacuaaaacacauccugguagucccagugaugug

SEQ ID NO: 125884 - RNA, 50 nt, Human
uauauucuagcaaacauugaaaaacacauuuugcauaucucccagcauaa

SEQ ID NO: 125885 - RNA, 64 nt, Human
gcaggcuguaacuaucuuaauagaauaguacaauaaaacacaaccccccacccagcauuaaaaa

SEQ ID NO: 125886 - RNA, 64 nt, Human
ugguuuugguuuccaccuuacccuacuggcuguaaaaacacaaauguguacuuuauugauuuuc

SEQ ID NO: 125887 - RNA, 64 nt, Human
guuugggaaugagaggaugagugagugaggcuugaaaacacaccacauugaaaauccugccaca

SEQ ID NO: 125888 - RNA, 64 nt, Human
aagagauguaaaaaaaaaaaaaaaaaaaaaaaaaaaaacacacacacagaggaaagacgcucuu

SEQ ID NO: 125889 - RNA, 64 nt, Human
uguauaauagacaauugugucuacuacauguuuaaaaacacauugcuuguuauuuuugaggcuu

SEQ ID NO: 125890 - RNA, 64 nt, Human
ccucugccuaccaacaacugggcuuaucacugggaaaacacaaaaaauuacacaacccagcaac

SEQ ID NO: 125891 - RNA, 64 nt, Human
acaaaccacccccacuccuacccagccagcccucaaaacacaaaggaacaaagacaguccacuc

SEQ ID NO: 125892 - RNA, 64 nt, Human
guguaaauagccagccugucucuuucucggugauaaaacacacccucucuggugagcccagcgu

SEQ ID NO: 125893 - RNA, 64 nt, Human
cagcuucuuaaaguucagcguguuaaccuaacauaaaacacagcaagaaucugguugucugaac

SEQ ID NO: 125894 - RNA, 64 nt, Human
aaaucuuucuuucucuucucucuccaugaaaauuaaaacacacaagugaaugaaguaauuacau

SEQ ID NO: 125895 - RNA, 64 nt, Human
aaagcccauucuuccagagucuugugccuuaaauaaaacacaccucucugcugugggaagacug

SEQ ID NO: 125896 - RNA, 64 nt, Human
aauuuuuaagggggggaaagguuucaaauggggaaaaacacacaaaaaaaaaaaucacuaaaaa

SEQ ID NO: 125897 - RNA, 64 nt, Human
cuacuauuuucaacaaaacaaaacaaacaagcaaaaaacacaaaaaccucagagaccaaaacac

SEQ ID NO: 125898 - RNA, 64 nt, Human
aauucuaaauccuugauccucugcaaugugcuugaaaacacaaaccuuuuggguuaaaagcuuu

SEQ ID NO: 125899 - RNA, 64 nt, Human
uauuugauggcuccaagggcuauaaauuacaaacaaaacacaucccagacauuaggaguucaua

SEQ ID NO: 125900 - RNA, 64 nt, Human
uauucuuuuuaagaaggaguagaguugcaacuggaaaacacagacaccagaaaugaaaguguug

SEQ ID NO: 125901 - RNA, 64 nt, Human
agagcuagggcuggagggacagggagcagggcagaaaacacagccuguguacuccucugacugg

SEQ ID NO: 125902 - RNA, 64 nt, Human
gauuaaacuuucauauugggcagugguucacuuuaaaacacacacauacacacacaaaacaauu

SEQ ID NO: 125903 - RNA, 64 nt, Human
ccccaccccuuuuucuaaaaaacaaacaaaaaaaaaaacacacaaaacaaaaacagaacaaaag

SEQ ID NO: 125904 - RNA, 64 nt, Human; identical to SEQ ID NO: 125882

SEQ ID NO: 125905 - RNA, 64 nt, Human
gcucacugcaggcaggcaauccaggcagucguuaaaaacacagagagagguguccuccugacca

SEQ ID NO: 125906 - RNA, 64 nt, Human
caagaagcaauuauuuaaagaaagugaaaaauguaaaacacauacaaaagaauuaaacccacaa

SEQ ID NO: 125907 - RNA, 64 nt, Human
ggaggaaaggcagucgggacugacccccucucuuaaaacacauucccgcccgcccacaggccug

SEQ ID NO: 125908 - RNA, 64 nt, Human
guaccccacauccucuccuccgggacagucaccgaaaacacagguuccaaagucuaccuggugc

SEQ ID NO: 125909 - RNA, 64 nt, Human
uuuuuaauuugagaauuuuuauuucuuuugacugaaaacacauuagaaccuaugaguaaauucu

SEQ ID NO: 125910 - RNA, 64 nt, Human
auaggcuuugccuuuaaugaucucuuacgguuagaaaacacaauaaaaacaaacuguucggcua

SEQ ID NO: 125911 - RNA, 64 nt, Human
uugauucaucgaggagaacuugguagauggggagaaaacacaguugguuuuuuuuuccacguua

SEQ ID NO: 125912 - RNA, 64 nt, Human
acagaacuaguccaacucuuaaaaggagagaggaaaaacacaggcaccaguugucagcucaugc

SEQ ID NO: 125913 - RNA, 62 nt, Human
aggccuacgaugucuccuaaguuucccugucuaaaacacaucaguguaaauucaggcuucag

SEQ ID NO: 125914 - RNA, 64 nt, Human
gauuucagcugauagaaaaacaaaaaugaaaaaaaaaacacaaaaaacaaaaaacauggcacgu

SEQ ID NO: 125915 - RNA, 64 nt, Human
gcucuucugaacaacuucugcuacccacuaaauaaaaacacagaaauaauuagacaauugucua

SEQ ID NO: 125916 - RNA, 64 nt, Human
aaaagacaguguugaauaaacauaccugugugauaaaacacagaauuuacauauacacugaaga

SEQ ID NO: 125917 - RNA, 64 nt, Human
uggacuaaauggacauauuucuuaugcaaaaaggaaaacacacacaaccaauaacucaaacaaa

SEQ ID NO: 125918 - RNA, 64 nt, Human
cauauuugugcaccuuauuaagccccaucuuaagaaaacacaaagucuaagucugcuguuacaa

SEQ ID NO: 125919 - RNA, 64 nt, Human
cauuaaguagaauuccaguugucuuucuguuucuaaaacacagaacuuacaagagccacaggag

SEQ ID NO: 125920 - RNA, 64 nt, Human
uguguuagagcaguugcaugcucuccugcuguuaaaaacacauuguuaagcuguggauuuguac

SEQ ID NO: 125921 - RNA, 64 nt, Human
uuucgaaaucaaguagauaagaacuucuuagacaaaaacacacaagccauuaguugacacugau

SEQ ID NO: 125922 - RNA, 64 nt, Human
auccuucuuauguuucuaaauuuugugauucuauaaaacacaucaucaauaaaauaaugacaua

SEQ ID NO: 125923 - RNA, 64 nt, Human
auccuucuuauguuucuaaauuuugugauucuauaaaacacaucaucaauaaaauagugacaua

SEQ ID NO: 125924 - RNA, 64 nt, Human
acaacgcugcucuuuguuucaacuuccggauauaaaaacacaaguauugccuauuuuuauagaa

SEQ ID NO: 125925 - RNA, 64 nt, Human
caccccugccgacucccagcccggccaaaaagacaaaacacauagacgcacacacucaggagga

SEQ ID NO: 125926 - RNA, 64 nt, Human
aagaaaaaauaacaaaacaaaaaacaagaaaaaaaaaacacaaaaccccguaaaaucacaaaga

SEQ ID NO: 125927 - RNA, 64 nt, Human
gaagaaguggcccuccauagacauguguagcaucaaaacacaaaggcccacacuuccugacgga

SEQ ID NO: 125928 - RNA, 64 nt, Human
cagccugggcaacaagagugaaacucugucuuaaaaaacacaaaaaaagacuuggccuuagggc

SEQ ID NO: 125929 - RNA, 64 nt, Human
cauucauaucugccaagaucguuugaauacaugcaaaacacacacuggagagaaaccuaugaau

SEQ ID NO: 125930 - RNA, 64 nt, Human
gccucucucuuucucucucuuucuuaauuguaugaaaacacaaagcacaggucaggauccucug

SEQ ID NO: 125931 - RNA, 64 nt, Human
auaccacaugguaaccuacuguuugccagccuguaaaacacacacacacacacacacacacaca

SEQ ID NO: 125932 - RNA, 64 nt, Human
agauuuucuaagaaccaaaaaaaaaaaaggaaaaaaaacacaaaacaacaaaaaccaaaaaaaa

SEQ ID NO: 125933 - RNA, 64 nt, Human
acugaacuccaguuuugaucucgugacuuuuagaaaaacacagggacucgugggagcaagcgag

SEQ ID NO: 125934 - RNA, 64 nt, Human
cugaguucaggugacugaggaagagccacaaaacaaaacacaacaaaaccaaaccacagaauca

SEQ ID NO: 125935 - RNA, 64 nt, Human
ccuuaaaaugaauucaaggaaaugacauuuaauuaaaacacauaaaaccaagcagucuacaauc

SEQ ID NO: 125936 - RNA, 64 nt, Human
aaaguuugugcgcauguuuuucauuauaacaaugaaaacacaaaaguggagaagcuguacaacg

SEQ ID NO: 125937 - RNA, 64 nt, Human
auaagacacccaauuuuucaugggaguugacaccaaaacacagcuggauuccaucaggaaagcu

SEQ ID NO: 125938 - RNA, 64 nt, Human
aaaaaaauuucacaccuugcaaaaggagaucuaaaaaacacaaucagaaaugacaaaggggaca

SEQ ID NO: 125939 - RNA, 64 nt, Human
cagccguggguuacgcaaugauuucuuaguacacaaaacacagcaaacauaaaaaguuguuaca

SEQ ID NO: 125940 - RNA, 64 nt, Human
caaaugucuaagguccccacugccugcuggagagaaaacacacuugcuuagcccacaauucucc

SEQ ID NO: 125941 - RNA, 64 nt, Human
caaaugucuaagguccccacugccugcuggagagaaaacacacuccuuugcuuagcccacaauu

SEQ ID NO: 125942 - RNA, 64 nt, Human
caaaugucuaagguccccacugccugcuggagaaaaaacacacuccuuugcuuaacccacaguu

SEQ ID NO: 125943 - RNA, 64 nt, Human
ccaaugucuaagguccccacugccugcugcagagaaaacacacuccuuugcuuagcccacaauu

SEQ ID NO: 125944 - RNA, 64 nt, Human
acaaaugucuagguccccacugccugcuggaaagaaaacacacuccuuugcuuagcccacaguu

SEQ ID NO: 125945 - RNA, 64 nt, Human; identical to SEQ ID NO: 125941

SEQ ID NO: 125946 - RNA, 64 nt, Human
caaaugccuaaggucgccacugccugcugcagagaaaacacacuccuuugcuuagcccacaagu

SEQ ID NO: 125947 - RNA, 64 nt, Human
uuagagaagaacauaaaugaccugauggagcugaaaaacacagcaugagaacuucgugaagcau

SEQ ID NO: 125948 - RNA, 64 nt, Human
uggaauuuauccacuucuuuugguuccccaguccaaaacacagucauuucaccuggacuauuuc

SEQ ID NO: 125949 - RNA, 64 nt, Human
auuguggcaaacuagaggggaagugcccauuguaaaaacacauccacagacaguccaggcacua

SEQ ID NO: 125950 - RNA, 64 nt, Human
agagagagaaaaaaaaucacccaccacccccccaaaaacacaaaaaaagaaaaucuaucuauau

SEQ ID NO: 125951 - RNA, 64 nt, Human
ucucugccaaaaaaaaaaaaaaacuuaaaaauuaaaaacacaaagagcaaagcagaacuuauaa

SEQ ID NO: 125952 - RNA, 64 nt, Human
ugggauuacaggccugagccaccguaucuggcccaaaacacaaauuuauauucucacauaucug

SEQ ID NO: 125953 - RNA, 64 nt, Human
uagaaauuaauuuaauuuuaaaucaaugagguuaaaaacacaggauuuuuuuuuuuuuuuuuuu

SEQ ID NO: 125954 - RNA, 64 nt, Human
ccacccccaagacugggaggggacuucuuuuucuaaaacacaaaacucagcccagccaggcccc

SEQ ID NO: 125955 - RNA, 64 nt, Human
caaacagaagaggaaaaaaaagcaacaaaaaaagaaaacacacagaagagauuuaaaaaaaaaa

SEQ ID NO: 125956 - RNA, 64 nt, Human
gaacaaaaaagaaaaaaaucaaaaaagcgacaaaaaaacacaaacagaagaggaaaaaaaagca

SEQ ID NO: 125957 - RNA, 64 nt, Human
aauuuuuacuggggauucuugaacuugaaaaaaaaaaacacaaaaaaagacaaaaaaaaaaaaa

SEQ ID NO: 125958 - RNA, 64 nt, Human
guggcuugaugguuaagacagguuuauuuuagagaaaacacaccugagaggggcugcuggcuga

SEQ ID NO: 125959 - RNA, 64 nt, Human
ggccccaggcucguuuuccuuuauagcgaagcaaaaaacacaagacccuccgcccgaguaaauu

SEQ ID NO: 125960 - RNA, 64 nt, Human
ugucaaauccuuuaguguauuuucaacuuuuauuaaaacacaagauaauucauacuggagagaa

SEQ ID NO: 125961 - RNA, 64 nt, Human
cuacuuuauuuugauacaacauauuccccccaaaaaaacacauacauaggaacugguuauauuc

SEQ ID NO: 125962 - RNA, 64 nt, Human
guggcuaguccaaauucaaaugguguuuuuuuguaaaacacaagauucugaagacuuaguuauu

SEQ ID NO: 125963 - RNA, 64 nt, Human
caaacaggcugauaccuuugugaaguugcccaccaaaacacagaaggaaaaaaacaugaauuuc

SEQ ID NO: 125964 - RNA, 64 nt, Human
cauaaaaaaugaaauauucacagaaucagaucugaaaacacaugucccagacugcauacugggg

SEQ ID NO: 125965 - RNA, 64 nt, Human
gaaauaaauguuguuuuagaaagccuacucaaugaaaacacauuuuaagacugaaagugaaaua

SEQ ID NO: 125966 - RNA, 64 nt, Human
ugugacaaaaguuuucaguuguaaaucaaaccuuaaaacacauaagaaaauucacauugaagag

SEQ ID NO: 125967 - RNA, 64 nt, Human
cauggugaaaccucaucucuaccaacaaaacaaaaaaacacaaaaauuagccaggugugguggu

SEQ ID NO: 125968 - RNA, 64 nt, Human
ugagcagggaaggaacuuacugucuaauauaggaaaaacacaugagaacaggugcaauauauug

SEQ ID NO: 125969 - RNA, 64 nt, Human
guaccugcagcagacaacucugaauuaaagcaugaaaacacagcaagccccuuggccuguuuuc

SEQ ID NO: 125970 - RNA, 64 nt, Human
aagcacgaaaaauuauuuauaauagucuggagaaaaaacacacuguaauauuucaaguguaugc

SEQ ID NO: 125971 - RNA, 64 nt, Human
aguucaaacauaaggaaacaguguuugauuaaaaaaaacacaucuaguaagacguaaggggaaa

SEQ ID NO: 125972 - RNA, 64 nt, Human
ucaaucugugugagucuguuuuucaaaaugaaauaaaacacacuauucucuggccuuuggcugc

SEQ ID NO: 125973 - RNA, 64 nt, Human
auaauacaguggaucugaauuuauuauugcuuauaaaacacauuugauggaauaggaguacugg

SEQ ID NO: 125974 - RNA, 64 nt, Human
auaaugguuaaaaaugaaaccagcuguggauuucaaaacacaguguauucuagaucaucuaaga

SEQ ID NO: 125975 - RNA, 64 nt, Human
uccuucucauucuuuucuuugggguucaggaggaaaaacacaguccuagggacaaaagccaggu

SEQ ID NO: 125976 - RNA, 64 nt, Human
caugcaggaggaaagaaacgauuuuaaaucauuaaaaacacaaaaacuaagugcgaacggaaca

SEQ ID NO: 125977 - RNA, 64 nt, Human
cucaggcuguggcuggaacaggacaggaugaucuaaaacacacguaccauuggcuguaaaacag

SEQ ID NO: 125978 - RNA, 64 nt, Human
uuucccccuuacuguuucaaugaccuuuauuuuaaaaacacauagcuugaaaauuuauuuuuau

SEQ ID NO: 125979 - RNA, 64 nt, Human
uacccuccaggcaucuguguccccucuugaagagaaaacacacagcuucacacauccaggcaua

SEQ ID NO: 125980 - RNA, 64 nt, Human
gaucaucaacaagucuucuauuuacaaacuucaaaaaacacaaaacaacauucauguuuuaaau

SEQ ID NO: 125981 - RNA, 64 nt, Human
gcgaaaaaaggguacauuuuaauuuaauguguuaaaaacacaaugucccuaccguguaaauaga

SEQ ID NO: 125982 - RNA, 64 nt, Human
aucagauuccagccacuagaagaaccucagugagaaaacacacccgccuuucccuguucccuuc

SEQ ID NO: 125983 - RNA, 64 nt, Human
uuagcuucuccauugucuaaaucaggaaaacaggaaaacacagcuuucuagcagcugcaaaaug

SEQ ID NO: 125984 - RNA, 64 nt, Human
uuaaaaauagauauuuuuaaaaaauagauuuucuaaaacacagauuuaugaaagcaagugaauc

SEQ ID NO: 125985 - RNA, 64 nt, Human
cuuguauucacgguuaauuuacaacccaaacagcaaaacacaguugguggacaaguucaugcag

SEQ ID NO: 125986 - RNA, 64 nt, Human
aaaugguuaaaugaggucugcugaaguugacuugaaaacacacuugacccucaggcaggagggc

SEQ ID NO: 125987 - RNA, 64 nt, Human
uacguucugguugucauguuucccuguauuugauaaaacacauaauuuugagaaaaauaaaguu

SEQ ID NO: 125988 - RNA, 64 nt, Human
ccaccucagauagucaucucaguccaaggaucccaaaacacaaaucuagaauugcaaagccagc

SEQ ID NO: 125989 - RNA, 64 nt, Human
cuccuggacauuaggaagcccaaaggccagaacaaaaacacaugccuagugggggaaggcucac

SEQ ID NO: 125990 - RNA, 64 nt, Human
guuauuacuugcagagauaggagcaaaaauuacaaaaacacacaggguaguggguccuuuugug

SEQ ID NO: 125991 - RNA, 64 nt, Human
uuggacaugcuuuugcagacaguccuuaaugcugaaaacacagagaauggguaauucaagaggc

SEQ ID NO: 125992 - RNA, 64 nt, Human
ugccacaguugaaggagggagagaacacgcugugaaaacacagaagcucccagagaagccuucu

SEQ ID NO: 125993 - RNA, 64 nt, Human
cuaaaaaaaaauucuuagcaaugaaauugcuguuaaaacacaaauuucaaucaaauacuuuugu

SEQ ID NO: 125994 - RNA, 64 nt, Human
ucaucugauaucucacaauguaugauauacguacaaaacacacagcaaguuuucuaucaugucc

SEQ ID NO: 125995 - RNA, 64 nt, Human
ccucccuugcacccauccugcacacaucucccugaaaacacacaggcacauacacucauauaca

SEQ ID NO: 125996 - RNA, 64 nt, Human
uuagaauuauuuuucucaaaaaacaaacaaacaaaaaacacaaaaaaaaccacucuucuccaaa

SEQ ID NO: 125997 - RNA, 64 nt, Human
aacuuaucugagucacuugaaacuugguucccagaaaacacauuucugguuuauaaucuccuuu

SEQ ID NO: 125998 - RNA, 64 nt, Human
uccauuuuccccaagcaggauuacuccagagggcaaaacacagcccaauaguaucacauuuccu

SEQ ID NO: 125999 - RNA, 64 nt, Human
uuccuauagaacacagaggacauaggaaacccuuaaaacacacaugggauucucuggucacagu

SEQ ID NO: 126000 - RNA, 64 nt, Human
gcacugaaccaggcugcaagauuugacugccuuaaaaacacaaggcccucuaggccuggcaggg

SEQ ID NO: 126001 - RNA, 64 nt, Human
aauuugguuuaauggaaagaauaaaaguaaaugaaaaacacacccuacacacuagacuccgaac

SEQ ID NO: 126002 - RNA, 64 nt, Human
cuuuacccuggacagcaggaaaccuguauauucaaaaacacaaaaaguccugcuaauaaaauuu

SEQ ID NO: 126003 - RNA, 64 nt, Human
agaugaagaggaaaaacaaacaaacaaacaaaaaaaaacacaaaaaaagaaagaauacuuuuuu

SEQ ID NO: 126004 - RNA, 64 nt, Human
aaaaaacaaaaaaaacaaaaaaacaaaaaacaaaaaaacacacacacacaaaaaaagagaaaaa

SEQ ID NO: 126005 - RNA, 64 nt, Human
ggggaaggugugugaacuuuuuaaaauaaacacaaaaacacaggccuguuaguccaucuuauuc

SEQ ID NO: 126006 - RNA, 64 nt, Human
auuggaaggcaagucauuauuacugguauuaguuaaaacacauaucaaaugcuugcucuucauc

SEQ ID NO: 126007 - RNA, 64 nt, Human
auugccacuuaaagaaauaacgugcaugcuuuaaaaaacacagucacgcaccaagcaggcaaau

SEQ ID NO: 126008 - RNA, 64 nt, Human
cuacuuggaaaccauaucauucauauuuagaaguaaaacacaaaacaaaaaagagagagaaaag

SEQ ID NO: 126009 - RNA, 61 nt, Human
uguucaaggaaacggucuagcccuucuuugcaaaacacaacugccuaguuuaccaaggaga

SEQ ID NO: 126010 - RNA, 64 nt, Human
gugggcuuuaaaagugauucuaaaucuugaauagaaaacacaugaauuggcuuuaauaaaaaug

SEQ ID NO: 126011 - RNA, 64 nt, Human
aaauuccugucuucauauuaagauguacugcuuuaaaacacaacuccagagccccuccccaagc

SEQ ID NO: 126012 - RNA, 64 nt, Human
cagaccauggauauguuguauuaacuggguacccaaaacacauuuuccauauuuggauggugaa

SEQ ID NO: 126013 - RNA, 64 nt, Human
cauagacagauguggacaugcacccgcauguacaaaaacacaaauacggaaguaaaccugaaca

SEQ ID NO: 126014 - RNA, 64 nt, Human
aauauccaaagaugccuuuugaauuucaaagauuaaaacacagcuagaguaguaguauuguagu

SEQ ID NO: 126015 - RNA, 64 nt, Human
caguaucugaaauuucacaguccuauccgaucugaaaacacacauacacaaaugcacacacaug

SEQ ID NO: 126016 - RNA, 64 nt, Human
gcauuuuucugaugccagcugaauauuagagcugaaaacacauuuguugauauuugucuugucc

SEQ ID NO: 126017 - RNA, 64 nt, Human
ucauuuuguggaugccaaaugaauaucaaaacugaaaacacauuuguugauauuugucuugcug

SEQ ID NO: 126018 - RNA, 64 nt, Human
uggaaaaaauguugauggugcauuguaaaauuaaaaaacacaacuugcagaaccaaauauaugg

SEQ ID NO: 126019 - RNA, 64 nt, Human
uggacaaaguucuuccaaacaauucugagaaacaaaaacacacacgcagaauuaacaauucuuu

SEQ ID NO: 126020 - RNA, 64 nt, Human
cagaaauuuaaauguacugggaguuauguuguuaaaaacacaagauauguuaacugcaguuugu

SEQ ID NO: 126021 - RNA, 64 nt, Human
auuuuauuccuuuaacugccaugguuauuuuuauaaaacacaucuauguuucucuuauuaaaag

SEQ ID NO: 126022 - RNA, 64 nt, Human
caccaguguuucuugagccauuucagauguauguaaaacacaaaauaugccaaauauauauugc

SEQ ID NO: 126023 - RNA, 64 nt, Human
uuuaagaguaacaguuugauauuuuguaaaaacaaaaacacacccaaacacaccacauugggaa

SEQ ID NO: 126024 - RNA, 64 nt, Human
aaaaaaaaaaccuauuuuauuauccaaaugcuagaaaacacacaugaauuuucuauaaaaucac

SEQ ID NO: 126025 - RNA, 64 nt, Human
caucgauaguauuuaauaauuuguuuuaccucccaaaacacaguucuucuuucagcuugucuua

SEQ ID NO: 126026 - RNA, 64 nt, Human
cucccaagaguaacucucauuaucuccuccacagaaaacacacagcuuccacaacuucucuguu

SEQ ID NO: 126027 - RNA, 64 nt, Human
cauucguaugcagccuugaagggagaaggcagagaaaacacacgcuccucugcccuuccuuucc

SEQ ID NO: 126028 - RNA, 64 nt, Human
ccccuuccuccuccuagccucucucccaaaaaguaaaacacaaugcugaagaaauauuggugug

SEQ ID NO: 126029 - RNA, 64 nt, Human
uaaacaaugaaagcgaugaggggaccauuuacauaaaacacagagcuuagacacucuuccccuc

SEQ ID NO: 126030 - RNA, 64 nt, Human
aggagauaucccacauuuaaaguucuuauuuaaaaaaacacacacacacaaaugaaauuuuuaa

SEQ ID NO: 126031 - RNA, 64 nt, Human
gaauaaagauuuauauauucauucuuuacauauaaaaacacacagcugaguucuuagaguugau

SEQ ID NO: 126032 - RNA, 64 nt, Human
guggcuuuauauugauaaugaaauauuccagagcaaaacacauuguccuaaugaaguuguugca

SEQ ID NO: 126033 - RNA, 64 nt, Human
ugcuugggaaugugugugaugccuucugucaauaaaaacacauuacacaguuugacuuugaauu

SEQ ID NO: 126034 - RNA, 64 nt, Human
uuuuuuauaaacuggugauuuuucuuuugucuaaaaaacacaugaagaaaauuuaccaaaaaaa

SEQ ID NO: 126035 - RNA, 64 nt, Human
ucaaguuuuuauuuuguuguuguuguuauuuugaaaaacacauuguaauauguuggguuuauuu

SEQ ID NO: 126036 - RNA, 64 nt, Human
aaauuugacagcauuacaaauuaagugaccauuaaaaacacagcaaucauucauacugcuuuca

SEQ ID NO: 126037 - RNA, 64 nt, Human
ugcagcugccgacgaggcuuugaaaauucuucaaaaaacacagcccacuuauccaucugucaaa

SEQ ID NO: 126038 - RNA, 64 nt, Human
ggcaacgcauuuauuuacaccaagcccuucccauaaaacacaacugcugaagaaaauagcagac

SEQ ID NO: 126039 - RNA, 64 nt, Human
aguacauuuuuaaaugagggugguuuuuuucuuuaaaacacaugaacauuguaaauguguugga

SEQ ID NO: 126040 - RNA, 64 nt, Human
gaguuuuuucuuuuuuuuuuuuuuuuguccacuaaaaacacacugauggucaacacaggucaaa

SEQ ID NO: 126041 - RNA, 64 nt, Human
ccuggccaacaugaugaaacccuugucucuauuaaaaacacaaaaauuagccagaugugguggc

SEQ ID NO: 126042 - RNA, 64 nt, Human; identical to SEQ ID NO: 125062

SEQ ID NO: 126043 - RNA, 64 nt, Human; identical to SEQ ID NO: 125063

SEQ ID NO: 126044 - RNA, 64 nt, Human; identical to SEQ ID NO: 125064

SEQ ID NO: 126045 - RNA, 64 nt, Human; identical to SEQ ID NO: 125065

SEQ ID NO: 126046 - RNA, 64 nt, Human; identical to SEQ ID NO: 125066

SEQ ID NO: 126047 - RNA, 64 nt, Human; identical to SEQ ID NO: 125067

SEQ ID NO: 126048 - RNA, 64 nt, Human; identical to SEQ ID NO: 125068

SEQ ID NO: 126049 - RNA, 64 nt, Human; identical to SEQ ID NO: 125069

SEQ ID NO: 126050 - RNA, 64 nt, Human; identical to SEQ ID NO: 125070

SEQ ID NO: 126051 - RNA, 64 nt, Human; identical to SEQ ID NO: 125071

SEQ ID NO: 126052 - RNA, 64 nt, Human; identical to SEQ ID NO: 125072

SEQ ID NO: 126053 - RNA, 64 nt, Human; identical to SEQ ID NO: 125073

SEQ ID NO: 126054 - RNA, 64 nt, Human; identical to SEQ ID NO: 125074

SEQ ID NO: 126055 - RNA, 64 nt, Human; identical to SEQ ID NO: 125075

SEQ ID NO: 126056 - RNA, 64 nt, Human; identical to SEQ ID NO: 125076

SEQ ID NO: 126057 - RNA, 64 nt, Human; identical to SEQ ID NO: 125077

SEQ ID NO: 126058 - RNA, 64 nt, Human; identical to SEQ ID NO: 125078

SEQ ID NO: 126059 - RNA, 64 nt, Human; identical to SEQ ID NO: 125079

SEQ ID NO: 126060 - RNA, 64 nt, Human; identical to SEQ ID NO: 125080

SEQ ID NO: 126061 - RNA, 64 nt, Human; identical to SEQ ID NO: 125081

SEQ ID NO: 126062 - RNA, 64 nt, Human; identical to SEQ ID NO: 125082

SEQ ID NO: 126063 - RNA, 64 nt, Human; identical to SEQ ID NO: 125083

SEQ ID NO: 126064 - RNA, 64 nt, Human; identical to SEQ ID NO: 125084

SEQ ID NO: 126065 - RNA, 64 nt, Human; identical to SEQ ID NO: 125085

SEQ ID NO: 126066 - RNA, 64 nt, Human; identical to SEQ ID NO: 125086

SEQ ID NO: 126067 - RNA, 64 nt, Human; identical to SEQ ID NO: 125087

SEQ ID NO: 126068 - RNA, 64 nt, Human; identical to SEQ ID NO: 125088

SEQ ID NO: 126069 - RNA, 64 nt, Human; identical to SEQ ID NO: 125089

SEQ ID NO: 126070 - RNA, 64 nt, Human; identical to SEQ ID NO: 125090

SEQ ID NO: 126071 - RNA, 64 nt, Human; identical to SEQ ID NO: 125091

SEQ ID NO: 126072 - RNA, 59 nt, Human; identical to SEQ ID NO: 125092

SEQ ID NO: 126073 - RNA, 64 nt, Human; identical to SEQ ID NO: 125093

SEQ ID NO: 126074 - RNA, 64 nt, Human; identical to SEQ ID NO: 125094

SEQ ID NO: 126075 - RNA, 64 nt, Human; identical to SEQ ID NO: 125095

SEQ ID NO: 126076 - RNA, 64 nt, Human; identical to SEQ ID NO: 125096

SEQ ID NO: 126077 - RNA, 64 nt, Human; identical to SEQ ID NO: 125097

SEQ ID NO: 126078 - RNA, 64 nt, Human; identical to SEQ ID NO: 125098

SEQ ID NO: 126079 - RNA, 64 nt, Human; identical to SEQ ID NO: 125099

SEQ ID NO: 126080 - RNA, 64 nt, Human; identical to SEQ ID NO: 125100

SEQ ID NO: 126081 - RNA, 64 nt, Human; identical to SEQ ID NO: 125101

SEQ ID NO: 126082 - RNA, 64 nt, Human; identical to SEQ ID NO: 125102

SEQ ID NO: 126083 - RNA, 64 nt, Human; identical to SEQ ID NO: 125103

SEQ ID NO: 126084 - RNA, 64 nt, Human; identical to SEQ ID NO: 125104

SEQ ID NO: 126085 - RNA, 64 nt, Human; identical to SEQ ID NO: 125105

SEQ ID NO: 126086 - RNA, 64 nt, Human; identical to SEQ ID NO: 125106

SEQ ID NO: 126087 - RNA, 64 nt, Human; identical to SEQ ID NO: 125107

SEQ ID NO: 126088 - RNA, 64 nt, Human; identical to SEQ ID NO: 125108

SEQ ID NO: 126089 - RNA, 64 nt, Human; identical to SEQ ID NO: 125109

SEQ ID NO: 126090 - RNA, 64 nt, Human; identical to SEQ ID NO: 125110

SEQ ID NO: 126091 - RNA, 64 nt, Human; identical to SEQ ID NO: 125111

SEQ ID NO: 126092 - RNA, 64 nt, Human; identical to SEQ ID NO: 125112

SEQ ID NO: 126093 - RNA, 64 nt, Human; identical to SEQ ID NO: 125113

SEQ ID NO: 126094 - RNA, 64 nt, Human; identical to SEQ ID NO: 125114

SEQ ID NO: 126095 - RNA, 64 nt, Human; identical to SEQ ID NO: 125115

SEQ ID NO: 126096 - RNA, 64 nt, Human; identical to SEQ ID NO: 125116

SEQ ID NO: 126097 - RNA, 64 nt, Human; identical to SEQ ID NO: 125117

SEQ ID NO: 126098 - RNA, 64 nt, Human; identical to SEQ ID NO: 125118

SEQ ID NO: 126099 - RNA, 64 nt, Human; identical to SEQ ID NO: 125119

SEQ ID NO: 126100 - RNA, 64 nt, Human; identical to SEQ ID NO: 125120

SEQ ID NO: 126101 - RNA, 64 nt, Human; identical to SEQ ID NO: 125121

SEQ ID NO: 126102 - RNA, 64 nt, Human; identical to SEQ ID NO: 125122

SEQ ID NO: 126103 - RNA, 64 nt, Human; identical to SEQ ID NO: 125123

SEQ ID NO: 126104 - RNA, 64 nt, Human; identical to SEQ ID NO: 125124

SEQ ID NO: 126105 - RNA, 64 nt, Human; identical to SEQ ID NO: 125125

SEQ ID NO: 126106 - RNA, 64 nt, Human; identical to SEQ ID NO: 125126

SEQ ID NO: 126107 - RNA, 64 nt, Human; identical to SEQ ID NO: 125127

SEQ ID NO: 126108 - RNA, 64 nt, Human; identical to SEQ ID NO: 125128

SEQ ID NO: 126109 - RNA, 64 nt, Human; identical to SEQ ID NO: 125129

SEQ ID NO: 126110 - RNA, 64 nt, Human; identical to SEQ ID NO: 125130

SEQ ID NO: 126111 - RNA, 64 nt, Human; identical to SEQ ID NO: 125131

SEQ ID NO: 126112 - RNA, 64 nt, Human; identical to SEQ ID NO: 125132

SEQ ID NO: 126113 - RNA, 60 nt, Human; identical to SEQ ID NO: 125133

SEQ ID NO: 126114 - RNA, 64 nt, Human; identical to SEQ ID NO: 125134

SEQ ID NO: 126115 - RNA, 64 nt, Human; identical to SEQ ID NO: 125135

SEQ ID NO: 126116 - RNA, 64 nt, Human; identical to SEQ ID NO: 125136

SEQ ID NO: 126117 - RNA, 64 nt, Human; identical to SEQ ID NO: 125137

SEQ ID NO: 126118 - RNA, 64 nt, Human; identical to SEQ ID NO: 125138

SEQ ID NO: 126119 - RNA, 64 nt, Human; identical to SEQ ID NO: 125139

SEQ ID NO: 126120 - RNA, 64 nt, Human; identical to SEQ ID NO: 125140

SEQ ID NO: 126121 - RNA, 64 nt, Human; identical to SEQ ID NO: 125141

SEQ ID NO: 126122 - RNA, 64 nt, Human; identical to SEQ ID NO: 125142

SEQ ID NO: 126123 - RNA, 64 nt, Human; identical to SEQ ID NO: 125143

SEQ ID NO: 126124 - RNA, 64 nt, Human; identical to SEQ ID NO: 125144

SEQ ID NO: 126125 - RNA, 64 nt, Human; identical to SEQ ID NO: 125145

SEQ ID NO: 126126 - RNA, 64 nt, Human; identical to SEQ ID NO: 125146

SEQ ID NO: 126127 - RNA, 64 nt, Human; identical to SEQ ID NO: 125147

SEQ ID NO: 126128 - RNA, 64 nt, Human; identical to SEQ ID NO: 125148

SEQ ID NO: 126129 - RNA, 64 nt, Human; identical to SEQ ID NO: 125149

SEQ ID NO: 126130 - RNA, 64 nt, Human; identical to SEQ ID NO: 125150

SEQ ID NO: 126131 - RNA, 64 nt, Human; identical to SEQ ID NO: 125151

SEQ ID NO: 126132 - RNA, 64 nt, Human; identical to SEQ ID NO: 125152

SEQ ID NO: 126133 - RNA, 64 nt, Human; identical to SEQ ID NO: 125153

SEQ ID NO: 126134 - RNA, 64 nt, Human; identical to SEQ ID NO: 125154

SEQ ID NO: 126135 - RNA, 64 nt, Human; identical to SEQ ID NO: 125155

SEQ ID NO: 126136 - RNA, 64 nt, Human; identical to SEQ ID NO: 125156

SEQ ID NO: 126137 - RNA, 64 nt, Human; identical to SEQ ID NO: 125157

SEQ ID NO: 126138 - RNA, 64 nt, Human; identical to SEQ ID NO: 125158

SEQ ID NO: 126139 - RNA, 64 nt, Human; identical to SEQ ID NO: 125159

SEQ ID NO: 126140 - RNA, 64 nt, Human; identical to SEQ ID NO: 125160

SEQ ID NO: 126141 - RNA, 64 nt, Human; identical to SEQ ID NO: 125161

SEQ ID NO: 126142 - RNA, 64 nt, Human; identical to SEQ ID NO: 125162

SEQ ID NO: 126143 - RNA, 64 nt, Human; identical to SEQ ID NO: 125163

SEQ ID NO: 126144 - RNA, 64 nt, Human; identical to SEQ ID NO: 125164

SEQ ID NO: 126145 - RNA, 64 nt, Human; identical to SEQ ID NO: 125165

SEQ ID NO: 126146 - RNA, 64 nt, Human; identical to SEQ ID NO: 125166

SEQ ID NO: 126147 - RNA, 64 nt, Human; identical to SEQ ID NO: 125167

SEQ ID NO: 126148 - RNA, 64 nt, Human; identical to SEQ ID NO: 125168

SEQ ID NO: 126149 - RNA, 64 nt, Human; identical to SEQ ID NO: 125169

SEQ ID NO: 126150 - RNA, 64 nt, Human; identical to SEQ ID NO: 125170

SEQ ID NO: 126151 - RNA, 64 nt, Human; identical to SEQ ID NO: 125171

SEQ ID NO: 126152 - RNA, 64 nt, Human; identical to SEQ ID NO: 125172

SEQ ID NO: 126153 - RNA, 64 nt, Human; identical to SEQ ID NO: 125173

SEQ ID NO: 126154 - RNA, 64 nt, Human; identical to SEQ ID NO: 125174

SEQ ID NO: 126155 - RNA, 64 nt, Human; identical to SEQ ID NO: 125175

SEQ ID NO: 126156 - RNA, 64 nt, Human; identical to SEQ ID NO: 125176

SEQ ID NO: 126157 - RNA, 64 nt, Human; identical to SEQ ID NO: 125177

SEQ ID NO: 126158 - RNA, 64 nt, Human; identical to SEQ ID NO: 125178

SEQ ID NO: 126159 - RNA, 64 nt, Human; identical to SEQ ID NO: 125179

SEQ ID NO: 126160 - RNA, 64 nt, Human; identical to SEQ ID NO: 125180

SEQ ID NO: 126161 - RNA, 64 nt, Human; identical to SEQ ID NO: 125181

SEQ ID NO: 126162 - RNA, 64 nt, Human; identical to SEQ ID NO: 125182

SEQ ID NO: 126163 - RNA, 64 nt, Human; identical to SEQ ID NO: 125183

SEQ ID NO: 126164 - RNA, 64 nt, Human; identical to SEQ ID NO: 125184

SEQ ID NO: 126165 - RNA, 64 nt, Human; identical to SEQ ID NO: 125185

SEQ ID NO: 126166 - RNA, 64 nt, Human; identical to SEQ ID NO: 125186

SEQ ID NO: 126167 - RNA, 64 nt, Human; identical to SEQ ID NO: 125187

SEQ ID NO: 126168 - RNA, 64 nt, Human; identical to SEQ ID NO: 125188

SEQ ID NO: 126169 - RNA, 64 nt, Human; identical to SEQ ID NO: 125189

SEQ ID NO: 126170 - RNA, 64 nt, Human; identical to SEQ ID NO: 125190

SEQ ID NO: 126171 - RNA, 64 nt, Human; identical to SEQ ID NO: 125191

SEQ ID NO: 126172 - RNA, 64 nt, Human; identical to SEQ ID NO: 125192

SEQ ID NO: 126173 - RNA, 64 nt, Human; identical to SEQ ID NO: 125193

SEQ ID NO: 126174 - RNA, 64 nt, Human; identical to SEQ ID NO: 125194

SEQ ID NO: 126175 - RNA, 64 nt, Human; identical to SEQ ID NO: 125195

SEQ ID NO: 126176 - RNA, 64 nt, Human; identical to SEQ ID NO: 125196

SEQ ID NO: 126177 - RNA, 64 nt, Human; identical to SEQ ID NO: 125197

SEQ ID NO: 126178 - RNA, 64 nt, Human; identical to SEQ ID NO: 125198

SEQ ID NO: 126179 - RNA, 64 nt, Human; identical to SEQ ID NO: 125199

SEQ ID NO: 126180 - RNA, 64 nt, Human; identical to SEQ ID NO: 125200

SEQ ID NO: 126181 - RNA, 64 nt, Human; identical to SEQ ID NO: 125201

SEQ ID NO: 126182 - RNA, 64 nt, Human; identical to SEQ ID NO: 125202

SEQ ID NO: 126183 - RNA, 64 nt, Human; identical to SEQ ID NO: 125203

SEQ ID NO: 126184 - RNA, 64 nt, Human; identical to SEQ ID NO: 125204

SEQ ID NO: 126185 - RNA, 64 nt, Human; identical to SEQ ID NO: 125205

SEQ ID NO: 126186 - RNA, 64 nt, Human; identical to SEQ ID NO: 125206

SEQ ID NO: 126187 - RNA, 64 nt, Human; identical to SEQ ID NO: 125207

SEQ ID NO: 126188 - RNA, 64 nt, Human; identical to SEQ ID NO: 125208

SEQ ID NO: 126189 - RNA, 64 nt, Human; identical to SEQ ID NO: 125209

SEQ ID NO: 126190 - RNA, 64 nt, Human; identical to SEQ ID NO: 125210

SEQ ID NO: 126191 - RNA, 64 nt, Human; identical to SEQ ID NO: 125211

SEQ ID NO: 126192 - RNA, 64 nt, Human; identical to SEQ ID NO: 125212

SEQ ID NO: 126193 - RNA, 64 nt, Human; identical to SEQ ID NO: 125213

SEQ ID NO: 126194 - RNA, 64 nt, Human; identical to SEQ ID NO: 125214

SEQ ID NO: 126195 - RNA, 64 nt, Human; identical to SEQ ID NO: 125215

SEQ ID NO: 126196 - RNA, 64 nt, Human; identical to SEQ ID NO: 125216

SEQ ID NO: 126197 - RNA, 64 nt, Human; identical to SEQ ID NO: 125217

SEQ ID NO: 126198 - RNA, 64 nt, Human; identical to SEQ ID NO: 125218

SEQ ID NO: 126199 - RNA, 64 nt, Human; identical to SEQ ID NO: 125219

SEQ ID NO: 126200 - RNA, 64 nt, Human; identical to SEQ ID NO: 125220

SEQ ID NO: 126201 - RNA, 64 nt, Human; identical to SEQ ID NO: 125221

SEQ ID NO: 126202 - RNA, 64 nt, Human; identical to SEQ ID NO: 125222

SEQ ID NO: 126203 - RNA, 64 nt, Human; identical to SEQ ID NO: 125223

SEQ ID NO: 126204 - RNA, 64 nt, Human; identical to SEQ ID NO: 125224

SEQ ID NO: 126205 - RNA, 64 nt, Human; identical to SEQ ID NO: 125225

SEQ ID NO: 126206 - RNA, 64 nt, Human; identical to SEQ ID NO: 125226

SEQ ID NO: 126207 - RNA, 64 nt, Human; identical to SEQ ID NO: 125227

SEQ ID NO: 126208 - RNA, 64 nt, Human; identical to SEQ ID NO: 125228

SEQ ID NO: 126209 - RNA, 64 nt, Human; identical to SEQ ID NO: 125229

SEQ ID NO: 126210 - RNA, 64 nt, Human; identical to SEQ ID NO: 125230

SEQ ID NO: 126211 - RNA, 64 nt, Human; identical to SEQ ID NO: 125231

SEQ ID NO: 126212 - RNA, 64 nt, Human; identical to SEQ ID NO: 125232

SEQ ID NO: 126213 - RNA, 64 nt, Human; identical to SEQ ID NO: 125233

SEQ ID NO: 126214 - RNA, 64 nt, Human; identical to SEQ ID NO: 125234

SEQ ID NO: 126215 - RNA, 64 nt, Human; identical to SEQ ID NO: 125235

SEQ ID NO: 126216 - RNA, 64 nt, Human; identical to SEQ ID NO: 125236

SEQ ID NO: 126217 - RNA, 64 nt, Human; identical to SEQ ID NO: 125237

SEQ ID NO: 126218 - RNA, 64 nt, Human; identical to SEQ ID NO: 125238

SEQ ID NO: 126219 - RNA, 64 nt, Human; identical to SEQ ID NO: 125239

SEQ ID NO: 126220 - RNA, 64 nt, Human; identical to SEQ ID NO: 125240

SEQ ID NO: 126221 - RNA, 64 nt, Human; identical to SEQ ID NO: 125241

SEQ ID NO: 126222 - RNA, 64 nt, Human; identical to SEQ ID NO: 125242

SEQ ID NO: 126223 - RNA, 64 nt, Human; identical to SEQ ID NO: 125243

SEQ ID NO: 126224 - RNA, 64 nt, Human; identical to SEQ ID NO: 125244

SEQ ID NO: 126225 - RNA, 64 nt, Human; identical to SEQ ID NO: 125245

SEQ ID NO: 126226 - RNA, 64 nt, Human; identical to SEQ ID NO: 125246

SEQ ID NO: 126227 - RNA, 64 nt, Human; identical to SEQ ID NO: 125247

SEQ ID NO: 126228 - RNA, 64 nt, Human; identical to SEQ ID NO: 125248

SEQ ID NO: 126229 - RNA, 64 nt, Human; identical to SEQ ID NO: 125249

SEQ ID NO: 126230 - RNA, 64 nt, Human; identical to SEQ ID NO: 125250

SEQ ID NO: 126231 - RNA, 64 nt, Human; identical to SEQ ID NO: 125251

SEQ ID NO: 126232 - RNA, 64 nt, Human; identical to SEQ ID NO: 125252

SEQ ID NO: 126233 - RNA, 64 nt, Human; identical to SEQ ID NO: 125253

SEQ ID NO: 126234 - RNA, 64 nt, Human; identical to SEQ ID NO: 125254

SEQ ID NO: 126235 - RNA, 56 nt, Human; identical to SEQ ID NO: 125255

SEQ ID NO: 126236 - RNA, 64 nt, Human; identical to SEQ ID NO: 125256

SEQ ID NO: 126237 - RNA, 64 nt, Human; identical to SEQ ID NO: 125257

SEQ ID NO: 126238 - RNA, 64 nt, Human; identical to SEQ ID NO: 125258

SEQ ID NO: 126239 - RNA, 64 nt, Human; identical to SEQ ID NO: 125259

SEQ ID NO: 126240 - RNA, 64 nt, Human; identical to SEQ ID NO: 125260

SEQ ID NO: 126241 - RNA, 64 nt, Human; identical to SEQ ID NO: 125261

SEQ ID NO: 126242 - RNA, 64 nt, Human; identical to SEQ ID NO: 125262

SEQ ID NO: 126243 - RNA, 64 nt, Human; identical to SEQ ID NO: 125263

SEQ ID NO: 126244 - RNA, 64 nt, Human; identical to SEQ ID NO: 125264

SEQ ID NO: 126245 - RNA, 64 nt, Human; identical to SEQ ID NO: 125265

SEQ ID NO: 126246 - RNA, 64 nt, Human; identical to SEQ ID NO: 125266

SEQ ID NO: 126247 - RNA, 64 nt, Human; identical to SEQ ID NO: 125267

SEQ ID NO: 126248 - RNA, 64 nt, Human; identical to SEQ ID NO: 125268

SEQ ID NO: 126249 - RNA, 64 nt, Human; identical to SEQ ID NO: 125269

SEQ ID NO: 126250 - RNA, 64 nt, Human; identical to SEQ ID NO: 125270

SEQ ID NO: 126251 - RNA, 64 nt, Human; identical to SEQ ID NO: 125271

SEQ ID NO: 126252 - RNA, 64 nt, Human; identical to SEQ ID NO: 125272

SEQ ID NO: 126253 - RNA, 64 nt, Human; identical to SEQ ID NO: 125273

SEQ ID NO: 126254 - RNA, 64 nt, Human; identical to SEQ ID NO: 125274

SEQ ID NO: 126255 - RNA, 64 nt, Human; identical to SEQ ID NO: 125275

SEQ ID NO: 126256 - RNA, 64 nt, Human; identical to SEQ ID NO: 125276

SEQ ID NO: 126257 - RNA, 64 nt, Human; identical to SEQ ID NO: 125277

SEQ ID NO: 126258 - RNA, 64 nt, Human; identical to SEQ ID NO: 125278

SEQ ID NO: 126259 - RNA, 64 nt, Human; identical to SEQ ID NO: 125279

SEQ ID NO: 126260 - RNA, 64 nt, Human; identical to SEQ ID NO: 125280

SEQ ID NO: 126261 - RNA, 64 nt, Human; identical to SEQ ID NO: 125281

SEQ ID NO: 126262 - RNA, 64 nt, Human; identical to SEQ ID NO: 125282

SEQ ID NO: 126263 - RNA, 64 nt, Human; identical to SEQ ID NO: 125283

SEQ ID NO: 126264 - RNA, 64 nt, Human; identical to SEQ ID NO: 125284

SEQ ID NO: 126265 - RNA, 64 nt, Human; identical to SEQ ID NO: 125285

SEQ ID NO: 126266 - RNA, 64 nt, Human; identical to SEQ ID NO: 125286

SEQ ID NO: 126267 - RNA, 64 nt, Human; identical to SEQ ID NO: 125287

SEQ ID NO: 126268 - RNA, 64 nt, Human; identical to SEQ ID NO: 125288

SEQ ID NO: 126269 - RNA, 64 nt, Human; identical to SEQ ID NO: 125289

SEQ ID NO: 126270 - RNA, 64 nt, Human; identical to SEQ ID NO: 125290

SEQ ID NO: 126271 - RNA, 64 nt, Human; identical to SEQ ID NO: 125291

SEQ ID NO: 126272 - RNA, 64 nt, Human; identical to SEQ ID NO: 125292

SEQ ID NO: 126273 - RNA, 64 nt, Human; identical to SEQ ID NO: 125293

SEQ ID NO: 126274 - RNA, 64 nt, Human; identical to SEQ ID NO: 125294

SEQ ID NO: 126275 - RNA, 64 nt, Human; identical to SEQ ID NO: 125295

SEQ ID NO: 126276 - RNA, 64 nt, Human; identical to SEQ ID NO: 125296

SEQ ID NO: 126277 - RNA, 64 nt, Human; identical to SEQ ID NO: 125297

SEQ ID NO: 126278 - RNA, 64 nt, Human; identical to SEQ ID NO: 125298

SEQ ID NO: 126279 - RNA, 64 nt, Human; identical to SEQ ID NO: 125299

SEQ ID NO: 126280 - RNA, 64 nt, Human; identical to SEQ ID NO: 125300

SEQ ID NO: 126281 - RNA, 64 nt, Human; identical to SEQ ID NO: 125301

SEQ ID NO: 126282 - RNA, 64 nt, Human; identical to SEQ ID NO: 125302

SEQ ID NO: 126283 - RNA, 64 nt, Human; identical to SEQ ID NO: 125303

SEQ ID NO: 126284 - RNA, 64 nt, Human; identical to SEQ ID NO: 125304

SEQ ID NO: 126285 - RNA, 64 nt, Human; identical to SEQ ID NO: 125305

SEQ ID NO: 126286 - RNA, 64 nt, Human; identical to SEQ ID NO: 125306

SEQ ID NO: 126287 - RNA, 64 nt, Human; identical to SEQ ID NO: 125307

SEQ ID NO: 126288 - RNA, 64 nt, Human; identical to SEQ ID NO: 125308

SEQ ID NO: 126289 - RNA, 64 nt, Human; identical to SEQ ID NO: 125309

SEQ ID NO: 126290 - RNA, 64 nt, Human; identical to SEQ ID NO: 125310

SEQ ID NO: 126291 - RNA, 64 nt, Human; identical to SEQ ID NO: 125311

SEQ ID NO: 126292 - RNA, 64 nt, Human; identical to SEQ ID NO: 125312

SEQ ID NO: 126293 - RNA, 64 nt, Human; identical to SEQ ID NO: 125313

SEQ ID NO: 126294 - RNA, 64 nt, Human; identical to SEQ ID NO: 125314

SEQ ID NO: 126295 - RNA, 64 nt, Human; identical to SEQ ID NO: 125315

SEQ ID NO: 126296 - RNA, 64 nt, Human; identical to SEQ ID NO: 125316

SEQ ID NO: 126297 - RNA, 64 nt, Human; identical to SEQ ID NO: 125317

SEQ ID NO: 126298 - RNA, 64 nt, Human; identical to SEQ ID NO: 125318

SEQ ID NO: 126299 - RNA, 64 nt, Human; identical to SEQ ID NO: 125319

SEQ ID NO: 126300 - RNA, 64 nt, Human; identical to SEQ ID NO: 125320

SEQ ID NO: 126301 - RNA, 64 nt, Human; identical to SEQ ID NO: 125321

SEQ ID NO: 126302 - RNA, 64 nt, Human; identical to SEQ ID NO: 125322

SEQ ID NO: 126303 - RNA, 64 nt, Human; identical to SEQ ID NO: 125323

SEQ ID NO: 126304 - RNA, 64 nt, Human; identical to SEQ ID NO: 125324

SEQ ID NO: 126305 - RNA, 64 nt, Human; identical to SEQ ID NO: 125325

SEQ ID NO: 126306 - RNA, 64 nt, Human; identical to SEQ ID NO: 125326

SEQ ID NO: 126307 - RNA, 64 nt, Human; identical to SEQ ID NO: 125327

SEQ ID NO: 126308 - RNA, 64 nt, Human; identical to SEQ ID NO: 125328

SEQ ID NO: 126309 - RNA, 64 nt, Human; identical to SEQ ID NO: 125329

SEQ ID NO: 126310 - RNA, 64 nt, Human; identical to SEQ ID NO: 125330

SEQ ID NO: 126311 - RNA, 64 nt, Human; identical to SEQ ID NO: 125331

SEQ ID NO: 126312 - RNA, 64 nt, Human; identical to SEQ ID NO: 125332

SEQ ID NO: 126313 - RNA, 64 nt, Human; identical to SEQ ID NO: 125333

SEQ ID NO: 126314 - RNA, 64 nt, Human; identical to SEQ ID NO: 125334

SEQ ID NO: 126315 - RNA, 64 nt, Human; identical to SEQ ID NO: 125335

SEQ ID NO: 126316 - RNA, 64 nt, Human; identical to SEQ ID NO: 125336

SEQ ID NO: 126317 - RNA, 64 nt, Human; identical to SEQ ID NO: 125337

SEQ ID NO: 126318 - RNA, 64 nt, Human; identical to SEQ ID NO: 125338

SEQ ID NO: 126319 - RNA, 64 nt, Human; identical to SEQ ID NO: 125339

SEQ ID NO: 126320 - RNA, 64 nt, Human; identical to SEQ ID NO: 125340

SEQ ID NO: 126321 - RNA, 64 nt, Human; identical to SEQ ID NO: 125341

SEQ ID NO: 126322 - RNA, 64 nt, Human; identical to SEQ ID NO: 125342

SEQ ID NO: 126323 - RNA, 64 nt, Human; identical to SEQ ID NO: 125343

SEQ ID NO: 126324 - RNA, 64 nt, Human; identical to SEQ ID NO: 125344

SEQ ID NO: 126325 - RNA, 64 nt, Human; identical to SEQ ID NO: 125345

SEQ ID NO: 126326 - RNA, 64 nt, Human; identical to SEQ ID NO: 125346

SEQ ID NO: 126327 - RNA, 64 nt, Human; identical to SEQ ID NO: 125347

SEQ ID NO: 126328 - RNA, 64 nt, Human; identical to SEQ ID NO: 125348

SEQ ID NO: 126329 - RNA, 64 nt, Human; identical to SEQ ID NO: 125349

SEQ ID NO: 126330 - RNA, 64 nt, Human; identical to SEQ ID NO: 125350

SEQ ID NO: 126331 - RNA, 64 nt, Human; identical to SEQ ID NO: 125351

SEQ ID NO: 126332 - RNA, 64 nt, Human; identical to SEQ ID NO: 125352

SEQ ID NO: 126333 - RNA, 64 nt, Human; identical to SEQ ID NO: 125353

SEQ ID NO: 126334 - RNA, 64 nt, Human; identical to SEQ ID NO: 125354

SEQ ID NO: 126335 - RNA, 64 nt, Human; identical to SEQ ID NO: 125355

SEQ ID NO: 126336 - RNA, 64 nt, Human; identical to SEQ ID NO: 125356

SEQ ID NO: 126337 - RNA, 64 nt, Human; identical to SEQ ID NO: 125357

SEQ ID NO: 126338 - RNA, 64 nt, Human; identical to SEQ ID NO: 125358

SEQ ID NO: 126339 - RNA, 64 nt, Human; identical to SEQ ID NO: 125359

SEQ ID NO: 126340 - RNA, 64 nt, Human; identical to SEQ ID NO: 125360

SEQ ID NO: 126341 - RNA, 64 nt, Human; identical to SEQ ID NO: 125361

SEQ ID NO: 126342 - RNA, 64 nt, Human; identical to SEQ ID NO: 125362

SEQ ID NO: 126343 - RNA, 64 nt, Human; identical to SEQ ID NO: 125363

SEQ ID NO: 126344 - RNA, 64 nt, Human; identical to SEQ ID NO: 125364

SEQ ID NO: 126345 - RNA, 64 nt, Human; identical to SEQ ID NO: 125365

SEQ ID NO: 126346 - RNA, 64 nt, Human; identical to SEQ ID NO: 125366

SEQ ID NO: 126347 - RNA, 64 nt, Human; identical to SEQ ID NO: 125367

SEQ ID NO: 126348 - RNA, 64 nt, Human; identical to SEQ ID NO: 125368

SEQ ID NO: 126349 - RNA, 64 nt, Human; identical to SEQ ID NO: 125369

SEQ ID NO: 126350 - RNA, 64 nt, Human; identical to SEQ ID NO: 125370

SEQ ID NO: 126351 - RNA, 64 nt, Human; identical to SEQ ID NO: 125371

SEQ ID NO: 126352 - RNA, 64 nt, Human; identical to SEQ ID NO: 125372

SEQ ID NO: 126353 - RNA, 64 nt, Human; identical to SEQ ID NO: 125373

SEQ ID NO: 126354 - RNA, 64 nt, Human; identical to SEQ ID NO: 125374

SEQ ID NO: 126355 - RNA, 64 nt, Human; identical to SEQ ID NO: 125375

SEQ ID NO: 126356 - RNA, 64 nt, Human; identical to SEQ ID NO: 125376

SEQ ID NO: 126357 - RNA, 64 nt, Human; identical to SEQ ID NO: 125377

SEQ ID NO: 126358 - RNA, 64 nt, Human; identical to SEQ ID NO: 125378

SEQ ID NO: 126359 - RNA, 64 nt, Human; identical to SEQ ID NO: 125379

SEQ ID NO: 126360 - RNA, 64 nt, Human; identical to SEQ ID NO: 125380

SEQ ID NO: 126361 - RNA, 64 nt, Human; identical to SEQ ID NO: 125381

SEQ ID NO: 126362 - RNA, 64 nt, Human; identical to SEQ ID NO: 125382

SEQ ID NO: 126363 - RNA, 64 nt, Human; identical to SEQ ID NO: 125383

SEQ ID NO: 126364 - RNA, 64 nt, Human; identical to SEQ ID NO: 125384

SEQ ID NO: 126365 - RNA, 64 nt, Human; identical to SEQ ID NO: 125385

SEQ ID NO: 126366 - RNA, 64 nt, Human; identical to SEQ ID NO: 125386

SEQ ID NO: 126367 - RNA, 64 nt, Human; identical to SEQ ID NO: 125387

SEQ ID NO: 126368 - RNA, 64 nt, Human; identical to SEQ ID NO: 125388

SEQ ID NO: 126369 - RNA, 64 nt, Human; identical to SEQ ID NO: 125389

SEQ ID NO: 126370 - RNA, 64 nt, Human; identical to SEQ ID NO: 125390

SEQ ID NO: 126371 - RNA, 64 nt, Human; identical to SEQ ID NO: 125391

SEQ ID NO: 126372 - RNA, 64 nt, Human; identical to SEQ ID NO: 125392

SEQ ID NO: 126373 - RNA, 64 nt, Human; identical to SEQ ID NO: 125393

SEQ ID NO: 126374 - RNA, 64 nt, Human; identical to SEQ ID NO: 125394

SEQ ID NO: 126375 - RNA, 64 nt, Human; identical to SEQ ID NO: 125395

SEQ ID NO: 126376 - RNA, 64 nt, Human; identical to SEQ ID NO: 125396

SEQ ID NO: 126377 - RNA, 64 nt, Human; identical to SEQ ID NO: 125397

SEQ ID NO: 126378 - RNA, 64 nt, Human; identical to SEQ ID NO: 125398

SEQ ID NO: 126379 - RNA, 64 nt, Human; identical to SEQ ID NO: 125399

SEQ ID NO: 126380 - RNA, 64 nt, Human; identical to SEQ ID NO: 125400

SEQ ID NO: 126381 - RNA, 64 nt, Human; identical to SEQ ID NO: 125401

SEQ ID NO: 126382 - RNA, 64 nt, Human; identical to SEQ ID NO: 125402

SEQ ID NO: 126383 - RNA, 64 nt, Human; identical to SEQ ID NO: 125403

SEQ ID NO: 126384 - RNA, 64 nt, Human; identical to SEQ ID NO: 125404

SEQ ID NO: 126385 - RNA, 64 nt, Human; identical to SEQ ID NO: 125405

SEQ ID NO: 126386 - RNA, 64 nt, Human; identical to SEQ ID NO: 125406

SEQ ID NO: 126387 - RNA, 64 nt, Human; identical to SEQ ID NO: 125407

SEQ ID NO: 126388 - RNA, 64 nt, Human; identical to SEQ ID NO: 125408

SEQ ID NO: 126389 - RNA, 64 nt, Human; identical to SEQ ID NO: 125409

SEQ ID NO: 126390 - RNA, 64 nt, Human; identical to SEQ ID NO: 125410

SEQ ID NO: 126391 - RNA, 64 nt, Human; identical to SEQ ID NO: 125411

SEQ ID NO: 126392 - RNA, 64 nt, Human; identical to SEQ ID NO: 125412

SEQ ID NO: 126393 - RNA, 64 nt, Human; identical to SEQ ID NO: 125413

SEQ ID NO: 126394 - RNA, 64 nt, Human; identical to SEQ ID NO: 125414

SEQ ID NO: 126395 - RNA, 64 nt, Human; identical to SEQ ID NO: 125415

SEQ ID NO: 126396 - RNA, 64 nt, Human; identical to SEQ ID NO: 125416

SEQ ID NO: 126397 - RNA, 64 nt, Human; identical to SEQ ID NO: 125417

SEQ ID NO: 126398 - RNA, 64 nt, Human; identical to SEQ ID NO: 125418

SEQ ID NO: 126399 - RNA, 64 nt, Human; identical to SEQ ID NO: 125419

SEQ ID NO: 126400 - RNA, 64 nt, Human; identical to SEQ ID NO: 125420

SEQ ID NO: 126401 - RNA, 64 nt, Human; identical to SEQ ID NO: 125421

SEQ ID NO: 126402 - RNA, 64 nt, Human; identical to SEQ ID NO: 125422

SEQ ID NO: 126403 - RNA, 64 nt, Human; identical to SEQ ID NO: 125423

SEQ ID NO: 126404 - RNA, 64 nt, Human; identical to SEQ ID NO: 125424

SEQ ID NO: 126405 - RNA, 64 nt, Human; identical to SEQ ID NO: 125425

SEQ ID NO: 126406 - RNA, 64 nt, Human; identical to SEQ ID NO: 125426

SEQ ID NO: 126407 - RNA, 64 nt, Human; identical to SEQ ID NO: 125427

SEQ ID NO: 126408 - RNA, 64 nt, Human; identical to SEQ ID NO: 125428

SEQ ID NO: 126409 - RNA, 64 nt, Human; identical to SEQ ID NO: 125429

SEQ ID NO: 126410 - RNA, 64 nt, Human; identical to SEQ ID NO: 125430

SEQ ID NO: 126411 - RNA, 64 nt, Human; identical to SEQ ID NO: 125431

SEQ ID NO: 126412 - RNA, 64 nt, Human; identical to SEQ ID NO: 125432

SEQ ID NO: 126413 - RNA, 64 nt, Human; identical to SEQ ID NO: 125433

SEQ ID NO: 126414 - RNA, 64 nt, Human; identical to SEQ ID NO: 125434

SEQ ID NO: 126415 - RNA, 64 nt, Human; identical to SEQ ID NO: 125435

SEQ ID NO: 126416 - RNA, 64 nt, Human; identical to SEQ ID NO: 125436

SEQ ID NO: 126417 - RNA, 64 nt, Human; identical to SEQ ID NO: 125437

SEQ ID NO: 126418 - RNA, 64 nt, Human; identical to SEQ ID NO: 125438

SEQ ID NO: 126419 - RNA, 64 nt, Human; identical to SEQ ID NO: 125439

SEQ ID NO: 126420 - RNA, 64 nt, Human; identical to SEQ ID NO: 125440

SEQ ID NO: 126421 - RNA, 64 nt, Human; identical to SEQ ID NO: 125441

SEQ ID NO: 126422 - RNA, 64 nt, Human; identical to SEQ ID NO: 125442

SEQ ID NO: 126423 - RNA, 64 nt, Human; identical to SEQ ID NO: 125443

SEQ ID NO: 126424 - RNA, 64 nt, Human; identical to SEQ ID NO: 125444

SEQ ID NO: 126425 - RNA, 64 nt, Human; identical to SEQ ID NO: 125445

SEQ ID NO: 126426 - RNA, 64 nt, Human; identical to SEQ ID NO: 125446

SEQ ID NO: 126427 - RNA, 64 nt, Human; identical to SEQ ID NO: 125447

SEQ ID NO: 126428 - RNA, 64 nt, Human; identical to SEQ ID NO: 125448

SEQ ID NO: 126429 - RNA, 64 nt, Human; identical to SEQ ID NO: 125449

SEQ ID NO: 126430 - RNA, 64 nt, Human; identical to SEQ ID NO: 125450

SEQ ID NO: 126431 - RNA, 64 nt, Human; identical to SEQ ID NO: 125451

SEQ ID NO: 126432 - RNA, 64 nt, Human; identical to SEQ ID NO: 125452

SEQ ID NO: 126433 - RNA, 64 nt, Human; identical to SEQ ID NO: 125453

SEQ ID NO: 126434 - RNA, 64 nt, Human; identical to SEQ ID NO: 125454

SEQ ID NO: 126435 - RNA, 64 nt, Human; identical to SEQ ID NO: 125455

SEQ ID NO: 126436 - RNA, 64 nt, Human; identical to SEQ ID NO: 125456

SEQ ID NO: 126437 - RNA, 64 nt, Human; identical to SEQ ID NO: 125457

SEQ ID NO: 126438 - RNA, 64 nt, Human; identical to SEQ ID NO: 125458

SEQ ID NO: 126439 - RNA, 57 nt, Human; identical to SEQ ID NO: 125459

SEQ ID NO: 126440 - RNA, 64 nt, Human; identical to SEQ ID NO: 125460

SEQ ID NO: 126441 - RNA, 64 nt, Human; identical to SEQ ID NO: 125461

SEQ ID NO: 126442 - RNA, 64 nt, Human; identical to SEQ ID NO: 125462

SEQ ID NO: 126443 - RNA, 64 nt, Human; identical to SEQ ID NO: 125463

SEQ ID NO: 126444 - RNA, 64 nt, Human; identical to SEQ ID NO: 125464

SEQ ID NO: 126445 - RNA, 64 nt, Human; identical to SEQ ID NO: 125465

SEQ ID NO: 126446 - RNA, 64 nt, Human; identical to SEQ ID NO: 125466

SEQ ID NO: 126447 - RNA, 64 nt, Human; identical to SEQ ID NO: 125467

SEQ ID NO: 126448 - RNA, 64 nt, Human; identical to SEQ ID NO: 125468

SEQ ID NO: 126449 - RNA, 64 nt, Human; identical to SEQ ID NO: 125469

SEQ ID NO: 126450 - RNA, 63 nt, Human; identical to SEQ ID NO: 125470

SEQ ID NO: 126451 - RNA, 64 nt, Human; identical to SEQ ID NO: 125471

SEQ ID NO: 126452 - RNA, 64 nt, Human; identical to SEQ ID NO: 125472

SEQ ID NO: 126453 - RNA, 64 nt, Human; identical to SEQ ID NO: 125473

SEQ ID NO: 126454 - RNA, 64 nt, Human; identical to SEQ ID NO: 125474

SEQ ID NO: 126455 - RNA, 64 nt, Human; identical to SEQ ID NO: 125475

SEQ ID NO: 126456 - RNA, 64 nt, Human; identical to SEQ ID NO: 125476

SEQ ID NO: 126457 - RNA, 64 nt, Human; identical to SEQ ID NO: 125477

SEQ ID NO: 126458 - RNA, 64 nt, Human; identical to SEQ ID NO: 125478

SEQ ID NO: 126459 - RNA, 64 nt, Human; identical to SEQ ID NO: 125479

SEQ ID NO: 126460 - RNA, 64 nt, Human; identical to SEQ ID NO: 125480

SEQ ID NO: 126461 - RNA, 64 nt, Human; identical to SEQ ID NO: 125481

SEQ ID NO: 126462 - RNA, 64 nt, Human; identical to SEQ ID NO: 125482

SEQ ID NO: 126463 - RNA, 64 nt, Human; identical to SEQ ID NO: 125483

SEQ ID NO: 126464 - RNA, 64 nt, Human; identical to SEQ ID NO: 125484

SEQ ID NO: 126465 - RNA, 64 nt, Human; identical to SEQ ID NO: 125485

SEQ ID NO: 126466 - RNA, 64 nt, Human; identical to SEQ ID NO: 125486

SEQ ID NO: 126467 - RNA, 64 nt, Human; identical to SEQ ID NO: 125487

SEQ ID NO: 126468 - RNA, 64 nt, Human; identical to SEQ ID NO: 125488

SEQ ID NO: 126469 - RNA, 64 nt, Human; identical to SEQ ID NO: 125489

SEQ ID NO: 126470 - RNA, 64 nt, Human; identical to SEQ ID NO: 125490

SEQ ID NO: 126471 - RNA, 64 nt, Human; identical to SEQ ID NO: 125491

SEQ ID NO: 126472 - RNA, 64 nt, Human; identical to SEQ ID NO: 125492

SEQ ID NO: 126473 - RNA, 64 nt, Human; identical to SEQ ID NO: 125493

SEQ ID NO: 126474 - RNA, 64 nt, Human; identical to SEQ ID NO: 125494

SEQ ID NO: 126475 - RNA, 64 nt, Human; identical to SEQ ID NO: 125495

SEQ ID NO: 126476 - RNA, 61 nt, Human; identical to SEQ ID NO: 125496

SEQ ID NO: 126477 - RNA, 64 nt, Human; identical to SEQ ID NO: 125497

SEQ ID NO: 126478 - RNA, 64 nt, Human; identical to SEQ ID NO: 125498

SEQ ID NO: 126479 - RNA, 64 nt, Human; identical to SEQ ID NO: 125499

SEQ ID NO: 126480 - RNA, 64 nt, Human; identical to SEQ ID NO: 125500

SEQ ID NO: 126481 - RNA, 64 nt, Human; identical to SEQ ID NO: 125501

SEQ ID NO: 126482 - RNA, 64 nt, Human; identical to SEQ ID NO: 125502

SEQ ID NO: 126483 - RNA, 64 nt, Human; identical to SEQ ID NO: 125503

SEQ ID NO: 126484 - RNA, 64 nt, Human; identical to SEQ ID NO: 125504

SEQ ID NO: 126485 - RNA, 64 nt, Human; identical to SEQ ID NO: 125505

SEQ ID NO: 126486 - RNA, 64 nt, Human; identical to SEQ ID NO: 125506

SEQ ID NO: 126487 - RNA, 64 nt, Human; identical to SEQ ID NO: 125507

SEQ ID NO: 126488 - RNA, 64 nt, Human; identical to SEQ ID NO: 125508

SEQ ID NO: 126489 - RNA, 64 nt, Human; identical to SEQ ID NO: 125509

SEQ ID NO: 126490 - RNA, 64 nt, Human; identical to SEQ ID NO: 125510

SEQ ID NO: 126491 - RNA, 64 nt, Human; identical to SEQ ID NO: 125511

SEQ ID NO: 126492 - RNA, 64 nt, Human; identical to SEQ ID NO: 125512

SEQ ID NO: 126493 - RNA, 64 nt, Human; identical to SEQ ID NO: 125513

SEQ ID NO: 126494 - RNA, 64 nt, Human; identical to SEQ ID NO: 125514

SEQ ID NO: 126495 - RNA, 64 nt, Human; identical to SEQ ID NO: 125515

SEQ ID NO: 126496 - RNA, 64 nt, Human; identical to SEQ ID NO: 125516

SEQ ID NO: 126497 - RNA, 64 nt, Human; identical to SEQ ID NO: 125517

SEQ ID NO: 126498 - RNA, 64 nt, Human; identical to SEQ ID NO: 125518

SEQ ID NO: 126499 - RNA, 64 nt, Human; identical to SEQ ID NO: 125519

SEQ ID NO: 126500 - RNA, 64 nt, Human; identical to SEQ ID NO: 125520

SEQ ID NO: 126501 - RNA, 64 nt, Human; identical to SEQ ID NO: 125521

SEQ ID NO: 126502 - RNA, 64 nt, Human; identical to SEQ ID NO: 125522

SEQ ID NO: 126503 - RNA, 64 nt, Human; identical to SEQ ID NO: 125523

SEQ ID NO: 126504 - RNA, 64 nt, Human; identical to SEQ ID NO: 125524

SEQ ID NO: 126505 - RNA, 64 nt, Human; identical to SEQ ID NO: 125525

SEQ ID NO: 126506 - RNA, 64 nt, Human; identical to SEQ ID NO: 125526

SEQ ID NO: 126507 - RNA, 64 nt, Human; identical to SEQ ID NO: 125527

SEQ ID NO: 126508 - RNA, 64 nt, Human; identical to SEQ ID NO: 125528

SEQ ID NO: 126509 - RNA, 64 nt, Human; identical to SEQ ID NO: 125529

SEQ ID NO: 126510 - RNA, 64 nt, Human; identical to SEQ ID NO: 125530

SEQ ID NO: 126511 - RNA, 64 nt, Human; identical to SEQ ID NO: 125531

SEQ ID NO: 126512 - RNA, 64 nt, Human; identical to SEQ ID NO: 125532

SEQ ID NO: 126513 - RNA, 64 nt, Human; identical to SEQ ID NO: 125533

SEQ ID NO: 126514 - RNA, 64 nt, Human; identical to SEQ ID NO: 125534

SEQ ID NO: 126515 - RNA, 64 nt, Human; identical to SEQ ID NO: 125535

SEQ ID NO: 126516 - RNA, 64 nt, Human; identical to SEQ ID NO: 125536

SEQ ID NO: 126517 - RNA, 64 nt, Human; identical to SEQ ID NO: 125537

SEQ ID NO: 126518 - RNA, 64 nt, Human; identical to SEQ ID NO: 125538

SEQ ID NO: 126519 - RNA, 64 nt, Human; identical to SEQ ID NO: 125539

SEQ ID NO: 126520 - RNA, 64 nt, Human; identical to SEQ ID NO: 125540

SEQ ID NO: 126521 - RNA, 64 nt, Human; identical to SEQ ID NO: 125541

SEQ ID NO: 126522 - RNA, 64 nt, Human; identical to SEQ ID NO: 125542

SEQ ID NO: 126523 - RNA, 64 nt, Human; identical to SEQ ID NO: 125543

SEQ ID NO: 126524 - RNA, 64 nt, Human; identical to SEQ ID NO: 125544

SEQ ID NO: 126525 - RNA, 64 nt, Human; identical to SEQ ID NO: 125545

SEQ ID NO: 126526 - RNA, 64 nt, Human; identical to SEQ ID NO: 125546

SEQ ID NO: 126527 - RNA, 64 nt, Human; identical to SEQ ID NO: 125547

SEQ ID NO: 126528 - RNA, 64 nt, Human; identical to SEQ ID NO: 125548

SEQ ID NO: 126529 - RNA, 64 nt, Human; identical to SEQ ID NO: 125549

SEQ ID NO: 126530 - RNA, 64 nt, Human; identical to SEQ ID NO: 125550

SEQ ID NO: 126531 - RNA, 64 nt, Human; identical to SEQ ID NO: 125551

SEQ ID NO: 126532 - RNA, 64 nt, Human; identical to SEQ ID NO: 125552

SEQ ID NO: 126533 - RNA, 64 nt, Human; identical to SEQ ID NO: 125553

SEQ ID NO: 126534 - RNA, 64 nt, Human; identical to SEQ ID NO: 125554

SEQ ID NO: 126535 - RNA, 64 nt, Human; identical to SEQ ID NO: 125555

SEQ ID NO: 126536 - RNA, 64 nt, Human; identical to SEQ ID NO: 125556

SEQ ID NO: 126537 - RNA, 64 nt, Human; identical to SEQ ID NO: 125557

SEQ ID NO: 126538 - RNA, 64 nt, Human; identical to SEQ ID NO: 125558

SEQ ID NO: 126539 - RNA, 64 nt, Human; identical to SEQ ID NO: 125559

SEQ ID NO: 126540 - RNA, 64 nt, Human; identical to SEQ ID NO: 125560

SEQ ID NO: 126541 - RNA, 64 nt, Human; identical to SEQ ID NO: 125561

SEQ ID NO: 126542 - RNA, 64 nt, Human; identical to SEQ ID NO: 125562

SEQ ID NO: 126543 - RNA, 64 nt, Human; identical to SEQ ID NO: 125563

SEQ ID NO: 126544 - RNA, 64 nt, Human; identical to SEQ ID NO: 125564

SEQ ID NO: 126545 - RNA, 64 nt, Human; identical to SEQ ID NO: 125565

SEQ ID NO: 126546 - RNA, 64 nt, Human; identical to SEQ ID NO: 125566

SEQ ID NO: 126547 - RNA, 64 nt, Human; identical to SEQ ID NO: 125567

SEQ ID NO: 126548 - RNA, 64 nt, Human; identical to SEQ ID NO: 125568

SEQ ID NO: 126549 - RNA, 64 nt, Human; identical to SEQ ID NO: 125569

SEQ ID NO: 126550 - RNA, 64 nt, Human; identical to SEQ ID NO: 125570

SEQ ID NO: 126551 - RNA, 64 nt, Human; identical to SEQ ID NO: 125571

SEQ ID NO: 126552 - RNA, 64 nt, Human; identical to SEQ ID NO: 125572

SEQ ID NO: 126553 - RNA, 64 nt, Human; identical to SEQ ID NO: 125573

SEQ ID NO: 126554 - RNA, 64 nt, Human; identical to SEQ ID NO: 125574

SEQ ID NO: 126555 - RNA, 64 nt, Human; identical to SEQ ID NO: 125575

SEQ ID NO: 126556 - RNA, 64 nt, Human; identical to SEQ ID NO: 125576

SEQ ID NO: 126557 - RNA, 64 nt, Human; identical to SEQ ID NO: 125577

SEQ ID NO: 126558 - RNA, 64 nt, Human; identical to SEQ ID NO: 125578

SEQ ID NO: 126559 - RNA, 64 nt, Human; identical to SEQ ID NO: 125579

SEQ ID NO: 126560 - RNA, 64 nt, Human; identical to SEQ ID NO: 125580

SEQ ID NO: 126561 - RNA, 64 nt, Human; identical to SEQ ID NO: 125581

SEQ ID NO: 126562 - RNA, 64 nt, Human; identical to SEQ ID NO: 125582

SEQ ID NO: 126563 - RNA, 64 nt, Human; identical to SEQ ID NO: 125583

SEQ ID NO: 126564 - RNA, 64 nt, Human; identical to SEQ ID NO: 125584

SEQ ID NO: 126565 - RNA, 64 nt, Human; identical to SEQ ID NO: 125585

SEQ ID NO: 126566 - RNA, 64 nt, Human; identical to SEQ ID NO: 125586

SEQ ID NO: 126567 - RNA, 64 nt, Human; identical to SEQ ID NO: 125587

SEQ ID NO: 126568 - RNA, 64 nt, Human; identical to SEQ ID NO: 125588

SEQ ID NO: 126569 - RNA, 64 nt, Human; identical to SEQ ID NO: 125589

SEQ ID NO: 126570 - RNA, 64 nt, Human; identical to SEQ ID NO: 125590

SEQ ID NO: 126571 - RNA, 64 nt, Human; identical to SEQ ID NO: 125591

SEQ ID NO: 126572 - RNA, 64 nt, Human; identical to SEQ ID NO: 125592

SEQ ID NO: 126573 - RNA, 64 nt, Human; identical to SEQ ID NO: 125593

SEQ ID NO: 126574 - RNA, 64 nt, Human; identical to SEQ ID NO: 125594

SEQ ID NO: 126575 - RNA, 64 nt, Human; identical to SEQ ID NO: 125595

SEQ ID NO: 126576 - RNA, 64 nt, Human; identical to SEQ ID NO: 125596

SEQ ID NO: 126577 - RNA, 64 nt, Human; identical to SEQ ID NO: 125597

SEQ ID NO: 126578 - RNA, 64 nt, Human; identical to SEQ ID NO: 125598

SEQ ID NO: 126579 - RNA, 64 nt, Human; identical to SEQ ID NO: 125599

SEQ ID NO: 126580 - RNA, 64 nt, Human; identical to SEQ ID NO: 125600

SEQ ID NO: 126581 - RNA, 64 nt, Human; identical to SEQ ID NO: 125601

SEQ ID NO: 126582 - RNA, 64 nt, Human; identical to SEQ ID NO: 125602

SEQ ID NO: 126583 - RNA, 64 nt, Human; identical to SEQ ID NO: 125603

SEQ ID NO: 126584 - RNA, 64 nt, Human; identical to SEQ ID NO: 125604

SEQ ID NO: 126585 - RNA, 64 nt, Human; identical to SEQ ID NO: 125605

SEQ ID NO: 126586 - RNA, 62 nt, Human; identical to SEQ ID NO: 125606

SEQ ID NO: 126587 - RNA, 64 nt, Human; identical to SEQ ID NO: 125607

SEQ ID NO: 126588 - RNA, 64 nt, Human; identical to SEQ ID NO: 125608

SEQ ID NO: 126589 - RNA, 53 nt, Human; identical to SEQ ID NO: 125609

SEQ ID NO: 126590 - RNA, 64 nt, Human; identical to SEQ ID NO: 125610

SEQ ID NO: 126591 - RNA, 64 nt, Human; identical to SEQ ID NO: 125611

SEQ ID NO: 126592 - RNA, 64 nt, Human; identical to SEQ ID NO: 125612

SEQ ID NO: 126593 - RNA, 64 nt, Human; identical to SEQ ID NO: 125613

SEQ ID NO: 126594 - RNA, 64 nt, Human; identical to SEQ ID NO: 125614

SEQ ID NO: 126595 - RNA, 64 nt, Human; identical to SEQ ID NO: 125615

SEQ ID NO: 126596 - RNA, 64 nt, Human; identical to SEQ ID NO: 125616

SEQ ID NO: 126597 - RNA, 64 nt, Human; identical to SEQ ID NO: 125617

SEQ ID NO: 126598 - RNA, 64 nt, Human; identical to SEQ ID NO: 125618

SEQ ID NO: 126599 - RNA, 64 nt, Human; identical to SEQ ID NO: 125619

SEQ ID NO: 126600 - RNA, 64 nt, Human; identical to SEQ ID NO: 125620

SEQ ID NO: 126601 - RNA, 64 nt, Human; identical to SEQ ID NO: 125621

SEQ ID NO: 126602 - RNA, 64 nt, Human; identical to SEQ ID NO: 125622

SEQ ID NO: 126603 - RNA, 64 nt, Human; identical to SEQ ID NO: 125623

SEQ ID NO: 126604 - RNA, 64 nt, Human; identical to SEQ ID NO: 125624

SEQ ID NO: 126605 - RNA, 64 nt, Human; identical to SEQ ID NO: 125625

SEQ ID NO: 126606 - RNA, 64 nt, Human; identical to SEQ ID NO: 125626

SEQ ID NO: 126607 - RNA, 64 nt, Human; identical to SEQ ID NO: 125627

SEQ ID NO: 126608 - RNA, 64 nt, Human; identical to SEQ ID NO: 125628

SEQ ID NO: 126609 - RNA, 64 nt, Human; identical to SEQ ID NO: 125629

SEQ ID NO: 126610 - RNA, 64 nt, Human; identical to SEQ ID NO: 125630

SEQ ID NO: 126611 - RNA, 64 nt, Human; identical to SEQ ID NO: 125631

SEQ ID NO: 126612 - RNA, 64 nt, Human; identical to SEQ ID NO: 125632

SEQ ID NO: 126613 - RNA, 64 nt, Human; identical to SEQ ID NO: 125633

SEQ ID NO: 126614 - RNA, 64 nt, Human; identical to SEQ ID NO: 125634

SEQ ID NO: 126615 - RNA, 64 nt, Human; identical to SEQ ID NO: 125635

SEQ ID NO: 126616 - RNA, 64 nt, Human; identical to SEQ ID NO: 125636

SEQ ID NO: 126617 - RNA, 64 nt, Human; identical to SEQ ID NO: 125637

SEQ ID NO: 126618 - RNA, 64 nt, Human; identical to SEQ ID NO: 125638

SEQ ID NO: 126619 - RNA, 64 nt, Human; identical to SEQ ID NO: 125639

SEQ ID NO: 126620 - RNA, 64 nt, Human; identical to SEQ ID NO: 125640

SEQ ID NO: 126621 - RNA, 64 nt, Human; identical to SEQ ID NO: 125641

SEQ ID NO: 126622 - RNA, 64 nt, Human; identical to SEQ ID NO: 125642

SEQ ID NO: 126623 - RNA, 64 nt, Human; identical to SEQ ID NO: 125643

SEQ ID NO: 126624 - RNA, 64 nt, Human; identical to SEQ ID NO: 125644

SEQ ID NO: 126625 - RNA, 64 nt, Human; identical to SEQ ID NO: 125645

SEQ ID NO: 126626 - RNA, 64 nt, Human; identical to SEQ ID NO: 125646

SEQ ID NO: 126627 - RNA, 64 nt, Human; identical to SEQ ID NO: 125647

SEQ ID NO: 126628 - RNA, 64 nt, Human; identical to SEQ ID NO: 125648

SEQ ID NO: 126629 - RNA, 64 nt, Human; identical to SEQ ID NO: 125649

SEQ ID NO: 126630 - RNA, 64 nt, Human; identical to SEQ ID NO: 125650

SEQ ID NO: 126631 - RNA, 64 nt, Human; identical to SEQ ID NO: 125651

SEQ ID NO: 126632 - RNA, 64 nt, Human; identical to SEQ ID NO: 125652

SEQ ID NO: 126633 - RNA, 64 nt, Human; identical to SEQ ID NO: 125635

SEQ ID NO: 126634 - RNA, 64 nt, Human; identical to SEQ ID NO: 125654

SEQ ID NO: 126635 - RNA, 64 nt, Human; identical to SEQ ID NO: 125655

SEQ ID NO: 126636 - RNA, 64 nt, Human; identical to SEQ ID NO: 125656

SEQ ID NO: 126637 - RNA, 64 nt, Human; identical to SEQ ID NO: 125657

SEQ ID NO: 126638 - RNA, 64 nt, Human; identical to SEQ ID NO: 125658

SEQ ID NO: 126639 - RNA, 64 nt, Human; identical to SEQ ID NO: 125659

SEQ ID NO: 126640 - RNA, 64 nt, Human; identical to SEQ ID NO: 125660

SEQ ID NO: 126641 - RNA, 64 nt, Human; identical to SEQ ID NO: 125661

SEQ ID NO: 126642 - RNA, 64 nt, Human; identical to SEQ ID NO: 125662

SEQ ID NO: 126643 - RNA, 64 nt, Human; identical to SEQ ID NO: 125663

SEQ ID NO: 126644 - RNA, 64 nt, Human; identical to SEQ ID NO: 125664

SEQ ID NO: 126645 - RNA, 64 nt, Human; identical to SEQ ID NO: 125665

SEQ ID NO: 126646 - RNA, 64 nt, Human; identical to SEQ ID NO: 125666

SEQ ID NO: 126647 - RNA, 64 nt, Human; identical to SEQ ID NO: 125667

SEQ ID NO: 126648 - RNA, 64 nt, Human; identical to SEQ ID NO: 125668

SEQ ID NO: 126649 - RNA, 64 nt, Human; identical to SEQ ID NO: 125669

SEQ ID NO: 126650 - RNA, 64 nt, Human; identical to SEQ ID NO: 125670

SEQ ID NO: 126651 - RNA, 64 nt, Human; identical to SEQ ID NO: 125671

SEQ ID NO: 126652 - RNA, 64 nt, Human; identical to SEQ ID NO: 125672

SEQ ID NO: 126653 - RNA, 64 nt, Human; identical to SEQ ID NO: 125673

SEQ ID NO: 126654 - RNA, 64 nt, Human; identical to SEQ ID NO: 125674

SEQ ID NO: 126655 - RNA, 64 nt, Human; identical to SEQ ID NO: 125675

SEQ ID NO: 126656 - RNA, 64 nt, Human; identical to SEQ ID NO: 125676

SEQ ID NO: 126657 - RNA, 61 nt, Human; identical to SEQ ID NO: 125677

SEQ ID NO: 126658 - RNA, 64 nt, Human; identical to SEQ ID NO: 125678

SEQ ID NO: 126659 - RNA, 64 nt, Human; identical to SEQ ID NO: 125679

SEQ ID NO: 126660 - RNA, 64 nt, Human; identical to SEQ ID NO: 125680

SEQ ID NO: 126661 - RNA, 64 nt, Human; identical to SEQ ID NO: 125681

SEQ ID NO: 126662 - RNA, 64 nt, Human; identical to SEQ ID NO: 125682

SEQ ID NO: 126663 - RNA, 64 nt, Human; identical to SEQ ID NO: 125683

SEQ ID NO: 126664 - RNA, 64 nt, Human; identical to SEQ ID NO: 125684

SEQ ID NO: 126665 - RNA, 64 nt, Human; identical to SEQ ID NO: 125685

SEQ ID NO: 126666 - RNA, 64 nt, Human; identical to SEQ ID NO: 125686

SEQ ID NO: 126667 - RNA, 64 nt, Human; identical to SEQ ID NO: 125687

SEQ ID NO: 126668 - RNA, 64 nt, Human; identical to SEQ ID NO: 125688

SEQ ID NO: 126669 - RNA, 64 nt, Human; identical to SEQ ID NO: 125689

SEQ ID NO: 126670 - RNA, 64 nt, Human; identical to SEQ ID NO: 125690

SEQ ID NO: 126671 - RNA, 64 nt, Human; identical to SEQ ID NO: 125691

SEQ ID NO: 126672 - RNA, 64 nt, Human; identical to SEQ ID NO: 125692

SEQ ID NO: 126673 - RNA, 64 nt, Human; identical to SEQ ID NO: 125693

SEQ ID NO: 126674 - RNA, 64 nt, Human; identical to SEQ ID NO: 125694

SEQ ID NO: 126675 - RNA, 64 nt, Human; identical to SEQ ID NO: 125695

SEQ ID NO: 126676 - RNA, 64 nt, Human; identical to SEQ ID NO: 125696

SEQ ID NO: 126677 - RNA, 64 nt, Human; identical to SEQ ID NO: 125697

SEQ ID NO: 126678 - RNA, 64 nt, Human; identical to SEQ ID NO: 125698

SEQ ID NO: 126679 - RNA, 64 nt, Human; identical to SEQ ID NO: 125699

SEQ ID NO: 126680 - RNA, 64 nt, Human; identical to SEQ ID NO: 125700

SEQ ID NO: 126681 - RNA, 64 nt, Human; identical to SEQ ID NO: 125701

SEQ ID NO: 126682 - RNA, 64 nt, Human; identical to SEQ ID NO: 125702

SEQ ID NO: 126683 - RNA, 64 nt, Human; identical to SEQ ID NO: 125703

SEQ ID NO: 126684 - RNA, 64 nt, Human; identical to SEQ ID NO: 125704

SEQ ID NO: 126685 - RNA, 64 nt, Human; identical to SEQ ID NO: 125705

SEQ ID NO: 126686 - RNA, 64 nt, Human; identical to SEQ ID NO: 125706

SEQ ID NO: 126687 - RNA, 64 nt, Human; identical to SEQ ID NO: 125707

SEQ ID NO: 126688 - RNA, 64 nt, Human; identical to SEQ ID NO: 125708

SEQ ID NO: 126689 - RNA, 64 nt, Human; identical to SEQ ID NO: 125709

SEQ ID NO: 126690 - RNA, 64 nt, Human; identical to SEQ ID NO: 125710

SEQ ID NO: 126691 - RNA, 64 nt, Human; identical to SEQ ID NO: 125711

SEQ ID NO: 126692 - RNA, 64 nt, Human; identical to SEQ ID NO: 125712

SEQ ID NO: 126693 - RNA, 64 nt, Human; identical to SEQ ID NO: 125713

SEQ ID NO: 126694 - RNA, 63 nt, Human; identical to SEQ ID NO: 125714

SEQ ID NO: 126695 - RNA, 64 nt, Human; identical to SEQ ID NO: 125715

SEQ ID NO: 126696 - RNA, 64 nt, Human; identical to SEQ ID NO: 125716

SEQ ID NO: 126697 - RNA, 64 nt, Human; identical to SEQ ID NO: 125717

SEQ ID NO: 126698 - RNA, 64 nt, Human; identical to SEQ ID NO: 125718

SEQ ID NO: 126699 - RNA, 64 nt, Human; identical to SEQ ID NO: 125719

SEQ ID NO: 126700 - RNA, 64 nt, Human; identical to SEQ ID NO: 125720

SEQ ID NO: 126701 - RNA, 64 nt, Human; identical to SEQ ID NO: 125721

SEQ ID NO: 126702 - RNA, 64 nt, Human; identical to SEQ ID NO: 125722

SEQ ID NO: 126703 - RNA, 64 nt, Human; identical to SEQ ID NO: 125723

SEQ ID NO: 126704 - RNA, 64 nt, Human; identical to SEQ ID NO: 125724

SEQ ID NO: 126705 - RNA, 64 nt, Human; identical to SEQ ID NO: 125725

SEQ ID NO: 126706 - RNA, 64 nt, Human; identical to SEQ ID NO: 125726

SEQ ID NO: 126707 - RNA, 64 nt, Human; identical to SEQ ID NO: 125727

SEQ ID NO: 126708 - RNA, 64 nt, Human; identical to SEQ ID NO: 125728

SEQ ID NO: 126709 - RNA, 64 nt, Human; identical to SEQ ID NO: 125729

SEQ ID NO: 126710 - RNA, 64 nt, Human; identical to SEQ ID NO: 125730

SEQ ID NO: 126711 - RNA, 64 nt, Human; identical to SEQ ID NO: 125731

SEQ ID NO: 126712 - RNA, 64 nt, Human; identical to SEQ ID NO: 125732

SEQ ID NO: 126713 - RNA, 64 nt, Human; identical to SEQ ID NO: 125733

SEQ ID NO: 126714 - RNA, 64 nt, Human; identical to SEQ ID NO: 125734

SEQ ID NO: 126715 - RNA, 64 nt, Human; identical to SEQ ID NO: 125735

SEQ ID NO: 126716 - RNA, 64 nt, Human; identical to SEQ ID NO: 125736

SEQ ID NO: 126717 - RNA, 64 nt, Human; identical to SEQ ID NO: 125737

SEQ ID NO: 126718 - RNA, 64 nt, Human; identical to SEQ ID NO: 125738

SEQ ID NO: 126719 - RNA, 64 nt, Human; identical to SEQ ID NO: 125739

SEQ ID NO: 126720 - RNA, 64 nt, Human; identical to SEQ ID NO: 125740

SEQ ID NO: 126721 - RNA, 64 nt, Human; identical to SEQ ID NO: 125741

SEQ ID NO: 126722 - RNA, 64 nt, Human; identical to SEQ ID NO: 125742

SEQ ID NO: 126723 - RNA, 64 nt, Human; identical to SEQ ID NO: 125743

SEQ ID NO: 126724 - RNA, 64 nt, Human; identical to SEQ ID NO: 125744

SEQ ID NO: 126725 - RNA, 64 nt, Human; identical to SEQ ID NO: 125745

SEQ ID NO: 126726 - RNA, 64 nt, Human; identical to SEQ ID NO: 125746

SEQ ID NO: 126727 - RNA, 64 nt, Human; identical to SEQ ID NO: 125747

SEQ ID NO: 126728 - RNA, 64 nt, Human; identical to SEQ ID NO: 125748

SEQ ID NO: 126729 - RNA, 64 nt, Human; identical to SEQ ID NO: 125749

SEQ ID NO: 126730 - RNA, 64 nt, Human; identical to SEQ ID NO: 125750

SEQ ID NO: 126731 - RNA, 64 nt, Human; identical to SEQ ID NO: 125751

SEQ ID NO: 126732 - RNA, 64 nt, Human; identical to SEQ ID NO: 125752

SEQ ID NO: 126733 - RNA, 64 nt, Human; identical to SEQ ID NO: 125753

SEQ ID NO: 126734 - RNA, 64 nt, Human; identical to SEQ ID NO: 125754

SEQ ID NO: 126735 - RNA, 64 nt, Human; identical to SEQ ID NO: 125755

SEQ ID NO: 126736 - RNA, 64 nt, Human; identical to SEQ ID NO: 125756

SEQ ID NO: 126737 - RNA, 64 nt, Human; identical to SEQ ID NO: 125757

SEQ ID NO: 126738 - RNA, 64 nt, Human; identical to SEQ ID NO: 125758

SEQ ID NO: 126739 - RNA, 64 nt, Human; identical to SEQ ID NO: 125759

SEQ ID NO: 126740 - RNA, 64 nt, Human; identical to SEQ ID NO: 125760

SEQ ID NO: 126741 - RNA, 64 nt, Human; identical to SEQ ID NO: 125761

SEQ ID NO: 126742 - RNA, 64 nt, Human; identical to SEQ ID NO: 125762

SEQ ID NO: 126743 - RNA, 64 nt, Human; identical to SEQ ID NO: 125763

SEQ ID NO: 126744 - RNA, 64 nt, Human; identical to SEQ ID NO: 125764

SEQ ID NO: 126745 - RNA, 64 nt, Human; identical to SEQ ID NO: 125765

SEQ ID NO: 126746 - RNA, 64 nt, Human; identical to SEQ ID NO: 125766

SEQ ID NO: 126747 - RNA, 64 nt, Human; identical to SEQ ID NO: 125767

SEQ ID NO: 126748 - RNA, 64 nt, Human; identical to SEQ ID NO: 125768

SEQ ID NO: 126749 - RNA, 64 nt, Human; identical to SEQ ID NO: 125769

SEQ ID NO: 126750 - RNA, 64 nt, Human; identical to SEQ ID NO: 125770

SEQ ID NO: 126751 - RNA, 64 nt, Human; identical to SEQ ID NO: 125771

SEQ ID NO: 126752 - RNA, 64 nt, Human; identical to SEQ ID NO: 125772

SEQ ID NO: 126753 - RNA, 64 nt, Human; identical to SEQ ID NO: 125773

SEQ ID NO: 126754 - RNA, 64 nt, Human; identical to SEQ ID NO: 125774

SEQ ID NO: 126755 - RNA, 64 nt, Human; identical to SEQ ID NO: 125775

SEQ ID NO: 126756 - RNA, 64 nt, Human; identical to SEQ ID NO: 125776

SEQ ID NO: 126757 - RNA, 64 nt, Human; identical to SEQ ID NO: 125777

SEQ ID NO: 126758 - RNA, 64 nt, Human; identical to SEQ ID NO: 125778

SEQ ID NO: 126759 - RNA, 64 nt, Human; identical to SEQ ID NO: 125779

SEQ ID NO: 126760 - RNA, 64 nt, Human; identical to SEQ ID NO: 125780

SEQ ID NO: 126761 - RNA, 64 nt, Human; identical to SEQ ID NO: 125781

SEQ ID NO: 126762 - RNA, 64 nt, Human; identical to SEQ ID NO: 125782

SEQ ID NO: 126763 - RNA, 64 nt, Human; identical to SEQ ID NO: 125783

SEQ ID NO: 126764 - RNA, 64 nt, Human; identical to SEQ ID NO: 125784

SEQ ID NO: 126765 - RNA, 64 nt, Human; identical to SEQ ID NO: 125785

SEQ ID NO: 126766 - RNA, 64 nt, Human; identical to SEQ ID NO: 125786

SEQ ID NO: 126767 - RNA, 64 nt, Human; identical to SEQ ID NO: 125787

SEQ ID NO: 126768 - RNA, 64 nt, Human; identical to SEQ ID NO: 125788

SEQ ID NO: 126769 - RNA, 64 nt, Human; identical to SEQ ID NO: 125789

SEQ ID NO: 126770 - RNA, 64 nt, Human; identical to SEQ ID NO: 125790

SEQ ID NO: 126771 - RNA, 64 nt, Human; identical to SEQ ID NO: 125791

SEQ ID NO: 126772 - RNA, 64 nt, Human; identical to SEQ ID NO: 125792

SEQ ID NO: 126773 - RNA, 64 nt, Human; identical to SEQ ID NO: 125793

SEQ ID NO: 126774 - RNA, 64 nt, Human; identical to SEQ ID NO: 125794

SEQ ID NO: 126775 - RNA, 64 nt, Human; identical to SEQ ID NO: 125795

SEQ ID NO: 126776 - RNA, 64 nt, Human; identical to SEQ ID NO: 125796

SEQ ID NO: 126777 - RNA, 64 nt, Human; identical to SEQ ID NO: 125797

SEQ ID NO: 126778 - RNA, 64 nt, Human; identical to SEQ ID NO: 125798

SEQ ID NO: 126779 - RNA, 64 nt, Human; identical to SEQ ID NO: 125799

SEQ ID NO: 126780 - RNA, 64 nt, Human; identical to SEQ ID NO: 125800

SEQ ID NO: 126781 - RNA, 64 nt, Human; identical to SEQ ID NO: 125801

SEQ ID NO: 126782 - RNA, 64 nt, Human; identical to SEQ ID NO: 125802

SEQ ID NO: 126783 - RNA, 64 nt, Human; identical to SEQ ID NO: 125803

SEQ ID NO: 126784 - RNA, 64 nt, Human; identical to SEQ ID NO: 125804

SEQ ID NO: 126785 - RNA, 64 nt, Human; identical to SEQ ID NO: 125805

SEQ ID NO: 126786 - RNA, 64 nt, Human; identical to SEQ ID NO: 125806

SEQ ID NO: 126787 - RNA, 64 nt, Human; identical to SEQ ID NO: 125807

SEQ ID NO: 126788 - RNA, 64 nt, Human; identical to SEQ ID NO: 125808

SEQ ID NO: 126789 - RNA, 64 nt, Human; identical to SEQ ID NO: 125809

SEQ ID NO: 126790 - RNA, 64 nt, Human; identical to SEQ ID NO: 125810

SEQ ID NO: 126791 - RNA, 64 nt, Human; identical to SEQ ID NO: 125811

SEQ ID NO: 126792 - RNA, 64 nt, Human; identical to SEQ ID NO: 125812

SEQ ID NO: 126793 - RNA, 64 nt, Human; identical to SEQ ID NO: 125813

SEQ ID NO: 126794 - RNA, 64 nt, Human; identical to SEQ ID NO: 125814

SEQ ID NO: 126795 - RNA, 64 nt, Human; identical to SEQ ID NO: 125815

SEQ ID NO: 126796 - RNA, 64 nt, Human; identical to SEQ ID NO: 125816

SEQ ID NO: 126797 - RNA, 64 nt, Human; identical to SEQ ID NO: 125817

SEQ ID NO: 126798 - RNA, 64 nt, Human; identical to SEQ ID NO: 125818

SEQ ID NO: 126799 - RNA, 64 nt, Human; identical to SEQ ID NO: 125819

SEQ ID NO: 126800 - RNA, 64 nt, Human; identical to SEQ ID NO: 125820

SEQ ID NO: 126801 - RNA, 64 nt, Human; identical to SEQ ID NO: 125821

SEQ ID NO: 126802 - RNA, 64 nt, Human; identical to SEQ ID NO: 125822

SEQ ID NO: 126803 - RNA, 64 nt, Human; identical to SEQ ID NO: 125823

SEQ ID NO: 126804 - RNA, 64 nt, Human; identical to SEQ ID NO: 125824

SEQ ID NO: 126805 - RNA, 64 nt, Human; identical to SEQ ID NO: 125825

SEQ ID NO: 126806 - RNA, 64 nt, Human; identical to SEQ ID NO: 125826

SEQ ID NO: 126807 - RNA, 64 nt, Human; identical to SEQ ID NO: 125827

SEQ ID NO: 126808 - RNA, 64 nt, Human; identical to SEQ ID NO: 125828

SEQ ID NO: 126809 - RNA, 64 nt, Human; identical to SEQ ID NO: 125829

SEQ ID NO: 126810 - RNA, 64 nt, Human; identical to SEQ ID NO: 125830

SEQ ID NO: 126811 - RNA, 64 nt, Human; identical to SEQ ID NO: 125831

SEQ ID NO: 126812 - RNA, 64 nt, Human; identical to SEQ ID NO: 125832

SEQ ID NO: 126813 - RNA, 64 nt, Human; identical to SEQ ID NO: 125833

SEQ ID NO: 126814 - RNA, 64 nt, Human; identical to SEQ ID NO: 125834

SEQ ID NO: 126815 - RNA, 64 nt, Human; identical to SEQ ID NO: 125835

SEQ ID NO: 126816 - RNA, 64 nt, Human; identical to SEQ ID NO: 125836

SEQ ID NO: 126817 - RNA, 64 nt, Human; identical to SEQ ID NO: 125837

SEQ ID NO: 126818 - RNA, 64 nt, Human; identical to SEQ ID NO: 125838

SEQ ID NO: 126819 - RNA, 64 nt, Human; identical to SEQ ID NO: 125839

SEQ ID NO: 126820 - RNA, 64 nt, Human; identical to SEQ ID NO: 125840

SEQ ID NO: 126821 - RNA, 64 nt, Human; identical to SEQ ID NO: 125841

SEQ ID NO: 126822 - RNA, 64 nt, Human; identical to SEQ ID NO: 125842

SEQ ID NO: 126823 - RNA, 64 nt, Human; identical to SEQ ID NO: 125843

SEQ ID NO: 126824 - RNA, 64 nt, Human; identical to SEQ ID NO: 125844

SEQ ID NO: 126825 - RNA, 64 nt, Human; identical to SEQ ID NO: 125845

SEQ ID NO: 126826 - RNA, 64 nt, Human; identical to SEQ ID NO: 125846

SEQ ID NO: 126827 - RNA, 64 nt, Human; identical to SEQ ID NO: 125847

SEQ ID NO: 126828 - RNA, 64 nt, Human; identical to SEQ ID NO: 125848

SEQ ID NO: 126829 - RNA, 64 nt, Human; identical to SEQ ID NO: 125849

SEQ ID NO: 126830 - RNA, 64 nt, Human; identical to SEQ ID NO: 125850

SEQ ID NO: 126831 - RNA, 64 nt, Human; identical to SEQ ID NO: 125851

SEQ ID NO: 126832 - RNA, 64 nt, Human; identical to SEQ ID NO: 125852

SEQ ID NO: 126833 - RNA, 64 nt, Human; identical to SEQ ID NO: 125853

SEQ ID NO: 126834 - RNA, 64 nt, Human; identical to SEQ ID NO: 125854

SEQ ID NO: 126835 - RNA, 64 nt, Human; identical to SEQ ID NO: 125855

SEQ ID NO: 126836 - RNA, 64 nt, Human; identical to SEQ ID NO: 125856

SEQ ID NO: 126837 - RNA, 64 nt, Human; identical to SEQ ID NO: 125838

SEQ ID NO: 126838 - RNA, 64 nt, Human; identical to SEQ ID NO: 125858

SEQ ID NO: 126839 - RNA, 64 nt, Human; identical to SEQ ID NO: 125859

SEQ ID NO: 126840 - RNA, 64 nt, Human; identical to SEQ ID NO: 125860

SEQ ID NO: 126841 - RNA, 64 nt, Human; identical to SEQ ID NO: 125861

SEQ ID NO: 126842 - RNA, 64 nt, Human; identical to SEQ ID NO: 125862

SEQ ID NO: 126843 - RNA, 64 nt, Human; identical to SEQ ID NO: 125863

SEQ ID NO: 126844 - RNA, 64 nt, Human; identical to SEQ ID NO: 125864

SEQ ID NO: 126845 - RNA, 64 nt, Human; identical to SEQ ID NO: 125865

SEQ ID NO: 126846 - RNA, 64 nt, Human; identical to SEQ ID NO: 125866

SEQ ID NO: 126847 - RNA, 64 nt, Human; identical to SEQ ID NO: 125867

SEQ ID NO: 126848 - RNA, 64 nt, Human; identical to SEQ ID NO: 125868

SEQ ID NO: 126849 - RNA, 64 nt, Human; identical to SEQ ID NO: 125869

SEQ ID NO: 126850 - RNA, 64 nt, Human; identical to SEQ ID NO: 125870

SEQ ID NO: 126851 - RNA, 64 nt, Human; identical to SEQ ID NO: 125871

SEQ ID NO: 126852 - RNA, 64 nt, Human; identical to SEQ ID NO: 125872

SEQ ID NO: 126853 - RNA, 64 nt, Human; identical to SEQ ID NO: 125873

SEQ ID NO: 126854 - RNA, 64 nt, Human; identical to SEQ ID NO: 125874

SEQ ID NO: 126855 - RNA, 64 nt, Human; identical to SEQ ID NO: 125875

SEQ ID NO: 126856 - RNA, 64 nt, Human; identical to SEQ ID NO: 125876

SEQ ID NO: 126857 - RNA, 64 nt, Human; identical to SEQ ID NO: 125877

SEQ ID NO: 126858 - RNA, 64 nt, Human; identical to SEQ ID NO: 125878

SEQ ID NO: 126859 - RNA, 64 nt, Human; identical to SEQ ID NO: 125879

SEQ ID NO: 126860 - RNA, 64 nt, Human; identical to SEQ ID NO: 125880

SEQ ID NO: 126861 - RNA, 64 nt, Human; identical to SEQ ID NO: 125881

SEQ ID NO: 126862 - RNA, 64 nt, Human; identical to SEQ ID NO: 125882

SEQ ID NO: 126863 - RNA, 64 nt, Human; identical to SEQ ID NO: 125883

SEQ ID NO: 126864 - RNA, 50 nt, Human; identical to SEQ ID NO: 125884

SEQ ID NO: 126865 - RNA, 64 nt, Human; identical to SEQ ID NO: 125885

SEQ ID NO: 126866 - RNA, 64 nt, Human; identical to SEQ ID NO: 125886

SEQ ID NO: 126867 - RNA, 64 nt, Human; identical to SEQ ID NO: 125887

SEQ ID NO: 126868 - RNA, 64 nt, Human; identical to SEQ ID NO: 125888

SEQ ID NO: 126869 - RNA, 64 nt, Human; identical to SEQ ID NO: 125889

SEQ ID NO: 126870 - RNA, 64 nt, Human; identical to SEQ ID NO: 125890

SEQ ID NO: 126871 - RNA, 64 nt, Human; identical to SEQ ID NO: 125891

SEQ ID NO: 126872 - RNA, 64 nt, Human; identical to SEQ ID NO: 125892

SEQ ID NO: 126873 - RNA, 64 nt, Human; identical to SEQ ID NO: 125893

SEQ ID NO: 126874 - RNA, 64 nt, Human; identical to SEQ ID NO: 125894

SEQ ID NO: 126875 - RNA, 64 nt, Human; identical to SEQ ID NO: 125895

SEQ ID NO: 126876 - RNA, 64 nt, Human; identical to SEQ ID NO: 125896

SEQ ID NO: 126877 - RNA, 64 nt, Human; identical to SEQ ID NO: 125897

SEQ ID NO: 126878 - RNA, 64 nt, Human; identical to SEQ ID NO: 125898

SEQ ID NO: 126879 - RNA, 64 nt, Human; identical to SEQ ID NO: 125899

SEQ ID NO: 126880 - RNA, 64 nt, Human; identical to SEQ ID NO: 125900

SEQ ID NO: 126881 - RNA, 64 nt, Human; identical to SEQ ID NO: 125901

SEQ ID NO: 126882 - RNA, 64 nt, Human; identical to SEQ ID NO: 125902

SEQ ID NO: 126883 - RNA, 64 nt, Human; identical to SEQ ID NO: 125903

SEQ ID NO: 126884 - RNA, 64 nt, Human; identical to SEQ ID NO: 125882

SEQ ID NO: 126885 - RNA, 64 nt, Human; identical to SEQ ID NO: 125905

SEQ ID NO: 126886 - RNA, 64 nt, Human; identical to SEQ ID NO: 125906

SEQ ID NO: 126887 - RNA, 64 nt, Human; identical to SEQ ID NO: 125907

SEQ ID NO: 126888 - RNA, 64 nt, Human; identical to SEQ ID NO: 125908

SEQ ID NO: 126889 - RNA, 64 nt, Human; identical to SEQ ID NO: 125909

SEQ ID NO: 126890 - RNA, 64 nt, Human; identical to SEQ ID NO: 125910

SEQ ID NO: 126891 - RNA, 64 nt, Human; identical to SEQ ID NO: 125911

SEQ ID NO: 126892 - RNA, 64 nt, Human; identical to SEQ ID NO: 125912

SEQ ID NO: 126893 - RNA, 62 nt, Human; identical to SEQ ID NO: 125913

SEQ ID NO: 126894 - RNA, 64 nt, Human; identical to SEQ ID NO: 125914

SEQ ID NO: 126895 - RNA, 64 nt, Human; identical to SEQ ID NO: 125915

SEQ ID NO: 126896 - RNA, 64 nt, Human; identical to SEQ ID NO: 125916

SEQ ID NO: 126897 - RNA, 64 nt, Human; identical to SEQ ID NO: 125917

SEQ ID NO: 126898 - RNA, 64 nt, Human; identical to SEQ ID NO: 125918

SEQ ID NO: 126899 - RNA, 64 nt, Human; identical to SEQ ID NO: 125919

SEQ ID NO: 126900 - RNA, 64 nt, Human; identical to SEQ ID NO: 125920

SEQ ID NO: 126901 - RNA, 64 nt, Human; identical to SEQ ID NO: 125921

SEQ ID NO: 126902 - RNA, 64 nt, Human; identical to SEQ ID NO: 125922

SEQ ID NO: 126903 - RNA, 64 nt, Human; identical to SEQ ID NO: 125923

SEQ ID NO: 126904 - RNA, 64 nt, Human; identical to SEQ ID NO: 125924

SEQ ID NO: 126905 - RNA, 64 nt, Human; identical to SEQ ID NO: 125925

SEQ ID NO: 126906 - RNA, 64 nt, Human; identical to SEQ ID NO: 125926

SEQ ID NO: 126907 - RNA, 64 nt, Human; identical to SEQ ID NO: 125927

SEQ ID NO: 126908 - RNA, 64 nt, Human; identical to SEQ ID NO: 125928

SEQ ID NO: 126909 - RNA, 64 nt, Human; identical to SEQ ID NO: 125929

SEQ ID NO: 126910 - RNA, 64 nt, Human; identical to SEQ ID NO: 125930

SEQ ID NO: 126911 - RNA, 64 nt, Human; identical to SEQ ID NO: 125931

SEQ ID NO: 126912 - RNA, 64 nt, Human; identical to SEQ ID NO: 125932

SEQ ID NO: 126913 - RNA, 64 nt, Human; identical to SEQ ID NO: 125933

SEQ ID NO: 126914 - RNA, 64 nt, Human; identical to SEQ ID NO: 125934

SEQ ID NO: 126915 - RNA, 64 nt, Human; identical to SEQ ID NO: 125935

SEQ ID NO: 126916 - RNA, 64 nt, Human; identical to SEQ ID NO: 125936

SEQ ID NO: 126917 - RNA, 64 nt, Human; identical to SEQ ID NO: 125937

SEQ ID NO: 126918 - RNA, 64 nt, Human; identical to SEQ ID NO: 125938

SEQ ID NO: 126919 - RNA, 64 nt, Human; identical to SEQ ID NO: 125939

SEQ ID NO: 126920 - RNA, 64 nt, Human; identical to SEQ ID NO: 125940

SEQ ID NO: 126921 - RNA, 64 nt, Human; identical to SEQ ID NO: 125941

SEQ ID NO: 126922 - RNA, 64 nt, Human; identical to SEQ ID NO: 125942

SEQ ID NO: 126923 - RNA, 64 nt, Human; identical to SEQ ID NO: 125943

SEQ ID NO: 126924 - RNA, 64 nt, Human; identical to SEQ ID NO: 125944

SEQ ID NO: 126925 - RNA, 64 nt, Human; identical to SEQ ID NO: 125941

SEQ ID NO: 126926 - RNA, 64 nt, Human; identical to SEQ ID NO: 125946

SEQ ID NO: 126927 - RNA, 64 nt, Human; identical to SEQ ID NO: 125947

SEQ ID NO: 126928 - RNA, 64 nt, Human; identical to SEQ ID NO: 125948

SEQ ID NO: 126929 - RNA, 64 nt, Human; identical to SEQ ID NO: 125949

SEQ ID NO: 126930 - RNA, 64 nt, Human; identical to SEQ ID NO: 125950

SEQ ID NO: 126931 - RNA, 64 nt, Human; identical to SEQ ID NO: 125951

SEQ ID NO: 126932 - RNA, 64 nt, Human; identical to SEQ ID NO: 125952

SEQ ID NO: 126933 - RNA, 64 nt, Human; identical to SEQ ID NO: 125953

SEQ ID NO: 126934 - RNA, 64 nt, Human; identical to SEQ ID NO: 125954

SEQ ID NO: 126935 - RNA, 64 nt, Human; identical to SEQ ID NO: 125955

SEQ ID NO: 126936 - RNA, 64 nt, Human; identical to SEQ ID NO: 125956

SEQ ID NO: 126937 - RNA, 64 nt, Human; identical to SEQ ID NO: 125957

SEQ ID NO: 126938 - RNA, 64 nt, Human; identical to SEQ ID NO: 125958

SEQ ID NO: 126939 - RNA, 64 nt, Human; identical to SEQ ID NO: 125959

SEQ ID NO: 126940 - RNA, 64 nt, Human; identical to SEQ ID NO: 125960

SEQ ID NO: 126941 - RNA, 64 nt, Human; identical to SEQ ID NO: 125961

SEQ ID NO: 126942 - RNA, 64 nt, Human; identical to SEQ ID NO: 125962

SEQ ID NO: 126943 - RNA, 64 nt, Human; identical to SEQ ID NO: 125963

SEQ ID NO: 126944 - RNA, 64 nt, Human; identical to SEQ ID NO: 125964

SEQ ID NO: 126945 - RNA, 64 nt, Human; identical to SEQ ID NO: 125965

SEQ ID NO: 126946 - RNA, 64 nt, Human; identical to SEQ ID NO: 125966

SEQ ID NO: 126947 - RNA, 64 nt, Human; identical to SEQ ID NO: 125967

SEQ ID NO: 126948 - RNA, 64 nt, Human; identical to SEQ ID NO: 125968

SEQ ID NO: 126949 - RNA, 64 nt, Human; identical to SEQ ID NO: 125969

SEQ ID NO: 126950 - RNA, 64 nt, Human; identical to SEQ ID NO: 125970

SEQ ID NO: 126951 - RNA, 64 nt, Human; identical to SEQ ID NO: 125971

SEQ ID NO: 126952 - RNA, 64 nt, Human; identical to SEQ ID NO: 125972

SEQ ID NO: 126953 - RNA, 64 nt, Human; identical to SEQ ID NO: 125973

SEQ ID NO: 126954 - RNA, 64 nt, Human; identical to SEQ ID NO: 125974

SEQ ID NO: 126955 - RNA, 64 nt, Human; identical to SEQ ID NO: 125975

SEQ ID NO: 126956 - RNA, 64 nt, Human; identical to SEQ ID NO: 125976

SEQ ID NO: 126957 - RNA, 64 nt, Human; identical to SEQ ID NO: 125977

SEQ ID NO: 126958 - RNA, 64 nt, Human; identical to SEQ ID NO: 125978

SEQ ID NO: 126959 - RNA, 64 nt, Human; identical to SEQ ID NO: 125979

SEQ ID NO: 126960 - RNA, 64 nt, Human; identical to SEQ ID NO: 125980

SEQ ID NO: 126961 - RNA, 64 nt, Human; identical to SEQ ID NO: 125981

SEQ ID NO: 126962 - RNA, 64 nt, Human; identical to SEQ ID NO: 125982

SEQ ID NO: 126963 - RNA, 64 nt, Human; identical to SEQ ID NO: 125983

SEQ ID NO: 126964 - RNA, 64 nt, Human; identical to SEQ ID NO: 125984

SEQ ID NO: 126965 - RNA, 64 nt, Human; identical to SEQ ID NO: 125985

SEQ ID NO: 126966 - RNA, 64 nt, Human; identical to SEQ ID NO: 125986

SEQ ID NO: 126967 - RNA, 64 nt, Human; identical to SEQ ID NO: 125987

SEQ ID NO: 126968 - RNA, 64 nt, Human; identical to SEQ ID NO: 125988

SEQ ID NO: 126969 - RNA, 64 nt, Human; identical to SEQ ID NO: 125989

SEQ ID NO: 126970 - RNA, 64 nt, Human; identical to SEQ ID NO: 125990

SEQ ID NO: 126971 - RNA, 64 nt, Human; identical to SEQ ID NO: 125991

SEQ ID NO: 126972 - RNA, 64 nt, Human; identical to SEQ ID NO: 125992

SEQ ID NO: 126973 - RNA, 64 nt, Human; identical to SEQ ID NO: 125993

SEQ ID NO: 126974 - RNA, 64 nt, Human; identical to SEQ ID NO: 125994

SEQ ID NO: 126975 - RNA, 64 nt, Human; identical to SEQ ID NO: 125995

SEQ ID NO: 126976 - RNA, 64 nt, Human; identical to SEQ ID NO: 125996

SEQ ID NO: 126977 - RNA, 64 nt, Human; identical to SEQ ID NO: 125997

SEQ ID NO: 126978 - RNA, 64 nt, Human; identical to SEQ ID NO: 125998

SEQ ID NO: 126979 - RNA, 64 nt, Human; identical to SEQ ID NO: 125999

SEQ ID NO: 126980 - RNA, 64 nt, Human; identical to SEQ ID NO: 126000

SEQ ID NO: 126981 - RNA, 64 nt, Human; identical to SEQ ID NO: 126001

SEQ ID NO: 126982 - RNA, 64 nt, Human; identical to SEQ ID NO: 126002

SEQ ID NO: 126983 - RNA, 64 nt, Human; identical to SEQ ID NO: 126003

SEQ ID NO: 126984 - RNA, 64 nt, Human; identical to SEQ ID NO: 126004

SEQ ID NO: 126985 - RNA, 64 nt, Human; identical to SEQ ID NO: 126005

SEQ ID NO: 126986 - RNA, 64 nt, Human; identical to SEQ ID NO: 126006

SEQ ID NO: 126987 - RNA, 64 nt, Human; identical to SEQ ID NO: 126007

SEQ ID NO: 126988 - RNA, 64 nt, Human; identical to SEQ ID NO: 126008

SEQ ID NO: 126989 - RNA, 61 nt, Human; identical to SEQ ID NO: 126009

SEQ ID NO: 126990 - RNA, 64 nt, Human; identical to SEQ ID NO: 126010

SEQ ID NO: 126991 - RNA, 64 nt, Human; identical to SEQ ID NO: 126011

SEQ ID NO: 126992 - RNA, 64 nt, Human; identical to SEQ ID NO: 126012

SEQ ID NO: 126993 - RNA, 64 nt, Human; identical to SEQ ID NO: 126013

SEQ ID NO: 126994 - RNA, 64 nt, Human; identical to SEQ ID NO: 126014

SEQ ID NO: 126995 - RNA, 64 nt, Human; identical to SEQ ID NO: 126015

SEQ ID NO: 126996 - RNA, 64 nt, Human; identical to SEQ ID NO: 126016

SEQ ID NO: 126997 - RNA, 64 nt, Human; identical to SEQ ID NO: 126017

SEQ ID NO: 126998 - RNA, 64 nt, Human; identical to SEQ ID NO: 126018

SEQ ID NO: 126999 - RNA, 64 nt, Human; identical to SEQ ID NO: 126019

SEQ ID NO: 127000 - RNA, 64 nt, Human; identical to SEQ ID NO: 126020

SEQ ID NO: 127001 - RNA, 64 nt, Human; identical to SEQ ID NO: 126021

SEQ ID NO: 127002 - RNA, 64 nt, Human; identical to SEQ ID NO: 126022

SEQ ID NO: 127003 - RNA, 64 nt, Human; identical to SEQ ID NO: 126023

SEQ ID NO: 127004 - RNA, 64 nt, Human; identical to SEQ ID NO: 126024

SEQ ID NO: 127005 - RNA, 64 nt, Human; identical to SEQ ID NO: 126025

SEQ ID NO: 127006 - RNA, 64 nt, Human; identical to SEQ ID NO: 126026

SEQ ID NO: 127007 - RNA, 64 nt, Human; identical to SEQ ID NO: 126027

SEQ ID NO: 127008 - RNA, 64 nt, Human; identical to SEQ ID NO: 126028

SEQ ID NO: 127009 - RNA, 64 nt, Human; identical to SEQ ID NO: 126029

SEQ ID NO: 127010 - RNA, 64 nt, Human; identical to SEQ ID NO: 126030

SEQ ID NO: 127011 - RNA, 64 nt, Human; identical to SEQ ID NO: 126031

SEQ ID NO: 127012 - RNA, 64 nt, Human; identical to SEQ ID NO: 126032

SEQ ID NO: 127013 - RNA, 64 nt, Human; identical to SEQ ID NO: 126033

SEQ ID NO: 127014 - RNA, 64 nt, Human; identical to SEQ ID NO: 126034

SEQ ID NO: 127015 - RNA, 64 nt, Human; identical to SEQ ID NO: 126035

SEQ ID NO: 127016 - RNA, 64 nt, Human; identical to SEQ ID NO: 126036

SEQ ID NO: 127017 - RNA, 64 nt, Human; identical to SEQ ID NO: 126037

SEQ ID NO: 127018 - RNA, 64 nt, Human; identical to SEQ ID NO: 126038

SEQ ID NO: 127019 - RNA, 64 nt, Human; identical to SEQ ID NO: 126039

SEQ ID NO: 127020 - RNA, 64 nt, Human; identical to SEQ ID NO: 126040

SEQ ID NO: 127021 - RNA, 64 nt, Human; identical to SEQ ID NO: 126041

SEQ ID NO: 127022 - RNA, 64 nt, Human
gccccgaucuuucacacacuggugacccugagagaggagggaggagggaaccuggcgggggugu

SEQ ID NO: 127023 - RNA, 64 nt, Human
ucuuucacacacuggugacccugagagaggagggaggagggaaccuggcgggggugucugaggc

SEQ ID NO: 127024 - RNA, 64 nt, Human
ggagcuggcagagcagguggcagucacugggacaaggagggacuugccucucuucucauuauug

SEQ ID NO: 127025 - RNA, 64 nt, Human
ccagcauccuuuucugcagaggggcuuucuggagaggagggaugcugccugagucacccaugaa

SEQ ID NO: 127026 - RNA, 64 nt, Human
aauuucaagagugagcuaucaaacccagagcggaaggagggagcucugaugagcacgguuuguc

SEQ ID NO: 127027 - RNA, 64 nt, Human
agcagguuuagaggcugcagcuugagcuacaaucaggagggaaauuggaaggauuagcagcuuu

SEQ ID NO: 127028 - RNA, 64 nt, Human
uguugguuuguuuuagcugauccaucuguaacacaggagggauccuuggcugaggauuguauuu

SEQ ID NO: 127029 - RNA, 64 nt, Human
cuuagagguugaagcccaccuucucuuuucacauaggagggaacagaccauggaaauuuaaacg

SEQ ID NO: 127030 - RNA, 64 nt, Human
ucuaguuuugagagacuuccucuuggcucccaggaggagggauucccugacuuugacacacaug

SEQ ID NO: 127031 - RNA, 64 nt, Human
uuugagccuuugcuggucacauugccuucugaagaggagggaguauuagauuauaaauccucuu

SEQ ID NO: 127032 - RNA, 64 nt, Human
uuuucuuuugguacccaugugagacaugaacaacaggagggagggaaagagcccaggugggacg

SEQ ID NO: 127033 - RNA, 64 nt, Human
cgucaugugacagaucuaacagggcaagugguacaggagggaaccaggcgcuacagacugugua

SEQ ID NO: 127034 - RNA, 64 nt, Human
accggggacagacccaggggcgggcagagagggaaggagggaggaggcaucuucccugaagccc

SEQ ID NO: 127035 - RNA, 64 nt, Human
aggugucauugugcccgaugucuggcuccccugcaggagggaggcuccaggguaagacagggcu

SEQ ID NO: 127036 - RNA, 64 nt, Human
ccuggugccaucuggccuggcuggagccaggaacaggagggacacuuccccagaauccgcaugu

SEQ ID NO: 127037 - RNA, 64 nt, Human
ggagcugugccacccaaauccagaggaagcaaggaggagggaggugggguagggaggaguguag

SEQ ID NO: 127038 - RNA, 64 nt, Human
augggaaagugaggggcuugagaaagugggugggaggagggaaggauuuuuuaggagccuuaau

SEQ ID NO: 127039 - RNA, 64 nt, Human
ugcaggaggagggcaggguugggugggcaauggaaggagggaggagagaaaugaauggaauaaa

SEQ ID NO: 127040 - RNA, 64 nt, Human
caucccccugccaagauccuugaaggacccuggaaggagggagagcaggcagcccuucacagga

SEQ ID NO: 127041 - RNA, 64 nt, Human
cucauccuuauuuggguauuagaggugucaguugaggagggacuuuagcugagguuaagccuuc

SEQ ID NO: 127042 - RNA, 64 nt, Human
uuccaguuguuaggaagagaugaggaguuggaagaggagggauuagaaacaggaggaggcaguc

SEQ ID NO: 127043 - RNA, 64 nt, Human
auggauggacggauggggugggggaaggaaggaaaggagggagaaaggagggaauacuggcucc

SEQ ID NO: 127044 - RNA, 64 nt, Human
gauggggugggggaaggaaggaaaggagggagaaaggagggaauacuggcuccaucuuugagag

SEQ ID NO: 127045 - RNA, 64 nt, Human
acccucucacuuuccugccuguuccccacuccacaggagggagcugacguuggcuugaaaggag

SEQ ID NO: 127046 - RNA, 64 nt, Human
cauagagccggauggggagagucaacaggaaaaaaggagggaggaggaaaagccacaagagaca

SEQ ID NO: 127047 - RNA, 64 nt, Human
ccugaaaagagacuugguuuggggaccccacaaaaggagggaagcuguagcuguuuggauguga

SEQ ID NO: 127048 - RNA, 64 nt, Human
uaagcuuugacuggguggccuugucuuucuggggaggagggaauguacauucagggaguagccu

SEQ ID NO: 127049 - RNA, 64 nt, Human
ggagaguugagauacagugaaaugagccagggcgaggagggagggugaaggaacggagggcggg

SEQ ID NO: 127050 - RNA, 61 nt, Human
agcggaacucccgcacaugaccucccacccuaggagggagggaaggacaccguccuagggu

SEQ ID NO: 127051 - RNA, 64 nt, Human
aaggagccagaguccucccaagauccccuggaggaggagggaucccugcugccugcacuggggg

SEQ ID NO: 127052 - RNA, 64 nt, Human
gucacuggagguugaagccaaguggggugcugggaggagggagagggaggucacuggaaagggg

SEQ ID NO: 127053 - RNA, 64 nt, Human
ccggcugacccugugccccaguuggggcaggggcaggagggaggguuucucucccaacgcugaa

SEQ ID NO: 127054 - RNA, 64 nt, Human
ugugccuuuugucuauuuauaaugccacuggaagaggagggauaacuuuuucuguuauuugauu

SEQ ID NO: 127055 - RNA, 61 nt, Human
ugaaaaggauggaagcaugagggagggagggaggagggagaaaaacagaauccagccgcuu

SEQ ID NO: 127056 - RNA, 64 nt, Human
ugugaaagucuggauuuacugaggaccuccccugaggagggaccguugggaccgcagauucugc

SEQ ID NO: 127057 - RNA, 64 nt, Human
cagagcacuggcucuccagccccaggaggagaacaggagggaggaggagaugaaagaggaggga

SEQ ID NO: 127058 - RNA, 64 nt, Human
caggaggagaacaggagggaggaggagaugaaagaggagggacagguucuuggugcuguaccuu

SEQ ID NO: 127059 - RNA, 64 nt, Human
ggaaucuaaagcuuuggguuuucugaggggggggaggagggaacuggagguuauugggguuagg

SEQ ID NO: 127060 - RNA, 64 nt, Human
gaagaacagaucaguuguugucagguuugagaaaaggagggaaguuugcuacaaaggggcugca

SEQ ID NO: 127061 - RNA, 64 nt, Human
gugcucucuggcccccagcuggccacacuucuccaggagggacccuuggacuucuuuguguguc

SEQ ID NO: 127062 - RNA, 64 nt, Human
ugcugccagcggggcagccccucauaggaggcccaggagggagccccaaggcguagaagccuug

SEQ ID NO: 127063 - RNA, 64 nt, Human
uggggccaguaauuccggggugcucagaaguuuuaggagggaaugagccucagggaggagugag

SEQ ID NO: 127064 - RNA, 64 nt, Human
ugagacggagaggugcauuucugcuggugacuggaggagggaccagaaugaggauacgugagaa

SEQ ID NO: 127065 - RNA, 64 nt, Human
cagacccugugaccugcgagcugcuacuacuguaaggagggaaauggaugaaucuggcucguuu

SEQ ID NO: 127066 - RNA, 64 nt, Human
ucaauuuauuuggauggauggauggagggauggaaggagggagggaaggaugucugggauguga

SEQ ID NO: 127067 - RNA, 64 nt, Human
uauuuguaaucaaaaaaaaaaaaucacuuggcgcaggagggagaacuuuguaagaagcugcccu

SEQ ID NO: 127068 - RNA, 64 nt, Human
gucgggcaguaacugccgcuugccuugccgcaguaggagggaaaucucaccuuccuuccacaua

SEQ ID NO: 127069 - RNA, 64 nt, Human
accaugcaguucggcggccgcggcugggcccugcaggagggagagagagacacagucauggccc

SEQ ID NO: 127070 - RNA, 64 nt, Human
caaccugucgcucuuggaggcugguguggccuugaggagggaagccucgcauggccgcuggaag

SEQ ID NO: 127071 - RNA, 64 nt, Human
aagcagguccaaggaaagugccgccagugguccaaggagggagacagagggucgucccaacagg

SEQ ID NO: 127072 - RNA, 64 nt, Human
acaaguggggcugcacucgguccagaggccagcuaggagggaaaccgcagcuuccuggggcuug

SEQ ID NO: 127073 - RNA, 64 nt, Human
uuuaaccaugcugucucuggacugagcaagagggaggagggagccugcucaccccacuccaggg

SEQ ID NO: 127074 - RNA, 64 nt, Human
aggacgggagaaagggccccggccaucuugcagcaggagggauucuuaggcguacggccagggc

SEQ ID NO: 127075 - RNA, 64 nt, Human
ccaaccugaugaccucucuggcuggccucccaggaggagggacacuccagccccccucucuggc

SEQ ID NO: 127076 - RNA, 64 nt, Human
gugaaccaaacuaguucucagaauucuacagagaaggagggaaucagacugaggaagcugugac

SEQ ID NO: 127077 - RNA, 64 nt, Human
aguggccuuuggaaaggugguggggauccaguucaggagggagggguauguuugucucccaguc

SEQ ID NO: 127078 - RNA, 64 nt, Human
ccucagguagugaugaauuaguugcugucacaaaaggagggaaguagcacccaaauuaaguugc

SEQ ID NO: 127079 - RNA, 64 nt, Human
aauacuccucccacacuagacacuggguuucaggaggagggagacugcccugcuuuggucccag

SEQ ID NO: 127080 - RNA, 64 nt, Human
cagcugccaugauaaguccuuccaugaaggacugaggagggagaguggggguccagggcuggug

SEQ ID NO: 127081 - RNA, 64 nt, Human
acacaaagcggggggaggguuggggaggggcggcaggagggagguuugugagagcgaggcugag

SEQ ID NO: 127082 - RNA, 64 nt, Human
cacagcgccuggcccaguguaauauuuuugaaagaggagggacaauugugaaaucaguagguua

SEQ ID NO: 127083 - RNA, 64 nt, Human
ugcaacaaagaugcauuuaccucuguaccaacagaggagggaucaugaguugccaccacucaga

SEQ ID NO: 127084 - RNA, 64 nt, Human
gaaagggccaggucccagugcugggccccuggggaggagggagggugggcgguauggcucucga

SEQ ID NO: 127085 - RNA, 64 nt, Human
ugaaaaguagagaaauggauucaguauaaggauaaggagggaagguggaccagaaugaaaacug

SEQ ID NO: 127086 - RNA, 64 nt, Human
uuuuguuugacuccuuaccaauagccugaauuugaggagggaaugauugguagcaaaggauggg

SEQ ID NO: 127087 - RNA, 64 nt, Human
uggacaaaucaccaaacacugggaaggaggagagaggagggaucucucccauagagauggaagg

SEQ ID NO: 127088 - RNA, 64 nt, Human
uguuggcuuguuuuagcugauccaucuguaacacaggagggauccuuggcugaggauuguauuu

SEQ ID NO: 127089 - RNA, 64 nt, Human
ccuccuagacucugucccugggcuagggcaggggaggagggagagcaggguugggggagaggcu

SEQ ID NO: 127090 - RNA, 64 nt, Human
ccauugcuucaccuuaaggguuaauaauguagagaggagggaggaccacauugaugaccagaac

SEQ ID NO: 127091 - RNA, 64 nt, Human
cgcuggagcagcccagaggaaauucgugugaaagaggagggaaugagauuauucggaggaaggg

SEQ ID NO: 127092 - RNA, 64 nt, Human
ucaccccaccacacgcagacucaugcacgcacacaggagggaggccuagcugcucagaggcugc

SEQ ID NO: 127093 - RNA, 64 nt, Human
agcuccagccaaaaacuggacaaggauagagaggaggagggaagaacaaaagagcccuucucua

SEQ ID NO: 127094 - RNA, 64 nt, Human
ccaucuaaacugcccccucugcccugcgggucacaggagggagggggaaggcagggagggccug

SEQ ID NO: 127095 - RNA, 64 nt, Human
gccagggagcugcugccagaaugaaguaggaaagaggagggauccaucuggguuggucugugga

SEQ ID NO: 127096 - RNA, 64 nt, Human
gcugcugccuugccuuccgggaccucguuugcugaggagggacuuacagacuccacugguguuu

SEQ ID NO: 127097 - RNA, 64 nt, Human
cccaggacuguggaguguguggaccaccccacagaggagggacucagauuuauuuacucuugcu

SEQ ID NO: 127098 - RNA, 64 nt, Human
cauacuuggggugagagggagcugaggaugucugaggagggaauaguauugcagggaagacuga

SEQ ID NO: 127099 - RNA, 64 nt, Human
cuuucaggaucugggagggggcagucuggagagaaggagggagacgcagguggacuuggggcaa

SEQ ID NO: 127100 - RNA, 64 nt, Human
agcaucuuucuagccaaugagcccccuccccaggaggagggauggccugacugaaacaggugag

SEQ ID NO: 127101 - RNA, 64 nt, Human
cccaccuggagacgaauguagccagagaggaggaaggagggaaacugaagacaccguggccccu

SEQ ID NO: 127102 - RNA, 64 nt, Human
gaagcagcaggacacauuggcaagucaagcaggaaggagggagauggaaaggggauaucagauu

SEQ ID NO: 127103 - RNA, 64 nt, Human
uguuucgcuccaaaggguugucuuccucgccaaaaggagggagggacuuugaauuugauaugaa

SEQ ID NO: 127104 - RNA, 64 nt, Human
ucugcugccauucugaggaacaucuccaaggaacaggagggacuuuggcuagagccuccugccu

SEQ ID NO: 127105 - RNA, 64 nt, Human
gaauaaggaggaggagggagaagagaaaauguaaaggagggagaucuuucccaggccgcaccau

SEQ ID NO: 127106 - RNA, 64 nt, Human
ccucuguuggaggcacaguuuuagaauaaggaggaggagggagaagagaaaauguaaaggaggg

SEQ ID NO: 127107 - RNA, 64 nt, Human
cagacucauuuaaucaccccaauccagcuccuggaggagggacccagcuccaucgcgcuggagg

SEQ ID NO: 127108 - RNA, 64 nt, Human
uaugagcuguaagaagaaaauggagacaaacagaaggagggaaaaaccaaccuacucugaaagc

SEQ ID NO: 127109 - RNA, 64 nt, Human
ccacugaguguuuuggccacuuggaggaccugggaggagggaguguguccuuugagcaagagga

SEQ ID NO: 127110 - RNA, 64 nt, Human
gagcauccgccgccucuuuucugcugggucugggaggagggaggcugggaggccgcucggggcc

SEQ ID NO: 127111 - RNA, 64 nt, Human
gcccgcugcgaacccuccaccagcuaccggagggaggagggaggaugcgcugugggguuguuuu

SEQ ID NO: 127112 - RNA, 64 nt, Human
cuaaagcugguccccagaaagcaggacagaaagaaggagggacaggcaggcagcaggaggggcg

SEQ ID NO: 127113 - RNA, 64 nt, Human
uggagcuuuuuuuuuuuuacaacgugacaggaagaggagggagagggugacgaacaccaggcau

SEQ ID NO: 127114 - RNA, 64 nt, Human
acuuuagcacaaagucaaacuagagaauguguuaaggagggaauguauaugucuugguagacca

SEQ ID NO: 127115 - RNA, 64 nt, Human
cuuauggaguauggaaaaggccucugccuuccucaggagggacacauagugggucaucacccuu

SEQ ID NO: 127116 - RNA, 64 nt, Human
aaugcaauuauaaacuauauggaggagggugcagaggagggaaugugucuggugugugaugugu

SEQ ID NO: 127117 - RNA, 64 nt, Human
uaucacugcacuuuaagaaacuggaggcugcaacaggagggaaaggcagaaugauaucacagca

SEQ ID NO: 127118 - RNA, 64 nt, Human
cugacugagaacuccaggcaccggcugaccccucaggagggauugcaggccccagguggcagcc

SEQ ID NO: 127119 - RNA, 64 nt, Human
aaagauucuguuucaaauauagccacagaaauaaaggagggaccaauaucugggacagguaauu

SEQ ID NO: 127120 - RNA, 64 nt, Human
auuccaaaguuuugaagucaucuuagcuuuccacaggagggagagaacuuaaaaaagcaacagu

SEQ ID NO: 127121 - RNA, 64 nt, Human
caagaauuacaaguagaauggcagcuggaauuuaaggagggacaagaaucaauggauaagcgug

SEQ ID NO: 127122 - RNA, 64 nt, Human
cagaauuucuaauggaaguuuguugugaauguaaaggagggagcauucuuugcuuuuuaauaua

SEQ ID NO: 127123 - RNA, 64 nt, Human
caagaaagagucagguuagggagcagugaaagugaggagggaagacaauucugugaacucugua

SEQ ID NO: 127124 - RNA, 64 nt, Human
aagacugacaagagucuuuuuauuugggagccagaggagggaaguguuacuugugcuauaacug

SEQ ID NO: 127125 - RNA, 64 nt, Human
ugcucaagagggaagcaauuauaagguggguggcaggagggaacaggugccaccugcuggacaa

SEQ ID NO: 127126 - RNA, 64 nt, Human
cguuuugaacuacagauguuguaguggguuuuggaggagggaguggaguaagaugcccucccac

SEQ ID NO: 127127 - RNA, 64 nt, Human
gaggagccccucugcccggccagccgccccguccaggagggaggugggggggucagccccccgc

SEQ ID NO: 127128 - RNA, 64 nt, Human
cuaaaaccagaguacagggugugaaucauguaccaggagggauuuuauuuuuaaauaucuuuau

SEQ ID NO: 127129 - RNA, 64 nt, Human
acagugguuccuggcugcugccaugucucagaugaggagggagagaaggaggccgccagacucg

SEQ ID NO: 127130 - RNA, 64 nt, Human
acaggugggaggaaaagaaaacuucuuaccuuggaggagggacaucccgcuuccuuauccuuag

SEQ ID NO: 127131 - RNA, 64 nt, Human
acauuucacuuggggaaauccacaagguuccuggaggagggaagagaggacaagaggacccuuu

SEQ ID NO: 127132 - RNA, 64 nt, Human
uucucccaucucugucccugcaagcacagggcuaaggagggauagaguaggacccuggaccaca

SEQ ID NO: 127133 - RNA, 53 nt, Human
ucugcaaguucacugacuagugcaggagggaagucagcagccuguguuuggug

SEQ ID NO: 127134 - RNA, 64 nt, Human
cugagccugcauggugccgccgagcccgggguggaggagggagccaggcuucgcuucaaggcgg

SEQ ID NO: 127135 - RNA, 64 nt, Human
cugguggguugcaggaacagcacccaggacucugaggagggacagagaagcaagggggcugcug

SEQ ID NO: 127136 - RNA, 64 nt, Human
cggccccucgcugggggagaaagcaucugcuccaaggagggagggagcgcagggaaaagagcga

SEQ ID NO: 127137 - RNA, 64 nt, Human
uguaagcuguggccucaccaggcaagcugaggccaggagggacccugcccagucugugaaagcu

SEQ ID NO: 127138 - RNA, 64 nt, Human
augucacaacaaucagcccugggcagacacgagcaggagggagagacagagaaaagaaaaacac

SEQ ID NO: 127139 - RNA, 64 nt, Human
agggguuguuuuuaaagaaaaaaacaaucccagcaggagggauugcugggauuguuuuuucuuu

SEQ ID NO: 127140 - RNA, 64 nt, Human
uccaagagaaaggaggcuccguuuugcaaaguggaggagggacgagggacagggguuucaccag

SEQ ID NO: 127141 - RNA, 64 nt, Human
uggaagccucccucacucuccaugcuggcagagcaggagggagacugaaguaagagauggcaga

SEQ ID NO: 127142 - RNA, 64 nt, Human
ccugggggcugggcuguagaagaguuguuggggaaggagggagcugaggagggggcaucuccca

SEQ ID NO: 127143 - RNA, 64 nt, Human
agcaccucaguuucccucagagggaaacagcaggaggagggaucccugacugcugaggacucac

SEQ ID NO: 127144 - RNA, 64 nt, Human
gacuugggggcagaaguucagacacaccgugcucaggagggacccagagccgaguuucggaguu

SEQ ID NO: 127145 - RNA, 64 nt, Human
uuguugcugucagauucuauuuucagaaagugagaggagggaccguaggucuuuucggagugac

SEQ ID NO: 127146 - RNA, 64 nt, Human
gcacccaggcugugaucuguccugggcggggaccaggagggagcggggucgggaucaccugcca

SEQ ID NO: 127147 - RNA, 64 nt, Human
ccaucugagaaguggcccaugugcuucaaggcccaggagggagaucugucagcucauucuugcc

SEQ ID NO: 127148 - RNA, 64 nt, Human
caccggaguucaacgucccagcagucuugguaaaaggagggagccugcugagccaggagggaga

SEQ ID NO: 127149 - RNA, 64 nt, Human
gcagucuugguaaaaggagggagccugcugagccaggagggagaaaagaagauugaccagcuug

SEQ ID NO: 127150 - RNA, 64 nt, Human
uuuacugaccccauuugucgacauggccccagacaggagggauccacuucucuguucugaacag

SEQ ID NO: 127151 - RNA, 64 nt, Human
gcacccgcuggggccuggagucagggcccacuccaggagggacccacugccuucccggggagca

SEQ ID NO: 127152 - RNA, 64 nt, Human
ugggguggaagugggguaggggaagaggaggggcaggagggagaguuccugugagcaugugggg

SEQ ID NO: 127153 - RNA, 64 nt, Human
uggccucugcuaagcucaaggcgugaggaugggaaggagggagguauucguaaggaugggaagg

SEQ ID NO: 127154 - RNA, 64 nt, Human
gaugggaaggagggagguauucguaaggaugggaaggagggagguauucgugcagcauaugagg

SEQ ID NO: 127155 - RNA, 64 nt, Human
ggcagagagggucacugggggacacuguggcagcaggagggacucugucuggccagggaggagc

SEQ ID NO: 127156 - RNA, 64 nt, Human
gugauuuagaccuuuugagaauaggacacuuggcaggagggaaaaggaagaggacaaaggaggg

SEQ ID NO: 127157 - RNA, 64 nt, Human
ugagccaagcaaagagaagucucaguggagcaugaggagggagcaguccagaugccaacaagga

SEQ ID NO: 127158 - RNA, 64 nt, Human
uugucgcuugaaaccuucccacacucccugcuccaggagggaaaaacagauguuguugacagau

SEQ ID NO: 127159 - RNA, 64 nt, Human
gacuccagcagaguagcugauauugacauaucugaggagggaggaggcuccaauacgacuacuc

SEQ ID NO: 127160 - RNA, 64 nt, Human
ccuucagaucuauugccuuggcuucagggggauaaggagggaacauaucauaacugcacuguga

SEQ ID NO: 127161 - RNA, 64 nt, Human
aggaccccugaaggagcagaguccaugagaaagaaggagggaugggaccuuuguaggaagagac

SEQ ID NO: 127162 - RNA, 64 nt, Human
auggcaugagaacucuuguuucuuggggaaggagaggagggaaaaggaccagggucaaggggga

SEQ ID NO: 127163 - RNA, 64 nt, Human
cuggaaaaaaaaugggggggaaggguggaugaaaaggagggagagaagguggaaaugguuuuuu

SEQ ID NO: 127164 - RNA, 64 nt, Human
auguuacucaagcugccacucccugcugaagagcaggagggaacucucacugggggcggaagga

SEQ ID NO: 127165 - RNA, 64 nt, Human
gaugcggggagauuugagaggggaaaaccccgccaggagggagagagaggcaccccucugggau

SEQ ID NO: 127166 - RNA, 64 nt, Human
cuggcucccucaggcccugcuuaccaagcucuggaggagggagugcugcauuacugagcaccuu

SEQ ID NO: 127167 - RNA, 64 nt, Human
gugaaugccaguggggaugcggggggaugaggguaggagggacuuauagaaggggauuuguggc

SEQ ID NO: 127168 - RNA, 64 nt, Human
ccuuuuuaauuuccagaacugcacaaugaccagcaggagggaaggacagacaucaagugccaga

SEQ ID NO: 127169 - RNA, 64 nt, Human
acacuuggcucaggcugaucaccaugcuagucacaggagggagagagaggcaguguacuugccc

SEQ ID NO: 127170 - RNA, 64 nt, Human
gacugagggugggaucgcagcuccgaagacggagaggagggaaauggggcccuuuccccucuau

SEQ ID NO: 127171 - RNA, 64 nt, Human
ccuguaaagggucggugcugaggaggaauagugaaggagggaggccucuuugcaguugagauaa

SEQ ID NO: 127172 - RNA, 64 nt, Human
cuuggcgccucuguuugccaccacuuccccaggaaggagggacagcauuucucuggcugguucc

SEQ ID NO: 127173 - RNA, 64 nt, Human
cugccccaccugccaucuugguugucaaagucaaaggagggaaugaaguuaugaauugaauugg

SEQ ID NO: 127174 - RNA, 64 nt, Human
ugcuggcauggacaugacuggauagaauuuucucaggagggagcuugguggauuuugaagguaa

SEQ ID NO: 127175 - RNA, 64 nt, Human
gggaaagcacuagaaccccuggguagggaaagaaaggagggaaaaaccauaaaaggaauacuua

SEQ ID NO: 127176 - RNA, 64 nt, Human
cuaguuuguuacuuuaaaaaucaguuuugaugaaaggagggaaaagcagauggacuugaaaaag

SEQ ID NO: 127177 - RNA, 64 nt, Human
aguagcagcaaccuguuugaauacaauguacuaaaggagggauguacuuucagaucauguaacc

SEQ ID NO: 127178 - RNA, 64 nt, Human
ggaaauaucuuccucagcaucugagaauuuuuccaggagggagaccuguugguuauugugcacu

SEQ ID NO: 127179 - RNA, 64 nt, Human
acagauugcgggagggccugagagaagcagggacaggagggagccuggggauugugguuuggga

SEQ ID NO: 127180 - RNA, 64 nt, Human
ggcuuaaucuuauuuuaucuucuuuccucaauauaggagggaagauuuuuccauuuguauuacu

SEQ ID NO: 127181 - RNA, 64 nt, Human
gagcugcagggacagggugagcagcugaagggcuaggagggaagccggcccccgcucugcagaa

SEQ ID NO: 127182 - RNA, 64 nt, Human
cuggagacguuaagagcugagcacaccacaggaaaggagggaggaugcugugugagagccaugc

SEQ ID NO: 127183 - RNA, 64 nt, Human
ggacacucgcuugccgggccugggccuccugggaaggagggagcugcucagaaugccgcaugac

SEQ ID NO: 127184 - RNA, 64 nt, Human
cccuggcucgaugccucauggaucuuucuccccaaggagggacgucuugagggguccgagccuc

SEQ ID NO: 127185 - RNA, 64 nt, Human
uacgaguaagcugaugagagcaaugaacaggagaaggagggagagagccaaaugucugaguaaa

SEQ ID NO: 127186 - RNA, 64 nt, Human
ucuagucauaacacuuuagagagaaugucagagcaggagggaggcaagccgccucuucucggcc

SEQ ID NO: 127187 - RNA, 64 nt, Human
uuauuuuucucguagaucuuuagcuacuuuggggaggagggaaggugcugauaccuucaauuug

SEQ ID NO: 127188 - RNA, 64 nt, Human
cuaccaagcauguuucacauuuuccuauuaguggaggagggagaaccauauuuauuuauaauga

SEQ ID NO: 127189 - RNA, 64 nt, Human
gugcaugacucugggugugagucugucuaggaacaggagggaaaguuggacucagacagaaauc

SEQ ID NO: 127190 - RNA, 64 nt, Human
cucaagccuguaaccccagcacuuugggaggccaaggagggaggaucacaaggucaggagaucg

SEQ ID NO: 127191 - RNA, 64 nt, Human
gcuggcugggccccaaugcaccgucccucagcucaggagggaugggccugaccugacgcucagg

SEQ ID NO: 127192 - RNA, 64 nt, Human
ggaaaauuugauguuccuuaggauuauauaacugaggagggaacauugcaaauagggucugagg

SEQ ID NO: 127193 - RNA, 64 nt, Human
ggcccauuaagaguuacucagaugaccugaggaaaggagggaaaguuccagcaguuucaugaga

SEQ ID NO: 127194 - RNA, 64 nt, Human
guacagaucaaagaagacagaacaugucaggggaaggagggaaagaucuugaugcaggguuucu

SEQ ID NO: 127195 - RNA, 64 nt, Human
caaaaggaaaaauguggaggaaaagggaaaaaucaggagggaggauugccucauguauuauuua

SEQ ID NO: 127196 - RNA, 64 nt, Human
cgcagucauggaucuggguaguccggaaaacaaaaggagggaagacagccugguaaugaauaag

SEQ ID NO: 127197 - RNA, 64 nt, Human
cucacaccuauaaucccagcacuuugggaggcagaggagggaggaucacuugaacccaggaauu

SEQ ID NO: 127198 - RNA, 64 nt, Human
cucacaccuauaaucccaacacuuucggaggccaaggagggacaaacgaacccuugaggccagg

SEQ ID NO: 127199 - RNA, 64 nt, Human
aauuuccuauuuucacauaaguuauauuuaagggaggagggaauuuuuuuuaaacaagcuuagg

SEQ ID NO: 127200 - RNA, 64 nt, Human
ccauaaugagaugugagccuugugcaugugggggaggagggagagagauguacuuuuuaaauca

SEQ ID NO: 127201 - RNA, 64 nt, Human
gcugcaccuggcccccuggcauuccugacgcucuaggagggaagggggaggcagugcuggccuc

SEQ ID NO: 127202 - RNA, 64 nt, Human
ugaaaaagauggaaugcuugcagagcaugaccugaggagggaggaacguggucaacucacaccu

SEQ ID NO: 127203 - RNA, 64 nt, Human
uucccagcugcuccuggggaggccgcuuccugguaggagggaguccacgagacucuuuucuguc

SEQ ID NO: 127204 - RNA, 64 nt, Human
auccccagccucuuccugucuucagaaaagcagcaggagggacuuuggggcauggaccugaguu

SEQ ID NO: 127205 - RNA, 64 nt, Human
aagcugcuuagaaggcccuggaagggaagugaggaggagggacaaggaagaugacuaguuacgg

SEQ ID NO: 127206 - RNA, 64 nt, Human
aacuuucagcuguagucuucuugaacacuucaugaggagggacauucccugauauaagagagga

SEQ ID NO: 127207 - RNA, 64 nt, Human
cuggcacugccacucacacucggccccagggcccaggagggacagugccuggagccugggccag

SEQ ID NO: 127208 - RNA, 64 nt, Human
agaggccagcccggggcuggggaggcgcaaggagaggagggauccaguggggccgugggcuggg

SEQ ID NO: 127209 - RNA, 64 nt, Human
cauacaggcccacaccugagcuccugucugccugaggagggaaagggggaguggccaggucagg

SEQ ID NO: 127210 - RNA, 64 nt, Human
uagagcuggguaauaaaugucuauucuccuggggaggagggauucuaaacuuuccuuccguccu

SEQ ID NO: 127211 - RNA, 64 nt, Human
ccuucugcgccugaggcgggcgggucccgagcccaggagggaacccgcgcucaggcggacggcg

SEQ ID NO: 127212 - RNA, 64 nt, Human
cacuuagaguaaauggacuugccuuaauuuauaaaggagggaagagguagaagggaaccauggg

SEQ ID NO: 127213 - RNA, 64 nt, Human
ggauuuauugauccaaagugcuggacacgguauuaggagggaaugccagauuggagagauccaa

SEQ ID NO: 127214 - RNA, 64 nt, Human
gauuagacaggaaggaagacauuagugauuagacaggagggaagauauuagugauuagacagca

SEQ ID NO: 127215 - RNA, 64 nt, Human
cuaaaagaguuaaaagucauugcucuggagaauuaggagggauggggcaggggacuguuaggau

SEQ ID NO: 127216 - RNA, 64 nt, Human
uugaaaguauggaaguuuuccauucacuggggaaaggagggaaaagugcauuuauuuuuauaca

SEQ ID NO: 127217 - RNA, 64 nt, Human
agcaugagggcaacuauagugaggccuuauugccaggagggaggguuuugguugcuggcgcuug

SEQ ID NO: 127218 - RNA, 64 nt, Human
guggagggugcagaggggcugggguagggcauguaggagggaggugggugggucaggugagugg

SEQ ID NO: 127219 - RNA, 64 nt, Human
accuuacuucccugggauccccagaguugguccaaggagggagaguggguucucaauacgguac

SEQ ID NO: 127220 - RNA, 64 nt, Human
acugacucaggaacagcaagucagggcagagaggaggagggaggcugucaggauggaaauaccu

SEQ ID NO: 127221 - RNA, 64 nt, Human
aaccgagggcggcccuuggcggcaacaugcaagaaggagggacugucgaacccaagggcucaaa

SEQ ID NO: 127222 - RNA, 64 nt, Human
cugaggauggcccaaaguccagggucugguggggaggagggaagcuuaacucaaguuuggguua

SEQ ID NO: 127223 - RNA, 64 nt, Human
guuauuggcaaggguuugaaauguguaagaaccuaggagggaaaggaagauugagcaacauagg

SEQ ID NO: 127224 - RNA, 64 nt, Human
gaacggagacagcauugggcugacugugggcaugaggagggauaaggcugauuuggaccccagg

SEQ ID NO: 127225 - RNA, 64 nt, Human
ggacuggcagguuauuaaucgagauacacuuguuaggagggacaggguuccccuaaggcacuuu

SEQ ID NO: 127226 - RNA, 64 nt, Human
uacacuuccuggggaaauugucuuugguguuuagaggagggaaugagaacacaaauuggauaau

SEQ ID NO: 127227 - RNA, 64 nt, Human
uucagugugugcaugacaacucguguguaugagaaggagggauaugaaggaagauggcuugcag

SEQ ID NO: 127228 - RNA, 64 nt, Human
gcacacagacuguuaaaaugucugccucacagauaggagggaaaauauauagaggauuauaaua

SEQ ID NO: 127229 - RNA, 52 nt, Human
auuuucuucccacagauugaaaaggagggagcuacucucaggcugcaaguaa

SEQ ID NO: 127230 - RNA, 64 nt, Human
ggcuaaaggaacagauuccuagagauuaaugaagaggagggagguuucuuuggucuucuauucc

SEQ ID NO: 127231 - RNA, 64 nt, Human
cccgauuggcuggagaauugacuugggagagauaaggagggagggcgggugccagcaugcuaug

SEQ ID NO: 127232 - RNA, 64 nt, Human
auuuagagguggcagugucuggaucuaccuugguaggagggagucaguacuguuggacccauag

SEQ ID NO: 127233 - RNA, 64 nt, Human
ugcagugggggagggaugcagggacauuuacugaaggagggacauggacaaaacaacauugaau

SEQ ID NO: 127234 - RNA, 64 nt, Human
uuuaaaauuauuuaaccccugggggcagagacugaggagggaggaugauaagggaucccggacu

SEQ ID NO: 127235 - RNA, 64 nt, Human
acugauugcccacccccaccacugcaccauuuccaggagggagaguggggacccucagccgccc

SEQ ID NO: 127236 - RNA, 64 nt, Human
guuagggguauaugaugggggaguagaucuuucuaggagggagacacuggccccucaaaucguc

SEQ ID NO: 127237 - RNA, 64 nt, Human
ggagaagagugacugaggcccuagggcaugggagaggagggacgcccaggguggggaggaagag

SEQ ID NO: 127238 - RNA, 64 nt, Human
cccugggagacagcaccguggacagcaagccgugaggagggagcccgcucaggauggccugggc

SEQ ID NO: 127239 - RNA, 64 nt, Human
ucacguuuucuuuacacacacguugacgggccgcaggagggaggcggggaggaggaacgggcag

SEQ ID NO: 127240 - RNA, 64 nt, Human
cuaugcugaagagccugcuuagaggaggaguaccaggagggagccagcauuucagaucugaagu

SEQ ID NO: 127241 - RNA, 64 nt, Human
ugggagaaguuacauuucuggaggugaugaagcaaggagggagcacuaggaagagaaaagcuac

SEQ ID NO: 127242 - RNA, 64 nt, Human
acuuuuauuaaagccugagacucaggccagaauuaggagggagcuuuuugaaggaagacuuauu

SEQ ID NO: 127243 - RNA, 64 nt, Human
gcuggagggaggcugggcggguacagcgcggaggaggagggaggccaggcgggcauggcgugga

SEQ ID NO: 127244 - RNA, 64 nt, Human
ggaggagggaggccaggcgggcauggcguggaggaggagggaggccgggcggucacagcaugga

SEQ ID NO: 127245 - RNA, 64 nt, Human
ggaggagggaggccgggcggucacagcauggaggaggagggaggcgcugcugguguucuuauuc

SEQ ID NO: 127246 - RNA, 64 nt, Human
aaaggacagacuguuggcuuuguguuuggaggauaggagggagagagggaaggggcugaggaaa

SEQ ID NO: 127247 - RNA, 64 nt, Human
uggauguuuuccugggcuucauaucuguauggcaaggagggagcuguccuucagcagacaaagu

SEQ ID NO: 127248 - RNA, 64 nt, Human
auucuggccagagcagggcuggagggaaggagccaggagggagagagccucccaccuuuccccu

SEQ ID NO: 127249 - RNA, 64 nt, Human
acacacuggggccuaugagagggcggaaggugggaggagggagagaucaggaaaaauaacuaau

SEQ ID NO: 127250 - RNA, 58 nt, Human
aguacaccagcgcuaaguaaacuugccaaggagggacuuucucuggaauuuccugaua

SEQ ID NO: 127251 - RNA, 64 nt, Human
acuuugcuuccuauacucugcuguccccuacuugaggagggauugggaucugggccugaaaugg

SEQ ID NO: 127252 - RNA, 64 nt, Human
caacucgguucucauggaggaguggguggagacaaggagggaguaagucguaggaguacaaggu

SEQ ID NO: 127253 - RNA, 60 nt, Human
aaccugagggccacguaugacgccacgccaaggagggaagagucccagugaacucggccc

SEQ ID NO: 127254 - RNA, 64 nt, Human
cagacgcaaggcuuucugugggcccccaagugguaggagggagaguagcagagcauggguuacu

SEQ ID NO: 127255 - RNA, 64 nt, Human
uccagccacauccaucuggcaguugugccaagggaggagggaggagguaaaaggcagggaguua

SEQ ID NO: 127256 - RNA, 64 nt, Human
gucuccaggcuggggagagaagggugaccaggcgaggagggagccgagacgucaacugugaagg

SEQ ID NO: 127257 - RNA, 64 nt, Human
gcagauggcucucgguuccaggugugggacuaugaggagggagagguggaggcccugcuggauc

SEQ ID NO: 127258 - RNA, 64 nt, Human
gccuggggccagccaguacaguccugagccgaggaggagggacugcaaguggaagagagccagu

SEQ ID NO: 127259 - RNA, 64 nt, Human
cacgauucaaauaauuccccuccuaaaaccaaaaaggagggaaacgucaacuccauugcaauua

SEQ ID NO: 127260 - RNA, 64 nt, Human
gugacugaacgauccuucaaagucucaaugaaauaggagggaaaccuuuggcuacacaauugga

SEQ ID NO: 127261 - RNA, 64 nt, Human
ggauuaaaacaacugaugccacaaugacuauugaaggagggaaaauucucaagguuccauagua

SEQ ID NO: 127262 - RNA, 64 nt, Human
gucagacacaugcccuucggcagcauuccagaacaggagggaagagaaagagaaaacuuucuuc

SEQ ID NO: 127263 - RNA, 64 nt, Human
ucaagugagcagcgggcgggcccggcugccaaggaggagggagagcggcgggaggggccgcggu

SEQ ID NO: 127264 - RNA, 64 nt, Human
agagggagagagaggaaagggaaggaagaaaggaaggagggagaagggaagaaagaaacaaugu

SEQ ID NO: 127265 - RNA, 64 nt, Human
cagaggaucuuaggugcuggcuuguggagacaaaaggagggaaauggguagagccuguuugucu

SEQ ID NO: 127266 - RNA, 64 nt, Human
ccaaggauauaugccccaacgaaugcugcugaagaggagggaggccucguggacugcugcugag

SEQ ID NO: 127267 - RNA, 64 nt, Human
uuuuucucaaccuuaaauaugaacuuaggaaauaaggagggaaguacaaagauuauugacuaua

SEQ ID NO: 127268 - RNA, 64 nt, Human
aucaaucaucacggccugcagagcaccuguccuaaggagggaaaauccugucacacugccucuc

SEQ ID NO: 127269 - RNA, 64 nt, Human
ugccacuaggcaucugcauccccgagcccaagccaggagggauuucccuuaggcaacaccaucc

SEQ ID NO: 127270 - RNA, 64 nt, Human
guccaagugugagccauucacagacuagaacacaaggagggagagagacucuuaaacguaaaua

SEQ ID NO: 127271 - RNA, 64 nt, Human
ugucugugggagcccagaggcugcagggaggaggaggagggagguaucuggugugagcguugcc

SEQ ID NO: 127272 - RNA, 64 nt, Human
gauccucguuaauaccuggcugcgugugcagcugaggagggagugaaccucaagccuaaauacc

SEQ ID NO: 127273 - RNA, 64 nt, Human
gaccuaaucccccucaugcuagccuagucccuggaggagggaguccggccccaggccagggacu

SEQ ID NO: 127274 - RNA, 64 nt, Human
auuuacagaacgaggaggaagagagagaaaacgcaggagggagacagacuggccaggcuggugg

SEQ ID NO: 127275 - RNA, 64 nt, Human
gcugcucaagcaguucaggcuacagcucagaugaaggagggacgaagaacaucaaguuuaaaag

SEQ ID NO: 127276 - RNA, 64 nt, Human
aaccuuuuuaagagccauucuaaaagugaccagcaggagggaucuaguagugaauaauaucuua

SEQ ID NO: 127277 - RNA, 64 nt, Human
cuguucaaaagcuuugggccaauuagggaguaaaaggagggaaggggccuauccauuccauugu

SEQ ID NO: 127278 - RNA, 64 nt, Human
auuugagggguggcuacuuggcuaugggauagggaggagggaauuacuagggaggagagaaagg

SEQ ID NO: 127279 - RNA, 64 nt, Human
gaguggauuucaagcauuugccaggguaugcuggaggagggacuccuaaaguaggugagaugug

SEQ ID NO: 127280 - RNA, 64 nt, Human
guuguuccuaacuuggggacuggaccuacccucuaggagggaguuguuaauggggcucuuuuag

SEQ ID NO: 127281 - RNA, 64 nt, Human
auuuucaaauaacuaucuugggggugagaggagaaggagggagggaaaaggggucaggcacacu

SEQ ID NO: 127282 - RNA, 64 nt, Human
accugugaguggcucccagcacuuugagaggccgaggagggaggacugcuugaagccagaaguu

SEQ ID NO: 127283 - RNA, 64 nt, Human
ugcgccguguccugagagaggugcccucccuacgaggagggaagaacaggcccuggggugcaga

SEQ ID NO: 127284 - RNA, 64 nt, Human
uuuuuuuuugagauggagucuuguucuguugcccaggagggagugcaguggugcaaccucggcu

SEQ ID NO: 127285 - RNA, 64 nt, Human
guugagcucucagccuuaggaaggaagcacguggaggagggacggaggagguucccuugcuggg

SEQ ID NO: 127286 - RNA, 64 nt, Human
aguuccacccacagaguagugaaucucucagccaaggagggaaagaaaaggaagaacucuugac

SEQ ID NO: 127287 - RNA, 64 nt, Human
aucgugcggggcaaaaugaggagcagaggcauggaggagggaggcgugggaugggaauagcaga

SEQ ID NO: 127288 - RNA, 64 nt, Human
cuucgagucugagcgcuuguggcuagaguuugccaggagggaggaaaccagugacccugaaaac

SEQ ID NO: 127289 - RNA, 64 nt, Human
gcccaggauggcuuuugcugcggccccgugggguaggagggacagagagacagggagagucagc

SEQ ID NO: 127290 - RNA, 64 nt, Human
uuguggaugacuucuuuucugauggagagaguccaggagggauggaaaacuccuggauuuaagc

SEQ ID NO: 127291 - RNA, 64 nt, Human
cacaaguaaaacuaaggcuucagccauaauauggaggagggagcagauguaagcucccaagagc

SEQ ID NO: 127292 - RNA, 64 nt, Human
ugacucugggagggcccggcgcagaggauugaggaggagggaucuggccuccucauggcacugc

SEQ ID NO: 127293 - RNA, 64 nt, Human
aaauagccaaucaucuauugccugagagcacagcaggagggacaaugaucgggauauaaaccca

SEQ ID NO: 127294 - RNA, 64 nt, Human
ugguaaugggaggggggccuggggguauuuauuuaggagggagugugguuuccuuagaagguau

SEQ ID NO: 127295 - RNA, 64 nt, Human
ucugcucccucuuuuucucccuucucuggggcgcaggagggagaaguugcuaagugcugggucu

SEQ ID NO: 127296 - RNA, 64 nt, Human
ugccccaucuccucaucauccccagccuugauggaggagggagggcuucaggacggggcgucag

SEQ ID NO: 127297 - RNA, 64 nt, Human
uaccauguuuuuauauagguucacaccuguacuuaggagggacccuguccaucuauauacuuuu

SEQ ID NO: 127298 - RNA, 64 nt, Human
cagacguagaguaggaaacgugcucuucuaaaugaggagggagaagauaaaggaaacuucuagc

SEQ ID NO: 127299 - RNA, 64 nt, Human
gagggagagaauggcccgagggaggagggagagaaggagggaggcgcuccugggaccgugggcg

SEQ ID NO: 127300 - RNA, 64 nt, Human
gagggagggagggagggagagaauggcccgagggaggagggagagaaggagggaggcgcuccug

SEQ ID NO: 127301 - RNA, 64 nt, Human
augcagggcaagcugggaucggguggcagccggaaggagggagcccuggcaggagagacacucc

SEQ ID NO: 127302 - RNA, 64 nt, Human
guggcagccuccucccuggauccuuagaucccagaggagggaagaaaauuugcagugacugaaa

SEQ ID NO: 127303 - RNA, 64 nt, Human
auuuauggauaucuacaagcugcuucuuaccagcaggagggaaacacacuucacacaacaggcu

SEQ ID NO: 127304 - RNA, 64 nt, Human
agauuggcaagaaaagcagucggacucuaccuuaaggagggaugggaaggaaagaguugaguug

SEQ ID NO: 127305 - RNA, 64 nt, Human
aaucccaaaaauuacuugggggugauugucacagaggagggacagaaaggguaucugcugacca

SEQ ID NO: 127306 - RNA, 64 nt, Human
ccagaaucucggucuuugggguggggagggagggaggagggagguggaguugggauggaguaug

SEQ ID NO: 127307 - RNA, 64 nt, Human
caaauacuuuuaggaaguaaaugaguaggaguuuaggagggauaaacgagauaaauuccaugca

SEQ ID NO: 127308 - RNA, 64 nt, Human
ccuuuuccagcacuaccauuguaagguuuuuuucaggagggagggcuaaccaccuugcuuuucu

SEQ ID NO: 127309 - RNA, 64 nt, Human
agcgggugggcggcggccacgcacugggccacggaggagggaugcugcuccgcccgcuccugcc

SEQ ID NO: 127310 - RNA, 64 nt, Human
uaauauaaaacaucuuuggaggaugggagagaacaggagggaagaugggaaacaaaauagagaa

SEQ ID NO: 127311 - RNA, 64 nt, Human
cauaggaaagccccacggugggucagaaggcggaaggagggaggggaacgugugggcaagagac

SEQ ID NO: 127312 - RNA, 64 nt, Human
ugcaugucgauaagcagagcuguucuuggggagaaggagggaggucucgggaguguagcaccau

SEQ ID NO: 127313 - RNA, 64 nt, Human
ccuccagaaccugacgacugggccaugugacccaaggagggauccuuaccaaguggguuuucac

SEQ ID NO: 127314 - RNA, 64 nt, Human
uguuuuugccaauuaacaguaugugccuugggggaggagggaaagauuagcuuugaacauuccu

SEQ ID NO: 127315 - RNA, 64 nt, Human
caaauauaagaaagcugucaaugaguuucuucaaaggagggaaaacuuucuacgaaucuaagau

SEQ ID NO: 127316 - RNA, 64 nt, Human
ggaaaaggaaccaagaaguagaaggagucccaucaggagggaagauggugggccucagggagga

SEQ ID NO: 127317 - RNA, 64 nt, Human
guggggaacaaaacaauuaacguaagagcuacaaaggagggaaaaggaaccaagaaguagaagg

SEQ ID NO: 127318 - RNA, 64 nt, Human
cuguuguaggcacuuacagcugcguuguuaugaaaggagggaauagcccuuugugucuuugauc

SEQ ID NO: 127319 - RNA, 64 nt, Human
cacacacuuguagccccagcuacuagggaggcugaggagggaggaucucuugugccuaggaguu

SEQ ID NO: 127320 - RNA, 64 nt, Human
uggagggugugcuguagcgggggcgcccggggacaggagggauguccugccgcccccagccagg

SEQ ID NO: 127321 - RNA, 64 nt, Human
uaggcuaucgccccauuccagcggagacuuauguaggagggaccuucccucuaccucccccagu

SEQ ID NO: 127322 - RNA, 64 nt, Human
cagaaagaaccaaagggcagauuagggacggggcaggagggauccuaggauggccagaguaggu

SEQ ID NO: 127323 - RNA, 64 nt, Human
cuuccuucaacuguguucucccuggcauucagagaggagggagaggaggaagaggaaggggagg

SEQ ID NO: 127324 - RNA, 64 nt, Human
uuaaaaaagcaaaauaauaagaaggaaaaauuccaggagggaaaaugaauugucuucacucuuc

SEQ ID NO: 127325 - RNA, 64 nt, Human
augauuuuaaauugugaucgaguuuuaaauugauaggagggaacauguccuaauucuucugucc

SEQ ID NO: 127326 - RNA, 64 nt, Human
gggggaccaggcucgaacugacccuggacaucaaaggagggauuauguggcugcuaaagccauc

SEQ ID NO: 127327 - RNA, 64 nt, Human
agagaaacagggcccauaaccagugggcagcuuuaggagggauggggaucuguuucagaucuag

SEQ ID NO: 127328 - RNA, 64 nt, Human
gcugucggccagagggaauguucuggagcugccaaggagggaggagacucggguuggcuaaucc

SEQ ID NO: 127329 - RNA, 64 nt, Human
ccgccaguguuucucagggaugugacugaggcccaggagggaccugugagggucuguuuacaga

SEQ ID NO: 127330 - RNA, 64 nt, Human
gcacuagcaaagcauucaucccuuuccauauaacaggagggaggggaagaaggaaguuuccaug

SEQ ID NO: 127331 - RNA, 64 nt, Human
cugggaggugggagcuggaauggggagcaaugagaggagggagugagacuguuggcuuaggaag

SEQ ID NO: 127332 - RNA, 64 nt, Human
agcugcccacagcaggccagguccagagagaccgaggagggagagucucccagggagcaugaga

SEQ ID NO: 127333 - RNA, 64 nt, Human
uggaggggggagaaugacuccuuucugaggggugaggagggaagugggguauggaauauggaau

SEQ ID NO: 127334 - RNA, 64 nt, Human
caggcuucacauacagugggaauggaguaauuacaggagggaguuguaggagcuuugaagucag

SEQ ID NO: 127335 - RNA, 64 nt, Human
acguuguucuaaacccccgacgcauaaaguguagaggagggauggccaagggugggugguagaa

SEQ ID NO: 127336 - RNA, 64 nt, Human
acacccagcucugcucagaaaacguccugcguggaggagggaugaugcagaauucugaagucga

SEQ ID NO: 127337 - RNA, 62 nt, Human
agcugagccugcuagacugagugacugcaguuaggagggauccgacagagaagaccauuucc

SEQ ID NO: 127338 - RNA, 64 nt, Human
ggcucuggggaggcugugggccuggagagggaaaaggagggagggggugucugcaccaccuggg

SEQ ID NO: 127339 - RNA, 64 nt, Human
agagaaagcacagaaucccagauccagcuggugaaggagggaaggcuucaggccuuuaagcuca

SEQ ID NO: 127340 - RNA, 64 nt, Human
agagagggucuccaguguuccccccauagagaccaggagggagagccucuguuuuguaaacuaa

SEQ ID NO: 127341 - RNA, 64 nt, Human
ggugggcucucggggaaggugucgggggcccccuaggagggagcgcuggggacauugccauggg

SEQ ID NO: 127342 - RNA, 64 nt, Human
ggagcccccuccccgacucccacuuccagaagcuaggagggagggauaccuggaagacuccggu

SEQ ID NO: 127343 - RNA, 64 nt, Human
ugcccuucugugucugcgugaccucacccagccuaggagggaggugcauucaggguagauuugc

SEQ ID NO: 127344 - RNA, 64 nt, Human
cauccccgagcaccccacccuccaggcuccacuaaggagggaggggcugucugcagcagcugca

SEQ ID NO: 127345 - RNA, 64 nt, Human
cuggggccagacaaagacucggcaaaggggcgagaggagggaacgagcgggcgccgggccacuc

SEQ ID NO: 127346 - RNA, 64 nt, Human
ggcugguguguaggugguaaaaccuguucuccauaggagggaaggagcagucacugggagaggu

SEQ ID NO: 127347 - RNA, 64 nt, Human
caguguagugacacugggguuucugcagucagggaggagggaggguggccaggcugacagcuuu

SEQ ID NO: 127348 - RNA, 64 nt, Human
gauagacaaaaaacaugagugagucguguacauaaggagggaacaugguacagaaggcuagaag

SEQ ID NO: 127349 - RNA, 64 nt, Human
ggucuuuguguuuugcccuguuuuacggugagguaggagggaacccaucuggggaccgguaggu

SEQ ID NO: 127350 - RNA, 64 nt, Human
ugggucagcuguaaccuguuccuauucaucuggaaggagggaggcuuggaugagcaggggauga

SEQ ID NO: 127351 - RNA, 64 nt, Human
uuuaaaguguagcaucuccaggaagaagaggaaaaggagggaaccccggauuggauaugagaca

SEQ ID NO: 127352 - RNA, 64 nt, Human
uguaauuggggagagggagugugccccucggggcaggagggaagggcaucuggggaagggcagg

SEQ ID NO: 127353 - RNA, 64 nt, Human
ucggggcaggagggaagggcaucuggggaagggcaggagggaagagcuguccaugcagccacgc

SEQ ID NO: 127354 - RNA, 64 nt, Human
aacaaaauauuuuuuuaagggaaagaaauguuucaggagggauaaagcuuaccauuaaagcuuu

SEQ ID NO: 127355 - RNA, 64 nt, Human
uuuaauuugccaagaugaagaaaaugaguucucaaggagggaaugcuuugcuugaggccacaca

SEQ ID NO: 127356 - RNA, 64 nt, Human
gaaggccggggaacaacucuaauccuuuuggggcaggagggaggguuuuuuuaggguugcgggg

SEQ ID NO: 127357 - RNA, 64 nt, Human
gagccauuucuacaccaaagcaaaguacggccucaggagggaguaaaaagggugccaucugugu

SEQ ID NO: 127358 - RNA, 64 nt, Human
ccaccuccccacacccauugagucauucacaggcaggagggagacugaucauuccucuggguua

SEQ ID NO: 127359 - RNA, 64 nt, Human
ucuuucucaccuacccccugccgcacagcccagcaggagggaggcggacagccagaugcagagc

SEQ ID NO: 127360 - RNA, 64 nt, Human
ugccgagaaggcauuucuagacccguguuuuuaaaggagggaacuuuggggauugccagccccu

SEQ ID NO: 127361 - RNA, 64 nt, Human
guuuuuucuuuuuuuuuuguuuuucgagggggcaaggagggacagaaaaguaaccucuucuuaa

SEQ ID NO: 127362 - RNA, 64 nt, Human
caagccggaagucccugcagcaccaccuuuggcuaggagggaggggugacagccaaaaagggcu

SEQ ID NO: 127363 - RNA, 64 nt, Human
gucccucuuaacaagaacuccaaagcuggaaagcaggagggaacaaaggugaacaugaaggcga

SEQ ID NO: 127364 - RNA, 64 nt, Human
cuaaaaggcuuccaggcugagagccggccguggaaggagggaugcguguuccagccaaagcaug

SEQ ID NO: 127365 - RNA, 64 nt, Human
gaaugcagcuauuaauagauucccauauuuuaaaaggagggaaaggacaauuuaauauaaauuu

SEQ ID NO: 127366 - RNA, 64 nt, Human
ucccaacacaacuagagugcaauuuuggcaucuuaggagggaaaaaggacaguuuacaacugug

SEQ ID NO: 127367 - RNA, 64 nt, Human
aggaagccauugccauucugagccuugaagggcaaggagggaaacaguguuaccagagcccagu

SEQ ID NO: 127368 - RNA, 64 nt, Human
caaaggaccagugguugcugagaguugaggggaaaggagggauggcagguaggugauuuuuagg

SEQ ID NO: 127369 - RNA, 64 nt, Human
uguuuuccuuuuuuuuuuaauugaggguggggggaggagggagugcgucuguucacuuuaaguu

SEQ ID NO: 127370 - RNA, 64 nt, Human
caaauaggggucucaagugacuucacccuagaagaggagggagggauucugggugggggugacu

SEQ ID NO: 127371 - RNA, 64 nt, Human
gagggcaggaaggagagcugcacauugagaacaaaggagggaccugagguggagagaggcccag

SEQ ID NO: 127372 - RNA, 64 nt, Human
gauuuugcuuaaaacagcacuugccgccagugggaggagggagguuuuauuuauucccacaguu

SEQ ID NO: 127373 - RNA, 64 nt, Human
aacuccuggcagcuuuggcccuggucaugagcagaggagggagggggagaaagggaggaagccu

SEQ ID NO: 127374 - RNA, 64 nt, Human
ucagugagggcggccgggagggcgagcgagggagaggagggagagggggaggggaggaguccag

SEQ ID NO: 127375 - RNA, 64 nt, Human
gccgacccagccacaaguacuggaguagauaacaaggagggaaaagagagggcacugccucagg

SEQ ID NO: 127376 - RNA, 64 nt, Human
uugaauguguacucccauaauucccacauuuuauaggagggauccagugagagauaauuugaau

SEQ ID NO: 127377 - RNA, 64 nt, Human
cuccccacaguggaugccuuagaagggagagggaaggagggaggcaggcauagcaucugaaccc

SEQ ID NO: 127378 - RNA, 64 nt, Human
uugugccauucuugaccuuggaccugcuugguuaaggagggagugggccagaccagagugccag

SEQ ID NO: 127379 - RNA, 64 nt, Human
cugaagauaacuugaagauucuaggcacauuaugaggagggaaacaaaggaggcuucugcagga

SEQ ID NO: 127380 - RNA, 64 nt, Human
ugugaugcugaaggauacugccggcagcaggcagaggagggagggggccuagggcucugaccca

SEQ ID NO: 127381 - RNA, 64 nt, Human
gagccaguucagucacuagugcgccagccaggccaggagggagugcagagcaugucugccaagc

SEQ ID NO: 127382 - RNA, 64 nt, Human
ugaaaaugagaauguccuaagugauucagaagagaggagggaaguugugcacucugaaaaugca

SEQ ID NO: 127383 - RNA, 64 nt, Human
gcaaacugcagcagaaaucgaauuuaaaacaaaaaggagggacuuuaaaauaccuucuugacaa

SEQ ID NO: 127384 - RNA, 64 nt, Human
caccaccagccucggugcucugccccaugcugggaggagggagggagggacaggugccuggagc

SEQ ID NO: 127385 - RNA, 64 nt, Human
auuucuugcugguggucaggaggcauagggaggcaggagggaaggaagcuuuaccuguaaaaug

SEQ ID NO: 127386 - RNA, 64 nt, Human
uguggagacugcuccugagcccccagcuuccagcaggagggacagucucaccauuuccccaggg

SEQ ID NO: 127387 - RNA, 64 nt, Human
uguaguuuuuaauguggggguagagugggucagcaggagggagcugguuuuaugugagcagaug

SEQ ID NO: 127388 - RNA, 64 nt, Human
gagcgagcaugugugugugugugcgcgugugcagaggagggaguggugugccuguuugugugug

SEQ ID NO: 127389 - RNA, 64 nt, Human
gagacggcuguguagcgggccgcccacgggcagcaggagggacaaugcggccaggggacgagcg

SEQ ID NO: 127390 - RNA, 64 nt, Human
ugucugcaggcugucucuccaggcacggggugucaggagggagagacagccuggguaugggcaa

SEQ ID NO: 127391 - RNA, 64 nt, Human
guggcugcgagagagaaugagccucccgccagacaggagggaggugcguguggauguauguggu

SEQ ID NO: 127392 - RNA, 64 nt, Human
uuuucucuguguuguagucucucauauuuacucaaggagggaccaggaugauacagucaucuga

SEQ ID NO: 127393 - RNA, 64 nt, Human
ggagggcgccuaguccccccagcucuaagcagccaggagggaccugcaucuaagcaucuggguu

SEQ ID NO: 127394 - RNA, 64 nt, Human
caugcccuguggaucaagucuagggggccucaggaggagggagguggguguuggagccccugag

SEQ ID NO: 127395 - RNA, 56 nt, Human
ugaugcucucccgccacugaggcuccaggagggaauaucuguugccccugcggccc

SEQ ID NO: 127396 - RNA, 64 nt, Human
gacccaguccaaggagucaggaaagagcucucugaggagggagcaucugagccagauguugagg

SEQ ID NO: 127397 - RNA, 64 nt, Human
ggauauuccucggaaaaacagacuuugggaaugaaggagggacucaggaucauuguuaucagug

SEQ ID NO: 127398 - RNA, 64 nt, Human
ccucuuaacagcuuggggaggugaccagugguucaggagggacuagacaauuaccuguccagug

SEQ ID NO: 127399 - RNA, 64 nt, Human
guuccuggauguucauaucuaguguuugaaggggaggagggauuuaaacugguccuguacauag

SEQ ID NO: 127400 - RNA, 64 nt, Human
agagggaagaaaagagcuuucuucccgaaccccaaggagggagauggaucaaucaaacccggcg

SEQ ID NO: 127401 - RNA, 64 nt, Human
ugaugccuucucugugagcaguggcucugugggaaggagggagccgggagccuggugggaagcc

SEQ ID NO: 127402 - RNA, 64 nt, Human
gugcccuguggcaccccagcucacugggagucucaggagggauaaccggauuucugcucuuucc

SEQ ID NO: 127403 - RNA, 64 nt, Human
guuguuguuguuguuguuuauuugauuuugaguuaggagggauaauagagaaguccauuuaaaa

SEQ ID NO: 127404 - RNA, 64 nt, Human
uugcagggcauuuguuuuuaaugugguuuucuuuaggagggagagguuguuuuuguuuuguuuu

SEQ ID NO: 127405 - RNA, 64 nt, Human
aguuucucagcuccuuugacagacauucaagggcaggagggagccccaaagcauaaccaguggc

SEQ ID NO: 127406 - RNA, 64 nt, Human
ucugggaaaaacaacgaaacuuucccuuguggagaggagggauuuuccugcucuauauaagcaa

SEQ ID NO: 127407 - RNA, 64 nt, Human
caagcacagccacugugacggggaguccaggcgcaggagggacccggggccacaaggcgcugcg

SEQ ID NO: 127408 - RNA, 64 nt, Human
aucuuaagccauuguaugggggggauuaggaaguaggagggauuguccuacaacaggcccuuau

SEQ ID NO: 127409 - RNA, 64 nt, Human
gcagcaucuggugggcccggggcugcuggggccaaggagggaccuugaccuucuggugccugcc

SEQ ID NO: 127410 - RNA, 64 nt, Human
cuuuguuuaacuccuuuaccuuuccagcccuuugaggagggaccaugagaacagaaauuaccuu

SEQ ID NO: 127411 - RNA, 64 nt, Human
uggugaacagagagaaccaggaggguaacagaagaggagggaccuacugaacccagagucagga

SEQ ID NO: 127412 - RNA, 64 nt, Human
agacccaaagugggggguggacacagaagucccuaggagggaaggagcuguuggggcaggggug

SEQ ID NO: 127413 - RNA, 64 nt, Human
cugucuaggguggaacagaaggacagauggacccaggagggagggcagcugaguaacuggguaa

SEQ ID NO: 127414 - RNA, 64 nt, Human
cuggucuuuccaguuuagaaaaggcucugugccaaggagggaccacaggagcugggaccugccu

SEQ ID NO: 127415 - RNA, 55 nt, Human
uaggggccuacaccuucugaggagcaggagggagccacccucccugcagcuaccc

SEQ ID NO: 127416 - RNA, 64 nt, Human
gguucucucagggcuucgccuucaaggguucuggaggagggaagggucugcagguuccaugggu

SEQ ID NO: 127417 - RNA, 64 nt, Human
agcccacaagauggguguuauucucauuuuacagaggagggaggggagacgcgaagggauugcc

SEQ ID NO: 127418 - RNA, 64 nt, Human
ggagaggagcugccuuuccacccccuucaaggcaaggagggauggaggucccuuauuuccuuca

SEQ ID NO: 127419 - RNA, 64 nt, Human
ggcccuggggagaagcaggaugggauugaugggcaggagggauccccgcacugggagacaggcc

SEQ ID NO: 127420 - RNA, 64 nt, Human
uaaucagaucauguuggcuacauaaggaaacagaaggagggauuucaggagaggcuggcuccuc

SEQ ID NO: 127421 - RNA, 64 nt, Human
uuguugcugauucaagaaacagaaguagaagaggaggagggauucuggucuucacugccaugcc

SEQ ID NO: 127422 - RNA, 64 nt, Human
aauccuugggggugcaggguggagcagaaagugaaggagggacacgugcaagaguggugugcau

SEQ ID NO: 127423 - RNA, 64 nt, Human
gguggggacaggccagugacgaagagagggacagaggagggaugggaacaggcugugcaucuua

SEQ ID NO: 127424 - RNA, 58 nt, Human
caguucuugcauuggcauaaugaggagcaggagggaaaaggccuuuacuagauucuug

SEQ ID NO: 127425 - RNA, 64 nt, Human
acugauuuuuugaugcccugucuucugggccccuaggagggaugagagaggaguagcccccuuu

SEQ ID NO: 127426 - RNA, 64 nt, Human
auucucacucguauuucccaccccuaguggccagaggagggaggggcacagugaagaagggagc

SEQ ID NO: 127427 - RNA, 64 nt, Human
gucaagaaaagggaucugagaaaaguacucuuucaggagggacuagaaagagaagggggugaua

SEQ ID NO: 127428 - RNA, 64 nt, Human
gaaagagggggcaggggcugcugggacacugagcaggagggaggccugagcacacugcuuugga

SEQ ID NO: 127429 - RNA, 64 nt, Human
cauucccuaacucccuccugccccuggucugaggaggagggacucuggaguagcagaggggcug

SEQ ID NO: 127430 - RNA, 64 nt, Human
gugggcaaggugggaccuccugcagccuggaaagaggagggaggccaaggccauucccuaacuc

SEQ ID NO: 127431 - RNA, 64 nt, Human
uggaaauauuuacugucuguccaccacggccuggaggagggagguugugguuggauggaggaga

SEQ ID NO: 127432 - RNA, 64 nt, Human
cagccuugcucagcuguggguugcccugcugggaaggagggaaucacguccaccugggucccaa

SEQ ID NO: 127433 - RNA, 64 nt, Human
ugcaaagcaaugaacucaagaaggaauugaaauaaggagggacaugauggggaaggaguacaaa

SEQ ID NO: 127434 - RNA, 64 nt, Human
ccucccccuuuguuugccccugugugguuggucaaggagggaugugagggaaauagggaccccc

SEQ ID NO: 127435 - RNA, 64 nt, Human
guccugacccucagaucugucauguaucccuaaaaggagggagcuggccacuggcuguugggaa

SEQ ID NO: 127436 - RNA, 64 nt, Human
ucacauugcaacaccagcuucuaaggauuuuuuaaggagggaauauauauguguguguguauau

SEQ ID NO: 127437 - RNA, 64 nt, Human
gcuguugaauaagcccuaagggugguaggaacccaggagggacccaggaaacuaagauuugaga

SEQ ID NO: 127438 - RNA, 64 nt, Human
cuccaacccagcaguucucugccaaagcuuguggaggagggagagcccugucccugcccucagg

SEQ ID NO: 127439 - RNA, 64 nt, Human
caacccuaucccuccuaccucacccgcagggggaaggagggaggcugacaagccuugaauaaaa

SEQ ID NO: 127440 - RNA, 64 nt, Human
auuaagggcccugggggagaauaaagcucagagcaggagggaguaaggaaacauuuccuuuuug

SEQ ID NO: 127441 - RNA, 64 nt, Human
gccugcaucuuuggcucugcugugaucugauuggaggagggacaguuucugguacccauccucu

SEQ ID NO: 127442 - RNA, 64 nt, Human
gaaugaaugaagaauuauuuccucauuuggaaguaggagggacugaagaaauucuccccaggca

SEQ ID NO: 127443 - RNA, 64 nt, Human
aaaacacgccccuacagaagugcacuuccuugagaggagggaaugaccucauucucuguccaga

SEQ ID NO: 127444 - RNA, 64 nt, Human
ucuggucccuuuaaagagcaauccuggaagaagcaggagggaggguggcuuugcuguuguuggg

SEQ ID NO: 127445 - RNA, 64 nt, Human
agagcuaggagcaaagccuguucauggcagauguaggagggacugucgcugcuucgugggauac

SEQ ID NO: 127446 - RNA, 64 nt, Human
ccacccugaggagucugagguccugagcacugccaggagggacaaaggagccugugaacccagg

SEQ ID NO: 127447 - RNA, 64 nt, Human
cucuccacagccccaucaaagaacagagaggaggaggagggagaaauggccaccacaucacccc

SEQ ID NO: 127448 - RNA, 64 nt, Human
uuccacacgagugggauucuggccuucagagaccaggagggagugucugggccgcagguguggc

SEQ ID NO: 127449 - RNA, 64 nt, Human
cuuaggagagaccgagugaaccuaccuucauuucaggagggauuggccgcuuggcacaugacaa

SEQ ID NO: 127450 - RNA, 64 nt, Human; identical to SEQ ID NO: 127449

SEQ ID NO: 127451 - RNA, 64 nt, Human
cacacgcucauaguucuagcugcuugggagguugaggagggaggauggcuugaacacagguguu

SEQ ID NO: 127452 - RNA, 50 nt, Human
ugaaacuugauauaaaaugaaggagggagaugacggacuagaagacugua

SEQ ID NO: 127453 - RNA, 64 nt, Human
auuucuaagguaucagugacacuugaguuuuccuaggagggacaucaauaacagcccccuaaag

SEQ ID NO: 127454 - RNA, 64 nt, Human
guugcacaggagugggauggggugugguagcaaaaggagggagaggaguccuuuuugugccaaa

SEQ ID NO: 127455 - RNA, 64 nt, Human
ccccagccaggugucccuccuaugcacagagcagaggagggagaagcucuggggagccagcuuu

SEQ ID NO: 127456 - RNA, 64 nt, Human
cauaggagggcaggguaggguagggccucugaggaggagggaaaaagugaaggagaggcuuugg

SEQ ID NO: 127457 - RNA, 64 nt, Human
gcuuauucagggcugagugccaaaagcuugggggaggagggacagguccucggcaauaaacagu

SEQ ID NO: 127458 - RNA, 64 nt, Human
uucaaacuggaaagucaccuggucgagucuagggaggagggaguggaagggucucugcuucugu

SEQ ID NO: 127459 - RNA, 64 nt, Human
ggaccccaggaaccccagggcacuccacugcagcaggagggacuuaagcuagacucaagaaagc

SEQ ID NO: 127460 - RNA, 50 nt, Human
cagacagucccacucucugaaggagggagggacacuuacccaaggcucuu

SEQ ID NO: 127461 - RNA, 64 nt, Human
uccguuuacucuguuuacacauuuugcacuugggaggagggaggcuaaggcuggguccuccccu

SEQ ID NO: 127462 - RNA, 64 nt, Human
guuuuugauuuucccagguagugggagagaggaaaggagggaaggcaagauucuuucccccucc

SEQ ID NO: 127463 - RNA, 64 nt, Human
agcuacaagucuaucuucuuucuugacccauuucaggagggagcccucuccuuuauccugauau

SEQ ID NO: 127464 - RNA, 64 nt, Human
ucagaaaugcagacaccccagacgagagccucacaggagggagggggccccacaggcuccccag

SEQ ID NO: 127465 - RNA, 64 nt, Human
aaagaaaaccauuuucagggagcucagacgucacaggagggagcgggagcaggauguggcccug

SEQ ID NO: 127466 - RNA, 64 nt, Human
ccuggggccucccuucgaggagcccucugaugugaggagggacuugaguugagugacgcugugg

SEQ ID NO: 127467 - RNA, 64 nt, Human
uacgcauccucaagaauccacugcuuuucaggcaaggagggagaaauccugcugcacacuggcu

SEQ ID NO: 127468 - RNA, 64 nt, Human
uuagcuuaugcuucuuuagauggaauaaugggaaaggagggaaaugggaaauggauggaaaugg

SEQ ID NO: 127469 - RNA, 64 nt, Human
aaggagggaaaugggaaauggauggaaaugggaaaggagggaaaauaauagcccagugagagcu

SEQ ID NO: 127470 - RNA, 64 nt, Human
gcaggaaaccggcuagaugaccaucacacagcaaaggagggaguggaagagagaugagaaaauu

SEQ ID NO: 127471 - RNA, 64 nt, Human
ccuggcugggggucugcgccacaguuugguccagaggagggaggaggaagggaagaccccagug

SEQ ID NO: 127472 - RNA, 64 nt, Human
cacaccaguggccucugggcauucggcucaacgcaggagggacauucugcuggcccacccugcg

SEQ ID NO: 127473 - RNA, 64 nt, Human
ucaggagacagaaggcccaugcugaugggggaggaggagggaugugggcauuuuggacaccagg

SEQ ID NO: 127474 - RNA, 64 nt, Human
agauuacuuagcacacuguggaaguuuaaguggaaggagggaauuuaaaaaugggacuugagug

SEQ ID NO: 127475 - RNA, 64 nt, Human
gcauuuuucggacacuggaaacauuuaaaugaucaggagggaguaacagaaagagcaaggcugu

SEQ ID NO: 127476 - RNA, 64 nt, Human
guggaaggggggagaaucccauaacuaacugcugaggagggaccugcuuuggggaguaggggaa

SEQ ID NO: 127477 - RNA, 64 nt, Human
gcugccuuggagggcugggggaaggaguguguggaggagggaggagggugaagacugaggcuag

SEQ ID NO: 127478 - RNA, 64 nt, Human
ucucugugggcuugggauguuaacaggagccaaaaggagggaaagugugaagaauaaaguagau

SEQ ID NO: 127479 - RNA, 64 nt, Human
ccuugaugcccagcucagugccacaaagcucaauaggagggauguuccaguggaugagggccac

SEQ ID NO: 127480 - RNA, 64 nt, Human
uuuauugaagaaaugaaaggugacaaaaggcagaaggagggagaccccaaaaagagguaaauuu

SEQ ID NO: 127481 - RNA, 64 nt, Human
cgauagcugaucgugugcacgcaaggaaagaaccaggagggagagugcagccaggcucagggau

SEQ ID NO: 127482 - RNA, 64 nt, Human
agagcuguccaaccaagagagcgggagggagggaaggagggagggagagagauagagagagaga

SEQ ID NO: 127483 - RNA, 64 nt, Human
ucuaguuuugagagacuuccucuuggcucccaggaggagggauuuccugacuuugacacacaug

SEQ ID NO: 127484 - RNA, 64 nt, Human
uccccagugaccugcgaaaguggagcaucgagguaggagggaaacggcaaccagggaguccucg

SEQ ID NO: 127485 - RNA, 64 nt, Human
aguucaaggaugcacuguauagccaggcugugggaggagggaggaaagaugaaaaaccacuuaa

SEQ ID NO: 127486 - RNA, 64 nt, Human
cacuugcuuaauugcauuucuggcagggaaggagaggagggauggagaagcucugcucgcugcu

SEQ ID NO: 127487 - RNA, 64 nt, Human
ccuggcucagcugggcugcaggaugcccacuuugaggagggaggcacagggcuugggcgagggg

SEQ ID NO: 127488 - RNA, 64 nt, Human
gcucccugucagagcuggaucaggccccccaucgaggagggagggcagacggaggcccgagagc

SEQ ID NO: 127489 - RNA, 64 nt, Human
cguuuuucauaugcaacgugcugcucucaggaggaggagggaauggcaggaaccggacagacug

SEQ ID NO: 127490 - RNA, 64 nt, Human
gcacccacgggugugcuggauacuggaguuugagaggagggaggugcuggggccaaaggagaca

SEQ ID NO: 127491 - RNA, 64 nt, Human
acucagguucgcccucugggccagguccuucacgaggagggagcuacccuucgccagaaguuug

SEQ ID NO: 127492 - RNA, 64 nt, Human
guuagaugcuguuaaaagaggaggaaacuacuugaggagggacccaacuuuccgcuaucuuuug

SEQ ID NO: 127493 - RNA, 64 nt, Human
gacaacucagauuaucugaagacacaaaccugacaggagggagaagaaaaaacaaaacacuuga

SEQ ID NO: 127494 - RNA, 64 nt, Human
gugagaaugagaacugcugugauagggagagugaaggagggauaugugguagagcacuugauuu

SEQ ID NO: 127495 - RNA, 64 nt, Human
gguacuuuauucuugcugggcauacuuucucucuaggagggagccuugugagauccuucacagg

SEQ ID NO: 127496 - RNA, 64 nt, Human
ccuuagguauacccuggaagagcuggggugggggaggagggagcgugaagguagugacuccuga

SEQ ID NO: 127497 - RNA, 64 nt, Human
caccagcucuccuuccugccuuuagauccugagaaggagggaaaugaggggugcugacacaguc

SEQ ID NO: 127498 - RNA, 64 nt, Human
ucccuuccccauggggaguacacuuggguguucuaggagggaugcagucuauccaugcacuugg

SEQ ID NO: 127499 - RNA, 64 nt, Human
cugaugagaagcguccguccucgagccaggcgggaggagggaguggagagacugacuggccgug

SEQ ID NO: 127500 - RNA, 64 nt, Human
uagcuccuugggacacaaacaagaaauguggacaaggagggacauuugcauacuccuacugucu

SEQ ID NO: 127501 - RNA, 64 nt, Human
cuaacugcccacucugauaugccugggugagccuaggagggaaggcucugauuuggauuucucc

SEQ ID NO: 127502 - RNA, 64 nt, Human
cuugaucuguucugucuuguggcagggcucuaccaggagggagugagaucuggggacacagugg

SEQ ID NO: 127503 - RNA, 64 nt, Human
ggcuuaggaugcaguauauggggccgcauuuaaaaggagggaaagauuguuuggugcuggaaca

SEQ ID NO: 127504 - RNA, 64 nt, Human
uaauacucagcacuagagggagggagggggagggaggagggagcaggcaggucccaaaugcaaa

SEQ ID NO: 127505 - RNA, 64 nt, Human
ugaaugccuuggagggaucccaggaagccccaguaggagggagcuucagacaguucaauucugg

SEQ ID NO: 127506 - RNA, 64 nt, Human
cuucaaauaaaagucugcagaguuuuuuuuaaauaggagggaaaaucuuauuuucuaauauguc

SEQ ID NO: 127507 - RNA, 64 nt, Human
gaaaucgugguucuuccccgagggugcauguugcaggagggagagggcagggaagacucacagc

SEQ ID NO: 127508 - RNA, 64 nt, Human
gcacugaggggcugggugcuggggaggggcugguaggagggagggugggcccacugcuuuggag

SEQ ID NO: 127509 - RNA, 64 nt, Human
uucucuccccauccacaauggagaaggugaaaagaggagggaaaggccuuugguguggacaagc

SEQ ID NO: 127510 - RNA, 64 nt, Human
uggaggacucaagggauguaagggauauggcuugaggagggaugggggcaggaaugagggaagg

SEQ ID NO: 127511 - RNA, 64 nt, Human
ucccggagcucugagcacgccccacgcauggugcaggagggacuggacagaucugaggaaggcc

SEQ ID NO: 127512 - RNA, 64 nt, Human
aggacacguggugggggccacugaaaccaggccuaggagggagaacaaguuccaaaggugccga

SEQ ID NO: 127513 - RNA, 64 nt, Human
auggugccaggggucucccuccgccaccuaggaaaggagggagaugugcgugucaaauauucau

SEQ ID NO: 127514 - RNA, 64 nt, Human
cugggaacaccauaggucaccuuuauucuggcagaggagggagcaucagugcccuccaggauag

SEQ ID NO: 127515 - RNA, 64 nt, Human
gggauuaauaugaaaacuuaugaccucuuccuuuaggagggaguuaucuaaaagaaaugucuau

SEQ ID NO: 127516 - RNA, 64 nt, Human
guuucucugaauccuuuccugagagguggugggcaggagggaggagugagacuuaucagauggg

SEQ ID NO: 127517 - RNA, 64 nt, Human
ccucagugucuugcuucugccagcuccuuccccuaggagggaagggugggguggaacugggcac

SEQ ID NO: 127518 - RNA, 64 nt, Human
aggggaauggaagagaaaagacagggugggagggaggagggagugcuguguuuuagucucuuaa

SEQ ID NO: 127519 - RNA, 64 nt, Human
auccagagccguggcugcaaauccagcaggaauaaggagggacaaccacagccuccucauccau

SEQ ID NO: 127520 - RNA, 64 nt, Human
ggacucaggcaagccuuuguggcuggaucaugagaggagggacuccaucuugagccaugucccc

SEQ ID NO: 127521 - RNA, 64 nt, Human
aucaacugcuauccuuccccucaccccucagcccaggagggaaagggcauuuucuuuuucaucu

SEQ ID NO: 127522 - RNA, 64 nt, Human
gcacuggagggcgcaucaaagaagaguccuacccaggagggagagcgcagcugcugcaggauuc

SEQ ID NO: 127523 - RNA, 64 nt, Human
gggcugcacuccuuucucuccaaccagggcagaaaggagggaggauucgucccauuacaauaau

SEQ ID NO: 127524 - RNA, 64 nt, Human
caacucccucacgagguggggcucaggcuggaggaggagggauuaagauccccuugcuccacua

SEQ ID NO: 127525 - RNA, 64 nt, Human
uucaggccuguaauuccagcacuuugggaggccgaggagggaggaucaccugaggucaggaguu

SEQ ID NO: 127526 - RNA, 64 nt, Human
aucuuccaguggccagcacacccuagacaccccgaggagggagggcuccuuucuagccugcccc

SEQ ID NO: 127527 - RNA, 64 nt, Human
ccgucccacagcaucuccuagaagcagccggcacaggagggaagguggccaggcucgaagcagu

SEQ ID NO: 127528 - RNA, 64 nt, Human
aaacacaguagcaaauugcuucaggaguugagacaggagggagcuugcugucucggccuucuuu

SEQ ID NO: 127529 - RNA, 64 nt, Human
cucucugcuaccuggacguucauucuuauguauuaggagggaggcugcgcuccuucagacuugc

SEQ ID NO: 127530 - RNA, 64 nt, Human
aaacacaguagcaaauugcuucaggaguugagacaggagggagcuugcugucuuggccuucuuu

SEQ ID NO: 127531 - RNA, 64 nt, Human
cccccagccagagcaagcuuggggcaccaugcccaggagggaagaagccauccacagccuuccc

SEQ ID NO: 127532 - RNA, 64 nt, Human
gugauggcgagaguaacugagcucugccacccccaggagggacccuugauacauguacaaagca

SEQ ID NO: 127533 - RNA, 64 nt, Human
uuuuuaagcaaauuacuuacuguauuuuuauggcaggagggagaaaaaguguuacaacgguuuc

SEQ ID NO: 127534 - RNA, 64 nt, Human
ccccgaccuugcugacuaggcacaugggacgcaaaggagggagggaagcaaggccuugccuggc

SEQ ID NO: 127535 - RNA, 64 nt, Human
aggcuggagcuuguuccugccccaggaauaggccaggagggaaggccgcagcaggacugccgug

SEQ ID NO: 127536 - RNA, 64 nt, Human
gugaggagacgcguagggauggugaggaggggagaggagggagaccugcuggugcccuugcacc

SEQ ID NO: 127537 - RNA, 64 nt, Human
gcugccaggcacugcuuguaucccugcugauaagaggagggagucacuccaggaauaagacaaa

SEQ ID NO: 127538 - RNA, 63 nt, Human
gccagcuggcagccgccugaggguggugaccccaggagggaggcaggggaggggugcggcggu

SEQ ID NO: 127539 - RNA, 64 nt, Human
cugguacaucgagaagauuccuguggaucccgucaggagggacuuaguggcucugccgccagug

SEQ ID NO: 127540 - RNA, 64 nt, Human
gcugcccaggacugcugcugagccccaggggcggaggagggagcgcccuguccacccgggcggg

SEQ ID NO: 127541 - RNA, 64 nt, Human
auggaacuggccacgcacaggcucuggcucuggaaggagggaugaugagugggcguuuucccgg

SEQ ID NO: 127542 - RNA, 64 nt, Human
aggcucagaggguguccugcaccggggccugggcaggagggaggugcuucuaguucugccagga

SEQ ID NO: 127543 - RNA, 64 nt, Human
uugggcuuuggaugcagcuugaaccaagaaaacgaggagggaaagggauucagugaacuauucc

SEQ ID NO: 127544 - RNA, 64 nt, Human
uuuucuggaaggggacagugaaaagaggagugacaggagggaaagggggagacaaaacuccuac

SEQ ID NO: 127545 - RNA, 64 nt, Human
ccgaggcugcugagacccuuagaucuuugggccuaggagggagucagagagggggaugucugaa

SEQ ID NO: 127546 - RNA, 64 nt, Human
agccuggaaaagauggggaaccugcuagugaacuaggagggagacuuccauagccucagacuug

SEQ ID NO: 127547 - RNA, 64 nt, Human
uuugaagccuguuaagagguagcaagggggcuagaggagggagauuccaccuccccucccaagu

SEQ ID NO: 127548 - RNA, 64 nt, Human
caggcccugcucagaggucagagggucugggcagaggagggaccacauuccccugccuugcccc

SEQ ID NO: 127549 - RNA, 64 nt, Human
cuuugcagccuggccagcagcucagagugcaccgaggagggaaggauggcuaagcugggaccgg

SEQ ID NO: 127550 - RNA, 64 nt, Human
uggggagagggaugcuauuuauucaguuuggggcaggagggagaggagggaaaguauuucugac

SEQ ID NO: 127551 - RNA, 64 nt, Human
ggaugcuauuuauucaguuuggggcaggagggagaggagggaaaguauuucugacccugaugcc

SEQ ID NO: 127552 - RNA, 64 nt, Human
agaccugggguggugggcaucuggcugaaccuugaggagggaaagcuugccuucuauucagugg

SEQ ID NO: 127553 - RNA, 64 nt, Human
ccuugagaaucuccaagagaaaaauauuuggggaaggagggaggaaauaugucccuugcacacc

SEQ ID NO: 127554 - RNA, 64 nt, Human
gaagcugcgagggcccagugaacuuggugggcccaggagggaacaggagccugagccagggcaa

SEQ ID NO: 127555 - RNA, 64 nt, Human
cuugaaucaauguugaggugaaaaaggaaaugucaggagggauaagacagggugaggcccugcu

SEQ ID NO: 127556 - RNA, 64 nt, Human
aauaggggccguuuucuuacacacccccagagagaggagggacugucacacuggugcugaguga

SEQ ID NO: 127557 - RNA, 64 nt, Human
ccacacuccugcuuuuugggauaucuaacugcuaaggagggaguugacaucccccuucuggcuc

SEQ ID NO: 127558 - RNA, 64 nt, Human
ccagugccgaguggaaugccugguuugggggaggaggagggacuggguucagcuguggugcuuu

SEQ ID NO: 127559 - RNA, 64 nt, Human
ggaagggaagguggcagaaagucucauuucaggaaggagggauagaaggaaggaaggaaggaac

SEQ ID NO: 127560 - RNA, 64 nt, Human
auguccugugacugccccacagagauaaggggccaggagggauugaaaggcaucccaguucuaa

SEQ ID NO: 127561 - RNA, 64 nt, Human
gcaggcagggaaggggguaguaaaggacugagagaggagggagguggcuggagaaggaaaagga

SEQ ID NO: 127562 - RNA, 64 nt, Human
ggguauuuuuaaaggguuuuuuuuucccuucaagaggagggaaaaugcaaccaguagcaucucu

SEQ ID NO: 127563 - RNA, 64 nt, Human
aggguuugggugcauccagaaauaugccugcaguaggagggagaggaaggggugccaccgucaa

SEQ ID NO: 127564 - RNA, 64 nt, Human
agggaucucucuugcacgggccuugccaaggcccaggagggacuugggcaguauguucaugugg

SEQ ID NO: 127565 - RNA, 64 nt, Human
acccagugucccaggccacaggagcuuauuggccaggagggaauaaugucccccaauacugccu

SEQ ID NO: 127566 - RNA, 64 nt, Human
uuuaagugcugguucccccgaauauuuuaugcagaggagggaaaauuuauaguggcaauuauuu

SEQ ID NO: 127567 - RNA, 64 nt, Human
acuggaaacccugagaauguuucugcagugggacaggagggacgucuucccaugccuucccuag

SEQ ID NO: 127568 - RNA, 64 nt, Human
ugugugacccagcaagggcccugugugggacagcaggagggaggcgucgggggccuuagcagaa

SEQ ID NO: 127569 - RNA, 64 nt, Human
cucuggaccucaggagggcaggcugagguggggaaggagggacuuggcuguccuuccccuuccc

SEQ ID NO: 127570 - RNA, 64 nt, Human
ccaggugcuuauuggacauccuucgagggggaagaggagggaagcggccagcucacccuuccgg

SEQ ID NO: 127571 - RNA, 64 nt, Human
gcccuccggaucccauccaggcgcaaagaggaauaggagggacauggaaccauuugccucuggc

SEQ ID NO: 127572 - RNA, 64 nt, Human
uggccuauucugggcuagaccagauuugggggccaggagggaagaacuccauaugggauggaga

SEQ ID NO: 127573 - RNA, 64 nt, Human
ccaggugcauaaaugggggucagggagggaaaggaggagggagagagauggagaggaggggaga

SEQ ID NO: 127574 - RNA, 64 nt, Human
ccauugccauuucuggccucgcuaggcccaggagaggagggaggcaagccagucggguuuccug

SEQ ID NO: 127575 - RNA, 64 nt, Human
cccauuucucaacauagcacacuugugcacugagaggagggagcauuaugggaaagucccugcc

SEQ ID NO: 127576 - RNA, 64 nt, Human
aguccugggucugaggcacaugagcguguuggguaggagggaagcaaaaaggauggccauguau

SEQ ID NO: 127577 - RNA, 64 nt, Human
gauauccaguaaugaucaaggccucagagggaggaggagggaagggaauuagaaaagucaacaa

SEQ ID NO: 127578 - RNA, 64 nt, Human
ggucccagaagggggcagcagcaggcugggaguuaggagggagagcagggugccggcccugcca

SEQ ID NO: 127579 - RNA, 64 nt, Human
gacaguacucuccaguucuggggccccccgagugaggagggaacgggaagucggugccuugguu

SEQ ID NO: 127580 - RNA, 64 nt, Human
uuuaacugcugugaacucacuuugaggggguaggaggagggagaaacagccuguguuuuuuaug

SEQ ID NO: 127581 - RNA, 64 nt, Human
uuugauucugaucauggggugggggagagaggaaaggagggaggggagaagcccagcagaagcu

SEQ ID NO: 127582 - RNA, 64 nt, Human
accaaaguugccauuuuggagauggaaauugacgaggagggaaggucuuuuauuggagaguaua

SEQ ID NO: 127583 - RNA, 64 nt, Human
agagucuagacagacggcacaggccuaggagacuaggagggaaucuggagggggcgcuggagga

SEQ ID NO: 127584 - RNA, 64 nt, Human
caagaugaggcaccaggaaaggggugguagucagaggagggaggaggaauaaggggaaggaaga

SEQ ID NO: 127585 - RNA, 64 nt, Human
uauuuaaaugaaaggaguuuaaaaacauuuuuuaaggagggagaaaggagaaauuuugguuuuu

SEQ ID NO: 127586 - RNA, 64 nt, Human
uauauucauguuugaaaugaaugcuuugaaccacaggagggagauguugucaaaugcuacagug

SEQ ID NO: 127587 - RNA, 64 nt, Human
caaagguucugcaggggaaucuggagcuacacacaggagggaucagcuccugggugugucagag

SEQ ID NO: 127588 - RNA, 64 nt, Human
gcccagcaguggcugcuggggaagcagcugcagcaggagggagacggucuugccucucagcccc

SEQ ID NO: 127589 - RNA, 64 nt, Human
agagauuccagggccagcaaagccggcguucagaaggagggagaaaaccgugagaggaugugug

SEQ ID NO: 127590 - RNA, 64 nt, Human
aguuagauaucuucuuuugcccggauugauggggaggagggauuaaaagagucaggaagaagac

SEQ ID NO: 127591 - RNA, 64 nt, Human
uugaaacucaagcacagcugcgaggagggcagcgaggagggaccccucucucaugguugucucu

SEQ ID NO: 127592 - RNA, 64 nt, Human
uucuaucuccccgucacacccgaggccuggcuucaggagggagcggagcagccauucuccaggc

SEQ ID NO: 127593 - RNA, 64 nt, Human
agcccccaguguccugacuucugucugccacaugaggagggaggcccugccugugugggagggu

SEQ ID NO: 127594 - RNA, 64 nt, Human
uugccacagaggcuccgucugacugugggcugggaggagggaggcaggggagagccggucacgg

SEQ ID NO: 127595 - RNA, 64 nt, Human
ccuuccauuaaguguucaagcaugucugcaaauuaggagggaguuagaaacagucuuuuucauc

SEQ ID NO: 127596 - RNA, 64 nt, Human
uggggaguagaaaagaagauccccauugacagugaggagggaggguggcuggaguugucacugc

SEQ ID NO: 127597 - RNA, 64 nt, Human
uuuuuaauauuacuuauagcugagucagaauuaaaggagggaauuguauugauacuccaauacc

SEQ ID NO: 127598 - RNA, 64 nt, Human
ucggcagaucugcaaggcuggcuuuaagagcacaaggagggaaaguaacgaaagggcuggacua

SEQ ID NO: 127599 - RNA, 64 nt, Human
auauauuuuuauuuuuuaguaauuuaggggagggaggagggagaaagggauaaugaugcccuug

SEQ ID NO: 127600 - RNA, 64 nt, Human
ucucaguggggguucaccacaaaacacgggccccaggagggaagcgcugucuaggcacacggca

SEQ ID NO: 127601 - RNA, 64 nt, Human
agccccgggcggagccuucccgggcgggcgugggaggagggaggcggccuccaugcacuuuaug

SEQ ID NO: 127602 - RNA, 64 nt, Human
cugaguucacccccagggcuggccagauggggccaggagggacagagcaaggggggugaaggcc

SEQ ID NO: 127603 - RNA, 64 nt, Human
uucgucuaccugguggcagggucugagcgggaggaggagggaaagaguguguucugagcuggac

SEQ ID NO: 127604 - RNA, 64 nt, Human
ugugugcccaggugggggugucuccuggcugggaaggagggaaagggagggagaguuuugcggg

SEQ ID NO: 127605 - RNA, 64 nt, Human
ggggaccgcccgugucuaagcaugugcaaaggagaggagggagaugaggucauuguuugucauu

SEQ ID NO: 127606 - RNA, 64 nt, Human
aggcuguggccccgagcuggcggagggagggaagaggagggagugacgggaggggaggagguca

SEQ ID NO: 127607 - RNA, 64 nt, Human
ccuccacccucccucccugaucccgugugccaccaggagggaguggcagcuauagucuggcacc

SEQ ID NO: 127608 - RNA, 64 nt, Human
ggaucaaaugcuguaaugguggaggugugggcagaggagggaggcaaguguccuuugaaaguug

SEQ ID NO: 127609 - RNA, 64 nt, Human
caugucauccucagggcgcuuccucgcucacgccaggagggacuuggaguggcgagcuggggcc

SEQ ID NO: 127610 - RNA, 64 nt, Human
gcuccgggaagcaggcacuggggagggggcuucaaggagggagugcccccucagacucccugcu

SEQ ID NO: 127611 - RNA, 64 nt, Human
cccugggcaggauguucacucuauuuauuggggaaggagggaggggggggacacuuaacuuauu

SEQ ID NO: 127612 - RNA, 64 nt, Human
ccuccccccuugggggucgggggggacauuggaaaggagggaccccgccaccccagcagcugag

SEQ ID NO: 127613 - RNA, 64 nt, Human
augcaccaaugaaccccacaggaagggggaaggaaggagggaauuucacauucccuuguucuag

SEQ ID NO: 127614 - RNA, 64 nt, Human
cucauccacccucuggcacccagccucugagggaaggagggauggggcauagugggagacccag

SEQ ID NO: 127615 - RNA, 64 nt, Human
gucuuucaaggcagguuccuggggcuucagggcuaggagggaggagccugcccuuuuaacagaa

SEQ ID NO: 127616 - RNA, 64 nt, Human
acugaguagcaaaucauuuguucuagaccaccuaaggagggaagguuauggaaugccccaagua

SEQ ID NO: 127617 - RNA, 64 nt, Human
cagaaagaaggggaggauccuccuauguuguugaaggagggacuagggggagaaacugaaagcu

SEQ ID NO: 127618 - RNA, 64 nt, Human
cucacaccuguaaucccagcacuuugagaggccaaggagggaggaucgcuuaagcccaggaauu

SEQ ID NO: 127619 - RNA, 64 nt, Human
ccugggcggcgugagcucuguguuggacccacggaggagggagucacugcagggaaagagggac

SEQ ID NO: 127620 - RNA, 64 nt, Human
cugugaagcuacagacugacagccagggcaggggaggagggaggggcgccagcaccugaugauc

SEQ ID NO: 127621 - RNA, 64 nt, Human
gucccugaaagggccagcacaucacugguuuucuaggagggacucuuaaguuuucuaccugggc

SEQ ID NO: 127622 - RNA, 64 nt, Human
cucacguauguaaucccagcacuuugggaagccaaggagggaggaucacuugaacucaggaauu

SEQ ID NO: 127623 - RNA, 64 nt, Human
agugaggaggagcccagaggaccccaggggagugaggagggagaacuuggaagggugcagccca

SEQ ID NO: 127624 - RNA, 64 nt, Human
aucucuccuuccaggcccaucccuggcccagagcaggagggagggagggacgauggcggugggu

SEQ ID NO: 127625 - RNA, 64 nt, Human
gccaagaccugccaggagugucucuaagagauccaggagggagccacccccaaggacccugcca

SEQ ID NO: 127626 - RNA, 64 nt, Human
gagcaaggauugggggucgugcagcccagccagcaggagggacugaggcccucuaggaggaaag

SEQ ID NO: 127627 - RNA, 64 nt, Human
ugacccccacccacauuucccuccuuagagauccaggagggauggaauguucuuuaaaauucaa

SEQ ID NO: 127628 - RNA, 64 nt, Human
accuggggaagcggggguuggguguuuuagagacaggagggacaucuccgggugucuuuagucu

SEQ ID NO: 127629 - RNA, 64 nt, Human
ucucaacccuuacugaacauaagggaauuuauacaggagggaaacccuacaaaugugaagaaug

SEQ ID NO: 127630 - RNA, 64 nt, Human
caaggcagugcugagagggagggguuauagcuucaggagggaaccagcuucugauaaacacaau

SEQ ID NO: 127631 - RNA, 64 nt, Human
ccgcuccgccugagcuccccgguuugcagaauggaggagggaaguugaaggagccaccuccucu

SEQ ID NO: 127632 - RNA, 64 nt, Human
aaacagugcacccccauggcugccacggaguauaaggagggagagaaaggagcugaaagucuag

SEQ ID NO: 127633 - RNA, 64 nt, Human
gaucagcccagaggaaugcugagaaaucaccuggaggagggagcagaaagagaagguuuuuaag

SEQ ID NO: 127634 - RNA, 64 nt, Human
cuuagaaaagcaggagucaggcugccacccccuaaggagggacccuaacguucugcccuugccu

SEQ ID NO: 127635 - RNA, 64 nt, Human
acaaggaugaaaagcacauggaaaaaaauggaugaggagggaaaacucugccaaauggaaaaug

SEQ ID NO: 127636 - RNA, 64 nt, Human
agcucccuuacuuguccacagauaauguaaacaaaggagggaaaaacuuauuaaauucuccuuc

SEQ ID NO: 127637 - RNA, 64 nt, Human
ucuuugaaggguaggaaaccuggaagacguacaaaggagggagaggucaggugcuagaaaguuu

SEQ ID NO: 127638 - RNA, 64 nt, Human
gccaaagauggagaagagugccagggaccccucaaggagggagacgcuccauaucccagggcau

SEQ ID NO: 127639 - RNA, 64 nt, Human
gcccagguaagaccucucugaagagcugucaugaaggagggagggagcacauuccuggcagaga

SEQ ID NO: 127640 - RNA, 64 nt, Human
gggguuggggaagacagcauuccacagccuggucaggagggaaggaccucacuuguuucaucaa

SEQ ID NO: 127641 - RNA, 64 nt, Human
uucuccuccccaagucggcacccuuuaacucaugaggagggaaaagagugccuaagcgggggug

SEQ ID NO: 127642 - RNA, 64 nt, Human
ugcccucucugagucuggacuuugcuuccccuccaggagggaccacccucccugacuggccugg

SEQ ID NO: 127643 - RNA, 64 nt, Human
gcuguugccguaucuccuagucuccgugugauggaggagggagaugccuggggaggggcuccug

SEQ ID NO: 127644 - RNA, 64 nt, Human
cucuuccaccucaggcaguguggcuccagaugucaggagggacugaccucaggaccuuccaggu

SEQ ID NO: 127645 - RNA, 64 nt, Human
caaaccuaaaaaagcaaugaaauagauguaaggaaggagggauuuaaaccuuuuaaaaaacuuu

SEQ ID NO: 127646 - RNA, 64 nt, Human
cacucacagaacuguccccugcuccguggugggcaggagggaaguggugcagggcugcgugcau

SEQ ID NO: 127647 - RNA, 64 nt, Human
auugagagcagccucuugaaugcuuaaaugaucaaggagggagaaaggcaaaccaauuuguucu

SEQ ID NO: 127648 - RNA, 64 nt, Human
ugcccccguggcagcccacuuggaccccccuaaaaggagggaauaggaggagggcagggugagu

SEQ ID NO: 127649 - RNA, 64 nt, Human
ggcagcugggcaucagugcagcugauaucguuugaggagggagacagaugcuuggaccugggug

SEQ ID NO: 127650 - RNA, 64 nt, Human
uguucucugucucuuuuccuuaaaauuggggguaaggagggaaggaagagggaaagagaugacu

SEQ ID NO: 127651 - RNA, 64 nt, Human
ggaggaggaggcauggcacaagugacccuggcuaaggagggagggagccucaaaucacguugua

SEQ ID NO: 127652 - RNA, 64 nt, Human
uccagaagccucuggcuagaggccagccccacccaggagggagggggcuauagcuacaggaagc

SEQ ID NO: 127653 - RNA, 64 nt, Human
auggccugcuguucacauggacccugagcaaggaaggagggagggaggggcagaguggaguguc

SEQ ID NO: 127654 - RNA, 64 nt, Human
accucuuuguagugcuuggcuacucugugauggcaggagggaaccuucagccugucuggcugcu

SEQ ID NO: 127655 - RNA, 64 nt, Human
gccagagcacaggaagccacccugccugcuggggaggagggacccacacaagcccccucggcag

SEQ ID NO: 127656 - RNA, 64 nt, Human
cuauggacaaaagcaggaaugacuaacacauccuaggagggaaaguccaguguaccugucauca

SEQ ID NO: 127657 - RNA, 64 nt, Human
agacgaaaauccauuuguuuaaauucacaucucaaggagggagaacccgggcuguguugggugg

SEQ ID NO: 127658 - RNA, 64 nt, Human
uuaggcugugugucuccuacauuaacagcuggggaggagggaaaagcuucagacuuuuaaacua

SEQ ID NO: 127659 - RNA, 64 nt, Human
ggccauggaagcuggcaggagacacuggucucagaggagggauagagacgcagauuucagaugu

SEQ ID NO: 127660 - RNA, 64 nt, Human
caaucccuucccucccagaagcuggccgcccagcaggagggacugaggccagacucauguccag

SEQ ID NO: 127661 - RNA, 64 nt, Human
uucaagcuguuucuagcacauuccaaaauaaaugaggagggaagagucuuuguuuucuguauuu

SEQ ID NO: 127662 - RNA, 64 nt, Human
aagcgguuucacuccgcaaauauccuccacuuucaggagggaaaacccacccuaccacaguccg

SEQ ID NO: 127663 - RNA, 64 nt, Human
auuuuuggaaauaugcaacuccuuuucagagaucaggagggauuuauguagcagcuauuuuuac

SEQ ID NO: 127664 - RNA, 64 nt, Human
ccgcgcgcccccccaucccacagaucaggagccaaggagggagaacagggcagccugugggacu

SEQ ID NO: 127665 - RNA, 64 nt, Human
uggguagggacugcaugccccaugccacaguugaaggagggagagaacacgcugugaaaacaca

SEQ ID NO: 127666 - RNA, 64 nt, Human
aaagaguguggaauuuugguugggguggggggagaggagggaugcaacucgcccuguuuggcau

SEQ ID NO: 127667 - RNA, 64 nt, Human
ugaagagcccccuaggggacacacagcuuccaggaggagggaauguccucuaagcaugcuccug

SEQ ID NO: 127668 - RNA, 55 nt, Human
ugaagcucugcaggauauagcccggaggagggaagcauagagaacgggaguggcc

SEQ ID NO: 127669 - RNA, 64 nt, Human
aaguuuuuuaguagcucuagaaacauuuuuaagaaggagggaaucccaccucaucccauuuuuu

SEQ ID NO: 127670 - RNA, 64 nt, Human
guuugcacugccuuggagcaagcacacuuuguagaggagggauuugcaguuacuugggcaacaa

SEQ ID NO: 127671 - RNA, 64 nt, Human
acucugacuggcacagucuuugcauggagacuugaggagggagggcuugagguuggugagguua

SEQ ID NO: 127672 - RNA, 64 nt, Human
ugacauggacaccugugacagagagaggacaguuaggagggacagacagcucuuccuuucggag

SEQ ID NO: 127673 - RNA, 64 nt, Human
gccggacgaugcccugcagacugcucugaagagaaggagggaccuucugcagagacuccgggua

SEQ ID NO: 127674 - RNA, 64 nt, Human
cuuuaauggacaguccguaccaagcagagccgagaggagggaagccaggggucccagcccgucu

SEQ ID NO: 127675 - RNA, 64 nt, Human
agcacacagcaagcaaccacaaaaccagagcggaaggagggacuucccaccggcauccggcccc

SEQ ID NO: 127676 - RNA, 64 nt, Human
uucccucugugaaguggggggaggcaggccuucaaggagggauagagguacaaggcuucgucuc

SEQ ID NO: 127677 - RNA, 64 nt, Human
cucuuccuaccauccaggggcuccugggaaauuaaggagggauuugcacaggaacccccaggac

SEQ ID NO: 127678 - RNA, 64 nt, Human
uggcagaugagaguguagucaagggccugggcacaggagggagagcugcagaguguccugccug

SEQ ID NO: 127679 - RNA, 64 nt, Human
uaggggcgggaggaaaggcggaggcgagcccuggaggagggaggccacaacuccgagcugccca

SEQ ID NO: 127680 - RNA, 64 nt, Human
uguaaaguggccacuaugaaucccuauguaugagaggagggaggcaggcugcagcuucagccac

SEQ ID NO: 127681 - RNA, 64 nt, Human
uuguuugaaagaaagaggaguggaaaaugguuccaggagggaagagguucuuugagacacagua

SEQ ID NO: 127682 - RNA, 64 nt, Human
ugcccuucccccacccccacggcucuccugguugaggagggaggggccuggcugaccccuccag

SEQ ID NO: 127683 - RNA, 64 nt, Human
aggaagagagagugggaggcagagugugauggggaggagggacaggaagacccuuuuaaugaug

SEQ ID NO: 127684 - RNA, 64 nt, Human
aaagagagcuagcuggcgguuagagccuggaagaaggagggaaguggcaccucacuagcauuua

SEQ ID NO: 127685 - RNA, 64 nt, Human
aggccccucgggggcagcacaucuuccuccucgcaggagggaccaggcggggcuccaggccacu

SEQ ID NO: 127686 - RNA, 64 nt, Human
uagagcccucagcaggucuggggagcuagagcaaaggagggaccucaggccuuccguuucuucu

SEQ ID NO: 127687 - RNA, 64 nt, Human
cccugaugcagccuguggcuuggaguggccaaauaggagggagacugugguaggggcagggagg

SEQ ID NO: 127688 - RNA, 64 nt, Human
ugaauuucagacaaaaauuaaccagacagaggagaggagggaggaagagcugggcgagaggccu

SEQ ID NO: 127689 - RNA, 64 nt, Human
uguaaaaugggugcuggggguggagggguauaagaggagggagagucagagagaguguguaugg

SEQ ID NO: 127690 - RNA, 64 nt, Human
aucucaucaacgaggccuggacaaacaagcccugaggagggaucugcaacaacccugaagacaa

SEQ ID NO: 127691 - RNA, 64 nt, Human
uggccuccagcaacucagggauaacaugggcuccaggagggacccucugguccagcugccccac

SEQ ID NO: 127692 - RNA, 64 nt, Human
accacauccugagcacucggccccauccccccacaggagggaagcuguggucugacggaauggg

SEQ ID NO: 127693 - RNA, 64 nt, Human
gccaaagacauuuccauuuccgaucuccauggggaggagggacuuaagcccaagugggucaggc

SEQ ID NO: 127694 - RNA, 64 nt, Human
ggccagggaagggacugggaggggagagaagagaaggagggaaggauuuaggaugguaaaguua

SEQ ID NO: 127695 - RNA, 64 nt, Human
ugucagauacccuguuucuggagucacaucagugaggagggauguggguaagaggagcagaggg

SEQ ID NO: 127696 - RNA, 64 nt, Human
uaugacugucauagacacaugggugcuugaagaaaggagggacccggaacuugggccaaucagc

SEQ ID NO: 127697 - RNA, 64 nt, Human
cacagauaaauguagccucauaacugugcaccugaggagggaugagaagcuacugcuaucugcu

SEQ ID NO: 127698 - RNA, 64 nt, Human
auuaauuuuuuugugugcuaggggagggagagugaggagggaguguuauuuccuugggaaccua

SEQ ID NO: 127699 - RNA, 64 nt, Human
uccuggcaagaggcagaccccggggcccucaggaaggagggaguuggcagcgggggcugcagca

SEQ ID NO: 127700 - RNA, 64 nt, Human
cagcaguggcagcuugggaaaugugaggaagggaaggagggagagacgggagggaggagagaga

SEQ ID NO: 127701 - RNA, 64 nt, Human
ugccuucagauguucucucccaggggcuggcuucaggagggagcauagaaggcaggugagcaac

SEQ ID NO: 127702 - RNA, 64 nt, Human
aauguaaguuuagcuucuaaaugaaauaauauauaggagggauaucagaaugucuagauagaga

SEQ ID NO: 127703 - RNA, 64 nt, Human
cccauaaauucaacaccuggagggugugguuuugaggagggauaugauuuuauggagaaugaua

SEQ ID NO: 127704 - RNA, 64 nt, Human
uuuucucuccauauaccuugacuuggauuuugacaggagggagccugggaaaauaauuuuuucc

SEQ ID NO: 127705 - RNA, 64 nt, Human
cugccuaacaaaauauugaaaggcaaacauuugaaggagggagggggugcagguucaguuuaua

SEQ ID NO: 127706 - RNA, 64 nt, Human
agcuuuacgcauuacuaggaauauuuucuuuuacaggagggagaaggguuuugagggagggggu

SEQ ID NO: 127707 - RNA, 64 nt, Human
aagacagacugaauuugcgaugaaaauauuuuuuaggagggaggauguaaauagccgcacaaag

SEQ ID NO: 127708 - RNA, 64 nt, Human
uuuuuaaccaugagguuuaauuuauuuuugugauaggagggauauuuacauauuuuaguggacc

SEQ ID NO: 127709 - RNA, 64 nt, Human
gagacuagaagagucuuaaauuauaugugggaggaggagggauagaacaucacaacacugcucu

SEQ ID NO: 127710 - RNA, 64 nt, Human
cuuugaaagaagauuggagagggugggaaaggggaggagggagcccugaaaagagguacuaagg

SEQ ID NO: 127711 - RNA, 64 nt, Human
gggcuuucuccccuuuugcuugagcaggguucccaggagggagaaagagaagacaagagccuga

SEQ ID NO: 127712 - RNA, 64 nt, Human
agaggggagaagaaggaagggaagggcagaaggaaggagggaagaaaagaaagcaaaggaacag

SEQ ID NO: 127713 - RNA, 64 nt, Human
ccuaacuggguucuuggggucuucaggacugaagaggagggagaguggggucagaagauucucc

SEQ ID NO: 127714 - RNA, 64 nt, Human
agcauguucguauuagagacaaaaucuguguaacaggagggagaauagcgccaagucucugggc

SEQ ID NO: 127715 - RNA, 64 nt, Human
ugugaacuuuuagcuuuggugcacagcugauaccaggagggaacauccugaagugucagagaaa

SEQ ID NO: 127716 - RNA, 64 nt, Human
augccacuuugaagaaaagaacacugagaacuagaggagggaacacuuugcccaagauuacuca

SEQ ID NO: 127717 - RNA, 64 nt, Human
uccgggcaccccgggagcuccugcaagaggccugaggagggaggcucccgggaccguccacgca

SEQ ID NO: 127718 - RNA, 64 nt, Human
gugaagacaagcugggcuggggagaacggugucuaggagggaugaccccacucagcuccaggca

SEQ ID NO: 127719 - RNA, 64 nt, Human
aguucacuuauaguauuucuauaauuugauucauugccguaauagagccauguaggaaaugcac

SEQ ID NO: 127720 - RNA, 64 nt, Human
aguucaccagcuugcucuaagagcaagcaggcaaugccguaaagccugagccugccugaggugc

SEQ ID NO: 127721 - RNA, 64 nt, Human
gaagaaauacagcuaaggccuugccagcaacaccugccguaaguuacuggcugagugagggcau

SEQ ID NO: 127722 - RNA, 64 nt, Human
aauuuaaaacuguuggaauggauuuuucuuuaacugccguaauuuaacuuucuggguugccuuu

SEQ ID NO: 127723 - RNA, 64 nt, Human
guuucagagaccuuaauuuauauucuccuuccugugccguaaggauugcaucggacuaaacuau

SEQ ID NO: 127724 - RNA, 64 nt, Human
cauaugccaacaaaugccuuguauuauauggcacugccguaauucaaauuuguuuuuauuuugg

SEQ ID NO: 127725 - RNA, 64 nt, Human
uuuuuucuuccaggcgcuuaaauuccuagcgaagugccguaagaaaaagaaacuauuugcuccu

SEQ ID NO: 127726 - RNA, 64 nt, Human
accuuuggagaggugcacuucugaaugcugccucugccguaaauccuggggcaagggaucagcc

SEQ ID NO: 127727 - RNA, 64 nt, Human
uuauuauuaugaaccuucagccuacuuucuugagugccguaaaagugcuuguaaaucuuuuuuu

SEQ ID NO: 127728 - RNA, 64 nt, Human
aguggucuguguuucuuuucgccauugccuagcuugccguaaugauucuauaaugccaucaugc

SEQ ID NO: 127729 - RNA, 52 nt, Human
cccucaagcuccuuaagugaauugccguaacugauuuuaaaggguuuagauu

SEQ ID NO: 127730 - RNA, 64 nt, Human
acaucacucuuauguaauccccaaaggcuuggcaugccguaagugugugguggguagacugcug

SEQ ID NO: 127731 - RNA, 64 nt, Human
ugagcccuugugaaagguuagguucuaauguauaugccguaaugaaauaaucauuaagccuauu

SEQ ID NO: 127732 - RNA, 64 nt, Human
uucuguagguggaauauuuccaauaaacacaaggugccguaauugacugcuacucuggcaagug

SEQ ID NO: 127733 - RNA, 64 nt, Human
aaauuaaggaaagaaacaaaccacgacacccaaaugccguaaucuuaaagaaaagcaaaugcag

SEQ ID NO: 127734 - RNA, 64 nt, Human
uuuaguuauaaugaaauugauuuguagucuguuuugccguaaacuuguuuuucuuuaaauuguu

SEQ ID NO: 127735 - RNA, 64 nt, Human
augaccuuagaagacaaagccuguuugucauggcugccguaaaccgagcucuuacagugcgugg

SEQ ID NO: 127736 - RNA, 64 nt, Human
uacagaaaaauucuuaacuguaauugaugguuguugccguaauaguauauugccuguauuucua

SEQ ID NO: 127737 - RNA, 64 nt, Human
ggaacugucuuauuuuuguucuguaaaugucuauugccguaaauuguuaauaaaauugaaguuu

SEQ ID NO: 127738 - RNA, 64 nt, Human
acuggacaucuuuguguaaaccauaauccacaugugccguaaaugaucuucacuccuuauccga

SEQ ID NO: 127739 - RNA, 64 nt, Human
ugguauaaaagguugccaaauugcugcauauuugugccguaauuauguaccaugaauauuuauu

SEQ ID NO: 127740 - RNA, 64 nt, Human
uuaaugccgugaaaguuuaacguuugcgauaaacugccguaauuuugauacaucugugauuuag

SEQ ID NO: 127741 - RNA, 64 nt, Human
ugugauccagcuuucucuugccauccuaugugcaugccguaagaucaguuggauauuaaaccau

SEQ ID NO: 127742 - RNA, 64 nt, Human
gccucagaggccaaguuuccagaagccucuuaccugccguaaaaugcucaacccuguguccugg

SEQ ID NO: 127743 - RNA, 64 nt, Human
cugcaguucccgccagccuccaacacggggacucugccguaacuggaaucuucauaggucauau

SEQ ID NO: 127744 - RNA, 64 nt, Human
acuugguguugcuugucauggacaccggugaacaugccguaacucugugacugcauuguaagug

SEQ ID NO: 127745 - RNA, 64 nt, Human
uugcuugauaaguauuaagaaauauuggacuugcugccguaauuuaaagcucuguugauuuugu

SEQ ID NO: 127746 - RNA, 64 nt, Human
caacacgucauuguguaaggaaaaauaaaagugcugccguaaccaaugaauggcuccuguuugg

SEQ ID NO: 127747 - RNA, 64 nt, Human
uauuuuuaacagcuuugucaaacuacaauuuacaugccguaaaauguacacacuguaauuuuau

SEQ ID NO: 127748 - RNA, 64 nt, Human
gcccucaaguccuacagccccuagaagaccccaaugccguaacuccuaggacccccaaaucaug

SEQ ID NO: 127749 - RNA, 64 nt, Human
ugcauguuaugggucgauguuccuguaauugcagugccguaaaagcuuauuaaaguuguucuuu

SEQ ID NO: 127750 - RNA, 64 nt, Human
gugcggaugggccccggacccgguguccugucuacaucuacagcuguucacuggaagcgcugag

SEQ ID NO: 127751 - RNA, 64 nt, Human
uugacaccuuagagaagcuaccccucaaacugcacaucuacacacaaacaaacaaugcauagga

SEQ ID NO: 127752 - RNA, 64 nt, Human
gugcugcuucauaacaaaaaugaaaagcugcaugcaucuacagcaggcauggauuguuuauguc

SEQ ID NO: 127753 - RNA, 64 nt, Human
gggaauuuuuuuccugaaguaauaauuuauuccacaucuacaucagugaaagcuaucuaccuau

SEQ ID NO: 127754 - RNA, 64 nt, Human
aaauauuuaauaaaugaugaaugauagaaguuuccaucuacaauauauguuccuaaauggagca

SEQ ID NO: 127755 - RNA, 64 nt, Human
accucccuuugccuccccaucuggugcuuucuugcaucuacaccccagggcccugugguggggc

SEQ ID NO: 127756 - RNA, 64 nt, Human
ucauaguuuuuuuuuaauaaaauggcauauuuugcaucuacaacuucuauaauuugaaaaaaua

SEQ ID NO: 127757 - RNA, 64 nt, Human
auuaucaucaaucuuuauguauuuguuaaagaaacaucuacaggaucuuuauuggugaccuuuu

SEQ ID NO: 127758 - RNA, 64 nt, Human
acaaaaaauauaugaauuucuucauuugcucuugcaucuacauugcuauaaggauauaaaaugu

SEQ ID NO: 127759 - RNA, 64 nt, Human
uugcauuuauuugaaaugucuguaagucucuuuccaucuacagaguuuagcacauuugaacguu

SEQ ID NO: 127760 - RNA, 64 nt, Human
caaacaaacaaauacacagacagaaguaguuaaacaucuacaagguaagugcaucuugaagacg

SEQ ID NO: 127761 - RNA, 64 nt, Human
aaacuuugagcuuuguuaauaaacuauuaugcagcaucuacacuuugaaaaucaaguacuucaa

SEQ ID NO: 127762 - RNA, 64 nt, Human
ucauuggaaacaaaagcuugaaagaaacacaucgcaucuacauuuguaacaugagaaggaaaac

SEQ ID NO: 127763 - RNA, 64 nt, Human
aaaaagacugggugaccuggaucucugcuuaauacaucuacaaccauugucucacuggagacuc

SEQ ID NO: 127764 - RNA, 64 nt, Human
aacuauaucuugaaaacaaagacccuucgguguccaucuacaguaaaccccaccauuaccuucu

SEQ ID NO: 127765 - RNA, 64 nt, Human
cucuugggaaagucacuccuaguaucuauuucaccaucuacagaagagaaauacuucacagaau

SEQ ID NO: 127766 - RNA, 64 nt, Human
caucaggcuagaaguaauuaauguugauuuauuucaucuacaagcaguuggucccuaagugaaa

SEQ ID NO: 127767 - RNA, 64 nt, Human
augagguauuuggguuuuuuuuuuagaucgaucacaucuacagaaaauggcuaaaccaaguuaa

SEQ ID NO: 127768 - RNA, 64 nt, Human
acacuucucugaggaucaccugcugucaaauugccaucuacaguauuacagcuuugcauuuggg

SEQ ID NO: 127769 - RNA, 64 nt, Human
aguuuucuauauuucauagucaaagccuugaaagcaucuacaaaucucuuuuuuuagguuuugu

SEQ ID NO: 127770 - RNA, 64 nt, Human
cauggauauccacgcagcagccccucuuuaaccucaucuacaagcauuugcccuguggauucca

SEQ ID NO: 127771 - RNA, 64 nt, Human
aauucuuuugucaaaaaguguguauauauguuugcaucuacauauauuuguacaucuauaugac

SEQ ID NO: 127772 - RNA, 64 nt, Human
auuuucuauuacaauuggaaguggagaauaugugcaucuacacuaaaaaaauguuuaagauauc

SEQ ID NO: 127773 - RNA, 64 nt, Human
ucuuccucuugcuguaggcucaaucccauaccgacaucuacaacuaaucuuucccaucaacucu

SEQ ID NO: 127774 - RNA, 64 nt, Human
gaagauaaggucugaauaauagcagaaaaaccaacaucuacaaaacauuaaacuaguguuauac

SEQ ID NO: 127775 - RNA, 64 nt, Human
ggugaucagcauaagaggccagauccccucgagucaucuacaccuagcuucaccuuauucuuua

SEQ ID NO: 127776 - RNA, 64 nt, Human
uaaagcacuauuuuauuuauagauauaucuagugcaucuacaucucuauacuguacacucaccc

SEQ ID NO: 127777 - RNA, 64 nt, Human
gacaauuuaggacugggcuagauuuucagaagaacaucuacaauauccuauuuauaaaucuucc

SEQ ID NO: 127778 - RNA, 64 nt, Human
cgccagcaauuaaagaccaccaaucuuguuuguccaucuacaugguuugucggggacauuuaac

SEQ ID NO: 127779 - RNA, 64 nt, Human
uuuugcacaagaucuguuuuccaugauguguugacaucuacaauuucacuaacuguugacguua

SEQ ID NO: 127780 - RNA, 64 nt, Human
aucaccaaacaauauguuaaguggcuuuccuuggcaucuacagagaaaacauucuauagcccuc

SEQ ID NO: 127781 - RNA, 64 nt, Human
guagguaaaaugcaguccaugucccauccauagccaucuacaauaguaacugcccacaggcucu

SEQ ID NO: 127782 - RNA, 64 nt, Human
uuuccuucuggaaccauaaggguaaccagauuuucaucuacagacaagugguagucauuugugu

SEQ ID NO: 127783 - RNA, 64 nt, Human
ucuauaucuauaucuauaucuauauauuuuuaaucaucuacauguaaaugaagcaauagaauuc

SEQ ID NO: 127784 - RNA, 64 nt, Human
uaugccagguggucccugcugggggcagcaguaccaucuacaucuccuucaccccuauggugcu

SEQ ID NO: 127785 - RNA, 64 nt, Human
ggccugggcgcagcucuggacucugcguauaacacaucuacaaucuggcaaacccuuggcccaa

SEQ ID NO: 127786 - RNA, 64 nt, Human
uuugggcgggaacaaauagucaaauuauauuacccaucuacaugguuuucuuuuucuuaguaug

SEQ ID NO: 127787 - RNA, 64 nt, Human
cccaccccagucuagcaccacccugccuucacuucaucuacauaaaggugguauaaaaacauag

SEQ ID NO: 127788 - RNA, 64 nt, Human
ggaccuggaguugcuggcuaccuuaccgcagguacaucuacaucagucaugucuaaccugccac

SEQ ID NO: 127789 - RNA, 64 nt, Human
gcagaugucaacugaaggccacaaaaaugaacuccaucuacaagugauuaccuaguugugagcu

SEQ ID NO: 127790 - RNA, 64 nt, Human
acauacuuaucaauuucuugaugcuuccaaaugacaucuacagauaugguuuuguggacaucuu

SEQ ID NO: 127791 - RNA, 64 nt, Human
ugucucucuuggucaccagcuguguguccuucuccaucuacacggccuggggcgagcacuguga

SEQ ID NO: 127792 - RNA, 64 nt, Human
gaguuaagaaacaccugguaccucaaagaugacucaucuacagguuguuuccuauugagacuuu

SEQ ID NO: 127793 - RNA, 64 nt, Human
auguuaauuuuugcaccauuaauuuagcaaaggccaucuacaagagguauaccacuguauuuug

SEQ ID NO: 127794 - RNA, 64 nt, Human
auauuuggcuuggaaauguguuuuucuucaauuacaucuacaaguaaguacagcugaaauucag

SEQ ID NO: 127795 - RNA, 64 nt, Human
gugggccauugccuucaugccgugguaaguaccacaucuacaauuuugguaaccgaacuggugc

SEQ ID NO: 127796 - RNA, 64 nt, Human
auauuuuucaugaugacccaugaaaaauaucacucaucuacauaaaggagagacuauaucuauu

SEQ ID NO: 127797 - RNA, 64 nt, Human
gcuugcaccaaacauuucuaaacacuuguucugccaucuacaugggaggugaugaaacucagug

SEQ ID NO: 127798 - RNA, 64 nt, Human
uccagcuauaauauuaugaagaacauuucccaugcaucuacaagcuugagaaauaggauuuuca

SEQ ID NO: 127799 - RNA, 64 nt, Human
cuucugugauuaaguaaauggaugucucgugaugcaucuacaguuauuuauuguuacauccuuu

SEQ ID NO: 127800 - RNA, 64 nt, Human
accuaggaugaucucauuuggaaauccuuaauuucaucuacaaaaacuguuuucccaaauaggu

SEQ ID NO: 127801 - RNA, 64 nt, Human
uuuauuacaaaauuauauucaccuaaaugccaaccaucuacaaaaacaaugaguaauuuuucua

SEQ ID NO: 127802 - RNA, 64 nt, Human
cuaugaguugaaauguucugucaaaugugucucacaucuacacguggcuuggaggcuuuuaugg

SEQ ID NO: 127803 - RNA, 64 nt, Human
ucuaggugaacagccuccagacggugugcaccaacaucuacaagauccuccugcugcaggcgua

SEQ ID NO: 127804 - RNA, 64 nt, Human
ggccaccugcuggcagccgaugggggcacucggacaucuacaacccugcaacuuuguacagaga

SEQ ID NO: 127805 - RNA, 64 nt, Human
cacuuacacucucucacauauucacacgugugcacaucuacaccagggcucugaucuacucuag

SEQ ID NO: 127806 - RNA, 64 nt, Human
ucuaaagauagccugauggaagaaaaaccucagacaucuacaaacaaccuggcuggaaaacaca

SEQ ID NO: 127807 - RNA, 64 nt, Human
aguuauuucucauaaguacccaauggcaucucuccaucuacaaaguugcaguauuaugcaaaua

SEQ ID NO: 127808 - RNA, 64 nt, Human
caggugcccaggacagaagccccagccccagccucaucuacaccccaggagcccuggccuggug

SEQ ID NO: 127809 - RNA, 63 nt, Human
cccugacaguguuuggcugagccgagacuggagcaucuacaccugaggacaagacgcugccca

SEQ ID NO: 127810 - RNA, 64 nt, Human
augucuccuucuacaacaugagggacagaucgcacaucuacacauguccccguucagccuuuuc

SEQ ID NO: 127811 - RNA, 64 nt, Human
aaaaaaaaguccagaagaaaucauaaauaucucucaucuacaugguugcuuccucuuccuccca

SEQ ID NO: 127812 - RNA, 64 nt, Human
ugugaaucccauccuggaagggaaggugcaucgccaucuacaggagcagaagaauggacuugcu

SEQ ID NO: 127813 - RNA, 64 nt, Human
uaugaaucccauccugaaaaggaaggugcaucaccaucuacaggagaagaagaauggacuugcu

SEQ ID NO: 127814 - RNA, 64 nt, Human
uuuguuuaacuucucucuucacugcaucccaauccaucuacaggcaugcacacuuauuaggaaa

SEQ ID NO: 127815 - RNA, 64 nt, Human
uugacuacuuuuuauaacuuaagaauuuuuauaccaucuacaucuauccuacuuaugcagaaaa

SEQ ID NO: 127816 - RNA, 64 nt, Human
cugaugucuucuuaaugucugugaaagcaacuggcaucuacaauaaaucacacuuagagcuggu

SEQ ID NO: 127817 - RNA, 64 nt, Human
auauuuugaaaugaacuuguuggcccaucuauuacaucuacagcugacccuugaacaugggggu

SEQ ID NO: 127818 - RNA, 64 nt, Human
ggggagcagaaagaguuauggcagagguuccacucaucuacaaagucacagucacaugccacau

SEQ ID NO: 127819 - RNA, 64 nt, Human
gggauuuugaaaaugcugcacaucccuuaauagucaucuacauagguaauacugauaaacauuu

SEQ ID NO: 127820 - RNA, 64 nt, Human
uuaagaugggcaaauccaaugaguugauguaacccaucuacauuuuguggcuauuucauguaua

SEQ ID NO: 127821 - RNA, 64 nt, Human
gacacaaguauauacugugcacugaaaaaauauccaucuacacagcacccaaggggagggcugg

SEQ ID NO: 127822 - RNA, 64 nt, Human
cuacuccuuaagaaaaaaacuuugguuuauuuagcaucuacacuuuugucaguuguguugcugu

SEQ ID NO: 127823 - RNA, 64 nt, Human
cuugggaggcgcaggauggcaccggcacaucuaacaucuacacuucucuagcucagccucacag

SEQ ID NO: 127824 - RNA, 64 nt, Human
aaauacaguacucaugcugacugaaauaauaagacaucuacaaauuuauaaacaaaaagugauu

SEQ ID NO: 127825 - RNA, 64 nt, Human
auuauuuagcaguguaacuuuuagaccugcgugacaucuacaaagcgcccaauaaagaaagagg

SEQ ID NO: 127826 - RNA, 64 nt, Human
gacaagucugaacccacgaaaauacccagcgcagcaucuacacauucaaaagauaagcugagug

SEQ ID NO: 127827 - RNA, 64 nt, Human
uuacagguuguaaaaauaaacuucgguaucagugcaucuacagaaguguuauuugguaauccaa

SEQ ID NO: 127828 - RNA, 64 nt, Human
acagaaaaugcuuuuccgcggcacgaaucagacucaucuacacagcaguaugaaugauguuuua

SEQ ID NO: 127829 - RNA, 64 nt, Human
cuaagccgaggggagagagguaccuagaccaugucaucuacaagcuucaguaacuaaagaaaaa

SEQ ID NO: 127830 - RNA, 64 nt, Human
cuuuauuuauuuauuugggcuacauuguaagauccaucuacacagucguuguccgacuucacuu

SEQ ID NO: 127831 - RNA, 64 nt, Human
ugagcucagcucugcaccaagcggaccuaggagacaucuacagaacgcuccaccccaaaucaac

SEQ ID NO: 127832 - RNA, 64 nt, Human
aaaaagaaaugagagggaugcuuccuuucccuugcaucuacaaaacaagagagagacuguucug

SEQ ID NO: 127833 - RNA, 64 nt, Human
gcaagucccccuggaggcggguggcccagaaagccaucuacaggguucccuaggccagguggag

SEQ ID NO: 127834 - RNA, 64 nt, Human
ucugacaagcuuucguaugguuuuguuauauuuucaucuacauguaauguguuauuaauuuuau

SEQ ID NO: 127835 - RNA, 64 nt, Human
cauggguggcacauugggacuucucucccucccccaucuacacagaagacugucaccaugcuga

SEQ ID NO: 127836 - RNA, 64 nt, Human
uguggcugugaagguauuuuguagaugugauuaacaucuacaaucaguugacuuuaagugaaag

SEQ ID NO: 127837 - RNA, 64 nt, Human
auaggaggaaaaggaaagcguuuuuguagcccaccaucuacagcuuuacuguaaaaccuugucu

SEQ ID NO: 127838 - RNA, 64 nt, Human
cucaagaguuucugggcuggauguuucagaacaacaucuacaccaguaaaguguaauaggucag

SEQ ID NO: 127839 - RNA, 64 nt, Human
aggaccugacaucuguagguggccccugaugccccaucuacagcaggaggucaggaccacgccc

SEQ ID NO: 127840 - RNA, 64 nt, Human
cauugugugguugacccucugagauaacuguuuucaucuacagaauugcauuuuugcuuuuaaa

SEQ ID NO: 127841 - RNA, 64 nt, Human
gucuuuaucaugagggauucuguauccugucucucaucuacacuugcuggccuuccugguugug

SEQ ID NO: 127842 - RNA, 64 nt, Human
ugaauguucacacagaaggaguugguuuucaugucaucuacagcauaugagaaaagcuaccuuu

SEQ ID NO: 127843 - RNA, 64 nt, Human
uuaagaaaacuuuaucuuauggaguuauuuaagccaucuacagagcugaggaaacaguguaaug

SEQ ID NO: 127844 - RNA, 51 nt, Human
gaccacaaguguauuuuuagucaucuacacgucaaauaucccaagacagau

SEQ ID NO: 127845 - RNA, 64 nt, Human
uacagguucaaguggguuaaggagaccuccuguacaucuacaguguuuccuuuuaaauugucca

SEQ ID NO: 127846 - RNA, 64 nt, Human
auaccuguuaccauggcugcgauuguuagcacuucaucuacacagucaaauucacaggacgcua

SEQ ID NO: 127847 - RNA, 64 nt, Human
uuucauuaaaaagaaauuugauugaaaauagaaacaucuacagcucagauacugaucucuuucu

SEQ ID NO: 127848 - RNA, 64 nt, Human
gguggugacauuuagagcuagucuugaaaccuaucaucuacagaggggagggcagccaacagcc

SEQ ID NO: 127849 - RNA, 64 nt, Human
auaagauuacaaagaauaagcagcaauauugaagcaucuacaguauguuaacuacauuuuuuaa

SEQ ID NO: 127850 - RNA, 64 nt, Human
gggcaagggaaaaggucccuggacucccuccugccaucuacaggcuugucacaucucaccacca

SEQ ID NO: 127851 - RNA, 64 nt, Human
gaagagcauugggaaacuugcacagcuagcuaugcaucuacauuuugguuugggguuaguuaug

SEQ ID NO: 127852 - RNA, 64 nt, Human
uaacgccagcccugcugugccccaucacacccggcaucuacacaagauccgccgggccacagag

SEQ ID NO: 127853 - RNA, 64 nt, Human
ucucauuuuucaaugucacaaaccacggagcacucaucuacaaguucucuggaugucgcuuuuc

SEQ ID NO: 127854 - RNA, 64 nt, Human
caggaaccaaguccuuugcguguggcccaacaaccaucuacagaacagcugcuggugcuucagg

SEQ ID NO: 127855 - RNA, 64 nt, Human
gaugggccgcugcuuugcgcugguggaccacaggcaucuacacagccuggacuuugguucucuc

SEQ ID NO: 127856 - RNA, 64 nt, Human
uaaguagaauucaucaacggucuccuaauuuuugcaucuacaucuggggggaaaaagcugugau

SEQ ID NO: 127857 - RNA, 64 nt, Human
uucaauaaaauugccuagcaccacaguggagagucaucuacaccccaaggugagcuguaagacu

SEQ ID NO: 127858 - RNA, 64 nt, Human
uuucauugucauauguggaauuuaaauauaccaucaucuacaaagaauuccacagaguuaaaua

SEQ ID NO: 127859 - RNA, 64 nt, Human
uuuuuuuccugauauuuccaccacuuuucagagucaucuacaaaauuuuucuuuccucaagaaa

SEQ ID NO: 127860 - RNA, 64 nt, Human
cugaggacggagaccgcggcaucaaccagcccaucaucuacagcaucuuuaggggugagugggg

SEQ ID NO: 127861 - RNA, 64 nt, Human
aguuuacucauuguccccuggaacaaaucacugacaucuacaaccauuaccaucucacuaaaua

SEQ ID NO: 127862 - RNA, 64 nt, Human
aacuaacagcaaaaaggcguuaaacagcaagugucaucuacauccuagccuuuugacaaauuca

SEQ ID NO: 127863 - RNA, 64 nt, Human
ugcgguacccauggggugaugcuacuucugcaugcaucuacagggcaucugacaccuaacauga

SEQ ID NO: 127864 - RNA, 64 nt, Human
ggccugaggagagaggggaaggguacagagaaaccaucuacauuccauggaauguuuuuaauaa

SEQ ID NO: 127865 - RNA, 64 nt, Human
gauuuggguacaggggaauuaugugugugaaugucaucuacaauuaaaaaaaauuagcacaucc

SEQ ID NO: 127866 - RNA, 64 nt, Human
ugagauucugacguguccagguuucuccugagcucaucuacauagauugguagacccuuccuuu

SEQ ID NO: 127867 - RNA, 64 nt, Human
cagcccccaccucauccgucuguuugcagagccucaucuacagguccccacgcugccuucuuua

SEQ ID NO: 127868 - RNA, 64 nt, Human
uucugucuaucuagcugucugccaucugaguguccaucuacauucugcugccaccagucaccaa

SEQ ID NO: 127869 - RNA, 64 nt, Human
cuuuuuucauuucccucagcacuuggcaucuugucaucuacacaauggacccucaauaaauggc

SEQ ID NO: 127870 - RNA, 64 nt, Human
gcaugauuaggccccggagauuuccaaguccccccaucuacacuuacaaacgauuagaaggguu

SEQ ID NO: 127871 - RNA, 64 nt, Human
agcugggagcagaacuagaaaguuaauuuuuaaacaucuacacuucauuuucaaguuaaccauu

SEQ ID NO: 127872 - RNA, 64 nt, Human
uccaaugccaucucccacuagauccuguauuauccaucuacaucagaaccaaacuacuucucca

SEQ ID NO: 127873 - RNA, 64 nt, Human
uuucuguaaacuuaaguuuccguugacuucuguacaucuacaaugaauaccuccucauagaagu

SEQ ID NO: 127874 - RNA, 64 nt, Human
uaucuuuaagguauggcugaaaauaacagcuacacaucuacagcuuaggauacuggagauuuaa

SEQ ID NO: 127875 - RNA, 64 nt, Human
gggaaacuaagaaaugguugacagcguucccacccaucuacaauguuauuuuaggugcuuugug

SEQ ID NO: 127876 - RNA, 64 nt, Human
aauagugaacuuugugaauggauuuuuccauacucaucuacaauuccuccauuuuaaaugacua

SEQ ID NO: 127877 - RNA, 64 nt, Human
gagagaauuuaacguguacuucaucgacacaacccaucuacaaaugugcccagaucuaacaaag

SEQ ID NO: 127878 - RNA, 64 nt, Human
gugcuucuuucuauuaaagugcuccauccccuaccaucuacacauuagcauugucucuagagcu

SEQ ID NO: 127879 - RNA, 64 nt, Human
ccaggaacaucaaugugagggaacuuaccaagaacaucuacaugguuuuuuaucuuauuguaau

SEQ ID NO: 127880 - RNA, 64 nt, Human
uaguauccuuucauuggagaauuuacaaaaauaucaucuacagcucaaaagucccacuaacggc

SEQ ID NO: 127881 - RNA, 64 nt, Human
agagcaauuuuuccacccaaaagucauuuggcaacaucuacagacaauuuugauugucacacug

SEQ ID NO: 127882 - RNA, 64 nt, Human
aauuuuaacuuuuaagugcuauuauguacucuuucaucuacauaaugcacguguucuggaugua

SEQ ID NO: 127883 - RNA, 64 nt, Human
caaaacacacgaagcauaauauguaaaaaagaugcaucuacaaagaaggcuaaugucauucuuc

SEQ ID NO: 127884 - RNA, 64 nt, Human
uuggugagugagggucucucuacucagugucagacaucuacaggaaagaaacaacugguggaaa

SEQ ID NO: 127885 - RNA, 64 nt, Human
ucucccugccugcuuugugccaacuagcauguugcaucuacaugcauuaugagucugguuaggc

SEQ ID NO: 127886 - RNA, 64 nt, Human
ggcucaagggacauguuuucuagccuuaguuccccaucuacaaaaugggccucauggaauggaa

SEQ ID NO: 127887 - RNA, 64 nt, Human
accagcagcaagggcugccaugggauacagcacccaucuacaaagaccucuauuacauaaacac

SEQ ID NO: 127888 - RNA, 64 nt, Human
uccaguggaacgaagacuaaccucaccagccagucaucuacaacaaaucugccugguucuccgg

SEQ ID NO: 127889 - RNA, 64 nt, Human
gggagucuggagccagacagccaagccccuuccacaucuacagggucacugucauccucaccac

SEQ ID NO: 127890 - RNA, 64 nt, Human
ugguaguuuuguuuuacuaaucuaaggguacuagcaucuacaaugauauagacaaaauaaaaua

SEQ ID NO: 127891 - RNA, 64 nt, Human
gaaaagcgauuaaaagacaucuuuccugcauugccaucuacauaauaucagauauuacggaugu

SEQ ID NO: 127892 - RNA, 64 nt, Human
gggaggagagcugugcccagcccaaccggccuggcaucuacacccgugucaccuacuacuugga

SEQ ID NO: 127893 - RNA, 64 nt, Human
gaacaccaguucuaacgaagcaugcgugucucuucaucuacaggaugcaauaggcugauuguau

SEQ ID NO: 127894 - RNA, 64 nt, Human
ucuaauacuucaguaggacccuaccuacgugguucaucuacaaugguuaccauaaaaaaucugg

SEQ ID NO: 127895 - RNA, 64 nt, Human
gguuuaguucuguuaacuuuugguaaaaugacaccaucuacaaagaauaguuuuuguuucuugc

SEQ ID NO: 127896 - RNA, 64 nt, Human
ccucuaaaccuugccuacgacauguuuaauacuucaucuacauagcagcccuucagauaaucac

SEQ ID NO: 127897 - RNA, 64 nt, Human
uguagaaagaugcuagaaaaauguucuuuaaaggcaucuacacaauuuaauuccucuuuuuagg

SEQ ID NO: 127898 - RNA, 64 nt, Human
cacaggaucaauaaugccugaggcugauugacgacaucuacauuucagugcuuuuucccuaagc

SEQ ID NO: 127899 - RNA, 64 nt, Human
gggaguagcaagacccaccccacacugccuucaccaucuacaccagugacgccgcugugugucu

SEQ ID NO: 127900 - RNA, 64 nt, Human
ggaaaguccauuuguuuuucuccaaguuaggucucaucuacagcucuuagcuucucaguaaaga

SEQ ID NO: 127901 - RNA, 64 nt, Human
cuauguugcacacaugguuuucagaugacccagccaucuacaagaucugaauucuacugaaaau

SEQ ID NO: 127902 - RNA, 64 nt, Human
uuacugaacuacagccugguuuguagacuuccaacaucuacacugcugcucuucaccauuggaa

SEQ ID NO: 127903 - RNA, 64 nt, Human
cuuaccucucugggaccuagggggacggggcugacaucuacauuuuuuaaaacugaaucuuaau

SEQ ID NO: 127904 - RNA, 64 nt, Human
auuaauaacauacacagaaauguacauacuacaucaucuacagaaaucuugaucaauaaccuag

SEQ ID NO: 127905 - RNA, 64 nt, Human
gcuggaaggucuuugacggcaccaucuggaaggacaucuacaaucaggagugguggaaccucag

SEQ ID NO: 127906 - RNA, 64 nt, Human
ccucgggccacauggguccacugcaccagugugacaucuacaacuccaagauugccgggaagcu

SEQ ID NO: 127907 - RNA, 64 nt, Human
cagcuugggcccugcaaacacaaccaucuacacacaucuacacccccaagcacacacacauggu

SEQ ID NO: 127908 - RNA, 64 nt, Human
uguaugugaacagcuugggcccugcaaacacaaccaucuacacacaucuacacccccaagcaca

SEQ ID NO: 127909 - RNA, 64 nt, Human
uguuauuccacuaaguaacuggugaaagggcauccaucuacauuuaauaccacucauuuuuccc

SEQ ID NO: 127910 - RNA, 64 nt, Human
gcuguaauugaaaagcuuguauccucuuugaagacaucuacaaagccauuuagaucaaccacag

SEQ ID NO: 127911 - RNA, 64 nt, Human
augcaacugcauucuuugauuucacuuguuccuucaucuacauguuuuguucauuugcagccag

SEQ ID NO: 127912 - RNA, 64 nt, Human
gaauugcauucuuguaauauccccuugcuccuaacaucuacauucccuucgugucuuugauaaa

SEQ ID NO: 127913 - RNA, 64 nt, Human
ugcuugagugugugaacacgugugugugugugcacaucuacaugccaugccuaugggccagagu

SEQ ID NO: 127914 - RNA, 64 nt, Human
aauacuaaaucaccuaggugucuauguucuaucacaucuacaaacaugucacuuccuaauuaac

SEQ ID NO: 127915 - RNA, 64 nt, Human
aggcuucagaaacuagcuuuaagaaauaauucugcaucuacaacucaacauuuacgacugcuua

SEQ ID NO: 127916 - RNA, 64 nt, Human
agacccggugucccaccaggcuccaggcucccaccaucuacagaggggcuuacagcgcccauuc

SEQ ID NO: 127917 - RNA, 64 nt, Human
augucugcuagaucaagcaaauguguuuaaaaaccaucuacacauuuauaaauguugaucugug

SEQ ID NO: 127918 - RNA, 64 nt, Human
ugaacacagcucugcaccaagcggaccuaauagacaucuacagaacucuccaccccaaauuaac

SEQ ID NO: 127919 - RNA, 64 nt, Human
gaugacaguaaaauuucagugaauagcaccuugacaucuacaacuuaaaaauggugauugaagc

SEQ ID NO: 127920 - RNA, 64 nt, Human
uuggaaaggaacagacaaaaauagaugacauggucaucuacaacuaauauuaagacuccugugg

SEQ ID NO: 127921 - RNA, 64 nt, Human
uuaucuaaagucaacugauuauggacuuuaaucacaucuacaaaacacuuccauggcgacagcu

SEQ ID NO: 127922 - RNA, 64 nt, Human
caguaaauuagauggaaugacucuucuaaaaguucaucuacaaauuuuccagugaauaugguug

SEQ ID NO: 127923 - RNA, 64 nt, Human
uggagaagacuguguggauccaccagaagauggccaucuacaagccaaggacagagaccuggaa

SEQ ID NO: 127924 - RNA, 64 nt, Human
agcuccugaggccacacagcaccauaaagucucgcaucuacaggccuuugauuaccuccuggga

SEQ ID NO: 127925 - RNA, 64 nt, Human
uuccugacguaaugcaauaggaaguccacaccaccaucuacaaagccuuauugcuggaauaaug

SEQ ID NO: 127926 - RNA, 64 nt, Human
uuugguugacugugauuuucuucacagaucaugucaucuacaaacaaauaaaauuugacuucuu

SEQ ID NO: 127927 - RNA, 64 nt, Human
gacucuuugugauuuucuuuacagaaggucaugucaucuacaaacaaauaaaauuugacuucuu

SEQ ID NO: 127928 - RNA, 64 nt, Human
gacucuuugugauuuucuacacagaagaucaugucaucuacaaagaaauaguuuuacuucuuuc

SEQ ID NO: 127929 - RNA, 64 nt, Human
cggcucuuccaggcgucuccaccuacugcccucccaucuacacuugacuguagacuggucuggc

SEQ ID NO: 127930 - RNA, 64 nt, Human
gaggaccccugcggcccccugccuagaggagcaccaucuacaguugugccauuccccagccacu

SEQ ID NO: 127931 - RNA, 64 nt, Human
uccacaccagccugggcaacacagcaagacaccgcaucuacagaaaaauuuuaaaauuagcugg

SEQ ID NO: 127932 - RNA, 64 nt, Human
ugguggugguggugguggugguggugagugucagcaucuacaguacagccaggcaggcaggacc

SEQ ID NO: 127933 - RNA, 64 nt, Human
gaaucacagaggggucaggaagcuguggcaggagcaucuacacagcuugggugaaaggggauuc

SEQ ID NO: 127934 - RNA, 64 nt, Human
gcagcauaucagacagcaauuuaacagcuugaaacaucuacagauaguuccuacuaaaagaagu

SEQ ID NO: 127935 - RNA, 64 nt, Human
cauguaucaguuuuaaagcagcccaggcaaagaucaucuacagauucuaggaauucucuccccu

SEQ ID NO: 127936 - RNA, 64 nt, Human
uccuuccuccuggucuguuccaaaaacucugaaucaucuacauuuuaagguauuuuaccucaaa

SEQ ID NO: 127937 - RNA, 64 nt, Human
aacuugcucaaaggcuggugacuugugggccauucaucuacaaccaaguccugauggagcaaga

SEQ ID NO: 127938 - RNA, 64 nt, Human
ugcucacuuugugcagugaacaaacuacacaagucaucuacaagagcccugaccacagggugag

SEQ ID NO: 127939 - RNA, 64 nt, Human
cacgccugagaguggcacuggggaaacauaacuccaucuacaccuuggauuuggacugauucuc

SEQ ID NO: 127940 - RNA, 64 nt, Human
ucccugcuacuggcuuuauugcaauauuuauuuucaucuacaauaguugcacaucuacucaacu

SEQ ID NO: 127941 - RNA, 64 nt, Human
augguuuuaucauuauguuagaaagaaggguccucaucuacauucucaaacaucuguggcugau

SEQ ID NO: 127942 - RNA, 64 nt, Human
acaguaaauauacacuuuacauucuugcucugcucaucuacacauauaaacacaguaagauagg

SEQ ID NO: 127943 - RNA, 64 nt, Human
aaucccuuaaacuugcuuuuuagggagaguccuccaucuacauuugccugugcuucaggguaau

SEQ ID NO: 127944 - RNA, 64 nt, Human
ggggaggccacaggguccaucccgucuucaggaucaucuacacugcacuaggggagccccagga

SEQ ID NO: 127945 - RNA, 64 nt, Human
ucggaaguuuccuuuuccgugggagggaggcauucaucuacagacuccaacaaggccuccagcg

SEQ ID NO: 127946 - RNA, 64 nt, Human
uagaauuuuauuaacuacaucuuuuggguucauccaucuacaaacacugauuaagggccccugg

SEQ ID NO: 127947 - RNA, 64 nt, Human
cgacauagcggcccccgcguccggguuacaaauacaucuacagauauuuucagggauugcuuca

SEQ ID NO: 127948 - RNA, 64 nt, Human
aguuguggaaagccucugcugccauggcgugucccucucggaaggcuggcugggcauggacguu

SEQ ID NO: 127949 - RNA, 64 nt, Human
acugccugagaucaugaucucuuaaaagaugagacucucggaaggguugauuguaugcgucagu

SEQ ID NO: 127950 - RNA, 64 nt, Human
uccucccgcaaagcgguuuucugacccucagggccucucggaauguaguugcucgagguaaccg

SEQ ID NO: 127951 - RNA, 64 nt, Human
aggccaccuuggaggaggaugccacgcacuuccucucucggagcccucagacaucuccagugug

SEQ ID NO: 127952 - RNA, 64 nt, Human
uuccauaccauuguggaauugagcagagaaccugcucucggaggaugccuaggagauguuggga

SEQ ID NO: 127953 - RNA, 64 nt, Human
ucacauauugaaaggcgcccgcugcucgcucuuucucucggagggugcagagcuggguuccuug

SEQ ID NO: 127954 - RNA, 64 nt, Human
ccgaucuugcauuugagcuccagccccacucauccucucggauguucugcaggcccagcaaacu

SEQ ID NO: 127955 - RNA, 64 nt, Human
gcuacccuccgagccgcgccccugucucaggcaccucucggaccucgcuguguuucacugccuc

SEQ ID NO: 127956 - RNA, 64 nt, Human
cugagcccaugacaccaaaccugccccuuggcugcucucggacucccuaccccaaccccaggga

SEQ ID NO: 127957 - RNA, 64 nt, Human
ugcacagcccucauucuuuucaugagcccgaccucucucggagcagcuucaggccucugccagu

SEQ ID NO: 127958 - RNA, 64 nt, Human
ggaggugacagcgacgccucagccgccucuguugcucucggagccccggcuuccccugcaccgg

SEQ ID NO: 127959 - RNA, 64 nt, Human
ugccaugauugugaaguucuagccacguggaacucucucggaagaacugguuguuaaagagcac

SEQ ID NO: 127960 - RNA, 64 nt, Human
uuucugccucggccuuuaaaugcugacucaccuccucucggaggaggcguccugucuucacggg

SEQ ID NO: 127961 - RNA, 64 nt, Human
acccuuagaagcacuccucgguacucccauaauccucucggagaaaaaaaucacaaggcaacug

SEQ ID NO: 127962 - RNA, 64 nt, Human
cccccuauagggcuggaaucugucuaggagcccucucucggaggccacagaggcuggggguagc

SEQ ID NO: 127963 - RNA, 64 nt, Human
gaggucuuccuucaugugguuaguuuggucuguucucucggaguuggugggcacccuaaauauu

SEQ ID NO: 127964 - RNA, 64 nt, Human
ggccauucccaaauuugggacgcggaaggagaggcucucggagcagaagaggccagauacccug

SEQ ID NO: 127965 - RNA, 64 nt, Human
gagcagaggagaauuguacauuuggggagcugaucucucggaaggguuuuaacugucaccuguc

SEQ ID NO: 127966 - RNA, 64 nt, Human
caggucccaguguucagauggggagcgaucaguucucucggaagugaaguaagugggcaggcca

SEQ ID NO: 127967 - RNA, 64 nt, Human
cguguuccuaagccccugcccgccugccugccaccucucggacuccagcuugauggaguuggga

SEQ ID NO: 127968 - RNA, 64 nt, Human
aguggaggaagugacuucacugggucucuggaggcucucggagcuugaguggcucugccccacc

SEQ ID NO: 127969 - RNA, 64 nt, Human
guugccaagaagcagacagucucccagugucugacucucggauauuuggauuugacugguguga

SEQ ID NO: 127970 - RNA, 64 nt, Human
uugguuguuugagauuccuuccuuguuaucaagccucucggacaaaagggcuaggaaaagguga

SEQ ID NO: 127971 - RNA, 64 nt, Human
gagagcuccgugucaccaggauggaagggggugccucucggaggagccuguguccaccuccagu

SEQ ID NO: 127972 - RNA, 64 nt, Human
ggagugacccgccgcccccgacccaggugcccagcucucggaaugacuguggcuccacuguccc

SEQ ID NO: 127973 - RNA, 64 nt, Human
cgcuucuaugacugugcuugcagaagaguaaacacucucggaugccgcuguccugggggagccc

SEQ ID NO: 127974 - RNA, 64 nt, Human
aggguucccgguggugugcugugaagaugucuuccucucggacccucugcugccccgggggcag

SEQ ID NO: 127975 - RNA, 64 nt, Human
acaucaaccugggcaacauggugaccucccgucucucucggaaaaaaaaaaagaaaaaagaaaa

SEQ ID NO: 127976 - RNA, 64 nt, Human
uacagauugucucagagaaaacaaaugaguuacucucucggacaagcuguagguccuaccuaaa

SEQ ID NO: 127977 - RNA, 64 nt, Human
caugugugacuuacguuccuuauguuuuauggaacucucggaacaguguuuuguuuuuguuuag

SEQ ID NO: 127978 - RNA, 64 nt, Human
uccacgagggagcuccuggccagcagccgucauccucucggaccagccagcugguccucuggga

SEQ ID NO: 127979 - RNA, 64 nt, Human
accccaauuugugcuucagggggauaaucuccuucucucggaucauugugauggaugcuggaac

SEQ ID NO: 127980 - RNA, 64 nt, Human
cugggagcccucgggaaaccucccccgacgcucucucucggaacucccgcacccuccuuucuca

SEQ ID NO: 127981 - RNA, 64 nt, Human
cuucucuacuccuuugcuccauaguguuaaccuacucucggagcugccuccaugggcacaguaa

SEQ ID NO: 127982 - RNA, 64 nt, Human
cuucaggcugagcagagaggcuccuguacccucucucucggaaucugaagagccagauuuaggc

SEQ ID NO: 127983 - RNA, 64 nt, Human
aagggugagcaucucugcugagacaguccuuuugcucucggaggccagggaagaugguacuuag

SEQ ID NO: 127984 - RNA, 64 nt, Human
cacucauuccaggucccagagcaaacucucucugcucucggagccugugacacuggcuaugugc

SEQ ID NO: 127985 - RNA, 64 nt, Human
aaucaggacagaccaccgugcgacacccaggaggcucucggauggggcgcgccugcgcccucag

SEQ ID NO: 127986 - RNA, 64 nt, Human
uagagcugugaaugaggccaaccagauuuccacucucucggagcucacuuuauuuuuauugguu

SEQ ID NO: 127987 - RNA, 64 nt, Human
accaaccuaugucccuggaccuccuggugucugccucucggagucugugcacaucugcucacag

SEQ ID NO: 127988 - RNA, 64 nt, Human
ggucccccucgggcuccaggcccccacugagacccucucggaggcagaagcacuucaccccuca

SEQ ID NO: 127989 - RNA, 64 nt, Human
accgcuguuuucuuuugccgaacgaugguugcaucucucggacacaguguacccccucccaagc

SEQ ID NO: 127990 - RNA, 64 nt, Human
acacguucuagcucauucuuggccucgcagaaaacucucggauggcaacauuaaguccuaccuc

SEQ ID NO: 127991 - RNA, 64 nt, Human
accugcaccacggcuccuagagacgcugaccuggcucucggaaacgcaggaguccuuccuggua

SEQ ID NO: 127992 - RNA, 64 nt, Human
uggggucccgcggccgcuucuucaucucaggaaucucucggaccgcggauccucagcccccgcu

SEQ ID NO: 127993 - RNA, 60 nt, Human
uuggguuaacugcacuuugacaaaugugaacucucggaaauaguaugguggugaaacuug

SEQ ID NO: 127994 - RNA, 64 nt, Human
uaauccuuuguucccagacacacaaccccucuagcucucggaggggcgaucaugagaaaccuuc

SEQ ID NO: 127995 - RNA, 64 nt, Human
ggagaucgccuuccugcgcuccaugcugggaaagcucucggagaagaucgaccagcuagagaag

SEQ ID NO: 127996 - RNA, 64 nt, Human
aaagaaaccgucuuugcguuacacccgagucugccucucggagcagggagcucaccuuccgcga

SEQ ID NO: 127997 - RNA, 64 nt, Human
augagugcaaagucuguuuuccccaccaacuuagcucucggaaagaugugcuggagggacccuc

SEQ ID NO: 127998 - RNA, 64 nt, Human
gucucagagccaucuggaugagugucccgacacccucucggaugcagggcaggaccacccagcu

SEQ ID NO: 127999 - RNA, 64 nt, Human
gguucaugcagcccaacaaaugauuguugagcaccucucggagccaaaguccuuaggcgagugu

SEQ ID NO: 128000 - RNA, 64 nt, Human
gcucugggaaauagacaggagugguauuuccgcccucucggagggcugguguucaccaaguuuc

SEQ ID NO: 128001 - RNA, 64 nt, Human
aguagaguggagggaggguggccuaagaguugagcucucggaacugcaugcugcuggacaguau

SEQ ID NO: 128002 - RNA, 64 nt, Human
uaauugugcgagcucaauucacuuuguaagaaaacucucggagaaauaaaaucaauaaaaagca

SEQ ID NO: 128003 - RNA, 64 nt, Human
guuguuauggaaacuguugccagagauggagguucucucggaguaucugggaacugugccuuug

SEQ ID NO: 128004 - RNA, 64 nt, Human
gcaagccagacacacuuccucuugagaccucguucucucggagugagccaaacacacuucccaa

SEQ ID NO: 128005 - RNA, 64 nt, Human
uguggccaccuggggcucagguacacaguggggucucucggaagccaccgugugguucuuucac

SEQ ID NO: 128006 - RNA, 64 nt, Human
gaguggagcugcuuuauugcccuuggagcccgcgcucucggaggcugucuucugucgccaaggg

SEQ ID NO: 128007 - RNA, 64 nt, Human
ucuuugggacuucagaggaaaucucccagucccacucucggaggguuaagagaaggccuccugc

SEQ ID NO: 128008 - RNA, 64 nt, Human
aagcugcagaagacauugcauaccagcucucaugcucucggaacaucaccugccugccggcagg

SEQ ID NO: 128009 - RNA, 64 nt, Human
cggggaucccgcgccccccuccucacuugcgcugcucucggagccccagccggcuccgcccgcu

SEQ ID NO: 128010 - RNA, 64 nt, Human
uggcagccccaggccugguccugggugcauaggucucucggacccacucucugccuucacaguu

SEQ ID NO: 128011 - RNA, 64 nt, Human
ccgcugacucaggucuccgccaugcacgcguggacucucggaugagcucagcagaaccgcacag

SEQ ID NO: 128012 - RNA, 64 nt, Human
cacccacagugugcucuggcugcugggagcccaucucucggagaaacccuguccacccaacccc

SEQ ID NO: 128013 - RNA, 64 nt, Human
cagaccccagggcagggugggcagccuaugggggcucucggaaauggaaugugccccuggccca

SEQ ID NO: 128014 - RNA, 64 nt, Human
aagaauagucaccaggguuacucagaccugccagcucucggaguccuuggugguugaacuugga

SEQ ID NO: 128015 - RNA, 64 nt, Human
guagagaugggguuucuccauguuggucaggcugcucucggacuccugaucucaggugaccugc

SEQ ID NO: 128016 - RNA, 64 nt, Human
agugcugggagcaggugagccacaggcaacucuucucucggaaccugcacacaaacuggggcua

SEQ ID NO: 128017 - RNA, 64 nt, Human
ccuaggagucagcucuccuuuccuugcugaggugcucucggaacccuggcgucucuccaccagc

SEQ ID NO: 128018 - RNA, 64 nt, Human
ggagaaccgaaaccccccccccccccccgccacccucucggacaguuauucauucucuuucaau

SEQ ID NO: 128019 - RNA, 64 nt, Human
ucagagcguguucugccugagacccccgugagggcucucggagaaaguguguguauuccuuucu

SEQ ID NO: 128020 - RNA, 64 nt, Human
gauggcagccucaggacacacaccccugccucaaggugcugagcccccgccuugcacugcgccu

SEQ ID NO: 128021 - RNA, 64 nt, Human
cagcccugggcccuucagcagcagcauggaggagggugcugaaccucgggaacgagcuauccua

SEQ ID NO: 128022 - RNA, 64 nt, Human
aucaaguuucucaaccuuuauuuuuaaugaaggaggugcugaguuuuguaucuuuuuaaucaua

SEQ ID NO: 128023 - RNA, 64 nt, Human
cagggacaaacaucguuggggggugagugugaaaggugcugauggcccucaucuccagcuaacu

SEQ ID NO: 128024 - RNA, 64 nt, Human
ucaaguaacauuggagcucugggacaauggcgcaggugcugauucugucaagaaugauggcauc

SEQ ID NO: 128025 - RNA, 64 nt, Human
ccccuaccuaaaacauucuccucggaaauuacauggugcugaccacaaaguuucuggauguuuu

SEQ ID NO: 128026 - RNA, 64 nt, Human
uuugcagaaucugcaccuacagcucaauacggguggugcugauuauuauaguacauauaccaug

SEQ ID NO: 128027 - RNA, 64 nt, Human
cauuuuaaucuuguucucucccuacuguguugguggugcugaugaaucugccagaguugaguuc

SEQ ID NO: 128028 - RNA, 64 nt, Human
ccuuuucccauucauucacaaauaaauuacaaugggugcugagaacuuaacuuuccuuaagucu

SEQ ID NO: 128029 - RNA, 64 nt, Human
gaggagcacggaggagaaggacuggcagaucccaggugcugaagaugugugucagccugaggcu

SEQ ID NO: 128030 - RNA, 64 nt, Human
ugucgcccgggcuggagugcugugagcuguccguggugcugaauucacugugacgucacuccug

SEQ ID NO: 128031 - RNA, 64 nt, Human
cuguauugauaauguacucacucaugcuguacuaggugcugaagccuggacacccuuggugggu

SEQ ID NO: 128032 - RNA, 64 nt, Human
uuauuccuugcaucuuugggucuacugagcagugggugcugaggugacaggggaggaaccaguu

SEQ ID NO: 128033 - RNA, 64 nt, Human
cucugccauagagcuaacuggggucuauaugcugggugcugagacacugaucccccucauuuga

SEQ ID NO: 128034 - RNA, 64 nt, Human
ggagggaggagaaagccgaagcgaaaggggucagggugcugaggcaacagcagcaagggcuggu

SEQ ID NO: 128035 - RNA, 64 nt, Human
ccccccauccuugaggccugucacccacacaguaggugcugagaguuaggacaggucaggaagu

SEQ ID NO: 128036 - RNA, 64 nt, Human
uucuguggugggaagaggcuguguguccaaggauggugcugaaaucacugccuuaaggucucug

SEQ ID NO: 128037 - RNA, 64 nt, Human
ugcuguuagcccucucucaggcugcuguucugugggugcugagagcugccccccaucaccacgc

SEQ ID NO: 128038 - RNA, 64 nt, Human
cagguucuugggagcgugaggcaggaagacacuaggugcugaaucuccugcaaaacuggcugcc

SEQ ID NO: 128039 - RNA, 64 nt, Human
uuuccucuccagccgaugggcuggagcugggagaggugcugagcuaacagugccaacaagugcu

SEQ ID NO: 128040 - RNA, 64 nt, Human
auuaaggcaaaaaaccaaagcaaaacaaauacauggugcugaaauuaacuugaugccaagccca

SEQ ID NO: 128041 - RNA, 64 nt, Human
gcaagggcucagaaaacagaaauacugucauggaggugcugaacacagggaaggucugguacau

SEQ ID NO: 128042 - RNA, 64 nt, Human
cuaggaguugaguacagugaggaggguggaggaaggugcugagcuuagccuugugcccugcccc

SEQ ID NO: 128043 - RNA, 64 nt, Human
uccuucuggcagggaccuggcuggggaacguucuggugcugauggugcugggaccuauauguau

SEQ ID NO: 128044 - RNA, 64 nt, Human
gccuucuagauucaggugacuauccuuaccugggggugcugaugcauccucaguuaaccuacac

SEQ ID NO: 128045 - RNA, 64 nt, Human
ugacuguacagaaggauccugguugcuaccagugggugcugauucagcaucacaagugacugaa

SEQ ID NO: 128046 - RNA, 64 nt, Human
gugaaguaggugggacaaguauaaggggaagaggggugcugaauuuuuaggccaaagacugaua

SEQ ID NO: 128047 - RNA, 64 nt, Human
caagcaacuuucugcuacauacuuacuccgguugggugcugacuucagggacaggaaaaagcaa

SEQ ID NO: 128048 - RNA, 64 nt, Human
cacucuuuccaccucucuccaggcauuauccccaggugcugaaauggcuguggccccagcaccu

SEQ ID NO: 128049 - RNA, 64 nt, Human
cgagugaaugccagugugcugaugggcguacgcuggugcugaguagaugcgcagccccaucugu

SEQ ID NO: 128050 - RNA, 64 nt, Human
gaaauaaaaugacuggcgugaugccuggaaccaaggugcugauccuaccaccuacugcuaccuu

SEQ ID NO: 128051 - RNA, 64 nt, Human
acauuuuauaggucagagugugacuucuuaauauggugcugauguuuuugugucaauggcuuga

SEQ ID NO: 128052 - RNA, 64 nt, Human
agcugguauagaagggaauggguaggaggcacugggugcugacucauucagcacugucccuuuu

SEQ ID NO: 128053 - RNA, 64 nt, Human
ggagaaggaaagccuauagucgagugccugcuuaggugcugaggucacaggggagaugguggaa

SEQ ID NO: 128054 - RNA, 64 nt, Human
uugaaagagaggccuuaggauucuccucucucuaggugcugagcccucaccucccuguuccagg

SEQ ID NO: 128055 - RNA, 64 nt, Human
ugcaacaaagaauuauccagacaaaaauaucaauggugcugagguugagaaaaccugacuuaag

SEQ ID NO: 128056 - RNA, 64 nt, Human
ucgugggagagccugggcaggaucccaucagaaaggugcugacuaaacugguugcccggacacu

SEQ ID NO: 128057 - RNA, 64 nt, Human
ccaguccgucucccccugcaugccccaugugggaggugcugagcuccaaaccagcaucacacca

SEQ ID NO: 128058 - RNA, 64 nt, Human
uguuuucuuuuaccgugaugcaccaguaugagauggugcugacacuuucuaugaagugguuaug

SEQ ID NO: 128059 - RNA, 64 nt, Human
aauaacaacagaaaauacaacuccugggaaaaaaggugcugauucuauaagauuauuuauauau

SEQ ID NO: 128060 - RNA, 64 nt, Human
uugcaaacaaacugaauguacaaaucuuagugcuggugcugaaaucucuucagaauagucauca

SEQ ID NO: 128061 - RNA, 64 nt, Human
uuaaaggagauuccucagacucauccagcccuugggugcugaccagcagagucacuaguggaug

SEQ ID NO: 128062 - RNA, 64 nt, Human
ggauucggcauggagcccucagcuggcggcucugggugcugacggccgcuggagaggugggcuc

SEQ ID NO: 128063 - RNA, 64 nt, Human
uugacacugccggcuuccuuccauccagcgagguggugcugacaguguggacuugagcacacuu

SEQ ID NO: 128064 - RNA, 64 nt, Human
gcgaagaugauuuuuaagagaugaagaaggaugaggugcugacccagugagggugccuucugcu

SEQ ID NO: 128065 - RNA, 64 nt, Human
ucuucaagggcugcuucuacacccaccccaccgaggugcugaagccugucagccagcaccccag

SEQ ID NO: 128066 - RNA, 64 nt, Human
aggcugcucuucugauucugagagcuggccuaguggugcugagggccccuuucugcuucucugc

SEQ ID NO: 128067 - RNA, 64 nt, Human
aagugccucagcaucuguaugauauaguggagcaggugcugacauagguaccagcugacaugau

SEQ ID NO: 128068 - RNA, 64 nt, Human
uucgucuacauuuucuuagugucauuuucacgcuggugcugagacaggggcaaggcugcuguua

SEQ ID NO: 128069 - RNA, 64 nt, Human
cucuucccucaucaucuuguugugggcaugaggaggugcugaugucagaagaaauggcucgagc

SEQ ID NO: 128070 - RNA, 64 nt, Human
uccugaacaugaugaccuagaggcccgagcgccuggugcugagugcacccggaggggucaucgc

SEQ ID NO: 128071 - RNA, 64 nt, Human
ucauugcuuggcccuucaagcaaccuagcuaaaaggugcugauauuuuauuuaguacugccaac

SEQ ID NO: 128072 - RNA, 64 nt, Human
ucagucccaagaagaucaaacucagcaguacuugggugcugaagaacuguuggauuuacccugg

SEQ ID NO: 128073 - RNA, 64 nt, Human
ccuaugugcuuauguguagcuuuuuacuuuuuauggugcugauuaauggugaucaagguaggaa

SEQ ID NO: 128074 - RNA, 64 nt, Human
gggagggggguaggcugggccgggaacuguccgaggugcugagcuggggcgggaccggaauccu

SEQ ID NO: 128075 - RNA, 64 nt, Human
aagaugcuuuuugaucuaccuagguggaguugguggugcugauauuuaaauucaggcuacugcu

SEQ ID NO: 128076 - RNA, 64 nt, Human
ugugucugugcacuucccacagacuggaguuuuuggugcugaauagagccaguugcuaaaaaau

SEQ ID NO: 128077 - RNA, 64 nt, Human
ggcacccugaauuagcaaaaauggggggugaugaggugcugaagaaggauacuuaacagcuuag

SEQ ID NO: 128078 - RNA, 64 nt, Human
gccgcauuuaggcccugucagcugugaggccacuggugcugagucagagggaaaagcucagaac

SEQ ID NO: 128079 - RNA, 64 nt, Human
aaggccccauagugcauaggaacaguaaagccagggugcugacgugugugugugugugugugug

SEQ ID NO: 128080 - RNA, 64 nt, Human
gaagugcucccaguucagaacaagggcagcccguggugcugaccuaggauauaacaaagcucuu

SEQ ID NO: 128081 - RNA, 64 nt, Human
cuagaaccugguagcguguguguguguggcggggggugcugagggaggggagugagucacagga

SEQ ID NO: 128082 - RNA, 64 nt, Human
ccagugaccucauucccgagcagcccugcucuggggugcugagugagcuggugaccacccacca

SEQ ID NO: 128083 - RNA, 64 nt, Human
gcuuaccagccccaccccaccaugguagccuuagggugcugagugccugauacugccugacaag

SEQ ID NO: 128084 - RNA, 64 nt, Human
ugaagcaggcuaaaagcucuugaugaaauuugagggugcugaagauguucccacuaauuuccag

SEQ ID NO: 128085 - RNA, 64 nt, Human
aggagcuuguuuugcugaagauuucuccauuccuggugcugagaauaaaggcaaccaguagcca

SEQ ID NO: 128086 - RNA, 64 nt, Human
gacuuuuaugccagaaacuuucccagcaagguagggugcugagaauccuacccuuccuugcugu

SEQ ID NO: 128087 - RNA, 64 nt, Human
acugccauuuaggacugauggcccuaauuuuugaggugcugauuuagaggcaaaauugcagaau

SEQ ID NO: 128088 - RNA, 64 nt, Human
caguccugcagcagcagcccccacccccaagcuuggugcugagcccuggugaggagcugagggg

SEQ ID NO: 128089 - RNA, 64 nt, Human
ggcgaggcuggagggcagggugagccuccacaugggugcugaagcaagaaaccgacagauguug

SEQ ID NO: 128090 - RNA, 64 nt, Human
cacaccuggcacugcugugcugugcccaaguuguggugcugacaaagcuuggaagagccugcag

SEQ ID NO: 128091 - RNA, 64 nt, Human
ugacugucccccagcccgacaccuguaaagggucggugcugaggaggaauagugaaggagggag

SEQ ID NO: 128092 - RNA, 64 nt, Human
agugaccuuauuucugcuuuucugagcuaagaauggugcugaugguaaaguuugagacuuuugc

SEQ ID NO: 128093 - RNA, 64 nt, Human
ugacccgccccuugacccaagccugugaugacauggugcugauucuggggggcauuaaagcugc

SEQ ID NO: 128094 - RNA, 64 nt, Human
uaaaacuuacaugaucuguacuuccacgugacugggugcugaggggaguuaaagccucccuggu

SEQ ID NO: 128095 - RNA, 64 nt, Human
agauuaaauauuauaauuugagguuuuggggacuggugcugauuccaaaaaguuaauuuaauaa

SEQ ID NO: 128096 - RNA, 64 nt, Human
ugacagcaaacagaucacuaggccucugaccacaggugcugaguacucagcagcccucauauaa

SEQ ID NO: 128097 - RNA, 64 nt, Human
gggugcgagaugugguuuccagccuggugccuggggugcugagcuagugaguggugcaguccag

SEQ ID NO: 128098 - RNA, 64 nt, Human
augagacucacaguuggaguucuccagcucuggaggugcugaaggagcugcauuaauucuggaa

SEQ ID NO: 128099 - RNA, 64 nt, Human
aaaauaagacaaaaauaauaguuuuagugaggauggugcugaguaaacauaaaaacugauuugc

SEQ ID NO: 128100 - RNA, 64 nt, Human
ucguagaucuuuagcuacuuuggggaggagggaaggugcugauaccuucaauuuguuacuuuuc

SEQ ID NO: 128101 - RNA, 64 nt, Human
uuuaaaguuuuguuuaaguagagcuggaauuugaggugcugaucuguggucuacaguuaugugg

SEQ ID NO: 128102 - RNA, 64 nt, Human
uucccaguacugucauggagcagagcaggcagugggugcugaugugugugcaugagcuguaugu

SEQ ID NO: 128103 - RNA, 64 nt, Human
ccugucaguguuuuugaaacccacaguuuuaguuggugcugauggagggagggggaagucgaag

SEQ ID NO: 128104 - RNA, 64 nt, Human
gugugucagagcuagggugggggugcccgauucgggugcugaauguaaggaggggagccuccaa

SEQ ID NO: 128105 - RNA, 64 nt, Human
gaguuugcagaguucagcaauaugauagggaacaggugcugaugggcccaagagugacaagcau

SEQ ID NO: 128106 - RNA, 64 nt, Human
agagacuugccccuuuugaagaucauuucuacuuggugcugaugaauuuaugccuagcuuuuuu

SEQ ID NO: 128107 - RNA, 64 nt, Human
uguaauaacagccuuugagacuuggcacaacuauggugcugagaaugaaaaucuaaaugauuga

SEQ ID NO: 128108 - RNA, 64 nt, Human
ugaagcucgcugguucugugcgaaggguauuccuggugcugaauaaaggguguugcugucaagg

SEQ ID NO: 128109 - RNA, 64 nt, Human
gaagcacccauuaugcgcuguggccacuccaauaggugcugaguguacagaguggaauaagaca

SEQ ID NO: 128110 - RNA, 64 nt, Human
uaauauuccaaaauagaguuccuuuugaucuguuggugcugagccuugguuaaaccagggagaa

SEQ ID NO: 128111 - RNA, 64 nt, Human
aauuauaaacuguauauuaaauagauauuuuuugggugcugaaucaauuuuauuuaaauuugug

SEQ ID NO: 128112 - RNA, 64 nt, Human
gugccccagccuggaccccuggggcucagauagaggugcugagccccugugucaaaguuguuaa

SEQ ID NO: 128113 - RNA, 64 nt, Human
ggcuuuccccauuucccaaccccucugggccuuaggugcugaggccccugccaccugucuuucc

SEQ ID NO: 128114 - RNA, 64 nt, Human
aagauugguuaaacaguuuuguguagaucuuuuuggugcugaacuaugacaugagccuuauaga

SEQ ID NO: 128115 - RNA, 64 nt, Human
uagaguauauuuuuuguuuauuaauaaugaaauuggugcugacauguaaugacuucacaaguuu

SEQ ID NO: 128116 - RNA, 64 nt, Human
uguuuguaauuucucuuuuuuuccuuuuuuauuuggugcugaauauguccuuguaggcucuguu

SEQ ID NO: 128117 - RNA, 64 nt, Human
gauuuugucuaccauuuguguuuugaaagcccaaggugcugaugucaaaguguaacagauauca

SEQ ID NO: 128118 - RNA, 64 nt, Human
uuucugcaguuccaucaggucccccccaggugcaggugcugacaauacugcugccuuacccgcc

SEQ ID NO: 128119 - RNA, 64 nt, Human
guccaugaaacuucagauaaacuagggaaaacugggugcugaggugaaagcauaacuuuuuugg

SEQ ID NO: 128120 - RNA, 64 nt, Human
acuggcagcuucuccuccagacuccuagccccgaggugcugauggagaugcucaaggccagcaa

SEQ ID NO: 128121 - RNA, 64 nt, Human
agcugggucuccagaucccauuuagaaccaaccaggugcugaaaacacauguagauaauggcca

SEQ ID NO: 128122 - RNA, 64 nt, Human
aggugcuggggcugcuggggggaguuaucaugauggugcugauugcccaccuugagugaggggu

SEQ ID NO: 128123 - RNA, 64 nt, Human
gccacaugccgcgucccugccccgacccgggucuggugcugaggauacagcucuucucaguguc

SEQ ID NO: 128124 - RNA, 64 nt, Human
uaugaaauuuuuaauacaaaaaauaauccauuuaggugcugaguuacggucccaucucuucaca

SEQ ID NO: 128125 - RNA, 64 nt, Human
cuccagccccuaggggaugcaugaggggggagggggugcugagugggaggaagagucaggcuca

SEQ ID NO: 128126 - RNA, 64 nt, Human
cgccagauuugaaacagugagaggucccacaucuggugcugaaacucagagcaacaguucagag

SEQ ID NO: 128127 - RNA, 64 nt, Human
caucacccauguugagaccucagcuuggcacucaggugcugaaggguaauauggacucagccuu

SEQ ID NO: 128128 - RNA, 64 nt, Human
uauugggcaccuacuaugugccaggcacuguguaggugcugaaaaguggccaagggccaccccc

SEQ ID NO: 128129 - RNA, 64 nt, Human
cacuccagaggcacaggagggucaccaggccugcggugcugaauucacacuugccuugacuuuc

SEQ ID NO: 128130 - RNA, 64 nt, Human
cuugccugcccgugggcacccacggacguggcuuggugcugaggauagcagagcccccagccau

SEQ ID NO: 128131 - RNA, 64 nt, Human
uauccugcccuugggagcacagacaggcuccuagggugcugagugaagccugaagaccaagccc

SEQ ID NO: 128132 - RNA, 64 nt, Human
gcucugucaccagggguacuccacaggaggagcaggugcugacuuucaggucccuggaccccag

SEQ ID NO: 128133 - RNA, 64 nt, Human
gaagugcaggggguccugggcacauugccagcugggugcugagcauugagucacugaucucuug

SEQ ID NO: 128134 - RNA, 64 nt, Human
gaagagagcggccaucucggaucauaaucuccuuggugcugauuaacugacgagauauaugauu

SEQ ID NO: 128135 - RNA, 64 nt, Human
acacugcuguugccuuauuaguuauaacaugauaggugcugaauugugauucacaauuuaaaaa

SEQ ID NO: 128136 - RNA, 64 nt, Human
uugugaacauguggaagaaaaucagugggauucuggugcugaugaauagguugccuucagagua

SEQ ID NO: 128137 - RNA, 64 nt, Human
ggaccgaaggggacaaguuccccuuucauccuuuggugcugaguuuucuguaacccuugguugc

SEQ ID NO: 128138 - RNA, 64 nt, Human
uaaauguuguguuuucagaaaaagacaaaacgauggugcugacugguuuucuguauauugcaca

SEQ ID NO: 128139 - RNA, 64 nt, Human
cuugagggucacugguggaccaugcuaguauuuuggugcugaguaauuagauuauguauagggg

SEQ ID NO: 128140 - RNA, 64 nt, Human
aaacacuuucccaugagugugauccacauuguuaggugcugaccuagacagagaugaacugagg

SEQ ID NO: 128141 - RNA, 64 nt, Human
ccaucacccuguggugcggccucaaccacucccuggugcugagccagagcucagaguucagcaa

SEQ ID NO: 128142 - RNA, 64 nt, Human
gauagaagauguugaaaaguuaacauaagcauugggugcugacuuacccuuucauguacuucca

SEQ ID NO: 128143 - RNA, 64 nt, Human
gucugccagcugagaugcuccucgggcuggcccaggugcugaccuugccacaggcagaugaaug

SEQ ID NO: 128144 - RNA, 64 nt, Human
uuaagaacaaacucugaaagaccuaugagcaaauggugcugaauacuuuuuuuuuaaagccaca

SEQ ID NO: 128145 - RNA, 64 nt, Human
aaaugcaaaagaaguggcauaggaguguguuaugggugcugaacucucucucuuuuuccccgau

SEQ ID NO: 128146 - RNA, 64 nt, Human
cagugaaaagggagaagagccaaaguauugucuaggugcugaguucccuuuucugaguggauuu

SEQ ID NO: 128147 - RNA, 64 nt, Human
gguggugggcaccugggagccaugcagaggcuguggugcugaguuagacuccagguacuuugug

SEQ ID NO: 128148 - RNA, 64 nt, Human
ccugggaccaguggcagggaccccggaaccugaaggugcugacaaagaugaccugcugcuguug

SEQ ID NO: 128149 - RNA, 64 nt, Human
acccagccccugugguagccccagcaguucucagggugcugaccucucucucccacagacccca

SEQ ID NO: 128150 - RNA, 64 nt, Human
acuuuaaguagaaauggcaaaguugcuuuguuggggugcugauacugaugauuuuaggauaaau

SEQ ID NO: 128151 - RNA, 64 nt, Human
cugagcaguaguggcugcugugauguaaacuuagggugcugagauaagcaauuagcucuagccu

SEQ ID NO: 128152 - RNA, 64 nt, Human
ugccuguugugucugguggcuggaacauggcaguggugcugagacauggggaggguuggagacu

SEQ ID NO: 128153 - RNA, 64 nt, Human
augguggcaugcacauguagucagagcuacugggggugcugaggugggaggaucgcuugagccc

SEQ ID NO: 128154 - RNA, 64 nt, Human
uugucacagauguguuaauuuuugaagcaaugugggugcugacuacuaguaguaucaaaaauau

SEQ ID NO: 128155 - RNA, 64 nt, Human
gcaggagacaaaggauuccaaaaagagauguggaggugcugagggcaccucuaucucuuuguug

SEQ ID NO: 128156 - RNA, 64 nt, Human
aaaacuuagaagguuuaacacuucacugauuaauggugcugaaaacacguuacaauuaccacau

SEQ ID NO: 128157 - RNA, 64 nt, Human
cuguguccucuuccaccacagagggcgugugcucggugcugacgggacccacaugcuccagauu

SEQ ID NO: 128158 - RNA, 64 nt, Human
caaacaaaaaaccuucaacugccuuaugcccuuaggugcugaguuucauuaaguacugucacgu

SEQ ID NO: 128159 - RNA, 64 nt, Human
uaccuuacaccaaguguagaucauuuaugggauuggugcugauugaaagaacaaaacaaaacaa

SEQ ID NO: 128160 - RNA, 64 nt, Human
auuuuccagagccccagagccagcucaucuuccaggugcugaaaccacuuuccaaauaaacuaa

SEQ ID NO: 128161 - RNA, 64 nt, Human
gggguugaaguuuggagucuguccgaguuugcagggugcugagcuguaugguccagcaggggag

SEQ ID NO: 128162 - RNA, 64 nt, Human
cuucacacaguuucccuacuguauguagaauccaggugcugaaaccaaguguuucuuuucccau

SEQ ID NO: 128163 - RNA, 64 nt, Human
agauuauaaaagccaaauaguuuuuaaagaucucggugcugaacgacagucccaguucccauuu

SEQ ID NO: 128164 - RNA, 64 nt, Human
gaacacacagcacagaggguaggggggcccucuaggugcugaaucuacacaucuguggggucuc

SEQ ID NO: 128165 - RNA, 64 nt, Human
uaauuuguguaaaaaacacaccuucaccuuacaaggugcugaccauauuaaauguucagguucu

SEQ ID NO: 128166 - RNA, 64 nt, Human
uuucagaccugccuuuggggggcgugcauguguuggugcugaccuccaggccgagaugugcaac

SEQ ID NO: 128167 - RNA, 64 nt, Human
ggggcaagaggguggaagguuucuuuggacaggaggugcugaggcuggcugcaccugcucucug

SEQ ID NO: 128168 - RNA, 64 nt, Human
acaaacacaaaauaaaaaacaaaacacagacaacggugcugauucuggugugguuucuacucac

SEQ ID NO: 128169 - RNA, 64 nt, Human
uuuaccugauuugcagucauaaacacugcacuuuggugcugacacuggguccagagugagcauu

SEQ ID NO: 128170 - RNA, 64 nt, Human
gggacagaacaguaguccuggacucgaaagggaaggugcugaccaguggggccuuagcaauuug

SEQ ID NO: 128171 - RNA, 64 nt, Human
auucugagcaguguagacucagggucccuguggaggugcugaagcccacaguuccacacagggc

SEQ ID NO: 128172 - RNA, 64 nt, Human
aggcugcccuugcagcgccgcaggaacucggccaggugcugaucggugagguggccuggggagg

SEQ ID NO: 128173 - RNA, 64 nt, Human
ugaucccaucagugcccggcacucccuucacccaggugcugacgugccgggguugagcuggcac

SEQ ID NO: 128174 - RNA, 64 nt, Human
uggagggugggaggcaucuuggccugcaguaagcggugcugacggggacucuggccacagaggu

SEQ ID NO: 128175 - RNA, 64 nt, Human
uucauggggaaaggacaaaauggagagugacugaggugcugaccucagugcaaggcuggugaac

SEQ ID NO: 128176 - RNA, 64 nt, Human
auguguugaagaugaaauuggcaucaguguagacggugcugauugggaaaaguucaugauuagg

SEQ ID NO: 128177 - RNA, 64 nt, Human
cauaccuucgggguacaagucaguuucuacacugggugcugauccuugcacgcgcccuuucuac

SEQ ID NO: 128178 - RNA, 64 nt, Human
cagcuuucagagguacuauggcaguuuugccucaggugcugaacauuucucagcccuggcuaaa

SEQ ID NO: 128179 - RNA, 64 nt, Human
ucagcgugacgugaccucucuguuucugcuugcuggugcugaagaccaagggucccccuuguua

SEQ ID NO: 128180 - RNA, 64 nt, Human
gaaagagccaugugagaagauuagaaggaacaguggugcugacacaggaccuaggguagggccu

SEQ ID NO: 128181 - RNA, 64 nt, Human
agcagccuacacuggcucugcugagcugggccugggugcugaaagccaggauuuggggcuaggc

SEQ ID NO: 128182 - RNA, 64 nt, Human
ggccaggacagauguugccccacccacuggagauggugcugagggagguggguggggccuucug

SEQ ID NO: 128183 - RNA, 64 nt, Human
cuggacggcucagccccuguuccaaggauuuuggggugcugagauucuccccuagagaccugaa

SEQ ID NO: 128184 - RNA, 64 nt, Human
cuuggaaagcacuagaaacuaaacaucuucaccaggugcugaagaaaagugucuucguuuuaau

SEQ ID NO: 128185 - RNA, 64 nt, Human
accuuucuuugacauaauuguucauaucaaugaaggugcugaccagcucaauacaaaguuaagc

SEQ ID NO: 128186 - RNA, 64 nt, Human
cugaagaauagguuacaaaaaauaaacuccauuuggugcugaaaguugugaauagaugguggaa

SEQ ID NO: 128187 - RNA, 64 nt, Human
ugcucaggcugguuuugaacuccuggccucccaaggugcugauaguacaggcaugaaccacugu

SEQ ID NO: 128188 - RNA, 64 nt, Human
ucacccuuugaacaacucauggacgugagggaugggugcugagcagaaccaagagaggaaacuu

SEQ ID NO: 128189 - RNA, 62 nt, Human
cugcugagcgggacuggugacccauggcugggggugcugaggagagccgaguuggacuggcu

SEQ ID NO: 128190 - RNA, 64 nt, Human
agagaugugggcuuccuuuuugagucuuguguuaggugcugagaccuuuuacaugggcuuauac

SEQ ID NO: 128191 - RNA, 64 nt, Human
uauuuucucauuuauguuugaacaacauguucguggugcugaaugccucucagcaucaucaagg

SEQ ID NO: 128192 - RNA, 64 nt, Human
aaguggugagaaguuugccuagaaagggcuucccggugcugauggagaggccgagacccuucug

SEQ ID NO: 128193 - RNA, 64 nt, Human
agugaacacuuguuuagugucacucaguuugcuaggugcugauauguacguauaucucaaugug

SEQ ID NO: 128194 - RNA, 64 nt, Human
uuguaaucuagcuuaaagaaauguuaacugggagggugcugaggccacucacugcauuaauuuu

SEQ ID NO: 128195 - RNA, 64 nt, Human
agccccgucuggacgagccuugccugaccucuucggugcugaccuucccaaagugaugccuuac

SEQ ID NO: 128196 - RNA, 64 nt, Human
gcagagaaaacagcaauagugaaugaaugcaaaaggugcugagaaauuccacacaugaguauug

SEQ ID NO: 128197 - RNA, 64 nt, Human
ucugggacuugccagcucagcccguuaggaugagggugcugagaggaaacaggaaacaagacug

SEQ ID NO: 128198 - RNA, 64 nt, Human
ugguugccaggacgaauugagauaauaucugugaggugcugaugagugauugacacacagcacu

SEQ ID NO: 128199 - RNA, 64 nt, Human
cauacauuuaucagcauaacugcccaguuuuuuuggugcugaaguacuguaaguagaauucauc

SEQ ID NO: 128200 - RNA, 64 nt, Human
acuugacacggguuguacagaaacugguauuuuuggugcugauacaagagaaauguauuuuuaa

SEQ ID NO: 128201 - RNA, 64 nt, Human
augguggcaugcaccuguagucccagcuacuuggggugcugaggcgggaggauuacuugagccc

SEQ ID NO: 128202 - RNA, 64 nt, Human
cagacuucaguaaucuuuugaaccagacguggauggugcugaauuguugcuuggauggaaaaag

SEQ ID NO: 128203 - RNA, 64 nt, Human
cuuuuguaauguuuuucauguuacugccuagggcggugcugagcacacagcaaguuuaauaaac

SEQ ID NO: 128204 - RNA, 64 nt, Human
gagagacaugccuguaguuacauccagugugaugggugcugagaggcaaguacaaaccacgaug

SEQ ID NO: 128205 - RNA, 64 nt, Human
aaggccagggucacugaaggccuggcccacagcaggugcugagcaaagggaacagugaggugcc

SEQ ID NO: 128206 - RNA, 64 nt, Human
guuguaccuccauuggcuuccucacuccaaaauaggugcugauccuuccuauuccuauucuuug

SEQ ID NO: 128207 - RNA, 64 nt, Human
ucuuucacccaggggugguggucccagccaguuuggugcugacggugagaggaaauuagaaucu

SEQ ID NO: 128208 - RNA, 64 nt, Human
gguggacugaagaggggcccccagcucgggaccuggugcugaucagaguggcugcugccccagc

SEQ ID NO: 128209 - RNA, 64 nt, Human
cagcaagccugcagcagcaggugcccccacgucaggugcugacugucugcuguccgcuccugua

SEQ ID NO: 128210 - RNA, 64 nt, Human
aagguuagggugagaugagaacaugccauacccuggugcugaaucccugaggggccagcuugcc

SEQ ID NO: 128211 - RNA, 64 nt, Human
gaggagcugcgccgccggcuccgcccaaccagguggugcugagcuuccgcugagcgcucuuuug

SEQ ID NO: 128212 - RNA, 64 nt, Human
agggugaagaccgcuucccugagacaggggcaguggugcugauggaaugugggggaggcccaca

SEQ ID NO: 128213 - RNA, 64 nt, Human
cuuggcauuucuucuuagaaaaaaacuaauuuuuggugcugauuggcaugucugguucacaguu

SEQ ID NO: 128214 - RNA, 64 nt, Human
ggugacgggcccauggggcggagcucguccgcauggugcugaauggcugaggaccuucccaguc

SEQ ID NO: 128215 - RNA, 64 nt, Human
aagaugagcuguaacuggugaaaaccauggggguggugcugacucagccgccuauuccccaagg

SEQ ID NO: 128216 - RNA, 64 nt, Human
cauauugacagccuccaucccugucccccaucuuggugcugaaccaacgcuaagggcaccuucu

SEQ ID NO: 128217 - RNA, 64 nt, Human
cgggggaggcugggagccggcggcaggauuagcuggugcugaacuuucucucauaggacgucgc

SEQ ID NO: 128218 - RNA, 64 nt, Human
gcuuggcacuucuguuacaagcugagagucuggaggugcugaguuuaacguggcugugcagcug

SEQ ID NO: 128219 - RNA, 64 nt, Human
cacacacagugcagcgggaacgguggggcuggcuggugcugaagacagacacacuccugagcca

SEQ ID NO: 128220 - RNA, 64 nt, Human
gacuccucgggacaagcccauggcgcugaucgcuggugcugagcccugcccugggccccacgga

SEQ ID NO: 128221 - RNA, 64 nt, Human
cugucaucccuucuccuccccucuccccacucccggugcugaggcugcaucagacccugguagg

SEQ ID NO: 128222 - RNA, 64 nt, Human
cucagagauucucauccccaaagucccaaaagagggugcugauuggugcuuuuccucaggcucu

SEQ ID NO: 128223 - RNA, 64 nt, Human
cuacugaaaaggaggggucuggguacuucuugaaggugcugacggccagggagaagcuccucuc

SEQ ID NO: 128224 - RNA, 64 nt, Human
gggauaggccuuuucuaugucuccccaaggcuggggugcugagccugccuuccucaccaccuag

SEQ ID NO: 128225 - RNA, 64 nt, Human
acagagaagggaaguaggcccuuacuucuggcagggugcugagcugacuucuaccuagccccuu

SEQ ID NO: 128226 - RNA, 64 nt, Human
gaagaagugagacucugucuuaaaaaaaaaaauuggugcugauaaauauugaugaauucugcuc

SEQ ID NO: 128227 - RNA, 64 nt, Human
auaaacgcaguaaugcaugaagagugccgggcauggugcugagcccuguuccugcucucccucc

SEQ ID NO: 128228 - RNA, 64 nt, Human
ugccuauagagauauauucacaguucaaaagucaggugcugagagaugguuuaaagacaaauuc

SEQ ID NO: 128229 - RNA, 64 nt, Human
ucugaccuucuucaaaucuuuguauuucaaagaaggugcugagggaucuguuuccuugcccugg

SEQ ID NO: 128230 - RNA, 64 nt, Human
uccaggacucaaaucaguaacuuggugauuacaaggugcugaauguguugguaaccauaucgca

SEQ ID NO: 128231 - RNA, 64 nt, Human
cuggacccugaagcugauggaaccaccuaauacuggugcugagcgccuagucacagcaggugga

SEQ ID NO: 128232 - RNA, 64 nt, Human
ucacuaaacugggcugccuuucccaaaugggaaaggugcugacagaguuggagaaaaaagaaua

SEQ ID NO: 128233 - RNA, 55 nt, Human
uaacugaaagacggacaugagcgugggugcugacuccuggaagagcaacucuauc

SEQ ID NO: 128234 - RNA, 64 nt, Human
cccagcccucaccucccccagagcuaaccugggaggugcugaaggggcauugggccaccguaag

SEQ ID NO: 128235 - RNA, 64 nt, Human
caaccgugaugccauggaacucaagcccaacggcggugcugaccaaaaaugucucaaagucaac

SEQ ID NO: 128236 - RNA, 64 nt, Human
cccgagggcccagcgaacucuucgaaaaccugcuggugcugaguccuguguggggcaccccaca

SEQ ID NO: 128237 - RNA, 64 nt, Human
uggaugagaaacgccugcgcugcucuguuagacuggugcugaaacaaaagguuaaggcuagguu

SEQ ID NO: 128238 - RNA, 64 nt, Human
cugccuuuagauccugagaaggagggaaaugaggggugcugacacagucccucugggagagcuc

SEQ ID NO: 128239 - RNA, 64 nt, Human
ccccuguucuccggguuuggaacaauacgagguuggugcugaugggauuuacuugcguacgugc

SEQ ID NO: 128240 - RNA, 64 nt, Human
aaucgguguggcuucagcuucugaggaucugccgggugcugaggucucucaaacuccuugcaca

SEQ ID NO: 128241 - RNA, 64 nt, Human
ugugccuguaacucugagggggggcacccaguggggugcugagugggcagaaucucagaagguc

SEQ ID NO: 128242 - RNA, 64 nt, Human
uagcacugacugccaguaucuguuuuaucuugcuggugcugaacauucuuugugcaacuccaug

SEQ ID NO: 128243 - RNA, 64 nt, Human
gccccugggcccaguaccuagcuggcucugugagggugcugacuggcuucagcaaguuagaacu

SEQ ID NO: 128244 - RNA, 64 nt, Human
auuuaagggagauugcaaggaagcuauuuaacauggugcugagcuagccaggacugauggagcc

SEQ ID NO: 128245 - RNA, 64 nt, Human
aacagcguggcuuagauugugcccacccagggaaggugcugaaugggacccuguugauggcccc

SEQ ID NO: 128246 - RNA, 64 nt, Human
ggcuccacagacuguccuggggcccagaggagcuggugcugaccuagcuagggaugcaagagug

SEQ ID NO: 128247 - RNA, 64 nt, Human
cagaggaggaaauccccaaggaggaugggaucuuggugcugagccgccacacccugggccuggc

SEQ ID NO: 128248 - RNA, 64 nt, Human
ccuggccugucaugcagggagagcugugcuccugggugcugaagccucgcuccugucugucccc

SEQ ID NO: 128249 - RNA, 64 nt, Human
cuaagguugcugcagucaccuuccucaucuugcaggugcugaaccaacaucaucaguuucuauu

SEQ ID NO: 128250 - RNA, 64 nt, Human
cauccccugggggagugggucagagguacuggagggugcugagccgaagggacggugggagggg

SEQ ID NO: 128251 - RNA, 64 nt, Human
aaugucacuguaguuuugaguguauacaugugugggugcugauaauuguguauuuucuuugggg

SEQ ID NO: 128252 - RNA, 64 nt, Human
cacagacaacccuucccaucuggcgggacccagaggugcugagaugggggucugggaaacacug

SEQ ID NO: 128253 - RNA, 64 nt, Human
cguuuacggagcacagucauaaguggagguucagggugcugacgaaauccaagcugcucugguu

SEQ ID NO: 128254 - RNA, 64 nt, Human
aaaccaagaccuucccauuuccuccuccccacauggugcugaggcucccugcugcaaugcaauu

SEQ ID NO: 128255 - RNA, 64 nt, Human
gcuuuguaggcugggaagaugccccugggguaggggugcugauuaccucagccauguggaggaa

SEQ ID NO: 128256 - RNA, 64 nt, Human
uauuuugcgaagagagguguucuuuuuccuuacuggugcugaaaggaaggauggauaacgagga

SEQ ID NO: 128257 - RNA, 64 nt, Human
ugacuagccuuguugccgucgaguuggagaaaguggugcugaaauccaccuuuaaccggguaag

SEQ ID NO: 128258 - RNA, 64 nt, Human
gaugggcuguguccggcccugcagccuaguggaaggugcugagggggcccugaggcaggaccgc

SEQ ID NO: 128259 - RNA, 64 nt, Human
ucauuggauccugcauuguuuuuaugacauuuguggugcugaaccuguuuaucucugucauccu

SEQ ID NO: 128260 - RNA, 64 nt, Human
gcguccugggaucaggguagacacguggagugcuggugcugagcuguuugagaagcucugugug

SEQ ID NO: 128261 - RNA, 64 nt, Human
gaccccacuucagaagguaggggccgugucccgcggugcugacugaggccugcuucccccuccc

SEQ ID NO: 128262 - RNA, 64 nt, Human
gugccgaugaccugcugcccauccuguccuucguggugcugaggagcggccucccucagcuggu

SEQ ID NO: 128263 - RNA, 64 nt, Human
ggagagcucugaccugcacaccgcgggaggccagggugcugacugucaagcauccccugucccc

SEQ ID NO: 128264 - RNA, 64 nt, Human
cuuguucacugcagcaugcccagugccacgcacaggugcugaccuauaguaagugcuuaacauu

SEQ ID NO: 128265 - RNA, 64 nt, Human
gggaagacucaggagucugccacuugucaaagaaggugcugauccuaagaauuuuucauucuca

SEQ ID NO: 128266 - RNA, 64 nt, Human
acacacccccagagagaggagggacugucacacuggugcugagugaccgggggcugcugggcgu

SEQ ID NO: 128267 - RNA, 64 nt, Human
ucaagcugaugagugagauccugaacggcaucaaggugcugaagcuguacgccugggagcccag

SEQ ID NO: 128268 - RNA, 64 nt, Human
auuauucugugcgcuaccggccgggccuagaccuggugcugagagaccugagucugcaugugca

SEQ ID NO: 128269 - RNA, 64 nt, Human
guauuguccucaucuguucugacugaaggauggaggugcugaauaaauuaggccucaggccucu

SEQ ID NO: 128270 - RNA, 64 nt, Human
gggggguggccuucaugcacuagccacuuccgcaggugcugacucccgcacucccuggcauuuu

SEQ ID NO: 128271 - RNA, 64 nt, Human
gcgcgaucuugacccuaagaccggcggccaugauggugcugaccucugguggccgaucggggca

SEQ ID NO: 128272 - RNA, 64 nt, Human
aaaaggugauauccauucuuucugauaacuagauggugcugagaagcuuuugaauaaaaacuuu

SEQ ID NO: 128273 - RNA, 57 nt, Human
uugaugcaguuuggaaauaauggugaaggugcugaacccucagcaggagggcaguuu

SEQ ID NO: 128274 - RNA, 64 nt, Human
gagggagguuggggauugugggacaaggucccuuggugcugauggccugaaggggccugagcug

SEQ ID NO: 128275 - RNA, 64 nt, Human
acucagcccauucaccaggcgcuggucucaccugggugcugagggcugccugggccccuccuga

SEQ ID NO: 128276 - RNA, 64 nt, Human
uuuuaauaaaugaaauaggcuugccuuuagaucgggugcugauauugccuguuuccuaguaaug

SEQ ID NO: 128277 - RNA, 64 nt, Human
ccuuuguagugugcuuccuugcuuccuaucggagggugcugauccagaggcucaguaaccccau

SEQ ID NO: 128278 - RNA, 64 nt, Human
ccucacugaucuguaccgggaccggaaacuucuuggugcugaagguaaggaaaggagaggacaa

SEQ ID NO: 128279 - RNA, 64 nt, Human
gggccagcagcccagccagcagcacagucucuauggugcugaggaagagcagcagcagcaggau

SEQ ID NO: 128280 - RNA, 64 nt, Human
aaagcacaugccuucacgggcaggaugaucaagcggugcugauucacgagaguggaagccucca

SEQ ID NO: 128281 - RNA, 64 nt, Human
guccccacguuucuaauuuggagcaaaucuaaaaggugcugagggauuggacagcucugacuuu

SEQ ID NO: 128282 - RNA, 64 nt, Human
cugugauagucauggaugcuuuuauuuuccuuggggugcugaaauugagcugaaaaaaaaaggc

SEQ ID NO: 128283 - RNA, 64 nt, Human
uaaaccauguccccaggaaauuugaaaggaagcaggugcugaauggaauuuuuuuccuuuucca

SEQ ID NO: 128284 - RNA, 64 nt, Human
guguauuugcacaugguugugcugucgaggaccuggugcugagaagagucuguucacagccaaa

SEQ ID NO: 128285 - RNA, 64 nt, Human
ccagugagaagauggggggcaacacugaccauuuggugcugagcgcuggccucuggguugccuc

SEQ ID NO: 128286 - RNA, 64 nt, Human
ucugggggccccuccugcagcgaggaugggagggggugcugagcugugaauccccugggcaggg

SEQ ID NO: 128287 - RNA, 64 nt, Human
ugaccgccacuggcccccaacaugaccacacgugggugcugaacucggggcgccgugcccaccg

SEQ ID NO: 128288 - RNA, 64 nt, Human
guccggcgcacaguucccgggcgagugggcugugggugcugacguuguagaagcgaguggccuc

SEQ ID NO: 128289 - RNA, 64 nt, Human
cgcugccuccugcucucuggagguacugagacagggugcugaugggaaggaggggagccuuugg

SEQ ID NO: 128290 - RNA, 64 nt, Human
ugaaguacaccacgagcuccaggcuucagaaaguggugcugagaacuugcuccaagaagaaguc

SEQ ID NO: 128291 - RNA, 64 nt, Human
cuggacacauacuuugaauaccuuucauauuuuaggugcugaaaauggugagggagugagugcu

SEQ ID NO: 128292 - RNA, 64 nt, Human
cuucuuucucuccuugccuccacccaccuccaaaggugcugagcucacauccacaccccuugca

SEQ ID NO: 128293 - RNA, 64 nt, Human
guuuaguggcgacacaggcacccagcuuugggguggugcugacgcucccaggggugccaggagc

SEQ ID NO: 128294 - RNA, 64 nt, Human
agcaccaggcaggugguccucgcugugacacugaggugcugagccagugagcuaggguggaggg

SEQ ID NO: 128295 - RNA, 64 nt, Human
cucuagucgcagcucugugacugauucccucccgggugcugaguccccuccccggccaccaucc

SEQ ID NO: 128296 - RNA, 64 nt, Human
ggaccaugagggagccccagaauggggugcauuuggugcugaggcuuugaagccaccguauuuu

SEQ ID NO: 128297 - RNA, 64 nt, Human
aggaaacaaacauguucaggcccugaacauuuccggugcugacucggccuuaaacguuugugcc

SEQ ID NO: 128298 - RNA, 64 nt, Human
ucagcaacagcgugucccgcugggugcaggugauggugcugagccgucccgggccccuacagcg

SEQ ID NO: 128299 - RNA, 64 nt, Human
cacacugggggccagagcuaggguggggggcgagggugcugaggagcagcccccaggggccgag

SEQ ID NO: 128300 - RNA, 64 nt, Human
agaguccccaucacguggcaagccaggcgaggcgggugcugaggucucagggaagcugguaaca

SEQ ID NO: 128301 - RNA, 64 nt, Human
ggcuccagugcugacucucauuggggagggcggaggugcugaccuggccugggccucuggggcc

SEQ ID NO: 128302 - RNA, 64 nt, Human
aaacucgauaaaauauguuuuacuaucucagaugggugcugaaauauuuuaauaaucagagcua

SEQ ID NO: 128303 - RNA, 64 nt, Human
gacccaguguggccccguggccucucccgacauuggugcugaagacgcagggacaggaauggga

SEQ ID NO: 128304 - RNA, 64 nt, Human
cagagggacaggugugguggcacaguccugguguggugcugaccacccaaauaugacugugaau

SEQ ID NO: 128305 - RNA, 64 nt, Human
uggggcugccguuaaggcacguucuuuccuuacuggugcugauaacaacagggaaccgugcagu

SEQ ID NO: 128306 - RNA, 64 nt, Human
cucugaaaauccccaguaggcaucugccaagaagggugcugaaggcuccagccagcuguccugg

SEQ ID NO: 128307 - RNA, 64 nt, Human
ccugacuccugggugggugggguacaggcaguuaggugcugaaugaagcugccauccuugcugc

SEQ ID NO: 128308 - RNA, 64 nt, Human
accugaggucagaggcggggcaucagaggcucaaggugcugagaagccaccgggaaagcagcca

SEQ ID NO: 128309 - RNA, 64 nt, Human
uuuuuccucucucgcuuuaguuuucaaccuuguuggugcugagagagagaaccgagagguccca

SEQ ID NO: 128310 - RNA, 64 nt, Human
ggguguguggugcuucucuuucccgauaaaggcuggugcugaccucuuguuugugcuauuugag

SEQ ID NO: 128311 - RNA, 64 nt, Human
aacuccaaagaacuccaggcugaggaguucuuuuggugcugaacaguggucugacaacaggugc

SEQ ID NO: 128312 - RNA, 64 nt, Human
aaagaauuaucaucccaacagccaagacccaacaggugcugaacugugcaucaaccaggaagag

SEQ ID NO: 128313 - RNA, 64 nt, Human
uuuccugcuuugggaagccgugcucgccccagcaggugcugacuucaucucccaccuagcagca

SEQ ID NO: 128314 - RNA, 64 nt, Human
uaccguuacuugggaaaucaucuuuacggaauguggugcugagagacuacauuuauaauuggag

SEQ ID NO: 128315 - RNA, 64 nt, Human
uagugugugugcaaaauccgcuuccugagcguagggugcugagcuggcgcuagggcucgguugu

SEQ ID NO: 128316 - RNA, 64 nt, Human
guccagacccugcugcgucucccuuccaaacucuggugcugaauaaacccuucugaucuggucu

SEQ ID NO: 128317 - RNA, 64 nt, Human
ggggugugaggccccagccuggagccaggcacugggugcugacaggggaaccaugaggagggug

SEQ ID NO: 128318 - RNA, 64 nt, Human
acuuuccucugaccauggcuuggaugcccucaggggugcugaccccugccaggccacgaauauc

SEQ ID NO: 128319 - RNA, 64 nt, Human
uuuuguuucuaaacuacagaugucaacuccuuggggugcugaucucgaguguuauuuucugauu

SEQ ID NO: 128320 - RNA, 64 nt, Human
gaggagggaggccacaacuccgagcugcccaccuggugcugagcuggggccccgccuccuuucu

SEQ ID NO: 128321 - RNA, 64 nt, Human
gggaaagcugucaagacuccugccaggaauggggggugcugagucaucucacgaagaaucccuc

SEQ ID NO: 128322 - RNA, 64 nt, Human
agaaaucagcagacagaauuaccaaaguguaucuggugcugaaugacugggggacaagcagaag

SEQ ID NO: 128323 - RNA, 64 nt, Human
gacacaggcagcuucucuccuuguccucuggggaggugcugaccccucagaaaccccuuccccc

SEQ ID NO: 128324 - RNA, 64 nt, Human
cugggcaaacgcccggagagcugcucaacccgcuggugcugaacucugugcugagcaaggcccu

SEQ ID NO: 128325 - RNA, 64 nt, Human
aacuguguggggagguccacuuauccauaggguuggugcugaaauguuagguugugcagacccc

SEQ ID NO: 128326 - RNA, 64 nt, Human
agguuggcgggggccuguaauccuagcuacuuggggugcugaggcaggagaaucaacugaaccc

SEQ ID NO: 128327 - RNA, 64 nt, Human
aaauuuuaaauaaaauuauauauauauauaaauuggugcugauuuuauaauugcgcaguuuguu

SEQ ID NO: 128328 - RNA, 64 nt, Human
aucaguuuuaccgugaaugugaaaaggugaaacuggugcugacuucggcagcagguauacuaaa

SEQ ID NO: 128329 - RNA, 64 nt, Human
agagauguuuuaacauuauauuuugagagcuuugggugcugaagggccaaacguuuucugggca

SEQ ID NO: 128330 - RNA, 64 nt, Human
ucuuuauuccugaauaaugaaagaauaguacuuuggugcugacaccaaugaggcacuucucuug

SEQ ID NO: 128331 - RNA, 64 nt, Human
cuauuagggacagaagaagccuccaaaucuggaaggugcugaaugcccugcugacugggaaagu

SEQ ID NO: 128332 - RNA, 64 nt, Human
ugaacgacagggaguauucuggccucugaaaggaggugcugagcugaacagggccaucuguuca

SEQ ID NO: 128333 - RNA, 64 nt, Human
uggggcacuccuggauccuaucugcccuggacaaggugcugaggugcauuguccugcuuucuug

SEQ ID NO: 128334 - RNA, 64 nt, Human
acuaucuguauuguggaaugcacaaaauuguguaggugcugaaugcuguaaggaguuuagguug

SEQ ID NO: 128335 - RNA, 64 nt, Human
aguccuguuuugaaugccaaacccaccauucacuggugcugacuacauagaaugggguugagag

SEQ ID NO: 128336 - RNA, 64 nt, Human; identical to SEQ ID NO: 42454

SEQ ID NO: 128337 - RNA, 64 nt, Human; identical to SEQ ID NO: 42455

SEQ ID NO: 128338 - RNA, 64 nt, Human; identical to SEQ ID NO: 42456

SEQ ID NO: 128339 - RNA, 64 nt, Human; identical to SEQ ID NO: 42457

SEQ ID NO: 128340 - RNA, 64 nt, Human; identical to SEQ ID NO: 42458

SEQ ID NO: 128341 - RNA, 64 nt, Human; identical to SEQ ID NO: 42459

SEQ ID NO: 128342 - RNA, 64 nt, Human; identical to SEQ ID NO: 42460

SEQ ID NO: 128343 - RNA, 64 nt, Human; identical to SEQ ID NO: 42461

SEQ ID NO: 128344 - RNA, 64 nt, Human; identical to SEQ ID NO: 42462

SEQ ID NO: 128345 - RNA, 64 nt, Human; identical to SEQ ID NO: 42463

SEQ ID NO: 128346 - RNA, 64 nt, Human; identical to SEQ ID NO: 42464

SEQ ID NO: 128347 - RNA, 64 nt, Human; identical to SEQ ID NO: 42465

SEQ ID NO: 128348 - RNA, 64 nt, Human; identical to SEQ ID NO: 42466

SEQ ID NO: 128349 - RNA, 64 nt, Human; identical to SEQ ID NO: 42467

SEQ ID NO: 128350 - RNA, 64 nt, Human; identical to SEQ ID NO: 42468

SEQ ID NO: 128351 - RNA, 64 nt, Human; identical to SEQ ID NO: 42469

SEQ ID NO: 128352 - RNA, 64 nt, Human; identical to SEQ ID NO: 42470

SEQ ID NO: 128353 - RNA, 64 nt, Human; identical to SEQ ID NO: 42471

SEQ ID NO: 128354 - RNA, 64 nt, Human; identical to SEQ ID NO: 42472

SEQ ID NO: 128355 - RNA, 64 nt, Human; identical to SEQ ID NO: 42473

SEQ ID NO: 128356 - RNA, 64 nt, Human; identical to SEQ ID NO: 42474

SEQ ID NO: 128357 - RNA, 64 nt, Human; identical to SEQ ID NO: 42475

SEQ ID NO: 128358 - RNA, 64 nt, Human; identical to SEQ ID NO: 42476

SEQ ID NO: 128359 - RNA, 64 nt, Human; identical to SEQ ID NO: 42477

SEQ ID NO: 128360 - RNA, 64 nt, Human; identical to SEQ ID NO: 42478

SEQ ID NO: 128361 - RNA, 64 nt, Human; identical to SEQ ID NO: 42479

SEQ ID NO: 128362 - RNA, 64 nt, Human; identical to SEQ ID NO: 42480

SEQ ID NO: 128363 - RNA, 64 nt, Human; identical to SEQ ID NO: 42481

SEQ ID NO: 128364 - RNA, 64 nt, Human; identical to SEQ ID NO: 42482

SEQ ID NO: 128365 - RNA, 64 nt, Human; identical to SEQ ID NO: 42483

SEQ ID NO: 128366 - RNA, 64 nt, Human; identical to SEQ ID NO: 42484

SEQ ID NO: 128367 - RNA, 64 nt, Human; identical to SEQ ID NO: 42485

SEQ ID NO: 128368 - RNA, 64 nt, Human; identical to SEQ ID NO: 42486

SEQ ID NO: 128369 - RNA, 64 nt, Human; identical to SEQ ID NO: 42487

SEQ ID NO: 128370 - RNA, 64 nt, Human; identical to SEQ ID NO: 42488

SEQ ID NO: 128371 - RNA, 64 nt, Human; identical to SEQ ID NO: 42489

SEQ ID NO: 128372 - RNA, 64 nt, Human; identical to SEQ ID NO: 42490

SEQ ID NO: 128373 - RNA, 64 nt, Human; identical to SEQ ID NO: 42491

SEQ ID NO: 128374 - RNA, 64 nt, Human; identical to SEQ ID NO: 42492

SEQ ID NO: 128375 - RNA, 64 nt, Human; identical to SEQ ID NO: 42493

SEQ ID NO: 128376 - RNA, 64 nt, Human; identical to SEQ ID NO: 42494

SEQ ID NO: 128377 - RNA, 64 nt, Human; identical to SEQ ID NO: 42495

SEQ ID NO: 128378 - RNA, 64 nt, Human; identical to SEQ ID NO: 42496

SEQ ID NO: 128379 - RNA, 64 nt, Human; identical to SEQ ID NO: 42497

SEQ ID NO: 128380 - RNA, 64 nt, Human; identical to SEQ ID NO: 42498

SEQ ID NO: 128381 - RNA, 64 nt, Human; identical to SEQ ID NO: 42499

SEQ ID NO: 128382 - RNA, 64 nt, Human; identical to SEQ ID NO: 42500

SEQ ID NO: 128383 - RNA, 64 nt, Human; identical to SEQ ID NO: 42501

SEQ ID NO: 128384 - RNA, 64 nt, Human; identical to SEQ ID NO: 42502

SEQ ID NO: 128385 - RNA, 64 nt, Human; identical to SEQ ID NO: 42503

SEQ ID NO: 128386 - RNA, 50 nt, Human; identical to SEQ ID NO: 42504

SEQ ID NO: 128387 - RNA, 64 nt, Human; identical to SEQ ID NO: 42505

SEQ ID NO: 128388 - RNA, 64 nt, Human; identical to SEQ ID NO: 42506

SEQ ID NO: 128389 - RNA, 64 nt, Human; identical to SEQ ID NO: 42507

SEQ ID NO: 128390 - RNA, 64 nt, Human; identical to SEQ ID NO: 42508

SEQ ID NO: 128391 - RNA, 64 nt, Human; identical to SEQ ID NO: 42509

SEQ ID NO: 128392 - RNA, 64 nt, Human; identical to SEQ ID NO: 42510

SEQ ID NO: 128393 - RNA, 64 nt, Human; identical to SEQ ID NO: 42511

SEQ ID NO: 128394 - RNA, 64 nt, Human; identical to SEQ ID NO: 42512

SEQ ID NO: 128395 - RNA, 64 nt, Human; identical to SEQ ID NO: 42513

SEQ ID NO: 128396 - RNA, 64 nt, Human; identical to SEQ ID NO: 42514

SEQ ID NO: 128397 - RNA, 64 nt, Human; identical to SEQ ID NO: 42515

SEQ ID NO: 128398 - RNA, 64 nt, Human; identical to SEQ ID NO: 42516

SEQ ID NO: 128399 - RNA, 64 nt, Human; identical to SEQ ID NO: 42517

SEQ ID NO: 128400 - RNA, 64 nt, Human; identical to SEQ ID NO: 42518

SEQ ID NO: 128401 - RNA, 64 nt, Human; identical to SEQ ID NO: 42519

SEQ ID NO: 128402 - RNA, 64 nt, Human; identical to SEQ ID NO: 42520

SEQ ID NO: 128403 - RNA, 64 nt, Human; identical to SEQ ID NO: 42521

SEQ ID NO: 128404 - RNA, 64 nt, Human; identical to SEQ ID NO: 42522

SEQ ID NO: 128405 - RNA, 64 nt, Human; identical to SEQ ID NO: 42523

SEQ ID NO: 128406 - RNA, 64 nt, Human; identical to SEQ ID NO: 42524

SEQ ID NO: 128407 - RNA, 64 nt, Human; identical to SEQ ID NO: 42525

SEQ ID NO: 128408 - RNA, 64 nt, Human
aacugcugcaccccaucccgacccugucuccgccaccucgcagccccauuaaagcgcucucauc

SEQ ID NO: 128409 - RNA, 64 nt, Human
cccaucuguaaacuguagauaugacuacugaccuaccucgcagggggcuguggggaggcauaag

SEQ ID NO: 128410 - RNA, 64 nt, Human
cagagugccccaucggucaccuuguuucucaacuaccucgcaucauugcagaugcuagcgcguu

SEQ ID NO: 128411 - RNA, 64 nt, Human
uauacuaaguaacuggugauuucucuaggaacagaccucgcacuuucuguucuaaauauauuua

SEQ ID NO: 128412 - RNA, 64 nt, Human
ccuaugggcuucagaugucuuugccccauuugucaccucgcacacuuauagcguuuccuccucg

SEQ ID NO: 128413 - RNA, 64 nt, Human
cuuuuaaaauauuuaacaguucaaucucaauaagaccucgcauuauguaugaauguuauucacu

SEQ ID NO: 128414 - RNA, 64 nt, Human
cugcucaacgggcaugcgccgggggccgucccaaaccucgcagggcuccagcaggccaaccggc

SEQ ID NO: 128415 - RNA, 64 nt, Human
guuccguguagguuucauuguaauacucaugccuaccucgcaugguugcugugaggcaccuaug

SEQ ID NO: 128416 - RNA, 64 nt, Human
uggggucaugcuuuguagcagugucucccuugcgaccucgcaauaaauuggccccacgggguga

SEQ ID NO: 128417 - RNA, 64 nt, Human
cugacacccuucuccccuuccugguagaccuuaaaccucgcacacauguccccagcauuuucuc

SEQ ID NO: 128418 - RNA, 64 nt, Human
cuccaguuccauguggccaaauccuagggccucaaccucgcauccugaaccuuagcaucgugga

SEQ ID NO: 128419 - RNA, 64 nt, Human
cugugacccagcagcaucaagccccucgcugggcaccucgcacacacccccugccuuaucucug

SEQ ID NO: 128420 - RNA, 64 nt, Human
gagaagagccuccgcccggcccgggcaccacccgaccucgcagggagcaggcccugucaccgac

SEQ ID NO: 128421 - RNA, 64 nt, Human
gcacugccgguguccccagagcagggacucugucaccucgcacuucauuacauuccuguacuaa

SEQ ID NO: 128422 - RNA, 64 nt, Human
uaaacagaagaaaucauuuuuuuugcuauguaauaccucgcaacuuugcucuaaaaucaagcuc

SEQ ID NO: 128423 - RNA, 64 nt, Human
gauguagcacuucccacugccuggagagaaauaaaccucgcaaguuauuaaggagaaggcaugc

SEQ ID NO: 128424 - RNA, 64 nt, Human
gugaggcgagguggggaguuggcagaauccccauaccucgcagauuugcugagucugucuugug

SEQ ID NO: 128425 - RNA, 64 nt, Human
ccauccacugauucuggggugagaagcgauuucuaccucgcaagagugacuagaaaguuucuag

SEQ ID NO: 128426 - RNA, 64 nt, Human
aaaagauuagccucugucucgguggcagguucccaccucgcaagcaauuggaaacaaaacuuuu

SEQ ID NO: 128427 - RNA, 64 nt, Human
ucuugccucgccucgccuccccucaccuugccucaccucgcagcagccuuuccaggcccagcuc

SEQ ID NO: 128428 - RNA, 64 nt, Human
ugugccgcuucauuuguagagggcuguaacagugaccucgcacggucauccggaguacuaagcc

SEQ ID NO: 128429 - RNA, 64 nt, Human
uacuauuccuucccgccaauucuguccacuccucaccucgcaucagcuauaaauuuggaaguac

SEQ ID NO: 128430 - RNA, 64 nt, Human
cuuccccuccacccgcccuaacccccucucauuuaccucgcaguguguucuaauccaagggcca

SEQ ID NO: 128431 - RNA, 64 nt, Human
agggugagcuggagcuccaggcuggccaggcugaaccucgcacacacgcagaguucugcucccu

SEQ ID NO: 128432 - RNA, 64 nt, Human
acagcugcuggacagauaaggacggcugcucuccaccucgcagacugcucuuguuauaaguaga

SEQ ID NO: 128433 - RNA, 64 nt, Human
uccucaucugucaaauggggguuuauaaacaccuaccucgcaggguuguugugaggauuuaaug

SEQ ID NO: 128434 - RNA, 64 nt, Human
ugggcuaaccuguuccagccaggcuccucaugugaccucgcaguugagaagcccauuaucgugg

SEQ ID NO: 128435 - RNA, 64 nt, Human
gccauggagcccgaguagcugccuggaucgcucgaccucgcaugcgcgccgcgucgccucuggg

SEQ ID NO: 128436 - RNA, 64 nt, Human
ugaaugacguugcagggucuucaugcaauuuuccaccucgcaguaguuaguauuuacuugccuu

SEQ ID NO: 128437 - RNA, 64 nt, Human
ugcaguggcgugaucucagcucacugcaaccuccaccucgcagguucaagcaauccucccacuu

SEQ ID NO: 128438 - RNA, 64 nt, Human
gacgugagggggaccccucccugccagcccgcggaccucgcaugcucccugcaugagacucacc

SEQ ID NO: 128439 - RNA, 64 nt, Human
ucugccucccaggcgggaucgcugguuucucucgaccucgcagagcuccugacaaaggcggcuu

SEQ ID NO: 128440 - RNA, 64 nt, Human
uguagcuccuccagccucugcagagacucccuucaccucgcacuuacugccugggaaccacggc

SEQ ID NO: 128441 - RNA, 64 nt, Human
gcgcaccguccggcucggguccggacagccaguaaccucgcagagagugacggugucuccuugc

SEQ ID NO: 128442 - RNA, 64 nt, Human
ccaccuccucuugugggaaggaggucucagccccaccucgcaucuucaccugcccuuggugugg

SEQ ID NO: 128443 - RNA, 64 nt, Human
cucggugacuuccacugucgcgguguaguuguccaccucgcaggagccgccccccgggcccccc

SEQ ID NO: 128444 - RNA, 64 nt, Human
caggugcuggaggugcccaaugcucccuccuaggaccucgcagccaggcaaggcugucagguug

SEQ ID NO: 128445 - RNA, 64 nt, Human
cccugcccucccaggaggggugguagccguucccaccucgcagcaggacccccagugcagaggc

SEQ ID NO: 128446 - RNA, 64 nt, Human
agagcccgagauccuggccacuaugccaguucugaccucgcaucccccuaccccgagcccaugc

SEQ ID NO: 128447 - RNA, 53 nt, Human
gagguggugaagaggauugacugaccucgcaucuucggaccgaagugagagcc

SEQ ID NO: 128448 - RNA, 64 nt, Human
cauugaauuuaaggcccaccccaaguccagaaugaccucgcaagacccuuaacucacucccguc

SEQ ID NO: 128449 - RNA, 64 nt, Human
gagggagguccccgccaugccggcuggaagaagaaccucgcaucuuuugguguguaugcaccuu

SEQ ID NO: 128450 - RNA, 64 nt, Human
gcuucucuggaggccucacguccauucagcucucaccucgcaccugcuguagccaccagugggc

SEQ ID NO: 128451 - RNA, 64 nt, Human; identical to SEQ ID NO: 128408

SEQ ID NO: 128452 - RNA, 64 nt, Human; identical to SEQ ID NO: 128409

SEQ ID NO: 128453 - RNA, 64 nt, Human; identical to SEQ ID NO: 128410

SEQ ID NO: 128454 - RNA, 64 nt, Human; identical to SEQ ID NO: 128411

SEQ ID NO: 128455 - RNA, 64 nt, Human; identical to SEQ ID NO: 128412

SEQ ID NO: 128456 - RNA, 64 nt, Human; identical to SEQ ID NO: 128413

SEQ ID NO: 128457 - RNA, 64 nt, Human; identical to SEQ ID NO: 128414

SEQ ID NO: 128458 - RNA, 64 nt, Human; identical to SEQ ID NO: 128415

SEQ ID NO: 128459 - RNA, 64 nt, Human; identical to SEQ ID NO: 128416

SEQ ID NO: 128460 - RNA, 64 nt, Human; identical to SEQ ID NO: 128417

SEQ ID NO: 128461 - RNA, 64 nt, Human; identical to SEQ ID NO: 128418

SEQ ID NO: 128462 - RNA, 64 nt, Human; identical to SEQ ID NO: 128419

SEQ ID NO: 128463 - RNA, 64 nt, Human; identical to SEQ ID NO: 128420

SEQ ID NO: 128464 - RNA, 64 nt, Human; identical to SEQ ID NO: 128421

SEQ ID NO: 128465 - RNA, 64 nt, Human; identical to SEQ ID NO: 128422

SEQ ID NO: 128466 - RNA, 64 nt, Human; identical to SEQ ID NO: 128423

SEQ ID NO: 128467 - RNA, 64 nt, Human; identical to SEQ ID NO: 128424

SEQ ID NO: 128468 - RNA, 64 nt, Human; identical to SEQ ID NO: 128425

SEQ ID NO: 128469 - RNA, 64 nt, Human; identical to SEQ ID NO: 128426

SEQ ID NO: 128470 - RNA, 64 nt, Human; identical to SEQ ID NO: 128427

SEQ ID NO: 128471 - RNA, 64 nt, Human; identical to SEQ ID NO: 128428

SEQ ID NO: 128472 - RNA, 64 nt, Human; identical to SEQ ID NO: 128429

SEQ ID NO: 128473 - RNA, 64 nt, Human; identical to SEQ ID NO: 128430

SEQ ID NO: 128474 - RNA, 64 nt, Human; identical to SEQ ID NO: 128431

SEQ ID NO: 128475 - RNA, 64 nt, Human; identical to SEQ ID NO: 128432

SEQ ID NO: 128476 - RNA, 64 nt, Human; identical to SEQ ID NO: 128433

SEQ ID NO: 128477 - RNA, 64 nt, Human; identical to SEQ ID NO: 128434

SEQ ID NO: 128478 - RNA, 64 nt, Human; identical to SEQ ID NO: 128435

SEQ ID NO: 128479 - RNA, 64 nt, Human; identical to SEQ ID NO: 128436

SEQ ID NO: 128480 - RNA, 64 nt, Human; identical to SEQ ID NO: 128437

SEQ ID NO: 128481 - RNA, 64 nt, Human; identical to SEQ ID NO: 128438

SEQ ID NO: 128482 - RNA, 64 nt, Human; identical to SEQ ID NO: 128439

SEQ ID NO: 128483 - RNA, 64 nt, Human; identical to SEQ ID NO: 128440

SEQ ID NO: 128484 - RNA, 64 nt, Human; identical to SEQ ID NO: 128441

SEQ ID NO: 128485 - RNA, 64 nt, Human; identical to SEQ ID NO: 128442

SEQ ID NO: 128486 - RNA, 64 nt, Human; identical to SEQ ID NO: 128443

SEQ ID NO: 128487 - RNA, 64 nt, Human; identical to SEQ ID NO: 128444

SEQ ID NO: 128488 - RNA, 64 nt, Human; identical to SEQ ID NO: 128445

SEQ ID NO: 128489 - RNA, 64 nt, Human; identical to SEQ ID NO: 128446

SEQ ID NO: 128490 - RNA, 53 nt, Human; identical to SEQ ID NO: 128447

SEQ ID NO: 128491 - RNA, 64 nt, Human; identical to SEQ ID NO: 128448

SEQ ID NO: 128492 - RNA, 64 nt, Human; identical to SEQ ID NO: 128449

SEQ ID NO: 128493 - RNA, 64 nt, Human; identical to SEQ ID NO: 128450

SEQ ID NO: 128494 - RNA, 64 nt, Human
cuggaucuuguagugggugcacacgcgugcacugggaccccacacagcaauacgaguccaacuu

SEQ ID NO: 128495 - RNA, 64 nt, Human
ccccacccacccccacccuugcuggcaggggcagggaccccagggggauugacucugcaguuug

SEQ ID NO: 128496 - RNA, 64 nt, Human
ugccugucuggccgggccgcacuuguggcccccgggaccccaccucuggccccaccucccucaa

SEQ ID NO: 128497 - RNA, 64 nt, Human
cagcugcuuaucugucuaacuuggcuggugguguggaccccacugccugcuagggaauaccagc

SEQ ID NO: 128498 - RNA, 64 nt, Human
gcagauaaagcucaggacgucaaaaacucaccauggaccccaaggcagaaaccaagaacugucu

SEQ ID NO: 128499 - RNA, 64 nt, Human
ggaaaugccaaggaugcuucugguggacuucaggggaccccaggguuuggccgugggccgugau

SEQ ID NO: 128500 - RNA, 64 nt, Human
gggcuuuuguccuccugggucagggagaacgcggggaccccagaaaggucagccuuccugagga

SEQ ID NO: 128501 - RNA, 64 nt, Human
uccucagggcccagcaggcggggguuugagcccuggaccccaggcucuuagagacuaaggggca

SEQ ID NO: 128502 - RNA, 64 nt, Human
ugccaacagcaagcggauuuucuugcaagaucagggaccccauuucugcagccagugucuccug

SEQ ID NO: 128503 - RNA, 64 nt, Human
cccacaccuacacacccucugcauggcccugccuggaccccauggaggccgaauagggaggagg

SEQ ID NO: 128504 - RNA, 64 nt, Human
caggaggcugggagcagcucuguuuccuaauucaggaccccacucaucuagcccuccaagagcc

SEQ ID NO: 128505 - RNA, 64 nt, Human
aacucacagcacagugugugaugcuguccuuccuggaccccauucuguccggaggcucauggcc

SEQ ID NO: 128506 - RNA, 64 nt, Human
caugucugcucuccugaaaagagacuugguuuggggaccccacaaaaggagggaagcuguagcu

SEQ ID NO: 128507 - RNA, 64 nt, Human
ccaguccuggaggcagguugugcagcuuaggggaggaccccagaaucuggaccccagagucugg

SEQ ID NO: 128508 - RNA, 64 nt, Human
agguugugcagcuuaggggaggaccccagaaucuggaccccagagucuggaagcaggccagaaa

SEQ ID NO: 128509 - RNA, 64 nt, Human
cucuggugggcaggagcuuggacugcucuggcuaggaccccaguaagauuguggcaagaccugg

SEQ ID NO: 128510 - RNA, 64 nt, Human
agcccagcuggccuggcccccagcuucaccucugggaccccagcugcucuaagcccaggaucuc

SEQ ID NO: 128511 - RNA, 53 nt, Human
caggagcugugucauacugaggaggaccccagcuuuucuugccagcucagcag

SEQ ID NO: 128512 - RNA, 64 nt, Human
uauagcuuuugguguuugaguguucaucagggugggaccccauuccaguccaauuuuccuaagu

SEQ ID NO: 128513 - RNA, 62 nt, Human
ccagcagcaggccgcauugacccgucuccaucggaccccagccccuaucuccaagagacaga

SEQ ID NO: 128514 - RNA, 64 nt, Human
agauagcacugggugugagaaugaucaaggaucuggaccccaaagaauagacuggauggaaaga

SEQ ID NO: 128515 - RNA, 64 nt, Human
ucaaggagccuccguucccaccucugaggacucuggaccccaggccauaccaggugcuagggug

SEQ ID NO: 128516 - RNA, 64 nt, Human
ccucgcgggugacuccgggcuccguggcugucccggaccccaccucuucccugccgcccgccac

SEQ ID NO: 128517 - RNA, 64 nt, Human
ggcaagacaucagacacacccaacccaaaggcguggaccccaggcccggcccgugguacccagc

SEQ ID NO: 128518 - RNA, 64 nt, Human
cagggcauggauggggcuuuggguccucgagguuggaccccagcuucuugccaccuuccccucc

SEQ ID NO: 128519 - RNA, 64 nt, Human
gggaggcuccugugugaugggcagccauggccuaggaccccaccuccaugccuggcuccuggau

SEQ ID NO: 128520 - RNA, 64 nt, Human
aaaguguugggucuuccuccaggaugccugcaugggaccccacccggagcugguguggccauuc

SEQ ID NO: 128521 - RNA, 64 nt, Human
uuuaccuccagggcugcugcugccuggguaucugggaccccagaucaggcucuggagacgcugc

SEQ ID NO: 128522 - RNA, 64 nt, Human
agggagaguuggcugcuccagcuccacagcccugggaccccaacuccugucuucccugcuccuu

SEQ ID NO: 128523 - RNA, 64 nt, Human
uaggagucccugccccuagaguaggagcagggcuggaccccaagccccucccucuuccauggag

SEQ ID NO: 128524 - RNA, 64 nt, Human
acuaggacugggaggagaauaacccaggucuuaaggaccccaaagucaggauguuguuugaucu

SEQ ID NO: 128525 - RNA, 64 nt, Human
ccccuccucacccagugugaggagggcccucuggggaccccagaguccuguucugcugagguuu

SEQ ID NO: 128526 - RNA, 63 nt, Human
uccugggcaagaacaaguagacagcagcggcugggaccccacaccuuucacggacacugacaa

SEQ ID NO: 128527 - RNA, 64 nt, Human
gaaucaugucgauccuggggcccucagcuccuggggaccccacucccugcucuaacaccugccu

SEQ ID NO: 128528 - RNA, 64 nt, Human
accaugggagaaggaccaagaucaaaggccuucaggaccccagccucuuuccaucauccuuccu

SEQ ID NO: 128529 - RNA, 64 nt, Human
ggaggccuggaacgguggggcguuugacuggaauggaccccagggacuguccaggugcagcccc

SEQ ID NO: 128530 - RNA, 64 nt, Human
cgagcccggagaaggggagacccgugucccacaaggaccccaccggccugccuggcaucugucu

SEQ ID NO: 128531 - RNA, 64 nt, Human
uccagcagccugguucaccacacaaacucugccuggaccccauugucugucugcuucccaccug

SEQ ID NO: 128532 - RNA, 64 nt, Human
agcauuucucuaacguuuauuacaauuaggagggggaccccacaucugugagauucuguuucau

SEQ ID NO: 128533 - RNA, 64 nt, Human
agagacagaccccuuggcuuuugcuuggcagagaggaccccacuggacuggguuuugucucugc

SEQ ID NO: 128534 - RNA, 64 nt, Human
cacuaccuaugcuucuagaaagccccucaccucaggaccccagagggaccagcuggggggcagg

SEQ ID NO: 128535 - RNA, 64 nt, Human
cuuauguggaucuauuuaugggaacuucuuaaaaggaccccagaauagcucuuuaucuuucaca

SEQ ID NO: 128536 - RNA, 64 nt, Human
ccggccagacucucaucuugaugucuugauggauggaccccagcuagucagacaugauccucca

SEQ ID NO: 128537 - RNA, 64 nt, Human
cuccuacggcggcucugaagcagagcccugggacggaccccaugcuguccccaacagcuggggu

SEQ ID NO: 128538 - RNA, 64 nt, Human
uuggaucaguguaugauauggaugaugaugaaauggaccccaauuaugccagagugaaccacuu

SEQ ID NO: 128539 - RNA, 64 nt, Human
cuggcucacccugaagaggugggauaggaccgggggaccccagagggaggccuaggaggggacu

SEQ ID NO: 128540 - RNA, 64 nt, Human
gccuggucacagggcaugccccggccaccucugcggaccccagcugugagccuuggcuguuggc

SEQ ID NO: 128541 - RNA, 64 nt, Human
acagucuggguccccagcucgcucuugguacuugggaccccagugccucguugagggcgccauu

SEQ ID NO: 128542 - RNA, 64 nt, Human
gggcacaguacugacggggcucucagggcugggaggaccccagugcccuccucagaagaagcac

SEQ ID NO: 128543 - RNA, 64 nt, Human
acagcagggggcaaguuggucugugugaauuaugggaccccauuacuuuuccugagacugguca

SEQ ID NO: 128544 - RNA, 64 nt, Human
gcugguggaugccugugggcauggcuuucucuggggaccccauuccugucaguagcaacccugg

SEQ ID NO: 128545 - RNA, 64 nt, Human
caucuuccuccucucugugaaucacagacacgcgggaccccagccgccaaaacuuuucaaggca

SEQ ID NO: 128546 - RNA, 64 nt, Human
guauucagguuucucuggguuuuacagaacgcauggaccccauucacguuugguuuguuuaucu

SEQ ID NO: 128547 - RNA, 64 nt, Human
uagcuuuacacuuucugcuuuaauagauuuaaguggaccccaauauuuauuaaaauugcuaguu

SEQ ID NO: 128548 - RNA, 64 nt, Human
gaagaaccaugcuugagucucucugggauggagaggaccccaacucgccaaagaaaagauucac

SEQ ID NO: 128549 - RNA, 64 nt, Human
ggcuuuccagggcucagcucccaaccagcuguuaggaccccacccuuuugccuuuauugucgac

SEQ ID NO: 128550 - RNA, 64 nt, Human
ugaacccaagcccucucgacugccccuauccccuggaccccaacauaccuacaaugcuggggag

SEQ ID NO: 128551 - RNA, 64 nt, Human
ugcuucacuguguggaguggggcaggcaggggcuggaccccagggacuugccuuccccacccac

SEQ ID NO: 128552 - RNA, 64 nt, Human
gcaccaaguggauugccaacaacuggauuaauguggaccccagccgagcgcggcaagcgcuguu

SEQ ID NO: 128553 - RNA, 64 nt, Human
gcagaggcaagagcagagccaggcugugcccgagggaccccagcucuugacugcaccuguuuca

SEQ ID NO: 128554 - RNA, 64 nt, Human
gguuauagauucccccacugccccagcucugacuggaccccaaguggcugcuauguaaauuaaa

SEQ ID NO: 128555 - RNA, 64 nt, Human
caacaguggggucgggggcccacccccagcugggggaccccaugcaggcugaugggccccgggg

SEQ ID NO: 128556 - RNA, 64 nt, Human
gggcaagaucauugguuuaucauagugaaacccaggaccccaaaguucugcguaggugccucag

SEQ ID NO: 128557 - RNA, 64 nt, Human
ucaauucauguggccuuacgggauggugggucugggaccccaauucauucuuaucugccaaaga

SEQ ID NO: 128558 - RNA, 64 nt, Human
ggucaggacagagacaaaaaugaggaaaacuaggggaccccacacacauguggcuaccauacuc

SEQ ID NO: 128559 - RNA, 64 nt, Human
augcagccaucccugaguucaugcgaugcugacgggaccccagcacacuucccugccuccuuug

SEQ ID NO: 128560 - RNA, 64 nt, Human
ugggagccgagauccaccugauccgugacaugauggaccccaaccacacaggaggccuguauga

SEQ ID NO: 128561 - RNA, 64 nt, Human
caccagccaggacccaaacucuccuuaccgagaaggaccccagcucuugaagggcugaguggcc

SEQ ID NO: 128562 - RNA, 64 nt, Human
aaagaggaaggggaccaguguagcaacuugccagggaccccaccccucccucucugggccugug

SEQ ID NO: 128563 - RNA, 64 nt, Human
ccauugaccaucuggucccaggagcucaggaggaggaccccaggggagaggagagcugugagag

SEQ ID NO: 128564 - RNA, 64 nt, Human
ccuuaggauacaucugaaagcauuccuuuggcauggaccccagagauaguuuuggagccaggca

SEQ ID NO: 128565 - RNA, 64 nt, Human
ggccaccucaguccugccuggguccuggugccuuggaccccacgugcuuguggccaggcugccc

SEQ ID NO: 128566 - RNA, 64 nt, Human
ccucagcucugacggccugaccacugcggcaagaggaccccagcuggggugcuuaccuccagua

SEQ ID NO: 128567 - RNA, 58 nt, Human
acaugaccucgcauaauugacucggaaaggaccccagcuuuccacgcgcgcgcaagca

SEQ ID NO: 128568 - RNA, 64 nt, Human
ucucaagccugcccuuccuagacggccaccugcaggaccccacacucacugcacuggcagcgug

SEQ ID NO: 128569 - RNA, 64 nt, Human
cugaacgcugagaugggaaggucacuugagcccaggaccccaccacugcacuccagccuggaug

SEQ ID NO: 128570 - RNA, 64 nt, Human
gggagcuaggagucugaaccugaaguaugugauuggaccccagaauguauuugaaggcucugaa

SEQ ID NO: 128571 - RNA, 64 nt, Human
aagauuagugugagaccaucauggugccagucuaggaccccauucuccuauuuaccaguccugu

SEQ ID NO: 128572 - RNA, 64 nt, Human
aacuuguguagcagcacagggcccacacuuagaaggaccccacacuugguucaaggcucugcua

SEQ ID NO: 128573 - RNA, 64 nt, Human
aaauuugauuaaaugguuuuauaguauaauauugggaccccauaccguuagcccuuguauguau

SEQ ID NO: 128574 - RNA, 64 nt, Human
agcacuucagacaaagaccaccccuucacccacuggaccccaagccgcaaaagcuggggaggua

SEQ ID NO: 128575 - RNA, 64 nt, Human
gaucaaccaaggcagaugugacagcaagggccacggaccccauggcagggguggcgucuucaug

SEQ ID NO: 128576 - RNA, 64 nt, Human
cccagucgaaccagauaccccaggugggccggagggaccccagaccuucagagggcugcccugg

SEQ ID NO: 128577 - RNA, 64 nt, Human
cccaggaaucccuuccucccauguccuggcagcaggaccccaggcuacauauggaagguagaga

SEQ ID NO: 128578 - RNA, 64 nt, Human
cucugccuggccuugagccgugaccuccaggaagggaccccacuggaauuuuauuucucucagg

SEQ ID NO: 128579 - RNA, 64 nt, Human
acuggaaccacccuuuggcugugcugcgaagcauggaccccaguguuguugugggugugucaaa

SEQ ID NO: 128580 - RNA, 64 nt, Human
gccaccucauccguaaggacucgguucuguguugggaccccaaaaaaccagaacaaguucugug

SEQ ID NO: 128581 - RNA, 64 nt, Human
ucccacuccggguugguuuuguguuugcuuuuccggaccccacucugcccuccaaaaagacaaa

SEQ ID NO: 128582 - RNA, 64 nt, Human
gcugugagaucuugaauaguguucuuucaucucuggaccccacuuuccacaucugugcacucaa

SEQ ID NO: 128583 - RNA, 64 nt, Human
gccugaagcugccaggcccugagguucagacccuggaccccauagcuggaggccuguggugcca

SEQ ID NO: 128584 - RNA, 64 nt, Human
gaaugccuuccacuucccaacagcccccaucaagggaccccaagaggccaccaugcucuuaucu

SEQ ID NO: 128585 - RNA, 64 nt, Human
ugacugugggcaugaggagggauaaggcugauuuggaccccaggcuucugcccuggacagcacu

SEQ ID NO: 128586 - RNA, 64 nt, Human
ugcgcccccagcuucucucucccugucacacacuggaccccacuggcugagaaucuggggguga

SEQ ID NO: 128587 - RNA, 64 nt, Human
guagccccagcuggcuugugggcuucaccaaagaggaccccacucugaagccagccuggagcca

SEQ ID NO: 128588 - RNA, 64 nt, Human
guuuccgguucugagucagggugaucuguggacgggaccccagcaccaagucuacgggugccag

SEQ ID NO: 128589 - RNA, 64 nt, Human
uguggcaggugggccaucccaugucccuccagggggaccccacagccuggcagaugagcagaua

SEQ ID NO: 128590 - RNA, 64 nt, Human
ggacgggaugccuggccuaagcaccuggagcaggggaccccauauccacugguagccaccuccc

SEQ ID NO: 128591 - RNA, 64 nt, Human
gcgagugcgugaauauugggggcccggacgcccaggaccccauggcagugggaaaaauguagga

SEQ ID NO: 128592 - RNA, 64 nt, Human
ucauaccagcccuccuugccucccuccagccacuggaccccagccuuggcucuuccucuugguu

SEQ ID NO: 128593 - RNA, 64 nt, Human
uccaagggaucugcuugauaucccaaguuggaagggaccccagauaccugugaggacugguugu

SEQ ID NO: 128594 - RNA, 64 nt, Human
uuuuuuucucucaggaccucuuaaaaaucaucaaggaccccaaaaagcuuuuggguaugugggu

SEQ ID NO: 128595 - RNA, 64 nt, Human
cgaucacaucacgguaaagcccaaggaguaauuaggaccccaggaagccuugcugcccagaaaa

SEQ ID NO: 128596 - RNA, 64 nt, Human
cucccagggacacuggaugcgcugggagccccggggaccccauggggugcuguaaucauggacc

SEQ ID NO: 128597 - RNA, 64 nt, Human
uagcccagguuccugggcuucugcugcccccucaggaccccagcuaaccucagaacaacuaacu

SEQ ID NO: 128598 - RNA, 64 nt, Human
cacaggaggagcaggugcugacuuucaggucccuggaccccagaaacccaggguagacauggac

SEQ ID NO: 128599 - RNA, 64 nt, Human
ucuuggucauccaugacaccacaccggcaucagaggaccccagaaaacuacccaaaugaguaug

SEQ ID NO: 128600 - RNA, 64 nt, Human
cccagcccugagagggguggugaggcagcccccuggaccccagaaccccagacaagggggcagg

SEQ ID NO: 128601 - RNA, 64 nt, Human
gcugccuucucugggcucacgacuguucuggaaaggaccccauggcagacuuggcaaggucucc

SEQ ID NO: 128602 - RNA, 64 nt, Human
ggcuugggcaucacgcccaccuccuuuggcagagggaccccagcacacuaacucuggguggcug

SEQ ID NO: 128603 - RNA, 56 nt, Human
ugcaacugagccaggauugaauacuuggaccccaggucuggagauugggauacugu

SEQ ID NO: 128604 - RNA, 64 nt, Human
ugucucgugggguggcaucggggcugcgggguggggaccccaaggcuuucuggggcagacccuu

SEQ ID NO: 128605 - RNA, 64 nt, Human
aguguguguauguccacguuuguaaucauagaauggaccccauucuuuuguuaaauacacaaga

SEQ ID NO: 128606 - RNA, 64 nt, Human
ugugugucccuggaacauguaaugauagggaacaggaccccagucccuuuccccucagccaagg

SEQ ID NO: 128607 - RNA, 64 nt, Human
ugggcagcccaacagcacuuuuccucuucuagauggaccccagcauuuaagugaccuucugauc

SEQ ID NO: 128608 - RNA, 64 nt, Human
uggcccccucgaggaugacuccacuagcgcccugggaccccaaguaugaagccaaagcaggacc

SEQ ID NO: 128609 - RNA, 64 nt, Human
uugcauuuauggacuuuucacacacucauuuugaggaccccagguucaaaaguaaaagcagugg

SEQ ID NO: 128610 - RNA, 64 nt, Human
uuuaauaucaaaagagucggugugaaccuugguuggaccccaaguucacaagauuuuuaaggug

SEQ ID NO: 128611 - RNA, 64 nt, Human
aggugugagcugggagguugcuggacaggaugggggaccccagaaguccuuuaucugugcucuc

SEQ ID NO: 128612 - RNA, 50 nt, Human
ucagcaauauauugccaugaggaccccaccuuggagggucugaccaucuu

SEQ ID NO: 128613 - RNA, 64 nt, Human
cacaggggcaucuaccuagacaggacagcaggguggaccccaguuuggaagcugagcccccagc

SEQ ID NO: 128614 - RNA, 64 nt, Human
ucugccuguccgggcugggacagagacuccccaaggaccccauucugccuccuucuggggaaau

SEQ ID NO: 128615 - RNA, 64 nt, Human
guguuguguccauuuugcaaacccaacuaagccaggaccccaaugcgacaaguaguucaugagu

SEQ ID NO: 128616 - RNA, 64 nt, Human
uaugagacaggaaaaaccaacagguuuaucugaaggaccccagguaagauguuaaucucccagc

SEQ ID NO: 128617 - RNA, 64 nt, Human
ccuucacucuacaggggacaggagaccauggauuggaccccaaagggauugaacugcaucugca

SEQ ID NO: 128618 - RNA, 64 nt, Human
ccccaggcuuaccuguaggacucaaagggagccaggaccccaucugaaagggucuccucucuca

SEQ ID NO: 128619 - RNA, 64 nt, Human
ucagacaugcacagaaguggagaggaugguccuuggaccccauguguccaucaccuagcugcau

SEQ ID NO: 128620 - RNA, 64 nt, Human
cccaucacccucccuccgucugucuuuccggccuggaccccacccuccacacucucaggccauc

SEQ ID NO: 128621 - RNA, 50 nt, Human
acaucaaaccacgucugugaggaccccagggaccggccugcaccuaccuc

SEQ ID NO: 128622 - RNA, 64 nt, Human
uucucucaugcauucccuggccuggaggcgucagggaccccacauccucccugcuccucagacu

SEQ ID NO: 128623 - RNA, 64 nt, Human
ugccggaggcagugggugcccugguuagggcugaggaccccaagauaggcugaaguccuaacuu

SEQ ID NO: 128624 - RNA, 64 nt, Human
uggugcuucaaagcccugagaagaauauuucuuuggaccccaggcacuaggggccaccugccug

SEQ ID NO: 128625 - RNA, 64 nt, Human
ccccuugaggggccgagcugacauccaaggcugaggaccccaguggggaguguucuguuccggc

SEQ ID NO: 128626 - RNA, 64 nt, Human
cacccccacuccccugcgcagcccccaggccucaggaccccaccccucugaggcccaggggagc

SEQ ID NO: 128627 - RNA, 64 nt, Human
gccaaguucaggcucacugaccuggcucugacgaggaccccaggccacucugagaagaccuugg

SEQ ID NO: 128628 - RNA, 64 nt, Human
ccaugagccuugguaucaagaggccacaagagugggaccccaggggcuccccucccaucuugag

SEQ ID NO: 128629 - RNA, 64 nt, Human
ugacuucaucuacgccucggcaccacggggugugggaccccagcccggagagaacagagggaag

SEQ ID NO: 128630 - RNA, 64 nt, Human
gauaccuguuacuuccuggcugucaacccuuaaaggaccccagugaaaugaugugcauaugaaa

SEQ ID NO: 128631 - RNA, 64 nt, Human
gccuaaucccaggguugagccuugugcucguggcggaccccaaaccacugcccuccuggguacc

SEQ ID NO: 128632 - RNA, 64 nt, Human
caacauccccccaaccccugugcccccaucaucuggaccccagagccagcccucccacuaccac

SEQ ID NO: 128633 - RNA, 64 nt, Human
ggacaccugccauggacacuucacccacccuccaggaccccagcaaguggauucugggcaagcc

SEQ ID NO: 128634 - RNA, 64 nt, Human
uacggcaucucuuaugaucauuggcugccauccaggaccccaauuugugcuucagggggauaau

SEQ ID NO: 128635 - RNA, 64 nt, Human
acuuaaacacuaaccaaugacaguauuuguuccuggaccccacaagacuugauauauauugaaa

SEQ ID NO: 128636 - RNA, 64 nt, Human
uguuuauuauuuauuucccuccccaugccccuggggaccccaaggccccagcuucccucugcac

SEQ ID NO: 128637 - RNA, 64 nt, Human
ugccuccuccucccagccugccccgcugcccagaggaccccacgccucucagaggcagaggucc

SEQ ID NO: 128638 - RNA, 64 nt, Human
uucucucagccuagguucccauuuggggacuucaggaccccagagccacuaggacuuccuuggg

SEQ ID NO: 128639 - RNA, 64 nt, Human
cucccccacuccccuccuugccaggggcacacccggaccccacacggcaggccccucucuuggg

SEQ ID NO: 128640 - RNA, 64 nt, Human
gguggcaggguuuggacccgcccagcagcaccacggaccccagccacucucgggggcagacguc

SEQ ID NO: 128641 - RNA, 64 nt, Human
ucacuguggugucuguguuccaaccacugaaucuggaccccaucugugaauaagccauucugac

SEQ ID NO: 128642 - RNA, 64 nt, Human
uggaaggcuaagagaugugcuguuuuccuucaugggaccccacuuuccacaguaaacaacuggu

SEQ ID NO: 128643 - RNA, 64 nt, Human
ggccugcgagugagccugcccauucugcccugugggaccccaggcccacucaggggucacugag

SEQ ID NO: 128644 - RNA, 64 nt, Human
ccuggggagcuggaccaggagguggaggcucaggggaccccauggggacaggcagagcuggucu

SEQ ID NO: 128645 - RNA, 64 nt, Human
gccuccacggccccuugcccuugcucagguucuuggaccccaggcagcugguguggagccccuu

SEQ ID NO: 128646 - RNA, 64 nt, Human
gcucucuggcgccccacagccuggccagcuccagggaccccaguugcagggcccaagcaggugg

SEQ ID NO: 128647 - RNA, 64 nt, Human
agcugugugggucuaaaaaguuaggcagaauuguggaccccacagccccugaaggguugucaga

SEQ ID NO: 128648 - RNA, 64 nt, Human
ccugauaccucuguggggacuguggggacuuuugggaccccacacacuccaggugggaucagau

SEQ ID NO: 128649 - RNA, 64 nt, Human
gaaaguucuuccuccgagucagucaguggugccgggaccccagggcagccuccucgacuccuga

SEQ ID NO: 128650 - RNA, 64 nt, Human
ccuccgcucugcucccuggcuccaggggugugggggaccccagaaccaggcagagugggaacuu

SEQ ID NO: 128651 - RNA, 64 nt, Human
gaaguggcuggaaaccagaagcuggggauuccagggaccccacuuagugcucuauuuccuuuau

SEQ ID NO: 128652 - RNA, 64 nt, Human
aguaggccaagcagaaagacugcugagguaacacggaccccagccccugucagggccucugcca

SEQ ID NO: 128653 - RNA, 64 nt, Human
uucgguuuagagaacuuugccacaggucuucuggggaccccagaggugucugugcugacaaggc

SEQ ID NO: 128654 - RNA, 64 nt, Human
gacacccacccugugccaucaccauaaccucuggggaccccaaccucagaggcagcuucaagug

SEQ ID NO: 128655 - RNA, 64 nt, Human
agggggcuuccugaggggagacagagcaaccccuggaccccagccucaaauccaggacccugcc

SEQ ID NO: 128656 - RNA, 64 nt, Human
gggcuggggucuucuccugaagccugacuccaugggaccccaaagaagcagauggaaaacugaa

SEQ ID NO: 128657 - RNA, 52 nt, Human
aaaaacuuguaaaccugugaauggaccccaagcaguacacuugcuggucuag

SEQ ID NO: 128658 - RNA, 64 nt, Human
ggcggggccagcacaguagugaaggcggucuccuggaccccagaagcgugcugugguguggacu

SEQ ID NO: 128659 - RNA, 64 nt, Human
ucuucccccgaccaugcugggaauccagaaacagggaccccauuugucuucccauaucuggugg

SEQ ID NO: 128660 - RNA, 64 nt, Human
ggguguccgagaggcugguguaugcacugcucacggaccccauguuggaucuuucucccuuucu

SEQ ID NO: 128661 - RNA, 64 nt, Human
aggccccaggcagcccaagagcucagggagccagggaccccaaggggaguccuuggacaaggag

SEQ ID NO: 128662 - RNA, 64 nt, Human
ucagcccaggcgcccugagcaucuuggggcaccuggaccccaucacaauacuccuucuuccuuc

SEQ ID NO: 128663 - RNA, 64 nt, Human
caaaggagucagggaagggguuggcugagucaagggaccccagagggcaccaggaauaaaaucu

SEQ ID NO: 128664 - RNA, 64 nt, Human
agcggagggcccuguuggggaagguuggguuuuuggaccccagggauaagcuuuuccgauguca

SEQ ID NO: 128665 - RNA, 64 nt, Human
ggccgguuccuuccuggaggccuccuguccucggggaccccagcaccucaucaucagcauugcu

SEQ ID NO: 128666 - RNA, 64 nt, Human
cccuggagcuucuaccaaagacacagcugggucuggaccccacggggcuggggagggccaugug

SEQ ID NO: 128667 - RNA, 64 nt, Human
ccugcgcuuggauugcuagacuccucuuccuccuggaccccauccucuaccauccaagcccugu

SEQ ID NO: 128668 - RNA, 64 nt, Human
caugccacugcacucuagccuaggcuacagagcaggaccccaucuccaaaaaaaaaaaaaaaaa

SEQ ID NO: 128669 - RNA, 64 nt, Human
ccguucccugaaaccguuaaaaaaucaaacaaaaggaccccaaauuaagaaucuaggaagcuca

SEQ ID NO: 128670 - RNA, 64 nt, Human
cccccugcgacucccuguuuccugggcuagucuuggaccccacgagagagaaucguuccucagc

SEQ ID NO: 128671 - RNA, 64 nt, Human
augguuuuucucucagcaugucuccuccaccacgggaccccagcccugaccaacccaugguugc

SEQ ID NO: 128672 - RNA, 64 nt, Human
caccuguuccuucccaaccaccgagcuucaaugaggaccccagccccacuucccuggaacugcc

SEQ ID NO: 128673 - RNA, 64 nt, Human
uuagguguggguacccggggagcaccccguuccuggaccccaguguugcauuuccuggcugagg

SEQ ID NO: 128674 - RNA, 64 nt, Human
gggucagccucugcagcugccucaguuuccccagggaccccaccccccuuugggggucaggaac

SEQ ID NO: 128675 - RNA, 64 nt, Human
ggaaaaugagauuuacuaaguugacuuaccugacggaccccagagaccuauugcauugagcagu

SEQ ID NO: 128676 - RNA, 64 nt, Human
ccaccaucaccgagugagccccgcagccggcugcggaccccaucggcagggagaggaggcgcgg

SEQ ID NO: 128677 - RNA, 64 nt, Human
cugggagacccauguaaauaccagacugcagguuggaccccagagauucccaagccaaaaaccu

SEQ ID NO: 128678 - RNA, 64 nt, Human
gccugcucgcucuuggugugcuucccgugaccuaggaccccagggcccaccuggggccuccuga

SEQ ID NO: 128679 - RNA, 64 nt, Human
uccccccaaucccucaaaccuugaggagaaguggggaccccaccccucaucaggaguuccagug

SEQ ID NO: 128680 - RNA, 64 nt, Human
auuuggagaagggagcggggcaggacuuccaggaggaccccaacccggcccggagagggaggag

SEQ ID NO: 128681 - RNA, 64 nt, Human
guucuuccaggaggccuuauuuugaacugccucaggaccccacuggagagcacagcaugccuua

SEQ ID NO: 128682 - RNA, 64 nt, Human
caucaugcccuuucuuggugcugcuuuuuggguaggaccccacgauuuaggguaacuguuauca

SEQ ID NO: 128683 - RNA, 64 nt, Human
ucaagaccaucacagaccagguccuaauggguguggaccccaggggagaaucagaggucaaagc

SEQ ID NO: 128684 - RNA, 64 nt, Human
gccagcgcuaaaagagggggaggccgagccaagaggaccccaggagcccagagcagcgggagag

SEQ ID NO: 128685 - RNA, 64 nt, Human
cuagcuagcucaacuagugggguuuccuggcacuggaccccagcaagugguccuagaggcccuu

SEQ ID NO: 128686 - RNA, 64 nt, Human
cucuuagguagcguuuccccuaaucguggggguuggaccccagagucuuccaaagaauuuucac

SEQ ID NO: 128687 - RNA, 64 nt, Human
ugcgcacgcugggcggguucgugcauacaugcggggaccccagacugucagcacagggaagaug

SEQ ID NO: 128688 - RNA, 64 nt, Human
gauacugccugguaauccaaagcuagaacucucaggaccccaaacuccaccucuuggauuggcc

SEQ ID NO: 128689 - RNA, 64 nt, Human
aaaaaagguggaaggagcagccagauguuccacaggaccccaccaagaaggucauuuccaaacc

SEQ ID NO: 128690 - RNA, 64 nt, Human
ucagagacugggcggcccggcgggggcucccuggggaccccagaugggcucagugcugccaccc

SEQ ID NO: 128691 - RNA, 64 nt, Human
uaucuuggaauugaagauauaucccuagagcaggggaccccaacccccaggccaugggccacac

SEQ ID NO: 128692 - RNA, 57 nt, Human
agucggaggucucagaguaaggcggcuggaccccaggaaccccagggcacuccacug

SEQ ID NO: 128693 - RNA, 64 nt, Human
gcuuucuuuaccuuuuaacauugccccuuucaggggaccccacuuuguagggaaucugcagaag

SEQ ID NO: 128694 - RNA, 64 nt, Human
uaaucccuuccucucccauucacccuguguaacaggaccccaaggaccugccuccccggaagug

SEQ ID NO: 128695 - RNA, 64 nt, Human
ugccuauggggucccgguguaccuaaagggagaaggaccccaugugcuagccagaaauauacug

SEQ ID NO: 128696 - RNA, 64 nt, Human
caaaaaaagaauuuuucguuuuguguuuugguugggaccccagacgugucaagacuuuuaaccc

SEQ ID NO: 128697 - RNA, 64 nt, Human
ucugucacccucccguggggcgaucacuguguggggaccccauuccccaguuaaagugugucuc

SEQ ID NO: 128698 - RNA, 64 nt, Human
caccuugggcuggucuuuggccuggugcucacugggaccccauaugucugcguaggagcagaac

SEQ ID NO: 128699 - RNA, 64 nt, Human
uugugcacagccgagaaguggucaagcuagaaugggaccccagguuugugcucccuacucucca

SEQ ID NO: 128700 - RNA, 64 nt, Human
ugucccuuuuguguaucugucauccggaugcuucggaccccacgccucugcaagugggagagac

SEQ ID NO: 128701 - RNA, 64 nt, Human
gaaggcuggauggaagauucugagccuggaauuaggaccccauggaggcaguucaguaacuaaa

SEQ ID NO: 128702 - RNA, 64 nt, Human
acucagacuaaauagcauucaguaggacuggacuggaccccagguuuccuuuacaugagauccc

SEQ ID NO: 128703 - RNA, 64 nt, Human
uccauaagaagcugaccgagggugugcugaugcgggaccccaaguucuuguggugugcccaggu

SEQ ID NO: 128704 - RNA, 64 nt, Human
ccguuccuaccgcagguccagggccugggcccgcggaccccacaggcaggcggcggcgcuccac

SEQ ID NO: 128705 - RNA, 64 nt, Human
cagcagugccgcagcguuucgaggggcgugugcuggaccccaccacuguggguugcaggcccaa

SEQ ID NO: 128706 - RNA, 64 nt, Human
cuggaggaggcaagggguaguguggcuggguucgggaccccacagggccauugcccaggagaau

SEQ ID NO: 128707 - RNA, 64 nt, Human
acucugcaggccuggcagaagaguccucuggggaggaccccaagggccggagacccaaagauca

SEQ ID NO: 128708 - RNA, 64 nt, Human
acauucucaagaguugcuugaccgaaaguuacaaggaccccaaccccuuuguccucucuaccca

SEQ ID NO: 128709 - RNA, 64 nt, Human
ucacuaaagcugagucaauggggcuauugucugaggaccccaagagcagugauucagagaacag

SEQ ID NO: 128710 - RNA, 64 nt, Human
ucagcauccauuuguacauuaguaugguucuacaggaccccagcuguggaaguaacaaauuucu

SEQ ID NO: 128711 - RNA, 64 nt, Human
gaggccagucuuggccacucaccccacaccccgcggaccccaauaaaggcuugcauagcuccag

SEQ ID NO: 128712 - RNA, 64 nt, Human
aaucaggccugaugagggggaauuccuggaaccuggaccccagccuuggugggggagccucugg

SEQ ID NO: 128713 - RNA, 64 nt, Human
ccucagccccuuguucuucccuguccuccacccuggaccccagccggcugcuggagcccagagg

SEQ ID NO: 128714 - RNA, 64 nt, Human
gugggccuggagggcauuaauauuacacucacagggaccccagugcaucagcugaacgagacca

SEQ ID NO: 128715 - RNA, 58 nt, Human
aggcaaaggccaucuccuaauggaccaaggaccccagagcccaccugugugacgcugc

SEQ ID NO: 128716 - RNA, 64 nt, Human
ccugaggcuccacagagagaaauuccuggaaucuggaccccauggcccagucagguuacacaaa

SEQ ID NO: 128717 - RNA, 64 nt, Human
caccaaaguauuuuuuuaucuugggacuggguuuggaccccagcugggaggcaagaggggugga

SEQ ID NO: 128718 - RNA, 64 nt, Human
ugguggccacccuaccaugagagucagccguaggggaccccagaccccuugguuuccuuggaaa

SEQ ID NO: 128719 - RNA, 51 nt, Human
guguuguuccugugccgugauggaccccagagccccuccuccagccccugu

SEQ ID NO: 128720 - RNA, 64 nt, Human
auggucaggugggcgaugccaacauuaauacucaggaccccaagauacagaaggaaaucaugcg

SEQ ID NO: 128721 - RNA, 64 nt, Human
cuagggacguucucucuccaguccucagggaagaggaccccaggacuucgcagcaggcccccuc

SEQ ID NO: 128722 - RNA, 64 nt, Human
acugccgggaccuacugcagcggcuccuggagcgggaccccagccgucgcaucuccuuccagga

SEQ ID NO: 128723 - RNA, 64 nt, Human
uccuucuaccaggaccucagaagcccagaccuggggaccccaccuacacaggggcauugacaga

SEQ ID NO: 128724 - RNA, 64 nt, Human
gaccaggagcagcugugagcuggagacagcagagggaccccaggguguccccugcagaucccac

SEQ ID NO: 128725 - RNA, 64 nt, Human
caacccugucccucggcccggcccugccagagagggaccccagcacaucgugggcacgggcagg

SEQ ID NO: 128726 - RNA, 64 nt, Human
gugagugggggggcauggggcaguuuccuuugguggaccccaggacuucggcccacuccggggc

SEQ ID NO: 128727 - RNA, 64 nt, Human
cuuccaucuguggccaccucccgggcuguccgagggaccccaggguaccucacacucggagcuc

SEQ ID NO: 128728 - RNA, 64 nt, Human
ccgccaagaucagggcuacagaugucugcucucuggaccccacgugaucuggccacuggggacc

SEQ ID NO: 128729 - RNA, 64 nt, Human
ccaccccaggucuaguggccccacccuccauuccggaccccaugggcccagccccugcccaucu

SEQ ID NO: 128730 - RNA, 64 nt, Human
ggagcuggaagaggccgugggccgcauccaccugggaccccaggguggcccggagucagugggu

SEQ ID NO: 128731 - RNA, 64 nt, Human
agccccuccccagggccccacccugccauaugaaggaccccacccccgacaccacaaggcauua

SEQ ID NO: 128732 - RNA, 64 nt, Human
ggcuccugcuagagaggguggcaggccugcugcuggaccccagaggccacugugaccgccaagg

SEQ ID NO: 128733 - RNA, 64 nt, Human
ugguuacgucagccgguccauggcgguguccugcggaccccagagcccccgggaagggcgcaag

SEQ ID NO: 128734 - RNA, 64 nt, Human
gcccggggcugucccgugcauggguuggcuguggggaccccaggugggccuggcaggacuccag

SEQ ID NO: 128735 - RNA, 64 nt, Human
acaucuugcugguggaggcauggcccacugugcaggaccccacccucgggggcuuucggcuccc

SEQ ID NO: 128736 - RNA, 64 nt, Human
ucccacacagccaugcauugucacucugccuccgggaccccagcuugggagcugugggucugcc

SEQ ID NO: 128737 - RNA, 64 nt, Human
ggucugggcaaguagcaggacuaggcaugucagaggaccccagggugguuagaggaaaagacuc

SEQ ID NO: 128738 - RNA, 64 nt, Human
cucccacucuuaucaccucuccccagcaagugcuggaccccagguagccucuuggagaugaccg

SEQ ID NO: 128739 - RNA, 64 nt, Human
aguacccucccuacaucaauguggcugcuggccuggaccccaggggucugguacagccaagaug

SEQ ID NO: 128740 - RNA, 64 nt, Human
cuagccggcguccccugccuccagaacgcgggcuggaccccaauggagaacaggugguguggca

SEQ ID NO: 128741 - RNA, 64 nt, Human
auucuacaacagaaaaaaucgaaccaagagaacuggaccccauccugacugaggucacccugau

SEQ ID NO: 128742 - RNA, 64 nt, Human
ugucaagagucgcugugccacaggcuuagggacaggaccccagcucugcgucgguccuggugcc

SEQ ID NO: 128743 - RNA, 64 nt, Human
uguggaugcuacugcucguggccuacgggcagagggaccccagcgccuaccaccucaacagaca

SEQ ID NO: 128744 - RNA, 64 nt, Human
gugugccccauguuguguuaacaccugcguguggggaccccaucugaggucuuggcugagguug

SEQ ID NO: 128745 - RNA, 64 nt, Human
gauccuuggugcugugugccccacuccagccuggggaccccacuucagaagguaggggccgugu

SEQ ID NO: 128746 - RNA, 64 nt, Human
ggcagcugucacaucugaaggguuucugcaaccuggaccccaucugggugugggucagacccug

SEQ ID NO: 128747 - RNA, 64 nt, Human
ccaugcccgguuugcuguuggaaugaucugaacaggaccccaaaugccucuucccucuggucau

SEQ ID NO: 128748 - RNA, 64 nt, Human
gcccucagaauuggggcaugggaggggggcugggggaccccaugauucagccacggacuccaau

SEQ ID NO: 128749 - RNA, 64 nt, Human
gaagccuuauccuacguccuucucuccaucuaucggaccccaguuuccaucacuaucuccagag

SEQ ID NO: 128750 - RNA, 64 nt, Human
ccucccucccucagcccggcugggacugucucccggaccccagugcuggggugggggaaggggg

SEQ ID NO: 128751 - RNA, 64 nt, Human
gggucugggcccugcucccugucccaucugcaguggaccccaggcaccccccuuugaggaggug

SEQ ID NO: 128752 - RNA, 64 nt, Human
cauccccaaacgcuccuuggggcgugguuccuguggaccccagcucagcucgucaagcugcagg

SEQ ID NO: 128753 - RNA, 62 nt, Human
uccugggagaagacucauaggggcugggccucggaccccacuccggcccuccagagccccac

SEQ ID NO: 128754 - RNA, 64 nt, Human
acacauuccagggcuggggugagccugacugccaggaccccaggucaggggcucccuacauucc

SEQ ID NO: 128755 - RNA, 64 nt, Human
gggaggcugggggagcuguguccugcaguucccaggaccccauccucucagaagguaggggaag

SEQ ID NO: 128756 - RNA, 64 nt, Human
gugagggacaguacugaagacucugcagcccucgggaccccacucggagggugcccucugcuca

SEQ ID NO: 128757 - RNA, 64 nt, Human
cucccuagcaccucccccuaaccaaauucucccuggaccccauucugagcuccccaucaccaug

SEQ ID NO: 128758 - RNA, 64 nt, Human
auuuccucaguacccacaaagugcagcccacauuggaccccagacaccccucugcagccauuga

SEQ ID NO: 128759 - RNA, 64 nt, Human
augaccugcgcucucagcugaccaucaucccgcaggaccccauccuguucucggggacccugcg

SEQ ID NO: 128760 - RNA, 64 nt, Human
acacagacaaagugacauuccugagucugaagcuggaccccaaccaggcuaaauuuggguacug

SEQ ID NO: 128761 - RNA, 64 nt, Human
ugaccccuugccacaacuggaaacacuugaaaggggaccccagggccagcuguuucagggguuu

SEQ ID NO: 128762 - RNA, 64 nt, Human
ugggcugccugggaggcuuccugguguggugucuggaccccacggccuugggucauccuguggc

SEQ ID NO: 128763 - RNA, 64 nt, Human
gggggucucuaccuccccaucaacagcugcagggggaccccagugccaacuuccucucccacua

SEQ ID NO: 128764 - RNA, 50 nt, Human
ggcuggucggcuucugcuagggaccccaccgggugugguuuugauacccc

SEQ ID NO: 128765 - RNA, 64 nt, Human
uuuucccaagaaaauuauuuuugaaauuaaaacaggaccccaaaugaaauccaaguggucuucu

SEQ ID NO: 128766 - RNA, 64 nt, Human
ugcugacccugcagagggaagggguggggaugcaggaccccacucugcgggagccccauagcca

SEQ ID NO: 128767 - RNA, 64 nt, Human
gccaguucugccucucugacaaccaucagccaccggaccccaccccgaggcaucaccacaaauc

SEQ ID NO: 128768 - RNA, 64 nt, Human
gccugacugaccccugccagggcacagauaggcaggaccccagagagggcaggcagccacgccc

SEQ ID NO: 128769 - RNA, 64 nt, Human
acugagcacccaucuggccugcacccuugacaaaggaccccaggaccaggcagaaggcgccucc

SEQ ID NO: 128770 - RNA, 64 nt, Human
agcaggccuuagccugcacuccaggcuccuucuuggaccccaggcugugagcacacuccugccu

SEQ ID NO: 128771 - RNA, 64 nt, Human
cuuuucuggcuucugccaugaaauccuggccaugggaccccagugacagaugaugucuuccaug

SEQ ID NO: 128772 - RNA, 64 nt, Human
ucccccuuuuucguugugcagccuggccccccagggaccccagagggccagggcgcuagaugca

SEQ ID NO: 128773 - RNA, 59 nt, Human
ggacagccagccagcgcugagugcaggaaggaccccaggucuucccuggaggcagccuc

SEQ ID NO: 128774 - RNA, 64 nt, Human
gaacgggaaguggaccccagcccgggagccugcuggaccccagaucguccccuccucccagcug

SEQ ID NO: 128775 - RNA, 64 nt, Human
uggucggucuccacucccagggagaacgggaaguggaccccagcccgggagccugcuggacccc

SEQ ID NO: 128776 - RNA, 53 nt, Human
ccgugcaauauagcaaguagucaggaccccagcucacuuuuucauagucauug

SEQ ID NO: 128777 - RNA, 64 nt, Human
cacugggcccuccuuccuccuggugcuaauuuggggaccccaggggccgcccccggccucuucu

SEQ ID NO: 128778 - RNA, 64 nt, Human
uccaggcucaguauugugaccgcggagccacaggggaccccacgcacauuccguugccuuaccc

SEQ ID NO: 128779 - RNA, 64 nt, Human
cccucaccucucccccaaggccacugcgcucuugggaccccagagaaaacccggagcaagcagg

SEQ ID NO: 128780 - RNA, 64 nt, Human
gacccuggugcagacgccgggccggcugacauuuggaccccaucccagaggagaugcuggcuac

SEQ ID NO: 128781 - RNA, 64 nt, Human
gcgccccagcucgcgccccuucccauauuuauucggaccccaagcaucgccccaauaaagacca

SEQ ID NO: 128782 - RNA, 64 nt, Human
caggaccgugccacaccagcuguccagagucggaggaccccagcuccucagcuugcauggacuc

SEQ ID NO: 128783 - RNA, 64 nt, Human
ugggacaaagguccuaacaggagucacuggcucaggaccccagggagaaacgcucuccccaccc

SEQ ID NO: 128784 - RNA, 64 nt, Human
ggccagucuccaggccugguccacggacuggcagggaccccaggcacaagagcugccaccccuc

SEQ ID NO: 128785 - RNA, 64 nt, Human
cauccuggccgcaccccccuuuccaggguccuccggaccccaccuuccacacucugaucacagc

SEQ ID NO: 128786 - RNA, 64 nt, Human
agcccucccccuguccucagcgugcagcccuagaggaccccagggcugaggggcaguggauccu

SEQ ID NO: 128787 - RNA, 64 nt, Human
cauuggcuuggguggcagagcccacuuguuucagggaccccaggaggugcccccuggcucccag

SEQ ID NO: 128788 - RNA, 64 nt, Human
ccaaaaucuguuccgcuguaacagaacugaauuuggaccccagcacaguggcucacgccuguaa

SEQ ID NO: 128789 - RNA, 64 nt, Human
uguagaaaucgggguucccucuuucucucugccaggaccccauagagucacagcuuuuggaggg

SEQ ID NO: 128790 - RNA, 64 nt, Human
cuccagcagcuggacucugggcccacaaggggagggaccccagccaguauucccucagagccgg

SEQ ID NO: 128791 - RNA, 64 nt, Human
gacgcucaggucuccuaagaccucauccugcuggggaccccacgaggggacauccacccucugg

SEQ ID NO: 128792 - RNA, 64 nt, Human
aagagggcagcuccagaagcugcccagggcuccgggaccccaucccaugguggcaggugcagcg

SEQ ID NO: 128793 - RNA, 64 nt, Human
cggguggggggcagaggcgcccagccuuggauggggaccccagccccuggccuguaccuguuuc

SEQ ID NO: 128794 - RNA, 64 nt, Human
uccucagcagccuggcaggcaggaaacagacauaggaccccagcccagaucugaauggcauggg

SEQ ID NO: 128795 - RNA, 64 nt, Human
guucccacauucgcacuccauggccuccuguccuggaccccacgucugcaaggaaacccuagga

SEQ ID NO: 128796 - RNA, 64 nt, Human
gggagccacgucucuugcacuguggucucugcauggaccccagggcuguggggacuugggggac

SEQ ID NO: 128797 - RNA, 64 nt, Human
gagggggucgacagguugaacgucuucaggcccaggaccccaagcuccucagccuggccccugg

SEQ ID NO: 128798 - RNA, 64 nt, Human
ggcuuuuggggauggggcagcaaaguugggagcuggaccccaauugaguggggguagcaauugg

SEQ ID NO: 128799 - RNA, 64 nt, Human
gcauuccuuccccuucccaguccauaaaaaccccggaccccagccucauacugggcaacuuauu

SEQ ID NO: 128800 - RNA, 64 nt, Human
aggggcaaagggcucaagggugaggaggccagugggaccccacagaguuggggagauaaaggaa

SEQ ID NO: 128801 - RNA, 64 nt, Human
guuggcagaaacguucccaaacucccccagcccuggaccccagcagaugaggaaacggccccau

SEQ ID NO: 128802 - RNA, 64 nt, Human
gcucacagggcuagaaguccagaacauguaugugggaccccagaccaucccagccaccccccau

SEQ ID NO: 128803 - RNA, 64 nt, Human
ccuucaccacauauuagugcuugacccuggcaggggaccccauggaaaagauggggaagagcaa

SEQ ID NO: 128804 - RNA, 57 nt, Human
aggugccccagcaucugugauccuccgggaccccagcccucaggauuccugaugcuc

SEQ ID NO: 128805 - RNA, 64 nt, Human
cacuaacagauggggcccagcccccuuccucccuggaccccacgggccccugucccaggaaccc

SEQ ID NO: 128806 - RNA, 64 nt, Human
agaaaccagggcuucccuacccccagcugacacuggaccccaacauguaugcucaguagcugcu

SEQ ID NO: 128807 - RNA, 64 nt, Human
augcaugggagcugcccccccaguggacaccauuggaccccacccagccuggaucuaccccagg

SEQ ID NO: 128808 - RNA, 64 nt, Human
gggggacccagaccccacaagccauggagacucaggaccccagaaggcauggaagcugccucca

SEQ ID NO: 128809 - RNA, 64 nt, Human
ucuuccuggggcuucugcgcuguuguuggggaagggaccccaguccugccuuccaccccccaac

SEQ ID NO: 128810 - RNA, 64 nt, Human
gggauggggacagggugcacagcagggcgggguaggaccccagccccucccaaaacagccucuc

SEQ ID NO: 128811 - RNA, 64 nt, Human
cagcugacuguauccagggcuuccuggacuccugggaccccacguccugcaccccggcuucuga

SEQ ID NO: 128812 - RNA, 64 nt, Human
gguucccugagcuguccagaccccaccaucucccggaccccagggagguggccauugccagaag

SEQ ID NO: 128813 - RNA, 64 nt, Human
gaagggacaaaagccuguuccagagacccugggaggaccccaggcagggagagcccgccugccu

SEQ ID NO: 128814 - RNA, 64 nt, Human
gccugccggcaucaccugcggccacaccugagauggaccccacgcagcccugaucgcaggaggc

SEQ ID NO: 128815 - RNA, 64 nt, Human
cggagccccauccugggccugcccuggcuggccaggaccccagcgguucuugguccuguaugau

SEQ ID NO: 128816 - RNA, 64 nt, Human
cauuccccucccccugugguccagugaagccuccggaccccaggcucugcucugcccugcccug

SEQ ID NO: 128817 - RNA, 64 nt, Human
ccugggccccggcccuugagguacucccugagcaggaccccacacuugggugggggggcuuauc

SEQ ID NO: 128818 - RNA, 64 nt, Human
ccuggggaacaccccuggacccaggcaucggccaggaccccauagagcaccccggucugcccug

SEQ ID NO: 128819 - RNA, 64 nt, Human
gcagggcugccacugaccugaagacuccggacugggaccccacuccgagggcagcucccggccu

SEQ ID NO: 128820 - RNA, 64 nt, Human
uaugucaaaauuuaccagaagccaagaugauguaggaccccaaagguggguuguuaagagaugc

SEQ ID NO: 128821 - RNA, 64 nt, Human
agggagucagauccccucaaccccccggcuucagggaccccagaagugccuuccaagcuucccc

SEQ ID NO: 128822 - RNA, 64 nt, Human
uauuugggggaaguguagugaggaggagcccagaggaccccaggggagugaggagggagaacuu

SEQ ID NO: 128823 - RNA, 64 nt, Human
agaccacccuccaugcuccacccccaggcgguuuggaccccaccacuguugccauggugaccaa

SEQ ID NO: 128824 - RNA, 64 nt, Human
gauuucaaucuacguucuagucacuggccucaaaggaccccacagcaccugggccagaccaaca

SEQ ID NO: 128825 - RNA, 64 nt, Human
cucuauuuuuuaaguaacgacuucccccuuugggggaccccaaaauuuggaggccccauucuag

SEQ ID NO: 128826 - RNA, 64 nt, Human
guauuuuggagccucuucuguccccuucuuucuaggaccccaguuaaaaaaaaaaaaaacaaaa

SEQ ID NO: 128827 - RNA, 64 nt, Human
uccucccuccaggcugaaccccacuuccucggcaggaccccagucucagcagccuccugauuuc

SEQ ID NO: 128828 - RNA, 64 nt, Human
gcggcucugggaagcggaaagcagucagcggagaggaccccauucugggacugcucaggcuccc

SEQ ID NO: 128829 - RNA, 64 nt, Human
uccuccaucugcccagaugggagaauagggggcuggaccccaggguccgaaugagcccugugag

SEQ ID NO: 128830 - RNA, 64 nt, Human
cugccucugguucccgccugguccuccagcuucaggaccccaccuccaaaggccccucugcuca

SEQ ID NO: 128831 - RNA, 64 nt, Human
cuccuagggccuggguacagggcaugaguuggacggaccccaggguuauuauugccuuugcuuu

SEQ ID NO: 128832 - RNA, 64 nt, Human
cugagagaccucagggauggcccagcugaucuaaggaccccaguuugggaacucaucaaauaau

SEQ ID NO: 128833 - RNA, 54 nt, Human
accgccuggucagggacugaagggggaccccaaaacuggcucaccccccagaac

SEQ ID NO: 128834 - RNA, 64 nt, Human
uggccuaggcccgggaucggaccaggcucccucaggaccccauccuuuccugcccggaccguga

SEQ ID NO: 128835 - RNA, 64 nt, Human
cggccgucccauggcuuccaucugagccaccucgggaccccagcgcuccuggcgcccucuucuc

SEQ ID NO: 128836 - RNA, 64 nt, Human
cuggaaggggcgcugagaaaggcaccagcuccuuggaccccaccucccaugcucucacucucau

SEQ ID NO: 128837 - RNA, 64 nt, Human
acagucaaauucaguguacuugauaauaucaacuggaccccaaaucugucucacggucuuccug

SEQ ID NO: 128838 - RNA, 64 nt, Human
ccuugugugguucuugccuaacucugugguuuuuggaccccauggggcccagacagagcacagg

SEQ ID NO: 128839 - RNA, 64 nt, Human
cccgucugggaaggccccaaggucagcuuaugaaggaccccacuugcaccccaccccagccaug

SEQ ID NO: 128840 - RNA, 64 nt, Human
uugugucgcugaagcgccucccccagggaccggcggaccccagccauccagggggcaagaggaa

SEQ ID NO: 128841 - RNA, 64 nt, Human
cuugcucugaccuauaaugucuuaggugcaacacggaccccaccagagcucuuggauacccccc

SEQ ID NO: 128842 - RNA, 64 nt, Human
ccaggaagaggaaguaaaucugcaacccuggggaggaccccaacucaccugggaaugaggcaaa

SEQ ID NO: 128843 - RNA, 64 nt, Human
uuaaagaauuauuaggccaccuucucccuuuccuggaccccagagucauuccuccauuugguua

SEQ ID NO: 128844 - RNA, 64 nt, Human
ccugccugacagccuuccccagcuccagcaggaaggaccccacauccuucucacugccauggaa

SEQ ID NO: 128845 - RNA, 64 nt, Human
acagacucacugggaagcucccaccccacucaggggaccccacuccccucacacacaccccccc

SEQ ID NO: 128846 - RNA, 64 nt, Human
cuagagaccccacaagcacuauggacgaagcgugggaccccagcacgggcugcccucaggaaga

SEQ ID NO: 128847 - RNA, 64 nt, Human
uucgauuuguuuccuguuuauucuucuucccgagggaccccagguuccagggaccgacugagcc

SEQ ID NO: 128848 - RNA, 64 nt, Human
ccccucugccauccacgucaggucuuugguggggggaccccaaagccauucugggaagggcucc

SEQ ID NO: 128849 - RNA, 50 nt, Human
uacgggagaccgauauuuaaggaccccagagcuaggccgcggagugugcu

SEQ ID NO: 128850 - RNA, 64 nt, Human
cuauugcccccagaggccucugaaccccaggcugggaccccagcacagaggcaauaaaggcagu

SEQ ID NO: 128851 - RNA, 64 nt, Human
agagucccuccuucucccagguuuggucucagggggaccccagggaugccccagaucaggggcc

SEQ ID NO: 128852 - RNA, 64 nt, Human
uggggccaugaucgggcccgggggccugagccugggaccccaccccguguuaaugaaaaaugag

SEQ ID NO: 128853 - RNA, 64 nt, Human
caagauggccuggagaccacccagcccugaccugggaccccaggcccaggggcacauugaacag

SEQ ID NO: 128854 - RNA, 64 nt, Human
agcccucaauccccaagcuggcagcugucauucaggaccccaaccccucucagccccucuuuuc

SEQ ID NO: 128855 - RNA, 64 nt, Human
ugaggugguguccugcacggaauagaaggggaaaggaccccagagaaguggcugugacccgucc

SEQ ID NO: 128856 - RNA, 64 nt, Human
cagaaagcccaguguuuuugcaaagaaugaaaagggaccccauauguagcaaaaaucagggcug

SEQ ID NO: 128857 - RNA, 64 nt, Human
gccaccucggccagggcagcccaccaugcuaaaaggaccccaaaugguggucguugucccuucu

SEQ ID NO: 128858 - RNA, 64 nt, Human
cccccuggccccucccacaucccccguguauucaggaccccaucugcugagcucugaccugccc

SEQ ID NO: 128859 - RNA, 64 nt, Human
gggaguaaggcugguccugggguccucccugcacggaccccacugggccugccgagugcugugu

SEQ ID NO: 128860 - RNA, 64 nt, Human
aggagcuucggaccaagaucaaaccaaacaguggggaccccaacagaagagaaagacugaagga

SEQ ID NO: 128861 - RNA, 64 nt, Human
augcugaucaccagggccgagggggcucccagaaggaccccaggcccuggggaggguggcugug

SEQ ID NO: 128862 - RNA, 64 nt, Human
uuuacacggcagagaggaaggacgcggccgccauggaccccaugggagagugaguaugagccgc

SEQ ID NO: 128863 - RNA, 64 nt, Human
ucccccaguccuucccagaugauggcugccugugggaccccagcuacucccccagacccaaguu

SEQ ID NO: 128864 - RNA, 64 nt, Human
caaaugacaaaaaucuauauuacuuucucaaaauggaccccaaagaaacuuugauuuacuguuc

SEQ ID NO: 128865 - RNA, 64 nt, Human
ugcccggcagcaacugggguggccagguggggcgggaccccagcaccucccccaacugacccug

SEQ ID NO: 128866 - RNA, 64 nt, Human
uucggauucaugaggaaagagaaauccugggguuggaccccaagacgacguacaacagguucug

SEQ ID NO: 128867 - RNA, 64 nt, Human
gcaggggguucccccugcugaggagagaccagguggaccccagcugccugucacccuucaucug

SEQ ID NO: 128868 - RNA, 64 nt, Human
cugccacacauccgccauggugccacggggaccaggaccccacagcgcacccccccuccccacc

SEQ ID NO: 128869 - RNA, 64 nt, Human
cugccuugguuccuggaccccugggcccauccugggaccccagaugggguaaggagaggcccca

SEQ ID NO: 128870 - RNA, 64 nt, Human
cccuggucugcaggaaggaggacagcagacuuuaggaccccacagcauggcagugcugaccauu

SEQ ID NO: 128871 - RNA, 64 nt, Human
ucuucuccuugggccccuuccucugacccucguuggaccccaacccagacccccuuuucuccau

SEQ ID NO: 128872 - RNA, 64 nt, Human
ggacagaaccccgggagcacugcccuaggagcccggaccccacgagcucagucccagcucugcc

SEQ ID NO: 128873 - RNA, 64 nt, Human
cucgcauguccuaggucccuggguggacccaucaggaccccaagugauagugacccaguggucu

SEQ ID NO: 128874 - RNA, 64 nt, Human
uccaaguccucccaaaggacagcagugauggagaggaccccagccagcugugugacagcugguu

SEQ ID NO: 128875 - RNA, 64 nt, Human
agcccaaccucgggccugcgucugagguggcccaggaccccaagcugcagagcccagggaagag

SEQ ID NO: 128876 - RNA, 64 nt, Human
aaaaccccucuuaucuaggaggcuuuaacuuccuggaccccaggauucaccuuccuaguggugu

SEQ ID NO: 128877 - RNA, 64 nt, Human
acagcagcgagccagcggccggacucuguauuucggaccccacuccagugcucccugggucaua

SEQ ID NO: 128878 - RNA, 64 nt, Human
gcaaacagccgccaucaggguucaccucggugggggaccccacucacccccuuagggucgccac

SEQ ID NO: 128879 - RNA, 64 nt, Human; identical to SEQ ID NO: 128867

SEQ ID NO: 128880 - RNA, 64 nt, Human
ugucccagcacugccgcuccccaccccugagccaggaccccagaggauggccaugccccgugcc

SEQ ID NO: 128881 - RNA, 64 nt, Human
ccccaauuaccugccccucccugaggaacagccaggaccccaucugccacccccgcagcaguga

SEQ ID NO: 128882 - RNA, 64 nt, Human
gcugacagcaggagccuggugcgccuaggcccucggaccccauccccaccccagccgggcccgc

SEQ ID NO: 128883 - RNA, 64 nt, Human
cauuagaaagggcucauuaagccuuuuggacacaggaccccagagaggaaaaagugacuugccc

SEQ ID NO: 128884 - RNA, 64 nt, Human
aacagccucagcacauccgacaccucccagcgugggaccccaagugaagacgaggccaaggcug

SEQ ID NO: 128885 - RNA, 64 nt, Human
aagcaggcuaggcccaauuguugcgggaagucagggaccccaaacggagggacuggcugaagcc

SEQ ID NO: 128886 - RNA, 64 nt, Human
agcagggaugaguccugguucccuugcccgcgugggaccccaauagaacucagcccuuccaugc

SEQ ID NO: 128887 - RNA, 64 nt, Human
agcacccccaguaggguaggauuguguaugagggggaccccacuaucucagugguggggguggc

SEQ ID NO: 128888 - RNA, 64 nt, Human
gccccuggcaccccacccacuccauccuacccagggaccccaaguaggcaacuguuauggcagu

SEQ ID NO: 128889 - RNA, 64 nt, Human
uguccugggucacuguggcuggugaggaccucaaggaccccaucaaguguacacagcagcagca

SEQ ID NO: 128890 - RNA, 64 nt, Human
uuggacuuggaagaagcccacauuggagaggugaggaccccaugguggcucuaguggaagauac

SEQ ID NO: 128891 - RNA, 64 nt, Human
uccuaagacugcagucaaagccagaacugagaggggaccccagacugggcccagaggcuggcca

SEQ ID NO: 128892 - RNA, 64 nt, Human
gacaccgcacgccagcgccccgcggccgcgauccggaccccaagcccacggcucccucgacucu

SEQ ID NO: 128893 - RNA, 64 nt, Human
cagcggggcggggcccgagcgucgggcgaggccgggaccccagcgcugcgccgcguccgaacgu

SEQ ID NO: 128894 - RNA, 64 nt, Human
aauuguuagguagaaaccugggcugggaggccucggaccccaggcuccaucccuggcuucccca

SEQ ID NO: 128895 - RNA, 64 nt, Human
cauccagcacauggggugccugggccucagauggggaccccaaagaagcagaagcugaagaagg

SEQ ID NO: 128896 - RNA, 64 nt, Human
auacaggacaggcugcacaucucaguauauguagggaccccaaaugaccacaacacaguacaau

SEQ ID NO: 128897 - RNA, 64 nt, Human
gguuccuuuagcccauuugcuuucucuaccuuggggaccccaggggccaagcaguucuccaucu

SEQ ID NO: 128898 - RNA, 53 nt, Human
acauccaggccugccaguaagggggaccccacgugggccaaucuacaaauaug

SEQ ID NO: 128899 - RNA, 64 nt, Human
ugcagcuggucuuuggcauugacgugaaggaagcggaccccaccagcaacaccuacacccuugu

SEQ ID NO: 128900 - RNA, 64 nt, Human
ggccuggggaggacuugguggcgauccgcaaccuggaccccagugagaggcggugggcugacug

SEQ ID NO: 128901 - RNA, 64 nt, Human
cugcuaaucaagggugaugcacagcaaaagcaauggaccccaucccucuaaagccugcccuccu

SEQ ID NO: 128902 - RNA, 64 nt, Human
gaccguuuggagaccaagcagcagaugcagguguggaccccaggaaccuacaggggugucagcc

SEQ ID NO: 128903 - RNA, 64 nt, Human
auuuuuggcacauuuguucuggccuggcuuggugggaccccaccccuauucugcuucugugagu

SEQ ID NO: 128904 - RNA, 64 nt, Human; identical to SEQ ID NO: 128494

SEQ ID NO: 128905 - RNA, 64 nt, Human; identical to SEQ ID NO: 128495

SEQ ID NO: 128906 - RNA, 64 nt, Human; identical to SEQ ID NO: 128496

SEQ ID NO: 128907 - RNA, 64 nt, Human; identical to SEQ ID NO: 128497

SEQ ID NO: 128908 - RNA, 64 nt, Human; identical to SEQ ID NO: 128498

SEQ ID NO: 128909 - RNA, 64 nt, Human; identical to SEQ ID NO: 128499

SEQ ID NO: 128910 - RNA, 64 nt, Human; identical to SEQ ID NO: 128500

SEQ ID NO: 128911 - RNA, 64 nt, Human; identical to SEQ ID NO: 128501

SEQ ID NO: 128912 - RNA, 64 nt, Human; identical to SEQ ID NO: 128502

SEQ ID NO: 128913 - RNA, 64 nt, Human; identical to SEQ ID NO: 128503

SEQ ID NO: 128914 - RNA, 64 nt, Human; identical to SEQ ID NO: 128504

SEQ ID NO: 128915 - RNA, 64 nt, Human; identical to SEQ ID NO: 128505

SEQ ID NO: 128916 - RNA, 64 nt, Human; identical to SEQ ID NO: 128506

SEQ ID NO: 128917 - RNA, 64 nt, Human; identical to SEQ ID NO: 128507

SEQ ID NO: 128918 - RNA, 64 nt, Human; identical to SEQ ID NO: 128508

SEQ ID NO: 128919 - RNA, 64 nt, Human; identical to SEQ ID NO: 128509

SEQ ID NO: 128920 - RNA, 64 nt, Human; identical to SEQ ID NO: 128510

SEQ ID NO: 128921 - RNA, 53 nt, Human; identical to SEQ ID NO: 128511

SEQ ID NO: 128922 - RNA, 64 nt, Human; identical to SEQ ID NO: 128512

SEQ ID NO: 128923 - RNA, 62 nt, Human; identical to SEQ ID NO: 128513

SEQ ID NO: 128924 - RNA, 64 nt, Human; identical to SEQ ID NO: 128514

SEQ ID NO: 128925 - RNA, 64 nt, Human; identical to SEQ ID NO: 128515

SEQ ID NO: 128926 - RNA, 64 nt, Human; identical to SEQ ID NO: 128516

SEQ ID NO: 128927 - RNA, 64 nt, Human; identical to SEQ ID NO: 128517

SEQ ID NO: 128928 - RNA, 64 nt, Human; identical to SEQ ID NO: 128518

SEQ ID NO: 128929 - RNA, 64 nt, Human; identical to SEQ ID NO: 128519

SEQ ID NO: 128930 - RNA, 64 nt, Human; identical to SEQ ID NO: 128520

SEQ ID NO: 128931 - RNA, 64 nt, Human; identical to SEQ ID NO: 128521

SEQ ID NO: 128932 - RNA, 64 nt, Human; identical to SEQ ID NO: 128522

SEQ ID NO: 128933 - RNA, 64 nt, Human; identical to SEQ ID NO: 128523

SEQ ID NO: 128934 - RNA, 64 nt, Human; identical to SEQ ID NO: 128524

SEQ ID NO: 128935 - RNA, 64 nt, Human; identical to SEQ ID NO: 128525

SEQ ID NO: 128936 - RNA, 63 nt, Human; identical to SEQ ID NO: 128526

SEQ ID NO: 128937 - RNA, 64 nt, Human; identical to SEQ ID NO: 128527

SEQ ID NO: 128938 - RNA, 64 nt, Human; identical to SEQ ID NO: 128528

SEQ ID NO: 128939 - RNA, 64 nt, Human; identical to SEQ ID NO: 128529

SEQ ID NO: 128940 - RNA, 64 nt, Human; identical to SEQ ID NO: 128530

SEQ ID NO: 128941 - RNA, 64 nt, Human; identical to SEQ ID NO: 128531

SEQ ID NO: 128942 - RNA, 64 nt, Human; identical to SEQ ID NO: 128532

SEQ ID NO: 128943 - RNA, 64 nt, Human; identical to SEQ ID NO: 128533

SEQ ID NO: 128944 - RNA, 64 nt, Human; identical to SEQ ID NO: 128534

SEQ ID NO: 128945 - RNA, 64 nt, Human; identical to SEQ ID NO: 128535

SEQ ID NO: 128946 - RNA, 64 nt, Human; identical to SEQ ID NO: 128536

SEQ ID NO: 128947 - RNA, 64 nt, Human; identical to SEQ ID NO: 128537

SEQ ID NO: 128948 - RNA, 64 nt, Human; identical to SEQ ID NO: 128538

SEQ ID NO: 128949 - RNA, 64 nt, Human; identical to SEQ ID NO: 128539

SEQ ID NO: 128950 - RNA, 64 nt, Human; identical to SEQ ID NO: 128540

SEQ ID NO: 128951 - RNA, 64 nt, Human; identical to SEQ ID NO: 128541

SEQ ID NO: 128952 - RNA, 64 nt, Human; identical to SEQ ID NO: 128542

SEQ ID NO: 128953 - RNA, 64 nt, Human; identical to SEQ ID NO: 128543

SEQ ID NO: 128954 - RNA, 64 nt, Human; identical to SEQ ID NO: 128544

SEQ ID NO: 128955 - RNA, 64 nt, Human; identical to SEQ ID NO: 128545

SEQ ID NO: 128956 - RNA, 64 nt, Human; identical to SEQ ID NO: 128546

SEQ ID NO: 128957 - RNA, 64 nt, Human; identical to SEQ ID NO: 128547

SEQ ID NO: 128958 - RNA, 64 nt, Human; identical to SEQ ID NO: 128548

SEQ ID NO: 128959 - RNA, 64 nt, Human; identical to SEQ ID NO: 128549

SEQ ID NO: 128960 - RNA, 64 nt, Human; identical to SEQ ID NO: 128550

SEQ ID NO: 128961 - RNA, 64 nt, Human; identical to SEQ ID NO: 128551

SEQ ID NO: 128962 - RNA, 64 nt, Human; identical to SEQ ID NO: 128552

SEQ ID NO: 128963 - RNA, 64 nt, Human; identical to SEQ ID NO: 128553

SEQ ID NO: 128964 - RNA, 64 nt, Human; identical to SEQ ID NO: 128554

SEQ ID NO: 128965 - RNA, 64 nt, Human; identical to SEQ ID NO: 128555

SEQ ID NO: 128966 - RNA, 64 nt, Human; identical to SEQ ID NO: 128556

SEQ ID NO: 128967 - RNA, 64 nt, Human; identical to SEQ ID NO: 128557

SEQ ID NO: 128968 - RNA, 64 nt, Human; identical to SEQ ID NO: 128558

SEQ ID NO: 128969 - RNA, 64 nt, Human; identical to SEQ ID NO: 128559

SEQ ID NO: 128970 - RNA, 64 nt, Human; identical to SEQ ID NO: 128560

SEQ ID NO: 128971 - RNA, 64 nt, Human; identical to SEQ ID NO: 128561

SEQ ID NO: 128972 - RNA, 64 nt, Human; identical to SEQ ID NO: 128562

SEQ ID NO: 128973 - RNA, 64 nt, Human; identical to SEQ ID NO: 128563

SEQ ID NO: 128974 - RNA, 64 nt, Human; identical to SEQ ID NO: 128564

SEQ ID NO: 128975 - RNA, 64 nt, Human; identical to SEQ ID NO: 128565

SEQ ID NO: 128976 - RNA, 64 nt, Human; identical to SEQ ID NO: 128566

SEQ ID NO: 128977 - RNA, 58 nt, Human; identical to SEQ ID NO: 128567

SEQ ID NO: 128978 - RNA, 64 nt, Human; identical to SEQ ID NO: 128568

SEQ ID NO: 128979 - RNA, 64 nt, Human; identical to SEQ ID NO: 128569

SEQ ID NO: 128980 - RNA, 64 nt, Human; identical to SEQ ID NO: 128570

SEQ ID NO: 128981 - RNA, 64 nt, Human; identical to SEQ ID NO: 128571

SEQ ID NO: 128982 - RNA, 64 nt, Human; identical to SEQ ID NO: 128572

SEQ ID NO: 128983 - RNA, 64 nt, Human; identical to SEQ ID NO: 128573

SEQ ID NO: 128984 - RNA, 64 nt, Human; identical to SEQ ID NO: 128574

SEQ ID NO: 128985 - RNA, 64 nt, Human; identical to SEQ ID NO: 128575

SEQ ID NO: 128986 - RNA, 64 nt, Human; identical to SEQ ID NO: 128576

SEQ ID NO: 128987 - RNA, 64 nt, Human; identical to SEQ ID NO: 128577

SEQ ID NO: 128988 - RNA, 64 nt, Human; identical to SEQ ID NO: 128578

SEQ ID NO: 128989 - RNA, 64 nt, Human; identical to SEQ ID NO: 128579

SEQ ID NO: 128990 - RNA, 64 nt, Human; identical to SEQ ID NO: 128580

SEQ ID NO: 128991 - RNA, 64 nt, Human; identical to SEQ ID NO: 128581

SEQ ID NO: 128992 - RNA, 64 nt, Human; identical to SEQ ID NO: 128582

SEQ ID NO: 128993 - RNA, 64 nt, Human; identical to SEQ ID NO: 128583

SEQ ID NO: 128994 - RNA, 64 nt, Human; identical to SEQ ID NO: 128584

SEQ ID NO: 128995 - RNA, 64 nt, Human; identical to SEQ ID NO: 128585

SEQ ID NO: 128996 - RNA, 64 nt, Human; identical to SEQ ID NO: 128586

SEQ ID NO: 128997 - RNA, 64 nt, Human; identical to SEQ ID NO: 128587

SEQ ID NO: 128998 - RNA, 64 nt, Human; identical to SEQ ID NO: 128588

SEQ ID NO: 128999 - RNA, 64 nt, Human; identical to SEQ ID NO: 128589

SEQ ID NO: 129000 - RNA, 64 nt, Human; identical to SEQ ID NO: 128590

SEQ ID NO: 129001 - RNA, 64 nt, Human; identical to SEQ ID NO: 128591

SEQ ID NO: 129002 - RNA, 64 nt, Human; identical to SEQ ID NO: 128592

SEQ ID NO: 129003 - RNA, 64 nt, Human; identical to SEQ ID NO: 128593

SEQ ID NO: 129004 - RNA, 64 nt, Human; identical to SEQ ID NO: 128594

SEQ ID NO: 129005 - RNA, 64 nt, Human; identical to SEQ ID NO: 128595

SEQ ID NO: 129006 - RNA, 64 nt, Human; identical to SEQ ID NO: 128596

SEQ ID NO: 129007 - RNA, 64 nt, Human; identical to SEQ ID NO: 128597

SEQ ID NO: 129008 - RNA, 64 nt, Human; identical to SEQ ID NO: 128598

SEQ ID NO: 129009 - RNA, 64 nt, Human; identical to SEQ ID NO: 128599

SEQ ID NO: 129010 - RNA, 64 nt, Human; identical to SEQ ID NO: 128600

SEQ ID NO: 129011 - RNA, 64 nt, Human; identical to SEQ ID NO: 128601

SEQ ID NO: 129012 - RNA, 64 nt, Human; identical to SEQ ID NO: 128602

SEQ ID NO: 129013 - RNA, 56 nt, Human; identical to SEQ ID NO: 128603

SEQ ID NO: 129014 - RNA, 64 nt, Human; identical to SEQ ID NO: 128604

SEQ ID NO: 129015 - RNA, 64 nt, Human; identical to SEQ ID NO: 128605

SEQ ID NO: 129016 - RNA, 64 nt, Human; identical to SEQ ID NO: 128606

SEQ ID NO: 129017 - RNA, 64 nt, Human; identical to SEQ ID NO: 128607

SEQ ID NO: 129018 - RNA, 64 nt, Human; identical to SEQ ID NO: 128608

SEQ ID NO: 129019 - RNA, 64 nt, Human; identical to SEQ ID NO: 128609

SEQ ID NO: 129020 - RNA, 64 nt, Human; identical to SEQ ID NO: 128610

SEQ ID NO: 129021 - RNA, 64 nt, Human; identical to SEQ ID NO: 128611

SEQ ID NO: 129022 - RNA, 50 nt, Human; identical to SEQ ID NO: 128612

SEQ ID NO: 129023 - RNA, 64 nt, Human; identical to SEQ ID NO: 128613

SEQ ID NO: 129024 - RNA, 64 nt, Human; identical to SEQ ID NO: 128614

SEQ ID NO: 129025 - RNA, 64 nt, Human; identical to SEQ ID NO: 128615

SEQ ID NO: 129026 - RNA, 64 nt, Human; identical to SEQ ID NO: 128616

SEQ ID NO: 129027 - RNA, 64 nt, Human; identical to SEQ ID NO: 128617

SEQ ID NO: 129028 - RNA, 64 nt, Human; identical to SEQ ID NO: 128618

SEQ ID NO: 129029 - RNA, 64 nt, Human; identical to SEQ ID NO: 128619

SEQ ID NO: 129030 - RNA, 64 nt, Human; identical to SEQ ID NO: 128620

SEQ ID NO: 129031 - RNA, 50 nt, Human; identical to SEQ ID NO: 128621

SEQ ID NO: 129032 - RNA, 64 nt, Human; identical to SEQ ID NO: 128622

SEQ ID NO: 129033 - RNA, 64 nt, Human; identical to SEQ ID NO: 128623

SEQ ID NO: 129034 - RNA, 64 nt, Human; identical to SEQ ID NO: 128624

SEQ ID NO: 129035 - RNA, 64 nt, Human; identical to SEQ ID NO: 128625

SEQ ID NO: 129036 - RNA, 64 nt, Human; identical to SEQ ID NO: 128626

SEQ ID NO: 129037 - RNA, 64 nt, Human; identical to SEQ ID NO: 128627

SEQ ID NO: 129038 - RNA, 64 nt, Human; identical to SEQ ID NO: 128628

SEQ ID NO: 129039 - RNA, 64 nt, Human; identical to SEQ ID NO: 128629

SEQ ID NO: 129040 - RNA, 64 nt, Human; identical to SEQ ID NO: 128630

SEQ ID NO: 129041 - RNA, 64 nt, Human; identical to SEQ ID NO: 128631

SEQ ID NO: 129042 - RNA, 64 nt, Human; identical to SEQ ID NO: 128632

SEQ ID NO: 129043 - RNA, 64 nt, Human; identical to SEQ ID NO: 128633

SEQ ID NO: 129044 - RNA, 64 nt, Human; identical to SEQ ID NO: 128634

SEQ ID NO: 129045 - RNA, 64 nt, Human; identical to SEQ ID NO: 128635

SEQ ID NO: 129046 - RNA, 64 nt, Human; identical to SEQ ID NO: 128636

SEQ ID NO: 129047 - RNA, 64 nt, Human; identical to SEQ ID NO: 128637

SEQ ID NO: 129048 - RNA, 64 nt, Human; identical to SEQ ID NO: 128638

SEQ ID NO: 129049 - RNA, 64 nt, Human; identical to SEQ ID NO: 128639

SEQ ID NO: 129050 - RNA, 64 nt, Human; identical to SEQ ID NO: 128640

SEQ ID NO: 129051 - RNA, 64 nt, Human; identical to SEQ ID NO: 128641

SEQ ID NO: 129052 - RNA, 64 nt, Human; identical to SEQ ID NO: 128642

SEQ ID NO: 129053 - RNA, 64 nt, Human; identical to SEQ ID NO: 128643

SEQ ID NO: 129054 - RNA, 64 nt, Human; identical to SEQ ID NO: 128644

SEQ ID NO: 129055 - RNA, 64 nt, Human; identical to SEQ ID NO: 128645

SEQ ID NO: 129056 - RNA, 64 nt, Human; identical to SEQ ID NO: 128646

SEQ ID NO: 129057 - RNA, 64 nt, Human; identical to SEQ ID NO: 128647

SEQ ID NO: 129058 - RNA, 64 nt, Human; identical to SEQ ID NO: 128648

SEQ ID NO: 129059 - RNA, 64 nt, Human; identical to SEQ ID NO: 128649

SEQ ID NO: 129060 - RNA, 64 nt, Human; identical to SEQ ID NO: 128650

SEQ ID NO: 129061 - RNA, 64 nt, Human; identical to SEQ ID NO: 128651

SEQ ID NO: 129062 - RNA, 64 nt, Human; identical to SEQ ID NO: 128652

SEQ ID NO: 129063 - RNA, 64 nt, Human; identical to SEQ ID NO: 128653

SEQ ID NO: 129064 - RNA, 64 nt, Human; identical to SEQ ID NO: 128654

SEQ ID NO: 129065 - RNA, 64 nt, Human; identical to SEQ ID NO: 128655

SEQ ID NO: 129066 - RNA, 64 nt, Human; identical to SEQ ID NO: 128656

SEQ ID NO: 129067 - RNA, 52 nt, Human; identical to SEQ ID NO: 128657

SEQ ID NO: 129068 - RNA, 64 nt, Human; identical to SEQ ID NO: 128658

SEQ ID NO: 129069 - RNA, 64 nt, Human; identical to SEQ ID NO: 128659

SEQ ID NO: 129070 - RNA, 64 nt, Human; identical to SEQ ID NO: 128660

SEQ ID NO: 129071 - RNA, 64 nt, Human; identical to SEQ ID NO: 128661

SEQ ID NO: 129072 - RNA, 64 nt, Human; identical to SEQ ID NO: 128662

SEQ ID NO: 129073 - RNA, 64 nt, Human; identical to SEQ ID NO: 128663

SEQ ID NO: 129074 - RNA, 64 nt, Human; identical to SEQ ID NO: 128664

SEQ ID NO: 129075 - RNA, 64 nt, Human; identical to SEQ ID NO: 128665

SEQ ID NO: 129076 - RNA, 64 nt, Human; identical to SEQ ID NO: 128666

SEQ ID NO: 129077 - RNA, 64 nt, Human; identical to SEQ ID NO: 128667

SEQ ID NO: 129078 - RNA, 64 nt, Human; identical to SEQ ID NO: 128668

SEQ ID NO: 129079 - RNA, 64 nt, Human; identical to SEQ ID NO: 128669

SEQ ID NO: 129080 - RNA, 64 nt, Human; identical to SEQ ID NO: 128670

SEQ ID NO: 129081 - RNA, 64 nt, Human; identical to SEQ ID NO: 128671

SEQ ID NO: 129082 - RNA, 64 nt, Human; identical to SEQ ID NO: 128672

SEQ ID NO: 129083 - RNA, 64 nt, Human; identical to SEQ ID NO: 128673

SEQ ID NO: 129084 - RNA, 64 nt, Human; identical to SEQ ID NO: 128674

SEQ ID NO: 129085 - RNA, 64 nt, Human; identical to SEQ ID NO: 128675

SEQ ID NO: 129086 - RNA, 64 nt, Human; identical to SEQ ID NO: 128676

SEQ ID NO: 129087 - RNA, 64 nt, Human; identical to SEQ ID NO: 128677

SEQ ID NO: 129088 - RNA, 64 nt, Human; identical to SEQ ID NO: 128678

SEQ ID NO: 129089 - RNA, 64 nt, Human; identical to SEQ ID NO: 128679

SEQ ID NO: 129090 - RNA, 64 nt, Human; identical to SEQ ID NO: 128680

SEQ ID NO: 129091 - RNA, 64 nt, Human; identical to SEQ ID NO: 128681

SEQ ID NO: 129092 - RNA, 64 nt, Human; identical to SEQ ID NO: 128682

SEQ ID NO: 129093 - RNA, 64 nt, Human; identical to SEQ ID NO: 128683

SEQ ID NO: 129094 - RNA, 64 nt, Human; identical to SEQ ID NO: 128684

SEQ ID NO: 129095 - RNA, 64 nt, Human; identical to SEQ ID NO: 128685

SEQ ID NO: 129096 - RNA, 64 nt, Human; identical to SEQ ID NO: 128686

SEQ ID NO: 129097 - RNA, 64 nt, Human; identical to SEQ ID NO: 128687

SEQ ID NO: 129098 - RNA, 64 nt, Human; identical to SEQ ID NO: 128688

SEQ ID NO: 129099 - RNA, 64 nt, Human; identical to SEQ ID NO: 128689

SEQ ID NO: 129100 - RNA, 64 nt, Human; identical to SEQ ID NO: 128690

SEQ ID NO: 129101 - RNA, 64 nt, Human; identical to SEQ ID NO: 128691

SEQ ID NO: 129102 - RNA, 57 nt, Human; identical to SEQ ID NO: 128692

SEQ ID NO: 129103 - RNA, 64 nt, Human; identical to SEQ ID NO: 128693

SEQ ID NO: 129104 - RNA, 64 nt, Human; identical to SEQ ID NO: 128694

SEQ ID NO: 129105 - RNA, 64 nt, Human; identical to SEQ ID NO: 128695

SEQ ID NO: 129106 - RNA, 64 nt, Human; identical to SEQ ID NO: 128696

SEQ ID NO: 129107 - RNA, 64 nt, Human; identical to SEQ ID NO: 128697

SEQ ID NO: 129108 - RNA, 64 nt, Human; identical to SEQ ID NO: 128698

SEQ ID NO: 129109 - RNA, 64 nt, Human; identical to SEQ ID NO: 128699

SEQ ID NO: 129110 - RNA, 64 nt, Human; identical to SEQ ID NO: 128700

SEQ ID NO: 129111 - RNA, 64 nt, Human; identical to SEQ ID NO: 128701

SEQ ID NO: 129112 - RNA, 64 nt, Human; identical to SEQ ID NO: 128702

SEQ ID NO: 129113 - RNA, 64 nt, Human; identical to SEQ ID NO: 128703

SEQ ID NO: 129114 - RNA, 64 nt, Human; identical to SEQ ID NO: 128704

SEQ ID NO: 129115 - RNA, 64 nt, Human; identical to SEQ ID NO: 128705

SEQ ID NO: 129116 - RNA, 64 nt, Human; identical to SEQ ID NO: 128706

SEQ ID NO: 129117 - RNA, 64 nt, Human; identical to SEQ ID NO: 128707

SEQ ID NO: 129118 - RNA, 64 nt, Human; identical to SEQ ID NO: 128708

SEQ ID NO: 129119 - RNA, 64 nt, Human; identical to SEQ ID NO: 128709

SEQ ID NO: 129120 - RNA, 64 nt, Human; identical to SEQ ID NO: 128710

SEQ ID NO: 129121 - RNA, 64 nt, Human; identical to SEQ ID NO: 128711

SEQ ID NO: 129122 - RNA, 64 nt, Human; identical to SEQ ID NO: 128712

SEQ ID NO: 129123 - RNA, 64 nt, Human; identical to SEQ ID NO: 128713

SEQ ID NO: 129124 - RNA, 64 nt, Human; identical to SEQ ID NO: 128714

SEQ ID NO: 129125 - RNA, 58 nt, Human; identical to SEQ ID NO: 128715

SEQ ID NO: 129126 - RNA, 64 nt, Human; identical to SEQ ID NO: 128716

SEQ ID NO: 129127 - RNA, 64 nt, Human; identical to SEQ ID NO: 128717

SEQ ID NO: 129128 - RNA, 64 nt, Human; identical to SEQ ID NO: 128718

SEQ ID NO: 129129 - RNA, 51 nt, Human; identical to SEQ ID NO: 128719

SEQ ID NO: 129130 - RNA, 64 nt, Human; identical to SEQ ID NO: 128720

SEQ ID NO: 129131 - RNA, 64 nt, Human; identical to SEQ ID NO: 128721

SEQ ID NO: 129132 - RNA, 64 nt, Human; identical to SEQ ID NO: 128722

SEQ ID NO: 129133 - RNA, 64 nt, Human; identical to SEQ ID NO: 128723

SEQ ID NO: 129134 - RNA, 64 nt, Human; identical to SEQ ID NO: 128724

SEQ ID NO: 129135 - RNA, 64 nt, Human; identical to SEQ ID NO: 128725

SEQ ID NO: 129136 - RNA, 64 nt, Human; identical to SEQ ID NO: 128726

SEQ ID NO: 129137 - RNA, 64 nt, Human; identical to SEQ ID NO: 128727

SEQ ID NO: 129138 - RNA, 64 nt, Human; identical to SEQ ID NO: 128728

SEQ ID NO: 129139 - RNA, 64 nt, Human; identical to SEQ ID NO: 128729

SEQ ID NO: 129140 - RNA, 64 nt, Human; identical to SEQ ID NO: 128730

SEQ ID NO: 129141 - RNA, 64 nt, Human; identical to SEQ ID NO: 128731

SEQ ID NO: 129142 - RNA, 64 nt, Human; identical to SEQ ID NO: 128732

SEQ ID NO: 129143 - RNA, 64 nt, Human; identical to SEQ ID NO: 128733

SEQ ID NO: 129144 - RNA, 64 nt, Human; identical to SEQ ID NO: 128734

SEQ ID NO: 129145 - RNA, 64 nt, Human; identical to SEQ ID NO: 128735

SEQ ID NO: 129146 - RNA, 64 nt, Human; identical to SEQ ID NO: 128736

SEQ ID NO: 129147 - RNA, 64 nt, Human; identical to SEQ ID NO: 128737

SEQ ID NO: 129148 - RNA, 64 nt, Human; identical to SEQ ID NO: 128738

SEQ ID NO: 129149 - RNA, 64 nt, Human; identical to SEQ ID NO: 128739

SEQ ID NO: 129150 - RNA, 64 nt, Human; identical to SEQ ID NO: 128740

SEQ ID NO: 129151 - RNA, 64 nt, Human; identical to SEQ ID NO: 128741

SEQ ID NO: 129152 - RNA, 64 nt, Human; identical to SEQ ID NO: 128742

SEQ ID NO: 129153 - RNA, 64 nt, Human; identical to SEQ ID NO: 128743

SEQ ID NO: 129154 - RNA, 64 nt, Human; identical to SEQ ID NO: 128744

SEQ ID NO: 129155 - RNA, 64 nt, Human; identical to SEQ ID NO: 128745

SEQ ID NO: 129156 - RNA, 64 nt, Human; identical to SEQ ID NO: 128746

SEQ ID NO: 129157 - RNA, 64 nt, Human; identical to SEQ ID NO: 128747

SEQ ID NO: 129158 - RNA, 64 nt, Human; identical to SEQ ID NO: 128748

SEQ ID NO: 129159 - RNA, 64 nt, Human; identical to SEQ ID NO: 128749

SEQ ID NO: 129160 - RNA, 64 nt, Human; identical to SEQ ID NO: 128750

SEQ ID NO: 129161 - RNA, 64 nt, Human; identical to SEQ ID NO: 128751

SEQ ID NO: 129162 - RNA, 64 nt, Human; identical to SEQ ID NO: 128752

SEQ ID NO: 129163 - RNA, 62 nt, Human; identical to SEQ ID NO: 128753

SEQ ID NO: 129164 - RNA, 64 nt, Human; identical to SEQ ID NO: 128754

SEQ ID NO: 129165 - RNA, 64 nt, Human; identical to SEQ ID NO: 128755

SEQ ID NO: 129166 - RNA, 64 nt, Human; identical to SEQ ID NO: 128756

SEQ ID NO: 129167 - RNA, 64 nt, Human; identical to SEQ ID NO: 128757

SEQ ID NO: 129168 - RNA, 64 nt, Human; identical to SEQ ID NO: 128758

SEQ ID NO: 129169 - RNA, 64 nt, Human; identical to SEQ ID NO: 128759

SEQ ID NO: 129170 - RNA, 64 nt, Human; identical to SEQ ID NO: 128760

SEQ ID NO: 129171 - RNA, 64 nt, Human; identical to SEQ ID NO: 128761

SEQ ID NO: 129172 - RNA, 64 nt, Human; identical to SEQ ID NO: 128762

SEQ ID NO: 129173 - RNA, 64 nt, Human; identical to SEQ ID NO: 128763

SEQ ID NO: 129174 - RNA, 50 nt, Human; identical to SEQ ID NO: 128764

SEQ ID NO: 129175 - RNA, 64 nt, Human; identical to SEQ ID NO: 128765

SEQ ID NO: 129176 - RNA, 64 nt, Human; identical to SEQ ID NO: 128766

SEQ ID NO: 129177 - RNA, 64 nt, Human; identical to SEQ ID NO: 128767

SEQ ID NO: 129178 - RNA, 64 nt, Human; identical to SEQ ID NO: 128768

SEQ ID NO: 129179 - RNA, 64 nt, Human; identical to SEQ ID NO: 128769

SEQ ID NO: 129180 - RNA, 64 nt, Human; identical to SEQ ID NO: 128770

SEQ ID NO: 129181 - RNA, 64 nt, Human; identical to SEQ ID NO: 128771

SEQ ID NO: 129182 - RNA, 64 nt, Human; identical to SEQ ID NO: 128772

SEQ ID NO: 129183 - RNA, 59 nt, Human; identical to SEQ ID NO: 128773

SEQ ID NO: 129184 - RNA, 64 nt, Human; identical to SEQ ID NO: 128774

SEQ ID NO: 129185 - RNA, 64 nt, Human; identical to SEQ ID NO: 128775

SEQ ID NO: 129186 - RNA, 53 nt, Human; identical to SEQ ID NO: 128776

SEQ ID NO: 129187 - RNA, 64 nt, Human; identical to SEQ ID NO: 128777

SEQ ID NO: 129188 - RNA, 64 nt, Human; identical to SEQ ID NO: 128778

SEQ ID NO: 129189 - RNA, 64 nt, Human; identical to SEQ ID NO: 128779

SEQ ID NO: 129190 - RNA, 64 nt, Human; identical to SEQ ID NO: 128780

SEQ ID NO: 129191 - RNA, 64 nt, Human; identical to SEQ ID NO: 128781

SEQ ID NO: 129192 - RNA, 64 nt, Human; identical to SEQ ID NO: 128782

SEQ ID NO: 129193 - RNA, 64 nt, Human; identical to SEQ ID NO: 128783

SEQ ID NO: 129194 - RNA, 64 nt, Human; identical to SEQ ID NO: 128784

SEQ ID NO: 129195 - RNA, 64 nt, Human; identical to SEQ ID NO: 128785

SEQ ID NO: 129196 - RNA, 64 nt, Human; identical to SEQ ID NO: 128786

SEQ ID NO: 129197 - RNA, 64 nt, Human; identical to SEQ ID NO: 128787

SEQ ID NO: 129198 - RNA, 64 nt, Human; identical to SEQ ID NO: 128788

SEQ ID NO: 129199 - RNA, 64 nt, Human; identical to SEQ ID NO: 128789

SEQ ID NO: 129200 - RNA, 64 nt, Human; identical to SEQ ID NO: 128790

SEQ ID NO: 129201 - RNA, 64 nt, Human; identical to SEQ ID NO: 128791

SEQ ID NO: 129202 - RNA, 64 nt, Human; identical to SEQ ID NO: 128792

SEQ ID NO: 129203 - RNA, 64 nt, Human; identical to SEQ ID NO: 128793

SEQ ID NO: 129204 - RNA, 64 nt, Human; identical to SEQ ID NO: 128794

SEQ ID NO: 129205 - RNA, 64 nt, Human; identical to SEQ ID NO: 128795

SEQ ID NO: 129206 - RNA, 64 nt, Human; identical to SEQ ID NO: 128796

SEQ ID NO: 129207 - RNA, 64 nt, Human; identical to SEQ ID NO: 128797

SEQ ID NO: 129208 - RNA, 64 nt, Human; identical to SEQ ID NO: 128798

SEQ ID NO: 129209 - RNA, 64 nt, Human; identical to SEQ ID NO: 128799

SEQ ID NO: 129210 - RNA, 64 nt, Human; identical to SEQ ID NO: 128800

SEQ ID NO: 129211 - RNA, 64 nt, Human; identical to SEQ ID NO: 128801

SEQ ID NO: 129212 - RNA, 64 nt, Human; identical to SEQ ID NO: 128802

SEQ ID NO: 129213 - RNA, 64 nt, Human; identical to SEQ ID NO: 128803

SEQ ID NO: 129214 - RNA, 57 nt, Human; identical to SEQ ID NO: 128804

SEQ ID NO: 129215 - RNA, 64 nt, Human; identical to SEQ ID NO: 128805

SEQ ID NO: 129216 - RNA, 64 nt, Human; identical to SEQ ID NO: 128806

SEQ ID NO: 129217 - RNA, 64 nt, Human; identical to SEQ ID NO: 128807

SEQ ID NO: 129218 - RNA, 64 nt, Human; identical to SEQ ID NO: 128808

SEQ ID NO: 129219 - RNA, 64 nt, Human; identical to SEQ ID NO: 128809

SEQ ID NO: 129220 - RNA, 64 nt, Human; identical to SEQ ID NO: 128810

SEQ ID NO: 129221 - RNA, 64 nt, Human; identical to SEQ ID NO: 128811

SEQ ID NO: 129222 - RNA, 64 nt, Human; identical to SEQ ID NO: 128812

SEQ ID NO: 129223 - RNA, 64 nt, Human; identical to SEQ ID NO: 128813

SEQ ID NO: 129224 - RNA, 64 nt, Human; identical to SEQ ID NO: 128814

SEQ ID NO: 129225 - RNA, 64 nt, Human; identical to SEQ ID NO: 128815

SEQ ID NO: 129226 - RNA, 64 nt, Human; identical to SEQ ID NO: 128816

SEQ ID NO: 129227 - RNA, 64 nt, Human; identical to SEQ ID NO: 128817

SEQ ID NO: 129228 - RNA, 64 nt, Human; identical to SEQ ID NO: 128818

SEQ ID NO: 129229 - RNA, 64 nt, Human; identical to SEQ ID NO: 128819

SEQ ID NO: 129230 - RNA, 64 nt, Human; identical to SEQ ID NO: 128820

SEQ ID NO: 129231 - RNA, 64 nt, Human; identical to SEQ ID NO: 128821

SEQ ID NO: 129232 - RNA, 64 nt, Human; identical to SEQ ID NO: 128822

SEQ ID NO: 129233 - RNA, 64 nt, Human; identical to SEQ ID NO: 128823

SEQ ID NO: 129234 - RNA, 64 nt, Human; identical to SEQ ID NO: 128824

SEQ ID NO: 129235 - RNA, 64 nt, Human; identical to SEQ ID NO: 128825

SEQ ID NO: 129236 - RNA, 64 nt, Human; identical to SEQ ID NO: 128826

SEQ ID NO: 129237 - RNA, 64 nt, Human; identical to SEQ ID NO: 128827

SEQ ID NO: 129238 - RNA, 64 nt, Human; identical to SEQ ID NO: 128828

SEQ ID NO: 129239 - RNA, 64 nt, Human; identical to SEQ ID NO: 128829

SEQ ID NO: 129240 - RNA, 64 nt, Human; identical to SEQ ID NO: 128830

SEQ ID NO: 129241 - RNA, 64 nt, Human; identical to SEQ ID NO: 128831

SEQ ID NO: 129242 - RNA, 64 nt, Human; identical to SEQ ID NO: 128832

SEQ ID NO: 129243 - RNA, 54 nt, Human; identical to SEQ ID NO: 128833

SEQ ID NO: 129244 - RNA, 64 nt, Human; identical to SEQ ID NO: 128834

SEQ ID NO: 129245 - RNA, 64 nt, Human; identical to SEQ ID NO: 128835

SEQ ID NO: 129246 - RNA, 64 nt, Human; identical to SEQ ID NO: 128836

SEQ ID NO: 129247 - RNA, 64 nt, Human; identical to SEQ ID NO: 128837

SEQ ID NO: 129248 - RNA, 64 nt, Human; identical to SEQ ID NO: 128838

SEQ ID NO: 129249 - RNA, 64 nt, Human; identical to SEQ ID NO: 128839

SEQ ID NO: 129250 - RNA, 64 nt, Human; identical to SEQ ID NO: 128840

SEQ ID NO: 129251 - RNA, 64 nt, Human; identical to SEQ ID NO: 128841

SEQ ID NO: 129252 - RNA, 64 nt, Human; identical to SEQ ID NO: 128842

SEQ ID NO: 129253 - RNA, 64 nt, Human; identical to SEQ ID NO: 128843

SEQ ID NO: 129254 - RNA, 64 nt, Human; identical to SEQ ID NO: 128844

SEQ ID NO: 129255 - RNA, 64 nt, Human; identical to SEQ ID NO: 128845

SEQ ID NO: 129256 - RNA, 64 nt, Human; identical to SEQ ID NO: 128846

SEQ ID NO: 129257 - RNA, 64 nt, Human; identical to SEQ ID NO: 128847

SEQ ID NO: 129258 - RNA, 64 nt, Human; identical to SEQ ID NO: 128848

SEQ ID NO: 129259 - RNA, 50 nt, Human; identical to SEQ ID NO: 128849

SEQ ID NO: 129260 - RNA, 64 nt, Human; identical to SEQ ID NO: 128850

SEQ ID NO: 129261 - RNA, 64 nt, Human; identical to SEQ ID NO: 128851

SEQ ID NO: 129262 - RNA, 64 nt, Human; identical to SEQ ID NO: 128852

SEQ ID NO: 129263 - RNA, 64 nt, Human; identical to SEQ ID NO: 128853

SEQ ID NO: 129264 - RNA, 64 nt, Human; identical to SEQ ID NO: 128854

SEQ ID NO: 129265 - RNA, 64 nt, Human; identical to SEQ ID NO: 128855

SEQ ID NO: 129266 - RNA, 64 nt, Human; identical to SEQ ID NO: 128856

SEQ ID NO: 129267 - RNA, 64 nt, Human; identical to SEQ ID NO: 128857

SEQ ID NO: 129268 - RNA, 64 nt, Human; identical to SEQ ID NO: 128858

SEQ ID NO: 129269 - RNA, 64 nt, Human; identical to SEQ ID NO: 128859

SEQ ID NO: 129270 - RNA, 64 nt, Human; identical to SEQ ID NO: 128860

SEQ ID NO: 129271 - RNA, 64 nt, Human; identical to SEQ ID NO: 128861

SEQ ID NO: 129272 - RNA, 64 nt, Human; identical to SEQ ID NO: 128862

SEQ ID NO: 129273 - RNA, 64 nt, Human; identical to SEQ ID NO: 128863

SEQ ID NO: 129274 - RNA, 64 nt, Human; identical to SEQ ID NO: 128864

SEQ ID NO: 129275 - RNA, 64 nt, Human; identical to SEQ ID NO: 128865

SEQ ID NO: 129276 - RNA, 64 nt, Human; identical to SEQ ID NO: 128866

SEQ ID NO: 129277 - RNA, 64 nt, Human; identical to SEQ ID NO: 128867

SEQ ID NO: 129278 - RNA, 64 nt, Human; identical to SEQ ID NO: 128868

SEQ ID NO: 129279 - RNA, 64 nt, Human; identical to SEQ ID NO: 128869

SEQ ID NO: 129280 - RNA, 64 nt, Human; identical to SEQ ID NO: 128870

SEQ ID NO: 129281 - RNA, 64 nt, Human; identical to SEQ ID NO: 128871

SEQ ID NO: 129282 - RNA, 64 nt, Human; identical to SEQ ID NO: 128872

SEQ ID NO: 129283 - RNA, 64 nt, Human; identical to SEQ ID NO: 128873

SEQ ID NO: 129284 - RNA, 64 nt, Human; identical to SEQ ID NO: 128874

SEQ ID NO: 129285 - RNA, 64 nt, Human; identical to SEQ ID NO: 128875

SEQ ID NO: 129286 - RNA, 64 nt, Human; identical to SEQ ID NO: 128876

SEQ ID NO: 129287 - RNA, 64 nt, Human; identical to SEQ ID NO: 128877

SEQ ID NO: 129288 - RNA, 64 nt, Human; identical to SEQ ID NO: 128878

SEQ ID NO: 129289 - RNA, 64 nt, Human; identical to SEQ ID NO: 128867

SEQ ID NO: 129290 - RNA, 64 nt, Human; identical to SEQ ID NO: 128880

SEQ ID NO: 129291 - RNA, 64 nt, Human; identical to SEQ ID NO: 128881

SEQ ID NO: 129292 - RNA, 64 nt, Human; identical to SEQ ID NO: 128882

SEQ ID NO: 129293 - RNA, 64 nt, Human; identical to SEQ ID NO: 128883

SEQ ID NO: 129294 - RNA, 64 nt, Human; identical to SEQ ID NO: 128884

SEQ ID NO: 129295 - RNA, 64 nt, Human; identical to SEQ ID NO: 128885

SEQ ID NO: 129296 - RNA, 64 nt, Human; identical to SEQ ID NO: 128886

SEQ ID NO: 129297 - RNA, 64 nt, Human; identical to SEQ ID NO: 128887

SEQ ID NO: 129298 - RNA, 64 nt, Human; identical to SEQ ID NO: 128888

SEQ ID NO: 129299 - RNA, 64 nt, Human; identical to SEQ ID NO: 128889

SEQ ID NO: 129300 - RNA, 64 nt, Human; identical to SEQ ID NO: 128890

SEQ ID NO: 129301 - RNA, 64 nt, Human; identical to SEQ ID NO: 128891

SEQ ID NO: 129302 - RNA, 64 nt, Human; identical to SEQ ID NO: 128892

SEQ ID NO: 129303 - RNA, 64 nt, Human; identical to SEQ ID NO: 128893

SEQ ID NO: 129304 - RNA, 64 nt, Human; identical to SEQ ID NO: 128894

SEQ ID NO: 129305 - RNA, 64 nt, Human; identical to SEQ ID NO: 128895

SEQ ID NO: 129306 - RNA, 64 nt, Human; identical to SEQ ID NO: 128896

SEQ ID NO: 129307 - RNA, 64 nt, Human; identical to SEQ ID NO: 128897

SEQ ID NO: 129308 - RNA, 53 nt, Human; identical to SEQ ID NO: 128898

SEQ ID NO: 129309 - RNA, 64 nt, Human; identical to SEQ ID NO: 128899

SEQ ID NO: 129310 - RNA, 64 nt, Human; identical to SEQ ID NO: 128900

SEQ ID NO: 129311 - RNA, 64 nt, Human; identical to SEQ ID NO: 128901

SEQ ID NO: 129312 - RNA, 64 nt, Human; identical to SEQ ID NO: 128902

SEQ ID NO: 129313 - RNA, 64 nt, Human; identical to SEQ ID NO: 128903

SEQ ID NO: 129314 - RNA, 64 nt, Human
ggcagcccucgcaugcuggggucgggccagcucuccccgaaaggucuugaccugaaugauggcc

SEQ ID NO: 129315 - RNA, 64 nt, Human
gcuugagggcugcagggccugcgugcgcucccucccccgaaaucacuucucagggcaaaggagc

SEQ ID NO: 129316 - RNA, 64 nt, Human
ucucugaaguccguuugagcagaacuaccugguaccccgaaagaaaaucuuaggcuaccacauu

SEQ ID NO: 129317 - RNA, 64 nt, Human
ggggacugcaccagaaagugucuaaccuuguguuccccgaaauccuuucucugacuuaggaacc

SEQ ID NO: 129318 - RNA, 64 nt, Human
agagguguaaucuaaugaagaaaucaauuagaugccccgaaaucuacagucgcugaauaaccaa

SEQ ID NO: 129319 - RNA, 64 nt, Human
ccugcucagggucuaugguaggcagaauaaugucccccgaaauauguccacauccuaaucccaa

SEQ ID NO: 129320 - RNA, 64 nt, Human
acgcccacccacgaaggcccagggcgccagacggccccgaaaaggcgcucggggagcguuuaaa

SEQ ID NO: 129321 - RNA, 64 nt, Human
ggccgagugggccgccaggaccaagcgagguggaccccgaaacggacggcccggagcccgcacc

SEQ ID NO: 129322 - RNA, 64 nt, Human
auaaacacgcgagaacauccaccgcuuccuugcaccccgaaacccugcacaaagacacauacau

SEQ ID NO: 129323 - RNA, 64 nt, Human
aaacugaccugugauauuuuacuugaauuugucuccccgaaagggacacaauguggcaugacua

SEQ ID NO: 129324 - RNA, 64 nt, Human
agagcucugcacagggacccaucccaugguuucuccccgaaagccgcucucuucccucuucgcc

SEQ ID NO: 129325 - RNA, 64 nt, Human
cuaauugggauuauuuuuuaaaagaggucuuucuccccgaaauacaaguuuuagaaaaucuuag

SEQ ID NO: 129326 - RNA, 56 nt, Human
uuuacgaaagccaugucuaauaccaaccccgaaaagcuaugcauaucaagaaaauc

SEQ ID NO: 129327 - RNA, 64 nt, Human
auuucauuuguaaacuauauuugaacgacauuccccccgaaaaauugaaauguaaagaugaggc

SEQ ID NO: 129328 - RNA, 64 nt, Human
ccaagccugucaguggcccucccuggugcacuguccccgaaaccccugcuugggaagggaagcu

SEQ ID NO: 129329 - RNA, 64 nt, Human
gcgucccuaaccccuuccccagcuugguguuuuaccccgaaacaggaaggaacagggguccugu

SEQ ID NO: 129330 - RNA, 64 nt, Human
caguguuuuaugcucuuaguucaguaaaauacgcccccgaaauucaagauugagugucaggcuu

SEQ ID NO: 129331 - RNA, 56 nt, Human
agugcacggagaagccuuaaacacacccccgaaaaacacaagaccgacccaaaauc

SEQ ID NO: 129332 - RNA, 64 nt, Human
uuuaccccgagucaccggaaaaaucugauuuuucccccgaaagcucaaugacuuuaacgugcuu

SEQ ID NO: 129333 - RNA, 64 nt, Human
guguaggaagacuuuacgguaaucauuaacucuaccccgaaaugauggacuacaaguuauaaug

SEQ ID NO: 129334 - RNA, 64 nt, Human
aacgggggugccaggagccccaggcugagggcuuccccgaaagucugggaccagguccaggugg

SEQ ID NO: 129335 - RNA, 64 nt, Human
gaggugcugcccguggaagccagggagggauggaccccgaaaggagaaaaguacucccaggaaa

SEQ ID NO: 129336 - RNA, 64 nt, Human
auuuauacuauuauuuguuacguucaaucagaauccccgaaaccuccuauaaagcuuagcugcc

SEQ ID NO: 129337 - RNA, 64 nt, Human
augggguucauagaaauaagugcaauuucuacacccccgaaacaauucaaagggaagcagcauu

SEQ ID NO: 129338 - RNA, 64 nt, Human
aagaugauaaaauagauucuuauuuuucccccacccccgaaaauguucaauaaugucccaugua

SEQ ID NO: 129339 - RNA, 64 nt, Human
uguuucuaucuuguaugucugugugccccuccugccccgaaagugcugacuauggggaaaucuu

SEQ ID NO: 129340 - RNA, 64 nt, Human
ugcgacugcccaggcacacugcccaccaccccacccccgaaacaaugccagcccgcugcuuuuu

SEQ ID NO: 129341 - RNA, 64 nt, Human
guucuuuacuggauuuuuuaaaaaccugugaaccccccgaaacuguaugugaaaguugagacau

SEQ ID NO: 129342 - RNA, 64 nt, Human
cauaaggagagucgcaucagagcuuuucacagccccccgaaaccccagccugguuuugauggca

SEQ ID NO: 129343 - RNA, 64 nt, Human
gagaagguuguaggcauggaagagagccaggcagccccgaaagaagagccugggccacggccac

SEQ ID NO: 129344 - RNA, 64 nt, Human
uugcacagugaaagaauucuggauaucucaggagccccgaaauucuagcucugacuuugcuguu

SEQ ID NO: 129345 - RNA, 64 nt, Human
gggcuucuccugacccaguccccgugccccgccuccccgaaacaggcuacucuccucggccccc

SEQ ID NO: 129346 - RNA, 64 nt, Human
uucucuaccccaccacacaaauuucccauuucccccccgaaaaccuugaucuuacccaugaaug

SEQ ID NO: 129347 - RNA, 64 nt, Human
guuuucacuccagucaucauuuuccuaucucaccccccgaaacaccacccuaaaguuggauuuu

SEQ ID NO: 129348 - RNA, 64 nt, Human
uuguguuaggauuccgaugcaacaccaugcaaaaccccgaaacagcugcuuugccguccgucca

SEQ ID NO: 129349 - RNA, 64 nt, Human
uugaaaggaagcuuucccccgccaaggacgccuaccccgaaaccggccccgacgccccgcagag

SEQ ID NO: 129350 - RNA, 64 nt, Human
gcagcacaggaggcuccgugagcccuugguuccuccccgaaaacccccagcauuacgauccccc

SEQ ID NO: 129351 - RNA, 64 nt, Human
cgccacggccucucaucuuaggaccuaaugggacccccgaaaggagccaaguggggcccucggc

SEQ ID NO: 129352 - RNA, 64 nt, Human
cagucuguuuaaguaagcuaaauguaucuuacugccccgaaaugagaggagacuggucuugaag

SEQ ID NO: 129353 - RNA, 64 nt, Human
caacacaauuuccuaucagaauaugucccucaacccccgaaacaaggcuucucucagccucccc

SEQ ID NO: 129354 - RNA, 64 nt, Human
gggauagaaggaaggaaggaaggaacccccccccccccgaaaaaaaaaucaaagcgggaagaaa

SEQ ID NO: 129355 - RNA, 64 nt, Human
cugcagaagaagcugaaggcugacuuuguccccuccccgaaaaaggguguuuugaugccucagg

SEQ ID NO: 129356 - RNA, 57 nt, Human
agagaggaucgcggauguaaacuaagaccccgaaaacuccagaccuucaggagagca

SEQ ID NO: 129357 - RNA, 64 nt, Human
uagguuguuggccucuuacuugggcugaccugacccccgaaagagaaacagacaacucuguucu

SEQ ID NO: 129358 - RNA, 64 nt, Human
uugugggcucuggaaaccacauggcuucaccuguccccgaaacuaccagcccuacaccauuccu

SEQ ID NO: 129359 - RNA, 64 nt, Human
uuuggucagucauauacaauaaagaaucaucucaccccgaaaugcaaauugcaggcccauugag

SEQ ID NO: 129360 - RNA, 64 nt, Human
auuguugccaggggugaggccgugccccaggccuccccgaaaccaaaggggaaggcaggggugg

SEQ ID NO: 129361 - RNA, 64 nt, Human
agcaucaaggggacgcugugugugcugcaagugaccccgaaaacaaccacagccgucacauggu

SEQ ID NO: 129362 - RNA, 64 nt, Human
cccacaagggggccgcugcgagaaguucacccacccccgaaaaaauaauuaaacucgcaggcca

SEQ ID NO: 129363 - RNA, 64 nt, Human
ugggcgcucguguugugcgggcccugcuccucugccccgaaaccacuggcuggucccuucccug

SEQ ID NO: 129364 - RNA, 64 nt, Human
cugauuggaauuucuggccuccuaaggcuccccaccccgaaaucagcccccagccuuguuucug

SEQ ID NO: 129365 - RNA, 64 nt, Human
ggaggcgucuccaaggaggugacacuuaagccauccccgaaagaggugaaagagaucacuuugg

SEQ ID NO: 129366 - RNA, 64 nt, Human
ugucccccuacgccaucccgacacguccccguucccccgaaaccuggcucagugcaauacuccc

SEQ ID NO: 129367 - RNA, 64 nt, Human
ucaccccguuugcauaugcaaugcuagcaugggaccccgaaaauagacgcucugcugcacugag

SEQ ID NO: 129368 - RNA, 64 nt, Human
cugauccccagaagcgauggcugaccagauugaaccccgaaacucaggaagagugaaaugcuac

SEQ ID NO: 129369 - RNA, 64 nt, Human
ucuucuaggcaauuucuugcaaccaccaccgaggccccgaaaagcacuggucgucagggagcuc

SEQ ID NO: 129370 - RNA, 64 nt, Human
uuuucauugagcauuucucuauuuuuccaguuauccccgaaauuucuauguauuauauuuuuug

SEQ ID NO: 129371 - RNA, 64 nt, Human
gggauuaagaaggaacccggugugcacagcagauccccgaaauuggugggcuugaccuccuggc

SEQ ID NO: 129372 - RNA, 64 nt, Human
uaaccuggccccucaccucuucugcaccccccgcccccgaaacugucucguaaugaauuucugc

SEQ ID NO: 129373 - RNA, 64 nt, Human
acagagaagcccuauaaucacaggucugugguggccccgaaauggggggccugcuagucaggag

SEQ ID NO: 129374 - RNA, 64 nt, Human
gacguaccccagugcgccucggcacaccauugcuccccgaaacugggguguccaggcggaacag

SEQ ID NO: 129375 - RNA, 64 nt, Human
uuccuuuggaaaaccaaacuaguaucagaacaaaccccgaaacaguaagaaauuggagugagaa

SEQ ID NO: 129376 - RNA, 64 nt, Human
gcuguaggaucccccuugaugcaagagguaggcuccccgaaagacccuggaaagucccugccac

SEQ ID NO: 129377 - RNA, 64 nt, Human
gaucuugggcuaggugacaaguucuuggacuuugccccgaaagcacauccauaaaagacaaaau

SEQ ID NO: 129378 - RNA, 64 nt, Human
caucauaacuuuacagaauugaaucuagagucuuccccgaaaagcccagaaacuucucugcagu

SEQ ID NO: 129379 - RNA, 64 nt, Human
ucagggccagagaaagucagaacaaagaaaauguccccgaaacgaauuuucuuacaaaagccua

SEQ ID NO: 129380 - RNA, 64 nt, Human
aaaggcugcccuccacacccgcgccccgcgcgcgccccgaaaggucaccucacucagcaccacu

SEQ ID NO: 129381 - RNA, 64 nt, Human
cgcaggacccuuguccugguggcacaagggauggggacgcgagggggaggggaggcgaggaaca

SEQ ID NO: 129382 - RNA, 64 nt, Human
ucuucucaguucuccuugcagaggacuggcgccgggacgcgaagagcaacgggcgcugcacaaa

SEQ ID NO: 129383 - RNA, 64 nt, Human
gugcaguuuuucucuugaaggaucauuuaaaaagggacgcgaauaaguuugcuccuucauauaa

SEQ ID NO: 129384 - RNA, 64 nt, Human
ggaaguuuguagccauuuuucugacgccugccaaggacgcgacgaccagggaggaggaaucggc

SEQ ID NO: 129385 - RNA, 64 nt, Human
aaacggucugcaccgcugcgggcgugacgcucccggacgcgaguggguguggaauugcuuuccu

SEQ ID NO: 129386 - RNA, 64 nt, Human
gaagacaccagggcugacuuugaccgagggccauggacgcgacaggccuguggcccugcgcaug

SEQ ID NO: 129387 - RNA, 64 nt, Human
aacaggccgagugaaggugcuggaaagggagggaggacgcgaggggaaaggccuguggggagcc

SEQ ID NO: 129388 - RNA, 64 nt, Human
agguguaugcugccgucaaggggcucaggaaagcggacgcgaggcucgccaucgcaagguacag

SEQ ID NO: 129389 - RNA, 64 nt, Human
caguccugguccuuccacugugcaccugcgcggaggacgcgaccucaguuguccugcccugugg

SEQ ID NO: 129390 - RNA, 64 nt, Human
ccaacugcagagaagaaagacgagccucggcccaggacgcgauuucuaacgaaaugcaauaguu

SEQ ID NO: 129391 - RNA, 64 nt, Human
caaagcucugauggcaccaaaucuugacuccuuuggacgcgaucgggcacuguaucaagagcau

SEQ ID NO: 129392 - RNA, 64 nt, Human
gucaguugcuaagugcuaaauuacuggccagguaggacgcgaguccacuuugccauaaggaaag

SEQ ID NO: 129393 - RNA, 64 nt, Human; identical to SEQ ID NO: 40944

SEQ ID NO: 129394 - RNA, 64 nt, Human; identical to SEQ ID NO: 40945

SEQ ID NO: 129395 - RNA, 64 nt, Human; identical to SEQ ID NO: 40946

SEQ ID NO: 129396 - RNA, 64 nt, Human; identical to SEQ ID NO: 40947

SEQ ID NO: 129397 - RNA, 64 nt, Human; identical to SEQ ID NO: 40948

SEQ ID NO: 129398 - RNA, 64 nt, Human; identical to SEQ ID NO: 40949

SEQ ID NO: 129399 - RNA, 64 nt, Human; identical to SEQ ID NO: 40950

SEQ ID NO: 129400 - RNA, 64 nt, Human; identical to SEQ ID NO: 40951

SEQ ID NO: 129401 - RNA, 64 nt, Human; identical to SEQ ID NO: 40952

SEQ ID NO: 129402 - RNA, 64 nt, Human; identical to SEQ ID NO: 40953

SEQ ID NO: 129403 - RNA, 64 nt, Human; identical to SEQ ID NO: 40954

SEQ ID NO: 129404 - RNA, 64 nt, Human; identical to SEQ ID NO: 40955

SEQ ID NO: 129405 - RNA, 64 nt, Human; identical to SEQ ID NO: 40956

SEQ ID NO: 129406 - RNA, 64 nt, Human; identical to SEQ ID NO: 40957

SEQ ID NO: 129407 - RNA, 64 nt, Human; identical to SEQ ID NO: 40957

SEQ ID NO: 129408 - RNA, 64 nt, Human; identical to SEQ ID NO: 40959

SEQ ID NO: 129409 - RNA, 64 nt, Human; identical to SEQ ID NO: 40960

SEQ ID NO: 129410 - RNA, 64 nt, Human; identical to SEQ ID NO: 40961

SEQ ID NO: 129411 - RNA, 64 nt, Human; identical to SEQ ID NO: 40962

SEQ ID NO: 129412 - RNA, 64 nt, Human; identical to SEQ ID NO: 40963

SEQ ID NO: 129413 - RNA, 64 nt, Human; identical to SEQ ID NO: 40964

SEQ ID NO: 129414 - RNA, 57 nt, Human; identical to SEQ ID NO: 40965

SEQ ID NO: 129415 - RNA, 64 nt, Human; identical to SEQ ID NO: 40966

SEQ ID NO: 129416 - RNA, 64 nt, Human; identical to SEQ ID NO: 40967

SEQ ID NO: 129417 - RNA, 64 nt, Human; identical to SEQ ID NO: 40968

SEQ ID NO: 129418 - RNA, 64 nt, Human
gugaagagcagaaaagaugaauuuguccaauuguguagacgauauacucccugcccuucccccu

SEQ ID NO: 129419 - RNA, 64 nt, Human; identical to SEQ ID NO: 40969

SEQ ID NO: 129420 - RNA, 60 nt, Human; identical to SEQ ID NO: 40970

SEQ ID NO: 129421 - RNA, 64 nt, Human; identical to SEQ ID NO: 40971

SEQ ID NO: 129422 - RNA, 64 nt, Human; identical to SEQ ID NO: 40972

SEQ ID NO: 129423 - RNA, 64 nt, Human; identical to SEQ ID NO: 40973

SEQ ID NO: 129424 - RNA, 64 nt, Human; identical to SEQ ID NO: 40974

SEQ ID NO: 129425 - RNA, 64 nt, Human; identical to SEQ ID NO: 40975

SEQ ID NO: 129426 - RNA, 64 nt, Human; identical to SEQ ID NO: 40976

SEQ ID NO: 129427 - RNA, 64 nt, Human; identical to SEQ ID NO: 40977

SEQ ID NO: 129428 - RNA, 64 nt, Human; identical to SEQ ID NO: 40978

SEQ ID NO: 129429 - RNA, 64 nt, Human; identical to SEQ ID NO: 40979

SEQ ID NO: 129430 - RNA, 64 nt, Human; identical to SEQ ID NO: 40980

SEQ ID NO: 129431 - RNA, 64 nt, Human; identical to SEQ ID NO: 40981

SEQ ID NO: 129432 - RNA, 64 nt, Human; identical to SEQ ID NO: 40982

SEQ ID NO: 129433 - RNA, 64 nt, Human; identical to SEQ ID NO: 40983

SEQ ID NO: 129434 - RNA, 53 nt, Human; identical to SEQ ID NO: 40984

SEQ ID NO: 129435 - RNA, 64 nt, Human; identical to SEQ ID NO: 40985

SEQ ID NO: 129436 - RNA, 64 nt, Human; identical to SEQ ID NO: 40986

SEQ ID NO: 129437 - RNA, 64 nt, Human; identical to SEQ ID NO: 40987

SEQ ID NO: 129438 - RNA, 64 nt, Human; identical to SEQ ID NO: 40988

SEQ ID NO: 129439 - RNA, 64 nt, Human; identical to SEQ ID NO: 40989

SEQ ID NO: 129440 - RNA, 64 nt, Human; identical to SEQ ID NO: 40990

SEQ ID NO: 129441 - RNA, 64 nt, Human; identical to SEQ ID NO: 40991

SEQ ID NO: 129442 - RNA, 64 nt, Human; identical to SEQ ID NO: 40992

SEQ ID NO: 129443 - RNA, 64 nt, Human; identical to SEQ ID NO: 40993

SEQ ID NO: 129444 - RNA, 64 nt, Human; identical to SEQ ID NO: 40994

SEQ ID NO: 129445 - RNA, 64 nt, Human; identical to SEQ ID NO: 40995

SEQ ID NO: 129446 - RNA, 64 nt, Human; identical to SEQ ID NO: 40996

SEQ ID NO: 129447 - RNA, 64 nt, Human; identical to SEQ ID NO: 40997

SEQ ID NO: 129448 - RNA, 64 nt, Human; identical to SEQ ID NO: 40998

SEQ ID NO: 129449 - RNA, 64 nt, Human; identical to SEQ ID NO: 40999

SEQ ID NO: 129450 - RNA, 64 nt, Human; identical to SEQ ID NO: 41000

SEQ ID NO: 129451 - RNA, 64 nt, Human; identical to SEQ ID NO: 41001

SEQ ID NO: 129452 - RNA, 64 nt, Human; identical to SEQ ID NO: 41002

SEQ ID NO: 129453 - RNA, 64 nt, Human; identical to SEQ ID NO: 41003

SEQ ID NO: 129454 - RNA, 64 nt, Human; identical to SEQ ID NO: 41004

SEQ ID NO: 129455 - RNA, 64 nt, Human; identical to SEQ ID NO: 41005

SEQ ID NO: 129456 - RNA, 64 nt, Human; identical to SEQ ID NO: 41006

SEQ ID NO: 129457 - RNA, 64 nt, Human; identical to SEQ ID NO: 41007

SEQ ID NO: 129458 - RNA, 64 nt, Human; identical to SEQ ID NO: 41008

SEQ ID NO: 129459 - RNA, 54 nt, Human; identical to SEQ ID NO: 41009

SEQ ID NO: 129460 - RNA, 64 nt, Human; identical to SEQ ID NO: 41010

SEQ ID NO: 129461 - RNA, 64 nt, Human; identical to SEQ ID NO: 41011

SEQ ID NO: 129462 - RNA, 64 nt, Human; identical to SEQ ID NO: 41012

SEQ ID NO: 129463 - RNA, 64 nt, Human; identical to SEQ ID NO: 41013

SEQ ID NO: 129464 - RNA, 64 nt, Human; identical to SEQ ID NO: 41014

SEQ ID NO: 129465 - RNA, 64 nt, Human; identical to SEQ ID NO: 41015

SEQ ID NO: 129466 - RNA, 64 nt, Human; identical to SEQ ID NO: 41016

SEQ ID NO: 129467 - RNA, 64 nt, Human; identical to SEQ ID NO: 41017

SEQ ID NO: 129468 - RNA, 64 nt, Human; identical to SEQ ID NO: 41018

SEQ ID NO: 129469 - RNA, 64 nt, Human; identical to SEQ ID NO: 41019

SEQ ID NO: 129470 - RNA, 64 nt, Human; identical to SEQ ID NO: 41020

SEQ ID NO: 129471 - RNA, 64 nt, Human; identical to SEQ ID NO: 41021

SEQ ID NO: 129472 - RNA, 64 nt, Human; identical to SEQ ID NO: 41022

SEQ ID NO: 129473 - RNA, 64 nt, Human; identical to SEQ ID NO: 41023

SEQ ID NO: 129474 - RNA, 64 nt, Human; identical to SEQ ID NO: 41024

SEQ ID NO: 129475 - RNA, 64 nt, Human; identical to SEQ ID NO: 41025

SEQ ID NO: 129476 - RNA, 64 nt, Human; identical to SEQ ID NO: 41026

SEQ ID NO: 129477 - RNA, 64 nt, Human; identical to SEQ ID NO: 41027

SEQ ID NO: 129478 - RNA, 64 nt, Human; identical to SEQ ID NO: 41028

SEQ ID NO: 129479 - RNA, 64 nt, Human; identical to SEQ ID NO: 41029

SEQ ID NO: 129480 - RNA, 64 nt, Human; identical to SEQ ID NO: 41030

SEQ ID NO: 129481 - RNA, 64 nt, Human; identical to SEQ ID NO: 41031

SEQ ID NO: 129482 - RNA, 64 nt, Human; identical to SEQ ID NO: 41032

SEQ ID NO: 129483 - RNA, 64 nt, Human; identical to SEQ ID NO: 41033

SEQ ID NO: 129484 - RNA, 64 nt, Human; identical to SEQ ID NO: 41034

SEQ ID NO: 129485 - RNA, 64 nt, Human; identical to SEQ ID NO: 41035

SEQ ID NO: 129486 - RNA, 64 nt, Human; identical to SEQ ID NO: 41036

SEQ ID NO: 129487 - RNA, 64 nt, Human; identical to SEQ ID NO: 41037

SEQ ID NO: 129488 - RNA, 64 nt, Human; identical to SEQ ID NO: 41038

SEQ ID NO: 129489 - RNA, 64 nt, Human; identical to SEQ ID NO: 41039

SEQ ID NO: 129490 - RNA, 64 nt, Human; identical to SEQ ID NO: 41040

SEQ ID NO: 129491 - RNA, 64 nt, Human; identical to SEQ ID NO: 41041

SEQ ID NO: 129492 - RNA, 64 nt, Human; identical to SEQ ID NO: 41042

SEQ ID NO: 129493 - RNA, 57 nt, Human; identical to SEQ ID NO: 41043

SEQ ID NO: 129494 - RNA, 50 nt, Human; identical to SEQ ID NO: 41044

SEQ ID NO: 129495 - RNA, 64 nt, Human; identical to SEQ ID NO: 41045

SEQ ID NO: 129496 - RNA, 64 nt, Human; identical to SEQ ID NO: 41046

SEQ ID NO: 129497 - RNA, 64 nt, Human; identical to SEQ ID NO: 41047

SEQ ID NO: 129498 - RNA, 64 nt, Human; identical to SEQ ID NO: 41048

SEQ ID NO: 129499 - RNA, 60 nt, Human; identical to SEQ ID NO: 41049

SEQ ID NO: 129500 - RNA, 64 nt, Human; identical to SEQ ID NO: 41050

SEQ ID NO: 129501 - RNA, 64 nt, Human; identical to SEQ ID NO: 41051

SEQ ID NO: 129502 - RNA, 64 nt, Human; identical to SEQ ID NO: 41052

SEQ ID NO: 129503 - RNA, 64 nt, Human; identical to SEQ ID NO: 41053

SEQ ID NO: 129504 - RNA, 64 nt, Human; identical to SEQ ID NO: 41054

SEQ ID NO: 129505 - RNA, 64 nt, Human; identical to SEQ ID NO: 41055

SEQ ID NO: 129506 - RNA, 64 nt, Human; identical to SEQ ID NO: 41056

SEQ ID NO: 129507 - RNA, 64 nt, Human; identical to SEQ ID NO: 41057

SEQ ID NO: 129508 - RNA, 64 nt, Human; identical to SEQ ID NO: 41058

SEQ ID NO: 129509 - RNA, 64 nt, Human; identical to SEQ ID NO: 41059

SEQ ID NO: 129510 - RNA, 64 nt, Human; identical to SEQ ID NO: 41060

SEQ ID NO: 129511 - RNA, 64 nt, Human; identical to SEQ ID NO: 41061

SEQ ID NO: 129512 - RNA, 64 nt, Human; identical to SEQ ID NO: 41062

SEQ ID NO: 129513 - RNA, 64 nt, Human; identical to SEQ ID NO: 41063

SEQ ID NO: 129514 - RNA, 64 nt, Human; identical to SEQ ID NO: 41064

SEQ ID NO: 129515 - RNA, 64 nt, Human; identical to SEQ ID NO: 41065

SEQ ID NO: 129516 - RNA, 55 nt, Human; identical to SEQ ID NO: 41066

SEQ ID NO: 129517 - RNA, 64 nt, Human; identical to SEQ ID NO: 41067

SEQ ID NO: 129518 - RNA, 64 nt, Human; identical to SEQ ID NO: 41068

SEQ ID NO: 129519 - RNA, 64 nt, Human; identical to SEQ ID NO: 41069

SEQ ID NO: 129520 - RNA, 64 nt, Human; identical to SEQ ID NO: 41070

SEQ ID NO: 129521 - RNA, 64 nt, Human; identical to SEQ ID NO: 41071

SEQ ID NO: 129522 - RNA, 64 nt, Human
cuaucauugcuaagagauucccgcugauugggcucagugccagcuguuauucugcuuccacugu

SEQ ID NO: 129523 - RNA, 64 nt, Human
gugaggacgcuggaccugcaggagcggggagcugcagugccaccugcuggguaccacgggccgg

SEQ ID NO: 129524 - RNA, 64 nt, Human
gggcagcucuugaguccaccuugugccagaucagcagugccacccaggcucugccuccuggugu

SEQ ID NO: 129525 - RNA, 64 nt, Human
uuggggggacccagcaaggacucagagagucagacagugccacuuggccacuugggguaaagcc

SEQ ID NO: 129526 - RNA, 64 nt, Human
ucagacagugccacuuggccacuugggguaaagccagugccagcaauaacaguuuaucaugcuc

SEQ ID NO: 129527 - RNA, 64 nt, Human
ugccagacaucaccagguuguagaaguugacaggcagugccaugggggcaacagccaaaauagg

SEQ ID NO: 129528 - RNA, 64 nt, Human
cccacagccuugggcccuagguaccccagcugaucagugccaggagagaccagagccucuggag

SEQ ID NO: 129529 - RNA, 64 nt, Human
cacacccccuccucugagcucugaauaugggacccagugccaggagcuggaagacaagguguuu

SEQ ID NO: 129530 - RNA, 64 nt, Human
gcuggguugcaauuccagaaugcugggaguuuuacagugccauuccaagucccagaugucccuc

SEQ ID NO: 129531 - RNA, 64 nt, Human
gaauccgaggccaucaaccuuggugacagcagcgcagugccaaugcugaucacacugcauggga

SEQ ID NO: 129532 - RNA, 64 nt, Human
ggcugucuagccggguauagguaacccacaggcccagugccagcccucaaaggacauagacuuu

SEQ ID NO: 129533 - RNA, 64 nt, Human
aaucucuauacugcccugaguuggggggaauucucagugccaacuguggcugguccucauucaa

SEQ ID NO: 129534 - RNA, 64 nt, Human
ggauuaggaugaaauaccugugaaagugccuaggcagugccagccaaauaggaggcauucaaug

SEQ ID NO: 129535 - RNA, 64 nt, Human
ucuucaguagacaagucaccuuuguagcuagcaccagugccagcuccaugccauugcaccuucu

SEQ ID NO: 129536 - RNA, 64 nt, Human
cugcccccaucugacugcguagcugagaggggaacagugccauguaccacacagauguuccugu

SEQ ID NO: 129537 - RNA, 64 nt, Human
gaagaagagggaagaauccgaccacuuuccaauccagugccaauuggcccacuaagcauccuaa

SEQ ID NO: 129538 - RNA, 64 nt, Human
auccuggggcagcagcuggacagccauuagaccucagugccagggcacucuuccuccagcuggg

SEQ ID NO: 129539 - RNA, 64 nt, Human
aaaccuuucccaagccuuccuggcccacaguggccagugccauaggcagugcuguggacaguag

SEQ ID NO: 129540 - RNA, 64 nt, Human
uccagcaauacaugugcagggguugcugcuuucccagugccaggagaacccccgcuccgaguca

SEQ ID NO: 129541 - RNA, 64 nt, Human
guaucaugagccaacccucaaaggacccguauuacagugccacguuggaaaacgcuacaggaag

SEQ ID NO: 129542 - RNA, 64 nt, Human
ggggugagggugggggagagagggaauuauuguccagugccaaccccaaugaccccaaucccaa

SEQ ID NO: 129543 - RNA, 64 nt, Human
agguuuucaaccggaaggaggccaaccagcccgacagugccauccccaccuucaccucggaggg

SEQ ID NO: 129544 - RNA, 64 nt, Human
caucuggcauguguuucuuggauaggggccagugcagugccauccuacagguggcuggagcagc

SEQ ID NO: 129545 - RNA, 64 nt, Human
ggcacccaguccagaaggagcaauggcaccugggcagugccagggcuuaaagcccgcugcuccu

SEQ ID NO: 129546 - RNA, 64 nt, Human
ccucugaauagaccagacgcccuuucacuuaguucagugccaguccuuuugccuucccaacccu

SEQ ID NO: 129547 - RNA, 64 nt, Human
gucgggagaggugaccacaggucugaaaaucagccagugccaacauugcuugcccugcaaggug

SEQ ID NO: 129548 - RNA, 64 nt, Human
ugagccuaaaguugagaaaauggguggccaaggccagugccagugucuuggggccccuuuggcu

SEQ ID NO: 129549 - RNA, 64 nt, Human
gcgggaucacuggggggcucucagggaacagcagcagugccauagccaggcucucugcugccca

SEQ ID NO: 129550 - RNA, 64 nt, Human
acuucuggcccuucucccugccucaaucuaaaagcagugccacacccuccaaaguggaauagaa

SEQ ID NO: 129551 - RNA, 64 nt, Human
cgaugggcuggagcugggagaggugcugagcuaacagugccaacaagugcuccuuaagccugcg

SEQ ID NO: 129552 - RNA, 64 nt, Human
uacccacagcauuauauguaacaucucuccugaucagugccauucccacgguuucaaagaaaac

SEQ ID NO: 129553 - RNA, 64 nt, Human
cgauauggaugcagcuaaccaaagauccugcgugcagugccaggaccuggccgcacuguacauu

SEQ ID NO: 129554 - RNA, 64 nt, Human
cuggggcaguuuuaguucuuuauauuuagugggucagugccaagugcuaccacuucccaauaaa

SEQ ID NO: 129555 - RNA, 64 nt, Human
ggucucugaggcucuuuguggcaucagccuugcccagugccacacaguaucuccuggcguucua

SEQ ID NO: 129556 - RNA, 64 nt, Human
aguucaguuuuagaaaagggagucuguuccagaucagugccagaacugugcccaggcccaaagg

SEQ ID NO: 129557 - RNA, 64 nt, Human
gcuguagaugaaugguuaacacgagcuaguuaaacagugccauuguuuugccagugaagccucc

SEQ ID NO: 129558 - RNA, 64 nt, Human
aguuuccaccuggaguucaugcaagggcaaaaggcagugccaugcaagcuguuuaaaauaaaga

SEQ ID NO: 129559 - RNA, 64 nt, Human
agggugcuguggugagcuggccacuccagagcugcagugccacuggaggagucagacuaccaug

SEQ ID NO: 129560 - RNA, 64 nt, Human
aguuccccuacucuggccucuacuccccacaccccagugccacugugggugacuauacuggccc

SEQ ID NO: 129561 - RNA, 64 nt, Human
ggaagcagggcuuuuccggaugccuaggggugggcagugccagccccuccucaccacucuuccc

SEQ ID NO: 129562 - RNA, 64 nt, Human
auuuguaaggguaggaguugaaaacugcaguucccagugccacggaagugugauuggagccugc

SEQ ID NO: 129563 - RNA, 64 nt, Human
ggcugugcuugaaggcgaaacccugccauauccccagugccaguccccucagccugugguggcc

SEQ ID NO: 129564 - RNA, 64 nt, Human
aggggcacgucgcccgcugagcugaguggccagccagugccauuccacuccacucagguucuuc

SEQ ID NO: 129565 - RNA, 64 nt, Human
ugaagagcacagcugugcgggugguagacuuuggcagugccaccuuugaccaugagcaccauag

SEQ ID NO: 129566 - RNA, 64 nt, Human
ucucuacuguaugaauuaugcuuuaaguagaauucagugccaaggagaacuuggugaaauaaau

SEQ ID NO: 129567 - RNA, 64 nt, Human
augauugggaaaucugccagccaguggcuucaugcagugccauauuucuuuagaggauuacuuu

SEQ ID NO: 129568 - RNA, 64 nt, Human
aucuuccauaagugccagaaauugguacaaagugcagugccagcugcuccccagggcauggucu

SEQ ID NO: 129569 - RNA, 64 nt, Human
uucccccgguggagccuuagguuagugcccagugcagugccagacugucuccucugcuccuccc

SEQ ID NO: 129570 - RNA, 64 nt, Human
uuuuuuuuuuuuuuuucugauuugauucugguuacagugccauaaaccuuguuacauauguaua

SEQ ID NO: 129571 - RNA, 64 nt, Human
acuuuuaugucucuuguaaauuuauauauacuuucagugccauugugaagaauuggccuuuuaa

SEQ ID NO: 129572 - RNA, 64 nt, Human
cgcugcgugcucagacucacagccaaccuggaagguagacgagauagcgccacccacgccccuc

SEQ ID NO: 129573 - RNA, 64 nt, Human
agcuuagcuggggcgagaugcaugugaaggcaggcagugccaagauuccgcuuccuuuguuugc

SEQ ID NO: 129574 - RNA, 64 nt, Human
ccuugguccuguagguuaacugaaguucaaacaucagugccagcuugccuccauccuuuucaca

SEQ ID NO: 129575 - RNA, 64 nt, Human
uuuuucuuaaagcauauucuuugcaucuaacugccagugccauugucaaaacuuauuuuuuaaa

SEQ ID NO: 129576 - RNA, 64 nt, Human
gugccuuagucagggaccacgggcgcugaaucugcagugccaacaccaaacugacacaucucca

SEQ ID NO: 129577 - RNA, 64 nt, Human
gcuccuggcccaggugagcaagguggaggccuugcagugccaggaggagggcugccgccauggg

SEQ ID NO: 129578 - RNA, 64 nt, Human
uuaaaagaaauaacuaaauuuucaaaugaguaagcagugccaccaacuaguguuuugcccgaua

SEQ ID NO: 129579 - RNA, 64 nt, Human
gguugucacagcaacugggguggcauuugcugcccagugccaggaauaguaacauuaugaaugc

SEQ ID NO: 129580 - RNA, 64 nt, Human
aaucagccgcaaggauccuucccuguaaauuugacagugccacauacugcggaccaagggacuc

SEQ ID NO: 129581 - RNA, 64 nt, Human
guaaaagagauuuccugugacaggccaagucuuacagugccauggcccacauuccaacuuacca

SEQ ID NO: 129582 - RNA, 64 nt, Human
uuuguuaggaaaacccaugggccgccgccacacucagugccauggggaagcgggcgucuccccc

SEQ ID NO: 129583 - RNA, 64 nt, Human
ccccagggucuaacgguuaaggggacccacauaccagugccaagggggaugucaaguggugaug

SEQ ID NO: 129584 - RNA, 64 nt, Human
cuucgaguagagaggcccgcccgcccaccgugggcagugccacccgcagaugacacgcgcucuc

SEQ ID NO: 129585 - RNA, 64 nt, Human
agcacagggccccgcugggccuccucaccaacggcagugccaaaaucagcccccacaucaaggu

SEQ ID NO: 129586 - RNA, 64 nt, Human
caacacaggcaaguccaccccauaauaacccugccagugccagggugggcuggggacucuggca

SEQ ID NO: 129587 - RNA, 64 nt, Human
auacacaauauaaaauaugaaacucaauaauaaacagugccaccuguacaugggcaccaugccc

SEQ ID NO: 129588 - RNA, 64 nt, Human
uagaucuugaagauacagguaccccacgaagucucagugccagaacauaagcccugaagugggc

SEQ ID NO: 129589 - RNA, 64 nt, Human
cgccuguauggaguugguuucaucuucuggugcccacggccauuggcauugccagccucauucc

SEQ ID NO: 129590 - RNA, 64 nt, Human
cuucaccuccaggaucaggauucugucaaagaugcagugccagaucaacaguuagauuuuaagc

SEQ ID NO: 129591 - RNA, 64 nt, Human
gaugcucugucaccuucaaaggauggugucagagcagugccaccuccugucucaguucuucaga

SEQ ID NO: 129592 - RNA, 64 nt, Human
ucacccagccagcccuucaggugccuucuacucccagugccaaagccagaccacugggguuucc

SEQ ID NO: 129593 - RNA, 64 nt, Human
ugucacugcagugcauuauaccaaagagcgaagucagugccacugaaaauacagaacccauuaa

SEQ ID NO: 129594 - RNA, 64 nt, Human
gcacgcucagugagacuggucaugcaagcauuuacagugccaugcuccucaagccgauuuuuuc

SEQ ID NO: 129595 - RNA, 64 nt, Human
cugaccuucaaaugcccauguuggccuuuuacagcagugccacggcaccaagcgagcugccaca

SEQ ID NO: 129596 - RNA, 64 nt, Human
uaaccacaaugagauaaguauuggcauuaguguucagugccauuuuauacuuucucucuguguu

SEQ ID NO: 129597 - RNA, 64 nt, Human
uuguaccacaagagagaguguagcacccauuuuacagugccaugcacaucagagaaagaaacug

SEQ ID NO: 129598 - RNA, 64 nt, Human
uuaaccaagcuauucaaguauuccuaugccagagcagugccaacucuuggaggucccagagugc

SEQ ID NO: 129599 - RNA, 64 nt, Human
ccaaaagagaugaacccugccccuugcccagggccagugccauggggaaggggcuuguggggag

SEQ ID NO: 129600 - RNA, 64 nt, Human
caguugagaggggccgcuguuucgccuuguccgucagugccagugccugugccagagguggcga

SEQ ID NO: 129601 - RNA, 64 nt, Human
uucccacuguaggccgaugccugugcaaaggacgcagugccauaucagagaggauccuugaaga

SEQ ID NO: 129602 - RNA, 64 nt, Human
caucuguaaaauagucucauugccaaggcauccccagugccagcuggugaauccaugaucaaaa

SEQ ID NO: 129603 - RNA, 64 nt, Human
uuuaaauucacauaaaaggugaaagcuccugguucagugccauggcuucauggcauucagugau

SEQ ID NO: 129604 - RNA, 64 nt, Human
ccuagugagcagggacagagccaggagucaagugcagugccaaggugcaugacccucugagaag

SEQ ID NO: 129605 - RNA, 64 nt, Human
ucucuuugcagccuuucccaguuugguguuuaagcagugccauguuccuuguuugacaacaaga

SEQ ID NO: 129606 - RNA, 64 nt, Human
ucuccuacucacuuaaagcccgccugacagaaaccacggccacauuugguucuaagaaacccuc

SEQ ID NO: 129607 - RNA, 64 nt, Human
cagugauuccuuggugacagguugagggcagcuccagugccagcaauaggguggcacagaagcu

SEQ ID NO: 129608 - RNA, 64 nt, Human
uguggagcuggacuacggcggcaguauggaauuccagugccaggccagugaccucauucccgag

SEQ ID NO: 129609 - RNA, 64 nt, Human
cuucaccaccguauucucagucacuuccacuaaacagugccaguguuuuaagguucugucacac

SEQ ID NO: 129610 - RNA, 64 nt, Human
agguuuguggcaggccuguguugagcaagacuaucagugccauuuuuuuucaacagcaugugcu

SEQ ID NO: 129611 - RNA, 64 nt, Human
caccacccugguuguucucugggcuuggaggguacagugccagcagcuuccuugcccaauugau

SEQ ID NO: 129612 - RNA, 64 nt, Human
gaucacagcagggccuucugccugcugaccauaacagugccagcuucuuugcagcuuccucuuc

SEQ ID NO: 129613 - RNA, 64 nt, Human
ccuaaaccuuugccccuggggcuuccaucccaaccagugccaaggaccuccucuucccccuucc

SEQ ID NO: 129614 - RNA, 64 nt, Human
uuucuguacuagaaucuuccacugccagaaaacacagugccaguaagguucuacauaccacuga

SEQ ID NO: 129615 - RNA, 64 nt, Human
gguuucugugccccugugguggaagagggcacgacagugccagcgcagcguucugggcuccuca

SEQ ID NO: 129616 - RNA, 64 nt, Human
uguuuuguuuuucagcguuaauguaaaggggcagcagugccaaaauauaaucagagauaaagcu

SEQ ID NO: 129617 - RNA, 64 nt, Human
aaauauucacgagagacaauaaacgcugaaaggccagugccaaguccacauuccuccagcugau

SEQ ID NO: 129618 - RNA, 64 nt, Human
auauuguuguuguuuuuuaaccgaguuuucccaucagugccaaaacucaacucaaucugaaagu

SEQ ID NO: 129619 - RNA, 64 nt, Human
cccaagagacaggcccagagccuaaaggcaaggacagugccaaaagguucugugagcccaucgg

SEQ ID NO: 129620 - RNA, 64 nt, Human
guguuguagguuaagggcauggacugcuugaguucagugccagcuaugccacuuaccagcugug

SEQ ID NO: 129621 - RNA, 64 nt, Human
ucauccggcaccgggcccuggcugcagagaccuucagugccauccugacucuagaaggcccccc

SEQ ID NO: 129622 - RNA, 64 nt, Human
uuauagaaacugguuuauuucuggcagaaagcugcagugccaccugaguuccaaauuuuaccau

SEQ ID NO: 129623 - RNA, 64 nt, Human
ccgcaaguuugcacucuuugagcgcgcugagcgucacggccaaggugggcuucccaccccaccc

SEQ ID NO: 129624 - RNA, 64 nt, Human
gaaagacugagauaaaaguauuuguuucguucaacagugccacugguauuuacuaacaaaauga

SEQ ID NO: 129625 - RNA, 64 nt, Human
cugugauuuuauuuaauuguguauaguaauuauccagugccagaaaaaccgucacuugcaaaau

SEQ ID NO: 129626 - RNA, 64 nt, Human
gugcauuuucaccugagguuucccugcaucccugcagugccaaagccccaccuucagggaccac

SEQ ID NO: 129627 - RNA, 64 nt, Human
ccaucaguagagacauugcuguuccugcccaucccagugccagcuacuccuuccuggaagccuu

SEQ ID NO: 129628 - RNA, 64 nt, Human
aaacauucuccuaggaccagggaagccuggcuuacagugccauuucugcugggcaccaccaccu

SEQ ID NO: 129629 - RNA, 64 nt, Human
cucgauuccuccuguguuggacagaggcugggggcagugccagccugauucuuccgaccuaccu

SEQ ID NO: 129630 - RNA, 64 nt, Human
gcaggcauugaggaagagucuugguuucucucuacagugccaacuccucacacacccugagguc

SEQ ID NO: 129631 - RNA, 64 nt, Human
gcugguccucccauuucuaaagcugaaugucaaacagugccaaaugcuggggcagggggugaag

SEQ ID NO: 129632 - RNA, 64 nt, Human
uuuuuuuuuuuuaauaaggacaccucuuuccaaacagugccaucaaauauguucuuaucucaga

SEQ ID NO: 129633 - RNA, 64 nt, Human
cugagcagggacgcuccccagaaccaacagaaaucagugccaagcaugcgauauucagagucuc

SEQ ID NO: 129634 - RNA, 64 nt, Human
acugccagacaugccacguguccccagagcuuuacagugccacgacauggcugggcuacgugaa

SEQ ID NO: 129635 - RNA, 64 nt, Human
ccucugugcgggagcggcuugcucaccucucagccagugccagcugggugggucucucccagcu

SEQ ID NO: 129636 - RNA, 64 nt, Human
aggccuggccauagggcaagagcaggccuuacagcagugccacggugacccaagaggcaggguu

SEQ ID NO: 129637 - RNA, 64 nt, Human
uuugccacucagguugcaaaauuagcuaauccuucagugccagcacucagaagucuggcaggug

SEQ ID NO: 129638 - RNA, 64 nt, Human
gugcaggcagaggcuggggcagaauguuuacagccagugccagcacaagguaguaaucuaguga

SEQ ID NO: 129639 - RNA, 64 nt, Human
ucuguuucaacaguggguacaccccuaacagagccagugccaacaaaacauuuugaauggacuu

SEQ ID NO: 129640 - RNA, 64 nt, Human
agcaggcccugucaccgacgggucaccucgcccacacggccagcaccgacucaccacagcccuu

SEQ ID NO: 129641 - RNA, 64 nt, Human
aacauuacuguucuaaugcugaagugacuuuugccagugccauguccagguggugagguauaag

SEQ ID NO: 129642 - RNA, 64 nt, Human
cccgugcaguaggggcuacugugaccauggaggccagugccagcaccugcccagugggccccgc

SEQ ID NO: 129643 - RNA, 64 nt, Human
cuguucccuccaccuagacugccugcugagggggcagugccaggagguugccuguccuugggga

SEQ ID NO: 129644 - RNA, 64 nt, Human
uuaagcuguggaaaaugacucaagagcaauaaaucagugccaaagcuucccugcgcaucugaau

SEQ ID NO: 129645 - RNA, 64 nt, Human
uacaaaguuuccuccucuccuacacugaaagacucagugccaugcagaagccuuuuuuuuaaga

SEQ ID NO: 129646 - RNA, 64 nt, Human
cuauaccccacaaguuuucacugaaugagcauggcagugccacucaagaaaaugaaucuccaaa

SEQ ID NO: 129647 - RNA, 64 nt, Human
cugaaaaccccucuggucucagagacaguaggggcagugccacuuucuacaaccugccaaccca

SEQ ID NO: 129648 - RNA, 64 nt, Human
uuuaaaaaaaaguuuuacugauguuaaacguucucagugccaaugucagacugugcuccucccu

SEQ ID NO: 129649 - RNA, 64 nt, Human
cagugcuggagcaugguaugaccagauuuuaucacagugccauuugaagggaaaggaguucaga

SEQ ID NO: 129650 - RNA, 64 nt, Human
gcagacucgcagacggggcagugagcgucugggacagugccaagaguggggugugugauuuuug

SEQ ID NO: 129651 - RNA, 64 nt, Human
uuccagagacuaaauguccagacucacaaugucccagugccaugcuuccuccuuaggcccuagg

SEQ ID NO: 129652 - RNA, 64 nt, Human
gcuucuuuguuaauacacccaugcuaaauuucaacagugccacuucugcauucucuguucucaa

SEQ ID NO: 129653 - RNA, 64 nt, Human
gccaccuggccgccacacugaaaacuguccugcucagugccaaggugcuacucuugcaagccac

SEQ ID NO: 129654 - RNA, 64 nt, Human
ucuuacaauacagaacaacuguuaagauggaaaacagugccaaaccuccacagcucauuucuuu

SEQ ID NO: 129655 - RNA, 64 nt, Human
uugugcauuuguuucaacugaauuuugguggugucagugccauuaucuagcacccugauuuuuu

SEQ ID NO: 129656 - RNA, 64 nt, Human
aaacuggcagugcaccucucaucagcccaggucccagugccauuggcuucaagaaaaaaaaaaa

SEQ ID NO: 129657 - RNA, 64 nt, Human
ggagacugacugaguagcucauucuugugacuuacagugccaacauuuaaaaaaguaugaaaau

SEQ ID NO: 129658 - RNA, 64 nt, Human
auucuguggauggaugugauuucaggagauugugcagugccagcaucagugcauaaaggguccu

SEQ ID NO: 129659 - RNA, 64 nt, Human
ugcagugaaugcuccuuccauuccuguacucgggcagugccauucagcacaggagagcucuuuu

SEQ ID NO: 129660 - RNA, 64 nt, Human
caggugacauggauaaagagccccauuauuuucacagugccagccucuaccuaaggaaacccua

SEQ ID NO: 129661 - RNA, 64 nt, Human
uauaacucaacuaaauauugucuauaagaaacuucagugccauggacaugauuuaaacugaaac

SEQ ID NO: 129662 - RNA, 64 nt, Human
guuucuaguugaggaguuuccuaaaaguucauaacagugccauugucuuuauaugaacauagac

SEQ ID NO: 129663 - RNA, 64 nt, Human
gagguuccuguuaaauuuuuaauggcuaauagcccagugccauccaguugaaaaaacaacagca

SEQ ID NO: 129664 - RNA, 64 nt, Human
aggcucgggcuccccagccccaucccaaacccuucagugccaaaaacaacaacaaaaugaaacg

SEQ ID NO: 129665 - RNA, 64 nt, Human
aacaggcuugcccaacauggagggauggcguuggcagugccagccuccccagccugugccaagc

SEQ ID NO: 129666 - RNA, 64 nt, Human
ugaacguccguccucaggagcacagccucacggacagugccaaacccugugggucuccaggggc

SEQ ID NO: 129667 - RNA, 64 nt, Human
gagagcuccaggagccccgugaacccagaccacccagugccauggccacuuagggcugggaacc

SEQ ID NO: 129668 - RNA, 64 nt, Human
uaauuucucaggauauuuuugcacugcugagaagcagugccauuaccaauuaauucuugccagg

SEQ ID NO: 129669 - RNA, 64 nt, Human
agcuacuagaaugcagcuaaggaaagugaaauuucagugccaauuaauuaaaagauacacuguc

SEQ ID NO: 129670 - RNA, 64 nt, Human
uuuaggcuuauuugagcacugccugcccaacugucagugccagugcauagcccuucuuuugucu

SEQ ID NO: 129671 - RNA, 64 nt, Human
uaugacaaucaggaagaaugcaguguucugauaccagugccaucauacacuugugauggauggg

SEQ ID NO: 129672 - RNA, 64 nt, Human
accggugcuggccacaccagcccccuuucaccuccagugccacaauaaaccuguacccagcugu

SEQ ID NO: 129673 - RNA, 64 nt, Human
cuagccaaucagaacuggcuguggaccacccuagcacggccaccucucagggccacuggcaggc

SEQ ID NO: 129674 - RNA, 64 nt, Human
gggcagcaacaacggcaagacucccgugugucaccagugccacaaggucauccgguggguggcc

SEQ ID NO: 129675 - RNA, 64 nt, Human
ccuuucaugaagguaaugcuagucuucuguccaucagugccauuuccuguagaacuaaaggcug

SEQ ID NO: 129676 - RNA, 64 nt, Human
cgugcucucacaaaccccugacucccgcacuuuccagugccaaaguacaaacgcugcuuggaua

SEQ ID NO: 129677 - RNA, 64 nt, Human
gagagagagacaagcaggagcguggcugcucgcucagugccauagccuuaccgcagccugcgcg

SEQ ID NO: 129678 - RNA, 64 nt, Human
uaaucugaauagcaacugucugacuugauaacuccagugccaguauaguggcugcugcauagac

SEQ ID NO: 129679 - RNA, 64 nt, Human
aagugggucccccacgaagauacugcacggagagcagugccaagccuguggaucaggaauauca

SEQ ID NO: 129680 - RNA, 64 nt, Human
uguucaguccaauacaggguuguggggcccuuaacagugccauauuaauugguaucauuauuuc

SEQ ID NO: 129681 - RNA, 64 nt, Human
gcaccugcauggagggguccccagagcccccaaccagugccagcauacucagcguggccgguga

SEQ ID NO: 129682 - RNA, 64 nt, Human
cauuguauucggacagaagcugugacugaagacucagugccaaggaaaggggcuucuugugugu

SEQ ID NO: 129683 - RNA, 64 nt, Human
cauauaauacuaaucuaaacaguacuagaaauuacagugccaagagccaccaggaggcccagcc

SEQ ID NO: 129684 - RNA, 64 nt, Human
ggagguagagcaaugaucagaugggugcacagaccagugccaaucugaacauuguuaauggccu

SEQ ID NO: 129685 - RNA, 64 nt, Human
cacaggggucucucuucauccacugcaacccauccagugccagcuuugagauugcacuugaaga

SEQ ID NO: 129686 - RNA, 64 nt, Human
uaacauaaaauuaacuauuuuaaagugagaaguucagugccacuuaguauuguuaacaauguug

SEQ ID NO: 129687 - RNA, 64 nt, Human
uuggcuccacucuugucacucauguccagaucugcagugccagcuucuccuucucggugacaug

SEQ ID NO: 129688 - RNA, 64 nt, Human
ugcagagaagaggccuggaacucgggcagcacugcagugccaggaggcaggcggggaaccgagg

SEQ ID NO: 129689 - RNA, 64 nt, Human
ggaaagucacuugagacacauucucaguuuguugcagugccaggaaugcugcgcugcugcugcu

SEQ ID NO: 129690 - RNA, 64 nt, Human
gacagaccagggugaggguugugcccagcugggccacggccaugcgugggguggcccaauaaac

SEQ ID NO: 129691 - RNA, 64 nt, Human
agagacaucucuuuuaaaaaagugccagaugccccagugccagagcugcgaacgugaacacagu

SEQ ID NO: 129692 - RNA, 64 nt, Human
uucguucccacaaagaaagcaccucaccccagcacagugccaccccuguucaucugggcugccu

SEQ ID NO: 129693 - RNA, 64 nt, Human
aggccaaaccucuguucaguguaaauaguuacuccagugccaacaauccuagugcuuuccuuuu

SEQ ID NO: 129694 - RNA, 64 nt, Human
acugugcacugugcuuagagacccugccgcaccacagugccaaugcuugucagacacaugcccu

SEQ ID NO: 129695 - RNA, 64 nt, Human
uccuucauggacgagggcauauacaaugaugggacagugccacacuccuucaauaaacguggcu

SEQ ID NO: 129696 - RNA, 64 nt, Human
cuuccugcagcugugccuggaggcagucggccugcagugccagacucugagccaagccacuggg

SEQ ID NO: 129697 - RNA, 64 nt, Human
cucaucuccagcugcagcucggaugguggauuuucagugccaacagacacaucugccgugaacu

SEQ ID NO: 129698 - RNA, 64 nt, Human
uuaaauuucgaccuuguuucugaagcucacuuuucagugccauugaugugagaugugcuggagu

SEQ ID NO: 129699 - RNA, 59 nt, Human
ccaagccagaauucaucuagacccuagggcagugccagugcuaggcugagcaccaucag

SEQ ID NO: 129700 - RNA, 64 nt, Human
cugguuuucugcaugcacggguauacacauaaugcagugccaugcacauagggaagggucagua

SEQ ID NO: 129701 - RNA, 64 nt, Human
auguuggugccauuuucagcaauuacggcuuugacagugccaccucuuugaugccaaaucagca

SEQ ID NO: 129702 - RNA, 64 nt, Human
gccccucaccacauacccuuugccuuuuagaacucagugccauccugggugcccagggcagagc

SEQ ID NO: 129703 - RNA, 64 nt, Human
gccuagcccuguggcuuccaccagucuccuccugcagugccacgugguggcauuucucgccuca

SEQ ID NO: 129704 - RNA, 64 nt, Human
gcucagauuggcacagaauucuuuugugaaauaucagugccacagauuguaacagauagcuuca

SEQ ID NO: 129705 - RNA, 64 nt, Human
cucagcucagcgccagccugucccauggacacuccagugccagcaaugacaucucaggggccag

SEQ ID NO: 129706 - RNA, 64 nt, Human
ccucuuucuccuuggcugcaguggggccuuuauccagugccagggaggaacaacauaguuaauu

SEQ ID NO: 129707 - RNA, 64 nt, Human
acacacugagugaggaguggacgcuguccauugccacggccaugagggcuggagaccagaacag

SEQ ID NO: 129708 - RNA, 64 nt, Human
caucugugccaaacauaggcgcuccuagucuggucagugccaagaggcuaccagaacauggggc

SEQ ID NO: 129709 - RNA, 64 nt, Human
uaaacucuccuuugauauuauguggcuuuuauuucagugccauacauguuauuguuuucaaccu

SEQ ID NO: 129710 - RNA, 64 nt, Human
ucccguuagggacaucacacccugucucacgucgcagugccauggacgcagcaguuacagcacc

SEQ ID NO: 129711 - RNA, 64 nt, Human
ggugugcugcagggugugaugaggugggagcccucagugccagccucaucacugugugacccug

SEQ ID NO: 129712 - RNA, 64 nt, Human
gagacggucucauucugucacccagacuggagugcagugccacaaucauggcucaccgcauuga

SEQ ID NO: 129713 - RNA, 64 nt, Human
ugugaaugccaaagccauucucccccucuuugggcagugccauggauuuccacugcuucuuaug

SEQ ID NO: 129714 - RNA, 64 nt, Human
gcagccagcuuuucagagggaaaagaaguuagaacagugccaaagaaccugggccuaucagcgu

SEQ ID NO: 129715 - RNA, 64 nt, Human
gcacgcuauggcgcacacacacagugcacguccacagugccauaccacggggcaugguggcuca

SEQ ID NO: 129716 - RNA, 64 nt, Human
uauuuuuaccuucccauuaacuggcuucacucaacagugccagauaccuauggagaggggaagu

SEQ ID NO: 129717 - RNA, 64 nt, Human
gcacuuaaaaagggauauuguaaaugaaaggcugcagugccaguuuuaagaaagaauuucugug

SEQ ID NO: 129718 - RNA, 64 nt, Human
uccuucucgggucucuggggccuucuccucccugcagugccaacaugcacugcccacagcagga

SEQ ID NO: 129719 - RNA, 64 nt, Human
ucaaccguggccccucuucagaaccuagaccuaucagugccauuuuuuuuucauaaucuacgaa

SEQ ID NO: 129720 - RNA, 64 nt, Human
aaaaaaaaaaaaaauucuagaccgaaguguacggcagugccaucugguggcaagugguacaaag

SEQ ID NO: 129721 - RNA, 64 nt, Human
ucacugugcugcuuguggcucauggcagagcauucagugccacgguuuaggugaagucgcugca

SEQ ID NO: 129722 - RNA, 64 nt, Human
gaaaaaaacacaaaaacaaaugaaugcauguggccagugccaggugagcugcccuggggguuca

SEQ ID NO: 129723 - RNA, 64 nt, Human
uccacuuugguguucaaggaccugcuuaugcccucagugccaaucggcucuuggugagaugacu

SEQ ID NO: 129724 - RNA, 64 nt, Human
gagagccaggcagccccgaaagaagagccugggccacggccacguauaaaccuccgagggguca

SEQ ID NO: 129725 - RNA, 64 nt, Human
cuggacccacccgcucccuuuuuuccuuagccuucagugccauggaacuaaucaagggaggaaa

SEQ ID NO: 129726 - RNA, 64 nt, Human
uguccagcaagcucgguuugaauacgucacuuaccagugccauugcaggacccaaauucacagu

SEQ ID NO: 129727 - RNA, 64 nt, Human
acaggaucucacuuuuaccgcccaggcuggagugcagugccaugaucacagcucacugcagguu

SEQ ID NO: 129728 - RNA, 64 nt, Human
agugaagucaccccguguccuuuuugcuugcucucagugccaugccgaugguauguugcuguug

SEQ ID NO: 129729 - RNA, 64 nt, Human
cacauaauggaaacuucuuucuucuaaaaguugccagugccacuuuuaagaagugaaucacuau

SEQ ID NO: 129730 - RNA, 64 nt, Human
uuuaaagcauucuuucuagguuauuuuggggggacagugccaaguccaucuuugcccagucaau

SEQ ID NO: 129731 - RNA, 64 nt, Human
gcauguuuaucauauauccuuaaguggacacauacagugccauguugaugugccucucaguuuu

SEQ ID NO: 129732 - RNA, 64 nt, Human
ggcacggcuggccuggacccugccccuggcacggcagugccagcuguacuuccccucucucuug

SEQ ID NO: 129733 - RNA, 64 nt, Human
cuugcccgggcugaggucagcacugcagcccaaacagugccaacagcccuguccccacaggacc

SEQ ID NO: 129734 - RNA, 64 nt, Human
cacucuguuccccucccccuuaagccaacaaccacagugccaccaagcucacaccuguccuucu

SEQ ID NO: 129735 - RNA, 64 nt, Human
caaauugugcucugcaguucugcagauuuucuagcagugccaucuccaaaauguguuuuaaacu

SEQ ID NO: 129736 - RNA, 64 nt, Human
gucuaggacugggcuucuacccucagugcaagaccagugccagaugugcccccacuuccugccu

SEQ ID NO: 129737 - RNA, 64 nt, Human
uauaacuguuuauuuaccuaauuaaaaggaaaggcagugccaaauaugagaggauaaacaauau

SEQ ID NO: 129738 - RNA, 64 nt, Human
ucaggccuacagcgacguggaacacacuucaguccagugccaugccuuagauggaauugagugu

SEQ ID NO: 129739 - RNA, 64 nt, Human
cacccagcaugcgccacgccguggcucccaccagcagugccaccgccaccacaccccagauccc

SEQ ID NO: 129740 - RNA, 64 nt, Human
gcuggguauuugcuuaguguauucaucaaaucuucagugccaguuuccuugagaagcagcuuuc

SEQ ID NO: 129741 - RNA, 64 nt, Human
aaugggccggcgauugggaccagcugggccccaccacggccacgccaggcaaagcgccagcagc

SEQ ID NO: 129742 - RNA, 64 nt, Human
uucuaaucugugacgaggggcaucguuugaagaacagugccauuaagacaacuacagcccucau

SEQ ID NO: 129743 - RNA, 64 nt, Human
ggacacccuguaagaacagagcacacuugcuggacagugccaguuccagaugggcugaccggcu

SEQ ID NO: 129744 - RNA, 64 nt, Human
cccuuucucuccacucgacacagccugcgguuugcagugccagcugcacguuggagucuccugg

SEQ ID NO: 129745 - RNA, 64 nt, Human
aagccacaaugcccuugugccuuuuaauauaccacagugccaguuaaacuaauauuuuuguuug

SEQ ID NO: 129746 - RNA, 64 nt, Human
gaacaccauugagggagcugggagacccuccccacagugccacccaugcagcugcuccccaggc

SEQ ID NO: 129747 - RNA, 64 nt, Human
uuuguuuccccaccgccugcggcauggguguguccagugccaccgcuggccuccgcugcuucca

SEQ ID NO: 129748 - RNA, 64 nt, Human
caaggcugcagggccucuuucggguuuccuuggacagugccauggcuccagugcucugguguca

SEQ ID NO: 129749 - RNA, 64 nt, Human
ggaggacgauggugaggagauccuguuggacacccagugccaggggcugccucgcccggaaccc

SEQ ID NO: 129750 - RNA, 64 nt, Human
ugggccacagaucaagaaagcauuugaucugacccagugccagacacaggggauuuaaggcaug

SEQ ID NO: 129751 - RNA, 64 nt, Human
gaguaccuauuuaugugggccuucaguggaugggcagugccacucaggucucugggguuucccu

SEQ ID NO: 129752 - RNA, 64 nt, Human
cugaaacuacuaggauccuguguguguucaaacucagugccauuaacaaacccaaagugaagcg

SEQ ID NO: 129753 - RNA, 64 nt, Human
auugugugaccagggcuagucacuuuuuacuucucagugccaucuauaaaauggggauaauagc

SEQ ID NO: 129754 - RNA, 64 nt, Human
agggagaggacccucagugucauaucaggaagcccagugccagaggacagacagguucaaaacu

SEQ ID NO: 129755 - RNA, 56 nt, Human
aguggcugaaggaggaaugauggagacagugccaggcccaagaacuagaacuuuaa

SEQ ID NO: 129756 - RNA, 64 nt, Human
ucacgucuuccccuggauuugcuuaguacucagccagugccacaguuugaagauucucauuaaa

SEQ ID NO: 129757 - RNA, 64 nt, Human
uugggagggacgcauagaaggagcucuaggaacacagugccagugcagaaguuucuccaggugg

SEQ ID NO: 129758 - RNA, 64 nt, Human
uggcccguucuuauagaugauuuuguagaauaugcacggccaguagucacagguggaaaacgca

SEQ ID NO: 129759 - RNA, 64 nt, Human
uuggauugauguuuauacccucugaauuggagggcagugccagggcauuugcagaagcugggaa

SEQ ID NO: 129760 - RNA, 64 nt, Human
ucgcaggaguccccaucuguagcacaggcaaugccagugccaugcugcagccucagaaaccagg

SEQ ID NO: 129761 - RNA, 64 nt, Human
ggaaccagaggacuagcugacuuuugccaaggagcagugccaacgggcauggcauggugcccug

SEQ ID NO: 129762 - RNA, 64 nt, Human
ugcuggcccagggccacaccaagccacccgagcgcagugccacaggcgccaagagcaaguaccu

SEQ ID NO: 129763 - RNA, 64 nt, Human
agacacuuccaggucuugugguggggacgccucucagugccagucccgccacugcugagugagc

SEQ ID NO: 129764 - RNA, 64 nt, Human
gccugcaucugucuguccuuccuuccauugcucccagugccaaacuugggccgcugcaccgcgg

SEQ ID NO: 129765 - RNA, 64 nt, Human
gcugccaguguucgcccuagaguuauuacaaagccagugccaaaacccagccaugggcucuuug

SEQ ID NO: 129766 - RNA, 64 nt, Human
ccucugcccccauccccuggcucuccccugggcacagugccacucccuuggaagggagggaacc

SEQ ID NO: 129767 - RNA, 64 nt, Human
cuacuccgccuuuguccuuaagguuuuugcaggccagugccaaacacacacuaacuguccuggc

SEQ ID NO: 129768 - RNA, 64 nt, Human
cgcugccgaaucccugggaaaaauucuuuucccccagugccagccggacugcccucgccuuccg

SEQ ID NO: 129769 - RNA, 64 nt, Human
ucuuguuacuacccacuucauuccccaccgcugccagugccacugccaacccuguucacaggcg

SEQ ID NO: 129770 - RNA, 64 nt, Human
ugagacaagggaggcaggggacuuaugcaucccucagugccaucccuuguauccuggaauagcu

SEQ ID NO: 129771 - RNA, 64 nt, Human
cacaaauaaaaggacaagugugaggaagacugcgcagugccaccccgcagcccaguggggugcc

SEQ ID NO: 129772 - RNA, 64 nt, Human
aaguuguauaucugagguguaccaguggugaagucagugccacaucugcacuggcccccaaggu

SEQ ID NO: 129773 - RNA, 64 nt, Human
ccauugaaggauucaggaagaagaaaacucaacucagugccauuuuacgaauauaugcguuuau

SEQ ID NO: 129774 - RNA, 64 nt, Human
ggcagccccuguuuucugcuguuuacaacaucaccagugccacgucaugagcgucaaagaaaau

SEQ ID NO: 129775 - RNA, 64 nt, Human
agagugcuucccuuccauuaagcugaaauugccccacggccauauccacccauugacucugccu

SEQ ID NO: 129776 - RNA, 64 nt, Human
agagucaugcauauuuucucauaaauggcuucuucagugccauuguuauauguuuuuuauuucu

SEQ ID NO: 129777 - RNA, 64 nt, Human
guaugcacacugacuuuaagcuucauaaaaccaucagugccaagaaauucucuuuguaguaauu

SEQ ID NO: 129778 - RNA, 64 nt, Human
ccugggcccuagcccuuuccugcccugcagucugcagugccagcacgcaaaucccuucaccaca

SEQ ID NO: 129779 - RNA, 64 nt, Human
cccucagcucugccucugcagcccacugccugcccagugccaucaggaugagcaguaccggcca

SEQ ID NO: 129780 - RNA, 64 nt, Human
ugguggcucacuucugcccaccugccggcaacaccagugccaggaaaaggccaaaagaaugucu

SEQ ID NO: 129781 - RNA, 64 nt, Human
ccuuguauaaagugacaaaucggggcucuuguaucagugccagcuguaauguuuuuaaaugcag

SEQ ID NO: 129782 - RNA, 64 nt, Human
cugaggcaccugaugcauucagccugcugugcagcagugccauugacugcccugauguucagag

SEQ ID NO: 129783 - RNA, 64 nt, Human
cccuucacagagucccaacucagaggaaaagggccagugccaaggggcaccaagaaccugcuca

SEQ ID NO: 129784 - RNA, 64 nt, Human
ugcacuccaagcugcuggcauucuacucuagccacagugccagcucccugcgcccggccgaccu

SEQ ID NO: 129785 - RNA, 56 nt, Human
ugcagagaggcccugccugaaacccacagugccaggcaacccuucagaaaggcuuu

SEQ ID NO: 129786 - RNA, 64 nt, Human
ucuucguggccauccugcagaugagcaccguguccagugccacagcacaaggcgccuccccgcc

SEQ ID NO: 129787 - RNA, 64 nt, Human
acaacgcaugucugugaccuuugguaaucauuuacagugccacacggaacccuguauuuugcac

SEQ ID NO: 129788 - RNA, 64 nt, Human
gacagagucucacucugucgcgccagcuggagugcagugccaugaucucaggucgcuguaaccu

SEQ ID NO: 129789 - RNA, 64 nt, Human
cagccccgcccucugcgucccccagcccucaggccagugccaggacagcuggcugcugacagga

SEQ ID NO: 129790 - RNA, 64 nt, Human
uuccuuuccacuggcugucaagcccacagggcaccagugccacccagggcccggcacaaagggg

SEQ ID NO: 129791 - RNA, 64 nt, Human
ugacccuucuccaaaggcucuguuaucagcugggcagugccagccaaucccuggccauuuggcc

SEQ ID NO: 129792 - RNA, 64 nt, Human
cauuuccuccaggaggaaaggcaagacacgcuuacacggccauuugucucuuuucccaaugcgg

SEQ ID NO: 129793 - RNA, 64 nt, Human
guggaggagcugggccucccacagggugcccgggcagugccauccuggugggggagggcagccu

SEQ ID NO: 129794 - RNA, 64 nt, Human
agccccaagggcuggggcggagcuggggucugggcagugccacagccugcuggcagggccaggg

SEQ ID NO: 129795 - RNA, 64 nt, Human
agagggggaaguggugaccagacacugcccacugcagugccaagacggcagcaggacuggggcu

SEQ ID NO: 129796 - RNA, 64 nt, Human
gggcacauguggcccuugccuucugagcagcucccagugccagggcuuugagacuuucccacau

SEQ ID NO: 129797 - RNA, 64 nt, Human
uguaugccaauguagagaagaucauuuauauuugcagugccauccuuaagucauuuuuaacauu

SEQ ID NO: 129798 - RNA, 64 nt, Human
ggcaugcuggugguggcgggugcuggugggaggacagugccaaccuccuccuggggaucccaug

SEQ ID NO: 129799 - RNA, 64 nt, Human
ucaacuuggacaaccugcagucccuguccucagacagugccaccauggccaugcagcaggcuau

SEQ ID NO: 129800 - RNA, 64 nt, Human
cccugggaaaaggcuguggccucagggcgccucccagugccagaaaauaaaguccuuuuggauu

SEQ ID NO: 129801 - RNA, 64 nt, Human
ccagagcccguccagaggccaccaggagcugagacagugccaccaccagcaccucccacaagcc

SEQ ID NO: 129802 - RNA, 64 nt, Human
gucuuuuucucccucaaaaaaauagguuaaguuucagugccagcuagaaaauacugcuuucugc

SEQ ID NO: 129803 - RNA, 64 nt, Human
cuuaaugguagcaacugaaagaagacauccugagcagugccagcuuucuucuguugaugccguu

SEQ ID NO: 129804 - RNA, 64 nt, Human
ugaaguggacucuugcuuccccuaguaguguuuucagugccaagaagcugaaacugugagcugg

SEQ ID NO: 129805 - RNA, 64 nt, Human
cuagaaguuguacauauucagaguuuuccauuggcagugccaguuucuagccaauagacuuguc

SEQ ID NO: 129806 - RNA, 64 nt, Human
ucccugggccuacaguugguauuaccucugugcucagugccaggcaaaacacuagcucaaagga

SEQ ID NO: 129807 - RNA, 64 nt, Human
guuucuaagggaggcacuuccuccccucgcccaucagugccagccccugcuggcuggugccuga

SEQ ID NO: 129808 - RNA, 64 nt, Human
cacaaacuaugggauccaaggggcagucuugcaacagugccauguuaggguuauguuuuuagga

SEQ ID NO: 129809 - RNA, 64 nt, Human
acaaucagaaccagccaaagaagcacuuccugggcacggccaccagcucucccgccuccagugu

SEQ ID NO: 129810 - RNA, 64 nt, Human
uaggauuucuaagacuacuauaggaauugguuggcagugccagcuggcucuuuuuuuuaauauu

SEQ ID NO: 129811 - RNA, 64 nt, Human
uuuugcuugggauaauggaguuuuucuuuagaaacagugccaagaaugacaagauauuaaaaaa

SEQ ID NO: 129812 - RNA, 64 nt, Human
auggagacucugagagcgaauuguguggagaacucagugccacaccucgaacugguuguagugg

SEQ ID NO: 129813 - RNA, 64 nt, Human
uuugacaggucugaagaacuguugcccaauucaacagugccagcauuccaacuuuguuaaaccu

SEQ ID NO: 129814 - RNA, 64 nt, Human
cuuggacugaauagugacacucgguaaggauuuucagugccauuuagcaaaacgucuuuagucu

SEQ ID NO: 129815 - RNA, 64 nt, Human
guggggggccacuagucuaacagacggucacaaccagugccauggaaaaccaaggauauuagca

SEQ ID NO: 129816 - RNA, 64 nt, Human
cuuaauuccacgggaccaucugcugaacauuccccagugccauggccaguugccaggccccagc

SEQ ID NO: 129817 - RNA, 64 nt, Human
acacacucgcuguguccccucuccuccccugugccagugccaccugggugccuccuccuguccu

SEQ ID NO: 129818 - RNA, 53 nt, Human
auuuggaagaugacugcugauuccagugccacagaugaacccacaaggacaua

SEQ ID NO: 129819 - RNA, 64 nt, Human
uggcagagacacuuugucuaguguauucucuucacagugccaggaaagagugguuucugcgugu

SEQ ID NO: 129820 - RNA, 64 nt, Human
ucagcucagggguuguugaacagaugugaaaggccagugccaagagugucccucugagacccuu

SEQ ID NO: 129821 - RNA, 64 nt, Human
ucuacaauguucuagaaauucucacucagguacacagugccaacaaguggcuugugaauguguu

SEQ ID NO: 129822 - RNA, 64 nt, Human
aucuguaaauuuuuaaccuauguuacaccaucuucagugccagucuugggcaaaauugugcaag

SEQ ID NO: 129823 - RNA, 64 nt, Human
ggagggccuguccacacccuggauccccguaccacagugccagccaugcccuuccccugggcua

SEQ ID NO: 129824 - RNA, 64 nt, Human
caggugccaaagagcaggccggccagggcuggggcagugccagacucugaucugaggaccccgu

SEQ ID NO: 129825 - RNA, 64 nt, Human
aacugugaaagagagguuccagggguaucucccucagugccaguuacuuagugauguguuaccc

SEQ ID NO: 129826 - RNA, 64 nt, Human
cccgcgaggaccaggcaucgcugugugaggacggcacggccagcgccugcugugagugggucuc

SEQ ID NO: 129827 - RNA, 64 nt, Human
gucaggcccugauguccuggggauuucuuguccucagugccacccggccucccgucuuuccuga

SEQ ID NO: 129828 - RNA, 64 nt, Human
ggaccggccagacuucuaagccaggcugggcugccagugccaugcaagccacagccagccagcc

SEQ ID NO: 129829 - RNA, 64 nt, Human
agaggccugguggagccauaaccucucccacagccagugccaaguccucccccugcccauucuc

SEQ ID NO: 129830 - RNA, 64 nt, Human
auagaaugguaaaaaaaaaaaaaauuuuaagugacagugccauaguuuggacaguaccuuucaa

SEQ ID NO: 129831 - RNA, 64 nt, Human
uuucuuuuguacuugaauauacaaaacaugaacacagugccauaugaauaauuucacauacaga

SEQ ID NO: 129832 - RNA, 64 nt, Human
acugcugcucccuccugcuaugaaacgacacugccagugccagcaguguccuugggaaaggcaa

SEQ ID NO: 129833 - RNA, 64 nt, Human
ucgauguucuuuccaugauggggauggagguguucagugccaccguggcuguuacuuuucaaag

SEQ ID NO: 129834 - RNA, 64 nt, Human
aaugggggugauaauugugccuaccucagauagacagugccagaauuaagugagucaagccaag

SEQ ID NO: 129835 - RNA, 64 nt, Human
uggccagagcgagcaacacggcggaggagaccaucagugccaugaagacuguccggagcuucgc

SEQ ID NO: 129836 - RNA, 64 nt, Human
ggguagucccacauacuaaagauugucucacccgcagugccaauaacacuccuaagaaauguug

SEQ ID NO: 129837 - RNA, 64 nt, Human
accgcaugcuuccucauccacauagugccagcagcagugccacgcaguuccuccucucccuccc

SEQ ID NO: 129838 - RNA, 64 nt, Human
ggucuccccaucaccggccgccucguggagaaggcagugccacgugggaggacaaggccacgcc

SEQ ID NO: 129839 - RNA, 64 nt, Human
gugaggaccaucaggagcuucauauuucaauaaccagugccaaauucugaaugccagaugggau

SEQ ID NO: 129840 - RNA, 64 nt, Human
gcaccccuggcccccaggacuuccugcgcugugucagugccaucaucaucuuccugguggucuc

SEQ ID NO: 129841 - RNA, 64 nt, Human
uuguucuuucucauguaucucguguuuaugugcacagugccaaaagaagacugacuggguggag

SEQ ID NO: 129842 - RNA, 64 nt, Human
ccuaccagugaggcucccagagacgcagcugucucagugccaggggcagauugggugugaccuc

SEQ ID NO: 129843 - RNA, 64 nt, Human
uggacggcagccaggauggagcacccaugggucucacggccaugcuucagggucuucagguccu

SEQ ID NO: 129844 - RNA, 64 nt, Human
agagguccagaguccuggcccuugaugcccagcucagugccacaaagcucaauaggagggaugu

SEQ ID NO: 129845 - RNA, 64 nt, Human
ugugaaaaggaauggcaaugguguucaccaucggcagugccagggcagcacucauucacuugau

SEQ ID NO: 129846 - RNA, 64 nt, Human
cugcagccugcaggcaccagccgggccauaugcccagugccagcuagggcccaccgcccauccu

SEQ ID NO: 129847 - RNA, 64 nt, Human
gccaaaaagggcuggcagcugucucuggagggcccagugccacuccucuggggugaccuuucug

SEQ ID NO: 129848 - RNA, 64 nt, Human
cccacaugacuagcacgcugagcucugcagggaccagugccaggcacugggggguggaagugug

SEQ ID NO: 129849 - RNA, 64 nt, Human
uauacuucuucuucugugucccuaaggccugguacagugccaagcacauacuugguauccaaua

SEQ ID NO: 129850 - RNA, 64 nt, Human
caaaacagccacaauaaucagagauggagcaaaccagugccauccagucuuuaugcaaaugaaa

SEQ ID NO: 129851 - RNA, 54 nt, Human
ugggccucccaauagacuaacaggcagugccaguuggacccaagagaagacugc

SEQ ID NO: 129852 - RNA, 64 nt, Human
uaacucuuaccuaaacugagcugaauguuuguuucagugccauauggaauaacaacuuucagug

SEQ ID NO: 129853 - RNA, 64 nt, Human
ugcuccccagcaaacggugccucccaggcauucucagugccagggcuucaucccugugaaggca

SEQ ID NO: 129854 - RNA, 64 nt, Human
caggggccagggagcuggagauggccuccagcgucagugccaagacugagcgggcccuccagug

SEQ ID NO: 129855 - RNA, 57 nt, Human
aacauaaagcugcuggaugaaaugguccagugccaaaaugagcuuaaaaucuuuguu

SEQ ID NO: 129856 - RNA, 64 nt, Human
caccucauuccccauuaagucaugggcauauccccagugccauuguucuuccaaaugcuaccca

SEQ ID NO: 129857 - RNA, 64 nt, Human
cagcauacagccaacaucuauggugucccaggcacagugccaggccccgggaguggggaccaag

SEQ ID NO: 129858 - RNA, 64 nt, Human
ggagaguccuucaccguauaugaaagccagggggcagugccaaacacgcggcaccaggagaugg

SEQ ID NO: 129859 - RNA, 64 nt, Human
ugaagaacaccagcauccgaguggcugacuuuggcagugccacauuugaccaugagcaccacac

SEQ ID NO: 129860 - RNA, 64 nt, Human
cugcuucuccucuuguuucugccuuaauaauucccacggccacaggcaaggggguugcaguggc

SEQ ID NO: 129861 - RNA, 64 nt, Human
gaguagcugcggccagagugaggcuccugcuguacagugccacccauacugugaugucgaugcc

SEQ ID NO: 129862 - RNA, 64 nt, Human
agguggagaaaucacagagagguaaaauggaggccagugccauuucagaggggaggcucaggaa

SEQ ID NO: 129863 - RNA, 64 nt, Human
agaucagggagagaaggcccuuggucagagugggcagugccaggcucugcuuuggguugugagu

SEQ ID NO: 129864 - RNA, 64 nt, Human
ucaagggcagcaagaaggccaucaagguguucuccagugccaaguacccugcuccagagcgccu

SEQ ID NO: 129865 - RNA, 64 nt, Human
ucuguggagaaggugcuggggagggaaguccuuccagugccacauggagugaggcccugcccau

SEQ ID NO: 129866 - RNA, 64 nt, Human
uccucccgcaggugagaacccuguggagaugagucagugccaugacugagaaggaaccgacccc

SEQ ID NO: 129867 - RNA, 64 nt, Human
cagaaagcuguaacacuuaugacaacaauucuugcagugccagaggcccauuuacaaauucuca

SEQ ID NO: 129868 - RNA, 64 nt, Human
acuccaaaauaaaggcaaugauuuauuuuuuucccagugccaauacaauuuugagcuaagcacu

SEQ ID NO: 129869 - RNA, 64 nt, Human
gguggcuucagaagugaucuuggcucgcaggcaccagugccaccuaccaagcugugaaacuaaa

SEQ ID NO: 129870 - RNA, 64 nt, Human
uacaaagugaucuuguucacaaguaaucuguugacagugccaauaaaugauaaaaaaaaaauua

SEQ ID NO: 129871 - RNA, 64 nt, Human
uaugccaggcaugugcagucuggacuuccaccuccagugccagaaacuuccagaaggaaggaga

SEQ ID NO: 129872 - RNA, 64 nt, Human
cugacaggcaaugcuggcuguuggcugggggccucagugccacuacggaauaguuggcuaggac

SEQ ID NO: 129873 - RNA, 64 nt, Human
auuucugcuagguaauuaaccauuucgacucgagcagugccacuuuaaaaaucuuuugucagaa

SEQ ID NO: 129874 - RNA, 64 nt, Human
agucagcuuucaccauuuuauauacaaaggggaccagugccacagaaggguacccgaagaaaug

SEQ ID NO: 129875 - RNA, 64 nt, Human
aacacccucuccugguggcaggccacuucccucccagugccagucuccauccaccccagagagg

SEQ ID NO: 129876 - RNA, 64 nt, Human
gaacccgggagguggaggcugcagugaacagagacagugccacugcacaucagccugagugaca

SEQ ID NO: 129877 - RNA, 64 nt, Human
caaggugggaaccacgucugcuaacuuggagccccagugccaagcacagugccugcauguauuu

SEQ ID NO: 129878 - RNA, 64 nt, Human
cguguggagcacguggagauagugccagguggcucagugccaccuaugccuguggugaagugug

SEQ ID NO: 129879 - RNA, 64 nt, Human
ugcccgccuuggcggcuuaagccugcugcuuuggcagugccaugggugagccgagcagcuguga

SEQ ID NO: 129880 - RNA, 64 nt, Human
ggguaguaccuguggagccgggaagggucuccugcagugccauucugccuucucaaugagcaaa

SEQ ID NO: 129881 - RNA, 64 nt, Human
ggauaauaccuuuaucucuggccacucaaaaaugcagugccaggagugcuaaaccuagaggcca

SEQ ID NO: 129882 - RNA, 64 nt, Human
gacagggugucguucugucgcccaggcuggagugcagugccaccaucauagcucacugcagccu

SEQ ID NO: 129883 - RNA, 64 nt, Human
gacggggccuugcugugucccccaggcgggaauacagugccaugaucauagcucacugcagccu

SEQ ID NO: 129884 - RNA, 64 nt, Human
cguccccuacucauacccaccacagagcaccagccagugccaacgccaggcugcuauuuaucuc

SEQ ID NO: 129885 - RNA, 64 nt, Human
gggggauguuggccucucccaggcuccucuucugcagugccagcugacuuaagggagugaacua

SEQ ID NO: 129886 - RNA, 64 nt, Human
cucauggggcagaauugccaaggacagcucacgacagugccaccuucucaccauuccagccaag

SEQ ID NO: 129887 - RNA, 64 nt, Human
uuuugaagggucauauaaaaauaagguaacaccacagugccacuacaccuucuggggcuggacu

SEQ ID NO: 129888 - RNA, 64 nt, Human
cugagaaguucgugugacacccucagccaagggacagugccauccuuggggacaggaggaaaag

SEQ ID NO: 129889 - RNA, 64 nt, Human
ucaggcccgccccaggagccuccagcugccuaaccagugccauucuuucacaacacgauuuucu

SEQ ID NO: 129890 - RNA, 64 nt, Human
guccuuggcagagaugacaggcacacagcuugugcagugccagaauaucauuagcguuucccuu

SEQ ID NO: 129891 - RNA, 64 nt, Human
ugccccuuaaauuucugcccugagcccuccacgucagugccaucggucuagaaccacuaacccc

SEQ ID NO: 129892 - RNA, 64 nt, Human
auguagagagugugacauagaccugcauauuugucagugccaugauggaagaagcugagcaugu

SEQ ID NO: 129893 - RNA, 64 nt, Human
caccaggcagggcaaggagacuccgcucacuccccacggccagcgugggcacaggacugacccu

SEQ ID NO: 129894 - RNA, 56 nt, Human
ggagaagugcauugaugugagaggagcagugccaaucgggcagaaguuugcaaaua

SEQ ID NO: 129895 - RNA, 64 nt, Human
uauugacugugugugugugugaaaacagacauuccagugccacccaaauauauaucuguaacgu

SEQ ID NO: 129896 - RNA, 64 nt, Human
aaaaaaaaaagugucuuguucacugcagcaugcccagugccacgcacaggugcugaccuauagu

SEQ ID NO: 129897 - RNA, 64 nt, Human
cccgccagccagggccuaaagcagauggcaugcucagugccaggcugguagcugggccuguuug

SEQ ID NO: 129898 - RNA, 64 nt, Human
uuccacuccccucccugccagagucugucuuggccagugccagccucgaugcuuugguuuugac

SEQ ID NO: 129899 - RNA, 64 nt, Human
gagccggcgucugaaaggcccccgggaccugcugcagugccagaggggccucuggagcaggccu

SEQ ID NO: 129900 - RNA, 64 nt, Human
ugggaggccccugguggcauggaagagggagggucagugccaagucucaggaggagggcgcaug

SEQ ID NO: 129901 - RNA, 64 nt, Human
gcaaaaacacuggcauaugaccaugcaagacugucagugccaacaaagacaacacuaaucagca

SEQ ID NO: 129902 - RNA, 64 nt, Human
gcauccuggggcuggcagcaccuucccggcucaccagugccaccugcgggggagggacggggca

SEQ ID NO: 129903 - RNA, 64 nt, Human
cgagacucugauggaaugugccaccuguccggcccagugccagcuccagugccgcuccugcuuc

SEQ ID NO: 129904 - RNA, 64 nt, Human
gggcagugucugggccgaagcacgucccaccacacagugccagagccagagaaggggccccacc

SEQ ID NO: 129905 - RNA, 55 nt, Human
gccagcggcuuggagguuaaagcagcagugccaauaaugagacccagcugggaag

SEQ ID NO: 129906 - RNA, 64 nt, Human
cucuaccuccccaucaacagcugcagggggaccccagugccaacuuccucucccacuagggccc

SEQ ID NO: 129907 - RNA, 64 nt, Human
guacucaggugacaccaccugcuccagccacguccagugccacaguccccaguagccucaagca

SEQ ID NO: 129908 - RNA, 64 nt, Human
ggagagaaaagagggccacguaacugagagcuuacagugccaaugccguuuguguucuggccag

SEQ ID NO: 129909 - RNA, 64 nt, Human
agaaagagagagaaugaaugcaguugcauugauucagugccaaggucacuuccagaauucagag

SEQ ID NO: 129910 - RNA, 64 nt, Human
aacuuggagacucaccgcagaggccacgugaacccacggccacagagaggcaggacggcagagc

SEQ ID NO: 129911 - RNA, 64 nt, Human
ggcccacccagugccuuuccuuggcccucacugccagugccaaaccgccccucagcagggcagg

SEQ ID NO: 129912 - RNA, 64 nt, Human
caauggcauauuuuuagucaagguacacagauggcagugccauaagcaagucuauaaauaucgg

SEQ ID NO: 129913 - RNA, 64 nt, Human
ugcugcggucucuccuccccuuucccuccaggcccagugccagcacccuccugaaccacucuuu

SEQ ID NO: 129914 - RNA, 64 nt, Human
uaaauuauucuacuuuccaaacugaauucuccugcagugccaaguaucaaagguguccuuaaau

SEQ ID NO: 129915 - RNA, 64 nt, Human
uggcaagaccacgcccagcaaaaguggucggcugcagugccaggaccacccuugccugcagccu

SEQ ID NO: 129916 - RNA, 64 nt, Human
gacccuggaccuccugagggaaacauggaaaaagcagugccaugagugauacaguguuuccuug

SEQ ID NO: 129917 - RNA, 64 nt, Human
ggccacuggccuggcgccuguucccccaggcucucagugccaccacccccggcaggccuucccu

SEQ ID NO: 129918 - RNA, 64 nt, Human
ccuuggagcaggucgggagaguagaguacauaaucagugccacacagaggcagggcgugucuga

SEQ ID NO: 129919 - RNA, 64 nt, Human
uugaaggguccugccggugggacccuguccggcccagugccacugccccccgaggcugcuagau

SEQ ID NO: 129920 - RNA, 64 nt, Human
cugucacauaugcagguucguuuucauucuagggcagugccaggaaguauauugauagcuuugu

SEQ ID NO: 129921 - RNA, 64 nt, Human
ucacaccagauuguucccaggggccugcccaccccagugccauccaguggcacggccgggucuu

SEQ ID NO: 129922 - RNA, 64 nt, Human
uuguuguuguugcuguuuuugguguuuugcuuuucagugccaacucagcacauuguauaugauu

SEQ ID NO: 129923 - RNA, 64 nt, Human
guuaugggaagaacuuaagcauauacuguguaaacagugccauacauuucuaaaaucccaagug

SEQ ID NO: 129924 - RNA, 64 nt, Human
agguuuuugaaugacuguauauuuggcaguuaagcagugccacacuacaggguagauaugguaa

SEQ ID NO: 129925 - RNA, 64 nt, Human
agcaguuuacagacuugugucuuguaucauuuuccagugccaggguucugaaauucauucagaa

SEQ ID NO: 129926 - RNA, 64 nt, Human
cuucuuauugucuggaaugaaucccuuaccaacucagugccagcaucgguagacaccagucagu

SEQ ID NO: 129927 - RNA, 64 nt, Human
aggggcucgaagacugguuucuagcacuaccggucacggccaugucguccuagaaggguccaga

SEQ ID NO: 129928 - RNA, 64 nt, Human
ggugggcggcacagccuucuccacuggccggagucagugccagguccuugcccuuuguggaaag

SEQ ID NO: 129929 - RNA, 64 nt, Human
uauuuaucucugcuccuucuugccuggaggagggcagugccagcccugggguucugggauucca

SEQ ID NO: 129930 - RNA, 64 nt, Human
augcaccucugagugccuucuuccccaaaaccagcagugccauaccugcugucagcaagggugu

SEQ ID NO: 129931 - RNA, 64 nt, Human
cugaugguuuggggcaccagcuauacaucagccccagugccagaccuucuauucauuauuuuac

SEQ ID NO: 129932 - RNA, 64 nt, Human
cugucucuccagagccauccuucagaguggaccucagugccaguccugccucagcaucuggguc

SEQ ID NO: 129933 - RNA, 64 nt, Human
uguguaugggcagauaugaccugacagcccccuccagugccacaggguacgcacacgcagagcc

SEQ ID NO: 129934 - RNA, 64 nt, Human
cugcccaccucagccuccagaguagcuggaaauacagugccacccagauagccucacaaaacuu

SEQ ID NO: 129935 - RNA, 64 nt, Human
gugacccugggugaguggcuuccucucucugggccagugccagaugugacauugaauuuguguu

SEQ ID NO: 129936 - RNA, 64 nt, Human
cgugcccuaggccgggggccccccgaugccuuggcagugccagccacgggaaccaggagcgaga

SEQ ID NO: 129937 - RNA, 64 nt, Human
ggcgccuggucaccuggggugcacacaggucacacagugccaagaggccccagggcccagggac

SEQ ID NO: 129938 - RNA, 64 nt, Human
cccaaguuguucuggccacaccuucuuuguggcucagugccaaugugucccacagaacuuccca

SEQ ID NO: 129939 - RNA, 64 nt, Human
cggccagaucccuggagcuggccuccuuccagcccagugccagaaaccagcacuccaugaagau

SEQ ID NO: 129940 - RNA, 64 nt, Human
gcagugacaucauccagggagacacacaaggucccagugccauugccuuuaucucauauucuuc

SEQ ID NO: 129941 - RNA, 64 nt, Human
uuguguuguccucauuaggacaucaugucuuugucagugccauguccacaguaucugccauacu

SEQ ID NO: 129942 - RNA, 64 nt, Human
uuccccucggcuguguagggacaaagccgaagcccagugccaugacugcccgcggauugaaaaa

SEQ ID NO: 129943 - RNA, 64 nt, Human
acacgcugauggcagucacagggggccugugucacagugccaucuccagacucaaggacuccca

SEQ ID NO: 129944 - RNA, 64 nt, Human
cccacguccagguggcagggaaagccgagcggcccacggccaggucggagcaguacuugacccu

SEQ ID NO: 129945 - RNA, 64 nt, Human
gccgcggauaaauuauucccuccccgacccagcccagugccaccucuaucuguguacauacucc

SEQ ID NO: 129946 - RNA, 64 nt, Human
uguugauguuuccugcccaaaggacacauuugggcagugccacccacuccuugggccccuagga

SEQ ID NO: 129947 - RNA, 64 nt, Human
cuccccugacaaucuggaagguuccuuuugcccucagugccagccaauccgggcaggacccucg

SEQ ID NO: 129948 - RNA, 64 nt, Human
gggacacauaugugucaauucaguuuccuuagaccagugccaguguggaggauuaauugaaaac

SEQ ID NO: 129949 - RNA, 64 nt, Human
gaugcugcagcagggcgaggccaugcgcugcccccagugccagaucgugguacagaagaaggac

SEQ ID NO: 129950 - RNA, 64 nt, Human
gccguggcucagccccggguagcaccuguaguuucagugccacucuccacuguccccuugugga

SEQ ID NO: 129951 - RNA, 56 nt, Human
uugaaggaugcccuguguagauuauucagugccacaaauugaaagcuuccauguuu

SEQ ID NO: 129952 - RNA, 64 nt, Human
caagggccaggcuccauucucccucccuuuccaccagugccacagccucgucuggaaaaaggac

SEQ ID NO: 129953 - RNA, 64 nt, Human
cgacaaagcacagcuccagcucggacagcacccucagugccagccagccucugccagaccucuc

SEQ ID NO: 129954 - RNA, 64 nt, Human
gcagcaggcgccuccucccccaacgcaucccagccagugccauguccucugcagguggaguuac

SEQ ID NO: 129955 - RNA, 64 nt, Human
ggaugcugugaccucccuucuacggagaugcaggcagugccacgagggaggaggggaccugcaa

SEQ ID NO: 129956 - RNA, 64 nt, Human
cauuaacuuuccccagcucggccucugucgggaccagugccagguggacagccaguguccuggc

SEQ ID NO: 129957 - RNA, 64 nt, Human
ugcccugaggacuagggcucccguccugcuuuggcagugccauguaaauccccacugggaccaa

SEQ ID NO: 129958 - RNA, 64 nt, Human
gagggcgccccgccgcgcagagaccagagcuccucagugccaguuuggccccugggucuucgcu

SEQ ID NO: 129959 - RNA, 64 nt, Human
cucauugcccaggcuggagugcagugagcuauuacagugccacugcaauccagccugggcaaca

SEQ ID NO: 129960 - RNA, 64 nt, Human
uggugaauugugacauguugguuaccuguucgcccagugccacgucugcaugugaagcgugcuc

SEQ ID NO: 129961 - RNA, 64 nt, Human
ugauggaguaaagugugggauuguuguuuugcugggaugcaaauaacuaaaugcuuuggugguu

SEQ ID NO: 129962 - RNA, 64 nt, Human
gagugccaccccccaggccacagugauaccaucccagugccaugagcccacacugcccgcccuc

SEQ ID NO: 129963 - RNA, 64 nt, Human
gauuuccauuucagccaguggguagcugauaagccagugccagcauccagcaugagcagauguc

SEQ ID NO: 129964 - RNA, 64 nt, Human
cagcguuacugcucuccuucccuucaugauaagccagugccagcauccagcgugagcagacguc

SEQ ID NO: 129965 - RNA, 64 nt, Human
ccuccuggcugcaggcacccccagccagaacacgcagugccagccgugccccccaggcaccuuc

SEQ ID NO: 129966 - RNA, 64 nt, Human
aggcaccuucucagccagcagcuccagcucagagcagugccagccccaccgcaacugcacggcc

SEQ ID NO: 129967 - RNA, 64 nt, Human
auacguggugggaggguggagggcucccucuggccagugccagcugugcucagcuggcuucaga

SEQ ID NO: 129968 - RNA, 64 nt, Human
cacccccuuguuggagauggaggcagcagacgugcagugccauaaggugccccaguccuucugg

SEQ ID NO: 129969 - RNA, 64 nt, Human
acuuacuuccuuuaaaugucccauggauguaggacagugccauguuucaagaugccugugagcu

SEQ ID NO: 129970 - RNA, 64 nt, Human
uuugccccacagucuacccuucagggccuuguggcagugccaguguucggggggugucugggcc

SEQ ID NO: 129971 - RNA, 64 nt, Human
cucucuuagcccuuagaagucaccuacuuccuuccagugccaugaucccaccugcgaccucuag

SEQ ID NO: 129972 - RNA, 64 nt, Human
guuccugcugaggacaugaggacccgucuuuuugcagugccaggcaggguggccaaagaggacu

SEQ ID NO: 129973 - RNA, 64 nt, Human
cacauucauagccuguagugcccccucuaacccccagugccacagagaagacgggauuugaagc

SEQ ID NO: 129974 - RNA, 64 nt, Human
ucgggugucugcgugaaugagcguggccaaggaccagugccaccuuauggcaaagagcucccgc

SEQ ID NO: 129975 - RNA, 64 nt, Human
agcuaacaucugacguccagacaugaagagaugccagugccacgaggcaaauccaaauugucuu

SEQ ID NO: 129976 - RNA, 64 nt, Human
gaggacuuacaccauacaaaaauauugggcaccgcagugccagagaagaugcuugagguuagau

SEQ ID NO: 129977 - RNA, 64 nt, Human
ggucagaagcccagcugcugauggacacgccccccagugccagccaggcucaggucccaccuga

SEQ ID NO: 129978 - RNA, 64 nt, Human
gucgggaaauuuuuaaacccaggcagcuuccuggcagugccauuuggagcaucaaagugguaca

SEQ ID NO: 129979 - RNA, 64 nt, Human
aauaucaucaucaaaauucagugaaaucccaaaacagugccaagaauuuugcugaaugaaacaa

SEQ ID NO: 129980 - RNA, 64 nt, Human
cuaguuaaauaggugagaaaaaaaauaauaaucccagugccauuugucugugcaaagagaauua

SEQ ID NO: 129981 - RNA, 64 nt, Human
cccggccccgagggccaaggggguccccgcccgccagugccaaagcgcccggucggaggcggaa

SEQ ID NO: 129982 - RNA, 64 nt, Human
aagcugggaucaaggacagggaguuguaacagagcagugccagagcaugggcccaggucccagg

SEQ ID NO: 129983 - RNA, 64 nt, Human
gcggaaggagggacuucccaccggcauccggccccagugccauguuuuaucaucuggaacgguu

SEQ ID NO: 129984 - RNA, 64 nt, Human
uuguagggagugagacacugaagcccugagaagccagugccaucauccccaccccgcccagggu

SEQ ID NO: 129985 - RNA, 64 nt, Human
ccugggccaagaaacuggcacagccccacacugucagugccaagaggcugcgccaggccacucu

SEQ ID NO: 129986 - RNA, 64 nt, Human
gccugcugguccuguaagcaagcacuaagcuccacagugccaguuccuugccccaaccuggccc

SEQ ID NO: 129987 - RNA, 64 nt, Human
gggcaagacaccuagucuagagucaccaaggucacagugccacuuucacgggauagcaggcucu

SEQ ID NO: 129988 - RNA, 64 nt, Human
cugacagccaaggcagggcacugucuccugaggccagugccagcacgugcaugguucacagaaa

SEQ ID NO: 129989 - RNA, 64 nt, Human
cgaagcaguauuccagguuuucucuuuguuuuaucagugccaagaugaccuguugugucauaua

SEQ ID NO: 129990 - RNA, 64 nt, Human
uguaugaugacccuguccucccucacccaggcugcagugccaugcagacaccucauggcacuuc

SEQ ID NO: 129991 - RNA, 64 nt, Human
cccgcgcgcugcagccucaugugacccgaucggacagugccauccaugggccccaccuugugac

SEQ ID NO: 129992 - RNA, 64 nt, Human
aaacagcaaaccaucuagauuaaacuccuaaagccagugccacgaggcauuccuguuccaacug

SEQ ID NO: 129993 - RNA, 64 nt, Human
aggacccauuaagccacccccguguuccugccgucagugccaacugccgcauguggaagcaucu

SEQ ID NO: 129994 - RNA, 64 nt, Human
aaacucucuaagauuuaguaagugaaaaaaaguaggaugcaagaguuuuuauaguugauuccau

SEQ ID NO: 129995 - RNA, 64 nt, Human
gagacaugaugcaagagcugcaggccggggggcucagugccauggaagcuacuccaaguugcau

SEQ ID NO: 129996 - RNA, 64 nt, Human
uaugccccaccugcccugcuuccuggcuccuuaucagugccaugagggcagaggugcuaccugg

SEQ ID NO: 129997 - RNA, 64 nt, Human
ggaggcuagaacagagaagcccuuacuccugguucagugccacgcagggcagaggagagcagcu

SEQ ID NO: 129998 - RNA, 64 nt, Human
aggcucagcccgccguggcugggaagguucccugcagugccagugcugcagcagggagagcugg

SEQ ID NO: 129999 - RNA, 64 nt, Human
agcgacucccuuugcugcccaggaucuccaugggcagugccacagcggcugaugcucagucacu

SEQ ID NO: 130000 - RNA, 64 nt, Human
accuccuacacggcugcagugggacauuccaaaacagugccaggcggucaucgagaguuccuac

SEQ ID NO: 130001 - RNA, 64 nt, Human
agcaucauccuguuggaacucccaaaagucaucccagugccauucuguguucaggugcccauuu

SEQ ID NO: 130002 - RNA, 64 nt, Human
ggacgcugguuuauggcauccugagacaguugcacagugccagcggaggcugcacugagccuuc

SEQ ID NO: 130003 - RNA, 64 nt, Human
uuggagggguuuaugcucaauccauguucuauuucagugccaauaaaauuuaggaagacuucac

SEQ ID NO: 130004 - RNA, 64 nt, Human
accuccacacugccuccuggccagcugcccaccccagugccaggugggagagggagcagaacag

SEQ ID NO: 130005 - RNA, 64 nt, Human
ucuagccucuggacuggaaagcacaagacuggcccagugccagcaaguccuuaggcuacuguaa

SEQ ID NO: 130006 - RNA, 64 nt, Human
uccaugucaagauucagcuaguggccaagagaugcagugccaggaacccuuaaacaguugcaca

SEQ ID NO: 130007 - RNA, 64 nt, Human
augaccugcauccuaacccuugaaugacucaaaucagugccagguggaggacucccaucaccuu

SEQ ID NO: 130008 - RNA, 64 nt, Human
cuagaccucucuguaucccccagacuaucuguaacagugccaggcacacaguaggugaucaaua

SEQ ID NO: 130009 - RNA, 64 nt, Human
agugaggacaggagacccuaaggccccgggagcccagugccagccagagguugugcaggcaagg

SEQ ID NO: 130010 - RNA, 64 nt, Human
gccagccaggagugcggacaccauguucccagcucagugccaaagaggggucaccagggggagc

SEQ ID NO: 130011 - RNA, 64 nt, Human
cuugggaggccugccugcuagaauccuaaugugaggaugcaaaagaaaugaugauaacauuuug

SEQ ID NO: 130012 - RNA, 64 nt, Human
ggauguggccgggcugcagagccgggccacaccucagugccaaagaccccaugggagugggagg

SEQ ID NO: 130013 - RNA, 64 nt, Human
uuuuguaaccuaacagugaaucaauauuuucuaucagugccaagggcuuccuguaguucuauuc

SEQ ID NO: 130014 - RNA, 64 nt, Human
augcauagaaacucacauauaaacaugaaauaaacagugccaguauucauaggaaagugagaaa

SEQ ID NO: 130015 - RNA, 64 nt, Human
augaucccagccagacugagaaaauguaagcagacagugccacaguuagcucauacagugccuu

SEQ ID NO: 130016 - RNA, 64 nt, Human
ccauuuuuuaggugcuuuagagauaauugcuugccagugccaauugagggcauuaguacuuugu

SEQ ID NO: 130017 - RNA, 64 nt, Human
caaauucagcgccauugaaaguuggccuaaggcucagugccacucaccccucccuccccaaaag

SEQ ID NO: 130018 - RNA, 64 nt, Human
ccagaggggaggcucugggacaggggcugggguucagugccagggcccugaggaagaaaugggg

SEQ ID NO: 130019 - RNA, 64 nt, Human
gggacacccagaaacgccacaucccccaauccaucagugccaaacuagccaacggccccagcuu

SEQ ID NO: 130020 - RNA, 64 nt, Human
accccagcucugugaugugacuuugggcgagucucagugccacuugguccccagccauggacuc

SEQ ID NO: 130021 - RNA, 64 nt, Human
uauuuuuuuuacugauuuuuuauucuccagcuuucagugccaaagaggccaugcugaguuaggu

SEQ ID NO: 130022 - RNA, 56 nt, Human
ggagaagcacggccagcuagcacggccagugccaggaccgggccgagggaggccag

SEQ ID NO: 130023 - RNA, 64 nt, Human
gagagaaucugccuguggccuugcccgccagccucagugccacuugacauuccuugucaccagc

SEQ ID NO: 130024 - RNA, 64 nt, Human
uugggagaugcauuuuccgucuggcucacagggggagggugaggcuuuguaccccagccccugc

SEQ ID NO: 130025 - RNA, 64 nt, Human
uugggagaugcauuuuccgucuggcucacagggggagggugaggcuuugcaccccagccccugc

SEQ ID NO: 130026 - RNA, 64 nt, Human
ugccugaguuccagagagggaggacccugggguggagggugagggauucuguggaaguuuguaa

SEQ ID NO: 130027 - RNA, 64 nt, Human
caccaagagaccccaaggcuccagauggaacacugagggugaccgucccucucagaagccuuuu

SEQ ID NO: 130028 - RNA, 64 nt, Human
gugaaaaugcaaguguuugaagucugcucauuccgagggugaaacaaaauccaacccugucaga

SEQ ID NO: 130029 - RNA, 64 nt, Human
uucacccgcauguccagagggcggccgggauguggagggugagcgcugugggcagcucgggggc

SEQ ID NO: 130030 - RNA, 64 nt, Human
uugggcugccugggacaggcuccugaggaggauugagggugaaagucucccacgaguacacuaa

SEQ ID NO: 130031 - RNA, 64 nt, Human
uaaaagcuuuuucacaguuuuaagaagacaaguggagggugaggauagugguggggggucuggc

SEQ ID NO: 130032 - RNA, 64 nt, Human
ccgagccuuuuuguugcuccgcucccaggagagugagggugacgcaauugauuaaaaccauuuu

SEQ ID NO: 130033 - RNA, 64 nt, Human
ccagggcuauagcagaaagaacuuuaaagcucaggagggugacgcccagcuccgccugcuggga

SEQ ID NO: 130034 - RNA, 64 nt, Human
guaggaaagugauaguuaacuggauuuguuaggugagggugaggccaagggugacuuccagguu

SEQ ID NO: 130035 - RNA, 64 nt, Human
agacugccucuccagagcaaggcccagcugggcagagggugaaaaagagaaaugugagcauccg

SEQ ID NO: 130036 - RNA, 64 nt, Human
cugagcuuuaaugucagugucucuuagacauucagagggugaaccaccaucccuucaccccaaa

SEQ ID NO: 130037 - RNA, 64 nt, Human
uugagauacagugaaaugagccagggcgaggagggagggugaaggaacggagggcgggcggcuc

SEQ ID NO: 130038 - RNA, 64 nt, Human
uccucccuuucuucccuacaguugaaaaacagcugagggugagugggugaauaauacaguaucu

SEQ ID NO: 130039 - RNA, 64 nt, Human
cacaguuacagugaagcccaagccaggccugguugagggugauaaacgccacugucucuaaggg

SEQ ID NO: 130040 - RNA, 64 nt, Human
gaacccuagcagaggacucagccaccgccggggggagggugaggcggccgggggcauuaacuga

SEQ ID NO: 130041 - RNA, 64 nt, Human
agugugucucucccuauuagacuguaagccucucgagggugaggccuagccuucuugucuuugu

SEQ ID NO: 130042 - RNA, 64 nt, Human
gggaggcugaggugggaaaaucacuugaaccugggagggugagguugcagugagcugagaucau

SEQ ID NO: 130043 - RNA, 64 nt, Human
cuuuagcuguuucugcagcugaggucaguuucaggagggugaagcugauccccaggaauggauc

SEQ ID NO: 130044 - RNA, 56 nt, Human
ugaaggucaucuaccagugagggcuugagggugacguccuuccugcggcacccagc

SEQ ID NO: 130045 - RNA, 64 nt, Human
uuucaauucucgugguaauaccagaguagaaggagagggugacuuuaccgaacugacagccauu

SEQ ID NO: 130046 - RNA, 64 nt, Human
gucuaagaagucccauugccaaagcuuucugcaggagggugaaugccgcagcuuggcagccccu

SEQ ID NO: 130047 - RNA, 64 nt, Human
agaacagugggacaugagcaggggugugggcuuggagggugaagaggaugugguccuaucagau

SEQ ID NO: 130048 - RNA, 64 nt, Human
ucuggucuaccugagaucuauauggagcuuaaaggagggugaauaagauuaaugaccugaauug

SEQ ID NO: 130049 - RNA, 64 nt, Human
ggugagcugaagaaccuugccuguggcacuuuucgagggugagcuggaaccgagagaacauggu

SEQ ID NO: 130050 - RNA, 64 nt, Human
cucauucucucucuugccuguggcuuuggauacagagggugaugaugggguuauuaaugugugu

SEQ ID NO: 130051 - RNA, 64 nt, Human
aaauggaauagaguauuuugauauuguucauucagagggugauguguacauaucuauauuguau

SEQ ID NO: 130052 - RNA, 64 nt, Human
uguaugcaacacagcaauaaucuagaaugaaaaggagggugauuagccuucauaagaugaccua

SEQ ID NO: 130053 - RNA, 64 nt, Human
cuuuaaaagaucuaacuaugggaugggagaacuugagggugaucgggaaccuccccugcugagg

SEQ ID NO: 130054 - RNA, 64 nt, Human
uggacugcucucuccagaaacagcacagcucauggagggugagaucauguuagggaaaucaauu

SEQ ID NO: 130055 - RNA, 64 nt, Human
gcugacggaaagcagccuucuguacaacagaugggagggugaagggggcagaaugaaaaucgaa

SEQ ID NO: 130056 - RNA, 64 nt, Human
auaagauuauuuggaaacuuccuucaaacugcaggagggugagcuugagggaggaagcuaaaac

SEQ ID NO: 130057 - RNA, 64 nt, Human
gaaaaggccuguggcccagaggcuucuccaaagggagggugacaugcuggcuuuugugcccaag

SEQ ID NO: 130058 - RNA, 64 nt, Human
aacauuagccguaguggaauuaacaggaaaucaugagggugacguagaauugagucuuccaggg

SEQ ID NO: 130059 - RNA, 64 nt, Human
gaaguggaugaugugggaguugacaggccagggagagggugaagcagguaucagagucacuccu

SEQ ID NO: 130060 - RNA, 64 nt, Human
gugcagaacacgguguuuuaagcuugagugaaaggagggugaggcugccgaugccuuccugccc

SEQ ID NO: 130061 - RNA, 64 nt, Human
agggcuuccuccccagaggugcagcuugcguuuugagggugauugcuacauauguuguugcuaa

SEQ ID NO: 130062 - RNA, 64 nt, Human
ccagcaaccuguggagacaacccacacugugucugagggugaaaggacaccaggagucacuucu

SEQ ID NO: 130063 - RNA, 64 nt, Human
aaacaaaggccugugccucccacccaggaggugggagggugaauuuuauguuuaaaugaagaag

SEQ ID NO: 130064 - RNA, 64 nt, Human
uuuuuuuuuuacaacgugacaggaagaggagggagagggugacgaacaccaggcauuuccaggg

SEQ ID NO: 130065 - RNA, 64 nt, Human
cccauaaauaaaugaauggaguuugcaggaaggugagggugagcagagauguguguggacaucu

SEQ ID NO: 130066 - RNA, 64 nt, Human
acuggugguauguaucugugucccagcuaauugggagggugaguugggaggauuguuugagccu

SEQ ID NO: 130067 - RNA, 64 nt, Human
gaucugccacagaaaaagcaucuuugaagacaaagagggugaggucuucaugagucuccugggc

SEQ ID NO: 130068 - RNA, 64 nt, Human
acaacaucagcucacuggcaggaaaguccuuguugagggugagggggugcugggguacccgggg

SEQ ID NO: 130069 - RNA, 51 nt, Human
agccacggccagggagcuagugagggugauggggccaggaccugccccuga

SEQ ID NO: 130070 - RNA, 64 nt, Human
guuugggcacugauaugugggugagggcauggaggagggugaguucuccaaggcccaugaggau

SEQ ID NO: 130071 - RNA, 64 nt, Human
cuuuaguacaguuccugucaauuggcaacauggagagggugaccuggcugcugguuuaccacug

SEQ ID NO: 130072 - RNA, 64 nt, Human
guugcaugagucggaucccaguccauugucaguggagggugagggugaccccaucugcuauuuu

SEQ ID NO: 130073 - RNA, 64 nt, Human
ugagucggaucccaguccauugucaguggagggugagggugaccccaucugcuauuuuugugcu

SEQ ID NO: 130074 - RNA, 64 nt, Human
cuuccucuuuaggguaaccaucauguaugcccacgagggugauaguaauucgugagacugaagu

SEQ ID NO: 130075 - RNA, 64 nt, Human
ggugcaguggcaaaggauccagauagccuagggugagggugacagagggacagugggcuaugcc

SEQ ID NO: 130076 - RNA, 64 nt, Human
uauuugaagcauguuuucuagcgauuguguggaugagggugagcuggcugaggcaucgcucaag

SEQ ID NO: 130077 - RNA, 64 nt, Human
auuuaugcugguggcuuccauccguuccuccucugagggugaguggagggguauauggaaacac

SEQ ID NO: 130078 - RNA, 64 nt, Human
auagcagcccugccaucccugcagcagaaugagagagggugaacagggaacucuaugcuagauu

SEQ ID NO: 130079 - RNA, 64 nt, Human
ccuuaauaaaaucggaagcaagguuaggcugagugagggugaguaaagagguagaggagguuug

SEQ ID NO: 130080 - RNA, 64 nt, Human
gauaucuuuguugacucaggaguauguugcaagugagggugaagaagauccagaaguugaauuu

SEQ ID NO: 130081 - RNA, 64 nt, Human
uaaaauagguauaauugggucauacacuugacgagagggugacuguuucuaggggaagaaaacc

SEQ ID NO: 130082 - RNA, 64 nt, Human
cccccaucaccugcacaugggacagaccgggcuggagggugaccuuggcugugugcgucccagc

SEQ ID NO: 130083 - RNA, 64 nt, Human
cauaguaccgaauuuaguucaugcauuggucuuagagggugauggaacaagagaaguacuaucu

SEQ ID NO: 130084 - RNA, 64 nt, Human
agguuccuggagcuggggggugaccugagaggcagagggugacggguucucaggcaguccugau

SEQ ID NO: 130085 - RNA, 64 nt, Human
cuggguacuggaauuaauaccagugggugagacugagggugagugaguuaguacauauuaaucc

SEQ ID NO: 130086 - RNA, 64 nt, Human
ggguagggaggcaggagccaugucaguucugaaggagggugaggcggugggggauugcaggggg

SEQ ID NO: 130087 - RNA, 64 nt, Human
ggcacauuuccuguucuugaauucugcuccugaagagggugaacaaauggggcauucaaguugu

SEQ ID NO: 130088 - RNA, 64 nt, Human
uguucuaugggcacuuggggcuaaaucgccuccugagggugacuguugcuuauucugcuggaca

SEQ ID NO: 130089 - RNA, 64 nt, Human
accagagaaacuuccuuuugaacucaguggggaagagggugaugagacaggacuagaaaguagu

SEQ ID NO: 130090 - RNA, 64 nt, Human
gaggaaucaggcaaguacugucccaaggcagcuggagggugagggcugagugcccuggcuuccu

SEQ ID NO: 130091 - RNA, 64 nt, Human
caucucacugagcgacagugaccugcugcggcuggagggugacucgcguaccgugcggcugcug

SEQ ID NO: 130092 - RNA, 64 nt, Human
uaaauaaagaaucuuuguaccaaacugcccacaugagggugaagagauuuccucaaaagacuua

SEQ ID NO: 130093 - RNA, 64 nt, Human
gggggagggggacggugaaggccaaguucccaaugagggugagauugggccuggggucucaccc

SEQ ID NO: 130094 - RNA, 64 nt, Human
gccugaagauuuugcugugguguuuggagaagcagagggugaacuugcuguuggaggagucuuc

SEQ ID NO: 130095 - RNA, 64 nt, Human
acagauugaaagacaagugucauuuuuuuuuguagagggugauauauaccauguaaaugaacaa

SEQ ID NO: 130096 - RNA, 64 nt, Human
agaaaaugggcccuaggggucacuguacugacuugagggugauuaacagagagggcaccaucac

SEQ ID NO: 130097 - RNA, 64 nt, Human
cacaggaagaugcugcugcugcccugacugggaugagggugaggggugacggguguggcccugg

SEQ ID NO: 130098 - RNA, 64 nt, Human
aauuucuucuauggauucuggacagaagacacuugagggugauauguuuuaaaggaaagagguu

SEQ ID NO: 130099 - RNA, 64 nt, Human
gaccagccugagguguaagggcagacaaacaggugagggugaguguggcacccagagacugcuc

SEQ ID NO: 130100 - RNA, 64 nt, Human
uagugauggggcucagauggacugggaggagggggagggugaugcauuaauuaauggcuucguu

SEQ ID NO: 130101 - RNA, 64 nt, Human
gauuguucuggucuuacucauaacugggugguuugagggugacugaagucgugcuuuuccugug

SEQ ID NO: 130102 - RNA, 64 nt, Human
cccagccuaccaauaugcucauucgacuaacuaggagggugaguuggcccugucucuucuuuuu

SEQ ID NO: 130103 - RNA, 64 nt, Human
ggcugagccaaagccagaguggccacggcccagggagggugagcuggugccugcuuugacgggc

SEQ ID NO: 130104 - RNA, 64 nt, Human
augguggcucaugccuguaaucccaccacuuugggagggugaugcaggaggaucacuugaggcc

SEQ ID NO: 130105 - RNA, 64 nt, Human
uuucaugacacaaccuuucaugucgugaaaggcagagggugacugugugugaugugcagagucc

SEQ ID NO: 130106 - RNA, 64 nt, Human
cccaggccacacagacggacaugggcccacaugggagggugagcaggagcaaggcugugcuugc

SEQ ID NO: 130107 - RNA, 64 nt, Human
aggcagauugaagcucagcagggaagaggcuuuugagggugauccaggcgcuggagggauggcc

SEQ ID NO: 130108 - RNA, 64 nt, Human
uggaaaagggcucagagcugcugagcaggaaccggagggugacccauuucaggaggugccggua

SEQ ID NO: 130109 - RNA, 64 nt, Human
gggcaaaauuuauuuuagauauaaaguaaaggaggagggugagaugcuuucugcauuucuugau

SEQ ID NO: 130110 - RNA, 64 nt, Human
uccauauaaggugaaugugaaaugggagucuucugagggugauuuguacuuuccauguguaugu

SEQ ID NO: 130111 - RNA, 64 nt, Human
cuauuaucaguuguuauuguuaucccuugaaagcgagggugacaaaaacaacaaaacaccguua

SEQ ID NO: 130112 - RNA, 64 nt, Human
acauuuuuaauaaaagcaacauguugaaacaagagagggugagauuaaccuuuuugcuaaagua

SEQ ID NO: 130113 - RNA, 64 nt, Human
cuaaagauaucagagcucuuaauguugcuuagaugagggugacugucaaguacaagcaagacug

SEQ ID NO: 130114 - RNA, 64 nt, Human
uugaagaucaugaagaauagccaaacuugucuuugagggugaauuugacacuuuaaaauaauca

SEQ ID NO: 130115 - RNA, 64 nt, Human
ccuuaaguggcagaauauaauucccaagcuuuuggagggugauauaaaaauuuacuugauauuu

SEQ ID NO: 130116 - RNA, 64 nt, Human
uaauauaucuucccugauuuguuuuaaaagaucagagggugacugaugauacaugcauacauau

SEQ ID NO: 130117 - RNA, 64 nt, Human
ugcuggcagccucaggagcgaucgcuccccuggagagggugauugaguguggagaucaccgggg

SEQ ID NO: 130118 - RNA, 64 nt, Human
uuaaggugccauuccuucauguuuucucaguuuggagggugauggguagagcuuuccagaaccu

SEQ ID NO: 130119 - RNA, 64 nt, Human
gaauggcuggagucugcuguugucagaaggcagggagggugaugaaggacugacccacauggac

SEQ ID NO: 130120 - RNA, 64 nt, Human
ugaggaggagggacaaggaagaugacuaguuacggagggugaggguuguuuuuugccaaaaagc

SEQ ID NO: 130121 - RNA, 64 nt, Human
acccucugagggaguuccccaaucugaaggggaagagggugaccucagcggcuuuucucccaaa

SEQ ID NO: 130122 - RNA, 64 nt, Human
aagaaugucacauccgcccagacagcucuuugaugagggugaugggaacugaauaaaccauacg

SEQ ID NO: 130123 - RNA, 64 nt, Human
gcuuguggaaggagacgcugggcugugcggugcggagggugaugaggaugucuggugacagccg

SEQ ID NO: 130124 - RNA, 64 nt, Human
uaaaggaauugaaaagagacgauaaacauugaaugagggugagggcaucccugcuggggagaaa

SEQ ID NO: 130125 - RNA, 64 nt, Human
cuauaaacuuuauaaaauuaaucagagaagaagagagggugagaaacauaaauaauccaagcuu

SEQ ID NO: 130126 - RNA, 64 nt, Human
uaagccugguuuucuugagcagagggauggaacagagggugagagaggcaguggccgucuccac

SEQ ID NO: 130127 - RNA, 64 nt, Human
uauacagccccagguagggaggggagaguaugaggagggugacuggcagcuucuccuccagacu

SEQ ID NO: 130128 - RNA, 64 nt, Human
ugccccagcguuccugacuucuugcuggccuguggagggugagguguaauuauuugucaccuga

SEQ ID NO: 130129 - RNA, 64 nt, Human
cauucucuagucugugaugucuggagcuaguuuugagggugaaccacacuuuauccaacauaca

SEQ ID NO: 130130 - RNA, 64 nt, Human
guugggagcagugacagagagucauggccguggugagggugaaucccaaguggauggcucagga

SEQ ID NO: 130131 - RNA, 64 nt, Human
gcagccuggacauagagagggagaagaagucagagagggugacaagauagagagcuauuuaaug

SEQ ID NO: 130132 - RNA, 64 nt, Human
uggggggaaaaaggcuuuuuaacccauuuuugaagagggugaaguuuggagaacaaauuuaaaa

SEQ ID NO: 130133 - RNA, 64 nt, Human
agcuggaggaagucauggugucacugggguacaggagggugaaugaagggcaugcaggcccuca

SEQ ID NO: 130134 - RNA, 64 nt, Human
gaacucuccagccaaaugcugggagaaggaccuggagggugagucuuugcugaccucucucuac

SEQ ID NO: 130135 - RNA, 64 nt, Human
gccgcugcgcuggaugucccccgaggccauccuggagggugacuucucuaccaagucugauguc

SEQ ID NO: 130136 - RNA, 64 nt, Human
gaggggcccucaggccauuccccaacgggguggggagggugacccacagcucugggccucuuuu

SEQ ID NO: 130137 - RNA, 64 nt, Human
caaaugaaguguaauaucuauagaaaaguagagugagggugaauuuauauauauauuuuguuuu

SEQ ID NO: 130138 - RNA, 64 nt, Human
ugcugcugauauuuuuucuaauauauauaucauugagggugacuaaucuucaguggaccaaauc

SEQ ID NO: 130139 - RNA, 64 nt, Human
acuuucaaaagggaagaguuuuugugaugggggagagggugaaggaggucaggccccacuccuu

SEQ ID NO: 130140 - RNA, 64 nt, Human
accacuuuagucccuggccaccagcacaccccaggagggugaguggccugagguaguuacggca

SEQ ID NO: 130141 - RNA, 64 nt, Human
ugagacuguuccugagccuucagcacuaaccuaugagggugagcugguccccucuauauauaca

SEQ ID NO: 130142 - RNA, 64 nt, Human
uaaauuaaguuuggcauuauugucagacuggauggagggugaaguaaaauaguaugaacaauua

SEQ ID NO: 130143 - RNA, 64 nt, Human
ggggauguccacagagagggaagggccgaggggagagggugaccauggggaauguggggaucag

SEQ ID NO: 130144 - RNA, 64 nt, Human
uucaggggaaggggcauagcccagccuggaaggagagggugagugggggauggcuuucugaaaa

SEQ ID NO: 130145 - RNA, 64 nt, Human
uuuaccacaauaguuugaagcaguaagggggaaggagggugauuauauugcuuuguaaugguuu

SEQ ID NO: 130146 - RNA, 64 nt, Human
acaagcgguguaggcuccaaugcugcuuucccaggagggugaagauggugcugugcugaggaaa

SEQ ID NO: 130147 - RNA, 64 nt, Human
uuccugcuguucuccuacagaaaagugauucugugagggugaacaggaaaugccuuguggaaac

SEQ ID NO: 130148 - RNA, 64 nt, Human
cacagggccugcuauugcagaaugaagccauuuagagggugaaggagaaauacccauguuacuu

SEQ ID NO: 130149 - RNA, 64 nt, Human
gguuuacuaauucaaagagccaucucugaugggagagggugaggaaaucagcugaaugguuggc

SEQ ID NO: 130150 - RNA, 64 nt, Human
uaaauguaacuggugcccccuccccgaugugacugagggugagugagugguggcggggcugcuc

SEQ ID NO: 130151 - RNA, 64 nt, Human
ugaguccucucuggcugggaaggggggaagguaggagggugagggcccugcaggagucuuucuu

SEQ ID NO: 130152 - RNA, 64 nt, Human
ugucucugagaucuaugucuguugguggcaaugugagggugauacucucucacucuaauaaacu

SEQ ID NO: 130153 - RNA, 64 nt, Human
acaccaggguauacuugaggguggaggguggcaggagggugaagauugaaaagcugccuauugc

SEQ ID NO: 130154 - RNA, 64 nt, Human
ugagcugggagucccgcuggucucccugaggacugagggugaacuucgcucuuugccuuaaacc

SEQ ID NO: 130155 - RNA, 64 nt, Human
cuaaccugguagagguagacgggcgcuucguguggagggugaacuuggaugcccugacccagca

SEQ ID NO: 130156 - RNA, 64 nt, Human
ugggaggaaagacagccaugcugcuggcacuacagagggugagccgcccaugucuggggccucc

SEQ ID NO: 130157 - RNA, 64 nt, Human
uaagggugaauacuaguaguccaggcuugauuuggagggugaaugacgccuagcaagauguauu

SEQ ID NO: 130158 - RNA, 64 nt, Human
gcaagugucuaacuucugugccuguuaaucaugggagggugagacagaacaaucccuaaagggu

SEQ ID NO: 130159 - RNA, 64 nt, Human
ucauguuugcgcccucucccugccccucaccccagagggugaggaggaaugaggggcauuggug

SEQ ID NO: 130160 - RNA, 64 nt, Human
cagcuggggucccggugagugggggcacuucggugagggugacaggguggccuaucucaaggga

SEQ ID NO: 130161 - RNA, 64 nt, Human
cuguucucgggguuguuccauucaugccuucuuggagggugaggguggcuugggaaccgaccca

SEQ ID NO: 130162 - RNA, 64 nt, Human
gaggcggaggaggaagcuggcgcugggggaggcugagggugagggaacagccuggaugugagag

SEQ ID NO: 130163 - RNA, 64 nt, Human
auguguucacugucauuaugcuguggcuccaggugagggugaggacugggccuauauagaaucc

SEQ ID NO: 130164 - RNA, 64 nt, Human
cggccuuggauggaugaagucagagagguggggugagggugagcuuacucagggcccccagagg

SEQ ID NO: 130165 - RNA, 64 nt, Human
cccuucucucugccugccucaccuccagcugucagagggugagcagggcccuggaggcaggcac

SEQ ID NO: 130166 - RNA, 64 nt, Human
ucuuaaauaaagaagaguaaacuuauuuuuuauagagggugaaggaugcuggaaggguaaggau

SEQ ID NO: 130167 - RNA, 64 nt, Human
ccaugugcguuugcucuguggggaacagagcacagagggugagcgacaugugcagaacggcccc

SEQ ID NO: 130168 - RNA, 64 nt, Human
ggccuggggugugugugagugugagugugagcgagagggugaguguggucagaguaaagcugcu

SEQ ID NO: 130169 - RNA, 64 nt, Human
ucucuccacccaauugugccaguaaauggggguugagggugaccuaggcagcauuagaaucacu

SEQ ID NO: 130170 - RNA, 64 nt, Human
gccaggcgggcaccaaacacugauggcaccuauugagggugacagccacccagcccuccugaag

SEQ ID NO: 130171 - RNA, 64 nt, Human
gugcagcagcagugacggaggaaacagacauggggagggugaacaguccccacagcagacagcu

SEQ ID NO: 130172 - RNA, 64 nt, Human
aacaaaucuugggugggugaaggccuggcuggaagagggugaaaggcagggcccuuggggcugg

SEQ ID NO: 130173 - RNA, 64 nt, Human
cugcugggccagcccggccucccacacccacuuggagggugagacugcaguggggguuguuuuu

SEQ ID NO: 130174 - RNA, 64 nt, Human
auguccagccucggagaccuucacaaagccuugggagggugaugagugcugguccugacaggag

SEQ ID NO: 130175 - RNA, 64 nt, Human
guuauauaaguuguauaauaugcuuguaaaggcugagggugagcuguaucuggaugccuuuuua

SEQ ID NO: 130176 - RNA, 64 nt, Human
uuguggcuuugugucugcuggcaccaagagggcugagggugagguguggaagggacagggggag

SEQ ID NO: 130177 - RNA, 64 nt, Human
gcacgcuucucucguggucaugccaagaacacaggagggugagucuaacaagcacaccucaagc

SEQ ID NO: 130178 - RNA, 64 nt, Human
gugacaagggagugaccauccauccccuccacaggagggugaggaauugggacagguaauucca

SEQ ID NO: 130179 - RNA, 64 nt, Human
gaaguggugggaagaaggugagagaaaagggugggagggugagagaggggagggaggggaauaa

SEQ ID NO: 130180 - RNA, 64 nt, Human
uaggccuuuuccacccaaccaggccuaccugggagagggugagguucagcacaucacacaccau

SEQ ID NO: 130181 - RNA, 64 nt, Human
agcaaggaccuaggcuggggauguccuccgagcagagggugaaguuucucucaguucucucccu

SEQ ID NO: 130182 - RNA, 64 nt, Human
auuuuguuugcuucaugugucccagaagaugacugagggugaguuggcuuaccuggcccaucag

SEQ ID NO: 130183 - RNA, 64 nt, Human
uagccuuguagaguuucuagagagauguauuuaugagggugauaacuagcccaggauugauuuc

SEQ ID NO: 130184 - RNA, 64 nt, Human
ucccccagggaucuucuauuuaaguggcuucugagagggugaacaggauuguuacuuuuaagcc

SEQ ID NO: 130185 - RNA, 64 nt, Human
ucacuguuggccgcuccuuauccggccuggccuggagggugacaccaugucacccucaccagga

SEQ ID NO: 130186 - RNA, 64 nt, Human
auaaugcauguggcacuuagguccaaggucuccagagggugaaagcuggagucugucaaugucc

SEQ ID NO: 130187 - RNA, 64 nt, Human
agauuuuuacaguguugaaacuuaagaauuuugagagggugaggaggguuguucagaaucuaaa

SEQ ID NO: 130188 - RNA, 64 nt, Human
uucaccucagauuuucuggacuuagucaugaggagagggugaggcccacucuguuccuacugga

SEQ ID NO: 130189 - RNA, 64 nt, Human
ccaaaaaugcuuguuauauaaaggguacuuuugggagggugagugccgccauuuaguggcugcu

SEQ ID NO: 130190 - RNA, 64 nt, Human
aaauucuagcccuugcccucagggagccacgguugagggugaggcccaacaccugccuuagggc

SEQ ID NO: 130191 - RNA, 64 nt, Human
aucagccucccagaccugccagcagaugcugugugagggugauggagcacggggucacaccccu

SEQ ID NO: 130192 - RNA, 64 nt, Human
uguccacgacccaggcuggacgaaugccuggucagagggugaccugaaccagagcuggagugag

SEQ ID NO: 130193 - RNA, 64 nt, Human
ggaaagcaugauuaguuugcagguuaugguaggagagggugagauauaagacauacauacuuua

SEQ ID NO: 130194 - RNA, 64 nt, Human
cagcuuacauuuggauucagaguuguugucuauggagggugagagcagaaacucuuaagaaauc

SEQ ID NO: 130195 - RNA, 64 nt, Human
gccagacggugcugggaaggcaguuguucauugggagggugaggguuccgguucggccguggga

SEQ ID NO: 130196 - RNA, 64 nt, Human
uuagauuugauggggccaaaguugagauagaauagagggugaugacgguaagagcaaguguccc

SEQ ID NO: 130197 - RNA, 64 nt, Human
ucuagggaagcagugcgugugaaacagcguaacggagggugaagagcauaguuaauaagcaacu

SEQ ID NO: 130198 - RNA, 64 nt, Human
caccgcuaaggaaagugaugacauagcaguuacagagggugauaaaucucuccagcuaauucag

SEQ ID NO: 130199 - RNA, 64 nt, Human
cuuacauuaagccugaaagaaccuuuaguuuaaggagggugagauaagagacccuuuuccuacc

SEQ ID NO: 130200 - RNA, 64 nt, Human
cuggaaucugaggcauccucugacuccacucaaagagggugagggccuucuuaagauacaaaug

SEQ ID NO: 130201 - RNA, 64 nt, Human
guugauuucuuuaaugguuugacuuuuuuucccugagggugagggaugggugggaagagaggac

SEQ ID NO: 130202 - RNA, 64 nt, Human
aggggaguguucagggccagcccuggcuggcauggagggugaggcugggugucuggaagcaugg

SEQ ID NO: 130203 - RNA, 64 nt, Human
ccuaucaagggugaaagugaugaugguggugcaggagggugacaauaaaauccuaguggaauug

SEQ ID NO: 130204 - RNA, 64 nt, Human
gacaccagcuggguuagggucaagggugccuggggagggugaguaauccugcauugcuaaaaga

SEQ ID NO: 130205 - RNA, 64 nt, Human
ugugcaauacaacagagggaggcaggugggaauugagggugagggguuugggggaaaggggaag

SEQ ID NO: 130206 - RNA, 64 nt, Human
auagucuaccuuccuuauuuggggcaauagggaggagggugaauguuucuucuuucucaucuac

SEQ ID NO: 130207 - RNA, 64 nt, Human
uguugguuuuaaagauaagcacauggguaaaaaugagggugauccuuauucaaaaauaacaucu

SEQ ID NO: 130208 - RNA, 64 nt, Human
uguuuuaagagacaaucaugccagagucccacaugagggugacuaaaauggacaaaaagucugg

SEQ ID NO: 130209 - RNA, 64 nt, Human
gcaugggugagaccugaccagucagaugguaguugagggugacuuuuccugcugccuggccuuu

SEQ ID NO: 130210 - RNA, 64 nt, Human
agugucugcuggauuccauuuucuaagaguuucugagggugaggcucuuauuuuuuuuuuuaag

SEQ ID NO: 130211 - RNA, 64 nt, Human
cccucaacuucuagcaguauaucaguuaugaacugagggugaaauauauuucugaauagcuaaa

SEQ ID NO: 130212 - RNA, 64 nt, Human
guaaggcugugggucgcgugaugcgcaugucacggagggugacgggggugaacuugguucccau

SEQ ID NO: 130213 - RNA, 64 nt, Human
uucaccccaugucccuucuacacgcuuacucacugagggugagugggaacgcuugugauggugc

SEQ ID NO: 130214 - RNA, 64 nt, Human
gggccagggcaggcaggagcaggcacugaugcuagagggugaugacccugcccucugccaccca

SEQ ID NO: 130215 - RNA, 64 nt, Human
uuacucaaugguacccagggagggagcaugggaagagggugagcugagggcuggaggagggcaa

SEQ ID NO: 130216 - RNA, 64 nt, Human
aaaagaaucuuuuucaaaguuugugucggaaggggagggugagguuugcccacugucucugcag

SEQ ID NO: 130217 - RNA, 64 nt, Human
caaggcucuucuccuuggaggacagugggaacuggagggugagaggaagggugggucuguaaga

SEQ ID NO: 130218 - RNA, 64 nt, Human
gcaggcugggcccugcauuucuggggcaggaacagagggugaaagggacagauagaugcagguc

SEQ ID NO: 130219 - RNA, 64 nt, Human
aucugcuuuugccuacgugacaacacaaauuugggagggugagacacugcacagaagacagcag

SEQ ID NO: 130220 - RNA, 64 nt, Human
gcacacgcacgcacacacacauacagagcucucugagggugauggggcugagcaggaggggggc

SEQ ID NO: 130221 - RNA, 64 nt, Human
ccagcuaacguggcagaggaguugcgggucuccugagggugaguucugcugccuuguccauuua

SEQ ID NO: 130222 - RNA, 64 nt, Human
uaugcgauuaugucucuuuacguugcuaaggggggagggugaggauuaaguacucgugccuuau

SEQ ID NO: 130223 - RNA, 64 nt, Human
ggugaccuccugcccucuccucucucaggagggggagggugagcaggcacauugacuuucuguu

SEQ ID NO: 130224 - RNA, 64 nt, Human
ccccccaaguguuuaauaacuggcauuaagcuuagagggugaaaaaaaaaaaaaagauugauag

SEQ ID NO: 130225 - RNA, 64 nt, Human
auuccuuaccaggaaacuggaagcuaaaaauacagagggugacguagaaacacgcagaaaccau

SEQ ID NO: 130226 - RNA, 64 nt, Human
ggauagagugacugcugcuccauauuagcuuccagagggugagugagggacagaauauuuccuu

SEQ ID NO: 130227 - RNA, 64 nt, Human
agaugaccauuucagaucugaaucccaugggugugagggugauggguacuccaggacuggccua

SEQ ID NO: 130228 - RNA, 64 nt, Human
gagggcugggggaaggaguguguggaggagggaggagggugaagacugaggcuaggugccagaa

SEQ ID NO: 130229 - RNA, 64 nt, Human
agauuuuaccuuuuuguaaugcuguuuaucagaggagggugacaggggcuggaaauaaagagag

SEQ ID NO: 130230 - RNA, 64 nt, Human
agacuucuggcaaacuucugcugggaauuaguuugagggugaggguacauaugugacauuugcc

SEQ ID NO: 130231 - RNA, 64 nt, Human
aaacaaccuguucaccacuccugggugcaugauugagggugaagcauccaccagcacuucaagg

SEQ ID NO: 130232 - RNA, 64 nt, Human
agaaauugggcucaguggucuucaacuugaggacgagggugauuuuccuaagaaaucagcaaag

SEQ ID NO: 130233 - RNA, 64 nt, Human
agaacacuaaauuuuggucccauggcugaaacuugagggugacuaaaaguaaugccugugaaac

SEQ ID NO: 130234 - RNA, 64 nt, Human
uccuuggugucagggagcccccaggccgcagguggagggugauaaaauauguucucugacagga

SEQ ID NO: 130235 - RNA, 64 nt, Human
uaggaguggggcuucccccgccuuccggugaggggagggugaggagcuggagggaggggcggga

SEQ ID NO: 130236 - RNA, 64 nt, Human
ugugcuauagaauagggugcuucccuagccuagagagggugaguguugauuagauucugugcca

SEQ ID NO: 130237 - RNA, 64 nt, Human
ggauaaauucuuagaaccaauggugguuuguggggagggugacaggguggauagguacaggauu

SEQ ID NO: 130238 - RNA, 64 nt, Human
cucugaaggagccagaggggcagccaccuugcaugagggugaggaaggagaagcccagccagcc

SEQ ID NO: 130239 - RNA, 64 nt, Human
ugcaguuaacaaggcuggaugugaauuuuauucugagggugauuugugaucaaguuuaaucaca

SEQ ID NO: 130240 - RNA, 64 nt, Human
gcuagggguaccccagcugcugccacuccugcuggagggugaacuggggacccugcacccuccg

SEQ ID NO: 130241 - RNA, 64 nt, Human
acaagcaggauaguggagugagaaagggaggguggagggugaggccaaaucagguccagcaaaa

SEQ ID NO: 130242 - RNA, 64 nt, Human
uauagccuuuaauuccuuacuuuggcuauggguggagggugaguuugaagagguucugauuuuc

SEQ ID NO: 130243 - RNA, 64 nt, Human
aaaacuucuuuuuaaucuuaagauucuuugugaugagggugagaaaaagaauccucaguuuauu

SEQ ID NO: 130244 - RNA, 64 nt, Human
aaaagccagaaacacaaacccguguggacuccgggagggugacucagguccuccuuccaugucu

SEQ ID NO: 130245 - RNA, 64 nt, Human
uucaguccccaggcagcccugccucugacuccaagagggugaaguccacagaagugagcuccug

SEQ ID NO: 130246 - RNA, 64 nt, Human
cagaaauguacagcaaggagauuuacaacugggggagggugaagugaagacaaugacuuacugu

SEQ ID NO: 130247 - RNA, 64 nt, Human
uauagcagaggaucucauuugacuuuguuuugaugagggugaugcucucucuuaugugguacaa

SEQ ID NO: 130248 - RNA, 64 nt, Human
gcuugcgaauaacaguccccguggccaucccugugagggugacguuagcauuacccccaaccuc

SEQ ID NO: 130249 - RNA, 64 nt, Human
ugcuggacuggaggccccuggagccagauggcaagagggugacagcuuccuuuccuguguguac

SEQ ID NO: 130250 - RNA, 64 nt, Human
agggcugagccggcggguccuccugagcgcggcagagggugagccucacagccccucucuggag

SEQ ID NO: 130251 - RNA, 64 nt, Human
caggcuucacucccaaaagugcagccaggcccuggagggugauccugccagcagcccuacagcu

SEQ ID NO: 130252 - RNA, 64 nt, Human
gggagucccgugcaagccaucagaauguugaaaugagggugaagagcucagaucccucucuuug

SEQ ID NO: 130253 - RNA, 64 nt, Human
guccuggcucugcugucccccaagagggugcuucgagggugaggacuucucuggagaggccugg

SEQ ID NO: 130254 - RNA, 64 nt, Human
cacgcaaguuccugagcugaacauggagcaaggggagggugacuucucuccacauagggagggc

SEQ ID NO: 130255 - RNA, 64 nt, Human
ccaucacugccaccuggcuucugccauguggcaggagggugacuggauaauuaagacugcauua

SEQ ID NO: 130256 - RNA, 64 nt, Human
aggucuuccccuagcacauggggaccccggccucgagggugaccucccuaccccgccccugcca

SEQ ID NO: 130257 - RNA, 64 nt, Human
cccucccgaaucucucugcuagugguggguggaagagggugaggugggguauaggagaagaaug

SEQ ID NO: 130258 - RNA, 64 nt, Human
gcuuuaagacguaggccuggggacugggagggcagagggugagucacagcccucuccgucugcu

SEQ ID NO: 130259 - RNA, 64 nt, Human
caaacaugaauaugguuggagagcccuggauuaggagggugacauggggaaggcagaggcuggc

SEQ ID NO: 130260 - RNA, 64 nt, Human
acacuggggccuaccugaggucggagcauggaaggagggugaggaucaaaaaacuaccuaucug

SEQ ID NO: 130261 - RNA, 64 nt, Human
ggugagcacagacuucuaguuggcaggagcugaggagggugaacaaaccccgagggaggcccgg

SEQ ID NO: 130262 - RNA, 64 nt, Human
ucagguggggaugaagaagaggggcaggucgggggagggugaugccagggauuccaaggcaccg

SEQ ID NO: 130263 - RNA, 64 nt, Human
agcuugggauggauuugacuaaaucugccccgaggagggugaacaaggugaucucagagaucac

SEQ ID NO: 130264 - RNA, 64 nt, Human
cgguggagggggaguugcagaaagagagggcagugagggugaggagaggggaucuggggacuug

SEQ ID NO: 130265 - RNA, 64 nt, Human
uucuuccaaaaggaagcacccguugaguccuuuugagggugauuugucuuacaacugacugacu

SEQ ID NO: 130266 - RNA, 64 nt, Human
aaugccuccugcagggauucuuccugcuuagcuugagggugacuauggagcugagcagguguuc

SEQ ID NO: 130267 - RNA, 64 nt, Human
uggagauucgauacguggacuacggcggauauaagagggugaaaguagacgugcuccggcaaau

SEQ ID NO: 130268 - RNA, 64 nt, Human
ugugggggcuuuucaagaggggccaggcuuccuggagggugacugauguggccgaagcaggugu

SEQ ID NO: 130269 - RNA, 64 nt, Human
aagcagcuuauuguauaugagggagccaggccccgagggugagcgagauggagaaggggaagga

SEQ ID NO: 130270 - RNA, 64 nt, Human
agcagaauugagggagagaccuuucuuccuuguugagggugaaaaauaaauaagaauuacaugu

SEQ ID NO: 130271 - RNA, 64 nt, Human
gggaggagaggacaagggaaaugucaggggcggggagggugacaguggccgcccaaggcccacg

SEQ ID NO: 130272 - RNA, 64 nt, Human
aacuguucccaccugcuggagugaaggggccaaggagggugagugcaaggggcgugggaguggc

SEQ ID NO: 130273 - RNA, 64 nt, Human
guaccaggugcuccuggacgugaaggcccggcuggagggugagaucaacacguacuggggccug

SEQ ID NO: 130274 - RNA, 64 nt, Human
guggcaggugauguguccccauugguuaggugaggagggugaggcucagagagcuaaggacacu

SEQ ID NO: 130275 - RNA, 64 nt, Human
acagagaaggcgcuucccaacuucauacuggcaggagggugaggagguucacugagcuccccag

SEQ ID NO: 130276 - RNA, 64 nt, Human
uccucacagccuacuuccccuuccccggggcugagagggugaaaguguguggggaaggagagga

SEQ ID NO: 130277 - RNA, 64 nt, Human
accgcccugcacuucuagcccucauuuaagauuugagggugaaaccaaagaaaacccccuaagu

SEQ ID NO: 130278 - RNA, 64 nt, Human
gcccagccacuccaggaggaagucgggaggcguggagggugaccacaccuuggccuucugggaa

SEQ ID NO: 130279 - RNA, 64 nt, Human
gaauggcuuuaggcacuuuugugccagagcuugugagggugacagaagaggguccaggcuggaa

SEQ ID NO: 130280 - RNA, 64 nt, Human
uaaggucaaugccauuauuugauuauaccauuuugagggugaauauggcuaggcacuuuagaua

SEQ ID NO: 130281 - RNA, 64 nt, Human
ugcccaucccauaaccaaagagcucaaugggcuggagggugagacccagccaauccuugggagc

SEQ ID NO: 130282 - RNA, 64 nt, Human
aacccaacaccacaagcuugguugggugcaagcagagggugagcaggggcugccccuccaccug

SEQ ID NO: 130283 - RNA, 64 nt, Human
ucuauauauaacaaguauauaucaaacaugugcugagggugacaggauaugcucacuuaaauug

SEQ ID NO: 130284 - RNA, 64 nt, Human
guuuugaggcucgcucuugcgcggugccugagaagagggugaaggagcuggggcaggccccauc

SEQ ID NO: 130285 - RNA, 64 nt, Human
uacagaccaggcagggaaagagacccgguaauuggagggugagccucggggggggggcaggacg

SEQ ID NO: 130286 - RNA, 64 nt, Human
cugccuguguauacuuggccgugggcaugagaccgagggugaggcuggaggguccaaagcuggc

SEQ ID NO: 130287 - RNA, 64 nt, Human
aggaaaagaacauuccaggcagacagcacugcaagagggugagcucuugguguauuuggagacc

SEQ ID NO: 130288 - RNA, 64 nt, Human
gcacgcccagcuccagugauuacucggaccuacagagggugaaacagguaacuugggggggaag

SEQ ID NO: 130289 - RNA, 64 nt, Human
cugcaggaugugucugucuuugucacgguggacagagggugacaucauaggagcagcucgcugg

SEQ ID NO: 130290 - RNA, 64 nt, Human
auugggacugguuagacagugggugcagcccacggagggugagcugaagcaggguggggcguaa

SEQ ID NO: 130291 - RNA, 64 nt, Human
gccggucucaggccgcacagacguuccagaggaggagggugacauuuuuacucccuuuuugggg

SEQ ID NO: 130292 - RNA, 64 nt, Human
uuaaggcccacuguuuuacuggggcccauuguaugagggugaaguuuggcaguuacccaagaga

SEQ ID NO: 130293 - RNA, 64 nt, Human
gcacaguucaugcccuguaauccuagcacuuugggagggugaggcaggaggauggcucaagccc

SEQ ID NO: 130294 - RNA, 64 nt, Human
auuugugguggaaaaggcggccaucaucucugcugagggugacuccaaggcagcugagcugauc

SEQ ID NO: 130295 - RNA, 64 nt, Human
cugaguuggagggcaagggcuggggcugggaugggagggugaagaugcccaagcugaagaugcc

SEQ ID NO: 130296 - RNA, 64 nt, Human
aaaaauuccauguguugggggguggggggcggaggagggugaggggugccgcccaugggccaca

SEQ ID NO: 130297 - RNA, 64 nt, Human
acaguggcucaugccuguaguccuagcacuuugggagggugagaaaggaagaucucuugagcuc

SEQ ID NO: 130298 - RNA, 64 nt, Human
ugucgagaucucaggagccccuugcuguuuuuuggagggugaaagaagaaaccuuaaacauagu

SEQ ID NO: 130299 - RNA, 64 nt, Human
ugcaggcgcggagggcagaggcgcagaauccugugagggugacucugggggaccccuggucugu

SEQ ID NO: 130300 - RNA, 64 nt, Human
ccaccaugauuuuaaccuuccugaggcuucccuagagggugaucagaugccagcaccauguuuu

SEQ ID NO: 130301 - RNA, 64 nt, Human
gugguggcgagugccuguaaucccagcuauucaggagggugaggcagaagaauggcuugaauuc

SEQ ID NO: 130302 - RNA, 64 nt, Human
ccuuggaaugaggcccuuuguuuugagcuaggcggagggugauaagugaaaauacuauauaaac

SEQ ID NO: 130303 - RNA, 64 nt, Human
ugucagagccacugagugcugugcugcucgacgugagggugaaaugauugacuugugaccugcc

SEQ ID NO: 130304 - RNA, 64 nt, Human
uuuuuuuuugagaaggagucugucuccagccugggagggugagacuccaucuaaaaaaaauaaa

SEQ ID NO: 130305 - RNA, 64 nt, Human
gccagagagccuggugcugcugcugcuguggcgugagggugaggggcuggcacugacugggcau

SEQ ID NO: 130306 - RNA, 64 nt, Human
gaagguggaugugguggccgagaccccguccacggagggugauggccuuucccuucugcaggug

SEQ ID NO: 130307 - RNA, 64 nt, Human
aaggugggggcugccaugaggggggcguguccaggagggugaccaugggauggcuuauacacac

SEQ ID NO: 130308 - RNA, 64 nt, Human
agcuaagacagacugcgaaucacuuuucugcugugagggugauggugccugaugcggugucucg

SEQ ID NO: 130309 - RNA, 64 nt, Human
cagcauguauuacuugacaaagagacacugugcagagggugaccacagucuguaauuccccacu

SEQ ID NO: 130310 - RNA, 64 nt, Human
gcgauuugucccagguccucacuaccgggcgcaggagggugagcguuauuggucggcagccuuc

SEQ ID NO: 130311 - RNA, 64 nt, Human
ugagggagucacagccagacagagaguauugcuggagggugagagaauuguggagaccaacuac

SEQ ID NO: 130312 - RNA, 64 nt, Human
ugguaauucuggaagcuuuuccuggcagucaagagagggugacauccuggggcuugugacauuu

SEQ ID NO: 130313 - RNA, 64 nt, Human
ccagaaggcuggguccaggggagggaaaagcuaagagggugaacaaagaaaagacauugaaagc

SEQ ID NO: 130314 - RNA, 64 nt, Human
agaaaugucggaauuucagagucgccugacggcagagggugagcccccguggagucugcagaga

SEQ ID NO: 130315 - RNA, 64 nt, Human
uuucugagaagauaggauuggauuggauuuugcagagggugagaacuucucugugccugcucag

SEQ ID NO: 130316 - RNA, 64 nt, Human
uguuuccccugggaagugaggggacgaagccuuagagggugacauagcuagaaaguggagaagc

SEQ ID NO: 130317 - RNA, 64 nt, Human
ccccuguuugccaucucggggguguucccugugggagggugagugggugaggccgagccugcug

SEQ ID NO: 130318 - RNA, 64 nt, Human
ugucagugaauuuaucacucugagcgagucucuagagggugagaauuugagagaaauaguaauu

SEQ ID NO: 130319 - RNA, 64 nt, Human
uccagaaacucugugugguauuaguuuguauccagagggugacccucuucucaaggaaaugggu

SEQ ID NO: 130320 - RNA, 64 nt, Human
agaugaugcuguccaucccguacaccagugggaagagggugagggcugauccagagacccugag

SEQ ID NO: 130321 - RNA, 64 nt, Human
gacccaaaugcaaacauuuuauuagggggauaaagagggugagguaaaguuuauggaacugagu

SEQ ID NO: 130322 - RNA, 64 nt, Human
cucuggcagggaccugcccaggauggagaugagagagggugagagauggagggcgagauuugga

SEQ ID NO: 130323 - RNA, 64 nt, Human
guuuggggacccagugggaccaggugcgggggcagagggugacuuaccaagagccagggagggc

SEQ ID NO: 130324 - RNA, 64 nt, Human
ggcaggcugcagaacuuucccucuuccucucauugagggugaugacaagagacauccggggacu

SEQ ID NO: 130325 - RNA, 64 nt, Human
cccccaccugcccacuugggaaucugaggcagaggagggugaggccugugugccaaccuuguuc

SEQ ID NO: 130326 - RNA, 64 nt, Human
ccucaggaagucacagagucuacugaggcaaggagagggugauucuuuccccaaaucccuucuu

SEQ ID NO: 130327 - RNA, 64 nt, Human
gguugugcccagguguugcccccuaucuccuggggagggugaggcagggcagggacagucucca

SEQ ID NO: 130328 - RNA, 64 nt, Human
aacggugaagacaagcugcgagagcugggagcuggagggugaagaggugaacacuugagugguu

SEQ ID NO: 130329 - RNA, 64 nt, Human
gaguggggagaugagaccaguguuccucacacuggagggugauagaccccaaggggaacugaag

SEQ ID NO: 130330 - RNA, 64 nt, Human
uuuccacccugucccuaucucuaccacuauagaugagggugaggaguagggagugcagcccuga

SEQ ID NO: 130331 - RNA, 64 nt, Human
aaaauaucuuugaaggcagaaucaguugaguugugagggugaagccucacauacuucucaacag

SEQ ID NO: 130332 - RNA, 64 nt, Human
agaagacccagacucaucugaaggaucgucagaggagggugaggaagacuaauuaaacauggag

SEQ ID NO: 130333 - RNA, 64 nt, Human
uggaugggcagucauuuugcagaggcuaugggaagagggugauaauagaagaguggcagcuaua

SEQ ID NO: 130334 - RNA, 64 nt, Human
ugaaucaucgcuauaucaaguaucuaaaauuugggagggugaaucaguacacugugaccaaggu

SEQ ID NO: 130335 - RNA, 64 nt, Human
ccgcaccuuguggggaagcuucaggggagcgggggagggugauucccagugguggggaaaacau

SEQ ID NO: 130336 - RNA, 64 nt, Human
ccuaucugugcauuuuaccggcaccucaggaaaggagggugaccagguugucuuagcuuguacu

SEQ ID NO: 130337 - RNA, 64 nt, Human
gugugugugccuguguguguguagagacauaaaggagggugaugugauuuucagcuaguccuuu

SEQ ID NO: 130338 - RNA, 64 nt, Human
uagcaucauuaagaucaguuuuaagggguauagggagggugagggaagugggggguguuaggua

SEQ ID NO: 130339 - RNA, 64 nt, Human
uaaucauuuucccccuuuuauugguucuuguuuugagggugaggacaaggguuguggggagggg

SEQ ID NO: 130340 - RNA, 64 nt, Human
agcauaagcgggaagggcuuggucuggauguagagagggugaauaaaauugccaagagagauau

SEQ ID NO: 130341 - RNA, 64 nt, Human
cuuccugccaagguuuauagaaaccugagaaucugagggugaugucuggccgcuggucaagaag

SEQ ID NO: 130342 - RNA, 64 nt, Human
ggaggggaaccaggcguccuuggaggcagcuugggagggugacuguguagugucacccacaagg

SEQ ID NO: 130343 - RNA, 64 nt, Human
acucuuccccaggaagggaaggggggucagaagagagggugaguccuccagaacucuuccucca

SEQ ID NO: 130344 - RNA, 64 nt, Human
gaagccaugggccagcaauaccugcuuuucugaagcccccaaggagggcucugacauucuuuuu

SEQ ID NO: 130345 - RNA, 64 nt, Human
gauauuccaaaagggacuuuacauuaaaggagaagcccccaagauguggccacccuuaaccauu

SEQ ID NO: 130346 - RNA, 64 nt, Human
ccuccagggacuugccuggcccuccucccccuccgcccccaauggguucggucuccuuugcgcu

SEQ ID NO: 130347 - RNA, 64 nt, Human
agggcacucccaguuaccugcacaacaguuucaggcccccaaaccguuuccaccggcgggucuc

SEQ ID NO: 130348 - RNA, 64 nt, Human
gagagggaaggagggaggaggcaucuucccugaagcccccaaucuggccccccccuccccagac

SEQ ID NO: 130349 - RNA, 64 nt, Human
uccuaaauuucaguaggcuuuaugcuguguuuaugcccccaauuuauuuuaacaaaagaagauu

SEQ ID NO: 130350 - RNA, 64 nt, Human
cauaaaagacacugguaaacaccaagguaaaagggcccccaagguggucaugacuggucucauu

SEQ ID NO: 130351 - RNA, 64 nt, Human
cccucuuaccacacuuuaccaguuaaccacugaagcccccaauucccacagcuuuuccauuaaa

SEQ ID NO: 130352 - RNA, 64 nt, Human
gcuuccucaccuugagaguaaagugcugcccucugcccccaacacacacacauaucaauuccug

SEQ ID NO: 130353 - RNA, 64 nt, Human
uccugcuggccuugggcuggagccuaggaaaguggcccccaaauccuuagugagcuaaagcugg

SEQ ID NO: 130354 - RNA, 64 nt, Human
cccucaugcagaccugggguccuccugggcccuggcccccaaaccucuuggcacccgguuguua

SEQ ID NO: 130355 - RNA, 64 nt, Human
auaaguggacugugccaguacaauacaugccucagcccccaagccuagaaggaccucuagucuc

SEQ ID NO: 130356 - RNA, 64 nt, Human
gcuggcuuuacuaagccagccacacuuggagucugcccccaagcucucucacugaaugcugccu

SEQ ID NO: 130357 - RNA, 64 nt, Human
ucugauacuaauggagcuucaugacccacggucagcccccaaaccaaaguugucccaacagagg

SEQ ID NO: 130358 - RNA, 64 nt, Human
gcauaaaaggcauuaggugggcauuuuucugugugcccccaaaaagcuccauggaaacaggcac

SEQ ID NO: 130359 - RNA, 64 nt, Human
ggcccuaccuggggaaagccugaagggccucccagcccccaaccccaagaccaagcuuaguccu

SEQ ID NO: 130360 - RNA, 64 nt, Human
uccccacccuguagggaggucugagcagagggaggcccccaagagugccauugaccaagagaca

SEQ ID NO: 130361 - RNA, 64 nt, Human
cacagcugcagcugggccccaugcucugccccaagcccccaaccccgcggugcucuggcggcuu

SEQ ID NO: 130362 - RNA, 64 nt, Human
cuuccaucagccuuaacccugggaaaugccugcugcccccaaugacucuugguuucgucuccca

SEQ ID NO: 130363 - RNA, 64 nt, Human
uugucccuguccaccaaguaguuggaccauucuggcccccaaacaagggaagauaaagucccca

SEQ ID NO: 130364 - RNA, 64 nt, Human
acaauugugccucaucauuugcucaaauuccugggcccccaaguuagcccccucccaggagugg

SEQ ID NO: 130365 - RNA, 64 nt, Human
aauuccucugaauuuugauguaagaucuauauaggcccccaaaaugaucguaguacaugccagu

SEQ ID NO: 130366 - RNA, 64 nt, Human
aaaagagcccuggagcaucagguuccccagauaggcccccaaauaaagaccugucuauggcucu

SEQ ID NO: 130367 - RNA, 64 nt, Human
gaggagaucagaaaaucccucugacaucuccacugcccccaaagaccuccguugaacauucugu

SEQ ID NO: 130368 - RNA, 64 nt, Human
ucaauuucuguuuugaaggugcugggacucuggugcccccaacccugggcauccucaggcuuug

SEQ ID NO: 130369 - RNA, 64 nt, Human
accacaaagcaaugaaucauuaucaucucaacaugcccccaauuucucucccaaucacccucaa

SEQ ID NO: 130370 - RNA, 64 nt, Human
uuucaguggaacccuugcccccaaaugucgaccagcccccaaaugucgaagaauuuucuucuug

SEQ ID NO: 130371 - RNA, 64 nt, Human
gcgugaauuugggggauuuuucaguggaacccuugcccccaaaugucgaccagcccccaaaugu

SEQ ID NO: 130372 - RNA, 64 nt, Human
gccauaggcacauggagcagaauacuuaagccuggcccccaaaugccccugcacacacacgugc

SEQ ID NO: 130373 - RNA, 64 nt, Human
aggcugugaaaaggcauauggaccugcaaaggaggcccccaaccagacagaccuaguuucaaac

SEQ ID NO: 130374 - RNA, 64 nt, Human
acuuccagaaccagcuucaacauaugucuacauugcccccaaguuaauaaagugccaacccuuu

SEQ ID NO: 130375 - RNA, 64 nt, Human
aggagugaggcauggugacagcaguccccuaugugcccccaagucaucugagcauuggugugca

SEQ ID NO: 130376 - RNA, 64 nt, Human
aaaacacaugguuaaauguuaaauuuuaauuaaggcccccaaaaauuaaauauaacuuuuuaaa

SEQ ID NO: 130377 - RNA, 64 nt, Human
caaagguugcuuucccccuuuuuguucuuuuuaugcccccaagcacuuucugcaguagcuagag

SEQ ID NO: 130378 - RNA, 64 nt, Human
cuucuacuugagcccucucucucugccacccaccgcccccaaucuaucuuggcucacucgcucu

SEQ ID NO: 130379 - RNA, 64 nt, Human
gguagggagacaggaaacugcguuuuagccuugugcccccaaaccaagcucauccugcucaggg

SEQ ID NO: 130380 - RNA, 64 nt, Human
cuuccccugugaagaaacagguguucucggcugagcccccaacccucugcagaaccagguugau

SEQ ID NO: 130381 - RNA, 64 nt, Human
uagaccagugcagccagagagaccaccaaacagagcccccaaaagacagacaucucugcuagcu

SEQ ID NO: 130382 - RNA, 64 nt, Human
cuggaaccugacuuuagauguuuugggaucaggagcccccaacacaggcaaguccaccccauaa

SEQ ID NO: 130383 - RNA, 64 nt, Human
auuuccuggggagcccugaggcuuuucuucuccugcccccaagcaccuccagcggugaugagcu

SEQ ID NO: 130384 - RNA, 64 nt, Human
gggaagccacaccacuggccuucccuuccccagggcccccaagggugucucaugcuacaagaag

SEQ ID NO: 130385 - RNA, 64 nt, Human
aaaaauauucuucugaacucaucaaaguagaagagcccccaaccuuuucucucugccuucaaga

SEQ ID NO: 130386 - RNA, 64 nt, Human
auagagggucccucucugcuccccagcagcuccugcccccaaggccugacuguauauacuguaa

SEQ ID NO: 130387 - RNA, 64 nt, Human
uccaggccaucccauagccccuccucuucuggcugcccccaaugccccgaggccuggggagccc

SEQ ID NO: 130388 - RNA, 64 nt, Human
guggagaaacaagagaccaacuuuuucauucccugcccccaauuucccagacuagauuucaagc

SEQ ID NO: 130389 - RNA, 64 nt, Human
uguuauuacugguggaugcaccguguccacagcagcccccaaucccagcgaugcgucagaucuu

SEQ ID NO: 130390 - RNA, 64 nt, Human
acccguuucucccucaaguuugaguauuucgggagcccccaaaacagccugagcaaaaagacca

SEQ ID NO: 130391 - RNA, 64 nt, Human
cggccuccuucaccuuucucaucuccagagcccugcccccaauacucugucuggguuaggaucu

SEQ ID NO: 130392 - RNA, 64 nt, Human
ccaccuccugagcucaagugauccucccaucuaagcccccaaguagcuaggacuacaggagcac

SEQ ID NO: 130393 - RNA, 64 nt, Human
ccaagaucaacagcuccuucuccaaacaacucaagcccccaauucccaucgcauuccauuuggg

SEQ ID NO: 130394 - RNA, 64 nt, Human
gaaaaagggacuccaagaggcagugguggcuguggcccccaacuuuggugcuccagggugggcc

SEQ ID NO: 130395 - RNA, 64 nt, Human
cccccauaccucccacaguaucccagcgccucaugcccccaaccccaagcccugcccuucaccg

SEQ ID NO: 130396 - RNA, 64 nt, Human
ugggaugagcccccuccccccaaugcacaagccagcccccaagacccuggggguggacaccacu

SEQ ID NO: 130397 - RNA, 64 nt, Human
cuuccugggccaacuaaccagacaacugggaagagcccccaacuccaacaggauuauuuuccca

SEQ ID NO: 130398 - RNA, 64 nt, Human
uuugcugucucaggcacuacaugucauugaucuugcccccaauccugcuccuccucucauguuu

SEQ ID NO: 130399 - RNA, 64 nt, Human
guguggcugcucccagccucuugcucagagcuaggcccccaaauugccuucagcccuaacauag

SEQ ID NO: 130400 - RNA, 64 nt, Human
gcucccaggccaguaagggaaauagaaaaacccugcccccaaauaagaagggauggauuccaac

SEQ ID NO: 130401 - RNA, 64 nt, Human
ugccuaugcacugaagagcucuuggcccggcagggcccccaauaaaccagugugaacccccacu

SEQ ID NO: 130402 - RNA, 64 nt, Human
auuuuucuucuuaaaugugcaucaaucaugccuugcccccaaccuuuaaauauauucuuagacc

SEQ ID NO: 130403 - RNA, 64 nt, Human
ugucuagaaucauaagaauguggaacccgccauggcccccaaccaauguacaagcuauuauuua

SEQ ID NO: 130404 - RNA, 64 nt, Human
aaguuguuucucaguuguuuuugcuuuuaacuuugcccccaacguuuaaagggagugaucugcu

SEQ ID NO: 130405 - RNA, 64 nt, Human
ggugccaggaaugcgccaccccauccuccaccccgcccccaaaucgugacaaucaaaaaugccu

SEQ ID NO: 130406 - RNA, 64 nt, Human
aacucauucaugaggaaucugaugcuccuuugcugcccccaagaguauacuccaccgagaacca

SEQ ID NO: 130407 - RNA, 64 nt, Human
auuuauaaaauugaaggcaacccccgcuccugccgcccccaaucuccccauugccuagagcgcu

SEQ ID NO: 130408 - RNA, 64 nt, Human
ggagacgcuauguuuuuuugaauauaauuaacuugcccccaacucaaaauagcugucuguguug

SEQ ID NO: 130409 - RNA, 64 nt, Human
guauuauuaagacucacacagaaucagggacagggcccccaaaggaguuugcuguaaaauaggc

SEQ ID NO: 130410 - RNA, 64 nt, Human
uguuccuagaggagacagccugucucuccuuguugcccccaaagcccaugcccugccguggugg

SEQ ID NO: 130411 - RNA, 64 nt, Human
uccuugagcaaggcgcuuacucuccuccgcucaggcccccaaggccgcccuuucccucgcacac

SEQ ID NO: 130412 - RNA, 64 nt, Human
auggacuuacuaagggaaaggugagaugaacacugcccccaaggagggggugaaauaugaucua

SEQ ID NO: 130413 - RNA, 64 nt, Human
cuaaggcaucuaucugugcuagguuaaaugguuggcccccaaagauagacagguccugauuucu

SEQ ID NO: 130414 - RNA, 64 nt, Human
gggguggcuggaccuaccuggucauuugaaacaggcccccaagcuggaguuuuuaaucuggacu

SEQ ID NO: 130415 - RNA, 64 nt, Human
uuuguaaacacccucuugcuuaauccucccaacggcccccaaagguagaacuuagcucccuuuu

SEQ ID NO: 130416 - RNA, 64 nt, Human
uccgccucccaguucaagugauucuccugccucagcccccaaguagcugggauuacaagugugc

SEQ ID NO: 130417 - RNA, 64 nt, Human
cuuggccuucuucccugaaugcuuuuuuuuuuuggcccccaagaaagucccuuuuauagcacuu

SEQ ID NO: 130418 - RNA, 64 nt, Human
agcuugggcccgagcccaagcauuuggcucugcugcccccaaggggacaggaagccucuugggc

SEQ ID NO: 130419 - RNA, 64 nt, Human
aaauaaaaaccacugugugcaaugccuugcuguggcccccaaccacugcuuaggccucccaacu

SEQ ID NO: 130420 - RNA, 64 nt, Human
cagcugaugacagagagaggcucuacaaagaagcgcccccaaagagugcagcugcuaauuuuag

SEQ ID NO: 130421 - RNA, 64 nt, Human
ccacuaucacgaucaagauacaaauauuuucauugcccccaaaauucucauacccccuuuccca

SEQ ID NO: 130422 - RNA, 64 nt, Human
uggacgggcgcaccugcauggagggguccccagagcccccaaccagugccagcauacucagcgu

SEQ ID NO: 130423 - RNA, 64 nt, Human
acacucuucugaauugacuguauuucagugagcugcccccaaaucaaguuuagugcccucaucc

SEQ ID NO: 130424 - RNA, 64 nt, Human
ugcuggaggaagugccaucugcauggccacucuugcccccaagggcccaggcuguggcugacac

SEQ ID NO: 130425 - RNA, 64 nt, Human
guccgugugagcaggcccaccuggcuccagacccgcccccaaccugagacagaaccaggcugag

SEQ ID NO: 130426 - RNA, 64 nt, Human
agcauccagggcagaggaagccacaucucccggugcccccaaccccagcugcagccuccucccc

SEQ ID NO: 130427 - RNA, 64 nt, Human
cucugacccauuaggcuaaagagagacaagagaagcccccaaccugauucucaugacagcucca

SEQ ID NO: 130428 - RNA, 64 nt, Human
acaaaguauggguuuggccauaagcucauaugcugcccccaaagacuggggagagcugugugcc

SEQ ID NO: 130429 - RNA, 64 nt, Human
gucgcuccaggcccccucacccucaaaguguagcgcccccaaccgagcaaccucgguuuggucc

SEQ ID NO: 130430 - RNA, 64 nt, Human
cuucaacgccuucugacuuccaggugaugacugggcccccaauaaaucccgucuuugggucucu

SEQ ID NO: 130431 - RNA, 64 nt, Human
ggucaagcaguggcagacgcaaggcuuucugugggcccccaagugguaggagggagaguagcag

SEQ ID NO: 130432 - RNA, 64 nt, Human
caaacuccugaccucaggugauccgccugccucggcccccaaagugcugggauuacaggcauga

SEQ ID NO: 130433 - RNA, 64 nt, Human
uguccuguaaggguguugaagaugcucccuggcggcccccaagcagacuagaugggaggaggcg

SEQ ID NO: 130434 - RNA, 64 nt, Human
ccaauucaccuaauuuuuauacugaaauguagaugcccccaacaugauuuuggaaagauauaau

SEQ ID NO: 130435 - RNA, 64 nt, Human
uguuccccgcuuuuucacucccauaccuuuaauggcccccaaaaucugucacuacaauuuaaac

SEQ ID NO: 130436 - RNA, 64 nt, Human
uacucaaagaguauauguucccuccaggucagcugcccccaaacccccuccuuacgcuuuguca

SEQ ID NO: 130437 - RNA, 64 nt, Human
uguuugaaguagugccaggguccccugggaagaugcccccaagacaccugccccaagugggugg

SEQ ID NO: 130438 - RNA, 64 nt, Human
uaaaugcuuucauuuauugaaaaaaaaaaaaaaugcccccaaagcacuaugcuggucaugaacu

SEQ ID NO: 130439 - RNA, 64 nt, Human
aggguaagaauguucagggggcugcccaggaggggcccccaaccugacuaucauggacaagaga

SEQ ID NO: 130440 - RNA, 64 nt, Human
cggucacaucaggcccgcuagguccagagagcgagcccccaaugcccggccaggcuaagccgca

SEQ ID NO: 130441 - RNA, 64 nt, Human
uaaagcaguaguccacaaaguauucugcucaugugcccccaaaaguauuuugaaaaaucaugua

SEQ ID NO: 130442 - RNA, 64 nt, Human
uuuuucuugagaaaagcuaaugcaccuacagauggcccccaacauucucuuccuuuugcuucua

SEQ ID NO: 130443 - RNA, 64 nt, Human
cuucacgccucgguagauuugcauucugaugcaagcccccaaccucacggaccaagaggauccc

SEQ ID NO: 130444 - RNA, 64 nt, Human
agccaccguguccagccaguuucuguuguuugaagcccccaacuucuagauugggaaacgaagc

SEQ ID NO: 130445 - RNA, 64 nt, Human
cugugucccccacuuccacucaggaaauugggcugcccccaaccuggccacugaaugucuccag

SEQ ID NO: 130446 - RNA, 64 nt, Human
gggauggacccucgcagcaggugcaagagacagagcccccaagccucugccccaaggggcccac

SEQ ID NO: 130447 - RNA, 64 nt, Human
aguguguccaaccagcuguucucuccucaaagcagcccccaagcaagucccuucucuagggugu

SEQ ID NO: 130448 - RNA, 64 nt, Human
cagucgaguguuuacagauccggccaggaccccggcccccaaugcacuuuacgcgcgaagaagu

SEQ ID NO: 130449 - RNA, 64 nt, Human
uuuuguguuaaauuuuaguucccuguuguuuaaugcccccaaaauaugcagaccuuugggaaua

SEQ ID NO: 130450 - RNA, 64 nt, Human
ccugaguggaaguuucauucaucagugaugaauagcccccaaacagugggaguguguauguaug

SEQ ID NO: 130451 - RNA, 64 nt, Human
aucugcuucucggaucucccucagucugcccccagcccccaaacuccuccuggcuagacuguag

SEQ ID NO: 130452 - RNA, 64 nt, Human
cuucaccaccggcacacagcuugccccugucuuugcccccaaagguauuuugugucuaguguca

SEQ ID NO: 130453 - RNA, 64 nt, Human
agcagucuggucaggaaccuugguuucuugagaggcccccaagaugccgcagcuccagggcucu

SEQ ID NO: 130454 - RNA, 64 nt, Human
gccgccgccaggacuguguuuccaaagguuccccgcccccaaccccagcaucagccuguagcuc

SEQ ID NO: 130455 - RNA, 64 nt, Human
cgauuuccugggcucaagcaauccucccaccucagcccccaaguagcugggccuacaggugcgu

SEQ ID NO: 130456 - RNA, 64 nt, Human
gcccucagacauuuauauauuggaagcugcugaggcccccaaguuuuuuaauuaagcagaaaca

SEQ ID NO: 130457 - RNA, 64 nt, Human
cuuccagagaucauccggggcuuuaauauuaauggcccccaaaacuccguaagaagcaggaaau

SEQ ID NO: 130458 - RNA, 64 nt, Human
gccgggcgggggcucggggcucggccuccuaccugcccccaacccacccuccaccccguccccc

SEQ ID NO: 130459 - RNA, 64 nt, Human
ugauuccaaaaauguuucugagcccuggaccccugcccccaaaauauuuucaucuuucccccaa

SEQ ID NO: 130460 - RNA, 64 nt, Human
gcacgucaccaaguaaccaggccccagccuccaggcccccaacuccgcccagccucuccccgcu

SEQ ID NO: 130461 - RNA, 64 nt, Human
cuaaccugaccgugggcggggccuugcgguauccgcccccaauaaaagcaauuccaaccuuccc

SEQ ID NO: 130462 - RNA, 64 nt, Human
ggggccuggcaggcucucgguggguggggugggggcccccaaaccaaaguccucugggguaggg

SEQ ID NO: 130463 - RNA, 64 nt, Human
gccucucacagugcugauuuaccucccccaaaaugcccccaaacccccaugcaaguuuacagcc

SEQ ID NO: 130464 - RNA, 64 nt, Human
agcucuguagaaagaauguguugccuccuaccuugcccccaaguucugauuuuuaauuucuaug

SEQ ID NO: 130465 - RNA, 64 nt, Human
uccuccuaacuccauuugaauguaagggcagcuggcccccaauguggggagguccgaacauuuu

SEQ ID NO: 130466 - RNA, 64 nt, Human
gaaguugaaucugguuauuauuuaaaaacuagaagcccccaaaccagcagaucuuacugaagau

SEQ ID NO: 130467 - RNA, 64 nt, Human
guuaaaacacuaauugcugggccucaacccaaaagcccccaaaguggcacuucugaguuccugc

SEQ ID NO: 130468 - RNA, 64 nt, Human
agacccaagaccaaacgcaucuaaaggauccccagcccccaagaccuagccuuugucugcgauu

SEQ ID NO: 130469 - RNA, 64 nt, Human
aaccucucacucccaaguuucuuugaggccacuugcccccaagcacuucacaauagacccucga

SEQ ID NO: 130470 - RNA, 64 nt, Human
uggcuggcaggagucaggccccagcagcccuccugcccccaaagcuuuccgagucuggugggca

SEQ ID NO: 130471 - RNA, 64 nt, Human
uggcagccccagccugaccacucagacagccgcggcccccaaggccugacucuucuugugggag

SEQ ID NO: 130472 - RNA, 64 nt, Human
gcuuuccagaugaccaggacgagugggauauuuugcccccaacuuggcucggcaugugaauucu

SEQ ID NO: 130473 - RNA, 64 nt, Human
gucacccuacaacuacuacuucuugggaccucaagcccccaacaucccaguccucaguccucag

SEQ ID NO: 130474 - RNA, 51 nt, Human
ugcuaaggaaaaugggcugaagcccccaauagccaaauaauaaagcagcau

SEQ ID NO: 130475 - RNA, 64 nt, Human
ccuccuuauuucuuuuuucuaucuguuccucuuagcccccaaacucccagguucucacuuccuu

SEQ ID NO: 130476 - RNA, 64 nt, Human
gucugucaaguggccuuugucccuggggcugauggcccccaacucaccagcaucaugaccuugu

SEQ ID NO: 130477 - RNA, 64 nt, Human
gccuggggucaggcccucacugacccucaggggagcccccaaggugcugucugucuagacaggc

SEQ ID NO: 130478 - RNA, 64 nt, Human
cuaccuguuugggucagagagauguguuuuaaaagcccccaaggaaggaggcugggacugugcc

SEQ ID NO: 130479 - RNA, 64 nt, Human
cagucaaagaaaguccauuguacauaacaaaacagcccccaaacagcccagugccgacaccauu

SEQ ID NO: 130480 - RNA, 64 nt, Human
uaccaguggugaagucagugccacaucugcacuggcccccaaggucagcucccugggucugucu

SEQ ID NO: 130481 - RNA, 64 nt, Human
uuuaaaaucugucacguagaacuuggauguaccugcccccaauccaugaaccaagaccauugaa

SEQ ID NO: 130482 - RNA, 64 nt, Human
uugucugucuuggaaagugugggcagccacagaugcccccaaaucagagcucacagugagugag

SEQ ID NO: 130483 - RNA, 64 nt, Human
auaacauguucccuuuuguuuuguaaauaaaugugcccccaaguuguuaauguuauauuaaaag

SEQ ID NO: 130484 - RNA, 64 nt, Human
ucagaagauucaccggcccauggcucccaaggaggcccccaagaagcugauccgauacaucgac

SEQ ID NO: 130485 - RNA, 50 nt, Human
ccagaauuuauaacacaugagcccccaaaaagccgggacuggcagcuuua

SEQ ID NO: 130486 - RNA, 64 nt, Human
acugaggcagcugcuauccccaucucccugccuggcccccaaccucagggcucccaggggucuc

SEQ ID NO: 130487 - RNA, 64 nt, Human
gggaacaaagaggagccugguaaaaaacagccaagcccccaagaccucagcccaggcagaagcu

SEQ ID NO: 130488 - RNA, 64 nt, Human
agucacaggggccaaaggccugagaccccacccugcccccaaacuggcuaagacagcuuucagu

SEQ ID NO: 130489 - RNA, 64 nt, Human
caucuggccaagcuugaggaagauguguggccuugcccccaauuccaucagaccaaggcugcaa

SEQ ID NO: 130490 - RNA, 64 nt, Human
cauuccuggaaccagccaggccaggcaaccaguggcccccaaaggcaggcaggauccucaggcc

SEQ ID NO: 130491 - RNA, 64 nt, Human
aacucagucccuaaaaacacagacauucugccaggcccccaagccugcagucaucuugaccaag

SEQ ID NO: 130492 - RNA, 64 nt, Human
uuucagagaacaguuaaucaaggcaaaucagcaagcccccaaagugcuguaauuuaacaucaug

SEQ ID NO: 130493 - RNA, 64 nt, Human
gcagcccaugcuugaugccagcaacccagauccugcccccaaagccaagaagaucaagucucag

SEQ ID NO: 130494 - RNA, 64 nt, Human
ccucuuuuugguuauggauggcucacaaaauagggcccccaaugcuauuuuuuuuuuuuaaguu

SEQ ID NO: 130495 - RNA, 64 nt, Human
cguacacacgcacauucauuacacaccuacauacgcccccaacacacgcgcacggugaagagga

SEQ ID NO: 130496 - RNA, 64 nt, Human
cucuaaccucugcccucgcugcucuuggaauugcgcccccaagaugcucucucccuucuccaau

SEQ ID NO: 130497 - RNA, 64 nt, Human
ggauuacuggauagaauucaggcuuuccccuccagcccccaaucauagcucacaaaccuuccuu

SEQ ID NO: 130498 - RNA, 64 nt, Human
aggaaaaacaucuggccagggguagcuugauuucgcccccaaaaauacugaagacuaauccauu

SEQ ID NO: 130499 - RNA, 64 nt, Human
ggguuguuuggagucuggggaaccagguuagugggcccccaagaagagcuuuuuauuuccuauu

SEQ ID NO: 130500 - RNA, 64 nt, Human
ccugaguucagccccacggacaaagggacacacagcccccaauggagaccauuguaaguggugg

SEQ ID NO: 130501 - RNA, 64 nt, Human
uuccuggcugaggucugggaaggaauagaaaggggcccccaauuuuuuuuuaagcggccagaua

SEQ ID NO: 130502 - RNA, 64 nt, Human
auauguacaucucuuauuuucuuacauuauuuaugcccccaaauuauauuuauguauguaagug

SEQ ID NO: 130503 - RNA, 64 nt, Human
aguauauuccgugucguguguguguguggccaaagcccccaaggguggcaagugccaccuucgc

SEQ ID NO: 130504 - RNA, 64 nt, Human
cuguugacuuaucugcgcuuguuccaacucuuaugcccccaaccugcccuaccaccaccacgcg

SEQ ID NO: 130505 - RNA, 64 nt, Human
cuccucuccugggccccugcucuucccgagagcugcccccaaaucagacauaccucuguggcuc

SEQ ID NO: 130506 - RNA, 64 nt, Human
ccuccugaccugcuccaucugagcucuccagcuggcccccaauugcuccucucucucuuugcuc

SEQ ID NO: 130507 - RNA, 64 nt, Human
gcguuagacuggcaucaggcuggcacuaggcucagcccccaaaacccccugcccagccccagcu

SEQ ID NO: 130508 - RNA, 64 nt, Human
aaaugagaaaaagcauuuucuguuuucccaccaggcccccaaguguggucuuuuucuuuccucc

SEQ ID NO: 130509 - RNA, 64 nt, Human
cuuaucccaaaacuuuaguggcuuaaaaaaaccugcccccaacuguuagucaaucugagcuggg

SEQ ID NO: 130510 - RNA, 64 nt, Human
ccgccccaccaccuccugggaccacaccacuaccgcccccaaccacagcagagacuagcagcgg

SEQ ID NO: 130511 - RNA, 64 nt, Human
ugcucguuccaaagggaaaaacucggaugaagaagcccccaagacugcccagaagaaguuaaag

SEQ ID NO: 130512 - RNA, 64 nt, Human
cuguaggucccuggugcuuccaguacugcacuuugcccccaaggucuuugacuucauuuccuga

SEQ ID NO: 130513 - RNA, 64 nt, Human
aguccuggcugauugguguucgcuguucaucugagcccccaaaagcauuauuacugauacuugc

SEQ ID NO: 130514 - RNA, 64 nt, Human
cugagaaagaacuuaaagagcuaggaggacagaggcccccaagcugaucugguggugcauccac

SEQ ID NO: 130515 - RNA, 64 nt, Human
gcuccccuaacucagauccccuaacuuagauuuggcccccaacuccauuuccugucugucuuag

SEQ ID NO: 130516 - RNA, 64 nt, Human
aucacugcccuacaugugacuauguccaaguuaagcccccaacacgagaggaaagcugcugacu

SEQ ID NO: 130517 - RNA, 64 nt, Human
cccccaacuccccgggcccggccccugcccugcugcccccaacagcgucuggcuccccuacuaa

SEQ ID NO: 130518 - RNA, 64 nt, Human
ccuccccugcagcgacucggacccgcuacugccugcccccaacuccccgggcccggccccugcc

SEQ ID NO: 130519 - RNA, 64 nt, Human
ugcuccccuugggucccgcccaccagcggacucggcccccaaggcuccgcccacacugaccacg

SEQ ID NO: 130520 - RNA, 64 nt, Human
uauaaaaucaugaagcagguaaagggaggggcaagcccccaaacugcuguggggacauuuuaua

SEQ ID NO: 130521 - RNA, 64 nt, Human
ggaugcugcugagcaucccgcaguguacaggacagcccccaaacaaggaauuauccagccccaa

SEQ ID NO: 130522 - RNA, 64 nt, Human
caauucagaagcaucaccaugcaugguggcgaaugcccccaaacucucccccaaauguauuucu

SEQ ID NO: 130523 - RNA, 64 nt, Human
aaaguugucacagguuuuuguuguuguuuuuauugcccccaaaauuacauguuaauuuccauuu

SEQ ID NO: 130524 - RNA, 64 nt, Human
agcaccggaaugccaauuaacuagagacccuccagcccccaaggggaggauuugggcagaaccu

SEQ ID NO: 130525 - RNA, 64 nt, Human
cacacuuguaucuuuuaccuucccuuugccccaugcccccaaacugcuuaggucuucucugucc

SEQ ID NO: 130526 - RNA, 64 nt, Human
cagucgaacugggggcuagccaccuccucguccagcccccaaaccuccccuuccuuucccccuc

SEQ ID NO: 130527 - RNA, 64 nt, Human
agaaacccagcccugccccugccuccugcauccagcccccaacauggugccaaagcuuccagaa

SEQ ID NO: 130528 - RNA, 64 nt, Human
cuuagauucugguggagagaagugagaauaggcagcccccaaauaaaaaauauucauggauuua

SEQ ID NO: 130529 - RNA, 64 nt, Human
uuccuaagcagcuggccugaccucuuccugcccagcccccaacccagucucuggccucugccca

SEQ ID NO: 130530 - RNA, 64 nt, Human
cugcuccccgggcagccucccgccgaggggcccagcccccaacccacaggcacggaggggcauc

SEQ ID NO: 130531 - RNA, 64 nt, Human
ccaaagccuucauuuuaacagauggggaaagugagcccccaagaugggaaagaaccacacagcu

SEQ ID NO: 130532 - RNA, 64 nt, Human
uugaaaacagugugaugcaauuacugcuguucuagcccccaaagaguuuucugugcaaaaucuu

SEQ ID NO: 130533 - RNA, 64 nt, Human
ccugccacauuuauaaaauaaugguuuuaucccugcccccaaaucaucagguuccucggguuua

SEQ ID NO: 130534 - RNA, 64 nt, Human
guaguacuuuuguguaaaacuugucuuccccuuugcccccaacuuuuuuuuuuuuuuuuuugua

SEQ ID NO: 130535 - RNA, 64 nt, Human
aauagaaaaaucuaauucaauaaacucuguaucagcccccaacauauuauuuuucauuauuugg

SEQ ID NO: 130536 - RNA, 64 nt, Human
ggcaaggagcccggguuaaaauaucccccuauucgcccccaaaaugcaauaaaagaagauaaaa

SEQ ID NO: 130537 - RNA, 64 nt, Human
aguaagggaaccccaggcaggcggcccugccacagcccccaaagacacuggccuccugcuccag

SEQ ID NO: 130538 - RNA, 64 nt, Human
gcuggccuccagucccaucucccccaacacaugugcccccaaaaagugagccaggcaccucugu

SEQ ID NO: 130539 - RNA, 64 nt, Human
gugcugggauuacaggcaugagccacggcgccuggcccccaaaugcucuugaaccggaaaccca

SEQ ID NO: 130540 - RNA, 64 nt, Human
guuuggccacgcccugggccugggccacuccucagcccccaacuccauuaugaggcccuucuac

SEQ ID NO: 130541 - RNA, 64 nt, Human
uuaucugugccguccugacuagaagguugucugggcccccaaauuccaagucccaguauagcca

SEQ ID NO: 130542 - RNA, 64 nt, Human
ccaacccugcaaucaccuugaucuugggcuuucagcccccaaaggugugagaaaauaaacuucg

SEQ ID NO: 130543 - RNA, 64 nt, Human
ccacucucugaaacaacacagucacucuagcaaggcccccaaagggcccugguuuuacauuaca

SEQ ID NO: 130544 - RNA, 64 nt, Human
cccagggcgcugggucugguggggacgcgggggugcccccaauggugcagcugcagcagucacc

SEQ ID NO: 130545 - RNA, 64 nt, Human
aaccacgccuauuaagcggagguguucccaggcugcccccaacacuccaggcccugcccccucc

SEQ ID NO: 130546 - RNA, 64 nt, Human
ggagugaguugauagcacagacccugcccugugggcccccaaauggaaaugggcagagcagaga

SEQ ID NO: 130547 - RNA, 64 nt, Human
agggccugacacucuccuaagagguucucuccaagcccccaaauagcuccaggcgcccucggcc

SEQ ID NO: 130548 - RNA, 54 nt, Human
uggcuuuugcugaggugugacauggcccccaagcagagcggguaaagugcaaug

SEQ ID NO: 130549 - RNA, 64 nt, Human
ccugggauccugcuggcuugggcccggcucuggggcccccaaggccgaagggugacaaaauaca

SEQ ID NO: 130550 - RNA, 64 nt, Human
gggucccuccaagugguccacaagcuucuguccugcccccaaggaggcagccuggaccacuccu

SEQ ID NO: 130551 - RNA, 64 nt, Human
caggaugggcugcuccugggccuggugagcuacugcccccaaccuacccucuagaggggcuggg

SEQ ID NO: 130552 - RNA, 64 nt, Human
agaugucucuuuuguguuuuggccaccuggggccgcccccaaccuccccaccccaagagggguc

SEQ ID NO: 130553 - RNA, 64 nt, Human
acauagcagcccuucagauaaucacaaccacuuugcccccaaguuuucagguuaaguagcauga

SEQ ID NO: 130554 - RNA, 64 nt, Human
agccuggagaaagggagcaagcugcccccuccuugcccccaaggaugaggcuggacugaggcaa

SEQ ID NO: 130555 - RNA, 64 nt, Human
ccugugagccuugacugggauucaugauguggaggcccccaacuuccagaagcagcugguacuc

SEQ ID NO: 130556 - RNA, 64 nt, Human
gaugagggaaaagaaaaagauugagagaauuugugcccccaaccauuuccucagacucuaagaa

SEQ ID NO: 130557 - RNA, 64 nt, Human
aaauuuaugaagucugaggggccccagcucacgggcccccaacuuccagcucugcccuguguuu

SEQ ID NO: 130558 - RNA, 64 nt, Human
uucugccacgugguggcccagcuccucacccagggcccccaaagagcaagcgucugggcaagag

SEQ ID NO: 130559 - RNA, 64 nt, Human
gauaaguugguccucccucugccuuuccucucaagcccccaaagagcaaaggcaacagcaagac

SEQ ID NO: 130560 - RNA, 64 nt, Human
uccacagcagucugagcuggcaggucauggagcagcccccaaagagcuguggcuggggggauga

SEQ ID NO: 130561 - RNA, 64 nt, Human
uuggauaccaaagguuucucauguuaauuucucagcccccaaagaagcaucuuacuccugaacc

SEQ ID NO: 130562 - RNA, 64 nt, Human
aggcaucccaguucuaaggcugcugcuaauuacagcccccaaccuccaacccaccagcugaccu

SEQ ID NO: 130563 - RNA, 64 nt, Human
gacagggagcagcccccgggccgcuggcuggugggcccccaaugacacccaugccagagaggug

SEQ ID NO: 130564 - RNA, 64 nt, Human
auguagacgccacccugcccacccccgggauccugcccccaagucauuuccguccccccccagg

SEQ ID NO: 130565 - RNA, 64 nt, Human
guugaugcccagggucacucuugcuacccgcugggcccccaaacccccgcugccucucuuccuu

SEQ ID NO: 130566 - RNA, 64 nt, Human
aucgcuuguuuccaccuccugggccggggcucuggcccccaacgugucuaggagagcuuucucc

SEQ ID NO: 130567 - RNA, 64 nt, Human
cgcucacuucgcucgcuccgcgucccccaugccagcccccaacgcagggcgcccggcgaagcca

SEQ ID NO: 130568 - RNA, 64 nt, Human
ugcaguggcaccaucuuggcucacuucaaccuccgcccccaagguucaagugauucuccugccu

SEQ ID NO: 130569 - RNA, 64 nt, Human
uggcugggcaagugggaaccacuaucucuugggagcccccaaaagcugggaaaugcuggaggaa

SEQ ID NO: 130570 - RNA, 64 nt, Human
gagcccuugcuccuuaggauccccgcccccaccugcccccaaugcacacacagacccaccgggg

SEQ ID NO: 130571 - RNA, 64 nt, Human
caguguccccugccccccucuucccccaccccaugcccccaauucuguggcgcauccagauugu

SEQ ID NO: 130572 - RNA, 64 nt, Human
gaggguacagucccuuaaccugccacgggagggggcccccaaacuuucuuccccccacacuucu

SEQ ID NO: 130573 - RNA, 64 nt, Human
gaggaguuagguucaucacaaauacacacacacugcccccaacccucugccguugccucucuca

SEQ ID NO: 130574 - RNA, 64 nt, Human
ugucuuccugaacuccagccucugagacagaauggcccccaaauuaaaauaccaaaaugaagcu

SEQ ID NO: 130575 - RNA, 64 nt, Human
uaaaguuucucagagccugucacaaaggccggcugcccccaaaggucucaacuccucaucauuu

SEQ ID NO: 130576 - RNA, 64 nt, Human
cucagcuucccaucucugcccgcuugcuuccccugcccccaaccccugccuccucuauccccca

SEQ ID NO: 130577 - RNA, 64 nt, Human
ggagccugcagucacuggcuuggcuuuacuuugagcccccaaccccccucucccagcccuggua

SEQ ID NO: 130578 - RNA, 64 nt, Human
ggccaagggccauggggaagauggagcaaaccuagcccccaagccggugggcuagaaaguacaa

SEQ ID NO: 130579 - RNA, 64 nt, Human
cccugccggggccugcuggccccuguaaggucccgcccccaaagacccuggggccagcggggcc

SEQ ID NO: 130580 - RNA, 64 nt, Human
uuauugccuaccacauguuaugggcugaauaauggcccccaaagauaucuguguccuaauccuc

SEQ ID NO: 130581 - RNA, 64 nt, Human
agaggguggucacagcauguguccucugacguaugcccccaaagcucuccagccagacugaggu

SEQ ID NO: 130582 - RNA, 64 nt, Human
ccucuccugucagugccggcccacccaccagcaggcccccaacccccaggcagcccggcagagg

SEQ ID NO: 130583 - RNA, 64 nt, Human
gcucacggggccuggggccauggcuuucuucucggcccccaaaugccuuuccuggaguggcuaa

SEQ ID NO: 130584 - RNA, 64 nt, Human
aaggugggucuuaaaacagaccaaaccccgccccgcccccaacaacucugcuuuuagggaggcc

SEQ ID NO: 130585 - RNA, 61 nt, Human
ggcccgcggucacgcucuagacucccgagaggcccccaaauccuagcuccaguuccccggu

SEQ ID NO: 130586 - RNA, 64 nt, Human
guguccugaggcugauggacagugaccgccacuggcccccaacaugaccacacgugggugcuga

SEQ ID NO: 130587 - RNA, 64 nt, Human
ccccagcaaguccucuggcaagccggaggacgcagcccccaagaccagcggacagcgccagaag

SEQ ID NO: 130588 - RNA, 64 nt, Human
aaggcgacaggaucaguccuucucucggguucuggcccccaaggucagagcaagcaucuuccug

SEQ ID NO: 130589 - RNA, 64 nt, Human
agcacacaggagccccccacaacgaagaguuagugcccccaaacgucacuguugcugagguuga

SEQ ID NO: 130590 - RNA, 64 nt, Human
ccccacccugggccgagcccccaccccucccugggcccccaagugagauugcacauuuaacuac

SEQ ID NO: 130591 - RNA, 64 nt, Human
gcgcgccccugcggcucccgaggguccaggccccgcccccaaaggaccaggacucgccccaaag

SEQ ID NO: 130592 - RNA, 64 nt, Human
agaggccggcuggagccaggcccccucgcacgcagcccccaaaucauggacgcaccugugggga

SEQ ID NO: 130593 - RNA, 64 nt, Human
gaacaucuguccccaagccagcuccacugcccaggcccccaagagggcagcuccagaagcugcc

SEQ ID NO: 130594 - RNA, 64 nt, Human
gccccgggacccagcagagcugggggagggaucagcccccaaagaaaugggggugcaugcuggg

SEQ ID NO: 130595 - RNA, 64 nt, Human
ccccaacuccaugccugucuccaaucccaacccugcccccaaucuccccucaacuccaauccau

SEQ ID NO: 130596 - RNA, 64 nt, Human
ggguccuuccagacagucucagccucuccccgccgcccccaacaggcugucaaacaaaaccgga

SEQ ID NO: 130597 - RNA, 64 nt, Human
gccccuccgcagccccuucccuugcucggggaaagcccccaauucugcccacacccauuuauuu

SEQ ID NO: 130598 - RNA, 64 nt, Human
cuuuucuuuccuuccuuccuucuuuuuuguuuuugcccccaauucugcccauacccauuucuuu

SEQ ID NO: 130599 - RNA, 56 nt, Human
agaagcaggagcagcccugacccccugcccccaacuccauuauuuauuacggagcu

SEQ ID NO: 130600 - RNA, 64 nt, Human
cccugcccugcccugccccguguccaccucccuugcccccaagccuguccccagugccccuccc

SEQ ID NO: 130601 - RNA, 64 nt, Human
cuucccauucucuuuggcaagaaguccccuucucgcccccaaaccagcaagggacucccccacc

SEQ ID NO: 130602 - RNA, 64 nt, Human
guacaccccaacagcacccucuccagaugggagugcccccaacagcacccucuccagaugagag

SEQ ID NO: 130603 - RNA, 64 nt, Human
gccguggcgggacagcgugggcaggcucauuucugcccccaacccgggccccaggacaggucag

SEQ ID NO: 130604 - RNA, 64 nt, Human
ggggguguggaaagagcaggcuuccaggagagaggcccccaaacccucuggccggguaauaggc

SEQ ID NO: 130605 - RNA, 55 nt, Human
ccagcagcugcagcugcuagagauggcccccaaccccccacccaccccucuccug

SEQ ID NO: 130606 - RNA, 64 nt, Human
gugucgcaucuucuccagcgcugggcccucccuugcccccaagcucaagaagggggcacugccc

SEQ ID NO: 130607 - RNA, 64 nt, Human
guccucaguaagguuuuccauuuaaugaaaagcagcccccaaaaucauuuucuuuucuaacaaa

SEQ ID NO: 130608 - RNA, 64 nt, Human
augcucacagcgcccgacacaacccccucccgccgcccccaaccacccagggccaccaucagac

SEQ ID NO: 130609 - RNA, 64 nt, Human
cgggaaccccaacagggccccgggagggaacccugcccccaaccccccacagcaaggcuguaca

SEQ ID NO: 130610 - RNA, 64 nt, Human
ccuuaggggugaccugggcccaagucucucaucagcccccaauccccuggguaccaggcuucug

SEQ ID NO: 130611 - RNA, 64 nt, Human
cucccuccccaaaacuggggucccagcaacccuggcccccaaccccagcaaaucucuaacaccu

SEQ ID NO: 130612 - RNA, 64 nt, Human
ugcuguuuggggaaaucucugguguugggaacaggcccccaaaucuggccauaaacuggcccca

SEQ ID NO: 130613 - RNA, 64 nt, Human
gccaggggcggaggugggugucccccaggucucagcccccaaggcugcccccucagcagaggca

SEQ ID NO: 130614 - RNA, 64 nt, Human
cccuccuacagcuguaacuccccuccuguccucugcccccaaggucuacucccuccucacccca

SEQ ID NO: 130615 - RNA, 64 nt, Human
gacauggcugauggcugcggaugcuggaaccuuggcccccaaacucuggggccgaucagcugcu

SEQ ID NO: 130616 - RNA, 64 nt, Human
aaggucucucuccuuggucacccagccuggcuuugcccccaaagucucccuuccccuagugacc

SEQ ID NO: 130617 - RNA, 64 nt, Human
cucccaccccaaacuccaaccuguaucagaugcagcccccaagcccuuagacucuaagcccagu

SEQ ID NO: 130618 - RNA, 64 nt, Human
cuaagcaacuggggccaucccccccauuagaggggcccccaaaacuugguuggagagcugaaca

SEQ ID NO: 130619 - RNA, 64 nt, Human
ccauguucaaggguaccggaagagaagggugucugcccccaaccuccccugugggugucacugg

SEQ ID NO: 130620 - RNA, 64 nt, Human
cccaaccccuccucccucagacucagagguccaggcccccaaccccuccuuccccagacccaga

SEQ ID NO: 130621 - RNA, 64 nt, Human
cccagccccuccucccucagacccagggguccaggcccccaaccccuccucccucagacucaga

SEQ ID NO: 130622 - RNA, 64 nt, Human
caccuacugagcccaccgucagcggggcgcgcacgcccccaaaccagcuguuuacauacaggaa

SEQ ID NO: 130623 - RNA, 64 nt, Human
acucuugcaauccacaaucugacauucucaggaagcccccaaguugauauuucuauuuccugga

SEQ ID NO: 130624 - RNA, 64 nt, Human
gagacuccaucucaaaaaaaaggagacuucaugugcccccaauuuuucacuauuguuauuugaa

SEQ ID NO: 130625 - RNA, 64 nt, Human
ggcacagguuggggcaauguucccuuguuggugggcccccaagcuggcaaggccucuuggcuga

SEQ ID NO: 130626 - RNA, 64 nt, Human
acaaguuccagcuggucuuuugggaguggccccugcccccaaagguggucugcuuuugcugggg

SEQ ID NO: 130627 - RNA, 64 nt, Human
gucauccaugcgugcacauaugggugcuggcagagcccccaaggacucuggccucucgaguucu

SEQ ID NO: 130628 - RNA, 64 nt, Human
ugucggccaggugaggucagcagccugggagagugcccccaagagaugagggcaccccguguuc

SEQ ID NO: 130629 - RNA, 64 nt, Human
ucagcugaaucucucugaccauuccucuacuggagcccccaaugaaagccgcaaaccuauaccc

SEQ ID NO: 130630 - RNA, 64 nt, Human
ggucccuggggaucugcauuucuaacaggcuccugcccccaagacugcucugguggaaaaucca

SEQ ID NO: 130631 - RNA, 64 nt, Human
uggacaucaaagcugagucacuggaccuagcugugcccccaaccuagauuggcagcaccacccc

SEQ ID NO: 130632 - RNA, 64 nt, Human
gaggaacauuuccucaguguagccuaacaaugcagcccccaaucuguuccuuuuuuuuuuugaa

SEQ ID NO: 130633 - RNA, 64 nt, Human
gaaaaguugugucucccuuagaugagaucuagacgcccccaaauccuugagauguggguauagc

SEQ ID NO: 130634 - RNA, 64 nt, Human
ggcaccccagcuaccccuucuuugcagggcuaaggcccccaaacauagccccugccccggagga

SEQ ID NO: 130635 - RNA, 64 nt, Human
gccaagaccugcuguguaaagugguccaaucccugcccccaaguccagauuccagccccucugu

SEQ ID NO: 130636 - RNA, 64 nt, Human
cagauaaggcagaacuaggagucuucacugcucugcccccaacucccggaggugucaccuuccu

SEQ ID NO: 130637 - RNA, 64 nt, Human
uccgagccugcuaccugguugccaaccuucccuagcccccaaaccgaagccaucugccaaauuc

SEQ ID NO: 130638 - RNA, 64 nt, Human
gauaagugagagggauucggguugcguguucacugcccccaauuccuaaagcaaguuagaaguu

SEQ ID NO: 130639 - RNA, 64 nt, Human
ggcccuuucaccccucuucccaccaacucucucugcccccaaaagugucaaggggcccuaggaa

SEQ ID NO: 130640 - RNA, 64 nt, Human
aaauagggagaugcaggaagugggggcccauggggcccccaagaagcggacucuccaaggggua

SEQ ID NO: 130641 - RNA, 64 nt, Human
acgaaggcaaugcugcucccugaguccaguccccgcccccaaacccagcccaggugccuucagc

SEQ ID NO: 130642 - RNA, 64 nt, Human
ccaucacccagcaccccagaucaccgccaggccagcccccaaugguccccuuacggacaggucc

SEQ ID NO: 130643 - RNA, 64 nt, Human
gcuggcaccaaagagcuugggcccgugcugaccagcccccaaggcccucuggccggaccaugcu

SEQ ID NO: 130644 - RNA, 64 nt, Human
ggcuggcccgggccaugggcugcgcaaaucaccagcccccaacccagggaggaacuggccccuc

SEQ ID NO: 130645 - RNA, 64 nt, Human
uguguggccuuugacugaaaucagccagcccauggcccccaauaaaggcagcugccucugcucc

SEQ ID NO: 130646 - RNA, 64 nt, Human
gagagggcuuguuggugagggcugacuccugggggcccccaaggcuccccuccuguggggaggc

SEQ ID NO: 130647 - RNA, 64 nt, Human
gugcccugcuggaggacagaggggcaccucagccgcccccaagcccagagcacagcaauaaggu

SEQ ID NO: 130648 - RNA, 64 nt, Human
cccuagacgcugcuaggagggggggcccuccugggcccccaauaccccuccgcuugccgcugcu

SEQ ID NO: 130649 - RNA, 64 nt, Human
cacugaggauucuugcccccuuguggugcccgcugcccccaaccuucaggcugccagaugcucc

SEQ ID NO: 130650 - RNA, 64 nt, Human
aggggggggaacccaaggcacaggccccgccccugcccccaagcagcacugggcuacuggcuca

SEQ ID NO: 130651 - RNA, 64 nt, Human
auauugguaagacuaguaccugccagggagaggugcccccaagugaagggguacaguggcaccu

SEQ ID NO: 130652 - RNA, 64 nt, Human
cucccucgcucucaaguaccugcccgagguguuugcccccaacgccccggaugugcugagcugc

SEQ ID NO: 130653 - RNA, 64 nt, Human
aacaacgagcagaaggcccuggcgacugggcugagcccccaagugaaacugagguucaggagac

SEQ ID NO: 130654 - RNA, 64 nt, Human
ugggcuucagguaccuaaaacagauccaggaccugcccccaacuggccucccugagaugaaccu

SEQ ID NO: 130655 - RNA, 64 nt, Human
gcggcuggagggaugccacaccccucacagggcagcccccaacuacaucuucccugcuuacucu

SEQ ID NO: 130656 - RNA, 64 nt, Human
ugcucugugcccacccuccacucuccucuuccaggcccccaaccccccauuucuuccccaccaa

SEQ ID NO: 130657 - RNA, 64 nt, Human
cagggaggccaucuggggcuccuucuccaccccagcccccaaagcagcccuucccccagugccc

SEQ ID NO: 130658 - RNA, 64 nt, Human
cagcagucuccccagccugcccugcucaggccuugcccccaaaccuguacugucccggaggagg

SEQ ID NO: 130659 - RNA, 64 nt, Human
uccaccugacacaaccguccccggccccugccccgcccccaagcucggaucacaugaaggagac

SEQ ID NO: 130660 - RNA, 64 nt, Human
caccuucccaacacugcacugccgaaguguagcggcccccaaaccuugcucucaucaccagcua

SEQ ID NO: 130661 - RNA, 64 nt, Human
ccuugcuacccuaagccuggccuggccuggccuggcccccaauggucagaagagccaucccaug

SEQ ID NO: 130662 - RNA, 64 nt, Human
aagagucaagugaccaucauuucaccugcugcuugcccccaauaguagucucugugaggccuua

SEQ ID NO: 130663 - RNA, 64 nt, Human
uguacuauucauugauucagugaugugaaauugagcccccaaaagguuguuucugaagcucgag

SEQ ID NO: 130664 - RNA, 64 nt, Human
aucaugaaugauaagcuguuucugagggaugccagcccccaagagacucagagugccuucucca

SEQ ID NO: 130665 - RNA, 64 nt, Human
cagauguggaggcccagggaauagacccucaagagcccccaagagacaggagagacuccgaacu

SEQ ID NO: 130666 - RNA, 64 nt, Human
acuaucuuaucucagauauuugcacccccaaucugcccccaacucccaaaagcuagaacacugc

SEQ ID NO: 130667 - RNA, 64 nt, Human
aaugacaguugaauaaucaaaaauauuuuauuaggcccccaaaauuuaauagauaucuauuucu

SEQ ID NO: 130668 - RNA, 64 nt, Human
gggacccaugccuuucugaagcaggacugaaggggcccccaagugcccacccccggcgguuaug

SEQ ID NO: 130669 - RNA, 64 nt, Human
uuagcucaauuucugggccugaggugcucagacugcccccaagaucaaaucucuccuggcugua

SEQ ID NO: 130670 - RNA, 64 nt, Human
cagugagaggcggugggcugacugggaaggagaggcccccaaccuccucaggauuugcacgugu

SEQ ID NO: 130671 - RNA, 64 nt, Human
ggugcccugagucuggggcccgugccagccggcagcccccaagccugccccgcuacccaagcag

SEQ ID NO: 130672 - RNA, 64 nt, Human
gggaaaacugaggccuggagguaggaagggacuugcccccaaggccgcacacugaguuaacagc

SEQ ID NO: 130673 - RNA, 64 nt, Human; identical to SEQ ID NO: 130024

SEQ ID NO: 130674 - RNA, 64 nt, Human; identical to SEQ ID NO: 130025

SEQ ID NO: 130675 - RNA, 64 nt, Human; identical to SEQ ID NO: 130026

SEQ ID NO: 130676 - RNA, 64 nt, Human; identical to SEQ ID NO: 130027

SEQ ID NO: 130677 - RNA, 64 nt, Human; identical to SEQ ID NO: 130028

SEQ ID NO: 130678 - RNA, 64 nt, Human; identical to SEQ ID NO: 130029

SEQ ID NO: 130679 - RNA, 64 nt, Human; identical to SEQ ID NO: 130030

SEQ ID NO: 130680 - RNA, 64 nt, Human; identical to SEQ ID NO: 130031

SEQ ID NO: 130681 - RNA, 64 nt, Human; identical to SEQ ID NO: 130032

SEQ ID NO: 130682 - RNA, 64 nt, Human; identical to SEQ ID NO: 130033

SEQ ID NO: 130683 - RNA, 64 nt, Human; identical to SEQ ID NO: 130034

SEQ ID NO: 130684 - RNA, 64 nt, Human; identical to SEQ ID NO: 130035

SEQ ID NO: 130685 - RNA, 64 nt, Human; identical to SEQ ID NO: 130036

SEQ ID NO: 130686 - RNA, 64 nt, Human; identical to SEQ ID NO: 130037

SEQ ID NO: 130687 - RNA, 64 nt, Human; identical to SEQ ID NO: 130038

SEQ ID NO: 130688 - RNA, 64 nt, Human; identical to SEQ ID NO: 130039

SEQ ID NO: 130689 - RNA, 64 nt, Human; identical to SEQ ID NO: 130040

SEQ ID NO: 130690 - RNA, 64 nt, Human; identical to SEQ ID NO: 130041

SEQ ID NO: 130691 - RNA, 64 nt, Human; identical to SEQ ID NO: 130042

SEQ ID NO: 130692 - RNA, 64 nt, Human; identical to SEQ ID NO: 130043

SEQ ID NO: 130693 - RNA, 56 nt, Human; identical to SEQ ID NO: 130044

SEQ ID NO: 130694 - RNA, 64 nt, Human; identical to SEQ ID NO: 130045

SEQ ID NO: 130695 - RNA, 64 nt, Human; identical to SEQ ID NO: 130046

SEQ ID NO: 130696 - RNA, 64 nt, Human; identical to SEQ ID NO: 130047

SEQ ID NO: 130697 - RNA, 64 nt, Human; identical to SEQ ID NO: 130048

SEQ ID NO: 130698 - RNA, 64 nt, Human; identical to SEQ ID NO: 130049

SEQ ID NO: 130699 - RNA, 64 nt, Human; identical to SEQ ID NO: 130050

SEQ ID NO: 130700 - RNA, 64 nt, Human; identical to SEQ ID NO: 130051

SEQ ID NO: 130701 - RNA, 64 nt, Human; identical to SEQ ID NO: 130052

SEQ ID NO: 130702 - RNA, 64 nt, Human; identical to SEQ ID NO: 130053

SEQ ID NO: 130703 - RNA, 64 nt, Human; identical to SEQ ID NO: 130054

SEQ ID NO: 130704 - RNA, 64 nt, Human; identical to SEQ ID NO: 130055

SEQ ID NO: 130705 - RNA, 64 nt, Human; identical to SEQ ID NO: 130056

SEQ ID NO: 130706 - RNA, 64 nt, Human; identical to SEQ ID NO: 130057

SEQ ID NO: 130707 - RNA, 64 nt, Human; identical to SEQ ID NO: 130058

SEQ ID NO: 130708 - RNA, 64 nt, Human; identical to SEQ ID NO: 130059

SEQ ID NO: 130709 - RNA, 64 nt, Human; identical to SEQ ID NO: 130060

SEQ ID NO: 130710 - RNA, 64 nt, Human; identical to SEQ ID NO: 130061

SEQ ID NO: 130711 - RNA, 64 nt, Human; identical to SEQ ID NO: 130062

SEQ ID NO: 130712 - RNA, 64 nt, Human; identical to SEQ ID NO: 130063

SEQ ID NO: 130713 - RNA, 64 nt, Human; identical to SEQ ID NO: 130064

SEQ ID NO: 130714 - RNA, 64 nt, Human; identical to SEQ ID NO: 130065

SEQ ID NO: 130715 - RNA, 64 nt, Human; identical to SEQ ID NO: 130066

SEQ ID NO: 130716 - RNA, 64 nt, Human; identical to SEQ ID NO: 130067

SEQ ID NO: 130717 - RNA, 64 nt, Human; identical to SEQ ID NO: 130068

SEQ ID NO: 130718 - RNA, 51 nt, Human; identical to SEQ ID NO: 130069

SEQ ID NO: 130719 - RNA, 64 nt, Human; identical to SEQ ID NO: 130070

SEQ ID NO: 130720 - RNA, 64 nt, Human; identical to SEQ ID NO: 130071

SEQ ID NO: 130721 - RNA, 64 nt, Human; identical to SEQ ID NO: 130072

SEQ ID NO: 130722 - RNA, 64 nt, Human; identical to SEQ ID NO: 130073

SEQ ID NO: 130723 - RNA, 64 nt, Human; identical to SEQ ID NO: 130074

SEQ ID NO: 130724 - RNA, 64 nt, Human; identical to SEQ ID NO: 130075

SEQ ID NO: 130725 - RNA, 64 nt, Human; identical to SEQ ID NO: 130076

SEQ ID NO: 130726 - RNA, 64 nt, Human; identical to SEQ ID NO: 130077

SEQ ID NO: 130727 - RNA, 64 nt, Human; identical to SEQ ID NO: 130078

SEQ ID NO: 130728 - RNA, 64 nt, Human; identical to SEQ ID NO: 130079

SEQ ID NO: 130729 - RNA, 64 nt, Human; identical to SEQ ID NO: 130080

SEQ ID NO: 130730 - RNA, 64 nt, Human; identical to SEQ ID NO: 130081

SEQ ID NO: 130731 - RNA, 64 nt, Human; identical to SEQ ID NO: 130082

SEQ ID NO: 130732 - RNA, 64 nt, Human; identical to SEQ ID NO: 130083

SEQ ID NO: 130733 - RNA, 64 nt, Human; identical to SEQ ID NO: 130084

SEQ ID NO: 130734 - RNA, 64 nt, Human; identical to SEQ ID NO: 130085

SEQ ID NO: 130735 - RNA, 64 nt, Human; identical to SEQ ID NO: 130086

SEQ ID NO: 130736 - RNA, 64 nt, Human; identical to SEQ ID NO: 130087

SEQ ID NO: 130737 - RNA, 64 nt, Human; identical to SEQ ID NO: 130088

SEQ ID NO: 130738 - RNA, 64 nt, Human; identical to SEQ ID NO: 130089

SEQ ID NO: 130739 - RNA, 64 nt, Human; identical to SEQ ID NO: 130090

SEQ ID NO: 130740 - RNA, 64 nt, Human; identical to SEQ ID NO: 130091

SEQ ID NO: 130741 - RNA, 64 nt, Human; identical to SEQ ID NO: 130092

SEQ ID NO: 130742 - RNA, 64 nt, Human; identical to SEQ ID NO: 130093

SEQ ID NO: 130743 - RNA, 64 nt, Human; identical to SEQ ID NO: 130094

SEQ ID NO: 130744 - RNA, 64 nt, Human; identical to SEQ ID NO: 130095

SEQ ID NO: 130745 - RNA, 64 nt, Human; identical to SEQ ID NO: 130096

SEQ ID NO: 130746 - RNA, 64 nt, Human; identical to SEQ ID NO: 130097

SEQ ID NO: 130747 - RNA, 64 nt, Human; identical to SEQ ID NO: 130098

SEQ ID NO: 130748 - RNA, 64 nt, Human; identical to SEQ ID NO: 130099

SEQ ID NO: 130749 - RNA, 64 nt, Human; identical to SEQ ID NO: 130100

SEQ ID NO: 130750 - RNA, 64 nt, Human; identical to SEQ ID NO: 130101

SEQ ID NO: 130751 - RNA, 64 nt, Human; identical to SEQ ID NO: 130102

SEQ ID NO: 130752 - RNA, 64 nt, Human; identical to SEQ ID NO: 130103

SEQ ID NO: 130753 - RNA, 64 nt, Human; identical to SEQ ID NO: 130104

SEQ ID NO: 130754 - RNA, 64 nt, Human; identical to SEQ ID NO: 130105

SEQ ID NO: 130755 - RNA, 64 nt, Human; identical to SEQ ID NO: 130106

SEQ ID NO: 130756 - RNA, 64 nt, Human; identical to SEQ ID NO: 130107

SEQ ID NO: 130757 - RNA, 64 nt, Human; identical to SEQ ID NO: 130108

SEQ ID NO: 130758 - RNA, 64 nt, Human; identical to SEQ ID NO: 130109

SEQ ID NO: 130759 - RNA, 64 nt, Human; identical to SEQ ID NO: 130110

SEQ ID NO: 130760 - RNA, 64 nt, Human; identical to SEQ ID NO: 130111

SEQ ID NO: 130761 - RNA, 64 nt, Human; identical to SEQ ID NO: 130112

SEQ ID NO: 130762 - RNA, 64 nt, Human; identical to SEQ ID NO: 130113

SEQ ID NO: 130763 - RNA, 64 nt, Human; identical to SEQ ID NO: 130114

SEQ ID NO: 130764 - RNA, 64 nt, Human; identical to SEQ ID NO: 130115

SEQ ID NO: 130765 - RNA, 64 nt, Human; identical to SEQ ID NO: 130116

SEQ ID NO: 130766 - RNA, 64 nt, Human; identical to SEQ ID NO: 130117

SEQ ID NO: 130767 - RNA, 64 nt, Human; identical to SEQ ID NO: 130118

SEQ ID NO: 130768 - RNA, 64 nt, Human; identical to SEQ ID NO: 130119

SEQ ID NO: 130769 - RNA, 64 nt, Human; identical to SEQ ID NO: 130120

SEQ ID NO: 130770 - RNA, 64 nt, Human; identical to SEQ ID NO: 130121

SEQ ID NO: 130771 - RNA, 64 nt, Human; identical to SEQ ID NO: 130122

SEQ ID NO: 130772 - RNA, 64 nt, Human; identical to SEQ ID NO: 130123

SEQ ID NO: 130773 - RNA, 64 nt, Human; identical to SEQ ID NO: 130124

SEQ ID NO: 130774 - RNA, 64 nt, Human; identical to SEQ ID NO: 130125

SEQ ID NO: 130775 - RNA, 64 nt, Human; identical to SEQ ID NO: 130126

SEQ ID NO: 130776 - RNA, 64 nt, Human; identical to SEQ ID NO: 130127

SEQ ID NO: 130777 - RNA, 64 nt, Human; identical to SEQ ID NO: 130128

SEQ ID NO: 130778 - RNA, 64 nt, Human; identical to SEQ ID NO: 130129

SEQ ID NO: 130779 - RNA, 64 nt, Human; identical to SEQ ID NO: 130130

SEQ ID NO: 130780 - RNA, 64 nt, Human; identical to SEQ ID NO: 130131

SEQ ID NO: 130781 - RNA, 64 nt, Human; identical to SEQ ID NO: 130132

SEQ ID NO: 130782 - RNA, 64 nt, Human; identical to SEQ ID NO: 130133

SEQ ID NO: 130783 - RNA, 64 nt, Human; identical to SEQ ID NO: 130134

SEQ ID NO: 130784 - RNA, 64 nt, Human; identical to SEQ ID NO: 130135

SEQ ID NO: 130785 - RNA, 64 nt, Human; identical to SEQ ID NO: 130136

SEQ ID NO: 130786 - RNA, 64 nt, Human; identical to SEQ ID NO: 130137

SEQ ID NO: 130787 - RNA, 64 nt, Human; identical to SEQ ID NO: 130138

SEQ ID NO: 130788 - RNA, 64 nt, Human; identical to SEQ ID NO: 130139

SEQ ID NO: 130789 - RNA, 64 nt, Human; identical to SEQ ID NO: 130140

SEQ ID NO: 130790 - RNA, 64 nt, Human; identical to SEQ ID NO: 130141

SEQ ID NO: 130791 - RNA, 64 nt, Human; identical to SEQ ID NO: 130142

SEQ ID NO: 130792 - RNA, 64 nt, Human; identical to SEQ ID NO: 130143

SEQ ID NO: 130793 - RNA, 64 nt, Human; identical to SEQ ID NO: 130144

SEQ ID NO: 130794 - RNA, 64 nt, Human; identical to SEQ ID NO: 130145

SEQ ID NO: 130795 - RNA, 64 nt, Human; identical to SEQ ID NO: 130146

SEQ ID NO: 130796 - RNA, 64 nt, Human; identical to SEQ ID NO: 130147

SEQ ID NO: 130797 - RNA, 64 nt, Human; identical to SEQ ID NO: 130148

SEQ ID NO: 130798 - RNA, 64 nt, Human; identical to SEQ ID NO: 130149

SEQ ID NO: 130799 - RNA, 64 nt, Human; identical to SEQ ID NO: 130150

SEQ ID NO: 130800 - RNA, 64 nt, Human; identical to SEQ ID NO: 130151

SEQ ID NO: 130801 - RNA, 64 nt, Human; identical to SEQ ID NO: 130152

SEQ ID NO: 130802 - RNA, 64 nt, Human; identical to SEQ ID NO: 130153

SEQ ID NO: 130803 - RNA, 64 nt, Human; identical to SEQ ID NO: 130154

SEQ ID NO: 130804 - RNA, 64 nt, Human; identical to SEQ ID NO: 130155

SEQ ID NO: 130805 - RNA, 64 nt, Human; identical to SEQ ID NO: 130156

SEQ ID NO: 130806 - RNA, 64 nt, Human; identical to SEQ ID NO: 130157

SEQ ID NO: 130807 - RNA, 64 nt, Human; identical to SEQ ID NO: 130158

SEQ ID NO: 130808 - RNA, 64 nt, Human; identical to SEQ ID NO: 130159

SEQ ID NO: 130809 - RNA, 64 nt, Human; identical to SEQ ID NO: 130160

SEQ ID NO: 130810 - RNA, 64 nt, Human; identical to SEQ ID NO: 130161

SEQ ID NO: 130811 - RNA, 64 nt, Human; identical to SEQ ID NO: 130162

SEQ ID NO: 130812 - RNA, 64 nt, Human; identical to SEQ ID NO: 130163

SEQ ID NO: 130813 - RNA, 64 nt, Human; identical to SEQ ID NO: 130164

SEQ ID NO: 130814 - RNA, 64 nt, Human; identical to SEQ ID NO: 130165

SEQ ID NO: 130815 - RNA, 64 nt, Human; identical to SEQ ID NO: 130166

SEQ ID NO: 130816 - RNA, 64 nt, Human; identical to SEQ ID NO: 130167

SEQ ID NO: 130817 - RNA, 64 nt, Human; identical to SEQ ID NO: 130168

SEQ ID NO: 130818 - RNA, 64 nt, Human; identical to SEQ ID NO: 130169

SEQ ID NO: 130819 - RNA, 64 nt, Human; identical to SEQ ID NO: 130170

SEQ ID NO: 130820 - RNA, 64 nt, Human; identical to SEQ ID NO: 130171

SEQ ID NO: 130821 - RNA, 64 nt, Human; identical to SEQ ID NO: 130172

SEQ ID NO: 130822 - RNA, 64 nt, Human; identical to SEQ ID NO: 130173

SEQ ID NO: 130823 - RNA, 64 nt, Human; identical to SEQ ID NO: 130174

SEQ ID NO: 130824 - RNA, 64 nt, Human; identical to SEQ ID NO: 130175

SEQ ID NO: 130825 - RNA, 64 nt, Human; identical to SEQ ID NO: 130176

SEQ ID NO: 130826 - RNA, 64 nt, Human; identical to SEQ ID NO: 130177

SEQ ID NO: 130827 - RNA, 64 nt, Human; identical to SEQ ID NO: 130178

SEQ ID NO: 130828 - RNA, 64 nt, Human; identical to SEQ ID NO: 130179

SEQ ID NO: 130829 - RNA, 64 nt, Human; identical to SEQ ID NO: 130180

SEQ ID NO: 130830 - RNA, 64 nt, Human; identical to SEQ ID NO: 130181

SEQ ID NO: 130831 - RNA, 64 nt, Human; identical to SEQ ID NO: 130182

SEQ ID NO: 130832 - RNA, 64 nt, Human; identical to SEQ ID NO: 130183

SEQ ID NO: 130833 - RNA, 64 nt, Human; identical to SEQ ID NO: 130184

SEQ ID NO: 130834 - RNA, 64 nt, Human; identical to SEQ ID NO: 130185

SEQ ID NO: 130835 - RNA, 64 nt, Human; identical to SEQ ID NO: 130186

SEQ ID NO: 130836 - RNA, 64 nt, Human; identical to SEQ ID NO: 130187

SEQ ID NO: 130837 - RNA, 64 nt, Human; identical to SEQ ID NO: 130188

SEQ ID NO: 130838 - RNA, 64 nt, Human; identical to SEQ ID NO: 130189

SEQ ID NO: 130839 - RNA, 64 nt, Human; identical to SEQ ID NO: 130190

SEQ ID NO: 130840 - RNA, 64 nt, Human; identical to SEQ ID NO: 130191

SEQ ID NO: 130841 - RNA, 64 nt, Human; identical to SEQ ID NO: 130192

SEQ ID NO: 130842 - RNA, 64 nt, Human; identical to SEQ ID NO: 130193

SEQ ID NO: 130843 - RNA, 64 nt, Human; identical to SEQ ID NO: 130194

SEQ ID NO: 130844 - RNA, 64 nt, Human; identical to SEQ ID NO: 130195

SEQ ID NO: 130845 - RNA, 64 nt, Human; identical to SEQ ID NO: 130196

SEQ ID NO: 130846 - RNA, 64 nt, Human; identical to SEQ ID NO: 130197

SEQ ID NO: 130847 - RNA, 64 nt, Human; identical to SEQ ID NO: 130198

SEQ ID NO: 130848 - RNA, 64 nt, Human; identical to SEQ ID NO: 130199

SEQ ID NO: 130849 - RNA, 64 nt, Human; identical to SEQ ID NO: 130200

SEQ ID NO: 130850 - RNA, 64 nt, Human; identical to SEQ ID NO: 130201

SEQ ID NO: 130851 - RNA, 64 nt, Human; identical to SEQ ID NO: 130202

SEQ ID NO: 130852 - RNA, 64 nt, Human; identical to SEQ ID NO: 130203

SEQ ID NO: 130853 - RNA, 64 nt, Human; identical to SEQ ID NO: 130204

SEQ ID NO: 130854 - RNA, 64 nt, Human; identical to SEQ ID NO: 130205

SEQ ID NO: 130855 - RNA, 64 nt, Human; identical to SEQ ID NO: 130206

SEQ ID NO: 130856 - RNA, 64 nt, Human; identical to SEQ ID NO: 130207

SEQ ID NO: 130857 - RNA, 64 nt, Human; identical to SEQ ID NO: 130208

SEQ ID NO: 130858 - RNA, 64 nt, Human; identical to SEQ ID NO: 130209

SEQ ID NO: 130859 - RNA, 64 nt, Human; identical to SEQ ID NO: 130210

SEQ ID NO: 130860 - RNA, 64 nt, Human; identical to SEQ ID NO: 130211

SEQ ID NO: 130861 - RNA, 64 nt, Human; identical to SEQ ID NO: 130212

SEQ ID NO: 130862 - RNA, 64 nt, Human; identical to SEQ ID NO: 130213

SEQ ID NO: 130863 - RNA, 64 nt, Human; identical to SEQ ID NO: 130214

SEQ ID NO: 130864 - RNA, 64 nt, Human; identical to SEQ ID NO: 130215

SEQ ID NO: 130865 - RNA, 64 nt, Human; identical to SEQ ID NO: 130216

SEQ ID NO: 130866 - RNA, 64 nt, Human; identical to SEQ ID NO: 130217

SEQ ID NO: 130867 - RNA, 64 nt, Human; identical to SEQ ID NO: 130218

SEQ ID NO: 130868 - RNA, 64 nt, Human; identical to SEQ ID NO: 130219

SEQ ID NO: 130869 - RNA, 64 nt, Human; identical to SEQ ID NO: 130220

SEQ ID NO: 130870 - RNA, 64 nt, Human; identical to SEQ ID NO: 130221

SEQ ID NO: 130871 - RNA, 64 nt, Human; identical to SEQ ID NO: 130222

SEQ ID NO: 130872 - RNA, 64 nt, Human; identical to SEQ ID NO: 130223

SEQ ID NO: 130873 - RNA, 64 nt, Human; identical to SEQ ID NO: 130224

SEQ ID NO: 130874 - RNA, 64 nt, Human; identical to SEQ ID NO: 130225

SEQ ID NO: 130875 - RNA, 64 nt, Human; identical to SEQ ID NO: 130226

SEQ ID NO: 130876 - RNA, 64 nt, Human; identical to SEQ ID NO: 130227

SEQ ID NO: 130877 - RNA, 64 nt, Human; identical to SEQ ID NO: 130228

SEQ ID NO: 130878 - RNA, 64 nt, Human; identical to SEQ ID NO: 130229

SEQ ID NO: 130879 - RNA, 64 nt, Human; identical to SEQ ID NO: 130230

SEQ ID NO: 130880 - RNA, 64 nt, Human; identical to SEQ ID NO: 130231

SEQ ID NO: 130881 - RNA, 64 nt, Human; identical to SEQ ID NO: 130232

SEQ ID NO: 130882 - RNA, 64 nt, Human; identical to SEQ ID NO: 130233

SEQ ID NO: 130883 - RNA, 64 nt, Human; identical to SEQ ID NO: 130234

SEQ ID NO: 130884 - RNA, 64 nt, Human; identical to SEQ ID NO: 130235

SEQ ID NO: 130885 - RNA, 64 nt, Human; identical to SEQ ID NO: 130236

SEQ ID NO: 130886 - RNA, 64 nt, Human; identical to SEQ ID NO: 130237

SEQ ID NO: 130887 - RNA, 64 nt, Human; identical to SEQ ID NO: 130238

SEQ ID NO: 130888 - RNA, 64 nt, Human; identical to SEQ ID NO: 130239

SEQ ID NO: 130889 - RNA, 64 nt, Human; identical to SEQ ID NO: 130240

SEQ ID NO: 130890 - RNA, 64 nt, Human; identical to SEQ ID NO: 130241

SEQ ID NO: 130891 - RNA, 64 nt, Human; identical to SEQ ID NO: 130242

SEQ ID NO: 130892 - RNA, 64 nt, Human; identical to SEQ ID NO: 130243

SEQ ID NO: 130893 - RNA, 64 nt, Human; identical to SEQ ID NO: 130244

SEQ ID NO: 130894 - RNA, 64 nt, Human; identical to SEQ ID NO: 130245

SEQ ID NO: 130895 - RNA, 64 nt, Human; identical to SEQ ID NO: 130246

SEQ ID NO: 130896 - RNA, 64 nt, Human; identical to SEQ ID NO: 130247

SEQ ID NO: 130897 - RNA, 64 nt, Human; identical to SEQ ID NO: 130248

SEQ ID NO: 130898 - RNA, 64 nt, Human; identical to SEQ ID NO: 130249

SEQ ID NO: 130899 - RNA, 64 nt, Human; identical to SEQ ID NO: 130250

SEQ ID NO: 130900 - RNA, 64 nt, Human; identical to SEQ ID NO: 130251

SEQ ID NO: 130901 - RNA, 64 nt, Human; identical to SEQ ID NO: 130252

SEQ ID NO: 130902 - RNA, 64 nt, Human; identical to SEQ ID NO: 130253

SEQ ID NO: 130903 - RNA, 64 nt, Human; identical to SEQ ID NO: 130254

SEQ ID NO: 130904 - RNA, 64 nt, Human; identical to SEQ ID NO: 130255

SEQ ID NO: 130905 - RNA, 64 nt, Human; identical to SEQ ID NO: 130256

SEQ ID NO: 130906 - RNA, 64 nt, Human; identical to SEQ ID NO: 130257

SEQ ID NO: 130907 - RNA, 64 nt, Human; identical to SEQ ID NO: 130258

SEQ ID NO: 130908 - RNA, 64 nt, Human; identical to SEQ ID NO: 130259

SEQ ID NO: 130909 - RNA, 64 nt, Human; identical to SEQ ID NO: 130260

SEQ ID NO: 130910 - RNA, 64 nt, Human; identical to SEQ ID NO: 130261

SEQ ID NO: 130911 - RNA, 64 nt, Human; identical to SEQ ID NO: 130262

SEQ ID NO: 130912 - RNA, 64 nt, Human; identical to SEQ ID NO: 130263

SEQ ID NO: 130913 - RNA, 64 nt, Human; identical to SEQ ID NO: 130264

SEQ ID NO: 130914 - RNA, 64 nt, Human; identical to SEQ ID NO: 130265

SEQ ID NO: 130915 - RNA, 64 nt, Human; identical to SEQ ID NO: 130266

SEQ ID NO: 130916 - RNA, 64 nt, Human; identical to SEQ ID NO: 130267

SEQ ID NO: 130917 - RNA, 64 nt, Human; identical to SEQ ID NO: 130268

SEQ ID NO: 130918 - RNA, 64 nt, Human; identical to SEQ ID NO: 130269

SEQ ID NO: 130919 - RNA, 64 nt, Human; identical to SEQ ID NO: 130270

SEQ ID NO: 130920 - RNA, 64 nt, Human; identical to SEQ ID NO: 130271

SEQ ID NO: 130921 - RNA, 64 nt, Human; identical to SEQ ID NO: 130272

SEQ ID NO: 130922 - RNA, 64 nt, Human; identical to SEQ ID NO: 130273

SEQ ID NO: 130923 - RNA, 64 nt, Human; identical to SEQ ID NO: 130274

SEQ ID NO: 130924 - RNA, 64 nt, Human; identical to SEQ ID NO: 130275

SEQ ID NO: 130925 - RNA, 64 nt, Human; identical to SEQ ID NO: 130276

SEQ ID NO: 130926 - RNA, 64 nt, Human; identical to SEQ ID NO: 130277

SEQ ID NO: 130927 - RNA, 64 nt, Human; identical to SEQ ID NO: 130278

SEQ ID NO: 130928 - RNA, 64 nt, Human; identical to SEQ ID NO: 130279

SEQ ID NO: 130929 - RNA, 64 nt, Human; identical to SEQ ID NO: 130280

SEQ ID NO: 130930 - RNA, 64 nt, Human; identical to SEQ ID NO: 130281

SEQ ID NO: 130931 - RNA, 64 nt, Human; identical to SEQ ID NO: 130282

SEQ ID NO: 130932 - RNA, 64 nt, Human; identical to SEQ ID NO: 130283

SEQ ID NO: 130933 - RNA, 64 nt, Human; identical to SEQ ID NO: 130284

SEQ ID NO: 130934 - RNA, 64 nt, Human; identical to SEQ ID NO: 130285

SEQ ID NO: 130935 - RNA, 64 nt, Human; identical to SEQ ID NO: 130286

SEQ ID NO: 130936 - RNA, 64 nt, Human; identical to SEQ ID NO: 130287

SEQ ID NO: 130937 - RNA, 64 nt, Human; identical to SEQ ID NO: 130288

SEQ ID NO: 130938 - RNA, 64 nt, Human; identical to SEQ ID NO: 130289

SEQ ID NO: 130939 - RNA, 64 nt, Human; identical to SEQ ID NO: 130290

SEQ ID NO: 130940 - RNA, 64 nt, Human; identical to SEQ ID NO: 130291

SEQ ID NO: 130941 - RNA, 64 nt, Human; identical to SEQ ID NO: 130292

SEQ ID NO: 130942 - RNA, 64 nt, Human; identical to SEQ ID NO: 130293

SEQ ID NO: 130943 - RNA, 64 nt, Human; identical to SEQ ID NO: 130294

SEQ ID NO: 130944 - RNA, 64 nt, Human; identical to SEQ ID NO: 130295

SEQ ID NO: 130945 - RNA, 64 nt, Human; identical to SEQ ID NO: 130296

SEQ ID NO: 130946 - RNA, 64 nt, Human; identical to SEQ ID NO: 130297

SEQ ID NO: 130947 - RNA, 64 nt, Human; identical to SEQ ID NO: 130298

SEQ ID NO: 130948 - RNA, 64 nt, Human; identical to SEQ ID NO: 130299

SEQ ID NO: 130949 - RNA, 64 nt, Human; identical to SEQ ID NO: 130300

SEQ ID NO: 130950 - RNA, 64 nt, Human; identical to SEQ ID NO: 130301

SEQ ID NO: 130951 - RNA, 64 nt, Human; identical to SEQ ID NO: 130302

SEQ ID NO: 130952 - RNA, 64 nt, Human; identical to SEQ ID NO: 130303

SEQ ID NO: 130953 - RNA, 64 nt, Human; identical to SEQ ID NO: 130304

SEQ ID NO: 130954 - RNA, 64 nt, Human; identical to SEQ ID NO: 130305

SEQ ID NO: 130955 - RNA, 64 nt, Human; identical to SEQ ID NO: 130306

SEQ ID NO: 130956 - RNA, 64 nt, Human; identical to SEQ ID NO: 130307

SEQ ID NO: 130957 - RNA, 64 nt, Human; identical to SEQ ID NO: 130308

SEQ ID NO: 130958 - RNA, 64 nt, Human; identical to SEQ ID NO: 130309

SEQ ID NO: 130959 - RNA, 64 nt, Human; identical to SEQ ID NO: 130310

SEQ ID NO: 130960 - RNA, 64 nt, Human; identical to SEQ ID NO: 130311

SEQ ID NO: 130961 - RNA, 64 nt, Human; identical to SEQ ID NO: 130312

SEQ ID NO: 130962 - RNA, 64 nt, Human; identical to SEQ ID NO: 130313

SEQ ID NO: 130963 - RNA, 64 nt, Human; identical to SEQ ID NO: 130314

SEQ ID NO: 130964 - RNA, 64 nt, Human; identical to SEQ ID NO: 130315

SEQ ID NO: 130965 - RNA, 64 nt, Human; identical to SEQ ID NO: 130316

SEQ ID NO: 130966 - RNA, 64 nt, Human; identical to SEQ ID NO: 130317

SEQ ID NO: 130967 - RNA, 64 nt, Human; identical to SEQ ID NO: 130318

SEQ ID NO: 130968 - RNA, 64 nt, Human; identical to SEQ ID NO: 130319

SEQ ID NO: 130969 - RNA, 64 nt, Human; identical to SEQ ID NO: 130320

SEQ ID NO: 130970 - RNA, 64 nt, Human; identical to SEQ ID NO: 130321

SEQ ID NO: 130971 - RNA, 64 nt, Human; identical to SEQ ID NO: 130322

SEQ ID NO: 130972 - RNA, 64 nt, Human; identical to SEQ ID NO: 130323

SEQ ID NO: 130973 - RNA, 64 nt, Human; identical to SEQ ID NO: 130324

SEQ ID NO: 130974 - RNA, 64 nt, Human; identical to SEQ ID NO: 130325

SEQ ID NO: 130975 - RNA, 64 nt, Human; identical to SEQ ID NO: 130326

SEQ ID NO: 130976 - RNA, 64 nt, Human; identical to SEQ ID NO: 130327

SEQ ID NO: 130977 - RNA, 64 nt, Human; identical to SEQ ID NO: 130328

SEQ ID NO: 130978 - RNA, 64 nt, Human; identical to SEQ ID NO: 130329

SEQ ID NO: 130979 - RNA, 64 nt, Human; identical to SEQ ID NO: 130330

SEQ ID NO: 130980 - RNA, 64 nt, Human; identical to SEQ ID NO: 130331

SEQ ID NO: 130981 - RNA, 64 nt, Human; identical to SEQ ID NO: 130332

SEQ ID NO: 130982 - RNA, 64 nt, Human; identical to SEQ ID NO: 130333

SEQ ID NO: 130983 - RNA, 64 nt, Human; identical to SEQ ID NO: 130334

SEQ ID NO: 130984 - RNA, 64 nt, Human; identical to SEQ ID NO: 130335

SEQ ID NO: 130985 - RNA, 64 nt, Human; identical to SEQ ID NO: 130336

SEQ ID NO: 130986 - RNA, 64 nt, Human; identical to SEQ ID NO: 130337

SEQ ID NO: 130987 - RNA, 64 nt, Human; identical to SEQ ID NO: 130338

SEQ ID NO: 130988 - RNA, 64 nt, Human; identical to SEQ ID NO: 130339

SEQ ID NO: 130989 - RNA, 64 nt, Human; identical to SEQ ID NO: 130340

SEQ ID NO: 130990 - RNA, 64 nt, Human; identical to SEQ ID NO: 130341

SEQ ID NO: 130991 - RNA, 64 nt, Human; identical to SEQ ID NO: 130342

SEQ ID NO: 130992 - RNA, 64 nt, Human; identical to SEQ ID NO: 130343

SEQ ID NO: 130993 - RNA, 64 nt, Human; identical to SEQ ID NO: 130344

SEQ ID NO: 130994 - RNA, 64 nt, Human; identical to SEQ ID NO: 130345

SEQ ID NO: 130995 - RNA, 64 nt, Human; identical to SEQ ID NO: 130346

SEQ ID NO: 130996 - RNA, 64 nt, Human; identical to SEQ ID NO: 130347

SEQ ID NO: 130997 - RNA, 64 nt, Human; identical to SEQ ID NO: 130348

SEQ ID NO: 130998 - RNA, 64 nt, Human; identical to SEQ ID NO: 130349

SEQ ID NO: 130999 - RNA, 64 nt, Human; identical to SEQ ID NO: 130350

SEQ ID NO: 131000 - RNA, 64 nt, Human; identical to SEQ ID NO: 130351

SEQ ID NO: 131001 - RNA, 64 nt, Human; identical to SEQ ID NO: 130352

SEQ ID NO: 131002 - RNA, 64 nt, Human; identical to SEQ ID NO: 130353

SEQ ID NO: 131003 - RNA, 64 nt, Human; identical to SEQ ID NO: 130354

SEQ ID NO: 131004 - RNA, 64 nt, Human; identical to SEQ ID NO: 130355

SEQ ID NO: 131005 - RNA, 64 nt, Human; identical to SEQ ID NO: 130356

SEQ ID NO: 131006 - RNA, 64 nt, Human; identical to SEQ ID NO: 130357

SEQ ID NO: 131007 - RNA, 64 nt, Human; identical to SEQ ID NO: 130358

SEQ ID NO: 131008 - RNA, 64 nt, Human; identical to SEQ ID NO: 130359

SEQ ID NO: 131009 - RNA, 64 nt, Human; identical to SEQ ID NO: 130360

SEQ ID NO: 131010 - RNA, 64 nt, Human; identical to SEQ ID NO: 130361

SEQ ID NO: 131011 - RNA, 64 nt, Human; identical to SEQ ID NO: 130362

SEQ ID NO: 131012 - RNA, 64 nt, Human; identical to SEQ ID NO: 130363

SEQ ID NO: 131013 - RNA, 64 nt, Human; identical to SEQ ID NO: 130364

SEQ ID NO: 131014 - RNA, 64 nt, Human; identical to SEQ ID NO: 130365

SEQ ID NO: 131015 - RNA, 64 nt, Human; identical to SEQ ID NO: 130366

SEQ ID NO: 131016 - RNA, 64 nt, Human; identical to SEQ ID NO: 130367

SEQ ID NO: 131017 - RNA, 64 nt, Human; identical to SEQ ID NO: 130368

SEQ ID NO: 131018 - RNA, 64 nt, Human; identical to SEQ ID NO: 130369

SEQ ID NO: 131019 - RNA, 64 nt, Human; identical to SEQ ID NO: 130370

SEQ ID NO: 131020 - RNA, 64 nt, Human; identical to SEQ ID NO: 130371

SEQ ID NO: 131021 - RNA, 64 nt, Human; identical to SEQ ID NO: 130372

SEQ ID NO: 131022 - RNA, 64 nt, Human; identical to SEQ ID NO: 130373

SEQ ID NO: 131023 - RNA, 64 nt, Human; identical to SEQ ID NO: 130374

SEQ ID NO: 131024 - RNA, 64 nt, Human; identical to SEQ ID NO: 130375

SEQ ID NO: 131025 - RNA, 64 nt, Human; identical to SEQ ID NO: 130376

SEQ ID NO: 131026 - RNA, 64 nt, Human; identical to SEQ ID NO: 130377

SEQ ID NO: 131027 - RNA, 64 nt, Human; identical to SEQ ID NO: 130378

SEQ ID NO: 131028 - RNA, 64 nt, Human; identical to SEQ ID NO: 130379

SEQ ID NO: 131029 - RNA, 64 nt, Human; identical to SEQ ID NO: 130380

SEQ ID NO: 131030 - RNA, 64 nt, Human; identical to SEQ ID NO: 130381

SEQ ID NO: 131031 - RNA, 64 nt, Human; identical to SEQ ID NO: 130382

SEQ ID NO: 131032 - RNA, 64 nt, Human; identical to SEQ ID NO: 130383

SEQ ID NO: 131033 - RNA, 64 nt, Human; identical to SEQ ID NO: 130384

SEQ ID NO: 131034 - RNA, 64 nt, Human; identical to SEQ ID NO: 130385

SEQ ID NO: 131035 - RNA, 64 nt, Human; identical to SEQ ID NO: 130386

SEQ ID NO: 131036 - RNA, 64 nt, Human; identical to SEQ ID NO: 130387

SEQ ID NO: 131037 - RNA, 64 nt, Human; identical to SEQ ID NO: 130388

SEQ ID NO: 131038 - RNA, 64 nt, Human; identical to SEQ ID NO: 130389

SEQ ID NO: 131039 - RNA, 64 nt, Human; identical to SEQ ID NO: 130390

SEQ ID NO: 131040 - RNA, 64 nt, Human; identical to SEQ ID NO: 130391

SEQ ID NO: 131041 - RNA, 64 nt, Human; identical to SEQ ID NO: 130392

SEQ ID NO: 131042 - RNA, 64 nt, Human; identical to SEQ ID NO: 130393

SEQ ID NO: 131043 - RNA, 64 nt, Human; identical to SEQ ID NO: 130394

SEQ ID NO: 131044 - RNA, 64 nt, Human; identical to SEQ ID NO: 130395

SEQ ID NO: 131045 - RNA, 64 nt, Human; identical to SEQ ID NO: 130396

SEQ ID NO: 131046 - RNA, 64 nt, Human; identical to SEQ ID NO: 130397

SEQ ID NO: 131047 - RNA, 64 nt, Human; identical to SEQ ID NO: 130398

SEQ ID NO: 131048 - RNA, 64 nt, Human; identical to SEQ ID NO: 130399

SEQ ID NO: 131049 - RNA, 64 nt, Human; identical to SEQ ID NO: 130400

SEQ ID NO: 131050 - RNA, 64 nt, Human; identical to SEQ ID NO: 130401

SEQ ID NO: 131051 - RNA, 64 nt, Human; identical to SEQ ID NO: 130402

SEQ ID NO: 131052 - RNA, 64 nt, Human; identical to SEQ ID NO: 130403

SEQ ID NO: 131053 - RNA, 64 nt, Human; identical to SEQ ID NO: 130404

SEQ ID NO: 131054 - RNA, 64 nt, Human; identical to SEQ ID NO: 130405

SEQ ID NO: 131055 - RNA, 64 nt, Human; identical to SEQ ID NO: 130406

SEQ ID NO: 131056 - RNA, 64 nt, Human; identical to SEQ ID NO: 130407

SEQ ID NO: 131057 - RNA, 64 nt, Human; identical to SEQ ID NO: 130408

SEQ ID NO: 131058 - RNA, 64 nt, Human; identical to SEQ ID NO: 130409

SEQ ID NO: 131059 - RNA, 64 nt, Human; identical to SEQ ID NO: 130410

SEQ ID NO: 131060 - RNA, 64 nt, Human; identical to SEQ ID NO: 130411

SEQ ID NO: 131061 - RNA, 64 nt, Human; identical to SEQ ID NO: 130412

SEQ ID NO: 131062 - RNA, 64 nt, Human; identical to SEQ ID NO: 130413

SEQ ID NO: 131063 - RNA, 64 nt, Human; identical to SEQ ID NO: 130414

SEQ ID NO: 131064 - RNA, 64 nt, Human; identical to SEQ ID NO: 130415

SEQ ID NO: 131065 - RNA, 64 nt, Human; identical to SEQ ID NO: 130416

SEQ ID NO: 131066 - RNA, 64 nt, Human; identical to SEQ ID NO: 130417

SEQ ID NO: 131067 - RNA, 64 nt, Human; identical to SEQ ID NO: 130418

SEQ ID NO: 131068 - RNA, 64 nt, Human; identical to SEQ ID NO: 130419

SEQ ID NO: 131069 - RNA, 64 nt, Human; identical to SEQ ID NO: 130420

SEQ ID NO: 131070 - RNA, 64 nt, Human; identical to SEQ ID NO: 130421

SEQ ID NO: 131071 - RNA, 64 nt, Human; identical to SEQ ID NO: 130422

SEQ ID NO: 131072 - RNA, 64 nt, Human; identical to SEQ ID NO: 130423

SEQ ID NO: 131073 - RNA, 64 nt, Human; identical to SEQ ID NO: 130424

SEQ ID NO: 131074 - RNA, 64 nt, Human; identical to SEQ ID NO: 130425

SEQ ID NO: 131075 - RNA, 64 nt, Human; identical to SEQ ID NO: 130426

SEQ ID NO: 131076 - RNA, 64 nt, Human; identical to SEQ ID NO: 130427

SEQ ID NO: 131077 - RNA, 64 nt, Human; identical to SEQ ID NO: 130428

SEQ ID NO: 131078 - RNA, 64 nt, Human; identical to SEQ ID NO: 130429

SEQ ID NO: 131079 - RNA, 64 nt, Human; identical to SEQ ID NO: 130430

SEQ ID NO: 131080 - RNA, 64 nt, Human; identical to SEQ ID NO: 130431

SEQ ID NO: 131081 - RNA, 64 nt, Human; identical to SEQ ID NO: 130432

SEQ ID NO: 131082 - RNA, 64 nt, Human; identical to SEQ ID NO: 130433

SEQ ID NO: 131083 - RNA, 64 nt, Human; identical to SEQ ID NO: 130434

SEQ ID NO: 131084 - RNA, 64 nt, Human; identical to SEQ ID NO: 130435

SEQ ID NO: 131085 - RNA, 64 nt, Human; identical to SEQ ID NO: 130436

SEQ ID NO: 131086 - RNA, 64 nt, Human; identical to SEQ ID NO: 130437

SEQ ID NO: 131087 - RNA, 64 nt, Human; identical to SEQ ID NO: 130438

SEQ ID NO: 131088 - RNA, 64 nt, Human; identical to SEQ ID NO: 130439

SEQ ID NO: 131089 - RNA, 64 nt, Human; identical to SEQ ID NO: 130440

SEQ ID NO: 131090 - RNA, 64 nt, Human; identical to SEQ ID NO: 130441

SEQ ID NO: 131091 - RNA, 64 nt, Human; identical to SEQ ID NO: 130442

SEQ ID NO: 131092 - RNA, 64 nt, Human; identical to SEQ ID NO: 130443

SEQ ID NO: 131093 - RNA, 64 nt, Human; identical to SEQ ID NO: 130444

SEQ ID NO: 131094 - RNA, 64 nt, Human; identical to SEQ ID NO: 130445

SEQ ID NO: 131095 - RNA, 64 nt, Human; identical to SEQ ID NO: 130446

SEQ ID NO: 131096 - RNA, 64 nt, Human; identical to SEQ ID NO: 130447

SEQ ID NO: 131097 - RNA, 64 nt, Human; identical to SEQ ID NO: 130448

SEQ ID NO: 131098 - RNA, 64 nt, Human; identical to SEQ ID NO: 130449

SEQ ID NO: 131099 - RNA, 64 nt, Human; identical to SEQ ID NO: 130450

SEQ ID NO: 131100 - RNA, 64 nt, Human; identical to SEQ ID NO: 130451

SEQ ID NO: 131101 - RNA, 64 nt, Human; identical to SEQ ID NO: 130452

SEQ ID NO: 131102 - RNA, 64 nt, Human; identical to SEQ ID NO: 130453

SEQ ID NO: 131103 - RNA, 64 nt, Human; identical to SEQ ID NO: 130454

SEQ ID NO: 131104 - RNA, 64 nt, Human; identical to SEQ ID NO: 130455

SEQ ID NO: 131105 - RNA, 64 nt, Human; identical to SEQ ID NO: 130456

SEQ ID NO: 131106 - RNA, 64 nt, Human; identical to SEQ ID NO: 130457

SEQ ID NO: 131107 - RNA, 64 nt, Human; identical to SEQ ID NO: 130458

SEQ ID NO: 131108 - RNA, 64 nt, Human; identical to SEQ ID NO: 130459

SEQ ID NO: 131109 - RNA, 64 nt, Human; identical to SEQ ID NO: 130460

SEQ ID NO: 131110 - RNA, 64 nt, Human; identical to SEQ ID NO: 130461

SEQ ID NO: 131111 - RNA, 64 nt, Human; identical to SEQ ID NO: 130462

SEQ ID NO: 131112 - RNA, 64 nt, Human; identical to SEQ ID NO: 130463

SEQ ID NO: 131113 - RNA, 64 nt, Human; identical to SEQ ID NO: 130464

SEQ ID NO: 131114 - RNA, 64 nt, Human; identical to SEQ ID NO: 130465

SEQ ID NO: 131115 - RNA, 64 nt, Human; identical to SEQ ID NO: 130466

SEQ ID NO: 131116 - RNA, 64 nt, Human; identical to SEQ ID NO: 130467

SEQ ID NO: 131117 - RNA, 64 nt, Human; identical to SEQ ID NO: 130468

SEQ ID NO: 131118 - RNA, 64 nt, Human; identical to SEQ ID NO: 130469

SEQ ID NO: 131119 - RNA, 64 nt, Human; identical to SEQ ID NO: 130470

SEQ ID NO: 131120 - RNA, 64 nt, Human; identical to SEQ ID NO: 130471

SEQ ID NO: 131121 - RNA, 64 nt, Human; identical to SEQ ID NO: 130472

SEQ ID NO: 131122 - RNA, 64 nt, Human; identical to SEQ ID NO: 130473

SEQ ID NO: 131123 - RNA, 51 nt, Human; identical to SEQ ID NO: 130474

SEQ ID NO: 131124 - RNA, 64 nt, Human; identical to SEQ ID NO: 130475

SEQ ID NO: 131125 - RNA, 64 nt, Human; identical to SEQ ID NO: 130476

SEQ ID NO: 131126 - RNA, 64 nt, Human; identical to SEQ ID NO: 130477

SEQ ID NO: 131127 - RNA, 64 nt, Human; identical to SEQ ID NO: 130478

SEQ ID NO: 131128 - RNA, 64 nt, Human; identical to SEQ ID NO: 130479

SEQ ID NO: 131129 - RNA, 64 nt, Human; identical to SEQ ID NO: 130480

SEQ ID NO: 131130 - RNA, 64 nt, Human; identical to SEQ ID NO: 130481

SEQ ID NO: 131131 - RNA, 64 nt, Human; identical to SEQ ID NO: 130482

SEQ ID NO: 131132 - RNA, 64 nt, Human; identical to SEQ ID NO: 130483

SEQ ID NO: 131133 - RNA, 64 nt, Human; identical to SEQ ID NO: 130484

SEQ ID NO: 131134 - RNA, 50 nt, Human; identical to SEQ ID NO: 130485

SEQ ID NO: 131135 - RNA, 64 nt, Human; identical to SEQ ID NO: 130486

SEQ ID NO: 131136 - RNA, 64 nt, Human; identical to SEQ ID NO: 130487

SEQ ID NO: 131137 - RNA, 64 nt, Human; identical to SEQ ID NO: 130488

SEQ ID NO: 131138 - RNA, 64 nt, Human; identical to SEQ ID NO: 130489

SEQ ID NO: 131139 - RNA, 64 nt, Human; identical to SEQ ID NO: 130490

SEQ ID NO: 131140 - RNA, 64 nt, Human; identical to SEQ ID NO: 130491

SEQ ID NO: 131141 - RNA, 64 nt, Human; identical to SEQ ID NO: 130492

SEQ ID NO: 131142 - RNA, 64 nt, Human; identical to SEQ ID NO: 130493

SEQ ID NO: 131143 - RNA, 64 nt, Human; identical to SEQ ID NO: 130494

SEQ ID NO: 131144 - RNA, 64 nt, Human; identical to SEQ ID NO: 130495

SEQ ID NO: 131145 - RNA, 64 nt, Human; identical to SEQ ID NO: 130496

SEQ ID NO: 131146 - RNA, 64 nt, Human; identical to SEQ ID NO: 130497

SEQ ID NO: 131147 - RNA, 64 nt, Human; identical to SEQ ID NO: 130498

SEQ ID NO: 131148 - RNA, 64 nt, Human; identical to SEQ ID NO: 130499

SEQ ID NO: 131149 - RNA, 64 nt, Human; identical to SEQ ID NO: 130500

SEQ ID NO: 131150 - RNA, 64 nt, Human; identical to SEQ ID NO: 130501

SEQ ID NO: 131151 - RNA, 64 nt, Human; identical to SEQ ID NO: 130502

SEQ ID NO: 131152 - RNA, 64 nt, Human; identical to SEQ ID NO: 130503

SEQ ID NO: 131153 - RNA, 64 nt, Human; identical to SEQ ID NO: 130504

SEQ ID NO: 131154 - RNA, 64 nt, Human; identical to SEQ ID NO: 130505

SEQ ID NO: 131155 - RNA, 64 nt, Human; identical to SEQ ID NO: 130506

SEQ ID NO: 131156 - RNA, 64 nt, Human; identical to SEQ ID NO: 130507

SEQ ID NO: 131157 - RNA, 64 nt, Human; identical to SEQ ID NO: 130508

SEQ ID NO: 131158 - RNA, 64 nt, Human; identical to SEQ ID NO: 130509

SEQ ID NO: 131159 - RNA, 64 nt, Human; identical to SEQ ID NO: 130510

SEQ ID NO: 131160 - RNA, 64 nt, Human; identical to SEQ ID NO: 130511

SEQ ID NO: 131161 - RNA, 64 nt, Human; identical to SEQ ID NO: 130512

SEQ ID NO: 131162 - RNA, 64 nt, Human; identical to SEQ ID NO: 130513

SEQ ID NO: 131163 - RNA, 64 nt, Human; identical to SEQ ID NO: 130514

SEQ ID NO: 131164 - RNA, 64 nt, Human; identical to SEQ ID NO: 130515

SEQ ID NO: 131165 - RNA, 64 nt, Human; identical to SEQ ID NO: 130516

SEQ ID NO: 131166 - RNA, 64 nt, Human; identical to SEQ ID NO: 130517

SEQ ID NO: 131167 - RNA, 64 nt, Human; identical to SEQ ID NO: 130518

SEQ ID NO: 131168 - RNA, 64 nt, Human; identical to SEQ ID NO: 130519

SEQ ID NO: 131169 - RNA, 64 nt, Human; identical to SEQ ID NO: 130520

SEQ ID NO: 131170 - RNA, 64 nt, Human; identical to SEQ ID NO: 130521

SEQ ID NO: 131171 - RNA, 64 nt, Human; identical to SEQ ID NO: 130522

SEQ ID NO: 131172 - RNA, 64 nt, Human; identical to SEQ ID NO: 130523

SEQ ID NO: 131173 - RNA, 64 nt, Human; identical to SEQ ID NO: 130524

SEQ ID NO: 131174 - RNA, 64 nt, Human; identical to SEQ ID NO: 130525

SEQ ID NO: 131175 - RNA, 64 nt, Human; identical to SEQ ID NO: 130526

SEQ ID NO: 131176 - RNA, 64 nt, Human; identical to SEQ ID NO: 130527

SEQ ID NO: 131177 - RNA, 64 nt, Human; identical to SEQ ID NO: 130528

SEQ ID NO: 131178 - RNA, 64 nt, Human; identical to SEQ ID NO: 130529

SEQ ID NO: 131179 - RNA, 64 nt, Human; identical to SEQ ID NO: 130530

SEQ ID NO: 131180 - RNA, 64 nt, Human; identical to SEQ ID NO: 130531

SEQ ID NO: 131181 - RNA, 64 nt, Human; identical to SEQ ID NO: 130532

SEQ ID NO: 131182 - RNA, 64 nt, Human; identical to SEQ ID NO: 130533

SEQ ID NO: 131183 - RNA, 64 nt, Human; identical to SEQ ID NO: 130534

SEQ ID NO: 131184 - RNA, 64 nt, Human; identical to SEQ ID NO: 130535

SEQ ID NO: 131185 - RNA, 64 nt, Human; identical to SEQ ID NO: 130536

SEQ ID NO: 131186 - RNA, 64 nt, Human; identical to SEQ ID NO: 130537

SEQ ID NO: 131187 - RNA, 64 nt, Human; identical to SEQ ID NO: 130538

SEQ ID NO: 131188 - RNA, 64 nt, Human; identical to SEQ ID NO: 130539

SEQ ID NO: 131189 - RNA, 64 nt, Human; identical to SEQ ID NO: 130540

SEQ ID NO: 131190 - RNA, 64 nt, Human; identical to SEQ ID NO: 130541

SEQ ID NO: 131191 - RNA, 64 nt, Human; identical to SEQ ID NO: 130542

SEQ ID NO: 131192 - RNA, 64 nt, Human; identical to SEQ ID NO: 130543

SEQ ID NO: 131193 - RNA, 64 nt, Human; identical to SEQ ID NO: 130544

SEQ ID NO: 131194 - RNA, 64 nt, Human; identical to SEQ ID NO: 130545

SEQ ID NO: 131195 - RNA, 64 nt, Human; identical to SEQ ID NO: 130546

SEQ ID NO: 131196 - RNA, 64 nt, Human; identical to SEQ ID NO: 130547

SEQ ID NO: 131197 - RNA, 54 nt, Human; identical to SEQ ID NO: 130548

SEQ ID NO: 131198 - RNA, 64 nt, Human; identical to SEQ ID NO: 130549

SEQ ID NO: 131199 - RNA, 64 nt, Human; identical to SEQ ID NO: 130550

SEQ ID NO: 131200 - RNA, 64 nt, Human; identical to SEQ ID NO: 130551

SEQ ID NO: 131201 - RNA, 64 nt, Human; identical to SEQ ID NO: 130552

SEQ ID NO: 131202 - RNA, 64 nt, Human; identical to SEQ ID NO: 130553

SEQ ID NO: 131203 - RNA, 64 nt, Human; identical to SEQ ID NO: 130554

SEQ ID NO: 131204 - RNA, 64 nt, Human; identical to SEQ ID NO: 130555

SEQ ID NO: 131205 - RNA, 64 nt, Human; identical to SEQ ID NO: 130556

SEQ ID NO: 131206 - RNA, 64 nt, Human; identical to SEQ ID NO: 130557

SEQ ID NO: 131207 - RNA, 64 nt, Human; identical to SEQ ID NO: 130558

SEQ ID NO: 131208 - RNA, 64 nt, Human; identical to SEQ ID NO: 130559

SEQ ID NO: 131209 - RNA, 64 nt, Human; identical to SEQ ID NO: 130560

SEQ ID NO: 131210 - RNA, 64 nt, Human; identical to SEQ ID NO: 130561

SEQ ID NO: 131211 - RNA, 64 nt, Human; identical to SEQ ID NO: 130562

SEQ ID NO: 131212 - RNA, 64 nt, Human; identical to SEQ ID NO: 130563

SEQ ID NO: 131213 - RNA, 64 nt, Human; identical to SEQ ID NO: 130564

SEQ ID NO: 131214 - RNA, 64 nt, Human; identical to SEQ ID NO: 130565

SEQ ID NO: 131215 - RNA, 64 nt, Human; identical to SEQ ID NO: 130566

SEQ ID NO: 131216 - RNA, 64 nt, Human; identical to SEQ ID NO: 130567

SEQ ID NO: 131217 - RNA, 64 nt, Human; identical to SEQ ID NO: 130568

SEQ ID NO: 131218 - RNA, 64 nt, Human; identical to SEQ ID NO: 130569

SEQ ID NO: 131219 - RNA, 64 nt, Human; identical to SEQ ID NO: 130570

SEQ ID NO: 131220 - RNA, 64 nt, Human; identical to SEQ ID NO: 130571

SEQ ID NO: 131221 - RNA, 64 nt, Human; identical to SEQ ID NO: 130572

SEQ ID NO: 131222 - RNA, 64 nt, Human; identical to SEQ ID NO: 130573

SEQ ID NO: 131223 - RNA, 64 nt, Human; identical to SEQ ID NO: 130574

SEQ ID NO: 131224 - RNA, 64 nt, Human; identical to SEQ ID NO: 130575

SEQ ID NO: 131225 - RNA, 64 nt, Human; identical to SEQ ID NO: 130576

SEQ ID NO: 131226 - RNA, 64 nt, Human; identical to SEQ ID NO: 130577

SEQ ID NO: 131227 - RNA, 64 nt, Human; identical to SEQ ID NO: 130578

SEQ ID NO: 131228 - RNA, 64 nt, Human; identical to SEQ ID NO: 130579

SEQ ID NO: 131229 - RNA, 64 nt, Human; identical to SEQ ID NO: 130580

SEQ ID NO: 131230 - RNA, 64 nt, Human; identical to SEQ ID NO: 130581

SEQ ID NO: 131231 - RNA, 64 nt, Human; identical to SEQ ID NO: 130582

SEQ ID NO: 131232 - RNA, 64 nt, Human; identical to SEQ ID NO: 130583

SEQ ID NO: 131233 - RNA, 64 nt, Human; identical to SEQ ID NO: 130584

SEQ ID NO: 131234 - RNA, 61 nt, Human; identical to SEQ ID NO: 130585

SEQ ID NO: 131235 - RNA, 64 nt, Human; identical to SEQ ID NO: 130586

SEQ ID NO: 131236 - RNA, 64 nt, Human; identical to SEQ ID NO: 130587

SEQ ID NO: 131237 - RNA, 64 nt, Human; identical to SEQ ID NO: 130588

SEQ ID NO: 131238 - RNA, 64 nt, Human; identical to SEQ ID NO: 130589

SEQ ID NO: 131239 - RNA, 64 nt, Human; identical to SEQ ID NO: 130590

SEQ ID NO: 131240 - RNA, 64 nt, Human; identical to SEQ ID NO: 130591

SEQ ID NO: 131241 - RNA, 64 nt, Human; identical to SEQ ID NO: 130592

SEQ ID NO: 131242 - RNA, 64 nt, Human; identical to SEQ ID NO: 130593

SEQ ID NO: 131243 - RNA, 64 nt, Human; identical to SEQ ID NO: 130594

SEQ ID NO: 131244 - RNA, 64 nt, Human; identical to SEQ ID NO: 130595

SEQ ID NO: 131245 - RNA, 64 nt, Human; identical to SEQ ID NO: 130596

SEQ ID NO: 131246 - RNA, 64 nt, Human; identical to SEQ ID NO: 130597

SEQ ID NO: 131247 - RNA, 64 nt, Human; identical to SEQ ID NO: 130598

SEQ ID NO: 131248 - RNA, 56 nt, Human; identical to SEQ ID NO: 130599

SEQ ID NO: 131249 - RNA, 64 nt, Human; identical to SEQ ID NO: 130600

SEQ ID NO: 131250 - RNA, 64 nt, Human; identical to SEQ ID NO: 130601

SEQ ID NO: 131251 - RNA, 64 nt, Human; identical to SEQ ID NO: 130602

SEQ ID NO: 131252 - RNA, 64 nt, Human; identical to SEQ ID NO: 130603

SEQ ID NO: 131253 - RNA, 64 nt, Human; identical to SEQ ID NO: 130604

SEQ ID NO: 131254 - RNA, 55 nt, Human; identical to SEQ ID NO: 130605

SEQ ID NO: 131255 - RNA, 64 nt, Human; identical to SEQ ID NO: 130606

SEQ ID NO: 131256 - RNA, 64 nt, Human; identical to SEQ ID NO: 130607

SEQ ID NO: 131257 - RNA, 64 nt, Human; identical to SEQ ID NO: 130608

SEQ ID NO: 131258 - RNA, 64 nt, Human; identical to SEQ ID NO: 130609

SEQ ID NO: 131259 - RNA, 64 nt, Human; identical to SEQ ID NO: 130610

SEQ ID NO: 131260 - RNA, 64 nt, Human; identical to SEQ ID NO: 130611

SEQ ID NO: 131261 - RNA, 64 nt, Human; identical to SEQ ID NO: 130612

SEQ ID NO: 131262 - RNA, 64 nt, Human; identical to SEQ ID NO: 130613

SEQ ID NO: 131263 - RNA, 64 nt, Human; identical to SEQ ID NO: 130614

SEQ ID NO: 131264 - RNA, 64 nt, Human; identical to SEQ ID NO: 130615

SEQ ID NO: 131265 - RNA, 64 nt, Human; identical to SEQ ID NO: 130616

SEQ ID NO: 131266 - RNA, 64 nt, Human; identical to SEQ ID NO: 130617

SEQ ID NO: 131267 - RNA, 64 nt, Human; identical to SEQ ID NO: 130618

SEQ ID NO: 131268 - RNA, 64 nt, Human; identical to SEQ ID NO: 130619

SEQ ID NO: 131269 - RNA, 64 nt, Human; identical to SEQ ID NO: 130620

SEQ ID NO: 131270 - RNA, 64 nt, Human; identical to SEQ ID NO: 130621

SEQ ID NO: 131271 - RNA, 64 nt, Human; identical to SEQ ID NO: 130622

SEQ ID NO: 131272 - RNA, 64 nt, Human; identical to SEQ ID NO: 130623

SEQ ID NO: 131273 - RNA, 64 nt, Human; identical to SEQ ID NO: 130624

SEQ ID NO: 131274 - RNA, 64 nt, Human; identical to SEQ ID NO: 130625

SEQ ID NO: 131275 - RNA, 64 nt, Human; identical to SEQ ID NO: 130626

SEQ ID NO: 131276 - RNA, 64 nt, Human; identical to SEQ ID NO: 130627

SEQ ID NO: 131277 - RNA, 64 nt, Human; identical to SEQ ID NO: 130628

SEQ ID NO: 131278 - RNA, 64 nt, Human; identical to SEQ ID NO: 130629

SEQ ID NO: 131279 - RNA, 64 nt, Human; identical to SEQ ID NO: 130630

SEQ ID NO: 131280 - RNA, 64 nt, Human; identical to SEQ ID NO: 130631

SEQ ID NO: 131281 - RNA, 64 nt, Human; identical to SEQ ID NO: 130632

SEQ ID NO: 131282 - RNA, 64 nt, Human; identical to SEQ ID NO: 130633

SEQ ID NO: 131283 - RNA, 64 nt, Human; identical to SEQ ID NO: 130634

SEQ ID NO: 131284 - RNA, 64 nt, Human; identical to SEQ ID NO: 130635

SEQ ID NO: 131285 - RNA, 64 nt, Human; identical to SEQ ID NO: 130636

SEQ ID NO: 131286 - RNA, 64 nt, Human; identical to SEQ ID NO: 130637

SEQ ID NO: 131287 - RNA, 64 nt, Human; identical to SEQ ID NO: 130638

SEQ ID NO: 131288 - RNA, 64 nt, Human; identical to SEQ ID NO: 130639

SEQ ID NO: 131289 - RNA, 64 nt, Human; identical to SEQ ID NO: 130640

SEQ ID NO: 131290 - RNA, 64 nt, Human; identical to SEQ ID NO: 130641

SEQ ID NO: 131291 - RNA, 64 nt, Human; identical to SEQ ID NO: 130642

SEQ ID NO: 131292 - RNA, 64 nt, Human; identical to SEQ ID NO: 130643

SEQ ID NO: 131293 - RNA, 64 nt, Human; identical to SEQ ID NO: 130644

SEQ ID NO: 131294 - RNA, 64 nt, Human; identical to SEQ ID NO: 130645

SEQ ID NO: 131295 - RNA, 64 nt, Human; identical to SEQ ID NO: 130646

SEQ ID NO: 131296 - RNA, 64 nt, Human; identical to SEQ ID NO: 130647

SEQ ID NO: 131297 - RNA, 64 nt, Human; identical to SEQ ID NO: 130648

SEQ ID NO: 131298 - RNA, 64 nt, Human; identical to SEQ ID NO: 130649

SEQ ID NO: 131299 - RNA, 64 nt, Human; identical to SEQ ID NO: 130650

SEQ ID NO: 131300 - RNA, 64 nt, Human; identical to SEQ ID NO: 130651

SEQ ID NO: 131301 - RNA, 64 nt, Human; identical to SEQ ID NO: 130652

SEQ ID NO: 131302 - RNA, 64 nt, Human; identical to SEQ ID NO: 130653

SEQ ID NO: 131303 - RNA, 64 nt, Human; identical to SEQ ID NO: 130654

SEQ ID NO: 131304 - RNA, 64 nt, Human; identical to SEQ ID NO: 130655

SEQ ID NO: 131305 - RNA, 64 nt, Human; identical to SEQ ID NO: 130656

SEQ ID NO: 131306 - RNA, 64 nt, Human; identical to SEQ ID NO: 130657

SEQ ID NO: 131307 - RNA, 64 nt, Human; identical to SEQ ID NO: 130658

SEQ ID NO: 131308 - RNA, 64 nt, Human; identical to SEQ ID NO: 130659

SEQ ID NO: 131309 - RNA, 64 nt, Human; identical to SEQ ID NO: 130660

SEQ ID NO: 131310 - RNA, 64 nt, Human; identical to SEQ ID NO: 130661

SEQ ID NO: 131311 - RNA, 64 nt, Human; identical to SEQ ID NO: 130662

SEQ ID NO: 131312 - RNA, 64 nt, Human; identical to SEQ ID NO: 130663

SEQ ID NO: 131313 - RNA, 64 nt, Human; identical to SEQ ID NO: 130664

SEQ ID NO: 131314 - RNA, 64 nt, Human; identical to SEQ ID NO: 130665

SEQ ID NO: 131315 - RNA, 64 nt, Human; identical to SEQ ID NO: 130666

SEQ ID NO: 131316 - RNA, 64 nt, Human; identical to SEQ ID NO: 130667

SEQ ID NO: 131317 - RNA, 64 nt, Human; identical to SEQ ID NO: 130668

SEQ ID NO: 131318 - RNA, 64 nt, Human; identical to SEQ ID NO: 130669

SEQ ID NO: 131319 - RNA, 64 nt, Human; identical to SEQ ID NO: 130670

SEQ ID NO: 131320 - RNA, 64 nt, Human; identical to SEQ ID NO: 130671

SEQ ID NO: 131321 - RNA, 64 nt, Human; identical to SEQ ID NO: 130672

SEQ ID NO: 131322 - RNA, 64 nt, Human
aggguggacccagcugcuggggaagagccagggggaccgcgaggagccgagcguccucgggcac

SEQ ID NO: 131323 - RNA, 64 nt, Human
uucucagaaaaguggcaacuuugguggcagccuagaccgcgaggaaguggaaucuuccuuaaag

SEQ ID NO: 131324 - RNA, 64 nt, Human
gguucagggagcauuuccuuuuccugggaguuaugaccgcgaaguugucaugugccgugcccuu

SEQ ID NO: 131325 - RNA, 64 nt, Human
ccagguggcauuggaggcguggcgcagccggcgggaccgcgaggagauccuccugcaggagcug

SEQ ID NO: 131326 - RNA, 64 nt, Human
caccgucauccccgagacgcaacugcaggcugaggaccgcgacaaggacgacauucuguucuac

SEQ ID NO: 131327 - RNA, 64 nt, Human
gcacgucuggccccgccucuggcugcgcacucccgaccgcgacguccacgcagcagagggacau

SEQ ID NO: 131328 - RNA, 64 nt, Human
gggcgacccugacaaguaccgccugucucaggaugaccgcgauggccugcagcaacucuauggu

SEQ ID NO: 131329 - RNA, 64 nt, Human
gucgguugaggccacaccugcggccacagacugcgaccgcgauugcagggaggagcaucugagg

SEQ ID NO: 131330 - RNA, 64 nt, Human
gcggcgccgggaccgggaucgugaccgugaccgugaccgcgagcacaaacggggggagcggggc

SEQ ID NO: 131331 - RNA, 64 nt, Human
agccccuuggaacuuggaagacccguguuuccuggaccgcgaaucaguguguugggcaucagug

SEQ ID NO: 131332 - RNA, 64 nt, Human
uagcuaaacggauuccaaagaguagaauugcauugaccgcgacuaauuucaaaaugcuuuuuau

SEQ ID NO: 131333 - RNA, 64 nt, Human
gaagccaccaucgguuccagcgucucccagacuucucguacaguuaauuugugucaucccauca

SEQ ID NO: 131334 - RNA, 64 nt, Human
uuuaaacuuucugaagugcugauguacauacuuucucguacacacuuuugugaagauuucaagg

SEQ ID NO: 131335 - RNA, 64 nt, Human
aucucacacagaggucaaccgaugagcccacucacucguacaugccuucuuccacagugggaag

SEQ ID NO: 131336 - RNA, 64 nt, Human
ugcacuauugcaaaacggguguauuauccagguacucguacacuauuuuuuuguacugcugguc

SEQ ID NO: 131337 - RNA, 64 nt, Human
uugaaacucaucuugguaaauaaauugcaaauuacucguacaguuuuacaaggaucucauggca

SEQ ID NO: 131338 - RNA, 64 nt, Human
uguguaaguuuuaguugccuacccuagcucuuuucucguacaauuuugccaauaccaaguuuca

SEQ ID NO: 131339 - RNA, 64 nt, Human
uuccuucuguuaaucuuuuguauucacuuaugcucucguacauugaguacuuuuauuccaaaac

SEQ ID NO: 131340 - RNA, 64 nt, Human
aaaucuuacuguaccgccuguuguaucugggagccucguacagaggcucgcacagcagugauca

SEQ ID NO: 131341 - RNA, 64 nt, Human
ccugcuccuggccacccaaaacuccauauggcuucucguacacugacauccucucucuacccau

SEQ ID NO: 131342 - RNA, 64 nt, Human
uuaacuuaguaaauuugaagugcagcucuguuagcucguacauguggguucuuauccugauccu

SEQ ID NO: 131343 - RNA, 64 nt, Human
uauuugcaguguauuugcuucucaugaacuauuucucguacaaaucauuaaauaguucauugga

SEQ ID NO: 131344 - RNA, 64 nt, Human
gagcagugaucuccaaggccagcugcagggccugcucguacacuugcucaaccuggaccagccc

SEQ ID NO: 131345 - RNA, 64 nt, Human
gcaccccucuuccccagcuguccugccagcccuucucguacaggguggcuccuuugaaguggag

SEQ ID NO: 131346 - RNA, 64 nt, Human
ugaauacaucauccgcagccugggaaccuucucccucguacagcacaggaaccugacacauagu

SEQ ID NO: 131347 - RNA, 64 nt, Human
aggcauuuuguuauucuguuaaaaaccacacacacucguacaugcagacaccuccaaugagaua

SEQ ID NO: 131348 - RNA, 64 nt, Human
ccauuauuacaguaauuuuauuauaggacuuugccucguacaauuaauagugauauuuuggaca

SEQ ID NO: 131349 - RNA, 64 nt, Human
cagggcacagucccuaaauuacugaucaugugcacucguacaguauauuacugugaccacaagg

SEQ ID NO: 131350 - RNA, 59 nt, Human
accccuucaccuuugagugaucuuacucccucguacaugcacaaauacacacucaugca

SEQ ID NO: 131351 - RNA, 64 nt, Human
cauuuuuuucuugaauuuuauauccguuuguucacucguacaugccuagccuacagaaggggau

SEQ ID NO: 131352 - RNA, 64 nt, Human
agaaucuagugcgugggacaguaaaggauccuuucucguacagaauaaaaggucucagccugua

SEQ ID NO: 131353 - RNA, 64 nt, Human
uuccaaucacaaggaaagauuuauuuaaaauauacucguacauuucaccuguggaugucuauaa

SEQ ID NO: 131354 - RNA, 64 nt, Human
ggagcacuguuacaaauccuucuuguuuuggcaucucguacaacauuauuaagacacagcugag

SEQ ID NO: 131355 - RNA, 64 nt, Human
caucaacagugagcaaaucuggcaugguguuugucucguacaguugggauaggaggccauucau

SEQ ID NO: 131356 - RNA, 64 nt, Human
agaucuccuucccguggaaugaaauccgaaacaucucguacagugacaaggagguaggacaugu

SEQ ID NO: 131357 - RNA, 64 nt, Human
ugaaauuuuuuagcaguacuuuagcuugaaaguacucguacaaauacuguuagauuuaguugca

SEQ ID NO: 131358 - RNA, 64 nt, Human
cugcgcccagccccagaaaucucagugcuguuuggagcuccauuucucauuugaugacuugcuc

SEQ ID NO: 131359 - RNA, 64 nt, Human
cacagagaauaaacuccuacgaaagcccuacauugagcuccaaucugcucggggugggacgggu

SEQ ID NO: 131360 - RNA, 64 nt, Human
ugacggggagcacagacuuuguguccugcacacugagcuccaagugugccccagccacugagcc

SEQ ID NO: 131361 - RNA, 64 nt, Human
gaccaggaggcugcaagucuccuagaagcccucugagcuccagaggggugcgcagagcugaccc

SEQ ID NO: 131362 - RNA, 64 nt, Human
aagccucauuauacugaaguugaagaaaccaaaugagcuccacccucacuuugccugcccugau

SEQ ID NO: 131363 - RNA, 64 nt, Human
cuuuccccccucaauugagagcucuuguuauucagagcuccaagacuagaccuggcuaacaaac

SEQ ID NO: 131364 - RNA, 64 nt, Human
ugugcuccuaccaucaccauguaagaauucccgggagcuccaugccuuuuuaauuuuagccauu

SEQ ID NO: 131365 - RNA, 64 nt, Human
aaaacuauaguuuuauuacagcauaauucauuuugagcuccacuaugacauuucaaagacugcc

SEQ ID NO: 131366 - RNA, 64 nt, Human
agggaacucugggaagccugggauguaggcgcuggagcuccaguucccaggagcaggggcaggu

SEQ ID NO: 131367 - RNA, 64 nt, Human
guggucaacaucuggaguuuuuggucuccucagagagcuccaucacaccaguaaggagaagcaa

SEQ ID NO: 131368 - RNA, 64 nt, Human
ucucucuuaacuugagguucucuuuugacuaauagagcuccauuuccccucuuaaaugagaaag

SEQ ID NO: 131369 - RNA, 64 nt, Human
gacucuuuuaacuugagggucguuuugacuacuagagcuccauuucuacucuuaaaugagaaag

SEQ ID NO: 131370 - RNA, 64 nt, Human
uagcacuuuguucacuguccugugucagagcacugagcuccacccuuuucugagaguuauuaca

SEQ ID NO: 131371 - RNA, 64 nt, Human
gaggggaccagaccaucuccgcaaccacagcccagagcuccagucaccagauagaaaauugauu

SEQ ID NO: 131372 - RNA, 64 nt, Human
auaacacuucaccuucuguaauacuaaguccucagagcuccaugcuguucugaaagggauggcc

SEQ ID NO: 131373 - RNA, 64 nt, Human
uccuuacugggacaacguggagccacguuugcaggagcuccauuuguaucccugcugguguuga

SEQ ID NO: 131374 - RNA, 64 nt, Human
aagugaugcugcugcuaagaauauucgaggucaagagcuccagucuucaauaccugcagaggag

SEQ ID NO: 131375 - RNA, 64 nt, Human
cucucugguggcugggcugcuccugaaugaggcggagcuccaggauggggaggggcucugcguu

SEQ ID NO: 131376 - RNA, 64 nt, Human
cuggcucacaguccugcacaccugcuggccuggggagcuccagccaggcagcgaguccugcccc

SEQ ID NO: 131377 - RNA, 64 nt, Human
caguggugcuucaacugguaucuaugagguccuagagcuccaggacaaugauaagacucgcuau

SEQ ID NO: 131378 - RNA, 64 nt, Human
cccuggugcccaaagcaacaccagaaccaagaaggagcuccauaaauccuucuugggugaagcc

SEQ ID NO: 131379 - RNA, 64 nt, Human
agguccuuguaauggaguuaguguccagucagcugagcuccacccugaugccaguggugagugu

SEQ ID NO: 131380 - RNA, 64 nt, Human
gccagcauuucaugggggcugaggcagaacccaggagcuccaagaaaggccacccauagagcuc

SEQ ID NO: 131381 - RNA, 64 nt, Human
acccgaccuucccuucucccuugagugcuugcaugagcuccacuuuuccuuuugcuugaacagc

SEQ ID NO: 131382 - RNA, 52 nt, Human
uccagcgagcgacaugguaaaugagcuccagaaccuauugagcuugcaggga

SEQ ID NO: 131383 - RNA, 64 nt, Human
cgucucccccugcaugccccaugugggaggugcugagcuccaaaccagcaucacaccaacucug

SEQ ID NO: 131384 - RNA, 64 nt, Human
ucaccagcuccucccuuguucucuaaguuccacugagcuccaugugcccccucuaccauuugca

SEQ ID NO: 131385 - RNA, 64 nt, Human
uacagggggcaccuguggccaggccuccuccugggagcuccaggaccagccagcuguguucccu

SEQ ID NO: 131386 - RNA, 64 nt, Human
gccagucuggucccaaacaucaauuucuuaacaugagcuccaguuuaccuaaauguucacugac

SEQ ID NO: 131387 - RNA, 64 nt, Human
acccaugaguucagaaggcacacucugccaugcugagcuccaagggugcuaccaggggaagaug

SEQ ID NO: 131388 - RNA, 64 nt, Human
caggacgacgaaucuucucaaugggggggcggcugagcuccagccaccccgcagucacuuucuu

SEQ ID NO: 131389 - RNA, 64 nt, Human
aaucaaucuugcauguaacgcaaguucccaguuggagcuccagccugacaucaaaaaaggcagu

SEQ ID NO: 131390 - RNA, 64 nt, Human
auuauuggaugauaggcccuagaacccaauaaaggagcuccaaaugucguuggguggggaagca

SEQ ID NO: 131391 - RNA, 64 nt, Human
gauucucaaaucuguauuccccgaucuugcauuugagcuccagccccacucauccucucggaug

SEQ ID NO: 131392 - RNA, 64 nt, Human
uggcaguuaagagaugggcugugcagcccauccugagcuccaguccugaguuugcuacuuacuu

SEQ ID NO: 131393 - RNA, 64 nt, Human
aaacugugugaaaccugccaaucuguguagaucagagcuccaaauuuuggauuaucgggccugu

SEQ ID NO: 131394 - RNA, 50 nt, Human
cuggaaaccccuuauuuugagagcuccaggaagcgcccucaccccagccc

SEQ ID NO: 131395 - RNA, 64 nt, Human
uccuuuacagggacuuuaugugguuuagggcucagagcuccaaaacucugggcucagcugcucc

SEQ ID NO: 131396 - RNA, 64 nt, Human
cgguguaggggcagcaggcugcacugaggaccgugagcuccaggccccgugucagugccuucaa

SEQ ID NO: 131397 - RNA, 64 nt, Human
ggcccgaggagccagguugcauuuauuggauggggagcuccaaggggcauuagugguuugggcu

SEQ ID NO: 131398 - RNA, 64 nt, Human
ucgcuccugcccacggagucguggggugugcugggagcuccacucugcuucucugacuucugcc

SEQ ID NO: 131399 - RNA, 64 nt, Human
ucuucuccugcccccaagcaccuccagcggugaugagcuccacacccccacacccauugcagcu

SEQ ID NO: 131400 - RNA, 64 nt, Human
guuugcugucucuaggauucauauagcacccacagagcuccaaguaaccaaauucccccaaaga

SEQ ID NO: 131401 - RNA, 64 nt, Human
uggaguagagggaagggaaggauuggugauagcagagcuccaggccucccuuccagucagaaca

SEQ ID NO: 131402 - RNA, 64 nt, Human
aagaaucaauauacaggguaauagcuuuggcucagagcuccaauaaugugcuucagaucugucc

SEQ ID NO: 131403 - RNA, 64 nt, Human
gaugaucuucuguggugcuuaaggaaacuuacuagagcuccacuaacagucucauaaggaggca

SEQ ID NO: 131404 - RNA, 64 nt, Human
accgugacaggacaggcucccaagcucacucuuugagcuccaacgcuuguuaaacaugaggaaa

SEQ ID NO: 131405 - RNA, 64 nt, Human
guccaccaccauguugaagcccuuggcagccugagagcuccaaggaacaagcugugacaaccag

SEQ ID NO: 131406 - RNA, 64 nt, Human
gguucccugcuccgacucucagggcugccucccugagcuccagggccagaaugccuggaugccu

SEQ ID NO: 131407 - RNA, 64 nt, Human
gaugcaacaucuuuucugaaagauugccuuaagagagcuccaguccuacucuuggaacuuggau

SEQ ID NO: 131408 - RNA, 64 nt, Human
ugggucugagcccgugggcaagcccuggccgagugagcuccaaugcuaacucaugugccgaucu

SEQ ID NO: 131409 - RNA, 64 nt, Human
agauaggggacggaaggucguuuguuuuuguucugagcuccauaagaacugugcugacuuggaa

SEQ ID NO: 131410 - RNA, 64 nt, Human
aaugugaggauguagacauccaucagugcaacucgagcuccauccuccuccgauuucuaagguu

SEQ ID NO: 131411 - RNA, 64 nt, Human
agaggccgcccgacuugcagaccuagguugagcagagcuccaccgcagucccgggugucugcgg

SEQ ID NO: 131412 - RNA, 64 nt, Human
gccucagguccuacuggggaaacuuccuauaccggagcuccaguuucucuuaagcugcccaauu

SEQ ID NO: 131413 - RNA, 64 nt, Human
caggauucagccggagggaagggacggggaagccgagcuccagagcaacgaccagggccgagga

SEQ ID NO: 131414 - RNA, 64 nt, Human
cugggcccagcaauacaggagaggaugaagggaggagcuccaggaggcgagggaagagcccuag

SEQ ID NO: 131415 - RNA, 64 nt, Human
cugacccaagaaguugcuugaggagcuuucuccugagcuccagucccugcuggauucccugguu

SEQ ID NO: 131416 - RNA, 64 nt, Human
aaauacacgcuuucugcauguauuagaaacgcacgagcuccaccaagucuacaaugaaaguuug

SEQ ID NO: 131417 - RNA, 64 nt, Human
cgcacacagcuuagaagugcuauaaaaaaggaaagagcuccaaauugaaucaccuuuauaauuu

SEQ ID NO: 131418 - RNA, 64 nt, Human
aaggagugagcuggugagguuaccacccugaauugagcuccagcugccaguuuuuguguuuuuc

SEQ ID NO: 131419 - RNA, 64 nt, Human
ucucgcgugucaacagacgaccagaggagugcuggagcuccagcagccccaaccacagcauucc

SEQ ID NO: 131420 - RNA, 64 nt, Human
accucauagcuucacagccuugccuucagccucugagcuccaggggucagcagcuuaguguauc

SEQ ID NO: 131421 - RNA, 64 nt, Human
ccuucugcugcuggauucucaggcuaacauccuggagcuccaaccuucuaacuucugugguuug

SEQ ID NO: 131422 - RNA, 64 nt, Human
gcagggcucacaggagacagggcucaggcugccggagcuccaaccaaacucugucccacuucac

SEQ ID NO: 131423 - RNA, 64 nt, Human
acagaggggauuaaagaggggaggagagagugcagagcuccaggaaaggguaucagagcugcag

SEQ ID NO: 131424 - RNA, 64 nt, Human
agagaauggaggacugggaggagaagcauuaacugagcuccaagggugugugggcagagagcuu

SEQ ID NO: 131425 - RNA, 64 nt, Human
ccagggcucuccaaugucagauguggucaguagggagcuccaugcccaagcucaagaacgacug

SEQ ID NO: 131426 - RNA, 64 nt, Human
aaggucaaaacugagaagagauuaagauaggagagagcuccauaauggcuggauaguggucagg

SEQ ID NO: 131427 - RNA, 64 nt, Human
auaaaggaguaguuaagcucuguaaaugugccacgagcuccaacacgaccaucguagggugaag

SEQ ID NO: 131428 - RNA, 64 nt, Human
ucucaggaagcuucuagagacuuuaugcccuccagagcuccaagauauaagcccuccaagggau

SEQ ID NO: 131429 - RNA, 64 nt, Human
gugcuaacggccaugagcuccgacucuccaaagugagcuccacuuugggucugaggagccccug

SEQ ID NO: 131430 - RNA, 64 nt, Human
uuaaaacaucauaguaauauaaaucugcuguuaggagcuccaguugcuaaaaccucaauuuaag

SEQ ID NO: 131431 - RNA, 64 nt, Human
aaucaugcaaucuugcagugaagaaggaguaucagagcuccagcuacacugagucuuucaauuu

SEQ ID NO: 131432 - RNA, 64 nt, Human
ugacccagcucauggaauuuuuucaucuuauacugagcuccagaaaggacguaacuuagcaugg

SEQ ID NO: 131433 - RNA, 64 nt, Human
ucuauggaagaggaagcugagcucagggagauaugagcuccacagccacagcugguuaggggcg

SEQ ID NO: 131434 - RNA, 64 nt, Human
cuguuucuauauuggucauugccuugccaaacaggagcuccagcaaaagcgcaggaagagagac

SEQ ID NO: 131435 - RNA, 64 nt, Human
aauaagcuggaaaaaucugaggcuggcuuagcaggagcuccagcccgugcuguaucagcuguaa

SEQ ID NO: 131436 - RNA, 64 nt, Human
auuugggucuuuauguuggugcugccaggucucugagcuccagagguggccucuuggacagauc

SEQ ID NO: 131437 - RNA, 64 nt, Human
uggaaggcaggagaggugggcuggccuagggcaggagcuccacuucucucugccucuggcuaug

SEQ ID NO: 131438 - RNA, 64 nt, Human
uuccccaaugaaaaauagagcuguuggcuucucugagcuccaguggaagaagaaaacacuagua

SEQ ID NO: 131439 - RNA, 64 nt, Human
ucuguuuucaagaacaacauaagcauagugcaaggagcuccauuuccgagcuccuaagaaauau

SEQ ID NO: 131440 - RNA, 64 nt, Human
cgcaaggaauugggguggcacacgggacacccgagagcuccaggagccccgugaacccagacca

SEQ ID NO: 131441 - RNA, 64 nt, Human
uggcccuugcaccagaguaugaaauagcuuccaggagcuccagcuauaagcuuggaagugucug

SEQ ID NO: 131442 - RNA, 64 nt, Human
ccuagucccugaggguggagggaagcugaggauagagcuccagaaacagcacuagggucccagg

SEQ ID NO: 131443 - RNA, 64 nt, Human
auauacacuaggaauucuugacguggggucucuggagcuccaggaaauucgggcacaucauaug

SEQ ID NO: 131444 - RNA, 64 nt, Human
auuuguguuguguucggguuggggauggguuuaggagcuccagguugggagcagugacagagag

SEQ ID NO: 131445 - RNA, 64 nt, Human
cagguccugaccaaccugcaucaggggaugcccugagcuccacaggucuucaugggcagggguu

SEQ ID NO: 131446 - RNA, 64 nt, Human
gauuuaccucguucugcucagaggccuugcuguggagcuccacugccauguacccaguaggguu

SEQ ID NO: 131447 - RNA, 64 nt, Human
cuuuuaagaauuucauucuuuuuguauggucauggagcuccaaccauuuuuaauaggaaagucu

SEQ ID NO: 131448 - RNA, 64 nt, Human
gcuguauuuaugagaaaccucgggccuuuggcgagagcuccacggaaagugaugaggaggaaga

SEQ ID NO: 131449 - RNA, 64 nt, Human
agagcgggagggucuccuaccuggaagucccccugagcuccagggcccagcccuaccugccagu

SEQ ID NO: 131450 - RNA, 64 nt, Human
ugaaugccagcccuguaaaagaccaccauaaagagagcuccauguucuuuugcucuuuugggga

SEQ ID NO: 131451 - RNA, 64 nt, Human
caugcaaaucucagggguaugccucucuggggaggagcuccacuugcagggacuccuuuuauuu

SEQ ID NO: 131452 - RNA, 64 nt, Human
agagacuucauucuaaaaagagaagugauaaacagagcuccagcucugcuagcucuauauauuu

SEQ ID NO: 131453 - RNA, 64 nt, Human
ggauacgaagacauuugacguugcgcuguccgaggagcuccaugcggcacugagugaguggcug

SEQ ID NO: 131454 - RNA, 64 nt, Human
uugguccaugugccuucaggggguuguuacuugagagcuccagggugaagggagaaagccugug

SEQ ID NO: 131455 - RNA, 64 nt, Human
gagggcugcuccccuuuuagaauuuaccucuuaugagcuccauguugcuucacucuauccaaag

SEQ ID NO: 131456 - RNA, 64 nt, Human
cagccuguagacuuccaguuuuucuuaaauugaagagcuccagacacuuuugagcaggguuugu

SEQ ID NO: 131457 - RNA, 64 nt, Human
gugggcuucugaaaguugccaucuucccuccguggagcuccauuugcuauuuucauuauacacu

SEQ ID NO: 131458 - RNA, 64 nt, Human
uaucacucaacaucaggggaugccugaggagugcgagcuccacagcaacauggcaggcaggagg

SEQ ID NO: 131459 - RNA, 64 nt, Human
gaacauuggguuaaugcagccuugguuuccugcugagcuccaguauuuugauaguuaauuauuu

SEQ ID NO: 131460 - RNA, 64 nt, Human
guccggucugccgguggccuccagcagcaccacagagcuccagaccaaccaccccaagugccgu

SEQ ID NO: 131461 - RNA, 64 nt, Human
ggcuucgagucugcccuaauuuggguuugucuaggagcuccagccugaucuuggauugucaggc

SEQ ID NO: 131462 - RNA, 64 nt, Human
caacgugugagcccucuaccuggguucgggucaggagcuccaucugggaacuaacagcugcuaa

SEQ ID NO: 131463 - RNA, 64 nt, Human
gaagaugcaggggugggaagcggccaggcagaaagagcuccaggcucuugugucgcccacccag

SEQ ID NO: 131464 - RNA, 64 nt, Human
gcacagaccugagaauggggacacaggucauucagagcuccaggccuggaagcagugccucuug

SEQ ID NO: 131465 - RNA, 64 nt, Human
aaguacuuucucaccaagcgccagcuggaaaaucgagcuccauacuaaaggaagggaucauaga

SEQ ID NO: 131466 - RNA, 64 nt, Human
uauaaacauauaugauaguggcucuaguuuuauagagcuccaaguguauuaaacaugacagcca

SEQ ID NO: 131467 - RNA, 64 nt, Human
ugucuaacauaacaacagagcaguuugugucacugagcuccagucugugcuggauuauugauau

SEQ ID NO: 131468 - RNA, 64 nt, Human
gcccccugggcacccauccacaagcugggccacggagcuccagcuucucaggacaaagccccgg

SEQ ID NO: 131469 - RNA, 52 nt, Human
uuggccgcgccaaggaguagccgagcuccagcucgcugugcccgcucaggug

SEQ ID NO: 131470 - RNA, 64 nt, Human
ggucucaccugcggagccgcacucuuuagccccggagcuccaggcccagcggaugcuggcaccc

SEQ ID NO: 131471 - RNA, 64 nt, Human
cagcagugucagaaggacuucgccaggguuuugggagcuccaggguucauaagaaggugaacca

SEQ ID NO: 131472 - RNA, 64 nt, Human
agcaucaaguucuccccaggguagaauucaaucagagcuccaguuugcauuuggauguguaaau

SEQ ID NO: 131473 - RNA, 64 nt, Human
cugcugaucaauaccuaaucauuccacauuuauugagcuccaccuguguguauguguacccaag

SEQ ID NO: 131474 - RNA, 64 nt, Human
ucuccagguaacccgacuguagccccugcuggcugagcuccagccugugcccacugauaauagc

SEQ ID NO: 131475 - RNA, 64 nt, Human
ccccuccucgggcgccugcgcuccucugcagccugagcuccacccuccccucuucuugcggcac

SEQ ID NO: 131476 - RNA, 64 nt, Human
cuuucugguucucacacagaucuauggcuaugacgagcuccagaugcugcagucacggcugcca

SEQ ID NO: 131477 - RNA, 64 nt, Human
cuucucugcagaccgugauccucacuagacagaggagcuccaaaccugcccaucucaucccaug

SEQ ID NO: 131478 - RNA, 64 nt, Human
agaccagcacuuagggugggcggggcuccugagggagcuccaacucagaagggagcuagccaga

SEQ ID NO: 131479 - RNA, 64 nt, Human
gagggcuagaagccagucccuccccaccugcccagagcuccaggccagcacagaaauuccugag

SEQ ID NO: 131480 - RNA, 64 nt, Human
aagcccaggcagggaauggccuugaaagccauuggagcuccaauucgugacccacucagccuua

SEQ ID NO: 131481 - RNA, 64 nt, Human
cgaaauaugagaacuggggccuccugcucccagggagcuccagggccccucucuccucccaccu

SEQ ID NO: 131482 - RNA, 64 nt, Human
ucaagcaauucuguagcaaauaaauccuuugaaagagcuccaaauugguggcauuauccuuuca

SEQ ID NO: 131483 - RNA, 64 nt, Human
uaccguccuggccagcuaccgucagagagaaccagagcuccaagucuuuaauuugccaagauga

SEQ ID NO: 131484 - RNA, 64 nt, Human
aggggcugucugcuaggucccaguaggacaggcagagcuccaggcuggcaccaugguaggccuc

SEQ ID NO: 131485 - RNA, 64 nt, Human
agugcuccucgcccuucugaugugggggaggcuggagcuccaugcacguaguccagaugccugg

SEQ ID NO: 131486 - RNA, 64 nt, Human
cucuccuuggucauucucaagaguaugagagacagagcuccaggcaugucccauccccaugcac

SEQ ID NO: 131487 - RNA, 64 nt, Human
guugaacaaauuuccuaaucaaagaaaaaaguaugagcuccauguuucuuuaguuucacaaaaa

SEQ ID NO: 131488 - RNA, 64 nt, Human
ugcuacucuaaacugucuccaacacauuguuucugagcuccacaaaugcaaaagauguauuuuc

SEQ ID NO: 131489 - RNA, 64 nt, Human
auaacaguucauucuacuuaauaaugcaauaauggagcuccaaguugucuuggacuucuacacc

SEQ ID NO: 131490 - RNA, 64 nt, Human
ggccugcuucccucaugcccuggaauacaacucagagcuccaggcagcggaaccaucuauuguu

SEQ ID NO: 131491 - RNA, 64 nt, Human
guuccugcuccccgccuaggacaggagcugucuggagcuccaccuuugcaaagaaaggaaaaac

SEQ ID NO: 131492 - RNA, 64 nt, Human
acuucuacauccauccacaccccagggugagcuggagcuccaggcuggccaggcugaaccucgc

SEQ ID NO: 131493 - RNA, 64 nt, Human
uaccugagaggccccaagaagcugagcuggcagagagcuccaccauuuggugcuaaaaaaaaaa

SEQ ID NO: 131494 - RNA, 64 nt, Human
cauccagacugccaugucagcuaucccaguagcugagcuccaaggacucaggcagagggacuca

SEQ ID NO: 131495 - RNA, 64 nt, Human
agggcaggguagagaggguauguccaguagccuggagcuccaugguggcuucaugccucccuuc

SEQ ID NO: 131496 - RNA, 64 nt, Human
ugaaggauugagggauugagggauugcugagcuggagcuccagguguccuaucuuucucagugg

SEQ ID NO: 131497 - RNA, 64 nt, Human
acaccauauguccugucaauccagaacugccucugagcuccaggcugaccacagaucagccaca

SEQ ID NO: 131498 - RNA, 64 nt, Human
ggcugcuggggccuccuugcuuggaggcuggaaagagcuccauuucaguaucuuucuccguggu

SEQ ID NO: 131499 - RNA, 64 nt, Human
ucaauagggcccaaaccuuuuuauuuuacaauaugagcuccaagacacuuacugaucuacugug

SEQ ID NO: 131500 - RNA, 64 nt, Human
cccaaaaggcagaugacggggaguuaggcauggggagcuccagaaggucaccagagagcuuuca

SEQ ID NO: 131501 - RNA, 64 nt, Human
ggacacugugucuccucagccaggaagggguaaugagcuccagccccuaagcaaccggacuugc

SEQ ID NO: 131502 - RNA, 64 nt, Human
ugaaacugcuuauucgugauuccucaccagcguagagcuccaccuccccuuuccccaguacccu

SEQ ID NO: 131503 - RNA, 64 nt, Human
gggaaaccuguguucaagauucaaaaacuggaaggagcuccagcccugaugguuacuugcuaug

SEQ ID NO: 131504 - RNA, 64 nt, Human
aagcggggccuugagugggccaggccacucccccgagcuccagcugccuuaggaggagucacag

SEQ ID NO: 131505 - RNA, 64 nt, Human
uucagucccaggucauacucuccaacaguuuucagagcuccauauauauguagaugccauccuu

SEQ ID NO: 131506 - RNA, 64 nt, Human
cuucugcuccugucuccucguguccgcauugcuggagcuccaccucccucuugguuucuccgca

SEQ ID NO: 131507 - RNA, 64 nt, Human
auguauccaaaccuugagaaugcaggagcucugugagcuccaccgucagcaccauucagcugca

SEQ ID NO: 131508 - RNA, 64 nt, Human
gaaaaaaaugaacaaacuacaaaacaucagugaagagcuccagagaaauauuucucuacaacug

SEQ ID NO: 131509 - RNA, 64 nt, Human
gacauaaaaagaggaguacaacauacugagaaaagagcuccaguaacaaauauugaaaggaggu

SEQ ID NO: 131510 - RNA, 64 nt, Human
caaccaaaaugacuuugaaagcagugagcugauugagcuccaguucugugguuaccagaaauac

SEQ ID NO: 131511 - RNA, 64 nt, Human
ugccccugcccgccccccuccaguccaggcagucgagcuccaccugcccucuccugcugcuucc

SEQ ID NO: 131512 - RNA, 64 nt, Human
ugauuugcaaccagaaagggagcugaaaaccacggagcuccauggcucuucauucaaaagggaa

SEQ ID NO: 131513 - RNA, 64 nt, Human
cugccaccacccugcaaucagccacuucuuuaaggagcuccagggcugcagccacguuagaggg

SEQ ID NO: 131514 - RNA, 64 nt, Human
cacggugcggauccagcugcaagaccguguaaaugagcuccaggaggugaggguggcgccccac

SEQ ID NO: 131515 - RNA, 64 nt, Human
ggcugaaaagugcuuugcuggaguccuguucucagagcuccacagaagacacguguuuuuguau

SEQ ID NO: 131516 - RNA, 64 nt, Human
ucacaucauggggaggccagagggggccacacgagagcuccaggcucugggcuggucacuccga

SEQ ID NO: 131517 - RNA, 64 nt, Human
cacaggacaucucaugaagccauguucaggguaggagcuccacgcacaucaccacccauuguca

SEQ ID NO: 131518 - RNA, 64 nt, Human
ccggccgcccucacgcacgcgcugugccccgcgggagcuccaggccgccccuccugccgcccag

SEQ ID NO: 131519 - RNA, 64 nt, Human
gcuuggaccccugggaaucaggccgccgagggcugagcuccagagccgcaccaucugccacaaa

SEQ ID NO: 131520 - RNA, 64 nt, Human
cccagggaagccucccagcggcucaugaagcaucgagcuccaagcccagaugccaagcucccug

SEQ ID NO: 131521 - RNA, 64 nt, Human
gcccagaguaacugcacgccuuugugcagcucuggagcuccaccaacucucggccugccaguuc

SEQ ID NO: 131522 - RNA, 64 nt, Human
aacagauuucuuguccugccuucuagaugccucugagcuccaaacccagggcagccauggcuuc

SEQ ID NO: 131523 - RNA, 64 nt, Human
uagguuccuccugaggguucagguacagcaaggagagcuccaucccccacaguccaucuccauu

SEQ ID NO: 131524 - RNA, 64 nt, Human
gcaacuguaaauucucccauuauaacagugaacagagcuccagguaauaacgcauaggcauguc

SEQ ID NO: 131525 - RNA, 64 nt, Human
cucaguaaguuuuuagaacaucaaaauguuuucugagcuccaaguggcuagguuguaaaaguuu

SEQ ID NO: 131526 - RNA, 64 nt, Human
ggagugugugaggaccaggcgaaggaaggugcaggagcuccagucucuaggcuuugggccugag

SEQ ID NO: 131527 - RNA, 64 nt, Human
guugcugaggaauaauuaaaugagaauuucauaggagcuccaccauuccuguuacuuucauuuc

SEQ ID NO: 131528 - RNA, 64 nt, Human
uauugcuauuaaaauauccacuagaugccaccuagagcuccaguucuuuauaacaaaacaggga

SEQ ID NO: 131529 - RNA, 64 nt, Human
agaauuuguaguaaaccaggccucccaggauggcgagcuccaguaagaugauaauggaaagcag

SEQ ID NO: 131530 - RNA, 64 nt, Human
gggggugucccaccuggaccagacuggcgugggugagcuccacacccugccuggcaaugguaug

SEQ ID NO: 131531 - RNA, 64 nt, Human
gaaaaagaggaaguaacuucugaacuuuggcccugagcuccauucuuccuccagccaaccccug

SEQ ID NO: 131532 - RNA, 64 nt, Human
ucacuuccuuggccagagucaggggacagggagagagcuccacacuguaaccacugggucuggg

SEQ ID NO: 131533 - RNA, 64 nt, Human
ggguuaggaauguggugcucuuguugggggaagugagcuccaagaguagcuuuuuuucaucucu

SEQ ID NO: 131534 - RNA, 64 nt, Human
auuuaauuuuucuuuaauagguuucauuccuucagagcuccauuaauguaaucaaaaugaaaua

SEQ ID NO: 131535 - RNA, 50 nt, Human
auguucaaugucggaagugagagcuccaagcagcaggauaaguaguagac

SEQ ID NO: 131536 - RNA, 64 nt, Human
agccaagcccaucugccaggacgagguaaugucagagcuccaucagcccggacagugggaacua

SEQ ID NO: 131537 - RNA, 64 nt, Human
ccgggaagcagugcccgccaggccugggccaggagagcuccaggaagggcacugagcgcugcug

SEQ ID NO: 131538 - RNA, 64 nt, Human
ucauuguaauuucgcuuagacccuuuuaucaguggagcuccaguuuucuuaccuagcugucacu

SEQ ID NO: 131539 - RNA, 64 nt, Human
gcacaccugucucggaguaggcagcucuuccugggagcuccaggcuauuuuugugcuuaguuac

SEQ ID NO: 131540 - RNA, 64 nt, Human
gugaacugcuuagcauggugccugguauauacgagagcuccacaaaugugagcuauaauccuac

SEQ ID NO: 131541 - RNA, 64 nt, Human
ugcacuaccaaaauggccuggccauuugauggcggagcuccaggggccuuggcuuucucuggcu

SEQ ID NO: 131542 - RNA, 64 nt, Human
cuaccccugggcagguguccagcgcagccccgcagagcuccaggguggccaaguggaucucacc

SEQ ID NO: 131543 - RNA, 64 nt, Human
ugaggugcccgugacucugacacauggggcagaggagcuccaggcacagaccaggggaggggau

SEQ ID NO: 131544 - RNA, 64 nt, Human
caaagcucaaagguccuaggcccacaguucuuuugagcuccagucauggacauuaggaaguaaa

SEQ ID NO: 131545 - RNA, 64 nt, Human
uguuuucacugaucauuuaaagaguuugaccucagagcuccaggaucaucaguaaauuugucau

SEQ ID NO: 131546 - RNA, 64 nt, Human
aaacagcugccaucagcccguuagcuguaacuuggagcuccacucugcccccagaaaggggcug

SEQ ID NO: 131547 - RNA, 64 nt, Human
ucuuucuguccagaagggcuacuuuccacauauagagcuccagggacugucuuuucuguauucg

SEQ ID NO: 131548 - RNA, 64 nt, Human
acuucuuggcaaagaacucccgugacucaucgaggagcuccagcuguugggacaccaaggagcc

SEQ ID NO: 131549 - RNA, 64 nt, Human
cauccucuugcguuuuggcccccauuugcucccugagcuccaagauaagaauggccccgagaga

SEQ ID NO: 131550 - RNA, 64 nt, Human
gcucccccugcugcuucccuggcucaguucuucggagcuccagagugagaaggccgcuucgucc

SEQ ID NO: 131551 - RNA, 64 nt, Human
gugugugaccagggcgggaggggccccaguggcugagcuccaagugccugcugaagucugcagg

SEQ ID NO: 131552 - RNA, 64 nt, Human
uucuggagggaagcaccaugaauuaaaggugccagagcuccaugcauggaaaaguggccuguug

SEQ ID NO: 131553 - RNA, 64 nt, Human
uauguucacgaucagacacgcacugcauucggcagagcuccagugagcaaggcacgacccucag

SEQ ID NO: 131554 - RNA, 64 nt, Human
ccucuccgacucacaccacuagccucaggggucugagcuccagcuccuuugggcuucagcugcc

SEQ ID NO: 131555 - RNA, 64 nt, Human
ggguccggcuguggagcuccccugccagccccuggagcuccaggagggccuguugguccccugu

SEQ ID NO: 131556 - RNA, 64 nt, Human
aggaaguuguguuuguguuucaagcagaaaaacugagcuccaagugagcacauucagcuuugga

SEQ ID NO: 131557 - RNA, 64 nt, Human
gaggagauuuguaauccacuuuuuagugcaacaagagcuccauguuaugcuuguaauaaauuau

SEQ ID NO: 131558 - RNA, 64 nt, Human
aggugggacuggcccuugcaccugccugacccuugagcuccaggcuccugccagcuggagguga

SEQ ID NO: 131559 - RNA, 64 nt, Human
ggagcgagcgagggcccccggacuggaggcuugagagcuccaacgggaagauggcuucacggag

SEQ ID NO: 131560 - RNA, 64 nt, Human
guuaccugaagagaggugagaccaaggccacagggagcuccaccuucucuggucuucaguccag

SEQ ID NO: 131561 - RNA, 64 nt, Human
uccucucccaauuuuauucccuuauucauuucaagagcuccaauggggucuccagcugaaagcc

SEQ ID NO: 131562 - RNA, 64 nt, Human
caguuagucccuaucuggguaagggucuucccuugagcuccaggggguggaacccaauguuuac

SEQ ID NO: 131563 - RNA, 64 nt, Human
aggaaacugaggcaugggccauuuauuuuccucggagcuccacaguaaggaugccaaugaugca

SEQ ID NO: 131564 - RNA, 64 nt, Human
ccucuucccucuggucaugccucacuaucucuaggagcuccauccuguggcuuccagagugugc

SEQ ID NO: 131565 - RNA, 64 nt, Human
uccuauuauucgcuccaagaaagaugcuaagucugagcuccagaagagacugugcugggugugg

SEQ ID NO: 131566 - RNA, 64 nt, Human
caggauaagaccacagggaagcaaagaaggaagagagcuccacuuacaaagaacugcuucuugc

SEQ ID NO: 131567 - RNA, 64 nt, Human
auugucugugugucugucucccccaccagacugugagcuccaugagggcagggaccgugucuug

SEQ ID NO: 131568 - RNA, 64 nt, Human
auggaacccuuuuggcccccgagcugggggccaugagcuccagacccccagcaacccuccuauc

SEQ ID NO: 131569 - RNA, 64 nt, Human
acccgcuccuccacaagccuaguccauccugccugagcuccagcccccagcccccacugugccc

SEQ ID NO: 131570 - RNA, 64 nt, Human
cuuccugaagcagguggagggcaucaggcagggugagcuccagcugcugcgcacggcggccuac

SEQ ID NO: 131571 - RNA, 64 nt, Human
ccauuucaagcaaguucaaugaccuggucccuuagagcuccauaucccagucccagcccuucuu

SEQ ID NO: 131572 - RNA, 64 nt, Human
ucaggacugggagcccccagccugucagauccaggagcuccaguguccugagcucagcguggag

SEQ ID NO: 131573 - RNA, 64 nt, Human
acucaacugugcgucccagguucagggucuuacagagcuccacccccuggggucuuaccucacu

SEQ ID NO: 131574 - RNA, 64 nt, Human
ucugggggagaggaguguggaaggguugggggaagagcuccagccugucugcuccccagcucug

SEQ ID NO: 131575 - RNA, 64 nt, Human
aaucuccacguccucccucuucccagccuggauggagcuccagggcuggggaacguccgcaagu

SEQ ID NO: 131576 - RNA, 64 nt, Human
aaauauuggcccuaucuugacccccaaauccagugagcuccagauucuuccaaggcaaaagagg

SEQ ID NO: 131577 - RNA, 64 nt, Human
uuggggacccuggacgugccgacauauggccauugagcuccaacccacacauucccauucacca

SEQ ID NO: 131578 - RNA, 64 nt, Human
gauaguuccucuuucucauuuugcaaacuacccagagcuccaaggacagccugaagaucucagu

SEQ ID NO: 131579 - RNA, 64 nt, Human
ggcauguuccugccccacaggaauagaauggagggagcuccagaaacuuuccaucccaaaggca

SEQ ID NO: 131580 - RNA, 64 nt, Human
ggaacugaaacgcacagccagugcucuggaaauugagcuccaagcacagcaaagccuggugcgu

SEQ ID NO: 131581 - RNA, 64 nt, Human
uuuguuucuaaagauguucagcucccuguaaucugagcuccaguuacuacuuaagguguuuccu

SEQ ID NO: 131582 - RNA, 64 nt, Human
cugaagaacagaaagguguucaugugacuucagugagcuccaacccuggggcccugagauggcc

SEQ ID NO: 131583 - RNA, 64 nt, Human
aggagaggcuggcaugagguucagucauuccagugagcuccaaagaggggccaccuguucucaa

SEQ ID NO: 131584 - RNA, 64 nt, Human
auccaccaccugcagcuugagauguuaacuauuagagcuccauucuuuugguucaaaacguuga

SEQ ID NO: 131585 - RNA, 64 nt, Human
ccugggauggggagaagggcuucgaagauaaacugagcuccauuccccuggcaugaaacuuuca

SEQ ID NO: 131586 - RNA, 64 nt, Human
cccuacuaaaggguaacuucaggugugcagcccugagcuccaaggcucugcaccaugccacaca

SEQ ID NO: 131587 - RNA, 64 nt, Human
cucugaggguucagcggaggugaggaaggcagcagagcuccagcaggugaagggagaguucauc

SEQ ID NO: 131588 - RNA, 64 nt, Human
gcugcuuucuucccaaaggacauguauauuugcagagcuccacauacagaaacacauuauuuug

SEQ ID NO: 131589 - RNA, 64 nt, Human
auaucuuagaguaucuccagaaacuggcuuagaggagcuccaaauauguggaauuaccacacuc

SEQ ID NO: 131590 - RNA, 64 nt, Human
ccccaugcuccgggcccacacccugcaggacaaggagcuccagacaggacguccauaagucacc

SEQ ID NO: 131591 - RNA, 64 nt, Human
cccaccccuggacggcagaggcaaggacggacgggagcuccacugugaaucggcggcacgcgcc

SEQ ID NO: 131592 - RNA, 64 nt, Human
guuaugaccccgagagggcgcacagaccaagcgugagcuccacgcgggucgacagaccucccug

SEQ ID NO: 131593 - RNA, 64 nt, Human
cuggcuggacaccgcacugcgcaaaggggcccuggagcuccaggcagggggcgcugggguguug

SEQ ID NO: 131594 - RNA, 64 nt, Human
ucuccaugaguucugggcuccacugguuccaauugagcuccagcccugguuuuccuacccaugc

SEQ ID NO: 131595 - RNA, 64 nt, Human
ccuaggagaggagcaguggaggggcccaggcucugagcuccacaggucugagcagggagcaacu

SEQ ID NO: 131596 - RNA, 64 nt, Human
gucuggcacgauugugaccgcugaaguacaccacgagcuccaggcuucagaaaguggugcugag

SEQ ID NO: 131597 - RNA, 64 nt, Human
uaauuuagcggcuccacaaagucaucagucaccugagcuccauccaucuucacaugcugugcua

SEQ ID NO: 131598 - RNA, 64 nt, Human
auuguccuuccugagaagacagcccucugccuuggagcuccagagagagggagcccuguauucu

SEQ ID NO: 131599 - RNA, 64 nt, Human
agggucaccgcccgcccuucccggcgcagcccccgagcuccacagcuggggcagccccucuggc

SEQ ID NO: 131600 - RNA, 64 nt, Human
ggggccgagccgcugagcagguguugguccucaggagcuccaaccccggacggcagaugccuuc

SEQ ID NO: 131601 - RNA, 64 nt, Human
gcaguaauuucuaugcagcccccgacccagagccgagcuccacuucugcuccggcugcccccga

SEQ ID NO: 131602 - RNA, 64 nt, Human
guaauaguuuugagaugucugucccuccucccuggagcuccagagacccaccccucuccagguu

SEQ ID NO: 131603 - RNA, 64 nt, Human
uuugcgggggggguugcuuuuuucuggggucuuugagcuccaaaaaauaaacacuuccuuugag

SEQ ID NO: 131604 - RNA, 64 nt, Human
ugagccacccucagcaggagcugggguggccccugagcuccaacggccauaacagcucugacuc

SEQ ID NO: 131605 - RNA, 64 nt, Human
gcacugcauggagucgagguggaggucacgugcagagcuccaugaggucccggagccccccucu

SEQ ID NO: 131606 - RNA, 64 nt, Human
ucucucauuacagccugggccgagcugguuaggugagcuccauaaaacccaaagggacuuggug

SEQ ID NO: 131607 - RNA, 64 nt, Human
aauaucucccuggcaggguccucuucuuuucccagagcuccaccccaaccaggagcucuaguua

SEQ ID NO: 131608 - RNA, 64 nt, Human
gggacacuuuuuuuuaaagcucauaaacugccaagagcuccauauauugggugugaguucaggu

SEQ ID NO: 131609 - RNA, 64 nt, Human
ugcugaggcuggccccaucucagaagaugagcaggagcuccacuacgcuguccuacacuuccac

SEQ ID NO: 131610 - RNA, 64 nt, Human
gaacuuuauguuauccaaguucugggauagccaugagcuccaauuaccucagagcuccgagucc

SEQ ID NO: 131611 - RNA, 64 nt, Human
ucuaugcuugaaaacucacuuccugaagcagcuugagcuccaaagugcacaucugguuccaacu

SEQ ID NO: 131612 - RNA, 64 nt, Human
augggauuagugcccuuauauaaagagacccagagagcuccaucaccccuucugccaugugaaa

SEQ ID NO: 131613 - RNA, 64 nt, Human
ggaacccuggcacuggcccagcagccucuucucugagcuccaugucccagauaaaccaggccag

SEQ ID NO: 131614 - RNA, 64 nt, Human
aacugucauugugcaucucugagguucccucauggagcuccacagauccauuuuuagggaaggg

SEQ ID NO: 131615 - RNA, 64 nt, Human
gacgagccagaucauucaguuucagcgaguccuugagcuccacaacaucuaccagauauagcag

SEQ ID NO: 131616 - RNA, 64 nt, Human
ccaggcauccaucuuggaagaaaggaccagcuuugagcuccaucaaggguauuuuaagugaugu

SEQ ID NO: 131617 - RNA, 64 nt, Human
ggcggcagccagaguucccugaagugggaagucagagcuccaugcacacagugucuucagaagg

SEQ ID NO: 131618 - RNA, 64 nt, Human
gcccugcugagcugcagcaccugcucuaggggacgagcuccaagcaaagccuggcucugggaaa

SEQ ID NO: 131619 - RNA, 64 nt, Human
agagcagugggagaggcccucugaguuggaaguugagcuccaccuccuuuccaagugagcacuc

SEQ ID NO: 131620 - RNA, 64 nt, Human
guuugggguaucucuagaaaacagcaacugaacagagcuccacacaucugucagggugugagca

SEQ ID NO: 131621 - RNA, 64 nt, Human
guggugcccacagugccgacccguggcugggucggagcuccauguuccuaagcuaggucuaggu

SEQ ID NO: 131622 - RNA, 64 nt, Human
caaagacucuccugcuuuuuuucugucugagugugagcuccauccgccugggcaucugauuuuu

SEQ ID NO: 131623 - RNA, 64 nt, Human
ccauccauagggagcuggcuggggguuuccgugggagcuccagaacuuuccccagcugagugaa

SEQ ID NO: 131624 - RNA, 64 nt, Human
uccacaggugcugcuucucacuggcccagacucugagcuccaccggcccagucugcacggccca

SEQ ID NO: 131625 - RNA, 64 nt, Human
ucauucaugugauugauuuguaauuucauuucuggagcuccauuuguuuuuguuucuaaacuac

SEQ ID NO: 131626 - RNA, 64 nt, Human
gccuguuugcagcuagacauugaccuccgccauugagcuccacgguuuacagacaauugcacaa

SEQ ID NO: 131627 - RNA, 64 nt, Human
uguggcugcuacaggagcacaguagugaaggccugagcuccagguuugaaagacccaacuggag

SEQ ID NO: 131628 - RNA, 64 nt, Human
ggguucuugcagaaagcaucagugccuacaaauggagcuccacccuucagucugugucguguuc

SEQ ID NO: 131629 - RNA, 64 nt, Human
ccacuggaaagcccauucccuuuauuuagaaaacgagcuccaggaagccgcuacuuugugucca

SEQ ID NO: 131630 - RNA, 64 nt, Human
cuauucuuaaaauuaagugggcuggagaagaauggagcuccacaugccagcaccguauauggaa

SEQ ID NO: 131631 - RNA, 64 nt, Human
gccuugcucugccccaugcccugaacaggcaugagagcuccacguccccuagugcacccugaga

SEQ ID NO: 131632 - RNA, 51 nt, Human
cuguucccgccguccucugaggagcuccaagccaacaaggcuacacuggug

SEQ ID NO: 131633 - RNA, 64 nt, Human
agcagaacuuagggucagggucucagggaacccugagcuccaagcgugcugugcgucugaccug

SEQ ID NO: 131634 - RNA, 64 nt, Human
ccugcuugcacacuuccccaucuuugauccuucugagcuccaccucugguggcuccuccuagga

SEQ ID NO: 131635 - RNA, 64 nt, Human
ccacagacguugcugagcaacucgccagccuccugagcuccaugcccaucaggacucuagccuc

SEQ ID NO: 131636 - RNA, 64 nt, Human
gccagcagcagacauagacgggugcagaagcggggagcuccaggugcaggagggcaccggccgg

SEQ ID NO: 131637 - RNA, 64 nt, Human
ccaguccccgguggaggaggggcacggggccuccgagcuccagcuccguucccaaggauacucg

SEQ ID NO: 131638 - RNA, 64 nt, Human
uacacuccuaauaugaaaagucaauccugugagagagcuccauguaugagggacacucuccaag

SEQ ID NO: 131639 - RNA, 64 nt, Human
agggguaggggcccauacaggaguccuccuuucugagcuccagccccagccccucgaaccaccu

SEQ ID NO: 131640 - RNA, 64 nt, Human
aaaccuacgucaagauuaacaaugcuuaacccaugagcuccaugugccuuuuggaucuuugcaa

SEQ ID NO: 131641 - RNA, 64 nt, Human
gcauggacucaggcaacugguaaugauaagcuaugagcuccagugcuuuugccaaaauucucuu

SEQ ID NO: 131642 - RNA, 64 nt, Human
uuauagccauuaaagaaagcacuaaggaugaugggagcuccaaaucugauaucagauaauuuag

SEQ ID NO: 131643 - RNA, 64 nt, Human
acuaaaaucuggcauuaaaaauuuuaaguauuuggagcuccauguacugauuacaguuuuuaaa

SEQ ID NO: 131644 - RNA, 64 nt, Human
uucuuuuuuaaggagaaaaaaaaaugaguaaaaggagcuccacacuuugacuuaauuucauaca

SEQ ID NO: 131645 - RNA, 64 nt, Human
agcuggcuacacaugaggccacuuguuuuagggugagcuccagggauuugccuggauuuugaaa

SEQ ID NO: 131646 - RNA, 64 nt, Human
accuguccaaguucaaauuggaaaccauguugaagagcuccaguuugacauuauucaugcacca

SEQ ID NO: 131647 - RNA, 64 nt, Human
ccgccgcccagcccaccccauggccggcuuucaggagcuccauacacacgcugccuucgguacc

SEQ ID NO: 131648 - RNA, 64 nt, Human; identical to SEQ ID NO: 64674

SEQ ID NO: 131649 - RNA, 64 nt, Human; identical to SEQ ID NO: 64675

SEQ ID NO: 131650 - RNA, 64 nt, Human; identical to SEQ ID NO: 64676

SEQ ID NO: 131651 - RNA, 64 nt, Human; identical to SEQ ID NO: 64677

SEQ ID NO: 131652 - RNA, 64 nt, Human; identical to SEQ ID NO: 64678

SEQ ID NO: 131653 - RNA, 64 nt, Human; identical to SEQ ID NO: 64679

SEQ ID NO: 131654 - RNA, 64 nt, Human; identical to SEQ ID NO: 64680

SEQ ID NO: 131655 - RNA, 64 nt, Human; identical to SEQ ID NO: 64681

SEQ ID NO: 131656 - RNA, 64 nt, Human; identical to SEQ ID NO: 64682

SEQ ID NO: 131657 - RNA, 63 nt, Human; identical to SEQ ID NO: 64683

SEQ ID NO: 131658 - RNA, 53 nt, Human; identical to SEQ ID NO: 64684

SEQ ID NO: 131659 - RNA, 64 nt, Human; identical to SEQ ID NO: 64685

SEQ ID NO: 131660 - RNA, 64 nt, Human; identical to SEQ ID NO: 64686

SEQ ID NO: 131661 - RNA, 64 nt, Human; identical to SEQ ID NO: 64687

SEQ ID NO: 131662 - RNA, 64 nt, Human; identical to SEQ ID NO: 64688

SEQ ID NO: 131663 - RNA, 64 nt, Human; identical to SEQ ID NO: 64689

SEQ ID NO: 131664 - RNA, 64 nt, Human; identical to SEQ ID NO: 64690

SEQ ID NO: 131665 - RNA, 64 nt, Human; identical to SEQ ID NO: 64691

SEQ ID NO: 131666 - RNA, 64 nt, Human; identical to SEQ ID NO: 64692

SEQ ID NO: 131667 - RNA, 64 nt, Human; identical to SEQ ID NO: 64693

SEQ ID NO: 131668 - RNA, 64 nt, Human; identical to SEQ ID NO: 64694

SEQ ID NO: 131669 - RNA, 64 nt, Human; identical to SEQ ID NO: 64695

SEQ ID NO: 131670 - RNA, 64 nt, Human; identical to SEQ ID NO: 64696

SEQ ID NO: 131671 - RNA, 64 nt, Human; identical to SEQ ID NO: 64697

SEQ ID NO: 131672 - RNA, 64 nt, Human; identical to SEQ ID NO: 64698

SEQ ID NO: 131673 - RNA, 64 nt, Human; identical to SEQ ID NO: 64699

SEQ ID NO: 131674 - RNA, 64 nt, Human; identical to SEQ ID NO: 64700

SEQ ID NO: 131675 - RNA, 64 nt, Human; identical to SEQ ID NO: 64701

SEQ ID NO: 131676 - RNA, 64 nt, Human; identical to SEQ ID NO: 64702

SEQ ID NO: 131677 - RNA, 64 nt, Human; identical to SEQ ID NO: 64703

SEQ ID NO: 131678 - RNA, 64 nt, Human; identical to SEQ ID NO: 64704

SEQ ID NO: 131679 - RNA, 64 nt, Human; identical to SEQ ID NO: 64705

SEQ ID NO: 131680 - RNA, 64 nt, Human; identical to SEQ ID NO: 64706

SEQ ID NO: 131681 - RNA, 64 nt, Human; identical to SEQ ID NO: 64707

SEQ ID NO: 131682 - RNA, 64 nt, Human; identical to SEQ ID NO: 64708

SEQ ID NO: 131683 - RNA, 64 nt, Human; identical to SEQ ID NO: 64709

SEQ ID NO: 131684 - RNA, 64 nt, Human; identical to SEQ ID NO: 64710

SEQ ID NO: 131685 - RNA, 64 nt, Human; identical to SEQ ID NO: 64711

SEQ ID NO: 131686 - RNA, 64 nt, Human; identical to SEQ ID NO: 64712

SEQ ID NO: 131687 - RNA, 64 nt, Human; identical to SEQ ID NO: 64713

SEQ ID NO: 131688 - RNA, 64 nt, Human; identical to SEQ ID NO: 64714

SEQ ID NO: 131689 - RNA, 64 nt, Human; identical to SEQ ID NO: 64715

SEQ ID NO: 131690 - RNA, 64 nt, Human; identical to SEQ ID NO: 64716

SEQ ID NO: 131691 - RNA, 64 nt, Human; identical to SEQ ID NO: 64717

SEQ ID NO: 131692 - RNA, 64 nt, Human; identical to SEQ ID NO: 64718

SEQ ID NO: 131693 - RNA, 64 nt, Human; identical to SEQ ID NO: 64719

SEQ ID NO: 131694 - RNA, 64 nt, Human; identical to SEQ ID NO: 64720

SEQ ID NO: 131695 - RNA, 64 nt, Human; identical to SEQ ID NO: 64721

SEQ ID NO: 131696 - RNA, 64 nt, Human; identical to SEQ ID NO: 64722

SEQ ID NO: 131697 - RNA, 64 nt, Human; identical to SEQ ID NO: 64723

SEQ ID NO: 131698 - RNA, 64 nt, Human; identical to SEQ ID NO: 64724

SEQ ID NO: 131699 - RNA, 64 nt, Human; identical to SEQ ID NO: 64725

SEQ ID NO: 131700 - RNA, 64 nt, Human; identical to SEQ ID NO: 64726

SEQ ID NO: 131701 - RNA, 64 nt, Human; identical to SEQ ID NO: 64727

SEQ ID NO: 131702 - RNA, 64 nt, Human; identical to SEQ ID NO: 64728

SEQ ID NO: 131703 - RNA, 64 nt, Human; identical to SEQ ID NO: 64729

SEQ ID NO: 131704 - RNA, 64 nt, Human; identical to SEQ ID NO: 64730

SEQ ID NO: 131705 - RNA, 64 nt, Human; identical to SEQ ID NO: 64731

SEQ ID NO: 131706 - RNA, 64 nt, Human; identical to SEQ ID NO: 64732

SEQ ID NO: 131707 - RNA, 64 nt, Human; identical to SEQ ID NO: 64733

SEQ ID NO: 131708 - RNA, 64 nt, Human; identical to SEQ ID NO: 64734

SEQ ID NO: 131709 - RNA, 64 nt, Human; identical to SEQ ID NO: 64735

SEQ ID NO: 131710 - RNA, 64 nt, Human; identical to SEQ ID NO: 64736

SEQ ID NO: 131711 - RNA, 64 nt, Human; identical to SEQ ID NO: 64737

SEQ ID NO: 131712 - RNA, 64 nt, Human; identical to SEQ ID NO: 64738

SEQ ID NO: 131713 - RNA, 64 nt, Human; identical to SEQ ID NO: 64739

SEQ ID NO: 131714 - RNA, 64 nt, Human; identical to SEQ ID NO: 64740

SEQ ID NO: 131715 - RNA, 64 nt, Human; identical to SEQ ID NO: 64741

SEQ ID NO: 131716 - RNA, 64 nt, Human; identical to SEQ ID NO: 64742

SEQ ID NO: 131717 - RNA, 52 nt, Human; identical to SEQ ID NO: 64743

SEQ ID NO: 131718 - RNA, 64 nt, Human; identical to SEQ ID NO: 64744

SEQ ID NO: 131719 - RNA, 58 nt, Human; identical to SEQ ID NO: 64745

SEQ ID NO: 131720 - RNA, 64 nt, Human; identical to SEQ ID NO: 64746

SEQ ID NO: 131721 - RNA, 64 nt, Human; identical to SEQ ID NO: 64747

SEQ ID NO: 131722 - RNA, 64 nt, Human; identical to SEQ ID NO: 64748

SEQ ID NO: 131723 - RNA, 64 nt, Human; identical to SEQ ID NO: 64749

SEQ ID NO: 131724 - RNA, 64 nt, Human; identical to SEQ ID NO: 64750

SEQ ID NO: 131725 - RNA, 64 nt, Human; identical to SEQ ID NO: 64751

SEQ ID NO: 131726 - RNA, 64 nt, Human; identical to SEQ ID NO: 64752

SEQ ID NO: 131727 - RNA, 64 nt, Human; identical to SEQ ID NO: 64753

SEQ ID NO: 131728 - RNA, 64 nt, Human; identical to SEQ ID NO: 64754

SEQ ID NO: 131729 - RNA, 64 nt, Human; identical to SEQ ID NO: 64755

SEQ ID NO: 131730 - RNA, 64 nt, Human; identical to SEQ ID NO: 64756

SEQ ID NO: 131731 - RNA, 64 nt, Human; identical to SEQ ID NO: 64757

SEQ ID NO: 131732 - RNA, 64 nt, Human
uucugcauauucgcuccuaagggaggcucugaggggaugcaacaaaaugauccuuaugaugucc

SEQ ID NO: 131733 - RNA, 64 nt, Human
gguggaagcccugagagcuucagguccugcucagcccgaggagcagucuggcaugggagugagg

SEQ ID NO: 131734 - RNA, 64 nt, Human
ucagcuccuccagauggagcaggugcgccggauccccgaggaauacucucuggggcggauggca

SEQ ID NO: 131735 - RNA, 64 nt, Human
cagguggggagcaggucucccagaaacaccccgucccgaggauggugcucugugcaugccccag

SEQ ID NO: 131736 - RNA, 64 nt, Human
uucccugaccacagccuugggaagacgguggaaacccgaggauguguggguuucccagcuaacg

SEQ ID NO: 131737 - RNA, 64 nt, Human
aucugguucuacuaccauaauguauaugcagcuucccgaggaugaaugcuguguuuaaauuuca

SEQ ID NO: 131738 - RNA, 64 nt, Human
cgucgccgacgagaaccagaaccaccaccuggagcccgaggaggugcucaaguacagcgaguuc

SEQ ID NO: 131739 - RNA, 64 nt, Human
aacaaaagcugaacagaggcggccguggccuuggcccgaggagacuaacuugcuuucucccugc

SEQ ID NO: 131740 - RNA, 64 nt, Human
auuauuugaugaguuccacuuguaucauggccuacccgaggagaagaggaguuuguuaacuggg

SEQ ID NO: 131741 - RNA, 64 nt, Human
cuagugguuuucaaacugguacacauuagacucacccgaggaauuuuaaaacagccuauaugcc

SEQ ID NO: 131742 - RNA, 64 nt, Human
ucgggugaugguguauucugcccugcgcaucccacccgaggacugagggaaccuaggggggacc

SEQ ID NO: 131743 - RNA, 64 nt, Human
aacacugagcugccaaaacauuuuuuuaaauacacccgaggagcccaagggggaagggcaaugc

SEQ ID NO: 131744 - RNA, 64 nt, Human
acagcugccuugauaccagcucucuguggaaacccccgaggaguuggaucuggagaacagcugg

SEQ ID NO: 131745 - RNA, 64 nt, Human
caccuucuccaaaccagauccaaucaaaccucagcccgaggaaacaugcuccccaacgugcucu

SEQ ID NO: 131746 - RNA, 64 nt, Human
ucgggggaagacgcggcaggccggccgagggcaccccgaggaacauggcauggccucugugcga

SEQ ID NO: 131747 - RNA, 64 nt, Human
gcccaggguggggggugucagggcaguggaggggcccgaggagccagguugcauuuauuggaug

SEQ ID NO: 131748 - RNA, 64 nt, Human
cuagagucaccgucauucugaggucaaaucauggcccgaggacaagggcuguaagacagggagc

SEQ ID NO: 131749 - RNA, 64 nt, Human
gcugcugcuuguguaggucggggagccagagauccccgaggacgcgcgccggacagucggcacu

SEQ ID NO: 131750 - RNA, 64 nt, Human
acuuuguugcugaaguaaacguuacuuguugcaacccgaggaugggcaugagguuuggccuuag

SEQ ID NO: 131751 - RNA, 64 nt, Human
cucccacuuugccuucugccaugaguaaaaauuccccgaggacucccuagaagcagauguugcc

SEQ ID NO: 131752 - RNA, 64 nt, Human
ccacaaaaucuguacucccagcggggguguuuggcccgaggagucaguguuauuacugguggau

SEQ ID NO: 131753 - RNA, 64 nt, Human
ccugcuguccugggggagagaagguucgccccuccccgaggaagaaggcuucuggucaggaccc

SEQ ID NO: 131754 - RNA, 59 nt, Human
cgucagugcugugcuccuaagccaugggacccgaggacugccccccggcgccugcccag

SEQ ID NO: 131755 - RNA, 64 nt, Human
ugcacacaucgucugugaauuguggcuguucacucccgaggauguguccuagacuccgggucgc

SEQ ID NO: 131756 - RNA, 64 nt, Human
ggccucucagacccagaugugacgggguguguggcccgaggaagcuggacagcggcagugggcc

SEQ ID NO: 131757 - RNA, 64 nt, Human
gaaggagcuggguggccuugagggagaccccagccccgaggaggaugagggcauccagaaggca

SEQ ID NO: 131758 - RNA, 64 nt, Human
gacugcuuaaccaaagaaauugaucuuuuucaagcccgaggaccacauuuuaaccccagcgcua

SEQ ID NO: 131759 - RNA, 64 nt, Human
agaacuccucucugcugcacccacagcaucuguucccgaggaguuaugacucuugacuuccugc

SEQ ID NO: 131760 - RNA, 64 nt, Human
gcucuuaacucgaugacuuggggcucccugcucucccgaggaagaugcucugcaggaaaauaaa

SEQ ID NO: 131761 - RNA, 64 nt, Human
gagcccaaguagccucuggccagggacccaaugucccgaggaaucugccucccacccacugacu

SEQ ID NO: 131762 - RNA, 64 nt, Human
aggggcccagagcaaagggcaucagggagaaagucccgaggaaaugugaccagugguuucugcu

SEQ ID NO: 131763 - RNA, 64 nt, Human
cacacgucgugaggucuccccugugcucuggugacccgaggaggucgugcagcacagcgcagaa

SEQ ID NO: 131764 - RNA, 64 nt, Human
cucccuugagcaccaggagugggugccagccggccccgaggauucccagcaccccaccuauggu

SEQ ID NO: 131765 - RNA, 64 nt, Human
cgcccauccgugcuaugacauggaggcacugaagcccgaggaagguguguggagauucuaaucc

SEQ ID NO: 131766 - RNA, 64 nt, Human
ucaaacugcaccgccggccagauacccuccugaccccgaggacuuggucuggucucucuggugg

SEQ ID NO: 131767 - RNA, 64 nt, Human
ggaaagcggggugacucauuucccuuguccagggcccgaggagagugagguguccagccugcaa

SEQ ID NO: 131768 - RNA, 64 nt, Human
gcccauaaagccugaugacuugccccaagggccacccgaggaagcaguauuaucugcggugggg

SEQ ID NO: 131769 - RNA, 64 nt, Human
auccaccuggcaggugaccuggaggaguagcuuccccgaggacccccaggcuuggccugugauu

SEQ ID NO: 131770 - RNA, 64 nt, Human
cuggaagucgggcccugggcugcccgaucgccagcccgaggacuuaccauccacaaugcaccac

SEQ ID NO: 131771 - RNA, 64 nt, Human
uccuggaaagggacugucccaagccacuuaccuucccgaggagucugcugguucuccuugagga

SEQ ID NO: 131772 - RNA, 64 nt, Human
gaggguuugagcgucuggaaacucucugcucugacccgaggaagcacccuccugacgccgccuu

SEQ ID NO: 131773 - RNA, 64 nt, Human
aggggaggauuccgucuucucucaugagccgcugcccgaggagcccugccugccccgacaccca

SEQ ID NO: 131774 - RNA, 64 nt, Human
ugacguuuuuaguagggagcuggggaaacgacugcccgaggaaugcggucggaggauuguguug

SEQ ID NO: 131775 - RNA, 64 nt, Human
gagugaauugaauauuguaagucagccacugggacccgaggauuucugggaccccgcaguuggg

SEQ ID NO: 131776 - RNA, 64 nt, Human
uccucugcuuccugugcuguccccuggggaaggucccgaggaugcugucaggagauggaagagu

SEQ ID NO: 131777 - RNA, 64 nt, Human
uccucugcuuccugagcuguccccuggagaaggucccgaggaugcugucaggagauggaagagu

SEQ ID NO: 131778 - RNA, 64 nt, Human
uaagugccuuccaugucggccucuaaccccaggccccgaggacccagacccaguggggaggcgg

SEQ ID NO: 131779 - RNA, 64 nt, Human
gggggggcgccuggagagcgaggaggcgcggccucccgaggaggggcccgguggcggcagggcc

SEQ ID NO: 131780 - RNA, 64 nt, Human
ggcaggggcaggggcagggacaguggccaggcggcccgaggacuuacggucggcacuucucugu

SEQ ID NO: 131781 - RNA, 64 nt, Human
gauaagggaagcggccacuucucccucccugagacccgaggaugccccugguggggguggccuu

SEQ ID NO: 131782 - RNA, 64 nt, Human
uggguugagugagucccacaaagggcaaguggggcccgaggaagccucucuggggccaggggua

SEQ ID NO: 131783 - RNA, 64 nt, Human
ccucgguucccacccucagcaagcaggccuccagcccgaggaaggccucugccguagugacguu

SEQ ID NO: 131784 - RNA, 64 nt, Human
gauguugagggccagucuaggcugacacauccuacccgaggacaagccuguucuccauuucuuc

SEQ ID NO: 131785 - RNA, 64 nt, Human
ugccgcccagccaccuucaaugccugccacccugcccgaggauguacagagccgugcccacaca

SEQ ID NO: 131786 - RNA, 64 nt, Human
uccccaccugacacuaaccagagucagcacaggccccgaggagcccgaagucugcugcugugca

SEQ ID NO: 131787 - RNA, 64 nt, Human
caaugccccuccagggcuggaggggaagaggggccccgaggaugggccugggcucagcauucga

SEQ ID NO: 131788 - RNA, 64 nt, Human
gcacugcugcagggcaagaacauucauguaggagcccgaggaccagcaggcugggaauggggag

SEQ ID NO: 131789 - RNA, 64 nt, Human
aggggagagacaccacagaaggagacccagacaucccgaggaaguucccagcagagcaaacugc

SEQ ID NO: 131790 - RNA, 64 nt, Human
acucucacaucucgggccccaaauggacagaucacccgaggagcuggaggggucggccaagcug

SEQ ID NO: 131791 - RNA, 64 nt, Human
caugcucagagaagccuaggugggcuaccaugaccccgaggaagagcaggcuuuguuuuccauc

SEQ ID NO: 131792 - RNA, 64 nt, Human
agcccuguuggugcuuuaccaccgcuuggagucucccgaggacacaaacaggcagagagggacg

SEQ ID NO: 131793 - RNA, 64 nt, Human
ugcggcugguggagacggggccugggcucccgggcccgaggaggaaaaggauugccaaggcucc

SEQ ID NO: 131794 - RNA, 64 nt, Human
gggggcggguguccguccggaaaugaaggaauagcccgaggaccgggcugggguuuauuuaaac

SEQ ID NO: 131795 - RNA, 64 nt, Human
ugucugccuggcuucuugucuguccugcuucuaccccgaggacuccucugcagggagcgccauc

SEQ ID NO: 131796 - RNA, 64 nt, Human
guccccuccucacucccuucccauaagcuauagacccgaggaaacucagagucggaacggagaa

SEQ ID NO: 131797 - RNA, 64 nt, Human
cuggaccgaagaagaacugagcauuuucaaaguucccgaggagagauggaugccgcguccccuu

SEQ ID NO: 131798 - RNA, 64 nt, Human
caggcggggggcacggagccacuuccuguacagacccgaggaagccagugcaugcagaguucac

SEQ ID NO: 131799 - RNA, 64 nt, Human
caauugcauaguucagaagcccucacuuuucagccccgaggaugguuuuguucaucuuccacca

SEQ ID NO: 131800 - RNA, 64 nt, Human
ccuggccaccccuucuuucccuccgcgccccgcccccgaggagccuaauaaagaucucguugug

SEQ ID NO: 131801 - RNA, 64 nt, Human
cuuuucuggaagggcagcauauaaaaacaucagucccgaggaggggacaacaauacuaccucac

SEQ ID NO: 131802 - RNA, 64 nt, Human
ugagaccauucagaauaucaucuuuuagacacagcccgaggaaucaacaauaguaacucuuucu

SEQ ID NO: 131803 - RNA, 64 nt, Human
guuucuucuccucuaucucauaaugcauuaugggcccgaggaauaggggaggguuaauaagacu

SEQ ID NO: 131804 - RNA, 64 nt, Human
ucucuguagccuuuccugguagucaauuuguugucccgaggauucaucuuuuucuuccgccugc

SEQ ID NO: 131805 - RNA, 64 nt, Human
ggcugagcgucccaggcauagaaaccucgaagcgcccgaggaaacgagggccugcuggcugaga

SEQ ID NO: 131806 - RNA, 64 nt, Human
gacugccccaaaugcaaguucucguacgcccuggcccgaggaggcugcaugcacuuucacugua

SEQ ID NO: 131807 - RNA, 64 nt, Human
ucuagcacaucauggcagugggaccaagcguggucccgaggaagggccagagccugguagagac

SEQ ID NO: 131808 - RNA, 64 nt, Human
uuuccuuccugugcucuggacugcugcccuuguccccgaggagugucccgcgcagccacaccug

SEQ ID NO: 131809 - RNA, 64 nt, Human
aaaaucgaucuacacacauccacgcacaugcgaccccgaggaaacgaaacccacucuagaaaac

SEQ ID NO: 131810 - RNA, 64 nt, Human
gugcucgcugccccgcggcuucgagccccaagcucccgaggacuuggcgcagcggaguuuggug

SEQ ID NO: 131811 - RNA, 64 nt, Human
guagaagacauuuaauuucuaaagcuugaagugccccgaggagcagguagaauuuccagcaggg

SEQ ID NO: 131812 - RNA, 64 nt, Human
ugacuuuccugugugcgugagcaccaagccggagcccgaggacgaugcagaagagggacuuggg

SEQ ID NO: 131813 - RNA, 64 nt, Human
uaagauccuauuaaguguuugauucaaaccucuacccgaggaagggcuguuaccuuacuccugg

SEQ ID NO: 131814 - RNA, 64 nt, Human
aggagguuccgaggcucaaaggaggggaaggagccccgaggaggcucugaguugaugucacuua

SEQ ID NO: 131815 - RNA, 64 nt, Human
gcaaaagggaugcaaagaggucccagggaccugccccgaggaaggccaccccccagguccccug

SEQ ID NO: 131816 - RNA, 64 nt, Human
acugugcccgcuggacacuggggucagagcagugcccgaggaagcggggucuggcccugguggg

SEQ ID NO: 131817 - RNA, 64 nt, Human
ugucugccugugcugugucguguggcuuuaucagcccgaggaagggcagguguauucuaauuug

SEQ ID NO: 131818 - RNA, 64 nt, Human
uccaaucuuccaguggccagcacacccuagacaccccgaggagggagggcuccuuucuagccug

SEQ ID NO: 131819 - RNA, 64 nt, Human
ggccucuccaaucccuggcguacaggguuuccugcccgaggagcugcuccaggagccugcgcgg

SEQ ID NO: 131820 - RNA, 64 nt, Human
gcagcuucugacaaggcuucuaaagagcaaccaccccgaggaccuucaggcugcaaaccgguua

SEQ ID NO: 131821 - RNA, 64 nt, Human
uggucccaugaaacacuaagggucgucacgcccucccgaggagcucaaggaccugccugucagg

SEQ ID NO: 131822 - RNA, 64 nt, Human
cucuugaugccagugcagagaccagagucagaugcccgaggacaguggguaggaauuucaucaa

SEQ ID NO: 131823 - RNA, 64 nt, Human
uugaagagcuugggauggauuugacuaaaucugccccgaggagggugaacaaggugaucucaga

SEQ ID NO: 131824 - RNA, 64 nt, Human
ccugcccacgcagaccugcagcgggcaaagagcucccgaggaagcacagcuugggucagguucu

SEQ ID NO: 131825 - RNA, 64 nt, Human
aaagcugaauccagaucauuccucagaaugaggacccgaggacaguggcagacagacgcguugg

SEQ ID NO: 131826 - RNA, 64 nt, Human
cugggucacccgaauuuucccaccccugcuucuccccgaggagguugagcucuugagcaaguug

SEQ ID NO: 131827 - RNA, 64 nt, Human
uuauaaagugcaccucgcccccgcaagccccagccccgaggaccguccauggaccuuauuuuua

SEQ ID NO: 131828 - RNA, 64 nt, Human
caucuggccuggccagugcccugaucccagagagcccgaggaggugucucaggcugccugaguc

SEQ ID NO: 131829 - RNA, 64 nt, Human
aauugagucacccccuagauaccaacugucugaccccgaggagcucuguaagucccugcuccuc

SEQ ID NO: 131830 - RNA, 64 nt, Human
cccagagaaggccccaccuucuucaucccucagacccgaggaggccucccaguaaggaguuucc

SEQ ID NO: 131831 - RNA, 53 nt, Human
caguuuacuucagcacuuaaauccccgaggagucugcccugccuagagaaggg

SEQ ID NO: 131832 - RNA, 64 nt, Human
aaggggcccuccuuaaaagggacaggaugaccuucccgaggaacucauuggccugggguaguuu

SEQ ID NO: 131833 - RNA, 64 nt, Human
ucgagcccacccagcaucccgcgcgcccuuccuucccgaggaacucgccucagccugaucaggc

SEQ ID NO: 131834 - RNA, 64 nt, Human
guuugauacuguggggauucaguuuaggcgcuggcccgaggauaucccagcggugguacuucgg

SEQ ID NO: 131835 - RNA, 64 nt, Human
ccagaagucaaggguugggguggcgacacggccucccgaggaagaggucugcuugauggugacu

SEQ ID NO: 131836 - RNA, 64 nt, Human
gcugaauuccaagcccaggguuuggcuccuuaaacccgaggaccgccaccucuucccagugcuu

SEQ ID NO: 131837 - RNA, 64 nt, Human
cucagcccgcugaguggggggucgugggccaguccccgaggagcugggccccugcacaggcaca

SEQ ID NO: 131838 - RNA, 57 nt, Human
ggcugguccagaguuccuagcacuggccccgaggacagccaagggccauuucuucuc

SEQ ID NO: 131839 - RNA, 59 nt, Human
gccagaggaacucuuccugaggcagguggcccgaggacgcucccugcuccacgucugcg

SEQ ID NO: 131840 - RNA, 64 nt, Human
gcuugcauggacucugccuucccagcgcuugucccccgaggaaggcggcugggcgggcggggag

SEQ ID NO: 131841 - RNA, 64 nt, Human
aggguuugcuuuuaaggaucggcucccugucgcgcccgaggagggccuggaccuuucgugucgg

SEQ ID NO: 131842 - RNA, 64 nt, Human
ccaggcccacgaaagacggugacucuuggcucugcccgaggauguggccguucccugccugggc

SEQ ID NO: 131843 - RNA, 56 nt, Human
cugguggcggcggcguguaacaccuucccgaggaaacuccgcugccgacccugccu

SEQ ID NO: 131844 - RNA, 64 nt, Human
gauuggccauuuauacugggcucgagcucagaagcccgaggaacucuuugcuccccugcuuugg

SEQ ID NO: 131845 - RNA, 64 nt, Human
gugaggcacuuugucccgcccagcgcuggccagccccgaggagccgcugccuucaccgccccga

SEQ ID NO: 131846 - RNA, 64 nt, Human
cuagucugagccggcgcgagggcacgggcuguggcccgaggaggcgguggacugaaggcaugag

SEQ ID NO: 131847 - RNA, 64 nt, Human
aagcaaggauauauaaggcacuguggugguuauucccgaggagccagagaaaccuggagaagag

SEQ ID NO: 131848 - RNA, 64 nt, Human
aggcggugagagaggauuuauuuaaaaaaauaaacccgaggaagaugcucaucugagccagcac

SEQ ID NO: 131849 - RNA, 64 nt, Human
auaauauuguggucugaauggcgugaauuuuuaucccgaggagggggcaguugugacaaccucc

SEQ ID NO: 131850 - RNA, 64 nt, Human
aaagagacagaguccccacuagcaucuccugacacccgaggagcccugagucacccugagauag

SEQ ID NO: 131851 - RNA, 64 nt, Human
ccagccuggggaugggccccuuucaggaaucacccccgaggauggccucgggguuucccccugu

SEQ ID NO: 131852 - RNA, 64 nt, Human
ggggcccggggcucaagugcgggaagggggcuggcccgaggaucccauggcucucacaccaugu

SEQ ID NO: 131853 - RNA, 64 nt, Human
gagcaggggugggaggcagguggacuccuggguccccgaggaggaggggacuggggucccggau

SEQ ID NO: 131854 - RNA, 50 nt, Human
ggggccgcgcugcgcccugacccgaggacgcccugagcgggaggucgcgg

SEQ ID NO: 131855 - RNA, 64 nt, Human
ggcaccaagggaaggccccauuccggggcuguuccccgaggaggaagggaaggggcucugugug

SEQ ID NO: 131856 - RNA, 64 nt, Human
gcucucccugccucucacacacaauuuuacaugccccgaggagccaaguuugggacauuuaccc

SEQ ID NO: 131857 - RNA, 64 nt, Human
cagccugacaggaugcagugaggggcguuccugccccgaggacuguggcauugucaccuucaca

SEQ ID NO: 131858 - RNA, 64 nt, Human
ggccaugccagggaaaggaagagcuccccugaaucccgaggacacaguccccugcguacuugcu

SEQ ID NO: 131859 - RNA, 64 nt, Human
acaccggugcccgccacaugccaacccucaccuccccgaggacuggaugaugugcugccacgug

SEQ ID NO: 131860 - RNA, 64 nt, Human
cccuucucuccugccaggacauuuucugcacugccccgaggaacgcugagccuuccucccuggg

SEQ ID NO: 131861 - RNA, 64 nt, Human
ccagcacgggcugcccucaggaagaccaguguugcccgaggaggggccggccugcuggccuggg

SEQ ID NO: 131862 - RNA, 64 nt, Human
cuccccacccccuccaggcccggggcugaaacagcccgaggacagccccaggggcuggcuuuca

SEQ ID NO: 131863 - RNA, 64 nt, Human
ugcccauccagguguacaaaggcuacauggaugacccgaggaacacggacaaugccuggaucga

SEQ ID NO: 131864 - RNA, 64 nt, Human
ugccgcucuucacucuggccucgcugagcggcugcccgaggaggagcucuaggccgacgcccac

SEQ ID NO: 131865 - RNA, 64 nt, Human
cugaugucuuaacgaauaaaggucccaugcuccacccgaggacaguucuucgugccugagacuu

SEQ ID NO: 131866 - RNA, 64 nt, Human
gugcgucucuguggguuagucugucucucuccugcccgaggaaugcugagcgcccugagccggu

SEQ ID NO: 131867 - RNA, 64 nt, Human
ucaggcuaugcugcuuugggcagguggagcaccccccgaggaagccugcaaguccagggcacag

SEQ ID NO: 131868 - RNA, 64 nt, Human
aaguacaacaucagcucagcaggaacgccggcuccccgaggacccaggcuugacgauucaccgg

SEQ ID NO: 131869 - RNA, 64 nt, Human
ccuuggcauccugagcuucggucuguccagccgacccgaggaggccggacucagacacauaggc

SEQ ID NO: 131870 - RNA, 64 nt, Human
augugcauuaugggugccagguggccagugagggcccgaggaccacgcagcagagucccccacg

SEQ ID NO: 131871 - RNA, 64 nt, Human
gacauggugcugugugugagcgagugacagaaggcccgaggaggccgacugggcugcuggggca

SEQ ID NO: 131872 - RNA, 64 nt, Human
caguggcucagcagcaagaaugcugguucuacaucccgaggagugucugaggugcgccccacuc

SEQ ID NO: 131873 - RNA, 64 nt, Human
agcuaccuguagggccuggggaaagccaggauggcccgaggaagaggcagaagccgugggugug

SEQ ID NO: 131874 - RNA, 64 nt, Human
ugugggagcaggcccagugggaggcuguggacaccccgaggacaguguccugucucgaggcagg

SEQ ID NO: 131875 - RNA, 64 nt, Human
gaagaccucccuucuugccucuccagacguguuccccgaggagaucuuccuuccguccuuccug

SEQ ID NO: 131876 - RNA, 64 nt, Human
cacguaccugaaccacgagggccagcucucccgacccgaggaguugcgccugcggaucuaucau

SEQ ID NO: 131877 - RNA, 64 nt, Human
gaccaaaccugggcccuggauggccuuggccugucccgaggagaaaugagaaaaucccagaucu

SEQ ID NO: 131878 - RNA, 64 nt, Human
cccaggacggagcggggcugcccugccugaggcucccgaggagcuuugugcuuugguguuccac

SEQ ID NO: 131879 - RNA, 64 nt, Human
cagagcaacuuaccccggccagccagcccucucacccgaggaucccuacccccuggccccacaa

SEQ ID NO: 131880 - RNA, 64 nt, Human
ucugaagaauuggccgcuguggaaaagagcaaauguccgagacccccaacaggaagagucuaaa

SEQ ID NO: 131881 - RNA, 64 nt, Human
acuugacaaguugcgacggagagaaaaaagaaguguccgagaacuaaagccaaggguauccaag

SEQ ID NO: 131882 - RNA, 64 nt, Human
ugugacucggcuagguggggcaaggcugggcaguguccgagagagcaccccucucugcaucuga

SEQ ID NO: 131883 - RNA, 64 nt, Human
ccugagaaaagcuggggaaacagucugagcuggaguccgagagugguugggggugggccguggc

SEQ ID NO: 131884 - RNA, 64 nt, Human
gggaauccaaggccacgagacuccuugguuugugguccgagauccuguacuaaggagggucugg

SEQ ID NO: 131885 - RNA, 64 nt, Human
aaacucauuccaaauacuucuuuuuuccccuggaguccgagaaggaaaauggaauucugguuca

SEQ ID NO: 131886 - RNA, 64 nt, Human
cagcugcugcuggagauucaaagcccaacuguggguccgagagggaagcuggcugggcuggcug

SEQ ID NO: 131887 - RNA, 64 nt, Human
gugggcccagcucagcagggacaguuuggggagaguccgagaggcugggcugauucccuucugu

SEQ ID NO: 131888 - RNA, 64 nt, Human
gaaaacucauagaaccauucccuagaucccauuuguccgagaggcuuuggugcuuaguuaaggu

SEQ ID NO: 131889 - RNA, 64 nt, Human
aaugacgauacccgugacucagcccuggacacugguccgagaagggacaugugggacgugagcc

SEQ ID NO: 131890 - RNA, 64 nt, Human
aggagauccagagccagcagcggcuggagagccuguccgagacacccgggccuagcucuccgcg

SEQ ID NO: 131891 - RNA, 64 nt, Human
gcaaggggaagccuccugucuccccuuuccccgcguccgagaaggcggaaacccacaguguuac

SEQ ID NO: 131892 - RNA, 64 nt, Human
ccgcagccgccugugcugguacgacuauguggagguccgagauggcuucuggaggaaggcgccc

SEQ ID NO: 131893 - RNA, 64 nt, Human
ugugugaaugagccagacacauugcuuaaccugaguccgagauggacaaugguauaggaaagau

SEQ ID NO: 131894 - RNA, 64 nt, Human
cguuucugcuucuagagauugaggugaaagcuucguccgagaaacgccaggacagacgauggca

SEQ ID NO: 131895 - RNA, 64 nt, Human
gaucgagaugguacaagaggcugguagaguaacuguccgagaugggaugccugagcucuugaag

SEQ ID NO: 131896 - RNA, 64 nt, Human
ccaacugcagcucccagggacuccgagaccuccgguccgagacccugccuggguucacccccca

SEQ ID NO: 131897 - RNA, 64 nt, Human
gugagccacugugcccagcccagguuuugaaguuguccgagauagcagucugcucucuacugcc

SEQ ID NO: 131898 - RNA, 64 nt, Human
gccagaggaaugaugggcuuuuguucugagggguguccgagaggcugguguaugcacugcucac

SEQ ID NO: 131899 - RNA, 64 nt, Human
gccgcccagcaugcagguggccucgcuuugccggguccgagaggcuccccgucaauuuugcacg

SEQ ID NO: 131900 - RNA, 64 nt, Human
uuaggacacgacaugaaaccagaguggugccucuguccgagaacuuguaaguucucaacuuggg

SEQ ID NO: 131901 - RNA, 64 nt, Human
gcccccacgggacgcggcaggcuucucagucucuguccgagacagccgggaggagccugggggc

SEQ ID NO: 131902 - RNA, 64 nt, Human
gaugugcaggaguaaguaguauaagaagaaucaaguccgagagugaucaggaaaugaguauuaa

SEQ ID NO: 131903 - RNA, 64 nt, Human
aucaauuacuguccucacuuagaacaaagccugaguccgagaauauuuauauuuuaccaauaua

SEQ ID NO: 131904 - RNA, 64 nt, Human
acuacagaaaacagcugaagacaguggccaugcaguccgagaggaguaguggucugccucuaau

SEQ ID NO: 131905 - RNA, 64 nt, Human
uuucugucucccaaccucuacuguaaacuuucugguccgagaacgagccgaacacagcgcgacg

SEQ ID NO: 131906 - RNA, 64 nt, Human
gggcagugucacacccugccugcucaguccugggguccgagaugcuagggacgcuugagugagg

SEQ ID NO: 131907 - RNA, 61 nt, Human
uuuucuccuugaagacaugacaauggaugaaguccgagaauuugaacgagccacucaggaa

SEQ ID NO: 131908 - RNA, 64 nt, Human
ccaagcccgcccggggcugagcgcacgccccgagguccgagaccgccacgcacagggauacagg

SEQ ID NO: 131909 - RNA, 64 nt, Human
gacaagcagaguaacaggaucagugggucuaaguguccgagacuuaacgaaaauaguauuucag

SEQ ID NO: 131910 - RNA, 64 nt, Human
uuagaacuuaagaccugauucuagcaauaaacguguccgagaugagcggugacuggcgugcacg

SEQ ID NO: 131911 - RNA, 64 nt, Human
uccacgcggggcagacucuggcgggucuccuagcguccgagagauggcuuauuuucuacaguau

SEQ ID NO: 131912 - RNA, 64 nt, Human
ucuuacaaaugucaucagugugguaaggucuucaguccgagaucacuccuugcagaccaucaga

SEQ ID NO: 131913 - RNA, 64 nt, Human
acucgcugucccccuccggccacccuagaccaggguccgagaggcaggcaggagccacucaugu

SEQ ID NO: 131914 - RNA, 64 nt, Human
ggcagccugagcagcuccaaagcacuggcuugggguccgagaccuucaaaguaaagcaggcgga

SEQ ID NO: 131915 - RNA, 64 nt, Human
cuugaucaaugaaaugucacauuauucauccugaguccgagacucaaauuuucugccccagcca

SEQ ID NO: 131916 - RNA, 64 nt, Human
uaaaaauagaagacauccccaguccucaugacauaccgcaaauaucugugggguccuguugaaa

SEQ ID NO: 131917 - RNA, 64 nt, Human
gaaaaaggggguuucguuuacacgcugugagaucaccgcaaaccuaccuuacuguguugaaacg

SEQ ID NO: 131918 - RNA, 64 nt, Human
cccuugcugagauuguagagauugagugcucuggaccgcaaaagccaggcuaguccuuguaggg

SEQ ID NO: 131919 - RNA, 64 nt, Human
ugaaaagcaguucaugucugaaacagagaaccaaaccgcaaacgugaaauucuauugaaaacag

SEQ ID NO: 131920 - RNA, 64 nt, Human
aguggacccugagccuagaagagcagaauccaggaccgcaaacugccaaggacaucccccuucu

SEQ ID NO: 131921 - RNA, 64 nt, Human
aaaaauauauaaaaaacaagaaaauaacaaauuaaccgcaaacuaucaacaacccccaaccacc

SEQ ID NO: 131922 - RNA, 64 nt, Human
uggcugguguuuguaguugacauaaaggauuaagaccgcaaauuguccuucauggguagaguca

SEQ ID NO: 131923 - RNA, 64 nt, Human
uuuuaaacauugaaaagaaauauggaggcuuuaaaccgcaaacugaaaaagcugaguagaacaa

SEQ ID NO: 131924 - RNA, 64 nt, Human
aaaggggacacagaagcacuggcugcugcuacagaccgcaaaagcagaaaguuucgugaaaaug

SEQ ID NO: 131925 - RNA, 64 nt, Human
gacaggggagugcuggaaccgcggaguuuggcucaccgcaaagcugcaacgauggacucuugca

SEQ ID NO: 131926 - RNA, 64 nt, Human
cccaggcuggagugcauuggcgcgaucucggcucaccgcaaaguccgccucccaggcgauucuc

SEQ ID NO: 131927 - RNA, 64 nt, Human
gagggcuguggucauacacacuguguacguggccaccgcaaaggacggcgucgugcaacccuag

SEQ ID NO: 131928 - RNA, 64 nt, Human
gcuucggcggcugagcuuaccucuacaguacacuaccgcaaaaccaacggcccuuuucagggcc

SEQ ID NO: 131929 - RNA, 64 nt, Human
agaugaugaaugggaaaaaaaacauagagaucacaccgcaaagaagcaaagcguaauaauuacu

SEQ ID NO: 131930 - RNA, 64 nt, Human
ggcuacugaugauacagccaugcugacauucaucaccgcaaagaugaugauuccagucucuggu

SEQ ID NO: 131931 - RNA, 64 nt, Human
gaugugguauaugaucuuaaaugaugaacaugagaccgcaaaaauucacuccuggagaucuccg

SEQ ID NO: 131932 - RNA, 64 nt, Human
cuucccguggucauuuuaauuacggggcagugucaccgcaaagggaggaaacucaaagccgaaa

SEQ ID NO: 131933 - RNA, 64 nt, Human
auucuaaauuuaaaaaaucuucaaaucugaauauaccgcaaaugucaugagaaguuugauucag

SEQ ID NO: 131934 - RNA, 64 nt, Human
aaaauuuuuuuguucucuugcauuuuuuucaacuaccgcaaagcuauacagauuuuuuuguacu

SEQ ID NO: 131935 - RNA, 64 nt, Human
ccugcuuccaagaauaaaacaguucugaaaagcaaccgcaaagccgggcgcgguggcucacacc

SEQ ID NO: 131936 - RNA, 64 nt, Human
uguccuuucagacaaagcuuguacaaauuccugaaccgcaaauuugcugaagugaccguauaua

SEQ ID NO: 131937 - RNA, 64 nt, Human
cugguggaggcugcugugggacggucaggccaccaccgcaaagaggcagccggagcuucugcac

SEQ ID NO: 131938 - RNA, 64 nt, Human
gguuuggccauuaauuugucuuccauuugaugauaccgcaaaauuccgugaguccauuccuuug

SEQ ID NO: 131939 - RNA, 64 nt, Human
gcauucucucuggcgauggaguguggcugggcugaccgcaaaaggugccuuacacacugccccc

SEQ ID NO: 131940 - RNA, 64 nt, Human
gaguacacagugacccaggagucugggccagcccaccgcaaagaauucaccaugaccugucgag

SEQ ID NO: 131941 - RNA, 64 nt, Human
ugaacuguacuggcuguugaccaccagacaccugaccgcaaauaucuuuucuuguauucccaua

SEQ ID NO: 131942 - RNA, 64 nt, Human
uagacugaaaugauacaaacuuccaucuggucugaccgcaaacaguguuuauuuggggacaggg

SEQ ID NO: 131943 - RNA, 64 nt, Human
agauccgugcgcccgaccagcaccagcaucgcggaccgcaaaggccgcccgucccgucaaacaa

SEQ ID NO: 131944 - RNA, 64 nt, Human
uucccguuuccuucaaggacaugaaagaacucauaccgcaaagaagcuaugugaauguaaggaa

SEQ ID NO: 131945 - RNA, 64 nt, Human
uugcugcucugcggcaccaucucucucaggguuuaccgcaaagugcugcaggccgugcaccggg

SEQ ID NO: 131946 - RNA, 64 nt, Human
uuccugcagugcugaaauucauccuacggaaguaaccgcaaaacucuagagggggaguugagca

SEQ ID NO: 131947 - RNA, 50 nt, Human; identical to SEQ ID NO: 58964

SEQ ID NO: 131948 - RNA, 64 nt, Human; identical to SEQ ID NO: 58965

SEQ ID NO: 131949 - RNA, 64 nt, Human; identical to SEQ ID NO: 58966

SEQ ID NO: 131950 - RNA, 64 nt, Human; identical to SEQ ID NO: 58967

SEQ ID NO: 131951 - RNA, 64 nt, Human; identical to SEQ ID NO: 58968

SEQ ID NO: 131952 - RNA, 64 nt, Human; identical to SEQ ID NO: 58969

SEQ ID NO: 131953 - RNA, 64 nt, Human; identical to SEQ ID NO: 58970

SEQ ID NO: 131954 - RNA, 64 nt, Human; identical to SEQ ID NO: 58971

SEQ ID NO: 131955 - RNA, 64 nt, Human; identical to SEQ ID NO: 58972

SEQ ID NO: 131956 - RNA, 64 nt, Human; identical to SEQ ID NO: 58973

SEQ ID NO: 131957 - RNA, 64 nt, Human; identical to SEQ ID NO: 58974

SEQ ID NO: 131958 - RNA, 64 nt, Human; identical to SEQ ID NO: 58975

SEQ ID NO: 131959 - RNA, 64 nt, Human; identical to SEQ ID NO: 58976

SEQ ID NO: 131960 - RNA, 64 nt, Human; identical to SEQ ID NO: 58977

SEQ ID NO: 131961 - RNA, 64 nt, Human; identical to SEQ ID NO: 58978

SEQ ID NO: 131962 - RNA, 64 nt, Human; identical to SEQ ID NO: 58979

SEQ ID NO: 131963 - RNA, 64 nt, Human; identical to SEQ ID NO: 58980

SEQ ID NO: 131964 - RNA, 64 nt, Human; identical to SEQ ID NO: 58981

SEQ ID NO: 131965 - RNA, 64 nt, Human; identical to SEQ ID NO: 58982

SEQ ID NO: 131966 - RNA, 64 nt, Human; identical to SEQ ID NO: 58983

SEQ ID NO: 131967 - RNA, 64 nt, Human; identical to SEQ ID NO: 58984

SEQ ID NO: 131968 - RNA, 64 nt, Human; identical to SEQ ID NO: 58985

SEQ ID NO: 131969 - RNA, 64 nt, Human; identical to SEQ ID NO: 58986

SEQ ID NO: 131970 - RNA, 59 nt, Human; identical to SEQ ID NO: 58987

SEQ ID NO: 131971 - RNA, 64 nt, Human; identical to SEQ ID NO: 58988

SEQ ID NO: 131972 - RNA, 64 nt, Human; identical to SEQ ID NO: 58989

SEQ ID NO: 131973 - RNA, 64 nt, Human; identical to SEQ ID NO: 58990

SEQ ID NO: 131974 - RNA, 64 nt, Human; identical to SEQ ID NO: 58991

SEQ ID NO: 131975 - RNA, 64 nt, Human; identical to SEQ ID NO: 58992

SEQ ID NO: 131976 - RNA, 64 nt, Human; identical to SEQ ID NO: 58993

SEQ ID NO: 131977 - RNA, 64 nt, Human; identical to SEQ ID NO: 58994

SEQ ID NO: 131978 - RNA, 64 nt, Human; identical to SEQ ID NO: 58995

SEQ ID NO: 131979 - RNA, 64 nt, Human; identical to SEQ ID NO: 58996

SEQ ID NO: 131980 - RNA, 64 nt, Human; identical to SEQ ID NO: 58997

SEQ ID NO: 131981 - RNA, 64 nt, Human; identical to SEQ ID NO: 58998

SEQ ID NO: 131982 - RNA, 64 nt, Human; identical to SEQ ID NO: 58999

SEQ ID NO: 131983 - RNA, 64 nt, Human; identical to SEQ ID NO: 59000

SEQ ID NO: 131984 - RNA, 64 nt, Human; identical to SEQ ID NO: 59001

SEQ ID NO: 131985 - RNA, 64 nt, Human; identical to SEQ ID NO: 59002

SEQ ID NO: 131986 - RNA, 64 nt, Human; identical to SEQ ID NO: 59003

SEQ ID NO: 131987 - RNA, 64 nt, Human; identical to SEQ ID NO: 59004

SEQ ID NO: 131988 - RNA, 64 nt, Human; identical to SEQ ID NO: 59005

SEQ ID NO: 131989 - RNA, 64 nt, Human; identical to SEQ ID NO: 59006

SEQ ID NO: 131990 - RNA, 64 nt, Human; identical to SEQ ID NO: 59007

SEQ ID NO: 131991 - RNA, 64 nt, Human; identical to SEQ ID NO: 59008

SEQ ID NO: 131992 - RNA, 64 nt, Human; identical to SEQ ID NO: 59009

SEQ ID NO: 131993 - RNA, 64 nt, Human; identical to SEQ ID NO: 59010

SEQ ID NO: 131994 - RNA, 64 nt, Human; identical to SEQ ID NO: 59011

SEQ ID NO: 131995 - RNA, 64 nt, Human; identical to SEQ ID NO: 59012

SEQ ID NO: 131996 - RNA, 64 nt, Human; identical to SEQ ID NO: 59013

SEQ ID NO: 131997 - RNA, 64 nt, Human; identical to SEQ ID NO: 59014

SEQ ID NO: 131998 - RNA, 64 nt, Human; identical to SEQ ID NO: 59015

SEQ ID NO: 131999 - RNA, 64 nt, Human; identical to SEQ ID NO: 59016

SEQ ID NO: 132000 - RNA, 64 nt, Human; identical to SEQ ID NO: 59017

SEQ ID NO: 132001 - RNA, 64 nt, Human; identical to SEQ ID NO: 59018

SEQ ID NO: 132002 - RNA, 64 nt, Human; identical to SEQ ID NO: 59019

SEQ ID NO: 132003 - RNA, 64 nt, Human; identical to SEQ ID NO: 59020

SEQ ID NO: 132004 - RNA, 64 nt, Human; identical to SEQ ID NO: 59021

SEQ ID NO: 132005 - RNA, 64 nt, Human; identical to SEQ ID NO: 59022

SEQ ID NO: 132006 - RNA, 64 nt, Human; identical to SEQ ID NO: 59023

SEQ ID NO: 132007 - RNA, 64 nt, Human; identical to SEQ ID NO: 59024

SEQ ID NO: 132008 - RNA, 64 nt, Human; identical to SEQ ID NO: 59025

SEQ ID NO: 132009 - RNA, 64 nt, Human; identical to SEQ ID NO: 59026

SEQ ID NO: 132010 - RNA, 64 nt, Human; identical to SEQ ID NO: 59027

SEQ ID NO: 132011 - RNA, 64 nt, Human; identical to SEQ ID NO: 59028

SEQ ID NO: 132012 - RNA, 64 nt, Human; identical to SEQ ID NO: 59029

SEQ ID NO: 132013 - RNA, 64 nt, Human; identical to SEQ ID NO: 4000

SEQ ID NO: 132014 - RNA, 64 nt, Human; identical to SEQ ID NO: 4001

SEQ ID NO: 132015 - RNA, 64 nt, Human; identical to SEQ ID NO: 4002

SEQ ID NO: 132016 - RNA, 64 nt, Human; identical to SEQ ID NO: 4003

SEQ ID NO: 132017 - RNA, 64 nt, Human; identical to SEQ ID NO: 4004

SEQ ID NO: 132018 - RNA, 64 nt, Human; identical to SEQ ID NO: 4005

SEQ ID NO: 132019 - RNA, 64 nt, Human; identical to SEQ ID NO: 4006

SEQ ID NO: 132020 - RNA, 64 nt, Human; identical to SEQ ID NO: 4007

SEQ ID NO: 132021 - RNA, 64 nt, Human; identical to SEQ ID NO: 4008

SEQ ID NO: 132022 - RNA, 64 nt, Human; identical to SEQ ID NO: 4009

SEQ ID NO: 132023 - RNA, 64 nt, Human; identical to SEQ ID NO: 4010

SEQ ID NO: 132024 - RNA, 64 nt, Human; identical to SEQ ID NO: 4011

SEQ ID NO: 132025 - RNA, 64 nt, Human; identical to SEQ ID NO: 4012

SEQ ID NO: 132026 - RNA, 64 nt, Human; identical to SEQ ID NO: 4013

SEQ ID NO: 132027 - RNA, 64 nt, Human; identical to SEQ ID NO: 4014

SEQ ID NO: 132028 - RNA, 64 nt, Human; identical to SEQ ID NO: 4015

SEQ ID NO: 132029 - RNA, 64 nt, Human; identical to SEQ ID NO: 4016

SEQ ID NO: 132030 - RNA, 64 nt, Human; identical to SEQ ID NO: 4017

SEQ ID NO: 132031 - RNA, 64 nt, Human; identical to SEQ ID NO: 4018

SEQ ID NO: 132032 - RNA, 64 nt, Human; identical to SEQ ID NO: 4017

SEQ ID NO: 132033 - RNA, 64 nt, Human; identical to SEQ ID NO: 4018

SEQ ID NO: 132034 - RNA, 64 nt, Human; identical to SEQ ID NO: 4021

SEQ ID NO: 132035 - RNA, 64 nt, Human; identical to SEQ ID NO: 4022

SEQ ID NO: 132036 - RNA, 64 nt, Human; identical to SEQ ID NO: 4023

SEQ ID NO: 132037 - RNA, 64 nt, Human; identical to SEQ ID NO: 4024

SEQ ID NO: 132038 - RNA, 64 nt, Human; identical to SEQ ID NO: 4025

SEQ ID NO: 132039 - RNA, 64 nt, Human; identical to SEQ ID NO: 4026

SEQ ID NO: 132040 - RNA, 64 nt, Human; identical to SEQ ID NO: 4027

SEQ ID NO: 132041 - RNA, 64 nt, Human; identical to SEQ ID NO: 4028

SEQ ID NO: 132042 - RNA, 64 nt, Human; identical to SEQ ID NO: 4029

SEQ ID NO: 132043 - RNA, 63 nt, Human; identical to SEQ ID NO: 4030

SEQ ID NO: 132044 - RNA, 64 nt, Human; identical to SEQ ID NO: 4031

SEQ ID NO: 132045 - RNA, 64 nt, Human; identical to SEQ ID NO: 4032

SEQ ID NO: 132046 - RNA, 64 nt, Human; identical to SEQ ID NO: 4033

SEQ ID NO: 132047 - RNA, 64 nt, Human; identical to SEQ ID NO: 4033

SEQ ID NO: 132048 - RNA, 64 nt, Human; identical to SEQ ID NO: 4035

SEQ ID NO: 132049 - RNA, 64 nt, Human; identical to SEQ ID NO: 4036

SEQ ID NO: 132050 - RNA, 64 nt, Human; identical to SEQ ID NO: 4037

SEQ ID NO: 132051 - RNA, 64 nt, Human; identical to SEQ ID NO: 4038

SEQ ID NO: 132052 - RNA, 64 nt, Human; identical to SEQ ID NO: 4039

SEQ ID NO: 132053 - RNA, 64 nt, Human; identical to SEQ ID NO: 4040

SEQ ID NO: 132054 - RNA, 64 nt, Human; identical to SEQ ID NO: 4041

SEQ ID NO: 132055 - RNA, 63 nt, Human; identical to SEQ ID NO: 4042

SEQ ID NO: 132056 - RNA, 64 nt, Human; identical to SEQ ID NO: 4043

SEQ ID NO: 132057 - RNA, 64 nt, Human; identical to SEQ ID NO: 4044

SEQ ID NO: 132058 - RNA, 64 nt, Human; identical to SEQ ID NO: 4045

SEQ ID NO: 132059 - RNA, 64 nt, Human; identical to SEQ ID NO: 4046

SEQ ID NO: 132060 - RNA, 64 nt, Human; identical to SEQ ID NO: 4047

SEQ ID NO: 132061 - RNA, 64 nt, Human; identical to SEQ ID NO: 4048

SEQ ID NO: 132062 - RNA, 64 nt, Human; identical to SEQ ID NO: 4049

SEQ ID NO: 132063 - RNA, 64 nt, Human; identical to SEQ ID NO: 4050

SEQ ID NO: 132064 - RNA, 64 nt, Human; identical to SEQ ID NO: 4051

SEQ ID NO: 132065 - RNA, 64 nt, Human; identical to SEQ ID NO: 4052

SEQ ID NO: 132066 - RNA, 64 nt, Human; identical to SEQ ID NO: 4053

SEQ ID NO: 132067 - RNA, 64 nt, Human; identical to SEQ ID NO: 4054

SEQ ID NO: 132068 - RNA, 64 nt, Human; identical to SEQ ID NO: 4055

SEQ ID NO: 132069 - RNA, 64 nt, Human; identical to SEQ ID NO: 4056

SEQ ID NO: 132070 - RNA, 64 nt, Human; identical to SEQ ID NO: 4057

SEQ ID NO: 132071 - RNA, 64 nt, Human; identical to SEQ ID NO: 4058

SEQ ID NO: 132072 - RNA, 64 nt, Human; identical to SEQ ID NO: 4059

SEQ ID NO: 132073 - RNA, 64 nt, Human; identical to SEQ ID NO: 4060

SEQ ID NO: 132074 - RNA, 64 nt, Human; identical to SEQ ID NO: 4061

SEQ ID NO: 132075 - RNA, 64 nt, Human; identical to SEQ ID NO: 4062

SEQ ID NO: 132076 - RNA, 64 nt, Human; identical to SEQ ID NO: 4063

SEQ ID NO: 132077 - RNA, 64 nt, Human; identical to SEQ ID NO: 4064

SEQ ID NO: 132078 - RNA, 64 nt, Human; identical to SEQ ID NO: 4065

SEQ ID NO: 132079 - RNA, 64 nt, Human; identical to SEQ ID NO: 4066

SEQ ID NO: 132080 - RNA, 64 nt, Human; identical to SEQ ID NO: 4067

SEQ ID NO: 132081 - RNA, 51 nt, Human; identical to SEQ ID NO: 4068

SEQ ID NO: 132082 - RNA, 64 nt, Human; identical to SEQ ID NO: 4069

SEQ ID NO: 132083 - RNA, 64 nt, Human; identical to SEQ ID NO: 4070

SEQ ID NO: 132084 - RNA, 64 nt, Human; identical to SEQ ID NO: 4071

SEQ ID NO: 132085 - RNA, 64 nt, Human; identical to SEQ ID NO: 4072

SEQ ID NO: 132086 - RNA, 64 nt, Human; identical to SEQ ID NO: 4073

SEQ ID NO: 132087 - RNA, 64 nt, Human; identical to SEQ ID NO: 4074

SEQ ID NO: 132088 - RNA, 64 nt, Human; identical to SEQ ID NO: 4075

SEQ ID NO: 132089 - RNA, 64 nt, Human; identical to SEQ ID NO: 4076

SEQ ID NO: 132090 - RNA, 64 nt, Human; identical to SEQ ID NO: 4077

SEQ ID NO: 132091 - RNA, 64 nt, Human; identical to SEQ ID NO: 4078

SEQ ID NO: 132092 - RNA, 64 nt, Human; identical to SEQ ID NO: 4079

SEQ ID NO: 132093 - RNA, 64 nt, Human; identical to SEQ ID NO: 4080

SEQ ID NO: 132094 - RNA, 64 nt, Human; identical to SEQ ID NO: 4081

SEQ ID NO: 132095 - RNA, 64 nt, Human; identical to SEQ ID NO: 4082

SEQ ID NO: 132096 - RNA, 64 nt, Human; identical to SEQ ID NO: 4083

SEQ ID NO: 132097 - RNA, 64 nt, Human; identical to SEQ ID NO: 4084

SEQ ID NO: 132098 - RNA, 64 nt, Human; identical to SEQ ID NO: 4085

SEQ ID NO: 132099 - RNA, 64 nt, Human; identical to SEQ ID NO: 4086

SEQ ID NO: 132100 - RNA, 64 nt, Human; identical to SEQ ID NO: 4087

SEQ ID NO: 132101 - RNA, 64 nt, Human; identical to SEQ ID NO: 4088

SEQ ID NO: 132102 - RNA, 64 nt, Human; identical to SEQ ID NO: 4089

SEQ ID NO: 132103 - RNA, 64 nt, Human; identical to SEQ ID NO: 4090

SEQ ID NO: 132104 - RNA, 64 nt, Human; identical to SEQ ID NO: 4091

SEQ ID NO: 132105 - RNA, 64 nt, Human; identical to SEQ ID NO: 4092

SEQ ID NO: 132106 - RNA, 64 nt, Human; identical to SEQ ID NO: 4093

SEQ ID NO: 132107 - RNA, 64 nt, Human; identical to SEQ ID NO: 4094

SEQ ID NO: 132108 - RNA, 64 nt, Human; identical to SEQ ID NO: 4095

SEQ ID NO: 132109 - RNA, 64 nt, Human; identical to SEQ ID NO: 4096

SEQ ID NO: 132110 - RNA, 64 nt, Human; identical to SEQ ID NO: 4097

SEQ ID NO: 132111 - RNA, 64 nt, Human; identical to SEQ ID NO: 4098

SEQ ID NO: 132112 - RNA, 64 nt, Human; identical to SEQ ID NO: 4099

SEQ ID NO: 132113 - RNA, 64 nt, Human; identical to SEQ ID NO: 4100

SEQ ID NO: 132114 - RNA, 64 nt, Human; identical to SEQ ID NO: 4101

SEQ ID NO: 132115 - RNA, 64 nt, Human; identical to SEQ ID NO: 4102

SEQ ID NO: 132116 - RNA, 64 nt, Human; identical to SEQ ID NO: 4103

SEQ ID NO: 132117 - RNA, 64 nt, Human; identical to SEQ ID NO: 4104

SEQ ID NO: 132118 - RNA, 63 nt, Human; identical to SEQ ID NO: 4105

SEQ ID NO: 132119 - RNA, 64 nt, Human; identical to SEQ ID NO: 4106

SEQ ID NO: 132120 - RNA, 64 nt, Human; identical to SEQ ID NO: 4107

SEQ ID NO: 132121 - RNA, 64 nt, Human; identical to SEQ ID NO: 4108

SEQ ID NO: 132122 - RNA, 64 nt, Human; identical to SEQ ID NO: 4109

SEQ ID NO: 132123 - RNA, 64 nt, Human; identical to SEQ ID NO: 4110

SEQ ID NO: 132124 - RNA, 64 nt, Human; identical to SEQ ID NO: 4111

SEQ ID NO: 132125 - RNA, 64 nt, Human; identical to SEQ ID NO: 4112

SEQ ID NO: 132126 - RNA, 64 nt, Human; identical to SEQ ID NO: 4113

SEQ ID NO: 132127 - RNA, 64 nt, Human; identical to SEQ ID NO: 4114

SEQ ID NO: 132128 - RNA, 64 nt, Human; identical to SEQ ID NO: 4115

SEQ ID NO: 132129 - RNA, 64 nt, Human; identical to SEQ ID NO: 4116

SEQ ID NO: 132130 - RNA, 64 nt, Human; identical to SEQ ID NO: 4117

SEQ ID NO: 132131 - RNA, 64 nt, Human; identical to SEQ ID NO: 4118

SEQ ID NO: 132132 - RNA, 64 nt, Human; identical to SEQ ID NO: 4119

SEQ ID NO: 132133 - RNA, 64 nt, Human; identical to SEQ ID NO: 4120

SEQ ID NO: 132134 - RNA, 64 nt, Human; identical to SEQ ID NO: 4121

SEQ ID NO: 132135 - RNA, 64 nt, Human; identical to SEQ ID NO: 4122

SEQ ID NO: 132136 - RNA, 64 nt, Human; identical to SEQ ID NO: 4123

SEQ ID NO: 132137 - RNA, 64 nt, Human; identical to SEQ ID NO: 4124

SEQ ID NO: 132138 - RNA, 64 nt, Human; identical to SEQ ID NO: 4125

SEQ ID NO: 132139 - RNA, 64 nt, Human; identical to SEQ ID NO: 4126

SEQ ID NO: 132140 - RNA, 55 nt, Human; identical to SEQ ID NO: 4127

SEQ ID NO: 132141 - RNA, 64 nt, Human; identical to SEQ ID NO: 4128

SEQ ID NO: 132142 - RNA, 64 nt, Human; identical to SEQ ID NO: 4129

SEQ ID NO: 132143 - RNA, 64 nt, Human; identical to SEQ ID NO: 4130

SEQ ID NO: 132144 - RNA, 64 nt, Human; identical to SEQ ID NO: 4131

SEQ ID NO: 132145 - RNA, 64 nt, Human; identical to SEQ ID NO: 4132

SEQ ID NO: 132146 - RNA, 64 nt, Human; identical to SEQ ID NO: 4133

SEQ ID NO: 132147 - RNA, 64 nt, Human; identical to SEQ ID NO: 4134

SEQ ID NO: 132148 - RNA, 64 nt, Human; identical to SEQ ID NO: 4135

SEQ ID NO: 132149 - RNA, 64 nt, Human; identical to SEQ ID NO: 4136

SEQ ID NO: 132150 - RNA, 64 nt, Human; identical to SEQ ID NO: 4137

SEQ ID NO: 132151 - RNA, 64 nt, Human; identical to SEQ ID NO: 4138

SEQ ID NO: 132152 - RNA, 64 nt, Human; identical to SEQ ID NO: 4139

SEQ ID NO: 132153 - RNA, 64 nt, Human; identical to SEQ ID NO: 4140

SEQ ID NO: 132154 - RNA, 64 nt, Human; identical to SEQ ID NO: 4141

SEQ ID NO: 132155 - RNA, 64 nt, Human; identical to SEQ ID NO: 4142

SEQ ID NO: 132156 - RNA, 64 nt, Human; identical to SEQ ID NO: 4143

SEQ ID NO: 132157 - RNA, 64 nt, Human; identical to SEQ ID NO: 4144

SEQ ID NO: 132158 - RNA, 64 nt, Human; identical to SEQ ID NO: 4145

SEQ ID NO: 132159 - RNA, 64 nt, Human; identical to SEQ ID NO: 4146

SEQ ID NO: 132160 - RNA, 64 nt, Human; identical to SEQ ID NO: 4147

SEQ ID NO: 132161 - RNA, 64 nt, Human; identical to SEQ ID NO: 4148

SEQ ID NO: 132162 - RNA, 64 nt, Human; identical to SEQ ID NO: 4149

SEQ ID NO: 132163 - RNA, 64 nt, Human; identical to SEQ ID NO: 4150

SEQ ID NO: 132164 - RNA, 64 nt, Human; identical to SEQ ID NO: 4151

SEQ ID NO: 132165 - RNA, 64 nt, Human; identical to SEQ ID NO: 4152

SEQ ID NO: 132166 - RNA, 64 nt, Human; identical to SEQ ID NO: 4153

SEQ ID NO: 132167 - RNA, 64 nt, Human; identical to SEQ ID NO: 4154

SEQ ID NO: 132168 - RNA, 64 nt, Human; identical to SEQ ID NO: 4155

SEQ ID NO: 132169 - RNA, 64 nt, Human; identical to SEQ ID NO: 4156

SEQ ID NO: 132170 - RNA, 64 nt, Human; identical to SEQ ID NO: 4157

SEQ ID NO: 132171 - RNA, 64 nt, Human; identical to SEQ ID NO: 4158

SEQ ID NO: 132172 - RNA, 64 nt, Human; identical to SEQ ID NO: 4159

SEQ ID NO: 132173 - RNA, 64 nt, Human; identical to SEQ ID NO: 4160

SEQ ID NO: 132174 - RNA, 64 nt, Human; identical to SEQ ID NO: 4161

SEQ ID NO: 132175 - RNA, 64 nt, Human; identical to SEQ ID NO: 4162

SEQ ID NO: 132176 - RNA, 64 nt, Human; identical to SEQ ID NO: 4163

SEQ ID NO: 132177 - RNA, 64 nt, Human; identical to SEQ ID NO: 4164

SEQ ID NO: 132178 - RNA, 64 nt, Human; identical to SEQ ID NO: 4165

SEQ ID NO: 132179 - RNA, 64 nt, Human; identical to SEQ ID NO: 4166

SEQ ID NO: 132180 - RNA, 64 nt, Human; identical to SEQ ID NO: 4167

SEQ ID NO: 132181 - RNA, 64 nt, Human; identical to SEQ ID NO: 4168

SEQ ID NO: 132182 - RNA, 64 nt, Human; identical to SEQ ID NO: 4169

SEQ ID NO: 132183 - RNA, 64 nt, Human; identical to SEQ ID NO: 4170

SEQ ID NO: 132184 - RNA, 64 nt, Human; identical to SEQ ID NO: 4171

SEQ ID NO: 132185 - RNA, 63 nt, Human; identical to SEQ ID NO: 4172

SEQ ID NO: 132186 - RNA, 64 nt, Human; identical to SEQ ID NO: 4173

SEQ ID NO: 132187 - RNA, 64 nt, Human; identical to SEQ ID NO: 4174

SEQ ID NO: 132188 - RNA, 64 nt, Human; identical to SEQ ID NO: 4175

SEQ ID NO: 132189 - RNA, 64 nt, Human; identical to SEQ ID NO: 4176

SEQ ID NO: 132190 - RNA, 64 nt, Human; identical to SEQ ID NO: 4177

SEQ ID NO: 132191 - RNA, 64 nt, Human; identical to SEQ ID NO: 4178

SEQ ID NO: 132192 - RNA, 64 nt, Human; identical to SEQ ID NO: 4179

SEQ ID NO: 132193 - RNA, 64 nt, Human; identical to SEQ ID NO: 4180

SEQ ID NO: 132194 - RNA, 64 nt, Human; identical to SEQ ID NO: 4181

SEQ ID NO: 132195 - RNA, 64 nt, Human; identical to SEQ ID NO: 4182

SEQ ID NO: 132196 - RNA, 64 nt, Human; identical to SEQ ID NO: 4183

SEQ ID NO: 132197 - RNA, 64 nt, Human; identical to SEQ ID NO: 4184

SEQ ID NO: 132198 - RNA, 64 nt, Human; identical to SEQ ID NO: 4185

SEQ ID NO: 132199 - RNA, 64 nt, Human; identical to SEQ ID NO: 4186

SEQ ID NO: 132200 - RNA, 64 nt, Human; identical to SEQ ID NO: 4187

SEQ ID NO: 132201 - RNA, 64 nt, Human; identical to SEQ ID NO: 4188

SEQ ID NO: 132202 - RNA, 64 nt, Human; identical to SEQ ID NO: 4189

SEQ ID NO: 132203 - RNA, 64 nt, Human; identical to SEQ ID NO: 4190

SEQ ID NO: 132204 - RNA, 64 nt, Human; identical to SEQ ID NO: 4191

SEQ ID NO: 132205 - RNA, 64 nt, Human; identical to SEQ ID NO: 4192

SEQ ID NO: 132206 - RNA, 64 nt, Human; identical to SEQ ID NO: 4193

SEQ ID NO: 132207 - RNA, 64 nt, Human; identical to SEQ ID NO: 4194

SEQ ID NO: 132208 - RNA, 64 nt, Human; identical to SEQ ID NO: 4195

SEQ ID NO: 132209 - RNA, 58 nt, Human; identical to SEQ ID NO: 4196

SEQ ID NO: 132210 - RNA, 64 nt, Human; identical to SEQ ID NO: 4197

SEQ ID NO: 132211 - RNA, 64 nt, Human; identical to SEQ ID NO: 4198

SEQ ID NO: 132212 - RNA, 64 nt, Human; identical to SEQ ID NO: 4199

SEQ ID NO: 132213 - RNA, 64 nt, Human; identical to SEQ ID NO: 4200

SEQ ID NO: 132214 - RNA, 64 nt, Human; identical to SEQ ID NO: 4201

SEQ ID NO: 132215 - RNA, 64 nt, Human; identical to SEQ ID NO: 4202

SEQ ID NO: 132216 - RNA, 64 nt, Human; identical to SEQ ID NO: 4203

SEQ ID NO: 132217 - RNA, 64 nt, Human; identical to SEQ ID NO: 4204

SEQ ID NO: 132218 - RNA, 64 nt, Human; identical to SEQ ID NO: 4205

SEQ ID NO: 132219 - RNA, 64 nt, Human; identical to SEQ ID NO: 4206

SEQ ID NO: 132220 - RNA, 64 nt, Human; identical to SEQ ID NO: 4207

SEQ ID NO: 132221 - RNA, 64 nt, Human; identical to SEQ ID NO: 4208

SEQ ID NO: 132222 - RNA, 64 nt, Human; identical to SEQ ID NO: 4209

SEQ ID NO: 132223 - RNA, 64 nt, Human; identical to SEQ ID NO: 4210

SEQ ID NO: 132224 - RNA, 64 nt, Human; identical to SEQ ID NO: 4211

SEQ ID NO: 132225 - RNA, 64 nt, Human; identical to SEQ ID NO: 4212

SEQ ID NO: 132226 - RNA, 64 nt, Human; identical to SEQ ID NO: 4213

SEQ ID NO: 132227 - RNA, 64 nt, Human; identical to SEQ ID NO: 4214

SEQ ID NO: 132228 - RNA, 64 nt, Human; identical to SEQ ID NO: 4215

SEQ ID NO: 132229 - RNA, 64 nt, Human; identical to SEQ ID NO: 4216

SEQ ID NO: 132230 - RNA, 64 nt, Human; identical to SEQ ID NO: 4217

SEQ ID NO: 132231 - RNA, 64 nt, Human; identical to SEQ ID NO: 4218

SEQ ID NO: 132232 - RNA, 64 nt, Human; identical to SEQ ID NO: 4219

SEQ ID NO: 132233 - RNA, 64 nt, Human; identical to SEQ ID NO: 4220

SEQ ID NO: 132234 - RNA, 64 nt, Human; identical to SEQ ID NO: 4221

SEQ ID NO: 132235 - RNA, 64 nt, Human; identical to SEQ ID NO: 4222

SEQ ID NO: 132236 - RNA, 53 nt, Human; identical to SEQ ID NO: 4223

SEQ ID NO: 132237 - RNA, 64 nt, Human; identical to SEQ ID NO: 4224

SEQ ID NO: 132238 - RNA, 64 nt, Human; identical to SEQ ID NO: 4225

SEQ ID NO: 132239 - RNA, 64 nt, Human; identical to SEQ ID NO: 4226

SEQ ID NO: 132240 - RNA, 64 nt, Human; identical to SEQ ID NO: 4227

SEQ ID NO: 132241 - RNA, 64 nt, Human; identical to SEQ ID NO: 4228

SEQ ID NO: 132242 - RNA, 64 nt, Human; identical to SEQ ID NO: 4229

SEQ ID NO: 132243 - RNA, 64 nt, Human; identical to SEQ ID NO: 4230

SEQ ID NO: 132244 - RNA, 64 nt, Human; identical to SEQ ID NO: 4231

SEQ ID NO: 132245 - RNA, 64 nt, Human; identical to SEQ ID NO: 4232

SEQ ID NO: 132246 - RNA, 64 nt, Human; identical to SEQ ID NO: 4233

SEQ ID NO: 132247 - RNA, 64 nt, Human; identical to SEQ ID NO: 4234

SEQ ID NO: 132248 - RNA, 64 nt, Human; identical to SEQ ID NO: 4235

SEQ ID NO: 132249 - RNA, 64 nt, Human; identical to SEQ ID NO: 4236

SEQ ID NO: 132250 - RNA, 64 nt, Human; identical to SEQ ID NO: 4237

SEQ ID NO: 132251 - RNA, 64 nt, Human; identical to SEQ ID NO: 4238

SEQ ID NO: 132252 - RNA, 64 nt, Human; identical to SEQ ID NO: 4239

SEQ ID NO: 132253 - RNA, 64 nt, Human; identical to SEQ ID NO: 4240

SEQ ID NO: 132254 - RNA, 64 nt, Human; identical to SEQ ID NO: 4241

SEQ ID NO: 132255 - RNA, 64 nt, Human; identical to SEQ ID NO: 4242

SEQ ID NO: 132256 - RNA, 64 nt, Human; identical to SEQ ID NO: 4243

SEQ ID NO: 132257 - RNA, 64 nt, Human; identical to SEQ ID NO: 4244

SEQ ID NO: 132258 - RNA, 64 nt, Human; identical to SEQ ID NO: 4245

SEQ ID NO: 132259 - RNA, 64 nt, Human; identical to SEQ ID NO: 4246

SEQ ID NO: 132260 - RNA, 64 nt, Human; identical to SEQ ID NO: 4247

SEQ ID NO: 132261 - RNA, 64 nt, Human; identical to SEQ ID NO: 4248

SEQ ID NO: 132262 - RNA, 64 nt, Human; identical to SEQ ID NO: 4249

SEQ ID NO: 132263 - RNA, 64 nt, Human; identical to SEQ ID NO: 4250

SEQ ID NO: 132264 - RNA, 64 nt, Human; identical to SEQ ID NO: 4251

SEQ ID NO: 132265 - RNA, 64 nt, Human; identical to SEQ ID NO: 4252

SEQ ID NO: 132266 - RNA, 64 nt, Human; identical to SEQ ID NO: 4253

SEQ ID NO: 132267 - RNA, 64 nt, Human; identical to SEQ ID NO: 4254

SEQ ID NO: 132268 - RNA, 64 nt, Human; identical to SEQ ID NO: 4255

SEQ ID NO: 132269 - RNA, 64 nt, Human; identical to SEQ ID NO: 4256

SEQ ID NO: 132270 - RNA, 64 nt, Human; identical to SEQ ID NO: 4257

SEQ ID NO: 132271 - RNA, 64 nt, Human; identical to SEQ ID NO: 4258

SEQ ID NO: 132272 - RNA, 64 nt, Human; identical to SEQ ID NO: 4259

SEQ ID NO: 132273 - RNA, 64 nt, Human; identical to SEQ ID NO: 4260

SEQ ID NO: 132274 - RNA, 64 nt, Human; identical to SEQ ID NO: 4261

SEQ ID NO: 132275 - RNA, 64 nt, Human; identical to SEQ ID NO: 4262

SEQ ID NO: 132276 - RNA, 64 nt, Human; identical to SEQ ID NO: 4263

SEQ ID NO: 132277 - RNA, 64 nt, Human; identical to SEQ ID NO: 4264

SEQ ID NO: 132278 - RNA, 64 nt, Human; identical to SEQ ID NO: 4265

SEQ ID NO: 132279 - RNA, 64 nt, Human; identical to SEQ ID NO: 4266

SEQ ID NO: 132280 - RNA, 64 nt, Human; identical to SEQ ID NO: 4267

SEQ ID NO: 132281 - RNA, 64 nt, Human; identical to SEQ ID NO: 4268

SEQ ID NO: 132282 - RNA, 64 nt, Human; identical to SEQ ID NO: 4269

SEQ ID NO: 132283 - RNA, 64 nt, Human; identical to SEQ ID NO: 4270

SEQ ID NO: 132284 - RNA, 64 nt, Human; identical to SEQ ID NO: 4271

SEQ ID NO: 132285 - RNA, 64 nt, Human; identical to SEQ ID NO: 4272

SEQ ID NO: 132286 - RNA, 64 nt, Human; identical to SEQ ID NO: 4273

SEQ ID NO: 132287 - RNA, 64 nt, Human; identical to SEQ ID NO: 4274

SEQ ID NO: 132288 - RNA, 64 nt, Human; identical to SEQ ID NO: 4275

SEQ ID NO: 132289 - RNA, 64 nt, Human; identical to SEQ ID NO: 4276

SEQ ID NO: 132290 - RNA, 64 nt, Human; identical to SEQ ID NO: 4277

SEQ ID NO: 132291 - RNA, 64 nt, Human; identical to SEQ ID NO: 4278

SEQ ID NO: 132292 - RNA, 64 nt, Human; identical to SEQ ID NO: 4279

SEQ ID NO: 132293 - RNA, 64 nt, Human; identical to SEQ ID NO: 4280

SEQ ID NO: 132294 - RNA, 64 nt, Human; identical to SEQ ID NO: 4281

SEQ ID NO: 132295 - RNA, 64 nt, Human
agucagaaaggccagcggggagaggcuggggcgaggggaggagggggaucagcuucugcuauua

SEQ ID NO: 132296 - RNA, 55 nt, Human
ugugguugagugaggagugaaggauggggaggaggccucuggggaagggguuccc

SEQ ID NO: 132297 - RNA, 64 nt, Human
uuguucggcuggaacugacccaggcuggacuugcggggaggaaacuccagggcacugcaucugg

SEQ ID NO: 132298 - RNA, 64 nt, Human
cucugacaggcaauggugacuguguguguuuccuggggaggagguuagcagggacgguugccuu

SEQ ID NO: 132299 - RNA, 64 nt, Human
cugcagugacgugcaccuguacucaggaggcugaggggaggaucacuggagcccaggaguuuga

SEQ ID NO: 132300 - RNA, 64 nt, Human
cuggcaucuggagaacaccccugugccugggacaggggaggacccuucuuuuggacagcccccc

SEQ ID NO: 132301 - RNA, 64 nt, Human
ucuuguuuuaaaaaaauuuuuuucagaguguuuuggggaggaguuuuagggcuuggggagaggg

SEQ ID NO: 132302 - RNA, 64 nt, Human
gccaagcugcacaauuuaauauauucaagaguggggggaggaagcagaggucuucagggcucuu

SEQ ID NO: 132303 - RNA, 64 nt, Human
uccugucuggcuucuagagaugugccugugggagggggaggaaguuggcugagccauugagugc

SEQ ID NO: 132304 - RNA, 64 nt, Human
uucucuggcuuccuuggcuugccuggugggggaaggggaggaggggaagaaggaaagggaagag

SEQ ID NO: 132305 - RNA, 64 nt, Human
uuuuuuaauucauuaaccagugguuagcccuuaaggggaggaggacggauugauuccacauucc

SEQ ID NO: 132306 - RNA, 64 nt, Human
cacuuuguccccacucuagagcagggaggcagugggggaggaguugugucucgucuucugucuc

SEQ ID NO: 132307 - RNA, 64 nt, Human
ucuggccugccucaaaaccccuucugccucagguggggaggaacaagcugaacugucuucaggg

SEQ ID NO: 132308 - RNA, 64 nt, Human
ccugaagugucucaaguauaccagugggagugcaggggaggagcacaggccuucagauggggcu

SEQ ID NO: 132309 - RNA, 64 nt, Human
aagcuuuagcagcuuaauuaaaucuguuggacugggggaggagagagcuguucucuagugguua

SEQ ID NO: 132310 - RNA, 64 nt, Human
gucucagcuugcgggguggggggagucaugcccaggggaggagacuuuuuaucuggaggggaga

SEQ ID NO: 132311 - RNA, 64 nt, Human
uaggggcucagcaggucccuguugaagggaggaaggggaggagagaaggagaaaggcaagcagg

SEQ ID NO: 132312 - RNA, 64 nt, Human
agcuggguugugcuccacugugacgguggcccggggggaggaugccagcagccugccuauggcu

SEQ ID NO: 132313 - RNA, 64 nt, Human
cacccuggggauaguccuuccuggcaucguggugggggaggagccucuggcuucccuaaacugc

SEQ ID NO: 132314 - RNA, 64 nt, Human
uguuaaguugcgcuucuuugcugugaugugggugggggaggaagaguaaacacagugcuggcuc

SEQ ID NO: 132315 - RNA, 64 nt, Human
cucuguccagggcaguaagaagggcugcaaggaaggggaggauggggacaaggaaaggaucaga

SEQ ID NO: 132316 - RNA, 64 nt, Human
aaccuaagcuuugacuggguggccuugucuuucuggggaggagggaauguacauucagggagua

SEQ ID NO: 132317 - RNA, 64 nt, Human
uuucucuucauauuuauaugggggggagggcgcuggaugcaaaaguugaagaucgugaugcuau

SEQ ID NO: 132318 - RNA, 64 nt, Human
ggaguauaguuucuuuaucuuccaagagggugcuggggaggagaaagagguguguuucucaagg

SEQ ID NO: 132319 - RNA, 64 nt, Human
aacuuccaguccuggaggcagguugugcagcuuaggggaggaccccagaaucuggaccccagag

SEQ ID NO: 132320 - RNA, 64 nt, Human
uugggucuacugagcagugggugcugaggugacaggggaggaaccaguuguucuguagccuagg

SEQ ID NO: 132321 - RNA, 64 nt, Human
cggggccuccuagaagaaccuucuuagacaauggggggaggaugggacuuuguuuuuuccaaga

SEQ ID NO: 132322 - RNA, 64 nt, Human
caugcagccaugcagggacccaggacuguaaccuggggaggacgcgggucccugcaaggaagag

SEQ ID NO: 132323 - RNA, 64 nt, Human
caggcacaggcaggaagagagagagagagguucuggggaggaagggccaggagagagaucuaga

SEQ ID NO: 132324 - RNA, 55 nt, Human
ccccaccgaagaaggccugagcaagggggaggaagaggaggaagguuggaccuuc

SEQ ID NO: 132325 - RNA, 64 nt, Human
gaagaucugguauuuccuggccuaaauuccccuuggggaggacagggagaugcugcaguuccaa

SEQ ID NO: 132326 - RNA, 64 nt, Human
uaacaugguucaggcccuuggugugagagcccagggggaggacagcuugucugcugcuccaaau

SEQ ID NO: 132327 - RNA, 57 nt, Human
cuggccacccugcagccugaaccaccuggggaggaggcgggagagggagcugccauc

SEQ ID NO: 132328 - RNA, 64 nt, Human
ccaucguggccuucugagcccuuggccccccugcggggaggagguggagcagcgggcguccccg

SEQ ID NO: 132329 - RNA, 64 nt, Human
ccaagacagaauugggaagccagugcggcccgggggggaggaagagggaaaaggaagauggaag

SEQ ID NO: 132330 - RNA, 64 nt, Human
ccucgccuuaucauccucacuguggaguaaugagggggaggagaaucuuuaucagaaacugguu

SEQ ID NO: 132331 - RNA, 64 nt, Human
agaaaaagagagagagagacagaguggcgggggcggggaggagcgcaaacucauccuuuauaaa

SEQ ID NO: 132332 - RNA, 64 nt, Human
agcucugagcccuccuucuugcccugagcuuuccggggaggagccuuggaguguaauuaccugu

SEQ ID NO: 132333 - RNA, 64 nt, Human
gcaacugugaacagagaggucgggauuugcccugggggaggaagagaggccaaguucagagcuc

SEQ ID NO: 132334 - RNA, 64 nt, Human
gccaggaaucuaaagcuuuggguuuucugaggggggggaggagggaacuggagguuauuggggu

SEQ ID NO: 132335 - RNA, 64 nt, Human
gccgccggcagcauggacaaaggucuccaugcagggggaggaggccugcuucuuuccccacagc

SEQ ID NO: 132336 - RNA, 64 nt, Human
uaaguaccuuaaugcuaaugagguccacuaaaaaggggaggaaggcagaccuccugggagaccc

SEQ ID NO: 132337 - RNA, 64 nt, Human
uaauuuauuuauuuauugccuggccggugacucgggggaggaggcgacccugucaucuguccca

SEQ ID NO: 132338 - RNA, 64 nt, Human
ucuugcacaagcaaguuugugucagccacgcccuggggaggauccacuggaucaccgccgucac

SEQ ID NO: 132339 - RNA, 64 nt, Human
aguccuggcacugcccuguggacucagcccagcuggggaggacauggcgcccggugcccuagga

SEQ ID NO: 132340 - RNA, 64 nt, Human
cagcaauauuccacagcgcccuccagaguuaccuggggaggaccgaggccacacgccacugccc

SEQ ID NO: 132341 - RNA, 64 nt, Human
acaagucuauaauuuaaagaugugaugguggggaggggaggauggggaagcuuuuuauauaugc

SEQ ID NO: 132342 - RNA, 64 nt, Human
uccugaggccucauuuugggggucaucuuggaaaggggaggagcuucucccagugugagacccc

SEQ ID NO: 132343 - RNA, 64 nt, Human
guggccucucacucccaccacucugggccccuugggggaggacuggggagggggccgugggaga

SEQ ID NO: 132344 - RNA, 64 nt, Human
ucccaugccucaggcucugguuugagaucgugcuggggaggaacauggccacuaccccuuaucc

SEQ ID NO: 132345 - RNA, 64 nt, Human
gucacauggugagagagggagcaagagacagacaggggaggaaauucacacacugauggugggg

SEQ ID NO: 132346 - RNA, 64 nt, Human
cgccuucaccuagcaaugggaacccugcuucccaggggaggaaccaacugcuccaccuucuagg

SEQ ID NO: 132347 - RNA, 64 nt, Human
cagucccuccucauggcggccugugaccaaggucggggaggaguggagcuauccuuccaugauc

SEQ ID NO: 132348 - RNA, 64 nt, Human
agucucuugugcugugccuaguggcaccugggcuggggaggacacugccccgucuagguuuuua

SEQ ID NO: 132349 - RNA, 64 nt, Human
ccaccacucugcuuugcccaagugugacagcacuggggaggagagacaggauaaagggcagaug

SEQ ID NO: 132350 - RNA, 64 nt, Human
ccacgggcacagggagagggacaacugcagcaguggggaggaggcacagcuagcugcacaguuc

SEQ ID NO: 132351 - RNA, 64 nt, Human
uucaguucuuaaguuucgguuuuuuuuaaaaacaggaugcaacuuaaacuuuucuuugcaucaa

SEQ ID NO: 132352 - RNA, 64 nt, Human
gguccugggaagcacugggaaagaagggagagccggggaggauagggcaggagucuggccagga

SEQ ID NO: 132353 - RNA, 64 nt, Human
ugugggguggagggaggaagggcugggagggaguggggaggaauugcuagcuguagugugacac

SEQ ID NO: 132354 - RNA, 64 nt, Human
uaucagagaaagggaccauugggugcauagagauggggaggaggccacugggcugaauuuucuc

SEQ ID NO: 132355 - RNA, 64 nt, Human
agacccauaaagccuugaccacaucacuccauauggggaggagaaggaucccugucaccuucuc

SEQ ID NO: 132356 - RNA, 64 nt, Human
caaccuacccugguccagucgggaggagcagcccggggaggaacugggugacuggaggccucgc

SEQ ID NO: 132357 - RNA, 64 nt, Human
ugacugccauguacacugcagucaagggcagggaggggaggaaugacacaaauggcagggagcu

SEQ ID NO: 132358 - RNA, 64 nt, Human
ccguuagggcuucaaugaugcugagucuggaaaaggggaggagacccuugggaggacuccaggc

SEQ ID NO: 132359 - RNA, 64 nt, Human
uuuaccauacaguuuccuuugugaaagaacaguaggggaggaaauaauucucugcuguguauug

SEQ ID NO: 132360 - RNA, 64 nt, Human
gccugaaagggccaggucccagugcugggccccuggggaggagggagggugggcgguauggcuc

SEQ ID NO: 132361 - RNA, 64 nt, Human
uggugugugggggugggaggugggcagaagucuuggggaggaaugggcaaaggagguucucagu

SEQ ID NO: 132362 - RNA, 64 nt, Human
uugggaaaggaggaggggagugguggguuuauagggggaggaggaggcagguggucuaagugcu

SEQ ID NO: 132363 - RNA, 64 nt, Human
aauauuguacaguuauuauagggcuuuuggggaaggggaggauagcgagaagaugcucuggggg

SEQ ID NO: 132364 - RNA, 64 nt, Human
gucuauccuugcuacuugguugugaguuucuccaggggaggaacuguguuuuauucaucucuau

SEQ ID NO: 132365 - RNA, 64 nt, Human
ggcuccuccuagacucugucccugggcuagggcaggggaggagggagagcaggguugggggaga

SEQ ID NO: 132366 - RNA, 64 nt, Human
gaaguugggcucuaagaaugaggggaaagagccuggggaggagcuuaaaacucaaccacucugg

SEQ ID NO: 132367 - RNA, 64 nt, Human
ggugcauuauggaugguuugguggauugagguguggggaggaggguccuaggcuagagggggua

SEQ ID NO: 132368 - RNA, 64 nt, Human
auaucauuuuuuuaacacauaacuagaaaccugaggaugcaacaaauauuuauauauuugaaua

SEQ ID NO: 132369 - RNA, 64 nt, Human
cagcuccuucaagaagcuuugagcagaaugaaguggggaggacccagcuuccagcccaggaagc

SEQ ID NO: 132370 - RNA, 64 nt, Human
gguggggugagggguaaguuuaggcuuucgcggaggggaggagacauggagccugggaacuccu

SEQ ID NO: 132371 - RNA, 64 nt, Human
uuugugccuugucucuacucccucucuuggaucuggggaggaggggcagagaccugggacucug

SEQ ID NO: 132372 - RNA, 64 nt, Human
agcaggaaaaacaaaugggaaaugggggggcgggggggaggaagaggcugcacugcagccacag

SEQ ID NO: 132373 - RNA, 64 nt, Human
ggugccguggggcugcagccugagaggcuggcccggggaggaguucccaucaccgccugugccg

SEQ ID NO: 132374 - RNA, 64 nt, Human
ucaggguaaaagucaguacggauuuuaauagccuggggaggaaaacacauucuuugccacagac

SEQ ID NO: 132375 - RNA, 64 nt, Human
cucugggugcgaguuccuccugcauaugaaccgaggggaggaggagaagcugagcacgugugac

SEQ ID NO: 132376 - RNA, 64 nt, Human
uuucccuaucacugaagcuuuuuagugcauuaguggggaggaggguggggagacauaaccacug

SEQ ID NO: 132377 - RNA, 64 nt, Human
cauaggaaacauauuaugugcagguccuagccugggggaggaaaguagauagacagaaaaucau

SEQ ID NO: 132378 - RNA, 64 nt, Human
gcuugcuguccccugagaccccauccuggggagaggggaggacuccucucccuacgccagccaa

SEQ ID NO: 132379 - RNA, 64 nt, Human
gcugggcaguaucccccgccuuuaguucuccacuggggaggaauccuggaccaagcacaaaaac

SEQ ID NO: 132380 - RNA, 64 nt, Human
uucuuucacaguagaagaauggcugcuuuugaauggggaggaaagaagacauuuuucuuaauau

SEQ ID NO: 132381 - RNA, 64 nt, Human
guuuucuguacuggauugcaccaaggaagcuuuuggggaggaaggaaggacauuaaauucuuuc

SEQ ID NO: 132382 - RNA, 64 nt, Human
aaacauuuuguagaguauaggggagugggaggaaggggaggaauaauuuuuuauuuaaaguuga

SEQ ID NO: 132383 - RNA, 64 nt, Human
gggacuggagucagcccagcugggaggaggggcuggggaggaucugcagcugaagcccgaggca

SEQ ID NO: 132384 - RNA, 64 nt, Human
auggggcccagagucccuugcagauauagaaauaggggaggagcucaggucugcgccaggcagg

SEQ ID NO: 132385 - RNA, 64 nt, Human
cugcuggccgccggccuugcagucucucuacccuggggaggaacaguggcuucucagagccugg

SEQ ID NO: 132386 - RNA, 64 nt, Human
ccuuggugacucuguccuucgcccugugcacccuggggaggagagcucugggaacagccgcuca

SEQ ID NO: 132387 - RNA, 64 nt, Human
cgggacucagcgccuucggguggcggcgguaagcggggaggaaacauggcgccgcccaaaugcg

SEQ ID NO: 132388 - RNA, 64 nt, Human
aaagaggucuuguuuuuuguuuaaaaaaguuuguggggaggaaagacaucuguguaucacuuca

SEQ ID NO: 132389 - RNA, 64 nt, Human
aaaacuaaaaggguuuuuuggggggggaguuggcggggaggaaauaaggcuaacagagguugac

SEQ ID NO: 132390 - RNA, 64 nt, Human
uagaccccggguacugcgggaggggagggcugcuggggaggauggggggauguuauauaaauau

SEQ ID NO: 132391 - RNA, 64 nt, Human
uccaaccccuggggaagacauuugcaacugacuuggggaggacacagcuucagcacagccucuc

SEQ ID NO: 132392 - RNA, 64 nt, Human
agguugcccuguucaggggacagaugcaagcuguggggaggacucugccuguguccuguguucc

SEQ ID NO: 132393 - RNA, 64 nt, Human
gugcccugggcuugccaccagcucugcccuggcuggggaggacacucggugccccacacccagu

SEQ ID NO: 132394 - RNA, 64 nt, Human
gacccgacccugcucgagagcccgcgcuagagucggggaggaucugcgcagagaccgcagcauc

SEQ ID NO: 132395 - RNA, 64 nt, Human
gcacaaagucuaagggaccauggcugccugccuuggggaggaaccauaucucccucugggccgc

SEQ ID NO: 132396 - RNA, 64 nt, Human
aaaccagcuuccuucagagagcagugcuuuuggcggggaggaggaaaucccuucauacuugaac

SEQ ID NO: 132397 - RNA, 64 nt, Human
caggcugguccugccauacgugcggcaccugaagggggaggaugacaagccgcugcccaccucc

SEQ ID NO: 132398 - RNA, 64 nt, Human
acucgagcccacccggccggccagcuuuagaggaggggaggagcagggcgaguucacauuauuc

SEQ ID NO: 132399 - RNA, 64 nt, Human
uacuuuugguccauguaagugcuacccguugcugggggaggagucaugguuuauuuggaaaugu

SEQ ID NO: 132400 - RNA, 64 nt, Human
ucuucccuccaccuggggcagcagcaggaggccuggggaggaggaaaaucaggcagucggccug

SEQ ID NO: 132401 - RNA, 64 nt, Human
uaggcaaggggaugagaccgcaggaggaaauggcggggaggaggcauucuugaacugcugagga

SEQ ID NO: 132402 - RNA, 64 nt, Human
uagaaucuuaacuccuagagcaacucugugggguggggaggagcagauccaaguuuugcggggu

SEQ ID NO: 132403 - RNA, 64 nt, Human
aggcccgaagcuguucccaugcuugagcuuccauggggaggaugcugagugagcaguuuccuac

SEQ ID NO: 132404 - RNA, 64 nt, Human
uuguuugcagguuucuguguguggggugggguauggggaggagaaccuucaugguggcccaccu

SEQ ID NO: 132405 - RNA, 64 nt, Human
gaagggauggagaggcaguacgcauccuuacccaggggaggacccgcagauccuguagacuauc

SEQ ID NO: 132406 - RNA, 64 nt, Human
cagaugccacaccugcuccuucuugcuuuccccgggggaggaaggggguuguggucggggagcu

SEQ ID NO: 132407 - RNA, 64 nt, Human
ccucacggagaggaagggaaggaaggagagggagggggaggauagagcccaucccagccgggga

SEQ ID NO: 132408 - RNA, 64 nt, Human
caccacccaacccaaaccaugagaauuugcaacaggggaggaaaaaagaaccaaaacuuccaag

SEQ ID NO: 132409 - RNA, 64 nt, Human
agggguggugugguguugggaagggguccugcagggggaggaggacuuggagggucugggggca

SEQ ID NO: 132410 - RNA, 64 nt, Human
gaaaaucaggaucugaguuauuuugcuaaacuugggggaggaggaacaaauaaauggagucuuu

SEQ ID NO: 132411 - RNA, 64 nt, Human
auccccuagaaaauuauacuauugagaaaucuauggggaggauaugagaaaauaaauuccuucu

SEQ ID NO: 132412 - RNA, 64 nt, Human
uuuuacuucaugcccauuuuuguggcugggcuggggggaggaggcaaauucgauuugaacauau

SEQ ID NO: 132413 - RNA, 64 nt, Human
gaugcauauuauucagcaucagacagccgacacuggggaggagccuuaucaaugcagugagugu

SEQ ID NO: 132414 - RNA, 64 nt, Human
ccuuccacuuuucccaguggggccugcugcugagggggaggaagaaacgaagacugaucaccca

SEQ ID NO: 132415 - RNA, 64 nt, Human
agcagaaagcgcggguccagaugagggccaggaaggggaggagagugagggccaagaacgagcc

SEQ ID NO: 132416 - RNA, 56 nt, Human
gaaugccaggaaggauguagaaauaaggggaggaagauucccaucucuacaaucuu

SEQ ID NO: 132417 - RNA, 64 nt, Human
ugaccgagcugagguagaaaaacgucuccgagaaggggaggaggaucauguacgcccggaagua

SEQ ID NO: 132418 - RNA, 64 nt, Human
aauuauuaacuacccugaagauacuuugucuuuaggggaggagggcugaggaagaaggcauaca

SEQ ID NO: 132419 - RNA, 64 nt, Human
cuaugagaaucuaaugcugcugcugaucugacagggggaggaacucaguaaugcuccauugcuc

SEQ ID NO: 132420 - RNA, 64 nt, Human
cucugucuccaaaggcaacgugaaaagaaaugauggggaggaaaaaaccccauagauugaauua

SEQ ID NO: 132421 - RNA, 64 nt, Human
uagacagacaggccuggggacacuggccccaugaggggaggaaggcaggcgcacgagguccagg

SEQ ID NO: 132422 - RNA, 64 nt, Human
ccugcccugacccaccuggcaaagcagggcacauggggaggaagagacuggaaccuuucuuuga

SEQ ID NO: 132423 - RNA, 64 nt, Human
caguaagauggaugguuccggccagagucgauguggggaggaacagagggcugaagggagaggg

SEQ ID NO: 132424 - RNA, 64 nt, Human
aauucaauuuguaaguagcgcagcagccucugugggggaggauaggcugaaaaaaaaaaguggg

SEQ ID NO: 132425 - RNA, 64 nt, Human
cugccaccugcccucuuaccccgccguggcuuauggggaggaaugcaucaucucacuuuuuuuu

SEQ ID NO: 132426 - RNA, 64 nt, Human
uuccagugaagcagcagcugcacguccgaggcuuggggaggacccaggacuguguggguuucuu

SEQ ID NO: 132427 - RNA, 64 nt, Human
cacuuuagaggggcugcgccccaccagauaggaaggggaggauuuucuccuccagucgaccuug

SEQ ID NO: 132428 - RNA, 64 nt, Human
cgugggcagggguagaauggaaggagaggcggcuggggaggacaggugguggagggccuuggcu

SEQ ID NO: 132429 - RNA, 64 nt, Human
ggugacagagcaggacaugagacauagauacaguggggaggagaaguggggaaagguggagcag

SEQ ID NO: 132430 - RNA, 64 nt, Human
cauguucuggcagcaacuucacuuuuccuaaggaggggaggaggcagcagggaagcaacccugg

SEQ ID NO: 132431 - RNA, 64 nt, Human
gguuuucagaagguccuucugauggcuaggcuaaggggaggaagaauuccugccaugccccagc

SEQ ID NO: 132432 - RNA, 64 nt, Human
ggugcaaaggcauguugggaaagagauggauguuggggaggaagagaggagauggauuucaguu

SEQ ID NO: 132433 - RNA, 64 nt, Human
ugucauuuaaugucuuuauuccugccuuuaauauggggaggaagguuccauaagcuacauguuu

SEQ ID NO: 132434 - RNA, 64 nt, Human
cuguagaaggagacagagcugguugggaagacauggggaggaaggacaaggcuagaucaugaag

SEQ ID NO: 132435 - RNA, 64 nt, Human
auagucucuuuaaaaggaaagaaaacaucuuuaaggggaggaaccagagugcugaaggaaugga

SEQ ID NO: 132436 - RNA, 64 nt, Human
ugggcugucugugcccaugcucagcaugccuugaggggaggaggugguggccguggguuccuga

SEQ ID NO: 132437 - RNA, 64 nt, Human
uugggccugaacuacuggaaaaggucuggcggcuggggaggagugccagcaauaguucauaaua

SEQ ID NO: 132438 - RNA, 64 nt, Human
ucuucagccccugcucccauccaguggccagucgggggaggagaaagacgcgauuaacacugug

SEQ ID NO: 132439 - RNA, 64 nt, Human
cuuguguccuauggaauccaguucugaagaggugggggaggacaacugugggaaaagcccuggg

SEQ ID NO: 132440 - RNA, 64 nt, Human
gcagugcuagagcuugaagccacucaagccaguuggggaggaaagggaugcggagguacccucu

SEQ ID NO: 132441 - RNA, 64 nt, Human
agcagacucuccagcccucuuccuccuuccucugggggaggagggguuccugagggaccugacu

SEQ ID NO: 132442 - RNA, 64 nt, Human
cauuccagaggaucaugaagacugggcuuccaauggggaggaggaaagaugcaauaugucucuu

SEQ ID NO: 132443 - RNA, 64 nt, Human
ccaaaggcacgucccugacagcugaaaauagcacggggaggaauaaugcggacacuuuugagga

SEQ ID NO: 132444 - RNA, 64 nt, Human
ggcuucucuucccuccaugagccuggagaccccaggggaggauccauuugggaugagcccccuc

SEQ ID NO: 132445 - RNA, 64 nt, Human
aggcuugguacccaaggugcgguagggggucgagggggaggaggccaccugaccaaaugccgcc

SEQ ID NO: 132446 - RNA, 64 nt, Human
ucuaguugacuuugcaccugucuucaggcugccaggggaggaggagaagccagcaggcaccacu

SEQ ID NO: 132447 - RNA, 64 nt, Human
gccugcccauccagaagggacuccccagggccugggggaggagacccuuggaaaaguccucucu

SEQ ID NO: 132448 - RNA, 64 nt, Human
gcacggcaccuguggggaugggcuccugcagccuggggaggagugugacgacgguaacagcgau

SEQ ID NO: 132449 - RNA, 64 nt, Human
guagguaaagacccuuuuguucuuuccuguuguaggggaggaagcuguucuccccaccccaggu

SEQ ID NO: 132450 - RNA, 64 nt, Human
ucagccccugggcugccccucagaggcggugucuggggaggacuuugugcucagcacucugcac

SEQ ID NO: 132451 - RNA, 64 nt, Human
cugcuguaguuggggagcaggaguaccuuugggaggggaggacuuuauuuaaacagugguucua

SEQ ID NO: 132452 - RNA, 64 nt, Human
ugaugacugagaacaggcuuggaaaagguuuucuggggaggaggaggcuggaggccaggacacu

SEQ ID NO: 132453 - RNA, 64 nt, Human
gugugaauaucaguuuuagaauaguuucucugguggaugcaaugauguuucugaaacugcuaug

SEQ ID NO: 132454 - RNA, 64 nt, Human
aagggggguggggguaggugggcuccacaggaugggggaggagcauguccacugaguaucuucc

SEQ ID NO: 132455 - RNA, 64 nt, Human
cuggguuaggcccagccuugaugccauaugccuuggggaggacaaaacuucuugucagacauaa

SEQ ID NO: 132456 - RNA, 64 nt, Human
cccugccagaggggaaggaggguacagcugggcuggggaggaccugacccuacucccuugcccu

SEQ ID NO: 132457 - RNA, 64 nt, Human
aagcucugugcuucuauaaugugggaaauggcuuggggaggauggccccuagcuuaggaagacu

SEQ ID NO: 132458 - RNA, 64 nt, Human
auguguccacucucuucugcccccagccauauuuggggaggauggacaacuacaauagguaaga

SEQ ID NO: 132459 - RNA, 64 nt, Human
agcagaagggaggggagacagaggggauuaaagaggggaggagagagugcagagcuccaggaaa

SEQ ID NO: 132460 - RNA, 64 nt, Human
gccaucaccaguuucucaggcuggggagcacagaggggaggaggaggacuaaaugaaaaguugu

SEQ ID NO: 132461 - RNA, 64 nt, Human
acugcagggccgcuucuggggccuggaccaccauggggaggaagagucccacucauuacaaaua

SEQ ID NO: 132462 - RNA, 52 nt, Human
gggcugcguuuguguggugaauggggaggaaaugucacugccgaagaccaaa

SEQ ID NO: 132463 - RNA, 64 nt, Human
uagcuucaaggacaccugccuucaaagccacugaggggaggaagggcagggcagacugcagaug

SEQ ID NO: 132464 - RNA, 64 nt, Human
uagcugagcugguugcagcugcugauagccuucaggggaggaccugcccagguaugccuuccag

SEQ ID NO: 132465 - RNA, 64 nt, Human
cugguagaaggaagagaggcaaaggaaacuggguggggaggaucaauuagagaggaggcaccug

SEQ ID NO: 132466 - RNA, 64 nt, Human
gggcaggucccuggagccggggggggggggggggggggaggaccgggccgcugggcccucaugu

SEQ ID NO: 132467 - RNA, 64 nt, Human
aagucugguagagcagucgggcagcuaguuuucgggggaggaugauguggugggacagaggacc

SEQ ID NO: 132468 - RNA, 64 nt, Human
gccagagaggaggccagcaggcccagaguccccaggggaggaggaccaggucaagggacguucu

SEQ ID NO: 132469 - RNA, 64 nt, Human
cgggucacccugcugaagaucacucugugcccugggggaggagccaagcccucaccccacaagg

SEQ ID NO: 132470 - RNA, 64 nt, Human
ggcuaccuguggaauggcugagccugguucugcaggggaggaaggcugccaggagcugaggggc

SEQ ID NO: 132471 - RNA, 64 nt, Human
aggcgcccggcgcagugggaagcucgcagcagcuggggaggagccaaagccucggcgcucaccu

SEQ ID NO: 132472 - RNA, 64 nt, Human
uuaagggugggagagggcacaugggcuugagaguggggaggacacagucuggacuugauccugc

SEQ ID NO: 132473 - RNA, 64 nt, Human
uggugguuaggaucagagcucuccuggcauccguggggaggauuugcuggugguggcuucgggc

SEQ ID NO: 132474 - RNA, 64 nt, Human
cgggcuuugucccucccccgcuuccucccucugcggggaggacccgggaccacagcugcuggcc

SEQ ID NO: 132475 - RNA, 64 nt, Human
agcuuggcagagagauagccgggcuccagggaguggggaggagagagggggagaccccuuugcc

SEQ ID NO: 132476 - RNA, 64 nt, Human
ggggugaaucuucacgccccaaacagugcccgguggggaggaggcacccgcuccuuguugagua

SEQ ID NO: 132477 - RNA, 64 nt, Human
uuauagguaagguaauugauugggaaugggguagggggaggaguugugggggaauaaugugcau

SEQ ID NO: 132478 - RNA, 64 nt, Human
cacuuuauuuuucucguagaucuuuagcuacuuuggggaggagggaaggugcugauaccuucaa

SEQ ID NO: 132479 - RNA, 64 nt, Human
ugcaugagcuauggagucagauaguuguugggagggggaggacaagaagucuauuguuuggacu

SEQ ID NO: 132480 - RNA, 64 nt, Human
agccucuccgcccacgcggcugcugcuucucccuggggaggaccccugcccucggccauugaac

SEQ ID NO: 132481 - RNA, 64 nt, Human
uggaccugguggcccuuuccuagugccucugcuuggggaggagaaccucuguccacguggaggc

SEQ ID NO: 132482 - RNA, 64 nt, Human
auagagguggcucaaaggaaguguccgugggcagggggaggaaugaacaaaauggcgcuguuuc

SEQ ID NO: 132483 - RNA, 64 nt, Human
gccaaauuauguuagcgugagcagaaacaccgugggggaggaaggcagcagcugaagaaaaaag

SEQ ID NO: 132484 - RNA, 64 nt, Human
ugaacuguuucauguauuuuuuaaagacauuugaggggaggaggauuauuaugaaugggaaaaa

SEQ ID NO: 132485 - RNA, 64 nt, Human
uuuacuguauaaucugcagcaugcuauagaaaguggggaggaagggaggaaaaauaauuacagu

SEQ ID NO: 132486 - RNA, 64 nt, Human
uuaagggucuucuuuuacuuuugcgggggggaggggggaggaguuggggagggagggaaugugg

SEQ ID NO: 132487 - RNA, 64 nt, Human
guuaaccaagucagcccaacaggcaggugccggaggggaggacagggaacaguauuuccacuug

SEQ ID NO: 132488 - RNA, 64 nt, Human
aaagcuaguucuauaaaauacugguauuauggguggggaggaaauagaauugagucaauuggaa

SEQ ID NO: 132489 - RNA, 64 nt, Human
cccacuuuucuaccaguaaaagacauagaccaauggggaggaggggaggagagauggauauuuc

SEQ ID NO: 132490 - RNA, 64 nt, Human
ucuaccaguaaaagacauagaccaauggggaggaggggaggagagauggauauuucagcccucu

SEQ ID NO: 132491 - RNA, 64 nt, Human
cgcaccauaaugagaugugagccuugugcaugugggggaggagggagagagauguacuuuuuaa

SEQ ID NO: 132492 - RNA, 64 nt, Human
gggccugaaggcacaugggggaaagggagcacacggggaggacguuggggacccuggguggggc

SEQ ID NO: 132493 - RNA, 64 nt, Human
aagguuugcagagagaggaagaagagggcaggguggggaggagcucugggccagaggaugcuga

SEQ ID NO: 132494 - RNA, 64 nt, Human
uucgcugccauaugucccuguccuccaggcuguaggggaggagagccuggccgggggagacaga

SEQ ID NO: 132495 - RNA, 64 nt, Human
gggugcaguguauccuggagagguagggugugugggggaggaaucccuugggggagauauuagg

SEQ ID NO: 132496 - RNA, 64 nt, Human
ggagcaggcucagcccccuggaagaugagcucaaggggaggacaggccuugggagggcaggcgu

SEQ ID NO: 132497 - RNA, 64 nt, Human
guuuuagggcccccgugcgcagcuuucuuucccuggggaggaaaacaucgugggggggagggga

SEQ ID NO: 132498 - RNA, 64 nt, Human
auacaaauggggcagugugcaugcaacacacuuaggggaggaguggccccagaauucagcacgc

SEQ ID NO: 132499 - RNA, 64 nt, Human
cugcuuccuuucaaugugucagugccuggggggaggggaggagcacccccucagccccccugaa

SEQ ID NO: 132500 - RNA, 64 nt, Human
aagccgaagcagggaggugggugagacagaggguggggaggauagugucuggcucauuccaggc

SEQ ID NO: 132501 - RNA, 64 nt, Human
uggcuuuauuuaugaaccugguuuucgggagucaggggaggagaugacuuugcuucugugcaca

SEQ ID NO: 132502 - RNA, 64 nt, Human
aggguagagcuggguaauaaaugucuauucuccuggggaggagggauucuaaacuuuccuuccg

SEQ ID NO: 132503 - RNA, 64 nt, Human
aggccccucaacagagaagccuccaccugaggauggggaggaccuggcaggcagcuuccacggc

SEQ ID NO: 132504 - RNA, 64 nt, Human
acuacucuuagaggacacaugccuuaaaaaaggaggggaggaaccacgcugccaccaaagcagc

SEQ ID NO: 132505 - RNA, 64 nt, Human
ugccuuggguaacauccagacucaucugaaggcuggggaggauuugguagcaauguguagagca

SEQ ID NO: 132506 - RNA, 64 nt, Human
acucuaauauaauauggaucagagcauuuauuuuggggaggaaaacaguggugauuaccggcau

SEQ ID NO: 132507 - RNA, 64 nt, Human
ugucaguccuuugggaaaugggagggaguaguuuggggaggagggugggaacccuaauuuccac

SEQ ID NO: 132508 - RNA, 64 nt, Human
gcugauuuagucucugcuuuucccuugagggauuggggaggacccaguccaggccuuucuaaga

SEQ ID NO: 132509 - RNA, 64 nt, Human
guauauacuaggguacuuuagagcaacuuaaugaggggaggaaaugaaagaauagaucagaaug

SEQ ID NO: 132510 - RNA, 64 nt, Human
ggcgcgguaggcgagcgccgaggcccagcggccgggggaggacgaccucguaucccgcgucccc

SEQ ID NO: 132511 - RNA, 64 nt, Human
aaucccagaugaugggaaguauguuuucaaguguggggaggauaugaaaauguucuguucucac

SEQ ID NO: 132512 - RNA, 64 nt, Human
cagcaugagauacuguccccucuggaggauuuuaggggaggaagagccacguccccagggauug

SEQ ID NO: 132513 - RNA, 64 nt, Human
caggcugaggauggcccaaaguccagggucugguggggaggagggaagcuuaacucaaguuugg

SEQ ID NO: 132514 - RNA, 64 nt, Human
ugguuaggaaagcccagggggaagggagggggcaggggaggaggcaauucugaaugaaugaaug

SEQ ID NO: 132515 - RNA, 64 nt, Human
agagcuggugcacuuaauccagcucugcccuuggggggaggaggaccugugugucaggcucugc

SEQ ID NO: 132516 - RNA, 64 nt, Human
ugggaaguccauuugcaagcugagcgccaggccuggggaggaagaggcuugggcugcagaugca

SEQ ID NO: 132517 - RNA, 64 nt, Human
gcugcccacccgcgagggcugaaaaccccgccgcggggaggaccguccauccccuucccccggc

SEQ ID NO: 132518 - RNA, 64 nt, Human
uugcccccucugcagccggaggaggagauguugaggggaggaggccagccagugugaccggcgc

SEQ ID NO: 132519 - RNA, 64 nt, Human
caguguccacccuccggcccccgucuuguaaaaaggggaggagaauuagccaaacacuguaagc

SEQ ID NO: 132520 - RNA, 64 nt, Human
uaaggccagcccuggacauuguccaggaaggccuggggaggaggagugaagucugugcauagau

SEQ ID NO: 132521 - RNA, 64 nt, Human
ucuccccugugccguaguuugucuccugggacugggggaggaguccgaggugggguugguuacc

SEQ ID NO: 132522 - RNA, 64 nt, Human
cggccugauggcucugugcaguaccugguugaguggggaggagggggcaucuucugaacagccu

SEQ ID NO: 132523 - RNA, 64 nt, Human
agccagcaacaguagcagccugcucccauuugcuggggaggagaucaucuuguuccccuggccc

SEQ ID NO: 132524 - RNA, 64 nt, Human
cccuagggcaugggagaggagggacgcccaggguggggaggaagagucugcaagcagggcugug

SEQ ID NO: 132525 - RNA, 64 nt, Human
caccgggcccugugugugucaccgaggugcgggaggggaggagcauuaaagcugaaagaucgcu

SEQ ID NO: 132526 - RNA, 64 nt, Human
gcagcagaaccccuccuugucggguagccggaauggggaggagaacaucaucgauaacccuuau

SEQ ID NO: 132527 - RNA, 64 nt, Human
gugaggagggagcccgcucaggauggccugggcaggggaggacaucucuagagggaagcucaca

SEQ ID NO: 132528 - RNA, 64 nt, Human
uuacacacacguugacgggccgcaggagggaggcggggaggaggaacgggcagccacaggacug

SEQ ID NO: 132529 - RNA, 64 nt, Human
ccaucacucacucacuccccacucccccacccauggggaggagaccuuugaugaauucuuccuc

SEQ ID NO: 132530 - RNA, 64 nt, Human
ggccagggugguggcuucucugcagaccagcugaggggaggacuccuggguggacagccuuuga

SEQ ID NO: 132531 - RNA, 64 nt, Human
augcagugggcugcugggcaccccucucacgguuggggaggauucuguaaauaaaggugccccu

SEQ ID NO: 132532 - RNA, 64 nt, Human
cagaaucaugcaaaucucagggguaugccucucuggggaggagcuccacuugcagggacuccuu

SEQ ID NO: 132533 - RNA, 64 nt, Human
uuaccaagaaucuuugaugcagcuuuaagaugguggggaggauggggugaauuuaggaaaggaa

SEQ ID NO: 132534 - RNA, 64 nt, Human
cgugacucagcgccucaaaugaagagacugguguggggaggagagagaugcagagagccuuugg

SEQ ID NO: 132535 - RNA, 64 nt, Human
ccacguugcagaaagagccagccaaggagacccgggggaggaaccgcaguguccccugucacca

SEQ ID NO: 132536 - RNA, 64 nt, Human
ggugcgcauugauguacauauuuuccuccagucuggggaggagagagacuggaaacguuccugg

SEQ ID NO: 132537 - RNA, 64 nt, Human
caaaguaggagaagaaauggggaggacucgggugggggaggacgucccggcugggaugaagucu

SEQ ID NO: 132538 - RNA, 64 nt, Human
acaccuggaacugcggcaaaguaggagaagaaauggggaggacucgggugggggaggacguccc

SEQ ID NO: 132539 - RNA, 64 nt, Human
gugccugcccuucuaggaaugggggacagggggaggggaggagcuagggaaagaaaaccuggag

SEQ ID NO: 132540 - RNA, 64 nt, Human
ggaguaauagggaacagcuauccucucuugagaaggggaggauaaguaggcugggaaacuucaa

SEQ ID NO: 132541 - RNA, 64 nt, Human
uguuuauguauaaaaauaacuuucuggauuuuguggggaggagcaggagaggaaggaaguuaau

SEQ ID NO: 132542 - RNA, 64 nt, Human
aaaguucaaggacuaaccuuauuuauuugggaaaggggaggaggaaggaaaugauaugguaccc

SEQ ID NO: 132543 - RNA, 64 nt, Human
auuuuggcuuugacucugccauuucugaaaugugggggaggauggaggcagcugaccucuccag

SEQ ID NO: 132544 - RNA, 64 nt, Human
ucuccagccagggagucuggucucaaggccggauggggaggaagauguuuuguaaucuuuuuuu

SEQ ID NO: 132545 - RNA, 64 nt, Human
gccccucacugcccugaccgacuccgcaguccccggggaggagcauggauggugugucggcagc

SEQ ID NO: 132546 - RNA, 64 nt, Human
ccuaaggguguccuuccagagacgguguuuccagggggaggaccgcccccgcuuccagaucccc

SEQ ID NO: 132547 - RNA, 64 nt, Human
agggauagugcaucuuuuaaaauacauuuuauuuggggaggaacauguggcugagcagacuuuu

SEQ ID NO: 132548 - RNA, 64 nt, Human
gggacaguugguuguggggcuggagagagguuguggggaggaagcgaggaugcgugccugccac

SEQ ID NO: 132549 - RNA, 64 nt, Human
cucugucuccaccccaugggcccacacccaggugggggaggaggaagccacugcaucuguuggc

SEQ ID NO: 132550 - RNA, 64 nt, Human
ggagaggcaagaacugggggaacacaggaaccuaggggaggaggggagcgcugggcauccucag

SEQ ID NO: 132551 - RNA, 64 nt, Human
accgagcaggcacagcacagcagugacucggugaggggaggacacccgacugugcacacuucca

SEQ ID NO: 132552 - RNA, 64 nt, Human
uuccugauuuuacuucuaagaggaaaauuauuuuggggaggaacuacacagucgugauuagaau

SEQ ID NO: 132553 - RNA, 64 nt, Human
gggagcguggagcugcggugcccuggccggcgauggggaggagccggcuccggcagugagagga

SEQ ID NO: 132554 - RNA, 64 nt, Human
uaauccaagcaucccuuugcccagaaagaagaugggggaggaggcaguaauaaaaagauugaag

SEQ ID NO: 132555 - RNA, 64 nt, Human
agaauuuaguguaucuuuuaauguuguaugucugggaugcaaguauugcuaaauauguuagccc

SEQ ID NO: 132556 - RNA, 64 nt, Human
uucaacuguuaaaaacccaccucugagauacuggggggaggauccugaaacaugcgggaaaagg

SEQ ID NO: 132557 - RNA, 64 nt, Human
ugggccacaucuugaaaacucguggaaagggaaaggggaggagaugggacuuugaccacacaca

SEQ ID NO: 132558 - RNA, 64 nt, Human
uaagaacauaauguaaaauugucagcagccucauggggaggaaaaaggaagagucaacucacuu

SEQ ID NO: 132559 - RNA, 64 nt, Human
gcaacaucugucacccacuauacccaguuacuugggggaggacagacacuguggugucauuaaa

SEQ ID NO: 132560 - RNA, 64 nt, Human
ccggugauggagccccggggggacagucgugccuggggaggagcaggguacagcccauuccccc

SEQ ID NO: 132561 - RNA, 64 nt, Human
gggugaugagcagcuuuuccccccuggcuuucugggggaggagugggccuccuuagggagacag

SEQ ID NO: 132562 - RNA, 64 nt, Human
aauuaauaauuguauuaagugguaugaaaaaaagggggaggauuguucacucacuguuaccugu

SEQ ID NO: 132563 - RNA, 64 nt, Human
auuguugaauuguauugcggugguaucaaccuggggggaggaggggcuggcacugagauuuuuu

SEQ ID NO: 132564 - RNA, 64 nt, Human
gcggaaucuuuucugaaggcuacauggacccgcuggggaggagaggguguuuccucccagaguu

SEQ ID NO: 132565 - RNA, 64 nt, Human
ggcccuuuccccuccuccccccucagcugggccuggggaggagucgaagggggcugcagagagg

SEQ ID NO: 132566 - RNA, 64 nt, Human
aauagugcuuuuuugaaauggagaggaaaaacuuggggaggaagaggccugcugugggggcauc

SEQ ID NO: 132567 - RNA, 64 nt, Human
gccagaaagguaugcaugugggugucuucacaccggggaggagggccucucaugggaaagcccu

SEQ ID NO: 132568 - RNA, 64 nt, Human
gggccacccgaggaagcaguauuaucugcgguggggggaggagauauaggacaggaaaaccacg

SEQ ID NO: 132569 - RNA, 64 nt, Human
cucuggacagaugugagaaggcaccaccucaagaggggaggagcggggcugauccuggucgggc

SEQ ID NO: 132570 - RNA, 64 nt, Human
agugaccucugccucucccacauuccuccccgcgggggaggaccucgccgcucugaagagcacc

SEQ ID NO: 132571 - RNA, 64 nt, Human
guccugggccaggacgcaucugcauggcggugguggggaggaggggugcgccauggccuggagg

SEQ ID NO: 132572 - RNA, 64 nt, Human
uacugugacuuuauuagcagcugacuuucaaaguggaugcaauuuuucuuucuuuuguugggga

SEQ ID NO: 132573 - RNA, 64 nt, Human
uuuuaugaacgauagaucacaucagaacuccuguggggaggaaaccuuauaaauuaaacacaug

SEQ ID NO: 132574 - RNA, 64 nt, Human
ggcccucagaugucccuugaugcacagagaagcuggggaggagcuuuguuuugggggucaggca

SEQ ID NO: 132575 - RNA, 64 nt, Human
gccccauuccccaagggggcuccucuggagugguggggaggauuaggcugcagaagggccaacc

SEQ ID NO: 132576 - RNA, 64 nt, Human
cccuacgaugaggccacucaugugggccuagguaggggaggauggugccuggagcagagggacc

SEQ ID NO: 132577 - RNA, 64 nt, Human
cugggucuugcuggacgaguguggccuagagcugggggaggacacuccccacgugugcugggag

SEQ ID NO: 132578 - RNA, 64 nt, Human
gaggaagcugcuccaauggaugggggagaagccuggggaggagggggaggaagacaagaaggaa

SEQ ID NO: 132579 - RNA, 64 nt, Human
gcuccaauggaugggggagaagccuggggaggagggggaggaagacaagaaggaagaggaggag

SEQ ID NO: 132580 - RNA, 64 nt, Human
ggggucugagacagcagccacugggguugaggagggggaggagaccccugagacccagaggugc

SEQ ID NO: 132581 - RNA, 64 nt, Human
guccagcaggggaguaauaagggcucuucuggaaggggaggaagcgggaggcagggccugcacc

SEQ ID NO: 132582 - RNA, 64 nt, Human
uccuagcaaaugugcccaaccagcuuuacuaaagggggaggaagggagggcaaagggaugagaa

SEQ ID NO: 132583 - RNA, 64 nt, Human
cuuucccgacacccggagcucuacgugcuccucaggggaggauuccgucuucucucaugagccg

SEQ ID NO: 132584 - RNA, 64 nt, Human
ggcugcacgcuccggcugcuaguaggagccguuaggggaggaguuuggggucuccacacgaugc

SEQ ID NO: 132585 - RNA, 64 nt, Human
guuuuguuuuugccaauuaacaguaugugccuugggggaggagggaaagauuagcuuugaacau

SEQ ID NO: 132586 - RNA, 64 nt, Human
uacgguuucaugcauuuuuuuaaagggcauuugaggggaggauuauugcuaugaaugaaaaaaa

SEQ ID NO: 132587 - RNA, 64 nt, Human
ggacugguggaugguuggugucauuuacuaaaauggggaggauuugaggugaaaaaauuuuagg

SEQ ID NO: 132588 - RNA, 64 nt, Human
ccuuaugugucuuacaggcuuugauagaaggggaggggaggagagaugcauacccguuucucaa

SEQ ID NO: 132589 - RNA, 64 nt, Human
caggagccaauaucccuuacuuuaacccuuucugggaugcaauacuaggaaguaaagugaagaa

SEQ ID NO: 132590 - RNA, 64 nt, Human
aagaguuggugaaaugcgcagccggcuguggacgggggaggaggaaggggacagagggagcagg

SEQ ID NO: 132591 - RNA, 64 nt, Human
uauccccagcuguuagcacguuaguaauacuuuuggggaggaguugucuguccuggucaguuuu

SEQ ID NO: 132592 - RNA, 64 nt, Human
ugagccucaccuuaugagauucugauucagccagggggaggacaggaaucuguauuuuucauag

SEQ ID NO: 132593 - RNA, 64 nt, Human
uuuguggcaugcucuuugggagcugcacaguuauggggaggacucccacugcugugcaaguuaa

SEQ ID NO: 132594 - RNA, 64 nt, Human
aauguaccaagugguuguguguccucagauguguggggaggauccaucccccacccacugcagc

SEQ ID NO: 132595 - RNA, 64 nt, Human
cccaaauuauuuuuucuuuguuuuucuuuuuuugggggaggaggggaaaaaagcagcaauacug

SEQ ID NO: 132596 - RNA, 64 nt, Human
cucccuuacagagcauacaacagagggggcacccggggaggagagcacauacuguguuccaauu

SEQ ID NO: 132597 - RNA, 64 nt, Human
accccugcccccgguggagggguuguugcuuucuggggaggaggacgguugacggcccugcuug

SEQ ID NO: 132598 - RNA, 64 nt, Human
ccaaguucacugggcuccacccccaccuccaggaggggaggagaggaccugacaucuguaggug

SEQ ID NO: 132599 - RNA, 64 nt, Human
ugucaccuccaucucagucuuggccuggcuaugaggggaggaggaaugggagagggggcucagg

SEQ ID NO: 132600 - RNA, 64 nt, Human
ccggaggcccggugaccacggaacucaccgucugggggaggaggagagaaggaagggguggggg

SEQ ID NO: 132601 - RNA, 64 nt, Human
cgugcggaggauccuguauugugcccgggcccauggggaggacgauggugaggagauccuguug

SEQ ID NO: 132602 - RNA, 64 nt, Human
ccugcagccaucugugaggcccgcggggaugggaggggaggaggguggccuguugguuucccuc

SEQ ID NO: 132603 - RNA, 64 nt, Human
ggcccacgcagagccccggagcaccacggggucgggggaggagcacccccagccucccccaggc

SEQ ID NO: 132604 - RNA, 64 nt, Human
uaugggguccauuuuaauucuucauuuguucuacggggaggaaagaccaaaaguauuugcagua

SEQ ID NO: 132605 - RNA, 64 nt, Human
aggccucccggucagcauuauccugccagaccucggggaggauaccugggagacagaagccucu

SEQ ID NO: 132606 - RNA, 64 nt, Human
cuacuacucagcccucuccugcggccacaucaacggaugcaagucacagucuuaacacagccug

SEQ ID NO: 132607 - RNA, 64 nt, Human
uccccccaagaacuucccaugguagaauggggugggggaggagggcgcacgggcugagcggaua

SEQ ID NO: 132608 - RNA, 64 nt, Human
guucacuaccucuuuccucagaauaaaggaagaaggggaggaaggaaucccuaauucuuuuaua

SEQ ID NO: 132609 - RNA, 64 nt, Human
auggggccuucguggcaucucugugcugugugcuggggaggagguugauguaauggugacucuu

SEQ ID NO: 132610 - RNA, 64 nt, Human
gaggauaguggugggaacagacaaauaaggaagcggggaggacuggauaauugguuuucccccc

SEQ ID NO: 132611 - RNA, 64 nt, Human
cugugaccccucaggcuagcccuucuccacucugggggaggaggugggaagggccaccaggccc

SEQ ID NO: 132612 - RNA, 64 nt, Human
uccuccaugucuagauggcagauggacacugaguggggaggaugcacugcugcugggcaggugu

SEQ ID NO: 132613 - RNA, 64 nt, Human
aacagacagggagaaguugagcagguaucaacuaggggaggagagagggucuccaguguucccc

SEQ ID NO: 132614 - RNA, 64 nt, Human
gcucucucuccuggagucugaagccugcagguccggggaggagguucgggauucccuggugggc

SEQ ID NO: 132615 - RNA, 64 nt, Human
guaucauaccuagcagagguuggagcuggcacauggggaggagguucuaauaauuauuuggggc

SEQ ID NO: 132616 - RNA, 64 nt, Human
guccccauggccgccaccgcucuggaccacaggcggggaggaagcaugcucaagcagcccagcg

SEQ ID NO: 132617 - RNA, 64 nt, Human
agcagcugggugggcagaaugcagaguagacucgggggaggauccuuucacuuuccgcuucccc

SEQ ID NO: 132618 - RNA, 64 nt, Human
uuguugggaaagauaaaacucuagcaguuguugaggggaggauguauaaaauggucauggggau

SEQ ID NO: 132619 - RNA, 64 nt, Human
uagggccugauucgggaagaugccuuugcagggaggggaggauaagugggaucuaccaauugau

SEQ ID NO: 132620 - RNA, 64 nt, Human
ccuugcgugaaggacacgccccacagaaggcuacggggaggacugagaggacagggcuggaggc

SEQ ID NO: 132621 - RNA, 64 nt, Human
ugcgaccugcggcccagcaggcgcggaggauggcggggaggaagccagcagccccuguguuuac

SEQ ID NO: 132622 - RNA, 64 nt, Human
agugcuuagagcacaggccccucuguugggggauggggaggagagcagucugcccuugggagcg

SEQ ID NO: 132623 - RNA, 64 nt, Human
guguagccauauacccaggcucugcaguaucgaaggaugcaaauguugacauagauggaagcuc

SEQ ID NO: 132624 - RNA, 64 nt, Human
cggguguucgacaccagacguggggauuucaacaggggaggagccaaggaauucuguggcugug

SEQ ID NO: 132625 - RNA, 64 nt, Human
uuucuguuaaaaugggaucaucaucuuugaaaggggggaggaggaguaaaagcccgauuauaau

SEQ ID NO: 132626 - RNA, 64 nt, Human
caagagggcugagggugagguguggaagggacagggggaggagaugggcagcauuguugagaga

SEQ ID NO: 132627 - RNA, 64 nt, Human
gcugggagacgcuggcgccagggccugccggcgcggggaggaaagcaaaauccaacuaauggua

SEQ ID NO: 132628 - RNA, 64 nt, Human
caaggagcuggagacuucagggagccccucucauggggaggaaagagcuuccagggggcgaacg

SEQ ID NO: 132629 - RNA, 64 nt, Human
aaaaggaugugucauuggucaugauauuugaaaaggggaggaggccgaaguuguucccauuuau

SEQ ID NO: 132630 - RNA, 64 nt, Human
uuaccuuuucagggcuggcuccugauccacuuugggggaggagaacaugaguagauaauuucag

SEQ ID NO: 132631 - RNA, 58 nt, Human
agggcaaggccaagaagugaaggccggcggggaggauacuguccccaggagcacccuc

SEQ ID NO: 132632 - RNA, 64 nt, Human
gguuuuugcgagugcuuuguuuacuaaggacuuuggggaggaaccaugcuaagccaugaccagu

SEQ ID NO: 132633 - RNA, 64 nt, Human
acugucucugaggcagaaacgccggcugggcgccggggaggacgauggccccgacccuggcagc

SEQ ID NO: 132634 - RNA, 64 nt, Human
ggagggggcagaggcaaaucaccgggcagagggaggggaggagaggaggccgcacucucccugu

SEQ ID NO: 132635 - RNA, 64 nt, Human
agagggcuccagguucugggccccuggcugagaaggggaggauccuguccuggcuguagccuuc

SEQ ID NO: 132636 - RNA, 64 nt, Human
uugagaucaugucauugaugaacugccaaagucaggggaggagggcagagacuuuguguuuaca

SEQ ID NO: 132637 - RNA, 64 nt, Human
agugcccagaaugggaggcacggaagccccucccggggaggacucccgcguugauggaccguuc

SEQ ID NO: 132638 - RNA, 64 nt, Human
ugcuuccacaggaacggugcuggaccaccuggucggggaggagaccauggcugacuaccugcug

SEQ ID NO: 132639 - RNA, 64 nt, Human
ugauuggggugaugagaaaguucuggagguggauggggaggaugguugcacaacagugugagug

SEQ ID NO: 132640 - RNA, 64 nt, Human
gaagagccugaagacauugggaaaggcugggccuggggaggaggcagcccugggcccgcugccc

SEQ ID NO: 132641 - RNA, 64 nt, Human
aauggcaagagacuagcuggcucucugcucugauggggaggagguuguuguuugggcuguucuc

SEQ ID NO: 132642 - RNA, 64 nt, Human
uuucuguuuuccuuuuuuuuuuaauugaggguggggggaggagggagugcgucuguucacuuua

SEQ ID NO: 132643 - RNA, 64 nt, Human
cucuguggaauugugauugaaggauuuuaaagcaggggaggagaguagggggcaucucuguaca

SEQ ID NO: 132644 - RNA, 64 nt, Human
ugcuagguaccuuugacccaucaucuugggagguggggaggaaugagaggguccaggcagggug

SEQ ID NO: 132645 - RNA, 64 nt, Human
uaccaccauccuaaacccacacguccacgugauuggggaggacgcagcgugcaucgccuacauc

SEQ ID NO: 132646 - RNA, 64 nt, Human
gggaucacggcccaggcugcugacacccgcgcguggggaggacucgggccacgaaaggaaagaa

SEQ ID NO: 132647 - RNA, 64 nt, Human
ggagggcgagcgagggagaggagggagagggggaggggaggaguccagggagaggcgggaucac

SEQ ID NO: 132648 - RNA, 64 nt, Human
uguggcuuuucccaacacaaucagugcuagugcuggggaggaacagucaagagcagucaguugc

SEQ ID NO: 132649 - RNA, 64 nt, Human
uaccagacauggggaaaagcuaccuuuccugaaaggggaggagggcacuguccuuucagacaaa

SEQ ID NO: 132650 - RNA, 64 nt, Human
guaaaguguuaaaauuuacgauaaguauucuauuggggaggaaagguaacucugaucucaguua

SEQ ID NO: 132651 - RNA, 64 nt, Human
ugggugaagaccucagggucucagaaaguaggcaggggaggagaggguaagggaaagguggagg

SEQ ID NO: 132652 - RNA, 64 nt, Human
uuccagagcugccucugccuuuauccugggagauggggaggaagccccaucucugcuguucccu

SEQ ID NO: 132653 - RNA, 64 nt, Human
gguuaaaugaaguuugccagguggaggugauuagggggaggaugcuaagugaaaaugcuauaaa

SEQ ID NO: 132654 - RNA, 64 nt, Human
gugggaugcuccuggauggagaggguuugcugcuggggaggacaugggugugugugugacugca

SEQ ID NO: 132655 - RNA, 64 nt, Human
cguugcaaacaaaucuugggaagcgaggagggccggggaggacacuuccggacacgcucuucua

SEQ ID NO: 132656 - RNA, 64 nt, Human
gcccuccccacccagcuccgcuucuuguuacuugggggaggaaagaaacuccugaucauuggcc

SEQ ID NO: 132657 - RNA, 64 nt, Human
auagaaguuauauaccuaagcuuauauaauacauggggaggauuaaauaaaggaauaaagauga

SEQ ID NO: 132658 - RNA, 64 nt, Human
uugcccuugaucuuguccuuuuuauggaguuaacggggaggaagaccccucaggaaaacgaaag

SEQ ID NO: 132659 - RNA, 64 nt, Human
uguauauuguauaggggcaacuguaugaaaaauuggggaggagggggccgggcgcgguggcuca

SEQ ID NO: 132660 - RNA, 64 nt, Human
caugcuggccuguggcaggccuaggaccucaggcggggaggaggagcugccgcaaggcccuguc

SEQ ID NO: 132661 - RNA, 64 nt, Human
cuucugugcagcauccaccccugcggaucccucuggggaggacaggaaggggacucccggagac

SEQ ID NO: 132662 - RNA, 64 nt, Human
cacagauggggaaagauggggaaggguguggaguggggaggagccugggcagccugcugggugg

SEQ ID NO: 132663 - RNA, 64 nt, Human
accaaagagcccucuuuccacgagacugaagucuggggaggaggcuacaguugccucuccgccu

SEQ ID NO: 132664 - RNA, 64 nt, Human
cuuuggcuaccauaccaagaagagagggcugggcggggaggagcugcuacugcugcuaccgagg

SEQ ID NO: 132665 - RNA, 64 nt, Human
cauagccccuuuuaguugguuuuaguugcucuggggggaggagagaagguagagcuguucuuaa

SEQ ID NO: 132666 - RNA, 64 nt, Human
gacccaggccaacaaauuauccccagugauauggggggaggaggggcuagaacaagggcccagg

SEQ ID NO: 132667 - RNA, 64 nt, Human
guggcuguccagugcccauuccucaccuuuucccggggaggagagagcagcuucugccacuucc

SEQ ID NO: 132668 - RNA, 57 nt, Human
ccucuuccgccagaaccugagggugguggggaggagaagguuguaggcauggaagag

SEQ ID NO: 132669 - RNA, 64 nt, Human
uuugucuuucguagcagggaaaggauaugacaauggggaggacaguucuuuuggagguuggagg

SEQ ID NO: 132670 - RNA, 64 nt, Human
ccaccagggccacagaggagcggaggggccuaugggggaggagcggagggcccuguuggggaag

SEQ ID NO: 132671 - RNA, 64 nt, Human
aaaaaaaauaguauuugcauaacccugagcggugggggaggaggguugugcuacagaugauaga

SEQ ID NO: 132672 - RNA, 64 nt, Human
ccagacgaggggcuuccucuagagucucacugcuggggaggagaggacugggccugauggaagu

SEQ ID NO: 132673 - RNA, 64 nt, Human
uggcuagucuuaucuggccugguuauuuccuugcggggaggagaggguuugcuaaucugcuccc

SEQ ID NO: 132674 - RNA, 64 nt, Human
aguccugaaacugcaggaccaguuucucugccaaggggaggaguuggagagcacaguugccccg

SEQ ID NO: 132675 - RNA, 64 nt, Human
ucacuuuucugugccuuccugaggggguugggccggggaggaaacccaacccucuccugugugu

SEQ ID NO: 132676 - RNA, 64 nt, Human
uagauuagugauugccugggccaaguggcagguuggggaggauggcugcaaagaaguaugagga

SEQ ID NO: 132677 - RNA, 64 nt, Human
gaauguuccuggauguucauaucuaguguuugaaggggaggagggauuuaaacugguccuguac

SEQ ID NO: 132678 - RNA, 64 nt, Human
ccucacucucuaccaacccuaaacccugaggacaggggaggaacccacagcuuccuucuccugc

SEQ ID NO: 132679 - RNA, 64 nt, Human
aacucaggcagaagagcacagaugugugggauugggggaggaguggggacaagauuuuuuaucu

SEQ ID NO: 132680 - RNA, 64 nt, Human
ugcuguuugggggcucaggagccaucaaggcuguggggaggaaccauaaacccagcccucacag

SEQ ID NO: 132681 - RNA, 64 nt, Human
uccucagccuccaaaguggagcugggagguagaaggggaggacacuggugguucuacugaccca

SEQ ID NO: 132682 - RNA, 64 nt, Human
acgucagguggagcagccaggugaaaggccuggcggggaggaaagugaaacgccugaaucaaaa

SEQ ID NO: 132683 - RNA, 64 nt, Human
uucacuggugguuggggguaaggagcggggcacgggggaggaggagguagggggcaguaaaaaa

SEQ ID NO: 132684 - RNA, 64 nt, Human
ccguuuguucuacauggcuuugauaauuguuugaggggaggagauggaaacaauguggagucuc

SEQ ID NO: 132685 - RNA, 64 nt, Human
ggcuccccuccgagggccaguuucaggucuggaaggggaggaagcaggggaaggugaccugagg

SEQ ID NO: 132686 - RNA, 64 nt, Human
gaugaaucacuguuuuuagacaccuucauuuugaggggaggaguuccacagauuguuucuauac

SEQ ID NO: 132687 - RNA, 64 nt, Human
gagccuaggccaaagcuagcccaaggcuggggaaggggaggagacuccaggucagaaugugagg

SEQ ID NO: 132688 - RNA, 64 nt, Human
caaacugguuguauguaucaugccguggagcuagggggaggagucauuguggcacaaguauuug

SEQ ID NO: 132689 - RNA, 64 nt, Human
ggagugagcacuuuggguccuuagacucacgucuggggaggaagagcaaguagaaaaguggcau

SEQ ID NO: 132690 - RNA, 64 nt, Human
ucccaggcuggggaugcuuugccuuguggaagcuggggaggauuuguuacuucguauguguggu

SEQ ID NO: 132691 - RNA, 61 nt, Human
ugcaguuuguguuggccuaaggcuguggggaggggaggagaacugcucacuccuuuucccu

SEQ ID NO: 132692 - RNA, 64 nt, Human
uuggcagacccuugacuccaggggagaugaccugggggaggaagugugucaacuauuucuuuag

SEQ ID NO: 132693 - RNA, 64 nt, Human
gccaugcuagagcuugagcuguugcucuucuucaggggaggaaauaggguggagagcgggaagg

SEQ ID NO: 132694 - RNA, 64 nt, Human
cacaacgcccggccugagcccccugccauagggaggggaggacccugagggcucagccagggag

SEQ ID NO: 132695 - RNA, 64 nt, Human
ucgggguuggcuggaagcccugggugggggguugggggaggacuaauggggagucggggaauau

SEQ ID NO: 132696 - RNA, 64 nt, Human
guaccauagccaguuuccagaugggccacagacuggggaggagaaucaguggcccagccagaag

SEQ ID NO: 132697 - RNA, 64 nt, Human
uuucaaaggagguaguugcaaaagcugugcccaaggggaggaaggaggucacaccaauaugaug

SEQ ID NO: 132698 - RNA, 64 nt, Human
gucuccuccccaccucccaaaggucuaccgagcuggggaggagguacaguaggcccuguccugu

SEQ ID NO: 132699 - RNA, 54 nt, Human
agaggaagcuuggggugugacuguggggaggacuccauccaccucaucacugga

SEQ ID NO: 132700 - RNA, 64 nt, Human
gccuuggaauuggacuugagauggggagcagacaggggaggauggggaaugugggacacggugu

SEQ ID NO: 132701 - RNA, 64 nt, Human
guucuuauaagaagaagagaggcauagucaccuaggggaggaggccguaugaagacagaggcag

SEQ ID NO: 132702 - RNA, 64 nt, Human
uugguugggcaugcugugguugcugagggaugagggggaggagagagguaggagcuggagauga

SEQ ID NO: 132703 - RNA, 64 nt, Human
gggagugucuuucccaccagcccuugcccaugguggggaggacaucuggucugagucagagauc

SEQ ID NO: 132704 - RNA, 64 nt, Human
gcucagcugggccacccccucccacccugggguuggggaggagcagggagugggugcccacagu

SEQ ID NO: 132705 - RNA, 64 nt, Human
uucuuuuuuaauucuaauucacuuguuuauuuugggggaggaagacuuugguauggagcaaaga

SEQ ID NO: 132706 - RNA, 64 nt, Human
uaguaauguuaaacaccauuuuuuuuuucuuuuuggggaggaguugauaugcaacugcaguuca

SEQ ID NO: 132707 - RNA, 64 nt, Human
ugagaauaaguccuaaucuccagagaaaugguggggggaggaggaggcuuauugcuucccagca

SEQ ID NO: 132708 - RNA, 64 nt, Human
agugcugguuggcugucgccagcccaugguaggaggggaggaauggcuuaagaugagguaagau

SEQ ID NO: 132709 - RNA, 64 nt, Human
uuuuuaaauguuuuauuuugcuuucccagcgggaggggaggaagaagaguguuuacaaaguccu

SEQ ID NO: 132710 - RNA, 64 nt, Human
aaaaaaaaaaaaaaaagguggcaggagaggcuuuggggaggaucagccagcagacaugagcacu

SEQ ID NO: 132711 - RNA, 64 nt, Human
guaggauuccuagguauggggaagaguuuuggaaggggaggaaaauggcaaguguauuuauauu

SEQ ID NO: 132712 - RNA, 64 nt, Human
ggggaacacugugccucccugaacagaaauggcaggggaggaggcugaugcuuuaaaugaagag

SEQ ID NO: 132713 - RNA, 64 nt, Human
uccugagaguuggcccucccuugugccacugccaggggaggaaaggccuugauguuccagacaa

SEQ ID NO: 132714 - RNA, 64 nt, Human
guauguuucuuauuguaugucuauauauguauguggggaggacaggagugaauguucacacacu

SEQ ID NO: 132715 - RNA, 64 nt, Human
aucucucagccugcuuucucaucuguaaaaaaggggggaggauaacuuucacaggguaauuggu

SEQ ID NO: 132716 - RNA, 64 nt, Human
uaaggccggacgaguucauggggaucugggggguggggaggaggaagccguugaaucugggagg

SEQ ID NO: 132717 - RNA, 64 nt, Human
gacgugcgcgcccaggccagugcugugagcaggcggggaggaggcugccggagggagcccugag

SEQ ID NO: 132718 - RNA, 64 nt, Human
gagccccgcaggccgcugaaccaaaggccuagauggggaggacuaggagagcgagggggccccc

SEQ ID NO: 132719 - RNA, 64 nt, Human
ccacccuacucccuggggugaggaaagaacaggaggggaggaggaggagugugcucugcacuug

SEQ ID NO: 132720 - RNA, 64 nt, Human
auuuggggauuauuuauccuccuggggacaguuuggggaggauuauuuauuguauuuauauuga

SEQ ID NO: 132721 - RNA, 64 nt, Human
uagccucucccaagaugagaaaguccucaagugaggggaggaggaagcagauagaugguccagc

SEQ ID NO: 132722 - RNA, 64 nt, Human
ccacauacugcuccaccgcugaacuucgggugccggggaggagaaauugggcugaugugagcuc

SEQ ID NO: 132723 - RNA, 64 nt, Human
ggaccagggauugcaggccccaucuccaggcuaaggggaggagagcaucaucacuuuccauuag

SEQ ID NO: 132724 - RNA, 64 nt, Human
cugacacugucacagcggaugacagacuuucuacggggaggagggggggaucaucaggaagccc

SEQ ID NO: 132725 - RNA, 64 nt, Human
gccagguguguccugguagcccagguucagggcuggggaggagccugcggaaggggccgcagcc

SEQ ID NO: 132726 - RNA, 64 nt, Human
cacagacucugcucccgagaagccaagugaugcuggggaggauggcgcgccugaagacgcagcc

SEQ ID NO: 132727 - RNA, 64 nt, Human
augggcuauuaaugugggauaagcccaggugcaaggggaggagggcaggcugggaacagagcgg

SEQ ID NO: 132728 - RNA, 64 nt, Human
aaauuuauguccuucuuauuuauuucuaggaugaggggaggauaacauuuuugcuuucuuaugu

SEQ ID NO: 132729 - RNA, 64 nt, Human
ugugcuaaugauauuuugaguuaaaauaucuuuuggggaggauuugcugaaaaguugcacuuuu

SEQ ID NO: 132730 - RNA, 64 nt, Human
gcuuugguuuuauaauguaaccacugugggggugggggaggauggugaaccauguauuucagug

SEQ ID NO: 132731 - RNA, 64 nt, Human
cauuucuucccauaaugugaguggggaggauuguggggaggaggggcuuuggguuccuguguuu

SEQ ID NO: 132732 - RNA, 64 nt, Human
uccauuuagugacauuucuucccauaaugugaguggggaggauuguggggaggaggggcuuugg

SEQ ID NO: 132733 - RNA, 64 nt, Human
ccugcccuucuaucugggagcuagggaagguaugggggaggaaagagaauggauuuauagcuac

SEQ ID NO: 132734 - RNA, 64 nt, Human
agaagcuuauucagggcugagugccaaaagcuugggggaggagggacagguccucggcaauaaa

SEQ ID NO: 132735 - RNA, 64 nt, Human
gaggugugauugggcccuccggcuggauguucugggggaggaggcaaucgcuguagcugccagg

SEQ ID NO: 132736 - RNA, 64 nt, Human
gcagacugaccaucucccagaccgccagugacugggggaggaccugcucugcccucuccccacc

SEQ ID NO: 132737 - RNA, 64 nt, Human
cugccuccccggaagugccuuaaccuagagggucggggaggagguugugucacugacucaggcu

SEQ ID NO: 132738 - RNA, 64 nt, Human
aagcgccucugacccuuggcuugagucccacgugggggaggaggaggcaggcagcaccagcagg

SEQ ID NO: 132739 - RNA, 64 nt, Human
ccucacaagaaggcuaauugguggugagacagcaggggaggaggaagagcugugguuuguaacu

SEQ ID NO: 132740 - RNA, 64 nt, Human
auuaacauuucugauacaagaaacuacaauuuuuggggaggaaguuaguauacuuccaguggaa

SEQ ID NO: 132741 - RNA, 64 nt, Human
uccagagccacagguaggggagugugaaguugagggggaggaaagcuggaaggacucugccuug

SEQ ID NO: 132742 - RNA, 64 nt, Human
gacuguccaaaccugugaccccaggccagggaacggggaggaaaccaaagaaaaccauuuucag

SEQ ID NO: 132743 - RNA, 64 nt, Human
agaguuaucccacuggcuugguguguauacauuaggggaggauaaucugaugcuaacuuuuuuu

SEQ ID NO: 132744 - RNA, 64 nt, Human
gauaugagaggcugacaaacaucaggggacaucuggggaggagaucccugucaugucucuugug

SEQ ID NO: 132745 - RNA, 64 nt, Human
cucucccucccggugagcugcugcccugggcagaggggaggagaauuccaggacaagaguguca

SEQ ID NO: 132746 - RNA, 64 nt, Human
auugugaaaaauuuuauuuucggcguugcaaugcggggaggagaagucagauuauguacauagu

SEQ ID NO: 132747 - RNA, 64 nt, Human
gcuugggaauuuuauugacacaguaccauuuaauggggaggacaaaauggggcaggggagggag

SEQ ID NO: 132748 - RNA, 64 nt, Human
gucuacuucaggagacagaaggcccaugcugaugggggaggaggagggaugugggcauuuugga

SEQ ID NO: 132749 - RNA, 64 nt, Human
aaugccaauuaacuagagacccuccagcccccaaggggaggauuugggcagaaccugagguuuu

SEQ ID NO: 132750 - RNA, 64 nt, Human
gaggaggggaacuuauugggggaggggggguggaggggaggaaucuggaccucuaagucauucc

SEQ ID NO: 132751 - RNA, 64 nt, Human
uaucugcacacacaaaaugcccaaggcacucacuggggaggaagcaaggaagcaaacagucuga

SEQ ID NO: 132752 - RNA, 64 nt, Human
guacauguccauucuuaaguugguguuuggagguggggaggaugcuacuuuacuggaguugaga

SEQ ID NO: 132753 - RNA, 64 nt, Human
uggcauguuuggaaaucaaaaugucacauucucgggggaggaagcccagaaaauuggguauguu

SEQ ID NO: 132754 - RNA, 64 nt, Human
uucucauuaauacucuuuauuuauccuauuucugggggaggauguacguggccauguaugaagc

SEQ ID NO: 132755 - RNA, 64 nt, Human
cauggauguuucuucuuugacuauaacaaaaucuggggaggacaaaggugauuuuccugugucc

SEQ ID NO: 132756 - RNA, 64 nt, Human
ggugucucuuuaccaggggcagugccucucugcgggggaggaaaagcucaagguuagcugucuu

SEQ ID NO: 132757 - RNA, 64 nt, Human
ggacacaucaggaaguuacccuauaugucuaaaaggggaggagcccuccauuccaauuguccac

SEQ ID NO: 132758 - RNA, 64 nt, Human
accugcagagaaacgcgcuccuuggcggacacugggggaggagaggaagaagcgcggcuaacuu

SEQ ID NO: 132759 - RNA, 64 nt, Human
acaucuccuugaugucugugaucaaaccaugacaggaugcaaccacaacacacggcuaugauca

SEQ ID NO: 132760 - RNA, 64 nt, Human
ccagacuuuuaaaggggacaaugaaggugacuguggggaggagcaugucagguuugggcuuggu

SEQ ID NO: 132761 - RNA, 64 nt, Human
aaugcacucugcaggccuggcagaagaguccucuggggaggaccccaagggccggagacccaaa

SEQ ID NO: 132762 - RNA, 64 nt, Human
gacuuugugauuuaauuuuuucuuuuuuuuaaguggggaggaaggggaagcuagauggacuagg

SEQ ID NO: 132763 - RNA, 64 nt, Human
uauugaguaggucuauuaggagucagaagguguuggggaggagucucuggcuuaugacuccugg

SEQ ID NO: 132764 - RNA, 64 nt, Human
gccuucagcaggggaugaggaugaggaugaauccggggaggagaggcugcccuccugcuuugac

SEQ ID NO: 132765 - RNA, 64 nt, Human
uggaggggcuguggccaucagcucuggcuguguaggggaggaaggggugcaugcauguccccca

SEQ ID NO: 132766 - RNA, 64 nt, Human
ccuuggagaccugcauuugccaacaccuuuuuaaggggaggagagagcacuuaguuucugaacu

SEQ ID NO: 132767 - RNA, 64 nt, Human
agaaacagcucagccaguggggaugaggucaccaggggaggagccugugcgucccagcugaagg

SEQ ID NO: 132768 - RNA, 64 nt, Human
gcgccucuugggcugcucccucgugcacagcgcaggggaggaugggugccagagggugggagug

SEQ ID NO: 132769 - RNA, 64 nt, Human
aggcuuucccacauggaagguggcugcaugccaaggggaggagcgacaccuccaggcuuccggg

SEQ ID NO: 132770 - RNA, 64 nt, Human
gauuguuuuacugugaacauaacaagguuguauuggggaggagggcagggguugauugcugcca

SEQ ID NO: 132771 - RNA, 64 nt, Human
guguguguguguguguguguguguguguguguaaggggaggaaagccaccuugacagcccaggu

SEQ ID NO: 132772 - RNA, 64 nt, Human
aaaggacucuuccaucagagaugggaaaaccauuggggaggacuaggacccauaugggaauuau

SEQ ID NO: 132773 - RNA, 64 nt, Human
uucuuuugacaauacuguugguaccuauuacuugggggaggacauguugcagaagaccagauca

SEQ ID NO: 132774 - RNA, 64 nt, Human
guagggagcaagagaaugcagcuggaaggcacaaggggaggacauuguggcauucagaaacugc

SEQ ID NO: 132775 - RNA, 64 nt, Human
cauccucuaccagcuguuaauccaucacucugagggggaggaaauguugcauugcuguuuguaa

SEQ ID NO: 132776 - RNA, 64 nt, Human
gaccccuuagguauacccuggaagagcuggggugggggaggagggagcgugaagguagugacuc

SEQ ID NO: 132777 - RNA, 64 nt, Human
ugacuccugaacacacccagguggaaccaucuuuggggaggagaggcccgugugaggggucuga

SEQ ID NO: 132778 - RNA, 64 nt, Human
ccuuccuuugauaggacaaagcagauacuaagagggggaggaaaggcuguucugugucugaacc

SEQ ID NO: 132779 - RNA, 64 nt, Human
aaguguuuuaaugcugccauaaaagggaggcgggggggaggaagggaaaauaaaggcaucuuuc

SEQ ID NO: 132780 - RNA, 64 nt, Human
cauggagugaggcccugcccaugcuggggacuuuggggaggaauuugguauucugguggccuug

SEQ ID NO: 132781 - RNA, 64 nt, Human
aaaaaaacucagcuucuucagagagauaaaauugggggaggagcccagggccacauaccaagcu

SEQ ID NO: 132782 - RNA, 64 nt, Human
cagcucaagccauggcaggcguggcaagcaaaguggggaggagacagucccugcuugugacaag

SEQ ID NO: 132783 - RNA, 64 nt, Human
cauugauuugcucuuacuacagcuucagugauugggggaggaaaagucccaacccaaugggcuc

SEQ ID NO: 132784 - RNA, 64 nt, Human
aaacugcgcugugugauguguucuaucuagccuaggggaggacauugccuagagggggagggac

SEQ ID NO: 132785 - RNA, 64 nt, Human
ucacaguggagaacucuuggccaaagguuuuugcggggaggaggaggaaaccagcuuucugguu

SEQ ID NO: 132786 - RNA, 64 nt, Human
aucacgcugggaauagguuucaacauaugaauugggggaggacacauuuggaccacagcaugaa

SEQ ID NO: 132787 - RNA, 64 nt, Human
ccuuggaaggagcucuugcuggccaguguuuggaggggaggaugagugccugucacugaggccu

SEQ ID NO: 132788 - RNA, 64 nt, Human
ccugacuugggucccgucgugagcagaaaggcccggggaggaugacggcccaggcccugguucu

SEQ ID NO: 132789 - RNA, 64 nt, Human
gggaugaggcagguaaggguggaacaggagggguggggaggaagccggggcagucaccgaguga

SEQ ID NO: 132790 - RNA, 64 nt, Human
ggggugggagggaaugcagaugggaguugggggaggggaggauacaguucaggauaccccagcc

SEQ ID NO: 132791 - RNA, 64 nt, Human
cccuaagauacagacccccccaacuccccaaagcggggaggagauauuuauuuuggggagaguu

SEQ ID NO: 132792 - RNA, 64 nt, Human
ggucggaccccgccucccgagcccggggaggggcggggaggacaaggggcgggcccgcggccuc

SEQ ID NO: 132793 - RNA, 64 nt, Human
ugcauuucugagugaagugcacgucuugggaaagggaugcaaucccugaaaccaggugcuuccu

SEQ ID NO: 132794 - RNA, 64 nt, Human
ugacucuuuugguaaccagacaccaaucaaauaaggggaggagacgaaaauggaaugauuucuu

SEQ ID NO: 132795 - RNA, 64 nt, Human
cacuggggguaccugagccuggauuagagggcagggggaggauauugccuagccaaagugggug

SEQ ID NO: 132796 - RNA, 64 nt, Human
ugugccagcucccagacacuaccuggguagcucaggggaggagguggggguccaggagggggau

SEQ ID NO: 132797 - RNA, 58 nt, Human
cuucccacuucuauuccugaggugcagcggggaggagcagaugagcugggcagggcag

SEQ ID NO: 132798 - RNA, 64 nt, Human
gggagguggugggagggagaaggaagggaagaaaggggaggaagaauagauagaaauagggauu

SEQ ID NO: 132799 - RNA, 64 nt, Human
cuaccacccaaguccucaugcccuccgagggcugggggaggaggggcucaaggaagggggguuc

SEQ ID NO: 132800 - RNA, 64 nt, Human
ccccacuuacuuacccucaccugucaggccugacggggaggaaccacugcaccaccgagagagg

SEQ ID NO: 132801 - RNA, 64 nt, Human
ccggugagugggaagugggugccuugcgggguugggggaggagugcuguguuucccaggcccgu

SEQ ID NO: 132802 - RNA, 64 nt, Human
cuggcuauuccuguucugguguguguggaguguuggggaggaacagaugcagaucaaccugugg

SEQ ID NO: 132803 - RNA, 64 nt, Human
cauguucccuuuaguuuauuuuugugagggcaaaggggaggaaaugggguucuguuugaaaaaa

SEQ ID NO: 132804 - RNA, 61 nt, Human
agagacacacagagcuguagcucccugugccggggaggaggggguggguucgcugacaggc

SEQ ID NO: 132805 - RNA, 64 nt, Human
ugggggcggcuaccaagaaggaacagaggucucuggggaggagucugggugguccagcccugau

SEQ ID NO: 132806 - RNA, 61 nt, Human
acagaggcagccggcuguagcucaaggccucggggaggagcaggagguggaaucccugugg

SEQ ID NO: 132807 - RNA, 64 nt, Human
accuguaauaaaauauguaaugggguugaaagcuggggaggaggaucuacugcuguacagcuaa

SEQ ID NO: 132808 - RNA, 64 nt, Human
uccuagguucacauccagggcugugucuuccuugggggaggagauggugucguuuagaucaggg

SEQ ID NO: 132809 - RNA, 64 nt, Human
uuucuccacauagacucuugaaauagccauuucaggggaggaaaggguugggguuuucuuuguu

SEQ ID NO: 132810 - RNA, 64 nt, Human
augaagucaugaaugucugggaguuuuucuguguggggaggagacagagacccauaacuaaaua

SEQ ID NO: 132811 - RNA, 64 nt, Human
ccgaugaggggauggaccgcgccaucccagggcuggggaggagcggggagggcggaucucccug

SEQ ID NO: 132812 - RNA, 64 nt, Human
uuguccaaguuuacacacgacacuaaucuccccuggggaggaagcgggaagccagccagguuga

SEQ ID NO: 132813 - RNA, 64 nt, Human
guuagcagcuagccagccacaccaaccacgccagggggaggaaagggaaggacugggagagaca

SEQ ID NO: 132814 - RNA, 64 nt, Human
aagaaaaaugaaaaagguuaguguuugggggccgggggaggacugaccgcuucauaagccagua

SEQ ID NO: 132815 - RNA, 64 nt, Human
guagaggcagacccaugugcugcuguugcaaagaggggaggauaggagggggauguuggccucu

SEQ ID NO: 132816 - RNA, 64 nt, Human
cccccacacaaaaccuucaggcuugaauuuuaaaggggaggacuuucugccaacuuuucuugua

SEQ ID NO: 132817 - RNA, 64 nt, Human
ggccauguccccuccaucgagugcccggugcuugggggaggagggcagggacagggagggagcc

SEQ ID NO: 132818 - RNA, 64 nt, Human
ggguaucccaucuggggcaaacucacuguguaccggggaggaggcuacgugguccccuugggga

SEQ ID NO: 132819 - RNA, 64 nt, Human
ggaacugaugcggcuggaacaggagcuggcagugggggaggaggagagggaagauggucccugg

SEQ ID NO: 132820 - RNA, 64 nt, Human
cugaaaggaaaacgugaaaacacucaaggccuagggggaggacagguugguaaaacaugaaaag

SEQ ID NO: 132821 - RNA, 64 nt, Human
aaauagcugaaaagggcacucccaacccugggcuggggaggaggagagagucccagagcucauc

SEQ ID NO: 132822 - RNA, 64 nt, Human
aaaacagcagcccuaauagcagcccacggacuuuggggaggagcaaagggaggcuccggcugcc

SEQ ID NO: 132823 - RNA, 64 nt, Human
aucuguucuuggucuuuugugacgcagguugaagggggaggaauagaaaaagacaaacugccuu

SEQ ID NO: 132824 - RNA, 64 nt, Human
ccggcacugaggaugcuguucucaguuugacuguggggaggagagagaaugggguacuagcacc

SEQ ID NO: 132825 - RNA, 64 nt, Human
ggcagagagaggagacgaagaguuugggacagugggggaggagaugggaagggaugggauuucu

SEQ ID NO: 132826 - RNA, 64 nt, Human
gccaaguauacacaacuucccaguaaaugguuguggggaggaaagagguggagccuccccagcc

SEQ ID NO: 132827 - RNA, 64 nt, Human
cuagucagggccuugggcaagacauugggcucuaggaugcaauuggcaaauacguccccguuac

SEQ ID NO: 132828 - RNA, 64 nt, Human
auugugcuuaucuaaaucuuggaacuuugagcuaggggaggagaauguauuagacuaaauacaa

SEQ ID NO: 132829 - RNA, 64 nt, Human
cuaccaucccaggaggcaggcacagccagggagaggggaggagugggcagugaagaugaagccc

SEQ ID NO: 132830 - RNA, 64 nt, Human
gaguugacaucgggcaaccaaagaaaugaguuuuggggaggaacacaacucccaucccagucag

SEQ ID NO: 132831 - RNA, 64 nt, Human
uuauaguugugacauugaaagacuguugggguggggggaggaaaauuuuuacuuuccaucuuaa

SEQ ID NO: 132832 - RNA, 64 nt, Human
ccccagccuccucaaccucuuggggccccgugauggggaggagagggcaggugcggggaggcuc

SEQ ID NO: 132833 - RNA, 64 nt, Human
agggcagggucugggcugggcaccugacuuggcuggggaggaccagggcccugggcagggcagg

SEQ ID NO: 132834 - RNA, 64 nt, Human
agccucaggcggccagagggugugcggagcugguggggaggagccuggagagaaggggcagagc

SEQ ID NO: 132835 - RNA, 64 nt, Human
cauggucacagagaacuagugguggcucugagaaggggaggaccucugggcuuugauuccaucu

SEQ ID NO: 132836 - RNA, 64 nt, Human
gaugugugggagugcagggcugcagaggguauggggggaggaggcugcuaaacccuauccccca

SEQ ID NO: 132837 - RNA, 64 nt, Human
gauaggaacuacagcagaucgcuguuuccagaacggggaggaguaucucauugugaaacagacu

SEQ ID NO: 132838 - RNA, 64 nt, Human
uuugggcugugggggggcauccauuuccagggucggggaggaaauaccaaaugcauuguuguuc

SEQ ID NO: 132839 - RNA, 64 nt, Human
cuuuuggccagugccgaguggaaugccugguuugggggaggaggagggacuggguucagcugug

SEQ ID NO: 132840 - RNA, 64 nt, Human
cuuucccuguucugcccacucuggggaauagggaggggaggagaggagaggagagggaggaucc

SEQ ID NO: 132841 - RNA, 64 nt, Human
uaaauggcaauucuuugaccucaaccugugaugaggggaggaaacucaccugcuggccccucac

SEQ ID NO: 132842 - RNA, 64 nt, Human
ugccuguaaucccagccacucaggaggcugaggcggggaggauccauugagcccagcaguccaa

SEQ ID NO: 132843 - RNA, 64 nt, Human
gccucagggaagauaagagauauggagaugggagggggaggacaaggggcagagaguagggucu

SEQ ID NO: 132844 - RNA, 64 nt, Human
uuuuuuuuguauuucagagaaaauucagguaccaggaugcaauggauuuauuugauucagggga

SEQ ID NO: 132845 - RNA, 64 nt, Human
cucccagcccaagcccccucaagagucugggucgggggaggaggaguggguggccuccuugaug

SEQ ID NO: 132846 - RNA, 64 nt, Human
gucaggcugcugaggaaacaccacaggcugaacgggggaggaaugcacaugccacgcugggugu

SEQ ID NO: 132847 - RNA, 64 nt, Human
gcuaucgagauagccagagggucaggagagaaugggggaggaggcggucaggcugcugaggaaa

SEQ ID NO: 132848 - RNA, 64 nt, Human
uugguugggucaaggacagggcugagcguggaagggggaggagucaggggcucuguguuaggau

SEQ ID NO: 132849 - RNA, 64 nt, Human
gugugcgggggacggagguaagcuggauauccugggggaggaggggaaugcgcucuggaaacac

SEQ ID NO: 132850 - RNA, 64 nt, Human
cugaacaaguuggccugcacugguguuuuguuguggggaggaggauggggaguaggacauacca

SEQ ID NO: 132851 - RNA, 64 nt, Human
cuaccagugugugugugggggucaucacugccuuggggaggaguggggcagggcagagaauccc

SEQ ID NO: 132852 - RNA, 64 nt, Human
ucucugggguuugccuuguggaaccaagugcuugggggaggagcuccuggcaggacuccagcug

SEQ ID NO: 132853 - RNA, 64 nt, Human
acacucuagguugcuggguccauggggaggauugggggaggagaagcagugccuucccucucgu

SEQ ID NO: 132854 - RNA, 64 nt, Human
ugccuacugggacacucuagguugcuggguccauggggaggauugggggaggagaagcagugcc

SEQ ID NO: 132855 - RNA, 64 nt, Human
uccaaagggcugaggcagggaggccgugggccauggggaggacuucacucagcagcaaagagaa

SEQ ID NO: 132856 - RNA, 64 nt, Human
aggaaggaagucagcaugccucuagaggcaaggaggggaggaacacugcacucuuaagcuuccg

SEQ ID NO: 132857 - RNA, 64 nt, Human
agcuucgaggcccagcgaccucggugggcccaguggggaggagcaggagccugagccuugggaa

SEQ ID NO: 132858 - RNA, 64 nt, Human
agcuucgaggcccagcgaccucagugggcccaguggggaggagcaggagccugagccuugggaa

SEQ ID NO: 132859 - RNA, 64 nt, Human
ccugcugccagccccuuugccauagccugauuuuggggaggaggaaggggcgauuugagggaga

SEQ ID NO: 132860 - RNA, 64 nt, Human
cucuugaaaaguucagggaccguccaggggagauggggaggagauauggagugagucaccugcu

SEQ ID NO: 132861 - RNA, 64 nt, Human
ccguccuggcucacuuugcaguuggcacuggguuggggaggaagagagcugaugaguguggcuu

SEQ ID NO: 132862 - RNA, 64 nt, Human
gugcgugugugugugugugugucagguuuaauuuggggaggaagcaaaggguuuuguuuuggag

SEQ ID NO: 132863 - RNA, 64 nt, Human
ccuuaauuucacucuccucccuucuccagccucaggggaggaucuggaggauccacuacugucu

SEQ ID NO: 132864 - RNA, 64 nt, Human
ggaccccugcauuggaacuggaggcagggaacauggggaggaggagggucggugccuucaagaa

SEQ ID NO: 132865 - RNA, 64 nt, Human
cgugaguugggggaugggauccuagguagggccaggggaggagacccauaaauguucccuuggg

SEQ ID NO: 132866 - RNA, 64 nt, Human
gcagcuugcguuagaaugaggaggaaggagagaaggggaggagggcggggggcaccuacuacau

SEQ ID NO: 132867 - RNA, 64 nt, Human
ugugaugggaaagggcgaacgaggauuaggggauggggaggaagagagagacuguggagcucug

SEQ ID NO: 132868 - RNA, 64 nt, Human
agcagcccagcccgcccagccccagguggguaguggggaggagagcuggcauuccuccaggugg

SEQ ID NO: 132869 - RNA, 64 nt, Human
ugcuccuguuuccaauagcuuaggucccauggugggggaggaaccucaggggcuaugcagcccc

SEQ ID NO: 132870 - RNA, 64 nt, Human
ucuuguggcauuuguauuauaaaaacuuggugugggggaggagcacaaaacuccagcccacuga

SEQ ID NO: 132871 - RNA, 64 nt, Human
gagagccgaggccuggaggagcccgggucaggcuggggaggaacagaacugggcccucccagag

SEQ ID NO: 132872 - RNA, 64 nt, Human
cuggaguuagauaucuucuuuugcccggauugauggggaggagggauuaaaagagucaggaaga

SEQ ID NO: 132873 - RNA, 64 nt, Human
gucagauuuguauuguuuccaagggaaaagcuugggggaggacucaguucacaaaaugcaaaac

SEQ ID NO: 132874 - RNA, 64 nt, Human
gccugcccaccggcccccggcagugcaguccagcggggaggaggcugcccguuccugccaguuc

SEQ ID NO: 132875 - RNA, 64 nt, Human
aaaagcacgucuggcugcgagggcacacagggccggggaggaggauuaggcuggacugaucgcg

SEQ ID NO: 132876 - RNA, 64 nt, Human
ccaucgauuuuguccaacaaacaauuucuggcuuggggaggagucccucuagguagaacacagu

SEQ ID NO: 132877 - RNA, 64 nt, Human
uagcaaugagguucacuggauacagcuggauacuggggaggacgugggcugcgaggagaagcug

SEQ ID NO: 132878 - RNA, 64 nt, Human
uuaaagagaugaaauaaauuaagcaguagauccaggaugcaaaauccucccaauuccugugcau

SEQ ID NO: 132879 - RNA, 64 nt, Human
caacccuccuccacagcgccauauuaauggaggaggggaggaaggugaaaucuacugcauggga

SEQ ID NO: 132880 - RNA, 64 nt, Human
uggugguaucggugucgagggagaggaggggguuggggaggacccaccucuccagaauggcgac

SEQ ID NO: 132881 - RNA, 64 nt, Human
agcacuaagggcugaggucaauaccgcagaccuuggggaggaagcugagcaucccccgggaugu

SEQ ID NO: 132882 - RNA, 64 nt, Human
auacacucaaguguggggagucaugggguguggaggggaggaaaggaaagguauuuuguuucuu

SEQ ID NO: 132883 - RNA, 64 nt, Human
ucugcaggagucugcaggucacccggagcaggacggggaggagcugagccggacccuccaccug

SEQ ID NO: 132884 - RNA, 64 nt, Human
uuuucccuuuuagaauacauuaaaugguugauuuggggaggaaaacuuauucugaauauuaacg

SEQ ID NO: 132885 - RNA, 64 nt, Human
cauucgccacgcaugugaccugggauagcuuucgggggaggagagaccuuccucuccugcggac

SEQ ID NO: 132886 - RNA, 64 nt, Human
guccuccuagaguuuagaggcuagagggagcugaggggaggaucuuacugaaagcacccugggg

SEQ ID NO: 132887 - RNA, 64 nt, Human
aauagauaacucagcguagauaguauugcaaaaaggggaggaaauacacaacaauaauaaaugu

SEQ ID NO: 132888 - RNA, 64 nt, Human
uaucaaaauuggggcucuucaguuaaaaagggguggggaggacaaacgugucgaugugcuuugg

SEQ ID NO: 132889 - RNA, 54 nt, Human
cuggcaccaaggcccucugacaguggggaggacgaggaugugggaccgccagcc

SEQ ID NO: 132890 - RNA, 64 nt, Human
ggaugccccagccccuacccuaagaccuauugccggggaggauuccacacuuccgcuccuuugg

SEQ ID NO: 132891 - RNA, 64 nt, Human
cgcgggggugcguggcgcuugcgagcccuggccaggggaggaagugaggcccaggcaccugcug

SEQ ID NO: 132892 - RNA, 64 nt, Human
uccagagggucuucagaagccccccugggagggaggggaggaugagcacgcccagcuccccucc

SEQ ID NO: 132893 - RNA, 64 nt, Human
uggcggagggagggaagaggagggagugacgggaggggaggaggucagcgaccuggggccguag

SEQ ID NO: 132894 - RNA, 64 nt, Human
gggggguggggagaagggucgggcagggggugcaggggaggaaacuccucaccaggagagccaa

SEQ ID NO: 132895 - RNA, 64 nt, Human
ggagguccuggggcgugcacccgcccugggcaguggggaggagaguggccugaguuacuucacc

SEQ ID NO: 132896 - RNA, 64 nt, Human
cugaggcucagccccucaacccgguggcauucugggggaggaguggggcccacagcucuccagc

SEQ ID NO: 132897 - RNA, 64 nt, Human
uuucuaggagauuuucauuuugugugacucccauggggaggaacagacuggcaggaagcacacc

SEQ ID NO: 132898 - RNA, 58 nt, Human
uggccugugcugaaagcuagguccuccgggggaggaggguguagcuggcaugucaucc

SEQ ID NO: 132899 - RNA, 64 nt, Human
acaugugccucccguuccagcaucuggcugcccgggggaggaaggacacccggggcgggcgccc

SEQ ID NO: 132900 - RNA, 64 nt, Human
aaaaaaaaaaaaguuuaaaaagcaaaauggggagggggaggaagcagugacuuuuuuuugguaa

SEQ ID NO: 132901 - RNA, 64 nt, Human
cccauuaccgacauuaggcagaagagugggggguggggaggacaaggggguggguaaggggcuc

SEQ ID NO: 132902 - RNA, 64 nt, Human
ccuuggaggaaauaagaugagggagaaaggagaaggggaggaaacuucuccccucccaccuuca

SEQ ID NO: 132903 - RNA, 64 nt, Human
agcccauggucgggacagugcccuggccuuugccggggaggaggaugcucugagauucagggug

SEQ ID NO: 132904 - RNA, 64 nt, Human
gcauuguccccgucuuucccaucgccuagcguuuggggaggaacagggagagagcuucggggcg

SEQ ID NO: 132905 - RNA, 64 nt, Human
aaccacaugaacuggacugagagggggaagaagcggggaggaagaaaucccgccccaaacgucc

SEQ ID NO: 132906 - RNA, 64 nt, Human
uuguggagcacugaccuggccaaggccucauccuggggaggauacugaggcacacagaggggag

SEQ ID NO: 132907 - RNA, 64 nt, Human
aagcccagcacgcagugcaccuugaacagagggaggggaggacccauggcucuccccccuagcc

SEQ ID NO: 132908 - RNA, 64 nt, Human
ugggaagccuagauaaggccgugagcagaaagaaggggaggauccuccuauguuguugaaggag

SEQ ID NO: 132909 - RNA, 64 nt, Human
cccccgacaccauggccuggcugcccacuccucaggggaggaaagagagauccaguaugcaccc

SEQ ID NO: 132910 - RNA, 64 nt, Human
acguuuuuauuuuuugccucagagggaugggauuggggaggaggggaugggcagcggaggguug

SEQ ID NO: 132911 - RNA, 64 nt, Human
agaccugugaagcuacagacugacagccagggcaggggaggagggaggggcgccagcaccugau

SEQ ID NO: 132912 - RNA, 64 nt, Human
aaccacccugggcccagaaacagaggccugccgaggggaggagccuggccucuguccacccguc

SEQ ID NO: 132913 - RNA, 64 nt, Human
gaauggaguuuugaucucgcugaguuuggaguugggggaggaaaggaguggucuugguucaaau

SEQ ID NO: 132914 - RNA, 64 nt, Human
ucguugagacauaucuguccaugucugucuaaaaggggaggagaugagggagaaaaaagggaau

SEQ ID NO: 132915 - RNA, 64 nt, Human
cauccccaaagagguagcacugcagcaacaucagggggaggacgugguggcugaacucuagugg

SEQ ID NO: 132916 - RNA, 64 nt, Human
ggauggagugggccggcggccaaaccagucacucggggaggaaugcggaggagcgcucauucca

SEQ ID NO: 132917 - RNA, 64 nt, Human
gucaucaucauccauggaguggcugcuggugcccggggaggagcagcuauccuugcccccagag

SEQ ID NO: 132918 - RNA, 64 nt, Human
ccaccucccugacacccuccccugaccugacuagggggaggauccaccccaaccucugcccugc

SEQ ID NO: 132919 - RNA, 64 nt, Human
ucucuucuuguuucuccugcccacugcugcaguaggggaggagcacaguuuguggcuuauaggu

SEQ ID NO: 132920 - RNA, 64 nt, Human
ggaccgggaacggaggcggccagcggcgcccggaggggaggaaggggccgggccagacguuccc

SEQ ID NO: 132921 - RNA, 64 nt, Human
gugacucaugcggcaaugaaauauuuaacaaaugggggaggaacuugcacucuccugcgggauu

SEQ ID NO: 132922 - RNA, 64 nt, Human
uggguggggggccucaggcgggaucucggggcggggggaggaggauggugaccuugggagucgc

SEQ ID NO: 132923 - RNA, 64 nt, Human
cauuacaccagaagaccaugggugaagucuagauggggaggagaagugaggccagggacagucu

SEQ ID NO: 132924 - RNA, 64 nt, Human
gucuccauccccgcucagccuggguugcacuggaggggaggaagaaaguuguuuucagcauagu

SEQ ID NO: 132925 - RNA, 64 nt, Human
cggcauuugaucagaccaaacagugcuguuucccggggaggaaacacuuuuuuaauuacccuuu

SEQ ID NO: 132926 - RNA, 64 nt, Human
cgccccugucaguccccccaauuuuguauucuggggggaggagcccucucuuccuguggcccca

SEQ ID NO: 132927 - RNA, 64 nt, Human
ccuccaggccccccggggagggggaaaggaguuuggggaggauucguggucuucaugguuuuau

SEQ ID NO: 132928 - RNA, 64 nt, Human
caccauuuuuccagagcugcagagagcaccugguggggaggaagaaguguaacucaccagccuc

SEQ ID NO: 132929 - RNA, 64 nt, Human
ugagccugggguugacuggguuagagaagaaccgggaugcaaggagcugccugugacaccuggc

SEQ ID NO: 132930 - RNA, 64 nt, Human
gcagcagacucccucagccaugagaaccagcuuuggggaggaggccgggaaucaaagcgagucc

SEQ ID NO: 132931 - RNA, 64 nt, Human
ccccagcccucagggagcuccgcucagccccggcggggaggagcgggugggugugcgcgcaagg

SEQ ID NO: 132932 - RNA, 64 nt, Human
uguaaucccagcacuuugggaggucgggggggugggggaggaucacggggucaggagaucgaga

SEQ ID NO: 132933 - RNA, 64 nt, Human
ccugguuuuaccccagcuccauccuugcaucacuggggaggacgugaugagugaggacuugggu

SEQ ID NO: 132934 - RNA, 64 nt, Human
caacaucaggaaguuacccgauaugucccaaaagggggaggaaugaauaauccaccccuuguuu

SEQ ID NO: 132935 - RNA, 64 nt, Human
augccuauaaucccaguacuuuaggacauggaagggggaggaucacuugagaccaggaguugug

SEQ ID NO: 132936 - RNA, 64 nt, Human
gcccacccccuucgugcgcaugcuuaaugcuucuggggaggagggggcuggucccagcggagcc

SEQ ID NO: 132937 - RNA, 64 nt, Human
cuccccgaugcuccgaagccugaucuuccaggguggggaggagaaaaucccaccuccccugacc

SEQ ID NO: 132938 - RNA, 64 nt, Human
gugguaaagcuguacuuggugggagugagggcguggggaggaaccaugcaaaucgccuuccaug

SEQ ID NO: 132939 - RNA, 64 nt, Human
uguagggugaaauggcaauuauucucuccaugcuggggaggaggggaggagggucucagacagc

SEQ ID NO: 132940 - RNA, 64 nt, Human
gaaauggcaauuauucucuccaugcuggggaggaggggaggagggucucagacagcuuucgugc

SEQ ID NO: 132941 - RNA, 64 nt, Human
uguucccaggaagaggaaguaaaucugcaacccuggggaggaccccaacucaccugggaaugag

SEQ ID NO: 132942 - RNA, 60 nt, Human
gcgagccucaccccacuuaacauauccugcggggaggaggagccccaggggugcuagucu

SEQ ID NO: 132943 - RNA, 64 nt, Human
gguuagggaaguuaaagucuguuuauccguaaguggggaggagggucagcuaagagaaguggga

SEQ ID NO: 132944 - RNA, 64 nt, Human
cuccuggggcccuagaagccggggcggccccagcggggaggaggagcaaggacauguaccaugc

SEQ ID NO: 132945 - RNA, 64 nt, Human
ugugagugugugucccuguguguguguugcgggaggggaggacuggggcuggaaguccagcacc

SEQ ID NO: 132946 - RNA, 64 nt, Human
ucaaacgcccugagagucccggauguccgaggcgggaugcaaaccaucccguccugagcacggg

SEQ ID NO: 132947 - RNA, 64 nt, Human
gggaagcucuuuaggccaccuggugaaggugcauggggaggauggagcuucuccucagcuccuc

SEQ ID NO: 132948 - RNA, 60 nt, Human
aggaggaggagaggaagugaggagaaggaaggggaggacagacguucacacugccacgua

SEQ ID NO: 132949 - RNA, 64 nt, Human
gaggccucuuuggugagccuggggaaucagcaaaggggaggaggggugugggguugauacccca

SEQ ID NO: 132950 - RNA, 64 nt, Human
ugccgguuucuuggcugucagucagucccagaguggggaggaagauaugggugacccccacccc

SEQ ID NO: 132951 - RNA, 64 nt, Human
cugguugcagauacaguaccuggacuccaugaacggggaggaucugcuucugacaggggaggug

SEQ ID NO: 132952 - RNA, 60 nt, Human
agcucccuccuguuuucugaagcugccacaggggaggagucucuucucagugagggucuc

SEQ ID NO: 132953 - RNA, 64 nt, Human
uuuuugacuauaaaggagcuuuuuuauuuugggaggggaggagugucauuuuugagaaucuugg

SEQ ID NO: 132954 - RNA, 64 nt, Human
acuacggucuguccucaccaagggauggggguuuggggaggagagugacauuuucaucauuagc

SEQ ID NO: 132955 - RNA, 64 nt, Human
agugacuuuuggaaaucaaccuuuuuuauuugggggggaggauggggaaaagagcugagaguuu

SEQ ID NO: 132956 - RNA, 64 nt, Human
agcuucgguaugccuucagggaaaggucacagcuggggaggaagcggggggacgccugucaccc

SEQ ID NO: 132957 - RNA, 64 nt, Human
accagccagagcacaggaagccacccugccugcuggggaggagggacccacacaagcccccucg

SEQ ID NO: 132958 - RNA, 64 nt, Human
gucuggauuugugggaauggcuuugcgugagaaaggggaggagagugguugcugcccucagccg

SEQ ID NO: 132959 - RNA, 64 nt, Human
auucaacuaauaaaaauuuagccacacuuacaagggggaggaagucccuaguuuaaaauguaua

SEQ ID NO: 132960 - RNA, 64 nt, Human
cugguuaggcugugugucuccuacauuaacagcuggggaggagggaaaagcuucagacuuuuaa

SEQ ID NO: 132961 - RNA, 64 nt, Human
augccgcuguguccccgcgggcagugacgugaguggggaggagacucaggcccacauugcccac

SEQ ID NO: 132962 - RNA, 64 nt, Human
cccugcugccagagagaccugcugccggagagaaggggaggaggacuccagcugggcucggucc

SEQ ID NO: 132963 - RNA, 64 nt, Human
uugucaaauguuacccuuuuugaucaggguguagggggaggauauugcuaguauauuuucagug

SEQ ID NO: 132964 - RNA, 64 nt, Human
guggacaccguccccacuccggacucccagcacaggggaggauaccugagccuguauggcccug

SEQ ID NO: 132965 - RNA, 64 nt, Human
agagacacugcuuuccaacuuaccucgagucccaggggaggaaaaugaaaaagcagacgcuucc

SEQ ID NO: 132966 - RNA, 64 nt, Human
gaaggagacagcaucuggaacaagcuugggauauggggaggagcaagccaucagugaugaggau

SEQ ID NO: 132967 - RNA, 64 nt, Human
cagcaccaguugacugcucgugugccagcgguguggggaggacggggcaggacgcugcagcucu

SEQ ID NO: 132968 - RNA, 64 nt, Human
gaggugaggacacagcaggcccaggaccauggcuggggaggauaugucagcaccuggaagugga

SEQ ID NO: 132969 - RNA, 64 nt, Human
ucucagguuccagcaagucaggcuagggaccuggggggaggagacccauggacuucacccauac

SEQ ID NO: 132970 - RNA, 64 nt, Human
ccaccaccuucugcacacacagcgguggggaggcggggaggagcagcugggacccagaacugag

SEQ ID NO: 132971 - RNA, 64 nt, Human
ccucuuaccccagaaaggucagguaugaccucccggggaggaaucccaccugccuguauacccc

SEQ ID NO: 132972 - RNA, 64 nt, Human
gcuaccaaggaagagagcacacagauaagacagaggggaggaggugggcauuuccuacauuccu

SEQ ID NO: 132973 - RNA, 64 nt, Human
aguauuuauugcaauguaaauguauccugaagguggggaggaauguuuaaucuaccauguccgu

SEQ ID NO: 132974 - RNA, 64 nt, Human
ggacugacucccauuuccuaaaggaaaugcccccggggaggacauugggaggaagauggccuga

SEQ ID NO: 132975 - RNA, 64 nt, Human
gguaaggaagagagagugggaggcagagugugauggggaggagggacaggaagacccuuuuaau

SEQ ID NO: 132976 - RNA, 64 nt, Human
ucauuguuuuucccuuuauuacacaggacagccaggggaggaggggggcccagcccugggaggc

SEQ ID NO: 132977 - RNA, 64 nt, Human
uaaggugauggacggcgucugcugggcaggccucggggaggaccccucagcuuugcucucagca

SEQ ID NO: 132978 - RNA, 64 nt, Human
augcaggaccgccucucaccugaccaggcuguagggggaggagacacuggcaggagaugugcug

SEQ ID NO: 132979 - RNA, 64 nt, Human
gccaggcucccgggcaucugguugaccccagccuggggaggagggcuggucuccgcuccucagg

SEQ ID NO: 132980 - RNA, 64 nt, Human
acaaauguuauaauuuauauagugugguugaacaggaugcaaucuuuuguugucuaaaggugcu

SEQ ID NO: 132981 - RNA, 64 nt, Human
gcagggcugcuccaggcaggucagagcagugcagggggaggagaggagaaagggaggaagcugg

SEQ ID NO: 132982 - RNA, 64 nt, Human
gggugucggguagagggaagagggcagggggcuaggggaggacucagaggccaucugcagggcc

SEQ ID NO: 132983 - RNA, 64 nt, Human
caacccuggccaguugcugaucccaaagauaacaggggaggaaguuucagcugagaagauggag

SEQ ID NO: 132984 - RNA, 64 nt, Human
gaagaaauuuccuuuagacuaacgaauauauuggggggaggaauagaggggaggugugcaggaa

SEQ ID NO: 132985 - RNA, 64 nt, Human
agaagcaguuuacucuagacuaaagaguauauugggggaggaagagagggaggcacguaggaac

SEQ ID NO: 132986 - RNA, 64 nt, Human
ccaccucugugcagggcacagaaggcugggguggggggaggaguggauuccuccccacccuguc

SEQ ID NO: 132987 - RNA, 64 nt, Human
cccccuaaccucuuucccccuuuucugcccccguggggaggagccccuuguaccugcuccgugc

SEQ ID NO: 132988 - RNA, 64 nt, Human
aagaggcuggcagaaguuacccuggauagggaagggggaggaggggacuuuuagagccagcagg

SEQ ID NO: 132989 - RNA, 64 nt, Human
ccaaacaucuuggcauccccaccccaggaagugcggggaggagguuaugaucccugggcgcuuc

SEQ ID NO: 132990 - RNA, 64 nt, Human
gcccugcgaguguguccccuguccccaccugaguggggaggagcgucucaagugaacaguggga

SEQ ID NO: 132991 - RNA, 64 nt, Human
ccccauuccaagcucccucuuccuccggguguuuggggaggaugcugaagaauccauucccgag

SEQ ID NO: 132992 - RNA, 64 nt, Human
guuucauuugcucuugggggauuagguaucauuuggggaggaagcauguguucugugagguugu

SEQ ID NO: 132993 - RNA, 64 nt, Human
uggcauguuggggugagggcagagggacagaugaggggaggagggugcuggcuaaacaggaacu

SEQ ID NO: 132994 - RNA, 64 nt, Human
cuccuccugcuccugaaccaggaggcuucaugugggggaggaggagaggucuccaugugacaca

SEQ ID NO: 132995 - RNA, 64 nt, Human
uccggcagguuuuuuacgagccggguggaggguuggggaggaaagaaagggcgguggcucggga

SEQ ID NO: 132996 - RNA, 64 nt, Human
gaggauccuggacgaccccuccccaccucagccuggggaggagaagcuggcagcccucacugca

SEQ ID NO: 132997 - RNA, 64 nt, Human
ccgagagacacggucuggacagcccaaggcgccaggaugcaaccugcuuucaccagacugcaga

SEQ ID NO: 132998 - RNA, 64 nt, Human
aggccaguucugaaaggcgagcagaacucccccuggggaggaagcucaccaaaaguuuuuccca

SEQ ID NO: 132999 - RNA, 50 nt, Human
aguuuaagucagucaguuaaggggaggagaaggagagguuauaccuucag

SEQ ID NO: 133000 - RNA, 64 nt, Human
gccccagggagaacacagggacgugccacucgagggggaggaugguauggauuucugcuuuugu

SEQ ID NO: 133001 - RNA, 64 nt, Human
uggggccaaagacauuuccauuuccgaucuccauggggaggagggacuuaagcccaaguggguc

SEQ ID NO: 133002 - RNA, 64 nt, Human
ugaggcaggcuuaggggaaagaaccagaggggcaggggaggacuggggagggcuggcuagccag

SEQ ID NO: 133003 - RNA, 64 nt, Human
auguggaaguguguguggcagcaggcagcggggaggggaggaacagggaagggggagcugggga

SEQ ID NO: 133004 - RNA, 64 nt, Human
cuuuggaaccucuccauauacuuucuaagcucugggggaggaggaggaugggaccuccuggacc

SEQ ID NO: 133005 - RNA, 64 nt, Human
agccccgcuaucuugagauuaguguugacagggaggggaggauugugaggugagggguuaauaa

SEQ ID NO: 133006 - RNA, 64 nt, Human
ggaggaggaaaaggaggaagaggaggacaaaaagggggaggagaagguucuucguccaaaggag

SEQ ID NO: 133007 - RNA, 64 nt, Human
ccugccuuucccugacacuuuuggggucugccugggggaggaggggagaaagcaccaugagugc

SEQ ID NO: 133008 - RNA, 64 nt, Human
gauggugcauaacaggauguguuugaaccuaguaggggaggaaacaggcuuucuuacucugguu

SEQ ID NO: 133009 - RNA, 64 nt, Human
gcugcugggaggcaagagccgcaccaugcaggauggggaggagggcgagagucacaggguugcc

SEQ ID NO: 133010 - RNA, 64 nt, Human
auccacccagccuuuucauuuucgauugcacagcggggaggaggaauggcuuuguggucgucgu

SEQ ID NO: 133011 - RNA, 64 nt, Human
auggcagggccagcgggcaggacagggaaacaggggggaggacaauggauacucaguuuuuugu

SEQ ID NO: 133012 - RNA, 64 nt, Human
aacugagugguacagauaugacauggaagaucugggggaggaaguucaaggaaggcaccacacc

SEQ ID NO: 133013 - RNA, 64 nt, Human
ugugggauagaaugaacuuaaugggggacggaagggggaggagugcucaacggggagggaaaug

SEQ ID NO: 133014 - RNA, 64 nt, Human
ugagcuuugaaagaagauuggagagggugggaaaggggaggagggagcccugaaaagagguacu

SEQ ID NO: 133015 - RNA, 64 nt, Human
guguguacuuguuggucuguaucuuaguuucuuuggggaggacagggcuguagcugugaggucu

SEQ ID NO: 133016 - RNA, 64 nt, Human
gcuuguuugcuuaaaaauguaauugggggcggcgggggaggagaggggaaagagacauucgcuu

SEQ ID NO: 133017 - RNA, 64 nt, Human
uguagcccgccucaugcacugaccacagcccccaggggaggaugguacuggaucuggccccauc

SEQ ID NO: 133018 - RNA, 64 nt, Human
gagcagcaguggaagaccucgggccaugcggccuggggaggacuugguggcgauccgcaaccug

SEQ ID NO: 133019 - RNA, 64 nt, Human
acuccccucuccacugauggcugggaagggaguuggggaggaagagugggagggagggcugggg

SEQ ID NO: 133020 - RNA, 64 nt, Human
cguuccugagggccaggucgggggcaggcauggaggggaggaaaggcgucccucuuggcccucc

SEQ ID NO: 133021 - RNA, 64 nt, Human
auguugggaggcugcuggcugcacagacccgugaggggaggagaggggcugcugugcaggggug

SEQ ID NO: 133022 - RNA, 64 nt, Human
gucugugacuuaguggacaggggagggggcaaagggggaggagaagaaaauguucuuccaguua

SEQ ID NO: 133023 - RNA, 64 nt, Human
ccugaguggggccagggugggagggagggacaagggggaggaaaggggcgagcacccacgugag

SEQ ID NO: 133024 - RNA, 64 nt, Human
uguuaccaaaccucaugcauccacguuugcgucuggggaggaauaaaaagacaucguucccgcu

SEQ ID NO: 133025 - RNA, 64 nt, Human
ccaacagcaaagcauaggccucaucuuuggagagggggaggagugauaaacuagccaaaguuag

SEQ ID NO: 133026 - RNA, 64 nt, Human
acuguccugcuuguacaacaugguuuggggugaaggggaggaaaguauuaaaaaaucuauaucg

SEQ ID NO: 133027 - RNA, 64 nt, Human
uaaggggcccuaggguacagggugcugcccagcaggucgccaccgagugucuucucauuuuauu

SEQ ID NO: 133028 - RNA, 64 nt, Human
cugcuggugacuucugaccauaagcuagaaccauggucgccacuguuuucccucuguaguuucu

SEQ ID NO: 133029 - RNA, 64 nt, Human
uacugcuaguuuugaaaugucuuuguaagaguagggucgccaugaugcagccauauggaagacu

SEQ ID NO: 133030 - RNA, 64 nt, Human
ccccuaugcuccaguauggaagaaugggguggagggucgccacacccggcucccccugcuucuc

SEQ ID NO: 133031 - RNA, 64 nt, Human
cugagggaagaguuagccccgguucccagccgcgggucgccaguugcccaagaucagggguccg

SEQ ID NO: 133032 - RNA, 64 nt, Human
agaugguaacuacauuaggguuugcgggucugauggucgccaucauaacugcauacucaacucu

SEQ ID NO: 133033 - RNA, 64 nt, Human
accauggcuacucuugggaaccacccggccauguggucgccaaguagagcaagcccccuuucuc

SEQ ID NO: 133034 - RNA, 64 nt, Human
uccaccucagccuccccaguagcugggacuacggggucgccacugcacccagccugugucuucc

SEQ ID NO: 133035 - RNA, 64 nt, Human
ucugcuacguuccuauugucauuaaagguaucacggucgccaccuggcauuccuucugaccaca

SEQ ID NO: 133036 - RNA, 64 nt, Human
cagaauuuagcuucacuugagagagaucuggaauggucgccaugauugaaaccacgcaccauua

SEQ ID NO: 133037 - RNA, 64 nt, Human
agaggccauuguaaacaucugcuuguccuucuuaggucgccauucccuuugcauguuaagcguc

SEQ ID NO: 133038 - RNA, 64 nt, Human
gucauccugcaugccuccuggaauucuccaauggggucgccaaacaacaaauggagaaaaaaag

SEQ ID NO: 133039 - RNA, 64 nt, Human
gggcccgggcaucucgccugcgcuuccuccugauggucgccagagggcagcauccccuaacuaa

SEQ ID NO: 133040 - RNA, 64 nt, Human
gcccggggucggggcuggggaaggggagccccagggucgccagagccgcgagccacuccagcga

SEQ ID NO: 133041 - RNA, 64 nt, Human
aggggacucaggggcgaggaggaugacuggguccggucgccaggacugucucugaggcagaaac

SEQ ID NO: 133042 - RNA, 64 nt, Human
uugagcagucccuguugcuggccagagacugccuggucgccagcgcucaccaugggugccagga

SEQ ID NO: 133043 - RNA, 64 nt, Human
ccucaucagcaggaaggugcccuuccuggaggauggucgccacaggcacauaauucaacagugu

SEQ ID NO: 133044 - RNA, 64 nt, Human
aaaccagguuaucugggaaucuuuccagcccgcaggucgccacggccaucccuuugcucccagc

SEQ ID NO: 133045 - RNA, 64 nt, Human
acccgccuucgggaccccgcucccagcucugagaggucgccaaagccugcagccuggccugggc

SEQ ID NO: 133046 - RNA, 64 nt, Human
gcauguccgaaagcaguccaggagauuauuaaggggucgccaugaauccacuuugguuuuaaaa

SEQ ID NO: 133047 - RNA, 64 nt, Human
caggccaguggacagagggagaagggagaacaggggucgccaacacuuguguugcuuucugacu

SEQ ID NO: 133048 - RNA, 64 nt, Human
agaaaaaaggcgucuaugaaugaccaguguuuuuggucgccaaauguugcugacaaacuuaucc

SEQ ID NO: 133049 - RNA, 55 nt, Human
acgaccucucggugcucugagccgcggucgccauggccacugcggucgccauggu

SEQ ID NO: 133050 - RNA, 64 nt, Human
cggugcucugagccgcggucgccauggccacugcggucgccauggucaccgcgcccuccgcucg

SEQ ID NO: 133051 - RNA, 64 nt, Human
aagucaaacauugcucaguaaaaugccuuuggcuggucgccagcugugcaugacugcaguuccu

SEQ ID NO: 133052 - RNA, 64 nt, Human
uuuucugccgucuuuugaggaaaucuagugaagaggucgccauaaaauauuagagucaacaacc

SEQ ID NO: 133053 - RNA, 64 nt, Human
cugcacugacucccccacuccugacccuggugauggucgccacugggcagcagcagccuuacca

SEQ ID NO: 133054 - RNA, 64 nt, Human
gagcagaagacgucuccccuucucugccucaccuggucgccaauccaugcucucuuucuuuucu

SEQ ID NO: 133055 - RNA, 64 nt, Human
agaacucugggccuuagagcaggccccgaacuguggucgccaggcccaggaggcgacugcaugg

SEQ ID NO: 133056 - RNA, 64 nt, Human
aucuugaagaagcucuuuuggguaucaacaccuaggucgccagugaaauagaacacagaacagg

SEQ ID NO: 133057 - RNA, 64 nt, Human
accccauuacuguaccucuggagucacuacugugggucgccacuccucugcuacacagcacggc

SEQ ID NO: 133058 - RNA, 64 nt, Human
guggcaucgcacgaucuagucugugguguagacuggucgccaucacguguaauaaagcacccgg

SEQ ID NO: 133059 - RNA, 64 nt, Human
cgucacucugggcagggaugccgucagccuugagggucgccacccaccuguguguugcccucug

SEQ ID NO: 133060 - RNA, 64 nt, Human
uugggggccuucuuggagccgugugugagugaguggucgccacacagcauuguacccagagucu

SEQ ID NO: 133061 - RNA, 64 nt, Human
ugaacaugccucucucuugcuuacaaaugccuaaggucgccacugccugcugcagagaaaacac

SEQ ID NO: 133062 - RNA, 64 nt, Human
aaggccuccugcagcugugccguccacaccucuaggucgccagagcccuggcccccagccccca

SEQ ID NO: 133063 - RNA, 64 nt, Human
agcccauauccccauagagucuaccuagagcaggggucgccaaauguuuucuuaaagagccuga

SEQ ID NO: 133064 - RNA, 64 nt, Human
accccuguaggugacaggugggcagccugguaggggucgccagccuccaugcccccucaucuuc

SEQ ID NO: 133065 - RNA, 64 nt, Human
ggaggggcccgccuuagccaugugaagguggauuggucgccaucugcacgccaggcggcauccu

SEQ ID NO: 133066 - RNA, 64 nt, Human
uuugcuagggucacccucucggccaucccacgagggucgccaugaucaccccaacucuagaggc

SEQ ID NO: 133067 - RNA, 64 nt, Human
ucaccucggugggggaccccacucacccccuuagggucgccaccccucacggcaacuugugccu

SEQ ID NO: 133068 - RNA, 64 nt, Human
ucccuuccagcucugcagcuaaugagguccugccacaacggaaagagggaguuaauaaagccau

SEQ ID NO: 133069 - RNA, 64 nt, Human
cuggugauguuuacuuaaaaagugaucccccucaacaacggauacagcgugcuuauuauugggc

SEQ ID NO: 133070 - RNA, 64 nt, Human
ugcucuuguugaucuuguauucagucagguuaaaacaacggacaauaaaagaaugaacacauuc

SEQ ID NO: 133071 - RNA, 64 nt, Human
cugcugcuggcgcccuagguggcugggggggaagacaacggagaccggugucgcgccgccucca

SEQ ID NO: 133072 - RNA, 64 nt, Human
uggaaaauacaugucuagaacugauccagcaauuacaacggagucaaaaauuaaaccggaccau

SEQ ID NO: 133073 - RNA, 64 nt, Human
uauaacauacuuggaaaggauuuaccguucugcaacaacggacugguacauacaggaugaucac

SEQ ID NO: 133074 - RNA, 64 nt, Human
cuccccaggagagccugcacagcuucuugcacucacaacggacacuuugcuccacacacauaau

SEQ ID NO: 133075 - RNA, 64 nt, Human
uuuuuucccuugagaugaggucugugccugauguacaacggauacuccauaaauguuugacaaa

SEQ ID NO: 133076 - RNA, 64 nt, Human
cgcagcaagugaggcucccacaggcaccagcaaaacaacggaugaauguagcccuuccaacacc

SEQ ID NO: 133077 - RNA, 64 nt, Human
auauauaacauauauggaagaggaaaaggcugguacaacggaggccugcgacccugggggcaca

SEQ ID NO: 133078 - RNA, 64 nt, Human
gcauuccuccagcgccaagcgucagagccugcagacaacggagggcagcgcccccccgagauca

SEQ ID NO: 133079 - RNA, 64 nt, Human
aaaguggaagauauuaagcaaaauguuuaaagacacaacggaauagacccaaaaagauaauuuc

SEQ ID NO: 133080 - RNA, 64 nt, Human
aaaagcuaaauaacuuaaaaaaaaacugaggcguacaacggagcaacaauaucgguucucagug

SEQ ID NO: 133081 - RNA, 64 nt, Human
uaggcuugcuccacuuucauccuccacuauagauacaacggacuuugacuaaaagcagugaagg

SEQ ID NO: 133082 - RNA, 64 nt, Human
cugggguuucaauuccucagaaacaacuuuuuucacaacggaaaggaaagaacacuaguguucu

SEQ ID NO: 133083 - RNA, 64 nt, Human
gaauccggauuguucggcaggcccuugguguuauacaacggaucccaaagucaggugggaguac

SEQ ID NO: 133084 - RNA, 64 nt, Human
auuuguugaauaacagaacgaguguaaaauuuuaacaacggaaaggguuaaauuaacucuuuga

SEQ ID NO: 133085 - RNA, 64 nt, Human
uuacagcgccccucaguguucaucuccagcagagacaacggaggaggcucccaccaggacgguu

SEQ ID NO: 133086 - RNA, 64 nt, Human
ugcuggaucuagggaaaggaggagcuaucgaaguacaacggaucaaaaaaccacagggcuuuug

SEQ ID NO: 133087 - RNA, 64 nt, Human
gcagcuuuucugcuuuuucccuuccucuguggugacaacggaggaaauauccaacagaaauacg

SEQ ID NO: 133088 - RNA, 52 nt, Human
caggccugggcuccagcugaggacaacggaacccccuuucccugcccuccag

SEQ ID NO: 133089 - RNA, 64 nt, Human
uggaggcaaguaccuuaauuaguuuuauauagucacaacggaaauauauuuucuagugaauucu

SEQ ID NO: 133090 - RNA, 64 nt, Human
uuuauuaggaggaucagagugagugggaaguuucacaacggauugaucugaucaaucccuucaa

SEQ ID NO: 133091 - RNA, 64 nt, Human
gcagaggaagaggcucucaguccccaccuguacaacaacggaaagguguguggccacacgaaga

SEQ ID NO: 133092 - RNA, 64 nt, Human
gagaccaagauggcagguggaggccaggcuuaccacaacggaagagaccucccgcuggggccgg

SEQ ID NO: 133093 - RNA, 64 nt, Human
gcggggccuccccuucgacgaccaggccucggucacaacggacgugacaugcugcuuuuuuuaa

SEQ ID NO: 133094 - RNA, 64 nt, Human
guaccugcugagggcgcuggcucugcagaucagaacaacggaggauagcuuugugccuggaccc

SEQ ID NO: 133095 - RNA, 64 nt, Human
auacaguccuuacauuuuuucccuugguguaggaacaacggaggaguuucuccucugcuaacua

SEQ ID NO: 133096 - RNA, 64 nt, Human
ucuagauguaauguugucacuaauuaauugccauuacucccaguuaguuacccuugucauuugg

SEQ ID NO: 133097 - RNA, 64 nt, Human
cuaguuuuagagaaugagaaagucuuaagcaaaauacucccaggucucacuccagaacauaaaa

SEQ ID NO: 133098 - RNA, 64 nt, Human
cccagaaugcaccugacuuaugaaauggggauaauacucccaggaaauagcgcaggacaucaca

SEQ ID NO: 133099 - RNA, 64 nt, Human
aauugaugugauaaggaaaaaaguccuauuuuuauacucccaacaagccuguguccugugguuc

SEQ ID NO: 133100 - RNA, 64 nt, Human
uugcaaauguccauagggagcagguggcagccucuacucccagcaacaaguuuguguucucucc

SEQ ID NO: 133101 - RNA, 64 nt, Human
ccagcacucacaccacuaacaugcccuguucagcuacucccacucccggccugucauucagaaa

SEQ ID NO: 133102 - RNA, 64 nt, Human
aaaggucuauugaauuuauuuguuuguaaguuucuacucccaucaaagcagcuuucuaaguuau

SEQ ID NO: 133103 - RNA, 64 nt, Human
uguaugcauguaaguguuuuuguccuaauguugcuacucccauggcaaagaaaaaaaaaagaau

SEQ ID NO: 133104 - RNA, 64 nt, Human
aagugcuaguuaaauggauucauaugaagugcuuuacucccaaccauugaguuauuuauaaugu

SEQ ID NO: 133105 - RNA, 64 nt, Human
gggugggguuuccaugauccauuaaaugccuuccuacucccauucaucgcucucaaaauuagcu

SEQ ID NO: 133106 - RNA, 64 nt, Human
cuccucguuccuuucuccuguuuauucccaucuuuacucccaagacuucauugucccucuucac

SEQ ID NO: 133107 - RNA, 64 nt, Human; identical to SEQ ID NO: 133106

SEQ ID NO: 133108 - RNA, 64 nt, Human
cccagccugcccugugacccuugccucuuccugauacucccaagagcaggccccaggggucugu

SEQ ID NO: 133109 - RNA, 64 nt, Human
cccuggaaauuauagagaaaauaaacauaaucuauacucccaacaccacaaaguaacaccugcc

SEQ ID NO: 133110 - RNA, 64 nt, Human
uccccaaaucccugagccagaaguggggugcuuauacucccaaaccuugaguguccagccuucc

SEQ ID NO: 133111 - RNA, 64 nt, Human
uuauccagcagucaauuaacucuccaguuaucaguacucccacaauuggccagggcaacaauaa

SEQ ID NO: 133112 - RNA, 64 nt, Human
guuaaacuccuauacacaagucuacaccccaggauacucccagccuccagcugggaacucuuuu

SEQ ID NO: 133113 - RNA, 64 nt, Human
ggaccaugaaacaacaagauccaguggcucuucuuacucccaggacuccaucaucuucccuuca

SEQ ID NO: 133114 - RNA, 64 nt, Human
acagacuguugucccugcacucuuuaagggaguguacucccagggcuuacggcccuggccuugg

SEQ ID NO: 133115 - RNA, 64 nt, Human
gcacuuagaguugcuuucaguaacauuuuaccccuacucccaaagguagcuuaaauagacagau

SEQ ID NO: 133116 - RNA, 64 nt, Human
aagaacauaucagaaauauauaggucccagguaauacucccaaacaucccacuuuuuacuguuu

SEQ ID NO: 133117 - RNA, 64 nt, Human
aaaguaaaagaaaagcagaaaaucaccuguuaucuacucccagaaauaaucaauuucaacauuu

SEQ ID NO: 133118 - RNA, 64 nt, Human
aguguccaagaggaguaaaggucaugacagaauuuacucccaggacaaucuaaguucugccaca

SEQ ID NO: 133119 - RNA, 64 nt, Human
agcggaaaaggacaagacggugcagucggcugcauacucccagucgggaguguggucagucugc

SEQ ID NO: 133120 - RNA, 64 nt, Human
uuuuagaaccuuuauaaaagcaauagcuggaauauacucccaguuuuaaaauaaaugccugauu

SEQ ID NO: 133121 - RNA, 64 nt, Human
uagacuuguuuauaccuuccagauuugauuguuuuacucccaaugacugcacuauauguaugca

SEQ ID NO: 133122 - RNA, 64 nt, Human
uuuguacagaagaguacuguauuuuugaauagccuacucccaaguaagagcaaaucuguaugau

SEQ ID NO: 133123 - RNA, 64 nt, Human
aauaguugagaccaccuacccacaaugcagccuauacucccaagacuacaaaguuaccaucgca

SEQ ID NO: 133124 - RNA, 63 nt, Human
gaccugacagcuaguuacauacgcucugacauaguacucccaugauggcuuccagugacacau

SEQ ID NO: 133125 - RNA, 64 nt, Human
ccucacucacccagccagcccuucaggugccuucuacucccagugccaaagccagaccacuggg

SEQ ID NO: 133126 - RNA, 64 nt, Human
ggaauuuuauauuuucagaguuuaaaauuauugcuacucccaauuuagaaaaauggggagaaag

SEQ ID NO: 133127 - RNA, 64 nt, Human
aaagaaauccugguuuguaauguuugucaguaaauacucccacuaugccugaugugacgcuacu

SEQ ID NO: 133128 - RNA, 64 nt, Human
acacugagaugugcuuauaacccuguuucauaucuacucccacgacuuacucauauuuaagggu

SEQ ID NO: 133129 - RNA, 64 nt, Human
cuugggcugaaguugcccacguccacaaaaucuguacucccagcggggguguuuggcccgagga

SEQ ID NO: 133130 - RNA, 64 nt, Human
cacccagcagagcuucucagugggcacagucucuuacucccauuucugcugccuuuggcccugc

SEQ ID NO: 133131 - RNA, 64 nt, Human
uuuuguccaugacuugcagguccccugacccccuuacucccagguagcacuggggcaaggguuu

SEQ ID NO: 133132 - RNA, 64 nt, Human
uugcaccugagggggaaaaaacaguucaacugcuuacucccaaaacagccuuuuuguaauuuau

SEQ ID NO: 133133 - RNA, 64 nt, Human
aucacagaugcauauagacacacauacauaaugguacucccaaacugacaauuuuaccuauucu

SEQ ID NO: 133134 - RNA, 64 nt, Human
acauaucugaggagggaggaggcuccaauacgacuacucccaauucacaggguuugugguucug

SEQ ID NO: 133135 - RNA, 64 nt, Human
gacagaagugucucagugacaaguuggaugacacuacucccaacuuuuuaaauuuggagaaaac

SEQ ID NO: 133136 - RNA, 64 nt, Human
ccagcgcucuaaaagcaccuccuugucacuuuauuacucccagaacaacaacuauccugacuuc

SEQ ID NO: 133137 - RNA, 64 nt, Human
gaacuaaaaugcaauauacaguuaaguccacggauacucccauuaaugagaaauaacacuagga

SEQ ID NO: 133138 - RNA, 64 nt, Human
uuuuuuuuuggcagcucccuagaucuuuagcuucuacucccacugcuccuaccacuccagcaac

SEQ ID NO: 133139 - RNA, 64 nt, Human
uccaucuuugauucacuucucuuuccuuucuauuuacucccaaaauggagucauucauccugau

SEQ ID NO: 133140 - RNA, 64 nt, Human
gaagcccagugccuuugcuccucuguccugccucuacucccacccccacuaccucugggaacca

SEQ ID NO: 133141 - RNA, 64 nt, Human
caggacacaagacuucugauuucuacccucaagauacucccagauccuaaauccaguagccucc

SEQ ID NO: 133142 - RNA, 64 nt, Human
ccugcccuuccacccggaggccaaaggccaacuguacucccaaaggcaugggagaagguuggcg

SEQ ID NO: 133143 - RNA, 64 nt, Human
guagauugcagcccuucugaugagaaauagggaauacucccaguccaggcccagcaaaaccaaa

SEQ ID NO: 133144 - RNA, 64 nt, Human
uuugaaaccuagcauuaaauggaaaaacaaaaauuacucccauauuuugaaacccuuuauaugg

SEQ ID NO: 133145 - RNA, 64 nt, Human
ccaucauugaagcgcaaauuuucuugaauucaaauacucccaaugagcuuguauacuuccaaac

SEQ ID NO: 133146 - RNA, 64 nt, Human
uguuaacuuuugaacauguguaacuuaaccuaaauacucccaaacuuuaccucuaaauuuuugu

SEQ ID NO: 133147 - RNA, 64 nt, Human
ugaaauuuuaauugaacuaacaauccuaguuugauacucccagucuugucauugccagcugugu

SEQ ID NO: 133148 - RNA, 64 nt, Human
uuuuuccucugugcaauuggaauaauaaaaauacuacucccauagaguuguuauguggucuuaa

SEQ ID NO: 133149 - RNA, 64 nt, Human
gcaugaacugaccacccuuagaagcacuccucgguacucccauaauccucucggagaaaaaaau

SEQ ID NO: 133150 - RNA, 64 nt, Human
cugcacaauuuugcauaucaaugauacugguucuuacucccaccaguguuucauaauacuaaca

SEQ ID NO: 133151 - RNA, 64 nt, Human
uuauguguaauuuaacaaacaaauuuuauuuuuuuacucccaugacagacauguuuuuccuagu

SEQ ID NO: 133152 - RNA, 64 nt, Human
ucaaauaugggauuguugucccaacccuguacuguacucccaguggccaaacuuauuuaugcug

SEQ ID NO: 133153 - RNA, 64 nt, Human
guugugcagcagaaacagauucucaguucauuuuuacucccacuguauuauaguuuaacaaaaa

SEQ ID NO: 133154 - RNA, 64 nt, Human
aggguauggggaaaggcuguuauuaccuagaguuuacucccaggccagggggcugccaucuucu

SEQ ID NO: 133155 - RNA, 64 nt, Human
cugcucacuuagggagcuguagggcaagaaguguuacucccauuuuucuaauuagaaaaaggcu

SEQ ID NO: 133156 - RNA, 64 nt, Human
ccugccagaaucucggcacuuggggggagaccuuuacucccaguuuggugaccaugcuguaguc

SEQ ID NO: 133157 - RNA, 64 nt, Human
guacauuuaaaauaugcauuauuuaauuuaaucuuacucccagcaccaaaagguaauugaccag

SEQ ID NO: 133158 - RNA, 64 nt, Human
uuuuuccugccucaauaucuugauauguuauguuuacucccaaucucccauuuuuaccacuaaa

SEQ ID NO: 133159 - RNA, 64 nt, Human
gaagccucagggaaaggccugcccccccagcacauacucccauaguguccuagguccagccgac

SEQ ID NO: 133160 - RNA, 64 nt, Human
caggccguuucucauacuacaggauauuuacuauuacucccaggaucagcagaagauugcguag

SEQ ID NO: 133161 - RNA, 64 nt, Human
accucacaacagucuugugaggcccuuauauaauuacucccauuuugcagaugaaguaacugag

SEQ ID NO: 133162 - RNA, 64 nt, Human
aaagcccuggccuuaaagaauguuacuuaguagcuacucccaaauugucagccuucuuaccugg

SEQ ID NO: 133163 - RNA, 64 nt, Human
cuccagaaacgucuucuuaauccccaccuuuucuuacucccaaaaaagaaugaacaccccugac

SEQ ID NO: 133164 - RNA, 64 nt, Human
ccccucugccccuuccuucucucuucuuggucucuacucccagggggaggggggaacuuacucu

SEQ ID NO: 133165 - RNA, 64 nt, Human
uccuucuugaggggcugccuggcccgcuccauccuacucccacuaacuacaccucagggcgggu

SEQ ID NO: 133166 - RNA, 64 nt, Human
gccugcgcucugcccugcccugccuagccucugcuacucccacuucccaacuccagggaaugca

SEQ ID NO: 133167 - RNA, 64 nt, Human
ggugaauggggaagggucuguuccagccucucccuacucccaucccauuuccaccaacugggga

SEQ ID NO: 133168 - RNA, 64 nt, Human
gaaacuuaaaauccagguuguugaaaagacuuuguacucccacuuccuccaaauccauacagug

SEQ ID NO: 133169 - RNA, 64 nt, Human
uuucucucucccucucccacaccucacacacacauacucccacuugcaacuauucuguuucucu

SEQ ID NO: 133170 - RNA, 64 nt, Human
ugccagccuucuuccuugcucugcgcugggaucauacucccaaaucacauuacuaaaugccaac

SEQ ID NO: 133171 - RNA, 64 nt, Human
acacugggcuaggcugcaacuuuaucucauuuaauacucccagcugucaugugagaaagaaagc

SEQ ID NO: 133172 - RNA, 64 nt, Human
guuuguuucuauucuagggauaacugcucaugauuacucccauauauuucuaguauuucccucu

SEQ ID NO: 133173 - RNA, 64 nt, Human
auguccacuuuacaaaagaaaacagcauugugauuacucccagggaccguauuuuaucuucagu

SEQ ID NO: 133174 - RNA, 64 nt, Human
gaugugugguagucaccaauuucugugguguaaauacucccaccaugguugauuucaagccacc

SEQ ID NO: 133175 - RNA, 64 nt, Human
gcugauuauacuugaguggaauccuuuccucacguacucccacagacgucugggccuggaaauu

SEQ ID NO: 133176 - RNA, 64 nt, Human
gaaacuugacuaaaauuuauuugauuuguuguuuuacucccacuuggaauccugagguagaaga

SEQ ID NO: 133177 - RNA, 64 nt, Human
gauuucuggagugucuguuauucaaugauguauauacucccacagcucgcaugaaggaacagcc

SEQ ID NO: 133178 - RNA, 64 nt, Human
aaaguccucaccuacuggcaaaaacaagauguucuacucccagguugacuuuuucaagccccaa

SEQ ID NO: 133179 - RNA, 64 nt, Human
gagcuaccuguaagcccugguaucuccccaucccuacucccagccccuucucccaggguccaga

SEQ ID NO: 133180 - RNA, 64 nt, Human
cauaguaagucugacuauggcagucagacuuacuuacucccauuuucccuucgauauaugacuu

SEQ ID NO: 133181 - RNA, 64 nt, Human
uggcucccacccauauaucccuccuuuaccauaguacucccacccacuuccaucacccauccaa

SEQ ID NO: 133182 - RNA, 64 nt, Human
uuaccagugcaggaagucucauaaaacucagauguacucccacaaaaauuuuauuggccuuuuu

SEQ ID NO: 133183 - RNA, 64 nt, Human
gggcacagcacaucccaggugcacccuccccaaguacucccaccccgccuacuguccaugcggc

SEQ ID NO: 133184 - RNA, 64 nt, Human
ugcccaggggggugccagggcuuugcuuggaggcuacucccaagccuacgggacugucugccac

SEQ ID NO: 133185 - RNA, 64 nt, Human
auaauuuacuuuuuuuuacuuuuauaaugcauuuuacucccaguauuauguucauuuaauaaau

SEQ ID NO: 133186 - RNA, 64 nt, Human
uuaagauagcaccauuguuuaaauaccgccuauguacucccaaaugaauaaaacauaauucuug

SEQ ID NO: 133187 - RNA, 64 nt, Human
uccagcaagcagugcccucuggacagcuugacucuacucccagcgcuggcuccaggcuccucau

SEQ ID NO: 133188 - RNA, 64 nt, Human
ggugaaacugaggagaaaaguuaaucaaccagguuacucccacaguuugcccguguguuaugua

SEQ ID NO: 133189 - RNA, 64 nt, Human
aggagguggaccacccuggcugaaaugacacaccuacucccaggaacagcagagguggaggcaa

SEQ ID NO: 133190 - RNA, 64 nt, Human
agcaacaagccaauauucaaauccagaugauuuuuacucccaaggacaauaaauccaacucaau

SEQ ID NO: 133191 - RNA, 64 nt, Human
agccagggagggauggaccccgaaaggagaaaaguacucccaggaaacagacgcgugaaaacug

SEQ ID NO: 133192 - RNA, 64 nt, Human
accaggcgugguggcgggcacuuguaaucccagcuacucccaaggcugaggcaggagaauugcu

SEQ ID NO: 133193 - RNA, 64 nt, Human
ccaucccucccccaaccccuguauccccaccccguacucccaccccucccacaaccccuguacc

SEQ ID NO: 133194 - RNA, 64 nt, Human
cccugcaaccaacuacaaccaagcucucugcaucuacucccaaguaugggguucaagagaguaa

SEQ ID NO: 133195 - RNA, 64 nt, Human
ucugcuuucucuguacuguauaggcaacauguuguacucccaguagcaacuagaucucuuuuac

SEQ ID NO: 133196 - RNA, 64 nt, Human
uauacagucuaucaaauuugcccccuggcuuuauuacucccaauugaauuaucuaccucauuuu

SEQ ID NO: 133197 - RNA, 64 nt, Human
ucggccccacagcacgucugcaccagcgggccguuacucccaugccguucuucuguguaauauu

SEQ ID NO: 133198 - RNA, 64 nt, Human
ucuguuuuccucccccaugaacuagaaaaccacuuacucccagaauucaggucgugcuuguuag

SEQ ID NO: 133199 - RNA, 64 nt, Human
agaggggcaccugccccccgcccuccccauccccuacucccacugcucagcgcgggccauugca

SEQ ID NO: 133200 - RNA, 64 nt, Human
cugcccgucagagaagugcacagccugggccagauacucccacaggugggugagugcuccuaau

SEQ ID NO: 133201 - RNA, 64 nt, Human
ucuguguccccacccaaaucucaucuugaauguguacucccauaauucccacauuuuauaggag

SEQ ID NO: 133202 - RNA, 64 nt, Human
cggaauugucaaugaggagaacuucaagcagauuuacucccaguucuuuccucaaggaggugag

SEQ ID NO: 133203 - RNA, 64 nt, Human
auacaaccccccacccuucuccgccauucuucccuacucccaacccacucugccuucuuuuuca

SEQ ID NO: 133204 - RNA, 64 nt, Human
aacuguagguuauaaggcagucacuuuuucucucuacucccacccacaccugccucccucuuac

SEQ ID NO: 133205 - RNA, 64 nt, Human
aaaggggggggcaagggaggggcuuugugauaacuacucccagcuucuucugaucauuucaaaa

SEQ ID NO: 133206 - RNA, 64 nt, Human
gcugaauccguuauuaacuuguuauuuagguuuuuacucccaguagcaagggauucuaaguuag

SEQ ID NO: 133207 - RNA, 64 nt, Human
uacagcguuuacaaccuugugagcaaggugguguuacucccauuagguagaugagaaaacaggc

SEQ ID NO: 133208 - RNA, 64 nt, Human
uacaaaaauagcugggcaugguggcacgcaccucuacucccagcuacuaggaggcugaggcagg

SEQ ID NO: 133209 - RNA, 64 nt, Human
gcacaugcauaguggcaucagcagcuuccuggccuacucccaaucacacugugcccugcaccuc

SEQ ID NO: 133210 - RNA, 64 nt, Human
acucaccaggcuuugcagcccugggcucugucucuacucccagggaccugcuggaaggcuggag

SEQ ID NO: 133211 - RNA, 64 nt, Human
uucuagcauaucuuuaagaaaauugauuguuauuuacucccagauccucuugcagacccagaau

SEQ ID NO: 133212 - RNA, 64 nt, Human
aagcuggggacagagaagguucugagcugucccauacucccacuuugugccaaaugacuuugca

SEQ ID NO: 133213 - RNA, 64 nt, Human
caauuaauuauccccucuuacacacaaacacacauacucccacauacuuacccacauguacaca

SEQ ID NO: 133214 - RNA, 64 nt, Human
ugcuacaaagcccaggcaugguggugcacaccuguacucccagcuacucgggugguuuacacag

SEQ ID NO: 133215 - RNA, 64 nt, Human
ucaagaugagggcuuguaaaauauagcuggucccuacucccagaguuuccauuucaggaggucu

SEQ ID NO: 133216 - RNA, 64 nt, Human
acagcucucuccacaaccucuugggcccaagugauacucccaccucugccuuacaaaauacagg

SEQ ID NO: 133217 - RNA, 64 nt, Human
auuaaaaaauuagccaggcaugguggcacaugccuacucccagcucccaaggagacugagaugg

SEQ ID NO: 133218 - RNA, 64 nt, Human
uuaaaauugaauucauucugaugcuugacccccauacucccaaccuuguccaguggagcccaac

SEQ ID NO: 133219 - RNA, 64 nt, Human
ucuucaaugcucaagugaagucacaucuaccuauuacucccagcauugauugacuauaagaaag

SEQ ID NO: 133220 - RNA, 64 nt, Human
guuccuucccagccccaucccuccccacccuuccuacucccagcuuucaagaaacauugcagaa

SEQ ID NO: 133221 - RNA, 64 nt, Human
augaaugaaugaacaaggggugccaggagacugcuacucccaguccuucccagaaacugccuag

SEQ ID NO: 133222 - RNA, 64 nt, Human
gcgggcaaugaagccuuaguaaaacggugaaaaguacucccagacggacgcgggcacccgucau

SEQ ID NO: 133223 - RNA, 64 nt, Human
ucaggccucauggaaggugagacaguaaagacauuacucccauaaaaaugugaggagagagacu

SEQ ID NO: 133224 - RNA, 64 nt, Human
gguuauagcugcuuucagauuguuccauuaucuguacucccaacaacccugccggauauauuug

SEQ ID NO: 133225 - RNA, 64 nt, Human
ccucucagucauucaucaauguggccagcuuaucuacucccaauuauguuguugauacaucucc

SEQ ID NO: 133226 - RNA, 64 nt, Human
uuuuuuaauguggguuuucuguuuccuuuuggccuacucccaagaagauauugguaagcuauug

SEQ ID NO: 133227 - RNA, 64 nt, Human
aaagauaguauuuccaaacuguuauauacccaucuacucccaacauggauauaaguuuuuuaaa

SEQ ID NO: 133228 - RNA, 64 nt, Human
gguaaauucugauccaauauucaauucauuuguguacucccacaugcaaaaugcuaaauuacaa

SEQ ID NO: 133229 - RNA, 64 nt, Human
uaguuugaaccuucacagcaacccaaugagguaauacucccauuucacauauaauacugagaga

SEQ ID NO: 133230 - RNA, 64 nt, Human
acuuuucuauuuuucucugaagcuuuacaggacauacucccacucccauuuuuuucuaagccua

SEQ ID NO: 133231 - RNA, 64 nt, Human
acuuuuagcuuaggaagucuuccagaauacaaacuacucccaguuagauaucagugaguuugaa

SEQ ID NO: 133232 - RNA, 64 nt, Human
ucaccggaaccagcguggugacugugucacagauuacucccauucagacgucucuggccuaugu

SEQ ID NO: 133233 - RNA, 64 nt, Human
cggcaacaacuuugaaaaacuugcucucuuucaauacucccaaugaagauacauuucacucacc

SEQ ID NO: 133234 - RNA, 64 nt, Human
aagcauuucaggccaguguggugucuugcgccuguacucccagcacuuugggaggccgaggcag

SEQ ID NO: 133235 - RNA, 64 nt, Human
gggagcauggaugcuggcaucuuagaacccucccuacucccauaccuccuccucuucugggcuc

SEQ ID NO: 133236 - RNA, 64 nt, Human
auuauacugucaaccuacuguugcuaugguuauauacucccacuucauacauuaccaagagucg

SEQ ID NO: 133237 - RNA, 64 nt, Human
aaaaaaccuauuuuuuuuuccacuguccuuccacuacucccauaacaaacuuauccaugguugg

SEQ ID NO: 133238 - RNA, 64 nt, Human
uuaucaguacauuuuaaauaggggcauugaaauuuacucccaccaccagggcuuuuuuggggga

SEQ ID NO: 133239 - RNA, 64 nt, Human
ccaggccgaguucaggccacugcuagcuuucucauacucccacaggcuagaccagagaugccaa

SEQ ID NO: 133240 - RNA, 64 nt, Human
ccugggccgugccugcccuccaccuugagugccauacucccaacagcuccagguacccaccggg

SEQ ID NO: 133241 - RNA, 64 nt, Human
guaucaacuggccaggcaggguggcucacgccuguacucccagcauuuugugaggccaaggugg

SEQ ID NO: 133242 - RNA, 64 nt, Human
acugucuagaacuuaaguuugaucugucagccaguacucccauuaaauucaguguaguuucacu

SEQ ID NO: 133243 - RNA, 64 nt, Human
uucugauccuaguuccaccaucaagccaccaacauacucccaucugugaaaggaaagagggagg

SEQ ID NO: 133244 - RNA, 64 nt, Human
aucugagaccagcgucuuccaucucucagagccuuacucccaaaguaccugcucacuguuccgu

SEQ ID NO: 133245 - RNA, 64 nt, Human
gugaagucucuggguggaagugugugccaagagcuacucccacagcagccccaggagaaggggc

SEQ ID NO: 133246 - RNA, 64 nt, Human
ucaucuuccacuuuauuggcaguugacauucccuuacucccaaucaacacucuuaaauauuugu

SEQ ID NO: 133247 - RNA, 64 nt, Human
gcucugcccucgugcuuugcuggccccugcccgcuacucccacucucagacacccagggguggu

SEQ ID NO: 133248 - RNA, 64 nt, Human
ggccccucuacucauccaacucccucuucacugguacucccaaucaaucaaagaaccucaaaau

SEQ ID NO: 133249 - RNA, 64 nt, Human
aucagcuuuucaccucuccaguuuuuccaagugauacucccaguucuagagcaaucuacagcug

SEQ ID NO: 133250 - RNA, 64 nt, Human
cccaauaauauuuccaccggggaugcaucauuuuuacucccaauauucuguagagagggaguca

SEQ ID NO: 133251 - RNA, 64 nt, Human
aaaguacucacuaguaaauauuuccuucucucuuuacucccacuuuuuacguuugcaggugcca

SEQ ID NO: 133252 - RNA, 64 nt, Human
gaagcggcuggaaucagucagccgcucaccuaucuacucccacuuuucggagacagugacuggu

SEQ ID NO: 133253 - RNA, 64 nt, Human
cauggcaguggccucagccuuaaacuuuuguuccuacucccacccucagcgaacugggcagcac

SEQ ID NO: 133254 - RNA, 64 nt, Human
acuucaaucccaaaguuugaaucugcagauaccuuacucccagccacuuugccuucuuacugug

SEQ ID NO: 133255 - RNA, 64 nt, Human
ccccaggaauaaaugguuuucuuggcuuccuccuuacucccaucuggacccaguccccugguuc

SEQ ID NO: 133256 - RNA, 64 nt, Human
cgcuuauuuggccaagccugauggcucgugccuguacucccagcacuuugggaggcugaggugg

SEQ ID NO: 133257 - RNA, 61 nt, Human
ccucggaguugcagcugugacacucauagguuacucccaggagugugcugagcagaaggca

SEQ ID NO: 133258 - RNA, 64 nt, Human
augacuagcuuaaguguacuugacucccauagacuacucccaugcccacagucacccauuccag

SEQ ID NO: 133259 - RNA, 64 nt, Human
aucgcuauauucaagauaaugaaccuaucuaucauacucccaaauuccuucuugcaucuuugua

SEQ ID NO: 133260 - RNA, 64 nt, Human
uuuuagaacucuucauguuaaagacgugguuuaguacucccaaugcuguguaucaugacacuau

SEQ ID NO: 133261 - RNA, 64 nt, Human
aauauacagccugcagagagugcguggcaauccuuacucccagccgacugugcgccaagaugcu

SEQ ID NO: 133262 - RNA, 64 nt, Human
ugcagaguuguauuuacuuguuucuguacucaccuacucccaccccaagggaaaauuuuagaca

SEQ ID NO: 133263 - RNA, 64 nt, Human
gaggcugaggcuagggcuggggacagauaucuuguacucccagugaccucaauaaaguacuuuu

SEQ ID NO: 133264 - RNA, 64 nt, Human
aggugguaaagacacuuguggggugagucaucccuacucccaacaucuggaggggaaaggugag

SEQ ID NO: 133265 - RNA, 64 nt, Human
uggaaacugaaaggugacgugcaaaacugccuauuacucccaggaguggaggauaauuucauau

SEQ ID NO: 133266 - RNA, 64 nt, Human
cguccccguucccccgaaaccuggcucagugcaauacucccauugccaugggguccuucaccau

SEQ ID NO: 133267 - RNA, 64 nt, Human
uaaguuccaccagugccucccucccuccuuccucuacucccaccccucccauguccccccauuc

SEQ ID NO: 133268 - RNA, 64 nt, Human
agcccucgaucauugaggccccauuauuaacagauacucccauaauaacccccaaauacagacc

SEQ ID NO: 133269 - RNA, 64 nt, Human
acaaaaauuagccaggugugguggugcaucccuauacucccagcaacucagggggcugaggugg

SEQ ID NO: 133270 - RNA, 64 nt, Human
uucaauccaacaugggacggacacugacagacaguacucccagcaggcccaggccagccagggc

SEQ ID NO: 133271 - RNA, 64 nt, Human
ccagcaccauccgccagggcccacacccccuuccuacucccagacacccacccucgcuucagcc

SEQ ID NO: 133272 - RNA, 64 nt, Human
aauaagcucccagggccugucucaagcucuuccuuacucccaggcacugucuuaaggcaucuga

SEQ ID NO: 133273 - RNA, 64 nt, Human
ggagaagaggcuauauuucaaaggaauugagacauacucccaucuauaaacauguuugguuuuc

SEQ ID NO: 133274 - RNA, 64 nt, Human
ggaucugugccagggagucacacugaccaccuccuacucccaccccuuguagugcucccacccc

SEQ ID NO: 133275 - RNA, 64 nt, Human
ggucugugcaaggccugucacacugaccaccuccuacucccacccccuguagugcucccacccc

SEQ ID NO: 133276 - RNA, 64 nt, Human
auuuauuacuguuugauuuucuuguaucugguucuacucccaggaugaaauuauccaacuacau

SEQ ID NO: 133277 - RNA, 64 nt, Human
aaacgccacggagcucacgcaggacccggccgccuacucccagcugguggccgugcuggucuac

SEQ ID NO: 133278 - RNA, 64 nt, Human
ugugugugugccaguuuuucuugucucagguagauacucccacuguguauaaauagaucuacag

SEQ ID NO: 133279 - RNA, 64 nt, Human
cacuuagccacuugagaaccagacaguaagguguuacucccagguuuguuuuuccaaaguaaca

SEQ ID NO: 133280 - RNA, 64 nt, Human
acucaugcagcaguccuacaacaccuucaaguacuacucccacuuucucuucaaaggugaggcc

SEQ ID NO: 133281 - RNA, 64 nt, Human
uauugccuuuuacuguacguucuacacucuguccuacucccacagaauuuucaagcccuuaaga

SEQ ID NO: 133282 - RNA, 64 nt, Human
cuuuauuuucagcaaugaaacugaaauuuagccuuacucccaaguuauaaaugcuggcaacaaa

SEQ ID NO: 133283 - RNA, 64 nt, Human
ugucugaaggaccauaucuuacagaaggugcacauacucccaagggccacucuugcccuggaga

SEQ ID NO: 133284 - RNA, 64 nt, Human
ugauuguggugggguggggauccuugggaagaauuacucccaagaguaacucucauuaucuccu

SEQ ID NO: 133285 - RNA, 64 nt, Human
ugggggcccuggaucccggccaccagggggcuccuacucccacccccaccacccccagucacca

SEQ ID NO: 133286 - RNA, 64 nt, Human
uuuuuaaugugagguuuucuguuucuuuuuugccuacucccaagaagauauugguaagcuauag

SEQ ID NO: 133287 - RNA, 53 nt, Human
ugaaccagccugggcccugagcucggucgcacacucacuucucuuccuuggga

SEQ ID NO: 133288 - RNA, 64 nt, Human
ugcaacccaacagcagugcagugugauaacugagcggucgcauggcagaggacaucccccucag

SEQ ID NO: 133289 - RNA, 64 nt, Human
gaugcgaggaugcagggacgcgcgacgccggccccggucgcagccgacgacgccgccgccagcc

SEQ ID NO: 133290 - RNA, 64 nt, Human
gggcacuguguuacacucugagguguuggcggggcggucgcagacuucaggguccccuaacgga

SEQ ID NO: 133291 - RNA, 64 nt, Human
auuucacuucaaaaauaagcccuguagcucuuuacggucgcauaguaugaaauuauacccugca

SEQ ID NO: 133292 - RNA, 64 nt, Human
gcccuccccaccgcuccgcuccgggagccauccccggucgcaggaguccggggagggccgggag

SEQ ID NO: 133293 - RNA, 64 nt, Human; identical to SEQ ID NO: 115531

SEQ ID NO: 133294 - RNA, 64 nt, Human; identical to SEQ ID NO: 115532

SEQ ID NO: 133295 - RNA, 64 nt, Human; identical to SEQ ID NO: 115533

SEQ ID NO: 133296 - RNA, 64 nt, Human; identical to SEQ ID NO: 115534

SEQ ID NO: 133297 - RNA, 64 nt, Human; identical to SEQ ID NO: 115535

SEQ ID NO: 133298 - RNA, 64 nt, Human; identical to SEQ ID NO: 115536

SEQ ID NO: 133299 - RNA, 64 nt, Human; identical to SEQ ID NO: 115537

SEQ ID NO: 133300 - RNA, 64 nt, Human; identical to SEQ ID NO: 115538

SEQ ID NO: 133301 - RNA, 64 nt, Human; identical to SEQ ID NO: 115539

SEQ ID NO: 133302 - RNA, 64 nt, Human; identical to SEQ ID NO: 115540

SEQ ID NO: 133303 - RNA, 64 nt, Human; identical to SEQ ID NO: 115541

SEQ ID NO: 133304 - RNA, 64 nt, Human; identical to SEQ ID NO: 115542

SEQ ID NO: 133305 - RNA, 64 nt, Human; identical to SEQ ID NO: 115543

SEQ ID NO: 133306 - RNA, 64 nt, Human; identical to SEQ ID NO: 115544

SEQ ID NO: 133307 - RNA, 64 nt, Human; identical to SEQ ID NO: 115545

SEQ ID NO: 133308 - RNA, 64 nt, Human; identical to SEQ ID NO: 115546

SEQ ID NO: 133309 - RNA, 64 nt, Human; identical to SEQ ID NO: 115547

SEQ ID NO: 133310 - RNA, 64 nt, Human; identical to SEQ ID NO: 115548

SEQ ID NO: 133311 - RNA, 64 nt, Human; identical to SEQ ID NO: 115549

SEQ ID NO: 133312 - RNA, 64 nt, Human; identical to SEQ ID NO: 115550

SEQ ID NO: 133313 - RNA, 64 nt, Human; identical to SEQ ID NO: 115551

SEQ ID NO: 133314 - RNA, 64 nt, Human; identical to SEQ ID NO: 115552

SEQ ID NO: 133315 - RNA, 64 nt, Human; identical to SEQ ID NO: 115553

SEQ ID NO: 133316 - RNA, 64 nt, Human; identical to SEQ ID NO: 115536

SEQ ID NO: 133317 - RNA, 64 nt, Human; identical to SEQ ID NO: 115555

SEQ ID NO: 133318 - RNA, 64 nt, Human; identical to SEQ ID NO: 115536

SEQ ID NO: 133319 - RNA, 64 nt, Human; identical to SEQ ID NO: 115557

SEQ ID NO: 133320 - RNA, 64 nt, Human; identical to SEQ ID NO: 115558

SEQ ID NO: 133321 - RNA, 64 nt, Human; identical to SEQ ID NO: 115559

SEQ ID NO: 133322 - RNA, 64 nt, Human; identical to SEQ ID NO: 115560

SEQ ID NO: 133323 - RNA, 64 nt, Human; identical to SEQ ID NO: 115561

SEQ ID NO: 133324 - RNA, 64 nt, Human; identical to SEQ ID NO: 115562

SEQ ID NO: 133325 - RNA, 64 nt, Human; identical to SEQ ID NO: 115563

SEQ ID NO: 133326 - RNA, 64 nt, Human; identical to SEQ ID NO: 115564

SEQ ID NO: 133327 - RNA, 64 nt, Human; identical to SEQ ID NO: 115565

SEQ ID NO: 133328 - RNA, 64 nt, Human; identical to SEQ ID NO: 115566

SEQ ID NO: 133329 - RNA, 64 nt, Human; identical to SEQ ID NO: 115567

SEQ ID NO: 133330 - RNA, 64 nt, Human; identical to SEQ ID NO: 115568

SEQ ID NO: 133331 - RNA, 64 nt, Human; identical to SEQ ID NO: 115569

SEQ ID NO: 133332 - RNA, 64 nt, Human; identical to SEQ ID NO: 115570

SEQ ID NO: 133333 - RNA, 64 nt, Human; identical to SEQ ID NO: 115571

SEQ ID NO: 133334 - RNA, 64 nt, Human; identical to SEQ ID NO: 115572

SEQ ID NO: 133335 - RNA, 57 nt, Human; identical to SEQ ID NO: 115573

SEQ ID NO: 133336 - RNA, 64 nt, Human; identical to SEQ ID NO: 115574

SEQ ID NO: 133337 - RNA, 64 nt, Human; identical to SEQ ID NO: 115575

SEQ ID NO: 133338 - RNA, 64 nt, Human; identical to SEQ ID NO: 115576

SEQ ID NO: 133339 - RNA, 64 nt, Human; identical to SEQ ID NO: 115577

SEQ ID NO: 133340 - RNA, 64 nt, Human; identical to SEQ ID NO: 115578

SEQ ID NO: 133341 - RNA, 64 nt, Human; identical to SEQ ID NO: 115579

SEQ ID NO: 133342 - RNA, 64 nt, Human; identical to SEQ ID NO: 115580

SEQ ID NO: 133343 - RNA, 64 nt, Human; identical to SEQ ID NO: 115581

SEQ ID NO: 133344 - RNA, 64 nt, Human; identical to SEQ ID NO: 115582

SEQ ID NO: 133345 - RNA, 64 nt, Human; identical to SEQ ID NO: 115583

SEQ ID NO: 133346 - RNA, 64 nt, Human; identical to SEQ ID NO: 115584

SEQ ID NO: 133347 - RNA, 64 nt, Human; identical to SEQ ID NO: 115585

SEQ ID NO: 133348 - RNA, 64 nt, Human; identical to SEQ ID NO: 115586

SEQ ID NO: 133349 - RNA, 64 nt, Human; identical to SEQ ID NO: 115587

SEQ ID NO: 133350 - RNA, 64 nt, Human; identical to SEQ ID NO: 115588

SEQ ID NO: 133351 - RNA, 64 nt, Human; identical to SEQ ID NO: 115589

SEQ ID NO: 133352 - RNA, 64 nt, Human; identical to SEQ ID NO: 115590

SEQ ID NO: 133353 - RNA, 64 nt, Human; identical to SEQ ID NO: 115591

SEQ ID NO: 133354 - RNA, 64 nt, Human; identical to SEQ ID NO: 115592

SEQ ID NO: 133355 - RNA, 64 nt, Human
gucaggcgccugggaaggggccuuugguggccacccuggugaggacaccugucccccagggcag

SEQ ID NO: 133356 - RNA, 64 nt, Human
uggucaucugacagucucuacacugugaauauugccuggugaucaagacucuccucaaagaaau

SEQ ID NO: 133357 - RNA, 64 nt, Human
uccaugguucaggguaacagaagggccuguaggcccuggugaacugaauccagcacaggccucc

SEQ ID NO: 133358 - RNA, 64 nt, Human
uguuguuguuguuguucacuugugguucuacauuccuggugaaugaugaauguugcugucaaag

SEQ ID NO: 133359 - RNA, 64 nt, Human
ccaggaccugaagggagcaaggauggccucagggccuggugaagucugcuacucuguccuuacu

SEQ ID NO: 133360 - RNA, 64 nt, Human
aaucuggucuuacuuucaugcuguuaugauuucaccuggugaaucaguguuuuaaauaagaaag

SEQ ID NO: 133361 - RNA, 64 nt, Human
ugacucgccuccagugaguccauaccccagguuuccuggugaguuccaagccuuuggaagccag

SEQ ID NO: 133362 - RNA, 64 nt, Human
ucauuaacaccacuucuuuucaucuguaccacacccuggugaaaccuuugaagacauaaaaaaa

SEQ ID NO: 133363 - RNA, 64 nt, Human
gcuaaaauucucccggccucauccuuacguguucccuggugacuuuuccuacuacuuccugcug

SEQ ID NO: 133364 - RNA, 63 nt, Human
cugucuuggggauguuuccccugucagcaaguaaccuggugaagucuauugaaggccagacug

SEQ ID NO: 133365 - RNA, 64 nt, Human
uuagcccuguuggcccugacaggaagggaggaagccuggugaauuuagugagcagcuggccugg

SEQ ID NO: 133366 - RNA, 64 nt, Human
uccugcagacagauagugggguuaccuggcaaggccuggugagagccagugaaccuaagcuuug

SEQ ID NO: 133367 - RNA, 64 nt, Human
ggcaggcuuuggggcuggacgcuguccaggcauuccuggugaggggaaggggacccugucaucc

SEQ ID NO: 133368 - RNA, 64 nt, Human
aaugcaaaguacauguauuuuuaauauaugcaucccuggugaaggaucuugccugcaugaaaca

SEQ ID NO: 133369 - RNA, 64 nt, Human
uguugagauugucaccauccuucaagcugagacuccuggugagccuuugccaccaugaaaacca

SEQ ID NO: 133370 - RNA, 64 nt, Human
caggaagcuggaaggaggaagggaggguaaguggccuggugaguggagguagaaaaaugaugag

SEQ ID NO: 133371 - RNA, 64 nt, Human
ugcagcaagccgagauugugccacuguacuccagccuggugacagagcgagacucccucucaaa

SEQ ID NO: 133372 - RNA, 64 nt, Human
gcaggaagggacgaugagcaagucugccacaccaccuggugacugggaagggcugcuucucucg

SEQ ID NO: 133373 - RNA, 64 nt, Human
gaguaugggccaugggccccuguagagcugcuuaccuggugaugaccaugcaccuuacaauuuc

SEQ ID NO: 133374 - RNA, 64 nt, Human
cucacccgugcauauguugaccuuugcaaaaugaccuggugacauggcaagucaguggggacag

SEQ ID NO: 133375 - RNA, 64 nt, Human
gggaaaaaaagaaauuuuacuuucucucaccuuaccuggugauaaguuccaaauauguuaaggg

SEQ ID NO: 133376 - RNA, 64 nt, Human
ucuccggagcaucucagcaagcaaggccucaccaccuggugaccugcagaauccuaagcgagcc

SEQ ID NO: 133377 - RNA, 64 nt, Human
uccaccaggacugcugcugggcacugagcugccgccuggugaagggggcgcccagggcgcaugg

SEQ ID NO: 133378 - RNA, 64 nt, Human
ccuuccaaggucaagccaugugucugaugacauuccuggugaagcaaaggagaggaggaugggu

SEQ ID NO: 133379 - RNA, 64 nt, Human
uguuaggaaugagaaucucaggucucauuccagaccuggugagccagagucuaaauuuuaagau

SEQ ID NO: 133380 - RNA, 64 nt, Human
ugcagugagcagagaucacaacauugcacuucagccuggugacaugagcaaaacuguugucuca

SEQ ID NO: 133381 - RNA, 64 nt, Human
guucuaucuguucauuugucuggguauagucacuccuggugaugauaugggcugaaaugucucc

SEQ ID NO: 133382 - RNA, 64 nt, Human
agcuggacccauuugccaggauuggcacaagcucccuggugagggagccucguccaaggcaguu

SEQ ID NO: 133383 - RNA, 64 nt, Human
ggccuuuucugugggcccuggccagacaggguuaccuggugaggugcagagagucccucuagug

SEQ ID NO: 133384 - RNA, 64 nt, Human
guuuguccuugcaggacagggugcaggcagaugaccuggugaagaugcucuucagcccagaaga

SEQ ID NO: 133385 - RNA, 64 nt, Human
cagcagcugaacauuccuggugagcaaagguuucccuggugaauuuuucaccacugcguuuuag

SEQ ID NO: 133386 - RNA, 64 nt, Human
guggcucuagaucacuguucagcagcugaacauuccuggugagcaaagguuucccuggugaauu

SEQ ID NO: 133387 - RNA, 64 nt, Human
uuccugccuuccccaucauucccucugccuaggcccuggugaaaccacagguaugcaauuaugc

SEQ ID NO: 133388 - RNA, 64 nt, Human
guuucauuucucucucucucuccauuccccucugccuggugagccuuccccuggugucugccug

SEQ ID NO: 133389 - RNA, 64 nt, Human
gcuucucuuugcuauucuuucauauccucuugggccuggugauuaauuagcaauucucauuccu

SEQ ID NO: 133390 - RNA, 64 nt, Human
augcugcacgucuguacccuucucagaucaacucccuggugauguuucuuccacauacaucugu

SEQ ID NO: 133391 - RNA, 64 nt, Human
uacucuccuccugguucuuucuaaucuuaaacuuccuggugagcauugccccagccacacuuuc

SEQ ID NO: 133392 - RNA, 64 nt, Human
uucaagguaacuguacugggccauguugugccucccuggugagagggccgggcagaggggcaga

SEQ ID NO: 133393 - RNA, 64 nt, Human
ccuuucuccaucccacuaccuccuggguccaaagccuggugagagcauagggccuucuggggug

SEQ ID NO: 133394 - RNA, 64 nt, Human
ccagucauagucuucuuuucaaauguuuugaacaccuggugauuuaauaaaguggucgucucac

SEQ ID NO: 133395 - RNA, 64 nt, Human
gcugcugaggaauggaaucaaaagaacguagucuccuggugaccaccucagaucucuauuauua

SEQ ID NO: 133396 - RNA, 64 nt, Human
uucccuugccccaggccaccuccucccccucccaccuggugaccagaaggcgcucucgguucuu

SEQ ID NO: 133397 - RNA, 64 nt, Human
uguuccccccaugggugagaggccugggcaacugccuggugaaugugucuugcggcagcugcag

SEQ ID NO: 133398 - RNA, 64 nt, Human
uacccagaaaucuagaacucugccgacagccucuccuggugagucgggacucagcugaggacac

SEQ ID NO: 133399 - RNA, 64 nt, Human
caugacaguggccuuuugggaacccaaguuacguccuggugaaagcagaaaggaggagacagga

SEQ ID NO: 133400 - RNA, 64 nt, Human
gacaaucuuccagaaguggucaggcagaaggugcccuggugagagcuccuuuacagggacuuua

SEQ ID NO: 133401 - RNA, 64 nt, Human
ggauuugcugugcucagcccagggcugauaggucccuggugaagcccaggguggggggugucag

SEQ ID NO: 133402 - RNA, 64 nt, Human
cgcaagcagucuccauguguguguaaacugcuguccuggugacuugucccucuucuuaguggaa

SEQ ID NO: 133403 - RNA, 64 nt, Human
auggcuucggagggccgcagggcccaccuuggacccuggugaccuccugucacucacugaggcc

SEQ ID NO: 133404 - RNA, 64 nt, Human
gccgccccuggccacaucgcccucuccucuuacaccuggugaccuucgaauguuucagagcgca

SEQ ID NO: 133405 - RNA, 64 nt, Human
aaggggcccgggaacaccugcucucaccugagccccuggugaaggggcccggaacacuugcucu

SEQ ID NO: 133406 - RNA, 64 nt, Human
aaagaaaagcaaaacugaccauaaaaaacaauuaccuggugagaaguugcauaaacagaauuag

SEQ ID NO: 133407 - RNA, 64 nt, Human
auuaaagugccuucagccaagaccaucucucccuccuggugaagugugacuucgaauuaguuug

SEQ ID NO: 133408 - RNA, 64 nt, Human
uacacagauacugaaaauucuccacugcauggacccuggugaguggcuuccccagacggagcac

SEQ ID NO: 133409 - RNA, 64 nt, Human
aaacugauuauaccaguauaaaagcuacuuugcuccuggugagagcuuaaaagaaaugggcugu

SEQ ID NO: 133410 - RNA, 64 nt, Human
uguuucugucaagucuucccuuggccuggguccuccuggugagucauuggagcuaugaagggga

SEQ ID NO: 133411 - RNA, 64 nt, Human
cuccuguuucagguuugcuucccuucucagugacccuggugagcauccgccuuuccuguucuug

SEQ ID NO: 133412 - RNA, 64 nt, Human
gcaaagggagacaaggaaacgggcacagcgaaauccuggugaagagcaaagcagaagaaaugac

SEQ ID NO: 133413 - RNA, 64 nt, Human
ccuguggcugcaaggaacccagggacccuuguugccuggugaaccugcagggaggguaugauug

SEQ ID NO: 133414 - RNA, 64 nt, Human
uccagggccccccaaaaccccgguggcacaaaaaccuggugaggccucccccuucccaagucca

SEQ ID NO: 133415 - RNA, 64 nt, Human
ucuccaucgccagagcaggacugcugaccccaggccuggugauucugggccccuccuccauacc

SEQ ID NO: 133416 - RNA, 64 nt, Human
ucucccugagucuaaggggaagauucucaaguccccuggugauuuccaaguggagcugagcagu

SEQ ID NO: 133417 - RNA, 64 nt, Human
guggacugaacacacugaagcucugaugggaaaaccuggugacugauauaguuguucagcaaua

SEQ ID NO: 133418 - RNA, 64 nt, Human
gugccccagagacaggagcacaagugggaucugaccuggugagauuauuucugaugaccucauc

SEQ ID NO: 133419 - RNA, 64 nt, Human
ucccaccuuaaagaaguuccccuuauguggguugccuggugaauggccuuccuucccgccagag

SEQ ID NO: 133420 - RNA, 64 nt, Human
cagcacuaguuaggggaggucagguggucaauguccuggugauuuuaugagacugccccacuga

SEQ ID NO: 133421 - RNA, 64 nt, Human
gggucuggaacaggaggagaaagggugucugcugccuggugaggcccacggacuucugagagcc

SEQ ID NO: 133422 - RNA, 64 nt, Human
cucgucaaauaauuauguauacugucuguugcugccuggugauucauaaccaccagcuuaauuu

SEQ ID NO: 133423 - RNA, 64 nt, Human
gcagcagcccccacccccaagcuuggugcugagcccuggugaggagcugagggggauggguugc

SEQ ID NO: 133424 - RNA, 64 nt, Human
auuauuauuuuauuaaaggggucugggcucacugccuggugaaguuucaaguguucagcagacc

SEQ ID NO: 133425 - RNA, 64 nt, Human
gcagugugccaagaucauaccacugcacuccagcccuggugacagaggagaccccgucucaaaa

SEQ ID NO: 133426 - RNA, 64 nt, Human
ugcagugagccaagaucgugccacugcacuccagccuggugacagagugagacucuguuucaaa

SEQ ID NO: 133427 - RNA, 64 nt, Human
uggggcugcugcuauuuaagccaagaacugagguccuggugagagcguuggacccaggcuuggc

SEQ ID NO: 133428 - RNA, 64 nt, Human
auguuccuacuguggcccagcugcccagcauggaccuggugacucuccacagggccucuaccau

SEQ ID NO: 133429 - RNA, 58 nt, Human
aaagggaggaggccagcugaguaggcagccuggugagggggggcaggggaugggcagg

SEQ ID NO: 133430 - RNA, 64 nt, Human
aaauugguucagggugauaacuacuuagcacugcccuggugauuacccagagauaucuaugaaa

SEQ ID NO: 133431 - RNA, 64 nt, Human
gaauuuuuccuuuuuguauuuucuuagcagagcuccuggugauguagaguauaaaacaguugua

SEQ ID NO: 133432 - RNA, 64 nt, Human
ugugccaggcacuuccuuuuaucgguucauuuaaccuggugacuggcucuuaucacuucuaguu

SEQ ID NO: 133433 - RNA, 64 nt, Human
auaacaugugucauguccuuuggaaaccuggucaccuggugaaaacccuugggauucuucccug

SEQ ID NO: 133434 - RNA, 64 nt, Human
gucauguagagguuguaguagaauggcuuuucacccuggugacuuuggaagaaacucuugaaua

SEQ ID NO: 133435 - RNA, 64 nt, Human
ucuucugugucuucagcgcccagcccugcguguuccuggugaagcaguuucacaucagucucuc

SEQ ID NO: 133436 - RNA, 64 nt, Human
ugcagugagcugagaucacaccacugcacuccagccuggugacagagcaagacuccggcucuua

SEQ ID NO: 133437 - RNA, 64 nt, Human
ggaggaucgcuugagcccaggaguucaagaccaaccuggugaaaccccgucucuacaaaaaaac

SEQ ID NO: 133438 - RNA, 64 nt, Human
gcgcccacaugggcaugagacagucugcacugcgccuggugaaaugcguguguguacagacagu

SEQ ID NO: 133439 - RNA, 64 nt, Human
ggugcaauggaagacacuacgcuacuugguugagccuggugaagaauguauuaaugagacugcu

SEQ ID NO: 133440 - RNA, 64 nt, Human
uccuuguggucauagaugcaaagagaugugucauccuggugaaugucccuuuaacugcaaccag

SEQ ID NO: 133441 - RNA, 64 nt, Human
uggagcuagagcggugccggcagcaagcaggccuccuggugaccggagagaaagaggagcccuc

SEQ ID NO: 133442 - RNA, 64 nt, Human
acuauguuucacauuugugaauuagguauggccaccuggugaauucaguuguuaagcaauauau

SEQ ID NO: 133443 - RNA, 64 nt, Human
cggcuuuggcuuuuccaauuuuccaucuuuaggcccuggugagaggcacacuuaugcacuaaaa

SEQ ID NO: 133444 - RNA, 64 nt, Human
aaucgcuaauagaaccaagaauucuagaaaauuuccuggugauucugaugcagccuguccacua

SEQ ID NO: 133445 - RNA, 64 nt, Human
uuaucaaaucucacagacaucaggcaaauuauagccuggugacaaaaguguucauagugaauua

SEQ ID NO: 133446 - RNA, 64 nt, Human
cuuccuucuugccagcucucccaacauacccaauccuggugaucagggaacuaaaagucugagg

SEQ ID NO: 133447 - RNA, 64 nt, Human
ccccacccccaccccccuuauuuuccuuuugucuccuggugauuaggccaaagucugggaguaa

SEQ ID NO: 133448 - RNA, 64 nt, Human
ugaagacaacugccagauacuggcaauacuccagccuggugacagagugagacucugucucaaa

SEQ ID NO: 133449 - RNA, 64 nt, Human
ccauuguagcucuuuuuuuuuuuuuuuccccuuuccuggugauugauuuuacaaaagaaaguaa

SEQ ID NO: 133450 - RNA, 64 nt, Human
gugcucgugcuggcccugggugggagcggggaguccuggugagaccccggugagauggaccauc

SEQ ID NO: 133451 - RNA, 64 nt, Human
gccugggcaaggccaagaaccaugcagaagccuuccuggugagguggccgugaagccgaagcag

SEQ ID NO: 133452 - RNA, 64 nt, Human
agugauagguuuguuccaugggacuuaucauaggccuggugauucuugaaagagcauuuuucau

SEQ ID NO: 133453 - RNA, 64 nt, Human
aggggccaugcagcuggcguagguggcaguugggccuggugaggguuaggacuucagaaaccag

SEQ ID NO: 133454 - RNA, 64 nt, Human
gccgcucuuccuuaggccugggcuguuuggaaguccuggugaaacuuugcgguucacauuuuaa

SEQ ID NO: 133455 - RNA, 64 nt, Human
uuuucaaagaacaguuaacuuggugcuaaugugcccuggugaaauaaauaaaagaugggcaguu

SEQ ID NO: 133456 - RNA, 64 nt, Human
cagugccauggccacuuagggcugggaacccgaaccuggugacuuugaaaggauagagcuucau

SEQ ID NO: 133457 - RNA, 64 nt, Human
cucagccccauguuguucuuuguuauugucagaaccuggugaguuguuuugaacagaacuguuu

SEQ ID NO: 133458 - RNA, 64 nt, Human
cccagcccagugcagucccggcuguguuuuccuaccuggugaucagaagugucugguuugcuug

SEQ ID NO: 133459 - RNA, 64 nt, Human
agcuugauggaguugggacagccaugugggacccccuggugauucagcaugaaggaaaugaagc

SEQ ID NO: 133460 - RNA, 64 nt, Human
uggagaccccuggggccguggggucucaggggugccuggugaauucugcacuuacacguacuca

SEQ ID NO: 133461 - RNA, 64 nt, Human
gcuccacaggucuucaugggcagggguuguggguccuggugaaggaagugcauccucaggccug

SEQ ID NO: 133462 - RNA, 64 nt, Human
uuccuuucagaauggaaaaauggcccucuucaagccuggugaggaaaugcuucagaugaggcuc

SEQ ID NO: 133463 - RNA, 64 nt, Human
acccgugucuaaacccuccucucacuccccuaagccuggugaaagagucagaagccccaggcuc

SEQ ID NO: 133464 - RNA, 64 nt, Human
guguccaugccacccccggcauggcuccagguggccuggugacuccaugauggacgaucuugcu

SEQ ID NO: 133465 - RNA, 64 nt, Human
gaaucacccaucugguuuggagcuagaguugcuuccuggugagagaggaagcaacucuccuucu

SEQ ID NO: 133466 - RNA, 64 nt, Human
acaaacaucacaguucccaugcuuuguaauaacaccuggugaaaaaguuagauauucuagacuu

SEQ ID NO: 133467 - RNA, 64 nt, Human
accuugucauguauacagucauuuaugccuaaagccuggugauuauucauuuaaaugaagauca

SEQ ID NO: 133468 - RNA, 64 nt, Human
uugcuggaaaugcaggcucaagccccuccccacaccuggugaaugagagagccccagccugacc

SEQ ID NO: 133469 - RNA, 64 nt, Human
caggaaacuuaauucccuggugacuagagcuuugccuggugaugaggaguauuuuguggcauaa

SEQ ID NO: 133470 - RNA, 64 nt, Human
ggugggggcugucuguguccaggaaacuuaauucccuggugacuagagcuuugccuggugauga

SEQ ID NO: 133471 - RNA, 64 nt, Human
caccguguuagccaggauggucucgaucuccuaaccuggugauccgcccgccucggccucccaa

SEQ ID NO: 133472 - RNA, 64 nt, Human
guuccucagcaggaaugagugucuuuguguaucaccuggugacuugucagugucugugucugug

SEQ ID NO: 133473 - RNA, 64 nt, Human
uagaagucuuuaguacaaaacugcucuagggacaccuggugauuccuacacaagugauguuuau

SEQ ID NO: 133474 - RNA, 64 nt, Human
ggaaggagagaaugauuuugcugacuucccaagcccuggugaccagaccaaggcagggcccagc

SEQ ID NO: 133475 - RNA, 64 nt, Human
cucccuucaggcccgcugcccuaggauaugcccuccuggugacucgggggcugucucagacgac

SEQ ID NO: 133476 - RNA, 64 nt, Human
cucacuccccucugcaaauaccugcauuucuuacccuggugagaaaagcacaagcgguguaggc

SEQ ID NO: 133477 - RNA, 64 nt, Human
gcuuacugcugcauggcugucugcaugaaccacgccuggugaaggagccugggugagaaacacc

SEQ ID NO: 133478 - RNA, 64 nt, Human
uacagccacagaagaugucauguacuguauauuaccuggugauaguugcuuuucaccccccgag

SEQ ID NO: 133479 - RNA, 64 nt, Human
agggaugacauuuaccuaugugugcugccucauuccuggugaagcaacugcuacuuguucucua

SEQ ID NO: 133480 - RNA, 64 nt, Human
auccgcaaccagcgccgacaccaugcccccucuuccuggugacacccucaacaaccaggauuug

SEQ ID NO: 133481 - RNA, 64 nt, Human
caccguguuagccaggauggucucgaucuccugaccuggugauccacccaccuuggccucccaa

SEQ ID NO: 133482 - RNA, 64 nt, Human
ugagaguaauucaucugugaaucugcuuuaauuaccuggugaguaacuuagaaaagugguguaa

SEQ ID NO: 133483 - RNA, 64 nt, Human
cuuacugacaccagggguccgcugccccauguguccuggugagaaaauauaugccuggcacagc

SEQ ID NO: 133484 - RNA, 64 nt, Human
aucagcaaccauuguuguuaugaucugcagucuuccuggugacacuggaaucucucucucugcc

SEQ ID NO: 133485 - RNA, 64 nt, Human
cagacucagccugucaccccaaaugcagcaauggccuggugauucccacacauccuuccugcau

SEQ ID NO: 133486 - RNA, 64 nt, Human
gaauggggcgugggggguuagagcaggaccacagccuggugaguccccgggcagccguccugca

SEQ ID NO: 133487 - RNA, 64 nt, Human
gugccgggaggagcugagcccccggaggugggcuccuggugacggguguccaagaagcgguuuc

SEQ ID NO: 133488 - RNA, 60 nt, Human
ccuucaaugcagaauauugagguugaaucuccuggugagauuauacaggagauucucuuu

SEQ ID NO: 133489 - RNA, 64 nt, Human
ccgugcuaggaauuccaggaaagugcauuccugcccuggugaccuuuuccuaugucuaggcucc

SEQ ID NO: 133490 - RNA, 64 nt, Human
gccuaucccucucagauaggugggguaggauuuuccuggugaccgaguaaagugagaggcaggu

SEQ ID NO: 133491 - RNA, 64 nt, Human
cacaaaagaugugcaaaugcccuucagcacaggaccuggugacaugacauaaacuccaagacag

SEQ ID NO: 133492 - RNA, 64 nt, Human
ucuuggagcagccagaccauguuuccaagagaaaccuggugauauugccagcagacccccugcc

SEQ ID NO: 133493 - RNA, 64 nt, Human
ugcagugagccgagaucgcaccacugcacuccagccuggugacagagcaaaaaaaaaaaaauug

SEQ ID NO: 133494 - RNA, 64 nt, Human
ggccugcccggcguggugggaggggagcugguuuccuggugaacuuucuaaaaggaaaaauaau

SEQ ID NO: 133495 - RNA, 64 nt, Human
aaggacgggcccccuacggagaugaaauuuguuuccuggugagcacagaaucagaacaaagaac

SEQ ID NO: 133496 - RNA, 64 nt, Human
ccugguagaggggccggcuguuuccugacagaugccuggugagcaggggaagcaggacccagug

SEQ ID NO: 133497 - RNA, 64 nt, Human
agccccaggccagcugcggccaggccugcgggccccuggugaugggguuacguggggugcggga

SEQ ID NO: 133498 - RNA, 64 nt, Human
aaaaccuuucuguaggcugagaccucucggugcaccuggugacccuggguggaggggacuugcu

SEQ ID NO: 133499 - RNA, 64 nt, Human
ugugucacaauguaacaagacucuagcuggguccccuggugaugaguuucagcauagaauaaug

SEQ ID NO: 133500 - RNA, 64 nt, Human
agaucuauuuaaauauaagaguagcaauacugcaccuggugaucacaaagauaauguucuacuu

SEQ ID NO: 133501 - RNA, 64 nt, Human
gcaccaugaggcagcacugagcacgguagggcagccuggugagaggggccuagcucgcugccga

SEQ ID NO: 133502 - RNA, 64 nt, Human
ugcucacugaugggcccucccaggcccgucaagcccuggugaaggagcuuagcuugucuucuug

SEQ ID NO: 133503 - RNA, 64 nt, Human
cugcaacugagccacccacucccaaacaggaaacccuggugaagguucaggaagcacggagauu

SEQ ID NO: 133504 - RNA, 64 nt, Human
ggaugcuaggacugagacccuggguggugcagcgccuggugaucuugcugugugccugugccug

SEQ ID NO: 133505 - RNA, 64 nt, Human
uaccuccauuccacuugugacacccccucgacucccuggugacgcuccucccagaucgcucuac

SEQ ID NO: 133506 - RNA, 64 nt, Human
aaaaagaggagauuaaccucuuguuuuuuuaccaccuggugaaucagccauaacgcacacacac

SEQ ID NO: 133507 - RNA, 64 nt, Human
aucagcgccggccuccagaacuuagcaauuuccgccuggugaugcgcaguugcugucagucuug

SEQ ID NO: 133508 - RNA, 64 nt, Human
uuuucaucaaagacucagguaccuauuauuguucccuggugaaacugaggagaaaaguuaauca

SEQ ID NO: 133509 - RNA, 64 nt, Human
acucagaugugcagguguuaaucuucucuaaaagccuggugauacagcucuggcuuucugagca

SEQ ID NO: 133510 - RNA, 64 nt, Human
gacagcucuaauuacgaauugaacacauuaaacaccuggugaaauuaucaauuaaaaacaucua

SEQ ID NO: 133511 - RNA, 64 nt, Human
aaccaccauauuauaucacucccaauagcacugaccuggugaucaaaaacacuugagaagacau

SEQ ID NO: 133512 - RNA, 64 nt, Human
gguagagagcaguagaaaucuuguucuaacugugccuggugagagacuuuggcccccucccucc

SEQ ID NO: 133513 - RNA, 64 nt, Human
ccaaggcugucgccugcaccuucgccagggagcaccuggugagucugccggcgguggccuggga

SEQ ID NO: 133514 - RNA, 64 nt, Human
ggcugggacaagccagcugccccaggguucuuccccuggugauucucgccugcuuucucaucuc

SEQ ID NO: 133515 - RNA, 64 nt, Human
uggauuuugugcaagcuaauuuggccacauuuggccuggugacagaacuguucauaaggaagua

SEQ ID NO: 133516 - RNA, 64 nt, Human
uagaaaugucuaauaguucucuauaguccuuguuccuggugaaccacaguuaggguguuuuguu

SEQ ID NO: 133517 - RNA, 64 nt, Human
ucccugucccccaggggagacgguaguacacgggccuggugaggcaacagcuguggaguggggg

SEQ ID NO: 133518 - RNA, 64 nt, Human
ccaggagguccuuuccgcucuccuaagagccacaccuggugaauacucaguaaacauuugcgga

SEQ ID NO: 133519 - RNA, 64 nt, Human
ccuugucucucaugcggaagaggcauucgaguuaccuggugagagaccguguugcccccuccca

SEQ ID NO: 133520 - RNA, 64 nt, Human
cgucccugccucccgugggcccuguccggguugcccuggugaccccagccucuguccacuuccu

SEQ ID NO: 133521 - RNA, 64 nt, Human
ccccagcccaguuacugcagggcagcuuuccccaccuggugacaggcugugcgcagcagcccca

SEQ ID NO: 133522 - RNA, 64 nt, Human
ucagggaucccugguggauggggaaaagcacuuuccuggugauggaaaaacguucucagcuuua

SEQ ID NO: 133523 - RNA, 64 nt, Human
gucuggaacagcaggaaggguugaugcuuacugaccuggugauguuagaagacaaguaguuuau

SEQ ID NO: 133524 - RNA, 64 nt, Human
uucuugaguucacgguucaauauugccuccucgcccuggugaggggaggugcugcuuuucugcc

SEQ ID NO: 133525 - RNA, 64 nt, Human
acagaggaaggaggcggggauggggucguggcgcccuggugaugcgacuccuguuuauuuugcu

SEQ ID NO: 133526 - RNA, 64 nt, Human
uuugagacgguaggaaagcaacaaaacgugggaaccuggugacuaagggccuggugcaaggacu

SEQ ID NO: 133527 - RNA, 64 nt, Human
cucauccagaacugucuuagucauaccauccaucccuggugaaagaguaaaaccaaagguuauu

SEQ ID NO: 133528 - RNA, 64 nt, Human
gagcagcgugucuuuccucggccgagucaggcuuccuggugagccucagggagugcauggucuc

SEQ ID NO: 133529 - RNA, 64 nt, Human
ugccccccagagaccccccccagacacugcagggccuggugaugcuguccucuguaccggaaau

SEQ ID NO: 133530 - RNA, 64 nt, Human
aggugggaucagaugcugcuccaaccaugcaguuccuggugagggucagaaggggacgguacca

SEQ ID NO: 133531 - RNA, 64 nt, Human
ugguucaacugugauuuggcuuucccgugucuuuccuggugaugccuuguuugggguucugugg

SEQ ID NO: 133532 - RNA, 64 nt, Human
guuuuagaaaaugaggccuguuuggggaagguacccuggugauguuuuugcuagacauuagcug

SEQ ID NO: 133533 - RNA, 64 nt, Human
ugagcagaggagggagggggagaaagggaggaagccuggugauuguggcaaagacuccuguccc

SEQ ID NO: 133534 - RNA, 64 nt, Human
aaauuucuaacuacuuuguaacugcauggcuuaaccuggugauaaaagcaguuauuaaaagucu

SEQ ID NO: 133535 - RNA, 64 nt, Human
cuaugucccuaagccaacaggguauaacacaggcccuggugauaaugaggguguccuaaagauc

SEQ ID NO: 133536 - RNA, 64 nt, Human
cauugaaugacaagcaucaguagcugagugcacuccuggugauccugguuuuccuugaccacug

SEQ ID NO: 133537 - RNA, 64 nt, Human
ccugaggucaggaguucaagagcagccuggccaaccuggugaaacccugucucuacuaaaaaua

SEQ ID NO: 133538 - RNA, 64 nt, Human
uuuggguagaagcccucaugcugagcuuugugucccuggugauguuggaacauuaaugauggaa

SEQ ID NO: 133539 - RNA, 64 nt, Human
ugcaaugagccaagauugggccacugcauuccagccuggugacagagcgagacugucucaaaaa

SEQ ID NO: 133540 - RNA, 64 nt, Human
aagugcauucacucugcuugccuugggcccagccccuggugaucacaggguucaaacagugucc

SEQ ID NO: 133541 - RNA, 64 nt, Human
caugccucccccguccuuuuucccuugccaguucccuggugacaguuaccagcuuuccugaaug

SEQ ID NO: 133542 - RNA, 64 nt, Human
gugccugauucggcugucucagacucuuuuuguaccuggugaccccuuuucagcuucugcuggg

SEQ ID NO: 133543 - RNA, 64 nt, Human
ccuaaggaaaaugucauaguaggugcugcuggccccuggugauccagcuucucugccaaucaug

SEQ ID NO: 133544 - RNA, 64 nt, Human
uuugcaggacucuaggcaugcaugaaagagccccccuggugaugcccuuggaugcugccaaguc

SEQ ID NO: 133545 - RNA, 64 nt, Human
cugccacaugaucggaccaucggcucuggggaauccuggugaauauagugcugcuauguugaca

SEQ ID NO: 133546 - RNA, 64 nt, Human
uacaacugguggaccacacaccaggcacuaaucaccuggugaggauuuggcauauccaccaaaa

SEQ ID NO: 133547 - RNA, 64 nt, Human
ugucagcugggaggcccaaggagaagagccugguccuggugaaggugagaccagagccucaagg

SEQ ID NO: 133548 - RNA, 64 nt, Human
cugacccuccccagggugccagugacuacuucucccuggugaguguaaaccgucccgcccugag

SEQ ID NO: 133549 - RNA, 64 nt, Human
cuccccugguccugcacugucccggagcucaggcccuggugaggggcugggucccgggugcccc

SEQ ID NO: 133550 - RNA, 64 nt, Human
cuuauucuuugggccuugagcagguuaguaguccccuggugagaagagaacauuuuguuugugg

SEQ ID NO: 133551 - RNA, 64 nt, Human
aggccauggcguugccagccucccugugacagagccuggugaacagugagccuggcucccacgc

SEQ ID NO: 133552 - RNA, 64 nt, Human
cauaggagcgaacacugcugcucucucgcuggccccuggugaggacaggaagccugaacccggg

SEQ ID NO: 133553 - RNA, 64 nt, Human
gagucuucaagaucccggagugguagcgcugucuccuggugaaggaguauuugucacacuggaa

SEQ ID NO: 133554 - RNA, 64 nt, Human
uacgugucugucaccggcaggcagcccuacaaauccuggugaccugcucucccaagaacagagc

SEQ ID NO: 133555 - RNA, 64 nt, Human
cuccuaaacugaggucagaccaccuaggcuuccaccuggugagcccuagcagggcugagacccc

SEQ ID NO: 133556 - RNA, 64 nt, Human
caccauguuggccaggcuggucucgaacuccugaccuggugauuugcccgccuuggccucccaa

SEQ ID NO: 133557 - RNA, 64 nt, Human
aauggggcagagggacacccuuugggcguggcuuccuggugaugggaagggucuuguguuuuaa

SEQ ID NO: 133558 - RNA, 64 nt, Human
gcuccuuccucuccccgccccuccucccuuugugccuggugauauauuuuuuuuuccucccuga

SEQ ID NO: 133559 - RNA, 64 nt, Human
aaccuccagauuccaccaacacggguccauucuuccuggugauggcagaggggcuucuuuuagc

SEQ ID NO: 133560 - RNA, 64 nt, Human
ugcucuggcagcugcaggguuccugucuggccucccuggugagcagaggggcggccacggcggg

SEQ ID NO: 133561 - RNA, 64 nt, Human
uggugcagcagauucccaacaguaaccuccuccuccuggugacagaccccaccugugacugcag

SEQ ID NO: 133562 - RNA, 64 nt, Human
cccugcauggccccagcaaugcagucacccagggccuggugauaucuguguccucucaccccuu

SEQ ID NO: 133563 - RNA, 64 nt, Human
ggauccuggaguucugguuccuacugggggcaacccuggugaccagcaccaucucuccuccuuu

SEQ ID NO: 133564 - RNA, 64 nt, Human
agggaaagaaggagagcugggguuuagcauucucccuggugaagauuggagguccaaagaaaug

SEQ ID NO: 133565 - RNA, 64 nt, Human
aggaggagggaaaaagugaaggagaggcuuuggaccuggugacagagugaucagaugacagagg

SEQ ID NO: 133566 - RNA, 64 nt, Human
cucuuggaguuugguagcuacuucuugauuugggccuggugacccaccuggaaugggaaggaug

SEQ ID NO: 133567 - RNA, 64 nt, Human
uccuuuucagaaccugaugcccaguagggguuguccuggugacaccccuccuuuuuccagugcc

SEQ ID NO: 133568 - RNA, 64 nt, Human
cgcugaggaaaauauauucaacugugaagaagacccuggugauaccuuucuaaaaagguggagu

SEQ ID NO: 133569 - RNA, 64 nt, Human
ucaguuaaacugaaguugccuuuaccuagcauucccuggugaaguguugcagguugugaacucu

SEQ ID NO: 133570 - RNA, 64 nt, Human
ccuacgaccacaaguacuugcaccgugugaucucccuggugagccaggagcccgugcuguucgc

SEQ ID NO: 133571 - RNA, 64 nt, Human
ccuccccagagccccgggggccgcagcccgcccuccuggugagcgcugggcagggcucguggug

SEQ ID NO: 133572 - RNA, 64 nt, Human
gaguuauuuucuuaacuugaaauuuucuacuagcccuggugaacuucugugcuuaaaaaaaaaa

SEQ ID NO: 133573 - RNA, 64 nt, Human
ucuugucucuucuguugauuuaaaaaugaucccuccuggugauaacccauuuuacagggaugaa

SEQ ID NO: 133574 - RNA, 64 nt, Human
agcacgaauuacucaaaaaguaagcaaaccaauaccuggugaaucuauggacagucauacacau

SEQ ID NO: 133575 - RNA, 64 nt, Human
acacucugccuaacuaucaaaggauuauagcaauccuggugauuuaggugcaucugucugugag

SEQ ID NO: 133576 - RNA, 64 nt, Human
ccaaguauuuaauauagcucucuuauggugguggccuggugauggggaccgucuuucuuuuacu

SEQ ID NO: 133577 - RNA, 64 nt, Human
ggccaccucuguuacuuacuguacuauggaagcuccuggugaauguuuacaauuaugggaugua

SEQ ID NO: 133578 - RNA, 64 nt, Human
caccauguuggccaggauggucucgaucucuugaccuggugaucugcccaccucggccugccaa

SEQ ID NO: 133579 - RNA, 64 nt, Human
gagaagaaucaucucugccaggucaacuggagucccuggugacuccauucugaggugucacaag

SEQ ID NO: 133580 - RNA, 64 nt, Human
gaagccccauauguaguauagagcaaagguggcuccuggugaagagaggguggaaaggcccuuc

SEQ ID NO: 133581 - RNA, 64 nt, Human
ccccucuucuccggcucccugccccuccagauugccuggugaucuauuuuguuuccuuuugugu

SEQ ID NO: 133582 - RNA, 64 nt, Human
ucuucucccuguccccucaugggucccggguuagccuggugacaggcagacacaugcuguuggc

SEQ ID NO: 133583 - RNA, 62 nt, Human
ccaugaagcacaaauguugagaaacugccuauccuggugacucuucuuaagagaaacugaag

SEQ ID NO: 133584 - RNA, 64 nt, Human
gaaagguuacugauaugacacuacaugugaucugccuggugaaggcuaucuggggcaggcacaa

SEQ ID NO: 133585 - RNA, 64 nt, Human
agcacuuacuguuuucagagcacccauaucccacccuggugagaaggccacucucacaucugag

SEQ ID NO: 133586 - RNA, 64 nt, Human
ucucaggacgucgguguucccaacuccaaggggaccuggugacagacgaggcugcaggcugccu

SEQ ID NO: 133587 - RNA, 64 nt, Human
aggaccgcagcaggcaggccccagcgccgagacuccuggugacagguggcaccugucccacagc

SEQ ID NO: 133588 - RNA, 62 nt, Human
gggagguccgcaucauaugacaaagaacugccccuggugaugugagcagggaccugccugcc

SEQ ID NO: 133589 - RNA, 64 nt, Human
cuaaucuuccacagacccacgaaaaccgagagcaccuggugaugauggagaagauccuagggcc

SEQ ID NO: 133590 - RNA, 64 nt, Human
uccucagggauccagacuuccucugcuggucuggccuggugacucucaggguaucuucuccuuc

SEQ ID NO: 133591 - RNA, 64 nt, Human
aggcaggcccugggagggaguuuagaaagacaguccuggugaaugggcuucaaguggucacaaa

SEQ ID NO: 133592 - RNA, 64 nt, Human
gcuuagugaucuaaacuggccccuuccuccucugccuggugaguuggccuaaacauuccucaag

SEQ ID NO: 133593 - RNA, 64 nt, Human
ugcaguaagcugagaucgugccacugcacuccagccuggugacagagugagacuccgucucaaa

SEQ ID NO: 133594 - RNA, 64 nt, Human
gaauaaaaggucaccucagacaccaggugucauuccuggugaggccugccucgucgguggccug

SEQ ID NO: 133595 - RNA, 64 nt, Human
cuaaaaauaugucuuaacuauucaucaaggaaagccuggugaagccuuuacuuguuacuacuuc

SEQ ID NO: 133596 - RNA, 64 nt, Human
caccaugcauuaagauuuauuuauuguauuuaaaccuggugagaggacaagugaggucugcuca

SEQ ID NO: 133597 - RNA, 64 nt, Human
gccagggacuuccaacuagauagccaugugacguccuggugacuugggggaaaaauuagugaug

SEQ ID NO: 133598 - RNA, 64 nt, Human
ccugggucucugcacugacucccccacuccugacccuggugauggucgccacugggcagcagca

SEQ ID NO: 133599 - RNA, 64 nt, Human
acuggcacccugccucucugugcccaggcccagcccuggugacauggcaccacucagcagugcu

SEQ ID NO: 133600 - RNA, 64 nt, Human
ggacuagcccccgcaggggccugcgccaccccguccuggugaauaaacgcacucccugugccuc

SEQ ID NO: 133601 - RNA, 64 nt, Human
uccugggccgcagauggcaaagggagugccugggccuggugacccagggcuggauccaccccug

SEQ ID NO: 133602 - RNA, 64 nt, Human
cugacccuccugcccgcauacacaacccauuuccccuggugagccacuuggcagcauauguagg

SEQ ID NO: 133603 - RNA, 64 nt, Human
cuccugaaguggaagcuggggccuuagacucugcccuggugacaccagcaauuaugacuuuguc

SEQ ID NO: 133604 - RNA, 64 nt, Human
guggaaagguagggaugaauuggggugauagaacccuggugaauucagaguaaucuuucuuuag

SEQ ID NO: 133605 - RNA, 64 nt, Human
ugcagcauugaccagaccauccgaaaccugcgucccuggugauguucucaagccucggaagugg

SEQ ID NO: 133606 - RNA, 64 nt, Human
cugagaaggcagagcagugucugugcugccagguccuggugaagcccaagguugaagggggcgg

SEQ ID NO: 133607 - RNA, 64 nt, Human
auaggcuuugccuccaggaugggcugcuccugggccuggugagcuacugcccccaaccuacccu

SEQ ID NO: 133608 - RNA, 64 nt, Human
cuuccucuccgggcugccaggcagccagguaaggccuggugaggccacuuggccucuugguugg

SEQ ID NO: 133609 - RNA, 64 nt, Human
uccugaauggcccguugucaucccaggggugacuccuggugaugggagucagcaguuucagauu

SEQ ID NO: 133610 - RNA, 64 nt, Human
ggucauuaagauguuaagucuuuugcggcagauuccuggugauuugaucaauaaagaguaauuu

SEQ ID NO: 133611 - RNA, 64 nt, Human
uuaaaaaccuaugcugguuugcuuuggaucacacccuggugaaccccgggugcuaagaaugaaa

SEQ ID NO: 133612 - RNA, 64 nt, Human
aggagccuagagugggaaaggcaccugggggagcccuggugaagggcuggaccugacccaugga

SEQ ID NO: 133613 - RNA, 64 nt, Human
gcccuacacccagccuggcccagggccggcuuugccuggugaggcuggagggagcaccaggacc

SEQ ID NO: 133614 - RNA, 64 nt, Human
gcaucgagaguacugacgaggcgaagauguccuuccuggugacucugaacaacguggaagucug

SEQ ID NO: 133615 - RNA, 64 nt, Human
ccacugccggggucccaggacccuucccccuucaccuggugacaggaacacuccuuuccuggua

SEQ ID NO: 133616 - RNA, 64 nt, Human
cuugaggucaggaguucaagaccagccuggccaaccuggugaaacccugucucuacuaaaaaug

SEQ ID NO: 133617 - RNA, 64 nt, Human
ggaggcaggggaugcauggguguccccaucugucccuggugagaagcaaggcuagcucugccuu

SEQ ID NO: 133618 - RNA, 64 nt, Human
gguuuauuuccaaaauaaauccccugacaaaaaaccuggugauguuaagcaauugacugucuua

SEQ ID NO: 133619 - RNA, 64 nt, Human
uuaucuggaugaugaaauaaucuguacaacaaacccuggugacaugcaauuuaccuauauagca

SEQ ID NO: 133620 - RNA, 64 nt, Human
aggggccuguugggguuugagucacugggaucuuccuggugagagguaagagaagucacugggc

SEQ ID NO: 133621 - RNA, 64 nt, Human
cucaggucccucaaaggccucggagcacccccuuccuggugacugagccagggccugcauuuuu

SEQ ID NO: 133622 - RNA, 64 nt, Human
gugccuuucuuuacucacaaggcaugggcuuuguccuggugaucaguuuguaagccuucuuccu

SEQ ID NO: 133623 - RNA, 64 nt, Human
ucugccuggcucccugucuucauucuccacgcagccuggugauggcaggccuggguuuggauuu

SEQ ID NO: 133624 - RNA, 64 nt, Human
ugucauacauccuagugaauguaaaaugcaaaauccuggugauguguuuuuuguuuuuguuuuc

SEQ ID NO: 133625 - RNA, 64 nt, Human
gaacauuugacuugaaccacaagugaaucuuucuccuggugacucaaauaaaaguauaauuuuu

SEQ ID NO: 133626 - RNA, 64 nt, Human
guguggauggggagaucggggccagaggcagaacccuggugaggaagcuccaguccugcucucu

SEQ ID NO: 133627 - RNA, 64 nt, Human
uccucuguggggcauuggauccucccacaguugcccuggugaugacuuagggcuucccaucugu

SEQ ID NO: 133628 - RNA, 64 nt, Human
augaccacuucucuucacacaucugcuuucagugccuggugaaaaauagaccuuggccuaacag

SEQ ID NO: 133629 - RNA, 64 nt, Human
ucuagggcgaaaauguccgaggagaacugcuggcccuggugaaggaccugccgagucagcuggc

SEQ ID NO: 133630 - RNA, 64 nt, Human
ccacaaccaccuucaccuggaugugcagccccuuccuggugacccugaucacccucugggugua

SEQ ID NO: 133631 - RNA, 64 nt, Human
cauauuucuguaacuuguauuuaaugaugguguaccuggugauuguaaaaauauuagacagaua

SEQ ID NO: 133632 - RNA, 64 nt, Human
ggggccgggggcucaggaggggcucucagggacuccuggugacuccaggaaaaugcugccaucg

SEQ ID NO: 133633 - RNA, 64 nt, Human
gaccuacuguggcgggagggaggggcggcugcugccuggugacggcacccggaggcccaccagg

SEQ ID NO: 133634 - RNA, 64 nt, Human
ugaagccaguccuggagcccauaccucaccccugccuggugaggaugucuuguuccugagggag

SEQ ID NO: 133635 - RNA, 64 nt, Human
auuuauuacccuccccucccacacccccaaucuaccuggugaugauuuuaaguuugcgcguguc

SEQ ID NO: 133636 - RNA, 64 nt, Human
gcugaggucaggaguucaagaccagccuggccaaccuggugaaaugcagugucaacuaaaaaua

SEQ ID NO: 133637 - RNA, 64 nt, Human
caccauguugaccaggcuggucucgaacuccugaccuggugaucugcccacccaggccucccaa

SEQ ID NO: 133638 - RNA, 64 nt, Human
gggaggcuuggguaggauugugggauaagaucgcccuggugacgaggagcggaucucgaacgga

SEQ ID NO: 133639 - RNA, 64 nt, Human
cugugggcuuggggaaccucucacguugcuguguccuggugagcagcccgaccaauaaaccugc

SEQ ID NO: 133640 - RNA, 64 nt, Human
ugagacccucuucucugggcccagagagaggcguccuggugaggacaagguacaggcaaggaug

SEQ ID NO: 133641 - RNA, 64 nt, Human
guagcucaaccaagcaguugugcugagaauggcaccuggugagagccugcugugugccaggcuu

SEQ ID NO: 133642 - RNA, 64 nt, Human
uucccgaggaacucgccucagccugaucaggcuuccuggugagaacugaggagcggacucacuu

SEQ ID NO: 133643 - RNA, 64 nt, Human
ccuuucuaacccucaguucuuggaggacaagauaccuggugauuuaaaauauuauuuuagucuu

SEQ ID NO: 133644 - RNA, 64 nt, Human
ucuuugccucuuugcagguucugacccagccaguccuggugacuggccucugccuuccaccgga

SEQ ID NO: 133645 - RNA, 64 nt, Human
ugacccaagagaacucaccuuauucuucauuucgccuggugaauccuccaggcccuucucuaca

SEQ ID NO: 133646 - RNA, 64 nt, Human
cuuugagugucuucccuucuagacuuucccaucuccuggugagauguuucccacuuaugccgug

SEQ ID NO: 133647 - RNA, 64 nt, Human
auggucacaccccccgcccaccccaggcgaggauccuggugacaugcuccucucccuggcuccg

SEQ ID NO: 133648 - RNA, 64 nt, Human
uccgucucuugccggugccguggugucguccgugccuggugagguuuugugcagcgguaaagug

SEQ ID NO: 133649 - RNA, 64 nt, Human
aagaaacaagaguauuacuuuuccuacaacagaaccuggugaaacuucagguauuguaucacaa

SEQ ID NO: 133650 - RNA, 64 nt, Human
agugcccucuccccucagccucuccccugccugcccuggugacaucagguuuuucccggacuua

SEQ ID NO: 133651 - RNA, 64 nt, Human
caccacauuggucaggcuggucucaaucucuugaccuggugaucugcccaccugggccucccaa

SEQ ID NO: 133652 - RNA, 64 nt, Human
cccgcgugcggggcgcgcggagccuucccuucgcccuggugaggcccugccauaaccaggcgcc

SEQ ID NO: 133653 - RNA, 64 nt, Human
gguggaucaccugaggucaggaguucaagaccagccuggugaacauggcgaaaccccgucucua

SEQ ID NO: 133654 - RNA, 64 nt, Human
ggcagucaaaugcccaggcagauagggguggguaccuggugaaacccaaccuuaaagcugaaga

SEQ ID NO: 133655 - RNA, 64 nt, Human
gcuucgugucccugcuggagaccaacaagccguaccuggugaacugcguccgcaucccugcccu

SEQ ID NO: 133656 - RNA, 64 nt, Human
uggguaaaugacuaggugguaagguucugccaugccuggugacccaccauggacauacuggacc

SEQ ID NO: 133657 - RNA, 64 nt, Human
ggccaugcaggaggggugggguagcugccuugucccuggugagggcaagggucacugucuucac

SEQ ID NO: 133658 - RNA, 64 nt, Human
gacuuugcagggagccuggacuccuguccagacaccuggugagagccugaggcugguguucagg

SEQ ID NO: 133659 - RNA, 64 nt, Human
ugagacccugucucuuaaaaaaaaaaaaaaaaauccuggugaugcuuuucuggauuaaaaaaua

SEQ ID NO: 133660 - RNA, 64 nt, Human
aaggcuacagcaggagcugaugacccucaugaugccuggugacaaaagaauuucugccuacccu

SEQ ID NO: 133661 - RNA, 64 nt, Human
gcucccuggagucggguccuggcaguggggacugccuggugaacacagaugugcuugggaugac

SEQ ID NO: 133662 - RNA, 64 nt, Human
caggugcccugccugaguugugugcauccaggggccuggugagcccccaggcugguggcauggc

SEQ ID NO: 133663 - RNA, 64 nt, Human
cuuauguuuagucaaacucucauuuaggugacagccuggugacuccagaauggagccagucaug

SEQ ID NO: 133664 - RNA, 64 nt, Human
ugggggcagccggugcagccccggggagcccuggccuggugaccucgccgcucuucuugaauca

SEQ ID NO: 133665 - RNA, 64 nt, Human
gcucugaguggggcggguggggccauaaacgguuccuggugacuccugagucuugccuggcccu

SEQ ID NO: 133666 - RNA, 64 nt, Human
cuggacuugcaaucccuuccugggucccaucuuaccuggugaccaccaucauuguuuuccccau

SEQ ID NO: 133667 - RNA, 64 nt, Human
accuacugcgaccacccaccucauccuggcucagccuggugauggagaagugcugauggucuug

SEQ ID NO: 133668 - RNA, 64 nt, Human
ugcagugagccgagauugcaccacugcacuccagccuggugacagagcgagacuccgucucaaa

SEQ ID NO: 133669 - RNA, 64 nt, Human
cagccagggucagagacagggcuugguucugcuuccuggugaagcauggcuucggggugcugcc

SEQ ID NO: 133670 - RNA, 64 nt, Human
cucagcauagacccagcucucugggggauggucaccuggugauuucaaugauggcauccaggaa

SEQ ID NO: 133671 - RNA, 64 nt, Human
agagaaaaaaaauuaagacaagccuggcaacacaccuggugaagaguaguuuacuagcuuuuca

SEQ ID NO: 133672 - RNA, 64 nt, Human
ugggcaaguuacuuaaucucucuggccucaauuuccuggugaauguggagaaaaauaauagugc

SEQ ID NO: 133673 - RNA, 64 nt, Human
aaaugcucugagggaacuggcuaagaauagugggccuggugauugucuaucacgcaaggcuuug

SEQ ID NO: 133674 - RNA, 64 nt, Human
cuuguuuuucaguuuccccaacacacagcagauaccuggugagcucagauagucucuuucucug

SEQ ID NO: 133675 - RNA, 64 nt, Human
cuccacuggcuccccccagcccccuaagagagcaccuggugaucacguggucacggcaaaggaa

SEQ ID NO: 133676 - RNA, 64 nt, Human
gaacaaaagcaaggaauugcugauuuggggggugccuggugaugaggaggggauggguuugucu

SEQ ID NO: 133677 - RNA, 64 nt, Human
uugccuaauuccuggcaugacacucuagugacuuccuggugaggcccagccuguccugguacag

SEQ ID NO: 133678 - RNA, 64 nt, Human
gucggucauggaguccggagccccugagccggccccuggugacggcacagcccucacagcucaa

SEQ ID NO: 133679 - RNA, 64 nt, Human
ggaucagugauggugguuucugaagccccaugucccuggugaaggaggacugaaccaaggacuc

SEQ ID NO: 133680 - RNA, 64 nt, Human
cugagugugggguucagggaagcucuuuaggccaccuggugaaggugcauggggaggauggagc

SEQ ID NO: 133681 - RNA, 64 nt, Human
ucccuugagaacuuccaagccuccggcaucuuuuccuggugaguguuucuccugugcuugguug

SEQ ID NO: 133682 - RNA, 64 nt, Human
cucuaggaccugaagaacucucgaaggacccagcccuggugagccaaggacaaccacacagaaa

SEQ ID NO: 133683 - RNA, 64 nt, Human
acaggugccacugccuccucaaaucacauuugugccuggugacuuccugucccugggacaguug

SEQ ID NO: 133684 - RNA, 64 nt, Human
gcauggcucugccucacaaugaugcagucagccaccuggugaagaagugaccugcgacacagga

SEQ ID NO: 133685 - RNA, 64 nt, Human
ugcagugagccgagaucacgccacugcacuccagccuggugacagcgugagacucuuuaaaaaa

SEQ ID NO: 133686 - RNA, 64 nt, Human
aaggaccccucgggcucagagcccuaaagugggcccuggugaagcagggugguccugcguccac

SEQ ID NO: 133687 - RNA, 64 nt, Human
uggcgucaagagcaguugacucacugaugaaggcccuggugaggagaaagcacucuguucuucg

SEQ ID NO: 133688 - RNA, 64 nt, Human
cauucgagugucccccaaccccgggcagguggcaccuggugacaccuccuucagucccacucag

SEQ ID NO: 133689 - RNA, 64 nt, Human
cucuacucuggaaguccccgggagccucuccuugccuggugaccuacuaaaaauauaaaaauua

SEQ ID NO: 133690 - RNA, 64 nt, Human
gguccaucuccagcagcugguccaacagucguauccuggugaaugucuguucagcucuucugug

SEQ ID NO: 133691 - RNA, 64 nt, Human
caggauguuaauggagcuggaaguucagaaaaagccuggugaagugacccuuggccuuucacuu

SEQ ID NO: 133692 - RNA, 64 nt, Human
cuguuccuacugaaggccuagcaccugcucuuggccuggugagccccuccaccuuccaggcuua

SEQ ID NO: 133693 - RNA, 64 nt, Human
uccguuuucuuccguugugaaugccgcguccuguccuggugacaggagaacaauguuggugaac

SEQ ID NO: 133694 - RNA, 64 nt, Human
cagggaggcaaggggcugcuuuccacuguggguaccuggugaucagggcaagcuguggagggcc

SEQ ID NO: 133695 - RNA, 64 nt, Human
cagguucaauguccuccgaagaaugaagucuuucccuggugaugguccccugcccugucuuucc

SEQ ID NO: 133696 - RNA, 64 nt, Human
aggggacugacguuaguucccuacuccauccuucccuggugauucuugaucuucaaagccucgg

SEQ ID NO: 133697 - RNA, 64 nt, Human
ugcagugagcuaagacugcaccacugcacuccagccuggugacagaacgagacucugucuuaaa

SEQ ID NO: 133698 - RNA, 64 nt, Human
ccuggucaggcugccuccuuaaucgagaaaacuaccuggugaugcaaucuuuuuuuuuuuuaau

SEQ ID NO: 133699 - RNA, 64 nt, Human
ccgguucgauguccuuccaagaaugaagucuuucccuggugaugguccccugcccugucuuucc

SEQ ID NO: 133700 - RNA, 64 nt, Human
ccgguuggauguccuuccaagaauggaauccuucccuggugauggucucucacccugucuuacc

SEQ ID NO: 133701 - RNA, 64 nt, Human
cagguuugauguccuuccaagaauaaagucuuucccuggugauggucucucgcucugucuuucc

SEQ ID NO: 133702 - RNA, 64 nt, Human
cuggggccccggguucagccuggccugcccgugcccuggugaaucaccuggcugagcaguuccc

SEQ ID NO: 133703 - RNA, 64 nt, Human
aggagcccgcggagcaugugcugagggaagucugccuggugaggcuggcaggugggagucuaau

SEQ ID NO: 133704 - RNA, 64 nt, Human
ucuugguucucccaggagcucagggccugucagaccuggugacaagugccaaaggccacaggca

SEQ ID NO: 133705 - RNA, 64 nt, Human
aaagucuuacugggcccuggggaagguauccuacccuggugaagcagcugcuuugcucuacaaa

SEQ ID NO: 133706 - RNA, 64 nt, Human
ugaucccugaacauaguuuucacccaagagcuguccuggugaccaaaaaagauuacuaggguuu

SEQ ID NO: 133707 - RNA, 64 nt, Human
uaguagacaacuguuauuacuugguucuugcugaccuggugaguuggggggcagggguugucuu

SEQ ID NO: 133708 - RNA, 64 nt, Human
cacccuccuuguagcuauuggggcuuaaugguuuccuggugauucuuaccaauccacaauaaac

SEQ ID NO: 133709 - RNA, 64 nt, Human
uuguuuaagcauaauuuaagaaaaaaaauuuuuaccuggugaacuugcuaucugcucuguuucu

SEQ ID NO: 133710 - RNA, 64 nt, Human
cauagucacacuggcacugaaaagaaagcguugcccuggugauucuuucccccccguuuguaau

SEQ ID NO: 133711 - RNA, 64 nt, Human
aaaacuacauuuuguaaggccacacauaagugaaaauacggaaggcuuuggaaacccccagaug

SEQ ID NO: 133712 - RNA, 64 nt, Human
uucucacugugcugcaaaucuuuauagccuuuacaauacggacuucuguguauauguuauacug

SEQ ID NO: 133713 - RNA, 64 nt, Human
uggaaaaaaaauuggaaaagaaaaacucaguuuaaauacggagacuauaaugauaacacugaau

SEQ ID NO: 133714 - RNA, 64 nt, Human
ugacucgccagcucauucucaccaaucgcuccccaauacggacccguuucucccucaaguuuga

SEQ ID NO: 133715 - RNA, 64 nt, Human
uguaccacaaaauuuuagguuaggcaaauucacaaauacggaauccaugaauaacgaggaucaa

SEQ ID NO: 133716 - RNA, 64 nt, Human
guaguuuuuaauacauugguuaggacucagaggaaauacggaaaaaacauuguagaugguuaau

SEQ ID NO: 133717 - RNA, 64 nt, Human
guggugguagaugcuaugaauuucuucauuguaaaauacggaucauuuguauuuuggggugaua

SEQ ID NO: 133718 - RNA, 64 nt, Human
aggugauguaggucuuucacagcuagcuuuggggaauacggaauacucaaauaaagugcuuugu

SEQ ID NO: 133719 - RNA, 64 nt, Human
aaauagaugacauuaaucugucuucacuguuuauaauacggauggauuuuuuuucaaaucagug

SEQ ID NO: 133720 - RNA, 64 nt, Human
ugaauuucuagguguuugggucacaguuccuacaaauacggaaaaggggguuaaaaagcagugc

SEQ ID NO: 133721 - RNA, 64 nt, Human
uuguuuuauaauugaguaguacaagcgaggaaaaaauacggaggauaaccacuauuuuugugca

SEQ ID NO: 133722 - RNA, 64 nt, Human
uauaaauuuagagugauuggugguauauuacggaaauacggaaccuuuagggauaguuccgugu

SEQ ID NO: 133723 - RNA, 64 nt, Human
gaacugcucaggauugauacauuucaagucuguaaauacggacaccaacgccauuuacccuaau

SEQ ID NO: 133724 - RNA, 64 nt, Human
ugaaacuacugaaaauccgagugaugauguugugaauacggaacaccuaaucacacagcuugcu

SEQ ID NO: 133725 - RNA, 64 nt, Human
uugacacaguuauuaguuaaaucaaauguucaaaaauacggagcagugccuaguaucuggagag

SEQ ID NO: 133726 - RNA, 64 nt, Human
uguggagagucaauuaaacaccuuuacucuuagaaauacggauucggcagccuucagugaauau

SEQ ID NO: 133727 - RNA, 64 nt, Human
uagggagguaucaaggagcauaauuaaacuugucaauacggaaaguuguuuuuucuaacacaac

SEQ ID NO: 133728 - RNA, 64 nt, Human
cuuuacaguaaaaaugacccaucuauggcugcuuaauacggacauugagggauccuuccccaga

SEQ ID NO: 133729 - RNA, 64 nt, Human
ucauuuuuucccaugagaugaagcacaugugacgaauacggacuagauaaccucuaagaauuuu

SEQ ID NO: 133730 - RNA, 64 nt, Human
uaauuuagagcuauaagaggaacuuauuuuuucuaauacggaagcauugccuaauaauuaagaa

SEQ ID NO: 133731 - RNA, 64 nt, Human
agggguuuaccuggaacauuaguaguuaccacagaauacggaagagcaggugacugugcugugc

SEQ ID NO: 133732 - RNA, 64 nt, Human
gggcaauuugguaaaaugcaucaaaagacuuaaaaauacggacguacuuugugcugggaacucu

SEQ ID NO: 133733 - RNA, 64 nt, Human
cauccucuagucaaauuuuuuuucauuguuuaaaaauacggaaguguuccaauauaauuuuuuc

SEQ ID NO: 133734 - RNA, 64 nt, Human
acauaucaaggugcuuuuggcacaggugcccacaaauacggaugcagugcugagauaguuuaug

SEQ ID NO: 133735 - RNA, 64 nt, Human
ggaggaggggaagauagucugaauggaaaucugaaauacggaauguuuuagagaaauaugucac

SEQ ID NO: 133736 - RNA, 64 nt, Human
aguaaaagcugccucauacauacugaguaaaauaaauacggaauuguauuuuuuuuguaaaggg

SEQ ID NO: 133737 - RNA, 64 nt, Human
accuggcucaaucaugucacacagcaguggaaagaauacggacucuuaagucacaccuaccacu

SEQ ID NO: 133738 - RNA, 64 nt, Human
ugaauuuuaauaacaaaauuuuaaaauuggcaugaauacggaauacugcacugugagaugcaaa

SEQ ID NO: 133739 - RNA, 64 nt, Human
ugagaaaaaacaaaccaaccugugugaauuuuagaauacggaacagaccuaugcucuaagcaaa

SEQ ID NO: 133740 - RNA, 64 nt, Human
aaacauuuuauuccuacuuucagaagaaaaauauaauacggaaaaaauuauagauuuacuugua

SEQ ID NO: 133741 - RNA, 64 nt, Human
guacaugggagggcuagccccgggacuuggggccaauacggaaacccuaccccuuccaugcuca

SEQ ID NO: 133742 - RNA, 64 nt, Human
guacacuacuuucauuuaaaggggaaaguuugauaauacggaauuaauuaauaugaaugagaug

SEQ ID NO: 133743 - RNA, 64 nt, Human
gcugcuuguguuucuuggggugacugucauugguaauacggacacagugacccauccuccaucc

SEQ ID NO: 133744 - RNA, 64 nt, Human
gauuaauuccaaucacucccuaaccaauagguacaauacggaaugaagaagaggggaaaauggg

SEQ ID NO: 133745 - RNA, 64 nt, Human
uuaguagcagaauuaacacaggguuuuaacuugcaauacggaaaagacauuucaguugagaaug

SEQ ID NO: 133746 - RNA, 64 nt, Human
cuuuggagcgggugggaguuguaagacaaaucaaaauacggaugacaaagaggauauagccgug

SEQ ID NO: 133747 - RNA, 64 nt, Human
uagcaacuuaaaguuggcaagucucaucuucaguaauacggaugccaugggaguggccaggcca

SEQ ID NO: 133748 - RNA, 64 nt, Human
gugggcaaucccaacaugaaauguagacagcgugaauacggacaggaggugaugccauauucac

SEQ ID NO: 133749 - RNA, 64 nt, Human
gugcucugaagaugugucacauuauauuauaaacaauacggaaggggagauaggugagaugaua

SEQ ID NO: 133750 - RNA, 64 nt, Human
ggagcaaugcccuuguaggauguggagaagggaaaauacggacauuaacauuaaaagacaccag

SEQ ID NO: 133751 - RNA, 64 nt, Human
acaaauagugcuaauaaaguuaaauugcacgugcaauacggaacacugucaauggacugcaccu

SEQ ID NO: 133752 - RNA, 64 nt, Human
uacggcccucacgauaaucaacggcuguuccuggaauacggauuuguuucuguccauaauccuc

SEQ ID NO: 133753 - RNA, 64 nt, Human
cacaugaguguuuguagaccauagaccauuaaaaaauacggaauucaaaaguuacaaaaagggu

SEQ ID NO: 133754 - RNA, 64 nt, Human
gauguggacaugcacccgcauguacaaaaacacaaauacggaaguaaaccugaacaaacccuuu

SEQ ID NO: 133755 - RNA, 64 nt, Human
cccgaccgagcaccagacugcagaaugaggcaauaauacggaccaacaagaagccgccuuauca

SEQ ID NO: 133756 - RNA, 64 nt, Human
uuuguaagggagcagacuuuuaaagacuugcacaaauacggauccugcacugacucuggaaaag

SEQ ID NO: 133757 - RNA, 64 nt, Human
uauucagaaguguguaccaaucaaggcucuuuaaaauacggaacgacucacuuaauaaccaggg

SEQ ID NO: 133758 - RNA, 64 nt, Human
gacaguagaaugcaaauaccucccuccccuaaacugacuggacggcugccaaggaggccccaaa

SEQ ID NO: 133759 - RNA, 64 nt, Human
cuguaugauuaauuccaucuguguuugucauuucugacuggaaaacuucuuacuccauaccuug

SEQ ID NO: 133760 - RNA, 64 nt, Human
cuuccucuaaaacccucucauauauagacagcuuugacuggaggguccauuuuucuuccaggau

SEQ ID NO: 133761 - RNA, 64 nt, Human
ccacaggggaagcuguccucaguuguagccgucuugacuggaugaguccuggcagucuuucuag

SEQ ID NO: 133762 - RNA, 64 nt, Human
aaaaugugauacaacauauacucacuauggaaucugacuggacaccuuggcuauuuguaagggg

SEQ ID NO: 133763 - RNA, 64 nt, Human
gcuguugacaugggauuugggaaaggugaagcugugacuggaggggcaggagaugguccaagug

SEQ ID NO: 133764 - RNA, 64 nt, Human
agaggccugagacggagaggugcauuucugcuggugacuggaggagggaccagaaugaggauac

SEQ ID NO: 133765 - RNA, 64 nt, Human
cccuggaaauagcugccucaugccacuuaggccaugacuggauuuaaugucaguggugugccac

SEQ ID NO: 133766 - RNA, 64 nt, Human
ccagucgggaggagcagcccggggaggaacugggugacuggaggccucgccccaacacuguccu

SEQ ID NO: 133767 - RNA, 64 nt, Human
gccuucauaagaugaccuauagagcaaagaaaggugacuggaaggguuccuaacccaaccuacu

SEQ ID NO: 133768 - RNA, 64 nt, Human
auucagucccaugcacuacacucuggaugguguaugacuggaugaauggguuucuauauauggg

SEQ ID NO: 133769 - RNA, 64 nt, Human
aauucuggaaucugaauauuaaaaccuuacuuagugacuggaaugguauaugcucccuccaaaa

SEQ ID NO: 133770 - RNA, 64 nt, Human
caucagucuuacuaggcauaaaagucacacuuaaugacuggaaaaaacuugcuuauugccuuuc

SEQ ID NO: 133771 - RNA, 64 nt, Human
gccaguccccucagccugugguggccuugcauccugacuggauguucucagccccuuguucugg

SEQ ID NO: 133772 - RNA, 64 nt, Human
ucugacccuggcugggugugugugcaaaucugugugacuggagcucuaggggcaucucuguguc

SEQ ID NO: 133773 - RNA, 64 nt, Human
cuucuggaagcugcauaugacuagaggccucuugugacuggagguaacaacccugcccaguaac

SEQ ID NO: 133774 - RNA, 64 nt, Human
gugcugcccagagcugugccuaguucauagaaacugacuggaagcacauugcugagggagguuu

SEQ ID NO: 133775 - RNA, 64 nt, Human
guuaugaagacuccaguggacuguacucacaaauugacuggacacccuaugaaaguggguagac

SEQ ID NO: 133776 - RNA, 64 nt, Human
agggcaggggaaaaucuuaggaugguuguacaauugacuggaggauuuuuuccccuuggaagac

SEQ ID NO: 133777 - RNA, 64 nt, Human
ugaguuguggagagauguaugauucaaacauagaugacuggauuccuguuccagaauugagaac

SEQ ID NO: 133778 - RNA, 64 nt, Human
ggcuagugccucagagagaacuguacgggguuugugacuggaaaaaguuacguucccauucuaa

SEQ ID NO: 133779 - RNA, 64 nt, Human
uuuacuuucaggaaaggauagaaguauagauuaaugacuggaaaguuuuaauauauuuagccca

SEQ ID NO: 133780 - RNA, 64 nt, Human
gggcucaguagcuucucugaguggcguuuuuagcugacuggaagugcuuaaucuggaucgucuu

SEQ ID NO: 133781 - RNA, 64 nt, Human
ucccucuccucucuccccagucucuagggcugccugacuggaggccuuccaaggggguuucagu

SEQ ID NO: 133782 - RNA, 64 nt, Human
accaguuuuaggagguugaaccuaaagaaauggaugacuggacaaaccauccaaauaaugauaa

SEQ ID NO: 133783 - RNA, 64 nt, Human
uuaauaaguuuacucuucuuguuaacuagucauuugacuggaaaaaaauaaaauacuuuuaaau

SEQ ID NO: 133784 - RNA, 64 nt, Human
aucauuccugucaccaaagaacuaaaauuuugguugacuggaacuagugagcuguguccauggu

SEQ ID NO: 133785 - RNA, 64 nt, Human
gaggcuaaagggaggccuggaacgguggggcguuugacuggaauggaccccagggacuguccag

SEQ ID NO: 133786 - RNA, 64 nt, Human
uguuuagauaaguacaaguuaagaaaguagcauaugacuggaaacuauauucagugcacuuucu

SEQ ID NO: 133787 - RNA, 64 nt, Human
cuccaggacauggaagaggccucucucugcccuuugacuggaaaggucaaguuuuauucuggug

SEQ ID NO: 133788 - RNA, 64 nt, Human
ccuguuuuuuuuuucuaaauaauucuuuaaaacuugacuggaacaugccucugcauuucugagu

SEQ ID NO: 133789 - RNA, 64 nt, Human
aagaccaggcuguuggcaccagaacuuaaagcgaugacuggaugucucuguacuguauguaucu

SEQ ID NO: 133790 - RNA, 64 nt, Human
aaagcacgggguccugcuccagggaauggugaaaugacuggauugcucuuuauccagcccacag

SEQ ID NO: 133791 - RNA, 64 nt, Human
uaaucguguguccaggcaaacgcacacuagugucugacuggaaagcucaggaauuuuaaucuug

SEQ ID NO: 133792 - RNA, 64 nt, Human
uaugauugucacagagaugguagaaauuaugaucugacuggaaaacaauccuguauccccuccc

SEQ ID NO: 133793 - RNA, 64 nt, Human
guucuucucaauuugacauacuugggagucggaaugacuggaugggggauggguagaggaugac

SEQ ID NO: 133794 - RNA, 64 nt, Human
aaugacauaauccucagcugacugacugaaaaugugacuggacgcauucccuguggacaguuga

SEQ ID NO: 133795 - RNA, 64 nt, Human
gacuugaucuaugguaauaaaugauuuuguuuucugacuggaaaaauaggccuacuaaagauga

SEQ ID NO: 133796 - RNA, 64 nt, Human
aaccuaacaggguggcccccugugccagcucaggugacuggagcccgagggccugacagguucc

SEQ ID NO: 133797 - RNA, 64 nt, Human
uccaguuguucucggucauacuuuugaccacuugugacuggaguucaguggcccuggcaggcuu

SEQ ID NO: 133798 - RNA, 64 nt, Human
gccauuucugaucacaccaccauccuggaccaugugacuggaagguggguaaccaaguucacca

SEQ ID NO: 133799 - RNA, 64 nt, Human
cccaugacauccaagggcgugaaaggaucagagcugacuggacauagugagcugccuucuugcg

SEQ ID NO: 133800 - RNA, 64 nt, Human
cauguuaugauaaaaaauuuuguaauuuucuugaugacuggaauuuuuauuaugcauaacugac

SEQ ID NO: 133801 - RNA, 64 nt, Human
gaagauagauuucuauccuuagcuuuggcauuauugacuggauugacuugaacaagucacuuaa

SEQ ID NO: 133802 - RNA, 64 nt, Human
aucgcaauuaccuuauguaaagcagaacuaaugcugacuggauguuuaaugggaugagcauuaa

SEQ ID NO: 133803 - RNA, 64 nt, Human
agacacuaaagcguuacacuuuaucccgucucuaugacuggaucauagucauuauaaucacagg

SEQ ID NO: 133804 - RNA, 64 nt, Human
uuugugagguagagcugugcauuaaacuugcacaugacuggaacgaaguaggagugcaacucaa

SEQ ID NO: 133805 - RNA, 64 nt, Human
aguuaacauuucaagggcaauaccguguugguuuugacuggauauucauauaaacuuuuuaaag

SEQ ID NO: 133806 - RNA, 64 nt, Human
ccuugaagaggacucaccccaagcaagggaaaauugacuggaccgcagaucauuaccuugaacc

SEQ ID NO: 133807 - RNA, 64 nt, Human
accgcacccggccgagaauauguguuguuauuuaugacuggauuaugaagaaucaggagaaugc

SEQ ID NO: 133808 - RNA, 64 nt, Human
ucccacuggugccguugcugcguucuuucaaugcugacuggacuguguuuuuccuaugcagugu

SEQ ID NO: 133809 - RNA, 64 nt, Human
ugaaacaccucaugccccacaggagccccaguggugacuggaucugcaaggguuaucucccgcc

SEQ ID NO: 133810 - RNA, 64 nt, Human
uggagugguggggcuugguuauccucuuguuuugugacuggaccacugcccaggugcuugauga

SEQ ID NO: 133811 - RNA, 64 nt, Human
auuuaucagcuugagguccaugggggcagccuugugacuggaaggguggauaugggagacacau

SEQ ID NO: 133812 - RNA, 64 nt, Human
uucccugccagggcugaaugaccccagcaccaaaugacuggagacgcauccuuaggagcaaaug

SEQ ID NO: 133813 - RNA, 64 nt, Human
gggacagccuuauucccaaaugucucuauccuuuugacuggagcaucuucugcacaaccuuggg

SEQ ID NO: 133814 - RNA, 64 nt, Human
ucugggguuauagauucccccacugccccagcucugacuggaccccaaguggcugcuauguaaa

SEQ ID NO: 133815 - RNA, 64 nt, Human
auuccugcuacuaagacaugcuguuaacucagucugacuggaagaauuuaggaccacugcaucc

SEQ ID NO: 133816 - RNA, 52 nt, Human
uggaaguguucgaggauuagacugacuggauucauucucauaauuccuacag

SEQ ID NO: 133817 - RNA, 64 nt, Human
acggccccucaucaccugaaguccucugcuguguugacuggacccucaguucccacacugcuaa

SEQ ID NO: 133818 - RNA, 64 nt, Human
uggguuuuuuuuaaggggcuguggggugaaauguugacuggaagccacccacaaacacacaccu

SEQ ID NO: 133819 - RNA, 64 nt, Human
cauuaggagaagggagugggugcuggcauggacaugacuggauagaauuuucucaggagggagc

SEQ ID NO: 133820 - RNA, 64 nt, Human
gcagcuuccugggagauuagaaauucuacuucccugacuggagcuaaaucccaccagccaggac

SEQ ID NO: 133821 - RNA, 59 nt, Human
ucaucaucugcuggaagugaggcugguagugacuggauggacacauugcuguggguagu

SEQ ID NO: 133822 - RNA, 64 nt, Human
ugcagauuucuugcugcuuccacugauacccuuuugacuggaaugaacuggcugggcuugucag

SEQ ID NO: 133823 - RNA, 64 nt, Human
gccuuaccaaguguuuucuuacuacaaugcugaaugacuggaaagaagaacugauauggcuagu

SEQ ID NO: 133824 - RNA, 64 nt, Human
gguucugaccaagaacaaagacaaccacaaccuaugacuggagcagaauaagucuaaaggcaga

SEQ ID NO: 133825 - RNA, 64 nt, Human
ugucucccucuucucuccuuugcaaauggcucagugacuggaagaggcggacuaauagccagag

SEQ ID NO: 133826 - RNA, 64 nt, Human
cauauuuauauaaucucugacuuguaauggacccugacuggaaugugaucccucaggaacuuag

SEQ ID NO: 133827 - RNA, 50 nt, Human
uuuuugaaagaacuagguaaugacuggaaugucagagugugggaguggau

SEQ ID NO: 133828 - RNA, 64 nt, Human
auaucauauaugaugauguaacugaucuaaucagugacuggaaauagcauuaguaacagaagau

SEQ ID NO: 133829 - RNA, 64 nt, Human
agucuggacuugauccugcuacagauucaacauaugacuggacaauccggucaccucucugggc

SEQ ID NO: 133830 - RNA, 64 nt, Human
ucucaucauugugauguguagcaugucugcccucugacuggacaucauugccauuaacuuucuu

SEQ ID NO: 133831 - RNA, 64 nt, Human
ccuccauuagcucaauuuugagauaauggaaaauugacuggaaauucaaaacucaaacuacuau

SEQ ID NO: 133832 - RNA, 64 nt, Human
caugucaccauaaaaugccuuuagcauuucucaaugacuggaugggaaauuuuccuuuauugcc

SEQ ID NO: 133833 - RNA, 51 nt, Human
cccgcuggcugucugacugacugacuggauccuccucuuuccccuccugcu

SEQ ID NO: 133834 - RNA, 64 nt, Human
aacuaaugacagcaaucauuggaaauacugauuaugacuggaaacaguuugaacagguagguga

SEQ ID NO: 133835 - RNA, 64 nt, Human
uguauaauaucaggaaaauuaagcaucccaagugugacuggacaaagagagcagaugcaccagu

SEQ ID NO: 133836 - RNA, 64 nt, Human
gugcucuaucacagugugccuuaugggaaguuucugacuggaaaaucuugucauucuaacacug

SEQ ID NO: 133837 - RNA, 64 nt, Human
aacaguugcaaggacacauacacaaacaaauguuugacuggauaugacauuuuaacauuacuau

SEQ ID NO: 133838 - RNA, 64 nt, Human
ucaaccauaauuuucaagggaucuucauggguugugacuggaagcugaccuuagucuugcgucu

SEQ ID NO: 133839 - RNA, 64 nt, Human
augaaugcaggaggaaacauucugucaggcgguaugacuggacagacuuugaauauacucuaaa

SEQ ID NO: 133840 - RNA, 64 nt, Human
aguucucuuuggaggaagcccauuacuccguaacugacuggaugguccagugucauuuugaucu

SEQ ID NO: 133841 - RNA, 64 nt, Human
uacuuugggugauuggaggggaaugacuuaguuaugacuggacaucuuaaaagcugauagacaa

SEQ ID NO: 133842 - RNA, 64 nt, Human
gaaggaauuaucacaucaaggagucaggggaaagugacuggaagcaaacgcccuaaaaguuacc

SEQ ID NO: 133843 - RNA, 64 nt, Human
ucuaacuaaacuguacacuguagcacgguguuauugacuggaguuaauguguaaguuauuaaca

SEQ ID NO: 133844 - RNA, 64 nt, Human
gagaauaacaagauuggacauguacauugucaugugacuggaucacauggggaagcgcuuuaua

SEQ ID NO: 133845 - RNA, 64 nt, Human
uauauucuguguaugucagauggcuuuuucuuuuugacuggacuuuuggguggugguagauuuu

SEQ ID NO: 133846 - RNA, 64 nt, Human
gugcugccugugacucugaacagcaggaccuuggugacuggauucaacuugcuugggagggucu

SEQ ID NO: 133847 - RNA, 64 nt, Human
ccucaugccccuucacuaguucaugccaagaacgugacuggaaaggcauggcaccuauaccuug

SEQ ID NO: 133848 - RNA, 64 nt, Human
acauccagccagugauccuuaaaagauuaagagaugacuggaccaggucuaccuugaucuugaa

SEQ ID NO: 133849 - RNA, 64 nt, Human
uaauccaugugcugguuaauuuuagaugucaaccugacuggauuaaggaauaccuagacagcug

SEQ ID NO: 133850 - RNA, 64 nt, Human
ugaccaccacugauaacuaauauauuggucacaaugacuggaaugugacuagugaucucaggag

SEQ ID NO: 133851 - RNA, 64 nt, Human
caacugccugcuugcucuuuacagccucucucugugacuggaaucucuccaccucaucguaucu

SEQ ID NO: 133852 - RNA, 64 nt, Human
aaaagccugauucaaggagaucaggcugugucucugacuggagcagcuacacuccccaucugua

SEQ ID NO: 133853 - RNA, 64 nt, Human
ucauucagaaagcaauaauuaaaaaaguuuacaaugacuggaaagauuccuuguaauuugagua

SEQ ID NO: 133854 - RNA, 64 nt, Human
guaaaguugucaucucucuguaauagauaauggcugacuggaccauaguuguucacuuuugucu

SEQ ID NO: 133855 - RNA, 64 nt, Human
uccagcugugugaauauaauuuuugacuaaccugugacuggaaaauaagucuucauuuuucucc

SEQ ID NO: 133856 - RNA, 64 nt, Human
acacaccacacacacacacacacacaaaacccugugacuggaguguuauauuacuaugcuaucu

SEQ ID NO: 133857 - RNA, 64 nt, Human
cucagcacuucagccaucaggacuaauccaucgaugacuggaaaagaggcuagcuuugaggaaa

SEQ ID NO: 133858 - RNA, 64 nt, Human
cacaccaccuuuuggcuuacuucgaguauugaauugacuggauccacuaaaccaacacuaagau

SEQ ID NO: 133859 - RNA, 64 nt, Human
gugagcaaaagcaggaaggggcauccacugcgggugacuggaggccgggcaggaagcaagucau

SEQ ID NO: 133860 - RNA, 64 nt, Human
acacacacacacacaggugucuacugaccuggagugacuggaauagcaccuggggauaaaugug

SEQ ID NO: 133861 - RNA, 64 nt, Human
aaaccuggcaacccuguggccugucugccggagcugacuggauccacucaucaauucuucgucc

SEQ ID NO: 133862 - RNA, 64 nt, Human
acugcuugauugggcucuucuuauaagccagcucugacuggauuuugaacgcuugaaaucaggc

SEQ ID NO: 133863 - RNA, 64 nt, Human
uagcaaucuccuuaguucuugcuacacaggauggugacuggaacuaaggcuacacagagggucg

SEQ ID NO: 133864 - RNA, 64 nt, Human
gaggacggucuuuuuuucucuucagaccuucaccugacuggaucaagcccacuaacaucgagga

SEQ ID NO: 133865 - RNA, 64 nt, Human
cacuguuugaguggaggaauguuuucuagagcagugacuggaaggacaaacgugguguugcaga

SEQ ID NO: 133866 - RNA, 64 nt, Human
ugugcugcuuuaugguucgcaguguugggcuuggugacuggagcaaagcugcugugagagagug

SEQ ID NO: 133867 - RNA, 64 nt, Human
agaugcagugacuuuuugucguggcagccaguggugacuggauugaccuacuagguacccagug

SEQ ID NO: 133868 - RNA, 64 nt, Human
gucuuccuccugucucuuuccuuucacccuagccugacuggaagcagaaaaugaccaaaucagu

SEQ ID NO: 133869 - RNA, 64 nt, Human
cuuuuuuacaggauaaguuuauguaugucacagaugacuggauuaauuaagugcuaaguuacua

SEQ ID NO: 133870 - RNA, 64 nt, Human
uaaaguauuaacuuggaauuuuuuuuuuuuuuuuugacuggaaaaucccuaguuguuugaauua

SEQ ID NO: 133871 - RNA, 64 nt, Human
agaccugagcagcauugggcuggcuguccgcugcugacuggauggcagcacaaagacaauauga

SEQ ID NO: 133872 - RNA, 64 nt, Human
uaagaagauguugguauuuuauguaggguaaaugugacuggaauacaccuuuggaacggaauuc

SEQ ID NO: 133873 - RNA, 64 nt, Human
gauguaauuuauuguugcguuccucuggaagcugugacuggaauaaacccccgcguggcacugc

SEQ ID NO: 133874 - RNA, 64 nt, Human
auaacugaaguauuuucagauauggugaaugcauugacuggaagcuccuuuucuccaccucucu

SEQ ID NO: 133875 - RNA, 64 nt, Human
aagguguuauaauaaauuauucuacauacucauuugacuggauaaacuuuacauaaaauuaacu

SEQ ID NO: 133876 - RNA, 64 nt, Human
cauaaagugucuauaauaaaacuaaacuuucaugugacuggagucaucuuguccaaacugccug

SEQ ID NO: 133877 - RNA, 64 nt, Human
uuaacaucauugaugacaaaauaauaaggagcuaugacuggagucaggagaaguuaguguaaua

SEQ ID NO: 133878 - RNA, 64 nt, Human
uuugacuugguuaaaggaaguuuguucacuucgaugacuggauacagaaugaaucccauaauug

SEQ ID NO: 133879 - RNA, 64 nt, Human
caaguaaugguguauguaaugguacaggcaaaugugacuggauuucccucaaaaaaguaacuau

SEQ ID NO: 133880 - RNA, 64 nt, Human
acuggcaaggaggcucaggugcuuccaucuguggugacuggaaugggacccacguggaguaggu

SEQ ID NO: 133881 - RNA, 64 nt, Human
aaacccauuggaagucaaaugcauuuaauaccccugacuggacaccacagcuuagccucgucca

SEQ ID NO: 133882 - RNA, 64 nt, Human
acauugcagaguuugaauccucaguaacucucauugacuggauuagaggugauggccacagcaa

SEQ ID NO: 133883 - RNA, 64 nt, Human
agaaaagugcuuggaguacgguuugccacacacgugacuggacaguguccaauucaaaucuuuc

SEQ ID NO: 133884 - RNA, 64 nt, Human
aaguuuagaaaaauacaaaaaaccauuccaaggaugacuggauacuuuuugaaaucugacuuuc

SEQ ID NO: 133885 - RNA, 64 nt, Human
auccaagcaaucugaauuuguuuuugugauuauuugacuggaaugcuucuuaaguggaauaacu

SEQ ID NO: 133886 - RNA, 64 nt, Human
uccuucuccuuccuccuucugcuggcugaagugaugacuggagcucagcaaccacuuugcacca

SEQ ID NO: 133887 - RNA, 64 nt, Human
cggcucagguggccaaccaggcccugauccggggugacuggaaccggggcgguggggugagggu

SEQ ID NO: 133888 - RNA, 64 nt, Human
uuccuguuuguugagggucuguauucauagaccuugacuggaauauguaagacugugcaaaaaa

SEQ ID NO: 133889 - RNA, 64 nt, Human
cauauccccugaaauagcauuuaucuuacuggguugacuggaaaggaauggaaaauauaguaac

SEQ ID NO: 133890 - RNA, 64 nt, Human
uugaaaaucauguacugaacuguaaccgcuaacuugacuggaugaacuaguuugcuugugugua

SEQ ID NO: 133891 - RNA, 64 nt, Human
cacuuugaucauucagucuuugaacuuuaaccuuugacuggaagugaccuauaggcaaugaaga

SEQ ID NO: 133892 - RNA, 64 nt, Human
augaugugggcuccugacuggccuccuuuuccuuugacuggaccacugccaccucuugguagcc

SEQ ID NO: 133893 - RNA, 64 nt, Human
agcacaugacaacacuucagaagggucccccugcugacuggagagcugggaauauggcauuugg

SEQ ID NO: 133894 - RNA, 64 nt, Human
cagaccucacaguucuagggccccuggcugcagaugacuggaaacaaggaaggacauuuccgug

SEQ ID NO: 133895 - RNA, 52 nt, Human
uuugcuccauagaggccugagcugacuggagcagagucauuugcuucagcag

SEQ ID NO: 133896 - RNA, 64 nt, Human
cccauuuuaaaacucugauauuggccuucaccugugacuggacacuuuacuagaggcccauuuu

SEQ ID NO: 133897 - RNA, 64 nt, Human
uuagggcccuucucauagcuguuccucauggccaugacuggaacagggaugcaaccucuuucua

SEQ ID NO: 133898 - RNA, 64 nt, Human
aggguuuucugagggaaagugcauaugaaauccuugacuggaccugguggcuacgaaucuuccg

SEQ ID NO: 133899 - RNA, 64 nt, Human
ccagucacaaguguggcuggugucauucugggucugacuggagcccuccuggacuguuucuuua

SEQ ID NO: 133900 - RNA, 64 nt, Human
augcccauaauaagagacuauuuucugauaagacugacuggaaucaagcugccgacagcuuucu

SEQ ID NO: 133901 - RNA, 64 nt, Human
ugaauauuccuggacuuacaaaaugccaagggggugacuggaaguuguggauaucaggguauaa

SEQ ID NO: 133902 - RNA, 64 nt, Human
caaaagacaaaaaucaaagaacagauggggucugugacuggaucuucuaucauuccaauucuaa

SEQ ID NO: 133903 - RNA, 64 nt, Human
accaccccugcuuuguaacaaaauuauuuuaaagugacuggaauuaucuaguccccagauugau

SEQ ID NO: 133904 - RNA, 64 nt, Human
gcagaguccccauggcauggagcuuacaccugacugacuggagcccccuccccgacucccacuu

SEQ ID NO: 133905 - RNA, 64 nt, Human
ggacagagaccaagauggcccauccuguggucacugacuggaaggcagucucuaauccacccca

SEQ ID NO: 133906 - RNA, 64 nt, Human
guggauggugacacagaggauggcucuaugcuggugacuggacacaucgccucugguuaaaucu

SEQ ID NO: 133907 - RNA, 64 nt, Human
guggauggugacgcagaggacgucucuaugccggugacuggacauaucaccucuacuuaaaucc

SEQ ID NO: 133908 - RNA, 64 nt, Human
guggauggugaugcagaggaugucucuaugcuggugacuggacacacagccucugguuaaaucc

SEQ ID NO: 133909 - RNA, 64 nt, Human
uaauuuacuggcauauguuuuguagacuguuuaaugacuggauaucuuccuucaacuuuugaaa

SEQ ID NO: 133910 - RNA, 64 nt, Human
ccugccauggggcgugggagcccaucccgcugccugacuggagcuggccgcugugguggacuca

SEQ ID NO: 133911 - RNA, 64 nt, Human
agggggacgcccugcacauggcuuugcugugcaaugacuggaaggccgcccggcaugggcagua

SEQ ID NO: 133912 - RNA, 64 nt, Human; identical to SEQ ID NO: 133906

SEQ ID NO: 133913 - RNA, 64 nt, Human
cugagcugcccaaggcgaugcccuuugugcuguaugacuggaggccucuccgcguggguacuug

SEQ ID NO: 133914 - RNA, 64 nt, Human
uccaaaaaugguugcugaugacaucaccaaccauugacuggaagagucugaggaugauagugaa

SEQ ID NO: 133915 - RNA, 64 nt, Human
aacagaagccagugaagcaauggaagcuggagugugacuggaaaaauacucagcaaacaaaguu

SEQ ID NO: 133916 - RNA, 64 nt, Human
agcuguaccauaaugcaggacgucaguuuuggugugacuggacauacuugcuucaauaaaagaa

SEQ ID NO: 133917 - RNA, 64 nt, Human
ggagagagcucugcuggcaugagccacaguuucuugacuggaggccaucaacccucuugguuga

SEQ ID NO: 133918 - RNA, 64 nt, Human
gcuaacacuuuucuuuguaaagaaguuuaccuuuugacuggaaccagauggcacugagaaaaag

SEQ ID NO: 133919 - RNA, 64 nt, Human
cuucuuccuauguuuuggaauucuggggacaaucugacuggauaugacacugcagaauagauuu

SEQ ID NO: 133920 - RNA, 64 nt, Human
ugagaagguggcagugaggaaguauccccucaggugacuggaucuguguuccuccuuaacauca

SEQ ID NO: 133921 - RNA, 64 nt, Human
gaaauggccuuuagcugguuucauguuuguguuuugacuggagggaguagacccuaucuauaag

SEQ ID NO: 133922 - RNA, 64 nt, Human
agagaucugacaaauacugcccauuccccuaggcugacuggauuugagaacaaauacccaccca

SEQ ID NO: 133923 - RNA, 64 nt, Human
augacagccuucgucacccagccugugaggguccugacuggagcaccuucuaaaucuaagauuc

SEQ ID NO: 133924 - RNA, 64 nt, Human
acuggaauauaaucccauaaauuaucaccuuuuaugacuggaaaauauuugccaaugaagaaau

SEQ ID NO: 133925 - RNA, 64 nt, Human
cuggauauuugaucuguucaauguacugugcuagugacuggaggcccugcuacugcaaauauaa

SEQ ID NO: 133926 - RNA, 64 nt, Human
uugugaaaauuguggugccaugaauuaagauggaugacuggaaaaagguguuggagaaagaguu

SEQ ID NO: 133927 - RNA, 64 nt, Human
aaaaggcuaaucuaaguuccugcgggcaguggcaugacuggagcacagccuccugccucccagc

SEQ ID NO: 133928 - RNA, 64 nt, Human
caagggcuguguugaccacagucacacuguggcaugacuggauacccaaacuacacuucuacac

SEQ ID NO: 133929 - RNA, 64 nt, Human
uucauccuggucacaugaagacagaugguauuauugacuggaguugaauuauuuuuauaucuug

SEQ ID NO: 133930 - RNA, 64 nt, Human
caauucagaaggcagcucugcauucuaccuugcuugacuggaauugucugaagcuuuuucuggc

SEQ ID NO: 133931 - RNA, 64 nt, Human
acacaggguucuagauuugaacucugcugugaagugacuggaagggagcagaggccagcugggg

SEQ ID NO: 133932 - RNA, 64 nt, Human
cauuugcccuucccaaaucccuccaggccagaacugacuggagcaggcauggcccaccaggcuu

SEQ ID NO: 133933 - RNA, 64 nt, Human
ggaacagagcccagggccaggcagacuggggcagugacuggaaaaggaaaacuaaaggucagaa

SEQ ID NO: 133934 - RNA, 64 nt, Human
ugaaacauucucuguacuaguucuggucuccuuuugacuggacuguggcucugaaccuugagca

SEQ ID NO: 133935 - RNA, 64 nt, Human
aaguuaggaacccauuuccuccccagaaccagaaugacuggacaaucuuuuucauagcuucucc

SEQ ID NO: 133936 - RNA, 64 nt, Human
uggagcauugacguuuucaaaaccauuauuccugugacuggagaggcaucaggagaggucucgu

SEQ ID NO: 133937 - RNA, 64 nt, Human
gggaauacucacauuuuguuaagaaguugaacuaugacuggaguaaaccauguauucccuuauc

SEQ ID NO: 133938 - RNA, 58 nt, Human
gcaaggaaacucaacuuuagaaacaugaugacuggaagucaugucuucuaauugguug

SEQ ID NO: 133939 - RNA, 64 nt, Human
accaagaugaaguuucccaggcacagggcaucugugacuggaggcaucagauuccugauccaca

SEQ ID NO: 133940 - RNA, 64 nt, Human
uaggggaaggggguuguuugccuucuucaggaccugacuggacagauggaccuggcucaagcaa

SEQ ID NO: 133941 - RNA, 64 nt, Human
uuuucuuuccauauuugaauuaauuuuuucuguuugacuggaagggguuuuuguauaacuaaaa

SEQ ID NO: 133942 - RNA, 64 nt, Human
ucuuaggaauccagcacuacgcccugcccucuacugacuggaggcaggccucugccuacuuuag

SEQ ID NO: 133943 - RNA, 64 nt, Human
uuuuuuuuugagacggggucuggcuguguugcccugacuggaguucaguggugcaaacacagcu

SEQ ID NO: 133944 - RNA, 64 nt, Human
uucacaaaaauucacagcuuaaauuucccaucagugacuggaggaauuuuuuucaggugcuucc

SEQ ID NO: 133945 - RNA, 64 nt, Human
uuguguugugccuguaugaauuuuuaaaaguuguugacuggauuuugcaaaaggauguauaaua

SEQ ID NO: 133946 - RNA, 64 nt, Human
ccuucccugaccucaccuuccuggggucugugacugacuggagauaaaaauaaaagcaauugug

SEQ ID NO: 133947 - RNA, 64 nt, Human
auaaauuuuagauuauagaacauggauucaaaagugacuggaacaaauuggcugacaccuuacu

SEQ ID NO: 133948 - RNA, 64 nt, Human
uucuaucauuccccugcccaccuccuuccagcacugacuggaagggaaguucaggcucugagac

SEQ ID NO: 133949 - RNA, 64 nt, Human
guuacugcaacccuaacucacucuagugggaccuugacuggagaaacuccacgaucuuccugaa

SEQ ID NO: 133950 - RNA, 64 nt, Human
uauguaauauucaguaauaaaugucaucaggugaugacuggaugagcugcugaagacauucgua

SEQ ID NO: 133951 - RNA, 64 nt, Human
ucagaaauguaccuguguuuaaggaacugccgugugacuggauuuggcauuuaaagggagcucg

SEQ ID NO: 133952 - RNA, 64 nt, Human
aaacauuugaaugcaaagcauuucuaacaaaaagugacuggagcacuugccauugcaacaaccc

SEQ ID NO: 133953 - RNA, 64 nt, Human
agucucuuuaccaaagggcacugaaacacacaauugacuggacagguccacgcgccaugacaaa

SEQ ID NO: 133954 - RNA, 64 nt, Human
aaaaagaagauauggaugaagugaacccaugcagugacuggaugauuccggcauuccugggucu

SEQ ID NO: 133955 - RNA, 64 nt, Human
auuaugacugcugaaucaucauaucuacuauauaugacuggaagaagugguucuucaagucaac

SEQ ID NO: 133956 - RNA, 64 nt, Human
uugguagaaaggcaaaaaguaggauauuuugaccugacuggaaagaugguuguguuuuuauugc

SEQ ID NO: 133957 - RNA, 64 nt, Human
gcuaaauuacaaugcagacauuaagaaaaaguauugacuggagggguugaauuccuugagaauu

SEQ ID NO: 133958 - RNA, 64 nt, Human
uauguacccgaauauacaguucaagaauuuugucugacuggaaauaaaugcauuuuguagcaaa

SEQ ID NO: 133959 - RNA, 64 nt, Human
cuggccaauuccauuuccugucccucugugguucugacuggagaccccagugugggggaggucu

SEQ ID NO: 133960 - RNA, 64 nt, Human
agguccaaucugaccccucccugucucauuuuaaugacuggacagcgcucggugaaggcugugu

SEQ ID NO: 133961 - RNA, 64 nt, Human
auggcuuuuggguuuuuguuuauuuuuuugauaaugacuggacaucagaagaggaaaaaaacuc

SEQ ID NO: 133962 - RNA, 64 nt, Human
acuguugcuuucgcaugauguauguagugucucaugacuggaguuugcuuuguuuuauaguauc

SEQ ID NO: 133963 - RNA, 64 nt, Human
cacagaacacuguguuacuuuacaagggcuuaugugacuggaauaagguggucccacuugacug

SEQ ID NO: 133964 - RNA, 64 nt, Human
uaccuuaugacacagccaacauuuugugaaacaaugacuggaacaaaacagcagccauacuuac

SEQ ID NO: 133965 - RNA, 64 nt, Human
auggauguagugcaucuuagagccauagagcaggugacuggaaaucuaacucaguauauuuccg

SEQ ID NO: 133966 - RNA, 64 nt, Human
uucuccucaagagccuggacaucucugucugucaugacuggaaagggcccguugugcugaaauc

SEQ ID NO: 133967 - RNA, 64 nt, Human
gaugaauggcaauguaaaugaacaaggcuccaugugacuggagcauggaagugaaugcuacuuu

SEQ ID NO: 133968 - RNA, 64 nt, Human
uugcauuuacaaauguuuuacaaggcagaaaguuugacuggauaguuaguguaaaagcuucaug

SEQ ID NO: 133969 - RNA, 64 nt, Human
agaggaaaccagggcaguucuagaggagugcuggugacuggauagcaguuuuaaguggcguuca

SEQ ID NO: 133970 - RNA, 51 nt, Human
aguuuguuggauuucauuaagugacuggauauguaaagucguuuaaugugg

SEQ ID NO: 133971 - RNA, 64 nt, Human
uuguccuucagcccaugcccagcagauaccucucugacuggagacgggcucaaagcuggauuag

SEQ ID NO: 133972 - RNA, 64 nt, Human
uuuuucuguacagggagagaagacauauugacucugacuggacacccugauuccuccaaauaua

SEQ ID NO: 133973 - RNA, 64 nt, Human
aaguagaagagguccucgaucaugguguuagaauugacuggauaguaacagguggucuggugga

SEQ ID NO: 133974 - RNA, 64 nt, Human
ggagagccaggccugcccugcccugcuggcuuccugacuggagagacaggacccacagaaacag

SEQ ID NO: 133975 - RNA, 64 nt, Human
cuuucaaugagggaaccggaugcuguucacacuuugacuggauggagaugcauuuacaaaacag

SEQ ID NO: 133976 - RNA, 64 nt, Human
ugguccaguguccaucacagccaugcugacugagugacuggagacagggaugauggagaguuca

SEQ ID NO: 133977 - RNA, 56 nt, Human
cuggaccccaggccagcuaaugaggcugacuggauguccagagcuggccaggccac

SEQ ID NO: 133978 - RNA, 64 nt, Human
guucugucuccaaggcccaggacacuugucagaaggaugcaaaaaaagaaaaaaguacauccac

SEQ ID NO: 133979 - RNA, 64 nt, Human
gaggugguggcgguggaggacagcagcgagcuggugacuggaaguguccuaauccgugagugaa

SEQ ID NO: 133980 - RNA, 64 nt, Human
aucuccaccagcccuuaaagugucggccgcucugugacuggaguuaugcucuuuugaaauguca

SEQ ID NO: 133981 - RNA, 64 nt, Human
gugggagacccugguaggcacaaagcuugugccuugacuggacccguagccccuggcuaggucg

SEQ ID NO: 133982 - RNA, 64 nt, Human
auaaaacaauuuuuucuaugaaccuuuacuuacuugacuggauuggacuaaaagcacugaucag

SEQ ID NO: 133983 - RNA, 64 nt, Human
gagauuugaaggauuuuggacucuugugaaugggugacuggacuuggcuuuacagaguugggug

SEQ ID NO: 133984 - RNA, 64 nt, Human
acugccaccuggcuucugccauguggcaggagggugacuggauaauuaagacugcauuaugaaa

SEQ ID NO: 133985 - RNA, 64 nt, Human
ucauucacccugagugacguacuucauccuccaaugacuggacaacugcgaugccuuuuccucc

SEQ ID NO: 133986 - RNA, 64 nt, Human
aaauuuuaacuguagguaugaucucuucugguguugacuggacugcuuggggugggggacgauc

SEQ ID NO: 133987 - RNA, 64 nt, Human
cuuccucagcugccuccugcgcccugugcccgacugacuggaggaggccugucccaauucugcc

SEQ ID NO: 133988 - RNA, 64 nt, Human
gcuuguagguccuugcuaguaacagcccuaaugaugacuggaaacugagagguuccagagaaau

SEQ ID NO: 133989 - RNA, 64 nt, Human
cuuacauugaaaagucuuuuucccuuagcucuucugacuggauuuuucuacaaaaacuauggaa

SEQ ID NO: 133990 - RNA, 64 nt, Human
ucaggagcuaugagagucgggacucuccugcaccugacuggagcucagaugugggcaggaauuc

SEQ ID NO: 133991 - RNA, 64 nt, Human
cacaccucccuacuccccugggcaucuucuggcuugacuggauggaaggagacuuaggaaccua

SEQ ID NO: 133992 - RNA, 64 nt, Human
aaaauggguuggggcccugccagaguuaaagcagugacuggaggguggacugggggguugcagc

SEQ ID NO: 133993 - RNA, 64 nt, Human
uuguuuuggggcccuucaaggcaaaagaccaggcugacuggaagauggaaagccacaggaagga

SEQ ID NO: 133994 - RNA, 64 nt, Human
cagcuggcugcucagugaguggccuagacauugaugacuggagcucugaggucugagggaugac

SEQ ID NO: 133995 - RNA, 64 nt, Human
ucugccucacucagaaugggcaggacagacccacugacuggacuucagagucuggaggguucca

SEQ ID NO: 133996 - RNA, 64 nt, Human
agcuccgcucugaaggcacugugugggugcugcgugacuggagagcuguguggaggccaugugu

SEQ ID NO: 133997 - RNA, 64 nt, Human
cagugggaguggggcucacuggcuuccugugggaugacuggaaaaugaccucgcugcuguuccc

SEQ ID NO: 133998 - RNA, 64 nt, Human
uguaacuugaagcuaauuuguacuacuggauaucugacuggagccacagauacagaaucuguau

SEQ ID NO: 133999 - RNA, 64 nt, Human
acaucccugcaucagugauucuaaugaucagcuuugacuggaccucagcucacacgaaucucca

SEQ ID NO: 134000 - RNA, 64 nt, Human
aggcaaagacugaagacaaacaugggaggagaagugacuggaaaagaacuggugugggagaggg

SEQ ID NO: 134001 - RNA, 64 nt, Human
cugugaaggaacucgguuacaaauccauaacaaaugacuggaaaagccacacaacucuuacaua

SEQ ID NO: 134002 - RNA, 64 nt, Human
gagcagggcagaaaacacagccuguguacuccucugacuggagucuaggaagggcgugucccau

SEQ ID NO: 134003 - RNA, 64 nt, Human
aaaaaaaaaaaaaaaaacuuaagauggacacagcugacuggacccccauccugccucacccaug

SEQ ID NO: 134004 - RNA, 64 nt, Human
ccuggggccuuggccccauuaggagaaggagaaaugacuggaaaccagcacugucagcacuuug

SEQ ID NO: 134005 - RNA, 64 nt, Human
ccucaccucucacuuccuucuagaaggagcuuccugacuggaaccagagaaugcaugucugucc

SEQ ID NO: 134006 - RNA, 64 nt, Human
aagugccugcggagcgccgaggagaggagagagcugacuggacgcuuacguuauuuuccuccuu

SEQ ID NO: 134007 - RNA, 64 nt, Human
gugggcgcagggagcccggccccccaugcagccaugacuggaugcgcccccaucucgggggcuu

SEQ ID NO: 134008 - RNA, 64 nt, Human
cagaacuuaaauccugcacguggcacuccaccacugacuggaccgagcuggcauauguuguuuc

SEQ ID NO: 134009 - RNA, 64 nt, Human
cgggccgugauguuaaauaucuccggcucccaagugacuggauuugccuaggaccuucagacca

SEQ ID NO: 134010 - RNA, 64 nt, Human
ugcccccccgccagugccuuggauauuucuggggugacuggacuggcgccccugggccaccuuu

SEQ ID NO: 134011 - RNA, 64 nt, Human
cuguccccuccccccuucuccaggagccagggggugacuggagagacagacccacccccaagca

SEQ ID NO: 134012 - RNA, 64 nt, Human
uggcccuggagccucaauaaagugucccuuucauugacuggagcagcaauugguguccucaugg

SEQ ID NO: 134013 - RNA, 64 nt, Human
gaaggacugagggggcguugaggaauuguggcguugacuggauguggcccaggagggggucgag

SEQ ID NO: 134014 - RNA, 64 nt, Human
uaaacacagaggagcggggcaggcagggaggcaaugacuggagcuaccuugcuuguugggggac

SEQ ID NO: 134015 - RNA, 64 nt, Human
gccuaaagauaucagcuguuccauggcagagccuugacuggauggagguggggaguguggugug

SEQ ID NO: 134016 - RNA, 64 nt, Human
cagaagauugugugaaggcugacuauacauaaagugacuggaauuuuaacaggugaaccugcau

SEQ ID NO: 134017 - RNA, 64 nt, Human
uuuuuuuuuccaaugauuuguaauauacauuuuaugacuggaaacuuuuuuguacaacacucca

SEQ ID NO: 134018 - RNA, 64 nt, Human
cucuagggcagugccugcccucagcucucacacaugacuggagagaagugagaagacucccaga

SEQ ID NO: 134019 - RNA, 64 nt, Human
uacuucuuuggggagccccuuguguuuuggagucugacuggagucucgcauccuggggccugcu

SEQ ID NO: 134020 - RNA, 64 nt, Human
gggggcccugggcucccauccucaucucucuccuugacuggaauugcugcuacccagcuggggu

SEQ ID NO: 134021 - RNA, 64 nt, Human
uccccaugugucagaggagggccuuggugggagaugacuggaucacgagggcagauuucucccu

SEQ ID NO: 134022 - RNA, 64 nt, Human
ccuucucuuucuauuuuguuuaggauuuccaugaugacuggauguugaauuuugugaaaugcuu

SEQ ID NO: 134023 - RNA, 64 nt, Human
aaauccagacgcaggcccugaaaugaggggacccugacuggagaggugggggccaccaaaaacc

SEQ ID NO: 134024 - RNA, 64 nt, Human
gcuaagggaaaaaccuuaugcagagaaaaguuuuugacuggaaauacacuguuuugcaucaagc

SEQ ID NO: 134025 - RNA, 64 nt, Human
uggguccccuucuggcugcaugaauggaaaugagugacuggaaaucccauaggccacaagaaug

SEQ ID NO: 134026 - RNA, 64 nt, Human
gagccaggcagaaaaacccugugccguaggaaagugacuggaaguggacuccagagggacaggu

SEQ ID NO: 134027 - RNA, 64 nt, Human
gcauggucguacacugcucauugugccacaggugugacuggaaagcaugauauucuaggguugg

SEQ ID NO: 134028 - RNA, 64 nt, Human
ugguuuugcucuaguucuuucuuuuugaagagagugacuggagugguaaagauggaaaugcugg

SEQ ID NO: 134029 - RNA, 64 nt, Human
agagccagauucguuaggucccuggaggaaggacugacuggaccagagggacccucuggcucag

SEQ ID NO: 134030 - RNA, 64 nt, Human
accuggaagcagcugacaugcugguggacggccgugacuggagcccgugccccucccuccccgu

SEQ ID NO: 134031 - RNA, 64 nt, Human
uucacuagugugucccacccgccagccccacagaugacuggaggaaggaggggaaauguguaga

SEQ ID NO: 134032 - RNA, 64 nt, Human
ugauuccagucacccuguaguuacugacagaaauugacuggacugucauugugugaagucuagg

SEQ ID NO: 134033 - RNA, 64 nt, Human
gccuggccuuauguaaagcucuugaccuagcaucugacuggaaacaagcgggaauugcauuggg

SEQ ID NO: 134034 - RNA, 64 nt, Human
cacuucccagcuaggagugcacuuuaugggacugugacuggacucuuccguucuggcuccagcc

SEQ ID NO: 134035 - RNA, 64 nt, Human
ccagucaucauuaauacaauguguugggauucugugacuggaaaaggugacaaguuggugacuu

SEQ ID NO: 134036 - RNA, 64 nt, Human
guucauuuucuggcuccaaccugacauugaaugaugacuggaauaaagguacaaaugucuccuu

SEQ ID NO: 134037 - RNA, 64 nt, Human
agaugaggucauuggggugggcccucacccaauaugacuggaguccuuaucggaagagggaaau

SEQ ID NO: 134038 - RNA, 64 nt, Human
acaaaagugcaugggggggauuaauuaaaccuucugacuggaaguucuaucacacaagaggcaa

SEQ ID NO: 134039 - RNA, 64 nt, Human
cgcaaaaucuuacacccugguauaacagacagcaugacuggacagcgguuguaaauacaauuca

SEQ ID NO: 134040 - RNA, 64 nt, Human
aagccacccucuuccuguguaguccuuacaggcaugacuggaaaguuggggggcaucuauggua

SEQ ID NO: 134041 - RNA, 64 nt, Human
gucaagaugcgcccucucuggggagaagggaacgugacuggauucccucacuguuguaucuuga

SEQ ID NO: 134042 - RNA, 64 nt, Human
gcuccccaccccgaggucaggcugcccaauccucugacuggaucaccgggggcuucuugccuca

SEQ ID NO: 134043 - RNA, 64 nt, Human
uccaagauuccuuuguaguuaaaggguccaguucugacuggagccucuagagagcugggcuugu

SEQ ID NO: 134044 - RNA, 64 nt, Human
aucccauuggauggaaaggacuuggcuaugaacuugacuggaaacacgcagccugcuccuggag

SEQ ID NO: 134045 - RNA, 64 nt, Human
uggggugaggguagggggagcauuuguuauuaaaugacuggacuuuugugccaauugcauuuug

SEQ ID NO: 134046 - RNA, 64 nt, Human
aaaaaaaaaaaaaauauauauauauauauauagcugacuggaagagauuaauuucuucccccaa

SEQ ID NO: 134047 - RNA, 64 nt, Human
aaagcuuccccagagacgcucagcuuguauccauugacuggaagucugucacguggcucccccu

SEQ ID NO: 134048 - RNA, 64 nt, Human
uuaauguuucuuacaucuuguuuuuacucauuucugacuggacaaaguucuuccaaacaauucu

SEQ ID NO: 134049 - RNA, 64 nt, Human
uuuacuuguauacagacuuaacaacaaccgguauugacuggauugacagcuaaaguaucagaau

SEQ ID NO: 134050 - RNA, 64 nt, Human
caaagcuagccaagauucuacguuacuuuucccuugacuggaucccaaguagcuuggaaguuuu

SEQ ID NO: 134051 - RNA, 64 nt, Human
ccuggcacucaagcccaccgguggcagcuccuagugacuggacaugccuggaagaccccucagc

SEQ ID NO: 134052 - RNA, 64 nt, Human
agcacuuugggagaccgaggcagguggaucacgaggucaggagauagagaccauccuggccaac

SEQ ID NO: 134053 - RNA, 64 nt, Human
caaaugugcuggucacccuucaacgcucccagacggucaggaaaacuguuccaaucaugaaaag

SEQ ID NO: 134054 - RNA, 64 nt, Human
cacuuugggaggccaagguggguggaucaccugaggucaggaguucaagaccagccuggccaac

SEQ ID NO: 134055 - RNA, 64 nt, Human
agaugcaauugggggccuuccauguagaaaguggggucaggaggccaagaaagggaauaugaau

SEQ ID NO: 134056 - RNA, 64 nt, Human
uccauuauaaucuuucucuuucucuuugaaagcuggucaggaaugggagaagugucagacacua

SEQ ID NO: 134057 - RNA, 64 nt, Human
cacuuugggaggcugagguagguggaucacccaaggucaggaguuugagaccagccuggccaaa

SEQ ID NO: 134058 - RNA, 64 nt, Human
accuggagaauguuuuugcgugggaugaugugcuggucaggagccccuugggcaucgcuucccc

SEQ ID NO: 134059 - RNA, 64 nt, Human
cacagugagcagguggccccagcuggguuucccaggucaggaaugugggccccaggcaaggugc

SEQ ID NO: 134060 - RNA, 64 nt, Human
accacuuuuuuuuuaaggcaggcggaucaccugaggucaggaguuuaagaccagccugaccaac

SEQ ID NO: 134061 - RNA, 64 nt, Human
aacuuuggaaggcugaggcagguggaucaccugaggucaggaggaguucaagaccagccuggcc

SEQ ID NO: 134062 - RNA, 64 nt, Human
gcacuuugggaggccaaggcaggcaaucaccugaggucaggaguucaagaccagccuggcuaac

SEQ ID NO: 134063 - RNA, 64 nt, Human
cauuuugagaggcugaggcggguggaucacuugaggucaggaguuugagaccaaccuggccaac

SEQ ID NO: 134064 - RNA, 64 nt, Human
cacuuugguaggcugagguagguggaucaccugaggucaggaguucgaguccagccuggccaau

SEQ ID NO: 134065 - RNA, 64 nt, Human
gucucugcacacagcuuuugcuuaguguuuccugggucaggaacagagccaacaggaugaacgu

SEQ ID NO: 134066 - RNA, 64 nt, Human
ccucuuuauuucauuuuguguuauugugauugcuggucaggaaaaaugcugauagaaggaguug

SEQ ID NO: 134067 - RNA, 64 nt, Human
gcugaggccuugguggacagaggauggggaaaggggucaggaggaaaaagcuugcauuucugug

SEQ ID NO: 134068 - RNA, 64 nt, Human
cacuuugggaggccaaggugggcggaucgccugaggucaggaguucaagaccaaccugacuaac

SEQ ID NO: 134069 - RNA, 64 nt, Human
gagucacaucuuagcuuuugcacaaggcauucguggucaggaauagguuagggaauggucacuu

SEQ ID NO: 134070 - RNA, 64 nt, Human
agcacuuugggaggccgaggcagguggaucaugaggucaggaguucgaggcgagccuggccaac

SEQ ID NO: 134071 - RNA, 64 nt, Human
cacuuugggaggccaaggugggugggucaucugaggucaggaguucaagaccagccuggccaac

SEQ ID NO: 134072 - RNA, 64 nt, Human
gaccccagccccuaucuccaagagacagaggaggggucaggaggcacugcucaucuguacauac

SEQ ID NO: 134073 - RNA, 64 nt, Human
cccuuuuggaggccaagguaagaggaucgcuugaggucaggaguucgagaccagcuugugcaac

SEQ ID NO: 134074 - RNA, 64 nt, Human
caccuugggaggccaaggugggcggaucacuugaggucaggaguucaagaccaucuggccaaca

SEQ ID NO: 134075 - RNA, 64 nt, Human
cacuuugggaggccgaggcggguggaucacuugaggucaggaguucaagaccagccugaccaau

SEQ ID NO: 134076 - RNA, 64 nt, Human
gucacccacacaguaggugcugagaguuaggacaggucaggaagucccccaggguccacaaagg

SEQ ID NO: 134077 - RNA, 64 nt, Human
guuauuaugaguguaggacacugagccauccgugggucaggaugcaauuauuuauaaaagucuc

SEQ ID NO: 134078 - RNA, 64 nt, Human
agcacuucaggaggccgagguggacagaucacgaggucaggaguucgagaccauccuggcuaac

SEQ ID NO: 134079 - RNA, 64 nt, Human
cacucugggaggccaaagcgggcagaucaccugaggucaggaguucaagaccagccuggccaac

SEQ ID NO: 134080 - RNA, 64 nt, Human
cagcacuuugcggggccgaggcaggggaacacaaggucaggagaucaagacuguccuggacaac

SEQ ID NO: 134081 - RNA, 64 nt, Human
uccaaaggguuaggacucuccacucaaugucuuaggucaggaguugugucuaggcuggaagagc

SEQ ID NO: 134082 - RNA, 64 nt, Human
cacuuugggaggccaagguggguggaucaccugaggucaggaguucgagaccagccuggccaac

SEQ ID NO: 134083 - RNA, 50 nt, Human
cuggcuggucagugcugugaggucaggauacccacucuaggauucucaug

SEQ ID NO: 134084 - RNA, 64 nt, Human
ucaauuugaaagauauuuaugggcaacaaaguaaggucaggauuagacuucaggcauucauaag

SEQ ID NO: 134085 - RNA, 64 nt, Human
ggucacugucucucaccagcauguuucuuugugcggucaggaauuauuuccaaaugcuccugaa

SEQ ID NO: 134086 - RNA, 64 nt, Human
ccuucccagagucccccgggugcuccccugccgaggucaggagcugaccaagccuuggcccggu

SEQ ID NO: 134087 - RNA, 64 nt, Human
gagggccugccugggacugagggggccagggcugggucaggauucaccagcuuguguugcagac

SEQ ID NO: 134088 - RNA, 64 nt, Human
agcacuuugggaggccgaggcggguggaucacgaggucaggagaucgagaccauccuggcuaac

SEQ ID NO: 134089 - RNA, 64 nt, Human
agcacuuugggaggccaaggugggcggaucacaaggucaggagaucgagaccauccuggcgaac

SEQ ID NO: 134090 - RNA, 64 nt, Human
uacuuugggaggccgaggcagguggaucaccugaggucaggaguucgagaccagccugaccaac

SEQ ID NO: 134091 - RNA, 64 nt, Human
cacuuaggguggcugaggcaggcagaucaccuggggucaggaguucaagaccagccugcccaac

SEQ ID NO: 134092 - RNA, 64 nt, Human
agcacuuugggaggccgaggcaggcggcucacgaggucaggagaucgagacuauccuggcuaac

SEQ ID NO: 134093 - RNA, 64 nt, Human
ggagugggcaccucagaaagucaccaggacuuggggucaggaacaguggcugggugggcccaga

SEQ ID NO: 134094 - RNA, 64 nt, Human
agcacuuugggaggccgaggcgggcggaucacgaggucaggaguucgagaccagccugaccaac

SEQ ID NO: 134095 - RNA, 64 nt, Human
uaguuugggaggccaaggcgggcagaucaccugaggucaggaguuuuagaccagccuggccaac

SEQ ID NO: 134096 - RNA, 64 nt, Human
guaaaauaugaaggucacagccaggauuucuaagggucaggaggccuucaccgcugcuggggca

SEQ ID NO: 134097 - RNA, 64 nt, Human
ccucuccaccuacaccugugaccaaggcuuauguggucaggacugagcaggggacuggcccucc

SEQ ID NO: 134098 - RNA, 64 nt, Human
guggacagucugcucuagaugagcugggccggagggucaggaaacccagucgcccuuacuucuu

SEQ ID NO: 134099 - RNA, 64 nt, Human
agcacuuugggaggccgaggcggguggaucaugaggucaggagaucgagaccauccuggcuaac

SEQ ID NO: 134100 - RNA, 64 nt, Human
cacuuuggaaagcugaggcagguggaucaccugaggucaggaauucaagaccagccuggccaac

SEQ ID NO: 134101 - RNA, 64 nt, Human
agcacuuugggaggccgagacggguggaucacgaggucaggagaucgagaccauccuggcuaac

SEQ ID NO: 134102 - RNA, 64 nt, Human
gcacucugggaggccaaggcagaugaucaccugaggucaggaguucuagaccagccuggcuaac

SEQ ID NO: 134103 - RNA, 64 nt, Human
agcacuuugggaggccgaggugggcagaucacgaggucaggaguuugagaccagccugaccaac

SEQ ID NO: 134104 - RNA, 64 nt, Human
cacuuugggaggccgagguggccagaucaccugaggucaggaguucgagaccacccuggccaac

SEQ ID NO: 134105 - RNA, 64 nt, Human
cacuuugggagggcaaggcaggcggauuaccuggggucaggaguucaugaccagccuggccaac

SEQ ID NO: 134106 - RNA, 64 nt, Human
uugcaacaggaaacauccuguuuuaugguaguggggucaggaauguaggaacugguauccauuc

SEQ ID NO: 134107 - RNA, 64 nt, Human
guacuuugggaggccaaggggggagaucacuugaggucaggaguucaagaccagccuggccaac

SEQ ID NO: 134108 - RNA, 64 nt, Human
cacuuugggaggccaaggcaggcggaucaccugaggucaggaguucgagauuagucuggccaac

SEQ ID NO: 134109 - RNA, 64 nt, Human
uaaucccagaggcugaggcaggcggaucaccugaggucaggaguucaagaucagccugaccaac

SEQ ID NO: 134110 - RNA, 64 nt, Human
ggggaguggguucccagaagggagaucugggaggggucaggagccacuaaguugcuucacuccu

SEQ ID NO: 134111 - RNA, 64 nt, Human
ucucagcagcuagaugcauggccugaggcaggguggucaggaaccaccucaaaaagugcggagg

SEQ ID NO: 134112 - RNA, 64 nt, Human
uuugccuguggaucuguuuggccagggucccuggggucaggaauauuugcaagacucagccagc

SEQ ID NO: 134113 - RNA, 64 nt, Human
gggagagagagacucaucugacacuucuuuuggaggucaggauuuguauaucagaauugaaguu

SEQ ID NO: 134114 - RNA, 64 nt, Human
cacuuugggaggccaaggcggguugaucacccgaggucaggaguucaagaccagccuggccaac

SEQ ID NO: 134115 - RNA, 64 nt, Human
cacuuugggaggcugaggcagguggaucgccugaggucaggaguucaagaucaaccuggccaac

SEQ ID NO: 134116 - RNA, 64 nt, Human
cacuuugggaggcugaggcggguggaucacuugaggucaggaguuccuaaccagccuggucaac

SEQ ID NO: 134117 - RNA, 64 nt, Human
aggauagagcgaaaauggagagaaggguguucaaggucaggagugauuuuugcauuugguggaa

SEQ ID NO: 134118 - RNA, 64 nt, Human
acucauuucuucuaaauaaacuauuuaauauccuggucaggaaaugacauguuaaugcuuugcu

SEQ ID NO: 134119 - RNA, 64 nt, Human
agcacuuuggaaggccgaggcaggcggaucacgaggucaggagaucgagaccauccuggcuaac

SEQ ID NO: 134120 - RNA, 64 nt, Human
agcacuuugggaggccaaggcaaacggaucacgaggucaggagaucaagaccauccuggccaac

SEQ ID NO: 134121 - RNA, 64 nt, Human
aacacuuugggaggccaagguggguggaucacaaggucaggaguucaagaccagccuggccaau

SEQ ID NO: 134122 - RNA, 64 nt, Human
cacuuugggaggcugaaguggguggaucaccagaggucaggaguucgagaccagcccagccaac

SEQ ID NO: 134123 - RNA, 64 nt, Human
uacauuguuugcaggaagaaaacuucgaguuacaggucaggaaaagccugcugaauuuauguug

SEQ ID NO: 134124 - RNA, 64 nt, Human
agcacuuugagagaccgaggcgggcggaucacgaggucaggagaucgagaccauccuggcuaac

SEQ ID NO: 134125 - RNA, 64 nt, Human
ggcccauggguggguguugagguuuuuaaaguguggucaggaaaggccccacugauaagguaac

SEQ ID NO: 134126 - RNA, 64 nt, Human
cacuuugggaggccaaggagggcagaucacuucaggucaggaguucgagaccagccuggccaac

SEQ ID NO: 134127 - RNA, 64 nt, Human
uacucugggaagccaaggcaggcagaucacuugaggucaggaguucgagaccagccuggccaau

SEQ ID NO: 134128 - RNA, 64 nt, Human
cacuuugggaggccuaggcaggcagaucaccugaggucaggaguucaagaccagccuggccaac

SEQ ID NO: 134129 - RNA, 64 nt, Human
cauccaggacuucucuuacacuuggggguagcggggucaggacaaucaucucaguccugcaucu

SEQ ID NO: 134130 - RNA, 64 nt, Human
agagaaugaucuggccucaggggacaggccaccuggucaggaggaauauuuuuccugcacuuuu

SEQ ID NO: 134131 - RNA, 64 nt, Human
agcacuuugggaggccgaggugggcggaucacgaggucaggagauggagaccauccuggcuaac

SEQ ID NO: 134132 - RNA, 64 nt, Human
uuuaaauauuauggauggugggcagaucacuugaggucaggaguucgagaccagccuggccaac

SEQ ID NO: 134133 - RNA, 64 nt, Human
cacuuugggaggccgaggugggcggaucacuugaggucaggaguuggagaccagccuggccaac

SEQ ID NO: 134134 - RNA, 64 nt, Human
ccucugcugggucacagccacucaggaggggaagggucaggaugagaggcugcagccucgacac

SEQ ID NO: 134135 - RNA, 64 nt, Human
auuuaauauuccuggcauaccuuuaagguaaauuggucaggaacuauuaauuccaugugauaca

SEQ ID NO: 134136 - RNA, 64 nt, Human
ggucccucaguccuccccugucccuuccaaggugggucaggagguucuggccccgcuggggcag

SEQ ID NO: 134137 - RNA, 64 nt, Human
aaaagauggcagcagcucauuuucuuuaauaggaggucaggauggucagcuccaguaucucccc

SEQ ID NO: 134138 - RNA, 64 nt, Human
gcaccuuaggaggccgaggcaggaggauccuugaggucaggaguucgagaccagccucgccaac

SEQ ID NO: 134139 - RNA, 64 nt, Human
agcacuuugggaggccgaggcggacagaucacgaggucaggaguucgagaccauccuggcuaac

SEQ ID NO: 134140 - RNA, 64 nt, Human
gcuuucauuuuucacuuggagugacaaugggagaggucaggaaucaaguucacuuucaagaucu

SEQ ID NO: 134141 - RNA, 64 nt, Human
acaucucggaaacugagcagcugccggacgccugggucaggaauccaagaccccaccucuuaag

SEQ ID NO: 134142 - RNA, 64 nt, Human
cacuuugggaggccgagguggguggaucaccugaggucaggaguuugagaccagccuggccaac

SEQ ID NO: 134143 - RNA, 64 nt, Human
cccucucuggcccaugguccugcuucaugcuuugggucaggaggccaaagcugauguucaggcc

SEQ ID NO: 134144 - RNA, 64 nt, Human
cacuuugggaggcugaggcgggcagaucgcuugaggucaggaguucaagaccagcccgggcaac

SEQ ID NO: 134145 - RNA, 64 nt, Human
uacuuugggaggccgagucagguggaucaccugaggucaggaguucaagaccagccuggccaac

SEQ ID NO: 134146 - RNA, 64 nt, Human
agcacuuugggaggcugaggcaggcggaucacgaggucaggagauggagaccauccuggcuaac

SEQ ID NO: 134147 - RNA, 64 nt, Human
cacuuugggaggccaagguggggggauuacccgaggucaggaauucgagaccagccugaccaac

SEQ ID NO: 134148 - RNA, 64 nt, Human
aaccacaauguuucuucauuucucugcauggguuggucaggagaaugaaacagcuagagaagga

SEQ ID NO: 134149 - RNA, 64 nt, Human
cacuuugggaggccgagguaggcgggucaguugaggucaggaguucaagaccaggcuggccaac

SEQ ID NO: 134150 - RNA, 64 nt, Human
cacuuugggaggcugagacggguggauuaccugaggucaggacuucaagaccagccuggccaac

SEQ ID NO: 134151 - RNA, 64 nt, Human
cacuuugggaggccgaggcagguggaucacuugaggucaggaguucgagagcagccuggccaau

SEQ ID NO: 134152 - RNA, 64 nt, Human
ggaauaaaucaaauuacuucaucucuaggucacgggucaggaaacauuugggcagcugcucccu

SEQ ID NO: 134153 - RNA, 64 nt, Human
cuggaccuaggaaaagaggcuuuuggcuccagguggucaggacaguggggguuggggguggggu

SEQ ID NO: 134154 - RNA, 64 nt, Human
agcacuuugggaggccgaugugggcagaucacaaggucaggaguucaagaccagccuggccaac

SEQ ID NO: 134155 - RNA, 64 nt, Human
gcaggugggaacccugggccuggaugugaggggcggucaggaagggguacagguggguucccuc

SEQ ID NO: 134156 - RNA, 64 nt, Human
gugcacugccccaaagugagaacuugcucuacguggucaggaaagagcagggagaccaagcaga

SEQ ID NO: 134157 - RNA, 64 nt, Human
agcacuuugggaggcugaggcggguggaucaugaggucaggaguucgagaccagcccgcccaau

SEQ ID NO: 134158 - RNA, 64 nt, Human
gaagguucgccccuccccgaggaagaaggcuucuggucaggacccccaccccaaggcuggggac

SEQ ID NO: 134159 - RNA, 64 nt, Human
cacuuugagaggccgaagcgaguggaucaccugaggucaggauuuugagaccagccugaccaac

SEQ ID NO: 134160 - RNA, 64 nt, Human
guguugcagaagguuuacucuguggccaaaggagggucaggaaggaugagcauuuagggcaagg

SEQ ID NO: 134161 - RNA, 64 nt, Human
aacacuuugggaggcugaggcaggcagaucacgaggucaggaguucgagaccagccugaccaac

SEQ ID NO: 134162 - RNA, 64 nt, Human
gggggcucuuucgcugcagccuccaccgugcugaggucaggaggccgacguggcaguugugguc

SEQ ID NO: 134163 - RNA, 64 nt, Human
cacuuugggaggcugcggcaggcggaucacuugaggucaggaguccaagaccagccuggccaac

SEQ ID NO: 134164 - RNA, 64 nt, Human
agcacuuugggaggccgagguggguggaucacgaggucaggagaucgagaccauccuggcuaac

SEQ ID NO: 134165 - RNA, 64 nt, Human
cacuuugggaggccgaggugggcagaucaccugaggucaggaguucaagaccagccuggccaac

SEQ ID NO: 134166 - RNA, 64 nt, Human
acagacucuuacguggagagugcacugaccuguaggucaggaccaucagagaggcaagguugcc

SEQ ID NO: 134167 - RNA, 64 nt, Human
agcacuuugggaggccgaggcgggcggaucacgaggucaggagauugagaccagccugacuaac

SEQ ID NO: 134168 - RNA, 64 nt, Human
uuuuuaaaaaguuacaugaaacuaacauuccaagggucaggaaaaaaaccaauuauguauaguc

SEQ ID NO: 134169 - RNA, 64 nt, Human
aacacuuugggagucugaggcgggcggaucaugaggucaggagauuaagaccagcuuggccaac

SEQ ID NO: 134170 - RNA, 64 nt, Human
uacuuugggagguugaggcgggcagaucacuugaggucaggaguuugagauuggccuggucaac

SEQ ID NO: 134171 - RNA, 64 nt, Human
ugucagcaagaccauggggacuucaagagccuguggucaggaaaucagguccagccuucccugu

SEQ ID NO: 134172 - RNA, 64 nt, Human
gaaaagcgguaaauauaggauuggugaccaauugggucaggaaguccaguguucuggacuuggg

SEQ ID NO: 134173 - RNA, 64 nt, Human
uuuggagucuuuucucugaagucaccaggccaggggucaggagagagauggauucccaagggau

SEQ ID NO: 134174 - RNA, 64 nt, Human
cagaugugggcaggcagcccgggcugcacuaugcggucaggauuccuugcugcuuuggugggac

SEQ ID NO: 134175 - RNA, 64 nt, Human
gcaccuugggggucaagguggguggaucacuugaggucaggaguuugaggccagccuggccaac

SEQ ID NO: 134176 - RNA, 64 nt, Human
agcacuuugggaggccgagaugggugaaucaugaggucaggaguucgagaccagccuaaacaac

SEQ ID NO: 134177 - RNA, 64 nt, Human
ucagcuggcugggucaaggcaccauguguuacuuggucaggacagagacaaaaaugaggaaaac

SEQ ID NO: 134178 - RNA, 64 nt, Human
agcacuuugggaggccgaggcaggcggaucacaaggucaggaauucgagaccagccugaccaac

SEQ ID NO: 134179 - RNA, 64 nt, Human
cccccaguugaggaguugagagagugcaggcuggggucaggacaggcugcggaugcuugugccu

SEQ ID NO: 134180 - RNA, 64 nt, Human
cuccuuccugggcuccaggaaaguguuucugggaggucaggagggcuggcagcugaacgcacuu

SEQ ID NO: 134181 - RNA, 64 nt, Human
ccagcaucucccacccacccagcuagggcagaggggucaggaugucuguuugccucuuagagac

SEQ ID NO: 134182 - RNA, 64 nt, Human
guggaggccacguagaagggggcagaggagggguggucaggaugggcuggggggcccacuagca

SEQ ID NO: 134183 - RNA, 64 nt, Human
cacuguaggcggccgaggugggugaaucacaugaggucaggaguucaagaccagccugaccaac

SEQ ID NO: 134184 - RNA, 64 nt, Human
cacuaugggaggccagggagggaggaucuccagaggucaggaguucgagaccagccuggccaac

SEQ ID NO: 134185 - RNA, 64 nt, Human
ggcugguacauccgcccaccaugucccccugcugggucaggagccaacacaggacccugcgugu

SEQ ID NO: 134186 - RNA, 64 nt, Human
gccuggcagggggugaaggcaggaguugggggcaggucaggaccaggacccagggagaggcugu

SEQ ID NO: 134187 - RNA, 64 nt, Human
agcacuuugggaggccgaggugggcaaaucaugaggucaggagauugagaccuuccuggcuaac

SEQ ID NO: 134188 - RNA, 64 nt, Human
uuuugccuugucaauguauuuaaaguuuacuuaaggucaggaaauucuaaaacaacuuuucugg

SEQ ID NO: 134189 - RNA, 64 nt, Human
agcacuuugggaggccgaagcaggcggaucacgaggucaggaggucgagaucauccuggcuaac

SEQ ID NO: 134190 - RNA, 64 nt, Human
caauuugggaggccaaggugggcagaucacuugaggucaggaguucgcgaccagccuacccaac

SEQ ID NO: 134191 - RNA, 64 nt, Human
agcacuuugggaggccgaggccggugauucacaaggucaggaguucaagaccagccuggccaag

SEQ ID NO: 134192 - RNA, 64 nt, Human
agcacuuugggaggcugagguggguggaucacaaggucaggaguuugagaccagccuggccaag

SEQ ID NO: 134193 - RNA, 64 nt, Human
ccuucuggagccagcucaucagcucagagcccagggucaggaguucguucaguaacgcagcggg

SEQ ID NO: 134194 - RNA, 64 nt, Human
cacuuuaggaggccaaggcggguggaucaccugaggucaggaguucgagaccagccuggccaac

SEQ ID NO: 134195 - RNA, 64 nt, Human
cacuuugggaggccgaggcgaguggauuuccuaaggucaggaguuugagaccagccugagcaau

SEQ ID NO: 134196 - RNA, 64 nt, Human
cacuucgggaggcugaagcaagcagaucacuugaggucaggaguuugagaccagccuggccaac

SEQ ID NO: 134197 - RNA, 64 nt, Human
uguauuuuuaguagagacgggguuucaccauguuggucaggauggucucaauccuggccucuug

SEQ ID NO: 134198 - RNA, 64 nt, Human
ccuuacuaaucacuggugaugauaagaaggauugggucaggaagagugggagaaagaaauuccu

SEQ ID NO: 134199 - RNA, 64 nt, Human
cacuuugggaggccaagguggguggaccacaugaggucaggaguuugagaucagccuggccaac

SEQ ID NO: 134200 - RNA, 64 nt, Human
gacuuugguaggccaagacaagcagaucacuugaggucaggaguucaacaucagccuggccaac

SEQ ID NO: 134201 - RNA, 64 nt, Human
agccucuuucccucugccacaguuaucaagaaugggucaggagaccgcugcuucugggcauaag

SEQ ID NO: 134202 - RNA, 64 nt, Human
agcacuuugggaggccaaggagggaggaucacaaggucaggagaucgagaccauccuggcuaac

SEQ ID NO: 134203 - RNA, 64 nt, Human
cacuuuggcaggccaaggcagguggaucaccugaggucaggaguucaugaccagccuggccagc

SEQ ID NO: 134204 - RNA, 64 nt, Human
ugccagugaggcuggaggcuggagguggagauggggucaggaacaucuggcagagggagguccc

SEQ ID NO: 134205 - RNA, 64 nt, Human
cccuuugggaggccaaggcggguggaucacuugaggucaggaguucaagaccagccuggccaac

SEQ ID NO: 134206 - RNA, 64 nt, Human
aguuauuaaaaauguauaugaaugcuccuaauauggucaggaagcaaggaagcgaaggauauau

SEQ ID NO: 134207 - RNA, 64 nt, Human
cacuuugagaggccaagguggguagaucaucugaggucaggaauucaagaccagccuggccaac

SEQ ID NO: 134208 - RNA, 64 nt, Human
uuaacagaaagagcacauuuguggacuuccagauggucaggagaugagcaaaggauugguaugu

SEQ ID NO: 134209 - RNA, 64 nt, Human
agcacuuugggaggcugaggcgggcagaucaugaggucaggaguuugagaccaggcuggccaac

SEQ ID NO: 134210 - RNA, 64 nt, Human
agcacuuugggaggccgaggcgggcggaucacgaggucaggagaucgagaccaucccggcuaaa

SEQ ID NO: 134211 - RNA, 64 nt, Human
cacuuugggaggcugaggcaggcggaucacuugaggucaggaguuugaaacuagccuggccaac

SEQ ID NO: 134212 - RNA, 64 nt, Human
gcccuuugggaggccgaaugggcagaucacuugaggucaggaguuugagaccagccucgccaac

SEQ ID NO: 134213 - RNA, 64 nt, Human
agcacuuugggaggcugaggcggguggaucacgaggucaggagaucgagaccauccuggcuaac

SEQ ID NO: 134214 - RNA, 64 nt, Human
gcacuuugggaggcugaggcaggcaaucacuugaggucaggaguucgagaccagccuggccauc

SEQ ID NO: 134215 - RNA, 64 nt, Human
cacuuugggaggccaagguaggcagaucaccugaggucaggaguucaagaccagccuggccaac

SEQ ID NO: 134216 - RNA, 64 nt, Human
agcacuuugggaggcugagaagggcggaucacgaggucaggagauggagaccauccuggcuaac

SEQ ID NO: 134217 - RNA, 64 nt, Human
cacucugggaggcugagacagguagaucauuugaggucaggaguucaaaaccaaccuggucuac

SEQ ID NO: 134218 - RNA, 64 nt, Human
ggguccuggggccucggagccucauccgaggcagggucaggagaggggcagaacagccgcuccu

SEQ ID NO: 134219 - RNA, 64 nt, Human
caauuugggaggccgaggugggcagaucacuugaggucaggaguucaagacuagccuggucaac

SEQ ID NO: 134220 - RNA, 64 nt, Human
agcacuuugggaggccgaggcgggcggaucacgaggucaggagauugagaccauccuggcuacg

SEQ ID NO: 134221 - RNA, 64 nt, Human
cacuuugggaggccgaggcaggaggaucaccugaggucaggaguuugagaccagucuggccaaa

SEQ ID NO: 134222 - RNA, 64 nt, Human
ucucccugccucucucucugggggcgauggggaaggucaggaguccagcccauucccagggugu

SEQ ID NO: 134223 - RNA, 64 nt, Human
aaaaguuugaaugaugaauacuguaaaucuuuuuggucaggaggauuauauucucaugauucag

SEQ ID NO: 134224 - RNA, 64 nt, Human
agcacuuugggaggccgagguggguggaucacgaggucaggagaucgagaccaucccggcuaac

SEQ ID NO: 134225 - RNA, 64 nt, Human
gcuguggaucgcccugggcugggcaccagugacaggucaggaucuccaaacauggacguccucc

SEQ ID NO: 134226 - RNA, 64 nt, Human
agugcccaggagagggucugaggggugggaugggggucaggacaauuuugcaaaagaaguagcu

SEQ ID NO: 134227 - RNA, 64 nt, Human
agcacuuugggaggccgaggugggcggaucacgaggucaggagaucgagaccauccuggcuaac

SEQ ID NO: 134228 - RNA, 64 nt, Human
agaggaccucgcccuggagcugagccuggcgccgggucaggacggagggaagggcggguugggg

SEQ ID NO: 134229 - RNA, 64 nt, Human
cacuuugggaggccaaggaggguggaucacuuaaggucaggaguuugagaccagccuggccaac

SEQ ID NO: 134230 - RNA, 64 nt, Human
cacuuugggaagccgaggugggcggaucaccugaggucaggaguucgagaccagccugaccaac

SEQ ID NO: 134231 - RNA, 64 nt, Human
agcacuuugggaggccgaggcgggcagaucauuaggucaggagaucgagaccauccuuacuaag

SEQ ID NO: 134232 - RNA, 64 nt, Human; identical to SEQ ID NO: 134211

SEQ ID NO: 134233 - RNA, 64 nt, Human
cacuuugggaggcugaggugggcagaucaccugaggucaggaguucgagaccagccuggccaac

SEQ ID NO: 134234 - RNA, 64 nt, Human
cauacuugaauauuagagaaggagaggagcugugggucaggaaucagagagaccugcuaaaacc

SEQ ID NO: 134235 - RNA, 64 nt, Human
cauuguguuagcuuuuauuuccuggauaguaacuggucaggauauauuuuaaugauauuugaaa

SEQ ID NO: 134236 - RNA, 64 nt, Human
agcacuuugggaggccgaggcgggcggaucacaaggucaggagaucgagaccauccuggcuaac

SEQ ID NO: 134237 - RNA, 64 nt, Human
ccguggucagagugccacugcgggagcucuguauggucaggauguagggguuaacuuggucaga

SEQ ID NO: 134238 - RNA, 64 nt, Human
aguacuuugggaggccgaggcggguggaucacaaggucaggaguucgagaccagccuggccaau

SEQ ID NO: 134239 - RNA, 64 nt, Human
gacuuugggaagcugagguggacggaucauuugaggucaggaguucaagaccagccugaccaac

SEQ ID NO: 134240 - RNA, 64 nt, Human
uuggccagagccuucaggagguggaggccggugaggucaggagcccagcucuccagggggcuuc

SEQ ID NO: 134241 - RNA, 64 nt, Human
aacuaugugaggcugaggcagguggaucacuugaggucaggaguucaacaccagccuggccaac

SEQ ID NO: 134242 - RNA, 64 nt, Human
agcacuuuggaaggcugaggagggcggaucacaaggucaggagaucaagaccauccuggcuaac

SEQ ID NO: 134243 - RNA, 64 nt, Human
agcacuuugggaggccgaggcgggcgaaucacgaggucaggaguucaagaccagccuggccaac

SEQ ID NO: 134244 - RNA, 64 nt, Human
ugaaguccaucagguuuucuguugcacaaggacgggucaggaaggaaggagaggcuuuuccaga

SEQ ID NO: 134245 - RNA, 64 nt, Human
acagguucaguuuugaacuggcccugaggaaaugggucaggaguuguauuggcaagagggaggg

SEQ ID NO: 134246 - RNA, 64 nt, Human
cacuuugggaggcugagguagguggaaaaccugaggucaggaguucaagaacagccugaccaac

SEQ ID NO: 134247 - RNA, 64 nt, Human
aauaaacugcagacugaaagaaacaugccugcagggucaggaacugggccacuguucccagaac

SEQ ID NO: 134248 - RNA, 64 nt, Human
agcacuuugggaggccaaggcgggcagaccaugaggucaggagauugagaccauccuggccaac

SEQ ID NO: 134249 - RNA, 64 nt, Human
cacuuugggaggccgaggcagacagaucaccugaggucaggaguuugagaccagccuggccaac

SEQ ID NO: 134250 - RNA, 64 nt, Human
agcacuuugggaggccaaggcgggcagaucacgaggucaggaguuucagaccaauauggugaaa

SEQ ID NO: 134251 - RNA, 64 nt, Human
uacuuugggaggccaaggcaggaggauugcuugaggucaggaguuuuagaccagccuggacaac

SEQ ID NO: 134252 - RNA, 64 nt, Human
cacuuugggaggcugaggcaggugaaucaccugaggucaggaguucaagaccagccuggccaac

SEQ ID NO: 134253 - RNA, 64 nt, Human
uacuuugggaggccaaggugggcagauaaccugcggucaggaguuugagaccaggcuggacaac

SEQ ID NO: 134254 - RNA, 64 nt, Human
gaugcuuaauacacagucuguucuccugugucuaggucaggaacuccaguuugcuuuucuguuu

SEQ ID NO: 134255 - RNA, 64 nt, Human
cacuuugggaguccaaggcaggcauaucauuugaggucaggaguuuaagaccagccuggcuaac

SEQ ID NO: 134256 - RNA, 64 nt, Human
accuugguuuccgcacaccuucgcaaugugaacaggucaggagucccucccguccaccuccucu

SEQ ID NO: 134257 - RNA, 64 nt, Human
cauuuugggaagcuaagauggguggaucacuugaggucaggaguuugagaccagccuggccaac

SEQ ID NO: 134258 - RNA, 64 nt, Human
cucuauuuuuuucuuacugagauucuuacuuuggggucaggaacuugaagggaugcuuggagug

SEQ ID NO: 134259 - RNA, 64 nt, Human
cuagaaacaccaggcccagacacacggucccucaggucaggaggagugagcagccggcacagcc

SEQ ID NO: 134260 - RNA, 64 nt, Human
uguuuggacuuagugccugucuggcagccuguggggucaggagaagcacccccagggcagcccu

SEQ ID NO: 134261 - RNA, 64 nt, Human
cgcuuugggaggccgcgguggguggaucaccugaggucaggaguucgagaccagccuggccaac

SEQ ID NO: 134262 - RNA, 64 nt, Human
agcacuuugggaggccgaggcagguagaucaugaggucaggagaucaaaaccauccuggcuaac

SEQ ID NO: 134263 - RNA, 64 nt, Human
agcacuuugggaggccaaggugggcggaucacgaggucaggaguucgagggcagccugaccaac

SEQ ID NO: 134264 - RNA, 64 nt, Human
caccuugggaggcugaggcagguggaucaccuaaggucaggaguucaacaacaccagccugacc

SEQ ID NO: 134265 - RNA, 64 nt, Human
aguaucuuuuauuuuuuaauuucgacaauaaaaaggucaggauggcguuuucuggaggguagau

SEQ ID NO: 134266 - RNA, 64 nt, Human
agcacuuugggaggccgaggcaggcgaaucacgaggucaggaguucgagaccagccugcccaac

SEQ ID NO: 134267 - RNA, 64 nt, Human
aacuuugggaggcccagacagaaggaucgcuugaggucaggaauuugagaccuggccaacaugg

SEQ ID NO: 134268 - RNA, 64 nt, Human
gcacuuugagaggaugagguaggcggaucacuggggucaggauuucgagaccagccuggccaac

SEQ ID NO: 134269 - RNA, 64 nt, Human
cgcucugggaggcugaggcaggaggaucacuugaggucaggaguucaauguggacaacacagua

SEQ ID NO: 134270 - RNA, 64 nt, Human
acuuuucggaggccgaggagggcagaucacuugaggucaggaguucaagaccagccuggccaac

SEQ ID NO: 134271 - RNA, 64 nt, Human
aaucuguuuuguuacagagacaugccucucagaaggucaggagguuuugaguaccuauccuugc

SEQ ID NO: 134272 - RNA, 64 nt, Human
cacuuugggaggccugaguggauggaucacuugaggucaggaguucaggaccagccuggccaac

SEQ ID NO: 134273 - RNA, 64 nt, Human
cacuuugggaggccgaggugagcggaucaccugaggucaggaguuuugagaccagccuggccaa

SEQ ID NO: 134274 - RNA, 64 nt, Human
uuccuugucuccaaaaugagaauaauaaaauuuaggucaggauuacuauauaaacuaagauaau

SEQ ID NO: 134275 - RNA, 64 nt, Human; identical to SEQ ID NO: 134088

SEQ ID NO: 134276 - RNA, 64 nt, Human
agcacuuugggaggccaaggcggguggaucaugaggucaggagaucaagaccauccuggccaac

SEQ ID NO: 134277 - RNA, 64 nt, Human
cacuuugggaggcugagguggguggaucaccugaggucaggaguucgagaccagccucgccaac

SEQ ID NO: 134278 - RNA, 64 nt, Human
agcacuuugggaggccaaggugggcagaucaggaggucaggagaucgagaccaucuuggcuaac

SEQ ID NO: 134279 - RNA, 64 nt, Human
cagcacuuugggagguugcggguggaucacuugaggucaggaguucgagaccagccuggccaac

SEQ ID NO: 134280 - RNA, 64 nt, Human
augcggucgugcacacgcgcuagguagcagcgucggucaggacugucucgaggccacacucgcu

SEQ ID NO: 134281 - RNA, 64 nt, Human
gcaggauuaugcgaucacggaucagucagagcagggucaggagacggggcugacggcacgggug

SEQ ID NO: 134282 - RNA, 64 nt, Human
gcagaggcacaacuccaggaauucucuagcuccuggucaggaagccaaucugaaaacaggcaug

SEQ ID NO: 134283 - RNA, 64 nt, Human
cacuuugggaggcaggggcggguggaucaccugaggucaggaguucaagacuagccuggccaac

SEQ ID NO: 134284 - RNA, 64 nt, Human
cacuuugagaggcugaggugguaggaucaccugaggucaggaguucaagaccagccuguccaac

SEQ ID NO: 134285 - RNA, 64 nt, Human; identical to SEQ ID NO: 134099

SEQ ID NO: 134286 - RNA, 64 nt, Human
gcacuuugggaggugagguggguggaucaucugaggucaggaguucaagaccagccuggccaac

SEQ ID NO: 134287 - RNA, 64 nt, Human
caguuugggaggcugagccggguggaucgccugaggucaggaguucaagacaagccuggccuac

SEQ ID NO: 134288 - RNA, 64 nt, Human
cacuuugguaggcugagguggguggauuacuugaggucaggaguucaaaaccagccuggccaac

SEQ ID NO: 134289 - RNA, 64 nt, Human
agcacuuugggaggccaaggugggcggaucaugaggucaggagaucgagaccauccugaccaac

SEQ ID NO: 134290 - RNA, 64 nt, Human
agauaccuauggagaggggaaguaaaacaccuuaggucaggaauaauaaaccaaugaguuagcu

SEQ ID NO: 134291 - RNA, 64 nt, Human
cccuuugggaggcugagguggguguaucacuugaggucaggaguucaagaccaaucuggccaac

SEQ ID NO: 134292 - RNA, 64 nt, Human
gacccacaacgugugagcccucuaccuggguucgggucaggagcuccaucugggaacuaacagc

SEQ ID NO: 134293 - RNA, 64 nt, Human
cacuuugggaggccgaggcgggcggaugaccugaggucaggaguucaagaccagccuggccaac

SEQ ID NO: 134294 - RNA, 64 nt, Human
cacuuugggaggccgaggcggguggaucauuugaggucaggaguuugaaaccagccuggccaac

SEQ ID NO: 134295 - RNA, 64 nt, Human
agcacuuugggaggccaaggcgggcggaucaugaggucaggagaucgagaccauccuggcuaac

SEQ ID NO: 134296 - RNA, 64 nt, Human
gcaagauggggagugagcugauggcuccgagacuggucaggagcccaggccagugagauggggc

SEQ ID NO: 134297 - RNA, 64 nt, Human
agcacuuugggaggccgaggcggguggaucaugaggucaggagaucaagaccauccuggccaac

SEQ ID NO: 134298 - RNA, 64 nt, Human
gucgagggcugaaucuuucuccucuaagcagucuggucaggaaccuugguuucuugagaggccc

SEQ ID NO: 134299 - RNA, 64 nt, Human
agcacuuugggaggccgaggcgggcggaucaugaggucaggaguucgagaccaaccgaccaaca

SEQ ID NO: 134300 - RNA, 64 nt, Human
agcacuuugggaggccaauguggguggaucaugaggucaggaguucaagaccagccuagccaag

SEQ ID NO: 134301 - RNA, 64 nt, Human
cacuuugggaggcugaggcgggcagaucaccugaggucaggaguuggagaccagccugaccaac

SEQ ID NO: 134302 - RNA, 64 nt, Human
uguauuuuuaguagaggcgggguuucaccaugcuggucaggauguucuccaacuccugacuuca

SEQ ID NO: 134303 - RNA, 64 nt, Human
uguauuuuuaguagagacgggguuucaccauguuggucaggauggucuccaucucuugacauug

SEQ ID NO: 134304 - RNA, 64 nt, Human
gguacuccaaauugacuuugcagcaggguggcagggucaggagagucugguccugccuagcuca

SEQ ID NO: 134305 - RNA, 64 nt, Human
aagcaucaggugaaaagcaggagaccaaagaaguggucaggaacaaucaucagcccuccucugg

SEQ ID NO: 134306 - RNA, 64 nt, Human
aagugagcauagcuaucaaaagccacaaaguuuuggucaggacuguaaaucucucgcagacccu

SEQ ID NO: 134307 - RNA, 64 nt, Human
gcucaggaccuuggcugggccuggucgucauguaggucaggaccuuggcuggaccuggaggccc

SEQ ID NO: 134308 - RNA, 64 nt, Human
cacuuugggaggccgaggcaggcggaucacuugaggucaggaguucaaaaccagccuggccaag

SEQ ID NO: 134309 - RNA, 64 nt, Human
aggacaaacgggcucgggucugggcagcaccucuggucaggagggucacccuggccugccaguc

SEQ ID NO: 134310 - RNA, 64 nt, Human
cauuuugggaggcagagguagguggaucaccugaggucaggaguucaagaccagccuggccaac

SEQ ID NO: 134311 - RNA, 64 nt, Human
agcacuuugggaggccgaggcagguggaucacgaggucaggagaucgagaccauccuggcuaac

SEQ ID NO: 134312 - RNA, 64 nt, Human
cacuuugggaggccgaggcauguggaucaccugaggucaggaguuugagaccagccuagacaac

SEQ ID NO: 134313 - RNA, 64 nt, Human
ccuccuuaugacgcggcucaaaaggaaaccaaguggucaggaguuguuucugacccacugaucu

SEQ ID NO: 134314 - RNA, 64 nt, Human
uagcaccuucagggcugaguucuggguuucuagaggucaggacggcuccucagagcgccaggaa

SEQ ID NO: 134315 - RNA, 64 nt, Human
agcacuuugggaggccgaggcgggcggaucaugaggucaggagaucgagaccauccuggcuaac

SEQ ID NO: 134316 - RNA, 64 nt, Human
gccucucuccauguuuggucccuucugugcccauggucaggagcuauucggguggcaccucgcu

SEQ ID NO: 134317 - RNA, 64 nt, Human
uagcaggaggcccagaucacccauccuccccuggggucaggagaggccgagccccaggccacug

SEQ ID NO: 134318 - RNA, 64 nt, Human
uugggaggcugaggcgggugaaucacuugauugaggucaggaguucgagaccagccuggccaac

SEQ ID NO: 134319 - RNA, 64 nt, Human
cacuuugcaaggccgaggaggguggaucacuugaggucaggaguucgagaccagccugaccaac

SEQ ID NO: 134320 - RNA, 64 nt, Human
agcauuuugggaggcugagguaggcggaucacaaggucaggagaucgagaccauccuggccaac

SEQ ID NO: 134321 - RNA, 64 nt, Human
agcacuuugggaggcugaggcggguagaucacaaggucaggagaucaggaccauccuggcuaac

SEQ ID NO: 134322 - RNA, 64 nt, Human
cacuuugggaagccgaggcgggcugaucgcuugaggucaggaguucgagaccagccuggccaaa

SEQ ID NO: 134323 - RNA, 64 nt, Human
auaaaaauaugaaaacaguacacuguuguagguuggucaggaaagggaaugauuguggcuugga

SEQ ID NO: 134324 - RNA, 64 nt, Human
caccuguuuuaugugccgaaucacuguggggaaaggucaggaagguauaguccuucaauaggaa

SEQ ID NO: 134325 - RNA, 64 nt, Human
acuuggccccuccaccugucccuaacggacggcaggucaggaaagccaggacucaggggagaag

SEQ ID NO: 134326 - RNA, 64 nt, Human
aacacuuugggaggcccaggcgggcggaucacgaggucaggagaucgagaccauccuggcuaac

SEQ ID NO: 134327 - RNA, 64 nt, Human
agcacugugggaggccgagacggguggaucacaaggucaggagaucgagaccauccuggcuaau

SEQ ID NO: 134328 - RNA, 64 nt, Human
uugcucaggcucagagggaccucaccccugagcaggucaggacucagaacagucuggcgucucc

SEQ ID NO: 134329 - RNA, 64 nt, Human
cacuuugguagaccgaagugggcagaucaccugaggucaggaguucacgaccagccuggccaac

SEQ ID NO: 134330 - RNA, 64 nt, Human
agcacuuugggaggcugaggugaguggauuacaaggucaggaguuccagaccagccuggcuaau

SEQ ID NO: 134331 - RNA, 64 nt, Human
agcacuuugggaggccgagguggguggaucacaaggucaggaguucgagaccagccugaccaac

SEQ ID NO: 134332 - RNA, 64 nt, Human
cacuuuuggaggccaagguggguggaucaccugaggucaggaguucaagaccagccuggccaac

SEQ ID NO: 134333 - RNA, 64 nt, Human
cacuuugggaggccaaggaggguggaucaccugaggucaggaguucgagaccagccuggccaac

SEQ ID NO: 134334 - RNA, 64 nt, Human
cacuuugggaggcugaggcggguggaucaccugaggucaggaguuugugaccagccuggccaac

SEQ ID NO: 134335 - RNA, 64 nt, Human
cacuuugggaggccaaggcagguggaucaccugaggucaggaguucgagaccaaccuggccaac

SEQ ID NO: 134336 - RNA, 64 nt, Human
uuugggaggccaagcgggggugcagaucaccugaggucaggaguuugagaccagccuggccaau

SEQ ID NO: 134337 - RNA, 64 nt, Human
gucaccaggccacugugcagugggcgcagagcauggucaggaguggccugcccguacuccucca

SEQ ID NO: 134338 - RNA, 64 nt, Human
acagcucauuuucccuaguccgccuucguucaagggucaggaauggaccagaacagauggguuc

SEQ ID NO: 134339 - RNA, 64 nt, Human
guagguggccccugaugccccaucuacagcaggaggucaggaccacgccccuggccucucccca

SEQ ID NO: 134340 - RNA, 64 nt, Human
gccugggauccggugauggucugggcagaggcugggucaggagucccaaaggucagugacaguu

SEQ ID NO: 134341 - RNA, 64 nt, Human
gucuuggagguggucccccagaucugcgccugggggucaggacagggccugauuugagccuccu

SEQ ID NO: 134342 - RNA, 64 nt, Human
cacggagggcacagucuccugucaggcucggagaggucaggagaccgaccccaccacuaacuuu

SEQ ID NO: 134343 - RNA, 64 nt, Human
agcacuuugggaggccgaggcgggcggaucacgaggucaggagaucgagaccgcccuggcuaac

SEQ ID NO: 134344 - RNA, 64 nt, Human
accuggccagcacugcucccagcacugcgcaccaggucaggaggaccuggaguggacuagaauc

SEQ ID NO: 134345 - RNA, 64 nt, Human
guuccacacagggcagcagggagcgcaaggcucaggucaggauggacaccacucaugcgagcau

SEQ ID NO: 134346 - RNA, 64 nt, Human
ucagucaugacuagugccuagaaagcaaugugauggucaggaucucaugacauuauauuugagu

SEQ ID NO: 134347 - RNA, 64 nt, Human
cauacaggaaaaacgaggcaggcagaucacuuuaggucaggaguucaagaccagccuguacgug

SEQ ID NO: 134348 - RNA, 64 nt, Human
aggaagagagcaggacaaggcagacagaaggucaggucaggaacuggugcuguacuggguacac

SEQ ID NO: 134349 - RNA, 64 nt, Human
acacugaucacuaaaugaauggaugaucuacucgggucaggauugaaagagaaauauuucaaca

SEQ ID NO: 134350 - RNA, 64 nt, Human
aacagacucaaugucccccucacccccaccucaaggucaggaugagaacacacugagugaggag

SEQ ID NO: 134351 - RNA, 64 nt, Human
cacuuugggaagcugaggcaggaggauccccugaggucaggaguucgagagcagccuggccaac

SEQ ID NO: 134352 - RNA, 64 nt, Human
uaaauauauugucuuucucuuaauauuugcucugggucaggaagaagcuguucacggugugaua

SEQ ID NO: 134353 - RNA, 64 nt, Human
gggaaugcaugugcgucacaucuuucauauuaugggucaggauagauucauuucuugcaacaua

SEQ ID NO: 134354 - RNA, 64 nt, Human
gugggcuggguggccccauccuaccaggcccugaggucaggauggggagcugcugccuuugggg

SEQ ID NO: 134355 - RNA, 50 nt, Human
aaggccgguggaucaucugaggucaggaguucgagaccggccugaccaac

SEQ ID NO: 134356 - RNA, 64 nt, Human
gcaagcagcgggcuaacgggaggcugggcacagaggucaggaagcagggguggggggugcaggu

SEQ ID NO: 134357 - RNA, 64 nt, Human
cacuuugggaggccaaggcugguggaucaccugaggucaggaguucgagaccagccuggccaac

SEQ ID NO: 134358 - RNA, 64 nt, Human
cacuuugggaggcuuaggcggcuggaucaccugaggucaggaguucaagaccagccuggucaac

SEQ ID NO: 134359 - RNA, 64 nt, Human
agcacguugggaggccaagucgggcggaucacaaggucaggagaucaaggccauccuggccaac

SEQ ID NO: 134360 - RNA, 64 nt, Human
agcacuuugggaggccaaggcgggcggaucacgaggucaggagaucgagaccguccuggcuaac

SEQ ID NO: 134361 - RNA, 64 nt, Human
uucacuuugggaggcugaggcggguggaucacaaggucaggaguucgagaccagccuggucaac

SEQ ID NO: 134362 - RNA, 64 nt, Human
uacuuugggaggcugaggugggcaaaucaccugaggucaggaguuccagaccagccuggccaac

SEQ ID NO: 134363 - RNA, 64 nt, Human
aaccuguuuuacuacuauggcacuuugauaaaauggucaggaaccaacuuuacuggcaaaaggg

SEQ ID NO: 134364 - RNA, 64 nt, Human
caccuggggaggcugaggugaguggaucacuagaggucaggaguucaagaccagucuggccgac

SEQ ID NO: 134365 - RNA, 64 nt, Human
gccaagaccgugaucaagguagcuuaagagagauggucaggagaaaacacuguuuuuguuuuuu

SEQ ID NO: 134366 - RNA, 64 nt, Human
gcacuuugggaggcgaggcggggguggaucacaaggucaggagaccagccuggccaacauggcg

SEQ ID NO: 134367 - RNA, 64 nt, Human
agcacuuugggaggccgaggcgaguggaucacgaggucaggagaucgagaccauccuggcuaac

SEQ ID NO: 134368 - RNA, 64 nt, Human
acagacagugcucagugcaaaucaacauuccagcggucaggacugaccccggggcagcacuggg

SEQ ID NO: 134369 - RNA, 64 nt, Human
cagaugaggaggccacuguccagggccaugcaguggucaggacagaccugaguguggcgccccc

SEQ ID NO: 134370 - RNA, 64 nt, Human
cccccgcuuucaaacaaguuuucaaauuguuugaggucaggauuucucaaacugauuccuuucu

SEQ ID NO: 134371 - RNA, 64 nt, Human
ggcugucuccccacagcuuuauccaagccuccaaggucaggaugggaucucuguaucauguuuu

SEQ ID NO: 134372 - RNA, 64 nt, Human
uaguucagggaugagugguuucuggggcaucugaggucaggaguuugaaaccagccuggccaac

SEQ ID NO: 134373 - RNA, 64 nt, Human
agcacuuugggaggccgaggcgggaggaucaugaggucaggagaucgagaccauccuggcuaac

SEQ ID NO: 134374 - RNA, 64 nt, Human
aacauuuugggaggccgagaaggguggaucaugaggucaggagauggagaccauccuggccaac

SEQ ID NO: 134375 - RNA, 64 nt, Human
agcacuuugggaggccaaggugggcagaucaugaggucaggagaucgagaccauucuggccaac

SEQ ID NO: 134376 - RNA, 64 nt, Human
cacuuugggaggccgaggcagguugaucaccugaggucaggaguuugagacuagccuggccagc

SEQ ID NO: 134377 - RNA, 64 nt, Human
aaaaagccuguccaaagucuagcuuuauuuagagggucaggaagucaaagagcacccaggacca

SEQ ID NO: 134378 - RNA, 64 nt, Human
agcacuuugggaggcugaggcggguggaucacgaggucaggagauugagaccauccuggccaac

SEQ ID NO: 134379 - RNA, 64 nt, Human
agcacuuugggaggccgaggcgggcggaucacgaggucaggagaucgagaccauccuggcuaac

SEQ ID NO: 134380 - RNA, 64 nt, Human
uucuccucagucuccuguccaauuucuugcugguggucaggaggcauagggaggcaggagggaa

SEQ ID NO: 134381 - RNA, 64 nt, Human
aguuucuggccuuuacacagucaccuuucacugaggucaggagccccugagcaguggcugcucc

SEQ ID NO: 134382 - RNA, 64 nt, Human
cacuuugggaggccgaggcggguggaucaccugaggucaggaguucaagagcagccuggccaac

SEQ ID NO: 134383 - RNA, 64 nt, Human
cacuuugggagggauaggugggcggaucaccugaggucaggaguuugagaccagccuggccaac

SEQ ID NO: 134384 - RNA, 64 nt, Human; identical to SEQ ID NO: 134088

SEQ ID NO: 134385 - RNA, 64 nt, Human
cacuuugguaggccgagguggacggaucacccgaggucaggaguuugagaccagccuggccaac

SEQ ID NO: 134386 - RNA, 64 nt, Human
ugggggccaaaguuuuuaugugggcagaugcuguggucaggaacuaggcaugcuuucuggcaau

SEQ ID NO: 134387 - RNA, 64 nt, Human
auaguuuuggagauaauuuugaaauuuuuuuuauggucaggauuauaaaagaagauuaaaaccu

SEQ ID NO: 134388 - RNA, 64 nt, Human
uacacccaaggaucaacugcuccugaagcaaagaggucaggauggaguaugcagaaguugggua

SEQ ID NO: 134389 - RNA, 64 nt, Human
cacuuugggaggcugagguaggcagaucacuugaggucaggaguuggagaccagccuggccaac

SEQ ID NO: 134390 - RNA, 64 nt, Human
agcacuuugggaggcugaggcggguggaucaagaggucaggagaucgagaccauccuggcuaag

SEQ ID NO: 134391 - RNA, 64 nt, Human
agcauuuugggaggccgaggcggguggaucaugaggucaggagaucgagaccauccuggcuaac

SEQ ID NO: 134392 - RNA, 64 nt, Human
agcacuuugggaggccgaggcaggcagaucacggggucaggagaucaagaccauccuggcuaac

SEQ ID NO: 134393 - RNA, 64 nt, Human
accuacaaaauacuccuuugcaaugauaauugugggucaggaaucuucuuccuguguggcagga

SEQ ID NO: 134394 - RNA, 64 nt, Human
agcacuuugggaggccgaggcgggcggaucaccaggucaggagaucaagaccauccuggcuaac

SEQ ID NO: 134395 - RNA, 64 nt, Human
cucaguuuccccagggaccccaccccccuuugggggucaggaacacuacacugcacaggaagcc

SEQ ID NO: 134396 - RNA, 64 nt, Human
gccuaacaggauaaauucagugauagcccaagcuggucaggagagacagaagugcuggcuagga

SEQ ID NO: 134397 - RNA, 64 nt, Human
aaguagcuccaccugaagagggauggaaccucugggucaggaaacagcuggaauccacacucac

SEQ ID NO: 134398 - RNA, 64 nt, Human
aagaauuaaauuuugugguaugucuuuuuguuuuggucaggauuaugaggucuugaguuuuuau

SEQ ID NO: 134399 - RNA, 64 nt, Human
ggcgggaaagcaggcuguccaggcugggcuugguggucaggaacaggggcagcucacgguggcu

SEQ ID NO: 134400 - RNA, 64 nt, Human
cacuuuggcaggccgagaugggcggaucuuuugaggucaggaguuugagaccagccuggccaac

SEQ ID NO: 134401 - RNA, 64 nt, Human
agacuuuggaaauuuccuuucucuuuuaggacagggucaggauuuaggacucauagccugaaag

SEQ ID NO: 134402 - RNA, 64 nt, Human
uucacgggccucagggccccagcagauggggcugggucaggaaccaucucugucccaggugcuc

SEQ ID NO: 134403 - RNA, 64 nt, Human
uauagcuuuauaaaaccagaguguguggggcugaggucaggaguauaaguaccugccuuaggca

SEQ ID NO: 134404 - RNA, 64 nt, Human
ccugggguuuaauuguugugcaguuucauagaugggucaggagguggacaaguuggggccagag

SEQ ID NO: 134405 - RNA, 64 nt, Human
uuugcaaaucucacaaagugcggcaagcccagcuggucaggaaagagaauacuugcagaggggu

SEQ ID NO: 134406 - RNA, 64 nt, Human
agcacuuugggaggccgaggcaggcagaucacaaggucaggaguucgagaccagccugaccaac

SEQ ID NO: 134407 - RNA, 64 nt, Human
agcacuuugggaggccgaggugggagaaucacaaggucaggagacugagaccauccuggcuaac

SEQ ID NO: 134408 - RNA, 64 nt, Human
agcacuuugggaggccgaggcgggcagaucacgaggucaggaguucgagaccagcagccuggcc

SEQ ID NO: 134409 - RNA, 64 nt, Human
agcacuuugggaggcugaggcggguggaucacuaggucaggaguucaagaccagccuggccaac

SEQ ID NO: 134410 - RNA, 64 nt, Human
gggugggaaugggguggggucacuaaggagagagggucaggagccagaguugaugagcagaucu

SEQ ID NO: 134411 - RNA, 64 nt, Human
agcacuuugggaggccaaggcggguggaucacgaggucaggagauggagaccauccuggcuaac

SEQ ID NO: 134412 - RNA, 64 nt, Human
cacuuugggaggccaaggccagcggaucacuugaggucaggaguucgagaccagccugaccaac

SEQ ID NO: 134413 - RNA, 64 nt, Human
accugugaaaucuauaacucagaaauggucagauggucaggagccagcuaugcagcaguauacc

SEQ ID NO: 134414 - RNA, 64 nt, Human
gaauguagaacuugacagcagccuucugagucugggucaggaagauguccuuuggaccaaagca

SEQ ID NO: 134415 - RNA, 64 nt, Human
ccuugguggggucugucuuuuccuugaggucagaggucaggagcagggcuggggucaggaugac

SEQ ID NO: 134416 - RNA, 64 nt, Human
uuuccuugaggucagaggucaggagcagggcuggggucaggaugacgaggccugggguccuggu

SEQ ID NO: 134417 - RNA, 64 nt, Human
cugugcucuggaaaggcuaccaaauacuggccaaggucaggaggagcaaaaaugagccagcacc

SEQ ID NO: 134418 - RNA, 64 nt, Human
cacuuugggaggcugagguggguggaucacuugaggucaggaguuugagaccagccuggguaau

SEQ ID NO: 134419 - RNA, 64 nt, Human
gaagaaauccugguuaaaaaagucuuuuguauugggucaggaguugaauuuggggugggaggau

SEQ ID NO: 134420 - RNA, 64 nt, Human
aacaccuuaggaguccgagguggguggaucacgaggucaggagauccagcccauccuggccaac

SEQ ID NO: 134421 - RNA, 64 nt, Human
cacuuugggaggccgagccgggcggaucaccuguggucaggaguuugagaccagccuggccaac

SEQ ID NO: 134422 - RNA, 64 nt, Human
agcacuuugggaggccgaggcaggcggaucacaaggucaggagauugagacccuccuggcuaac

SEQ ID NO: 134423 - RNA, 64 nt, Human
aaacacacacacacacacaauuuucacgauguauggucaggaaugugacuguaaacuggacuuu

SEQ ID NO: 134424 - RNA, 64 nt, Human
gacuuugggaggcugaggcagguggaucaccugaggucaggaguucgagcccagccugaccaau

SEQ ID NO: 134425 - RNA, 64 nt, Human
ugcucagagagcaagccuguguguggggaugucaggucaggagcuggaaguucaccugcaggug

SEQ ID NO: 134426 - RNA, 64 nt, Human
ggaaaacaauccaacucccuagcccagacccucaggucaggaggccugcguguggggcugcaaa

SEQ ID NO: 134427 - RNA, 64 nt, Human
guuuuuguuugaugaauucuguuauaaccuauggggucaggauaugaguccugggcauuauuua

SEQ ID NO: 134428 - RNA, 64 nt, Human
cacuuugggaggccgaggcggguggaucacuugaggucaggaguucgagaccagccuggccaau

SEQ ID NO: 134429 - RNA, 64 nt, Human
cacugugagaggcugaggcgggaugaucaccugaggucaggaguucaagaucagccugggcaac

SEQ ID NO: 134430 - RNA, 64 nt, Human
ggggagggugcccuccuauccccaccuacuccugggucaggaggaaaagacuaacaggagaaug

SEQ ID NO: 134431 - RNA, 64 nt, Human
cacuuugggaggcugaggcaggcggaucacuugaggucaggagcucgagaccagccuggccaac

SEQ ID NO: 134432 - RNA, 64 nt, Human
cauuuugggaggccaaggcgggcggaucacuugaggucaggagcucaagaccagccuggccaac

SEQ ID NO: 134433 - RNA, 64 nt, Human
agcacuuugggaggccaaggcagguggaucacgaggucaggagauccagaccauccuggcuaac

SEQ ID NO: 134434 - RNA, 64 nt, Human
agcacuuugggaggccgagacaggcagaucacgaggucaggagaucgagaccauccuggcuaac

SEQ ID NO: 134435 - RNA, 64 nt, Human
acuuugggaggccaaggcaggcagaucacuuugaggucaggaguuugagaccagccuggccaac

SEQ ID NO: 134436 - RNA, 64 nt, Human
gacuuugggaggccgaggcaggcagaucaccugaggucaggaguuugagaccagccuggucaac

SEQ ID NO: 134437 - RNA, 64 nt, Human
ccucccacccuuguccgaguugccucccacuggaggucaggagucuacacugcagccucgggca

SEQ ID NO: 134438 - RNA, 64 nt, Human
ccagcacuuugggagacugaggcggaucaccugaggucaggaguucuagaccagccugaccaac

SEQ ID NO: 134439 - RNA, 64 nt, Human
agccacaccccucugccacaaaugaccaacagcuggucaggacguuacacgcggugccuuguaa

SEQ ID NO: 134440 - RNA, 64 nt, Human
agcacuuugggaggccgaggcagguggaucacaaggucaggagauagagaccaucauugcuaac

SEQ ID NO: 134441 - RNA, 64 nt, Human
gagacuucagggcuugucacuuucagaguguggaggucaggauggcugcgggcaaugaagccuu

SEQ ID NO: 134442 - RNA, 64 nt, Human
cacuuuaggaguccaaggcgggcggaucacuugaggucaggaguucaagaccagcuuggccaag

SEQ ID NO: 134443 - RNA, 64 nt, Human
agcacuuugggaggccaaggugggcggaucacaaggucaggaguucgagaccagccuggccaau

SEQ ID NO: 134444 - RNA, 64 nt, Human
cacuuugggaggccaaggcagguggaucaccugaggucaggaguucgagacaagcguggccaau

SEQ ID NO: 134445 - RNA, 64 nt, Human
cacuuugggaggccgaggcaggcggaucaccugaggucaggaguuugagaccagccugacaugg

SEQ ID NO: 134446 - RNA, 64 nt, Human
accaugcaacugaagaaaauguggaaacucaaaaggucaggacagacuuccaagcacuugcaac

SEQ ID NO: 134447 - RNA, 64 nt, Human
caaaagcuaguaaacauguuucaaagaaaaauaaggucaggagaaaaagaauaaugccuacaga

SEQ ID NO: 134448 - RNA, 64 nt, Human
cacuuugggaggcccagacuggcggaucaccugaggucaggagaucgagaucagccuggccaac

SEQ ID NO: 134449 - RNA, 64 nt, Human
cacuuggggaggcugaggcagacggauuaccugaggucaggaguucgagaccaaccuggccgac

SEQ ID NO: 134450 - RNA, 64 nt, Human
uacgugucaaaaaagaaucuguauucagacccugggucaggaaauuacugcccacuugucaagu

SEQ ID NO: 134451 - RNA, 64 nt, Human
uaagguucucaaggcugguggcagcucagucuggggucaggacaugucggggucaugcguuucu

SEQ ID NO: 134452 - RNA, 51 nt, Human
auucacagaaacagaugugaaggucaggaggcaaguggaggauggacuggg

SEQ ID NO: 134453 - RNA, 64 nt, Human
cacuuugggaggccaaggcguguggaucaccugaggucaggaguucaagaccagccuggccaac

SEQ ID NO: 134454 - RNA, 64 nt, Human
cauuuugggaggccgaggcagguggaucaccugaggucaggaguuugagaccagccuggccaac

SEQ ID NO: 134455 - RNA, 64 nt, Human
ggaccccgugcacgugguuugcuucaagggcaugggucaggauuccugccagguccccgaugug

SEQ ID NO: 134456 - RNA, 64 nt, Human
agcauuuugggaggccgaggugggcggaucacgaggucaggagaucgagaccaucgugacuaac

SEQ ID NO: 134457 - RNA, 64 nt, Human
cacuuugggaggccaaagcaggcggaucaccugaggucaggaguuugagaccagccgggccaac

SEQ ID NO: 134458 - RNA, 64 nt, Human
augcuaaaggugauucuaguuaaucugggauuagggucaggaaaaugauagcaagacacauuga

SEQ ID NO: 134459 - RNA, 64 nt, Human
cacuuugggaggcagaggcgggcagaucacuugaggucaggaguucaagaccagccuggccaac

SEQ ID NO: 134460 - RNA, 64 nt, Human
gcugaagaaaauagacauagccggcauaucucauggucaggagcuggacgauucugguaacuua

SEQ ID NO: 134461 - RNA, 64 nt, Human
agcacuuugggaggccgaggugggcagaucacgaggucaggagaucaagaccauccuggcuaac

SEQ ID NO: 134462 - RNA, 64 nt, Human
agcacuuugggaggcugaggugggcagaucacaaggucaggaguuugagaccagccugaccaaa

SEQ ID NO: 134463 - RNA, 64 nt, Human
agcaaguauugaggguacccaucuagcuacuuggggucaggaccucgucagaccagguucggau

SEQ ID NO: 134464 - RNA, 64 nt, Human
auuuccccuuggacacuugguuagacgccuuccaggucaggaugcacauuucuggauugugguu

SEQ ID NO: 134465 - RNA, 64 nt, Human
cacuuugggaggcugaggcagguggcucacuugaggucaggaauucaagaccagccuggccaac

SEQ ID NO: 134466 - RNA, 64 nt, Human
ugaugcaagucauaugggggaacacuuuguaaauggucaggauaaaaaccaaaucugggugcca

SEQ ID NO: 134467 - RNA, 64 nt, Human
cacuuugggaggccgagacgggaggaucaguugaggucaggaguuugagaccagccucggcaac

SEQ ID NO: 134468 - RNA, 64 nt, Human
agcacuuuggaaggccgagaugggcgaaucacaaggucaggaguuugagacuagccuggccaac

SEQ ID NO: 134469 - RNA, 64 nt, Human
agcacuuugggaggucgaggcagguagaucacgaggucaggaauucaagaccagccuggccaac

SEQ ID NO: 134470 - RNA, 64 nt, Human; identical to SEQ ID NO: 134236

SEQ ID NO: 134471 - RNA, 64 nt, Human
gaaaagccauuguggagccaacuccagggcugggggucaggaguccuaggcucccauuccugcu

SEQ ID NO: 134472 - RNA, 64 nt, Human
cacuuugggaggccaagguggguggaucacuugaggucaggaguucgagaccagccuggccaag

SEQ ID NO: 134473 - RNA, 64 nt, Human
cacuuuggggggcugaggcagguggaucacuugaggucaggaguucaagaccagccuggccaac

SEQ ID NO: 134474 - RNA, 64 nt, Human
uugugggcaauuccagagaauucaguaccugcuuggucaggaggaugugcaccaucuugccuuu

SEQ ID NO: 134475 - RNA, 64 nt, Human
acuuugagaggccugaggucggcggacugccugaggucaggaauucaagaccagccuggccaac

SEQ ID NO: 134476 - RNA, 64 nt, Human
agcacuuugggaagccgagggggaugggucaugaggucaggaguucgagaccagccugaccaac

SEQ ID NO: 134477 - RNA, 64 nt, Human
agcacuuugggaggccgaggcgggcggaucacgaggucaggaguucgagaccacggugaaaccc

SEQ ID NO: 134478 - RNA, 64 nt, Human
agcacuuugggaggccgaggagggcggaucacgaggucaggagaucgagaccauccuggcuaac

SEQ ID NO: 134479 - RNA, 64 nt, Human
agcacuuugggaggccgaggcaggcggaucacaaggucaggagaucaagacuauccuggcuaac

SEQ ID NO: 134480 - RNA, 64 nt, Human
aacacuuugggaggccgaggcgggccgaucacgaggucaggagaucaaggccauccuggcuaac

SEQ ID NO: 134481 - RNA, 64 nt, Human
gcugcugcugcugcucagggcuucgugcccauggggucaggaacagggagcgaggagccccucg

SEQ ID NO: 134482 - RNA, 64 nt, Human
ucccacacucacccugaauccucacucaggguggggucaggaaucugcauuuuaacuagucgcg

SEQ ID NO: 134483 - RNA, 64 nt, Human
cacuuugggacaccaagguggguggaucaccugaggucaggaguucuagaccagccugaccaac

SEQ ID NO: 134484 - RNA, 64 nt, Human
cauuuugugaggccaagguggguggaucaccugaggucaggaguuugagaccagccugaccaaa

SEQ ID NO: 134485 - RNA, 64 nt, Human
cuuacuggcaggaaggaucaggauggggucuuggggucaggaugccugggucucuucccguaac

SEQ ID NO: 134486 - RNA, 64 nt, Human
cacuuugggaggccaaggaggguggaucaccugaggucaggaguuagaggccagccuggcgaaa

SEQ ID NO: 134487 - RNA, 64 nt, Human
cacuuugggaggccaagguggguggaucaccugaggucaggagcucgagaccagccuggccaac

SEQ ID NO: 134488 - RNA, 64 nt, Human
cacuuugggaggcugagguggguggaucacuugaggucaggagcucgagaccagcuuggccaac

SEQ ID NO: 134489 - RNA, 64 nt, Human
aaaaaaccuugcuuuuaguguuuguacugcugcuggucaggacauuaaaauauugaaguguuuu

SEQ ID NO: 134490 - RNA, 64 nt, Human
cacuuugggaggccgaggagggaggaucaccugaggucaggaguuugagaccagccuggccaac

SEQ ID NO: 134491 - RNA, 64 nt, Human
ggaaagauaaaccuuuugaggugaagagccagggggucaggaaauauggccuaucugccaggca

SEQ ID NO: 134492 - RNA, 64 nt, Human
ggagugccagccccaggaagcuccagggcugaguggucaggagccaguuucuccagccccuccu

SEQ ID NO: 134493 - RNA, 64 nt, Human
accggcuugccuggugguuugcacauuucaggggggucaggagaguuaaggagguugugggugg

SEQ ID NO: 134494 - RNA, 64 nt, Human
ucacggacgucagggacaucaaggacaccugaggggucaggauauccccacccccacccuggga

SEQ ID NO: 134495 - RNA, 64 nt, Human
cacuuugggaggccaaggcaggugggucaccuggggucaggaguucgagaccagccugaccaau

SEQ ID NO: 134496 - RNA, 64 nt, Human
cauuuugagaggcugaggcggguggaucaccugaggucaggaguucgaaaccagccuggccaac

SEQ ID NO: 134497 - RNA, 64 nt, Human
cacuuugggaagcccaggcaggcagaucacuugaggucaggaguucaagaccagccuggccaac

SEQ ID NO: 134498 - RNA, 64 nt, Human
gggggaagccaggcaacaguggccucugggagggggucaggaagaggcgaacagcucaggcagc

SEQ ID NO: 134499 - RNA, 64 nt, Human
ggaguuguagccccaugaacuaguuucuugucugggucaggaacaagggccggcuggggccugg

SEQ ID NO: 134500 - RNA, 64 nt, Human
cacuuugggaggccgagacgggcggaucaccugaggucaggaguucgagaccagccucaacaug

SEQ ID NO: 134501 - RNA, 64 nt, Human
cacuuugggaggcugaggcgggugguucaccugaggucaggaguuugagaccagccuggccaac

SEQ ID NO: 134502 - RNA, 64 nt, Human
ggcagcucugggaacaugcgggauuguggaauugggucaggaacccucucugguauucuggaug

SEQ ID NO: 134503 - RNA, 64 nt, Human
cacuuugggaggcugaggcagguggaucacuggaggucaggaguuugagaccagccuggccaac

SEQ ID NO: 134504 - RNA, 64 nt, Human
agcacuuugggaggccaaggcaggcggaucacgaggucaggaguucaaaaccagccuguccaau

SEQ ID NO: 134505 - RNA, 64 nt, Human
agcacuuugggaggcugaggcgggcggaucacgaggucaggagaucgagaccauccuggcuaac

SEQ ID NO: 134506 - RNA, 64 nt, Human
guaaguguucagaacaacugcaaagaaagugggaggucaggaaacuuuuaacugagaaaucuca

SEQ ID NO: 134507 - RNA, 64 nt, Human
gguggccucgggacaccugcccugcccccacgagggucaggacugugacucuuuuuagggccag

SEQ ID NO: 134508 - RNA, 64 nt, Human
uggagccaccugucccaccucaaaugggucugggggucaggaggcaggguuuuaucucugucua

SEQ ID NO: 134509 - RNA, 64 nt, Human
cacuuugggaggccaaggcgggucgauuacuugaggucaggaguucacgaccagccuggccaac

SEQ ID NO: 134510 - RNA, 64 nt, Human
agcacuuugggaggccgaggcgggcggaucacaaggucaggaguucgagaccauccugucuaac

SEQ ID NO: 134511 - RNA, 64 nt, Human
cacauugggaggcugaggugggcggaucaccugaggucaggaguucaagaccagccuggccaac

SEQ ID NO: 134512 - RNA, 64 nt, Human
cacuuugggaggccaaggcgggcggaucagcugaggucaggaguuggagaccagcguggccaac

SEQ ID NO: 134513 - RNA, 64 nt, Human
aacacuuugggaggcugaggcaggcggaucacgaggucaggagaucgagaccauccuggccaac

SEQ ID NO: 134514 - RNA, 64 nt, Human
cacuuugggaggccgagguggguggaucacccgaggucaggaguucgagaccagccuggccaac

SEQ ID NO: 134515 - RNA, 64 nt, Human
ucacucugaagccaaagcugggcucaguggggaaggucaggaauggagaaauugccuuuucucg

SEQ ID NO: 134516 - RNA, 64 nt, Human
cacuuugggaggccaaggcggacagaccaccugaggucaggaguucgaaaccagccuggccaac

SEQ ID NO: 134517 - RNA, 64 nt, Human
augcuuuggggggacaggccagaaugaaguccugggucaggagcccagcuggcugggcccagcu

SEQ ID NO: 134518 - RNA, 64 nt, Human
acucacaggugaccugcuaucgagauagccagagggucaggagagaaugggggaggaggcgguc

SEQ ID NO: 134519 - RNA, 64 nt, Human
agcacuuugggaggccgaggcggguggaucaugaggucaggaguucgagaccagccuggccaac

SEQ ID NO: 134520 - RNA, 64 nt, Human
cacuuugggaggcggagacgggcagauaaccugaggucaggauuucgagaccaaccugaccuac

SEQ ID NO: 134521 - RNA, 64 nt, Human
ccaggaaggccugggcagagacccuguaggauggggucaggaaggguugccugcagggacuuuu

SEQ ID NO: 134522 - RNA, 64 nt, Human
agcacuuugggaggccgaggcaggcagaucacgaggucaggagauccagaccauccuggcuaac

SEQ ID NO: 134523 - RNA, 64 nt, Human
cacuuugggagcccgaggcggguggaucagcugaggucaggaguucaagaccagccuggccaac

SEQ ID NO: 134524 - RNA, 64 nt, Human
cacuuugggaagcccaagugggugaaucaccugaggucaggaguucaagaccagccugaccaac

SEQ ID NO: 134525 - RNA, 64 nt, Human
aagcaucuuccuauaagagcacuuucgccuucugggucaggacuccaaggugcagcgggcuuca

SEQ ID NO: 134526 - RNA, 64 nt, Human
cacuuugggaggccgaggcggguggaucaccugaggucaggaguuccagaccagccuggccaac

SEQ ID NO: 134527 - RNA, 64 nt, Human
agcucuuugggaggccgaggugggcagaucacgaggucaggagaucgagaccauccuggcuaac

SEQ ID NO: 134528 - RNA, 64 nt, Human
gcuccugucuucccagacccaccaugccuggagaggucaggauggaacuaccucauucggcaaa

SEQ ID NO: 134529 - RNA, 64 nt, Human
gcuaggcuucaagaaaccgucaugcccgcuugagggucaggacccacggggcauuaucuugucu

SEQ ID NO: 134530 - RNA, 64 nt, Human
ucucccauggcguguuuggauaucugcugccuguggucaggaaccuugcacuggggaaacaauc

SEQ ID NO: 134531 - RNA, 64 nt, Human
guugcuaaucagauaccugcugucaccacacuugggucaggaacccuaaugagaacggggagcu

SEQ ID NO: 134532 - RNA, 64 nt, Human
cacaggcgucuccaaccucagaggcccuuuguggggucaggacacagagugggagggagacuga

SEQ ID NO: 134533 - RNA, 64 nt, Human
cacuuugggaggccaagguggguggaucacuugaggucaggaguucgagaccagccuggccaac

SEQ ID NO: 134534 - RNA, 64 nt, Human
ugccccuccacccccagcugaggcccggucaccuggucaggacagagcaacugcaucuaaaagc

SEQ ID NO: 134535 - RNA, 64 nt, Human
cagcacugucucugugccugacucacagcauauaggucaggaaagaauggagacggcauucuug

SEQ ID NO: 134536 - RNA, 64 nt, Human
cacuuugggaggcugaggugggcagaucaccugaggucaggaguucaagaccagccuggccaac

SEQ ID NO: 134537 - RNA, 64 nt, Human
gcccgaguuaggagauugaggcugguugcacuggggucaggagugcccucaccuugcccagucu

SEQ ID NO: 134538 - RNA, 64 nt, Human
ugcccaccagcuggccucaccuccugaaggcccgggucaggacccugcucuccuggcgcaguuc

SEQ ID NO: 134539 - RNA, 64 nt, Human
cuguaaucccagcacugagaggccgaucacuugaggucaggaguucaagaccagccuggccaac

SEQ ID NO: 134540 - RNA, 64 nt, Human
ucccagcacuuugggaggccgaggcggaucauaaggucaggagaucaagaccauccuggcuaac

SEQ ID NO: 134541 - RNA, 59 nt, Human
ucacacucccagaccccugaggggcccacggucaggacugguggggacugcaggauguc

SEQ ID NO: 134542 - RNA, 64 nt, Human
uggggagauggagcagggaaguacagagugggauggucaggaccugggccauugcaaccaaaau

SEQ ID NO: 134543 - RNA, 64 nt, Human
uuccccaauccuggcaaaagcccaaagaucccagggucaggagagaccccucuguauccccagg

SEQ ID NO: 134544 - RNA, 64 nt, Human
agcacuuuaggaggccgaggcuggcagaucacaaggucaggagaucgagaccauccuggcuaac

SEQ ID NO: 134545 - RNA, 64 nt, Human
agcacuuugggaggccaaggugggcggaucacaaggucaggaguucgagaccaaccuagccaac

SEQ ID NO: 134546 - RNA, 64 nt, Human
agcacuuugggaggccgaggcaggcggaucacaaggucaggaguucgagaccagccuggccaac

SEQ ID NO: 134547 - RNA, 64 nt, Human
gguugggucuggucacggcagagcuuuuguggagggucaggaaggguggagaggagcuggguug

SEQ ID NO: 134548 - RNA, 64 nt, Human
uaauagaggaucagagcagaguugggaguauauuggucaggaucauagaaaagaagacaaagcu

SEQ ID NO: 134549 - RNA, 64 nt, Human
cacuuugggagaccaaggcggguggaucacuugaggucaggaguucaagaccagccugggcaac

SEQ ID NO: 134550 - RNA, 64 nt, Human
agcacuuugggaggccaaggugggcggaucaugaggucaggagaucgagaccauccuggccaac

SEQ ID NO: 134551 - RNA, 64 nt, Human
agcacuuugggaggcugaagcaggcggaucacaaggucaggaguucgagaccagccuggccaac

SEQ ID NO: 134552 - RNA, 64 nt, Human
ucuacugcaugggauucaggaaacaguugugguuggucaggacggaaguugggguaaguuuggu

SEQ ID NO: 134553 - RNA, 64 nt, Human
agcacuuugggaggccgaggcggguggaucacgaggucaggagaucgagaccauccuggcgaac

SEQ ID NO: 134554 - RNA, 64 nt, Human
gacagcugagucacccuggguaaguucucagaguggucaggauggcuugaccugcagaagauac

SEQ ID NO: 134555 - RNA, 64 nt, Human
acucuucauagauugugaacuggcccaucaauauggucaggaauauuugcagucuacauuuuaa

SEQ ID NO: 134556 - RNA, 64 nt, Human
cacuuugggaggcugaggcggguggaucacuugaggucaggaguucaagaccagccuggccaac

SEQ ID NO: 134557 - RNA, 64 nt, Human
ugucuugaggagcaugaggaauucaggagcagaaggucaggauagcaugagauagucucaaugu

SEQ ID NO: 134558 - RNA, 64 nt, Human
agcacuuugggaggcugaggcggggagaucacaaggucaggagaucgagaccagccugaccaac

SEQ ID NO: 134559 - RNA, 64 nt, Human
cacuuugggaggcuacgauggguggaucaccugaggucaggaguucaagaccagucuggccaac

SEQ ID NO: 134560 - RNA, 64 nt, Human
agcacuucgggaggccgaggcggguggaucacgaggucaggagaucaagaccauccuggcuaac

SEQ ID NO: 134561 - RNA, 64 nt, Human
gcacuuugggaggcuaaggcggcggaucacuugaggucaggaguucaagaucagccugaccaac

SEQ ID NO: 134562 - RNA, 64 nt, Human
aacacuuuaggaggccgaggcggguggaucaugaggucaggagaucgagaccauccuggcuaac

SEQ ID NO: 134563 - RNA, 64 nt, Human
agcacuuugggaggccgaggcaggcggaucacgaggucaggagaucaagaccauccuggcuaug

SEQ ID NO: 134564 - RNA, 64 nt, Human
cacucugggaggcugagguggguggaucaccugaggucaggaguucaagaccagccuggugaac

SEQ ID NO: 134565 - RNA, 64 nt, Human
cuuuucuucugaauuuagaggauuucuagaacguggucaggaauagccauucuaggcggggcug

SEQ ID NO: 134566 - RNA, 64 nt, Human; identical to SEQ ID NO: 134099

SEQ ID NO: 134567 - RNA, 64 nt, Human
caggacucucaugugagaaggaacaccuugcucuggucaggaaauguccaguguuuccuguuau

SEQ ID NO: 134568 - RNA, 64 nt, Human
ucacgccuguaaucccagcacuuugggaggccgaggucaggaguuagagaccauucugaccaau

SEQ ID NO: 134569 - RNA, 64 nt, Human
agcacuuugggaggccgaggcgggcggaucacuaggucaggaaauggagaccauccuggccaac

SEQ ID NO: 134570 - RNA, 64 nt, Human; identical to SEQ ID NO: 134568

SEQ ID NO: 134571 - RNA, 64 nt, Human
acuggauagaaaccaaagcaggugaaucaccugaggucaggaguucaagacuggccugaucaau

SEQ ID NO: 134572 - RNA, 64 nt, Human
cacuuugggaggcugaggcaggaggaucacuugaggucaggaguuugagaccagugugcaaaac

SEQ ID NO: 134573 - RNA, 64 nt, Human
ucucuuucuuaauuguaugaaaacacaaagcacaggucaggauccucugagagaaaaucaacau

SEQ ID NO: 134574 - RNA, 64 nt, Human
cacuuugggaggcugaggcugggggaucaccugaggucaggaguucgagaucagccuggccaac

SEQ ID NO: 134575 - RNA, 64 nt, Human
agcacuuuaggaggucaaggugggcagaucaugaggucaggaguuugagaccagccuggccaau

SEQ ID NO: 134576 - RNA, 64 nt, Human
ccaacacuuugggaggccaggacagaucacuugaggucaggaguucgagaccagcccagccaac

SEQ ID NO: 134577 - RNA, 64 nt, Human
cacucuguggggccgaggcaggcagaucgcuugaggucaggaguucgagaccagccuggccaac

SEQ ID NO: 134578 - RNA, 64 nt, Human
cacuuugggaggccgaggcgggcagaucaccugaggucaggaguucaagaccagcuuggccaac

SEQ ID NO: 134579 - RNA, 64 nt, Human
cagaauaggagccagcgacucaggacugcucacgggucaggagggcaacgccugaagucagacc

SEQ ID NO: 134580 - RNA, 64 nt, Human
uccagcaucagucccugcagcagcuggggccucuggucaggaacccucagggacccaggaacuc

SEQ ID NO: 134581 - RNA, 64 nt, Human
gcuccugggaggugagcgugcacaggugugugcaggucaggaggugccguccaggugugcggcg

SEQ ID NO: 134582 - RNA, 64 nt, Human
cacuuugggaggccgaggcagguggaucaccuaaggucaggaguucgagaccagccuggccaau

SEQ ID NO: 134583 - RNA, 64 nt, Human
cuacuugggaggcugauagaagaagauaacuugaggucaggaguucaagaccagccugggaaac

SEQ ID NO: 134584 - RNA, 64 nt, Human
acagaccuguccccagacagugauggcccaaaauggucaggacuuuaauggaggaggugaggug

SEQ ID NO: 134585 - RNA, 64 nt, Human
agcacuuugggaggccgaggcaggcagaucacgaggucaggaguucgagaccagccuggccaac

SEQ ID NO: 134586 - RNA, 64 nt, Human
aacacuuugggagcccgaggcgggcggaucacaaggucaggaguucgagaccagccuggccaac

SEQ ID NO: 134587 - RNA, 64 nt, Human
cacuuugggaggcugagguggguggaucaccugaggucaggaguucaagaccagccucaacaug

SEQ ID NO: 134588 - RNA, 64 nt, Human
cacuaugggaggcccaggugagcagaucaccugaggucaggaguucaagaccagccuggccaac

SEQ ID NO: 134589 - RNA, 64 nt, Human
ggagaccucgacagccugcccuaggcccugggugggucaggacaaaggccucucaucaccgcag

SEQ ID NO: 134590 - RNA, 64 nt, Human
agcacuuugggaggccgaggcgggcagaucacgaggucaggagaucgagaccauccuggcuaac

SEQ ID NO: 134591 - RNA, 64 nt, Human
cacuuugugaggccaggguggguggaucacuugaggucaggaguucaagacuagccuggccaac

SEQ ID NO: 134592 - RNA, 64 nt, Human
cacuaugggaggucgaggugggcagauuaccugaggucaggaguuccagaccagccuggccaac

SEQ ID NO: 134593 - RNA, 64 nt, Human
cacuuugggaggccaaggcagguggaucaccugaggucaggaguuugagaccagccugaccaac

SEQ ID NO: 134594 - RNA, 64 nt, Human
cugacugaucacagcauacgugugacccaguuugggucaggagggcccagccuugguucugcug

SEQ ID NO: 134595 - RNA, 64 nt, Human
agcacuuagguaggccaagguggguggaucacgaggucaggagauugagaccauccuggcuaau

SEQ ID NO: 134596 - RNA, 64 nt, Human
uggauauuuauuuuuuuacauuggucaguacacaggucaggagcucacgccagggccuugagga

SEQ ID NO: 134597 - RNA, 64 nt, Human
agcacuuugggaggcccaggugggcggaucacgaggucaggagaucgagaccaucuuggcuaac

SEQ ID NO: 134598 - RNA, 64 nt, Human
agcacuuugggaggacgaggcaggcggaucaugaggucaggagauggagaccauccuggcuaac

SEQ ID NO: 134599 - RNA, 64 nt, Human
agcacuuugggaggccgaggcaggcggaucacaaggucaggagaucgagaccauccuggccaau

SEQ ID NO: 134600 - RNA, 64 nt, Human
cacuuugggaggccaaggcaggcggaucaccugaggucaggaguucgagaccagccuggcuaac

SEQ ID NO: 134601 - RNA, 64 nt, Human
cugcaaugugcaaucccccugcccccacagccaaggucaggaagaggcccuguggucaccgugu

SEQ ID NO: 134602 - RNA, 64 nt, Human
cauuuugagaggcugagguggguggaucacuugaggucaggaguuugagaccacccuggccaac

SEQ ID NO: 134603 - RNA, 64 nt, Human
aacacuuugggaggccgaggugggcggaucacgaggucaggagaucaagaccauccuggccaac

SEQ ID NO: 134604 - RNA, 64 nt, Human
gcuuuuguagagagaugauuauuguacugugggaggucaggaaguucgagauuccuucacuguc

SEQ ID NO: 134605 - RNA, 64 nt, Human
cgaauccggcuucggaugaggugagggaggagcaggucaggaggggggcccucguagggacgcg

SEQ ID NO: 134606 - RNA, 64 nt, Human
cacuuugggaggcugagaugggcagaucacuugaggucaggaguucgagaccagccuggccaac

SEQ ID NO: 134607 - RNA, 64 nt, Human
cacuuugggaggcugagguggucagaucaccuaaggucaggaguucaagaccagccuggucaac

SEQ ID NO: 134608 - RNA, 59 nt, Human
auggcuccauugcuguauagggccuugugggucaggacgcuuggcugccuuccugcccc

SEQ ID NO: 134609 - RNA, 64 nt, Human
agcacuuugggaggccaagaugggcggaucacgaggucaggaguucgagaccagccuggccaac

SEQ ID NO: 134610 - RNA, 64 nt, Human
cccaccaggcucuaagcggcgaucugugcuaagaggucaggacccagccgaaguccucggcguu

SEQ ID NO: 134611 - RNA, 64 nt, Human
cacuuugagaggccaaggcgggcggaucacuggaggucaggaguuuaagaccagccuggccaac

SEQ ID NO: 134612 - RNA, 64 nt, Human
cacuuugggaggcugaggcggguggaucaccugaggucaggaguucgagaccagccuggccaac

SEQ ID NO: 134613 - RNA, 64 nt, Human; identical to SEQ ID NO: 134379

SEQ ID NO: 134614 - RNA, 64 nt, Human
ccagcacuuugggaggccggugggcagaucaugaggucaggaguucgagaccagccugaccauc

SEQ ID NO: 134615 - RNA, 64 nt, Human
uccuacagugcugagcaaaaaguccccaauaaauggucaggacaaaggccucuguggaucugug

SEQ ID NO: 134616 - RNA, 64 nt, Human
cacuuugggaggcugaggcaggcggaucaccugaggucaggaguucaagaccagccuggccaac

SEQ ID NO: 134617 - RNA, 64 nt, Human
gugaaagaaaccaccgaaaucccucaggucccuuggucaggagccucucaagauuuuuuuuguc

SEQ ID NO: 134618 - RNA, 64 nt, Human
ugcacaggagcuaaggcuuauaaaauaugaguauggucaggaauuuaauaaaaguacagugaug

SEQ ID NO: 134619 - RNA, 64 nt, Human
caccuugggaggccgaggcgggcggaucacuugaggucaggaguuccagaccagccuggccaac

SEQ ID NO: 134620 - RNA, 64 nt, Human
uuugggaggucgggggggugggggaggaucacggggucaggagaucgagaccauccuggccaac

SEQ ID NO: 134621 - RNA, 64 nt, Human
agcacuaugggaggccgagacgggcggaucacgaggucaggagacugagaccauccuggcuaac

SEQ ID NO: 134622 - RNA, 64 nt, Human
agcacuuugggaggccgaggugggcaaauuacgaggucaggagauccagaccauccuggcuaac

SEQ ID NO: 134623 - RNA, 64 nt, Human
cacuuuggguggccaaggcgggcagaugacuugaggucaggaguucgagaccagccuggccaac

SEQ ID NO: 134624 - RNA, 64 nt, Human
agcacuuugggaggccgagacgggcccaugacaaggucaggagaucgagaccguccuggcuaac

SEQ ID NO: 134625 - RNA, 64 nt, Human
agcacuuugggaggccgaggcaagagcaucacgaggucaggagaucgagaaaauccuggcuaac

SEQ ID NO: 134626 - RNA, 64 nt, Human
cacuuugggaguccgaggcagguggaucaccugaggucaggaguucaagaccagccugaccaac

SEQ ID NO: 134627 - RNA, 64 nt, Human
agcacuucgagaggccgaggcagguggaucacgaggucaggaguuugagauuagccuggccaag

SEQ ID NO: 134628 - RNA, 64 nt, Human
uacuuugggaggcugaggugggcgcaucaccugaggucaggaguucgagaccagcaugaccaac

SEQ ID NO: 134629 - RNA, 64 nt, Human
agcacuuugggaggcggaggcgggcagaucgcgaggucaggagaucgagaccauccuggcuaac

SEQ ID NO: 134630 - RNA, 64 nt, Human
agcacuuugggaggcugagguggguggcuuacaaggucaggaguucaagaccacccuggacaau

SEQ ID NO: 134631 - RNA, 64 nt, Human
aaaguauuaauaaucuggaagacaguguugcccaggucaggaguguuuucuuggugguuccagc

SEQ ID NO: 134632 - RNA, 64 nt, Human
ugguauuuggagguggggcuuuugguaagugauaggucaggagaguaacagcgcucaugaaugg

SEQ ID NO: 134633 - RNA, 64 nt, Human
uacuuugggaggccaaggcaggcugauugcuugaggucaggaguuugagaccagccuggccaaa

SEQ ID NO: 134634 - RNA, 64 nt, Human
agugggugcuugugucugcugucucagaggccuuggucaggaugaaguuggcugacacagcuua

SEQ ID NO: 134635 - RNA, 64 nt, Human
agcacuuugggaggccaaggcaggcggaucacaaggucaggagauugagaccauccuggccaac

SEQ ID NO: 134636 - RNA, 64 nt, Human
ucaagaaucccuuucugaaauucuccaacucucuggucaggaggaggagcaccauuggggcggg

SEQ ID NO: 134637 - RNA, 64 nt, Human
gguggggguuggggaagacagcauuccacagccuggucaggagggaaggaccucacuuguuuca

SEQ ID NO: 134638 - RNA, 64 nt, Human
cacuuugggaggccgaggcagguggaucaccugaggucaggaguucgagaccagccuggccaac

SEQ ID NO: 134639 - RNA, 64 nt, Human
accuccuacuugggagaaaagugagccaucugcuggucaggaaguccuccagagaggcagcuuu

SEQ ID NO: 134640 - RNA, 64 nt, Human
ugaccucugucuguugaagccuugguaucugagaggucaggaaggggaccucuuugaggguaau

SEQ ID NO: 134641 - RNA, 64 nt, Human
ccaguuuuccagaccaggacugaaauccagagagggucaggaauuuggccccaugaugaagcca

SEQ ID NO: 134642 - RNA, 64 nt, Human
aaucccagacuuugagaggccaaggcggucacgaggucaggaguucgagaccagccuagccaac

SEQ ID NO: 134643 - RNA, 64 nt, Human
agcacuuugggaggccgaggcugguggaucacaaggucaggagauugagaccauccuggcuaac

SEQ ID NO: 134644 - RNA, 64 nt, Human
cagggaccgucuggcuuccccagcuggacugggaggucaggaagccaggcaaggagagggacag

SEQ ID NO: 134645 - RNA, 64 nt, Human
gaccuugagaccacuggggucucccacaagguggggucaggagagggucacuuuuguagcugag

SEQ ID NO: 134646 - RNA, 64 nt, Human
auacuaaggcagacucagcuuuuuaaagaugggaggucaggagguggaagugagaggagauccc

SEQ ID NO: 134647 - RNA, 64 nt, Human
agagccccuuccugcacuccuggaaucacagaggggucaggaagcuguggcaggagcaucuaca

SEQ ID NO: 134648 - RNA, 64 nt, Human
gacuuugggaggccaaggcgggcagaucaccggaggucaggaguucgagaccagccugaccaac

SEQ ID NO: 134649 - RNA, 64 nt, Human
cacuuugggaggccgaggcagguggaucaccugaggucaggaguucaagacuagccuggccaac

SEQ ID NO: 134650 - RNA, 64 nt, Human
agcacuuugggaggccgaggcgggcggaucaauaggucaggaaauccagaccguccuggcuaac

SEQ ID NO: 134651 - RNA, 64 nt, Human
agcacuuugggaggcugaggcagguggaucacgaggucaggagaucgacaccauccuggcuaac

SEQ ID NO: 134652 - RNA, 64 nt, Human
cacuuugggaagccgaggcgggcagaucaccugaggucaggaguucgagaccauccuggccaac

SEQ ID NO: 134653 - RNA, 64 nt, Human
aguucugcagcaugcagcgguaugacccuacgggggucaggagagcccugcggcccccacccac

SEQ ID NO: 134654 - RNA, 64 nt, Human
gcaccuuagaggucgaggcaggcggaucacuugaggucaggaguucaagaccagccuggccaau

SEQ ID NO: 134655 - RNA, 64 nt, Human
cacuuugggaggccaaggcaggcagaucacuugaggucaggaguucgagaccagccugaccaac

SEQ ID NO: 134656 - RNA, 64 nt, Human
caucucugagaaggagucgggugguaacgguuggggucaggaagaauucugccaaguaucuuua

SEQ ID NO: 134657 - RNA, 64 nt, Human
cacuuugggaggccgagguggccagaucaccugaggucaggaguuugagaccagacugaccaac

SEQ ID NO: 134658 - RNA, 64 nt, Human
ggacggccccacgacagagggagucagcccgggaggucaggagcgcggcgggcgagggcccugu

SEQ ID NO: 134659 - RNA, 64 nt, Human
agccauuggccucugucucguuuugggaaaccaaggucaggaggccguugcagacauaaaucuc

SEQ ID NO: 134660 - RNA, 64 nt, Human
agcacuuugggaggccgaggcgagcagaucacgaggucaggagaccgagaccauccuggcuaac

SEQ ID NO: 134661 - RNA, 64 nt, Human
guugacauccaggauggcugcaagcgcacuugauggucaggaaguuugcagauacucgccaagg

SEQ ID NO: 134662 - RNA, 64 nt, Human
agcacuuugggagacugaggcgggcggaucaugaggucaggagaucgcgaccauccuggcuaac

SEQ ID NO: 134663 - RNA, 64 nt, Human
agcucuuugggaggccaaggcagguagaucacaaggucaggaaauugagaccauccuggcuaau

SEQ ID NO: 134664 - RNA, 64 nt, Human
cagauuccuccuccccaggccuucccuacucaacggucaggaaguauuaaggaagguaaguguu

SEQ ID NO: 134665 - RNA, 64 nt, Human
acacugggaggccgaggcagguggaucacucugaggucaggaguuugagccagccuggccaaca

SEQ ID NO: 134666 - RNA, 64 nt, Human
aucuucuuggugaaggcaagggguugguucuucaggucaggauguuaauggagcuggaaguuca

SEQ ID NO: 134667 - RNA, 64 nt, Human
gcccagggcgccugcagggcugcuacagggaccuggucaggaggugcacauggugcccugcccu

SEQ ID NO: 134668 - RNA, 64 nt, Human
caccccacccucccuaccccuccccagucucuggggucaggaagaaaccuuauuuuagguugug

SEQ ID NO: 134669 - RNA, 64 nt, Human
aaccccugcgaaucacacaugaccuuugcgggaaggucaggaggccugucuaagucaagucagc

SEQ ID NO: 134670 - RNA, 64 nt, Human
agcacuuugggaggcugagguggguggaugacaaggucaggaguucaagaccagcuuggccaac

SEQ ID NO: 134671 - RNA, 64 nt, Human
uucuuaguuggugaagacuuaaacaucugccugaggucaggaggcaauuugccugccuuguaca

SEQ ID NO: 134672 - RNA, 64 nt, Human
agcacuuugggaggccaaggcgggcggaucacgaggucaggagaucgagaccauccuggcuaac

SEQ ID NO: 134673 - RNA, 64 nt, Human
cccacccacccccacauuugcacaccuuccacagggucaggauggaguagcugccuugcgaggu

SEQ ID NO: 134674 - RNA, 64 nt, Human
cagcacuuuggaggccaaggcggguggaucacgaggucaggagaucgagaccauccuggcuaac

SEQ ID NO: 134675 - RNA, 64 nt, Human
agcacugggaagcuaaggcggguggaucacuugaggucaggaguucgagaccagccuggccaac

SEQ ID NO: 134676 - RNA, 64 nt, Human
agcacuuugggaggccgaggugggcggaucacgaggucaggagauugagaccuccuggcuaaca

SEQ ID NO: 134677 - RNA, 64 nt, Human
cacuuugggaggccaagguuggcagaucaccugaggucaggaguucaagaccagucuggccaac

SEQ ID NO: 134678 - RNA, 64 nt, Human
gagugaaggagggggcccuggggcaaggcucgggggucaggagcucagcguccgcuacucagcc

SEQ ID NO: 134679 - RNA, 64 nt, Human
cacuuugggaggccaagauggguggaucaccugaggucaggaguucuagaucagccuggccaac

SEQ ID NO: 134680 - RNA, 64 nt, Human
uuguggagauggcuuugcggcggugugagcuggcggucaggagugagggcccagccuucccggc

SEQ ID NO: 134681 - RNA, 64 nt, Human
caaaaaaacaaauacaaacaaaccucgucaccacggucaggaggagguucagacauucugccca

SEQ ID NO: 134682 - RNA, 64 nt, Human
agcacuaccugggucucauuccaagaaggaagagggucaggagaccuggggagucucauauucc

SEQ ID NO: 134683 - RNA, 64 nt, Human
cacuuugggaggccgaggcaggcggaucaccugaggucaggaguuugagaccagucuggccaac

SEQ ID NO: 134684 - RNA, 64 nt, Human
aaauaccuacugcugagagggcugcugaccauuuggucaggauuccuguugccuuuauauccaa

SEQ ID NO: 134685 - RNA, 64 nt, Human
cacuuugggaggccgaggcagguggaucacuugaggucaggaguucaagaccagccuggccaac

SEQ ID NO: 134686 - RNA, 64 nt, Human
cacuuugggaggcugagacaggcagaucacuugaggucaggaguucgaagucagccuggccaac

SEQ ID NO: 134687 - RNA, 64 nt, Human
gucauuuauguggcuggaaagcacccaaagugguggucaggagggucgcugcuguggaaggggu

SEQ ID NO: 134688 - RNA, 64 nt, Human
cacuuugggagaccgaggcagguggaucaccugaggucaggaguucgagaccagccuggccaac

SEQ ID NO: 134689 - RNA, 64 nt, Human
cacuuugggaggccgaggcggguggaucaccuaaggucaggaguuugagaucagccugcccaac

SEQ ID NO: 134690 - RNA, 64 nt, Human
agccccuggcuuuccccucagccucaggaaagguggucaggaaaacucuggcuggacaaggguc

SEQ ID NO: 134691 - RNA, 64 nt, Human
aaaacaacacauuugcuggcccacaguuuuugagggucaggaguccaggcccagcauaacuggg

SEQ ID NO: 134692 - RNA, 64 nt, Human
cacuuugggaggccgaggugggcagaucaccggaggucaggaguucgagaccagccuugccaac

SEQ ID NO: 134693 - RNA, 64 nt, Human
agcacuuugggaggccgaggcgggcggaucacgaggucaggaguucgagaccagccuggccaac

SEQ ID NO: 134694 - RNA, 64 nt, Human
cagcacagccagaaaggggcugcauuugugcccaggucaggagcaaauugaaaaaaaaaauaaa

SEQ ID NO: 134695 - RNA, 64 nt, Human
guguccauuagacauuuggcuacaucuggcuggaggucaggagaaaauucugagguaaauagau

SEQ ID NO: 134696 - RNA, 64 nt, Human; identical to SEQ ID NO: 134638

SEQ ID NO: 134697 - RNA, 64 nt, Human
caauuugggaguccgaggcgggcggaucacucgaggucaggaguuccagaccagccugaccaaa

SEQ ID NO: 134698 - RNA, 64 nt, Human
agcacuuugggaggcugaggcagguggaucacgaggucaggagaucgagaccauccuggcuaac

SEQ ID NO: 134699 - RNA, 64 nt, Human; identical to SEQ ID NO: 134638

SEQ ID NO: 134700 - RNA, 64 nt, Human; identical to SEQ ID NO: 134454

SEQ ID NO: 134701 - RNA, 64 nt, Human
uacuuugggaggccgaggcgggcagaucacuugaggucaggaguucaagaccagccuggccaac

SEQ ID NO: 134702 - RNA, 64 nt, Human
agcacuuugggaggccaaggcaggcagaucacgaggucaggaguucgagaccauccuggccaac

SEQ ID NO: 134703 - RNA, 64 nt, Human
ccccacaccccauccccagcuagcccaagcuccaggucaggaggggagggugcugggccugaca

SEQ ID NO: 134704 - RNA, 64 nt, Human
ccccucccuuccauccuccucuccaaagaacagaggucaggaaaaacacuggcugggacgcuag

SEQ ID NO: 134705 - RNA, 64 nt, Human
cacuuugggaggccaaggcaggcagaucaccugaggucaggaguuugagaccagccuggccaac

SEQ ID NO: 134706 - RNA, 64 nt, Human
cacuuugggaggccaaggcaggcggaucaccugaggucaggaguucaagaccagccugcccaac

SEQ ID NO: 134707 - RNA, 64 nt, Human
cugggcgguggccgggcgugguggcucacgcugaggucaggaguucgagaccagccuggccaac

SEQ ID NO: 134708 - RNA, 64 nt, Human
cacuuugggaggccgaggugggcagaucagcugaggucaggagaucgagaccagccuggccaac

SEQ ID NO: 134709 - RNA, 64 nt, Human; identical to SEQ ID NO: 134052

SEQ ID NO: 134710 - RNA, 64 nt, Human; identical to SEQ ID NO: 134053

SEQ ID NO: 134711 - RNA, 64 nt, Human; identical to SEQ ID NO: 134054

SEQ ID NO: 134712 - RNA, 64 nt, Human; identical to SEQ ID NO: 134055

SEQ ID NO: 134713 - RNA, 64 nt, Human; identical to SEQ ID NO: 134056

SEQ ID NO: 134714 - RNA, 64 nt, Human; identical to SEQ ID NO: 134057

SEQ ID NO: 134715 - RNA, 64 nt, Human; identical to SEQ ID NO: 134058

SEQ ID NO: 134716 - RNA, 64 nt, Human; identical to SEQ ID NO: 134059

SEQ ID NO: 134717 - RNA, 64 nt, Human; identical to SEQ ID NO: 134060

SEQ ID NO: 134718 - RNA, 64 nt, Human; identical to SEQ ID NO: 134061

SEQ ID NO: 134719 - RNA, 64 nt, Human; identical to SEQ ID NO: 134062

SEQ ID NO: 134720 - RNA, 64 nt, Human; identical to SEQ ID NO: 134063

SEQ ID NO: 134721 - RNA, 64 nt, Human; identical to SEQ ID NO: 134064

SEQ ID NO: 134722 - RNA, 64 nt, Human; identical to SEQ ID NO: 134065

SEQ ID NO: 134723 - RNA, 64 nt, Human; identical to SEQ ID NO: 134066

SEQ ID NO: 134724 - RNA, 64 nt, Human; identical to SEQ ID NO: 134067

SEQ ID NO: 134725 - RNA, 64 nt, Human; identical to SEQ ID NO: 134068

SEQ ID NO: 134726 - RNA, 64 nt, Human; identical to SEQ ID NO: 134069

SEQ ID NO: 134727 - RNA, 64 nt, Human; identical to SEQ ID NO: 134070

SEQ ID NO: 134728 - RNA, 64 nt, Human; identical to SEQ ID NO: 134071

SEQ ID NO: 134729 - RNA, 64 nt, Human; identical to SEQ ID NO: 134072

SEQ ID NO: 134730 - RNA, 64 nt, Human; identical to SEQ ID NO: 134073

SEQ ID NO: 134731 - RNA, 64 nt, Human; identical to SEQ ID NO: 134074

SEQ ID NO: 134732 - RNA, 64 nt, Human; identical to SEQ ID NO: 134075

SEQ ID NO: 134733 - RNA, 64 nt, Human; identical to SEQ ID NO: 134076

SEQ ID NO: 134734 - RNA, 64 nt, Human; identical to SEQ ID NO: 134077

SEQ ID NO: 134735 - RNA, 64 nt, Human; identical to SEQ ID NO: 134078

SEQ ID NO: 134736 - RNA, 64 nt, Human; identical to SEQ ID NO: 134079

SEQ ID NO: 134737 - RNA, 64 nt, Human; identical to SEQ ID NO: 134080

SEQ ID NO: 134738 - RNA, 64 nt, Human; identical to SEQ ID NO: 134081

SEQ ID NO: 134739 - RNA, 64 nt, Human; identical to SEQ ID NO: 134082

SEQ ID NO: 134740 - RNA, 50 nt, Human; identical to SEQ ID NO: 134083

SEQ ID NO: 134741 - RNA, 64 nt, Human; identical to SEQ ID NO: 134084

SEQ ID NO: 134742 - RNA, 64 nt, Human; identical to SEQ ID NO: 134085

SEQ ID NO: 134743 - RNA, 64 nt, Human; identical to SEQ ID NO: 134086

SEQ ID NO: 134744 - RNA, 64 nt, Human; identical to SEQ ID NO: 134087

SEQ ID NO: 134745 - RNA, 64 nt, Human; identical to SEQ ID NO: 134088

SEQ ID NO: 134746 - RNA, 64 nt, Human; identical to SEQ ID NO: 134089

SEQ ID NO: 134747 - RNA, 64 nt, Human; identical to SEQ ID NO: 134090

SEQ ID NO: 134748 - RNA, 64 nt, Human; identical to SEQ ID NO: 134091

SEQ ID NO: 134749 - RNA, 64 nt, Human; identical to SEQ ID NO: 134092

SEQ ID NO: 134750 - RNA, 64 nt, Human; identical to SEQ ID NO: 134093

SEQ ID NO: 134751 - RNA, 64 nt, Human; identical to SEQ ID NO: 134094

SEQ ID NO: 134752 - RNA, 64 nt, Human; identical to SEQ ID NO: 134095

SEQ ID NO: 134753 - RNA, 64 nt, Human; identical to SEQ ID NO: 134096

SEQ ID NO: 134754 - RNA, 64 nt, Human; identical to SEQ ID NO: 134097

SEQ ID NO: 134755 - RNA, 64 nt, Human; identical to SEQ ID NO: 134098

SEQ ID NO: 134756 - RNA, 64 nt, Human; identical to SEQ ID NO: 134099

SEQ ID NO: 134757 - RNA, 64 nt, Human; identical to SEQ ID NO: 134100

SEQ ID NO: 134758 - RNA, 64 nt, Human; identical to SEQ ID NO: 134101

SEQ ID NO: 134759 - RNA, 64 nt, Human; identical to SEQ ID NO: 134102

SEQ ID NO: 134760 - RNA, 64 nt, Human; identical to SEQ ID NO: 134103

SEQ ID NO: 134761 - RNA, 64 nt, Human; identical to SEQ ID NO: 134104

SEQ ID NO: 134762 - RNA, 64 nt, Human; identical to SEQ ID NO: 134105

SEQ ID NO: 134763 - RNA, 64 nt, Human; identical to SEQ ID NO: 134106

SEQ ID NO: 134764 - RNA, 64 nt, Human; identical to SEQ ID NO: 134107

SEQ ID NO: 134765 - RNA, 64 nt, Human; identical to SEQ ID NO: 134108

SEQ ID NO: 134766 - RNA, 64 nt, Human; identical to SEQ ID NO: 134109

SEQ ID NO: 134767 - RNA, 64 nt, Human; identical to SEQ ID NO: 134110

SEQ ID NO: 134768 - RNA, 64 nt, Human; identical to SEQ ID NO: 134111

SEQ ID NO: 134769 - RNA, 64 nt, Human; identical to SEQ ID NO: 134112

SEQ ID NO: 134770 - RNA, 64 nt, Human; identical to SEQ ID NO: 134113

SEQ ID NO: 134771 - RNA, 64 nt, Human; identical to SEQ ID NO: 134114

SEQ ID NO: 134772 - RNA, 64 nt, Human; identical to SEQ ID NO: 134115

SEQ ID NO: 134773 - RNA, 64 nt, Human; identical to SEQ ID NO: 134116

SEQ ID NO: 134774 - RNA, 64 nt, Human; identical to SEQ ID NO: 134117

SEQ ID NO: 134775 - RNA, 64 nt, Human; identical to SEQ ID NO: 134118

SEQ ID NO: 134776 - RNA, 64 nt, Human; identical to SEQ ID NO: 134119

SEQ ID NO: 134777 - RNA, 64 nt, Human; identical to SEQ ID NO: 134120

SEQ ID NO: 134778 - RNA, 64 nt, Human; identical to SEQ ID NO: 134121

SEQ ID NO: 134779 - RNA, 64 nt, Human; identical to SEQ ID NO: 134122

SEQ ID NO: 134780 - RNA, 64 nt, Human; identical to SEQ ID NO: 134123

SEQ ID NO: 134781 - RNA, 64 nt, Human; identical to SEQ ID NO: 134124

SEQ ID NO: 134782 - RNA, 64 nt, Human; identical to SEQ ID NO: 134125

SEQ ID NO: 134783 - RNA, 64 nt, Human; identical to SEQ ID NO: 134126

SEQ ID NO: 134784 - RNA, 64 nt, Human; identical to SEQ ID NO: 134127

SEQ ID NO: 134785 - RNA, 64 nt, Human; identical to SEQ ID NO: 134128

SEQ ID NO: 134786 - RNA, 64 nt, Human; identical to SEQ ID NO: 134129

SEQ ID NO: 134787 - RNA, 64 nt, Human; identical to SEQ ID NO: 134130

SEQ ID NO: 134788 - RNA, 64 nt, Human; identical to SEQ ID NO: 134131

SEQ ID NO: 134789 - RNA, 64 nt, Human; identical to SEQ ID NO: 134132

SEQ ID NO: 134790 - RNA, 64 nt, Human; identical to SEQ ID NO: 134133

SEQ ID NO: 134791 - RNA, 64 nt, Human; identical to SEQ ID NO: 134134

SEQ ID NO: 134792 - RNA, 64 nt, Human; identical to SEQ ID NO: 134135

SEQ ID NO: 134793 - RNA, 64 nt, Human; identical to SEQ ID NO: 134136

SEQ ID NO: 134794 - RNA, 64 nt, Human; identical to SEQ ID NO: 134137

SEQ ID NO: 134795 - RNA, 64 nt, Human; identical to SEQ ID NO: 134138

SEQ ID NO: 134796 - RNA, 64 nt, Human; identical to SEQ ID NO: 134139

SEQ ID NO: 134797 - RNA, 64 nt, Human; identical to SEQ ID NO: 134140

SEQ ID NO: 134798 - RNA, 64 nt, Human; identical to SEQ ID NO: 134141

SEQ ID NO: 134799 - RNA, 64 nt, Human; identical to SEQ ID NO: 134142

SEQ ID NO: 134800 - RNA, 64 nt, Human; identical to SEQ ID NO: 134143

SEQ ID NO: 134801 - RNA, 64 nt, Human; identical to SEQ ID NO: 134144

SEQ ID NO: 134802 - RNA, 64 nt, Human; identical to SEQ ID NO: 134145

SEQ ID NO: 134803 - RNA, 64 nt, Human; identical to SEQ ID NO: 134146

SEQ ID NO: 134804 - RNA, 64 nt, Human; identical to SEQ ID NO: 134147

SEQ ID NO: 134805 - RNA, 64 nt, Human; identical to SEQ ID NO: 134148

SEQ ID NO: 134806 - RNA, 64 nt, Human; identical to SEQ ID NO: 134149

SEQ ID NO: 134807 - RNA, 64 nt, Human; identical to SEQ ID NO: 134150

SEQ ID NO: 134808 - RNA, 64 nt, Human; identical to SEQ ID NO: 134151

SEQ ID NO: 134809 - RNA, 64 nt, Human; identical to SEQ ID NO: 134152

SEQ ID NO: 134810 - RNA, 64 nt, Human; identical to SEQ ID NO: 134153

SEQ ID NO: 134811 - RNA, 64 nt, Human; identical to SEQ ID NO: 134154

SEQ ID NO: 134812 - RNA, 64 nt, Human; identical to SEQ ID NO: 134155

SEQ ID NO: 134813 - RNA, 64 nt, Human; identical to SEQ ID NO: 134156

SEQ ID NO: 134814 - RNA, 64 nt, Human; identical to SEQ ID NO: 134157

SEQ ID NO: 134815 - RNA, 64 nt, Human; identical to SEQ ID NO: 134158

SEQ ID NO: 134816 - RNA, 64 nt, Human; identical to SEQ ID NO: 134159

SEQ ID NO: 134817 - RNA, 64 nt, Human; identical to SEQ ID NO: 134160

SEQ ID NO: 134818 - RNA, 64 nt, Human; identical to SEQ ID NO: 134161

SEQ ID NO: 134819 - RNA, 64 nt, Human; identical to SEQ ID NO: 134162

SEQ ID NO: 134820 - RNA, 64 nt, Human; identical to SEQ ID NO: 134163

SEQ ID NO: 134821 - RNA, 64 nt, Human; identical to SEQ ID NO: 134164

SEQ ID NO: 134822 - RNA, 64 nt, Human; identical to SEQ ID NO: 134165

SEQ ID NO: 134823 - RNA, 64 nt, Human; identical to SEQ ID NO: 134166

SEQ ID NO: 134824 - RNA, 64 nt, Human; identical to SEQ ID NO: 134167

SEQ ID NO: 134825 - RNA, 64 nt, Human; identical to SEQ ID NO: 134168

SEQ ID NO: 134826 - RNA, 64 nt, Human; identical to SEQ ID NO: 134169

SEQ ID NO: 134827 - RNA, 64 nt, Human; identical to SEQ ID NO: 134170

SEQ ID NO: 134828 - RNA, 64 nt, Human; identical to SEQ ID NO: 134171

SEQ ID NO: 134829 - RNA, 64 nt, Human; identical to SEQ ID NO: 134172

SEQ ID NO: 134830 - RNA, 64 nt, Human; identical to SEQ ID NO: 134173

SEQ ID NO: 134831 - RNA, 64 nt, Human; identical to SEQ ID NO: 134174

SEQ ID NO: 134832 - RNA, 64 nt, Human; identical to SEQ ID NO: 134175

SEQ ID NO: 134833 - RNA, 64 nt, Human; identical to SEQ ID NO: 134176

SEQ ID NO: 134834 - RNA, 64 nt, Human; identical to SEQ ID NO: 134177

SEQ ID NO: 134835 - RNA, 64 nt, Human; identical to SEQ ID NO: 134178

SEQ ID NO: 134836 - RNA, 64 nt, Human; identical to SEQ ID NO: 134179

SEQ ID NO: 134837 - RNA, 64 nt, Human; identical to SEQ ID NO: 134180

SEQ ID NO: 134838 - RNA, 64 nt, Human; identical to SEQ ID NO: 134181

SEQ ID NO: 134839 - RNA, 64 nt, Human; identical to SEQ ID NO: 134182

SEQ ID NO: 134840 - RNA, 64 nt, Human; identical to SEQ ID NO: 134183

SEQ ID NO: 134841 - RNA, 64 nt, Human; identical to SEQ ID NO: 134184

SEQ ID NO: 134842 - RNA, 64 nt, Human; identical to SEQ ID NO: 134185

SEQ ID NO: 134843 - RNA, 64 nt, Human; identical to SEQ ID NO: 134186

SEQ ID NO: 134844 - RNA, 64 nt, Human; identical to SEQ ID NO: 134187

SEQ ID NO: 134845 - RNA, 64 nt, Human; identical to SEQ ID NO: 134188

SEQ ID NO: 134846 - RNA, 64 nt, Human; identical to SEQ ID NO: 134189

SEQ ID NO: 134847 - RNA, 64 nt, Human; identical to SEQ ID NO: 134190

SEQ ID NO: 134848 - RNA, 64 nt, Human; identical to SEQ ID NO: 134191

SEQ ID NO: 134849 - RNA, 64 nt, Human; identical to SEQ ID NO: 134192

SEQ ID NO: 134850 - RNA, 64 nt, Human; identical to SEQ ID NO: 134193

SEQ ID NO: 134851 - RNA, 64 nt, Human; identical to SEQ ID NO: 134194

SEQ ID NO: 134852 - RNA, 64 nt, Human; identical to SEQ ID NO: 134195

SEQ ID NO: 134853 - RNA, 64 nt, Human; identical to SEQ ID NO: 134196

SEQ ID NO: 134854 - RNA, 64 nt, Human; identical to SEQ ID NO: 134197

SEQ ID NO: 134855 - RNA, 64 nt, Human; identical to SEQ ID NO: 134198

SEQ ID NO: 134856 - RNA, 64 nt, Human; identical to SEQ ID NO: 134199

SEQ ID NO: 134857 - RNA, 64 nt, Human; identical to SEQ ID NO: 134200

SEQ ID NO: 134858 - RNA, 64 nt, Human; identical to SEQ ID NO: 134201

SEQ ID NO: 134859 - RNA, 64 nt, Human; identical to SEQ ID NO: 134202

SEQ ID NO: 134860 - RNA, 64 nt, Human; identical to SEQ ID NO: 134203

SEQ ID NO: 134861 - RNA, 64 nt, Human; identical to SEQ ID NO: 134204

SEQ ID NO: 134862 - RNA, 64 nt, Human; identical to SEQ ID NO: 134205

SEQ ID NO: 134863 - RNA, 64 nt, Human; identical to SEQ ID NO: 134206

SEQ ID NO: 134864 - RNA, 64 nt, Human; identical to SEQ ID NO: 134207

SEQ ID NO: 134865 - RNA, 64 nt, Human; identical to SEQ ID NO: 134208

SEQ ID NO: 134866 - RNA, 64 nt, Human; identical to SEQ ID NO: 134209

SEQ ID NO: 134867 - RNA, 64 nt, Human; identical to SEQ ID NO: 134210

SEQ ID NO: 134868 - RNA, 64 nt, Human; identical to SEQ ID NO: 134211

SEQ ID NO: 134869 - RNA, 64 nt, Human; identical to SEQ ID NO: 134212

SEQ ID NO: 134870 - RNA, 64 nt, Human; identical to SEQ ID NO: 134213

SEQ ID NO: 134871 - RNA, 64 nt, Human; identical to SEQ ID NO: 134214

SEQ ID NO: 134872 - RNA, 64 nt, Human; identical to SEQ ID NO: 134215

SEQ ID NO: 134873 - RNA, 64 nt, Human; identical to SEQ ID NO: 134216

SEQ ID NO: 134874 - RNA, 64 nt, Human; identical to SEQ ID NO: 134217

SEQ ID NO: 134875 - RNA, 64 nt, Human; identical to SEQ ID NO: 134218

SEQ ID NO: 134876 - RNA, 64 nt, Human; identical to SEQ ID NO: 134219

SEQ ID NO: 134877 - RNA, 64 nt, Human; identical to SEQ ID NO: 134220

SEQ ID NO: 134878 - RNA, 64 nt, Human; identical to SEQ ID NO: 134221

SEQ ID NO: 134879 - RNA, 64 nt, Human; identical to SEQ ID NO: 134222

SEQ ID NO: 134880 - RNA, 64 nt, Human; identical to SEQ ID NO: 134223

SEQ ID NO: 134881 - RNA, 64 nt, Human; identical to SEQ ID NO: 134224

SEQ ID NO: 134882 - RNA, 64 nt, Human; identical to SEQ ID NO: 134225

SEQ ID NO: 134883 - RNA, 64 nt, Human; identical to SEQ ID NO: 134226

SEQ ID NO: 134884 - RNA, 64 nt, Human; identical to SEQ ID NO: 134227

SEQ ID NO: 134885 - RNA, 64 nt, Human; identical to SEQ ID NO: 134228

SEQ ID NO: 134886 - RNA, 64 nt, Human; identical to SEQ ID NO: 134229

SEQ ID NO: 134887 - RNA, 64 nt, Human; identical to SEQ ID NO: 134230

SEQ ID NO: 134888 - RNA, 64 nt, Human; identical to SEQ ID NO: 134231

SEQ ID NO: 134889 - RNA, 64 nt, Human; identical to SEQ ID NO: 134211

SEQ ID NO: 134890 - RNA, 64 nt, Human; identical to SEQ ID NO: 134233

SEQ ID NO: 134891 - RNA, 64 nt, Human; identical to SEQ ID NO: 134234

SEQ ID NO: 134892 - RNA, 64 nt, Human; identical to SEQ ID NO: 134235

SEQ ID NO: 134893 - RNA, 64 nt, Human; identical to SEQ ID NO: 134236

SEQ ID NO: 134894 - RNA, 64 nt, Human; identical to SEQ ID NO: 134237

SEQ ID NO: 134895 - RNA, 64 nt, Human; identical to SEQ ID NO: 134238

SEQ ID NO: 134896 - RNA, 64 nt, Human; identical to SEQ ID NO: 134239

SEQ ID NO: 134897 - RNA, 64 nt, Human; identical to SEQ ID NO: 134240

SEQ ID NO: 134898 - RNA, 64 nt, Human; identical to SEQ ID NO: 134241

SEQ ID NO: 134899 - RNA, 64 nt, Human; identical to SEQ ID NO: 134242

SEQ ID NO: 134900 - RNA, 64 nt, Human; identical to SEQ ID NO: 134243

SEQ ID NO: 134901 - RNA, 64 nt, Human; identical to SEQ ID NO: 134244

SEQ ID NO: 134902 - RNA, 64 nt, Human; identical to SEQ ID NO: 134245

SEQ ID NO: 134903 - RNA, 64 nt, Human; identical to SEQ ID NO: 134246

SEQ ID NO: 134904 - RNA, 64 nt, Human; identical to SEQ ID NO: 134247

SEQ ID NO: 134905 - RNA, 64 nt, Human; identical to SEQ ID NO: 134248

SEQ ID NO: 134906 - RNA, 64 nt, Human; identical to SEQ ID NO: 134249

SEQ ID NO: 134907 - RNA, 64 nt, Human; identical to SEQ ID NO: 134250

SEQ ID NO: 134908 - RNA, 64 nt, Human; identical to SEQ ID NO: 134251

SEQ ID NO: 134909 - RNA, 64 nt, Human; identical to SEQ ID NO: 134252

SEQ ID NO: 134910 - RNA, 64 nt, Human; identical to SEQ ID NO: 134253

SEQ ID NO: 134911 - RNA, 64 nt, Human; identical to SEQ ID NO: 134254

SEQ ID NO: 134912 - RNA, 64 nt, Human; identical to SEQ ID NO: 134255

SEQ ID NO: 134913 - RNA, 64 nt, Human; identical to SEQ ID NO: 134256

SEQ ID NO: 134914 - RNA, 64 nt, Human; identical to SEQ ID NO: 134257

SEQ ID NO: 134915 - RNA, 64 nt, Human; identical to SEQ ID NO: 134258

SEQ ID NO: 134916 - RNA, 64 nt, Human; identical to SEQ ID NO: 134259

SEQ ID NO: 134917 - RNA, 64 nt, Human; identical to SEQ ID NO: 134260

SEQ ID NO: 134918 - RNA, 64 nt, Human; identical to SEQ ID NO: 134261

SEQ ID NO: 134919 - RNA, 64 nt, Human; identical to SEQ ID NO: 134262

SEQ ID NO: 134920 - RNA, 64 nt, Human; identical to SEQ ID NO: 134263

SEQ ID NO: 134921 - RNA, 64 nt, Human; identical to SEQ ID NO: 134264

SEQ ID NO: 134922 - RNA, 64 nt, Human; identical to SEQ ID NO: 134265

SEQ ID NO: 134923 - RNA, 64 nt, Human; identical to SEQ ID NO: 134266

SEQ ID NO: 134924 - RNA, 64 nt, Human; identical to SEQ ID NO: 134267

SEQ ID NO: 134925 - RNA, 64 nt, Human; identical to SEQ ID NO: 134268

SEQ ID NO: 134926 - RNA, 64 nt, Human; identical to SEQ ID NO: 134269

SEQ ID NO: 134927 - RNA, 64 nt, Human; identical to SEQ ID NO: 134270

SEQ ID NO: 134928 - RNA, 64 nt, Human; identical to SEQ ID NO: 134271

SEQ ID NO: 134929 - RNA, 64 nt, Human; identical to SEQ ID NO: 134272

SEQ ID NO: 134930 - RNA, 64 nt, Human; identical to SEQ ID NO: 134273

SEQ ID NO: 134931 - RNA, 64 nt, Human; identical to SEQ ID NO: 134274

SEQ ID NO: 134932 - RNA, 64 nt, Human; identical to SEQ ID NO: 134088

SEQ ID NO: 134933 - RNA, 64 nt, Human; identical to SEQ ID NO: 134276

SEQ ID NO: 134934 - RNA, 64 nt, Human; identical to SEQ ID NO: 134277

SEQ ID NO: 134935 - RNA, 64 nt, Human; identical to SEQ ID NO: 134278

SEQ ID NO: 134936 - RNA, 64 nt, Human; identical to SEQ ID NO: 134279

SEQ ID NO: 134937 - RNA, 64 nt, Human; identical to SEQ ID NO: 134280

SEQ ID NO: 134938 - RNA, 64 nt, Human; identical to SEQ ID NO: 134281

SEQ ID NO: 134939 - RNA, 64 nt, Human; identical to SEQ ID NO: 134282

SEQ ID NO: 134940 - RNA, 64 nt, Human; identical to SEQ ID NO: 134283

SEQ ID NO: 134941 - RNA, 64 nt, Human; identical to SEQ ID NO: 134284

SEQ ID NO: 134942 - RNA, 64 nt, Human; identical to SEQ ID NO: 134099

SEQ ID NO: 134943 - RNA, 64 nt, Human; identical to SEQ ID NO: 134286

SEQ ID NO: 134944 - RNA, 64 nt, Human; identical to SEQ ID NO: 134287

SEQ ID NO: 134945 - RNA, 64 nt, Human; identical to SEQ ID NO: 134288

SEQ ID NO: 134946 - RNA, 64 nt, Human; identical to SEQ ID NO: 134289

SEQ ID NO: 134947 - RNA, 64 nt, Human; identical to SEQ ID NO: 134290

SEQ ID NO: 134948 - RNA, 64 nt, Human; identical to SEQ ID NO: 134291

SEQ ID NO: 134949 - RNA, 64 nt, Human; identical to SEQ ID NO: 134292

SEQ ID NO: 134950 - RNA, 64 nt, Human; identical to SEQ ID NO: 134293

SEQ ID NO: 134951 - RNA, 64 nt, Human; identical to SEQ ID NO: 134294

SEQ ID NO: 134952 - RNA, 64 nt, Human; identical to SEQ ID NO: 134295

SEQ ID NO: 134953 - RNA, 64 nt, Human; identical to SEQ ID NO: 134296

SEQ ID NO: 134954 - RNA, 64 nt, Human; identical to SEQ ID NO: 134297

SEQ ID NO: 134955 - RNA, 64 nt, Human; identical to SEQ ID NO: 134298

SEQ ID NO: 134956 - RNA, 64 nt, Human; identical to SEQ ID NO: 134299

SEQ ID NO: 134957 - RNA, 64 nt, Human; identical to SEQ ID NO: 134300

SEQ ID NO: 134958 - RNA, 64 nt, Human; identical to SEQ ID NO: 134301

SEQ ID NO: 134959 - RNA, 64 nt, Human; identical to SEQ ID NO: 134302

SEQ ID NO: 134960 - RNA, 64 nt, Human; identical to SEQ ID NO: 134303

SEQ ID NO: 134961 - RNA, 64 nt, Human; identical to SEQ ID NO: 134304

SEQ ID NO: 134962 - RNA, 64 nt, Human; identical to SEQ ID NO: 134305

SEQ ID NO: 134963 - RNA, 64 nt, Human; identical to SEQ ID NO: 134306

SEQ ID NO: 134964 - RNA, 64 nt, Human; identical to SEQ ID NO: 134307

SEQ ID NO: 134965 - RNA, 64 nt, Human; identical to SEQ ID NO: 134308

SEQ ID NO: 134966 - RNA, 64 nt, Human; identical to SEQ ID NO: 134309

SEQ ID NO: 134967 - RNA, 64 nt, Human; identical to SEQ ID NO: 134310

SEQ ID NO: 134968 - RNA, 64 nt, Human; identical to SEQ ID NO: 134311

SEQ ID NO: 134969 - RNA, 64 nt, Human; identical to SEQ ID NO: 134312

SEQ ID NO: 134970 - RNA, 64 nt, Human; identical to SEQ ID NO: 134313

SEQ ID NO: 134971 - RNA, 64 nt, Human; identical to SEQ ID NO: 134314

SEQ ID NO: 134972 - RNA, 64 nt, Human; identical to SEQ ID NO: 134315

SEQ ID NO: 134973 - RNA, 64 nt, Human; identical to SEQ ID NO: 134316

SEQ ID NO: 134974 - RNA, 64 nt, Human; identical to SEQ ID NO: 134317

SEQ ID NO: 134975 - RNA, 64 nt, Human; identical to SEQ ID NO: 134318

SEQ ID NO: 134976 - RNA, 64 nt, Human; identical to SEQ ID NO: 134319

SEQ ID NO: 134977 - RNA, 64 nt, Human; identical to SEQ ID NO: 134320

SEQ ID NO: 134978 - RNA, 64 nt, Human; identical to SEQ ID NO: 134321

SEQ ID NO: 134979 - RNA, 64 nt, Human; identical to SEQ ID NO: 134322

SEQ ID NO: 134980 - RNA, 64 nt, Human; identical to SEQ ID NO: 134323

SEQ ID NO: 134981 - RNA, 64 nt, Human; identical to SEQ ID NO: 134324

SEQ ID NO: 134982 - RNA, 64 nt, Human; identical to SEQ ID NO: 134325

SEQ ID NO: 134983 - RNA, 64 nt, Human; identical to SEQ ID NO: 134326

SEQ ID NO: 134984 - RNA, 64 nt, Human; identical to SEQ ID NO: 134327

SEQ ID NO: 134985 - RNA, 64 nt, Human; identical to SEQ ID NO: 134328

SEQ ID NO: 134986 - RNA, 64 nt, Human; identical to SEQ ID NO: 134329

SEQ ID NO: 134987 - RNA, 64 nt, Human; identical to SEQ ID NO: 134330

SEQ ID NO: 134988 - RNA, 64 nt, Human; identical to SEQ ID NO: 134331

SEQ ID NO: 134989 - RNA, 64 nt, Human; identical to SEQ ID NO: 134332

SEQ ID NO: 134990 - RNA, 64 nt, Human; identical to SEQ ID NO: 134333

SEQ ID NO: 134991 - RNA, 64 nt, Human; identical to SEQ ID NO: 134334

SEQ ID NO: 134992 - RNA, 64 nt, Human; identical to SEQ ID NO: 134335

SEQ ID NO: 134993 - RNA, 64 nt, Human; identical to SEQ ID NO: 134336

SEQ ID NO: 134994 - RNA, 64 nt, Human; identical to SEQ ID NO: 134337

SEQ ID NO: 134995 - RNA, 64 nt, Human; identical to SEQ ID NO: 134338

SEQ ID NO: 134996 - RNA, 64 nt, Human; identical to SEQ ID NO: 134339

SEQ ID NO: 134997 - RNA, 64 nt, Human; identical to SEQ ID NO: 134340

SEQ ID NO: 134998 - RNA, 64 nt, Human; identical to SEQ ID NO: 134341

SEQ ID NO: 134999 - RNA, 64 nt, Human; identical to SEQ ID NO: 134342

SEQ ID NO: 135000 - RNA, 64 nt, Human; identical to SEQ ID NO: 134343

SEQ ID NO: 135001 - RNA, 64 nt, Human; identical to SEQ ID NO: 134344

SEQ ID NO: 135002 - RNA, 64 nt, Human; identical to SEQ ID NO: 134345

SEQ ID NO: 135003 - RNA, 64 nt, Human; identical to SEQ ID NO: 134346

SEQ ID NO: 135004 - RNA, 64 nt, Human; identical to SEQ ID NO: 134347

SEQ ID NO: 135005 - RNA, 64 nt, Human; identical to SEQ ID NO: 134348

SEQ ID NO: 135006 - RNA, 64 nt, Human; identical to SEQ ID NO: 134349

SEQ ID NO: 135007 - RNA, 64 nt, Human; identical to SEQ ID NO: 134350

SEQ ID NO: 135008 - RNA, 64 nt, Human; identical to SEQ ID NO: 134351

SEQ ID NO: 135009 - RNA, 64 nt, Human; identical to SEQ ID NO: 134352

SEQ ID NO: 135010 - RNA, 64 nt, Human; identical to SEQ ID NO: 134353

SEQ ID NO: 135011 - RNA, 64 nt, Human; identical to SEQ ID NO: 134354

SEQ ID NO: 135012 - RNA, 50 nt, Human; identical to SEQ ID NO: 134355

SEQ ID NO: 135013 - RNA, 64 nt, Human; identical to SEQ ID NO: 134356

SEQ ID NO: 135014 - RNA, 64 nt, Human; identical to SEQ ID NO: 134357

SEQ ID NO: 135015 - RNA, 64 nt, Human; identical to SEQ ID NO: 134358

SEQ ID NO: 135016 - RNA, 64 nt, Human; identical to SEQ ID NO: 134359

SEQ ID NO: 135017 - RNA, 64 nt, Human; identical to SEQ ID NO: 134360

SEQ ID NO: 135018 - RNA, 64 nt, Human; identical to SEQ ID NO: 134361

SEQ ID NO: 135019 - RNA, 64 nt, Human; identical to SEQ ID NO: 134362

SEQ ID NO: 135020 - RNA, 64 nt, Human; identical to SEQ ID NO: 134363

SEQ ID NO: 135021 - RNA, 64 nt, Human; identical to SEQ ID NO: 134364

SEQ ID NO: 135022 - RNA, 64 nt, Human; identical to SEQ ID NO: 134365

SEQ ID NO: 135023 - RNA, 64 nt, Human; identical to SEQ ID NO: 134366

SEQ ID NO: 135024 - RNA, 64 nt, Human; identical to SEQ ID NO: 134367

SEQ ID NO: 135025 - RNA, 64 nt, Human; identical to SEQ ID NO: 134368

SEQ ID NO: 135026 - RNA, 64 nt, Human; identical to SEQ ID NO: 134369

SEQ ID NO: 135027 - RNA, 64 nt, Human; identical to SEQ ID NO: 134370

SEQ ID NO: 135028 - RNA, 64 nt, Human; identical to SEQ ID NO: 134371

SEQ ID NO: 135029 - RNA, 64 nt, Human; identical to SEQ ID NO: 134372

SEQ ID NO: 135030 - RNA, 64 nt, Human; identical to SEQ ID NO: 134373

SEQ ID NO: 135031 - RNA, 64 nt, Human; identical to SEQ ID NO: 134374

SEQ ID NO: 135032 - RNA, 64 nt, Human; identical to SEQ ID NO: 134375

SEQ ID NO: 135033 - RNA, 64 nt, Human; identical to SEQ ID NO: 134376

SEQ ID NO: 135034 - RNA, 64 nt, Human; identical to SEQ ID NO: 134377

SEQ ID NO: 135035 - RNA, 64 nt, Human; identical to SEQ ID NO: 134378

SEQ ID NO: 135036 - RNA, 64 nt, Human; identical to SEQ ID NO: 134379

SEQ ID NO: 135037 - RNA, 64 nt, Human; identical to SEQ ID NO: 134380

SEQ ID NO: 135038 - RNA, 64 nt, Human; identical to SEQ ID NO: 134381

SEQ ID NO: 135039 - RNA, 64 nt, Human; identical to SEQ ID NO: 134382

SEQ ID NO: 135040 - RNA, 64 nt, Human; identical to SEQ ID NO: 134383

SEQ ID NO: 135041 - RNA, 64 nt, Human; identical to SEQ ID NO: 134088

SEQ ID NO: 135042 - RNA, 64 nt, Human; identical to SEQ ID NO: 134385

SEQ ID NO: 135043 - RNA, 64 nt, Human; identical to SEQ ID NO: 134386

SEQ ID NO: 135044 - RNA, 64 nt, Human; identical to SEQ ID NO: 134387

SEQ ID NO: 135045 - RNA, 64 nt, Human; identical to SEQ ID NO: 134388

SEQ ID NO: 135046 - RNA, 64 nt, Human; identical to SEQ ID NO: 134389

SEQ ID NO: 135047 - RNA, 64 nt, Human; identical to SEQ ID NO: 134390

SEQ ID NO: 135048 - RNA, 64 nt, Human; identical to SEQ ID NO: 134391

SEQ ID NO: 135049 - RNA, 64 nt, Human; identical to SEQ ID NO: 134392

SEQ ID NO: 135050 - RNA, 64 nt, Human; identical to SEQ ID NO: 134393

SEQ ID NO: 135051 - RNA, 64 nt, Human; identical to SEQ ID NO: 134394

SEQ ID NO: 135052 - RNA, 64 nt, Human; identical to SEQ ID NO: 134395

SEQ ID NO: 135053 - RNA, 64 nt, Human; identical to SEQ ID NO: 134396

SEQ ID NO: 135054 - RNA, 64 nt, Human; identical to SEQ ID NO: 134397

SEQ ID NO: 135055 - RNA, 64 nt, Human; identical to SEQ ID NO: 134398

SEQ ID NO: 135056 - RNA, 64 nt, Human; identical to SEQ ID NO: 134399

SEQ ID NO: 135057 - RNA, 64 nt, Human; identical to SEQ ID NO: 134400

SEQ ID NO: 135058 - RNA, 64 nt, Human; identical to SEQ ID NO: 134401

SEQ ID NO: 135059 - RNA, 64 nt, Human; identical to SEQ ID NO: 134402

SEQ ID NO: 135060 - RNA, 64 nt, Human; identical to SEQ ID NO: 134403

SEQ ID NO: 135061 - RNA, 64 nt, Human; identical to SEQ ID NO: 134404

SEQ ID NO: 135062 - RNA, 64 nt, Human; identical to SEQ ID NO: 134405

SEQ ID NO: 135063 - RNA, 64 nt, Human; identical to SEQ ID NO: 134406

SEQ ID NO: 135064 - RNA, 64 nt, Human; identical to SEQ ID NO: 134407

SEQ ID NO: 135065 - RNA, 64 nt, Human; identical to SEQ ID NO: 134408

SEQ ID NO: 135066 - RNA, 64 nt, Human; identical to SEQ ID NO: 134409

SEQ ID NO: 135067 - RNA, 64 nt, Human; identical to SEQ ID NO: 134410

SEQ ID NO: 135068 - RNA, 64 nt, Human; identical to SEQ ID NO: 134411

SEQ ID NO: 135069 - RNA, 64 nt, Human; identical to SEQ ID NO: 134412

SEQ ID NO: 135070 - RNA, 64 nt, Human; identical to SEQ ID NO: 134413

SEQ ID NO: 135071 - RNA, 64 nt, Human; identical to SEQ ID NO: 134414

SEQ ID NO: 135072 - RNA, 64 nt, Human; identical to SEQ ID NO: 134415

SEQ ID NO: 135073 - RNA, 64 nt, Human; identical to SEQ ID NO: 134416

SEQ ID NO: 135074 - RNA, 64 nt, Human; identical to SEQ ID NO: 134417

SEQ ID NO: 135075 - RNA, 64 nt, Human; identical to SEQ ID NO: 134418

SEQ ID NO: 135076 - RNA, 64 nt, Human; identical to SEQ ID NO: 134419

SEQ ID NO: 135077 - RNA, 64 nt, Human; identical to SEQ ID NO: 134420

SEQ ID NO: 135078 - RNA, 64 nt, Human; identical to SEQ ID NO: 134421

SEQ ID NO: 135079 - RNA, 64 nt, Human; identical to SEQ ID NO: 134422

SEQ ID NO: 135080 - RNA, 64 nt, Human; identical to SEQ ID NO: 134423

SEQ ID NO: 135081 - RNA, 64 nt, Human; identical to SEQ ID NO: 134424

SEQ ID NO: 135082 - RNA, 64 nt, Human; identical to SEQ ID NO: 134425

SEQ ID NO: 135083 - RNA, 64 nt, Human; identical to SEQ ID NO: 134426

SEQ ID NO: 135084 - RNA, 64 nt, Human; identical to SEQ ID NO: 134427

SEQ ID NO: 135085 - RNA, 64 nt, Human; identical to SEQ ID NO: 134428

SEQ ID NO: 135086 - RNA, 64 nt, Human; identical to SEQ ID NO: 134429

SEQ ID NO: 135087 - RNA, 64 nt, Human; identical to SEQ ID NO: 134430

SEQ ID NO: 135088 - RNA, 64 nt, Human; identical to SEQ ID NO: 134431

SEQ ID NO: 135089 - RNA, 64 nt, Human; identical to SEQ ID NO: 134432

SEQ ID NO: 135090 - RNA, 64 nt, Human; identical to SEQ ID NO: 134433

SEQ ID NO: 135091 - RNA, 64 nt, Human; identical to SEQ ID NO: 134434

SEQ ID NO: 135092 - RNA, 64 nt, Human; identical to SEQ ID NO: 134435

SEQ ID NO: 135093 - RNA, 64 nt, Human; identical to SEQ ID NO: 134436

SEQ ID NO: 135094 - RNA, 64 nt, Human; identical to SEQ ID NO: 134437

SEQ ID NO: 135095 - RNA, 64 nt, Human; identical to SEQ ID NO: 134438

SEQ ID NO: 135096 - RNA, 64 nt, Human; identical to SEQ ID NO: 134439

SEQ ID NO: 135097 - RNA, 64 nt, Human; identical to SEQ ID NO: 134440

SEQ ID NO: 135098 - RNA, 64 nt, Human; identical to SEQ ID NO: 134441

SEQ ID NO: 135099 - RNA, 64 nt, Human; identical to SEQ ID NO: 134442

SEQ ID NO: 135100 - RNA, 64 nt, Human; identical to SEQ ID NO: 134443

SEQ ID NO: 135101 - RNA, 64 nt, Human; identical to SEQ ID NO: 134444

SEQ ID NO: 135102 - RNA, 64 nt, Human; identical to SEQ ID NO: 134445

SEQ ID NO: 135103 - RNA, 64 nt, Human; identical to SEQ ID NO: 134446

SEQ ID NO: 135104 - RNA, 64 nt, Human; identical to SEQ ID NO: 134447

SEQ ID NO: 135105 - RNA, 64 nt, Human; identical to SEQ ID NO: 134448

SEQ ID NO: 135106 - RNA, 64 nt, Human; identical to SEQ ID NO: 134449

SEQ ID NO: 135107 - RNA, 64 nt, Human; identical to SEQ ID NO: 134450

SEQ ID NO: 135108 - RNA, 64 nt, Human; identical to SEQ ID NO: 134451

SEQ ID NO: 135109 - RNA, 51 nt, Human; identical to SEQ ID NO: 134452

SEQ ID NO: 135110 - RNA, 64 nt, Human; identical to SEQ ID NO: 134453

SEQ ID NO: 135111 - RNA, 64 nt, Human; identical to SEQ ID NO: 134454

SEQ ID NO: 135112 - RNA, 64 nt, Human; identical to SEQ ID NO: 134455

SEQ ID NO: 135113 - RNA, 64 nt, Human; identical to SEQ ID NO: 134456

SEQ ID NO: 135114 - RNA, 64 nt, Human; identical to SEQ ID NO: 134457

SEQ ID NO: 135115 - RNA, 64 nt, Human; identical to SEQ ID NO: 134458

SEQ ID NO: 135116 - RNA, 64 nt, Human; identical to SEQ ID NO: 134459

SEQ ID NO: 135117 - RNA, 64 nt, Human; identical to SEQ ID NO: 134460

SEQ ID NO: 135118 - RNA, 64 nt, Human; identical to SEQ ID NO: 134461

SEQ ID NO: 135119 - RNA, 64 nt, Human; identical to SEQ ID NO: 134462

SEQ ID NO: 135120 - RNA, 64 nt, Human; identical to SEQ ID NO: 134463

SEQ ID NO: 135121 - RNA, 64 nt, Human; identical to SEQ ID NO: 134464

SEQ ID NO: 135122 - RNA, 64 nt, Human; identical to SEQ ID NO: 134465

SEQ ID NO: 135123 - RNA, 64 nt, Human; identical to SEQ ID NO: 134466

SEQ ID NO: 135124 - RNA, 64 nt, Human; identical to SEQ ID NO: 134467

SEQ ID NO: 135125 - RNA, 64 nt, Human; identical to SEQ ID NO: 134468

SEQ ID NO: 135126 - RNA, 64 nt, Human; identical to SEQ ID NO: 134469

SEQ ID NO: 135127 - RNA, 64 nt, Human; identical to SEQ ID NO: 134236

SEQ ID NO: 135128 - RNA, 64 nt, Human; identical to SEQ ID NO: 134471

SEQ ID NO: 135129 - RNA, 64 nt, Human; identical to SEQ ID NO: 134472

SEQ ID NO: 135130 - RNA, 64 nt, Human; identical to SEQ ID NO: 134473

SEQ ID NO: 135131 - RNA, 64 nt, Human; identical to SEQ ID NO: 134474

SEQ ID NO: 135132 - RNA, 64 nt, Human; identical to SEQ ID NO: 134475

SEQ ID NO: 135133 - RNA, 64 nt, Human; identical to SEQ ID NO: 134476

SEQ ID NO: 135134 - RNA, 64 nt, Human; identical to SEQ ID NO: 134477

SEQ ID NO: 135135 - RNA, 64 nt, Human; identical to SEQ ID NO: 134478

SEQ ID NO: 135136 - RNA, 64 nt, Human; identical to SEQ ID NO: 134479

SEQ ID NO: 135137 - RNA, 64 nt, Human; identical to SEQ ID NO: 134480

SEQ ID NO: 135138 - RNA, 64 nt, Human; identical to SEQ ID NO: 134481

SEQ ID NO: 135139 - RNA, 64 nt, Human; identical to SEQ ID NO: 134482

SEQ ID NO: 135140 - RNA, 64 nt, Human; identical to SEQ ID NO: 134483

SEQ ID NO: 135141 - RNA, 64 nt, Human; identical to SEQ ID NO: 134484

SEQ ID NO: 135142 - RNA, 64 nt, Human; identical to SEQ ID NO: 134485

SEQ ID NO: 135143 - RNA, 64 nt, Human; identical to SEQ ID NO: 134486

SEQ ID NO: 135144 - RNA, 64 nt, Human; identical to SEQ ID NO: 134487

SEQ ID NO: 135145 - RNA, 64 nt, Human; identical to SEQ ID NO: 134488

SEQ ID NO: 135146 - RNA, 64 nt, Human; identical to SEQ ID NO: 134489

SEQ ID NO: 135147 - RNA, 64 nt, Human; identical to SEQ ID NO: 134490

SEQ ID NO: 135148 - RNA, 64 nt, Human; identical to SEQ ID NO: 134491

SEQ ID NO: 135149 - RNA, 64 nt, Human; identical to SEQ ID NO: 134492

SEQ ID NO: 135150 - RNA, 64 nt, Human; identical to SEQ ID NO: 134493

SEQ ID NO: 135151 - RNA, 64 nt, Human; identical to SEQ ID NO: 134494

SEQ ID NO: 135152 - RNA, 64 nt, Human; identical to SEQ ID NO: 134495

SEQ ID NO: 135153 - RNA, 64 nt, Human; identical to SEQ ID NO: 134496

SEQ ID NO: 135154 - RNA, 64 nt, Human; identical to SEQ ID NO: 134497

SEQ ID NO: 135155 - RNA, 64 nt, Human; identical to SEQ ID NO: 134498

SEQ ID NO: 135156 - RNA, 64 nt, Human; identical to SEQ ID NO: 134499

SEQ ID NO: 135157 - RNA, 64 nt, Human; identical to SEQ ID NO: 134500

SEQ ID NO: 135158 - RNA, 64 nt, Human; identical to SEQ ID NO: 134501

SEQ ID NO: 135159 - RNA, 64 nt, Human; identical to SEQ ID NO: 134502

SEQ ID NO: 135160 - RNA, 64 nt, Human; identical to SEQ ID NO: 134503

SEQ ID NO: 135161 - RNA, 64 nt, Human; identical to SEQ ID NO: 134504

SEQ ID NO: 135162 - RNA, 64 nt, Human; identical to SEQ ID NO: 134505

SEQ ID NO: 135163 - RNA, 64 nt, Human; identical to SEQ ID NO: 134506

SEQ ID NO: 135164 - RNA, 64 nt, Human; identical to SEQ ID NO: 134507

SEQ ID NO: 135165 - RNA, 64 nt, Human; identical to SEQ ID NO: 134508

SEQ ID NO: 135166 - RNA, 64 nt, Human; identical to SEQ ID NO: 134509

SEQ ID NO: 135167 - RNA, 64 nt, Human; identical to SEQ ID NO: 134510

SEQ ID NO: 135168 - RNA, 64 nt, Human; identical to SEQ ID NO: 134511

SEQ ID NO: 135169 - RNA, 64 nt, Human; identical to SEQ ID NO: 134512

SEQ ID NO: 135170 - RNA, 64 nt, Human; identical to SEQ ID NO: 134513

SEQ ID NO: 135171 - RNA, 64 nt, Human; identical to SEQ ID NO: 134514

SEQ ID NO: 135172 - RNA, 64 nt, Human; identical to SEQ ID NO: 134515

SEQ ID NO: 135173 - RNA, 64 nt, Human; identical to SEQ ID NO: 134516

SEQ ID NO: 135174 - RNA, 64 nt, Human; identical to SEQ ID NO: 134517

SEQ ID NO: 135175 - RNA, 64 nt, Human; identical to SEQ ID NO: 134518

SEQ ID NO: 135176 - RNA, 64 nt, Human; identical to SEQ ID NO: 134519

SEQ ID NO: 135177 - RNA, 64 nt, Human; identical to SEQ ID NO: 134520

SEQ ID NO: 135178 - RNA, 64 nt, Human; identical to SEQ ID NO: 134521

SEQ ID NO: 135179 - RNA, 64 nt, Human; identical to SEQ ID NO: 134522

SEQ ID NO: 135180 - RNA, 64 nt, Human; identical to SEQ ID NO: 134523

SEQ ID NO: 135181 - RNA, 64 nt, Human; identical to SEQ ID NO: 134524

SEQ ID NO: 135182 - RNA, 64 nt, Human; identical to SEQ ID NO: 134525

SEQ ID NO: 135183 - RNA, 64 nt, Human; identical to SEQ ID NO: 134526

SEQ ID NO: 135184 - RNA, 64 nt, Human; identical to SEQ ID NO: 134527

SEQ ID NO: 135185 - RNA, 64 nt, Human; identical to SEQ ID NO: 134528

SEQ ID NO: 135186 - RNA, 64 nt, Human; identical to SEQ ID NO: 134529

SEQ ID NO: 135187 - RNA, 64 nt, Human; identical to SEQ ID NO: 134530

SEQ ID NO: 135188 - RNA, 64 nt, Human; identical to SEQ ID NO: 134531

SEQ ID NO: 135189 - RNA, 64 nt, Human; identical to SEQ ID NO: 134532

SEQ ID NO: 135190 - RNA, 64 nt, Human; identical to SEQ ID NO: 134533

SEQ ID NO: 135191 - RNA, 64 nt, Human; identical to SEQ ID NO: 134534

SEQ ID NO: 135192 - RNA, 64 nt, Human; identical to SEQ ID NO: 134535

SEQ ID NO: 135193 - RNA, 64 nt, Human; identical to SEQ ID NO: 134536

SEQ ID NO: 135194 - RNA, 64 nt, Human; identical to SEQ ID NO: 134537

SEQ ID NO: 135195 - RNA, 64 nt, Human; identical to SEQ ID NO: 134538

SEQ ID NO: 135196 - RNA, 64 nt, Human; identical to SEQ ID NO: 134539

SEQ ID NO: 135197 - RNA, 64 nt, Human; identical to SEQ ID NO: 134540

SEQ ID NO: 135198 - RNA, 59 nt, Human; identical to SEQ ID NO: 134541

SEQ ID NO: 135199 - RNA, 64 nt, Human; identical to SEQ ID NO: 134542

SEQ ID NO: 135200 - RNA, 64 nt, Human; identical to SEQ ID NO: 134543

SEQ ID NO: 135201 - RNA, 64 nt, Human; identical to SEQ ID NO: 134544

SEQ ID NO: 135202 - RNA, 64 nt, Human; identical to SEQ ID NO: 134545

SEQ ID NO: 135203 - RNA, 64 nt, Human; identical to SEQ ID NO: 134546

SEQ ID NO: 135204 - RNA, 64 nt, Human; identical to SEQ ID NO: 134547

SEQ ID NO: 135205 - RNA, 64 nt, Human; identical to SEQ ID NO: 134548

SEQ ID NO: 135206 - RNA, 64 nt, Human; identical to SEQ ID NO: 134549

SEQ ID NO: 135207 - RNA, 64 nt, Human; identical to SEQ ID NO: 134550

SEQ ID NO: 135208 - RNA, 64 nt, Human; identical to SEQ ID NO: 134551

SEQ ID NO: 135209 - RNA, 64 nt, Human; identical to SEQ ID NO: 134552

SEQ ID NO: 135210 - RNA, 64 nt, Human; identical to SEQ ID NO: 134553

SEQ ID NO: 135211 - RNA, 64 nt, Human; identical to SEQ ID NO: 134554

SEQ ID NO: 135212 - RNA, 64 nt, Human; identical to SEQ ID NO: 134555

SEQ ID NO: 135213 - RNA, 64 nt, Human; identical to SEQ ID NO: 134556

SEQ ID NO: 135214 - RNA, 64 nt, Human; identical to SEQ ID NO: 134557

SEQ ID NO: 135215 - RNA, 64 nt, Human; identical to SEQ ID NO: 134558

SEQ ID NO: 135216 - RNA, 64 nt, Human; identical to SEQ ID NO: 134559

SEQ ID NO: 135217 - RNA, 64 nt, Human; identical to SEQ ID NO: 134560

SEQ ID NO: 135218 - RNA, 64 nt, Human; identical to SEQ ID NO: 134561

SEQ ID NO: 135219 - RNA, 64 nt, Human; identical to SEQ ID NO: 134562

SEQ ID NO: 135220 - RNA, 64 nt, Human; identical to SEQ ID NO: 134563

SEQ ID NO: 135221 - RNA, 64 nt, Human; identical to SEQ ID NO: 134564

SEQ ID NO: 135222 - RNA, 64 nt, Human; identical to SEQ ID NO: 134565

SEQ ID NO: 135223 - RNA, 64 nt, Human; identical to SEQ ID NO: 134099

SEQ ID NO: 135224 - RNA, 64 nt, Human; identical to SEQ ID NO: 134567

SEQ ID NO: 135225 - RNA, 64 nt, Human; identical to SEQ ID NO: 134568

SEQ ID NO: 135226 - RNA, 64 nt, Human; identical to SEQ ID NO: 134569

SEQ ID NO: 135227 - RNA, 64 nt, Human; identical to SEQ ID NO: 134568

SEQ ID NO: 135228 - RNA, 64 nt, Human; identical to SEQ ID NO: 134571

SEQ ID NO: 135229 - RNA, 64 nt, Human; identical to SEQ ID NO: 134572

SEQ ID NO: 135230 - RNA, 64 nt, Human; identical to SEQ ID NO: 134573

SEQ ID NO: 135231 - RNA, 64 nt, Human; identical to SEQ ID NO: 134574

SEQ ID NO: 135232 - RNA, 64 nt, Human; identical to SEQ ID NO: 134575

SEQ ID NO: 135233 - RNA, 64 nt, Human; identical to SEQ ID NO: 134576

SEQ ID NO: 135234 - RNA, 64 nt, Human; identical to SEQ ID NO: 134577

SEQ ID NO: 135235 - RNA, 64 nt, Human; identical to SEQ ID NO: 134578

SEQ ID NO: 135236 - RNA, 64 nt, Human; identical to SEQ ID NO: 134579

SEQ ID NO: 135237 - RNA, 64 nt, Human; identical to SEQ ID NO: 134580

SEQ ID NO: 135238 - RNA, 64 nt, Human; identical to SEQ ID NO: 134581

SEQ ID NO: 135239 - RNA, 64 nt, Human; identical to SEQ ID NO: 134582

SEQ ID NO: 135240 - RNA, 64 nt, Human; identical to SEQ ID NO: 134583

SEQ ID NO: 135241 - RNA, 64 nt, Human; identical to SEQ ID NO: 134584

SEQ ID NO: 135242 - RNA, 64 nt, Human; identical to SEQ ID NO: 134585

SEQ ID NO: 135243 - RNA, 64 nt, Human; identical to SEQ ID NO: 134586

SEQ ID NO: 135244 - RNA, 64 nt, Human; identical to SEQ ID NO: 134587

SEQ ID NO: 135245 - RNA, 64 nt, Human; identical to SEQ ID NO: 134588

SEQ ID NO: 135246 - RNA, 64 nt, Human; identical to SEQ ID NO: 134589

SEQ ID NO: 135247 - RNA, 64 nt, Human; identical to SEQ ID NO: 134590

SEQ ID NO: 135248 - RNA, 64 nt, Human; identical to SEQ ID NO: 134591

SEQ ID NO: 135249 - RNA, 64 nt, Human; identical to SEQ ID NO: 134592

SEQ ID NO: 135250 - RNA, 64 nt, Human; identical to SEQ ID NO: 134593

SEQ ID NO: 135251 - RNA, 64 nt, Human; identical to SEQ ID NO: 134594

SEQ ID NO: 135252 - RNA, 64 nt, Human; identical to SEQ ID NO: 134595

SEQ ID NO: 135253 - RNA, 64 nt, Human; identical to SEQ ID NO: 134596

SEQ ID NO: 135254 - RNA, 64 nt, Human; identical to SEQ ID NO: 134597

SEQ ID NO: 135255 - RNA, 64 nt, Human; identical to SEQ ID NO: 134598

SEQ ID NO: 135256 - RNA, 64 nt, Human; identical to SEQ ID NO: 134599

SEQ ID NO: 135257 - RNA, 64 nt, Human; identical to SEQ ID NO: 134600

SEQ ID NO: 135258 - RNA, 64 nt, Human; identical to SEQ ID NO: 134601

SEQ ID NO: 135259 - RNA, 64 nt, Human; identical to SEQ ID NO: 134602

SEQ ID NO: 135260 - RNA, 64 nt, Human; identical to SEQ ID NO: 134603

SEQ ID NO: 135261 - RNA, 64 nt, Human; identical to SEQ ID NO: 134604

SEQ ID NO: 135262 - RNA, 64 nt, Human; identical to SEQ ID NO: 134605

SEQ ID NO: 135263 - RNA, 64 nt, Human; identical to SEQ ID NO: 134606

SEQ ID NO: 135264 - RNA, 64 nt, Human; identical to SEQ ID NO: 134607

SEQ ID NO: 135265 - RNA, 59 nt, Human; identical to SEQ ID NO: 134608

SEQ ID NO: 135266 - RNA, 64 nt, Human; identical to SEQ ID NO: 134609

SEQ ID NO: 135267 - RNA, 64 nt, Human; identical to SEQ ID NO: 134610

SEQ ID NO: 135268 - RNA, 64 nt, Human; identical to SEQ ID NO: 134611

SEQ ID NO: 135269 - RNA, 64 nt, Human; identical to SEQ ID NO: 134612

SEQ ID NO: 135270 - RNA, 64 nt, Human; identical to SEQ ID NO: 134379

SEQ ID NO: 135271 - RNA, 64 nt, Human; identical to SEQ ID NO: 134614

SEQ ID NO: 135272 - RNA, 64 nt, Human; identical to SEQ ID NO: 134615

SEQ ID NO: 135273 - RNA, 64 nt, Human; identical to SEQ ID NO: 134616

SEQ ID NO: 135274 - RNA, 64 nt, Human; identical to SEQ ID NO: 134617

SEQ ID NO: 135275 - RNA, 64 nt, Human; identical to SEQ ID NO: 134618

SEQ ID NO: 135276 - RNA, 64 nt, Human; identical to SEQ ID NO: 134619

SEQ ID NO: 135277 - RNA, 64 nt, Human; identical to SEQ ID NO: 134620

SEQ ID NO: 135278 - RNA, 64 nt, Human; identical to SEQ ID NO: 134621

SEQ ID NO: 135279 - RNA, 64 nt, Human; identical to SEQ ID NO: 134622

SEQ ID NO: 135280 - RNA, 64 nt, Human; identical to SEQ ID NO: 134623

SEQ ID NO: 135281 - RNA, 64 nt, Human; identical to SEQ ID NO: 134624

SEQ ID NO: 135282 - RNA, 64 nt, Human; identical to SEQ ID NO: 134625

SEQ ID NO: 135283 - RNA, 64 nt, Human; identical to SEQ ID NO: 134626

SEQ ID NO: 135284 - RNA, 64 nt, Human; identical to SEQ ID NO: 134627

SEQ ID NO: 135285 - RNA, 64 nt, Human; identical to SEQ ID NO: 134628

SEQ ID NO: 135286 - RNA, 64 nt, Human; identical to SEQ ID NO: 134629

SEQ ID NO: 135287 - RNA, 64 nt, Human; identical to SEQ ID NO: 134630

SEQ ID NO: 135288 - RNA, 64 nt, Human; identical to SEQ ID NO: 134631

SEQ ID NO: 135289 - RNA, 64 nt, Human; identical to SEQ ID NO: 134632

SEQ ID NO: 135290 - RNA, 64 nt, Human; identical to SEQ ID NO: 134633

SEQ ID NO: 135291 - RNA, 64 nt, Human; identical to SEQ ID NO: 134634

SEQ ID NO: 135292 - RNA, 64 nt, Human; identical to SEQ ID NO: 134635

SEQ ID NO: 135293 - RNA, 64 nt, Human; identical to SEQ ID NO: 134636

SEQ ID NO: 135294 - RNA, 64 nt, Human; identical to SEQ ID NO: 134637

SEQ ID NO: 135295 - RNA, 64 nt, Human; identical to SEQ ID NO: 134638

SEQ ID NO: 135296 - RNA, 64 nt, Human; identical to SEQ ID NO: 134639

SEQ ID NO: 135297 - RNA, 64 nt, Human; identical to SEQ ID NO: 134640

SEQ ID NO: 135298 - RNA, 64 nt, Human; identical to SEQ ID NO: 134641

SEQ ID NO: 135299 - RNA, 64 nt, Human; identical to SEQ ID NO: 134642

SEQ ID NO: 135300 - RNA, 64 nt, Human; identical to SEQ ID NO: 134643

SEQ ID NO: 135301 - RNA, 64 nt, Human; identical to SEQ ID NO: 134644

SEQ ID NO: 135302 - RNA, 64 nt, Human; identical to SEQ ID NO: 134645

SEQ ID NO: 135303 - RNA, 64 nt, Human; identical to SEQ ID NO: 134646

SEQ ID NO: 135304 - RNA, 64 nt, Human; identical to SEQ ID NO: 134647

SEQ ID NO: 135305 - RNA, 64 nt, Human; identical to SEQ ID NO: 134648

SEQ ID NO: 135306 - RNA, 64 nt, Human; identical to SEQ ID NO: 134649

SEQ ID NO: 135307 - RNA, 64 nt, Human; identical to SEQ ID NO: 134650

SEQ ID NO: 135308 - RNA, 64 nt, Human; identical to SEQ ID NO: 134651

SEQ ID NO: 135309 - RNA, 64 nt, Human; identical to SEQ ID NO: 134652

SEQ ID NO: 135310 - RNA, 64 nt, Human; identical to SEQ ID NO: 134653

SEQ ID NO: 135311 - RNA, 64 nt, Human; identical to SEQ ID NO: 134654

SEQ ID NO: 135312 - RNA, 64 nt, Human; identical to SEQ ID NO: 134655

SEQ ID NO: 135313 - RNA, 64 nt, Human; identical to SEQ ID NO: 134656

SEQ ID NO: 135314 - RNA, 64 nt, Human; identical to SEQ ID NO: 134657

SEQ ID NO: 135315 - RNA, 64 nt, Human; identical to SEQ ID NO: 134658

SEQ ID NO: 135316 - RNA, 64 nt, Human; identical to SEQ ID NO: 134659

SEQ ID NO: 135317 - RNA, 64 nt, Human; identical to SEQ ID NO: 134660

SEQ ID NO: 135318 - RNA, 64 nt, Human; identical to SEQ ID NO: 134661

SEQ ID NO: 135319 - RNA, 64 nt, Human; identical to SEQ ID NO: 134662

SEQ ID NO: 135320 - RNA, 64 nt, Human; identical to SEQ ID NO: 134663

SEQ ID NO: 135321 - RNA, 64 nt, Human; identical to SEQ ID NO: 134664

SEQ ID NO: 135322 - RNA, 64 nt, Human; identical to SEQ ID NO: 134665

SEQ ID NO: 135323 - RNA, 64 nt, Human; identical to SEQ ID NO: 134666

SEQ ID NO: 135324 - RNA, 64 nt, Human; identical to SEQ ID NO: 134667

SEQ ID NO: 135325 - RNA, 64 nt, Human; identical to SEQ ID NO: 134668

SEQ ID NO: 135326 - RNA, 64 nt, Human; identical to SEQ ID NO: 134669

SEQ ID NO: 135327 - RNA, 64 nt, Human; identical to SEQ ID NO: 134670

SEQ ID NO: 135328 - RNA, 64 nt, Human; identical to SEQ ID NO: 134671

SEQ ID NO: 135329 - RNA, 64 nt, Human; identical to SEQ ID NO: 134672

SEQ ID NO: 135330 - RNA, 64 nt, Human; identical to SEQ ID NO: 134673

SEQ ID NO: 135331 - RNA, 64 nt, Human; identical to SEQ ID NO: 134674

SEQ ID NO: 135332 - RNA, 64 nt, Human; identical to SEQ ID NO: 134675

SEQ ID NO: 135333 - RNA, 64 nt, Human; identical to SEQ ID NO: 134676

SEQ ID NO: 135334 - RNA, 64 nt, Human; identical to SEQ ID NO: 134677

SEQ ID NO: 135335 - RNA, 64 nt, Human; identical to SEQ ID NO: 134678

SEQ ID NO: 135336 - RNA, 64 nt, Human; identical to SEQ ID NO: 134679

SEQ ID NO: 135337 - RNA, 64 nt, Human; identical to SEQ ID NO: 134680

SEQ ID NO: 135338 - RNA, 64 nt, Human; identical to SEQ ID NO: 134681

SEQ ID NO: 135339 - RNA, 64 nt, Human; identical to SEQ ID NO: 134682

SEQ ID NO: 135340 - RNA, 64 nt, Human; identical to SEQ ID NO: 134683

SEQ ID NO: 135341 - RNA, 64 nt, Human; identical to SEQ ID NO: 134684

SEQ ID NO: 135342 - RNA, 64 nt, Human; identical to SEQ ID NO: 134685

SEQ ID NO: 135343 - RNA, 64 nt, Human; identical to SEQ ID NO: 134686

SEQ ID NO: 135344 - RNA, 64 nt, Human; identical to SEQ ID NO: 134687

SEQ ID NO: 135345 - RNA, 64 nt, Human; identical to SEQ ID NO: 134688

SEQ ID NO: 135346 - RNA, 64 nt, Human; identical to SEQ ID NO: 134689

SEQ ID NO: 135347 - RNA, 64 nt, Human; identical to SEQ ID NO: 134690

SEQ ID NO: 135348 - RNA, 64 nt, Human; identical to SEQ ID NO: 134691

SEQ ID NO: 135349 - RNA, 64 nt, Human; identical to SEQ ID NO: 134692

SEQ ID NO: 135350 - RNA, 64 nt, Human; identical to SEQ ID NO: 134693

SEQ ID NO: 135351 - RNA, 64 nt, Human; identical to SEQ ID NO: 134694

SEQ ID NO: 135352 - RNA, 64 nt, Human; identical to SEQ ID NO: 134695

SEQ ID NO: 135353 - RNA, 64 nt, Human; identical to SEQ ID NO: 134638

SEQ ID NO: 135354 - RNA, 64 nt, Human; identical to SEQ ID NO: 134697

SEQ ID NO: 135355 - RNA, 64 nt, Human; identical to SEQ ID NO: 134698

SEQ ID NO: 135356 - RNA, 64 nt, Human; identical to SEQ ID NO: 134638

SEQ ID NO: 135357 - RNA, 64 nt, Human; identical to SEQ ID NO: 134454

SEQ ID NO: 135358 - RNA, 64 nt, Human; identical to SEQ ID NO: 134701

SEQ ID NO: 135359 - RNA, 64 nt, Human; identical to SEQ ID NO: 134702

SEQ ID NO: 135360 - RNA, 64 nt, Human; identical to SEQ ID NO: 134703

SEQ ID NO: 135361 - RNA, 64 nt, Human; identical to SEQ ID NO: 134704

SEQ ID NO: 135362 - RNA, 64 nt, Human; identical to SEQ ID NO: 134705

SEQ ID NO: 135363 - RNA, 64 nt, Human; identical to SEQ ID NO: 134706

SEQ ID NO: 135364 - RNA, 64 nt, Human; identical to SEQ ID NO: 134707

SEQ ID NO: 135365 - RNA, 64 nt, Human; identical to SEQ ID NO: 134708

SEQ ID NO: 135366 - RNA, 64 nt, Human
gcucugcccagcaguguuggugcccagagaugacaagggccagggagccuggcccgggugugag

SEQ ID NO: 135367 - RNA, 64 nt, Human
uguggacaaacaaggacagaaaaacccaguguccaagggccaauuuaaauagaaaaaaagacaa

SEQ ID NO: 135368 - RNA, 64 nt, Human
gccgcccaccucgcuccccucuggaaucuuccccaagggccaaacccacuucuggccuccagcc

SEQ ID NO: 135369 - RNA, 64 nt, Human
ccuaggucuggucaccaauaggguuuggagagcaaagggccacaacucaucagcugccugucuc

SEQ ID NO: 135370 - RNA, 64 nt, Human
cuccaguacguacagcaagauuccugcccacaggaagggccacaggcccgcuaagccccaaagg

SEQ ID NO: 135371 - RNA, 64 nt, Human
acuuuucuuuccucagaucauccagaaguuccucaagggccaggacuuuaucuaauaccucugu

SEQ ID NO: 135372 - RNA, 64 nt, Human
acacugagauggaagacuccagggggcaaggaccaagggccauaucccaagugacuuuguaccc

SEQ ID NO: 135373 - RNA, 64 nt, Human
cagcccaccaugggggccaagaccugcacaggacaagggccaccuggccuuucaguuacuugag

SEQ ID NO: 135374 - RNA, 64 nt, Human
uuacaagucuuuaaucauacagcuaaggaauuccaagggccacaugcgaguauuaauaaauaaa

SEQ ID NO: 135375 - RNA, 64 nt, Human
gaacuagaucaggaggucaguaaacuuucuguggaagggccagagaguaaauauuuuaggcuuu

SEQ ID NO: 135376 - RNA, 64 nt, Human
cauagcuucugggagcuuuuuugaagcauuucauaagggccaaggaaguggggcagggcuuuuc

SEQ ID NO: 135377 - RNA, 55 nt, Human
uccaguuuuccaggcuguaagaaaaaagggccaauaaccagacugcugagguugc

SEQ ID NO: 135378 - RNA, 64 nt, Human
cccagcuacucugaucccucugggggcucuggccaagggccagacagaccuucacagaugccua

SEQ ID NO: 135379 - RNA, 55 nt, Human
uggcaacuguuucaucuuaauaugcaagggccacaauuugcacuguguucauauu

SEQ ID NO: 135380 - RNA, 64 nt, Human
aggcaggaagagagagagagagguucuggggaggaagggccaggagagagaucuagaaaguggg

SEQ ID NO: 135381 - RNA, 64 nt, Human
aucccagcguaugcugccucuuuagggcagccccaagggccagccagccuguacucugggcaag

SEQ ID NO: 135382 - RNA, 64 nt, Human
aagcaucuccuguccuggccucucugaagcagacaagggccaccuaucccggggguggaugcug

SEQ ID NO: 135383 - RNA, 64 nt, Human
gcuuggucuuagaguaucauucagaaaguccgcuaagggccagcgugcuucuucuggcuacaca

SEQ ID NO: 135384 - RNA, 64 nt, Human
uggaauuaagaaaacauauuuucuaguauccucuaagggccaaaguccuacaaucggaauggau

SEQ ID NO: 135385 - RNA, 64 nt, Human
ugccucagucuccugaguagcuggaacuacaaggaagggccaccacaccugacuaacuuuuuug

SEQ ID NO: 135386 - RNA, 64 nt, Human
gccugucccccaagguuuuggagucaguagguccaagggccauacuuuugagagggguuugggu

SEQ ID NO: 135387 - RNA, 64 nt, Human
aacucuuccuauccugcuaacucuaagauuugauaagggccacaucccaguguuuaucuuagcu

SEQ ID NO: 135388 - RNA, 64 nt, Human
auagaauuauccgaccccagaugucaaaagugccaagggccaugagcccugccauaaacugaua

SEQ ID NO: 135389 - RNA, 64 nt, Human
gaauuuugcaaaaugggaaagugggcgcuugcccaagggccaggcugcauggauucucacauca

SEQ ID NO: 135390 - RNA, 64 nt, Human
gcgcacugaaagggcagaguaggccgaaggguccaagggccagacugccucacccucugcccua

SEQ ID NO: 135391 - RNA, 64 nt, Human
uauugggaguucuagauuugagugaauggcaggaaagggccaucuccauugagaugauuaagug

SEQ ID NO: 135392 - RNA, 64 nt, Human
ccuccgcagcagggaagcucuuuucuccugcagaaagggccacccaugauacuccacucccagc

SEQ ID NO: 135393 - RNA, 64 nt, Human
aguugggagcacuggagugcagggaggagaggggaagggccagucugggcugccggguucuagu

SEQ ID NO: 135394 - RNA, 64 nt, Human
ugaauccuagagacagaaaguugacugagccugaaagggccaggucccagugcugggccccugg

SEQ ID NO: 135395 - RNA, 64 nt, Human
uuuguuuuuuuuuuuuuaagguuugcaaauuaaaaagggccagaaaaauuuggcaccaggcaaa

SEQ ID NO: 135396 - RNA, 64 nt, Human
agacaccggccccucccaccccccugccucucugaagggccauggcuaugcuucccuggcucca

SEQ ID NO: 135397 - RNA, 64 nt, Human
cauauaagagugggcagcuaauuuuacuguaaagaagggccaugguauaguagauaaauaaaau

SEQ ID NO: 135398 - RNA, 64 nt, Human
ucccaccaaggaggagaaguaggaaguuuucuuaaagggccaauucaaagccaagucguggggu

SEQ ID NO: 135399 - RNA, 64 nt, Human
cacaauugacauggcuccuccaucccagcgcuggaagggccagugggaagaggaaauagauguc

SEQ ID NO: 135400 - RNA, 64 nt, Human
cuuuuaucaaaaucuaguaccagcuacggccagaaagggccaggugggaccugaaagcaaagac

SEQ ID NO: 135401 - RNA, 64 nt, Human
gagaggacucuccccugugagacuccuccuugugaagggccagggcccugggcaggccuccagc

SEQ ID NO: 135402 - RNA, 64 nt, Human
uccugcuucaggaaagaaccaaaacacuacccugaagggccagccuagccugcagcccucccuu

SEQ ID NO: 135403 - RNA, 64 nt, Human
cuuucugauucaaguacaaugcugccauuuuuuaaagggccacaacuauagaauuaccacuguu

SEQ ID NO: 135404 - RNA, 64 nt, Human
aaccaaguuuuauuuuaagcuguuucuuugauagaagggccaugaaaauagaguaaugauauag

SEQ ID NO: 135405 - RNA, 64 nt, Human
cccgcugaacuucacuggcaccccgggccccuugaagggccaggcugcacuccccuucagcccc

SEQ ID NO: 135406 - RNA, 64 nt, Human
uauaaaaaauaaguaaaguuccacuuagagaacaaagggccaaauagaguuuuuauauuuguua

SEQ ID NO: 135407 - RNA, 64 nt, Human
uagacucuggucauagaaacaauaaaugaguuagaagggccagauuucauucucagucccagag

SEQ ID NO: 135408 - RNA, 64 nt, Human
uaaaucaaaagggagagaacaaaagcuauaccaaaagggccauguuucaagaaaauggauuuaa

SEQ ID NO: 135409 - RNA, 64 nt, Human
cugccauacgcgggcgcugccuggggccugggucaagggccagucagcaggaggcugccggaac

SEQ ID NO: 135410 - RNA, 64 nt, Human
ucucaccugaacccgggggucccaucccaggaagaagggccaucucaggacaugaguccucagg

SEQ ID NO: 135411 - RNA, 64 nt, Human
uggugagcucuugaggaccccugccagaagcagcaagggccaugggguggugcuucccuggacc

SEQ ID NO: 135412 - RNA, 64 nt, Human
acacacccauaaacacacacacagugcuuuaagaaagggccaggugauaucacacccaaauuuc

SEQ ID NO: 135413 - RNA, 64 nt, Human
gccagguuaucaucggagccuucuuguguccucaaagggccacgaggccugaaaggaggaucag

SEQ ID NO: 135414 - RNA, 64 nt, Human
aggucagcugcagcugcaaaaugacuacagccugaagggccauuuucaguccagcaaugucauc

SEQ ID NO: 135415 - RNA, 64 nt, Human
accauauagcaaaacuuuuaaacuacagguaguuaagggccaccuacaauacaucugagguccu

SEQ ID NO: 135416 - RNA, 64 nt, Human
gaauacaugaaucggcugugaugugugaacugcuaagggccaaaugaacguuugcagagcagug

SEQ ID NO: 135417 - RNA, 58 nt, Human
uagaacaggcccggcccugaggguccagaagggccagggccuggcacccaccuggaga

SEQ ID NO: 135418 - RNA, 64 nt, Human
gcccuaagugcagcuggacuguacagaacacuccaagggccaauggcaguucagcgcaaggaga

SEQ ID NO: 135419 - RNA, 64 nt, Human
gccuaaagauggccccccagcacugguuggggacaagggccaaauuggugaccaccagucaugc

SEQ ID NO: 135420 - RNA, 64 nt, Human
uauuugcuugaaauucuugagcagggaucuuauaaagggccagaaauaagaugugugguucaca

SEQ ID NO: 135421 - RNA, 64 nt, Human
gcaguuugaagcccaaucugcaaggacauuucucaagggccaugugguuuugcagacaacccug

SEQ ID NO: 135422 - RNA, 64 nt, Human
ugcaaggaccauauagacaugucacagguggaaaaagggccacaagccguuuugcacaaaugcc

SEQ ID NO: 135423 - RNA, 64 nt, Human
augcuauacagcugggaacagcagacuuucucugaagggccagaugguaacuacauuaggguuu

SEQ ID NO: 135424 - RNA, 64 nt, Human
cucccacccaggacagcccccagcccaacuaggaaagggccaugggcagagggcugguagccag

SEQ ID NO: 135425 - RNA, 64 nt, Human
uaucuaaaauaaagguuggcaaacuuuuucuguaaagggccagauuguaaauauuucagacugu

SEQ ID NO: 135426 - RNA, 64 nt, Human
gcacauaagcuuccauuuuaauuuuaaagugcaaaagggccagcguggcucuaaaagguaaugu

SEQ ID NO: 135427 - RNA, 64 nt, Human
aagaaugaaaguagcuguaugagcagagcaguucaagggccaaacccuggaacgguagcaaugg

SEQ ID NO: 135428 - RNA, 64 nt, Human
uuggccuugugagccgagaugcugacccugcauaaagggccaaaggagggcugcggcuuccuuc

SEQ ID NO: 135429 - RNA, 64 nt, Human
ucacaggggucugcugcgaguugccuuagagcgcaagggccaggcccuggaggaggaugaagac

SEQ ID NO: 135430 - RNA, 64 nt, Human
gcugggcacaccccacaaaccccacucccucaagaagggccagggccagggcuguauggaauaa

SEQ ID NO: 135431 - RNA, 64 nt, Human
auguauuaggacauaaaauagaggcugaccuuaaaagggccaggacagaagcggcugccagcuc

SEQ ID NO: 135432 - RNA, 64 nt, Human
aauaaaggauaugaagguggcuggcuaggaagggaagggccacagccuucauuucuaggagugc

SEQ ID NO: 135433 - RNA, 64 nt, Human
accucuuccucccagaguccuccccacaguuccuaagggccacuguguacccgggcuguguggg

SEQ ID NO: 135434 - RNA, 64 nt, Human
ccagugagggcugugccccggucuuacccucccaaagggccaaggccagaccuccccagggagg

SEQ ID NO: 135435 - RNA, 64 nt, Human
uguaugcucuccccucucagaugcgauuuggaggaagggccauacucagaucauuaaucaauga

SEQ ID NO: 135436 - RNA, 64 nt, Human
aauggacuauauuauucagccauaaaaagaaauaaagggccaggcacaguggcucacaccugua

SEQ ID NO: 135437 - RNA, 64 nt, Human
uauuagucgguguguucaguaucacgcucaagacaagggccaaccuauuacuucacacaccuca

SEQ ID NO: 135438 - RNA, 64 nt, Human
ggccgugcuugucucuagacgaggggaaugggggaagggccacaaccucuguuucugugaccca

SEQ ID NO: 135439 - RNA, 64 nt, Human
ccaagcugggagaggcugaggauggcagggcuggaagggccaucagcgugacccucauuuucaa

SEQ ID NO: 135440 - RNA, 64 nt, Human
uuaagcuggguuuaacuuguuaagcaauauuuuuaagggccaaaugauucaaaacaucacaggu

SEQ ID NO: 135441 - RNA, 64 nt, Human
caaugauuccugguuccagaaagggcuggagcagaagggccaagagggccuguggaacugcuac

SEQ ID NO: 135442 - RNA, 64 nt, Human
cacgggagaauauacaaauagcaaaauugaggccaagggccaagagaauauccgaacuuuaauu

SEQ ID NO: 135443 - RNA, 64 nt, Human
ucuuuuauauuuuggcacaauuauacacauuggaaagggccaaccuauuagggcucaaguaugu

SEQ ID NO: 135444 - RNA, 64 nt, Human
ccucugcuguugcggugaaucuggaagccggagcaagggccacuccacaggcucuuuggcacag

SEQ ID NO: 135445 - RNA, 64 nt, Human
auucauguuuaaggugguggcgcuugaggccugcaagggccacguuggauuacugaagcggaaa

SEQ ID NO: 135446 - RNA, 64 nt, Human
auccccagucgagaacaucuuguaagccuucauuaagggccaccugcugucuguugaacuagac

SEQ ID NO: 135447 - RNA, 64 nt, Human
ucuguggguuuuaacauuuuuauaaagauauaccaagggccauucaguacaucaggaaaguggc

SEQ ID NO: 135448 - RNA, 64 nt, Human
ucuuucuaccauuugaaugcauugguguuuaacuaagggccauccaaccauccaaccuuuaaaa

SEQ ID NO: 135449 - RNA, 64 nt, Human
ucuucccuuaucacugaaggcaagaagaguccagaagggccacagagaacucauguguucagcu

SEQ ID NO: 135450 - RNA, 64 nt, Human
cccucacuacuguaacauacaacgguucagcuguaagggccauuugaaaguuuggaauuuuaag

SEQ ID NO: 135451 - RNA, 64 nt, Human
aguaaauacauugggucuauaaaugugcauuuguaagggccacaaaagugaacgugugguacug

SEQ ID NO: 135452 - RNA, 64 nt, Human
gauuacuuucagaaauagauguauuucucuacguaagggccagguuuauuuucuccuuuuuuga

SEQ ID NO: 135453 - RNA, 64 nt, Human
auauaugguuuacuucucgaacauugguuaugacaagggccauaaauugcuaauauaaagaagu

SEQ ID NO: 135454 - RNA, 64 nt, Human
ccucccugagaucaaccaaggcagaugugacagcaagggccacggaccccauggcagggguggc

SEQ ID NO: 135455 - RNA, 64 nt, Human
ccugcacuugggagcaaaggcacuaccaguagagaagggccauccagccgugccccagccugga

SEQ ID NO: 135456 - RNA, 64 nt, Human
ggccggcauuuguauugggguugcaaugacucccaagggccaaaagaguuaaaggcacgacugg

SEQ ID NO: 135457 - RNA, 64 nt, Human
uucuggaguagggggucagcaaacauugucugcaaagggccagauacugaauccaguacuuuca

SEQ ID NO: 135458 - RNA, 64 nt, Human
aagaaauguagcugaaguagaggggacgugagagaagggccaggccggcaggccaacccuccuc

SEQ ID NO: 135459 - RNA, 64 nt, Human
cuaaggacaggguggaagagggugguauauagggaagggccagauaggcaacuucauuuggcuu

SEQ ID NO: 135460 - RNA, 64 nt, Human
gaagcacugaggagauuuguaauacuccuaaaggaagggccaaacuagagauuuucaaucauag

SEQ ID NO: 135461 - RNA, 64 nt, Human
aggggacccuggauaggcugcaaggaaagaggccaagggccaagcugcuaagccaaagauggcc

SEQ ID NO: 135462 - RNA, 64 nt, Human
uacugcccucuggguccagcagagggaguggaggaagggccacugccucccaccuagagcuucu

SEQ ID NO: 135463 - RNA, 64 nt, Human
accaaggauuaucaaaggagguggacacucaaggaagggccacgccaggcugcguuuccugcaa

SEQ ID NO: 135464 - RNA, 64 nt, Human
ggaggaaugaaaacaaagugaaguacacuuagaaaagggccaaguggacaucuuggaugucaag

SEQ ID NO: 135465 - RNA, 64 nt, Human
acaaaccccaauacaggagaagcacaagacagagaagggccaauggggucauccccucccuaac

SEQ ID NO: 135466 - RNA, 64 nt, Human
gugccaggcacuguguaggugcugaaaaguggccaagggccacccccgcugaugacuccuugca

SEQ ID NO: 135467 - RNA, 64 nt, Human
ucaguuucugauucuuggccauauccuaacaugcaagggccaagcaaaggcuucaaggcucuga

SEQ ID NO: 135468 - RNA, 64 nt, Human
aaauacagccccaaagggggaauuugucauggggaagggccagccacugacuacuugaucuugg

SEQ ID NO: 135469 - RNA, 64 nt, Human
cuuuuucggugaccucauccaaggccaugaugucaagggccauguccccaagcagagguggaga

SEQ ID NO: 135470 - RNA, 64 nt, Human
cucuuccucagcuuuaucucccuuuccuucacucaagggccauuuccccagucccuaucucccc

SEQ ID NO: 135471 - RNA, 64 nt, Human
cucacuacuucugacacucugguuauugggcacuaagggccagacuggaaagucacuugagaca

SEQ ID NO: 135472 - RNA, 64 nt, Human
augaaaauaggaacaaauaaagacaaacaacauuaagggccauauuguaagauuuccauguuaa

SEQ ID NO: 135473 - RNA, 64 nt, Human
cugaccaugcauuuuaccaucacacauguucagaaagggccaaauucccaaccugcucauuuuu

SEQ ID NO: 135474 - RNA, 64 nt, Human
gaagaggcacaagaauggcuaaagcaauucauccaagggccaccggaaguaauuagagcuuuga

SEQ ID NO: 135475 - RNA, 64 nt, Human
ucugaaaugcauuugggguaguuuccugggguccaagggccaauuccuauacccaguccugcag

SEQ ID NO: 135476 - RNA, 64 nt, Human
ucgcuuuuaauaaacugcaaguucauuuuaaaugaagggccagcauauauacuugcaagauaau

SEQ ID NO: 135477 - RNA, 64 nt, Human
cagagguaaaaagaugauggaagguguggugacuaagggccacgguuauugggugaaauuugag

SEQ ID NO: 135478 - RNA, 64 nt, Human
auacaaucucuuaguggcuaggagaaauaaauaaaagggccauaaugguuuguucucuuucaga

SEQ ID NO: 135479 - RNA, 64 nt, Human
cucagccugcuuugaaauuagcuuguagccaugaaagggccacccgauuuuccaguuuaaugaa

SEQ ID NO: 135480 - RNA, 64 nt, Human
cagcgagaggcagagaaagaagagacaggagggcaagggccaugcugaagggaccuugaagggu

SEQ ID NO: 135481 - RNA, 64 nt, Human
uccgcgcuaaacaaugcaauaauuuaaaaucauaaagggccaguguauaaagauuauaccagca

SEQ ID NO: 135482 - RNA, 64 nt, Human
cgcuguaaguggcuagguugguagaaucaaaaacaagggccagauguauuuaagggguauucag

SEQ ID NO: 135483 - RNA, 64 nt, Human
caagccucugccccaaggggcccacaaaggggagaagggccagcccuacaucuucagcucccau

SEQ ID NO: 135484 - RNA, 64 nt, Human
ggaguuccaggagguggugcgagccuucgaacuaaagggccacuccgcggcugugcacucguuu

SEQ ID NO: 135485 - RNA, 64 nt, Human
agaaucauuucacguuuugaacagcagcaguuugaagggccaaagccuugaucagggaucaguc

SEQ ID NO: 135486 - RNA, 61 nt, Human
uccuggcccauaaagccugaugacuugccccaagggccacccgaggaagcaguauuaucug

SEQ ID NO: 135487 - RNA, 64 nt, Human
augcuagccuggaagcucggcauuugguuucacuaagggccaugugguucccugcagccucaug

SEQ ID NO: 135488 - RNA, 64 nt, Human
ggcaagauccagucugagagaagucuccuuugagaagggccaagaggcucuuuccugaguguuu

SEQ ID NO: 135489 - RNA, 64 nt, Human
cuccucuggagugguggggaggauuaggcugcagaagggccaaccccuugcaacagggcagcuc

SEQ ID NO: 135490 - RNA, 64 nt, Human
augcuuugaaauagguuuuuaaugaugugccccaaagggccagcugauucugguacuagauugu

SEQ ID NO: 135491 - RNA, 64 nt, Human
aggggagugaccccugccagcacacccugcagccaagggccaggaaguggacaagaacgaaccc

SEQ ID NO: 135492 - RNA, 64 nt, Human
cccuauaccaggugucaucaaauuuuuuucuggaaagggccaugcaguaaauaguucaagcuuu

SEQ ID NO: 135493 - RNA, 64 nt, Human
ggcuuggaaagugaacuugcagccuuggauggggaagggccagaugcugggugggugccuguca

SEQ ID NO: 135494 - RNA, 64 nt, Human
ggauuuucacagaggaagaacacagcgcagaaugaagggccaggcuuacugagcuguccagugg

SEQ ID NO: 135495 - RNA, 64 nt, Human
cccaaguguuucccucucucccucaccaaaacaaaagggccaucucugcccugcacuugugcag

SEQ ID NO: 135496 - RNA, 64 nt, Human
uccaaaccccaggguagccauggccggguaaagcaagggccauuuagauuaggaagguuuuuaa

SEQ ID NO: 135497 - RNA, 64 nt, Human
ucuuggaaaauacacaauaaaguauuuugagguaaagggccauaauguaugcaaucuacucuca

SEQ ID NO: 135498 - RNA, 64 nt, Human
uuggcauaguacuuuugguacauuguggcuucaaaagggccaguguaaaacugcuuccaugucu

SEQ ID NO: 135499 - RNA, 64 nt, Human
auuacuuauuuuaauuuucugacuuuacuauuuuaagggccagaggguuaaucacaaagagcaa

SEQ ID NO: 135500 - RNA, 64 nt, Human
ccgccccuuccuagguuacaaguaaaucauugucaagggccagccaggggaagguuucaauuaa

SEQ ID NO: 135501 - RNA, 64 nt, Human
auauagcugcuguuacagaguaagaaacucauggaagggccaccucaggagggggauauaaugu

SEQ ID NO: 135502 - RNA, 64 nt, Human
acugcuugcugggacagucaccaggguuggggggaagggccacaaaaugaaaccauuaaagacc

SEQ ID NO: 135503 - RNA, 64 nt, Human
ggcccucccuggcgccccagcccagugccccccgaagggccaaaugccaaguccacugaggccc

SEQ ID NO: 135504 - RNA, 64 nt, Human
cgcugcccuggccuugagcauccacugacuguccaagggccacucccaagaagcccccuucacg

SEQ ID NO: 135505 - RNA, 64 nt, Human
uagagccagggccaucuggacuaugcuccaucccaagggccaagggucaggggccggguccacu

SEQ ID NO: 135506 - RNA, 64 nt, Human
gaucuaaggggccgcgauggucagggccacggccaagggccacgggaacuuggagagggagcuu

SEQ ID NO: 135507 - RNA, 64 nt, Human
cuuggccgugauucccaaggucccagccaaagcaaagggccaguuguuucaguuuaaacagaca

SEQ ID NO: 135508 - RNA, 64 nt, Human
gcuagcccuucuccacucugggggaggaggugggaagggccaccaggcccccagcugccaggcc

SEQ ID NO: 135509 - RNA, 64 nt, Human
gagagacagaccaggaccaaaccaugcagaggucaagggccacauucaccuuuucagagugacu

SEQ ID NO: 135510 - RNA, 64 nt, Human
gccccucagccagcugccauuagcuuggcucuuaaagggccaggccuccuuuucugcccucuag

SEQ ID NO: 135511 - RNA, 64 nt, Human
ccccucucauuuaccucgcaguguguucuaauccaagggccaguugguguuccucaguagcuuu

SEQ ID NO: 135512 - RNA, 64 nt, Human
uuucgagggcagggcaggggaaagaaacgcguuaaagggccaugacaugacacaguucccuggc

SEQ ID NO: 135513 - RNA, 64 nt, Human
cgcaagauggacagggagccagcaggcaggcgggaagggccaaguacaggcaaucacccccauc

SEQ ID NO: 135514 - RNA, 64 nt, Human
ugacuuagagcaagggucagcaagcuugucuguaaagggccaaacaguaaauauuuuagggcug

SEQ ID NO: 135515 - RNA, 64 nt, Human
acccugccugucucccgaagcagguucgagccacaagggccaaccaggaggccccuggagccca

SEQ ID NO: 135516 - RNA, 64 nt, Human
gcuuacaggugggcagcugugauugcacaacuugaagggccaucauucacaucuauucaguggg

SEQ ID NO: 135517 - RNA, 64 nt, Human
gguuucugagccagccuggguuggcugagcaacgaagggccaaagcugaccucugaguggccaa

SEQ ID NO: 135518 - RNA, 64 nt, Human
uucaacaugcaaaugcuagggucuagcccuggguaagggccaugcugguguacuguguugugau

SEQ ID NO: 135519 - RNA, 64 nt, Human
uccugaccugucucaccauguacauagcuugauaaagggccaauaaauaugauguuauggugau

SEQ ID NO: 135520 - RNA, 64 nt, Human
caucuugugaaaguuauggagcaugaaaagacugaagggccaggacaguuugcaugggcugagu

SEQ ID NO: 135521 - RNA, 64 nt, Human
ccaaacucacuccuuuuuagaaaaaacaaaaaaaaagggccagaaagucauuccuuccaucuuc

SEQ ID NO: 135522 - RNA, 64 nt, Human
gccaugcccuucacagagucccaacucagaggaaaagggccagugccaaggggcaccaagaacc

SEQ ID NO: 135523 - RNA, 64 nt, Human
cagguagggagagccagaggugccagccuuccugaagggccagaaaauuuagccuggaucuccu

SEQ ID NO: 135524 - RNA, 64 nt, Human
gggagaagaugaggccaucagagauggccaggagaagggccaggggaauagagcuauuuuuuua

SEQ ID NO: 135525 - RNA, 64 nt, Human
ggcucccucggaacagugccucaaauccugacccaagggccagcauggggaagagaugguugca

SEQ ID NO: 135526 - RNA, 64 nt, Human
aucaaguccugcaagcagagguggcgauuuguuaaagggccaaaaguauccaagguuaggguug

SEQ ID NO: 135527 - RNA, 64 nt, Human
ucuccuuucccuuauacuuuuuauuaccuugcucaagggccagagaucucaagugucaaccuug

SEQ ID NO: 135528 - RNA, 64 nt, Human
cccauggcagugcugccucuuguaggugcuggcuaagggccaggccaggaugaguuuccccaug

SEQ ID NO: 135529 - RNA, 64 nt, Human
uguccccagccccaugaccuuccuucugcuggugaagggccaacaggccgaccuugcccgcuac

SEQ ID NO: 135530 - RNA, 64 nt, Human
augcuccuuacccugccccagcuggggaaaucaaaagggccaaagaaccaaagaagaaagucca

SEQ ID NO: 135531 - RNA, 64 nt, Human
agggugauggagcacggggucacaccccugccccaagggccacuggucucccugggcuugcagu

SEQ ID NO: 135532 - RNA, 64 nt, Human
caaacaaccccccaucacaaacuuaaaggauugcaagggccagaucuguuaagugguuucauag

SEQ ID NO: 135533 - RNA, 64 nt, Human
uuggagauuaaaggacagggcauugauggaagguaagggccaggagaagaggccuuucugcugu

SEQ ID NO: 135534 - RNA, 64 nt, Human
aaaaugccuauguuuucuuuuaguuacaugaauuaagggccagaaaaaaguguuuauaaugcaa

SEQ ID NO: 135535 - RNA, 64 nt, Human
gguuuuaggaauagugacagagucaggccaccccaagggccaugggagccagcugaccugcuug

SEQ ID NO: 135536 - RNA, 64 nt, Human
cacccagcagccacugcccagccgcacuccaggcaagggccagugcgccugcuccugaccacug

SEQ ID NO: 135537 - RNA, 64 nt, Human
ggaggaacagauguggaggaccugagggugcucaaagggccaggcucagccucaagcaguguuu

SEQ ID NO: 135538 - RNA, 64 nt, Human
cagaugugugugugacguguuuagaaaugcggugaagggccagacggugcugggaaggcaguug

SEQ ID NO: 135539 - RNA, 64 nt, Human
gugaugguggggagugguugauaaaggcacacagaagggccacggaggcucucaggggaaccau

SEQ ID NO: 135540 - RNA, 63 nt, Human
gccuggcuccgcaacgguagcaguggguggcucaagggccagccuccagcgcugcucuuucug

SEQ ID NO: 135541 - RNA, 64 nt, Human
gcccccaccccccaucugucucuuccuccuaauuaagggccacugcaaagagagacgggcuggc

SEQ ID NO: 135542 - RNA, 64 nt, Human
uggcugaggccuuuugcgccccaccuccaggaccaagggccauucuagacagggugucuucuac

SEQ ID NO: 135543 - RNA, 64 nt, Human
ccaggccuccccaugccaccacaaaggcccuuuuaagggccaccaccgcccucauggaaagagc

SEQ ID NO: 135544 - RNA, 64 nt, Human
aggugcuaagugacugcccuaaggaaugaaaagcaagggccaggugggaguagcccagcgaagg

SEQ ID NO: 135545 - RNA, 64 nt, Human
aucagaagaacauccuucucugcuugaccugaagaagggccagaccugggcagaaagacuccag

SEQ ID NO: 135546 - RNA, 64 nt, Human
caucaaaauguagauucauugugucugugugguaaagggccaaagucaauaauugggacaaaug

SEQ ID NO: 135547 - RNA, 64 nt, Human
cagugaauccacagucuuuacuuccugccucauaaagggccaggucuccccaguaccaaguccu

SEQ ID NO: 135548 - RNA, 64 nt, Human
gcaaguuucuuugaaucaggaaggcaggugagguaagggccaaaucacucuccuccauagcagg

SEQ ID NO: 135549 - RNA, 64 nt, Human
cccagcuuuuggauauuuuggguuauggggaagcaagggccaaacauucuuuaucccucccacc

SEQ ID NO: 135550 - RNA, 64 nt, Human
ccgugccaagccggcagaggucaugccaggcgccaagggccaugugcccagcugcugcuggcug

SEQ ID NO: 135551 - RNA, 64 nt, Human
ccagcagcuacuagggagaagucugcaagaugucaagggccaagaagucccaguaaguuaaauc

SEQ ID NO: 135552 - RNA, 64 nt, Human
gguuugcccuugaacuaaaaauguuguuuggggcaagggccagaaauguggagacaugguuuuu

SEQ ID NO: 135553 - RNA, 64 nt, Human
aucauuccaacacuaaauucuuaaguaguugcccaagggccagcucaguuuauccuucggagag

SEQ ID NO: 135554 - RNA, 64 nt, Human
gcuggcacccauaggaaggggccucaggagcaggaagggccaggaccagaaccuugcccacggc

SEQ ID NO: 135555 - RNA, 64 nt, Human
agaagcuccucuccccagcccagagacauacuugaagggccagagccaggggggugaggagcug

SEQ ID NO: 135556 - RNA, 64 nt, Human
caaugccaugaagcaccuuccuaacuucuucuacaagggccagcugacaaagauguucuuccuc

SEQ ID NO: 135557 - RNA, 64 nt, Human
gcuggaaaccaagucaggccaggugggcggacaaaagggccaggugcggccuggggggaacgga

SEQ ID NO: 135558 - RNA, 64 nt, Human
uucgaugucauauuuuauguguaauauauauguaaagggccauucuuaaguucucuccuuaaac

SEQ ID NO: 135559 - RNA, 64 nt, Human
ugcaugaagaaccugugagccggcgcgugccaggaagggccauuuuggugcuuauucuuaacuu

SEQ ID NO: 135560 - RNA, 64 nt, Human
uacugcuauuuugagagagucaagacucuuucuuaagggccaagaaagcaacuugagccuuggg

SEQ ID NO: 135561 - RNA, 64 nt, Human
aguggaugcuuaugccuguaaucccagugcuuugaagggccaaagggggaagaucucuugaggu

SEQ ID NO: 135562 - RNA, 64 nt, Human
aaaccuggagccagguguacaaccacuugccaugaagggccaggaugcccagaugcuuggcccc

SEQ ID NO: 135563 - RNA, 64 nt, Human
uuucauauaacuaaauauuggucaugaacuguguaagggccaugcuuauugggaucaguuuuaa

SEQ ID NO: 135564 - RNA, 64 nt, Human
caucauggcagugggaccaagcguggucccgaggaagggccagagccugguagagacuagggaa

SEQ ID NO: 135565 - RNA, 64 nt, Human
cuugcacagaauugcaaaugucuuuugccauaccaagggccagacucagaacccuuggagucau

SEQ ID NO: 135566 - RNA, 64 nt, Human
aacuuauuguucuuuucuauucuuucaguugaauaagggccaguugguaugcagcccauguaua

SEQ ID NO: 135567 - RNA, 64 nt, Human
aucaggauucuauagacugauaggcccuauccacaagggccaugacugggaaaagguaugggag

SEQ ID NO: 135568 - RNA, 64 nt, Human
cuugaagaagccauauuuggcaugggugaagugaaagggccaggagguucuggaggccccuuca

SEQ ID NO: 135569 - RNA, 64 nt, Human
aagccaauaaucacuguaggaguaugaguugccuaagggccaaaacuaauguaaauaagagaaa

SEQ ID NO: 135570 - RNA, 64 nt, Human
gucacuccuacuccacccugauggccagcagaggaagggccacucuucucaugggcacagccau

SEQ ID NO: 135571 - RNA, 64 nt, Human
gaacaugcaagaauuucuggaagaaaggcuguggaagggccaauggagaaaaugaauggacaaa

SEQ ID NO: 135572 - RNA, 64 nt, Human
uggccuacuggcaauggcuacuuaggauugaucuaagggccaaagugcagggugggugaacuuu

SEQ ID NO: 135573 - RNA, 64 nt, Human
uccacgcucuucuaauugggagauaauauggaagaagggccagagcaguuacagcccuccuucu

SEQ ID NO: 135574 - RNA, 64 nt, Human
aguacacagaauacuucauuguuguuuuggggagaagggccauaugucacuaauagaaagcccc

SEQ ID NO: 135575 - RNA, 64 nt, Human
uaaacaucuuucagcccagcgcugcggccccgggaagggccacugcgaauagagaggaagcugg

SEQ ID NO: 135576 - RNA, 64 nt, Human
uuagauccaagccaaguuuucucaacagagagcaaagggccaggcaguaagguagaaauagaga

SEQ ID NO: 135577 - RNA, 64 nt, Human
guggaauuccaggcacugugacugucaagcuggcaagggccaggauugggggaauggagcuggg

SEQ ID NO: 135578 - RNA, 52 nt, Human
ccuaccuggagaagcuuugaggaagggccaggagccccuucggaccugcccu

SEQ ID NO: 135579 - RNA, 64 nt, Human
gccagcaccccaccaucccuuugcaggggagucaaagggccagaacuccuugggggaccagaac

SEQ ID NO: 135580 - RNA, 64 nt, Human
uaucuuucaccuuucuagggacaugaaauuuacaaagggccaucguucauccaaggcuguuacc

SEQ ID NO: 135581 - RNA, 64 nt, Human
aucaaagggacgcagguuucuguuuauucugaacaagggccaggccccgcggagugucuuuggu

SEQ ID NO: 135582 - RNA, 64 nt, Human
gaaauaguuuagucacagguuuuuacaguccagcaagggccaaagagguauaguauacaaguua

SEQ ID NO: 135583 - RNA, 64 nt, Human
auggcuucuccuccaacuuccuccugcacuuaaaaagggccagguuccaaauuagacuuguaaa

SEQ ID NO: 135584 - RNA, 64 nt, Human
uggggagccucagaagccugcgaccuugggagaaaagggccagggcccugagggccuagcauuu

SEQ ID NO: 135585 - RNA, 64 nt, Human
uuggcuagauaaauguggugaaauugccacuagaaagggccaguagcaauguguucuuaauucc

SEQ ID NO: 135586 - RNA, 64 nt, Human
uagaacacaguggauccuuuuugaauguucguggaagggccaggaguuccugugaaaccaggau

SEQ ID NO: 135587 - RNA, 64 nt, Human
gcuggcgaacccugggccauccucacaugugacaaagggccagcagucuaccugcucguugccu

SEQ ID NO: 135588 - RNA, 64 nt, Human
acggcguccaaggagacuaggaugaguucuuggcaagggccagcguuagaaaucacugugguac

SEQ ID NO: 135589 - RNA, 64 nt, Human
uuaagacccuggaugacaucaauaaagggacaggaagggccauguugccacaugagcaagcuug

SEQ ID NO: 135590 - RNA, 64 nt, Human
acuggaaacuaggccgggaagcagcagccccuccaagggccagggcaccugggagacgggagga

SEQ ID NO: 135591 - RNA, 64 nt, Human
agagauccugcuugagcccuggacucaucuugggaagggccaugggagguccuggcuagaguuc

SEQ ID NO: 135592 - RNA, 64 nt, Human
gcagcugcaggcauucugaggggcaacguggaggaagggccagggaugcaugggauuuuaauug

SEQ ID NO: 135593 - RNA, 64 nt, Human
gcucugcuuaccuguccgcccaccugucuggaacaagggccagguuaagaccacaugccucaug

SEQ ID NO: 135594 - RNA, 64 nt, Human
uuuuggguaggcuguggcucuggacaccuaugagaagggccagcugacauccagcaugguggau

SEQ ID NO: 135595 - RNA, 64 nt, Human
aggaaucagagaccuuccagaaauacuacuguguaagggccagaaauaucuucacuugucauug

SEQ ID NO: 135596 - RNA, 64 nt, Human
ucuucccuuaucacugaaggaaggaagaguccagaagggccacagagaacucaaacguucaguu

SEQ ID NO: 135597 - RNA, 64 nt, Human
gcuguggcuccgaguagugguuugagugggcaggaagggccauuugcaaacacugcuguguucu

SEQ ID NO: 135598 - RNA, 64 nt, Human
aggccgugggggcugcugaaggcucuuuccccgcaagggccagguguugacaccuuaaagcugg

SEQ ID NO: 135599 - RNA, 64 nt, Human
cugagucagccagauccucccccuacuucuccccaagggccaagaacugcucagggacauuaaa

SEQ ID NO: 135600 - RNA, 64 nt, Human
ugcauuuucaaggacacuugcuggguugugcauuaagggccaguuuacuugucugccucuuuga

SEQ ID NO: 135601 - RNA, 64 nt, Human
caccaagagccaauggaguagaccccuggcugguaagggccaagucccaccgguugcuucuggg

SEQ ID NO: 135602 - RNA, 64 nt, Human
cucacagacuggagacaaugcagaugccagagcaaagggccaggaagggucaaaacauuuuauu

SEQ ID NO: 135603 - RNA, 64 nt, Human
auccugcccaacccuuccucucccauccucaaaaaagggccauuuuaugaugcauugcacaccc

SEQ ID NO: 135604 - RNA, 64 nt, Human
agggacugguuuauagaaagagccuaggagacaaaagggccagucccccugcccagaauggagc

SEQ ID NO: 135605 - RNA, 64 nt, Human
gaagggggugcaaagacucugagccaagggagggaagggccacccugcugcacuaggacuuggu

SEQ ID NO: 135606 - RNA, 64 nt, Human
gcauguggucaguuuccauuuucuauuaccuggaaagggccauaaggaagcaggcagggcuuag

SEQ ID NO: 135607 - RNA, 64 nt, Human
ggucccaguucuguguagcuugcccugccccaugaagggccaccagccaagggcccuggccacg

SEQ ID NO: 135608 - RNA, 64 nt, Human
ucccaaguucuugugacugagggagauuuucuggaagggccacaggagguugcggagcuuggau

SEQ ID NO: 135609 - RNA, 64 nt, Human
aggguucugggaaagcaacagcuaucagagagagaagggccagaccccauagccucuuagauuc

SEQ ID NO: 135610 - RNA, 64 nt, Human
cuaauguugcauauuaggcggcgggggcagagauaagggccaucucucugugauucugccucag

SEQ ID NO: 135611 - RNA, 64 nt, Human
ugcccaggcuauggggacaaaggccuucaccagcaagggccacaguuggaacaguccccugggu

SEQ ID NO: 135612 - RNA, 64 nt, Human
ccauucccauggaguugccaacuauucucaggccaagggccauggggaagauggagcaaaccua

SEQ ID NO: 135613 - RNA, 64 nt, Human
accagccccucacuggguucggaggagagucaggaagggccacgacaaagcagaaacaucggau

SEQ ID NO: 135614 - RNA, 64 nt, Human
agcgccuccugccagcugcccuggugcuuucuccaagggccaucagugucuugccuagcuugag

SEQ ID NO: 135615 - RNA, 64 nt, Human
acucggagccgagggccucccagcagagcuugggaagggccauggacccaacugggccccagaa

SEQ ID NO: 135616 - RNA, 64 nt, Human
cuugagcagagcucuuauuucuggugaggaaugaaagggccaaguguuccuguucauugugagu

SEQ ID NO: 135617 - RNA, 64 nt, Human
uucagaucuaccugaacuugccucuggagaugauaagggccaaaggagcagucagggaggggcg

SEQ ID NO: 135618 - RNA, 64 nt, Human
ggccagaggguccaggcaucccaaguccagcgugaagggccacagccccucuuggcugccaagc

SEQ ID NO: 135619 - RNA, 64 nt, Human
ccauucagggagaaaccucuccuucccgugugagaagggccagaggguccaggcaucccaaguc

SEQ ID NO: 135620 - RNA, 64 nt, Human
aggcuugcugaaagagugagagaagauggaagggaagggccagugcaacugggcgcuugggcca

SEQ ID NO: 135621 - RNA, 64 nt, Human
uccagaguuccuagcacuggccccgaggacagccaagggccauuucuucucagcuugguggagc

SEQ ID NO: 135622 - RNA, 64 nt, Human
aguuggauauccuuuugagaaacugaauuuugcaaagggccaaauuuccccaaacugaacgggc

SEQ ID NO: 135623 - RNA, 64 nt, Human
cugaaccccuucuccacaccugaacaguuggcucaagggccaccagaagcauuucuuuauuauu

SEQ ID NO: 135624 - RNA, 64 nt, Human
gaaggugcgcacuugccccuacuauugcccuuuuaagggccaaagcuugaccccauuggccauu

SEQ ID NO: 135625 - RNA, 64 nt, Human
uaagaugcacaaccgcacacccauacacaacuacaagggccacaaagcaacugcuggguuagcu

SEQ ID NO: 135626 - RNA, 64 nt, Human
cuucucauggauggcacugcuuuucugaggacucaagggccaagauggaggggcugacucaguc

SEQ ID NO: 135627 - RNA, 64 nt, Human
ggagugcguuuuaggcacagcaaauggcacauacaagggccagggagcaagagagaggacaggu

SEQ ID NO: 135628 - RNA, 64 nt, Human
ucagagucaaagcacaaauccucaggacgggcucaagggccagggcagccgagggaagcuccag

SEQ ID NO: 135629 - RNA, 64 nt, Human
ccccgcugcugagcgagacaccaguagccaggugaagggccacagcgggccaggccccgacccu

SEQ ID NO: 135630 - RNA, 64 nt, Human
ucuccggugaagcugaaggggccugugucccugaaagggccagcacaucacugguuuucuagga

SEQ ID NO: 135631 - RNA, 64 nt, Human
uagagaucuggcuguggggcgggcauggggggugaagggccacugggacccucagccuuguuug

SEQ ID NO: 135632 - RNA, 64 nt, Human
ugaaaaccaacacaaccauauguuuagggcuggaaagggccaugacgccuggccauuuuuccug

SEQ ID NO: 135633 - RNA, 64 nt, Human
cagggauggggguguuggaugccuggaucucuguaagggccagaagugagggcccagaggucug

SEQ ID NO: 135634 - RNA, 64 nt, Human
gagggacccugugucuuacucgccccucuggccuaagggccacucugguuaucugccaagguug

SEQ ID NO: 135635 - RNA, 64 nt, Human
ggucgaccuugccucccgauuuucggaguuggggaagggccaugaccacccucguagacuuuuu

SEQ ID NO: 135636 - RNA, 64 nt, Human
aagggguuccuccccuagcaccugggcuuggcagaagggccauaguucauccagcuccuccccu

SEQ ID NO: 135637 - RNA, 64 nt, Human
aguagauaagcugucauuaaguaauucccaaaaaaagggccauuugcuugcauuacuuugaauu

SEQ ID NO: 135638 - RNA, 64 nt, Human
ggugccggcacagugccucucccagagccucaagaagggccauuuaggagcuugcuucaaccau

SEQ ID NO: 135639 - RNA, 64 nt, Human
uguuacugcagcaucugggcugccagccacagggaagggccaagccccauguagccccagucau

SEQ ID NO: 135640 - RNA, 64 nt, Human
cuguguccugaggugcauuuccuguuguacacacaagggccaggcuccauucucccucccuuuc

SEQ ID NO: 135641 - RNA, 64 nt, Human
agagauuuugcguuugacauugugucugggaaggaagggccagaccuuggaaccuuuggaaccu

SEQ ID NO: 135642 - RNA, 64 nt, Human
ucauuuccccuacuugaucugcaaugccaauaucaagggccauguaucagguuucuguauaugu

SEQ ID NO: 135643 - RNA, 64 nt, Human
aaugggaaggaugaagggcccgagaacauggccuaagggccacaucccacugccacccuugacg

SEQ ID NO: 135644 - RNA, 64 nt, Human
ccuggucaucagccaggcagcccucccagugcccaagggccaccaaccccagggaaacagggcc

SEQ ID NO: 135645 - RNA, 64 nt, Human
uuauuuauggcuuauaaauguguauucuggcugcaagggccagaguuccacaaaucuauauuaa

SEQ ID NO: 135646 - RNA, 64 nt, Human
cuguuagccagugguggaggagcaaggcuucaggaagggccagccacaugccaucuucccugcg

SEQ ID NO: 135647 - RNA, 64 nt, Human
caucggucucugaggugacacucuggagugguugaagggccacaaggugcaggguuaauacucu

SEQ ID NO: 135648 - RNA, 64 nt, Human
ggaagaaagagaaaguagcaggaaaggaagugggaagggccagccaaggacagacuguagagga

SEQ ID NO: 135649 - RNA, 64 nt, Human
agccugcugcauggggugggguagggcugacuagaagggccaguccugccuggccaggcagauc

SEQ ID NO: 135650 - RNA, 64 nt, Human
uguuaauccuaugaacucccuuuuguaggagagaaagggccaaucuguagggguagcccugucc

SEQ ID NO: 135651 - RNA, 64 nt, Human
aaaaaaaucucaggccauguugggguaacccagcaagggccagugaugauuucccccagcucau

SEQ ID NO: 135652 - RNA, 64 nt, Human
guauuggcguauaacauuauuuucaaggaacuccaagggccacaggagcugacagguuuuucaa

SEQ ID NO: 135653 - RNA, 64 nt, Human
gucacugagacuagauucucaccugccuucaaagaagggccaauucccuuuaaaggucgcaccu

SEQ ID NO: 135654 - RNA, 64 nt, Human
aacuucucugugccugcucagaggcgcccuagggaagggccauguuugaguuuugcuuuguaug

SEQ ID NO: 135655 - RNA, 64 nt, Human
acaucugccucagugagggaucagggcagcaaacaagggccaagaccaucugagccagccccac

SEQ ID NO: 135656 - RNA, 64 nt, Human
acaagagagugaaauuuaggucagggaaaagaccaagggccagcauugcuacuuuugugugugu

SEQ ID NO: 135657 - RNA, 64 nt, Human
ucaucugcccauggggaagucggcucacugggacaagggccacugggcuggucugugucugggc

SEQ ID NO: 135658 - RNA, 64 nt, Human
ugccuccucuaguuaaagucagucaccuccccagaagggccacacuccaggaggaguguugaga

SEQ ID NO: 135659 - RNA, 64 nt, Human
gagugggcacuugucuggcugcuggccagcagugaagggccacuuggugacuucguaggguucc

SEQ ID NO: 135660 - RNA, 64 nt, Human
ccugcggcuggggccgucugccuacacgcuccagaagggccagcgcagagcugggauggccacu

SEQ ID NO: 135661 - RNA, 64 nt, Human
auggcugggcggcuggugagcaguccaggugcccaagggccagcuugcugcugcccaaagcaga

SEQ ID NO: 135662 - RNA, 64 nt, Human
ggucuauuuggaagagguaacccuuuucagggcuaagggccaggguguucuucugcacccuggg

SEQ ID NO: 135663 - RNA, 64 nt, Human
cagccucuuguucuuagggcuuggaucguggaagaagggccacccugagcagaucgugccgugg

SEQ ID NO: 135664 - RNA, 64 nt, Human
caggggucugaacacagggccugggugccagggaaagggccaaacuaggccuaggcagcucugc

SEQ ID NO: 135665 - RNA, 64 nt, Human
uuugaacuguacuggacccauaguuuuaacugaaaagggccaaacaaguggugucuguccaguu

SEQ ID NO: 135666 - RNA, 64 nt, Human
cccucaaccuuaccccaccccucuguuaauuugaaagggccacuauugcugaguggaugaguuu

SEQ ID NO: 135667 - RNA, 64 nt, Human
ggccuggugcugccuuuacaaacaccugcaggagaagggccacggaagccccaggcuuuagagc

SEQ ID NO: 135668 - RNA, 64 nt, Human
cagcaggugucuggacgaaaacaucaaugugaauaagggccaagugcaguccugucuugauuaa

SEQ ID NO: 135669 - RNA, 64 nt, Human
aggaccauaucuuacagaaggugcacauacucccaagggccacucuugcccuggagaucuuggc

SEQ ID NO: 135670 - RNA, 64 nt, Human
gaugugcggugggugggcuguuuaggggaucuggaagggccaaggucugagcacuggaguggcu

SEQ ID NO: 135671 - RNA, 64 nt, Human
ucagcuuccaaucccuaguacauauauaauagaaaagggccaagaaaaauaugcaucuugauuu

SEQ ID NO: 135672 - RNA, 64 nt, Human
cacuuaaaucaggggucagcaaacuuuuucuguaaagggccagacgggaaauauuuugggcuuu

SEQ ID NO: 135673 - RNA, 64 nt, Human
ucccugaauuauccccccccccaugaaguacuucaagggccaagcugccccuuucccuccucuc

SEQ ID NO: 135674 - RNA, 64 nt, Human
uuuuaacauuauauuuugagagcuuugggugcugaagggccaaacguuuucugggcauuuuuug

SEQ ID NO: 135675 - RNA, 64 nt, Human
augcaaagauccuccuggcggcaguagccuugacaagggccaccucuucacaggaugcagucug

SEQ ID NO: 135676 - RNA, 64 nt, Human
caguauagacagacagauggacccuggcuguacgaagggccagggccacuggggcuugggggcg

SEQ ID NO: 135677 - RNA, 64 nt, Human
cacccagcaucagcccuggggagagaggcucccaaagggccaccaugagcccaagauauccuuc

SEQ ID NO: 135678 - RNA, 64 nt, Human
guggucucucagcuguucugcccucauacccuuaaagggccagccugggcccaguggacacagg

SEQ ID NO: 135679 - RNA, 64 nt, Human
cucaggcgggaggacugauugaguccggguguucaagggccaaccuaggcaacacagugagaac

SEQ ID NO: 135680 - RNA, 64 nt, Human
ggaagagaaaucugaagaacagccccaucucuuucgccugcacacuuggaacucagcaagaagg

SEQ ID NO: 135681 - RNA, 64 nt, Human
ugacuuugaagggccucaauauuagccacacugccgccugcagaagguggagaguuaagauguu

SEQ ID NO: 135682 - RNA, 64 nt, Human
ggggcuggacggcugcguggaagacuugcgcagccgccugcagcgcggcccgugacacggcgcc

SEQ ID NO: 135683 - RNA, 64 nt, Human
accagcgggcuugagcuggccugugucccuccaccgccugcaccacccaccuccagagugcagu

SEQ ID NO: 135684 - RNA, 64 nt, Human
uguucaggaggccugugagcgggagcucgcccugcgccugcagcagacgcagagcuugcauucu

SEQ ID NO: 135685 - RNA, 64 nt, Human
ggaacaucucuucacugggcuccaccugcucacccgccugcagaucugggauccagccugcucu

SEQ ID NO: 135686 - RNA, 64 nt, Human
cuucaggggcaugccaauugcguaaagugaggcucgccugcauagcuaauccuguuaaagacaa

SEQ ID NO: 135687 - RNA, 64 nt, Human
ggagggggcugggcucacaggccucucuuuuccccgccugcagucuucugggcugcgggaggcc

SEQ ID NO: 135688 - RNA, 64 nt, Human
uauauaacuugaauaucugguacuaguuuuuucacgccugcaaucuuggagucuagguugccuu

SEQ ID NO: 135689 - RNA, 64 nt, Human
uaucaaacccuuuccugcgccccagacuccaggccgccugcagccugccccugugaucccuucg

SEQ ID NO: 135690 - RNA, 64 nt, Human
aaggaaaccccauacagaagaaacaacaaaccugcgccugcaccgccucugcguccuggguagu

SEQ ID NO: 135691 - RNA, 61 nt, Human
acaaguguuccguguggugagccuggcugcccgccugcacgcccccacugcccccgcacga

SEQ ID NO: 135692 - RNA, 64 nt, Human
guagguggaaagggagauuccagggaagaggcaucgccugcaggacuuugcggugggaccccug

SEQ ID NO: 135693 - RNA, 64 nt, Human
aaggcaccaggccucaggaggagccccauagucccgccugcagccuguaaccaucggcugggcc

SEQ ID NO: 135694 - RNA, 64 nt, Human
cugcaagaaagcacugugacuaaaacauacauaacgccugcauaaauauuccaugguuucaguu

SEQ ID NO: 135695 - RNA, 53 nt, Human
cccagagucgcuggagaugagcucgccugcaggcagcugcugugagcuggccu

SEQ ID NO: 135696 - RNA, 64 nt, Human
cugugguaggaacuccaguggugaacggcuugcgcgccugcagccagaguugcagggaaagcuc

SEQ ID NO: 135697 - RNA, 64 nt, Human
gcuccgcacgggggaccucggagcugcucuaaggcgccugcagaggcgagcagagcccgcagcc

SEQ ID NO: 135698 - RNA, 64 nt, Human
ggcacuccauacccucgaagauguuguacuccaccgccugcaccaacagccucaguguuacuuc

SEQ ID NO: 135699 - RNA, 64 nt, Human
ccaccccacccacaccugucccuggccagcaggccgccugcaagcgucaggcacacagggacag

SEQ ID NO: 135700 - RNA, 64 nt, Human
uuuuuagggaaaaugaaaagaggaccuugcuguccgccugcacugcuuccugguaaacuauaac

SEQ ID NO: 135701 - RNA, 64 nt, Human
ucuguccuggggacguggaggguggcagcguccccgccugcaccagugccguccugcugaugug

SEQ ID NO: 135702 - RNA, 64 nt, Human
aaaauacaaaaaauuagccgggcgugguggcgggcgccugcagucccagcuacucaggaggcug

SEQ ID NO: 135703 - RNA, 64 nt, Human
uccugugcaggcaauagacuucccucacugucuccgccugcagggaggagaauguaccccacug

SEQ ID NO: 135704 - RNA, 64 nt, Human
ucaccugcagcucugaagacccaggccucaccuccgccugcaggaccuccucuuggccacuugg

SEQ ID NO: 135705 - RNA, 64 nt, Human
uaacaggccacguuaaacugcccaucuggagaaucgccugcagguggggcccuuuccuucccgc

SEQ ID NO: 135706 - RNA, 64 nt, Human
cgcccgacgcgcgccacccgcggccccagcuuuccgccugcacccgcgaggacgcgcgcgagca

SEQ ID NO: 135707 - RNA, 64 nt, Human
agggcgggugggaaggagaggggugcaacaggaccgccugcacugaaaacucacugcugccaug

SEQ ID NO: 135708 - RNA, 64 nt, Human
cacauguggcacuucaaaaggcagcaccacugggcgccugcacuuauuugaaaauggaacuuug

SEQ ID NO: 135709 - RNA, 64 nt, Human
uuccugggggauacuccuccccacccuaaagggucgccugcaacuuaggcggauugggucucuc

SEQ ID NO: 135710 - RNA, 64 nt, Human
gugagcaacuucuuuaggcauuuccucuuuuccccgccugcacccacucugaacaugacaaaag

SEQ ID NO: 135711 - RNA, 64 nt, Human
augugugcuuuccacaggggcgucucugcguccacgccugcacaucccggcgcacgugugggca

SEQ ID NO: 135712 - RNA, 64 nt, Human
uuguuccaaauauaaacgaaaggcacuagucagccgccugcauagacuuucuaaacagugagua

SEQ ID NO: 135713 - RNA, 64 nt, Human
caucuucaggccugaagcugcacgaccugaaguucgccugcauuuaucagcccucuuugugcug

SEQ ID NO: 135714 - RNA, 64 nt, Human
uucuccugauccucuugccaccgucccacguggucgccugcauuucuccgugcguccucccugc

SEQ ID NO: 135715 - RNA, 64 nt, Human
uuuccaagggugcagaugagccuuagguuccagccgccugcagaccccaccccagcaggcucac

SEQ ID NO: 135716 - RNA, 64 nt, Human
ggaaucaggauuccuucuuccccaaggcacugagcgccugcagaucccgcaggcuucguuugcc

SEQ ID NO: 135717 - RNA, 64 nt, Human
cccacccggcagaucggcucuauugacacagauccgccugcagauggccccuccaacccucucu

SEQ ID NO: 135718 - RNA, 64 nt, Human
gacgcugaagagcuucugccuggagcccgaggcccgccugcacccugccgggccugcucagcug

SEQ ID NO: 135719 - RNA, 64 nt, Human
cacccaccucuugugcaagguggccuuugugcugcgccugcaggcagagcuggagcccccagca

SEQ ID NO: 135720 - RNA, 64 nt, Human
cucggauggaccaaccugcucuguccccaaaggacgccugcaggagagagcagcacuccgcauc

SEQ ID NO: 135721 - RNA, 64 nt, Human
guggaaaggaaacugaagguaauugaauagaauacgccugcauuuaccagccccagcaacacaa

SEQ ID NO: 135722 - RNA, 64 nt, Human
cacuucucuguucucccgugucagcguguggugucgccugcaugggucguaccuggauggugug

SEQ ID NO: 135723 - RNA, 64 nt, Human
aggccuugguuaggcugagcucccagcaggacaccgccugcagaaaggaccugcccugauaaug

SEQ ID NO: 135724 - RNA, 64 nt, Human
agcagugccgcguggccuucggccccaaggcugucgccugcaccuucgccagggagcaccuggu

SEQ ID NO: 135725 - RNA, 64 nt, Human
accacuggugcuagcugcaccgugaccgcucagacgccugcaugcagcaggcguguguuccagu

SEQ ID NO: 135726 - RNA, 64 nt, Human
cagagcgcuccacgcguauucacgccccgcuccucgccugcacccccaccccgucuggggccug

SEQ ID NO: 135727 - RNA, 64 nt, Human
ccgcccaugcacuggggacgcuccgcugccgugccgccugcacuccucagggcagccucccccg

SEQ ID NO: 135728 - RNA, 64 nt, Human
guccacugaaugucacuugaccuugauaagaggccgccugcacacagagcccaguuaauucucc

SEQ ID NO: 135729 - RNA, 58 nt, Human
ugcagcccuggagugucugacccagucccgccugcaugugccugcagccaccguggac

SEQ ID NO: 135730 - RNA, 64 nt, Human
cguggagcaacacugacuagaaucuggauccugacgccugcagcugagagcaggagcaggaaaa

SEQ ID NO: 135731 - RNA, 64 nt, Human
ccaguggcucccauuuucauuuuagccauuuugucgccugcacccacucccuucauacaaucua

SEQ ID NO: 135732 - RNA, 64 nt, Human
ccagaggcagugggaucccugagugcugaaugcucgccugcagagcagcccagaaagagcccug

SEQ ID NO: 135733 - RNA, 64 nt, Human
cugcgggggcagcggccccggcuccuucuuguagcgccugcacaccuggguguugcagggaccc

SEQ ID NO: 135734 - RNA, 64 nt, Human
cgcccaccgagccauccugccucgccuccccccacgccugcagcuucucgcgaggggcggcgac

SEQ ID NO: 135735 - RNA, 64 nt, Human
cugcggggccacccaucguccaccccagugugcacgccugcaggcuggagacuggaccgcugac

SEQ ID NO: 135736 - RNA, 64 nt, Human
accaggcagagccguaccugucacccuccccaagcgccugcaccgcggugcaaggugagugcau

SEQ ID NO: 135737 - RNA, 64 nt, Human
cacacaugcccguaacaggauuuaucacaagacacgccugcauguagaccagacacagggcgua

SEQ ID NO: 135738 - RNA, 64 nt, Human
ccaaagggacuagagagaagccuccugcuccccucgccugcacacccccuuucagagggccacu

SEQ ID NO: 135739 - RNA, 64 nt, Human
cauacaaaguugacauaugagacccuguuguccccgccugcagcuuugccccaguaacagaugc

SEQ ID NO: 135740 - RNA, 64 nt, Human
aaaaauacaaaaauuagccaggcaugguggcgugcgccugcagucccagcuacuugggaggcug

SEQ ID NO: 135741 - RNA, 64 nt, Human
auuucaaaagugcauuuaaaaucauacauguucccgccugcaaauauauuguuauuuuggugga

SEQ ID NO: 135742 - RNA, 64 nt, Human
auuauuacagacuuuaaggagaaaacaaagucaccgccugcaucuagugcugcuucugcagauc

SEQ ID NO: 135743 - RNA, 64 nt, Human
gauccugggucccucauaagcacuuugguuuuaccgccugcaaccucacugugcccgccccgca

SEQ ID NO: 135744 - RNA, 59 nt, Human
acuuucuagaggaaauuuaggcgugcgggcgccugcaagcgggagacacccacacccca

SEQ ID NO: 135745 - RNA, 64 nt, Human
gguccuaaagaagagccugcgccuccgccuccgccgccugcaccgccgcgaagccgaagccgaa

SEQ ID NO: 135746 - RNA, 64 nt, Human
uacugaaaauacaaaaauuaggcauaguggugcacgccugcagucccagcuacucaggagguug

SEQ ID NO: 135747 - RNA, 64 nt, Human
augcuaggcaguguuucucaaaaucuccauagaucgccugcaucacuugaggagcuggugaaaa

SEQ ID NO: 135748 - RNA, 64 nt, Human
gcgugaggcuuauauguggaacugaugcagaguucgccugcagacggaucuggauauacacuau

SEQ ID NO: 135749 - RNA, 64 nt, Human
agagaagaccauguuggccgggcgcgguggcucacgccugcagucccagcacuuugggaggcca

SEQ ID NO: 135750 - RNA, 64 nt, Human
ccuucccggguuuguccugagccugcacuguccucgccugcagccucagaggggcaggcauccc

SEQ ID NO: 135751 - RNA, 64 nt, Human
aaacacgccugcaaacgcugccugcccguaaacacgccugcaaacgcugccugcccacacaggu

SEQ ID NO: 135752 - RNA, 64 nt, Human
aaacacgccugcaaacgcugccugccgguaaacacgccugcaaacgcugccugcccguaaacac

SEQ ID NO: 135753 - RNA, 64 nt, Human
uggucucacauggugcuacgccugcauguaaacacgccugcaaacgcugccugccgguaaacac

SEQ ID NO: 135754 - RNA, 64 nt, Human
ugaaacccuggaccaguggucucacauggugcuacgccugcauguaaacacgccugcaaacgcu

SEQ ID NO: 135755 - RNA, 64 nt, Human
gguguucuccagugccaaguacccugcuccagagcgccugcaggaauauggcuccaucuucacg

SEQ ID NO: 135756 - RNA, 64 nt, Human
acgcgcuucgggcagccuagccacaggcuuugagcgccugcauuccugggggcuggaggguggg

SEQ ID NO: 135757 - RNA, 64 nt, Human
cuauccugagcccccuucccuguccuaagccugacgccugcaccgggcccuccagcccuccccu

SEQ ID NO: 135758 - RNA, 64 nt, Human
caagggguacugugcagacugaccaccggccucccgccugcaggucagaggcucugacacuguc

SEQ ID NO: 135759 - RNA, 64 nt, Human
cgaaguuuacaaacaccuccuggaacgaagcucccgccugcaugucaccuugaugggggcugug

SEQ ID NO: 135760 - RNA, 64 nt, Human
ccacccuuugcugacuccuuuuuuggacucagcccgccugcacucaggugaaauaaacagccau

SEQ ID NO: 135761 - RNA, 64 nt, Human
gacgcgagggaaaggagcacuaaguggggcucgccgccugcagccaggggccgccugugggaac

SEQ ID NO: 135762 - RNA, 64 nt, Human
gucagcgacagccugggcacccgcggggccgucccgccugcagagggccacucggggggguuuc

SEQ ID NO: 135763 - RNA, 64 nt, Human
agaacgaguggaagaagugagagaugcuggccugcgccugcaccugcgccuggcucugucaccg

SEQ ID NO: 135764 - RNA, 64 nt, Human
ccauccugagcccccuucccuguccuaagccugacgccugcaccgggcccuccggcccuccccu

SEQ ID NO: 135765 - RNA, 64 nt, Human
gaaaaauuccucaaaguauuugucauuucugagucgccugcauuaucccauucuuauucuccuc

SEQ ID NO: 135766 - RNA, 64 nt, Human
agccaggaccuggauuccucuggguagagggcaacgccugcagccccucuucccucccacaugg

SEQ ID NO: 135767 - RNA, 64 nt, Human
uuggaggccccugggcucucacccaguccccacccgccugcagagagggaacuagggcaccccu

SEQ ID NO: 135768 - RNA, 64 nt, Human
uaguguuuuuccucgcuuuuaaugaccucagccccgccugcaguggcuagaagccagcaggugc

SEQ ID NO: 135769 - RNA, 64 nt, Human
cacccuggagcccacccccaugggcaccgcgugccgccugcacgugggcugucuucacaggucu

SEQ ID NO: 135770 - RNA, 57 nt, Human
aggugcugaagucgugcugagucuggccgccugcagggggguacccgggccaacggc

SEQ ID NO: 135771 - RNA, 64 nt, Human
gcccagauugcucagcuguuuguaccugacuugccgccugcauaggagccaguucuguuccuuc

SEQ ID NO: 135772 - RNA, 64 nt, Human
ugaacaaugaagaggccugcgccuccugccuugccgccugcaaagcaaagaaacugccuuuuau

SEQ ID NO: 135773 - RNA, 64 nt, Human
agucccagggggagacagauuccucccuccuccccgccugcagcucucuuuaauuuuuuguaac

SEQ ID NO: 135774 - RNA, 64 nt, Human
ggacggagccggacuggacauggucacucaguaccgccugcagugucgccaugacugaucaugg

SEQ ID NO: 135775 - RNA, 51 nt, Human
cauaugccgcagacccauagccgccugcaaggcagagaggacacaggagag

SEQ ID NO: 135776 - RNA, 64 nt, Human
accccccuccccagcucggccccucuuucccugucgccugcagccacccgccaagcauaguuca

SEQ ID NO: 135777 - RNA, 57 nt, Human
cggccugcaagcagcagugaggcuggccgccugcagcccguguccaggagccccgcc

SEQ ID NO: 135778 - RNA, 64 nt, Human
agucugccaagaggcacccccuuccccagccucucgccugcacugaugcagacaaaaucucacc

SEQ ID NO: 135779 - RNA, 61 nt, Human
cguucaucgaacugcacugaccugcccagaacgccugcacccucaccucuccccucuccug

SEQ ID NO: 135780 - RNA, 64 nt, Human
uucccacggccacaggcaaggggguugcaguggccgccugcaccuuggaugaggcagggccagg

SEQ ID NO: 135781 - RNA, 64 nt, Human
cccaccugcuaaauaccuccaaacucugggcaggcgccugcauucucaacacaggacuucccuu

SEQ ID NO: 135782 - RNA, 64 nt, Human
cccucacagaggcacaaacccacauaguuguggacgccugcagagacucaaauauugagaggac

SEQ ID NO: 135783 - RNA, 64 nt, Human
uccagaguguacacugcaggcagccacauuuacacgccugcaguuguuuuccggagucuguccc

SEQ ID NO: 135784 - RNA, 64 nt, Human
uuucccgggcgucugcagcugcccugcccgugcccgccugcagugguuggagacgggaguggcc

SEQ ID NO: 135785 - RNA, 64 nt, Human
ggcccugccgagagcccgugcugccugcuggagccgccugcagacgcgguccucggccccacgu

SEQ ID NO: 135786 - RNA, 64 nt, Human
agaucugagggacuccucaguccuggggcgucgccgccugcagccucuuccaagcccugcgucc

SEQ ID NO: 135787 - RNA, 64 nt, Human
uaagucuucaguuuuggcugggcaugauggugagcgccugcagucccagcuacuugggaggcua

SEQ ID NO: 135788 - RNA, 64 nt, Human
gcaugaggcacagcccgacagguugccugacggccgccugcaccuacccaagcugaacaaccuc

SEQ ID NO: 135789 - RNA, 64 nt, Human
ccuuucuaaaucugagaucucccuccagggaauccgccugcagaggacagagcuggcugucuuc

SEQ ID NO: 135790 - RNA, 64 nt, Human
auguuaagaggacugggcugggcacuguggcucacgccugcaaugccagcacuuugagaggcca

SEQ ID NO: 135791 - RNA, 64 nt, Human
cccccaucccugcuacagaacacagcacccauggcgccugcaguggacuggccccuuaauuccc

SEQ ID NO: 135792 - RNA, 64 nt, Human
caacauggucauccgggaggacaaccagaccaaccgccugcaggaggcucugaaccucuucaag

SEQ ID NO: 135793 - RNA, 64 nt, Human
aguaaaaugaucccagaugugccccagagcaugacgccugcagcuccgguuucaugcaggaaau

SEQ ID NO: 135794 - RNA, 64 nt, Human
ugguggcccccacccugggggaggucuccucaugcgccugcaccaggagacagacacagaaggu

SEQ ID NO: 135795 - RNA, 64 nt, Human
cacauggggccacccggcucccucgggauggcuccgccugcacuuuugaaaccccgguuuccuu

SEQ ID NO: 135796 - RNA, 64 nt, Human
ccugugggacuacugcuaggugugugggguguuucgccugcaccccugguuucuuuaagucuua

SEQ ID NO: 135797 - RNA, 64 nt, Human
cauuuaaaauuuggaggcugggugcuguggcucacgccugcaaucccagcacuuugggagacug

SEQ ID NO: 135798 - RNA, 64 nt, Human
ugucauggagccgcauaccccuggguugugagcucgccugcauaugcagggucugucauggaac

SEQ ID NO: 135799 - RNA, 64 nt, Human
gccggcaguugcaguguagacagcccgagagccccgccugcaggcgguguagauacauguagau

SEQ ID NO: 135800 - RNA, 64 nt, Human
ggcccgugaugccagguggcccaugugcccagggcgccugcagggcugcuacagggaccugguc

SEQ ID NO: 135801 - RNA, 64 nt, Human
caugcggugcccguggcccgccccacaccaccgccgccugcagaccucucccuuggccggcucc

SEQ ID NO: 135802 - RNA, 64 nt, Human
aucuucugagcgccacccuugcaacaaauacaggcgccugcacagccuggcccaccuguucauu

SEQ ID NO: 135803 - RNA, 64 nt, Human
uggcacugggggcuggucacccugagagucccaucgccugcagcaccuggagacccaccuccca

SEQ ID NO: 135804 - RNA, 64 nt, Human
gaaagguggcgcgcuucucacggcugaguugcugcgccugcagacggaagcuccccacaggcag

SEQ ID NO: 135805 - RNA, 64 nt, Human
ucuggugcgcgcgcgcccugcacacccggcccugcgccugcagggggcgcugcaucccgcgcgc

SEQ ID NO: 135806 - RNA, 64 nt, Human
cagccaguggccucccaacuugguucugggcccccgccugcaagcacacauggcaaggagggcu

SEQ ID NO: 135807 - RNA, 64 nt, Human
cuuaucugcagaaauuugcugucaauauauaacccgccugcaguggaaaguguauaguguuuug

SEQ ID NO: 135808 - RNA, 64 nt, Human
ggccgccacuuggcaugaagccuccacagcuccccgccugcaggggcaaagaggucgacagcaa

SEQ ID NO: 135809 - RNA, 64 nt, Human
auuuugcugauuuaaaggcuuaggcauguucaaacgccugcaaaacuacuuaucacucagcuuu

SEQ ID NO: 135810 - RNA, 64 nt, Human
cugcaggccugugaagggugccaccugagggagccgccugcaagcggcccugcagccacaaagc

SEQ ID NO: 135811 - RNA, 64 nt, Human
uuccaauaaagaagugcacgugucagagcuggagcgccugcauugugagaaaccauuuguguuc

SEQ ID NO: 135812 - RNA, 64 nt, Human
cgacggagggcagggcccacccugcggugucgcgcgccugcagcacgccccacguccagguggc

SEQ ID NO: 135813 - RNA, 64 nt, Human
gacccuugaaggucacuuagccuucuuaggcaaacgccugcaaaacagaagccuggagagggga

SEQ ID NO: 135814 - RNA, 64 nt, Human
cccgcgcgcccggacucccgggcuccgcgcaccccgccugcaccgcgcguccugcacucaaccc

SEQ ID NO: 135815 - RNA, 64 nt, Human
gggggucugccucaaucucccuggccgggccaggcgccugcacagacuggcugcuggaccugcg

SEQ ID NO: 135816 - RNA, 64 nt, Human
gacauuaacugcgugccuggcccuaugagggcggcggcgggacagggugagcggagagacagaa

SEQ ID NO: 135817 - RNA, 64 nt, Human
uuguaugaaaggggccacugugugucuuccuccccggcgggagccccacaugugugcacuguag

SEQ ID NO: 135818 - RNA, 52 nt, Human
gccucuggcggcccuggugacccggcgggaccugcgggcgcgcggcccgacg

SEQ ID NO: 135819 - RNA, 64 nt, Human
gugaggcccugucacagccuguggguaggggaugcggcgggauccucauugccaugguacucaa

SEQ ID NO: 135820 - RNA, 64 nt, Human
gaggacggugcggggccgcagggggcgcggggcgcggcgggacccaggcuacgagcgggaggga

SEQ ID NO: 135821 - RNA, 64 nt, Human
ccgcccugcgcuggacugguucaagcuuccgccucggcgggaacgcuguacauagucagguccg

SEQ ID NO: 135822 - RNA, 64 nt, Human
ggcccugcccucacuuuuaccaaagguucucccucggcgggagggcaucuguguuggaggugau

SEQ ID NO: 135823 - RNA, 64 nt, Human
ggagucaucaguaugaggggaacccccaccgcgucggcgggaagcgugggagguguagcuccua

SEQ ID NO: 135824 - RNA, 64 nt, Human
ccagcaaggacacgcucuccccaacagggugcuucggcgggaggugggggaacaaggggucuuc

SEQ ID NO: 135825 - RNA, 54 nt, Human
gcgucuaccgagcccagugaggcgcggcgggagggcgcggggcggggagcgagc

SEQ ID NO: 135826 - RNA, 64 nt, Human
ggguggggcuggacggggacgaggcgcggagaggcggcgggaaagagcuucggcugggccacgg

SEQ ID NO: 135827 - RNA, 64 nt, Human
agauggugaggcugucaguguauggggcagcuuccggcgggauguugaacuggucauuaaugug

SEQ ID NO: 135828 - RNA, 64 nt, Human
ccggcguuucuguuaccccggccgcggcucuuggcggcgggagaggcgcaguggcugcaggcug

SEQ ID NO: 135829 - RNA, 64 nt, Human
gcgggcgggcccggcugccaaggaggagggagagcggcgggaggggccgcggugccgggccggg

SEQ ID NO: 135830 - RNA, 64 nt, Human
cgccacauccucacgcucgguggagggacgcgugcggcgggacggugccuacggguacuugcag

SEQ ID NO: 135831 - RNA, 64 nt, Human
cagcaagcaggaucgcugcucagaccugugaccccggcgggacccccauguccuccgcuccgcc

SEQ ID NO: 135832 - RNA, 64 nt, Human
ucggucaucuagccccaccccugccugucggacgcggcgggaggcccacgguucggggcuucug

SEQ ID NO: 135833 - RNA, 64 nt, Human
agagcuguguggccuggcaagcaagccugggagccggcgggaggucugccaggcugucccgugc

SEQ ID NO: 135834 - RNA, 64 nt, Human
gaucaaccagguggcauuggaggcguggcgcagccggcgggaccgcgaggagauccuccugcag

SEQ ID NO: 135835 - RNA, 64 nt, Human
ugcugugcagucagaggcccaggguccagcagcccggcgggaacgggugcugccucuuccucca

SEQ ID NO: 135836 - RNA, 64 nt, Human
gcuggcagacaaggugaagaggcugaugcggccccggcgggaggggggccccccuggggggcug

SEQ ID NO: 135837 - RNA, 64 nt, Human
ggcgagguggcuggacagcaccagcagcgcaucccggcgggaacccagaaaaggcuucuuacac

SEQ ID NO: 135838 - RNA, 64 nt, Human
aagggcucagggcaccagcaaccaagccagcccccggcgggaucgauacccucaccccuccacu

SEQ ID NO: 135839 - RNA, 64 nt, Human
acacccucuguaauuuuaagauguaugugguggccggcgggaagaccagccccgacagcaccuc

SEQ ID NO: 135840 - RNA, 64 nt, Human
gagacggaggaagcggcagaaggcggacgcgugccggcgggaggagccacgcgugagcacaccu

SEQ ID NO: 135841 - RNA, 59 nt, Human
uccucaacaaccccagauaguggcggccccggcgggaggggcgggugggaggccgcggc

SEQ ID NO: 135842 - RNA, 64 nt, Human
ccagagcaagcucagcgaggaccucauggaguuccggcgggacgcauccauguuaaaugugagc

SEQ ID NO: 135843 - RNA, 64 nt, Human
auccauucuagagccagucucugccucccagacgcggcgggagccaagcuccuccaaccacaag

SEQ ID NO: 135844 - RNA, 64 nt, Human
gccgcaccgagugcacuuuaggggccccuacggccggcgggaucggccucccucccccacgacu

SEQ ID NO: 135845 - RNA, 64 nt, Human
ggcgggggcaaagcccccagagccucacuggccccggcgggaugaggagaccaugccgggcgcg

SEQ ID NO: 135846 - RNA, 64 nt, Human
ccaggguuagacacaaggaccugaagugacaugacggcgggacaggggaaaugugacuuucuaa

SEQ ID NO: 135847 - RNA, 59 nt, Human
uggucacgaagaacuuguaaggccaacugcggcgggaggcccugaagaugcaguccccc

SEQ ID NO: 135848 - RNA, 64 nt, Human
cggcaacguagccugggcucacugugcuggggcacggcgggauccuccacagagaggaggggac

SEQ ID NO: 135849 - RNA, 64 nt, Human
gaccuggccuugccaagggccuggggcaaggugucggcgggacggugaggaagggggaggcagc

SEQ ID NO: 135850 - RNA, 64 nt, Human
aggcgucuacauucgcugagaggcaggggccacacggcgggaggaagggcucugagcccagggg

SEQ ID NO: 135851 - RNA, 64 nt, Human
agccccgggggauccgggcugcugggcagcaggucggcgggaccacaugccugggucucacccu

SEQ ID NO: 135852 - RNA, 64 nt, Human
caagucgcugagccauugaggaucgcgacgcagucggcgggacccucauggaagcaucgcccuc

SEQ ID NO: 135853 - RNA, 64 nt, Human
ccgccccugggcccgucugcgccggaggcugcggcggcgggagccacggaccagaccagccaca

SEQ ID NO: 135854 - RNA, 64 nt, Human
gaagcggcgaagcagccggagucgggagcgggcccggcgggagcgggagcgcaaggaggagcug

SEQ ID NO: 135855 - RNA, 64 nt, Human
gagccgcuacgaggccuuccugaguccggaguaccggcgggaggagguagggccauagugaccc

SEQ ID NO: 135856 - RNA, 64 nt, Human
ugcuccugccgccuuccuucacggcacuuacaaccggcgggacccccagggaccaccccucagg

SEQ ID NO: 135857 - RNA, 64 nt, Human
ccuugggcugggggagggggcccacccuuaaaggcggcgggaggggagggagggagaguggagg

SEQ ID NO: 135858 - RNA, 64 nt, Human
cccgcugcucggcggaucccagcugcgguggcgacggcgggaaggcgcuuuccgcuguuccuca

SEQ ID NO: 135859 - RNA, 64 nt, Human
ugcuucuccccugggcugcugugggcuggguccccggcgggacugucaauggaggcagggguuc

SEQ ID NO: 135860 - RNA, 64 nt, Human
gacccgaggccaccccagccugguguggacccaucggcgggagagagugccacgccuccacagc

SEQ ID NO: 135861 - RNA, 64 nt, Human
aaugauuuuauucauuuuuauguuuucuuuugggcggcgggauggagucucugucacccaggcu

SEQ ID NO: 135862 - RNA, 64 nt, Human; identical to SEQ ID NO: 120310

SEQ ID NO: 135863 - RNA, 64 nt, Human; identical to SEQ ID NO: 120311

SEQ ID NO: 135864 - RNA, 64 nt, Human; identical to SEQ ID NO: 120312

SEQ ID NO: 135865 - RNA, 64 nt, Human; identical to SEQ ID NO: 120313

SEQ ID NO: 135866 - RNA, 64 nt, Human; identical to SEQ ID NO: 120314

SEQ ID NO: 135867 - RNA, 51 nt, Human; identical to SEQ ID NO: 120315

SEQ ID NO: 135868 - RNA, 64 nt, Human; identical to SEQ ID NO: 120316

SEQ ID NO: 135869 - RNA, 64 nt, Human; identical to SEQ ID NO: 120317

SEQ ID NO: 135870 - RNA, 64 nt, Human; identical to SEQ ID NO: 120318

SEQ ID NO: 135871 - RNA, 64 nt, Human; identical to SEQ ID NO: 120319

SEQ ID NO: 135872 - RNA, 64 nt, Human; identical to SEQ ID NO: 120320

SEQ ID NO: 135873 - RNA, 64 nt, Human; identical to SEQ ID NO: 120321

SEQ ID NO: 135874 - RNA, 64 nt, Human; identical to SEQ ID NO: 120322

SEQ ID NO: 135875 - RNA, 64 nt, Human; identical to SEQ ID NO: 120323

SEQ ID NO: 135876 - RNA, 64 nt, Human; identical to SEQ ID NO: 120324

SEQ ID NO: 135877 - RNA, 64 nt, Human; identical to SEQ ID NO: 120325

SEQ ID NO: 135878 - RNA, 64 nt, Human; identical to SEQ ID NO: 120326

SEQ ID NO: 135879 - RNA, 52 nt, Human; identical to SEQ ID NO: 120327

SEQ ID NO: 135880 - RNA, 64 nt, Human; identical to SEQ ID NO: 120328

SEQ ID NO: 135881 - RNA, 64 nt, Human; identical to SEQ ID NO: 120329

SEQ ID NO: 135882 - RNA, 64 nt, Human; identical to SEQ ID NO: 120330

SEQ ID NO: 135883 - RNA, 64 nt, Human; identical to SEQ ID NO: 120331

SEQ ID NO: 135884 - RNA, 64 nt, Human; identical to SEQ ID NO: 120332

SEQ ID NO: 135885 - RNA, 52 nt, Human; identical to SEQ ID NO: 120333

SEQ ID NO: 135886 - RNA, 64 nt, Human; identical to SEQ ID NO: 120334

SEQ ID NO: 135887 - RNA, 64 nt, Human; identical to SEQ ID NO: 120335

SEQ ID NO: 135888 - RNA, 64 nt, Human; identical to SEQ ID NO: 120336

SEQ ID NO: 135889 - RNA, 64 nt, Human; identical to SEQ ID NO: 120337

SEQ ID NO: 135890 - RNA, 64 nt, Human; identical to SEQ ID NO: 120338

SEQ ID NO: 135891 - RNA, 64 nt, Human; identical to SEQ ID NO: 120339

SEQ ID NO: 135892 - RNA, 64 nt, Human; identical to SEQ ID NO: 120340

SEQ ID NO: 135893 - RNA, 64 nt, Human; identical to SEQ ID NO: 120341

SEQ ID NO: 135894 - RNA, 64 nt, Human; identical to SEQ ID NO: 120342

SEQ ID NO: 135895 - RNA, 64 nt, Human; identical to SEQ ID NO: 120343

SEQ ID NO: 135896 - RNA, 64 nt, Human; identical to SEQ ID NO: 120344

SEQ ID NO: 135897 - RNA, 64 nt, Human; identical to SEQ ID NO: 120345

SEQ ID NO: 135898 - RNA, 64 nt, Human; identical to SEQ ID NO: 120346

SEQ ID NO: 135899 - RNA, 64 nt, Human; identical to SEQ ID NO: 120347

SEQ ID NO: 135900 - RNA, 64 nt, Human; identical to SEQ ID NO: 120348

SEQ ID NO: 135901 - RNA, 64 nt, Human; identical to SEQ ID NO: 120349

SEQ ID NO: 135902 - RNA, 64 nt, Human; identical to SEQ ID NO: 120350

SEQ ID NO: 135903 - RNA, 64 nt, Human; identical to SEQ ID NO: 120351

SEQ ID NO: 135904 - RNA, 64 nt, Human; identical to SEQ ID NO: 120352

SEQ ID NO: 135905 - RNA, 64 nt, Human; identical to SEQ ID NO: 120353

SEQ ID NO: 135906 - RNA, 64 nt, Human; identical to SEQ ID NO: 120354

SEQ ID NO: 135907 - RNA, 64 nt, Human; identical to SEQ ID NO: 120355

SEQ ID NO: 135908 - RNA, 64 nt, Human; identical to SEQ ID NO: 120356

SEQ ID NO: 135909 - RNA, 57 nt, Human; identical to SEQ ID NO: 120357

SEQ ID NO: 135910 - RNA, 57 nt, Human; identical to SEQ ID NO: 120358

SEQ ID NO: 135911 - RNA, 64 nt, Human; identical to SEQ ID NO: 120359

SEQ ID NO: 135912 - RNA, 64 nt, Human; identical to SEQ ID NO: 120360

SEQ ID NO: 135913 - RNA, 64 nt, Human; identical to SEQ ID NO: 120361

SEQ ID NO: 135914 - RNA, 64 nt, Human; identical to SEQ ID NO: 120362

SEQ ID NO: 135915 - RNA, 64 nt, Human; identical to SEQ ID NO: 120363

SEQ ID NO: 135916 - RNA, 64 nt, Human; identical to SEQ ID NO: 120364

SEQ ID NO: 135917 - RNA, 64 nt, Human; identical to SEQ ID NO: 120365

SEQ ID NO: 135918 - RNA, 64 nt, Human; identical to SEQ ID NO: 120366

SEQ ID NO: 135919 - RNA, 64 nt, Human; identical to SEQ ID NO: 120367

SEQ ID NO: 135920 - RNA, 64 nt, Human; identical to SEQ ID NO: 120368

SEQ ID NO: 135921 - RNA, 64 nt, Human; identical to SEQ ID NO: 120369

SEQ ID NO: 135922 - RNA, 64 nt, Human; identical to SEQ ID NO: 120370

SEQ ID NO: 135923 - RNA, 64 nt, Human; identical to SEQ ID NO: 120371

SEQ ID NO: 135924 - RNA, 64 nt, Human; identical to SEQ ID NO: 120372

SEQ ID NO: 135925 - RNA, 64 nt, Human; identical to SEQ ID NO: 120373

SEQ ID NO: 135926 - RNA, 64 nt, Human; identical to SEQ ID NO: 120374

SEQ ID NO: 135927 - RNA, 64 nt, Human; identical to SEQ ID NO: 120375

SEQ ID NO: 135928 - RNA, 64 nt, Human; identical to SEQ ID NO: 120376

SEQ ID NO: 135929 - RNA, 64 nt, Human; identical to SEQ ID NO: 120377

SEQ ID NO: 135930 - RNA, 64 nt, Human; identical to SEQ ID NO: 120378

SEQ ID NO: 135931 - RNA, 64 nt, Human; identical to SEQ ID NO: 120379

SEQ ID NO: 135932 - RNA, 64 nt, Human; identical to SEQ ID NO: 120380

SEQ ID NO: 135933 - RNA, 64 nt, Human; identical to SEQ ID NO: 120381

SEQ ID NO: 135934 - RNA, 64 nt, Human; identical to SEQ ID NO: 120382

SEQ ID NO: 135935 - RNA, 64 nt, Human; identical to SEQ ID NO: 120383

SEQ ID NO: 135936 - RNA, 64 nt, Human; identical to SEQ ID NO: 120384

SEQ ID NO: 135937 - RNA, 64 nt, Human; identical to SEQ ID NO: 120385

SEQ ID NO: 135938 - RNA, 64 nt, Human; identical to SEQ ID NO: 120386

SEQ ID NO: 135939 - RNA, 64 nt, Human; identical to SEQ ID NO: 120387

SEQ ID NO: 135940 - RNA, 64 nt, Human
uuccacacaggauuccguuggugaaccuguaaaaacaaaacaaacaaaacaaaacaaaaaagac

SEQ ID NO: 135941 - RNA, 64 nt, Human
ggauuccguuggugaaccuguaaaaacaaaacaaacaaaacaaaacaaaaaagacaaaaccuaa

SEQ ID NO: 135942 - RNA, 64 nt, Human
ccguuggugaaccuguaaaaacaaaacaaacaaaacaaaacaaaaaagacaaaaccuaaaacug

SEQ ID NO: 135943 - RNA, 64 nt, Human
cguuaggaauccauucucacuguguucgcucuaaacaaaacagugguagguuaauguguucaga

SEQ ID NO: 135944 - RNA, 64 nt, Human
ccaggauuaaaacuaaccgugaccacuacuccaaacaaaacacaauaugccuaggggcacggau

SEQ ID NO: 135945 - RNA, 64 nt, Human
uuuuuucucuuuuugguggugguuaaaagggaacacaaaacauuuaaauaaaacuuuccaaaua

SEQ ID NO: 135946 - RNA, 64 nt, Human
uccagccugguuacagagcaagacucugucucaaacaaaacaaaacaaaacaaaaacacacuac

SEQ ID NO: 135947 - RNA, 64 nt, Human
ccugguuacagagcaagacucugucucaaacaaaacaaaacaaaacaaaaacacacuacuguau

SEQ ID NO: 135948 - RNA, 64 nt, Human
uuacagagcaagacucugucucaaacaaaacaaaacaaaacaaaaacacacuacuguauuuugg

SEQ ID NO: 135949 - RNA, 64 nt, Human
caagcauacuucuuuugcguauuauguuuaacucacaaaacaaagcucaucaugcguuugauuc

SEQ ID NO: 135950 - RNA, 64 nt, Human
uuacuuacuaaaauauauauagaaauauauacgaacaaaacacacgcgcgcacacacacacaua

SEQ ID NO: 135951 - RNA, 64 nt, Human
cucauuacuguagugcugagguuauugaaguuauacaaaacacaucucagucucuguuucuugg

SEQ ID NO: 135952 - RNA, 64 nt, Human
gaguugaauauugaacucuaacaguuuucuacauacaaaacacagugucaugaagguuauucau

SEQ ID NO: 135953 - RNA, 64 nt, Human
uccaugaccagggagaacuuacaggauguuagagacaaaacaagcagacaccugaaacaaucaa

SEQ ID NO: 135954 - RNA, 64 nt, Human
ggauauacuuuuaauaaaguuuuauaacucacugacaaaacauauuucaauaguauaugaguau

SEQ ID NO: 135955 - RNA, 64 nt, Human
aucuucaaguagaccuagaagagaguuuuaaaaaacaaaacaauguaaguaaaggauauuucug

SEQ ID NO: 135956 - RNA, 64 nt, Human
ggugcuuuauaauguguuuuaaagcauugcauuuacaaaacaaggaaaaugcuguaaauauugc

SEQ ID NO: 135957 - RNA, 64 nt, Human
uuaaaaguuuaaggauaagacauguguauauguaacaaaacacauugcaucuagaaaucaaaac

SEQ ID NO: 135958 - RNA, 64 nt, Human
uuuuuaacaauggauauucuguaaaauauccuguacaaaacaagacuauugccaguaauguaua

SEQ ID NO: 135959 - RNA, 64 nt, Human
gccuggcgacacagugagacucugucucaaaaaaacaaaacaaacaaacaaaaauacaaaaaau

SEQ ID NO: 135960 - RNA, 64 nt, Human
caaaccucauuuuaguuguagaagaaaauuucuuacaaaacaaauuccacaaagaacacccuau

SEQ ID NO: 135961 - RNA, 64 nt, Human
uuugagagguagucugucugauacaauguaaaugacaaaacauaauuccugagaggcccagaac

SEQ ID NO: 135962 - RNA, 64 nt, Human
aagaucauaauguugucuuguaauauauuuauuuacaaaacacuucauuauuuauaaagaauuu

SEQ ID NO: 135963 - RNA, 64 nt, Human
aggaaauguucuuuuuuaaaaaaaaauaacaaaaacaaaacaaaacuauuuauuuugugauugu

SEQ ID NO: 135964 - RNA, 64 nt, Human
uccuuucagaaaacaugcaaauaccaagauccauacaaaacaauaauuuauuccacugaucaac

SEQ ID NO: 135965 - RNA, 64 nt, Human
uacuucauuugccaaucagaggauguuuuaagaaacaaaacauaguaucuuauggauuguuuac

SEQ ID NO: 135966 - RNA, 64 nt, Human
aucuggcagagaacaguuaaucccuaaggucuugacaaaacagaagaaaaacaagccuccucgu

SEQ ID NO: 135967 - RNA, 64 nt, Human
gcuuacagacuaacuggggagauguagugugcauacaaaacaguaaaagagccaucucaaggac

SEQ ID NO: 135968 - RNA, 64 nt, Human
auguuuuuguuagaguagacuuuuuuuaaacaagacaaaacauuuuuauaugauuauaaaagaa

SEQ ID NO: 135969 - RNA, 64 nt, Human
aguuuuguaugcuuuuuugaaauauguaaaaauuacaaaacaaaccucaucaguauaauauaau

SEQ ID NO: 135970 - RNA, 64 nt, Human
caucgacaaagaacaguaaauuuuuagagaaacaacaaaacaaagaaaaagagcuuugagucug

SEQ ID NO: 135971 - RNA, 64 nt, Human
uuguguuuguuuuauagagugcagcgcagcuuggacaaaacacauuucaagugcccaguaguca

SEQ ID NO: 135972 - RNA, 64 nt, Human
ggccauuauuuucuaauccauuuuuaaaauacagacaaaacacuucuuuaaacagaacaagaau

SEQ ID NO: 135973 - RNA, 64 nt, Human
guauaaggagagaaauaacuuuaaaguuuauuagacaaaacagaguauagaugccaagaugucu

SEQ ID NO: 135974 - RNA, 64 nt, Human
ggcugagaucgcgguauuaaaucugugaaagaaaacaaaacaaaacaaaaacggcuucuuggcg

SEQ ID NO: 135975 - RNA, 64 nt, Human
aagugacaaccgucugagucuugugcucuucaagacaaaacagauugcgucgcugacaaguucu

SEQ ID NO: 135976 - RNA, 64 nt, Human
gucucuguagcccugacauaaggaacagaacacaacaaaacacagcaaaccaugugcccaaacu

SEQ ID NO: 135977 - RNA, 64 nt, Human
aaaaaaaaaaaaaaaacaaaaaaacaaaaaaaaaacaaaacaguuuuuaaaacugauuuuagaa

SEQ ID NO: 135978 - RNA, 64 nt, Human
aaucuguagauucucuccucucccaucccagaaaacaaaacaaaauaaugcuuuucgaaauugu

SEQ ID NO: 135979 - RNA, 64 nt, Human
cagagcgacacucggucucaaaaaacaaaacaaaacaaaacaaaauuagagauugggucuuucc

SEQ ID NO: 135980 - RNA, 64 nt, Human
ggugacagagcgacacucggucucaaaaaacaaaacaaaacaaaacaaaauuagagauuggguc

SEQ ID NO: 135981 - RNA, 64 nt, Human
gccugggugacagagcgacacucggucucaaaaaacaaaacaaaacaaaacaaaauuagagauu

SEQ ID NO: 135982 - RNA, 64 nt, Human
agucucagaaaaggcuaacaauuuuauauagaggacaaaacagcauuaaacucaucaguugcaa

SEQ ID NO: 135983 - RNA, 64 nt, Human
gccuuuuucuacaccuuuuguugcuuaaaaagaaacaaaacaaaucacauacauacauuuaaaa

SEQ ID NO: 135984 - RNA, 64 nt, Human
ccucccucugaagaaguauuauguucagaagccaacaaaacaguuuguugccagaccaauguuu

SEQ ID NO: 135985 - RNA, 64 nt, Human
guacaaaggggaaagaacauaaagguaaaacaaaacaaaacaacauuuugagaacaaagaugac

SEQ ID NO: 135986 - RNA, 64 nt, Human
caucuguacaaaggggaaagaacauaaagguaaaacaaaacaaaacaacauuuugagaacaaag

SEQ ID NO: 135987 - RNA, 64 nt, Human
aaugaauguaaugagagaaaauguuuugaaaagaacaaaacaucaaaaugaauagaaagaaaaa

SEQ ID NO: 135988 - RNA, 64 nt, Human
ccaguaaaugaggcaagcaauucuaagaucuuccacaaaacaucuagccaacuaaaauggagag

SEQ ID NO: 135989 - RNA, 64 nt, Human
ugcuugauauuugugaacauuuacugcauggaucacaaaacaauauacccuguauuucuuacac

SEQ ID NO: 135990 - RNA, 64 nt, Human
cuucuaggacccgguuucuuuuacugauuuaaaaacaaaacaaaaaaaaauaaaaaaguugugc

SEQ ID NO: 135991 - RNA, 64 nt, Human
ugugcacuaaaagugucacacucccaaaaaacucacaaaacauuuugcuaaaaagauaugacug

SEQ ID NO: 135992 - RNA, 64 nt, Human
cguuaguccagccccugcuucacccccuccacacacaaaacaggaaacauaaucaaagcgcuag

SEQ ID NO: 135993 - RNA, 64 nt, Human
uagggaaacaaauucuuuugaauaaaaauaaauaacaaaacaauaaaaguuuauugagccacag

SEQ ID NO: 135994 - RNA, 64 nt, Human
uggcuucaccuuguacugcaagaugaauuuguaaacaaaacaaaauuggacugucuggaaagcu

SEQ ID NO: 135995 - RNA, 64 nt, Human
auuugucugaaucauuagucuugacuugaagugaacaaaacacccuuugcccaagugccauugg

SEQ ID NO: 135996 - RNA, 64 nt, Human
uccacaucgugcagucgugucauaaaaaaacaaaacaaaacaaaaaaacacuaggaguccacuc

SEQ ID NO: 135997 - RNA, 64 nt, Human
ccagauccacaucgugcagucgugucauaaaaaaacaaaacaaaacaaaaaaacacuaggaguc

SEQ ID NO: 135998 - RNA, 64 nt, Human
cuuccuccuagaacuuacauuuuaauggaaauagacaaaacacaucuucuuaacggauggugac

SEQ ID NO: 135999 - RNA, 64 nt, Human
uuuaucuucuauauaauuccuguuuuuauuauuaacaaaacaguccuaaauagcagcccucaau

SEQ ID NO: 136000 - RNA, 64 nt, Human
guauuaguuacucaaauugauacaaugcuugacuacaaaacagagcugucuucagcaacauuau

SEQ ID NO: 136001 - RNA, 64 nt, Human
augugacauaacucauacaucggcacugaauuaaacaaaacaaaauacaacuguugcuauaucu

SEQ ID NO: 136002 - RNA, 64 nt, Human
cuauguugguuucaguggcuggaauuaaaacaaaacaaaacaaacuuccaaacaguguguuggu

SEQ ID NO: 136003 - RNA, 64 nt, Human
aacuucuauguugguuucaguggcuggaauuaaaacaaaacaaaacaaacuuccaaacagugug

SEQ ID NO: 136004 - RNA, 64 nt, Human
ugugagaugauugucaggacuaacugucuuuuuaacaaaacauuuucaguauuuuaaauaaaau

SEQ ID NO: 136005 - RNA, 64 nt, Human
gacccccaguguuguaacguaccuuuguacccagacaaaacaauuauguuacauuccucaaagu

SEQ ID NO: 136006 - RNA, 64 nt, Human
gauauagaauaguaaucuaguugaacuguucugcacaaaacaugcuuccuuuucaaagaauaga

SEQ ID NO: 136007 - RNA, 62 nt, Human
aaagagcuuauaugugguaaaaaacaacaacaacaaaacaccucugucaauguaagaagugu

SEQ ID NO: 136008 - RNA, 64 nt, Human
ucauuugcuaaugaauuuuaaaagcauauauaaaacaaaacaaacaaccugccacaaugugaua

SEQ ID NO: 136009 - RNA, 64 nt, Human
auuuuuucauauguggaaaucuauuacauguaauacaaaacaaacauguaguuugaaggcgguc

SEQ ID NO: 136010 - RNA, 64 nt, Human
uacucugaaaauacauuauguuuuuuuucuuuaaacaaaacacacaacauguaagcauguaaga

SEQ ID NO: 136011 - RNA, 64 nt, Human
gugaugcuucugagacucagaaugguuuacucuaacaaaacacugugcugucuaucccuuguac

SEQ ID NO: 136012 - RNA, 64 nt, Human
uaaccaguagcugaucuuaaggcuuuuuuaaaaaacaaaacaaaacaacaaaaaaaaaucuuua

SEQ ID NO: 136013 - RNA, 64 nt, Human
aguagcugaucuuaaggcuuuuuuaaaaaacaaaacaaaacaacaaaaaaaaaucuuuauaaga

SEQ ID NO: 136014 - RNA, 64 nt, Human
auaauuuguggaaagcccuuagcaguggccuggcacaaaacaaaugcucaguggauggaagcug

SEQ ID NO: 136015 - RNA, 64 nt, Human
gaguuuuguuguuaugacucuugugucuuuugucacaaaacaaugauauuugcuaaacgauaua

SEQ ID NO: 136016 - RNA, 64 nt, Human
ggaacauugaacuguuagaggagugcucuuccaaacaaaacaaaaaugucucuagguuuaguca

SEQ ID NO: 136017 - RNA, 64 nt, Human
cgugaacuuccuuugacuuauuguccccacuaaaacaaaacaaaaaacuuuuaaugccuuccac

SEQ ID NO: 136018 - RNA, 64 nt, Human
auugaaauauuuauuuuaaaaaugaauauuagaaacaaaacagccauaaacagaguuuaauagc

SEQ ID NO: 136019 - RNA, 64 nt, Human
caguuuggacuacagagugagacuccaucucaaaacaaaacaaaacaacaacagcaaaaaacaa

SEQ ID NO: 136020 - RNA, 64 nt, Human
uggacuacagagugagacuccaucucaaaacaaaacaaaacaacaacagcaaaaaacaacaaaa

SEQ ID NO: 136021 - RNA, 64 nt, Human
ucaaaacaaaacaaaacaacaacagcaaaaaacaacaaaacaaaacacaaauacucucacaggg

SEQ ID NO: 136022 - RNA, 64 nt, Human
acaaaacaaaacaacaacagcaaaaaacaacaaaacaaaacacaaauacucucacagggcaugg

SEQ ID NO: 136023 - RNA, 64 nt, Human
uauugcaguucuguagugucauuucuuauaaaaaacaaaacaacaacaauaauuuaucaaaauu

SEQ ID NO: 136024 - RNA, 64 nt, Human
aauuuagagcuuucaaacuggaaaaaaaaaugaaacaaaacaaauacaccaagaccaaaauagg

SEQ ID NO: 136025 - RNA, 64 nt, Human
ccagggagcuguagugauuggaacccacguuugcacaaaacauuuuugcagaaggaaagucaac

SEQ ID NO: 136026 - RNA, 64 nt, Human
uuauaguaucuaacaaaaaguggcauaaaauauuacaaaacauccaacacuagaaagcaaugac

SEQ ID NO: 136027 - RNA, 64 nt, Human
uaauucugcuuuuagagccuuguuauuuuauuucacaaaacaggcauaugucuaggaguguaau

SEQ ID NO: 136028 - RNA, 58 nt, Human
ucaaacugucuaaacugugaacaaggugacaaaacauaauagauugggaggugguuug

SEQ ID NO: 136029 - RNA, 64 nt, Human
ccgaccuucagcuuugugggacuaucaggaaaaaacaaaacaaaaacaaaauguagaaaaagca

SEQ ID NO: 136030 - RNA, 64 nt, Human
gcuacuacugacuguauugccacuagagaauucuacaaaacaagcaaaaacacauccugagaca

SEQ ID NO: 136031 - RNA, 64 nt, Human
uagaaacaauugaccucucaggugagaaagucacacaaaacaagcuacuguuaaaagacugaau

SEQ ID NO: 136032 - RNA, 64 nt, Human
aacuuauccuuggaaauauucaauuuugguuauuacaaaacagaaaagaacaacagcaacaaaa

SEQ ID NO: 136033 - RNA, 64 nt, Human
ucauugcaggaacggggcuguguucucugcugggacaaaacaggagcucaucucuuugggguca

SEQ ID NO: 136034 - RNA, 64 nt, Human
acugcuguacugcaauauuuggauugucauucuuacaaaacauuuuuuuguucucuuguaaaaa

SEQ ID NO: 136035 - RNA, 64 nt, Human
cuuuuaaaaacguguaugugccuuuugaagauacacaaaacacugaggauuuuaguuuugaaau

SEQ ID NO: 136036 - RNA, 64 nt, Human
gagagcugccaucgcugugaugcugggaguucuaacaaaacaaguuggaugcggccauucaagg

SEQ ID NO: 136037 - RNA, 64 nt, Human
gaugacuuaguacaaaguuucaauuuguuuccccacaaaacaaagcaauucuuucaagucaguu

SEQ ID NO: 136038 - RNA, 64 nt, Human
uaaggucugaauaauagcagaaaaaccaacaucuacaaaacauuaaacuaguguuauacuugau

SEQ ID NO: 136039 - RNA, 64 nt, Human
uuuuucaccuucaguugucucugauguagcuuauacaaaacauuuguuguucuguuaacugaau

SEQ ID NO: 136040 - RNA, 64 nt, Human
aagagaguuaaugguuaacagacauuggccaauaacaaaacaccccauggacugugacucgagu

SEQ ID NO: 136041 - RNA, 64 nt, Human
aauucuuuuggcuuugaaacuugcaacuuugagaacaaaacaguccuuuaaauuuugcacugcu

SEQ ID NO: 136042 - RNA, 64 nt, Human
uagcgacacaaaguuaaacaaacaaacaaaaaacacaaaacauaauaaaacaccaagaacauga

SEQ ID NO: 136043 - RNA, 64 nt, Human
auaacgaugauucuuuugcuuuccaugcauuugcacaaaacaaccagaauuaaagauuccacaa

SEQ ID NO: 136044 - RNA, 64 nt, Human
aaaaugcauguuugaggaauugucugaaauugggacaaaacaccuucauguaaaccagcuuugc

SEQ ID NO: 136045 - RNA, 64 nt, Human
uacuacagcaucaaggcacaacacaaaaaccaacacaaaacauaacacaaaaaagaagcuaccu

SEQ ID NO: 136046 - RNA, 64 nt, Human
ccaaauuuuuaaauuggugguuaccaaagaguucacaaaacagguuuguauguagcaccuuuca

SEQ ID NO: 136047 - RNA, 64 nt, Human
aauaggcugcaucuuuuuaacaacucauuaaaaaacaaaacaacucuggcuuuugagaugacuu

SEQ ID NO: 136048 - RNA, 64 nt, Human
cugcagaauauuguaauuuguugcacacuauguaacaaaacaacugaagauauguuuaauaaau

SEQ ID NO: 136049 - RNA, 64 nt, Human
aaauuauucagauuuuauuuuuguaucugugguaacaaaacauuaaccaaaagauuuucugucc

SEQ ID NO: 136050 - RNA, 64 nt, Human
guauaggaggugagcuaguuaacaaacuuguaccacaaaacaauaucgcuuuaacuuuucuaaa

SEQ ID NO: 136051 - RNA, 64 nt, Human
agguuggcuuuaauuuaauauacuugauucagaaacaaaacaauagaguacaaaagugccaagc

SEQ ID NO: 136052 - RNA, 64 nt, Human
gaggagggggagaaggguuagacaagccuggaggacaaaacagcgggagugugggggugccaug

SEQ ID NO: 136053 - RNA, 64 nt, Human
gauggaauaaggagggggaacacaacuagcaagaacaaaacauuggguuggcaauugauaucac

SEQ ID NO: 136054 - RNA, 64 nt, Human
guaaaggaagcaaggccuguauugcagucuucauacaaaacaaaaggaauaagaacagaaaaga

SEQ ID NO: 136055 - RNA, 64 nt, Human
uaaaaaguccacagaggagaauuugcugguuagcacaaaacauacugcaaaauugcuucuuucu

SEQ ID NO: 136056 - RNA, 64 nt, Human
ccaaacagucaugccaacugugaaggaaugucccacaaaacauuuccauucccugaggaaaaac

SEQ ID NO: 136057 - RNA, 64 nt, Human
guuucuaaguugcacacaguuuauuaacaacugaacaaaacauuuuuaucauuuaaaaaucuau

SEQ ID NO: 136058 - RNA, 64 nt, Human
ucuauaucauuaggaaaacaucuuaguugaugcuacaaaacaccuugucaaccucuuccugucu

SEQ ID NO: 136059 - RNA, 64 nt, Human
auugaucuuaagguauuuacauguauguggaaaaacaaaacacuuaacuagaauucucuaauaa

SEQ ID NO: 136060 - RNA, 64 nt, Human
uguuaaaucaacuaaauuauuucagcaauaggagacaaaacaaccagcuuucauaauuuuuaau

SEQ ID NO: 136061 - RNA, 64 nt, Human
guauauggaccccugagaaugagcaauugagaaaacaaaacaaaaggaacaauccaugaacuua

SEQ ID NO: 136062 - RNA, 64 nt, Human
gucuuacuauggacaccaggucaggugcaaccacacaaaacaaagccaguuccaugagcugccu

SEQ ID NO: 136063 - RNA, 64 nt, Human
cauuucaauaaaaaaaagagaaacuguccuuaaaacaaaacaaaaaccaaaaaagucacccuau

SEQ ID NO: 136064 - RNA, 64 nt, Human
guuucuuaucgguguuauaauaaaaugacauuaaacaaaacauuauuuaaggaccuacuguaua

SEQ ID NO: 136065 - RNA, 64 nt, Human
aggcacagaaaacaaauaucaaagaucuaauaauacaaaacaaacuugauuaaaacuggugcuu

SEQ ID NO: 136066 - RNA, 64 nt, Human
uccagcuacgcuaagcgcccugcccaggcacguaacaaaacauagaccuguuuugaaguggcuu

SEQ ID NO: 136067 - RNA, 64 nt, Human
cuuauauuguuuucaggugcucaaaaugcaaaacacaaaacaaauccugcauuuagauacaccu

SEQ ID NO: 136068 - RNA, 64 nt, Human
gaggcagaauccaagaucugccaggaaacacacaacaaaacaucugcuguccugggugggaggg

SEQ ID NO: 136069 - RNA, 64 nt, Human
guuuucuccuucccaaggcagcuggauugaaaaaacaaaacaaaacaaaaaaacccaggggcgu

SEQ ID NO: 136070 - RNA, 64 nt, Human
cuccuucccaaggcagcuggauugaaaaaacaaaacaaaacaaaaaaacccaggggcgucaguc

SEQ ID NO: 136071 - RNA, 64 nt, Human
cccaagaggaaguuuucugaaauaagauuuaaaaacaaaacaaaaaaaacacuuaauauuucag

SEQ ID NO: 136072 - RNA, 64 nt, Human
acgggagacuuuguacaguggccucucuaaaaguacaaaacauucauaagagaaaccugcauac

SEQ ID NO: 136073 - RNA, 64 nt, Human
aaauuuccagaagaggaaaaaaaaacuacaaaaaacaaaacauugaagguugauauuuuaugug

SEQ ID NO: 136074 - RNA, 64 nt, Human
uuaaagccccauacacagaaguauacgaaagcacacaaaacacuccaaguuucagcaguuuuag

SEQ ID NO: 136075 - RNA, 64 nt, Human
uaaagauuggaguauuuuauaauucaaggagcauacaaaacaaugguugggaacauaugccaau

SEQ ID NO: 136076 - RNA, 64 nt, Human
agaaucaaguaucugagacuguggaguaauagccacaaaacagagggcccacugcacagcauau

SEQ ID NO: 136077 - RNA, 64 nt, Human
cagcuuuaaauacugaggaaaauguggccuguuuacaaaacauucagcacguugaagaaagugu

SEQ ID NO: 136078 - RNA, 64 nt, Human
cuguuuuacuagcuuuuacaucuuuuuauuuaaaacaaaacaacacaaaaaaacaaugugcccc

SEQ ID NO: 136079 - RNA, 64 nt, Human
acaggugccucgcaagagagcaagcacguucauaacaaaacagcaacacaaagacauguuaagc

SEQ ID NO: 136080 - RNA, 64 nt, Human
guugcgugauuagugauguuggaagcauuuuagcacaaaacagccuugugucuuagaugauauc

SEQ ID NO: 136081 - RNA, 64 nt, Human
agcuuuugaguaggaaaggacuuugauuuguggcacaaaacauuauuaauauagcuauugacag

SEQ ID NO: 136082 - RNA, 64 nt, Human
cuaguuucauauauuaccuaguuauucuuucaaaacaaaacaaaaaaaaaacaaaaacugacgc

SEQ ID NO: 136083 - RNA, 64 nt, Human
cuugagaauguacuuugugagauccacccugcccacaaaacauugcucuuaacuucaccgccua

SEQ ID NO: 136084 - RNA, 64 nt, Human
aggccuucaacacaauuccccucuccucuuccaaacaaaacauacauugaucucucacauccag

SEQ ID NO: 136085 - RNA, 64 nt, Human
aaaagccaagaagaggaaacaagauaauaaauguacaaaacaugaaaauuaaaaugaacaauau

SEQ ID NO: 136086 - RNA, 64 nt, Human
aaauauaaaaaggugauguucaacagaagugaagacaaaacaauaugcaucaggagaacaagag

SEQ ID NO: 136087 - RNA, 64 nt, Human
guuugauguggaaguguuuauccacauacaaaguacaaaacaagccaugaacaagcuucuuucc

SEQ ID NO: 136088 - RNA, 64 nt, Human
uaaaggaauauguguagcuggguucccaggccggacaaaacagauggugaccagauuuggcccc

SEQ ID NO: 136089 - RNA, 58 nt, Human
uuaacgaaugguacguuuaaaaucagaaacaaaacaucgaacaaaacccuauuuaaga

SEQ ID NO: 136090 - RNA, 64 nt, Human
ucuauauucucagaaauaucuagcaugguauauaacaaaacacuaaacucaucaguucauccgg

SEQ ID NO: 136091 - RNA, 64 nt, Human
cagugcaagugaguauaacucuaacugauguuccacaaaacauuuuugauuucagguuuguaug

SEQ ID NO: 136092 - RNA, 64 nt, Human
aacuuugaagauuguuuguaucuuuuuuuaaaaaacaaaacaaaacaaaaauccccaaaauaua

SEQ ID NO: 136093 - RNA, 64 nt, Human
ugaagauuguuuguaucuuuuuuuaaaaaacaaaacaaaacaaaaauccccaaaauauauagaa

SEQ ID NO: 136094 - RNA, 64 nt, Human
gauuacccaaagaaauagaucaguuggagaaaauacaaaacaauucaaagcucuuaagguauuu

SEQ ID NO: 136095 - RNA, 64 nt, Human
auuaaaacucuugguggucacauauuguauauaaacaaaacaauaugcuuuguugaaggaaaau

SEQ ID NO: 136096 - RNA, 64 nt, Human
uaccaucagaaagaauaaaauaggaaucaacuuaacaaaacaagugcaagacugaaaacuacaa

SEQ ID NO: 136097 - RNA, 64 nt, Human
aagaaguuggauggguggguacuauucugauuacacaaaacaaaugccacacaucacccuuacc

SEQ ID NO: 136098 - RNA, 64 nt, Human
uucuuacaggcacaaaaugauggacccaaugcacacaaaacaacccuagaguguuguugagaau

SEQ ID NO: 136099 - RNA, 64 nt, Human
aacuguuuuaaaugaaaguuuuaguaaaaaaaauacaaaacaaaaagauuaaauugcuauugcu

SEQ ID NO: 136100 - RNA, 64 nt, Human
uacacaaagaccaucgagacggccauucuuguuuacaaaacacuuaccaagaaagcacuuugua

SEQ ID NO: 136101 - RNA, 64 nt, Human
guuuaagcucaaguuugcugugcucucugcagcuacaaaacaucuuggcauauuuaagaguggc

SEQ ID NO: 136102 - RNA, 64 nt, Human
auauauauuuuaaguuuaaaaaacagaaaaacagacaaaacaauccccaucagguagcugucua

SEQ ID NO: 136103 - RNA, 64 nt, Human
caauuuugccaauaccaaguuucaauuuguuuuuacaaaacauuauucaagccacuagaauuau

SEQ ID NO: 136104 - RNA, 64 nt, Human
ugcaagauaaaaggucuugggaaaacaaaacaaaacaaaacaaaccucccuuccccagcagggc

SEQ ID NO: 136105 - RNA, 64 nt, Human
ucuggugcaagauaaaaggucuugggaaaacaaaacaaaacaaaacaaaccucccuuccccagc

SEQ ID NO: 136106 - RNA, 64 nt, Human
aauucucuggugcaagauaaaaggucuugggaaaacaaaacaaaacaaaacaaaccucccuucc

SEQ ID NO: 136107 - RNA, 64 nt, Human
caguuguaaaaaauauccaucagaaaaaugacacacaaaacaaaauaucuggaccuuuacagaa

SEQ ID NO: 136108 - RNA, 64 nt, Human
aaccgaacucaaggcuuaauuaacggggcacuaaacaaaacaaccaauaaagucaccagcagua

SEQ ID NO: 136109 - RNA, 64 nt, Human
agccacuucauauaaagguuacuccagaccauguacaaaacacagccacucuugaaaucacaag

SEQ ID NO: 136110 - RNA, 64 nt, Human
aagaggagacaauuugaaugaauccucaugaucuacaaaacaaaaucauagugacuaggacucc

SEQ ID NO: 136111 - RNA, 64 nt, Human
uuccuugauuuaaaauauuuguuauuuuaaauauacaaaacauuuuagaaaaucuuagaguaaa

SEQ ID NO: 136112 - RNA, 64 nt, Human
uaauguccugcuuucacauugaagggcagagccuacaaaacauuguauauuucaaaagacaaaa

SEQ ID NO: 136113 - RNA, 64 nt, Human
uucuagaaguuaaacaagagcuaagacaaacaaaacaaaacacagcuuaucuaaucuaaugaga

SEQ ID NO: 136114 - RNA, 64 nt, Human
uaguuuucuagaaguuaaacaagagcuaagacaaacaaaacaaaacacagcuuaucuaaucuaa

SEQ ID NO: 136115 - RNA, 64 nt, Human
uaaguaguaucuuucucucuuucuuaugaacaaaacaaaacaacaacaaaaaacaaacaaacaa

SEQ ID NO: 136116 - RNA, 64 nt, Human
acggauaaguaguaucuuucucucuuucuuaugaacaaaacaaaacaacaacaaaaaacaaaca

SEQ ID NO: 136117 - RNA, 64 nt, Human
aaaaaagaaaacuuuaaaaaaacucccauuaaaaacaaaacaucuuuguguuuugaacaaagga

SEQ ID NO: 136118 - RNA, 64 nt, Human
cugggcugggagagaagacggggaagugugugagacaaaacaaagccggcuuguuuccuccccu

SEQ ID NO: 136119 - RNA, 64 nt, Human
cacugucaccaagcuggauggcaagcugcggcccacaaaacagccagucagguuggcuuuccug

SEQ ID NO: 136120 - RNA, 64 nt, Human
agagucaaauaguccucugaauggagcccccaucacaaaacagugcccaggaggcuggcuccuc

SEQ ID NO: 136121 - RNA, 64 nt, Human
aagaauuacacaacguuuuccucaagaaaaugguacaaaacacaaccgaggagcguauacaguu

SEQ ID NO: 136122 - RNA, 64 nt, Human
uguuacugaguuauaagcucacuaggcuguaaaaacaaaacaauguagaguuuuauuuauugaa

SEQ ID NO: 136123 - RNA, 64 nt, Human
gauugauuucagcauucguugcuuugcuauuuuuacaaaacagcauugauugaagcaagucuug

SEQ ID NO: 136124 - RNA, 64 nt, Human
gcuaacacagugaaaccccaucucuacuaaaaauacaaaacauuagccgggcgugguggugggu

SEQ ID NO: 136125 - RNA, 64 nt, Human
aacaguuggcauaagaauuaaacauaugaacaucacaaaacaauuuauaaaaacuucuuaaaua

SEQ ID NO: 136126 - RNA, 64 nt, Human
aacaguggguacaccccuaacagagccagugccaacaaaacauuuugaauggacuuagggccca

SEQ ID NO: 136127 - RNA, 64 nt, Human
gaauuuuggguauuguaaucugaaguaugguauuacaaaacaaacaaacaaacaaaaaacccau

SEQ ID NO: 136128 - RNA, 64 nt, Human
guguagagacauccaaauuuaaagaaaaaaaaacacaaaacagaauguuaaaaaauguaugcag

SEQ ID NO: 136129 - RNA, 64 nt, Human
cauggaaaauaaguuuagugcacauagcuaaaucacaaaacauccaauuucucuguuuccucag

SEQ ID NO: 136130 - RNA, 64 nt, Human
uucuuccauuggaaaauuuaagacaaguucaacaacaaaacauuugcucuggggggcagggaaa

SEQ ID NO: 136131 - RNA, 64 nt, Human
aaggauauuuggcacacucaugcgucauucauucacaaaacacaaacccaggacuuucugccua

SEQ ID NO: 136132 - RNA, 64 nt, Human
uaaguuugauuccuaacacuggaguuggccuuaaacaaaacaaacacaaaaacuuuuaaagaau

SEQ ID NO: 136133 - RNA, 64 nt, Human
cuuuacugguaaaauuuaaaacaaaaaaggcaaaacaaaacaaacucauuuuccccuuaguucc

SEQ ID NO: 136134 - RNA, 64 nt, Human
aguuuuauuacugcaccauguuuacuucaaaaagacaaaacaaaaaaaaaauuauuuuuccagu

SEQ ID NO: 136135 - RNA, 64 nt, Human
cuggauauuauucuuguaguuuaccucuuuaaaaacaaaacaaaacaaaacaaaaaacuccccu

SEQ ID NO: 136136 - RNA, 64 nt, Human
uauuauucuuguaguuuaccucuuuaaaaacaaaacaaaacaaaacaaaaaacuccccuuccuc

SEQ ID NO: 136137 - RNA, 64 nt, Human
uucuuguaguuuaccucuuuaaaaacaaaacaaaacaaaacaaaaaacuccccuuccucacugc

SEQ ID NO: 136138 - RNA, 64 nt, Human
ugucuguuggauaauggcuguaaaauguuuaaaaacaaaacaaaacaaaaaagaggcacuaguc

SEQ ID NO: 136139 - RNA, 64 nt, Human
guuggauaauggcuguaaaauguuuaaaaacaaaacaaaacaaaaaagaggcacuagucuaucu

SEQ ID NO: 136140 - RNA, 64 nt, Human
uaaugagaaugccacaaacuugaauaccuuaugcacaaaacacaaacauuguuaugcauaaugu

SEQ ID NO: 136141 - RNA, 64 nt, Human
acagagucagacuccgucccaaaaaaacaaacaaacaaaacaaaacaaaaaaaaacagaaguua

SEQ ID NO: 136142 - RNA, 64 nt, Human
gucagacuccgucccaaaaaaacaaacaaacaaaacaaaacaaaaaaaaacagaaguuacaaau

SEQ ID NO: 136143 - RNA, 64 nt, Human
uuauuaacaaacaucacucugcugcuuagacauaacaaaacacucggcauuucaaaugugcugu

SEQ ID NO: 136144 - RNA, 64 nt, Human
ccagccuggaugacagagugagaccuugucucaaacaaaacaaaacaaaaaugaaauguucuag

SEQ ID NO: 136145 - RNA, 64 nt, Human
cuggaugacagagugagaccuugucucaaacaaaacaaaacaaaaaugaaauguucuaguuuug

SEQ ID NO: 136146 - RNA, 64 nt, Human
agaagccuaagaaguuauauauuuaaucagguagacaaaacaguucaaagcauaagguccaugg

SEQ ID NO: 136147 - RNA, 64 nt, Human
aguacucuuuuaggcacuggaaauacagugauggacaaaacagguaaaaaaucgcugcccccuc

SEQ ID NO: 136148 - RNA, 64 nt, Human
auuuucauggauuucauuuguugguacauauuacacaaaacauugugccuuaaaaugagucaua

SEQ ID NO: 136149 - RNA, 64 nt, Human
uuguuaucccuugaaagcgagggugacaaaaacaacaaaacaccguuauaaacacaucaaaggu

SEQ ID NO: 136150 - RNA, 64 nt, Human
aagggaaagguuaaugggcuacuuaauauuaugaacaaaacaaaaaaacaaggcugccacagug

SEQ ID NO: 136151 - RNA, 64 nt, Human
ccugcuugucuuauuuuuagaauaauuuagaaaaacaaaacaaaggcuguuuuuccuaauuuug

SEQ ID NO: 136152 - RNA, 64 nt, Human
auuuuuaaaucuguaaaugucuauaugagcagaaacaaaacauuguguaacauguuuuaagcau

SEQ ID NO: 136153 - RNA, 64 nt, Human
uucuccuacuuuacacucucuguacaaaaacaaaacaaaacaacaacaauacaacaagaacaac

SEQ ID NO: 136154 - RNA, 64 nt, Human
ggaauuucuccuacuuuacacucucuguacaaaaacaaaacaaaacaacaacaauacaacaaga

SEQ ID NO: 136155 - RNA, 64 nt, Human
auuauguggugaaauuuuguaaauaaaugauuauacaaaacagucaccaccuagaacuggguau

SEQ ID NO: 136156 - RNA, 64 nt, Human
ugaugaaaaacuaaauucgaggaauuaaaaucgaacaaaacauagccuuucuuuuccgaugguu

SEQ ID NO: 136157 - RNA, 64 nt, Human
caaccccacuccuacccccuuccucaacccccaaacaaaacaaacaaacuucccuggcuucgca

SEQ ID NO: 136158 - RNA, 64 nt, Human
uaaguaguagaugaauuuucagcuaugcaauaugacaaaacauggggaauuuugaagauuguca

SEQ ID NO: 136159 - RNA, 64 nt, Human
aauuauauuccaggucaaaauuugugaaaaauacacaaaacacuuugauuuuacaagagaggag

SEQ ID NO: 136160 - RNA, 64 nt, Human
uuaauuuaaacuuaccuaagaagaugagaaucaaacaaaacagauaugcuuacucuaguuaaaa

SEQ ID NO: 136161 - RNA, 64 nt, Human
uugaagugaaauguuuuacuuuucacuggagaagacaaaacagggugaucuucauguuauuguu

SEQ ID NO: 136162 - RNA, 64 nt, Human
aagaauguuucaguuauagagguaaaauuugcacacaaaacaucuuaggcacuuuuuaacauuc

SEQ ID NO: 136163 - RNA, 64 nt, Human
gagcuuccuuauguuucacacauuguauuugaacacaaaacauuaacaacuccacucauaguau

SEQ ID NO: 136164 - RNA, 64 nt, Human
aggguuuuaaauggaggauuuccuuuuuccugugacaaaacaucuuuucacaacuuaccuuguu

SEQ ID NO: 136165 - RNA, 64 nt, Human
acguugugauacaagagauuccuuucuucuugugacaaaacaucuuucaaaacuuaccuuguca

SEQ ID NO: 136166 - RNA, 64 nt, Human
aauaggauucugugauaauauuuaaauggcaaaaacaaaacauaauuuugugcaauuaacaaag

SEQ ID NO: 136167 - RNA, 64 nt, Human
gggaccagagagagcuuggaauguuaaaaacaaaacaaaacaaaaaaaaacaaggagaaguugu

SEQ ID NO: 136168 - RNA, 64 nt, Human
gauaggggaccagagagagcuuggaauguuaaaaacaaaacaaaacaaaaaaaaacaaggagaa

SEQ ID NO: 136169 - RNA, 64 nt, Human
ugaggauaggaguuauauauucuuauaagacaaaacaaaacaggacaauguuacaagaguaaga

SEQ ID NO: 136170 - RNA, 64 nt, Human
cucugugaggauaggaguuauauauucuuauaagacaaaacaaaacaggacaauguuacaagag

SEQ ID NO: 136171 - RNA, 64 nt, Human
auuuacaaauuaaaucuucuggagggucgcuaucacaaaacauugacgauguauguauuauaau

SEQ ID NO: 136172 - RNA, 64 nt, Human
gcaacaacacgaagaugauaccaaaacaaggaccacaaaacaacuagccaugaugggagacagg

SEQ ID NO: 136173 - RNA, 64 nt, Human
aacuuaacucaguucuaaauacuuugucuggagcacaaaacaauaaaagguuaucuuauagucg

SEQ ID NO: 136174 - RNA, 64 nt, Human
gaauagaaacacauuuucuggcuagcagaaaaaaacaaaacaaaacuguuguuucucuuucuug

SEQ ID NO: 136175 - RNA, 64 nt, Human
cacaaggaaucacacguggugcagcuaaaacaaaacaaaacaugagcaaacacaaaacccaagg

SEQ ID NO: 136176 - RNA, 64 nt, Human
aauggcacaaggaaucacacguggugcagcuaaaacaaaacaaaacaugagcaaacacaaaacc

SEQ ID NO: 136177 - RNA, 64 nt, Human
agaacuuaaucgcacuguuucuaauucuuuuuacacaaaacaagggcuuagaguauacuguauu

SEQ ID NO: 136178 - RNA, 64 nt, Human
cuaacuugggcaacacagggcgacccccaucucuacaaaacauaaaagauuuuuaaaaaauuag

SEQ ID NO: 136179 - RNA, 64 nt, Human
cccagugucuaauucccuguuauaauuugcacaaacaaaacaaaauguuaugauaaucuuucuc

SEQ ID NO: 136180 - RNA, 64 nt, Human
ccuuuuauuuauuccuuauuucucuuucaucaaaacaaaacagcagcugugggaggagaaauga

SEQ ID NO: 136181 - RNA, 64 nt, Human
uuuuaaugaauauugauguuaacaagaggggaaaacaaaacacagguuuuuucaauuuaugcug

SEQ ID NO: 136182 - RNA, 64 nt, Human
acaguguaauaauuuacacuauuuugugcuccaaacaaaacaaaaaucuguguaacuguaaaac

SEQ ID NO: 136183 - RNA, 64 nt, Human
guucauauguguuguuguaacuuuagauuacuaaacaaaacaaacuguuuuuuuguuugaaggu

SEQ ID NO: 136184 - RNA, 64 nt, Human
ucuuguauaaguuaaggcagccauaaaugaaaauacaaaacaaacguuugcuuuuguauuugau

SEQ ID NO: 136185 - RNA, 64 nt, Human
gaaaugcuaacagauuuuucuggaggaaauuuagacaaaacaaugucauuuaguagaauauuuc

SEQ ID NO: 136186 - RNA, 64 nt, Human
gccugggcgacagagcgagacucugccucaaaaaacaaaacaaaacaaaacacucacccaucaa

SEQ ID NO: 136187 - RNA, 64 nt, Human
ggcgacagagcgagacucugccucaaaaaacaaaacaaaacaaaacacucacccaucaacgaau

SEQ ID NO: 136188 - RNA, 64 nt, Human
cagagcgagacucugccucaaaaaacaaaacaaaacaaaacacucacccaucaacgaauauaga

SEQ ID NO: 136189 - RNA, 64 nt, Human
aagaaccuguuugaugcaaaaaagaaaaugaaaaacaaaacaaaaaauccccaaaaccuuauua

SEQ ID NO: 136190 - RNA, 64 nt, Human
agacucuuuuaaugcuaauggcuaguacguuuaaacaaaacagcaguucucugcugcaauauuc

SEQ ID NO: 136191 - RNA, 64 nt, Human
uaaaaggaauagaauuuuuuuuugauaaaggaucacaaaacaauucuaaaaccuaacuguuuuu

SEQ ID NO: 136192 - RNA, 64 nt, Human
ggguccuacuguuguuauuaaaaacagaacaaaaacaaaacacacacacacacaaaaacagaaa

SEQ ID NO: 136193 - RNA, 64 nt, Human
cauaucaguuagacugcaauacuuuaaacacgagacaaaacaauccauauguuuagggaaccag

SEQ ID NO: 136194 - RNA, 64 nt, Human
ucacaaguccugugaggcaaaaaaacaaaacaaaacaaaacaaccaaacaaauacaaucuaacu

SEQ ID NO: 136195 - RNA, 64 nt, Human
cuauuucacaaguccugugaggcaaaaaaacaaaacaaaacaaaacaaccaaacaaauacaauc

SEQ ID NO: 136196 - RNA, 64 nt, Human
uaagacuauuucacaaguccugugaggcaaaaaaacaaaacaaaacaaaacaaccaaacaaaua

SEQ ID NO: 136197 - RNA, 52 nt, Human
aggagucucugggccagugaauacaaaacaucaugucgagaaucauuggaag

SEQ ID NO: 136198 - RNA, 64 nt, Human
caagcauuucuagcagugaugaaaaugaaucuucacaaaacacuucgagcacuguccaguauuc

SEQ ID NO: 136199 - RNA, 64 nt, Human
aaaauguguaaggcuugcuaaaaaacaaaacaaaacaaaacacaguccugcauacucaccacca

SEQ ID NO: 136200 - RNA, 64 nt, Human
aaaagaaaauguguaaggcuugcuaaaaaacaaaacaaaacaaaacacaguccugcauacucac

SEQ ID NO: 136201 - RNA, 64 nt, Human
cauacaaaagaaaauguguaaggcuugcuaaaaaacaaaacaaaacaaaacacaguccugcaua

SEQ ID NO: 136202 - RNA, 64 nt, Human
aaaacucuuuggugcacaaguaacacauuuggccacaaaacaccaaagaauuguaggcaguggc

SEQ ID NO: 136203 - RNA, 64 nt, Human
agcgaagggauuuauacaacauuuuuaucauguuacaaaacaguaucaugaauggccuccuuuu

SEQ ID NO: 136204 - RNA, 64 nt, Human
gaaucugccuugacuguauauuucauacugcccaacaaaacaauaaaaaacaauuuuaaaugca

SEQ ID NO: 136205 - RNA, 64 nt, Human
gaaggaugaacuuguuagauagucagaguuggaaacaaaacaauccaagaauagggauauaagc

SEQ ID NO: 136206 - RNA, 64 nt, Human
gcuugaccugguuaaauacugucuuaaagcucauacaaaacaaauaggcuuuuccauaaguggc

SEQ ID NO: 136207 - RNA, 64 nt, Human
ucuuaaaacuuguuuguggucagcacaacaaggaacaaaacaaagcuuugaaaaaacuuuaaca

SEQ ID NO: 136208 - RNA, 64 nt, Human
auaaaagcuguggaucaucuccuaggaaaauagaacaaaacauacauauucacauuacacaguu

SEQ ID NO: 136209 - RNA, 64 nt, Human
agaagccucggguaacacugaaaaacaaaacaaaacaaaacaaaaacaggaaaaaaacaaaaaa

SEQ ID NO: 136210 - RNA, 64 nt, Human
uucagagaagccucggguaacacugaaaaacaaaacaaaacaaaacaaaaacaggaaaaaaaca

SEQ ID NO: 136211 - RNA, 64 nt, Human
agcucuucagagaagccucggguaacacugaaaaacaaaacaaaacaaaacaaaaacaggaaaa

SEQ ID NO: 136212 - RNA, 64 nt, Human
aaucucauuuuguacuugguuguggugccacuaaacaaaacaaaugaugggagaguaaguaggc

SEQ ID NO: 136213 - RNA, 64 nt, Human
cagauuaaucauagaaaauguugcuuccacauuaacaaaacaaucacugaaaaacagcagaugu

SEQ ID NO: 136214 - RNA, 64 nt, Human
aaguaugggucucaucauucccauacacagaaacacaaaacacuuugaucauaaacuuuuuucu

SEQ ID NO: 136215 - RNA, 64 nt, Human
cagauccguguggacauuuuuaauuuuuguaaaaacaaaacaguaauauauugaucuuuuuuca

SEQ ID NO: 136216 - RNA, 64 nt, Human
ccugggugacagagcgagacucugucucaaaaaaacaaaacaaaaaaacaccaaaaaaaccccc

SEQ ID NO: 136217 - RNA, 64 nt, Human
acuuuuuuuguuuuugcuucuggaacuuugaaacacaaaacacaaguuggcacuuacaauuuua

SEQ ID NO: 136218 - RNA, 64 nt, Human
auggguguuguauuuuuccaaaaugacuucuuaaacaaaacaaauauuauaaugaauugucugg

SEQ ID NO: 136219 - RNA, 64 nt, Human
guuguagaaaguuauauacaaauuauauauauguacaaaacaauacuaugcauucucuauggcu

SEQ ID NO: 136220 - RNA, 64 nt, Human
cgagauuuugauucccaaaguuuggaaaaaaaugacaaaacaacgagggaagaaggaaccagac

SEQ ID NO: 136221 - RNA, 64 nt, Human
agaaagcugcaauuauccgccaacugcauuuaaaacaaaacaaaacagaaaaaucaaaauaaca

SEQ ID NO: 136222 - RNA, 64 nt, Human
gcugcaauuauccgccaacugcauuuaaaacaaaacaaaacagaaaaaucaaaauaacauugac

SEQ ID NO: 136223 - RNA, 64 nt, Human
acuucaugagaacgaaccccuucagagaggcccuacaaaacagauuagagggaagacagagggg

SEQ ID NO: 136224 - RNA, 64 nt, Human
ggaugcagggacauuuacugaaggagggacauggacaaaacaacauugaauucccagccccauu

SEQ ID NO: 136225 - RNA, 64 nt, Human
aucaagcuuuuauuuuuuuaaaagucaaaacagaacaaaacaaaguaugcagagacagagcauu

SEQ ID NO: 136226 - RNA, 64 nt, Human
uaauuguuuuaaauuuuucauaggggaguuuuggacaaaacagucacuggggagaucacugcca

SEQ ID NO: 136227 - RNA, 64 nt, Human
uuugggacaugagccagaguuuaaaagggaaccaacaaaacacuauaacuuaaaaggauggggu

SEQ ID NO: 136228 - RNA, 64 nt, Human
gggcaacaagagcgaaaccccaucucgaaaaaaaacaaaacaaaacuagacaagugagugccua

SEQ ID NO: 136229 - RNA, 64 nt, Human
acuuuccaagacaauccugagcauaaacaggcccacaaaacaugugcugacugcacucuggcga

SEQ ID NO: 136230 - RNA, 64 nt, Human
acaaagcacugugcuuagaggguaaaaaggaaucacaaaacaagaaucuuuccaaaguugucuc

SEQ ID NO: 136231 - RNA, 64 nt, Human
guuguuguagagaaaacaugcagaacaaaugaagacaaaacauacauuuuguaccaaccaucca

SEQ ID NO: 136232 - RNA, 64 nt, Human
gagacccuaaaaccuuggugcagugguggggaccacaaaacaaccagggaggaagagauacauc

SEQ ID NO: 136233 - RNA, 64 nt, Human
ugaacauaagguauagcauuugguuuuuaagaaaacaaaacauuaagacgcaacucauuuuaua

SEQ ID NO: 136234 - RNA, 64 nt, Human
agaucaccacagaauccauuuuuuucccaguuccacaaaacacucuguuugccuucaguuuuua

SEQ ID NO: 136235 - RNA, 64 nt, Human
gugccccuuuaauuaaaaacacaugaaaugaauaacaaaacaagacccaaauagaguuuauuuu

SEQ ID NO: 136236 - RNA, 64 nt, Human
gggacuaaauuaaugcuugggugcauuaaaaagaacaaaacauucccacauguuggggucauug

SEQ ID NO: 136237 - RNA, 64 nt, Human
aacaucaccacuagcguaaaagcaaaaagcuuuuacaaaacacagccaaaaauucucaagaugc

SEQ ID NO: 136238 - RNA, 64 nt, Human
uguagcucuaggguauauauccgccuggcauuucacaaaacagccuuugggaaaugcugaauua

SEQ ID NO: 136239 - RNA, 64 nt, Human
cucccugcacccuucugacugacaguucauccccacaaaacacauugguuuugagaggugaugc

SEQ ID NO: 136240 - RNA, 64 nt, Human
agcuucaagcaugacuguuaauggcuccucugugacaaaacacaaguuggaccaaggagaaagc

SEQ ID NO: 136241 - RNA, 64 nt, Human
gagaaggaaacuaaggacuuggcuccaaaacaaaacaaaacaaaaucuggagaugcugaauuuu

SEQ ID NO: 136242 - RNA, 64 nt, Human
uuacugagaaggaaacuaaggacuuggcuccaaaacaaaacaaaacaaaaucuggagaugcuga

SEQ ID NO: 136243 - RNA, 64 nt, Human
cacuccaaccugggugacagacucugucuccaaaacaaaacaaacaaacaaaaagauuuuauua

SEQ ID NO: 136244 - RNA, 64 nt, Human
auuacaggaauucuggugauauuaaggugaaauaacaaaacacaaaaggcccuauuuuaacagu

SEQ ID NO: 136245 - RNA, 64 nt, Human
cucuaauaaggauaaugcugaauuuugaaaggacacaaaacaucuaaugccaauauauacauga

SEQ ID NO: 136246 - RNA, 64 nt, Human
gcauucucaaaacugugggucagugaguagaacuacaaaacaauagcaguagggcagaaacuug

SEQ ID NO: 136247 - RNA, 64 nt, Human
aguagcaccaguuaaggugaauauguauuguaucacaaaacaaacccaauauccagaugaauau

SEQ ID NO: 136248 - RNA, 64 nt, Human
gaacaaacucaaagaacagcuguggaaagaagucacaaaacacuggguaagaaguucagauauu

SEQ ID NO: 136249 - RNA, 64 nt, Human
acuguuggcgugacauugacacuaguauuauuuuacaaaacagacugaaaaagacauuagcaag

SEQ ID NO: 136250 - RNA, 64 nt, Human
ucaaauacaaacgauguuguguuccuucucucgaacaaaacagcaaagggaaugccagcuaacu

SEQ ID NO: 136251 - RNA, 64 nt, Human
uuaaaaucgaacuuuauuacauacugauucuggaacaaaacaguuagaaaaacuuuaaaaaaaa

SEQ ID NO: 136252 - RNA, 64 nt, Human
ugcacagaauaucaccauugcaguucaaaacaaaacaaaacaaaaagucuuuuguuugugaaca

SEQ ID NO: 136253 - RNA, 64 nt, Human
uuugcugcacagaauaucaccauugcaguucaaaacaaaacaaaacaaaaagucuuuuguuugu

SEQ ID NO: 136254 - RNA, 64 nt, Human
gggacugggacuccagaaccauuaauaaaacaaaacaaaacaaagcaaaauauugaugaucagg

SEQ ID NO: 136255 - RNA, 64 nt, Human
ggguagggacugggacuccagaaccauuaauaaaacaaaacaaaacaaagcaaaauauugauga

SEQ ID NO: 136256 - RNA, 64 nt, Human
uuaaguaugaaaggaguaauuaaaaacaagcaaaacaaaacaagacuuaguuuuuaaaugacca

SEQ ID NO: 136257 - RNA, 64 nt, Human
auuuguuuacucauguuaaaaaaaaaaaaaacagacaaaacacacugaaauuuccuaacuacau

SEQ ID NO: 136258 - RNA, 64 nt, Human
uucugccaugaggauuucucuuuaggccagaaguacaaaacaaaaaaaccaauggauuuuaacc

SEQ ID NO: 136259 - RNA, 64 nt, Human
acacugguugacaguauaauuuucccaaagggcaacaaaacauacagauagcaaauuuauauuc

SEQ ID NO: 136260 - RNA, 64 nt, Human
aaagcuuuuuaggaaauuuugacaguauuuuuguacaaaacauuuuuuugaaaaaauacuuguu

SEQ ID NO: 136261 - RNA, 64 nt, Human
uuccguuaggccaauaaaagaagggccucacaagacaaaacaggagccagaaguaaggacugaa

SEQ ID NO: 136262 - RNA, 64 nt, Human
uuaagagaaaucaucaguuaagaaaucuacuuuaacaaaacaaaaaggagaaaaaguaauaaug

SEQ ID NO: 136263 - RNA, 64 nt, Human
gguuuuccaugguuaaguuuggagaaaauaccacacaaaacaaugaauugccaaauuguuuguu

SEQ ID NO: 136264 - RNA, 64 nt, Human
uaauccauguggauuuuuuuuuucuuagagaaccacaaaacauaaaaggagcaagucggacuga

SEQ ID NO: 136265 - RNA, 64 nt, Human
gcacugguuaggcacagcgggaagguuaucgaagacaaaacacauuucuacccaaguuuaaaug

SEQ ID NO: 136266 - RNA, 64 nt, Human
uuuuauaguggucauaugaccugauacuggguaaacaaaacaaagauggacuuguucugggaaa

SEQ ID NO: 136267 - RNA, 64 nt, Human
uagcacuaauuuuuauuugugguauuuuucuauaacaaaacaaguagcucuaggaaaagagguu

SEQ ID NO: 136268 - RNA, 64 nt, Human
ccaaagcaacaagagcaaaaacuucgucucaaaaacaaaacaaaaaaagaguauucauugugag

SEQ ID NO: 136269 - RNA, 64 nt, Human
ccuacuuacaucuucaauguggauaagauaaagaacaaaacacaugcaucuaaacugcugggca

SEQ ID NO: 136270 - RNA, 64 nt, Human
ccuccaggcaggagccgggacugucacuuuggagacaaaacaguguuuguaacaauaacguacu

SEQ ID NO: 136271 - RNA, 64 nt, Human
gaaagcaagccaaggacuugcuccuaugucuguuacaaaacauaguuuauguagcuuuguaaca

SEQ ID NO: 136272 - RNA, 64 nt, Human
gaaaaaaucacuuuuaccuuccuaauuuaaaaagacaaaacagaaauguacguuccuucgcuag

SEQ ID NO: 136273 - RNA, 52 nt, Human
gccaauauucucuagaaugagcacaaaacaaaucgaauaacagcuaaacaaa

SEQ ID NO: 136274 - RNA, 64 nt, Human
aaaaaaaaagcgaaagacugcaguugugcuaaaaacaaaacaaaacaaacaaacaaacaaaaaa

SEQ ID NO: 136275 - RNA, 64 nt, Human
aaaagcgaaagacugcaguugugcuaaaaacaaaacaaaacaaacaaacaaacaaaaaaguaaa

SEQ ID NO: 136276 - RNA, 64 nt, Human
aggcaauacagucaaaguuucaaaauagcaucacacaaaacauguuuauaaaugaacaggaugu

SEQ ID NO: 136277 - RNA, 64 nt, Human
cuggcaguggccuugaggcuuuggaccauugguuacaaaacagacacagccaagauaagaucca

SEQ ID NO: 136278 - RNA, 64 nt, Human
uuuuuaaaaauagggcuguguuuaaaaaaaaaaaacaaaacaagaaaagcagcagugauuauag

SEQ ID NO: 136279 - RNA, 64 nt, Human
ugaugugaaacugacaauccuguggccacauggcacaaaacaccaaauauugguuaugaugaaa

SEQ ID NO: 136280 - RNA, 64 nt, Human
guagagucugauaggacauauucuuguaccacagacaaaacaaaucuuauguugcauuuacuau

SEQ ID NO: 136281 - RNA, 64 nt, Human
agugauaugaaaagguuaaguaugccaguaguuuacaaaacagaaaauacuuaacuaggaguag

SEQ ID NO: 136282 - RNA, 64 nt, Human
uaaugaguaauaauuggccacugccuuauuuauuacaaaacagaaaugucucaugacuuuuuua

SEQ ID NO: 136283 - RNA, 64 nt, Human
ugcgcgcuccacucggaaaaagcggugccccuauacaaaacaccagacccuggaacuggagaaa

SEQ ID NO: 136284 - RNA, 64 nt, Human
aaacaaacaacgugagauuuuuacucaaacagaaacaaaacaugaaggggcauccucaaaaucc

SEQ ID NO: 136285 - RNA, 64 nt, Human
aaaccuggugguguuuacaauguugcuaaucauuacaaaacauucuauauugaagcacugauaa

SEQ ID NO: 136286 - RNA, 64 nt, Human
auaugugcauuguaaaauaaaugccauauuucaaacaaaacacguaauuuuuuuacaguauguu

SEQ ID NO: 136287 - RNA, 64 nt, Human
guuucugaguuaaccagaaaaauagaaauuaaaaacaaaacaaaaaaaaaaacaaaaaaaaaca

SEQ ID NO: 136288 - RNA, 64 nt, Human
ucuuuuaagagauuuaagcuucaguuuucucaaaacaaaacaauuauccugucuuaucugaaga

SEQ ID NO: 136289 - RNA, 64 nt, Human
uucuuucccuuuuaugauggauuuugauaaaaguacaaaacaggguuuuucuuuuuuaucaccu

SEQ ID NO: 136290 - RNA, 64 nt, Human
cuaggcaacagagcaagacucugucucaaaaaaaacaaaacaaaaaggaggcacaaaaccccag

SEQ ID NO: 136291 - RNA, 64 nt, Human
cuuuugcuuauaacuacaauuuaauuucacguugacaaaacacagugaaaagacaacuuuguga

SEQ ID NO: 136292 - RNA, 64 nt, Human
uaagccacaaaggcauucgaagagaaugaaguguacaaaacaacucuuguaguuuacuguuuuu

SEQ ID NO: 136293 - RNA, 64 nt, Human
auggugggaguccagcucaugcauuucugauuauacaaaacaguuugcaguagguuauuuguca

SEQ ID NO: 136294 - RNA, 64 nt, Human
ucuauuuaaugugguuauggaaccagcuggaaacacaaaacaaacagugauuguacagcaggcu

SEQ ID NO: 136295 - RNA, 64 nt, Human
aagauauuuaggugacuuacagcaaccaauugcaacaaaacaaaauguuaagaaaugaucuuuu

SEQ ID NO: 136296 - RNA, 64 nt, Human
gaguauacaacaaugcauuuuaagagcaaaugcaacaaaacaaaucuggacuauggauaaauaa

SEQ ID NO: 136297 - RNA, 64 nt, Human
cacagauccaccugucucuugaaaauauaaaaagacaaaacagguuugccuuggcaucagagag

SEQ ID NO: 136298 - RNA, 64 nt, Human
cuuaccaaaucuucuccuaugcauuuuuaauaugacaaaacaaauuuuaaaagauuugaaauaa

SEQ ID NO: 136299 - RNA, 64 nt, Human
cccauauaacuaagacauaugcauuuaugggaagacaaaacaagaaugaaacacuuauacugac

SEQ ID NO: 136300 - RNA, 64 nt, Human
aaaaaagaauaagaaugaaaacugcugacguauuacaaaacagaaaaauaaaugauuuaaaauc

SEQ ID NO: 136301 - RNA, 64 nt, Human
ggacacuagaaugaaaaccaguguuaggguaaagacaaaacagacuauguacauaaucuguaua

SEQ ID NO: 136302 - RNA, 64 nt, Human
cuggaacuugcucucauuuuccugggugcaucaaacaaaacaaaaaccaaacacccagaggucu

SEQ ID NO: 136303 - RNA, 64 nt, Human
auaccuuuauagacaaauacgaacauguaugcacacaaaacauuuaacuaugguauuuauggaa

SEQ ID NO: 136304 - RNA, 64 nt, Human
cuaaaaagccauugaugagauguauagcugggggacaaaacauaaagccaucaagcacgugcuu

SEQ ID NO: 136305 - RNA, 64 nt, Human
guuucccaauugggaaacuaauuggggguggguuacaaaacauuugauccuuguaaauacauug

SEQ ID NO: 136306 - RNA, 64 nt, Human
agcugauacguuuaacucauuuccuugagcuuauacaaaacauagaaaagcaaacuguuaaagu

SEQ ID NO: 136307 - RNA, 64 nt, Human
gaaagucgugguucaggcaguaugggccgcugugacaaaacaccuaagacuggguaguuuauaa

SEQ ID NO: 136308 - RNA, 64 nt, Human
uucugugaagaaugaaguggaggaaguaacuuuuacaaaacauacccaguguuugggguguuuc

SEQ ID NO: 136309 - RNA, 64 nt, Human
acagagccaacucacucuuaugaaaugggcuuuaacaaaacaagaaagaaacguacuuaacugu

SEQ ID NO: 136310 - RNA, 64 nt, Human
ucuguaauaggaauugauucauucucuaaugaaaacaaaacauaaaaacaucacacuaaucuug

SEQ ID NO: 136311 - RNA, 64 nt, Human
cccuaaguuugaguugauaguuauuaaaaagaaaacaaaacaaaaaaaaaaggcaaggcacaac

SEQ ID NO: 136312 - RNA, 64 nt, Human
uugaaaagccuuucuguugcaacuaugaaugaaaacaaaacaccacaaaacagacuucacuaac

SEQ ID NO: 136313 - RNA, 64 nt, Human
uuucuguugcaacuaugaaugaaaacaaaacaccacaaaacagacuucacuaacacagaaaaac

SEQ ID NO: 136314 - RNA, 64 nt, Human
ucauuaauaucuaccagucccuuuucauucuaagacaaaacauuucuccuaaaucucugaauaa

SEQ ID NO: 136315 - RNA, 64 nt, Human
agcaugugacuaguuacaaaagcaauaaauugaaacaaaacaaaacaaaacaaaacuuguuucu

SEQ ID NO: 136316 - RNA, 64 nt, Human
gugacuaguuacaaaagcaauaaauugaaacaaaacaaaacaaaacaaaacuuguuucuuaaaa

SEQ ID NO: 136317 - RNA, 64 nt, Human
uaguuacaaaagcaauaaauugaaacaaaacaaaacaaaacaaaacuuguuucuuaaaaaugcg

SEQ ID NO: 136318 - RNA, 64 nt, Human
aaugaacucccccaaacauggcuguggagagacaacaaaacaaaacaaagcacaaaagucucug

SEQ ID NO: 136319 - RNA, 64 nt, Human
acucccccaaacauggcuguggagagacaacaaaacaaaacaaagcacaaaagucucugccaac

SEQ ID NO: 136320 - RNA, 64 nt, Human
ucugauuuuugcuacaguuuagacacugugguuuacaaaacagcaugcacucaacuugggacuu

SEQ ID NO: 136321 - RNA, 64 nt, Human
caaaguguucaggugaguuucucuaguuccauaaacaaaacauacauagugggaacucccuggu

SEQ ID NO: 136322 - RNA, 64 nt, Human
uccuuccuuccauuggcagauuguauauuuauucacaaaacauuaaauguccauccugugccag

SEQ ID NO: 136323 - RNA, 64 nt, Human
cauaaaauuguccuuucauucuuuugaagauauuacaaaacaaaaauaguuuuuuuuaaauugu

SEQ ID NO: 136324 - RNA, 64 nt, Human
gccucccacugauccacucagcgcacagccuugaacaaaacagagcaagaguuauaaccuucag

SEQ ID NO: 136325 - RNA, 64 nt, Human
aucacauucguuucccagugaaaagcaaaccagaacaaaacaaaaagccaccgcaauaauucgg

SEQ ID NO: 136326 - RNA, 64 nt, Human
augggauuggugcugauugaaagaacaaaacaaaacaaaacaaacacaaacaaacaaaaaaccu

SEQ ID NO: 136327 - RNA, 64 nt, Human
cauuuaugggauuggugcugauugaaagaacaaaacaaaacaaaacaaacacaaacaaacaaaa

SEQ ID NO: 136328 - RNA, 64 nt, Human
uagaucauuuaugggauuggugcugauugaaagaacaaaacaaaacaaaacaaacacaaacaaa

SEQ ID NO: 136329 - RNA, 64 nt, Human
auucaauacaugguuuuuaacaaaacagaacaaaacaaaacaauacagaaucucucccugaguu

SEQ ID NO: 136330 - RNA, 64 nt, Human
uuuaaauucaauacaugguuuuuaacaaaacagaacaaaacaaaacaauacagaaucucucccu

SEQ ID NO: 136331 - RNA, 64 nt, Human
uuuacuaaaauuuaaauucaauacaugguuuuuaacaaaacagaacaaaacaaaacaauacaga

SEQ ID NO: 136332 - RNA, 64 nt, Human
uauuacagugcuguaacugggugguccuuuuuaaacaaaacauuauuugcaaaacagaggguau

SEQ ID NO: 136333 - RNA, 64 nt, Human
guugcuacaaagguaaauaauggagagauuugguacaaaacaacaaaauauauauauauucuca

SEQ ID NO: 136334 - RNA, 64 nt, Human
ugguagaggggagacauuagaaaaaaaugaaacaacaaaacaauuacuaaugagguacgcugag

SEQ ID NO: 136335 - RNA, 64 nt, Human
uuuuuccccugcuccccugagaccacccccaaacacaaaacauucauguaacucuccagccauu

SEQ ID NO: 136336 - RNA, 64 nt, Human
agauaccaauuuaguuuaugcagaaaaaaauugaacaaaacaggguaccagcacggaagacuuu

SEQ ID NO: 136337 - RNA, 64 nt, Human
cuucuugcggcugaggagaggagcaguucaguuuacaaaacaagugcaaauuaccaaacucaaa

SEQ ID NO: 136338 - RNA, 64 nt, Human
uuguggggaaucaaauuuguuccuuuccucaugcacaaaacauaaaggauaguggcgaguuuac

SEQ ID NO: 136339 - RNA, 64 nt, Human
uauauuuuuaaaagggaggaaaaaaauaacaagaacaaaacacaggagaauguauuaaaaguau

SEQ ID NO: 136340 - RNA, 64 nt, Human
gcuuucagguaugaauuaaaagcaaaaacaaaaaacaaaacaauucauuagccucagauucuuc

SEQ ID NO: 136341 - RNA, 64 nt, Human
gugaguuaaauauaacucacaucccacucaagacacaaaacauuuucuuaauccuaguacauuu

SEQ ID NO: 136342 - RNA, 64 nt, Human
agugcgccauguuucucaaaguuuguuuuuguugacaaaacauuuuauaauauauaucuuaugu

SEQ ID NO: 136343 - RNA, 64 nt, Human
uuuuccaguucaaaaaaaugggcaggaguggggaacaaaacaauuaacguaagagcuacaaagg

SEQ ID NO: 136344 - RNA, 64 nt, Human
gaaaugagagggaugcuuccuuucccuugcaucuacaaaacaagagagagacuguucuguugua

SEQ ID NO: 136345 - RNA, 64 nt, Human
auuugaagagcaaagcauguuuuguguguuugccacaaaacauugcuugaagcacauacuuaga

SEQ ID NO: 136346 - RNA, 64 nt, Human
ccuuugccuucuucagaagcuuggaaaucgacacacaaaacagugcacauuuaguucacugcua

SEQ ID NO: 136347 - RNA, 64 nt, Human
aacuagcugugaaucuucugagagugaaagcaacacaaaacacaagugugguuuuaaagccuug

SEQ ID NO: 136348 - RNA, 64 nt, Human
cagcacacggaacuaccucccacccccuuuuuguacaaaacacaaggaaaaacauuuuuugcuu

SEQ ID NO: 136349 - RNA, 64 nt, Human
gauugacuucaagauaauaagcugcuaauuguaaacaaaacaguuacccuccaguauuaauaug

SEQ ID NO: 136350 - RNA, 64 nt, Human
auacuggguagcaaaagaaaauggaaaaaaacccacaaaacaaacuuuaaaaaaaaaaaaaaac

SEQ ID NO: 136351 - RNA, 64 nt, Human
uucugcugaagcuguugucagaaucuuccuuuggacaaaacaucacuagcugacuauaaaaaca

SEQ ID NO: 136352 - RNA, 64 nt, Human
gaggacucccacugcugugcaaguuaagucuuuuacaaaacaaggacagcagaggaggguuugc

SEQ ID NO: 136353 - RNA, 64 nt, Human
uuaaggauugucuuaaaguuccuuagccagcaaaacaaaacaaaacaaaacaaacaaaugaaaa

SEQ ID NO: 136354 - RNA, 64 nt, Human
gauugucuuaaaguuccuuagccagcaaaacaaaacaaaacaaaacaaacaaaugaaaaacguu

SEQ ID NO: 136355 - RNA, 64 nt, Human
ucuuaaaguuccuuagccagcaaaacaaaacaaaacaaaacaaacaaaugaaaaacguuuaaaa

SEQ ID NO: 136356 - RNA, 64 nt, Human
uaauccuuguuuuugucgugucuauaaaggaagaacaaaacaaaauaaaaacagagcccuagag

SEQ ID NO: 136357 - RNA, 64 nt, Human
cguuuucaccacugaaauaguuuucuacugaaauacaaaacauuucauuaacugcuauaggauc

SEQ ID NO: 136358 - RNA, 64 nt, Human
cauuuucaccauugaaauaguuuucuacugaaauacaaaacauuucauuaacugcucuaagaug

SEQ ID NO: 136359 - RNA, 64 nt, Human
accacuaggugacagaauguuugccaguauccccacaaaacaaguuaaaacuuaagugaaaauc

SEQ ID NO: 136360 - RNA, 64 nt, Human
ugguuuggggccaaucuacaauggauccaaaaggacaaaacauguuacaagcaaaucaacauag

SEQ ID NO: 136361 - RNA, 64 nt, Human
gugcuagauccaguugugccucagggcagaggaaacaaaacacagcuauccuguuggccugugu

SEQ ID NO: 136362 - RNA, 64 nt, Human
gaccacauuuuucaaguauuucuaaguauaaaaaacaaaacaaaaaucucuuaggaaaugucua

SEQ ID NO: 136363 - RNA, 64 nt, Human
auuacugaacauuaggacaaacacaaaauaaaaaacaaaacacagacaacggugcugauucugg

SEQ ID NO: 136364 - RNA, 64 nt, Human
ucuagcuaacaacuacuuagugggacuauuacacacaaaacaaauuaaaaacaaauuauuccag

SEQ ID NO: 136365 - RNA, 64 nt, Human
uuuaaauaaaaaaaaaggaaaagaggaagacuggacaaaacaacacaaaggcagaaaggaaaga

SEQ ID NO: 136366 - RNA, 64 nt, Human
uaacaaauguuugccuuuacauuguauuaagauaacaaaacauguucagcuuuccauuugguua

SEQ ID NO: 136367 - RNA, 64 nt, Human
cugacucuggacaggggguuucuguugcaaaaauacaaaacaaaagcgauaaaauaaaagcgau

SEQ ID NO: 136368 - RNA, 64 nt, Human
uauucuuugugauuaaauccuguuuuaaaaugucacaaaacaggaaccagcauucuaauuagau

SEQ ID NO: 136369 - RNA, 64 nt, Human
uuuucuuugguucuuuuuuccuuuuuuaggaaaaacaaaacaacagacuucauccuuagguuuu

SEQ ID NO: 136370 - RNA, 64 nt, Human
uaccaagaaaagcaagaagcagauuagguuuuugacaaaacaaacaggccaaaagggggcugac

SEQ ID NO: 136371 - RNA, 64 nt, Human
cuuuauguuucguuuauucacuaaaguagcugacacaaaacacaccaaaaccuagagcgguagu

SEQ ID NO: 136372 - RNA, 64 nt, Human
aagacuuuugaauuuucauuuuuuaaaaagauguacaaaacaguuugaaauaaauuuuaauucg

SEQ ID NO: 136373 - RNA, 64 nt, Human
guuguacacacacaacagaacaaaaugaagcaaaacaaaacaaaaaaacccacaaaaauuugua

SEQ ID NO: 136374 - RNA, 64 nt, Human
caugaccugcugguguguguguauauuuacaaaaacaaaacaaacaaaccacccauugggauau

SEQ ID NO: 136375 - RNA, 64 nt, Human
guuuuguauaaaucccuaauauuuaaaaaaaaaaacaaaacaaaaaaagguuacaaaguuuguu

SEQ ID NO: 136376 - RNA, 64 nt, Human
gaucaccugagguugggaguucgagaccagccugacaaaacauagugaaaccccgucucuacua

SEQ ID NO: 136377 - RNA, 64 nt, Human
acuguguaaaguaaaaacuaaaaaaauacaaaauacaaaacacacacacacacacacacacaca

SEQ ID NO: 136378 - RNA, 64 nt, Human
uugaaaucauaauuaaugcguuacuguaugaaccacaaaacagcacuauuuauuuagccuuacu

SEQ ID NO: 136379 - RNA, 64 nt, Human
auuuuucugcacugguuuaaucaugcuuaauacuacaaaacaaaaauaaauauuucacaguggu

SEQ ID NO: 136380 - RNA, 64 nt, Human
gggccagggaauauggguuuuuaacaagcgucuuacaaaacacuucucuaucaugcagccggag

SEQ ID NO: 136381 - RNA, 64 nt, Human
uguaugcauugauuuaauacacauuauaaagaauacaaaacauuuaaaaagggagacaaaacua

SEQ ID NO: 136382 - RNA, 64 nt, Human; identical to SEQ ID NO: 136379

SEQ ID NO: 136383 - RNA, 64 nt, Human
cagaucuggaacauuacuuauuugaggucagagaacaaaacaagaaccuggccagguguugauu

SEQ ID NO: 136384 - RNA, 64 nt, Human
uuuuuacccauuuuaaauguguuucugaagcaagacaaaacaaacuuccaaaaauacccuuaag

SEQ ID NO: 136385 - RNA, 64 nt, Human
gcaauguuuuuauguuuccuuuaugccaaacauaacaaaacaguuauauagacugcuuuagcaa

SEQ ID NO: 136386 - RNA, 64 nt, Human
aauacuuggugagugauuuaaaaauaaaaccaaaacaaaacacaaaaagauauuccacaggaca

SEQ ID NO: 136387 - RNA, 64 nt, Human
aaugaggaagauguguucauuguggacucuaaaaacaaaacaaaacacaaaauccccuguucaa

SEQ ID NO: 136388 - RNA, 64 nt, Human
ggaagauguguucauuguggacucuaaaaacaaaacaaaacacaaaauccccuguucaaauaaa

SEQ ID NO: 136389 - RNA, 64 nt, Human
aguaaccauuguuaaggguugggggaaagcauggacaaaacaucacuggaaacaaaggcuguaa

SEQ ID NO: 136390 - RNA, 64 nt, Human
ucucuuggaauguguauuguuuuuauuuugcgaaacaaaacaaaacaaaaaaaaaagcuuggaa

SEQ ID NO: 136391 - RNA, 64 nt, Human
uggaauguguauuguuuuuauuuugcgaaacaaaacaaaacaaaaaaaaaagcuuggaacucca

SEQ ID NO: 136392 - RNA, 64 nt, Human
uuggcuacguauuggaaucaccuaaaaaguuaaaacaaaacauggaugucugggucccgcccca

SEQ ID NO: 136393 - RNA, 64 nt, Human
uagcuaggauuuggagaauaaguguguacagaucacaaaacauguauauacauuauuuagaaaa

SEQ ID NO: 136394 - RNA, 64 nt, Human
uuuacuuuuauuaaaaaaguauaguauauauaauacaaaacaauaacccuucugggguuucuug

SEQ ID NO: 136395 - RNA, 64 nt, Human
caauucccuauuauauucugcaucagaaaaacaaacaaaacaaaaacaacuuuaaaugcuugua

SEQ ID NO: 136396 - RNA, 64 nt, Human
cgugggucacacuuccaagauauuuaaagcaaauacaaaacagaacagaggauucaaaccgcaa

SEQ ID NO: 136397 - RNA, 64 nt, Human
cauuuauuuaauaugauggucuuugcaaaaaggaacaaaacaacacaaaagcccaccaggcugc

SEQ ID NO: 136398 - RNA, 64 nt, Human
uaaauuggguucaugaugcagucuccucuuuaaaacaaaacaaaacaaaacaaaacuauacuug

SEQ ID NO: 136399 - RNA, 64 nt, Human
uggguucaugaugcagucuccucuuuaaaacaaaacaaaacaaaacaaaacuauacuugaacaa

SEQ ID NO: 136400 - RNA, 64 nt, Human
ucaugaugcagucuccucuuuaaaacaaaacaaaacaaaacaaaacuauacuugaacaaaaggg

SEQ ID NO: 136401 - RNA, 64 nt, Human
cguuucaggugcuagggacuuaaugaaaaacaggacaaaacaauuccuuuuuguggcccaggua

SEQ ID NO: 136402 - RNA, 64 nt, Human
uguuugcacuuggcaaaaagaaucccaauguuugacaaaacacagccaaggggauauuuacugc

SEQ ID NO: 136403 - RNA, 64 nt, Human
agagacagggagagguggagaaggaaaaaacccuacaaaacaaaaacaaaccgcauacacguuc

SEQ ID NO: 136404 - RNA, 64 nt, Human
guuuccuucagucaaagaaaguccauuguacauaacaaaacagcccccaaacagcccagugccg

SEQ ID NO: 136405 - RNA, 64 nt, Human
aaguggcucuuacccagcucucagugacucccccacaaaacagcaacagccuccaccgccaacu

SEQ ID NO: 136406 - RNA, 64 nt, Human
gcucaccugucccccuccucgcagcagccucgggacaaaacaaugacucaaggacagcacuucu

SEQ ID NO: 136407 - RNA, 64 nt, Human
gugacagagccaaacuccgucaaaaaaaaacaaaacaaaacaaaaaaaagacaugggagagaug

SEQ ID NO: 136408 - RNA, 64 nt, Human
cuggagugacagagccaaacuccgucaaaaaaaaacaaaacaaaacaaaaaaaagacaugggag

SEQ ID NO: 136409 - RNA, 64 nt, Human
gaucuaggugagcccauuguaaguaucauugaaaacaaaacaugcccgucaacaugucacagaa

SEQ ID NO: 136410 - RNA, 64 nt, Human
auaucugccuuauauguuauauucaaggaaauuaacaaaacauccuguaaaacaucguuuaagg

SEQ ID NO: 136411 - RNA, 64 nt, Human
caucauucauacccacuguucugaaggcuugaaaacaaaacauauccacaacauuggcuugaug

SEQ ID NO: 136412 - RNA, 64 nt, Human
gcaagaacucuauuuggaucagaacuacauuauuacaaaacaaaaugaacacuugaccaaaaaa

SEQ ID NO: 136413 - RNA, 64 nt, Human
ucgcccuacugagacugguccccucaaaagguagacaaaacagcagcucccuguggagcugaag

SEQ ID NO: 136414 - RNA, 64 nt, Human
acacacucugcccgugucacacgugugcuuuaacacaaaacagauaacacuaaagacggguuca

SEQ ID NO: 136415 - RNA, 64 nt, Human
cguagagcaguuauuugaaaaacaguuauggaacacaaaacauuuuauagauuuaauaucauaa

SEQ ID NO: 136416 - RNA, 64 nt, Human
uguuguaaacaagauucuaaauuuaaaaaggaaaacaaaacaaacuuguucuuugcagcuuauc

SEQ ID NO: 136417 - RNA, 64 nt, Human
aggacgccaguaaaaaaacaaaaacaaaaacaaaacaaaacauaaaauauaaacaaucaaaauc

SEQ ID NO: 136418 - RNA, 64 nt, Human
aauggaggacgccaguaaaaaaacaaaaacaaaaacaaaacaaaacauaaaauauaaacaauca

SEQ ID NO: 136419 - RNA, 64 nt, Human
aaaaagaauaauaauaacuuggaaguuuuaguuuacaaaacagagauuccuucaacacuggaca

SEQ ID NO: 136420 - RNA, 64 nt, Human
guauaacguuaauuuauuaauaaauugguaauauacaaaacaauuaaucauuuauaguuuuuuu

SEQ ID NO: 136421 - RNA, 64 nt, Human
uuuaaauaaaggggaaguccacauuaaaaagaaaacaaaacaaacccuaacuaacuuccaaaug

SEQ ID NO: 136422 - RNA, 64 nt, Human
cagcuugggcaacagagugagacuccaucucaaaacaaaacaaaacaaaacaaaacaaaaaaac

SEQ ID NO: 136423 - RNA, 64 nt, Human
ugggcaacagagugagacuccaucucaaaacaaaacaaaacaaaacaaaacaaaaaaacccggc

SEQ ID NO: 136424 - RNA, 64 nt, Human
aacagagugagacuccaucucaaaacaaaacaaaacaaaacaaaacaaaaaaacccggcuuugc

SEQ ID NO: 136425 - RNA, 64 nt, Human
agugagacuccaucucaaaacaaaacaaaacaaaacaaaacaaaaaaacccggcuuugcugcuu

SEQ ID NO: 136426 - RNA, 64 nt, Human
uaucaaccaggcaagucuugcuguaaaaaugaaaacaaaacaaacccaugagguuaccaucaag

SEQ ID NO: 136427 - RNA, 64 nt, Human
ggagaagggccaggggaauagagcuauuuuuuuaacaaaacaaaaugaagacaaaaauauggac

SEQ ID NO: 136428 - RNA, 64 nt, Human
uucuccuuuacaaugcaugaaugccuaucccccuacaaaacaaagauuaaaugugaugauguau

SEQ ID NO: 136429 - RNA, 64 nt, Human
gcuguucuagaguuucagucaccuaaguacacccacaaaacaauaugaauauggagaucuuccu

SEQ ID NO: 136430 - RNA, 64 nt, Human
ugagacccugccuuuaaaaacaaacagaacaaaaacaaaacaccagggacacauuucucugucu

SEQ ID NO: 136431 - RNA, 64 nt, Human
cucauucugauaaaguauaagacuuuaaaauaauacaaaacagggccgggcgcaguggcucaca

SEQ ID NO: 136432 - RNA, 64 nt, Human
uuccaagcaguuuucucuucaucacuacuaacaaacaaaacacuaagaaggcuuaguaucgcuc

SEQ ID NO: 136433 - RNA, 64 nt, Human
ucaucccacgcuugcuuuagcacaggacaacuuuacaaaacaugauuguuuacagcugcucuuc

SEQ ID NO: 136434 - RNA, 64 nt, Human
cuuucuuuuuccaccugagacuuguuuauaaaaaacaaaacaauaaaaagagucugaucagagc

SEQ ID NO: 136435 - RNA, 64 nt, Human
gggccuacugagggaaagaaguaaccaggcaacuacaaaacagugauaaguauuaggauacaga

SEQ ID NO: 136436 - RNA, 64 nt, Human
aauaacaugcaaaaaaagcugaaugcacuaacucacaaaacaaacacuugcacugaauucccaa

SEQ ID NO: 136437 - RNA, 64 nt, Human
guuucuucucuuugguugguguggguaaaagaaaacaaaacauuuccuauaagcugaaagcuga

SEQ ID NO: 136438 - RNA, 64 nt, Human
uagaaucuuucagguggaauaaagucacaugaaaacaaaacacaacuauauauauuuucaguuu

SEQ ID NO: 136439 - RNA, 64 nt, Human
ggccuuuguauguguguacauauauauauauauaacaaaacaucagccuugggugguguguucc

SEQ ID NO: 136440 - RNA, 64 nt, Human
uuuugagaauaaguuuauauucuugcuagguaaaacaaaacaaaaacgacaguaauaccaagga

SEQ ID NO: 136441 - RNA, 64 nt, Human
gguguguuuuuuaauuuucuggggggaaaaaaagacaaaacaaaaaaccaacucugacuuuucu

SEQ ID NO: 136442 - RNA, 64 nt, Human
aauucauaaugcagcaguuucuccaaaaacaaaaacaaaacacacaccacacacacgcgcuuuu

SEQ ID NO: 136443 - RNA, 64 nt, Human
uggguuucacuccauaucuagaagaauuuagcucacaaaacaauuuuuguguguuuugaguaac

SEQ ID NO: 136444 - RNA, 64 nt, Human
uuuaggagauaaauuuauuuuuaaauuuugaaacacaaaacaauuuugaaucuugcucucuuaa

SEQ ID NO: 136445 - RNA, 64 nt, Human
gggagaagauauucucgugaaagaaaaaaacaaaacaaaacaacagugcuuuuuucaaaccuga

SEQ ID NO: 136446 - RNA, 64 nt, Human
uccaagggagaagauauucucgugaaagaaaaaaacaaaacaaaacaacagugcuuuuuucaaa

SEQ ID NO: 136447 - RNA, 64 nt, Human
gguugcguuuaauauauuuuuugaacuuuguaggacaaaacauagcugguuaaccuugaaguga

SEQ ID NO: 136448 - RNA, 64 nt, Human
uuauauucaacugacagacaaaaaccaaccaacgacaaaacaaaaacccccaaucaugaacgcc

SEQ ID NO: 136449 - RNA, 64 nt, Human
ggccccgcucccuaaauuuuuuaaaaagacaaaaacaaaacaacaacaacaacacacaaaccug

SEQ ID NO: 136450 - RNA, 64 nt, Human
gaaaugacaacuuuauuccacauaaacaaggguaacaaaacaagcugcuuaaauauaccaguca

SEQ ID NO: 136451 - RNA, 64 nt, Human
cucaucaaacucauauauuccuccuggcuuccuuacaaaacaagccuuucaaacaaucauuguc

SEQ ID NO: 136452 - RNA, 64 nt, Human
gccaguagugggcauggggugggggcaaggcaggacaaaacauacaagucugagcaaguacauc

SEQ ID NO: 136453 - RNA, 64 nt, Human
auugaaauaaggagggacaugauggggaaggaguacaaaacaaucucucaacaugauugaacca

SEQ ID NO: 136454 - RNA, 64 nt, Human
cuuugaagauagaaaugaaaaaaaugaacaaacuacaaaacaucagugaagagcuccagagaaa

SEQ ID NO: 136455 - RNA, 64 nt, Human
uucacuuugagaaucgguuugacuuugcuuucaaacaaaacaaaaaccucuugcuuuuaggggu

SEQ ID NO: 136456 - RNA, 64 nt, Human
aagggacuauguacuacuguuaauaucucuaagaacaaaacacauugaacauccuuccagaaag

SEQ ID NO: 136457 - RNA, 64 nt, Human
ggccccuugccucuucccuucccacuggugcauuacaaaacaguguucuuuugaaauguucauc

SEQ ID NO: 136458 - RNA, 64 nt, Human
uccucucaccuugucccuugucaguuccaaacagacaaaacagauaaacaaacaagcccccugc

SEQ ID NO: 136459 - RNA, 64 nt, Human
aaagagagaggcagaagagacagacgaggcagagacaaaacacugagaaagagacugaaaugga

SEQ ID NO: 136460 - RNA, 64 nt, Human
ucccugcccgugaggcccggugcaggaccgauguacaaaacagcagcaagugccucucuucuca

SEQ ID NO: 136461 - RNA, 64 nt, Human
auuccuuaagaucauggguucugacuucagccaaacaaaacaaucaaaaccuaccaaaaaggga

SEQ ID NO: 136462 - RNA, 64 nt, Human
cauuacagcugaaggaagaggaucaccuuccaagacaaaacagucuucaugggggaaaaaugac

SEQ ID NO: 136463 - RNA, 64 nt, Human
gcagcauccaggcugaccucaaggaagcauagccacaaaacagaauagcaccugucuguacaua

SEQ ID NO: 136464 - RNA, 64 nt, Human
aguuuaagcucaauuuaauuuugcuagauauuuaacaaaacauacggcucaaccucauaaccua

SEQ ID NO: 136465 - RNA, 64 nt, Human
caucuucuuuaugccuaguauuugugauaagagcacaaaacaauuuucuaaucucaaagagcuu

SEQ ID NO: 136466 - RNA, 64 nt, Human
ccauguauuuuuguuacaaaucuucugaaaaaaaacaaaacaaugugaaacauuaaaauuaaaa

SEQ ID NO: 136467 - RNA, 64 nt, Human
uuuuuaccugcacaaauggacuaaaaaaucuggcacaaaacauuguuauguaaugucuuaugau

SEQ ID NO: 136468 - RNA, 64 nt, Human
ugagauuaaaagaagacaauuauucaaagccaucacaaaacacuauaagacugaccaaaauuua

SEQ ID NO: 136469 - RNA, 64 nt, Human
cagcccaggcugcagucuccacaccaaacagucaacaaaacacaaacccugaaggaaaaccuuu

SEQ ID NO: 136470 - RNA, 64 nt, Human
aucccagcugugaagaggccacugcauggcugacacaaaacaccucuuggccauucacaggggc

SEQ ID NO: 136471 - RNA, 64 nt, Human
cugggaacacagcgagacccucucauuaaaaacaacaaaacaaaacaauuccagucuuggagua

SEQ ID NO: 136472 - RNA, 64 nt, Human
aacacagcgagacccucucauuaaaaacaacaaaacaaaacaauuccagucuuggaguagucua

SEQ ID NO: 136473 - RNA, 64 nt, Human
cucucaaguguguuuccuuuggcuguucccuaauacaaaacacggacauauuuuuacucguagc

SEQ ID NO: 136474 - RNA, 64 nt, Human
aaggaacuuuccuaagaaaccgcugauaaccaggacaaaacacaaccaaggguacacgcaggca

SEQ ID NO: 136475 - RNA, 64 nt, Human
cccaaagguauauuaacuauauaagagaguugugacaaaacagaaugauaaagcugcgaaccgu

SEQ ID NO: 136476 - RNA, 64 nt, Human
ucuuacuguaaaaaaaagugcacugaacuucaaaacaaaacaaaaaacaacaacaacaaaaaac

SEQ ID NO: 136477 - RNA, 64 nt, Human
uguaauagaugcacgacaggcauaaacaagaacaacaaaacagguguuauguguacauucggag

SEQ ID NO: 136478 - RNA, 64 nt, Human
cucugcaaguugaccuggccucucccccacaggaacaaaacacugccuccagagucuuuaaauu

SEQ ID NO: 136479 - RNA, 64 nt, Human
cugaaaaauaaaaugugcaagucuucaggauggcacaaaacaaagguuaaugcuucuuggggca

SEQ ID NO: 136480 - RNA, 64 nt, Human
cauguuauaaauauuguuauuuaaaaaacaaaaaacaaaacacacguacauuagguccugggug

SEQ ID NO: 136481 - RNA, 64 nt, Human
aacuuuggaaaagaauuccuucuuaaaaucaaaaacaaaacaaaaaaacacaaaaaacacauuc

SEQ ID NO: 136482 - RNA, 64 nt, Human
cacagauccuuaucucuccccauccccuagccucacaaaacacaguugagagucuuuuaaguac

SEQ ID NO: 136483 - RNA, 64 nt, Human
uaccuggggaccccccuugcccaugccuccagcuacaaaacaauucaauugcuuuuuuuuuuug

SEQ ID NO: 136484 - RNA, 64 nt, Human
aagguaucaaaugccuuggaagcucccugauccuacaaaacaaaaaaaugcuuauuuuuaccac

SEQ ID NO: 136485 - RNA, 64 nt, Human
cuuuauauuugggguccuuuuuuauacaggaaaaacaaaacaaagaaauaauggucuuuuuuuu

SEQ ID NO: 136486 - RNA, 64 nt, Human
uugcauuggcuugaagcaauauaauauauuguaaacaaaacacagcucuuaccuaauaaacauu

SEQ ID NO: 136487 - RNA, 64 nt, Human
guuaucuaucagacucaaaaucauuuaaagacuaacaaaacacaaucaugauauucuaacugug

SEQ ID NO: 136488 - RNA, 64 nt, Human
ggccagaucucuuacuuaaugacuuggggaaggcacaaaacaugagagaaagguaacugccagc

SEQ ID NO: 136489 - RNA, 64 nt, Human
ggagaaagagcaguaugccacuucuuaaaacagaacaaaacaaaaaaagaaaauugugcucuuu

SEQ ID NO: 136490 - RNA, 64 nt, Human
cuucuuaaaagaaguugacuaugaauugaaacacacaaaacauuuaagugccagacuuaauauu

SEQ ID NO: 136491 - RNA, 64 nt, Human
cuaaugcuuuguuuaaaaaaacgaaaaaaacaaaacaaaacaaaaaaacaugagcagugguguu

SEQ ID NO: 136492 - RNA, 64 nt, Human
uaacacuaaugcuuuguuuaaaaaaacgaaaaaaacaaaacaaaacaaaaaaacaugagcagug

SEQ ID NO: 136493 - RNA, 64 nt, Human
ggauuuucuaaauaaaaauauugaaugcuuucuaacaaaacagaauauuucaaagaaauuagca

SEQ ID NO: 136494 - RNA, 64 nt, Human
accacuauacauaguuucuuuuguacuugaauauacaaaacaugaacacagugccauaugaaua

SEQ ID NO: 136495 - RNA, 64 nt, Human
aagauggauagcacauaauggcacuugucuauguacaaaacacaaacuuuagagcaagaagacc

SEQ ID NO: 136496 - RNA, 64 nt, Human
cucuuaucuuaaaaaguaaacaaaacaaaacaaaacaaaacaaaaaacuagauauguaauuucu

SEQ ID NO: 136497 - RNA, 64 nt, Human
caggacucuuaucuuaaaaaguaaacaaaacaaaacaaaacaaaacaaaaaacuagauauguaa

SEQ ID NO: 136498 - RNA, 64 nt, Human
ugcggcaggacucuuaucuuaaaaaguaaacaaaacaaaacaaaacaaaacaaaaaacuagaua

SEQ ID NO: 136499 - RNA, 64 nt, Human
agaggugcggcaggacucuuaucuuaaaaaguaaacaaaacaaaacaaaacaaaacaaaaaacu

SEQ ID NO: 136500 - RNA, 64 nt, Human
uuacaugucagaaugccuuaacuacccuaacuugacaaaacagaauucuuugguagacgcggug

SEQ ID NO: 136501 - RNA, 64 nt, Human
gcuuuacuucuuuugcaugcacuuuaaaaacaaaacaaaacauuuuucagguuccaaggaagag

SEQ ID NO: 136502 - RNA, 64 nt, Human
aaaaggcuuuacuucuuuugcaugcacuuuaaaaacaaaacaaaacauuuuucagguuccaagg

SEQ ID NO: 136503 - RNA, 64 nt, Human
auugugacuuccugguagcccaagaagaacaacaacaaaacaaucugcucugaccuucuucaaa

SEQ ID NO: 136504 - RNA, 64 nt, Human
cacggaaaaggcagugaaguugggaguacugcuuacaaaacagggucaccagugcauuaugugg

SEQ ID NO: 136505 - RNA, 64 nt, Human
aaucaggauuaaauuuucuaugaauaauugaaaaacaaaacacucacuggauuuguuauaaucc

SEQ ID NO: 136506 - RNA, 64 nt, Human
guaccuacauaguuuuuaaauuauuguuuaaaaaacaaaacagcuguuauaaaugaauauuaug

SEQ ID NO: 136507 - RNA, 64 nt, Human
ugguaacugaugccuuucauuuuguucaacuuauacaaaacaagccagcaucugaucaaaagua

SEQ ID NO: 136508 - RNA, 64 nt, Human
aaaauaaaaguuacaaaauccaacaacaacaacaacaaaacaauguucuugguuuuaauguucc

SEQ ID NO: 136509 - RNA, 64 nt, Human
uaguacauaucuuuaaauuaccaaaaaacaagaaacaaaacauaaaaaccccaaaacuaucacu

SEQ ID NO: 136510 - RNA, 64 nt, Human
cccagacacccagcaaucaagccagaugaguaccacaaaacaguguguccccagcagcucccca

SEQ ID NO: 136511 - RNA, 64 nt, Human
ugaaaucuuuauuguuuuccaaacagcuaguuuaacaaaacagcaucauacauagugaaugaug

SEQ ID NO: 136512 - RNA, 64 nt, Human
ugaauuauucaauuuauuugaaugauuuuucuuuacaaaacaaacucauucauuagucauguuu

SEQ ID NO: 136513 - RNA, 64 nt, Human
guuauugccaaaggaacugucuguaagacaaaaaacaaaacauguuggaauuacuuaauugaaa

SEQ ID NO: 136514 - RNA, 64 nt, Human
uuaaaauuguaugaucguaacauuauuuauuaccacaaaacagcaaaaucuucaaugucuaaga

SEQ ID NO: 136515 - RNA, 64 nt, Human
guuaugcagcacaucauuauaauuuugaugugucacaaaacauuacucauuugauuucccccac

SEQ ID NO: 136516 - RNA, 64 nt, Human
gaagucauuaaaacaaaaugaaacauuugccaaaacaaaacaaaaaacuauguauuugcacagc

SEQ ID NO: 136517 - RNA, 64 nt, Human
ccaccaaaaacuagacaaauaaagacaaacuaaaacaaaacagaacaaaagcaaaggaaaaugc

SEQ ID NO: 136518 - RNA, 61 nt, Human
uucaaccugacgaaaaguagacaucaaguggacaaaacagacgaguuccaaauuacguucu

SEQ ID NO: 136519 - RNA, 64 nt, Human
gcuaauaauauuugaaggagauugccuaccaaggacaaaacaauaaauuuaaaaaucaaacgau

SEQ ID NO: 136520 - RNA, 64 nt, Human
auauguauaacuuucgcuuuaaaguuuuuuuuuaacaaaacauauauaugcuguuuauuuacuu

SEQ ID NO: 136521 - RNA, 64 nt, Human
ggagacagagcaagacuccaucucaaaaacaaaaacaaaacaaaacaacaacaaaaaaagaagu

SEQ ID NO: 136522 - RNA, 64 nt, Human
cagagcaagacuccaucucaaaaacaaaaacaaaacaaaacaacaacaaaaaaagaaguuaaau

SEQ ID NO: 136523 - RNA, 64 nt, Human
cacuagaugccaccuagagcuccaguucuuuauaacaaaacagggaucuguuugaacacuuacu

SEQ ID NO: 136524 - RNA, 64 nt, Human
auaccaaaaaguguaagugaaaacccccuuuaaaacaaaacaaaaaaaugaaauaaaauuaggc

SEQ ID NO: 136525 - RNA, 64 nt, Human
aaggucacacaagccaaccaugucaugccagaguacaaaacacauaguucuuuccccgccccga

SEQ ID NO: 136526 - RNA, 64 nt, Human
agugccccaaauggaaaaaagauacucacacagaacaaaacaguucuuggucuuguucuugguc

SEQ ID NO: 136527 - RNA, 64 nt, Human
aagaguuuuguauaugucugauaccguuguuauaacaaaacaaauuuuuuuacuauaguuuuuu

SEQ ID NO: 136528 - RNA, 64 nt, Human
cacauuauauaguagauguuuguuuauaauguuuacaaaacauuuuggugaauuuccucaaugu

SEQ ID NO: 136529 - RNA, 64 nt, Human
agaacauguggaauaaguuuuuuagcugcuaaugacaaaacaaauccuguaacuacccagccag

SEQ ID NO: 136530 - RNA, 64 nt, Human
guggcucagucagcaaccucagaacucugaaaaaacaaaacaaaaaaaaaaaaaaaagaaaaaa

SEQ ID NO: 136531 - RNA, 64 nt, Human
ccagccuggcgacagagagagacuccaucucaaaacaaaacaaaaaaaauuagccuacuuaaag

SEQ ID NO: 136532 - RNA, 64 nt, Human
gacacagccaacauuuugugaaacaaugacuggaacaaaacagcagccauacuuaccuuugagg

SEQ ID NO: 136533 - RNA, 64 nt, Human
ucagcggcaaaucuuuucaugaagccccaaggacacaaaacauuuucccauuuaaaggaaaaca

SEQ ID NO: 136534 - RNA, 64 nt, Human
agcugaaaccgcuuuuuaaaauucaaaacaagaaacaaaacaaaaaaaauuaaggggaaaauua

SEQ ID NO: 136535 - RNA, 64 nt, Human
guauuuguaauaaucgagaaugccugggcauuuuacaaaacaagaaaaaaaauacccuuuucuu

SEQ ID NO: 136536 - RNA, 64 nt, Human
uuguguuuauauuuccuguaagugaauaaauaaaacaaaacaaaacaaaaaaaacuugugccug

SEQ ID NO: 136537 - RNA, 64 nt, Human
uuuauauuuccuguaagugaauaaauaaaacaaaacaaaacaaaaaaaacuugugccugauaag

SEQ ID NO: 136538 - RNA, 64 nt, Human
gcccguaugacagagugagacccuguuucuaaaaacaaaacaaacaaacaaacaaacaacguau

SEQ ID NO: 136539 - RNA, 64 nt, Human
gaagacacaaaccugacaggagggagaagaaaaaacaaaacacuugaaccaagaaacucaaaug

SEQ ID NO: 136540 - RNA, 64 nt, Human
aauuauuuauguauggugcaauguguguauauggacaaaacaagaaagacgcacuuuggcuuau

SEQ ID NO: 136541 - RNA, 64 nt, Human
aaacuuuaccaucuagagugcucaugcaauuaaaacaaaacaaacacaaacaaggaggcacuaa

SEQ ID NO: 136542 - RNA, 64 nt, Human
ccaccucgaucucgguguuucaggcacuaaagcaacaaaacaacccauaguaucucauucuguc

SEQ ID NO: 136543 - RNA, 64 nt, Human
ccagccugggugacagagcgagacuaucucagaaacaaaacaaaacaaaacaacaaaaaaagaa

SEQ ID NO: 136544 - RNA, 64 nt, Human
cugggugacagagcgagacuaucucagaaacaaaacaaaacaaaacaacaaaaaaagaaaaggc

SEQ ID NO: 136545 - RNA, 64 nt, Human
ugacagagcgagacuaucucagaaacaaaacaaaacaaaacaacaaaaaaagaaaaggcagagu

SEQ ID NO: 136546 - RNA, 64 nt, Human
uggaggauggacauuucuggauacacauacacauacaaaacagaaaacauuuuuuaaaagaagu

SEQ ID NO: 136547 - RNA, 64 nt, Human
cugaaggggugaagacuugauuuuggagagggcaacaaaacaagggugugugugcauaggagaa

SEQ ID NO: 136548 - RNA, 64 nt, Human
ggcacugcaauuuuauuuuugaguugggacuuuuacaaaacacuuuuuucccuggagucuucuc

SEQ ID NO: 136549 - RNA, 64 nt, Human
cacaaccagucuuuuuguauuuauuguuacugagacaaaacaguacucacugaguguuuuucag

SEQ ID NO: 136550 - RNA, 64 nt, Human
gugcaugggaaagggcuguugauauuaaaaacaaacaaaacaaaaaagccccacacauaacugu

SEQ ID NO: 136551 - RNA, 64 nt, Human
aaacuaaguuacugaaugaaggaaccucuuucuuacaaaacaaaaaaaagggcagaaaucaccc

SEQ ID NO: 136552 - RNA, 64 nt, Human
caaaaacauucacaaauauagaaaaguauacaaaacaaaacaguaagauugucuguaaucacau

SEQ ID NO: 136553 - RNA, 64 nt, Human
uauuucaaaaacauucacaaauauagaaaaguauacaaaacaaaacaguaagauugucuguaau

SEQ ID NO: 136554 - RNA, 56 nt, Human
aaggauuuggcaugcuguaaaacaaaacaaaacaaaauaaaacaaaaaaaaggaag

SEQ ID NO: 136555 - RNA, 51 nt, Human
aaggauuuggcaugcuguaaaacaaaacaaaacaaaauaaaacaaaaaaaa

SEQ ID NO: 136556 - RNA, 64 nt, Human
aagauguacuguagugcuauuugaaguaccuguaacaaaacaguuggcccucuguauccaugua

SEQ ID NO: 136557 - RNA, 64 nt, Human
agcuucuuccaggaguucugagccuugguuguggacaaaacaaucuuaaguugggcagcuuucc

SEQ ID NO: 136558 - RNA, 64 nt, Human
ccagagggucacugucugguuugugauuugguggacaaaacacucgcuguuacaaguacagauu

SEQ ID NO: 136559 - RNA, 64 nt, Human
ugggcgacacagcgagacuccaucucaaaacaaaacaaaacaaaauuagcugagcaugguggug

SEQ ID NO: 136560 - RNA, 64 nt, Human
gagccugggcgacacagcgagacuccaucucaaaacaaaacaaaacaaaauuagcugagcaugg

SEQ ID NO: 136561 - RNA, 64 nt, Human
acacuccaggccucuaguuccagaaggauccaagacaaaacagaucugaauucugcccuuuucu

SEQ ID NO: 136562 - RNA, 64 nt, Human
uccugcucucaaauuuaggacagagccgcuaaggacaaaacaaucccucccgugcuuuaugaug

SEQ ID NO: 136563 - RNA, 64 nt, Human
gcuguucacacuuugacuggauggagaugcauuuacaaaacagacuggagaaggacuuaauacu

SEQ ID NO: 136564 - RNA, 64 nt, Human
gaaaacgugaacauuccugcaaaguauuauuguaacaaaacacuguaacucugguaaauguucu

SEQ ID NO: 136565 - RNA, 64 nt, Human
uaaauggggaaauauuauucaucgagaaagugaaacaaaacacuaggaaaugauuaugaaaugu

SEQ ID NO: 136566 - RNA, 64 nt, Human
gaccagcugaccaggcuugugcucagagaagcagacaaaacaaagauucaagguuuuaauuaau

SEQ ID NO: 136567 - RNA, 64 nt, Human
uccagaacagaaagggagccucacgcuggcucacacaaaacagcugacacugacuaaggaacug

SEQ ID NO: 136568 - RNA, 64 nt, Human
agaauucccaggcugaaaucagccauagcaguugacaaaacagcuauccccacaagugaugaga

SEQ ID NO: 136569 - RNA, 64 nt, Human
ugcuuacaauuuuuaaugcaugugccuuuauuucacaaaacauguggcugggcgcagcggcuca

SEQ ID NO: 136570 - RNA, 64 nt, Human
uccugacuuaauauccaguugugggguuugcaaaacaaaacagcuguauguaaucauugccacu

SEQ ID NO: 136571 - RNA, 64 nt, Human
cacaccuccacugccucccagcagaucuguggagacaaaacaagcaacaccuuaaaagaguuuu

SEQ ID NO: 136572 - RNA, 64 nt, Human
aucuugugguuccaugagaauuauuacuuuaaaaacaaaacaaaauauaaaaaacuguguuuga

SEQ ID NO: 136573 - RNA, 64 nt, Human
ccagcuugggcgacagaucaagacucugucacacacaaaacaaacaaacaaauuuucccguuuc

SEQ ID NO: 136574 - RNA, 64 nt, Human
uccuaugaauuuagugguuuuauguggauaugccacaaaacacaagugguaugcuuuagaucug

SEQ ID NO: 136575 - RNA, 64 nt, Human
auaaaugcagaaucugaagguaaauagguuuaaaacaaaacaaaaacccaccccuuuaaggagu

SEQ ID NO: 136576 - RNA, 64 nt, Human
aauaggauugugugauaauguuuaaauggcaaaaacaaaacaugauuuugugcaauuaacaaag

SEQ ID NO: 136577 - RNA, 64 nt, Human
agucucgcuuauuaucucacugguauuuagguauacaaaacaguugauuauucaccacgccaau

SEQ ID NO: 136578 - RNA, 64 nt, Human
aggcucggcggccuuuuccaggcuucaggccugaacaaaacaggcuguuugcugugaggagcua

SEQ ID NO: 136579 - RNA, 64 nt, Human
gaaguugaagaaucauuguuagaagcauuuccaaacaaaacacuaagcaaaaugggaauuaggc

SEQ ID NO: 136580 - RNA, 64 nt, Human
ugugggugugggaggauggagagagaacucuaacacaaaacaucuuauuaaaauuguacuugag

SEQ ID NO: 136581 - RNA, 64 nt, Human
ugguauuuaaaaaauaucuaggaggagcuaaaugacaaaacacagcaguguuuugagggagaaa

SEQ ID NO: 136582 - RNA, 64 nt, Human
uguauuugauggcucuaagggcuauaaauuacaaacaaaacacaucccagacauuaggaguuca

SEQ ID NO: 136583 - RNA, 64 nt, Human
accagggagaugaaagaucucuacaacaaaaauuacaaaacacugcugaaagaaaucagagaug

SEQ ID NO: 136584 - RNA, 64 nt, Human
guuuagauaguguuucagcugcugucccaaaguaacaaaacaauaccuacuguuaaguaggaag

SEQ ID NO: 136585 - RNA, 64 nt, Human
ggcaaaaagagugagacucugucucaaaaaaaaaacaaaacaaaaaaaaccucuuugcugguau

SEQ ID NO: 136586 - RNA, 64 nt, Human
gccaugaugucuuuucuucuuuuucuuuuuuuuaacaaaacagaacaaaaccaaaaaaugucca

SEQ ID NO: 136587 - RNA, 64 nt, Human
aaaauaaauauacaauaaaaguaaacacauacacacaaaacagcaaacuucagguaacuauuuu

SEQ ID NO: 136588 - RNA, 64 nt, Human
cuggcuucucucucuguucuaguuuuggcugaaaacaaaacaacaaaaggaacagauccuugac

SEQ ID NO: 136589 - RNA, 64 nt, Human
uuauuuuaccaaacgcgaauugagacggacuuugacaaaacacgaaaugguaaugugaagcuaa

SEQ ID NO: 136590 - RNA, 64 nt, Human
caggggauuccaugcucaauggaugaauguagacacaaaacagcaacacuuguaugaagaugua

SEQ ID NO: 136591 - RNA, 64 nt, Human
acauuuaaagagaagcaucuaccacggcuuuaaaacaaaacaacucugagaugaacaauaugug

SEQ ID NO: 136592 - RNA, 64 nt, Human
ucaacaagaguaaaacuucaucucaaaaaacaaaacaaaacaaaaacaacaacaaaaaacaaaa

SEQ ID NO: 136593 - RNA, 64 nt, Human
ccuggucaacaagaguaaaacuucaucucaaaaaacaaaacaaaacaaaaacaacaacaaaaaa

SEQ ID NO: 136594 - RNA, 64 nt, Human
ucuccccauucugugcccuacuauuuucaacaaaacaaaacaaacaagcaaaaaacacaaaaac

SEQ ID NO: 136595 - RNA, 64 nt, Human
ucuccucuccccauucugugcccuacuauuuucaacaaaacaaaacaaacaagcaaaaaacaca

SEQ ID NO: 136596 - RNA, 64 nt, Human
uuguuuacaugugagugaaacugcacaaaggaacacaaaacaaaacuugcacuuuaacgguagu

SEQ ID NO: 136597 - RNA, 64 nt, Human
uguauuugauggcuccaagggcuauaaauuacaaacaaaacacaucccagacauuaggaguuca

SEQ ID NO: 136598 - RNA, 64 nt, Human
aaaggaauaugaaaacagagacuauaaagauuucacaaaacaggaccugccuacggcugaacgg

SEQ ID NO: 136599 - RNA, 64 nt, Human
cuggcuugcagcuggugauggucaagaacugacuacaaaacaggaauggauagacucuauuucc

SEQ ID NO: 136600 - RNA, 64 nt, Human
gcaaguuugcuggggaguuugauaaaaguauaaaacaaaacaaaaaaagccucgguauaauuuu

SEQ ID NO: 136601 - RNA, 64 nt, Human
aagucacaagcuuucggaugggcgguggcuuuucacaaaacauuuagcucaucuuauucucucu

SEQ ID NO: 136602 - RNA, 64 nt, Human
gcagugguucacuuuaaaacacacacauacacacacaaaacaauuuuuuaagaaauccuaauaa

SEQ ID NO: 136603 - RNA, 64 nt, Human
ucaggaaacucaaaucgaauagggaaguaaaaaaacaaaacaaaaaacaaaaaaaacaaaaaaa

SEQ ID NO: 136604 - RNA, 64 nt, Human
ccuuuuucuaaaaaacaaacaaaaaaaaaaacacacaaaacaaaaacagaacaaaagaagagag

SEQ ID NO: 136605 - RNA, 64 nt, Human
ccuacaucagggacagguaucugugugucauuauacaaaacaguucuaggggguugaacuacau

SEQ ID NO: 136606 - RNA, 64 nt, Human; identical to SEQ ID NO: 136582

SEQ ID NO: 136607 - RNA, 64 nt, Human
accaaccugaagacaccguucauucaggcaacgcacaaaacagaaaaugaagguggaacaagca

SEQ ID NO: 136608 - RNA, 64 nt, Human
cucuugugaacugucuuggcugugagcaacugcgacaaaacauuuugaaggaaaauuaaaccaa

SEQ ID NO: 136609 - RNA, 64 nt, Human
gggguagaauucuccauuuauuuuacuacuuaauacaaaacauuuauuuuugaccaguccugug

SEQ ID NO: 136610 - RNA, 64 nt, Human
cacacguuggucuuuuaaccgugcugagcagaaaacaaaacagguuaagaagagccggguggca

SEQ ID NO: 136611 - RNA, 64 nt, Human
cuuguauauacuauuauuacaccuugauaucuauacaaaacaucacuuguauuaaaauauauag

SEQ ID NO: 136612 - RNA, 64 nt, Human
acaaauucuugugaguccuaauuccuccuuauccacaaaacagucaauguucccguggaguggu

SEQ ID NO: 136613 - RNA, 64 nt, Human
acuugaggccaggagucugagacaagccuaggcaacaaaacaagacucugucucuacaaaaagu

SEQ ID NO: 136614 - RNA, 64 nt, Human
aaauuuauccugugaaacuggcuuuauagaguuaacaaaacagagucagagaccacugucuuaa

SEQ ID NO: 136615 - RNA, 64 nt, Human
uugcuuccaaaguaagugaauagaauacaauaaaacaaaacaaugacacaaaaccacaaucauc

SEQ ID NO: 136616 - RNA, 64 nt, Human
ccagaaugauaugcaaaaacuacuuuuuagagaaacaaaacaacuuuguagcaacaaauuaaau

SEQ ID NO: 136617 - RNA, 64 nt, Human
uaauugaauugguuuuucccacgucuaacuggaaacaaaacagaaggggcgucauaaauuugaa

SEQ ID NO: 136618 - RNA, 64 nt, Human
uucuuuuuccuuuuuuuuuaaaaaaacaaaacaaacaaaacaccuugaaucaaguuuguuugua

SEQ ID NO: 136619 - RNA, 64 nt, Human
ccuuugucuuucuuuuuccuuuuuuuuuaaaaaaacaaaacaaacaaaacaccuugaaucaagu

SEQ ID NO: 136620 - RNA, 64 nt, Human
cauguuuauaucuuucguuauggauaaaguauuuacaaaacagugacauuugauucaauuguug

SEQ ID NO: 136621 - RNA, 64 nt, Human
auaugguaaauuuuauauuuguauauuuacaguuacaaaacaaauguacuuuuaccuuuuauuu

SEQ ID NO: 136622 - RNA, 64 nt, Human
aguauguucccaaaucugugcuggcauugaaaggacaaaacauuauacuaguggguuuuucuac

SEQ ID NO: 136623 - RNA, 64 nt, Human
uuccagugcugccuucuuuacacugccaguuuugacaaaacagguuuguuuuuuauuuuacaac

SEQ ID NO: 136624 - RNA, 64 nt, Human
uugggagauguuuauuuacauugucagacuauucacaaaacagauucuaaaauuuguuugcucg

SEQ ID NO: 136625 - RNA, 64 nt, Human
gaaaauauagaauuccuggauaagaccaaacaaaacaaaacauuaaaauaccuguauguuuugu

SEQ ID NO: 136626 - RNA, 64 nt, Human
ggagagaaaauauagaauuccuggauaagaccaaacaaaacaaaacauuaaaauaccuguaugu

SEQ ID NO: 136627 - RNA, 64 nt, Human
aauauaucucuuucuuuuucuuccgacauuagaaacaaaacaaaaagaacuguccuuucugcgc

SEQ ID NO: 136628 - RNA, 64 nt, Human
aaagugugcgcuccauucucaguggggguucaccacaaaacacgggccccaggagggaagcgcu

SEQ ID NO: 136629 - RNA, 64 nt, Human
aaucugugcgacagagugagacccugucucaaaaacaaaacaacaacaacaaaaaaaaaacagg

SEQ ID NO: 136630 - RNA, 64 nt, Human
aacaccccugccgacucccagcccggccaaaaagacaaaacacauagacgcacacacucaggag

SEQ ID NO: 136631 - RNA, 64 nt, Human
guucuuugaaaacauaaaagccugcaauuucucgacaaaacaacacaagauuuuuuaaagaugg

SEQ ID NO: 136632 - RNA, 64 nt, Human
aaaguuguuuucuagauuuguggcuuuaagaaaaacaaaacaaaacaaacacauuguuuuucuc

SEQ ID NO: 136633 - RNA, 64 nt, Human
uguuuucuagauuuguggcuuuaagaaaaacaaaacaaaacaaacacauuguuuuucucagaac

SEQ ID NO: 136634 - RNA, 64 nt, Human
uguugcaugcaaaucaaguggacaagaaaaaauaacaaaacaaaaaacaagaaaaaaaaaacac

SEQ ID NO: 136635 - RNA, 64 nt, Human
agaugucacaagggauuggcaauuguccccagggacaaaacacugugucccccccagugcaggg

SEQ ID NO: 136636 - RNA, 64 nt, Human
ggggagggggacauagcgagacucggucucaaaaacaaaacaaaacaaaacaaaacaaaacaaa

SEQ ID NO: 136637 - RNA, 64 nt, Human
gggggacauagcgagacucggucucaaaaacaaaacaaaacaaaacaaaacaaaacaaaaacaa

SEQ ID NO: 136638 - RNA, 64 nt, Human
acauagcgagacucggucucaaaaacaaaacaaaacaaaacaaaacaaaacaaaaacaaaacaa

SEQ ID NO: 136639 - RNA, 64 nt, Human
gcgagacucggucucaaaaacaaaacaaaacaaaacaaaacaaaacaaaacaaaacaaaacaaa

SEQ ID NO: 136640 - RNA, 64 nt, Human
acucggucucaaaaacaaaacaaaacaaaacaaaacaaaacaaaacaaaacaaaacaaaacacu

SEQ ID NO: 136641 - RNA, 64 nt, Human
gucucaaaaacaaaacaaaacaaaacaaaacaaaacaaaacaaaacaaaacaaaacacugccaa

SEQ ID NO: 136642 - RNA, 64 nt, Human
aaaaacaaaacaaaacaaaacaaaacaaaacaaaacaaaacaaaacaaaacacugccaaacugu

SEQ ID NO: 136643 - RNA, 64 nt, Human
caaaacaaaacaaaacaaaacaaaacaaaacaaaacaaaacaaaacacugccaaacuguuucca

SEQ ID NO: 136644 - RNA, 64 nt, Human
aaaacaaaacaaaacaaaaacaaaacaaaacaaaacaaaacacugccaaacuguuuccaaagca

SEQ ID NO: 136645 - RNA, 64 nt, Human
uucuaagaaccaaaaaaaaaaaaggaaaaaaaacacaaaacaacaaaaaccaaaaaaaaaaaaa

SEQ ID NO: 136646 - RNA, 64 nt, Human
uaaagucaacugauuauggacuuuaaucacaucuacaaaacacuuccauggcgacagcuagaug

SEQ ID NO: 136647 - RNA, 64 nt, Human
uucuuuccugaguucaggugacugaggaagagccacaaaacaaaacacaacaaaaccaaaccac

SEQ ID NO: 136648 - RNA, 64 nt, Human
uccugaguucaggugacugaggaagagccacaaaacaaaacacaacaaaaccaaaccacagaau

SEQ ID NO: 136649 - RNA, 64 nt, Human
ggugauucccccugcccuugcccccuuccccagaacaaaacauguugaucaugugcaauauuuc

SEQ ID NO: 136650 - RNA, 63 nt, Human
ccucccuccucgcucugugaacucuuuagacacacaaaacaaacaaacacaugggggagagag

SEQ ID NO: 136651 - RNA, 64 nt, Human
gaugacaacugaguggggaaaacagaccgugaacacaaaacaucaaguuccacacacgcuaugg

SEQ ID NO: 136652 - RNA, 64 nt, Human
uccaggcaaggaaaacugaagucauuggcccgauacaaaacauuuccugcaacgaaggaggugg

SEQ ID NO: 136653 - RNA, 64 nt, Human
aaauauguaacuggaaucucaaaaguucuuugggacaaaacagaaguccauggaguuaucuaag

SEQ ID NO: 136654 - RNA, 64 nt, Human
cuccagaaacuaaagaguaauguuucuagaaugcacaaaacauuguuagucuguggguuuagaa

SEQ ID NO: 136655 - RNA, 64 nt, Human
caggacuguguucuuucuggaguuuucgcugagaacaaaacaguguugucuggacccuggagug

SEQ ID NO: 136656 - RNA, 64 nt, Human
guuacauugauaggauacauacugaaaucagcaaacaaaacagauguauagauuagagugugga

SEQ ID NO: 136657 - RNA, 64 nt, Human
cacagccguggguuacgcaaugauuucuuaguacacaaaacacagcaaacauaaaaaguuguua

SEQ ID NO: 136658 - RNA, 64 nt, Human
agaccucucaauucacaaugaguuaacugauaaaacaaaacagaagucagacaauguuuuaaau

SEQ ID NO: 136659 - RNA, 64 nt, Human
ccauauaauuuuuaggauuaguuuguacuuauuuacaaaacagucuuguucagauuuuuacaga

SEQ ID NO: 136660 - RNA, 64 nt, Human
guuuacaaccaggaaauagcuugucaucuuugauacaaaacagaaaucuuugcaaaauaccaau

SEQ ID NO: 136661 - RNA, 64 nt, Human
uuuuuuuccaguaaacaaaaccugaaagcaagcaacaaaacauacacuuugucagagaagaaaa

SEQ ID NO: 136662 - RNA, 64 nt, Human
ucucaggcagggcaucauucaguaauuagcucaaacaaaacaucucaaguccccaaaaccuuua

SEQ ID NO: 136663 - RNA, 64 nt, Human
uggucucagaggcucugcuuccuuagguuacaaaacaaaacagggagagaaaaagcaaaccgcg

SEQ ID NO: 136664 - RNA, 64 nt, Human
guguguggucucagaggcucugcuuccuuagguuacaaaacaaaacagggagagaaaaagcaaa

SEQ ID NO: 136665 - RNA, 64 nt, Human
auaaaaaacuguaaaaaaaaaaaaaaaaaaaaagacaaaacaaaagacaaaaaaaaaaaaaaaa

SEQ ID NO: 136666 - RNA, 64 nt, Human
gugggaaaccuucaggaaccuggccacuauaggaacaaaacaaaaagaauggaacauugaagag

SEQ ID NO: 136667 - RNA, 64 nt, Human
caaaccaauuuugggucgagugcauuuaacgagaacaaaacaaaaggcucauaacaacaagaac

SEQ ID NO: 136668 - RNA, 64 nt, Human
gguaacagagcgagacuccaucucaaaaaaaaaaacaaaacaaaaccaaguucccacuggugau

SEQ ID NO: 136669 - RNA, 64 nt, Human
uguaccuguuuuccgaagaaaaaagcaauacugaacaaaacaaaucauuuuaacaagaugacua

SEQ ID NO: 136670 - RNA, 64 nt, Human
uucaguauguuggcauuacuuggaccugguuugaacaaaacauaaaaagccauuuuggagacag

SEQ ID NO: 136671 - RNA, 64 nt, Human
uuauguguguguauaaaacuccugugggaaagaaacaaaacaucauucuauaagucaguauacu

SEQ ID NO: 136672 - RNA, 64 nt, Human
uucuucuccugcaaggaucucgguggacucagucacaaaacaaaggcuaaaccaggauuuauaa

SEQ ID NO: 136673 - RNA, 64 nt, Human
ugcugaaauauuuuaauaaucagagcuaucauagacaaaacauuuguuuuauagagucaguagu

SEQ ID NO: 136674 - RNA, 64 nt, Human
ggcaacauggugaaaccccaucucuacaaaaaauacaaaacauagcugggcuugguggugugug

SEQ ID NO: 136675 - RNA, 64 nt, Human
caacagagcgagacuccaacucagaaaaagcaaaacaaaacaaacaaacaagcaaaaaaccaca

SEQ ID NO: 136676 - RNA, 64 nt, Human
aguuacuucauguuuugugucagagaaaacauguacaaaacauuugagaaaauauuuuaggaca

SEQ ID NO: 136677 - RNA, 64 nt, Human
gccugugcaacauggugaaaccucaucucuaccaacaaaacaaaaaaacacaaaaauuagccag

SEQ ID NO: 136678 - RNA, 64 nt, Human
acacagcaaguucuuguuuccaaacaacaacaaaacaaaacaaaaaaaaaaccggauagaauaa

SEQ ID NO: 136679 - RNA, 64 nt, Human
gggcgacacagcaaguucuuguuuccaaacaacaacaaaacaaaacaaaaaaaaaaccggauag

SEQ ID NO: 136680 - RNA, 64 nt, Human
uaauggaauugauuuucaguaacugaauuugugcacaaaacauucuaaacacuagugaagccug

SEQ ID NO: 136681 - RNA, 64 nt, Human
uggaggcaauuaugaggguagcauuucuuucgagacaaaacacccgucugggaaggccccaagg

SEQ ID NO: 136682 - RNA, 64 nt, Human
acaguagcauacugaugagacaacacacacacacacaaaacaacagcaacaacaacagaacaac

SEQ ID NO: 136683 - RNA, 54 nt, Human
aguccagaauguugaccuaauuuuacaaaacaagcugcauaucagcugaugaau

SEQ ID NO: 136684 - RNA, 64 nt, Human
accagccugagcaacauggcaaaaucccaucucuacaaaacaucaaaaaaaaaaaaaauuaguc

SEQ ID NO: 136685 - RNA, 64 nt, Human
ucaacaagucuucuauuuacaaacuucaaaaaacacaaaacaacauucauguuuuaaaugcuuu

SEQ ID NO: 136686 - RNA, 64 nt, Human
aagggaauucucuuuaaagaaaccaccaccaacaacaaaacaaccaaaaaccauguuuuauguc

SEQ ID NO: 136687 - RNA, 64 nt, Human
uaauugccuaagucugggaacugcuuccacugggacaaaacauucuccugcugcucuuggaugc

SEQ ID NO: 136688 - RNA, 64 nt, Human
gaacauaaauucauguaaagccauuuucucuuaaacaaaacaaaacuuucuaaguacagucauu

SEQ ID NO: 136689 - RNA, 64 nt, Human
aaauugacauugucauugacaaacauggcuaaaaacaaaacaucaaauccugcccccgugaaga

SEQ ID NO: 136690 - RNA, 64 nt, Human
aagggcugucaccaucaccugcugcuaggacacuacaaaacaaucaaauaauucuuuucuguaa

SEQ ID NO: 136691 - RNA, 64 nt, Human
auaaauacuguuaauuggagaugugaguuuguacacaaaacaucagacuagaccuuuguauggg

SEQ ID NO: 136692 - RNA, 64 nt, Human
gugucuaauuuuuuuuccuguugaauggguaaaaacaaaacaaaacuuuuuuuagaagaugaau

SEQ ID NO: 136693 - RNA, 64 nt, Human
ggugacagagcgagacccugucuuaaaaaaaaaaacaaaacaaaaccagcaucuguuacuggaa

SEQ ID NO: 136694 - RNA, 64 nt, Human
gucuggucggcaagagugagacuccgucucaaaaacaaaacaaaacaaaaaaaccacauaacau

SEQ ID NO: 136695 - RNA, 64 nt, Human
gucggcaagagugagacuccgucucaaaaacaaaacaaaacaaaaaaaccacauaacauaaauu

SEQ ID NO: 136696 - RNA, 64 nt, Human
cguguacagauggaaacuucauuuaaaaauaaaaacaaaacaacucaaaaaggaauaaaauuua

SEQ ID NO: 136697 - RNA, 64 nt, Human
uuucaucugauaucucacaauguaugauauacguacaaaacacacagcaaguuuucuaucaugu

SEQ ID NO: 136698 - RNA, 64 nt, Human
ugcaauaagucauuguaagugcacugauaucuucacaaaacaccacuauuugauguguacagag

SEQ ID NO: 136699 - RNA, 64 nt, Human
gggucuauuuguguggcaguuauuggguuuggucacaaaacauccugaaaauucgugcgugggc

SEQ ID NO: 136700 - RNA, 64 nt, Human
uuuuauacaugaaaauuuguuugacaauaaucucacaaaacauauuuuacaucugaacaaaaug

SEQ ID NO: 136701 - RNA, 64 nt, Human
caccauucgcuguuggcaagaaacggcuuuacuuacaaaacagacucuuuaccuucugcugugu

SEQ ID NO: 136702 - RNA, 64 nt, Human
uguucugcauuccacauguaagugaauugcaaaaacaaaacaaaacucacucucuuguagguuu

SEQ ID NO: 136703 - RNA, 64 nt, Human
aguccagguuccagcaacacuagcuaccuaccaaacaaaacacuucugagcuuuucuugccauu

SEQ ID NO: 136704 - RNA, 64 nt, Human
ggacauugguguguuuagagauuuuaguuuaaaaacaaaacaaaaagauugaucaaaucuguac

SEQ ID NO: 136705 - RNA, 64 nt, Human
ucaaucuguccaucuaccaggccucgcgauaaaaacaaaacaaaaaaacgcugccagguuuuag

SEQ ID NO: 136706 - RNA, 64 nt, Human
uggaaaccauaucauucauauuuagaaguaaaacacaaaacaaaaaagagagagaaaagaaaag

SEQ ID NO: 136707 - RNA, 64 nt, Human
cauauauauauaaauauaaauauauauaaaaacaacaaaacaaaacaaaaaaagaaaaaaaaac

SEQ ID NO: 136708 - RNA, 64 nt, Human
auauauaaauauaaauauauauaaaaacaacaaaacaaaacaaaaaaagaaaaaaaaacaaaaa

SEQ ID NO: 136709 - RNA, 64 nt, Human
cccugcucugaaauaggacauuuuuccuacaguaacaaaacaggaaucaaacucaaggcuguga

SEQ ID NO: 136710 - RNA, 64 nt, Human
ugccaagucuucaacucuucauugagcuaucuucacaaaacaguccuuugaaacugaggaaaac

SEQ ID NO: 136711 - RNA, 64 nt, Human
aacaaauaucguuaaguuaaacaaguuuucaaaaacaaaacaauuuuuaaaguaccuuaaaauu

SEQ ID NO: 136712 - RNA, 64 nt, Human
agaaauuuagacccagaauugcagcuucaacaacacaaaacaggaaagcuagaagagguugcug

SEQ ID NO: 136713 - RNA, 64 nt, Human
ggcuuuguuagcacuuuuuaaaacaaacaaacaaacaaaacaaaaaagcaaaccacauuuguua

SEQ ID NO: 136714 - RNA, 64 nt, Human
aucaugacugagccaaucacuguuucucagaaaaacaaaacaaaacaaaacaaaugacaguaac

SEQ ID NO: 136715 - RNA, 64 nt, Human
gacugagccaaucacuguuucucagaaaaacaaaacaaaacaaaacaaaugacaguaacccuuc

SEQ ID NO: 136716 - RNA, 64 nt, Human
agccaaucacuguuucucagaaaaacaaaacaaaacaaaacaaaugacaguaacccuuccccgg

SEQ ID NO: 136717 - RNA, 64 nt, Human
agccugggugacagagcaagacucugucuaaaaaacaaaacaaaacaaaacaaaacaaaaaaac

SEQ ID NO: 136718 - RNA, 64 nt, Human
gggugacagagcaagacucugucuaaaaaacaaaacaaaacaaaacaaaacaaaaaaaccucuu

SEQ ID NO: 136719 - RNA, 64 nt, Human
acagagcaagacucugucuaaaaaacaaaacaaaacaaaacaaaacaaaaaaaccucuuaauau

SEQ ID NO: 136720 - RNA, 64 nt, Human
gcaagacucugucuaaaaaacaaaacaaaacaaaacaaaacaaaaaaaccucuuaauauucugg

SEQ ID NO: 136721 - RNA, 64 nt, Human
ugauugaugaagcagaugaguuuguagcagggccacaaaacaaagugaaacguccaggggaacc

SEQ ID NO: 136722 - RNA, 64 nt, Human
uguucagauuuuccagugaaaaauacccuucugaacaaaacauguacuuacucuccgaaaggca

SEQ ID NO: 136723 - RNA, 64 nt, Human
uuucaacuguauauaucuauaguuuguaaaaagaacaaaacaaccgagacaaacccuugaugcu

SEQ ID NO: 136724 - RNA, 64 nt, Human
auuuucuuuuuaacuuuuuaaagacugugccaccacaaaacagccuuagccuccuuguugccaa

SEQ ID NO: 136725 - RNA, 64 nt, Human
gaguuacacaacuuuuaagugaaaaaaauagguaacaaaacaaccaccugauaguaaguuuucu

SEQ ID NO: 136726 - RNA, 64 nt, Human
uauaaaaaaaaguuguuuauaaaaaccccuaaaaacaaaacaaacacacacacacacacauaca

SEQ ID NO: 136727 - RNA, 64 nt, Human
aagcaauauuuaauaaaacuaggucaaaaacaaaacaaaacagugacacucacuuguguguaua

SEQ ID NO: 136728 - RNA, 64 nt, Human
caaggaagcaauauuuaauaaaacuaggucaaaaacaaaacaaaacagugacacucacuugugu

SEQ ID NO: 136729 - RNA, 64 nt, Human
cacuuaaaacaggagccuagagcccccugcccaaacaaaacaggacaucugugaccgcccuacc

SEQ ID NO: 136730 - RNA, 64 nt, Human
gguacaggaguuaaauaacaaugacacacacacaacaaaacaaacacaaaaccacugaucugug

SEQ ID NO: 136731 - RNA, 64 nt, Human
acaaaaacgaaacuccaucucaaaacaaaacaaaacaaaacaaacaaacaaacaaaacuugcau

SEQ ID NO: 136732 - RNA, 64 nt, Human
gggcgacaaaaacgaaacuccaucucaaaacaaaacaaaacaaaacaaacaaacaaacaaaacu

SEQ ID NO: 136733 - RNA, 64 nt, Human
agccugggcgacaaaaacgaaacuccaucucaaaacaaaacaaaacaaaacaaacaaacaaaca

SEQ ID NO: 136734 - RNA, 64 nt, Human
uuaaagguuuuacacaggguguaucucacauuaaacaaaacaccuuuuuuucaaaaugaaauac

SEQ ID NO: 136735 - RNA, 64 nt, Human
ccagcaaaugaggcaggcaauucuaagaucuuccacaaaacaucuagccaucuaaaauggagag

SEQ ID NO: 136736 - RNA, 64 nt, Human
accacaauuguucuucaaaaacaaacaaaacaaaacaaaacaaaauuaacugcuuaaauguuuu

SEQ ID NO: 136737 - RNA, 64 nt, Human
aaaagaccacaauuguucuucaaaaacaaacaaaacaaaacaaaacaaaauuaacugcuuaaau

SEQ ID NO: 136738 - RNA, 64 nt, Human
aauguaaaagaccacaauuguucuucaaaaacaaacaaaacaaaacaaaacaaaauuaacugcu

SEQ ID NO: 136739 - RNA, 64 nt, Human
cagaugugugcauuuggacaaauaguacuuaaaaacaaaacaaacaagcacucagcccagcucc

SEQ ID NO: 136740 - RNA, 64 nt, Human
auuaaauugccaccuucgugguuguaaaagacaaacaaaacauggcaaauuucauuaacacaaa

SEQ ID NO: 136741 - RNA, 64 nt, Human
aacucuacuucagauugucuccuuaucccaucccacaaaacagaaucuguccguuucucuagua

SEQ ID NO: 136742 - RNA, 64 nt, Human
aaagagaauagacaguaugacauauagaauuaauacaaaacaguuuaacaaccauuuaacugca

SEQ ID NO: 136743 - RNA, 64 nt, Human
cagccuggaggccagagugagacuccgucucaaaacaaaacaaaaguggguggcucacgggucc

SEQ ID NO: 136744 - RNA, 64 nt, Human
acccccagauucuucgcacagugucuagauccgaccgcccaacguuugccucccagccugacuc

SEQ ID NO: 136745 - RNA, 64 nt, Human
ucuccccaggccuccagccucucccggcugccugccgcccaaagagaaaucacaggggcggggc

SEQ ID NO: 136746 - RNA, 50 nt, Human
aaauggagcaacgugagugaccgcccaaggucacaggcacagaaccuuuc

SEQ ID NO: 136747 - RNA, 64 nt, Human
ucagcauccuuucuucgcccgccuucgggcugagccgcccaacaaguugugggacuccagucgg

SEQ ID NO: 136748 - RNA, 64 nt, Human
acugguggccgccucccugucccguguguuuccaccgcccaaucuggcuuguccuggcagugcu

SEQ ID NO: 136749 - RNA, 64 nt, Human
ggguggcggcgguaagcggggaggaaacauggcgccgcccaaaugcgcccggaggccguuaggc

SEQ ID NO: 136750 - RNA, 64 nt, Human
gggugagcgcucuggcccaggcugggccagacucccgcccaagcaugaacaggacuugaccauc

SEQ ID NO: 136751 - RNA, 64 nt, Human
accucugacccucuccuagcccuucccauacaggccgcccaacacucccccuacguugcgcugc

SEQ ID NO: 136752 - RNA, 64 nt, Human
gaaaggggcccaacccugcccacuucagcccagcccgcccaaggggacuugugccagcagaaca

SEQ ID NO: 136753 - RNA, 64 nt, Human
ggguggaucaugaggucaggaguucgagaccagcccgcccaauauggugaaaccccgucucucc

SEQ ID NO: 136754 - RNA, 64 nt, Human
aacugggagcaggguagggcugucgccuuagaucccgcccaagccccucauucccuccuugcac

SEQ ID NO: 136755 - RNA, 64 nt, Human
acccaugaaaugcccugccuccccauucgcauggccgcccaagaggcuggcucccagcaugucc

SEQ ID NO: 136756 - RNA, 64 nt, Human
ggaccaccagcagggggcugccucugcacccuacccgcccaaggagacuccacccugggguccc

SEQ ID NO: 136757 - RNA, 64 nt, Human
ugaucuaucguggccugcucgucgcaguccaaacccgcccaagacugcagcccaaucaacgccu

SEQ ID NO: 136758 - RNA, 64 nt, Human
auaugugugaauguguggcaucauuucacuucagccgcccaauuccaucucuccucugcagcca

SEQ ID NO: 136759 - RNA, 64 nt, Human
aacagacggcagacacaccugucccccagugaugccgcccaagcugcccauggggcuuccuacg

SEQ ID NO: 136760 - RNA, 64 nt, Human
cgucacugccguccccggagggccagauacggccccgcccaaaggguucugccuggcgucgggc

SEQ ID NO: 136761 - RNA, 64 nt, Human
aguggcacugauaacuggugaagccuacagccauccgcccaaaagucuguucugauggcacuga

SEQ ID NO: 136762 - RNA, 64 nt, Human
uuuuuuuuuuuuuuugagagagagucuuacucugccgcccaaacuggagugcaguggcacaauc

SEQ ID NO: 136763 - RNA, 64 nt, Human
ggccagccugcucccuggcugaggcucaggcuauccgcccaagcucuuugcucauucuagggcc

SEQ ID NO: 136764 - RNA, 64 nt, Human
cuagcacagugcagccuccauaaccaugacauucccgcccaagcucucagugccuaauccugcu

SEQ ID NO: 136765 - RNA, 64 nt, Human
auguugcuucccucuccugucuuucccacuggagccgcccaagcuuguagguggguggugugca

SEQ ID NO: 136766 - RNA, 64 nt, Human
ugugcaguggacugugggucucccauaugcggugccgcccaaagguggcuuugccucaagcaac

SEQ ID NO: 136767 - RNA, 64 nt, Human
ugcguccucccugcacucauacccccccuucaacccgcccaaauguccgauccccgaccuuccu

SEQ ID NO: 136768 - RNA, 64 nt, Human
ccacgcuggccccaacugcugcagcucucggcuuccgcccaacagccucuggaggugaggcggg

SEQ ID NO: 136769 - RNA, 64 nt, Human
cucugccccuccguccccagggugcaggcgcgcaccgcccaacccccaccucccgguguaugca

SEQ ID NO: 136770 - RNA, 64 nt, Human
acgcacuggaucacccaggucccagcagacauggccgcccaaagucagcaagccuccuuugugc

SEQ ID NO: 136771 - RNA, 64 nt, Human
ugcccggccccucgccccugccuggcacugcucaccgcccaaggcgacgccggcuggaccaggc

SEQ ID NO: 136772 - RNA, 64 nt, Human
agugccaaacuugggccgcugcaccgcggcgccuccgcccaaaucaauaaacugugucuguccc

SEQ ID NO: 136773 - RNA, 64 nt, Human
gcauggcguucaagauuuuggagaugaacugauuccgcccaaauagaaucauguuuauuuuuuc

SEQ ID NO: 136774 - RNA, 64 nt, Human
ccgaauacgcacucuugaaagcugcaucgagaacccgcccaagcgccaccugcuagacggccag

SEQ ID NO: 136775 - RNA, 64 nt, Human
uccccaggaagcuccugcgcuacuacagcaagaaccgcccaaccgaggcugucaggugcuacga

SEQ ID NO: 136776 - RNA, 64 nt, Human
gcuccuguaccaaccgcccagccacgcuccaucgccgcccaaagggaggugccaaggccaggaa

SEQ ID NO: 136777 - RNA, 64 nt, Human
uuggcucaggauguguucugggcuugcaagccccccgcccaaucauguguucaguagccguccu

SEQ ID NO: 136778 - RNA, 64 nt, Human
ccaacccaauucaggacuggcucaccccucucccccgcccaaggcugcagaggcugugggaggu

SEQ ID NO: 136779 - RNA, 64 nt, Human
caggcagcgcgagggaggagcugcgccgccggcuccgcccaaccagguggugcugagcuuccgc

SEQ ID NO: 136780 - RNA, 64 nt, Human
aucaaauucuaagggagaaaaaaacaauauuaaaccgcccaagcagugugcccuagcagaggaa

SEQ ID NO: 136781 - RNA, 64 nt, Human
ccucccccaaugucuucaagacuuuucucuccccccgcccaaccccgucucucccucccuugcc

SEQ ID NO: 136782 - RNA, 64 nt, Human
gggcucuuggcaccugcguguccugugcuuaccaccgcccaaggcccccuuggaucucuuggau

SEQ ID NO: 136783 - RNA, 64 nt, Human
cacugaagccuugacgcugugggcacugccucagccgcccaaguaucugggaccacaggcgugc

SEQ ID NO: 136784 - RNA, 64 nt, Human
aagauugaaggaugugcagggcuuccucucagagccgcccaaacugccguugauguguggaggg

SEQ ID NO: 136785 - RNA, 64 nt, Human
uccucugguggagagguccucagccagagcucgcccgcccaagagccaagagagaugucaucuu

SEQ ID NO: 136786 - RNA, 64 nt, Human
gacucuuccugcgaggucucagagcgcuguguaaccgcccaagggguucaccuugccugcugcc

SEQ ID NO: 136787 - RNA, 64 nt, Human
acggccucaggccccgccuccaaggcaucaggccccgcccaacggccucauguccccgccccca

SEQ ID NO: 136788 - RNA, 64 nt, Human
gcaccaugggcaggguugaggacugccccccaccccgcccaagccaaugcagacacugaccuca

SEQ ID NO: 136789 - RNA, 64 nt, Human
uaccccaagacucccaugagggagaugccaugagccgcccaaggccuuccccuggcacuggcaa

SEQ ID NO: 136790 - RNA, 64 nt, Human
cgaaccugugccuaauacacgcaagggcgcugucccgcccaaccccgccuuuaaacgccacaaa

SEQ ID NO: 136791 - RNA, 64 nt, Human
uaggcugcuggaguccuggaaccaccugggucggccgcccaaaucuuuccuggcgaaggggagg

SEQ ID NO: 136792 - RNA, 64 nt, Human
agggaaaugucaggggcggggagggugacaguggccgcccaaggcccacgagcuuguucuuugu

SEQ ID NO: 136793 - RNA, 64 nt, Human
gcugccgccccaacugcugccagaccaugugcugccgcccaaccugcucuagugcuucuugcug

SEQ ID NO: 136794 - RNA, 64 nt, Human
cgguaggagcucucccgguaccaguguccacagaccgcccaacacagaggcuuugaggcuucuc

SEQ ID NO: 136795 - RNA, 64 nt, Human
cggcggggacucggagggugccgugcgggcgaggccgcccaaauuuggcaauaaauaaagcuug

SEQ ID NO: 136796 - RNA, 64 nt, Human
cgcccgcguagacgcgcuggacgccgccuccucgccgcccaaugcggcagccugcccgucggcg

SEQ ID NO: 136797 - RNA, 51 nt, Human
ugcuacaauccagcuucuaauccgcccaaaagcggcagccaaucggagcgc

SEQ ID NO: 136798 - RNA, 64 nt, Human
augagaaacccaaagcugagagagguguggggaaccgcccaaggucacccagcugugaaugaac

SEQ ID NO: 136799 - RNA, 64 nt, Human
gaacuccuggccucaagugauccacccaccucagccgcccaaaguguugggauuacaggcauga

SEQ ID NO: 136800 - RNA, 64 nt, Human
augagguucccugcaacccccgcccuccagcccaccgcccaaccuuuuacaaauggcauuuucu

SEQ ID NO: 136801 - RNA, 64 nt, Human
cuggcucuggacuguggccaaccuucuccacauuccgcccaaucuguaccggaugcuggcaggg

SEQ ID NO: 136802 - RNA, 64 nt, Human
cguagccaggccuggaggccccccaggcaggaggccgcccaaaggcggggccggcgucucgcag

SEQ ID NO: 136803 - RNA, 53 nt, Human
cagcccgccuugugccuuaggccccgcccaagccaccagggagccaaucucag

SEQ ID NO: 136804 - RNA, 64 nt, Human
agccuaccucugacagcgcggggcucacuaguuaccgcccaaccuggauccggcgcguguggcc

SEQ ID NO: 136805 - RNA, 64 nt, Human
ugcuguaugcuugaacuucggaaaaugcuuuuccccgcccaaucuucucucaaauauaaacaca

SEQ ID NO: 136806 - RNA, 64 nt, Human
gaccagacaagcuguugaccaggcaccuccccucccgcccaaaccuuucccccauguggucguu

SEQ ID NO: 136807 - RNA, 64 nt, Human
caugaagaagacuaagccuacuucaucucaggacccgcccaagaguggccgcggcuuugggaca

SEQ ID NO: 136808 - RNA, 64 nt, Human
uucguguuuuauaaauagcucucauagucugcuccaucuugauaguuaagugauuucugaagcg

SEQ ID NO: 136809 - RNA, 64 nt, Human
gauaugguuaagcuuuguguccccacccacaucucaucuugaaugguaauccuggguguuuagg

SEQ ID NO: 136810 - RNA, 64 nt, Human
cccauuguauguuuguggaaagagcauaguuuaacaucuugagaaauuugggacauaaaguuuu

SEQ ID NO: 136811 - RNA, 64 nt, Human
acgacaagccugugaggcagaugcucauuguucccaucuugaugaaacuugagucucagggaag

SEQ ID NO: 136812 - RNA, 64 nt, Human
ccaccuccuucaccaccccacuuggcuccuuugccaucuugaugcugagguuuccuguuuggug

SEQ ID NO: 136813 - RNA, 64 nt, Human
gacucaauggcuuguugaaucucagcaguuccgccaucuugaagaaugauugauugucaaacac

SEQ ID NO: 136814 - RNA, 64 nt, Human
caagucacuuaaccucucuuugccucaauuuccucaucuugaaaugaggauaauaauaccugcu

SEQ ID NO: 136815 - RNA, 64 nt, Human
aacaaucuuaacuaugcacaugaugugaccagaucaucuugaaaauauuccucuuuaguaggaa

SEQ ID NO: 136816 - RNA, 64 nt, Human
acucagcucaccuguauauuuaaacuguucuuggcaucuugaaacaccuauuucuacucaggua

SEQ ID NO: 136817 - RNA, 64 nt, Human
aauaacccagaugcucuuucauauucuuuuaauacaucuugaucacagcugggggaaaaaaagc

SEQ ID NO: 136818 - RNA, 64 nt, Human
aagugaaagauucaucuuguaauaguuaaaccuccaucuugaagcuucuaugguucauagucuu

SEQ ID NO: 136819 - RNA, 64 nt, Human
aauugccagccucugucaugagaagguauagccccaucuugauagaagaguuacuccgagcuuu

SEQ ID NO: 136820 - RNA, 64 nt, Human
uucucaagaaaagaaaauuggauuauuaggaauacaucuugacccuuuuccacucaauagacca

SEQ ID NO: 136821 - RNA, 64 nt, Human
acagguggcccuucacagggggcagcgggacaggcaucuugaagggcauauguccucggaagcu

SEQ ID NO: 136822 - RNA, 64 nt, Human
uucacuccccucucaucguccggccuucucccuucaucuugaucugggaagaaugaaaugaacu

SEQ ID NO: 136823 - RNA, 64 nt, Human
augacacaggaugcuacaugcacuccugcuagcacaucuugaucuguugaauguucauucuuuc

SEQ ID NO: 136824 - RNA, 64 nt, Human
ccucugccagcaggugucuguccccggcccagcgcaucuugaaggcccuggacucuguuaccag

SEQ ID NO: 136825 - RNA, 64 nt, Human
cuuggcaaccauauugucaccuguaccugucacacaucuugaaaaauaaaacgauaauagaacu

SEQ ID NO: 136826 - RNA, 64 nt, Human
agacagaaguaguuaaacaucuacaagguaagugcaucuugaagacguguuaaguuaaagaagc

SEQ ID NO: 136827 - RNA, 64 nt, Human
agggacagcugugaugcccuuuugcuggggcugccaucuugaaaucugagugcaauaggauuug

SEQ ID NO: 136828 - RNA, 64 nt, Human
uugauaugguuuggauguauccccacccaagucucaucuugaauuuuaauccucauaauuccca

SEQ ID NO: 136829 - RNA, 64 nt, Human
ggggcuuauagcuccaauaauggaaugguucugccaucuugaaacccccauucuguuuccagcc

SEQ ID NO: 136830 - RNA, 64 nt, Human
aggaaacaagaaucccaagggcccaggaaaaccccaucuugaugcaugaguucccagauacccu

SEQ ID NO: 136831 - RNA, 64 nt, Human
gugugaagaucccuggugcguggccuucaccacgcaucuugagcaaauuaggaaaauguacccu

SEQ ID NO: 136832 - RNA, 64 nt, Human
uaccuuaaaucugccuuuguuucuaaagguagaucaucuugaauauuugcuuaaaauugcuagu

SEQ ID NO: 136833 - RNA, 64 nt, Human
caguugauacugacauuguucacucaucaaaccacaucuugaugcuaaguaacauuucccauga

SEQ ID NO: 136834 - RNA, 64 nt, Human
cauuaauagaaaacccuucuuucccaccccuccccaucuugacauuuucuuuuuuaggauguug

SEQ ID NO: 136835 - RNA, 64 nt, Human
uuuuuggaaaauuuaagaaacucuccaggcucuccaucuugauuuaugcuugaguuguuaugug

SEQ ID NO: 136836 - RNA, 64 nt, Human
gauaagaaaugaucuuuacguggcaaaaugaacacaucuugaguauuuaggaaaugggcaguga

SEQ ID NO: 136837 - RNA, 64 nt, Human
gcuccccggggccgccgcaacgaagguggauccgcaucuugauuguucuccgggagccuccugg

SEQ ID NO: 136838 - RNA, 64 nt, Human
cuuuuucuuguuuugucugccauucuugaaagugcaucuugagagcccccauuuguuguguaga

SEQ ID NO: 136839 - RNA, 64 nt, Human
ucaaaaaaauuuuuauucaaggcaaagcaaggaacaucuugagauaugucucaagaauauaaag

SEQ ID NO: 136840 - RNA, 64 nt, Human
augcagaugccguuaauuuuuuacccuauguuuacaucuugaggcagcagagucugucugcagc

SEQ ID NO: 136841 - RNA, 64 nt, Human
aauuuuauuuaguucuugaguagaucugcuucuucaucuugacauguaaugaauggucaguugu

SEQ ID NO: 136842 - RNA, 64 nt, Human
ccaggacuaccauugaccucagagcuguaccccacaucuugaaguaaauugaucccaccagguc

SEQ ID NO: 136843 - RNA, 64 nt, Human
guacaucuauaugacagauguauuuuaaaaguuucaucuugaaguaaaaguacaacagcuugaa

SEQ ID NO: 136844 - RNA, 64 nt, Human
ucagcaggcagugagugucacacaccuguuaauccaucuugagcaggacaguacuauacaaaua

SEQ ID NO: 136845 - RNA, 64 nt, Human
aggcaguucucucacugaacacaugccuuccuuucaucuugaauaacuuuguccuaaaaugaau

SEQ ID NO: 136846 - RNA, 64 nt, Human
gaauccugacaucccagccagccggccagacucucaucuugaugucuugauggauggaccccag

SEQ ID NO: 136847 - RNA, 64 nt, Human
guagaaggaauugccuuucuuuuuuaaacagcaucaucuugauucuuagcuuggacagcaccuu

SEQ ID NO: 136848 - RNA, 64 nt, Human
aaaugggauagauuuggauaaaauuuuaacucaacaucuugauuuggagccugggguuucggga

SEQ ID NO: 136849 - RNA, 64 nt, Human
ucagaaacuuaacugcaguuuuuaaguuaugcuacaucuugacccacuagaauuagcaacuuua

SEQ ID NO: 136850 - RNA, 64 nt, Human
auaccugccuugugucugaguucuauuuaguuagcaucuugaaauuuguauucauuuuccagau

SEQ ID NO: 136851 - RNA, 64 nt, Human
aaaguggccuuaaauaugaguagugaauugagaacaucuugaauucuuaaaagacuucuuagug

SEQ ID NO: 136852 - RNA, 64 nt, Human
gaggugagacggcccucguccugguguuccugaucaucuugaaagguucuucuggaacuccugu

SEQ ID NO: 136853 - RNA, 64 nt, Human
guccguuuagagagcaaaccauauugugccucuucaucuugacccaggcucuuauagauagguc

SEQ ID NO: 136854 - RNA, 64 nt, Human
cucugcugcuaaauaugcauguucugacugacaccaucuugaugccaguacuggauuccagcau

SEQ ID NO: 136855 - RNA, 64 nt, Human
gaaguucugcuguuuuguuauaaugccugauacacaucuugaauaaagucuuaacauuuuucuu

SEQ ID NO: 136856 - RNA, 64 nt, Human
gaaaauuagcuuuuaguuuuaaaacucuuuaucccaucuugauuggggcaguugacuuuuuuuu

SEQ ID NO: 136857 - RNA, 64 nt, Human
gaaacaagguguccuccaucccccagugccuucacaucuugaggauaugcuucuguacuuuuua

SEQ ID NO: 136858 - RNA, 64 nt, Human
cacgucacuguucuuuccacccauucucccuuugcaucuugagcaguuauccaacuaggaucug

SEQ ID NO: 136859 - RNA, 64 nt, Human
ccaaaagucaacccuccuaaaaguucaaccuguucaucuugaacuuggccugagaacauuuucu

SEQ ID NO: 136860 - RNA, 64 nt, Human
aagcuuuggcacucuuuugacuggugccauuagacaucuugauuauugugacaacucuagaccu

SEQ ID NO: 136861 - RNA, 64 nt, Human
guugguuugauuugaucugcucucugugaggccucaucuugaaccagaccuuaacgaccaaacc

SEQ ID NO: 136862 - RNA, 64 nt, Human
aaaccaacuaauauacaaccauauaaaugaaggccaucuugauggucucaacacuaauuuuuau

SEQ ID NO: 136863 - RNA, 64 nt, Human
uuccuuuuucuuuuccagucauggcuccgaucuucaucuugaagaagagugacauugggugacu

SEQ ID NO: 136864 - RNA, 64 nt, Human
ggaccaaaggcaucacuucugauggagaugaagccaucuugaaagugagugguguccuuuggag

SEQ ID NO: 136865 - RNA, 64 nt, Human
uaaacuuauuaaugggugagaaucuaauuuuacucaucuugauggcuucaugauccagcacagu

SEQ ID NO: 136866 - RNA, 64 nt, Human
cuauuauggggaauggauacaaaagcagagcucccaucuugacuuucaauuccucaucagaagu

SEQ ID NO: 136867 - RNA, 64 nt, Human
uaauucccuuccuuaucauagugggcaucugucucaucuugauagucauuuucaugguagguac

SEQ ID NO: 136868 - RNA, 64 nt, Human
augcauaccuaguuaguuuccuauauauucaugccaucuugaaaagacagacuaugguguaacc

SEQ ID NO: 136869 - RNA, 64 nt, Human
uucccccacuuuucucucuauuuguauuguuagccaucuugaagugauguuguuuaacauaaau

SEQ ID NO: 136870 - RNA, 64 nt, Human
gaggccagauggucagauaugauuucugcaaacccaucuugaccuugaguaugugaagggguac

SEQ ID NO: 136871 - RNA, 64 nt, Human
cuuauuuugaugaucagaggucuugaggucuugacaucuugacauauacacugaaaaaaauggg

SEQ ID NO: 136872 - RNA, 64 nt, Human
ggggcggcucuugugguuucaaaaucucuggcaccaucuugaccucuuggcucucucugcacuu

SEQ ID NO: 136873 - RNA, 64 nt, Human
uugcugcugauauauuagaauaauuuuuaaaugucaucuugaaauagaaauauguauuuuaagc

SEQ ID NO: 136874 - RNA, 64 nt, Human
uaggucgguucgugguuaucccauuguggaaauucaucuugaaucccauuguccuauaguccua

SEQ ID NO: 136875 - RNA, 64 nt, Human
cuuuccucuuaagcacuuuuaaaauaauaaaguacaucuugaaauuuggggaggcaucucugau

SEQ ID NO: 136876 - RNA, 64 nt, Human
uuggaggacccaccugugaggacccugaccuggccaucuugagggguuuucuaacccccagguc

SEQ ID NO: 136877 - RNA, 64 nt, Human
acuaauuucgaaccauagcuuucauuuuaagcaucaucuugaauuucuaaacuuuuuucuaugu

SEQ ID NO: 136878 - RNA, 64 nt, Human
cuuucaggaaagggaggagcacaaggacucugugcaucuugacugcaccccaaagaggcuccag

SEQ ID NO: 136879 - RNA, 64 nt, Human
auuucucaaaaauagcugauuggcaaaauaucgucaucuugacaauauuugcucuauaucuuau

SEQ ID NO: 136880 - RNA, 64 nt, Human
agcuucccuccugaugauggcucauaaucugaagcaucuugagcugggggugugagggggaggg

SEQ ID NO: 136881 - RNA, 64 nt, Human
cuuuccaguuuugcauccagugacgucugcuuggcaucuugagauuguuauggugagaguauuu

SEQ ID NO: 136882 - RNA, 64 nt, Human
uaagucauaagauuuaaucucaacuauaaugggucaucuugacacuuugcuguuugucauuguc

SEQ ID NO: 136883 - RNA, 64 nt, Human
ucuuucagccaagaauucuuaaauauguggaguucaucuugaauuguaaggaaugauuaauuaa

SEQ ID NO: 136884 - RNA, 64 nt, Human
gcaguuagugacuggcuagaggucucuugggauccaucuugaccucaaagaauauuugcacaug

SEQ ID NO: 136885 - RNA, 64 nt, Human
uugugacuguucaucuguccuugacaguggcugucaucuugacuacuuuguugauuuguuggua

SEQ ID NO: 136886 - RNA, 64 nt, Human
uagugccuugauuuuaauucaggugauaacucaccaucuugaagucauuguccgguuuccguag

SEQ ID NO: 136887 - RNA, 64 nt, Human
cuggauuagaguucaccaugauccaauaugaccucaucuugacuacauccgcaaagacccuguc

SEQ ID NO: 136888 - RNA, 64 nt, Human
ccuccagccucuuaccaaaagaggcuuuaaaccucaucuugauucagacugucagucuauuccu

SEQ ID NO: 136889 - RNA, 64 nt, Human
uauauucuacagaguuuauucuaguauguauuuacaucuugaagaacaagaaaguuguucuugu

SEQ ID NO: 136890 - RNA, 64 nt, Human
aaacuaaaagcauaggcugcauaugagucuuuaacaucuugaacugguugugaauaauuuucug

SEQ ID NO: 136891 - RNA, 64 nt, Human
cugauaugguuuggcuguguucccacucaaaucucaucuugaauuguaguuccaauaaucccca

SEQ ID NO: 136892 - RNA, 64 nt, Human
guaccugccauccaauacggucauuagauugggucaucuugauuagauuagauuagauuagauu

SEQ ID NO: 136893 - RNA, 64 nt, Human
accauuguacauuaugaacaauagauagagauuacaucuugaugacucuugaaauauggaaauu

SEQ ID NO: 136894 - RNA, 64 nt, Human
gauuaucgucuucuaagagguugcuaaugccuuucaucuugaaguuacacauaacuucuuacua

SEQ ID NO: 136895 - RNA, 64 nt, Human
gucacauguuauuauacacuaaaaaauaggaagucaucuugaaaggcaguuaauguacugcaaa

SEQ ID NO: 136896 - RNA, 64 nt, Human
acacugaucuuauuagaggucagugcuaaguacccaucuugauugaaguuagcucagaugugga

SEQ ID NO: 136897 - RNA, 64 nt, Human
aauaaacuaaaaggaaauaaucuccacguacuaccaucuugauuaaauuguguaauuuuuuaua

SEQ ID NO: 136898 - RNA, 64 nt, Human
guaguauuucaucacaagaaaccuacucuucugucaucuugaaguaaauagaagaucaagccuu

SEQ ID NO: 136899 - RNA, 64 nt, Human
aucuauuccugaaauuucuuuuaugugauuagcucaucuugauuuuuaauauuuuuccacuuaa

SEQ ID NO: 136900 - RNA, 64 nt, Human
cugagaaaugcaaacaacuuuaugaaaguguggucaucuugacccccaaagagccacaguagcu

SEQ ID NO: 136901 - RNA, 64 nt, Human
cuuugaaguauggcuugcugaauaucuuuaccaacaucuugaauauauauucuaguguccacaa

SEQ ID NO: 136902 - RNA, 64 nt, Human
ccuaaucacaguuuuuccuggaauugccagcugacaucuugaauccuuccauuccacacagaau

SEQ ID NO: 136903 - RNA, 64 nt, Human
uguacugugaaugcuaaauauuugcaaacaaguacaucuugaaaguaaaggugacuuagagaaa

SEQ ID NO: 136904 - RNA, 64 nt, Human
gucauguacucuaucuggcucuacacaucaaucacaucuugauucaaaccucacaaggcaauau

SEQ ID NO: 136905 - RNA, 64 nt, Human
gaaaauaauguaccuugauuauuaugaaauagagcaucuugaaauucaguuuuacucuaaaugu

SEQ ID NO: 136906 - RNA, 64 nt, Human
cacagguaaaaauuauuaacaauagaacuucaagcaucuugaggagcgggcauuugagggggca

SEQ ID NO: 136907 - RNA, 64 nt, Human
ugcauccaucucuuguacuaagcgaauuguuuaucaucuugacaugguuggucauuucuaugac

SEQ ID NO: 136908 - RNA, 64 nt, Human
uuaucagaauacaaagugacacugauaggcggaucaucuugaaucugcucauugcaugagucaa

SEQ ID NO: 136909 - RNA, 64 nt, Human
gaguuagcuuuuggacaguuaccuucuuucuggccaucuugacuucugccccacaucugcuuuu

SEQ ID NO: 136910 - RNA, 64 nt, Human
aggaaaacagccuguugcaugguaagagugauaccaucuugaagugaaaccaccacaauggcca

SEQ ID NO: 136911 - RNA, 64 nt, Human
caggcaugagccauugcaccuggccaagaagagacaucuugacuugagccugaagacuauguac

SEQ ID NO: 136912 - RNA, 64 nt, Human
ugcucccggauaccccuccagcacucccuuuugucaucuugaguuucaguccgugacuugggug

SEQ ID NO: 136913 - RNA, 64 nt, Human
uugggaaagaagcuggguuuguggagaaucagagcaucuugacaugacugcugaccuaaagauc

SEQ ID NO: 136914 - RNA, 64 nt, Human
aaaugaucaacuauugaccauauagguagguaugcaucuugagaaagcuacuaugugccccuga

SEQ ID NO: 136915 - RNA, 64 nt, Human
uugauauuuguccauaggucuccuuucuauaaaucaucuugauguuuaacaacucuuauuauau

SEQ ID NO: 136916 - RNA, 64 nt, Human
agcgauaccaaaggguacacccaucugugagucacaucuugaaaaacacugagaggaaccuucu

SEQ ID NO: 136917 - RNA, 64 nt, Human
cugaacuuguuugcacugcuucuguuugaaagagcaucuugaaaaacuuccccgguaugaugau

SEQ ID NO: 136918 - RNA, 64 nt, Human
uccugccagcaggggugugauguaccaguuuguccaucuugagauggugaggcugucaguguau

SEQ ID NO: 136919 - RNA, 64 nt, Human
cggugguggugauguugggaagauguuucccugccaucuugagauuuuuuacuuuuuuaaaaaa

SEQ ID NO: 136920 - RNA, 64 nt, Human
ugggagcuucuuccguuucuuccccccagauacccaucuugaaaaacacuauuucuggaaugcu

SEQ ID NO: 136921 - RNA, 64 nt, Human
cugacgagauauaugauuccaguucugcauguaccaucuugaggcacagcagccacugcucguu

SEQ ID NO: 136922 - RNA, 64 nt, Human
ugcauuuaagaauugccagucuuuuguccugcaucaucuugaacauuaauccacauguuucaga

SEQ ID NO: 136923 - RNA, 64 nt, Human
ccuuauguacuguacaguuaaucuuauuugccaucaucuugaacacaaaauguguauuuagaau

SEQ ID NO: 136924 - RNA, 64 nt, Human
uuucauauggcuuuuaguucacuuguuuguauuucaucuugauuuuuuucuuuggaaaauaaag

SEQ ID NO: 136925 - RNA, 64 nt, Human
agaaaauauuaauacagauuaaaagccuuucuuacaucuugaaaauuuucuaauauuugagaau

SEQ ID NO: 136926 - RNA, 64 nt, Human
gaguugcucccaagccuggaugaguugcaccuugcaucuugagcaugcauuucucacaauaauu

SEQ ID NO: 136927 - RNA, 64 nt, Human
gcacaggcuccuguauuugagacuaggauagcuucaucuugagccugagccuuagaaucuguag

SEQ ID NO: 136928 - RNA, 64 nt, Human
acccuccagaagggguccacguugaauucugaaucaucuugaaaauaagauuccaaccacaaaa

SEQ ID NO: 136929 - RNA, 64 nt, Human
uaccauggaaugucagaaaugacuuuaucaucgucaucuugaagaaaaauaugaacacugauga

SEQ ID NO: 136930 - RNA, 64 nt, Human
caaggcuaaaaccugagauuaucgaucuaugagacaucuugauauguaaagcacuuaauauuaa

SEQ ID NO: 136931 - RNA, 64 nt, Human
uaaucugcaaagacagcagcaagcauuauacggucaucuugaaugaucccuuugaaauuuuuuu

SEQ ID NO: 136932 - RNA, 64 nt, Human
ggucauagaaggcagcaaugcacugacugggccacaucuugaaaacucguggaaagggaaaggg

SEQ ID NO: 136933 - RNA, 64 nt, Human
guaauuguaauuucguauaaauaguaaaugaguacaucuugauuaaaagcuaugaauucagaau

SEQ ID NO: 136934 - RNA, 64 nt, Human
aaagauguaauuguugucauuuugaacaguuaaacaucuugaguauaaaaagaaccccaauguu

SEQ ID NO: 136935 - RNA, 64 nt, Human
auaugcugacuauauccuggaagcauuuuuauaccaucuugaaauuucaacaaacuggcuuuug

SEQ ID NO: 136936 - RNA, 64 nt, Human
uguaggcaugacagcagaggagaaaaucauuuggcaucuugaggucugucaugcuuuauuaucc

SEQ ID NO: 136937 - RNA, 64 nt, Human
aaauguauaguuugacucuccagaauguacuauccaucuugaugagaaaacucuuaaauaguac

SEQ ID NO: 136938 - RNA, 64 nt, Human
auuguacauccauuaaauguacaauugauugcaacaucuugauuguuuuaaccauuaacuuguc

SEQ ID NO: 136939 - RNA, 64 nt, Human
acucagauaucuuucuacugccugguagagcugccaucuugagccugaaauauaagaaaugguc

SEQ ID NO: 136940 - RNA, 64 nt, Human
auucuguaaagcuuaaauugguauuaacuaugaucaucuugaugucuaugauagauaauaaaca

SEQ ID NO: 136941 - RNA, 64 nt, Human
gagcuucagaaugggcuauccuuagagucuaguacaucuugaggccucucagcaggagacaaag

SEQ ID NO: 136942 - RNA, 53 nt, Human
aguaugagucuucacucuaagagcaucuugaccaaguugagaaggggaccuua

SEQ ID NO: 136943 - RNA, 64 nt, Human
gaaaaagacagcaucucacuauguugccaaggcucaucuugagaagcaggcggguuggguggga

SEQ ID NO: 136944 - RNA, 64 nt, Human
ggaaacaaugugggaggaagaaucaccguugacgcaucuugauuugguugguuuuuacaugugu

SEQ ID NO: 136945 - RNA, 64 nt, Human
auugggaccagucauuuccuaagcuacauauggccaucuugacaguguuuuuucuuuugugugu

SEQ ID NO: 136946 - RNA, 64 nt, Human
agagccaguuaacauuuagggaguuaucuguuuucaucuugagguggccaauauggggaugugg

SEQ ID NO: 136947 - RNA, 64 nt, Human
aaacuucagagacuaccuguuuuauuuuccucaacaucuugaaguuauguuggagaguaaucau

SEQ ID NO: 136948 - RNA, 64 nt, Human
uggguauuuugauucuaugguucccucaguauuacaucuugacuuguaaucaauuaugaauauu

SEQ ID NO: 136949 - RNA, 64 nt, Human
acauguggaaguuuaaacuacaaaguuauuucuucaucuugaccuguuuuuuuaaauguaaacu

SEQ ID NO: 136950 - RNA, 64 nt, Human
gaugaagcuagugaaggagaaaaagcuuaaauuccaucuugagcucuuggauugugauaauaca

SEQ ID NO: 136951 - RNA, 64 nt, Human
ggccacaagagugggaccccaggggcuccccucccaucuugagcucuuccugaauaaagccuca

SEQ ID NO: 136952 - RNA, 64 nt, Human
uuuuaaucugcauuuauuaguauucuaauaaaagcaucuugaucggaagaaugccuuucucuug

SEQ ID NO: 136953 - RNA, 64 nt, Human
cagccggguggcaccagcacucaggcuacugucacaucuugaucacagagcagaaaggcaccug

SEQ ID NO: 136954 - RNA, 64 nt, Human
caagcccccaacaucccaguccucaguccucagucaucuugacuucaaaucucaaccugagcca

SEQ ID NO: 136955 - RNA, 64 nt, Human
augugacugucacgugcuggaaaauaaagugauacaucuugaaaaugaauccaguguguuggau

SEQ ID NO: 136956 - RNA, 64 nt, Human
aacaagcaauucuauuuauuuuauguuguguauacaucuugaucauuagcaagacauuaagcuu

SEQ ID NO: 136957 - RNA, 64 nt, Human
auauauauugaaaauuagcuuaugugacaacccucaucuugauccccaucccuucugaaaguag

SEQ ID NO: 136958 - RNA, 64 nt, Human
ggaauguguaaaaccuccacgugacuguuuggugcaucuugaccugggaagacgccucauggga

SEQ ID NO: 136959 - RNA, 64 nt, Human
aaauaaacaaaaaugugcccuauguaagcuucuacaucuugauuuauuguaaagauuuaaaaga

SEQ ID NO: 136960 - RNA, 64 nt, Human
uuuuaguuuuuuaauaguacuuauuagcaucaaccaucuugauaaucaccaagggaaaaauuaa

SEQ ID NO: 136961 - RNA, 64 nt, Human
gcaaaugaaauuacugucuggaaaacugcaauuucaucuugagaguuuuauuaugcuaauaaau

SEQ ID NO: 136962 - RNA, 64 nt, Human
caccugcacaugucacacugaccacaucuguagacaucuugaguuguagcugcagacggggacc

SEQ ID NO: 136963 - RNA, 64 nt, Human
ccugcuucaagauucaaauucagaaauauacuaucaucuugaauuuuagcugaagaauccuaug

SEQ ID NO: 136964 - RNA, 64 nt, Human
ugggagcuuggaagggaggggugguggguggcggcaucuugacugcccccuguugucccacacg

SEQ ID NO: 136965 - RNA, 64 nt, Human
auuuuugucuaagcaauuuuauauuuuagaauaucaucuugaaccauuauaaaacaccuuaaau

SEQ ID NO: 136966 - RNA, 64 nt, Human
ggauaugguuuagcugugcccccaccuaaaauaucaucuugaauuguaaucccuauaaucccca

SEQ ID NO: 136967 - RNA, 64 nt, Human
gauaugguuuggcucuguguccccacccaaaucucaucuugaauguguacucccauaauuccca

SEQ ID NO: 136968 - RNA, 64 nt, Human
cccaaagguuucucuuucuuccuccuugauuuuccaucuugacgaaggcauuauauagaaucau

SEQ ID NO: 136969 - RNA, 64 nt, Human
auugaaagcuucugaucaacgguccugaaauuuucaucuugaaugucuuuguauuaaacugaau

SEQ ID NO: 136970 - RNA, 64 nt, Human
uuauaccacauaccacacauagccacagaaacaucaucuugaaauaaagaagaguuuuggacaa

SEQ ID NO: 136971 - RNA, 64 nt, Human
acuauuuuuacucugcauguucuguccuaagcgucaucuugagccuugcacaugauacucagau

SEQ ID NO: 136972 - RNA, 64 nt, Human
auauguaaaccuuucuagguaaaccgcuugccuucaucuugagucggaauauauuuaaauaaau

SEQ ID NO: 136973 - RNA, 64 nt, Human
cauuauucagacuucaaauugugaaucuuuuaaacaucuugauaauuuguuguugagagcuguu

SEQ ID NO: 136974 - RNA, 64 nt, Human
cucucugccccagccaguuuggggcugguucccccaucuugaauuguuuaucccuuuuucauaa

SEQ ID NO: 136975 - RNA, 64 nt, Human
uaccuuuuuaauaacucuucccacugcauauuuccaucuugaauuggugguucuaaauucugaa

SEQ ID NO: 136976 - RNA, 64 nt, Human
aggaaaacagccuguugcauuguaagagugaugucaucuugaagagcagcuggcaugaugacug

SEQ ID NO: 136977 - RNA, 64 nt, Human
ugcuuuugcuuugaaaucuggaguguaucuuacacaucuugauuggaacucaaauauuucaagg

SEQ ID NO: 136978 - RNA, 64 nt, Human
acaucuaugucuguaaaaauguuagaguacuugucaucuugaauauagccuccccaagagagaa

SEQ ID NO: 136979 - RNA, 64 nt, Human
cacagacauucugccaggcccccaagccugcagucaucuugaccaagcaggaagcucagacugg

SEQ ID NO: 136980 - RNA, 64 nt, Human
cagugaagcagccuccuuauauuuggcccaaacucaucuugaucaaccaaaaacauguuucugc

SEQ ID NO: 136981 - RNA, 64 nt, Human
cgaaacuccacccguucccacugcccugggcagccaucuugaauaugggcggaaguacuucccu

SEQ ID NO: 136982 - RNA, 64 nt, Human
ggcaaauuaagugagacuugaacaaaauuuuguucaucuugaagaauguauaguggcuuagguu

SEQ ID NO: 136983 - RNA, 64 nt, Human
cucugucuuuuuccaugacucuuauauacugccucaucuugauuuauaagcaaaaccuggaaaa

SEQ ID NO: 136984 - RNA, 64 nt, Human
uaggaggaaacggguuaaaaauuguuuuaaacuacaucuugaaaauauugaagaauuuguuuua

SEQ ID NO: 136985 - RNA, 64 nt, Human
agugguuuccacaugcucugagaagaggagcccucaucuugaagggcccaggagggucuauggg

SEQ ID NO: 136986 - RNA, 64 nt, Human
uuaaugaaugguauagaaguuuggggaaaggugccaucuugaaaauucuggaucagugguuggc

SEQ ID NO: 136987 - RNA, 64 nt, Human
ucaaaagcggggcuucaucugcaaagggcccuuucaucuugaaguuuuuccccuccgucuuucc

SEQ ID NO: 136988 - RNA, 64 nt, Human
ccuugaggauguggccacuugacuuguggaaggccaucuugaugccaggacacacaggaagccc

SEQ ID NO: 136989 - RNA, 64 nt, Human
ucauuaagcaugacauauccuucauaugaucacucaucuugaguuaauuagaaaauaccugagu

SEQ ID NO: 136990 - RNA, 64 nt, Human
ccaaacgucgucugcuuaccacguaacacagcugcaucuugagcagugaccugccaagggcaaa

SEQ ID NO: 136991 - RNA, 64 nt, Human
agguuauuuuauuggggauuuuaagaacuaauaacaucuugaguuauuuuuaauucagggggau

SEQ ID NO: 136992 - RNA, 64 nt, Human
caccuuuuaugcugcacuccuccccuaguuuacacaucuugaugcuguggcucaguuugccuuc

SEQ ID NO: 136993 - RNA, 64 nt, Human
ugaugaguguugggguuuucuauacucauguugccaucuugagauguucaaaaaauuugggguu

SEQ ID NO: 136994 - RNA, 64 nt, Human
acuuugcauaauuauuuugagauucauaugucuccaucuugaugcucguaugaauucauucuuu

SEQ ID NO: 136995 - RNA, 64 nt, Human
cccacugaacccaccuuaguuccacauuuggcugcaucuugaauuaugccaacuccagacuucu

SEQ ID NO: 136996 - RNA, 64 nt, Human
auuccaagaauugcaaauguuuauuggaccccuccaucuugaugauauauaaaaauuggaagcc

SEQ ID NO: 136997 - RNA, 64 nt, Human
caucagggggcuaccaccaugauuccgcuaccuccaucuugagcucugaguuuacagggguuca

SEQ ID NO: 136998 - RNA, 64 nt, Human
aauuuagcuuugcuuaauaguaaaauaagugagccaucuugaacacuuuaaguuuauacuauau

SEQ ID NO: 136999 - RNA, 64 nt, Human
cauauaaguuuggaaguuugccaacaucacaauucaucuugaaaagagcuuuuuucccuccuac

SEQ ID NO: 137000 - RNA, 64 nt, Human
uccuggcaggcagacccggcauguagccgcuggccaucuugaauccuagggcaugaaguugccc

SEQ ID NO: 137001 - RNA, 64 nt, Human
uguucauaguugaaacaguaggauagauauuugucaucuugacaaguagcccuuugcaauuuau

SEQ ID NO: 137002 - RNA, 64 nt, Human
cucacuuucacuguggauuuggaucgaccccuuacaucuugauuucccuuaaacgagugaaguc

SEQ ID NO: 137003 - RNA, 64 nt, Human
uaucucaagcuccuaucucuugauguuuucuugucaucuugaaggcuccauggaaugagauaaa

SEQ ID NO: 137004 - RNA, 64 nt, Human
guauuuggaguucaacacugucucucaaucagaucaucuugaucuuuuucuuuaucucccuucc

SEQ ID NO: 137005 - RNA, 64 nt, Human
ucaguauaaaucucagccagaaaaaccaacuccucaucuugaucugcaggaaaacaccaaacac

SEQ ID NO: 137006 - RNA, 64 nt, Human
gaggauacuuaacaucuggaagacaaguucauuucaucuugagaucauggugaaauauuuugga

SEQ ID NO: 137007 - RNA, 64 nt, Human
ggggaaaagugcaguauuuaccuguugaauucagcaucuugagagcacaagggaaaaaauaaga

SEQ ID NO: 137008 - RNA, 64 nt, Human
uaauccguguuggcacuggauucuaaguaguugccaucuugaauccuuuguaauaaagccauac

SEQ ID NO: 137009 - RNA, 64 nt, Human
gucuuacaccaacccccacuuggcuguuggcugucaucuugaacucuauuugaaugugacuuaa

SEQ ID NO: 137010 - RNA, 64 nt, Human
uaucacaggaguuuagaaagacucugccucccagcaucuugaauaucuccagccuguucacugu

SEQ ID NO: 137011 - RNA, 64 nt, Human
uuagcuuugagucacaauuaaggggaagcaaaaacaucuugaaaagacugcuaggaaggaaauu

SEQ ID NO: 137012 - RNA, 64 nt, Human
cuuugugagcaaaacaaagucacuucugccauaacaucuugaauuuaaccauauaugccagauu

SEQ ID NO: 137013 - RNA, 64 nt, Human
aauugaagaaaauauaacaccuuacacccuuuuucaucuugacauuaaaaguucuggcuaacuu

SEQ ID NO: 137014 - RNA, 64 nt, Human
caacaccaggacuuaagacaaaugggacugaugucaucuugagcucuucauuuauuuugacugu

SEQ ID NO: 137015 - RNA, 64 nt, Human
uuaacucuagaauuugggcuuggaccagaucuaacaucuugaauacucugcccucuagagccuu

SEQ ID NO: 137016 - RNA, 64 nt, Human
agguauuuugaccaacgugauuuagcugaugagccaucuugauguagcugaucucucagggaua

SEQ ID NO: 137017 - RNA, 64 nt, Human
auacucccacucccauuuuuuucuaagccuacagcaucuugauucauaguauaauuccugaagu

SEQ ID NO: 137018 - RNA, 64 nt, Human
cccgauuuggauaaaaguugaucuguauagucaacaucuugaacuauauuucaaaugaauuuaa

SEQ ID NO: 137019 - RNA, 64 nt, Human
uaggcaagagggaagaaagagaaggagccaucuccaucuugaaggaacucaaagacucaagugg

SEQ ID NO: 137020 - RNA, 58 nt, Human
agggcuugaaugaggaguagcuuugccacaucuugaucugcucagcccuggaggugcc

SEQ ID NO: 137021 - RNA, 64 nt, Human
gcccugaaaggccaagaucaagaugucccccaggcaucuugaucccagccugacugcugcuaca

SEQ ID NO: 137022 - RNA, 64 nt, Human
agcuaggucuacugauauacaauaaacaugugugcaucuugaacaauuugagaggggaggugga

SEQ ID NO: 137023 - RNA, 64 nt, Human
accuggaaaggcuagaacagccauuaggcgucagcaucuugacuuuuccccagcaucacaaaca

SEQ ID NO: 137024 - RNA, 64 nt, Human
ucagaggcccgagugcauuuaucccaaaacgaggcaucuugacauccccuauccccacccccua

SEQ ID NO: 137025 - RNA, 64 nt, Human
acaucgacaaagcaaacuucaacaaugaaaaagucaucuugaaguuggauuacucagacuucca

SEQ ID NO: 137026 - RNA, 64 nt, Human
auagaaugcugagauugguuaaguuugcaaugaccaucuugaaccacagauuucugcuaugugu

SEQ ID NO: 137027 - RNA, 64 nt, Human
aguucccgucucagcuguacuuuugugggccugucaucuugaugaccagaaugaaagcuugcuc

SEQ ID NO: 137028 - RNA, 64 nt, Human
gacagcuugaacugacaacauuguguauauagaucaucuugaaguauuauuucacauugaaaag

SEQ ID NO: 137029 - RNA, 64 nt, Human
uucacuguuauggccuuuucacauuucuaaaucccaucuugauauacuaugaauacucuagaau

SEQ ID NO: 137030 - RNA, 64 nt, Human
gggaauucuugcuagguaagcacuaauaacucggcaucuugacgauagucccauuugggugguu

SEQ ID NO: 137031 - RNA, 64 nt, Human
ccacuuggcuacacagggauguacaaggcgaucccaucuugauaagaccaccaccucagaguau

SEQ ID NO: 137032 - RNA, 64 nt, Human
uuaaaacauauuugaaagguaaguaaaaaacuaccaucuugaaggugaagggaguuaagaaaag

SEQ ID NO: 137033 - RNA, 64 nt, Human
uuaauaccauauuuuauacaucuccagagccuuucaucuugaggaucucaaagaccguagaaga

SEQ ID NO: 137034 - RNA, 64 nt, Human
ucuucucagcagcugaagaaugucccuaccagagcaucuugaccuaaucagcuuacaguuugaa

SEQ ID NO: 137035 - RNA, 64 nt, Human
aggagggucugcagccaguucauucccagggccccaucuugaugggccaagggcuaaacaugca

SEQ ID NO: 137036 - RNA, 64 nt, Human
ccccagcauauuguucuguagucuuuucuugaaacaucuugauugcuuuuccucggcagcuuuc

SEQ ID NO: 137037 - RNA, 64 nt, Human
uuuaggguaagaaguuugugucuuugucuggccacaucuugacuagguauugucuacucugaag

SEQ ID NO: 137038 - RNA, 64 nt, Human
agccuuuguggcuggaucaugagaggagggacuccaucuugagccaugucccccagccauggca

SEQ ID NO: 137039 - RNA, 64 nt, Human
cauuuaucucuaaaaccaggaguugaauuuuccucaucuugaaagacucuuggggucuguuucu

SEQ ID NO: 137040 - RNA, 64 nt, Human
cauuucugaagccccuuucuaagacaaggcucagcaucuugauauuuuugacagauuccuccca

SEQ ID NO: 137041 - RNA, 64 nt, Human
caauucucaugucccccacauggcccaaggugggcaucuugacguuaccucugccacgugugag

SEQ ID NO: 137042 - RNA, 64 nt, Human
gagaauguuaccagacuucaagauccucuugccacaucuugaaaaugccaccauccaauaaaaa

SEQ ID NO: 137043 - RNA, 64 nt, Human
uagggaggucuugaagccaaugagggauuuauagcaucuugaauagagagcugcaaaccaccag

SEQ ID NO: 137044 - RNA, 64 nt, Human
ccuuccuucaggacucugcgggaggcuggggccccaucuugaucuuugagcccauucuucuggg

SEQ ID NO: 137045 - RNA, 64 nt, Human
cagaauuuucuucucguuuaaccccacucacuuccaucuugacugggugacaagugguaaugac

SEQ ID NO: 137046 - RNA, 64 nt, Human
gcguguuuggguuuuuuuccuuuaacugacaagccaucuugaguggucaugggccacugcuuuu

SEQ ID NO: 137047 - RNA, 64 nt, Human
uggggcuaaccagcuccugauggccugagccaggcaucuugacuggcaccuggagagcccuuaa

SEQ ID NO: 137048 - RNA, 64 nt, Human
acauuaauugcugucaaagaugaagaagaaggcacaucuugacacaguaccugaauccagcugu

SEQ ID NO: 137049 - RNA, 64 nt, Human
uuugcuuuuaagugaacacuuuuuccccauugagcaucuugaacauacuuuuuuuccaaauaaa

SEQ ID NO: 137050 - RNA, 64 nt, Human
aauguggugacaccucccccuuucacacuggauccaucuugagccacagucacuggauugacuu

SEQ ID NO: 137051 - RNA, 64 nt, Human
accucggcccuugcccaggguggggccuggcccucaucuugaccaaagcugcuguguggcagcu

SEQ ID NO: 137052 - RNA, 64 nt, Human
gaguggcauucuuuuauacccaaagacuguagugcaucuugaagagcucaaagcacaugaccgc

SEQ ID NO: 137053 - RNA, 64 nt, Human
gcugaccugggcugcugguuccguugacuagggucaucuugaucucugcaguuugcuccagcua

SEQ ID NO: 137054 - RNA, 64 nt, Human
caggcaggcccgggugguggugccagccuggugccaucuugaaggcuggaggagucagagugag

SEQ ID NO: 137055 - RNA, 64 nt, Human
guguugucagagagugucuggaagcugcuguugccaucuugaacaacucaccaaccuccaaccc

SEQ ID NO: 137056 - RNA, 64 nt, Human
guguggcucaugaaaucacagagcucagagauaccaucuugagaaauccuccuugguaucauga

SEQ ID NO: 137057 - RNA, 64 nt, Human
uagguuugaagcaaccuccagcuugaggccucggcaucuugagauggaagagcagccuuguguu

SEQ ID NO: 137058 - RNA, 64 nt, Human
gcaagacuguguagcaggccuaccaggucccuuucaucuugagagggacauggcccuuguuuuc

SEQ ID NO: 137059 - RNA, 64 nt, Human
uuugucccuuguucccgguguaggagacccaaggcaucuugaaucccaucuauaagaacacaau

SEQ ID NO: 137060 - RNA, 64 nt, Human
uugaaaauaaagguagggcuucuaaaaacuucaucaucuugauaaguuaaaaaaugaaaguuau

SEQ ID NO: 137061 - RNA, 64 nt, Human
gggaacuucuuuaaaggaaaauuguaguagaggucaucuugauggaauuguguuuuaaaguuuu

SEQ ID NO: 137062 - RNA, 64 nt, Human
gaaccaaaaagagaaaaaaaaaucagaaguguugcaucuugaggcgaauuaacuguaagacauu

SEQ ID NO: 137063 - RNA, 64 nt, Human
uucagcuacauuuuucauaacuuuguaguacauccaucuugaguaaauuaagccacaauuuggu

SEQ ID NO: 137064 - RNA, 64 nt, Human
cuuucagaaucagcaaaaguggggaugacccaggcaucuugauuugcaaaaucacaaaacuaag

SEQ ID NO: 137065 - RNA, 64 nt, Human
uuguaaguagauucaaauuagauagucaauaaaacaucuugaaaaucccacaagccaauuaugu

SEQ ID NO: 137066 - RNA, 64 nt, Human
agucaagucucugaagcgguggccacuucuuggacaucuugacccagcgaguggucuccuacac

SEQ ID NO: 137067 - RNA, 64 nt, Human
acagauucucuuggcucauauuucuuuucuaucucaucuugaugaugauagucaucaucaagaa

SEQ ID NO: 137068 - RNA, 64 nt, Human
acagauucucuuggcucauauuucuuuucuuucucaucuugaugaugaucgucaucaucaagaa

SEQ ID NO: 137069 - RNA, 64 nt, Human
ggaugcuguggugcccagaacguugaucuaacaccaucuugaagcacacaugcugaucuccagg

SEQ ID NO: 137070 - RNA, 64 nt, Human
uauucuuaguuguauuuuuccuucuuuaaaauugcaucuugaccaggcacaguggcucaugccu

SEQ ID NO: 137071 - RNA, 64 nt, Human
ggccauauacucccuaggaacccaagauggccaccaucuugauuuuacuuuccuuaaagacuca

SEQ ID NO: 137072 - RNA, 64 nt, Human
cagggcugaggagaugcucuccuuuucuacugaccaucuugauacuuauuuauacgagaggcag

SEQ ID NO: 137073 - RNA, 64 nt, Human
gggaagguuauggaaugccccaaguauucaagaucaucuugauugaccaaagaccaaaaaaaaa

SEQ ID NO: 137074 - RNA, 64 nt, Human
uuuucaucgacgauugcuguuaguugacaagugacaucuugaaaaugccacauucccucauguc

SEQ ID NO: 137075 - RNA, 64 nt, Human
uaaaggguuugauuuuuauagucacauuuacaaccaucuugagauuuuuauuuuuuuugaacgg

SEQ ID NO: 137076 - RNA, 64 nt, Human
uaacccuauugggguuaguucccacccuuuguuccaucuugagcagagaugugcugcauuucuu

SEQ ID NO: 137077 - RNA, 64 nt, Human
cugaccuucacccccagcuggcccuccucuucuacaucuugaccuucgugggugccaucuucaa

SEQ ID NO: 137078 - RNA, 64 nt, Human
caagcagggcaaccccacacccuugacauaaaagcaucuugaagcuuuuacuccguuuuuauaa

SEQ ID NO: 137079 - RNA, 64 nt, Human
uugcagugagcaaugggucuccacaaguaccucucaucuugagagcccuaauacuaaaagaugg

SEQ ID NO: 137080 - RNA, 64 nt, Human
ggaguauuaagguggagcagaaaagaagugagaacaucuugauuccccuuucuuuuacuugaug

SEQ ID NO: 137081 - RNA, 64 nt, Human
ccagugggaagggcucucuugacagucagcgugccaucuugauguguguauguacauuggucag

SEQ ID NO: 137082 - RNA, 64 nt, Human
uaaaagaccaacccaguucuguuugacuauguagcaucuugaaaagaaaaauuauaauaaagcc

SEQ ID NO: 137083 - RNA, 64 nt, Human
cccaggaagcaggcacauugccaaggacugggggcaucuugacuaggaagcuccucguuugugu

SEQ ID NO: 137084 - RNA, 64 nt, Human
uuugaauuaaaugcuuugauauucucagaucagccaucuugaaccaaagcaaaaccacaaguua

SEQ ID NO: 137085 - RNA, 64 nt, Human
ugagcuggauugauggggccagucuccccccucccaucuugaggucguucuccacauuccuucc

SEQ ID NO: 137086 - RNA, 64 nt, Human
ugagaucucagaucaguguuuuagaaaauccacacaucuugagccuaaucauguaguguagauc

SEQ ID NO: 137087 - RNA, 64 nt, Human
caugcccaggugucagcucaaaggaucucugcaucaucuugaggugggaggcagggaaaggagc

SEQ ID NO: 137088 - RNA, 64 nt, Human
aaccuucuucaaccggaaaugugaagacccucgacaucuugaauugcugguagaguaugugagg

SEQ ID NO: 137089 - RNA, 64 nt, Human
uuauguauauagcuuuuuuucuuucuugagaauucaucuugaguuaucuuuuauuuagauaaaa

SEQ ID NO: 137090 - RNA, 64 nt, Human
gacagccucaggugggcugggaccuaggaagcuccaucuugaaggcuggucuagccccagacag

SEQ ID NO: 137091 - RNA, 64 nt, Human
agaagaaugguugcugauauggcuacugcuucuacaucuugaguuuuuuaauuuacuuuuuuua

SEQ ID NO: 137092 - RNA, 64 nt, Human
ccagccaagaccagaaauaaacagccgaugcugacaucuugaucacuggaaggucuccuugccc

SEQ ID NO: 137093 - RNA, 64 nt, Human
uugauaggguuuggcuguguccccauccaaaucucaucuugaauuguucccguaauccccacgu

SEQ ID NO: 137094 - RNA, 64 nt, Human
guggauacucuuaaaggacaauuaaaucuuaacucaucuugauugaguggccuuccugccaaac

SEQ ID NO: 137095 - RNA, 60 nt, Human
acaugggccaguucuacugaaaaccacaugcaucuugaugcgaucgcacuuucugaagaa

SEQ ID NO: 137096 - RNA, 64 nt, Human
aguucauaaagguuuacagugaauaaaaggauaucaucuugaguauagcaauaucaaaaggaau

SEQ ID NO: 137097 - RNA, 64 nt, Human
uuagccacgcugaugaguaagugagggaugucuccaucuugagaucaccaggcaagagaguugc

SEQ ID NO: 137098 - RNA, 64 nt, Human
ugacuucguacugucuuucaccuuuccauuguugcaucuugaauuuuuuaaaaugucuagaauu

SEQ ID NO: 137099 - RNA, 64 nt, Human
uuaacucucgcaauaccauaaacgcacacuguuucaucuugacccuuucuugggaaggugacag

SEQ ID NO: 137100 - RNA, 64 nt, Human
uuccccauaaaaccacggacagcgucugugugcgcaucuugagucuucacaccuguugacucac

SEQ ID NO: 137101 - RNA, 64 nt, Human
cugcacagcagcugggcacagaggagcgcucuuccaucuugaccaggacugcaccaagaagcac

SEQ ID NO: 137102 - RNA, 64 nt, Human
ugcauacuuggacacuaaagccaggaugugcaugcaucuugaagcaacaaagcagccacaguuu

SEQ ID NO: 137103 - RNA, 64 nt, Human
gauggguccugcuugcagaagcugcccuuucacccaucuugacaagauccagccacccaggacu

SEQ ID NO: 137104 - RNA, 64 nt, Human
agcugaagaaauggaaaagcagucuccaauuucacaucuugaaauagagguuuuuucccacaug

SEQ ID NO: 137105 - RNA, 64 nt, Human
cccacacuuccaaaauuaaacaguguuuucuuagcaucuugaauaucuccugcgguguauauua

SEQ ID NO: 137106 - RNA, 64 nt, Human
uagcaucuugaauaucuccugcgguguauauuaacaucuugaugagacagauuuccaggcaaca

SEQ ID NO: 137107 - RNA, 64 nt, Human
caguuacagcaacuguaauguaacauaaaaagggcaucuugaaguauuguucauauuugucacc

SEQ ID NO: 137108 - RNA, 64 nt, Human
ugggacucagaggagggggcugaggccacagccgcaucuugaucaggcuuucucaagcccucca

SEQ ID NO: 137109 - RNA, 64 nt, Human
acauauauaauagaaaagggccaagaaaaauaugcaucuugauuuggagagaggcuaauauuau

SEQ ID NO: 137110 - RNA, 64 nt, Human
aggugauuuuguaguucuuaacaguucuccagagcaucuugaacaggaauauuaagauaaaugu

SEQ ID NO: 137111 - RNA, 64 nt, Human
ucaaaaguuauuauaaacagaccuuuauuaaacacaucuugaaagauguagaagucccucuaua

SEQ ID NO: 137112 - RNA, 64 nt, Human
aucuaagacuaccagucuuuuucuguuuuugcuccaucuugaccauaacauauucaucaaacca

SEQ ID NO: 137113 - RNA, 64 nt, Human
uagaucucugaaaauuggaaccacucaagaguaucaucuugauaguguuacuucagcauaugac

SEQ ID NO: 137114 - RNA, 64 nt, Human
gaaggugcuuuuaaagauccuugagcagaggagacaucuugaagugucagauuacaggaguacc

SEQ ID NO: 137115 - RNA, 64 nt, Human
uaugauuuucuauauggagugagaaaauucuucucaucuugagaacucuuauugcugugaaagg

SEQ ID NO: 137116 - RNA, 64 nt, Human
ucacugugccacuggguggagugugccuucagggcaucuugaaaugucccgcugaaugauuuga

SEQ ID NO: 137117 - RNA, 64 nt, Human
cccuguccuccauuccucacgccaucuccauccccaucuugaguccuggaacggcccugggugc

SEQ ID NO: 137118 - RNA, 64 nt, Human
uuuucugcccaaaaggaacaucacggacguucuucaucuugagucaucacuugaguaauaaagu

SEQ ID NO: 137119 - RNA, 64 nt, Human
ggcggagcucccagucgcauggagcgguguucauggaugcaacagacccuggcuucuggagucc

SEQ ID NO: 137120 - RNA, 64 nt, Human
uucaggcuuuuaugaggaaagcguuucuguguagaaacuggaagcuguucagggcaucggcagc

SEQ ID NO: 137121 - RNA, 64 nt, Human
uuugcuuuggaagcgucagacauuagaacaggccaaacuggacugucuguucauagcgugccug

SEQ ID NO: 137122 - RNA, 64 nt, Human
cuggaugccucugaagagagggacagaccgucagaaacuggagaguuucuauuaaaggucauuu

SEQ ID NO: 137123 - RNA, 64 nt, Human
cagcuaaaaaccguuguuugcuuuaaauuuucauaaacuggaauccuuucacccgcuccuacag

SEQ ID NO: 137124 - RNA, 64 nt, Human
aguccuccugauucuguaucacaugagacaccaaaaacuggaaauguagucacacccaguacag

SEQ ID NO: 137125 - RNA, 64 nt, Human
ugauguuuuuucuacaaaaguccauaaaaugugaaaacuggagaagaucuuagagguugaagcc

SEQ ID NO: 137126 - RNA, 64 nt, Human
ugugcugucaugagaaaaauugagacuuccaagaaaacuggacaccaggugaggguugguuugg

SEQ ID NO: 137127 - RNA, 64 nt, Human
gaauacaaaggguauacucuguuggaugcaccagaaacuggaaacugggaccaguggcagagau

SEQ ID NO: 137128 - RNA, 64 nt, Human
acccagaugcccaugagcaagagaguggacaaguaaacuggaauauucacauaauagaacauua

SEQ ID NO: 137129 - RNA, 64 nt, Human
cacagaaacaggcucuccucuuacuuugcugucuaaacuggagaucacagaagucaagacugca

SEQ ID NO: 137130 - RNA, 64 nt, Human
caacagcagucauacccaaaucauuugcacuuuaaaacuggaagauuaagcuuuuguuaacacu

SEQ ID NO: 137131 - RNA, 64 nt, Human
accaacacaggaagaaauagaagucaccuauugaaaacuggaauggcccauucagaaagacagg

SEQ ID NO: 137132 - RNA, 64 nt, Human
cugcaguuuugacauuuaggauuuugugucuuuuaaacuggaaaaucuucuagcauguuggguu

SEQ ID NO: 137133 - RNA, 64 nt, Human
acaaaagccaggcucaacuuauagaauguuuuggaaacuggaaguaaugauacauuucacuuca

SEQ ID NO: 137134 - RNA, 64 nt, Human
guggugguauuuucaacaaacagggaauaacugcaaacuggacaggacacccaucugggaccac

SEQ ID NO: 137135 - RNA, 64 nt, Human
aucugagcaucuuuuagacaagagaggcaaagacaaacuggauuuaauggcccaacaucaaagg

SEQ ID NO: 137136 - RNA, 64 nt, Human
cauaccaacagccucuccuuguacuauauuuuuaaaacuggaacuaugaacuucauccauuugc

SEQ ID NO: 137137 - RNA, 64 nt, Human
gacuuucauacucugcucuuagucuaaaaaaaauaaacuggagauaaaaauaacugagugugug

SEQ ID NO: 137138 - RNA, 64 nt, Human
caggaccuggcuuggcuuuaaccguuuuucaagaaaacuggaaaucuggauuuucagcgaacau

SEQ ID NO: 137139 - RNA, 64 nt, Human
aaugacaaaacauaauuccugagaggcccagaacaaacuggagucuagccuggaguuaaauuga

SEQ ID NO: 137140 - RNA, 64 nt, Human
uaccuagaacauauccucagcaagaaacaaaaccaaacuggacucucgugcagaaaauguagcc

SEQ ID NO: 137141 - RNA, 64 nt, Human
cuggauauuacuagaguuguaaaacacaacuuggaaacuggaauuuaugugaagaaccaaacaa

SEQ ID NO: 137142 - RNA, 64 nt, Human
guuucagaggacacagacaaaagcuguugcaucaaaacuggacuuuaggaguaauuucuauuga

SEQ ID NO: 137143 - RNA, 64 nt, Human
uggugugcaaagcauuaugauaggcaccguggggaaacuggaaaugaauuugacaugaaaagga

SEQ ID NO: 137144 - RNA, 64 nt, Human
ucuuucuaauugccaacaagacuuuuauuaauuaaaacuggacauuaagcucuguugucaugaa

SEQ ID NO: 137145 - RNA, 64 nt, Human
uagaaaacagaggaguuuguagccagcagccuguaaacuggaaacacuggucucagccaaccuc

SEQ ID NO: 137146 - RNA, 64 nt, Human
uuucaccaaccaaauaguugccucucucgucaccaaacuggaaccucacaccagccggcaaagg

SEQ ID NO: 137147 - RNA, 64 nt, Human
uuuggaaauugaacaagaaaugcaucugucuuagaaacuggagauuauuugauguuagguaaaa

SEQ ID NO: 137148 - RNA, 64 nt, Human
uuuuagaaaugugaagaggucugauuggcugcuuaaacuggaaaggaucugugauuggcugguu

SEQ ID NO: 137149 - RNA, 64 nt, Human
cuuuuauuuuaaagacuaauguuaauuguucuuaaaacuggauuuuuuuuccuuaaagcaauuu

SEQ ID NO: 137150 - RNA, 64 nt, Human
guauucauagggaugguggcucaacaaaucaagcaaacuggaaucaaggggagggggaagggaa

SEQ ID NO: 137151 - RNA, 64 nt, Human
cccauugccugcccgaggugcaaggugggguauaaaacuggauaaccccugaaguauuguauau

SEQ ID NO: 137152 - RNA, 64 nt, Human
uuuauauuuuugguuuuacaagaaaaaacauuaaaaacuggaaaggagaugugaaguccucguu

SEQ ID NO: 137153 - RNA, 64 nt, Human
cacauugucuguagccaucaaaaauaauaauaauaaacuggacaguuuacaaucguugguuucu

SEQ ID NO: 137154 - RNA, 64 nt, Human
uauuugguuaucaaagauaaugaaaaugacaaucaaacuggauuauggacagaacuuggaaaua

SEQ ID NO: 137155 - RNA, 64 nt, Human
aguauaccuuguaaaucuucccaaauguuguggaaaacuggaauauuaagaaaaugagaaauua

SEQ ID NO: 137156 - RNA, 64 nt, Human
uuggauaaugcugcaaaugcuuuuuuugugugagaaacuggagagaugugauuucuccuuuugg

SEQ ID NO: 137157 - RNA, 64 nt, Human
uaaggaaaagaagagacuaggaaagcugggcccaaaacuggagacuguuugucuuuccuggaga

SEQ ID NO: 137158 - RNA, 64 nt, Human
ugccacauggagagagacugugaggacagaagccaaacuggaaguggaggagccaagggauuga

SEQ ID NO: 137159 - RNA, 64 nt, Human
gcuuacuaauacauucccuuccccauagccaucaaaacuggaccaacuggccucuuccuuuccc

SEQ ID NO: 137160 - RNA, 64 nt, Human
agugucacuauuuucuccuuaaagcuccagccaaaaacuggacaaggauagagaggaggaggga

SEQ ID NO: 137161 - RNA, 64 nt, Human
cccaucuuccaaccccggcuauuuggagacggaaaaacuggaauucuaacaaggaggagaggag

SEQ ID NO: 137162 - RNA, 64 nt, Human
aaaaggauuuaaaaccgcugcucuaaagaaaagaaaacuggaggcugggcgcaguggcucacgc

SEQ ID NO: 137163 - RNA, 64 nt, Human
aacacaugugcacacagauuauuuuuuggcuccaaaacuggauugcaaaagaaagaggagaaga

SEQ ID NO: 137164 - RNA, 64 nt, Human
aaaauaugagagacuggcagcuauuaacauugcaaaacuggaccauauuucccuuauuuaauaa

SEQ ID NO: 137165 - RNA, 64 nt, Human
ucuacuuuucucugccuagcacaaaauugggagaaaacuggagccuccauccgcagucacacgu

SEQ ID NO: 137166 - RNA, 64 nt, Human
uaagccucauucuccuuuuguucauuuugguaauaaacuggauuugaauugugaacaaaugcac

SEQ ID NO: 137167 - RNA, 64 nt, Human
acauaucuaacucuguucucuuuugguuguucagaaacuggauuuuuuuuuucuuaagcagugc

SEQ ID NO: 137168 - RNA, 64 nt, Human
augguugcuucuucauagaauugucugcuuuuuaaaacuggaaguacaggauuuucuucaggua

SEQ ID NO: 137169 - RNA, 64 nt, Human
agacacacaguucacugaaaauucagucagucaaaaacuggaagaacuguaaaagaaaaaagua

SEQ ID NO: 137170 - RNA, 64 nt, Human
uuucccagauuuccucaaauacaugaaacgaaucaaacuggagauaaacccuaugacuauaagc

SEQ ID NO: 137171 - RNA, 64 nt, Human
ugugauguggauggggccccagauggaagguuugaaacuggauucucgauuuuuagcaaaaaag

SEQ ID NO: 137172 - RNA, 64 nt, Human
gaaacucgcaucgccaauagucucuauggaagucaaacuggagguccuguugucgcagagcauu

SEQ ID NO: 137173 - RNA, 64 nt, Human
uacuuuuuguuuuuguuauaaaggaagacagaacaaacuggaauguuuuaugauguuguauagc

SEQ ID NO: 137174 - RNA, 64 nt, Human
uaacaaaguuuuuccuaauggcccuucuuuuaguaaacuggacauguuauuccacuacaaaaac

SEQ ID NO: 137175 - RNA, 60 nt, Human
aacacgcucggacuugcuagacgcuucucaaaacuggacagucacugccacuuugcacau

SEQ ID NO: 137176 - RNA, 64 nt, Human
uuuguauaccuuguucuuugugaucuauaaaauuaaacuggauaaaauguuaauuggggguagg

SEQ ID NO: 137177 - RNA, 64 nt, Human
gugaagccaaaagggaccaggaaccgugcaaaggaaacuggaaacuuuuccccgcuggguagag

SEQ ID NO: 137178 - RNA, 64 nt, Human
agaaccuaggccccagguaucacugcacuuuaagaaacuggaggcugcaacaggagggaaaggc

SEQ ID NO: 137179 - RNA, 64 nt, Human
aaaguugaccuugagaauuuauaauauucugagaaaacuggaagcaugcauaaagccccucugc

SEQ ID NO: 137180 - RNA, 64 nt, Human
uuccugccuccugaggacuccucugacggcaggaaaacuggacaugaaugacugcccccacgcc

SEQ ID NO: 137181 - RNA, 64 nt, Human
cuuucaguauaagcugaauaaauuuagagcuuucaaacuggaaaaaaaaaugaaacaaaacaaa

SEQ ID NO: 137182 - RNA, 64 nt, Human
cuaugcaauuuaaaggguugacccacacuagacgaaacuggacucguacgacucuuuuuauauu

SEQ ID NO: 137183 - RNA, 64 nt, Human
cucuggcagggcacuugauccauuccaaagucaaaaacuggacugaagcuaaauuuguacuuuu

SEQ ID NO: 137184 - RNA, 64 nt, Human
ucuguguguuccuugcuguacguuagacauuuguaaacuggauucugauugucaguuuuaugag

SEQ ID NO: 137185 - RNA, 64 nt, Human
agugccuauaacaagacagagaccucuggucagcaaacuggaacucaguaaacuggagaaauag

SEQ ID NO: 137186 - RNA, 64 nt, Human
acagagaccucuggucagcaaacuggaacucaguaaacuggagaaauaguaucgaugggagguu

SEQ ID NO: 137187 - RNA, 64 nt, Human
aaauaauuuguuauaaaaauucuguuugcaaauuaaacuggaaaaguauccagagucucaaaag

SEQ ID NO: 137188 - RNA, 64 nt, Human
ucauuugcauagaauuuaagugauugauuuaaaaaaacuggacauaaacuaagucuaagaagag

SEQ ID NO: 137189 - RNA, 64 nt, Human
aguggucaaaccauaaucucuuuucacuggggccaaacuggagcccagauggguuaauuuccag

SEQ ID NO: 137190 - RNA, 50 nt, Human
cucuuuugguuuuuagguagaaacuggagcuaucaauauuuucauguaag

SEQ ID NO: 137191 - RNA, 64 nt, Human
gguagaacacaaggucauuugcuaacuagcuuggaaacuggaugaggucauagcagugcuugau

SEQ ID NO: 137192 - RNA, 64 nt, Human
caugaacagcucuuucuuguaugcgauuuaaaacaaacuggaaaggaaacuucacacgucaaaa

SEQ ID NO: 137193 - RNA, 64 nt, Human
agacucugucucaguccaugaagauguagaggagaaacuggaacucucgagcguugcugggggg

SEQ ID NO: 137194 - RNA, 64 nt, Human
gagggcuugaggacuugggcgggacacaggcuccaaacuggagcuugaaauagugucugaugaa

SEQ ID NO: 137195 - RNA, 64 nt, Human
ggauauuuguuuauguuuguuuuuugggggaaagaaacuggaacucaguguuaccuuaaaguua

SEQ ID NO: 137196 - RNA, 64 nt, Human
gcuacagugcuucacacccuucgccacggcugugaaacuggagauggguggguuuuguauguua

SEQ ID NO: 137197 - RNA, 64 nt, Human
ugccccugugaucccuucggcgccagcagcuccaaaacuggaccaccagagaauggacaccauc

SEQ ID NO: 137198 - RNA, 64 nt, Human
uuaagagcagggacuguucucuaguuauugaggaaaacuggacuuuguuuguguuuuuggugga

SEQ ID NO: 137199 - RNA, 64 nt, Human
aagguagaaggaguaugguuaagcacacucuugaaaacuggagcuuuguauucugugacugcua

SEQ ID NO: 137200 - RNA, 64 nt, Human
ccagggccugauucaggacugacucuccaccauaaaacuggaagcugcuuccccuguagucccc

SEQ ID NO: 137201 - RNA, 64 nt, Human
ugcccaacaacuuuacuugccuacaacgguucacaaacuggaacaggccauauucaaagccagu

SEQ ID NO: 137202 - RNA, 64 nt, Human
ggggaagggaaaaaggaaaguaucaaguguugggaaacuggauucagugggaucuacaaggaau

SEQ ID NO: 137203 - RNA, 64 nt, Human
cucgcugggaccucccuaaacccuuccuggaagaaaacuggaaccaacucugcccuaccucccu

SEQ ID NO: 137204 - RNA, 64 nt, Human
auuggucuaccaguuacuauggaguaaaagaauuaaacuggaccaucucucuccauaucaaucu

SEQ ID NO: 137205 - RNA, 64 nt, Human
guucugaggaggugagauguggacuugugcuuauaaacuggagaguuuagucauaaucccuccu

SEQ ID NO: 137206 - RNA, 64 nt, Human
uuaaagaaagacuuuaacaggugucaugaagaacaaacuggaauuucauucugaagcuugcuuu

SEQ ID NO: 137207 - RNA, 64 nt, Human
ccagcaaaacaaaaauaauucuacaaaaugacauaaacuggacaugccuuauauucaguugaaa

SEQ ID NO: 137208 - RNA, 64 nt, Human
acaucaguuauaucuuguggcauauccauuguggaaacuggaugaacaggauguauaauaugca

SEQ ID NO: 137209 - RNA, 64 nt, Human
gugagaagcuuaacuaggcugcauaacagcuugaaaacuggauuaucuacuacagaguguuaua

SEQ ID NO: 137210 - RNA, 64 nt, Human
aggaacaagcaugucucucugccaagauccaucuaaacuggagugauguuagcagacccagcuu

SEQ ID NO: 137211 - RNA, 64 nt, Human
agugagugcucaugugucuuggccccuugcucgcaaacuggauaaagggugcccaagccucucc

SEQ ID NO: 137212 - RNA, 64 nt, Human
cgggugggggacagagggaccuuuaaagaaaacaaaacuggacagaaacaggaaugugagcugg

SEQ ID NO: 137213 - RNA, 64 nt, Human
ucucccugauagaccaaucagcugugucgcacuuaaacuggagaaguuacacugaaguauaauc

SEQ ID NO: 137214 - RNA, 64 nt, Human
uaaauuugcucacaaauugugguuuguuacaauuaaacuggauacuuauuugcaaaguguugua

SEQ ID NO: 137215 - RNA, 64 nt, Human
agaccauuuaugcugagcuuuggaauacuauuuuaaacuggauuguacuuaaauaaugaagcuc

SEQ ID NO: 137216 - RNA, 64 nt, Human
gcaucgccugcaggacuuugcggugggaccccugaaacuggaccugcauagcuacgugaggccu

SEQ ID NO: 137217 - RNA, 64 nt, Human
caggguucccucacugcuagucagcuucuuuuggaaacuggacaggccauugccaccugcacuu

SEQ ID NO: 137218 - RNA, 64 nt, Human
ugugucaugcuuauguauuauggcaagaagaggaaaacuggauuaauaaauacguuuuuuguaa

SEQ ID NO: 137219 - RNA, 64 nt, Human
cugaaggaaauuuaaacaaagaaacacuugaaagaaacuggaaagaaaaauaauuuuuuuaugu

SEQ ID NO: 137220 - RNA, 64 nt, Human
uguauaaggaguuaauugcaaacaugcaauugagaaacuggauagauacacucauaaaaccccc

SEQ ID NO: 137221 - RNA, 64 nt, Human
cuuucuacauuaacuaguaagacauaaagauuugaaacuggaacuauauuauacuuuuuaacca

SEQ ID NO: 137222 - RNA, 64 nt, Human
gaccacggguguuguaagcugggacacggaagccaaacuggaaucaaacgccgacuguaaauug

SEQ ID NO: 137223 - RNA, 64 nt, Human
uguagcacuuuccuauauauuugucacacauugaaaacuggacuggguauaacuauguuauagg

SEQ ID NO: 137224 - RNA, 64 nt, Human
gccuugaaauuaaacuaugaaauuaaaggcagaaaaacuggaaaaccuacugcagguccagaga

SEQ ID NO: 137225 - RNA, 64 nt, Human
guuucauuugagugccuucguguguauguccaucaaacuggaaccaaacuguuuuguaaguaaa

SEQ ID NO: 137226 - RNA, 64 nt, Human
uuugcccugaauggucucagcuugagaccauuucaaacuggagagaagcaagccagccaauaga

SEQ ID NO: 137227 - RNA, 64 nt, Human
aaauauuuauaguagugguguucacaauagucccaaacuggaaacccaaguguccaucuccauc

SEQ ID NO: 137228 - RNA, 64 nt, Human
ggcacuuuaaaaaucagcaggacaacccugaggcaaacuggaagguaaaauauacuuuuauuuu

SEQ ID NO: 137229 - RNA, 64 nt, Human
guaaagaucaugguuaaguauaaucauuacugccaaacuggaauuuucaaguuauuauaauauc

SEQ ID NO: 137230 - RNA, 64 nt, Human
agcaguuuguugugugcaguuugauggcagcugcaaacuggaggugaggcggaggaaaggcagg

SEQ ID NO: 137231 - RNA, 64 nt, Human
cgaacagagggugcccuuggccaauguaguuaagaaacuggaaaaugguuucuucauguuuucc

SEQ ID NO: 137232 - RNA, 64 nt, Human
gcaccuuuuugaaaugcaaaacuaggaaaagguuaaacuggauuuuuuuuuuuaaaaaaaagaa

SEQ ID NO: 137233 - RNA, 64 nt, Human
aagugcugucaguauaaaguuguggggauaaaggaaacuggauauuuuuagcacgaugugcaug

SEQ ID NO: 137234 - RNA, 64 nt, Human
caguccccaaagaagguuuaaaauguacuaauaaaaacuggagaaauaggaauuugugaacucc

SEQ ID NO: 137235 - RNA, 64 nt, Human
ccuucuggaaauguggugacuuggcuuagucuucaaacuggauucauggauuugaaguaacugu

SEQ ID NO: 137236 - RNA, 64 nt, Human
uuuguuucaugacaaauuauauagucuauaaauuaaacuggaaguaauuauuacuuuaauugca

SEQ ID NO: 137237 - RNA, 64 nt, Human
uuuuuuuuuuuaugccugcaaauaaucaaaaguaaaacuggaguagccuaauuuucugggagca

SEQ ID NO: 137238 - RNA, 64 nt, Human
cucuuaggcauguaggacccugcaggggguggacaaacuggagucuggagugggcagagccccc

SEQ ID NO: 137239 - RNA, 64 nt, Human
acuaccccauauacaccuggaacauugaggauggaaacuggacucacauucgacauaccccacu

SEQ ID NO: 137240 - RNA, 64 nt, Human
uggcagaucagcuuugagagugguccuaagcaguaaacuggaugauguugcauuagaaaaacau

SEQ ID NO: 137241 - RNA, 64 nt, Human
ggaaacacauacuccuuaauuuaccuguuguuggaaacuggagaaaugauugucgggcaaccgu

SEQ ID NO: 137242 - RNA, 64 nt, Human
ucgguggcccuacccgguaccaguucuuucugagaaacuggagaugucuuguuagcauaagugu

SEQ ID NO: 137243 - RNA, 64 nt, Human
auuaccacuugugauucaaacaauuuugugguuaaaacuggauuuuaaauuuaaaaaucaauaa

SEQ ID NO: 137244 - RNA, 64 nt, Human
cacuugcuuuacauccaugcaacaugucauuuugaaacuggauugauuugcauuuccuggaacu

SEQ ID NO: 137245 - RNA, 64 nt, Human
ccagggccuuuucuggcaccgcaguuuuguuuuaaaacuggaccuguauauuuguaaagcuauu

SEQ ID NO: 137246 - RNA, 64 nt, Human
ggaugacaguauggaacugucugcauuggacccuaaacuggacuagaagaggcaucuucaaggu

SEQ ID NO: 137247 - RNA, 64 nt, Human
aaguguagaggcugccucugugugugguuuaaguaaacuggaaaugagacauugacgugcugcu

SEQ ID NO: 137248 - RNA, 64 nt, Human
augggcccuuuaaagacuacaagauuugcuagauaaacuggaaauggagaaguuauugcagaca

SEQ ID NO: 137249 - RNA, 64 nt, Human
ugaaccagauuugguggugguuuuguuucuaugcaaacuggacacaaauuacaacaguaaauuu

SEQ ID NO: 137250 - RNA, 64 nt, Human
ugugacugaaacaaaauguuuuuugauaggaaggaaacuggaauucuuuguacuaauacaggga

SEQ ID NO: 137251 - RNA, 50 nt, Human
aaauggagcugacucagugaaaacuggaauuaaaaggaaagucaagaaga

SEQ ID NO: 137252 - RNA, 64 nt, Human
auuugauaaugacuuuagugacauuauaaaacugaaacuggaaaauaaaauggcuuaucugcug

SEQ ID NO: 137253 - RNA, 64 nt, Human
uuuuguuagagaugagaaaaggauugagaaggauaaacuggaauccugguaagaagccuuuaug

SEQ ID NO: 137254 - RNA, 64 nt, Human
gagccuggagccacuuuaaguuguacuucugacuaaacuggaauuaugagugaggaagaguguu

SEQ ID NO: 137255 - RNA, 64 nt, Human
cagguggauacccgcuuccauggucuugcacuauaaacuggaauggauuucucaaugcgggacc

SEQ ID NO: 137256 - RNA, 64 nt, Human
aaagcuaauuuuuuuuacaugucaauauuggcacaaacuggaaugaaagaauaguuugauucag

SEQ ID NO: 137257 - RNA, 64 nt, Human
uguuucauugaaaaaacaaauugauaaacauauuaaacuggaagaauuuucuuuauucaaauga

SEQ ID NO: 137258 - RNA, 64 nt, Human
agauuuagggacauaaaaugaucuugcaggucguaaacuggaaaacaguauuuugguugucuua

SEQ ID NO: 137259 - RNA, 64 nt, Human
aauauuuuuaaaaccuucuuaacaaaacuucuuaaaacuggaaaaaauauauauuauguaucua

SEQ ID NO: 137260 - RNA, 64 nt, Human
caacaaugaagaggauagcacuuuaucuagaugaaaacuggauuucuuaucuuugaaauaucuu

SEQ ID NO: 137261 - RNA, 64 nt, Human
caacugaaccauucaaaaggauuuuuuuuguuuaaaacuggauuucaauguaagcaaaugaaga

SEQ ID NO: 137262 - RNA, 64 nt, Human
acagugugggagaauaggaguccagccguaagauaaacuggaaauauuugggcgucuuguaccu

SEQ ID NO: 137263 - RNA, 64 nt, Human
aauucggcaauggaauaucuuuuaaguuuuaaaaaaacuggaauaauuauaucuaucuuuuuug

SEQ ID NO: 137264 - RNA, 64 nt, Human
aacacacacaauccuuucuaacuuuauggacacuaaacuggagccaauagaaaagacaaaaaug

SEQ ID NO: 137265 - RNA, 64 nt, Human
acauaaagccaugcuguuuuuggucaaacuguguaaacuggaaaaauucacaucauuucugagu

SEQ ID NO: 137266 - RNA, 64 nt, Human
acagaguuuuaauguuuugguuuucacuucuuuuaaacuggacaacaaauccagcauuucaagu

SEQ ID NO: 137267 - RNA, 64 nt, Human
ccacuagaaaguaauuguacuauaaaauuucauaaaacuggauuugauuucuuuuuaugaaagu

SEQ ID NO: 137268 - RNA, 64 nt, Human
uauuuuucuguguacaauuauaggauuguaaucuaaacuggaauuuuuaggcaguaagucacca

SEQ ID NO: 137269 - RNA, 64 nt, Human
acagacacacacugcuaaaugugaagauggaacuaaacuggaaauuaaauuauacugacaauau

SEQ ID NO: 137270 - RNA, 64 nt, Human
uugguaaaaucagugcuuaaauacgcaaugauuuaaacuggaaccugagguauuuuucaugcua

SEQ ID NO: 137271 - RNA, 64 nt, Human
uuaugccccaguucagaaauuuggcauugaucuuaaacuggaacaugcuuuuacuuuauugccc

SEQ ID NO: 137272 - RNA, 64 nt, Human
cccagccaggcuccccuccuuccuauuagcuacaaaacuggauaaacuucagaauaugagccaa

SEQ ID NO: 137273 - RNA, 64 nt, Human
auauuuguuaugccuuauucuaaaauugagucucaaacuggaaugccuuugaagacagaugcuu

SEQ ID NO: 137274 - RNA, 64 nt, Human
cuauauuugggaucucauccuaggagaaaacccaaaacuggauuccucuuaagaccucugucaa

SEQ ID NO: 137275 - RNA, 64 nt, Human
uuuuugauuuuguguuacaguacacuuguagccaaaacuggaagacaaaaccaauauauaauuu

SEQ ID NO: 137276 - RNA, 64 nt, Human
uaaugguaaccagucagaggagggcauaacuaugaaacuggacaccuugguugucagguuagaa

SEQ ID NO: 137277 - RNA, 64 nt, Human
aaauauaaauaauuuugucaauuauaccuaaauaaaacuggaaaaaaauuucuggaaguuuaua

SEQ ID NO: 137278 - RNA, 64 nt, Human
aaagguguauguauguuuuguuguuuuguuuuggaaacuggacaggagucaaaacagggauguu

SEQ ID NO: 137279 - RNA, 64 nt, Human
aggagcaaggucuucaagcucucauuauggacugaaacuggagaaaauucuauggaacuauuau

SEQ ID NO: 137280 - RNA, 64 nt, Human
aauuaacaaaauauuaucuuuauucaugaguuggaaacuggaaaaaggcuucuugaaguaaaug

SEQ ID NO: 137281 - RNA, 64 nt, Human
ggcauggccugagucagaagagcuaccccaggugaaacuggaagugcaugaggcagagcguccg

SEQ ID NO: 137282 - RNA, 64 nt, Human
aggggaaauuaacuauuauaaucucuugaauccaaaacuggauauuaagaacuuucccccuuac

SEQ ID NO: 137283 - RNA, 64 nt, Human
uuccggugacagcuguggaacgcgucaacaggacaaacuggacacauggaguuacaguguguac

SEQ ID NO: 137284 - RNA, 64 nt, Human
uagucuucagcuuuaggcagaugcaaaagaauacaaacuggaauauuaagaauacuguucaacu

SEQ ID NO: 137285 - RNA, 64 nt, Human
caagaaaaugcagauagagaaaaagaagaaaauaaaacuggaguauuuccacaacccaaguuua

SEQ ID NO: 137286 - RNA, 64 nt, Human
ccuagcuuucccauugcuguuccauugcugagacaaacuggaaggcucccuuucuguuugaagu

SEQ ID NO: 137287 - RNA, 64 nt, Human
acuugaaauugugccacaugacuuuuuccucuaaaaacuggauccuaguguuuuaauuaccugu

SEQ ID NO: 137288 - RNA, 64 nt, Human
ccaccauaaggccaaauaaggagcgagguugugaaaacuggaaaacaaaggcucuuuucagagc

SEQ ID NO: 137289 - RNA, 64 nt, Human
ggccugaagccugaagccuuuuauuauaacacuaaaacuggacagucuccugagacaagaccuc

SEQ ID NO: 137290 - RNA, 64 nt, Human
cauauuauguuuguauuuaugcuacuuaaauacaaaacuggacaggccaggcaugguggcucau

SEQ ID NO: 137291 - RNA, 64 nt, Human
aaaggugguacaggguugucugccccuuuaaaagaaacuggacaaagaaggggaaggcucaggg

SEQ ID NO: 137292 - RNA, 64 nt, Human
agugaagguucagaugcaaauggaaggaaaaaggaaacuggaaggaaaaccauugcgguaaguu

SEQ ID NO: 137293 - RNA, 64 nt, Human
guuugaaagcucagauuaagcaagccaugccaagaaacuggacgauguguaagccuagacucua

SEQ ID NO: 137294 - RNA, 64 nt, Human
cuguggagguugcugguacacaccaaaugaguccaaacuggaaugagcagcuuuagcaaagaac

SEQ ID NO: 137295 - RNA, 64 nt, Human
cuuuuaaaccugcugcacauuggacucaaaaggaaaacuggaccaacaauaauugaggaaauag

SEQ ID NO: 137296 - RNA, 64 nt, Human
gaacuggaguuggcaauaccuaguucugcuucugaaacuggaguaucauucuuuacauauuuau

SEQ ID NO: 137297 - RNA, 64 nt, Human
uggcuacuagagaacaagagggaaaguagggcagaaacuggauacaguucugaggcacagccag

SEQ ID NO: 137298 - RNA, 64 nt, Human
guccgaugccugggaggaccagaagccaacagcaaaacuggaaaagcccggcaggcccaggaga

SEQ ID NO: 137299 - RNA, 64 nt, Human
cagcugugacacuuaagauugauuggagauuuuaaaacuggaggaugcauuuagagggagaaag

SEQ ID NO: 137300 - RNA, 64 nt, Human
gaguaucagagauguaccuacccuucugggagccaaacuggauaaguaccacagucuaaaugag

SEQ ID NO: 137301 - RNA, 64 nt, Human
acacaaguuggaccaaggagaaagcccuuuggagaaacuggacccuaguucaguuuagaucuca

SEQ ID NO: 137302 - RNA, 64 nt, Human
agaggaaggggacugcguuaacgguuacuaaggaaaacuggaaauacugucugguuuuuguaaa

SEQ ID NO: 137303 - RNA, 64 nt, Human
ccagguuucugaagauaauuuucauauuccugagaaacuggacuuuuuacaagucuuuacaaaa

SEQ ID NO: 137304 - RNA, 64 nt, Human
ccuacuuuaacuccuuaauuccagcauacagcuaaaacuggauguauauucuggcaaguaaagg

SEQ ID NO: 137305 - RNA, 64 nt, Human
caaaaguccugcaugccucaacuuucucauccuaaaacuggaaacuuauuucucauuuagaaac

SEQ ID NO: 137306 - RNA, 64 nt, Human
aaaaaggaauuauguggucagugcauuguuuuuuaaacuggaaaucauuuuguuuuaaaaguua

SEQ ID NO: 137307 - RNA, 64 nt, Human
uagacaagcucucaaaguguugaguggggcccuuaaacuggauucaaaaaaugcucuaaacaua

SEQ ID NO: 137308 - RNA, 64 nt, Human
gcauuugaguacagacuaauuuuuaaaauaugcuaaacuggaagauuaaacagaugugggccaa

SEQ ID NO: 137309 - RNA, 64 nt, Human
ucuauaauuguagcacauggagaaagcaaauguaaaacuggauaagaaaauuauuuuggcaguu

SEQ ID NO: 137310 - RNA, 64 nt, Human
uuuguuuagcuucacagcauagcugaaaguugccaaacuggacauugugcaauaaaguagaauu

SEQ ID NO: 137311 - RNA, 64 nt, Human
ucaagccacuuuucugguccaaagaauauugggaaaacuggauuacuuucaguauauuucuuga

SEQ ID NO: 137312 - RNA, 64 nt, Human
ggugaacuuuuguagaaugagauagucgaagcuaaaacuggaguauggcaucugaagguaaaug

SEQ ID NO: 137313 - RNA, 64 nt, Human
uaucaaauaacuuauucacuuuucauguggcaggaaacuggaauaucgcuuuuaauaaaaugga

SEQ ID NO: 137314 - RNA, 64 nt, Human
gcuccagggcgggaggcaagcccccuugccuuucaaacuggaaaccccagagaaaacggugccc

SEQ ID NO: 137315 - RNA, 64 nt, Human
uuguauaacucuaaacgcccaugauaguagcuucaaacuggaaauagcgaaauaaaauaacuca

SEQ ID NO: 137316 - RNA, 64 nt, Human
uuuuuuuuugagagagagucuuacucugccgcccaaacuggagugcaguggcacaaucuuggcu

SEQ ID NO: 137317 - RNA, 64 nt, Human
acuucuaaaaaaagauuuuuaaacacuuaaugggaaacuggaauuguuaauaauugcuccuaaa

SEQ ID NO: 137318 - RNA, 64 nt, Human
cugguagaaaaaaagcugguggugaaccaaggucaaacuggaaauuauagucacaguauagaua

SEQ ID NO: 137319 - RNA, 64 nt, Human
uaguucucgaacuuuacuaugcauaagaaaauucaaacuggagagaaacucuacaaaugugaag

SEQ ID NO: 137320 - RNA, 64 nt, Human
aagcuuuucuauaaucaagcucaauacaccaaggaaacuggauccagaauuccuaaacuuuaaa

SEQ ID NO: 137321 - RNA, 64 nt, Human
ggagucagauucucuuucuuaaaaaaccacaaaaaaacuggauuuccaguucucuaauauucuu

SEQ ID NO: 137322 - RNA, 64 nt, Human
ugggcugcaagugcucacagcucuuguucuccagaaacuggagaauugcccucaggagaugaga

SEQ ID NO: 137323 - RNA, 64 nt, Human
cugacccuggggaaagacgccuucaucugggacaaaacuggagaugcaucgggaaagaagaaac

SEQ ID NO: 137324 - RNA, 64 nt, Human
auuucaaguuauaugaugaaauucugaauuaaugaaacuggaaaacuuuauagaauuacuuauu

SEQ ID NO: 137325 - RNA, 64 nt, Human
uuccuucauaaauauuuaucuuuuguuuguguuaaaacuggagaguguuuaaaaauuuccuuuu

SEQ ID NO: 137326 - RNA, 64 nt, Human
cuuuuaaauguggaaaggcuuuuaaaauauuuuaaaacuggaccuguauuauccugaauacacu

SEQ ID NO: 137327 - RNA, 64 nt, Human
uuuuaaauuagcaacuucaaguauaacaacuuugaaacuggaauaaguguuuauuuucuauuaa

SEQ ID NO: 137328 - RNA, 64 nt, Human
cuagguagagacagauacaugagaagagccuccaaaacuggaagcccaucauaaggcaugagaa

SEQ ID NO: 137329 - RNA, 64 nt, Human
uuuuuuuuuuuuuuuggcuugacucaggauuuaaaaacuggaacggugaaggugacagcagucg

SEQ ID NO: 137330 - RNA, 64 nt, Human
gcuccccagccacagcccccucuuacuugccuuaaaacuggagagaggaaucuaguauuugcac

SEQ ID NO: 137331 - RNA, 64 nt, Human
cuauuuggaacuuagaaaagaucuugguuuuuccaaacuggaccauccugucuuauggugaaaa

SEQ ID NO: 137332 - RNA, 64 nt, Human
ggugggagacauaagaaaggaaagaaaagacuuaaaacuggagugacaggacaaauaaucauua

SEQ ID NO: 137333 - RNA, 64 nt, Human
acugaaguggccgggcccagacaugccccuuccaaaacuggaacaccuagcuaacaggagagag

SEQ ID NO: 137334 - RNA, 64 nt, Human
guaggaaucaaaaauugaagagagauauaucugaaaacuggaauaagaagcaaauaaauaucau

SEQ ID NO: 137335 - RNA, 64 nt, Human
gagggcauggaagauccagcggaaaguugaaaauaaacuggaaugaucaucuuggcuugggccg

SEQ ID NO: 137336 - RNA, 64 nt, Human
uaucaagaaacaggacaaaguuaagagcaaucacaaacuggaauaucgccuuaaaaaucaaacu

SEQ ID NO: 137337 - RNA, 64 nt, Human
gggcauuaaauauauguuguguaugaaguaucucaaacuggaacauaaauuuagugaucaaacu

SEQ ID NO: 137338 - RNA, 64 nt, Human
ugaagauucuccccucccuggaaccagggaugugaaacuggaauucucagaugccugaggagcu

SEQ ID NO: 137339 - RNA, 64 nt, Human
cugauuuugagaauuuaaagcagauuaccuuuuaaaacuggaccaacuaaguaauugguauuua

SEQ ID NO: 137340 - RNA, 64 nt, Human
guggacaggauucgauuaaguauucccucuugucaaacuggaagcuaggggaaaaagagggauu

SEQ ID NO: 137341 - RNA, 64 nt, Human
ucaaacauuuugguuuaaaaaacaugauuauuuaaaacuggaaacuaaaaagaaucaaauugaa

SEQ ID NO: 137342 - RNA, 64 nt, Human
aagcaagaacuaauggcuaaauuaucaacuuggaaaacuggaaaaucuggauggcagagaaaua

SEQ ID NO: 137343 - RNA, 64 nt, Human
ucagugguggcuacuguucucuagcuguucuacaaaacuggagcaugcuggugaguaacaguca

SEQ ID NO: 137344 - RNA, 64 nt, Human
aaaaacaucuaccuaaaagaugguugucccuaaaaaacuggaaacaucugaaaugcucuauuua

SEQ ID NO: 137345 - RNA, 64 nt, Human
ucacacaacaggcuuaucagaaaccuaccagaugaaacuggauauaaucugagacaaacaggau

SEQ ID NO: 137346 - RNA, 64 nt, Human
uaacaguacuaaguggaagggaucugcagauuccaaacuggaauaagcucuaucauauucugaa

SEQ ID NO: 137347 - RNA, 64 nt, Human
auucacaaaaaguaaaccaaacaaaacgaaugaaaaacuggaaauaauucguuuccauaucuuu

SEQ ID NO: 137348 - RNA, 64 nt, Human
cuccaaggccggccugcgcacuugcugccaccagaaacuggaggacaugauccaggagcuucag

SEQ ID NO: 137349 - RNA, 64 nt, Human
cuuggcaauucacaaugccucacuccacacccuaaaacuggagcguccccuauggucuccugcu

SEQ ID NO: 137350 - RNA, 64 nt, Human
ugacacagcaguggaaaaagcgucgucagcaggaaaacuggaucaugacuuuugcucgaaaggg

SEQ ID NO: 137351 - RNA, 64 nt, Human
cagcuacaaaaaucuguauuauccucuuaaaguaaaacuggaguuacaaauuugagccuguuga

SEQ ID NO: 137352 - RNA, 64 nt, Human
guguagggaucauggccccuguagccaggguuaaaaacuggacuuuuuagaaguaaaguaaaag

SEQ ID NO: 137353 - RNA, 64 nt, Human
aaauguagcuuuuaugugauauguuuuaaaguuaaaacuggauggaaauagccauuuggaagcu

SEQ ID NO: 137354 - RNA, 64 nt, Human
aguaaaaucuuucuugugcauuuucaauacuuguaaacuggaaaucagaaaauauuuacuauga

SEQ ID NO: 137355 - RNA, 64 nt, Human
uuggcuacuccaucuguccuagcagagugugacuaaacuggaaauguauggagcugcauuuuuu

SEQ ID NO: 137356 - RNA, 64 nt, Human
gagccaaguagucaguggaagagaguagagcucaaaacuggauuaucaccuuagcaacuuagaa

SEQ ID NO: 137357 - RNA, 64 nt, Human
agcucacccugcccaccucgccgcaaagcgaaagaaacuggagcagccggcggcaggagagggc

SEQ ID NO: 137358 - RNA, 64 nt, Human
uccugaggaaugauacagaagaguguuuuuucauaaacuggaccauaauucuucauguuuacca

SEQ ID NO: 137359 - RNA, 64 nt, Human
gagugaguuccccucuacuuuuagccuuccacccaaacuggaagccucuaggugcuaucaauua

SEQ ID NO: 137360 - RNA, 64 nt, Human
aagagaagagugguaccauauguugcaggaagucaaacuggacuuuuuguggcuacuaaauuug

SEQ ID NO: 137361 - RNA, 55 nt, Human
agagcucacuaaagccuuaaaaaccaaacuggacuugucuuccuuggccuauucc

SEQ ID NO: 137362 - RNA, 64 nt, Human
aguuagggcagucaguaaagugagcuuuagaaagaaacuggaauuuuaacuucauuuuguaucu

SEQ ID NO: 137363 - RNA, 64 nt, Human
aauauuucagaggcuccauucacagcuuucagauaaacuggaguguucagauggacuguuuuaa

SEQ ID NO: 137364 - RNA, 64 nt, Human
acuguccagcuauccugaaaguggaucagauuauaaacuggauuacauguaacuguuuugguug

SEQ ID NO: 137365 - RNA, 64 nt, Human
uuuaagacguuuuuaguuuauuuguuguuaaguuaaacuggagaaaguuugucauccucauuuu

SEQ ID NO: 137366 - RNA, 64 nt, Human
uuaugacauucucugucuacucagaucauagugaaaacuggaaacaaaaaaaaaaaacagccuc

SEQ ID NO: 137367 - RNA, 64 nt, Human
auugcagaauauugcauggagcacagugcuuccaaaacuggaagguggguuguauuaggucauu

SEQ ID NO: 137368 - RNA, 64 nt, Human
ugguuuccucaaguaucaugggauaguuuccuugaaacuggaggaugacaguuucccaacucac

SEQ ID NO: 137369 - RNA, 64 nt, Human
cugagcaccucuaggcccucuaggcuggggaagcaaacuggaacccauggcaauaauaggaggg

SEQ ID NO: 137370 - RNA, 64 nt, Human
uuccagccagucugcugccugcucccucuuccugaaacuggacuguuccugggaaaagggugaa

SEQ ID NO: 137371 - RNA, 64 nt, Human
ugguaguagguauuucgugagaaguucaacaccaaaacuggaacauaguucuccuucaaguguu

SEQ ID NO: 137372 - RNA, 64 nt, Human
auacuaguauuuuauauucuuuuguugucguuuaaaacuggagcuucagugucucuucccuccc

SEQ ID NO: 137373 - RNA, 64 nt, Human
uuuugguauuguuacgaacauggauaugacaaccaaacuggaaaucagaacacuaggguaaagu

SEQ ID NO: 137374 - RNA, 64 nt, Human
ugauauuucacuuauacugcauaacaagcuaaccaaacuggacauggugaauaaaucauaaaac

SEQ ID NO: 137375 - RNA, 64 nt, Human
gagaaaagagccagaaguugaugugggaagaaguaaacuggauacuguacugauacuauucaau

SEQ ID NO: 137376 - RNA, 64 nt, Human
cuacaaucugacuuuucugugaauuuuucuccuaaaacuggaccauaauuucaguaaaaccuuc

SEQ ID NO: 137377 - RNA, 64 nt, Human
agaguauuguauagucaauguuaaauaaaagccaaaacuggaaugugcagaaaguaggcuuugg

SEQ ID NO: 137378 - RNA, 64 nt, Human
uguaacuaucuuacauguuuacauaagaaauaauaaacuggaggugggaauggagaacaaugug

SEQ ID NO: 137379 - RNA, 64 nt, Human
acauuggcaugaauuuugugaauuaggguguuaaaaacuggaauugaauuuguacaaaaagaga

SEQ ID NO: 137380 - RNA, 64 nt, Human
uccccugcaccucuccuguucgguuuagacccccaaacuggagggggcauggagaaccguagag

SEQ ID NO: 137381 - RNA, 64 nt, Human
cccuuuacugccacagcugcucaccuugucuggcaaacuggagggaccucagaaacuggacucc

SEQ ID NO: 137382 - RNA, 64 nt, Human
gcucaccuugucuggcaaacuggagggaccucagaaacuggacuccugcauguccuugggggcg

SEQ ID NO: 137383 - RNA, 64 nt, Human
uucuggaauuaccaacaggaaugaggaaagaagaaaacuggaguuuccagucucugaguucuac

SEQ ID NO: 137384 - RNA, 64 nt, Human
acaccaaagauagaggcaauggauagaaauuuuuaaacuggaaagaaaaccugaauuacacuac

SEQ ID NO: 137385 - RNA, 64 nt, Human
uuagaauagucagcuauccugagcaaaaggaaucaaacuggaggaaucauauuaccugacuucc

SEQ ID NO: 137386 - RNA, 64 nt, Human
gaaaagauaaugucuuuaauaaauggugcugggaaaacuggauauccauaugcagaagaaugaa

SEQ ID NO: 137387 - RNA, 64 nt, Human
gugcauguuuggaguuuguagugggugguuuguaaaacuggaccauucugccuugcuauggguu

SEQ ID NO: 137388 - RNA, 64 nt, Human
cuggaugaugaccacuggcauuggcauguucagaaaacuggauuuaggaauaauguuuugcuac

SEQ ID NO: 137389 - RNA, 64 nt, Human
ugguggaaaaaauauaauuauuuucaucagacuuaaacuggaaauugaugauuucugaacugaa

SEQ ID NO: 137390 - RNA, 64 nt, Human
gaaagaugaaaaaaagagguagcuuuuagauugcaaacuggaaauguaaaacucaugaaauuua

SEQ ID NO: 137391 - RNA, 64 nt, Human
auaugcaaugguagaucagauugggggauguagcaaacuggacuuuaagaacuggaaagagguu

SEQ ID NO: 137392 - RNA, 64 nt, Human
aguaaaagguggcuggaacaucuauuuuucuacaaaacuggaaaaaugaaccugguucuagaag

SEQ ID NO: 137393 - RNA, 64 nt, Human
uaaauuuuaagaaccccgcccacaacagggaguuaaacuggaggacuuugcaugauuaguucag

SEQ ID NO: 137394 - RNA, 64 nt, Human
aucaugcauaguagcuugaaaucuagucuggagaaaacuggaucaagauucuagcccacuggag

SEQ ID NO: 137395 - RNA, 64 nt, Human
uccuuuacuuucucaccucuguugaaacauuuagaaacuggauuugggaacccaauuuuggaaa

SEQ ID NO: 137396 - RNA, 64 nt, Human
acaauauaaugaagugcuccagucaggccuaucuaaacuggauucacagcucugucacuuaauu

SEQ ID NO: 137397 - RNA, 64 nt, Human
guuuuauuuggucucaucuugucuaugagaguugaaacuggaacugggaaaccuaagaugggug

SEQ ID NO: 137398 - RNA, 64 nt, Human
auuguaucauaauuacaggaaguuuuuauuuuuaaaacuggaucugggguauauucauuugccc

SEQ ID NO: 137399 - RNA, 64 nt, Human
gcuggucaucacaggaacaucucaacguucgaguaaacuggaggacuguggcuauuccugaacc

SEQ ID NO: 137400 - RNA, 64 nt, Human
gacucuauuaccuguuuugccuuauacauuuuagaaacuggaaauuuuuuaaagaaaaugcuuu

SEQ ID NO: 137401 - RNA, 64 nt, Human
guggucaguuccaacagcacuguccguacuuuuaaaacuggaaugaccuccuucagauaucgug

SEQ ID NO: 137402 - RNA, 64 nt, Human
gcuuuauucuaagcaaaucugugucuacuuuaaaaaacuggaaauggaaaaaaaaauaaaucuu

SEQ ID NO: 137403 - RNA, 64 nt, Human
accuggucugugcaccuguguugcucacaguugaaaacuggacacuuuuguauguauauuauag

SEQ ID NO: 137404 - RNA, 64 nt, Human
gagauucaguguauguauuuauuuacaugagaggaaacuggaauauaaucccauaaauuaucac

SEQ ID NO: 137405 - RNA, 64 nt, Human
acuuaagggcacacagcuaauaaguaauaggccuaaacuggauuuccuuauuccaaauccuguc

SEQ ID NO: 137406 - RNA, 64 nt, Human
ugaucauuuaguucugucuauuuagaaauauguaaaacuggauuuuuuuuuaaguaauauguga

SEQ ID NO: 137407 - RNA, 64 nt, Human
uggauuucuuuuuauuuucuuuucaacuugaaagaaacuggacauuaggccacuauguguuguu

SEQ ID NO: 137408 - RNA, 64 nt, Human
uaaagguuucuguauauuguauagagcuguguauaaacuggauguagaagcacgcuggcugccu

SEQ ID NO: 137409 - RNA, 64 nt, Human
caguuuugacccuggcauuaacuggccuuagaagaaacuggauccugguaggggguggcauuuu

SEQ ID NO: 137410 - RNA, 64 nt, Human
gugucuuauuccuauaagcuauguguucagacugaaacuggagaaauuaugacuauuuuauuua

SEQ ID NO: 137411 - RNA, 64 nt, Human
aaacgaggggaaaagaccagaguuuuucaggagaaaacuggaggaaaaugggcacaaaaacuca

SEQ ID NO: 137412 - RNA, 64 nt, Human
uuuuuuuuuuuuuaauaugcaguuuguaagaacaaaacuggauggcaucagaauugucuggaag

SEQ ID NO: 137413 - RNA, 64 nt, Human
ucaacaggacauauguggccuugaagggaagacaaaacuggauguucuuucuuguuggauagaa

SEQ ID NO: 137414 - RNA, 64 nt, Human
uggcuguucauguauguaggaguuaaaauaggccaaacuggagaaauaaacgcauucuguccac

SEQ ID NO: 137415 - RNA, 64 nt, Human
accacucuuauaaaaagcucacaaaccuuugaagaaacuggaguaggcuguuauuucauuaagg

SEQ ID NO: 137416 - RNA, 64 nt, Human
aagauuugugaguuuuucaacaguuuuauuuuaaaaacuggauggcuuaugauuguaaagcauu

SEQ ID NO: 137417 - RNA, 64 nt, Human
guucuggugggggaaaccuguguucaagauucaaaaacuggaaggagcuccagcccugaugguu

SEQ ID NO: 137418 - RNA, 64 nt, Human
cuccaacucgaggagccucaguuuccucaucuguaaacuggagagagcccagcacuuggcaggu

SEQ ID NO: 137419 - RNA, 64 nt, Human
aaaaugauugcauucucauugagcaugaaagucaaaacuggaauuuucuaaagcuuuggagaaa

SEQ ID NO: 137420 - RNA, 64 nt, Human
ugacucaacugcccagacaccucauuguacuugaaaacuggaacagcuugggaaugccaugggg

SEQ ID NO: 137421 - RNA, 64 nt, Human
gacuguugcugaacuggcaacuuacuugggccugaaacuggagaaggggugacauuuuuuuaau

SEQ ID NO: 137422 - RNA, 64 nt, Human
gaaaauguguuagacaagccacaaaguuaaaauuaaacuggauucaugaugauguaggauuguu

SEQ ID NO: 137423 - RNA, 64 nt, Human
cuugagauauaagugugaguacuauacaagcauuaaacuggagugcaguaaaccuaggaaccuu

SEQ ID NO: 137424 - RNA, 64 nt, Human
aaucgacuggacugcagauguuuuuucuuuuaacaaacuggaauuuucaaacagauuaucugua

SEQ ID NO: 137425 - RNA, 64 nt, Human
agauuuuuuuccccuagauuuugagggagcagagaaacuggaaaaaacuuuagucaauaucucg

SEQ ID NO: 137426 - RNA, 64 nt, Human
acagggcucaacugaauaagaggcuuaagaggauaaacuggagcagaaauaagccuuaggugcu

SEQ ID NO: 137427 - RNA, 64 nt, Human
uuuacagggcuaacauaaagcuggcuccauuuaaaaacuggaguacuuccuagugcagccagcc

SEQ ID NO: 137428 - RNA, 64 nt, Human
gauuaagaagaugguuuuguuauuaaauagcauuaaacuggaauugacaagaguguugagcauc

SEQ ID NO: 137429 - RNA, 64 nt, Human
auuugauuuggcuaauuacaaaaaguacagguuuaaacuggacuuagcuugaguuaaaggcaaa

SEQ ID NO: 137430 - RNA, 64 nt, Human
uuauuuucuaacucgucuucuuuccgccgguggaaaacuggacuguggccagggcuggccccca

SEQ ID NO: 137431 - RNA, 64 nt, Human
cagggcaacugaacagauugcacaugggauagccaaacuggacuuucuuuguuuccucuuuaaa

SEQ ID NO: 137432 - RNA, 64 nt, Human
aauugugcaaccaccagaaaaacacuacuguggcaaacuggagaagugccaauuuaauucuaac

SEQ ID NO: 137433 - RNA, 64 nt, Human
aauuuccuuaaauuauauacuuaacauagcagagaaacuggauuguuuuuguauauaagacugc

SEQ ID NO: 137434 - RNA, 64 nt, Human
guaucacacucagcucugcuguguuaacuuugugaaacuggauggaacaaacuuuaacuuacca

SEQ ID NO: 137435 - RNA, 64 nt, Human
aagaacaguucuauccuggugccuuacgaauaaaaaacuggauucugguuuacagcagcuuuac

SEQ ID NO: 137436 - RNA, 64 nt, Human
cggcaacuucuaccgagagccauggcucaacaccaaacuggacaguagacaucaugaucccucc

SEQ ID NO: 137437 - RNA, 64 nt, Human
ccacuaccccugccaucacugccccacauggacaaaacuggagucgagaccuagguuagauucc

SEQ ID NO: 137438 - RNA, 64 nt, Human
ugugucucaguugcaucuguacagccuugucugcaaacuggaggaugcggggcaagcccuuagg

SEQ ID NO: 137439 - RNA, 64 nt, Human
cagccuucucuuuccucuugaggauacuuaggguaaacuggauccuuccugcucaaggauccuc

SEQ ID NO: 137440 - RNA, 64 nt, Human
aaaaggucauugguggcagaguggauucuugaacaaacuggaaaguacguuaugauaguguccc

SEQ ID NO: 137441 - RNA, 64 nt, Human
ucagacccagugaaaacuaaggauagauguuuaaaaacuggaggucuccugauaaggagaacac

SEQ ID NO: 137442 - RNA, 64 nt, Human
aaaguguuuucuuuuuuuuaaaucaagacuuuuaaaacuggauuuccucccaucacuguuuuuu

SEQ ID NO: 137443 - RNA, 64 nt, Human
aauuuucacgauguauggucaggaaugugacuguaaacuggacuuuggggcccaggcauaaguc

SEQ ID NO: 137444 - RNA, 64 nt, Human
caccagugaccuccagcugggggugggaaggaaaaaacuggacacugccaucugcugccuaggc

SEQ ID NO: 137445 - RNA, 64 nt, Human
aaugcgggagaagcagcuggcucaggaagccaagaaacuggaugccaaggugggugggaccaag

SEQ ID NO: 137446 - RNA, 64 nt, Human
ucugauaucccauuuuggugugucauaauacuucaaacuggaaagucaccuggucgagucuagg

SEQ ID NO: 137447 - RNA, 64 nt, Human
auggacagaggcaggaaguaaggaaacugauguuaaacuggaaccuaagacagugaugaagaug

SEQ ID NO: 137448 - RNA, 64 nt, Human
aagguauacaucuuccccuaaugccuaucugaccaaacuggauagaaccaccauagugaagugu

SEQ ID NO: 137449 - RNA, 64 nt, Human
cuaagcauuuuguucacaccacgcuuugauaacuaaacuggaaaacaaagguguuaaguaccuc

SEQ ID NO: 137450 - RNA, 64 nt, Human
ggguugguuucuuuccuuuaaaaaaauuuguauaaaacuggaagugugugugugugagcauggg

SEQ ID NO: 137451 - RNA, 64 nt, Human
ggauugagaaaagggauggaacugauuugaggcuaaacuggauuagcaauuuauuaaaaacuga

SEQ ID NO: 137452 - RNA, 64 nt, Human
acacaaacuuuagagcaagaagaccucagacaggaaacuggaauuuuuuaaagugccaaaacau

SEQ ID NO: 137453 - RNA, 64 nt, Human
acaaaugugaaugaucgacugacugcuuguugccaaacuggaaauguucuguagggauuuacug

SEQ ID NO: 137454 - RNA, 64 nt, Human
cagagucccgcagguaccccagcucugcuugccgaaacuggaaguuauuuauuuuuuaauaacc

SEQ ID NO: 137455 - RNA, 64 nt, Human
uccuuaaguaagugaagcauagcaaaucuacuuuaaacuggauggguuaauuuauauaaacauu

SEQ ID NO: 137456 - RNA, 64 nt, Human
ccccaaccuuccaaaccuccaucaccaacaacccaaacuggaugucaagcaaaaugcacaauuc

SEQ ID NO: 137457 - RNA, 64 nt, Human
ucaaaaccacccagcaguagguuuuguuaacaacaaacuggauuuuaaaaguucugccauguua

SEQ ID NO: 137458 - RNA, 64 nt, Human
acuucacccgggggugaagggguaaacccgacugaaacuggaacccuuguccuccgcuggugcg

SEQ ID NO: 137459 - RNA, 64 nt, Human
aucuggguagcaacagcaucuuccacaguuuuccaaacuggauagcugccaaccagcagacauu

SEQ ID NO: 137460 - RNA, 64 nt, Human
auaaauacugauuauuggccauaaagugguauuaaaacuggaucucuuuucuuccauggcacua

SEQ ID NO: 137461 - RNA, 64 nt, Human
cucagguacuucagaugugcuuaauauggagugaaaacuggaccagagguggaaagauguauuu

SEQ ID NO: 137462 - RNA, 64 nt, Human
auuaugaugaguaacuggaggggcuuagaaacaaaaacuggaugaaagaguaugcaugaagaaa

SEQ ID NO: 137463 - RNA, 64 nt, Human
agggugggugaaguugacaucacgauagaaaacaaaacuggaaugggaguuuagguccaauuug

SEQ ID NO: 137464 - RNA, 64 nt, Human
uuccagugugguucugacagcacuacugauaaccaaacuggagucagguauuuuguacuuugca

SEQ ID NO: 137465 - RNA, 64 nt, Human
acaaaaacaaacaaaagcaagaaaaccacaacuaaaacuggaaauguauauuuuguauauuuga

SEQ ID NO: 137466 - RNA, 64 nt, Human
ugcuuuuggggagauacacuagcaauuuuuuuaaaaacuggaacagugugauaggaagccugcu

SEQ ID NO: 137467 - RNA, 64 nt, Human
uccaucauaauuuuugcuguugauuugaacauuaaaacuggaauugugcuaaaaucagaacaug

SEQ ID NO: 137468 - RNA, 64 nt, Human
uggccacagccaguaaaucaggccagagugucucaaacuggacaagaaaugugcugcauugccg

SEQ ID NO: 137469 - RNA, 64 nt, Human
gucuccuucuagcuuuuaggcagccuacucuuggaaacuggaggaaacugcccugagaauuauu

SEQ ID NO: 137470 - RNA, 64 nt, Human
cauauuuagugaccaaggcaucaaggacaucccgaaacuggaaauucauauccaucugguauga

SEQ ID NO: 137471 - RNA, 64 nt, Human
ugugacugggaaggagaacuuauuccuuaccaggaaacuggaagcuaaaaauacagagggugac

SEQ ID NO: 137472 - RNA, 64 nt, Human
acuuuguauaauucuguguuauuaacaguuaacaaaacuggagcaucugaauuacauccaaccu

SEQ ID NO: 137473 - RNA, 64 nt, Human
cagaaguaagccucaucaucagagccuuuccucaaaacuggagucccaaaugucaucagguuuu

SEQ ID NO: 137474 - RNA, 64 nt, Human
aaauaaucuguauaaacaaggaauguguuagcuuaaacuggaucauuuuacuuuuuggcaucau

SEQ ID NO: 137475 - RNA, 64 nt, Human
aacauaccuaacuuucuugcaauaaaugcaaaagaaacuggaacuugacaauuauaaauaguaa

SEQ ID NO: 137476 - RNA, 64 nt, Human
uaggggucaaugugaugcugcuggagacgagaauaaacuggacuagaauagugcauuguauuua

SEQ ID NO: 137477 - RNA, 64 nt, Human
acggaguaaaauacuaaacaccucugaagacugcaaacuggauuaguucuuuuacuucaguguu

SEQ ID NO: 137478 - RNA, 64 nt, Human
agguuccaagauuuuacuucaaauuacaccuucaaaacuggagcagcauauagccgaaaaggag

SEQ ID NO: 137479 - RNA, 64 nt, Human
uauccuaugacugugcuacguauauauagguaauaaacuggaauucuguugaugaauauagcug

SEQ ID NO: 137480 - RNA, 64 nt, Human
agaacgcuugagaggcacuuuguaaagauuuguuaaacuggaaacguuuuacaugaucugauac

SEQ ID NO: 137481 - RNA, 64 nt, Human
caugauggcagacauucuaccccuuuuccuggaaaaacuggaagaaugaaaauaauuuuuuucu

SEQ ID NO: 137482 - RNA, 64 nt, Human
ggauucucucccccaccccgaauucugucugcuuaaacuggaauacacaggagcccuuccuggc

SEQ ID NO: 137483 - RNA, 64 nt, Human
cuggcaugggcagggagcccacaaaacucuaaccaaacuggaggcuggcaugggagaagugcuu

SEQ ID NO: 137484 - RNA, 64 nt, Human
uuuuguaucuugucauaguuauccacaaauggcaaaacuggacuugauucuacugguaugcaaa

SEQ ID NO: 137485 - RNA, 64 nt, Human
cuauuggucccauccaugaugcugagacaaacagaaacuggaagcugaagucagugucucuggu

SEQ ID NO: 137486 - RNA, 64 nt, Human
gucccagggccccuccugaggaugcucgccagggaaacuggaaacaggggcagggcaaagacug

SEQ ID NO: 137487 - RNA, 64 nt, Human
ggagucauaccuagaauaguuacacacaagagggaaacuggaagccaaacacuguacaguauug

SEQ ID NO: 137488 - RNA, 64 nt, Human
uuaaaauuuauuauuuugaucuugaauuauuuauaaacuggaaagugguuugauuauugugagu

SEQ ID NO: 137489 - RNA, 64 nt, Human
caaacaaacaaacaaacaacguaucuuacugacuaaacuggaauggaaaucuuauaauuagugu

SEQ ID NO: 137490 - RNA, 64 nt, Human
aagaaacagaagucaggcagaggcgugucugugcaaacuggaggacuccuuccaacuuccugga

SEQ ID NO: 137491 - RNA, 64 nt, Human
cacagcuaucauagaaaagaaacuugccucauguaaacuggauugagaaauucucagugauucu

SEQ ID NO: 137492 - RNA, 64 nt, Human
uuuaauugaauucaaacuaucaagcacuacuuagaaacuggaaaacauauauauguuagcauca

SEQ ID NO: 137493 - RNA, 64 nt, Human
ugccccagggguuuucaccaaggauuuucaagacaaacuggaguaagaauuaaagccccagagg

SEQ ID NO: 137494 - RNA, 64 nt, Human
uuaacucuugaaauauaggaacuuaaauaaugugaaacuggauuaaacuuaaucuaaauggaac

SEQ ID NO: 137495 - RNA, 64 nt, Human
uuuuaauuucuccauuuguaauagcuggguauuuaaacuggaagcaaauaguuuucuuucuuaa

SEQ ID NO: 137496 - RNA, 64 nt, Human
caguauaacagagcaauuggaagagaauaugaaaaaacuggaaucuaaauagucagugaggaag

SEQ ID NO: 137497 - RNA, 64 nt, Human
ggacaaaucauggcuauaucuauagaccuuggauaaacuggauugaccaauuauacacucacgg

SEQ ID NO: 137498 - RNA, 64 nt, Human
uauggagcucaugcaggagaaugagcggguggagaaacuggaaugucgcugcauucagcugucu

SEQ ID NO: 137499 - RNA, 64 nt, Human
acaggaaguaugagaguucugaaacccuugauagaaacuggaagccugccauggaacacaauac

SEQ ID NO: 137500 - RNA, 64 nt, Human
uucuuguguuggaaacuuuguaauguaaaaggaaaaacuggaaauccccacgcccuguuucccu

SEQ ID NO: 137501 - RNA, 64 nt, Human
cauguaaaaauguuuccuuuuaguuguugaaacaaaacuggauagaaaaaugcuguucagaaau

SEQ ID NO: 137502 - RNA, 64 nt, Human
uucuacuaaaauucacacugaaacuuuaucuucuaaacuggaaucauuacuuaauuuuaacuaa

SEQ ID NO: 137503 - RNA, 64 nt, Human
ucaaaccaaauguuaaaaagacuuuccuuuuguaaaacuggauuagagaagacuuuucaguggg

SEQ ID NO: 137504 - RNA, 64 nt, Human
ccucacucuuuucaucuucugcacguucuucgugaaacuggaaggaucccgggucucagcuaga

SEQ ID NO: 137505 - RNA, 64 nt, Human
gagcucucacuauauugucaagccuaagauugaaaaacuggaggcuuuauuaguguuuuuauau

SEQ ID NO: 137506 - RNA, 64 nt, Human
ucacagaucuccaaaaccaggaauuguucuaguaaaacuggaaauuuguaugaguggggggagu

SEQ ID NO: 137507 - RNA, 64 nt, Human
ugguuuagaggaacccaagauguggccuuuagcaaaacuggacaauguccaaacccacucauga

SEQ ID NO: 137508 - RNA, 64 nt, Human
uacuggagcuucuucauguauguaacagcauauuaaacuggagacagugaugaaucagcuacaa

SEQ ID NO: 137509 - RNA, 64 nt, Human
ccuggcugucuuuaucauccccacaaacauuuugaaacuggaauauuugucuucagaaaaugga

SEQ ID NO: 137510 - RNA, 64 nt, Human
cauggauggugacugcuggcucugucaccucaucaaacuggaugugacccaugccgccucguug

SEQ ID NO: 137511 - RNA, 64 nt, Human
cuucacuuguuauacaucacugauuauuuggguuaaacuggacucauuucaagcaguuugcuuu

SEQ ID NO: 137512 - RNA, 64 nt, Human
uuggcaucaacuuggauggcucgcauaugacaggaaacuggauugccaaggcauggcagacuga

SEQ ID NO: 137513 - RNA, 64 nt, Human
uguaucagaugcuggaauauuccuaacauuugacaaacuggaguugaacuaaaggcuccacggg

SEQ ID NO: 137514 - RNA, 64 nt, Human
aaggagucucuggacaagaagcugggagaggcacaaacuggacaucucucucucucauauccuu

SEQ ID NO: 137515 - RNA, 64 nt, Human
cuuacgugcacaaaaagagaaggcuuugguacugaaacuggacaccuuguguacucgauaccuu

SEQ ID NO: 137516 - RNA, 64 nt, Human
acugaguuuuccuuuaggaaaacucccgagggccaaacuggaaacauaagagugacugcucggu

SEQ ID NO: 137517 - RNA, 64 nt, Human
cuucaugccucaagauuuggguaccuggauugcuaaacuggauuguugagauaaaaugagccag

SEQ ID NO: 137518 - RNA, 64 nt, Human
ccugggcaucuuaggacuggaggggcuccuuggaaaacuggaagaagucucaacacuguuucuu

SEQ ID NO: 137519 - RNA, 64 nt, Human
cccuugaagcaagaaagagggucccagggcugcaaaacuggaagcacagccucggggaugggga

SEQ ID NO: 137520 - RNA, 64 nt, Human
agaaagacuuaucaacauuuguuccaugagcagaaaacuggagcucuggccucaguguuacagc

SEQ ID NO: 137521 - RNA, 64 nt, Human
ggggaagaaggggguuugaagcccaccaagaccgaaacuggagaagggcuggaccuggaccugg

SEQ ID NO: 137522 - RNA, 64 nt, Human
ggcauuucguucagagcugacuuucagugcacccaaacuggaugacgugccaauguccauuugc

SEQ ID NO: 137523 - RNA, 64 nt, Human
aguuggagucacucuuaugcuguacccaguuucuaaacuggagacugugugugcccucugggcu

SEQ ID NO: 137524 - RNA, 64 nt, Human
aaccuuggcuaaauggagcagcgaaaucaacgagaaacuggacuuuuuaaacccucuucagagc

SEQ ID NO: 137525 - RNA, 64 nt, Human
caucccuuuuuucuuuguuguuuuuguugaaaacaaacuggaaacuuguuucuuuuuuuguaua

SEQ ID NO: 137526 - RNA, 64 nt, Human
gaggaagccagacuccagagacacggagaagaucaaacuggagcugcguucauaggcuggcacu

SEQ ID NO: 137527 - RNA, 64 nt, Human
gcagugcccgcugcccagaagagaccagcaagccaaacuggagcccccauugcaggcugucgcc

SEQ ID NO: 137528 - RNA, 64 nt, Human
ugaauuuuauuuuacuugucacaccugucuuaauaaacuggaguuuugcugcuaaagaacucuu

SEQ ID NO: 137529 - RNA, 64 nt, Human
uacagaagccggcaacgcuugcuauuuauuuuacaaacuggacuggcucaggcagggccacggc

SEQ ID NO: 137530 - RNA, 64 nt, Human
cuguugccuaaauauguguguaaaaugagcugauaaacuggaguacuacuuaaaaaaaagucug

SEQ ID NO: 137531 - RNA, 64 nt, Human
acugguacugaaaguguaauuucuuagagccaaaaaacuggagaaacaaauauccugccaccuc

SEQ ID NO: 137532 - RNA, 51 nt, Human
auaacacaucgggaaaaugaaaaacuggauacaaacgaggcacuuaauaca

SEQ ID NO: 137533 - RNA, 64 nt, Human
ugugaagcuuuacgcgcacacggacaaaaugcccaaacuggagcccuugcaaaaacacggcuug

SEQ ID NO: 137534 - RNA, 64 nt, Human
agcagaggcauccuugagcuuuaaagcauugaacaaacuggaaaaugcaacauaccacauaacu

SEQ ID NO: 137535 - RNA, 64 nt, Human
agguuuugucuaucaucucaguucagaggcaacgaaacuggacucauuacuccaaauaaacaug

SEQ ID NO: 137536 - RNA, 64 nt, Human
ugguggcuuuugcaaaaaucuuuauugguguugaaaacuggaaaaaauaacucauccagaauuc

SEQ ID NO: 137537 - RNA, 64 nt, Human
uuaaucuugcagaauguuugcaggacugacuaucaaacuggaugauuuccauuuauacccuacu

SEQ ID NO: 137538 - RNA, 64 nt, Human
gauaccaucuugagaaauccuccuugguaucaugaaacuggagcagaggaauugcaauuuagca

SEQ ID NO: 137539 - RNA, 64 nt, Human
cauuuccaugucaacucuaaaugaagucuuuaugaaacuggaaggacagucaacuaucgaacaa

SEQ ID NO: 137540 - RNA, 64 nt, Human
aaaagggagggcugucugcuuuuuguaacuugaaaaacuggacaucuauguuauauguacucau

SEQ ID NO: 137541 - RNA, 64 nt, Human
cuggcaaaugcacacaccucaugcuagccucacgaaacuggaauaagccuucgaaaagaaauug

SEQ ID NO: 137542 - RNA, 64 nt, Human
caaucauuguuuugaauauuacuccuauuuuuguaaacuggaauuaaaaggauaguauuuuuau

SEQ ID NO: 137543 - RNA, 64 nt, Human
gaaauaugauucuuggagucaaugaucucuaaacaaacuggauuaucaacuauuuacaacgucu

SEQ ID NO: 137544 - RNA, 64 nt, Human
auucugguagcuccuucuccuugugacauggcaaaaacuggacguuuccagauugugaauaacu

SEQ ID NO: 137545 - RNA, 64 nt, Human
uucuuuuauucagagcaauguuucuuguauucugaaacuggaaacugaaccaguuuguuucucc

SEQ ID NO: 137546 - RNA, 64 nt, Human
aaaauguguuugcugccuugcuccuagcagacagaaacuggauuaaaacaauuuuuuuuuuccu

SEQ ID NO: 137547 - RNA, 64 nt, Human
acauaaugauaauuuuuuccauacucagaaugaaaaacuggauauuacguuuuuguuuuggggu

SEQ ID NO: 137548 - RNA, 64 nt, Human
uguguuccuguugggcguuacuagaaacuauggaaaacuggaaaauaacuuugaaaaaauugga

SEQ ID NO: 137549 - RNA, 64 nt, Human
gucggcucuagccccagucccauuggaagguuaaaaacuggaguucugcuuccuugauucagug

SEQ ID NO: 137550 - RNA, 64 nt, Human
aacaguggaagaugcaaauaaguuuuugagaauaaaacuggauuuugaaauuuuacauuaguac

SEQ ID NO: 137551 - RNA, 64 nt, Human
gaaaaucuucuuuacucugcauguuuuuaaugguaaacuggaaucccagauaugguugcacaaa

SEQ ID NO: 137552 - RNA, 64 nt, Human
auagauauuucugauuugaaaauucuaaagaauuaaacuggaaaaguauuucauuuacuuagug

SEQ ID NO: 137553 - RNA, 64 nt, Human
uuuuuaaaaaaaaaauggaaaaaaaaaagcuuuuaaacuggagagacuucugacaacagcuuug

SEQ ID NO: 137554 - RNA, 64 nt, Human
ggaaccuuacuuuccuuuuaguuauaaaugagauaaacuggaaaauuucaguuguaaaugauga

SEQ ID NO: 137555 - RNA, 64 nt, Human
gugacucaaaguagugccacugcagugucuuuuuaaacuggaaacagaauuggaaaacugccug

SEQ ID NO: 137556 - RNA, 64 nt, Human
aaacacagagcccccuagauggugggggaauggcaaacuggacccaggacuccgcccuuuaaaa

SEQ ID NO: 137557 - RNA, 64 nt, Human
aaacagggauauuuuaaaucacauaccugcagacaaacuggagcaauguuauuuuuaaaggguu

SEQ ID NO: 137558 - RNA, 64 nt, Human
gagcuguaccuggcacggcccauccuggacugagaaacuggaaccucagaggaacccgugccuc

SEQ ID NO: 137559 - RNA, 64 nt, Human
cugggaaaacugucuagccauaaguagaaagcugaaacuggaucccuuccuuacaccuuauaca

SEQ ID NO: 137560 - RNA, 64 nt, Human
uuugccgucuaaggcaguuguuuaugacagcugaaaacuggacacucccuaaauguccaccuuu

SEQ ID NO: 137561 - RNA, 64 nt, Human
cauucuuaagagucgugagguccuucugaauguaaaacuggagcccaggagaagcugucccagg

SEQ ID NO: 137562 - RNA, 64 nt, Human
agcaggacauuguguguauaguuacaaugcuuccaaacuggaacucuacauuuuguaucuuuua

SEQ ID NO: 137563 - RNA, 64 nt, Human
caguuccaagugcaucccuuauucuauaggaaauaaacuggagacaaaucucauuuaagagaug

SEQ ID NO: 137564 - RNA, 64 nt, Human
cuggcauaacuggcuagccauaugcaggauauugaaacuggaccccuauccuucacgauauaca

SEQ ID NO: 137565 - RNA, 64 nt, Human
gaaucacaauguaaauauuacacaucaagcgaugaaacuggaaaacuacaagccacgaaugaau

SEQ ID NO: 137566 - RNA, 64 nt, Human
cccucuuccuuucccaccccaccuccccggagagaaacuggacauggggccuggggaggggagc

SEQ ID NO: 137567 - RNA, 64 nt, Human
caaaggaucacaacuccuugccggcaagggaacaaaacuggauagagaaugaguuugacaaauu

SEQ ID NO: 137568 - RNA, 62 nt, Human
gucagaaccaagggguuuaauaaauaacccuugaaaacuggaucggaugaauuggcuuucau

SEQ ID NO: 137569 - RNA, 64 nt, Human
acuggagcuguuugguuuucucgcauuuuccaccaaacuggaagcuguuuuugcagccugagga

SEQ ID NO: 137570 - RNA, 64 nt, Human
uggucccuaaaucuuacuaaacauaaaaaaacuuaaacuggagagaaacuacaaagcuggaaga

SEQ ID NO: 137571 - RNA, 64 nt, Human
ccaggaaaccccacacaggaauucccaucccuggaaacuggagaauuucaaugccccgagucca

SEQ ID NO: 137572 - RNA, 64 nt, Human
ggguggggggaugggaagggggugcccugaaaccaaacuggaagcccccucugccucccagcug

SEQ ID NO: 137573 - RNA, 64 nt, Human
aaugaacuguucuagggaaaguggcuuccugcccaaacuggaugggacacguggggaguggggu

SEQ ID NO: 137574 - RNA, 64 nt, Human
uguuauuucagaauaacuaaaguacuucagaaugaaacuggauacaguauauucaguucauaag

SEQ ID NO: 137575 - RNA, 64 nt, Human
uauaauucauaccuggcaaaacauauuagaauucaaacuggagagaaaccuuacaaaugugaug

SEQ ID NO: 137576 - RNA, 64 nt, Human
caagaugguucauuauggcuguguucaccauagcaaacuggaaacaaucuagauauccaacagu

SEQ ID NO: 137577 - RNA, 64 nt, Human
ucuuccauuucugcucucaaacccuacugggaucaaacuggaauaaauugaagacagccagggg

SEQ ID NO: 137578 - RNA, 63 nt, Human
auuucauuacagauaggugaucuucagcuuugcaaacuggaugaacuagauugcuugaucaaa

SEQ ID NO: 137579 - RNA, 64 nt, Human
uugguccaccuuuaggaagguauugagaagcaagaaacuggaggcccaauaucuaaccugcaaa

SEQ ID NO: 137580 - RNA, 64 nt, Human
agccuggcucugucaagcugggucaggggccuugaaacuggagaaguggaagucuaugguuggu

SEQ ID NO: 137581 - RNA, 64 nt, Human
ggcugucauuccugucgaugaccugaaaggacacaaacuggaauuuucaggucuguccccugca

SEQ ID NO: 137582 - RNA, 64 nt, Human
gaccuucuacugauuagauuuucaguuuucuuucaaacuggaaaugccuccauaaauaugaucu

SEQ ID NO: 137583 - RNA, 64 nt, Human
ucccagccaccaaaacccaugcacagugcugcagaaacuggacaguuccggacagcggucaagg

SEQ ID NO: 137584 - RNA, 64 nt, Human
aaauauacuccuaguaauuuaagauuuuguuuuuaaacuggaaauaaaagauuguauagugcau

SEQ ID NO: 137585 - RNA, 64 nt, Human
uaacguaguaaauccucuuuuugaugaguuucugaaacuggagcgguucaacguuauccagugu

SEQ ID NO: 137586 - RNA, 64 nt, Human
aguugaaaauuauggcuguacuauugcuuaaacaaaacuggaacuguuguugaauccauagcca

SEQ ID NO: 137587 - RNA, 64 nt, Human
ccuaagagauaaugcucuguacuucauuugaaauaaacuggaauuguauuagauagcucacacc

SEQ ID NO: 137588 - RNA, 64 nt, Human
gauuuuuuuuuccuccugucuuuuucauuuguagaaacuggagacguguaaagaagauaaauaa

SEQ ID NO: 137589 - RNA, 64 nt, Human
acgaagccuuccccaugaaccccaccacuggcuaaaacuggacacauccugccuggcaaccuga

SEQ ID NO: 137590 - RNA, 64 nt, Human
aucgcuguccaaguguuucuuguuaagugcuuuuaaacuggagaggcuaaccucaaaauauuuu

SEQ ID NO: 137591 - RNA, 64 nt, Human
gaucuacagaaaaaauuuuuuuuuuucaaucuaaaaacuggaaauucuaggguuuuuguacauu

SEQ ID NO: 137592 - RNA, 64 nt, Human
gagcccccuccccagcccucaggcccucccugccaaacuggagaaccccaccccaaggcaugcc

SEQ ID NO: 137593 - RNA, 64 nt, Human
aagaguagccgauuuuagaguucuuuuggaucauaaacuggaaauacugauggaagcacacaag

SEQ ID NO: 137594 - RNA, 64 nt, Human
gaucaggauccaggggagggagauggaggcacccaaacuggaacuucauuugucuuaccuuggu

SEQ ID NO: 137595 - RNA, 64 nt, Human
cgagagcaggccuguccccuacccaacugggaauaaacuggaagcugggucucuuuguugcuau

SEQ ID NO: 137596 - RNA, 64 nt, Human
ggcaguaaauccacagugaguuggggcgacugugaaacuggaaugcuguuacuuugauaauuac

SEQ ID NO: 137597 - RNA, 64 nt, Human
aaacaucauccacgccaugaucauguaucgccguaaacuggaccgugaagaaaucaagccugug

SEQ ID NO: 137598 - RNA, 64 nt, Human
gaaaggugagacccucucccaagaggagcagagaaaacuggaagaagauuugcugguagaaguc

SEQ ID NO: 137599 - RNA, 64 nt, Human
guguaauagccagugacaugcuguagauuuuugcaaacuggauguacuuagcauguuuucuaau

SEQ ID NO: 137600 - RNA, 64 nt, Human
ccacagcuuuaaacgaagacaaccaaaagaaugcaaacuggauuuauccgagauauuugacuuu

SEQ ID NO: 137601 - RNA, 64 nt, Human
uaagugaaacuuguuaaauaaaucuuccuuuuaaaaacuggaaaaaaucuugaacugauugauu

SEQ ID NO: 137602 - RNA, 64 nt, Human
agacuaauaaaacauauguuuaaaaggacacuaaaaacuggaguuauagauauccagauagaaa

SEQ ID NO: 137603 - RNA, 64 nt, Human
gcauucagaucugaaguagugugaguguuagaaaaaacuggaaacaucugauuucugaacuauc

SEQ ID NO: 137604 - RNA, 64 nt, Human
cuaaagguaucuucuggaguuuuugggaggagagaaacuggaaaauuaaauuguauuuuugcca

SEQ ID NO: 137605 - RNA, 64 nt, Human
uguuuaguuaaaaugucauaguuacaaugcaaguaaacuggauacuuguucuuuugucagauuu

SEQ ID NO: 137606 - RNA, 64 nt, Human
aauucaccugcaugaguuggcaggugggagaaccaaacuggaucacuggguaagacuacucagu

SEQ ID NO: 137607 - RNA, 64 nt, Human
aaauagugaaaauaccaaauacugaugaggauacaaacuggauauuuuauacauugcugacagg

SEQ ID NO: 137608 - RNA, 64 nt, Human
aaauauucauaggagcuuuauuuguaauagccccaaacuggaaacaacccagauguccuacaac

SEQ ID NO: 137609 - RNA, 64 nt, Human
uaauguauaauuuuuauguauuuuucaaaacuacaaacuggaauccaacuauaaaguguuuaag

SEQ ID NO: 137610 - RNA, 64 nt, Human
ccucugaaaggcccaaugccauguaacuaacuuuaaacuggauauauacuuugagccuuacuua

SEQ ID NO: 137611 - RNA, 64 nt, Human
aaggggcuauccugggaccuccccagcccaggaaaaacuggaagccuucccccagcaaggcaga

SEQ ID NO: 137612 - RNA, 64 nt, Human
agaucaaacaauauuggaugugauugaacuuuauaaacuggagagcuacaccauuuucuucucc

SEQ ID NO: 137613 - RNA, 64 nt, Human
aacuggccuguaagauuugugguguuccuaggccaaacuggaugaagaugaaauuaaaugugug

SEQ ID NO: 137614 - RNA, 62 nt, Human
uagaggaguccucugaauaauggauauacaccaaacuggauacccaacuuuggaaauucuga

SEQ ID NO: 137615 - RNA, 64 nt, Human
uguuaucauuuuuuccuguuugggaagagcuuagaaacuggaaauacuagauuugggagaaggg

SEQ ID NO: 137616 - RNA, 64 nt, Human
uuaaacauugaauugcccgaacuucuuugggggaaaacuggauuaacuuaauaagaguauuuga

SEQ ID NO: 137617 - RNA, 64 nt, Human
guauuaaucuuauuguuuaaucuuuuuuuuaaaaaaacuggauauuucaaucuuuuaaauugca

SEQ ID NO: 137618 - RNA, 64 nt, Human
ugcucauguguuucaucuguaguaauauagccacaaacuggacaagaagcuggguauuuggguu

SEQ ID NO: 137619 - RNA, 64 nt, Human
gcagugugauggagagucucugccgugccaucugggaugcaaaccgucccuguguuccccacgu

SEQ ID NO: 137620 - RNA, 64 nt, Human
agcccuugugugucuggucacacuuuuuaggcgucacgccaaaggccagccuccuggccccaau

SEQ ID NO: 137621 - RNA, 64 nt, Human
gucaggagcaaugacugacuggcugcagccuucccacgccaagaggcuggaacauagugucugc

SEQ ID NO: 137622 - RNA, 64 nt, Human
cucccgaguagcugggauuacaggugcgcacuaccacgccaagcuaauuuuuguauuuuuuagu

SEQ ID NO: 137623 - RNA, 64 nt, Human
cucccgaguagcugggauuacaggcaugugccaccacgccaagcuaauuuuuguauuuuuagua

SEQ ID NO: 137624 - RNA, 64 nt, Human
aggcugggagaaggggcuccugggugucuguauacacgccaaaggcagauacaaauaaaauaca

SEQ ID NO: 137625 - RNA, 64 nt, Human
gccguagacucacggcugcaccugcagggagcagcacgccaaccccagcaguccugggcccccu

SEQ ID NO: 137626 - RNA, 64 nt, Human
uggguguucaucauaacuuuccacagcuuuaauccacgccaaguuuguauauaacugaaauuca

SEQ ID NO: 137627 - RNA, 64 nt, Human
gaccggcaugacuuuauauuguauacagauuuugcacgccaaacucggcagcuuuggggaagaa

SEQ ID NO: 137628 - RNA, 64 nt, Human
ccagagccugauugggggccucccggcccuggcucacgccaagucccuggugcuggguuugcuc

SEQ ID NO: 137629 - RNA, 64 nt, Human
cuuacacgaguacugcagugauaccgaacuguggcacgccaaagcaaaggauaaccauccucca

SEQ ID NO: 137630 - RNA, 64 nt, Human
uccucuuccacugucguccuuccucagagggccucacgccaaacaaacggccuuuucgugugaa

SEQ ID NO: 137631 - RNA, 64 nt, Human
agucggccuuacuccguuuccuuagcgcccaugacacgccaagucccguuucgcacucggcuuc

SEQ ID NO: 137632 - RNA, 64 nt, Human
uaccuaauguuaaaugacgaguuacuggaugcagcacgccaacauggcacauguauacauaugu

SEQ ID NO: 137633 - RNA, 64 nt, Human
aucuaucucccccgacuucuaccagggaugccuucacgccaaggcuguucucaccagcugccuc

SEQ ID NO: 137634 - RNA, 53 nt, Human
aaccugagggccacguaugacgccacgccaaggagggaagagucccagugaac

SEQ ID NO: 137635 - RNA, 64 nt, Human
aagccagccccaaggaaacacugaaaacacauaucacgccaaugccgugugguuuuguuugaau

SEQ ID NO: 137636 - RNA, 64 nt, Human
ccuucuacuagcccgcggcgccgcccgggugggacacgccaagcucuucagugaagacacgaug

SEQ ID NO: 137637 - RNA, 64 nt, Human
acacccucccacaugaugucaccuccccaucauccacgccaaguggaagccacuggaccacagg

SEQ ID NO: 137638 - RNA, 64 nt, Human
gcccagaagagccaggcacagagcugcaguugggcacgccaaggauuccaaagguggaaugaga

SEQ ID NO: 137639 - RNA, 64 nt, Human
caacgaggaggugguggcuggcccggcccccgcccacgccaaggagggcuugcggcacuuucug

SEQ ID NO: 137640 - RNA, 64 nt, Human
augaccucacaggagugauaagaaacaucugcuccacgccaacucccagagcugaugcuauugu

SEQ ID NO: 137641 - RNA, 64 nt, Human
cugccaggcucaugucuuuacaccuucacucagccacgccaaccagagacuggguuccaaucuc

SEQ ID NO: 137642 - RNA, 64 nt, Human
ucguguguguccugaguguuucuuugguucuuugcacgccaagucucuugguuguaccauguga

SEQ ID NO: 137643 - RNA, 64 nt, Human
ugaaccucuggccucaggauuggccccacaucaccacgccaacaggaccacagcgcacuggcuc

SEQ ID NO: 137644 - RNA, 64 nt, Human
gagaauuuuuuggacucaagcugucaucuucaagcacgccaacuucaggcaguguuuucuacug

SEQ ID NO: 137645 - RNA, 64 nt, Human
uagaggcaugaacacacauggaugcacacacacacacgccaaugcacacacacagagauaugca

SEQ ID NO: 137646 - RNA, 62 nt, Human
ggcagccagucaaaaaguaaaaugaagagaggcacgccaaccacuccaaaauuuugagucuu

SEQ ID NO: 137647 - RNA, 64 nt, Human
cuguuuugcaccugauuuuauuuaucauuagugccacgccaagaucauuuagacgaugcuuauc

SEQ ID NO: 137648 - RNA, 64 nt, Human
gcagcuccugaggcagguaaauggggcaaggacucacgccaaauaccacacgcguaugucaaac

SEQ ID NO: 137649 - RNA, 64 nt, Human
uagcagagcaguuucuugccgcuugggucuucagcacgccaagccccccaccaacccuccaccc

SEQ ID NO: 137650 - RNA, 64 nt, Human
cccugaagcaagcccaggagaagacucuccgccccacgccaaucccaaaggcaugcagauggcu

SEQ ID NO: 137651 - RNA, 64 nt, Human
gguauuuagguauacaaaacaguugauuauucaccacgccaauaucugggucucuguaucucau

SEQ ID NO: 137652 - RNA, 64 nt, Human
aggacgucgcuguugaaaugugaaucccggcggacacgccaaauugcgaggcgacggaaacgga

SEQ ID NO: 137653 - RNA, 64 nt, Human
agagacuucuacccauagcacaucccaacaccgucacgccaaaggaagagaaagaucaacucac

SEQ ID NO: 137654 - RNA, 64 nt, Human
cucacugcucccccaacccagcgucaggcugggacacgccaacgcuguuccggguuggaacagc

SEQ ID NO: 137655 - RNA, 64 nt, Human
cagggcucccuccuggagcaucccaggcgggcggcacgccaacagccccccccuugaaucugca

SEQ ID NO: 137656 - RNA, 64 nt, Human
ggagcuguggucagaggaggagccggcgccuggccacgccaaccuuagaaucaugaacuguagu

SEQ ID NO: 137657 - RNA, 64 nt, Human
cuacgaacacgccaagauggaagagcaacugaggcacgccaaguucaccaucacggagugcuuc

SEQ ID NO: 137658 - RNA, 64 nt, Human
cuccacuuacgaagaacuggccagggccuacgaacacgccaagauggaagagcaacugaggcac

SEQ ID NO: 137659 - RNA, 64 nt, Human
aacugucuuuuguaaccuccugucccuccuaaaacacgccaaccccugcagucaaaucacauua

SEQ ID NO: 137660 - RNA, 64 nt, Human
guguguugcagaggucagucucuggcgugggccgcacgccaaccgcucauuucuguguugccuu

SEQ ID NO: 137661 - RNA, 64 nt, Human
cguggucuuggagcuucugacuaguucagacugccacgccaaccccagaaaauaccccacaugc

SEQ ID NO: 137662 - RNA, 64 nt, Human
cgcccaagccaccagggagccaaucucagcccuccacgccaaggagccuugcccaccagccaau

SEQ ID NO: 137663 - RNA, 64 nt, Human
aaggugcucauuccuacuaugaauccagaauaaacacgccaagauaacagcuaaaucagcaagg

SEQ ID NO: 137664 - RNA, 64 nt, Human
gugaggcuggggucucugcaggggaggucacuggaacagcgagcaagggacuggugccucgcug

SEQ ID NO: 137665 - RNA, 64 nt, Human
uggaggccagccugugcagaaggcugcagcugacaacagcgaccccaccugccauuaccuucag

SEQ ID NO: 137666 - RNA, 64 nt, Human
uggauuuuuucuggggccucaauccagucuugauaacagcgaggaaagagguauugaagaaaca

SEQ ID NO: 137667 - RNA, 64 nt, Human
gaccaugggcuacuacugggcauuagugcaauauaacagcgauaauaaaauucucuauuagucu

SEQ ID NO: 137668 - RNA, 64 nt, Human
gcggggggugggggucagaugcacugaaguagccaacagcgaagccaguccagaagaggggucc

SEQ ID NO: 137669 - RNA, 64 nt, Human
gaccccuccucacuggccaucccucgugguccccaacagcgacauagcccaucccugccugguc

SEQ ID NO: 137670 - RNA, 64 nt, Human
uacuguacaacccgacuucauaauggugcuuucaaacagcgagaugaguaaaaacaucagcuuc

SEQ ID NO: 137671 - RNA, 64 nt, Human
aggugaauuccuggucuuggcagauggcucugggaacagcgagggagcacagaagucguggccu

SEQ ID NO: 137672 - RNA, 64 nt, Human
uaccuugauugccuuacaaaguuauuuguuuacaaacagcgaccauauaaaagccuccugcccc

SEQ ID NO: 137673 - RNA, 64 nt, Human
ccaccaggaggccugcagauccagccuuccugucaacagcgacaggaaaucucuagguugguga

SEQ ID NO: 137674 - RNA, 64 nt, Human
gcuccugcagccuggggaggagugugacgacgguaacagcgaugugggugacgacugcauccgu

SEQ ID NO: 137675 - RNA, 64 nt, Human
gaggcccuccugugcugggggaaugagcccagagaacagcgaaguagcuugcucccugugucca

SEQ ID NO: 137676 - RNA, 64 nt, Human
guuguucuauuuuguacagacaaguuggaaaaacaacagcgacaaaaaagucaagaaacuuugu

SEQ ID NO: 137677 - RNA, 64 nt, Human
uaaucagugcacaggaguauaaaauauuauuuuaaacagcgaaauuaauaauauaaaaugccaa

SEQ ID NO: 137678 - RNA, 64 nt, Human
ccaggauuugcucugccccaaacgagcuguucauaacagcgauuuugccuaacauuauaucaua

SEQ ID NO: 137679 - RNA, 64 nt, Human
ccucuucuauuguuuuuuaaccuuacagguccccaacagcgauacugcuguuucucgagguaag

SEQ ID NO: 137680 - RNA, 64 nt, Human
uggagguauucugaaggucagaagagagauauacaacagcgaggcuuggugauaacguauagaa

SEQ ID NO: 137681 - RNA, 64 nt, Human
gcacaagugauccuuggcuuucagaauuugcaagaacagcgauuugaauuuugggggggucugc

SEQ ID NO: 137682 - RNA, 64 nt, Human
uucuuuuuuuuaaguucuauuuuaaaagcuaucaaacagcgacauagccauacaucugacugcc

SEQ ID NO: 137683 - RNA, 64 nt, Human
uuuaaagguucagaggaauccauaccaaaguucuaacagcgaguaggagguauagaugagagau

SEQ ID NO: 137684 - RNA, 64 nt, Human
agccaagaucgugccacugcacucuauccuggguaacagcgagacucugucuuaaaaauaauaa

SEQ ID NO: 137685 - RNA, 64 nt, Human
agugacugugaccacuguccguguugccuucuugaacagcgauuccccccaaccccuucaccaa

SEQ ID NO: 137686 - RNA, 64 nt, Human
uuuuaagcaagggcgccucaccugcucuucaagaaacagcgagagggagacccagggggcugaa

SEQ ID NO: 137687 - RNA, 64 nt, Human
uugcagaaagguguugaaaugcuucucuagcccaaacagcgacaugcuaaaguccccuucuuca

SEQ ID NO: 137688 - RNA, 64 nt, Human
aaugucuuuugcccguuuugauuacgugcaugcaaacagcgauuugcaaagaccguaugaugau

SEQ ID NO: 137689 - RNA, 64 nt, Human
gaggccuagccaacaacgaagggacggauuuuaaaacagcgagaacugggugccaagaaacacu

SEQ ID NO: 137690 - RNA, 64 nt, Human
ugugaaauuaaaccaaguacuggaaacguaacuaaacagcgaaccauguagcuucaccugacuc

SEQ ID NO: 137691 - RNA, 64 nt, Human
caauaugacacuuguaaauuguuguuucaaaaugaacagcgaagccuuaacuuuaaaugacauu

SEQ ID NO: 137692 - RNA, 64 nt, Human
cucccacacuuuucuuugaugggagguuucaauaaacagcgauaagaacucuagccaugauguu

SEQ ID NO: 137693 - RNA, 64 nt, Human
ggaauaguucauagggaagggacaacauggaagaaacagcgauuuaaauuguauugaacagggc

SEQ ID NO: 137694 - RNA, 64 nt, Human
cauuccccaguuaaagugugucucuguaccuuacaacagcgauucaggacccaagugugaacaa

SEQ ID NO: 137695 - RNA, 64 nt, Human
ggggagauggagauuugacuguuuaaaaacugaaaacagcgaggagucuuucuagaacuuuuga

SEQ ID NO: 137696 - RNA, 64 nt, Human
gacuuuuuuuucauacauuuaguaugaaaacuugaacagcgaaagcagagcauguuauuuauau

SEQ ID NO: 137697 - RNA, 64 nt, Human
uaaacuuguagacuaaaccaaguauuguaaaauaaacagcgauaacagugauaguuuuuaacuc

SEQ ID NO: 137698 - RNA, 64 nt, Human
gacuuucacaaauaucuuuuuaaaaaucaaaaccaacagcgaucucaagcuuaaucuccucuuc

SEQ ID NO: 137699 - RNA, 64 nt, Human
agugagcugagauugcgccacuguacuccugggcaacagcgagacuccgucucaaaaaaaaaaa

SEQ ID NO: 137700 - RNA, 64 nt, Human
ugggcacaugagugagggcucuggcuuacugggaaacagcgauugaccugugcuucugacagcc

SEQ ID NO: 137701 - RNA, 64 nt, Human
gacgcauuuuucuguugagcuaugcagucgucaaaacagcgauagacagcauaggagguuugaa

SEQ ID NO: 137702 - RNA, 64 nt, Human
auauuuguaaauuguguuuuuaauuaaacuuuggaacagcgaauuuggauguuccagagguugg

SEQ ID NO: 137703 - RNA, 64 nt, Human
uuuaaauuguagcuucagaacacuuuugguucagaacagcgauugaccaguaacugugagauca

SEQ ID NO: 137704 - RNA, 64 nt, Human
aauggaccaagagccugcagggaacagaacagugaacagcgaggauucugaugaacaagaccau

SEQ ID NO: 137705 - RNA, 64 nt, Human
uacaauccagagacagaaaacaaaaucuagaugcaacagcgaaacaaagaacccauuuccuucc

SEQ ID NO: 137706 - RNA, 64 nt, Human
gcgccugucgcccaucuccgugcucuucuuugacaacagcgacaacguggugcugcggcaguau

SEQ ID NO: 137707 - RNA, 64 nt, Human
acucuggccugcguacuccucacucagaaacaagaacagcgacagcccuucucgagcagaugac

SEQ ID NO: 137708 - RNA, 64 nt, Human
ggaacauaagaccgcaauucuaaguuucuagauaaacagcgaucuccaagucaagacugaggau

SEQ ID NO: 137709 - RNA, 64 nt, Human
aggccaguuaauuuaaaaaaaacagucgcuaguuaacagcgacagagcccagcacccugggguc

SEQ ID NO: 137710 - RNA, 64 nt, Human
gggcggcgaagaggacccgcaggcugcaaggagcaacagcgauggguaggcacauucaaaacca

SEQ ID NO: 137711 - RNA, 64 nt, Human
ccaaaacaaaucacgagaagagagaaggggacagaacagcgagagcaaccuggaaaaucggucu

SEQ ID NO: 137712 - RNA, 64 nt, Human
gcgguuacugcgugauucuaaagcugccacucggaacagcgaguccucugccgucgagagcagg

SEQ ID NO: 137713 - RNA, 64 nt, Human
ugccaggagauugugauugggagaggguaaggcaaacagcgacugccagaaagaccuuuugcag

SEQ ID NO: 137714 - RNA, 64 nt, Human
agcuaagaucgcgccacuguacuccagccugggcaacagcgagacuccaucucaaaaaaaaagg

SEQ ID NO: 137715 - RNA, 64 nt, Human
ucuguggcaaaaagagucagacauuucuuuggaaaacagcgaacagccuuagagcucuuguguu

SEQ ID NO: 137716 - RNA, 64 nt, Human
ggcgcuguggaaauugggucuugggcuggguggcaucuggcagucauggguaacacuugcuuuu

SEQ ID NO: 137717 - RNA, 64 nt, Human
auugcugaagccaggauguucugaccuggcuggcaucuggcacuugcaauuuuggauuuugugg

SEQ ID NO: 137718 - RNA, 64 nt, Human
uaagaagaaaaaacaaagccaaagaaaacucauuaucuggcauguucgccuuaaagaugguacu

SEQ ID NO: 137719 - RNA, 64 nt, Human
guaugauuuuaucagcuauuucuuauauaucauaaucuggcaauuucugaaaccagucagaaaa

SEQ ID NO: 137720 - RNA, 64 nt, Human
cugccuccaccaccgcuacccagagaaccucugcaucuggcauuucugcucucuaugcuugaga

SEQ ID NO: 137721 - RNA, 64 nt, Human
cuugaagccagggagaucaagaugagaccaaagaaucuggcaaacaucacagacuccaagguau

SEQ ID NO: 137722 - RNA, 64 nt, Human
uguuuagaauuuaaguucuacucagaaucauaacaucuggcagaacagcccaaacccacauucc

SEQ ID NO: 137723 - RNA, 64 nt, Human
aggggggcgguguugaggagagguauuuuuaaagaucuggcaacuuuucaggauuauuugugga

SEQ ID NO: 137724 - RNA, 64 nt, Human
uuuuuauuaguuagucuuggaacuaguguuaaguaucuggcagagaacaguuaaucccuaaggu

SEQ ID NO: 137725 - RNA, 64 nt, Human
gagggcuucaucaaagugagaggaaaggaaaagcaucuggcauguguuucuuggauaggggcca

SEQ ID NO: 137726 - RNA, 64 nt, Human
acaaaacugugcugugaccuugcgguaggccuggaucuggcaaagagaauacaaaugaaacccc

SEQ ID NO: 137727 - RNA, 64 nt, Human
cuccaaauauaaggaaaaaagacuaaagcaagagaucuggcaguugaaaauugugggaaagaga

SEQ ID NO: 137728 - RNA, 64 nt, Human
guugcacuuuaaaucacacuguccuauuaaugcgaucuggcaucuucucccacaagcccccuac

SEQ ID NO: 137729 - RNA, 64 nt, Human
cuacucugggauacccaguucuguuuucaguaucaucuggcacacaacuguccaagcucucagc

SEQ ID NO: 137730 - RNA, 64 nt, Human
acagccuagaaggugagaagcagauuuuaaccccaucuggcagccauucaaggaaaacccagcc

SEQ ID NO: 137731 - RNA, 64 nt, Human
uucuccagguuacaaaggccaugugccccuuugaaucuggcagagaaaguuuccucguuguaag

SEQ ID NO: 137732 - RNA, 64 nt, Human
accccaaagagggggauggguagcuggcagaaucaucuggcauccuaguaauagauaccaguua

SEQ ID NO: 137733 - RNA, 64 nt, Human
cucguacaugccuucuuccacagugggaagcaugaucuggcaggggccgcccuguaggcugggg

SEQ ID NO: 137734 - RNA, 64 nt, Human
gcuauaaacaaaagcaucugaaauaauugugcacaucuggcagugacuguagaaaauacgaaau

SEQ ID NO: 137735 - RNA, 64 nt, Human
caaugcaggcuguuuccuaaauuuuuacaucaaaaucuggcagagucagcugcugacccucucc

SEQ ID NO: 137736 - RNA, 64 nt, Human
uauauuguggauguguucauucaagcuauuuaauaucuggcacuguuaauacacaguacuuuau

SEQ ID NO: 137737 - RNA, 64 nt, Human
ccucuguauagaccuuaggaacaguguuucagugaucuggcaccaguuuauuuuguucugcuga

SEQ ID NO: 137738 - RNA, 64 nt, Human
ucaaaagauucuacaugucuagaaucaaacucaaaucuggcacguaggugcuucuuaguaaaug

SEQ ID NO: 137739 - RNA, 64 nt, Human
gacagugucgcuaagugcauuucacaguuuuuggaucuggcaggcauaugucucuauguagaaa

SEQ ID NO: 137740 - RNA, 64 nt, Human
cuauguacaguaaugccucauucaucuagagguaaucuggcagucuugugaaaaccgaacacaa

SEQ ID NO: 137741 - RNA, 64 nt, Human
gugcaugugcgugugcgugugugcaggggugagaaucuggcagauggugccucugccugcucuu

SEQ ID NO: 137742 - RNA, 64 nt, Human
gugauaagcacuaagcagucaguccccugggggaaucuggcauaauucggcuauaaauguagca

SEQ ID NO: 137743 - RNA, 64 nt, Human
cccgaaguaaaauacgaucgguuucauauuuuaaaucuggcagagccucagcuguacgaaaaag

SEQ ID NO: 137744 - RNA, 64 nt, Human
agagaaacucaagcuauugcaugauuagcccccuaucuggcaaggaaaccccauacagaagaaa

SEQ ID NO: 137745 - RNA, 64 nt, Human
ucuuguuuguauuuuauuaaggaaaaugaaaauaaucuggcaucaguuucauuuugcuaaauau

SEQ ID NO: 137746 - RNA, 64 nt, Human
cccugauuuuuuuuuuuuaauucuauggcuuccuaucuggcagcuuaauggguaauuuuugagg

SEQ ID NO: 137747 - RNA, 64 nt, Human
uugagggcaagucucuggaaaagaggcuguaggcaucuggcagcuaccaugcaugguagugugu

SEQ ID NO: 137748 - RNA, 64 nt, Human
ggguggggguccugggcacuggcugugugaagggaucuggcagggcaccacagcgcccccuacu

SEQ ID NO: 137749 - RNA, 64 nt, Human
cgcagcucuggacucugcguauaacacaucuacaaucuggcaaacccuuggcccaaagacucac

SEQ ID NO: 137750 - RNA, 64 nt, Human
uucuuaucccccucaucucuggggcccccuguggaucuggcauacccaaguucaguaaaugucu

SEQ ID NO: 137751 - RNA, 64 nt, Human
cauuguauuuacuaaguuauuggauuuacaugaaaucuggcacuuuaggguguucuuuuucuca

SEQ ID NO: 137752 - RNA, 64 nt, Human
aucuauaucucuaaacugcuguuaauugauuaaaaucuggcaaaguuauauuuacuuuaaaaua

SEQ ID NO: 137753 - RNA, 64 nt, Human
cuuucccgccccccuccccuguucccacuuccucaucuggcacuaugcaugucucacucacccu

SEQ ID NO: 137754 - RNA, 64 nt, Human
cacguuuucuguuuaaauaaauguaaaaacugccaucuggcaucuuccuuccuugauuuuaagu

SEQ ID NO: 137755 - RNA, 64 nt, Human
agcuguuggacaccugccuucucauguggacaucaucuggcaggaucccugcugggcacacccc

SEQ ID NO: 137756 - RNA, 64 nt, Human
gaaaaugucacuugaagaggaaguauuuauuuuaaucuggcacaacacuaauuaccauuuuuaa

SEQ ID NO: 137757 - RNA, 64 nt, Human
gucuagaaauucuggcagguuuuuuguauuggagaucuggcaguauccugcauaacuuugggug

SEQ ID NO: 137758 - RNA, 64 nt, Human
gauauaaaucgggguccaggaaauccucaccagaaucuggcacugcagccaaaggcgauacuuc

SEQ ID NO: 137759 - RNA, 64 nt, Human
uuaaucugaaauggcaggcaguaagugcagcagaaucuggcaggacugauauuugugcaguggg

SEQ ID NO: 137760 - RNA, 64 nt, Human
uuuguauguuaaccacuguauguaaccaacccuuaucuggcaacauaauugcagcacaauaaug

SEQ ID NO: 137761 - RNA, 64 nt, Human
cugugacuuacguaggaaaccuaauaugcugaguaucuggcacuugaauuccugcuuuuauugc

SEQ ID NO: 137762 - RNA, 64 nt, Human
auuuguuucaaccuaauugguaaccugaguuuauaucuggcaugaauucauuauggugauacac

SEQ ID NO: 137763 - RNA, 64 nt, Human
auuuagcuggaaauccuggauuuuuuucuguuaaaucuggcaacccuagucugcuagccaggau

SEQ ID NO: 137764 - RNA, 64 nt, Human
cauguaaaauuuuuuuaauuaaaaaagagcuguaaucuggcaaaaaguuucuauguaauauuuu

SEQ ID NO: 137765 - RNA, 64 nt, Human
ucacauguucuggggaugauggccuucaggggucaucuggcaaacagccccugggcugugccug

SEQ ID NO: 137766 - RNA, 64 nt, Human
gcuggaggcuggagguggagauggggucaggaacaucuggcagagggaggucccagucuguguc

SEQ ID NO: 137767 - RNA, 64 nt, Human
auggccuucccaccuucuguuagaaauuaguuuuaucuggcauuuuuaaacauuuaaaaauuau

SEQ ID NO: 137768 - RNA, 64 nt, Human
auuucauacucugugaauauucaaaaguaauagaaucuggcauauaguuuuauugguuccuuag

SEQ ID NO: 137769 - RNA, 64 nt, Human
acauugccauacugcuuuuuaucuugaugaauucaucuggcauugcuuugccuuaucaucucau

SEQ ID NO: 137770 - RNA, 64 nt, Human
uuuguuucaguucagauaauuggcaacugggugaaucuggcaggaaucuauccauugaacuaaa

SEQ ID NO: 137771 - RNA, 64 nt, Human
uuugccaaaaagccuggguagagugaucugaauuaucuggcacccuccugaauggaaccccaga

SEQ ID NO: 137772 - RNA, 64 nt, Human
agacuauaauucuggccauguuuuucaucauuugaucuggcagcagggcagaggugcaccagga

SEQ ID NO: 137773 - RNA, 51 nt, Human
augaagcuguaagaaugugaaaucuggcaaagaaaacaggcucccaaaagg

SEQ ID NO: 137774 - RNA, 64 nt, Human
acugcugccuuucauuuauaauaauagcccuuccaucuggcaguggggguagaauacacucuug

SEQ ID NO: 137775 - RNA, 64 nt, Human
cucagggguaaccugcuuacaucuggacuuuagaaucuggcacacaacaaaagugccuggcauc

SEQ ID NO: 137776 - RNA, 64 nt, Human
uaucagacauauuuucaggauggugcgucaggauaucuggcaguggauuucuaaugcuuuuggc

SEQ ID NO: 137777 - RNA, 64 nt, Human
uacugaguaaacccuaucugugauucccccaaacaucuggcauggcucccuuuuguccuuccug

SEQ ID NO: 137778 - RNA, 64 nt, Human
uuagaccccaagacaauuuuucuguuucaguuucaucuggcauuccaacaugucagugauacug

SEQ ID NO: 137779 - RNA, 64 nt, Human
aauuauccugaguagcuaaugcaccuugagaaaaaucuggcauacugaauaaauaacauuaacu

SEQ ID NO: 137780 - RNA, 64 nt, Human
ucaguuauaggagaaaaccuccaugcuggacuccaucuggcauucaaaaucuccacaguaaaau

SEQ ID NO: 137781 - RNA, 64 nt, Human
cgccggcucuggucugccauucgccagugcagggaucuggcacggaccagauguggcgaauggc

SEQ ID NO: 137782 - RNA, 64 nt, Human
cuuaaguacuuccugaagaugaagcaaaauuuuaaucuggcaauuaugaaaaagaaauauuuua

SEQ ID NO: 137783 - RNA, 64 nt, Human
aaacucaucuauccaggcagggauaauuaaaaccaucuggcagacuuacaaagcuugggacagu

SEQ ID NO: 137784 - RNA, 64 nt, Human
ccugcuggugggcauggauguccucacucucgccaucuggcagaucguggacccucugcaccgg

SEQ ID NO: 137785 - RNA, 64 nt, Human
ccacgagaauguccucugacuuccagccacauccaucuggcaguugugccaagggaggagggag

SEQ ID NO: 137786 - RNA, 64 nt, Human
ccacaaaccuguuuggaaauaaacauggaagaauaucuggcaggcuuacuuuuagaagacgaca

SEQ ID NO: 137787 - RNA, 64 nt, Human
cuaaaucugaacgggugccgcuauaauuugugacaucuggcaagauuucccuuuauguauauau

SEQ ID NO: 137788 - RNA, 64 nt, Human
gauuucauagguuuguccccaguguuagcuuaauaucuggcaugugguagguguucaauaaaca

SEQ ID NO: 137789 - RNA, 64 nt, Human
ccuucauacuuuuaugcaggaaaaaguccguaucaucuggcauuuuaucaagacucagcaacug

SEQ ID NO: 137790 - RNA, 64 nt, Human
gcagugagauaggaaaucaagauggaagcagagaaucuggcaugccaaaaacuaacagaaacuu

SEQ ID NO: 137791 - RNA, 64 nt, Human
ucaguugcuauuauacaccaccuguagaaaaguaaucuggcaugcagaacauucuugugguaca

SEQ ID NO: 137792 - RNA, 64 nt, Human
uaaucccugcacuggacaugugaggaaaaaaauaaucuggcaaguauauucuaagguugccaaa

SEQ ID NO: 137793 - RNA, 64 nt, Human
ugaaauucaaauuuagcuggguguccuguauuucaucuggcaacccuacuucagacccaggugu

SEQ ID NO: 137794 - RNA, 64 nt, Human
guuucaacaacuccuccacugggcagagcugggcaucuggcagggcuggcucuguccccugggc

SEQ ID NO: 137795 - RNA, 64 nt, Human
cuccccuucaguucagagccaaaaugggucuagaaucuggcacuuuacucauuuccuuugauaa

SEQ ID NO: 137796 - RNA, 64 nt, Human
auacaguuuugggauauauacaaggauugccuugaucuggcacuuacugauacaagcauuugga

SEQ ID NO: 137797 - RNA, 64 nt, Human
aacuacugaaaugauugugcuggguaaauuaaggaucuggcaucauacaaaaugaagccagacc

SEQ ID NO: 137798 - RNA, 64 nt, Human
cuacagagucuggugaagcucacuucugggcuucaucuggcaacaucuuuauccguagugggua

SEQ ID NO: 137799 - RNA, 64 nt, Human
cugugagccccauccaacacccacaguaauuauuaucuggcacaucaaugaauuugggguccua

SEQ ID NO: 137800 - RNA, 64 nt, Human
acgggccaaucuguguuuccuaagguccugaagaaucuggcaaagaguccuguggguuguuuau

SEQ ID NO: 137801 - RNA, 64 nt, Human
uugauaacaguugcauuuagguugcaccuggguaaucuggcauaaaagaucucucuaggccuca

SEQ ID NO: 137802 - RNA, 64 nt, Human
uuggaaguuauuuauuuuagacucaaagaauauaaucuggcacuacucaguuauuacuguuugu

SEQ ID NO: 137803 - RNA, 64 nt, Human
aaaagaagagacauuaagaguuccugaaauuuauaucuggcauacggauaggcuuauauucaaa

SEQ ID NO: 137804 - RNA, 64 nt, Human
gaccuguuagaauuggugugcacucaccugagagaucuggcagguuggauauauuuauguguau

SEQ ID NO: 137805 - RNA, 64 nt, Human
ugauauugggggguacauucauaauagugagaauaucuggcagaaugugugaaugccauaucug

SEQ ID NO: 137806 - RNA, 64 nt, Human
cuggcccaaggaguacccccccaacaagaacugcaucuggcagcugguggcccccacccaguac

SEQ ID NO: 137807 - RNA, 64 nt, Human
aaucccgccccacauucuccaaauucagggcgcgaucuggcaaaggcucccucccccacccucu

SEQ ID NO: 137808 - RNA, 64 nt, Human
gaaacaauagauaaacagcaugaaaauguaaaucaucuggcaucacugauagaauuucugaaag

SEQ ID NO: 137809 - RNA, 64 nt, Human
ucuggucuuugcacuuccauccucucccacuuccaucuggcaucccacgcguuguccccugcac

SEQ ID NO: 137810 - RNA, 64 nt, Human
ugcaaacuuuuuauguaagcaaacuuuuuguguuaucuggcacaggccuuugaaaagacuauaa

SEQ ID NO: 137811 - RNA, 64 nt, Human
auucuguacaacuuucuguacaauauugauucccaucuggcauauucuaaucagguuauagguc

SEQ ID NO: 137812 - RNA, 64 nt, Human
acagaauuuaacguugaauauauuaaaauaacaaaucuggcaugguuugcggagguuagauuua

SEQ ID NO: 137813 - RNA, 64 nt, Human
ugaaagaaguuuaauuuucagguuagaaaaugugaucuggcaguuuaugcauucuucagaguaa

SEQ ID NO: 137814 - RNA, 64 nt, Human
cuggggggacacugcagucuggcuacacacagagaucuggcacccccuggguggagugucccuc

SEQ ID NO: 137815 - RNA, 64 nt, Human
cuuggccuaucuaucuuuauccacaugcagaaacaucuggcaaccccacauggcugagaugacc

SEQ ID NO: 137816 - RNA, 64 nt, Human
auggccgaugacacaguggcagaacuggacaggcaucuggcagugaagaccaaagaacuccuug

SEQ ID NO: 137817 - RNA, 64 nt, Human
cugguccuugcuaacugcugcaggguggaguuugaucuggcagacccgauccuccuucaugaac

SEQ ID NO: 137818 - RNA, 64 nt, Human
cuucacgguagcacuuacagcugaagccaucagcaucuggcaggcacaccugagucaccaugua

SEQ ID NO: 137819 - RNA, 64 nt, Human
auugacccuuucacuaugcccucaaccugggagcaucuggcaggcaggggggcagguacacaca

SEQ ID NO: 137820 - RNA, 64 nt, Human
uuggacagcugacugaaugcagaacgguuuuuggaucuggcauugaaaugccucuugaccuucc

SEQ ID NO: 137821 - RNA, 64 nt, Human
aagagguuaaaggaagcugauuaauuagauaugcaucuggcauuguuuuaucuuaucaguauua

SEQ ID NO: 137822 - RNA, 64 nt, Human
ucaaaucuuaacccuuaggacucugguauuuuugaucuggcaaccauauuucuggaaguugaga

SEQ ID NO: 137823 - RNA, 64 nt, Human
uacaggaaguguuucaacuugucuuaugcaucuuaucuggcauguccugggagauggaugggca

SEQ ID NO: 137824 - RNA, 64 nt, Human
cuccaagcagagucgacaucauggaaugaaccaaaucuggcaggaucugcucggggaaguguuu

SEQ ID NO: 137825 - RNA, 64 nt, Human
aucuggagucugaaggacccuaguuccuagaggcaucuggcagcaagaaggugaggcaucaggg

SEQ ID NO: 137826 - RNA, 64 nt, Human
cugcugguguuuuaaagccacaaguagggaagauaucuggcaggcagaaagaagucugugauga

SEQ ID NO: 137827 - RNA, 64 nt, Human
acaaccgacuggggcgggagacggggcgguucugaucuggcaggcagccaggaucccugacccu

SEQ ID NO: 137828 - RNA, 64 nt, Human
caugauuugcuguugguuucaaaugaaacuacaaaucuggcauguuuuacugugaacacuuuug

SEQ ID NO: 137829 - RNA, 64 nt, Human
ugggcauugucuuuuuagaugcccaaauccuuagaucuggcauguuagcccuuccuccaauuau

SEQ ID NO: 137830 - RNA, 64 nt, Human
uggcucugcucccgccuguuuucuuucugacucuaucuggcagcccgaugccacccaguacagg

SEQ ID NO: 137831 - RNA, 64 nt, Human
uugucagacacagugagccgcucaagcaaaauggaucuggcagaauccgccaagcggcugggcc

SEQ ID NO: 137832 - RNA, 64 nt, Human
uuuacaggcuaguauuuuaaaaguagaaaucaaaaucuggcaccgaagcaugcuaauuguuuac

SEQ ID NO: 137833 - RNA, 64 nt, Human
cacauucagcuuaccccagagagcaagugaggcaaucuggcaaaagauuaauaaagauguaaac

SEQ ID NO: 137834 - RNA, 64 nt, Human
uacagagggcgcugugggagcacaaaggaggggcaucuggcauggacugggguggaaaugggga

SEQ ID NO: 137835 - RNA, 64 nt, Human
cuuugugagccccuucuggcccccugccuggagcaucuggcagccccacaccugcccuuggggg

SEQ ID NO: 137836 - RNA, 64 nt, Human
aggcuccuguggugcugcugggcccucccacuccaucuggcacuggccuggacuccuccucugc

SEQ ID NO: 137837 - RNA, 64 nt, Human
uuccaauaccugcugccugucucccugacccaugaucuggcaaguuaggcacagucagacaugg

SEQ ID NO: 137838 - RNA, 64 nt, Human
cucaguuauugaacaagcaagcauuauccaguugaucuggcaaugacuuuuugugugugggcca

SEQ ID NO: 137839 - RNA, 64 nt, Human
guuuauagcaccuuaacuuuaacuguucaguuuuaucuggcagaggaaaacauucuuauuucuu

SEQ ID NO: 137840 - RNA, 64 nt, Human
gaguguggacaucagcccagggccgcguggugaaaucuggcaguggggaaagagcaaccccagc

SEQ ID NO: 137841 - RNA, 64 nt, Human
ugguuguagugggaagucccgcgaaacccggugcaucuggcacguggccaggagccaugacagg

SEQ ID NO: 137842 - RNA, 64 nt, Human
ugaacagggcauauaaaaugcauucuguacccugaucuggcauauagcuucaaaacugcagugg

SEQ ID NO: 137843 - RNA, 64 nt, Human
uuguaacaauguguuuucuugccuaaauucauuuaucuggcaucaucagaguacuaacauguuu

SEQ ID NO: 137844 - RNA, 64 nt, Human
uagaccccuauuccccaccccauggccacagggcaucuggcaauaagacuaguauacauugacc

SEQ ID NO: 137845 - RNA, 64 nt, Human
auugcacugauuguuuuugugggaaugacacuuuaucuggcaaaguaacugagaguuugguaaa

SEQ ID NO: 137846 - RNA, 64 nt, Human
gcaaguggauguaagcacucuggggccuggcuuaaucuggcaaaguucuucagacgacuuggga

SEQ ID NO: 137847 - RNA, 64 nt, Human
ccaaucaaacagagcaguauagcugugacuauggaucuggcagauucuuuauccuuuguggacu

SEQ ID NO: 137848 - RNA, 64 nt, Human
gaaggauuuuauucuauaaagcggcccugguugaaucuggcaauucuuuuugccaagaucccua

SEQ ID NO: 137849 - RNA, 64 nt, Human
aauuggugaggcugugaccaauaaugaggaaauaaucuggcaaauuuuuaggggugggaacuuu

SEQ ID NO: 137850 - RNA, 64 nt, Human
cuaagguccucuucgaaggugguuugcauucuuaaucuggcaucuucuccaggccuaaaucuua

SEQ ID NO: 137851 - RNA, 64 nt, Human
aguuagcuuuuuaccugcacaaauggacuaaaaaaucuggcacaaaacauuguuauguaauguc

SEQ ID NO: 137852 - RNA, 64 nt, Human
agcauaggauuuuauauuuuggggugaaagaauuaucuggcacauuagguauuggaguuuaaaa

SEQ ID NO: 137853 - RNA, 64 nt, Human
gcuaauuaucuuuugauuucuuuuucauaagcagaucuggcauuuauuacagggcugccgcuua

SEQ ID NO: 137854 - RNA, 64 nt, Human
ggauugauacguuuugaguauguauuuguacacuaucuggcacauaugcgcucaauaaacgugu

SEQ ID NO: 137855 - RNA, 64 nt, Human
cugcuuuuagggcccuccugcugugccaguuaccaucuggcauuaggcagcacuuuuaucuacu

SEQ ID NO: 137856 - RNA, 64 nt, Human
ggugaaaaaucaagcugaaugacaauuagcacuaaucuggcacuuuauaaauugugauguagcc

SEQ ID NO: 137857 - RNA, 64 nt, Human
agggucuggagaagcagugagccgcaucuucuccaucuggcagggugggauggaggagaagaau

SEQ ID NO: 137858 - RNA, 64 nt, Human
ccucuagaaaacagaguugcuguuguuuuuuuaaaucuggcaaugcugaaaaagcguuuguuuu

SEQ ID NO: 137859 - RNA, 64 nt, Human
auuauggaauuuaaaccaugucacagcugugaagaucuggcacaagauagaaugguaaaaaaaa

SEQ ID NO: 137860 - RNA, 64 nt, Human
acccaaggcagguacacaaaggaccuuagaugagaucuggcauaugcacccgcaauagaagggc

SEQ ID NO: 137861 - RNA, 64 nt, Human
guacgaggggaucaccuucgaggacuuccugaagaucuggcaggggaucgacauugagaccaag

SEQ ID NO: 137862 - RNA, 64 nt, Human
uuucuuauauuuuauauuaccauuaaccaauaaaaucuggcagaaagucugcuauuccauuggu

SEQ ID NO: 137863 - RNA, 64 nt, Human
augucaaaugauuuaguuucuggcucuuagacucaucuggcaguucuacacaugaaacaucuuu

SEQ ID NO: 137864 - RNA, 64 nt, Human
cccguuugcagaaaccucacaggacaguacgaauaucuggcauuuuuaaguucauuaaagcagc

SEQ ID NO: 137865 - RNA, 64 nt, Human
uuaaagcuagguuuccuagugaggaaagccucugaucuggcagacucauugcagcaggugguaa

SEQ ID NO: 137866 - RNA, 64 nt, Human
cugcagugagccaugauugugcuacugcacuccaaucuggcaacagagcgagaccuugucuuua

SEQ ID NO: 137867 - RNA, 64 nt, Human
caguaauuauguuuggcaaauaugaaauacaaggaucuggcaagguuaggaagagguuaagaau

SEQ ID NO: 137868 - RNA, 64 nt, Human
aaagaaacauccauucuguggcauguuggacuugaucuggcaaaaacugccaauaggaggacug

SEQ ID NO: 137869 - RNA, 64 nt, Human
ccaccucuucuacuuacuuucucuuacuuaaauuaucuggcauaagcaguuaucuccagcuuuu

SEQ ID NO: 137870 - RNA, 64 nt, Human
ugaaauucaaauuuaacugggagucuuguauuuuaucuggcaauccuaaaauacauugguauga

SEQ ID NO: 137871 - RNA, 64 nt, Human
cagaccccagcaaggucagcugccccacgccuguaucuggcacugcuggugugugcagggauga

SEQ ID NO: 137872 - RNA, 64 nt, Human
uucucuuuuauucuugauguccuaagucaauugaaucuggcaucuggggcuagggucugccugu

SEQ ID NO: 137873 - RNA, 64 nt, Human
cugcagguguccggcgcagccgugggagcugaggaucuggcacuugagaggcagcagcuccuug

SEQ ID NO: 137874 - RNA, 64 nt, Human
auuuaguuucuuuuucuucauauuuauaauguugaucuggcauccucaggcugcagcuuuauua

SEQ ID NO: 137875 - RNA, 64 nt, Human
gcagaggcugaacaccugcggaaggagcuggagaaucuggcaggacagcuuuaagcccaagugg

SEQ ID NO: 137876 - RNA, 64 nt, Human
gaccuaaguaaauuugaggaacaaggagcaagugaucuggcaaaagagggacaggaggaaaaug

SEQ ID NO: 137877 - RNA, 64 nt, Human
ucaguguuacagcuguguuggggauaggaaguauaucuggcagauugauauuuauacacuuuuu

SEQ ID NO: 137878 - RNA, 64 nt, Human
cuucccugaacacauuccucagugagaugcaggcaucuggcacccagcugcuauaaccaagugu

SEQ ID NO: 137879 - RNA, 64 nt, Human
uccaugagaaacuugaggagacuucauaacaagaaucuggcauuucucuucaguuaucuuauau

SEQ ID NO: 137880 - RNA, 64 nt, Human
gggguuuuuuaaacacauccuauauaucaugucaaucuggcaagaaauaugacuugcuuuuugc

SEQ ID NO: 137881 - RNA, 64 nt, Human
cuucuucaacagguugcuaauaauuuauacuggaaucuggcauuuuuccaagccaagagaagau

SEQ ID NO: 137882 - RNA, 64 nt, Human
cuacgugguucaucuacaaugguuaccauaaaaaaucuggcaggauuuuaaaacucaaucaguc

SEQ ID NO: 137883 - RNA, 64 nt, Human
gcugugcagccucugccauugccaucccagggggaucuggcauccuccuaaggaccggggcgcg

SEQ ID NO: 137884 - RNA, 64 nt, Human
ggggagaagcaaauucaugaugugugugcuggagaucuggcacucauggccagugcuuuccagu

SEQ ID NO: 137885 - RNA, 64 nt, Human
guuuuuggucuuuuauaauucucauuaaaagaauaucuggcaaauuaaaaaaaucuuacugugu

SEQ ID NO: 137886 - RNA, 64 nt, Human
uggcaauugcaaguugcccugcuaggcaguuguaaucuggcauuaacuuauuuucuauauccag

SEQ ID NO: 137887 - RNA, 64 nt, Human
acuagcuggguuaccaucuucaggcacuuuuaacaucuggcauucggaauggaaauguaauaau

SEQ ID NO: 137888 - RNA, 64 nt, Human
acauccucccugcaaagcaagcagggcaagggagaucuggcauuuucugcuuuacguggaggga

SEQ ID NO: 137889 - RNA, 64 nt, Human
cuccaaauucacuucugccuuccucagguuugauaucuggcagguuugacuauccagaggaaau

SEQ ID NO: 137890 - RNA, 64 nt, Human
caacccugagcucccgauaaagcuaaaguccaucaucuggcaaauucaguaaauuggagaguac

SEQ ID NO: 137891 - RNA, 64 nt, Human
aaaugcucagugagaugaaacuuccccuucauggaucuggcaaaaauuaagagaucuuuugcua

SEQ ID NO: 137892 - RNA, 64 nt, Human
ucuggauuuccaacuuuucuugagaagucauaauaucuggcacuaguaggucuacagucccaua

SEQ ID NO: 137893 - RNA, 64 nt, Human
agaaacaaucaggcacgcugacacccuuaucagcaucuggcauccaaagcaacaucagagagag

SEQ ID NO: 137894 - RNA, 64 nt, Human
gaggagggugggccuagggcuuggcgagugccacaucuggcagguuuggaaauuuccaaauaaa

SEQ ID NO: 137895 - RNA, 64 nt, Human
ccugcuucucuuuuccucgcagaugauaaaaggaaucuggcauucuacaccuggaccauuugau

SEQ ID NO: 137896 - RNA, 64 nt, Human
ccaggcuggagcuggccccgcuugguggccugggaucuggcacacucccucuccuuggggugag

SEQ ID NO: 137897 - RNA, 64 nt, Human
uguggggugugugugggauguggguuguguguauaucuggcaugugucccagucacuugcagaa

SEQ ID NO: 137898 - RNA, 64 nt, Human
uguggcguguguguaugauguaugugggcuguguaucuggcacauguguguuggguggugugug

SEQ ID NO: 137899 - RNA, 64 nt, Human
gcugaguguauguuuuuguucuguggagaaugcuaucuggcauuaugguaauauauuauuuuag

SEQ ID NO: 137900 - RNA, 64 nt, Human
cucaaagcuguugcagacuaucccaagagaaaggaucuggcacaaaggaaucugccuuuccucc

SEQ ID NO: 137901 - RNA, 64 nt, Human
auguuuuuaucgaguacccugugcaccacauuauaucuggcaauucuuuuuguuucauuaugug

SEQ ID NO: 137902 - RNA, 64 nt, Human
gucaccucagcugcccacacccacacucuccagcaucuggcacaauaaacauucucuguuuugu

SEQ ID NO: 137903 - RNA, 64 nt, Human
ggaaaggaggcuggagaggcuucugaugguggagaucuggcaugccaggcuuaggugucuagaa

SEQ ID NO: 137904 - RNA, 64 nt, Human
ccuagagaagguagucccugaaggaaaaguaggaaucuggcagugaaagaggaaaagaacauuc

SEQ ID NO: 137905 - RNA, 64 nt, Human
caggugggagccuuucccagugggugugggacauaucuggcaagauuuuguggcacuccugguu

SEQ ID NO: 137906 - RNA, 64 nt, Human
gucaccuggaccauggugaacaugugaccugcagaucuggcaucagaggccagaguucaaaugu

SEQ ID NO: 137907 - RNA, 59 nt, Human
cguuggcaauaggguuuuagguggagucuaucuggcauucagagaagagucaggaaaac

SEQ ID NO: 137908 - RNA, 64 nt, Human
aagguuugugacaagguuuuugcauauaaugcauaucuggcaaaacauacuagaauucacacug

SEQ ID NO: 137909 - RNA, 64 nt, Human
uccacgcaucaauaaauaauuuugaaggccucacaucuggcagccccaggccugguccugggug

SEQ ID NO: 137910 - RNA, 64 nt, Human
cugccggguucccuugccagacaugaugucgguuaucuggcaaaagccauuuuaugucggccac

SEQ ID NO: 137911 - RNA, 64 nt, Human
gcuccuugcccaguuaucccacugucuucuuugcaucuggcacacaguagaugcucaauaaaug

SEQ ID NO: 137912 - RNA, 64 nt, Human
cucggagccuguuuccaagaaggaauugguugucaucuggcaguguugcgcgucacaagagagc

SEQ ID NO: 137913 - RNA, 64 nt, Human
aaacgcauccccauugugugauguguucagaugcaucuggcaccaauuagguauuucuuaaaac

SEQ ID NO: 137914 - RNA, 64 nt, Human
aaccaacuuaaucugguugaacgugcuguuccuaaucuggcacucagccccucugggaaacauc

SEQ ID NO: 137915 - RNA, 64 nt, Human
ccagagccgcccgugauguuccucccccguccccaucuggcagcuccugucucgccugagggac

SEQ ID NO: 137916 - RNA, 64 nt, Human
aggguuccuguuuggauuagaccauaguugacccaucuggcauugccaacgaagccuucauuaa

SEQ ID NO: 137917 - RNA, 64 nt, Human
uacaagacagcccagugucaucaacagugagcaaaucuggcaugguguuugucucguacaguug

SEQ ID NO: 137918 - RNA, 64 nt, Human
gcccccaggccugggagcuugaagcccucccggcaucuggcauccgagccucccgcccuccagg

SEQ ID NO: 137919 - RNA, 64 nt, Human
aacauuuuagguuuguauuugguagucuuaauguaucuggcauuugggugaacuguggacauac

SEQ ID NO: 137920 - RNA, 64 nt, Human
uaagugauuuuuaacucuucucacacuuuaaugcaucuggcaagaagauccacgugguguuagg

SEQ ID NO: 137921 - RNA, 64 nt, Human
cugggguuggaauguggaacugcagccucagcccaucuggcagagucccaggaacucggagacu

SEQ ID NO: 137922 - RNA, 64 nt, Human
uugaggaugaucagagaacuugggcauaggaacaaucuggcagaaguuuccagaaggaggucac

SEQ ID NO: 137923 - RNA, 64 nt, Human
uuuuagggacuuuccuggaagcaaaggcagucacaucuggcauaaucauaauaaagaaaacaac

SEQ ID NO: 137924 - RNA, 64 nt, Human
ugauaaccacgauggagcccguguuuguccugccaucuggcacugcacugaguguggcacaggc

SEQ ID NO: 137925 - RNA, 64 nt, Human
uaauaauaaucuuaaagaugagaaaagccaccccaucuggcaccacagcugcaucuugcuugug

SEQ ID NO: 137926 - RNA, 64 nt, Human
gucuucucugucaagauugcacaguuguacuugaaucuggcauguguugacgaaacuggugccc

SEQ ID NO: 137927 - RNA, 64 nt, Human
ugugaaucugugggcgcccaaggccagcagccauaucuggcaagaagcuggagccggggugggu

SEQ ID NO: 137928 - RNA, 64 nt, Human
gcaggcccagcugaaccaauggaggccuggggacaucuggcauggucaccccugcacaugaucu

SEQ ID NO: 137929 - RNA, 64 nt, Human
ccauuaccagaagcaaagcugcugcuaacccaacaucuggcacauaggauuuguacucgguaaa

SEQ ID NO: 137930 - RNA, 64 nt, Human
caggagaaaauucugagguaaauagauggauuuuaucuggcagugucgaaaauaguaggagccu

SEQ ID NO: 137931 - RNA, 64 nt, Human
aauccugggaacucaacuugaaggucugucuuccaucuggcaccauaaaaacaugaacuuauug

SEQ ID NO: 137932 - RNA, 64 nt, Human
acuguuggaccugcuauaauaauauuucacuaaaaucuggcauuaaaaauuuuaaguauuugga

SEQ ID NO: 137933 - RNA, 64 nt, Human
uacacacaaguaaaucuuuuuuuucuugaauuuaaucuggcacuuugcacugccacagagguga

SEQ ID NO: 137934 - RNA, 64 nt, Human
gggugaccuuccaaaacucugcucucaggcugaaaucuggcaucaucucagguucccugucccc

SEQ ID NO: 137935 - RNA, 64 nt, Human
aauuaucaacauaccuuggccagcaaguuagagaaucuggcaauggaugaacugaaagugauga

SEQ ID NO: 137936 - RNA, 64 nt, Human
ggagcacuucccaggggccgcagggacgacacucuccagggaggccccagcaaccacaccaucu

SEQ ID NO: 137937 - RNA, 64 nt, Human
caaaacacaauaugccuaggggcacggaugaacguccagggagcccgggccccaggcuuuguug

SEQ ID NO: 137938 - RNA, 64 nt, Human
cacccccagaauucccugcugacccugccccacuuccagggaaaagcugggggagguuggaccc

SEQ ID NO: 137939 - RNA, 64 nt, Human
gguuuccccaaggccucucaccccacuucccaucuccagggaagcgucgccccaguggcacuga

SEQ ID NO: 137940 - RNA, 64 nt, Human
ccuagaccauucuccccaccagauggacuucuccuccagggagcccacccugacccacccccac

SEQ ID NO: 137941 - RNA, 64 nt, Human
cuaacuucugcucgucuuucagagcauugucuccuccagggacuugccuggcccuccucccccu

SEQ ID NO: 137942 - RNA, 64 nt, Human
aggugagauccuuaaccuuucaaaauuuucggguuccagggagacacacaagcgaggguuuugu

SEQ ID NO: 137943 - RNA, 59 nt, Human
acuuccugccuuggacaugaccuggacucuccagggacagguuggaagccaacuuaacc

SEQ ID NO: 137944 - RNA, 64 nt, Human
agacccccaaccuucugauaaaagagucucuaccuccagggaaagccuucuuaccacacuggca

SEQ ID NO: 137945 - RNA, 58 nt, Human
uggagggcuuccagcuauaauaucugccuccagggaggggaggggaugggaagcacca

SEQ ID NO: 137946 - RNA, 64 nt, Human
cugauccauuagggaucgaggugcuacacuggccuccagggauaagccuggggcuacuguugcu

SEQ ID NO: 137947 - RNA, 64 nt, Human
ucauagccacuuuuauguuaccuuuuauaagcacuccagggaagauuuuauauuuuuuuguaga

SEQ ID NO: 137948 - RNA, 64 nt, Human
acauugcaucuagaaaucaaaacuugaaaguauuuccagggauuaggauuagaaggaauauuag

SEQ ID NO: 137949 - RNA, 64 nt, Human
aagaaguggucagguuuucgcacuucuuggcugguccagggacugcagaaaccaaagcugcuau

SEQ ID NO: 137950 - RNA, 64 nt, Human
ugaaaaacuggguuccuguaaguuaugaauggcauccagggauauuuggguuacuuuuaagaaa

SEQ ID NO: 137951 - RNA, 64 nt, Human
gcugcauggagaauuucaccugcggugauuuugauccagggacugcaucuccucuuuccucauc

SEQ ID NO: 137952 - RNA, 64 nt, Human
ugguacagguuaacaucagcauuuucauuuuguguccagggaaaagcacccagaggucaucugu

SEQ ID NO: 137953 - RNA, 64 nt, Human
cucucuuucuuuuuucaaccuucucauucuccuauccagggauuuaaucagcagaauuacuuuu

SEQ ID NO: 137954 - RNA, 64 nt, Human
aagaaccuggagaggauccuucaguucuggccauuccagggacccuccagaaacacaguguuuc

SEQ ID NO: 137955 - RNA, 64 nt, Human
cugaaccuuccugucucccagggacauguaugcuuccagggacaagcuuaggucaugaacaugg

SEQ ID NO: 137956 - RNA, 64 nt, Human
cucuccugccuucccuuguccuucccugaguuccuccagggagacuagguuauucucugccaua

SEQ ID NO: 137957 - RNA, 64 nt, Human
gacauagggguaagguaugggagagguagguggauccagggaaaagcaguggggacggaaggca

SEQ ID NO: 137958 - RNA, 64 nt, Human
aggaccagucacuaaucucugagacuccauuuucuccagggaaacgaggcuugcccagauagac

SEQ ID NO: 137959 - RNA, 64 nt, Human
ccacgcccacaauccgacagcccccaggagcagguccagggaugaugcagcccccuucuugguc

SEQ ID NO: 137960 - RNA, 64 nt, Human
gaucuacuucccaugcagaagagaagucacaucuuccagggaaucgcaauguuguggcgucuga

SEQ ID NO: 137961 - RNA, 64 nt, Human
uucucagcuugaugacaaggaaccuguauagugauccagggaugaacacccccugugcgguuua

SEQ ID NO: 137962 - RNA, 64 nt, Human
cugaaauugcauggaucaaguaagcauaguuuuauccagggagaaaaauaaaaggaagccauag

SEQ ID NO: 137963 - RNA, 64 nt, Human
cucucacaagaaggcugcaggugagguggccaaguccagggaaaggcccugcuaccuccuuuug

SEQ ID NO: 137964 - RNA, 64 nt, Human
uggcagaacuggaaaagcuucuuagggcaucucauccagggauucucaaaccaugucccccaga

SEQ ID NO: 137965 - RNA, 64 nt, Human
ccuccugugccugcuucccugugugucgggguccuccagggagcugacccagagguggaggcca

SEQ ID NO: 137966 - RNA, 64 nt, Human
agugugugccaggcucuggacuaggugcuagguuuccagggaggagccaaacacgggccuugcu

SEQ ID NO: 137967 - RNA, 64 nt, Human
aguguuguguggacaugacucacccugaggagucuccagggauggagguggggcaugcggccac

SEQ ID NO: 137968 - RNA, 64 nt, Human
ggcuuugguuccucacccacuucccccgggcagcuccagggauguggccucauugcugucugcc

SEQ ID NO: 137969 - RNA, 64 nt, Human
augaaucauguuugguuccugugaaagucccugguccagggauccuccuccuuucucuuuuacu

SEQ ID NO: 137970 - RNA, 64 nt, Human
uuauccaguuaggucuucuuaugaagaguuuucauccagggauauaacuccuuggucagugauu

SEQ ID NO: 137971 - RNA, 64 nt, Human
aucaguguggaggaagugugucacagugaacaaauccagggagcugauaauuggcaaaagacca

SEQ ID NO: 137972 - RNA, 64 nt, Human
auggcgauucugucuuauaaccuccugggucccauccagggaccuaagagaaaguagcagggga

SEQ ID NO: 137973 - RNA, 64 nt, Human
ucccugcagcccuaccucugccaaggucucucccuccagggaccucugcuuccacccacauaug

SEQ ID NO: 137974 - RNA, 64 nt, Human
ggagcuuaauugaucucacuuguuuuaguucugauccagggagaucaccccucuaauuauuucu

SEQ ID NO: 137975 - RNA, 64 nt, Human
agcgcugagcauggggcgcucccacucagaacucuccagggaggcgaugccagccuuggggggu

SEQ ID NO: 137976 - RNA, 64 nt, Human
cucaggcuccaaauguggcagccaaagagaacaauccagggaaccuacauuuauuuuuaaggac

SEQ ID NO: 137977 - RNA, 64 nt, Human
cuucuagaauuacaugcugggcacugggccgggcuccagggauaagguggggaaaaagacuaac

SEQ ID NO: 137978 - RNA, 64 nt, Human
aacccaagacccugccucuuccacuccacccuucuccagggacccuuagaucacaucacuccac

SEQ ID NO: 137979 - RNA, 64 nt, Human
ucagcugccuccuuagaggagagggcauccccuuuccagggagguaaagcaggggaccagagcg

SEQ ID NO: 137980 - RNA, 64 nt, Human
uucugcugaggacauaggcagaagcucacucuuuuccagggacagaaguggugguagauggaag

SEQ ID NO: 137981 - RNA, 64 nt, Human
ugccuuguucccucccuggcccucaggcccuccuuccagggaugucucuccagcucuacuuuau

SEQ ID NO: 137982 - RNA, 64 nt, Human
ccuuggacagggugggagaggggacacauggguguccagggagaaggcucugucccugccgcca

SEQ ID NO: 137983 - RNA, 64 nt, Human
aaugggguccuucuguaggcaaagguggaaguccuccagggauccgcuacauccccuaacugca

SEQ ID NO: 137984 - RNA, 64 nt, Human
aucugggcacuuucccaacccagguuuaugcgucuccagggaagccucggugccagaguggugg

SEQ ID NO: 137985 - RNA, 64 nt, Human
ccaacacaagacuggcaguccaaauugaaagagauccagggaaugaugacaacaaucucaauuc

SEQ ID NO: 137986 - RNA, 64 nt, Human
cugaguuucuuguccagcagggccuugacaggaauccagggaguagcuccuggccagaaccagc

SEQ ID NO: 137987 - RNA, 64 nt, Human
cacucagccggcagccagauggccccgcaaggccuccagggauggccccuagccacaggcccug

SEQ ID NO: 137988 - RNA, 64 nt, Human
ccucggcgggaacgcuguacauagucagguccguuccagggaccacuuaaacuuuuuaguugcu

SEQ ID NO: 137989 - RNA, 64 nt, Human
ucucuaucuuagaaagcaaaaacaaacaggaguuuccagggagaaugggaaagccagggggcau

SEQ ID NO: 137990 - RNA, 64 nt, Human
gggggccuugcccaaaccaacugaggucuuaaaguccagggaaaaaaagucuggguuccaacua

SEQ ID NO: 137991 - RNA, 64 nt, Human
aggagaguucuaaggucaccucuggcugcaggcauccagggauuauuccagcaaucugcaggua

SEQ ID NO: 137992 - RNA, 61 nt, Human
cuucucuucugagcugguagaagcagugugauccagggauuacuggccuccagagucuuca

SEQ ID NO: 137993 - RNA, 64 nt, Human
cuguuauucaccauguaauucagguaccacguauuccagggagccuuucuuggcccucaguuug

SEQ ID NO: 137994 - RNA, 64 nt, Human
ucccugcugccuuggaaaaagcacgggguccugcuccagggaauggugaaaugacuggauugcu

SEQ ID NO: 137995 - RNA, 64 nt, Human
uaguaaauguuauauaguuuaguucuaagauaguuccagggauuaaaagguuaagaggaaaaca

SEQ ID NO: 137996 - RNA, 64 nt, Human
ugcuuuaucuugcucuugaaauuuuggccccaacuccagggacuggggauuugugccuggcagc

SEQ ID NO: 137997 - RNA, 64 nt, Human
uuuuugaggugggagaggaugugugaaaaucuuuuccagggaaauggguucgcugcagagguaa

SEQ ID NO: 137998 - RNA, 64 nt, Human
gauggugugugucaaaucaguuguagcuaaucuguccagggagaauacuggcuucauuacacuu

SEQ ID NO: 137999 - RNA, 64 nt, Human
augcuugccugauuuaaaagcccucaguuugcaguccagggacuguucaggcuuguccucagcu

SEQ ID NO: 138000 - RNA, 64 nt, Human
ugaguggugucugcuuagaguuuacuccuacccuuccagggaccccuauccugauccccaacug

SEQ ID NO: 138001 - RNA, 64 nt, Human
ggagucuguaacuuuauuuauacuuaugaauauauccagggacuacuucucauugcugagcagc

SEQ ID NO: 138002 - RNA, 64 nt, Human
aaccuucugcucuggacuggacucacuuuucugcuccagggacuccuuuucuggguuugggucu

SEQ ID NO: 138003 - RNA, 64 nt, Human
cccuggauucuggauuaggagcuucugaaucuuuuccagggauaggcagguagcucacucuugg

SEQ ID NO: 138004 - RNA, 64 nt, Human
cuggguggacagcagugaaucuccaccugucuucuccagggagcucccauguuggggcugaaga

SEQ ID NO: 138005 - RNA, 64 nt, Human
gaggagguguggucagaggugacuuguucccaccuccagggaggacgcuucgucuucggccagc

SEQ ID NO: 138006 - RNA, 64 nt, Human
guccaccugugcccacagcuuccgcccacagaccuccagggacaggagcaaauugcaccacagc

SEQ ID NO: 138007 - RNA, 64 nt, Human
ccaaaccaagcaaauuaggaaccuugcaacgguauccagggacuaugaugagaggccagcacau

SEQ ID NO: 138008 - RNA, 64 nt, Human
ggccccaugaggggaggaaggcaggcgcacgagguccagggaggcccuuuucugaucaugcccc

SEQ ID NO: 138009 - RNA, 64 nt, Human
gaucccuuuguccacaaguaaaaggaaaugcuccuccagggagucucagcuucacccugaggug

SEQ ID NO: 138010 - RNA, 64 nt, Human
uccuuagcucucgcagugagccauguucuuagucuccagggauggauggccuuguauauggacc

SEQ ID NO: 138011 - RNA, 64 nt, Human
cagggggacccacacgaagucaccagcccauagguccagggaggcaggcaguuaacugagaauu

SEQ ID NO: 138012 - RNA, 64 nt, Human
aacaucccucccauucugggaaaggaaagcagccuccagggaaauguuuucugccuuccugcuu

SEQ ID NO: 138013 - RNA, 64 nt, Human
accuuuuuguuucugucaacuugucauauacaccuccagggaccaaaaacaaaagcagcucgga

SEQ ID NO: 138014 - RNA, 64 nt, Human
aucagacuugggcucaguagguggaaagggagauuccagggaagaggcaucgccugcaggacuu

SEQ ID NO: 138015 - RNA, 64 nt, Human
ucaaguuucuucaaucugaagauacaugucuuucuccagggacauguggaaaaaaaaaagaugu

SEQ ID NO: 138016 - RNA, 64 nt, Human
ucuucccuuauucuaaagcugccccuugggagacuccagggagaaggcauugcuuccucccugg

SEQ ID NO: 138017 - RNA, 64 nt, Human
uuuguccacucccucucacuggaagugguugaucuccagggaauccccaagguuagccugcuua

SEQ ID NO: 138018 - RNA, 64 nt, Human
gugcagguaacccuuggucuguaagcaccaccgauccagggaucauugucuaaauagguuacua

SEQ ID NO: 138019 - RNA, 64 nt, Human
caccugccaacuucagucuggagcuucucuugccuccagggacuggccaggucuccccccuuuc

SEQ ID NO: 138020 - RNA, 64 nt, Human
agggcccccucaguugccugagcagcugguggcuuccagggagcaucucugcucuaccccugcc

SEQ ID NO: 138021 - RNA, 64 nt, Human
uggaccauccagugccuguccucgccacagggccuccagggagcauucgggucaaauccaugga

SEQ ID NO: 138022 - RNA, 64 nt, Human
cuuuggcaaaaaaaaaaaaaaaaaaaaguaaauauccagggaacccugcccagacuaauacugu

SEQ ID NO: 138023 - RNA, 64 nt, Human
guuggaggauaaaauggguaucaaugcuaauauuuccagggagaacaugaaaccagagguuucu

SEQ ID NO: 138024 - RNA, 64 nt, Human
caugaggcugcaccgcuuaccuggccacuggcacuccagggagcucugguagccuggccuuucc

SEQ ID NO: 138025 - RNA, 64 nt, Human
gugacuggcgcaggucuccuuggggccugccguguccagggaggccucaugcgucugcuccuag

SEQ ID NO: 138026 - RNA, 64 nt, Human
gcauuacgaggacuggggacaggguagagggacauccagggaucagggcaugagugggggcaac

SEQ ID NO: 138027 - RNA, 64 nt, Human
agaucaugugaguccuccauggcaaggaagcaguuccagggagagucagguuccagcuaguuag

SEQ ID NO: 138028 - RNA, 64 nt, Human
cguucccacccccucucaggcacaaaagccgguguccagggacucaagaccuguaccugggguu

SEQ ID NO: 138029 - RNA, 64 nt, Human
caugagacccacagacuuggugccugagcgcagcuccagggaagccccagccccuuccaggcgg

SEQ ID NO: 138030 - RNA, 64 nt, Human
gguuugcuuuaccuguggcagcagguugcugcuuuccagggauguguccagugcccuggguucu

SEQ ID NO: 138031 - RNA, 64 nt, Human
gccccuggaaaaaauucaggugaugucuuugacauccagggauuucucaaaggcagugaguaaa

SEQ ID NO: 138032 - RNA, 64 nt, Human
cuaauugcugugugucccaggcagggagacgguuuccagggaggggccggcccugugugcaggu

SEQ ID NO: 138033 - RNA, 64 nt, Human
gcagggcaggagcuuggcagagagauagccgggcuccagggaguggggaggagagagggggaga

SEQ ID NO: 138034 - RNA, 64 nt, Human
uucccggacucugccccuacaucucagcugaaucuccagggaggcugcagagcaucguggagac

SEQ ID NO: 138035 - RNA, 64 nt, Human
agaggcaugcaggcugcugggcaccacccccucauccagggaacgagugugucucaaggggcau

SEQ ID NO: 138036 - RNA, 64 nt, Human
uucgccugcugucucugauggcucuggcaaggacuccagggauucuggugggauaugacuuaga

SEQ ID NO: 138037 - RNA, 64 nt, Human
aaaguucuuuauuacuacauacuaaaguuugcauuccagggauauugacuguacauauuuaugu

SEQ ID NO: 138038 - RNA, 64 nt, Human
augaaauuuaaauaaaaaaggacagagucuauccuccagggauugaacauuuuccaauuaucug

SEQ ID NO: 138039 - RNA, 64 nt, Human
uuggcuuaugaaaacaccacugaacagaaauuucuccagggagccacaggcucuccuucaucgc

SEQ ID NO: 138040 - RNA, 64 nt, Human
cccugcccacugccugacccccaccccccgccaguccagggagacccugugggugggggccggc

SEQ ID NO: 138041 - RNA, 64 nt, Human
ucucccccaugccucacuggucccagaucagggcuccagggacagaugaugagucucaaacgag

SEQ ID NO: 138042 - RNA, 64 nt, Human
gccaaauauuaagaagcucagcuaugaaaugaccuccagggaaucagaaaggcacuaaugaugu

SEQ ID NO: 138043 - RNA, 64 nt, Human
uucacaacuuaccuuguuaagacaaaauuuauuuuccagggauuuaauacguacuuuagcugaa

SEQ ID NO: 138044 - RNA, 64 nt, Human
ucaccuugcucacagcaaagccagaaaugcucucuccagggaguagauguaaaguacuuguaca

SEQ ID NO: 138045 - RNA, 64 nt, Human
accugaaaauauauuaauacgccucugacaugaguccagggagaggcaagauugagcaauaguc

SEQ ID NO: 138046 - RNA, 64 nt, Human
aaaucuggaaaguucauuuccugggauucacuucuccagggauuuuuuaaaguuaauuugggaa

SEQ ID NO: 138047 - RNA, 64 nt, Human
ucccauuugcaggaaaagugcagacucugaguguuccagggaaacacaugcuggacaucccuug

SEQ ID NO: 138048 - RNA, 64 nt, Human
agcagcggauggcuuucuuuagcuuagcccaguuuccagggaagcauuguuuuuuccaggcugu

SEQ ID NO: 138049 - RNA, 64 nt, Human
acaaguuguucauaauccagcaggccagaagacuuccagggaaacucauucaaggaggugaaaa

SEQ ID NO: 138050 - RNA, 64 nt, Human
uuuguccuccacaagauggcucuaugaguauucuuccagggauucuaauauuuauuuaagguaa

SEQ ID NO: 138051 - RNA, 64 nt, Human
gucucuaggggccugagagaggcccucuagagaauccagggaaacugugagcccaggaguugcc

SEQ ID NO: 138052 - RNA, 64 nt, Human
aaggcaaguagcaagaauagagcaaaauaucaaauccagggauggcuuagguuucauuaacagu

SEQ ID NO: 138053 - RNA, 64 nt, Human
ucuuacucugauucucagcugagcugugagggcuuccagggaaaauggaacaaaaugguguucu

SEQ ID NO: 138054 - RNA, 64 nt, Human
uuguuauuuuuaacaugaaucuaaaguuuaugguuccagggacuuuuuauuugacccaacaaca

SEQ ID NO: 138055 - RNA, 64 nt, Human
auugcuccccagcccuccagaaaccuugagcagauccagggaucagugagaggaguggugugua

SEQ ID NO: 138056 - RNA, 64 nt, Human
ggagagaggcuggagaccugggcuggggccuuccuccagggaaggaggcuggggugggaacacu

SEQ ID NO: 138057 - RNA, 64 nt, Human
agcuggcucacacgugccauccccaccccggugcuccagggaaggaggacacggacccgacgug

SEQ ID NO: 138058 - RNA, 64 nt, Human
cagucauggcuguccccugcaaguggacgugggcuccagggacuggaguguaaugcucgguggg

SEQ ID NO: 138059 - RNA, 64 nt, Human
cugcacacuacacaacaugugggcuuccuguagcuccagggacauguagcuuuggugaaacugg

SEQ ID NO: 138060 - RNA, 64 nt, Human
acaaguuguucauaauccagcaggccagaagacuuccagggaaacucauuucaagaugaaaaug

SEQ ID NO: 138061 - RNA, 64 nt, Human
uugacugcgaaaggaaaccucacuguuuccuccuuccagggacugaggucuccaagcuagcugu

SEQ ID NO: 138062 - RNA, 64 nt, Human
cuccccuggguucugacuucuuccuccccuugcuuccagggaagaugaagagagagagauuugg

SEQ ID NO: 138063 - RNA, 64 nt, Human
cuccucugcaaugacugggcuccuucccuugacuuccagggagcacccccucgauuugggcaga

SEQ ID NO: 138064 - RNA, 64 nt, Human
agaaaacugcaggggccgugaccagcccucugccuccagggaggccaacugacucugagccagg

SEQ ID NO: 138065 - RNA, 64 nt, Human
aaaugaucuugaaugcgugaaaaaucaguuugauuccagggauauuucuugucuuacauggucu

SEQ ID NO: 138066 - RNA, 64 nt, Human
cugagcucugugaucgcugugauguggacccagcuccagggagcagagugucgaggauggaggg

SEQ ID NO: 138067 - RNA, 64 nt, Human
gcagcucagagaggguggagugaggaugcaugcauccagggaacaggcaucaagaagccagggc

SEQ ID NO: 138068 - RNA, 64 nt, Human
cgcccagaagagcugcacguaucccuuucaugaguccagggaagaggguccuccaggucuugga

SEQ ID NO: 138069 - RNA, 64 nt, Human
auccaaagaaacacuaagcucucugggccuggguuccagggaaggcuaagcauggccuggacug

SEQ ID NO: 138070 - RNA, 64 nt, Human
cccugccuagccucugcuacucccacuucccaacuccagggaaugcauuacuuuuauuucaaac

SEQ ID NO: 138071 - RNA, 64 nt, Human
uccuucccugagucacagagagcaagccaagacauccagggaaagaggaagaaaggccuuagug

SEQ ID NO: 138072 - RNA, 64 nt, Human
cucacagaggccugguuugcucagucuucugaacuccagggaccagcccuggugggcauggggu

SEQ ID NO: 138073 - RNA, 64 nt, Human
uuuccaccccacaguuccuccugggaucuggcccuccagggaaguggagccuccagccccuagg

SEQ ID NO: 138074 - RNA, 64 nt, Human
uucuugagugguguggaccugguguucauaauguuccagggauucagaagcaacgcuaugaacu

SEQ ID NO: 138075 - RNA, 64 nt, Human
uguucaccuguagaagagaacaaauuucgaauaauccagggaaacccaagagccuuacuggucu

SEQ ID NO: 138076 - RNA, 64 nt, Human
agauguguguuaagaaggcugcagcccacaggaguccagggaaggcggggaccacagaggcaca

SEQ ID NO: 138077 - RNA, 64 nt, Human
ucucgaagcaugucuuugccaugggcuguguccuuccagggaaauuguggucucgggccugggu

SEQ ID NO: 138078 - RNA, 64 nt, Human
caccagcuuggauggccgucaccucagacaucacuccagggagcacccgcaggagcugggcccc

SEQ ID NO: 138079 - RNA, 64 nt, Human
gacaagaccagacaggcuuucccaggccuggguauccagggaggcucugcagcccugcugaagg

SEQ ID NO: 138080 - RNA, 64 nt, Human
guauaccaucccuggaaggauucugggacaauauuccagggauucauugacuucuuggcuccuu

SEQ ID NO: 138081 - RNA, 64 nt, Human
aaguguuuguggaguuuccauggugauguuuacauccagggacaguuucgucucccugucaaug

SEQ ID NO: 138082 - RNA, 64 nt, Human
ugaagugcggcuagauucucagauucaccuuucuuccagggaagauaacuuucaaucuauauaa

SEQ ID NO: 138083 - RNA, 64 nt, Human
aucaggggugggaggggaggccccugaggugcucuccagggaagaggggcugggguuuaaauag

SEQ ID NO: 138084 - RNA, 64 nt, Human
gauuuuuaaaaaauccacuaguaauaucagaauguccagggagugacugucacuacaaugaugg

SEQ ID NO: 138085 - RNA, 53 nt, Human
aucgcgcucgccuuuccuagagcuccagggaccguggaggccugaggucaucg

SEQ ID NO: 138086 - RNA, 64 nt, Human
gagaccugccugggcaacauaaugaaacuuccuuuccagggaggaaaaaaaaaaaaaaaaaaag

SEQ ID NO: 138087 - RNA, 64 nt, Human
uggaaaucggaaguaguaugcuucugaaacucuuuccagggaaacaucucuucuugauuugaga

SEQ ID NO: 138088 - RNA, 64 nt, Human
cuccuuucugggacucccggcacaacuccccucauccagggagggaggcagcugcuggggaggg

SEQ ID NO: 138089 - RNA, 64 nt, Human
uacucggaaggccaaggcaggaggaccgcuugaguccagggauucaaggccaaccugggcaaua

SEQ ID NO: 138090 - RNA, 64 nt, Human
gcuugauugaaaacgacaucaucccuugguauacuccagggauugguuucaggaccccugcauu

SEQ ID NO: 138091 - RNA, 64 nt, Human
gccguuuuuccucuuguccaggcucacgaguuaguccagggauuccauacucccuauucccugg

SEQ ID NO: 138092 - RNA, 64 nt, Human
uacgucugaaacugaguagggaaaggcauacuuuuccagggacuuagggggauaggcuuuggaa

SEQ ID NO: 138093 - RNA, 64 nt, Human
cagcauggggugggucagagaugugcuugcaagguccagggacugcguggucugccagcugaga

SEQ ID NO: 138094 - RNA, 64 nt, Human
ucugacucgaagacgggacagucccuggugcacauccagggaagaggagugucgguaguucuug

SEQ ID NO: 138095 - RNA, 64 nt, Human
ugguuacugcacuaccaggguuacugguuuauuuuccagggagcugauaaagcaggagaacugu

SEQ ID NO: 138096 - RNA, 64 nt, Human
cuccuuggaacuuauggcccaaucuuaccuguucuccagggacuggucacugccucaggacccc

SEQ ID NO: 138097 - RNA, 64 nt, Human
cuuauccucggcugcccuucuuggcucccugcauuccagggacuugcucgucuuguuuaccccu

SEQ ID NO: 138098 - RNA, 64 nt, Human
ugacauccagugacagugugggagcaggcuacucuccagggacauguuuuuggaggcauaugga

SEQ ID NO: 138099 - RNA, 64 nt, Human
gcugcccugggggcugcuuucccugggcacgggcuccagggaucaucucugggcacucccuucc

SEQ ID NO: 138100 - RNA, 64 nt, Human
acugcuaggaugggccgcacccaggggucuggccuccagggaccuagagaaugggagggagaac

SEQ ID NO: 138101 - RNA, 64 nt, Human
agcucccuacagacgcuguagccaucacugccucuccagggacccuccucuccugcccaggaca

SEQ ID NO: 138102 - RNA, 64 nt, Human
auucuguaaauuaaaagaauaguuauuuuacaguuccagggauugugaaauaaauguugcaguu

SEQ ID NO: 138103 - RNA, 64 nt, Human
ggcaugauccagggucccccagggugggcucagcuccagggagaggccacccacguggcagccc

SEQ ID NO: 138104 - RNA, 64 nt, Human
gaucucggcucacugcaaccuccaccucccggguuccagggauucuccugccucacccuuucaa

SEQ ID NO: 138105 - RNA, 64 nt, Human
ggauuuuuuuuuuuuuaucuuguucccuggaggauccagggaugaggauagaguggccugagag

SEQ ID NO: 138106 - RNA, 61 nt, Human
ccauugcagauuggauuugaggcuccuccccuccagggacaggcugcagcuccagcgagug

SEQ ID NO: 138107 - RNA, 64 nt, Human
acauauuauccaggcuggugucgaauuccugggcuccagggauccacagucccccuuggccucc

SEQ ID NO: 138108 - RNA, 64 nt, Human
ugaccaucugcugacuguucuuguggaucuuguguccagggacauggggugacaugccucguau

SEQ ID NO: 138109 - RNA, 64 nt, Human
ccagcucuucccuugcugcagccgcaccugcagcuccagggaguuaacucuucuucugggggac

SEQ ID NO: 138110 - RNA, 64 nt, Human
ucuaguuugaccugugcagcacauuccagaagguuccagggagguuguggggcagcuagaggac

SEQ ID NO: 138111 - RNA, 64 nt, Human
uuagcccucccugcuuugccuggcccguugaaguuccagggagcuugcccgggucuccucgggg

SEQ ID NO: 138112 - RNA, 64 nt, Human
agcugacuguggcccccuccgugauccauccaucuccagggagcaagacagagacgcaggaaug

SEQ ID NO: 138113 - RNA, 64 nt, Human
cacuguccgugucauaugagucacuaauauuaacuccagggacuucuggauaggcuaauagauc

SEQ ID NO: 138114 - RNA, 64 nt, Human
gccuuuguucgaaauagauauccucucccccuccuccagggaagguggccacagcaaguacagc

SEQ ID NO: 138115 - RNA, 64 nt, Human
ugcuggcguuuuggcccuugguguuucuggagccuccagggaucuaggggagccugggcugcgu

SEQ ID NO: 138116 - RNA, 64 nt, Human
agaacuuggcaaugagagaucccaucuguugguuuccagggauguaagugaguaauaaaagcug

SEQ ID NO: 138117 - RNA, 64 nt, Human
caaccaguuugcccauucucuuccuauuacuugcuccagggauagguaaaaaaaaaaaaaaaaa

SEQ ID NO: 138118 - RNA, 64 nt, Human
aaaaaauucaugauacucauuucuuaugaaucuuuccagggauuuuugaguccuauucaaauuc

SEQ ID NO: 138119 - RNA, 64 nt, Human
acacauuuugccauguaaacuaacauucacugguuccagggauuaaggaaugaaccucuuuugu

SEQ ID NO: 138120 - RNA, 64 nt, Human
caagccuucuagcgcagggccugcggcccagacguccagggagccggccccuccccggcagcag

SEQ ID NO: 138121 - RNA, 64 nt, Human
uguccauggccuaccaucccuucugacccuggcuuccagggaccuaugucuuuuaauacucacu

SEQ ID NO: 138122 - RNA, 64 nt, Human
cuugugggccuucuaagaugaagccacccucagguccagggaagguugugcugguauuuggcuc

SEQ ID NO: 138123 - RNA, 64 nt, Human
uaugguccucagaucccccuucucuccugcuuccuccagggaacccaacagucaugacccugau

SEQ ID NO: 138124 - RNA, 64 nt, Human
cugugacugccaagguguggccugcacuggguuguccagggagaccuagugcuguuucucccac

SEQ ID NO: 138125 - RNA, 64 nt, Human
cccugcgccccgcacgacugcgggagccagacuguccagggaaacagccucucucuuuucuaca

SEQ ID NO: 138126 - RNA, 64 nt, Human
cgcgccucagaagcuacggucacaacuaaaggaguccagggacuugcugcaggcuggggggcac

SEQ ID NO: 138127 - RNA, 64 nt, Human
acucaccaugaagcgaaacacagagaagcggauuuccagggauauuuaggagugugugacauuc

SEQ ID NO: 138128 - RNA, 64 nt, Human
ccuacagugcauuugaacugccuucugaaagagguccagggagggauuuaggaaauaaaguuuc

SEQ ID NO: 138129 - RNA, 64 nt, Human
ggccaccccacagcucuuuccuuccccuccucucuccagggagccggggcugugagaggaucau

SEQ ID NO: 138130 - RNA, 64 nt, Human
ccacuugccugaagcuccccucuuccucucuuccuccagggacucuggggcccuuugguggggc

SEQ ID NO: 138131 - RNA, 64 nt, Human
uggacaggacuguaccuuagcaaguugcucccucuccagggagcgcauagauacagcagagcuc

SEQ ID NO: 138132 - RNA, 64 nt, Human
gccaccuucgcuagcagggagugggaggcuucuuuccagggauuugugucuccguucugaaggu

SEQ ID NO: 138133 - RNA, 64 nt, Human
caggugcccgcacagaggcuccgugugacuuccguccagggagcaugugggccugcaacuuucu

SEQ ID NO: 138134 - RNA, 64 nt, Human
gagccaucaagcuaagacaauuggggaagagcauuccagggagagggaggaguugugcaaaggc

SEQ ID NO: 138135 - RNA, 52 nt, Human
gcaggcgcaaacgggcauaaauuccagggaccacugggugagagaggaauaa

SEQ ID NO: 138136 - RNA, 64 nt, Human
auguugggauaaggaaacacuucuauuuaaugcuuccagggauuuuuuuuuuuuuuuuuaaccc

SEQ ID NO: 138137 - RNA, 64 nt, Human
caucucuccccucuugaccuuccacccacuccccuccagggagagagcagcagagaccucauca

SEQ ID NO: 138138 - RNA, 64 nt, Human
uuucauaccaauuccaacuuucaggggcugacucuccagggagcugaugucaucacacucucca

SEQ ID NO: 138139 - RNA, 64 nt, Human
agccaugggccgcaggagugcauacaacccugcauccagggacacggcccugcugggugaccuc

SEQ ID NO: 138140 - RNA, 64 nt, Human
gcagucggccucugcagccccuccaagcaagugcuccagggacuauccuguguuuguagcugcu

SEQ ID NO: 138141 - RNA, 64 nt, Human
ucuucccggucacugguaacaauagcaauauguguccagggacacagaauguugguuucuaaca

SEQ ID NO: 138142 - RNA, 64 nt, Human
gcucugccacuacuugcugagcacaggacuggccuccagggauggccugaagccuaacacuggc

SEQ ID NO: 138143 - RNA, 64 nt, Human
aucccuugcaaaccaccaagguguguggcugaccuccagggaggagcacucacuggagugcuca

SEQ ID NO: 138144 - RNA, 64 nt, Human
caggcagagcuccaggcuggcaccaugguaggccuccagggaaagagcugggaggcaggaaugg

SEQ ID NO: 138145 - RNA, 64 nt, Human
ugaaauaugcuggcuggagugaggaaaaaaaucguccagggagcauuuuccuccaucgcagugu

SEQ ID NO: 138146 - RNA, 64 nt, Human
guugggggcuagggagacgccaugugauggacacuccagggacacacagccuagcacagcagcu

SEQ ID NO: 138147 - RNA, 64 nt, Human
ugcccccagggguaugagggcaccagcuggguucuccagggagcaggaguuggaccuccaugga

SEQ ID NO: 138148 - RNA, 64 nt, Human
uugguacugaguauacuuaaauauaacuccagaauccagggacuugguguuaaaacaggauuag

SEQ ID NO: 138149 - RNA, 64 nt, Human
uuuuaaaaaauuagucaugagacuuauucaucuuuccagggaacauacugauuggucuuaaaag

SEQ ID NO: 138150 - RNA, 64 nt, Human
cagccucccugcaguaggaaaacaaugccagggauccagggagacuaagguggccggaacucgc

SEQ ID NO: 138151 - RNA, 64 nt, Human
cuccaaccuacaucagaccaugaaguucaaccccuccagggaagcuccugauuuccccugcaua

SEQ ID NO: 138152 - RNA, 64 nt, Human
caaggcccacaccuaagcuuccauguagcccucauccagggaaguuuugcgauccuuuaggaag

SEQ ID NO: 138153 - RNA, 64 nt, Human
ccuggugugaggccccccggggaccggcaguguguccagggaggggauggcccugagcccagcg

SEQ ID NO: 138154 - RNA, 64 nt, Human
aggggcuucuucagcacagagaccccccacuguguccagggacccccucugccagguggaggug

SEQ ID NO: 138155 - RNA, 64 nt, Human
gcugugcucucuggcgccccacagccuggccagcuccagggaccccaguugcagggcccaagca

SEQ ID NO: 138156 - RNA, 64 nt, Human
gggugaaguuucucucaguucucucccugccacuuccagggaucugagccugugcucagccucc

SEQ ID NO: 138157 - RNA, 64 nt, Human
auucuuccgggggaaggggugacugaacugggaguccagggagggagcugaggagcccuuaccc

SEQ ID NO: 138158 - RNA, 64 nt, Human
gcgagggagaggagggagagggggaggggaggaguccagggagaggcgggaucacggcccaggc

SEQ ID NO: 138159 - RNA, 64 nt, Human
agugcauuuggagggagugaguggcccuuucggauccagggaggcugguccuauggccucaugu

SEQ ID NO: 138160 - RNA, 64 nt, Human
aucuagaaguggcuggaaaccagaagcuggggauuccagggaccccacuuagugcucuauuucc

SEQ ID NO: 138161 - RNA, 50 nt, Human
uccaccagaucagacacugauccagggaaagagccaggaauggcaguguc

SEQ ID NO: 138162 - RNA, 64 nt, Human
uuaguguaaucgauuauaaaggauauuuaucaaauccagggauugcauuuugaaauuauaauua

SEQ ID NO: 138163 - RNA, 64 nt, Human
ucagaaggagccucauccuaaucucacucaggccuccagggauccaugggggagugaaaccaau

SEQ ID NO: 138164 - RNA, 64 nt, Human
uuauauuguagaaggaaacaccaagaaaagaauuuccagggaaaauccucuuugcagguauuaa

SEQ ID NO: 138165 - RNA, 64 nt, Human
uuuagcaaugccuauugcaagugcaauuauauacuccagggaaauucaccacacugaaucgagc

SEQ ID NO: 138166 - RNA, 64 nt, Human
uccuugccaagacuucuccacccucuugcauaccuccagggacagagagcuuacuaccucccaa

SEQ ID NO: 138167 - RNA, 51 nt, Human
agaagccugaugccaaguagcuccagggaacgcauguggauccuagacagc

SEQ ID NO: 138168 - RNA, 64 nt, Human
gcuuucccuucugcuccauaugccucauuguccuuccagggagcucuuuuaaucuuaaaguucu

SEQ ID NO: 138169 - RNA, 64 nt, Human
aaagccauacaauaucaagcacccucccucuagguccagggacuaucacagaagaagcaggcau

SEQ ID NO: 138170 - RNA, 57 nt, Human
ucuacuguguccacuccugaggaugguuccagggaaauaccgccagaaaacaagaag

SEQ ID NO: 138171 - RNA, 64 nt, Human
aaccaaaauaaaguuggggcaggaagagggggcuuccagggagcccugcucggcccugaaucac

SEQ ID NO: 138172 - RNA, 64 nt, Human
cauugugcaauggggcuacgaggcugcaucuggcuccagggaagcguguugcaauccaugagug

SEQ ID NO: 138173 - RNA, 64 nt, Human
ccucccaaccaauucaguauuuuucuccccauuuuccagggagaaaucuaaggcgucagaaugu

SEQ ID NO: 138174 - RNA, 64 nt, Human
ugauauguccuugaagcuggcaggggauucccaguccagggaauaucccuacaugauuuuuguc

SEQ ID NO: 138175 - RNA, 64 nt, Human
guuuuuuuuuucccccuucacucuaauggacuguuccagggaagggaugggggcagcagcugcu

SEQ ID NO: 138176 - RNA, 64 nt, Human
uagugcacuuuaaaaccugcuugguuaccaaguguccagggaaacccuuguauuuugaugacua

SEQ ID NO: 138177 - RNA, 64 nt, Human
ucaaggaucuaaaccagggauuggcaaacguuuuuccagggaguaaauauuuuacgcuuugcau

SEQ ID NO: 138178 - RNA, 64 nt, Human
uaccccgggagacugaacugcaggguucaagccuuccagggauuugccucaccuuggggccuug

SEQ ID NO: 138179 - RNA, 64 nt, Human
auaaagaccuuccugcccaccuccuauggacauguccagggauacaggacaagagugggguuag

SEQ ID NO: 138180 - RNA, 64 nt, Human
aacauucauaggcaguaauguuccucccaggguuuccagggaaacaacaugaaaaacaggugac

SEQ ID NO: 138181 - RNA, 64 nt, Human
agccgagcucguguauccuggggcucccuucaucuccagggaguccccuccccggcccuaccag

SEQ ID NO: 138182 - RNA, 64 nt, Human
gagcacacagcauuauucugauggaaaaagauuauccagggaaugguacaacaaugaccagccc

SEQ ID NO: 138183 - RNA, 64 nt, Human
gugaacagaguuaccuuacagaguuuuggaucuuuccagggauagccaaugauuuuauccccca

SEQ ID NO: 138184 - RNA, 64 nt, Human
ucccaggggacaugaguaaagcagugugguacacuccagggacuugggaaaaugagcaaacaca

SEQ ID NO: 138185 - RNA, 64 nt, Human
caggaaacugcucucccucagcugggcuggggucuccagggaccugagcuacaugcagguugug

SEQ ID NO: 138186 - RNA, 64 nt, Human
gccuggcccccgggaaagaggaaaacccgcugccuccagggagggcuggacggcgagcugggag

SEQ ID NO: 138187 - RNA, 64 nt, Human
gaucugcggaucucagcuuugagaagccuucagcuccagggaauccaagccuccacagcgaggg

SEQ ID NO: 138188 - RNA, 64 nt, Human
cugugucugccaccaccuuugucugauacuuguuuccagggaagcugggggaacugccacaucu

SEQ ID NO: 138189 - RNA, 64 nt, Human
caaccccaugugggaauugaucuauaucucuacuuccagggaccauuugcccuucccaaauccc

SEQ ID NO: 138190 - RNA, 55 nt, Human
gcagccuugaugcugagugauccccuccagggacacuucccugcccaggccaccu

SEQ ID NO: 138191 - RNA, 64 nt, Human
uuuuuuuuucaaucacacuuuguggaaaaacauuuccagggacucaaaauuccaaaaagguggu

SEQ ID NO: 138192 - RNA, 64 nt, Human
uucuuaagggucuaacuugccagagaaaucucauuccagggacugauuguuuuuaucaccuucu

SEQ ID NO: 138193 - RNA, 64 nt, Human
augauaucaugcuugguuuucuuuuuucuuuugguccagggaauggagaaugguguuccauugc

SEQ ID NO: 138194 - RNA, 64 nt, Human
gcuuguccaggcauucagguugcuugcguagacuuccagggaagcaagccuguccuuccugacc

SEQ ID NO: 138195 - RNA, 64 nt, Human
cuugauggagaaggaaaaggcuggcaagguggguuccagggacuguaccuguaggaaacagaaa

SEQ ID NO: 138196 - RNA, 64 nt, Human
uaaauagaaaaccuaauuaaggaaguaacuuuuuuccagggaggggugggagagggaauuuaaa

SEQ ID NO: 138197 - RNA, 64 nt, Human
gcagugggugacugcuguugccaauaccucagacuccagggaaagagaggaggccaucauucuc

SEQ ID NO: 138198 - RNA, 64 nt, Human
ggaaagaacauaaugguuaacaaauaucacagcauccagggauugcccagcuauagugugggug

SEQ ID NO: 138199 - RNA, 64 nt, Human
cugaugugccaggaauggugcauugauucccaguuccagggaugaucaugagcaggcgcaaaau

SEQ ID NO: 138200 - RNA, 62 nt, Human
gugaagaggaugcacugugauaccuaccagucuccagggacuaugacccuaaaccagggccu

SEQ ID NO: 138201 - RNA, 64 nt, Human
gaugccaguagauaaaagugugagagaaggggucuccagggaagagucacaggcuguuggacgc

SEQ ID NO: 138202 - RNA, 64 nt, Human
cuucuccagcuguaaaauggacacacaauccuccuccagggacugcugugaaaucaagaaaucg

SEQ ID NO: 138203 - RNA, 64 nt, Human
aguccaucccgcuaguccaucccgcuagccccacuccagggacucagacccaucuccaaccaug

SEQ ID NO: 138204 - RNA, 64 nt, Human
agaacuacauagaaucaguauuguuuucauggccuccagggaaaaaauguuuuucaaguaagag

SEQ ID NO: 138205 - RNA, 64 nt, Human
agaacaacuuucucuacauuguguuuuaaaaggcuccagggaauccugcauucuaauuggcaag

SEQ ID NO: 138206 - RNA, 64 nt, Human
ccucauucuuuaccuuuguuguaagaacuuuagcuccagggaacugaggcagaggcccuguuug

SEQ ID NO: 138207 - RNA, 64 nt, Human
uccuugcacacaugggcacacacaaucuccaccauccagggagguccugaagucaaaucucuau

SEQ ID NO: 138208 - RNA, 64 nt, Human
guccuucaaaaucaacaacagauugucucucggcuccagggaggugucauuucuauagaaauua

SEQ ID NO: 138209 - RNA, 64 nt, Human
gauacagcugcuuagaaaggaggcgacuccuagauccagggauagccccgucuggugccagugu

SEQ ID NO: 138210 - RNA, 64 nt, Human
gaagagccgggaccuucccccugcacccccgacauccagggacggggugugaggaagacgcugc

SEQ ID NO: 138211 - RNA, 64 nt, Human
aaugaugguugauggguucuaauuuuggauggaguccagggaagagaaagugauuucuagaaag

SEQ ID NO: 138212 - RNA, 64 nt, Human
accuuccacucuggaaccuuauuccagcaguuguuccagggagcuucuaccuggaaaagaaaag

SEQ ID NO: 138213 - RNA, 64 nt, Human
ugaagcuaaagugugucuacaaugguacagcucuuccagggacaugggaaguuuaucgugggag

SEQ ID NO: 138214 - RNA, 64 nt, Human
uguagugacaucaccgaauucuugaagacuauuuuccagggaugccugaguggugcacugagcu

SEQ ID NO: 138215 - RNA, 64 nt, Human
ugacagcuuagauuuagccccaguuccugcacgcuccagggaacggggugucuggccucacugg

SEQ ID NO: 138216 - RNA, 64 nt, Human
caggccucaccccucaccuuguuuuuuugggggcuccagggaccaaucuggggcuggaaauguu

SEQ ID NO: 138217 - RNA, 64 nt, Human
ucuggucuggggcugagggcaaggacugcacuaguccagggaguaggggacccuugaacaccaa

SEQ ID NO: 138218 - RNA, 64 nt, Human
gccguucuccugagucccugagggcagacacagcuccagggacccaggccagcugccacacccc

SEQ ID NO: 138219 - RNA, 64 nt, Human
uccagauguguauucuguugaggacccaggcccauccagggauuucaucucuaagccuggcagu

SEQ ID NO: 138220 - RNA, 64 nt, Human
acacauacccucuucauggaugggggaacucagauccagggacagaggccccagccucccugaa

SEQ ID NO: 138221 - RNA, 64 nt, Human
uuauuuuuaaaacacacgaaugaccaaggcuuguuccagggaauaaugcucugucugaaagcgu

SEQ ID NO: 138222 - RNA, 64 nt, Human
auguguuuccuuagauuuccuuuccuaggcgauuuccagggagagcccugauuggacaaucaca

SEQ ID NO: 138223 - RNA, 64 nt, Human
cuccccaccacggaaccuuccaucuaagauuucuuccagggaaugccagcaaucaggcagcacc

SEQ ID NO: 138224 - RNA, 64 nt, Human
gagaagaacugucuuuguuucuugugugcuucaauccagggaaaguuucuuggacccagugaua

SEQ ID NO: 138225 - RNA, 64 nt, Human
gcauuuuaguuugaaccaggcauuguguuaggaauccagggauaaagaugaaugaaauguauuu

SEQ ID NO: 138226 - RNA, 64 nt, Human
uuuugaauuacaagagugacaguuaguaaacugcuccagggaaauaagugucaucuuuuaagag

SEQ ID NO: 138227 - RNA, 64 nt, Human
agagacuugucauuucuaaagacauuuaaguugcuccagggauuucugaaaaaagacacaggcu

SEQ ID NO: 138228 - RNA, 64 nt, Human
auuggccuuugcugucacugggagagaagagccguccagggacccaugguggcccacaugugga

SEQ ID NO: 138229 - RNA, 64 nt, Human
aggaccucugcugaagagggggaugaagugggucuccagggaggcagugggggccuuguuggca

SEQ ID NO: 138230 - RNA, 64 nt, Human
augaauccuugguagcucucugagaacagugaaguccagggaaaggcaucuggucugucuggaa

SEQ ID NO: 138231 - RNA, 64 nt, Human
ggacuccuggacuacuuucauugaugaccauaucuccagggauguuguugauccccacacugcc

SEQ ID NO: 138232 - RNA, 64 nt, Human
ggugcacucacuccugacugcccggcacagaugcuccagggaugauucaagccauuccaaaguu

SEQ ID NO: 138233 - RNA, 64 nt, Human
cauagugggaugcccagcaggcacaaaccauggguccagggagucucagcggggaacuucuauc

SEQ ID NO: 138234 - RNA, 64 nt, Human
uuuaaugguuagggacaguaaaucuacuucuuuuuccagggacgacuguccccucuaaaguuaa

SEQ ID NO: 138235 - RNA, 64 nt, Human
aaagugcugcauggcucgcauggaauccacgcgcuccagggacucugcccgcccccgcgacugg

SEQ ID NO: 138236 - RNA, 64 nt, Human
cgccacugggagccaccccagcgccaggcgcccguccagggacacacacagucuucacugugcu

SEQ ID NO: 138237 - RNA, 64 nt, Human
agagucuuaaagguaaagacacgaaaacacuuccuccagggaccuucccgaaaacguucuggcu

SEQ ID NO: 138238 - RNA, 64 nt, Human
aggugaccauucucagaacuccagcuauucacucuccagggagaaggaccucaaaucgccacuc

SEQ ID NO: 138239 - RNA, 64 nt, Human
uaucugagguugucugggaccugccuccaccccauccagggaugagaauggcagccaaucucug

SEQ ID NO: 138240 - RNA, 64 nt, Human
cugccuugccucaagaaccauccccugcagagcauccagggagguuucucgccccaauagccuc

SEQ ID NO: 138241 - RNA, 64 nt, Human
cuaaggagcagaaaacccaagggcagguggagaguccagggaggcaggauggaucaccagacac

SEQ ID NO: 138242 - RNA, 64 nt, Human
ucaaaauugauaagucacuuggcucucggccuuguccagggagguugggcuaaggagagaugga

SEQ ID NO: 138243 - RNA, 64 nt, Human
gaaaucugaucucggcuccaaccaacagccaccuuccagggauggggggccugaagccucgaug

SEQ ID NO: 138244 - RNA, 64 nt, Human
cugucugggaaccagaaacccuacacccucccccuccagggaaugcugaguuccaguuuugagc

SEQ ID NO: 138245 - RNA, 64 nt, Human
gggguugccucauuggauggcuuuuuuuuuuuccuccagggagaaggggagaaauguacuugga

SEQ ID NO: 138246 - RNA, 64 nt, Human
auggcccucgccucccaugucuuugaagcaccccuccagggagucaggugugugcucagccacc

SEQ ID NO: 138247 - RNA, 64 nt, Human
uuuccgaguccagcccccccugagccccaccuccuccagggagcccuccaggaagccccuuccc

SEQ ID NO: 138248 - RNA, 64 nt, Human
aacuguggcugggaaggugccuccaacaaugggauccagggaagccaaggagaagacagccccc

SEQ ID NO: 138249 - RNA, 64 nt, Human
ccuuguccuagcccugccacgugaggguccagccuccagggacaggcacugcccaccaacggca

SEQ ID NO: 138250 - RNA, 64 nt, Human
cuuauauugguaauuguuagguggacuacuuuucuccagggacuuuuugcacucuugugacuaa

SEQ ID NO: 138251 - RNA, 64 nt, Human
cucuagcucucggaggggcgaucaugagaaaccuuccagggaaacugagcacaggaugaacugu

SEQ ID NO: 138252 - RNA, 64 nt, Human
uggggagcccagugcccggcacagcacaggggcuuccagggaggccgcgcagggccguggggcu

SEQ ID NO: 138253 - RNA, 64 nt, Human
aguggcccgucccugggaggcuggcaaagugcucuccagggaggggucagacguccuugugauc

SEQ ID NO: 138254 - RNA, 64 nt, Human
ucaauuccuuguacucacugaacccaugcugaucuccagggaaccauccuuccucucagaaucc

SEQ ID NO: 138255 - RNA, 64 nt, Human
ucaauacuguuuuaccccaucccuugugcauauuuccagggagaaggaaagcauauacacuuuu

SEQ ID NO: 138256 - RNA, 64 nt, Human
cuccucccucguagagggagauuauauccccaacuccagggaccucuuuaucucaaucuauuua

SEQ ID NO: 138257 - RNA, 64 nt, Human
aaucuagucaucuguguaggagcuaaagcaggucuccagggagagaggguggucgucugugcau

SEQ ID NO: 138258 - RNA, 64 nt, Human
uucagggagcauagcaucgggaggaugcuacauauccagggacucccuccuggccuuccugugu

SEQ ID NO: 138259 - RNA, 64 nt, Human
ugcaggacugggcaccaugggccaaaauuuuguguccagggaagaggcgagaagugcaaccugc

SEQ ID NO: 138260 - RNA, 64 nt, Human
ugagcuccugccuuagggccucauuugcucuucauccagggaacugagcacagggggccuccag

SEQ ID NO: 138261 - RNA, 64 nt, Human
ugcuucaaaggccagagucacaggaaggacuucuuccagggagauuaguggugauggagaggag

SEQ ID NO: 138262 - RNA, 64 nt, Human
augagccgaagcuuuacauugugagaguagcaaguccagggagagcuaaagagguuuuaucugu

SEQ ID NO: 138263 - RNA, 64 nt, Human
uuugaacagaagucauugcaguugggguguuuuguccagggaaacaguuuauuaaauagaagga

SEQ ID NO: 138264 - RNA, 64 nt, Human
caggacgacagcagcagcagcgcgucuccuucaguccagggagcucccagggaagugguugacc

SEQ ID NO: 138265 - RNA, 64 nt, Human
gcuucucuaacaaaucuguaguaaguauacggacuccagggagagaggcugggcuucuuucucu

SEQ ID NO: 138266 - RNA, 64 nt, Human
gauacuauuuguaacauuuugauuugauuuaaucuccagggacagaaauaauucauugguaaag

SEQ ID NO: 138267 - RNA, 64 nt, Human
aaaaggagggaaagauuguuuggugcuggaacauuccagggaaaaggagacuggaaugaaaggu

SEQ ID NO: 138268 - RNA, 64 nt, Human
aagaaaguugucacuccagugaguuacccagggcuccagggagcccacagcagcaucagaccca

SEQ ID NO: 138269 - RNA, 64 nt, Human
caugcauagagccacgggaggugcguccuuguuuuccagggaauguucuuagaacuuggacuac

SEQ ID NO: 138270 - RNA, 64 nt, Human
ucuguccagaagggcuacuuuccacauauagagcuccagggacugucuuuucuguauucgcugu

SEQ ID NO: 138271 - RNA, 64 nt, Human
gagguuggaagcucuaggcauuguucucuuuggauccagggaugcuaaguagaaacugcaugag

SEQ ID NO: 138272 - RNA, 64 nt, Human
uccccggcccugggugggcggugggcagcuggucuccagggacucagugaguggcugugcucuc

SEQ ID NO: 138273 - RNA, 64 nt, Human
gucuuuucuggagauugggacagagcaucugugguccagggaaguuaguccucuggccucaauu

SEQ ID NO: 138274 - RNA, 64 nt, Human
acuaagugccuaggguugcccgcuguggccugcuuccagggagcaacagagaggccaccaagca

SEQ ID NO: 138275 - RNA, 64 nt, Human
agcccagcaacaguguguccuguggucauaaaacuccagggaccucuauccuccaggagucuca

SEQ ID NO: 138276 - RNA, 55 nt, Human
cagcaacaggacuggaaugacgcgguccagggagggcggaggcccaggagaccaa

SEQ ID NO: 138277 - RNA, 64 nt, Human
ggaaaagugacuaaugagucaggagcaaggaacguccagggagugggagcagcacaugcgcgug

SEQ ID NO: 138278 - RNA, 64 nt, Human
ccccacccugagcgccuggguccaggggaggccuuccagggacgaagaagagccacagugaggg

SEQ ID NO: 138279 - RNA, 64 nt, Human
ccccguguucagagugcuggcagcccugcacguguccagggacacugcauuucaaagaaccacu

SEQ ID NO: 138280 - RNA, 64 nt, Human
uugaaacuuacccucuagggaugcaggugggauguccagggacuauagguuugggaaaaccaua

SEQ ID NO: 138281 - RNA, 64 nt, Human
cucccagccaagaucugucuuccuucauggugccuccagggagccuuccuggucccaggaccuc

SEQ ID NO: 138282 - RNA, 64 nt, Human
acguauccucuguauucaguaaacaggcugccucuccagggagggcugccauucauuccaacag

SEQ ID NO: 138283 - RNA, 64 nt, Human
gcuuuaugugagauaccccacuccacaucaacauuccagggaugagccaaaccagcagggaguu

SEQ ID NO: 138284 - RNA, 64 nt, Human
aucuuugagaccauccauucuccucaguggcuucuccagggaauucuuacagccaaguugugac

SEQ ID NO: 138285 - RNA, 64 nt, Human
aacugcacagugaccacuguauuuuucacgcucuuccagggaucccugucccccgacauugaag

SEQ ID NO: 138286 - RNA, 64 nt, Human
uauuacgguccacacagggacagagcgccccugcuccagggaggaggcucaccggacccugggg

SEQ ID NO: 138287 - RNA, 64 nt, Human
uuccucuuaggaaagcugcaggaaccucgugggcuccagggacccaggcccacauccauccagc

SEQ ID NO: 138288 - RNA, 64 nt, Human
ucucugaaaguguugaagcgcggacccuucuggguccagggaggggucccugcaaaacuccagg

SEQ ID NO: 138289 - RNA, 64 nt, Human
augccacaaccugggcuccuggcuacagcagggcuccagggacuccaaauaaauguucagugac

SEQ ID NO: 138290 - RNA, 64 nt, Human
cagccuccacucuccucgucuagguuucuuuaccuccagggaucagcugugugugugugaccuc

SEQ ID NO: 138291 - RNA, 64 nt, Human
cuggcagagucccgagaagauggggcccuggcuuuccagggagugcagcaagcagccggccugc

SEQ ID NO: 138292 - RNA, 64 nt, Human
cugggacacagaguuggagcuggcacugaagaucuccagggacuucagagaccaauaaaagccc

SEQ ID NO: 138293 - RNA, 64 nt, Human
ccaugaccccaaacugcucuuuccaauuugaacuuccagggauuuuauugugaacuuacauagc

SEQ ID NO: 138294 - RNA, 64 nt, Human
guguguguggacucacacucacauucucagaggauccagggaggcccagguacacacaggccau

SEQ ID NO: 138295 - RNA, 64 nt, Human
uuccaacuggugggaugacauccggacauccucuuccagggacuggggcaaacucaggccccac

SEQ ID NO: 138296 - RNA, 64 nt, Human
aaguggccuuaagucuuuuugaaguguuauuucauccagggaaaugccucgagccauagagccu

SEQ ID NO: 138297 - RNA, 64 nt, Human
aguaccuuguggaggcagguucuugggcugcuacuccagggaguggauggaauccuuggucccc

SEQ ID NO: 138298 - RNA, 64 nt, Human
ucgucuugaacgugcaugggcggcgugugacaucuccagggaggccguccgaagucgagaaucg

SEQ ID NO: 138299 - RNA, 64 nt, Human
uggaagaagaguccagaacaggccagaaagugaauccagggaacacaggcaaauuauuuguggg

SEQ ID NO: 138300 - RNA, 64 nt, Human
guccacucacccuguucccugagcagcagcucccuccagggaggcccugggucccacgcccugg

SEQ ID NO: 138301 - RNA, 64 nt, Human
ugaaagcacuuuaaugauuccccuucccccaaacuccagggaauggaggggggaccccgccagc

SEQ ID NO: 138302 - RNA, 64 nt, Human
ccugacggugcaagaacgguugaagcucuuugaauccagggacuugaagaaagacuaggugugu

SEQ ID NO: 138303 - RNA, 64 nt, Human
uuuucuaaugcuggggagcugcacccaccucccuuccagggauuugaauagugguuuuucucua

SEQ ID NO: 138304 - RNA, 64 nt, Human
cugagcugcugaagcugcacuacaugcaggaaucuccagggaccagccaccccaugcucagguu

SEQ ID NO: 138305 - RNA, 64 nt, Human
cccaagcugagaagcugagagcuggaggacaauauccagggacauggcucuggaaaauaacuuu

SEQ ID NO: 138306 - RNA, 64 nt, Human
gaucagugaggggagaagguugagcucuccggcuuccagggagaccuccccgcccagcagcccc

SEQ ID NO: 138307 - RNA, 64 nt, Human
ccuggagagccuugacccagagccugugcugagguccagggaguguggagagcuccuggugucg

SEQ ID NO: 138308 - RNA, 64 nt, Human
uccgcagccccuuuccccacgcccacccccagucuccagggacccuugccugccuccuaggcug

SEQ ID NO: 138309 - RNA, 64 nt, Human
agcacugccuccuguuuucucccucucaugucccuccagggaaaaugacuuuauugcuuaauuu

SEQ ID NO: 138310 - RNA, 64 nt, Human
cccuugcaagucccccacucaggccucuggaagguccagggaugggcucugaugagaggguaaa

SEQ ID NO: 138311 - RNA, 64 nt, Human
cagugcggauccgggaggaggagcgcuacccaccuccagggagcacccugcccaccaagaagca

SEQ ID NO: 138312 - RNA, 64 nt, Human
agguaggcagaaaaugggcuugggagccagacacuccagggaucaguaguuccuacccauaguc

SEQ ID NO: 138313 - RNA, 64 nt, Human
uuuucugggcauagaacucgaagucauggccaccuccagggacaaagaggagcugcugugggcc

SEQ ID NO: 138314 - RNA, 64 nt, Human
uuuuuuaugcucaggagcauuggaauccucuucuuccagggaggaauuagccugcaagguuagg

SEQ ID NO: 138315 - RNA, 64 nt, Human
aaaaaaaaaaagccagugcccagggaugggcaucuccagggagcuggggauuagugccaggcag

SEQ ID NO: 138316 - RNA, 64 nt, Human
ccucgccaucggagcucucaugggccccaggaaguccagggacagcucccuuauaccuggccca

SEQ ID NO: 138317 - RNA, 64 nt, Human
aguaaauauggagccguuuuauugagcaguuuccuccagggaugacggcugucaguguguuucc

SEQ ID NO: 138318 - RNA, 64 nt, Human
aaagagauucugucuuaccggugccagucaguacuccagggaugggaggcacaaguugugauug

SEQ ID NO: 138319 - RNA, 64 nt, Human
ccccaucgugcugcaugaccuccacgcacgcacguccagggacagacuggaauguaugucauuu

SEQ ID NO: 138320 - RNA, 64 nt, Human
aauauguugauucaaacuugcuucuaagccugaguccagggauagcaaugguacugaccagcua

SEQ ID NO: 138321 - RNA, 64 nt, Human
aagggaucuuucgagguuccccucucagucuuccuccagggaauggccuccaugaggggcaggg

SEQ ID NO: 138322 - RNA, 64 nt, Human
gccagaaugaauucuucgaaaaauauaggugguuuccagggaauuugaaugauuguauuuugug

SEQ ID NO: 138323 - RNA, 64 nt, Human
uacagaagacaucagccaacugcacgagucagaguccagggauugucacuauuauuaauaaugu

SEQ ID NO: 138324 - RNA, 64 nt, Human
agugugcgcccuugacugcuuucuuugcugcccuuccagggagcugccccccugguagggcaug

SEQ ID NO: 138325 - RNA, 64 nt, Human
uggcugcaguacaggaucugacucuggcucaggcuccagggacuuguggggugggaggggcuuc

SEQ ID NO: 138326 - RNA, 64 nt, Human
uuccauggaaccugacguagcugcaaaggacagauccagggacugaagccaaaguuaugcaagg

SEQ ID NO: 138327 - RNA, 64 nt, Human
guucagccauugcccugugagggcucacucggcuuccagggagcccuuuacccuauuugucucc

SEQ ID NO: 138328 - RNA, 64 nt, Human
ggguucccuccuccucucucccaaggagugcuucuccagggaccucucuccgggggcucccugg

SEQ ID NO: 138329 - RNA, 64 nt, Human
gggguuuuaagggagcggugugggagugggaaaguccagggacugguuaagaaaguuggauaag

SEQ ID NO: 138330 - RNA, 64 nt, Human
cagccucagagacaucagcccuuggggguccuccuccagggacagcaacuaucagacuaagcca

SEQ ID NO: 138331 - RNA, 64 nt, Human
cguccuggugaggacaagguacaggcaaggaugauccagggauugggccugggacucaggccuc

SEQ ID NO: 138332 - RNA, 64 nt, Human
augacucaagugucucaguccaccugagcugccauccagggaugccaucugugggcacgcugug

SEQ ID NO: 138333 - RNA, 64 nt, Human
uuacaugaaaugauuugcaggggauggggccuuuuccagggaagucaccuaaagcuugcauguu

SEQ ID NO: 138334 - RNA, 64 nt, Human
aaggaacucccuuucccccucccuugccccuuccuccagggacccaagcgcuuccagaugacaa

SEQ ID NO: 138335 - RNA, 64 nt, Human
aggaccucaguuaaccaauuaccuuuucccggauuccagggaauucauacugugaaaucaaaac

SEQ ID NO: 138336 - RNA, 64 nt, Human
cuuaacucuauaauguucauuuaguuguuucagcuccagggaaauggagguauugauguugaac

SEQ ID NO: 138337 - RNA, 64 nt, Human
caguauugcagauuuuaacugauuuggcugauccuccagggaccaguuucugugggcguguauu

SEQ ID NO: 138338 - RNA, 64 nt, Human
gccugccuucugccucccuuugggaucugugucuuccagggaucagcugcuuggcuucugcugg

SEQ ID NO: 138339 - RNA, 64 nt, Human
cauuugcuacuguacauaaacaaugaugcccugcuccagggagauuuugagguaaagauaugga

SEQ ID NO: 138340 - RNA, 64 nt, Human
gagggucucuagggucugcaaaauagaggccaaauccagggaccaggcccuaauaauagaaguu

SEQ ID NO: 138341 - RNA, 64 nt, Human
auagaagcacuccccugauaaauacuuucugugcuccagggaaccccuuuuuucagacaagaag

SEQ ID NO: 138342 - RNA, 64 nt, Human
uagaccuuccagugaagaaagugaucucaagagguccagggacuuaacagccaagccacaccac

SEQ ID NO: 138343 - RNA, 64 nt, Human
ugccacagggaaggggcucccacugcuucuggucuccagggacagugcugcuggaaaggcuagu

SEQ ID NO: 138344 - RNA, 64 nt, Human
uccuggaacugagccggggcccucacuggccuccuccagggaugaucaacagggcagugugguc

SEQ ID NO: 138345 - RNA, 64 nt, Human
uagucauggauggucucguuccagauguuauuguuccagggaacuaaauucauuccugaugcca

SEQ ID NO: 138346 - RNA, 64 nt, Human
uugauguccaucuuccaggagagacggucucggguccagggaguggagggggcugccccugccg

SEQ ID NO: 138347 - RNA, 64 nt, Human
ggcaagucccugcgcuccagcuggacggcccuguuccagggaggaggugcucgguugacaccau

SEQ ID NO: 138348 - RNA, 64 nt, Human
gcuuggacggcugggcacacgccucccacugggguccagggagcaggcggugggcacccacccu

SEQ ID NO: 138349 - RNA, 64 nt, Human
auccgcccacccacccugggacccacgcggccacuccagggaucauuguuguccuuuugugagg

SEQ ID NO: 138350 - RNA, 55 nt, Human
acuucugugugggcaagugacgggauccagggaagucgcacccaagcugcgugga

SEQ ID NO: 138351 - RNA, 64 nt, Human
ccagccagcgagucaggagcgggggagacagggcuccagggaugaggccgcauucugcucccac

SEQ ID NO: 138352 - RNA, 64 nt, Human
agaaguuguaccugacucauuuuucucaggugucuccagggagcaggacccauggagggacccc

SEQ ID NO: 138353 - RNA, 64 nt, Human
gggaggccugagguuggccacgggggagcuggccuccagggacgggagagauugugucaugugc

SEQ ID NO: 138354 - RNA, 64 nt, Human
cuuggcucagggcuaaugcgcccugaaggcagaguccagggaccuugacccagccccucucagc

SEQ ID NO: 138355 - RNA, 64 nt, Human
cuugugguucuguaaugccaaaaggaaugaaggcuccagggauacagaguuguccauuaccaaa

SEQ ID NO: 138356 - RNA, 64 nt, Human
cucacggagucgcgacaaggaggagcggaggcgcuccagggagcggagcaaggacaaggaccgg

SEQ ID NO: 138357 - RNA, 64 nt, Human
aggccaaccuugccgggcuguuucccgaggcugcuccagggagccccgaggcccgcuggaggcc

SEQ ID NO: 138358 - RNA, 64 nt, Human
gacaucacgggaggaagaugagaugacuuuugcauccagggagugggugcagccacauuuggag

SEQ ID NO: 138359 - RNA, 64 nt, Human
gagaugauauuguagcuguuuguacauaauguaauccagggaguccuaauucuucccucugauu

SEQ ID NO: 138360 - RNA, 64 nt, Human
acagacaggaaccucagcagugacagaagagagauccagggaugggucuucucugacccagcca

SEQ ID NO: 138361 - RNA, 64 nt, Human
accuacaaaaaagaaauggaacaaauguaguggauccagggaacgcuuuuguccaaggauucac

SEQ ID NO: 138362 - RNA, 64 nt, Human
gaggcucccagacgcuccucgaggugcccagcucuccagggagcuucuggcccaaggccgucug

SEQ ID NO: 138363 - RNA, 64 nt, Human
gucugcgcuuggccuuaguccuggagacccagccuccagggacugaaccgugcugcuguuggga

SEQ ID NO: 138364 - RNA, 64 nt, Human
cggccacccgacuacuuugccuccuuggauuuccuccagggagaaugugaccuaauuuaugaca

SEQ ID NO: 138365 - RNA, 64 nt, Human
caagggcagagcauuuaagagugaagucaugaccuccagggagccuagaagcugguggccuugg

SEQ ID NO: 138366 - RNA, 64 nt, Human
aucuuccucgcacaguguggguucuuggaguucauccagggaaggcggcgccucuuucucaggu

SEQ ID NO: 138367 - RNA, 64 nt, Human
cucaacuccagucagaccaggucuugcugguguauccagggacaggguauggaaagaggggcuc

SEQ ID NO: 138368 - RNA, 64 nt, Human
cuacuggaagagcacagggcagggcagccagugguccagggauggcugcuuccugauacacgug

SEQ ID NO: 138369 - RNA, 64 nt, Human
augaacucaauggacauccguugcagugacaucauccagggagacacacaagguaugccugaug

SEQ ID NO: 138370 - RNA, 64 nt, Human
cgcuguucccacagaaugaugcucauuucccuguuccagggaaggcguugggaugauggaugcg

SEQ ID NO: 138371 - RNA, 64 nt, Human
gugagcugggaaagguuuguggcuccuugcagccuccagggacuggccuguccccgauagaauu

SEQ ID NO: 138372 - RNA, 64 nt, Human
gguccuugccaccgguucucuguucuccuggaaguccagggaagaaggagggccccagccuuaa

SEQ ID NO: 138373 - RNA, 64 nt, Human
cucugcccaucccagcugcacccuagcucccugcuccagggaugugagcacccacucccugugc

SEQ ID NO: 138374 - RNA, 64 nt, Human
augguacagcuucuggagcagaacuuuccagggauccagggacacuuuuuuuuaaagcucauaa

SEQ ID NO: 138375 - RNA, 64 nt, Human
cugccaaaaugguacagcuucuggagcagaacuuuccagggauccagggacacuuuuuuuuaaa

SEQ ID NO: 138376 - RNA, 64 nt, Human
auccuacucuuccuuucuaaaucugagaucucccuccagggaauccgccugcagaggacagagc

SEQ ID NO: 138377 - RNA, 64 nt, Human
cagauugguuuaaccaauuacucguccccgccauuccagggauugauucucaccagcguuucug

SEQ ID NO: 138378 - RNA, 64 nt, Human
uuugaggcacccacaccccccgcuuuccuuuaucuccagggacucucaggcuaaccuuugagau

SEQ ID NO: 138379 - RNA, 52 nt, Human
agcugaagcggaaauauugaaguccagggagggagcgccccgggccgcgucc

SEQ ID NO: 138380 - RNA, 64 nt, Human
gucuggacuauauugggacugggacuucugggucuccagggaggguauuuauuggucagggugu

SEQ ID NO: 138381 - RNA, 60 nt, Human
cucagagaccuccccacugauggcuaggacuccagggagccucgacccuagggcugaucc

SEQ ID NO: 138382 - RNA, 64 nt, Human
cuuuugcauaggaaauacuugauuuaauuacagguccagggaugagcugaugguugcuggagga

SEQ ID NO: 138383 - RNA, 64 nt, Human
uuuauucuugcacgauuuaggcaauuaucucucuuccagggaguaccuuuuuuucuaguugaga

SEQ ID NO: 138384 - RNA, 64 nt, Human
gagaguuggcgggucacugaggugcauucugggcuccagggacgccacugcggggcaaaggcgc

SEQ ID NO: 138385 - RNA, 64 nt, Human
cuucagcccucaacugccucgaguccugugaugguccagggaaucucuuuugggcacuucuugc

SEQ ID NO: 138386 - RNA, 64 nt, Human
ugaggacagaggaagaccugauggggucuccuauuccagggaauaagccaaauuaacacuaaaa

SEQ ID NO: 138387 - RNA, 64 nt, Human
gaagcuaagugaggagcuuccauuggaaugcuuuuccagggagagaggccaguuaauuuaaaaa

SEQ ID NO: 138388 - RNA, 64 nt, Human
ccauccuugcugcagcuucuaacugguaaaaagauccagggauggagaugggaagguuagaaag

SEQ ID NO: 138389 - RNA, 64 nt, Human
ggggaagagaccugugucagucuugguuaauuguuccagggaaccuugcuaacagaaacuugcu

SEQ ID NO: 138390 - RNA, 64 nt, Human
cacuuuggcauagagacaagcagcacuguuccaguccagggaugcugugugugcccugguggug

SEQ ID NO: 138391 - RNA, 64 nt, Human
ccuggcugcccuggacugugcagagaugccugacuccagggaaaccugaaagcaagaaguuaau

SEQ ID NO: 138392 - RNA, 64 nt, Human
ggaaccuguguaaguauugugaaaacccuuuucuuccagggaaaaauuauuggaaauuccuuaa

SEQ ID NO: 138393 - RNA, 64 nt, Human
uccuguuuauucuucuucccgagggaccccagguuccagggaccgacugagccccggacccgcu

SEQ ID NO: 138394 - RNA, 64 nt, Human
cuguccuuccaaccuguucacgugacuccucaauuccagggaaccagagcgauguguucuuugu

SEQ ID NO: 138395 - RNA, 64 nt, Human
ggcuccgggccugagcauucgcaaagcucgcuucuccagggagccuccucuuggcuuuggaaaa

SEQ ID NO: 138396 - RNA, 64 nt, Human
auaacauuucuacccaggauaauagucacaguuuuccagggagggaaugauauaauuuucauga

SEQ ID NO: 138397 - RNA, 64 nt, Human
auuggacggccugaugcucccuccccugcccugguccagggaagcuggccgaggguccuggcuc

SEQ ID NO: 138398 - RNA, 64 nt, Human
acagagacuucucucugccauggcccuucuuuauuccagggacuuagaaacuugccugagaugg

SEQ ID NO: 138399 - RNA, 64 nt, Human
cccgucugcugaugugaccaguggcaggcacagguccagggagacagacucugaaugggacuga

SEQ ID NO: 138400 - RNA, 64 nt, Human
uuccauuggcaugggcucuggagcuguccagaaguccagggacaccagacuugaucaaggaagg

SEQ ID NO: 138401 - RNA, 64 nt, Human
auuugggaggacacagcaggcagcgcuggccuucuccagggauggcccaaggcuuccgcagccg

SEQ ID NO: 138402 - RNA, 64 nt, Human
gccuuaaggccacacuggcaucucccugaccuucuccagggacagaagcaggaguaaguuucuc

SEQ ID NO: 138403 - RNA, 64 nt, Human
cuuccuaguaacuguugcaguuuacaaccugcccuccagggacacgucuccaugguuuuuccua

SEQ ID NO: 138404 - RNA, 64 nt, Human
uucauugucucaucuagacaucaagcagggaaaauccagggagauuaaauucauggugacaagu

SEQ ID NO: 138405 - RNA, 64 nt, Human
caucccagcucuggggugugcagagguuugugucuccagggaacccacggcuggagagaaauag

SEQ ID NO: 138406 - RNA, 64 nt, Human
gaauagaauuagagaaaacucugaccugccggguuccagggacugguggagguggauggcaggu

SEQ ID NO: 138407 - RNA, 64 nt, Human
aucggcagcaugucaaccauuugcauggcugggcuccagggaaacuacugacaacgacaggugg

SEQ ID NO: 138408 - RNA, 64 nt, Human
caaggaggguacacaacuagcaccauucuugauguccagggaagaagccaccucaagacauaug

SEQ ID NO: 138409 - RNA, 64 nt, Human
uuacaguuucagaccucagcagcuguaaggccaguccagggaacccuccccugcugcuggaaac

SEQ ID NO: 138410 - RNA, 64 nt, Human
cugagugcuccaggaggacaaggcugacaagcaauccagggacaagauacucaccaggaccagg

SEQ ID NO: 138411 - RNA, 64 nt, Human
agaggaagaccaaaugcugccaggacacggauuguccagggauuacauuccagcaucuuauuag

SEQ ID NO: 138412 - RNA, 64 nt, Human; identical to SEQ ID NO: 138410

SEQ ID NO: 138413 - RNA, 64 nt, Human
ggcuuccccuccuaccuggacucggccagcugccuccagggaccgcccguccauauuuauuaau

SEQ ID NO: 138414 - RNA, 64 nt, Human
cugucuguccuguaaacugugccaacuucaccuguccagggacagcgaagcuggggguggcggg

SEQ ID NO: 138415 - RNA, 64 nt, Human
gcugacuuccaguacccgggcagccagcucugucuccagggaggccuggccuggaggaggaguc

SEQ ID NO: 138416 - RNA, 64 nt, Human
gugacggacccaaggggcaaauagggucccaggguccagggaggggcgccugcugagcacuucc

SEQ ID NO: 138417 - RNA, 64 nt, Human
gaccccucacuuaggcuuuccucugccaccccgguccagggaagaggcucgcucccgcccaugg

SEQ ID NO: 138418 - RNA, 64 nt, Human
aaguccagaguuuucaucuucagccugugaucuguccagggacccuugggaucuggggcuuccu

SEQ ID NO: 138419 - RNA, 64 nt, Human
aagaaaggcggcauccgucugugcccugugccuuuccagggagccaggcgccaugggcuucugg

SEQ ID NO: 138420 - RNA, 64 nt, Human
uuagaucuggacuggaacugccaggaccaccgccuccagggagucgcugggcaccuggagguau

SEQ ID NO: 138421 - RNA, 64 nt, Human
gagcauuuugguuuccuuaaggcccagcaagacuuccagggacaucucuggugaagccagaaug

SEQ ID NO: 138422 - RNA, 64 nt, Human
gggaaacagccuuccuggagcguugucuggagguuccagggacagggcagccucccagagccga

SEQ ID NO: 138423 - RNA, 64 nt, Human
cugauugcuccaggcagacaaggcugacaagcaauccagggacaagauacucaccaggaugagg

SEQ ID NO: 138424 - RNA, 64 nt, Human
gcacaugugucuuuuguugguguguuuguuuuuuuccagggaggucuaauuccgaagcaguauu

SEQ ID NO: 138425 - RNA, 64 nt, Human
ucugccucugccccacauggggcccuaccccacuuccagggagcacagcagccucugacccuag

SEQ ID NO: 138426 - RNA, 64 nt, Human
cuguuuguagggcugccaggcugcagccugcugcuccagggagcaccagcugcagcugauccaa

SEQ ID NO: 138427 - RNA, 64 nt, Human
gcggcagggugucccaggagcccugauccggggguccagggaauggagcucaggucccaggcca

SEQ ID NO: 138428 - RNA, 64 nt, Human
ucagccuuccaguugaguggguaacgacugagucuccagggaauucccagugaccuccccucca

SEQ ID NO: 138429 - RNA, 64 nt, Human
ugaaauguuuggaagguuuauuucucaugcacauuccagggaaaagcagagaguaaauuagaga

SEQ ID NO: 138430 - RNA, 64 nt, Human
ggucccaccagcuccaugggagugaccaccucaguccagggaaaacagcugaagaccaagaugg

SEQ ID NO: 138431 - RNA, 64 nt, Human
uuuggccagacugacuucaaaaaauuaauguguauccagggacauuuuaaaaaccuguacacag

SEQ ID NO: 138432 - RNA, 64 nt, Human
ugcuccagucaccccggccucuugcaagagaaaguccagggacuggcaagaagacccuuugacu

SEQ ID NO: 138433 - RNA, 64 nt, Human
uaugcgcagaguagcugucuguuugacugcuucauccagggagggagaaggcuuuucagcacca

SEQ ID NO: 138434 - RNA, 64 nt, Human
ugugcaugaacugaaauaaaaccauccuacgguauccagggaacagaaagcaggaugcaggaug

SEQ ID NO: 138435 - RNA, 64 nt, Human
ucccaucaccaccgaggccaguccuaguucuugguccagggagaagucuaggcaggauaaauca

SEQ ID NO: 138436 - RNA, 64 nt, Human
gaggagugcuagguggguggccugagcaucuguauccagggacaggacuccaaaggcuuuuggu

SEQ ID NO: 138437 - RNA, 64 nt, Human
uuucuucaaggugacaggucuaaagagagaagaauccagggaacagguagaggacauugcuuuu

SEQ ID NO: 138438 - RNA, 64 nt, Human
ggcuacacaugaggccacuuguuuuagggugagcuccagggauuugccuggauuuugaaaucau

SEQ ID NO: 138439 - RNA, 64 nt, Human
gagauagauugauaaccauccuuuggggcagcauuccagggaugcaaaaugugcuaguccauga

SEQ ID NO: 138440 - RNA, 64 nt, Human
uuaaauuccauuuuaugaaaaggcaucuucaugguccagggaauauguaucuuguaaaauguac

SEQ ID NO: 138441 - RNA, 64 nt, Human
uuguuuuccugucaguuggaccccucaccuggccuccagggaagaaugcagagaaaagcaagga

SEQ ID NO: 138442 - RNA, 64 nt, Human
uuuucacagguacauguggaacagcguucaaccuuccagggaauacgaccccuucucccuguua

SEQ ID NO: 138443 - RNA, 64 nt, Human
aagccaggagaggaucagguuccaaaggggaaugcuaugaaagggcagugagacaagaccucau

SEQ ID NO: 138444 - RNA, 64 nt, Human
ucaauauuucaauauguugaguguguguccaaugcuaugaaauuaaaauauuaaauaacauauu

SEQ ID NO: 138445 - RNA, 64 nt, Human
guugaucugucucuaguuucuuucuguuauugcacuaugaaaaucaguuauauucuuuaaauuu

SEQ ID NO: 138446 - RNA, 64 nt, Human
acuaucuguauacaugugcacaugcggcauuuuacuaugaaauuuaauaugcuggguuuuuuaa

SEQ ID NO: 138447 - RNA, 64 nt, Human
aaagauuucuaugaauucuaaaaaauauuuuuuucuaugaaauuacuagugcccagcuguagaa

SEQ ID NO: 138448 - RNA, 64 nt, Human
auuucuucugagagcaugguuucaugguuuuucucuaugaaaugacucaauauuccaaauguuu

SEQ ID NO: 138449 - RNA, 64 nt, Human
ccccugcugcacacgcuagcauaucuggaaccuacuaugaaaaugaaaggacccuuauagguac

SEQ ID NO: 138450 - RNA, 64 nt, Human
augcuccugaucuuuuuuuucccccuuccuuuggcuaugaaaacccaaagcccggagugauugu

SEQ ID NO: 138451 - RNA, 64 nt, Human
ucagaaagagacaacuugaagaaaccaacaaugacuaugaaacagcugacggcggcuacaugac

SEQ ID NO: 138452 - RNA, 64 nt, Human
guaacucuaguuacacagaaacugugacuaaagucuaugaaacugauuacaacagacuguaaga

SEQ ID NO: 138453 - RNA, 64 nt, Human
gcuagcuaaaguucagauuuuguuagguucaacccuaugaaaaaaacuauuuucauaggucaaa

SEQ ID NO: 138454 - RNA, 64 nt, Human
uaucuaaacauuagaaacaugacauuuaaaaaaacuaugaaauaauacuguauaagcauuccau

SEQ ID NO: 138455 - RNA, 64 nt, Human
cugccuaauugucaaggccuccuuggcucuggagcuaugaaaggccccacuuucaagucacccu

SEQ ID NO: 138456 - RNA, 64 nt, Human
cugacuagcuuugauaaacaaugucagauuuuaacuaugaaaacgacauuaccuugugcauuuu

SEQ ID NO: 138457 - RNA, 64 nt, Human
ccaagggcaggugaccacuggcaucuaugcuuagcuaugaaagugaauaaagcagaauaaaaau

SEQ ID NO: 138458 - RNA, 64 nt, Human
ugacuggguacuuucuacucucauuuuuguuagccuaugaaaaaaaaaacauuuuguuaaccua

SEQ ID NO: 138459 - RNA, 64 nt, Human
gggaagagcuuuaauaauacuuauguuaauaacucuaugaaacauauaagcuaacuauauauca

SEQ ID NO: 138460 - RNA, 64 nt, Human
aggaggugaaaugaaucccaaaugcauuuuuuaacuaugaaaaucauuaugucauuccauaaug

SEQ ID NO: 138461 - RNA, 64 nt, Human
uaagugaaaaauauagacuguuaucuuguuggcccuaugaaauucugcacuuuucauuauauac

SEQ ID NO: 138462 - RNA, 64 nt, Human
auugugggaaagagaauuuguaugggcacuguaucuaugaaauaccucauaacuuacguuuaca

SEQ ID NO: 138463 - RNA, 64 nt, Human
gggauagcaucaaagguugaacuuuuugagcuuucuaugaaaaaccccaggaccuucuuucuuu

SEQ ID NO: 138464 - RNA, 64 nt, Human
ugucucgagcagucuagaagagugcaucuccagccuaugaaacagcugggucuuuggccauaag

SEQ ID NO: 138465 - RNA, 64 nt, Human
ccaguggacuguacucacaaauugacuggacacccuaugaaaguggguagaccucucagcggaa

SEQ ID NO: 138466 - RNA, 63 nt, Human
aucaggaguuaaucaaguaguaauuuagccaggcuaugaaaucauccugugaguuauuuccuc

SEQ ID NO: 138467 - RNA, 64 nt, Human
aagauuauagucauuguauaauuuggcuuggaggcuaugaaaugucuuuuuuucuuuuugguau

SEQ ID NO: 138468 - RNA, 64 nt, Human
ucugacauuuaauuguuuuauaauaauccaaacucuaugaaagcaauuuuaaaaauuauuaagg

SEQ ID NO: 138469 - RNA, 63 nt, Human
uauucuuaauauuuguaauucuaaauaaauugaucuaugaaaauuauuauuuucuauauuuuc

SEQ ID NO: 138470 - RNA, 64 nt, Human
uguacaaaucacuucuaggccucaguuucugcgacuaugaaaauuacuagauugcacuagcuug

SEQ ID NO: 138471 - RNA, 64 nt, Human
ugcaaaacaguguugcagaaaaaaaacucagagacuaugaaauacauaaaccauauaucaaguu

SEQ ID NO: 138472 - RNA, 64 nt, Human
aaaggccuuuggccugugcuacuaaacaagaagccuaugaaaaauuucuucuuuaaacuuguuu

SEQ ID NO: 138473 - RNA, 64 nt, Human
uuagccucuugacgcuggaaguguggauuuauagcuaugaaaccacugcuggcagugggugggc

SEQ ID NO: 138474 - RNA, 64 nt, Human
aaaagauugguggaagggcucaugugguuagcaacuaugaaacagaaauaggacacucaguuac

SEQ ID NO: 138475 - RNA, 64 nt, Human
gcucacauaagcaaacaacauagggacguaucugcuaugaaaauccacaaauuuuucagauagu

SEQ ID NO: 138476 - RNA, 64 nt, Human
guggcagagucuccuuggcaaucaaccaacguugcuaugaaauaugccucacacuguauagcuc

SEQ ID NO: 138477 - RNA, 64 nt, Human
agauaauaguagucuuguucacauuucaugaaaccuaugaaacuauauuuuuguaaaauguauu

SEQ ID NO: 138478 - RNA, 64 nt, Human
ugcugcauguucaggcauauuauaaaacuuuagucuaugaaagaauaauuauaauaauguccag

SEQ ID NO: 138479 - RNA, 64 nt, Human
acuugagucuuguacauacauacuuuuuuaugagcuaugaaauaaaacauuuuaaacugaauuu

SEQ ID NO: 138480 - RNA, 64 nt, Human
uugcacaaauacaagccaagcuagaaggaagcaccuaugaaagcaacaacuuuguuucucaucc

SEQ ID NO: 138481 - RNA, 64 nt, Human
auugcuacacuuacaaguaaugaauuuuaugugacuaugaaacgaauauaagcuuaaaauaagu

SEQ ID NO: 138482 - RNA, 64 nt, Human
uuggaacuaacacgugaugugauauauuccuaaacuaugaaaccuuuuuccuaguagucagcua

SEQ ID NO: 138483 - RNA, 64 nt, Human
agugcauuuaaauguuuguuggcuuguugcaguucuaugaaacagagcuguuaauaaugguuau

SEQ ID NO: 138484 - RNA, 64 nt, Human
ugugacucagcuaaccacaaaugucuccuccaggcuaugaaauuggccgauuucaagaacacau

SEQ ID NO: 138485 - RNA, 64 nt, Human
uuggaugaauuacuagagguaauaacaaaucuuacuaugaaaucaagagguuuaagaacauaca

SEQ ID NO: 138486 - RNA, 64 nt, Human
uuuuuuuaucaugauuaaauaucaaaaaauugcccuaugaaaacuuuaaaucucuaaaacauuu

SEQ ID NO: 138487 - RNA, 64 nt, Human
ggagaugugacugaugcugcaagaaccaucuuuucuaugaaaaugacuauuuuauaauauacca

SEQ ID NO: 138488 - RNA, 64 nt, Human
gaauuaguuuuaaaaugauauuguuauauacauacuaugaaauauguauaacuuuaacuucugu

SEQ ID NO: 138489 - RNA, 64 nt, Human
auaugauuucuugcuuuggggaaaaagaaugaugcuaugaaauuggugggugguguauuugaga

SEQ ID NO: 138490 - RNA, 57 nt, Human
uuuccuuucuuuucagcuaacugccuucuaugaaagcagucauuauucaaggugauc

SEQ ID NO: 138491 - RNA, 64 nt, Human
auguguauaauuaaaaucguuuuuaauccuuugccuaugaaaauauuuuggaaaaaaacuugcu

SEQ ID NO: 138492 - RNA, 64 nt, Human
cgaauugacacgacaacucugaauguguggcccucuaugaaagcuggugccaguuuucaucacu

SEQ ID NO: 138493 - RNA, 64 nt, Human
cguuuauuugagaaacacauaacaucucuccuuucuaugaaaaauuuuuuaaaaggugguuaaa

SEQ ID NO: 138494 - RNA, 64 nt, Human
aaauauugguaauugauguaauaaaaccauagaacuaugaaaauaucaagauuauugcaaaaau

SEQ ID NO: 138495 - RNA, 64 nt, Human
uaguuacaacaugaugugauuguagcuuuuuaaacuaugaaaccccugagagauuguaccuucu

SEQ ID NO: 138496 - RNA, 64 nt, Human
uaacuguacucaugucccaguauguacguucuuucuaugaaagagaaaacacuaaucuuaaauu

SEQ ID NO: 138497 - RNA, 64 nt, Human
uaaaaucuuagucaacuucuguagaaaguuuucucuaugaaaguaaagcuguuugaaaaauuau

SEQ ID NO: 138498 - RNA, 64 nt, Human
uaaaaugaaauggacagaauauucaauuuuccaucuaugaaaauuucacaauaaaaaucauagu

SEQ ID NO: 138499 - RNA, 64 nt, Human
aaaucucaauguaaaauucuuuuuuuucuuauuacuaugaaauggauggaauaaggagggggaa

SEQ ID NO: 138500 - RNA, 64 nt, Human
aauguaugcugugagacaugaaauuaaaacagaccuaugaaauaaauuauuuuaaaaccagaag

SEQ ID NO: 138501 - RNA, 64 nt, Human
acuaagcaucaagaacacauacuagagagaggcccuaugaaagcaggaaauagaggaaggccuu

SEQ ID NO: 138502 - RNA, 64 nt, Human
cuuagcucugugcucucaccagacaaugaaugaacuaugaaagauuuagucaacagaaacuauu

SEQ ID NO: 138503 - RNA, 64 nt, Human
ccugagagaaugcuagucauaacuguacuaguuacuaugaaaauggaaauaauuaucuuagaau

SEQ ID NO: 138504 - RNA, 64 nt, Human
acaguaauaaacaaugacaguuaaaauguaaagacuaugaaaauuacauuggaagggagcuuuc

SEQ ID NO: 138505 - RNA, 64 nt, Human
cagaagugaauuaucccugcuggcuuucuuuucucuaugaaaagcaacugaguacaauuguuau

SEQ ID NO: 138506 - RNA, 64 nt, Human
aaguuacaucaggcaaguaccaggaugaaaagaacuaugaaauaaaugaaggaagcuacaagug

SEQ ID NO: 138507 - RNA, 64 nt, Human
caucauccuucugcuuguuuacaacuaugaucuucuaugaaauggugguaccaaggggcgccca

SEQ ID NO: 138508 - RNA, 64 nt, Human
cccacuccccuuggaaaugcauguaugaacuacccuaugaaauguaagcugcagaauagauaaa

SEQ ID NO: 138509 - RNA, 64 nt, Human
uuuuaaacugauuacguuuacauucuucucuuuucuaugaaaggcagggcaagaacagaagugu

SEQ ID NO: 138510 - RNA, 64 nt, Human
aagacaacaaagaucauucauuugguucuuuauacuaugaaacuugaguaaguauuaccuccuu

SEQ ID NO: 138511 - RNA, 64 nt, Human
uauuccugguuggcuagaacugggugaccaacagcuaugaaacaaauuucagcuguuugaaguu

SEQ ID NO: 138512 - RNA, 64 nt, Human
uaagaacuaugggccagacauuuaaucucuccaucuaugaaauaguccauucucauuuaucuac

SEQ ID NO: 138513 - RNA, 64 nt, Human
gugugugcuccugguguuaggagagaaaaaagcucuaugaaagaauauaggaaguuucuccuuu

SEQ ID NO: 138514 - RNA, 64 nt, Human
ggugauucuaauucuuucaugccuugaaauuaaacuaugaaauuaaaggcagaaaaacuggaaa

SEQ ID NO: 138515 - RNA, 64 nt, Human
uuuuuuccagauuaucuaaaguuggaugcccacacuaugaaagaaauauuuguuuuauuugccu

SEQ ID NO: 138516 - RNA, 64 nt, Human
ccauuugccuuauauuggcaaauguaaguuguuucuaugaaacaaacauauuuaguucacuauu

SEQ ID NO: 138517 - RNA, 64 nt, Human
uggagcacaccugcuaacugcucccucaacauaacuaugaaaucauagcucuguuuucaccaaa

SEQ ID NO: 138518 - RNA, 64 nt, Human
uaacuugaucaacaaugaauucaaaauaguuaaccuaugaaauaacauccucucaaauguuugc

SEQ ID NO: 138519 - RNA, 64 nt, Human
agauacuuugacuugaaguguuuuuaguguaucccuaugaaaaucauuuuugguacaucuaagu

SEQ ID NO: 138520 - RNA, 64 nt, Human
uagacuauaugaaucaauuauuacaucuguuuuacuaugaaaaaaaaauuaauacuacuagcuu

SEQ ID NO: 138521 - RNA, 64 nt, Human
aauuucuauuucugccucugacaaaaagaacuuacuaugaaagaaauaguuguuuuaucaauaa

SEQ ID NO: 138522 - RNA, 64 nt, Human
aaggggguggacuuaucaacacuauaauuguucccuaugaaagauuccacagagauguuuaugg

SEQ ID NO: 138523 - RNA, 64 nt, Human
ucugcugcuuuuagggacaauuaaaacugggaaacuaugaaacauggaacauuuuauccuaccu

SEQ ID NO: 138524 - RNA, 64 nt, Human
uuccucuuaaagagcugcucugagcugugggauucuaugaaaaauucuugccuuuccuuguuuc

SEQ ID NO: 138525 - RNA, 64 nt, Human
cguauaacggcauuguggaagcaauaacuaguuccuaugaaagaaccagagcugggaagauggc

SEQ ID NO: 138526 - RNA, 64 nt, Human
uauaaagguguauuucuuuuuuaugaguuuauggcuaugaaaacagcuauuuuguuacagcugg

SEQ ID NO: 138527 - RNA, 64 nt, Human
uccaagaaaugaugagagagagagaaauuauauacuaugaaaagugcacccccacacucugcua

SEQ ID NO: 138528 - RNA, 64 nt, Human
gaaaccagagguuucuuucuuucucuguaaucugcuaugaaagaaaauaacaaaugaaaauaaa

SEQ ID NO: 138529 - RNA, 64 nt, Human
uugacuggacccucaguucccacacugcuaauuacuaugaaagcugcucuggccucgucuucua

SEQ ID NO: 138530 - RNA, 64 nt, Human
ugucaccugccuccucaucauggaagggggugggcuaugaaagccggucucaaagauaacugca

SEQ ID NO: 138531 - RNA, 64 nt, Human
acauugaacaguuacagaucugggacagucccuucuaugaaagugcugaaauuuaauuaaaauc

SEQ ID NO: 138532 - RNA, 64 nt, Human
uugccaaaaugugauuguugaaguacaaaaggaacuaugaaaaccagaacaaauuuuaacaaaa

SEQ ID NO: 138533 - RNA, 64 nt, Human
ccuggauuuuaaacacuguuggaagaagaguuuucuaugaaaaaauuaaauauagggcacacug

SEQ ID NO: 138534 - RNA, 64 nt, Human
acuuagcacugcccuggugauuacccagagauaucuaugaaaaccaguggcuuccaucaaaccu

SEQ ID NO: 138535 - RNA, 64 nt, Human
uuaucaguuggaaguaaguuaugguacaucuguucuaugaaauacugugaaacaauaagguauc

SEQ ID NO: 138536 - RNA, 64 nt, Human
guccaguugauuguacguagccacaggagcccugcuaugaaaggaauaaaaccuacacacaagg

SEQ ID NO: 138537 - RNA, 64 nt, Human
ggaagcuacaacacagugaagacccaaggaaggccuaugaaaagguccugaugcccaaccuccc

SEQ ID NO: 138538 - RNA, 64 nt, Human
uguuuaaauguuacuuguuuucaaacuuuguuuucuaugaaaaugauauggaaacuucuaaaau

SEQ ID NO: 138539 - RNA, 64 nt, Human
ucccugugcauuugcaccagaugaauguuugaugcuaugaaaagcuuuccauaucaucaaaacu

SEQ ID NO: 138540 - RNA, 64 nt, Human
uuaagagccgucaaucagccugguuuuggggaugcuaugaaagagagaaggaaaaucaugccgc

SEQ ID NO: 138541 - RNA, 64 nt, Human
gaagaaaauuauggcauauauuaaaagcaggcuucuaugaaagacucaaaaagcugccugggag

SEQ ID NO: 138542 - RNA, 64 nt, Human
aggaauacauuuuauucuguccaugaagcauacacuaugaaauucaagugcuuaaaaauacuuc

SEQ ID NO: 138543 - RNA, 64 nt, Human
augaaagucucuggggaucaugggaauugagugucuaugaaaaccauauuccagacaagaauau

SEQ ID NO: 138544 - RNA, 64 nt, Human
uaauguuuuuaagcaaaaaaaaaucauuacagaucuaugaaauagguaacauuugaguaggugu

SEQ ID NO: 138545 - RNA, 64 nt, Human
aggucugugauuugggggauagaaaacaaaguaccuaugaaacgggauaucuggauuuuacuug

SEQ ID NO: 138546 - RNA, 64 nt, Human
uuuuaauuuaacauaaagucuucagaaagccuuucuaugaaagaauuuuaaccuauaauguaaa

SEQ ID NO: 138547 - RNA, 64 nt, Human
aggagacuuccauaaguuuguguauuauguuagucuaugaaaacgugcaaauguauuguagaga

SEQ ID NO: 138548 - RNA, 64 nt, Human
guaguauaaaacaugaggcuuuaaugguacuuugcuaugaaaagaaaacacuguauuccuuaug

SEQ ID NO: 138549 - RNA, 64 nt, Human
uuuaacuuuuaaaauguuguuuaaaagugugaagcuaugaaaagccugauaaugugacuacaga

SEQ ID NO: 138550 - RNA, 64 nt, Human
guguguguauauauauauauauauauauauauuucuaugaaauuguccagauguguucaggaac

SEQ ID NO: 138551 - RNA, 64 nt, Human
uuauuguugaaagucauuugaugaaugguaaauucuaugaaaaguaagugauuugcauguauaa

SEQ ID NO: 138552 - RNA, 64 nt, Human
ucuguagaaguuuugcuuuguugaucugagccuucuaugaaaguuuaaauauguaacgcauuca

SEQ ID NO: 138553 - RNA, 64 nt, Human
cuuauuucuaaguagauagaaagcaauaaaaauacuaugaaaugaaagaacuuguucacagguu

SEQ ID NO: 138554 - RNA, 64 nt, Human
ugcaaaaaugagauguacagauuucgguucccugcuaugaaaagugaugugguagcaauuuuau

SEQ ID NO: 138555 - RNA, 64 nt, Human
aaaagaauauauugccaaauauuaagaagcucagcuaugaaaugaccuccagggaaucagaaag

SEQ ID NO: 138556 - RNA, 64 nt, Human
uuguucuauuuuuacaucuuuaaauaccuaucuucuaugaaagccuaugugcaugugugugugu

SEQ ID NO: 138557 - RNA, 64 nt, Human
uaguuggaauuauucuaugucaaugauuuuuaagcuaugaaaaauaauaauauaaaaccuuaug

SEQ ID NO: 138558 - RNA, 64 nt, Human
uuagcugaauuauucuaugucaaugauuuuuaagcuaugaaaaauacaauggggggaaggauag

SEQ ID NO: 138559 - RNA, 64 nt, Human
uaaccaauucauuaaauguaauucauaaaauguacuaugaaaaaaauuauacgcuaugggauac

SEQ ID NO: 138560 - RNA, 64 nt, Human
aauggggaaauuaucacuuacaaguauuuguuuacuaugaaauuuuaaauacacauuuaugccu

SEQ ID NO: 138561 - RNA, 64 nt, Human
aaaaguuaaggcacucugaaacaaauggaaaguccuaugaaacuguauuguaaagaaaacauua

SEQ ID NO: 138562 - RNA, 64 nt, Human
ucaauuguguuuacauuaauagugguguuuuuaccuaugaaauuauucuggaucuaauaggaca

SEQ ID NO: 138563 - RNA, 64 nt, Human
aauaagcaaauguucuuauaaugcuaccugauuucuaugaaauguguuugacaagccaaaauuc

SEQ ID NO: 138564 - RNA, 64 nt, Human
cccggaaggucaguaagugcaacaugaaaaaaaucuaugaaaagauuauuugaccuaauuauuc

SEQ ID NO: 138565 - RNA, 64 nt, Human
cuucuggcuuuauucaaauaaucuaugcaaauaacuaugaaaaauuuuaucuuuguuuuaucca

SEQ ID NO: 138566 - RNA, 64 nt, Human
ugauaauuuuaaauucucucucuugcaggaaggacuaugaaaagcuagaauugaguguuuaaag

SEQ ID NO: 138567 - RNA, 64 nt, Human
ucugccuguuacaaauaucaaggaagaccugcuacuaugaaauagaugacauuaaucugucuuc

SEQ ID NO: 138568 - RNA, 64 nt, Human
ccaguaaaaaaaaaaaauggcuucagaauuaaaacuaugaaauauuuuacaguuuuucuuguac

SEQ ID NO: 138569 - RNA, 64 nt, Human
agcugacuagggacaaacauguaaaccuauuuuccuaugaaaaaaauuuuaaaugucccacuug

SEQ ID NO: 138570 - RNA, 64 nt, Human
guugccaaaguuuugcugucucuuagagaaagaacuaugaaaucaacugacaagaaacacauuc

SEQ ID NO: 138571 - RNA, 64 nt, Human
uuuaguagggauucacugacuagauuuuacugaacuaugaaaauaaauacacauaauuuuucac

SEQ ID NO: 138572 - RNA, 64 nt, Human
uaagauuaucauuagaaaacaaauacgucaacaccuaugaaaagaagcggggaaaacaacaaca

SEQ ID NO: 138573 - RNA, 64 nt, Human
uuuuacacuaacuaacuuuucccaauaaaguccacuaugaaaccacgacauccaagagcccaaa

SEQ ID NO: 138574 - RNA, 64 nt, Human
cagaauggccuugagaauagagccacaaaaauaacuaugaaaaugccaguaacguuuauuuaaa

SEQ ID NO: 138575 - RNA, 64 nt, Human
auaaaauaacuuaaaaagaacuuugaauaaaauucuaugaaaaaagacacuagaaugcuguucu

SEQ ID NO: 138576 - RNA, 64 nt, Human
uauugaaugugagauaauccguucuagagaauaacuaugaaagcuugcaucaagauagucacuu

SEQ ID NO: 138577 - RNA, 64 nt, Human
cccugucugucuguguuaguagaaaaauaaaauccuaugaaaucugaguacguugaagaaucuc

SEQ ID NO: 138578 - RNA, 64 nt, Human
acggaaacguguucuuacaaaugaaccuucggaucuaugaaagaaaauauaguagggggacuaa

SEQ ID NO: 138579 - RNA, 64 nt, Human
ugacauaaugguaaccagucagaggagggcauaacuaugaaacuggacaccuugguugucaggu

SEQ ID NO: 138580 - RNA, 64 nt, Human
uccuguuuuuauuuuguccuguugugcucaucuucuaugaaaaauaaaugauuauuaggccuug

SEQ ID NO: 138581 - RNA, 64 nt, Human
uuucuguagcaccagagaauccauccaaaguucccuaugaaaaauguguuccauugccauagcu

SEQ ID NO: 138582 - RNA, 64 nt, Human
uugacuggaguuaauguguaaguuauuaacauuucuaugaaaaugcccuuuuggggccuccuga

SEQ ID NO: 138583 - RNA, 64 nt, Human
uuguaaggacuugauaaccuggcuacagcguuuucuaugaaaucuacuuggaucccaugccuga

SEQ ID NO: 138584 - RNA, 64 nt, Human
gugacuguuaauguaaaccugguuauuaaaauaacuaugaaauuaccaacauuguucuccaguc

SEQ ID NO: 138585 - RNA, 64 nt, Human
accauccuccuugcaccuuugugccaagaaaggccuaugaaaaguaaacacugacuuuugaaag

SEQ ID NO: 138586 - RNA, 64 nt, Human
aauuccucgugauaaugugacuuugcaccugcuccuaugaaaagaugaagucuguaucuguauc

SEQ ID NO: 138587 - RNA, 64 nt, Human
agugauccaggguaugaccuagggaaugaacuagcuaugaaauacucaggguuaggaauccuag

SEQ ID NO: 138588 - RNA, 64 nt, Human
uaaccuggauguuauagcccagcaucuagaaauccuaugaaacguauuagcacaauaucuugcc

SEQ ID NO: 138589 - RNA, 64 nt, Human
aaagaagaacaauauuucaugacaccugaaaauucuaugaaauucagauuucaguguccauaaa

SEQ ID NO: 138590 - RNA, 64 nt, Human
uugauauuuuuggauaugcuauagcagcuuucuccuaugaaauaaaacugaugauguuuggaag

SEQ ID NO: 138591 - RNA, 64 nt, Human
agcacuuucccucuuggugccucaguuuccugaccuaugaaacagagaaaauaaaagcacuuau

SEQ ID NO: 138592 - RNA, 64 nt, Human
ggaucucaccagcacuuucccucuguuuccugaccuaugaaacagagaaaauaacaucacuuau

SEQ ID NO: 138593 - RNA, 64 nt, Human
ucuaaacagcauaaggaagacuugcuccccuguccuaugaaagagaauaguuuuggaggggaga

SEQ ID NO: 138594 - RNA, 64 nt, Human
acagauucuuacggaaauuuuuuuaccugacuugcuaugaaaaaacucaucacacaagaagaga

SEQ ID NO: 138595 - RNA, 64 nt, Human
aaacuaagaauacauccaaagaauaguguuguaacuaugaaaaagaauacuuugaaagacaaag

SEQ ID NO: 138596 - RNA, 64 nt, Human
uuuaucucucucucucuuaauuuagacuuucaaccuaugaaaauguaaauaccuuugaaaaaac

SEQ ID NO: 138597 - RNA, 64 nt, Human
guguauuauuuaaaaaugggagaaauaguuuguucuaugaaauaaaccuaguuuagaaauaggg

SEQ ID NO: 138598 - RNA, 64 nt, Human
cugcuuuacagugcugaauuccauauuuuagaagcuaugaaaguccuuuuaugaaaaaguuacu

SEQ ID NO: 138599 - RNA, 64 nt, Human
caagaacugcugccugguacccugugagucauuucuaugaaauuccauauaaagaaugaugaua

SEQ ID NO: 138600 - RNA, 64 nt, Human
gggcucaaggagguaugucggucaguagucaaaacuaugaaaugauacugguuucuccacagga

SEQ ID NO: 138601 - RNA, 64 nt, Human
caguucucuccuucacuuuggcaucaguuguuuucuaugaaaacaguggauugguuggguuuug

SEQ ID NO: 138602 - RNA, 64 nt, Human
cacagaauguaagauggaauuuuaucaaauaaaacuaugaaaaugcaagugggcuccuaugcca

SEQ ID NO: 138603 - RNA, 64 nt, Human
cauuuuguaucagagcaauuuugcuugcagaaagcuaugaaauaaaacacgucccuuaacugca

SEQ ID NO: 138604 - RNA, 64 nt, Human
acauaaaggugcuucaaaauauguagaaacauuacuaugaaaucaguuuuuaaaagauauacuu

SEQ ID NO: 138605 - RNA, 64 nt, Human
ugaaauguaaagaugaggcagagaauaaaguguucuaugaaauucagaacuuuauuucugaaug

SEQ ID NO: 138606 - RNA, 64 nt, Human
cuugaaugugauuauuuuauaaauaaaagaaccacuaugaaacuuucaugugauuuguucuauu

SEQ ID NO: 138607 - RNA, 64 nt, Human
auuucuguuaggucgguauuauuuaugacacuuucuaugaaagaauaaggacauuaaaauguaa

SEQ ID NO: 138608 - RNA, 64 nt, Human
aauucagccucauuguguaguauguuuuuucuuucuaugaaaaacaacagaaagcauuucauuu

SEQ ID NO: 138609 - RNA, 64 nt, Human
cugugaacacugaacuaauuauuccugugucagucuaugaaaucccuguuuugaaauacguaaa

SEQ ID NO: 138610 - RNA, 64 nt, Human
auggagcuccgaaugugcuuaaguggaaagauaucuaugaaauauggugguuuuuuaaaacaca

SEQ ID NO: 138611 - RNA, 64 nt, Human
uauguaaaucacaugacucauguccguaaaugaacuaugaaagauaucgaucaguuuaugauca

SEQ ID NO: 138612 - RNA, 64 nt, Human
uucuucccuguguacuucuacacauagcuaugcacuaugaaaauuaaauggaaugaaugauaug

SEQ ID NO: 138613 - RNA, 64 nt, Human
uuugaaauauugacuuuuuauggcacuaguauuucuaugaaauauuauguuaaaacugggacag

SEQ ID NO: 138614 - RNA, 64 nt, Human
gagagcaagucugaguggacccacauguaaccugcuaugaaaaccauuuguauaguguguuuca

SEQ ID NO: 138615 - RNA, 64 nt, Human
guaaaaugugguaccugaagucauauuugagauucuaugaaauguuuaaaucugaacaucacuc

SEQ ID NO: 138616 - RNA, 64 nt, Human
agaccagccuggccaacauggcaaaaccccgucucuaugaaaaauauaaaaauuagcugggcau

SEQ ID NO: 138617 - RNA, 64 nt, Human
uaugaauuuacuacuuuaaagagcuuacaagacccuaugaaaaaauuaguugagaaagaagaga

SEQ ID NO: 138618 - RNA, 64 nt, Human
aacggaguuaauuuuauugauaauaaauuauacacuaugaaaccgccauugggcuacuguagau

SEQ ID NO: 138619 - RNA, 64 nt, Human
cuaaaaucucacugagugauuucaccuucgccuacuaugaaaugucucaucagaccugacaugu

SEQ ID NO: 138620 - RNA, 64 nt, Human
gugcuuugucauuuucuuugcuaaacaaaagaggcuaugaaagaacuaaauaugaguacauaaa

SEQ ID NO: 138621 - RNA, 64 nt, Human
aauggucuacgaucuugcaguuauccaaaagagccuaugaaaaauggacagcugcuuuugacaa

SEQ ID NO: 138622 - RNA, 64 nt, Human
gggcguggugaguuggaaugauacguccauuucucuaugaaauauuugcuacuagacuguucau

SEQ ID NO: 138623 - RNA, 64 nt, Human
aacauuacucaugaccuugaaauaaaauaggaaccuaugaaacuauugauaugugaauagaugg

SEQ ID NO: 138624 - RNA, 64 nt, Human
uuugugaaaaauauauugauauauauacuaguugcuaugaaaauaucauggaauaauagggauu

SEQ ID NO: 138625 - RNA, 64 nt, Human
augguuucuuggcuuuaaguccacugaauaaaaacuaugaaauugcacucugugucaaccaucc

SEQ ID NO: 138626 - RNA, 64 nt, Human
cagaagaaguagagaaugaaggaaaaggugaaugcuaugaaauugauauuuuuucuggaacuga

SEQ ID NO: 138627 - RNA, 64 nt, Human
uuuccacauugaaacacuuugcagacacaaauaucuaugaaaagaugcuuugucagccacugug

SEQ ID NO: 138628 - RNA, 64 nt, Human
uuaccauccacaaugcaccacggaagaggccguucuaugaaaaacugacacagacuguauuccu

SEQ ID NO: 138629 - RNA, 64 nt, Human
uagaauaaaagugcaacagaagaauuugauuagucuaugaaagguucucuuaaaauucuaucga

SEQ ID NO: 138630 - RNA, 64 nt, Human
aguuccaaaugaaucaguauuuuaaaaaauaaaacuaugaaagcauuaaaauauaggugaauuu

SEQ ID NO: 138631 - RNA, 64 nt, Human
agagagagagagagcgagagagagagacauguuacuaugaaagacuuguauuuuuuauugucuc

SEQ ID NO: 138632 - RNA, 64 nt, Human
uaguuuugcauggcuguuugacugccuuuccgcccuaugaaaaucaagaaaaucuuuuuuaaaa

SEQ ID NO: 138633 - RNA, 64 nt, Human
aauacauggacaaaaaguaaaucauugaccaaagcuaugaaauguuucacaaaguuuuccucuu

SEQ ID NO: 138634 - RNA, 64 nt, Human
acuagugccucauuuuuauauguaaugaugaaaacuaugaaaaaauguauuuucuucuaugugc

SEQ ID NO: 138635 - RNA, 64 nt, Human
auugaguuugauuauggaaauccauucaaagucacuaugaaaauuuuacucauguaguuuggaa

SEQ ID NO: 138636 - RNA, 64 nt, Human
uaucaugguaccuauaauggugauauauuuguuucuaugaaaaauguauugugcuuugauacua

SEQ ID NO: 138637 - RNA, 64 nt, Human
uuuauuuauaggauauacaguaacuauuuggguccuaugaaaauaguccuuaaagagcuuacau

SEQ ID NO: 138638 - RNA, 64 nt, Human
uuacuggaaagcaagacuuaacgaacaauucugacuaugaaaaaugucucuuucaguuuguucu

SEQ ID NO: 138639 - RNA, 64 nt, Human
auaauuucuuuauugaaacuaucaggaaguuuuacuaugaaauuuuacauacaugauggaaagu

SEQ ID NO: 138640 - RNA, 64 nt, Human
agaccagccuagacaacauggugaaaccuugucucuaugaaaaauacaaaauuugcugggagug

SEQ ID NO: 138641 - RNA, 64 nt, Human
ugcacuuuauaaugcaucauauuuucauucacaacuaugaaaucgcugcucaaaaaugauuuua

SEQ ID NO: 138642 - RNA, 64 nt, Human
gaaaauuauucaccauuuugaagcucacccuagacuaugaaaauuauauucacugcagagcaau

SEQ ID NO: 138643 - RNA, 64 nt, Human
auggugcaugucauugagaacuacuuuaaugcagcuaugaaaagggaaaaaagugcccaguucu

SEQ ID NO: 138644 - RNA, 64 nt, Human
ugaaagaccacuaucuggaguuugagaaaacccgcuaugaaauguaugucagcauucucaagga

SEQ ID NO: 138645 - RNA, 64 nt, Human
auuaugaucaaaaacugccuuccccagggugucucuaugaaaagcacaaggggccaaggucagg

SEQ ID NO: 138646 - RNA, 64 nt, Human
guaaacuucucagaugacuuguauuuuuguagugcuaugaaauuuauuuacauacuuauaaaga

SEQ ID NO: 138647 - RNA, 64 nt, Human
uuucgcucugcuucauuacugcuuccuuuaguuucuaugaaacagauugcuuaccuaaaucuuu

SEQ ID NO: 138648 - RNA, 64 nt, Human
cuccugccauucaaugauuaaugcaugauagggccuaugaaaugaacuuacugguuauaguggg

SEQ ID NO: 138649 - RNA, 64 nt, Human
gauucaaacuguaauaagcucaucaauuucauuucuaugaaaaugugcucuguugucacaggau

SEQ ID NO: 138650 - RNA, 64 nt, Human
caacaagaagaaacucagauuuaaccuguuauuucuaugaaaaugggaugaauucuuuguuuau

SEQ ID NO: 138651 - RNA, 64 nt, Human
ucauucaauuuacuuguuuuuaauacaugauucucuaugaaauugaugggcucaaacuagcugu

SEQ ID NO: 138652 - RNA, 64 nt, Human
auuuauccugaguccaacuguucuugcugcgaaccuaugaaaucaaacauguuaugugcuucca

SEQ ID NO: 138653 - RNA, 64 nt, Human
aacaugaaauauauuuucucuuuuugaucuugugcuaugaaacaaucuuccaaagaacuguaua

SEQ ID NO: 138654 - RNA, 64 nt, Human
agaugauuuacuuugagaaaagacauugugucaccuaugaaauuuuauuaggcacagagucaua

SEQ ID NO: 138655 - RNA, 64 nt, Human
auuguauauauauguuuguguauccuaacagcugcuaugaaauuauaaaauuaccuaauaaaaa

SEQ ID NO: 138656 - RNA, 64 nt, Human
agaugucaucacaaacucugccaaauuuguggaacuaugaaauguauuauuuguagacauaaag

SEQ ID NO: 138657 - RNA, 64 nt, Human
uaaaggcaguuccaaugccugaugguucccagaucuaugaaaugaguggaccauuaaccuuaca

SEQ ID NO: 138658 - RNA, 64 nt, Human
ucccuaacacuuucuugaaggucaggggcuuuaucuaugaaaaaguaguaaauaguucuuugua

SEQ ID NO: 138659 - RNA, 64 nt, Human
ugccuucuagagagagaucagaauuaaacuaguacuaugaaauguccuuuugaauguuagguca

SEQ ID NO: 138660 - RNA, 64 nt, Human
acauuuuaauguugaaauuaauauugaauguuagcuaugaaauuuuaguauugaauuuuauaau

SEQ ID NO: 138661 - RNA, 64 nt, Human; identical to SEQ ID NO: 138654

SEQ ID NO: 138662 - RNA, 64 nt, Human
aaauaggacuacuagaguucauugaacacuaaaacuaugaaacaauuacuuuuuauauuaaaaa

SEQ ID NO: 138663 - RNA, 64 nt, Human
ccucccuagcaaaacuauuuaagagccaauuaaacuaugaaauaguuauaaaauuauuuuuaau

SEQ ID NO: 138664 - RNA, 64 nt, Human
guucucguuggggucaccaaagugugcccggcugcuaugaaaaacguugggaaucuugguuuca

SEQ ID NO: 138665 - RNA, 64 nt, Human
agugaucuuccuaaaacuucacuuaaccccucagcuaugaaaaggcuuccaggaguuuccauga

SEQ ID NO: 138666 - RNA, 64 nt, Human
uuuugugcuggguucuaccuuaacccagaagacacuaugaaaaacaagacagacuccacucaaa

SEQ ID NO: 138667 - RNA, 64 nt, Human
gaguagggggcauuccacagggacaacgguuuagcuaugaaauuuggggcccaaaauuucacac

SEQ ID NO: 138668 - RNA, 64 nt, Human
aguuaaaugauccauuaaucugcuaauugguugccuaugaaaucacauugucuguuauuaaagc

SEQ ID NO: 138669 - RNA, 63 nt, Human
ggaaaaccauacuguucugauaauaaaaugcuuucuaugaaauacguugcuuuucuaccgagu

SEQ ID NO: 138670 - RNA, 64 nt, Human
aaauuaauuaaaaaguuaaaucuaagaccucaaacuaugaaacagcuaaaagaaaacaucgggg

SEQ ID NO: 138671 - RNA, 64 nt, Human
ccaaaugcagugaacuccuuuuauauaauagaugcuaugaaaaccuuuuaugaccuucaucaac

SEQ ID NO: 138672 - RNA, 64 nt, Human
cacucaguuuggugcuuuaaauuaagucuguuuacuaugaaacaagagucauuuuuagaggauu

SEQ ID NO: 138673 - RNA, 64 nt, Human
gccaagaaagaaaccuguuuguuuuucuuuugaacuaugaaaagacccuguuugugaauauauu

SEQ ID NO: 138674 - RNA, 64 nt, Human
auccauuuaauggucuuauaacuaaauagaaugacuaugaaauuaaauaaugcaaacuuaaagc

SEQ ID NO: 138675 - RNA, 64 nt, Human
accccaggggguccauaguuggacuucagagggucuaugaaaccccuaaaacugucaguauuua

SEQ ID NO: 138676 - RNA, 64 nt, Human
aucuuaaaaugacaaucuguuuuuaaauuggauucuaugaaaaugcauaaugcuuauggugaau

SEQ ID NO: 138677 - RNA, 64 nt, Human
ucauaaaguaagccuuucuggugaaggaagguugcuaugaaacuuuuuuucuugguggaaaugg

SEQ ID NO: 138678 - RNA, 64 nt, Human
ugcaauagaauaaugagaauugaauuuuuaaguucuaugaaacagccagcauugacauuuuauu

SEQ ID NO: 138679 - RNA, 64 nt, Human
ugccgagcuaacuguugccacucuccuccccagacuaugaaaucccuggagaauuuuuggugac

SEQ ID NO: 138680 - RNA, 64 nt, Human
guuuuacagguacaaguuuucuagcucagacaaacuaugaaaaacuguagacuauucucaaggu

SEQ ID NO: 138681 - RNA, 64 nt, Human
uuuuaaagcaacuaacuuauugcuuuauguuuaucuaugaaaaccauagauaaaaucugaugca

SEQ ID NO: 138682 - RNA, 64 nt, Human
uguguauagagcagaauguuucccuucaugugcacuaugaaaacgagcugacagcacacuccca

SEQ ID NO: 138683 - RNA, 64 nt, Human
guuaguccucaaaaggaauaucuugcaguguuuucuaugaaaugcuugggcacaaacacuuauu

SEQ ID NO: 138684 - RNA, 64 nt, Human
acaggcauaaaaucucuucuccuggcaaaagcugcuaugaaaagccucagcuugggaagauaga

SEQ ID NO: 138685 - RNA, 64 nt, Human
cgcacaaugggaaucucuaaugugaaaauguauucuaugaaaauaauuuuuuuaaauaaaaugu

SEQ ID NO: 138686 - RNA, 64 nt, Human
aggcaaguucuguguuagucaugcacacacauaccuaugaaaccuuggaguuuacaaagaauug

SEQ ID NO: 138687 - RNA, 64 nt, Human
agagaguccuugugaggauuaagugagacagugccuaugaaacaaacacuaagugcagugucuc

SEQ ID NO: 138688 - RNA, 64 nt, Human
guguuguguaggcaaagcacuuguuaguggcuuccuaugaaauguuuuagagaucucuucacca

SEQ ID NO: 138689 - RNA, 64 nt, Human
uggccacccuguccuccccccaccacccucaggccuaugaaacacacaggguucuagauuugaa

SEQ ID NO: 138690 - RNA, 64 nt, Human
agaaccauuuuaacuccaucugauacuccauugccuaugaaauguaaaaugugaacucccugug

SEQ ID NO: 138691 - RNA, 64 nt, Human
aaguaaucauaacucuuuaccaguagugguaaaccuaugaaaaauccuugcuuuuaaguguuag

SEQ ID NO: 138692 - RNA, 64 nt, Human
uguggguagguacuuaaauggccaaaaacuuuaacuaugaaauguuacuguguaguauauugaa

SEQ ID NO: 138693 - RNA, 64 nt, Human
caauuugcagaugcuuauguguuaauaccuuuuucuaugaaaaaagacccagcgccgugugcaa

SEQ ID NO: 138694 - RNA, 64 nt, Human
acuaaucucacuauuuguauugagcccaaaauaacuaugaaaggagacaaaaauuugugacaaa

SEQ ID NO: 138695 - RNA, 64 nt, Human
uuccaagauacauuuuuguuggcccauuugauaucuaugaaaucuaaagauuuuuuuuccuguc

SEQ ID NO: 138696 - RNA, 64 nt, Human
gccccuuccccaccccuuaccagauguuaagcagcuaugaaacauucucuguacuaguucuggu

SEQ ID NO: 138697 - RNA, 64 nt, Human
guagauuauuguuaauuguauucacccuaauaaucuaugaaacacuaggucuuacuucuucuau

SEQ ID NO: 138698 - RNA, 64 nt, Human
aguguaagaagauauuguacaguauauuuuaaaucuaugaaauucauaguucugaugcuuuugg

SEQ ID NO: 138699 - RNA, 64 nt, Human
cugaauacauguaaaauuuguacaaaaauaucuucuaugaaaaugauuuguaaucuguagacuu

SEQ ID NO: 138700 - RNA, 64 nt, Human
uuguacauaagaaaaugcucuuaggaaugaaguucuaugaaaguacuaaauaugggacagugca

SEQ ID NO: 138701 - RNA, 64 nt, Human
acuucuuuacaaagcccuaaaggaaaguuugcaucuaugaaaagccaauaggcugagacaucca

SEQ ID NO: 138702 - RNA, 64 nt, Human
guuggcuuggaggacaaauaagaaaugaaacauccuaugaaauacuuuauagcacauggcagau

SEQ ID NO: 138703 - RNA, 64 nt, Human
gcuacaguuucaguucugcuuuuggggaauugugcuaugaaagcagcugccaaaauaagcucau

SEQ ID NO: 138704 - RNA, 64 nt, Human
ugaaaacuuagcuagggcuuaaauaaacauguugcuaugaaauuauuuuuacuguauuguucuu

SEQ ID NO: 138705 - RNA, 64 nt, Human
ggaccagccugggcaacauggugaaagcucaucucuaugaaaaaauuugaauauacauauauau

SEQ ID NO: 138706 - RNA, 64 nt, Human
uccaucugaugccaguguugaguaaacucaacuacuaugaaauuucaccuaauguuuucaguuu

SEQ ID NO: 138707 - RNA, 64 nt, Human
ucuggaauauuuuuauguagcucuuggaguacagcuaugaaaauuaacaacuguuaaaggaaau

SEQ ID NO: 138708 - RNA, 64 nt, Human
gcugucuaaaacuguugugcuagccaaaguaaugcuaugaaaucauuugcagaauuaacccgug

SEQ ID NO: 138709 - RNA, 64 nt, Human
uauuuauuucaguugucacugcugcucccuccugcuaugaaacgacacugccagugccagcagu

SEQ ID NO: 138710 - RNA, 64 nt, Human
uauaagaauauauuuaguuuacaguauauggauucuaugaaaaaauguccacaacacaguaauu

SEQ ID NO: 138711 - RNA, 64 nt, Human
auacuuuuucuuuccagaaauaauuucauaccgccuaugaaauaucagauaaauuaccuuagcu

SEQ ID NO: 138712 - RNA, 64 nt, Human
cauguaaaauauuuaggauuugaccacacaauggcuaugaaaaugcaaguaguuuccucgcgug

SEQ ID NO: 138713 - RNA, 64 nt, Human
cuccuguuggcuugauggaacaggugcauucacacuaugaaacagaaagaucuguccaaggaca

SEQ ID NO: 138714 - RNA, 64 nt, Human
guuguuguaaaauugaaaucaggcauuuaacauacuaugaaaacaccaggagucaaugauuaau

SEQ ID NO: 138715 - RNA, 64 nt, Human
augagcguuuagugagccugcuggcugcagagcacuaugaaaucaugguacguaguccccggca

SEQ ID NO: 138716 - RNA, 64 nt, Human
gauuaggaugugggccccacuuuagaggcacagacuaugaaaagcugaguuagugcgcccggga

SEQ ID NO: 138717 - RNA, 64 nt, Human
uuaaauuuuuuguugacauuagucucagugaagacuaugaaaaugcuggcuauagaugucuuuu

SEQ ID NO: 138718 - RNA, 64 nt, Human
cuuggaacagaacauacucaucuucauguaggaccuaugaaaauugucuauuuuuaucuauaua

SEQ ID NO: 138719 - RNA, 64 nt, Human
agaaggauaccaaauaccauguacauaauucuugcuaugaaaaguuuccccauuauuuugguuu

SEQ ID NO: 138720 - RNA, 64 nt, Human
uagcuuuauuuuacaagaaggcauaguuagauuucuaugaaauauuuauucuguacaguuuuau

SEQ ID NO: 138721 - RNA, 64 nt, Human
auuuuauagauccacgcaauagagagcuuccuuccuaugaaacaaaaaccuugagaucucuuuu

SEQ ID NO: 138722 - RNA, 64 nt, Human
auauugaauaguucuuugacagaauuuguuuaaacuaugaaacuacacacuuaaaaaucuaaga

SEQ ID NO: 138723 - RNA, 64 nt, Human
uuacaguguauauaaugguuguguuuucauggggcuaugaaagugcacguuaaaccugagcgcc

SEQ ID NO: 138724 - RNA, 64 nt, Human
agauugugauggugauaauuugaauaccaucuuucuaugaaaagcuguguauauuaauuuuaau

SEQ ID NO: 138725 - RNA, 64 nt, Human
uaaaacuaguuuuuaagaagaaauuuuuuuuggccuaugaaauuguuaaaccuggaacaugaca

SEQ ID NO: 138726 - RNA, 64 nt, Human
gagaauauuauuuagacuaauccagauuugcuuucuaugaaaaucuaaugucuggauuaucuuc

SEQ ID NO: 138727 - RNA, 64 nt, Human
cggugagaucucacagaugucagaacugcuggaacuaugaaaugggguauauaaccacgacucu

SEQ ID NO: 138728 - RNA, 64 nt, Human
gguuuuaacauuggguguuuuuguuuuguuuuuacuaugaaaagacagcuuaaggaagagcuaa

SEQ ID NO: 138729 - RNA, 64 nt, Human
gauuguuuuuauuuuaaacuugugauaggcauaucuaugaaaccuuuguaaauuuaguuuauug

SEQ ID NO: 138730 - RNA, 64 nt, Human
uggaguacauguauuuucuuuguaaaguagcuuccuaugaaaauguggacuuuuuugaagguuu

SEQ ID NO: 138731 - RNA, 64 nt, Human
aguuauaaauaccaugucaaauugauuauacaggcuaugaaaaccauuuuaaaggaaagaaaau

SEQ ID NO: 138732 - RNA, 64 nt, Human
cuuauuuuaaagacuuguucagugacuguaaacucuaugaaaccagaaaccgaaucugccucuu

SEQ ID NO: 138733 - RNA, 64 nt, Human
gaccaagagagugggucuccagugagagaaaugccuaugaaagaggguuucccuuuuugcucuu

SEQ ID NO: 138734 - RNA, 64 nt, Human
ucuucauacuucuauuuugagguaacuguuguaacuaugaaaugcuuaucugaaaguagugcuu

SEQ ID NO: 138735 - RNA, 64 nt, Human
uggccgagaacugcacuugccucaguguucucaucuaugaaauaaggacccucaugcccacacu

SEQ ID NO: 138736 - RNA, 64 nt, Human
auuaaaaugugaaugucaacaauaaaaagcaagacuaugaaaggcucagauuucuugcaguuua

SEQ ID NO: 138737 - RNA, 64 nt, Human
cacuuccugaaagccagggucgguucaugaaaagcuaugaaacagcaugcuaaaugugaaaugu

SEQ ID NO: 138738 - RNA, 64 nt, Human
ccacacauucucucucaauuucagcuucggaacgcuaugaaaauaauacaugauuaaaguuuca

SEQ ID NO: 138739 - RNA, 64 nt, Human
uaaagcagguaugcagguaugugggugaaagugacuaugaaaagacuuaaugaauucugggauu

SEQ ID NO: 138740 - RNA, 64 nt, Human
uucacaggcagugcaugugaagcaugcuuugcugcuaugaaaaugagcaucagagaguguacau

SEQ ID NO: 138741 - RNA, 64 nt, Human
uuaacaaaucuaaucucuuauucuaauaaauauacuaugaaauaaaaaaaaaaggaugaaagcu

SEQ ID NO: 138742 - RNA, 64 nt, Human
acaauaggcaagcguuauguuuuugguaaguuaacuaugaaagcuuucuuauuuuuauuauuaa

SEQ ID NO: 138743 - RNA, 64 nt, Human
aaggccuuaacuuauuuuaagaggccgagggagucuaugaaaaucuccccuuuuuuacuuuuuu

SEQ ID NO: 138744 - RNA, 64 nt, Human
ccaaaagccgaaugcacuaaugacaguuuuaagucuaugaaaaugcuuuauuuuuucauuggug

SEQ ID NO: 138745 - RNA, 64 nt, Human
augacuucuuucaccuccaaaauucccuuaguuucuaugaaaauauuggggguaggggggugga

SEQ ID NO: 138746 - RNA, 64 nt, Human
gaaaaaccauuauuguacagagguauuaaugagacuaugaaacggcaauacuuuuuuaaaucac

SEQ ID NO: 138747 - RNA, 64 nt, Human
acccugaccgugaccguuugcuauauuccuuuuucuaugaaauaaugugaaugauaauaaaaca

SEQ ID NO: 138748 - RNA, 64 nt, Human
guacaacccugacccguuugcuacaucuuuuuuucuaugaaauaugugaauggcaauaaauuca

SEQ ID NO: 138749 - RNA, 64 nt, Human
agaccagccugcccaacguggugaaaccccaucucuaugaaaaauacaaaaaucagacgggcac

SEQ ID NO: 138750 - RNA, 64 nt, Human
ugccuaaagugcugcagccaaagacagagcggaacuaugaaaagugggcuuggagauggcagga

SEQ ID NO: 138751 - RNA, 64 nt, Human
uguuaaauggccaagaggugaggcuuacuauucacuaugaaaauggguucaccaucucaaggga

SEQ ID NO: 138752 - RNA, 64 nt, Human
ucacucagcccgcaguuuaugugugugcuuuuuucuaugaaaaaugauguauuuugcuacuucc

SEQ ID NO: 138753 - RNA, 64 nt, Human
auuagugcucucucugccuggaucccggcagaagcuaugaaagggaauaaagagaaaagaagua

SEQ ID NO: 138754 - RNA, 64 nt, Human
uguauauauuuuucuaaaaaccaaauaaagcuaccuaugaaaaugaacagauggaucugugucu

SEQ ID NO: 138755 - RNA, 64 nt, Human
ggccgagcuccuggggagcuccugggacccuuggcuaugaaaaugagcccuggcucccaccugu

SEQ ID NO: 138756 - RNA, 64 nt, Human
gacagaaaaucugacuacuaggaagacuucuaggcuaugaaacugacuucuaggcuaugaaacu

SEQ ID NO: 138757 - RNA, 64 nt, Human
ggaagacuucuaggcuaugaaacugacuucuaggcuaugaaacuuacaggguaugggugggcac

SEQ ID NO: 138758 - RNA, 64 nt, Human
ugugugagggaagcugcuuggguggguguuagggcuaugaaaucuuggauuuggggcugagggg

SEQ ID NO: 138759 - RNA, 64 nt, Human
cgucacacagcugugauaagaguagauuauuuuacuaugaaauaauucugaauagaugaaagca

SEQ ID NO: 138760 - RNA, 64 nt, Human
aaaguacaagacgaccucuagaugucuuuucuuucuaugaaaggagcugcuauguacacaugug

SEQ ID NO: 138761 - RNA, 64 nt, Human
agagaaagggaaggggcucuggggacuucuccuucuaugaaagccuccucgagccaggugcucc

SEQ ID NO: 138762 - RNA, 64 nt, Human
auaggaaagugaagcucaaggguaaccagugaggcuaugaaauugccagugaauuaagaccagg

SEQ ID NO: 138763 - RNA, 64 nt, Human
gugucaugaauuauucugguuauuacuaaaguuucuaugaaacacuuaaguagauuuuaagaau

SEQ ID NO: 138764 - RNA, 64 nt, Human
uggaagcccuuguuuacagaagagagggguaaaccuaugaaaacaggggaagccuuauuaggcu

SEQ ID NO: 138765 - RNA, 64 nt, Human
uuccuguaucccaccguccugcaaauugcacccccuaugaaagaggaauaauauaccaaggucu

SEQ ID NO: 138766 - RNA, 64 nt, Human
aaguagguaucuuucaggucgugauaaugagcuccuaugaaaggaugcaauauaaugacccgcu

SEQ ID NO: 138767 - RNA, 64 nt, Human
agcauccaggagcccuugagaaguuuaucuaugacuaugaaacuggcaacgucaccccagaauu

SEQ ID NO: 138768 - RNA, 64 nt, Human
uucugaaauuguaaaugucuauuuuaauauucaccuaugaaagaaucugugaauauauguaaau

SEQ ID NO: 138769 - RNA, 64 nt, Human
augaagaaucuuuaccaagauuuucaggguguaccuaugaaauugcuuuaaaugcacugcuggu

SEQ ID NO: 138770 - RNA, 64 nt, Human
aaaggaaucuuccuagauaugauaaauauaacaucuaugaaaagcccacaccuaacauuauacu

SEQ ID NO: 138771 - RNA, 64 nt, Human
auagaaaaguacauuccaguuugaucccacucaacuaugaaaacaggacuuuucaacuguauuu

SEQ ID NO: 138772 - RNA, 64 nt, Human
aaagagauucuguuauuagcaccaugaacucguacuaugaaauuuuuaagccuuuuauuuuucu

SEQ ID NO: 138773 - RNA, 64 nt, Human
gagaauguguuugauaucacaguguuuguaaauucuaugaaaaaugcauuuuccaaacaacuua

SEQ ID NO: 138774 - RNA, 64 nt, Human
uggcugagugaagauaaucauagguugugugagccuaugaaaaaguguauacgucuaagauuuc

SEQ ID NO: 138775 - RNA, 64 nt, Human
auucuuuuuuauuaggcauuauuuaugaccuuuucuaugaaaagauaaggacauuaaaauguaa

SEQ ID NO: 138776 - RNA, 64 nt, Human
aaguuagucauauguuauuuuauuaauuguacuucuaugaaauaauaugcagucuauuuuuaaa

SEQ ID NO: 138777 - RNA, 64 nt, Human
cucugaaagaaaaaugacguaaccacagcguguacuaugaaagcuguuauuuuaauaaagaacg

SEQ ID NO: 138778 - RNA, 64 nt, Human
uacagugaucauuauuuucauaaaagcuguaaagcuaugaaaaaugaauaaaauuacuaaaaau

SEQ ID NO: 138779 - RNA, 64 nt, Human
guguaaaaugugcuguuucagcauguguguacaccuaugaaaccaccacagucaagauauccaa

SEQ ID NO: 138780 - RNA, 64 nt, Human
acgauggagugugggggucuggagggggcuucgucuaugaaaaguugccaagugugacuccccu

SEQ ID NO: 138781 - RNA, 64 nt, Human
auuuaaaaacauguuuacaaguuacaaccaacuucuaugaaaaguugaaaagacaaaaaaaaaa

SEQ ID NO: 138782 - RNA, 64 nt, Human
uuuuuuauuaggugagcauuauuuauaaacuuugcuaugaaaaagacauuaaaauaugagaugu

SEQ ID NO: 138783 - RNA, 64 nt, Human
aaaaaauaaaagaucguaugauaugagauacauacuaugaaaugaagauagacacauuuggauu

SEQ ID NO: 138784 - RNA, 64 nt, Human
aguuuacuugauuguggcugcauaauuugguaaccuaugaaagaugcuagagcaccaauguaua

SEQ ID NO: 138785 - RNA, 64 nt, Human
aagauguuaacgcugaguuauuaggacuggaaggcuaugaaaagaacuugaaauugucggaaua

SEQ ID NO: 138786 - RNA, 64 nt, Human
auugcuuuuucuucaaggagauuuauggaaaagacuaugaaaaggacucuugaauacaaguucc

SEQ ID NO: 138787 - RNA, 64 nt, Human
aaaagugugcucaaaaaugaaacccaugcucuuacuaugaaagaacguuaguacccagguuuuc

SEQ ID NO: 138788 - RNA, 64 nt, Human
auacaauguuaaacuugauucuuaugacauauuccuaugaaaauaauaaauacuggcacuuuuc

SEQ ID NO: 138789 - RNA, 64 nt, Human
cugauuauggacauguauuuccuccauuuuccugcuaugaaauauaucaccaccagcuugauuc

SEQ ID NO: 138790 - RNA, 64 nt, Human
aaguuccuucuccucuuagggccuugugccaagccuaugaaauuggagguggcuuuccugcucu

SEQ ID NO: 138791 - RNA, 64 nt, Human
uuaaauuauccaguguuucuuuagccuuggugaacuaugaaauacgaaggccuuaauuuuguac

SEQ ID NO: 138792 - RNA, 64 nt, Human
agcaaacuucacaauaauggacguagacuugcugcuaugaaaacauauuuuuuuuauuuaugaa

SEQ ID NO: 138793 - RNA, 64 nt, Human
uggacaaugggguuggggaauaggguugucuuuccuaugaaaaugccaucuguagaccuuguga

SEQ ID NO: 138794 - RNA, 64 nt, Human
uugugggugauguuugaccuucagagccagccggcuaugaaagggagcgagccccucggcucug

SEQ ID NO: 138795 - RNA, 64 nt, Human
cugccaguggggaaggaggccaagcagugccugccuaugaaauuucaacuuuuccuuucauacg

SEQ ID NO: 138796 - RNA, 64 nt, Human
aaggcuguacauaguccuuuuaucuccuuguggccuaugaaacugguuuauaauaaacucuuaa

SEQ ID NO: 138797 - RNA, 64 nt, Human
uuguuuaaagaauaauggcuuguucacgugugugcuaugaaaaaugaugucccauguucacaua

SEQ ID NO: 138798 - RNA, 64 nt, Human
agaaauaagaugguauuaggcaaaucuuacuauacuaugaaaagcauuaccuugccuauuuuua

SEQ ID NO: 138799 - RNA, 64 nt, Human
ggcugucaaaugugugccacccuuuauaauacagcuaugaaaaguuacuucuccauuaauuucu

SEQ ID NO: 138800 - RNA, 64 nt, Human
aaaaaaaaaaaugcauuuauauuacaguuuuccucuaugaaaguccuuacuuauaugauacaag

SEQ ID NO: 138801 - RNA, 64 nt, Human
uaauuuguuuaauaaauguauuauucauugugaacuaugaaaauauucaacagcaauucaaagg

SEQ ID NO: 138802 - RNA, 64 nt, Human
cuaauuuuacuucuaagucauucauaaaccuugucuaugaaaugacuucuuaaauauuuaguug

SEQ ID NO: 138803 - RNA, 64 nt, Human
ugugugugugugugugugugagcaccugacaaaucuaugaaaccgagugaaaggagaaauguua

SEQ ID NO: 138804 - RNA, 64 nt, Human
uuugacacugcagguauuccauuuucaugguuuacuaugaaaagucauuuuucauauuauguaa

SEQ ID NO: 138805 - RNA, 64 nt, Human
agucugucuaccuuuagccaggcacaggacagcccuaugaaaaaauacccaauauauauuuuuu

SEQ ID NO: 138806 - RNA, 64 nt, Human
uauuuucuuaguagugcagaccuuuaccccuagucuaugaaaaaacaaaccaaaauaugcucuu

SEQ ID NO: 138807 - RNA, 64 nt, Human
ugucuuacaauucagggaauauauuuauauuuuucuaugaaaaguuaugaaugugacuaaauca

SEQ ID NO: 138808 - RNA, 64 nt, Human
aaucuacaaaaagcagcaaugggaccuucaaguccuaugaaacgacgcuuaaacauagccuuua

SEQ ID NO: 138809 - RNA, 64 nt, Human
uaagacguccacuagaaauagcuuguccugucaacuaugaaauauggugacuagauuuuaauuc

SEQ ID NO: 138810 - RNA, 64 nt, Human
uggggaccacacugcucugcuccaccagaccacacuaugaaauaggaauaagugcuccuguugc

SEQ ID NO: 138811 - RNA, 64 nt, Human
uaauccacaguuauucauuguggaguuguugagacuaugaaagacucauugucuuuguauucag

SEQ ID NO: 138812 - RNA, 64 nt, Human
acgacaguccggguaacauaaugagaccuguccucuaugaaaaaacuuuuuuaaaaauuuagcu

SEQ ID NO: 138813 - RNA, 64 nt, Human
uguagcacuuuggcagugcacuaaaauuuugccacuaugaaauguuucuuuauugugugugcgu

SEQ ID NO: 138814 - RNA, 64 nt, Human
ccuuccaguauuaaacaaaaagaauuaaacauaacuaugaaaaaacuuugcuaauaucuguguu

SEQ ID NO: 138815 - RNA, 64 nt, Human
uucuacccucuccuuaaacaucagaaaacacccucuaugaaaucaaauguacuguaccuggguu

SEQ ID NO: 138816 - RNA, 64 nt, Human
uccaagcgaacagcaaccuccugcuacccucccucuaugaaaauagccaugcagacaagucucu

SEQ ID NO: 138817 - RNA, 64 nt, Human
agcaaggaagaaaaaacaaacucugcucagacgccuaugaaacaccugaaugaacuuugaugaa

SEQ ID NO: 138818 - RNA, 64 nt, Human
cagcaaccccacugaugcagacauccagagaguccuaugaaaagacaaggccauuaugcacagg

SEQ ID NO: 138819 - RNA, 64 nt, Human
auauuguauuucuuuugauguuucaaaagguugccuaugaaaaacugauuuguuaaaacaugcu

SEQ ID NO: 138820 - RNA, 64 nt, Human
acauaaaacacagagcuuagacacucuuccccuccuaugaaauaauugguuguuggcaccaucu

SEQ ID NO: 138821 - RNA, 64 nt, Human
gaagucuuuuugucauguagcuauuaaucuguggcuaugaaaugaucagaaaugcuaagugaga

SEQ ID NO: 138822 - RNA, 64 nt, Human
cagcucaguuuaaccgaaugacaguugaguaugucuaugaaaggaugacaggccuccgcuggaa

SEQ ID NO: 138823 - RNA, 64 nt, Human
uauuggagcgcagauaaauauaaauuguggacugcuaugaaaacagguuguacuucuccauaug

SEQ ID NO: 138824 - RNA, 64 nt, Human
cucgggcucuuggaauaccuaauuuuaauaauaucuaugaaaucaagggaaacuuuccauuuac

SEQ ID NO: 138825 - RNA, 64 nt, Human
gguuaaggaauguagacaauaucccguuucaaagcuaugaaaugugcuauuuauugaaagggga

SEQ ID NO: 138826 - RNA, 64 nt, Human
augguacucuucuaagacaaaaucagauugauaacuaugaaaguaacauuuuugacccauuucc

SEQ ID NO: 138827 - RNA, 64 nt, Human
gagggcauccccugagccgccgcggcccggcccuccgggacaccugcuucacccggcggcgccu

SEQ ID NO: 138828 - RNA, 64 nt, Human
gucaaggggccugcuggguuaggcaugcccgaccccgggacaggacuaacccaagggggaaagc

SEQ ID NO: 138829 - RNA, 64 nt, Human
ccaggaccaagaagugaccguggcuccagccaccccgggacauugcuaagaugggagggcuguu

SEQ ID NO: 138830 - RNA, 64 nt, Human
gucagcagcaggaggcccaucccuuacucaguugccgggacauccccagucucgggggaagaag

SEQ ID NO: 138831 - RNA, 64 nt, Human
ggagacgcccaugccccucaggggaaaguggagaccgggacaccagaggccgcgguguuuggau

SEQ ID NO: 138832 - RNA, 64 nt, Human
guacagggcagcaacccagagcccaugggcccucccgggacaucuggaugcugggcauagauuu

SEQ ID NO: 138833 - RNA, 64 nt, Human
ggucaggcuggcuucugauguucaguccccugggccgggacagauuuuuuuuaacgucuugaaa

SEQ ID NO: 138834 - RNA, 64 nt, Human
agcaugaugcagcgugaggacagcugagcagggaccgggacagcccucaccgcaugcgugugga

SEQ ID NO: 138835 - RNA, 64 nt, Human
accacagcugcgcacacagcugcuugcucaggggccgggacagcacugggugcucaggcuggcc

SEQ ID NO: 138836 - RNA, 64 nt, Human
cccaaccccggccugugggcagccgcgccagcugccgggacacugcugccagaccugcccccag

SEQ ID NO: 138837 - RNA, 64 nt, Human
cagaugcccucuggcgccuucgagauuugaugcuccgggacacccucaacauucgccaagcaua

SEQ ID NO: 138838 - RNA, 64 nt, Human
cccccagcccugccccaggccacagcaggacaggccgggacaggccucacccaaggccaaggcu

SEQ ID NO: 138839 - RNA, 64 nt, Human
uagaauacauuauuagaaacuguuaaggucuuucccgggacauuuuuuucugccauuuucuuuu

SEQ ID NO: 138840 - RNA, 64 nt, Human
gcucggggcugggcugccuggcugcuggguggccccgggacaguggcuuuuccucucugaaccu

SEQ ID NO: 138841 - RNA, 64 nt, Human
ccucuccucccaggaaccucauucaaauauuuacccgggacacacacccccccccacacacaca

SEQ ID NO: 138842 - RNA, 64 nt, Human
cgcuccagcaagcucgaccaugccaagagacuggccgggacaagauaaacggagcugguggcgg

SEQ ID NO: 138843 - RNA, 64 nt, Human
aaggagacaucugucccgucuuugagugacaagcccgggacaacagccagugggcaucacggcu

SEQ ID NO: 138844 - RNA, 64 nt, Human
ggcuaaguguggccccaccacccucucugcccucccgggacauugauugguccugucuugggca

SEQ ID NO: 138845 - RNA, 64 nt, Human
ccuaaccuuccaucauccucagcuagauguaugcccgggacagggccucuguucuccagcugaa

SEQ ID NO: 138846 - RNA, 64 nt, Human
cuuaaaccagacagcaggguucagagguggcacaccgggacaaagcugaggcccugcaccucaa

SEQ ID NO: 138847 - RNA, 64 nt, Human
gacagagugaaacugucucaaaaaagagagacuuccgggacagucauuaucagauaggccccaa

SEQ ID NO: 138848 - RNA, 64 nt, Human
augggagagcugucccuccuucuccaccugcccaccgggacacucccccugcucucuagaaagg

SEQ ID NO: 138849 - RNA, 64 nt, Human
cggagagaagccucccgacccugugcccuggcucccgggacacauagaaaccuguaggaaccca

SEQ ID NO: 138850 - RNA, 64 nt, Human
agaaucccgaccgccgcgccggacgcgccgucucccgggacaagcgcaggcugcgauccgaggg

SEQ ID NO: 138851 - RNA, 64 nt, Human
uuuccccaggacgcaagacucuccccuccacuguccgggacagcguucgcccuuuagcggggag

SEQ ID NO: 138852 - RNA, 64 nt, Human
cugacuccucaacaggcauaaucaccagcaacacccgggacaauaauacgggggccaccuaccc

SEQ ID NO: 138853 - RNA, 64 nt, Human
ggcccagccucuuccugggagaugcguacgcagcccgggacaagagcaagcugauccagcuggg

SEQ ID NO: 138854 - RNA, 61 nt, Human
acgccuaccuucacaaaugaagccacagcccccgggacaccguggggaaggggugcaggug

SEQ ID NO: 138855 - RNA, 64 nt, Human
cugaggaggguaggaggggccucccuggauugaaccgggacagaaacacggugagggcccccac

SEQ ID NO: 138856 - RNA, 64 nt, Human
gaaaggauguuuugucccauuuccuuggaggccaccgggacagaccuggacacuagggucaggc

SEQ ID NO: 138857 - RNA, 64 nt, Human
gggugggggagggagguuccucgcaggucucagcccgggacagggucuugcaagcagccuccug

SEQ ID NO: 138858 - RNA, 64 nt, Human
acccguagaugccagggcuggaagcuuucauuugccgggacacucgggcccaugggauugcaca

SEQ ID NO: 138859 - RNA, 64 nt, Human
uuguggcuccugcacccugcucagcagcucugucccgggacagucaggguggacucaaucuuuc

SEQ ID NO: 138860 - RNA, 64 nt, Human
gcugcucccgccgccgccucagcgccacacaucgccgggacacccgcgccgggcagccccgccg

SEQ ID NO: 138861 - RNA, 64 nt, Human
accgagaggguguguggcuccggggcccuggggaccgggacagccgcuccagcuucugcacuca

SEQ ID NO: 138862 - RNA, 64 nt, Human
gccccugugaagugcugucuggagcagcaggaucccgggacaggauggggggcuuuggggaaag

SEQ ID NO: 138863 - RNA, 64 nt, Human
ucagguggcauggacagggagucguccgcccuuuccgggacagcaaaucccaucucaguccagc

SEQ ID NO: 138864 - RNA, 64 nt, Human
ugacucggacugaauuccccauacuguuuccacgccgggacaccauguucuccaucaagcuaaa

SEQ ID NO: 138865 - RNA, 64 nt, Human
gugcuggaggaaaaaaaugacauuucugaccuucccgggacacauucuucuggaggcuuuacau

SEQ ID NO: 138866 - RNA, 64 nt, Human
uccauccucuugaaagguggauucagagggacccccgggacaagggucugagacccaaaggcac

SEQ ID NO: 138867 - RNA, 64 nt, Human
ggaccucugcccgagaccugcucagagagauggcccgggacaagccacgccuccuagcugcccu

SEQ ID NO: 138868 - RNA, 64 nt, Human
gggguggaggguccugggagauagucccagggguccgggacagaguggagucaagagcuggaac

SEQ ID NO: 138869 - RNA, 64 nt, Human
gagcggccaucgcguagaaagaaccaggguguccccgggacaggccgucccccaccccauccug

SEQ ID NO: 138870 - RNA, 64 nt, Human
uucugacacgggcuccaaccccaccugaccaagcccgggacagucaaggcuucucaauuuguau

SEQ ID NO: 138871 - RNA, 64 nt, Human
ucucagaaacuccagacucccauggcaaugacagccgggacacuuuucuucccuccagccaggg

SEQ ID NO: 138872 - RNA, 64 nt, Human
aaugccugggggaggccugcacuguccugauuggccgggacacacgguuuuguaaaaaauuaaa

SEQ ID NO: 138873 - RNA, 64 nt, Human
uuguuuacacuuggagccaccuuggugugggucaccgggacaguguacuccucuccugccagcc

SEQ ID NO: 138874 - RNA, 64 nt, Human
aggcgggccagagcugagcgugaggacgugcuugccgggacagcaggcaguggccaccugguac

SEQ ID NO: 138875 - RNA, 64 nt, Human
aaccaaaaauaacuaacuacauaagggcaagucuccgggacaugccuacuggguauguuggcaa

SEQ ID NO: 138876 - RNA, 64 nt, Human
aagggagggggagagggcugccuuuggacuugucccgggacaccuaggcuaggguggggagaga

SEQ ID NO: 138877 - RNA, 64 nt, Human
gagcggcgggggcggcgcgcagggcccacugugcccgggacaaccgcagcgucgccacaguggc

SEQ ID NO: 138878 - RNA, 64 nt, Human
cauuuccacugugaucuccacgaggggauguuuuccgggacacaucucuggcucugggaacugc

SEQ ID NO: 138879 - RNA, 64 nt, Human
accaugaggcauggagcagggcagagcaagggccccgggacagaguuuucccagaccuggcucc

SEQ ID NO: 138880 - RNA, 64 nt, Human
gcucuccccggcaggccugagaaugagugggaauccgggacaccugggccgggcuguagaucag

SEQ ID NO: 138881 - RNA, 64 nt, Human
ggccaccuuggaguagacccagaccccucgggacccgggacauuagucucaggcugcugaugga

SEQ ID NO: 138882 - RNA, 64 nt, Human
ggugcugggcucuggccuucucaugcagagagguccgggacagggucaguaucgugggcaugug

SEQ ID NO: 138883 - RNA, 64 nt, Human
caugaauucccaaagcaucacugaacuugcccagccgggacacuggagacugaagaaguucccc

SEQ ID NO: 138884 - RNA, 64 nt, Human
gucgccgucgccccggcuccccugggcgcccaccccgggacacagaacuagugagcgcccccug

SEQ ID NO: 138885 - RNA, 64 nt, Human
agaauuuauugugaaucgauucccaagcucccuuccgggacaaguggucugggacagggaggag

SEQ ID NO: 138886 - RNA, 64 nt, Human
aagggaaccauccugguaccccacauccucuccuccgggacagucaccgaaaacacagguucca

SEQ ID NO: 138887 - RNA, 64 nt, Human
aucaucauccucaggacccaggacccucccauggccgggacagcccaucagaggcugccggggc

SEQ ID NO: 138888 - RNA, 64 nt, Human
uggagggccaggccccgccacccccacgggagacccgggacagggcgucuuccuaaguuauuca

SEQ ID NO: 138889 - RNA, 64 nt, Human
ccagacagcaccuggguccucgccacccuaagccccgggacaccuguuggagggcggaugggau

SEQ ID NO: 138890 - RNA, 57 nt, Human
cacaagccacgccucccugaaccuaucccgggacagggccucuuccucggccuuccc

SEQ ID NO: 138891 - RNA, 64 nt, Human
acacccugaguggacucuaucccucccccuuccaccgggacaacuucagcccuuaccuguuugc

SEQ ID NO: 138892 - RNA, 64 nt, Human
ucgguauaaaucauguuuauaaguuauggaagaaccgggacauuuuacagaaaaaaaacaaaaa

SEQ ID NO: 138893 - RNA, 64 nt, Human
gccuccccuuccccguccccuccucccgaagacgccgggacagucggguguccgcccucagccu

SEQ ID NO: 138894 - RNA, 64 nt, Human
ggaguuuggcuggugcugggccugagccagggggccgggacacccuuguuuccgguggucuucc

SEQ ID NO: 138895 - RNA, 57 nt, Human
auggcgagaagucggauuagcagggggccgggacagggagguugggaggggggacag

SEQ ID NO: 138896 - RNA, 64 nt, Human
gguuguuucacaagacagauucuguccuugucacccgggacagaaaacucagucuuuucacccu

SEQ ID NO: 138897 - RNA, 64 nt, Human
gucaccuggggacuccccacugucagcagcagccccgggacacccuacccccagcaaccccacu

SEQ ID NO: 138898 - RNA, 64 nt, Human
ccagguuugcucuccccaaguuuggggucagaggccgggacacugaggcagcagaacuagugcc

SEQ ID NO: 138899 - RNA, 64 nt, Human
agacccugacagguugcccugggcucugggugggccgggacaaaggccucucaucaccacagga

SEQ ID NO: 138900 - RNA, 64 nt, Human
ugucacucuagcaucuuugaggacugcgacaggaccgggacagcaggccccuugacagccccuc

SEQ ID NO: 138901 - RNA, 64 nt, Human
gcucuggggaagccgagggacagccauaacacccccgggacaguaggucugggcggcaccacug

SEQ ID NO: 138902 - RNA, 64 nt, Human
ucuuuguguagggaccgggggaccauggccuguuccgggacacucugggcagggcccucgggac

SEQ ID NO: 138903 - RNA, 64 nt, Human
gagacuccuggcuuucugaacuuugcgcguuaagccgggacagcugcuuugcugcccggagagu

SEQ ID NO: 138904 - RNA, 64 nt, Human
uccgggaccugcccagcguccucccugccuccuuccgggacaagccuggccacccucgcuguga

SEQ ID NO: 138905 - RNA, 64 nt, Human
uggggaagaagggcugcccagccagcugguucucccgggacaccagcagauccacacccugggc

SEQ ID NO: 138906 - RNA, 60 nt, Human
cggcccccuuccccuccugaccccagauggccgggacaugcagcucugaugagagagugc

SEQ ID NO: 138907 - RNA, 64 nt, Human
agcacacacacagcucagacccacggacaggaccccgggacagaaccccgggagcacugcccua

SEQ ID NO: 138908 - RNA, 64 nt, Human
acagugagcugacuggcaaguucgauguuagcucccgggacacucagcagcgauggugagcauu

SEQ ID NO: 138909 - RNA, 64 nt, Human
acuggauugcggaggagccucccgcagcacugguccgggacaagaugauggagugccacuuccg

SEQ ID NO: 138910 - RNA, 64 nt, Human
gugcagccaccagggaaggugagccagacacaggccgggacaaaacgcagacauuuuuuagggg

SEQ ID NO: 138911 - RNA, 64 nt, Human
ggcugucucuggcccugccgagccuaugggagucccgggacagagugcccacuccccucuacuu

SEQ ID NO: 138912 - RNA, 64 nt, Human
acccccagggcaggauggggacaggaucaccugcccgggacaccaccauuaucauucuccucua

SEQ ID NO: 138913 - RNA, 64 nt, Human
ggucucccaagaggggucccccaacucaccguucccgggacaggcugcccccuguuccaggaag

SEQ ID NO: 138914 - RNA, 64 nt, Human
cugcuggcauuuugcuguguccugcagccccuuuccgggacaccuggguucacacagcuuuuua

SEQ ID NO: 138915 - RNA, 64 nt, Human
ccauccccguccccaccccccccuccaccgcugggcccaucaguguguguuggggggaugcuug

SEQ ID NO: 138916 - RNA, 64 nt, Human
ggucuugcuccguugcccagguuggagugcaguggcccaucagggcucacuguaaccuccgacu

SEQ ID NO: 138917 - RNA, 64 nt, Human
uucacuugccaugcaggaagaggcccacuagagggcccaucaggcaguguuaccuguuagcucc

SEQ ID NO: 138918 - RNA, 64 nt, Human
acacauguuuaaggugucucugcacaugucucaagcccaucacaagaaagcaaguacagugugg

SEQ ID NO: 138919 - RNA, 64 nt, Human
uuuucaucccuuuguguaaaccuguuaauaaugagcccaucacuaauauccaguguaaaguuua

SEQ ID NO: 138920 - RNA, 64 nt, Human
cugcucaauuaaguagguggacuauggaaagguugcccaucaugacuuuguauuuauauacaau

SEQ ID NO: 138921 - RNA, 64 nt, Human
guauguucuaaagcugugucugagaucuggaucugcccaucacuuuggcuagugacagggcuaa

SEQ ID NO: 138922 - RNA, 64 nt, Human
uuucagagugaaauucaaggcagcacggacaugugcccaucaggcacagaagaaaacacgacgu

SEQ ID NO: 138923 - RNA, 64 nt, Human
ccugcuggaagacaggucucucuccguccacagugcccaucaucugagccugggcugggaugac

SEQ ID NO: 138924 - RNA, 64 nt, Human
gaaagauggugccuuccacccucuugggcugugugcccaucagagcaggcucagccugcaaagg

SEQ ID NO: 138925 - RNA, 64 nt, Human
uuaaagcccgcugcuccuuuucgguagaggagaggcccaucacuggugugguggggugggcucu

SEQ ID NO: 138926 - RNA, 64 nt, Human
cuuugcaccaaagauguccugacuuugcccccuugcccaucagccauuugccaucaccccaaac

SEQ ID NO: 138927 - RNA, 64 nt, Human
gcuauauggggaagggugucucaaagccuguugagcccaucaauaaaacuauugcaccuguccu

SEQ ID NO: 138928 - RNA, 64 nt, Human
ugcccaccccuggcacaaccaaaaucccacugaugcccaucaugcccucagacccuucugggcu

SEQ ID NO: 138929 - RNA, 64 nt, Human
aggugcccuuucugguaacuggaggcccagaugugcccaucacguuuuuucugaggcuuuugua

SEQ ID NO: 138930 - RNA, 50 nt, Human
gucccaacuacuuccgcuaggcccaucauggcucaggcugcccaaggcuu

SEQ ID NO: 138931 - RNA, 64 nt, Human
uuguucuaguuuuuagugagaccucugcagacaggcccaucacuguccauguuccagggcaggu

SEQ ID NO: 138932 - RNA, 64 nt, Human
uggagcuggagaaaccagggauccugaccgcagggcccaucaauugcuacauagagauacacau

SEQ ID NO: 138933 - RNA, 64 nt, Human
uagugacucugcaggacuucacagagagagcugugcccaucauucaguccaagugcuuucucug

SEQ ID NO: 138934 - RNA, 64 nt, Human
ucuuaagaauaauguuuuuuaaaggaggcuuuuugcccaucaagaauaaaaagaaauaaaacca

SEQ ID NO: 138935 - RNA, 64 nt, Human
gaccugggcccagacagucccccuugaccccagggcccaucagggaaaugccucccuuugguaa

SEQ ID NO: 138936 - RNA, 64 nt, Human
aaauaaaaagcauuuuaaaaaguauugacacaaagcccaucagugggcauuaaaaauauuaaaa

SEQ ID NO: 138937 - RNA, 64 nt, Human
ggugaugucuccagcagccggcuuagaggagcuagcccaucaagccggcagagaaucccccaca

SEQ ID NO: 138938 - RNA, 64 nt, Human
gcaagaggaggaggagagccugccguuccaacuugcccaucagagacccggacacggccuggug

SEQ ID NO: 138939 - RNA, 64 nt, Human
gaaguaaaacaaaauccuuuuaucucaguuauuugcccaucacaagcacauuuuuaaaauguug

SEQ ID NO: 138940 - RNA, 64 nt, Human
cuggcaagggaggagggccggccagcauuugguggcccaucagucuggccaucugucacgucac

SEQ ID NO: 138941 - RNA, 64 nt, Human
aucaucucauuuuuuaggaagacaugauaauacugcccaucauauucauguguaacuacuguuc

SEQ ID NO: 138942 - RNA, 64 nt, Human
uggguuccccaggcucacaguguagagacauugagcccaucacaacuguuuugacugcuggcag

SEQ ID NO: 138943 - RNA, 64 nt, Human
cugucuauacuucccccuccccagccccaaacaugcccaucacaugcccuagaagguaaguccc

SEQ ID NO: 138944 - RNA, 64 nt, Human
uccaagcuugccagucuuuuuggcuuugaacacugcccaucagcuacagucauuacuguucccc

SEQ ID NO: 138945 - RNA, 64 nt, Human
cucugggagguguuccccucccucccaugacugagcccaucagccauuccugaaggaagacagu

SEQ ID NO: 138946 - RNA, 64 nt, Human
ugacagaauuguccuggauuuugacuccauccacgcccaucaccuuucuacauuuugcugacag

SEQ ID NO: 138947 - RNA, 64 nt, Human
aaauuucccauguaagcugcaguuucuaucuuuagcccaucaucauuuucugcccccccaaaau

SEQ ID NO: 138948 - RNA, 64 nt, Human
ggaaccaagccucugcucucaccuguggguucuugcccaucaggguaauuguauugagaacuca

SEQ ID NO: 138949 - RNA, 64 nt, Human
uaggucuacgcuaggaccccgugcugggcucucagcccaucaugagauuuugguggauuuaaug

SEQ ID NO: 138950 - RNA, 64 nt, Human
ugagcagcagcccauccccuguucacuuucucuagcccaucauuaccugugaacugcagugggg

SEQ ID NO: 138951 - RNA, 64 nt, Human
gguguagcuccccugcccaucuuggaggugcauggcccaucagggaucuuuaaagugggagcag

SEQ ID NO: 138952 - RNA, 64 nt, Human
uuggcaucuguuuaaaguagauuagaucuuuuaagcccaucaauuauagaaagccaaaucaaaa

SEQ ID NO: 138953 - RNA, 64 nt, Human
gagggaagcugaggcccauggccacauccucauggcccaucaggggcaggaaccagacaaucuc

SEQ ID NO: 138954 - RNA, 64 nt, Human
gcaggaaacagcaggucuggccagauucucacuugcccaucaaucucguucuuggaugauuucc

SEQ ID NO: 138955 - RNA, 64 nt, Human
ucuuccugacugucccagguccccacucuccagggcccaucaagucacccagacccaugaaaug

SEQ ID NO: 138956 - RNA, 64 nt, Human
cugcuuuuucaaaugcuuaagccaggagugcucagcccaucaacuuccugagugucuaaagaag

SEQ ID NO: 138957 - RNA, 64 nt, Human
caccuccaguuuggcuucugagcagagacucccugcccaucaagucugaaacccccauggauga

SEQ ID NO: 138958 - RNA, 64 nt, Human
gacuccgacugaggcaugcccugccccaccacucgcccaucaggccuguccugcagaggauggu

SEQ ID NO: 138959 - RNA, 64 nt, Human
ccaaaucuuuuaagaaaauuaaacuguggaccaugcccaucagcucagucagguuugucccucg

SEQ ID NO: 138960 - RNA, 64 nt, Human
aucuuucuuuuuuuaugaccaacaaccaaauaaagcccaucaucaaucaucucucacuauauau

SEQ ID NO: 138961 - RNA, 64 nt, Human
aauaguucuacugcccgugucuccagaauguagagcccaucaauauuuuuauuuuaggaggugu

SEQ ID NO: 138962 - RNA, 64 nt, Human
cgguccuuugauaagacccauaggcaaacuucgagcccaucagcaggucaacccuaugcuggga

SEQ ID NO: 138963 - RNA, 64 nt, Human
uuaggaauuggucaaaauucaucucuuucuuuaagcccaucaacucccaggacgguuugaguua

SEQ ID NO: 138964 - RNA, 64 nt, Human
uucaucaaucccaugacacaugccuuguuagcaugcccaucaaauaaucagaucaaacaccugc

SEQ ID NO: 138965 - RNA, 64 nt, Human
uagaaaucuaguauugccauaaaggaaacuaagugcccaucaaagauuuguuugguauaaauaa

SEQ ID NO: 138966 - RNA, 64 nt, Human
cugaugcacguuccucccggccuaguccguggaggcccaucacaccagcauccgugacgccagc

SEQ ID NO: 138967 - RNA, 64 nt, Human
ggagcuuuuguaucuucugcagacacuguggguagcccaucaaaauguaagcugugcuccucuc

SEQ ID NO: 138968 - RNA, 64 nt, Human
cuuuuuguagacuguaguuuauugauuaguucaagcccaucacgaacuaauuaaacauauuguu

SEQ ID NO: 138969 - RNA, 64 nt, Human
aagcuuuaaaguuuugucaaaacaugagugcuuugcccaucagugaauggaauggaccaaugag

SEQ ID NO: 138970 - RNA, 64 nt, Human
cuucccuaccagguuucuacacccccgccaggcugcccaucagggcccagggagcccccagagg

SEQ ID NO: 138971 - RNA, 64 nt, Human
acagacgaguggccaccggaaucacccgauaacagcccaucacaacuccaaagcccuuguguug

SEQ ID NO: 138972 - RNA, 64 nt, Human
cugcuccuacccaugcuacaggccaggaaccagagcccaucaucucagaggccccuggaugucc

SEQ ID NO: 138973 - RNA, 64 nt, Human
cauauuauuuuugccaauuucacaaauuccucuggcccaucaugucagucauuauugaguauau

SEQ ID NO: 138974 - RNA, 64 nt, Human
aauguaaugguugguuuauuguucuauaaccccagcccaucauuuucuguguaaaucauaaaca

SEQ ID NO: 138975 - RNA, 64 nt, Human
uuguuccuguuaaauguauagcauuguaaugagagcccaucaaauccugagugucaguuuguug

SEQ ID NO: 138976 - RNA, 64 nt, Human
ugacccccaaagguggggaggggcaugggcccaggcccaucagccucccugcugggacagggac

SEQ ID NO: 138977 - RNA, 64 nt, Human
agccauagcaagugccugugucccuguccuucaggcccaucaguccuggggcuuuuucuuuauc

SEQ ID NO: 138978 - RNA, 64 nt, Human
accugccauugccuccucuccauugcagacgccugcccaucaaguauuaccugcggcgacucaa

SEQ ID NO: 138979 - RNA, 64 nt, Human
acacaauggcaccucugcccuuccccucccgacagcccaucaccucuaauagaggcagugagac

SEQ ID NO: 138980 - RNA, 64 nt, Human
acccuuguccacaggcucaacauuucuacacguugcccaucaucccuucuuccauccuuagagg

SEQ ID NO: 138981 - RNA, 64 nt, Human
uucccgaccccaucagcuuggaagggugcuagaggcccaucaaggaagugggucuggugggaaa

SEQ ID NO: 138982 - RNA, 64 nt, Human
cugcaugugugugugggugugaauguguauacaugcccaucagcauuuagucacaugucugaau

SEQ ID NO: 138983 - RNA, 64 nt, Human
uucucucccccauaaggacuggcuguaaccuuaagcccaucaaaguuacuuccagccuggagag

SEQ ID NO: 138984 - RNA, 64 nt, Human
gcucagagcccugguaccuuggacccaagaggaggcccaucaucuuccuggaguaacaucacca

SEQ ID NO: 138985 - RNA, 64 nt, Human
caaaggcuuggcauauaccaaaggccagcugcaugcccaucagucuggucuuuuuccucugcgg

SEQ ID NO: 138986 - RNA, 64 nt, Human
ugaauuagacagagacucacucaggaagugacaggcccaucauaucaaauaacuuauucacuuu

SEQ ID NO: 138987 - RNA, 64 nt, Human
gaugaccccuucagaucaucugugccuaccuccugcccaucaggcgucuacacugucacucaga

SEQ ID NO: 138988 - RNA, 64 nt, Human
uggccguguguccccagguuuguuaccugcagcggcccaucacccuguggugcggccucaacca

SEQ ID NO: 138989 - RNA, 64 nt, Human
agggaugugggaaucucccagacuuguuuccugugcccaucaucucugccuuugagugugggac

SEQ ID NO: 138990 - RNA, 64 nt, Human
gacagauacaugagaagagccuccaaaacuggaagcccaucauaaggcaugagaauguuuaacu

SEQ ID NO: 138991 - RNA, 64 nt, Human
caaauagcaucuagaaagccaugaguuugaaagggcccaucacaggcacuuuccuacccaauua

SEQ ID NO: 138992 - RNA, 64 nt, Human
ccgccccccaucaugucugccagggugcucccccgcccaucacccucccggggccccuccacug

SEQ ID NO: 138993 - RNA, 64 nt, Human
cacuauggccuccuuugcccaaguugaaacaggggcccaucaucaugucuguuuccagaacagu

SEQ ID NO: 138994 - RNA, 64 nt, Human
aagacacaugcacgcguauguucguugcagcacugcccaucagugacagacuggauuaaaaaaa

SEQ ID NO: 138995 - RNA, 64 nt, Human
ucuguucaguugucuaaguaucaucccuucuguggcccaucacgcagcagaguugcccuacaaa

SEQ ID NO: 138996 - RNA, 64 nt, Human
ucugauaucaguccaguuuguccuuagucacaaagcccaucauaauauaaaacaggaugguggc

SEQ ID NO: 138997 - RNA, 64 nt, Human
gcauuuucuaacuuaggaagccacaauguucuuggcccaucaugacauuggguagcauuaacug

SEQ ID NO: 138998 - RNA, 64 nt, Human
agguggcgugagaggcaaugacucguuaccugccgcccaucaccuuggaggccuucccuggccu

SEQ ID NO: 138999 - RNA, 64 nt, Human
uggcaaguugcuuucuuugccugguccucaguuugcccaucaauauaauggguggauuggauga

SEQ ID NO: 139000 - RNA, 64 nt, Human
guugcagcaugagacuuucugcugggauccuugggcccaucacuguauagacaugcuaccacug

SEQ ID NO: 139001 - RNA, 64 nt, Human
cuagaauucuugcugcugcuuugcagagucaacagcccaucagcccauguuuuagaggggacac

SEQ ID NO: 139002 - RNA, 64 nt, Human
uuguuaucauaucaugcuucaacuauuaaauuaagcccaucauaucauagcacuaaaaagauug

SEQ ID NO: 139003 - RNA, 64 nt, Human
aaaugugaaagcucaguggccgcuccuucuuucagcccaucaaccagcauuggucccauaggga

SEQ ID NO: 139004 - RNA, 64 nt, Human
acaugauacguagccuacagucagugggccugaagcccaucaucccucagggcagcuacuuccu

SEQ ID NO: 139005 - RNA, 64 nt, Human
gggaaacaguuguuucccuagccauuuccgaauagcccaucauuccgagucaucaucucuguuu

SEQ ID NO: 139006 - RNA, 64 nt, Human
ccaucucuaaugcauguagaagcuccuuacgggugcccaucaagagcauagcuuggaagccacc

SEQ ID NO: 139007 - RNA, 64 nt, Human
ucuccaaaaaacagggcaaaaggggcacuugauugcccaucauguauaaaucacuauuucaacc

SEQ ID NO: 139008 - RNA, 64 nt, Human
aggcucaguguguaggaccuacaaaccuauaggggcccaucauaacguucucuuuaauuuauau

SEQ ID NO: 139009 - RNA, 64 nt, Human
aaggaaucugggaauuagcccuggccugaaaguggcccaucauucauacccacuguucugaagg

SEQ ID NO: 139010 - RNA, 64 nt, Human
ccagaagaugacugagggugaguuggcuuaccuggcccaucaggguaggcuggaguuagggacu

SEQ ID NO: 139011 - RNA, 64 nt, Human
cugccuucucauccugggagguggcccuucccaagcccaucagggcgugugagcagacugaagg

SEQ ID NO: 139012 - RNA, 64 nt, Human
uuugcuucugauuucuucuccccugcuguuuccugcccaucagagaggccugauacaagcaagu

SEQ ID NO: 139013 - RNA, 64 nt, Human
gagcccuggcuguucugugguuccucugcucaccgcccaucaggguucucuuagcaacucagag

SEQ ID NO: 139014 - RNA, 64 nt, Human
cuggcuggggccuaucagugugccccccauccuggcccaucaguguacccccgcccaggcuggc

SEQ ID NO: 139015 - RNA, 64 nt, Human
agcucgcauucucuuguguucguguugcccucgugcccaucaagugcagucgggaccucccagg

SEQ ID NO: 139016 - RNA, 64 nt, Human
agggcagugagcucugucuucccccaccugccuagcccaucaucuaucuaaccgguccuugauu

SEQ ID NO: 139017 - RNA, 64 nt, Human
uccaugccugcucucgaggcagcaguggguucaggcccaucagcuaccccugcagcuggggaag

SEQ ID NO: 139018 - RNA, 64 nt, Human
ccaaggcugggggaacuucaugcugggacaagcagcccaucaacgccauggguucaggcugauc

SEQ ID NO: 139019 - RNA, 64 nt, Human
augauuacaaggugucugugguuuagggggcccagcccaucauuccuuuuccccuuggcacuca

SEQ ID NO: 139020 - RNA, 64 nt, Human
ucuccauuuaggccuguugauaacuccauuacccgcccaucacugcuguuccuccagggccagc

SEQ ID NO: 139021 - RNA, 64 nt, Human
ucuacgcugaggacggagaccgcggcaucaaccagcccaucaucuacagcaucuuuagggguga

SEQ ID NO: 139022 - RNA, 64 nt, Human
agccuucccagaagucucacugcguguguugagagcccaucaggagggcaugcaugacucuuug

SEQ ID NO: 139023 - RNA, 64 nt, Human
cacagccagcaugacugcuucucugagagaacuugcccaucaggggcugggacaugggggugug

SEQ ID NO: 139024 - RNA, 64 nt, Human
accgugacagucucagggaccaaucccugccucugcccaucagauugccaauuuggggagacag

SEQ ID NO: 139025 - RNA, 64 nt, Human
gcccaaguuucuaagggaggcacuuccuccccucgcccaucagugccagccccugcuggcuggu

SEQ ID NO: 139026 - RNA, 64 nt, Human
ugaaucuugcccguuuauguaugcuccaugucuagcccaucauccugcuuggagcaaguaggca

SEQ ID NO: 139027 - RNA, 64 nt, Human
cuaaucagcucccuuccccugccugguaugaguugcccaucauacgcaugguccuggaggauga

SEQ ID NO: 139028 - RNA, 64 nt, Human
cauaauggaaaauguacaaaugccuaguuguguugcccaucaauuuuguauauuuucauaauuu

SEQ ID NO: 139029 - RNA, 64 nt, Human
cccuggaggggggccgggugcugcuggacggcaagcccaucagcgccuacgaccacaaguacuu

SEQ ID NO: 139030 - RNA, 64 nt, Human
ccuacuuuucuucagauauugaaccagaucucuggcccaucaggcuuucuaaauucuucaaaag

SEQ ID NO: 139031 - RNA, 64 nt, Human
ugacugaaacagaagcgauaccucucgcucccaugcccaucacuacagaccccaagucaagaug

SEQ ID NO: 139032 - RNA, 64 nt, Human
ccuucagccccagggccaugucuggguucuccaugcccaucagucucugcaguuucucuaccug

SEQ ID NO: 139033 - RNA, 64 nt, Human
uuguguuuggagcaaggguugugaagucugucuggcccaucaaaugaccaauggcuuuuaagga

SEQ ID NO: 139034 - RNA, 64 nt, Human
augcugggauuagaggugugagccacugugcccagcccaucaauguguuuuaaagcuagcuguc

SEQ ID NO: 139035 - RNA, 64 nt, Human
uuuuaugaguucgcaggucuacuagaagguucuggcccaucaauauucauuucauuuaauucuu

SEQ ID NO: 139036 - RNA, 64 nt, Human
uucagccuccugcacccaaggcagugccugagaagcccaucauagacaagaaguagcaaacugu

SEQ ID NO: 139037 - RNA, 64 nt, Human
aggugcaguacaucuaugggcugugauuccccuugcccaucagagaggagcauuucaaucugcu

SEQ ID NO: 139038 - RNA, 64 nt, Human
auuuuucuaaguauuuccagaaacauuugagagugcccaucauuuucaggucugcagaaccaua

SEQ ID NO: 139039 - RNA, 64 nt, Human
cuacagggagaaaauccaggucaugcaguuccuggcccaucaacuguauugggccuuuuggaua

SEQ ID NO: 139040 - RNA, 64 nt, Human
gccauuccccucucccagcaccuugcagacuugggcccaucaagagcuacugcuggcccuggcu

SEQ ID NO: 139041 - RNA, 64 nt, Human
aauguguguacagacucacugaugcagcacuguagcccaucaccuuggagcacugacuguacau

SEQ ID NO: 139042 - RNA, 64 nt, Human
aaguugaaaauaccaucuccguggaucggccagugcccaucaucuucguuucggacagagcaaa

SEQ ID NO: 139043 - RNA, 64 nt, Human
caaugggcugaacaaagaugcuucacuuugccuugcccaucacccuauacaguuucgcagauag

SEQ ID NO: 139044 - RNA, 64 nt, Human
cagaaaugcggaugcaaaacaacuuuugacagaggcccaucaaacccagaucugcacuugguaa

SEQ ID NO: 139045 - RNA, 64 nt, Human
gaccauuacgcccccucccuguuucuuaucaccagcccaucagcccacugacucccauauggua

SEQ ID NO: 139046 - RNA, 64 nt, Human
acuuaacuuaaaucugcggcagacaacugccagugcccaucaaacaggagugugcgcuauggaa

SEQ ID NO: 139047 - RNA, 64 nt, Human
agccugcucuagugggacagcccagagccuggcugcccaucauguggccccacccaaucaaggg

SEQ ID NO: 139048 - RNA, 64 nt, Human
ccaugcgaugcacucuggcaccaaggcuuuaugugcccaucacucucagagaccacguuucccu

SEQ ID NO: 139049 - RNA, 64 nt, Human
aacuuaaagaugugaaugaguguuacaguugaaagcccaucauagguuuagugguccuaggaga

SEQ ID NO: 139050 - RNA, 64 nt, Human
gcccucccaacccuggaguugucagggagggccugcccaucaccucccucuccccaacaucccc

SEQ ID NO: 139051 - RNA, 64 nt, Human
ccaagcccccaaauagcuccaggcgcccucggccgcccaucaugguuaauucuguccaacaaac

SEQ ID NO: 139052 - RNA, 64 nt, Human
gaaccuaagaagaauuccaguguggugaugccaugcccaucaugggaggcuuuuggagaaacag

SEQ ID NO: 139053 - RNA, 64 nt, Human
ucacuccucuccagcaccgagcucccccagggcugcccaucaucuuaauguuuggagcuugccu

SEQ ID NO: 139054 - RNA, 64 nt, Human
agaguguggagcagagucggcgagcgcaagccgagcccaucaaccuggacagcugucuccgugc

SEQ ID NO: 139055 - RNA, 64 nt, Human
gagcccgugggcacugcaugguguuggcuggcaugcccaucagcugaggacagcaaacucccag

SEQ ID NO: 139056 - RNA, 64 nt, Human
gggacuugggagagggagcaagccuuccuccauggcccaucacucggcuguggagaacaaagac

SEQ ID NO: 139057 - RNA, 64 nt, Human
ccauacccugcugucuccacggagggaggucacagcccaucacgcaggacacugugauuguguu

SEQ ID NO: 139058 - RNA, 64 nt, Human
ccugaucaggccccaucucaagguuggcacuccugcccaucacccuuagaaggaucuuuuccca

SEQ ID NO: 139059 - RNA, 64 nt, Human
uuugcgauugaaaacauagggaaccagccuaaaugcccaucaagcaaugaguggauaaagacaa

SEQ ID NO: 139060 - RNA, 64 nt, Human
ucauucagcaggguggacuucauguuuccaaugagcccaucaccaucccacugacucugugaga

SEQ ID NO: 139061 - RNA, 64 nt, Human
gaaaguuggauaagauucccccuugcaccucgcugcccaucagaaagccugaggcgugcccaga

SEQ ID NO: 139062 - RNA, 64 nt, Human
ugccucuccuggcccuggaaggugccacuccagugcccaucagccuuguccuaauaaaauuaag

SEQ ID NO: 139063 - RNA, 64 nt, Human
ccucaggacccaggacccucccauggccgggacagcccaucagaggcugccggggcccacaggc

SEQ ID NO: 139064 - RNA, 64 nt, Human
uauauauguucaacucuucauagauugugaacuggcccaucaauauggucaggaauauuugcag

SEQ ID NO: 139065 - RNA, 64 nt, Human
ggguugcccgccuccuccagagacuugcccaagggcccaucaccacuggccucugggcacuugu

SEQ ID NO: 139066 - RNA, 64 nt, Human
ccagagagaaaggucggguuacccacaaagggaagcccaucagacucacagcugaccucuuggc

SEQ ID NO: 139067 - RNA, 64 nt, Human
ugggaaagcuuuuagcaaaggcucgaaucuuacugcccaucaaagaguacauaauggagagaaa

SEQ ID NO: 139068 - RNA, 64 nt, Human
uuguaguagccaaaaauuagaaacaacugagaaagcccaucacgaacaauaugggaaauucuua

SEQ ID NO: 139069 - RNA, 64 nt, Human
uucucaauagcaaagauguggaaucaacguaaaugcccaucagcaguagaccagauaaagaaaa

SEQ ID NO: 139070 - RNA, 64 nt, Human
cgggacuugccccagggaagccgucaccggcccggcccaucauguuuuuggauuuuuuuuuuuu

SEQ ID NO: 139071 - RNA, 64 nt, Human
agaaugucaacaucacacugugcauccucuuccggcccaucacuagccagcuuccucgcaucuu

SEQ ID NO: 139072 - RNA, 64 nt, Human
gucaccgggcaccacugauggugauuccaccccugcccaucacugggggcugcgcuagcugggc

SEQ ID NO: 139073 - RNA, 64 nt, Human
ggagccccaagaggggcugggaaggggggccauagcccaucaagcuccugcccuggcugggccc

SEQ ID NO: 139074 - RNA, 64 nt, Human
augaagaacaauuagacuggacccacccaccacagcccaucacccuccauuuccacuugguguu

SEQ ID NO: 139075 - RNA, 64 nt, Human
gccaaagcccaggcucccuuugggaaucauguuagcccaucagaauguugaaggauugaagagu

SEQ ID NO: 139076 - RNA, 64 nt, Human
caggagaaccacuacaugcagcccaugcccaccugcccaucacaggguugggcccagaucuggu

SEQ ID NO: 139077 - RNA, 64 nt, Human
ucccccaacagucugaccuuggcaguuccuuucugcccaucacacagacguccagcccuacauu

SEQ ID NO: 139078 - RNA, 64 nt, Human
uuuuugcacuaaaagugggcaggagucggcaugugcccaucagagagacggcuccucagaugcu

SEQ ID NO: 139079 - RNA, 64 nt, Human
uauucaagugaugcucaugauccuguuacugugugcccaucauagauuucuuuuuuuaguguug

SEQ ID NO: 139080 - RNA, 64 nt, Human
aggcauugccucggcuggcuccccugcagcccuggcccaucauggggggagcacccugagggcg

SEQ ID NO: 139081 - RNA, 64 nt, Human
caggcgggagggaagggcggcacuggagagaugggcccaucauuaggggccagcaucccaggaa

SEQ ID NO: 139082 - RNA, 64 nt, Human
gugccuugggaugccggagcugggggaccuggaggcccaucagccggagccacgugaaagguac

SEQ ID NO: 139083 - RNA, 64 nt, Human
ugguagugacuugcuuuuccugugcacacauguagcccaucaggacagcgagccgacgggucac

SEQ ID NO: 139084 - RNA, 64 nt, Human
caaaaacaagagaaaagacacgagagagacuguggcccaucaacagacguugauaugcaacugc

SEQ ID NO: 139085 - RNA, 64 nt, Human
gggcacugcuaugugcagggacagccagcacccagcccaucaccacucccugggcuggcuggca

SEQ ID NO: 139086 - RNA, 53 nt, Human
acacggccccggccugguaaccagcccaucagcacacggcucccacggagcau

SEQ ID NO: 139087 - RNA, 64 nt, Human
guugcugauuccacccggggggcccggcugacucgcccaucaccucaucucccuguggacuugg

SEQ ID NO: 139088 - RNA, 64 nt, Human
cugcacuggaguugucucuuaccccacccucccugcccaucaacuguaucugauuucacuaauu

SEQ ID NO: 139089 - RNA, 64 nt, Human
uugcugagcaacucgccagccuccugagcuccaugcccaucaggacucuagccucugaccuugc

SEQ ID NO: 139090 - RNA, 64 nt, Human
ccuccuccccacggccaugccucugcucuugggcgcccaucauggaggagcaccugaacuuucu

SEQ ID NO: 139091 - RNA, 64 nt, Human
cucaaaaugcaguucagccccacucccucuccaugcccaucaaacaacugcacaaucacuuguu

SEQ ID NO: 139092 - RNA, 64 nt, Human
guuaggaucuucuaaguguauaacugucuccuaagcccaucacuguggcacacuguagagugag

SEQ ID NO: 139093 - RNA, 64 nt, Human
aaaugcagaaauuuacccaggcacggcggcggacgcccaucaucccagcuacuugggaggcuga

SEQ ID NO: 139094 - RNA, 64 nt, Human; identical to SEQ ID NO: 114502

SEQ ID NO: 139095 - RNA, 64 nt, Human; identical to SEQ ID NO: 114503

SEQ ID NO: 139096 - RNA, 64 nt, Human; identical to SEQ ID NO: 114504

SEQ ID NO: 139097 - RNA, 64 nt, Human; identical to SEQ ID NO: 114505

SEQ ID NO: 139098 - RNA, 64 nt, Human; identical to SEQ ID NO: 114506

SEQ ID NO: 139099 - RNA, 64 nt, Human; identical to SEQ ID NO: 114507

SEQ ID NO: 139100 - RNA, 64 nt, Human; identical to SEQ ID NO: 114508

SEQ ID NO: 139101 - RNA, 64 nt, Human; identical to SEQ ID NO: 114509

SEQ ID NO: 139102 - RNA, 54 nt, Human; identical to SEQ ID NO: 114510

SEQ ID NO: 139103 - RNA, 64 nt, Human; identical to SEQ ID NO: 114511

SEQ ID NO: 139104 - RNA, 64 nt, Human; identical to SEQ ID NO: 114512

SEQ ID NO: 139105 - RNA, 64 nt, Human; identical to SEQ ID NO: 114513

SEQ ID NO: 139106 - RNA, 64 nt, Human; identical to SEQ ID NO: 114514

SEQ ID NO: 139107 - RNA, 64 nt, Human; identical to SEQ ID NO: 114515

SEQ ID NO: 139108 - RNA, 64 nt, Human; identical to SEQ ID NO: 114516

SEQ ID NO: 139109 - RNA, 64 nt, Human; identical to SEQ ID NO: 114517

SEQ ID NO: 139110 - RNA, 64 nt, Human; identical to SEQ ID NO: 114518

SEQ ID NO: 139111 - RNA, 64 nt, Human; identical to SEQ ID NO: 114519

SEQ ID NO: 139112 - RNA, 64 nt, Human; identical to SEQ ID NO: 114520

SEQ ID NO: 139113 - RNA, 64 nt, Human; identical to SEQ ID NO: 114521

SEQ ID NO: 139114 - RNA, 64 nt, Human; identical to SEQ ID NO: 114522

SEQ ID NO: 139115 - RNA, 64 nt, Human
acagccuucugaaguuacucauuauaagucaagcaaacgagaaguacgaacaucugauucuucc

SEQ ID NO: 139116 - RNA, 64 nt, Human
cugagcagaggggugcggcagcuucaggaggcagaaacgagaggggugggagauccacaggacc

SEQ ID NO: 139117 - RNA, 64 nt, Human
gagaucgcaccacugcacuccagccuaggagacaaaacgagacuucauuuaaaaaaaauaaaaa

SEQ ID NO: 139118 - RNA, 64 nt, Human
aaagugggaggccccugugacauuuugccaacuuaaacgagaaaaagaccccccgcacccggca

SEQ ID NO: 139119 - RNA, 64 nt, Human
uucaugcccaagcccugagaguggguacuagaaaaaacgagauugcacaguuggagagagcagg

SEQ ID NO: 139120 - RNA, 64 nt, Human
uccgcuauauccaaaauuacagcuauuggcaaauaaacgagauggauaaaggugugugucugua

SEQ ID NO: 139121 - RNA, 64 nt, Human
aauuuagggaaaauuggaaaauauaggaaacuuuaaacgagaaaaugaaaccucucauaauccc

SEQ ID NO: 139122 - RNA, 64 nt, Human
caacccuauuuagaaauggauuuaucaucaccucaaacgagauauaucccggaugaggcugacu

SEQ ID NO: 139123 - RNA, 64 nt, Human
aauaugcccuucaaaucuauaauuuuacuuugguaaacgagauuuaacaugaugucuuuuaugc

SEQ ID NO: 139124 - RNA, 64 nt, Human
auuaguccauuugcuagaagaguggucaagggaaaaacgagagaugaaauuuaguuaagucuau

SEQ ID NO: 139125 - RNA, 64 nt, Human
aucauucuuuccccucagagcucuuauguggauuaaacgagauaauguauauaaaguacuuuag

SEQ ID NO: 139126 - RNA, 64 nt, Human
uuuguuuuuucaaauaaguagagacuauuguaaaaaacgagaaaggaaaaugaaaugugcgugu

SEQ ID NO: 139127 - RNA, 64 nt, Human
ugagacuuuugccacacacaaauuugugaaaauuaaacgagauguggaaggagaaccucaguga

SEQ ID NO: 139128 - RNA, 64 nt, Human
aaguuguuggacucuaguaccaagaaacaacaacaaacgagauacauuauaauuacugucugau

SEQ ID NO: 139129 - RNA, 64 nt, Human
ggacguguuuagauaguuuccaccaugaggugcaaaacgagacagaagagugagaagcagaugg

SEQ ID NO: 139130 - RNA, 64 nt, Human
gaaaaacuuagaauagugaacuauuaauauuuaaaaacgagaaauacaacauuuaaaaaauuaa

SEQ ID NO: 139131 - RNA, 64 nt, Human
gaccgacaaaggacacugugaaucacaguagcguaaacgagaggccuuccuuucuaaugacaau

SEQ ID NO: 139132 - RNA, 64 nt, Human
cguccuagcacaaaagcagccauagacaacacacaaacgagagggcuuggcucccuuccaggaa

SEQ ID NO: 139133 - RNA, 64 nt, Human
uaagucauuugaaaagaacagacuuacuaaaaucaaacgagacggauagaagcuacuuuuuaaa

SEQ ID NO: 139134 - RNA, 64 nt, Human
cagauugugcaaucuuuaagaaaaauaaagauacaaacgagaguuuuguucacuuagugauuuc

SEQ ID NO: 139135 - RNA, 64 nt, Human
uuaaaugucaguuacaauaugagaaagauuuggaaaacgagacugggacuauggcuuauucagu

SEQ ID NO: 139136 - RNA, 64 nt, Human
cuuuuccuauuuucagcccauauuucaucguguaaaacgagaauccacccauccuaccaaugca

SEQ ID NO: 139137 - RNA, 64 nt, Human
ucugcaaaacauuuuauguauagauuuagaggggaaacgagaagguacugaaauaaugaucuug

SEQ ID NO: 139138 - RNA, 64 nt, Human
uuacucuugcaacauaacuaccaucucucucuuaaaacgagaucagguuagcaaaugauguaaa

SEQ ID NO: 139139 - RNA, 64 nt, Human
uuaggaaguaaaugaguaggaguuuaggagggauaaacgagauaaauuccaugcaaugaucaag

SEQ ID NO: 139140 - RNA, 64 nt, Human
agcaaauuaaguauuugacaaacauuauuucauuaaacgagacugucaaucauuacucaaagaa

SEQ ID NO: 139141 - RNA, 64 nt, Human
ugugagcuauaauguuucccucaagaacaaacagaaacgagauuugccaaaaacuaaaauucaa

SEQ ID NO: 139142 - RNA, 64 nt, Human
agcaggcuagucagcuaagguaaauuucauuuucaaacgagagggaaacaugggaaguaaaaga

SEQ ID NO: 139143 - RNA, 64 nt, Human
aaccucaagcucucucuaaggagcuguuuuccucaaacgagaagaauugaaguguuuaguucua

SEQ ID NO: 139144 - RNA, 64 nt, Human
gagagacgaagauacuugcugcugauagaggugaaaacgagauugauccgucugggguuuuacg

SEQ ID NO: 139145 - RNA, 64 nt, Human
agccacugcgccuggccuuuuuuuuuuuuuuuuuaaacgagaacaagaauaugaagaacuggaa

SEQ ID NO: 139146 - RNA, 64 nt, Human
gugccccugccaaggccggagacccacagcccugaaacgagaagugcccuuaaggaucacccca

SEQ ID NO: 139147 - RNA, 64 nt, Human
ggagccgcggaggaggacagugagggaggaauggaaacgagagaugugaaguuggcagccgggg

SEQ ID NO: 139148 - RNA, 64 nt, Human
uaauauacucuaaaccuguuauuucugugcuaauaaacgagaugcagaacccuugaauguugga

SEQ ID NO: 139149 - RNA, 64 nt, Human
uuuuaagcccaaauaugacacuggccauuuuuguaaacgagaccaccaggccuucuucacuaag

SEQ ID NO: 139150 - RNA, 64 nt, Human
uucaucucuuguuuacgauuucacuaggacucagaaacgagaucgggaagcagaaauauagugc

SEQ ID NO: 139151 - RNA, 64 nt, Human
gagauccuggcccauaguagaaucuguguagaggaaacgagagcucacuauuugugaggcagcc

SEQ ID NO: 139152 - RNA, 64 nt, Human
ccccaaaccuguuuacagucaauuauaaccugacaaacgagacuuuuguaacauauuauuguua

SEQ ID NO: 139153 - RNA, 64 nt, Human
aguuuuguaucuuaaagacugaggcacagaagcgaaacgagaacacacuguuuuugagacacag

SEQ ID NO: 139154 - RNA, 64 nt, Human
cuuuucccauuuaucuaaauauggacugcucaggaaacgagacuuuccauuacaaguauuuuua

SEQ ID NO: 139155 - RNA, 64 nt, Human
cauccaggaugcucagaagcagauuccaguguaaaaacgagaaaaacaaaaugaaagaggggaa

SEQ ID NO: 139156 - RNA, 64 nt, Human
aggagcagaagcugggugggcugaagaggccuggaaacgagagucuuaauugaggagaugggag

SEQ ID NO: 139157 - RNA, 64 nt, Human
cuguuauguuguaaacaggaagcauuucacauccaaacgagaaaaucauguaaacaugugucuu

SEQ ID NO: 139158 - RNA, 64 nt, Human
gcccugaagcacugcgcaagcacauggaaaagagaaacgagauugggccgggcacgguggcuca

SEQ ID NO: 139159 - RNA, 64 nt, Human
ucuaaaaaaaaaaauggaaacuuuaauuuuuuuaaaacgagaauuucauuuacagcuacauuaa

SEQ ID NO: 139160 - RNA, 64 nt, Human
cacaggaaacuucgcagugaugcaccaggcgaggaaacgagaccucuuucguuccuucuagaag

SEQ ID NO: 139161 - RNA, 64 nt, Human
uugcagagguccaaaugauauucaugaugguaauaaacgagauguuugccaaauaaaaaacaga

SEQ ID NO: 139162 - RNA, 64 nt, Human
ugccaggaugaaugaggaaaaaacccagccccacaaacgagacacacgcuggcggggagagacg

SEQ ID NO: 139163 - RNA, 64 nt, Human
acauccaucuaaauggauaccuuuccauccccucaaacgagaacaaaaaguauucccugcaagc

SEQ ID NO: 139164 - RNA, 64 nt, Human
uaacagucuuuuuagaaguaaauauauucaagacaaacgagaaaauccuggcuacccaagucga

SEQ ID NO: 139165 - RNA, 64 nt, Human
uaucauuauuuacuuaggaaagaguaaaaauaccaaacgagaaaauuuaaaggagcaaaaauuu

SEQ ID NO: 139166 - RNA, 64 nt, Human
uagccucuggaacugugcguucugcauagaauucaaacgagauucacccagcgcgaggaggaag

SEQ ID NO: 139167 - RNA, 64 nt, Human
uuguaacucccuuacagcccccagacccuucuugaaacgagagccagcaagcugagcacagacc

SEQ ID NO: 139168 - RNA, 64 nt, Human
caucauauugucauuuguuuugagcagucugaauaaacgagaccgggaaagacaucccuggcag

SEQ ID NO: 139169 - RNA, 64 nt, Human
accaaaccgucccagcguuaaugucgucacuugaaaacgagaaaaagaccgaccccccaccccu

SEQ ID NO: 139170 - RNA, 64 nt, Human
cugcuuuuucugcgcuucaguaacaaguguuggcaaacgagacuuucuccuggccccugccugc

SEQ ID NO: 139171 - RNA, 64 nt, Human
ggccaaggcugagagcucucucuucucuguuacaaaacgagauaagcaaguguuagaauugccu

SEQ ID NO: 139172 - RNA, 64 nt, Human
gugagugagcagagcagguuaugugcagacagggaaacgagaacuuuggaccuggcuuucugag

SEQ ID NO: 139173 - RNA, 64 nt, Human
ccaugcagacucucugaauaaccuagccaauaucaaacgagaacagggaaacauugaagaggca

SEQ ID NO: 139174 - RNA, 64 nt, Human
gccucuucuuggugcccugccccaaauaaaggaacuggacaaagagaacuugccuccaacucua

SEQ ID NO: 139175 - RNA, 64 nt, Human
auaacuugaggcaguaauuacaguggaaugaguacuggacaaggagucaaaaaacuugauuuca

SEQ ID NO: 139176 - RNA, 64 nt, Human
aacuuugccaauauuuuaaaagccaaaauauucucuggacaacaaauuuguauugcucagggac

SEQ ID NO: 139177 - RNA, 64 nt, Human
ucucuccucauggcagcgacccaccuccaguccccuggacaaucggguacaagagacuuaaggu

SEQ ID NO: 139178 - RNA, 64 nt, Human
accaggucacacgauagcucuugggggucacggccuggacaagaaaggcuugacugagccguga

SEQ ID NO: 139179 - RNA, 64 nt, Human
ucagggugcugaggcaacagcagcaagggcuggucuggacaagaaaagccauagcccggcagcc

SEQ ID NO: 139180 - RNA, 64 nt, Human
caggggaacacaaggucaggagaucaagacuguccuggacaacauggugaaacccugucucuac

SEQ ID NO: 139181 - RNA, 64 nt, Human
uuauaauaauuauaaauaaaccuguuaaauuuuucuggacaaugccagcauuuggauuuuuuua

SEQ ID NO: 139182 - RNA, 64 nt, Human
cugcccauggugaggagcgagcaugugacagucccuggacaaccuccugcuccauccacuacaa

SEQ ID NO: 139183 - RNA, 64 nt, Human
ugaagacugagggucagauuugcccugagcugcacuggacaaaaugccuccaggacccacuucg

SEQ ID NO: 139184 - RNA, 64 nt, Human
gcccagacugcuggaacagccaaggacugucaggcuggacaaaaauaacugcaaggaggggcaa

SEQ ID NO: 139185 - RNA, 64 nt, Human
caauauuaaauacagacacuaaguuauaguauaucuggacaagccaacuuguaaauacaccacc

SEQ ID NO: 139186 - RNA, 64 nt, Human
ugccccaauuaagcgugaaauugaaaaacugaagcuggacaaggaccauuuagagaagguuuua

SEQ ID NO: 139187 - RNA, 64 nt, Human
aggaucgucuugagcccaggaguucaagaccagccuggacaacauagugagaccuugucuccac

SEQ ID NO: 139188 - RNA, 64 nt, Human
gccccuuuccccauucucaacaccauccaucccucuggacaaaggaucauacagguguuauuag

SEQ ID NO: 139189 - RNA, 64 nt, Human
gacgaauagcacccuaccuguggguguuugggggcuggacaauuuggguggcaguguuugguac

SEQ ID NO: 139190 - RNA, 64 nt, Human
gucacuauuuucuccuuaaagcuccagccaaaaacuggacaaggauagagaggaggagggaaga

SEQ ID NO: 139191 - RNA, 64 nt, Human
accuucuccuuuacuauguugaauguauuuuuuucuggacaagcuuacaucuuccucagccauc

SEQ ID NO: 139192 - RNA, 64 nt, Human
aagaggaaauagaugucugcacuccuggcugcagcuggacaacagaagccccaugccgccuguc

SEQ ID NO: 139193 - RNA, 64 nt, Human
caaggccccaacaccauggcugccagcuuccaggcuggacaaagcagggggcuacuucucccuu

SEQ ID NO: 139194 - RNA, 64 nt, Human
ccaaauuuugcuuuaguacauggagcucagguuucuggacaagaagaguccuuuuagcacauca

SEQ ID NO: 139195 - RNA, 64 nt, Human
gccacauuauacaaaaguuuauaauuugccacaucuggacaaguaacuuucuucuuuuguucau

SEQ ID NO: 139196 - RNA, 64 nt, Human
aagugaaacgguuugagagacgcagugcccugaccuggacaagcugugcacgucuccuguucug

SEQ ID NO: 139197 - RNA, 64 nt, Human
uaccuugccagaucccucucucaguuccagccuucuggacaaggccugggcuaagaggagcuga

SEQ ID NO: 139198 - RNA, 64 nt, Human
gcagacccaguacauccuggagggcuacagcauccuggacaacaacgcggccaccaugcugcag

SEQ ID NO: 139199 - RNA, 64 nt, Human
aguuuuaggagguugaaccuaaagaaauggaugacuggacaaaccauccaaauaaugauaaagu

SEQ ID NO: 139200 - RNA, 64 nt, Human
cucuccaggagccuuugccuuaauguaucucugccuggacaacuugugguggggggugggggga

SEQ ID NO: 139201 - RNA, 64 nt, Human
aagguggguggcaggagggaacaggugccaccugcuggacaaucacacgaaaggcaggcgggcu

SEQ ID NO: 139202 - RNA, 64 nt, Human
agagcucuuugacaggcucccaggccucccaguccuggacaagcaugugcagucacgggagcuc

SEQ ID NO: 139203 - RNA, 64 nt, Human
uuuucucauuucgggaggaacucuguugcuucgccuggacaagaaggaaaaugcugauuuccuc

SEQ ID NO: 139204 - RNA, 64 nt, Human
aguauauucguucucaugaagacacagucagacacuggacaauguaauguaugcaacugcaaac

SEQ ID NO: 139205 - RNA, 64 nt, Human
auaauagcacauuaaccuucacauaauaagaaaucuggacaaguucaguuacacaguaugauga

SEQ ID NO: 139206 - RNA, 64 nt, Human
auaucagacgugacaaagauuugaguuuauuugccuggacaacuuggguuugucuggcuuuugu

SEQ ID NO: 139207 - RNA, 64 nt, Human
ucuguuggcgugcuaccuggaagauccuucuguccuggacaagaggaauuggaagagcauuuua

SEQ ID NO: 139208 - RNA, 64 nt, Human
gcagugagccaagaucaagccauuguacuccagccuggacaacaagagcgaaacucugucuaaa

SEQ ID NO: 139209 - RNA, 64 nt, Human
gagggacaaggccagcacacggugccucaaccaacuggacaagggauggcggcagaccaggggc

SEQ ID NO: 139210 - RNA, 64 nt, Human
guccuuccucugaaaguggcucuuucugaugcuacuggacaaucuuuucagaaaucuacuuuua

SEQ ID NO: 139211 - RNA, 64 nt, Human
auucuauaguuuuucacugauguaacuuucuagacuggacaacaaagaugacuaauaguaauca

SEQ ID NO: 139212 - RNA, 61 nt, Human
ccaacccauuugcucaguagcuaugauagaccuggacaaauaacuugacaaauugcuggaa

SEQ ID NO: 139213 - RNA, 64 nt, Human
ugguccccucucuggcucugugggucccugggcucuggacaagcacugggggacgugcccccag

SEQ ID NO: 139214 - RNA, 64 nt, Human
uauauauacguaacccaagccccauaaccccuaacuggacaaaugaggucuguuucuuugggcc

SEQ ID NO: 139215 - RNA, 64 nt, Human
cauagugauagagugcagugauguuugccauuugcuggacaaccaacacccggguugcuccuuu

SEQ ID NO: 139216 - RNA, 64 nt, Human
gugggugaguuccaaagagcuuggauuagaagggcuggacaaagagagaauucaauggggccca

SEQ ID NO: 139217 - RNA, 64 nt, Human
ucucagaguuucugugaugauuuguugagccuugcuggacaagugguuuguuugugugcaaacc

SEQ ID NO: 139218 - RNA, 64 nt, Human
gugacguugagcagagacguuagggaaguggauccuggacaaggcauuccaggcagaggaacag

SEQ ID NO: 139219 - RNA, 64 nt, Human
uuuuugagacggagucucacucuuguugcccaggcuggacaacaauggcgcgaucucggcucac

SEQ ID NO: 139220 - RNA, 64 nt, Human
uuugaaacgaucugcaggucuugccagugaaccccuggacaacugaccacacccacaaggcauc

SEQ ID NO: 139221 - RNA, 64 nt, Human
cgacaccugaccuagcacacacugacacaggggccuggacaagcccgcccucucugguccuccc

SEQ ID NO: 139222 - RNA, 64 nt, Human
uuuucucacagcagcugccugggugaagcaucugcuggacaagucggaccacuggccaggggac

SEQ ID NO: 139223 - RNA, 64 nt, Human
cagugaccugaucuccuccucaugaccuucugcccuggacaagcccccugaacuggauuuggga

SEQ ID NO: 139224 - RNA, 64 nt, Human
gcuuagauuuuaaggcacuucugaaagucaaucccuggacaaggcagucaucacauaagaacag

SEQ ID NO: 139225 - RNA, 64 nt, Human
gaaggacuucccugacaucugcaccaaggagagucuggacaaagcuacugaaacuccuccaccu

SEQ ID NO: 139226 - RNA, 64 nt, Human
gcagugagcugaggucgcaccacugcacuccagccuggacaacagagcaagacucugucucaaa

SEQ ID NO: 139227 - RNA, 64 nt, Human
uagggcacaagccuuagcaaaugauugauucucccuggacaaagcaggaaagcagauagagcag

SEQ ID NO: 139228 - RNA, 64 nt, Human
aaaucccugguuuuaaguaucaauccuuguucagcuggacaauaugaaucuuuuccacugaagu

SEQ ID NO: 139229 - RNA, 64 nt, Human
ggcucauuccuuuuugcaugguugucuaggguuucuggacaaugugcuguugcauuuuuauuuu

SEQ ID NO: 139230 - RNA, 64 nt, Human
uggccauuuuccuucaacugagggcucaaaacuccuggacaaguugcuggcuccugagaccagu

SEQ ID NO: 139231 - RNA, 64 nt, Human
ccaggaugacccacucuuaggggggugguggcaucuggacaaaugccaccacagcagguggggu

SEQ ID NO: 139232 - RNA, 64 nt, Human
cuugaggccuauuaauaauuucauuugucugucacuggacaauuucucauuccucucagugacu

SEQ ID NO: 139233 - RNA, 64 nt, Human
cugaacaaacacagcuuccggcccgaggccucaccuggacaacggugcuuccccaacagcugau

SEQ ID NO: 139234 - RNA, 64 nt, Human
uuccucaaguuuccuuuuuaaacauuugcauuugcuggacaauugcaauuuuuuuuaaaaaauu

SEQ ID NO: 139235 - RNA, 64 nt, Human
ggucauuaggauuaggcagaaucucucagagcugcuggacaaggaggucuacuuauuuugugug

SEQ ID NO: 139236 - RNA, 64 nt, Human
gcucccuucccugcagggcgccccugggagacaacuggacaagauuuccuacuuucuccugaaa

SEQ ID NO: 139237 - RNA, 64 nt, Human
cuggacuugauccugcuacagauucaacauaugacuggacaauccggucaccucucugggccuc

SEQ ID NO: 139238 - RNA, 64 nt, Human
aagaaguuaggcucauggcaacgugugucuuucucuggacaacuggcccaguuuacagugaaau

SEQ ID NO: 139239 - RNA, 64 nt, Human
auaauaucaggaaaauuaagcaucccaagugugacuggacaaagagagcagaugcaccagugcc

SEQ ID NO: 139240 - RNA, 64 nt, Human
cuguguguuaucagcugcgacugguucacugcgucuggacaagccucauggggacuggggauuc

SEQ ID NO: 139241 - RNA, 64 nt, Human
agguggcccuuugauuugugcguguccuugcccucuggacaacuuaauauuucaaguaaucgaa

SEQ ID NO: 139242 - RNA, 64 nt, Human
agugaaccaaaaaggcuagaaaccagaggaaaaccuggacaaccucucucuucccauggugcau

SEQ ID NO: 139243 - RNA, 64 nt, Human
cuggcuugcccaggccagagcaggaccacagauacuggacaagcugguacagccaacccccuag

SEQ ID NO: 139244 - RNA, 64 nt, Human
cuuccaggcagggccagaauuacagaaaacaauucuggacaacuaaacuaccucggaucaagcc

SEQ ID NO: 139245 - RNA, 64 nt, Human
ccucuccccagccccccuuaccuucacucccauacuggacaagacauuuuggacaugaguucaa

SEQ ID NO: 139246 - RNA, 64 nt, Human
aguaccaaagcucacuacugcgguuugccugugccuggacaaugaggcggagccacuguuguuu

SEQ ID NO: 139247 - RNA, 64 nt, Human
gaguuuuaauguuuugguuuucacuucuuuuaaacuggacaacaaauccagcauuucaagugcc

SEQ ID NO: 139248 - RNA, 58 nt, Human
ccaagaaacuaauuuuuuaaagagaacacuggacaacauuuuacuacugagggaaaua

SEQ ID NO: 139249 - RNA, 64 nt, Human
uugaaucaucauaaaaaaaauaccugcuuuucaucuggacaacccaauugagccacuuuaucuc

SEQ ID NO: 139250 - RNA, 64 nt, Human
uguacaaaggcaacagcaacuuaaaaaagaaaaucuggacaauagauguggacuccaaggggcc

SEQ ID NO: 139251 - RNA, 64 nt, Human
gcagugagccgagauugcgccacugcaccccagccuggacaacagagugagacuccuucucaaa

SEQ ID NO: 139252 - RNA, 64 nt, Human
gagaaagccacagccagccugccauaggauccaacuggacaacgugugggauggaccuggaaac

SEQ ID NO: 139253 - RNA, 64 nt, Human
gucucggagcuggauccccgucagcucauccaggcuggacaaaccaguuccugggucccccagc

SEQ ID NO: 139254 - RNA, 64 nt, Human
agcugccucacgguugacguuguguccuccuccccuggacaaucuccucuuggaaccaaaggac

SEQ ID NO: 139255 - RNA, 64 nt, Human
uucacucaaccccgugccaggacucagcaguggccuggacaacagccucagcuuccucuaccca

SEQ ID NO: 139256 - RNA, 64 nt, Human
ucuaacaccacacagaaagaggcuggaggagccacuggacaaagcuucugucucuguguguaca

SEQ ID NO: 139257 - RNA, 64 nt, Human
aauuauuuuauugggauacagaaaaauauaaauucuggacaaauaagucauauaccuguuuuca

SEQ ID NO: 139258 - RNA, 64 nt, Human
aaagucacaauaaaaauuagugauauucucaugccuggacaaaaucuuuaauuaaaacagugaa

SEQ ID NO: 139259 - RNA, 64 nt, Human
uguccccacccccacuuacuauaguucugugauccuggacaaguaacugaaucucuccgugcca

SEQ ID NO: 139260 - RNA, 64 nt, Human
ggcuuguguuucaaaggacacacccauguggcuccuggacaauccaagagcagccaaauccugc

SEQ ID NO: 139261 - RNA, 64 nt, Human
aggggacaggaagccucuugggccucuucccuuccuggacaaggcccccugccuuugccucaca

SEQ ID NO: 139262 - RNA, 64 nt, Human
acuggacauggcccauuggagcaccugggccccacuggacaacacugauuccuggagagguggc

SEQ ID NO: 139263 - RNA, 64 nt, Human
ccccccgcccacccacgcauacacacaugcccuccuggacaaggcuaacaucccacuuagccgc

SEQ ID NO: 139264 - RNA, 64 nt, Human
ggugguacaggguugucugccccuuuaaaagaaacuggacaaagaaggggaaggcucagggucu

SEQ ID NO: 139265 - RNA, 64 nt, Human
ugggacaugccugucuuccuaauaccauuuggagcuggacaacauuugacaccaaccaaucaua

SEQ ID NO: 139266 - RNA, 64 nt, Human
ggagcuggacaacauuugacaccaaccaaucauacuggacaaggcccuuagaggacuugaaaua

SEQ ID NO: 139267 - RNA, 64 nt, Human
ggcaggucugaccugccccaaaguuggcuccauccuggacaacucggugagaggcagugggcaa

SEQ ID NO: 139268 - RNA, 64 nt, Human
gaggauugcuugaggucaggaguuuuagaccagccuggacaacauagcaagaccucaucucuuc

SEQ ID NO: 139269 - RNA, 64 nt, Human
acuccaaacauccucuuccauauggauccacuggcuggacaaacugcaccaguugcugcuucaa

SEQ ID NO: 139270 - RNA, 64 nt, Human
gcagauaaccugcggucaggaguuugagaccaggcuggacaacauggugaaaccucgucucuac

SEQ ID NO: 139271 - RNA, 64 nt, Human
ugaggccauguagccaggcccggaaugggccucucuggacaagagccacccuuucacugugcau

SEQ ID NO: 139272 - RNA, 64 nt, Human
gagguuucuagcaugcgcccgggguugacaacagcuggacaaacuugaaaagucaauucaugug

SEQ ID NO: 139273 - RNA, 64 nt, Human
cuauacucucuauaacaauacuuuaucaagaacucuggacaaugguauuauuuuuaaaaaucau

SEQ ID NO: 139274 - RNA, 64 nt, Human
gcagugagcggagauuguaccauggcacuccagccuggacaacaagagcgaaauucugucuaaa

SEQ ID NO: 139275 - RNA, 64 nt, Human
gcagaucgcuggagcuuaugaguucgagaccagccuggacaacauagugaaacacugucucugc

SEQ ID NO: 139276 - RNA, 64 nt, Human
guucugaugaaagaaccaagugacccaaagugaccuggacaagauucauagacugaaagcuguu

SEQ ID NO: 139277 - RNA, 64 nt, Human
aaauaaaaagaauauaaaugaggucucguugaugcuggacaauucaagaauucagacuugaacc

SEQ ID NO: 139278 - RNA, 64 nt, Human
gccuugccuggcugagcuguguuccaggggagcccuggacaagcccucauaggcagggaggggg

SEQ ID NO: 139279 - RNA, 64 nt, Human
agaaaaagcuaauuggucuuugaauagaagacuucuggacaauuuuucacuuucacagauauga

SEQ ID NO: 139280 - RNA, 64 nt, Human
gaaauuuagcugguuaacggugccagaaaagucacuggacaaagaacacagauguaucgucaga

SEQ ID NO: 139281 - RNA, 64 nt, Human
cgcgagggccuggacuaacucagauggugcucggcuggacaaggggacugggggaggggccaaa

SEQ ID NO: 139282 - RNA, 64 nt, Human
cacaaagcuggucuaagcugccaucaauucccaccuggacaacugcaaaagccuuccagcuguu

SEQ ID NO: 139283 - RNA, 64 nt, Human
gaggauggaaaaguuucaugucauaagucaccaccuggacaauaauugaugcccuuaaaaugcu

SEQ ID NO: 139284 - RNA, 64 nt, Human
uggcuugagcucagucaaucuggugcagaugaggcuggacaacuacuaaccaauaaaaucagga

SEQ ID NO: 139285 - RNA, 57 nt, Human
ucuuagcuucuguuggauaaaugcuuacuggacaagaggaaacugaugcacacuaca

SEQ ID NO: 139286 - RNA, 64 nt, Human
ugcuaaucauuucagagguccaguuuuccuuucacuggacaaucuugaauaggaggaacgcugu

SEQ ID NO: 139287 - RNA, 64 nt, Human
agggucauccuacagccuccaagcgggcuuuccccuggacaaaugccacugcaacauuuaugug

SEQ ID NO: 139288 - RNA, 64 nt, Human
ccuguacggcagagacaugguggucugcacaagccuggacaaguucuuccauauugauggugga

SEQ ID NO: 139289 - RNA, 64 nt, Human
accagaaagggaugaacuuggcccucuugcgggccuggacaaggucucuuccuuacccuuucug

SEQ ID NO: 139290 - RNA, 64 nt, Human
aaagcucagaguccaguuccuuccauaaaacaggcuggacaaaugaccacuauguuagaccccc

SEQ ID NO: 139291 - RNA, 64 nt, Human
guguuuaguguacaaagagacuuuauaacccuuacuggacaacacacagauccuugagcucacg

SEQ ID NO: 139292 - RNA, 64 nt, Human
aggaaccaguaauaugccaaugguucaugaauuacuggacaaauagcagacaaugggagucccu

SEQ ID NO: 139293 - RNA, 64 nt, Human
gguuaaagaauuuaauccauugugaaacacuuaacuggacaaacuguaguuuuaguaaauucua

SEQ ID NO: 139294 - RNA, 64 nt, Human
gauuggcaacuucuacaggggccagucuuuugaacuggacaaccuuacaaguauaugaguauua

SEQ ID NO: 139295 - RNA, 64 nt, Human
aaauuccugugcucugaaaugccacuugguagcucuggacaaugaaggacaauugacucaaggg

SEQ ID NO: 139296 - RNA, 64 nt, Human
ugcuaguagauuacaacuucacacuagaggaguucuggacaaagcuuuuaauuagucaaacuaa

SEQ ID NO: 139297 - RNA, 51 nt, Human
agagugaaccuaaaggguagucuggacaacagagaugccaugauaucacug

SEQ ID NO: 139298 - RNA, 64 nt, Human
uucucaugucuuuggugcuuuggcccuaauagcacuggacaacaccacgaccacauggaaacau

SEQ ID NO: 139299 - RNA, 64 nt, Human
ggaagaucauugagcucaggaguuugaaaccagucuggacaacauagggagaccccaucucuac

SEQ ID NO: 139300 - RNA, 64 nt, Human
gaggauugcuugaggccaggaguucaaggccagccuggacaacauaguaagacccuaucucuac

SEQ ID NO: 139301 - RNA, 64 nt, Human
gaggauggcuuguguccagaaguucgagaccagccuggacaacauagugagauccuaucucuau

SEQ ID NO: 139302 - RNA, 64 nt, Human
aaggccguggagcugcugugugacugugucaggccuggacaaggaagacccuuagggaugacgu

SEQ ID NO: 139303 - RNA, 64 nt, Human
gauccggagccccagguuccgccccagagcgguccuggacaaggccagaccaaagcaagcaggg

SEQ ID NO: 139304 - RNA, 64 nt, Human
uuuuuuuaaauaaaaaaaaaggaaaagaggaagacuggacaaaacaacacaaaggcagaaagga

SEQ ID NO: 139305 - RNA, 64 nt, Human
gaaacugaagaucuccuagccugugccucugggacuggacaauugcuucaagcauucuucaacc

SEQ ID NO: 139306 - RNA, 64 nt, Human
aagccuccaaaccugccuacggcaacucuccauacuggacaaacuaaacccagaagagaggggu

SEQ ID NO: 139307 - RNA, 64 nt, Human
agacauggaauugaagagcacuagaaacaacuuccuggacaaggaauguaggaagugagugcug

SEQ ID NO: 139308 - RNA, 64 nt, Human
gaaguggcagcauucugaggccaagagacacucacuggacaauaucaaaccauggcuccuccuc

SEQ ID NO: 139309 - RNA, 64 nt, Human
auauugaugcugaaagaggaacuggucagcuccucuggacaacaaauucuuagucuauaauauu

SEQ ID NO: 139310 - RNA, 64 nt, Human
gcaggagcuggagccggucaucucccgcgcggugcuggacaacccgcaccgugagucuggcuca

SEQ ID NO: 139311 - RNA, 64 nt, Human
ugcuugaagguggguucuggcugccagccagucccuggacaaacucuccugccccuuuuaaauu

SEQ ID NO: 139312 - RNA, 64 nt, Human
agaugcagaguccauguccaucuugugccuucuccuggacaaaccuuuccuuccugguggugga

SEQ ID NO: 139313 - RNA, 64 nt, Human
caacuagccucaccgaggugccggagagggagcgcuggacaacuagaauguugaccucgagccg

SEQ ID NO: 139314 - RNA, 64 nt, Human
ucuaagcugcuguagccugaagaagacaagauuucuggacaagcucagcccaggaaacaaaggg

SEQ ID NO: 139315 - RNA, 64 nt, Human
aauauaucuccuugcccaagaguuugagaccagccuggacaacauaaugagacccucgucucua

SEQ ID NO: 139316 - RNA, 64 nt, Human
ucaggaaaucuauauuauaugcauucaaaaagaccuggacaaauaaagaccaaucuuaacagca

SEQ ID NO: 139317 - RNA, 64 nt, Human
cgaaucugggcucuuucacauacuagcugugacccuggacaaagagcuuuaaccugcugagucc

SEQ ID NO: 139318 - RNA, 64 nt, Human
aaauaauuaguguaacuuuuuucuuuaguuccuccuggacaacacuguaaauauaaagccuaaa

SEQ ID NO: 139319 - RNA, 64 nt, Human
uugccgagggcugcccagcucugcuucugguuuccuggacaauuucucugucagauacggccca

SEQ ID NO: 139320 - RNA, 64 nt, Human
ccacaugggcagacuggcagaagcccagacuuaccuggacaagguggagaacauuugcaagaag

SEQ ID NO: 139321 - RNA, 64 nt, Human
aacaauuucuacugcuuacacugguuuuuauccucuggacaacauaaaaaacaaaauaugggag

SEQ ID NO: 139322 - RNA, 64 nt, Human
uuaggaucaaagcacaagcucaccaucaaugagccuggacaaaaagggaagcugacucucacug

SEQ ID NO: 139323 - RNA, 64 nt, Human
cucuuuacugaccaacugaaguauagacuuacugcuggacaaucugcaugggcaucaccccucc

SEQ ID NO: 139324 - RNA, 64 nt, Human
cccuaacucaggcuuccuccggcagcuccagguucuggacaaccgacuggggcgggagacgggg

SEQ ID NO: 139325 - RNA, 64 nt, Human
uacaucagcccugaguaguaacugguuagcuucucuggacaauucagcaugguaacgugacugu

SEQ ID NO: 139326 - RNA, 64 nt, Human
uuagguucuuuucggucuccagcugacaacccaacuggacaaugaucugucuggugcaggagaa

SEQ ID NO: 139327 - RNA, 64 nt, Human
ccaggggcacagaccaguucugcagugacugucccuggacaaugggucuuuauucugaguuucc

SEQ ID NO: 139328 - RNA, 64 nt, Human
gcaggaggucagcccagggccaggagacacauggcuggacaaggcuuugcagccugggagaccc

SEQ ID NO: 139329 - RNA, 64 nt, Human
uggccugcuguccugcgucuauccauguggaaugcuggacaauaaagcgagugcugcccacccu

SEQ ID NO: 139330 - RNA, 64 nt, Human
gccccccuccaggcaugcuggccucccaauaaagcuggacaagaagcugcuaugagugggccgu

SEQ ID NO: 139331 - RNA, 64 nt, Human
uuuaaagucccccaacuauggggagguaccaauucuggacaagugccacuacaacaacacuaaa

SEQ ID NO: 139332 - RNA, 64 nt, Human
ugagaagaggggugugggaagguaaagaaacuugcuggacaagucauuaacacacuuuaagcga

SEQ ID NO: 139333 - RNA, 64 nt, Human
gguucaaacccucuuccacuaauuggcuaugucucuggacaaguuuuuuuuuuuuuuuuuuuuu

SEQ ID NO: 139334 - RNA, 64 nt, Human
ugucacccuaauccacuucccuaagacagaauuucuggacaagauggguaagggcuucauuccu

SEQ ID NO: 139335 - RNA, 64 nt, Human
guauuuuuguuuuucaagaggaaguagauuuuaacuggacaacuuugaguacugacaucauuga

SEQ ID NO: 139336 - RNA, 64 nt, Human
cugccugggcccccauucugcucccucgagguugcuggacaagcugcugcacugucucaguucu

SEQ ID NO: 139337 - RNA, 64 nt, Human
uccuggguccuagaccaggacuuccugugugacccuggacaaguacuaccuuccugggccucag

SEQ ID NO: 139338 - RNA, 64 nt, Human
aauauuucuggccucaaggaacuggaugaagagacuggacaaaguccccaggaugggcaucccc

SEQ ID NO: 139339 - RNA, 64 nt, Human
caucuaaacugaacugagagcacagcgggcuacccuggacaaaguaaagguggaaacuagguga

SEQ ID NO: 139340 - RNA, 64 nt, Human
acccacugaacuuucuggaaugggccauaggaugcuggacaauaggacagauuuggaaugagca

SEQ ID NO: 139341 - RNA, 64 nt, Human
cuucaaagacggaguauucuuuaccucagguuuacuggacaaaaucaauaacuacaaaaggcaa

SEQ ID NO: 139342 - RNA, 64 nt, Human
uuaggaacccauuuccuccccagaaccagaaugacuggacaaucuuuuucauagcuucuccauc

SEQ ID NO: 139343 - RNA, 64 nt, Human
uauacauuuagaagaugagucaguugaauuaguacuggacaaacaguuggagauuaguuugcaa

SEQ ID NO: 139344 - RNA, 64 nt, Human
guggcugugugcaauucuuggaguucuuuggcuucuggacaaaucuuguccaaguauugcagac

SEQ ID NO: 139345 - RNA, 64 nt, Human
uuccugccauuuucccucccuugaaagguugacacuggacaaccuuggggcagcugagcccugg

SEQ ID NO: 139346 - RNA, 64 nt, Human
agagaagaacucucauggcugcuggagguaccagcuggacaagguguuuggggcaugcugcccc

SEQ ID NO: 139347 - RNA, 64 nt, Human
aucagaucagcuggguccagaguuuaaugggcaacuggacaaccaaguuaaccccaauugaaag

SEQ ID NO: 139348 - RNA, 64 nt, Human
cugccccuggcccuccaugacacacccccgauuccuggacaaccagaggagauacagcugcuua

SEQ ID NO: 139349 - RNA, 64 nt, Human
uaggaguuuugggaaugcacuuggaaacuguauucuggacaaagacuaccugagaucacuaaau

SEQ ID NO: 139350 - RNA, 64 nt, Human
acuaauagaaacuuggcacuccugugcccucugccuggacaagcacauagcaagcugaacuguc

SEQ ID NO: 139351 - RNA, 64 nt, Human
ccugguccaucucauugcggccuguugggcagagcuggacaaggugucuuugaaggaaagcuaa

SEQ ID NO: 139352 - RNA, 64 nt, Human
uaaucacaagagcaauaucucuuugaaugacugucuggacaaacacaauugcaaauaagggaag

SEQ ID NO: 139353 - RNA, 64 nt, Human
gcagugagcugagaucgugccguuacucuccaaccuggacaacaagagcgaaacuccgucuuag

SEQ ID NO: 139354 - RNA, 64 nt, Human
gcagugagccaagaucgcgccauugcacuccagccuggacaacaagagcaaaacugucucaaaa

SEQ ID NO: 139355 - RNA, 64 nt, Human
uguccagcugugacugugcggugggcuccaucugcuggacaaaaggggaacugcaccauggcac

SEQ ID NO: 139356 - RNA, 64 nt, Human
uugccaauaccauugccaaaagggccuuuggauccuggacaaagcuuggcugccggcuucauuu

SEQ ID NO: 139357 - RNA, 64 nt, Human
ggaacuuaaaaccuugaaggucugucauaggacucuggacaaucucacaccuuagcuauuccca

SEQ ID NO: 139358 - RNA, 64 nt, Human
cugaaaggaagguuucuauucguugguuguggaccuggacaaaguccaagucuguggaacuuaa

SEQ ID NO: 139359 - RNA, 64 nt, Human
cuugccguggggaccuuggaaaccuggcuuugcucuggacaaaggguuccagagagaagcuaga

SEQ ID NO: 139360 - RNA, 64 nt, Human
gagcaccguggagcacgcgcaccucauuguggugcuggacaagggccgcguagugcagcagggc

SEQ ID NO: 139361 - RNA, 64 nt, Human
ccccacacuacauaucaguauuuucuaucuguaucuggacaaugcaguagaaauuauaacaaau

SEQ ID NO: 139362 - RNA, 64 nt, Human
ccacagccaguaaaucaggccagagugucucaaacuggacaagaaaugugcugcauugccgagu

SEQ ID NO: 139363 - RNA, 64 nt, Human
uuuaccuaaauuguccugaacuuuguuaaguguucuggacaaggccaagcuuuucuuuauuaaa

SEQ ID NO: 139364 - RNA, 64 nt, Human
aaaugguggaacugcguuaugaagagcuaauuuacuggacaaagaauuccaaagcaaaaccaga

SEQ ID NO: 139365 - RNA, 64 nt, Human
caaaguucuuacaguuaauuacugcaacuugcugcuggacaauuguauacagaguuaaaggcag

SEQ ID NO: 139366 - RNA, 64 nt, Human
gacagcuacaugacuuacaccauacagaacaguacuggacaaaaggggugauauuuuaaauuua

SEQ ID NO: 139367 - RNA, 64 nt, Human
uaaccugcucaaaggauaccaaauaaugguuuaacuggacaaccugaaaauuagcauagaaaac

SEQ ID NO: 139368 - RNA, 64 nt, Human
gccccuguccaccuggagacccggagacagaggccuggacaaggagugaacacgggaacuguca

SEQ ID NO: 139369 - RNA, 64 nt, Human
augccagauguugauaaacuuacucuuucugaaucuggacaaagucgacuuaacagauuuuucu

SEQ ID NO: 139370 - RNA, 64 nt, Human
gggagauuuuacuccuuucuucaacaacuauucacuggacaaguucucugcucccaugacgcgc

SEQ ID NO: 139371 - RNA, 64 nt, Human
ucauuaaagaaaacaagcugauaugugccuguuucuggacaauggaggcgaaagaguggaauuu

SEQ ID NO: 139372 - RNA, 64 nt, Human
uuacaacuuuugugaggauguguuucaaacauuucuggacaaaucuuauuuuguauuucuggaa

SEQ ID NO: 139373 - RNA, 64 nt, Human
gugagcugcacugaaacuuuacgacaaaaugucucuggacaaagagagucagagaagagaagca

SEQ ID NO: 139374 - RNA, 64 nt, Human
aguauguaugucguacuguaauggggguuuaugccuggacaauuaaguguuuuauuuguuuucu

SEQ ID NO: 139375 - RNA, 53 nt, Human
aacggaugagacuucagugaguacuggacaaaagagaagccuggaagacuccu

SEQ ID NO: 139376 - RNA, 64 nt, Human
ccuuaggaaugacuuggguuuaacaagcugucuacuggacaaucuuauguuuccaagagaacua

SEQ ID NO: 139377 - RNA, 64 nt, Human
aguggaauuggcagcuucuagaauauguacaccucuggacaaaauguuccucaaucuuaagaua

SEQ ID NO: 139378 - RNA, 64 nt, Human
ccucccucucucugaagauuuuuaugaagugagccuggacaacaacguggagccugcaccagga

SEQ ID NO: 139379 - RNA, 64 nt, Human
auuucccagucuccugugcagguaugacuguguucuggacaauggaaugugaggggaaacgauu

SEQ ID NO: 139380 - RNA, 64 nt, Human
cucagcguccaguccuccugggcggccccagguccuggacaauaagcaacagaugauauugagu

SEQ ID NO: 139381 - RNA, 64 nt, Human
gcaucugggcugugcccuggcucugcuuuucacccuggacaaagucgcuguggacuucaauuuc

SEQ ID NO: 139382 - RNA, 64 nt, Human
cagugaaguaaggcccaaaggaaagacggcuucccuggacaaagaagaccucagggcuacccaa

SEQ ID NO: 139383 - RNA, 64 nt, Human
cuuauuuuuccuccuugcagucuaauaaaaaaaucuggacaaucaaaccuuaaaauagcuacac

SEQ ID NO: 139384 - RNA, 64 nt, Human
guggagaaacuggaaugucgcugcauucagcugucuggacaaacagacaccaucagugagcgag

SEQ ID NO: 139385 - RNA, 64 nt, Human
cggcugccaugcacgucuccccuacagugguucucuggacaaggcuuuguccaucccggucccc

SEQ ID NO: 139386 - RNA, 64 nt, Human
acagaugagggaaucucgcugggaagcugacacccuggacaaagagggacugucggaaucuguu

SEQ ID NO: 139387 - RNA, 64 nt, Human
cagccgcucccugacagcgcgcuuucgccgugggcuggacaaugacuacguggagucaccaugc

SEQ ID NO: 139388 - RNA, 64 nt, Human
gaggaucacuugagcccaggaguuuuagacuagccuggacaacuaagugagacuccaucucuac

SEQ ID NO: 139389 - RNA, 64 nt, Human
gugugagagacagacagaugccccacgaggauggcuggacaaggacuuuuacuuuuuauuacau

SEQ ID NO: 139390 - RNA, 64 nt, Human
ccuguuucugucucauagcacaugugacaaucaucuggacaacagccacaagggggcgcucgga

SEQ ID NO: 139391 - RNA, 64 nt, Human
uuuagaggaacccaagauguggccuuuagcaaaacuggacaauguccaaacccacucaugacug

SEQ ID NO: 139392 - RNA, 64 nt, Human
gacacagaacauaucaucacugcagauaguucuacuggacaauguuacgcuagaauaaacacca

SEQ ID NO: 139393 - RNA, 64 nt, Human
acuagcagaaagucaaaaacuaagauacuguagacuggacaagaaauucuaccugggcaccuag

SEQ ID NO: 139394 - RNA, 64 nt, Human
uaccuccuccacucccccugccugcccccagcaucuggacaagcuaauagcaaauauuacccau

SEQ ID NO: 139395 - RNA, 64 nt, Human
cacuguguccauagaaaaacugugcugguauuugcuggacaaaggguugggccccuuuuauuuu

SEQ ID NO: 139396 - RNA, 52 nt, Human
gguccaccugcgcccacugaagcuggacaagagccucaauaaggacacccug

SEQ ID NO: 139397 - RNA, 64 nt, Human
uucacccugagugacguacuucauccuccaaugacuggacaacugcgaugccuuuuccucccuu

SEQ ID NO: 139398 - RNA, 64 nt, Human
uagaugacuucaaaagccugcuccuuacugcacucuggacaaggcccuggucuguauaguuugg

SEQ ID NO: 139399 - RNA, 64 nt, Human
uucaauuuuacugaaguacuggcucuuuccugcucuggacaagaauugagcaacuugucugaug

SEQ ID NO: 139400 - RNA, 64 nt, Human
gcagugagccaagacaaugccacuacacuccagccuggacaacagagcgagacucagucucaaa

SEQ ID NO: 139401 - RNA, 64 nt, Human
cuggaccccaggggucugguacagccaagauguucuggacaacauccagcuacuucaaaggcca

SEQ ID NO: 139402 - RNA, 64 nt, Human
cuuucuuggcuguccccuagagcaccagaagugucuggacaaacuccucaauaacugccuuuug

SEQ ID NO: 139403 - RNA, 64 nt, Human
uaaguaguguaucaaaaucuaaaccaaggagucucuggacaagaagcugggagaggcacaaacu

SEQ ID NO: 139404 - RNA, 64 nt, Human
cgccucugcccgggagaaagcccaggccagccugcuggacaagcagagaccaugagaaggagag

SEQ ID NO: 139405 - RNA, 64 nt, Human
gaggcugugaaugcugagaccagaguuuaucaugcuggacaagccuggaaggaggcaauaagug

SEQ ID NO: 139406 - RNA, 64 nt, Human
guggugagccgagaucgcgccauugcacuccauccuggacaacaggagugaaacuccgucucaa

SEQ ID NO: 139407 - RNA, 64 nt, Human
gaggauugcuugaguccaggaauuugagaccagccuggacaacacagugagaccucaucucuau

SEQ ID NO: 139408 - RNA, 64 nt, Human
gagagcaucauggggcagacagaugguggauggucuggacaagaagcgaguaagccacugcggu

SEQ ID NO: 139409 - RNA, 64 nt, Human
gcaguaagccaagaucacaccacugcacuccaaccuggacaacagagcgagacuccaucucaaa

SEQ ID NO: 139410 - RNA, 64 nt, Human
cagcggccccugcauccccuuggcugugaggccccuggacaagcagagguggccagagcuggga

SEQ ID NO: 139411 - RNA, 64 nt, Human
auuuauauuuauaugcccgcucucauggugaaggcuggacaaggugcuccucuggccccuccuu

SEQ ID NO: 139412 - RNA, 64 nt, Human
augcauauuagccagguaaugcacuuuagcuacccuggacaaugcuaucaagugugcugggaag

SEQ ID NO: 139413 - RNA, 64 nt, Human
caccacuaccauggacuggacaccuucacuccagcuggacaaagacucuggagagagagccauu

SEQ ID NO: 139414 - RNA, 64 nt, Human
cggcugccauuggagccaauguguggcucagugccuggacaaaugaugccauggcagacaguag

SEQ ID NO: 139415 - RNA, 64 nt, Human
uaacacuaucauggacuacaccaggguccugguccuggacaaaggaguaguagcugaauuugau

SEQ ID NO: 139416 - RNA, 64 nt, Human
ucuaccuuuuuucauaggaguagacacuagcaagcuggacaaacuaucacaaaaguauuuguca

SEQ ID NO: 139417 - RNA, 64 nt, Human
ggcccugccucugcccagcgagaggccgugggcucuggacaagccgcccuucaggcugggguag

SEQ ID NO: 139418 - RNA, 64 nt, Human
cagcugaaaaacuagaccugugccauuggggaagcuggacaaagucuagggggcccgccuggua

SEQ ID NO: 139419 - RNA, 64 nt, Human
ucugccuucacaugugagacgguggacuuuuccucuggacaaaaugacagcauccuggcgacuc

SEQ ID NO: 139420 - RNA, 64 nt, Human
gucugugccugcccagcauguucccaaaucugugcuggacaagcugugggaagcguucuuggaa

SEQ ID NO: 139421 - RNA, 64 nt, Human
guggggggcaguucagugaagucuagaagaccugcuggacaaauucuaaaagagcuagagcugu

SEQ ID NO: 139422 - RNA, 64 nt, Human
accucccaccuuuggagaggaauccuucccuccccuggacaaaguugcugacaagcugcugaag

SEQ ID NO: 139423 - RNA, 64 nt, Human
ucuugacccuggcuguguacuagccaaaaugcaacuggacaaccccagcaagguucagcaggug

SEQ ID NO: 139424 - RNA, 64 nt, Human
ccaagcaaagacacacaucaucaacuuccaaugucuggacaacuccuuccuguugagggucgag

SEQ ID NO: 139425 - RNA, 64 nt, Human
uccucacugcugagcuccucaccuggacagucuccuggacaaggaguuuccagcugcuggcugg

SEQ ID NO: 139426 - RNA, 64 nt, Human
ugggaauuuaaaaacgaauuguauuuucucucuccuggacaacuuccccaggaaccccguacca

SEQ ID NO: 139427 - RNA, 64 nt, Human
gugaacauggccacugacuuuucugccacucuaacuggacaacuggaagacuuggaaaggccuc

SEQ ID NO: 139428 - RNA, 64 nt, Human
guguuucuguccggaggaaauggaucuuaggccacuggacaagaaccugcacccaagggcccug

SEQ ID NO: 139429 - RNA, 64 nt, Human
gcacaaguaacuugaauagcacaucaauagguuacuggacaaaagcagaaaaaccuguuacagg

SEQ ID NO: 139430 - RNA, 63 nt, Human
aaaaaggagaaagccacuaagguacaaaagacacuggacaaccauauugcaaucagaucuaca

SEQ ID NO: 139431 - RNA, 64 nt, Human
aaucucaugcaucaguucauagcauaaaaucuagcuggacaacuaagaagcuaugguagcaaac

SEQ ID NO: 139432 - RNA, 64 nt, Human
cugucuccagaaggggacaggcaguccgcggucucuggacaaucaacucaagguacgcccacug

SEQ ID NO: 139433 - RNA, 64 nt, Human
gcuucugacgccaaaugggcuucccauggucacccuggacaaggaggcaaccaccccaccuccc

SEQ ID NO: 139434 - RNA, 64 nt, Human
auagcuucauccuugauaacguccuaauuuccuucuggacaaccuccuugaccaauggcauauu

SEQ ID NO: 139435 - RNA, 64 nt, Human
gagaaucgcuugagcccaggaguucgagaccagccuggacaacauagugagaccccgucuaugc

SEQ ID NO: 139436 - RNA, 64 nt, Human
guguccuggaggagaaaagcauuagagggggcagcuggacaagcucccaacugcagagucccag

SEQ ID NO: 139437 - RNA, 64 nt, Human
accucauuucaggcaccagauuggucgcuacacccuggacaagugacugcccgucucugagccu

SEQ ID NO: 139438 - RNA, 64 nt, Human
cauguccuucccccacuaaauggccagagaggcccuggacaaccucuugcggcccuggcuucau

SEQ ID NO: 139439 - RNA, 64 nt, Human
gcaccuguagucucagcuacucagggggcugaggcuggacaauggugugaacccaggaggcggu

SEQ ID NO: 139440 - RNA, 64 nt, Human
gguuuccuugccucacccgcggagagcgcugaaccuggacaagcagcggcugggaaggacaggu

SEQ ID NO: 139441 - RNA, 64 nt, Human
caccagggccccaccagaccauggguuccuuauucuggacaaacccuccucugcuggaacccug

SEQ ID NO: 139442 - RNA, 64 nt, Human
cguccccagagcaggucagcgucucgagaggccccuggacaauugaggaugcccauccccuccc

SEQ ID NO: 139443 - RNA, 64 nt, Human
gaggauagcuuaagcccaggaguucaagaccaaccuggacaacauagcaagaccccaucucuua

SEQ ID NO: 139444 - RNA, 64 nt, Human
gaucgccaucacuaaaacaauuuuagaaucacaccuggacaaucucgugcuaccuacauacugc

SEQ ID NO: 139445 - RNA, 64 nt, Human
cugaaaugucauaucugaaggaagaaagcagcagcuggacaauguuucuuugcaaagcaacacu

SEQ ID NO: 139446 - RNA, 64 nt, Human
uaccgucaucccuaucccaucacuuugugucauacuggacaagacgcuuaacugcucugugcua

SEQ ID NO: 139447 - RNA, 64 nt, Human
gagccgucccgggccccuacagcgugcacaggugcuggacaaguucauucacguggcacaggug

SEQ ID NO: 139448 - RNA, 64 nt, Human
gccugagugcuggcccaauuacugcugaguggcccuggacaaaguuguuucucucccugggccu

SEQ ID NO: 139449 - RNA, 64 nt, Human
ccaggucuugaugggagggaggagggcccagaagcuggacaacuuaagccacuccuuggccucc

SEQ ID NO: 139450 - RNA, 64 nt, Human
cccuucagccccccggcugaugccaucucugguucuggacaauuaucaaauauaucagugggga

SEQ ID NO: 139451 - RNA, 64 nt, Human
ggaggccgaggcagguggauugcuugagcucagccuggacaacauggcaaaaccccaucuauua

SEQ ID NO: 139452 - RNA, 64 nt, Human
gaagauugcuugagcucaggaguuugaaaccagccuggacaacauauagcaagacucugccucu

SEQ ID NO: 139453 - RNA, 64 nt, Human
ggguggcuuacaaggucaggaguucaagaccacccuggacaauauggugaaacccugucucuac

SEQ ID NO: 139454 - RNA, 64 nt, Human
agggaagggggacccaaggcaggagguacaccagcuggacaaauugcagggaggggagggagcg

SEQ ID NO: 139455 - RNA, 64 nt, Human
cccugagaucugggcauaggcaccgcauucugaucuggacaaagucgggacagcaccaucccag

SEQ ID NO: 139456 - RNA, 64 nt, Human
uggugguggucuuaaggaccuaccacaucaacaucuggacaacccucacugauuaccugcccuu

SEQ ID NO: 139457 - RNA, 64 nt, Human
cgaguaccagcugauugacugugcccaguacuuccuggacaagaucgacgugaucaagcaggcu

SEQ ID NO: 139458 - RNA, 64 nt, Human
uggaccacacaggagaagcucggacuuggcacuccuggacaaccuggacccagaugcaagacac

SEQ ID NO: 139459 - RNA, 64 nt, Human
acuuuuaggaacaccagucuauuuuuacugagagcuggacaacagcaaacacuugacaaauaaa

SEQ ID NO: 139460 - RNA, 64 nt, Human
uaaaaguugugcauguauguauacaguugcaagucuggacaaauguauagaauaaaccuuuuau

SEQ ID NO: 139461 - RNA, 64 nt, Human
gaaguggcaauauaaggggaugaggaaggcaugccuggacaaacccuucuuuuaagaugugucu

SEQ ID NO: 139462 - RNA, 64 nt, Human
ggggaucacuugagcccaggagucuaggaccagccuggacaacauggugagaccucgucucuac

SEQ ID NO: 139463 - RNA, 64 nt, Human
ucuccuuggggcccagaggaagcugaugucauggcuggacaaagucacggaguaaagccagcaa

SEQ ID NO: 139464 - RNA, 64 nt, Human
acagugagcuaugauugugccacuguacuccagacuggacaacagagugagaccccaucucuaa

SEQ ID NO: 139465 - RNA, 64 nt, Human
ggggaucgcuugaguccaggaguuugagaccagccuggacaacauggugaaaccccaucucuac

SEQ ID NO: 139466 - RNA, 64 nt, Human
gcagcacaggggacgcaaugggaggcagggacaccuggacaauauuuauuuuugcugaaaccca

SEQ ID NO: 139467 - RNA, 64 nt, Human
gggaauggaaucuagaggaauacguggggugggucuggacaaggagcggcaggaaucaccaccc

SEQ ID NO: 139468 - RNA, 64 nt, Human
gccaaaaguccuguaugcauucauuuauuccuugcuggacaaacucuggaagcagcgugugaaa

SEQ ID NO: 139469 - RNA, 64 nt, Human
uugggcgcccaucauggaggagcaccugaacuuucuggacaagaccucuggccgaccuggggau

SEQ ID NO: 139470 - RNA, 64 nt, Human
gaggaucacuugagcacaggaguucgagaccagccuggacaacauagugagacccccaucucua

SEQ ID NO: 139471 - RNA, 64 nt, Human
ucagccucaggaaagguggucaggaaaacucuggcuggacaagggucagucuucggggucagca

SEQ ID NO: 139472 - RNA, 64 nt, Human
acuuguuuucaaaauaucaucucaucaacgaggccuggacaaacaagcccugaggagggaucug

SEQ ID NO: 139473 - RNA, 64 nt, Human
ggggugguguccuucuccucuuguagccagaauucuggacaacccaagucucugggccccaggc

SEQ ID NO: 139474 - RNA, 64 nt, Human
cuuggcugagaaacuguugagucaggcuagaggacuggacaagagaagaggcauugagagcccc

SEQ ID NO: 139475 - RNA, 64 nt, Human
auguuucuuacaucuuguuuuuacucauuucugacuggacaaaguucuuccaaacaauucugag

SEQ ID NO: 139476 - RNA, 64 nt, Human
gccuguggccccgaggcugggacacuguguggcccuggacaagccacagccccugccugggucu

SEQ ID NO: 139477 - RNA, 64 nt, Human
caaggcaagugacuagacucgcgcuaauacagugcuggacaacacauucaccuuuucugugaac

SEQ ID NO: 139478 - RNA, 64 nt, Human
gcugaagaguugggcgaggugcagagacuucuagcuggacaaccuacacaaaccuuagcgucua

SEQ ID NO: 139479 - RNA, 64 nt, Human
ugccagagucucuagggcaaggagaaacaacuagcuggacaauacucaauucacaacuuagcau

SEQ ID NO: 139480 - RNA, 64 nt, Human
ucaacucuuggggcacuccuggauccuaucugcccuggacaaggugcugaggugcauuguccug

SEQ ID NO: 139481 - RNA, 64 nt, Human
ucauguguuucaucuguaguaauauagccacaaacuggacaagaagcuggguauuuggguuuaa

SEQ ID NO: 139482 - RNA, 64 nt, Human
cccacaccaacaccaaauccaucagcaaauucuacuggacaauccucccuuuuaguagcagagu

SEQ ID NO: 139483 - RNA, 64 nt, Human
caaggaagaaauggagucugcuccugagaagcuucaaauucaggccaggagagaagucuuaaga

SEQ ID NO: 139484 - RNA, 64 nt, Human
aaaacuuuaaaaggcaggaaagagaauucuuaggcaaauucagagaaauaagugcuaguuaaua

SEQ ID NO: 139485 - RNA, 64 nt, Human
uuguaucaggaaacucagaagcaguuugccuugucaaauucaaucucaauggccauuguccaca

SEQ ID NO: 139486 - RNA, 64 nt, Human
agaaauacuuuuucagaaacgaauccauagcugacaaauucacucagugcccaauauauuguga

SEQ ID NO: 139487 - RNA, 64 nt, Human
aucuauauuuuaaacuagaaauuauauuagaacucaaauucaauguuauacauacuugguaaac

SEQ ID NO: 139488 - RNA, 64 nt, Human
uaagcauuuuaagaaacauuuuuaaagugugcuacaaauucauuugguguacuaacaucaaaau

SEQ ID NO: 139489 - RNA, 64 nt, Human
aaauuacuuuguggacuguguuuucaaaacuuugcaaauucaucuguuacacagaaaauuuuga

SEQ ID NO: 139490 - RNA, 64 nt, Human
uugccagccagcuuggguucuaaagugauuuaaucaaauucaugcuccugaucuuuuuuuuccc

SEQ ID NO: 139491 - RNA, 64 nt, Human
acacggggacaauugucaaaggagcgggggagggcaaauucaccagcaggggcuaggaauuuag

SEQ ID NO: 139492 - RNA, 64 nt, Human
acuacucuugaucacauuagcuaugaggcgaggucaaauucagguaucuaagacuaaugauuuu

SEQ ID NO: 139493 - RNA, 64 nt, Human
ccucccaaccccagugccucagucaauaaauuugcaaauucaugagaauuuuuaggucuccaag

SEQ ID NO: 139494 - RNA, 64 nt, Human
uugaugacuucucuaaaaggagcuuuggaaacuucaaauucagcuauaggauaguaccaaugaa

SEQ ID NO: 139495 - RNA, 64 nt, Human
cccuccucugcucuccaucauaacugcuauuagccaaauucaggcccagucaucuccuaucuga

SEQ ID NO: 139496 - RNA, 64 nt, Human
ugcaaacaacugauauaugcagacaaauuuuugacaaauucaccuuuuaaacacacuuaaccau

SEQ ID NO: 139497 - RNA, 64 nt, Human
uugaaauauaauagcugcaucagcccugaaaagccaaauucaaccacauggcuggagaaucauu

SEQ ID NO: 139498 - RNA, 64 nt, Human
augcucagaugaaaaacagauguuauccucagcacaaauucaguaaagagacuacaaaaggaug

SEQ ID NO: 139499 - RNA, 64 nt, Human
augacuguuacaguuuuauuuggcuguuuaaagccaaauucagcuauuuaauuaugguuucaug

SEQ ID NO: 139500 - RNA, 64 nt, Human
acuguggcacgguugcucaacacaucaccucggacaaauucaggaagcauuucuuuagcccaca

SEQ ID NO: 139501 - RNA, 64 nt, Human
uuuuauauuaaaguaaauggcauggaguauagugcaaauucauuuuuaagauagaacacaaaac

SEQ ID NO: 139502 - RNA, 64 nt, Human
aagcucagaugaugguaucugugaguauguuuugcaaauucaaaauauaguuugguaauuuuuu

SEQ ID NO: 139503 - RNA, 64 nt, Human
gauccuuggauguaagaaccaagucauuacaugucaaauucaauuuuucugccuuaagaaugaa

SEQ ID NO: 139504 - RNA, 64 nt, Human
gauaguuugaucuagaaaccagcagcuacuggcucaaauucagguucuggcgucaaauagcgac

SEQ ID NO: 139505 - RNA, 64 nt, Human
aggucuuccggggccaugggcauuuguuuagagccaaauucauccucuuaccagauccuuuucc

SEQ ID NO: 139506 - RNA, 64 nt, Human
ccuucaaauacucagcauuaccauugguugaggccaaauucagagcuuucucaaaucagauuua

SEQ ID NO: 139507 - RNA, 64 nt, Human
ucugaauuuucaggaaccgucaaaggagcagcagcaaauucacauauuuucgacuugagaaaug

SEQ ID NO: 139508 - RNA, 64 nt, Human
ccauaaccacugaagggaaucacaucuuuuaagacaaauucauauucuuuuauuuguuauggca

SEQ ID NO: 139509 - RNA, 64 nt, Human
uuuuuuuucuuauaaaagccguaacccagucagacaaauucaccuucacuuaggccccuguucu

SEQ ID NO: 139510 - RNA, 64 nt, Human
guggagucagguuuucuauuccuuucuguguuugcaaauucaguguuaacuaaauaaagguauu

SEQ ID NO: 139511 - RNA, 64 nt, Human
uaaaucuuuauauacagaaauaucaguacuugaacaaauucaaagcacauuugguuuauuaacc

SEQ ID NO: 139512 - RNA, 64 nt, Human
cuuuagaccauuagacaauugacacuggauuaaacaaauucacauaaugccaaauacacaaugu

SEQ ID NO: 139513 - RNA, 64 nt, Human
cacaaagccuuuauucuauauaauuuuauaaacacaaauucaugauuaucuguuuugagaguuu

SEQ ID NO: 139514 - RNA, 64 nt, Human
ucagaaaguaacaaucuauggcuuauuucuaugacaaauucaagagcuagaaaaauaaaauguu

SEQ ID NO: 139515 - RNA, 64 nt, Human
aagcaugaagcaaauaucuuuuauuggaaauaugcaaauucaauacuuuuccauuauagucuau

SEQ ID NO: 139516 - RNA, 64 nt, Human
gcuaggaguaggaugaugauucaaagugguaacccaaauucauaaagcaauaauaauaaaaacc

SEQ ID NO: 139517 - RNA, 64 nt, Human
ucucaguuuagcauaaccucuuauggauuuucaucaaauucagcguguuggucacuggaaagag

SEQ ID NO: 139518 - RNA, 64 nt, Human
ggccuuccuggcuuuuuucuuuccucccuuaccccaaauucauugagcacuuaaaggagcagag

SEQ ID NO: 139519 - RNA, 64 nt, Human
ccaccaaauuaggauagaauaauugcuggauaaacaaauucagaauaucaacagaugaucacaa

SEQ ID NO: 139520 - RNA, 64 nt, Human
uccugguucacucagaagauaagucucuccaaagcaaauucacaugcauuaugagucgcuuuga

SEQ ID NO: 139521 - RNA, 64 nt, Human
uugcugguuucaagaaaugaggugauccuauuaucaaauucaaucugaugucaaauagcacuaa

SEQ ID NO: 139522 - RNA, 64 nt, Human
uagcauuguaguaauggugaugaauaugcucugccaaauucauccagucugcaccaucuuauag

SEQ ID NO: 139523 - RNA, 64 nt, Human
caggagagugaugauggagcauauagaucuggcucaaauucagccuccaucacuuaccagucag

SEQ ID NO: 139524 - RNA, 64 nt, Human
uacagaauggaaaauaauauuuugggcaagcaaacaaauucacugagaauuccaaaaguauauu

SEQ ID NO: 139525 - RNA, 64 nt, Human
ucucauuuuuaauuguccuguaauggaacaguagcaaauucacuaaacuuuuguguucagaguu

SEQ ID NO: 139526 - RNA, 64 nt, Human
aaaagacuuucuuaaauauuucauuuaugaccugcaaauucaagaauaaagacacugaaguaag

SEQ ID NO: 139527 - RNA, 64 nt, Human
auuucuuuuauucuuugcacaacaacaacaacaacaaauucacggaaucuuuuaagugcugaac

SEQ ID NO: 139528 - RNA, 64 nt, Human
aauaaaaugcucucaaguccuuugaauguuccaacaaauucaaaacuucauuuucugaauguuu

SEQ ID NO: 139529 - RNA, 64 nt, Human
aaguauacucuguuauagucaacaaaguuaaauccaaauucaaaauuauccauuaaaguuacau

SEQ ID NO: 139530 - RNA, 64 nt, Human
cauguuuaagauaaaauacaaacuuuaccuaccccaaauucauaaaguacauuuagugcuguau

SEQ ID NO: 139531 - RNA, 64 nt, Human
uuugaacucuguuaacauuugaaaaauauauuuucaaauucacuuucuaauuggccaaaagaga

SEQ ID NO: 139532 - RNA, 64 nt, Human
auauauuacuaaaucaguuauuauuuuacuuuuccaaauucagagaaagaaaacagauuaccug

SEQ ID NO: 139533 - RNA, 64 nt, Human
cagcagaagccaaauuuuuuguauauuaaagcaccaaauucauguacagcaugcaucacggauc

SEQ ID NO: 139534 - RNA, 64 nt, Human
gaaggcugcuguacugguugaauugugucccccucaaauucacauccuucuuggaaucucaguc

SEQ ID NO: 139535 - RNA, 64 nt, Human
agcauuauuaaguuuccaaauuuaauuugaauuccaaauucaccuagcaauaaaaucuaauuuu

SEQ ID NO: 139536 - RNA, 64 nt, Human
ugauggggaaaagucucuuguaaguaaaaguagucaaauucaaauggccuuuucucuccauucu

SEQ ID NO: 139537 - RNA, 64 nt, Human
uggugccugcauuuauaauuauuuaugugaaagucaaauucauguacaguaaauuuguuauaag

SEQ ID NO: 139538 - RNA, 64 nt, Human
aauauuuuugcuccagaaagacauguucuuuucucaaauucaguuaaaaugguuuacuuuguuc

SEQ ID NO: 139539 - RNA, 64 nt, Human
auaagaauguuuaugaauaguuuccaaauuauggcaaauucauguagagagagaaaaguaacug

SEQ ID NO: 139540 - RNA, 64 nt, Human
aagcuuaaucuccaauaaacaucuauguuaaauccaaauucagcauuugcuguuagcuauucag

SEQ ID NO: 139541 - RNA, 64 nt, Human
caacuaacaacugacaaaucagaguuugccaguucaaauucagcauggcugcagcugauuaaga

SEQ ID NO: 139542 - RNA, 64 nt, Human
aauaagaauaacucagaaacucaaaaggaaaccacaaauucagcuaauaauagcauuucgagua

SEQ ID NO: 139543 - RNA, 64 nt, Human
gagauuuuaacuucacuucaugcugaugauguaucaaauucauuuuauagaaagauuuaaaguu

SEQ ID NO: 139544 - RNA, 64 nt, Human
aggguguuaaacuuuuuaccaaguacaaaaaucccaaauucacuuuauuauuuugcuucaggau

SEQ ID NO: 139545 - RNA, 64 nt, Human
uuuuuaaacuuguuagaaaucccuggaggcauuucaaauucaucuucuaaccuaccuaagcacu

SEQ ID NO: 139546 - RNA, 64 nt, Human
gaucaaaaauguaauuuguaaacacaaugauaagcaaauucaaaacuguuaugccuaaauggug

SEQ ID NO: 139547 - RNA, 64 nt, Human
uuuugaaaauaaccuaauuaauauauuaaaauuccaaauucauggcaugcuuaaauuuuaacua

SEQ ID NO: 139548 - RNA, 64 nt, Human
augaaaucaaaaaaugcauugauacucauuaaugcaaauucauuauuuaacaucaauaucagag

SEQ ID NO: 139549 - RNA, 54 nt, Human
cagaagaaaugugugauuaaaauccaaauucaugcuguuuuuuuucucugcaac

SEQ ID NO: 139550 - RNA, 64 nt, Human
uugguaaauuagaauacuuuguaauuuguaagaccaaauucauacuaauuacccgcgugaaagg

SEQ ID NO: 139551 - RNA, 64 nt, Human
gcggcacaagaaugggcagacugaagacuguguccaaauucagcagaaguggaaugacaugacc

SEQ ID NO: 139552 - RNA, 64 nt, Human
uggcucugucacuaaauggcagugagaugucagacaaauucauucccuucucucagccuccacu

SEQ ID NO: 139553 - RNA, 64 nt, Human
ggaaauaacuugagaaauucauaugguuauguuacaaauucauauucuguuacuacaguaaacg

SEQ ID NO: 139554 - RNA, 64 nt, Human
aaaccaagggauaaaacuguucauggaugcaacucaaauucagaugauccucaacucaugggaa

SEQ ID NO: 139555 - RNA, 64 nt, Human
ugguaauuaagcuuguauucacaagacuucaugccaaauucacuuuuuagcauuauaucuaaca

SEQ ID NO: 139556 - RNA, 64 nt, Human
gcagagaugacuugcaucccagcuuuccaccaaccaaauucaaacauucacugcuuauuuguua

SEQ ID NO: 139557 - RNA, 64 nt, Human
cacuagcuaauaucaauagaaggauguacauuuccaaauucacaaguuguguuugauauccaaa

SEQ ID NO: 139558 - RNA, 64 nt, Human
cagcauaaauggguuagcuacugucaucaguuagcaaauucauccacacaaacacaauuagagu

SEQ ID NO: 139559 - RNA, 64 nt, Human
aacuaaaaugcauuccauuccucugaaagcaaaacaaauucauaauugagugauauuaaauaga

SEQ ID NO: 139560 - RNA, 64 nt, Human
auaagucagaggaaaagcaaaauauaggucuguccaaauucauacaacuugugggugaguucca

SEQ ID NO: 139561 - RNA, 64 nt, Human
uuuccccgauauucuccuucugucaaagucagaacaaauucagggaauuuauuuucuggcaguu

SEQ ID NO: 139562 - RNA, 64 nt, Human
uuccuagcaccugucggaaggucaaggccaaaggcaaauucaaggccagacugugacaaaccca

SEQ ID NO: 139563 - RNA, 64 nt, Human
aaauucuuauaggcuagacuuagauucauuaacucaaauucaaugcuucuaucagacucaguuu

SEQ ID NO: 139564 - RNA, 64 nt, Human
guagagguuuacaaagaguacaaagguuaaauuacaaauucauucccagccuaggcucugggca

SEQ ID NO: 139565 - RNA, 64 nt, Human
auccauaaugcucccuacaucucacacuaacaggcaaauucagaugcugggauuggcaaugauu

SEQ ID NO: 139566 - RNA, 64 nt, Human
guugacaauuucuguagucuuuccuaguugugaucaaauucagccuauggauggccuauuuuau

SEQ ID NO: 139567 - RNA, 64 nt, Human
uucuugcuuguucucucuguacucaaaccuguggcaaauucauccuagcaacguuauuugacga

SEQ ID NO: 139568 - RNA, 64 nt, Human
aagaauuaugcugguaguaaaugggacucugagucaaauucagaacgagaugucacuaaaaaca

SEQ ID NO: 139569 - RNA, 64 nt, Human
cccagcuugaaaauugagccugauaacaagauuacaaauucacaauaccuaauacuuagggaaa

SEQ ID NO: 139570 - RNA, 64 nt, Human
caaagaugauuucuuugacacuugaaauaaaauacaaauucaacaaaaaguagaucagcauuau

SEQ ID NO: 139571 - RNA, 64 nt, Human
agauagguucuuucuguauaugaaacgcuccccgcaaauucacuggcagcucagaauuauucug

SEQ ID NO: 139572 - RNA, 64 nt, Human
augguuuggcagugcaagaauucuguaacauuaacaaauucaauaaaaaguaaauauauggauu

SEQ ID NO: 139573 - RNA, 64 nt, Human
agaaaaauaaaaugaaaggaaaaaaaaaaguuugcaaauucagacaggaaacaggugagugguu

SEQ ID NO: 139574 - RNA, 64 nt, Human
aguuuuuugcuguaccacaaaauuuuagguuaggcaaauucacaaauacggaauccaugaauaa

SEQ ID NO: 139575 - RNA, 64 nt, Human
ggaccagaaaccacuguuauguacaaaaaaauggcaaauucaauaaacucaaauuuaaaauaau

SEQ ID NO: 139576 - RNA, 64 nt, Human
guugugaaugaugcuuuuuuguauuuauuaauaucaaauucacuuaugaauaaacuugauaaug

SEQ ID NO: 139577 - RNA, 64 nt, Human
cucagucugcauguaacuuuuaugauaguuauuccaaauucaagaagaagcaguauuaacauca

SEQ ID NO: 139578 - RNA, 64 nt, Human
auugaaacaccuuaaucugugguuacuaauccagcaaauucaaggaaccaggcuaugacuaaga

SEQ ID NO: 139579 - RNA, 64 nt, Human
caacauauagaguguuuaaaauagcauuucugggcaaauucaaacucuugugguucuaggacuc

SEQ ID NO: 139580 - RNA, 64 nt, Human
cuuaaaacuugggcacuuuuauuuguuuuuaucccaaauucauguuuuaaggccuuuaaagaau

SEQ ID NO: 139581 - RNA, 64 nt, Human
agguaauggauuuugcuuuaaaaugucugccuuacaaauucauaacaacaagauuugucaguca

SEQ ID NO: 139582 - RNA, 64 nt, Human
aguacacagauaaagcaugguuuguuucagucuccaaauucaaaccuuugaguaauaaaucagc

SEQ ID NO: 139583 - RNA, 64 nt, Human
guuugcuguuuuuaccacuuauuucaugcccugccaaauucaaguuacacagacuuccauuuuc

SEQ ID NO: 139584 - RNA, 64 nt, Human
cucgucucuuuccggagccccagcgucuccugcccaaauucaccgcggaaagggcccggggcgg

SEQ ID NO: 139585 - RNA, 64 nt, Human
ucagaaaacagagaaaggguaauuuccuuugcuucaaauucaaggccuuccaacgcccccaucc

SEQ ID NO: 139586 - RNA, 64 nt, Human
cacacacacacacacacacacaauuaaguugcugcaaauucaaaagcuuagagagaauaagcuu

SEQ ID NO: 139587 - RNA, 64 nt, Human
cggaauaagaaaggauuaaacaguuacaagccuccaaauucaaauaaaauuaaaucacaguuca

SEQ ID NO: 139588 - RNA, 64 nt, Human
uguuugugcucaauuucagacacucauuuauaaacaaauucaaccaagggauauuuacugcuuu

SEQ ID NO: 139589 - RNA, 64 nt, Human
auguuaacuaucaucauauggacucuauguaacacaaauucaaaagcaaacuaaaagcuauaug

SEQ ID NO: 139590 - RNA, 64 nt, Human
ucucauccucuguacaaaagccucaagugagggucaaauucaacauuauccugaucuagacagc

SEQ ID NO: 139591 - RNA, 64 nt, Human
uaaucauggggcaugauuauagagguuugacuggcaaauucacuuuuuacucauuuauucucau

SEQ ID NO: 139592 - RNA, 64 nt, Human
auauuaaagaacagcaacuguuaauguuuguucacaaauucagaaaucuaauaggaaaacauga

SEQ ID NO: 139593 - RNA, 64 nt, Human
uaaaaugagaauuguauauuuguuauucauuuugcaaauucagaaaguugguccagauauaugu

SEQ ID NO: 139594 - RNA, 64 nt, Human
gaacacacugaauaaaauaaaggcagugugacuccaaauucagccaucugaauuguuuaaauuu

SEQ ID NO: 139595 - RNA, 64 nt, Human
ucauaauaacuguauuuuaugccuugcauucacgcaaauucacauuggaugugauuuaaaagua

SEQ ID NO: 139596 - RNA, 64 nt, Human
gccccuuaauguguugucaaugagucuaaguugacaaauucaguggcagcccagccaccuccua

SEQ ID NO: 139597 - RNA, 64 nt, Human
gcaaucauagagaaaccugcguaacuccaucugacaaauucaaaagagagagagagaucuugag

SEQ ID NO: 139598 - RNA, 64 nt, Human
aauauguuguuugcuuuccuuaacugaauuucaucaaauucauucagugauuuuuauuuugguc

SEQ ID NO: 139599 - RNA, 64 nt, Human
cuguguaguccucauacuguuuacugauaacccacaaauucauuuucauggcagaccuaagcuc

SEQ ID NO: 139600 - RNA, 64 nt, Human
uuuuuuguaaauuuaaugcaauugaaaaaguuuucaaauucaauuaagauaacuagaauuggau

SEQ ID NO: 139601 - RNA, 64 nt, Human
uaugucaaccuguuauuagaucucuuacucugcucaaauucaucacugaaagauuuaauuuuag

SEQ ID NO: 139602 - RNA, 64 nt, Human
agugugcugacacuuggucuucuccugaaauucccaaauucacugaaugguaccaugccgaucu

SEQ ID NO: 139603 - RNA, 64 nt, Human
guggcuuuuuuuguucaccuaugaugccauguaccaaauucagaagcuaucguuaauaauuugu

SEQ ID NO: 139604 - RNA, 64 nt, Human
ucccacagaauuuacuuuaaaugucacguaaaaacaaauucaccuaagauagucuugcuuauuu

SEQ ID NO: 139605 - RNA, 64 nt, Human
acacuuuuuuuccucuuucucccagcuucaaaugcaaauucaucauugggcucacuucuaauaa

SEQ ID NO: 139606 - RNA, 64 nt, Human
cugucuuggauggggaaguacuaccuggagauuucaaauucacuuggccugcaaacaacagagu

SEQ ID NO: 139607 - RNA, 64 nt, Human
uaaggaaauugaggagagggacugaauagaagcccaaauucauauaaaaguugcguuuaaguug

SEQ ID NO: 139608 - RNA, 64 nt, Human
gcuuuuuaaaaucauauuuaccugugaaucaaaacaaauucaagaaugcaguauccgcgagccu

SEQ ID NO: 139609 - RNA, 64 nt, Human
uuuagcugugcagaaggugaaauggaggaaaccacaaauucaugcaaaguccuuucccgaugcg

SEQ ID NO: 139610 - RNA, 64 nt, Human
uuuauuuugugauacagugacagcuuuauaugagcaaauucaauauuauucauaagcauguaau

SEQ ID NO: 139611 - RNA, 64 nt, Human
uauacaaacauaugcccauuccugugauagcauacaaauucaaacauacagaaacacacacaga

SEQ ID NO: 139612 - RNA, 64 nt, Human
uucgaaauauuuucaaaguguucugucuuaaucacaaauucauauuuuuacacauuuuuacaau

SEQ ID NO: 139613 - RNA, 64 nt, Human
cugaauuauuucaggaaggucuucaaucuuaaaacaaauucauuauucuuuuucaguuuuaccu

SEQ ID NO: 139614 - RNA, 64 nt, Human
ugcauauauauacuucuugcauggaagagcaaaacaaauucaaguugucaugccugauaauuuc

SEQ ID NO: 139615 - RNA, 64 nt, Human
uuggucagugggaaaacuaagggccuccaacaggcaaauucagggaggauagguuucagggaau

SEQ ID NO: 139616 - RNA, 64 nt, Human
uaauggaaugucuuccuuauagaaauguucacgacaaauucauuuguguuuuuuacaugucaau

SEQ ID NO: 139617 - RNA, 64 nt, Human
acgcuuguaaaagacauaagaguuuauaaaggaccaaauucaguuccuugguccuuggaagacc

SEQ ID NO: 139618 - RNA, 64 nt, Human
ccaaaggaucucacuggacuguucaacuuccagccaaauucaaggagcuugcgggaacauuuga

SEQ ID NO: 139619 - RNA, 64 nt, Human
uucaauuuaauuguuuacuuugaagcgguuuuugcaaauucauauuacuuaagcagagggagag

SEQ ID NO: 139620 - RNA, 64 nt, Human
gggugagaggagauagguagcuccauaaggcacacaaauucaaauauuaucauuccuaucacug

SEQ ID NO: 139621 - RNA, 64 nt, Human
aagugcuuccgcccccucacuaccuccuuuaauacaaauucaauaaaaaaggugaaauauauug

SEQ ID NO: 139622 - RNA, 64 nt, Human
uagcaauugcaaaucagcauuuuuugauuuuucccaaauucauuccauauguuuugcuuuacaa

SEQ ID NO: 139623 - RNA, 64 nt, Human
auuugcacugcaagaaaauugaaguuuacgugaacaaauucaugagcauauuuucucuuucucc

SEQ ID NO: 139624 - RNA, 64 nt, Human
aagcuguuguuuuaagaagcaaaagauaguucugcaaauucaaagauacaguaucccuucaaaa

SEQ ID NO: 139625 - RNA, 64 nt, Human
acacauuucaagcucuggccagagucccguuccucaaauucauguguucucuccuuucuaccag

SEQ ID NO: 139626 - RNA, 64 nt, Human
uccagugauuaauagauggguuuuuaguaauugacaaauucaugagggaaagcauaugaucucu

SEQ ID NO: 139627 - RNA, 64 nt, Human
cuucuuuggaaaucaaugccuuugcauagaaaaucaaauucagggaccacaaagaauuuucagu

SEQ ID NO: 139628 - RNA, 64 nt, Human
agagagguggggcuggaugucuccaucucugucucaaauucauggugcacugagcugcaacuuc

SEQ ID NO: 139629 - RNA, 64 nt, Human
uggugggaaaugggcaugagaauaaauaccuccccaaauucaaucugagcccagcaggagagga

SEQ ID NO: 139630 - RNA, 64 nt, Human
accacucaagaagacacuucacguauucuuguaucaaauucaauaaucuuaaacaauuugugua

SEQ ID NO: 139631 - RNA, 64 nt, Human
ggaaaaucgaagugaaacauuugucucuaauacucaaauucaacauauggcucaucucaucuac

SEQ ID NO: 139632 - RNA, 64 nt, Human
auacauuugguaagguuguuaaaggcaauuucaccaaauucacacauuuguacggggcccauuu

SEQ ID NO: 139633 - RNA, 64 nt, Human
uacaaaaaaagagcucccuaauguuuuuauaaaucaaauucagaagcgagaugccauugccaac

SEQ ID NO: 139634 - RNA, 64 nt, Human
cuggagaagaauaucaaauaauaaaguagcaaaacaaauucaaauaauccauuccaaaauacaa

SEQ ID NO: 139635 - RNA, 64 nt, Human
uucuuuaaaaagauacaacucaucuuaccaagaccaaauucaauaagaagcccaaacacuaaaa

SEQ ID NO: 139636 - RNA, 64 nt, Human
gaaucuuaaaaggaagaagaaaagaaaagcugugcaaauucauaguaaaguucguuuuuuauau

SEQ ID NO: 139637 - RNA, 64 nt, Human
aggcuuaaaauauuauaaccacaggguauccagccaaauucaacauuacugcaagucuuagaga

SEQ ID NO: 139638 - RNA, 64 nt, Human
cuuacguauuucuagaccauaaagcaguuuuucacaaauucaucuuuacagaaaaccagcaucu

SEQ ID NO: 139639 - RNA, 64 nt, Human
gcccuucuuggaaguuugcaggauuggaugggaacaaauucagaggaucuuaggugcuggcuug

SEQ ID NO: 139640 - RNA, 64 nt, Human
agugucugucuuaucuuuacuacacauauuguaacaaauucaauauccuagucuucauuuguau

SEQ ID NO: 139641 - RNA, 64 nt, Human
caaagccugcuacaccaauuacuucuaaagaaaacaaauucacuguuauuuugaguuuaugugu

SEQ ID NO: 139642 - RNA, 64 nt, Human
gcgagaaauggaugguggaaggguggcgaauguucaaauucauaugugugguagugauucuugg

SEQ ID NO: 139643 - RNA, 64 nt, Human
uuaguuuuugaaaagcaaaugauguaauucaacucaaauucaugcucuucauuccuauuguauu

SEQ ID NO: 139644 - RNA, 64 nt, Human
guuuuuugaaaagugaauaauguaauucaacucucaaauucaugguuuuuuuuuuuuugguuuu

SEQ ID NO: 139645 - RNA, 64 nt, Human
auuuuuugaaaagcaauugauguaauuuaacucucaaauucauguuuuucuucauuccuauuau

SEQ ID NO: 139646 - RNA, 64 nt, Human
auaucugugauuugaaugagggagcccuuuggggcaaauucaggugcccccauugccucaggcu

SEQ ID NO: 139647 - RNA, 64 nt, Human
cucaugaauguaaugaagaugggaagauauuuaucaaauucaggcuucauucagcaucugagag

SEQ ID NO: 139648 - RNA, 64 nt, Human
agccaucagucaaagaaacuaccuuguuuaguaucaaauucacgccaugcaaaaagauuauaaa

SEQ ID NO: 139649 - RNA, 64 nt, Human
cuauuaaauauauuuaaggguuuuuuuuuuuugacaaauucaacauucaacgaguagacaaaau

SEQ ID NO: 139650 - RNA, 64 nt, Human
cacagaaggcugccggguggggggagggcacccccaaauucaaagaaaacccuaaguguggaug

SEQ ID NO: 139651 - RNA, 64 nt, Human
aagaacagagaccugucuggaaaaucgaucucuacaaauucaauuaaauaaugauccccaaaug

SEQ ID NO: 139652 - RNA, 64 nt, Human
uuacucuuuuaauuuucauccuuugcagguagugcaaauucaacuucaaauaugguguagguuu

SEQ ID NO: 139653 - RNA, 64 nt, Human
caaagauuuucuuggaaauuagaagagcaaaauccaaauucaaagaaacagggcguggggcgca

SEQ ID NO: 139654 - RNA, 64 nt, Human
uacaggcgugagccaccaggcccugccugguuuucaaauucagaaaucuuauuauuuaacccag

SEQ ID NO: 139655 - RNA, 64 nt, Human
auaacaaauauggcuaguuuucaacuucaguacucaaauucaaugauucuuccuuuuauuaaaa

SEQ ID NO: 139656 - RNA, 64 nt, Human
cagucuuuuguucugucugagguuagaauuaauucaaauucagaaucuguugugagaaaugccc

SEQ ID NO: 139657 - RNA, 64 nt, Human
auuucgaccccugagcuuguucggacguaugguccaaauucagauuaagguggucacccaaccc

SEQ ID NO: 139658 - RNA, 64 nt, Human
uuuacuguguggcacccaggcaaaacaugcuccacaaauucaacuuguauauuuggcagauuaa

SEQ ID NO: 139659 - RNA, 64 nt, Human
aagcaaaagaauguauuggaaguugauggaaagacaaauucaucuguaguaguaacuggccgau

SEQ ID NO: 139660 - RNA, 64 nt, Human
uuauuuauaauguauuucugaaccacuuggcagacaaauucacaacacuuaauguucauauuuu

SEQ ID NO: 139661 - RNA, 64 nt, Human
augauucguggagcccuacucacacauuaacccccaaauucaaaaguaagaaugcaaaagucua

SEQ ID NO: 139662 - RNA, 64 nt, Human
gucccuaccauuggccugcaucaugacaaaguuacaaauucaaggagauauaaaaucuagauca

SEQ ID NO: 139663 - RNA, 64 nt, Human
acagagacuguuuggaaucccgccccacauucuccaaauucagggcgcgaucuggcaaaggcuc

SEQ ID NO: 139664 - RNA, 64 nt, Human
acccuguuuuuacauauccaauuccaguaacucucaaauucaauauuuuauucaaacucuguug

SEQ ID NO: 139665 - RNA, 64 nt, Human
gcuggcucaugaaacagcagaauuccagccaaggcaaauucaguuggaucuagggcuugaaaac

SEQ ID NO: 139666 - RNA, 64 nt, Human
uuaauucaccucagacuucagccuaagauucaaucaaauucauccuucagccugucuuguuucu

SEQ ID NO: 139667 - RNA, 64 nt, Human
ugaauacgucacuuaccagugccauugcaggacccaaauucacaguucauaaaagaugugacca

SEQ ID NO: 139668 - RNA, 64 nt, Human
gaguccugcuauuuuccacuccuugcagauaauacaaauucaguuugucagguuggauggugag

SEQ ID NO: 139669 - RNA, 64 nt, Human
uuuucuguuaguguuugaauaucuucauuccucucaaauucauaacaguucuauuuaacugaau

SEQ ID NO: 139670 - RNA, 64 nt, Human
gcuaauggagauuugcugguacauaggaaucuagcaaauucaggaaccaaggggaaauguugug

SEQ ID NO: 139671 - RNA, 64 nt, Human
gcuuaauggagaaauugcaacuuucauuaaaaaacaaauucagaugaaauaucaguaacugucu

SEQ ID NO: 139672 - RNA, 64 nt, Human
gaacaacuuuaucaaggaagcuaguauuuaaaaacaaauucaugagcaagcugcaaaugagaau

SEQ ID NO: 139673 - RNA, 64 nt, Human
uaaagaugggaauaagugcaaaagaggauucuuacaaauucauuaauguacuuaaacuauuuca

SEQ ID NO: 139674 - RNA, 64 nt, Human
uuauaaaacugccugacaauuaugaaaaaauguucaaauucacguucuagugaaacugcauuau

SEQ ID NO: 139675 - RNA, 64 nt, Human
ugccuggauagugaagcaugaggcagcacgugcacaaauucaugugccgugccuuaucugaguu

SEQ ID NO: 139676 - RNA, 64 nt, Human
cagcaacacaaagaauuuuuaaucacacggaucucaaauucacaaauguuaacauggauaagug

SEQ ID NO: 139677 - RNA, 64 nt, Human
gccccuguuaaagaaucagagguugggcagucaucaaauucaucauaaagacaugggcaagugu

SEQ ID NO: 139678 - RNA, 64 nt, Human
aucccaaauaaaugauuaaucuucauugguuucucaaauucagguugaaauacaaauuaauagc

SEQ ID NO: 139679 - RNA, 64 nt, Human
aacguuaguauaaucugaauaaauaaaauguugccaaauucaauguagaaagaaugugacaaca

SEQ ID NO: 139680 - RNA, 64 nt, Human
acaucucauccauucucauauguauucucaaugacaaauucacugaugcccaauuaaaugauug

SEQ ID NO: 139681 - RNA, 64 nt, Human
uccagcugaggggcuggaggaaaacagguauagccaaauucaagaaagauaaaccccugucuca

SEQ ID NO: 139682 - RNA, 64 nt, Human
guguccucauggagaacccaggggacagcuggugcaaauucagaacugagggcucuguuugugg

SEQ ID NO: 139683 - RNA, 64 nt, Human
uguucucucacgguauccuucugucuucccguugcaaauucacuuuucuuucuuccugacauug

SEQ ID NO: 139684 - RNA, 64 nt, Human
gaaagcuaacauuucauacaagauagcuucagaccaaauucaaauugaauuugaauaaauuaga

SEQ ID NO: 139685 - RNA, 64 nt, Human
uuugucccuaugacucagaggaggguuugucgggcaaauucagguggaugaaguaugugugugc

SEQ ID NO: 139686 - RNA, 64 nt, Human
aaagcaacuggauuuacagauuuauugugagacacaaauucacugcugccuuuacacuaagaaa

SEQ ID NO: 139687 - RNA, 64 nt, Human
ugcaaaauucuguuagucagugauucuuuacuugcaaauucaggggcuuagaaaaugaaagcaa

SEQ ID NO: 139688 - RNA, 64 nt, Human
accaacacacacacgaccccucccccaacacccccaaauucaagaguggauguggcccugucac

SEQ ID NO: 139689 - RNA, 64 nt, Human
uaaauagggauuguauucuugaaaacugcuguagcaaauucaucuguggugcaauacacuuuuu

SEQ ID NO: 139690 - RNA, 64 nt, Human
cugcauucaugcaagacugaaauuuauuauuagacaaauucauuauagaaaaaaccuguggcaa

SEQ ID NO: 139691 - RNA, 64 nt, Human
aaauaaaguuuugugaaucuguuuuguauugugacaaauucauaagauaacauugauauuuuga

SEQ ID NO: 139692 - RNA, 64 nt, Human
acuuaauaacugagcaaaguuauauugugauacucaaauucacagcagaguaguuuugaguaac

SEQ ID NO: 139693 - RNA, 64 nt, Human
cagacacauaggaacaguauagacaacccagaaacaaauucauacaucuauggugaccacuuuu

SEQ ID NO: 139694 - RNA, 64 nt, Human
ucaucuguaaaugucagugucugaacagacaacacaaauucaaaucauuauacguguagccaga

SEQ ID NO: 139695 - RNA, 64 nt, Human
auuagaaauuauagaaaaucauguuguccguuuucaaauucaucaacagccuagagugccugag

SEQ ID NO: 139696 - RNA, 64 nt, Human
aaaccacuggaaauaaucaaaugcaaaaagguaacaaauucauaacuggaaagcaaagagaaga

SEQ ID NO: 139697 - RNA, 64 nt, Human
aaaagaaacggggauuucagaagaaaauuguaaccaaauucauacuuuguauaauuuuugauau

SEQ ID NO: 139698 - RNA, 64 nt, Human
ugaaauccaaagcuuggucuagagugaaaaacaacaaauucaguucugaguauaugcaauuagu

SEQ ID NO: 139699 - RNA, 64 nt, Human
aucaacauuauuuuauugugcaauuaaaacaauacaaauucaugguuuuuuaaaguuaaaaauu

SEQ ID NO: 139700 - RNA, 64 nt, Human
aguugauuucaauaauucauccugcuucaagauucaaauucagaaauauacuaucaucuugaau

SEQ ID NO: 139701 - RNA, 64 nt, Human
aacaaacacuuuaugcaagauuggaauguaucuucaaauucagauuuaauaaacauguaaagau

SEQ ID NO: 139702 - RNA, 64 nt, Human
aaauuuggacuguuguucugcuuuuccuggcacucaaauucaugacuaguuuugaggucaaacc

SEQ ID NO: 139703 - RNA, 64 nt, Human
agacugcuuuguaauauuucacuuuguuuuacuacaaauucagaucacuuuguuuuacuauaaa

SEQ ID NO: 139704 - RNA, 64 nt, Human
auggcugcgauuguuagcacuucaucuacacagucaaauucacaggacgcuaagauagacuucg

SEQ ID NO: 139705 - RNA, 64 nt, Human
uguggaucaagaggaaacucugacaugaugauuccaaauucagaaagauuuccaucauuaucca

SEQ ID NO: 139706 - RNA, 64 nt, Human
acgcgagugugcaauguuuggacgagcaacaacacaaauucagaacgugccucuuuccagaucg

SEQ ID NO: 139707 - RNA, 64 nt, Human
ggaacacaucuucccuacaucaggaagacaggcccaaauucaggcauggggugaaauaggagau

SEQ ID NO: 139708 - RNA, 64 nt, Human
cgacaugccuuggauugaguguauaugucuuccccaaauucauauguugaagcuuaaauccuga

SEQ ID NO: 139709 - RNA, 64 nt, Human
gaguuucuauuaucuccaaccucucuuggcauuccaaauucaaggcuacgauauuuucuuauug

SEQ ID NO: 139710 - RNA, 64 nt, Human
cuuaauguuugguaacuuuuaugccuucacuuuacaaauucaagccuuagauaaaagaaccgag

SEQ ID NO: 139711 - RNA, 64 nt, Human
aauaaggauaacucagaauuucaaaaggaaaucacaaauucagcuaauaauagcauuuucagua

SEQ ID NO: 139712 - RNA, 64 nt, Human
ucgccggagcuggccaagccaccgacuugcuucucaaauucacuucaccucccuuagcuuuagc

SEQ ID NO: 139713 - RNA, 64 nt, Human
uuugaacgucaaagaagacucuauuauuuuaccccaaauucaaugaaaugcaguuuuuuuucuc

SEQ ID NO: 139714 - RNA, 64 nt, Human
ugauuuaaauaauuuguaaaauccugcuaacuagcaaauucacauugagauuuucuauugauug

SEQ ID NO: 139715 - RNA, 64 nt, Human
aagaaaacacaaaauccuagcuugggauucccaacaaauucagccuccucucccaggggccuca

SEQ ID NO: 139716 - RNA, 64 nt, Human
augcucucauaacuuguauacauuuuugcagguacaaauucaaaaguauguaagcauuguauaa

SEQ ID NO: 139717 - RNA, 64 nt, Human
uuccauccuuuuuuuuuuuauuuugaggaaaagucaaauucauuguuuauuuuuauauuauuuu

SEQ ID NO: 139718 - RNA, 64 nt, Human
gaaaaaaucuaaugcaaggagggcuaguucacagcaaauucacugccuccucccaugcacgugg

SEQ ID NO: 139719 - RNA, 64 nt, Human
cauggcuuaauguuuauuccugauaauaauugaucaaauucauuuuuuucacuggaguuacauu

SEQ ID NO: 139720 - RNA, 64 nt, Human
uuccugaccucuugucauuuuggccugaaggcuacaaauucagggucagcuguaugcacuaagu

SEQ ID NO: 139721 - RNA, 64 nt, Human
gaacaagaugugcaaccagacacuucagcuuccucaaauucauauaaagaagaugugaauuuaa

SEQ ID NO: 139722 - RNA, 64 nt, Human
uuauguggaaacugcuagacaacuguugaaaccucaaauucauuuccauuucaauaaacuaacu

SEQ ID NO: 139723 - RNA, 64 nt, Human
aagaacuaucuuagaacucagaagaagaaagaaucaaauucauaggauaagucaauaccuuaau

SEQ ID NO: 139724 - RNA, 64 nt, Human
ccccuccuucucugcuuugggucccuucucucaccaaauucaaacuccauucccaccuaccuag

SEQ ID NO: 139725 - RNA, 64 nt, Human
cugcccauuuccauggugcaaaaacucuuauggccaaauucaaacuauaaacaugaugucaacu

SEQ ID NO: 139726 - RNA, 64 nt, Human
uggcccaggauauggcuuugaauggggccuaacacaaauucauaaacuuucuuaaaacauugag

SEQ ID NO: 139727 - RNA, 64 nt, Human
uguauuccugaaaagcugcauuuaaaucaagucccaaauucauugacuuaggggaguucaguau

SEQ ID NO: 139728 - RNA, 64 nt, Human
uuuuagcucaguacacugaaaccauaugauaacacaaauucacauauaauuggggguuaguccc

SEQ ID NO: 139729 - RNA, 64 nt, Human
aggugggaagcuuauaaucuaauuuuaggaggaccaaauucaguggauggcaacuggaacauug

SEQ ID NO: 139730 - RNA, 64 nt, Human
gcccccacguggaacauucuggagcuggccaucccaaauucaaucaguccauagagacgaacag

SEQ ID NO: 139731 - RNA, 64 nt, Human
aacagcaagugucaucuacauccuagccuuuugacaaauucaucuuucaaaagguuacacaaaa

SEQ ID NO: 139732 - RNA, 64 nt, Human
aaacccaaguggaaucaucacuuaauuacuuacucaaauucaaugaaucaaauccaauccaauc

SEQ ID NO: 139733 - RNA, 64 nt, Human
aaagcuucuagucuuaacauacuugcauccacuucaaauucaaaucaaaagccagggaaaucua

SEQ ID NO: 139734 - RNA, 64 nt, Human
uuuuguuuauuuuuaugguaacugcuuucuguuccaaauucaguuucauaaaaggagaaccagc

SEQ ID NO: 139735 - RNA, 64 nt, Human
auuuacauacaccuggaaaccugugccuuguauucaaauucauuaaagccuaauccugcaagua

SEQ ID NO: 139736 - RNA, 64 nt, Human
aaaagcaaaacgcucucacugagaucagggaucccaaauucaugggacuuauauaagaaggaca

SEQ ID NO: 139737 - RNA, 64 nt, Human
ugggaaucuuggagccuaaagagaaaccgaggugcaaauucauuucauggugacugacccuuga

SEQ ID NO: 139738 - RNA, 64 nt, Human
ggacuaaaaauggacaggcugaccucaguguuuacaaauucagaauuuugauagggguagauau

SEQ ID NO: 139739 - RNA, 64 nt, Human
uccauuauaucuaaauuagaaugaucauccugcgcaaauucagauuacuguuugcuggcuaauu

SEQ ID NO: 139740 - RNA, 64 nt, Human
ggacucuuucacuucgggacauuuaauaauggaccaaauucaacagaacaccaggaaggucaag

SEQ ID NO: 139741 - RNA, 64 nt, Human
uacguauauugcaguaucaucuuuccucacacuccaaauucagcuagggaaguugauuccaaua

SEQ ID NO: 139742 - RNA, 64 nt, Human
uuuguuuacuuucugucaagauauuuacccgugucaaauucaaacuacaguacuguguaauuau

SEQ ID NO: 139743 - RNA, 64 nt, Human
gugccguaaaugaucuucacuccuuauccgagggcaaauucacaaggauccccaagauccacuu

SEQ ID NO: 139744 - RNA, 64 nt, Human
cagagccgacaccagacgugauuagcaggcgcagcaaauucaauuuguuaaaugaaauuguauu

SEQ ID NO: 139745 - RNA, 64 nt, Human
ccacauguacacagaguaucuggagaauaaaacccaaauucaaaaaaaaaaaugauaauuuauu

SEQ ID NO: 139746 - RNA, 64 nt, Human
ugacuucccugacuacuaccuucauauuucauuucaaauucaaacuucugagguugcagcauau

SEQ ID NO: 139747 - RNA, 64 nt, Human
ccauuuacaaauaagaggacagauaacugcuuugcaaauucaagagccuccccuggguuaacaa

SEQ ID NO: 139748 - RNA, 64 nt, Human
aaacaacaucaaauuuuuucaugaaaucuugguacaaauucagaucucuuauuuaaaauuuaaa

SEQ ID NO: 139749 - RNA, 63 nt, Human
augggggccccagcaguuaacagggcccagccacaaauucagcugaagggaccaaggugggca

SEQ ID NO: 139750 - RNA, 64 nt, Human
uuuuuaugauguucaucacagugugguaagguugcaaauucaaaacaugucacccaagcucugu

SEQ ID NO: 139751 - RNA, 64 nt, Human
ucaacagucuuggccauuucucaucaaaagaagccaaauucaugaucaacaucucugaaguuuc

SEQ ID NO: 139752 - RNA, 64 nt, Human
agcaacaugagaagugugauacaugugaacccaacaaauucaaaguugcacuuuucaagaugug

SEQ ID NO: 139753 - RNA, 64 nt, Human
auggacauggucuuaaucaauggaguuaaauaaacaaauucagcaaguuauuaaaucugacaug

SEQ ID NO: 139754 - RNA, 64 nt, Human
uucauguuugcuucauaaaugaagcagcuuuaaacaaauucauauucugucuggagugacagac

SEQ ID NO: 139755 - RNA, 64 nt, Human
uccucuguuuucuaggcuuuauaaaguccaauuucaaauucagacgcagaacucuucagauuuc

SEQ ID NO: 139756 - RNA, 64 nt, Human
uucaaaagucaggugcugagagaugguuuaaagacaaauucaugaagguauauuuuguguuaua

SEQ ID NO: 139757 - RNA, 64 nt, Human
gagcgaucaggcgaggccagcgagggugugcuugcaaauucaagcaauaagagggggguuccug

SEQ ID NO: 139758 - RNA, 64 nt, Human
gacgggccaggcugggagugccgccuuccugugccaaauucaguggggacucagugcccaggcc

SEQ ID NO: 139759 - RNA, 64 nt, Human
uccaauuuagauuauuuuuagaguauuuuuccagcaaauucaauuuauucugaaauuuaaaucc

SEQ ID NO: 139760 - RNA, 64 nt, Human
caguaacugaaggagcauguauagcucuuuccuucaaauucaacuagagccuuuuuaaaaagac

SEQ ID NO: 139761 - RNA, 64 nt, Human
uaauccguuuaguaguuaccucccuuuuacuuuucaaauucacaaaauuacauuucucauaaau

SEQ ID NO: 139762 - RNA, 64 nt, Human
gacaggcugugucuccaaaaagaaaaaaaaaagucaaauucaaauaucaucuggacaugucaca

SEQ ID NO: 139763 - RNA, 64 nt, Human
acuaagacacaggagguuuagccugcuuucuuaccaaauucauguuacccagacuuguguucuc

SEQ ID NO: 139764 - RNA, 64 nt, Human
auaacaauguuuauuugaacuaauauuaaauuaacaaauucaguguaaucaaaauguguaaaga

SEQ ID NO: 139765 - RNA, 64 nt, Human
caauuaaaacaugaauuguaguuauaacucaaugcaaauucaacaguuguauuuggaguuaaau

SEQ ID NO: 139766 - RNA, 64 nt, Human
caugcuagugagccaacacaaacaaaaaacaacucaaauucaaugugauuaauuccuaaaauca

SEQ ID NO: 139767 - RNA, 64 nt, Human
uaaaauuacaacuguugucuaaauaagugaaacacaaauucacuuaauagcaucaagauuugaa

SEQ ID NO: 139768 - RNA, 64 nt, Human
aggcacuguauucauugccaauguuccaaauuaucaaauucaagugaauuuauuuguguguucu

SEQ ID NO: 139769 - RNA, 64 nt, Human
acugcccugcauguguucaugaccuccgaaggcccaaauucaugaagcagcaaacccagcagau

SEQ ID NO: 139770 - RNA, 64 nt, Human
aacccuggcugguccuggaagugacaaaaaccagcaaauucaauucuuugcaggcugaguuccc

SEQ ID NO: 139771 - RNA, 64 nt, Human
auuagaaaaguaguauuugauuaggauaacuuuacaaauucaauaguauagccaucacuuauua

SEQ ID NO: 139772 - RNA, 64 nt, Human
cucuuccaguagaggggugagggauucugcuuuucaaauucauaacauugaucuuuuuaugcaa

SEQ ID NO: 139773 - RNA, 62 nt, Human
aagucccuugugaacccugcaauaaacugcuuugcaaauucaucuggaagugucuguguguc

SEQ ID NO: 139774 - RNA, 64 nt, Human
agagcuuuuuaagcacuuauuuaauccucauuaacaaauucauaagguaggugcuauugauagu

SEQ ID NO: 139775 - RNA, 64 nt, Human
ucccucgcugucuggagacggucacaccuucuggcaaauucaagaggcaugaguggaccgagag

SEQ ID NO: 139776 - RNA, 64 nt, Human
guugcuuuauccuaaaaguuuuaaccucagguuccaaauucaguaaauuuuggaaacaguacag

SEQ ID NO: 139777 - RNA, 64 nt, Human
caggccuuuguauuaaaaaugaaaaaugaaaaaacaaauucaaaaccuauucaaauggguucua

SEQ ID NO: 139778 - RNA, 64 nt, Human
gagauuagcauggccccugcacaaggaugacucgcaaauucauaaagcuuuccauaaauauauu

SEQ ID NO: 139779 - RNA, 64 nt, Human
guguucagucuggugccaaacuucgaauggaauacaaauucacauaaucugaacuuuguucaca

SEQ ID NO: 139780 - RNA, 64 nt, Human
uguuuuuuaaaacaauucuguagaaauguuugugcaaauucaguaauucaacuuaaaauauaau

SEQ ID NO: 139781 - RNA, 64 nt, Human
ucuuguaaacauuuaucauuaauauuuaaaagaucaaauucauucaacuaagaauuagaguuua

SEQ ID NO: 139782 - RNA, 64 nt, Human
uuuaaaguuuaauauugaauaaaaggaggauuaucaaauucauauaugauaaaagugaauguuc

SEQ ID NO: 139783 - RNA, 64 nt, Human
gaaacacaauacuuaauguauuguacuagauugccaaauucauaaaauguuaauggaagcuuuu

SEQ ID NO: 139784 - RNA, 64 nt, Human
augaaguuuaguauuugguugacauagugcucuucaaauucaucccauuacccuaaaaguaaua

SEQ ID NO: 139785 - RNA, 64 nt, Human
uagucuuuuuauuuuggcuugcaugaagucacugcaaauucaaaugucaguaccggcauuuaaa

SEQ ID NO: 139786 - RNA, 64 nt, Human
augcugcucagugugguucucaccccugcaagcucaaauucaguucccugaauggagucaggug

SEQ ID NO: 139787 - RNA, 64 nt, Human
gaaacacuugugguuccaagcauuuuggauaaggcaaauucaacuuucagucucuuuucugggg

SEQ ID NO: 139788 - RNA, 64 nt, Human
ucuuacauccacaguaaugagucauaauauuauacaaauucagaguguuauuaaagagguauug

SEQ ID NO: 139789 - RNA, 64 nt, Human
auuuguguguauucugaaacuuucucuuugggaccaaauucauucucaauggcccugaguucaa

SEQ ID NO: 139790 - RNA, 64 nt, Human
cauuguugguuuauugcagauuuguauccugugucaaauucaagguauuauugauaaaccuuuu

SEQ ID NO: 139791 - RNA, 64 nt, Human
aggccauuuaaaaguauguauuuauuagaacaugcaaauucauguugucuccaucaguggucac

SEQ ID NO: 139792 - RNA, 64 nt, Human
ugccagcacuucugcaagcugaaauuuacagaagcaaauucaccagaagggaaacaucucaggc

SEQ ID NO: 139793 - RNA, 64 nt, Human
caggaugcugacagcugcaagcaacaggcacugccaaauucagggaacagugguggccagcuug

SEQ ID NO: 139794 - RNA, 64 nt, Human
aaugggcucauuuaguugccugggcaccuauucacaaauucauuugucagccucuuuuuaguuc

SEQ ID NO: 139795 - RNA, 64 nt, Human
ggagcagagacucugccuggccacugagaacagccaaauucacaaacccucaguggggcuuugu

SEQ ID NO: 139796 - RNA, 64 nt, Human
gcugaggucucucaaacuccuugcacaauuccgucaaauucaaauuauuauuuugguccugguc

SEQ ID NO: 139797 - RNA, 64 nt, Human
cugcuguagaaaaaaaaauucacaugaugcacuucaaauucaaauaaaaauccuuuuggcaugu

SEQ ID NO: 139798 - RNA, 64 nt, Human
uuuacuaaacagaugguucauaagacaugugaagcaaauucauauuugcaauggguaaaaagua

SEQ ID NO: 139799 - RNA, 64 nt, Human
agcaugugcugcauugacucuauuaaucacauuucaaauucacccuacauuccucuccucuuca

SEQ ID NO: 139800 - RNA, 64 nt, Human
ugucuacuagcagagcaacaugugucaauuuaaccaaauucacaaauaacccuccauuuuucaa

SEQ ID NO: 139801 - RNA, 64 nt, Human
uggaggaauugguuguauagaagauccuagugaccaaauucagccuacugccucggaucucucc

SEQ ID NO: 139802 - RNA, 64 nt, Human
auacaggugguaccuguuguggacugaauugcgucaaauucauauguuggagcucuaaccccua

SEQ ID NO: 139803 - RNA, 64 nt, Human
cuuucccugccuccuuccuuaaauagcugacaaucaaauucaugcuauggugugaaagacuacc

SEQ ID NO: 139804 - RNA, 64 nt, Human
ggguauuuuaaccuguauacucuugaauuccucucaaauucagcucugaucugaggcuaagaca

SEQ ID NO: 139805 - RNA, 64 nt, Human
guaauucaaucauguuuaauaugucagucaaaaccaaauucagaauuguuuuguguaccaguca

SEQ ID NO: 139806 - RNA, 64 nt, Human
ccccuuuaccuaaucuaguagauuagccaucuuucaaauucacuuuuauuucaguccuuauauu

SEQ ID NO: 139807 - RNA, 64 nt, Human
aagacuguuucauccucuggggguagaacagaaccaaauucacagcuggugggccagacuggug

SEQ ID NO: 139808 - RNA, 64 nt, Human
agaggugguucuuccucuuacggacugcaaccuucaaauucagcuguggugucucggcaaaggc

SEQ ID NO: 139809 - RNA, 64 nt, Human
gauaggugaauauguaaaucuuuuaucacuuucucaaauucaaacuaaaggggaaagaucaaac

SEQ ID NO: 139810 - RNA, 64 nt, Human
acccugaaggagcuucuuuuccucuggggagaagcaaauucaugaugugugugcuggagaucug

SEQ ID NO: 139811 - RNA, 64 nt, Human; identical to SEQ ID NO: 139808

SEQ ID NO: 139812 - RNA, 64 nt, Human
aagugugugugcgaacgggaacagagacgcaagccaaauucaccuccguggagcugcucaggga

SEQ ID NO: 139813 - RNA, 64 nt, Human
ugauaucuuaauauugucuguucuagguguugcccaaauucagugucagugaaguucuuuuccu

SEQ ID NO: 139814 - RNA, 64 nt, Human
cauguuuaauuagaagugagagguagaaguacuucaaauucaacaggccagcaagcaaucggcu

SEQ ID NO: 139815 - RNA, 64 nt, Human
gaaauaagaguuucaggugucuccccaccuagggcaaauucaugcacauugucauguuauacca

SEQ ID NO: 139816 - RNA, 64 nt, Human
aauuucagcuagauuuggaaaaggaaagguacuacaaauucaaaagauuucacuuuuaacacug

SEQ ID NO: 139817 - RNA, 64 nt, Human
cccuuuucucaucauugggguuagcgggugcagacaaauucagcaauaguaugcagaucagccc

SEQ ID NO: 139818 - RNA, 64 nt, Human
gguaacaagauaaagacaaauccacuucuuuggccaaauucaggcuuuggcuuuaugacuuucc

SEQ ID NO: 139819 - RNA, 64 nt, Human
gauucauuguguuguaagguuauguggguuuugacaaauucauaauggcaugugugcaccauug

SEQ ID NO: 139820 - RNA, 64 nt, Human
cguuuuauagcaaccucucucuacccuaguucuccaaauucacuucugccuuccucagguuuga

SEQ ID NO: 139821 - RNA, 64 nt, Human
ugagcucccgauaaagcuaaaguccaucaucuggcaaauucaguaaauuggagaguacuugcuu

SEQ ID NO: 139822 - RNA, 64 nt, Human
guugcuguaaaauuuguguaaauuuguauccacacaaauucagucucugaauacacaguauuca

SEQ ID NO: 139823 - RNA, 64 nt, Human
gccaggcaguccccauuuuaggaguuggcuucugcaaauucaauccauugagcuaacuguuggg

SEQ ID NO: 139824 - RNA, 64 nt, Human
ccccaucgccagccgggcccucaugcugaccuugcaaauucagccgcugcuuugagcccaaaau

SEQ ID NO: 139825 - RNA, 64 nt, Human
ugcgccauccuuuaggccgaccuuggucacauaccaaauucaauaaaacccaauacuggccugu

SEQ ID NO: 139826 - RNA, 64 nt, Human
gaagcaagagaaaauuccauuuuauaguuagacccaaauucacuaaauaguguguauguucacu

SEQ ID NO: 139827 - RNA, 64 nt, Human
cccaacucuuugcugcacuguccuuuuucuuccucaaauucagacccuccuuccaccggcaccc

SEQ ID NO: 139828 - RNA, 64 nt, Human
agaaaccgaggcccaguacagcucccagcuggcccaaauucagugucugaucgauaaccuggag

SEQ ID NO: 139829 - RNA, 64 nt, Human
aacaggagaaguaaauaaauaagguugccuuuuucaaauucaggguuuuuuuuuuuaaauaaag

SEQ ID NO: 139830 - RNA, 64 nt, Human
uuaacuuguaagucugauuacaucauuauuguuccaaauucauuaucucuguaggaacuuuuag

SEQ ID NO: 139831 - RNA, 64 nt, Human
ucauuggauauaacuuugauucuuaaucagagggcaaauucauuagagaagaauuuuuaguaga

SEQ ID NO: 139832 - RNA, 64 nt, Human
cagauucgaaauucugugccauggcauauauguucaaauucaaaccauuuuuaaaaugugaaga

SEQ ID NO: 139833 - RNA, 64 nt, Human
uauaauuuucacaaaauucuccaauuuucagugucaaauucagugaauuuugaaaacauauaua

SEQ ID NO: 139834 - RNA, 64 nt, Human
ccaauauaaauucucauaagcacuauagaauuugcaaauucagaacauuuuauaccuaaaagua

SEQ ID NO: 139835 - RNA, 64 nt, Human
cauaaagaauugggacucaccccuacugcacuaccaaauucauuugacuuuggaggcaaaaugu

SEQ ID NO: 139836 - RNA, 64 nt, Human
cacacauguuauuuacuucaaaagacaggauugacaaauucagucaauacuauuuuagagauuc

SEQ ID NO: 139837 - RNA, 64 nt, Human
uaaauauuguaucccuuugucaaaccuuguuucccaaauucaauuaaagagaggagagaauuga

SEQ ID NO: 139838 - RNA, 64 nt, Human
aagugaagcuuuaaaauuacuuuuuuaaaauagucaaauucauguuuuuaaguaaguuggccca

SEQ ID NO: 139839 - RNA, 64 nt, Human
acuucuucaauuccagaguuucugagaacagacccaaauucaauggcaugaccaagaacaccug

SEQ ID NO: 139840 - RNA, 64 nt, Human
augaggaaggccuuagucacauuuuagagccagccaaauucacaugggcuguguggcccccuga

SEQ ID NO: 139841 - RNA, 64 nt, Human
augugggaaagccuucagaucugccucacaccuucaaauucaugaaaggacacaaacacacaua

SEQ ID NO: 139842 - RNA, 64 nt, Human
uucuccuuuuuucggaauugaaacauuuuaauuucaaauucaaauagaacauuuaaaaugauuu

SEQ ID NO: 139843 - RNA, 64 nt, Human
gggagccagggaacguuucugaacuaagcaaggacaaauucagagacccugagcuuuagaaaga

SEQ ID NO: 139844 - RNA, 64 nt, Human
uuccuuuguuaaaccaucgucuuauaagcaauagcaaauucauguuagaaacuucuguuuugca

SEQ ID NO: 139845 - RNA, 64 nt, Human
uggugguggguuuuuuuaaggcuuucuacaaaaccaaauucagaauccaggcgucgaccuggug

SEQ ID NO: 139846 - RNA, 64 nt, Human
aaaaaacaaaaacaaaaaaaaaccaccaaauccccaaauucauuccagaucuauuuuucuacca

SEQ ID NO: 139847 - RNA, 64 nt, Human
auuuuucuuuuuuuuuuuacauuuuguauagaaacaaauucauuuaaacaaacuuauuauuauu

SEQ ID NO: 139848 - RNA, 64 nt, Human
uagauuuggcacaucuuuucuuagucuuuugauucaaauucaaaacuuaacagcacaaaccagg

SEQ ID NO: 139849 - RNA, 64 nt, Human
ugugaaccaaauuucagggucaccagaaguucaucaaauucaaaugaauuuggccuggcacagg

SEQ ID NO: 139850 - RNA, 64 nt, Human
ggguagccuugaagucaccagaauaacuaggacucaaauucagaccaaaccaggacuagcuuuu

SEQ ID NO: 139851 - RNA, 64 nt, Human
aauugaguuauugagcacugaaauguggcuaguccaaauucaaaugguguuuuuuuguaaaaca

SEQ ID NO: 139852 - RNA, 64 nt, Human
gucuuuuuauuuaacaauccuuaucuaacaucaccaaauucacauugcagagaaacuucagaaa

SEQ ID NO: 139853 - RNA, 64 nt, Human
cugaaacuaauaauuaggcaaugucaagugaacacaaauucaggaugacagacugcaaaguaac

SEQ ID NO: 139854 - RNA, 57 nt, Human
cuggagccagaacguggugaacacagucaaauucaguguacuugauaauaucaacug

SEQ ID NO: 139855 - RNA, 64 nt, Human
auuucccacccugugccguguuccccaauaaaaacaaauucacaagaguugguucauguucuuu

SEQ ID NO: 139856 - RNA, 64 nt, Human
agcugcagguggagcuggagcaagaauaccaagacaaauucaaaagacugccccucgagauuuu

SEQ ID NO: 139857 - RNA, 64 nt, Human
cauguaugugagauuuuuguuuucuuuccaauagcaaauucaaagcaagcaacuugcaggcucc

SEQ ID NO: 139858 - RNA, 64 nt, Human
caaugacccaaaucucuuccacaagacuuaaaaccaaauucagggacaaauggauagagaagaa

SEQ ID NO: 139859 - RNA, 64 nt, Human
gccugguuuccugggcugggcucaggaaagcugccaaauucaguccuauguuggguccaagcug

SEQ ID NO: 139860 - RNA, 64 nt, Human
caaguggaugggaauuugucagcguucuaccaggcaaauucacuguuucacugaaauguuugga

SEQ ID NO: 139861 - RNA, 64 nt, Human
uugaaaaaugauggccaguuuucagaagugcugacaaauucauauugguaugcaaaagcucauc

SEQ ID NO: 139862 - RNA, 64 nt, Human
ccugauuguuacgcgaaucuagcuuuaacggaagcaaauucauuauuuuuuaaaugcaguggac

SEQ ID NO: 139863 - RNA, 64 nt, Human
uugacuacggaugugaucaacacuaacaaggaaacaaauucaaggacaaccugucuuugagcca

SEQ ID NO: 139864 - RNA, 64 nt, Human
guauggcacuuauuaugaggcuauuaaaagaauccaaauucaaacuaaauuagcucugauacuu

SEQ ID NO: 139865 - RNA, 64 nt, Human
agcucauaccaagagguaacauuuugccccgggccaaauucaggggucuagugcccugcauucc

SEQ ID NO: 139866 - RNA, 64 nt, Human
uccuugugcuuuuuggagcuaagccugggaugaccaaauucaccccagcuccuucauucacagg

SEQ ID NO: 139867 - RNA, 64 nt, Human
ugggagaacccccuccuaguccaccugaaaacaccaaauucaaccaucaucugucaagaaauua

SEQ ID NO: 139868 - RNA, 64 nt, Human
acggugcagcaucagggaccuucccaggccccagcaaauucaagucggucugcagaccucucag

SEQ ID NO: 139869 - RNA, 64 nt, Human
guugaaaugcuggucaccaaaaaaggaaacugagcaaauucauuucaacaacaucaaaacuuca

SEQ ID NO: 139870 - RNA, 64 nt, Human
guaacugccauauuauauaacaaauuuacauucacaaauucaguauccuguuaagugucauauu

SEQ ID NO: 139871 - RNA, 64 nt, Human
acaaagaaaaaagaaaaaaaaauaagcucauacccaaauucacaaagccuauuuuuuaaaccaa

SEQ ID NO: 139872 - RNA, 64 nt, Human
acgaugagcaccaggccccaccuuuguccccuagcaaauucaggguacagcuccaccuagaacc

SEQ ID NO: 139873 - RNA, 64 nt, Human
gagcgacccugugagaagcacuuggcuggcugagcaaauucauccucuggaaauauucucucuc

SEQ ID NO: 139874 - RNA, 64 nt, Human
gggaagugccacucgcuguuuggggcccggccuucaaauucaaaauugagccaugcuuuuucgg

SEQ ID NO: 139875 - RNA, 64 nt, Human
cucccucuggacccccagccaggggcuuggaaaucaaauucagcucuucacuccagcaugcaca

SEQ ID NO: 139876 - RNA, 64 nt, Human
ccaggaccaggugggggugcggcccugugcccuccaaauucacaggggguaccuaggagccagg

SEQ ID NO: 139877 - RNA, 64 nt, Human
aaaggcuggaagacagaaacgaagugaguucaggcaaauucacuguauuguaauuuauuuauag

SEQ ID NO: 139878 - RNA, 64 nt, Human
uguucauaaaguuucauuuuguaugcacugauggcaaauucauuaggucaguuaagggaaauau

SEQ ID NO: 139879 - RNA, 64 nt, Human
uggcuguaauacucauugagccaaguugucauaucaaauucaacccugcuguaaacacauagaa

SEQ ID NO: 139880 - RNA, 64 nt, Human
aacaacccagaaacaaaaaucucuauacagagaucaaauucacacucaauaguauguucugaau

SEQ ID NO: 139881 - RNA, 64 nt, Human
guuucaguuaggauaauuucuauugaucugucuucaaauucacugauguuuuuucucucacccu

SEQ ID NO: 139882 - RNA, 64 nt, Human
gcacugagcagggaucugcccccuaguucagguccaaauucaccuuccccuaaaccccaagcuu

SEQ ID NO: 139883 - RNA, 64 nt, Human
auuugguaauuagguugggccuauaaauauagaacaaauucagggauuuuuaaaaaauuguguu

SEQ ID NO: 139884 - RNA, 64 nt, Human
caccccacccuuguuuccccuugguauuugaugacaaauucagcagaagacccggcuugcucca

SEQ ID NO: 139885 - RNA, 64 nt, Human
aacacuaaacucucaacacuuuaaaagcaacccccaaauucaaccuauguaaugugauuaaauc

SEQ ID NO: 139886 - RNA, 64 nt, Human
gacagugguuauauuucaaccacaccuaaauuaacaaauucaguggacauuuguucuggguuaa

SEQ ID NO: 139887 - RNA, 64 nt, Human
aaugaaacugccuccucucaacccauuuucuuaacaaauucaauuuucaaaacuaaccuuuaaa

SEQ ID NO: 139888 - RNA, 64 nt, Human
uacugaccucacuuuauguaaauacuucgcaugacaaauucaguaacucgucuauuucagcaug

SEQ ID NO: 139889 - RNA, 64 nt, Human
auauaauuuuaaaaaauuucucuccaaccuccuucaaauucagucaccacuguuauauuaccuu

SEQ ID NO: 139890 - RNA, 64 nt, Human
gcccuggcuauugauugauguugcaucaauuuagcaaauucauuuccucauucuugauggccug

SEQ ID NO: 139891 - RNA, 64 nt, Human
uauccauuuaucuuuuacaugaacuugucaugaacaaauucaaauguuuaugccagcaaauuuu

SEQ ID NO: 139892 - RNA, 64 nt, Human
aagaaauuaagaaguuguccgucccacguuacaucaaauucaguuuuauauaggccauauauaa

SEQ ID NO: 139893 - RNA, 64 nt, Human
gauguccaauuuuccagaguaaggauagaggagucaaauucaaauacagguuuucugacauuaa

SEQ ID NO: 139894 - RNA, 64 nt, Human
uuaaagcuauaucauucccaguuauuaguuaacacaaauucagccacauucugaguauuguuug

SEQ ID NO: 139895 - RNA, 64 nt, Human
uguuccugaaagcaccacagcuacucaagaagaucaaauucaggacauaaacuuuauugaacau

SEQ ID NO: 139896 - RNA, 64 nt, Human
uguucauggggccuugauguuggggaaacagagacaaauucaguugugaaaaguauuauguauu

SEQ ID NO: 139897 - RNA, 64 nt, Human
uuucuaaaguuacagauucagcuuuucaaauugucaaauucacuuugaauaauaauagaaccug

SEQ ID NO: 139898 - RNA, 64 nt, Human
uaguuucauuuauuugaagugauuucaaauauuucaaauucaugaauaagaauauuccgucaaa

SEQ ID NO: 139899 - RNA, 64 nt, Human
ucaauguauuaagcaaagcaaaccugccagccagcaaauucaaauaaaaaauaaagcauuaaaa

SEQ ID NO: 139900 - RNA, 64 nt, Human
agguuuagaagacagucacagaacagcacacauccaaauucagcgccauugaaaguuggccuaa

SEQ ID NO: 139901 - RNA, 64 nt, Human
uauugacuuuuugcgucacuuaauccaaaucaaccaaauucaggguugaaucugaauuggcuuc

SEQ ID NO: 139902 - RNA, 64 nt, Human
ucucagcuacacauuacauugugauacugcagcucaaauucagaauggcaaugauacaugauau

SEQ ID NO: 139903 - RNA, 64 nt, Human
uaccaucucugcacccacaaucacacugauuuuucaaauucauuuuguuuuugcuguuucauuu

SEQ ID NO: 139904 - RNA, 64 nt, Human
cacccugccagcucagccuuuaugguugucauggcaaauucaggugauauauggguaugagguu

SEQ ID NO: 139905 - RNA, 64 nt, Human
ucccacuaaagugucaagguguggaagggaccaagcgaccaaggaugggccaucuggggucuau

SEQ ID NO: 139906 - RNA, 63 nt, Human
auaacuacaagccauacugaggcggcagcaggagcgaccaacugaucgcacacaugcuuuguu

SEQ ID NO: 139907 - RNA, 64 nt, Human
aguucaucugacuuauguucacagaaccguaucagcgaccaagaaaauaggacugucagaagcu

SEQ ID NO: 139908 - RNA, 64 nt, Human
ucugugagcaccacguaugccugugugaagacaagcgaccaaccugcauucaugcccuuguauc

SEQ ID NO: 139909 - RNA, 64 nt, Human
agcagcauacaggggaaggcuuggaccaagcugggcgaccaagcacauggggcaggaacacaug

SEQ ID NO: 139910 - RNA, 64 nt, Human
uccagaaauuuguggccuuuuaggcgggaguuaggcgaccaaaccagugagagccccaaucccu

SEQ ID NO: 139911 - RNA, 64 nt, Human
uuuguggcuuagguuaugaugcgccuccuucugugcgaccaaugagacgacuucagcaucuuuu

SEQ ID NO: 139912 - RNA, 64 nt, Human
gucuuccucugggauguccuggccccuacugagagcgaccaaagcuuccccggggcccccccag

SEQ ID NO: 139913 - RNA, 64 nt, Human
ggggcuccggcccgggacccaggaccagcaacccgcgaccaaucaugcugcagcccaggggcgu

SEQ ID NO: 139914 - RNA, 64 nt, Human
uuuucuaaaacuaaagaaucuaggaaccuugccugcgaccaaucauggagccacgugagcugau

SEQ ID NO: 139915 - RNA, 64 nt, Human
uccuugugccuucuuuguauauaggcuucucacggcgaccaauaaacagcucccaguuuguaug

SEQ ID NO: 139916 - RNA, 64 nt, Human
caugugcucaaaggagcccuccucucacaucucagcgaccaagaaccccaaucccuaaucagag

SEQ ID NO: 139917 - RNA, 64 nt, Human
guucucauagaaccaacagcaucugagcccucaacaccaacagcaccauccucuguagcagaca

SEQ ID NO: 139918 - RNA, 64 nt, Human
ugccacugccucuggccauuuaaagugagaggggcaccaacagacaauucggggaccuuaggcc

SEQ ID NO: 139919 - RNA, 64 nt, Human
augccuggccaggcuccacggaucccgccagaaacaccaacagagggucucccuuucugccuuu

SEQ ID NO: 139920 - RNA, 64 nt, Human
auaucagaaaugcacacaacagaaccauaggcaacaccaacacaggaagaaauagaagucaccu

SEQ ID NO: 139921 - RNA, 64 nt, Human
guugggacauguuaaggaaaacaaauauguucaucaccaacaaucagcugucauuuuauuaauc

SEQ ID NO: 139922 - RNA, 64 nt, Human
agcacuucugguacuucagucguuuuuacugauccaccaacaccuaaagaggcuaugcuacagu

SEQ ID NO: 139923 - RNA, 64 nt, Human
uguguuuaaccaaagcuuugaaaugugaugaagccaccaacauaagcacuugccuaacagaaau

SEQ ID NO: 139924 - RNA, 64 nt, Human
caugcagaggagcucaaugucgcgggacuagcuacaccaacauaugcacuuuuuacauuuagaa

SEQ ID NO: 139925 - RNA, 64 nt, Human
ccuggaaacuccacucugaagcugccgcuuuggacaccaacacucccuucucccagggucaugc

SEQ ID NO: 139926 - RNA, 64 nt, Human
agaguagaaaauggguucaacuccuguuucgcuccaccaacaccucugugagucucaucaucag

SEQ ID NO: 139927 - RNA, 64 nt, Human
acugugcuuuccuccccauagugggagcugucaucaccaacaggguuuacucuccccuggagag

SEQ ID NO: 139928 - RNA, 64 nt, Human
aauaaacauugaacucaguucuucaagguuucaucaccaacauaaggaaugaaguuggaaccac

SEQ ID NO: 139929 - RNA, 64 nt, Human
cucagccuccugaguagcugggauuacaggugugcaccaacacacccggcuaauuuuuguauuu

SEQ ID NO: 139930 - RNA, 64 nt, Human
ucaggacuucugccaauuuugaaugauauagcugcaccaacaauaucccgccuccucuaauuac

SEQ ID NO: 139931 - RNA, 64 nt, Human
gugccaaagucuggaucuuuccacauuucagcagcaccaacaucugcugcuacucaaaaugucc

SEQ ID NO: 139932 - RNA, 64 nt, Human
cucaaccacaugcuauuuaguuagcaucaguugucaccaacagucuuucugcaaagggcaggag

SEQ ID NO: 139933 - RNA, 64 nt, Human
cagcagucuggacucugcaccaagcagcucgauccaccaacacugucaagguggagacuggagg

SEQ ID NO: 139934 - RNA, 64 nt, Human
gccauuggucuccucugccucugacuacaucugccaccaacaacccuccccucaccccugccag

SEQ ID NO: 139935 - RNA, 64 nt, Human
ugcuuuccacaguggcuaaacuaauuuacacucccaccaacaguguauguguuccauuuucucc

SEQ ID NO: 139936 - RNA, 64 nt, Human
ucuugcuuucuuugaccucuucucuccuccccuacaccaacaaagaggaauggcugcaagagcc

SEQ ID NO: 139937 - RNA, 64 nt, Human
aaaaucugcucacagucuguucuggaggucacaucaccaacaaagcucacgcccuaugcaguuc

SEQ ID NO: 139938 - RNA, 64 nt, Human
ugccaaacaggucuuaagggaggugcuuauaucccaccaacacucucccagcucccaugucccc

SEQ ID NO: 139939 - RNA, 64 nt, Human
auuuuucuucaugggagaaacagcccacagagcucaccaacaaguacuccaaaacuaaguaaga

SEQ ID NO: 139940 - RNA, 64 nt, Human
ccacagggccaccagcacacccccgcacgcugggcaccaacagagccacggagcgcgagcacau

SEQ ID NO: 139941 - RNA, 64 nt, Human
ucaggugcuuugcuagaugcugugacagguaugccaccaacacugcucacagccuuucugagga

SEQ ID NO: 139942 - RNA, 64 nt, Human
gaagaaauucaagauucaaaaagaauuuuaaauacaccaacaugagacaucaguagucaguugg

SEQ ID NO: 139943 - RNA, 64 nt, Human
acucccucugugucacuguaugugaaaggaaaugcaccaacaaccguaaacugaacguguucuu

SEQ ID NO: 139944 - RNA, 64 nt, Human
uuagccuuuacaccaccaaucaaaacucuagguacaccaacacaaccuggaaguacuccuagga

SEQ ID NO: 139945 - RNA, 64 nt, Human
augacuugcaugugacuccuacuuggcuucuauccaccaacagaaauuauaccauauagugaaa

SEQ ID NO: 139946 - RNA, 64 nt, Human
gcccagcccacuccccgcauggggaggccgccaccaccaacaccucaucauccuucucaucgcu

SEQ ID NO: 139947 - RNA, 64 nt, Human
ugcugugugugacgugaccggacuuuucugcaaacaccaacauguugggaaacuuggcucgaau

SEQ ID NO: 139948 - RNA, 64 nt, Human
cucuugggcuccuuuucaaggacauuaauaaccucaccaacauagcucaugcccuucagcuuug

SEQ ID NO: 139949 - RNA, 64 nt, Human
aaccuccugcaggaguaacuaagauuauaauuuccaccaacauugcugagacauccauaaccau

SEQ ID NO: 139950 - RNA, 64 nt, Human
ucacacccaaauuucacaagcacugacccccuggcaccaacacccgccaguacugugacuucca

SEQ ID NO: 139951 - RNA, 64 nt, Human
acccaucuccuagcacacgugcccacugaaguggcaccaacagaaguuuggcuugaacuaaagg

SEQ ID NO: 139952 - RNA, 64 nt, Human
aaugcuuuagggggaaaaucagucauaucuuuaacaccaacaagcaauuucccaccaacgaaug

SEQ ID NO: 139953 - RNA, 64 nt, Human
gugagccuacccuuucgaggaggaguauuuuaaucaccaacauuguuuagaauuucaagcagau

SEQ ID NO: 139954 - RNA, 64 nt, Human
uaaugguguggauuggccugcuuugacucucagccaccaacagaaaucuuugucaccuuuguuc

SEQ ID NO: 139955 - RNA, 63 nt, Human
ucugcgugaaguauagcuagagaaugcgaaauucaccaacacguggccaagagaaacuuccua

SEQ ID NO: 139956 - RNA, 64 nt, Human
uuuaaaagaaaagacaaguuuguuguguuuaacucaccaacacgugguguauaaugaagacaga

SEQ ID NO: 139957 - RNA, 64 nt, Human
gaucuuuaacaauucaaccucaaauuucuaauuucaccaacaacuauuuauugagggcuaggua

SEQ ID NO: 139958 - RNA, 64 nt, Human
agggcagaaagguucugcccgggaaggucaccagcaccaacaccacgguagugccugaaauuuc

SEQ ID NO: 139959 - RNA, 64 nt, Human
ggucaggaaggaugagcauuuagggcaaggagaccaccaacagcccucaggucagggugaggau

SEQ ID NO: 139960 - RNA, 64 nt, Human
uuauaagccccuuucuuuugugaauuugaaguagcaccaacaagccuggauugugaagguauua

SEQ ID NO: 139961 - RNA, 64 nt, Human
guuuugaucugggcucugagcacaagucaggaaacaccaacauauucacacucucccaguaggu

SEQ ID NO: 139962 - RNA, 64 nt, Human
agauauauauucaacagaaaugcaugaguaugugcaccaacaggcaugacaaaaauauuuauag

SEQ ID NO: 139963 - RNA, 64 nt, Human
acccuucugagguaacuagacugcagcuaaccaccaccaacagccauucaucaucugaucucug

SEQ ID NO: 139964 - RNA, 64 nt, Human
guccuuaccauauguaauaggcagcuguuaaauucaccaacagauacccugauuuuucaucuua

SEQ ID NO: 139965 - RNA, 64 nt, Human
caaacccaccacacaccagcagccacaaccucaccaccaacaaagaggacuuuuguggggccac

SEQ ID NO: 139966 - RNA, 64 nt, Human
ugucuucugggcacaguggacucagcagugaccacaccaacacugacccuugaaccaauaaagg

SEQ ID NO: 139967 - RNA, 64 nt, Human
acaaccaauaaagucaccagcaguauuacuaucacaccaacagccacaccucuuccucgacaau

SEQ ID NO: 139968 - RNA, 64 nt, Human
uuauagugaaguggcuggacuagcauuuguuuagcaccaacaaauaaaaggugggaugggggau

SEQ ID NO: 139969 - RNA, 64 nt, Human
aacuauauucucaguguagggcagagaggucuaacaccaacauaagguacuagcaguguuuccc

SEQ ID NO: 139970 - RNA, 64 nt, Human
acauuggagaggguacagggaaaggaaaaauuuucaccaacagaggcagucucucauagaguau

SEQ ID NO: 139971 - RNA, 64 nt, Human
cagccuucucuggugacagaggcucagcuguggccaccaacacacaaccacacacacacaacca

SEQ ID NO: 139972 - RNA, 64 nt, Human
aucugaaacaggcagggagcuaagcucaucagaacaccaacagauucauguucucgucuuagcu

SEQ ID NO: 139973 - RNA, 64 nt, Human
ccauacccucgaagauguuguacuccaccgccugcaccaacagccucaguguuacuucccagga

SEQ ID NO: 139974 - RNA, 64 nt, Human
gcugauauagucaagcuugccucuucuugaggagcaccaacaucuguuauuuuuaggauucugc

SEQ ID NO: 139975 - RNA, 64 nt, Human
aaaucuuucuaaaacauuguuuuaguugucaaagcaccaacaggacauuuugggaugugaaaug

SEQ ID NO: 139976 - RNA, 64 nt, Human
ucagacaacuugauuccuaagguuuccagugugucaccaacaaaaagugcauugauagggaccu

SEQ ID NO: 139977 - RNA, 64 nt, Human
cuguggaaacacucauuaaaagaaccccagaggucaccaacauguuuauaucuugacuugacuu

SEQ ID NO: 139978 - RNA, 63 nt, Human
augugguugacuguaugugauuugaguucuggccaccaacaauuuagucauaucugauaggua

SEQ ID NO: 139979 - RNA, 64 nt, Human
agccuucaaauuacauuaucaacaugagagaaaucaccaacaaagaagauguucaaaauaauag

SEQ ID NO: 139980 - RNA, 64 nt, Human
caguuccaguuucucuuccauucugugucacagacaccaacacaccacucauuggaaaauggaa

SEQ ID NO: 139981 - RNA, 64 nt, Human
gguaguuauguaugccagaccuaauaugagcugccaccaacaccccuagaacuuucagccaugg

SEQ ID NO: 139982 - RNA, 64 nt, Human
aauggcacagauuacaaaaguaaagaacaaccaccaccaacaucgguaacucccuguauucuca

SEQ ID NO: 139983 - RNA, 64 nt, Human
caaauauagcgaaaucucuccacugccuucuguccaccaacauuuagugccagccuaggcacaa

SEQ ID NO: 139984 - RNA, 64 nt, Human
ggcgacucuaggugaacagccuccagacggugugcaccaacaucuacaagauccuccugcugca

SEQ ID NO: 139985 - RNA, 64 nt, Human
cgggccuccgauuucauccucagcacguaaugcucaccaacagcacuugcacugaguugacucu

SEQ ID NO: 139986 - RNA, 64 nt, Human
accuucuagguuccugaaguauuuucaaacaaaccaccaacaggagauauugaggauauuuaga

SEQ ID NO: 139987 - RNA, 64 nt, Human
ccuccccauuguacacagguguacaccaugcaugcaccaacaccuaaaacucaaaacuaaaugg

SEQ ID NO: 139988 - RNA, 64 nt, Human
agaacugcuucuucaauuccuuaacaaaugcaaccaccaacacccagaucucucucucucuuua

SEQ ID NO: 139989 - RNA, 64 nt, Human
cucagucuccugaguagcugggacuacaggugugcaccaacaugcccagcuaauuuuuuauauu

SEQ ID NO: 139990 - RNA, 64 nt, Human
cagcgaggucugaagggcucgccccguguccucucaccaacaccacaccccaacaagccagccu

SEQ ID NO: 139991 - RNA, 64 nt, Human
aggagaaggcaugccucauugguaauuuggaagacaccaacacuuacccagaaucuguugcuau

SEQ ID NO: 139992 - RNA, 64 nt, Human
aauguaugagaauuccaauuucuguccacuuccucaccaacacuuauuauuuuccuuuuccuuu

SEQ ID NO: 139993 - RNA, 64 nt, Human
ccaucucccccugccaggccugugugaucauuaucaccaacagcugguggguggccgggccagg

SEQ ID NO: 139994 - RNA, 64 nt, Human
aaguccucuuuguagaugauguauuuugcuugggcaccaacagaauuaaaaacgaaaaacaaaa

SEQ ID NO: 139995 - RNA, 64 nt, Human
uuguuacuauacaauuaugaaauguaauguaagacaccaacagaaaugauauaccuguaacugu

SEQ ID NO: 139996 - RNA, 64 nt, Human
uuuuagaggugccaguucccaccucuaaaaaaaacaccaacaacaaaagaaaugaugcaacaug

SEQ ID NO: 139997 - RNA, 64 nt, Human
ccgguuccaagccuagaggauccuuccaaaccagcaccaacagagccaaggccuugggagcagc

SEQ ID NO: 139998 - RNA, 64 nt, Human
uguccacacaagacagcagagccaucugcgacaccaccaacaggcguucucagccuccggauga

SEQ ID NO: 139999 - RNA, 64 nt, Human
uuugacaaauagcuauaauaggaacacucccuaucaccaacauauuuugguuaguauauuccuu

SEQ ID NO: 140000 - RNA, 64 nt, Human
auauaccauuucaaauauuuacaguacuugucuucaccaacacugucccaaggugaaaugaagc

SEQ ID NO: 140001 - RNA, 64 nt, Human
uucucugcuucugagauaagaaccauuuguguaacaccaacacuuaacuucagaaagacaugca

SEQ ID NO: 140002 - RNA, 64 nt, Human
gagggcaggggaacgggauccuucucccgcugcccaccaacaccaacacacacacaccucuaag

SEQ ID NO: 140003 - RNA, 64 nt, Human
aggggaacgggauccuucucccgcugcccaccaacaccaacacacacacaccucuaagcugcug

SEQ ID NO: 140004 - RNA, 64 nt, Human
acacacauuuuuguucaauauugauauauuuuaucaccaacauuucaaguuuguauuuguuaau

SEQ ID NO: 140005 - RNA, 64 nt, Human
acacaacuuucuggcagacagacaaauuguacaacaccaacaauauccuggaccuugaaauucu

SEQ ID NO: 140006 - RNA, 64 nt, Human
gguguguccaccugggcauauccaccaccucccucaccaacauugcuugugccacacccucccc

SEQ ID NO: 140007 - RNA, 64 nt, Human
aggcgagggauucccagccggacggggguucucucaccaacagcugugauuucaucccgaagug

SEQ ID NO: 140008 - RNA, 64 nt, Human
auccuuuaggaaaugaaaaaaccaugacuaucaucaccaacauccuuggguauuaagugcaguc

SEQ ID NO: 140009 - RNA, 64 nt, Human
gacagacgcagggagaccccaccaccaccaccaccaccaacaccaccaccaccaccgcgagcug

SEQ ID NO: 140010 - RNA, 64 nt, Human
ucggccucuugcuaggcauagcgggccugcgcugcaccaacauugggggccuggagcucuccag

SEQ ID NO: 140011 - RNA, 64 nt, Human
auuuccucagaacugauaaaaaauaaugcaacaucaccaacagauccuguuauuuccucugcag

SEQ ID NO: 140012 - RNA, 64 nt, Human
augcagcauugugagaagucaguucggaccacugcaccaacacugucguauccuuguuaaaaug

SEQ ID NO: 140013 - RNA, 64 nt, Human
guggaaaaagccauggugugugguuucugggaaccaccaacacuugcagguuuagcuuuuuccc

SEQ ID NO: 140014 - RNA, 64 nt, Human
uuuuuauuuguaaacuaauaaagguaaucacagccaccaacauuccaagcuacccuggguaccu

SEQ ID NO: 140015 - RNA, 64 nt, Human
uguccccauuuuuaaccucagccuucccuacugucaccaacaaccaagcuaaauaaagucaaca

SEQ ID NO: 140016 - RNA, 64 nt, Human
caugagagaccccgacuacuccucagccacaucgcaccaacaauucucuucaggucuaggaugg

SEQ ID NO: 140017 - RNA, 64 nt, Human
cacagaaccaccgccaccaccaccaacaccgccacaccaacaccaccacuacaaaaaaaaaaga

SEQ ID NO: 140018 - RNA, 64 nt, Human
cccuucccccaauacacagaaccaccgccaccaccaccaacaccgccacaccaacaccaccacu

SEQ ID NO: 140019 - RNA, 64 nt, Human
aauaugcuugauauugugaaaaggugaaauucuucaccaacauuucauuugcuccuuugucaua

SEQ ID NO: 140020 - RNA, 64 nt, Human
uggggaagcuggcucugcuuuugcccuuugucaucaccaacacaacagauagaauuuaaauaua

SEQ ID NO: 140021 - RNA, 64 nt, Human
ucaauaucccaacauucugcaauggcagcauucccaccaacaaaauccaugugaccauucugcc

SEQ ID NO: 140022 - RNA, 64 nt, Human
gaaaucuucgaaggugugguuuucauuucucagucaccaacagaugaauaauuaugcuuaauaa

SEQ ID NO: 140023 - RNA, 64 nt, Human
augaauguguauuucccauggucuccgcugcccacaccaacaguguggcaucucauaaguuaac

SEQ ID NO: 140024 - RNA, 64 nt, Human
cucuggcugcuaccucagggcaugguuguggccccaccaacaccuauuuuccaaauaauuauuc

SEQ ID NO: 140025 - RNA, 64 nt, Human
caucagaaggaagccaaagaguucacagccucagcaccaacaacucaacauggucaucauguuu

SEQ ID NO: 140026 - RNA, 64 nt, Human
acagagaaaugcuggugaaacuggccaaacagaacaccaacaaggccaaagacucuuuacggaa

SEQ ID NO: 140027 - RNA, 64 nt, Human
ccaauuucacgcuuuuaauucucauuuguucucacaccaacagugugaagugcgugguauaauc

SEQ ID NO: 140028 - RNA, 64 nt, Human
cugcacgcuggccccacgguaacccccccucccccaccaacauccugcagggauggggucagug

SEQ ID NO: 140029 - RNA, 64 nt, Human
aacagucuauuauacauagcccuguauauauguacaccaacaugaaacuuuuauuuaacagacg

SEQ ID NO: 140030 - RNA, 64 nt, Human
ucaccgcgucacgacuuuuggggagacucacccccaccaacaccguccagagaggccugaggga

SEQ ID NO: 140031 - RNA, 64 nt, Human
ugcguccuauuguccuuaagagggcguuucacaccaccaacaguaagccacccacucuggaguc

SEQ ID NO: 140032 - RNA, 64 nt, Human
gcugcucacgccuccucacucucugucugucccucaccaacaccaaggccuccaucucacugua

SEQ ID NO: 140033 - RNA, 64 nt, Human
cagcacccaguguuggucuguguccaucagugaccaccaacauucuguguucacaugugugggu

SEQ ID NO: 140034 - RNA, 59 nt, Human
gauggcgugggauguacugaaagcaaaaacaccaacauacaagucuugacaacagcauc

SEQ ID NO: 140035 - RNA, 64 nt, Human
acucuucucagcuugagcuuacauagguaaauaucaccaacaucuguccuuagaaaggaccauc

SEQ ID NO: 140036 - RNA, 64 nt, Human
ucauuugagauuuucuaaggguagaauuuggucucaccaacaagugaggauauagccuuaucuc

SEQ ID NO: 140037 - RNA, 64 nt, Human
ugcagccucccuggucuuccuccacacaguuguucaccaacagaccagaccuccuuuaaccaca

SEQ ID NO: 140038 - RNA, 64 nt, Human
gcucuuugugaaccucucauccccacagcagaaucaccaacacucuccgcuucccccagcacac

SEQ ID NO: 140039 - RNA, 64 nt, Human
uuugugggcaaucacuaaaaaugaucacuaacagcaccaacaaagcaauaauaguaguaguagu

SEQ ID NO: 140040 - RNA, 64 nt, Human
ugaucagacugggccaugucaaacccggaauuuucaccaacaguucacucacccuccugguaca

SEQ ID NO: 140041 - RNA, 64 nt, Human
gcugaguccuugcugugggaugugccaguguccccaccaacaccaggaauuuagaccuuuuccc

SEQ ID NO: 140042 - RNA, 64 nt, Human
ucucccaaacuaaugauucuugggugcugugggucaccaacaggcuguuuacaaagcagaaaau

SEQ ID NO: 140043 - RNA, 64 nt, Human
aguuuaagauagcagaucaucucagcaguaagcacaccaacagaacugaguuccagaaaggaag

SEQ ID NO: 140044 - RNA, 64 nt, Human
auucucuugaguaauaaaucuuaucuuuucaaggcaccaacaaacaaaacugugauauuggaaa

SEQ ID NO: 140045 - RNA, 64 nt, Human
accucgggcauccccuuauugccugaugggccaacaccaacaguuacggagugcuugagaaggg

SEQ ID NO: 140046 - RNA, 64 nt, Human
cuagguaguccauaggaaccacccccaugaccaccaccaacaucaacuaaagguucuuggaggg

SEQ ID NO: 140047 - RNA, 64 nt, Human
ccuucccuucucguccuugaggguuuagaacacacaccaacaccuccagcguccccgccccagc

SEQ ID NO: 140048 - RNA, 64 nt, Human
cuugggccgaccacucuguucucauucuccuucccaccaacauccauccguccuucucagacaa

SEQ ID NO: 140049 - RNA, 64 nt, Human
ucugaaucccugaucuuaaaaaauaauuauacuucaccaacaaaacuuggccucuuuugguucc

SEQ ID NO: 140050 - RNA, 64 nt, Human
ggcugcucccagaaucugcucagcuuucugcccccaccaacacccuccaaccaggccuugccuu

SEQ ID NO: 140051 - RNA, 64 nt, Human
acuaaucaguucuuagauucaggggaagggcaggcaccaacaacucagaaugggggcuuucggg

SEQ ID NO: 140052 - RNA, 64 nt, Human
ugugcauuucugguugcaccgcggcgcuucccagcaccaacauguaaccggcauguuuccagca

SEQ ID NO: 140053 - RNA, 64 nt, Human
uccacagagagggacagcaugugcaaaggcugagcaccaacacauaguggucaccugggccuua

SEQ ID NO: 140054 - RNA, 64 nt, Human
uuccccacccgggaaaggcugccgccaccaccaccaccaacacaacagcaauggcaacaccgac

SEQ ID NO: 140055 - RNA, 64 nt, Human
ccccacagcuucucgacugcaguggggcggggggcaccaacacuuggagauuuuuccggagggg

SEQ ID NO: 140056 - RNA, 64 nt, Human
cucagccuccuggguagcugggauuacaggugcccaccaacaugccuggcuaauuuuuguacuu

SEQ ID NO: 140057 - RNA, 64 nt, Human
guuauuuugcauauauguucuucauaagcugaaccaccaacagagaaaagcaggccuuugcaga

SEQ ID NO: 140058 - RNA, 64 nt, Human
uccagguagggggccauguuucccagcggggacccaccaacagaggccaguuucaaagucagcu

SEQ ID NO: 140059 - RNA, 64 nt, Human
ugggauacagcguauaggugcagcccugucacaacaccaacagaaguagcagccucugggugca

SEQ ID NO: 140060 - RNA, 64 nt, Human
ucucuggagcagaauuuaucacacacaaaaguuacaccaacagaauaccaagcagaaugaugag

SEQ ID NO: 140061 - RNA, 64 nt, Human
ccuagaaugucaucauaugguccuaauuccaugucaccaacaacacagacaagacccuguuuac

SEQ ID NO: 140062 - RNA, 64 nt, Human
ugagauccugauaccaccuucaaggaaccucaggcaccaacagugagcccacgaggauggucac

SEQ ID NO: 140063 - RNA, 64 nt, Human
ggcacagggcugcagaaaauaaaccuccagauuccaccaacacggguccauucuuccuggugau

SEQ ID NO: 140064 - RNA, 64 nt, Human
accaggagcccuugcuggcgcuggauguggauuccaccaacagccggcugcggcacugugccua

SEQ ID NO: 140065 - RNA, 64 nt, Human
uacuaacguaaaugacgaguuaaugggugcagcacaccaacauggcacauguauacauauguaa

SEQ ID NO: 140066 - RNA, 64 nt, Human
ggcccacagcucccaccccacccccuucagugcccaccaacaucccauugcccugguuauauuc

SEQ ID NO: 140067 - RNA, 64 nt, Human
cugcacuccggcuuccuagacucuggcccugccacaccaacacacuuucuauuugggcucccaa

SEQ ID NO: 140068 - RNA, 64 nt, Human
cagucugguugacaggaagaaaccacaccaucaacaccaacaaguuucuguguuccuuuuacag

SEQ ID NO: 140069 - RNA, 64 nt, Human
aguucugggaaauuguuauagcuuaaauggaacucaccaacauuauucauaguuuaagucuuuu

SEQ ID NO: 140070 - RNA, 64 nt, Human
ugaaucccugacauuuugaggaucucacauuagacaccaacaaauuaaagcuccaaaauuauuu

SEQ ID NO: 140071 - RNA, 64 nt, Human
gugaucuuugcacagaugaauggaaguugaugcacaccaacaagaggcaacuugucacuuucuu

SEQ ID NO: 140072 - RNA, 64 nt, Human
caugcuguguuggaggaggaaguggcucuccuuccaccaacaaagcuccugcucuacccucuuc

SEQ ID NO: 140073 - RNA, 64 nt, Human
aaacaaggccagccccaaccuuccaaaccuccaucaccaacaacccaaacuggaugucaagcaa

SEQ ID NO: 140074 - RNA, 64 nt, Human
gaauugcuguuaacacuagaaaacacacuuccugcaccaacaccaauacccuuucaaaagaguu

SEQ ID NO: 140075 - RNA, 64 nt, Human
cuccaaacccagggcagccauggcuucucauuuacaccaacagguuucaguuccaacagaaagg

SEQ ID NO: 140076 - RNA, 64 nt, Human
aguuucucagaacugguucauagaccaccugugucaccaacagccagauaccuaaucccugagc

SEQ ID NO: 140077 - RNA, 64 nt, Human
aggugcagcugaucucuagcuaaucaacacaacccaccaacaaaugaccacagguuggcacugu

SEQ ID NO: 140078 - RNA, 64 nt, Human
gaaaugagggagcaauaacuucaaccaauguaaucaccaacagggacugauuucuauuuaucuu

SEQ ID NO: 140079 - RNA, 64 nt, Human
gcacauugacccauagcacacacauacacaccaccaccaacaacgcuugugaauguauuuuucu

SEQ ID NO: 140080 - RNA, 64 nt, Human
ggaaaaccccgucucuauaccaaccaaaccaauucaccaacacaguugggacccaaaacacagg

SEQ ID NO: 140081 - RNA, 64 nt, Human
guuuggaaacaucuguggacucuguuagaugaggcaccaacaaggcaaggucaccugccucuuu

SEQ ID NO: 140082 - RNA, 64 nt, Human
aaauuuugguguuguguaaugcauaaugcuuucucaccaacagaaaaaaggaaaaaaauuguuu

SEQ ID NO: 140083 - RNA, 64 nt, Human
acuucagugcagaaugguucguggguacagugaacaccaacacauccuacaaagccuucagcgc

SEQ ID NO: 140084 - RNA, 64 nt, Human
cauuuuuuuuucauguguggcaucuuuuucaugccaccaacaaacuuguugugugugugcgugu

SEQ ID NO: 140085 - RNA, 64 nt, Human
aauuaaaccaaccaaugauaaacacuacucaguccaccaacaacaaacguguuugaauucaccu

SEQ ID NO: 140086 - RNA, 64 nt, Human
cuggcaacaaucugacauuauuaguggaauuccacaccaacagggcuugugagcuuccauuuca

SEQ ID NO: 140087 - RNA, 64 nt, Human
agucaccaucuuaagagaugccucauuuuagaaccaccaacaagcaagcucccaagggauggug

SEQ ID NO: 140088 - RNA, 64 nt, Human
uuacaccccucacguuucccucucccuucuuccccaccaacaaaacccaggagguagcuggcag

SEQ ID NO: 140089 - RNA, 64 nt, Human
uuugaugguggugagggugggugauggugcccagcaccaacaguuuuaguggccuguccuugac

SEQ ID NO: 140090 - RNA, 64 nt, Human
ccgagacuguauauuuaucagacuccugggagaacaccaacauccaugggguuguagggaaggc

SEQ ID NO: 140091 - RNA, 64 nt, Human
gugccagcacaguccuaaaagggcuggaguaccacaccaacacagguaggggugcagggcuuca

SEQ ID NO: 140092 - RNA, 64 nt, Human
gggugcccccccucucccuucuccuucccggccccaccaacacucugagauccgagaggagcuu

SEQ ID NO: 140093 - RNA, 64 nt, Human
aaaaauguaacugaugaaucuaaacgacccacugcaccaacaaucauuuaucaaugguucuaag

SEQ ID NO: 140094 - RNA, 64 nt, Human
auagcaggggaagcuggggggucaagcaccaucgcaccaacacuccaccgcgaucugccugcgg

SEQ ID NO: 140095 - RNA, 64 nt, Human
gagcugacccuuccauuaccaauggccugucccucaccaacaagccaacugccacagaugaccc

SEQ ID NO: 140096 - RNA, 64 nt, Human
ugcaaagcacccaaaccacuaacacauccaacagcaccaacaaaucucagguguguggaacgug

SEQ ID NO: 140097 - RNA, 64 nt, Human
aggcuggguucugauccuaguuccaccaucaagccaccaacauacucccaucugugaaaggaaa

SEQ ID NO: 140098 - RNA, 64 nt, Human
uguguuuccuuauugucauuccauuauauauccacaccaacaugggugacgauaauucaaaguc

SEQ ID NO: 140099 - RNA, 64 nt, Human
uuauucucucuguugguggcaaaccacuucauagcaccaacagagauguaggaaaaauuccuca

SEQ ID NO: 140100 - RNA, 64 nt, Human
ucgcucuucccagaguuguuaauguggugacaugcaccaacagccguauguguacugugaucug

SEQ ID NO: 140101 - RNA, 64 nt, Human
uaggacauguacaugaaacagugaaaaugagauccaccaacaucuuuuauuaaguucaguuauu

SEQ ID NO: 140102 - RNA, 64 nt, Human
cacguagaucgcagcaggcgugauuacacaugcacaccaacaugcaugccgccggcacaugcuc

SEQ ID NO: 140103 - RNA, 62 nt, Human
cugccgaguuuuucgguugaagugaugcacaccaccaacauucuuggcauuacgcaggccag

SEQ ID NO: 140104 - RNA, 64 nt, Human
uugccguugaaaaauacagugcccaaaauaaucucaccaacaaagcacugcucauacuagacag

SEQ ID NO: 140105 - RNA, 64 nt, Human
aaagggggagacaaaacuccuacucucaaccucacaccaacaccucccauuaucacucucucug

SEQ ID NO: 140106 - RNA, 64 nt, Human
gaccuuuggcucuguccaucaccagcaaccaauccaccaacagaaugugguuucugccauccug

SEQ ID NO: 140107 - RNA, 64 nt, Human
agucugggggaagggucguggguggggaauuuaucaccaacauccauuguagggggaaucuaug

SEQ ID NO: 140108 - RNA, 64 nt, Human
gaguugacaucccccuucuggcucaugugucugacaccaacaacauggucucugucccucucuc

SEQ ID NO: 140109 - RNA, 64 nt, Human
gggcuugggugcccauauaggaggucuguauguucaccaacagugcggaggggucacacauugc

SEQ ID NO: 140110 - RNA, 64 nt, Human
cgggggagacggagagauauaaaggucccagcggcaccaacaucaucauuggcuccauugcugg

SEQ ID NO: 140111 - RNA, 64 nt, Human
cuuacucacucauucccucaaaauauuuauugagcaccaacaaugucacaagcacugugcuaaa

SEQ ID NO: 140112 - RNA, 64 nt, Human
aucaguaaucaugccacuacucaccaguguuguucaccaacacccacccccacacacaccaaca

SEQ ID NO: 140113 - RNA, 64 nt, Human
accaguguuguucaccaacacccacccccacacacaccaacauuuugcugccuaccuuguuauc

SEQ ID NO: 140114 - RNA, 64 nt, Human
aaguccgagaauuugaacgagccacucaggaagccaccaacaagaaaaucggcauuuucccacc

SEQ ID NO: 140115 - RNA, 64 nt, Human
gagcaaggguauaaagggggaaauuguuuggcagcaccaacagaaaacaaacaaacaaaaaaca

SEQ ID NO: 140116 - RNA, 64 nt, Human
gaagcuaucuuagguggagcuacuccccaccucccaccaacauauacauuuuguugcaggaaau

SEQ ID NO: 140117 - RNA, 64 nt, Human
gggaagucccauuagagauguaucaccaccuugucaccaacaggaugaugucaccagguaauaa

SEQ ID NO: 140118 - RNA, 64 nt, Human
ccaggaauguuuaaaacuagugucuucaaauccucaccaacauccaggauugugucuuuaugau

SEQ ID NO: 140119 - RNA, 64 nt, Human
uuacaaguuuuugucuggagccaaccaagcuugccaccaacauauugagaguaauacacuauug

SEQ ID NO: 140120 - RNA, 64 nt, Human
uucacuauucagacaaagacagcccuaaugacaucaccaacagucaaagcaauuagagaccaua

SEQ ID NO: 140121 - RNA, 64 nt, Human
agcggcucaucugaacgcuggggccugcugcagccaccaacacugcccaggacugcggguugcu

SEQ ID NO: 140122 - RNA, 64 nt, Human
gggaggcaguucugggaggggguuuuuucagugucaccaacagagucaacaaggaaacauaauu

SEQ ID NO: 140123 - RNA, 64 nt, Human
cacucccuguccccaugucccgggcuccacugggcaccaacauaaccuuguucucuguccuuuc

SEQ ID NO: 140124 - RNA, 64 nt, Human
agggggagccucaggaccuaucaggacaagaagccaccaacaaugaguacucagagaucaagau

SEQ ID NO: 140125 - RNA, 64 nt, Human
ccccuaauguaaaugacgaguuaauggugcagcacaccaacauggcacauguauacauauguaa

SEQ ID NO: 140126 - RNA, 64 nt, Human
gggaucaaguuuccaauaugugaauacagggaagcaccaacagaccauaucaguaacuucgagu

SEQ ID NO: 140127 - RNA, 64 nt, Human
uuaugaaugcaguggauaugggaaagccuucagucaccaacauauuguggcuggacagcaggca

SEQ ID NO: 140128 - RNA, 64 nt, Human
gcagugcacaaggauugcaaucuauauacauccucaccaacauuguucauuuucuauuucuguu

SEQ ID NO: 140129 - RNA, 64 nt, Human
acuauuuuauaaacacugucuucuuucgucuucacaccaacaugcagaaaaguuucuaaucuca

SEQ ID NO: 140130 - RNA, 64 nt, Human
acacacaccaugacaacgacaccuauagauauggcaccaacaucacaugcacgcaugcccuuuc

SEQ ID NO: 140131 - RNA, 64 nt, Human
aagaggaccuggccagagcgacuuugaucaccaucaccaacaacauuggcucaauagcaagaau

SEQ ID NO: 140132 - RNA, 64 nt, Human
aacaaaagcacuuuuccaucuuguacacgagauacaccaacauagcuacaaucaaacaggccug

SEQ ID NO: 140133 - RNA, 64 nt, Human
gcccaggcuggcccccacccaccuuccuugcgaccaccaacacacaggaacucugugugagaga

SEQ ID NO: 140134 - RNA, 64 nt, Human
cuggggaaacugaggcaaaaccauacuuagucaucaccaacaagcuggacugcuuagcugggcu

SEQ ID NO: 140135 - RNA, 64 nt, Human
cucgcgagcggcccgggcagggacccugucccaacaccaacaccuccucuccagcccaaucuuc

SEQ ID NO: 140136 - RNA, 64 nt, Human
cccugcagaagcagaccaggguuggcaaggcuggcaccaacaagccccccaggugccggggaag

SEQ ID NO: 140137 - RNA, 64 nt, Human
cuuaagaaaagggaauucucuuuaaagaaaccaccaccaacaacaaaacaaccaaaaaccaugu

SEQ ID NO: 140138 - RNA, 64 nt, Human
gucaggauugaaacaagcacgcgugcucggcucacaccaacaaggcaagccaaaggcgccccuc

SEQ ID NO: 140139 - RNA, 64 nt, Human
uacuucuguuuggcuaguuugcuuagcugaucaccaccaacaucauaggucuauaaaucaccca

SEQ ID NO: 140140 - RNA, 64 nt, Human
cugucccuauucccccagcccagcuagcugaucacaccaacagauccucaucagcaaagcauuu

SEQ ID NO: 140141 - RNA, 64 nt, Human
uuuuguuaagaauuucaauaucaagacugacuggcaccaacacuuugguauucaauuugauucu

SEQ ID NO: 140142 - RNA, 64 nt, Human
aagugcucuauuuauuaagaacuauauuuaauaccaccaacaaauauagggguuaaggaaaaaa

SEQ ID NO: 140143 - RNA, 64 nt, Human
ccuacuuguaaacuugaaagcaagaccuugauugcaccaacagguccagaguaugagugcaagc

SEQ ID NO: 140144 - RNA, 64 nt, Human
augggguucguuaugccaaagugucuacaugugccaccaacauaaaacaaaaccaagccuuggc

SEQ ID NO: 140145 - RNA, 64 nt, Human
ugacgguccuccuacucugccucuaccugcucuucaccaacauccugcugcucaaccuccucau

SEQ ID NO: 140146 - RNA, 64 nt, Human
uccauccaauggccuuuucugaaguuacagaaaacaccaacaugggagggaguuuaugaagcaa

SEQ ID NO: 140147 - RNA, 64 nt, Human
gagauaagcaguuaugugaccucacgugcaaagccaccaacagccacucagaaaagacgcacca

SEQ ID NO: 140148 - RNA, 64 nt, Human
ccagaucuucccaucuuguggcauguggugcccccaccaacaucccaaggggaccaauccccuu

SEQ ID NO: 140149 - RNA, 64 nt, Human
guuaaacuuuaccacugugcccuggcccaggcaucaccaacacggccucccugcagcugcccug

SEQ ID NO: 140150 - RNA, 64 nt, Human
gucuuugauacucuguaagugcuaguuccuaaggcaccaacauugcauuccuugguuuauacuu

SEQ ID NO: 140151 - RNA, 64 nt, Human
gaacauuggggauugaaaaucauauugguauuugcaccaacauagucauaaaauaguauguuaa

SEQ ID NO: 140152 - RNA, 64 nt, Human
accauuuucugcgcagauaugcuagguguauccacaccaacaugaagacacugaccuugucccg

SEQ ID NO: 140153 - RNA, 64 nt, Human
aaacaggaaagugucaauaaaaaaacuugagcaacaccaacauauuuuuucuuaaaaugucacg

SEQ ID NO: 140154 - RNA, 64 nt, Human
gaugcaaaaauaauauaugaaaagagacgaaaagcaccaacaaaugaagcucacuaaaugugcu

SEQ ID NO: 140155 - RNA, 64 nt, Human
gugagcucuggcucagacagcagcaagccggauccaccaacaccgcagcgccuuaugaccccgg

SEQ ID NO: 140156 - RNA, 64 nt, Human
cucauauacaggguggaauuuuauccuguuaucacaccaacaguugauuauauauuuucugaau

SEQ ID NO: 140157 - RNA, 64 nt, Human
augugcuugaaagugaaaagcaaucaauuauacccaccaacaccacugaaaucauaagcuauuc

SEQ ID NO: 140158 - RNA, 64 nt, Human
ucuuacuugaguaucauaauauauuguguuuuaacaccaacacuguaacauuuacgaauuauuu

SEQ ID NO: 140159 - RNA, 64 nt, Human
aaacaaaauuaccgagaaccccauccccauauaacaccaacaguguacauguuuacugucacuu

SEQ ID NO: 140160 - RNA, 64 nt, Human
ggcucugcccuuaggucuuuguggcuguuuaagucaccaacaauagagucaggguaaagaauaa

SEQ ID NO: 140161 - RNA, 64 nt, Human
acuuaaaaauuaaaaacaucaguacuaccaccaccaccaacaacaucaacacagaucuucacau

SEQ ID NO: 140162 - RNA, 64 nt, Human
uguaacucaggggggcagaagcucuggucacccacaccaacaccaaauccaucagcaaauucua

SEQ ID NO: 140163 - RNA, 64 nt, Human
guccuauuggagcaaagauuggagugaguguugccaccaacaggauuuuaucguuugacuccaa

SEQ ID NO: 140164 - RNA, 64 nt, Human
aaacgugccaaauggaacucaaggugccccuucagaauuaaaaucauuaccuugugugugaacc

SEQ ID NO: 140165 - RNA, 64 nt, Human
gcuacuauuuuucaguugagaaagaaauuuuugaggaugcaaagcuuuucugugaagacaaguc

SEQ ID NO: 140166 - RNA, 64 nt, Human
cuuaagguuaaauuuuaauaugaaagauccucaugaauuaaauaguugaugcaauuuuuaacgu

SEQ ID NO: 140167 - RNA, 64 nt, Human
uuugcuauguuaaaaguggcagaacaggaaagacgaauuaaaaauaacauuuuuuaagcgacau

SEQ ID NO: 140168 - RNA, 64 nt, Human
uugauaugauuuauuuaugaaaccuaaugaagcagaauuaaauacuguauuaaaauaaguucgc

SEQ ID NO: 140169 - RNA, 64 nt, Human
guuaaucacuuggaauguguuuagcuugacugaggaauuaaauuuugauuguaaauuuaaaucg

SEQ ID NO: 140170 - RNA, 64 nt, Human
uguuaacugaugaaaguggauagaacccauacaugaauuaaaugaugcacaaaauaaauggcug

SEQ ID NO: 140171 - RNA, 64 nt, Human
aggaauugguuguuuagggcacacuguuauaugggaauuaaaauauguuuaggcaggggugugu

SEQ ID NO: 140172 - RNA, 64 nt, Human
aauacuuuauggcaggauuguacuauaagcaaaugaauuaaacagcuauguaaaucauaaagaa

SEQ ID NO: 140173 - RNA, 64 nt, Human
agaagaggcagcuuguaggugauuguacaagugagaauuaaagagagaacagauauuuaaacag

SEQ ID NO: 140174 - RNA, 64 nt, Human
ugaggcaccagaugaagauaagaucugcaucaaggaauuaaauuuccaguuuguccuugggguu

SEQ ID NO: 140175 - RNA, 64 nt, Human
cagagaaggcaguguuccucuauucccuucuuccgaauuaaaaauacccccucagagcgaucua

SEQ ID NO: 140176 - RNA, 64 nt, Human
agcaaauccuaguucucuucccaccugucaaccugaauuaaagucuacacugccuuugugaagc

SEQ ID NO: 140177 - RNA, 64 nt, Human
ucaucgaaguaauguacccuuuuuuucugaaacugaauuaaauacucauuuuaucuuugacucu

SEQ ID NO: 140178 - RNA, 64 nt, Human
gcugcucaaaggccuucugagccgggugguccuggaauuaaaggagccacaggcccuccgggag

SEQ ID NO: 140179 - RNA, 64 nt, Human
cuuauuuugagaauucauuguuaaaaauuacagggaauuaaaauaauugccuuuuuuuuuuuua

SEQ ID NO: 140180 - RNA, 64 nt, Human
ggaacuuaguucagggacauagaagagucuuaaugaauuaaaaucauucacuugauuaaauguc

SEQ ID NO: 140181 - RNA, 64 nt, Human
ugaagggaaugucagggaagugugccugugagcugaauuaaaggacuggccuuuccagaaaacg

SEQ ID NO: 140182 - RNA, 64 nt, Human
uaccuccaucaugcaauuuugaaaauuguguccagaauuaaaagugcauagaaauagccuuuac

SEQ ID NO: 140183 - RNA, 64 nt, Human
gccagucaaaguggcacagcaaaucauauaaaucgaauuaaauggacaacaccguuagaugugu

SEQ ID NO: 140184 - RNA, 64 nt, Human
caagccucaaaaauaggcuuauuccauggaacaagaauuaaaaaugaauaagcuaucaauauau

SEQ ID NO: 140185 - RNA, 64 nt, Human
acaagugguuuuuucauuauguaaagcacccguugaauuaaaagaauuuguuuuuguucaaccu

SEQ ID NO: 140186 - RNA, 64 nt, Human
ugcuuuccaaaguccuuuuuuuucccuuaauguugaauuaaaauacuugcucauaguugauuua

SEQ ID NO: 140187 - RNA, 64 nt, Human
acauguuagggcauuaaagcaaagguggauuuaagaauuaaaccauuacaugccccuuccaaaa

SEQ ID NO: 140188 - RNA, 64 nt, Human
uuuuguuuuccucuuccuuuugagaagacacuaugaauuaaauucuacagcuuuuuuuugauau

SEQ ID NO: 140189 - RNA, 64 nt, Human
cccuauaaauggcuuguauugaacuuuuacauuugaauuaaagauguuaaacaugaagucuuuu

SEQ ID NO: 140190 - RNA, 64 nt, Human
aucauucuugaaaaaagaaauaauucaaaccuuggaauuaaaaagucagaaaaauaugggauuu

SEQ ID NO: 140191 - RNA, 64 nt, Human
agggagaaaggaaaaggaaacuucaaacaauauagaauuaaauguaaaaggaagcacuccugug

SEQ ID NO: 140192 - RNA, 64 nt, Human
uggaaaaugccugucucucuacuugaaugauaaagaauuaaauuagaucucucugagucuuggu

SEQ ID NO: 140193 - RNA, 64 nt, Human
gcaucaccacuuauuaaaacacacauagaaugaugaauuaaaaaaguuuucuaggauugucuuu

SEQ ID NO: 140194 - RNA, 56 nt, Human
aguuccguagucuaagauaacuaacugaauuaaaaauuauguaauacuuguggaac

SEQ ID NO: 140195 - RNA, 64 nt, Human
gcaauguaagcauacuuuguaaauaggauuuuuagaauuaaaaaagcauacuucuaggauagcu

SEQ ID NO: 140196 - RNA, 64 nt, Human
aucaguaccuguuucauaugaaggucguuucugagaauuaaauggacuaauguaugcaaaaagc

SEQ ID NO: 140197 - RNA, 64 nt, Human
augugacaccugagaccuuuagacaguugacccugaauuaaauagucacaugguaacaauuaug

SEQ ID NO: 140198 - RNA, 64 nt, Human
caucauccucaaauaucucacugucaaaauuguagaauuaaauaacccaaucuugaaacuguca

SEQ ID NO: 140199 - RNA, 64 nt, Human
accagguuucauuuugggccuugcuaaauugauugaauuaaauccuccagcuuuugaaccuuga

SEQ ID NO: 140200 - RNA, 64 nt, Human
gcugcugugguaauucuauuuguauaucucaacagaauuaaaaugucuagcuuggugguauuuu

SEQ ID NO: 140201 - RNA, 64 nt, Human
acccagaccuucguucauucuaaagagacugauagaauuaaaaacaaagugccuuaucuugcac

SEQ ID NO: 140202 - RNA, 64 nt, Human
gggaagggaaagguaugagggaaagagagucugagaauuaaaauauuuuaguauaagcaauugg

SEQ ID NO: 140203 - RNA, 64 nt, Human
gaacaguaccuuggcuuggcucuugacguggacagaauuaaaaaggaccaagaagaggaagaag

SEQ ID NO: 140204 - RNA, 64 nt, Human
aguggaauuuagggcauagcugaaaggggaaacagaauuaaagacaccagaaguagcagagaag

SEQ ID NO: 140205 - RNA, 64 nt, Human
gauaucaugcagaugcagucugaauuccuugccugaauuaaauuuauguauccucuccauaccc

SEQ ID NO: 140206 - RNA, 64 nt, Human
uucccguuccucugacaucuuguaaaugcuuuuugaauuaaagaugauaacaggcuuuuccacu

SEQ ID NO: 140207 - RNA, 64 nt, Human
agaggaagggcagguacuagguguuucauuuccagaauuaaaaaaaaaauccauuuaagacgua

SEQ ID NO: 140208 - RNA, 64 nt, Human
uguucucuaguuucaagcuccagcuucucagaaagaauuaaagaacuugcuguucaaauuaagu

SEQ ID NO: 140209 - RNA, 64 nt, Human
acaggaaaugugacauaacucauacaucggcacugaauuaaacaaaacaaaauacaacuguugc

SEQ ID NO: 140210 - RNA, 64 nt, Human
ugagcaauaacuucuauguugguuucaguggcuggaauuaaaacaaaacaaaacaaacuuccaa

SEQ ID NO: 140211 - RNA, 64 nt, Human
gauuuguauaucagaauugaaguuagaauuaagugaauuaaacugaauuugauugugagugaac

SEQ ID NO: 140212 - RNA, 64 nt, Human
aguauucauuuaagaggcaauaaggcaaaugccagaauuaaaaaaaaaaaucaucaaagacaga

SEQ ID NO: 140213 - RNA, 64 nt, Human
uauauuuaguuauuauauuuaggaauagaaaauagaauuaaauaauuuaacuugauuaaucaac

SEQ ID NO: 140214 - RNA, 64 nt, Human
ucaguauuuuaaauaaaauuuuguaaaguaaugugaauuaaaaauuuuggaacaauuagaauuc

SEQ ID NO: 140215 - RNA, 64 nt, Human
ggggaaacagaacugaauugcuguguuauaugaggaauuaaaaccuucaaaucucuauuucccc

SEQ ID NO: 140216 - RNA, 64 nt, Human
uuaaggauuuuauaaacucaaauuggcaccuacugaauuaaaauacauaaaaucauuuaaauau

SEQ ID NO: 140217 - RNA, 64 nt, Human
aguaucaaccugauuguugccaggaaauccuuaugaauuaaaacaaugcauauuuuacuacagu

SEQ ID NO: 140218 - RNA, 64 nt, Human
cuagaguuuuuccuuagacucuuuagucuuuucugaauuaaagaauaagugcucuuaaauccau

SEQ ID NO: 140219 - RNA, 64 nt, Human
uuacaccggguccagcugcgucagcccgaguucugaauuaaaacaugccucccacagaaucuau

SEQ ID NO: 140220 - RNA, 64 nt, Human
aauuguaucauugaagauguauuuuaaaccaaaggaauuaaauuuuauaugucuauuucguaau

SEQ ID NO: 140221 - RNA, 64 nt, Human
gacuaagcauguaauuuuuaaguuuuauuuuaaugaauuaaaauauuuguuaaccaacuuuaaa

SEQ ID NO: 140222 - RNA, 64 nt, Human
cuacuucuagauauucuaguauuugcuucugguggaauuaaaugacgguaaaauuggcuaauua

SEQ ID NO: 140223 - RNA, 64 nt, Human
guuaucuguaauauacaucccagaauaaaggagugaauuaaauaguuuacauguguguuacguu

SEQ ID NO: 140224 - RNA, 64 nt, Human
agucuggucuuuuguacuuuucuucagaagaaaugaauuaaaggguacaguugcauaaaguggg

SEQ ID NO: 140225 - RNA, 64 nt, Human
guuucauuuuugucaugacaauguaggaauugcugaauuaaauguuuagaaggaugacaugcaa

SEQ ID NO: 140226 - RNA, 64 nt, Human
cuuuguagaguuaauuuuauggaaauuaaaaucagaauuaaaugcuauguugugaugucuuuuu

SEQ ID NO: 140227 - RNA, 64 nt, Human
cauuuaggaaaaaacuucuguccaagcuuuguaugaauuaaauucauaaguauaccaaauuaaa

SEQ ID NO: 140228 - RNA, 64 nt, Human
auuucaguuuaguucuguaaugucaagaauuuaagaauuaaaaaacggauugguuaaaaaaugc

SEQ ID NO: 140229 - RNA, 64 nt, Human
uaggcuggauuccaucgccacaggacuuuaguuagaauuaaauuccugcuuguaauuuauaucc

SEQ ID NO: 140230 - RNA, 64 nt, Human
gcagauaacauuuguguguuauaccuugauuggggaauuaaaagucauuuaacugaagauguug

SEQ ID NO: 140231 - RNA, 64 nt, Human
gccuguauauauauauucauucuccaguguugcugaauuaaaauucugcuggacuuuuuaacau

SEQ ID NO: 140232 - RNA, 64 nt, Human
ugguaaaaauuccaaucagucaaaagaggucaaugaauuaaaaggcuugcaacuuuuucaaaaa

SEQ ID NO: 140233 - RNA, 64 nt, Human
uuucacuggagaggauuuggaugaacuagaagaagaauuaaauacacuugauuuagaagaauga

SEQ ID NO: 140234 - RNA, 64 nt, Human
cgagcugugcuugcaaagacuucauaguucccaagaauuaaaaaaaaaaaaaaaagaauuccac

SEQ ID NO: 140235 - RNA, 64 nt, Human
ugccccuuuucugagcaguaugccucuucuuuuagaauuaaaugaaugcugcacagguccagau

SEQ ID NO: 140236 - RNA, 64 nt, Human
cuugcucccaggcgccgguucugugguugguuuggaauuaaaguccuguuugaaguugucagac

SEQ ID NO: 140237 - RNA, 64 nt, Human
cuuuugcuuuccaugcauuugcacaaaacaaccagaauuaaagauuccacaaccaagaucugua

SEQ ID NO: 140238 - RNA, 64 nt, Human
auacaaagagugccauuggaacagcugugucuaagaauuaaaauuuuagagauguuuagugcuc

SEQ ID NO: 140239 - RNA, 64 nt, Human
aguauucaauaaccauuauguagaagguagauaagaauuaaaaggguuuaauuuccuagaaaga

SEQ ID NO: 140240 - RNA, 64 nt, Human
auggucuuuuuucuguauuucuagaaugguauuugaauuaaauguucaucuaguguuaggcacu

SEQ ID NO: 140241 - RNA, 64 nt, Human
caucugauuuaguuagcauccacauaucauugaggaauuaaagugugggacagucauuauuaaa

SEQ ID NO: 140242 - RNA, 64 nt, Human
augaaaagcugccaugauucugugguguucuaaggaauuaaaugcacuggagcuuuaagagcuc

SEQ ID NO: 140243 - RNA, 64 nt, Human
cuagaauuggucuaccaguuacuauggaguaaaagaauuaaacuggaccaucucucuccauauc

SEQ ID NO: 140244 - RNA, 64 nt, Human
cauuuuagcuuuauugugucuuaaaaacaaaagcgaauuaaaacacaacaaaaaaccccacccc

SEQ ID NO: 140245 - RNA, 64 nt, Human
ugggauacugugcccagagccucgaggagguaaugaauuaaagaagagaacugccuuuggcaga

SEQ ID NO: 140246 - RNA, 64 nt, Human
gaaggcccuucuacuucaguuuugaauccacaaagaauuaaaaacugguaacaccacaggcuuu

SEQ ID NO: 140247 - RNA, 64 nt, Human
gagaaagaccaguuuuaccuagauacuaaaggaagaauuaaaccgcuguuaguuugaaaugcuu

SEQ ID NO: 140248 - RNA, 64 nt, Human
guuuuccccuuccuuaucuucucuccuaucuauggaauuaaauuguggguaaaauguuagaacu

SEQ ID NO: 140249 - RNA, 64 nt, Human
uguuugcuaaauguugccuuuaugcuuucaaacugaauuaaacccauugugagguugacacugg

SEQ ID NO: 140250 - RNA, 64 nt, Human
aguauuuguaucauuuuaaauucuguaacacugggaauuaaauauacucaacuuuagaggacac

SEQ ID NO: 140251 - RNA, 64 nt, Human
auccuguguaguacuagaucuguaucucuugucugaauuaaacauuuuuaguugcuguguaaau

SEQ ID NO: 140252 - RNA, 64 nt, Human
gaggaaaugaaagcgauucuccuugaguucugaugaauuaaaggaguaugcuuuaaagucuauu

SEQ ID NO: 140253 - RNA, 64 nt, Human
uguuauuuuauaauaaaauuuaaaaaguuuuaaagaauuaaaucguaggacaaauuaauuaaaa

SEQ ID NO: 140254 - RNA, 64 nt, Human
auugucuaauaggagaaauaucuucccgagcucagaauuaaaaguucuccuaaauuaugaagau

SEQ ID NO: 140255 - RNA, 64 nt, Human
aauuucuuuauguaaucuauguauauacauuuaugaauuaaaguaauuguugguuaucuuaaaa

SEQ ID NO: 140256 - RNA, 64 nt, Human
cugugauauuauuacauaauguaauuaaaaauaugaauuaaaauauuccuacagucuuuagcau

SEQ ID NO: 140257 - RNA, 64 nt, Human
cccaccuuguugcaaaagcugaccucguugcauggaauuaaaagagaaggaaaaacacaaggau

SEQ ID NO: 140258 - RNA, 64 nt, Human
aaucuucaggacaguaagcagaacaaucagaauggaauuaaaucucuaaaaacguguuacagug

SEQ ID NO: 140259 - RNA, 64 nt, Human
aauaaaaacuaugacuuuuccccuugcagaggcagaauuaaagcuaaucuagggacucaaauca

SEQ ID NO: 140260 - RNA, 64 nt, Human
uucaagagaaaaugcgguuauaaaaaaugguucagaauuaaacuuuuaauucauucgauugugu

SEQ ID NO: 140261 - RNA, 64 nt, Human
gugcacacaaauguuggcaaagucaaaaccccaugaauuaaaaccuacuggaauuugguuuuua

SEQ ID NO: 140262 - RNA, 64 nt, Human
ucuugacaccaauuuuaagaauagcugugagaccgaauuaaagauaaucccuaccaagugaaaa

SEQ ID NO: 140263 - RNA, 64 nt, Human
cccccuuuccccacuuccuugacugcugugaugugaauuaaagauaaauacgugauacugaucc

SEQ ID NO: 140264 - RNA, 64 nt, Human
aagaccuuaaguaaaaggcacaauggguacuacagaauuaaaauguaggucuaacauaaugcca

SEQ ID NO: 140265 - RNA, 64 nt, Human
cuaaugggaaauggaucacacgauuucuuuaagggaauuaaaaaaaauaaaagaauuacggcuu

SEQ ID NO: 140266 - RNA, 64 nt, Human
cugguuuaauuaagcucucuccugacaacccccagaauuaaaugaaccaugauugugaagagua

SEQ ID NO: 140267 - RNA, 64 nt, Human
aaugcuguaaguguuguacaugucucugguuucagaauuaaaagaauucagaguuaccuuguga

SEQ ID NO: 140268 - RNA, 64 nt, Human
cuucugcuuugucugugucuauccaguggccuaggaauuaaaguguaaguuguuuucgcuguua

SEQ ID NO: 140269 - RNA, 64 nt, Human
uagcccuggguuuaaugucaaaucaaggcaaaaggaauuaaauaauguacuuuuggcuagaggg

SEQ ID NO: 140270 - RNA, 64 nt, Human
uaacuauugcaacuaucuaauaguucacacaaaagaauuaaaagcuuaaaaauaauuuuuagga

SEQ ID NO: 140271 - RNA, 64 nt, Human
acuaauucuuuaaaaaaaaaaaaaaguugagccugaauuaaauguaauguuuccaagugacagg

SEQ ID NO: 140272 - RNA, 64 nt, Human
aaauauuuuuaaguguucuaaaaauaaaaguauugaauuaaagugauucugcaauuuuucuaau

SEQ ID NO: 140273 - RNA, 64 nt, Human
agagauccagaaagaacaucgcaaucugcuucaagaauuaaaaguuauucaagaaaaugaacau

SEQ ID NO: 140274 - RNA, 64 nt, Human
ucuuugcuuuaggcuguuucucaucuaaguguuugaauuaaagauguuaaauuuuucuaauugu

SEQ ID NO: 140275 - RNA, 64 nt, Human
uccuaauccagauguauuaaaaauauauaaaagugaauuaaauaagcacauagaggaugguaug

SEQ ID NO: 140276 - RNA, 64 nt, Human
aguuacugccuaugcuuuuuaccuuaggcuuacagaauuaaauaaaaauuagccauuccagaaa

SEQ ID NO: 140277 - RNA, 64 nt, Human
gauuuaaugucuggugcugccgccugaguuucaagaauuaaagcugcaagaggacuccaggagc

SEQ ID NO: 140278 - RNA, 64 nt, Human
cucaccugagagccauugaauuugccuuccucaugaauuaaaaccucccccaagcagagcuucc

SEQ ID NO: 140279 - RNA, 64 nt, Human
gucaauccaggaacaguuauuuagaauucauauugaauuaaauuaauugcuagcuuaaucaaaa

SEQ ID NO: 140280 - RNA, 64 nt, Human
aagcuaucaguaacaguuucaugcuuauaccaaagaauuaaaucugaucuuuaauaucugauau

SEQ ID NO: 140281 - RNA, 64 nt, Human
gacuuuaucugagacaggaaggcagugguuaaaagaauuaaaaaaggacaguggugcuugacag

SEQ ID NO: 140282 - RNA, 64 nt, Human
guggagauuuacuugguucauacaccuuuugccugaauuaaaguauuucauguaggaggacuuu

SEQ ID NO: 140283 - RNA, 64 nt, Human
ggccaagaaacuguccuuggcucagagguguugggaauuaaagcagagagaagccauucgugau

SEQ ID NO: 140284 - RNA, 64 nt, Human
agauaugauacaccaacuucuaaaaagaaaguacgaauuaaagaccgcaauaaacuuucuacag

SEQ ID NO: 140285 - RNA, 64 nt, Human
ugaauuuuugagcauuuguccuaaucugcugccagaauuaaagaccuauuuuuagaggauuuug

SEQ ID NO: 140286 - RNA, 64 nt, Human
aggucuuuuacauacagugauaugguacuaaggagaauuaaacuccuacugcuuccucugaaua

SEQ ID NO: 140287 - RNA, 64 nt, Human
cuacgauccuaaagaacagaugaauaaaacuaaugaauuaaauaugaaauaacuuuaaauuuua

SEQ ID NO: 140288 - RNA, 64 nt, Human
agagaguguuuaaacacuccaacacccagacuuagaauuaaaucaguaaagcaaucuguuauuu

SEQ ID NO: 140289 - RNA, 64 nt, Human
aaagaaaacccucaguccuauuuauuaauggguagaauuaaauauauaauuuuauagcucaguu

SEQ ID NO: 140290 - RNA, 64 nt, Human
cagguccauucuguuuaaaucccuaagaaugucagaauuaaaauaacagggcuaucccguaauu

SEQ ID NO: 140291 - RNA, 64 nt, Human
uacuuaaauggcuaaguuuacuuggugcaguuaagaauuaaacuugucaauuuuaacauugcug

SEQ ID NO: 140292 - RNA, 64 nt, Human
uauagaaaguuuuaacugaauauguuacauauaagaauuaaauucuucucaaauaauucuuaac

SEQ ID NO: 140293 - RNA, 64 nt, Human
ugauuuagaagacaggauuguuuuugaacauuaggaauuaaaggcuauaucugguccuuacaau

SEQ ID NO: 140294 - RNA, 64 nt, Human
uuuguuaaauauuuuacugugguaauauagagaagaauuaaagcaagaaaaucugaaguauugu

SEQ ID NO: 140295 - RNA, 64 nt, Human
uauuagucaggcccuucaaagaugauauguggaggaauuaaauauaaaggaauuggagguuuuu

SEQ ID NO: 140296 - RNA, 64 nt, Human
cauuaccacucguaaaaagguaucuuuuuuaaaugaauuaaauauugaaacacuguacaccaua

SEQ ID NO: 140297 - RNA, 64 nt, Human
uuuuguuaauuuuauguccuuuuuuuccuaaagugaauuaaagugaaucauggaagcagcauua

SEQ ID NO: 140298 - RNA, 64 nt, Human
aaaaguuaagguuguucacuaugauggcaucuuagaauuaaacaaaacuuuuacuagggcugaa

SEQ ID NO: 140299 - RNA, 64 nt, Human
caaugcugucuucaucagaaaacaguuggcauaagaauuaaacauaugaacaucacaaaacaau

SEQ ID NO: 140300 - RNA, 64 nt, Human
auaacauaguaccugcuucguagaguuuuugugagaauuaaaggcaauaaagcauauaaugacu

SEQ ID NO: 140301 - RNA, 64 nt, Human
accaaaaugcauaccaguuauuauauauugccaagaauuaaaugauaaacuuagagacugauua

SEQ ID NO: 140302 - RNA, 64 nt, Human
uaauugaauaaaguugaagcuaagauuuagagaugaauuaaauuuaauuagggguugcuaagaa

SEQ ID NO: 140303 - RNA, 64 nt, Human
guugcacaacuuugugaauauacuagaaaccaaugaauuaaaaacuuuggaagaugaauuuuau

SEQ ID NO: 140304 - RNA, 64 nt, Human
ggccuuaaacaaaacaaacacaaaaacuuuuaaagaauuaaaccaaggcuuagccuuaagcagc

SEQ ID NO: 140305 - RNA, 64 nt, Human
aguucuauuuagcagguuaaaaaaugcugcauuagaauuaaagcaaguuauuuucuuauuugua

SEQ ID NO: 140306 - RNA, 64 nt, Human
auacaaaauaacaaaaauguaauggaaucagacugaauuaaaguaaggcuguauauugaaaguc

SEQ ID NO: 140307 - RNA, 64 nt, Human
auguuucucuauaaaguaugguaauagcuuuagugaauuaaauuuaguugagcauagagaacaa

SEQ ID NO: 140308 - RNA, 64 nt, Human
uagugccuaauguaucuauauuuuuauuauucaugaauuaaauuacuaaaaguauguuuauacu

SEQ ID NO: 140309 - RNA, 64 nt, Human
gauuaccaagucauucaccugaacaccagaauuagaauuaaacauuguaccauacaauuucauu

SEQ ID NO: 140310 - RNA, 64 nt, Human
guaaauuaguguaccuauuaaaaguugcaaaguggaauuaaaggaaucccuagaauaaggauuc

SEQ ID NO: 140311 - RNA, 64 nt, Human
auuucaguucuaaaaagauguaauaaucauuuuagaauuaaaauuuauucuacuuuuaaauaaa

SEQ ID NO: 140312 - RNA, 64 nt, Human
agaagcaaggagaaaauauaaggacuuuuugauggaauuaaaugugggagguaaggaaaaggau

SEQ ID NO: 140313 - RNA, 64 nt, Human
aaauagcucauacaauaauccauucaauagaauggaauuaaaacuguucagaaugauuuuccaa

SEQ ID NO: 140314 - RNA, 56 nt, Human
aaauggagcugacucagugaaaacuggaauuaaaaggaaagucaagaagaaugaac

SEQ ID NO: 140315 - RNA, 64 nt, Human
aaaaaaaucuaauaaaucuuagauuuuuaaaaaagaauuaaaaugugggaguucucagaaagaa

SEQ ID NO: 140316 - RNA, 64 nt, Human
gcacuuuguaaucagucccgugguugucuguacagaauuaaacuauuuuccgaugacugcugug

SEQ ID NO: 140317 - RNA, 64 nt, Human
uuuuaggauuuucagaacuagaauacuuuuuaaggaauuaaaaguguuucuggaagucaaaaau

SEQ ID NO: 140318 - RNA, 64 nt, Human
ccccugggcucuauuuauuaucaugacaauguuggaauuaaauuuugauucgaauaugucugcc

SEQ ID NO: 140319 - RNA, 64 nt, Human
auguuuaugucauagacguaguuuucgcauccuugaauuaaacugccuuaacuccuuuuguggu

SEQ ID NO: 140320 - RNA, 64 nt, Human
gaaacuucaaaauugaugaaaaacuaaauucgaggaauuaaaaucgaacaaaacauagccuuuc

SEQ ID NO: 140321 - RNA, 64 nt, Human
uguccucauugaguugacauccaaaauuugucaggaauuaaagaaugacuuuugaguggcaauu

SEQ ID NO: 140322 - RNA, 64 nt, Human
ugauuucauaauacuuuuuugggcucauguaguggaauuaaauauaccucuuacuucaggaaca

SEQ ID NO: 140323 - RNA, 64 nt, Human
uaaagagauacauuuuuagaaaucacaacaaacugaauuaaacaugaaagaacccaagacauca

SEQ ID NO: 140324 - RNA, 64 nt, Human
auaauaaauauaucaaaagguguuaaagaaaacugaauuaaacccaaaauuauguuuucauggu

SEQ ID NO: 140325 - RNA, 64 nt, Human
guuuuauucacuuguguuuguauauaaauggugagaauuaaaauaaaacguuaucucauugcaa

SEQ ID NO: 140326 - RNA, 64 nt, Human
ggaguguaaaacugggaaaugcugcucacugacagaauuaaaaaaaaaaauaaccaguaugaaa

SEQ ID NO: 140327 - RNA, 64 nt, Human
aaaguuacuuguauuagaacauaauaaaaguagagaauuaaacuaccuaaauaaaugcaucaaa

SEQ ID NO: 140328 - RNA, 64 nt, Human
uguugauaaaaucaagucuugguuguggcuugcugaauuaaauauuuaugaguggugcauuuuu

SEQ ID NO: 140329 - RNA, 64 nt, Human
uuguuugauguuuuuaaagguuuuugaaauccaggaauuaaaucaucccuuaauaaaauauucg

SEQ ID NO: 140330 - RNA, 64 nt, Human
ugcuuggaaaccccacaugcaaacgucaugaggagaauuaaaggaguauuaucaguaaugaagu

SEQ ID NO: 140331 - RNA, 64 nt, Human
augguguagcugacagcuaauaggggcuguaaaggaauuaaacuauucagaagggcuccuaaua

SEQ ID NO: 140332 - RNA, 64 nt, Human
ucaaaugaacuuuuuauagacaaugaugaaaacagaauuaaagucaauguuuccugacucccag

SEQ ID NO: 140333 - RNA, 64 nt, Human
uugcagcguguuguuuccuuugugacucaagguugaauuaaaaugccugugaacugcaaacuug

SEQ ID NO: 140334 - RNA, 64 nt, Human
aaaccugguuuuuaaaaaggaacuauguugcuaugaauuaaacuugugucgugcugauaggaca

SEQ ID NO: 140335 - RNA, 64 nt, Human
aauaaacccuuucaucuuuuuuuuuuuccuuuaagaauuaaaacugggaaauagaaacaugaac

SEQ ID NO: 140336 - RNA, 64 nt, Human
cuuuaagaacuuuuaccgacuccaaaaaucucaggaauuaaacuuuuaacaguuacagcaauaa

SEQ ID NO: 140337 - RNA, 64 nt, Human
gcuaccucaaacuuccagucagguaguugcaauugaauuaaauuaggaauaaauaaaaauggau

SEQ ID NO: 140338 - RNA, 64 nt, Human
aauuucacaaaacuaaggguaaaagacauuuaaagaauuaaacuuaaauaagugugugcagcau

SEQ ID NO: 140339 - RNA, 64 nt, Human
agucuauucaagcaugacagcauuucucuuugaggaauuaaaaucuuuaggaaagugaucaugg

SEQ ID NO: 140340 - RNA, 64 nt, Human
gcaacacugugaagacaaucaugggauuuuacuagaauuaaacaacaaacaaaacgcaaaaccc

SEQ ID NO: 140341 - RNA, 64 nt, Human
uacaggaugccaguaaaaaaaaaaaauggcuucagaauuaaaacuaugaaauauuuuacaguuu

SEQ ID NO: 140342 - RNA, 64 nt, Human
gcauuggguucuaaaggacuaacauaaaaucugugaauuaaaaaagcucaaugcauugucuugu

SEQ ID NO: 140343 - RNA, 64 nt, Human
aaaaugaagacuacauuugugaacaaaaaauggagaauuaaaaauaccaacuguacaaaauaac

SEQ ID NO: 140344 - RNA, 64 nt, Human
uuggguaaagaaaggaauacuuuuguuagaaugagaauuaaagagaaaacaaaagaaucuuggc

SEQ ID NO: 140345 - RNA, 64 nt, Human
ugccauggcauuugacaguucauuauuccuauaagaauuaaauugaguuuagagagaauggugg

SEQ ID NO: 140346 - RNA, 64 nt, Human
uguaagcccacacaagcucuucuuaucucuacuagaauuaaaauguuaagucaaaaacggcucc

SEQ ID NO: 140347 - RNA, 64 nt, Human
ugcaaacagcagaauagaaugaaaucucaguaaugaauuaaagcaacaaaaagauauugauugg

SEQ ID NO: 140348 - RNA, 64 nt, Human
uaaaaauauuuaauaauuuauucuuucuauuacugaauuaaaaaaucagaggucccuguuauau

SEQ ID NO: 140349 - RNA, 64 nt, Human
ugcuuuauucauccuccaucucaaaaugaacuuggaauuaaauauuguaagauauguauaaugc

SEQ ID NO: 140350 - RNA, 64 nt, Human
ggcacaguuaucuuacugaaaaugcaugcauggugaauuaaaauaaaagggggaacaaugcaca

SEQ ID NO: 140351 - RNA, 64 nt, Human
uaacucuggacuaaaaaaaucaggaucauuaaaagaauuaaaaacuauguauuucagcauucaa

SEQ ID NO: 140352 - RNA, 64 nt, Human
ugauauauuuuauugaagaguuaucucuuauucugaauuaaauuaagcauuuguuuuauugcag

SEQ ID NO: 140353 - RNA, 64 nt, Human
uucccaacacuugccugauggaaaaaaaacaaaggaauuaaaacucuccucaggcauucggaag

SEQ ID NO: 140354 - RNA, 64 nt, Human
aaccauucaauuuauaaauaauuagguccccaacgaauuaaauauuauguccuaccaacuuauu

SEQ ID NO: 140355 - RNA, 64 nt, Human
uuguuaagccucucuguucagccuguuuuaaaaagaauuaaagaguuaaauaaaaaauaaacug

SEQ ID NO: 140356 - RNA, 64 nt, Human
agcuuucucacuuuucugcuuguuuguucagucugaauuaaaauuagacuuugaaaauaaagcu

SEQ ID NO: 140357 - RNA, 64 nt, Human
acagguguaguuugugugcauaaauaauacuuccgaauuaaauuauuuaauauuugacugauuu

SEQ ID NO: 140358 - RNA, 64 nt, Human
gcagaauuaaauuucuaauugagcagauuagauugaauuaaauagaaacuuauugaauauacau

SEQ ID NO: 140359 - RNA, 64 nt, Human
auucaguacuuugcuuuaaaaaaauuuuguggcagaauuaaauuucuaauugagcagauuagau

SEQ ID NO: 140360 - RNA, 64 nt, Human
ucaaagucauuaugcaguauguauaaacuuauaagaauuaaauugaugugauaauuuuauguuu

SEQ ID NO: 140361 - RNA, 56 nt, Human
acuuauaccuugcugucuaguuuaaggaauuaaaaauacacaugcaugaaccuuga

SEQ ID NO: 140362 - RNA, 64 nt, Human
uauucugaauuguuaacuagguauuucaaaacaggaauuaaauucaauaggcucuucucaguga

SEQ ID NO: 140363 - RNA, 64 nt, Human
aaaacaggacaauuuaaaaauuuuaaauuuuaaagaauuaaaaauuuuaaaaauuuaaauuaaa

SEQ ID NO: 140364 - RNA, 64 nt, Human
cugaguuuuacaccauacuguuaagaguccuuuugaauuaaacucgacuaaaacaaguguauaa

SEQ ID NO: 140365 - RNA, 64 nt, Human
uuuuuuauaccugccuuaaauaauuuggcaaucagaauuaaaaaguuuuuuuuuuuuuaaauaa

SEQ ID NO: 140366 - RNA, 64 nt, Human
aacaggaaauaaaaaagggaucuuuuacauuauagaauuaaaacuaauuuuuucuuguauauaa

SEQ ID NO: 140367 - RNA, 64 nt, Human
cuuuaauuucccuauacaggaaaugauuggaauagaauuaaaaggaguccaacauucccagcuc

SEQ ID NO: 140368 - RNA, 64 nt, Human
gucaucacugagucagcacucaccuggccugggggaauuaaaggaauuccccguaagggcugga

SEQ ID NO: 140369 - RNA, 64 nt, Human
uagcagaagucauguuccagcuuagacugaugaagaauuaaaaaucugcaucuuccacuauuuu

SEQ ID NO: 140370 - RNA, 64 nt, Human
uuggaaccccacguuuuuucuuaaaaauuauucugaauuaaauguauauuucuuuagccuuccc

SEQ ID NO: 140371 - RNA, 64 nt, Human
gguaagaccugaaacuguuuguucucucccacuagaauuaaauggauguuuagacuggcuacuu

SEQ ID NO: 140372 - RNA, 64 nt, Human
uaagggguuuccugcuggacaggggcgugggauugaauuaaaacagcugcgacaacaccugugu

SEQ ID NO: 140373 - RNA, 64 nt, Human
guguacacagacugacgaaacuuuaaauaaaugggaauuaaauauuuaagagcugacuggaagc

SEQ ID NO: 140374 - RNA, 64 nt, Human
aaacacucuccuggacucuggcaaaauaaaaaaugaauuaaaacucuauccccaaguuucaaca

SEQ ID NO: 140375 - RNA, 64 nt, Human
aggcccugaagauagaagccaggcccgaaggccagaauuaaagggguagcuuggccaucagcuc

SEQ ID NO: 140376 - RNA, 64 nt, Human
cuauuaucaguucugccuagguaaauguaagauagaauuaaauggcagugcaaaauuucugagu

SEQ ID NO: 140377 - RNA, 64 nt, Human
gagccucaaguccaguccucuaucacuuuugcaugaauuaaaguauauagcgcaaaagagcacc

SEQ ID NO: 140378 - RNA, 64 nt, Human
aaaaucauccuuuuuuucacacauacugacuguagaauuaaaaaacaaagcuacaauuugcccu

SEQ ID NO: 140379 - RNA, 64 nt, Human
ucucucgacagcaaaugguuuccccucaccucuggaauuaaagaaggaacuccaaaguuacuga

SEQ ID NO: 140380 - RNA, 64 nt, Human
uuuuaaucugaaaauuuaucauguuuuauaauuugaauuaaaguuuugucccccccccccuuuu

SEQ ID NO: 140381 - RNA, 64 nt, Human
caaauccaguagcagaaucaucuuccacaacaaggaauuaaaguaauuaaagugcaaguucaau

SEQ ID NO: 140382 - RNA, 64 nt, Human
uauggugugugccaguuaugaguugaccauuugggaauuaaacaggucacacgugacagaugaa

SEQ ID NO: 140383 - RNA, 64 nt, Human
augcucuguuuccaacugcauuuccuuuccaauugaauuaaaguguggccucguuuuuagucau

SEQ ID NO: 140384 - RNA, 64 nt, Human
ugcuccucugccccauucacuauuuaccaauugggaauuaaagaaauaauuaauuugaacaguu

SEQ ID NO: 140385 - RNA, 64 nt, Human
cuggcauuucacaaaacagccuuugggaaaugcugaauuaaagugaauuguugacaaauguaaa

SEQ ID NO: 140386 - RNA, 64 nt, Human
uuuuaaacuaacaaaauggaauguuaacugaauggaauuaaacauagcaauugucaagccauca

SEQ ID NO: 140387 - RNA, 64 nt, Human
agcaccgaucggaacuguaaagcuauaauccccagaauuaaaguuuuuauuauuuuuuauacau

SEQ ID NO: 140388 - RNA, 64 nt, Human
aauuuaaauuuauccuccaacuaaauuuuugauagaauuaaauuuaaauuuguccuccaacugu

SEQ ID NO: 140389 - RNA, 64 nt, Human
guuugcacaauuuaaauuugauaaauuuuugauagaauuaaauuuaaauuuauccuccaacuaa

SEQ ID NO: 140390 - RNA, 64 nt, Human
aggcugcauauggauugccaagucagcauaugaggaauuaaagacauuguuuuuaaaaaaaaaa

SEQ ID NO: 140391 - RNA, 64 nt, Human
agggaggagguaaaaggcagggaguuaauaacaugaauuaaaucuguaaucaccggcuauuucu

SEQ ID NO: 140392 - RNA, 64 nt, Human
uauauuacuaaguaacaacauaugguuguucuaagaauuaaaaggaacugacauguaaaagugc

SEQ ID NO: 140393 - RNA, 64 nt, Human
uguuucuuauaaaucuguuuacuuuuuauauuaagaauuaaacuguaccuaaaaaaacucugac

SEQ ID NO: 140394 - RNA, 64 nt, Human
ucuaugccaauuuugaaaaaacuauaagcacaaggaauuaaauacuauugaguauagaacuguu

SEQ ID NO: 140395 - RNA, 64 nt, Human
uuuguagaugauguauuuugcuugggcaccaacagaauuaaaaacgaaaaacaaaaaaaaacuc

SEQ ID NO: 140396 - RNA, 64 nt, Human
auuuccaaucuucuccuagccaaccauuuuccuggaauuaaaaauucaguaaaaaaggaaacua

SEQ ID NO: 140397 - RNA, 64 nt, Human
auuucugaaaauaaaugcuuaauuacauauacaggaauuaaauaguuuggaagaggguuggauu

SEQ ID NO: 140398 - RNA, 64 nt, Human
uguuuaaugacaaauaacuuucuuuaucuccuuggaauuaaagagggcuuuuaaaagauaauuu

SEQ ID NO: 140399 - RNA, 64 nt, Human
uuaucugaagacuaugaagacuucuaugcuaaccgaauuaaaauguacuuguugaucucugaau

SEQ ID NO: 140400 - RNA, 64 nt, Human
acuuuacuguaaggacaguuucgguaguuaaguggaauuaaaggucuagagugauuuguauugg

SEQ ID NO: 140401 - RNA, 64 nt, Human
uucuuuauagugauucucuuguguacaugcuugugaauuaaauuuguguaaaaucccuuggcaa

SEQ ID NO: 140402 - RNA, 64 nt, Human
ugcuacaacugguaacaaugaccagaagccugaagaauuaaaaugccaacaccaaaccuuuccu

SEQ ID NO: 140403 - RNA, 62 nt, Human
aaaauacaaugcaaaacaaaauaaugaaguaagugaauuaaauuauugcaccaaauaugggg

SEQ ID NO: 140404 - RNA, 64 nt, Human
agcuaguuuaacacuugagcaaaugcuuaagaaggaauuaaaaaaaaaaagcuuugccaauagc

SEQ ID NO: 140405 - RNA, 64 nt, Human
ggaaaaaaaucuuaugauuucuggauugauaucugaauuaaaacuaucaacaacaaggaagucu

SEQ ID NO: 140406 - RNA, 64 nt, Human
gcgaaagaaaucaaacccccaacuucuucggcgugaauuaaaagaaacauucccuuagacacag

SEQ ID NO: 140407 - RNA, 64 nt, Human
auauuuuuaacaggaauuuaagaaaauauuacuggaauuaaaaauauauauauauuaaacaaga

SEQ ID NO: 140408 - RNA, 64 nt, Human
gaaggugaacaugggggugagacugaagccugaggaauuaaaggucauaugacagggcuguuac

SEQ ID NO: 140409 - RNA, 64 nt, Human
uucaucaacaucuguaucuuuccagagguauacagaauuaaaauuugaucuucaagcuuuaaug

SEQ ID NO: 140410 - RNA, 64 nt, Human
aaggacagaaaccuuucuuuguguaugcauguuugaauuaaaagaaaguaauggaagaauugau

SEQ ID NO: 140411 - RNA, 64 nt, Human
uagauagaaaugucuacuuuuucagcaguucugugaauuaaagagcagagugacugugggucug

SEQ ID NO: 140412 - RNA, 64 nt, Human
ugcaaugauauaggaaugaggucugaacuccacugaauuaaaccacuggcauuugggggcuguu

SEQ ID NO: 140413 - RNA, 64 nt, Human
auaaaaaugaacauguauauacauuuggaaauuugaauuaaauacuguaucauacuuucaaagg

SEQ ID NO: 140414 - RNA, 64 nt, Human
guaguggguaugguugacacuagcccaaugaaaugaauuaaaguggaccaauagggcugagcuc

SEQ ID NO: 140415 - RNA, 64 nt, Human
cuaagaguuagucuggacuggcccuaggaaacuugaauuaaauaagccucuuccccuuaccgau

SEQ ID NO: 140416 - RNA, 64 nt, Human
uuuguacaacuuuggucuugaugggaaaaauggagaauuaaaaaguguuuugagaagcuuaaau

SEQ ID NO: 140417 - RNA, 64 nt, Human
agucauguauaaucuuuauggcuuccaaggacaagaauuaaaauacucuuuuacguaaaaugag

SEQ ID NO: 140418 - RNA, 64 nt, Human
ucaacacuuucccuuuuuucccaaaaugaguagagaauuaaagccacccaaaacagcuucugcu

SEQ ID NO: 140419 - RNA, 64 nt, Human
gcuucaaguaauacuucugccaguuguguuuuaugaauuaaacagggaacggcaugcugaacuu

SEQ ID NO: 140420 - RNA, 64 nt, Human
ucuccuagcauucaugauuuuuuuuucauacaaugaauuaaaauugcuaaaaucauggacuggc

SEQ ID NO: 140421 - RNA, 64 nt, Human
cuguagucaucuuauuugagaugggggugggaacgaauuaaaauaugauagagaacuauaugca

SEQ ID NO: 140422 - RNA, 64 nt, Human
cgagcaauacuauagcuucacacaguuugcgcuggaauuaaaugaaauggauccaucaucaaag

SEQ ID NO: 140423 - RNA, 64 nt, Human
caggggaagcauucagcaacccuuuaaagaaaaagaauuaaaugcaugcuuuaaauuuuuucug

SEQ ID NO: 140424 - RNA, 64 nt, Human
cggcuucuguaauaaucguauugccuauauacuugaauuaaaaauauaugguggcucaaaugug

SEQ ID NO: 140425 - RNA, 64 nt, Human
uuaguaauuugcaaaagccacaacaguaguggaagaauuaaaauucauaaagucucaucauucu

SEQ ID NO: 140426 - RNA, 64 nt, Human
ucauaguuuaaacugcauuauaaauuuuauaacagaauuaaaguagauuuuaaaagauaaaaug

SEQ ID NO: 140427 - RNA, 64 nt, Human
guuauuuuagccauguaaauaaguguagauagaggaauuaaacuguauauucuggauaaauaaa

SEQ ID NO: 140428 - RNA, 64 nt, Human
uuuacagacaaaauguuaauagaccauauucuuugaauuaaauuuguuuuuaauuuucucuaca

SEQ ID NO: 140429 - RNA, 64 nt, Human
uuccaucacuuugccaaaaccuauuuaaaacagugaauuaaauuuucacuagguuugaaugauc

SEQ ID NO: 140430 - RNA, 64 nt, Human
gaaugagaguuccuucucacuuagaauccgaagggaauuaaaaagaagaugaauggucuggcaa

SEQ ID NO: 140431 - RNA, 64 nt, Human
ugaggacccaauauuggccuguuugcaacagcuagaauuaaauuuuacuuuuaaguaaguuucu

SEQ ID NO: 140432 - RNA, 64 nt, Human
aauauuuacuuagggauaauguggggauucacaugaauuaaauagcugcaauuggaagaagagg

SEQ ID NO: 140433 - RNA, 64 nt, Human
aaacuaaaaacaaggaaauguaccucuuucuucagaauuaaaacuaaaaucuuaaauaaaacag

SEQ ID NO: 140434 - RNA, 64 nt, Human
auaugacacagcuuguccccaucguucaccuuuagaauuaaauauaaauuaacuccucacauug

SEQ ID NO: 140435 - RNA, 64 nt, Human
agaugaauauugcuugagauuuauaauacccuuagaauuaaauuccuguuauuugcccaguuuu

SEQ ID NO: 140436 - RNA, 64 nt, Human
uuauuuaaaacuggaaacuaaaaagaaucaaauugaauuaaagcuauauaaacacaguuaaccc

SEQ ID NO: 140437 - RNA, 64 nt, Human
gugugaccaugcugggggagggggacucugcuuggaauuaaaagguugcauugggucccuacau

SEQ ID NO: 140438 - RNA, 64 nt, Human
gcauugugcuagcauggaagaaucaugggcuuuggaauuaaacccauuugguggaauuaaaccc

SEQ ID NO: 140439 - RNA, 64 nt, Human
gaaucaugggcuuuggaauuaaacccauuugguggaauuaaacccauuugguuucaaaucccag

SEQ ID NO: 140440 - RNA, 64 nt, Human
auucuuuuaacuucuuucuauuugacuugugguugaauuaaaauugucccauuugcuuugcggu

SEQ ID NO: 140441 - RNA, 64 nt, Human
acauucugguagcucaguuaauaaaacaauuucagaauuaaagaaauuuucuaugcaagguuua

SEQ ID NO: 140442 - RNA, 64 nt, Human
cauucgaacuuaacagaugccuccucuccaaagagaauuaaaaucguagcuuguacagaucaag

SEQ ID NO: 140443 - RNA, 56 nt, Human
gcaugagcaguggaagauaaaccgaagaauuaaagaucccacuuccagccgggccc

SEQ ID NO: 140444 - RNA, 64 nt, Human
auguaguuuuccaguagugaugaaucaaauuauugaauuaaauuucuucuuaagaaguaaaaac

SEQ ID NO: 140445 - RNA, 64 nt, Human
aaaauugagcuuucuagaauauuugccuaauugggaauuaaaaaguaaaauaauaggccaggca

SEQ ID NO: 140446 - RNA, 64 nt, Human
cauaucaucaaaagacugaaaaauuauaauuuuagaauuaaacugauggauuucauuauagaau

SEQ ID NO: 140447 - RNA, 64 nt, Human
uccuccaggaauuuuccugugauucuccuuguaagaauuaaaugcucucuaauaugauaucccu

SEQ ID NO: 140448 - RNA, 64 nt, Human
uuuacauguuacuuugagaugcuagguauuuguggaauuaaaaagaaucaggcucuuuuguacu

SEQ ID NO: 140449 - RNA, 64 nt, Human
auuccucucaaauucauaacaguucuauuuaacugaauuaaauaaccauaugaaaaaucuuuug

SEQ ID NO: 140450 - RNA, 64 nt, Human
aaauugcaggagauuuaauguauaaaauuucuaggaauuaaaagcuuaaacccaaaaauuguuc

SEQ ID NO: 140451 - RNA, 64 nt, Human
ccaaaaauuguucauccauauauaagaaauuaucgaauuaaaacuuaauguaugucaauuauuu

SEQ ID NO: 140452 - RNA, 64 nt, Human
auuguaauugguugucacuguuguacggugucuagaauuaaagaauacauguaaacuuucaugg

SEQ ID NO: 140453 - RNA, 64 nt, Human
uaauguacagaaugguuggagaaaugccuauggugaauuaaagcuucauaucugcuuucugaau

SEQ ID NO: 140454 - RNA, 64 nt, Human
auuuuuucucuccuuuucuuuucuucaauaaaaagaauuaaaaacccaucuccucucugugugg

SEQ ID NO: 140455 - RNA, 64 nt, Human
auacaaggggacuucaaaaguucacgaaaaaauugaauuaaaagauaaaaauuaaaaaauguuu

SEQ ID NO: 140456 - RNA, 64 nt, Human
agaaaggacaaccaggaugaggaugucaccaacugaauuaaacuuaaguccagaagccuccugu

SEQ ID NO: 140457 - RNA, 64 nt, Human
cccuucuacuggagauaggaaaaguagaauucaggaauuaaaagaauuacucuuuauucaauuu

SEQ ID NO: 140458 - RNA, 64 nt, Human
uuuaggaauaauaaauucaucagaauccuuggcugaauuaaaaugguuuuuguuuuuugguuuu

SEQ ID NO: 140459 - RNA, 64 nt, Human
aguugucauacacaaggcgcauauauauauuugugaauuaaaaucuguagcugagucuacauug

SEQ ID NO: 140460 - RNA, 64 nt, Human
uaaauacaaauauaugcauuguguaauccacucagaauuaaacagacaaaagguaugcuugcuu

SEQ ID NO: 140461 - RNA, 64 nt, Human
gcaaaauuggauuaaauuccaccuaucuuaaugugaauuaaaaaccaccauuuauaauaauaau

SEQ ID NO: 140462 - RNA, 64 nt, Human
uuccaaagugucuccauuagcauauacugagcaggaauuaaauaaagcaucagauacugaucug

SEQ ID NO: 140463 - RNA, 64 nt, Human
agcucuuuugaaaguacucgacaccuuuagauaagaauuaaaaccaaccuauguaacugacaua

SEQ ID NO: 140464 - RNA, 64 nt, Human
cuuuaggaaaaagaggaacaaagacauuauuugagaauuaaauuauauauuuuuaauaugacug

SEQ ID NO: 140465 - RNA, 64 nt, Human
aaagcaaagacuauuuuuaugcuuccauaaccuagaauuaaaaccaaauuaugaccuuaugaua

SEQ ID NO: 140466 - RNA, 64 nt, Human
uagugaaauguggaagucaaccagaccaaugauggaauuaaauguaaauuccaagagggcuuuc

SEQ ID NO: 140467 - RNA, 64 nt, Human
gaggcuuugucauuuagcauuagacuuuaaacaagaauuaaaaucaugugcuguauuuuuaaaa

SEQ ID NO: 140468 - RNA, 64 nt, Human
gcucccuugaaauaacaagacuuuugagcaaucugaauuaaaaauacaucaaaaaaguaauagc

SEQ ID NO: 140469 - RNA, 64 nt, Human
aauguuucuguaggacuuuguucuccacaagcuugaauuaaagcaggauucaguuugcauuugu

SEQ ID NO: 140470 - RNA, 64 nt, Human
cagcugaauuugugagaaaacaagaggccucaaagaauuaaauaauuuuuaaaaggugguaaag

SEQ ID NO: 140471 - RNA, 64 nt, Human
uaaaauuugaaucuauuugagcuuuaguucagcagaauuaaauuuuuacuugacauuaucauua

SEQ ID NO: 140472 - RNA, 64 nt, Human
acagauuagaugaaaagaugguuguaagcuuugggaauuaaaaacaaacaaauacauuuuagua

SEQ ID NO: 140473 - RNA, 64 nt, Human
ugggaugugguuucugccuucuagagagagaucagaauuaaacuaguacuaugaaauguccuuu

SEQ ID NO: 140474 - RNA, 64 nt, Human
uuggagacauuccugggcacaguuugguccguuagaauuaaaaguugaauuuuuuuuuuuuuua

SEQ ID NO: 140475 - RNA, 64 nt, Human
ccugggacacugcgggacagaggguggcuggagugaauuaaagccuuuguuuuuuaaagaaaug

SEQ ID NO: 140476 - RNA, 64 nt, Human
caccaggccuuggagacaggcuagccuggccacagaauuaaacguguugccacaccugccggcu

SEQ ID NO: 140477 - RNA, 64 nt, Human
uagacaaagugaagccgcagacagcaguccuucagaauuaaaauacuuaggcuuggauacucau

SEQ ID NO: 140478 - RNA, 64 nt, Human
ccaguugcccucauuuccaaagaacugcacucuggaauuaaagggacucuuccauuuugaagaa

SEQ ID NO: 140479 - RNA, 64 nt, Human
aagaaauaugugagauuuuuuauugcuaguauuugaauuaaaacuucuuaaauaucuuuuaugu

SEQ ID NO: 140480 - RNA, 64 nt, Human
cauacgaacuaguaaaaaggucuaaauuauucaugaauuaaaaugaauggauucucauauuaac

SEQ ID NO: 140481 - RNA, 64 nt, Human
auuacucaugauaaacugacauggcuaacugcaagaauuaaaucuucuaucugagaguaauaau

SEQ ID NO: 140482 - RNA, 64 nt, Human
uguauuacugacaguucuagauuaauuucuuuuagaauuaaaguagauuuguuaaaguguauug

SEQ ID NO: 140483 - RNA, 64 nt, Human
aaaugauaauaucuaccuugugugauuccuggaagaauuaaauacauuauauucaaaaucuuuu

SEQ ID NO: 140484 - RNA, 64 nt, Human
auguauauucuagggucaggggaaauguaaucuggaauuaaauauuagccuuaaaauucacaau

SEQ ID NO: 140485 - RNA, 64 nt, Human
agguccuagaguugccuguuugucucuggagauggaauuaaaccaaauaaagagcuuccacugg

SEQ ID NO: 140486 - RNA, 64 nt, Human
gugaagugaaugcaagauaaaaagugggauggaagaauuaaauccagaguuccaggcaaucaaa

SEQ ID NO: 140487 - RNA, 64 nt, Human
uggacaggugaacaguagggcauuacauuugugugaauuaaaugugaacuucuguauuacguug

SEQ ID NO: 140488 - RNA, 64 nt, Human
uugauugauagaaagaaaguugcuuuucuuuugagaauuaaaaacuuuggcuugauuucuuuuu

SEQ ID NO: 140489 - RNA, 64 nt, Human
guuaggccccuuucugaucaggaggcuucuuuaugaauuaaacucgccccaccacccccuccuc

SEQ ID NO: 140490 - RNA, 64 nt, Human
uuuuuuucccuaagugaucaacaucaaauuuuuagaauuaaaauacauuuaacucagggaauuu

SEQ ID NO: 140491 - RNA, 64 nt, Human
uucuuuuugaucaacagggacaaaaacaucuuuagaauuaaaaacaugguuguuuuggaauuuu

SEQ ID NO: 140492 - RNA, 64 nt, Human
guauacugcuuacagguuuagauauagucuguuagaauuaaaaccaaguuuaguguucauauuu

SEQ ID NO: 140493 - RNA, 64 nt, Human
uugauuggguauuuucauuauuauuuggacacaugaauuaaaucccaagggaaagugagaagaa

SEQ ID NO: 140494 - RNA, 64 nt, Human
cacaagagucuuggagguuugcguguuucugcuagaauuaaaaaguuaaauuuaaaaaugaaaa

SEQ ID NO: 140495 - RNA, 64 nt, Human
aaugaaaaagauguacguuguagacaaaguugcagaauuaaaaaaagaaaucugcuuuuaauuu

SEQ ID NO: 140496 - RNA, 64 nt, Human
caaacuaugacuacuacauuccaaagaaacaguugaauuaaacauuuucauaaaauaucccaca

SEQ ID NO: 140497 - RNA, 64 nt, Human
gcacuugauguuuguuugcaugaugucuaccucagaauuaaaacuuuaaggaagaagaaacucu

SEQ ID NO: 140498 - RNA, 64 nt, Human
agauuuuaccacuaucaaauauaauucaagggcagaauuaaacgugagugugugugugugugug

SEQ ID NO: 140499 - RNA, 64 nt, Human
acccuaaaugucauugcaagaaauaaaaauuuaagaauuaaauugcugcccuguguauaaucuc

SEQ ID NO: 140500 - RNA, 64 nt, Human
aacccccucucuuuucuuuuagcuccucuguggugaauuaaacguacuugaguuaaaauauuuc

SEQ ID NO: 140501 - RNA, 64 nt, Human
auggggaaacaggccagagcauugcccggcuccugaauuaaacucuguucuggugccugagcuc

SEQ ID NO: 140502 - RNA, 64 nt, Human
aauaaacagcaaaauauuguccuuacucauucaagaauuaaaaggauaaauuuuaaaaauguua

SEQ ID NO: 140503 - RNA, 64 nt, Human
gccacaucuaaaagagcacaguuuauguggugcggaauuaaacuuccccauccugcagauuaug

SEQ ID NO: 140504 - RNA, 64 nt, Human
aaauaucagcauaacuaugugggcaaaauagauagaauuaaaugcaugaauuuuccucagacuu

SEQ ID NO: 140505 - RNA, 64 nt, Human
caauagaagacauuuucacuggaauuacaaagcagaauuaaaauuauauuguagaaggaaacac

SEQ ID NO: 140506 - RNA, 64 nt, Human
guuuguaauauauucaugaggcuggaaguaagaagaauuaaaaauuuguccuaauuacaaugag

SEQ ID NO: 140507 - RNA, 64 nt, Human
ccuucccagcauuugacuguucauugcauagaaugaauuaaauauccaguuacuugaaugggua

SEQ ID NO: 140508 - RNA, 64 nt, Human
gcugagacaggagguuauuuucaauuuuauuuuggaauuaaauacuuuuuucccuuuauuacug

SEQ ID NO: 140509 - RNA, 64 nt, Human
gaaucuacccaauaccacacugcccccauuaauggaauuaaauugggaaaaacaauauugccuc

SEQ ID NO: 140510 - RNA, 64 nt, Human
ggcucaagaagcgccggagcaagaggcuguacgugaauuaaaaacgccaccuugggcucgagca

SEQ ID NO: 140511 - RNA, 64 nt, Human
uaugcagagccgugaacgucauggcauguccaaggaauuaaaugggaguucauuugggcugggg

SEQ ID NO: 140512 - RNA, 64 nt, Human
cauguuuuaucauuuggauggaguaauuuaaaaugaauuaaauuccagagaacaauggaagcau

SEQ ID NO: 140513 - RNA, 64 nt, Human
gcuauuugguaaugaggaacuguuauuuguaugugaauuaaagugcucuuauuuuaaaaaauug

SEQ ID NO: 140514 - RNA, 64 nt, Human
gugauaaaagugggaagacauaaagagccuuugugaauuaaaguggaagagaauaacacuuugc

SEQ ID NO: 140515 - RNA, 64 nt, Human
cuucaauauaagcuaugaaguaauaguugguugugaauuaaaguggcaccagcuagcaccucug

SEQ ID NO: 140516 - RNA, 64 nt, Human
caaaugucaauuauuagaccgagcauauugugaagaauuaaacuaaaauuaauacguacaguuu

SEQ ID NO: 140517 - RNA, 64 nt, Human
aggugauagcagaagcuuuucauuuuuaaacauagaauuaaaauuggauuugcuucucuuuaau

SEQ ID NO: 140518 - RNA, 64 nt, Human
uuuaaugcaaauacauacauuccugaaagacggggaauuaaauuacuaauuuuuuuuuuuuuuu

SEQ ID NO: 140519 - RNA, 64 nt, Human
guucccagguccuagcucaggaguuggcaaauaagaauuaaaugucugcuacaccgaaaaccuc

SEQ ID NO: 140520 - RNA, 64 nt, Human
ggcauuacauugccucacauucacuaaccaccuugaauuaaauuuauuucuuaagaaaaagcau

SEQ ID NO: 140521 - RNA, 64 nt, Human
gcugucagugccaacugaggaguuuuuguuugcugaauuaaaguacucugacauuucacccccc

SEQ ID NO: 140522 - RNA, 64 nt, Human
cuuccguacaauuucugucucaacaaaauuagaagaauuaaauuuaaaacuagcuccaaaagag

SEQ ID NO: 140523 - RNA, 64 nt, Human
ucuguuuuacugcuuuuaacuucugauagcguuggaauuaaaacaaugucaaggugcuguuguc

SEQ ID NO: 140524 - RNA, 64 nt, Human
caaauuuagccaauaaagaaauuaacacccaaaagaauuaaauugauuauuuugugcaacauaa

SEQ ID NO: 140525 - RNA, 64 nt, Human
cccuugccaguuuuucugggagcuaggaagaggugaauuaaauuuucugagcacuaugacuucu

SEQ ID NO: 140526 - RNA, 64 nt, Human
uucuuggugucugcuucucagauuccaaggacuggaauuaaaaccuuuccugggacucuggcgu

SEQ ID NO: 140527 - RNA, 64 nt, Human
gguucugauugcaaacaaacagugaacacugucugaauuaaacaaaaagcugcccgacuugcaa

SEQ ID NO: 140528 - RNA, 64 nt, Human
uagucccucccuucccucuccuugagugcauuuugaauuaaagccuauauugaaaagaauggag

SEQ ID NO: 140529 - RNA, 64 nt, Human
aaguuaaugucuagccaagaguuuaguaaacgaagaauuaaacugcacuguugaucggugcuuu

SEQ ID NO: 140530 - RNA, 64 nt, Human
auacucucuggcuccccucauccucauggucacugaauuaaaugcuuauuguauugagaaccaa

SEQ ID NO: 140531 - RNA, 64 nt, Human
uacaaauagauuuccaugaagauauuugucuucagaauuaaaacugcccuuaauuuuaauauac

SEQ ID NO: 140532 - RNA, 64 nt, Human
ucauaaaaagugaaugucaucuuuuucuuuuaaagaauuaaauuuugugguaugucuuuuuguu

SEQ ID NO: 140533 - RNA, 64 nt, Human
uuaaaggaaaaggaaauguccccaaaguauuaaagaauuaaaugauacugaaaauuuguaugau

SEQ ID NO: 140534 - RNA, 64 nt, Human
aacaagccuaacauuggugcaaagauugccucuugaauuaaaaaaaaaaacuagauugacuauu

SEQ ID NO: 140535 - RNA, 64 nt, Human
cucucaagggaaggugaugcaggggagaaaaugugaauuaaauuacauagauggguguuuuuau

SEQ ID NO: 140536 - RNA, 64 nt, Human
gcuguaauucugaaauacacauccaagugaaugagaauuaaaaauuuucuaaauauuaauacua

SEQ ID NO: 140537 - RNA, 64 nt, Human
aucuggaguugaguuggugucagauaguguaugagaauuaaaugugucaucugagcaugcuacu

SEQ ID NO: 140538 - RNA, 64 nt, Human
guuccagggaugaucaugagcaggcgcaaaaucagaauuaaaggucgcacauagacguuucaga

SEQ ID NO: 140539 - RNA, 64 nt, Human
uugccaauuacaauauacggcaagugucuuuuaugaauuaaaaugaacuaaaccuuccacuuca

SEQ ID NO: 140540 - RNA, 64 nt, Human
uaaauuuuuuaaagaaauauuagacaaaaauauagaauuaaaaccuuugguuccaaaaugggaa

SEQ ID NO: 140541 - RNA, 64 nt, Human
uagaaaguauuucuuuuugggguaauauaacuuagaauuaaaucccuguuucucuauguagucu

SEQ ID NO: 140542 - RNA, 64 nt, Human
auaucagcaucaaauucuuuggguaucucucuaagaauuaaauaaucuuuucuagcuuaauauu

SEQ ID NO: 140543 - RNA, 64 nt, Human
auaaugacauuuucuuuaaauuagacucuauuuugaauuaaaagaguuuuauuauaaaccgugu

SEQ ID NO: 140544 - RNA, 64 nt, Human
acagguggaauguagauauuguaaagcuuuuugugaauuaaaagugcaaaauaaagcaaccaca

SEQ ID NO: 140545 - RNA, 64 nt, Human
gaacuauauaauaauauggacuugcuguguaauggaauuaaagugcuuuugcacaauaaguucu

SEQ ID NO: 140546 - RNA, 64 nt, Human
aaauuagguuuggagggaacuuugaucuuccuaagaauuaaaguugccaaauuauucugauugg

SEQ ID NO: 140547 - RNA, 64 nt, Human
auaauaaaucaccucuuccgcuguuuuagcugaagaauuaaaucaucuugucuauuauguuuuu

SEQ ID NO: 140548 - RNA, 64 nt, Human
ucacuguugugaaucaccaaaggagcuauggagagaauuaaaacucaacauuacuguuaacugu

SEQ ID NO: 140549 - RNA, 64 nt, Human
uuuggauaugccucaaucuaaucuugcguucagugaauuaaacauaguaauuaagugucuuuug

SEQ ID NO: 140550 - RNA, 64 nt, Human
gcucucacuggccagaguaaguccuguaaacacagaauuaaauuaggggacucaagcaacuauu

SEQ ID NO: 140551 - RNA, 64 nt, Human
gcauuagcauauucagcaaauccaucuguggugggaauuaaaaauauuauugguauuaaagaaa

SEQ ID NO: 140552 - RNA, 64 nt, Human
uaacuuucgaggcacuggaacauaccugaacuaagaauuaaaucuuuuacuuuauacucacuua

SEQ ID NO: 140553 - RNA, 64 nt, Human
uuauuguucuuuuuaagaaaaaaacugagaguuugaauuaaaaguuuaaaucauugcuaggucc

SEQ ID NO: 140554 - RNA, 64 nt, Human
cucauguaggcagaguauaaaguauuaccuuuuggaauuaaaagccacugacuguuauaaagua

SEQ ID NO: 140555 - RNA, 64 nt, Human
uauaugaauugcauuuucaaaagaagauuuguaagaauuaaacuauauuuaugaguaaacuuuu

SEQ ID NO: 140556 - RNA, 64 nt, Human
caaauuuugcuauaauguacaaauugcuauaugugaauuaaaaaguuuucagaaucuugauuug

SEQ ID NO: 140557 - RNA, 64 nt, Human
ugacuacuuagugguguauaugagacuuucaagggaauuaaauaaauaaauaagaauguuauug

SEQ ID NO: 140558 - RNA, 64 nt, Human
caaagcauauaaucucuacuccuuacagucucuagaauuaaauguacucauuuagacaacauau

SEQ ID NO: 140559 - RNA, 64 nt, Human
aaaagauuuuaacaaguauaaaaaauucucauaggaauuaaauguagucucccugugucagacu

SEQ ID NO: 140560 - RNA, 64 nt, Human
cuaagaauggcagcaucuauuuccucuuuuguuugaauuaaagacucugaauuucugcuguaua

SEQ ID NO: 140561 - RNA, 64 nt, Human
caaaaggacccuguucacugcugcacuuuucaaugaauuaaaauuuauuucuguucuaguggga

SEQ ID NO: 140562 - RNA, 64 nt, Human
acauauaccccaaaaugcuaaguggaaacugcaugaauuaaaagagggguaugauagggacauu

SEQ ID NO: 140563 - RNA, 64 nt, Human
aaugaguuaaauauaauaacaaugacuuuaugaggaauuaaagguuaagcuuuguguuuaccua

SEQ ID NO: 140564 - RNA, 64 nt, Human
auaugcauaccuaaugaaguauugguuuuaguaagaauuaaauacauuucauugagcuuuaaag

SEQ ID NO: 140565 - RNA, 64 nt, Human
uaaaaucgggcacucuauauucauuaagguuuaugaauuaaaaagaaagcuuuauguaguuaug

SEQ ID NO: 140566 - RNA, 64 nt, Human
caauauuauaugcagaaaucacaggaugaauuuagaauuaaaucucaauuaguucacuuuggcc

SEQ ID NO: 140567 - RNA, 64 nt, Human
uaaccuuaccaguuuuauaaugcaguuuuugauggaauuaaacacaaagaacuugaaagcaguc

SEQ ID NO: 140568 - RNA, 64 nt, Human
cucauuauaccaauucacuauuuuauuuuuuaaugaauuaaaacuagaaaacaaauugaugcaa

SEQ ID NO: 140569 - RNA, 64 nt, Human
uuuaacagaucaagaaaaugaagccaaaucaagugaauuaaauuccucacaauuauuuucuuuc

SEQ ID NO: 140570 - RNA, 64 nt, Human
caagucagcaagcucuaugugagucucaggaagugaauuaaauuuggaccuuauguuuuacucu

SEQ ID NO: 140571 - RNA, 64 nt, Human
aaaaauuuagauuuauucuaaauguauuugaugugaauuaaaauaaauauuuuuucaugugaaa

SEQ ID NO: 140572 - RNA, 64 nt, Human
cacaaugguuuuuaaauuuuguaaugaauuccuagaauuaaaccagauuggagcaauuacgggg

SEQ ID NO: 140573 - RNA, 64 nt, Human
cacaaggaaaucaagaugaaaagcacucauuaaggaauuaaaguuacaaguuuuaucuuaauaa

SEQ ID NO: 140574 - RNA, 64 nt, Human
uuaaaggauguguuuguaugcauucuggacauuugaauuaaaaaaaaaguauugugauccugua

SEQ ID NO: 140575 - RNA, 64 nt, Human
acagaaaauggaggcuuucacaaggguuugaucagaauuaaaaccccaaacccgcccucuguua

SEQ ID NO: 140576 - RNA, 64 nt, Human
uaauagcagucauagugaagauuagcacuacuuagaauuaaauuaggaagucuuuuaucauugc

SEQ ID NO: 140577 - RNA, 64 nt, Human
aguagaucuacgaaaauauuguucauacugaucagaauuaaauuuguauagagcagaguuuuaa

SEQ ID NO: 140578 - RNA, 64 nt, Human
cauuauuugaagcugucugaagaaugcacuuuaugaauuaaaaaacugaauugccugaccucgu

SEQ ID NO: 140579 - RNA, 64 nt, Human
aaagaaauucuugaauucgucauucucaaccuuugaauuaaagcuuagacuaaauaguaauaua

SEQ ID NO: 140580 - RNA, 64 nt, Human
gaccuguuuaauaauuuaccauccugaaaguccagaauuaaaauauggaagcaagaacuauaua

SEQ ID NO: 140581 - RNA, 64 nt, Human
augcuuauggcuuggagaaauuucuuaguugggugaauuaaagguuaauccgagaauuagcaug

SEQ ID NO: 140582 - RNA, 64 nt, Human
gggaauugugagaugaauggagaggccccaucgugaauuaaagaugcugaccuggggauuguua

SEQ ID NO: 140583 - RNA, 64 nt, Human
uaugugacucuuuuuacauuuccuaaagguuugagaauuaaauauauuuaauuaugauuuagua

SEQ ID NO: 140584 - RNA, 64 nt, Human
acauguuuucauuccaaacugguagugguauguagaauuaaagauaauaauguugcuucuuauu

SEQ ID NO: 140585 - RNA, 64 nt, Human
uggaugaggaaauuaagguuuuagaaagcuuaaugaauuaaagagcuugucuaauuaguuagua

SEQ ID NO: 140586 - RNA, 64 nt, Human
agaggaaaaaaagaggaaagaaggaaaaaaaaaagaauuaaaaaaaaaaaaaagaaaaacagaa

SEQ ID NO: 140587 - RNA, 64 nt, Human
gccugacacaguagguauucaauaaaaauuuacugaauuaaaggauuaaauuaggugacauggu

SEQ ID NO: 140588 - RNA, 64 nt, Human
aauagggucagauauuuugcacuguauauucugugaauuaaaaguuaugugauuggugucaaac

SEQ ID NO: 140589 - RNA, 64 nt, Human
uguuaguauaaaagauauuaaauauaggugccaagaauuaaauguauaauuuguuuaauaagag

SEQ ID NO: 140590 - RNA, 64 nt, Human
uccuaacaaaagacaauggauggccuuagcaucagaauuaaaauaaucuggauuaaauggcaau

SEQ ID NO: 140591 - RNA, 64 nt, Human
uucuggauuuuuuucucccaacuguggcccaaaagaauuaaaaucuguuaauauaaauagagaa

SEQ ID NO: 140592 - RNA, 64 nt, Human
ccacagcaaaugagauguaugcccaaagacgguagaauuaaagaagaguaaaauggcuguugaa

SEQ ID NO: 140593 - RNA, 64 nt, Human
uuuugauaagugauuauuaugcuugauaaacuuugaauuaaauacaguugucuugaggguauga

SEQ ID NO: 140594 - RNA, 64 nt, Human
gacuccaaagaaugcccgcgcugaaauuuggcgugaauuaaacugaagcccaggccucuaccuu

SEQ ID NO: 140595 - RNA, 64 nt, Human
auuuuaguuuugucacaguuaacugugucaaagagaauuaaaaaaaaaaacuucagauuuuguu

SEQ ID NO: 140596 - RNA, 64 nt, Human
cuuuagguccuuccucuucuuuggggcuggaacagaauuaaauuuguuuggaaaaaaaaaaaaa

SEQ ID NO: 140597 - RNA, 64 nt, Human
ggaugacaauuugcugagagagugcagcuuuugugaauuaaacuugaaguccaggcagaauucu

SEQ ID NO: 140598 - RNA, 64 nt, Human
aaaguuaagccaaaauuuaagcaguuuuuauaaugaauuaaauuauuccauaaauaauauuuaa

SEQ ID NO: 140599 - RNA, 64 nt, Human
gcauuuauuuuccuuacgagaagguuuucguagagaauuaaauaaauguaggcccuuuuaccuu

SEQ ID NO: 140600 - RNA, 64 nt, Human
cuauuuugauuuuauuuaauuuuuuaaaguugaagaauuaaauauuuuaaugguucuaaucuuu

SEQ ID NO: 140601 - RNA, 64 nt, Human
auuuuuuguuuucauuuaccagaauaaaaacuaagaauuaaaaguuugauuacagucaaaagaa

SEQ ID NO: 140602 - RNA, 64 nt, Human
cccaaaagagaaauaaaugcucacaagugcuguagaauuaaacuucagaaguucuaaccuaaaa

SEQ ID NO: 140603 - RNA, 64 nt, Human
gcaaauauuauaguauaauagugaucccuauggagaauuaaaggugagaaagcuacuuuguggu

SEQ ID NO: 140604 - RNA, 64 nt, Human
aucaugguggauuugaucuucaguggccaaacacgaauuaaaguauaauucuuaacugaacugg

SEQ ID NO: 140605 - RNA, 64 nt, Human
agaguaucauccauaugguccauccuaauucacagaauuaaaugagcuuaaauagaaaauucag

SEQ ID NO: 140606 - RNA, 64 nt, Human
cugcuuagauauggaguggaggugauuuacugcugaauuaaaacucaagugacacaaguuacaa

SEQ ID NO: 140607 - RNA, 64 nt, Human
accugcuccaggaccaaucagugaaaccugcucggaauuaaaggcuuccucugggugccugcug

SEQ ID NO: 140608 - RNA, 64 nt, Human
aggguuugucuacauuuuuugggcucuggauaaggaauuaaaggagugcagcaauaacugcacu

SEQ ID NO: 140609 - RNA, 64 nt, Human
cacacucuuaauacugauuacauggauuggacuugaauuaaauauauuguuacaauuaaacuga

SEQ ID NO: 140610 - RNA, 64 nt, Human
caggcacaguccuuggcacacagaauacagcagugaauuaaacaggcaaaaauuccuccccucc

SEQ ID NO: 140611 - RNA, 64 nt, Human
uauauucacuuucugacauuuagauaugccaaaagaauuaaaaucaaaagcacuaagaaauaca

SEQ ID NO: 140612 - RNA, 64 nt, Human
uuucaccaaggauuuucaagacaaacuggaguaagaauuaaagccccagaggauuuaauuaucc

SEQ ID NO: 140613 - RNA, 64 nt, Human
gcuaaacaucaccaucaucuaagagcgggucaaggaauuaaaaaaaaacaacaaaacguuuaag

SEQ ID NO: 140614 - RNA, 64 nt, Human
aaaacuguguaucauuaaaauauauguucugcaagaauuaaaacugaguccaugaaaauaccau

SEQ ID NO: 140615 - RNA, 64 nt, Human
uuggaauuuuguuuccuccauaaaauguggaagugaauuaaacaaguuuuagucauuuauacaa

SEQ ID NO: 140616 - RNA, 64 nt, Human
caggguaccuggggccaaacccaccugcuagugugaauuaaaguacuuuaauuuuguuuucugu

SEQ ID NO: 140617 - RNA, 64 nt, Human
uuuuuuuuuuuaaagaagaaaaaaaaacugcccugaauuaaauggcuguuuuaacaguaggcuc

SEQ ID NO: 140618 - RNA, 64 nt, Human
caacucccaagcccuaaagagaaccuucucacaagaauuaaaaacaaaaagggcaaaccuagga

SEQ ID NO: 140619 - RNA, 64 nt, Human
acaaaggcagaaaaugaaacaccacuagguaaaagaauuaaaaaucuaauccuuuauuucuuaa

SEQ ID NO: 140620 - RNA, 64 nt, Human
uuucagaaccaauugcgagucauguagugugguagaauuaaaggaggacacgagccugcuucug

SEQ ID NO: 140621 - RNA, 64 nt, Human
cagcuccugccacuaucuuuagagccaauaaagagaauuaaaaaccugugcaccaggagcaucu

SEQ ID NO: 140622 - RNA, 64 nt, Human
uuccacuaauguagauuauugaaaauuagauauugaauuaaagcuaauauaugagaaguuauau

SEQ ID NO: 140623 - RNA, 64 nt, Human
acauauguagucuggucuguauauaugaaaauuugaauuaaacugcagaauguuuaugucuagu

SEQ ID NO: 140624 - RNA, 64 nt, Human
uuuaaagagaggaaugcucuacgugcucagaacugaauuaaaauggcauuaugucaauagagaa

SEQ ID NO: 140625 - RNA, 64 nt, Human
uuauuuuuacaaggcagaaugggguguaacaguugaauuaaacuuagcaaucacgugcucagag

SEQ ID NO: 140626 - RNA, 64 nt, Human
ggagggcgagggcgagaaagggcaggcacucugcgaauuaaaggccuuggacuugaagcgcccg

SEQ ID NO: 140627 - RNA, 64 nt, Human
gcuggacuggauuucuucuggagggaagcaccaugaauuaaaggugccagagcuccaugcaugg

SEQ ID NO: 140628 - RNA, 64 nt, Human
acaauguaacggaugaccauaugcacaauuccaugaauuaaaucuguuuccuguguuagucagu

SEQ ID NO: 140629 - RNA, 64 nt, Human
acauauuucugaucaugugcugccuuuuacugcugaauuaaaacagauauuucacgaaaaaugu

SEQ ID NO: 140630 - RNA, 64 nt, Human
ccugauaacaagacucugugggcccaacucuccugaauuaaaggagccuuuugacccaaucaua

SEQ ID NO: 140631 - RNA, 64 nt, Human
ggaccgaacauuauucuaguuucauguuuaauuugaauuaaauauauucugugguuuauaugaa

SEQ ID NO: 140632 - RNA, 64 nt, Human
guguggggggagauaccuuuaccaugaacuuacagaauuaaagauggcccauaaggaauuccag

SEQ ID NO: 140633 - RNA, 64 nt, Human
ucacugcaauuuuguguaaauuucucaaagaucugaauuaaauaaauaaaauucauuucuacag

SEQ ID NO: 140634 - RNA, 64 nt, Human
cgcaguucuguucagccaucagaagagagacaaggaauuaaaaauuucuuuuuaauccuguuac

SEQ ID NO: 140635 - RNA, 64 nt, Human
cuucuacgagaucaacgcgaggggccuguaucuugaauuaaaaccuacucgcuuccuuucugca

SEQ ID NO: 140636 - RNA, 64 nt, Human
ccucuucccucuuucuccccauggccccacugcagaauuaaagaaggaagaagggaaggcggag

SEQ ID NO: 140637 - RNA, 64 nt, Human
acugucaccggccucagggaguuuauguguaauagaauuaaaaauaauagcuguguauaacacu

SEQ ID NO: 140638 - RNA, 64 nt, Human
uucaaaguaaacaccaccaccguggacaacucuugaauuaaauccacuagagcgagcuuuaaaa

SEQ ID NO: 140639 - RNA, 64 nt, Human
acuagggccagcgcaaauacuggaaccuguaacagaauuaaaggugaauguucugagauguugc

SEQ ID NO: 140640 - RNA, 64 nt, Human
gagcaagugacaugccauccauucugccgucguggaauuaaaucacggauggcagauuggaggg

SEQ ID NO: 140641 - RNA, 64 nt, Human
ugaauguaguuaacugguuccugcucacacuccagaauuaaauucuauugaaaaaggaaaauca

SEQ ID NO: 140642 - RNA, 64 nt, Human
uuaagcauuguucccccucuaaccugugucuaaagaauuaaaagaauuuggccgggugcggcag

SEQ ID NO: 140643 - RNA, 64 nt, Human
gaaacucacuuucccuguggcacguuaugcuucagaauuaaaacaaugaagauuaaaauuugca

SEQ ID NO: 140644 - RNA, 64 nt, Human
auaguuuuauagcuacuauuguauuucacuuguugaauuaaaguauuugaauucuuuuaaaugu

SEQ ID NO: 140645 - RNA, 64 nt, Human
uccugccagcuguuugcccuuaggccaguacacagaauuaaagugggggagauggcagacgcuu

SEQ ID NO: 140646 - RNA, 64 nt, Human
cccuauaaauuaaaaauuuuuuacuuaaauuuaagaauuaaaaaaauacaaaaaagaaaaaaug

SEQ ID NO: 140647 - RNA, 64 nt, Human
cuuuauuuucauagauugagaaguuuuguacagagaauuaaaaaugaaauuauuuauaaucugg

SEQ ID NO: 140648 - RNA, 64 nt, Human
agccccagucacccucuuggagcuucccugcuuugaauuaaagaccacucaugcucuucccugg

SEQ ID NO: 140649 - RNA, 64 nt, Human
accuauaagcagcaguauaagcaauauggaacucgaauuaaauauccacaauucaaaagcaccu

SEQ ID NO: 140650 - RNA, 64 nt, Human
uggcguuggaaauaauaccucuuucacuaggugagaauuaaaugacuuaauguguauuaaaggg

SEQ ID NO: 140651 - RNA, 64 nt, Human
uaaaaauuguguacaggauauuccuuuagugguggaauuaaaauguacgaauacuugcuuuuuc

SEQ ID NO: 140652 - RNA, 64 nt, Human
uaaacaggauaguaguuggcaagaugaaaugccagaauuaaaaccaaucauaaguagaacccac

SEQ ID NO: 140653 - RNA, 64 nt, Human
auaguaagugguguaguauuaaaauauuuucacggaauuaaaaguagcuugcugucaaagaaac

SEQ ID NO: 140654 - RNA, 64 nt, Human
uaaagaaagugaaaaauguaaaacacauacaaaagaauuaaacccacaagcugccucugacagc

SEQ ID NO: 140655 - RNA, 64 nt, Human
uuguuuugaauauuacuccuauuuuuguaaacuggaauuaaaaggauaguauuuuuauccauga

SEQ ID NO: 140656 - RNA, 64 nt, Human
cuuggugucauaucuaggggaagagaauuaacuagaauuaaauuuaauguuugaaucuaaauca

SEQ ID NO: 140657 - RNA, 64 nt, Human
cugacugaagagagccuguggccauguaaaaagagaauuaaacucuuguugcuuuuuguauacc

SEQ ID NO: 140658 - RNA, 64 nt, Human
aacuuucauauauguuaaaggauuauaauuuauggaauuaaaaaaugcaguguaguccuuaaau

SEQ ID NO: 140659 - RNA, 64 nt, Human
aaguuuauuuuuaauauuacuuauagcugagucagaauuaaaggagggaauuguauugauacuc

SEQ ID NO: 140660 - RNA, 64 nt, Human
accauggcaauucauaaauagaggaaacauuaaugaauuaaaagcauuccuuauuuuuuaacua

SEQ ID NO: 140661 - RNA, 64 nt, Human
auugaauuuuacuguuacacauaguuuuugacuugaauuaaaauacuagacaaagcagaaaugu

SEQ ID NO: 140662 - RNA, 64 nt, Human
aaugugaugauugaacucccuguguacagcgagugaauuaaaaugucugccucuccagacauuu

SEQ ID NO: 140663 - RNA, 64 nt, Human
auuauguucuacagaauauucucccauaaacacugaauuaaauauggaacaacugcuuuuagga

SEQ ID NO: 140664 - RNA, 64 nt, Human
uaugguuacuaauaguuuuauaauggaggucuaagaauuaaaguugugugggaguuucaggaca

SEQ ID NO: 140665 - RNA, 64 nt, Human
ucagaauagauauuucugauuugaaaauucuaaagaauuaaacuggaaaaguauuucauuuacu

SEQ ID NO: 140666 - RNA, 64 nt, Human
auaaucuuuacugcaaguguaaugauauuugagugaauuaaaaugcaugacagacaagguacaa

SEQ ID NO: 140667 - RNA, 64 nt, Human
ugcagcccuccuucugggcacuaagaaggucuaugaauuaaaugccuaucuaaaauucugauuu

SEQ ID NO: 140668 - RNA, 64 nt, Human
ugaagaaaguuuuggaaaagaaacaaugaagacugaauuaaauuaaaaauguugcagcucauaa

SEQ ID NO: 140669 - RNA, 64 nt, Human
gccaaugaaagaugaauuugcauuguagauguacgaauuaaauauguucuucaaaaucuugggg

SEQ ID NO: 140670 - RNA, 64 nt, Human
uuauaauauacaaaugaauuauacuauuagauaagaauuaaauauucuauuuuuauaaagauaa

SEQ ID NO: 140671 - RNA, 64 nt, Human
guguguuuucccuccaagugugauauuuccugcugaauuaaauuauacuucaguuguugccuca

SEQ ID NO: 140672 - RNA, 64 nt, Human
ccuugaauucuuugauuuauuuuauugcaucaaugaauuaaaacaaaaaucuugggggaagaaa

SEQ ID NO: 140673 - RNA, 64 nt, Human
uuuuguauaaguaguuucaaacuauuugagaggagaauuaaagacaugcuuguuuuguuucgac

SEQ ID NO: 140674 - RNA, 64 nt, Human
guagauucaaacaaagaugcucuguagacaaguagaauuaaaccugcgaauccguguaaaaauu

SEQ ID NO: 140675 - RNA, 64 nt, Human
cuucucugcugaccuugccaaguuguucgagguggaauuaaacaccucccagaccucuggcuug

SEQ ID NO: 140676 - RNA, 64 nt, Human
uuuugccuaaugucccugccucuagguucauaaugaauuaaagguucaugaacgcugcgaaacc

SEQ ID NO: 140677 - RNA, 64 nt, Human
gucaauccaaaccauuggcaucaucguuucuuuugaauuaaaaccaacauaucagcaauagucu

SEQ ID NO: 140678 - RNA, 64 nt, Human
gauacagauaguacaaugacuuuuuuguaaauuugaauuaaaaguuuccucauaaaacucagua

SEQ ID NO: 140679 - RNA, 64 nt, Human
aaguguccuacuaaaaagaauaaauguuggcagugaauuaaacaauuuuucaaaugacauguga

SEQ ID NO: 140680 - RNA, 64 nt, Human
aaaucacaaaaacaaaaaaacuauaaaaaagaaagaauuaaaaacuuucagagaauuacuauuu

SEQ ID NO: 140681 - RNA, 64 nt, Human
guccccagacauugcaccuggcgcuguuaggccggaauuaaaguggcuuuuugagguuugguuu

SEQ ID NO: 140682 - RNA, 64 nt, Human
uggauucccugauauguuccuucaaaucugcugagaauuaaauaaacaucucuaaagccugacc

SEQ ID NO: 140683 - RNA, 64 nt, Human
cugacguuccuugugacuuaaggguccggcuugggaauuaaaguuuguuucuggccuuuagccu

SEQ ID NO: 140684 - RNA, 64 nt, Human
aggacaguaggcccggcucugcccguagcccugagaauuaaacgccggcucucccugcaguggu

SEQ ID NO: 140685 - RNA, 64 nt, Human
ugaaauguccgucauaucucagagcauauagagggaauuaaauaaacacaaagcauuuggaaaa

SEQ ID NO: 140686 - RNA, 64 nt, Human
accccaccccagucuccccacacggaccuuugcugaauuaaaguuuguaaguaaaugguuuuaa

SEQ ID NO: 140687 - RNA, 64 nt, Human
caucugcaaccauugucgagauucuucguaggaagaauuaaaggaauggggaagaaggacuugg

SEQ ID NO: 140688 - RNA, 64 nt, Human
uccuugccaagccuccaccacuaggucaguguaagaauuaaagaaagaggaaagaaacacaaaa

SEQ ID NO: 140689 - RNA, 64 nt, Human
uggaauuaaggcaggucagaggacuguaaugauagaauuaaauuagugucacuaaaaacugucc

SEQ ID NO: 140690 - RNA, 64 nt, Human
acucagcugccacgggugagagagcaggagguaugaauuaaaagucuacagcacuaacccgugu

SEQ ID NO: 140691 - RNA, 64 nt, Human
aaaugugagaaaccuuugugagacagagaacagggaauuaaaugugucauacauauccacuuga

SEQ ID NO: 140692 - RNA, 64 nt, Human
uucagacagaguuguaccugcagcagacaacucugaauuaaagcaugaaaacacagcaagcccc

SEQ ID NO: 140693 - RNA, 64 nt, Human
gcacugauaguccuuuuuccaauguuuuauuggggaauuaaauagugugauguuuggauugaua

SEQ ID NO: 140694 - RNA, 64 nt, Human
uaggguagugacugagauguaaaaauagauuuuagaauuaaaacaaaauccaaguccucacacc

SEQ ID NO: 140695 - RNA, 64 nt, Human
uuaauccuucuaacuaaacuaaaauagauuaaaggaauuaaacuaaaauacaaguaaagcuaga

SEQ ID NO: 140696 - RNA, 64 nt, Human
uaacauccaguaaccacaggaauauauucucugugaauuaaaagucuucaaaguuaucauuucu

SEQ ID NO: 140697 - RNA, 64 nt, Human
uaauaauccgaaauguuaccgggguugacucacggaauuaaauuuuuccucuauuuuuauaucc

SEQ ID NO: 140698 - RNA, 64 nt, Human
gggaugaaggcaaggcugcaggucuggcccaggggaauuaaaagccagccacuccagugguauc

SEQ ID NO: 140699 - RNA, 64 nt, Human
ugguggacggacuguaauugauagauugauuauggaauuaaauuggguacagcuucaaaucccg

SEQ ID NO: 140700 - RNA, 64 nt, Human
uucuaguccuaggaugaggacacacuauuaguuugaauuaaaugcuuugauauucucagaucag

SEQ ID NO: 140701 - RNA, 64 nt, Human
uaaauugucucuugucuccuucaguuaauuuucagaauuaaaaacauaccaugggaaaaaagcu

SEQ ID NO: 140702 - RNA, 64 nt, Human
ugcauaaaugcauuauaggaucauuuguuggaaugaauuaaauaaacccuuccuggggcaucug

SEQ ID NO: 140703 - RNA, 64 nt, Human
ggagaacagagaugagauuugacaaaaaaaaauugaauuaaaaauaacacagucuuuuuaaaac

SEQ ID NO: 140704 - RNA, 64 nt, Human
caugccaucuucccugcgaucaggcaaaaaaguggaauuaaaaagucaaaccuuuauaugcaug

SEQ ID NO: 140705 - RNA, 64 nt, Human
uaaauguuaccaagaugauuccaaugagggguuggaauuaaaugcauuaaguagugaauucaug

SEQ ID NO: 140706 - RNA, 64 nt, Human
uaaucuggcuucuugugucuggacuaaguuaaaagaauuaaaauacuuuguaauguccugggcu

SEQ ID NO: 140707 - RNA, 64 nt, Human
ugauuugguuauuuugguaccugagaacguaacagaauuaaaaggcaguugcuguggaaacagu

SEQ ID NO: 140708 - RNA, 64 nt, Human
uggggacacaacugcccgggacucuaacuuccaggaauuaaagacucaccacacacgaaggauc

SEQ ID NO: 140709 - RNA, 64 nt, Human
guuucagagaauguuuauacauuauuucuaccgagaauuaaaacuucagauuguucaacaugag

SEQ ID NO: 140710 - RNA, 64 nt, Human
augaguaaaguagguaaacuucacaggccccuuagaauuaaauccuuagggcaugguucaaguc

SEQ ID NO: 140711 - RNA, 64 nt, Human
guugcuguaaauccccauuggagacugcauuagggaauuaaagcugcuugucacuuuuugcuga

SEQ ID NO: 140712 - RNA, 64 nt, Human
ggcagaugucccaauccuggaggucauccauuaggaauuaaauucuccagccucacucucggcu

SEQ ID NO: 140713 - RNA, 64 nt, Human
ggugaaugccaccuccugagauccucaccucuuggaauuaaaauuguuggucacuggggaaagc

SEQ ID NO: 140714 - RNA, 60 nt, Human
aagcagaauuaugucuguagaguuggaagagaauuaaacgaaaaucauuguuaauugcug

SEQ ID NO: 140715 - RNA, 64 nt, Human
aucuagaagaauaaaugccaagagggagaaaguugaauuaaacccaggaaaauaucagaagaac

SEQ ID NO: 140716 - RNA, 64 nt, Human
cugauagauaggaauuugugcuuacaaagcaggagaauuaaaaagacgcuuuccucuccucuuc

SEQ ID NO: 140717 - RNA, 64 nt, Human
uaguauucaucuuuguauucugaagauaagguuugaauuaaauugauacacacagaggggaacc

SEQ ID NO: 140718 - RNA, 64 nt, Human
gccacuagcuuccuguugugugcggggugugguggaauuaaacagcauucauugugugucccug

SEQ ID NO: 140719 - RNA, 64 nt, Human
ggggaggggugggaugauggggaaaggguggggggaauuaaaagggagggauaaauauauauau

SEQ ID NO: 140720 - RNA, 64 nt, Human
uucauuuauguagaugccacuuuaagcuuuaucagaauuaaaugugagauuucuucuuugagcc

SEQ ID NO: 140721 - RNA, 64 nt, Human
uguuguacaggugcugugagaccuacccuauucagaauuaaaccucacugcaaauuuccuccca

SEQ ID NO: 140722 - RNA, 64 nt, Human
gauuccacuguuuucuuuggggaauggaaguucugaauuaaaagcccacuguggagaugcugug

SEQ ID NO: 140723 - RNA, 64 nt, Human
auaaccauauaugucuggcuuacuuaagaauguagaauuaaaucauaauaaauuagaccucaug

SEQ ID NO: 140724 - RNA, 64 nt, Human
ugauguuuuuuggucaagaggguaugaacaggaagaauuaaaugcagcaggcuuuauuuuaaau

SEQ ID NO: 140725 - RNA, 64 nt, Human
uggaguuuugaacguaguaagccuuaccuuaauagaauuaaauucaugaaacauaagauaguga

SEQ ID NO: 140726 - RNA, 64 nt, Human
uacacaaaagcuuccuuccaguauuaaacaaaaagaauuaaacauaacuaugaaaaaacuuugc

SEQ ID NO: 140727 - RNA, 64 nt, Human
guauuuuguauugucaaggcaugcauauucuaaagaauuaaaugcuaacuuaacagcacuggcu

SEQ ID NO: 140728 - RNA, 64 nt, Human
gcaucaguggggaagaaaccuccccaggaaauuggaauuaaagugaaaaaucauucuggaggug

SEQ ID NO: 140729 - RNA, 64 nt, Human
ccugaauuugcuuggcuucuuugagaaugaaauugaauuaaauaugaauaaauaagucccccug

SEQ ID NO: 140730 - RNA, 64 nt, Human
cuaaacacaaagaaccaaguagccuaguaaauaagaauuaaauccagaauaaucauucacuucu

SEQ ID NO: 140731 - RNA, 64 nt, Human
agcuacugugacaugcaaaggaaaggacagugcagaauuaaaccguguugaagaccaguggaaa

SEQ ID NO: 140732 - RNA, 64 nt, Human
acacuuagguuuuuuuuguauaaaaauuuaaauugaauuaaaagaaggaaaaaaaaagcccaaa

SEQ ID NO: 140733 - RNA, 64 nt, Human
aaagaauuaaagcuucuaugaguauaugguuuaagaauuaaauuauuaguaauuuauuauuuua

SEQ ID NO: 140734 - RNA, 64 nt, Human
uacauuccccaagggucaaauuggagcuuuuaaagaauuaaagcuucuaugaguauaugguuua

SEQ ID NO: 140735 - RNA, 64 nt, Human
uguacuuuuuuugaucaguuggcaugaagccauagaauuaaauuuuggcuuuagaauacagaug

SEQ ID NO: 140736 - RNA, 64 nt, Human
uuuauuuuguaaaugccuaaugaggcagauuuuugaauuaaagaaaugcuacauguuccgguug

SEQ ID NO: 140737 - RNA, 64 nt, Human
uucauacuuuaaauuuauauggcuguggaaaaacgaauuaaaauguuuugaggagaaagacuuu

SEQ ID NO: 140738 - RNA, 64 nt, Human
cugcuuuuaaaggagggcauguucaguuuucugugaauuaaaauaugcucaugugugggcacac

SEQ ID NO: 140739 - RNA, 64 nt, Human
uauacuguguguagguaaaacaaaucucaauauggaauuaaauugucuuuuugggguuggacua

SEQ ID NO: 140740 - RNA, 64 nt, Human
gaaaucugccgauaaccuaaaauaauuuagaaaugaauuaaaaaugugaaaucggguuaaagug

SEQ ID NO: 140741 - RNA, 64 nt, Human
gaauagaaaaaaauuguuuauuuuuuauucuucugaauuaaaccccacuuauggguguaagccu

SEQ ID NO: 140742 - RNA, 64 nt, Human
ggaagacaacggagaccggugucgcgccgccuccacgcucgacauccugcacacccucagccug

SEQ ID NO: 140743 - RNA, 64 nt, Human
cccucccgccucgcugggcgcccuggccgcagacacgcucgacgaggcggagcgccaguggaag

SEQ ID NO: 140744 - RNA, 64 nt, Human
gagaagguccgccugugcgcguggaacacuguggacgcucgacuuccaagggucuucucacccg

SEQ ID NO: 140745 - RNA, 64 nt, Human
ucuucauuuaaaccaaaaucauauuucauauuuuacgcucgaggguuuuuaccgguuccuuuuu

SEQ ID NO: 140746 - RNA, 64 nt, Human; identical to SEQ ID NO: 42454

SEQ ID NO: 140747 - RNA, 64 nt, Human; identical to SEQ ID NO: 42455

SEQ ID NO: 140748 - RNA, 64 nt, Human; identical to SEQ ID NO: 42456

SEQ ID NO: 140749 - RNA, 64 nt, Human; identical to SEQ ID NO: 42457

SEQ ID NO: 140750 - RNA, 64 nt, Human; identical to SEQ ID NO: 42458

SEQ ID NO: 140751 - RNA, 64 nt, Human; identical to SEQ ID NO: 42459

SEQ ID NO: 140752 - RNA, 64 nt, Human; identical to SEQ ID NO: 42460

SEQ ID NO: 140753 - RNA, 64 nt, Human; identical to SEQ ID NO: 42461

SEQ ID NO: 140754 - RNA, 64 nt, Human; identical to SEQ ID NO: 42462

SEQ ID NO: 140755 - RNA, 64 nt, Human; identical to SEQ ID NO: 42463

SEQ ID NO: 140756 - RNA, 64 nt, Human; identical to SEQ ID NO: 42464

SEQ ID NO: 140757 - RNA, 64 nt, Human; identical to SEQ ID NO: 42465

SEQ ID NO: 140758 - RNA, 64 nt, Human; identical to SEQ ID NO: 42466

SEQ ID NO: 140759 - RNA, 64 nt, Human; identical to SEQ ID NO: 42467

SEQ ID NO: 140760 - RNA, 64 nt, Human; identical to SEQ ID NO: 42468

SEQ ID NO: 140761 - RNA, 64 nt, Human; identical to SEQ ID NO: 42469

SEQ ID NO: 140762 - RNA, 64 nt, Human; identical to SEQ ID NO: 42470

SEQ ID NO: 140763 - RNA, 64 nt, Human; identical to SEQ ID NO: 42471

SEQ ID NO: 140764 - RNA, 64 nt, Human; identical to SEQ ID NO: 42472

SEQ ID NO: 140765 - RNA, 64 nt, Human; identical to SEQ ID NO: 42473

SEQ ID NO: 140766 - RNA, 64 nt, Human; identical to SEQ ID NO: 42474

SEQ ID NO: 140767 - RNA, 64 nt, Human; identical to SEQ ID NO: 42475

SEQ ID NO: 140768 - RNA, 64 nt, Human; identical to SEQ ID NO: 42476

SEQ ID NO: 140769 - RNA, 64 nt, Human; identical to SEQ ID NO: 42477

SEQ ID NO: 140770 - RNA, 64 nt, Human; identical to SEQ ID NO: 42478

SEQ ID NO: 140771 - RNA, 64 nt, Human; identical to SEQ ID NO: 42479

SEQ ID NO: 140772 - RNA, 64 nt, Human; identical to SEQ ID NO: 42480

SEQ ID NO: 140773 - RNA, 64 nt, Human; identical to SEQ ID NO: 42481

SEQ ID NO: 140774 - RNA, 64 nt, Human; identical to SEQ ID NO: 42482

SEQ ID NO: 140775 - RNA, 64 nt, Human; identical to SEQ ID NO: 42483

SEQ ID NO: 140776 - RNA, 64 nt, Human; identical to SEQ ID NO: 42484

SEQ ID NO: 140777 - RNA, 64 nt, Human; identical to SEQ ID NO: 42485

SEQ ID NO: 140778 - RNA, 64 nt, Human; identical to SEQ ID NO: 42486

SEQ ID NO: 140779 - RNA, 64 nt, Human; identical to SEQ ID NO: 42487

SEQ ID NO: 140780 - RNA, 64 nt, Human; identical to SEQ ID NO: 42488

SEQ ID NO: 140781 - RNA, 64 nt, Human; identical to SEQ ID NO: 42489

SEQ ID NO: 140782 - RNA, 64 nt, Human; identical to SEQ ID NO: 42490

SEQ ID NO: 140783 - RNA, 64 nt, Human; identical to SEQ ID NO: 42491

SEQ ID NO: 140784 - RNA, 64 nt, Human; identical to SEQ ID NO: 42492

SEQ ID NO: 140785 - RNA, 64 nt, Human; identical to SEQ ID NO: 42493

SEQ ID NO: 140786 - RNA, 64 nt, Human; identical to SEQ ID NO: 42494

SEQ ID NO: 140787 - RNA, 64 nt, Human; identical to SEQ ID NO: 42495

SEQ ID NO: 140788 - RNA, 64 nt, Human; identical to SEQ ID NO: 42496

SEQ ID NO: 140789 - RNA, 64 nt, Human; identical to SEQ ID NO: 42497

SEQ ID NO: 140790 - RNA, 64 nt, Human; identical to SEQ ID NO: 42498

SEQ ID NO: 140791 - RNA, 64 nt, Human; identical to SEQ ID NO: 42499

SEQ ID NO: 140792 - RNA, 64 nt, Human; identical to SEQ ID NO: 42500

SEQ ID NO: 140793 - RNA, 64 nt, Human; identical to SEQ ID NO: 42501

SEQ ID NO: 140794 - RNA, 64 nt, Human; identical to SEQ ID NO: 42502

SEQ ID NO: 140795 - RNA, 64 nt, Human; identical to SEQ ID NO: 42503

SEQ ID NO: 140796 - RNA, 50 nt, Human; identical to SEQ ID NO: 42504

SEQ ID NO: 140797 - RNA, 64 nt, Human; identical to SEQ ID NO: 42505

SEQ ID NO: 140798 - RNA, 64 nt, Human; identical to SEQ ID NO: 42506

SEQ ID NO: 140799 - RNA, 64 nt, Human; identical to SEQ ID NO: 42507

SEQ ID NO: 140800 - RNA, 64 nt, Human; identical to SEQ ID NO: 42508

SEQ ID NO: 140801 - RNA, 64 nt, Human; identical to SEQ ID NO: 42509

SEQ ID NO: 140802 - RNA, 64 nt, Human; identical to SEQ ID NO: 42510

SEQ ID NO: 140803 - RNA, 64 nt, Human; identical to SEQ ID NO: 42511

SEQ ID NO: 140804 - RNA, 64 nt, Human; identical to SEQ ID NO: 42512

SEQ ID NO: 140805 - RNA, 64 nt, Human; identical to SEQ ID NO: 42513

SEQ ID NO: 140806 - RNA, 64 nt, Human; identical to SEQ ID NO: 42514

SEQ ID NO: 140807 - RNA, 64 nt, Human; identical to SEQ ID NO: 42515

SEQ ID NO: 140808 - RNA, 64 nt, Human; identical to SEQ ID NO: 42516

SEQ ID NO: 140809 - RNA, 64 nt, Human; identical to SEQ ID NO: 42517

SEQ ID NO: 140810 - RNA, 64 nt, Human; identical to SEQ ID NO: 42518

SEQ ID NO: 140811 - RNA, 64 nt, Human; identical to SEQ ID NO: 42519

SEQ ID NO: 140812 - RNA, 64 nt, Human; identical to SEQ ID NO: 42520

SEQ ID NO: 140813 - RNA, 64 nt, Human; identical to SEQ ID NO: 42521

SEQ ID NO: 140814 - RNA, 64 nt, Human; identical to SEQ ID NO: 42522

SEQ ID NO: 140815 - RNA, 64 nt, Human; identical to SEQ ID NO: 42523

SEQ ID NO: 140816 - RNA, 64 nt, Human; identical to SEQ ID NO: 42524

SEQ ID NO: 140817 - RNA, 64 nt, Human; identical to SEQ ID NO: 42525

SEQ ID NO: 140818 - RNA, 64 nt, Human
ucugaaugagaagugagaagguuuuuauacucugggaugcaaccgacauguucaaauguuugaa

SEQ ID NO: 140819 - RNA, 64 nt, Human; identical to SEQ ID NO: 42454

SEQ ID NO: 140820 - RNA, 64 nt, Human; identical to SEQ ID NO: 42455

SEQ ID NO: 140821 - RNA, 64 nt, Human; identical to SEQ ID NO: 42456

SEQ ID NO: 140822 - RNA, 64 nt, Human; identical to SEQ ID NO: 42457

SEQ ID NO: 140823 - RNA, 64 nt, Human; identical to SEQ ID NO: 42458

SEQ ID NO: 140824 - RNA, 64 nt, Human; identical to SEQ ID NO: 42459

SEQ ID NO: 140825 - RNA, 64 nt, Human
acuaggguucagagaaccaggguucaaagcccagggaugcaaagguugcagugaguugagucau

SEQ ID NO: 140826 - RNA, 64 nt, Human; identical to SEQ ID NO: 42460

SEQ ID NO: 140827 - RNA, 64 nt, Human; identical to SEQ ID NO: 42461

SEQ ID NO: 140828 - RNA, 64 nt, Human; identical to SEQ ID NO: 42462

SEQ ID NO: 140829 - RNA, 64 nt, Human; identical to SEQ ID NO: 42463

SEQ ID NO: 140830 - RNA, 64 nt, Human; identical to SEQ ID NO: 42464

SEQ ID NO: 140831 - RNA, 64 nt, Human; identical to SEQ ID NO: 42465

SEQ ID NO: 140832 - RNA, 64 nt, Human; identical to SEQ ID NO: 42466

SEQ ID NO: 140833 - RNA, 64 nt, Human; identical to SEQ ID NO: 42467

SEQ ID NO: 140834 - RNA, 64 nt, Human; identical to SEQ ID NO: 42468

SEQ ID NO: 140835 - RNA, 64 nt, Human; identical to SEQ ID NO: 42469

SEQ ID NO: 140836 - RNA, 64 nt, Human; identical to SEQ ID NO: 42470

SEQ ID NO: 140837 - RNA, 64 nt, Human; identical to SEQ ID NO: 42471

SEQ ID NO: 140838 - RNA, 64 nt, Human; identical to SEQ ID NO: 42472

SEQ ID NO: 140839 - RNA, 64 nt, Human; identical to SEQ ID NO: 42473

SEQ ID NO: 140840 - RNA, 64 nt, Human; identical to SEQ ID NO: 42474

SEQ ID NO: 140841 - RNA, 64 nt, Human; identical to SEQ ID NO: 42475

SEQ ID NO: 140842 - RNA, 64 nt, Human; identical to SEQ ID NO: 42476

SEQ ID NO: 140843 - RNA, 64 nt, Human; identical to SEQ ID NO: 42477

SEQ ID NO: 140844 - RNA, 64 nt, Human; identical to SEQ ID NO: 42478

SEQ ID NO: 140845 - RNA, 64 nt, Human; identical to SEQ ID NO: 42479

SEQ ID NO: 140846 - RNA, 64 nt, Human; identical to SEQ ID NO: 42480

SEQ ID NO: 140847 - RNA, 64 nt, Human; identical to SEQ ID NO: 42481

SEQ ID NO: 140848 - RNA, 64 nt, Human; identical to SEQ ID NO: 42482

SEQ ID NO: 140849 - RNA, 64 nt, Human; identical to SEQ ID NO: 42483

SEQ ID NO: 140850 - RNA, 64 nt, Human; identical to SEQ ID NO: 42484

SEQ ID NO: 140851 - RNA, 64 nt, Human; identical to SEQ ID NO: 42485

SEQ ID NO: 140852 - RNA, 64 nt, Human; identical to SEQ ID NO: 42486

SEQ ID NO: 140853 - RNA, 64 nt, Human; identical to SEQ ID NO: 42487

SEQ ID NO: 140854 - RNA, 64 nt, Human; identical to SEQ ID NO: 42488

SEQ ID NO: 140855 - RNA, 64 nt, Human; identical to SEQ ID NO: 42489

SEQ ID NO: 140856 - RNA, 64 nt, Human; identical to SEQ ID NO: 42490

SEQ ID NO: 140857 - RNA, 64 nt, Human; identical to SEQ ID NO: 42491

SEQ ID NO: 140858 - RNA, 64 nt, Human; identical to SEQ ID NO: 42492

SEQ ID NO: 140859 - RNA, 64 nt, Human; identical to SEQ ID NO: 42493

SEQ ID NO: 140860 - RNA, 64 nt, Human; identical to SEQ ID NO: 42494

SEQ ID NO: 140861 - RNA, 64 nt, Human; identical to SEQ ID NO: 42495

SEQ ID NO: 140862 - RNA, 64 nt, Human; identical to SEQ ID NO: 42496

SEQ ID NO: 140863 - RNA, 64 nt, Human; identical to SEQ ID NO: 42497

SEQ ID NO: 140864 - RNA, 64 nt, Human; identical to SEQ ID NO: 42498

SEQ ID NO: 140865 - RNA, 64 nt, Human; identical to SEQ ID NO: 42499

SEQ ID NO: 140866 - RNA, 64 nt, Human; identical to SEQ ID NO: 42500

SEQ ID NO: 140867 - RNA, 64 nt, Human; identical to SEQ ID NO: 42501

SEQ ID NO: 140868 - RNA, 64 nt, Human; identical to SEQ ID NO: 42502

SEQ ID NO: 140869 - RNA, 64 nt, Human; identical to SEQ ID NO: 42503

SEQ ID NO: 140870 - RNA, 50 nt, Human; identical to SEQ ID NO: 42504

SEQ ID NO: 140871 - RNA, 64 nt, Human; identical to SEQ ID NO: 42505

SEQ ID NO: 140872 - RNA, 64 nt, Human; identical to SEQ ID NO: 42506

SEQ ID NO: 140873 - RNA, 64 nt, Human; identical to SEQ ID NO: 42507

SEQ ID NO: 140874 - RNA, 64 nt, Human; identical to SEQ ID NO: 42508

SEQ ID NO: 140875 - RNA, 64 nt, Human; identical to SEQ ID NO: 42509

SEQ ID NO: 140876 - RNA, 64 nt, Human; identical to SEQ ID NO: 42510

SEQ ID NO: 140877 - RNA, 64 nt, Human; identical to SEQ ID NO: 42511

SEQ ID NO: 140878 - RNA, 64 nt, Human; identical to SEQ ID NO: 42512

SEQ ID NO: 140879 - RNA, 64 nt, Human; identical to SEQ ID NO: 42513

SEQ ID NO: 140880 - RNA, 64 nt, Human; identical to SEQ ID NO: 42514

SEQ ID NO: 140881 - RNA, 64 nt, Human; identical to SEQ ID NO: 42515

SEQ ID NO: 140882 - RNA, 64 nt, Human; identical to SEQ ID NO: 42516

SEQ ID NO: 140883 - RNA, 64 nt, Human; identical to SEQ ID NO: 42517

SEQ ID NO: 140884 - RNA, 64 nt, Human; identical to SEQ ID NO: 42518

SEQ ID NO: 140885 - RNA, 64 nt, Human; identical to SEQ ID NO: 42519

SEQ ID NO: 140886 - RNA, 64 nt, Human; identical to SEQ ID NO: 42520

SEQ ID NO: 140887 - RNA, 64 nt, Human; identical to SEQ ID NO: 42521

SEQ ID NO: 140888 - RNA, 64 nt, Human; identical to SEQ ID NO: 42522

SEQ ID NO: 140889 - RNA, 64 nt, Human; identical to SEQ ID NO: 42523

SEQ ID NO: 140890 - RNA, 64 nt, Human; identical to SEQ ID NO: 42524

SEQ ID NO: 140891 - RNA, 64 nt, Human; identical to SEQ ID NO: 42525

SEQ ID NO: 140892 - RNA, 64 nt, Human; identical to SEQ ID NO: 35617

SEQ ID NO: 140893 - RNA, 64 nt, Human; identical to SEQ ID NO: 35618

SEQ ID NO: 140894 - RNA, 64 nt, Human; identical to SEQ ID NO: 35619

SEQ ID NO: 140895 - RNA, 64 nt, Human; identical to SEQ ID NO: 35620

SEQ ID NO: 140896 - RNA, 64 nt, Human; identical to SEQ ID NO: 35621

SEQ ID NO: 140897 - RNA, 64 nt, Human; identical to SEQ ID NO: 35622

SEQ ID NO: 140898 - RNA, 64 nt, Human; identical to SEQ ID NO: 35623

SEQ ID NO: 140899 - RNA, 64 nt, Human; identical to SEQ ID NO: 35624

SEQ ID NO: 140900 - RNA, 64 nt, Human; identical to SEQ ID NO: 35625

SEQ ID NO: 140901 - RNA, 64 nt, Human; identical to SEQ ID NO: 35626

SEQ ID NO: 140902 - RNA, 64 nt, Human; identical to SEQ ID NO: 35627

SEQ ID NO: 140903 - RNA, 64 nt, Human; identical to SEQ ID NO: 35628

SEQ ID NO: 140904 - RNA, 64 nt, Human; identical to SEQ ID NO: 35629

SEQ ID NO: 140905 - RNA, 64 nt, Human; identical to SEQ ID NO: 35630

SEQ ID NO: 140906 - RNA, 64 nt, Human; identical to SEQ ID NO: 35631

SEQ ID NO: 140907 - RNA, 64 nt, Human; identical to SEQ ID NO: 35632

SEQ ID NO: 140908 - RNA, 64 nt, Human; identical to SEQ ID NO: 35633

SEQ ID NO: 140909 - RNA, 64 nt, Human; identical to SEQ ID NO: 35634

SEQ ID NO: 140910 - RNA, 64 nt, Human; identical to SEQ ID NO: 35635

SEQ ID NO: 140911 - RNA, 64 nt, Human; identical to SEQ ID NO: 35636

SEQ ID NO: 140912 - RNA, 64 nt, Human; identical to SEQ ID NO: 35637

SEQ ID NO: 140913 - RNA, 64 nt, Human; identical to SEQ ID NO: 35638

SEQ ID NO: 140914 - RNA, 64 nt, Human; identical to SEQ ID NO: 35639

SEQ ID NO: 140915 - RNA, 64 nt, Human; identical to SEQ ID NO: 35640

SEQ ID NO: 140916 - RNA, 64 nt, Human; identical to SEQ ID NO: 35641

SEQ ID NO: 140917 - RNA, 64 nt, Human; identical to SEQ ID NO: 35642

SEQ ID NO: 140918 - RNA, 64 nt, Human; identical to SEQ ID NO: 35643

SEQ ID NO: 140919 - RNA, 64 nt, Human; identical to SEQ ID NO: 35644

SEQ ID NO: 140920 - RNA, 64 nt, Human; identical to SEQ ID NO: 35645

SEQ ID NO: 140921 - RNA, 64 nt, Human; identical to SEQ ID NO: 35646

SEQ ID NO: 140922 - RNA, 64 nt, Human; identical to SEQ ID NO: 35647

SEQ ID NO: 140923 - RNA, 64 nt, Human; identical to SEQ ID NO: 35648

SEQ ID NO: 140924 - RNA, 64 nt, Human; identical to SEQ ID NO: 35649

SEQ ID NO: 140925 - RNA, 64 nt, Human; identical to SEQ ID NO: 35650

SEQ ID NO: 140926 - RNA, 64 nt, Human; identical to SEQ ID NO: 35651

SEQ ID NO: 140927 - RNA, 64 nt, Human; identical to SEQ ID NO: 35652

SEQ ID NO: 140928 - RNA, 64 nt, Human; identical to SEQ ID NO: 35653

SEQ ID NO: 140929 - RNA, 64 nt, Human; identical to SEQ ID NO: 35654

SEQ ID NO: 140930 - RNA, 64 nt, Human; identical to SEQ ID NO: 35655

SEQ ID NO: 140931 - RNA, 64 nt, Human; identical to SEQ ID NO: 35656

SEQ ID NO: 140932 - RNA, 64 nt, Human; identical to SEQ ID NO: 35657

SEQ ID NO: 140933 - RNA, 64 nt, Human; identical to SEQ ID NO: 35658

SEQ ID NO: 140934 - RNA, 64 nt, Human; identical to SEQ ID NO: 35659

SEQ ID NO: 140935 - RNA, 64 nt, Human; identical to SEQ ID NO: 35660

SEQ ID NO: 140936 - RNA, 64 nt, Human; identical to SEQ ID NO: 35661

SEQ ID NO: 140937 - RNA, 64 nt, Human; identical to SEQ ID NO: 35662

SEQ ID NO: 140938 - RNA, 64 nt, Human; identical to SEQ ID NO: 35663

SEQ ID NO: 140939 - RNA, 64 nt, Human; identical to SEQ ID NO: 35664

SEQ ID NO: 140940 - RNA, 64 nt, Human; identical to SEQ ID NO: 35665

SEQ ID NO: 140941 - RNA, 64 nt, Human; identical to SEQ ID NO: 35666

SEQ ID NO: 140942 - RNA, 64 nt, Human; identical to SEQ ID NO: 35667

SEQ ID NO: 140943 - RNA, 64 nt, Human; identical to SEQ ID NO: 35668

SEQ ID NO: 140944 - RNA, 64 nt, Human; identical to SEQ ID NO: 35669

SEQ ID NO: 140945 - RNA, 64 nt, Human; identical to SEQ ID NO: 35670

SEQ ID NO: 140946 - RNA, 64 nt, Human; identical to SEQ ID NO: 35671

SEQ ID NO: 140947 - RNA, 64 nt, Human; identical to SEQ ID NO: 35672

SEQ ID NO: 140948 - RNA, 64 nt, Human; identical to SEQ ID NO: 35673

SEQ ID NO: 140949 - RNA, 64 nt, Human; identical to SEQ ID NO: 35674

SEQ ID NO: 140950 - RNA, 64 nt, Human; identical to SEQ ID NO: 35675

SEQ ID NO: 140951 - RNA, 64 nt, Human; identical to SEQ ID NO: 35676

SEQ ID NO: 140952 - RNA, 64 nt, Human; identical to SEQ ID NO: 35677

SEQ ID NO: 140953 - RNA, 64 nt, Human
ggagaaggcaugaaauugucuagcagagcaggggcagggugauaaauuguugauaaauuccacu

SEQ ID NO: 140954 - RNA, 64 nt, Human
ccauccucucugcccucuugcuagggaacccugccagggugaaggcaaggaacaaccaccuggc

SEQ ID NO: 140955 - RNA, 64 nt, Human
gcaaaaauggucuucaaagcacauaaaaagcacccagggugagaaagccccaucccgggggccg

SEQ ID NO: 140956 - RNA, 64 nt, Human
cugcgugccuggcccuaugagggcggcggcgggacagggugagcggagagacagaacugucccc

SEQ ID NO: 140957 - RNA, 64 nt, Human
gggaacugcuugggccuugcugagccaggguccucagggugaagcaggacugaggaguggccag

SEQ ID NO: 140958 - RNA, 64 nt, Human
ccucauccccuauuucugucagacaguuauaugacagggugacuguggaaccucuuaguucauc

SEQ ID NO: 140959 - RNA, 64 nt, Human
agugagacuccguuuugugccacugcacuccagccagggugacagagugagacucugucucaaa

SEQ ID NO: 140960 - RNA, 64 nt, Human
gcuuuugaaaaccuggaccucuaugucaacaugacagggugaaacuauucccccuaagacuguu

SEQ ID NO: 140961 - RNA, 64 nt, Human
gauuccugcaacucauuuuccuuccacucuggagcagggugaggggaauguuauggguaacaga

SEQ ID NO: 140962 - RNA, 64 nt, Human
gcuucugcuacucugcaucacugaugacacucagcagggugaugcacagcagucugccuccccu

SEQ ID NO: 140963 - RNA, 64 nt, Human
ugcccucagcaucccccauagcucccagcagccccagggugaucucaaaguaucuaauucaccc

SEQ ID NO: 140964 - RNA, 64 nt, Human
gacacagggaugcgcagggcgcccccuucuguuccagggugaacauagcacacgcccuccuggc

SEQ ID NO: 140965 - RNA, 64 nt, Human
gguccagggcagucgugugucuuacccagcuacacagggugacauuuuggucuagaaccuaguc

SEQ ID NO: 140966 - RNA, 64 nt, Human
cuauacccaaggaguccugugauuugagcuucagcagggugaucuacauuugggugcuuguuuc

SEQ ID NO: 140967 - RNA, 64 nt, Human
cuuccugugcagagcuugggcaucuccuuuacgccagggugaggaagacaccaggacaaugaca

SEQ ID NO: 140968 - RNA, 64 nt, Human
cuugaguacuuucuccugccuccaggcauuggcucagggugaauuacaaggggcuacugaaugg

SEQ ID NO: 140969 - RNA, 64 nt, Human
ugcucuuaggugcugggcagaggggaaggguggucagggugaggauggugagggagggcuggug

SEQ ID NO: 140970 - RNA, 64 nt, Human
ugugccaccaccuuccugcccacaggccgagggacagggugaggguauacccaaagcugaugca

SEQ ID NO: 140971 - RNA, 64 nt, Human
cucaguaaaucacagacccaggggcccugugguccagggugagagucacaccacauuacacaug

SEQ ID NO: 140972 - RNA, 64 nt, Human
uugaacgcaacuugcuaguuaugacagagaggaccagggugagaacuaaugcucaagagagcaa

SEQ ID NO: 140973 - RNA, 64 nt, Human
cccagggaagugcacaugucucucccugcucuuccagggugauuuuuuugauguuuggcucuug

SEQ ID NO: 140974 - RNA, 64 nt, Human
gucagggcaaaggcauggcccagguguuuaaguacagggugacgugugccuaugcaauggggug

SEQ ID NO: 140975 - RNA, 64 nt, Human
cccuuccgucuucucccucauccuuuccaaacagcagggugacuuuagaggcaugggcuccaac

SEQ ID NO: 140976 - RNA, 64 nt, Human
guggccaggccuuccuuugcuggaggaagguacacagggugaagcugaugcuguacuuggggga

SEQ ID NO: 140977 - RNA, 64 nt, Human
gcuggcuuguggguccccugagacgaaggcugagcagggugagccucgaaaaccccauagcacu

SEQ ID NO: 140978 - RNA, 64 nt, Human
uacuuuucaaguacggugucauuuucacagucuccagggugacaaaugccaauagauaugugag

SEQ ID NO: 140979 - RNA, 64 nt, Human
cuguugaaucauuacaucaaggagcugccccugucagggugaguguaauuaggaacgauaccag

SEQ ID NO: 140980 - RNA, 64 nt, Human
gaauuugcauuuacacuuagacacuuucuaaaaacagggugaacuuaauugaaauuuuucagug

SEQ ID NO: 140981 - RNA, 64 nt, Human
ggacgaguccccgggccuggccaacccugcugugcagggugagggccaugcaugcaguaugagg

SEQ ID NO: 140982 - RNA, 64 nt, Human
cauguuuuuuuuuccuuuguugaaaaaaauaaaccagggugauuucuauaaaucaccaguuuuu

SEQ ID NO: 140983 - RNA, 64 nt, Human
aagagacugagcuugcacagaucagaccgagaagcagggugagagauucuaacgacuggaugcu

SEQ ID NO: 140984 - RNA, 64 nt, Human
ucugucugucuguccuuccccucucuucuuuuuucagggugaggugcuguguuucuuauuucau

SEQ ID NO: 140985 - RNA, 64 nt, Human
cugccgggcuccgccuuucccccacccuggcucucagggugacgccacccacagagauuuaaug

SEQ ID NO: 140986 - RNA, 64 nt, Human
aauuuagaaauaccauuuuauaauuuuacuauuccagggugacauaaugcauuuaaauuuggga

SEQ ID NO: 140987 - RNA, 64 nt, Human
caguauaaagauacguuugcaaucagugacuacucagggugacacccuugcccuaaagcaggag

SEQ ID NO: 140988 - RNA, 64 nt, Human
guggcagcucucccuggacuugcccugccuggaacagggugauuugcuggaauggaguuaccac

SEQ ID NO: 140989 - RNA, 64 nt, Human
ucauucgccugugggaagagaagggaagccucuucagggugagugaauggcaaagcgguugcuu

SEQ ID NO: 140990 - RNA, 64 nt, Human
cggggaguccccgugugccccaagaggcuagccccagggugagcagggcccucagaggaaaggc

SEQ ID NO: 140991 - RNA, 64 nt, Human
cagcaucugucuccugcuucacagggucgacugucagggugaccguauguggccgcagcugugu

SEQ ID NO: 140992 - RNA, 64 nt, Human
aauguuguuucauagaguuuggaguguuuugauacagggugaaaaugaacuucugguuucaaac

SEQ ID NO: 140993 - RNA, 64 nt, Human
caacagccuuuugaaagcuauuuccaucuaguaucagggugagagcauccuugaucuggcugcc

SEQ ID NO: 140994 - RNA, 64 nt, Human
acccugcauggaaucaggcuccucagccaggacacagggugaggccccccagccaggauaugcc

SEQ ID NO: 140995 - RNA, 64 nt, Human
ucaccugguguccuauugucagggacaucuuaaccagggugacugcaccucgaauaaaggccag

SEQ ID NO: 140996 - RNA, 64 nt, Human
gagaggcucugggacggguuuacuuguuuuugaacagggugaugggcccuaugguuuucuagag

SEQ ID NO: 140997 - RNA, 64 nt, Human
ggggcccaggcugcccgcgggugcacccaggcugcagggugaggccaggcaggccuggguaggg

SEQ ID NO: 140998 - RNA, 64 nt, Human
accucccugcgcccuugaggggccccagcgucugcagggugacgccugagacagcaccacugcu

SEQ ID NO: 140999 - RNA, 64 nt, Human
uacaaagggaagcagagccuggggugggugugagcagggugaccccucaucugaaaggcccaaa

SEQ ID NO: 141000 - RNA, 64 nt, Human
agcuggguucaucucaucacauuagauuaucccucagggugacaccaaagcacccagacagauu

SEQ ID NO: 141001 - RNA, 64 nt, Human
accauucaggucuuucuuuccgaggccccugucucagggugaggugcuugagucuccaacggca

SEQ ID NO: 141002 - RNA, 64 nt, Human
cugcauccauugccaccuccuguucgugaccugacagggugacacagccccuuucacacucugu

SEQ ID NO: 141003 - RNA, 64 nt, Human
ucugaacuuggcagguaccguucuaaaucugaaacagggugauagcucaaaguugccauucauc

SEQ ID NO: 141004 - RNA, 64 nt, Human
aggggcagagucauacguguggccaggaaguagccagggugaagagagacucggugcgggcagg

SEQ ID NO: 141005 - RNA, 64 nt, Human
cccugcugccccucacuucaggaggggccuggagcagggugaggcuggacuuuggggggcugug

SEQ ID NO: 141006 - RNA, 64 nt, Human
agcugaaagugaggauacuccgugcuccaggccacagggugaauguggccaugccuaccuguuu

SEQ ID NO: 141007 - RNA, 64 nt, Human
uggcugaguuggguuggaguacacaccuggugugcagggugaagcagcucauuuugucuggucc

SEQ ID NO: 141008 - RNA, 64 nt, Human
ugcucagcugcuucuggaccuuccagggcccaugcagggugagggaaaggguagaggucuuuuc

SEQ ID NO: 141009 - RNA, 64 nt, Human
agaucugccaguaaagaaggcuuucuuucauuaucagggugaaggucuuuccugauucuuccaa

SEQ ID NO: 141010 - RNA, 64 nt, Human
uuuagggcaaggagaccaccaacagcccucaggucagggugaggauggccucugcuaagcucaa

SEQ ID NO: 141011 - RNA, 64 nt, Human
uuugguuuaugaugugucagagcuaauucauguucagggugagcguuguaccuaccaacaaauu

SEQ ID NO: 141012 - RNA, 64 nt, Human
caagaugcacagaggacacagaaggacuuggcagcagggugaugaccugaucauuuguugaugg

SEQ ID NO: 141013 - RNA, 64 nt, Human
acaggaaaugcaggaugggacuccccagggaacgcagggugaagggaacaaagcuggaggcucu

SEQ ID NO: 141014 - RNA, 64 nt, Human
agaagugaaaucuaggguuggcgaggcuggagggcagggugagccuccacaugggugcugaagc

SEQ ID NO: 141015 - RNA, 64 nt, Human
aguccuuguuccagcccuauucugccacuccugacagggugaccuuggguauuugcaauauucc

SEQ ID NO: 141016 - RNA, 64 nt, Human
gucccgucuggcuccagcccuugucagauucacccagggugaagccuucaaagcuuuuugcuac

SEQ ID NO: 141017 - RNA, 64 nt, Human
aucuaagcccuuuaauuagagauagcaacuuucccagggugaccgaggaaucaguacguguuga

SEQ ID NO: 141018 - RNA, 64 nt, Human
caguugcgauucuaaaggaagaagcacuaaauggcagggugaucaguccaaagcauuuaugagg

SEQ ID NO: 141019 - RNA, 64 nt, Human
aagggugcaggcgggaagagugggcugucuuucccagggugaugcaagcaugccgcagcccugg

SEQ ID NO: 141020 - RNA, 64 nt, Human
ccucuggccucuagguaaccaguuuaaauugguucagggugauaacuacuuagcacugcccugg

SEQ ID NO: 141021 - RNA, 64 nt, Human
aaggaaaucuggauucugaggaccacgucucacccagggugacaucaggaauggugcuagccuc

SEQ ID NO: 141022 - RNA, 64 nt, Human
cugagauugugccaguucauuccacccugggcaacagggugagacucugucucaaaaaaaaaaa

SEQ ID NO: 141023 - RNA, 64 nt, Human
uuaagucuuaauucuggaaauuuuauuagcaaugcagggugaugggguaugaaccugugucucc

SEQ ID NO: 141024 - RNA, 64 nt, Human
gaaaguucuccccuugauuuucugcuccugaaggcagggugaguucucuccucaaagaagacuu

SEQ ID NO: 141025 - RNA, 64 nt, Human
cuuacuggaagggcguuuuucagagcugcagggacagggugagcagcugaagggcuaggaggga

SEQ ID NO: 141026 - RNA, 64 nt, Human
agggccccaguggcuuugggaagcacccccagcccagggugaaacaugcuucuucucuuccugu

SEQ ID NO: 141027 - RNA, 64 nt, Human
aaugaaacucacgaaucuacggacauuuugcuuucagggugaagcaagcuugaauuuggauugc

SEQ ID NO: 141028 - RNA, 64 nt, Human
uugggaaaaaaugugugcuuaaacuuuuuucagucagggugaugaucuucugaagcucuuggau

SEQ ID NO: 141029 - RNA, 64 nt, Human
uuucuacuacaauaugcuauagcuuuauggaacucagggugaugaucagacgugucauuagaac

SEQ ID NO: 141030 - RNA, 64 nt, Human
ugaaauguuuuacuuuucacuggagaagacaaaacagggugaucuucauguuauuguuuuauac

SEQ ID NO: 141031 - RNA, 64 nt, Human
uaaccucgauauuaaaaucauccuugacaugaaacagggugaagagaagcuguccguggcggcu

SEQ ID NO: 141032 - RNA, 64 nt, Human
auccuguaugcuuucuuugccuuguuccuguucucagggugacgacugccaccaggagaugcag

SEQ ID NO: 141033 - RNA, 64 nt, Human
caaacucucaucgggucauaaagaggaggagaaacagggugagucaagguaaaggagcagaaau

SEQ ID NO: 141034 - RNA, 64 nt, Human
uguagaauggggguaaaacuacaaaucuccuccucagggugauauuuuuaaagauuaaggagua

SEQ ID NO: 141035 - RNA, 64 nt, Human
guaguugcucugaagaguuucaguagaguggccccagggugauagcucagggaacaacaaaaaa

SEQ ID NO: 141036 - RNA, 64 nt, Human
guuagcuuugacacucaagcaauguuggaaaaugcagggugacugaguucccugcccagcuuuc

SEQ ID NO: 141037 - RNA, 64 nt, Human
ggcacuagguguaaaaggugcuggccaaaugguucagggugaagagggcucuugauucaggggc

SEQ ID NO: 141038 - RNA, 64 nt, Human
uuuguuguguaacauaaauaagccuucugagaagcagggugaauaaaguuuagggagcugggac

SEQ ID NO: 141039 - RNA, 64 nt, Human
agagcccagugcucccuugucccucuuuuaugaucagggugaaauguacuuccugauguaauga

SEQ ID NO: 141040 - RNA, 64 nt, Human
cacgaggucaggagaucgagaccauccuggcuaacagggugaaaccccaucgcuacuaaaaaua

SEQ ID NO: 141041 - RNA, 64 nt, Human
gcacuuccccguaacgaaagcaaagugguaagcacagggugagacccuuuuacacagaauggug

SEQ ID NO: 141042 - RNA, 64 nt, Human
ucccggccggcgcgcucaucccacccgcccaccgcagggugaacugcagcgaguacuucccgcu

SEQ ID NO: 141043 - RNA, 64 nt, Human
acauggaagacaauucauguuugacaaaugcugacagggugaagaaagcccaguguaaaaauga

SEQ ID NO: 141044 - RNA, 64 nt, Human
aaaaauugauuucacuuagaaaaacuucuaggaacagggugaaccacugauuuuaauuugccua

SEQ ID NO: 141045 - RNA, 64 nt, Human
uuuaaguguuguauucuuuuucauugggugaugucagggugauaaccagacauucauggaaagg

SEQ ID NO: 141046 - RNA, 64 nt, Human
gcuuuuaugauggauuuuguaaauagauuuguuacagggugaccuguucucuagcugugaucuu

SEQ ID NO: 141047 - RNA, 64 nt, Human
gaaguugaugggcagcaaaccugcuguuuaacaucagggugaccacauuaagcccaguauucca

SEQ ID NO: 141048 - RNA, 64 nt, Human
cccuggggguguggcaccuccaaacuuucaacuucagggugauuuuuuuagcaguaaccagagc

SEQ ID NO: 141049 - RNA, 64 nt, Human
acuuuggaguccccucaccuccucuaagguugggcagggugacccugaagugagcacagccuag

SEQ ID NO: 141050 - RNA, 64 nt, Human
guggacaggaucaggauucccuugaaagcccaggcagggugagcagucccagugguccuagugc

SEQ ID NO: 141051 - RNA, 64 nt, Human
cagcguccggcccaguguguuuccgguucugagucagggugaucuguggacgggaccccagcac

SEQ ID NO: 141052 - RNA, 58 nt, Human
cgcagaagaagaguguaugauucuggaacagggugaaacucucccagagacgaagaaa

SEQ ID NO: 141053 - RNA, 64 nt, Human
uucaucucccacaucaccuucccugggaacuggacagggugaaaguccucaaacucugggaaca

SEQ ID NO: 141054 - RNA, 64 nt, Human
caugugccuucaggggguuguuacuugagagcuccagggugaagggagaaagccugugcucugg

SEQ ID NO: 141055 - RNA, 64 nt, Human
aaugugggcuuccuuuaaagggagggggagaagccagggugauagcccagacucugcccuguug

SEQ ID NO: 141056 - RNA, 64 nt, Human
agacuagggugcccucugcgccuccuuaaggaugcagggugagcaucuccucuccacaccugcc

SEQ ID NO: 141057 - RNA, 64 nt, Human
cccuuccccuucaagcauuuuccucuucccuuuucagggugaagcucuuccuucaagaguuucu

SEQ ID NO: 141058 - RNA, 64 nt, Human
cacaucuccccaguggcagccucgcccucugggucagggugacugaggcauuuuguggccuuaa

SEQ ID NO: 141059 - RNA, 64 nt, Human
cuggcagggccaggcaaggccagagugcuaggggcagggugaaggcuucagcucacuguuguag

SEQ ID NO: 141060 - RNA, 64 nt, Human
uagaacucucccagccucguuggggaggcuuguccagggugauagagacugauuucagacaaac

SEQ ID NO: 141061 - RNA, 64 nt, Human
uuucagggucaaauuugagcaaacuguaaacugucagggugauaaaauguuucucuugauguuu

SEQ ID NO: 141062 - RNA, 64 nt, Human
uuugaaaugugugaaauuuuuggaacuugcuggacagggugauuuaauuuuuagcuacauaauu

SEQ ID NO: 141063 - RNA, 64 nt, Human
cgcaggcagcucacaccaggaagagacuguauugcagggugaagagugggcucccgugggccca

SEQ ID NO: 141064 - RNA, 64 nt, Human
ccuccucagaggucuucccuuugccuccccaggacagggugagucagagcucagcauuuaaucu

SEQ ID NO: 141065 - RNA, 64 nt, Human
aaagccacuuuagugagaagcagguaccaagccucagggugaagggggucccuugagggagcgu

SEQ ID NO: 141066 - RNA, 64 nt, Human
cccagacacucccuucucccaccuuaguugguuacagggugagugagauaaccaaugccaaacu

SEQ ID NO: 141067 - RNA, 64 nt, Human
uuauuauggaaaauugucacacuaacuuaaaagacagggugagggagauauguaaauuguccac

SEQ ID NO: 141068 - RNA, 64 nt, Human
ugcuccuugaucacggcaucccccggcgguaguacagggugagcuugcaggagggucugcaagu

SEQ ID NO: 141069 - RNA, 64 nt, Human
gcaugaccuaccaggacagaacuuuccccaauuacagggugacucacagccgcauuggugacuc

SEQ ID NO: 141070 - RNA, 64 nt, Human
uagcaaguucuagagaagaggcuggugcuguggccagggugagagcugcucuggaaaaugugac

SEQ ID NO: 141071 - RNA, 64 nt, Human
ggaguuacguacuauuguuuaguucacagcuguucagggugacagugagcagauccagacacca

SEQ ID NO: 141072 - RNA, 64 nt, Human
aaagccaggguagcugcaugcacuggcauuugaacagggugagacaguccacccagagcucucc

SEQ ID NO: 141073 - RNA, 64 nt, Human
cugggggagggacggccauggcacuugggggcuccagggugacucccaugaggccucccuucaa

SEQ ID NO: 141074 - RNA, 64 nt, Human
uuacugacacucaggcuuucuucccuuagggucacagggugaggaucaaagacacaaaugucug

SEQ ID NO: 141075 - RNA, 64 nt, Human
gugcacagcgaggagcagacccaggcagggccgccagggugacacaggccacccuuccuugccu

SEQ ID NO: 141076 - RNA, 64 nt, Human
gcagcguguggcccauucagcaggcccaggucuucagggugaggcugcuggcgagggcagggga

SEQ ID NO: 141077 - RNA, 64 nt, Human
cucucaaagagaaccugaagucagaacacaugagcagggugagaggugaggcaagguucauccu

SEQ ID NO: 141078 - RNA, 64 nt, Human
gcagcuggacagaggggacucugggcuauggacacagggugacggugacaaagauggcucagag

SEQ ID NO: 141079 - RNA, 64 nt, Human
aagcaaaaacauguugcuuuuaucaguuaggauacagggugaacuguaacaaagaaaccccuaa

SEQ ID NO: 141080 - RNA, 64 nt, Human
aaugacauauuuugaguaauaaccguauuuuucacagggugacaaauugggccaauaaaucugc

SEQ ID NO: 141081 - RNA, 64 nt, Human
gccgcugaguguaggaaaaacaggcaugacagaccagggugaggguugugcccagcugggccac

SEQ ID NO: 141082 - RNA, 64 nt, Human
augagcuuguuccaguuacagucccuuugaaguucagggugauaaacagaauauucuucuguag

SEQ ID NO: 141083 - RNA, 64 nt, Human
uugaggagagaugaaaaccagggcgguagaacuucagggugaaggacagaguccuggguggggc

SEQ ID NO: 141084 - RNA, 64 nt, Human
acuucccucgggcccuuaugaaggacugaggcuccagggugagaaggcucacuucugccccggg

SEQ ID NO: 141085 - RNA, 64 nt, Human
gugcuucaguuuaauuggcuuggaaaggggucagcagggugaaaccgaaccccagaaaacuuga

SEQ ID NO: 141086 - RNA, 64 nt, Human
aaaaaauuuuagaacaguccagcaaauugcuagucagggugaauugugaaauugggugaagagc

SEQ ID NO: 141087 - RNA, 64 nt, Human
aguuaaacuaguuuuaguuuaaaaagaaaaaaugcagggugauuucuuauuauuauauguuagc

SEQ ID NO: 141088 - RNA, 64 nt, Human
uguaacacuguggacauugacuucccgcauaaggcagggugacccccugaacuccagaugucug

SEQ ID NO: 141089 - RNA, 64 nt, Human
ccccagugcuccugugcagggauaggaagugccccagggugagaacgugcccagccacaucauc

SEQ ID NO: 141090 - RNA, 64 nt, Human
uucuccccagaucugaaccuguggucuugggagccagggugaccugauaugacaucuaaagaag

SEQ ID NO: 141091 - RNA, 64 nt, Human
uuuggcaaggaaaggggagaagggaauccuccuccagggugauuuuaugaucaguguuguugcu

SEQ ID NO: 141092 - RNA, 64 nt, Human
ggauggacacugcacuggcagugccuacccucgacagggugagcgcacuccuacacacaggggg

SEQ ID NO: 141093 - RNA, 64 nt, Human
uccaucacuuuguaaugaugauacuuaacaugagcagggugaaugacagguacugacgaagucc

SEQ ID NO: 141094 - RNA, 64 nt, Human
uuccucuguacuuuucuccaugguugaaauaaaacagggugacugggaguuacuuagaauucau

SEQ ID NO: 141095 - RNA, 64 nt, Human
accuuaaguuauagcccuguccaccgaggaaggucagggugagagccuagauuccuccuguguc

SEQ ID NO: 141096 - RNA, 64 nt, Human
uauaguuuugggaaaggagugggaucuuugauuucagggugaaaacagaguaccccuuuaaaca

SEQ ID NO: 141097 - RNA, 64 nt, Human
aggucugugcucauggccaccaggcccuacugcucagggugaaugcagcuggucucuggccagu

SEQ ID NO: 141098 - RNA, 64 nt, Human
guagucaguggggcauuuuaggaugucagggccccagggugacauguguccagcuuuucuaugg

SEQ ID NO: 141099 - RNA, 64 nt, Human
ugacccccuguccuaggucaugaaggacacucugcagggugaagcaccagggagaggccucggc

SEQ ID NO: 141100 - RNA, 64 nt, Human
agccugccacauccucccacgccaggcccugggccagggugauuggacugagaauuuggccaca

SEQ ID NO: 141101 - RNA, 64 nt, Human
ugacuugacagacgaaagacaagcccggaugacacagggugagaagagucagggccgcaccucu

SEQ ID NO: 141102 - RNA, 64 nt, Human
cucucagcgcucaucucacgcagaggaugccaggcagggugaggaugggggaguagaugccgcu

SEQ ID NO: 141103 - RNA, 64 nt, Human
uacgugccuuugccucuuuaugcacacagagacccagggugagggaguauuuguucccaguuuu

SEQ ID NO: 141104 - RNA, 64 nt, Human
gugcccugaacuuuuuuauuaagaaaucagaucccagggugagaguaacaggccauuuggccaa

SEQ ID NO: 141105 - RNA, 64 nt, Human
agagcagcugggcugcucccgccccagcccggcccagggugaaggaagaggcacgugcuccuca

SEQ ID NO: 141106 - RNA, 64 nt, Human
ccucaccucgaaaggaggcccuguucccuggagucagggugaacugcaaagcuuuggcugagac

SEQ ID NO: 141107 - RNA, 64 nt, Human
uugcagaagggcaaagcugcuuaagagagaggaucagggugaaguuuggcacacaggguuuauu

SEQ ID NO: 141108 - RNA, 64 nt, Human
acagauauaguuuggaauugcaguuuccucacuucagggugacaagauauguauaacagugaca

SEQ ID NO: 141109 - RNA, 64 nt, Human
cugaccuuggccuugcccuuuguacacaaguucccagggugagcagcuuuuggauuuaauauga

SEQ ID NO: 141110 - RNA, 64 nt, Human
cccccaaggcucaugguccuuggaggacccguugcagggugaggucaagagaguucugaccugg

SEQ ID NO: 141111 - RNA, 64 nt, Human
gaaucaaacuaaaauuacuugcuugacuucacuccagggugagacuugaccuuuaaggcccaaa

SEQ ID NO: 141112 - RNA, 64 nt, Human
aagagaagggcugaaccuggggagaugucacugccagggugagguggagccacauggcagggac

SEQ ID NO: 141113 - RNA, 64 nt, Human
cguugggagagaacgggaaaggggacuugaguuacagggugacccagaaagacgauucagcugu

SEQ ID NO: 141114 - RNA, 64 nt, Human
ccucaaccuggcaucuuaggguauggucaggcaacagggugaccagcuguccugguuucccagg

SEQ ID NO: 141115 - RNA, 64 nt, Human
ugcucccuaauucauuucccaggaagcugugauacagggugaaauaaagucuugucuuagaaac

SEQ ID NO: 141116 - RNA, 64 nt, Human
ucugucccagguggcccagguggugcagguagaacagggugaggagagggggucggcucagcag

SEQ ID NO: 141117 - RNA, 64 nt, Human
uuauugugaguacucaaguugcuuagagagccaccagggugauuugcugcuggcuuucuaucau

SEQ ID NO: 141118 - RNA, 64 nt, Human
cuguccuuucuugggaugucuaaaacaugacaaacagggugaucuguuguacacacuaucuuau

SEQ ID NO: 141119 - RNA, 64 nt, Human
ccauccccacccacuucuacauccauccacaccccagggugagcuggagcuccaggcuggccag

SEQ ID NO: 141120 - RNA, 64 nt, Human
ugguaaccauguagguucuugggagggaaugggacagggugaauaaagcagggaauauuuuaga

SEQ ID NO: 141121 - RNA, 64 nt, Human
ccuucagauuuauaauaacucuguacuuugguuucagggugacauuugggaaggauuuuguuua

SEQ ID NO: 141122 - RNA, 64 nt, Human
ucacccuugcuuaggaguaaaacaauauacuuuacagggugauaauaaucuccauaguuauuug

SEQ ID NO: 141123 - RNA, 64 nt, Human
uggcagcuugacuuggcacuuuagggccccuuagcagggugagcuguuaaaacagcacacaucu

SEQ ID NO: 141124 - RNA, 64 nt, Human
gcugcgaaggugacacauggcuuuucagacucagcagggugacuugccucagaggcuauauccc

SEQ ID NO: 141125 - RNA, 64 nt, Human
gcuggcagaguugucucgggagcggggugagcugcagggugaacgcggggagcuacggggccgg

SEQ ID NO: 141126 - RNA, 64 nt, Human
aaugaucacgugacccaccccccagggcagguaucagggugaacugaucuuagcaccggccaaa

SEQ ID NO: 141127 - RNA, 64 nt, Human
gguggcgccauucucucacgcaaggauggggcugcagggugagcagcgugggcugcaguguguc

SEQ ID NO: 141128 - RNA, 64 nt, Human
agucuucuuggaguuuguucaugaaugcugaucccagggugaggagaagauugggacauagaaa

SEQ ID NO: 141129 - RNA, 64 nt, Human
gucauuugagcauaaaauauuuucagauauuuuccagggugaaaucuguaaugcagaugauaua

SEQ ID NO: 141130 - RNA, 64 nt, Human
aaagcuccugagugcaacuuaauuaccaccauggcagggugagggaacauuugcaucgucagcu

SEQ ID NO: 141131 - RNA, 64 nt, Human
ugcagccaguuccaaugcuggacaccucaaccaucagggugaaaucuggggccucagcuuuuua

SEQ ID NO: 141132 - RNA, 64 nt, Human
guacagcuggcagagggaaaggcacuggguaccucagggugagcagagggcacugggcuggggc

SEQ ID NO: 141133 - RNA, 64 nt, Human
ugguuuggugcggugaguccugccccggcugugccagggugagggagggccaagcccaggagga

SEQ ID NO: 141134 - RNA, 64 nt, Human
aggauacgugcaagggaaguugggcuguuguaaacagggugaaggguguguuuggucggccauu

SEQ ID NO: 141135 - RNA, 64 nt, Human
gggcuuccauggcaggaagaugagaagaaaucuucagggugauuucuggagccugaaaagaaua

SEQ ID NO: 141136 - RNA, 64 nt, Human
uuagcuuccgagaucagaugagaucaggcgcguucagggugauauggccguagacgucuuuaca

SEQ ID NO: 141137 - RNA, 64 nt, Human
gggaguggagaguaggguggucuugugaguugugcagggugaagaccgcuucccugagacaggg

SEQ ID NO: 141138 - RNA, 64 nt, Human
accugccugcccccgggcagcacgggagggagagcagggugagcacgcuuguugguuucagaug

SEQ ID NO: 141139 - RNA, 64 nt, Human
gguaacugaucacagaccucagcaugggggugaccagggugacucuucaaucccuauccccaug

SEQ ID NO: 141140 - RNA, 64 nt, Human
aaauuuccccaacagugugaaguuagaauuccuucagggugaugccagguucuauuuggaauuu

SEQ ID NO: 141141 - RNA, 64 nt, Human
cacuauguuuuuaugguucauguuauauccuccccagggugacagccccuuaaggcccuccuuu

SEQ ID NO: 141142 - RNA, 64 nt, Human
gacuacuagucacugcuuccauaaauauuguuuacagggugagauuugguuuauucaucuuaag

SEQ ID NO: 141143 - RNA, 64 nt, Human
cuggucaggcccuggugcgaauggacuuuggaagcagggugaucgcacaaccugcaucuuuagu

SEQ ID NO: 141144 - RNA, 53 nt, Human
cccuggagugggaguucugaaggcagggugagggggcaagggacauacccugg

SEQ ID NO: 141145 - RNA, 64 nt, Human
ccacugagcccagcugacugaaaacaaggacagucagggugaaacuucuuuugccagaagugug

SEQ ID NO: 141146 - RNA, 64 nt, Human
ggcaggaaucauaauagaaaacucagccucccuacagggugagcaccuucugucucgcugucuc

SEQ ID NO: 141147 - RNA, 64 nt, Human
aauucacauccugcugggccuuuuuucaucaagucagggugauauaaaaacauuggaagucuuu

SEQ ID NO: 141148 - RNA, 64 nt, Human
gcacaacuaaugagauuuucucucauuccgaguucagggugacacauuuugggacaucugcugg

SEQ ID NO: 141149 - RNA, 64 nt, Human
ggaacucccggaagagccggauccgcuccgacuccagggugaucugcucaaaggcugagucaca

SEQ ID NO: 141150 - RNA, 64 nt, Human
cucugaaauauauugauuuuuaucacaguauucucagggugaaauuaaaccaacuauaggccuu

SEQ ID NO: 141151 - RNA, 64 nt, Human
uuccugcucccaccuuuuuggaagaucgguagcccagggugagcacaaacauuccaguuagagg

SEQ ID NO: 141152 - RNA, 64 nt, Human
guauggcuccacaccuccaaugcugccugggagccagggugagagucuggguccaggccuggcc

SEQ ID NO: 141153 - RNA, 64 nt, Human
acugucugaggagcuggugaagaguuguuuuuuucagggugauguuagagacagucaccuuuug

SEQ ID NO: 141154 - RNA, 64 nt, Human
ucacgaagucaggagaucaagaccaucuggcuaacagggugaaacccugucucuacuaaaaaau

SEQ ID NO: 141155 - RNA, 64 nt, Human
agaaguaaauauagugcgucauaauugcuaaaaacagggugaauuucuuucacuuaaguuggaa

SEQ ID NO: 141156 - RNA, 64 nt, Human
ggugcugcuucuucagaugauggggagcacuuuucagggugaaauucaggcgaguuuugcccag

SEQ ID NO: 141157 - RNA, 64 nt, Human
acauacugacuguuguugcuucuuucuagcagugcagggugaaacuaacuagcaaagacaaaaa

SEQ ID NO: 141158 - RNA, 64 nt, Human
cuugggucuucuugggcaccucucugggaaaacccagggugagguucagccugugagggcuggg

SEQ ID NO: 141159 - RNA, 64 nt, Human
ugggacuggcuggaaacgucuguaugcagggagccagggugagggcagaguguggugacagccg

SEQ ID NO: 141160 - RNA, 64 nt, Human
uccuguucauucucauagauggcccugcuuuccccagggugacaucguagccaaauguuuacug

SEQ ID NO: 141161 - RNA, 64 nt, Human
ucugguaaaucucuuugucaaauuacgaaaacuucagggugaaauccuaugcuuccauguacau

SEQ ID NO: 141162 - RNA, 64 nt, Human
cuuuccugccaaggugcagcuuacguaguugaggcagggugaguagcugcuugacaccccagug

SEQ ID NO: 141163 - RNA, 52 nt, Human
guuuucgagaggaguuauaaaucagggugaccugugcgccuagccugcgcag

SEQ ID NO: 141164 - RNA, 64 nt, Human
caucugcaacuuuaaggcauaguccaucgaucuacagggugaucucauuugaaagcuaugaugg

SEQ ID NO: 141165 - RNA, 64 nt, Human
uagaacgaauuuguuguaguauuugauagcccaacagggugacuacagucaacaauaacuuuau

SEQ ID NO: 141166 - RNA, 64 nt, Human
uggguuucugccagaaauguccagagccuaacugcagggugaaaaagucccugcacggccacca

SEQ ID NO: 141167 - RNA, 64 nt, Human
ucuacuggcauccuaauggcacucugacagcauccagggugacuacagggcccauuggaaaugg

SEQ ID NO: 141168 - RNA, 64 nt, Human
uaaugcuccuauacaaggcagcagaaaccuacugcagggugaagaauuacucagagcuuuggau

SEQ ID NO: 141169 - RNA, 64 nt, Human
uccucgcaggucucagugucaugcugucuuggggcagggugaaaggguaguggcagcagggcgc

SEQ ID NO: 141170 - RNA, 64 nt, Human
gcagcagaaggagcugcggaaucagggcucaacacagggugacccugagaggaaccaacuccag

SEQ ID NO: 141171 - RNA, 64 nt, Human
auauaaucaagcaaauauuuuaaaaaauguaugucagggugacaggcauaaaaguaaauuaccc

SEQ ID NO: 141172 - RNA, 64 nt, Human
ccgggugauaggccccauaagacacacacaugagcagggugagaaaugcuugcuuuauagcugc

SEQ ID NO: 141173 - RNA, 64 nt, Human
ucaaccaggucaucuccccguugccaaguggguucagggugagggcaauuuguaagcucaauuu

SEQ ID NO: 141174 - RNA, 64 nt, Human
cuggcugugaagacuucgcacagucuccuccgcacagggugagguggcaguggcagcacgucuu

SEQ ID NO: 141175 - RNA, 64 nt, Human
acgggagaacuuuccucacccgccccugcccagacagggugaggaaagggcucccccagugagg

SEQ ID NO: 141176 - RNA, 64 nt, Human
gcagugagucgagauugcacugcugcauuccagccagggugacagagugagaccauguuucaaa

SEQ ID NO: 141177 - RNA, 64 nt, Human
cccagccccccaggagauuggggcugccaacaagcagggugaucucccacaguguggagccuga

SEQ ID NO: 141178 - RNA, 64 nt, Human
uacaccagagagacagaguccuccccauugggaacagggugauugaggaaagugaaccuugggu

SEQ ID NO: 141179 - RNA, 64 nt, Human
cuccucgcugucuagggaaggacacugaggggcucagggugaggguugccuauuguguucucgg

SEQ ID NO: 141180 - RNA, 64 nt, Human
cucauaaaagcugccuuuaaauaucccuaggagacagggugaaggagacccuugacagccccag

SEQ ID NO: 141181 - RNA, 64 nt, Human
gucagcauaaaccugggggcccucaggacuaggacagggugagccagugcucccuccuuucaug

SEQ ID NO: 141182 - RNA, 64 nt, Human
cacgacgucaggagauccagaccaucuuggcuaacagggugaaaccccgucucuacuaaaaaua

SEQ ID NO: 141183 - RNA, 64 nt, Human
gcugggguccugguuccucaggagagagagaccacagggugagagugagccaggaacagcaagg

SEQ ID NO: 141184 - RNA, 64 nt, Human
aaaaggccaaccagggcccaaccgugcaugaugacagggugaagagaaggcaggucugggcacu

SEQ ID NO: 141185 - RNA, 64 nt, Human
ggccauuuccccauuaacuacccccagcccgaggcagggugagggggaagggcugucaguuaca

SEQ ID NO: 141186 - RNA, 64 nt, Human
cccaaggaauugaaagucaaccuaacuguaacaacagggugagaaaugaccaaacugcccguga

SEQ ID NO: 141187 - RNA, 64 nt, Human
cuguaccagcaggggccacuucaaagccaagguacagggugauaacuugugguccagcaucagu

SEQ ID NO: 141188 - RNA, 64 nt, Human
uggaggggcaguggagaucaggagugacagaucacagggugagggccaccuccacacccacccc

SEQ ID NO: 141189 - RNA, 64 nt, Human
gggagaggagggagaccugcuggugcccuugcaccagggugaggccugacucacgcugcuuccc

SEQ ID NO: 141190 - RNA, 64 nt, Human
uuaugguuaccauauuuuuaaaaagauuuuuugucagggugacuuaacauggacucuuauaggg

SEQ ID NO: 141191 - RNA, 64 nt, Human
ggaaugcgaccggagcacuugcucugaggaaucccagggugacucugucggggaagaauccggu

SEQ ID NO: 141192 - RNA, 64 nt, Human
ucuccaugcugcaaaggagaagcacagcuccugccagggugagcagggucaagccucuuauucc

SEQ ID NO: 141193 - RNA, 64 nt, Human
ggaaucuaguuggggguuggagggguaaggaacacagggugauaggggaggggucuuaguuccu

SEQ ID NO: 141194 - RNA, 64 nt, Human
ucagccugagccaagcugcauugggaggagaaggcagggugagggaucugggagagcaggacgu

SEQ ID NO: 141195 - RNA, 64 nt, Human
ugcuuucucacaacgggguguguuuucccaugugcagggugagguuuuuuuuugccacccugga

SEQ ID NO: 141196 - RNA, 64 nt, Human
agaggacaaucaaaaacgacaacaagcuucuucccagggugaggggaaacacuuaaggaauaaa

SEQ ID NO: 141197 - RNA, 64 nt, Human
cccauccuuaguacaugcucuguccagcuuuccccagggugacauacagaaggggcaacaucua

SEQ ID NO: 141198 - RNA, 64 nt, Human
ugaggugaaaaaggaaaugucaggagggauaagacagggugaggcccugcuucuuuuccuaaga

SEQ ID NO: 141199 - RNA, 64 nt, Human
guccucccuccugauacuguagccucuugguacccagggugaguugguggagaacagagagaug

SEQ ID NO: 141200 - RNA, 64 nt, Human
cuuucaggugccuggcccuuggcuuuagccauaccagggugaguuaaagagaggccccggcugg

SEQ ID NO: 141201 - RNA, 64 nt, Human
gcccagcuuccugaagcagguggagggcaucaggcagggugagcuccagcugcugcgcacggcg

SEQ ID NO: 141202 - RNA, 64 nt, Human
uaauaacuaauccagauaaaaaguuguggggcuucagggugaccugggcccaaagguucugaag

SEQ ID NO: 141203 - RNA, 64 nt, Human
gucuugguugggacuauugccucaggguugacaacagggugauggaggccugggacgcuguuca

SEQ ID NO: 141204 - RNA, 64 nt, Human
gcccugucaccccugcugucguagcuguuggcuucagggugagaagugagaagcagcuuauugu

SEQ ID NO: 141205 - RNA, 64 nt, Human
agggacauggaaccauuugccucuggcugugucacagggugagccccaaaauugggguucagcg

SEQ ID NO: 141206 - RNA, 64 nt, Human
gaguggcagcguggugcuagcagcuucagcggaacagggugagaguuaauuaugcagucuucuu

SEQ ID NO: 141207 - RNA, 64 nt, Human
ugggucaggaacccuaaugagaacggggagcugccagggugagggcagcccucagggucggccg

SEQ ID NO: 141208 - RNA, 64 nt, Human
gaccugggggaccucagagcagagugccacauuacagggugaucagacaugaccugugcuguug

SEQ ID NO: 141209 - RNA, 64 nt, Human
cuuccucugaaaggccaagccaagccaugcuuggcagggugaggggccaguugaguucugggag

SEQ ID NO: 141210 - RNA, 64 nt, Human
aggaggcguuuccacccccuggugccuaucagggcagggugaccuacuccccauuguucuggaa

SEQ ID NO: 141211 - RNA, 64 nt, Human
auaaaacaacaugguauguagaagccuaggaucacagggugauaaugucaauuggcagccaguu

SEQ ID NO: 141212 - RNA, 64 nt, Human
ccaucugagccuugguaggguuaaagggaggugacagggugaagagggauccugugcaggggcc

SEQ ID NO: 141213 - RNA, 64 nt, Human
guuggcugggccucggcuucgcuggaguguacuccagggugaaggcagagugggauuugagacc

SEQ ID NO: 141214 - RNA, 64 nt, Human
aacccgccaaccgcgagagacccaggcuggcccccagggugaggacgcccggagcggagguaac

SEQ ID NO: 141215 - RNA, 64 nt, Human
uucccuccuuuagugaagcccccgagguuguguccagggugaugaguguggacgggggcaccag

SEQ ID NO: 141216 - RNA, 64 nt, Human
aauugaagaagagaauugacucguaugaacaggacagggugaaaaugcugggaauuauuauggg

SEQ ID NO: 141217 - RNA, 64 nt, Human
ugugccuucaguacccagccagguucucuggguccagggugacucuccaaagaaauuggccuuc

SEQ ID NO: 141218 - RNA, 64 nt, Human
aaugaagguuuggcuacuuguauaggucugccugcagggugaaaaugccagugugaauauucua

SEQ ID NO: 141219 - RNA, 64 nt, Human
cauuacccaaagacuugggaacuaaaauguuccccagggugauaugcugauuuucauugugcac

SEQ ID NO: 141220 - RNA, 64 nt, Human
cugcguguguaaaagucgagguauugcuggcauucagggugacaugaugguacuaaauguuuuc

SEQ ID NO: 141221 - RNA, 54 nt, Human
augguggaggugaugacugaacuucagggugaacuugguuuuuggacaaguaca

SEQ ID NO: 141222 - RNA, 64 nt, Human
gcagggacaguguugaugaggcaguuuagcuugccagggugaugauaaagcccaggucccugca

SEQ ID NO: 141223 - RNA, 64 nt, Human
gcggccccugccuggccaccuggccucucugcaccagggugacaagggguccucgucugccccc

SEQ ID NO: 141224 - RNA, 64 nt, Human
agacagacccacccccaagcagggcuccucuccccagggugagcacaggaccucuguaagcugc

SEQ ID NO: 141225 - RNA, 64 nt, Human
caaaaguguuuuccccccacccccacucgcccaccagggugaugccacuuuugccuccugcccu

SEQ ID NO: 141226 - RNA, 64 nt, Human
cccacacacuauggauugggcucugggaaggggucagggugagaggcugcucuggagaacaaug

SEQ ID NO: 141227 - RNA, 64 nt, Human
cugcugugucccgagagucuccagaugggggcaucagggugagguccgggacucuugggucauc

SEQ ID NO: 141228 - RNA, 64 nt, Human
gauuccucuauauggggagaccuggauuguugaccagggugagaagccaaugguauagacugcc

SEQ ID NO: 141229 - RNA, 64 nt, Human
uuuaguuuucuuauuuuuagacaccccuccccuccagggugaucuuuaaaaaagcaaaacaaaa

SEQ ID NO: 141230 - RNA, 64 nt, Human
cugacgcucccaggggugccaggagccacugggacagggugaggcucccagacgcuccucgagg

SEQ ID NO: 141231 - RNA, 64 nt, Human
gcacgagggacgagcuuagcugagcugggaggagcagggugagggugggcgacccaggauuccc

SEQ ID NO: 141232 - RNA, 64 nt, Human
acgacgcgagggccccacgucccugcggaagccacagggugagcacucuggggugggagggucu

SEQ ID NO: 141233 - RNA, 64 nt, Human
gguggugucuccguccuuauccuagccuagcucgcagggugagaaccacuggaguggcuggggc

SEQ ID NO: 141234 - RNA, 64 nt, Human
ccucuggcagccuuaaccuguccucugcuaggaccagggugauuucaagccagggaagcaacug

SEQ ID NO: 141235 - RNA, 64 nt, Human
ugggaucuaagaaagggaggugaguggguggaggcagggugacgucucugaacccaaaacccug

SEQ ID NO: 141236 - RNA, 54 nt, Human
aucagcugcggcaagccuagggaccagggugaggacccgccggaugacagccac

SEQ ID NO: 141237 - RNA, 64 nt, Human
ccgccauggagaucacccuccccgaagcugucgccagggugacccaacauccaguucuccggcu

SEQ ID NO: 141238 - RNA, 64 nt, Human
cugaggccaagguagccaaggucagcccugaggccagggugaaaggucccagacuucgaaugcc

SEQ ID NO: 141239 - RNA, 64 nt, Human
ugcuggggaugagaaguacgggaaggauuccugccagggugauucuggggguccgcugguaugu

SEQ ID NO: 141240 - RNA, 64 nt, Human
ggcguggccgggcacuaaacacccgccugccugccagggugaacacacagccagcuuaucccuc

SEQ ID NO: 141241 - RNA, 64 nt, Human
ccugaggucaggaguucgagaccagccuggccaacagggugaaaccccgucucuacuaaaagua

SEQ ID NO: 141242 - RNA, 64 nt, Human
uacauuguccuguagcuuuaaaaccacagcugggcagggugagaagcuagaugccccugcaguu

SEQ ID NO: 141243 - RNA, 64 nt, Human
aagcagaucaaggaaacuucuguugagcuaggcucagggugagcuuuggcugggguugcccuug

SEQ ID NO: 141244 - RNA, 64 nt, Human
uacccaggucccuccuuuggacccuguaaagggucagggugaaucagaugggggacugagcaag

SEQ ID NO: 141245 - RNA, 64 nt, Human
cccugucccaggggccuggcccccucagccaucucagggugaggagcugccagucauguccaga

SEQ ID NO: 141246 - RNA, 64 nt, Human
cgcguugaacccacagcacuccgugguguguuugcagggugauuuccuaauaaaaguccacucu

SEQ ID NO: 141247 - RNA, 64 nt, Human
uggaccccccuaaaaggagggaauaggaggagggcagggugagugggggcaauccuagguggug

SEQ ID NO: 141248 - RNA, 64 nt, Human
acuaguuuucacauuuccuaagcagccuagaguacagggugagcauuuuuagaucuccuaauga

SEQ ID NO: 141249 - RNA, 64 nt, Human
acccccagggggucuccccaccccaccccauuuacagggugagcucagccugucaugagcagag

SEQ ID NO: 141250 - RNA, 64 nt, Human
ucauaguaccugagauuuuauuuugagauaccaucagggugaguugcaccacuuguacucaauu

SEQ ID NO: 141251 - RNA, 64 nt, Human
ggcugugggcaggagcggccugcccagugucacccagggugagugcaaaauaaagacggcgagu

SEQ ID NO: 141252 - RNA, 56 nt, Human
uggaagucaguguaacaugacaacgccagggugaacacacgccacuucccagcuag

SEQ ID NO: 141253 - RNA, 64 nt, Human
caguuuuauggaucccaauucauuucaucuacuacagggugaggugcuugcccccaugugggug

SEQ ID NO: 141254 - RNA, 64 nt, Human
gguguggaugcaccuacaaggccaacucucugaucagggugagggagagauggaagaauuaaca

SEQ ID NO: 141255 - RNA, 64 nt, Human
ccaggguggcacuguucacuggcgcugggacagucagggugaccccaccgccuaccucucuaca

SEQ ID NO: 141256 - RNA, 64 nt, Human
augaggaggguggcaggucuuugcagcucccggccagggugaggcggaagugagcccucauccu

SEQ ID NO: 141257 - RNA, 64 nt, Human
guucaucucggaguccaggccuggcccugggagacagggugaagggagugguuuuuaugaacuu

SEQ ID NO: 141258 - RNA, 64 nt, Human
aaucagcgugaccuggaccugcugggcaggaucccagggugaaccugccugugaacucugaagu

SEQ ID NO: 141259 - RNA, 64 nt, Human
gcugaggcaggggccgcugucgucaggccugagccagggugagcuggugccugccuugcauuuu

SEQ ID NO: 141260 - RNA, 64 nt, Human
cacaggccagcuggccggggguuggggagccacacagggugaacgggcagcagccggcuccaug

SEQ ID NO: 141261 - RNA, 64 nt, Human
gcaucaucugcgucagccgguccuagcccaucugcagggugaaagaacucaucaagagcuccuu

SEQ ID NO: 141262 - RNA, 64 nt, Human
cagagaccuaacagccuuggucuaccgugcugaccagggugaaggcacggcgagggacuccucc

SEQ ID NO: 141263 - RNA, 64 nt, Human
cugagagauguacuaggauugcagcaaagguggucagggugaugggccgcacagcgaggcaguc

SEQ ID NO: 141264 - RNA, 64 nt, Human
ccaacaacaguagguacaguggacaaaaauagcccagggugacugacugaauuuaaacccauaa

SEQ ID NO: 141265 - RNA, 64 nt, Human
aaacuacacaagucaucuacaagagcccugaccacagggugagacagcagggcccaggggagug

SEQ ID NO: 141266 - RNA, 64 nt, Human
ccuuuuguuuuuuggccuuaacgcuccugcugcacagggugaggugccuccuuggcacagacug

SEQ ID NO: 141267 - RNA, 64 nt, Human
ccggcccccugugcagggccguaguaccucccagcagggugaagaguccaagaagccagcacca

SEQ ID NO: 141268 - RNA, 64 nt, Human
cgucuguaagauggcaaaaaugcugccccccucacagggugaccaugaggaccagucacaguga

SEQ ID NO: 141269 - RNA, 64 nt, Human
cccaggucuuguuggcaccccgggagccacugcccagggugaugguggccagcucagggcuucc

SEQ ID NO: 141270 - RNA, 64 nt, Human
cugccccaagggggaccaaaagggccggacguuacagggugaaacccucugaccccucgcgaca

SEQ ID NO: 141271 - RNA, 64 nt, Human
ucagcauguuggcuaggccggucucuccugaccucagggugaucagcccaccucggccucacaa

SEQ ID NO: 141272 - RNA, 64 nt, Human
gucuuggccaagaaauguagaccuuuccccaggccagggugauuguucauuugacaugagaccc

SEQ ID NO: 141273 - RNA, 64 nt, Human
aaaugccccaguguuauuuauuccccagugacuccagggugacaaggccugcuugacuuuccag

SEQ ID NO: 141274 - RNA, 64 nt, Human
ucuaagcaaccacacugcuuggcccuucaagggucagggugagacgugaugggcuaggccuccg

SEQ ID NO: 141275 - RNA, 64 nt, Human
cucucuguguccguguggagggcugcagagccugcagggugaccugcuuccccaaaggccaaca

SEQ ID NO: 141276 - RNA, 64 nt, Human
uuuguugcugagagaguggaacauagguccuagacagggugaagaguucuggcacauuuuagcu

SEQ ID NO: 141277 - RNA, 64 nt, Human
uucacaucaaugucuguccuguggccaugucccucagggugacaggcccaggaaccaaugcuac

SEQ ID NO: 141278 - RNA, 64 nt, Human
aagcagcaaggacaaagggcaguuuagggagaggcagggugaaggggauagcucgauugggcau

SEQ ID NO: 141279 - RNA, 64 nt, Human
auaacaaguaagaugcaaucuagcaaaagucagucagggugaaagagaauugguugcaaaugag

SEQ ID NO: 141280 - RNA, 64 nt, Human
ugagugccugggucagccaaaccccuggcacccccagggugacggguggcgagcuguuugaccg

SEQ ID NO: 141281 - RNA, 64 nt, Human
uguagacuggccugaaccacaggagaggauggcccagggugagguggcaugguccauucucaag

SEQ ID NO: 141282 - RNA, 64 nt, Human
guaauuugcaauuugucaguguauaagacacaugcagggugaaguguacagaguuuuguaacaa

SEQ ID NO: 141283 - RNA, 64 nt, Human
guggccguugcuacaagucaccuggugcuacgaccagggugagaauaaagacgucuccucagga

SEQ ID NO: 141284 - RNA, 64 nt, Human
guccucugaaggcagggccuuggccacguccugggucucccaccucccaccugaccccagcggc

SEQ ID NO: 141285 - RNA, 64 nt, Human
cgaacuccugaccucaggugaucugcccgccucggucucccaaagugcugggauuacaggcaug

SEQ ID NO: 141286 - RNA, 64 nt, Human
ucacuuccugguugggcucaucucugaagaacaggucucccagcuucgcuccuuaucacugcau

SEQ ID NO: 141287 - RNA, 64 nt, Human
ccccaccccuagaacugccauucccaagaccucugucucccagccaaccacccuuggaacuugc

SEQ ID NO: 141288 - RNA, 64 nt, Human
uugcagcuuucucuccaucugcagauuauucccagucucccaguaacacguuucuacccagauc

SEQ ID NO: 141289 - RNA, 64 nt, Human
uucugugaacauguaauguaacuggcuuuugagggucucccaaggggugaguggacguguugga

SEQ ID NO: 141290 - RNA, 64 nt, Human
ugggacaggcuccugaggaggauugagggugaaagucucccacgaguacacuaaaccuaggucu

SEQ ID NO: 141291 - RNA, 64 nt, Human
ccacucuccugccuccaguggcccugccgcagaugucucccaaaaaguugagccuuucuagaug

SEQ ID NO: 141292 - RNA, 64 nt, Human
gacaggaacaugcgaagccaccaucgguuccagcgucucccagacuucucguacaguuaauuug

SEQ ID NO: 141293 - RNA, 64 nt, Human
agauuguacuaccgcgagaggcaucccuggcgcugucucccacuggacagaggaggcuggccau

SEQ ID NO: 141294 - RNA, 64 nt, Human
cuugcuggggccaugccauggaagcuucccaucagucucccagcugaauccucccugcucucug

SEQ ID NO: 141295 - RNA, 64 nt, Human
ucaaaaggggaaaugggcuggugggagugggauagucucccauuuaagcagcuaauaaauaauu

SEQ ID NO: 141296 - RNA, 64 nt, Human
cacagcucuguuuugucaaugaccuuuguuguaagucucccaacguccuauuaggagccacagc

SEQ ID NO: 141297 - RNA, 64 nt, Human
guuuuucaguucaagugcucuucagcacugucuugucucccaauauaccaacccacuggcacau

SEQ ID NO: 141298 - RNA, 64 nt, Human
agcccccuggccccuuccgcaaucuccucccccagucucccaaagagccauuucaacagagaag

SEQ ID NO: 141299 - RNA, 64 nt, Human
ccuucuuccucccaccauggcagguggggagcaggucucccagaaacaccccgucccgaggaug

SEQ ID NO: 141300 - RNA, 64 nt, Human
agugcaagagccugagacuggaaaagguggacuugucucccagucgaggcugguaagggaccuu

SEQ ID NO: 141301 - RNA, 64 nt, Human
agaaucaggguggagaaguucccugaaccuuccugucucccagggacauguaugcuuccaggga

SEQ ID NO: 141302 - RNA, 59 nt, Human
accacgugcuggacgucugaacucagccugucucccaccucccgggccucucuggggcc

SEQ ID NO: 141303 - RNA, 64 nt, Human
auuaaaaaauacccuuccaccuggaggcucccuugucucccagccccauguacaaagcucacca

SEQ ID NO: 141304 - RNA, 64 nt, Human
ggcuuuguacauucaggagcugcagagaggaaaggucucccauguaccagagaaggaaaagucu

SEQ ID NO: 141305 - RNA, 64 nt, Human
gggugggguuuggaagcuucuggaagucgugcuggucucccaggugaggcaagccaugguugcu

SEQ ID NO: 141306 - RNA, 64 nt, Human
gcccacagagggcccaggccccugcccagcugcagucucccagccuccacuuucagagugaaau

SEQ ID NO: 141307 - RNA, 64 nt, Human
uagacuauggcauaagugucagcucauuguuuucgucucccacuuaucuucccccuucaaagug

SEQ ID NO: 141308 - RNA, 64 nt, Human
gagaaacagggaggaaggggcggagcaccuggacgucucccagaagccccuccacguuugaaaa

SEQ ID NO: 141309 - RNA, 64 nt, Human
guucuuucaagcuacauguacuaaauugucgaaggucucccaggagcucuguacugaggcagac

SEQ ID NO: 141310 - RNA, 64 nt, Human
gggagguguggggcgacagggucugucuuguucugucucccaggcugaagugcagugcaguggu

SEQ ID NO: 141311 - RNA, 64 nt, Human
aaaguggaauugcccaguacugccugccagcugggucucccaagcaacuaccccaagacauacc

SEQ ID NO: 141312 - RNA, 64 nt, Human
aagcuccuuaaccugucuguauuuuuaugccucugucucccauucaguuccuccuugaauaccu

SEQ ID NO: 141313 - RNA, 64 nt, Human
guggcugggugacuaaagggcuugucuugguggggucucccaccccuccaagacccauucugca

SEQ ID NO: 141314 - RNA, 64 nt, Human
guucuaaguuguucuugcaggaauuagccuccccgucucccaaaaccuugagaaugaagcccuu

SEQ ID NO: 141315 - RNA, 64 nt, Human
uaucuucuuuuuuuuugagauggagucuggcucugucucccaggcuggagugcaguggcguaau

SEQ ID NO: 141316 - RNA, 64 nt, Human
uuuaagugaaucacauaauugucuuuggaacuuggucucccaacacuuauugugauugcaaagu

SEQ ID NO: 141317 - RNA, 64 nt, Human
ugcaauggugcgaucucggcucacugcaaccuccgucucccagguucaagcgauucuucugccu

SEQ ID NO: 141318 - RNA, 64 nt, Human
gaaaugccugcugcccccaaugacucuugguuucgucucccacauacagaagcaggguggaggg

SEQ ID NO: 141319 - RNA, 64 nt, Human
ccuaguggcccagggaaggccgauaauuuaaacagucucccaccaccuaccccaagagauacug

SEQ ID NO: 141320 - RNA, 64 nt, Human
guggggauccaguucaggagggagggguauguuugucucccagucugggcaaaggagugcuaug

SEQ ID NO: 141321 - RNA, 64 nt, Human
ggguggggaaggaaggaacaugaucccuccagaagucucccacccuggggccaacucacugcca

SEQ ID NO: 141322 - RNA, 64 nt, Human
cuuguggaacuugaauugggaacuuuggagucuugucucccaucccagcacauugaggauguag

SEQ ID NO: 141323 - RNA, 64 nt, Human
ccagggacaggaggaagagaugccaccagggcuggucucccaggaguagagaccaugggaaaug

SEQ ID NO: 141324 - RNA, 64 nt, Human
uuaagaccagccugggcaacauagugagaccccugucucccaaaaauuuuuuuuaauuagcugu

SEQ ID NO: 141325 - RNA, 64 nt, Human
aagcucuucaugaugagauggaaaccaaaagggagucucccaugaugggguggagucagcccug

SEQ ID NO: 141326 - RNA, 64 nt, Human
uugucauguggucagaucugucuuagucuuuugugucucccaaggugauguuuuugugguuuuu

SEQ ID NO: 141327 - RNA, 64 nt, Human
aucuaaagcuuucauaccaaaugucacaggagcugucucccagcucauuuuuaacacugaaaug

SEQ ID NO: 141328 - RNA, 64 nt, Human
uugaccuccagggcucaaggauccuccugccucagucucccaacuaagugggacuacaggcacg

SEQ ID NO: 141329 - RNA, 64 nt, Human
ccagggggugcgcuggcugucgggggcugggcaugucucccacacccccuccuacccucucucc

SEQ ID NO: 141330 - RNA, 64 nt, Human
auuccacuggguuuugauauuggcuuagcugccagucucccauuugugaccuaugccauccauc

SEQ ID NO: 141331 - RNA, 64 nt, Human
gggggagaggggagacagggcaaucuuguccacagucucccauucucauauguagcccucauga

SEQ ID NO: 141332 - RNA, 64 nt, Human
ccugggacauacugccuaaccuuuuggagccuuagucucccagacugaaaaaggaagaggaugg

SEQ ID NO: 141333 - RNA, 64 nt, Human
ucauguaaaaugaaacuguugcuccauuggaguagucucccaccuaaauaucaagauggcuaua

SEQ ID NO: 141334 - RNA, 64 nt, Human
gcacacuaucuuccucucuccuaucuuucccucagucucccaaguuccucuaccuucuuuaucu

SEQ ID NO: 141335 - RNA, 64 nt, Human
gggaagugcaguccuuggagauguacugguguccgucucccagcaugcucuagagaggcggcuc

SEQ ID NO: 141336 - RNA, 64 nt, Human
aaagagcuuaauccucaugauaggauugccuagugucucccauuugcagguuucuggguugaug

SEQ ID NO: 141337 - RNA, 64 nt, Human
caaccccggacaaaucagcgaugugucacccccagucucccaccuuuucuucuaaugagucgac

SEQ ID NO: 141338 - RNA, 64 nt, Human
uuucucugcagaguauaauauacuauaugguaacgucucccaaacuccucuccuggaucaaaaa

SEQ ID NO: 141339 - RNA, 64 nt, Human
guuugcaucucuauuuauaccucuguccugcuaggucucccaccuucccuugguuccaaaagcc

SEQ ID NO: 141340 - RNA, 64 nt, Human
cucagccccacuccccuuccucauccccagcugugucucccaaccucccuucguguuguuuugc

SEQ ID NO: 141341 - RNA, 64 nt, Human
acccuagccuucucccacagcugccuacaacagagucucccagccuucucagagagcuaaaacc

SEQ ID NO: 141342 - RNA, 64 nt, Human
gcucccugacuuucugaagcuagaaaaauguugugucucccaaccaccuuuccauccccagccc

SEQ ID NO: 141343 - RNA, 64 nt, Human
gucucucuuuauguucaggucgcuuggucgguucgucucccauuugccauccaggccucacacc

SEQ ID NO: 141344 - RNA, 64 nt, Human
uuuuaauccccauuauucuggaaagugcauccuagucucccagucuauaacaucauaauaccuu

SEQ ID NO: 141345 - RNA, 64 nt, Human
aaagagaaguuuagaauauagagaguuuuuaaaugucucccauucuuuugauuucuuacuguac

SEQ ID NO: 141346 - RNA, 64 nt, Human
cgaacuccugaccgcaagugauccacacgccuuggucucccaaagugcugggauuacgguguua

SEQ ID NO: 141347 - RNA, 64 nt, Human
gcauucagaacauaaaugcacaaaaucuguacaugucucccaucagaaagauucauuggcaugc

SEQ ID NO: 141348 - RNA, 64 nt, Human
auaggaagacauauuuaaaaaccauuaaaacacugucucccacucaugaaaugagccacguagu

SEQ ID NO: 141349 - RNA, 64 nt, Human
ugcaguggcacaaucucggcucacugcaauuuccgucucccaaguucaagcgauucuccugcuu

SEQ ID NO: 141350 - RNA, 64 nt, Human
cgaacugcuggauucaagugauccgcccaucuccgucucccaaagugcugggaauuacaggcgu

SEQ ID NO: 141351 - RNA, 64 nt, Human
agcauguguucacugugcugugauuucaucuacugucucccagaaaguguguugggaucggcca

SEQ ID NO: 141352 - RNA, 64 nt, Human
uacuucuugguuuuaagcugucuaccuaauugcugucucccagcagacugguggcaugcccagu

SEQ ID NO: 141353 - RNA, 64 nt, Human
ucguggcugccaggggccugcagggucugggugggucucccaggagaggaauacugagugggag

SEQ ID NO: 141354 - RNA, 64 nt, Human
cuaaaccagcccugcaugaaacagaguccaagcugucucccaacagccuggguucgguccuugg

SEQ ID NO: 141355 - RNA, 64 nt, Human
uaaccaggccauuuuuggugggaauccaagauuggucucccauaugcagaaauagacaaaaagu

SEQ ID NO: 141356 - RNA, 64 nt, Human
aagucaggguuggagcaguagcuggagggaccuugucucccagcucagggcucuuuccuccaca

SEQ ID NO: 141357 - RNA, 64 nt, Human
ccuccaccacaccccuccuuugaggacgcccggggucucccacaggccugugaguugccucggc

SEQ ID NO: 141358 - RNA, 64 nt, Human
caaacuccugaccucaagugauccacccaccuuggucucccaaagugcugggauuacaugcgug

SEQ ID NO: 141359 - RNA, 64 nt, Human
gugauuuuuauccaaucuuguuuccaaaaaccaugucucccagggccuuaaaagccaucaugua

SEQ ID NO: 141360 - RNA, 64 nt, Human
agcuuugagaugguguguccuggauuaauacuuugucucccaauaucacagaaaaauacaugcc

SEQ ID NO: 141361 - RNA, 64 nt, Human
agggguucagauguggugggguagggcccuggaagucucccaggucuucccucccuccucugau

SEQ ID NO: 141362 - RNA, 64 nt, Human
cccaaccaccuccacccuguuuguucccacaugugucucccaagccugcuagggacaggcaggg

SEQ ID NO: 141363 - RNA, 64 nt, Human
ucagaagggaaguaaguauucaggggguaaacaggucucccagcauucugaguguuccaaacca

SEQ ID NO: 141364 - RNA, 64 nt, Human
gcaagacccuuggcuggcuuccuccgcucugggugucucccacaugucuacuauggcaaaaaac

SEQ ID NO: 141365 - RNA, 64 nt, Human
cagguagaucccgaagcacagagacauaaaaaaggucucccagaaaacuauagaccauucucca

SEQ ID NO: 141366 - RNA, 64 nt, Human
acuccuggcagccucaagugauccacccaccucggucucccaaaguguugggauuacaggcgug

SEQ ID NO: 141367 - RNA, 64 nt, Human
uacagggcaggaaagagcugagguucuugguggugucucccauuccccuggcuaauuucagaca

SEQ ID NO: 141368 - RNA, 64 nt, Human
gcagauacacugcucuccccacccagaccugccugucucccacccuuucugccagggauggcag

SEQ ID NO: 141369 - RNA, 64 nt, Human
ggcuagggacauuuuggcacuggccugcccuauugucucccauccuagucuguccuggucccug

SEQ ID NO: 141370 - RNA, 64 nt, Human
uguucugugaugaggggaggggggcacaugcugagucucccaaggcugcgucuggaggggcccc

SEQ ID NO: 141371 - RNA, 64 nt, Human
ugaacuccugagcucaugccaucugccugccuuagucucccaaaaugcugggauuacaggagug

SEQ ID NO: 141372 - RNA, 64 nt, Human
ccugagucuuuucauugcuaccucuaauaguccugucucccacuucccacucguuccccuccuc

SEQ ID NO: 141373 - RNA, 64 nt, Human
agaccugccuaggacucuguggccgacuauaggcgucucccauccccuacaccuucccccagcc

SEQ ID NO: 141374 - RNA, 64 nt, Human
gaguauguguccaaugcugccuucccaugaaucugucucccaguuaugaaucagugggcaggau

SEQ ID NO: 141375 - RNA, 64 nt, Human
gagugcagugguugaucauagcucccgggcuguagucucccaggcucgagcaauccucccacuu

SEQ ID NO: 141376 - RNA, 64 nt, Human
guggaccaucaccuggugucuguagguggacccggucucccacaggugacaucaaccugagggu

SEQ ID NO: 141377 - RNA, 64 nt, Human
cccgugcaucagguccuucugcacuuugguggaagucucccaggguagguuuccuauuugaaac

SEQ ID NO: 141378 - RNA, 64 nt, Human
uguaauuauggggcuccccagagucugcguaacagucucccacuggcuggcucacccacaggug

SEQ ID NO: 141379 - RNA, 64 nt, Human
cagagcuuucuucuauccccagacccacaugggagucucccagcaccucugacucagcuuggcc

SEQ ID NO: 141380 - RNA, 64 nt, Human
accuggccaucuugagggguuuucuaacccccaggucucccaggccgaaggucagccuugaguc

SEQ ID NO: 141381 - RNA, 64 nt, Human
agcugaugucguguuuacagagcaaggcuucccugucucccacggggaggggcucgggccucua

SEQ ID NO: 141382 - RNA, 64 nt, Human
aggaaggaaacaacauuuucuugaaaggggaaacgucucccagaucgcucccuuggcuuugagg

SEQ ID NO: 141383 - RNA, 64 nt, Human
ccagccgagcgugggucccagucuauggaaucgagucucccagacaaaaaaggagaggcccugg

SEQ ID NO: 141384 - RNA, 64 nt, Human
gcaccacguuuacagaggaugaaaacacuucacagucucccagagccgaucguccucucccccg

SEQ ID NO: 141385 - RNA, 64 nt, Human
auuaugucuucgucucuuccaaccuaucuguucugucucccaauguaccacuuaucaacuaauc

SEQ ID NO: 141386 - RNA, 64 nt, Human
caaugcuugcuaaaccaugcccacgugagcaccugucucccacucaaaccucucccaucuccca

SEQ ID NO: 141387 - RNA, 64 nt, Human
uuauuuaacuaauccuuuauccucuauuuguguugucucccauuuuuuauuauuacaauauuac

SEQ ID NO: 141388 - RNA, 64 nt, Human
ugggcuuucucuaauuuugugauguucugucauugucucccaaaguauuuaggagaagcccuuu

SEQ ID NO: 141389 - RNA, 64 nt, Human
cauauguauuuuuuugcgacagggucgugcucuugucucccagacuggacugcaguggcacaau

SEQ ID NO: 141390 - RNA, 64 nt, Human
uucacucugguuacagggaggugcaaaccauucugucucccagccuuucuucucucuuugugug

SEQ ID NO: 141391 - RNA, 64 nt, Human
caagggccacguuggauuacugaagcggaaagcggucucccauguauaagaaaaaguuuuacaa

SEQ ID NO: 141392 - RNA, 64 nt, Human
ccccaggaaggaaaugaugcagcucuggcuccuugucucccaggcugauccuuuauucagaaua

SEQ ID NO: 141393 - RNA, 64 nt, Human
uuaauuccagacaaaaggaguuuaacaaaaacacgucucccauccuguuuccaaauuuucuauu

SEQ ID NO: 141394 - RNA, 64 nt, Human
uugaucugucuaauauugacagugggguauuaaagucucccacuauuauuauaugggagucuaa

SEQ ID NO: 141395 - RNA, 64 nt, Human
aaucuguuucccaguuuuccccucagcuuuccuggucucccauccgaacugcuucuuugugcac

SEQ ID NO: 141396 - RNA, 64 nt, Human
acacaaccaguaagugagguugccccacacagccgucucccagggaaucccuucugcaaaccaa

SEQ ID NO: 141397 - RNA, 64 nt, Human
uuuucuuggagcucugugucaacuuugauccuuugucucccaggaaggugugaccucuccuuug

SEQ ID NO: 141398 - RNA, 64 nt, Human
gaaguuggauuuuuguauucauguauaaaggaaagucucccagugcugucaaaggaauuguggu

SEQ ID NO: 141399 - RNA, 64 nt, Human
uuuuuccauuuuuuaaguacuuauguggaagcuagucucccaaaacacaaucuuuagagagaaa

SEQ ID NO: 141400 - RNA, 64 nt, Human
ugcuucccacucuggggccugccccugccuagcagucucccagcucccaacagccuggggaagc

SEQ ID NO: 141401 - RNA, 64 nt, Human
cugcuaucuaaucuguauucaaauccccccaauugucucccagguaacuuaugugucugguuuu

SEQ ID NO: 141402 - RNA, 64 nt, Human
ugguuauuugagaugugguacugcuuccucacaagucucccacaggccauguaaaggguauuuu

SEQ ID NO: 141403 - RNA, 64 nt, Human
ccccugaccgcacagggaggcuggggccagccuggucucccaggccugaggacaugccucccac

SEQ ID NO: 141404 - RNA, 64 nt, Human
guguaggugucagaaauacuccuagagccucaaggucucccaguccagaaacagucuggugacg

SEQ ID NO: 141405 - RNA, 64 nt, Human
ggagaaacugcagccccacuucuguuucccuggagucucccaauggaucauucaggaguguccu

SEQ ID NO: 141406 - RNA, 64 nt, Human
uguuccucuccugaccccaucuggcugcugccccgucucccaccccuguccccggggcucgcug

SEQ ID NO: 141407 - RNA, 64 nt, Human
uguaucaguccaguguguuccugucauaguuugugucucccaggcaggccaugguaggggccuc

SEQ ID NO: 141408 - RNA, 64 nt, Human
auggccaggccuugggcuacgucuggcuugcauggucucccaagggaaucagccccaucaacaa

SEQ ID NO: 141409 - RNA, 64 nt, Human
agggagggacugggcagggacugccggccccggagucucccacagggaggccauuccccuucua

SEQ ID NO: 141410 - RNA, 64 nt, Human
ccauauugauuccauguauuuaugagaagauauugucucccauuuuauuacacauuuuaaagcc

SEQ ID NO: 141411 - RNA, 64 nt, Human
caugaccuuuuaccuagucccaguuauuaccugagucucccauggaugacuugcugccaaggag

SEQ ID NO: 141412 - RNA, 64 nt, Human
uuugaguucuaaauuuuggugggaauuacuuuaugucucccaguuaagaagagucuccauuuuc

SEQ ID NO: 141413 - RNA, 64 nt, Human
cucccacucagagucugggucucacuggccccaagucucccacccagaacucuggccaaaaaug

SEQ ID NO: 141414 - RNA, 64 nt, Human
acaguguuggagguuaaggcauacgagagcagaggucucccaaacgcccuuuccuccucaggca

SEQ ID NO: 141415 - RNA, 64 nt, Human
uuuuuuuugauacggggauacggggucuugcucugucucccaggcuggagugcagugacacaau

SEQ ID NO: 141416 - RNA, 64 nt, Human
aaagagcacugggucauauggaaaaaauguaugugucucccaggugcauuucuugguuuauguc

SEQ ID NO: 141417 - RNA, 64 nt, Human
ggagggaaugagaacacaaauuggauaauccacugucucccaucccaggagguggugaguuggc

SEQ ID NO: 141418 - RNA, 64 nt, Human
gaaccauucaacauucaccucauuaaccuaaaaugucucccaaagauguauguaagacacacac

SEQ ID NO: 141419 - RNA, 64 nt, Human
cucgaucucuugaccucaugauccacccaccucggucucccaaagugcugggauuacaggcuug

SEQ ID NO: 141420 - RNA, 64 nt, Human
ucccugggaguaugucaugugacaagucuuuacugucucccagguuuuggauggagcauggggu

SEQ ID NO: 141421 - RNA, 64 nt, Human
uuccuuugucgccuccccagcaccugcccucccagucucccaccccggccccaggcuggaagcc

SEQ ID NO: 141422 - RNA, 64 nt, Human
ucucgcaguccccgcccuccaucucaccucacccgucucccaaccacccuuuuccauguuaccc

SEQ ID NO: 141423 - RNA, 64 nt, Human
gcgccaucuucccguggaguguggggaagcugcugucucccaggaagugccuuacucaucccgc

SEQ ID NO: 141424 - RNA, 64 nt, Human
ugcaauggcacgaucuuggcucacugcaaccucagucucccagguucaagugauucuccugccu

SEQ ID NO: 141425 - RNA, 64 nt, Human
gucuuauaaauuauaagucuuauauaauuuauaagucucccacaaucuuccaguucuuacccag

SEQ ID NO: 141426 - RNA, 64 nt, Human
agccaccgucucaccccugcggaggagcgcucccgucucccacaggugccuuaccgcguucccu

SEQ ID NO: 141427 - RNA, 64 nt, Human
ucauaaccaccugggaguugccaagaagcagacagucucccagugucugacucucggauauuug

SEQ ID NO: 141428 - RNA, 64 nt, Human
uaacuuuacuaaguaaucucacagcauuugccaagucucccaauauccaauuuuaaaaugaaau

SEQ ID NO: 141429 - RNA, 64 nt, Human
ggaagggcuagcgacugacagaaauaacuacccugucucccaccugcaggaaugucuaacaaag

SEQ ID NO: 141430 - RNA, 64 nt, Human
cucugccuuugugcucuguuccuguccagcaggggucucccaacaagugcucuuuccaccccaa

SEQ ID NO: 141431 - RNA, 64 nt, Human
agaaagcuauuccaagacucagaugaugccagcugucucccacguguguauuaugguucaccag

SEQ ID NO: 141432 - RNA, 64 nt, Human
uccaggcacccgguaccgauggggcagggaccgagucucccaugaaggcagacuccuccuccca

SEQ ID NO: 141433 - RNA, 64 nt, Human
uuuuaaguuucucugacuugguuuuucugucccugucucccacaguuguucccgcucugcaccu

SEQ ID NO: 141434 - RNA, 64 nt, Human
uggcaucuggcuugagucuccccgaggccugugcgucucccaaacacgcagcucaagguccaca

SEQ ID NO: 141435 - RNA, 64 nt, Human
gaguuuauguguugagaucagugacugcuggauagucucccagucugaucaaugaagcauucga

SEQ ID NO: 141436 - RNA, 64 nt, Human
agaggcauuucgggaaggcuugcuuuuucuccaugucucccaguuuguauaguuaaauugucca

SEQ ID NO: 141437 - RNA, 64 nt, Human
agcuucagccucaggaaagaacuuccccuucccugucucccaucccucuguggcaggcgccucu

SEQ ID NO: 141438 - RNA, 64 nt, Human
cggcugcaucuuugucccgaugcuagccgugccggucucccaucauccgcucgcccuccuuucc

SEQ ID NO: 141439 - RNA, 64 nt, Human
ugcuggucacaugaguuuacgauuccuuugaagugucucccacaggguggcaggacugggagaa

SEQ ID NO: 141440 - RNA, 64 nt, Human
ccuggccacugaaagagugugcaguggacugugggucucccauaugcggugccgcccaaaggug

SEQ ID NO: 141441 - RNA, 64 nt, Human
ugaagcucacggcugaagauuccagaagguccuggucucccaugcccaagggaugccauguagc

SEQ ID NO: 141442 - RNA, 64 nt, Human
ugcuguagauaucagcccaguggaaagcacaggugucucccacuuugcaaccuauguggcagcc

SEQ ID NO: 141443 - RNA, 64 nt, Human
guacuguugcuuugggagacagucuaggaauggagucucccacugcaacuugugaacuccauca

SEQ ID NO: 141444 - RNA, 64 nt, Human
gcagucauugucauccugugaccuuaucccuuuugucucccaucaccuuuuccuucuucagcag

SEQ ID NO: 141445 - RNA, 64 nt, Human
uuuuuuuuuuuucuuuuugaaacagucuuacucugucucccaggcugcuggagugcaguggcac

SEQ ID NO: 141446 - RNA, 64 nt, Human
ccuuaaaauuuuucuuaagacagagucuugcucugucucccaggcuggagugcaguggcacaau

SEQ ID NO: 141447 - RNA, 64 nt, Human
gaacuccuacaacucaagcauuccucccaccuuggucucccaaaauguugggaccacgggugug

SEQ ID NO: 141448 - RNA, 64 nt, Human
ccugcugcacuuggagggaggggacauacacacagucucccaucucuccuccccucccccuggg

SEQ ID NO: 141449 - RNA, 64 nt, Human
gcuggcagaggcgguaguaaagucccuguaccccgucucccagggcacaagcucccuagccucu

SEQ ID NO: 141450 - RNA, 64 nt, Human
caagugaguuuuccuccagccccugagaguugcugucucccaguggaauguucacugacgucuu

SEQ ID NO: 141451 - RNA, 64 nt, Human
agagacgguguugggagcccuuuggagaacgccagucucccaggcccccugcaucuaucgaguu

SEQ ID NO: 141452 - RNA, 64 nt, Human
ccuguuugggcucaggagauagaagacaaaaucugucucccacgucugccauggcaucaagggg

SEQ ID NO: 141453 - RNA, 64 nt, Human
uuuuuuggguggggggugcggggcaguucacucugucucccaggcuggagugcaauggugcaau

SEQ ID NO: 141454 - RNA, 64 nt, Human
aucugccaggucuuagaagucaggaccacccagggucucccagagugaacuuggugcucuaagu

SEQ ID NO: 141455 - RNA, 64 nt, Human
aaucauuggccaguguuacguuuucacauugucugucucccacccucacugaucacgccugccc

SEQ ID NO: 141456 - RNA, 64 nt, Human
ugaacuccugacgucaagugaucugccugccuuggucucccaauacaggcaugaaccacugcac

SEQ ID NO: 141457 - RNA, 64 nt, Human
cuagaccaccccuuuucaucauuuugcuuuuuaugucucccauaagaaaugugcuuuuuagagc

SEQ ID NO: 141458 - RNA, 64 nt, Human
uuagagauaauugauucagggguuuucucucccagucucccagcagggacugauuucauuucug

SEQ ID NO: 141459 - RNA, 64 nt, Human
aggucccuaugggcgcagcugcuccgugagcugagucucccacugcccugcacaccaccacauu

SEQ ID NO: 141460 - RNA, 64 nt, Human
uaccuguggggaaccuacuacucccugggccuuagucucccaaauccaccaugcaucugccccu

SEQ ID NO: 141461 - RNA, 64 nt, Human
uguguuagggagugagggucucucaggccuccaggucucccagccccuccuucucugucucuac

SEQ ID NO: 141462 - RNA, 64 nt, Human
uuuuuuuuuuuuuuuugagacaaagucucgcacugucucccaggcuggacugcagcagcgcagu

SEQ ID NO: 141463 - RNA, 64 nt, Human
gguggaaccggaauuugggucaauacauccuuuugucucccaagggaagagaaugggcagcagg

SEQ ID NO: 141464 - RNA, 64 nt, Human
agcaggccagguccagagagaccgaggagggagagucucccagggagcaugagaggaggcagca

SEQ ID NO: 141465 - RNA, 64 nt, Human
guucaguucccuuguccugaucucauccucucuggucucccaauaacucacccuugggaugugu

SEQ ID NO: 141466 - RNA, 64 nt, Human
aaaaccuauuuaguuaauucuuucuuggcccacagucucccagaaaugauguuuugagucccua

SEQ ID NO: 141467 - RNA, 64 nt, Human
aacccuccugggcccaagugauccuuccaccucagucucccagcuaauugagaccacaggcuug

SEQ ID NO: 141468 - RNA, 64 nt, Human
gaccaucuucuggccaaucaaggcuugcuggagugucucccagccaaucagggccuugaggagg

SEQ ID NO: 141469 - RNA, 64 nt, Human
ccugaggccacgcugcuauggaggcugccuccuagucucccaccaggucccaggcuguggaaag

SEQ ID NO: 141470 - RNA, 64 nt, Human
gaugggguuuggggauuagaacuuaccccacugggucucccaaaagccuuggugcucccggcug

SEQ ID NO: 141471 - RNA, 64 nt, Human
uuucucuggucacagggguccuggguccuuugaugucucccaaccacauguagccaauuccuca

SEQ ID NO: 141472 - RNA, 64 nt, Human
ugggaggggcucugagcaguguugggcaggccgggucucccaucccgaggccagcguuccugug

SEQ ID NO: 141473 - RNA, 64 nt, Human
ggcuucccugggcucaagcaguccucccaccucagucucccaaauagcuaggacuacaggcgug

SEQ ID NO: 141474 - RNA, 64 nt, Human
gaugcuaauagaguuucugaaauacuuuggaaaagucucccaaaccuucagagaguggauggga

SEQ ID NO: 141475 - RNA, 64 nt, Human
agggcuucuucucgcaggucagcuccuuagagaggucucccagauuccccguaaagcagcccug

SEQ ID NO: 141476 - RNA, 64 nt, Human
aagauguuaauuguaauucagccagaaaguacaugucucccauugggaggauuugguguuaaau

SEQ ID NO: 141477 - RNA, 64 nt, Human
agacccuggcaauauuaugugucccuuuggaccagucucccaagaggagaggggcaggcaggaa

SEQ ID NO: 141478 - RNA, 64 nt, Human
cgaacuccugaccucaagugaucugccugccuuggucucccaaagugcugggaauacaggcaug

SEQ ID NO: 141479 - RNA, 64 nt, Human
ccagcuagcuagcaacccauugccaccaccuacugucucccauccugacuaucacuguaauuua

SEQ ID NO: 141480 - RNA, 64 nt, Human
ucugugcacuugagagcugggggacccacccaccgucucccacuccaaguucaucccagagcgu

SEQ ID NO: 141481 - RNA, 64 nt, Human
accugaguggggaaggaaggaggauuucaguuaggucucccauuuggcugaugggaaggaggcc

SEQ ID NO: 141482 - RNA, 64 nt, Human
aaacuugucuuaucucaggagagagcccgcucuugucucccaguuccugguagggucugccugu

SEQ ID NO: 141483 - RNA, 64 nt, Human
caaauuccuggacugaagcuaucuacccgccuuagucucccaaagugcuaggauuacagcguga

SEQ ID NO: 141484 - RNA, 64 nt, Human
uaggaaacauccucauugauccucuucaguuggagucucccaaauuuaauguggaagacaaagu

SEQ ID NO: 141485 - RNA, 64 nt, Human
acauaagggugcuuacuuaguuuuucucuuccuugucucccacucuuucuucauauacgguguu

SEQ ID NO: 141486 - RNA, 64 nt, Human
ugaggcaccagggcuaagcaauuaaaccaguuaagucucccaggagccgugugucucaguucuc

SEQ ID NO: 141487 - RNA, 64 nt, Human
cgaacuccugaccgcaagugauccacccgccucggucucccaaagugcugggauuacagaugug

SEQ ID NO: 141488 - RNA, 64 nt, Human
ggcgggcucagagcuuugucacuugccacauggugucucccaacaugggagggaucagccccgc

SEQ ID NO: 141489 - RNA, 64 nt, Human
gcuccucuggcccugaguggcaccugucccucuggucucccagcaccuggcccagguaacagcc

SEQ ID NO: 141490 - RNA, 64 nt, Human
uauaguggugcuaucucggcucacugcaaccauugucucccagguucaagcgauacuccugccu

SEQ ID NO: 141491 - RNA, 64 nt, Human
ucuuagggagggcaaagguucgggggcagccagugucucccaucagugccuuuuuuaauaaaag

SEQ ID NO: 141492 - RNA, 64 nt, Human
ccuaucucagggagggaaggggauggaggccagagucucccagugggugaugcuuuugcugcug

SEQ ID NO: 141493 - RNA, 64 nt, Human
ccgacagcgccauccaggcccccugggggcgcccgucucccacagcaaaggugagggacaaggg

SEQ ID NO: 141494 - RNA, 64 nt, Human
cgaacuccugaccucaagugauccacccgccucagucucccaaagugcugagauuacaggcaug

SEQ ID NO: 141495 - RNA, 64 nt, Human
cccuuugccccagguuuccucccggaggcagacagucucccagagcugagggcuugccucugga

SEQ ID NO: 141496 - RNA, 56 nt, Human
guggcagcaaggccaccugaggcccugucucccagccacuuucccuccuggcacug

SEQ ID NO: 141497 - RNA, 64 nt, Human
gccucuucccuaacuagacaauuuuuuauugagugucucccaggugcaggcaugagccaggugc

SEQ ID NO: 141498 - RNA, 64 nt, Human
ugaacuccugggcucaagcgauccuccugccccugucucccaaagugcuaggauuacaggugug

SEQ ID NO: 141499 - RNA, 64 nt, Human
guuuuuuguuuuaaaagagacaggaucuugcuuugucucccaggcuggaacacaguggugugau

SEQ ID NO: 141500 - RNA, 64 nt, Human
guucuacccuccccacagaccuaagcugcucccagucucccagaaccaagaguucuuggguugg

SEQ ID NO: 141501 - RNA, 64 nt, Human
ucucugccaucuccacuccccuccuuuucaugcugucucccagaaaagcugccagggcucuggc

SEQ ID NO: 141502 - RNA, 64 nt, Human
guacaauggugcgaucuuggcucacugcaccucugucucccaaguucaagugauucuccugccu

SEQ ID NO: 141503 - RNA, 64 nt, Human
uuguuuuggggacagacuuuuaaaaugcccuugugucucccagugaggagcccuaagcauugac

SEQ ID NO: 141504 - RNA, 64 nt, Human
uuauuauuauuuuuuugagacagauucucacucugucucccaggcuagagugcaguggugcaau

SEQ ID NO: 141505 - RNA, 64 nt, Human
ccaagagugaggggcagagacuuccagucacugagucucccaggcccccuugaucuguacccca

SEQ ID NO: 141506 - RNA, 64 nt, Human
guguuuuuccuuauguagguguuauugcauuggagucucccauuuucauucucaaauuuaccuc

SEQ ID NO: 141507 - RNA, 64 nt, Human
cucaaucuccugaccucgugaaucgccccccucggucucccaaagugcugggauuacaggcgug

SEQ ID NO: 141508 - RNA, 64 nt, Human
cuuguuuggccucaaaacagaagcagcuucuuuugucucccagcaguagugagccacucagucu

SEQ ID NO: 141509 - RNA, 64 nt, Human
cugccucccggguucaagcgauccuccugccucagucucccaaguagcugggauuacaggugug

SEQ ID NO: 141510 - RNA, 64 nt, Human
ucuuuacuuguaucaaaugaugacugguauacuggucucccaucccuuugcuuguggcaggaga

SEQ ID NO: 141511 - RNA, 64 nt, Human
accagcacaucuggagccacacagcuuggggggugucucccaucuuuuacagguggggaucaca

SEQ ID NO: 141512 - RNA, 64 nt, Human
auaggauaacucaaguuacuggaaaccucgaccugucucccaguugguugcacagcagguuacu

SEQ ID NO: 141513 - RNA, 64 nt, Human
agaagagguaagggagugaggcacuccuaucccagucucccagguuugguugagggcuccccaa

SEQ ID NO: 141514 - RNA, 64 nt, Human
caggaaucugacuguccggaaugugaguugaggggucucccacugaaguccucuucuggaagcu

SEQ ID NO: 141515 - RNA, 64 nt, Human
aaccuacacucuucggugcuuagagagaucugcugucucccaaauaagcuuuuguaucugccag

SEQ ID NO: 141516 - RNA, 62 nt, Human
gcaacuugcuggagaucugagccggguggaaggucucccaccccagggcugcccugacaguc

SEQ ID NO: 141517 - RNA, 64 nt, Human
ccagccccagccaccccauggacucaggacucaggucucccauagcugcuuauuuacccguuuc

SEQ ID NO: 141518 - RNA, 64 nt, Human
ucacugacugcuuacucuaccuuagcuggaccucgucucccagggauuagagaaaagagcagga

SEQ ID NO: 141519 - RNA, 64 nt, Human
ugauuauugucauguauuaggcuaaugcuguguugucucccaccuggaacugaauugcuuggug

SEQ ID NO: 141520 - RNA, 64 nt, Human
gcuuaguuaagucacccaugcaccuggucauugugucucccaugcacauccagcguuucucaga

SEQ ID NO: 141521 - RNA, 64 nt, Human
agcgauaggccacauuccaguaagaacucaauuugucucccaaauuugcagaaacaaaacguga

SEQ ID NO: 141522 - RNA, 64 nt, Human
uggggagaggagugggaaauugauuaaaggggcugucucccaaugaaagaggcauucccagaau

SEQ ID NO: 141523 - RNA, 64 nt, Human
ccugaccucggacaccaccauggucagcgaccuggucucccagaacaucaaugucuuccugcgg

SEQ ID NO: 141524 - RNA, 64 nt, Human
caccacaaacgagcucccagacauguaaacacacgucucccacacgugagcucccacacguaca

SEQ ID NO: 141525 - RNA, 64 nt, Human
aagacccauuugugauggguaaacaucccuuccugucucccacaaccccugugacugcccugca

SEQ ID NO: 141526 - RNA, 64 nt, Human
aggggcagccgauguucagaggcauccaaaaaaagucucccacuucggcagccaugaagcccac

SEQ ID NO: 141527 - RNA, 64 nt, Human
uguuggguagcaagaacuuuaauuugcacuaccagucucccaaauagaaaaucauguauaguau

SEQ ID NO: 141528 - RNA, 64 nt, Human
aaacugggaaggcuuucaggcuaccuuuuucugggucucccacuuucuguuccuuccuccacug

SEQ ID NO: 141529 - RNA, 64 nt, Human
uacaacauggcaaagacugcuaagauuaaaauccgucucccauuuguuacagccucaccugcac

SEQ ID NO: 141530 - RNA, 64 nt, Human
accacacuguaguauguguggagggugcccucccgucucccacaacuucugcuauaacaauaaa

SEQ ID NO: 141531 - RNA, 64 nt, Human
aaaguugggaaacaagcugauuucuugccaagaggucucccaggagauauuugggaaaugugaa

SEQ ID NO: 141532 - RNA, 64 nt, Human
ggaauacacaggagcccuuccuggccuggauggugucucccagcuuccccgcccagcuugccca

SEQ ID NO: 141533 - RNA, 64 nt, Human
uuucugugggggacacugaaucucccaguguucagucucccaggacucugcugccucagccaga

SEQ ID NO: 141534 - RNA, 64 nt, Human
ccacuuuggcccagaaaccaaaugugaacuuccugucucccaccucagcacuaguccaugccag

SEQ ID NO: 141535 - RNA, 64 nt, Human
uuccaucugcacaugaaggacccccauacagccugucucccaccccugacaacccgagagggca

SEQ ID NO: 141536 - RNA, 64 nt, Human
acgcacaggccggaggcaccacgcacaggccagagucucccaaauccugucccgcacucucucc

SEQ ID NO: 141537 - RNA, 64 nt, Human
guagguuuuguagaggagaucugcacuggagcaagucucccagaugauucuaauacaggagggc

SEQ ID NO: 141538 - RNA, 64 nt, Human
ccaagcgucccccagccccgagagggagccugucgucucccagggaauaaaggagugcguucug

SEQ ID NO: 141539 - RNA, 64 nt, Human
ucuggaagcugcguccccucacccccuguuucaggucucccaucucccucagugaccuggaucu

SEQ ID NO: 141540 - RNA, 64 nt, Human
ucuaggggccaguucuagacuuuggagaugcagugucucccaggugugcacggacaccuggucc

SEQ ID NO: 141541 - RNA, 64 nt, Human
ucugucuccuggguucaggugauucuccucccuagucucccaaguagcugggacuauaggcacg

SEQ ID NO: 141542 - RNA, 64 nt, Human
ccuccuuccuugccccuggcugcucuaguguucugucucccagucaccucgcucucccagcacc

SEQ ID NO: 141543 - RNA, 64 nt, Human
ccuuucucccgccauucuuuuucugaggucuccugucucccacuccuucccuuuccuaggauuu

SEQ ID NO: 141544 - RNA, 64 nt, Human
uuacgcugaagccauggaucaacuucuuucuugugucucccagcacacgugugcacgcaaggca

SEQ ID NO: 141545 - RNA, 64 nt, Human
acuguuuauuuauuuugaggcagggucuugcucugucucccaggcucacugcagccucaacguu

SEQ ID NO: 141546 - RNA, 64 nt, Human
cgaacucaugaccucaagugauccgcccacuucggucucccaaagugcugggauuacaggcaug

SEQ ID NO: 141547 - RNA, 64 nt, Human
ucuggccuguuccugcgucugcggagcggcccuugucucccagcuaucuauaaccuuagcuaga

SEQ ID NO: 141548 - RNA, 64 nt, Human
gccacuugggucuggguggaaucagaacgugcaggucucccaggauguacacucacugcgcccu

SEQ ID NO: 141549 - RNA, 64 nt, Human
cgaacuccuggacuuaagugagccucccgccucagucucccaaagcgcugggauuacaggcagg

SEQ ID NO: 141550 - RNA, 64 nt, Human
ccgcggacucccuuuccugccuccaagaccuggugucucccacugugagcccagcugucccaca

SEQ ID NO: 141551 - RNA, 64 nt, Human
uuccaugacuccccacugcccuaagcugaggucagucucccaagccuggcauguggcccucugg

SEQ ID NO: 141552 - RNA, 64 nt, Human
auuuuauuuagacuuuuucaguggguauuuuucugucucccaaccucuacuguaaacuuucugg

SEQ ID NO: 141553 - RNA, 64 nt, Human
gggccagagcgggugggcagugucaaggcccgcugucucccaggugcuugcugggacucggggc

SEQ ID NO: 141554 - RNA, 64 nt, Human
gaaaucacaacacagagaagcaaaaagggaaaaagucucccacaauuuaucccaugagcaagaa

SEQ ID NO: 141555 - RNA, 64 nt, Human
ugcaucaucccccagccagguccccaccaggccugucucccagcguuugucuaauaaacgcacc

SEQ ID NO: 141556 - RNA, 64 nt, Human
uggggcuugugcuuggcaguuccugugcuguccugucucccagauccugagacccuggcugaga

SEQ ID NO: 141557 - RNA, 64 nt, Human
gggaagauuuuuuucuauagugaacucugugggcgucucccaguauuacccuggaugauaggaa

SEQ ID NO: 141558 - RNA, 64 nt, Human
acugagauuuugaggcaguugcagcccucgguuagucucccaguggaaaaaucgguugugccuc

SEQ ID NO: 141559 - RNA, 64 nt, Human
gccaccugcgccagcccuaccuuccaccacagaugucucccagaugggccuuggucacacuccu

SEQ ID NO: 141560 - RNA, 64 nt, Human
aagccuuguuucccuugcaggggggccagccauugucucccacuuggggaguuucuuccuggca

SEQ ID NO: 141561 - RNA, 64 nt, Human
acaggugcagccuuggaucaacagcuuuuucuccgucucccacaacaucgaggagguuagccug

SEQ ID NO: 141562 - RNA, 64 nt, Human
uacaggcaaaucacgccaccuccucucugagccugucucccacuccgugaaauggguaacauca

SEQ ID NO: 141563 - RNA, 64 nt, Human
cggaagcaucucucgaggacucuggucccaggaugucucccaggacaagccagucugccucuuc

SEQ ID NO: 141564 - RNA, 64 nt, Human
ugcacucccagugagccagccaccaccacaaccugucucccaguccugcucucaccccugcugc

SEQ ID NO: 141565 - RNA, 64 nt, Human
ccagauccuuagaaaaggagaggauggggguagagucucccaagccaaaauuuugacauuugag

SEQ ID NO: 141566 - RNA, 64 nt, Human
uuuuguauuuuuaguagagauaggguuucaccaugucucccaggcuggucucaaacuccuaacc

SEQ ID NO: 141567 - RNA, 64 nt, Human
gucuugaagcuugacaggauguuuucauuacucagucucccagggcacugcugguccguaggga

SEQ ID NO: 141568 - RNA, 64 nt, Human
guucuccaguugcugccuccuugucuugucuugggucucccauuccagcuucccugucucuucc

SEQ ID NO: 141569 - RNA, 64 nt, Human
cggucuggccccacccugguccaucacuuacgacgucucccaggcuugccuccccggaucggau

SEQ ID NO: 141570 - RNA, 64 nt, Human
aagccugggugaugaggcugcuggaagcuuugaagucucccauuccccucaugcuauaaaaaga

SEQ ID NO: 141571 - RNA, 64 nt, Human
gaggguccccaccugggacccuugagaguaucaggucucccacgugggagacaagaaaucccug

SEQ ID NO: 141572 - RNA, 64 nt, Human
cugugagucauuuagauagaauaguccuccuugggucucccaccaccccuagcuuuguguguag

SEQ ID NO: 141573 - RNA, 64 nt, Human
cccuccagcuuagagucugcauuugggcugugacgucucccaccugccccaauaagaucugcuc

SEQ ID NO: 141574 - RNA, 64 nt, Human
ugaacuccugaccucaaaugagccuccugcuucagucucccaaauugccgggauuacaggcaug

SEQ ID NO: 141575 - RNA, 64 nt, Human
cuaacacuaaaagucacuggguauuugguuaaaggucucccacaagacugguauucucuuugcc

SEQ ID NO: 141576 - RNA, 64 nt, Human
uuaagccucuccaccugucccaaccauaaaaagggucucccagcuuuccaucucuggcucuaua

SEQ ID NO: 141577 - RNA, 64 nt, Human
accccuggcucucccagucacccuccccuagccagucucccagcaaggguuuaagagauggccg

SEQ ID NO: 141578 - RNA, 64 nt, Human
caugucuuuacuagacugaggagcccucucgcgggucucccauccccucccuccuucacuccug

SEQ ID NO: 141579 - RNA, 64 nt, Human
cuguuuuuuauaaaacaccucaagcagcacugcagucucccaucuccucgugggcuaagcauca

SEQ ID NO: 141580 - RNA, 64 nt, Human
ugaggacggcacggccagcgccugcugugagugggucucccaagacuaggccucaggacgcggg

SEQ ID NO: 141581 - RNA, 64 nt, Human
cgucuccguucccccguccccauccuccauccccgucucccaucgccguccccccguccccguc

SEQ ID NO: 141582 - RNA, 64 nt, Human
uaagccaguguuggauucacuaaguggacagccagucucccagcucucugccuuccccaaaagg

SEQ ID NO: 141583 - RNA, 64 nt, Human
ccucucuacuacccauggcaggaaccuaguacaggucucccacccagggccuuccacccucggc

SEQ ID NO: 141584 - RNA, 64 nt, Human
cugccucccggguucaagcgauucuucugcuucagucucccaaguagcuuggauuacaggugag

SEQ ID NO: 141585 - RNA, 64 nt, Human
gaaaagccuugcccugguguucuaccagaaaaacgucucccaaucacccaggaaagcuguccac

SEQ ID NO: 141586 - RNA, 64 nt, Human
uugauucuuggaacuguaaagauuacaacccaaagucucccaggaagcuguggggagaccagag

SEQ ID NO: 141587 - RNA, 64 nt, Human
ugcuggagguuccggggccccaagccaguguggggucucccacagcugugccgggcagggggcc

SEQ ID NO: 141588 - RNA, 64 nt, Human
cagggauccaggcucguagagucacucccugcccgucucccagagaugcuucaccagcaccugc

SEQ ID NO: 141589 - RNA, 64 nt, Human
caaugagaggggagacagaggcagcuagggcuuggucucccaggacagagaguuacagaaaugg

SEQ ID NO: 141590 - RNA, 64 nt, Human
cucacaccacugcugcucgagucuccugcacugugucucccacacugagaaaccccccaaccca

SEQ ID NO: 141591 - RNA, 64 nt, Human
ugaccuccuaggcucaagcgauccuaucaccucagucucccaaguagcugggacuguaagugca

SEQ ID NO: 141592 - RNA, 64 nt, Human
ugggggacugaagcccuggcugccucagcgcucugucucccaacaccagcugguguugcagagg

SEQ ID NO: 141593 - RNA, 64 nt, Human
gcagagaggaggauguccuccugccugccugaaggucucccaugaaaacacugcugaacugugu

SEQ ID NO: 141594 - RNA, 64 nt, Human
cugggcuagagaaagguguccgccaaccuccucagucucccaggccugggacaggcagaacagg

SEQ ID NO: 141595 - RNA, 64 nt, Human
cuuuuuuuguuuguuugagauggagucucacucugucucccaggcuggagugcaguggcgugau

SEQ ID NO: 141596 - RNA, 56 nt, Human
ucgaacaccacggcaaguagcugcucgucucccaucggaaggcagcacugggugag

SEQ ID NO: 141597 - RNA, 64 nt, Human
aaaaauuuuuuuguuuaagacagcaucuugcucugucucccaggcuggagcguaguaaugcaau

SEQ ID NO: 141598 - RNA, 64 nt, Human
uggcacaaaggaaucugccuuuccuccgucucaagucucccacccuugacugguugggauuugc

SEQ ID NO: 141599 - RNA, 64 nt, Human
aaauaaacuaaccacaaaagacugaguugcaagagucucccaggcucacauuaaaccagggguu

SEQ ID NO: 141600 - RNA, 64 nt, Human
caaacuccuggccucaagugauccaccuaccuuagucucccaaagugcugggauuacaggugug

SEQ ID NO: 141601 - RNA, 64 nt, Human
acgucaccuccagcccggucucacccaugguccagucucccagcagcagcaacauccccacgca

SEQ ID NO: 141602 - RNA, 64 nt, Human
gcauccugcucuccggguggaagagcagcuuucugucucccagaaggcaucgcuuuucccucuu

SEQ ID NO: 141603 - RNA, 64 nt, Human
gccaccuccugacggguccccugggucugcauaggucucccauggcgcaaugagucaguggccc

SEQ ID NO: 141604 - RNA, 64 nt, Human
agccagggacagagcccacagagcccauacaccugucucccaccagcggggcccuccuggcagg

SEQ ID NO: 141605 - RNA, 64 nt, Human
uuuuuuuuuuuuuuuugaaacuaagccuugcucugucucccaggcuggagugcuauggugcaau

SEQ ID NO: 141606 - RNA, 64 nt, Human
acuugaaguuucucccacugccuccucuccaguggucucccaggugccagacccaaaagcuuuu

SEQ ID NO: 141607 - RNA, 64 nt, Human
gcucaacaaggaaaaaugccacucccuacccaaugucucccacacccacccuuuuuuuggggug

SEQ ID NO: 141608 - RNA, 64 nt, Human
gcaugaaaaacauuccacgugccccuugucgcgcgucucccauccugaucccagacccauuccu

SEQ ID NO: 141609 - RNA, 64 nt, Human
ccgccuccuggguuaaagugauucucucagcucagucucccagguagcugggauuacaggcaug

SEQ ID NO: 141610 - RNA, 64 nt, Human
cagacaccugggacuuuccccuucugguuccugugucucccaauaaacucucugaccaacccua

SEQ ID NO: 141611 - RNA, 64 nt, Human
ucccagaggauaagcaauaccuauuucugacugagucucccagcccagacccagggacccuugg

SEQ ID NO: 141612 - RNA, 64 nt, Human
gcauuuuuuuuguuuugagacaaagucucgcucugucucccaggcuagaguaccguggcacaau

SEQ ID NO: 141613 - RNA, 64 nt, Human
gcuggguccccucuguuggggguuugggguccgggucucccaccagccacugcuuccuccuggg

SEQ ID NO: 141614 - RNA, 64 nt, Human
aaccaucuugagauuuuuauuuuuuuugaacggagucucccacugucgcccagacuggagucca

SEQ ID NO: 141615 - RNA, 64 nt, Human
gagagagaaggccguuucuccuucuguagccugggucucccacgggccuuccccgcugcugagc

SEQ ID NO: 141616 - RNA, 64 nt, Human
guugugugaucaguuugugcuuuauucuguauuugucucccaugucuugcucuucuccuggaga

SEQ ID NO: 141617 - RNA, 64 nt, Human
agagccucccuccggacaaugaguccccccucuugucucccacccugagauugggcauggggug

SEQ ID NO: 141618 - RNA, 64 nt, Human
gaggcccucacugagccucaauuuccucaucugggucucccaggacacaucacauacccacccu

SEQ ID NO: 141619 - RNA, 64 nt, Human
uaaucugaggccgauccgggaccggccuccuugcgucucccauucccaagauugucccgccucu

SEQ ID NO: 141620 - RNA, 50 nt, Human
uccacugucuuccccagugagucucccagauacguugcauugugccaaca

SEQ ID NO: 141621 - RNA, 64 nt, Human
guuucagaagcauucaggcacugccaggcuugcagucucccagauguugcaucccugaaacauc

SEQ ID NO: 141622 - RNA, 64 nt, Human
ccuccucccagguucaagcaauucuccugccucagucucccaaguagcugacacuacaguugug

SEQ ID NO: 141623 - RNA, 64 nt, Human
uuucuucagcagugagaugcucagaauaacugcugucucccaugauggugugguacagcgagcu

SEQ ID NO: 141624 - RNA, 64 nt, Human
cugcugcugugcaugucccugcgaugggagucuugucucccagccugucaguuuccuccccagg

SEQ ID NO: 141625 - RNA, 64 nt, Human
uccucauagacggcaggugcccaccuuucagggagucucccagcaugggcggaugccgggcaug

SEQ ID NO: 141626 - RNA, 64 nt, Human
aauuuuuuuuccccccaagacagggccuugcucugucucccaggcuggagugcaguggcaugau

SEQ ID NO: 141627 - RNA, 64 nt, Human
uguuuguuuguuuugagacgggaguuucucucuugucucccaggcuggagugcaaucgcgcaau

SEQ ID NO: 141628 - RNA, 64 nt, Human
ggacugugaauggcuguucuccccucacugcugagucucccaggacccccuuuggagaugccca

SEQ ID NO: 141629 - RNA, 64 nt, Human
gaaaccaccaaagggcaugucugaugggcacagggucucccaaacccaguggcuucugucuguc

SEQ ID NO: 141630 - RNA, 64 nt, Human
uagcccugaucaugcuuuuugugccugucaccaggucucccaagugcacucauccaggucagug

SEQ ID NO: 141631 - RNA, 64 nt, Human
cccagagcccuguacaucccagacugggcccagggucucccauagacagccugggggcaaguua

SEQ ID NO: 141632 - RNA, 64 nt, Human
gaagaaccucucacuucacccuggagcccauccagucucccaacuuguauuaaagacagaggca

SEQ ID NO: 141633 - RNA, 64 nt, Human
gggcccaaguggggugcucuggucugaccgaugugucucccagaacuauucugggggcccgaca

SEQ ID NO: 141634 - RNA, 64 nt, Human
agucccuuuauucacagaccuugagaccacuggggucucccacaagguggggucaggagagggu

SEQ ID NO: 141635 - RNA, 64 nt, Human
ccuuauuauuauuuuugagacagugucuugcucugucucccaggcuggaggucaguggcacaaa

SEQ ID NO: 141636 - RNA, 64 nt, Human
gaaacaguccuggacuuucaaaaaccuugaauaagucucccacaguuguauaaauuggacaauu

SEQ ID NO: 141637 - RNA, 64 nt, Human
guuugguuugguuuugugacggaguuuugcucuugucucccaggcuggagugcagugacacaau

SEQ ID NO: 141638 - RNA, 64 nt, Human
gccucccugugaccuggaggacagugugugccaugucucccauacuagagauaaauaaauguag

SEQ ID NO: 141639 - RNA, 64 nt, Human
agccuccaagggcagcagugcacauggaggagacgucucccacgaggccaaggccuccaaugcu

SEQ ID NO: 141640 - RNA, 64 nt, Human
uuucuggccaagucuggccagccuggcccugcaggucucccaugaaggccaccccauggucuga

SEQ ID NO: 141641 - RNA, 64 nt, Human
aucccagagcgucccugcugcaacccugacagccgucucccaggccgcuuccccaacauccccg

SEQ ID NO: 141642 - RNA, 64 nt, Human
cucucugaucaugccagguuugcaccagccucgagucucccauguuguaguacauucuccaaga

SEQ ID NO: 141643 - RNA, 64 nt, Human
ucuuagggacaagucccaagaugccagaaaggcagucucccaaggacccaccaugcagaagugu

SEQ ID NO: 141644 - RNA, 64 nt, Human
cuggcagggccuuugccugaggagaguguguagggucucccaacgucgugggccgggucuuagg

SEQ ID NO: 141645 - RNA, 64 nt, Human
ccugcugucaagucccugccauuuugccucuccugucucccacccccugccccagacccaggag

SEQ ID NO: 141646 - RNA, 64 nt, Human
uauggucgagacuguagggaugaaauaaaccccagucucccauagcgcucccaggcuuauuagg

SEQ ID NO: 141647 - RNA, 64 nt, Human
cagggucugcagcaccugcuguuguugccaaccagucucccaaagcuccuugcuccccaccccu

SEQ ID NO: 141648 - RNA, 64 nt, Human
aggccacccagagacugugcccggagcuggccgugucucccacucaggggcugagaguagcuuu

SEQ ID NO: 141649 - RNA, 64 nt, Human
caagcugccugcccgaggcugguccugaaggccugucucccacuaaccccgccuuccagcacuu

SEQ ID NO: 141650 - RNA, 64 nt, Human
ucccuacguuuucucccaucuuuuuuccucuucagucucccagucaucugguuuguuuguuucu

SEQ ID NO: 141651 - RNA, 64 nt, Human
gggccuggcauguuucagugugguguccagcagugucucccacuccuugugaagucugagguau

SEQ ID NO: 141652 - RNA, 64 nt, Human
cucaguuguucuuugucauacuacuauuccuuucgucucccagaauccucagggcacugagggu

SEQ ID NO: 141653 - RNA, 64 nt, Human
gaagcagggcagcuuccuucgccagaggccugcggucucccacuuccggccuagucugccagcu

SEQ ID NO: 141654 - RNA, 64 nt, Human
aggggaagccaucccagccuuuaccacccaaugugucucccaugcugggcauccuaggccacuu

SEQ ID NO: 141655 - RNA, 64 nt, Human
agcgaggcucuaaccacacagccuacaaugcugcgucucccaucuuaacucuuugccuuugcca

SEQ ID NO: 141656 - RNA, 64 nt, Human
gacuauagacauuuagaucagguacccagugucugucucccacgacaggccaagggaugugaua

SEQ ID NO: 141657 - RNA, 64 nt, Human
gaaagaggcccucucaagggugccagaugccugggucucccaagaggggucccccaacucaccg

SEQ ID NO: 141658 - RNA, 64 nt, Human
gcauggcuguaauucuuuagcuuucuccacuucugucucccacauauacuaaaauucuuaggua

SEQ ID NO: 141659 - RNA, 64 nt, Human
ccauggggcccuggucuucuguacucaggggcuggucucccagugaugggcaaaagccagcuug

SEQ ID NO: 141660 - RNA, 64 nt, Human
ugaacuccugggcucaagugauccgcccgccucagucucccaaagugcgaggaugacaugugug

SEQ ID NO: 141661 - RNA, 64 nt, Human
cucagagucauugcagagccgggauggggaccaggucucccaucuccuacuuuaugacgcccuc

SEQ ID NO: 141662 - RNA, 64 nt, Human
cacuuguuguauuuauuaguguagcuucuccuuugucucccauccacucugacaccuaagcccc

SEQ ID NO: 141663 - RNA, 64 nt, Human
ccgccuccuggguucacgccauucuccugccucagucucccaaguaccugggaugacaggcgcc

SEQ ID NO: 141664 - RNA, 61 nt, Human
agccccccgggcccagccgccucccucucuugggacgcaacuucuuccccacucggauggg

SEQ ID NO: 141665 - RNA, 61 nt, Human
aggccgcccuacccaccuucaggcagccuaugggacgcagggccccaucugucccucgguc

SEQ ID NO: 141666 - RNA, 61 nt, Human
aaauagagagaucuauacagguaugucugacgggacgcagcaccgugggcacgcaccaaau

SEQ ID NO: 141667 - RNA, 61 nt, Human
ccuucuccacaggcugcgucaucaccaucucgggacgcaugaccuucacgagcaauaaguc

SEQ ID NO: 141668 - RNA, 61 nt, Human
cgaggagcccagauuugggccuaaucagguggggacgcaucucagccuggaaccaacaggg

SEQ ID NO: 141669 - RNA, 61 nt, Human
accauacucacuuuccagggcugggggaagggggacgcaggaucauccccucccaaggaga

SEQ ID NO: 141670 - RNA, 61 nt, Human
gcccugggggugggggguggugggcagggaugggacgcaccacacagaacugugauugugg

SEQ ID NO: 141671 - RNA, 61 nt, Human
agaggagagcucugggguuggggauggguuagggacgcaagcuugaguucuagcccuugcu

SEQ ID NO: 141672 - RNA, 61 nt, Human
acaagcugggacgucagggaaaugaacaaaagggacgcagguuauuuggggugagugggug

SEQ ID NO: 141673 - RNA, 61 nt, Human
caacuccagucaugggaccaggaggagcucugggacgcagacacauuccuuggauguugau

SEQ ID NO: 141674 - RNA, 61 nt, Human
gacgacgaaggaacaggcguuucugacgagcgggacgcaguucucggacgccgaggggcug

SEQ ID NO: 141675 - RNA, 61 nt, Human
ccucauagguagacaguucuuugggacuuuugggacgcagcacuugaagagagguuuaccu

SEQ ID NO: 141676 - RNA, 61 nt, Human
acugcccuaggccauugcagcauccuuagaugggacgcauaaucauuaccuuaaagcauca

SEQ ID NO: 141677 - RNA, 61 nt, Human
caauaaagaugccuuaagucucccgguucuggggacgcagcuacggcgccuaguucgugcu

SEQ ID NO: 141678 - RNA, 61 nt, Human
agccgugugaaggagucggagaucagagugagggacgcauccacaagccaaggaacccaag

SEQ ID NO: 141679 - RNA, 61 nt, Human
aagacagcaaagacagcacuguuccugggcugggacgcaaggaaugagguccuuuaugaaa

SEQ ID NO: 141680 - RNA, 61 nt, Human
gccuuauccacucccacuuguccuguuuggagggacgcagucccuagggcccgagacuggg

SEQ ID NO: 141681 - RNA, 61 nt, Human
augaauucucaacaaaaugugcuagccacuggggacgcaaaacaaguaagaucccuguugc

SEQ ID NO: 141682 - RNA, 61 nt, Human
gccguucccaauccuuagcaaugccuuagcugggacgcauagcuaauacuuuagagaggau

SEQ ID NO: 141683 - RNA, 61 nt, Human
acauuguggacuuugaaugugagggcuggaugggacgcaggagaucaucugaucccagcca

SEQ ID NO: 141684 - RNA, 61 nt, Human
guccaaucagcugaaauuaaaucacuugggagggacgcauagaaggagcucuaggaacaca

SEQ ID NO: 141685 - RNA, 61 nt, Human
gauaccucgguccagaucuccggauugucgggggacgcaggacucuucgaggaaaaccagc

SEQ ID NO: 141686 - RNA, 61 nt, Human
aauccuccccugccccgcgggucucuggauugggacgcacagugcaguugaggucugcguc

SEQ ID NO: 141687 - RNA, 61 nt, Human
cgccgaaccucaccauauggagccagacauugggacgcacgcaugugauugugugugcacg

SEQ ID NO: 141688 - RNA, 61 nt, Human
cugcccuacccucucacuuaacuggagcuuugggacgcacccuccacagugggagguggug

SEQ ID NO: 141689 - RNA, 61 nt, Human
uaaucucuguucuucuaacugaucuaggauggggacgcacccaggucugcugaacuuuacu

SEQ ID NO: 141690 - RNA, 61 nt, Human
ccccaucggcagggagaggaggcgcgggagggggacgcaaacaaaaaauggcuuucauauu

SEQ ID NO: 141691 - RNA, 61 nt, Human
ggaagcugaggcgggagaaucaugugaacccgggacgcagggguugcagugagcggagauc

SEQ ID NO: 141692 - RNA, 61 nt, Human
gucaagguguuuucacagcccccugagggaagggacgcagggucuccgacaggugcucugg

SEQ ID NO: 141693 - RNA, 61 nt, Human
gacucaccgcugggugcuugccaaagagauagggacgcauaugcuuuuuaaagcaaucuaa

SEQ ID NO: 141694 - RNA, 61 nt, Human
cagaagccucugggucagugguccacaucccgggacgcagcaggaggccaggccggcgagc

SEQ ID NO: 141695 - RNA, 61 nt, Human
ucugcaaaccuacccugucaaggagaucaaagggacgcagguuucuguuuauucugaacaa

SEQ ID NO: 141696 - RNA, 64 nt, Human
gggggccucacugcugcgcaagggguggggccgaggaugcaaguccaggcagagcggcgcaggc

SEQ ID NO: 141697 - RNA, 61 nt, Human
cacuggugacuucauggccacgccagcugcggggacgcacuugggacuccucgagagggga

SEQ ID NO: 141698 - RNA, 61 nt, Human
aagcucagcgaggaccucauggaguuccggcgggacgcauccauguuaaaugugagcgggc

SEQ ID NO: 141699 - RNA, 61 nt, Human
cacccacauucaccaaacccacccgcgcccugggacgcagccacgccaggaggaggacacg

SEQ ID NO: 141700 - RNA, 61 nt, Human
ccccauccaguguccucugcagcagggccaggggacgcacaccugccugacucuuuccuca

SEQ ID NO: 141701 - RNA, 61 nt, Human
ccuaggcuguuuuuccuuccuccacaccugagggacgcagcaacagcuaggaucugcauuu

SEQ ID NO: 141702 - RNA, 61 nt, Human
ggcccggugaccgcgcggauucaggauugcggggacgcagaaagguuaaggcacuuuuaaa

SEQ ID NO: 141703 - RNA, 61 nt, Human
gccuaaucagacuuauuauugagacgucaaugggacgcauuuuucuguugagcuaugcagu

SEQ ID NO: 141704 - RNA, 61 nt, Human
gugccuccccgaccuugcugacuaggcacaugggacgcaaaggagggagggaagcaaggcc

SEQ ID NO: 141705 - RNA, 61 nt, Human
cgugcccuuuggggcuugaagagcacacugugggacgcacgugcuucugauuaaaggaauc

SEQ ID NO: 141706 - RNA, 61 nt, Human
uuuuuuaccaagagcccgagccucgcucuaagggacgcaguccuagaggcgugcccuuugg

SEQ ID NO: 141707 - RNA, 61 nt, Human
aggguccugccuuuuucucugccccaggucugggacgcaggugaugccagccaggcccagg

SEQ ID NO: 141708 - RNA, 61 nt, Human
uaccccagaaguguaucccacgagggcaucagggacgcagugaguguugcucaagggaguc

SEQ ID NO: 141709 - RNA, 61 nt, Human
uuccaaggcugagggagggccuucucgccuggggacgcagccacuuucuccaguggagaca

SEQ ID NO: 141710 - RNA, 61 nt, Human
uaaagggcgcaaagggcaugggucgggagaggggacgcaggccccucuccuccguggcaca

SEQ ID NO: 141711 - RNA, 61 nt, Human
acuuuccucuucuaguagcuguugucugguggggacgcaguggcccuggacacggcucccc

SEQ ID NO: 141712 - RNA, 61 nt, Human
cccugcccagugcaucccccaggucaucacggggacgcaggaggcaggcccugcccugccc

SEQ ID NO: 141713 - RNA, 61 nt, Human
ccagucccaccccuugccccacggaguccuggggacgcagugccccagcugggaagagggc

SEQ ID NO: 141714 - RNA, 61 nt, Human
uccagauuccggcuucuacaugggacagacggggacgcacaggccaccuuccuucuggcag

SEQ ID NO: 141715 - RNA, 64 nt, Human
ugcaauaugccagaacuacagacaacagcccacaggaugcaaaagugcuuugccaucuuaaaaa

SEQ ID NO: 141716 - RNA, 58 nt, Human
ccacucuggccauccacuagcccagggggggacgcagaccccacacuccauggagucu

SEQ ID NO: 141717 - RNA, 61 nt, Human
ugcacaguguggcugcuuuuccauaauuuuugggacgcacaaaugucugcaugauuuugag

SEQ ID NO: 141718 - RNA, 61 nt, Human
gccugggaagagggcgaggaggccagugguggggacgcagaggguccucagagcaggagug

SEQ ID NO: 141719 - RNA, 58 nt, Human
gcguccacagcgccgaguagcuccagccgggacgcacuguguccgccauggucagaac

SEQ ID NO: 141720 - RNA, 61 nt, Human
uucauuagagcgaggcagcccuuggccgguggggacgcagagccccagcagguggugcacg

SEQ ID NO: 141721 - RNA, 61 nt, Human
gaagaauacagucauguaucucuuggugacagggacgcauucugauaaaugugucauuagg

SEQ ID NO: 141722 - RNA, 61 nt, Human
cuccaaggagcaugucacuccagcagcacaggggacgcaaugggaggcagggacaccugga

SEQ ID NO: 141723 - RNA, 61 nt, Human
uugaaggccugcugucuccuucugggggucagggacgcagcuccacccucaccacuagccc

SEQ ID NO: 141724 - RNA, 61 nt, Human
cggaaguaaaccugaacaaacccuuuaaauggggacgcagaugaguccucgguaaaccgag

SEQ ID NO: 141725 - RNA, 61 nt, Human
cggaggagcugguggugggagaaugacggcagggacgcagccacaguucagacccuguccc

SEQ ID NO: 141726 - RNA, 61 nt, Human
gagccccaaagaucccacgggagaggggagagggacgcacagcacugccugccaagcgaga

SEQ ID NO: 141727 - RNA, 61 nt, Human
ugggguugcucccuguucugccccgaggccggggacgcagggcagcccacgccuccguggg

SEQ ID NO: 141728 - RNA, 64 nt, Human
ugaguaagccgcgucccccaacuacagcuggagacggggccagcucggcggccugcugguccuc

SEQ ID NO: 141729 - RNA, 64 nt, Human
ugaugcugggugccccgaggcagaacaagaggcgcggggccacacccgugaaccaugcagacgg

SEQ ID NO: 141730 - RNA, 64 nt, Human
gagauucuggccuccagcugucaccacaccguaacggggccauguaacugugcagcauggacag

SEQ ID NO: 141731 - RNA, 64 nt, Human
agacaagggcuggugcccggcccagggugcccagcggggccaugccauggcagauaaagcucag

SEQ ID NO: 141732 - RNA, 55 nt, Human
augaccucuucagcuucugagggcccggggccagccggacacaagcggcccugac

SEQ ID NO: 141733 - RNA, 64 nt, Human
ggugaagaauggagggaggagcaggcuaggaagacggggccaccacccucuccuugcuuucagc

SEQ ID NO: 141734 - RNA, 64 nt, Human
uccaacuuucuuacuacauccaucuuuucuguggcggggccaaaaaaggaaaccaggagugcca

SEQ ID NO: 141735 - RNA, 64 nt, Human
gggcugcaguucccggcgagcggcgccccgacugcggggccacccgccugcgcuccgccgacgc

SEQ ID NO: 141736 - RNA, 64 nt, Human
ugggagaccugugggugugagccuggccguccuccggggccaccgaccgcagccagccccuccc

SEQ ID NO: 141737 - RNA, 64 nt, Human
uggucuggccuggccguguggugaugaggcuuagcggggccagugacggccguggcucaggauc

SEQ ID NO: 141738 - RNA, 64 nt, Human
gugcuguaaacuaaaacaaauugugcauuccuuccggggccaucgucuuuguuuucuuuuuugu

SEQ ID NO: 141739 - RNA, 64 nt, Human
cugaagaagugugaaugugaaggcggcgucggcgcggggccagagcaccacucugcugccccac

SEQ ID NO: 141740 - RNA, 64 nt, Human
agagaaacuaacuugguggccccgacaggucuuccggggccaugggcauuuguuuagagccaaa

SEQ ID NO: 141741 - RNA, 60 nt, Human
agcgcuaccugcggaaauaacagccucagccggggccaccagcacugcugccacuucuuc

SEQ ID NO: 141742 - RNA, 64 nt, Human
ugcugccccaaagcacaagagggaagagcaccgccggggccacaggacgucuguccuccaguca

SEQ ID NO: 141743 - RNA, 64 nt, Human
ccugcaguggcccgucucaggcccugcucacucccggggccaccaaacgggccccucucucggg

SEQ ID NO: 141744 - RNA, 64 nt, Human
ugacgccucaagcacgggcaccagccgucaucuccggggccaggggcugcagcccggcgguccc

SEQ ID NO: 141745 - RNA, 64 nt, Human
cuguaacaacauaaaccagcacgcgguucccacccggggccaaccucuccacgcgcacucagga

SEQ ID NO: 141746 - RNA, 64 nt, Human
gccugaggcagccacuucggccaggucacacgaccggggccagcaccacuuccuuuaaagauga

SEQ ID NO: 141747 - RNA, 64 nt, Human
aagggaauucgagcugggcaugaaaaggaugcuccggggccauuguuaguggguuuggggcuga

SEQ ID NO: 141748 - RNA, 64 nt, Human
ugugcucggugagaaguccugcacccugcggcuccggggccaaggcuccuaugaugagagauac

SEQ ID NO: 141749 - RNA, 64 nt, Human
cuagagagagaaaacaaaagaucagaaaugaaagcggggccaggcgcgguggcucgugccugua

SEQ ID NO: 141750 - RNA, 64 nt, Human
aaagcacuguagcccuggaccugccuccuucccucggggccauacuucuguuuccaucugcugg

SEQ ID NO: 141751 - RNA, 64 nt, Human
ucugagcccucuggccagcacgccuguccucccccggggccaaggcagaggaggaggacgacau

SEQ ID NO: 141752 - RNA, 64 nt, Human
caaagaaaccucugaugcaggucugcugccccgacggggccaggacuccacagcgcuuucucag

SEQ ID NO: 141753 - RNA, 64 nt, Human
uacuggguggcaugacugauugaggugaagcucacggggccaggcugaccgucuugaccguucc

SEQ ID NO: 141754 - RNA, 64 nt, Human
ggacguucgugguccugcgcuucugggguugcuccggggccagguucuccuauuuccugaacuc

SEQ ID NO: 141755 - RNA, 64 nt, Human
uaacaaaucauauuaugagugaauauggggagggcggggccaaucagucaaugauaaucugaac

SEQ ID NO: 141756 - RNA, 64 nt, Human
acuucgcaggugucagaaccuagggcugggcucucggggccaggcaggccagcccagcccacgc

SEQ ID NO: 141757 - RNA, 64 nt, Human
ccuugggucggguuuaccaaucagccaggacgcccggggccaccagcucagcuaccacuucccc

SEQ ID NO: 141758 - RNA, 64 nt, Human
uucccuggcuucgcaccugccuggggccucgcagcggggccagggcuccgccugcugaucgggg

SEQ ID NO: 141759 - RNA, 64 nt, Human
aaucacucugaggcuccaacuuccuuccuuccuucggggccagucucggccgaagucuggucac

SEQ ID NO: 141760 - RNA, 64 nt, Human
aacucagccuuccaaagggaagagugcagggggacggggccaugauauggggaaaugguguaaa

SEQ ID NO: 141761 - RNA, 64 nt, Human
ugucauuuaguucagcauccgcaggugcuggucccggggccagcacuuccaugggaaugucucu

SEQ ID NO: 141762 - RNA, 64 nt, Human
ccuucagucccaucccccuacacauacacccagccggggccaaauuuauacuuauauaaaaguu

SEQ ID NO: 141763 - RNA, 64 nt, Human
cuuuccuucucccgcaaaggcggcagaacuacaucggggccaccaaaucaccacucuucagccc

SEQ ID NO: 141764 - RNA, 64 nt, Human
aguguugugcaguaggaccugcuccccugaaggacggggccaaccagccacuggcuuuccugcc

SEQ ID NO: 141765 - RNA, 64 nt, Human
uugggaaucucguugagcguucggcguggauccacggggccaggccacccugcgggagcgccac

SEQ ID NO: 141766 - RNA, 64 nt, Human
ggcucggcccggaccuggcauccggacuuggacucggggccaugggcuuggcccggacccggaa

SEQ ID NO: 141767 - RNA, 64 nt, Human
cugcugggggccuguucuucagcccccgucagggcggggccagccucucuguccaaugcugccu

SEQ ID NO: 141768 - RNA, 64 nt, Human
gaccuugcaucuccagacuguuccagagaaggugcggggccagcugcuaugugguggccgcugu

SEQ ID NO: 141769 - RNA, 64 nt, Human
cacucggcauccccugcagagucaggacugcucccggggccaggcugcccugggagccccccuc

SEQ ID NO: 141770 - RNA, 64 nt, Human
accccaugcccaaucagggugcaaggagcaaggacggggccaaggucgcucauggucacucccu

SEQ ID NO: 141771 - RNA, 64 nt, Human
cugaggaccggccgcccaccaaggguugggcccccggggccagguugaucuaccgacaccuucc

SEQ ID NO: 141772 - RNA, 52 nt, Human
acccucggaagaagcccugagccggggccaucugcggacucgggcccugcgg

SEQ ID NO: 141773 - RNA, 64 nt, Human
gcuguagcccacagccauaucugucaugcuuccccggggccacucaccccugccccaccccguc

SEQ ID NO: 141774 - RNA, 64 nt, Human
gagucggaggcggagagccuggacgcccagaggccggggccaggcucugggucaaggcaggaag

SEQ ID NO: 141775 - RNA, 64 nt, Human
uccucuggguuuuauagugauacagugguguccccggggccaggcgcgcucugcccagcccagc

SEQ ID NO: 141776 - RNA, 64 nt, Human
ucuccgcccugaguuccuacccaggcugccuggccggggccacugccuccucagcaugcaggag

SEQ ID NO: 141777 - RNA, 64 nt, Human
gcgggaaggcgccgggcccgggacuguccguucucggggccagagcugcugggggaccgaguuu

SEQ ID NO: 141778 - RNA, 64 nt, Human
uguaaggcagugggcaguacaggguaacuggaggcggggccagggccucagcgcuauggaagag

SEQ ID NO: 141779 - RNA, 64 nt, Human
acuuggguugaggaugcacgggggccaccuugcccggggccacugguggcuccccagagccuca

SEQ ID NO: 141780 - RNA, 64 nt, Human
cagcgccggacggcgcagcuggccaagaggcgggcggggccagaaauaccucaugccccugcac

SEQ ID NO: 141781 - RNA, 64 nt, Human
ugggguggaggaggagggcucgcgccucuggucucggggccaggaauuccagguggcgugagaa

SEQ ID NO: 141782 - RNA, 64 nt, Human
aaugagaacaugagcugcccucugugcaagguuucggggccaccuccaggcugcaggggcgggu

SEQ ID NO: 141783 - RNA, 64 nt, Human
cccacgcucuguccacacccacgcgccccgggagcggggccaugccuccagccccccagcucgc

SEQ ID NO: 141784 - RNA, 64 nt, Human
ccuugcccagcagugcugccuucagcggccgugacggggccagcuggacacacggugagauuuu

SEQ ID NO: 141785 - RNA, 64 nt, Human
cuggggucgucugcccguggacuuggccgaggagcggggccaccgcgacguugcaggguaccug

SEQ ID NO: 141786 - RNA, 54 nt, Human
ccgccugccacauucaguagcgggcggggccacugcggucgccggggcggggcc

SEQ ID NO: 141787 - RNA, 64 nt, Human
gccucucugagccucugucucugcuucugaacagcggggccaauaaugaugccccgaugccuuc

SEQ ID NO: 141788 - RNA, 64 nt, Human
ccuggaagcacccagcaucacacccaggcuugugcggggccaggcugggagcccaugcaguagg

SEQ ID NO: 141789 - RNA, 64 nt, Human
ucugguggcgggacccccucuugcgguggucuugcggggccagccgggaccugucacuuuauua

SEQ ID NO: 141790 - RNA, 64 nt, Human
guggcccuggccccacugagcacgccugagccuccggggccacgcuucguucucaggaacaaaa

SEQ ID NO: 141791 - RNA, 64 nt, Human
gaacccagggauuucaccuccaccagugagaccacggggccacuguggggugagggaaggagcg

SEQ ID NO: 141792 - RNA, 62 nt, Human
cucuauuugagaacaacugagggccacccggucggggccaucccuccacacucugcauccua

SEQ ID NO: 141793 - RNA, 64 nt, Human
cacagccuagcacagcagcuuauaaugggcucuccggggccauuugcaauaacagcugcaauuc

SEQ ID NO: 141794 - RNA, 64 nt, Human
ggcacgauuauggcucauugcagccucgacuucucggggccaagcgauccuccugccucagccu

SEQ ID NO: 141795 - RNA, 64 nt, Human
gcuggguuccgugaugcuggaccucgacguccugcggggccaccccccggcugagacuuugccc

SEQ ID NO: 141796 - RNA, 64 nt, Human
cuaugcccggggagcugucgggaguggcgggaaucggggccaugcccggggagcugucgggagu

SEQ ID NO: 141797 - RNA, 64 nt, Human
ccaugcccggggagcugucgggaguggcgggaaucggggccaugcccggggagcugucgggagu

SEQ ID NO: 141798 - RNA, 64 nt, Human
uccacuggaggauggacuguuccccccuucaggccggggccaagagugagcugcuaacacggca

SEQ ID NO: 141799 - RNA, 64 nt, Human
ccuggauggcccggccccggggcccguacacaggcggggccagcacaguagugaaggcggucuc

SEQ ID NO: 141800 - RNA, 64 nt, Human
auuugcagggggagugggggacacacacaaauuucggggccauaccacccuucaccacacccuc

SEQ ID NO: 141801 - RNA, 52 nt, Human
augacaucagcgcagccuaggccggggccagccgaggcuccugggguggcuc

SEQ ID NO: 141802 - RNA, 64 nt, Human
guuucucagaccacggagaagugacuuuugggcccggggccaugcccgggcugugcaaagcugg

SEQ ID NO: 141803 - RNA, 59 nt, Human
agguccuggaggugaacugagccagccuucggggccaauucccuggaggaaccagcugc

SEQ ID NO: 141804 - RNA, 64 nt, Human
ugcucuucucccccaguguuggagugcaaggaggcggggccauccaaagcaacgcugaaggccu

SEQ ID NO: 141805 - RNA, 64 nt, Human
ccacuucccuggaacugccgaggacucuguuuggcggggccagucgagcagccuguguggaaag

SEQ ID NO: 141806 - RNA, 54 nt, Human
aagagaacacugggguauaggggccggggccacccaaauguguacaccugcggg

SEQ ID NO: 141807 - RNA, 64 nt, Human
auaggggccggggccacccaaauguguacaccugcggggccacccaucguccaccccagugugc

SEQ ID NO: 141808 - RNA, 64 nt, Human
cacugugacggggaguccaggcgcaggagggacccggggccacaaggcgcugcgggcccaggug

SEQ ID NO: 141809 - RNA, 55 nt, Human
ugaggagccucgcguccugacccaccggggccacuuccggcugccucuuugcuac

SEQ ID NO: 141810 - RNA, 64 nt, Human
acugaguuaugaagcugacaaugacugcauucaacggggccauggcaggaaagcugacccuacc

SEQ ID NO: 141811 - RNA, 64 nt, Human
aguccccuggaggggagguggaaaaucagugcuacggggccagucuuucccguggcugccacca

SEQ ID NO: 141812 - RNA, 64 nt, Human
gagcagaggugaccagaggguucagagugggaggcggggccagcccaggccaggagcgccucau

SEQ ID NO: 141813 - RNA, 64 nt, Human
caggaacuggugucauuccuuaaaagauacgugccggggccaggugugguggcucacgccugua

SEQ ID NO: 141814 - RNA, 64 nt, Human
aacguaaagaacugcggugugauaacagccuucacggggccacgguggaaccaagacagcaggc

SEQ ID NO: 141815 - RNA, 61 nt, Human
ucaguggcaauggcuucugagaucaggcacccggggccagagacauaugggccauaccccu

SEQ ID NO: 141816 - RNA, 64 nt, Human
cacuaccgcccccaaccacagcagagacuagcagcggggccaccuccacaaccaccaccacaag

SEQ ID NO: 141817 - RNA, 64 nt, Human
cuuccaaaaaccugcaaaccagcgcuuccugagacggggccagcggaggcagagccgggaggcu

SEQ ID NO: 141818 - RNA, 64 nt, Human
ugguggggguagauaauccauucagccagacaaacggggccagcucuuaaaauaagaaagcuga

SEQ ID NO: 141819 - RNA, 64 nt, Human
ccgggcccuggucaccuccagacagcugccuggccggggccacuaggcugcggcuggccacugu

SEQ ID NO: 141820 - RNA, 64 nt, Human
ggagucaguaguuuccuaagagggaguggaggcucggggccacucugggugcagcauggcaaac

SEQ ID NO: 141821 - RNA, 64 nt, Human
augccuucaagaucuaccggacugagauggcacccggggccagccagggugagugccugugcuc

SEQ ID NO: 141822 - RNA, 64 nt, Human
cccuggguacuuacagccuucucuugggaacagccggggccaggacugggucaccuaugagcug

SEQ ID NO: 141823 - RNA, 64 nt, Human
gcuccaggcucaucuaagcucccacaauuucuuacggggccagucaugugaagcguuuacagcu

SEQ ID NO: 141824 - RNA, 64 nt, Human
ucacucucuauagaauauaguaaccuuuaugaaacggggccauauaguuugguuaugacaucaa

SEQ ID NO: 141825 - RNA, 64 nt, Human
acacaguagcuguuagcccacaggcagagggcaucggggccauuuggccggcucugguggccac

SEQ ID NO: 141826 - RNA, 64 nt, Human
cuggccccucugacccuggcccagggaccccucacggggccaggggaggcauagcagaaagacu

SEQ ID NO: 141827 - RNA, 64 nt, Human
ccgcagagcuccaggguggccaaguggaucucaccggggccaccugccccuacacccuguccaa

SEQ ID NO: 141828 - RNA, 64 nt, Human
cagccgcccuggcuccuggcugcacagggugccacggggccaaguggcauauccagagcccugg

SEQ ID NO: 141829 - RNA, 64 nt, Human
ccgcggacagaguagguggccgcuuugcgccauccggggccaagaggggguggacccgcguguc

SEQ ID NO: 141830 - RNA, 64 nt, Human
gcuucgagagggugggugcugggccacaggggugcggggccagcucaggcacuggcgugggagc

SEQ ID NO: 141831 - RNA, 64 nt, Human
aaaaagcgaaaggcagcagccuggugugcugauccggggccacacggaggaggagccgccccag

SEQ ID NO: 141832 - RNA, 64 nt, Human
cugguuucgugugcugcccaugcaccuuccagcccggggccagcuuggcagggauccccaggag

SEQ ID NO: 141833 - RNA, 56 nt, Human
gguugggcggccagaagugagacccccggggccaggagccccuugagcagagcucu

SEQ ID NO: 141834 - RNA, 64 nt, Human
cugguuuggugggguaguggggaggucagggaggcggggccaagggugucccacauucccaaca

SEQ ID NO: 141835 - RNA, 64 nt, Human
aaaccaaagugaagagagagauaggaagcugccucggggccaccccuugcaaaggggguguguc

SEQ ID NO: 141836 - RNA, 64 nt, Human
gauccuccuuuccucaugcagcacaagugcucaccggggccagagccagggcauggauaugaca

SEQ ID NO: 141837 - RNA, 64 nt, Human
caguggccuggcuccgcuguguggauggggagaucggggccagaggcagaacccuggugaggaa

SEQ ID NO: 141838 - RNA, 64 nt, Human
cucauccccucucccaggcugggcuggcccugggcggggccacugugugcuggcccacugugac

SEQ ID NO: 141839 - RNA, 64 nt, Human
gcccuggggcuuggcacccaccucuggagaaacucggggccaccuccacuccaugugcccagcc

SEQ ID NO: 141840 - RNA, 64 nt, Human
gcauugugaccgaccccacuuccucagaauguaacggggccagagggaaacuucucacaaacuu

SEQ ID NO: 141841 - RNA, 64 nt, Human
gcagccaacuggugcuuuggccuuugcgcugucccggggccagcuucccucgaccuggggaggc

SEQ ID NO: 141842 - RNA, 64 nt, Human
ggacuagacugugcugugugcuggaaaaugaucccggggccaggacagacaaaccagagccucu

SEQ ID NO: 141843 - RNA, 64 nt, Human
gucucucccugugcccacaugaagcugcuuuuuccggggccaccgggcgggaguggggaagggu

SEQ ID NO: 141844 - RNA, 64 nt, Human
cugccuacaucaaggcuaaggccaucccaauccccggggccaagucuugaugaaucuucuuaau

SEQ ID NO: 141845 - RNA, 64 nt, Human
gcgccccugcccgagagagcucuggccccgcuagcggggccaggagccgggccucccaccgcag

SEQ ID NO: 141846 - RNA, 51 nt, Human
cugccaaagccaagaacugaccggggccagggcugccauggucuccuugcc

SEQ ID NO: 141847 - RNA, 64 nt, Human
cguagggacgcgcgucugcccaggcgggucuuugcggggccacuaggcacauggcgaauuuggc

SEQ ID NO: 141848 - RNA, 64 nt, Human
acuguggcagcgggaguucccggcccuccacacccggggccagacccucggggccaugccuugg

SEQ ID NO: 141849 - RNA, 64 nt, Human
aguucccggcccuccacacccggggccagacccucggggccaugccuugguggggccugugucg

SEQ ID NO: 141850 - RNA, 64 nt, Human
cagaccaacagacuucagacccucagaccugccccggggccagguggagaaagugagggccgua

SEQ ID NO: 141851 - RNA, 64 nt, Human
gcagaugcccuuggccggaacuaauaagaggcgucggggccagcuuccgguccccugcagugau

SEQ ID NO: 141852 - RNA, 64 nt, Human
ugaacuuccuuggaggagagcuugggagacgucccggggccaggcuacggacuugcggacgagc

SEQ ID NO: 141853 - RNA, 64 nt, Human
gcaugcuagccagcaggcuccugucugggugccacggggccagcauuuuggagggagcuuccuu

SEQ ID NO: 141854 - RNA, 64 nt, Human
ccagaccaaggcauguaggccugggcagguggcucggggccacuggcggagccagccuguggau

SEQ ID NO: 141855 - RNA, 64 nt, Human
aggacagaccuugcuuugagaaggagcugccggccggggccacgcuccacagccgccgcgcgac

SEQ ID NO: 141856 - RNA, 64 nt, Human
cagagcaggugaccggagggaaucggugacggagcggggccaagggagggguccggagggaguc

SEQ ID NO: 141857 - RNA, 64 nt, Human
ggcccucgcacauuuucccccuuccuguacaccucggggccagcauccucaccuucuucaacug

SEQ ID NO: 141858 - RNA, 64 nt, Human
gcugaagcccugcaguaacccgcccagccucccgcggggccacacacuuccccucccaacacac

SEQ ID NO: 141859 - RNA, 64 nt, Human
gccucagacuuuuucccacugaggguccagagagcggggccacgugucacccacgucugcgcuu

SEQ ID NO: 141860 - RNA, 64 nt, Human
auugucucuagagcuuccaaguccugggaaugugcggggccagucccugcccucccaggagggg

SEQ ID NO: 141861 - RNA, 64 nt, Human
ugagcgagggcugugcuggugcagggcuggugggcggggccagggaaacggccggggcaggggc

SEQ ID NO: 141862 - RNA, 61 nt, Human
cggagauggagcacgucuagggcaggugcugcggggccacgggggcucccuggagucgggu

SEQ ID NO: 141863 - RNA, 64 nt, Human
cccaggccacgcgccagccaggcugugggcagggcggggccagggacgccaaagagagguugca

SEQ ID NO: 141864 - RNA, 64 nt, Human
aaauucagaauccaggcgucgaccugguggggcccggggccaagccugcauucuggcugcccag

SEQ ID NO: 141865 - RNA, 64 nt, Human
gggucucagagggccggcccggcggggggcgccgcggggccaggacugcgcucaggaucccgcc

SEQ ID NO: 141866 - RNA, 64 nt, Human
gcccagggagcagggcuuaggggcuagcagcccacggggccacacagagaaacaaccacgcaga

SEQ ID NO: 141867 - RNA, 56 nt, Human
ccuacggcucgggccagugaccaugacggggccacgugugcuguggccaggccugc

SEQ ID NO: 141868 - RNA, 64 nt, Human
aaggaguaaccucccucaucucuaacugcccccacggggccagggcuaccccagaacuuuuaac

SEQ ID NO: 141869 - RNA, 64 nt, Human
ucuuccaaguucuccuuaccuaaguuuggacucucggggccaaagguggcuaaggcagaggcug

SEQ ID NO: 141870 - RNA, 64 nt, Human
ugagcgagggcugugccggugcaggucuggugggcggggccagggaaagggcagggccaagacc

SEQ ID NO: 141871 - RNA, 64 nt, Human
ugagcgagggcugugccggugcaggucuggugggcggggccagggaaaggcggggucagggcgg

SEQ ID NO: 141872 - RNA, 64 nt, Human
gagacccggccgcaccccgagucacacaggcccccggggccacggcguucgucucuccugugcu

SEQ ID NO: 141873 - RNA, 64 nt, Human
uccuucaacgaagccggaaggcgagaagccgcggcggggccagcuugccugccgguuuucagga

SEQ ID NO: 141874 - RNA, 64 nt, Human
gaggacuugccuguuccgacuccaccugugcagccggggccaccccaggagaaaguguccaggu

SEQ ID NO: 141875 - RNA, 64 nt, Human
uucucaagacuccuggagcaugaggggaauggggcggggccacugcucugugcugacgggcucc

SEQ ID NO: 141876 - RNA, 64 nt, Human
cacggacggugccccuugcgcgccaucggugcgccggggccaggcagaaccugggcccguccgg

SEQ ID NO: 141877 - RNA, 64 nt, Human
aggagagcaugagggguggggcuuugggacccaccggggccaguggcuggagcuugacgucuuu

SEQ ID NO: 141878 - RNA, 64 nt, Human
gacgcagggagacccugggagagugaggucaucccggggccauggaagcuggcaggagacacug

SEQ ID NO: 141879 - RNA, 64 nt, Human
cccaccccuccaugauuccaagggcccagaggggcggggccaggauggcguguccccugccugu

SEQ ID NO: 141880 - RNA, 64 nt, Human
accgggagccugcguggccuggggcugccgugcacggggccagcauccaugcggccggccuggg

SEQ ID NO: 141881 - RNA, 64 nt, Human
uccacccguguguguguccggugggucuccacugcggggccagggccacgcucaccccucucgc

SEQ ID NO: 141882 - RNA, 64 nt, Human
cgucaucccagccccuggccuuccugcugcccuccggggccauggcacugcuguucagcucagg

SEQ ID NO: 141883 - RNA, 64 nt, Human
aaugagcagcucccaagaaucacugcucgacucccggggccauuugaaaggaaacaauccuuac

SEQ ID NO: 141884 - RNA, 64 nt, Human
ccacuccaugagaagaggcucagacagcaggcuccggggccacgcagcccagaccacaccugcc

SEQ ID NO: 141885 - RNA, 64 nt, Human
gacaccagaccggacuguucccgacccggagacgcggggccacagcccccagcugacccuaauu

SEQ ID NO: 141886 - RNA, 64 nt, Human
uagccaagacugcagggauggcccgcagccucaucggggccaaggacacacgccuccugucaga

SEQ ID NO: 141887 - RNA, 64 nt, Human
cucuuuuccuuuaaucuguaagauucaugaaauucggggccagggaaacaguuuagccuuaggg

SEQ ID NO: 141888 - RNA, 64 nt, Human
agagauguggagcagaagcugggcccugaacacacggggccaugucuggacgagcaggggagag

SEQ ID NO: 141889 - RNA, 64 nt, Human
gagagagagcggaaggagcagcugaugcccagagcggggccagagcggcgggucuauguucacg

SEQ ID NO: 141890 - RNA, 64 nt, Human
gcaggugcguguggggggagaugccacacugugucggggccauggugcacuguagguggcugca

SEQ ID NO: 141891 - RNA, 64 nt, Human
aggagcaagagggagucugagcaccagccgcagccggggccaaaguuuguggggucagggcccc

SEQ ID NO: 141892 - RNA, 64 nt, Human; identical to SEQ ID NO: 141728

SEQ ID NO: 141893 - RNA, 64 nt, Human; identical to SEQ ID NO: 141729

SEQ ID NO: 141894 - RNA, 64 nt, Human; identical to SEQ ID NO: 141730

SEQ ID NO: 141895 - RNA, 64 nt, Human; identical to SEQ ID NO: 141731

SEQ ID NO: 141896 - RNA, 55 nt, Human; identical to SEQ ID NO: 141732

SEQ ID NO: 141897 - RNA, 64 nt, Human; identical to SEQ ID NO: 141733

SEQ ID NO: 141898 - RNA, 64 nt, Human; identical to SEQ ID NO: 141734

SEQ ID NO: 141899 - RNA, 64 nt, Human; identical to SEQ ID NO: 141735

SEQ ID NO: 141900 - RNA, 64 nt, Human; identical to SEQ ID NO: 141736

SEQ ID NO: 141901 - RNA, 64 nt, Human; identical to SEQ ID NO: 141737

SEQ ID NO: 141902 - RNA, 64 nt, Human; identical to SEQ ID NO: 141738

SEQ ID NO: 141903 - RNA, 64 nt, Human; identical to SEQ ID NO: 141739

SEQ ID NO: 141904 - RNA, 64 nt, Human; identical to SEQ ID NO: 141740

SEQ ID NO: 141905 - RNA, 60 nt, Human; identical to SEQ ID NO: 141741

SEQ ID NO: 141906 - RNA, 64 nt, Human; identical to SEQ ID NO: 141742

SEQ ID NO: 141907 - RNA, 64 nt, Human; identical to SEQ ID NO: 141743

SEQ ID NO: 141908 - RNA, 64 nt, Human; identical to SEQ ID NO: 141744

SEQ ID NO: 141909 - RNA, 64 nt, Human; identical to SEQ ID NO: 141745

SEQ ID NO: 141910 - RNA, 64 nt, Human; identical to SEQ ID NO: 141746

SEQ ID NO: 141911 - RNA, 64 nt, Human; identical to SEQ ID NO: 141747

SEQ ID NO: 141912 - RNA, 64 nt, Human; identical to SEQ ID NO: 141748

SEQ ID NO: 141913 - RNA, 64 nt, Human; identical to SEQ ID NO: 141749

SEQ ID NO: 141914 - RNA, 64 nt, Human; identical to SEQ ID NO: 141750

SEQ ID NO: 141915 - RNA, 64 nt, Human; identical to SEQ ID NO: 141751

SEQ ID NO: 141916 - RNA, 64 nt, Human; identical to SEQ ID NO: 141752

SEQ ID NO: 141917 - RNA, 64 nt, Human; identical to SEQ ID NO: 141753

SEQ ID NO: 141918 - RNA, 64 nt, Human; identical to SEQ ID NO: 141754

SEQ ID NO: 141919 - RNA, 64 nt, Human; identical to SEQ ID NO: 141755

SEQ ID NO: 141920 - RNA, 64 nt, Human; identical to SEQ ID NO: 141756

SEQ ID NO: 141921 - RNA, 64 nt, Human; identical to SEQ ID NO: 141757

SEQ ID NO: 141922 - RNA, 64 nt, Human; identical to SEQ ID NO: 141758

SEQ ID NO: 141923 - RNA, 64 nt, Human; identical to SEQ ID NO: 141759

SEQ ID NO: 141924 - RNA, 64 nt, Human; identical to SEQ ID NO: 141760

SEQ ID NO: 141925 - RNA, 64 nt, Human; identical to SEQ ID NO: 141761

SEQ ID NO: 141926 - RNA, 64 nt, Human; identical to SEQ ID NO: 141762

SEQ ID NO: 141927 - RNA, 64 nt, Human; identical to SEQ ID NO: 141763

SEQ ID NO: 141928 - RNA, 64 nt, Human; identical to SEQ ID NO: 141764

SEQ ID NO: 141929 - RNA, 64 nt, Human; identical to SEQ ID NO: 141765

SEQ ID NO: 141930 - RNA, 64 nt, Human; identical to SEQ ID NO: 141766

SEQ ID NO: 141931 - RNA, 64 nt, Human; identical to SEQ ID NO: 141767

SEQ ID NO: 141932 - RNA, 64 nt, Human; identical to SEQ ID NO: 141768

SEQ ID NO: 141933 - RNA, 64 nt, Human; identical to SEQ ID NO: 141769

SEQ ID NO: 141934 - RNA, 64 nt, Human; identical to SEQ ID NO: 141770

SEQ ID NO: 141935 - RNA, 64 nt, Human; identical to SEQ ID NO: 141771

SEQ ID NO: 141936 - RNA, 52 nt, Human; identical to SEQ ID NO: 141772

SEQ ID NO: 141937 - RNA, 64 nt, Human; identical to SEQ ID NO: 141773

SEQ ID NO: 141938 - RNA, 64 nt, Human; identical to SEQ ID NO: 141774

SEQ ID NO: 141939 - RNA, 64 nt, Human; identical to SEQ ID NO: 141775

SEQ ID NO: 141940 - RNA, 64 nt, Human; identical to SEQ ID NO: 141776

SEQ ID NO: 141941 - RNA, 64 nt, Human; identical to SEQ ID NO: 141777

SEQ ID NO: 141942 - RNA, 64 nt, Human; identical to SEQ ID NO: 141778

SEQ ID NO: 141943 - RNA, 64 nt, Human; identical to SEQ ID NO: 141779

SEQ ID NO: 141944 - RNA, 64 nt, Human; identical to SEQ ID NO: 141780

SEQ ID NO: 141945 - RNA, 64 nt, Human; identical to SEQ ID NO: 141781

SEQ ID NO: 141946 - RNA, 64 nt, Human; identical to SEQ ID NO: 141782

SEQ ID NO: 141947 - RNA, 64 nt, Human; identical to SEQ ID NO: 141783

SEQ ID NO: 141948 - RNA, 64 nt, Human; identical to SEQ ID NO: 141784

SEQ ID NO: 141949 - RNA, 64 nt, Human; identical to SEQ ID NO: 141785

SEQ ID NO: 141950 - RNA, 54 nt, Human; identical to SEQ ID NO: 141786

SEQ ID NO: 141951 - RNA, 64 nt, Human; identical to SEQ ID NO: 141787

SEQ ID NO: 141952 - RNA, 64 nt, Human; identical to SEQ ID NO: 141788

SEQ ID NO: 141953 - RNA, 64 nt, Human; identical to SEQ ID NO: 141789

SEQ ID NO: 141954 - RNA, 64 nt, Human; identical to SEQ ID NO: 141790

SEQ ID NO: 141955 - RNA, 64 nt, Human; identical to SEQ ID NO: 141791

SEQ ID NO: 141956 - RNA, 62 nt, Human; identical to SEQ ID NO: 141792

SEQ ID NO: 141957 - RNA, 64 nt, Human; identical to SEQ ID NO: 141793

SEQ ID NO: 141958 - RNA, 64 nt, Human; identical to SEQ ID NO: 141794

SEQ ID NO: 141959 - RNA, 64 nt, Human; identical to SEQ ID NO: 141795

SEQ ID NO: 141960 - RNA, 64 nt, Human; identical to SEQ ID NO: 141796

SEQ ID NO: 141961 - RNA, 64 nt, Human; identical to SEQ ID NO: 141797

SEQ ID NO: 141962 - RNA, 64 nt, Human; identical to SEQ ID NO: 141798

SEQ ID NO: 141963 - RNA, 64 nt, Human; identical to SEQ ID NO: 141799

SEQ ID NO: 141964 - RNA, 64 nt, Human; identical to SEQ ID NO: 141800

SEQ ID NO: 141965 - RNA, 52 nt, Human; identical to SEQ ID NO: 141801

SEQ ID NO: 141966 - RNA, 64 nt, Human; identical to SEQ ID NO: 141802

SEQ ID NO: 141967 - RNA, 59 nt, Human; identical to SEQ ID NO: 141803

SEQ ID NO: 141968 - RNA, 64 nt, Human; identical to SEQ ID NO: 141804

SEQ ID NO: 141969 - RNA, 64 nt, Human; identical to SEQ ID NO: 141805

SEQ ID NO: 141970 - RNA, 54 nt, Human; identical to SEQ ID NO: 141806

SEQ ID NO: 141971 - RNA, 64 nt, Human; identical to SEQ ID NO: 141807

SEQ ID NO: 141972 - RNA, 64 nt, Human; identical to SEQ ID NO: 141808

SEQ ID NO: 141973 - RNA, 55 nt, Human; identical to SEQ ID NO: 141809

SEQ ID NO: 141974 - RNA, 64 nt, Human; identical to SEQ ID NO: 141810

SEQ ID NO: 141975 - RNA, 64 nt, Human; identical to SEQ ID NO: 141811

SEQ ID NO: 141976 - RNA, 64 nt, Human; identical to SEQ ID NO: 141812

SEQ ID NO: 141977 - RNA, 64 nt, Human; identical to SEQ ID NO: 141813

SEQ ID NO: 141978 - RNA, 64 nt, Human; identical to SEQ ID NO: 141814

SEQ ID NO: 141979 - RNA, 61 nt, Human; identical to SEQ ID NO: 141815

SEQ ID NO: 141980 - RNA, 64 nt, Human; identical to SEQ ID NO: 141816

SEQ ID NO: 141981 - RNA, 64 nt, Human; identical to SEQ ID NO: 141817

SEQ ID NO: 141982 - RNA, 64 nt, Human; identical to SEQ ID NO: 141818

SEQ ID NO: 141983 - RNA, 64 nt, Human; identical to SEQ ID NO: 141819

SEQ ID NO: 141984 - RNA, 64 nt, Human; identical to SEQ ID NO: 141820

SEQ ID NO: 141985 - RNA, 64 nt, Human; identical to SEQ ID NO: 141821

SEQ ID NO: 141986 - RNA, 64 nt, Human; identical to SEQ ID NO: 141822

SEQ ID NO: 141987 - RNA, 64 nt, Human; identical to SEQ ID NO: 141823

SEQ ID NO: 141988 - RNA, 64 nt, Human; identical to SEQ ID NO: 141824

SEQ ID NO: 141989 - RNA, 64 nt, Human; identical to SEQ ID NO: 141825

SEQ ID NO: 141990 - RNA, 64 nt, Human; identical to SEQ ID NO: 141826

SEQ ID NO: 141991 - RNA, 64 nt, Human; identical to SEQ ID NO: 141827

SEQ ID NO: 141992 - RNA, 64 nt, Human; identical to SEQ ID NO: 141828

SEQ ID NO: 141993 - RNA, 64 nt, Human; identical to SEQ ID NO: 141829

SEQ ID NO: 141994 - RNA, 64 nt, Human; identical to SEQ ID NO: 141830

SEQ ID NO: 141995 - RNA, 64 nt, Human; identical to SEQ ID NO: 141831

SEQ ID NO: 141996 - RNA, 64 nt, Human; identical to SEQ ID NO: 141832

SEQ ID NO: 141997 - RNA, 56 nt, Human; identical to SEQ ID NO: 141833

SEQ ID NO: 141998 - RNA, 64 nt, Human; identical to SEQ ID NO: 141834

SEQ ID NO: 141999 - RNA, 64 nt, Human; identical to SEQ ID NO: 141835

SEQ ID NO: 142000 - RNA, 64 nt, Human; identical to SEQ ID NO: 141836

SEQ ID NO: 142001 - RNA, 64 nt, Human; identical to SEQ ID NO: 141837

SEQ ID NO: 142002 - RNA, 64 nt, Human; identical to SEQ ID NO: 141838

SEQ ID NO: 142003 - RNA, 64 nt, Human; identical to SEQ ID NO: 141839

SEQ ID NO: 142004 - RNA, 64 nt, Human; identical to SEQ ID NO: 141840

SEQ ID NO: 142005 - RNA, 64 nt, Human; identical to SEQ ID NO: 141841

SEQ ID NO: 142006 - RNA, 64 nt, Human; identical to SEQ ID NO: 141842

SEQ ID NO: 142007 - RNA, 64 nt, Human; identical to SEQ ID NO: 141843

SEQ ID NO: 142008 - RNA, 64 nt, Human; identical to SEQ ID NO: 141844

SEQ ID NO: 142009 - RNA, 64 nt, Human; identical to SEQ ID NO: 141845

SEQ ID NO: 142010 - RNA, 51 nt, Human; identical to SEQ ID NO: 141846

SEQ ID NO: 142011 - RNA, 64 nt, Human; identical to SEQ ID NO: 141847

SEQ ID NO: 142012 - RNA, 64 nt, Human; identical to SEQ ID NO: 141848

SEQ ID NO: 142013 - RNA, 64 nt, Human; identical to SEQ ID NO: 141849

SEQ ID NO: 142014 - RNA, 64 nt, Human; identical to SEQ ID NO: 141850

SEQ ID NO: 142015 - RNA, 64 nt, Human; identical to SEQ ID NO: 141851

SEQ ID NO: 142016 - RNA, 64 nt, Human; identical to SEQ ID NO: 141852

SEQ ID NO: 142017 - RNA, 64 nt, Human; identical to SEQ ID NO: 141853

SEQ ID NO: 142018 - RNA, 64 nt, Human; identical to SEQ ID NO: 141854

SEQ ID NO: 142019 - RNA, 64 nt, Human; identical to SEQ ID NO: 141855

SEQ ID NO: 142020 - RNA, 64 nt, Human; identical to SEQ ID NO: 141856

SEQ ID NO: 142021 - RNA, 64 nt, Human; identical to SEQ ID NO: 141857

SEQ ID NO: 142022 - RNA, 64 nt, Human; identical to SEQ ID NO: 141858

SEQ ID NO: 142023 - RNA, 64 nt, Human; identical to SEQ ID NO: 141859

SEQ ID NO: 142024 - RNA, 64 nt, Human; identical to SEQ ID NO: 141860

SEQ ID NO: 142025 - RNA, 64 nt, Human; identical to SEQ ID NO: 141861

SEQ ID NO: 142026 - RNA, 61 nt, Human; identical to SEQ ID NO: 141862

SEQ ID NO: 142027 - RNA, 64 nt, Human; identical to SEQ ID NO: 141863

SEQ ID NO: 142028 - RNA, 64 nt, Human; identical to SEQ ID NO: 141864

SEQ ID NO: 142029 - RNA, 64 nt, Human; identical to SEQ ID NO: 141865

SEQ ID NO: 142030 - RNA, 64 nt, Human; identical to SEQ ID NO: 141866

SEQ ID NO: 142031 - RNA, 56 nt, Human; identical to SEQ ID NO: 141867

SEQ ID NO: 142032 - RNA, 64 nt, Human; identical to SEQ ID NO: 141868

SEQ ID NO: 142033 - RNA, 64 nt, Human; identical to SEQ ID NO: 141869

SEQ ID NO: 142034 - RNA, 64 nt, Human; identical to SEQ ID NO: 141870

SEQ ID NO: 142035 - RNA, 64 nt, Human; identical to SEQ ID NO: 141871

SEQ ID NO: 142036 - RNA, 64 nt, Human; identical to SEQ ID NO: 141872

SEQ ID NO: 142037 - RNA, 64 nt, Human; identical to SEQ ID NO: 141873

SEQ ID NO: 142038 - RNA, 64 nt, Human; identical to SEQ ID NO: 141874

SEQ ID NO: 142039 - RNA, 64 nt, Human; identical to SEQ ID NO: 141875

SEQ ID NO: 142040 - RNA, 64 nt, Human; identical to SEQ ID NO: 141876

SEQ ID NO: 142041 - RNA, 64 nt, Human; identical to SEQ ID NO: 141877

SEQ ID NO: 142042 - RNA, 64 nt, Human; identical to SEQ ID NO: 141878

SEQ ID NO: 142043 - RNA, 64 nt, Human; identical to SEQ ID NO: 141879

SEQ ID NO: 142044 - RNA, 64 nt, Human; identical to SEQ ID NO: 141880

SEQ ID NO: 142045 - RNA, 64 nt, Human; identical to SEQ ID NO: 141881

SEQ ID NO: 142046 - RNA, 64 nt, Human; identical to SEQ ID NO: 141882

SEQ ID NO: 142047 - RNA, 64 nt, Human; identical to SEQ ID NO: 141883

SEQ ID NO: 142048 - RNA, 64 nt, Human; identical to SEQ ID NO: 141884

SEQ ID NO: 142049 - RNA, 64 nt, Human; identical to SEQ ID NO: 141885

SEQ ID NO: 142050 - RNA, 64 nt, Human; identical to SEQ ID NO: 141886

SEQ ID NO: 142051 - RNA, 64 nt, Human; identical to SEQ ID NO: 141887

SEQ ID NO: 142052 - RNA, 64 nt, Human; identical to SEQ ID NO: 141888

SEQ ID NO: 142053 - RNA, 64 nt, Human; identical to SEQ ID NO: 141889

SEQ ID NO: 142054 - RNA, 64 nt, Human; identical to SEQ ID NO: 141890

SEQ ID NO: 142055 - RNA, 64 nt, Human; identical to SEQ ID NO: 141891

SEQ ID NO: 142056 - RNA, 64 nt, Human
uguggugaaagccaagcacacuuuccuaaaaccagcgucggaagcugugcuguagccuguaauu

SEQ ID NO: 142057 - RNA, 64 nt, Human
cuuuuccccuuccccuugcuucagaggccugauggcgucggacuauuccgaagaaguggccacc

SEQ ID NO: 142058 - RNA, 64 nt, Human
agcucuagcuccgggccugaguuuccccgaggcugcgucggaggagcugcagggcgagcccgga

SEQ ID NO: 142059 - RNA, 64 nt, Human
cuuccggaggacgaauagaguuuaauuacucauugcgucggaaagccaagccauuucugucucc

SEQ ID NO: 142060 - RNA, 64 nt, Human
accauuugaagcucacaauugugaagcauucacggcgucggaagaggccuuuugagcaagcgcc

SEQ ID NO: 142061 - RNA, 57 nt, Human
aggaguacgugacgguguagccggagggcgucggaaggggaagcgccauucccgcgg

SEQ ID NO: 142062 - RNA, 64 nt, Human
uuguaccuuccuuaagccaggaaagggauucauggcgucggaaaugaucuggcugaauccgugg

SEQ ID NO: 142063 - RNA, 64 nt, Human
cuccucucaggugcuggaggagcugaaggcuucgccacaggaccuggaguuaucaggggucagg

SEQ ID NO: 142064 - RNA, 64 nt, Human
ggggccaccacccucuccuugcuuucagcccuucccacaggaaacaucaagaagccccagccag

SEQ ID NO: 142065 - RNA, 64 nt, Human
aggauggcuccaguacguacagcaagauuccugcccacaggaagggccacaggcccgcuaagcc

SEQ ID NO: 142066 - RNA, 64 nt, Human
gcuucaggaggcagaaacgagaggggugggagauccacaggaccaaagggugcagugaugggcu

SEQ ID NO: 142067 - RNA, 64 nt, Human
guuugagggcauauguuugaaagagggagcaucaccacaggaauccuuucugugagguggaaac

SEQ ID NO: 142068 - RNA, 64 nt, Human
aucccgaaggagcaagcagucggcagcacccaggccacaggagacuccgcuuuuacuucccugg

SEQ ID NO: 142069 - RNA, 64 nt, Human
uauaaaugaaauuaccauuuugagaaccauggaaccacaggaaaggaaauggugaaaagucauu

SEQ ID NO: 142070 - RNA, 64 nt, Human
agugggcuuuuuuguuuuaaaagugguuggggauccacaggaacgacauucauacagggacauu

SEQ ID NO: 142071 - RNA, 64 nt, Human
guuaaaaggaagcccgaaguuguguuugugcugcccacaggacagugggaguuacaguucauau

SEQ ID NO: 142072 - RNA, 64 nt, Human
uucaaacauugcacaagcaacuaacuuuauuccuccacaggaacccagcauuccugaucugggu

SEQ ID NO: 142073 - RNA, 64 nt, Human
aauaauugguaaaauucuccuagcucagugacugccacaggaugggucuuucagauuuugguuc

SEQ ID NO: 142074 - RNA, 64 nt, Human
aaaaaagggccaauaaccagacugcugagguugcccacaggaggaucacaaacucacagcacag

SEQ ID NO: 142075 - RNA, 64 nt, Human
uuccacccucucacuuuccugccuguuccccacuccacaggagggagcugacguuggcuugaaa

SEQ ID NO: 142076 - RNA, 64 nt, Human
cugaccacagauucccagagggccagguguggauccacaggacuugaaggucaaaguucacaaa

SEQ ID NO: 142077 - RNA, 64 nt, Human
aguuuccacguaaacuuucggggacacauucaaaccacaggagaaacucaaauuguuccugggc

SEQ ID NO: 142078 - RNA, 64 nt, Human
ggggcugggaagggcuacugaaggccccauucucccacaggauggugaggcugggaggaggaag

SEQ ID NO: 142079 - RNA, 64 nt, Human
cugagacugggcaccaggccaccucuguugggacccacaggaaagaguguggcagcaacugccu

SEQ ID NO: 142080 - RNA, 64 nt, Human
aaucguuucuuaauaaagaagcagaauuuagaaaccacaggauaguguacccacagaugggugu

SEQ ID NO: 142081 - RNA, 64 nt, Human
caccaugccauguuuuccuuccuggagggcagccccacaggacgguuuaugagcacacaauuau

SEQ ID NO: 142082 - RNA, 64 nt, Human
aauuucuuuuccaugucauucuugggaaugucuuccacaggauuugagaauaguuucaucucag

SEQ ID NO: 142083 - RNA, 64 nt, Human
uagucggcugccuggccggggaaccugcaggcucccacaggaagagguguggagaccugcccuc

SEQ ID NO: 142084 - RNA, 64 nt, Human
ggucuggaggugucuguggagcacccugcccucaccacaggagcgugagccacuucugcagucc

SEQ ID NO: 142085 - RNA, 64 nt, Human
uguuuccccuggagaccugacuggucugugguucccacaggaacaggguugucuuuugagcccc

SEQ ID NO: 142086 - RNA, 64 nt, Human
ucaggucaggcuucaugccugcauccuccagagaccacaggagccaaagcgagccuccaggccc

SEQ ID NO: 142087 - RNA, 64 nt, Human
ggccaucucucuuccagagagaggcagcauuggcccacaggauaagccucaggcccugggaaac

SEQ ID NO: 142088 - RNA, 64 nt, Human
cccaccuguccuugggccacaccaucacacugaaccacaggacagacccuuucuccaccacagc

SEQ ID NO: 142089 - RNA, 64 nt, Human
ucuacaccuuugggaugauaggguuguuagugacccacaggacaguauagauguuuguggaugu

SEQ ID NO: 142090 - RNA, 64 nt, Human
auaggggaagaagccagaaccccaccuggccugcccacaggacaagaaguggguaagggcagga

SEQ ID NO: 142091 - RNA, 64 nt, Human
aguuuguuuuaacaaauccuggguuaaacugaggccacaggacaugaugggcuguucuauaaag

SEQ ID NO: 142092 - RNA, 64 nt, Human
uucucccugugagagcucaacaucucaaauacaaccacaggaaaaauggcccaaucugccaguu

SEQ ID NO: 142093 - RNA, 64 nt, Human
ugugcaaaucugacaauauacaagcuuuuaguauccacaggauauuaaacguguaaauugcaca

SEQ ID NO: 142094 - RNA, 64 nt, Human
cacaccugugauguuguguguguugggggagcuuccacaggagccacacuggggaaaagcugua

SEQ ID NO: 142095 - RNA, 64 nt, Human
cucuuaaagguagguuggcaacguucuuuuucuaccacaggauacuccuuuucauuuuguacag

SEQ ID NO: 142096 - RNA, 64 nt, Human
ccccacuccauuccccuuuuuaauguaacuuuuuccacaggagguauuucuuuuuuauguuggu

SEQ ID NO: 142097 - RNA, 64 nt, Human
ggccucagaccacuagccccuuacccagaguggcccacaggaaacagccugcaccauuuuuuuu

SEQ ID NO: 142098 - RNA, 64 nt, Human
auagguagccccugagaaauuuaucacuauaacuccacaggaaauaugacuuggaagugcucug

SEQ ID NO: 142099 - RNA, 64 nt, Human
aucuguagugauggaguuccuucuggugucagccccacaggaggcucccaggccucccucacuu

SEQ ID NO: 142100 - RNA, 64 nt, Human
ccucucucucucuuucucccaagccuuucucccuccacaggaaacagauuuuucagggccuucc

SEQ ID NO: 142101 - RNA, 64 nt, Human
ugcauuuccaucauccuaguaaaaagacaacaacccacaggauuggaaugguuuucuuuuguuu

SEQ ID NO: 142102 - RNA, 64 nt, Human
cacaugggaggccuguggcccuguguccaguggcccacaggacacgccuccaccauaugcucau

SEQ ID NO: 142103 - RNA, 64 nt, Human
uaaaauugcuugcuucuauguaauuccugucauuccacaggaaauucacuuuuccagcuacuga

SEQ ID NO: 142104 - RNA, 64 nt, Human
auccggcccagggugcugcaguggcacagaccagccacaggauggcaguagaauaaagacaguc

SEQ ID NO: 142105 - RNA, 64 nt, Human
acaaucagcuuuaaccaauggaugagggggguggccacaggagauggggagaggagucugaacu

SEQ ID NO: 142106 - RNA, 64 nt, Human
uuuaaagggauuugagguaggcuggauuccaucgccacaggacuuuaguuagaauuaaauuccu

SEQ ID NO: 142107 - RNA, 64 nt, Human
caggauuccaaaguuuugaagucaucuuagcuuuccacaggagggagagaacuuaaaaaagcaa

SEQ ID NO: 142108 - RNA, 64 nt, Human
ccccaaagcacaagagggaagagcaccgccggggccacaggacgucuguccuccagucacaggc

SEQ ID NO: 142109 - RNA, 64 nt, Human
uaaaauccugucauauuuuuuucacccugccuuuccacaggaagcacucacaggcaccacacac

SEQ ID NO: 142110 - RNA, 64 nt, Human
agcagagccagggccuggcgagcuggcguggagcccacaggauucagcagcauggacagucacu

SEQ ID NO: 142111 - RNA, 64 nt, Human
ccgugauggugauguguuugugucaacaggacucccacaggaggucuaugccaaacugacuguu

SEQ ID NO: 142112 - RNA, 64 nt, Human
uuaguuucaauucuaugugcauagcaggaaugcuccacaggaauggcuucugacaauaaucugu

SEQ ID NO: 142113 - RNA, 64 nt, Human
ggccucuggauacugggcuccccagaacugcuggccacaggauggugggugagguuaguaucaa

SEQ ID NO: 142114 - RNA, 64 nt, Human
cccaucagccauuccugaaggaagacagugguagccacaggaacgguggccauuuccaagcucc

SEQ ID NO: 142115 - RNA, 64 nt, Human
gcaucuccugcgaucccacagaggacugugguggccacaggagcugaaagcagaagagugggau

SEQ ID NO: 142116 - RNA, 64 nt, Human
aagacaguacaucuccuguugaacuugcaucuuuccacaggacuuucuguuuuuagggaugaga

SEQ ID NO: 142117 - RNA, 64 nt, Human
aaaagggcccaaggaggagauggugucuuagaugccacaggagaagagguaaagaauguggagu

SEQ ID NO: 142118 - RNA, 64 nt, Human
uggcauggggaggggagagaagguggucugcaccccacaggaugaacuagccaugacuaggguc

SEQ ID NO: 142119 - RNA, 64 nt, Human
uagagaagaccuuguugaaccgcugcuaaacuugccacaggagcgauguguuuucucugagugc

SEQ ID NO: 142120 - RNA, 64 nt, Human
uagccugcugaggaauggaauggaauggagaugcccacaggagguccugaugucaucacugcac

SEQ ID NO: 142121 - RNA, 64 nt, Human
cccgcccuggcucuuuagaauggaccacugagagccacaggaccguuuuggggcugaccugucu

SEQ ID NO: 142122 - RNA, 64 nt, Human
cgcuccugaagggcugcccacccacagccagaauccacaggaucccaccgagaaggagagccag

SEQ ID NO: 142123 - RNA, 64 nt, Human
uacuagguuuaucucauuuaagccccacaacaccccacaggaggguaauuuucuaacucuaguu

SEQ ID NO: 142124 - RNA, 64 nt, Human
agggacugucauucucaucuccucccugggguauccacaggaauggacauucaaaugguuguag

SEQ ID NO: 142125 - RNA, 64 nt, Human
uagcccauuccccaugcugggccugcucacagagccacaggaagaucauucagaaacuaggaaa

SEQ ID NO: 142126 - RNA, 64 nt, Human
cuaccagucauucccaucgcuuugcaaucacaagccacaggaugagaaguucugacucacucau

SEQ ID NO: 142127 - RNA, 64 nt, Human
gccccagccuagcugagugugcuggcaaaguuccccacaggacucagccuucucgucuuuccga

SEQ ID NO: 142128 - RNA, 64 nt, Human
ucugacaucugccacuccucaucccccacuguacccacaggauacaucaucgccccucugugaa

SEQ ID NO: 142129 - RNA, 64 nt, Human
uuugcucccuuccauucuugaaacaccucaugccccacaggagccccaguggugacuggaucug

SEQ ID NO: 142130 - RNA, 64 nt, Human
ggcucacugcaggcuguggagaggucaugcugguccacaggaacacuuggcagugcucucguag

SEQ ID NO: 142131 - RNA, 64 nt, Human
aacggugguggguuuuguugcuuucacacucuauccacaggauagauugaaacugccagcuucc

SEQ ID NO: 142132 - RNA, 64 nt, Human
cagcucccauucucagugggcugcaguugcccaaccacaggaagaaagggaaggagguagaggg

SEQ ID NO: 142133 - RNA, 64 nt, Human
cacauaugugugauuuuaaacgaauauucucagaccacaggaaacucuucaucccccuguuguu

SEQ ID NO: 142134 - RNA, 64 nt, Human
agucugcuggaaugcaggaaguagaacagaaucgccacaggacuguucuggggccagcuucccu

SEQ ID NO: 142135 - RNA, 64 nt, Human
uagcaccccuuuccccccaucucugcucccuuugccacaggauaccuuguaaaguuccugcccc

SEQ ID NO: 142136 - RNA, 64 nt, Human
uauucugccuaccacaccuuccugccacugacucccacaggagaggcuacaaaaugaucuggcg

SEQ ID NO: 142137 - RNA, 64 nt, Human
cuguagcuucagcaccucaguaacuucacuucauccacaggaaacacugcucuuccucaccugu

SEQ ID NO: 142138 - RNA, 64 nt, Human
auaaggaguuccuagcaaggcuuccuuguggguaccacaggacaacucugcccauagcaaagau

SEQ ID NO: 142139 - RNA, 64 nt, Human
uuucccagggaagggggguggggguaggugggcuccacaggaugggggaggagcauguccacug

SEQ ID NO: 142140 - RNA, 64 nt, Human
auuuugacaaaaacuagugaagaaaaucuuuuggccacaggaaauaucuuccucagcaucugag

SEQ ID NO: 142141 - RNA, 64 nt, Human
uuaaauuugaaguaauauauuaugggauaaaaggccacaggaaauaagacugcugaaugucuga

SEQ ID NO: 142142 - RNA, 64 nt, Human
ucaccgagggagcacuggugggugcucugaaaacccacaggaucccaccuccaggcccaccugg

SEQ ID NO: 142143 - RNA, 64 nt, Human
uaaacucuuuuuggguccaguugauuguacguagccacaggagcccugcuaugaaaggaauaaa

SEQ ID NO: 142144 - RNA, 64 nt, Human
ccuucuaggccucugccucagugucccaccucugccacaggagcugugaucuuuguguucugaa

SEQ ID NO: 142145 - RNA, 64 nt, Human
ucacuugguaccauauagaucaaaagcuuuguaaccacaggaaaaaauaaacucuuccaucccu

SEQ ID NO: 142146 - RNA, 64 nt, Human
ccgcuccacaagacaccugugacauccuccagggccacaggagcacgugcugaccaguuuuccc

SEQ ID NO: 142147 - RNA, 64 nt, Human
ggaccuuccuguguaguuggugcaaaagcaaucuccacaggacagcacugcuuccaugcuucau

SEQ ID NO: 142148 - RNA, 64 nt, Human
cucauguagcuggagacguuaagagcugagcacaccacaggaaaggagggaggaugcuguguga

SEQ ID NO: 142149 - RNA, 64 nt, Human
aaccucaucucccugggucgggggguguucaaggccacaggacaaggggagcacccugggccac

SEQ ID NO: 142150 - RNA, 64 nt, Human
ucuagauacaaugcuccugagaagacagcauuuuccacaggaggcuguuuccuccccuggugga

SEQ ID NO: 142151 - RNA, 64 nt, Human
uguuugacaaaguuacugauucacugcauggcucccacaggagugggaaaacacugccaucuua

SEQ ID NO: 142152 - RNA, 64 nt, Human
uuucuuauucuuuacuugaaauaacuauagggauccacaggagaucaaaaggaaugauguauuu

SEQ ID NO: 142153 - RNA, 64 nt, Human
guugguuuuauucaguuccucauuuuucuaguucccacaggaggaacacaaagggcccaugaug

SEQ ID NO: 142154 - RNA, 64 nt, Human
cucaucugcauuucaucuggagcagggcagguaaccacaggaggaggcaugcccgaggcagcca

SEQ ID NO: 142155 - RNA, 64 nt, Human
gaccccugcccucggccauugaacacugcacccuccacaggagccgcagaggcccgaggcaccg

SEQ ID NO: 142156 - RNA, 64 nt, Human
gguuucccucaauugaagacaggaacaucauuuuccacaggauaugaagagcugccaguaaugc

SEQ ID NO: 142157 - RNA, 64 nt, Human
cguuugcauccccagcauuuccugaguuauaaggccacaggaguggauagcuguuuucaccuaa

SEQ ID NO: 142158 - RNA, 64 nt, Human
ucucagcugcaaauauuauggagaauuggggcacccacaggaaugaagagagaaagcagcuccc

SEQ ID NO: 142159 - RNA, 64 nt, Human
ggccacagagaacucauguguucagcucaagacuccacaggaauucaacccccagaaagacaua

SEQ ID NO: 142160 - RNA, 64 nt, Human
acagcaauuauuauauugaaggcuuuaauaaaggccacaggagacauuacuauagcauagauug

SEQ ID NO: 142161 - RNA, 64 nt, Human
caagauugaacuguaaaaaccaaggccagccacaccacaggaucugaacuuuguuuccagaaau

SEQ ID NO: 142162 - RNA, 64 nt, Human
caauccauggagcugguucacuguaacuagcaggccacaggaagcaaagccuuggugccuguga

SEQ ID NO: 142163 - RNA, 64 nt, Human
guauguuuuuuaagaguagauugauucacccuacccacaggacauucaccaagccacugauacc

SEQ ID NO: 142164 - RNA, 64 nt, Human
guagcugccagcguagaaacccaugaaaaggaggccacaggagauuccugggagcacugggugu

SEQ ID NO: 142165 - RNA, 64 nt, Human
acucaagggugugcauucauuuuaggugggaucgccacaggauuucauguuauuuuccuuacgg

SEQ ID NO: 142166 - RNA, 64 nt, Human
uugauuggaauaagauuauugcauaugaauuuacccacaggacucugaaucauguuacccacuc

SEQ ID NO: 142167 - RNA, 64 nt, Human
uccuuccauuuucugguuuuuaaaauuagccacaccacaggaaacccacauuuuuagauggaaa

SEQ ID NO: 142168 - RNA, 64 nt, Human
uuaggaaaaaaugcucaggcagaacgggguacauccacaggaggaaucggacgagaggauguga

SEQ ID NO: 142169 - RNA, 64 nt, Human
auuuagaacgagccuggaagcacuacagagcaucccacaggaccacacgcaggccucccugccu

SEQ ID NO: 142170 - RNA, 64 nt, Human
aggacuagcagggccugugguggagccagcagaaccacaggagagugcccugccugucucagug

SEQ ID NO: 142171 - RNA, 64 nt, Human
gagcguguacuaccccaggaugcaugcagggcccccacaggagcguguacuaccccaggacgca

SEQ ID NO: 142172 - RNA, 64 nt, Human
gagcguguacuaccccaggacgcaugcagggcccccacaggagcguguacuaccccaggaugca

SEQ ID NO: 142173 - RNA, 64 nt, Human
uguccuauccccggaccggacgcaugcagggcccccacaggagcguguacuaccccaggacgca

SEQ ID NO: 142174 - RNA, 64 nt, Human
gagcguguacuaccccaggacgcaugcagggcccccacaggagcguguccuauccccggaccgg

SEQ ID NO: 142175 - RNA, 64 nt, Human
gagcguguacuaccccagaacgcaugcagggcccccacaggagcguguacuaccccaggacgca

SEQ ID NO: 142176 - RNA, 64 nt, Human
gagcauguccuaucccuggacgcaugcagggcccccacaggagcguguacuaccccagaacgca

SEQ ID NO: 142177 - RNA, 64 nt, Human
gagcguguccuauccccggacgcaugcagggcccccacaggagcauguccuaucccuggacgca

SEQ ID NO: 142178 - RNA, 64 nt, Human
gagcguguccuauccccggacgcaugcagggcccccacaggagcguguccuauccccggacgca

SEQ ID NO: 142179 - RNA, 64 nt, Human
gaaccacugguauccagagaaagccugcagcucuccacaggagcuguaaaagucaugguugacu

SEQ ID NO: 142180 - RNA, 64 nt, Human
caguaaaaauucuuaucauucaaggauauuggaaccacaggacuauuuggauaaaaaacauuau

SEQ ID NO: 142181 - RNA, 64 nt, Human
uguuauacagacauauacacauacauacauugacccacaggacauuguaaaauauuaucacaug

SEQ ID NO: 142182 - RNA, 64 nt, Human
uaauagauuuucuuggcaaaucuaaugauucagcccacaggacuguugaaacuacugcggaagu

SEQ ID NO: 142183 - RNA, 64 nt, Human
cauuguuuccuugugguaagugaccgagaugcugccacaggaccugagacacugaugaauggug

SEQ ID NO: 142184 - RNA, 64 nt, Human
ugggugggcacacugaacuguuugguggccccaaccacaggaagcugcaauucucuggcuuagg

SEQ ID NO: 142185 - RNA, 64 nt, Human
uccaagccucguuccuccuucugccuccccggagccacaggauggauuuaggagccacugcuca

SEQ ID NO: 142186 - RNA, 64 nt, Human
uccaaugugcagacaaauuugaaaacugaaccaaccacaggaacaucaaguacacugugggccu

SEQ ID NO: 142187 - RNA, 64 nt, Human
gugcaaaaauuuuaaugcuagucaguaugcaccaccacaggaaaguuagaucccauuagcacuu

SEQ ID NO: 142188 - RNA, 64 nt, Human
uggccuugaguagcaggggccugguccccacagcccacaggauggaccaaagggggcagguggg

SEQ ID NO: 142189 - RNA, 64 nt, Human
ggggaacgccucuguucaguucauucccagaaguccacaggacgcacagcccaggccacagcca

SEQ ID NO: 142190 - RNA, 64 nt, Human
ucuaaucuagugacaaaggcauagaauucuccucccacaggaauguauuucuauuuucaaggug

SEQ ID NO: 142191 - RNA, 64 nt, Human
caggguucaccaggaugagagaggagagaggaauccacaggaccaccagaagggagagggaacc

SEQ ID NO: 142192 - RNA, 64 nt, Human
aauugccuguucuuuuccagccugauuuuuuuucccacaggaagagcccacauguagcccugag

SEQ ID NO: 142193 - RNA, 64 nt, Human
caggguucaccaggauguaagaggagagaggaauccacaggaccaccagagaggagagggaacc

SEQ ID NO: 142194 - RNA, 62 nt, Human
uagccuggcuucagagcugagagugccuggggccacaggaaaggcaggaacaggaccuucuc

SEQ ID NO: 142195 - RNA, 55 nt, Human
ucuccaagaggaagcccuaauccgcccacaggaagccugcaguccuggaagcgcg

SEQ ID NO: 142196 - RNA, 64 nt, Human
ugugaguccuguuagugcuccugaucugcaggugccacaggacagcagugacgagguuucugau

SEQ ID NO: 142197 - RNA, 64 nt, Human
ccgcaggagggaggcggggaggaggaacgggcagccacaggacugagcccucucacuccagcca

SEQ ID NO: 142198 - RNA, 64 nt, Human
gaucuuacacauucuguguauaaagaccuuaacuccacaggacggacauuuuagaguuuaaauu

SEQ ID NO: 142199 - RNA, 64 nt, Human
ccccugcuuacauuccagacagacacagacuacaccacaggagagaagauuuuaaccugugucu

SEQ ID NO: 142200 - RNA, 64 nt, Human
gcugcagcaagagguacagcucaacaaaggaaaaccacaggacuggauaugcaacuagugcuca

SEQ ID NO: 142201 - RNA, 64 nt, Human
aauuuguaauacgacaaacacuggaagauauaacccacaggaaauucuuggaaacaucaauacu

SEQ ID NO: 142202 - RNA, 64 nt, Human
uuuaucaugagauguguguuaagaaggcugcagcccacaggaguccagggaaggcggggaccac

SEQ ID NO: 142203 - RNA, 64 nt, Human
auucaaucccgcaaucccacuacucgggauauacccacaggaaaagaauucauuuuaucaaaaa

SEQ ID NO: 142204 - RNA, 64 nt, Human
caguagucaaaacuaugaaaugauacugguuucuccacaggaauaugguuccauuaggcuggga

SEQ ID NO: 142205 - RNA, 64 nt, Human
uuaaaaauguuuuaaauggaaaauguacucuagaccacaggacuaauguaaauuaauauacagu

SEQ ID NO: 142206 - RNA, 64 nt, Human
guaagguuuuggggaauaagaaucguccacauucccacaggaaaucauugcuauggucuccccu

SEQ ID NO: 142207 - RNA, 64 nt, Human
gcaggcccaguccuccuccagaaaauaagacaggccacaggagggcagaguggaguggaaauac

SEQ ID NO: 142208 - RNA, 64 nt, Human
gaugaagugcccaggcuccaggaaguugagggacccacaggagaggugggcagagcuggaguuc

SEQ ID NO: 142209 - RNA, 64 nt, Human
gcagagcagcaggauccccagccagacucuguacccacaggauuacagccauugcuugggaagg

SEQ ID NO: 142210 - RNA, 64 nt, Human
cagcugccagcugagcucugucaccagggguacuccacaggaggagcaggugcugacuuucagg

SEQ ID NO: 142211 - RNA, 64 nt, Human
gggaggacaggggaguuaaauggcugggcaggugccacaggaugaggccacugaaagaucugcu

SEQ ID NO: 142212 - RNA, 64 nt, Human
aagcaaagaaaaucguguauuagggcaggcuaggccacaggauacguagacuccaaaauguaca

SEQ ID NO: 142213 - RNA, 64 nt, Human
cuauagagauuuugauaucauuuggcuuauaaauccacaggaggagauaauguauggaaaacau

SEQ ID NO: 142214 - RNA, 64 nt, Human
uuuuaauucuuauuuccuucaggaagauccuuuuccacaggaagcuaucaaagaaaaguaaacu

SEQ ID NO: 142215 - RNA, 64 nt, Human
guaaacagauuuuaaaugucugauauaaaacaugccacaggagaauucggggauuugaguuucu

SEQ ID NO: 142216 - RNA, 64 nt, Human
uaguggauacaggucauuaugcauuuguccaaacccacaggagguguaccaccaagagugaacc

SEQ ID NO: 142217 - RNA, 64 nt, Human
gugcuugcagggccucucgcugcuacugggacauccacaggaccuaauguuuauguggaaucuc

SEQ ID NO: 142218 - RNA, 64 nt, Human
uaauauucaaaaguugacucuccuguggcucaugccacaggaucccagcacuuugggaggccga

SEQ ID NO: 142219 - RNA, 64 nt, Human
aggcaaaguuguggacuguuugaucuuguauuacccacaggaaugagggcagcuaaacccauag

SEQ ID NO: 142220 - RNA, 64 nt, Human
cagacuguggggacagauacaauuccacuccuguccacaggaacaugagauuuagcagacuaag

SEQ ID NO: 142221 - RNA, 64 nt, Human
ccaacuaucucauuuccaagcaaguauuagaauaccacaggaaccacaagacugcacaucaaaa

SEQ ID NO: 142222 - RNA, 64 nt, Human
ucuaacccccuccccucgcugcugggccccaucuccacaggagagacugguucagcucuagggc

SEQ ID NO: 142223 - RNA, 64 nt, Human
uccccaucauccacgccaaguggaagccacuggaccacaggaggugugauagagccuuugaucu

SEQ ID NO: 142224 - RNA, 64 nt, Human
agcaaaggaugguggccgcaggccccacgcgagcccacaggacaccggccccuagauuccagcc

SEQ ID NO: 142225 - RNA, 64 nt, Human
gaggugugcaagagagggaugcauggagauagccccacaggagguggucugggacucucuugau

SEQ ID NO: 142226 - RNA, 64 nt, Human
ccuucuccugggagguccugcugcaacucaaguuccacaggauggucaagcugucagacaucca

SEQ ID NO: 142227 - RNA, 64 nt, Human
gagagagcccccaccguggacaccggcucuagggccacaggaaaaggaacguuuccaggcauuu

SEQ ID NO: 142228 - RNA, 64 nt, Human
gccgaacgcuggccacuggauccacgcugaccgcccacaggacuucauagcugccauccgaggc

SEQ ID NO: 142229 - RNA, 64 nt, Human
cgaagcucccuagaggggcaaaagauggagugagccacaggaaguuuggggcguggugaguugg

SEQ ID NO: 142230 - RNA, 64 nt, Human
ccuuguuuauaugcccauucuuuucacuuccucuccacaggagccucugcagucgcuugccaaa

SEQ ID NO: 142231 - RNA, 64 nt, Human
auguuugcaguucuaggucuuugacagcugaagaccacaggaaucaaacaggcgagacacacag

SEQ ID NO: 142232 - RNA, 64 nt, Human
guuagcucaucucacucacucugauucuccugugccacaggaaaagagggccuggaaagcgcag

SEQ ID NO: 142233 - RNA, 64 nt, Human
ucaagccuaacgccaaguguacaaacuggcccaaccacaggagcugccaguauccagcaguauc

SEQ ID NO: 142234 - RNA, 64 nt, Human
uacuaaauucuuuuaaaccuggagccuuagagagccacaggaauaucuucuguuguacagucua

SEQ ID NO: 142235 - RNA, 64 nt, Human
uauuccucccuucucguauaaauagagugacuauccacaggagaaaagugugugcuuuaguauu

SEQ ID NO: 142236 - RNA, 64 nt, Human
aaguguuuuucaagccuguuauauucagugugugccacaggauugaaauaaaugacaauguaau

SEQ ID NO: 142237 - RNA, 64 nt, Human
gguaucaaugcuguagauggauggaagaggcuucccacaggaaggugccaccagucaguugugc

SEQ ID NO: 142238 - RNA, 64 nt, Human
cccuggccuggcucuaggcuugggacugcggcugccacaggaagggggcaucccccuacuuugg

SEQ ID NO: 142239 - RNA, 64 nt, Human
gucagggaaaggggcacugaccuguagugaaaggccacaggacacagccuuauuacugcugggg

SEQ ID NO: 142240 - RNA, 64 nt, Human
ggcgugugcucacugugagacguccugccacaccccacaggagacggaggcagugggcauuugg

SEQ ID NO: 142241 - RNA, 64 nt, Human
gaaccgggcacaacuaggaacaaugccaccauucccacaggagugguacuuaaaccagacagca

SEQ ID NO: 142242 - RNA, 64 nt, Human
guuucaaauuucaaucaaugagcacugucaacacccacaggagagaauaaaauuaccugugcaa

SEQ ID NO: 142243 - RNA, 64 nt, Human
cacugcagcccaaacagugccaacagcccuguccccacaggaccugggagcccugggccagcac

SEQ ID NO: 142244 - RNA, 64 nt, Human
uuugaaaccucagggcugucccagccccggcaagccacaggaaggaggggagagacaggcagcc

SEQ ID NO: 142245 - RNA, 64 nt, Human
auccaguugccauugaguagcaaagccacgcuccccacaggacuuggacagagggcccacaggg

SEQ ID NO: 142246 - RNA, 64 nt, Human
gauacuuaaagcuucaaaaagacugccccuaccaccacaggaggaccagccuaaccauacgcuc

SEQ ID NO: 142247 - RNA, 64 nt, Human
auagggaacgcgcccuugccccgaggcugcacuaccacaggaaauaacauauguaaauaaauuu

SEQ ID NO: 142248 - RNA, 64 nt, Human
ggggugggcaaggcagucagcaucaccagcaauaccacaggacccucaccccagcauagacaca

SEQ ID NO: 142249 - RNA, 64 nt, Human
uggagaggaaagaggcucuguccaccacucuaccccacaggagggccgcccgccaccaagccuc

SEQ ID NO: 142250 - RNA, 64 nt, Human
cuuuuaaccuggguguuagcauuuuaaagagaccccacaggaguucuggccugugacuaacuaa

SEQ ID NO: 142251 - RNA, 64 nt, Human
ccccaccaagugacuuugguugacuugugggcucccacaggagucauggugauggaugauaucc

SEQ ID NO: 142252 - RNA, 64 nt, Human
aggcaaaucuuacugcuuaauguauaaacucucaccacaggaagcaucgcuguuuccaauaaau

SEQ ID NO: 142253 - RNA, 64 nt, Human
gcccugcaggugccacgugagccugcucuggcauccacaggaugcuccuggagccucuucucug

SEQ ID NO: 142254 - RNA, 52 nt, Human
ugaaagauggcaaaugcugaucccacaggagcaccucaagccaugaaguguc

SEQ ID NO: 142255 - RNA, 64 nt, Human
uccccacugucucucuucuuucugucaggggcucccacaggaucagaggcuggggccaacugga

SEQ ID NO: 142256 - RNA, 64 nt, Human
ggggccacuguccccagccgcagccaacugugucccacaggaaugggagccuagguuuccaaau

SEQ ID NO: 142257 - RNA, 57 nt, Human
ccauuucuaucguccgcugaccucuggccacaggaagccagguccaccgcccaccac

SEQ ID NO: 142258 - RNA, 64 nt, Human
guggaggaagggcugggccaccagggaucacagaccacaggaagaugggagguggaagcagagg

SEQ ID NO: 142259 - RNA, 64 nt, Human
auagaaaccuguaggaacccagccugaggggaagccacaggaucggcccgagacccaggccaug

SEQ ID NO: 142260 - RNA, 64 nt, Human
cauaaauaugaugucagaauuuguugcuaauuugccacaggagcugaaguuaacccugucugag

SEQ ID NO: 142261 - RNA, 64 nt, Human
uacaauauuaggugaauauggaaguaaaggcauuccacaggaucaucauuuaaaaaaaaagaau

SEQ ID NO: 142262 - RNA, 64 nt, Human
uaugguaucauguaucucucuguggugguucauuccacaggacgaaugcauauucaacacacug

SEQ ID NO: 142263 - RNA, 64 nt, Human
cuggaggaacucuguagcugugcaucauggaacgccacaggauuuuuacauuaaaaaguugaau

SEQ ID NO: 142264 - RNA, 64 nt, Human
uguggcccugagacaccagggaaaaucuccccccccacaggacauacuaguucccuggcaggca

SEQ ID NO: 142265 - RNA, 64 nt, Human
ccaguaaggcucucuaagggguaaguaggaggauccacaggauuugagaugcuaaggccccaga

SEQ ID NO: 142266 - RNA, 64 nt, Human
cuucccuugugucucccuggaccugccugacaggccacaggagcagacagcacacccaagcccg

SEQ ID NO: 142267 - RNA, 64 nt, Human
gggugcccggcgugagggaucaggcucgccagggccacaggacaggugaugaccuguggccacg

SEQ ID NO: 142268 - RNA, 64 nt, Human
aacuguuuucuccaccaggcuuugacaaaagggcccacaggaaucuuaccaaugccaacauuuc

SEQ ID NO: 142269 - RNA, 64 nt, Human
auuucccaaaaguaugcuccugggaacccuaguuccacaggauaauagguuuuucauaaagaaa

SEQ ID NO: 142270 - RNA, 64 nt, Human
uucucucagccuuacacucacagaagccaacuuuccacaggacugaagacaaaguguuucauuu

SEQ ID NO: 142271 - RNA, 64 nt, Human
cccuagaccugcuccccagaggaggggccuugacccacaggacgugugguggcgccuggcacuc

SEQ ID NO: 142272 - RNA, 64 nt, Human
ucuucucucuggcucaggugugggugggaggggcccacaggaagcucagccuucuccucccaag

SEQ ID NO: 142273 - RNA, 64 nt, Human
aaaugagcccaagcacacaugcauggcauuuguuccacaggagggcaucccuggggauguggcu

SEQ ID NO: 142274 - RNA, 64 nt, Human
ccugggccuuucccacagugcaaugugaugaaaaccacaggacucacgccagucggauaggccg

SEQ ID NO: 142275 - RNA, 64 nt, Human
gcagcccaggaaauaggaacugagacucugguacccacaggagccugggugggcaaagagcgcu

SEQ ID NO: 142276 - RNA, 64 nt, Human
cugguggcccccuauuuugccauuuagcgaacaaccacaggaauuuuaaaaacaaaaacauccc

SEQ ID NO: 142277 - RNA, 64 nt, Human
ucccacagccagcucuuggcuccaagaugagcacccacaggaagccgacccaggccugaggggc

SEQ ID NO: 142278 - RNA, 64 nt, Human
augagauucuugucugcccucauaucacgcugccccacaggaaugcugcugggaaaagcagggc

SEQ ID NO: 142279 - RNA, 64 nt, Human
gaagcugugacaagggagugaccauccauccccuccacaggagggugaggaauugggacaggua

SEQ ID NO: 142280 - RNA, 64 nt, Human
aaaauaaaaccaaaacaaaacacaaaaagauauuccacaggacaugccacuuuauuauaaaacc

SEQ ID NO: 142281 - RNA, 64 nt, Human
cuggguuaucugcaucucaaaagaaaaugcuuacccacaggaacuguuaacucagggguucuua

SEQ ID NO: 142282 - RNA, 64 nt, Human
aggguaggcaggugggggcugggugggggacugcccacaggagcauguacauauggaaaaacag

SEQ ID NO: 142283 - RNA, 64 nt, Human
gccucugcugcacacacaggcaccagcagggaugccacaggagugcccacagggugcaggacuc

SEQ ID NO: 142284 - RNA, 64 nt, Human
gaagcucccccacccccacucccggccccgguucccacaggacacgcuaagaagcacagggagc

SEQ ID NO: 142285 - RNA, 64 nt, Human
uagucacggaguugccauggcauguaguagaaaaccacaggaagaauggucauauucacuuugu

SEQ ID NO: 142286 - RNA, 64 nt, Human
cugcucugcgugucaccugugcuucgggcccuucccacaggacauuucucuaagagaacaaugu

SEQ ID NO: 142287 - RNA, 64 nt, Human
cgucagagaagugcacagccugggccagauacucccacaggauggacucacugcagaagcagga

SEQ ID NO: 142288 - RNA, 64 nt, Human
ccugucuuccaccccuccugacccguauagugugccacaggaccugggucggucuagaacucuc

SEQ ID NO: 142289 - RNA, 64 nt, Human
aaaaucaagaggacccaaggggauggagacaggaccacaggaaugggccaaggagcaacgugcc

SEQ ID NO: 142290 - RNA, 64 nt, Human
ugacuaaaacaaagggaagaacuuuuuaugaacuccacaggaaguaguaaagcuuuuuuuuuuu

SEQ ID NO: 142291 - RNA, 64 nt, Human
guggccacaaggcugcuuucugcacucucuguggccacaggaacaaagaugcgaguugaagauc

SEQ ID NO: 142292 - RNA, 64 nt, Human
uaauccuauauaauagauugaucaugcaccauauccacaggagguuggaaaaaccaugccauuu

SEQ ID NO: 142293 - RNA, 64 nt, Human
ugggagauacaugacgcgaagacggauuucacauccacaggacggucuugaagaaaauaacacu

SEQ ID NO: 142294 - RNA, 64 nt, Human
cugcauuuccugguuacucuaucccagugaccagccacaggagauguccaauaaaguaugugau

SEQ ID NO: 142295 - RNA, 64 nt, Human
accaagcacugcucucuagcuccagggcacuaagccacaggaggcagcgcccugcagccucccg

SEQ ID NO: 142296 - RNA, 64 nt, Human
cuucuggggccaggaccccuggugggcaacguagccacaggaacaggccccguccaccgccucc

SEQ ID NO: 142297 - RNA, 64 nt, Human
gcuucucaagggaggguaagggggcacccugagcccacaggaccccuacuucacagcucacagg

SEQ ID NO: 142298 - RNA, 64 nt, Human
agcuccugcuuggccaguguggagaggaaaggagccacaggagcgggugcuacacccggcaaga

SEQ ID NO: 142299 - RNA, 64 nt, Human
aguggggagcccgcaggccuauguggcagcgucaccacaggaguugugggccuaggagaggcuu

SEQ ID NO: 142300 - RNA, 64 nt, Human
auggguucaggcugauccaggagaugcucacaggccacaggaccuggaaaacacucuugguggu

SEQ ID NO: 142301 - RNA, 64 nt, Human
cccucaacugccuccuuuuugcagagaacgauccccacaggaacuggucuaagaacacugucug

SEQ ID NO: 142302 - RNA, 64 nt, Human
uggggcaggacggugacugcagaccugucuacauccacaggagaagucacugcuugaggcucag

SEQ ID NO: 142303 - RNA, 64 nt, Human
ugugagaacguggccugcccucacuggccaguggccacaggaaccccgggccugaguggaggcu

SEQ ID NO: 142304 - RNA, 64 nt, Human
acucccuccagacacccagggaauacccucugccccacaggauugaagacugcuuggcaguccu

SEQ ID NO: 142305 - RNA, 64 nt, Human
agugacgguccccgacccaggagaacgguggcucccacaggacaaucgcugccccccaaccucg

SEQ ID NO: 142306 - RNA, 64 nt, Human
uccuggucuuccuuggugccagaagagggcacuaccacaggacccucucaagcuucucaggcaa

SEQ ID NO: 142307 - RNA, 64 nt, Human
uccaguuuagaaaaggcucugugccaaggagggaccacaggagcugggaccugccugccccugu

SEQ ID NO: 142308 - RNA, 64 nt, Human
gguugccaggcuggggagggcaaccauagccacaccacaggauuuccugaaaguuuacaaugca

SEQ ID NO: 142309 - RNA, 64 nt, Human
uuggggaccagaggugacaguggaugacgugaagccacaggagccccacccccaugcagccucu

SEQ ID NO: 142310 - RNA, 64 nt, Human
uggggagagauggacaguucacacccugcaaggcccacaggaggcaagcaagcucucuugccga

SEQ ID NO: 142311 - RNA, 64 nt, Human
guuccuuuuauauaaguggacaaauuuugaguugccacaggaggggaaguagggaggggggaaa

SEQ ID NO: 142312 - RNA, 64 nt, Human
gaaaucauacauugcuuuuuauucaucauggguaccacaggaaccugggggccugugaaacuac

SEQ ID NO: 142313 - RNA, 64 nt, Human
gcugucacuccuccaccgagggaggccucacaaaccacaggacgcugcaacgggucaggcuggc

SEQ ID NO: 142314 - RNA, 64 nt, Human
agagcaggugggcacuggcuggguacggugcccuccacaggacucucccuacugccugagcaaa

SEQ ID NO: 142315 - RNA, 64 nt, Human
auuuuuuaauuuaaagcuuacucuguccauuuauccacaggaaaguguuauuuuucaaggaagg

SEQ ID NO: 142316 - RNA, 64 nt, Human
guaauccuguuaaagggcugaagaaguaucuuagccacaggagcgaugaggcaaggauugucag

SEQ ID NO: 142317 - RNA, 64 nt, Human
gccgugaucagaagucaugcaugagauccauacaccacaggacacuacuaaucuagucccuugc

SEQ ID NO: 142318 - RNA, 64 nt, Human
ugucucccagcaguagugagccacucagucucuuccacaggaaguuuggagccuacauuccuug

SEQ ID NO: 142319 - RNA, 64 nt, Human
cggcccucccgaguuaaggugggcccggcccgcgccacaggacccucgccggacccucuaaccu

SEQ ID NO: 142320 - RNA, 64 nt, Human
ccaaguaaaccgcuagcuuguugcaccguggaggccacaggagcagaaacauggaaugccagac

SEQ ID NO: 142321 - RNA, 64 nt, Human
ggaaaggggucggguugcccuuccuuccccccaaccacaggaauggaggcgggacacagggcca

SEQ ID NO: 142322 - RNA, 64 nt, Human
ugcucuuaaaauguauucaguuauuuaguggcccccacaggaguggagucuugaaaucuaauuc

SEQ ID NO: 142323 - RNA, 64 nt, Human
aagaaaggaagccacugaacaucccuucucugcuccacaggagugccuuagacagccugacucu

SEQ ID NO: 142324 - RNA, 64 nt, Human
aaaaaaaaaaagguggaaggagcagccagauguuccacaggaccccaccaagaaggucauuucc

SEQ ID NO: 142325 - RNA, 64 nt, Human
acagauucccuggauaguguagugguagauuucuccacaggauagcgcaauuggcaaaucaugc

SEQ ID NO: 142326 - RNA, 64 nt, Human
ccucaguagcggagcaucuccacgaaacggggcaccacaggaucccugugcaagggcugggggc

SEQ ID NO: 142327 - RNA, 64 nt, Human
auguauggaauuugcugcuucucuggggucccuuccacaggagguccugugagaaccaaccuuu

SEQ ID NO: 142328 - RNA, 64 nt, Human
uaccuagcaacccuugcaaugaagaugagcagauccacaggaaaacuugaaugcacaacugucu

SEQ ID NO: 142329 - RNA, 64 nt, Human
ggccagcagaucacugagagugcaaccccacccuccacaggaaauugccucaugggcagggcca

SEQ ID NO: 142330 - RNA, 64 nt, Human
caaaaugaccaaagacugucagauuucuuagacuccacaggaccaaaccauagaacaauuucac

SEQ ID NO: 142331 - RNA, 64 nt, Human
gggagauacucugcaaguugaccuggccucucccccacaggaacaaaacacugccuccagaguc

SEQ ID NO: 142332 - RNA, 64 nt, Human
uuggcuaucuuggggccauguccccuucuugcugccacaggaugaauaaaguguugagauuugu

SEQ ID NO: 142333 - RNA, 64 nt, Human
uguuuaaaaccaucacuuuuuugucuuugggaaaccacaggaacaauuucucuggagacaaggc

SEQ ID NO: 142334 - RNA, 64 nt, Human
cucuugccugagcuucagacucgcgucccacugcccacaggacacauccaccuggaugugacuc

SEQ ID NO: 142335 - RNA, 64 nt, Human
aaggcuccauggaaugagauaaagcauugacccaccacaggacaucucaugaagccauguucag

SEQ ID NO: 142336 - RNA, 64 nt, Human
ggcgggggggggggcggugucaggucccagcgagccacaggaacggcccugcaggagcagggcg

SEQ ID NO: 142337 - RNA, 64 nt, Human
aaagcaugauuuuuaauaguuguugaguauuccaccacaggaauguaucacaacuuaaccguuc

SEQ ID NO: 142338 - RNA, 64 nt, Human
uggaucgaaguaaaauagaaaugggacuggcuuuccacaggaaguaaacugcuucagagcccac

SEQ ID NO: 142339 - RNA, 64 nt, Human
uucaagguaaagccggauuuccguggcgggggucccacaggaccuccuguaguagccccugcgc

SEQ ID NO: 142340 - RNA, 64 nt, Human
cagguauggagcacacucuucacccuacccucuaccacaggacacauaucccuguuagcauucc

SEQ ID NO: 142341 - RNA, 64 nt, Human
cauagcagauuauccauuucaauuuuuuuuuacuccacaggaaaauguaagcuacuuugucaua

SEQ ID NO: 142342 - RNA, 64 nt, Human
uugccucauaacaguggaauuucugauagacaaaccacaggacuuugauuuuaagccaaaucca

SEQ ID NO: 142343 - RNA, 64 nt, Human
ccuagcucccaaauccugccccguuggcacagggccacaggagcagaagcugggugggcugaag

SEQ ID NO: 142344 - RNA, 64 nt, Human
accauuugguaaguugcacuuugcugugcugaucccacaggaaaggcuugaaacacgagaagca

SEQ ID NO: 142345 - RNA, 64 nt, Human
ucccucccagggaggccccuucagagaggagaggccacaggagcugcauuguggggggacaggc

SEQ ID NO: 142346 - RNA, 64 nt, Human
uacaagugcugguacaucuuuuuucuuuuguggaccacaggaaggaagauuuauuuugauauug

SEQ ID NO: 142347 - RNA, 64 nt, Human
uuuucccuccugcuucccuucagucucuucaggaccacaggauggauaugcagacauguggggu

SEQ ID NO: 142348 - RNA, 64 nt, Human
gaagaaaagugaacgcccuuguagagcagcccgaccacaggagcauggccgcugccagcccaga

SEQ ID NO: 142349 - RNA, 64 nt, Human
uuaagcaugaccgaacgagagacaauacuauuucccacaggaguccauuggguucagcuuugaa

SEQ ID NO: 142350 - RNA, 64 nt, Human
agcuccuccucuuagaggaagcagcuccuuccucccacaggagccccaagggagcacucacccu

SEQ ID NO: 142351 - RNA, 64 nt, Human
ccauguuaauguaaucugauggcuucuccaggguccacaggaagugaagaaucuguuucccagc

SEQ ID NO: 142352 - RNA, 64 nt, Human
caccuucccuuucccagagcccucuucagggaagccacaggacuuagacccagcucaaucccac

SEQ ID NO: 142353 - RNA, 64 nt, Human
caucaccuggcucaucguuuccaccaagagugccccacaggagugccccacagacccgcuggac

SEQ ID NO: 142354 - RNA, 64 nt, Human
cugugugguguucaucuagcauuaggcagauaggccacaggaagaagguguggagaacccaccu

SEQ ID NO: 142355 - RNA, 64 nt, Human
cuuauuuuuauuauuaaaaauguaacaauuuaacccacaggaaaaaaaauuacuuuguaugcuu

SEQ ID NO: 142356 - RNA, 64 nt, Human
gcgcccaggacccuggccugcagagacgcccccgccacaggauccagagcaagcaccgcccccu

SEQ ID NO: 142357 - RNA, 64 nt, Human
uacauauauacauuuugcagcuauggacaauuuaccacaggaugcauauuaaagaaagucauag

SEQ ID NO: 142358 - RNA, 64 nt, Human
ugcgcaugggggugggccugguaagucccaggaaccacaggaagugagcuaaggcucacccaga

SEQ ID NO: 142359 - RNA, 64 nt, Human
gugcuuugugagguuuggacucaugcugagaaacccacaggaaagcacuguccagguaggauua

SEQ ID NO: 142360 - RNA, 64 nt, Human
auaaccaauauaaagcauauuucuuggccuugcuccacaggacauaggcaagccuugaucauag

SEQ ID NO: 142361 - RNA, 64 nt, Human
ccagccagguugagccuaggggccaguugggggaccacaggacaauuuucauauggccuaaaug

SEQ ID NO: 142362 - RNA, 64 nt, Human
gggucuacagagucagggacagaagggaagggacccacaggaagucacaguggugcccagggau

SEQ ID NO: 142363 - RNA, 64 nt, Human
cuguccucugcagcucccucucugguccugggucccacaggacagccgccuugcauguuuauug

SEQ ID NO: 142364 - RNA, 64 nt, Human
auggagaauuaaagagagaagccuccuuaaggagccacaggaugguaccuggccccaaaaggaa

SEQ ID NO: 142365 - RNA, 64 nt, Human
gcaggcaggagcagugugguaguacuggggguacccacaggacuugagaacaccugugccuccc

SEQ ID NO: 142366 - RNA, 64 nt, Human
ccaguugaacugcaggaagagaggacccauccugccacaggacccagaaaaaaagcccaacaca

SEQ ID NO: 142367 - RNA, 64 nt, Human
ugccuguucagcuccagcucaccagccccagugcccacaggaucagucugauucccaagcucug

SEQ ID NO: 142368 - RNA, 64 nt, Human
cuuuauugcuuuuuaaaauaggguuugaaacaugccacaggaagguugcucuccaaaaauacac

SEQ ID NO: 142369 - RNA, 58 nt, Human
gugugcuccuugggcccugacuccugugccacaggacuccuguggcucggccguggac

SEQ ID NO: 142370 - RNA, 64 nt, Human
uguaccaagccaacggcguuccuggcucuccugcccacaggaugaacauuuucggcuuccuuag

SEQ ID NO: 142371 - RNA, 64 nt, Human
agcugaaaugcauucagacuuuguucugcggugcccacaggacuuaccccuguauguacaggau

SEQ ID NO: 142372 - RNA, 64 nt, Human
cuuggaagaccucagaaccaagcugacugugaucccacaggauccuguccuguuuguagguaca

SEQ ID NO: 142373 - RNA, 64 nt, Human
cuccugcugccaggaccugcuugaacuaccagggccacaggagggggauaaucagagcuugagg

SEQ ID NO: 142374 - RNA, 64 nt, Human
cuucuuccuggagcgucccugccuagagcucagcccacaggacugcuucaggccguggccacag

SEQ ID NO: 142375 - RNA, 64 nt, Human
agggaagauggucccugggcacuguggcagcuaaccacaggaagacugucggcagcccucucac

SEQ ID NO: 142376 - RNA, 64 nt, Human
ggccacagagaacucaaacguucaguucaagucuccacaggaauucaaccccagaaagacauaa

SEQ ID NO: 142377 - RNA, 64 nt, Human
auacccuagaagaaaacccgagggacagcagauuccacaggacacgaaggcugccccuguaagg

SEQ ID NO: 142378 - RNA, 64 nt, Human
gccuggacugcugcccacgagugaaccuggggccccacaggauuaacaggggcuauagcggccu

SEQ ID NO: 142379 - RNA, 64 nt, Human
cuugaagccucuggugcuguuucaaccuccauccccacaggaggguggaacucccauucucaca

SEQ ID NO: 142380 - RNA, 64 nt, Human
ucccgggcucaagugguccuccugccucagccucccacaggaucgggauuacaggcaagagccu

SEQ ID NO: 142381 - RNA, 64 nt, Human
aagaaaccuccagcaagggaagagagguguguguccacaggaaggggcuccguggggaucccau

SEQ ID NO: 142382 - RNA, 64 nt, Human
gaaccuggcugcgaacugugcaguuacguugcauccacaggauuccaguugcgugucuguuucc

SEQ ID NO: 142383 - RNA, 64 nt, Human
uggcugugaaaauuacacccaugcacagaacaagccacaggaauaauaguucaggauuugguuu

SEQ ID NO: 142384 - RNA, 64 nt, Human
cgagucuccuaaguccccgucagugugguuuucaccacaggacugucucuugucguuuuccccu

SEQ ID NO: 142385 - RNA, 64 nt, Human
caucugguuauagguacuguagcagggauaggugccacaggaggauaggaacuacagcagaucg

SEQ ID NO: 142386 - RNA, 64 nt, Human
cucagagagcaccaucccgggggucagggccuccccacaggagcccugcagugugguagcgcca

SEQ ID NO: 142387 - RNA, 64 nt, Human
ugcccucagccccacuccuguucugcaacuguccccacaggaaggggcucuguucccuguauug

SEQ ID NO: 142388 - RNA, 64 nt, Human
aggcaaaagaccaggcugacuggaagauggaaagccacaggaaggaagcggcaccugaugguga

SEQ ID NO: 142389 - RNA, 64 nt, Human
agcaugcacaugcugucuggcccuggggaucuucccacaggagggccagcgcuguggaccuuac

SEQ ID NO: 142390 - RNA, 64 nt, Human
caggaagaugcucugacagaugccaugguaugggccacaggacacacuugcucgagaaccaaag

SEQ ID NO: 142391 - RNA, 64 nt, Human
caggcaagaacuaauucaaaaggcagaucagaaaccacaggagucaaaauuauugcuccggcag

SEQ ID NO: 142392 - RNA, 64 nt, Human
acccccaccaccuguccccacccagugucccaggccacaggagcuuauuggccaggagggaaua

SEQ ID NO: 142393 - RNA, 64 nt, Human
agcuggaagcagacaguaaggggaagagcugcucccacaggagagggagagauuccagcucacu

SEQ ID NO: 142394 - RNA, 64 nt, Human
gagagcugccagccugaggugcccacuccgccagccacaggaccaccuccucugccagcaggaa

SEQ ID NO: 142395 - RNA, 64 nt, Human
aguucuugugacugagggagauuuucuggaagggccacaggagguugcggagcuuggauguugc

SEQ ID NO: 142396 - RNA, 64 nt, Human
ggaagggaauacaaagguauccauggagguagcaccacaggaagcaggcaucacacuugaggcu

SEQ ID NO: 142397 - RNA, 64 nt, Human
ucacacacaccugccuaaagacagggauggcuguccacaggauccuccagccccgugagaggga

SEQ ID NO: 142398 - RNA, 64 nt, Human
cugaagccaaaguuaugcaagggacuguguguugccacaggacacagucagauuuccagucucc

SEQ ID NO: 142399 - RNA, 64 nt, Human
ccuuagccccagcgccagggccucccagcugaggccacaggacaagcacuuuuuuaugauguac

SEQ ID NO: 142400 - RNA, 64 nt, Human
uauuuucuauggaccaaccagauuaauuuaaaugccacaggaaacaaacuuuaugugugugugu

SEQ ID NO: 142401 - RNA, 64 nt, Human
ugccauuuaccagcagcccuggcauguuccugccccacaggaauagaauggagggagcuccaga

SEQ ID NO: 142402 - RNA, 64 nt, Human
ucuuugaagacaucuacaaagccauuuagaucaaccacaggaaggauccucaaguccugacuuu

SEQ ID NO: 142403 - RNA, 64 nt, Human
cccagacccauccugccacuucuaugucucuggaccacaggauggugguggcauugcagguugg

SEQ ID NO: 142404 - RNA, 64 nt, Human
uuaauauauucauguuugaaaugaaugcuuugaaccacaggagggagauguugucaaaugcuac

SEQ ID NO: 142405 - RNA, 64 nt, Human
gaagggccauggacccaacugggccccagaagagccacaggaacaucauuccucucccgcaacc

SEQ ID NO: 142406 - RNA, 64 nt, Human
gggggcaggaaucccgggugcuccacugcuuaaaccacaggaccugguuaacuccucaccaagc

SEQ ID NO: 142407 - RNA, 64 nt, Human
ggcucaaagcccuuccuaccucuggugaugguuuccacaggaacaacagcaucuuucaccaaga

SEQ ID NO: 142408 - RNA, 64 nt, Human
guggcuggcugucuggccgucucgccccgccccuccacaggacccuggaccagggcggugcagg

SEQ ID NO: 142409 - RNA, 64 nt, Human
ugggauuuuuauccaauaguuuggccuggugugcccacaggaugggaacagggaggcaccauca

SEQ ID NO: 142410 - RNA, 64 nt, Human
ccagcaggcgcaaccagagucucgugugugccgaccacaggagccaagccuuuuccacugugug

SEQ ID NO: 142411 - RNA, 64 nt, Human
cuuguugcauuaguucuccuguauguuccuucuuccacaggaauguauuugugcauauguucuu

SEQ ID NO: 142412 - RNA, 64 nt, Human
gucaggauuuugggggaaagcuaguuacugauagccacaggaaguugagacuucugccccauuc

SEQ ID NO: 142413 - RNA, 64 nt, Human
gcuccuucucuucccccaacacucccaaagauacccacaggaaguccagccaguuuccagguag

SEQ ID NO: 142414 - RNA, 64 nt, Human
cauguuuuccaaagcagguuugggcaaaauuaauccacaggacugaaagguauacaucugugag

SEQ ID NO: 142415 - RNA, 64 nt, Human
acuugggaagcaguauuacuagaucuggaggcaaccacaggacacuaaacuucucccagccucu

SEQ ID NO: 142416 - RNA, 64 nt, Human
ucuuucuguuucuaaaacacagaacuuacaagagccacaggagccaauuauagcaccugacaga

SEQ ID NO: 142417 - RNA, 64 nt, Human
ugcauucuauuuauugugaauaauuugaguguuuccacaggaaagugguaugaaucauaucguc

SEQ ID NO: 142418 - RNA, 64 nt, Human
augcccuggggugauggggacccccucgcugucuccacaggacccuuccccuccaggggugcag

SEQ ID NO: 142419 - RNA, 64 nt, Human
caagcacuccccagcagcccuuggccucugccguccacaggacgcccucuugcucccggaaacg

SEQ ID NO: 142420 - RNA, 64 nt, Human
caggaaccgacacucagacacaaggcaaagagggccacaggacccgggaaauacacacagagcc

SEQ ID NO: 142421 - RNA, 64 nt, Human
accacgcccagaggaggggaggcacuggcccccgccacaggacuggagacgcaagaacaaaaag

SEQ ID NO: 142422 - RNA, 64 nt, Human
uuccugucccccgcuuacacgacaacgggccagaccacaggaaggacgguguuugugucugagg

SEQ ID NO: 142423 - RNA, 64 nt, Human
cucuggucaggaaauguccaguguuuccuguuauccacaggagaauguaaugccucaguucauu

SEQ ID NO: 142424 - RNA, 64 nt, Human
cauuugagcaacuugggaacaauuugguaacacaccacaggaaguagcucucccccccagcccc

SEQ ID NO: 142425 - RNA, 64 nt, Human
ggguguccucaucuggugugucuacuggagggucccacaggagaggcagcagaggggucagggg

SEQ ID NO: 142426 - RNA, 64 nt, Human
ugagagauguuuugaaaaacuagccaggacacacccacaggauccuacuggcuccuuagcagcu

SEQ ID NO: 142427 - RNA, 64 nt, Human
gcucugggugggccaaggcgaaggcuucccaucaccacaggaagcgggggcuugcagggaaagu

SEQ ID NO: 142428 - RNA, 64 nt, Human
uggagacccaggagcaagucagcacaggcucugcccacaggaggcaugcacaaucugguaggag

SEQ ID NO: 142429 - RNA, 64 nt, Human
gccggucccucugcuggggaugcaccaaugaaccccacaggaagggggaaggaaggagggaauu

SEQ ID NO: 142430 - RNA, 64 nt, Human
gcgcaucgcccaugagaacaccugcccccaggccccacaggaugggcccccagguaagcacagg

SEQ ID NO: 142431 - RNA, 64 nt, Human
cauccaugagccgggcugccgggugccccagguaccacaggacuuugcagggagccuggacucc

SEQ ID NO: 142432 - RNA, 64 nt, Human
agugcuucugugaacgugaauuuuguucaguuguccacaggagauccacauaauuccuagcacu

SEQ ID NO: 142433 - RNA, 64 nt, Human
gucaugucccaggucccgugcuccuugagguuauccacaggaacauccagaaccuguugaacaa

SEQ ID NO: 142434 - RNA, 64 nt, Human
uugucuggacuucggaguuggggguggucagacaccacaggagcugucaccuccugcggauggg

SEQ ID NO: 142435 - RNA, 64 nt, Human
cguggagacauggccuagggggccaggcccggcuccacaggagucuccuucaggacuggugugg

SEQ ID NO: 142436 - RNA, 64 nt, Human
cauggcaggacagagcgggaggccgggccuugggccacaggagaccagcucagggcggaagguc

SEQ ID NO: 142437 - RNA, 64 nt, Human
ucuucccaagcccgagcagagggucaugcgggccccacaggagaagcggccagggcccgcgggg

SEQ ID NO: 142438 - RNA, 64 nt, Human
cacacaaaucagugaauggaucccaacaccccaaccacaggagcacggauucccuguaccucaa

SEQ ID NO: 142439 - RNA, 64 nt, Human
cccacaccucagccacuggagacugaugauccaaccacaggaucccuacucuuuggccacgaga

SEQ ID NO: 142440 - RNA, 64 nt, Human
aaaaccagagaaggugaaggggggcugcacugagccacaggaacaaugauggagauuccagcua

SEQ ID NO: 142441 - RNA, 64 nt, Human
cucucccucugcuucccugggggagccccgacggccacaggacuccagcuccaaguggguuuuc

SEQ ID NO: 142442 - RNA, 64 nt, Human
gcucaguucuuacaccgucuccacuuguggagagccacaggaagagaaggaagaccagcgcaug

SEQ ID NO: 142443 - RNA, 64 nt, Human
cguucccccgacccuggcacacgggccaagguacccacaggaucccauccccucccgcacagcc

SEQ ID NO: 142444 - RNA, 64 nt, Human
gcucugggugggccgggacaaaggccucucaucaccacaggaagcgggggcuugcaaggaaagu

SEQ ID NO: 142445 - RNA, 64 nt, Human
aggaccgggacagcaggccccuugacagccccucccacaggaugugggcucugaggccuaaacc

SEQ ID NO: 142446 - RNA, 64 nt, Human
uggacuauauaaauaccuucguauauauggcagaccacaggacuucuguccaagagaacugagu

SEQ ID NO: 142447 - RNA, 64 nt, Human
uuggaacuuuucugucucagugugauccacuaacccacaggaucauuuggaaccuugaauagcu

SEQ ID NO: 142448 - RNA, 64 nt, Human
acccugcuguucagacuugauaagaucucagaguccacaggaaagaagucacuguugcaauaaa

SEQ ID NO: 142449 - RNA, 64 nt, Human
cuggcuaaaaagaaaggaagauaacauccaguaaccacaggaauauauucucugugaauuaaaa

SEQ ID NO: 142450 - RNA, 64 nt, Human
gaaaaagaaaagaaagcaagaacagaaaacgaagccacaggaagggaaguagacauuguaugcu

SEQ ID NO: 142451 - RNA, 64 nt, Human
aacucugagcuugugcccagaaauuaccccaagaccacaggaacccuucaagaagcucccauca

SEQ ID NO: 142452 - RNA, 64 nt, Human
ucaccuccccuucccucuugcccagggaacucuuccacaggacaaagccgacaucaagacucaa

SEQ ID NO: 142453 - RNA, 64 nt, Human
cuuauuauggaccgucauugagggguaacuccucccacaggaaccccaguugacaguuuaaaag

SEQ ID NO: 142454 - RNA, 64 nt, Human
gguaggccugagcgccagagucgcccagguuagcccacaggauuccuuugugugccauggaaug

SEQ ID NO: 142455 - RNA, 64 nt, Human
ccuccugagugccccacuucuggccacaucagccccacaggacuuugaugaagaccauuuucug

SEQ ID NO: 142456 - RNA, 64 nt, Human
gagaagcuggccgggaccagccaggagcugggagccacaggaagcaaaagucagccuuuucuuc

SEQ ID NO: 142457 - RNA, 64 nt, Human
cggguuccuugaaccccacaaaaucccucuccaaccacaggacccuucggcucaccaagaacag

SEQ ID NO: 142458 - RNA, 64 nt, Human
ucuauuuuucaucccugggcccugacaaguuuuuccacaggaauauguaucauggaagaauaga

SEQ ID NO: 142459 - RNA, 64 nt, Human
ggcguauaacauuauuuucaaggaacuccaagggccacaggagcugacagguuuuucaauuaau

SEQ ID NO: 142460 - RNA, 64 nt, Human
uguccacguggcagcuuggggaccuaauauagccccacaggacuaugugauuggcccacacaag

SEQ ID NO: 142461 - RNA, 64 nt, Human
uacaugggauccuguggcucucccguugcagaggccacaggaagauaggauggaacgugacugg

SEQ ID NO: 142462 - RNA, 64 nt, Human
cacuuccaaguaaaagaugagaaaucaauuauucccacaggauuuuaggucagggagcaaaaau

SEQ ID NO: 142463 - RNA, 64 nt, Human
ugcaggggccacucucuacugguaggaagagguaccacaggaagccgccuagugcagagagguu

SEQ ID NO: 142464 - RNA, 64 nt, Human
gcaaagaaugccgagcagcacuuccagucuccacccacaggacgccaguagcacccucuaaguu

SEQ ID NO: 142465 - RNA, 64 nt, Human
ccugaacgcucccaaccugccucccgcccggaagccacaggacccacucaugugugugcccaca

SEQ ID NO: 142466 - RNA, 64 nt, Human
agugagugggcuccccgcugucacugccagucacccacaggaagggacuggugaugggcugucu

SEQ ID NO: 142467 - RNA, 64 nt, Human
ggccucuuggauaccagcucaggggacacuggccccacaggaguugugagcccucuagggcagg

SEQ ID NO: 142468 - RNA, 64 nt, Human
agcuagccuacgcggggauggccgucaguucuggccacaggacccgagucugggcuuggguccc

SEQ ID NO: 142469 - RNA, 64 nt, Human
caugggcauugcuggacugaugguugcuuugagcccacaggagcucccuuuuugaauugugugg

SEQ ID NO: 142470 - RNA, 64 nt, Human
aggcaugcaauaugccagaacuacagacaacagcccacaggaugcaaaagugcuuugccaucuu

SEQ ID NO: 142471 - RNA, 64 nt, Human
caccguggcuuggucauagggugaguguaaacacccacaggacacugggggcugucacccugcu

SEQ ID NO: 142472 - RNA, 64 nt, Human
augcauguuuauuugaggggauguggcacugagcccacaggaguaaaagcccaguuugcuagga

SEQ ID NO: 142473 - RNA, 64 nt, Human
ugggugacagcugugcaggcugugcgugcccuugccacaggacaggugcguggggugugggggu

SEQ ID NO: 142474 - RNA, 64 nt, Human
aagugggugguggaguggcagggagugcugagugccacaggaagucagacaaggaaggagagug

SEQ ID NO: 142475 - RNA, 64 nt, Human
ggagaagggcugcuacuuaacaaggaaguccuggccacaggaguccccuacuggcugcagagga

SEQ ID NO: 142476 - RNA, 64 nt, Human
aagaauuauuuuugcauaugaaagaggccagaacccacaggaaaaacuucaaaacuugacauuu

SEQ ID NO: 142477 - RNA, 64 nt, Human
aggggaggacucagaggccaucugcagggccaagccacaggaagggcugagcuggaggugggca

SEQ ID NO: 142478 - RNA, 64 nt, Human
accccaagaccccaagccuugacuccagcugcgcccacaggaaguccagucccgacagugcccu

SEQ ID NO: 142479 - RNA, 64 nt, Human
gaagaggauagagaaggaucugcuccgccuuuggccacaggagcagaggcagaccugggaugcc

SEQ ID NO: 142480 - RNA, 64 nt, Human
cuuaaguucucacaucacacucaaaccagugacaccacaggaaagaaagacccaagacguugga

SEQ ID NO: 142481 - RNA, 64 nt, Human
ggcccugcuaggguggcaccagacuucucuggucccacaggacagccaguggccucccaacuug

SEQ ID NO: 142482 - RNA, 64 nt, Human
cuccuuggucacccucugcuccaggccuucuccaccacaggaccucagcugucccuccuucuac

SEQ ID NO: 142483 - RNA, 64 nt, Human
guucaguucccacucuaauacucacacagcuccuccacaggagacuucuggagcaagcaggacc

SEQ ID NO: 142484 - RNA, 64 nt, Human
ucgaugaggccucgauuugaaucaauggggugggccacaggaaaugucagaggaaccagaacuc

SEQ ID NO: 142485 - RNA, 64 nt, Human
ugucaccacauccugagcacucggccccauccccccacaggagggaagcuguggucugacggaa

SEQ ID NO: 142486 - RNA, 63 nt, Human
accgacagaacaugggcugaucuucccacaacaccacaggacugcagggugcacaacuccccu

SEQ ID NO: 142487 - RNA, 64 nt, Human
cuccaaguauuucagaaugauuuaaaaagucaugccacaggaagggucuauugcagaauuucaa

SEQ ID NO: 142488 - RNA, 64 nt, Human
ucugccccgcccagcuuugcauauccauguucuaccacaggaagguggccugccaagagucugc

SEQ ID NO: 142489 - RNA, 64 nt, Human
ugugauacauaaaacuagauaacuuugaaaaaagccacaggagaaaaaucuucaggaucuuggg

SEQ ID NO: 142490 - RNA, 64 nt, Human
gagagugagcuggggaacaggaaagucuggggagccacaggagagggaccuugcacccucuuug

SEQ ID NO: 142491 - RNA, 64 nt, Human
cuggcugaccaagaagccaaaguuaacuugcaggccacaggacauagccaccugaagagccagu

SEQ ID NO: 142492 - RNA, 64 nt, Human
uugucugcuugcugcacagcagaaauuacaccauccacaggaaauggacuauuuuugcagucca

SEQ ID NO: 142493 - RNA, 64 nt, Human
cucaggcucccccggcccacccugcucagugaccccacaggaagcuuacacauuuucucagagg

SEQ ID NO: 142494 - RNA, 64 nt, Human
gucccuugaacuacuggguguagacuggccugaaccacaggagaggauggcccagggugaggug

SEQ ID NO: 142495 - RNA, 64 nt, Human
guuagaguauauucugaaaccaacuugucccaggccacaggaguguauauguuucauaaucuuu

SEQ ID NO: 142496 - RNA, 64 nt, Human
uacggaguggaggguacagacgcuugccuaucugccacaggaggacugggcccccacgucccug

SEQ ID NO: 142497 - RNA, 64 nt, Human; identical to SEQ ID NO: 41719

SEQ ID NO: 142498 - RNA, 64 nt, Human; identical to SEQ ID NO: 41720

SEQ ID NO: 142499 - RNA, 64 nt, Human; identical to SEQ ID NO: 41721

SEQ ID NO: 142500 - RNA, 64 nt, Human; identical to SEQ ID NO: 41722

SEQ ID NO: 142501 - RNA, 64 nt, Human; identical to SEQ ID NO: 41723

SEQ ID NO: 142502 - RNA, 64 nt, Human; identical to SEQ ID NO: 41724

SEQ ID NO: 142503 - RNA, 64 nt, Human; identical to SEQ ID NO: 41725

SEQ ID NO: 142504 - RNA, 64 nt, Human; identical to SEQ ID NO: 41726

SEQ ID NO: 142505 - RNA, 64 nt, Human; identical to SEQ ID NO: 41727

SEQ ID NO: 142506 - RNA, 64 nt, Human; identical to SEQ ID NO: 41728

SEQ ID NO: 142507 - RNA, 61 nt, Human; identical to SEQ ID NO: 41729

SEQ ID NO: 142508 - RNA, 64 nt, Human; identical to SEQ ID NO: 41730

SEQ ID NO: 142509 - RNA, 64 nt, Human; identical to SEQ ID NO: 41731

SEQ ID NO: 142510 - RNA, 64 nt, Human; identical to SEQ ID NO: 41732

SEQ ID NO: 142511 - RNA, 64 nt, Human; identical to SEQ ID NO: 41733

SEQ ID NO: 142512 - RNA, 64 nt, Human; identical to SEQ ID NO: 41734

SEQ ID NO: 142513 - RNA, 64 nt, Human; identical to SEQ ID NO: 41735

SEQ ID NO: 142514 - RNA, 64 nt, Human; identical to SEQ ID NO: 41736

SEQ ID NO: 142515 - RNA, 64 nt, Human; identical to SEQ ID NO: 41737

SEQ ID NO: 142516 - RNA, 64 nt, Human; identical to SEQ ID NO: 41738

SEQ ID NO: 142517 - RNA, 64 nt, Human; identical to SEQ ID NO: 41739

SEQ ID NO: 142518 - RNA, 64 nt, Human; identical to SEQ ID NO: 41740

SEQ ID NO: 142519 - RNA, 64 nt, Human; identical to SEQ ID NO: 41741

SEQ ID NO: 142520 - RNA, 64 nt, Human; identical to SEQ ID NO: 41742

SEQ ID NO: 142521 - RNA, 64 nt, Human; identical to SEQ ID NO: 41743

SEQ ID NO: 142522 - RNA, 64 nt, Human; identical to SEQ ID NO: 41744

SEQ ID NO: 142523 - RNA, 64 nt, Human; identical to SEQ ID NO: 41745

SEQ ID NO: 142524 - RNA, 64 nt, Human; identical to SEQ ID NO: 41746

SEQ ID NO: 142525 - RNA, 64 nt, Human; identical to SEQ ID NO: 41747

SEQ ID NO: 142526 - RNA, 64 nt, Human; identical to SEQ ID NO: 41748

SEQ ID NO: 142527 - RNA, 64 nt, Human; identical to SEQ ID NO: 41749

SEQ ID NO: 142528 - RNA, 64 nt, Human; identical to SEQ ID NO: 41750

SEQ ID NO: 142529 - RNA, 64 nt, Human; identical to SEQ ID NO: 41751

SEQ ID NO: 142530 - RNA, 64 nt, Human; identical to SEQ ID NO: 41752

SEQ ID NO: 142531 - RNA, 64 nt, Human; identical to SEQ ID NO: 41753

SEQ ID NO: 142532 - RNA, 64 nt, Human; identical to SEQ ID NO: 41754

SEQ ID NO: 142533 - RNA, 64 nt, Human; identical to SEQ ID NO: 41755

SEQ ID NO: 142534 - RNA, 64 nt, Human; identical to SEQ ID NO: 41756

SEQ ID NO: 142535 - RNA, 64 nt, Human; identical to SEQ ID NO: 41757

SEQ ID NO: 142536 - RNA, 64 nt, Human; identical to SEQ ID NO: 41758

SEQ ID NO: 142537 - RNA, 64 nt, Human; identical to SEQ ID NO: 41759

SEQ ID NO: 142538 - RNA, 64 nt, Human; identical to SEQ ID NO: 41760

SEQ ID NO: 142539 - RNA, 64 nt, Human; identical to SEQ ID NO: 41761

SEQ ID NO: 142540 - RNA, 64 nt, Human; identical to SEQ ID NO: 41762

SEQ ID NO: 142541 - RNA, 64 nt, Human; identical to SEQ ID NO: 41763

SEQ ID NO: 142542 - RNA, 64 nt, Human; identical to SEQ ID NO: 41764

SEQ ID NO: 142543 - RNA, 64 nt, Human; identical to SEQ ID NO: 41765

SEQ ID NO: 142544 - RNA, 64 nt, Human; identical to SEQ ID NO: 41766

SEQ ID NO: 142545 - RNA, 64 nt, Human; identical to SEQ ID NO: 41767

SEQ ID NO: 142546 - RNA, 64 nt, Human; identical to SEQ ID NO: 41768

SEQ ID NO: 142547 - RNA, 64 nt, Human; identical to SEQ ID NO: 41769

SEQ ID NO: 142548 - RNA, 64 nt, Human; identical to SEQ ID NO: 41770

SEQ ID NO: 142549 - RNA, 58 nt, Human; identical to SEQ ID NO: 41771

SEQ ID NO: 142550 - RNA, 64 nt, Human; identical to SEQ ID NO: 41772

SEQ ID NO: 142551 - RNA, 64 nt, Human; identical to SEQ ID NO: 41773

SEQ ID NO: 142552 - RNA, 64 nt, Human; identical to SEQ ID NO: 41774

SEQ ID NO: 142553 - RNA, 64 nt, Human; identical to SEQ ID NO: 41775

SEQ ID NO: 142554 - RNA, 64 nt, Human; identical to SEQ ID NO: 41776

SEQ ID NO: 142555 - RNA, 64 nt, Human; identical to SEQ ID NO: 41777

SEQ ID NO: 142556 - RNA, 64 nt, Human; identical to SEQ ID NO: 41778

SEQ ID NO: 142557 - RNA, 64 nt, Human; identical to SEQ ID NO: 41779

SEQ ID NO: 142558 - RNA, 64 nt, Human; identical to SEQ ID NO: 41780

SEQ ID NO: 142559 - RNA, 64 nt, Human; identical to SEQ ID NO: 41781

SEQ ID NO: 142560 - RNA, 64 nt, Human; identical to SEQ ID NO: 41782

SEQ ID NO: 142561 - RNA, 64 nt, Human; identical to SEQ ID NO: 41783

SEQ ID NO: 142562 - RNA, 64 nt, Human; identical to SEQ ID NO: 41784

SEQ ID NO: 142563 - RNA, 64 nt, Human; identical to SEQ ID NO: 41785

SEQ ID NO: 142564 - RNA, 64 nt, Human; identical to SEQ ID NO: 41786

SEQ ID NO: 142565 - RNA, 64 nt, Human; identical to SEQ ID NO: 41787

SEQ ID NO: 142566 - RNA, 64 nt, Human; identical to SEQ ID NO: 41788

SEQ ID NO: 142567 - RNA, 64 nt, Human; identical to SEQ ID NO: 41789

SEQ ID NO: 142568 - RNA, 64 nt, Human; identical to SEQ ID NO: 41790

SEQ ID NO: 142569 - RNA, 64 nt, Human; identical to SEQ ID NO: 41791

SEQ ID NO: 142570 - RNA, 64 nt, Human; identical to SEQ ID NO: 41792

SEQ ID NO: 142571 - RNA, 64 nt, Human; identical to SEQ ID NO: 41793

SEQ ID NO: 142572 - RNA, 64 nt, Human; identical to SEQ ID NO: 41794

SEQ ID NO: 142573 - RNA, 64 nt, Human; identical to SEQ ID NO: 41795

SEQ ID NO: 142574 - RNA, 64 nt, Human; identical to SEQ ID NO: 41796

SEQ ID NO: 142575 - RNA, 64 nt, Human; identical to SEQ ID NO: 41797

SEQ ID NO: 142576 - RNA, 64 nt, Human; identical to SEQ ID NO: 41798

SEQ ID NO: 142577 - RNA, 64 nt, Human; identical to SEQ ID NO: 41799

SEQ ID NO: 142578 - RNA, 64 nt, Human; identical to SEQ ID NO: 41800

SEQ ID NO: 142579 - RNA, 64 nt, Human; identical to SEQ ID NO: 41801

SEQ ID NO: 142580 - RNA, 64 nt, Human; identical to SEQ ID NO: 41802

SEQ ID NO: 142581 - RNA, 64 nt, Human; identical to SEQ ID NO: 41803

SEQ ID NO: 142582 - RNA, 64 nt, Human; identical to SEQ ID NO: 41804

SEQ ID NO: 142583 - RNA, 64 nt, Human; identical to SEQ ID NO: 41805

SEQ ID NO: 142584 - RNA, 64 nt, Human; identical to SEQ ID NO: 41806

SEQ ID NO: 142585 - RNA, 64 nt, Human; identical to SEQ ID NO: 41807

SEQ ID NO: 142586 - RNA, 64 nt, Human; identical to SEQ ID NO: 41808

SEQ ID NO: 142587 - RNA, 64 nt, Human; identical to SEQ ID NO: 41809

SEQ ID NO: 142588 - RNA, 64 nt, Human; identical to SEQ ID NO: 41810

SEQ ID NO: 142589 - RNA, 64 nt, Human; identical to SEQ ID NO: 41811

SEQ ID NO: 142590 - RNA, 64 nt, Human; identical to SEQ ID NO: 41812

SEQ ID NO: 142591 - RNA, 64 nt, Human; identical to SEQ ID NO: 41813

SEQ ID NO: 142592 - RNA, 64 nt, Human; identical to SEQ ID NO: 41814

SEQ ID NO: 142593 - RNA, 64 nt, Human; identical to SEQ ID NO: 41815

SEQ ID NO: 142594 - RNA, 64 nt, Human; identical to SEQ ID NO: 41816

SEQ ID NO: 142595 - RNA, 64 nt, Human; identical to SEQ ID NO: 41817

SEQ ID NO: 142596 - RNA, 64 nt, Human; identical to SEQ ID NO: 41818

SEQ ID NO: 142597 - RNA, 64 nt, Human; identical to SEQ ID NO: 41819

SEQ ID NO: 142598 - RNA, 64 nt, Human; identical to SEQ ID NO: 41820

SEQ ID NO: 142599 - RNA, 64 nt, Human; identical to SEQ ID NO: 41821

SEQ ID NO: 142600 - RNA, 64 nt, Human; identical to SEQ ID NO: 41822

SEQ ID NO: 142601 - RNA, 64 nt, Human; identical to SEQ ID NO: 41823

SEQ ID NO: 142602 - RNA, 64 nt, Human; identical to SEQ ID NO: 41824

SEQ ID NO: 142603 - RNA, 64 nt, Human; identical to SEQ ID NO: 41825

SEQ ID NO: 142604 - RNA, 64 nt, Human; identical to SEQ ID NO: 41826

SEQ ID NO: 142605 - RNA, 64 nt, Human; identical to SEQ ID NO: 41827

SEQ ID NO: 142606 - RNA, 64 nt, Human; identical to SEQ ID NO: 41828

SEQ ID NO: 142607 - RNA, 64 nt, Human; identical to SEQ ID NO: 41829

SEQ ID NO: 142608 - RNA, 64 nt, Human; identical to SEQ ID NO: 41830

SEQ ID NO: 142609 - RNA, 64 nt, Human; identical to SEQ ID NO: 41831

SEQ ID NO: 142610 - RNA, 64 nt, Human; identical to SEQ ID NO: 41832

SEQ ID NO: 142611 - RNA, 64 nt, Human; identical to SEQ ID NO: 41833

SEQ ID NO: 142612 - RNA, 64 nt, Human; identical to SEQ ID NO: 41834

SEQ ID NO: 142613 - RNA, 64 nt, Human; identical to SEQ ID NO: 41835

SEQ ID NO: 142614 - RNA, 64 nt, Human; identical to SEQ ID NO: 41836

SEQ ID NO: 142615 - RNA, 64 nt, Human; identical to SEQ ID NO: 41837

SEQ ID NO: 142616 - RNA, 64 nt, Human; identical to SEQ ID NO: 41838

SEQ ID NO: 142617 - RNA, 64 nt, Human; identical to SEQ ID NO: 41839

SEQ ID NO: 142618 - RNA, 64 nt, Human; identical to SEQ ID NO: 41840

SEQ ID NO: 142619 - RNA, 64 nt, Human; identical to SEQ ID NO: 41841

SEQ ID NO: 142620 - RNA, 64 nt, Human; identical to SEQ ID NO: 41842

SEQ ID NO: 142621 - RNA, 64 nt, Human; identical to SEQ ID NO: 41843

SEQ ID NO: 142622 - RNA, 64 nt, Human; identical to SEQ ID NO: 41844

SEQ ID NO: 142623 - RNA, 64 nt, Human; identical to SEQ ID NO: 41845

SEQ ID NO: 142624 - RNA, 64 nt, Human; identical to SEQ ID NO: 41846

SEQ ID NO: 142625 - RNA, 64 nt, Human; identical to SEQ ID NO: 41847

SEQ ID NO: 142626 - RNA, 64 nt, Human; identical to SEQ ID NO: 41848

SEQ ID NO: 142627 - RNA, 64 nt, Human; identical to SEQ ID NO: 41849

SEQ ID NO: 142628 - RNA, 64 nt, Human; identical to SEQ ID NO: 41850

SEQ ID NO: 142629 - RNA, 64 nt, Human; identical to SEQ ID NO: 41851

SEQ ID NO: 142630 - RNA, 64 nt, Human; identical to SEQ ID NO: 41852

SEQ ID NO: 142631 - RNA, 64 nt, Human; identical to SEQ ID NO: 41853

SEQ ID NO: 142632 - RNA, 64 nt, Human; identical to SEQ ID NO: 41854

SEQ ID NO: 142633 - RNA, 64 nt, Human; identical to SEQ ID NO: 41855

SEQ ID NO: 142634 - RNA, 64 nt, Human; identical to SEQ ID NO: 41856

SEQ ID NO: 142635 - RNA, 64 nt, Human; identical to SEQ ID NO: 41857

SEQ ID NO: 142636 - RNA, 64 nt, Human; identical to SEQ ID NO: 41858

SEQ ID NO: 142637 - RNA, 64 nt, Human; identical to SEQ ID NO: 41859

SEQ ID NO: 142638 - RNA, 64 nt, Human; identical to SEQ ID NO: 41860

SEQ ID NO: 142639 - RNA, 64 nt, Human; identical to SEQ ID NO: 41861

SEQ ID NO: 142640 - RNA, 64 nt, Human; identical to SEQ ID NO: 41862

SEQ ID NO: 142641 - RNA, 64 nt, Human; identical to SEQ ID NO: 41863

SEQ ID NO: 142642 - RNA, 64 nt, Human; identical to SEQ ID NO: 41864

SEQ ID NO: 142643 - RNA, 64 nt, Human; identical to SEQ ID NO: 41865

SEQ ID NO: 142644 - RNA, 64 nt, Human; identical to SEQ ID NO: 41866

SEQ ID NO: 142645 - RNA, 64 nt, Human; identical to SEQ ID NO: 41867

SEQ ID NO: 142646 - RNA, 64 nt, Human; identical to SEQ ID NO: 41868

SEQ ID NO: 142647 - RNA, 64 nt, Human; identical to SEQ ID NO: 41869

SEQ ID NO: 142648 - RNA, 64 nt, Human; identical to SEQ ID NO: 41870

SEQ ID NO: 142649 - RNA, 64 nt, Human; identical to SEQ ID NO: 41871

SEQ ID NO: 142650 - RNA, 64 nt, Human; identical to SEQ ID NO: 41872

SEQ ID NO: 142651 - RNA, 64 nt, Human; identical to SEQ ID NO: 41873

SEQ ID NO: 142652 - RNA, 63 nt, Human; identical to SEQ ID NO: 41874

SEQ ID NO: 142653 - RNA, 64 nt, Human; identical to SEQ ID NO: 41875

SEQ ID NO: 142654 - RNA, 64 nt, Human; identical to SEQ ID NO: 41876

SEQ ID NO: 142655 - RNA, 64 nt, Human; identical to SEQ ID NO: 41877

SEQ ID NO: 142656 - RNA, 64 nt, Human; identical to SEQ ID NO: 41878

SEQ ID NO: 142657 - RNA, 64 nt, Human; identical to SEQ ID NO: 41879

SEQ ID NO: 142658 - RNA, 64 nt, Human; identical to SEQ ID NO: 41880

SEQ ID NO: 142659 - RNA, 64 nt, Human; identical to SEQ ID NO: 41881

SEQ ID NO: 142660 - RNA, 64 nt, Human; identical to SEQ ID NO: 41882

SEQ ID NO: 142661 - RNA, 64 nt, Human; identical to SEQ ID NO: 41883

SEQ ID NO: 142662 - RNA, 64 nt, Human; identical to SEQ ID NO: 41884

SEQ ID NO: 142663 - RNA, 64 nt, Human; identical to SEQ ID NO: 41885

SEQ ID NO: 142664 - RNA, 64 nt, Human; identical to SEQ ID NO: 41886

SEQ ID NO: 142665 - RNA, 64 nt, Human; identical to SEQ ID NO: 41887

SEQ ID NO: 142666 - RNA, 64 nt, Human; identical to SEQ ID NO: 41888

SEQ ID NO: 142667 - RNA, 64 nt, Human; identical to SEQ ID NO: 41889

SEQ ID NO: 142668 - RNA, 64 nt, Human; identical to SEQ ID NO: 41890

SEQ ID NO: 142669 - RNA, 64 nt, Human; identical to SEQ ID NO: 41891

SEQ ID NO: 142670 - RNA, 64 nt, Human; identical to SEQ ID NO: 41892

SEQ ID NO: 142671 - RNA, 64 nt, Human; identical to SEQ ID NO: 41893

SEQ ID NO: 142672 - RNA, 64 nt, Human; identical to SEQ ID NO: 41894

SEQ ID NO: 142673 - RNA, 64 nt, Human; identical to SEQ ID NO: 41895

SEQ ID NO: 142674 - RNA, 64 nt, Human; identical to SEQ ID NO: 41896

SEQ ID NO: 142675 - RNA, 64 nt, Human; identical to SEQ ID NO: 41897

SEQ ID NO: 142676 - RNA, 64 nt, Human; identical to SEQ ID NO: 41898

SEQ ID NO: 142677 - RNA, 64 nt, Human; identical to SEQ ID NO: 41899

SEQ ID NO: 142678 - RNA, 64 nt, Human; identical to SEQ ID NO: 41900

SEQ ID NO: 142679 - RNA, 64 nt, Human; identical to SEQ ID NO: 41901

SEQ ID NO: 142680 - RNA, 64 nt, Human; identical to SEQ ID NO: 41902

SEQ ID NO: 142681 - RNA, 64 nt, Human; identical to SEQ ID NO: 41903

SEQ ID NO: 142682 - RNA, 64 nt, Human; identical to SEQ ID NO: 41904

SEQ ID NO: 142683 - RNA, 64 nt, Human; identical to SEQ ID NO: 41905

SEQ ID NO: 142684 - RNA, 64 nt, Human; identical to SEQ ID NO: 41906

SEQ ID NO: 142685 - RNA, 64 nt, Human; identical to SEQ ID NO: 41907

SEQ ID NO: 142686 - RNA, 64 nt, Human; identical to SEQ ID NO: 41908

SEQ ID NO: 142687 - RNA, 64 nt, Human; identical to SEQ ID NO: 41909

SEQ ID NO: 142688 - RNA, 64 nt, Human; identical to SEQ ID NO: 41910

SEQ ID NO: 142689 - RNA, 64 nt, Human; identical to SEQ ID NO: 41911

SEQ ID NO: 142690 - RNA, 64 nt, Human; identical to SEQ ID NO: 41912

SEQ ID NO: 142691 - RNA, 64 nt, Human; identical to SEQ ID NO: 41913

SEQ ID NO: 142692 - RNA, 64 nt, Human; identical to SEQ ID NO: 41914

SEQ ID NO: 142693 - RNA, 64 nt, Human; identical to SEQ ID NO: 41915

SEQ ID NO: 142694 - RNA, 64 nt, Human; identical to SEQ ID NO: 41916

SEQ ID NO: 142695 - RNA, 64 nt, Human; identical to SEQ ID NO: 41917

SEQ ID NO: 142696 - RNA, 64 nt, Human; identical to SEQ ID NO: 41918

SEQ ID NO: 142697 - RNA, 64 nt, Human; identical to SEQ ID NO: 41919

SEQ ID NO: 142698 - RNA, 64 nt, Human; identical to SEQ ID NO: 41920

SEQ ID NO: 142699 - RNA, 64 nt, Human; identical to SEQ ID NO: 41921

SEQ ID NO: 142700 - RNA, 64 nt, Human; identical to SEQ ID NO: 41922

SEQ ID NO: 142701 - RNA, 64 nt, Human; identical to SEQ ID NO: 41923

SEQ ID NO: 142702 - RNA, 64 nt, Human; identical to SEQ ID NO: 41924

SEQ ID NO: 142703 - RNA, 64 nt, Human; identical to SEQ ID NO: 41925

SEQ ID NO: 142704 - RNA, 64 nt, Human; identical to SEQ ID NO: 41926

SEQ ID NO: 142705 - RNA, 64 nt, Human; identical to SEQ ID NO: 41927

SEQ ID NO: 142706 - RNA, 64 nt, Human; identical to SEQ ID NO: 41928

SEQ ID NO: 142707 - RNA, 64 nt, Human; identical to SEQ ID NO: 41929

SEQ ID NO: 142708 - RNA, 64 nt, Human; identical to SEQ ID NO: 41930

SEQ ID NO: 142709 - RNA, 64 nt, Human; identical to SEQ ID NO: 41931

SEQ ID NO: 142710 - RNA, 64 nt, Human; identical to SEQ ID NO: 41932

SEQ ID NO: 142711 - RNA, 64 nt, Human; identical to SEQ ID NO: 41933

SEQ ID NO: 142712 - RNA, 59 nt, Human; identical to SEQ ID NO: 41934

SEQ ID NO: 142713 - RNA, 64 nt, Human; identical to SEQ ID NO: 41935

SEQ ID NO: 142714 - RNA, 64 nt, Human; identical to SEQ ID NO: 41936

SEQ ID NO: 142715 - RNA, 64 nt, Human; identical to SEQ ID NO: 41937

SEQ ID NO: 142716 - RNA, 64 nt, Human; identical to SEQ ID NO: 41938

SEQ ID NO: 142717 - RNA, 64 nt, Human; identical to SEQ ID NO: 41939

SEQ ID NO: 142718 - RNA, 64 nt, Human; identical to SEQ ID NO: 41940

SEQ ID NO: 142719 - RNA, 64 nt, Human; identical to SEQ ID NO: 41941

SEQ ID NO: 142720 - RNA, 64 nt, Human; identical to SEQ ID NO: 41942

SEQ ID NO: 142721 - RNA, 64 nt, Human; identical to SEQ ID NO: 41943

SEQ ID NO: 142722 - RNA, 64 nt, Human; identical to SEQ ID NO: 41944

SEQ ID NO: 142723 - RNA, 64 nt, Human; identical to SEQ ID NO: 41945

SEQ ID NO: 142724 - RNA, 64 nt, Human; identical to SEQ ID NO: 41946

SEQ ID NO: 142725 - RNA, 64 nt, Human; identical to SEQ ID NO: 41947

SEQ ID NO: 142726 - RNA, 64 nt, Human; identical to SEQ ID NO: 41948

SEQ ID NO: 142727 - RNA, 64 nt, Human; identical to SEQ ID NO: 41949

SEQ ID NO: 142728 - RNA, 64 nt, Human; identical to SEQ ID NO: 41950

SEQ ID NO: 142729 - RNA, 64 nt, Human; identical to SEQ ID NO: 41951

SEQ ID NO: 142730 - RNA, 64 nt, Human; identical to SEQ ID NO: 41952

SEQ ID NO: 142731 - RNA, 64 nt, Human; identical to SEQ ID NO: 41953

SEQ ID NO: 142732 - RNA, 64 nt, Human; identical to SEQ ID NO: 41954

SEQ ID NO: 142733 - RNA, 52 nt, Human; identical to SEQ ID NO: 41955

SEQ ID NO: 142734 - RNA, 64 nt, Human; identical to SEQ ID NO: 41956

SEQ ID NO: 142735 - RNA, 64 nt, Human; identical to SEQ ID NO: 41957

SEQ ID NO: 142736 - RNA, 64 nt, Human; identical to SEQ ID NO: 41958

SEQ ID NO: 142737 - RNA, 64 nt, Human; identical to SEQ ID NO: 41959

SEQ ID NO: 142738 - RNA, 64 nt, Human; identical to SEQ ID NO: 41960

SEQ ID NO: 142739 - RNA, 64 nt, Human; identical to SEQ ID NO: 41961

SEQ ID NO: 142740 - RNA, 64 nt, Human; identical to SEQ ID NO: 41962

SEQ ID NO: 142741 - RNA, 64 nt, Human; identical to SEQ ID NO: 41963

SEQ ID NO: 142742 - RNA, 64 nt, Human; identical to SEQ ID NO: 41964

SEQ ID NO: 142743 - RNA, 64 nt, Human; identical to SEQ ID NO: 41965

SEQ ID NO: 142744 - RNA, 64 nt, Human; identical to SEQ ID NO: 41966

SEQ ID NO: 142745 - RNA, 64 nt, Human; identical to SEQ ID NO: 41967

SEQ ID NO: 142746 - RNA, 64 nt, Human; identical to SEQ ID NO: 41968

SEQ ID NO: 142747 - RNA, 64 nt, Human; identical to SEQ ID NO: 41969

SEQ ID NO: 142748 - RNA, 64 nt, Human; identical to SEQ ID NO: 41970

SEQ ID NO: 142749 - RNA, 64 nt, Human; identical to SEQ ID NO: 41971

SEQ ID NO: 142750 - RNA, 64 nt, Human; identical to SEQ ID NO: 41972

SEQ ID NO: 142751 - RNA, 64 nt, Human; identical to SEQ ID NO: 41973

SEQ ID NO: 142752 - RNA, 64 nt, Human; identical to SEQ ID NO: 41974

SEQ ID NO: 142753 - RNA, 64 nt, Human; identical to SEQ ID NO: 41975

SEQ ID NO: 142754 - RNA, 55 nt, Human; identical to SEQ ID NO: 41976

SEQ ID NO: 142755 - RNA, 64 nt, Human; identical to SEQ ID NO: 41977

SEQ ID NO: 142756 - RNA, 64 nt, Human; identical to SEQ ID NO: 41978

SEQ ID NO: 142757 - RNA, 64 nt, Human; identical to SEQ ID NO: 41979

SEQ ID NO: 142758 - RNA, 64 nt, Human; identical to SEQ ID NO: 41980

SEQ ID NO: 142759 - RNA, 64 nt, Human; identical to SEQ ID NO: 41981

SEQ ID NO: 142760 - RNA, 64 nt, Human; identical to SEQ ID NO: 41982

SEQ ID NO: 142761 - RNA, 64 nt, Human; identical to SEQ ID NO: 41983

SEQ ID NO: 142762 - RNA, 64 nt, Human; identical to SEQ ID NO: 41984

SEQ ID NO: 142763 - RNA, 64 nt, Human; identical to SEQ ID NO: 41985

SEQ ID NO: 142764 - RNA, 64 nt, Human; identical to SEQ ID NO: 41986

SEQ ID NO: 142765 - RNA, 64 nt, Human; identical to SEQ ID NO: 41987

SEQ ID NO: 142766 - RNA, 64 nt, Human; identical to SEQ ID NO: 41988

SEQ ID NO: 142767 - RNA, 64 nt, Human; identical to SEQ ID NO: 41989

SEQ ID NO: 142768 - RNA, 64 nt, Human; identical to SEQ ID NO: 41990

SEQ ID NO: 142769 - RNA, 64 nt, Human; identical to SEQ ID NO: 41991

SEQ ID NO: 142770 - RNA, 52 nt, Human; identical to SEQ ID NO: 41992

SEQ ID NO: 142771 - RNA, 64 nt, Human; identical to SEQ ID NO: 41993

SEQ ID NO: 142772 - RNA, 64 nt, Human; identical to SEQ ID NO: 41994

SEQ ID NO: 142773 - RNA, 64 nt, Human; identical to SEQ ID NO: 41995

SEQ ID NO: 142774 - RNA, 64 nt, Human; identical to SEQ ID NO: 41996

SEQ ID NO: 142775 - RNA, 64 nt, Human; identical to SEQ ID NO: 41997

SEQ ID NO: 142776 - RNA, 64 nt, Human; identical to SEQ ID NO: 41998

SEQ ID NO: 142777 - RNA, 64 nt, Human; identical to SEQ ID NO: 41999

SEQ ID NO: 142778 - RNA, 64 nt, Human; identical to SEQ ID NO: 42000

SEQ ID NO: 142779 - RNA, 64 nt, Human; identical to SEQ ID NO: 42001

SEQ ID NO: 142780 - RNA, 64 nt, Human; identical to SEQ ID NO: 42002

SEQ ID NO: 142781 - RNA, 64 nt, Human; identical to SEQ ID NO: 42003

SEQ ID NO: 142782 - RNA, 64 nt, Human; identical to SEQ ID NO: 42004

SEQ ID NO: 142783 - RNA, 64 nt, Human; identical to SEQ ID NO: 42005

SEQ ID NO: 142784 - RNA, 64 nt, Human; identical to SEQ ID NO: 42006

SEQ ID NO: 142785 - RNA, 64 nt, Human; identical to SEQ ID NO: 42007

SEQ ID NO: 142786 - RNA, 64 nt, Human; identical to SEQ ID NO: 42008

SEQ ID NO: 142787 - RNA, 64 nt, Human; identical to SEQ ID NO: 42009

SEQ ID NO: 142788 - RNA, 64 nt, Human; identical to SEQ ID NO: 42010

SEQ ID NO: 142789 - RNA, 64 nt, Human; identical to SEQ ID NO: 42011

SEQ ID NO: 142790 - RNA, 64 nt, Human; identical to SEQ ID NO: 42012

SEQ ID NO: 142791 - RNA, 64 nt, Human; identical to SEQ ID NO: 42013

SEQ ID NO: 142792 - RNA, 64 nt, Human; identical to SEQ ID NO: 42014

SEQ ID NO: 142793 - RNA, 64 nt, Human; identical to SEQ ID NO: 42015

SEQ ID NO: 142794 - RNA, 64 nt, Human; identical to SEQ ID NO: 42016

SEQ ID NO: 142795 - RNA, 64 nt, Human; identical to SEQ ID NO: 42017

SEQ ID NO: 142796 - RNA, 64 nt, Human; identical to SEQ ID NO: 42018

SEQ ID NO: 142797 - RNA, 64 nt, Human; identical to SEQ ID NO: 42019

SEQ ID NO: 142798 - RNA, 64 nt, Human; identical to SEQ ID NO: 42020

SEQ ID NO: 142799 - RNA, 64 nt, Human; identical to SEQ ID NO: 42021

SEQ ID NO: 142800 - RNA, 64 nt, Human; identical to SEQ ID NO: 42022

SEQ ID NO: 142801 - RNA, 64 nt, Human; identical to SEQ ID NO: 42023

SEQ ID NO: 142802 - RNA, 64 nt, Human; identical to SEQ ID NO: 42024

SEQ ID NO: 142803 - RNA, 64 nt, Human; identical to SEQ ID NO: 42025

SEQ ID NO: 142804 - RNA, 64 nt, Human; identical to SEQ ID NO: 42026

SEQ ID NO: 142805 - RNA, 64 nt, Human; identical to SEQ ID NO: 42027

SEQ ID NO: 142806 - RNA, 64 nt, Human; identical to SEQ ID NO: 42028

SEQ ID NO: 142807 - RNA, 64 nt, Human; identical to SEQ ID NO: 42029

SEQ ID NO: 142808 - RNA, 64 nt, Human; identical to SEQ ID NO: 42030

SEQ ID NO: 142809 - RNA, 64 nt, Human; identical to SEQ ID NO: 42031

SEQ ID NO: 142810 - RNA, 64 nt, Human; identical to SEQ ID NO: 42032

SEQ ID NO: 142811 - RNA, 64 nt, Human; identical to SEQ ID NO: 42033

SEQ ID NO: 142812 - RNA, 62 nt, Human; identical to SEQ ID NO: 42034

SEQ ID NO: 142813 - RNA, 64 nt, Human; identical to SEQ ID NO: 42035

SEQ ID NO: 142814 - RNA, 64 nt, Human; identical to SEQ ID NO: 42036

SEQ ID NO: 142815 - RNA, 64 nt, Human; identical to SEQ ID NO: 42037

SEQ ID NO: 142816 - RNA, 64 nt, Human; identical to SEQ ID NO: 42038

SEQ ID NO: 142817 - RNA, 64 nt, Human; identical to SEQ ID NO: 42039

SEQ ID NO: 142818 - RNA, 64 nt, Human; identical to SEQ ID NO: 42040

SEQ ID NO: 142819 - RNA, 64 nt, Human; identical to SEQ ID NO: 42041

SEQ ID NO: 142820 - RNA, 64 nt, Human; identical to SEQ ID NO: 42042

SEQ ID NO: 142821 - RNA, 64 nt, Human; identical to SEQ ID NO: 42043

SEQ ID NO: 142822 - RNA, 64 nt, Human; identical to SEQ ID NO: 42044

SEQ ID NO: 142823 - RNA, 64 nt, Human; identical to SEQ ID NO: 42045

SEQ ID NO: 142824 - RNA, 64 nt, Human; identical to SEQ ID NO: 42046

SEQ ID NO: 142825 - RNA, 64 nt, Human; identical to SEQ ID NO: 42047

SEQ ID NO: 142826 - RNA, 64 nt, Human; identical to SEQ ID NO: 42048

SEQ ID NO: 142827 - RNA, 64 nt, Human; identical to SEQ ID NO: 42049

SEQ ID NO: 142828 - RNA, 64 nt, Human; identical to SEQ ID NO: 42050

SEQ ID NO: 142829 - RNA, 64 nt, Human; identical to SEQ ID NO: 42051

SEQ ID NO: 142830 - RNA, 64 nt, Human; identical to SEQ ID NO: 42052

SEQ ID NO: 142831 - RNA, 64 nt, Human; identical to SEQ ID NO: 42053

SEQ ID NO: 142832 - RNA, 64 nt, Human; identical to SEQ ID NO: 42054

SEQ ID NO: 142833 - RNA, 64 nt, Human; identical to SEQ ID NO: 42055

SEQ ID NO: 142834 - RNA, 64 nt, Human; identical to SEQ ID NO: 42056

SEQ ID NO: 142835 - RNA, 64 nt, Human; identical to SEQ ID NO: 42057

SEQ ID NO: 142836 - RNA, 64 nt, Human; identical to SEQ ID NO: 42058

SEQ ID NO: 142837 - RNA, 64 nt, Human; identical to SEQ ID NO: 42059

SEQ ID NO: 142838 - RNA, 64 nt, Human; identical to SEQ ID NO: 42060

SEQ ID NO: 142839 - RNA, 64 nt, Human; identical to SEQ ID NO: 42061

SEQ ID NO: 142840 - RNA, 64 nt, Human; identical to SEQ ID NO: 42062

SEQ ID NO: 142841 - RNA, 64 nt, Human; identical to SEQ ID NO: 42063

SEQ ID NO: 142842 - RNA, 64 nt, Human; identical to SEQ ID NO: 42064

SEQ ID NO: 142843 - RNA, 64 nt, Human; identical to SEQ ID NO: 42065

SEQ ID NO: 142844 - RNA, 64 nt, Human; identical to SEQ ID NO: 42066

SEQ ID NO: 142845 - RNA, 64 nt, Human; identical to SEQ ID NO: 42067

SEQ ID NO: 142846 - RNA, 64 nt, Human; identical to SEQ ID NO: 42068

SEQ ID NO: 142847 - RNA, 64 nt, Human; identical to SEQ ID NO: 42069

SEQ ID NO: 142848 - RNA, 64 nt, Human; identical to SEQ ID NO: 42070

SEQ ID NO: 142849 - RNA, 64 nt, Human; identical to SEQ ID NO: 42071

SEQ ID NO: 142850 - RNA, 64 nt, Human; identical to SEQ ID NO: 42072

SEQ ID NO: 142851 - RNA, 64 nt, Human; identical to SEQ ID NO: 42073

SEQ ID NO: 142852 - RNA, 64 nt, Human; identical to SEQ ID NO: 42074

SEQ ID NO: 142853 - RNA, 64 nt, Human; identical to SEQ ID NO: 42075

SEQ ID NO: 142854 - RNA, 64 nt, Human; identical to SEQ ID NO: 42076

SEQ ID NO: 142855 - RNA, 64 nt, Human; identical to SEQ ID NO: 42077

SEQ ID NO: 142856 - RNA, 64 nt, Human; identical to SEQ ID NO: 42078

SEQ ID NO: 142857 - RNA, 64 nt, Human; identical to SEQ ID NO: 42079

SEQ ID NO: 142858 - RNA, 64 nt, Human; identical to SEQ ID NO: 42080

SEQ ID NO: 142859 - RNA, 64 nt, Human; identical to SEQ ID NO: 42081

SEQ ID NO: 142860 - RNA, 64 nt, Human; identical to SEQ ID NO: 42082

SEQ ID NO: 142861 - RNA, 64 nt, Human; identical to SEQ ID NO: 42083

SEQ ID NO: 142862 - RNA, 64 nt, Human; identical to SEQ ID NO: 42084

SEQ ID NO: 142863 - RNA, 64 nt, Human; identical to SEQ ID NO: 42085

SEQ ID NO: 142864 - RNA, 64 nt, Human; identical to SEQ ID NO: 42086

SEQ ID NO: 142865 - RNA, 64 nt, Human; identical to SEQ ID NO: 42087

SEQ ID NO: 142866 - RNA, 64 nt, Human; identical to SEQ ID NO: 42088

SEQ ID NO: 142867 - RNA, 64 nt, Human; identical to SEQ ID NO: 42089

SEQ ID NO: 142868 - RNA, 64 nt, Human; identical to SEQ ID NO: 42090

SEQ ID NO: 142869 - RNA, 64 nt, Human; identical to SEQ ID NO: 42091

SEQ ID NO: 142870 - RNA, 64 nt, Human; identical to SEQ ID NO: 42092

SEQ ID NO: 142871 - RNA, 64 nt, Human; identical to SEQ ID NO: 42093

SEQ ID NO: 142872 - RNA, 64 nt, Human; identical to SEQ ID NO: 42094

SEQ ID NO: 142873 - RNA, 64 nt, Human; identical to SEQ ID NO: 42095

SEQ ID NO: 142874 - RNA, 64 nt, Human; identical to SEQ ID NO: 42096

SEQ ID NO: 142875 - RNA, 64 nt, Human; identical to SEQ ID NO: 42097

SEQ ID NO: 142876 - RNA, 64 nt, Human; identical to SEQ ID NO: 42098

SEQ ID NO: 142877 - RNA, 64 nt, Human; identical to SEQ ID NO: 42099

SEQ ID NO: 142878 - RNA, 64 nt, Human; identical to SEQ ID NO: 42100

SEQ ID NO: 142879 - RNA, 64 nt, Human; identical to SEQ ID NO: 42101

SEQ ID NO: 142880 - RNA, 64 nt, Human; identical to SEQ ID NO: 42102

SEQ ID NO: 142881 - RNA, 64 nt, Human; identical to SEQ ID NO: 42103

SEQ ID NO: 142882 - RNA, 64 nt, Human; identical to SEQ ID NO: 42104

SEQ ID NO: 142883 - RNA, 64 nt, Human; identical to SEQ ID NO: 42105

SEQ ID NO: 142884 - RNA, 64 nt, Human; identical to SEQ ID NO: 42106

SEQ ID NO: 142885 - RNA, 64 nt, Human; identical to SEQ ID NO: 42107

SEQ ID NO: 142886 - RNA, 64 nt, Human; identical to SEQ ID NO: 42108

SEQ ID NO: 142887 - RNA, 64 nt, Human; identical to SEQ ID NO: 42109

SEQ ID NO: 142888 - RNA, 64 nt, Human; identical to SEQ ID NO: 42110

SEQ ID NO: 142889 - RNA, 64 nt, Human; identical to SEQ ID NO: 42111

SEQ ID NO: 142890 - RNA, 64 nt, Human; identical to SEQ ID NO: 42112

SEQ ID NO: 142891 - RNA, 64 nt, Human; identical to SEQ ID NO: 42113

SEQ ID NO: 142892 - RNA, 64 nt, Human; identical to SEQ ID NO: 42114

SEQ ID NO: 142893 - RNA, 64 nt, Human; identical to SEQ ID NO: 42115

SEQ ID NO: 142894 - RNA, 64 nt, Human; identical to SEQ ID NO: 42116

SEQ ID NO: 142895 - RNA, 64 nt, Human; identical to SEQ ID NO: 42117

SEQ ID NO: 142896 - RNA, 64 nt, Human; identical to SEQ ID NO: 42118

SEQ ID NO: 142897 - RNA, 64 nt, Human; identical to SEQ ID NO: 42119

SEQ ID NO: 142898 - RNA, 64 nt, Human; identical to SEQ ID NO: 42120

SEQ ID NO: 142899 - RNA, 64 nt, Human; identical to SEQ ID NO: 42121

SEQ ID NO: 142900 - RNA, 64 nt, Human; identical to SEQ ID NO: 42122

SEQ ID NO: 142901 - RNA, 64 nt, Human; identical to SEQ ID NO: 42123

SEQ ID NO: 142902 - RNA, 64 nt, Human; identical to SEQ ID NO: 42124

SEQ ID NO: 142903 - RNA, 64 nt, Human; identical to SEQ ID NO: 42125

SEQ ID NO: 142904 - RNA, 64 nt, Human; identical to SEQ ID NO: 42126

SEQ ID NO: 142905 - RNA, 62 nt, Human; identical to SEQ ID NO: 42127

SEQ ID NO: 142906 - RNA, 64 nt, Human; identical to SEQ ID NO: 42128

SEQ ID NO: 142907 - RNA, 53 nt, Human; identical to SEQ ID NO: 42129

SEQ ID NO: 142908 - RNA, 64 nt, Human; identical to SEQ ID NO: 42130

SEQ ID NO: 142909 - RNA, 64 nt, Human; identical to SEQ ID NO: 42131

SEQ ID NO: 142910 - RNA, 64 nt, Human; identical to SEQ ID NO: 42132

SEQ ID NO: 142911 - RNA, 64 nt, Human; identical to SEQ ID NO: 42133

SEQ ID NO: 142912 - RNA, 64 nt, Human; identical to SEQ ID NO: 42134

SEQ ID NO: 142913 - RNA, 64 nt, Human; identical to SEQ ID NO: 42135

SEQ ID NO: 142914 - RNA, 64 nt, Human; identical to SEQ ID NO: 42136

SEQ ID NO: 142915 - RNA, 64 nt, Human; identical to SEQ ID NO: 42137

SEQ ID NO: 142916 - RNA, 64 nt, Human; identical to SEQ ID NO: 42138

SEQ ID NO: 142917 - RNA, 64 nt, Human; identical to SEQ ID NO: 42139

SEQ ID NO: 142918 - RNA, 64 nt, Human; identical to SEQ ID NO: 42140

SEQ ID NO: 142919 - RNA, 64 nt, Human; identical to SEQ ID NO: 42141

SEQ ID NO: 142920 - RNA, 64 nt, Human; identical to SEQ ID NO: 42142

SEQ ID NO: 142921 - RNA, 64 nt, Human; identical to SEQ ID NO: 42143

SEQ ID NO: 142922 - RNA, 64 nt, Human; identical to SEQ ID NO: 42144

SEQ ID NO: 142923 - RNA, 64 nt, Human; identical to SEQ ID NO: 42145

SEQ ID NO: 142924 - RNA, 64 nt, Human; identical to SEQ ID NO: 42146

SEQ ID NO: 142925 - RNA, 64 nt, Human; identical to SEQ ID NO: 42147

SEQ ID NO: 142926 - RNA, 64 nt, Human; identical to SEQ ID NO: 42148

SEQ ID NO: 142927 - RNA, 64 nt, Human; identical to SEQ ID NO: 42149

SEQ ID NO: 142928 - RNA, 64 nt, Human; identical to SEQ ID NO: 42150

SEQ ID NO: 142929 - RNA, 64 nt, Human; identical to SEQ ID NO: 42151

SEQ ID NO: 142930 - RNA, 64 nt, Human; identical to SEQ ID NO: 42152

SEQ ID NO: 142931 - RNA, 64 nt, Human; identical to SEQ ID NO: 42153

SEQ ID NO: 142932 - RNA, 64 nt, Human; identical to SEQ ID NO: 42154

SEQ ID NO: 142933 - RNA, 64 nt, Human; identical to SEQ ID NO: 42155

SEQ ID NO: 142934 - RNA, 64 nt, Human; identical to SEQ ID NO: 42156

SEQ ID NO: 142935 - RNA, 64 nt, Human; identical to SEQ ID NO: 42157

SEQ ID NO: 142936 - RNA, 64 nt, Human; identical to SEQ ID NO: 42158

SEQ ID NO: 142937 - RNA, 64 nt, Human; identical to SEQ ID NO: 42159

SEQ ID NO: 142938 - RNA, 64 nt, Human; identical to SEQ ID NO: 42160

SEQ ID NO: 142939 - RNA, 64 nt, Human; identical to SEQ ID NO: 42161

SEQ ID NO: 142940 - RNA, 64 nt, Human; identical to SEQ ID NO: 42162

SEQ ID NO: 142941 - RNA, 64 nt, Human
agguggucagcaggcaaucuccugggccuuaaaggaugcggacucauccucagccagcgcccau

SEQ ID NO: 142942 - RNA, 64 nt, Human
uuggcaaccuacuucuacucagauuucauugcuggaugcggaagggguaggcccaaaauauaua

SEQ ID NO: 142943 - RNA, 64 nt, Human
auauauuuaugacuguguuaaugaguagugaaaugaugcggaaagacagcuaucaggaagagga

SEQ ID NO: 142944 - RNA, 64 nt, Human
gaauuaggaccugguucuggaccaaguggguaaggaugcggaaggauugcaaugcccgccagca

SEQ ID NO: 142945 - RNA, 64 nt, Human
uggggggaauucaucucucuuuaauauaaaguuggaugcggaacccaaauuacguguacuacaa

SEQ ID NO: 142946 - RNA, 64 nt, Human
uuaacauuuuaauuugaauaacuuggucuuaucugaugcggaagacuggaaacuauuguguuca

SEQ ID NO: 142947 - RNA, 64 nt, Human
cuugaagccacucaagccaguuggggaggaaagggaugcggagguacccucuagcugggaagaa

SEQ ID NO: 142948 - RNA, 64 nt, Human
aacugucgaccagaguuagaacggagcccucggugaugcggacaucucagggaaacuugcguac

SEQ ID NO: 142949 - RNA, 64 nt, Human
ggaggaagcacaagccucagggaaggggaagcaggaugcggagggccaaagcccgggaccucua

SEQ ID NO: 142950 - RNA, 64 nt, Human
gcggggccggguguuccauagcaugugugucucggaugcggaaggcaguuuugcuugggaaaca

SEQ ID NO: 142951 - RNA, 64 nt, Human
cacacagcagacacggaccuauggacuauggauggaugcggacgauggaaccguucaguaaaga

SEQ ID NO: 142952 - RNA, 64 nt, Human
agagguagccacgagcugauaauuacagacaagagaugcggaguaugugggggcucauuauccu

SEQ ID NO: 142953 - RNA, 64 nt, Human
aaagccaugaggaggccaagaagcugcuguggcugaugcggauucagaaagggcucccucauca

SEQ ID NO: 142954 - RNA, 64 nt, Human
aacauuuuacauuggucugcucagcacauggcuggaugcggauauuucuauaauuccagaaagu

SEQ ID NO: 142955 - RNA, 64 nt, Human
cacacacacacacacacacacacacacaugcuaggaugcggaaauccccuuaugacuugcuacu

SEQ ID NO: 142956 - RNA, 64 nt, Human
uaagacguuuuaauuucuuugcagacaaggucuagaugcggagucagagaugggacugaauggg

SEQ ID NO: 142957 - RNA, 55 nt, Human
guggcucagaugaggaaugagccgagaugcggagggcgcagaugucccacugcac

SEQ ID NO: 142958 - RNA, 64 nt, Human
gacucuaaaacuaauuuguauauuaucagccagagaugcggauggcagucgagccaaaucgcau

SEQ ID NO: 142959 - RNA, 64 nt, Human
agcccuugcuuucggagcuccuguccaaaguagggaugcggauccugcuggggccgccacggcc

SEQ ID NO: 142960 - RNA, 64 nt, Human
acuggcagggagagggucaccuccacucugguuggaugcggagcuggucccucuggcugccaug

SEQ ID NO: 142961 - RNA, 64 nt, Human
gagucuggccccuccagcgggcagggagugcggggaugcggaucagcugggaggaggaggggag

SEQ ID NO: 142962 - RNA, 64 nt, Human
acuugcaguggauucuuggucaggugugcccacagaugcggaggcgaggugagugauuccauca

SEQ ID NO: 142963 - RNA, 64 nt, Human
aaagccauguggcggcagaggcagagaugggagugaugcggacggacacaaacuaagggaugcc

SEQ ID NO: 142964 - RNA, 64 nt, Human
gucguguccgaacucuccaaugacuaagcggggagaugcggacauccuagcuccuucucaggcc

SEQ ID NO: 142965 - RNA, 64 nt, Human
agcccugggcguagccggacaggaggagagcagugaugcggauggguacccgggcacaccagcc

SEQ ID NO: 142966 - RNA, 64 nt, Human
ccagccccagcccagccuggggugcacugacggagaugcggacuccugggucccuggccaagaa

SEQ ID NO: 142967 - RNA, 64 nt, Human
ggagggaaucuagggaacgaggcagccuauuggagaugcggacaggacagacacguugagaagc

SEQ ID NO: 142968 - RNA, 64 nt, Human
uugcugggggcggguaggaaacccugagcuuccugaugcggagucaugaagcagaguccucggg

SEQ ID NO: 142969 - RNA, 60 nt, Human
ucaugacugccuccaaguagccaccgccuggaugcggauggccggagaggaccggcggcu

SEQ ID NO: 142970 - RNA, 64 nt, Human
ggagggggaagcucaucccucccuccaagcccccgaugcggagcuagggcuggagcucugccca

SEQ ID NO: 142971 - RNA, 64 nt, Human
agcggcuccgggcggagaacaagucggcuguggagaugcggaaagcccugacggacuucauuca

SEQ ID NO: 142972 - RNA, 64 nt, Human
ggggagcaaucccagcggaucgcuccgggccaccaagccgcaccugugccugagacuccggaug

SEQ ID NO: 142973 - RNA, 64 nt, Human
gugacuuuauuaaagcaacauuugccacauguuuaagccgcaaagguauuagcaaugcuugcau

SEQ ID NO: 142974 - RNA, 64 nt, Human
uaaaugauuucauaaggaaaaccacuguuugaauaagccgcacaaaaaauaaaguuaagucuga

SEQ ID NO: 142975 - RNA, 64 nt, Human
aaaaaaaaaauucaaguucagcugauuuguugguaagccgcacuagaaagguauacauaguaau

SEQ ID NO: 142976 - RNA, 64 nt, Human
cuuccuggcaacaagguaggcccuggugcagggcaagccgcagcgaccauuucagauaccgucc

SEQ ID NO: 142977 - RNA, 64 nt, Human
aauccuuggggugccucgaggacgacuggccgaaaagccgcauucccugccucacaggccggaa

SEQ ID NO: 142978 - RNA, 64 nt, Human
agcuggggaggagccaaagccucggcgcucaccuaagccgcagggagauacacccaacugggag

SEQ ID NO: 142979 - RNA, 64 nt, Human
cagacaaagaccaccccuucacccacuggaccccaagccgcaaaagcuggggagguaggaaggg

SEQ ID NO: 142980 - RNA, 64 nt, Human
uucuccccggcagcucugccucccuaagucugugaagccgcagcccugcccuguccuguccugu

SEQ ID NO: 142981 - RNA, 64 nt, Human
uaagauuuuauacugcagauagucagcuucaccaaagccgcagaggaaacaugucgagaucagg

SEQ ID NO: 142982 - RNA, 64 nt, Human
acauggagagcacccugaggaccuuuaaaaggcaaagccgcaaggcagaaggaggcuggguccc

SEQ ID NO: 142983 - RNA, 64 nt, Human
uccagagagcgagcccccaaugcccggccaggcuaagccgcagagacccucucagcccccaccu

SEQ ID NO: 142984 - RNA, 64 nt, Human
gguuguacgaaacuugucuuucugugacuuccccaagccgcaggugagaccugguccaggguaa

SEQ ID NO: 142985 - RNA, 64 nt, Human
ucgggucugcccccgacccccugccacaggccggaagccgcagggggcaccguggggaagcuaa

SEQ ID NO: 142986 - RNA, 64 nt, Human
ggcauuucucuuugagagaguuuaucauugggagaagccgcagggacagaacugaacguccugc

SEQ ID NO: 142987 - RNA, 64 nt, Human
cagguaccaccccauccuccggcugcaggaggccaagccgcagagguccgcgagguccgcgaug

SEQ ID NO: 142988 - RNA, 64 nt, Human
gugggccugcaaaaucagacagaaauggcuugagaagccgcagggggagcaugccugucucuca

SEQ ID NO: 142989 - RNA, 64 nt, Human
aggagacgugcacuuggugcugcgcccagggaggaagccgcaccaccagccagcgcaggcccug

SEQ ID NO: 142990 - RNA, 64 nt, Human
gaauuuaagaaacuuauucgcaauagacaaagugaagccgcagacagcaguccuucagaauuaa

SEQ ID NO: 142991 - RNA, 64 nt, Human
gggggcuuuggugaagugcacggagcucacggacaagccgcaggcucugggaagcguggaggua

SEQ ID NO: 142992 - RNA, 64 nt, Human
aaguuucuucaaagggcucucuggcuaaucuucaaagccgcaguuaggcaaaaugacaguguga

SEQ ID NO: 142993 - RNA, 64 nt, Human
ggcugucuuggaaccucugugagcaggaggcccuaagccgcagcaguggauagaggugcagcuc

SEQ ID NO: 142994 - RNA, 64 nt, Human
ucagaauuaauaaaaguaucuguuaugugcacuuaagccgcagcugcuauagauagcacugccu

SEQ ID NO: 142995 - RNA, 64 nt, Human
cuguaucuccugggagcacaggcaucaaugguccaagccgcauaauaagucuggaagagcaaaa

SEQ ID NO: 142996 - RNA, 64 nt, Human
aucaccuagaaacuuguuagaaaugcaaauucucaagccgcaucccagacuugcugaaucggaa

SEQ ID NO: 142997 - RNA, 64 nt, Human
acgcgcccaguggcgccagcaagcugcccaugcaaagccgcagccuuugggagggagaagagaa

SEQ ID NO: 142998 - RNA, 64 nt, Human
uacucaccagguacaaauuacugguauguuuuauaagccgcagcuacuguacacagccuaucug

SEQ ID NO: 142999 - RNA, 64 nt, Human
gaccagaaucuguguauuucugucugggaccaggaagccgcagcugucccaucauccccagcaa

SEQ ID NO: 143000 - RNA, 64 nt, Human
accuggccucuccaaugucuccucgaacuagcaaaagccgcauguccaugaagcugcgucguuc

SEQ ID NO: 143001 - RNA, 64 nt, Human
aaccagagccuguuuuguuuuguucuaaacuaagaagccgcauaggaugugacuugcguuuuga

SEQ ID NO: 143002 - RNA, 64 nt, Human
gaggauuaggauuuuaacauaugaauuuugggggggaugcaaucauucagcccauaauacccuc

SEQ ID NO: 143003 - RNA, 64 nt, Human
gacuaaaccuggcccuuuucucugggcuguagugaagccgcauuuucacgcuggcuggcagugu

SEQ ID NO: 143004 - RNA, 64 nt, Human
ucuaaaagagaucuuauuuaaauuuccuuuuuaaaagccgcaugguucugugauccauguaacu

SEQ ID NO: 143005 - RNA, 64 nt, Human
ccuuuccuggcccaguccucaccacaguccacagaagccgcaaacaggcucauagccaagcugu

SEQ ID NO: 143006 - RNA, 64 nt, Human
gucgcugugagcaagagccggcuggcacauuuggaagccgcacuguauuuaacuuaaucaaaug

SEQ ID NO: 143007 - RNA, 64 nt, Human
gauggagcgagcguucugggcuggucgaagccugaagccgcaguauguccuugagugggucccc

SEQ ID NO: 143008 - RNA, 64 nt, Human
agccggacacggcuucacugaccagcggcugcucaagccgcaagcucucagcaagugcccagug

SEQ ID NO: 143009 - RNA, 64 nt, Human
uuauuaaaaauacagguacuuugaccucuuucuaaagccgcagacccuggugcaaugcucuggu

SEQ ID NO: 143010 - RNA, 64 nt, Human
ccgugucauuccagaguggaucugcggugaagccaagccgcaagguuacaaggcauccucacca

SEQ ID NO: 143011 - RNA, 64 nt, Human
acaccaggacaaggaagacaguuucgccucucgaaagccgcagcugcgccuaggcuggagcugg

SEQ ID NO: 143012 - RNA, 64 nt, Human
cgauugucucagaugcagggcgcugugcgggacgaagccgcaaggacucucguaucgggcccuu

SEQ ID NO: 143013 - RNA, 54 nt, Human
cagggaagagaguggccugagcccaagccgcaccggagcagcggcuggauugaa

SEQ ID NO: 143014 - RNA, 64 nt, Human
accuagaggagcccuccugugaccauaaggguaaaagccgcaagcuaagaagaggguggccgga

SEQ ID NO: 143015 - RNA, 64 nt, Human
guugaucaugugcaauauuucuuacugugccgagaagccgcaaugagcgagauuaaagcuguuu

SEQ ID NO: 143016 - RNA, 64 nt, Human
cagugcagagggccuggagcacggauugugaauaaagccgcacaugcugauacacacuguuguu

SEQ ID NO: 143017 - RNA, 64 nt, Human
cucugccauuauuucguuuucaguguaauuugccaagccgcaguuuucugugcuggcugugccu

SEQ ID NO: 143018 - RNA, 64 nt, Human
acaucacaugucgguagguuccgugaugccccacaagccgcaaaaaccagcaaguuuuuauuag

SEQ ID NO: 143019 - RNA, 64 nt, Human
agauugauaaccauccuuuggggcagcauuccagggaugcaaaaugugcuaguccaugaccuuu

SEQ ID NO: 143020 - RNA, 64 nt, Human
ucucugaccauuccucuacuggagcccccaaugaaagccgcaaaccuauacccuugacgcccau

SEQ ID NO: 143021 - RNA, 64 nt, Human
agguccccgugggguggagcauggugccccucacaagccgcagcggcuggugcccgggcuacca

SEQ ID NO: 143022 - RNA, 64 nt, Human
agagguagcacucucagaguguuuugaccaguuuaagccgcagaccuggagcuucagccagguc

SEQ ID NO: 143023 - RNA, 64 nt, Human
cuguggucccagcuacucagaaggcaaguggugauggcgccacugcacuccuaccucagcaaca

SEQ ID NO: 143024 - RNA, 64 nt, Human
gcuccgaggagcgagagucgggcugagggcaaccuggcgccagggaaaauucugguuauucacc

SEQ ID NO: 143025 - RNA, 64 nt, Human
cuccuuuguaaagucacugccuuaagggggcugauggcgccaccugugccuuacauccagguuc

SEQ ID NO: 143026 - RNA, 64 nt, Human
cuuccgagaccagcaguacgagaugcucaagcgcuggcgccagcagcagcccgcgggccucgga

SEQ ID NO: 143027 - RNA, 64 nt, Human
gagcccaggaggucaaggcugcagugagccgugauggcgccacugcacuucagccuuggagaca

SEQ ID NO: 143028 - RNA, 64 nt, Human
auaccuaucucccuccucccaucuccuaggggacuggcgccaaauggucucucccugccaauuu

SEQ ID NO: 143029 - RNA, 64 nt, Human
acccaggagcagagcgcuucggagcgguccucaguggcgccaccugcuggugcuaauagggaca

SEQ ID NO: 143030 - RNA, 64 nt, Human
gaugagcuccacacccccacacccauugcagcuguggcgccacguccucccaaggggccuucug

SEQ ID NO: 143031 - RNA, 64 nt, Human
gaacccgggaggcggagcuugcagugagcugagauggcgccacugcacuccagccuaggcaaca

SEQ ID NO: 143032 - RNA, 64 nt, Human
ugaaguugccccugggaagggcagcugggggcaguggcgccaguucccuuccauggucucccgg

SEQ ID NO: 143033 - RNA, 64 nt, Human
gauggaguuucuuuuugcccaggcuggagugcaguggcgccaucuuggcucacugcaaccucug

SEQ ID NO: 143034 - RNA, 64 nt, Human
gagucucacucuugucacccaggcuggagugcaguggcgccaucucggcucacugcaaccucug

SEQ ID NO: 143035 - RNA, 64 nt, Human
ggcaaaguccagacaaggcccacugcaguuccuauggcgccagucaccagcuccuagacagcac

SEQ ID NO: 143036 - RNA, 64 nt, Human
ccuuacugagauuggaugguuuucuuuccucuauuggcgccauucuucagauauuaaaguuaaa

SEQ ID NO: 143037 - RNA, 64 nt, Human
cugagcaccccggugcggaccacagagcagacccuggcgccaggaaggagcauguguuagcguc

SEQ ID NO: 143038 - RNA, 51 nt, Human
cagaguugccgcaagucugaauggcgccaucaaacuuaugggcagggauaa

SEQ ID NO: 143039 - RNA, 64 nt, Human
ugaacccgggaggcggagguugcaugagccgagauggcgccacugcucuccagccuggacgaca

SEQ ID NO: 143040 - RNA, 58 nt, Human
ucaagagaaaacucacauagugacaggauggcgccaaacucagccuucaggacucugu

SEQ ID NO: 143041 - RNA, 64 nt, Human
gaguuucgcucuuguugcccaggcuagagugcaauggcgccaucucggcucaccgcaaccucca

SEQ ID NO: 143042 - RNA, 50 nt, Human
ucaacaacaugcagcagugauggcgccaggcucugcagggugggccugau

SEQ ID NO: 143043 - RNA, 64 nt, Human
aauucaccaagcauguaguucuagcgcacuagcauggcgccagccauguacuuacaauguaguu

SEQ ID NO: 143044 - RNA, 64 nt, Human
gaaccugggaggcagaguuugcagugagccgagauggcgccacugcacuccagccugggggaca

SEQ ID NO: 143045 - RNA, 64 nt, Human
gaacccgggaggcagagguugcagugagccaagauggcgccacugcauuccagccugggcaaca

SEQ ID NO: 143046 - RNA, 53 nt, Human
gcuucgaggguggugauuagcgguggcgccagcccuaggcuacccuugccaag

SEQ ID NO: 143047 - RNA, 64 nt, Human
uggcgaguugcgggugggcagggccaggacgguguggcgccagccuugaagcaccacggcccaa

SEQ ID NO: 143048 - RNA, 64 nt, Human
cagagucuugcucugucgccaggcuggagugcaguggcgccaucucggcucacugcaacuuccg

SEQ ID NO: 143049 - RNA, 64 nt, Human
aagcugugucucuaacauaauaaugaguggcagcuggcgccagggaacgauggccucccaauag

SEQ ID NO: 143050 - RNA, 64 nt, Human
agagucuugcucuuuugcccaggcaggaaugcaguggcgccaucucggcucacugcaaccucug

SEQ ID NO: 143051 - RNA, 64 nt, Human
cuuucuucuuacaccccggucucaugcuccuuaauggcgccaugggugcuuguugggccuuuuu

SEQ ID NO: 143052 - RNA, 64 nt, Human
aaauaaguccuuauugauuggaccgagccagggauggcgccagggcgguggccugugguuuuuc

SEQ ID NO: 143053 - RNA, 64 nt, Human
cuggccagaggacgugagcgugugacgggcgccuuggcgccaccuguugggugcucacugccuc

SEQ ID NO: 143054 - RNA, 64 nt, Human
ggcaaggcccacauucuccuucagagacaggcacuggcgccagaggcuuccuuggggcgggggg

SEQ ID NO: 143055 - RNA, 64 nt, Human
gucacuaccuucaugcauagguuuagcaguauaguggcgccacuguuuugaaucucauaauuua

SEQ ID NO: 143056 - RNA, 64 nt, Human
ccccaggcgcuggucagaaacgggguagucucuuuggcgccaccuaguguccaguuuggcccau

SEQ ID NO: 143057 - RNA, 64 nt, Human
augauuuauucgaugugauuggcuuguuuuuauguggcgccaagaacgaaccuguuuaacagcu

SEQ ID NO: 143058 - RNA, 64 nt, Human
ggcacccuuuucaguugggaagaaaggagagggguggcgccauggacguggcccuaaacgcugu

SEQ ID NO: 143059 - RNA, 64 nt, Human
gacagcccugggagagccaugugaaggaggcagcuggcgccaucgcuccggauuaguugguuuc

SEQ ID NO: 143060 - RNA, 64 nt, Human
ccccggacgcucagcccccacagcccccacagccuggcgccagggcucacagcugccccucccu

SEQ ID NO: 143061 - RNA, 64 nt, Human
gaaccuaggaggcggagguugcagugagccaagauggcgccauugcacuccagccugggugaca

SEQ ID NO: 143062 - RNA, 64 nt, Human
gaacccaggaggcggagguugcagugagccaagauggcgccauugcacuccagccugggcgaca

SEQ ID NO: 143063 - RNA, 64 nt, Human
guguagcagaaaaaggcugugcugcccugaagaauggcgccaccagcucugccgucucuggagc

SEQ ID NO: 143064 - RNA, 64 nt, Human
aggaucagaccuucuuucccgugaaaccaguauuuggcgccauauauaagccugguuaaauugg

SEQ ID NO: 143065 - RNA, 64 nt, Human
gcagccccgcagcuggugcucugccccgcgguacuggcgccaucagggccucccuugcccgccu

SEQ ID NO: 143066 - RNA, 64 nt, Human
gaaccuggaaggcagagguugcagugagccgaaauggcgccacuguacuccaaccugggcgaca

SEQ ID NO: 143067 - RNA, 64 nt, Human
cccuacccucccagcgaguugcgcugggagacgcuggcgccagggccugccggcgcggggagga

SEQ ID NO: 143068 - RNA, 64 nt, Human
cccuggguaccucugcugugcgcuccuucccagguggcgccauggauuccucugggggcuggcg

SEQ ID NO: 143069 - RNA, 64 nt, Human
gaaugagcaggcugacacguugcacagccccagguggcgccauucucucacgcaaggauggggc

SEQ ID NO: 143070 - RNA, 64 nt, Human
augugccagaaaugucagguauguguccuucccuuggcgccacauaguaguuuacuaauguuug

SEQ ID NO: 143071 - RNA, 64 nt, Human
gaacacgggaggcagagguugcagugagccgagauggcgccacuacacuccagccuggguuaua

SEQ ID NO: 143072 - RNA, 64 nt, Human
uggucguucucaacgcgcccacccuggacguggauggcgccagugacuccggcagcggcgauga

SEQ ID NO: 143073 - RNA, 64 nt, Human
gccugggccugacauucccagaacuaccgccagguggcgccaggcccccacagucuguggccgu

SEQ ID NO: 143074 - RNA, 64 nt, Human
ggaguuucccucugucacacaagcuggagggcaauggcgccaucucagcucacugcaacgucca

SEQ ID NO: 143075 - RNA, 64 nt, Human
cuagcccagugugggcagaugccagcggcccagguggcgccauugcuguccugggauggaucgu

SEQ ID NO: 143076 - RNA, 64 nt, Human
cccuuccugcagaagagacaugcagcaguagcgcuggcgccaucugcaggagcuggcgggcugg

SEQ ID NO: 143077 - RNA, 64 nt, Human
gaaccugggaggcagagguugcagugagccgagauggcgccauugcacuccagccugggugaca

SEQ ID NO: 143078 - RNA, 64 nt, Human
gagucucgcucuugucacccaggcuggaaugcaguggcgccaucucagcucacugcaaccucca

SEQ ID NO: 143079 - RNA, 64 nt, Human
cucauuccauuuaaagucugcgggacgcgcccaguggcgccagcaagcugcccaugcaaagccg

SEQ ID NO: 143080 - RNA, 64 nt, Human
agcgccucagcuggcggugacagccggcccagcguggcgccaccacacaccgcagagcugucca

SEQ ID NO: 143081 - RNA, 64 nt, Human
uggagucucacucuuucgccaggcuagagugcaguggcgccaucuaggcucacugcaaccuccg

SEQ ID NO: 143082 - RNA, 64 nt, Human
gcagcccuucaccagaguucggaggagcaguguguggcgccacgucccgacuggccauacccac

SEQ ID NO: 143083 - RNA, 64 nt, Human
ugggcgucugugccaggccucccgaagguggcgauggcgccagggacaccaggaauucgggggc

SEQ ID NO: 143084 - RNA, 64 nt, Human
uaggcggcaccguugguccacacucagaggcccuuggcgccaagacugcaucuagaaucgcuca

SEQ ID NO: 143085 - RNA, 64 nt, Human
cuugagccuggguagaggcugcugugagcugaaauggcgccacugcacuccagccuggguaaca

SEQ ID NO: 143086 - RNA, 64 nt, Human
gaggcugcgaccgccccggagagcagcuucacacuggcgccacagaggagccccacgugcacuc

SEQ ID NO: 143087 - RNA, 64 nt, Human
acuucuaaaggagcgggcccacucuggacccaccuggcgccacagaggaagcugccugccggag

SEQ ID NO: 143088 - RNA, 64 nt, Human
gauguauaaagcaccugcaugcucagacuucuuguggcgccaccuccacgucugucuuguacau

SEQ ID NO: 143089 - RNA, 64 nt, Human
cgggggcagcucuggaggggguuugcuggggaacuggcgccaucgccgggacuccagaaccgca

SEQ ID NO: 143090 - RNA, 64 nt, Human
uucaguugugguuguugcccaggcuggagugcaguggcgccaucuuggcucacugcaccuccac

SEQ ID NO: 143091 - RNA, 64 nt, Human
gcugagcugcucagccaccaucagguuaauuggauggcgccagucuggcuggaggagcccugag

SEQ ID NO: 143092 - RNA, 64 nt, Human
acucccaacggugacggcucccuuccccacuccauggcgccagccuccucccccgcuccccaac

SEQ ID NO: 143093 - RNA, 64 nt, Human
ugaaauccaaggggggguuccggguuuugccauguggcgccauuuuccaacucauuuucagccu

SEQ ID NO: 143094 - RNA, 64 nt, Human
acagcgcagaccgaagcaaaauucuuguauacauuggcgccagggcugaugcuggggugugggu

SEQ ID NO: 143095 - RNA, 64 nt, Human
gaacacaggagacggagauugcagugagcugagauggcgccacugcacuccagccuggcaacag

SEQ ID NO: 143096 - RNA, 64 nt, Human
caauccaggagguggagguugcagugagccgagauggcgccacugcacuccagccugggccaca

SEQ ID NO: 143097 - RNA, 64 nt, Human
gaguuucacucuuguugcccaggcuggagugcaguggcgccaucucagcucacugcaacuucug

SEQ ID NO: 143098 - RNA, 64 nt, Human
agagucucacucuguugcccaggcuggagugcaguggcgccaucucggcucacugcaaccuccg

SEQ ID NO: 143099 - RNA, 64 nt, Human
caccuagcuugacaucucacgcaccucccagagcuggcgccacugaguaauccggaccucacca

SEQ ID NO: 143100 - RNA, 64 nt, Human
cucuuuuccuuugagcccaaggcagagcuggagcuggcgccacccagacagcgucagguguggc

SEQ ID NO: 143101 - RNA, 64 nt, Human
cuccguagcucaugggaugugcugggccugccuuuggcgccaugcugcagacuccagugggccu

SEQ ID NO: 143102 - RNA, 64 nt, Human
acauacugccuggcagccugccuuccuagggagcuggcgccaaggccucucccugauggcacac

SEQ ID NO: 143103 - RNA, 64 nt, Human
gggaacacagugccccaguggugcgggccaggucuggcgccaggggcaggcagcuaggcaggga

SEQ ID NO: 143104 - RNA, 64 nt, Human
cccguccucguccuggguaccccaccuuaguaaauggcgccaccaucugcccggucacucagcg

SEQ ID NO: 143105 - RNA, 64 nt, Human
ugagggccugaggucuggcugcuugcccccaugcuggcgccaacaacuucuccauccuuucugc

SEQ ID NO: 143106 - RNA, 64 nt, Human
cagcccccucccccgcaccccggaaccggcgucgcuggcgcauccuggguggaggcaggccccg

SEQ ID NO: 143107 - RNA, 64 nt, Human
aucuccuuguacccucuggcuuacuguccucucucuggcgcacuuuccugaagccucuuauuaa

SEQ ID NO: 143108 - RNA, 64 nt, Human
ccagagaugguaaauacugucccacucagcucugcuggcgcaguacagcagcagcagccccagc

SEQ ID NO: 143109 - RNA, 64 nt, Human
acuuuaugucaaaauuauuugaguacuaugggaccuggcgcaguggcucaugcuuguaauccca

SEQ ID NO: 143110 - RNA, 64 nt, Human
ggaccuucaccuccuagagauaaaccagccucagcuggcgcagcggggcccuucuucccuccgc

SEQ ID NO: 143111 - RNA, 64 nt, Human
accuuccaccucuccaacauuguccccugggucccuggcgcacgcggcacuucagagccccgcc

SEQ ID NO: 143112 - RNA, 64 nt, Human
cugcggaacccaaagaugugcuccugucucugcacuggcgcauuggcaugguagaugccacaau

SEQ ID NO: 143113 - RNA, 64 nt, Human
cccucccaccaugcgcugcucaaccucucuccuucuggcgcaagagaacauuucuagaaaaaac

SEQ ID NO: 143114 - RNA, 64 nt, Human
uguuuuuuuguuuguuuguuuguuuguuuugagacuggcgcaaucuuggcucaccgcaaccucc

SEQ ID NO: 143115 - RNA, 64 nt, Human
auuuaaagaaagcuaaauaaaaauguagacauggcuggcgcaguggcucaugcuuguaauccua

SEQ ID NO: 143116 - RNA, 64 nt, Human
gcccuaagagaaggggauuaccuuguaagaccaucuggcgcaguggaccuauuagaacuugggu

SEQ ID NO: 143117 - RNA, 64 nt, Human
ccacugacucccacaggagaggcuacaaaaugaucuggcgcacagggauguuuuguuuagcuug

SEQ ID NO: 143118 - RNA, 64 nt, Human
ccuggaggaggaugaagacacagagacaaggugacuggcgcaggucuccuuggggccugccgug

SEQ ID NO: 143119 - RNA, 64 nt, Human
cuuuuguguguuagcagucaaaucuauuauuccacuggcgcaucauaugcagugauauaugccu

SEQ ID NO: 143120 - RNA, 64 nt, Human
uucuuuuuagugaguucaugaauguuuaacgguucuggcgcaaagcuuucuugcauucugagca

SEQ ID NO: 143121 - RNA, 64 nt, Human
aaagugcugggauuacaggcgugagccaccauaccuggcgcaugcauauuuuuuaagaguaccc

SEQ ID NO: 143122 - RNA, 64 nt, Human
gucaggagaagcacccccagggcagcccucuugacuggcgcagugggaagaggccuucagcccc

SEQ ID NO: 143123 - RNA, 64 nt, Human
uuuggcacaacuugcgaguguagugacuuuaggacuggcgcaaaaccuccagggugcucaacuu

SEQ ID NO: 143124 - RNA, 64 nt, Human
accccuuccuacaaagaugauaaagcagucacuucuggcgcauuuuaauaauuuaaagauuuuu

SEQ ID NO: 143125 - RNA, 64 nt, Human
cugugugaaccucaugccaagcacagauauagggcuggcgcaggugcuuccuaaagcucaccuu

SEQ ID NO: 143126 - RNA, 64 nt, Human
gcccaugcccacacuacaggccagggcugcggggcuggcgcaaucccagcccccuuccccgggc

SEQ ID NO: 143127 - RNA, 64 nt, Human
caugcguggucucggggaagaagcuuccucuggccuggcgcaggccguuccaucugccucccag

SEQ ID NO: 143128 - RNA, 64 nt, Human
uguggacguugccuggcccugccucgaugccucucuggcgcaucaccugauuggaggggcuggu

SEQ ID NO: 143129 - RNA, 64 nt, Human
cggagcuccagcuucucaggacaaagccccggggcuggcgcauccugagggucucugggggugu

SEQ ID NO: 143130 - RNA, 64 nt, Human
agacccgacggcccggagcggagcgcgcccugcccuggcgcagccagagccgccgggugcccgc

SEQ ID NO: 143131 - RNA, 64 nt, Human
ugggggaggagggaaagauuagcuuugaacauuccuggcgcaugcuccauugucuuacuauuuu

SEQ ID NO: 143132 - RNA, 64 nt, Human
acucagggacccccagcugccgcagcccuggucucuggcgcaucucuucccucuugucccgaag

SEQ ID NO: 143133 - RNA, 64 nt, Human
uaauccccacuguccucaucucuaccgccaccuucuggcgcaacaagaaguugcgcucugacag

SEQ ID NO: 143134 - RNA, 64 nt, Human
uggaaucucgcucugucgcccaggcuggagugcacuggcgcaaucucggcucacugcaaccucu

SEQ ID NO: 143135 - RNA, 64 nt, Human
agcaacucagagaaaaaugcuccccacagcgucccuggcgcaggugggcuggacuucuaccugc

SEQ ID NO: 143136 - RNA, 64 nt, Human
ccuucccagguggcgccauggauuccucugggggcuggcgcaugcccaggaaagccugggccac

SEQ ID NO: 143137 - RNA, 64 nt, Human
ugagggcuccucaggcagccacaaggcaggaaaacuggcgcaaauuuccugggccucccucuga

SEQ ID NO: 143138 - RNA, 64 nt, Human
cuacaacuucguccuguuccccgacaccaagacccuggcgcagcggcuggcuauccucacaggc

SEQ ID NO: 143139 - RNA, 64 nt, Human
cgcaggacuuccccggagggcugcggcguacaggcuggcgcagaacgaaccuuggccugggccg

SEQ ID NO: 143140 - RNA, 64 nt, Human
aucggcacgcguccaccugcggaaccuguguuuccuggcgcaggagauggacagggccacgaca

SEQ ID NO: 143141 - RNA, 64 nt, Human
ccuuguguuuuggauuuuaggagaauacuuaucucuggcgcacaucacuauauuuggcugccuc

SEQ ID NO: 143142 - RNA, 64 nt, Human
gcagucaguuuuguugagaacuguguccugcauccuggcgcagaaccuaccugaugcgguuccu

SEQ ID NO: 143143 - RNA, 64 nt, Human
gacaagacugcaaaaauccgaugugcuuccuucccuggcgcagucgcuccucgagccgcugccc

SEQ ID NO: 143144 - RNA, 64 nt, Human
cacacuaaucugaaaggauguggaagagcauuagcuggcgcauauuaagcacuuuaagcuccuu

SEQ ID NO: 143145 - RNA, 64 nt, Human
ucccgaggcccggccuccccacuggguccuggaccuggcgcaggccguauagacucagguccug

SEQ ID NO: 143146 - RNA, 64 nt, Human
ucugggucuggaaacccaaacccucaaggauggccuggcgcaugggggaaccagccugcugggg

SEQ ID NO: 143147 - RNA, 64 nt, Human
cuacuaggcucagcccagguggaggcgagaugagcuggcgcagccccgcccuccauccucccca

SEQ ID NO: 143148 - RNA, 64 nt, Human
gugcuccgugccuccaccaccacuggccaccaggcuggcgcagccaaggccgaagcucuggcug

SEQ ID NO: 143149 - RNA, 64 nt, Human
agccaucugcucugccaggguggcaccagcucagcuggcgcauguccugugcuuuguggacgcu

SEQ ID NO: 143150 - RNA, 64 nt, Human
gcagccucggggucugggggcugcagggguuucccuggcgcagcgaaagucucugagcacuuac

SEQ ID NO: 143151 - RNA, 64 nt, Human
gcuggucuugcaggcuguuccgcuccuccuccagcuggcgcagcuucguagacacguugagcuu

SEQ ID NO: 143152 - RNA, 64 nt, Human
cugcagggcugugggcugcauacuggccgagcugcuggcgcacaggccucuucuccccggcacu

SEQ ID NO: 143153 - RNA, 64 nt, Human
acuuuguaaggaauucuugcucuucuaggggugccuggcgcaaccgugggcaaguuacugcucc

SEQ ID NO: 143154 - RNA, 64 nt, Human
aggggcuuggcauggccgcagugggggcuggggacuggcgcagccccaggcgccuccaagggaa

SEQ ID NO: 143155 - RNA, 64 nt, Human
accuccugaaggcccgggucaggacccugcucuccuggcgcaguucccagcuaucuccccugcu

SEQ ID NO: 143156 - RNA, 64 nt, Human
uaguagagccuucaggcgccuucgggcguggacucuggcgcacucuaguggacaggagaaggaa

SEQ ID NO: 143157 - RNA, 64 nt, Human
uccagccuuugaagacuuugaaagccagagauuccuggcgcaggcuuggacuuccugggagcuc

SEQ ID NO: 143158 - RNA, 64 nt, Human
gcugccagcucucccagccccucagcuucgcagccuggcgcagcauccucugaggccccggggc

SEQ ID NO: 143159 - RNA, 64 nt, Human
ccgugcccgcugggaaagugcccuggaccggcagcuggcgcaccaggcccagcagcagcuggag

SEQ ID NO: 143160 - RNA, 64 nt, Human
ugcuugagaacgucagacuggcuaguuuaauucccuggcgcagauacgcauaggaccaacaggg

SEQ ID NO: 143161 - RNA, 64 nt, Human
uccucaucucccugggcgcgcuggucacuuuugacuggcgcagucagaaccgcgcuccugcugg

SEQ ID NO: 143162 - RNA, 64 nt, Human
ugagggccuggaguggugggauuggucccagugccuggcgcacauuggccugcagaguagauua

SEQ ID NO: 143163 - RNA, 64 nt, Human
cauuuuagucugacuugacuauuguuuuuccuuucuggcgcaugaauccauacaucauuccugg

SEQ ID NO: 143164 - RNA, 64 nt, Human
gccucauggguguagccgcauggcagacccauggcuggcgcagcugccuguugccgucugucuu

SEQ ID NO: 143165 - RNA, 64 nt, Human
uuagugacgucaggcccuguaaccuguguccugucuggcgcaguugcucacauucaccaaaguu

SEQ ID NO: 143166 - RNA, 64 nt, Human
ucccugcaggcgccucccguaaauccugagcucucuggcgcaaucugaaacuucucuucuguuu

SEQ ID NO: 143167 - RNA, 64 nt, Human
ccuccaugccucggcgcucgaucuccuccacgcacuggcgcacgauguagggcaccuuggaccu

SEQ ID NO: 143168 - RNA, 64 nt, Human
cguguccgccucucucucucucucucugcgcguccuggcgcaaggccugggguggagccacggc

SEQ ID NO: 143169 - RNA, 64 nt, Human
gccugcuuucuggagcuguagaaaguugaaacaccuggcgcagauugcagcgcagcuguguugg

SEQ ID NO: 143170 - RNA, 64 nt, Human
gggcaaggaaggcuggcaucauccagugaggaggcuggcgcauguugggaggcugcuggcugca

SEQ ID NO: 143171 - RNA, 64 nt, Human
ugcugcuggaaggauggggaucuuucaccuuuagggaucucagcacaauuagaaucguaaagug

SEQ ID NO: 143172 - RNA, 64 nt, Human
ucucugguucauuugauugcuugauaaggccucaggaucucagcauugcacaaugccucaugga

SEQ ID NO: 143173 - RNA, 64 nt, Human
uguguguggugggggguguucucacaaggucaugggaucucaugugaacagugugugaucaagu

SEQ ID NO: 143174 - RNA, 64 nt, Human
ucacuggaauggacaguucauugcacugacucugggaucucagcccugcuccugggagcuggaa

SEQ ID NO: 143175 - RNA, 54 nt, Human
uuguggucuuagaggauuaacuggggaucucagggccaggaguuauguuuugau

SEQ ID NO: 143176 - RNA, 64 nt, Human
acgccuuuugaugcucacgggaaauuucugcccaggaucucagccccaggcugguuguuucuac

SEQ ID NO: 143177 - RNA, 64 nt, Human
uguaccuugcuguggggcuacaggauggugggcaggaucucaagccagcccccuccagcucaug

SEQ ID NO: 143178 - RNA, 64 nt, Human
agaccucagugccagggcacucuuccuccagcugggaucucaguggcucccagcugcaugggcu

SEQ ID NO: 143179 - RNA, 64 nt, Human
uacuaggauucuuaagauggcgagaccccaagagggaucucauagcacugcugcauuugccguu

SEQ ID NO: 143180 - RNA, 64 nt, Human
cagauaggaccucugagaggggacuggcauggggggaucucagagcuuacaggcugagccaagc

SEQ ID NO: 143181 - RNA, 64 nt, Human
cuccuagucucguccgugacuuuccgguugcccuggaucucagaauauauucguccacccccuc

SEQ ID NO: 143182 - RNA, 64 nt, Human
cugcccuccccucccccacucuauacuagggacuggaucucagccucugaucaguuucacaaag

SEQ ID NO: 143183 - RNA, 64 nt, Human
ucaguugaaugcccucacuccaagacuggaugcuggaucucauagaaaauucacagccagacaa

SEQ ID NO: 143184 - RNA, 64 nt, Human
uguaccgagaaggaaggaagaaggccgaccugcaggaucucaagcauaauggauacaagggcuc

SEQ ID NO: 143185 - RNA, 64 nt, Human
cacaaaacuggggagcugagacauuuguucucuuggaucucacucucucugucccuugugccuc

SEQ ID NO: 143186 - RNA, 64 nt, Human
cuggugugacagauaccggcuggccucacuugauggaucucaguacugagcugggcauuucucu

SEQ ID NO: 143187 - RNA, 64 nt, Human
ugcagcuacgccuggguguggugaggguucuaggggaucucagauguguguagcacggagccug

SEQ ID NO: 143188 - RNA, 64 nt, Human
gcagcuaagaagacagacaguagagaaugugagaggaucucaugguucugaugaugauuaucca

SEQ ID NO: 143189 - RNA, 64 nt, Human
ugucuggaaguuggagaauucccuaucagcacagggaucucagcucuggccuggaggugaagag

SEQ ID NO: 143190 - RNA, 64 nt, Human
cuucccagccaucccugacacauuccagccaguuggaucucacagcacagcuauccacagggag

SEQ ID NO: 143191 - RNA, 64 nt, Human
uugcucuuguagcccaggcuggagugcaauggcaggaucucagaucacugcaaccucugccucc

SEQ ID NO: 143192 - RNA, 64 nt, Human
ccucacaggagaaggacagcucuuccccacccugggaucucaggagggcagccacggagugggg

SEQ ID NO: 143193 - RNA, 64 nt, Human
gcaggcaauagauuuugccuucaaggguuccuguggaucucaggaaggcaucaguguugauuaa

SEQ ID NO: 143194 - RNA, 64 nt, Human
uucuggacauugcccauggauaauucucacugauggaucucaagcuaaagcaaaccaucuuaua

SEQ ID NO: 143195 - RNA, 64 nt, Human
cauaaacauaaacuucaaaagguuuguaagauuuggaucucaacuaauuucuacauugccagaa

SEQ ID NO: 143196 - RNA, 64 nt, Human
gaaauuaaaucagacaccacauggugguguccuuggaucucacuguacagaauuagcaguguau

SEQ ID NO: 143197 - RNA, 64 nt, Human
accacuggaccaauuaccuuugaaugcuguauuuggaucucacgcugccucugugguucccucc

SEQ ID NO: 143198 - RNA, 64 nt, Human
ccguaaaugucuucaguguucuucaggguaguugggaucucaaaagauuugguucagauccaaa

SEQ ID NO: 143199 - RNA, 64 nt, Human
accaagaugaggaggggggaaggcuggguuuuuuggaucucagagauucuccucugugggaaag

SEQ ID NO: 143200 - RNA, 64 nt, Human
caguucaggccucagccccucuuucccaggcccuggaucucaccagcagccaagguugagccag

SEQ ID NO: 143201 - RNA, 64 nt, Human
ugguuuucucuuuccagacggaugucuuaaaaugggaucucaucgucugcgcagugguugcugu

SEQ ID NO: 143202 - RNA, 64 nt, Human
ccauugaacuagacugaucugcuugacagacgugggaucucaguaugguacuuggacagcagga

SEQ ID NO: 143203 - RNA, 64 nt, Human
gacauugacccugauuugaccccucuucuuauaaggaucucaagaaucucuucagaagcacuga

SEQ ID NO: 143204 - RNA, 64 nt, Human
cgcagcaucacccaaaucggcgccggccccgggaggaucucaauaaagaacucgagcgucccag

SEQ ID NO: 143205 - RNA, 64 nt, Human
uuguauuuuguauuuaacuugcauucaaaaaacaggaucucaguucuccuuucuuguaaaguaa

SEQ ID NO: 143206 - RNA, 64 nt, Human
uugcugacauggcuuugcuuuguguaaauacaguggaucucaaucuucggggugugaugaauag

SEQ ID NO: 143207 - RNA, 64 nt, Human
agaagugcuaugggccagaagccccucccuucaaggaucucaccuucacaggugagagugaccu

SEQ ID NO: 143208 - RNA, 58 nt, Human
uugaguauauugaugauuaagggccagaggaucucacuugcuuaucugaagaagauug

SEQ ID NO: 143209 - RNA, 64 nt, Human
ucauaugagucuuugaucuugaaccgauacuuuuggaucucauuguugauauaccugaauuuac

SEQ ID NO: 143210 - RNA, 64 nt, Human
ggcugaucaauaauguugcaaagggagacuacagggaucucacgacgaauauucugauacaaua

SEQ ID NO: 143211 - RNA, 64 nt, Human
ucccaaauagcagcacagcugccaagucauuugaggaucucacggaccauccggucaccagaag

SEQ ID NO: 143212 - RNA, 64 nt, Human
agaucugcugggaacagggccaccaggaguggcuggaucucagucucucugucucucuuucucu

SEQ ID NO: 143213 - RNA, 64 nt, Human
gcuaccaaaaagaaaguggcaauauauugacucaggaucucaaagcuggguguuuuagcauuac

SEQ ID NO: 143214 - RNA, 64 nt, Human
guaaauuuuuaguuuuaaugaaagcaugcaacagggaucucacacccauguuacuugccauuua

SEQ ID NO: 143215 - RNA, 64 nt, Human
caguagaaccuuaugaauguauacuagcauacaaggaucucaaauacauuaauuauucucaguu

SEQ ID NO: 143216 - RNA, 64 nt, Human
aaauaaauugcaaauuacucguacaguuuuacaaggaucucauggcagaacagcggaagacuug

SEQ ID NO: 143217 - RNA, 64 nt, Human
gaaacuuuuauaucuguugccuaguuuuguacauggaucucauuuuacaagagaaucucucugc

SEQ ID NO: 143218 - RNA, 64 nt, Human
uccuuccuccucaugcuccuggaauagggaauagggaucucaugcuugcaaacuacacaaugcu

SEQ ID NO: 143219 - RNA, 64 nt, Human
aaaaaaaaagauugauuuuuuuuuuuuugagacaggaucucacucugucauccaggcugaaguc

SEQ ID NO: 143220 - RNA, 64 nt, Human
cuggcccacccacuaauacuacugcacagagucaggaucucacauuucaccccaggcucaacug

SEQ ID NO: 143221 - RNA, 64 nt, Human
acauugccaagucagaugguacggacuuccuuuaggaucucaggcuucugcaguucucaugacu

SEQ ID NO: 143222 - RNA, 64 nt, Human
cucgcacugucacccaggguggagugcaguggcgggaucucagcucagugcaaccuccaccucc

SEQ ID NO: 143223 - RNA, 64 nt, Human
uuauucuauuuauuuuuuaauuuuuuucgagacaggaucucacucuguugcccaggauggagug

SEQ ID NO: 143224 - RNA, 64 nt, Human
uagaaauugauuauuuuuaugauagcaguauucaggaucucaucaccuuugcccguguuuuaga

SEQ ID NO: 143225 - RNA, 64 nt, Human
guggaagggagcaucaggagaggaacaaaaaaagggaucucagggagaggccagugucaaacuu

SEQ ID NO: 143226 - RNA, 64 nt, Human
uuuuucuuuuucuuuuuuuuuuuaaugugagacaggaucucauucuguugccuaggcuggagug

SEQ ID NO: 143227 - RNA, 64 nt, Human
gagucaggagccacugugaggugagaaugaaaguggaucucagcugggcacgguggcucacgcc

SEQ ID NO: 143228 - RNA, 64 nt, Human
uuaaaauauguaggacacauuauuagaauuguugggaucucauagauggaaugggaaugggggu

SEQ ID NO: 143229 - RNA, 64 nt, Human
guaguaaacucucauuuauuugggguucgcucuuggaucucauccauccauuguguucucuuua

SEQ ID NO: 143230 - RNA, 64 nt, Human
ugcuuccccaccaaagauguccugggauucugcuggaucucaaagaugugccaagccaaggaaa

SEQ ID NO: 143231 - RNA, 64 nt, Human
uggacucggaaagccagacuccacgcaggaccagggaucucacgaggcacgcaggcuccguggc

SEQ ID NO: 143232 - RNA, 64 nt, Human
agcagaagagagaaauagugucacaucaagggcaggaucucauagcuagggaacauuucacaaa

SEQ ID NO: 143233 - RNA, 64 nt, Human
acuugggagcuuuggagaaaauagcaguaccaagggaucucaccauucagagauccugauucag

SEQ ID NO: 143234 - RNA, 64 nt, Human
cacagaagcuuuugcuucguaaagauaauccaaaggaucucagacccgcucuuccuuuucccuu

SEQ ID NO: 143235 - RNA, 64 nt, Human
aaaaauaaauuuacacuggauaugcgaaggguuuggaucucagauaaaugcauuuuguggaauu

SEQ ID NO: 143236 - RNA, 64 nt, Human
ccuccuccucccuccucccccuccucucuggcagggaucucagaugaccguggccucccucuca

SEQ ID NO: 143237 - RNA, 64 nt, Human
caggucacggggcagaaucucucagguugcugugggaucucagugugccccuaccuguucuccc

SEQ ID NO: 143238 - RNA, 64 nt, Human
auuguuuuuuuuuaauuuaucuuuuguagagaugggaucucacuauguugcucaggcugaucuc

SEQ ID NO: 143239 - RNA, 64 nt, Human
guuuucuggccuuguuauauacagauggcagcuuggaucucagguacagcuccaggggcaggca

SEQ ID NO: 143240 - RNA, 64 nt, Human
gaaggccauauuguccauaaaugcucagugcucaggaucucauuaauaugccgaaccuaacuac

SEQ ID NO: 143241 - RNA, 64 nt, Human
cguguuggcaguggaaucagccugugcaggcuggggaucucaggcugaucaguaggggccagcu

SEQ ID NO: 143242 - RNA, 64 nt, Human
cugcuccagagcacggcugaccauuucugcuccgggaucucagcucccguuccccaagcacacu

SEQ ID NO: 143243 - RNA, 64 nt, Human
ggcucccuuugucucuguaccuuuaccaacauuaggaucucaccucuuucuuccucccuuaauu

SEQ ID NO: 143244 - RNA, 64 nt, Human
gcuuucagacagagcccacuuagcuuguccacauggaucucaaugccaauccuccauucuuccu

SEQ ID NO: 143245 - RNA, 64 nt, Human
agacguuuuuaaaacguagaggauuuauauucaaggaucucaaagaaagcauuuucauuucacu

SEQ ID NO: 143246 - RNA, 64 nt, Human
uccaucuaaaaaaaaaaauguuuuuuuuaagacaggaucucauucuguugcccagacuagagua

SEQ ID NO: 143247 - RNA, 64 nt, Human
cuugaucugucacccaggcuggaguacaguggcaggaucucagcuuacugcagcuuccaucucc

SEQ ID NO: 143248 - RNA, 64 nt, Human
gagucuuagucacccagacuagaggucaguggcaggaucucagcucacugcaaccucugccucc

SEQ ID NO: 143249 - RNA, 64 nt, Human
aaguauuggacucuacaaauagguucuauauuugggaucucauccuaggagaaaacccaaaacu

SEQ ID NO: 143250 - RNA, 64 nt, Human
cucacucuaucacacaggcuggagggcaguggcaggaucucaguucaccccaaccuuugccuca

SEQ ID NO: 143251 - RNA, 64 nt, Human
auaggaagacagaccauaggcaaacucuguuuugggaucucaacuccaucaccuuuguuucaau

SEQ ID NO: 143252 - RNA, 64 nt, Human
aaucaagagaaacuucaaaguuaaugggauggucggaucucacaggcugagaacucguucaccu

SEQ ID NO: 143253 - RNA, 64 nt, Human
aaaguauguauuuuuaaauuuuuuuguagagacaggaucucacuauguucuccagcuggucuca

SEQ ID NO: 143254 - RNA, 64 nt, Human
agcuagaaugcugccuauauuuuaauaaggauuuggaucucacaagacaccuuaggccuuacac

SEQ ID NO: 143255 - RNA, 64 nt, Human
ugagaugaaugaacauaucauuuuaucauccaaaggaucucacuggacuguucaacuuccagcc

SEQ ID NO: 143256 - RNA, 64 nt, Human
uacagccaggcggcuggaauugaauucccugccuggaucucacaagcacuuucccucuuggugc

SEQ ID NO: 143257 - RNA, 64 nt, Human
uacagccaggcggccaggauucaacucccugccuggaucucaccagcacuuucccucuguuucc

SEQ ID NO: 143258 - RNA, 64 nt, Human
uugacuccucuuuuuguccaaaagugaucuggucggaucucacaaggccauccaaugagacccc

SEQ ID NO: 143259 - RNA, 64 nt, Human
uauuuaaugccuuuacaauaccuuuaauuuauuaggaucucagaaucauuguuuacuaucccuu

SEQ ID NO: 143260 - RNA, 64 nt, Human
agcccuccgcaucuaucagcagguugccccggauggaucucagagaugaggauuggaacaccau

SEQ ID NO: 143261 - RNA, 64 nt, Human
uaagagagugguugggaaacccaggguguuccuuggaucucaggaucugagccaucgagggaag

SEQ ID NO: 143262 - RNA, 64 nt, Human
aguguguggccucaauauuauacauuaugccucuggaucucaacuacucauuugccaagucagu

SEQ ID NO: 143263 - RNA, 64 nt, Human
uuuucuuuuccccucuaaaccuguuucugagaguggaucucaagcaaguucaugccuucaauca

SEQ ID NO: 143264 - RNA, 64 nt, Human
cggccccccagacaccgaccccacaggccgucccggaucucagcggacacaggcaggagcgccc

SEQ ID NO: 143265 - RNA, 64 nt, Human
aagccagagacagaaauaggcuaagccugcaguaggaucucagccacaagggccccgcaggaug

SEQ ID NO: 143266 - RNA, 64 nt, Human
agcuuuucaaaugugaaaucauuuuuggaagcuuggaucucauuaaacuucaugucucuauucc

SEQ ID NO: 143267 - RNA, 64 nt, Human
uucccuuuuaaauguuuguuuguuuuuugagacaggaucucacucuguugccagggcuguagug

SEQ ID NO: 143268 - RNA, 64 nt, Human
cugcuuuguuuucucagaagugaaaagcuucgguggaucucagccuuggccaugccaagagagg

SEQ ID NO: 143269 - RNA, 64 nt, Human
cuuugcaacugggccuaaguucuguuuccuuuauggaucucaaauuuucaucugcacaaugagg

SEQ ID NO: 143270 - RNA, 64 nt, Human
acuuucuagaucuaaagcuuaaggacuauggaguggaucucauugaaguuucagacaauggaug

SEQ ID NO: 143271 - RNA, 64 nt, Human
ggccagcuaggaagcaaggguuggaggcaaugugggaucucagacccaguagcugcccuuccug

SEQ ID NO: 143272 - RNA, 64 nt, Human
uuaaauaucaccuauacucugccacaucccaaagggaucucaagccuucagcucuccccugaac

SEQ ID NO: 143273 - RNA, 64 nt, Human
gaguggucggaccguggggaagggccccacucagggaucucagaccuagugcucccuuccuccu

SEQ ID NO: 143274 - RNA, 64 nt, Human
cccauuuuauuuuuuuauuuuuuuuuucgagacaggaucucacucuguagcacaggcuggauug

SEQ ID NO: 143275 - RNA, 64 nt, Human
uuuuggucacaucacuaugccgagcaagaaaaguggaucucagggaggacuagcagccccuggu

SEQ ID NO: 143276 - RNA, 64 nt, Human
gaguggccagcgagggcgugucuagcuugauguuggaucucaagagcccugucaguagaguaga

SEQ ID NO: 143277 - RNA, 57 nt, Human
gacaaacauacaacaauuaauuuuaguggaucucaaacuugucuuaaaucaacaacc

SEQ ID NO: 143278 - RNA, 64 nt, Human
augaguccuuuguaauuuauuuuuuuuugagacaggaucucacuuuuaccgcccaggcuggagu

SEQ ID NO: 143279 - RNA, 64 nt, Human
uuaaaaacaacuuuaaagguucuuuugugagccaggaucucagacugccguagcaugaugcugu

SEQ ID NO: 143280 - RNA, 64 nt, Human
cagccccagcaacacaaagaauuuuuaaucacacggaucucaaauucacaaauguuaacaugga

SEQ ID NO: 143281 - RNA, 64 nt, Human
aagucucaccauucuguccugggagagaagaggaggaucucaucucucaucuguccaaacaagg

SEQ ID NO: 143282 - RNA, 64 nt, Human
aaaagcuggugguguaggacuuaaccucauuggaggaucucacuuaauucucuaugacauugau

SEQ ID NO: 143283 - RNA, 64 nt, Human
ggaaacacacacagcuccugcugacuccccuuauggaucucaguuugcuccuuuuuauggaccu

SEQ ID NO: 143284 - RNA, 64 nt, Human
uagaaaccaggcaggacaguagaucccuaugguuggaucucagcuggaaguucuguuuggagcc

SEQ ID NO: 143285 - RNA, 64 nt, Human
gcccagggcugccaggaacaaguuccucucugcaggaucucacagcagcccugagaagacaugg

SEQ ID NO: 143286 - RNA, 64 nt, Human
ggagccccgcgcgcugggguugcgccccggaggcggaucucaggcacccccgccuuggcccgug

SEQ ID NO: 143287 - RNA, 64 nt, Human
caugacuagugccuagaaagcaaugugauggucaggaucucaugacauuauauuugaguuucuu

SEQ ID NO: 143288 - RNA, 64 nt, Human
uuuaggccuguauuucuauggaaagauacaaaaaggaucucaguuuggggccuguccuaaugcc

SEQ ID NO: 143289 - RNA, 64 nt, Human
augcggaccuccugcgcaaagcugagacuguccuggaucucauggugaccaacucucagaaacu

SEQ ID NO: 143290 - RNA, 64 nt, Human
gaacugcagagggcugugcacacaguagcacacaggaucucacaguaacgcggcaugggaacag

SEQ ID NO: 143291 - RNA, 64 nt, Human
gaagaaaguuuccaagcuaggucuggcccguuggggaucucagcaguggggcaggagggugccu

SEQ ID NO: 143292 - RNA, 64 nt, Human
uuguggcugggaauaagcccagcugagcagguggggaucucagccagccucccagacugcaccu

SEQ ID NO: 143293 - RNA, 64 nt, Human
caucccagaccucacagucccucagguucuacugggaucucaucaucauccuuagucaagcagc

SEQ ID NO: 143294 - RNA, 64 nt, Human
caucucugcugauugaaugucccuccaggcaccaggaucucaucauuuccccaucagagggugu

SEQ ID NO: 143295 - RNA, 64 nt, Human
caccucaucccuucuagaaauaggaggagccccaggaucucaggacagagacuuauagacacua

SEQ ID NO: 143296 - RNA, 64 nt, Human
cccagcuccucucugcaugcugagggcuaaauugggaucucagccugcccuaaucuuuccccau

SEQ ID NO: 143297 - RNA, 64 nt, Human
cauaauacagagaaaaauuaaucacaacugaccuggaucucagaugcuagaaauaguagacaaa

SEQ ID NO: 143298 - RNA, 64 nt, Human
auaaacgugacguuccaguugcucaacuacugcaggaucucaggacuaaggagagagaaggcua

SEQ ID NO: 143299 - RNA, 64 nt, Human
agcaagcucaccaggccucucagaagucccagcaggaucucacggacugccgggucggcgccuc

SEQ ID NO: 143300 - RNA, 64 nt, Human
agacugaaacggccccauugccuggucuaguagcggaucucacucagccgcagacaaguaauca

SEQ ID NO: 143301 - RNA, 64 nt, Human
ucccccaaccuuagauguucuaagucuuuccauuggaucucauuggacccuuccauggugugau

SEQ ID NO: 143302 - RNA, 64 nt, Human
ggagggguucucccugccccccgccguggccuugggaucucacccucuccauguccuggggaca

SEQ ID NO: 143303 - RNA, 64 nt, Human
aaacguuaggugcuaaccaccugcccagaagaguggaucucacagcccaggaacauucccaagc

SEQ ID NO: 143304 - RNA, 64 nt, Human
cacccauagaccuucagaucaucucccacacccuggaucucacucuccucuuaguaacagagac

SEQ ID NO: 143305 - RNA, 64 nt, Human
ccuuaauauuauugggguugguugggguggggcaggaucucagccauaaagugccaguuugcuu

SEQ ID NO: 143306 - RNA, 64 nt, Human
guauacucuuaaguauagagguuuuguaucuagaggaucucaguucaacuccugucucuccaua

SEQ ID NO: 143307 - RNA, 64 nt, Human
uggggagggggucauuguucuccucguccaucagggaucucagaggcucagagacugcaagcug

SEQ ID NO: 143308 - RNA, 64 nt, Human
uucuucuuuuuuuugggggggcggggcgggggagggaucucaaaguuuuagucuuccagaaucc

SEQ ID NO: 143309 - RNA, 64 nt, Human
ucuuucuuuuuuuuucggggagggguuaaagacaggaucucacucuggcgcucuggagugcagu

SEQ ID NO: 143310 - RNA, 64 nt, Human
aggcgcccuuggcuucugugaugagcugaucugcggaucucagcuuugagaagccuucagcucc

SEQ ID NO: 143311 - RNA, 64 nt, Human
uaugccugaauauuuuuauuuuuguguagacacgggaucucacuauguugccuaggcuggucuu

SEQ ID NO: 143312 - RNA, 64 nt, Human
ucucagucugcuugaauggugaugagauucugcuggaucucagcacgcugcaggugucuuuuga

SEQ ID NO: 143313 - RNA, 64 nt, Human
gggggaaucuugccuuucccuuucagagccccagggaucucaucuggggaacugucauugccag

SEQ ID NO: 143314 - RNA, 64 nt, Human
ugcugaccucugccaggacccacacagcuucgauggaucucaguguuuguuaacaaaauacaaa

SEQ ID NO: 143315 - RNA, 64 nt, Human
auuagcuucagcuugggcuggagcagucaauauaggaucucaggccaggcccgcuuuucuagaa

SEQ ID NO: 143316 - RNA, 64 nt, Human
caaucguuucuuccgugcagagcaaaaucacucaggaucucauggccaaagucagagcgaugcu

SEQ ID NO: 143317 - RNA, 64 nt, Human
aauucauagaguagagugaaccuaugacugcaguggaucucaaaaacuuuuaaaaccauagaca

SEQ ID NO: 143318 - RNA, 64 nt, Human
cuuuuuggucucagaccccacucuuagaaauugaggaucucaaagagcuuugcuuauauuuugu

SEQ ID NO: 143319 - RNA, 64 nt, Human
cuugcuuugucacccacgcuggaaugcaguggcgggaucucagcucaccgcaaccuccaccucc

SEQ ID NO: 143320 - RNA, 64 nt, Human
uccuuugcucugccuuauuuucaauugacugaauggaucucaccagauuuuguaucuauugcuc

SEQ ID NO: 143321 - RNA, 64 nt, Human
aggccagggcuccuuaucagcuuccaggcggcugggaucucaggcagggugugcgucagcccuc

SEQ ID NO: 143322 - RNA, 64 nt, Human
auuaagcuuucugggccacuggaacaaagaacuaggaucucacaggaaaagcuggguaacucaa

SEQ ID NO: 143323 - RNA, 64 nt, Human
agcacauaagcagaggcugcaggaacuuguguggggaucucaaugcuuuccacauuucuuucuc

SEQ ID NO: 143324 - RNA, 64 nt, Human
guugauucaagcaagugaaucccugacauuuugaggaucucacauuagacaccaacaaauuaaa

SEQ ID NO: 143325 - RNA, 50 nt, Human
caaacaaggaagagaaaugaggaucucaggaccuugguggacacugugua

SEQ ID NO: 143326 - RNA, 64 nt, Human
augccugaguauguaaccaaaagaauugaaauccggaucucaaagagguaugugcacucccaug

SEQ ID NO: 143327 - RNA, 64 nt, Human
cucuucuuugcuuaacacaauuaucuuguguuaaggaucucaaagauuucaugagacaagcugg

SEQ ID NO: 143328 - RNA, 64 nt, Human
ugggugggcccccauaauaaguuccuaaagcaugggaucucaucgaauaagacucaucauuuaa

SEQ ID NO: 143329 - RNA, 64 nt, Human
cuucaguauauauauuuuguuuguuuuagagaugggaucucaccauguugcccaggcuagucuu

SEQ ID NO: 143330 - RNA, 64 nt, Human
caggcugccucccucucagccuggacagcuaccaggaucucacugggucucagggcccagagcu

SEQ ID NO: 143331 - RNA, 64 nt, Human
cacagggucccggcacucccucgggacccauucaggaucucagcugggcaggggugccacccaa

SEQ ID NO: 143332 - RNA, 64 nt, Human
guuaaugggcucugcccucauccccacagucuugggaucucagggcacaauggcuggacauggg

SEQ ID NO: 143333 - RNA, 64 nt, Human
uuggaggcagggaugggaggaucacuugaggccaggaucucaggaccagccuagagagauccca

SEQ ID NO: 143334 - RNA, 64 nt, Human
cugggggaugugugggcaagagguggauugagcaggaucucaggguuaugucgaggaagggaag

SEQ ID NO: 143335 - RNA, 64 nt, Human
gcacuuuaaaguuucugcaguccuuugacacauaggaucucauggagccucacgucuacucccu

SEQ ID NO: 143336 - RNA, 64 nt, Human
cuggccucccacccgaugcugcuuuccccuguggggaucucaggggcuguuugaggauauauuu

SEQ ID NO: 143337 - RNA, 64 nt, Human
auauuuuauacaucuccagagccuuucaucuugaggaucucaaagaccguagaagacauuuaau

SEQ ID NO: 143338 - RNA, 64 nt, Human
agcgcagccccgcagagcuccaggguggccaaguggaucucaccggggccaccugccccuacac

SEQ ID NO: 143339 - RNA, 64 nt, Human
uuauaacuuuuuaaagggcucuuuguauagcagaggaucucauuugacuuuguuuugaugaggg

SEQ ID NO: 143340 - RNA, 64 nt, Human
uggcaagacaaaugaugagcaggaaaacaccacuggaucucacaccuucaauccaugaccaucc

SEQ ID NO: 143341 - RNA, 64 nt, Human
ccccuccccaaccucagugacugacagaggauccggaucucagagccugagaccagguuuauug

SEQ ID NO: 143342 - RNA, 64 nt, Human
ucgcaccaacacuccaccgcgaucugccugcgggggaucucagcgcagagaaguugagaggacc

SEQ ID NO: 143343 - RNA, 64 nt, Human
uauuuuauuuuauuuuuuauuuuuuguagaaauaggaucucacuauguugcccaggcuguucuu

SEQ ID NO: 143344 - RNA, 64 nt, Human
uaaggcauaacagcacauucaucccuuugguuugggaucucaggaauacagucccaugcaaaga

SEQ ID NO: 143345 - RNA, 64 nt, Human
aauucccgcggccuccaccugcuugcuaggggcaggaucucauucaggcugcccuggaagcacc

SEQ ID NO: 143346 - RNA, 64 nt, Human
agguagcacugggcacgaggagugggccacagcaggaucucaacgggaaagcagccagaggggu

SEQ ID NO: 143347 - RNA, 64 nt, Human
ccucagccagcuccggggcucucaucuuccacucggaucucagauugguucguuguggaugcuc

SEQ ID NO: 143348 - RNA, 64 nt, Human
cccuuccacugauuuuuuaaagugaaccauugcuggaucucagauucuguggcaucuaaggccu

SEQ ID NO: 143349 - RNA, 64 nt, Human
gcauuagggaauuccgcuggcauuagcauugcugggaucucaacuucucuauugaggagggggu

SEQ ID NO: 143350 - RNA, 64 nt, Human
gcacaguacgcagagcaagcucgggaaguugguaggaucucaggcuuggggccgggacucugga

SEQ ID NO: 143351 - RNA, 64 nt, Human
ggguaacgugguuuacucucccggacgcguccugggaucucaaccccagcagucuggcuuguuu

SEQ ID NO: 143352 - RNA, 64 nt, Human
aauaccacuuuuuagaaaaauuacgauagagaugggaucucacuagguugcccaggcugguguc

SEQ ID NO: 143353 - RNA, 64 nt, Human
cuggauuuggugaucagacucuauauugacaguaggaucucaaacccugcauccauccuuccuc

SEQ ID NO: 143354 - RNA, 64 nt, Human
uuggauucacuaaaaagggcccugguaaaauaguggaucucaguuuuuaagaguacaagcucuu

SEQ ID NO: 143355 - RNA, 64 nt, Human
uucagguauaggaaugagaugccucguggugaaaggaucucacccugggaagauguggugcccc

SEQ ID NO: 143356 - RNA, 64 nt, Human
guccucacucuugucccugaaugggucccuguguggaucucagugugugugugguuucuccacu

SEQ ID NO: 143357 - RNA, 64 nt, Human
gaauggucaaucccuguccugguuguccaagucgggaucucagaggaaauugcagugauuccac

SEQ ID NO: 143358 - RNA, 50 nt, Human
cacagcuccuggacuucuagggaucucagccguggcugaggccaccccca

SEQ ID NO: 143359 - RNA, 64 nt, Human
acaugggccagguuuuucaaaaggaauauaaacaggaucucaaacuugauuaaauguuagacca

SEQ ID NO: 143360 - RNA, 64 nt, Human
agcuaaagcagccucuugcaaugguaggaaaaaaggaucucaaauagcaugaguguaugucuau

SEQ ID NO: 143361 - RNA, 64 nt, Human
augcagaaggggaggccgaggugggaggaucauuggaucucaggaguucgagaucagcaugggc

SEQ ID NO: 143362 - RNA, 64 nt, Human
augcuggggcauccggguugggauggagauaggaggaucucaguauauuuguuucguaguuuuu

SEQ ID NO: 143363 - RNA, 64 nt, Human
ugagugacaaagugacugcccggucagaucagcuggaucucagcggggagccacgucucuugca

SEQ ID NO: 143364 - RNA, 64 nt, Human
gcugcccacucaugggcccuucaccaccugcccaggaucucacccaguacugacagcuccucuu

SEQ ID NO: 143365 - RNA, 64 nt, Human
ugaaaaaauggacuaccuuuuucagggaucuuuuggaucucacagaguucuuaagauggaauuu

SEQ ID NO: 143366 - RNA, 64 nt, Human
agccugggugcagguuggcuggguccucuacuugggaucucaggaggcugcaaucaaagcauuc

SEQ ID NO: 143367 - RNA, 64 nt, Human
ucucuaauaaauggaaggccccaaggcccugaggggaucucaaauccuggaaccccgauuucaa

SEQ ID NO: 143368 - RNA, 64 nt, Human
ucuauuuauguaacaacacagcuaauuuacucuuggaucucauucucccuuuuuauccugaguu

SEQ ID NO: 143369 - RNA, 64 nt, Human
ggguucaagcgauucuccugccucagccucccggggaucucaagggcauuucccuuugcccacc

SEQ ID NO: 143370 - RNA, 64 nt, Human
guggcugaggccaccgcugggacugcuccuagauggaucucagcggcauuaagcugugccugag

SEQ ID NO: 143371 - RNA, 64 nt, Human
gugaaguuucauagaaacaaggaguuggcaucuuggaucucagaauggccuggaaacggauggc

SEQ ID NO: 143372 - RNA, 64 nt, Human
ccauuuuaaaugggucaccccauuuaggauuaguggaucucaaauuauuaaccaaacaucacuc

SEQ ID NO: 143373 - RNA, 64 nt, Human
gaacauucaguauaauucuacuuugucucauuuuggaucucacuguugucuuuauaaaaauggc

SEQ ID NO: 143374 - RNA, 64 nt, Human
cccacacacaguuccuacugucuucaguccauggggaucucaucacccacucccagccccagcu

SEQ ID NO: 143375 - RNA, 64 nt, Human
cugguucuguuucccaggcuggagugcaguggugggaucucagcucacugcaacauccgccucu

SEQ ID NO: 143376 - RNA, 64 nt, Human
ggguccagacaggagauuuggauauaggagcucuggaucucagcugugguuccuuucuaggagc

SEQ ID NO: 143377 - RNA, 64 nt, Human
agaugugugggcacauguuauggcagauugaaaaggaucucauuccaugggaaaaaaaaaaauc

SEQ ID NO: 143378 - RNA, 64 nt, Human
gguaacauuaacaaaagaauucccuguaucaucuggaucucaacaucggaaaaaagaagcggau

SEQ ID NO: 143379 - RNA, 64 nt, Human
uccgauuugggccauuuaugcaccccgcaaccugggaucucaaggagcuuuaaagucuuaaugg

SEQ ID NO: 143380 - RNA, 64 nt, Human
aguugggggcugggaagggcggggcccugccuggggaucucaaggaugaggccccagcauggag

SEQ ID NO: 143381 - RNA, 58 nt, Human
agcccagcaagggucuuugagaccugggggaucucaggagccaccugggauggcccug

SEQ ID NO: 143382 - RNA, 64 nt, Human
caguuaacaaguuaaggaccgaaguguuucaaguggaucucaguaaaggaucuuuggagccaga

SEQ ID NO: 143383 - RNA, 64 nt, Human
agucucugucuuccuguccugugcaggcgcccuuggaucucaguuucccucacucaggaacucu

SEQ ID NO: 143384 - RNA, 64 nt, Human
ggaggguaggcaggauuggggaagagagccugcaggaucucaccaggcagccucuggggggugg

SEQ ID NO: 143385 - RNA, 64 nt, Human
uagcaggaggucuugaagugugcugugaaccgagggaucucaggaguuggguccagaugugggg

SEQ ID NO: 143386 - RNA, 64 nt, Human
aggcuguuguggacaaucaagaggaugaauggggggaucucaaggcccaaaugcuggaccacau

SEQ ID NO: 143387 - RNA, 64 nt, Human
uaagguucucuugcauauauuucaagugaauguuggaucucagacuaaccauaguaauaauaca

SEQ ID NO: 143388 - RNA, 64 nt, Human
ccaagaaugacaaacacaagugccccuuuucucuggaucucaagaaugguggaggacccuggaa

SEQ ID NO: 143389 - RNA, 64 nt, Human
gaaaacccugagucacagauuucugugggacuguggaucucacuggaagcuauccaagagccca

SEQ ID NO: 143390 - RNA, 64 nt, Human
caauacccaaagaaagacaagugacaggggcaauggaucucaggcucugagauaaguauaucag

SEQ ID NO: 143391 - RNA, 64 nt, Human
uuggcacuuggggacaugaguaguugucugggauacgucauauucucaacaguuucuuuguagu

SEQ ID NO: 143392 - RNA, 64 nt, Human
ugucccagaagucacuguauuuuugaaacuucuaacgucauaauuaaguuucucuugucuuggc

SEQ ID NO: 143393 - RNA, 64 nt, Human
aguauagaaacuuuuuuucucccagagccacccaacgucauaaaacugguaguacucuaauggu

SEQ ID NO: 143394 - RNA, 64 nt, Human
uucuaaaacuuagaaggacccguccugggaaagaacgucauaaaauacgaaaaauguguuagaa

SEQ ID NO: 143395 - RNA, 64 nt, Human
cucgacuuuggacagaguaaugacuccccagaaaacgucauauaagacuuuaccagccccugag

SEQ ID NO: 143396 - RNA, 64 nt, Human
uuauuguaaauuaaauaacugaaauuguggugagacgucauagucuucaugagaacgugggggu

SEQ ID NO: 143397 - RNA, 64 nt, Human
gguaucuacccagccuagaaagcacaggaacaauacgucauauauuuggaacaguuauugucug

SEQ ID NO: 143398 - RNA, 64 nt, Human
cuccacaggguuuggagaauagaaaugaaaagccacgucauauaacucaagaauaaaugguguu

SEQ ID NO: 143399 - RNA, 64 nt, Human
cauuaagucaaggagacugagaaugacucaagggacgucauaguaccauaguuuuaaggaccaa

SEQ ID NO: 143400 - RNA, 64 nt, Human
uauucauacuagcaugcucaugaccaacacauacacgucauagaagaaaauaguggugcuucuu

SEQ ID NO: 143401 - RNA, 64 nt, Human
augacagauuauguuucaacucuguagauguuuaacgucauagacaguuggcccucuguauccg

SEQ ID NO: 143402 - RNA, 64 nt, Human
ugauugaugggccaaaaaaagcaaucaaagucuuacgucauagaggaccaccuuuuggaucaua

SEQ ID NO: 143403 - RNA, 64 nt, Human
gcacacuccaggaagacugccacgucgcgccaacacgucauacucaaugccucagacuuucaua

SEQ ID NO: 143404 - RNA, 64 nt, Human
cggggcuccgaugccuucuucgacgcgcuggaccacgucauagacauacacggacacaucaucg

SEQ ID NO: 143405 - RNA, 64 nt, Human
uggguagaagaggaccaggggggcaagagcaacaacgucauaauggagaagucagacuuugguc

SEQ ID NO: 143406 - RNA, 64 nt, Human
cugggccuuccgcggcgauggcgcugcgcuaaugacgucauaggcccggacucgcgugagugcg

SEQ ID NO: 143407 - RNA, 64 nt, Human
caaaucaaaacaccagaaauauuuuuauauguuaacgucauauuauguuaauguugcugaaaac

SEQ ID NO: 143408 - RNA, 64 nt, Human
cuuuaugauauugugauagggaaaaaaaucauugacgucauagaauauucuucuuccucucagg

SEQ ID NO: 143409 - RNA, 64 nt, Human
cuucgucuuaagccagauucucugauucuuuuagacgucauagcuccuuaguucugcuccuguc

SEQ ID NO: 143410 - RNA, 64 nt, Human
gcacccgcucucccucccucccugcuggaggaacacgucauaucagaugagaggaagauggccu

SEQ ID NO: 143411 - RNA, 64 nt, Human
uuauguaggaauaauguuuggacuugauuuccccacgucauaaugaagaauggaaguuuggauc

SEQ ID NO: 143412 - RNA, 64 nt, Human
uuuuagacuugguuaggacaugaauucuuuacaaacgucauauuucacagaugcgagaaaacuu

SEQ ID NO: 143413 - RNA, 64 nt, Human
cacaguaauuauugauuuguacaaaaaucacuugacgucauaaccuuaaagugacacugcucug

SEQ ID NO: 143414 - RNA, 64 nt, Human
ucaagaggcuuuuaaacaaauaaauauggaagucacgucauaaucuaccuuugcaaagccauac

SEQ ID NO: 143415 - RNA, 64 nt, Human
guuacaaaauguaacuguuaccauuggaaauuucacgucauaggaaguuagccuuuaucuacca

SEQ ID NO: 143416 - RNA, 64 nt, Human; identical to SEQ ID NO: 31718

SEQ ID NO: 143417 - RNA, 64 nt, Human; identical to SEQ ID NO: 31719

SEQ ID NO: 143418 - RNA, 64 nt, Human; identical to SEQ ID NO: 31720

SEQ ID NO: 143419 - RNA, 64 nt, Human; identical to SEQ ID NO: 31721

SEQ ID NO: 143420 - RNA, 64 nt, Human; identical to SEQ ID NO: 31722

SEQ ID NO: 143421 - RNA, 64 nt, Human; identical to SEQ ID NO: 31723

SEQ ID NO: 143422 - RNA, 64 nt, Human; identical to SEQ ID NO: 31724

SEQ ID NO: 143423 - RNA, 64 nt, Human; identical to SEQ ID NO: 31725

SEQ ID NO: 143424 - RNA, 64 nt, Human; identical to SEQ ID NO: 31726

SEQ ID NO: 143425 - RNA, 61 nt, Human; identical to SEQ ID NO: 31727

SEQ ID NO: 143426 - RNA, 64 nt, Human; identical to SEQ ID NO: 31728

SEQ ID NO: 143427 - RNA, 64 nt, Human; identical to SEQ ID NO: 31729

SEQ ID NO: 143428 - RNA, 64 nt, Human; identical to SEQ ID NO: 31730

SEQ ID NO: 143429 - RNA, 64 nt, Human; identical to SEQ ID NO: 31731

SEQ ID NO: 143430 - RNA, 64 nt, Human; identical to SEQ ID NO: 31732

SEQ ID NO: 143431 - RNA, 64 nt, Human; identical to SEQ ID NO: 31733

SEQ ID NO: 143432 - RNA, 64 nt, Human; identical to SEQ ID NO: 31734

SEQ ID NO: 143433 - RNA, 64 nt, Human; identical to SEQ ID NO: 31735

SEQ ID NO: 143434 - RNA, 64 nt, Human; identical to SEQ ID NO: 31736

SEQ ID NO: 143435 - RNA, 64 nt, Human; identical to SEQ ID NO: 31737

SEQ ID NO: 143436 - RNA, 64 nt, Human; identical to SEQ ID NO: 31738

SEQ ID NO: 143437 - RNA, 64 nt, Human; identical to SEQ ID NO: 31739

SEQ ID NO: 143438 - RNA, 64 nt, Human; identical to SEQ ID NO: 31740

SEQ ID NO: 143439 - RNA, 64 nt, Human; identical to SEQ ID NO: 31741

SEQ ID NO: 143440 - RNA, 64 nt, Human; identical to SEQ ID NO: 31742

SEQ ID NO: 143441 - RNA, 64 nt, Human; identical to SEQ ID NO: 31743

SEQ ID NO: 143442 - RNA, 64 nt, Human; identical to SEQ ID NO: 31744

SEQ ID NO: 143443 - RNA, 64 nt, Human; identical to SEQ ID NO: 31745

SEQ ID NO: 143444 - RNA, 64 nt, Human; identical to SEQ ID NO: 31746

SEQ ID NO: 143445 - RNA, 64 nt, Human; identical to SEQ ID NO: 31747

SEQ ID NO: 143446 - RNA, 64 nt, Human; identical to SEQ ID NO: 31748

SEQ ID NO: 143447 - RNA, 64 nt, Human; identical to SEQ ID NO: 31749

SEQ ID NO: 143448 - RNA, 64 nt, Human; identical to SEQ ID NO: 31750

SEQ ID NO: 143449 - RNA, 64 nt, Human; identical to SEQ ID NO: 31751

SEQ ID NO: 143450 - RNA, 64 nt, Human; identical to SEQ ID NO: 31752

SEQ ID NO: 143451 - RNA, 64 nt, Human; identical to SEQ ID NO: 31753

SEQ ID NO: 143452 - RNA, 62 nt, Human; identical to SEQ ID NO: 31754

SEQ ID NO: 143453 - RNA, 64 nt, Human; identical to SEQ ID NO: 31755

SEQ ID NO: 143454 - RNA, 64 nt, Human; identical to SEQ ID NO: 31756

SEQ ID NO: 143455 - RNA, 64 nt, Human; identical to SEQ ID NO: 31757

SEQ ID NO: 143456 - RNA, 54 nt, Human; identical to SEQ ID NO: 31758

SEQ ID NO: 143457 - RNA, 64 nt, Human; identical to SEQ ID NO: 31759

SEQ ID NO: 143458 - RNA, 64 nt, Human; identical to SEQ ID NO: 31760

SEQ ID NO: 143459 - RNA, 64 nt, Human; identical to SEQ ID NO: 31761

SEQ ID NO: 143460 - RNA, 64 nt, Human; identical to SEQ ID NO: 31762

SEQ ID NO: 143461 - RNA, 64 nt, Human; identical to SEQ ID NO: 31763

SEQ ID NO: 143462 - RNA, 64 nt, Human; identical to SEQ ID NO: 31764

SEQ ID NO: 143463 - RNA, 64 nt, Human; identical to SEQ ID NO: 31765

SEQ ID NO: 143464 - RNA, 64 nt, Human; identical to SEQ ID NO: 31766

SEQ ID NO: 143465 - RNA, 64 nt, Human; identical to SEQ ID NO: 31767

SEQ ID NO: 143466 - RNA, 64 nt, Human; identical to SEQ ID NO: 31768

SEQ ID NO: 143467 - RNA, 64 nt, Human; identical to SEQ ID NO: 31769

SEQ ID NO: 143468 - RNA, 64 nt, Human; identical to SEQ ID NO: 31770

SEQ ID NO: 143469 - RNA, 64 nt, Human; identical to SEQ ID NO: 31771

SEQ ID NO: 143470 - RNA, 64 nt, Human; identical to SEQ ID NO: 31772

SEQ ID NO: 143471 - RNA, 64 nt, Human; identical to SEQ ID NO: 31773

SEQ ID NO: 143472 - RNA, 64 nt, Human; identical to SEQ ID NO: 31774

SEQ ID NO: 143473 - RNA, 64 nt, Human; identical to SEQ ID NO: 31775

SEQ ID NO: 143474 - RNA, 64 nt, Human; identical to SEQ ID NO: 31776

SEQ ID NO: 143475 - RNA, 64 nt, Human; identical to SEQ ID NO: 31777

SEQ ID NO: 143476 - RNA, 64 nt, Human; identical to SEQ ID NO: 31778

SEQ ID NO: 143477 - RNA, 64 nt, Human; identical to SEQ ID NO: 31779

SEQ ID NO: 143478 - RNA, 64 nt, Human; identical to SEQ ID NO: 31780

SEQ ID NO: 143479 - RNA, 64 nt, Human; identical to SEQ ID NO: 31781

SEQ ID NO: 143480 - RNA, 64 nt, Human; identical to SEQ ID NO: 31782

SEQ ID NO: 143481 - RNA, 64 nt, Human; identical to SEQ ID NO: 31783

SEQ ID NO: 143482 - RNA, 64 nt, Human; identical to SEQ ID NO: 31784

SEQ ID NO: 143483 - RNA, 64 nt, Human; identical to SEQ ID NO: 31785

SEQ ID NO: 143484 - RNA, 64 nt, Human; identical to SEQ ID NO: 31786

SEQ ID NO: 143485 - RNA, 64 nt, Human; identical to SEQ ID NO: 31787

SEQ ID NO: 143486 - RNA, 64 nt, Human; identical to SEQ ID NO: 31788

SEQ ID NO: 143487 - RNA, 51 nt, Human; identical to SEQ ID NO: 31789

SEQ ID NO: 143488 - RNA, 64 nt, Human; identical to SEQ ID NO: 31790

SEQ ID NO: 143489 - RNA, 64 nt, Human; identical to SEQ ID NO: 31791

SEQ ID NO: 143490 - RNA, 64 nt, Human; identical to SEQ ID NO: 31792

SEQ ID NO: 143491 - RNA, 64 nt, Human; identical to SEQ ID NO: 31793

SEQ ID NO: 143492 - RNA, 64 nt, Human; identical to SEQ ID NO: 31794

SEQ ID NO: 143493 - RNA, 64 nt, Human; identical to SEQ ID NO: 31795

SEQ ID NO: 143494 - RNA, 64 nt, Human; identical to SEQ ID NO: 31796

SEQ ID NO: 143495 - RNA, 64 nt, Human; identical to SEQ ID NO: 31797

SEQ ID NO: 143496 - RNA, 64 nt, Human; identical to SEQ ID NO: 31798

SEQ ID NO: 143497 - RNA, 64 nt, Human; identical to SEQ ID NO: 31799

SEQ ID NO: 143498 - RNA, 64 nt, Human; identical to SEQ ID NO: 31800

SEQ ID NO: 143499 - RNA, 64 nt, Human; identical to SEQ ID NO: 31801

SEQ ID NO: 143500 - RNA, 64 nt, Human; identical to SEQ ID NO: 31802

SEQ ID NO: 143501 - RNA, 64 nt, Human; identical to SEQ ID NO: 31803

SEQ ID NO: 143502 - RNA, 64 nt, Human; identical to SEQ ID NO: 31804

SEQ ID NO: 143503 - RNA, 64 nt, Human; identical to SEQ ID NO: 31805

SEQ ID NO: 143504 - RNA, 64 nt, Human; identical to SEQ ID NO: 31806

SEQ ID NO: 143505 - RNA, 64 nt, Human; identical to SEQ ID NO: 31807

SEQ ID NO: 143506 - RNA, 64 nt, Human; identical to SEQ ID NO: 31808

SEQ ID NO: 143507 - RNA, 64 nt, Human; identical to SEQ ID NO: 31809

SEQ ID NO: 143508 - RNA, 64 nt, Human; identical to SEQ ID NO: 31810

SEQ ID NO: 143509 - RNA, 64 nt, Human; identical to SEQ ID NO: 31811

SEQ ID NO: 143510 - RNA, 64 nt, Human; identical to SEQ ID NO: 31812

SEQ ID NO: 143511 - RNA, 64 nt, Human; identical to SEQ ID NO: 31813

SEQ ID NO: 143512 - RNA, 64 nt, Human; identical to SEQ ID NO: 31814

SEQ ID NO: 143513 - RNA, 64 nt, Human; identical to SEQ ID NO: 31815

SEQ ID NO: 143514 - RNA, 64 nt, Human; identical to SEQ ID NO: 31816

SEQ ID NO: 143515 - RNA, 64 nt, Human; identical to SEQ ID NO: 31817

SEQ ID NO: 143516 - RNA, 64 nt, Human; identical to SEQ ID NO: 31818

SEQ ID NO: 143517 - RNA, 64 nt, Human; identical to SEQ ID NO: 31819

SEQ ID NO: 143518 - RNA, 64 nt, Human; identical to SEQ ID NO: 31820

SEQ ID NO: 143519 - RNA, 64 nt, Human; identical to SEQ ID NO: 31821

SEQ ID NO: 143520 - RNA, 64 nt, Human; identical to SEQ ID NO: 31822

SEQ ID NO: 143521 - RNA, 64 nt, Human; identical to SEQ ID NO: 31823

SEQ ID NO: 143522 - RNA, 64 nt, Human; identical to SEQ ID NO: 31824

SEQ ID NO: 143523 - RNA, 64 nt, Human; identical to SEQ ID NO: 31825

SEQ ID NO: 143524 - RNA, 64 nt, Human; identical to SEQ ID NO: 31826

SEQ ID NO: 143525 - RNA, 64 nt, Human; identical to SEQ ID NO: 31827

SEQ ID NO: 143526 - RNA, 64 nt, Human; identical to SEQ ID NO: 31828

SEQ ID NO: 143527 - RNA, 64 nt, Human; identical to SEQ ID NO: 31829

SEQ ID NO: 143528 - RNA, 64 nt, Human; identical to SEQ ID NO: 31830

SEQ ID NO: 143529 - RNA, 64 nt, Human; identical to SEQ ID NO: 31831

SEQ ID NO: 143530 - RNA, 64 nt, Human; identical to SEQ ID NO: 31832

SEQ ID NO: 143531 - RNA, 64 nt, Human; identical to SEQ ID NO: 31833

SEQ ID NO: 143532 - RNA, 64 nt, Human; identical to SEQ ID NO: 31834

SEQ ID NO: 143533 - RNA, 64 nt, Human; identical to SEQ ID NO: 31835

SEQ ID NO: 143534 - RNA, 64 nt, Human; identical to SEQ ID NO: 31836

SEQ ID NO: 143535 - RNA, 64 nt, Human; identical to SEQ ID NO: 31837

SEQ ID NO: 143536 - RNA, 64 nt, Human; identical to SEQ ID NO: 31838

SEQ ID NO: 143537 - RNA, 64 nt, Human; identical to SEQ ID NO: 31839

SEQ ID NO: 143538 - RNA, 64 nt, Human; identical to SEQ ID NO: 31840

SEQ ID NO: 143539 - RNA, 64 nt, Human; identical to SEQ ID NO: 31841

SEQ ID NO: 143540 - RNA, 64 nt, Human; identical to SEQ ID NO: 31842

SEQ ID NO: 143541 - RNA, 64 nt, Human; identical to SEQ ID NO: 31843

SEQ ID NO: 143542 - RNA, 56 nt, Human; identical to SEQ ID NO: 31844

SEQ ID NO: 143543 - RNA, 64 nt, Human; identical to SEQ ID NO: 31845

SEQ ID NO: 143544 - RNA, 64 nt, Human; identical to SEQ ID NO: 31846

SEQ ID NO: 143545 - RNA, 64 nt, Human; identical to SEQ ID NO: 31847

SEQ ID NO: 143546 - RNA, 64 nt, Human; identical to SEQ ID NO: 31848

SEQ ID NO: 143547 - RNA, 64 nt, Human
caggacucaggccacccucgcuuguccuggcgcccggcggcagcugcccagaaacuuccuggga

SEQ ID NO: 143548 - RNA, 64 nt, Human
guggagacggacguguagcccuggcgaggccagccggcggcagcacagccugucuccaaucagc

SEQ ID NO: 143549 - RNA, 64 nt, Human
uccagaaaaugcagcugugauuuguugcugggagcggcggcagcgagucccugcaacagcaaua

SEQ ID NO: 143550 - RNA, 64 nt, Human
aaucucauuuagacuuuaauuuuuuugagauuaucggcggcacaaucacuuuguagaaacugua

SEQ ID NO: 143551 - RNA, 64 nt, Human; identical to SEQ ID NO: 122462

SEQ ID NO: 143552 - RNA, 64 nt, Human
aaggcguccuggagucacuccccgagcagcgcggcggcggcagggaguuggguuggggugggca

SEQ ID NO: 143553 - RNA, 64 nt, Human
auuuguuccuuucuggaauugggcuccgugguggcggcggcacuucaagcaaagacaguuucuu

SEQ ID NO: 143554 - RNA, 64 nt, Human
uauugcugggcaggcuaaguguggagcuggacuacggcggcaguauggaauuccagugccaggc

SEQ ID NO: 143555 - RNA, 64 nt, Human; identical to SEQ ID NO: 3902

SEQ ID NO: 143556 - RNA, 64 nt, Human; identical to SEQ ID NO: 117960

SEQ ID NO: 143557 - RNA, 64 nt, Human; identical to SEQ ID NO: 122479

SEQ ID NO: 143558 - RNA, 64 nt, Human
agcuucggcugggccacgggcucgcgggcacucucggcggcagccucgggggcuccgacuccag

SEQ ID NO: 143559 - RNA, 50 nt, Human; identical to SEQ ID NO: 14033

SEQ ID NO: 143560 - RNA, 64 nt, Human
caccucgccgcaaagcgaaagaaacuggagcagccggcggcaggagagggcaaaaagccaagag

SEQ ID NO: 143561 - RNA, 64 nt, Human; identical to SEQ ID NO: 3867

SEQ ID NO: 143562 - RNA, 52 nt, Human; identical to SEQ ID NO: 14036

SEQ ID NO: 143563 - RNA, 64 nt, Human; identical to SEQ ID NO: 120464

SEQ ID NO: 143564 - RNA, 64 nt, Human
uugugaacgugagcaaccuaggaggcuucggcagcggcggcagcgcacagccguugcaccaggg

SEQ ID NO: 143565 - RNA, 64 nt, Human
uuagcggggaugauguuaaguguggccaagcgcacggcggcaaguuuucaagcacugaguuucu

SEQ ID NO: 143566 - RNA, 64 nt, Human
cuccuggucugugcugcccugcucuggggaugcacggcggcagggugggggagggagguuccuc

SEQ ID NO: 143567 - RNA, 64 nt, Human; identical to SEQ ID NO: 3868

SEQ ID NO: 143568 - RNA, 64 nt, Human; identical to SEQ ID NO: 116087

SEQ ID NO: 143569 - RNA, 64 nt, Human; identical to SEQ ID NO: 121900

SEQ ID NO: 143570 - RNA, 64 nt, Human
ccggugugaccgccgggggcggcccggggccgcucggcggcaccuccacacccgccccaacgcg

SEQ ID NO: 143571 - RNA, 64 nt, Human
gcccuuccugcugcgcaguucucccauccugggacggcggcaguauugaagcucgugacaagug

SEQ ID NO: 143572 - RNA, 64 nt, Human
uacaggacacucgcugggggcccugugcccuugccggcggcagguugcagccaccgcggcccaa

SEQ ID NO: 143573 - RNA, 64 nt, Human; identical to SEQ ID NO: 3869

SEQ ID NO: 143574 - RNA, 64 nt, Human; identical to SEQ ID NO: 116105

SEQ ID NO: 143575 - RNA, 64 nt, Human; identical to SEQ ID NO: 122007

SEQ ID NO: 143576 - RNA, 64 nt, Human
ccuggcgguuccgugagcucaggcaggccugacccggcggcacagccuggcagggaccucgucc

SEQ ID NO: 143577 - RNA, 64 nt, Human
aggccuacucccuggucucaccuccgaccacagucggcggcaccuucucagagugccccgcacu

SEQ ID NO: 143578 - RNA, 64 nt, Human
ucaggcuagguggccauggugaaggugucaguggcggcggcagcgauggcaagcaggcggcguu

SEQ ID NO: 143579 - RNA, 64 nt, Human; identical to SEQ ID NO: 3883

SEQ ID NO: 143580 - RNA, 64 nt, Human; identical to SEQ ID NO: 116531

SEQ ID NO: 143581 - RNA, 64 nt, Human; identical to SEQ ID NO: 122428

SEQ ID NO: 143582 - RNA, 64 nt, Human
ggggagaaccccggaccccuggcaugcaugcuggcggcggcaugccucccuuccacaagcccau

SEQ ID NO: 143583 - RNA, 64 nt, Human
gucccuccgugccagggucggggggcccccccgccggcggcagcggcuuuggacgagggcagaa

SEQ ID NO: 143584 - RNA, 64 nt, Human
agaggcaaggacggacgggagcuccacugugaaucggcggcacgcgccgcaggaggcugggacu

SEQ ID NO: 143585 - RNA, 64 nt, Human; identical to SEQ ID NO: 3884

SEQ ID NO: 143586 - RNA, 64 nt, Human; identical to SEQ ID NO: 117553

SEQ ID NO: 143587 - RNA, 64 nt, Human; identical to SEQ ID NO: 122445

SEQ ID NO: 143588 - RNA, 64 nt, Human
gggcugaggcacagacucauuugucaccuucuggcggcggcagcccuggccccggccuccaagc

SEQ ID NO: 143589 - RNA, 64 nt, Human
aaagugcugggauuacaggcgugagccacuggcccggcggcacaaccaaaucuuauuaaacuca

SEQ ID NO: 143590 - RNA, 64 nt, Human
acccccaucuccaccccaucauguuuacaggguucggcggcagcguuuguuccagaacgccgcc

SEQ ID NO: 143591 - RNA, 64 nt, Human; identical to SEQ ID NO: 3885

SEQ ID NO: 143592 - RNA, 60 nt, Human
ccgaucuggguguccugacccucagcuggcccugcccagccacccuggacgugaccguau

SEQ ID NO: 143593 - RNA, 60 nt, Human
agggggagggugaggcuuuguaccccagccccugcccaggccacugugagggugggugcu

SEQ ID NO: 143594 - RNA, 60 nt, Human
agggggagggugaggcuuugcaccccagccccugcccaggccacugugagggugggugcu

SEQ ID NO: 143595 - RNA, 60 nt, Human
ugugguccccugcccccucugucccgucccccugcccaagugacugaaaccuacugagcu

SEQ ID NO: 143596 - RNA, 60 nt, Human
cgugucuucccucccuucucggccccgccaccugcccagcgugcccuggcucuccagaac

SEQ ID NO: 143597 - RNA, 60 nt, Human
gggaugcuuguagcuccucacagcaggauuccugcccacuguuuuuucucuguugggagg

SEQ ID NO: 143598 - RNA, 60 nt, Human
gggcggaaccaucuuucacccggccaagcuccugcccagauguugacccucacccagcgu

SEQ ID NO: 143599 - RNA, 60 nt, Human
ucauaaagaugucucacagcccuggggacaccugcccagugggccccagcccuacaggga

SEQ ID NO: 143600 - RNA, 60 nt, Human
cagagcugcugccuucccggccucacgcacccugcccaccagccccucggaagcauguga

SEQ ID NO: 143601 - RNA, 60 nt, Human
gcacaguggaagugggagccugguccuuccccugcccauggagagcucuuuaagggaucc

SEQ ID NO: 143602 - RNA, 60 nt, Human
ccagcccccaggugaggcuuccagcugggaccugcccagacaggcugagccugggcgugg

SEQ ID NO: 143603 - RNA, 60 nt, Human
ccugcccccuguccugcuucccacccccugccugcccagccugggcccugcaguguggag

SEQ ID NO: 143604 - RNA, 60 nt, Human
aaggauggcuccaguacguacagcaagauuccugcccacaggaagggccacaggcccgcu

SEQ ID NO: 143605 - RNA, 60 nt, Human
auccuaagggaccacacccuuccuccuuccccugcccacagaggcagagggcacaggaaa

SEQ ID NO: 143606 - RNA, 60 nt, Human
ugguguuccuggucacgucccccaggggacccugcccacuuccuggacuucgugccuuac

SEQ ID NO: 143607 - RNA, 60 nt, Human
cucaagcuuauacuagagaagagcaacugaccugcccaacuugugugaagucaggagggu

SEQ ID NO: 143608 - RNA, 60 nt, Human
aaccgaguaggggccacccuugacgggauuccugcccaggggagagaggcgcugggaaga

SEQ ID NO: 143609 - RNA, 60 nt, Human
gagucuuggacccuuucuuucucugggaucccugcccagcaccuuccuauagagaugacu

SEQ ID NO: 143610 - RNA, 60 nt, Human
caggagguggcacuggcucccacucccaccccugcccaggcuggcaucuagaaggcguca

SEQ ID NO: 143611 - RNA, 60 nt, Human
cacccaccgcuggagccccagcugugagaaccugcccacuucccaccagcggcgcuccug

SEQ ID NO: 143612 - RNA, 51 nt, Human; identical to SEQ ID NO: 13120

SEQ ID NO: 143613 - RNA, 60 nt, Human
cuuucauuucugucugcugagaucucagagccugcccaacagcagggaagccaagcaccc

SEQ ID NO: 143614 - RNA, 60 nt, Human
ugcagucaaaagcccauuaacgagaaagugccugcccacugcaacggagccgccagcacc

SEQ ID NO: 143615 - RNA, 60 nt, Human
aucagucaguagguaucacagcucacauuaccugcccagcgcugcccaaggcucccugga

SEQ ID NO: 143616 - RNA, 60 nt, Human
agcccugcccgccucuccccccacgcucaaccugcccacuuguccaggccuggccucuuu

SEQ ID NO: 143617 - RNA, 60 nt, Human
gcucacucugccaugagaacaggacaccauccugcccagcccagacgggguugcuccugg

SEQ ID NO: 143618 - RNA, 60 nt, Human
caaguagaagguacuggggauggggacauuccugcccauaaaggauuuggggaaagaaga

SEQ ID NO: 143619 - RNA, 60 nt, Human
cucccugagaucuugguagaggaggccccuccugcccagaccuucguuuguuuccccggu

SEQ ID NO: 143620 - RNA, 60 nt, Human
uaagucuuucucuuucccaucauacccuucccugcccaccuuguuuucuguucuccuuuu

SEQ ID NO: 143621 - RNA, 60 nt, Human
ucaguggguggccaucgaucuggaccguccccugcccacuugcuccccgugagcacugcg

SEQ ID NO: 143622 - RNA, 60 nt, Human
uucggaaaugccuuaaguuccccucuuuauccugcccauguucacuccauuguaggguug

SEQ ID NO: 143623 - RNA, 60 nt, Human
uuucccuuccgucuuccuucuccuucugggccugcccauguuguugagaggucuugguga

SEQ ID NO: 143624 - RNA, 60 nt, Human
ucuugagccuacccuccucucacaucuccuccugcccaagauguaaggaagcauuguaag

SEQ ID NO: 143625 - RNA, 60 nt, Human
caggcuagucuugaauuccugaccuccugaccugcccaccucaaccucccaaagugcuga

SEQ ID NO: 143626 - RNA, 55 nt, Human; identical to SEQ ID NO: 13134

SEQ ID NO: 143627 - RNA, 60 nt, Human
uuuuuucugaggaauuaaggguuaccccacccugcccacucccaucccuucaaccccacu

SEQ ID NO: 143628 - RNA, 60 nt, Human
cuguaaggcaaaauaaucuaaaaagacuaaccugcccacccacuccuuauauugcuguga

SEQ ID NO: 143629 - RNA, 60 nt, Human
cccagccccauguacaaagcucaccaagccccugcccauguacagcccccagacccucug

SEQ ID NO: 143630 - RNA, 60 nt, Human
acucccuuccccagcccgacuucuuggccuccugcccaaccagacaccucaaacucuguc

SEQ ID NO: 143631 - RNA, 60 nt, Human
uaucugcguagcccacagagggcccaggccccugcccagcugcagucucccagccuccac

SEQ ID NO: 143632 - RNA, 60 nt, Human
cuauagcccacugagccccgagacagagaaccugcccacagcucuccccgcuacaggcug

SEQ ID NO: 143633 - RNA, 60 nt, Human
gacacagaaagacacaaaacggucgucuuuccugcccaaguaaagcuuacagacuaacug

SEQ ID NO: 143634 - RNA, 60 nt, Human
cuguccccgauaacucccuaggggcuccugccugcccaagcggcugagaaccagcgcccc

SEQ ID NO: 143635 - RNA, 60 nt, Human
uuggacuucuuuguguguccaguuuggccuccugcccaaacuguccauuccagcagcucc

SEQ ID NO: 143636 - RNA, 60 nt, Human
cagccucgccuuucuacccaggcccccugcccugcccaccucaggcccccacccuccacu

SEQ ID NO: 143637 - RNA, 60 nt, Human
cucaggacaucucuggcaggugcauuugugccugcccagcaguuccagcuguggcaaaag

SEQ ID NO: 143638 - RNA, 60 nt, Human
cggcucuggcccacugagccaccgcgcccuccugcccacgggaggacaagcaauaacucu

SEQ ID NO: 143639 - RNA, 60 nt, Human
cuuaggaaccuucucccuucuugggucugcccugcccauacugagccugccaaagugccu

SEQ ID NO: 143640 - RNA, 60 nt, Human
uuggccagauugggcucauuaaugucguugccugcccaucugcaugaaugacaggcagcu

SEQ ID NO: 143641 - RNA, 60 nt, Human
ugucaaauccuugcauacuucugugacaccccugcccauuuucugucuuuaauuaaccaa

SEQ ID NO: 143642 - RNA, 60 nt, Human
cuuuucugaggaaugaguuugccuccguccccugcccaugcugggagcccacgcucaccc

SEQ ID NO: 143643 - RNA, 60 nt, Human
aacaucugaggcugccuuguagagaugcagccugcccagcugaaucuuggcuucuggacc

SEQ ID NO: 143644 - RNA, 60 nt, Human
ucccuggggacagaggccuugugucaccugccugcccaggcagcuguuugcagcugaaga

SEQ ID NO: 143645 - RNA, 60 nt, Human
gggaccggaagacgagagagggcuggacauccugcccaccgugucccagccagggcaggg

SEQ ID NO: 143646 - RNA, 60 nt, Human
ccaccccugcggccuuugcucacggguggcccugcccaccccuggcacaaccaaaauccc

SEQ ID NO: 143647 - RNA, 60 nt, Human
ucuccuccugccucucccgugagucuccagccugcccagcaccggcagcuguggagcacg

SEQ ID NO: 143648 - RNA, 60 nt, Human
ucacagcucuguagagacaaucaacuguguccugcccacccuccaaggugcauugucuuc

SEQ ID NO: 143649 - RNA, 60 nt, Human
cugggaucagcuggaagcugccugucaucuccugcccaauccccagaaacccugauucag

SEQ ID NO: 143650 - RNA, 60 nt, Human
uggcccugcccugugcccugggaugccuacccugcccaccuccggagguggaaccgggcu

SEQ ID NO: 143651 - RNA, 60 nt, Human
ggaggaggcccaggccacaguaccaccccaccugcccaggcagccccucgucaccuacuc

SEQ ID NO: 143652 - RNA, 60 nt, Human
agcaggugugguggcucauggcguaaugggccugcccaaugcuuugggaggccaaggcag

SEQ ID NO: 143653 - RNA, 60 nt, Human
uugugacugaaggggcacaccacugcccugccugcccacuuagccguccauggcaccagc

SEQ ID NO: 143654 - RNA, 60 nt, Human
ccuccaagccccacgccagcgagcaggcugccugcccaccccgugcccccagccagcugg

SEQ ID NO: 143655 - RNA, 60 nt, Human
gggacucagggaccggugcugcaggaguguccugcccaugccccagucggccccaucucu

SEQ ID NO: 143656 - RNA, 60 nt, Human
gaucaccuggggucaggaguucaagaccagccugcccaacauggcaaaaccucgucucua

SEQ ID NO: 143657 - RNA, 60 nt, Human
ccggacggcagggaugggccccaacuucgcccugcccacuugacuucaccaaaucccuuc

SEQ ID NO: 143658 - RNA, 60 nt, Human
ggcaggaggagcugcuuggcagaaggaccuccugcccagaccugaggagugagaggcuuu

SEQ ID NO: 143659 - RNA, 60 nt, Human
agugucacauccuuggcugucaaucccaugccugcccacgccacacacucugcgaucugg

SEQ ID NO: 143660 - RNA, 60 nt, Human; identical to SEQ ID NO: 13168

SEQ ID NO: 143661 - RNA, 60 nt, Human
ucuaggguuguccugccccuuggcucuaucccugcccagaggugggaacuggaggagugg

SEQ ID NO: 143662 - RNA, 60 nt, Human
ccacacauuauagucaugugccaccaccuuccugcccacaggccgagggacagggugagg

SEQ ID NO: 143663 - RNA, 60 nt, Human
gaugugacauggcuucuccucagggcaaccccugcccaacccucauccccaucuucucag

SEQ ID NO: 143664 - RNA, 60 nt, Human
ccuccugggaccacugccaccugcaagagcccugcccaggagauagaagaccuggacucc

SEQ ID NO: 143665 - RNA, 60 nt, Human
uuccuucagguuccuugccaacccuccuccccugcccacaacuucuccaaacaaagcagg

SEQ ID NO: 143666 - RNA, 60 nt, Human
cguaggcuuccagugaugguuggggacaauccugcccaaaggcagggcaguggauggaau

SEQ ID NO: 143667 - RNA, 60 nt, Human
guauaugcauaugcaaacucgacccccguuccugcccagauaauggcucaauaacucuga

SEQ ID NO: 143668 - RNA, 60 nt, Human
ugggacaugggcaccucgggaggcccgggcccugcccagcuacaguuccaccccucagcu

SEQ ID NO: 143669 - RNA, 60 nt, Human
gauaggggaagaagccagaaccccaccuggccugcccacaggacaagaaguggguaaggg

SEQ ID NO: 143670 - RNA, 60 nt, Human
cacagacaccugaaggagcccccacaugcgccugcccauccagcacugcagaugccaccu

SEQ ID NO: 143671 - RNA, 60 nt, Human
gauucccaguucuaaggccuuaucaccuccccugcccauaggccaacaaccauaguuccu

SEQ ID NO: 143672 - RNA, 60 nt, Human
aaguuauuucuuguuuguuuguuuggguauccugcccaguguuguuuguaaauaagagau

SEQ ID NO: 143673 - RNA, 60 nt, Human
gcgaaggcacugcaaucccuuccccauaucccugcccaacccggacugcugcccguccuc

SEQ ID NO: 143674 - RNA, 60 nt, Human
gaaaacgucagccucugccccacccucccuccugcccaaagugaauuugguacucagaaa

SEQ ID NO: 143675 - RNA, 60 nt, Human
acaaggcccaggcgcccagggucccaccgaccugcccaggaaugcaucacauuguucucu

SEQ ID NO: 143676 - RNA, 60 nt, Human
caugcugaaggcucccauuuucaguucccuccugcccaggacugcauuguuuucuagccc

SEQ ID NO: 143677 - RNA, 60 nt, Human
uguuagagcugagaugacuguacacauaccccugcccaauuuauauagcucuuuguggag

SEQ ID NO: 143678 - RNA, 60 nt, Human
acucccccugugucagugcucugcucucacccugcccaagacucaccucccuuccccucu

SEQ ID NO: 143679 - RNA, 60 nt, Human
cuaagaauguaauggggaagaacugcccugccugcccaucucagagccauaaggucaucu

SEQ ID NO: 143680 - RNA, 60 nt, Human
ggugcucuccccaggcucccuccucagccuccugcccacccagggcccuuuacucucuuc

SEQ ID NO: 143681 - RNA, 60 nt, Human
ugugauuuuuuuccuuaugcaaaucauacuccugcccaagaaaauacaguaguuccccuu

SEQ ID NO: 143682 - RNA, 60 nt, Human
acuucucuccugcucaugugucagugucuaccugcccaaguaaguggcuuucauacacca

SEQ ID NO: 143683 - RNA, 60 nt, Human
gugaacccagccccugaccuuccucuauccccugcccauccucccuuuuaccuccucucu

SEQ ID NO: 143684 - RNA, 60 nt, Human
uagaggccucuugugacuggagguaacaacccugcccaguaacugugggagaaggggauc

SEQ ID NO: 143685 - RNA, 60 nt, Human
cuuuuauaccuuccucacuggcccccuccaccugcccauagucaccaaauucuguuuuaa

SEQ ID NO: 143686 - RNA, 60 nt, Human
guuccugcaucccgauaccucagcccuggcccugcccagcccauuugggcucugguuuuc

SEQ ID NO: 143687 - RNA, 60 nt, Human
aaaggaguuugagucacuggcaccuagaagccugcccacgauuccuaggaaggcuggcag

SEQ ID NO: 143688 - RNA, 60 nt, Human
gugaaaggagggugaggcugccgaugccuuccugcccagaaguggaugaugugggaguug

SEQ ID NO: 143689 - RNA, 60 nt, Human
aacuguccaagcucucagccccacagggaaccugcccagagagcuuuaccuuucccaagc

SEQ ID NO: 143690 - RNA, 60 nt, Human
uaggcccucaagacccuuuuggguuucugcccugcccacccucuggagaaggugggcacu

SEQ ID NO: 143691 - RNA, 60 nt, Human
aagugcacaucagcacuauggggccuauguccugcccagagaccucugcuccuuccugcu

SEQ ID NO: 143692 - RNA, 60 nt, Human
ucugagugaggccaccaucacccaccacacccugcccacuccugcgcuuuucaucgccau

SEQ ID NO: 143693 - RNA, 60 nt, Human
ucaggccucaccucccagggcuacacagacccugcccaccccaucccuggcugaccugcu

SEQ ID NO: 143694 - RNA, 60 nt, Human
gugauuccaagaucauccuucacccgagguccugcccaagcacaggccagaugcaagaau

SEQ ID NO: 143695 - RNA, 60 nt, Human
aucauauuucugugugugucucucucagccccugcccaggcuagagggaaacagcuacug

SEQ ID NO: 143696 - RNA, 60 nt, Human
uguuuggaugucugaucuuuuccuacaguuccugcccaggccuguuuuucucucccuuau

SEQ ID NO: 143697 - RNA, 60 nt, Human
uuaugucccauggaucucuuccugaucuucccugcccauuggguacccaggaaacugcaa

SEQ ID NO: 143698 - RNA, 60 nt, Human
uucuaaggacagcuccuucccuacucauucccugcccaaguggggccagaccucuuuaca

SEQ ID NO: 143699 - RNA, 60 nt, Human
gaaauaaaaauuggcauguagccaauguuuccugcccacacucacuuuuuucuauagacc

SEQ ID NO: 143700 - RNA, 60 nt, Human
gcccuggggaucagacagccccuaccuaccccugcccacuccucuggagacugagccuug

SEQ ID NO: 143701 - RNA, 60 nt, Human
accccugcccuggcagccuggaagaccgugccugcccagcccucgucaccacagggacuc

SEQ ID NO: 143702 - RNA, 60 nt, Human
accaccccggggucucuggggaacugucaaccugcccacgggacauguacauuuccccuu

SEQ ID NO: 143703 - RNA, 60 nt, Human
aagccuuagggagugagaccaacacccaucccugcccagccaacaguggccggggcuugu

SEQ ID NO: 143704 - RNA, 60 nt, Human
ccgggccccgggccuggggcaugcguugcaccugcccagcccgguggcugcgccucccuc

SEQ ID NO: 143705 - RNA, 60 nt, Human
gaagcuccgccuccgccgcuuagucccaacccugcccaggaagaagggcccguggggcuu

SEQ ID NO: 143706 - RNA, 60 nt, Human
caguggggggcaggggugcgccuccucugcccugcccaccagccugugauuugauggggu

SEQ ID NO: 143707 - RNA, 60 nt, Human
auguuucugggugggugaaaggggcccaacccugcccacuucagcccagcccgcccaagg

SEQ ID NO: 143708 - RNA, 60 nt, Human
ugccaucacugggaggcucagaggacccuuccugcccaccuucggagacggcuucuggag

SEQ ID NO: 143709 - RNA, 60 nt, Human
ugacuggccucaggaauucucccuuccacaccugcccaccucaccucacugcaccgcacc

SEQ ID NO: 143710 - RNA, 60 nt, Human
ccauuccuuucuaaguguguuuuauggcauccugcccacaaagaacucacagucugauua

SEQ ID NO: 143711 - RNA, 60 nt, Human
cacagguugacuaguaucuguggguaccucccugcccagguuauucacucacaagccacc

SEQ ID NO: 143712 - RNA, 60 nt, Human
cuguugguucugauuagguaacguauuggaccugcccacaacucccuugcacguaaacuu

SEQ ID NO: 143713 - RNA, 56 nt, Human; identical to SEQ ID NO: 13221

SEQ ID NO: 143714 - RNA, 60 nt, Human
cacaacggucagcacuccucucccagccccccugcccacuguucucaauaaaaugugagu

SEQ ID NO: 143715 - RNA, 60 nt, Human
ugggcggggcugggagugggaccugagaucccugcccacucucuccccuucauuggcugc

SEQ ID NO: 143716 - RNA, 60 nt, Human
aaugccaucugacaggagggcccggggcccccugcccacccugcgggggccuccccagug

SEQ ID NO: 143717 - RNA, 60 nt, Human
aagagacuuacgugguaaaaaaugaagucuccugcccacagccacauuagugaaccuaga

SEQ ID NO: 143718 - RNA, 60 nt, Human
gccucugcauucaggaucaaaccccgaccaccugcccaaccugcucuccucuugccacug

SEQ ID NO: 143719 - RNA, 60 nt, Human
cugugacccagggagcagggucgcuaagguccugcccacugaggggacagccuucugggc

SEQ ID NO: 143720 - RNA, 60 nt, Human
cauuugccaguuucuauuuaguauuccaugccugcccaauucaucuguuacuguuuaauu

SEQ ID NO: 143721 - RNA, 60 nt, Human
aggcuugugcugugguggguucgauuuaucccugcccaccccacccccacaacuucccuu

SEQ ID NO: 143722 - RNA, 60 nt, Human
cagccaucagggcuggccguggacguggccccugcccacucaccugcccgccugcccgcc

SEQ ID NO: 143723 - RNA, 60 nt, Human
cccgagauagccaccuggaaacacuaggugccugcccagggaggaacggaggaggacucg

SEQ ID NO: 143724 - RNA, 60 nt, Human
cugcuaccugacgcgccagaagcacccagcccugcccagcaaccggccccagcagcaggu

SEQ ID NO: 143725 - RNA, 60 nt, Human
cagcugcaccccagaaucuguaugccugcaccugcccaaggauuuauucauagcuuaccu

SEQ ID NO: 143726 - RNA, 60 nt, Human
ggcugacuuacaucauguguuggggaagggccugcccaguugcacucaggugacauccuc

SEQ ID NO: 143727 - RNA, 60 nt, Human
ugucagcacucugaugugcucagaagagcaccugcccaaaguuuuucugguuuuaauuua

SEQ ID NO: 143728 - RNA, 60 nt, Human
aaacgaaucauuggcuauaaccuccagccuccugcccagcacaggaaucgguggucucca

SEQ ID NO: 143729 - RNA, 60 nt, Human
ccucucggaccucgcuguguuucacugccuccugcccacagacccaggccugccggcccg

SEQ ID NO: 143730 - RNA, 60 nt, Human
aggugacaugucucuccauuccucuccaacccugcccaccucccuguaccagagcuguga

SEQ ID NO: 143731 - RNA, 60 nt, Human
cuccaggaggguccuggggugggccagaugccugcccaccucugucuccugccucugcuc

SEQ ID NO: 143732 - RNA, 60 nt, Human
acccucucccgggaccuccugcuggcuccuccugcccagcuuccuaugcaaggcuuugug

SEQ ID NO: 143733 - RNA, 50 nt, Human; identical to SEQ ID NO: 13241

SEQ ID NO: 143734 - RNA, 57 nt, Human; identical to SEQ ID NO: 13242

SEQ ID NO: 143735 - RNA, 60 nt, Human
acuuugcaauauccacuuuauaaaauagcuccugcccaguggcucuugguuccugucaaa

SEQ ID NO: 143736 - RNA, 60 nt, Human
auggaaaccgggcucagugagaacugauuuccugcccaauauuugucuuugggcugucuc

SEQ ID NO: 143737 - RNA, 60 nt, Human
gaucaccugaggugaggaguucaagaccagccugcccaacauagugaaacuccgucucua

SEQ ID NO: 143738 - RNA, 60 nt, Human
cuccccagcauuccagccccucuggucgcuccugcccacggagucguggggugugcuggg

SEQ ID NO: 143739 - RNA, 60 nt, Human
ccggucuuugauccgcagcaggggccagacccugcccacaagucccagcgcggcugcuuc

SEQ ID NO: 143740 - RNA, 60 nt, Human
ggguuggggaccgaaaggacagggaugccgccugcccaguguuucugggccucacggugc

SEQ ID NO: 143741 - RNA, 60 nt, Human
auccccccggccaccucucuacccguccagccugcccagacccucucagaggaacggggu

SEQ ID NO: 143742 - RNA, 60 nt, Human
ggccaagcgagacuagcagucauccagaccccugcccaccuagacuguuuucugagcccu

SEQ ID NO: 143743 - RNA, 60 nt, Human
cuugccagguggucuacccccggccccgcuccugcccauuccucugucccugcagacuca

SEQ ID NO: 143744 - RNA, 60 nt, Human
uaguugguucugggcuuugaucucuuccaaccugcccagucacagaaggaggaaugacuc

SEQ ID NO: 143745 - RNA, 60 nt, Human
uggcguuuguguucugggcaccaccgugacccugcccagauggcuauaauauuauuuuau

SEQ ID NO: 143746 - RNA, 60 nt, Human
ucgugcuuuguuuuaugcuacuccucccacccugcccaugauuaaacaucauguauguag

SEQ ID NO: 143747 - RNA, 60 nt, Human
cauugagaaugugcuuuguaagauccacccccugcccacaaaaaauugcuccuaacucca

SEQ ID NO: 143748 - RNA, 60 nt, Human
uuccuugcuuaagguaugguacaagcaaugccugcccauuggagagaaaaaacuuaagua

SEQ ID NO: 143749 - RNA, 60 nt, Human
guguggcugccuccccugggcuuucugcucccugcccagauccuguaggccucaucuuag

SEQ ID NO: 143750 - RNA, 60 nt, Human
cuuaguuuggauguaagaugcucugaggacccugcccacaccccugcgugcauuaggaug

SEQ ID NO: 143751 - RNA, 60 nt, Human
uucccugggaggcugacagggucaagccacccugcccaccacccucccacuuccccuccc

SEQ ID NO: 143752 - RNA, 60 nt, Human
cagcgaagaauaaagcaugacucaucucguccugcccaccccucacacuggacuauaaau

SEQ ID NO: 143753 - RNA, 60 nt, Human
cucaccaggcaagcugaggccaggagggacccugcccagucugugaaagcuacagagcac

SEQ ID NO: 143754 - RNA, 60 nt, Human
cccucugcccccgcggcaaccgcucccacgccugcccacuuugcuagcccggcugugccc

SEQ ID NO: 143755 - RNA, 60 nt, Human
agucaggaagggaaagccagaaggggcacgccugcccagccucgcaugccagagccuggg

SEQ ID NO: 143756 - RNA, 60 nt, Human
ggaucuggcuuggggugcccggcccucaucccugcccacgcagugagugcucaugugucu

SEQ ID NO: 143757 - RNA, 60 nt, Human
aguccugcgcauuccagcuacgcuaagcgcccugcccaggcacguaacaaaacauagacc

SEQ ID NO: 143758 - RNA, 60 nt, Human
auuuuaauuaaaaaccucaauaaagauggcccugcccacacugugccuuguguuuggggc

SEQ ID NO: 143759 - RNA, 60 nt, Human
ggggcaaacaucacaaaauguaauuuaaugccugcccauuagagaaguauuuaucaggag

SEQ ID NO: 143760 - RNA, 60 nt, Human
gagcuucagaccguuuguccugucaucuguccugcccaacacuguaugguuuuucucuag

SEQ ID NO: 143761 - RNA, 60 nt, Human
ugcaggccauaaguuccaaaagauaauuucccugcccacaaaggcauaaacuugaaaaca

SEQ ID NO: 143762 - RNA, 60 nt, Human
gcaagcacauucaccaagugcaucgguagcccugcccaccccuccagaccucgguucuua

SEQ ID NO: 143763 - RNA, 60 nt, Human
aagccacagcugggcccaccgaggugcuauccugcccaggccagcacuuggcugaguugg

SEQ ID NO: 143764 - RNA, 60 nt, Human
cggagugaacaggcaucccuguugccccugccugcccagauuuacugaccccauuugucg

SEQ ID NO: 143765 - RNA, 60 nt, Human
ccuccuauuuguaacaauggguguagcuccccugcccaucuuggaggugcauggcccauc

SEQ ID NO: 143766 - RNA, 60 nt, Human
aguuauuauauucauuucguugguuucucuccugcccaauucuuggcacaggcauuaugu

SEQ ID NO: 143767 - RNA, 60 nt, Human
gugagggaagccugaaaaacuaagaugcugccugcccagugcacacaaguguagguauca

SEQ ID NO: 143768 - RNA, 60 nt, Human
uuacacuacaucaucaucaucucaugcccaccugcccacacccagcagagcuucucagug

SEQ ID NO: 143769 - RNA, 60 nt, Human
gcaaggggcaaggcugggccccuagcuuguccugcccauuccuccagguguugaucuuga

SEQ ID NO: 143770 - RNA, 60 nt, Human
ucccuggcaacaggaaccugggcagcuuauccugcccacagguaagccccugggagcauc

SEQ ID NO: 143771 - RNA, 60 nt, Human
cauccuguucugucuacucacccuagcagcccugcccagacucuucagccccugcuccca

SEQ ID NO: 143772 - RNA, 60 nt, Human
agcccaaguccaaauguuuacagggagccuccugcccagucccccaaccccagccgcucg

SEQ ID NO: 143773 - RNA, 60 nt, Human
aaaagggccacaagccguuuugcacaaaugccugcccaccugccccucuuccauccagga

SEQ ID NO: 143774 - RNA, 60 nt, Human
cugcaaggcuggacugugaucuucaaucauccugcccaucucugguaccccuauaucacu

SEQ ID NO: 143775 - RNA, 60 nt, Human
acccuugagaauguacuuugugagauccacccugcccacaaaacauugcucuuaacuuca

SEQ ID NO: 143776 - RNA, 60 nt, Human
ugagagucugaaagacagaaugucaccaguccugcccaaugccuugacaacagacugaau

SEQ ID NO: 143777 - RNA, 60 nt, Human
cccuugcccgugauggcuccuuggggucugccugcccacccacaugagcccgcgaguaug

SEQ ID NO: 143778 - RNA, 60 nt, Human
uucccuguguggucccucccuucgugugccccugcccagccucuuggcaccuccuguuua

SEQ ID NO: 143779 - RNA, 60 nt, Human
ggguuucaaacaagacaaaaggcauuccucccugcccaaucccagugcagucaaggccaa

SEQ ID NO: 143780 - RNA, 60 nt, Human
cuccacccugugcccgaggggguguccgguccugcccauccgauacucugguggaaaugu

SEQ ID NO: 143781 - RNA, 60 nt, Human
ugcaaguucauuuaagccucagggcuggucccugcccaaagggcuggacccuccuaaucc

SEQ ID NO: 143782 - RNA, 60 nt, Human
guuucccucccgauaucaaaaagacuguggccugcccagcucucguauccccaagccaca

SEQ ID NO: 143783 - RNA, 60 nt, Human
aagaauucccacccugagguggguuacauaccugcccaauggccaaaggaaccgccuugu

SEQ ID NO: 143784 - RNA, 60 nt, Human
aagagaguaaggccuugggcugugcugugaccugcccaagauuugacacuggcuaggagc

SEQ ID NO: 143785 - RNA, 60 nt, Human
ccucaagcuccuggccugauccagcuccuuccugcccaaggcagcuuagcccauccagac

SEQ ID NO: 143786 - RNA, 60 nt, Human
gccaugggacccgaggacugccccccggcgccugcccaggcggaggcccuuucagaaagg

SEQ ID NO: 143787 - RNA, 60 nt, Human
caaugauggagggcggccgccagcccagggccugcccauccagaagggacuccccagggc

SEQ ID NO: 143788 - RNA, 60 nt, Human
aaaaaaaaaaaaaguaaauauccagggaacccugcccagacuaauacuguugguggcaua

SEQ ID NO: 143789 - RNA, 60 nt, Human
gcuuguccuugcuccuggaaccuggcaggcccugcccagccagccaucggaagagagggc

SEQ ID NO: 143790 - RNA, 60 nt, Human
uuucugggcacugcacuucagcguggcccaccugcccaugcccugaggccaguuggcgag

SEQ ID NO: 143791 - RNA, 60 nt, Human
uauccccucccagucaccuuguggcaagccccugcccaucugggaaaauaccccaucauu

SEQ ID NO: 143792 - RNA, 60 nt, Human
aaugaaaccaucaguagagacauugcuguuccugcccaucccagugccagcuacuccuuc

SEQ ID NO: 143793 - RNA, 60 nt, Human
auggcaccuuucccuucugaaagucugguuccugcccagugacccuuggccuugugagcc

SEQ ID NO: 143794 - RNA, 60 nt, Human
ccagccccacacccucauuuauaccaauuaccugcccaguaacuguggacuuuugcuucc

SEQ ID NO: 143795 - RNA, 60 nt, Human
accuccaguuuggcuucugagcagagacucccugcccaucaagucugaaacccccaugga

SEQ ID NO: 143796 - RNA, 60 nt, Human
ucccagcaacccuaaugcuggaaaggugcuccugcccacacccagcauggacccagugug

SEQ ID NO: 143797 - RNA, 60 nt, Human
ucaggucaccagacucugaacaugcuacauccugcccaagacugcaccucuggaggugca

SEQ ID NO: 143798 - RNA, 60 nt, Human
gcugcucugacccuuggccucaggcuuggcccugcccaagcuacuuccuguacuuaaaag

SEQ ID NO: 143799 - RNA, 52 nt, Human; identical to SEQ ID NO: 13307

SEQ ID NO: 143800 - RNA, 60 nt, Human
caaaggcucaccuuuguggagaggauaaaaccugcccaaccuaccucaccaugguuuuuc

SEQ ID NO: 143801 - RNA, 60 nt, Human
cacaagugucaggcgccgcacuuccuuuuaccugcccaaggaugcugucaagcaccugca

SEQ ID NO: 143802 - RNA, 60 nt, Human
aaugcaggagccgaccuggggcugcacaucccugcccauccccagaaagacuguuccugu

SEQ ID NO: 143803 - RNA, 60 nt, Human
gccgccacugcaguucugcuaggucugcuuccugcccaggaaggugccugcacaugagag

SEQ ID NO: 143804 - RNA, 60 nt, Human
ggcccauggaagacacuugguuugagaaacccugcccacuuccaaagaccaaagagauua

SEQ ID NO: 143805 - RNA, 60 nt, Human
uguguucucauacuuuucugucacuguaagccugcccaguaggcaguguuuugcagacuu

SEQ ID NO: 143806 - RNA, 60 nt, Human
ugaaucaggguaugaaauucaaaaccuccaccugcccaugcugcuugcaucccuggagaa

SEQ ID NO: 143807 - RNA, 60 nt, Human
uggcagcuuccaugucaccacuuguucauaccugcccagagcuaguuuuagacauggcaa

SEQ ID NO: 143808 - RNA, 60 nt, Human
uugcagcugcugauagccuucaggggaggaccugcccagguaugccuuccagugaugccc

SEQ ID NO: 143809 - RNA, 60 nt, Human
uucuuuuguucugugucugaccuacuaauuccugcccaugcuucaaacucaguucagaaa

SEQ ID NO: 143810 - RNA, 60 nt, Human
ccugccucccuuccucccuggcgauccucaccugcccagccauggcacacacccuuccug

SEQ ID NO: 143811 - RNA, 60 nt, Human
ccuuuccuaugggcaaggcccagugcucuuccugcccaccagggaccauggagcaguggc

SEQ ID NO: 143812 - RNA, 60 nt, Human
ccagacugcaauaacuggaggcgccuccuuccugcccacccuucgcucacgccccagcgc

SEQ ID NO: 143813 - RNA, 60 nt, Human
ggccccuaggcgccgauggccgaggccgcgccugcccaccgggcggggucgcugguuggc

SEQ ID NO: 143814 - RNA, 60 nt, Human
ggcucgucucuuuccggagccccagcgucuccugcccaaauucaccgcggaaagggcccg

SEQ ID NO: 143815 - RNA, 60 nt, Human
ucccgggagaggcggugugggggcccgggcccugcccagcuacgcagaaagcagccggag

SEQ ID NO: 143816 - RNA, 60 nt, Human
cuacugugaccauggaggccagugccagcaccugcccagugggccccgcugcaggugcau

SEQ ID NO: 143817 - RNA, 60 nt, Human
gccaaggcugcgggaggcugggagcccugcccugcccaucccuccugcaccagcgcuguc

SEQ ID NO: 143818 - RNA, 60 nt, Human
cuccagggucagcguuuggcuguuugugugccugcccacccgccucccugugccugggcc

SEQ ID NO: 143819 - RNA, 60 nt, Human
gcugcucaacaggacugcacucgucucugcccugcccacccagagccccucuuugugccc

SEQ ID NO: 143820 - RNA, 60 nt, Human
ccccagacccaaagcucucuccccacccuaccugcccaccuggggcuccugugcccccuc

SEQ ID NO: 143821 - RNA, 60 nt, Human
cuuccuguguucucuggcuucagaguuucaccugcccacacaggguccguugcuggcaac

SEQ ID NO: 143822 - RNA, 60 nt, Human
cgaggcaccggacgcuggagacccugcgccccugcccagcaccuccuccgugggcagcuc

SEQ ID NO: 143823 - RNA, 60 nt, Human; identical to SEQ ID NO: 13331

SEQ ID NO: 143824 - RNA, 60 nt, Human
gcaggugguguccuguggcaccuccauccuccugcccagccggcugugucacacucaucu

SEQ ID NO: 143825 - RNA, 60 nt, Human
caugucccucguggcucagggugccccaggccugcccagcuagugcuguccucccaucuc

SEQ ID NO: 143826 - RNA, 60 nt, Human
ccagaccuccagagcauccagagccucuguccugcccacgcuagccucccugcagggacc

SEQ ID NO: 143827 - RNA, 60 nt, Human
accaggcagagugggagccuaggucaggccccugcccacugccugacccccaccccccgc

SEQ ID NO: 143828 - RNA, 60 nt, Human
gguagaugcuccuguucuggugauaccaaaccugcccaccccucugagucgucuuugcuc

SEQ ID NO: 143829 - RNA, 60 nt, Human
uuuccugggcuuuuauucacuaaaugggcuccugcccaguuuggguacugugcugauuuu

SEQ ID NO: 143830 - RNA, 60 nt, Human
gcuuaaccacgugcauuuggccuauguaauccugcccaugguggccgcagcuaaucagaa

SEQ ID NO: 143831 - RNA, 60 nt, Human
uccuggaggccuuccgccuuguggagaaauccugcccagagggcgaugccucagaaugcc

SEQ ID NO: 143832 - RNA, 60 nt, Human
gcuuguugaaaacccagacugucuccacggccugcccagucgaccccaaaggaacacuga

SEQ ID NO: 143833 - RNA, 60 nt, Human
agcauuuguaagcacauggugaaaucagccccugcccaccaaaauaaucuuuauguuacc

SEQ ID NO: 143834 - RNA, 60 nt, Human
gcccuccucuuuccgcucccccaucucggcccugcccauacuccaagggucagcucccau

SEQ ID NO: 143835 - RNA, 60 nt, Human
guuggguucuauaccuaaaaauuuucccucccugcccaaggugauuggaaaguacugcaa

SEQ ID NO: 143836 - RNA, 60 nt, Human
uugcaguucugugaaauguuuuauaaugucccugcccagggaccuguuagaaagcacuuu

SEQ ID NO: 143837 - RNA, 60 nt, Human
cgagcccuaaaggcaagaagugugucuucuccugcccauuucucucucccacaguacauc

SEQ ID NO: 143838 - RNA, 60 nt, Human
acccugccaggucccgcgcaccaucccugcccugcccacgugguauugcugggcuccugg

SEQ ID NO: 143839 - RNA, 60 nt, Human
uccugaucagcccguaucaucugaggccugccugcccacccugccacccuccccucccuu

SEQ ID NO: 143840 - RNA, 60 nt, Human
ccugggccccgcagauggccauuuccggugccugcccaguggccacucuucuggaagggg

SEQ ID NO: 143841 - RNA, 60 nt, Human
ccccagggggcccccugcggccugggccccccugcccacggccagcuuccugcugaugaa

SEQ ID NO: 143842 - RNA, 60 nt, Human
ugccucaguguaucacuggagucacaggacccugcccaccugaguucccaauaaagaaaa

SEQ ID NO: 143843 - RNA, 60 nt, Human
aauguuggaaaaugcagggugacugaguucccugcccagcuuucgggaucucuggccccc

SEQ ID NO: 143844 - RNA, 60 nt, Human
uagaugccaacuggagggccagaccuguguccugcccauguccuccuugguggacguuuc

SEQ ID NO: 143845 - RNA, 60 nt, Human
uucuguuuacucagagcugcuagagaccauccugcccauccgaguucugagauugggacu

SEQ ID NO: 143846 - RNA, 60 nt, Human
cugcuaugauggugguauccgaggccuuucccugcccagucuggugccugccccacauug

SEQ ID NO: 143847 - RNA, 60 nt, Human
ggggauccaagaccugagauaaagcaacagccugcccagaucccucuguucauccuaucc

SEQ ID NO: 143848 - RNA, 60 nt, Human
cagccagccaaaguaaugacacauuccagcccugcccagcaugcugaccuuuggccucua

SEQ ID NO: 143849 - RNA, 60 nt, Human
ugagagucugcugggauugagcaaucaucuccugcccaaguuuccuccuugcccugagga

SEQ ID NO: 143850 - RNA, 60 nt, Human
agccccccuuucccuggagcaccugccccaccugcccacagagaacacaguggucucccc

SEQ ID NO: 143851 - RNA, 60 nt, Human
uccuucgguucuuacugagucacagacucgccugcccacuacguguccuggguucucucu

SEQ ID NO: 143852 - RNA, 60 nt, Human
ccuucuggugaaguccaccuccaacauuaaccugcccaccccacccccgucaucccugga

SEQ ID NO: 143853 - RNA, 60 nt, Human
ccugccauugccuccucuccauugcagacgccugcccaucaaguauuaccugcggcgacu

SEQ ID NO: 143854 - RNA, 60 nt, Human
ggcucaacuucaccaagaugcauucucauaccugcccacagcuccauuuuggaggcaggc

SEQ ID NO: 143855 - RNA, 60 nt, Human
auguugagauuuaggcuuauuugagcacugccugcccaacugucagugccagugcauagc

SEQ ID NO: 143856 - RNA, 60 nt, Human
aggaagggucaagccagccacugcuguggcccugcccagggcuugguugagggaacggcu

SEQ ID NO: 143857 - RNA, 60 nt, Human
agccauacaucugacugccugacauggacuccugcccacuugggggaaaccuuauaccca

SEQ ID NO: 143858 - RNA, 60 nt, Human
ugggcuggcagcaggacgacuggcuguccuccugcccacccacacugacggcaucuuccc

SEQ ID NO: 143859 - RNA, 60 nt, Human
caaagugcugagauuacaggugugagccacccugcccagccgucaaaagagucuuaauau

SEQ ID NO: 143860 - RNA, 60 nt, Human
ucaggcugaaguaacuuuucucugcuucucccugcccagcucagagcugagggccucccc

SEQ ID NO: 143861 - RNA, 60 nt, Human
ggcugcucaguauuugagcuaugucugcuuccugcccaccuccagccagagaagaaucag

SEQ ID NO: 143862 - RNA, 60 nt, Human
uuaacuuauuucaagggugcugugcucagcccugcccauggcugugcagcucccuccgug

SEQ ID NO: 143863 - RNA, 60 nt, Human
agccacaggcuucuuguccaccucuucuccccugcccaccagcugcucagcgcauaagac

SEQ ID NO: 143864 - RNA, 60 nt, Human
aaaaggaaugugugugcacuuggcgagccuccugcccacccuguccacaccuaauaagug

SEQ ID NO: 143865 - RNA, 60 nt, Human
uuaugcacagacugauaauaaaccucuaaaccugcccagcggaaguguguuuuuuuuuaa

SEQ ID NO: 143866 - RNA, 60 nt, Human
cuguccgacugagccacugccagccgcucuccugcccaccucuccccacccugaacccag

SEQ ID NO: 143867 - RNA, 60 nt, Human
cauggauccuggaugaaucccaguucuuccccugcccagcuauugggagcuggccuaagu

SEQ ID NO: 143868 - RNA, 60 nt, Human
aggcagggcccugccccccucccuuccgcuccugcccagccugggggaaggagaaaggag

SEQ ID NO: 143869 - RNA, 60 nt, Human
ccuccugagccugcugucaucuucacugccccugcccaucugucacccaccugcuccuuu

SEQ ID NO: 143870 - RNA, 60 nt, Human
uuuuuuuauggcguuuuucucgucccccucccugcccaaacuccccuucccuggggagcc

SEQ ID NO: 143871 - RNA, 60 nt, Human
uauguuaccuuuuuacucaaaggaguccccccugcccaguaacaguccuauuaguguuua

SEQ ID NO: 143872 - RNA, 60 nt, Human
auaguuuuguuaugaaaguauguauuuugcccugcccacauugcagguguuuuguauaua

SEQ ID NO: 143873 - RNA, 60 nt, Human
cagaagcacaugaaguuugcaacuuuccacccugcccauuuuuguaaaacugcagucauc

SEQ ID NO: 143874 - RNA, 60 nt, Human
cuuccucaccucucagccuccagaucccuuccugcccaucccuucccuacaaugcccacu

SEQ ID NO: 143875 - RNA, 60 nt, Human
ugugaguggcaaguggcuuaucuggagccaccugcccaagucuuacuaaaaugcagcugu

SEQ ID NO: 143876 - RNA, 60 nt, Human
guauuuuugccggcuggugaauucaaacaaccugcccaaagauugauuuguguguuugug

SEQ ID NO: 143877 - RNA, 60 nt, Human
ugaaagaaagcacauccaaagcauaguuuaccugcccacgaguucuggaaagguggccuu

SEQ ID NO: 143878 - RNA, 60 nt, Human
acuuuaggaacacaguuggaggucaccucuccugcccagcucccgcacccugcguuuagg

SEQ ID NO: 143879 - RNA, 60 nt, Human
cccaccgacacccccagaacccucugggggccugcccaggggacccccugagccccccga

SEQ ID NO: 143880 - RNA, 60 nt, Human
guaugcucuggaaucuguggagacgccagcccugcccaaucagagaugccaaaaaugggg

SEQ ID NO: 143881 - RNA, 60 nt, Human
ggguuuacgggcugugaauggaccuucagcccugcccacccucccuccccacugcugcug

SEQ ID NO: 143882 - RNA, 60 nt, Human
gucaucacucuucuguaaugcccaccugccccugcccagaauuccuagcugccuguguca

SEQ ID NO: 143883 - RNA, 60 nt, Human
ccaaacagaggaugcucagauuucucacauccugcccaggaucuccucuuaggguagaag

SEQ ID NO: 143884 - RNA, 60 nt, Human
ggagaagguggacagauuugggaggccccuccugcccaagugaggcccugggaauuuaca

SEQ ID NO: 143885 - RNA, 53 nt, Human; identical to SEQ ID NO: 13393

SEQ ID NO: 143886 - RNA, 60 nt, Human
gugcugugcugaggaaaggggaugcagagcccugcccagcaccaccaccuccuaugcucc

SEQ ID NO: 143887 - RNA, 60 nt, Human
gaaggacggggccaaccagccacuggcuuuccugcccaggcuuggccucccaggacaucu

SEQ ID NO: 143888 - RNA, 60 nt, Human
aggaaaaugcuguugugugacaauggagagccugcccaaggacugugcaaccuaucuguu

SEQ ID NO: 143889 - RNA, 60 nt, Human
gcaguaccguccgcaccgccaggcucagccccugcccaccccacuuccacauggcccucg

SEQ ID NO: 143890 - RNA, 60 nt, Human
cgaaucacgaggucaggaguucgagaccagccugcccaacauggugaaacccugucucua

SEQ ID NO: 143891 - RNA, 60 nt, Human
gaggaggucgugcagcacagcgcagaagccccugcccacgggauccggccccccagacac

SEQ ID NO: 143892 - RNA, 60 nt, Human
agugacacguucucugacagcaccuugccgccugcccacgaccuugaccgugaggagcug

SEQ ID NO: 143893 - RNA, 60 nt, Human
agccccccucggaggccccgccacagccaaccugcccagucuuuccucugggcuugaccc

SEQ ID NO: 143894 - RNA, 60 nt, Human
aguacuagggccggcccguccuuccccgccccugcccacauggcggcuccugccaacccu

SEQ ID NO: 143895 - RNA, 60 nt, Human
agcccagggccccuugaggcccagacucagccugcccacuggugccggagacggagugga

SEQ ID NO: 143896 - RNA, 60 nt, Human
cugcugcagaacgguuuuugcugaggugccccugcccagcccuguccagccuuguccaca

SEQ ID NO: 143897 - RNA, 60 nt, Human
ucuuuuuccccacacugucccuggccaagcccugcccagagcugaacccuguagcugccc

SEQ ID NO: 143898 - RNA, 60 nt, Human
gagaccuaccggcgcggcgagagcggacugccugcccacccugagguccccgacugagcc

SEQ ID NO: 143899 - RNA, 60 nt, Human
caguaguacaagcuccccucagccagccugccugcccagcgaggcccccagguucaaggu

SEQ ID NO: 143900 - RNA, 60 nt, Human
caccugguacagguagguggcgcucacguuccugcccaaaugcagcccaucggggaguca

SEQ ID NO: 143901 - RNA, 60 nt, Human
ugugaaucuucccgucugaagaacgcccagccugcccagacaaagccccgccuuccccaa

SEQ ID NO: 143902 - RNA, 60 nt, Human
augaccccuucagaucaucugugccuaccuccugcccaucaggcgucuacacugucacuc

SEQ ID NO: 143903 - RNA, 60 nt, Human
cacccccacugggcccaggccaggaggggcccugcccaugcccacacuacaggccagggc

SEQ ID NO: 143904 - RNA, 60 nt, Human
cacgauauaaaaaaauuuuuccaaguuauuccugcccauugaccuaacauauggauuaca

SEQ ID NO: 143905 - RNA, 60 nt, Human
aauggccccugucuucggccgagcugguuuccugcccagccuggggcaaaccuagccgga

SEQ ID NO: 143906 - RNA, 60 nt, Human
uuauccuguaguacaagauuaucuuauuccccugcccaggugugagcacgugcucucgcu

SEQ ID NO: 143907 - RNA, 60 nt, Human
cugcaguuaacuguggcuccugcagggcacccugcccagaaugcccagaagagaaccaug

SEQ ID NO: 143908 - RNA, 60 nt, Human
cgucuccaaacagccuccuucgacucggcuccugcccagcucccggcggccuucguaggc

SEQ ID NO: 143909 - RNA, 60 nt, Human
gcggaauguggccucugcuuccuccguccuccugcccaaggacgacgaggauugcuccag

SEQ ID NO: 143910 - RNA, 60 nt, Human
ccgugugccccacccucccucggcuuuacuccugcccagugacugugaccacuguccgug

SEQ ID NO: 143911 - RNA, 60 nt, Human
gccugcgacaggugugcucucuuuccaagaccugcccaggauuuaguaagggaaagucaa

SEQ ID NO: 143912 - RNA, 60 nt, Human
ccaucacugccucuccagggacccuccucuccugcccaggacagacccagccagaaccac

SEQ ID NO: 143913 - RNA, 60 nt, Human
uaauaccauccugcccauuguccuuaccguccugcccauacagacuguggcuccuuccuc

SEQ ID NO: 143914 - RNA, 60 nt, Human
ggagauggcauagagaagaucuaauaccauccugcccauuguccuuaccguccugcccau

SEQ ID NO: 143915 - RNA, 60 nt, Human
cuauauuuuugcccaggucuggguauugcuccugcccagacccugacaucccuuuccacu

SEQ ID NO: 143916 - RNA, 60 nt, Human
caacaucacacaguauacucagcuaacaaaccugcccauguguuuccugaaucuaaaaua

SEQ ID NO: 143917 - RNA, 60 nt, Human
gaaagagucacaccuuagugcuauaacucuccugcccaugauaguguauucuguuucagg

SEQ ID NO: 143918 - RNA, 60 nt, Human
uaggucaggaccuuggcuggaccuggaggcccugcccagcccugcucugcccagcccagc

SEQ ID NO: 143919 - RNA, 60 nt, Human
cucaggcaccucuucccccaggaagccuucccugcccaccccaucuaugacuugagccag

SEQ ID NO: 143920 - RNA, 60 nt, Human
gcucugcagcgagcccugggaccacucaucccugcccagccagcuucagugcccggggcc

SEQ ID NO: 143921 - RNA, 60 nt, Human
agcgggggagggugcccggggcacacaaggccugcccagccagccagacucaccugcccu

SEQ ID NO: 143922 - RNA, 60 nt, Human
agcagggggccuggugggaggagcgacugcccugcccaaaugaacugccacagcagggac

SEQ ID NO: 143923 - RNA, 60 nt, Human
agagccuccagaugugccugcagccuagucccugcccaagcuucucccccagccacccuc

SEQ ID NO: 143924 - RNA, 60 nt, Human
gggcucuggagugguggggaagugaugcugccugcccacgagcccugguuuggguggcaa

SEQ ID NO: 143925 - RNA, 60 nt, Human
cugcaugggagagcugucccuccuucuccaccugcccaccgggacacucccccugcucuc

SEQ ID NO: 143926 - RNA, 60 nt, Human
ugccucguccaggucucuaucucccaaagaccugcccaccuccugggcucucccagggaa

SEQ ID NO: 143927 - RNA, 60 nt, Human
cgcacacaagacgggagucacccugugcuuccugcccaagauacugacccauugaacccc

SEQ ID NO: 143928 - RNA, 60 nt, Human
ccucucuggccauugcagagcugcuggccuccugcccagguggaggguccuggggacggc

SEQ ID NO: 143929 - RNA, 60 nt, Human
ugcaugucuguccuuugaacacuuucucucccugcccaaaaggaaacccaaauuauuugu

SEQ ID NO: 143930 - RNA, 60 nt, Human
ccaaaaccgccaucagucccgagagcucacccugcccaccucgccgcaaagcgaaagaaa

SEQ ID NO: 143931 - RNA, 60 nt, Human
aaguucuuaaaaaauuuauacuuaaaaaauccugcccaaaaugugaagcuugguugacug

SEQ ID NO: 143932 - RNA, 54 nt, Human; identical to SEQ ID NO: 13440

SEQ ID NO: 143933 - RNA, 60 nt, Human
acccgcagaauggugcucuccuuugcccucccugcccagcagccugauaggacucuccua

SEQ ID NO: 143934 - RNA, 60 nt, Human
agccccaaggcuggggccacagcuccuaccccugcccagcagcccugagcucagcugcag

SEQ ID NO: 143935 - RNA, 60 nt, Human
cccgaguagagggcaucccggagcccccagccugcccacuacauccagccuguggcuuug

SEQ ID NO: 143936 - RNA, 60 nt, Human
aagcaggggagcagagcaccaggccgggcgccugcccagcaggagcugaugccggaggca

SEQ ID NO: 143937 - RNA, 60 nt, Human
ucgggagagcuaccuuacuuugaccaacagccugcccaguguggaugucucuuacagagg

SEQ ID NO: 143938 - RNA, 60 nt, Human
cucagcguucacaccaggcgggcuggguccccugcccaccugccucccugcccccuguga

SEQ ID NO: 143939 - RNA, 60 nt, Human
ugccuucacugggccagucaacggggggcuccugcccaggccacagagaaccugaguucc

SEQ ID NO: 143940 - RNA, 60 nt, Human
ccaaagugcgggauuacaagcgugaaccacccugcccagccagaaacuagauuuucuuua

SEQ ID NO: 143941 - RNA, 60 nt, Human
auaauaacaguggaagucacaaaaauguccccugcccagcccccucgccgcccuugaccu

SEQ ID NO: 143942 - RNA, 60 nt, Human
ccaccguuuacaugugcacgcccugacccaccugcccacgccgacuugggaggauggugg

SEQ ID NO: 143943 - RNA, 60 nt, Human
agccucuggggagcgaggcugaaaccugaaccugcccauggagacaguuguggugagggu

SEQ ID NO: 143944 - RNA, 60 nt, Human
ccucccaggccucccuccuacugccugugcccugcccagggcuccuguccugcagccauu

SEQ ID NO: 143945 - RNA, 60 nt, Human
ccccucacgccgcccugcagcccccaugccccugcccaacaugcuggggguccagaaacc

SEQ ID NO: 143946 - RNA, 60 nt, Human
gccccugccccggcuccccgccaaagcaacccugcccacucaggcuucauccugcacaau

SEQ ID NO: 143947 - RNA, 60 nt, Human
accguggugugaggcccccggaggcgcccaccugcccaguuagcccggccaaggacacug

SEQ ID NO: 143948 - RNA, 60 nt, Human
ucugcccuggggccaccucggcugcugcagccugcccagcagcacauuccagucacugcc

SEQ ID NO: 143949 - RNA, 60 nt, Human
cucucuuggccuagccuggcccacucaggaccugcccagccucugccagcuccucuggca

SEQ ID NO: 143950 - RNA, 60 nt, Human
gccaccguuagcgcgagcugcuccguucgcccugcccacggccugcguggcuggggccga

SEQ ID NO: 143951 - RNA, 60 nt, Human
cccucccucugcccucccgucugugagcucccugcccagcaccaccuccugcacugcacu

SEQ ID NO: 143952 - RNA, 60 nt, Human
accaaagccuucugggcugucggggcccaaccugcccaaccccagcacuccccaaagugc

SEQ ID NO: 143953 - RNA, 60 nt, Human
gugauccucacuagacagaggagcuccaaaccugcccaucucaucccaugcaccgacggu

SEQ ID NO: 143954 - RNA, 60 nt, Human
ucucuucuugcuucaauugcuuacccacugccugcccagacuuucuauccagccucacug

SEQ ID NO: 143955 - RNA, 60 nt, Human
cagacagaccuggguucaaguccucaguccccugcccacucccuacgugacuuugaucag

SEQ ID NO: 143956 - RNA, 60 nt, Human
gugcccaccgcccccccccccaccccccgcccugcccacagagcaccugcugguaacccu

SEQ ID NO: 143957 - RNA, 60 nt, Human
cugagaggccuaauagggcagagauggaggccugcccagacuaggaggcagcggggauag

SEQ ID NO: 143958 - RNA, 60 nt, Human
cccaccuccgcauccacccccguccgccauccugcccaccaccaggucgguucccgaggc

SEQ ID NO: 143959 - RNA, 60 nt, Human
ggaggagggcuagaagccagucccuccccaccugcccagagcuccaggccagcacagaaa

SEQ ID NO: 143960 - RNA, 60 nt, Human
uuucauguuacuguugcagcuugugcugagccugcccaguuggaggagacugggcacccc

SEQ ID NO: 143961 - RNA, 60 nt, Human
ugagcgcucagagggccuggggcccucacuccugcccacgccucccagaccccagaacgg

SEQ ID NO: 143962 - RNA, 60 nt, Human
cccagugcuggcccccuacagguggcagccccugcccacucccaugcugguggcccuggc

SEQ ID NO: 143963 - RNA, 60 nt, Human
cccagcagcccacauguguucaggacccucccugcccacccccucccugccguaucgauc

SEQ ID NO: 143964 - RNA, 60 nt, Human
caucacagacacagagagcugcaggggaggccugcccacuguuuugucgacucugcccuc

SEQ ID NO: 143965 - RNA, 60 nt, Human
ggugcugaagaccaagggucccccuuguuaccugcccaaacuugugacugcaucccucug

SEQ ID NO: 143966 - RNA, 60 nt, Human
agccccaggccaggaggcuguuccaggaguccugcccagcagccucaguggccaagccca

SEQ ID NO: 143967 - RNA, 60 nt, Human
uggcuagagccuccaggcccuaugaugcucccugcccaggccauauccuuuauuccugcu

SEQ ID NO: 143968 - RNA, 60 nt, Human
agccagauggcaccagcugcuccggaugugccugcccacauugggggacagggccgggcc

SEQ ID NO: 143969 - RNA, 51 nt, Human; identical to SEQ ID NO: 13477

SEQ ID NO: 143970 - RNA, 60 nt, Human
gggaggcauccgugugccggcccugcagugccugcccacggucaggcauugaaaacuaag

SEQ ID NO: 143971 - RNA, 60 nt, Human
gcuuggacuagcuguggcccagacaucggcccugcccagaauugccaggaggaggcuuug

SEQ ID NO: 143972 - RNA, 60 nt, Human
ccaugucuaugauucguguaauuacuuaucccugcccauuucauauucuuucaauucugu

SEQ ID NO: 143973 - RNA, 60 nt, Human
gaccuaugccuaccuucucuuucuucguucccugcccacugggcauggcagcugggggug

SEQ ID NO: 143974 - RNA, 60 nt, Human
aagggcuucgggggagugguuacccugcucccugcccagugacaagcccuccuuuccccu

SEQ ID NO: 143975 - RNA, 60 nt, Human
uuccccugggggcccuccuuuccccugcucccugcccagcuacggggcccuccuuucagc

SEQ ID NO: 143976 - RNA, 60 nt, Human
caacccagacccagaaccgcucuccccuucccugcccagugccccuccuccccagcccag

SEQ ID NO: 143977 - RNA, 60 nt, Human
aaaaaaaaaaaaaaaaaagaauuccuggggccugcccagucugugagcugccauguugau

SEQ ID NO: 143978 - RNA, 60 nt, Human
ccucuacugccucuuccugccucuccccacccugcccacauccacagaggggagagaagg

SEQ ID NO: 143979 - RNA, 60 nt, Human
augaugacaucauggggagccagcagaguuccugcccauggucuugagcugaaugagaga

SEQ ID NO: 143980 - RNA, 60 nt, Human
gggggugaugaaaaggggaggggcggagcuccugcccaggagaggggcuguggggcccca

SEQ ID NO: 143981 - RNA, 60 nt, Human
guugugcucagccugucgggucucuuucuuccugcccauauauuauaccaguugcuucug

SEQ ID NO: 143982 - RNA, 60 nt, Human
ccugcucagaaugcucccaguucccucgucccugcccaggucucuugucucuugggaagg

SEQ ID NO: 143983 - RNA, 60 nt, Human
uguaccacaguggcucuggggccaggccugccugcccacuggccaucgccaccuucccca

SEQ ID NO: 143984 - RNA, 60 nt, Human
caccuccucccugacccuuaacacuccuguccugcccagaccaacagagagagcuguccc

SEQ ID NO: 143985 - RNA, 60 nt, Human
uuguccuggugcccaggagcccuccagcccccugcccacagaagggaaggccugcagagg

SEQ ID NO: 143986 - RNA, 60 nt, Human
agcagugaagguucuucucugugugggugcccugcccacccccuccuuugccuguguccu

SEQ ID NO: 143987 - RNA, 60 nt, Human
uccccucagcucugccucugcagcccacugccugcccagugccaucaggaugagcaguac

SEQ ID NO: 143988 - RNA, 60 nt, Human
agggauaugccuccgcaacucacacaccugccugcccacgcuccuucuuuagcucugaca

SEQ ID NO: 143989 - RNA, 60 nt, Human
ggaccuccaucugacugcgccgccugcccuccugcccacccucccacccacccgaccagc

SEQ ID NO: 143990 - RNA, 60 nt, Human
gagugagacaaauacagaaaugacccauucccugcccaccagaaacucagaggugauugg

SEQ ID NO: 143991 - RNA, 60 nt, Human
cuacacgcucauauugugcauauggcagacccugcccagcgugcgcuuugauacagcaaa

SEQ ID NO: 143992 - RNA, 60 nt, Human
gaauuuucuguuuagugggcagguguuauuccugcccacagcaaagcuuggacuugcagc

SEQ ID NO: 143993 - RNA, 60 nt, Human
aagcugguuacuuuuggccuccccagcaccccugcccaucuggugccacagccuugcccc

SEQ ID NO: 143994 - RNA, 60 nt, Human
aaauacuuuuuaaagcccucuugccucuucccugcccacuccugcccccugaccagaaga

SEQ ID NO: 143995 - RNA, 60 nt, Human
uugcuucugauuucuucuccccugcuguuuccugcccaucagagaggccugauacaagca

SEQ ID NO: 143996 - RNA, 60 nt, Human
aagugagggaaaaacguuaggugcuaaccaccugcccagaagaguggaucucacagccca

SEQ ID NO: 143997 - RNA, 60 nt, Human
caggaacccaagccaccccggcuccccucgccugcccaggggccguggugacucacgggc

SEQ ID NO: 143998 - RNA, 60 nt, Human
ggcugucccuguggacccgccauccaccguccugcccacgccgccucagccugccaccuc

SEQ ID NO: 143999 - RNA, 60 nt, Human
aaggucauuuuauacaacaggagauugguuccugcccagaugacagaaaaugggagcucu

SEQ ID NO: 144000 - RNA, 60 nt, Human
ugugccuacuguuccccaccucagaagcuuccugcccagagagccagcagccuugggaua

SEQ ID NO: 144001 - RNA, 60 nt, Human
aucucuagaauugccacgagucucucucuuccugcccaguccagggcccuccuuuccuau

SEQ ID NO: 144002 - RNA, 60 nt, Human
cgagucggagacuugaggaguccaaaggguccugcccacagcgcccuguaccugcuccca

SEQ ID NO: 144003 - RNA, 60 nt, Human
uggagcaggcacauagugagcccgggcagcccugcccagcucaggccccuuuccuucccc

SEQ ID NO: 144004 - RNA, 60 nt, Human
uacccccacuccaucccccaggggaacaccccugcccagcuacuuuccuaaugaaauaaa

SEQ ID NO: 144005 - RNA, 60 nt, Human
ggacuggccuggauggcuguccugggagccccugcccacccugacagagggagcugggcc

SEQ ID NO: 144006 - RNA, 60 nt, Human
ucguucccgaaugugcuuuccucccucuccccugcccaccucaaguuuaauaaauaaggu

SEQ ID NO: 144007 - RNA, 60 nt, Human
gagauuguucuccagcaccccacauucaccccugcccagagauucccccuucuccucucc

SEQ ID NO: 144008 - RNA, 60 nt, Human
agauuacuuccuccaccccucccuaucucaccugcccagcccugugcuggggcccugcaa

SEQ ID NO: 144009 - RNA, 60 nt, Human
cacugccacuuguccccccacacccguccaccugcccagagcucagagcuaaccaccauc

SEQ ID NO: 144010 - RNA, 60 nt, Human
uggccuugccagaguggcuucugaggacucccugcccagcccagcuuucacuggggggag

SEQ ID NO: 144011 - RNA, 60 nt, Human
cuuggcacugugccaagccuggggccaaucccugcccagucagcuggggucugguggggg

SEQ ID NO: 144012 - RNA, 60 nt, Human
cccaccugaagcagaaccacuuuggccuccccugcccaaaauggguagugucuacacguc

SEQ ID NO: 144013 - RNA, 60 nt, Human
gucaucucagccugagcccuggaggcugggccugcccacuccagcuccaucccuuauuua

SEQ ID NO: 144014 - RNA, 60 nt, Human
acuggguucucuccuucuucuuccugcuguccugcccaagaacugagggucuccccggcc

SEQ ID NO: 144015 - RNA, 60 nt, Human
cugcccugccagagacagacccaugcgcugccugcccaccgugccccuuuguccccaugu

SEQ ID NO: 144016 - RNA, 60 nt, Human
gggacucacccggccgccagacugccugggccugcccagauggccaccucguggugcugc

SEQ ID NO: 144017 - RNA, 60 nt, Human
ccacuuccagagggggccagagggacuuugccugcccagucuuuggagagcucaguacag

SEQ ID NO: 144018 - RNA, 60 nt, Human
accuucucuuccuuuccuuuccuuuccucuccugcccauuuuccuguucuucuguccuuc

SEQ ID NO: 144019 - RNA, 60 nt, Human
accuggccucaauguuggcuuguuauguuaccugcccacccucauccuuaccuccuccua

SEQ ID NO: 144020 - RNA, 60 nt, Human
cagccccugaggaaauggaaugaaccacucccugcccauucccuauaagaauaucccaag

SEQ ID NO: 144021 - RNA, 60 nt, Human
acacgccauggaccucagggcacucuccucccugcccacaaagaccuccugggugggaaa

SEQ ID NO: 144022 - RNA, 60 nt, Human
ucccggcaggacugugauacagagcccuagccugcccagccagccccaagaucucaggag

SEQ ID NO: 144023 - RNA, 60 nt, Human
ggcagcuuucccgcucuggguaccuuacguccugcccagcucugugcaccugaaccccag

SEQ ID NO: 144024 - RNA, 52 nt, Human; identical to SEQ ID NO: 13532

SEQ ID NO: 144025 - RNA, 60 nt, Human
uugcagugcugggagccgcuuccuuccugcccugcccaccuggggaucccccaaagucag

SEQ ID NO: 144026 - RNA, 60 nt, Human
auucagcuguacacacaaagucugguuuuuccugcccaacuucccccuggaagguguacu

SEQ ID NO: 144027 - RNA, 60 nt, Human
ugcugaccuccacagcuuccccucucuccuccugcccaccugucaaacaaagccagaagc

SEQ ID NO: 144028 - RNA, 60 nt, Human
caaagacuacugggaggcugcugccuccuuccugcccauggcacccuccucugcugucug

SEQ ID NO: 144029 - RNA, 60 nt, Human
caaugucuaccucugaagccuccuucccugccugcccaccccuccaugcuccacgcaggc

SEQ ID NO: 144030 - RNA, 60 nt, Human
ugagacuauuugcugugggcucuccuccagccugcccagggcccacccagaugccucugg

SEQ ID NO: 144031 - RNA, 60 nt, Human
uuccauuucacaggugcacauaaagaccuuccugcccaccuccuauggacauguccaggg

SEQ ID NO: 144032 - RNA, 60 nt, Human
gagacuucccugccguguuugugacccccuccugcccagcaaccugccagcuacaggagc

SEQ ID NO: 144033 - RNA, 60 nt, Human
accacugaugauggggacccugggccagcgccugcccacuuggccucagucuccccaccu

SEQ ID NO: 144034 - RNA, 60 nt, Human
gcccuaacgcgcuuugcugugagccuggccccugcccagggcuugggucuggugagcuga

SEQ ID NO: 144035 - RNA, 60 nt, Human
uuugcaggacucuuaccauggccaggcauuccugcccagccuuuaccuccuuuuccuggc

SEQ ID NO: 144036 - RNA, 60 nt, Human
gagaaauucagugcagcagggggacacagaccugcccaagccaccccacugccguucccu

SEQ ID NO: 144037 - RNA, 60 nt, Human
uggggaaacaucagugaauaaaacacggucccugcccacagugcuuagggccuacugagg

SEQ ID NO: 144038 - RNA, 60 nt, Human
uuggguuccacugacaccccugccccugccccugcccagaaccaagugccauuucucacu

SEQ ID NO: 144039 - RNA, 60 nt, Human
agacuugaggccauugaagcugcaggaagcccugcccagggaugguccugccaugaggag

SEQ ID NO: 144040 - RNA, 60 nt, Human
ggccuccaggcccgucuguccaucugcccgccugcccaccugccuggccggccagccagc

SEQ ID NO: 144041 - RNA, 60 nt, Human
acaacaaguuaucccagggccugagguucuccugcccaguccccucuugcagggguugcu

SEQ ID NO: 144042 - RNA, 60 nt, Human
cagagcccaagugccaucccacauucggacccugcccauaccccugccuggguuuucuaa

SEQ ID NO: 144043 - RNA, 60 nt, Human
ugucuuauguguguccugaaaaaauaagagccugcccaagacuuugggccucuugacaga

SEQ ID NO: 144044 - RNA, 60 nt, Human
gaaggccuaguugcccgcugggccuggggcccugcccaugccugggccagaguggcgcug

SEQ ID NO: 144045 - RNA, 60 nt, Human
cccugcgcgguaaccccaccacuccugaagccugcccagucuccuuccuucccugcuugg

SEQ ID NO: 144046 - RNA, 60 nt, Human
gucguccucaccauagccaaggccuuggggccugcccagggcugcuccccugggcccagc

SEQ ID NO: 144047 - RNA, 60 nt, Human
uuggugucuguccaguccauucaaggcuagccugcccaugcacuguggcagggguuggau

SEQ ID NO: 144048 - RNA, 60 nt, Human; identical to SEQ ID NO: 13556

SEQ ID NO: 144049 - RNA, 60 nt, Human
ggcacagaccuugugggacugggccccaggccugcccaggaugugguuuuccaaguccug

SEQ ID NO: 144050 - RNA, 60 nt, Human
aaggugucuccaucaccaccaccagagccuccugcccagcccuggccaguucaaagguuc

SEQ ID NO: 144051 - RNA, 60 nt, Human
ccccuucccacccuccagccaaggagcagcccugcccagggggcauuagguguggguacc

SEQ ID NO: 144052 - RNA, 60 nt, Human
cucucucuccucccuguuggugcuguucuuccugcccaacaccuguuucucuuuuccuca

SEQ ID NO: 144053 - RNA, 60 nt, Human
ggguaggugaaagucuagagaaagaggcuaccugcccagggucacagcaaggcugggacc

SEQ ID NO: 144054 - RNA, 60 nt, Human
augcugagugauccccuccagggacacuucccugcccaggccaccucccacagcccucca

SEQ ID NO: 144055 - RNA, 60 nt, Human
ccugaccccagugcugcucuaagcaccgucccugcccagccccacuucuccaucgcagcc

SEQ ID NO: 144056 - RNA, 60 nt, Human
cugcccgcacagcagccugcuucccaccucccugcccaggccggccagccucacccuugc

SEQ ID NO: 144057 - RNA, 57 nt, Human; identical to SEQ ID NO: 13565

SEQ ID NO: 144058 - RNA, 60 nt, Human
aacacuugccuccccacugcagccugcgguccugcccaccucccgugaugugugugugug

SEQ ID NO: 144059 - RNA, 60 nt, Human
ccgggcacaagaaaccagaguccugcccagccugcccauccccuucccagucagggcucc

SEQ ID NO: 144060 - RNA, 60 nt, Human
guagucuuuccgggcacaagaaaccagaguccugcccagccugcccauccccuucccagu

SEQ ID NO: 144061 - RNA, 60 nt, Human
ggcagggguagaggagggggccgcuguccaccugcccagugcuuggccuggcaguggcuu

SEQ ID NO: 144062 - RNA, 60 nt, Human
gggaaacagcauccugccgccuccucucugccugcccacucaccggcaagguugucccuc

SEQ ID NO: 144063 - RNA, 60 nt, Human
cgggccggcaguggugcggcucacuccgucccugcccaccugcgacgggaucccccgacc

SEQ ID NO: 144064 - RNA, 60 nt, Human
auggaaguggcuguccccuccucuccagccccugcccacccacugguggaggugcuaacu

SEQ ID NO: 144065 - RNA, 60 nt, Human
uuccauugugagaccacugccaucuauccaccugcccaccuccccuuuuguuucucagua

SEQ ID NO: 144066 - RNA, 60 nt, Human
gcacaagggcaccuucucccuugaggcugcccugcccacgugggauucacaggggccuga

SEQ ID NO: 144067 - RNA, 60 nt, Human
aggcaaggaacuggguggaaugucagguugccugcccaaugggagagguaggguuuuucu

SEQ ID NO: 144068 - RNA, 60 nt, Human
caccucagcgggccagcagcccagggaaccccugcccaccaggauugcuggaagugugac

SEQ ID NO: 144069 - RNA, 60 nt, Human
cacaccaagcccuuaucuggggcgcgucuuccugcccagguggaacacuggcauuuuguu

SEQ ID NO: 144070 - RNA, 60 nt, Human
cagcuguggcauccacuguggcaucuccguccugcccaccuucuuaagaggcgagaugga

SEQ ID NO: 144071 - RNA, 60 nt, Human
caauuuaaaaugauccauggccacagggcuccugcccaggggcuugucaccuuccccucc

SEQ ID NO: 144072 - RNA, 60 nt, Human
ggcuggcacuaggcucagcccccaaaacccccugcccagccccagcuucagggcugccug

SEQ ID NO: 144073 - RNA, 60 nt, Human
cauaccuagaggucgggacagacgacgcuaccugcccagacaccaccaaguucucugccu

SEQ ID NO: 144074 - RNA, 60 nt, Human
gacacaaggagggugcguggugcccucaccccugcccagagcgagggggcaaggacucug

SEQ ID NO: 144075 - RNA, 60 nt, Human
gaauugccuugggauuuccuucucccuuucccugcccacccuguccccuacaauuugugc

SEQ ID NO: 144076 - RNA, 60 nt, Human
gugcaaagaagcuaaagaaaaggaauaagcccugcccaguauguagacaaccaauucaaa

SEQ ID NO: 144077 - RNA, 60 nt, Human
uguuuuuaccacaguggucuuuuuaaaccaccugcccacucccuuaacaagaguuuuaua

SEQ ID NO: 144078 - RNA, 60 nt, Human
caccauccgcaagcgggagccaggcggccgccugcccaccuccuccaccugcuucaaccu

SEQ ID NO: 144079 - RNA, 60 nt, Human
ccauaccgggccucuggcccagaccuaagcccugcccacaaagacuaauggaugccagug

SEQ ID NO: 144080 - RNA, 60 nt, Human
caaguacagccacuguaaauaacccucgucccugcccaggaacccagacuggacuucagu

SEQ ID NO: 144081 - RNA, 60 nt, Human
caauggcguuagacucccaggaagacuagcccugcccacagggccaccuguugguuugag

SEQ ID NO: 144082 - RNA, 60 nt, Human
cggcucccaggacauggcugacuuugccaaccugcccagcugcugccgcuggaggauccg

SEQ ID NO: 144083 - RNA, 60 nt, Human
ccggggcucaggagccaugaccuggugucuccugcccacccuggucccagguaaauguga

SEQ ID NO: 144084 - RNA, 60 nt, Human
ccaaggguacacgcaggcaugcacggguuuccugcccagcgacggcuuaagccagccccc

SEQ ID NO: 144085 - RNA, 60 nt, Human
uuucgcccuuguuucccacauucccuucguccugcccaagggcgggacugaagagcugga

SEQ ID NO: 144086 - RNA, 60 nt, Human
ggcgucuauucugcccacaccccagcccaaccugcccacguucucuauuguuuugagacc

SEQ ID NO: 144087 - RNA, 60 nt, Human
agcagacugguuccuaacucucucccuccuccugcccacacacaucaaaagaaucuuccc

SEQ ID NO: 144088 - RNA, 60 nt, Human
ucucuucuugguuucauaccguucuuaucuccugcccaagcauauaucgucucuuuacuc

SEQ ID NO: 144089 - RNA, 60 nt, Human
ccucguccucccccugccagugccuuaccuccugcccaggagagccagcccucccugucc

SEQ ID NO: 144090 - RNA, 60 nt, Human
aaguugugagugucugcuguccuuggcaccccugcccacuccacacuccuggaauaccuc

SEQ ID NO: 144091 - RNA, 60 nt, Human
ugaggaguccucucuuuaauugcuaaccauccugcccauuauagcuacacucaggaguuc

SEQ ID NO: 144092 - RNA, 60 nt, Human
gccaauccacuccuuccuuucuaucauuccccugcccaccuccuuccagcacugacugga

SEQ ID NO: 144093 - RNA, 60 nt, Human
uuugccuccugaggcgcagcgcacuccuccccugcccaagccuacugccucccgcugccg

SEQ ID NO: 144094 - RNA, 60 nt, Human
cggcgcugcucagcuugggcugguccagggccugcccaggcuggggcaccuuugccuccu

SEQ ID NO: 144095 - RNA, 60 nt, Human
ccucucccacagccagugccaaguccucccccugcccauucucauggggcaggaaauggg

SEQ ID NO: 144096 - RNA, 60 nt, Human
uucucaggcagagacaucuuugggccugucccugcccaggccucuggcuuuuuauauuga

SEQ ID NO: 144097 - RNA, 60 nt, Human
cagcugccccauucuuuuaacguuguagggccugcccauggagcggacccuccucuuugg

SEQ ID NO: 144098 - RNA, 60 nt, Human
uuuuuaggccucacucccaucagaacccugccugcccaccugcaacucccccccaacaau

SEQ ID NO: 144099 - RNA, 60 nt, Human
uguggucaaaccagguacccaagccaccucccugcccaacgccuuuccggcuuuuccccu

SEQ ID NO: 144100 - RNA, 60 nt, Human
uacugggcucaagccuuccucccgccucagccugcccaguaacugguacuacagaugugc

SEQ ID NO: 144101 - RNA, 60 nt, Human
ccuugcucacugccuuaaucagaccgauuuccugcccaccugaccagcccagcgugguaa

SEQ ID NO: 144102 - RNA, 60 nt, Human
caggcccucagggucaaggccuugguuggaccugcccacuccaaaaacccaguguggggg

SEQ ID NO: 144103 - RNA, 60 nt, Human
acuucucagacaaaggcaaggccucgugccccugcccagcccauucauggagcccugggc

SEQ ID NO: 144104 - RNA, 60 nt, Human
cucaguggggaaagcaggggcagaugccacccugcccaggguuggcaugacugucugugc

SEQ ID NO: 144105 - RNA, 60 nt, Human
ccgcuccaucacggauaacaucuccuacggccugcccacugugccuuucgagaugguggu

SEQ ID NO: 144106 - RNA, 60 nt, Human
aggcuguaucuuaauuucugcaccccggacccugcccaccugucugccugccccgccugg

SEQ ID NO: 144107 - RNA, 60 nt, Human
ggacucuccucggguggguccagcaggggcccugcccaccagaacacaguccgugcugug

SEQ ID NO: 144108 - RNA, 60 nt, Human
ggguacuaugauauuuugguuuggaauugcccugcccaagucacugucuuuuaacuuuua

SEQ ID NO: 144109 - RNA, 60 nt, Human
uugguuucagucaucaacuacccaugaauuccugcccaaggauacuuaaucaggauuaaa

SEQ ID NO: 144110 - RNA, 60 nt, Human
ccauucuuuccagcgccccgcaccauagcaccugcccaccugagaaccaggaacgcaccc

SEQ ID NO: 144111 - RNA, 60 nt, Human
gcaagcacucggggucccuggagggcaagcccugcccacagaaagccaggagcagcccug

SEQ ID NO: 144112 - RNA, 60 nt, Human
guccuuguguggccgcccuggcuuggcagcccugcccacgcugcccccgcaaacaauggu

SEQ ID NO: 144113 - RNA, 60 nt, Human
uucucgcgauucaggacguccuuccauaucccugcccagccuguggugcuugaaacguuu

SEQ ID NO: 144114 - RNA, 60 nt, Human
ugcccccagagcugaggccaucugcaagccccugcccauggcccaauggggagccuccag

SEQ ID NO: 144115 - RNA, 60 nt, Human
uccuucggaacccgaacugcaagcugagcgccugcccagauucucccauggguauuucac

SEQ ID NO: 144116 - RNA, 60 nt, Human
gaaguauaaguaagccaagagaagucagccccugcccagaagaucugaaacuaauaguag

SEQ ID NO: 144117 - RNA, 60 nt, Human
ccuuccccucaagccugggcucauggagccccugcccagggcccucaggugggcggaaag

SEQ ID NO: 144118 - RNA, 60 nt, Human
cuuaacuuaugacucaggauuuauucacguccugcccacucuaggcucacaggaauaaaa

SEQ ID NO: 144119 - RNA, 60 nt, Human
aagaaagauuacguugaugaaaaagaacauccugcccaggacccaucauacauauuuuca

SEQ ID NO: 144120 - RNA, 60 nt, Human
augcccccacccaccucgguccagcgcggcccugcccaggaggcggcagccgggcgcacc

SEQ ID NO: 144121 - RNA, 60 nt, Human
ugcugcuuccgguagggaggcagccuccagccugcccaagcccaggccacccuaucgccc

SEQ ID NO: 144122 - RNA, 60 nt, Human
uccgguaaaacaccggagacuaauuccugcccugcccaauuuugcagggagcauggcugu

SEQ ID NO: 144123 - RNA, 60 nt, Human
gcaguguugucggccgaggccugagcucgcccugcccagcuacugaccucaggucgaggg

SEQ ID NO: 144124 - RNA, 60 nt, Human
gacacugcuccuugugcagcucugguaccuccugcccacugcugucacuucaagccacug

SEQ ID NO: 144125 - RNA, 60 nt, Human
gaaccaguauguggcauuccugucaaauggccugcccaugaagcccuggaauuccagcuc

SEQ ID NO: 144126 - RNA, 60 nt, Human
acagagaauauccaaugcagucaaguccacccugcccagacuuugccacugacuucuccc

SEQ ID NO: 144127 - RNA, 60 nt, Human
gauuaggaccucuauccgagaugcuuuuucccugcccaacccuguggccuucagggcuca

SEQ ID NO: 144128 - RNA, 58 nt, Human
caggcugcagccaguccagagagaauagagccugcccaggccuuaagaccaccucuca

SEQ ID NO: 144129 - RNA, 60 nt, Human
ggccccugacuuccuucuagggcagucuggccugcccacaaacugacuuugugaccuguc

SEQ ID NO: 144130 - RNA, 60 nt, Human
aacaaguaauuuaccaguucuacugggguuccugcccaccgucccaaggugggcgaggcc

SEQ ID NO: 144131 - RNA, 60 nt, Human
cugccgggcacaugcccgggggacgccugcccugcccagguggccuccuggcccgcccuc

SEQ ID NO: 144132 - RNA, 60 nt, Human
cggccggccggaccucugagcacauaguguccugcccacccuaccagcuccuccagcccu

SEQ ID NO: 144133 - RNA, 60 nt, Human
auuuaucauggaugaaagagaucuguaaaaccugcccaggaacuuacagaauuuacuuug

SEQ ID NO: 144134 - RNA, 60 nt, Human
augccuuaagaagcagagcuaccuuacgugccugcccaggcuguuccugccuaaaucucc

SEQ ID NO: 144135 - RNA, 60 nt, Human
aucaguauuuuuuuccucccuauacagugcccugcccacccuuaucugcacccaccuccc

SEQ ID NO: 144136 - RNA, 60 nt, Human
auggcugagcuuccagcgccuucuguccugccugcccagucccuucacugcuuuccugcc

SEQ ID NO: 144137 - RNA, 60 nt, Human
cacugccuucuaaggagccaaggagaauucccugcccacuuucuguuccuccaugcccaa

SEQ ID NO: 144138 - RNA, 60 nt, Human
uguugcacgggagaacuuuccucacccgccccugcccagacagggugaggaaagggcucc

SEQ ID NO: 144139 - RNA, 60 nt, Human
aaucaaguaucugagccagaugcugcgggaccugcccagcugcccgugugccuacccacu

SEQ ID NO: 144140 - RNA, 60 nt, Human
gccacuguggaccgggacccuugggggaagccugcccaugucgggcugugggaggcugau

SEQ ID NO: 144141 - RNA, 60 nt, Human
gccugcccguaaacacgccugcaaacgcugccugcccacacagguucacgugcagcucaa

SEQ ID NO: 144142 - RNA, 60 nt, Human
cgcaauguggcauuggggggccgggcagguccugcccauguguccccucacucugucagc

SEQ ID NO: 144143 - RNA, 60 nt, Human
aguccacccugccugccgucugugcuuccuccugcccagaacgcccgcuccagcgaucuc

SEQ ID NO: 144144 - RNA, 60 nt, Human
cagauuccuaagcagcuggccugaccucuuccugcccagcccccaacccagucucuggcc

SEQ ID NO: 144145 - RNA, 60 nt, Human
ugggaaguagagauguggcggcuuucccacccugcccacagcaggcccuccugcccagcu

SEQ ID NO: 144146 - RNA, 60 nt, Human
ggcuuucccacccugcccacagcaggcccuccugcccagcugcucuugucagcccucugg

SEQ ID NO: 144147 - RNA, 60 nt, Human
uguauacuguuaacgauugucugcccauguccugcccaaaauaccaugauucuuuaugga

SEQ ID NO: 144148 - RNA, 60 nt, Human
guuauucuaucaacuuuuaaagguuuuaaaccugcccagaaauuaccuugguaucugaag

SEQ ID NO: 144149 - RNA, 60 nt, Human
ccucuggggugagagcagcuuccgauaggaccugcccagauuucugcaugugcacuuuug

SEQ ID NO: 144150 - RNA, 60 nt, Human
ggggcauugagaauggaggcucccagggucccugcccacuucuguuuuccuaauguuuuu

SEQ ID NO: 144151 - RNA, 60 nt, Human
ccucaugagguuagggucccccacccuccaccugcccagaggccaacucuguucccuucu

SEQ ID NO: 144152 - RNA, 60 nt, Human
gaccugaugaggaggauguuagaauuugacccugcccagcgcaucacacuggccgaggcc

SEQ ID NO: 144153 - RNA, 60 nt, Human
ugcccagagugaccaagcagcaccagcaggccugcccaggaugcugaaagcagauuucuu

SEQ ID NO: 144154 - RNA, 60 nt, Human
uugccccacuggugagaggaggaccuugugccugcccagagccugcaggacagcacgccu

SEQ ID NO: 144155 - RNA, 60 nt, Human
ugcugcuugcucagaaacaacccgugcaucccugcccauggauucugcaggaccuagaag

SEQ ID NO: 144156 - RNA, 60 nt, Human
cauggcccuuugcuugagggcuccccacucccugcccaccaauacccaggugaggaacag

SEQ ID NO: 144157 - RNA, 60 nt, Human
guccuucuccaucugggccaauuguccuucccugcccauucagaguucaauuugagccuc

SEQ ID NO: 144158 - RNA, 60 nt, Human
uuuuuucaauaugcaagcagcuuuuuauucccugcccaaacccuuaacugacaugggccu

SEQ ID NO: 144159 - RNA, 60 nt, Human
aaguccuuccagugccacauggagugaggcccugcccaugcuggggacuuuggggaggaa

SEQ ID NO: 144160 - RNA, 60 nt, Human
uuucggaccgaaggugacagccgucccaacccugcccagccugaugccaccuccucuguu

SEQ ID NO: 144161 - RNA, 60 nt, Human
augaguuuuaaaacuuuuaacccgcuucuaccugcccaacugugaccaacuaaaugacag

SEQ ID NO: 144162 - RNA, 60 nt, Human
ccugccugggggcuaugugcacuccagaccccugcccaggcucaggcccaugagguaugg

SEQ ID NO: 144163 - RNA, 60 nt, Human
gcagaggccaggaggggaccuggugugucaccugcccaccaccuggcucaucccucaggc

SEQ ID NO: 144164 - RNA, 60 nt, Human
ccagcccugagggcagggaaggucaacccaccugcccaucugugcugaggcauguuccug

SEQ ID NO: 144165 - RNA, 60 nt, Human
aaacaggaaaggagguuccagccccacccaccugcccaccccgccccaggcaccaucagg

SEQ ID NO: 144166 - RNA, 54 nt, Human; identical to SEQ ID NO: 13674

SEQ ID NO: 144167 - RNA, 60 nt, Human
ggggccuccggagcugggcuuugggccucuccugcccaccucuacuucucugugaagccg

SEQ ID NO: 144168 - RNA, 60 nt, Human
cccgccuggugccuucuggccuguggccucccugcccauguucaccuggcugcugugggu

SEQ ID NO: 144169 - RNA, 58 nt, Human; identical to SEQ ID NO: 13677

SEQ ID NO: 144170 - RNA, 60 nt, Human
agccccucugcacggucaccaucgccugggccugcccacagcacuggugcucaccucuac

SEQ ID NO: 144171 - RNA, 60 nt, Human
ugacgccugcaccgggcccuccagcccuccccugcccagauagcugguggugggcgcuaa

SEQ ID NO: 144172 - RNA, 60 nt, Human
cuauccugucuguccccaccccagcuguccccugcccagggagcuggcauaaaagcacga

SEQ ID NO: 144173 - RNA, 60 nt, Human
gcugcuugagaacagagacugcuaccccauccugcccaugcaggcaggcucuugccagcc

SEQ ID NO: 144174 - RNA, 60 nt, Human
agagggcagacgccacccuggacugcucucccugcccagcugggccucucuggccuauuc

SEQ ID NO: 144175 - RNA, 60 nt, Human
ggcugccccuugacauucaggauguagcuuccugcccaccgcauacccuggcgccucacu

SEQ ID NO: 144176 - RNA, 60 nt, Human
caagcugcuccucucucuguggccccggccccugcccaggugugggugguucuggccagg

SEQ ID NO: 144177 - RNA, 60 nt, Human
cgcacaugcucaggcagcuaagggaggacgccugcccacgccugggacagaaggcuucac

SEQ ID NO: 144178 - RNA, 60 nt, Human
agccgacggcagcgccuugcccagaccuccccugcccaccugcuggagcccagccugugc

SEQ ID NO: 144179 - RNA, 60 nt, Human
ugaccuggguagucagacaccacuugagccccugcccacaucugcugguuuggggcuuca

SEQ ID NO: 144180 - RNA, 60 nt, Human
gguggccuggcaggucugggcccuucucucccugcccagguugucccuggagggcagccc

SEQ ID NO: 144181 - RNA, 60 nt, Human
ccuguccccgggacugagcugccaugccagccugcccacagcagccuccuagaguuagca

SEQ ID NO: 144182 - RNA, 60 nt, Human
aguagugacacucaggauccaaaagcuagcccugcccaccccagccccuggaccugcuua

SEQ ID NO: 144183 - RNA, 60 nt, Human
cccucccaacccuggaguugucagggagggccugcccaucaccucccucuccccaacauc

SEQ ID NO: 144184 - RNA, 60 nt, Human
gagcucgccugcccugcuuggcucugaggaccugcccagcgcucaaagggaacggaagcc

SEQ ID NO: 144185 - RNA, 60 nt, Human
acuugcccuagcaugaggcucugagagccaccugcccaccaaucuggugaggauaauggu

SEQ ID NO: 144186 - RNA, 60 nt, Human
agaggagccuguuggcaagagcugguauucccugcccagccgaccaaaugaccucugcau

SEQ ID NO: 144187 - RNA, 60 nt, Human
agagggagugacagaggcagccccauucugccugcccaggccccugccacccuggggaga

SEQ ID NO: 144188 - RNA, 60 nt, Human
auuuuauuuaugauucaaaugugacucgugccugcccaucccuguaauagauggaagguc

SEQ ID NO: 144189 - RNA, 60 nt, Human
gggggaaggauuauuauucauguuauuuucccugcccaagacuuuauuuaacccuggacu

SEQ ID NO: 144190 - RNA, 57 nt, Human; identical to SEQ ID NO: 13698

SEQ ID NO: 144191 - RNA, 60 nt, Human
cccuccauuccggaccccaugggcccagccccugcccaucuaguugguuuggggacccug

SEQ ID NO: 144192 - RNA, 60 nt, Human
cacccugugacugagccuguguccugucugccugcccagccaugcuccaucggcugugag

SEQ ID NO: 144193 - RNA, 60 nt, Human
gaagguagagaguuuuccuguucagauuacccugcccagcaggaacuggaauacaguguu

SEQ ID NO: 144194 - RNA, 60 nt, Human
cacuuccugcuggacucaggccuccagcucccugcccagcgagcggccucagccaccgcc

SEQ ID NO: 144195 - RNA, 60 nt, Human
ucuggaucuggguuccaucucugucuccagccugcccacuucccuucaugaauguugggu

SEQ ID NO: 144196 - RNA, 60 nt, Human
ugguccauagagagcaagacgcugugcugcccugcccaccuggccucugcacuccccugc

SEQ ID NO: 144197 - RNA, 60 nt, Human
ucguccagccgcaucuaggccuccagcccaccugcccaugugaugaagcagagauucggc

SEQ ID NO: 144198 - RNA, 60 nt, Human
aggcacaccuugcagaaggcaaggcccugcccugcccaaccucuguggucacccaugcau

SEQ ID NO: 144199 - RNA, 60 nt, Human
cugcaaaccacuguaccugccucagucaggccugcccacuaugggcagaccucucgcuca

SEQ ID NO: 144200 - RNA, 60 nt, Human
gccccgguggguuugucugcacuuggugcuccugcccacaccagccacuuuggugacaau

SEQ ID NO: 144201 - RNA, 60 nt, Human
gaacaccugaggacaggaguuugagaccagccugcccaacguggugaaaccccaucucua

SEQ ID NO: 144202 - RNA, 60 nt, Human
ccuccuggaaugggggaaccuuccuuauccccugcccacauccccucuccaauaaagcac

SEQ ID NO: 144203 - RNA, 60 nt, Human
ggagugaucacugcacgcccaucgugcacaccugcccaucgugcacacccacccauggug

SEQ ID NO: 144204 - RNA, 60 nt, Human
guauugggauuacagacaugagccacugcaccugcccagcuccccaacucccugccauuu

SEQ ID NO: 144205 - RNA, 60 nt, Human
gggggcuguccugagcccccugcacccaccccugcccaggcagucuuugcucaguggauc

SEQ ID NO: 144206 - RNA, 60 nt, Human
uggcagccgccaggcgagcaggcugcuuucccugcccagucaugcaccucccccucuggg

SEQ ID NO: 144207 - RNA, 60 nt, Human
cuggcaaucagggccgcaguguguucugcgccugcccagagcugacuccugauuuaaccg

SEQ ID NO: 144208 - RNA, 60 nt, Human
cugcacuuggaaggauauauuaugccuaacccugcccaacaaauuaagguuugugccuaa

SEQ ID NO: 144209 - RNA, 60 nt, Human
uuguaccaagccaacggcguuccuggcucuccugcccacaggaugaacauuuucggcuuc

SEQ ID NO: 144210 - RNA, 60 nt, Human
guggauccuugccaggcgucccugauccucccugcccaagucuuccuucgugagcuggcc

SEQ ID NO: 144211 - RNA, 60 nt, Human
gcacagccucccucccuccagcaagcccucccugcccagaaggaauggguccaggugugg

SEQ ID NO: 144212 - RNA, 60 nt, Human
gugggacugaugcgggaucccgagggccuuccugcccacaugccccgggagaaaccgagg

SEQ ID NO: 144213 - RNA, 60 nt, Human
ugacgccugcaccgggcccuccggcccuccccugcccaggcagcugguggugggcgcuaa

SEQ ID NO: 144214 - RNA, 58 nt, Human; identical to SEQ ID NO: 13722

SEQ ID NO: 144215 - RNA, 60 nt, Human
cuggggacagguccucaguguccucaggggccugcccagugcacuugcuggaagacgcaa

SEQ ID NO: 144216 - RNA, 60 nt, Human
auguuaaugauuuuuauagguauuuguaacccugcccacauaucuuauuuauuccuccaa

SEQ ID NO: 144217 - RNA, 60 nt, Human
aaauuaaacaaaaccccagguuauuucuucccugcccagagccagccugggauugucagc

SEQ ID NO: 144218 - RNA, 60 nt, Human
aagcccacaagaucugagugaaaaaagucaccugcccaauaaagcuugacaagacacucg

SEQ ID NO: 144219 - RNA, 60 nt, Human
agcccccagcuggaaguuaagagaaagucaccugcccaagaaacaccgagugaggccaua

SEQ ID NO: 144220 - RNA, 60 nt, Human
acuggaacucuggaaagaggggcuccccgaccugcccaucccccaggcucuucugggccu

SEQ ID NO: 144221 - RNA, 60 nt, Human
cuccagcccuccccugcccccagcccguccccugcccagggcacagcggagccauggggg

SEQ ID NO: 144222 - RNA, 60 nt, Human
cuccuuaacuuuguacuagacuggccugggccugcccagcucagcguuaucagucuguuu

SEQ ID NO: 144223 - RNA, 60 nt, Human
accuguuucuggaagacugcucccggcccgccugcccagacugaugagcacaucucucug

SEQ ID NO: 144224 - RNA, 60 nt, Human
gagggccagggacccaggugugccugugcuccugcccaggagcagcuuuuggucuccuug

SEQ ID NO: 144225 - RNA, 60 nt, Human
agucgagccgggaggaacccaggcugcugcccugcccagcccgacccugccccggcccca

SEQ ID NO: 144226 - RNA, 60 nt, Human
cugcagacgcagggggacugcacaauuccaccugcccaggaccugacccuggcgugugcu

SEQ ID NO: 144227 - RNA, 60 nt, Human
ggauggcucuggccucgguccucccccaacccugcccaagccagacagacagcaccugca

SEQ ID NO: 144228 - RNA, 60 nt, Human
uaucagacgugcucccucccauccuccagcccugcccacccucccuccacuccucucaac

SEQ ID NO: 144229 - RNA, 60 nt, Human
gacccugaccguguacauagcccuggugcuccugcccagccaccccucagaugcguucgc

SEQ ID NO: 144230 - RNA, 60 nt, Human
ccucuucaguccugcccuccccuccucaguccugcccaccccgugcagcccaugcugagg

SEQ ID NO: 144231 - RNA, 60 nt, Human
ggaagcucgggaaggggaagggagacuggcccugcccagccggucucuagccccucagcc

SEQ ID NO: 144232 - RNA, 60 nt, Human
ggccccgcagcccuucugcacccagcacagccugcccagcccagcccugcccccgggcac

SEQ ID NO: 144233 - RNA, 60 nt, Human
gcaggcugcaugcaguggcggcuacugggcccugcccagccccggaacucugcgcgauau

SEQ ID NO: 144234 - RNA, 60 nt, Human
cucagccacagcaccccuuauuccagcugcccugcccaaccugcucaccccacaugaccu

SEQ ID NO: 144235 - RNA, 60 nt, Human
ucccccuguauucccccucccagggcagccccugcccagcacaaaaccccaggacccugg

SEQ ID NO: 144236 - RNA, 60 nt, Human
gguggcacaugcuuggccacacaucuacucccugcccacaccaucuaugcucuugguugg

SEQ ID NO: 144237 - RNA, 60 nt, Human
ugguaccaauccaccaggcagcucagggcuccugcccagcccagcagcuucuguugucua

SEQ ID NO: 144238 - RNA, 60 nt, Human
cuggccuggcccuguugagucugcacagucccugcccagcugugucuucuguuggaagaa

SEQ ID NO: 144239 - RNA, 60 nt, Human
agccuuaggacccugggaccaagggcagacccugcccaaggaugcaggccuaagccgggc

SEQ ID NO: 144240 - RNA, 60 nt, Human
ugggcaauucucaccuucaaagaguccccgccugcccaggccuuuggcacagaggcugag

SEQ ID NO: 144241 - RNA, 60 nt, Human
cugccccucuguucucuccccucacauccuccugcccagcuccucacauacccacacauu

SEQ ID NO: 144242 - RNA, 60 nt, Human
gcguuccuucgcacacugugauuuugcccuccugcccacgcagaccugcagcgggcaaag

SEQ ID NO: 144243 - RNA, 60 nt, Human
gcacuggggagucuuuguggauucugaggcccugcccaaugagacucuaggguccagugg

SEQ ID NO: 144244 - RNA, 60 nt, Human
cagcuggucacccaugauaaccaacuuccaccugcccaaccauauaucacccccuacccc

SEQ ID NO: 144245 - RNA, 60 nt, Human
ggggacaggcucuuucccccuuggggguccccugcccagggcacuguccccauuuuccca

SEQ ID NO: 144246 - RNA, 60 nt, Human
cuuggcugcugcuuaccccuagccuugaugccugcccagggacccccagcccccucccgu

SEQ ID NO: 144247 - RNA, 60 nt, Human
gguuggcuucuucccaggccuugcaugggcccugcccacaagcacacccucaggccgagg

SEQ ID NO: 144248 - RNA, 60 nt, Human
cagugggguuugaagcagaguucagggaacccugcccaagguccuccuguucagacauuc

SEQ ID NO: 144249 - RNA, 60 nt, Human
ccuuuuccaagauaugcaauggccuuugugccugcccaaaggcuucgcccccuccagugc

SEQ ID NO: 144250 - RNA, 60 nt, Human
gacaggcaaagacugcaguauccauaacccccugcccacguccccacccacgggggagac

SEQ ID NO: 144251 - RNA, 60 nt, Human
gacugggccgggcccagggccucuggcuucccugcccaauccucccuggagaagggacau

SEQ ID NO: 144252 - RNA, 60 nt, Human
accacuagcuaagcaagccaggagaagaccccugcccaaguggcucuugggacaacgugc

SEQ ID NO: 144253 - RNA, 60 nt, Human
cagguguggaccggccgcagcccccacugaccugcccauguccagagggacuggacagcc

SEQ ID NO: 144254 - RNA, 60 nt, Human
uuggcccuuccccucaccacgagcucccggccugcccagacuguggacacuggccgugcc

SEQ ID NO: 144255 - RNA, 60 nt, Human
aaccucucugugacacccuccguguucuugccugcccaucuucuccgcuuuugggaugaa

SEQ ID NO: 144256 - RNA, 60 nt, Human
ugucuccagacccccaccccuuccccacugccugcccacccguggagaugggaugcuugc

SEQ ID NO: 144257 - RNA, 60 nt, Human
cagaggccaggccagggcuggaaggacaggccugcccaugcaggagaccaucuggacacc

SEQ ID NO: 144258 - RNA, 60 nt, Human
ggaggagcgcuacccaccuccagggagcacccugcccaccaagaagcacugggugaccag

SEQ ID NO: 144259 - RNA, 60 nt, Human
cugaucaggccccaucucaagguuggcacuccugcccaucacccuuagaaggaucuuuuc

SEQ ID NO: 144260 - RNA, 60 nt, Human
uguuuaucauguuacaauuuaauauuccauccugcccaacccuuccucucccauccucaa

SEQ ID NO: 144261 - RNA, 60 nt, Human
cccgagcucaucgaccugagggggcccaucccugcccaccuccuggguaaaggcccugcu

SEQ ID NO: 144262 - RNA, 60 nt, Human
aagagccuaggagacaaaagggccagucccccugcccagaauggagcagcagcaggacag

SEQ ID NO: 144263 - RNA, 60 nt, Human
ggugggaaaaaaaaaaguguggcauagcuaccugcccauccccaacccucagcaaaguag

SEQ ID NO: 144264 - RNA, 60 nt, Human
acugggcagcacggggaggguuuggcuaccccugcccaucccugagccagguaccaccau

SEQ ID NO: 144265 - RNA, 60 nt, Human
uugggauggacccucagccccaugguacgcccugcccaguuuccaguugcccuguccacu

SEQ ID NO: 144266 - RNA, 57 nt, Human; identical to SEQ ID NO: 13774

SEQ ID NO: 144267 - RNA, 60 nt, Human
ucagaguggcgugagcugcccggcgccugcccugcccaagugaccagggaagugugugug

SEQ ID NO: 144268 - RNA, 60 nt, Human
guggccagcgccagggcccaggccauguggccugcccagccucaaugucacuugguggcg

SEQ ID NO: 144269 - RNA, 60 nt, Human
aggguugcggugucuccacggugcucucgcccugcccauggccaccccagacucugaucu

SEQ ID NO: 144270 - RNA, 60 nt, Human
gccaacaacucccuacguccuguguggggcccugcccaaguggaugaggcauuccuugag

SEQ ID NO: 144271 - RNA, 60 nt, Human
guuggcaacacacgcauccgcaucggccucccugcccacaaagcgccacaacggugacca

SEQ ID NO: 144272 - RNA, 60 nt, Human
ugucuuucugucuguuuaccugucucccugccugcccaucugcaucuuuugcagcccacu

SEQ ID NO: 144273 - RNA, 60 nt, Human
accccgaagcccaccugcaaucucccaccuccugcccaucccucucuugagggagcagca

SEQ ID NO: 144274 - RNA, 60 nt, Human
uaauuccagcccccugucgccuguccagggccugcccacccguuggaggccgguggagaa

SEQ ID NO: 144275 - RNA, 60 nt, Human
ucuccaugucacuccauagcugcaacgccuccugcccagccgguuuccauggaaacaacu

SEQ ID NO: 144276 - RNA, 60 nt, Human
cagccucguggagcucgccccuccccucagccugcccaccucucccugcauccugaggcc

SEQ ID NO: 144277 - RNA, 60 nt, Human
ugcucugucagcagccuggccuggucugugccugcccagcauguucccaaaucugugcug

SEQ ID NO: 144278 - RNA, 60 nt, Human
agugggggagauggcagacgcuuucugggaccugcccaagauauguauucucugacacuc

SEQ ID NO: 144279 - RNA, 60 nt, Human
agaggccugaagcggaagcaccacaucgucccugcccaucucacucucucccuugaugau

SEQ ID NO: 144280 - RNA, 60 nt, Human
gccacaggcauaugguggagagggggguacccugcccaccuuggggugguggcaccagag

SEQ ID NO: 144281 - RNA, 60 nt, Human
agcacaccucuggcuaacccauaccccacaccugcccagcucuggcuucucuguugagga

SEQ ID NO: 144282 - RNA, 60 nt, Human
cccccacuguaagcccccgcacccccacccccugcccagagcaacagccuaaaggccugc

SEQ ID NO: 144283 - RNA, 60 nt, Human
aaugugccaugaucagggauaugagcagggccugcccagagccugggcaccuuugggaga

SEQ ID NO: 144284 - RNA, 60 nt, Human
ucacacguaggggcuagagccagccugcauccugcccaccgggcuccacuuggagaucag

SEQ ID NO: 144285 - RNA, 60 nt, Human
uacaguuaugugauaaaggaaaaauucuuuccugcccaggaccugcgccauccuuuaggc

SEQ ID NO: 144286 - RNA, 60 nt, Human
cuagaucaggcagggauccauucccuguccccugcccacuaccuucaggccauuuagagu

SEQ ID NO: 144287 - RNA, 60 nt, Human
aguucuugugucguuugugaaaguucuuaaccugcccaaaaacccccuuuuccccaagcu

SEQ ID NO: 144288 - RNA, 60 nt, Human
gaauuuauuugcugcuucucccagccuuccccugcccacaccaccugcgcaugccuggca

SEQ ID NO: 144289 - RNA, 60 nt, Human
ucaauaaguacugagagugcagccccuuccccugcccaggguggcaggggagggguaggg

SEQ ID NO: 144290 - RNA, 60 nt, Human
caaggacccucugaccccaucgaccugggcccugcccacacaacagucugagcaagagac

SEQ ID NO: 144291 - RNA, 60 nt, Human
uucgcgauacuagagccucuguaaacuucuccugcccagccccagcugagcauccccaga

SEQ ID NO: 144292 - RNA, 60 nt, Human
ggacacagaucccacuggaagauccccucuccugcccaagcacuucacagcuggacccug

SEQ ID NO: 144293 - RNA, 60 nt, Human
ccuagaacugagcugccucuaccacagccuccugcccaccagcuggccucaccuccugaa

SEQ ID NO: 144294 - RNA, 60 nt, Human
ccguguccuucugauacaguugaucagaccccugcccaccgcccaggccaggccuguggu

SEQ ID NO: 144295 - RNA, 60 nt, Human
ugggaaggucucugaucacacagaagcagcccugcccagccuggucauuugcuguccgcu

SEQ ID NO: 144296 - RNA, 60 nt, Human
gcagggaagugaaaggucccaggcacacacccugcccauugcagguggcucuuacagcuc

SEQ ID NO: 144297 - RNA, 60 nt, Human
guggggacguccugccaccuggggcagucaccugcccagaucccagaaggaccuccugag

SEQ ID NO: 144298 - RNA, 60 nt, Human
aaauuggcucacuauugcuuuguaguaaccccugcccagguauuuuuucacuugugaaaa

SEQ ID NO: 144299 - RNA, 60 nt, Human
cccugccuggagccuccaaaagaaaccagcccugcccacgccuugacuugagcccauuga

SEQ ID NO: 144300 - RNA, 60 nt, Human
gccaagggaaugccucuugccacccaccauccugcccaggcccugagaggcuggaggagg

SEQ ID NO: 144301 - RNA, 60 nt, Human
caccuaggccucauuccuuaccccccagccccugcccaccuucagcaggaugaggcccug

SEQ ID NO: 144302 - RNA, 60 nt, Human
uaagugagaaagagagcaggcucgggaggcccugcccaggguaggaggagcuuccugcuu

SEQ ID NO: 144303 - RNA, 60 nt, Human
cauaauccagugggggugacugggugcacaccugcccaggugaacacagcggcugccagu

SEQ ID NO: 144304 - RNA, 60 nt, Human
cauugguuauaauaacaguuaucaguaauuccugcccagaagacuuuuauuuauuuuuuu

SEQ ID NO: 144305 - RNA, 60 nt, Human
acaucuggagauacaggcccaccccucaguccugcccacagagaggcuuggucggucucc

SEQ ID NO: 144306 - RNA, 60 nt, Human
aggcccugcugaaguccagacccucccccuccugcccacugugcucuaaacccugcucag

SEQ ID NO: 144307 - RNA, 60 nt, Human
uacccugauacggccuggccaucgaggacaccugcccauccggccucugugucaagaggu

SEQ ID NO: 144308 - RNA, 60 nt, Human
uuugacaaacagcagcuggcagcgcugccuccugcccacauuccugccacccgacaucaa

SEQ ID NO: 144309 - RNA, 60 nt, Human
ggacaaugaugccuccuccgggaagccuucccugcccagcccacgccgccaccgggagga

SEQ ID NO: 144310 - RNA, 60 nt, Human
agagaaaguuuccuauucucuuccauuuccccugcccaaagugcugacauaggcagugau

SEQ ID NO: 144311 - RNA, 60 nt, Human
ucuggccacagacaggggcugccuguggagccugcccaccggcccccggcagugcagucc

SEQ ID NO: 144312 - RNA, 60 nt, Human
uacacaugcaucagugucugccugccuccaccugcccagccuguucuucuucuucuucuu

SEQ ID NO: 144313 - RNA, 60 nt, Human
uccuuccucacaccagauuguucccaggggccugcccaccccagugccauccaguggcac

SEQ ID NO: 144314 - RNA, 60 nt, Human
uaucaacuagccagugacucgcucaucugcccugcccaggcccacguuuugaaguuggag

SEQ ID NO: 144315 - RNA, 60 nt, Human
aucaguggaucaggaaugcaauugugaauuccugcccauugccucucuuggugaaugugg

SEQ ID NO: 144316 - RNA, 60 nt, Human
agacacccaccagcccggccccucccggcgccugcccacccuccacccacagccucacgg

SEQ ID NO: 144317 - RNA, 60 nt, Human
cacagggcuguguggauggaggaagcugucccugcccagugcaucccccaggucaucacg

SEQ ID NO: 144318 - RNA, 60 nt, Human
gcuccacaaguguguggccccgcccgagccccugcccacgcccuuggagccuuccaccgg

SEQ ID NO: 144319 - RNA, 60 nt, Human
gggacccucacugccuccgucuguucaucaccugcccaccggagccgcaugcucuuccug

SEQ ID NO: 144320 - RNA, 50 nt, Human; identical to SEQ ID NO: 13828

SEQ ID NO: 144321 - RNA, 60 nt, Human
uguggaggccauccuggaaggaaguuuagaccugcccagguguggagcgaggggcacagg

SEQ ID NO: 144322 - RNA, 60 nt, Human
ucaggacuccaaggagacggugcagggcugccugcccaucuagguccccucuccugcauc

SEQ ID NO: 144323 - RNA, 60 nt, Human
guggcgugaacaucugccuggagucccgucccugcccagaacccuuccugagaccucgcc

SEQ ID NO: 144324 - RNA, 60 nt, Human
gcugcauucccuggagacucacugcaaguuccugcccaggaggcugagggcaccccaucc

SEQ ID NO: 144325 - RNA, 60 nt, Human
gucguacacggagacuggcagcgccgacguccugcccaccacgcacucccggagagcacg

SEQ ID NO: 144326 - RNA, 60 nt, Human
uccauggcucuggucacccugacccucugcccugcccaccgcaggucccccggggucccg

SEQ ID NO: 144327 - RNA, 60 nt, Human
augggcucaagguuccugagacacccgauuccugcccaaacagcuguauuuauauaaguc

SEQ ID NO: 144328 - RNA, 60 nt, Human
uaaggugguucuuuccuugaagggcagccuccugcccaggccccguggcccuggagccuc

SEQ ID NO: 144329 - RNA, 60 nt, Human
augccaccacuugugucuccacaaugugcuccugcccacccggguuccgcacuguccgac

SEQ ID NO: 144330 - RNA, 60 nt, Human
cgcccuccuccacuuggaaacgguauccucccugcccauccgucugucugucgcccuucu

SEQ ID NO: 144331 - RNA, 60 nt, Human
gaggcaaugaacccucucccccaccucuucccugcccaaaucugucuccuagaaucuuau

SEQ ID NO: 144332 - RNA, 52 nt, Human; identical to SEQ ID NO: 13840

SEQ ID NO: 144333 - RNA, 60 nt, Human
acauacgaggacccucagaccggaggaacaccugcccaaccccaacacgugcuuauguaa

SEQ ID NO: 144334 - RNA, 60 nt, Human
uccagcugcccacucaugggcccuucaccaccugcccaggaucucacccaguacugacag

SEQ ID NO: 144335 - RNA, 60 nt, Human
cagccuccugaguagcugggacuacaggccccugcccagcuaauuuuuuguauuuuuuuu

SEQ ID NO: 144336 - RNA, 60 nt, Human
gagaggggccccucucuccucuauguacccccugcccaccucgggccuaccucagcccuc

SEQ ID NO: 144337 - RNA, 60 nt, Human
cccaggucgaucaaguggcuuuuccugggaccugcccagcuuugagaaucucuucucauc

SEQ ID NO: 144338 - RNA, 60 nt, Human
uguccagaauggggacguggggcagccaccccugcccagcgagagcgcagacaccgugug

SEQ ID NO: 144339 - RNA, 60 nt, Human
gaagcagcacgugugagcugggccaggagcccugcccaccuccgugcagcugaccugccc

SEQ ID NO: 144340 - RNA, 60 nt, Human
augcugauacacacuguuguuaggccugcaccugcccauccagaaagcagcagcugccuu

SEQ ID NO: 144341 - RNA, 60 nt, Human
cuccggcucacacacgcccugccugcccucccugcccagcuguaaggaccgggggucucc

SEQ ID NO: 144342 - RNA, 60 nt, Human
auaaacagacccccuucugcuccgcuuccuccugcccagccaggcaacacccucaaccgg

SEQ ID NO: 144343 - RNA, 60 nt, Human
uccucuccaucugcuguguuuggacgcguuccugcccagccccuugcugucauccccucc

SEQ ID NO: 144344 - RNA, 60 nt, Human
ugcggggagaggcugcucccuccccuuuuuccugcccagucgcggggcccaagucuuccu

SEQ ID NO: 144345 - RNA, 60 nt, Human
agccccaguccagguccaggaggcucccucccugcccagcgagucuuccagaagggguga

SEQ ID NO: 144346 - RNA, 60 nt, Human
auggccccaugcagccccaggggcuuccccccugcccauggaguagagcccgagauccug

SEQ ID NO: 144347 - RNA, 60 nt, Human
ccccuucuagcggggccgguaccccgccucccugcccaucccaccacccggccuuucccu

SEQ ID NO: 144348 - RNA, 60 nt, Human
ccccccaaggggccccauugccaaagcaugccugcccacccucgcugugccuuagucagu

SEQ ID NO: 144349 - RNA, 60 nt, Human
acccacccccuucccccgcaugcugaucccccugcccaggugagggcccugcccuggaag

SEQ ID NO: 144350 - RNA, 60 nt, Human
uuagcccacaauucuccauuucacuugaccccugcccaccucuccaaccuaacuggcuua

SEQ ID NO: 144351 - RNA, 60 nt, Human
caaaugcugagcccugauccaaaguugucuccugcccaugagcaccacagucaggccuug

SEQ ID NO: 144352 - RNA, 60 nt, Human; identical to SEQ ID NO: 144350

SEQ ID NO: 144353 - RNA, 60 nt, Human
uuaacccacaguucuccauuucacuugaccccugcccaccucuccaaccuaacuggcuua

SEQ ID NO: 144354 - RNA, 60 nt, Human
uuagcccacaauucucuauuucacuugaccccugcccaccucuccaaccuaacuggcuua

SEQ ID NO: 144355 - RNA, 60 nt, Human
uuagcccacaguucuccauuucacuugaccccugcccaccucuccaaccuaacuggcuua

SEQ ID NO: 144356 - RNA, 60 nt, Human; identical to SEQ ID NO: 144350

SEQ ID NO: 144357 - RNA, 60 nt, Human
uuagcccacaaguaucuauuucacuugaccccugcccaccucuccaaccuaacuggcuua

SEQ ID NO: 144358 - RNA, 60 nt, Human
agcauguguagcuauguuguacucucuaaaccugcccagggaccuuaccagauucguguc

SEQ ID NO: 144359 - RNA, 60 nt, Human
gguaugugggaacugcauaguauuuuucgaccugcccaggucucuugcuagacuucugug

SEQ ID NO: 144360 - RNA, 60 nt, Human
uccugucguaaucaguggugcugcuugacaccugcccagcauguuccugucucuccuuuu

SEQ ID NO: 144361 - RNA, 60 nt, Human
ccagggcccacggacccgcagcucagggcgccugcccacgucgucugccggcggugcgcc

SEQ ID NO: 144362 - RNA, 60 nt, Human
guggucagcgugcagcgggacgggacuggcccugcccagccaugaaucgcuuggccaugc

SEQ ID NO: 144363 - RNA, 60 nt, Human
cacgcauccaucuccaaguuaacagcccguccugcccaaguucuggggcagguaggagag

SEQ ID NO: 144364 - RNA, 60 nt, Human
cacacccugauagcacaaucuccuuggggcccugcccaccuccaggccucucccaccuca

SEQ ID NO: 144365 - RNA, 60 nt, Human
accgaggccaccgccccccccuccgcugccccugcccaccccgaggcagggcuggggcuu

SEQ ID NO: 144366 - RNA, 60 nt, Human
accaguccucccagggaguccucgagucgcccugcccagagcccuggcaccagagacgcc

SEQ ID NO: 144367 - RNA, 60 nt, Human
acaaacaaaccaaccagagggagaagagccccugcccacugcacucuuugguucucugcu

SEQ ID NO: 144368 - RNA, 60 nt, Human
guggccgggcucccugcgucccgcuggugaccugcccaccgucccuguccaugccccgcc

SEQ ID NO: 144369 - RNA, 51 nt, Human; identical to SEQ ID NO: 13877

SEQ ID NO: 144370 - RNA, 60 nt, Human
gccuuuguggggagcagccagcccucugccccugcccagggcuccccaacuauaggccug

SEQ ID NO: 144371 - RNA, 60 nt, Human
gccuaaaaguccaguccuuuggccuccaguccugcccaggcccugggucaccaggucacu

SEQ ID NO: 144372 - RNA, 60 nt, Human
cgcuuguugaagaugaauucuugaauucugccugcccacccccggccagaucccuggagc

SEQ ID NO: 144373 - RNA, 60 nt, Human
ugcugcaggcauggcugucuccugccccugccugcccaucuggccuauaccccagccgug

SEQ ID NO: 144374 - RNA, 60 nt, Human
ggggaagaaacacuuucucuucuuguuucuccugcccacugcugcaguaggggaggagca

SEQ ID NO: 144375 - RNA, 60 nt, Human
ggccccuggugaaaugacgccccucccccaccugcccauggccugggacucucugcgaug

SEQ ID NO: 144376 - RNA, 60 nt, Human
ugcuccgcgugcuauagcuuuuggggcggcccugcccaguccccgugcccacggggcucc

SEQ ID NO: 144377 - RNA, 60 nt, Human
gcugaggcacacagagaggccaacuuccucccugcccagccuuccuuguaucucuccaga

SEQ ID NO: 144378 - RNA, 60 nt, Human
aagaccugcuggacuagugguccuugcuggccugcccaggaggcauggauacucaggaag

SEQ ID NO: 144379 - RNA, 60 nt, Human
guagcccacggcaccccaaacuuggagggaccugcccacuccccucccccauucccaagg

SEQ ID NO: 144380 - RNA, 60 nt, Human
ucaccgggcaccacugauggugauuccaccccugcccaucacugggggcugcgcuagcug

SEQ ID NO: 144381 - RNA, 60 nt, Human
cugccggccucccgggccagcugccccaccccugcccaugccuguccugcacggcucugc

SEQ ID NO: 144382 - RNA, 60 nt, Human
cuugcccacacaucuccagccagccagggcccugcccagcuucaauuuacagaccugacu

SEQ ID NO: 144383 - RNA, 53 nt, Human; identical to SEQ ID NO: 13891

SEQ ID NO: 144384 - RNA, 60 nt, Human
ccaucaucacaucccccagcaagccagccaccugcccagccgggccugggaugggccacc

SEQ ID NO: 144385 - RNA, 60 nt, Human
agcaaugaacuguucuagggaaaguggcuuccugcccaaacuggaugggacacgugggga

SEQ ID NO: 144386 - RNA, 60 nt, Human
gccaucugcauuuucuuacuguugauguuuccugcccaaaggacacauuugggcagugcc

SEQ ID NO: 144387 - RNA, 60 nt, Human
cucucaccuagaccuugccuccccuccucuccugcccagcucugacccugaugcuuaaua

SEQ ID NO: 144388 - RNA, 60 nt, Human
ggugcacugaggagaugaaggccgggacccccugcccaaccuguauggcgggucuguacu

SEQ ID NO: 144389 - RNA, 60 nt, Human
gguaugugugaacugcauugcaccuuuugcccugcccagggcccaugucagauuuauguc

SEQ ID NO: 144390 - RNA, 60 nt, Human
ggaacaaacggucccagaguccuccggaccccugcccagggucucugcaggucucugccc

SEQ ID NO: 144391 - RNA, 60 nt, Human
gaguuucuguagggcugaaugacucuuuuuccugcccagggcccauucuugcuucucagg

SEQ ID NO: 144392 - RNA, 60 nt, Human
ccuucugugaccccgcugugguaaguccagccugcccagggcugcugagggcugccucuu

SEQ ID NO: 144393 - RNA, 60 nt, Human
uggcucaggcuguaaaaguagcugagccauccugcccauuccuggagguccuacagguga

SEQ ID NO: 144394 - RNA, 60 nt, Human
uauagacguauccaaugggaaaacagcggaccugcccagagcagggaggugucguggaac

SEQ ID NO: 144395 - RNA, 60 nt, Human
caucgucucaacaccaccaaguuuguaggaccugcccaaguucuaguaguauucaaaacu

SEQ ID NO: 144396 - RNA, 60 nt, Human
cuugccugguuccauauggcuccuuccagcccugcccaccaagugcagcucccacuuucc

SEQ ID NO: 144397 - RNA, 60 nt, Human
ugcccaccaagugcagcucccacuuuccauccugcccauacgccccucuucccccgacau

SEQ ID NO: 144398 - RNA, 60 nt, Human
gagagggguggauuuggccccuguccuccuccugcccauucuuugucucuuccacauggg

SEQ ID NO: 144399 - RNA, 60 nt, Human
augacugucauacauccagaggagaccgaaccugcccagcugauguacuguuuuauggaa

SEQ ID NO: 144400 - RNA, 60 nt, Human
aagggccaagccccauguagccccagucauccugcccagcccugccuccuggccaugccg

SEQ ID NO: 144401 - RNA, 60 nt, Human
cagagcuucagugagguuuccgagccucucccugcccauccucaccacugaggccacgac

SEQ ID NO: 144402 - RNA, 60 nt, Human
accgcucuccaaggugugcuagcagugggcccugcccaacuucaggcagaacagggaggc

SEQ ID NO: 144403 - RNA, 60 nt, Human
accugcugcagccugcagagccacagucagccugcccacaugccaccgagcaaacgcauc

SEQ ID NO: 144404 - RNA, 60 nt, Human
ucccagagaggcucggccuggaaacaguccccugcccagaguccccucagccuccaugac

SEQ ID NO: 144405 - RNA, 60 nt, Human
cgggccagauggccagcugucgagagcagcccugcccagauugcggugggggcugugcca

SEQ ID NO: 144406 - RNA, 60 nt, Human
ggccugggagucgggcggccccggucaggcccugcccagagagcuccugguuccugaacu

SEQ ID NO: 144407 - RNA, 60 nt, Human
acccacccgaggcucugcccaccgccuggaccugcccaccccugaaagacuggccccugg

SEQ ID NO: 144408 - RNA, 60 nt, Human
cuccccgcacacacccguccauaccagcucccugcccaugacccucgcucagggaucccc

SEQ ID NO: 144409 - RNA, 60 nt, Human
accuuucuuuaaauuagaauuacagaagccccugcccagugaacagauaacgauuggucu

SEQ ID NO: 144410 - RNA, 60 nt, Human
ugugacaggacugugauugugcuagauguaccugcccaagucugcuggucacauuuggca

SEQ ID NO: 144411 - RNA, 60 nt, Human
cucagaaaccagacucguucuucugggaacccugcccacucccaggaccaagauuggccu

SEQ ID NO: 144412 - RNA, 60 nt, Human
uuucagauucuugguccauggaugacaccaccugcccaugcuuccuugaauuaggcuuuc

SEQ ID NO: 144413 - RNA, 60 nt, Human
aaacagaauggauugccaguuacauguaugccugcccaguucccuuuuuauuugcagaag

SEQ ID NO: 144414 - RNA, 60 nt, Human
cauugaaucucgcacccagucuugcguaugccugcccaguuuucagccucuuaacgggag

SEQ ID NO: 144415 - RNA, 60 nt, Human
caaacagcucaugggcuuaguguccaaaccccugcccagccuucccuuuccaaguuggug

SEQ ID NO: 144416 - RNA, 60 nt, Human
cggaugagcagagccggcccugaggacaguccugcccauccacgcggagauguggcugcc

SEQ ID NO: 144417 - RNA, 60 nt, Human
gguaccgcggcccgcaugacuaggcguggaccugcccauggugccugucagcccgcagag

SEQ ID NO: 144418 - RNA, 60 nt, Human
gauccuggagagcugugaggauccauucagccugcccagcucuggcuggucagagacaag

SEQ ID NO: 144419 - RNA, 60 nt, Human
agcgcccucgcccagccccggcugcguuucccugcccaugacccucucguggggaccccc

SEQ ID NO: 144420 - RNA, 60 nt, Human
cuccaaacgccuccucucccaggucaucugccugcccacacgcuccuguuccaccuucac

SEQ ID NO: 144421 - RNA, 60 nt, Human
cuccaaacaucuccccucccaagacaucugccugcccacaggcuccuguugcuccuucac

SEQ ID NO: 144422 - RNA, 60 nt, Human
agguuccuggcgcccugagguggcucagcaccugcccaggguaggccuggcaugaggggu

SEQ ID NO: 144423 - RNA, 60 nt, Human
cagauggccugccuuuggcugagagggcuaccugcccagccccucccccaacaagaucuc

SEQ ID NO: 144424 - RNA, 59 nt, Human; identical to SEQ ID NO: 13932

SEQ ID NO: 144425 - RNA, 60 nt, Human
cgacacggucucggaucaggcucccaggagccugcccagcccccuggucuuugagcuccc

SEQ ID NO: 144426 - RNA, 60 nt, Human
uguggccccugaacaagaauuggaagcugcccugcccaugggagcugguuagaaaugcag

SEQ ID NO: 144427 - RNA, 60 nt, Human
aggagaaccacuacaugcagcccaugcccaccugcccaucacaggguugggcccagaucu

SEQ ID NO: 144428 - RNA, 60 nt, Human
ucuaguagccuggauuuaucauucucucugccugcccacccccuuuuuuguauagcccaa

SEQ ID NO: 144429 - RNA, 60 nt, Human
ggugagagaggaaagaccuacauucccucuccugcccagaugcccuuuggaaagccauug

SEQ ID NO: 144430 - RNA, 60 nt, Human
cccugguauguuuuucuuauagauguuagcccugcccaacagccagggcuacacuacaaa

SEQ ID NO: 144431 - RNA, 60 nt, Human
agacagcccagagccugccgcuacccucggccugcccaccaccaagcaagcagcaagcaa

SEQ ID NO: 144432 - RNA, 60 nt, Human
gauccucaucagcaaagcauuuggcuuuguccugcccaagugggcugcagacugagugcu

SEQ ID NO: 144433 - RNA, 60 nt, Human
ccaaggcuuccgcagccgcccguuccgggaccugcccagcguccucccugccuccuuccg

SEQ ID NO: 144434 - RNA, 60 nt, Human
cuguggguggaggccugacuccaggccucuccugcccacacccucugggcugaguuccuu

SEQ ID NO: 144435 - RNA, 60 nt, Human
cuuccucagucuggcugugggcaggagcggccugcccagugucacccagggugagugcaa

SEQ ID NO: 144436 - RNA, 60 nt, Human
guuuuguaccagucccugcucucaggccacccugcccaggacccaggcccgccucccccu

SEQ ID NO: 144437 - RNA, 60 nt, Human
gggccaagcgcuggccccucagcggugagcccugcccacucuuaccgagcaaggugggug

SEQ ID NO: 144438 - RNA, 60 nt, Human
cuuguacacauauacauaugaucaaauacuccugcccaugauccauucccuuuuguuauu

SEQ ID NO: 144439 - RNA, 60 nt, Human
gaauguucugaauugaccaaauuuaaugaaccugcccaaaguuagcuaccguuccauggu

SEQ ID NO: 144440 - RNA, 60 nt, Human
acacaccugcagccucccuccgcggcgggcccugcccacaccuccuggggcgcgugaggc

SEQ ID NO: 144441 - RNA, 60 nt, Human
gcaaguuguggagagaaggagcaccggguuccugcccagcacugugcuugcgggaggcgg

SEQ ID NO: 144442 - RNA, 60 nt, Human
gaggacagagugcccuggggcauccaccuuccugcccaggggacguggcgcugucggugu

SEQ ID NO: 144443 - RNA, 60 nt, Human
gccccuggcccugccucacugugaccugcuccugcccacgugcagcaccugucaccuuuu

SEQ ID NO: 144444 - RNA, 60 nt, Human
uagcgaagcuguggagacugcacauccggaccugcccaugucucaaaacaaacacaugua

SEQ ID NO: 144445 - RNA, 60 nt, Human
cuccucaguguaauccaccuauggguucuuccugcccacugcacagacaaaaccaauuca

SEQ ID NO: 144446 - RNA, 60 nt, Human
ucucucgaauuauauuuauagaugcaguguccugcccaguuuuguuugccuccuacauuu

SEQ ID NO: 144447 - RNA, 60 nt, Human
cugccauucugugcaggcugcaguggcuccccugcccagccugcucucccuaaccccuug

SEQ ID NO: 144448 - RNA, 60 nt, Human
cucugggagcucuccaguggcacugcuggaccugcccacguuucuguaaaaucaggauac

SEQ ID NO: 144449 - RNA, 60 nt, Human
agaauaaagggcgcccgcggucccccagcaccugcccaagccacaccccuagcuucccuc

SEQ ID NO: 144450 - RNA, 60 nt, Human
cgccugggccucuguuccuccaaagaccugccugcccaucugcauaggagaugaaggcug

SEQ ID NO: 144451 - RNA, 60 nt, Human
cugggagacuuuuccucccugccucagcucccugcccagccagccuccugucuccagaga

SEQ ID NO: 144452 - RNA, 60 nt, Human
gcgucuggacacccucagauccugucauugccugcccagaguccuucaggggcaccccuc

SEQ ID NO: 144453 - RNA, 60 nt, Human
cugcaggcccagaccacgugggacagaacuccugcccacccuaccccgagggaggcgaac

SEQ ID NO: 144454 - RNA, 60 nt, Human
cugggcgccgacaucugaggcccuguggcgccugcccauugugaagaaucgccgugccug

SEQ ID NO: 144455 - RNA, 60 nt, Human
ggcugcucucggacuccugaucucaggugaccugcccaccucggccucccgaagugcugg

SEQ ID NO: 144456 - RNA, 60 nt, Human
gcugggcauaagcuucacaggacgggagaaccugcccaugguggacugucguucuccaca

SEQ ID NO: 144457 - RNA, 60 nt, Human
auggaugccacuccccacacagcccccaggccugcccagcccaccuccucauggcauccu

SEQ ID NO: 144458 - RNA, 60 nt, Human
ucuccgagccccaggcagcggugauucagcccugcccaaccugauucugaugacugcgga

SEQ ID NO: 144459 - RNA, 60 nt, Human
gggcgccugcugagcacuuccgccccucacccugcccagccccugccaugagcucugggc

SEQ ID NO: 144460 - RNA, 60 nt, Human
uccucuguccucgcacagcgaaccugggcuccugcccaggacaggcaccagggucauggc

SEQ ID NO: 144461 - RNA, 60 nt, Human
uguccccucucuccacacccagccccugcuccugcccaggcugcccugcccagcgccuca

SEQ ID NO: 144462 - RNA, 60 nt, Human
acacccagccccugcuccugcccaggcugcccugcccagcgccucaucagccucugccuu

SEQ ID NO: 144463 - RNA, 60 nt, Human
cuuccccaucaggcugggcucuggcagggaccugcccaggauggagaugagagaggguga

SEQ ID NO: 144464 - RNA, 60 nt, Human
ugugcccaggaagagccauucacuccugccccugcccacacggcagguagcagggggagu

SEQ ID NO: 144465 - RNA, 60 nt, Human
uccuccugccccagcccucugguguccacaccugcccacagagaauguaaacccaguggg

SEQ ID NO: 144466 - RNA, 60 nt, Human
gcuauggcugagguggggccgggccacaccccugcccaucccagccagggugcugugccc

SEQ ID NO: 144467 - RNA, 50 nt, Human; identical to SEQ ID NO: 13975

SEQ ID NO: 144468 - RNA, 60 nt, Human
ccacgcacgccccgugcuguguuccugggcccugcccauggccucaauaaacucucugcu

SEQ ID NO: 144469 - RNA, 60 nt, Human
ugcuggaggugaggucaggugccucccagcccugcccagaguaugggcacucaggugugg

SEQ ID NO: 144470 - RNA, 60 nt, Human
gcgagcuggcugacaauaagaacguggccaccugcccagcuucacaccucccccgacuuc

SEQ ID NO: 144471 - RNA, 60 nt, Human
aggugcuacccggagccccauucacccccaccugcccacuugggaaucugaggcagagga

SEQ ID NO: 144472 - RNA, 60 nt, Human
auccuggccccaccagggccuugggcaaguccugcccaccauaggccucugcuaccugcc

SEQ ID NO: 144473 - RNA, 60 nt, Human
ucuugucuaucuugauggagaagagggguuccugcccaggaucuuacaacacagcaagua

SEQ ID NO: 144474 - RNA, 60 nt, Human
cuacacgguucaugaacugacauuccacauccugcccacccucugagggccaagcugccu

SEQ ID NO: 144475 - RNA, 60 nt, Human
gggacugaaggcaggagagagagcagcuccccugcccaccugccccucaacccuguagcu

SEQ ID NO: 144476 - RNA, 60 nt, Human
gagaaaaaucccagccaggggaacucgccaccugcccacgcuaguuccauccacgcucaa

SEQ ID NO: 144477 - RNA, 60 nt, Human
ggcagguaucuccuucccguuccucauccaccugcccagugcucaucguuacagcaaacc

SEQ ID NO: 144478 - RNA, 60 nt, Human
gcgggguccgaggucguaccccacagugcaccugcccaggggcuguucagagcuggcaau

SEQ ID NO: 144479 - RNA, 60 nt, Human
ugcacuggaguugucucuuaccccacccucccugcccaucaacuguaucugauuucacua

SEQ ID NO: 144480 - RNA, 60 nt, Human
gggaggagcgucucaagugaacagugggagccugcccaccuggcacugcacuggaguugu

SEQ ID NO: 144481 - RNA, 60 nt, Human
gacuugaggggggucauauucccuccucagccugcccacgcacuggccuucccuccugcc

SEQ ID NO: 144482 - RNA, 60 nt, Human
ccuggaauggggcaggggaagggcacacccccugcccaugcaugguagcccacugggugg

SEQ ID NO: 144483 - RNA, 60 nt, Human
ugcccugccccgccccgccccgcccgcgugccugcccaugccagcacuuccuuaaguucu

SEQ ID NO: 144484 - RNA, 60 nt, Human
auggguguaccuggagagggggucuggcuuccugcccaagaugccucccagcccugccag

SEQ ID NO: 144485 - RNA, 60 nt, Human
gaucaccuaaggucaggaguuugagaucagccugcccaacauggugaaaccucgucucua

SEQ ID NO: 144486 - RNA, 60 nt, Human
ggcaccugucugccaggaggccacguguguccugcccacccagggggagcuguauuuugg

SEQ ID NO: 144487 - RNA, 60 nt, Human
gaccugaccagacugugggucccugcgucuccugcccacucugaccgggcuuccucccuc

SEQ ID NO: 144488 - RNA, 60 nt, Human
gagcugauccaguaaccucggagacgggacccugcccagagcugaguuggggguguggcu

SEQ ID NO: 144489 - RNA, 60 nt, Human
ccugcucuuccgcugcucgcucccggaccaccugcccagcguuggcgaggagccccggga

SEQ ID NO: 144490 - RNA, 60 nt, Human
uugugcuauaaaauaaaugcagacuaauuuccugcccaaaguggucuucuccagcuagcc

SEQ ID NO: 144491 - RNA, 60 nt, Human
cucucugccuaccugccugagccauguucaccugcccacuuguccccugcugccugccca

SEQ ID NO: 144492 - RNA, 60 nt, Human
cauguucaccugcccacuuguccccugcugccugcccaaacaccccaccauuggccuguc

SEQ ID NO: 144493 - RNA, 60 nt, Human
agaacugcgacgauuaauuguggaucucccccugcccauugccugcuugaggggcaccac

SEQ ID NO: 144494 - RNA, 60 nt, Human
uccuuuuguugccaagauccuuaauucccuccugcccauaucccuacaggcgacggcaga

SEQ ID NO: 144495 - RNA, 60 nt, Human
guagaaguucuuccuuuccuaacccgggccccugcccagcucuccaaagucuuucagaaa

SEQ ID NO: 144496 - RNA, 60 nt, Human
agggugaggaguagggagugcagcccugagccugcccacuccucauuacgaaaugacugu

SEQ ID NO: 144497 - RNA, 60 nt, Human
gcuuucugucuguccggccugcacccagccccugcccacaaaaccccagggacagcaguc

SEQ ID NO: 144498 - RNA, 60 nt, Human
agagcaugaagcacucuuggaguuguggguccugcccagaguccagagagcagccucagc

SEQ ID NO: 144499 - RNA, 60 nt, Human
gccccugccccacccccacccacgggugucccugcccacucguguggcaagggaggggag

SEQ ID NO: 144500 - RNA, 60 nt, Human
gcacuccuccugccccugccacgcccacccccugcccaccucuccaggcucugcucugca

SEQ ID NO: 144501 - RNA, 60 nt, Human
gaggggucagggccgcucccuagggucccuccugcccaacauguggagguggcugguucc

SEQ ID NO: 144502 - RNA, 60 nt, Human
gccuuuucccccacccucccaugagacugcccugcccagguauccugggggaagaggaga

SEQ ID NO: 144503 - RNA, 60 nt, Human
cccagcacuuaaaacaggagccuagagcccccugcccaaacaaaacaggacaucugugac

SEQ ID NO: 144504 - RNA, 56 nt, Human; identical to SEQ ID NO: 14012

SEQ ID NO: 144505 - RNA, 60 nt, Human
uuucugcaacucuagcccuauauccagaagccugcccaccuccacccauucuguuugccc

SEQ ID NO: 144506 - RNA, 60 nt, Human
ccccaccagcuaucagauaaggcaaacuacccugcccaucuuuguugccauucagugcua

SEQ ID NO: 144507 - RNA, 60 nt, Human
aaagcaccugugauauauggcaagugucccccugcccaaacuuuaacaucagacccucuc

SEQ ID NO: 144508 - RNA, 60 nt, Human
uggcuggggccucugcaccccacccucccaccugcccaccuggcccugccuuuguuuucc

SEQ ID NO: 144509 - RNA, 60 nt, Human
caucugcaugauuggcauuaguuaccacagccugcccagagagaaacuaucuucucccaa

SEQ ID NO: 144510 - RNA, 60 nt, Human
gaucaccugaggucaggaguucaagaccagccugcccaacauggugaaaccccaucugga

SEQ ID NO: 144511 - RNA, 60 nt, Human
ggugcagcuugauucgggaguuccccaccuccugcccauucuccgcguccuuuuacccca

SEQ ID NO: 144512 - RNA, 60 nt, Human
augucacugggaccaucacccagaugauguccugcccacuaaaagaauugugacauaacg

SEQ ID NO: 144513 - RNA, 64 nt, Human
gaaauauagcuuucaggcauaaaccuggaagucucccucugaauccagcaguuguuuucauuga

SEQ ID NO: 144514 - RNA, 64 nt, Human
ucagugacgucauucuucuccaggcuggcccgcccccucugacuaggcacccaaagugagcauc

SEQ ID NO: 144515 - RNA, 64 nt, Human
caaguuccucuagugcccuccacagccgcagccucccucugaccugcaggccaagagcagaggc

SEQ ID NO: 144516 - RNA, 64 nt, Human
ggcuaagaccaggaggcugcaagucuccuagaagcccucugagcuccagaggggugcgcagagc

SEQ ID NO: 144517 - RNA, 64 nt, Human
aaaggaaggccuuucaaaccagagugucucacuccccucugaccuccagaccagauggggcaug

SEQ ID NO: 144518 - RNA, 64 nt, Human
aggugguggccaaggacaccagccaccccacugacccucugaccuccuuccugggccugcggcu

SEQ ID NO: 144519 - RNA, 64 nt, Human
uggggaggcuaccaugaaacaaaggucccucccucccucugacucuuugcccagaccucuuuag

SEQ ID NO: 144520 - RNA, 64 nt, Human
acacggccagccccgcggccuggcgcuccgacugcccucugaggccuccggacuccucucguac

SEQ ID NO: 144521 - RNA, 64 nt, Human
gaaacacaguugcagagaacucagcuguauguugcccucugaccuuggcccagaccuucagagg

SEQ ID NO: 144522 - RNA, 64 nt, Human
uuaagugggguagacugagggauuuuagccucuucccucugauuuuuccuuucgcgaauccgua

SEQ ID NO: 144523 - RNA, 64 nt, Human
aaaauaaucugcuuaccuacucacauuggaaaaacccucugagcugaauaauucuggccauucc

SEQ ID NO: 144524 - RNA, 64 nt, Human
cagucucugucacacccccacuaccgcugccacgcccucugaaucaugcagggaagggucugcc

SEQ ID NO: 144525 - RNA, 59 nt, Human
auuugcauggugcugcgugagcggaggaccccucugaauccugaaaccccucuugccuc

SEQ ID NO: 144526 - RNA, 64 nt, Human
uuggaucccuguccccucuugggccugagguccucccucugaaaugcagagugaaccaacccuc

SEQ ID NO: 144527 - RNA, 64 nt, Human
ucucuagcuaaauggaagacacauucauccuucucccucugacugcuuugaucaucauuuauug

SEQ ID NO: 144528 - RNA, 64 nt, Human
caguuaccaaggaagagagauuguucugaaguuacccucugaaaaauauuuugucucucugacu

SEQ ID NO: 144529 - RNA, 64 nt, Human
uucaaaagcccuaaacuaaauauuauuaauaacccccucugaauuucaugucucuggaauugag

SEQ ID NO: 144530 - RNA, 64 nt, Human
uaugucuccacugccaaguagaagugacucaaaacccucugacaaggauauucccuuggcuaug

SEQ ID NO: 144531 - RNA, 64 nt, Human
ccgcucacugccaccuguggacacucugugucuacccucugagugggaacauacuucuaaguuc

SEQ ID NO: 144532 - RNA, 64 nt, Human
gggggcacuuuuuagcauucccuuucuaucccaccccucugaucucccauaaguggaaaugggg

SEQ ID NO: 144533 - RNA, 64 nt, Human
uugcccucuuugagcuauuuggcuacuucccugucccucugacuccuacugucccaauuuucuc

SEQ ID NO: 144534 - RNA, 64 nt, Human
cuccccccaacgcaaggaggaugcccaauuguugcccucugaaaaugcacaguucuccuggccc

SEQ ID NO: 144535 - RNA, 64 nt, Human
uggcugcuuucacuuccccccauugagcucugcucccucugagccuggucuuuuguccuuuuuu

SEQ ID NO: 144536 - RNA, 64 nt, Human
uaccuaucaggaugaagaacaggcauugcaaggacccucugaugggacgguacugagauaucuc

SEQ ID NO: 144537 - RNA, 64 nt, Human
aagcccuagugucuuuagggcuggaaggcagcaucccucugacaggggggcaguugugaggcca

SEQ ID NO: 144538 - RNA, 64 nt, Human
uuuccuaacaugacauguagcucuccaugguccucccucugaaacaccacaugcuguuuaaacu

SEQ ID NO: 144539 - RNA, 64 nt, Human
cugagagcugccccccaucaccacgccaucacaccccucugagcagaagcaaaucugaggcuga

SEQ ID NO: 144540 - RNA, 64 nt, Human
gccccuuggagcccacacacguuucaucuuuuuccccucugagagcaagaagagacauggcaug

SEQ ID NO: 144541 - RNA, 64 nt, Human
gagcagugagcaggguuccugugguuucccuggucccucugagauggggacagacugaagacag

SEQ ID NO: 144542 - RNA, 64 nt, Human
ugggcaagcucugcaggacagacagacagacaaacccucugaucuaugaagucucugcagggca

SEQ ID NO: 144543 - RNA, 60 nt, Human
ucugucugcagggcuguuagccgggccacccccucugaaggugaaacugagcagguuaga

SEQ ID NO: 144544 - RNA, 64 nt, Human
cagguauccccaaggcagagcaccucucguuuggcccucugaacaaggugcacgcgagcugggg

SEQ ID NO: 144545 - RNA, 64 nt, Human
uuggauaaagauugaagagccacaggccacucuucccucugagccauugggccuagugguguca

SEQ ID NO: 144546 - RNA, 64 nt, Human
caaugcacagcacagaugccaucauuucccuuuccccucugaauggcagacaucaguaaucaau

SEQ ID NO: 144547 - RNA, 64 nt, Human
cuuuugcaaagcaaacauagauuuggugauaagacccucugauucugugaguuuuccauguauu

SEQ ID NO: 144548 - RNA, 64 nt, Human
acauaauuuaggcuucagcaucucaccagccccucccucugaagaaguauuauguucagaagcc

SEQ ID NO: 144549 - RNA, 64 nt, Human
ucugggagguugguuuaaugcaauagaagugcuccccucugaaaguuguacaugaaauuuuugu

SEQ ID NO: 144550 - RNA, 64 nt, Human
cauuagcugugugacucugggugagucccuuaaccccucugagcccgggucucuucauuaguug

SEQ ID NO: 144551 - RNA, 64 nt, Human
uccacgugagcggccuccguagcuaaccucccugcccucugaggagccaucuuccugaaucgca

SEQ ID NO: 144552 - RNA, 64 nt, Human
caguaggugagggcagaggaggagaucagaaaaucccucugacaucuccacugcccccaaagac

SEQ ID NO: 144553 - RNA, 64 nt, Human
agggccuccaaaccucauagcuggacauucacagcccucugagucugaguccagauuucuucuc

SEQ ID NO: 144554 - RNA, 64 nt, Human
acaguugagauucgcauauuugccuauucuuucacccucugagugccaggagaugagaggcugg

SEQ ID NO: 144555 - RNA, 64 nt, Human
uagaacgccccagucccacccugcugcugcuccucccucugacccagacuccgccugaggccag

SEQ ID NO: 144556 - RNA, 64 nt, Human
ccgugucagaucgcacaucccugcgcccccaugccccucugagucacacaggacagaggaggca

SEQ ID NO: 144557 - RNA, 64 nt, Human
gaaugccuuuggcaauagccuugagccuagagggcccucugaugccccacugaggugcuguugg

SEQ ID NO: 144558 - RNA, 64 nt, Human
ucuuccucucaagccaaauucgccuccacccacucccucugaagaacugggcauuugccaaagu

SEQ ID NO: 144559 - RNA, 64 nt, Human
ccugguuucuccuccuggagucuaauuuccuuggcccucugagccuuuugagucugggcccugg

SEQ ID NO: 144560 - RNA, 64 nt, Human
uuguagucuugaugugcuccugugguauuacuuccccucugauaggacauuguagccagccuca

SEQ ID NO: 144561 - RNA, 64 nt, Human
uuguucaauggccuggucaacaucaacaaccccucccucugaucauuuccaguugauugucaua

SEQ ID NO: 144562 - RNA, 64 nt, Human
auuuuuacugaaagucucgugcacaugugaagugcccucugaguuuaagguuugguuaauacug

SEQ ID NO: 144563 - RNA, 64 nt, Human
cuguggcuuguguaguguccugggauucucugcccccucugaguagaguguugugggauaaagg

SEQ ID NO: 144564 - RNA, 64 nt, Human
agcccgaggccucauccauagcuaugaucacuugcccucugaagcuuauuuuugcuucuuuggu

SEQ ID NO: 144565 - RNA, 64 nt, Human
aggagcacagcucagcagggucccugcugcccaccccucugagccuuuucuccccaggguaugg

SEQ ID NO: 144566 - RNA, 64 nt, Human
uuuuuuuuuuuuugaaauuugccgagcaguggagcccucugacaauuugcaaggcccucugaga

SEQ ID NO: 144567 - RNA, 64 nt, Human
gccgagcaguggagcccucugacaauuugcaaggcccucugagaaaggaagcugcuuagagcca

SEQ ID NO: 144568 - RNA, 64 nt, Human
ccgcacacacgagggagggcgcccuugaggcaugcccucugagggagggagaccagagaugcag

SEQ ID NO: 144569 - RNA, 64 nt, Human
augggcauuugaugaccccugggggucaucuuggcccucugaccuggugcucucucuccacugg

SEQ ID NO: 144570 - RNA, 64 nt, Human
uucuccauccucaccacaugaugaccugcugugucccucugagcacuacccaguggcugaaaac

SEQ ID NO: 144571 - RNA, 64 nt, Human
ugccuuacuggaaacuuuguuuacuugucugcuacccucugauuuguuuuuaguuaguuuuuau

SEQ ID NO: 144572 - RNA, 64 nt, Human
agaaaagaacagucgaaaugagcaacucaccuuacccucugacccugauuagacaggaucaauu

SEQ ID NO: 144573 - RNA, 64 nt, Human
ugggcccugaucgagguccccuccuggagccuggcccucugaggcuuacggucuuggcaaggca

SEQ ID NO: 144574 - RNA, 64 nt, Human
gucuuuucaccccuccuuggcugaugacccagagcccucugaugauggcauucuccuggcaaga

SEQ ID NO: 144575 - RNA, 64 nt, Human
auacugagcaagucuuucauucucugugugacagcccucugaauauuugaaguuguuuguugua

SEQ ID NO: 144576 - RNA, 64 nt, Human
acaaccuucucguaucuccccuagaguuucgugccccucugaacugucuguuauugcaauguag

SEQ ID NO: 144577 - RNA, 64 nt, Human
ucacugccccaggcugcggcuugcccagucccgccccucugaccccugccugugggcuggggag

SEQ ID NO: 144578 - RNA, 64 nt, Human
uuuuuucccuguauucuuuacaacuauuuuuugacccucugaaaauuauuauacuucaccuaaa

SEQ ID NO: 144579 - RNA, 64 nt, Human
ccuacuagcccugguuauuuugaaaguguaauuccccucugacacaauaucccucacauacaag

SEQ ID NO: 144580 - RNA, 64 nt, Human
aacuggcaucuuacucuuggcaccuugacuugcacccucugagguuccaacucagucauucuuu

SEQ ID NO: 144581 - RNA, 64 nt, Human
cagcccacauccauuccagagcugcagaaccagucccucugagugaaguccagugacccuggag

SEQ ID NO: 144582 - RNA, 64 nt, Human
uggaugaugugugugcuucaggcugcucccugaccccucugaccuuuccacgagugucacaugg

SEQ ID NO: 144583 - RNA, 64 nt, Human
cuucagcucuugguuaauuuagguucauggggaacccucugaccaccugaaugggaugucauag

SEQ ID NO: 144584 - RNA, 64 nt, Human
gccuuucggaaagaagcgaccgguuucucccucgcccucugaaaguccucaugccuggcagucg

SEQ ID NO: 144585 - RNA, 64 nt, Human
cuguaaguguuuuagggucuggcuuuugcaggcacccucugaccucagcagagcuccugggccu

SEQ ID NO: 144586 - RNA, 64 nt, Human
auugaagaacugcacuuuuuuuacuucgucuucgcccucugaaauuaaagaaaugaaaaaaaaa

SEQ ID NO: 144587 - RNA, 64 nt, Human
cacaaaguuggcagcugguuauauuuaauucagccccucugaaaagcacauacagucuauacuu

SEQ ID NO: 144588 - RNA, 64 nt, Human
ggcucuugaggaauccucaccaguuuguucucuucccucugacaagcagcaccugagcagaugc

SEQ ID NO: 144589 - RNA, 64 nt, Human
agccaggagucaagugcagugccaaggugcaugacccucugagaagucacugggcugauuugac

SEQ ID NO: 144590 - RNA, 64 nt, Human
cacggacacagaaugucuggagagggccagcaggcccucugaggguucuggaaucugugcaccu

SEQ ID NO: 144591 - RNA, 64 nt, Human
uugggccccgggggaaugguuagggggacugaaccccucugaccuuaugaggcccauggcacug

SEQ ID NO: 144592 - RNA, 64 nt, Human
caggguccugaggccucgcauugagcuggggguucccucugagccccaguguguguggaaucag

SEQ ID NO: 144593 - RNA, 64 nt, Human
acugacuuuucagcaaauuuccuuucuggccaagcccucugaguuugaaauucugacaucugcc

SEQ ID NO: 144594 - RNA, 64 nt, Human
uaccacccaccaggccuuaccuaguguuucccaucccucugaucacauagcacuuguaugugau

SEQ ID NO: 144595 - RNA, 64 nt, Human
ccuuccagagaacacagggcugcaucccgagcaacccucugaagaagggaauuaggcuuuagau

SEQ ID NO: 144596 - RNA, 64 nt, Human
gggugacaccuccgagaggcagccagacccagagcccucugagccgccacucccgggccaagac

SEQ ID NO: 144597 - RNA, 64 nt, Human
cuugcucuuuuauaagauuauuuaaauuauguuucccucugauuuuuuuucaccauuguauuua

SEQ ID NO: 144598 - RNA, 64 nt, Human
auuuuuuauuuccuucccucauaccuugcccauucccucugaauauuaggugugaugucaacag

SEQ ID NO: 144599 - RNA, 64 nt, Human
ucaacacgagagcucaacacugccuccgaccagucccucugaggcccacaggucugucauccca

SEQ ID NO: 144600 - RNA, 64 nt, Human
aaggggccagaaaaaacgcuuauaaaaccagaggcccucugagaucaugugaguccuccauggc

SEQ ID NO: 144601 - RNA, 64 nt, Human
gcuauuaccacuggugguccaggcucuggugaagcccucugagcccaggaggaagagaaagcau

SEQ ID NO: 144602 - RNA, 64 nt, Human
aagagucuaagcauugccacuuuagcugcugccucccucugauuccccagcucaucucccuggu

SEQ ID NO: 144603 - RNA, 64 nt, Human
gcuuucucuggcagaauugaggaggaagagguggcccucugacuugacaagccuucuguucugc

SEQ ID NO: 144604 - RNA, 64 nt, Human
agaggcauuacuugcuuucaauugacaaaugaugcccucugacuaguagauuucuaugauccuu

SEQ ID NO: 144605 - RNA, 64 nt, Human
auaggggccagcuccccagggcagacucacgugccccucugaggcucagaaaaugcccagcccu

SEQ ID NO: 144606 - RNA, 64 nt, Human
gaauucaggcaagauaccucuaagcuguuuugaacccucugauauuuuguauuuauguguuugu

SEQ ID NO: 144607 - RNA, 64 nt, Human
agucuguacaugugcgugcacauauauucaugcacccucugauuuugguuuucuuguuucugag

SEQ ID NO: 144608 - RNA, 64 nt, Human
gcagcucucaucauugugauguguagcaugucugcccucugacuggacaucauugccauuaacu

SEQ ID NO: 144609 - RNA, 64 nt, Human
ugagucgucgccacaccaggcgacaggcaccacccccucugauaaauccaagcccgcccaggcc

SEQ ID NO: 144610 - RNA, 64 nt, Human
uccccaauccaucguauuaaaaaacaauuaacugcccucugaaauaaugggauuagaaacaaac

SEQ ID NO: 144611 - RNA, 64 nt, Human
uuagaauaccagcagugaaaugguauuacuguuucccucugagugaaacugcuagaguauaugu

SEQ ID NO: 144612 - RNA, 64 nt, Human
aauaaucugcagaauguggguuuuccugguguuucccucugacucuagugcacugaugaucucu

SEQ ID NO: 144613 - RNA, 64 nt, Human
uugccauugaaaguuaaaauguuugcaugguuuacccucugaguuauguuucuucuagugagca

SEQ ID NO: 144614 - RNA, 64 nt, Human
ggggaaaccggggaaccccaacugggaaaggaggcccucugaucacacgcaggacccaaacacu

SEQ ID NO: 144615 - RNA, 64 nt, Human
cugauggcugccccugcguggccugaguccuggucccucugaggcaguugacggggcagucaga

SEQ ID NO: 144616 - RNA, 64 nt, Human
augcuccuguucuggugauaccaaaccugcccaccccucugagucgucuuugcucauggacuug

SEQ ID NO: 144617 - RNA, 64 nt, Human
cagucccagaggacacaucccucgggaacucugccccucugacaaugagggccacagagaaggu

SEQ ID NO: 144618 - RNA, 64 nt, Human
uuggguuccugagccaucagccagccuuucuuuccccucugaugcacguuccucccggccuagu

SEQ ID NO: 144619 - RNA, 64 nt, Human
acguucugcuggaauucugcauccagcucuaucccccucugaugcuuuuugcccagaaagcugu

SEQ ID NO: 144620 - RNA, 64 nt, Human
uaucaagucccugaauggaaguaugacguugggucccucugaaguuuaauucugaguucucauu

SEQ ID NO: 144621 - RNA, 64 nt, Human
uaugugugucuuguacaguuaguuauauuagcagcccucugagauggcguaucuaucggaagga

SEQ ID NO: 144622 - RNA, 64 nt, Human
gacuuauuaggacuuugaauuauuucuuuauuaacccucugaguuuuuguauguauuauuauua

SEQ ID NO: 144623 - RNA, 64 nt, Human
cucaucccaugccccguuuuaaauugucaguuuucccucugacucuucuguguuaaaacaugaa

SEQ ID NO: 144624 - RNA, 64 nt, Human
cugauaucuacuuuagcaauaauuuuuuuuacaacccucugacucaacaaaguaaauaaaagua

SEQ ID NO: 144625 - RNA, 64 nt, Human
uaaagagaaaacaaaagaaucuuggcaaaauuuucccucugaaauuacaaacuuuaggaacuuu

SEQ ID NO: 144626 - RNA, 64 nt, Human
uaggaaaaaaagcccccccaaauaccuuuuuaaccccucugauuggcuauuauuacuauauuua

SEQ ID NO: 144627 - RNA, 64 nt, Human
ggaagaaacccaagguuggagggugggaugaguacccucugaaaaagggaauuugcuggugaaa

SEQ ID NO: 144628 - RNA, 64 nt, Human
aguuuuauuuguucacuuacgugcuuugauuauccccucugaauuauagaccgagucuuguugu

SEQ ID NO: 144629 - RNA, 64 nt, Human
cucccuggcccccuccaacugccaaauucugcuucccucugaaccccaggaaauacuuucugga

SEQ ID NO: 144630 - RNA, 64 nt, Human
cugggaccuguuugggggccaucccugcgguccacccucugaacccccagcauguuuguccugu

SEQ ID NO: 144631 - RNA, 64 nt, Human
ggugccuccuccuuaccuuggcaagcccuuguagcccucugagcccucauccugcaggcagagc

SEQ ID NO: 144632 - RNA, 64 nt, Human
gaaggggugaaucauaaagccagugaaaauuucacccucugagggaguuccccaaucugaaggg

SEQ ID NO: 144633 - RNA, 64 nt, Human
ugcuuagccugugcuggaccagcuggccuggggucccucugaagagaccuuggcugcucacugu

SEQ ID NO: 144634 - RNA, 64 nt, Human
gcccuggaugggguauuuuggugucaccugaagucccucugacaucaccuuguuucaucauuuu

SEQ ID NO: 144635 - RNA, 64 nt, Human
agacucauggcguucccuccagaacuccccauuccccucugagcauauuucuaugcugcugcuu

SEQ ID NO: 144636 - RNA, 64 nt, Human
uuguuuuaugauaaaggaagugugugauuucccucccucugagaaauauacugcgcuuaauauu

SEQ ID NO: 144637 - RNA, 64 nt, Human
gauacagugggagcaaaaccagauguguuuucugcccucugacuccagugguugcagaauuagc

SEQ ID NO: 144638 - RNA, 64 nt, Human
augaagguguuuucuaguuuaaguuguucccccucccucugaaaaaaguauguauuuuuacauu

SEQ ID NO: 144639 - RNA, 64 nt, Human
ucaggccuuaauguugcauuagcuagcauguuuucccucugauguauauagucacuguuguaua

SEQ ID NO: 144640 - RNA, 61 nt, Human
gcucgcuggagaacaacuaaggggcaccaaacccucugagguuuuacuuuaagguucgcug

SEQ ID NO: 144641 - RNA, 64 nt, Human
acccucccuuccccacccucugccccacuuccagcccucugaaagauuggagucaagcagaugg

SEQ ID NO: 144642 - RNA, 64 nt, Human
guuccucuauuugccugccaccucucuugucucucccucugaagauggacucggccccacauac

SEQ ID NO: 144643 - RNA, 64 nt, Human
uuuaggaccacaacucagaggcugcuuggcccuccccucugaccagggacauccugaguuuggu

SEQ ID NO: 144644 - RNA, 64 nt, Human
aaaccguagccauagauccuguccaccuccacuccccucugacccucaggcuuucccagcuucc

SEQ ID NO: 144645 - RNA, 64 nt, Human
gcaggcuggucauugacuucgggcuggaccguugcccucugagcagagaacagacccauuucug

SEQ ID NO: 144646 - RNA, 64 nt, Human
aguuuuguuuccuacuuaagcucaggacuugauacccucugagaugaguggcuuugagugacau

SEQ ID NO: 144647 - RNA, 64 nt, Human
uggacagugacccaugauaucugccuucguuugccccucugacuguuggaaucccacgcaccau

SEQ ID NO: 144648 - RNA, 64 nt, Human
uuccaucucucugguuuagcacuccuguccucaucccucugagauuuugggcacauucaaaucu

SEQ ID NO: 144649 - RNA, 64 nt, Human
uuucuugauuugaucuucaaaggugggcaaaguucccucugacucuucccccacuccccaucuu

SEQ ID NO: 144650 - RNA, 64 nt, Human
uccuggagcagaccaccccgccugcccucauggccccucugaccugcacuggggagcccgucuc

SEQ ID NO: 144651 - RNA, 64 nt, Human
gccagccuggcgccccugcagauuccagcagggucccucugaguggggccaggcccaggacugu

SEQ ID NO: 144652 - RNA, 64 nt, Human
uguccucaagaagugcagggcgaguucugccgugcccucugaaauacucucccuccucucagag

SEQ ID NO: 144653 - RNA, 64 nt, Human
ccagagccaggaacagugaaggaugguuccuggccccucugagugacagcugguggcagcacuc

SEQ ID NO: 144654 - RNA, 64 nt, Human
gcccagauaugagaacuucugcuggaaagugggacccucugaguggguggucagaaaauaccca

SEQ ID NO: 144655 - RNA, 64 nt, Human
auguauuugcaaggcugauuuauggucagaauuucccucugauaugucuagggugugauuuagg

SEQ ID NO: 144656 - RNA, 64 nt, Human
uaaaaaaauuguacuuuuauuucauguaaacugccccucugaggauuugggcauauuuuuugga

SEQ ID NO: 144657 - RNA, 64 nt, Human
ccccaagguauuuccagaacuaaacccuuccuuucccucugauggguacacugaagccccugcu

SEQ ID NO: 144658 - RNA, 64 nt, Human
aaaggucaaguggucaaguucuguuuucuuuuuacccucugagaaacaugaaucccacugggac

SEQ ID NO: 144659 - RNA, 64 nt, Human
gggucucucugcuguggcguucucucuugagagacccucugaauuuuagcacaaagugccuucu

SEQ ID NO: 144660 - RNA, 64 nt, Human
gaauaaucacuuggucaccuugccccaagcuuuccccucugaauaaauacccauugaacucuga

SEQ ID NO: 144661 - RNA, 64 nt, Human
uuguauuucaguuuaaaaacccagugcauguacgcccucugagaugcaauaaacaccuugaaca

SEQ ID NO: 144662 - RNA, 64 nt, Human
gccuuagggaaggugaguguggguccuuccuaaucccucugacgucaugucauauagguggcug

SEQ ID NO: 144663 - RNA, 64 nt, Human
ggacuaccccugcccgacccugugggacccccaccccucugaugcugucugcagcucagucccu

SEQ ID NO: 144664 - RNA, 64 nt, Human
uggcagagcaacugaggagcucugcgagagugugcccucugagacagcccuguccgccccgccc

SEQ ID NO: 144665 - RNA, 64 nt, Human
ugcuuucuuuguggccucaucugugguuucgugucccucugaaggaaacuaguuuccacugugu

SEQ ID NO: 144666 - RNA, 64 nt, Human
acccgcuucagcccagggccccuggagacugauccccucugaguccucugccccuuccaaggac

SEQ ID NO: 144667 - RNA, 64 nt, Human
ugcaaaucuaucugcucuucagacaauacgaagacccucugagaugcuacagaggagaggaagc

SEQ ID NO: 144668 - RNA, 64 nt, Human
ugcucagcaucagauaauucacaccagagagaaacccucugaaugugacgaaugaagaaaaggu

SEQ ID NO: 144669 - RNA, 64 nt, Human
acuguaucauacuuucaaaggauaaaaagacuaccccucugaagguuguuuuguauuaaugguc

SEQ ID NO: 144670 - RNA, 64 nt, Human
guaggcagagccuuuggaugaccagaacaagguucccucugagaauuccaaggaguuccaugaa

SEQ ID NO: 144671 - RNA, 64 nt, Human
acugcgaucuucagagcagggguccuuggugugacccucugaaugguccaggguugaucacacu

SEQ ID NO: 144672 - RNA, 64 nt, Human
agggcaucggggaauuugcuccaagcagauagcucccucugaggaaccaaaggaagcaaguuuc

SEQ ID NO: 144673 - RNA, 64 nt, Human
cagguaaggaguuccaugcaacugcggauggagccccucugagaaacacaugccccuccaagug

SEQ ID NO: 144674 - RNA, 64 nt, Human
uguuaguacuuucaaauguuuucaauuugacuuucccucugaauaugcaugguguguuuccugu

SEQ ID NO: 144675 - RNA, 64 nt, Human
cugaaaucacauccagcuccugauguuuucuucucccucugacugcagaggaaguguuccuacc

SEQ ID NO: 144676 - RNA, 64 nt, Human
cagcucuugccuugccaugcagucaccuccuucccccucugaccccagaucccaaaggugcacc

SEQ ID NO: 144677 - RNA, 64 nt, Human
aaugacaguuuauguauauauauaauucaguauucccucugauaacauaguugccaguguuuaa

SEQ ID NO: 144678 - RNA, 53 nt, Human
ugaggaaaggguuuccuugaguccccucugagguguuuauuccugcuugugug

SEQ ID NO: 144679 - RNA, 64 nt, Human
ugccuuaguauauugcgguuaugugucauuguaccccucugaucauuuccuguguuugaguugg

SEQ ID NO: 144680 - RNA, 64 nt, Human
gcccuggucucagcagcgaccaccccugccuccacccucugagcuuugcauguuccacuaaccc

SEQ ID NO: 144681 - RNA, 64 nt, Human
ucucucucucucucaucggggucauuugcuauuccccucugauauucaacccuauagaaggagc

SEQ ID NO: 144682 - RNA, 64 nt, Human
uuuuacaugaaguauuuuuucaguauuauauguacccucugaaauacauagggauaugcguauu

SEQ ID NO: 144683 - RNA, 64 nt, Human
aacaaggacagcagaggaggguuugcagagaccucccucugaaaaacacaaagaauggacucuc

SEQ ID NO: 144684 - RNA, 64 nt, Human
uccccugcgcagcccccaggccucaggaccccaccccucugaggcccaggggagcccuguucac

SEQ ID NO: 144685 - RNA, 64 nt, Human
gggccuuagucucccaaauccaccaugcaucugccccucugagggugucuucacuuugucucug

SEQ ID NO: 144686 - RNA, 64 nt, Human
uagagcagcugauaaguuucccuaccugauggcccccucugacauaaacugcacaccuggggug

SEQ ID NO: 144687 - RNA, 64 nt, Human
agccccgugcccugacccggggaccacagggacacccucugagacgugcuggccccaggaggau

SEQ ID NO: 144688 - RNA, 64 nt, Human
uaucugcugacgggaacaagucauucugaaaggucccucugacccaggucaccaaauuugggcc

SEQ ID NO: 144689 - RNA, 60 nt, Human
caggcgaggagaagcugugauuccccccaucccucugagggccggcggaugcuggauccg

SEQ ID NO: 144690 - RNA, 64 nt, Human
agaggacaguaucuguggggcuggccccuuuucucccucugagacucacgucccccagggcaag

SEQ ID NO: 144691 - RNA, 64 nt, Human
cuggcccuuggcaccgugcuguguggaaacccuccccucugagacuccacugagacguggcuga

SEQ ID NO: 144692 - RNA, 64 nt, Human
ugccacccacagugcccggaauggcccuaggaggcccucugaggagagcuagagucccagcaaa

SEQ ID NO: 144693 - RNA, 64 nt, Human
agacgugggccugaggcccgcggcugcccgugcccccucugacagccauccuccugggagccca

SEQ ID NO: 144694 - RNA, 64 nt, Human
agaccagcgucucuguaugacauugugugguugacccucugagauaacuguuuucaucuacaga

SEQ ID NO: 144695 - RNA, 64 nt, Human
acagcccagccuccagccuggccuuuccuccuuccccucugaaccuccugcaacccugagccau

SEQ ID NO: 144696 - RNA, 64 nt, Human
ccccccucuccccuuguaggugacacaugcucugcccucugaggcagucagcgaaggcaaaugg

SEQ ID NO: 144697 - RNA, 64 nt, Human
guguggaagcacgucucaaauuuagacuuguucccccucugaaccgugaaucagaccauuucag

SEQ ID NO: 144698 - RNA, 64 nt, Human
uggugccaugcguggcuaacauccugcuuugauucccucugauaagcuguucugguggcaguaa

SEQ ID NO: 144699 - RNA, 64 nt, Human
gaccuuaaaggucaucuaguuuagccuccccacccccucugaaugcuugaauccccucgacaau

SEQ ID NO: 144700 - RNA, 64 nt, Human
uccuuugucuucucacucgcacucuggcacugcucccucugaagugcagugggaucucgugugc

SEQ ID NO: 144701 - RNA, 64 nt, Human
uggccucugcugccucucagucaccaagucaccucccucugaaaauccagucccuucuuuggau

SEQ ID NO: 144702 - RNA, 64 nt, Human
ggaaagaggaacagggcuuggauugauguuuauacccucugaauuggagggcagugccagggca

SEQ ID NO: 144703 - RNA, 64 nt, Human
gccgccgucuuccguccuaggagacuccaggacacccucugaguccuugacgcuggcucugucc

SEQ ID NO: 144704 - RNA, 64 nt, Human
augaggaggccccccaggccagacaguccugaaccccucugacacuuggaaacugaauauaagu

SEQ ID NO: 144705 - RNA, 64 nt, Human
acagauaggggcuugauagcugugguccccucuccccucugacuaccuaaaaucaauaccuaaa

SEQ ID NO: 144706 - RNA, 64 nt, Human
cacugaggguaggggacaggaggcucaggacgcgcccucugaaucgaguguuucuucuucacaa

SEQ ID NO: 144707 - RNA, 64 nt, Human
uccuucuuacucugggccaagaccucccacuccgcccucugaggaugguaccaagaaugggccu

SEQ ID NO: 144708 - RNA, 64 nt, Human
guagcaugacguuaagauuucagggaggaagcugcccucugaucccaugucauaugacaguacu

SEQ ID NO: 144709 - RNA, 64 nt, Human
gccccugcuugggcaguucacagugagaccgacccccucugaauaugauaacagccuguuucac

SEQ ID NO: 144710 - RNA, 64 nt, Human
guaaggagguaaggauguucccugucucugcccucccucugagcaggacucucagaagaaagac

SEQ ID NO: 144711 - RNA, 64 nt, Human
gcugcugcuggggaggggcaggcugcuggagccgcccucugaguugcccgggaugguagugccu

SEQ ID NO: 144712 - RNA, 64 nt, Human
ccacuucccucagcccccagggcuuccuucuggccccucugaggauucccuagggcugccccgc

SEQ ID NO: 144713 - RNA, 64 nt, Human
caggaugacucuuuaugggugggauuacauugcacccucugagggugcaggcuagaccgucucc

SEQ ID NO: 144714 - RNA, 64 nt, Human
cagcuccugauguaaggauuuagagggccuucugcccucugaauauauggugaggagaaugggg

SEQ ID NO: 144715 - RNA, 64 nt, Human
ccuugaguguuucgcucucgauuucucuaucugucccucugaggucggccccucagacccuccu

SEQ ID NO: 144716 - RNA, 64 nt, Human
cugagcgggcaagucgguuguaaguucaguaaaacccucugaugaugcaaaaaaaaaaaaaaaa

SEQ ID NO: 144717 - RNA, 64 nt, Human
cuucacugcccucgacagcuuuaccucccccggacccucugagccuccuaagcucggcuuccuc

SEQ ID NO: 144718 - RNA, 64 nt, Human
ugucucaggcagugggggggcuggggccagggcgcccucugaggacagagcugguggggcgcgg

SEQ ID NO: 144719 - RNA, 64 nt, Human
uguggccuggacugagggaggaaaugagcgaguucccucugacaccagcagauccccaggggcu

SEQ ID NO: 144720 - RNA, 64 nt, Human
ggucugggggccaguggaggccugaggugucccucccucugaguccuuugggggcugcagccca

SEQ ID NO: 144721 - RNA, 64 nt, Human
ccugcuguggcuugguugguuaccgguuaugugucccucugagugugucuugagcguguccacc

SEQ ID NO: 144722 - RNA, 64 nt, Human
gacuuggaggagaaauccccuggacuuucacuaacccucugacauacuccccacacccaguuga

SEQ ID NO: 144723 - RNA, 64 nt, Human
guguuggggguacugaaggagaggcccugggggacccucugaagcauuucugccucacuuuaug

SEQ ID NO: 144724 - RNA, 64 nt, Human
gcaaagaccuccauuuccagaggcccagaggcugcccucugagguccccacucucccccagggc

SEQ ID NO: 144725 - RNA, 64 nt, Human
ggcugaccugagaggaaggcuccuuccuggacugcccucugaaauguguauagauugauucuaa

SEQ ID NO: 144726 - RNA, 64 nt, Human
acauauggucaccuuggagggcagaccuaggagccccucugaccacugaauccgucuccacacc

SEQ ID NO: 144727 - RNA, 64 nt, Human
ggaguucauccguugcucacaucuuucauuggugcccucugaacucuguggguugcuaggaugu

SEQ ID NO: 144728 - RNA, 64 nt, Human
gugacucuuagaagguggccugggacuagacagccccucugagcacaugcauaguggcaucagc

SEQ ID NO: 144729 - RNA, 64 nt, Human
aaggcaggaaaacuggcgcaaauuuccugggccucccucugacuucugggcgccagauccugcc

SEQ ID NO: 144730 - RNA, 64 nt, Human
uuugaggggaggagauggaaacaauguggagucucccucugauugguuuuggggaaauguggag

SEQ ID NO: 144731 - RNA, 64 nt, Human
ccagcccauggacaggagauccuggguugggccucccucugaugaccccagccagaugagcgag

SEQ ID NO: 144732 - RNA, 58 nt, Human
augacagcaagcccuacugagcgugcuccccucugagacuggagugagagggucuucu

SEQ ID NO: 144733 - RNA, 64 nt, Human
cacuggaagaggcuucuagaagggaagaaauugucccucugaggccgccgugggugaccugcag

SEQ ID NO: 144734 - RNA, 64 nt, Human
aggucuggccuugcucucuuggcagggccccagccccucugaccacucugcagcucaccaugca

SEQ ID NO: 144735 - RNA, 64 nt, Human
uacuauuuacccuaaaacuuucugugucuggguacccucugaguaggccuauaauuccuaccuu

SEQ ID NO: 144736 - RNA, 64 nt, Human
caagacucuucuuauugguaauuuuccacacaaucccucugaaauaagggagaggauauagacc

SEQ ID NO: 144737 - RNA, 64 nt, Human
gguggugagggaaggguacgaguacauuccuuuucccucugaccugggcgcuagcaagggcaaa

SEQ ID NO: 144738 - RNA, 64 nt, Human
uagggagcuguguuguuucccacccaccacccuucccucugaacaaaugccugagugcuggggc

SEQ ID NO: 144739 - RNA, 64 nt, Human
aauggauuuucuccuuucaccaguauguuuggaacccucugauccaaugucuuuugauacugau

SEQ ID NO: 144740 - RNA, 64 nt, Human
caacagcugccccugcugacugcgccugucuucucccucugaccccagagaaaggggcuguggu

SEQ ID NO: 144741 - RNA, 64 nt, Human
aaaauggagagccucuucugguggaugcuuugcucccucugagcugcccaugcuggucuggcaa

SEQ ID NO: 144742 - RNA, 64 nt, Human
ucucuccccuggugucuguacuguguacacacaucccucugagaagcacaaggagacgacacgc

SEQ ID NO: 144743 - RNA, 64 nt, Human
uucacuggcaugggcuaaccacuucuuuuucaaacccucugaacaccuuuuucugauggguaac

SEQ ID NO: 144744 - RNA, 64 nt, Human
aggcuuggccuugggcuauuuggacucaggugggcccucugaacuugccuuaaacacucaccuu

SEQ ID NO: 144745 - RNA, 64 nt, Human
uagagcuugucucaauggaucuagaacuucaucgcccucugaucgccgaucaccucugagaccc

SEQ ID NO: 144746 - RNA, 64 nt, Human
uugcuauucuauuggaguagccucccuaggcagucccucugaagccuuggagugcagguaaaug

SEQ ID NO: 144747 - RNA, 64 nt, Human
guccaagaccugggucaguucuuugcuggugguccccucugaccacaagcuucugccugaagau

SEQ ID NO: 144748 - RNA, 64 nt, Human
cagguuuacaguguauaugugggcuauugaagagcccucugagcucgguugcuagcaggagagc

SEQ ID NO: 144749 - RNA, 64 nt, Human
uugaacagaugugaaaggccagugccaagagugucccucugagacccuugggaagcuggguggg

SEQ ID NO: 144750 - RNA, 64 nt, Human
agcccuaucacaggaaucauuccuggguuucugucccucugaggcucaccagguguaguuggcc

SEQ ID NO: 144751 - RNA, 64 nt, Human
ugggaugcccucagugaccuuuggcaguguccaccccucugauguguuggauaugccuguggau

SEQ ID NO: 144752 - RNA, 64 nt, Human
acucuugugggaggagcagaggggcucacaucuccccucugauucccccaugcacauugccuua

SEQ ID NO: 144753 - RNA, 64 nt, Human
auuuuaaaauuugacuccucuucaagcuugaaaacccucugaacucagucuucuuuaccucauu

SEQ ID NO: 144754 - RNA, 64 nt, Human
agaggcuuaaaaccgggcuuucacccaaccugcucccucugauccuccaucagggccagaucuu

SEQ ID NO: 144755 - RNA, 64 nt, Human
cuauuccuuuuguucuuucuagcaucucuccccacccucugagagcuccucaggcuuagauagu

SEQ ID NO: 144756 - RNA, 64 nt, Human
caugguaugcuuuggggcugggguagcauggaaucccucugaggaccuggauacugguacuacg

SEQ ID NO: 144757 - RNA, 64 nt, Human
gccagucucaguucaucucuuaccaggagcaaggcccucugaagcaugggccgugccagcugug

SEQ ID NO: 144758 - RNA, 64 nt, Human
aggcuccuccuccagcaucaggcucugccaaggccccucugacucuugcccaauccuugaccuu

SEQ ID NO: 144759 - RNA, 64 nt, Human
cacuugggaggagggaggcuaaggcuggguccuccccucugagguuucucagguggcaauguaa

SEQ ID NO: 144760 - RNA, 64 nt, Human
ccccucugcccuccugugugggaggaucucuaaccccucugaucguggcgcauggcuuggggau

SEQ ID NO: 144761 - RNA, 64 nt, Human
aaggauuaaggcaaggucccuucucuugagacuccccucugagaucugaaaaaugaaguggcuu

SEQ ID NO: 144762 - RNA, 64 nt, Human
uucaagaccccaggugaaaugaaaaugcuaaguacccucugaauggccaugccuguuaccaggu

SEQ ID NO: 144763 - RNA, 64 nt, Human
cugcguuuguguaauuguuugcuguaucucccuucccucugagcuguauuguucuuuaauggcu

SEQ ID NO: 144764 - RNA, 64 nt, Human
aagugugugugaugggggugcagcuuagaggacccccucugaaagggauggagaugcugaugag

SEQ ID NO: 144765 - RNA, 64 nt, Human
aagcuagaagucccccuugaaugacccccagagccccucugagaagggcuggaguuugggggaa

SEQ ID NO: 144766 - RNA, 64 nt, Human
uuaauaccaucccauagcuccugccaaaucgagacccucugacgacuugccgacuaacuggcca

SEQ ID NO: 144767 - RNA, 64 nt, Human
ugacaaccggguguuggggacacaugucaaaugccccucugagaugggcccuaaauuccaguaa

SEQ ID NO: 144768 - RNA, 64 nt, Human
agucguccugcagcguauuagaguaaaagucuaccccucugaagcacuauuaagcgcuuaacgu

SEQ ID NO: 144769 - RNA, 64 nt, Human
ugagagaaccguccuggggccucccuucgaggagcccucugaugugaggagggacuugaguuga

SEQ ID NO: 144770 - RNA, 64 nt, Human
aggugcucuggggugacucuucuguggagcuuuacccucugagugagacccuccccagagcccc

SEQ ID NO: 144771 - RNA, 64 nt, Human
uaggaucugcaguauguaauauagcacuuguuaacccucugagugcauagaauuuuauugagaa

SEQ ID NO: 144772 - RNA, 64 nt, Human
agacaagaucuuuuccaggcccugacuucugccucccucugaguggcacagggaguugaauacu

SEQ ID NO: 144773 - RNA, 64 nt, Human
aggaacucccuuugcacggaggcuugccccaucacccucugagcccucccaacacagcacacua

SEQ ID NO: 144774 - RNA, 64 nt, Human
gccucacuccucccuaucauguaccgugaaaacccccucugauggccucaaggcagugccugca

SEQ ID NO: 144775 - RNA, 64 nt, Human
aaguuacuuugcagauggguguaaggacucauggcccucugaggugcggcgugaagaugcccuu

SEQ ID NO: 144776 - RNA, 64 nt, Human
uuucucucggcgaccccgccccgcacgcgcccuccccucugaccccggccugggcuucagccgc

SEQ ID NO: 144777 - RNA, 64 nt, Human
ucacccugcagacaaacugcuguggccagugggccccucugaggccagccaaggcaaagaaugc

SEQ ID NO: 144778 - RNA, 64 nt, Human
cggcccaccgcggggggggggcagcgggcacaggcccucugagugagccccacgggguccaggc

SEQ ID NO: 144779 - RNA, 64 nt, Human
cugcuguggcucccuagccuaaggggccugcugucccucugaggccuagugaaaaagcugcagg

SEQ ID NO: 144780 - RNA, 64 nt, Human
cagugucucuggugcucagaaacccuguggauuucccucugaaccaagauuuuuaguaguaaaa

SEQ ID NO: 144781 - RNA, 64 nt, Human
cuuucuugcguuucuuuuuaccuuuuuuggcacucccucugaccccgcgaugaguguuuuggug

SEQ ID NO: 144782 - RNA, 64 nt, Human
ucuguacugccuugugugcacuucagccccgacccccucugauucucuguugaaaagugugucc

SEQ ID NO: 144783 - RNA, 64 nt, Human
uaccaauugguucaguaugugaaaccaccauuuccccucugauuaguaaugcuauuuuuauaga

SEQ ID NO: 144784 - RNA, 64 nt, Human
cccccacccuccaccugccccucuugccucuggccccucugacccuggcccagggaccccucac

SEQ ID NO: 144785 - RNA, 64 nt, Human
cuguguggagccgcccugcccguauggagucacgcccucugaacugcucuucgggaggcagccc

SEQ ID NO: 144786 - RNA, 64 nt, Human
gcuggugugugcaggacaguucaugguaauguugcccucugaggccccguacaccagaagggag

SEQ ID NO: 144787 - RNA, 64 nt, Human
acacucacuucuugucuuuuuguggguucaagagcccucugacuugugaagaauuugcugcccu

SEQ ID NO: 144788 - RNA, 64 nt, Human
ucagacaccauuucaccugagaccaauaggugcacccucugaggccccaagggaagggcuucuc

SEQ ID NO: 144789 - RNA, 64 nt, Human
auagcuuuuuaaauaucuuuuuccuucuacuccucccucugacucuaagaauucucucuucugg

SEQ ID NO: 144790 - RNA, 64 nt, Human
aacucaacuucuuuccucuggagacggggcaucucccucugauuuccuucugcuaugacaaaac

SEQ ID NO: 144791 - RNA, 64 nt, Human
ccuccuuguuuugaugucaccuugguaggcugggcccucugagagguuggaagcucuaggcauu

SEQ ID NO: 144792 - RNA, 64 nt, Human
cugaacuccucugugaucuaggaugaucuguucccccucugaugaacauccucugaugaucuag

SEQ ID NO: 144793 - RNA, 64 nt, Human
ugugugugcucggcacuccugggcuuccgaugcucccucugaaccacugaaagcugugaugucc

SEQ ID NO: 144794 - RNA, 64 nt, Human
ugagaucaguuucuuagaaaaagcuuuccugaaucccucugacguugccugggaucuuucuguu

SEQ ID NO: 144795 - RNA, 64 nt, Human
uucuacuucauggaagauuguuuuggugcccugacccucugaagugcccaguuccugccaucug

SEQ ID NO: 144796 - RNA, 64 nt, Human
ccccugcccaccugcuggagcccagccugugccgcccucugaggagaggccuggggggacagcu

SEQ ID NO: 144797 - RNA, 64 nt, Human
guggagcagaauucgacaacacauguccauucagcccucugaauggaucugagacgaagaccuu

SEQ ID NO: 144798 - RNA, 64 nt, Human
ucugcucaucucuuccgugagauuugcucccagacccucugaucucccuccaacaaacccuggc

SEQ ID NO: 144799 - RNA, 64 nt, Human
aguggccuuguuaauuccaaguggcauguaucuucccucugagcuucauuucuucaagaugcuc

SEQ ID NO: 144800 - RNA, 64 nt, Human
aauccugaccuccuguuaaaugacaucaguuucccccucugagcaacagacugcuugucuugcu

SEQ ID NO: 144801 - RNA, 64 nt, Human
gcggggccaagggugucccacauucccaacaccgcccucugaucaccaugggaaucuuuggacu

SEQ ID NO: 144802 - RNA, 64 nt, Human
gcugucgacaccccgcccucaccccuccaauccccccucugacccccucuuccucacauggggu

SEQ ID NO: 144803 - RNA, 64 nt, Human
ucuugaagagguacccaucauaaugacagcaucucccucugaaggguuuuggucaaaaugggug

SEQ ID NO: 144804 - RNA, 64 nt, Human
ugcuggaccuccucucagcacagccagcuccgugcccucugaauuauguuucgcagaaaagugu

SEQ ID NO: 144805 - RNA, 64 nt, Human
uucacuacauaaucugaaaucuuucucccuagcccccucugaauccuucugccuacugaaaucu

SEQ ID NO: 144806 - RNA, 64 nt, Human
accugccuggcucgcuggucucucgaauuuucuucccucugaaauccuauuuaagaacuuuugg

SEQ ID NO: 144807 - RNA, 64 nt, Human
gauguugcuccucagcucccucccucagcccugccccucugagacaauaaaacugcccucucua

SEQ ID NO: 144808 - RNA, 64 nt, Human
acaugggucuggcaccugugggcugucgauagugcccucugagcagagggucacggucauguca

SEQ ID NO: 144809 - RNA, 64 nt, Human
acagccugguagucccacaugugccaagaagacgcccucugaagccauguccugacucaugggu

SEQ ID NO: 144810 - RNA, 64 nt, Human
ggccagcaguggagacggcaguccaguuucucuccccucugaccccuagaaggggaguuguagc

SEQ ID NO: 144811 - RNA, 64 nt, Human
ucacaucauucuaugggguugaagacaacucauucccucugaggagccuuguacauacaagccu

SEQ ID NO: 144812 - RNA, 64 nt, Human
acauccagggcgaggguugaggcaaaccagcccucccucugacuuccuugucacugcagccagc

SEQ ID NO: 144813 - RNA, 64 nt, Human
cccucuccccacggucucccucuuuccacggucucccucugaugccgagccgaagcuggacugu

SEQ ID NO: 144814 - RNA, 64 nt, Human
gacuuugggcaagugaccugcccucugugagccucccucugacacagaggagguggcuccccuu

SEQ ID NO: 144815 - RNA, 64 nt, Human
uucaagccaaaacuacacuuugcugguuccuguccccucugagaaaggggauagaaagcuccuu

SEQ ID NO: 144816 - RNA, 64 nt, Human
cuagaugagaauucagcugcccccgcucaugggccccucugacucccaaagagcugccuaagag

SEQ ID NO: 144817 - RNA, 64 nt, Human
uggugaggccuugcucccaaccccacacgcuccucccucugaggcuguaggacucgcagucagg

SEQ ID NO: 144818 - RNA, 64 nt, Human
cuagaugguaaccacagccucgaccaugccugcucccucugacccagcuucaccucauggacaa

SEQ ID NO: 144819 - RNA, 64 nt, Human
caaauuacuuggagggcugccuaggaaucuaucucccucugaaauaaaguuuccucaucuucca

SEQ ID NO: 144820 - RNA, 64 nt, Human
ucaaauaacgauuuuaugaaaugaccucuguccucccucugauuuuucauauuuucuaaaguuu

SEQ ID NO: 144821 - RNA, 64 nt, Human
cuugcgcucugcuccuacccgaagguuuuuaagucccucugaauugcucaucugagauuaguag

SEQ ID NO: 144822 - RNA, 64 nt, Human
ccaggggcucuaucagccccuguaccccacacugcccucugaagacaacacaggcuccugcuuc

SEQ ID NO: 144823 - RNA, 64 nt, Human
aaccaggcugguguucuugcuugaaagcguugugcccucugagugucuggcugaucacaucaga

SEQ ID NO: 144824 - RNA, 64 nt, Human
ucugggggggccugggcaggaucccagcucccuccccucugaggcuuccugcccuccucgcccu

SEQ ID NO: 144825 - RNA, 64 nt, Human
uuuuucagucagcugccaccugcuucucauuuugcccucugagaaaaggcaugguuucuuaauu

SEQ ID NO: 144826 - RNA, 64 nt, Human
ugacucaaaagaaaagaugauccuuugauuuuggcccucugauguauugugcccaagccaggag

SEQ ID NO: 144827 - RNA, 64 nt, Human
aaaccacucugucucccccacaacccuccccuggcccucugauuuguucuguuccugucucaaa

SEQ ID NO: 144828 - RNA, 64 nt, Human
gguuuuaaaguuaccugaagcucuuaacuuccuccccucugaauuuaguuuggggaagguguuu

SEQ ID NO: 144829 - RNA, 64 nt, Human
cugaagaccccugcaugaaaauaaccuccaaggacccucugaccccaucgaccugggcccugcc

SEQ ID NO: 144830 - RNA, 64 nt, Human
agucugcccucguaugaggguguauaccuggccucccucugaggcuggugacuccucccugcug

SEQ ID NO: 144831 - RNA, 64 nt, Human
gcagucaguccauuugccuuccuaguacuuagcccccucugacaauuuuuuuuuuaaugugccu

SEQ ID NO: 144832 - RNA, 64 nt, Human
gcagccaucucccugugugauuuuuuuuuuuuuucccucugauucacuuugccauguuuccuuc

SEQ ID NO: 144833 - RNA, 64 nt, Human
ggcuuucccacacucaagagaggggccuuacagucccucugacaccccucccccuuccccucgc

SEQ ID NO: 144834 - RNA, 64 nt, Human
cuuugucccccacucccgauacccagcgaaagcacccucugacugccagauagugcaguguuuu

SEQ ID NO: 144835 - RNA, 64 nt, Human
aaagcccuggguccucuuuuugaugggcaccggccccucugaacgugaugggaccugccuucuc

SEQ ID NO: 144836 - RNA, 64 nt, Human
uucuccgccguuacccgauccacuccaucccccacccucugaggggugagugugucuuugcaug

SEQ ID NO: 144837 - RNA, 64 nt, Human
ggaucggggguaagagagcucaccugugucccagcccucugaugguggugagaccaggggaaag

SEQ ID NO: 144838 - RNA, 64 nt, Human
auccuauuaauccucagaauuccagugggagccucccucugagccuuguagaaaugggagcgag

SEQ ID NO: 144839 - RNA, 64 nt, Human
acacugcacacuugacaaguguuuucauuccccgcccucugacagaacaacauuccuaauucuu

SEQ ID NO: 144840 - RNA, 64 nt, Human
aggacaggaaaauuuaucgggaaaauuacauaaucccucugauuccacuauccagagauagcca

SEQ ID NO: 144841 - RNA, 64 nt, Human
uuuauauacaagaaaaaccuuuccacugaaaaaucccucugauuuaaaaguaaccccuuugaaa

SEQ ID NO: 144842 - RNA, 64 nt, Human
acagcccaaguaacugacguuuccccucccccuccccucugaggagccugccugccucacaacu

SEQ ID NO: 144843 - RNA, 64 nt, Human
ugaagcuugcuaugcuguucuuuccauuccuuuucccucugaaacacacaaaauaccaaaggaa

SEQ ID NO: 144844 - RNA, 64 nt, Human
agauuccuuuuagcuaauuccccaacccauaugccccucugaaguugagaaucauggcugccuc

SEQ ID NO: 144845 - RNA, 64 nt, Human
gcaaaggugaacacucaugcggcccagccaugggcccucugagcaacugugcagcacccuuuca

SEQ ID NO: 144846 - RNA, 64 nt, Human
uagaaggacauuuaggagacaucugccucucuggcccucugagauaucccgaugggcacaaaug

SEQ ID NO: 144847 - RNA, 64 nt, Human
caaggggcaccggggagaggacccggacccaggacccucugagcugggaggcuuccugcgcuca

SEQ ID NO: 144848 - RNA, 64 nt, Human
caguggccaaguugcgacacugcccacggccccucccucugaugcagauucagggcuucucuuc

SEQ ID NO: 144849 - RNA, 64 nt, Human
uuuugcggcuaguuggcuauucaagaaaccucgccccucugaaugucauacuguaaucuuuaag

SEQ ID NO: 144850 - RNA, 64 nt, Human
ccuguguguugcgugaucugugaaaaauacaucucccucugaccacagacuccucaucugugga

SEQ ID NO: 144851 - RNA, 64 nt, Human
aucccagggcugccucccuccagcccacugccuccccucugaggggcuuccuuccccuccauag

SEQ ID NO: 144852 - RNA, 64 nt, Human
uucuucaccgcugcugaccacccacacucaaccucccucugaccucauaaccuaauggccuugg

SEQ ID NO: 144853 - RNA, 64 nt, Human
ugucucgggcugacccuuuucugaucgucucggccccucugauuguucccgauggucucucucc

SEQ ID NO: 144854 - RNA, 64 nt, Human
ucaccuggaucaacuaaugcgucccucaccucagcccucugaagugacagcugcuauuauuuuc

SEQ ID NO: 144855 - RNA, 64 nt, Human
cuggaccccacgggccccugucccaggaaccccgcccucugacuucuugcccuuuggaaauggu

SEQ ID NO: 144856 - RNA, 64 nt, Human
ggggcuucuccccacucccgccccccccuuaucccccucugaagacgaugggcagaggagugac

SEQ ID NO: 144857 - RNA, 64 nt, Human
cuguuccuauccuucuucuccagcuccuccugcucccucugaaaccuuuucuagguacccuaug

SEQ ID NO: 144858 - RNA, 64 nt, Human
uguacauaauguaauccagggaguccuaauucuucccucugauugugguuucucagcuuuuuua

SEQ ID NO: 144859 - RNA, 64 nt, Human
cuuuucccccauggucauggugucacccccgucacccucugacugcaggccugggcgacugcgg

SEQ ID NO: 144860 - RNA, 64 nt, Human
gagucccaugccacccguccccuugugaccuccccccucugaccuccagcugaccaugcaugcc

SEQ ID NO: 144861 - RNA, 64 nt, Human
ugcgucccgcuccacggagucuuccagaacaccucccucugaacuaaucccggagcaccccacc

SEQ ID NO: 144862 - RNA, 64 nt, Human
ccucugaccccaacuucucuuugaucucugaauccccucugacuccaacuucucuuucacccuc

SEQ ID NO: 144863 - RNA, 64 nt, Human
uagaccuauaaguucugguuuauguuugaccccucccucugagcugcacuucaccgcugaccuu

SEQ ID NO: 144864 - RNA, 64 nt, Human
ggacccaucccaguuuucaucauugagccccagacccucugagcagcaccuugaagagggcaga

SEQ ID NO: 144865 - RNA, 64 nt, Human
agugugcuggcauuucucacccuuucaucuuuagcccucugaguacuuugaagcacuuuugcau

SEQ ID NO: 144866 - RNA, 64 nt, Human
cuuugagggaaacuguggaaggcaccuucaggcccccucugacuuguuguucuuggcacauguu

SEQ ID NO: 144867 - RNA, 64 nt, Human
agccccccucucaacccgcuccuaccccgcuggucccucugaaagcaccgagggguugauggca

SEQ ID NO: 144868 - RNA, 64 nt, Human
ccuugucucccucccuguucucugccucuuguaccccucugacccacccgcucugccccacucc

SEQ ID NO: 144869 - RNA, 64 nt, Human
ucucaaaaaaacaaaacuuggcuguuaaugucugcccucugaauucagacacacuauauuagac

SEQ ID NO: 144870 - RNA, 64 nt, Human
gaagaguagaacucagucucuaguuuccucauaacccucugauauuauauacuucagcauaauc

SEQ ID NO: 144871 - RNA, 64 nt, Human
uuacaacugaguccaaggcuuuucccuccuuugucccucugacaccccucccccuaauucucau

SEQ ID NO: 144872 - RNA, 64 nt, Human
uuucccaagcguuccaccacccucucaguuuugucccucugaagauaauuuuggaucaccuuga

SEQ ID NO: 144873 - RNA, 64 nt, Human
cgggacgaguucugauucuggccggagcaccagacccucugauccuggagggaccagagucuga

SEQ ID NO: 144874 - RNA, 64 nt, Human
agaguaugccugcuccccagcccccugccuggaacccucugagcaacuugcucugaccuauaau

SEQ ID NO: 144875 - RNA, 64 nt, Human
gguagguuuggaggucugccaguuacaccaaguccccucugagauucgaucaggggacuggaua

SEQ ID NO: 144876 - RNA, 64 nt, Human
uagacaccagcccccugcauccuucaguagaccucccucugaacaccacagccagguccugccu

SEQ ID NO: 144877 - RNA, 64 nt, Human
aucacccaggccagucuccucugccugggaugcgcccucugagaggaggccuagcagggcaggc

SEQ ID NO: 144878 - RNA, 64 nt, Human
cuccagcugcccucaccucucuagcagcucucaccccucugagucuaccuaaccuggagggggc

SEQ ID NO: 144879 - RNA, 64 nt, Human
uccgucugugacauggaggguguucggggcccaucccucugauguaguccucgccccucuucuc

SEQ ID NO: 144880 - RNA, 64 nt, Human
ugagcgucagcuguugcuuuauuuuccaucaaagcccucugagaagugagaccucagcaauucc

SEQ ID NO: 144881 - RNA, 64 nt, Human
caggccccuggccaaucugaguuuccugauucugcccucugacaccauugcagcugccugcacc

SEQ ID NO: 144882 - RNA, 64 nt, Human
uaccauaugacacgugucaagaugcccuuccgcccccucugaaaguggggcccggccagcacug

SEQ ID NO: 144883 - RNA, 64 nt, Human
aucaugggcauuucccugagagcagugggagaggcccucugaguuggaaguugagcuccaccuc

SEQ ID NO: 144884 - RNA, 64 nt, Human
agaccgcaugaagauacuuguaagcacacaugaucccucugaauuguuuuacuuuccuguaacu

SEQ ID NO: 144885 - RNA, 64 nt, Human
cuuggccgaagcauagauuguaaccccuccacuccccucugagauuggccuucggugaggaauu

SEQ ID NO: 144886 - RNA, 64 nt, Human
cagacgcuuucugaaaacuacuugcuccaaaagacccucugaguuaacguuucagcuguaucau

SEQ ID NO: 144887 - RNA, 64 nt, Human
aggggcccaccccgccccaccccaccccaccccacccucugaaaugugaaaagccugcacucuu

SEQ ID NO: 144888 - RNA, 64 nt, Human
ggcucagcccugagcuagugucaccugcacagggcccucugaggcucagcccugagcuggcguc

SEQ ID NO: 144889 - RNA, 64 nt, Human
cacauggugcaggugaaaagcaugcucaguugaacccucugaauucuggauugagaaugugaca

SEQ ID NO: 144890 - RNA, 64 nt, Human
gcacauggugcaggugaaaagcaugcucagugaacccucugaauucuggaucgagaauauaaua

SEQ ID NO: 144891 - RNA, 64 nt, Human
acuggaucaccgggggcuucuugccucaguucuucccucugagcccccaggcccucccgcaucu

SEQ ID NO: 144892 - RNA, 64 nt, Human
aaagaguguggcugcuggacucuuuucgaaaugccccucugagucaggagccugguggggacaa

SEQ ID NO: 144893 - RNA, 64 nt, Human
agggcgggaggcaugcaagccagugggggaaaaccccucugaagcugggcagcccucuaccugg

SEQ ID NO: 144894 - RNA, 64 nt, Human
gaccagcuugccacgguuucucagagcccaggugcccucugaccugccaugcggaggugggauu

SEQ ID NO: 144895 - RNA, 64 nt, Human
gaaacguaggagcaucuggugacagccuuucuugcccucugaccucaaaggcuagcugcgcaua

SEQ ID NO: 144896 - RNA, 64 nt, Human
agaguugaccguauucugggcaagacuccaugaccccucugauucugcaguguacagcuguuug

SEQ ID NO: 144897 - RNA, 64 nt, Human
ccacauauauaccaagccccuagucuuagagauacccucugagacagagagccaagcuaaugug

SEQ ID NO: 144898 - RNA, 64 nt, Human
acgguucaugaacugacauuccacauccugcccacccucugagggccaagcugccuggccacug

SEQ ID NO: 144899 - RNA, 64 nt, Human
cucuaccugugcacuccaaccccuucacacccaccccucugaccccugccuucccaggcagggu

SEQ ID NO: 144900 - RNA, 64 nt, Human
uuggugcugggacccucaauggcagccggaaggucccucugaggcagaagcucaagccccaugg

SEQ ID NO: 144901 - RNA, 64 nt, Human
ggggaccaaaagggccggacguuacagggugaaacccucugaccccucgcgacaccguaggacu

SEQ ID NO: 144902 - RNA, 64 nt, Human
gugccaugaaagguagacucugaaccacuuugaucccucugaaguaggugacugaugccuccuu

SEQ ID NO: 144903 - RNA, 64 nt, Human
gaauaucugaagcauguacucauugucagauguucccucugagagcacagaggaggcaaaagcu

SEQ ID NO: 144904 - RNA, 64 nt, Human
caaccaagcaccuuaccucucccauacaagaugacccucugagcuuuucauuuauucaagcucu

SEQ ID NO: 144905 - RNA, 64 nt, Human
cuucucuucugagugaagucuagggcagauucuucccucugaguuugaagggggcagucgaguu

SEQ ID NO: 144906 - RNA, 64 nt, Human
uguggagugaauggaaauuccaacuguauguucacccucugaaguggguacccagucucuuaaa

SEQ ID NO: 144907 - RNA, 64 nt, Human
accaggagguuucaaucuaguccuagaguugugucccucugaaaggcccaaugccauguaacua

SEQ ID NO: 144908 - RNA, 64 nt, Human
ggggcaagugaguuaggggcccaggggcaauuuucccucugaauaacgugucugaggcagggau

SEQ ID NO: 144909 - RNA, 64 nt, Human
agcuccaguuugacauuauucaugcaccacgauacccucugauuauuggaauccauuggcuuga

SEQ ID NO: 144910 - RNA, 64 nt, Human
uucgagagaagcugcccauccgcaguaauaucuucccucugaugcuggaaacugucgacggcca

SEQ ID NO: 144911 - RNA, 64 nt, Human
uuuccucauuucauugccucucauacaguuuucucccucugauuuauuucauuuugguagugga

SEQ ID NO: 144912 - RNA, 64 nt, Human
accucaugcaaaauauugguguggcugcaaauuucccucugaagcugacacaauuaaggaugaa

SEQ ID NO: 144913 - RNA, 64 nt, Human
cuuugcuauugauguagugugauagaaaauucaccccucugaacuggcuccuucccagucaagg

SEQ ID NO: 144914 - RNA, 64 nt, Human
aucccauucauguuagaucguugaaacccuguaucccucugaaacacuggaagagcuaguaaau

SEQ ID NO: 144915 - RNA, 64 nt, Human
cugauucaggagaucacugcuccaucgugaggagcccucugaauagccccccacugaaugcuug

SEQ ID NO: 144916 - RNA, 64 nt, Human; identical to SEQ ID NO: 84473

SEQ ID NO: 144917 - RNA, 64 nt, Human
aaugguaguaucagugcaacuuaaacuaaugauuguacuugauauuaaguguucucaacugagu

SEQ ID NO: 144918 - RNA, 64 nt, Human
uccucugcccugaucuguguaacucuuaucuuggguacuugagcagacgguauauuccagaggu

SEQ ID NO: 144919 - RNA, 64 nt, Human
uccgacugcccucugaggccuccggacuccucucguacuugaacucacucccucacggggagag

SEQ ID NO: 144920 - RNA, 64 nt, Human
ugcuagacagucuagaccaggguuucucaaacucguacuugacauuuggggccagauaauucuu

SEQ ID NO: 144921 - RNA, 64 nt, Human
auugcucaaguccaaacagcguguagucuguuugguacuugauaaaucuggaagcaugaaugca

SEQ ID NO: 144922 - RNA, 64 nt, Human
accgucucuuucgaaugaaucaagcagcagaauuguacuugauucaaauuauugaaaagggauc

SEQ ID NO: 144923 - RNA, 64 nt, Human
guagugggaaacaauguuguuugguaaaaauaauguacuugaucaauguaaaaaaguauauaaa

SEQ ID NO: 144924 - RNA, 64 nt, Human
uugaugacagacaauuuagauaauuuagguuaaaguacuugauaccagacugcggcuucugggc

SEQ ID NO: 144925 - RNA, 64 nt, Human
cuuuuguaagacauuaguuugagguacuaccuauguacuugaaaauaauaaaguggcauuucuu

SEQ ID NO: 144926 - RNA, 64 nt, Human
auuuucuuauuaguuuguuaauugccuguuacuaguacuugaccaauacauugugcuauaugua

SEQ ID NO: 144927 - RNA, 64 nt, Human
agaaagagaaaauuuagagaauaaaggagaggcaguacuugaaagauaacacaauuuuacaaau

SEQ ID NO: 144928 - RNA, 64 nt, Human
guuuucaaguguaaaugauguugagcagaauguuguacuugaaaaugcuauaagugagauggua

SEQ ID NO: 144929 - RNA, 64 nt, Human
aaauuguccaucucagugaucauuuacguugcguguacuugagggagauucugagagaugcucc

SEQ ID NO: 144930 - RNA, 64 nt, Human
gaaaucacuaaaaacuguguuugucaugaccuuuguacuugauuuaucaugacuuuguaugacu

SEQ ID NO: 144931 - RNA, 64 nt, Human
uauauaugcuaaaucuuuauauacagaaauaucaguacuugaacaaauucaaagcacauuuggu

SEQ ID NO: 144932 - RNA, 64 nt, Human
uuaagacauuuuguuucacuugcuauucacuaguguacuugaaacauggucauuuuuagcccuu

SEQ ID NO: 144933 - RNA, 64 nt, Human
ucuugacucuuguuuucaguuucaauucagugcuguacuugaugacagacacuucuaaaugaag

SEQ ID NO: 144934 - RNA, 64 nt, Human
agaauugguaugaaggguuaacucaagucaaauuguacuugauccugcugaaauacaucugcag

SEQ ID NO: 144935 - RNA, 64 nt, Human
uguguguguguucugugugugugugagagagagaguacuugauucauuaaaaaguccuggaaac

SEQ ID NO: 144936 - RNA, 64 nt, Human
uuuauauacgggugaaaugaaagcuuuuuugcauguacuugauacucagucuguaaacucagac

SEQ ID NO: 144937 - RNA, 64 nt, Human
cauugggcacgguacagagugauugucacauaagguacuugaagauuuauuaguuuaauucuau

SEQ ID NO: 144938 - RNA, 64 nt, Human
gccuccauuucuggcuucuagucugguguucugaguacuugauuucaggucaauaacggucccc

SEQ ID NO: 144939 - RNA, 64 nt, Human
aaugcaaccagcuuucaagaaaaagcccuaucuaguacuugauguugauguuuuuauuuugcug

SEQ ID NO: 144940 - RNA, 64 nt, Human
caguaaauuuuaaaaaagcacuugguugaaaauuguacuugaauacauacaugcaugcugcuaa

SEQ ID NO: 144941 - RNA, 64 nt, Human
caagaggaagccaagaaaacuuggccaaaucaaaguacuugauggggaagaugaauauuacaaa

SEQ ID NO: 144942 - RNA, 64 nt, Human
aucuagguaauuuuuacccuaaugucuucauaaaguacuugaguguaauguuuguuaccuccaa

SEQ ID NO: 144943 - RNA, 64 nt, Human
augcuuucuucauuaagauuuugagcauuuuuacguacuugagcuuuuuuuuuuuuuuuuuuca

SEQ ID NO: 144944 - RNA, 64 nt, Human
augacucuaccaguggccuuuuaaccaagaaguaguacuugauuggucauuugaaaacacugca

SEQ ID NO: 144945 - RNA, 64 nt, Human
guaguuuguuuuuaauuucaagcaaaaucuuacuguacuugaaugugcccuguuuuguuagcac

SEQ ID NO: 144946 - RNA, 64 nt, Human
cuucacuaauuuauaacuaaaauuucucaucuucguacuugaugcucacagaggaagaaaauga

SEQ ID NO: 144947 - RNA, 64 nt, Human
auucuggauaagagaauggaggaaaauacucagaguacuugauuauuuuauuuccuuuuauuaa

SEQ ID NO: 144948 - RNA, 64 nt, Human
uuaacagucauagauauauacauuuucauuuuuuguacuugaauauucuaaauaaaacugacau

SEQ ID NO: 144949 - RNA, 64 nt, Human
uugaguaacaguucuguuaauauuguacaagaugguacuugaauucuuuguuugccuuuuuucu

SEQ ID NO: 144950 - RNA, 64 nt, Human
cugaauaaauucagccugacugaauuuucaguauguacuugaaggaaggagguggagugaaagu

SEQ ID NO: 144951 - RNA, 64 nt, Human
agaaacuuuauucuagaacaaaauagucuauaugguacuugaucuacauuuaaguggaaaaauu

SEQ ID NO: 144952 - RNA, 64 nt, Human
aaauagaucagauuuuuuuuguaccuacguaagaguacuugaaguuuuauuuaaaauaaaaugu

SEQ ID NO: 144953 - RNA, 64 nt, Human
gcaguuaccccgauccguuugcaagaaccagaucguacuugaaacuauaguggccacacucugc

SEQ ID NO: 144954 - RNA, 64 nt, Human
gaagcuaaaagcccuauugcaaguaugaaauuaaguacuugagcuguaggacaaaccuugggca

SEQ ID NO: 144955 - RNA, 64 nt, Human
cuggagauccugggguuggucugcuuuguguaugguacuugaaaccacgcuguaauuauugucc

SEQ ID NO: 144956 - RNA, 64 nt, Human
ggacuugguaguuuuucuauuuuucaauagauuuguacuugaauaaggugaagaauuucacaca

SEQ ID NO: 144957 - RNA, 64 nt, Human
ggaguaacaauaugaagaauucauuaauaucucaguacuugauaaaucagaaaguuauaugugc

SEQ ID NO: 144958 - RNA, 64 nt, Human
gaggauuaagggacuuaaucugcuaggaacaccuguacuugaaguggaggaggcuagggggcca

SEQ ID NO: 144959 - RNA, 64 nt, Human
ggaauugcaccuggcucaggaaaggacugucuuuguacuugaauuuaaauccaauggagaacuu

SEQ ID NO: 144960 - RNA, 64 nt, Human
uuuaauacaagaacgauuucccugcauaauuuuaguacuugaauaaguaugcagcagaacucca

SEQ ID NO: 144961 - RNA, 64 nt, Human
uauuccguucuaaaauauuggagaugaggaaaauguacuugaguuuugaaauauuuugguaagc

SEQ ID NO: 144962 - RNA, 52 nt, Human
guagggcugcguuuaucuaauaguacuugaauguuguauguuuucacuguca

SEQ ID NO: 144963 - RNA, 64 nt, Human
agaaauagauuuaaagaauaugaaguucuaucuaguacuugagcagcuguauuucuuuucuaca

SEQ ID NO: 144964 - RNA, 64 nt, Human
uguacugcagguguaccuuaaaacuguucccaguguacuugaacaguugcauuuauaagggggg

SEQ ID NO: 144965 - RNA, 64 nt, Human
aaauugaaauaaauauauauuuuuaacauauauuguacuugaauuaucucauguuggcacuucu

SEQ ID NO: 144966 - RNA, 64 nt, Human
uguagagcccaucaauauuuuuauuuuaggagguguacuugacacccaauaaacugcacguauc

SEQ ID NO: 144967 - RNA, 64 nt, Human
cauguaucugaucaaugaagaccuguaacacuaaguacuugagaguuacagucugaauaaugaa

SEQ ID NO: 144968 - RNA, 62 nt, Human
aaucagagaaguguaaaauaaaacagauuauauuguacuugacccuuuaugucuuuaaagau

SEQ ID NO: 144969 - RNA, 64 nt, Human
ugacugacuaaaugacacccaaaaugguuaagauguacuugacuaguuuacuuaugcaucucuu

SEQ ID NO: 144970 - RNA, 64 nt, Human
agugcauuuaauuauuuuuuaaaaaacuuuuuaaguacuugaauuuuauaucaggaaaacaaag

SEQ ID NO: 144971 - RNA, 64 nt, Human
cuuaggaagagagaaaauaagguuucauaaguuuguacuugaaaacauuuggauugguaggauu

SEQ ID NO: 144972 - RNA, 64 nt, Human
cuuggcuaaguaauagaggaccauuuugguuuuuguacuugagaauauuuuuggugaauuacuu

SEQ ID NO: 144973 - RNA, 64 nt, Human
auacguucuucaaaauuauuaugauuguacuauuguacuugaaauuacagauguuauuauaauu

SEQ ID NO: 144974 - RNA, 64 nt, Human
gauccucugugccugugaauuuacuugcaugcuuguacuugacuucuuaggauggguagcugaa

SEQ ID NO: 144975 - RNA, 64 nt, Human
augaugcuuuggaagaugcagaagcaauaauaaaguacuugacuaccuacugguguaaucucaa

SEQ ID NO: 144976 - RNA, 64 nt, Human
uuuuuuaaaaaguggauuuaacuuaaauuacuguguacuugagguuggcuuuggauauggauuu

SEQ ID NO: 144977 - RNA, 64 nt, Human
cgaguuuuuugguuccuuuuuuaacuguguuaaaguacuugaaauguauugacugcugacuaua

SEQ ID NO: 144978 - RNA, 64 nt, Human
gucaaguguuaggucaauaacacuguauuuuaauguacuugaaaaauguuuuuauuuuuguuuu

SEQ ID NO: 144979 - RNA, 64 nt, Human
acauaucaaaucacaaagucauugucauuagaguguacuugauuacugggcauccuuguaauau

SEQ ID NO: 144980 - RNA, 64 nt, Human
ucucucuugauugauuuuuaaaguuuaaauaccaguacuugagggaccaauauuaccaucuuaa

SEQ ID NO: 144981 - RNA, 64 nt, Human
gcaucugccucuggaaaacuauugagccuugcauguacuugaaggauggaugagucagacacga

SEQ ID NO: 144982 - RNA, 64 nt, Human
guuuuaaauuguaaauggagcuaaguccaagaaaguacuugaagcucucuuccagcgagcuuaa

SEQ ID NO: 144983 - RNA, 64 nt, Human
ugguacagauuguucuauaagugaaaagcauuauguacuugaaaguaaaaaucagggcaauaua

SEQ ID NO: 144984 - RNA, 64 nt, Human
gggauuggaauucaggcaugacucaaaccuggauguacuugauuccaaaugccauguuguuuuc

SEQ ID NO: 144985 - RNA, 64 nt, Human
uucuguuugaaacaguuuuauacuuucugauauaguacuugaaauucuuaccagaaaauuacuu

SEQ ID NO: 144986 - RNA, 64 nt, Human
gaacaaacuauaauuacuuggcuguuggagauuuguacuugaguauaaauguacaccaguuuuu

SEQ ID NO: 144987 - RNA, 64 nt, Human
auccccacaugucaugggaggaacccagugggagguacuugaaucauugcggugguuuccccug

SEQ ID NO: 144988 - RNA, 64 nt, Human
cauaauuuccucuuucuuaauauuauagaauucuguacuugaaauugauucuuagacauugcag

SEQ ID NO: 144989 - RNA, 64 nt, Human
guucaugcuuaguaguuuauuacuucacuugaggguacuugacaauaugaacaaaaaguaaauu

SEQ ID NO: 144990 - RNA, 64 nt, Human
uuuacaauaggcacucucucuaccccaccucucaguacuugagacuuaaagugcuacaggcagc

SEQ ID NO: 144991 - RNA, 64 nt, Human
uccuguguuguuguggaacuaaggacaacacacaguacuugaauaaggguccggccuuuuguuu

SEQ ID NO: 144992 - RNA, 64 nt, Human
cuauguauuuuaccuuuucauauuuaaggcaaaaguacuugaaaauuuuaaguguccgaauaag

SEQ ID NO: 144993 - RNA, 64 nt, Human
aagaguuuugaagacuuaauuuuuuguaaaacaaguacuugagauuuugguuuauccauaauag

SEQ ID NO: 144994 - RNA, 64 nt, Human
cuguugguuaaggcagcugcaugugauaaaagugguacuugaacuugguaguguuuccuuagaa

SEQ ID NO: 144995 - RNA, 64 nt, Human
uuaaaugcuuucugcaaguuaaauaucgagaaaaguacuugacuucaaguuguaaggauacaau

SEQ ID NO: 144996 - RNA, 64 nt, Human
gauccagcagcacuggggaugccgaggcaaugcuguacuugaagccagaggacccaaauugccg

SEQ ID NO: 144997 - RNA, 64 nt, Human
cuuuuauuuauaaguuaccauuccuaguuucuuuguacuugaaauuuuaagaaaccagaaacaa

SEQ ID NO: 144998 - RNA, 64 nt, Human
cuacggucagcucagucaagacagacauccuggcguacuugaagcaauucaaaaccaaauagga

SEQ ID NO: 144999 - RNA, 64 nt, Human
cuuaccaggagcagcauugagguuuuugagcauaguacuugacuacucuagaggcugagacggg

SEQ ID NO: 145000 - RNA, 64 nt, Human
uuuuaaugagaauuugaauguuuauugaacaauaguacuugaaugaacauuuauaaauguaauu

SEQ ID NO: 145001 - RNA, 64 nt, Human
accagcuucaucuuuccuucaggaucauccuuuuguacuugaugcuggaagcucuuggagaaaa

SEQ ID NO: 145002 - RNA, 64 nt, Human
caugccgguacacagccaguagccuaaaucuccaguacuugagcugaccauugaacuagggcaa

SEQ ID NO: 145003 - RNA, 64 nt, Human
caauuuuuaaccauaauuuugacaugauugagauguacuugaggcuuuuuuguuuuaauugaga

SEQ ID NO: 145004 - RNA, 64 nt, Human
uuugggugguuaaucaguuuuauuuugaaaagacguacuugaauaguuacagcauauguuugaa

SEQ ID NO: 145005 - RNA, 64 nt, Human
uaucugaucagcuguuuguggauuuaauuaaaaaguacuugauaaauuguaauuugaaagccgu

SEQ ID NO: 145006 - RNA, 64 nt, Human
uguugucuuacuugauauuucuugcccuaguaauguacuugacauuuauguuccuaagcagugu

SEQ ID NO: 145007 - RNA, 64 nt, Human
aucucagaaaggaauaaggaugaggcagagaggaguacuugaguuugugugugugugugugugu

SEQ ID NO: 145008 - RNA, 64 nt, Human
uccuuccagagggaaaguucuuuguuuaaguguuguacuugaaaaggucaaucuucagggcuuc

SEQ ID NO: 145009 - RNA, 64 nt, Human
uuauugguaauaaaagggaacuuaauucauacagguacuugauacaguuauacauuuuccacuu

SEQ ID NO: 145010 - RNA, 55 nt, Human
ugcgcgggcucuuuuucugaugaggguacuugaagggcugauggacaggggucag

SEQ ID NO: 145011 - RNA, 52 nt, Human
ugaaccaguugcuacuauaagaguacuugaaaaccuagaagaaacuaccaca

SEQ ID NO: 145012 - RNA, 64 nt, Human
uuguuugugcuuuguccaagcuguggagacucuuguacuugauccccucccaccaauucuaaag

SEQ ID NO: 145013 - RNA, 64 nt, Human
guuuucuuuuucguccaacuaaaacaacuguaauguacuugauacauuuauaucaaguucuaaa

SEQ ID NO: 145014 - RNA, 64 nt, Human
ugagagguaagaaguaauaaugaguaaaugguaaguacuugaguaaaucuaaagaaauauugau

SEQ ID NO: 145015 - RNA, 64 nt, Human
aaugaagaaauggaaaacuuuuagaaauuaagguguacuugaaaacgaauaucuaucauaugac

SEQ ID NO: 145016 - RNA, 64 nt, Human
augauaguuuauaguugccacacuuuauugauuaguacuugacaggguguaaagccuauuuugg

SEQ ID NO: 145017 - RNA, 64 nt, Human
ugaagacauacuauuauugaaugaaauuuaauguguacuugaaaacauugcuuuugucccuucu

SEQ ID NO: 145018 - RNA, 64 nt, Human
uguaaccaaaauuaguauuucucuauacguauugguacuugaagauuccuuucaaaagaaaucc

SEQ ID NO: 145019 - RNA, 64 nt, Human
agaaagguaggauucagugcuuaccgaugaugcaguacuugauagaagaaaacagucugggagg

SEQ ID NO: 145020 - RNA, 64 nt, Human
accuggguguguucauuccuuccuguccuucaaaguacuugauagccuuucauaaggccuggca

SEQ ID NO: 145021 - RNA, 64 nt, Human
cuacaaagggaagcagccuggaagaaacaguccaguacuugacccaugccccaacaaacucuac

SEQ ID NO: 145022 - RNA, 64 nt, Human
aauauaaagcuuugugaaguacaauuaacuuaauguacuugaaugaauagaacuugcuacuuuu

SEQ ID NO: 145023 - RNA, 64 nt, Human
uugugaaguauguuuguauuuauuugccuacuuuguacuugauguguuuuguaaugugcacuga

SEQ ID NO: 145024 - RNA, 64 nt, Human
aguacauuuuaagagcauaaaaaucggcgauuuuguacuugaagagaacaugaaaguuauugcu

SEQ ID NO: 145025 - RNA, 64 nt, Human
uuuuggcauucgauaucagcagccucuccccaaaguacuugaagucaguuuuagaugcuuuauu

SEQ ID NO: 145026 - RNA, 64 nt, Human
uccuaccuggguuccggaaauacaugcaucaucuguacuugaagaggccagugggagaggagag

SEQ ID NO: 145027 - RNA, 64 nt, Human
uauucucagggucagcuguacacuuuauugaccaguacuugauaaucucucuguauaugaugaa

SEQ ID NO: 145028 - RNA, 64 nt, Human
uguaaaacucuuucaaaaauucugauaugguaagguacuugagacccuucaccagaaugucaau

SEQ ID NO: 145029 - RNA, 64 nt, Human
gcucuugaaccacuucuggcugcaccacaauucuguacuugaguaucacagucauuguuuuuga

SEQ ID NO: 145030 - RNA, 64 nt, Human
aacaucaagauaccuuugcguggaucaagcuuguguacuugaccguuuuuauauuacuuuugua

SEQ ID NO: 145031 - RNA, 64 nt, Human
uugaaccgucaaugugaaauaaagaguucuccuuguacuugaauaauaaccacgauuccaaccc

SEQ ID NO: 145032 - RNA, 64 nt, Human
uuuccacauuuagauccugguuucauaacuuccuguacuugaagucuaaaagcagaaaauaaag

SEQ ID NO: 145033 - RNA, 64 nt, Human
uuguuuuaacagaguugacuuuucaaagaaaauuguacuugaauuauuacuauaauauuagaau

SEQ ID NO: 145034 - RNA, 64 nt, Human
uuuauguauauaauaaaguuuuaaaaauuuguauguacuugacaauuccuuagaaaaaagaggc

SEQ ID NO: 145035 - RNA, 64 nt, Human
cacuagagaggucgggaggaaguuaauucucacuguacuugaagaggcuuuacauaaaggguuc

SEQ ID NO: 145036 - RNA, 64 nt, Human
ugcaucccagucuuguguuccgaagucagucggaguacuugaagaaggcccacgggcggcacgg

SEQ ID NO: 145037 - RNA, 64 nt, Human
aaauaggcaaaagacauguuggaaauguaguauaguacuugaaacagucacuaucauagggaua

SEQ ID NO: 145038 - RNA, 64 nt, Human
aaacuacucacuucuuuauuucauccuuucgacuguacuugauuaccagugaaguaagaugggu

SEQ ID NO: 145039 - RNA, 64 nt, Human
cuacuacccagguuaagaaaauaaaugucaccagguacuugagaaaccccucgauugucuaccu

SEQ ID NO: 145040 - RNA, 64 nt, Human
acuagaccuuaauuucuuuauuacagacauugguguacuugaagguuuuauauuuaaaaguauu

SEQ ID NO: 145041 - RNA, 64 nt, Human
uauuuacccugucacaagagccacugguauuuuaguacuugauuauuuuuucuuuagucacaaa

SEQ ID NO: 145042 - RNA, 64 nt, Human
ucuuuucuuuuagcuccucuguggugaauuaaacguacuugaguuaaaauauuucgauuuuuuu

SEQ ID NO: 145043 - RNA, 64 nt, Human
uguuuuuaacccucagagaacucugcauuuuaggguacuugaggcugacuuaacuaaaaguuuu

SEQ ID NO: 145044 - RNA, 64 nt, Human
gaucauaagcaagcucagaccugcccccaguucaguacuugaccacaucccaggauuuauggug

SEQ ID NO: 145045 - RNA, 64 nt, Human
uucccucaaauuuauuacaaauuuaguauuuuuaguacuugaugacucuaauuacaugaaugca

SEQ ID NO: 145046 - RNA, 64 nt, Human
cucaucccucccucccccuuuauuaccguuuuuuguacuugaugccuucucugugagcaguggc

SEQ ID NO: 145047 - RNA, 64 nt, Human
cuuuucugugacucaacugcccagacaccucauuguacuugaaaacuggaacagcuugggaaug

SEQ ID NO: 145048 - RNA, 64 nt, Human
uuaaucaguuuuuucauggauuuguguucuuacaguacuugaaaauauuuaaggaagagaugaa

SEQ ID NO: 145049 - RNA, 64 nt, Human
uuguuguuaauuuuauugcaaaguuguauucagcguacuugaauuuuucuuccucuccacuucu

SEQ ID NO: 145050 - RNA, 64 nt, Human
ugugauuuuuuuccuccuuucuucagagaagccaguacuugaaucgcuauauuucuauuuuuuu

SEQ ID NO: 145051 - RNA, 64 nt, Human
aauguaaauccuuuaucagauuuuaacuugugcaguacuugaagugaaacacaaugaaaacuuu

SEQ ID NO: 145052 - RNA, 64 nt, Human
ugggaagagacacuuuguugcaacccuuuuucaaguacuugaaaguugaaaauuugaaaucuug

SEQ ID NO: 145053 - RNA, 64 nt, Human
accuccugcuuugggugaaggagacuguaagcugguacuugagaacgaauuugccagcaugugc

SEQ ID NO: 145054 - RNA, 64 nt, Human
uaaaauuguaaauacuuuguaaacaucagcauuuguacuugaauaguaggauuuuaaagggcau

SEQ ID NO: 145055 - RNA, 64 nt, Human
cuuuuuucuuuaagauaauaguuuacauguaguaguacuugaaaucuaggauuauuaacuaaua

SEQ ID NO: 145056 - RNA, 64 nt, Human
uacccacgcauaaccacuauacauaguuucuuuuguacuugaauauacaaaacaugaacacagu

SEQ ID NO: 145057 - RNA, 64 nt, Human
uaugccaauguggugcuauuguuucuuuaagaaaguacuugacuaaaaaaaaaagaaaaaaaga

SEQ ID NO: 145058 - RNA, 64 nt, Human
uucaaagaaauauuacaacuuaaccauuaaauuaguacuugaaguugagccuuuguggugggac

SEQ ID NO: 145059 - RNA, 64 nt, Human
guacuaagaaauaagcauguuuucacuaauuuaaguacuugagacucuugaagaaaauucagaa

SEQ ID NO: 145060 - RNA, 64 nt, Human
cagucucuuaauguaucccccacucuuucagccaguacuugagaaaauuuuucugaaauauguc

SEQ ID NO: 145061 - RNA, 64 nt, Human
auucagaucacugaauuuauaaaguacccaucuaguacuugaaaaaguaaaguguucugccaga

SEQ ID NO: 145062 - RNA, 64 nt, Human
ucuggaaggauaaaacaaauacauaugggaaaaaguacuugagaccaaggccagcaucaauucc

SEQ ID NO: 145063 - RNA, 64 nt, Human
uuuauauggauaaagaugcaguauuccuuauucuguacuugauuuauuauacuuaccaaagcug

SEQ ID NO: 145064 - RNA, 64 nt, Human
uuaaauucuccugucuagaaugacccccccaccaguacuugaccaauuucauguaucaaucugg

SEQ ID NO: 145065 - RNA, 64 nt, Human
aagaagcacauccaaguuucugccucuuuuaaauguacuugacuuugcaaggcaaguaguuuua

SEQ ID NO: 145066 - RNA, 64 nt, Human
gauucaauuacggacucuggauauuugcacuuauguacuugauacugaaugcauaaauaaaugu

SEQ ID NO: 145067 - RNA, 64 nt, Human
ccuucauaauuuuugccaggcuucuguacuucuaguacuugaguuacuuaauauuuuuaaaaac

SEQ ID NO: 145068 - RNA, 64 nt, Human
ugcguuccuaaacucugaaaucagccuugcacaaguacuugagaauaaaugagcauuuuuuaaa

SEQ ID NO: 145069 - RNA, 64 nt, Human
cccuuggaccaccauuggaacaaccaagcagaauguacuugauauuauuucagggucccauugc

SEQ ID NO: 145070 - RNA, 64 nt, Human
uagguuucaaguacuccuuuucuccgauccugugguacuugaauauccaaaaacccugcacuuu

SEQ ID NO: 145071 - RNA, 64 nt, Human
gauagaucucuuaguggucuuuccaaaaguacauguacuugaaauauuuucauuaucauacuau

SEQ ID NO: 145072 - RNA, 56 nt, Human
ggcuguacuauguuaacugagugacuguacuugauuuuucaaagacuucauuuaac

SEQ ID NO: 145073 - RNA, 64 nt, Human
gaaaaguggccuguugguucaacgugguuuccuuguacuugauccuccugaaaugagagauuuu

SEQ ID NO: 145074 - RNA, 64 nt, Human
guccuacuuuuuuaauagcucgaauauuucuagaguacuugagccacauguauuucuguauuua

SEQ ID NO: 145075 - RNA, 64 nt, Human
aaaggagcccuuuuuacucaaaacacaugggcuaguacuugagguguucacugauugagaaaau

SEQ ID NO: 145076 - RNA, 64 nt, Human
gaauaaggucauugcauuuaaaaagcauauaacuguacuugacugaugagggagguguuacuuu

SEQ ID NO: 145077 - RNA, 64 nt, Human
agagaacucuaacacaaaacaucuuauuaaaauuguacuugagagacaaaaaaaaaacucuguu

SEQ ID NO: 145078 - RNA, 64 nt, Human
ccagcucagucucagccuuguguuuggucaugugguacuugagggaugcccgcugccugcacug

SEQ ID NO: 145079 - RNA, 64 nt, Human
uccaaaccaugaaaugugucaucuagacugcagaguacuugagugcuuugccucccgauaugcc

SEQ ID NO: 145080 - RNA, 64 nt, Human
uucuggccuguucaggagccucagauaaguauuuguacuugagaccaccucacacaaucuguau

SEQ ID NO: 145081 - RNA, 64 nt, Human
aacaaauauccugccaccucuaacaaguacaugaguacuugauuuuuaugguauaaggcagagc

SEQ ID NO: 145082 - RNA, 64 nt, Human
gagcuccugcucccuacagugggcugcaacuccuguacuugaagcugagaccucauaugacgug

SEQ ID NO: 145083 - RNA, 64 nt, Human
gccggugcuguugacccaagggccgugguccacgguacuugaagaagccagagcccacauccug

SEQ ID NO: 145084 - RNA, 64 nt, Human
cccuaauaauagaaguuguaccaaaaugccugugguacuugauggccuguuggucaaauaggaa

SEQ ID NO: 145085 - RNA, 64 nt, Human
aagcaaaauucaguuuauauuucacuagaacuguguacuugauugauuuucagagaaauaucac

SEQ ID NO: 145086 - RNA, 64 nt, Human
uuuccuugcccccugugucaugacuagcuuaaguguacuugacucccauagacuacucccaugc

SEQ ID NO: 145087 - RNA, 64 nt, Human
auuacaguucauaauagguaguuuggauauuuuuguacuugauuugaugugacuuuuuuuggua

SEQ ID NO: 145088 - RNA, 64 nt, Human
ggauguucacucggcacuacuucuauucagcauuguacuugaaguucuagccacagcaguuagg

SEQ ID NO: 145089 - RNA, 64 nt, Human
ugagaauaaaacuggauuuugaaauuuuacauuaguacuugacaaaaguuuucauuuugccuug

SEQ ID NO: 145090 - RNA, 64 nt, Human
guuaaggugcuucaaaggaacucugaccucugaaguacuugagcuacuuuaguauguccagccu

SEQ ID NO: 145091 - RNA, 64 nt, Human
ugggcacccaggacuuugcucugccugguggaggguacuugauuucucugggcuuccuucaucu

SEQ ID NO: 145092 - RNA, 64 nt, Human
gguuuuuacugggggucuguaggacgaguauggaguacuugaauaauugaccugaaguccucag

SEQ ID NO: 145093 - RNA, 64 nt, Human
caccucaggagacuuauuugagaggaagccuucuguacuugaaguugauuugaaauauguaaga

SEQ ID NO: 145094 - RNA, 64 nt, Human
gagccagaacguggugaacacagucaaauucaguguacuugauaauaucaacuggaccccaaau

SEQ ID NO: 145095 - RNA, 64 nt, Human
cagggccuaaguccgccuuacuccucuccuccauguacuugaacccuccagguggugccgggcu

SEQ ID NO: 145096 - RNA, 64 nt, Human
uuugcagaggcaugaaaaauuaagacgcuuuagaguacuugaaaguuguguagucauuuuauuu

SEQ ID NO: 145097 - RNA, 64 nt, Human
ucaagguuaucaaucuuggauugugaugcuauugguacuugagaauaccccuuaucugaguaua

SEQ ID NO: 145098 - RNA, 64 nt, Human
cacacuguuuacuuuuugcaugaaaaguaaauguguacuugauagagcuaaaauaugaucuuuu

SEQ ID NO: 145099 - RNA, 64 nt, Human
uauaccugugucacucucaauuuuuuccaguaaaguacuugauguaguccugugccuugaggcu

SEQ ID NO: 145100 - RNA, 64 nt, Human
guaauuugccucagucauuuuuuuaauauuugcaguacuugauuuaggaucuguggugcagggc

SEQ ID NO: 145101 - RNA, 64 nt, Human
uacagcaaggugauuauuucaagagaaucccaaaguacuugaauaagggcuauuguaaaauuua

SEQ ID NO: 145102 - RNA, 64 nt, Human
accaaguugauacuugaauaaccaucugaaagugguacuugaucauuuuuaccauuauuuuuag

SEQ ID NO: 145103 - RNA, 64 nt, Human
ugcuguauuuaacaucugccugcaaauggacaaaguacuugauaugguaaguagacaccuauga

SEQ ID NO: 145104 - RNA, 64 nt, Human
ccguauguaacagcugaccaacgugaagauacugguacuugauagccucuuaaggaaaauuugc

SEQ ID NO: 145105 - RNA, 64 nt, Human
ccaaaaaugaauguuugccuuuauuccguguuugguacuugauucacuuucuuuaaauaaaaac

SEQ ID NO: 145106 - RNA, 64 nt, Human
gaggaaaagucagauuucauuuucuacccuggauguacuugaagaaaaagaauuauuuuugcau

SEQ ID NO: 145107 - RNA, 64 nt, Human
auuugucaaaaucuuaacugaauguuuacuggaaguacuugagauuccauuugagaguuguauu

SEQ ID NO: 145108 - RNA, 64 nt, Human
gaggcccugggaggccuugugaggucacacagagguacuugagggggacuggaggccgucucug

SEQ ID NO: 145109 - RNA, 64 nt, Human
cucuugcugucuucucugucaagauugcacaguuguacuugaaucuggcauguguugacgaaac

SEQ ID NO: 145110 - RNA, 64 nt, Human
agaucuguagaucugcuauugaaucagaaucuguguacuugaacaaaugugugaaucucaaaua

SEQ ID NO: 145111 - RNA, 64 nt, Human
ggaaagccgagcggcccacggccaggucggagcaguacuugacccugagcggcgcccacgaccu

SEQ ID NO: 145112 - RNA, 64 nt, Human
uuuuagaagcagaaaaggucuuggugccucugcaguacuugauguauuggggucaaaucucuac

SEQ ID NO: 145113 - RNA, 64 nt, Human
guuuuggggugugaccucaauuucaauuuugucuguacuugaacauuaugaagaugggggccuc

SEQ ID NO: 145114 - RNA, 64 nt, Human
gcagacagaccuagugccgagggauggacaggcgagguggcagcguggagggcucggcguggau

SEQ ID NO: 145115 - RNA, 64 nt, Human
ccagugucugaccaaggucaaggggcaggugcagagguggcagggauggcuccgaagccagaaa

SEQ ID NO: 145116 - RNA, 64 nt, Human
cccuggguggagugggggagcugagcaggaggccagguggcaaccaguagcugcugggcccgug

SEQ ID NO: 145117 - RNA, 64 nt, Human
gagggcuguuggauguauggggagcuggcagagcagguggcagucacugggacaaggagggacu

SEQ ID NO: 145118 - RNA, 64 nt, Human
cugcgggaugguccuggggcucugugcagggaggagguggcagcccuguagggaacgggguccu

SEQ ID NO: 145119 - RNA, 64 nt, Human
auggucaguuucuuagggauuuacuauuugugugagguggcaucuaagggaagaauggguuuuc

SEQ ID NO: 145120 - RNA, 64 nt, Human
gggaacugucagucugggagagcucuugaucugcagguggcaaaauggcacugaauauccccuu

SEQ ID NO: 145121 - RNA, 64 nt, Human
cugaccuguccuuuucccacaggccucugggggcagguggcaaggccuggccgggccuuccuuc

SEQ ID NO: 145122 - RNA, 64 nt, Human
uggcaccaucucauugcuuuaaucccagcaacacagguggcagcuucucccccuuccuucccac

SEQ ID NO: 145123 - RNA, 64 nt, Human
gucucccaaaaaguugagccuuucuagauggcuuagguggcaccauggcucagcaggaggggcg

SEQ ID NO: 145124 - RNA, 64 nt, Human
cauucaccagcauuugcaaauguccauagggagcagguggcagccucuacucccagcaacaagu

SEQ ID NO: 145125 - RNA, 64 nt, Human
guggcagugaccauggcacuacacggcugugacgagguggcagucgcaggauuuggcuaugaca

SEQ ID NO: 145126 - RNA, 64 nt, Human
cuggagacucuggggaucuggagcugcaggcaggagguggcacuggcucccacucccaccccug

SEQ ID NO: 145127 - RNA, 64 nt, Human
auugaauuaugccaccacguuuauguaaaaaugaagguggcaccguggugagaccuaaugagaa

SEQ ID NO: 145128 - RNA, 64 nt, Human
cuaguucauugcugcagugcucccaucccccaccagguggcagcacagccccacugugucuucc

SEQ ID NO: 145129 - RNA, 64 nt, Human
aaaaaaaaaaaaaaugauuugcuuuugacgucuuagguggcagggcuguucccuccaggcaaau

SEQ ID NO: 145130 - RNA, 64 nt, Human
uuuaguaaauuaagagcauaaacaauauugcuagagguggcauguuuagucuaccaaaaacaau

SEQ ID NO: 145131 - RNA, 64 nt, Human
uggguuugcaggacuggcccacacaguccccugcagguggcagcccucuuuucuguuucucgcu

SEQ ID NO: 145132 - RNA, 64 nt, Human
uuucauugggguguauacauaucaggggacccugagguggcaccguacucaguguugugaugcc

SEQ ID NO: 145133 - RNA, 64 nt, Human
cauggccccccacucccccuucccuuggagggagagguggcaggaauacuucaccuuuccucuc

SEQ ID NO: 145134 - RNA, 64 nt, Human
ggcugcuuccugugacagugaaauacauccuucaagguggcagcuguuagggcugaaucuucug

SEQ ID NO: 145135 - RNA, 64 nt, Human
cccugcuccccuggcagcagaagugggugcaggaagguggcagugaccagcgcccuggaccaug

SEQ ID NO: 145136 - RNA, 64 nt, Human
gcguggaccccaggcccggcccgugguacccagcagguggcacugcagcuccccgcuccugcag

SEQ ID NO: 145137 - RNA, 64 nt, Human
ggaguauucuuaguucuacugguucuacacugugagguggcaaugggauuugcucagaugccac

SEQ ID NO: 145138 - RNA, 64 nt, Human
gggccuuucauuucugugggaggggcagagagguagguggcacagaagauggggcuuuaugcuu

SEQ ID NO: 145139 - RNA, 55 nt, Human
gccguggggugggaguguagagcguagguggcaauugagagagagugugcccuag

SEQ ID NO: 145140 - RNA, 64 nt, Human
ucgcauucucuacuggacucuggccugcuuggagagguggcagcaggcaccuggucuucagaaa

SEQ ID NO: 145141 - RNA, 64 nt, Human
aaaucacagcacccacuaccauacagacagcacaagguggcagcaagcaauucugccccacacc

SEQ ID NO: 145142 - RNA, 64 nt, Human
agaagacagggagucaucgaagggcugcucggggagguggcagggcggaggaccugcuugggaa

SEQ ID NO: 145143 - RNA, 64 nt, Human
gggccguguuaagauuuuuuuugcuacaaagaggagguggcaaugguagauccacccuuaugcu

SEQ ID NO: 145144 - RNA, 64 nt, Human
cuagccauuucauuaaaucuauucuguauccaccagguggcagcaucuugucauacgugucagg

SEQ ID NO: 145145 - RNA, 64 nt, Human
auacggaguuggaugggggccgagugagguaaccagguggcaucuaccccauguuuuauaagga

SEQ ID NO: 145146 - RNA, 64 nt, Human
caaucagucccucaggaaagggaagaaaaagaagagguggcaccaugaagaggagaagaugggg

SEQ ID NO: 145147 - RNA, 64 nt, Human
uugaaggaagguuuucuccacuuuguuggaaagcagguggcaucucuaauuggaagaaauuccu

SEQ ID NO: 145148 - RNA, 64 nt, Human
gauaaaaggacucauuuaagcucacauggucaguagguggcagagcuacuaguagggaaagaag

SEQ ID NO: 145149 - RNA, 64 nt, Human
aucagccucugggccaaggaggguccuacagacaagguggcaucucaaccucacccaagaaacc

SEQ ID NO: 145150 - RNA, 64 nt, Human
uugaagacguggacggaggaggggccccgacgacagguggcaacaaugccccgagugguggcag

SEQ ID NO: 145151 - RNA, 64 nt, Human
cgguggugaggcuguugugugcgcggaugaggggagguggcaggagagaauucuacauuuaggg

SEQ ID NO: 145152 - RNA, 64 nt, Human
gguuuccauguaaaaucucuguuguggugggcauagguggcaccaucuaaagaaaagaggucuu

SEQ ID NO: 145153 - RNA, 64 nt, Human
ggcaaggcugagguggcuaagggggaccauggggagguggcacuagggaucaaagaagaugguu

SEQ ID NO: 145154 - RNA, 64 nt, Human
uagccugggaaggagacaggacauuccuguacuaagguggcacagagcuguccuuugcaacauu

SEQ ID NO: 145155 - RNA, 64 nt, Human
accggcugaccccucaggagggauugcaggccccagguggcagccucagagaggaggcgcaggc

SEQ ID NO: 145156 - RNA, 64 nt, Human
ucuggccucugccagggaccucugaguagcucugagguggcacuguccagcccuggauaggggg

SEQ ID NO: 145157 - RNA, 61 nt, Human
aauuaaauauaaaugacugaacucagccuagagguggcagcuuggucuuugucuuaaaguu

SEQ ID NO: 145158 - RNA, 64 nt, Human
uaucuugucagaguccaucacuaaucuaaaacaaagguggcacuuuuuuauguuaaccuuaaac

SEQ ID NO: 145159 - RNA, 64 nt, Human
caaaagaaauaaggugccacaguuuuaaaccagaagguggcacucuguggcuccuuguaguauu

SEQ ID NO: 145160 - RNA, 64 nt, Human
gacuguguuguuaguuaucccucaacaucuucuaagguggcaggaaauaauauuggaaauaaca

SEQ ID NO: 145161 - RNA, 64 nt, Human
uagaaaguucugggugugagguguacagcagucuagguggcauagugaugaagaaagggaucag

SEQ ID NO: 145162 - RNA, 64 nt, Human; identical to SEQ ID NO: 84479

SEQ ID NO: 145163 - RNA, 64 nt, Human
auuacuuuucuaggauuauuaauaaaagccacauagguggcaaguuguaguuuuauauggcucu

SEQ ID NO: 145164 - RNA, 64 nt, Human
caugugguuaaugccauggacagaagaaggcagcagguggcagaauggggugcaugaagguuuc

SEQ ID NO: 145165 - RNA, 64 nt, Human
agguaaagugucuuuucaauauaaccagcaauuuagguggcaucuauaaaauaaaaaauuucua

SEQ ID NO: 145166 - RNA, 64 nt, Human
ccggggccuggguggcgggugggggccgggugggagguggcaguagucuuagccugugcacucu

SEQ ID NO: 145167 - RNA, 64 nt, Human
auucagcaccuauuuugaauuaaugugagaccacagguggcaggcagauuccugcuuggcauaa

SEQ ID NO: 145168 - RNA, 64 nt, Human
ugaucuuuauacuaauugcagcuuucaggcuacuagguggcauaguguuaauuaggacucccca

SEQ ID NO: 145169 - RNA, 64 nt, Human
gugcagauuuccguuugaauaaagcuucgcuucuagguggcacuguuugccuuaauacccugac

SEQ ID NO: 145170 - RNA, 64 nt, Human
accucggcaacagucuaagaugagagccugugacagguggcagcgcccccaggugggguacugg

SEQ ID NO: 145171 - RNA, 64 nt, Human
ggaauagucucagaucuaaaauuuccucuauauaagguggcauauguuaaguuuugcuucauug

SEQ ID NO: 145172 - RNA, 64 nt, Human
gggggcucugggaagcacaggccagcaccuccccagguggcaggaucuggcuuggggugcccgg

SEQ ID NO: 145173 - RNA, 64 nt, Human
ggcuucaccagcccugugcgggcucugggggcagagguggcagaaauggugcugggcacuagug

SEQ ID NO: 145174 - RNA, 64 nt, Human
guugaugugaccgaggaaucccuucuagaaucauagguggcaagggaggguuugcuagcucucc

SEQ ID NO: 145175 - RNA, 64 nt, Human
gucuucauuucccucccaccgaaccuugauuucaagguggcacccagcauccugaagccaagaa

SEQ ID NO: 145176 - RNA, 64 nt, Human
caaaguucuggaaagcuccuuuugccaucugcugagguggcaaaacuauaauuuauuccugguu

SEQ ID NO: 145177 - RNA, 64 nt, Human
cuggcugauucagcauuuuuuaucaggcaggaccagguggcacuuccaccuccagccucugguc

SEQ ID NO: 145178 - RNA, 64 nt, Human
ggcaggagugaggcucacaacucagccucgcaagagguggcagaggcacaggaggccacagucc

SEQ ID NO: 145179 - RNA, 64 nt, Human
uuuaguaaacuaaccacugucaaugauugagggcagguggcacguggggaagaggggacuuggc

SEQ ID NO: 145180 - RNA, 64 nt, Human
cugccagcaggcccagggaucccugaccugcaccagguggcaccaaggguccugaguccuggag

SEQ ID NO: 145181 - RNA, 64 nt, Human
agaggugagcacggccaacaaagcuguugaugguagguggcacacugggugcccaagcucagaa

SEQ ID NO: 145182 - RNA, 64 nt, Human
cccccuccccuucuccuuaagagacaauuucugcagguggcaggugagcaagcccaggagaaug

SEQ ID NO: 145183 - RNA, 64 nt, Human
gccccaaacuuucucauaagcaccuaaaacccaaagguggcagcuugugaagauuggggacacu

SEQ ID NO: 145184 - RNA, 64 nt, Human
uaacauuguauguauauguguuugcuuugggaggagguggcacuguguuaguugacaguugugg

SEQ ID NO: 145185 - RNA, 64 nt, Human
ccugccacucgcaucugggcaauguugacauuugagguggcaggcaggaugccugccuucuaau

SEQ ID NO: 145186 - RNA, 64 nt, Human
uuuaaucuucgaaucaugacacugagugcagaggagguggcauuccgacagcaggacauacaug

SEQ ID NO: 145187 - RNA, 64 nt, Human
acuggaaauaauuuauucauugcagauacuuuuuagguggcauuuuauucauuuccugugcuuu

SEQ ID NO: 145188 - RNA, 64 nt, Human
uaagaauguuuugcacugacagugggaggggauaagguggcagaaggaaccugagcaggacccc

SEQ ID NO: 145189 - RNA, 57 nt, Human
ugauccucuaugaggugugacccugggagguggcagacagaagcacccccugccccg

SEQ ID NO: 145190 - RNA, 64 nt, Human
aggggagcaggaaucaggagcucgguggauuugcagguggcaggccagggauuuguaccauggg

SEQ ID NO: 145191 - RNA, 64 nt, Human
acccuugguacugugaaaaggcuucuuggcagccagguggcauugaggaugguauucagggcgc

SEQ ID NO: 145192 - RNA, 64 nt, Human
cagcaacuucauauuuguauaugugagcugugagagguggcauucacuuaacuggcccagcccu

SEQ ID NO: 145193 - RNA, 64 nt, Human
gguuccaagcccuggagccaacugcugcuuuuugagguggcacuuuuucauuugccuauuccca

SEQ ID NO: 145194 - RNA, 64 nt, Human
ucgggaggcugaggcaggagaauugcuugaaccaagguggcagagguugcaguaagccaagauc

SEQ ID NO: 145195 - RNA, 64 nt, Human
cucuuugugcccugcuguuuauucuguaaggggaagguggcaaugggacccagcuccaucagac

SEQ ID NO: 145196 - RNA, 64 nt, Human
auuucagaaacuggaguagguucuuugccagugcagguggcaugaacugcauggaggcauaaca

SEQ ID NO: 145197 - RNA, 64 nt, Human; identical to SEQ ID NO: 84485

SEQ ID NO: 145198 - RNA, 64 nt, Human
caccacuuccuguuggcccuggccuggccggggaagguggcagcggcaccggacugaccugcag

SEQ ID NO: 145199 - RNA, 64 nt, Human
auguugggcauguggacccaagcaccugggaaggagguggcaucugagacagccugauacguuc

SEQ ID NO: 145200 - RNA, 64 nt, Human
cugcugaauaggacauugcaugggaagaguacagagguggcagaaugaagcuagagugggaagg

SEQ ID NO: 145201 - RNA, 64 nt, Human
caccaaugucagcaagaacucaaccugaauuuaaagguggcauuccauauacuaacauccccca

SEQ ID NO: 145202 - RNA, 64 nt, Human
aaaaaaaaguucuacuuuucaucagugcuauuaaagguggcagcaaauguaaaucuuggcugaa

SEQ ID NO: 145203 - RNA, 64 nt, Human
uuauaaccuuauuaacuaugcauaggccuaagaaagguggcaaugaacugugcauguaaauuuu

SEQ ID NO: 145204 - RNA, 64 nt, Human
cagugcccuccuacccccaggguugaggggaccaagguggcacggugguacugggggugcggca

SEQ ID NO: 145205 - RNA, 64 nt, Human
aagaaagucacagcacugaugaggacagcugcagagguggcaguguguggacacaggaaguuug

SEQ ID NO: 145206 - RNA, 64 nt, Human
aaaaagcacaaaacugcaggacaguuuaugaaauagguggcacuauuagggaaucuuccuuuaa

SEQ ID NO: 145207 - RNA, 64 nt, Human
uuauccucucuuaugaacaacuguagucaaaauaagguggcacaauuuaauuguuuuguaucag

SEQ ID NO: 145208 - RNA, 64 nt, Human
uccauauacauucuucaaugcauauguugcucaaagguggcaaguuguccuggguucugugagu

SEQ ID NO: 145209 - RNA, 64 nt, Human
uagcauuaaaaaugcacacauuacuccagguggaagguggcaauugcuuucugauaucagcucg

SEQ ID NO: 145210 - RNA, 64 nt, Human
uaugaauaauauugcagugugucuugucagcuguagguggcaaaggugcccuuauaaaaaagga

SEQ ID NO: 145211 - RNA, 64 nt, Human
cccagucacagaguggaguugugaauucauguagagguggcaaaccucuaccuuguguugauga

SEQ ID NO: 145212 - RNA, 64 nt, Human
cacuugccuguagucucagcuacuuaggaggcugagguggcagaauagcuuaugccuaggaggu

SEQ ID NO: 145213 - RNA, 64 nt, Human
aagggaccagacuuucuaaaucuuacaacucaagagguggcagccacccucuaggagacaaaac

SEQ ID NO: 145214 - RNA, 64 nt, Human
ucucaggggucacccugucuuagagcuagagaugagguggcagggagggaggcuguguccucag

SEQ ID NO: 145215 - RNA, 64 nt, Human
cagagacacaguguaggggccaugcagcuggcguagguggcaguugggccuggugaggguuagg

SEQ ID NO: 145216 - RNA, 64 nt, Human
caacaggcuugguccgggcagccugcucugcggaagguggcagccuccuggugcugggcucccu

SEQ ID NO: 145217 - RNA, 64 nt, Human
uuggcugcucacuguccacaugugaacuuuuucuagguggcaggacaaauugcgcccauuuaga

SEQ ID NO: 145218 - RNA, 64 nt, Human
uuuacagaugguuuuaaaauugagguaauaucugagguggcauaauuuaaaaauauuuagcaaa

SEQ ID NO: 145219 - RNA, 64 nt, Human
ccuccgagcauguccaucaccugcucuuuggcuaagguggcaguguaccucuagaucaaccugg

SEQ ID NO: 145220 - RNA, 64 nt, Human
uugccacuggugaugauagauuucaaaaaacaaaagguggcagcagcacaauguucauggugaa

SEQ ID NO: 145221 - RNA, 64 nt, Human
ugaugaugggagggggcuccguccugcaggcuggagguggcauccacacuggacagcagggagg

SEQ ID NO: 145222 - RNA, 64 nt, Human
ggucucaugcucugaaauggcgugcccucugcccagguggcacugccaggugcguagacagacg

SEQ ID NO: 145223 - RNA, 64 nt, Human
uuuucauacauuuugcuucuugcccagcagggacagguggcagagccgaggcuuagggucuggc

SEQ ID NO: 145224 - RNA, 64 nt, Human
cuacccaugcucuguguccaggcuugcuccuggcagguggcauucaucucagaugugagcacaa

SEQ ID NO: 145225 - RNA, 64 nt, Human
accaguuauguccaagaauggcuuucccucgggcagguggcagcggccaucucccacugggaau

SEQ ID NO: 145226 - RNA, 64 nt, Human
auuggguucaaaugcugaugaguaggacauuuagagguggcagugucuggaucuaccuugguag

SEQ ID NO: 145227 - RNA, 64 nt, Human
gcacuacauuuuggcggcugccggccucugggggagguggcaguuaugcuguuacuagugauuu

SEQ ID NO: 145228 - RNA, 64 nt, Human
cagcucuccggucucugcugaugaaaugggcuccagguggcagugcccgggucccaggugccgu

SEQ ID NO: 145229 - RNA, 64 nt, Human
aguuuuguuucaauuagaaaaggaaauagguuuuagguggcauaguggcuuaacuggacugaau

SEQ ID NO: 145230 - RNA, 64 nt, Human
acaacuguugaaaacuccagaaauacaucacccaagguggcaguucucaguauuuggcagaaca

SEQ ID NO: 145231 - RNA, 64 nt, Human
ucacucagcuuacugggcugaggcgucuguggagagguggcaccggggcugcagagggcggcug

SEQ ID NO: 145232 - RNA, 64 nt, Human; identical to SEQ ID NO: 84491

SEQ ID NO: 145233 - RNA, 64 nt, Human
gcacagccccgggaaauccgguaccaagugagcaagguggcaggacccacccaagccugauacg

SEQ ID NO: 145234 - RNA, 64 nt, Human
uaauucgaaaauaggcagaauuccauuccucccaagguggcaaaaauuagcuauacugauguaa

SEQ ID NO: 145235 - RNA, 64 nt, Human
uuguauaaauacaccagguguuuuuaauuuaauaagguggcaugcagauacauuggauaguguu

SEQ ID NO: 145236 - RNA, 64 nt, Human
gaggaggacggggaaccggauuacgugaauggggagguggcagccacagaagccuagggcagac

SEQ ID NO: 145237 - RNA, 64 nt, Human
ggugcccccauugccucaggcuggcccuggucccagguggcagcgguugaggagggguacaggg

SEQ ID NO: 145238 - RNA, 57 nt, Human
aggagccgcuggugcagugagcauagcagguggcaggcagcaccaucauucaucuuu

SEQ ID NO: 145239 - RNA, 64 nt, Human
aucugaggcuccccaaacgaggacacgacggccaagguggcaguuugucccacgggaggacagu

SEQ ID NO: 145240 - RNA, 64 nt, Human
ccuaccaucagggacaggaugaccuggauaacuuagguggcaagcugugacuucuccaggucuc

SEQ ID NO: 145241 - RNA, 64 nt, Human
cacuggccaccccuccccaguacaggggugcugcagguggcagagugaaugucccccaucaugu

SEQ ID NO: 145242 - RNA, 64 nt, Human
cugcaguuaccauggcaugcugaguugaugcaccagguggcagcagccauccguuauuauuucc

SEQ ID NO: 145243 - RNA, 64 nt, Human
ugccuaugcauuuacucuuuccugauuuaggcagagguggcauuuucuuuauugcauuucucua

SEQ ID NO: 145244 - RNA, 64 nt, Human
augauggggcgucggugcuguuugaggcagcaggagguggcaaucccgacugcauuucccuccu

SEQ ID NO: 145245 - RNA, 64 nt, Human
aaauaagaaaauacauaagaccauaacagccaacagguggcaggaccaggacuauagcccaggu

SEQ ID NO: 145246 - RNA, 64 nt, Human
accugcucccacaggggccauguccucucuuaauagguggcacuaccccaaacccaucuuuugu

SEQ ID NO: 145247 - RNA, 64 nt, Human
uggagcauucugcccaggcuacguggguucaggcagguggcagcuucccaaguauucgauuuca

SEQ ID NO: 145248 - RNA, 64 nt, Human
gcaaauccuugugggaaaagaaaucuaugauuccagguggcaucagugucuuuccacuccuccu

SEQ ID NO: 145249 - RNA, 64 nt, Human
gaggcaggagaaucgcuugaucccaggaaggcagagguggcagugagcugagaacgcacaacug

SEQ ID NO: 145250 - RNA, 64 nt, Human; identical to SEQ ID NO: 84497

SEQ ID NO: 145251 - RNA, 64 nt, Human
agggcacauaccuaccuggggcaugacaucugucagguggcaccgagcaggaugcggggaugga

SEQ ID NO: 145252 - RNA, 64 nt, Human
uugauuuuguauaagcuauuuagagugaggcuggagguggcagcuucacagaacuggagaacca

SEQ ID NO: 145253 - RNA, 64 nt, Human
gucaacuugugugcuauaucucugaggaauggugagguggcaugggagaugucugugcuuggag

SEQ ID NO: 145254 - RNA, 64 nt, Human
aggagugguacuuaaaccagacagcaggguucagagguggcacaccgggacaaagcugaggccc

SEQ ID NO: 145255 - RNA, 64 nt, Human
ggaggguagccuuguggcugagaggggucagacuagguggcacaggggcuccuggaaagacagc

SEQ ID NO: 145256 - RNA, 64 nt, Human
accauggggcccaggaguuggggaaacacaauaaagguggcauacgaaggaaaggcugguagca

SEQ ID NO: 145257 - RNA, 64 nt, Human
ggaguagccgagcuccagcucgcugugcccgcucagguggcacggcuggccuggacccugcccc

SEQ ID NO: 145258 - RNA, 64 nt, Human
ggcaccgugacucggcugccugugcagaagguggagguggcaggcggauggccagggagccaug

SEQ ID NO: 145259 - RNA, 64 nt, Human
agaugugucccccccaggccuuguccuacguccaagguggcagaugucuucccugggcugccac

SEQ ID NO: 145260 - RNA, 64 nt, Human
aggucccuggcucccagcuggagauaggaggcccagguggcagguagcaggaggcccagaucac

SEQ ID NO: 145261 - RNA, 64 nt, Human
cacaugccugugguuccagccacucaggaggucgagguggcaggaugguuugagcacaggagac

SEQ ID NO: 145262 - RNA, 64 nt, Human
cucuaaagcagagauguauuauggugauacuccaagguggcauagccauucauuuacaacuucc

SEQ ID NO: 145263 - RNA, 64 nt, Human
gaaacacacggggaccucucucucuagcuccagcagguggcaccucgguacccagcggguaggg

SEQ ID NO: 145264 - RNA, 64 nt, Human
agccuucaucaggaagggaaagggcuuuggggucagguggcagcuauuccccaccaagagauuc

SEQ ID NO: 145265 - RNA, 64 nt, Human
ccgccgaagaaguaacuuguuaaauguaaugggaagguggcagacuuaagaacguggauaugaa

SEQ ID NO: 145266 - RNA, 64 nt, Human
gguaggaaagcuuguccugaccccagcagcaaagagguggcaggucgcuaaugaauauaugcuu

SEQ ID NO: 145267 - RNA, 64 nt, Human
ugaggaagggucugccccgagcuuucugguuggcagguggcagcaggaugguggguguucagcc

SEQ ID NO: 145268 - RNA, 64 nt, Human
caucuuucaagucagagcaaugaguugggaaaagagguggcauuucugaucggauaauggaaua

SEQ ID NO: 145269 - RNA, 64 nt, Human
aaaaaacagccucuucuuggaaagugacagcagaagguggcauggagcuuguguccuuggacaa

SEQ ID NO: 145270 - RNA, 64 nt, Human
uucucugcuccccugggugaugggugggcccagaagguggcagucccacaccuuguccucccac

SEQ ID NO: 145271 - RNA, 64 nt, Human
ugaacuggccuuugggaaagaucagagagggcagagguggcacaggacaguaaaggagaugcug

SEQ ID NO: 145272 - RNA, 64 nt, Human
guuccuccuucauuucucucaagggaaauggcuaagguggcauugucucauggcucucguuuuu

SEQ ID NO: 145273 - RNA, 64 nt, Human
cugguagugagcagcaaaugccuuucaagaaaauagguggcagcuucacuccaugucauauaug

SEQ ID NO: 145274 - RNA, 64 nt, Human
uaccuuugucauuucauccucauggccacccuggagguggcauuguguaaccucaucuugcaca

SEQ ID NO: 145275 - RNA, 64 nt, Human
auugcugaguuugagguggugccaccaguuuugcagguggcaucagaggcuggcaugcuggcag

SEQ ID NO: 145276 - RNA, 64 nt, Human
gguuuuagcaacacggguggcaagcagaucaaccagguggcauuggaggcguggcgcagccggc

SEQ ID NO: 145277 - RNA, 64 nt, Human
ggcuccuccccgcacugagccauguuccuaugucagguggcagcggggaagcgaggguccaauc

SEQ ID NO: 145278 - RNA, 64 nt, Human
cuggcguccccggagcccagugcuggcccccuacagguggcagccccugcccacucccaugcug

SEQ ID NO: 145279 - RNA, 64 nt, Human
uccugcgggaagccaucagcuugggccagcuggcagguggcaggaauggagaagcugacccugc

SEQ ID NO: 145280 - RNA, 64 nt, Human
acgucuuaagcaagcgaccccccgacauagcaaaagguggcaacccauggaggcagaaagaagg

SEQ ID NO: 145281 - RNA, 64 nt, Human
gaacgucacauuggccgagccguguucaguucccagguggcagacucguuuuugguaguuuguu

SEQ ID NO: 145282 - RNA, 64 nt, Human
cuucaugggccgagcuugcccuuaugaggcccacagguggcagugggcagaggggaccccgcua

SEQ ID NO: 145283 - RNA, 64 nt, Human
acuguuuccacacagcgggaaggcugcugggaacagguggcagagaagugccauguuugcguug

SEQ ID NO: 145284 - RNA, 64 nt, Human
ccgccacaucccucucugcuggacguccagguggagguggcauccccacguggacaagaaaguc

SEQ ID NO: 145285 - RNA, 64 nt, Human; identical to SEQ ID NO: 84503

SEQ ID NO: 145286 - RNA, 64 nt, Human
uuggaggaggggcuaggacagccgugggugucaaagguggcauuugaggcucguuugaggugac

SEQ ID NO: 145287 - RNA, 64 nt, Human
cuacacaaugugaauucaagugccugauuaauugagguggcaacauaguuugagacgagggcag

SEQ ID NO: 145288 - RNA, 64 nt, Human
ggcccggccgcccugucuccgcaggcuagauccgagguggcagcuccagcccccgggcucgccc

SEQ ID NO: 145289 - RNA, 64 nt, Human
cuccucugcuccccacuuuguagagccuagcaugagguggcauguacuagaauuggauccuagg

SEQ ID NO: 145290 - RNA, 64 nt, Human
ucauaucuagugccccacagugugugucaaccaaagguggcaguggcuacaucugccuguugga

SEQ ID NO: 145291 - RNA, 64 nt, Human
gaucagcgcauucucuaggccaaaagggcuagccagguggcaagaucaauuuagcuacuuugua

SEQ ID NO: 145292 - RNA, 64 nt, Human
uuucgcuccagaaaggccguagcaguuugacgauagguggcaaaaccuuaagauuguguacugg

SEQ ID NO: 145293 - RNA, 64 nt, Human
cugagcucaccugucucucugacugccuuggaguagguggcauaaccuugugcacagagaacua

SEQ ID NO: 145294 - RNA, 64 nt, Human
cacauuuaagaaguagguguguggccuuuucagaagguggcaugguccucaagugaguucuuag

SEQ ID NO: 145295 - RNA, 64 nt, Human
aggacaagacuuaccaaagguaauacucgugaguagguggcagauguagcaaaaacuucacaac

SEQ ID NO: 145296 - RNA, 64 nt, Human
aacuagaacccacauguuggucuaaacccugagaagguggcagugaggaaguauccccucaggu

SEQ ID NO: 145297 - RNA, 64 nt, Human
gagacacgcagaccagcugaggaggacaaagauaagguggcauucacccccaggcucugacuuu

SEQ ID NO: 145298 - RNA, 64 nt, Human
gcugggacccuccaggggugagaaggaagggagaagguggcauaacuuuuuggaacaaaagaaa

SEQ ID NO: 145299 - RNA, 64 nt, Human
ccugccccaggcggucaggguuauggcacgaugcagguggcacucaggggcuaacuucaggcug

SEQ ID NO: 145300 - RNA, 64 nt, Human
ggccacugccuagcuggaaugggaggaagccugcagguggcaccgguggcccuggcugcaguuc

SEQ ID NO: 145301 - RNA, 64 nt, Human
uauaaacguccucugugcuggguguuucugcugcagguggcagguggccccaggccuguuugga

SEQ ID NO: 145302 - RNA, 64 nt, Human
guugugccagccugccuuuggcagcugcaagcugagguggcagcucugaccaccucuggcccca

SEQ ID NO: 145303 - RNA, 64 nt, Human; identical to SEQ ID NO: 84509

SEQ ID NO: 145304 - RNA, 64 nt, Human
guuugagcccaggaguuugagaccaaccugaguaagguggcaaaaccccaucucuaccaaaaau

SEQ ID NO: 145305 - RNA, 64 nt, Human
ggcaguucugagaagucacuggucuagaucccgcagguggcacgugacagcuaggguucaaaac

SEQ ID NO: 145306 - RNA, 64 nt, Human
ccaggacaguggagucagcaguaagcccugggacagguggcaagggugggucccuugaccuuug

SEQ ID NO: 145307 - RNA, 64 nt, Human
uucuuguaauuuuuauuuaggaaguguugaagggagguggcaagaguguggaggcugacgugug

SEQ ID NO: 145308 - RNA, 64 nt, Human
uuucuaccuuuuugccaguuugaagcuuugcaucagguggcaaaauucauucuaugugccguuu

SEQ ID NO: 145309 - RNA, 64 nt, Human
ccccugggcaucagaacagccugcccugggcaccagguggcagacacacucagagcaugucugg

SEQ ID NO: 145310 - RNA, 64 nt, Human
auaauguugauaacagugcuuggcaccuggaaguagguggcagauguuaacgcccuuccucccu

SEQ ID NO: 145311 - RNA, 64 nt, Human
guaaucacugccuggugucacuuagaagaaggagagguggcaguuuauuucucaaaccagucau

SEQ ID NO: 145312 - RNA, 64 nt, Human
cuauuuauucaccaaaagccccaggcauuucagaagguggcacucaggucacccugaaaagccc

SEQ ID NO: 145313 - RNA, 64 nt, Human
cuuugguuccagagagagagaagaugcuugugccagguggcaccagaguuugccaauugauccu

SEQ ID NO: 145314 - RNA, 64 nt, Human
uucuagaacugguagcucggucguuucgcacacuagguggcauacaggcagcagcagguguuca

SEQ ID NO: 145315 - RNA, 64 nt, Human
ccgcuucccccuccaacccacagccuuugcuuccagguggcaggauuacuacuuugccucuuca

SEQ ID NO: 145316 - RNA, 64 nt, Human
agcccuaaugcaacucacccucauccuggugcuuagguggcagagggugggcagcaggggacag

SEQ ID NO: 145317 - RNA, 64 nt, Human
ucagacccagugguccugugacugcugaggaccaagguggcauccuagggcaggaugaacuggc

SEQ ID NO: 145318 - RNA, 64 nt, Human
gccuaccacuuggccagugcccacccagccccucagguggcacaucuggagggcagggguugag

SEQ ID NO: 145319 - RNA, 64 nt, Human
uggguccccuccaggaaccaaggaguggcccuccagguggcagcacuaaggacacccccccaca

SEQ ID NO: 145320 - RNA, 64 nt, Human
uauuuaaggaagaagagaaugacucuguuauuaaagguggcauggagacuguggagggaauauu

SEQ ID NO: 145321 - RNA, 64 nt, Human; identical to SEQ ID NO: 84515

SEQ ID NO: 145322 - RNA, 64 nt, Human
ggcugaaggaagcuccagacucaaugugacccccagguggcaucgccaacuccugccucgugcc

SEQ ID NO: 145323 - RNA, 64 nt, Human
cuucuccuuuucucacuuccuuuccugccucgggagguggcagggcaguucccuggcugaggcc

SEQ ID NO: 145324 - RNA, 64 nt, Human
ucuuaaaaugaacauucuuuaaaguuggacaggaagguggcauuucuuauuuauuaacauuuuu

SEQ ID NO: 145325 - RNA, 64 nt, Human
ugaccauuuaguuuaguuaaaaaaaaaaaaaaaaagguggcaggagaggcuuuggggaggauca

SEQ ID NO: 145326 - RNA, 64 nt, Human
ccacucagagggccacacccagcgaugccagugaagguggcacagccucucuucaguuucuccu

SEQ ID NO: 145327 - RNA, 64 nt, Human
aagaucuugacccagggcgacuugguuuugcuuaagguggcaucaccaauguuccaaauccuuu

SEQ ID NO: 145328 - RNA, 64 nt, Human
acauuuuaguuugggcuaguguccugccucuuagagguggcauuguguaaaucugagcuuugag

SEQ ID NO: 145329 - RNA, 64 nt, Human
cccacuugcuggugaauaauucauguuggcugcuagguggcagcacuccgagguaucuaaaggg

SEQ ID NO: 145330 - RNA, 64 nt, Human
cagggucagugcugagacuguugaagcucucaauagguggcaguuuuagggaagauuuccauuc

SEQ ID NO: 145331 - RNA, 64 nt, Human
ggcaucacaagccagugaugcuccugggaagaccagguggcaggucgcaguuggguaccuucca

SEQ ID NO: 145332 - RNA, 64 nt, Human
cagagggcacuguccgccagggcugggcaggcucagguggcaaggacggagcuguccccuagug

SEQ ID NO: 145333 - RNA, 56 nt, Human
gcgauucugaccuggagugagacugcagguggcaggggcuccuuggccuccagcuc

SEQ ID NO: 145334 - RNA, 64 nt, Human
gcagcacaggcugacaaaauggaagcaaagcaagagguggcaacaauuuugaaagaccaaaagu

SEQ ID NO: 145335 - RNA, 64 nt, Human
cuugguauuuacuguauguaagcaacaacuugaaagguggcaauauggugucgauuuggacuau

SEQ ID NO: 145336 - RNA, 64 nt, Human
ggcuaaggcuggguccuccccucugagguuucucagguggcaauguaacucauuuuuuuguccc

SEQ ID NO: 145337 - RNA, 64 nt, Human
accuggucucaaggcaggcccugcaguuccacagagguggcaggucuugcccuuuggccaacag

SEQ ID NO: 145338 - RNA, 64 nt, Human
uaagucuuacuuauuauacccucgugagggugggagguggcagcuauguuaauuuauugauauu

SEQ ID NO: 145339 - RNA, 64 nt, Human; identical to SEQ ID NO: 84521

SEQ ID NO: 145340 - RNA, 64 nt, Human
agcaauagagaaaaaaauucaugcaucucaacaaagguggcagcaguugaaggaagagauugag

SEQ ID NO: 145341 - RNA, 64 nt, Human
ugagaggagguaaugaaaauggggacaggauaaaagguggcaacuaaauuuaaagcacagaaga

SEQ ID NO: 145342 - RNA, 64 nt, Human
aucuauuaccagcauaaugcauuguaagauggcaagguggcauuuugaaagagcgcugggcaag

SEQ ID NO: 145343 - RNA, 64 nt, Human
accagugcaagugacgcacagccccgccccccggagguggcagcagccccgagggacgccccca

SEQ ID NO: 145344 - RNA, 64 nt, Human
cagggaccacccacaguaagcaccauggucagggagguggcaggaggugcaaagacagaaguau

SEQ ID NO: 145345 - RNA, 64 nt, Human
aggucccgcccacccugccuaaggaacugcagagagguggcaaaucagcaaaaaggacaccagg

SEQ ID NO: 145346 - RNA, 64 nt, Human
augagauaagauugaguucugaugcguuaaacggagguggcagaaauuugucaagaaggccuua

SEQ ID NO: 145347 - RNA, 64 nt, Human
ugacuauguuucacccgcuucaugacuaaaucacagguggcagaauuuuucaguucuuuuuuuu

SEQ ID NO: 145348 - RNA, 64 nt, Human
ugaguacccuggcgggaggcuggcccacacagaaagguggcaagaagaucgggaagacugagua

SEQ ID NO: 145349 - RNA, 64 nt, Human
ccacccaccucuggaagacuggcugugaaaagucagguggcagaaaccuggggccacauagagc

SEQ ID NO: 145350 - RNA, 64 nt, Human
cugcucagcugcagaaugacugcccuagaaaagcagguggcagaaauuuuaaaaauacugucgg

SEQ ID NO: 145351 - RNA, 64 nt, Human
ugaagacuucgcacagucuccuccgcacagggugagguggcaguggcagcacgucuuccucaug

SEQ ID NO: 145352 - RNA, 64 nt, Human
ugcgugccuguagucccagcuacuuggggggcugagguggcaggaucgcuugagccugggaggu

SEQ ID NO: 145353 - RNA, 64 nt, Human
aaaaaauaacaccccauuaccaaaagaaaagguaagguggcaaccuuauuuuuaauaguuugaa

SEQ ID NO: 145354 - RNA, 64 nt, Human
gcaggcaggccccagcgccgagacuccuggugacagguggcaccugucccacagcccucguccc

SEQ ID NO: 145355 - RNA, 64 nt, Human
gggaggaagggcagaugaacccagcaggcuuaggagguggcacugggugaggacagcugggcag

SEQ ID NO: 145356 - RNA, 64 nt, Human
aaaacaagaggucuggcacuaguagcacaaccuaagguggcauuacagaucuuugagcgagcca

SEQ ID NO: 145357 - RNA, 64 nt, Human; identical to SEQ ID NO: 84527

SEQ ID NO: 145358 - RNA, 64 nt, Human
cugucaucacgcagugcuucagagccucgggcucagguggcacggucccaggguccaggcugag

SEQ ID NO: 145359 - RNA, 64 nt, Human
aucaguguagaagaauaccucaugugcagaugcuagguggcaggccagucucauucaucugacu

SEQ ID NO: 145360 - RNA, 64 nt, Human
auuuucuaaucucuagaaaucucugcuguucaaaagguggcagcacugaaaguuguuuuccugu

SEQ ID NO: 145361 - RNA, 64 nt, Human
cgugcagggccugccuagcuugcgugcuugaggaagguggcauuccgugcuugccuccuugagg

SEQ ID NO: 145362 - RNA, 64 nt, Human
aauugcauuccauggguuggguauuuagaaauguagguggcauuuagaacacaauguuuaauca

SEQ ID NO: 145363 - RNA, 64 nt, Human
uacuccaaugagaugugaaccagccacgccuaccagguggcagagcuggggccauugggacagg

SEQ ID NO: 145364 - RNA, 64 nt, Human
gcuugauucugcuacccugaccccaccaugugccagguggcaucugccuuacugccuucccuga

SEQ ID NO: 145365 - RNA, 59 nt, Human
ccaaaucucccggcagcuaaaccagagucagguggcauggacagggagucguccgcccu

SEQ ID NO: 145366 - RNA, 64 nt, Human
uaucccccuacaagaaugggcaccuccugcccgcagguggcauuuuaaaacuuggcuuuagcca

SEQ ID NO: 145367 - RNA, 64 nt, Human
cugcuggcuucuguagaggcugcccagaggggccagguggcacaaauaagagaggggagauggg

SEQ ID NO: 145368 - RNA, 64 nt, Human
uuaguaacagugggguuucucuuugccccaggugagguggcauauucagaggagccuguuggca

SEQ ID NO: 145369 - RNA, 64 nt, Human
gauuaaguuaccggcccaaggugacacagugaggagguggcagagcuaggauuugaacccagac

SEQ ID NO: 145370 - RNA, 64 nt, Human
gagggcacucugcauccucugucauuuuaaccucagguggcacccagggcgaauggggcccagg

SEQ ID NO: 145371 - RNA, 64 nt, Human
aggagguucucccagcccaucugaacacaaccagagguggcaggagaauuucuacugagcgagc

SEQ ID NO: 145372 - RNA, 64 nt, Human
ucuucuacccucaucaucauagguaagguuuucaagguggcaauuggggcggagccccggcucu

SEQ ID NO: 145373 - RNA, 64 nt, Human
gacacccagagggaguagaauacgcagaacuaccagguggcaaaguacuugucauagacuccuu

SEQ ID NO: 145374 - RNA, 64 nt, Human
ccuugguuggauuuucuaugacagcacaggggacagguggcacaccaugagaggucugcccagg

SEQ ID NO: 145375 - RNA, 64 nt, Human; identical to SEQ ID NO: 84533

SEQ ID NO: 145376 - RNA, 64 nt, Human
gagguggccauugcagggucucugccuccccagcagguggcagaugcucccggccacucguuua

SEQ ID NO: 145377 - RNA, 64 nt, Human
caggcucucccacuucguggcauccauguaaaguagguggcagggcagagaugucacucucauu

SEQ ID NO: 145378 - RNA, 64 nt, Human
uuccagcaugcaggugacuuccaaagaaugagucagguggcacugaaagccauggguucugaag

SEQ ID NO: 145379 - RNA, 64 nt, Human
gcugaggacagcaaacucccagcagccccuacagagguggcacaugcuuggccacacaucuacu

SEQ ID NO: 145380 - RNA, 64 nt, Human
ugaggcaagagaaucacuugaacccgggagguggagguggcagugagccgagauugcgccauug

SEQ ID NO: 145381 - RNA, 64 nt, Human
ccauauugauuuugacgcucuguauauuggcaucagguggcagcugaauaucuuuugaauuacu

SEQ ID NO: 145382 - RNA, 64 nt, Human
guggcucauguuucaggcagacuugggguccuuaagguggcaaguccuuuauggagagaaaacu

SEQ ID NO: 145383 - RNA, 64 nt, Human
gucugccugucuaaucugcaguagucuuuugaggagguggcaccggauauaacaugucucuguu

SEQ ID NO: 145384 - RNA, 64 nt, Human
caucagcaaccaugacugaugacugggcccuagcagguggcagguauaacauggccauggacac

SEQ ID NO: 145385 - RNA, 64 nt, Human
guggaacgaccccaccucgaggagcuuccugagcagguggcagaagaugcgguaagaugggccu

SEQ ID NO: 145386 - RNA, 64 nt, Human
agaggggaaggaauggaccugugagaggaagggaagguggcagaaagucucauuucaggaagga

SEQ ID NO: 145387 - RNA, 64 nt, Human
ccuuauauguguguucuauggaggggcagggaaaagguggcacuugugaguguguguggauugg

SEQ ID NO: 145388 - RNA, 64 nt, Human
cugcugggcuagguccagauccgcuccagcgucaagguggcauccgaaggugucucuggucuuc

SEQ ID NO: 145389 - RNA, 64 nt, Human
ccugcguggcuccaggaaaagauguggcucacguagguggcaccugccaauagcuuugucaauc

SEQ ID NO: 145390 - RNA, 64 nt, Human
aucauuucacccugcagugagggaagaggccaccagguggcagcacagccacacccguucccac

SEQ ID NO: 145391 - RNA, 64 nt, Human
agagcagcgugggcagcaaggcagggcagcccagagguggcagcggcaggcaaucuggucacua

SEQ ID NO: 145392 - RNA, 64 nt, Human
ucggagcuccuuugauaccucagagcuggcugucagguggcagcucacacccagacucacuggc

SEQ ID NO: 145393 - RNA, 64 nt, Human
gaagcccccagcccugugggucauggucugugagagguggcaggaauggggacccucacccccc

SEQ ID NO: 145394 - RNA, 64 nt, Human
ggcuggguggccagcagucugggcacacacgagcagguggcaucuuggcucuugccugaggcca

SEQ ID NO: 145395 - RNA, 64 nt, Human
aagcuccccaccccagccugguggcagaggaagcagguggcaccaacucaccaaagggacuugg

SEQ ID NO: 145396 - RNA, 64 nt, Human
ccgcgcaggagcauguaggcaggcucucagauguagguggcaaguggcacagcuccauguccgg

SEQ ID NO: 145397 - RNA, 64 nt, Human
gaagggauaguggccacacugcagcugaggccccagguggcagccauggaucauguagacuucc

SEQ ID NO: 145398 - RNA, 64 nt, Human
uuaucccugguucugaggagcaagugcaggguggagguggcaccugcaucaccuccuccucuug

SEQ ID NO: 145399 - RNA, 64 nt, Human
gaagggcacacagcagcaggcagggaggaggcggagguggcaaauaaaccugggcaauuuuguu

SEQ ID NO: 145400 - RNA, 64 nt, Human
gguggguaguggggaggagagcuggcauuccuccagguggcaaauggcgacucuauacucuccg

SEQ ID NO: 145401 - RNA, 64 nt, Human
cucgaccugaaauaguaauuuggaaacuguuggaagguggcacaguuuagucuaagacagcagu

SEQ ID NO: 145402 - RNA, 64 nt, Human
ucaauauagagauuugaggaaaguuauauccacuagguggcagucauugaucauaauaagugaa

SEQ ID NO: 145403 - RNA, 64 nt, Human
caagcucagcaaucggacaucucuggggaaaggaagguggcacagaccauguucccugguuccu

SEQ ID NO: 145404 - RNA, 64 nt, Human
guauauuaccauaauucauccucacucaauugggagguggcauucuugucccuguugcccccau

SEQ ID NO: 145405 - RNA, 64 nt, Human
cgaggacaccugcccauccggccucugugucaagagguggcagccgcaccuuucugugagaacg

SEQ ID NO: 145406 - RNA, 64 nt, Human
gaaaauuaucuuuggauugugcugcccuauauaaagguggcagaaagacauuuuuaaaaagcuu

SEQ ID NO: 145407 - RNA, 64 nt, Human
cuguggcaaaugggacauucguagagugggauagagguggcagaaugaaccugguguagggcag

SEQ ID NO: 145408 - RNA, 64 nt, Human
gcgucacucuaccuaaugucucacuguucugcaaagguggcaaugcuuaaacuaaauaaugaau

SEQ ID NO: 145409 - RNA, 64 nt, Human
aguggaaagaaggcuuucugaagucuguuugcacagguggcauuugcuuccaauuguagcuagc

SEQ ID NO: 145410 - RNA, 64 nt, Human
guuguuccagccauccacacaggagucuguucugagguggcaauagcacaugggaagaugaacu

SEQ ID NO: 145411 - RNA, 64 nt, Human
acuucuggauuuggagcauccacuugaggagcagagguggcagcagaggauucugagccaccaa

SEQ ID NO: 145412 - RNA, 64 nt, Human
guugauuuauccuuccaccucauaaaaaaugcauagguggcaguauaauuauuuucagggauau

SEQ ID NO: 145413 - RNA, 64 nt, Human
gaucuccuguauuuuaacacguuuuuaccaagaaagguggcaagguaaacuaacagcucaaauu

SEQ ID NO: 145414 - RNA, 54 nt, Human
gguuugggacugaauauuagcaguagguggcaaauuauuguuguuauuuaguug

SEQ ID NO: 145415 - RNA, 64 nt, Human
ugucuucaggucucgaggccugacuccgggggacagguggcagcaggucggccgcccucccguc

SEQ ID NO: 145416 - RNA, 64 nt, Human
aagcuuggccaacgcuugccagccagccagcugcagguggcaucugccacgaaggaagcgccag

SEQ ID NO: 145417 - RNA, 64 nt, Human
accucgcagcaggacccccagugcagaggcucacagguggcacacaggcgcugucucuccagag

SEQ ID NO: 145418 - RNA, 64 nt, Human
uaggacaaggcagacaccccaccaugcgggccucagguggcagagaggcccagccucacaggcc

SEQ ID NO: 145419 - RNA, 64 nt, Human
auuuccucuggaguuugagacccugacaaacaacagguggcaucuggugugcuguucuugaguu

SEQ ID NO: 145420 - RNA, 64 nt, Human
gacagagucucacucugucacccaggcgggaguuagguggcaugauuucggcucacugcaaccu

SEQ ID NO: 145421 - RNA, 64 nt, Human
aggggcugccugucucuggaggugucaggcaggcagguggcaggcagcucacccacccacccca

SEQ ID NO: 145422 - RNA, 64 nt, Human
cauuuucacuaucuggaaaaugggcucaaugcaaagguggcagacauuuauggacacccgccac

SEQ ID NO: 145423 - RNA, 64 nt, Human
uccugaggccuggacccccagugggcagggcaggagguggcagcggcagcagcuguguuucugc

SEQ ID NO: 145424 - RNA, 64 nt, Human
uugacuguucuguucugucuucucuguccauuuuagguggcacaauguaaguggcagugucucu

SEQ ID NO: 145425 - RNA, 64 nt, Human
ggcccaaggguccagccuccucucaccccauuccagguggcauacugcagucuggcucuuucuc

SEQ ID NO: 145426 - RNA, 64 nt, Human
ggccuccacccucccccaacagcagggaugggucagguggcagcauccaaaaccacggugaaga

SEQ ID NO: 145427 - RNA, 64 nt, Human; identical to SEQ ID NO: 84539

SEQ ID NO: 145428 - RNA, 64 nt, Human
ccuuuucuuagcaagucaguguguuuuagaagggagguggcagcauugagggaaaccaggucac

SEQ ID NO: 145429 - RNA, 64 nt, Human
agccuggaugcccaccugcccucaggcaagguagagguggcaggggccgaccucaaguucaagg

SEQ ID NO: 145430 - RNA, 64 nt, Human
aaaaugggcaagggagagcggguggagggcccugagguggcagcaggggucagggaagugggcu

SEQ ID NO: 145431 - RNA, 64 nt, Human
ucccaucuggggagugccgcgggccacagugggcagguggcaccgggggucagcaugcaggggc

SEQ ID NO: 145432 - RNA, 64 nt, Human
ggggagaagacuuagacccuuuugggccucggagagguggcaugauuguggauccccugagauc

SEQ ID NO: 145433 - RNA, 64 nt, Human
uuaccuuacagaagagcaagggcuuagggguuggagguggcagauaaaagaggauuuucaacuc

SEQ ID NO: 145434 - RNA, 64 nt, Human
gccaugucaccucccuuggccuuugauccuggaaagguggcagagccuccacugagccaggccc

SEQ ID NO: 145435 - RNA, 64 nt, Human
uggccgagcuugaccucugcauccauggugacggagguggcaaugacaucaucaaggucagagg

SEQ ID NO: 145436 - RNA, 64 nt, Human
ggccugagauaggaagcagugcccucgcuucaugagguggcacaucuucgguggccguuggccu

SEQ ID NO: 145437 - RNA, 64 nt, Human
acaauacaggcaucacugagcagaggauucguguagguggcaaagcuagaugaggacaugagaa

SEQ ID NO: 145438 - RNA, 64 nt, Human
ccuccagaauggccagaagugcaauuaaccucuuagguggcaaggaggcaggaagugccucuuu

SEQ ID NO: 145439 - RNA, 64 nt, Human
uccucaugcgccugcaccaggagacagacacagaagguggcaggaggccuuuguugcucagcag

SEQ ID NO: 145440 - RNA, 64 nt, Human
cauuccgcccaaucuguaccggaugcuggcagggagguggcagagagcucacugggacugaggg

SEQ ID NO: 145441 - RNA, 64 nt, Human
gugugaauggcaguaacugggcucaggagcucugagguggcacccugccugacuccaaggagaa

SEQ ID NO: 145442 - RNA, 64 nt, Human
ggauguggcugcaguccagagaaaggaaagauugagguggcagagcagaccacucucccuuccc

SEQ ID NO: 145443 - RNA, 64 nt, Human
aaccaauggcugcuuuguugucugacaagggagaagguggcacuuccguucagauucauuuugc

SEQ ID NO: 145444 - RNA, 64 nt, Human
gaucucagaggcggaggccugcacuugaccauguagguggcagagaucgugggcuggcuguguc

SEQ ID NO: 145445 - RNA, 64 nt, Human; identical to SEQ ID NO: 84545

SEQ ID NO: 145446 - RNA, 64 nt, Human
ucgagcucaugcaugugaaacgugugcuuuacgaagguggcagcugacagacgugggcucugca

SEQ ID NO: 145447 - RNA, 64 nt, Human
uggugaucaaggcacuccuggaagugguucagucagguggcaaaaacauugaacuugcugucau

SEQ ID NO: 145448 - RNA, 64 nt, Human
gaaccagauuuaggaccucagaauccugcacucaagguggcaggacccaauuucuguuuuauau

SEQ ID NO: 145449 - RNA, 64 nt, Human
agugagccaagaucaugcuacugcacuccagcuuagguggcaaagugagacccugucuccaaaa

SEQ ID NO: 145450 - RNA, 64 nt, Human
gugccuacaaaagucuuucugacauacacacugcagguggcaguucaagaagaaucaaccuuuu

SEQ ID NO: 145451 - RNA, 64 nt, Human
ugugucugcuuugauggagaucuguaauaaaagaagguggcaaccaccugaauuucuauugguc

SEQ ID NO: 145452 - RNA, 64 nt, Human
gugucgcuucagguguguccuacggacgugugggagguggcaggcgccagccuccgagcagugu

SEQ ID NO: 145453 - RNA, 64 nt, Human
cccugcugcauucgagugucccccaaccccgggcagguggcaccuggugacaccuccuucaguc

SEQ ID NO: 145454 - RNA, 64 nt, Human
uuacuguggagguggcuggucacgacuucuucggagguggcagccgagaucgggguggcagaaa

SEQ ID NO: 145455 - RNA, 64 nt, Human
augaaaaaggagagacauggaaagggagacagccagguggcaccugcagcggcugcccucuggg

SEQ ID NO: 145456 - RNA, 64 nt, Human
acagggcuuccgugagacgccaccgugagaggccagguggcagcuugagcauggacucccagac

SEQ ID NO: 145457 - RNA, 53 nt, Human
ugugcaccguggacgugugagggagguggcacgggccagggcgcgggggccgc

SEQ ID NO: 145458 - RNA, 64 nt, Human
gcuuucaccaagagaguguuucuucacucaacucagguggcauuuggggugacaucucaaaggc

SEQ ID NO: 145459 - RNA, 59 nt, Human
agauugccagcaagcagugagauuccuggagguggcacugggggcuggucacccugaga

SEQ ID NO: 145460 - RNA, 64 nt, Human
agagggagggcaggaaggaaaagaaaggacuuggagguggcaggaguccgagcccugcuccuug

SEQ ID NO: 145461 - RNA, 64 nt, Human
ccccugccuggggugggacugugcaggccagagaagguggcaugggccugaacccaccuggacu

SEQ ID NO: 145462 - RNA, 64 nt, Human
agcagaggucaccuccugacaugcgcucugggaaagguggcagagggcaggacaccaugagcuc

SEQ ID NO: 145463 - RNA, 64 nt, Human; identical to SEQ ID NO: 84549

SEQ ID NO: 145464 - RNA, 64 nt, Human
cccaugguccagggccuggugggcgugagaggauagguggcagggcagaaacugggcagcccug

SEQ ID NO: 145465 - RNA, 64 nt, Human
gaggccgacugggcugcuggggcagggcccagggagguggcagggaagggugccuggcugggcu

SEQ ID NO: 145466 - RNA, 64 nt, Human
guccuucucucccucagaagccucaggacccaacagguggcaggcaguggacagggugcccgcc

SEQ ID NO: 145467 - RNA, 64 nt, Human
ggagcaaaccccgccuucagagggcagacaaagcagguggcaugaauugaucagcgagaaaggu

SEQ ID NO: 145468 - RNA, 64 nt, Human
ccagggauguccuacaggauaguuucauagugacagguggcacuuggcuaauagaauauggcug

SEQ ID NO: 145469 - RNA, 64 nt, Human
gauaugugaaugaaguguugguguccucaccaagagguggcaccuaaggguucugaggaaauaa

SEQ ID NO: 145470 - RNA, 64 nt, Human
gggugggggagagagcaggcccugugguggcaggagguggcaucuugucucgucccugaugucu

SEQ ID NO: 145471 - RNA, 64 nt, Human
ugggcagagacuucugggugugccuuggcucccaagguggcacugugggucccuggcaaguguc

SEQ ID NO: 145472 - RNA, 64 nt, Human
guuacucagccacgccguguguaggcuuagccucagguggcagauguuugaggaaaggaauuau

SEQ ID NO: 145473 - RNA, 64 nt, Human
uuuuuguuuguaauggggagaagcguggccaggcagguggcacguggcaucgcauggugggcuc

SEQ ID NO: 145474 - RNA, 64 nt, Human
ggaggcccucccccucccccagcucagaccacagagguggcaagagaagggcugaagcuggaag

SEQ ID NO: 145475 - RNA, 64 nt, Human
uguguguuccagcagugagacgguguuauugugaagguggcauucaucugcggagccaaaaccc

SEQ ID NO: 145476 - RNA, 55 nt, Human
aauccaucauguuuaauuagcaacaagguggcaauuauuuucagaaaaacacuga

SEQ ID NO: 145477 - RNA, 64 nt, Human
acagcacccuaggcggcuucuuccugucagucggagguggcaugcaagaugaagcucucuuugc

SEQ ID NO: 145478 - RNA, 64 nt, Human
ggugggagagggagcagaacagccagccccuuccagguggcagucggaaggguuuuuguuuuug

SEQ ID NO: 145479 - RNA, 64 nt, Human
ugggaugugcuagucggcuaaagcuucacagaggagguggcaauugaaaaugaguccugaaugg

SEQ ID NO: 145480 - RNA, 64 nt, Human
guuaaauaccuuuuccuagauucccacagcaggaagguggcauagcuguuuugucugacaccag

SEQ ID NO: 145481 - RNA, 64 nt, Human; identical to SEQ ID NO: 84553

SEQ ID NO: 145482 - RNA, 64 nt, Human
acaaggaaaggaaagaagaucugguggaaagcucagguggcagcggacucugacuccacugagg

SEQ ID NO: 145483 - RNA, 64 nt, Human
uagcuacucuuauguuccacaugcacauaugacaagguggcauuaauuagauucaauauuauuu

SEQ ID NO: 145484 - RNA, 64 nt, Human
cuuuugugcauauggcaacguucauguucaucucagguggcauuugcaggugaccagaaugagg

SEQ ID NO: 145485 - RNA, 64 nt, Human
cacauuuaagaagaagguguguggccuuuucagaagguggcaugguccucaagugaguucuuag

SEQ ID NO: 145486 - RNA, 64 nt, Human
aggaaauuggaauuaaagugaaaaaucauucuggagguggcauguccuugacucacaauaaaaa

SEQ ID NO: 145487 - RNA, 64 nt, Human
gcggugucgcgcgccugcagcacgccccacguccagguggcagggaaagccgagcggcccacgg

SEQ ID NO: 145488 - RNA, 64 nt, Human
uuuguaagcuuaguaguugcagaaauugaacacuagguggcacucaguuaucuuaacaggggaa

SEQ ID NO: 145489 - RNA, 64 nt, Human
ccuuaauuccaacuuuuugagguucagcaauuggagguggcaauuggcuuugcauuuuaaagua

SEQ ID NO: 145490 - RNA, 64 nt, Human
uggccugaaccacaggagaggauggcccagggugagguggcaugguccauucucaagggacguc

SEQ ID NO: 145491 - RNA, 64 nt, Human
gugauguuuuaguaauggaaaagccaagagcgucagguggcaaaaguccuucuguuacucaaga

SEQ ID NO: 145492 - RNA, 64 nt, Human
ugauaaauucacauaggcaauaucuuuaauagguuaauaucaaugaagauuuuuaauuacaaua

SEQ ID NO: 145493 - RNA, 64 nt, Human
uagagacuuuuauuuuaaaaggcaucauaugagcuaauaucacaacuuucccaguuuaaaaaac

SEQ ID NO: 145494 - RNA, 64 nt, Human
uugauaagucauugcacuauuuaaaaaguuuuaguaauaucaugaauuuaauuugcuuaagauu

SEQ ID NO: 145495 - RNA, 64 nt, Human
auugucugaaguuuuaguuaagauuuucacacauuaauaucaaaaaaguaaguuuaguauuugu

SEQ ID NO: 145496 - RNA, 64 nt, Human
ucucuuugaacuauugaaaauuuaagguucaguauaauaucaauuuugaauuuuuaaugguguu

SEQ ID NO: 145497 - RNA, 64 nt, Human
caagagaauugucacacaugacacaagauguacauaauaucaugcucacugcaguguuauuuaa

SEQ ID NO: 145498 - RNA, 64 nt, Human
uuaauuauuucauggaucaugaagcaaggaugaauaauaucaugucuugguaaauacuaacaaa

SEQ ID NO: 145499 - RNA, 64 nt, Human
uuggggaauaaauggauaugggcuggauauucgguaauaucauuaaugaaaagcagauugcaga

SEQ ID NO: 145500 - RNA, 64 nt, Human
uauuggguuacuacuaacccugucccaagaauaguaauaucaccucuaguuauaagccagcaac

SEQ ID NO: 145501 - RNA, 64 nt, Human
auucagcggaauauugauuagaaagaaacugcucuaauaucagcaagucucuuuauauggccuc

SEQ ID NO: 145502 - RNA, 64 nt, Human
uuuaaaaaccagaauuuuaguugcaauacaauuuuaauaucacccuacauauuauuuauaaaac

SEQ ID NO: 145503 - RNA, 64 nt, Human
acggcagucacacugcugggaaguggcuuaauaguaauaucaauaaauagaugaguccuguuag

SEQ ID NO: 145504 - RNA, 64 nt, Human
cagaguuacccucuaaagauaagaaaaaggcuauuaauaucauacuaagugaaggacaggaaag

SEQ ID NO: 145505 - RNA, 64 nt, Human
uacaagaaccugggaggccaacgccuaaagaucauaauaucacacaauggaaggaaccuagauu

SEQ ID NO: 145506 - RNA, 64 nt, Human
uuuuuaagaauuacaaagcucauucuucugaaucuaauaucacuaacuccuagacuuuuuccgu

SEQ ID NO: 145507 - RNA, 64 nt, Human
aguuaucuugaaagcuauuggguauagcauaaaauaauaucacucuuuuaauaguauacaaaag

SEQ ID NO: 145508 - RNA, 64 nt, Human
aaugcauauuugccacaaaaccuguauuacugaauaauaucaaauaaaauaucauaaagcauuu

SEQ ID NO: 145509 - RNA, 64 nt, Human
aaaacuauauaauaauuauaauccaguuuuaagauaauaucaagagucuagaugugaggcuuuu

SEQ ID NO: 145510 - RNA, 64 nt, Human
gaccagaaugaaaacuguaaauauuuuuuuaaccuaauaucacuuaaaucgaggcagaaagaua

SEQ ID NO: 145511 - RNA, 64 nt, Human
aauacugcuaguuaaaauaagugcucuauaugcauaauaucaaauaugaagauaugcuaaugug

SEQ ID NO: 145512 - RNA, 64 nt, Human
uuuuaccaguguugcaaaguuuagaccuuuguguuaauaucagaaguguauuuguagccccucc

SEQ ID NO: 145513 - RNA, 64 nt, Human
aggucauaaacaugaauaauacucaguauauguauaauaucauauuuaauuguugcaacuuuuc

SEQ ID NO: 145514 - RNA, 64 nt, Human
ucucagcuuacgaacuaccauguuuuguuauucuuaauaucaacuguuugguaagaguacaguu

SEQ ID NO: 145515 - RNA, 64 nt, Human
caucauaagaagugucuggaauacccguucuauguaauaucaacagaaccuugugguccagcag

SEQ ID NO: 145516 - RNA, 64 nt, Human
aaacauaccaccuuguuggcucuaccacuuuaauuaauaucacuauaacauaacugauaggaau

SEQ ID NO: 145517 - RNA, 64 nt, Human
acaaaacaaacaaccugccacaaugugauauguguaauaucauuucauaaaaaucccucuuccu

SEQ ID NO: 145518 - RNA, 64 nt, Human
uugcucuuuuuaacuucauuugaugccuugcuuauaauaucauaugcuugaggcucacuguuga

SEQ ID NO: 145519 - RNA, 64 nt, Human
ugacauacuuuuuuuuucuuauagcaauacacuguaauaucagaaaugguuggccugagcaacc

SEQ ID NO: 145520 - RNA, 64 nt, Human
auaacuuuaauuaaaaaacuuacauagaagauuauaauaucagacgugacaaagauuugaguuu

SEQ ID NO: 145521 - RNA, 64 nt, Human
uaguguuuuuaauguuuacuuuugccacuuacaauaauaucaccaaaauaauaugcauagaguu

SEQ ID NO: 145522 - RNA, 64 nt, Human
caauguuuucuuuuucaggugaguaguugccgcguaauaucauuggaguacauucuuuauacug

SEQ ID NO: 145523 - RNA, 64 nt, Human
gagcguugcuuuaucaucgcacuuuucaucuugguaauaucaaaacaacuuuuuaaaugaacug

SEQ ID NO: 145524 - RNA, 64 nt, Human
auuuucuuuuacuuucaaauagaaauauuuggaauaauaucagucuuucuuuuuuguacauuau

SEQ ID NO: 145525 - RNA, 64 nt, Human
agauauguuuaauaaauauuguacuuauuggaaguaauaucaaacuguauggugauaaguauug

SEQ ID NO: 145526 - RNA, 64 nt, Human
uacuggggaagaaagugaaggaggggaaacuguuuaauaucacaugaagacccuagcuuuaaga

SEQ ID NO: 145527 - RNA, 64 nt, Human
acugugagaggaucauaaugagguccugaauauuuaauaucaucauuuacugugucuguuugcu

SEQ ID NO: 145528 - RNA, 64 nt, Human
gacaaauggcugauguucucuaugauauugguguuaauaucaaagaauugaaugaauacaacag

SEQ ID NO: 145529 - RNA, 64 nt, Human
gcuuuacuguuuguuauggcuuaaugacacuagcuaauaucaauagaaggauguacauuuccaa

SEQ ID NO: 145530 - RNA, 64 nt, Human
agaaaaauuugaaagcuuuggaaaaccaaauuuguaauaucauuguauuuuuuauuaaaaguuu

SEQ ID NO: 145531 - RNA, 64 nt, Human
cuauuuuaauaauuauuuucucuacacaaauguguaauaucauauuugacuuugcuuaugcagg

SEQ ID NO: 145532 - RNA, 64 nt, Human
aacugcuaauguggcugcuuuguagggaauggacuaauaucaguguguuagaucuuaagguauc

SEQ ID NO: 145533 - RNA, 64 nt, Human
gguaauaagaaugguugagugcaacaucauguauuaauaucaaaugaaagacaagggugcugua

SEQ ID NO: 145534 - RNA, 64 nt, Human
gaucucauaaacaagacguauggaggaguucucuuaauaucagcaaggugaacugggacauucu

SEQ ID NO: 145535 - RNA, 64 nt, Human
uauuaaagcauaguuuauuucacuagaaaaaauuuaauaucaaggacuauuacauacuucauua

SEQ ID NO: 145536 - RNA, 64 nt, Human
ugucuaaaaccuuauggugaccagaauuguuuauuaauaucaaacuuuuuuauauaugagaacu

SEQ ID NO: 145537 - RNA, 64 nt, Human
uuauucaaguuccuuagaaauuguuauuuagguauaauaucaucuugucuuugacuagagcuug

SEQ ID NO: 145538 - RNA, 64 nt, Human
uuauuacucccagaacaacaacuauccugacuucuaauaucauucacuagcuuugccugguuuu

SEQ ID NO: 145539 - RNA, 64 nt, Human
ucuuaauuuauuuuaauuuuuuacuugugccacuuaauaucaggcauuuuaauaaaauauuguu

SEQ ID NO: 145540 - RNA, 64 nt, Human
uugauuuuaaauaaaaaacauuccaucuuucauuuaauaucaauaucaaaagaagaagacaaac

SEQ ID NO: 145541 - RNA, 64 nt, Human
ucagucugccgagaauccauguauauauuugaacuaauaucauccuuauaacagguacauuuuc

SEQ ID NO: 145542 - RNA, 64 nt, Human
ccaucagaauguuucuuugauucuagaagcuguuuaauaucacuuaucuacuucauugccuaag

SEQ ID NO: 145543 - RNA, 64 nt, Human
ugcuggccacgcaagugucacaugcgaucuacauuaauaucaagucuugacucccuacuucccg

SEQ ID NO: 145544 - RNA, 64 nt, Human
acuuuaaugauuauaaucauacugucugcugauauaauaucauaauuguugugguuuaaauaca

SEQ ID NO: 145545 - RNA, 64 nt, Human
aaucauuaaaguaggacagcuaagaaauuaauauuaauaucaaaauuauugauaaucuuaaauu

SEQ ID NO: 145546 - RNA, 64 nt, Human
aucuuuguugugaaugaugcuuuuuuguauuuauuaauaucaaauucacuuaugaauaaacuug

SEQ ID NO: 145547 - RNA, 64 nt, Human
cagugaucuccaguggucaaaagacauuuacccuuaauaucagacaacauuuauauuuuaguga

SEQ ID NO: 145548 - RNA, 64 nt, Human
agguguuuauaaaacacuugagaacuuuuuuccuuaauaucagaaagcaaaaaaauaaaaccac

SEQ ID NO: 145549 - RNA, 64 nt, Human
aaugagaguucugauaaaauauuuuuguauuuuguaauaucaaaggaauuucuauaucguagga

SEQ ID NO: 145550 - RNA, 64 nt, Human
uggugguaggcaucgugugugacuuuuuuuccucuaauaucaauuuuacaguacggaaauagua

SEQ ID NO: 145551 - RNA, 64 nt, Human
guaauaaaaaacuaaauuaaaccuugcauuaaaauaauaucacaguaucaguggacuaaacauu

SEQ ID NO: 145552 - RNA, 64 nt, Human
acuccuuccaguaguagcucugaagugucacauuuaauaucaguuuuuuuuaaacaugauucua

SEQ ID NO: 145553 - RNA, 64 nt, Human
aaucacuacuauaucaugucuuuuacucuguuuauaauaucaaguauuuucuuaaagauauaga

SEQ ID NO: 145554 - RNA, 64 nt, Human
gaucauucuuauauugucagauaacacuuguguauaauaucacuuuggaucauggacaugagcu

SEQ ID NO: 145555 - RNA, 64 nt, Human
cauuaucauuagcuuacuaacuugaaaguuagauuaauaucaaaauaagaauagcagcacuaug

SEQ ID NO: 145556 - RNA, 64 nt, Human
uucuugugccuaguacuuuaccacaaauacaguguaauaucaucaguccaaaacugcauuacuu

SEQ ID NO: 145557 - RNA, 64 nt, Human
accacacagcagggauguccaauaucagaacuauuaauaucaauaaaaguauaaccuucccagg

SEQ ID NO: 145558 - RNA, 64 nt, Human
caggcaaucucaacuuacuucuuuaaucaacauuuaauaucaauggaucugugauuaaaugucu

SEQ ID NO: 145559 - RNA, 64 nt, Human
auauuuuuauguaguuugaaauguaaaaauguucuaauaucaagauuaacaaauauaaauuuau

SEQ ID NO: 145560 - RNA, 64 nt, Human
cagaauaguaccuuacauuugcuaaacagacaguuaauaucaaauccuuucaauauucugggaa

SEQ ID NO: 145561 - RNA, 64 nt, Human
acuauuugcuaauguauaaugugcagaaaauauuuaauaucaaaagaaaauugauauuuuuaua

SEQ ID NO: 145562 - RNA, 64 nt, Human
uuuuucauuaaaauauauuccauaucuacaacuauaauaucaaauaaagugauuauuuuuuaca

SEQ ID NO: 145563 - RNA, 64 nt, Human
aaucuuuauuuuauuauucagaauuauacagaccuaauaucauuuuauucacauaugucuuacu

SEQ ID NO: 145564 - RNA, 64 nt, Human
aaaucauaaggaaggaacuacuugccuuaaauguuaauaucaaaagaguuuucuaacaagguua

SEQ ID NO: 145565 - RNA, 64 nt, Human
gaaauaauucccauauccuugcuuuguaaguugguaauaucacuaugcauuucuacacauuuua

SEQ ID NO: 145566 - RNA, 64 nt, Human
guaaauucuaugaaaaguaagugauuugcauguauaauaucaggaaaauuaagcaucccaagug

SEQ ID NO: 145567 - RNA, 64 nt, Human
ucuuuacuuuauaaauuguccauaggccacacuuuaauaucacauuauaaagggaaggacaguc

SEQ ID NO: 145568 - RNA, 64 nt, Human
uacaacuguguucugugacucaauuguaucguguuaauaucagugcagacugucuccucuacgu

SEQ ID NO: 145569 - RNA, 64 nt, Human
uauauaauacauagagcacagagcccuuugcccauaauaucaacuuucccuccuauaguuaaaa

SEQ ID NO: 145570 - RNA, 64 nt, Human
agaguugguuugcaaaggaaaaguuuaaauagcuuaauaucaauagaaugauccugaagacaga

SEQ ID NO: 145571 - RNA, 64 nt, Human
cuugauaguauuuuuauguacuaaauauuuacacuaauaucaauuacauauuuugguaaacuag

SEQ ID NO: 145572 - RNA, 64 nt, Human
auuaaugauaaaaauaaugcauuuguauuguucauaauaucaugugcacuucaagaaaauggaa

SEQ ID NO: 145573 - RNA, 64 nt, Human
aaugucaaauuaauuuuauaaaagcaguuguuaguaauaucacaacaguguuuuuaaagguuag

SEQ ID NO: 145574 - RNA, 64 nt, Human
cacugacagcuagacaccuagaaaggaacugcaauaauaucaaaacaaguacugguugacuuuc

SEQ ID NO: 145575 - RNA, 64 nt, Human
uccagugucuauguugaaaaaaaggguuauaguguaauaucaggccuaaaguuucagaagagca

SEQ ID NO: 145576 - RNA, 64 nt, Human
aauuuaagaaaaagaauaguuaguuuuaaaugcauaauaucaaagagaaucauagaugaucauu

SEQ ID NO: 145577 - RNA, 64 nt, Human
ggaggacaggccuugggagggcaggcguuugcauuaauaucaaggcaaaaagcauucauagaua

SEQ ID NO: 145578 - RNA, 64 nt, Human
auauguuacugagcuugcuugugguaaccauuuauaauaucagaaaguauauguacaccaaaac

SEQ ID NO: 145579 - RNA, 64 nt, Human
gcauugacauacacagcaaagaagauauaggcaguaauaucaacacugcuauaucauguguagg

SEQ ID NO: 145580 - RNA, 64 nt, Human
uaauuaagguauuuuaguaugcaauuuacugccauaauaucaaaggucaguaacaguguucuuu

SEQ ID NO: 145581 - RNA, 64 nt, Human
caggaucuaagaugguauguaguagaauucaaaguaauaucauuuuaaaguuaaaugaguaugg

SEQ ID NO: 145582 - RNA, 64 nt, Human
uucaacuaagaaccaauaauggcuucuucaaggcuaauaucaauaguuuauaagcaguauauuu

SEQ ID NO: 145583 - RNA, 64 nt, Human
gcugauauacuuuuuuaaugaauaauuucaaucuuaauaucauuguaaaauuaagcuguaauuc

SEQ ID NO: 145584 - RNA, 58 nt, Human
ccgcaaauaaacucuacuaauauagcaguaauaucaaaaguucuuuggacacucaggc

SEQ ID NO: 145585 - RNA, 64 nt, Human
aacaauacagcauuaaagaaccaauguuauucacuaauaucauucaucuuucaguuuggaugau

SEQ ID NO: 145586 - RNA, 64 nt, Human
auuuuuuacucuuaaugccacuaauauacaucccuaauaucacagggcuugugcauucagauuu

SEQ ID NO: 145587 - RNA, 64 nt, Human
cuguauucuuccucauacuugccuacccccaaauuaauaucaguccuaaagaaugguuugugug

SEQ ID NO: 145588 - RNA, 64 nt, Human
ggaauacgggcugccacauagacuuuguucucauuaauaucacuauuuacaacucauguggacu

SEQ ID NO: 145589 - RNA, 64 nt, Human
uguaauggacaagcagcaggccaucaggaacucuuaauaucagcacagcaauucauuuuaguuu

SEQ ID NO: 145590 - RNA, 55 nt, Human
gguauuuauguaucauuugagcagauaauaucacauaucaaaaaguuauaauuaa

SEQ ID NO: 145591 - RNA, 64 nt, Human
agaaaagcuguggaaaagagucuuagagauuuuguaauaucauucuaaauagauuaagaaaaga

SEQ ID NO: 145592 - RNA, 64 nt, Human
cccaaugaauauacucauuagaauuaccauuuguuaauaucacucauuaauuaaccccauaauu

SEQ ID NO: 145593 - RNA, 64 nt, Human
aucauuaaaaugucaaguucaagugauaugugccuaauaucacuuggauguugguggguuuuug

SEQ ID NO: 145594 - RNA, 64 nt, Human
gaagcuaucaaagaaaaguaaacuagacaccaaguaauaucacucucauaauaugcuuuccagc

SEQ ID NO: 145595 - RNA, 64 nt, Human
guguccuaaaaauugcuuagugauuugauugugguaauaucauuucuuaucuacaaugucuaaa

SEQ ID NO: 145596 - RNA, 64 nt, Human
aauaucucccaacugacugauagacucugagcacuaauaucauagugcugugaugauggacaau

SEQ ID NO: 145597 - RNA, 64 nt, Human
cuucccuaggauauccuguguuugagugugaaguuaauaucacacaaagcauguagcuaacagu

SEQ ID NO: 145598 - RNA, 64 nt, Human
uauaaaaauauucugaauuuguuaagcacugccauaauaucauuauaauguuuuugucuuuuag

SEQ ID NO: 145599 - RNA, 64 nt, Human
augugacagaaccaggacacuacugcuuaauauuuaauaucagauacucuuaaaucacaggagc

SEQ ID NO: 145600 - RNA, 64 nt, Human
ucacauaaccuuuauacagaaucuucccaucucuuaauaucauguguuaacauguuuaaaaaga

SEQ ID NO: 145601 - RNA, 64 nt, Human
ccuugaaacaagccauucuacugugcuaauguuuuaauaucacaucucacaaauaacaggggug

SEQ ID NO: 145602 - RNA, 64 nt, Human
acuuaauaaaauggauuuuuaaaaaauccacuaguaauaucagaauguccagggagugacuguc

SEQ ID NO: 145603 - RNA, 64 nt, Human
gcuaaaauauguuaauauuuuuaaauuaaagguuuaauaucagaaugcaguccaaagagcaaau

SEQ ID NO: 145604 - RNA, 64 nt, Human
uugucagggcuacaauagugaauguccuuuuuuuuaauaucaaaaauaucgauaaguagguuuu

SEQ ID NO: 145605 - RNA, 64 nt, Human
cuagugcuuuuucucuaccugcccuugggcucacuaauaucaccaguauuauuaccaagaaaau

SEQ ID NO: 145606 - RNA, 64 nt, Human
cacuauguauuuuaugaacagaauugacugggacuaauaucacaggaucaaucaucucagaauc

SEQ ID NO: 145607 - RNA, 64 nt, Human
cgauuccccugagugacacaagaacauaaaauguuaauaucacuaauauagccuguuaaaucuu

SEQ ID NO: 145608 - RNA, 64 nt, Human
cuucuauaaaauacauuuaaaauggaaaaauacuuaauaucacuaaauaucagaacaauguaac

SEQ ID NO: 145609 - RNA, 64 nt, Human
aaucauacgauaaguuacuguuugcauugaaauauaauaucaaagccuuuugaaaucuguaaac

SEQ ID NO: 145610 - RNA, 64 nt, Human
ucauauaguaagaguauucuaaacagcacuacauuaauaucauuugauagguauaaaguauacu

SEQ ID NO: 145611 - RNA, 64 nt, Human
uugacaauauaucacauacucuucaagaucauaauaauaucauuaauauaaauuuaaacaacau

SEQ ID NO: 145612 - RNA, 64 nt, Human
uuuguccuccuuagcacaauguaaaaaagaauaguaauaucagaacaggaaggaggaauggcuu

SEQ ID NO: 145613 - RNA, 64 nt, Human
guuccauuguggaaauuaaauuauguaagcuuccuaauaucauaaacauauuaaaauucuucua

SEQ ID NO: 145614 - RNA, 64 nt, Human
auguugauguguccgugaaaguugugaucuguuguaauaucaguuacaguggcaguauugacaa

SEQ ID NO: 145615 - RNA, 64 nt, Human
agcuauguucuccaauccacacugccuuuuauuguaauaucaucuaaauagaugcagaaaaaug

SEQ ID NO: 145616 - RNA, 64 nt, Human
gcauugaccaagugguuuggaaggaggcaugcuuuaauaucacaauaauuuugauuuguaaacc

SEQ ID NO: 145617 - RNA, 64 nt, Human
agcuguucuaaucugcguuuugcauguuaaguguuaauaucaaacauucuuuacgugcucgagg

SEQ ID NO: 145618 - RNA, 64 nt, Human
aaacguuaagguuuucuguuuuguuuuguuuuuuuaauaucaaaagagucggugugaaccuugg

SEQ ID NO: 145619 - RNA, 64 nt, Human
uguagaauaagauuucuuucuugucuuuuaaaccuaauaucaccaagaagcaaguuucugagua

SEQ ID NO: 145620 - RNA, 64 nt, Human
uccauuuuuuaacaauuccuaacacuugauaucuuaauaucagucacuaacauuaguaacuucu

SEQ ID NO: 145621 - RNA, 64 nt, Human
ucauaucucccacuuaccuuauaaguaaaaagguuaauaucaaguaacuuauuagcucuuaaag

SEQ ID NO: 145622 - RNA, 64 nt, Human
uuugcuugcuuuuaugauuuuuuuugguuuguuuuaauaucagguggauuuuuguuucuaagca

SEQ ID NO: 145623 - RNA, 64 nt, Human
ccuaaaucccaagaaauggaaucagguagacuuuuaauaucacuaauuucuucuuuagaugcca

SEQ ID NO: 145624 - RNA, 64 nt, Human
gauaagauagccuugauuuuaaaagcugauucauuaauaucaaaauacuuuaauaagugucaca

SEQ ID NO: 145625 - RNA, 64 nt, Human
cuuuucagagacgccauagcuguuuuucccuuuguaauaucaaagcaguaauaucuucucugga

SEQ ID NO: 145626 - RNA, 64 nt, Human
aguuauuuucccccccaagcuauccuguuucagauaauaucaauuuauuuccaauccaucagac

SEQ ID NO: 145627 - RNA, 64 nt, Human
uuauuuucauucaaaugaggaugaugagucacuguaauaucaaaaaauccccagcagcugggac

SEQ ID NO: 145628 - RNA, 64 nt, Human
uggaguauuuuuauaauuuuaucuguauaagcuguaauaucauuuuauagaaaaugcauuauuu

SEQ ID NO: 145629 - RNA, 64 nt, Human
uuuagaagacacaggaggagaccaucaaaugaauuaauaucacuguauuaaaagucugccgggc

SEQ ID NO: 145630 - RNA, 64 nt, Human
uugguuuacccaagucauguuuuuaauagacugcuaauaucaaaggagaauuuuuaaagccuua

SEQ ID NO: 145631 - RNA, 64 nt, Human
ccaguuuucauuuuuuuacgucuugccuauaagcuaauaucauaaauaagguuguuuaagacgu

SEQ ID NO: 145632 - RNA, 64 nt, Human
cugaaauaauagaguaaguucuucucagagauguuaauaucauguuuuucauguucuaauuaga

SEQ ID NO: 145633 - RNA, 64 nt, Human
uuaacuauuuuuauuauuuaaauuauuuuuuauguaauaucauauguaccuuuacauugugguu

SEQ ID NO: 145634 - RNA, 64 nt, Human
uuaaauauuuauuuaauuauuuuuaaaauuuauguaauaucaugagucgcuuuacauugugguu

SEQ ID NO: 145635 - RNA, 64 nt, Human
uuaacuauuuuuaagguuuaaaucauguuuuauguaauaucauguguaccuuuacauuuugcuu

SEQ ID NO: 145636 - RNA, 64 nt, Human
uaauuauuuuuaagauuuaaauuauuuuuuuauguaauaucauguguaccuuuacauuguggug

SEQ ID NO: 145637 - RNA, 64 nt, Human
cagaaauguauaaaaaagcaaaaaugauuacugauaauaucacaacccagaaguaaccaccuuu

SEQ ID NO: 145638 - RNA, 64 nt, Human
guguguguuuccaugcugacuaguccccuacuguuaauaucacuacuaauuaggcuauaaccag

SEQ ID NO: 145639 - RNA, 64 nt, Human
accaaaguuuucacauaggcaguuagccuuuacuuaauaucaagacaagugaaaaaauauuggc

SEQ ID NO: 145640 - RNA, 64 nt, Human
ugcuuaugaaucuuuuacauuguuuauauaugauuaauaucaucauauauauuuucuguauuaa

SEQ ID NO: 145641 - RNA, 64 nt, Human
gauauuuucccuuucacuuuuaaaauaaucaaaguaauaucauacucuucucaguuauucagau

SEQ ID NO: 145642 - RNA, 64 nt, Human
cuuuuuaauuuugauaaaaaagauacaaaguucauaauaucaaaauauguguucaaaauuggua

SEQ ID NO: 145643 - RNA, 64 nt, Human
uaggacagcuuuuguuaggaagugauauucuauguaauaucagaugguuaauacgggcauaaca

SEQ ID NO: 145644 - RNA, 64 nt, Human
ggcugugauaguuuuugaaauaaaauuuaacauuuaauaucaugaaauguuauaaguagacaua

SEQ ID NO: 145645 - RNA, 64 nt, Human
ccaggauaagaacccauuauacagaaguguucaauaauaucaauuuugcaacucacucagcucc

SEQ ID NO: 145646 - RNA, 64 nt, Human
acuuuguuaacuucagguaaaaacuucauuaggguaauaucaucucaauuuuuucaaaugaaag

SEQ ID NO: 145647 - RNA, 64 nt, Human
aaucuuuaacaucauuuuuucaacuuuuaagauauaauaucaacuauucuaaauacagguaaug

SEQ ID NO: 145648 - RNA, 64 nt, Human
cuugugacaagaauaauuuuggaauaauuucuauuaauaucaacucugaagcuaauuguacuaa

SEQ ID NO: 145649 - RNA, 64 nt, Human
agggugcagaaggaaaacuaauaagaaaaccuccuaauaucauuuugugacuguaaacaauuau

SEQ ID NO: 145650 - RNA, 64 nt, Human
guuuuauggugccaaguauccuacguuacaacaauaauaucaugggagaaauagaaauagccua

SEQ ID NO: 145651 - RNA, 64 nt, Human
gagaucagaauauucuauguauugagaaaauguuuaauaucaaucuauaaaucuugaauuucua

SEQ ID NO: 145652 - RNA, 64 nt, Human
aaacaguuauggaacacaaaacauuuuauagauuuaauaucauaacauugcaaauuuuucuugu

SEQ ID NO: 145653 - RNA, 64 nt, Human
guuguguguauauguauuuaagauguacauuuaauaauaucaaagagaagaugccuguuaauuu

SEQ ID NO: 145654 - RNA, 64 nt, Human
uucauacagcacuuagaugaauuauugaucuuccuaauaucaggcgccuacuuaaccuauggug

SEQ ID NO: 145655 - RNA, 64 nt, Human
auacggugguugagaaggaaccaguguuuacaaguaauaucagaaaguugaaggaaccaguguu

SEQ ID NO: 145656 - RNA, 64 nt, Human
guacccccagcccaagagaugaacaucuggggacuaauaucauagacccaucuggaggcuccca

SEQ ID NO: 145657 - RNA, 64 nt, Human
uaucauauccaugaaaaaugucauuuuaagacacuaauaucaacaguauaucucagugugugag

SEQ ID NO: 145658 - RNA, 64 nt, Human
auuguuugaguugcuguuuccaaauagaaaugaauaauaucacaaaauggggucucuuacggca

SEQ ID NO: 145659 - RNA, 64 nt, Human
cauaguagcagcauauuaaggguuucuaguaugcuaauaucaccagcaaugaucuuuggcuuuu

SEQ ID NO: 145660 - RNA, 64 nt, Human
uuaaaagguaguauaagaaaugaggaaaaagagguaauaucagggcuucugcuguuuuuuauuu

SEQ ID NO: 145661 - RNA, 64 nt, Human
gugauuuauaaauuugaaauccaaacuacuuucuuaauaucacuuuggucuccauuuuucccag

SEQ ID NO: 145662 - RNA, 64 nt, Human
ggaugccuccaauggaccagagagcugaguguucuaauaucacaauaggugcuuucuccuaaaa

SEQ ID NO: 145663 - RNA, 64 nt, Human
guuuaugccuaucaaugcaauuuuuaauuuuuguuaauaucaacagcaaaagccuagugcauug

SEQ ID NO: 145664 - RNA, 64 nt, Human
acccuaaauuauucuguuauuggaucugugccuguaauaucaggauacuaccauccaaaucuau

SEQ ID NO: 145665 - RNA, 64 nt, Human
uggagcaguuuucaguuuuaaaugagucugcaguuaauaucaaaugugaguuugggacugccug

SEQ ID NO: 145666 - RNA, 64 nt, Human
aggccaggggguugugaugagaggauaggggagauaauaucagcaucaaauucuuuggguaucu

SEQ ID NO: 145667 - RNA, 64 nt, Human
cagcaaguuaccaagguauucauuaaagaacuuguaauaucaaauuacuauuuauucauaacaa

SEQ ID NO: 145668 - RNA, 64 nt, Human
cuuagucauugcacaauaaggauuuuugaauguauaauaucaucuaagguaagcuuucauaugg

SEQ ID NO: 145669 - RNA, 64 nt, Human
uguuuugugguaauugcuuuuuaaaggaaguuauuaauaucauaaguuauuauuaauauuuuga

SEQ ID NO: 145670 - RNA, 64 nt, Human
ucaaacuugcauuuauaugaaaaccuucugucucuaauaucacagaauaaacuuucuuuagaug

SEQ ID NO: 145671 - RNA, 64 nt, Human
gagauaacuuuuagcucucuuucuucucaaugucuaauaucaccucccuguuuucaugucuucc

SEQ ID NO: 145672 - RNA, 64 nt, Human
guuucuguuugaagugaggauuuucugaauuaucuaauaucaucuagguuuucuuuaaaauuuu

SEQ ID NO: 145673 - RNA, 64 nt, Human
auaguguuuuauagauuucacuaaauuuucaguguaauaucagauguuuucucuggaugcagaa

SEQ ID NO: 145674 - RNA, 64 nt, Human
ggccaaacauuuauguucagauugaaauuuaaauuaauaucauucaaaaggaaacaaaaaaugu

SEQ ID NO: 145675 - RNA, 64 nt, Human
uuauauaucuccccuuccuucuccucgagucacauaauaucaguaccuuguucuggucacuguu

SEQ ID NO: 145676 - RNA, 64 nt, Human
gaaauaacaggaagauuccaaagacguuuaccaguaauaucaccaggcaccugcagaagaggaa

SEQ ID NO: 145677 - RNA, 64 nt, Human
auauauaucuccccuuccuucuccucaagucacauaauaucagcacuuugugcuggucauuguu

SEQ ID NO: 145678 - RNA, 64 nt, Human
auaagaccuaaccauauuuauaugauuccuaacauaauaucauuugguagaaagaaaaccaacu

SEQ ID NO: 145679 - RNA, 64 nt, Human
ucuaaguaucuuauuguguguuauaagugccuuuuaauaucauacuaagugugagcuucuggac

SEQ ID NO: 145680 - RNA, 64 nt, Human
ucaaauacuucaucacuaaagaauucuuguuauuuaauaucaaauaaugaaacagcagucacuu

SEQ ID NO: 145681 - RNA, 64 nt, Human
uuaauuaacuugagggauuucuuuuuuaaguuuuuaauaucaaaaauugcuauuguauaguuug

SEQ ID NO: 145682 - RNA, 64 nt, Human
ggagcuuggaagauggcguucccagaaaguauuuuaauaucaauagaccacagccaaagccuua

SEQ ID NO: 145683 - RNA, 64 nt, Human
uaagauucagaccucaguuauauaaauuucaguuuaauaucaaccaaaaaauuaaaauuuuaau

SEQ ID NO: 145684 - RNA, 64 nt, Human
uugcagcuaaggaggggaaaaaaauguuguuuccuaauaucaaaugcaguauauuucuucguuc

SEQ ID NO: 145685 - RNA, 64 nt, Human
uugaacagucaagaaaaacauuauugaggaaaauuaauaucacagcauaaccccacccuuuaca

SEQ ID NO: 145686 - RNA, 64 nt, Human
cucuuuuaacaaaaaugucaagucuuuauaguuguaauaucaccauguuucccauuucuguuaa

SEQ ID NO: 145687 - RNA, 64 nt, Human
aaaaacaucuugaaaagacugcuaggaaggaaauuaauaucagucauccagaaguacacguuuc

SEQ ID NO: 145688 - RNA, 64 nt, Human
cacuaguagagaaagaauuacgucgcuuaauaccuaauaucauaguuguacaauaugaaaaaaa

SEQ ID NO: 145689 - RNA, 64 nt, Human
ucaaaaaaaaaaaaacaaauuaaccaauaaguucuaauaucaaagugcucagugguuugcccuu

SEQ ID NO: 145690 - RNA, 64 nt, Human
gagaaaauaaaauuguuagcauucuacccagagauaauaucaauucauauuguaguguagauuu

SEQ ID NO: 145691 - RNA, 64 nt, Human
accuacugcuucucugaggaaaugcauaaucuguuaauaucagacaaaaugagcaauuggcagu

SEQ ID NO: 145692 - RNA, 64 nt, Human
uaacugcuucugcauaccuuuuguguagagcuuuuaauaucauuugaggaaguuccaaauuugu

SEQ ID NO: 145693 - RNA, 64 nt, Human
ucgaucuuauuuaacuauguguggaacaacccaguaauaucagacucgaauuacuauuucauuc

SEQ ID NO: 145694 - RNA, 64 nt, Human
acuccuauacugcccucaaaauggaguuugcaauuaauaucaggauuuaucuuugcaaaaauca

SEQ ID NO: 145695 - RNA, 64 nt, Human
ugaaaguaguucuauugacauuccucaagauauuuaauaucaacugcauuauguauuaugucug

SEQ ID NO: 145696 - RNA, 64 nt, Human
aaaaauguaggguuauuuaccauaaccuguucauuaauaucagaaauuuacaauagcauuuuaa

SEQ ID NO: 145697 - RNA, 64 nt, Human
uaauaugccccagauugcaaaugcauccagucaguaauaucacugucuguauguggaggacaug

SEQ ID NO: 145698 - RNA, 64 nt, Human
ucaaguuaagggacacguuagaaauagaacagcuuaauaucacuggcuucagagcaaaaugagc

SEQ ID NO: 145699 - RNA, 64 nt, Human
agcagaugaaaaauuaaaauuugaacuugauuauuaauaucaauuaaaauguuuuauuuauuuu

SEQ ID NO: 145700 - RNA, 64 nt, Human
ccugccauucauauuuucugcauaacacuauuaauaauaucaaccuccacagccccuuauuuua

SEQ ID NO: 145701 - RNA, 64 nt, Human
auuaaaagacaucuuuccugcauugccaucuacauaauaucagauauuacggauguuagauugc

SEQ ID NO: 145702 - RNA, 64 nt, Human
auuauuauuuuuuacaaucauuucauuuuguauuuaauaucaauggacugagucugauucagaa

SEQ ID NO: 145703 - RNA, 64 nt, Human
caaggacauugugugauugccucacauuugcagguaauaucaagcagcaaacuaaauucugaga

SEQ ID NO: 145704 - RNA, 64 nt, Human
uacaaaauuagcugggugugguggcacaugccuguaauaucagcuacucaggaggcugaggcag

SEQ ID NO: 145705 - RNA, 64 nt, Human
uucugcaucagaacaaugugaggucauucuacguuaauaucauuaauaucagcauuuuucaugg

SEQ ID NO: 145706 - RNA, 64 nt, Human
agaacaaugugaggucauucuacguuaauaucauuaauaucagcauuuuucauggaaguuuaau

SEQ ID NO: 145707 - RNA, 64 nt, Human
ugggcaugagcugcugugcccagccuccauguuuuaauaucaacucucacuccugaauucaguu

SEQ ID NO: 145708 - RNA, 64 nt, Human
uucauccuuccuugccuuuuauuuuuauuuuuuguaauaucacaugugcuguaguuuggaauuu

SEQ ID NO: 145709 - RNA, 64 nt, Human
ucgccucuuucuguuucugugugaacuuucccgguaauaucacucguuaaauagguuuucuuua

SEQ ID NO: 145710 - RNA, 64 nt, Human
agagccuccacgcccggccaugaaauauaauucuuaauaucauacaggaaaaagucagcggguc

SEQ ID NO: 145711 - RNA, 64 nt, Human
aagcuagacaugugcuuugaaaugauuaucauccuaauaucaugggggaaaaaauaccaaauuu

SEQ ID NO: 145712 - RNA, 64 nt, Human
caugaagcacaucaauuacaagcuguagaccaccuaauaucaauuuguagguaauguuccugaa

SEQ ID NO: 145713 - RNA, 64 nt, Human
uuacauauuaacuguucuucaauaaauauuaucuuaauaucaguaauucuuuucucuuuuuuca

SEQ ID NO: 145714 - RNA, 64 nt, Human
agaaugagucuaauaucaagccuguacagacaguuaauaucacugcaggcuuuccugugguugg

SEQ ID NO: 145715 - RNA, 64 nt, Human
aacaaaaggaagaaaaucaaggaaagaaugagucuaauaucaagccuguacagacaguuaauau

SEQ ID NO: 145716 - RNA, 64 nt, Human
uacaggguguuuuuaaauccaacaagauagaguauaauaucaauacugcuaaaucugcaugucc

SEQ ID NO: 145717 - RNA, 64 nt, Human
ugcuuucugauggacaagaccucauaacugugauuaauaucaauaaaaaggggauguuguggau

SEQ ID NO: 145718 - RNA, 64 nt, Human
ucuuuauaaucagacuggaaacgggacuuucuauuaauaucauuuucagaauaaaaaauaggau

SEQ ID NO: 145719 - RNA, 64 nt, Human
cuuacaguguaaauuuuuccuccuuuaccuuugcuaauaucauggcagaauuuuucuuaucccu

SEQ ID NO: 145720 - RNA, 64 nt, Human
uacaaaccuuuguuucaacuuucuuaucuggaaauaauaucauuuauaaagggacacuuuuaug

SEQ ID NO: 145721 - RNA, 64 nt, Human
uuaccuuguuugaguuaucagggaacuuaguaaguaauaucaaagcauuuuauaaaugauauca

SEQ ID NO: 145722 - RNA, 64 nt, Human
gaggcuuaaaaucagggugguucaguucaaaagguaauaucaaccgucagcaaacaugucaguu

SEQ ID NO: 145723 - RNA, 64 nt, Human
gauaaauauuaguccaacaauagcuaaguuaugcuaauaucacauuauuauguauucacuuuaa

SEQ ID NO: 145724 - RNA, 64 nt, Human
aucuuaugaaagcacacaagagccuccauacuauuaauaucaaguuaauuucccguguuggaaa

SEQ ID NO: 145725 - RNA, 64 nt, Human
auuuugaguccuaggacuuaaaauuagucuuuuguaauaucaagcaggacccuaagaugaagcu

SEQ ID NO: 145726 - RNA, 64 nt, Human
cuuuacagaaaagaacauguuauucguauuuugcuaauaucaacugcauggauuaaaguagucc

SEQ ID NO: 145727 - RNA, 64 nt, Human
uuugaaaaaaaucaagguaacugucugaauacuuuaauaucagcuuguuuugugaauucucuga

SEQ ID NO: 145728 - RNA, 64 nt, Human
augaagggcuguaaaagcucaggucccuguucccuaauaucaaggagcccccugaccccuucuu

SEQ ID NO: 145729 - RNA, 64 nt, Human
uucauuaucuucaugguguuuuguuguguuacuguaauaucacuuaugaaauccuauuggugga

SEQ ID NO: 145730 - RNA, 64 nt, Human
uauuauuuauuuggcuuucugugaacugaggucuuaauaucagcucauuuuaaaagucuuugca

SEQ ID NO: 145731 - RNA, 64 nt, Human
cauaucccuuagaacagauccaauagacaacucuuaauaucagcuugcaacuguugaucucccu

SEQ ID NO: 145732 - RNA, 64 nt, Human
acguggugaacacagucaaauucaguguacuugauaauaucaacuggaccccaaaucugucuca

SEQ ID NO: 145733 - RNA, 64 nt, Human
uuacuaauaggcuuuucauauaauuaggaaaaccuaauaucacaucuauaguaaccauuucagu

SEQ ID NO: 145734 - RNA, 64 nt, Human
cacucuuuucccucagggagccuaaugagguuuuuaauaucaucuaaaaauaaagcauugaagu

SEQ ID NO: 145735 - RNA, 64 nt, Human
cacugugaaaacauucccuuaagcgugcacuuuuuaauaucacaucuauuugucugucugcuca

SEQ ID NO: 145736 - RNA, 50 nt, Human
uuuaugagagaauacuguaauaauaucaaaagcacuuuuucuggaaacac

SEQ ID NO: 145737 - RNA, 64 nt, Human
acaucacaaaccuggcacaccauuugaauaucccuaauaucauuccagucgcuuuccucaucag

SEQ ID NO: 145738 - RNA, 64 nt, Human
uacuaacacuggcuagcuauauuaucuuauauacuaauaucauguuuuaaaaauauaaaauaga

SEQ ID NO: 145739 - RNA, 64 nt, Human
aggacauggcauacaauggccuuggagguccaaauaauaucaaguacaucuuggagaugagggu

SEQ ID NO: 145740 - RNA, 64 nt, Human
uauaggacacacacacaaaagcucuuucuauuuauaauaucaaacugcauauucaccuuuauag

SEQ ID NO: 145741 - RNA, 64 nt, Human
uccauuaucgcaagugauauuuacaguaauucuuuaauaucaguaaauauccagugaggguuca

SEQ ID NO: 145742 - RNA, 64 nt, Human
uaaaacauaacagguuauggcaaagcagcauauuuaauaucagcucacauauguaggauaaaau

SEQ ID NO: 145743 - RNA, 64 nt, Human
agguuuacaaacaagcccauuguccugugccuccuaauaucauuuguacugaagaccccaucug

SEQ ID NO: 145744 - RNA, 64 nt, Human
auuuaaaaccaguaaggagacuugaaauucagaaaaucaacacauuuuuaaaugacuaacuucu

SEQ ID NO: 145745 - RNA, 64 nt, Human
uccccaccuucccucucccggcaacaucucugggaaucaacagcauauugacacguuggagccg

SEQ ID NO: 145746 - RNA, 64 nt, Human
auggguccagcugcguuuccaucacucgcuaauaaaucaacagaaacacaaauggcuuggcucu

SEQ ID NO: 145747 - RNA, 64 nt, Human
uccaagucuaaaauacaccuggaucugucuagucaaucaacauagcagagacagucuuaaaccu

SEQ ID NO: 145748 - RNA, 64 nt, Human
uaccaucguccaugaugccaaagguugagagaggaaucaacauggcugcuuugcugcuuccuuc

SEQ ID NO: 145749 - RNA, 64 nt, Human
aaggaggugcugaguuuuguaucuuuuuaaucauaaucaacaucaguuuuugacccaacuaacc

SEQ ID NO: 145750 - RNA, 64 nt, Human
uuuguuuuuuuguuuuuuuguuuuuuuugacucuaaucaacauuccuuuuguuggugacauuug

SEQ ID NO: 145751 - RNA, 64 nt, Human
uguauggauuuaccugaaaacaaauuauucauuuaaucaacagguguguuuuuuuuaagauuua

SEQ ID NO: 145752 - RNA, 64 nt, Human
uaauaaguuuuauauccuucauucugggagaggaaaucaacauaagguguugacuaauugauua

SEQ ID NO: 145753 - RNA, 64 nt, Human
guaacauaaugaaacacaccugucuaggggcggcaaucaacagucuuacacagagaggguauuc

SEQ ID NO: 145754 - RNA, 64 nt, Human
gcugugaauuuuuguacaagucuuguaauuaucgaaucaacaacuuguuucaauuuaauaaaaa

SEQ ID NO: 145755 - RNA, 51 nt, Human
cagccacugcaaaacuuuaauaaucaacaaauaguuauggaaaauucgguc

SEQ ID NO: 145756 - RNA, 64 nt, Human
gaaaaguuaaccaaggaauuauucuuuucucaccaaucaacacuuuuaagaaauauauauauau

SEQ ID NO: 145757 - RNA, 64 nt, Human
uugaaauuuauuacuagcuugcuacccacgaugaaaucaacaaccuguaucugguaucaggccg

SEQ ID NO: 145758 - RNA, 64 nt, Human
uuggauuaauucaugguaucuugagucuugguucaaucaacagaauuguucuuuuuccuguugu

SEQ ID NO: 145759 - RNA, 64 nt, Human
uuguauaccuguaauguaaauguggagaaguuugaaucaacauaaacacguuuuuugguaagaa

SEQ ID NO: 145760 - RNA, 64 nt, Human
uccagugacaaugcaagguaaguauaucaaaggaaaucaacaguugugcuugggggcuuuuugu

SEQ ID NO: 145761 - RNA, 64 nt, Human
ugaaagguauuccaugaagcugaguucuuuagauaaucaacacuacuaacauuacauuuuugag

SEQ ID NO: 145762 - RNA, 64 nt, Human
auccugucucaaaaaaaaaaaaaaaucacccuuaaaucaacaaaaagaccucaugcucaugcag

SEQ ID NO: 145763 - RNA, 64 nt, Human
gacacaacagaaaagaaacuguagaccuugggacaaucaacauuuaaauaaacuuuauaauuau

SEQ ID NO: 145764 - RNA, 64 nt, Human
uuucuuggcuaagauuaagacaaagaacauaucaaaucaacagaaaauauaccuuggugccacc

SEQ ID NO: 145765 - RNA, 64 nt, Human
gcuggggcucuuccauuuugcagauaagucaaauaaucaacacuaaaggaggcuaaacuguuga

SEQ ID NO: 145766 - RNA, 64 nt, Human
gcuuagucucacagugucuuuaacucaucuuugcaaucaacaacuuuacuagugacuuucugga

SEQ ID NO: 145767 - RNA, 64 nt, Human
aacuacccagggcagccccuuuguggcccaggauaaucaacacuguucucucuguaccaugagc

SEQ ID NO: 145768 - RNA, 64 nt, Human
ugaaagaaugacccuuauuguggucuguccuucuaaucaacauaauuagggcagcuuaccccaa

SEQ ID NO: 145769 - RNA, 64 nt, Human
cgaagaaacuuagaguuuaguuaacaacaucaaaaaucaacagacugcacugauaauuuagcag

SEQ ID NO: 145770 - RNA, 64 nt, Human
ucccugcuauuucccuccuugggcucuucccgcaaaucaacacuuucugcacuuaucuuuugga

SEQ ID NO: 145771 - RNA, 64 nt, Human
uaccauccucccaccugccauucugacuuuauuaaaucaacauguggaccagaguguuaaugag

SEQ ID NO: 145772 - RNA, 64 nt, Human
uuagaagguauuuuuuuuccaacugaguagugaaaaucaacaaggugcauauaaaccauccuau

SEQ ID NO: 145773 - RNA, 64 nt, Human
gacuuuccucuguaacagagguaauauaugagacaaucaacaccguuccaaaggccugaaaaua

SEQ ID NO: 145774 - RNA, 64 nt, Human
cggcccuagaaaccaguggaguuauuucaccacaaaucaacaaugugccugaggugcaugggaa

SEQ ID NO: 145775 - RNA, 64 nt, Human
agagguggcuggcuuuggccagacauggacccuaaaucaacagacaauggcauugucgaagagc

SEQ ID NO: 145776 - RNA, 64 nt, Human
uaggcuguaccccauuuccuuggcucccauuaaaaaucaacaacauucuaaugauuagggaaca

SEQ ID NO: 145777 - RNA, 64 nt, Human
acaagacucugaacauacuaccuucacacucgguaaucaacaauacagugugguucaaauaaga

SEQ ID NO: 145778 - RNA, 64 nt, Human
uuuauaauuaagcagaaauuacaaaacuaggaauaaucaacauuguaagauauguuaauaaaaa

SEQ ID NO: 145779 - RNA, 64 nt, Human
ucagaaaagaaagcuuuauuuuaacacucaucugaaucaacauuaaagccuuuucucucaaagc

SEQ ID NO: 145780 - RNA, 64 nt, Human
uuguauauucuugcaaugcauaaaaugacauuauaaucaacaaacuuaugguuuguuucaauug

SEQ ID NO: 145781 - RNA, 64 nt, Human
uugaaauugacuacauuaauuucuuuccaccuagaaucaacaggauguuuauuuccuaugcuga

SEQ ID NO: 145782 - RNA, 64 nt, Human
gagcagugaucauuauucuccgcuuucucuuucuaaucaacacuugaaaagcaaagugucuuuu

SEQ ID NO: 145783 - RNA, 64 nt, Human
ggccgcuugcacccgcucucuguuguacacuuucaaucaacacuuuuucagacuaaaggccaaa

SEQ ID NO: 145784 - RNA, 64 nt, Human
uaaagguuuucagggguucacuuaaguguaucacaaucaacaccagacgggauauuuuaacuau

SEQ ID NO: 145785 - RNA, 64 nt, Human
ccugacaugcuuuaaauuaucuggcuguauucuaaaucaacaccuaaccccucaaggaaacuga

SEQ ID NO: 145786 - RNA, 64 nt, Human
uguaguggggcugggcagggaugggggcuugagaaaucaacaggugcagcccagugggucagag

SEQ ID NO: 145787 - RNA, 64 nt, Human
ccucgguguacacagaggcgggucuauaacaggcaaucaacaaacguuucuugagcuagaccaa

SEQ ID NO: 145788 - RNA, 64 nt, Human
gaaguuaauaugcauccaaaauauuucaaccuguaaucaacauaaaauuuuaaugagauauuuu

SEQ ID NO: 145789 - RNA, 64 nt, Human
gcuugaugcccagggaacaacccaaccgucuuucaaucaacaguucuugacugccaaacuuuuu

SEQ ID NO: 145790 - RNA, 64 nt, Human
caaauccaagcaccauucuuuauuaucuaccaugaaucaacaaacauucuuaaaacaauaaauc

SEQ ID NO: 145791 - RNA, 64 nt, Human
uauggauuuuguauauauaggagauuuuuagaaaaaucaacaaccuaacaccagauucaaguca

SEQ ID NO: 145792 - RNA, 64 nt, Human
ugucucgugaauggacaguagccacuuacaaacaaaucaacauuuuuaaaaagaaaauguaaag

SEQ ID NO: 145793 - RNA, 64 nt, Human
cacaaaggcauaaacuugaaaacacaugagauugaaucaacaugcuuuaauaggaaaagaugua

SEQ ID NO: 145794 - RNA, 64 nt, Human
ucucacauucagacuuacacuuaaugguguuagaaaucaacaaaacuccuuuuuaaaaagaaaa

SEQ ID NO: 145795 - RNA, 64 nt, Human
gcuauaaauuguuuaaugaggccauuccagcagaaaucaacagaauaauugauuacucuucucu

SEQ ID NO: 145796 - RNA, 64 nt, Human
guguguugcuaaagaauucuacuuuuaguaggcuaaucaacaaugaaaggguuagaaaauugcu

SEQ ID NO: 145797 - RNA, 64 nt, Human
aaggcagugcaaagaaggaaggcuccaaacggaaaaucaacaugaguggcuacauccuguucag

SEQ ID NO: 145798 - RNA, 64 nt, Human
auagacccauuguguguuucuucucacuagcagcaaucaacaagcccuuucugccguuaauaag

SEQ ID NO: 145799 - RNA, 64 nt, Human
augcuucuuaaagucuggcuuuauaaccguuuaaaaucaacaauguugauuuuagauaaccaag

SEQ ID NO: 145800 - RNA, 64 nt, Human
uugcauuugagaagcuuaugacuuagaugggcagaaucaacaaagaugaaaccgccugaggaca

SEQ ID NO: 145801 - RNA, 64 nt, Human
gaugaucuuucaggcaaucucaacuuacuucuuuaaucaacauuuaauaucaauggaucuguga

SEQ ID NO: 145802 - RNA, 64 nt, Human
gcaucacagcuuuguguauaauugcaaaaguugaaaucaacaugaaugcccaaaauagugaauu

SEQ ID NO: 145803 - RNA, 64 nt, Human
auaaauaacauuuaauuugacggaaaauucuaaaaaucaacauuugguaacuuaaauauucauu

SEQ ID NO: 145804 - RNA, 64 nt, Human
uugcaauccuuugcaguuuguucucauuacagauaaucaacauuucuuuuguauaauucaauac

SEQ ID NO: 145805 - RNA, 64 nt, Human
guuuucccucaugcgauuacuagaaaauggcaggaaucaacaaaauggagaccucccacuguuu

SEQ ID NO: 145806 - RNA, 64 nt, Human
guagcauuagcucucacaaaagaggaccaagaaaaaucaacaaacaaaucaaagccaggcucag

SEQ ID NO: 145807 - RNA, 64 nt, Human
aucauucuuggcugucuuucuagguauuccauagaaucaacacauuuuaaggcugaaagauacu

SEQ ID NO: 145808 - RNA, 64 nt, Human
auuacagcuacugacaauauaaaggguuuuguugaaucaacaaugugauacguaaauuauagaa

SEQ ID NO: 145809 - RNA, 64 nt, Human
aucggguuucuuuucuuuuugccucuaaugcagaaaucaacagaaucacucacacauacaagua

SEQ ID NO: 145810 - RNA, 64 nt, Human
ggaacucccccauucuuucaagagauuaaaaauaaaucaacagucugaaaaccuaagcagacac

SEQ ID NO: 145811 - RNA, 64 nt, Human
cgcacaucugcccuaagcgaaaucugucagaaggaaucaacaaggcuccuugccuccccuccca

SEQ ID NO: 145812 - RNA, 64 nt, Human
cacacaaacacacacauuuaucauuuaaugcauaaaucaacacaaaagguuuucccauuaauau

SEQ ID NO: 145813 - RNA, 64 nt, Human
cucagcagcauuuuuccuucaaaaucaucuuuuuaaucaacagucauuaauaaauguacaugua

SEQ ID NO: 145814 - RNA, 64 nt, Human
ggagguuucuuucaaacaucauggccucccauccaaucaacaucaucaaauuacauguguaauc

SEQ ID NO: 145815 - RNA, 64 nt, Human
cauagcucuaaucuaauauauaaaaugugugaugaaucaacaagauuuccacaauucuucuguc

SEQ ID NO: 145816 - RNA, 64 nt, Human
accuucucaaacuuaaugucugagagccucauaaaaucaacauauuuacuuauuaagcaguuua

SEQ ID NO: 145817 - RNA, 64 nt, Human
accaagauaaaugagcugccagaaucagguuuccaaucaacagcagugaguugggauuggacag

SEQ ID NO: 145818 - RNA, 64 nt, Human
uauuacaacacuuuaaguaaaauauagacuggauaaucaacauuugccaccucuaaauaugccc

SEQ ID NO: 145819 - RNA, 64 nt, Human
caaagaggagccuguugucuguuagggaccacuaaaucaacaaccacaaauggauuuuuuuuuu

SEQ ID NO: 145820 - RNA, 64 nt, Human
acagacucuccugucccccuucaucgcucuuaagaaucaacagguuaaaacucggcuuccuuug

SEQ ID NO: 145821 - RNA, 64 nt, Human
uuuuuuaauuaagcaauuccauuugauugaaaaaaaucaacaaaaaauaaacaccguuuacucu

SEQ ID NO: 145822 - RNA, 64 nt, Human
auucuuaucuuaggauuuaccaaauagggcaaagaaucaacagugaacagcuucacuuaaaauc

SEQ ID NO: 145823 - RNA, 64 nt, Human
ggguagaaauaaaaucucugagaugaaacaaaggaaucaacaugauaaaauuuaggcgaaguag

SEQ ID NO: 145824 - RNA, 64 nt, Human
cucauucauccauccguucauucauucagccuucaaucaacaucucuugagugucuauuaugua

SEQ ID NO: 145825 - RNA, 64 nt, Human
cuacuccucacugcaaaaacauauccaugcguagaaucaacaacuccagucaugggaccaggag

SEQ ID NO: 145826 - RNA, 64 nt, Human
augguaaauucuuaaaugugugugagauugucagaaucaacaaaacuagguugguuaaacauau

SEQ ID NO: 145827 - RNA, 64 nt, Human
ugauacuguaaggguguuucguucccuuuaaaugaaucaacacugccaccuucuguacgaguuu

SEQ ID NO: 145828 - RNA, 64 nt, Human
gaccucacacacacaaaaaaugcacaaacaaugcaaucaacagaaaagcuguaaauguguguac

SEQ ID NO: 145829 - RNA, 64 nt, Human
uaucaguaagaaacagaccuaguuuaaaaggaauaaucaacaauuuuauaaaggagauggcuua

SEQ ID NO: 145830 - RNA, 64 nt, Human
uuuucugccucuuacaugugaauguugagcccacaaucaacagugguuuuauuuuuuccucuac

SEQ ID NO: 145831 - RNA, 64 nt, Human
uauagauaaaauccuauuuaagacaaauucuguuaaucaacaagggcucuguauuuuuuuaagu

SEQ ID NO: 145832 - RNA, 64 nt, Human
ggguaccacauuuugagaaccauggggcauuggcaaucaacaaaugcaaugcuugugacuugac

SEQ ID NO: 145833 - RNA, 64 nt, Human
aacaugagggugcacaugucaaguacuuagcuaaaaucaacaaagugaggacugugaagauaac

SEQ ID NO: 145834 - RNA, 64 nt, Human
uaaugucuauacauguuucgacuguuuaaugaguaaucaacaaaaucugccagagagucccucu

SEQ ID NO: 145835 - RNA, 64 nt, Human
aaggaaauguucaugugggaagaggguugcugaaaaucaacaacgcuugaaguuaaaaagugug

SEQ ID NO: 145836 - RNA, 64 nt, Human
cagagcaguguccuccugggguucccacgugcaaaaucaacaucaggaacccagcuucagggca

SEQ ID NO: 145837 - RNA, 64 nt, Human
uccacgaugaagagaaucucuuuucaaucugugcaaucaacaaguuuuugaaaggcuuuuguuu

SEQ ID NO: 145838 - RNA, 64 nt, Human
ucuaccugcaagaugugcagagggcauaaaagcaaaucaacacuuuauaguuauucuucugaac

SEQ ID NO: 145839 - RNA, 64 nt, Human
auuuccauuuauuguuugaaaugucgaucaagagaaucaacagaugauaguccaauuuuuacuc

SEQ ID NO: 145840 - RNA, 64 nt, Human
gaccacugucuucauugcacaacaaugugaauauaaucaacacuauugaacuguaccuaagaau

SEQ ID NO: 145841 - RNA, 64 nt, Human
gaaaucuguucaacaaacuuguuuaauuuguuuaaaucaacauagcaugaaacaccaaauaaaa

SEQ ID NO: 145842 - RNA, 64 nt, Human
gagcaaggagaacguuuaauacuucauuacaucaaaucaacacugcuccauggugagagcacag

SEQ ID NO: 145843 - RNA, 64 nt, Human
ugucauaggagggaagcuucaaagucaugaaaccaaucaacagccaagucagcaagcaaucagg

SEQ ID NO: 145844 - RNA, 64 nt, Human
agcccaaagguuccuaagccuggcugcaaagaagaaucaacagggacacuuuuuaaaaacacuc

SEQ ID NO: 145845 - RNA, 64 nt, Human
uuaacaucacuuucuaaagaguaguucauaaaaaaaucaacauacugauaaaaugacuuuguac

SEQ ID NO: 145846 - RNA, 64 nt, Human
gccaaaaaaaaaaaaaaaggaaacguuuaucaugaaucaacaggguuucaguccuuaucaaaga

SEQ ID NO: 145847 - RNA, 64 nt, Human
ugauagugaaauaaggagcuugggcuaagguauaaaucaacacacugcuuccuuccuccagaag

SEQ ID NO: 145848 - RNA, 64 nt, Human
uucucacuagaugacuguaaguagacacgagcuuaaucaacagaaguaucaagccaugugcuuu

SEQ ID NO: 145849 - RNA, 64 nt, Human
ucugguuccagaaccgcaggaugaaaaugaagaaaaucaacaaagaccgagcaaaagacgagug

SEQ ID NO: 145850 - RNA, 64 nt, Human
gaguguuuaaaucaagaggaagcugcaugaauguaaucaacauuccaacuggagcucuccuuug

SEQ ID NO: 145851 - RNA, 64 nt, Human
agcaccauuaacuccuccugagcucugauaagagaaucaacauuucucaauaauuuccuccaca

SEQ ID NO: 145852 - RNA, 64 nt, Human
cuacuacauuccagacuggaaauguaugaaugauaaucaacauaaugcugauaaacugacauaa

SEQ ID NO: 145853 - RNA, 64 nt, Human
cagucagggccccccugacguuaggaccaggagaaaucaacaggagggcagcccguccucucuc

SEQ ID NO: 145854 - RNA, 64 nt, Human
aggcggccucagaacucagcugugacucuugcagaaucaacagagacugaagugggcuuuugug

SEQ ID NO: 145855 - RNA, 64 nt, Human
aaccaaugacaaccaaacugaaaccgaaacgaaaaaucaacaaacacucuguccucuaucccuc

SEQ ID NO: 145856 - RNA, 64 nt, Human
auuuacucuccucugccuccauuuguuaauacagaaucaacauuuagucuucauuaucuuuuuu

SEQ ID NO: 145857 - RNA, 64 nt, Human
acaauuaauuuuaguggaucucaaacuugucuuaaaucaacaaccuucuacucauguuaauguc

SEQ ID NO: 145858 - RNA, 64 nt, Human
aggaaaaggcacauacucaguuuuuuaaauguacaaucaacaaguaaaaauaaccucauguaag

SEQ ID NO: 145859 - RNA, 64 nt, Human
aaggaaucauucuccccucccucccaccacauagaaucaacauaugguagggauuacagugggg

SEQ ID NO: 145860 - RNA, 64 nt, Human
ugcauuuuguggaauuuugagaaaaauagagcaaaaucaacaugacugguggugagagaccaca

SEQ ID NO: 145861 - RNA, 64 nt, Human
acugucacacaggucacgaggguggacucccuacaaucaacaaagcaaacagagagccuguggg

SEQ ID NO: 145862 - RNA, 64 nt, Human
gaccuaggagacaucuacagaacgcuccaccccaaaucaacagaauauacauucuucucagcac

SEQ ID NO: 145863 - RNA, 64 nt, Human
gaaguuaacagucucauuacagauuuaguuuaccaaucaacagcaugucuacugcuuggaucca

SEQ ID NO: 145864 - RNA, 64 nt, Human
uaucaguaagauuuguguuuugugauaaucccuaaaucaacauaccacuuguaaacugaacuuc

SEQ ID NO: 145865 - RNA, 64 nt, Human
acaauguguauugaaguaccuagauuuguuugauaaucaacaaaucuuuccuuuuucaaugaac

SEQ ID NO: 145866 - RNA, 64 nt, Human
guugaaaucauagaagaugcaaaugaccuuucaaaaucaacacaauguguucugaaacuuucgu

SEQ ID NO: 145867 - RNA, 64 nt, Human
uuuccuuucugcucuuacacagcauuguuuugucaaucaacacagccugcacugaaaggaccug

SEQ ID NO: 145868 - RNA, 64 nt, Human
aauggauccaaaaggacaaaacauguuacaagcaaaucaacauaguugcugcaggcggaacuga

SEQ ID NO: 145869 - RNA, 64 nt, Human
uuuaucccuuccugucugaacaaaaacuguauggaaucaacaccaccgagcucugugggaaaaa

SEQ ID NO: 145870 - RNA, 64 nt, Human
cuuggugauucuuucaagugccgaauguuauuagaaucaacauugcauccuucuugcuuauacg

SEQ ID NO: 145871 - RNA, 64 nt, Human
gauuuaaaucuuuucaaauguuuuuaggaguauuaaucaacauuguauucagcucuuaaggcac

SEQ ID NO: 145872 - RNA, 64 nt, Human
uuggaguccuuuccuucccaggcaaaacuucgagaaucaacaccuggagacagucccuccacug

SEQ ID NO: 145873 - RNA, 64 nt, Human
aauauaguaauccuguaacuggguuugaaaaaauaaucaacaaaagauacaauucaaggguuag

SEQ ID NO: 145874 - RNA, 64 nt, Human
cuuaaauauacuuagauccugguaagaggcaaagaaucaacagccaaacugcuggggcugcaag

SEQ ID NO: 145875 - RNA, 64 nt, Human
uacuuggauuuauaaaagcagacucaccuaauaaaaucaacauucauuguaugagugugugaau

SEQ ID NO: 145876 - RNA, 64 nt, Human
ugccccuaaccacugugccauaccaccucccaauaaucaacagcaaaauuauaggucuaacaau

SEQ ID NO: 145877 - RNA, 64 nt, Human
aggucauuguuuuuggcuuaaguuuauuauagaaaaucaacacuaauguuuuuagauuuuaauu

SEQ ID NO: 145878 - RNA, 64 nt, Human
uaccgccccaaaguaaaagaaaccacuucuggucaaucaacacuaccagcguauauauaagaaa

SEQ ID NO: 145879 - RNA, 64 nt, Human
cuucugccucccuugguaacccaaggaaugauggaaucaacacaacauaguauguuugcuuucc

SEQ ID NO: 145880 - RNA, 64 nt, Human
cagauuuuguaucuaacagacagugcucagugcaaaucaacauuccagcggucaggacugaccc

SEQ ID NO: 145881 - RNA, 64 nt, Human
auucagguuggcugugucagaugcuaaugugcugaaucaacagucauugcagaucacgaagugu

SEQ ID NO: 145882 - RNA, 64 nt, Human
ucaccuuacaugguaucacugggaacauuuauggaaucaacacuucuguagcucagugacaggu

SEQ ID NO: 145883 - RNA, 64 nt, Human
uaagcuugaaacugcagaagaaauucacaggaaaaaucaacaagauagugaucucucugugaaa

SEQ ID NO: 145884 - RNA, 64 nt, Human
uuaacucacaaauaacauaaaauauugggcgcuaaaucaacaaaagcaauauauauuugggauc

SEQ ID NO: 145885 - RNA, 64 nt, Human
agccucauccugucugccccucacucugcccuggaaucaacaucuuccgaguccuucuuggggg

SEQ ID NO: 145886 - RNA, 64 nt, Human
cuagcaaccagccccugcugccccauccugcuggaaucaacacagacuugcucuccaaagagac

SEQ ID NO: 145887 - RNA, 64 nt, Human
ucuuucucccuuuuccucuugcucacugcccuggaaucaacaggcugguugcugguuagauuuu

SEQ ID NO: 145888 - RNA, 64 nt, Human
ggcaauauccuuuuaauguguuuuaacauuuuuuaaucaacaucguuuaaaaauaauuuacuaa

SEQ ID NO: 145889 - RNA, 64 nt, Human
aguaccgccuuauggaguauacgggcaaccauggaaucaacaaggauuuggaguagaguaaguu

SEQ ID NO: 145890 - RNA, 64 nt, Human
aaaaggagggacuuuaaaauaccuucuugacaaaaaucaacaaugcacaacuuacaaaguguuc

SEQ ID NO: 145891 - RNA, 64 nt, Human
gacuuuguuuaaagauuuuauuuaaacuauuaagaaucaacaugcaaacagccuacuucuucau

SEQ ID NO: 145892 - RNA, 64 nt, Human
agaaagauuauauauaacuaugcuaauuguucauaaucaacagaaaccaagauagagcuacaaa

SEQ ID NO: 145893 - RNA, 64 nt, Human
ucuuuaaaaaaaagaaaaaagaaaccaaaaugagaaucaacacuucauaggcucacuggguuuu

SEQ ID NO: 145894 - RNA, 64 nt, Human
aucuuuucaccccaccuucaaucaacaaguccucaaucaacaaguccuacugacugcacaucuu

SEQ ID NO: 145895 - RNA, 64 nt, Human
ccagaaaccugugucaucuuuucaccccaccuucaaucaacaaguccucaaucaacaaguccua

SEQ ID NO: 145896 - RNA, 64 nt, Human
uaucuuuaaaagaaaauuacccuuugacuuuuauaaucaacauaaguuccaggcccaguaugga

SEQ ID NO: 145897 - RNA, 64 nt, Human
acuaaauggggagauggggcuguuaagcuguccaaaucaacaagggucauauaaauggccuuaa

SEQ ID NO: 145898 - RNA, 64 nt, Human
ccuaauggcaacucauugcucuccauguaaauguaaucaacagaugaagagaauauaauugcuc

SEQ ID NO: 145899 - RNA, 64 nt, Human
aaguuuuuauaugggcaacuuuaugcgaaauccaaaucaacacaaugcacucugcaguuagaca

SEQ ID NO: 145900 - RNA, 64 nt, Human
accaccucaacugauagcaaaauaucuaauuagaaaucaacaguuugaugaguuuuuuuccuag

SEQ ID NO: 145901 - RNA, 64 nt, Human
aaugcuaaacucaucagcucaguaccuaacugccaaucaacacacugccaaugcgggugggcua

SEQ ID NO: 145902 - RNA, 64 nt, Human
ucacuugucacuuuucuucugugcugggaaaaauaaucaacaaugugggucuuucaugagcagu

SEQ ID NO: 145903 - RNA, 64 nt, Human
auucagaauaucaucuuuuagacacagcccgaggaaucaacaauaguaacucuuucuuuccguu

SEQ ID NO: 145904 - RNA, 64 nt, Human
gacaaaacuguugcugcacacaucuguacucgucaaucaacaaaaccugaugcaaaaaacagaa

SEQ ID NO: 145905 - RNA, 64 nt, Human
uggcuuauacuuucuuaauaaaaaggagaaagaaaaucaacaaaugugagucauaaagaagggu

SEQ ID NO: 145906 - RNA, 64 nt, Human
aaaauaaugauuccacguugcuuuuuagaguucaaaucaacaucuuucuggauaaaucuauuuu

SEQ ID NO: 145907 - RNA, 64 nt, Human
uucuaggaauugacuccaaugcagaauagugagaaaucaacaaaaagcaaaauaagacaauucc

SEQ ID NO: 145908 - RNA, 64 nt, Human
acuaaauacaguguuggucuugccuguccuucaaaaucaacaacagauugucucucggcuccag

SEQ ID NO: 145909 - RNA, 64 nt, Human
uggaaaaagggacuauuuguggaguaauggcauuaaucaacauagaacaucuuauuugaaucaa

SEQ ID NO: 145910 - RNA, 64 nt, Human
uaauggcauuaaucaacauagaacaucuuauuugaaucaacaguuaacuucaguagucauguga

SEQ ID NO: 145911 - RNA, 64 nt, Human
ggacagaugggguguugucaaacaucuucagggaaaucaacaagccaacagacaagaaggagcg

SEQ ID NO: 145912 - RNA, 64 nt, Human
ggcugagccccuaccccaacccaagcucugcggaaaucaacagccccagagccacuuggaggga

SEQ ID NO: 145913 - RNA, 64 nt, Human
uaacauggcuccacuggacacaaaagagggauggaaucaacaggcagggggccuuuuauaagcc

SEQ ID NO: 145914 - RNA, 58 nt, Human
ggcuggucuugaacuccugagcucaagaaaucaacacaucuuggccucccaaguugcu

SEQ ID NO: 145915 - RNA, 64 nt, Human
uauauauacauauauauauauauaugcgccacauaaucaacagaaagauggggcugucccagcc

SEQ ID NO: 145916 - RNA, 64 nt, Human
aucaugcuucucauuuuuuaaacuauguucuuuaaaucaacacuggaaacucuguauuauauac

SEQ ID NO: 145917 - RNA, 64 nt, Human
ucaaauaggaaaaaaugggggaguaguuaagcaaaaucaacagucauccuacuauguugaaaga

SEQ ID NO: 145918 - RNA, 64 nt, Human
aguucccgaacccuagagccaggauguucuguuuaaucaacagcucagccagcugccugggagu

SEQ ID NO: 145919 - RNA, 64 nt, Human
agccuguuaauuguuaguugucuuccuguagcugaaucaacaaguuauuuucaacucaauuuua

SEQ ID NO: 145920 - RNA, 64 nt, Human
guauagugggcugaggugcagcugaucucuagcuaaucaacacaacccaccaacaaaugaccac

SEQ ID NO: 145921 - RNA, 64 nt, Human
ucuuuggauuugaucacuacaaguauuauuuuacaaucaacaaaauggucauccaaacucaaac

SEQ ID NO: 145922 - RNA, 64 nt, Human
auuaguguuucauugauacuaaauuacccagcuuaaucaacagaaugguuuaaguaguaccagg

SEQ ID NO: 145923 - RNA, 64 nt, Human
uaguguguaaggagccauauacaauauguaaacaaaucaacaugacuguguuucaacaaggccu

SEQ ID NO: 145924 - RNA, 64 nt, Human
uaauagcauugucauuugggcuuucuguugaaugaaucaacaaaccacaauacuuccugggacc

SEQ ID NO: 145925 - RNA, 64 nt, Human
caauaauuaaaggugccagaucaaaauaguaauaaaucaacaaauaauuuuugauugacuggug

SEQ ID NO: 145926 - RNA, 64 nt, Human
uuagcacuguugauguaucugaguugccaagacaaaucaacagaagcauuuguauuuuguguga

SEQ ID NO: 145927 - RNA, 64 nt, Human
ucuggcauagccaugcugguagcaagagagaaaaaaucaacagcaaacaaaaccacacaaacca

SEQ ID NO: 145928 - RNA, 64 nt, Human
uaugauuucaauuugcuaccaaugagaagaggcaaaucaacaaauuugucaauuuaugggggcu

SEQ ID NO: 145929 - RNA, 64 nt, Human
uuuuguagauugcacuaauuuacauccuagcaagaaucaacacuguaucaguccacggaccugc

SEQ ID NO: 145930 - RNA, 64 nt, Human
uuuucacaugcuuaaugauggaaaugaaauguuaaaucaacaaaauaagauccaguguuucaua

SEQ ID NO: 145931 - RNA, 64 nt, Human
ucacuuaucucauccauggauguaaaugaugaugaaucaacauaguaacugaaaugaaaucuuc

SEQ ID NO: 145932 - RNA, 64 nt, Human
guucucucuggagaaagguuagagaccccaggacaaucaacaugugcaccguuccccuccucgg

SEQ ID NO: 145933 - RNA, 64 nt, Human
ugccuaaaucauaacuugaugaugcuugggaaagaaucaacaguuaaaacuucaugaaguucua

SEQ ID NO: 145934 - RNA, 64 nt, Human
uaugugagugcaaaacauuuuaacaguuuucucaaaucaacaaacagccuucuccuauagcugu

SEQ ID NO: 145935 - RNA, 64 nt, Human
uauacacuggcuauuuaaccaaaugaggagguuuaaucaacagaaaacacagaauugaucauca

SEQ ID NO: 145936 - RNA, 64 nt, Human
cuuucaccuuucccuaaagacccuaaaucugaggaaucaacagggcagcagaucuguauauuuu

SEQ ID NO: 145937 - RNA, 64 nt, Human
gcacauaaaaaauaccgaagaaaacccaaaauucaaucaacaauucugucuuauugaagaguug

SEQ ID NO: 145938 - RNA, 64 nt, Human
gucuccugugaucacaucuugucucggcuguaggaaucaacagaaggagacguccucuacauaa

SEQ ID NO: 145939 - RNA, 64 nt, Human
guagcuuugguaacaaacaaaauccguauaugcaaaucaacauauccaaacaugccaagacugc

SEQ ID NO: 145940 - RNA, 64 nt, Human
ccacuuuauuggcaguugacauucccuuacucccaaucaacacucuuaaauauuuguacuguuu

SEQ ID NO: 145941 - RNA, 64 nt, Human
cgcacuucuccaccccucccacauuuacagccagaaucaacauucccugggccccugaggaaau

SEQ ID NO: 145942 - RNA, 64 nt, Human
ugcccaucaucuuaauguuuggagcuugccuuguaaucaacagagagagaaacuaaacacauac

SEQ ID NO: 145943 - RNA, 64 nt, Human
gaaaagucccaagggucugaaugaaagcaucuuuaaucaacacucaacacucgcaauauucuag

SEQ ID NO: 145944 - RNA, 64 nt, Human
uggacgggacagugaguggcugggaggaagccagaaucaacagcuccagcccucugcgcuacaa

SEQ ID NO: 145945 - RNA, 64 nt, Human
ucuuuccuuuccauaucccaguauaaucucuguuaaucaacaggacuaccccaagaacccaugu

SEQ ID NO: 145946 - RNA, 64 nt, Human
aaagguuacauuuuguuuuuccauuuaauuuaauaaucaacaaaacgacaaagucaguuuaaua

SEQ ID NO: 145947 - RNA, 64 nt, Human
agaaaaacugggaaauacagguacccaaagaguaaaucaacaucuguauacccccuucccaggg

SEQ ID NO: 145948 - RNA, 64 nt, Human
aggcccauaagagaaagaggaguuuguuacauuuaaucaacacugugaagucuguucuacagca

SEQ ID NO: 145949 - RNA, 64 nt, Human
gcuauguacacaugugcacacacacacaacugggaaucaacaaugaguuuauuguucaugguag

SEQ ID NO: 145950 - RNA, 64 nt, Human
uccgccucuaccaagagcuucgccagugucacugaaucaacagauccaagggaaugaacaagaa

SEQ ID NO: 145951 - RNA, 64 nt, Human
gcaguuuucuucccugcugcauguaaugucucagaaucaacauucuuuuaaaaucuagacuaua

SEQ ID NO: 145952 - RNA, 64 nt, Human
uuagaaauauuuuuuguuugcugaaauaaagcucaaucaacacacuaccuuaaaaaaaaagugg

SEQ ID NO: 145953 - RNA, 64 nt, Human
gguguaaauuguauugaaaaagaucgcgaauaaaaaucaacaaaugugaaagcccagaaaaaua

SEQ ID NO: 145954 - RNA, 64 nt, Human
uaacauguggacccuuuauugucuaacugauaagaaucaacaaggucacccaucaccgccaccu

SEQ ID NO: 145955 - RNA, 64 nt, Human
aaucaugguaaagaauacugagacaaugaaaaaaaaucaacaaaauaugcuuucuggagaacug

SEQ ID NO: 145956 - RNA, 64 nt, Human
guguacacaaaguuucucauauccuguucaaguuaaucaacaucaagcacauggggaugcuuua

SEQ ID NO: 145957 - RNA, 64 nt, Human
acuucauggaucagaucuggggcagcacccuauaaaucaacaccuuaauaugcugcaacaaaau

SEQ ID NO: 145958 - RNA, 64 nt, Human
ccagcuauagaaaucucucuauuuuugccacuuuaaucaacacauagcuuccuggaugacugcc

SEQ ID NO: 145959 - RNA, 64 nt, Human
ggcucucguuugcuauaauauuuuaaagcuguuuaaucaacaguggagucugcucuauaaauau

SEQ ID NO: 145960 - RNA, 64 nt, Human
aacacaaagcacaggucaggauccucugagagaaaaucaacauugcaccacguaggggugggcu

SEQ ID NO: 145961 - RNA, 64 nt, Human
uggaaaaacaauuuuucaaaaacuacagcuuagaaaucaacaguuauacuagaauauauuuuuu

SEQ ID NO: 145962 - RNA, 64 nt, Human
ucaguauuucuuuauaaaaaucuguuguucugaaaaucaacaaccuuagaaggauuuugucuua

SEQ ID NO: 145963 - RNA, 64 nt, Human
agaucuaauccagaaucuauaaagaacucaaacaaaucaacaaugagaaaaacaaccccauuaa

SEQ ID NO: 145964 - RNA, 64 nt, Human
guauggcaaaaccaucaucaugaguucuagcauuaaucaacaucagugaguccauacuaagugg

SEQ ID NO: 145965 - RNA, 64 nt, Human
gccucacuguuagaaggaaaacuaacaggaauauaaucaacaucaacaaaggacauccacacag

SEQ ID NO: 145966 - RNA, 64 nt, Human
aaugggauaacuuuuuauagguucacugagguguaaucaacaugcaauauauugcacauauuua

SEQ ID NO: 145967 - RNA, 64 nt, Human
ucucugcauccaaauaguagggaaacguggagauaaucaacacucaggaccuucagccuugaac

SEQ ID NO: 145968 - RNA, 64 nt, Human
cauauuguaaugaugcuucugugaauuugaauaaaaucaacacuaaccagcccuaguacuaaga

SEQ ID NO: 145969 - RNA, 64 nt, Human
auucauaugcuuugcuacucuaaaccuaguuugaaaucaacagucuugagaauagaugaaaauu

SEQ ID NO: 145970 - RNA, 64 nt, Human
augcuaccucaaagguuguugugaacauuaaagaaaucaacacauggaaaucaaccaacauggg

SEQ ID NO: 145971 - RNA, 64 nt, Human
acccuacaaguguaaugaauguggcauaguuuuuaaucaacagucacaccuugcaagucaucau

SEQ ID NO: 145972 - RNA, 64 nt, Human
accuuacaagcacaaugaaugugacaugguuuuuaaucaacaaucacaccuugcaagucaucau

SEQ ID NO: 145973 - RNA, 64 nt, Human
cugaagagagaguaguugucagagugaagaguuuaaucaacagaaguagaguaacauauucuuu

SEQ ID NO: 145974 - RNA, 64 nt, Human
agcuuuagguuaugaagauuuuacucacaaaaaaaaucaacaaaaaucacgaaacuagaaaacu

SEQ ID NO: 145975 - RNA, 64 nt, Human
gcaaaagcucaucacccauuaagguuuguuguugaaucaacaguacucagcauauuaaaacagu

SEQ ID NO: 145976 - RNA, 64 nt, Human
gaagucaauauaauauagauuauccccagaaaaaaaucaacaaucuucaaacacugcccuuuuu

SEQ ID NO: 145977 - RNA, 64 nt, Human
uuauguguagggacugugggaaggcuuuagcaauaaucaacauuuaccagacauccaaugacag

SEQ ID NO: 145978 - RNA, 64 nt, Human
gugacagauuccuccaguuagaaaaagcuguuaaaaucaacacauggugcuccuuuaccgugac

SEQ ID NO: 145979 - RNA, 64 nt, Human
cuuucugcuuugcacaggaaagagucacacaauuaaucaacauguauauuuucucuauacauag

SEQ ID NO: 145980 - RNA, 64 nt, Human
ggauaagaaaauaccuuucuuccuuguaaacuccaaucaacaaacauauuuugagugccuuuug

SEQ ID NO: 145981 - RNA, 64 nt, Human
ugccuucauuguauauaugugacuauuuacauguaaucaacaugggaacuuuuaggggaaccua

SEQ ID NO: 145982 - RNA, 64 nt, Human
uuuacuucuaaccuuguuuccugacgguguacagaaucaacaaaauaaaacauuuaaagucuga

SEQ ID NO: 145983 - RNA, 64 nt, Human
ggaaaaauuguaauugaugaaaauaaugaaugaaaaucaacagaugaauaaaugguucuuuaua

SEQ ID NO: 145984 - RNA, 64 nt, Human
aucacagaccugaaucuguuguguugguaaaaggaaucaacaccuuuacauugcucaauuuuuu

SEQ ID NO: 145985 - RNA, 64 nt, Human
uuuccuuuuuauggaucuguugggaaccagagagaaucaacagaucaaugacauaggauccgaa

SEQ ID NO: 145986 - RNA, 64 nt, Human
ccuuguguguuguagcucauuuguuucaagagagaaucaacagaucauauucagugucuugaau

SEQ ID NO: 145987 - RNA, 64 nt, Human
ugaugcauucuaaccaacucacacauauacacaaaaucaacauggggauggagaagagaauuag

SEQ ID NO: 145988 - RNA, 64 nt, Human
cuggcuaauauuuaaaacuagaaaaacuauuccuaaucaacauggaguggagaguuuauucacu

SEQ ID NO: 145989 - RNA, 64 nt, Human
uucaauucuuuuauaagggcauucaauacuacaaaaucaacaugauuucauaaggugcaaauaa

SEQ ID NO: 145990 - RNA, 64 nt, Human
auaauuaucagcgaucugagguacucagcauggaaaucaacauccugaacguccucaaauguga

SEQ ID NO: 145991 - RNA, 64 nt, Human
aucagauaaaugcuuggaauuugauugucuacccaaucaacaguuuucccucuuugcucuggaa

SEQ ID NO: 145992 - RNA, 64 nt, Human
uaucuauuguaugcuggucuuuacuuuuugccaaaaucaacauauaaugaagagaugccuuugu

SEQ ID NO: 145993 - RNA, 64 nt, Human
cuuugugucuuaaacgugagagcaaaaugcauguaaucaacauggcuacuugcuuugaggcuca

SEQ ID NO: 145994 - RNA, 64 nt, Human
uuuuagcauucuaaauuuaaaugcuuaaaacgucaaucaacaaaacuuuguuuuaaauauugua

SEQ ID NO: 145995 - RNA, 59 nt, Human
gucuuuuaccaaaagugucuguacagcagccauccaaguugccccuacuuaguggcuug

SEQ ID NO: 145996 - RNA, 59 nt, Human
uuggcugagccauugagugcugggggaggccauccaagauggcaugaaucgggcuaagg

SEQ ID NO: 145997 - RNA, 59 nt, Human
cgcacucaccugccgggacccucccuauuccauccaagggaagcagaacugccaaagac

SEQ ID NO: 145998 - RNA, 59 nt, Human
aacuaaccuaccccaacucugcccuucucccauccaagagaaaccagcaaaaugauaaa

SEQ ID NO: 145999 - RNA, 59 nt, Human
ugaugugguacgucccuccacccccggacccauccaagucaucugauugaagagcauga

SEQ ID NO: 146000 - RNA, 59 nt, Human
ugaccuaaaucuaauuuacuuccacugaaccauccaagaccucuggcaggcagggaaau

SEQ ID NO: 146001 - RNA, 59 nt, Human
uuuucuugguaggaaaaauuauacugaacccauccaaaccugaagucacagaugaugug

SEQ ID NO: 146002 - RNA, 59 nt, Human
caauccugaacgucacugacuugcugugaccauccaaauaauuuuccugucucugccuc

SEQ ID NO: 146003 - RNA, 59 nt, Human
cugaaaaccuaccauguuucuuuacagagccauccaaaaauuuuuugucccuacauagc

SEQ ID NO: 146004 - RNA, 59 nt, Human
caguggucugugccaaccaaacgauagccccauccaagccagcugagaaccuaggaagg

SEQ ID NO: 146005 - RNA, 59 nt, Human
aggacaugcuaucaguaauagucccaguuccauccaacuuucugaaauuucauuuuuuu

SEQ ID NO: 146006 - RNA, 59 nt, Human
gcagcagcuaggcagucaccggcccgccuccauccaaaaucacgcucgcgugcuucgga

SEQ ID NO: 146007 - RNA, 59 nt, Human
ugcaguuucaucccuaccuuguucacauaccauccaagaggcacauaggcuacccaaga

SEQ ID NO: 146008 - RNA, 59 nt, Human
uuaauugcuaagaguaaauacuacuuuagccauccaaggccaccuucugcagcaaaagg

SEQ ID NO: 146009 - RNA, 59 nt, Human
uuugauaagcuagaugcaguagaccgaaaccauccaaaaccuguuuagcuucuuccucc

SEQ ID NO: 146010 - RNA, 59 nt, Human
gaaugccgagucccugaauucacccaggaccauccaaggggccaccgcagcauuggccc

SEQ ID NO: 146011 - RNA, 59 nt, Human
cucuuaccuuuagcugcuugaucauuaagccauccaacuucaugccaguucccuucuuu

SEQ ID NO: 146012 - RNA, 59 nt, Human
gaaccuaaagaaauggaugacuggacaaaccauccaaauaaugauaaagucuauucauc

SEQ ID NO: 146013 - RNA, 59 nt, Human
ucuuucuuuuuuuuuaaauuuuguauuuuccauccaacagcaguguguagagagaauau

SEQ ID NO: 146014 - RNA, 59 nt, Human
gccagggacagugugcucaguaaagucuuccauccaaaaggggcagggcacgguggcuc

SEQ ID NO: 146015 - RNA, 59 nt, Human
gguagaauuuuauaaacacauacaugauaccauccaaauucuugcuuuuaauaacaaag

SEQ ID NO: 146016 - RNA, 59 nt, Human
gucuugggcagagcuggcucugagcgccuccauccaaggccagguucuccguuagcucc

SEQ ID NO: 146017 - RNA, 59 nt, Human
caugagugacaaccaucacgucaggcugcccauccaauagacuccugggauggggcagc

SEQ ID NO: 146018 - RNA, 59 nt, Human
uaaguauagcaauucaaacugaccugcauccauccaaaacaaauuccuccuucaaccuu

SEQ ID NO: 146019 - RNA, 59 nt, Human
uuguccuuggcagaacuggacacuauugaccauccaaauggaaauuccccuuucuuggu

SEQ ID NO: 146020 - RNA, 59 nt, Human
uacaguuauaggaaguuucagucuacaguccauccaaaggaccaaccugccuuacacau

SEQ ID NO: 146021 - RNA, 59 nt, Human
ggggaauauaugcaaugguuggcauuuaaccauccaaacaaaucauacaagaaaguuuu

SEQ ID NO: 146022 - RNA, 59 nt, Human
uguuuggcaagaaauccccuaacugauuuccauccaaaccuaccuuauagagcacaaua

SEQ ID NO: 146023 - RNA, 59 nt, Human
aaugaaagcuaaaacaacccauuugcuacccauccaaagcacuuacaguuuagcaaaua

SEQ ID NO: 146024 - RNA, 59 nt, Human
gcauauaucuagcuacucccuaaaugguuccauccaaggcuuagaguacccaaaggcua

SEQ ID NO: 146025 - RNA, 59 nt, Human
gaagaaugaaaaaaagccuagucagacucccauccaaaguaggaacuaucucuuuaaca

SEQ ID NO: 146026 - RNA, 59 nt, Human
aucaagucugcguggccauccuccccccaccauccaagacuauuagguuuugucccugc

SEQ ID NO: 146027 - RNA, 59 nt, Human
uggagcaucuucugcacaaccuugggagcccauccaaggguuggugaggacuggucucc

SEQ ID NO: 146028 - RNA, 59 nt, Human
uucuugauauaacacucauuuaauuguggccauccaaaugaauauuauugcagaauuua

SEQ ID NO: 146029 - RNA, 59 nt, Human
gccuagaggagacuaauucucuuucuagcccauccaaauuugauaaauggaaccagagg

SEQ ID NO: 146030 - RNA, 59 nt, Human
ccucaucauaaauaucaucucuagcacugccauccaauuuaguucaauaaaauucaaau

SEQ ID NO: 146031 - RNA, 59 nt, Human
aaaucaaugcguggauaaaggaacacaugccauccaagugaugauggcuuuuccuggag

SEQ ID NO: 146032 - RNA, 59 nt, Human
cgauucugcagcaccggccucgggaagccccauccaacacuggauggucaucucggagu

SEQ ID NO: 146033 - RNA, 59 nt, Human
uucuauuuuaagccuucuaucauauuuucccauccaauuguuugguuucagugguccag

SEQ ID NO: 146034 - RNA, 59 nt, Human
gguuacuccugcagaguguaaucagcaccccauccaacuggcccgaaagcccagaccug

SEQ ID NO: 146035 - RNA, 59 nt, Human
acugcuguuucucgagguaagagauucagccauccaauugguuuuaggucuugcauauc

SEQ ID NO: 146036 - RNA, 59 nt, Human
aucuucucaggcaguucagauuuaaagcaccauccaaaccuuggaaauacgacagggug

SEQ ID NO: 146037 - RNA, 59 nt, Human
uucaugcacggaacugaugucauuagacaccauccaaggaugggcagccugcagugugg

SEQ ID NO: 146038 - RNA, 59 nt, Human
ggacaccaaaagaccuagcugggcuaacuccauccaaaugauuuuacaguuuuauuuuu

SEQ ID NO: 146039 - RNA, 59 nt, Human
gucugcaaaaacaaaaauuauaaacuaguccauccaagaaccaaaguuuguauaaacag

SEQ ID NO: 146040 - RNA, 59 nt, Human
uuauucccugugaugcccagaguaauggcccauccaaagauguccagauguccaugugc

SEQ ID NO: 146041 - RNA, 59 nt, Human
uuacuauuaacugacuucagaaguaccugccauccaauacggucauuagauugggucau

SEQ ID NO: 146042 - RNA, 59 nt, Human
gcauugguguuuaacuaagggccauccaaccauccaaccuuuaaaaaacaaaacgaaag

SEQ ID NO: 146043 - RNA, 59 nt, Human
auuugaaugcauugguguuuaacuaagggccauccaaccauccaaccuuuaaaaaacaa

SEQ ID NO: 146044 - RNA, 59 nt, Human
ugcacauuccugccauagcgcagugaccaccauccaagcucagaucugugugucuacgc

SEQ ID NO: 146045 - RNA, 59 nt, Human
aggagguuucuuucaaacaucauggccucccauccaaucaacaucaucaaauuacaugu

SEQ ID NO: 146046 - RNA, 59 nt, Human
caaacuaugacagaaaaguaauguaaaauccauccaaucuauuauuucucuaauuaugc

SEQ ID NO: 146047 - RNA, 59 nt, Human
cuguacaaauauguuuauguauuaaaucaccauccaaaauauuuaaggaauauauaaaa

SEQ ID NO: 146048 - RNA, 59 nt, Human
aacucucauuauggugaucauagaauugaccauccaaacugggacacucuugagaguaa

SEQ ID NO: 146049 - RNA, 59 nt, Human
guucugcuucagcugguagcugauaaggaccauccaaaauucaaggaaauucagaaucu

SEQ ID NO: 146050 - RNA, 59 nt, Human
ucugggauuacaggcauaagccaaugugcccauccaaaguuuuauuuauuuauuuuuuu

SEQ ID NO: 146051 - RNA, 59 nt, Human
auaugcaaaagcaguuccgcugggaacccccauccaaucaacugcuguacccauggggg

SEQ ID NO: 146052 - RNA, 59 nt, Human
uacuguuuuuuucuguagcaccagagaauccauccaaaguucccuaugaaaaauguguu

SEQ ID NO: 146053 - RNA, 59 nt, Human
caccggacaccgcaccagacccucaaaacccauccaagacugugggaggaguaaacaac

SEQ ID NO: 146054 - RNA, 59 nt, Human
ggaccuaaauagauugauuucauuucuaaccauccaauucugcauguauucauaauucu

SEQ ID NO: 146055 - RNA, 59 nt, Human
uuggaauaaggaagagaagauugaccaaaccauccaaaugccaaaaagaaaaagaaaaa

SEQ ID NO: 146056 - RNA, 59 nt, Human
uccuuggacaguagcaacuagucagaagaccauccaagauagaugcagcugauacauuc

SEQ ID NO: 146057 - RNA, 59 nt, Human
ugggugaguucuguuugcuccuuguaccaccauccaaaugguguuaucaaaucucuuag

SEQ ID NO: 146058 - RNA, 59 nt, Human
gauaaggugguucuuucauaacucuaaugccauccaacauagcccugggagaggcaugu

SEQ ID NO: 146059 - RNA, 59 nt, Human
uccccuggccccccacucucccuccauguccauccaaaaaccauaaaaucacuggguuc

SEQ ID NO: 146060 - RNA, 59 nt, Human
ucuccugucuucagagcaaaagacuugagccauccaaagaaacacuaagcucucugggc

SEQ ID NO: 146061 - RNA, 59 nt, Human
gcgucacacugugugaggcugugucucugccauccaaaagggggccccuugagaauggu

SEQ ID NO: 146062 - RNA, 59 nt, Human
caaaagugaucuggucggaucucacaaggccauccaaugagaccccgcacagcauuuuc

SEQ ID NO: 146063 - RNA, 59 nt, Human
augaagacaaaacauacauuuuguaccaaccauccaauuagcuuauguuaacugacaag

SEQ ID NO: 146064 - RNA, 59 nt, Human
agagagggcgcagagcaaaccaugucacgccauccaaugacaccagcuggucagcucac

SEQ ID NO: 146065 - RNA, 59 nt, Human
uucuguaccaaugcaccagagaaugccuaccauccaaaaaagcagucagcugauggaaa

SEQ ID NO: 146066 - RNA, 59 nt, Human
caggacugcaccccacccccaccguccagccauccaaccucacuucgccuuacaggucu

SEQ ID NO: 146067 - RNA, 59 nt, Human
cugacauuaucuuggauccuaugguuucuccauccaauucuuugaauuucccagucucc

SEQ ID NO: 146068 - RNA, 59 nt, Human
agaccagaguuugaugccagcagcuucggccauccaaacagaggaugcucagauuucuc

SEQ ID NO: 146069 - RNA, 59 nt, Human
gccuggugaaggagccugggugagaaacaccauccaaagcuggggcaaagaugauuacc

SEQ ID NO: 146070 - RNA, 59 nt, Human
ucagggaaaugagcugaauggccccagcaccauccaaguugacacagcuaaaggaauaa

SEQ ID NO: 146071 - RNA, 59 nt, Human
gaaaggcuuuaguuauuucuagaggagucccauccaacacuauuuggcgacuguuaaua

SEQ ID NO: 146072 - RNA, 59 nt, Human
cuccaucuacuuuucccugugcauaauauccauccaaaggacaacaguggcaaagcuga

SEQ ID NO: 146073 - RNA, 59 nt, Human
guuuuaaacucuccuagucaauauccaccccauccaauuuaucaaggaagaaaugguuc

SEQ ID NO: 146074 - RNA, 59 nt, Human
caaaaaagugguggaacaaauaccaacauccauccaaaaugaaaaagaacaggaaauuc

SEQ ID NO: 146075 - RNA, 59 nt, Human
auuuuaaaucaacuacuccacguguuuuuccauccaaucacacugcugugauucaggga

SEQ ID NO: 146076 - RNA, 59 nt, Human
cacaaaauccaagagaaggucugugagccccauccaacacccacaguaauuauuaucug

SEQ ID NO: 146077 - RNA, 59 nt, Human
acagcugugagggccaagaugcuguccccccauccaaaacccgugcgccacugcaguga

SEQ ID NO: 146078 - RNA, 59 nt, Human
uuuuaaccucuuuuuuuuuucuaauuauuccauccaaaauuucuggugaauuacacaga

SEQ ID NO: 146079 - RNA, 59 nt, Human
accauaguacucccacccacuuccaucacccauccaauaaaaugcagccagguuuagcc

SEQ ID NO: 146080 - RNA, 59 nt, Human
uuuaaguuauauauacacaucuuauugaaccauccaaaaaucauugcuuuuaacuguuu

SEQ ID NO: 146081 - RNA, 55 nt, Human
uugcagaagauguaaucuaauauugccauccaauuuagcauacauaaaauguugc

SEQ ID NO: 146082 - RNA, 59 nt, Human
augugggcccagccuaggucagccaacccccauccaacccuuagacucacgaacaaauc

SEQ ID NO: 146083 - RNA, 59 nt, Human
aacagcuguaaccaaugguacugaucuauccauccaauguugucauuauauuugacugu

SEQ ID NO: 146084 - RNA, 59 nt, Human
cacccuaagucuuacauaaugccaccaguccauccaaaaccuauauaucaccuauacua

SEQ ID NO: 146085 - RNA, 59 nt, Human
caaugugagacacuauccaugauuuaagcccauccaaaaagaagggaggaaacguccau

SEQ ID NO: 146086 - RNA, 59 nt, Human
aaggaccugcaagggacugaaggcggagcccauccaacccucgcccgacccaaacaccu

SEQ ID NO: 146087 - RNA, 59 nt, Human
cucaggcucaagcgauucucccaccucagccauccaaauagcugggaccacaggugugc

SEQ ID NO: 146088 - RNA, 59 nt, Human
ucacaugaccgguacuggaagaaacucucccauccaacaucacccaguggauggaacau

SEQ ID NO: 146089 - RNA, 59 nt, Human
guaaccagauagcaaaagaaaagggaaagccauccaaauuugaaagcuguugauagaaa

SEQ ID NO: 146090 - RNA, 59 nt, Human
acaauguauagccagagaaggagaagcucccauccaaauccuacuaggaagagaguggg

SEQ ID NO: 146091 - RNA, 59 nt, Human
uuccuuguuuauggggcucucacagauacccauccaacuccucuagucagcacuagauc

SEQ ID NO: 146092 - RNA, 59 nt, Human
gagacagaauucaaguggguauucuggggccauccaauuucucuuuacuugaaauuugg

SEQ ID NO: 146093 - RNA, 59 nt, Human
uucccugucgaucccuucugagguauggcccauccaagacuuuuaggccauucuugaug

SEQ ID NO: 146094 - RNA, 59 nt, Human
uggcaccuccauccugaggugcugccccuccauccaaaacugccaagugacucauugcc

SEQ ID NO: 146095 - RNA, 59 nt, Human
uggauauaaauuaauugugccugccaccaccauccaacagaccuggugcucuaaugcca

SEQ ID NO: 146096 - RNA, 59 nt, Human
augucagggaagcacccagugucggcuccccauccaaauccacaccagcaccuuguuac

SEQ ID NO: 146097 - RNA, 59 nt, Human
augauaaucagaaaagacuguaaauagauccauccaaaugauuucucuguacaaaugaa

SEQ ID NO: 146098 - RNA, 59 nt, Human
gguaggguggaguggggagggauuaaaacccauccaaaaaauaaauaaaaacuauauag

SEQ ID NO: 146099 - RNA, 59 nt, Human
guacugaaaugaguauaaggcaguaucacccauccaaaagaaaggucuuuauagaccug

SEQ ID NO: 146100 - RNA, 59 nt, Human
gucuguuucugaaauagucaauagucuucccauccaaacuauaagagaaugugaauuuc

SEQ ID NO: 146101 - RNA, 59 nt, Human
ggcugggacuggggagggggcagccaccuccauccaaggcucuuccuaggggcccugcu

SEQ ID NO: 146102 - RNA, 59 nt, Human
gccuuggacauggugauggugauggguugccauccaagugaaagucuuuuccuugacca

SEQ ID NO: 146103 - RNA, 59 nt, Human
cuaugccuggaggcucaacacaaaacuucccauccaaacauucagaugaacugagcguc

SEQ ID NO: 146104 - RNA, 59 nt, Human
gcuucucgcccacuccacggcucugagccccauccaagggcaagacuuggugcccagcu

SEQ ID NO: 146105 - RNA, 59 nt, Human
ucuuaaaacuauacaguuacaucuuaauuccauccaaagaagauacaguuugaagacag

SEQ ID NO: 146106 - RNA, 59 nt, Human
gcuuccguggggcaugagaauuucccgggccauccaagcccaaggaccugggauaaacu

SEQ ID NO: 146107 - RNA, 59 nt, Human
ggcuucugugaaaaaccugaugcagugcuccauccaaacucagaaggcuuugggauaug

SEQ ID NO: 146108 - RNA, 59 nt, Human
uuucucucaggguucugagucagaggacaccauccaagaauguuguuagcuuuucaguu

SEQ ID NO: 146109 - RNA, 59 nt, Human
gacucaacgcagaagaauggacgaaaugaccauccaacgugauuaaggauaggaaucgg

SEQ ID NO: 146110 - RNA, 59 nt, Human
cacccuuuacugcuguguauggggcuucaccauccaagaggugguagguuggaguaaga

SEQ ID NO: 146111 - RNA, 59 nt, Human
cuccucuuccuccuggaccccauccucuaccauccaagcccugucccacuuuggcccua

SEQ ID NO: 146112 - RNA, 59 nt, Human
ccccaguguuggagugcaaggaggcggggccauccaaagcaacgcugaaggccuuuucc

SEQ ID NO: 146113 - RNA, 59 nt, Human
aaggcuacugcaggucacugaguugccugccauccaaaggggaugggcgggauuggaag

SEQ ID NO: 146114 - RNA, 59 nt, Human
agccaccugccugcuccuaugugcccucaccauccaauaaaggccccuuggcuguggca

SEQ ID NO: 146115 - RNA, 59 nt, Human
aacaccaaggccauuucaauuuugcagcaccauccaagaaacuacuaccuaucaagaau

SEQ ID NO: 146116 - RNA, 59 nt, Human
uuuuguacugggccuuuaaaaaaauaaauccauccaacuuuaacacaacauuucucagu

SEQ ID NO: 146117 - RNA, 59 nt, Human
guguucauguguucuuuauaaaauuucucccauccaaguacuaaccaggcccgacccug

SEQ ID NO: 146118 - RNA, 59 nt, Human
uaggggaaaaccugccagagaagaauaaaccauccaagagacggcgcugcagggccuca

SEQ ID NO: 146119 - RNA, 59 nt, Human
ccaucuacucaaauaucugauuuaucucaccauccaauuaucuacccaccugucuuccu

SEQ ID NO: 146120 - RNA, 59 nt, Human
agcccuggccuccacccccaccccgccgaccauccaagggagagugagaccuggcagcc

SEQ ID NO: 146121 - RNA, 59 nt, Human
auuuggggcucagaaggcccugcucucucccauccaagugaccagaugcccuacucagc

SEQ ID NO: 146122 - RNA, 59 nt, Human
ggaucugugccuguaauaucaggauacuaccauccaaaucuaucuagauaucuugugca

SEQ ID NO: 146123 - RNA, 59 nt, Human
agucucuagccucuuucucccuucugcucccauccaagaaagacaguguauaaggaaca

SEQ ID NO: 146124 - RNA, 59 nt, Human
augauucuauuauauauuuuauauaaaauccauccaaauuaaguuuuggguaagugugu

SEQ ID NO: 146125 - RNA, 59 nt, Human
acagaugacauuuucugaccaggcacaugccauccaauuuucugucaaucacacuguug

SEQ ID NO: 146126 - RNA, 59 nt, Human
gaucauuugcaaaccucccccagccccuaccauccaauguggaaggaaaacaagaacug

SEQ ID NO: 146127 - RNA, 59 nt, Human
agcauggacugugccacacacccagugauccauccaaaaacaaggacugcagccuaaau

SEQ ID NO: 146128 - RNA, 59 nt, Human
guaaucccgccaccuaucucgugggagagccauccaaauaagaaaccuaaaauaauugg

SEQ ID NO: 146129 - RNA, 59 nt, Human
ugauagcagauggaucaauauuaguaaccccauccaagauugaacugugaaagagaggu

SEQ ID NO: 146130 - RNA, 59 nt, Human
uuugagagcuggagcccaucuuucugccuccauccaaagaggccuuuuaacucagccuc

SEQ ID NO: 146131 - RNA, 59 nt, Human
agugagcagagcccucaugugacaugaacccauccaauggauugugcaaauccccuccc

SEQ ID NO: 146132 - RNA, 59 nt, Human
cccuccagacaaugccagcauaaauccauccauccaaaggcagagaaccaaaggggcca

SEQ ID NO: 146133 - RNA, 59 nt, Human
auucaguuuugugaaaauggauucuguggccauccaagggauguaucagggaugaucag

SEQ ID NO: 146134 - RNA, 59 nt, Human
cuaccaguuucucagaauuacacgcacgaccauccaaacauuggcuccaugccagggcu

SEQ ID NO: 146135 - RNA, 59 nt, Human
accccugggcaagaggcuggaaguucacaccauccaaaauuuauccuuguuuuuuuucu

SEQ ID NO: 146136 - RNA, 59 nt, Human
gcucuucucuggccucuucaccagggcacccauccaaggaaccuccgaacagccaggaa

SEQ ID NO: 146137 - RNA, 59 nt, Human
ucagagccagaucagccuuaagucaccucccauccaagaacuuggccuaaaaauacucc

SEQ ID NO: 146138 - RNA, 59 nt, Human
gauaucaagaguuuguuauuuucaaauacccauccaacaagagagauggggagguuuuu

SEQ ID NO: 146139 - RNA, 59 nt, Human
aacacgggcaagagggaaagaaaggcuaaccauccaaacagggauacaggggaggcggu

SEQ ID NO: 146140 - RNA, 59 nt, Human
gcuccucuggccaggaaagggaacagaguccauccaagcugccccccacucaucugcca

SEQ ID NO: 146141 - RNA, 59 nt, Human
ugacugggacccuacucuagaacuguguaccauccaauucgccaucauaaaggaaucuu

SEQ ID NO: 146142 - RNA, 59 nt, Human
uguguugcagaccauuucugaggucuccaccauccaaggaggcacagccgucauuacug

SEQ ID NO: 146143 - RNA, 59 nt, Human
uuuuucauucagcauaauucccuugaaauccauccaaguuguugcauguaugaauaguu

SEQ ID NO: 146144 - RNA, 59 nt, Human
aagagaaaucucuaaaagaauaugaucuuccauccaaguggagggaaacuuuaaaacaa

SEQ ID NO: 146145 - RNA, 59 nt, Human
auuuuauuuuaccuucaaaaacaaaaacgccauccaaaaccaaggaaguccuugguguu

SEQ ID NO: 146146 - RNA, 59 nt, Human
acggggacaucaguaaccuucugcagccaccauccaaugccauuacugucaagugagac

SEQ ID NO: 146147 - RNA, 59 nt, Human
aguuugaggaaguggcugucccuguggccccauccaaccacuguacacacccgccugac

SEQ ID NO: 146148 - RNA, 59 nt, Human
caaacuuuacucugggagguaggcuaugcccauccaaauaaaucuccaugagaaacuug

SEQ ID NO: 146149 - RNA, 59 nt, Human
uuuuucugcacugccauauucacccccaaccauccaaucuguggauaauuggauguuag

SEQ ID NO: 146150 - RNA, 59 nt, Human
ugagcucuccacucuguuucccgccugggccauccaaccuugaaguccuaaaccacacc

SEQ ID NO: 146151 - RNA, 59 nt, Human
cucccacccagucugccccuggucucugcccauccaaucagagcccacccuccuggaag

SEQ ID NO: 146152 - RNA, 59 nt, Human
gauaacuuaaaaacguagcucaucccuuaccauccaaggggcacucccuugguuggauu

SEQ ID NO: 146153 - RNA, 59 nt, Human
ccaagacacaguacccagucaugguuuccccauccaacuauuaguuucauacuuugaaa

SEQ ID NO: 146154 - RNA, 59 nt, Human
gauccucuugccacaucuugaaaaugccaccauccaauaaaaaucaggagccugcuaag

SEQ ID NO: 146155 - RNA, 59 nt, Human
cagggacuugaagaaagacuaggugugucccauccaaguugagcacgcgccuuccccag

SEQ ID NO: 146156 - RNA, 59 nt, Human
augggccaccgccuugcccagccuggaugccauccaaguuguauauuuuuuuaaucucu

SEQ ID NO: 146157 - RNA, 59 nt, Human
cagagaaucagcuaaguuuccuaacuuguccauccaaaugugaucaccacgauucaaca

SEQ ID NO: 146158 - RNA, 59 nt, Human
ggagaauuguggaaggauuguaacauggaccauccaaauuuauggccguaucaaauggu

SEQ ID NO: 146159 - RNA, 59 nt, Human
ugaagggacugcuguuugcaaugggcuuaccauccaaauaucccaaaggcuuugaccag

SEQ ID NO: 146160 - RNA, 59 nt, Human
cugcccaaauuccgauaucaccccuucccccauccaagcauccuucgauuagggaagug

SEQ ID NO: 146161 - RNA, 59 nt, Human
uccaguacauucuuucagagucuguuuuuccauccaaauauaagccccaggccauucca

SEQ ID NO: 146162 - RNA, 59 nt, Human
cagugcgcuuccucuguucccucccucagccauccaauucuugaguuuucucacugauu

SEQ ID NO: 146163 - RNA, 59 nt, Human
gggggaaaaucaguucuuucagcuaccacccauccaaccuuugggccuaugugaaaaga

SEQ ID NO: 146164 - RNA, 59 nt, Human
uccuucuguuaccuucagauguauugguuccauccaacaccugaaaagcaaauuuggca

SEQ ID NO: 146165 - RNA, 59 nt, Human
ucucuuucuugcccauagaugcauuggcuccauccaacaccugaaaaacaaacuuggca

SEQ ID NO: 146166 - RNA, 59 nt, Human
uaguggcaacagcccuuccguccacacucccauccaaggaggguucuuccuuccugugg

SEQ ID NO: 146167 - RNA, 59 nt, Human
uuuagaaaucuucucugaccuagaagaauccauccaaaucccugccuuccucucugaac

SEQ ID NO: 146168 - RNA, 59 nt, Human
uccucaagugcucgugacacauaaucauuccauccaaugaucgccuuugcuuuaccacu

SEQ ID NO: 146169 - RNA, 59 nt, Human
aacucagagcugcugcacucaggagggccccauccaaucccgggccccugcagggaaaa

SEQ ID NO: 146170 - RNA, 59 nt, Human
ugcuguguguccuguuccauguuccgguuccauccaaauacacuuucuggaacaaaugc

SEQ ID NO: 146171 - RNA, 59 nt, Human
caugccugaugaccaaacucucccuuuccccauccaaucgguccacacuccccgcccug

SEQ ID NO: 146172 - RNA, 59 nt, Human
agauuguggccaagaagagugaaugugucccauccaaaggugcauccagauaugucugu

SEQ ID NO: 146173 - RNA, 59 nt, Human
ccauccaucccuccugggcgccagacccuccauccaagcccugugucuuuccauaguca

SEQ ID NO: 146174 - RNA, 59 nt, Human
uaacaggagccaggguuaggauucaaaccccauccaacuggucccagagcuggagcuuc

SEQ ID NO: 146175 - RNA, 59 nt, Human
gcccugcugggacaugggggccugagugcccauccaagggcucucaaggacaccggcaa

SEQ ID NO: 146176 - RNA, 59 nt, Human
cgugccugaugaccaaacucucccuuucuccauccaaucgguccacacuccccgccccc

SEQ ID NO: 146177 - RNA, 59 nt, Human
auuucaacuaaagcagauuaaccugaaauccauccaaguuguucugcauaucauuguuc

SEQ ID NO: 146178 - RNA, 59 nt, Human
cccucaugcuaccuuuuuaugcuuacacuccauccaaaccuaacucugccaaccacuuu

SEQ ID NO: 146179 - RNA, 59 nt, Human
acuauguucacuuugggguugguucucagccauccaagggucuccagugagguggcugc

SEQ ID NO: 146180 - RNA, 59 nt, Human
uggacccagauggggcuuucccuuuguagccauccaaugggcauugugugggugcuugg

SEQ ID NO: 146181 - RNA, 57 nt, Human
acaaagcaagcaggcuuuagaccuccaccauccaaagcucaugcccggcaguggacu

SEQ ID NO: 146182 - RNA, 59 nt, Human
guuuaguggauguucguggaauugcugacccauccaagggcguccuuuggagccagugg

SEQ ID NO: 146183 - RNA, 59 nt, Human
agaccacaaagguuucacuucuuuuagauccauccaauaugcgaaaaaaggguacauuu

SEQ ID NO: 146184 - RNA, 59 nt, Human
auggagugauauaguuuggcucugugucuccauccaaaucucaucuuaaauuguaaucu

SEQ ID NO: 146185 - RNA, 59 nt, Human
acauauauuuuguauuuuccccucacccaccauccaauaaugaguaauagcacaaagua

SEQ ID NO: 146186 - RNA, 59 nt, Human
cuuuccugagcaagugacaaucuaaccugccauccaaaugauaaauugcuaauuaagca

SEQ ID NO: 146187 - RNA, 59 nt, Human
ucccuaguugauaggguuuggcuguguccccauccaaaucucaucuugaauuguucccg

SEQ ID NO: 146188 - RNA, 59 nt, Human
aaugaauugucugguagcccuguccugacccauccaagcgcuguuggggcuggugguga

SEQ ID NO: 146189 - RNA, 59 nt, Human
uuggacugcauuaauuggucauugacuggccauccaauuaccauuuuuucuuucagucc

SEQ ID NO: 146190 - RNA, 59 nt, Human
ugcuuccuguagacacgcacacguugucuccauccaauggccuuuucugaaguuacaga

SEQ ID NO: 146191 - RNA, 59 nt, Human
ugcuggaaaacuguaaagacuuccaggucccauccaaggagauuuugcuucugauugac

SEQ ID NO: 146192 - RNA, 59 nt, Human
aauugaguccuaaguauuaauuauugccaccauccaacucauugagucuuaugguucac

SEQ ID NO: 146193 - RNA, 59 nt, Human
uauugagucguaaguauuaauuauugccaccauccaacucauugagucuuaugguucac

SEQ ID NO: 146194 - RNA, 59 nt, Human
cagugccaguuccuugccccaaccuggccccauccaaguacagaagaccuuccuuuccu

SEQ ID NO: 146195 - RNA, 59 nt, Human
guccuguaacuuccccaggcuccauucccccauccaagaguugggguaaugggaacugg

SEQ ID NO: 146196 - RNA, 59 nt, Human
gcaggacuccaggaugguucagcccagcaccauccaaagggugggagcacaucugcccu

SEQ ID NO: 146197 - RNA, 59 nt, Human
ggguccugguuccagcagagcacuggggcccauccaaguuuguucugccaccacuggau

SEQ ID NO: 146198 - RNA, 59 nt, Human
ccuuccuccuuccauucugcauccccuccccauccaaccuaaaugccacagcuggggcu

SEQ ID NO: 146199 - RNA, 59 nt, Human
cugucacccagcuauccucgcacucaaagccauccaaccucagcaggccuucucgggcc

SEQ ID NO: 146200 - RNA, 59 nt, Human
cucccagaaccucagcauuuccuuccagcccauccaaacacugaggcagccuuggggaa

SEQ ID NO: 146201 - RNA, 59 nt, Human
augaucaaucaagauaaaaggugaucuauccauccaauggaauauuauuuggccuuaaa

SEQ ID NO: 146202 - RNA, 59 nt, Human
ccucuuccuggaagccuuccucuuuuccaccauccaaaacccucuuaauacccugugua

SEQ ID NO: 146203 - RNA, 59 nt, Human
gggaaagaucguaaggaugagagaggagaccauccaagccagaaauuauuuaauaaauc

SEQ ID NO: 146204 - RNA, 59 nt, Human
ucagggagccuugcaguguuauacgcgugccauccaaauuaauccugcauuugcagaug

SEQ ID NO: 146205 - RNA, 59 nt, Human
uuuuccgaacaauccuuguagaguauguaccauccaaaggcaggagggccucgccgugg

SEQ ID NO: 146206 - RNA, 59 nt, Human
acaaaagucuugauagcacaacacaaauuccauccaagaggagaaucuuccccaggguu

SEQ ID NO: 146207 - RNA, 59 nt, Human
ccguuuauauuagcacuguaucccuugugccauccaacauuuuguauguuuuuguaaac

SEQ ID NO: 146208 - RNA, 59 nt, Human
caauagucucaaaguaaaaacaaccaccaccauccaacaaaaggauuacgucugcaucu

SEQ ID NO: 146209 - RNA, 59 nt, Human
cauaaauuauguggcucauaguaggugcaccauccaaggagaaggucccuuuuuccaac

SEQ ID NO: 146210 - RNA, 59 nt, Human
uuuagucauauaugaauuuaaaccuaguaccauccaaaaccauguaauggauuuuaaga

SEQ ID NO: 146211 - RNA, 59 nt, Human; identical to SEQ ID NO: 145995

SEQ ID NO: 146212 - RNA, 59 nt, Human; identical to SEQ ID NO: 145996

SEQ ID NO: 146213 - RNA, 59 nt, Human; identical to SEQ ID NO: 145997

SEQ ID NO: 146214 - RNA, 59 nt, Human; identical to SEQ ID NO: 145998

SEQ ID NO: 146215 - RNA, 59 nt, Human; identical to SEQ ID NO: 145999

SEQ ID NO: 146216 - RNA, 59 nt, Human; identical to SEQ ID NO: 146000

SEQ ID NO: 146217 - RNA, 59 nt, Human; identical to SEQ ID NO: 146001

SEQ ID NO: 146218 - RNA, 59 nt, Human; identical to SEQ ID NO: 146002

SEQ ID NO: 146219 - RNA, 59 nt, Human; identical to SEQ ID NO: 146003

SEQ ID NO: 146220 - RNA, 59 nt, Human; identical to SEQ ID NO: 146004

SEQ ID NO: 146221 - RNA, 59 nt, Human; identical to SEQ ID NO: 146005

SEQ ID NO: 146222 - RNA, 59 nt, Human; identical to SEQ ID NO: 146006

SEQ ID NO: 146223 - RNA, 59 nt, Human; identical to SEQ ID NO: 146007

SEQ ID NO: 146224 - RNA, 59 nt, Human; identical to SEQ ID NO: 146008

SEQ ID NO: 146225 - RNA, 59 nt, Human; identical to SEQ ID NO: 146009

SEQ ID NO: 146226 - RNA, 59 nt, Human; identical to SEQ ID NO: 146010

SEQ ID NO: 146227 - RNA, 59 nt, Human; identical to SEQ ID NO: 146011

SEQ ID NO: 146228 - RNA, 59 nt, Human; identical to SEQ ID NO: 146012

SEQ ID NO: 146229 - RNA, 59 nt, Human; identical to SEQ ID NO: 146013

SEQ ID NO: 146230 - RNA, 59 nt, Human; identical to SEQ ID NO: 146014

SEQ ID NO: 146231 - RNA, 59 nt, Human; identical to SEQ ID NO: 146015

SEQ ID NO: 146232 - RNA, 59 nt, Human; identical to SEQ ID NO: 146016

SEQ ID NO: 146233 - RNA, 59 nt, Human; identical to SEQ ID NO: 146017

SEQ ID NO: 146234 - RNA, 59 nt, Human; identical to SEQ ID NO: 146018

SEQ ID NO: 146235 - RNA, 59 nt, Human; identical to SEQ ID NO: 146019

SEQ ID NO: 146236 - RNA, 59 nt, Human; identical to SEQ ID NO: 146020

SEQ ID NO: 146237 - RNA, 59 nt, Human; identical to SEQ ID NO: 146021

SEQ ID NO: 146238 - RNA, 59 nt, Human; identical to SEQ ID NO: 146022

SEQ ID NO: 146239 - RNA, 59 nt, Human; identical to SEQ ID NO: 146023

SEQ ID NO: 146240 - RNA, 59 nt, Human; identical to SEQ ID NO: 146024

SEQ ID NO: 146241 - RNA, 59 nt, Human; identical to SEQ ID NO: 146025

SEQ ID NO: 146242 - RNA, 59 nt, Human; identical to SEQ ID NO: 146026

SEQ ID NO: 146243 - RNA, 59 nt, Human; identical to SEQ ID NO: 146027

SEQ ID NO: 146244 - RNA, 59 nt, Human; identical to SEQ ID NO: 146028

SEQ ID NO: 146245 - RNA, 59 nt, Human; identical to SEQ ID NO: 146029

SEQ ID NO: 146246 - RNA, 59 nt, Human; identical to SEQ ID NO: 146030

SEQ ID NO: 146247 - RNA, 59 nt, Human; identical to SEQ ID NO: 146031

SEQ ID NO: 146248 - RNA, 59 nt, Human; identical to SEQ ID NO: 146032

SEQ ID NO: 146249 - RNA, 59 nt, Human; identical to SEQ ID NO: 146033

SEQ ID NO: 146250 - RNA, 59 nt, Human; identical to SEQ ID NO: 146034

SEQ ID NO: 146251 - RNA, 59 nt, Human; identical to SEQ ID NO: 146035

SEQ ID NO: 146252 - RNA, 59 nt, Human; identical to SEQ ID NO: 146036

SEQ ID NO: 146253 - RNA, 59 nt, Human; identical to SEQ ID NO: 146037

SEQ ID NO: 146254 - RNA, 59 nt, Human; identical to SEQ ID NO: 146038

SEQ ID NO: 146255 - RNA, 59 nt, Human; identical to SEQ ID NO: 146039

SEQ ID NO: 146256 - RNA, 59 nt, Human; identical to SEQ ID NO: 146040

SEQ ID NO: 146257 - RNA, 59 nt, Human; identical to SEQ ID NO: 146041

SEQ ID NO: 146258 - RNA, 59 nt, Human; identical to SEQ ID NO: 146042

SEQ ID NO: 146259 - RNA, 59 nt, Human; identical to SEQ ID NO: 146043

SEQ ID NO: 146260 - RNA, 59 nt, Human; identical to SEQ ID NO: 146044

SEQ ID NO: 146261 - RNA, 59 nt, Human; identical to SEQ ID NO: 146045

SEQ ID NO: 146262 - RNA, 59 nt, Human; identical to SEQ ID NO: 146046

SEQ ID NO: 146263 - RNA, 59 nt, Human; identical to SEQ ID NO: 146047

SEQ ID NO: 146264 - RNA, 59 nt, Human; identical to SEQ ID NO: 146048

SEQ ID NO: 146265 - RNA, 59 nt, Human; identical to SEQ ID NO: 146049

SEQ ID NO: 146266 - RNA, 59 nt, Human; identical to SEQ ID NO: 146050

SEQ ID NO: 146267 - RNA, 59 nt, Human; identical to SEQ ID NO: 146051

SEQ ID NO: 146268 - RNA, 59 nt, Human; identical to SEQ ID NO: 146052

SEQ ID NO: 146269 - RNA, 59 nt, Human; identical to SEQ ID NO: 146053

SEQ ID NO: 146270 - RNA, 59 nt, Human; identical to SEQ ID NO: 146054

SEQ ID NO: 146271 - RNA, 59 nt, Human; identical to SEQ ID NO: 146055

SEQ ID NO: 146272 - RNA, 59 nt, Human; identical to SEQ ID NO: 146056

SEQ ID NO: 146273 - RNA, 59 nt, Human; identical to SEQ ID NO: 146057

SEQ ID NO: 146274 - RNA, 59 nt, Human; identical to SEQ ID NO: 146058

SEQ ID NO: 146275 - RNA, 59 nt, Human; identical to SEQ ID NO: 146059

SEQ ID NO: 146276 - RNA, 59 nt, Human; identical to SEQ ID NO: 146060

SEQ ID NO: 146277 - RNA, 59 nt, Human; identical to SEQ ID NO: 146061

SEQ ID NO: 146278 - RNA, 59 nt, Human; identical to SEQ ID NO: 146062

SEQ ID NO: 146279 - RNA, 59 nt, Human; identical to SEQ ID NO: 146063

SEQ ID NO: 146280 - RNA, 59 nt, Human; identical to SEQ ID NO: 146064

SEQ ID NO: 146281 - RNA, 59 nt, Human; identical to SEQ ID NO: 146065

SEQ ID NO: 146282 - RNA, 59 nt, Human; identical to SEQ ID NO: 146066

SEQ ID NO: 146283 - RNA, 59 nt, Human; identical to SEQ ID NO: 146067

SEQ ID NO: 146284 - RNA, 59 nt, Human; identical to SEQ ID NO: 146068

SEQ ID NO: 146285 - RNA, 59 nt, Human; identical to SEQ ID NO: 146069

SEQ ID NO: 146286 - RNA, 59 nt, Human; identical to SEQ ID NO: 146070

SEQ ID NO: 146287 - RNA, 59 nt, Human; identical to SEQ ID NO: 146071

SEQ ID NO: 146288 - RNA, 59 nt, Human; identical to SEQ ID NO: 146072

SEQ ID NO: 146289 - RNA, 59 nt, Human; identical to SEQ ID NO: 146073

SEQ ID NO: 146290 - RNA, 59 nt, Human; identical to SEQ ID NO: 146074

SEQ ID NO: 146291 - RNA, 59 nt, Human; identical to SEQ ID NO: 146075

SEQ ID NO: 146292 - RNA, 59 nt, Human; identical to SEQ ID NO: 146076

SEQ ID NO: 146293 - RNA, 59 nt, Human; identical to SEQ ID NO: 146077

SEQ ID NO: 146294 - RNA, 59 nt, Human; identical to SEQ ID NO: 146078

SEQ ID NO: 146295 - RNA, 59 nt, Human; identical to SEQ ID NO: 146079

SEQ ID NO: 146296 - RNA, 59 nt, Human; identical to SEQ ID NO: 146080

SEQ ID NO: 146297 - RNA, 55 nt, Human; identical to SEQ ID NO: 146081

SEQ ID NO: 146298 - RNA, 59 nt, Human; identical to SEQ ID NO: 146082

SEQ ID NO: 146299 - RNA, 59 nt, Human; identical to SEQ ID NO: 146083

SEQ ID NO: 146300 - RNA, 59 nt, Human; identical to SEQ ID NO: 146084

SEQ ID NO: 146301 - RNA, 59 nt, Human; identical to SEQ ID NO: 146085

SEQ ID NO: 146302 - RNA, 59 nt, Human; identical to SEQ ID NO: 146086

SEQ ID NO: 146303 - RNA, 59 nt, Human; identical to SEQ ID NO: 146087

SEQ ID NO: 146304 - RNA, 59 nt, Human; identical to SEQ ID NO: 146088

SEQ ID NO: 146305 - RNA, 59 nt, Human; identical to SEQ ID NO: 146089

SEQ ID NO: 146306 - RNA, 59 nt, Human; identical to SEQ ID NO: 146090

SEQ ID NO: 146307 - RNA, 59 nt, Human; identical to SEQ ID NO: 146091

SEQ ID NO: 146308 - RNA, 59 nt, Human; identical to SEQ ID NO: 146092

SEQ ID NO: 146309 - RNA, 59 nt, Human; identical to SEQ ID NO: 146093

SEQ ID NO: 146310 - RNA, 59 nt, Human; identical to SEQ ID NO: 146094

SEQ ID NO: 146311 - RNA, 59 nt, Human; identical to SEQ ID NO: 146095

SEQ ID NO: 146312 - RNA, 59 nt, Human; identical to SEQ ID NO: 146096

SEQ ID NO: 146313 - RNA, 59 nt, Human; identical to SEQ ID NO: 146097

SEQ ID NO: 146314 - RNA, 59 nt, Human; identical to SEQ ID NO: 146098

SEQ ID NO: 146315 - RNA, 59 nt, Human; identical to SEQ ID NO: 146099

SEQ ID NO: 146316 - RNA, 59 nt, Human; identical to SEQ ID NO: 146100

SEQ ID NO: 146317 - RNA, 59 nt, Human; identical to SEQ ID NO: 146101

SEQ ID NO: 146318 - RNA, 59 nt, Human; identical to SEQ ID NO: 146102

SEQ ID NO: 146319 - RNA, 59 nt, Human; identical to SEQ ID NO: 146103

SEQ ID NO: 146320 - RNA, 59 nt, Human; identical to SEQ ID NO: 146104

SEQ ID NO: 146321 - RNA, 59 nt, Human; identical to SEQ ID NO: 146105

SEQ ID NO: 146322 - RNA, 59 nt, Human; identical to SEQ ID NO: 146106

SEQ ID NO: 146323 - RNA, 59 nt, Human; identical to SEQ ID NO: 146107

SEQ ID NO: 146324 - RNA, 59 nt, Human; identical to SEQ ID NO: 146108

SEQ ID NO: 146325 - RNA, 59 nt, Human; identical to SEQ ID NO: 146109

SEQ ID NO: 146326 - RNA, 59 nt, Human; identical to SEQ ID NO: 146110

SEQ ID NO: 146327 - RNA, 59 nt, Human; identical to SEQ ID NO: 146111

SEQ ID NO: 146328 - RNA, 59 nt, Human; identical to SEQ ID NO: 146112

SEQ ID NO: 146329 - RNA, 59 nt, Human; identical to SEQ ID NO: 146113

SEQ ID NO: 146330 - RNA, 59 nt, Human; identical to SEQ ID NO: 146114

SEQ ID NO: 146331 - RNA, 59 nt, Human; identical to SEQ ID NO: 146115

SEQ ID NO: 146332 - RNA, 59 nt, Human; identical to SEQ ID NO: 146116

SEQ ID NO: 146333 - RNA, 59 nt, Human; identical to SEQ ID NO: 146117

SEQ ID NO: 146334 - RNA, 59 nt, Human; identical to SEQ ID NO: 146118

SEQ ID NO: 146335 - RNA, 59 nt, Human; identical to SEQ ID NO: 146119

SEQ ID NO: 146336 - RNA, 59 nt, Human; identical to SEQ ID NO: 146120

SEQ ID NO: 146337 - RNA, 59 nt, Human; identical to SEQ ID NO: 146121

SEQ ID NO: 146338 - RNA, 59 nt, Human; identical to SEQ ID NO: 146122

SEQ ID NO: 146339 - RNA, 59 nt, Human; identical to SEQ ID NO: 146123

SEQ ID NO: 146340 - RNA, 59 nt, Human; identical to SEQ ID NO: 146124

SEQ ID NO: 146341 - RNA, 59 nt, Human; identical to SEQ ID NO: 146125

SEQ ID NO: 146342 - RNA, 59 nt, Human; identical to SEQ ID NO: 146126

SEQ ID NO: 146343 - RNA, 59 nt, Human; identical to SEQ ID NO: 146127

SEQ ID NO: 146344 - RNA, 59 nt, Human; identical to SEQ ID NO: 146128

SEQ ID NO: 146345 - RNA, 59 nt, Human; identical to SEQ ID NO: 146129

SEQ ID NO: 146346 - RNA, 59 nt, Human; identical to SEQ ID NO: 146130

SEQ ID NO: 146347 - RNA, 59 nt, Human; identical to SEQ ID NO: 146131

SEQ ID NO: 146348 - RNA, 59 nt, Human; identical to SEQ ID NO: 146132

SEQ ID NO: 146349 - RNA, 59 nt, Human; identical to SEQ ID NO: 146133

SEQ ID NO: 146350 - RNA, 59 nt, Human; identical to SEQ ID NO: 146134

SEQ ID NO: 146351 - RNA, 59 nt, Human; identical to SEQ ID NO: 146135

SEQ ID NO: 146352 - RNA, 59 nt, Human; identical to SEQ ID NO: 146136

SEQ ID NO: 146353 - RNA, 59 nt, Human; identical to SEQ ID NO: 146137

SEQ ID NO: 146354 - RNA, 59 nt, Human; identical to SEQ ID NO: 146138

SEQ ID NO: 146355 - RNA, 59 nt, Human; identical to SEQ ID NO: 146139

SEQ ID NO: 146356 - RNA, 59 nt, Human; identical to SEQ ID NO: 146140

SEQ ID NO: 146357 - RNA, 59 nt, Human; identical to SEQ ID NO: 146141

SEQ ID NO: 146358 - RNA, 59 nt, Human; identical to SEQ ID NO: 146142

SEQ ID NO: 146359 - RNA, 59 nt, Human; identical to SEQ ID NO: 146143

SEQ ID NO: 146360 - RNA, 59 nt, Human; identical to SEQ ID NO: 146144

SEQ ID NO: 146361 - RNA, 59 nt, Human; identical to SEQ ID NO: 146145

SEQ ID NO: 146362 - RNA, 59 nt, Human; identical to SEQ ID NO: 146146

SEQ ID NO: 146363 - RNA, 59 nt, Human; identical to SEQ ID NO: 146147

SEQ ID NO: 146364 - RNA, 59 nt, Human; identical to SEQ ID NO: 146148

SEQ ID NO: 146365 - RNA, 59 nt, Human; identical to SEQ ID NO: 146149

SEQ ID NO: 146366 - RNA, 59 nt, Human; identical to SEQ ID NO: 146150

SEQ ID NO: 146367 - RNA, 59 nt, Human; identical to SEQ ID NO: 146151

SEQ ID NO: 146368 - RNA, 59 nt, Human; identical to SEQ ID NO: 146152

SEQ ID NO: 146369 - RNA, 59 nt, Human; identical to SEQ ID NO: 146153

SEQ ID NO: 146370 - RNA, 59 nt, Human; identical to SEQ ID NO: 146154

SEQ ID NO: 146371 - RNA, 59 nt, Human; identical to SEQ ID NO: 146155

SEQ ID NO: 146372 - RNA, 59 nt, Human; identical to SEQ ID NO: 146156

SEQ ID NO: 146373 - RNA, 59 nt, Human; identical to SEQ ID NO: 146157

SEQ ID NO: 146374 - RNA, 59 nt, Human; identical to SEQ ID NO: 146158

SEQ ID NO: 146375 - RNA, 59 nt, Human; identical to SEQ ID NO: 146159

SEQ ID NO: 146376 - RNA, 59 nt, Human; identical to SEQ ID NO: 146160

SEQ ID NO: 146377 - RNA, 59 nt, Human; identical to SEQ ID NO: 146161

SEQ ID NO: 146378 - RNA, 59 nt, Human; identical to SEQ ID NO: 146162

SEQ ID NO: 146379 - RNA, 59 nt, Human; identical to SEQ ID NO: 146163

SEQ ID NO: 146380 - RNA, 59 nt, Human; identical to SEQ ID NO: 146164

SEQ ID NO: 146381 - RNA, 59 nt, Human; identical to SEQ ID NO: 146165

SEQ ID NO: 146382 - RNA, 59 nt, Human; identical to SEQ ID NO: 146166

SEQ ID NO: 146383 - RNA, 59 nt, Human; identical to SEQ ID NO: 146167

SEQ ID NO: 146384 - RNA, 59 nt, Human; identical to SEQ ID NO: 146168

SEQ ID NO: 146385 - RNA, 59 nt, Human; identical to SEQ ID NO: 146169

SEQ ID NO: 146386 - RNA, 59 nt, Human; identical to SEQ ID NO: 146170

SEQ ID NO: 146387 - RNA, 59 nt, Human; identical to SEQ ID NO: 146171

SEQ ID NO: 146388 - RNA, 59 nt, Human; identical to SEQ ID NO: 146172

SEQ ID NO: 146389 - RNA, 59 nt, Human; identical to SEQ ID NO: 146173

SEQ ID NO: 146390 - RNA, 59 nt, Human; identical to SEQ ID NO: 146174

SEQ ID NO: 146391 - RNA, 59 nt, Human; identical to SEQ ID NO: 146175

SEQ ID NO: 146392 - RNA, 59 nt, Human; identical to SEQ ID NO: 146176

SEQ ID NO: 146393 - RNA, 59 nt, Human; identical to SEQ ID NO: 146177

SEQ ID NO: 146394 - RNA, 59 nt, Human; identical to SEQ ID NO: 146178

SEQ ID NO: 146395 - RNA, 59 nt, Human; identical to SEQ ID NO: 146179

SEQ ID NO: 146396 - RNA, 59 nt, Human; identical to SEQ ID NO: 146180

SEQ ID NO: 146397 - RNA, 57 nt, Human; identical to SEQ ID NO: 146181

SEQ ID NO: 146398 - RNA, 59 nt, Human; identical to SEQ ID NO: 146182

SEQ ID NO: 146399 - RNA, 59 nt, Human; identical to SEQ ID NO: 146183

SEQ ID NO: 146400 - RNA, 59 nt, Human; identical to SEQ ID NO: 146184

SEQ ID NO: 146401 - RNA, 59 nt, Human; identical to SEQ ID NO: 146185

SEQ ID NO: 146402 - RNA, 59 nt, Human; identical to SEQ ID NO: 146186

SEQ ID NO: 146403 - RNA, 59 nt, Human; identical to SEQ ID NO: 146187

SEQ ID NO: 146404 - RNA, 59 nt, Human; identical to SEQ ID NO: 146188

SEQ ID NO: 146405 - RNA, 59 nt, Human; identical to SEQ ID NO: 146189

SEQ ID NO: 146406 - RNA, 59 nt, Human; identical to SEQ ID NO: 146190

SEQ ID NO: 146407 - RNA, 59 nt, Human; identical to SEQ ID NO: 146191

SEQ ID NO: 146408 - RNA, 59 nt, Human; identical to SEQ ID NO: 146192

SEQ ID NO: 146409 - RNA, 59 nt, Human; identical to SEQ ID NO: 146193

SEQ ID NO: 146410 - RNA, 59 nt, Human; identical to SEQ ID NO: 146194

SEQ ID NO: 146411 - RNA, 59 nt, Human; identical to SEQ ID NO: 146195

SEQ ID NO: 146412 - RNA, 59 nt, Human; identical to SEQ ID NO: 146196

SEQ ID NO: 146413 - RNA, 59 nt, Human; identical to SEQ ID NO: 146197

SEQ ID NO: 146414 - RNA, 59 nt, Human; identical to SEQ ID NO: 146198

SEQ ID NO: 146415 - RNA, 59 nt, Human; identical to SEQ ID NO: 146199

SEQ ID NO: 146416 - RNA, 59 nt, Human; identical to SEQ ID NO: 146200

SEQ ID NO: 146417 - RNA, 59 nt, Human; identical to SEQ ID NO: 146201

SEQ ID NO: 146418 - RNA, 59 nt, Human; identical to SEQ ID NO: 146202

SEQ ID NO: 146419 - RNA, 59 nt, Human; identical to SEQ ID NO: 146203

SEQ ID NO: 146420 - RNA, 59 nt, Human; identical to SEQ ID NO: 146204

SEQ ID NO: 146421 - RNA, 59 nt, Human; identical to SEQ ID NO: 146205

SEQ ID NO: 146422 - RNA, 59 nt, Human; identical to SEQ ID NO: 146206

SEQ ID NO: 146423 - RNA, 59 nt, Human; identical to SEQ ID NO: 146207

SEQ ID NO: 146424 - RNA, 59 nt, Human; identical to SEQ ID NO: 146208

SEQ ID NO: 146425 - RNA, 59 nt, Human; identical to SEQ ID NO: 146209

SEQ ID NO: 146426 - RNA, 59 nt, Human; identical to SEQ ID NO: 146210

SEQ ID NO: 146427 - RNA, 64 nt, Human
caugagacgggaucugaguuagacaucaccaguggaaauugauuggaauagaaacuuaaaggaa

SEQ ID NO: 146428 - RNA, 64 nt, Human
ucaucauaagaaggagauugagcgucugcagaaagaaauugagcgccauaagcagaagaucaaa

SEQ ID NO: 146429 - RNA, 64 nt, Human
ggagcccauagcuguugucuaacagguaagaaaugaaauugaacuauugacugggccccagaaa

SEQ ID NO: 146430 - RNA, 64 nt, Human
caggcuuucuggugugugcccuccugguaacagugaaauugaagcuacuuacucauagugguug

SEQ ID NO: 146431 - RNA, 64 nt, Human
ccuugcaaucugaacuuggguuuucccugcaauagaaauugaauucugccucuuuuugaaaaaa

SEQ ID NO: 146432 - RNA, 64 nt, Human
uuucguugauaaagaacuagauacaaagaccucugaaauugaugauaaaauuuguaucucauua

SEQ ID NO: 146433 - RNA, 64 nt, Human
auuguugauucuguuuaaaugaccaauacuuuuugaaauugauguacuuaguuucaagauucau

SEQ ID NO: 146434 - RNA, 64 nt, Human
guguccuucaagugcuuucuaacuuugagaggaagaaauugaccaccuggacuauggaacugug

SEQ ID NO: 146435 - RNA, 64 nt, Human
caugacuucagggauucauuuuuuuuauacgcuggaaauugacuccccuuucccuucccaaaga

SEQ ID NO: 146436 - RNA, 64 nt, Human
gaauuuccauuucuacuaaccucuuggagaaaaagaaauugaauuagagguaaauagaagacgu

SEQ ID NO: 146437 - RNA, 64 nt, Human
gcugacgggcuuugucuguggaaggagacagaaggaaauugacccacucuccuaucuccagacc

SEQ ID NO: 146438 - RNA, 64 nt, Human
uucaagaagggaaaugauucuaaaaggauuaucugaaauugaaaaacuaguaagcaaauaaaug

SEQ ID NO: 146439 - RNA, 64 nt, Human
ugagauucugaauuauuuggcuccuccauuucuggaaauugagacucaagcuuuaugaauuuau

SEQ ID NO: 146440 - RNA, 64 nt, Human
uaacuuaucauauggcccagccauuucacuacuagaaauugacgcaagugaacugaaaacuuau

SEQ ID NO: 146441 - RNA, 64 nt, Human
auauuuacucaugcugaugcucugugagauauuugaaauugaaccaaugacuacuuaggauggg

SEQ ID NO: 146442 - RNA, 64 nt, Human
auguuuucaguuagaaagccuuuauuuacuuuuggaaauugaacaagaaaugcaucugucuuag

SEQ ID NO: 146443 - RNA, 64 nt, Human
uggguggaugcgugugggcacgacuuuguacucagaaauugaacucucagucacguggaagcca

SEQ ID NO: 146444 - RNA, 64 nt, Human
ggguuucuuuugggggcgcuuaugaagaugcucugaaauugauugugaugguuguacaacucug

SEQ ID NO: 146445 - RNA, 64 nt, Human
aaauacauagaacaaauauuuaaaaaaacaaaaagaaauugacucaguacuauuucuuuucacu

SEQ ID NO: 146446 - RNA, 64 nt, Human
uaaccccacugucuuggggaaugaugccagcugggaaauugaguuuuugacugaaacauggagc

SEQ ID NO: 146447 - RNA, 64 nt, Human
cagcccugaggaggaagaggaggcgagggaaucagaaauugaggacagcgaugcgggcagcugg

SEQ ID NO: 146448 - RNA, 64 nt, Human
ccagaggaaggaagcacugcagagauuaagagcagaaauugaaguuuuaacagauuccugguua

SEQ ID NO: 146449 - RNA, 64 nt, Human
guccagucagggccaaugagugaacuuacuagaugaaauugacuggcuaaggaggcauuaggga

SEQ ID NO: 146450 - RNA, 64 nt, Human
uuaaugcaaauuuuguauuucuuacaggccuacagaaauugaaaaugaccaaaaucaggaacca

SEQ ID NO: 146451 - RNA, 64 nt, Human
aagguuuuuguagcuauuugcuugccugagaaaugaaauugaaaacauaccccugcgugucugu

SEQ ID NO: 146452 - RNA, 64 nt, Human
augcucuacccuuguguauuuaaggcaggacagagaaauugaggaugccccuggggcuagaucg

SEQ ID NO: 146453 - RNA, 64 nt, Human
ugcugugauugagaaguuugccccaauuaagcgugaaauugaaaaacugaagcuggacaaggac

SEQ ID NO: 146454 - RNA, 64 nt, Human
ggaaaaacauguuggcuuuucucuugacgugggagaaauugaaaagaaggggaaggggaagaaa

SEQ ID NO: 146455 - RNA, 64 nt, Human
gcaacagcguauuggcuuggcuguugacauggaugaaauugaaaaguaccaagaaguggaagaa

SEQ ID NO: 146456 - RNA, 64 nt, Human
gucauuugaaggauuaagaaacaaaaacaauccagaaauugaucgguuuuuuuaggccaauccc

SEQ ID NO: 146457 - RNA, 64 nt, Human
aguccugucuggguuuuaaauaagugaaguagaagaaauugaguauuuucugacauaagaauau

SEQ ID NO: 146458 - RNA, 64 nt, Human
agcagggaagccccagugaguagcugcauuccuagaaauugaaguuucagagcuacacaaacac

SEQ ID NO: 146459 - RNA, 64 nt, Human
gggagguuuguugaauugguuuuuaagguuuacugaaauugauuugcugaauuuuucugcuagu

SEQ ID NO: 146460 - RNA, 64 nt, Human
uacuuuuaagucuaauuuuacagauagaauaauggaaauugaaaauuuaacccuuuauuccgau

SEQ ID NO: 146461 - RNA, 64 nt, Human
aaggcgguuauaauuugucuuuuuaagaucacuggaaauugauaaaauuuugugauaauuauga

SEQ ID NO: 146462 - RNA, 64 nt, Human
gggauggauagguauagggaagggcauucguugggaaauugaugaccggaaacuagaaagcccc

SEQ ID NO: 146463 - RNA, 64 nt, Human
cgaaaagauuuucaguaucacagauuauucauaagaaauugagaaaaggaacaaucagaaguug

SEQ ID NO: 146464 - RNA, 64 nt, Human
aauacuccaacaggaaugguagucacacugucuugaaauugaaucuguccaucuguuuauaauc

SEQ ID NO: 146465 - RNA, 64 nt, Human
uugguugcagcacaacuguauauauuguauaaccgaaauugauuauuuucauuguccuuaaugc

SEQ ID NO: 146466 - RNA, 64 nt, Human
uaaaucucauuguaaauauauuugauuucuuguagaaauugauuuccuucuguuuaauuuuaug

SEQ ID NO: 146467 - RNA, 64 nt, Human
augaaagaaaaguagcugucaacaaggggaaagugaaauugagcaauucacuguuucaggauac

SEQ ID NO: 146468 - RNA, 64 nt, Human
guaaguagcuaaugaaguaaagaucaugaagaaagaaauugauagguguaaaugagagaccaug

SEQ ID NO: 146469 - RNA, 64 nt, Human
gauacaaggaucagaauggaaagaaacucacgaugaaauugaaccugguuuuuguauauuuauc

SEQ ID NO: 146470 - RNA, 64 nt, Human
ugccuagaaacaacacuguaguaaauaaugcuuugaaauugaaccuuugugcccuaucacccaa

SEQ ID NO: 146471 - RNA, 64 nt, Human
cugcuggucauggucaaaaaguaagauacgcuaggaaauugagucacuaggagcauggauguau

SEQ ID NO: 146472 - RNA, 64 nt, Human
uaagaugaaauuccucuguuguuaguaaaauuaugaaauugaaguucugcagcaugucaggcca

SEQ ID NO: 146473 - RNA, 64 nt, Human
agaaaagcuacaguaugaaaucugaaaagcaacagaaauugaaagugaccuuaaagaauaaauu

SEQ ID NO: 146474 - RNA, 64 nt, Human
cuaccucagaaacugcagcuugguucugaugauagaaauugaauuuuuccuuguaguuauugug

SEQ ID NO: 146475 - RNA, 64 nt, Human
auagauuugguccaguguauuuucaugauaaagugaaauugagucagaacaagaguuaauaucu

SEQ ID NO: 146476 - RNA, 64 nt, Human
acacacgcacacauauauguugcugcagcauaaagaaauugaaauaaaaguuuaaaauaguacc

SEQ ID NO: 146477 - RNA, 64 nt, Human
uauuuaggcuuugccugcuuggugugauguaagggaaauugaaagacuugcccauucaaaauga

SEQ ID NO: 146478 - RNA, 64 nt, Human
aaacaaacaaacuagcagcuacuaaaauagagaagaaauugagggcaaaguaauaugucuccaa

SEQ ID NO: 146479 - RNA, 64 nt, Human
ucgcugaaaaaauuaagucagcucagcacgaguugaaauugacuacauuaauuucuuuccaccu

SEQ ID NO: 146480 - RNA, 64 nt, Human
augaaaacccaaaagcuuuaaaaguuacuaucaagaaauugaaaggaaacccacagaauaggau

SEQ ID NO: 146481 - RNA, 64 nt, Human
uugaaauauaaaaaauaaauuaggcccaauccaagaaauugagugagaaggaaacacuuguuuu

SEQ ID NO: 146482 - RNA, 64 nt, Human
caauuuucuauuuaaaaaaugaauaguacaugcagaaauugaccugauuuccauuugcaacagg

SEQ ID NO: 146483 - RNA, 64 nt, Human
ccaguucaaauucagcauggcugcagcugauuaagaaauugauaugauuauucuuugcuagccu

SEQ ID NO: 146484 - RNA, 64 nt, Human
aucauuucuacugaaguugggaaauucaaccccagaaauugacagaugaaaggagacaaugguu

SEQ ID NO: 146485 - RNA, 64 nt, Human
uuacauuaguagcaauaaauauuagaauaaauaugaaauugaacuauuuucagaaaaagggcag

SEQ ID NO: 146486 - RNA, 64 nt, Human
cuguggcgccgucuccaggggcugcuuccuccuggaaauugacgaggggugucuugggcagagc

SEQ ID NO: 146487 - RNA, 64 nt, Human
agccaagcagaauugguuccauuugacagaugaagaaauugaggcagauugcguuaagugcugu

SEQ ID NO: 146488 - RNA, 64 nt, Human
uauaggguuugcaagggaagggcucagagcaagggaaauugagaaaagggcccaaggaggagau

SEQ ID NO: 146489 - RNA, 64 nt, Human
uggcuucaagcaccucuguucauagagcgucucugaaauugagucucggucaugacuuaucccg

SEQ ID NO: 146490 - RNA, 64 nt, Human
gaaaagggcagguugaaucaaggugaaucaaucugaaauugagcacaccugccugccaucgcug

SEQ ID NO: 146491 - RNA, 64 nt, Human
gugaaagguuacuuaauuaaauuacaaccaccaggaaauugacugcuuuuuuuuuuuuuuuaaa

SEQ ID NO: 146492 - RNA, 64 nt, Human
uuaacaacaaaagaguuauugaaaugcauggguagaaauugaaccaggaaaaucaguaaaguga

SEQ ID NO: 146493 - RNA, 64 nt, Human
ugccacaugggguauuggccacacgcuggaagcugaaauugaugaucccugaagguugaaccca

SEQ ID NO: 146494 - RNA, 64 nt, Human
aagccuuagauucacucugaucuaagaaauuauugaaauugacccuuuuuacacaaaugucuuu

SEQ ID NO: 146495 - RNA, 64 nt, Human
uguauacaaguguugcuucaaaguaccaaggucagaaauugauugaguacgguuuacuaaaguc

SEQ ID NO: 146496 - RNA, 64 nt, Human
ccuccugcuguguggccaaacggauauccuaauagaaauugauguuacuaacaauuagccucua

SEQ ID NO: 146497 - RNA, 64 nt, Human
uguuuuauuucuuuuauauaaaugugauuucucagaaauugauauuaaacacuaucuuaucuuc

SEQ ID NO: 146498 - RNA, 64 nt, Human
agaauaacauuuucuauaacauaugauggugucugaaauugagaauccaguuucuuuccccagc

SEQ ID NO: 146499 - RNA, 64 nt, Human
caagaauggaggaauccuugacucuuacacacuggaaauugaaauaaagauaaaugcaaccauu

SEQ ID NO: 146500 - RNA, 64 nt, Human
uggugauuuccaaguggagcugagcaguuuuagggaaauugagugcugggucauucagaaggua

SEQ ID NO: 146501 - RNA, 64 nt, Human
aucuuaaaagagaacacaccaaaaaagugaaagagaaauugaaagggaaaaaagacaaaaagca

SEQ ID NO: 146502 - RNA, 64 nt, Human
cccaaauuccuuucauguucuuaacugcuacccagaaauugagcuucagaagauugaggauagc

SEQ ID NO: 146503 - RNA, 64 nt, Human
auaaacauaacuuaccugagcuaggguugcagcagaaauugaguugcagcuugcccuuguccag

SEQ ID NO: 146504 - RNA, 64 nt, Human
ccaacuaaaauacguuugacccauuuugaauaaggaaauugaaaagaaaaauuuaaaaggagaa

SEQ ID NO: 146505 - RNA, 64 nt, Human
ccaauggccucugaaaaagcacauuuuagauacugaaauugaaggaaagaaaaugcaucuucaa

SEQ ID NO: 146506 - RNA, 64 nt, Human
ucaaaaugguauuuugaugccaucaaaugcccaggaaauugacuuugcagugucaccacuggug

SEQ ID NO: 146507 - RNA, 64 nt, Human
cucagaucauccaccugugugaguccaucacugugaaauugacuguguccaugugaugaugccc

SEQ ID NO: 146508 - RNA, 64 nt, Human
gggagguauauuugagccagacaggagugcuuuggaaauugagagguggagcaaucucagguaa

SEQ ID NO: 146509 - RNA, 64 nt, Human
guuugaauuuuuugcccguguuaucagaaugauggaaauugaucauuuucaguuguucauugug

SEQ ID NO: 146510 - RNA, 64 nt, Human
ucaguugcuguuuucucacucucuauauccauuugaaauugauuuauuuuagauguuguauacu

SEQ ID NO: 146511 - RNA, 64 nt, Human
guuccucaugcagcagaaggaagacagaaagauagaaauugauuauuuuuaugauagcaguauu

SEQ ID NO: 146512 - RNA, 64 nt, Human
aauccuuaugaaaaucauagcuggcuucuuuacagaaauugauaagcuagucccaaaauucaua

SEQ ID NO: 146513 - RNA, 64 nt, Human
ucaaugaagaaaucggagugggaagagacacagggaaauugagccauauuuuggcuaucggcug

SEQ ID NO: 146514 - RNA, 64 nt, Human
uuuagaauucccaagagggcuuuauuacaccucagaaauugaaagcacuaugaauuuguccauu

SEQ ID NO: 146515 - RNA, 64 nt, Human
guccuagguuucuaggagaguuuuguuuaacuaagaaauugacagaauucauaggugugggugu

SEQ ID NO: 146516 - RNA, 64 nt, Human
acuggaaacauagcaaaccuugauuuagcuccaagaaauugaguagggaaauauuuguuuuuua

SEQ ID NO: 146517 - RNA, 64 nt, Human
ggagaagcuggaggugcuggagaggacauacggggaaauugagggcacggugucgaggguauug

SEQ ID NO: 146518 - RNA, 64 nt, Human
ugugacuggcuuuuccuaccucugccaugguguagaaauugauugcacauugauuggaugagcc

SEQ ID NO: 146519 - RNA, 64 nt, Human
aacuucugagcagaacauugaguuugagaauccugaaauugagccuaugagaaagagacucauu

SEQ ID NO: 146520 - RNA, 64 nt, Human
gcuuaggauggcuaugugaucagguguggccaaugaaauugaagaggaagucuaccugggcuuc

SEQ ID NO: 146521 - RNA, 64 nt, Human
gaaaaugggauacuauagacuacugagaauuucagaaauugagaacaauuucauaauaaaacgg

SEQ ID NO: 146522 - RNA, 64 nt, Human
uauucagugcagcccucauaguaucauacuugaagaaauugauuacaguuccacuaaauuguug

SEQ ID NO: 146523 - RNA, 64 nt, Human
aauggguucuauagaaaaguccguuuaguguagagaaauugaaaacagaucuauuagguuggug

SEQ ID NO: 146524 - RNA, 64 nt, Human
cacccauuuaguuugugguagcaaagugcaaugcgaaauugaaugagaaacugagauuucucag

SEQ ID NO: 146525 - RNA, 64 nt, Human
cugaucagcuuuuaauaucugucaaauaaaaauugaaauugaagaugguauauaagauuucagg

SEQ ID NO: 146526 - RNA, 64 nt, Human
uuuaaaagugaauuuaaccacaacugagaccuaagaaauugaccuaggggugugugugugugug

SEQ ID NO: 146527 - RNA, 64 nt, Human
ucagaagcuccaaguuccugucuucuguuuuauagaaauugaucuucccugggggacuuuaacu

SEQ ID NO: 146528 - RNA, 64 nt, Human
uacauucuguuugcaggauuuuuuuuguaaccaugaaauugaacauuuccaaauuauaaacuau

SEQ ID NO: 146529 - RNA, 64 nt, Human
cacuauucacugucaauuucauuucuugucuuuugaaauugacacuuggccugacuuacgaaac

SEQ ID NO: 146530 - RNA, 64 nt, Human
ccaccucgaggagauuugcuccccauuagcgaaugaaauugaugcaguccuaccuaacucgauu

SEQ ID NO: 146531 - RNA, 64 nt, Human
caagaaggaaaagucacgauaaaccuggucaccugaaauugaaauugagccacuuccuugaaga

SEQ ID NO: 146532 - RNA, 64 nt, Human
ggaaaagucacgauaaaccuggucaccugaaauugaaauugagccacuuccuugaagaaucaaa

SEQ ID NO: 146533 - RNA, 64 nt, Human
uucuacgagcauuuggaaggagugaucaaauaccgaaauugaacuuucuaaaaccuacacauag

SEQ ID NO: 146534 - RNA, 64 nt, Human
agacauuaaacauggaauuuaaggacuguugggggaaauugaucacuucuuagcauuuccauuc

SEQ ID NO: 146535 - RNA, 64 nt, Human
uagcuuuugucauaauuccuuaccgaaaacaacugaaauugagagucauaaauacuguggguua

SEQ ID NO: 146536 - RNA, 64 nt, Human
gagcaucucauuuauaauguagcagcucauaaaugaaauugaaaaugguauuaaagaucugcaa

SEQ ID NO: 146537 - RNA, 64 nt, Human
uuuaaaaauuaaaagauugguuugaggaugugaugaaauugagacuuuuugugguuuucucuca

SEQ ID NO: 146538 - RNA, 64 nt, Human
uaaaaguacacuuugcaacuauuuuucagaaauagaaauugauucaggacuaaaacuuuaaacu

SEQ ID NO: 146539 - RNA, 64 nt, Human
ucaggccaagugucaauuucaaaagacaagaaaugaaauugacagugaauagugcucauaaauu

SEQ ID NO: 146540 - RNA, 64 nt, Human
uuuuuuuaagguauuugcuaagucuuuguaaacggaaauugaaaaugaccugguaucuugccag

SEQ ID NO: 146541 - RNA, 64 nt, Human
uggauuuucuuccaagauauuguauucccaagaagaaauugauuuauuuuuaaacuaucaguua

SEQ ID NO: 146542 - RNA, 64 nt, Human
aagccuguuagcaugcuggugagccaagcaguuugaaauugagcuggaccucaccaagcugcug

SEQ ID NO: 146543 - RNA, 64 nt, Human
uauuaaaagcauaaguuuggaagacaggcuugccgaaauugaggacaugauuaaaauugcagug

SEQ ID NO: 146544 - RNA, 64 nt, Human
gaggagauucuguaaacuuaaaauuacuauaaaugaaauugauuugucaagaggauaaauuuua

SEQ ID NO: 146545 - RNA, 64 nt, Human
aauaaauuacauuugggggcuuuccaaagaaauggaaauugauguaaaauuauuuuucaagcaa

SEQ ID NO: 146546 - RNA, 64 nt, Human
aauaaauuacacaugggggcuuuccaaagaaauggaaauugaugggaaauuauuuuucaggaaa

SEQ ID NO: 146547 - RNA, 64 nt, Human
aauaaauuacacgugggagcuuuccaaagaaauggaaauugaugggaaauuauuugucaagcaa

SEQ ID NO: 146548 - RNA, 64 nt, Human
cccagucaucucugaauuuacauuuuauauuaaagaaauugagcuauccauacaaccuguauuu

SEQ ID NO: 146549 - RNA, 64 nt, Human
agaagcagcucaauuguuugguuggaaaguaggggaaauugaaguuguagucacugucugagaa

SEQ ID NO: 146550 - RNA, 64 nt, Human
auaugugcaaaaaaaaauccacuugcaaugguaagaaauugaaguauccuuaaaggccaugaag

SEQ ID NO: 146551 - RNA, 64 nt, Human
uuccucuuucuuaauauuauagaauucuguacuugaaauugauucuuagacauugcagucucuu

SEQ ID NO: 146552 - RNA, 64 nt, Human
uucaauguugcuguucuugcucagugauuuuaaagaaauugaguaguuccuaugugauuuuuuu

SEQ ID NO: 146553 - RNA, 64 nt, Human
guuuugcucagaggaaguaaauguucacuuaaaugaaauugaaaacgccauguggcaccacaaa

SEQ ID NO: 146554 - RNA, 64 nt, Human
uuuuguuugcuuccauuauugaguuccuccuaaggaaauugaggagagggacugaauagaagcc

SEQ ID NO: 146555 - RNA, 64 nt, Human
uguaucauuuauauuugccuuauguuaacuuuaagaaauugauuuuuuuguauuaaucauuuuc

SEQ ID NO: 146556 - RNA, 64 nt, Human
aaauuauaugaaccuuuccccaagaagggcccuagaaauugauguggcuuuccucuuaaauauu

SEQ ID NO: 146557 - RNA, 64 nt, Human
auucacuuuuacuaccccaaaguuugcucaaggagaaauugaagccauagucgugccuguuugc

SEQ ID NO: 146558 - RNA, 64 nt, Human
caacauagaaagucacauuuugaaaggcuauuuugaaauugauuuaauagcuauuauaguuuau

SEQ ID NO: 146559 - RNA, 64 nt, Human
aacuagguuauucauaauguauaccuagaaaagugaaauugaaaauaccaaaagauguaucauu

SEQ ID NO: 146560 - RNA, 64 nt, Human
gaggaggcaucugcuaaacgcuuguugaaggagugaaauugagagaccaggaagggccugcagg

SEQ ID NO: 146561 - RNA, 64 nt, Human
uugcuguaccagcccagauguuuuacgucugggagaaauugacagaucaagcugugagacagug

SEQ ID NO: 146562 - RNA, 64 nt, Human
cagaaugcugcaggacuugagaagaccucaccuagaaauugacacaaguggaccuuaggccuuc

SEQ ID NO: 146563 - RNA, 64 nt, Human
uccugguacuguaguuuagggguugauggugguugaaauugauuucuggcugguuacuaaggug

SEQ ID NO: 146564 - RNA, 64 nt, Human
gagcugaucaaggucauguuucucacuguuccaggaaauugaucaacucuuccaaugggacauu

SEQ ID NO: 146565 - RNA, 64 nt, Human
gguuccuucucuguaacacuaaauauuuuagugugaaauugaauuuuuuuauuacuauagucuu

SEQ ID NO: 146566 - RNA, 64 nt, Human
cuuuucauuauaauucugagcaggaaauuuauaagaaauugaaagagcagaagaauuacagccc

SEQ ID NO: 146567 - RNA, 64 nt, Human
ucuguguuuagguauucucugccacucuugcugugaaauugaagugcauguagaaaaaaccuuu

SEQ ID NO: 146568 - RNA, 64 nt, Human
ggauaucaaaugaagugauaggggucacaauggggaaauugaaguggugcauaacauugccaaa

SEQ ID NO: 146569 - RNA, 64 nt, Human
acuauaauuaccaaaaacauguauauaaaagaaugaaauugaaaaauaaaauauauaaacauaa

SEQ ID NO: 146570 - RNA, 64 nt, Human
acaacuccagauugacauugacugcuuaaccaaagaaauugaucuuuuucaagcccgagguaaa

SEQ ID NO: 146571 - RNA, 64 nt, Human
gaagaagacacuaaaaacaauugcaacaaaaacagaaauugacaaauggggccucauuaaacua

SEQ ID NO: 146572 - RNA, 64 nt, Human
caucgcuauuaacagccagagucauaaaugaaaugaaauugaagaauucauucaaaugcucuuu

SEQ ID NO: 146573 - RNA, 64 nt, Human
uaauauucuuaauuuaacuguacauuucuuuauggaaauugauuaucuacacucaguuucauua

SEQ ID NO: 146574 - RNA, 64 nt, Human
ucucacuggucguguaaacuuuuuuuuuuuuuuggaaauugaagcuguagagugcugcccgaaa

SEQ ID NO: 146575 - RNA, 64 nt, Human
ccauggcagugggaaaaauguaggagacuguuuggaaauugauuuugaaccugaugaaaauaaa

SEQ ID NO: 146576 - RNA, 64 nt, Human
acccuugggcagggcuggacucaguaauuuugaggaaauugaagaugccaucuuccccugugag

SEQ ID NO: 146577 - RNA, 64 nt, Human
auagaacuguacuguuuucugggccagugagccagaaauugauuaaggcuuucuuugguaggua

SEQ ID NO: 146578 - RNA, 64 nt, Human
ggaaaaaacgcuguugcccauuuuuguagccagagaaauugaaaaacgacuguggcuugauguu

SEQ ID NO: 146579 - RNA, 64 nt, Human
uugaaagaaucaacuucuaaccucaaccauccaggaaauugacaguggcugcaguauugacucc

SEQ ID NO: 146580 - RNA, 64 nt, Human
guacuuugugaauuuuaauuuaaagaaagcaacugaaauugaaaucuugagggcagcugugucu

SEQ ID NO: 146581 - RNA, 64 nt, Human
gcaaaagguuuaugaaggggcucacagagcgguugaaauugaagcucuaacaccacacuccagc

SEQ ID NO: 146582 - RNA, 64 nt, Human
uauuuacaugcuuagaggggugaaaauuauuuuggaaauugagucugaagcacucucgcacaca

SEQ ID NO: 146583 - RNA, 64 nt, Human
cauauugcaaccuaguacuuuauuaguuuaaaaagaaauugagguuguucaaaguuuaagcaau

SEQ ID NO: 146584 - RNA, 64 nt, Human
cauuuuaaagaggcgguugcaggacucugagcuggaaauugaauuugaguuuaaacuccacguu

SEQ ID NO: 146585 - RNA, 64 nt, Human
aaugagugagaaacugccccauuuugaaggugaggaaauugagguucuggguauaacuuucuuu

SEQ ID NO: 146586 - RNA, 64 nt, Human
caaucuugaacugauuuagaagagacucuuugcugaaauugaauugcacuuauacauguaaauu

SEQ ID NO: 146587 - RNA, 64 nt, Human
ccuaagcauauuugaauaugaucucccauaauuugaaauugaaaucguauuguguggcucugua

SEQ ID NO: 146588 - RNA, 64 nt, Human
cguguaagcuuguguuucuugggcagucuuucuugaaauugaagaggugaaaugggggugggga

SEQ ID NO: 146589 - RNA, 64 nt, Human
cgugagugcaggugucccuguuguaauuugcagggaaauugacugcaggugauaguguugacgu

SEQ ID NO: 146590 - RNA, 64 nt, Human
uggaauucagguaguaaauaugaaacuaggguuugaaauugauaaugcuuucacaacauuugca

SEQ ID NO: 146591 - RNA, 64 nt, Human
gguugcuguuuuuaugucuucaaaaaugcaaugagaaauugagaaaacauugcauuaaaucuug

SEQ ID NO: 146592 - RNA, 64 nt, Human
cuguauauuuugguuuacuuacuccucuauuucagaaauugaaaaagauccccaaggaucuguu

SEQ ID NO: 146593 - RNA, 64 nt, Human
gacauugcugccuuuaagaauaccaugaauguaagaaauugaaagaaauuguaaaauaucacau

SEQ ID NO: 146594 - RNA, 64 nt, Human
aaggaccuucauucucuguucugcaccucuucuggaaauugaguaaauuuugcuuuuuuuuuuu

SEQ ID NO: 146595 - RNA, 64 nt, Human
uugcuuuccuuaacaagacagcaaaacguaaacagaaauugaaaacuugaaggauauuucagug

SEQ ID NO: 146596 - RNA, 64 nt, Human
cgcgccccccgcgccccucuuuuuccccuugauggaaauugaccauacaauuucauccuccuuc

SEQ ID NO: 146597 - RNA, 64 nt, Human
uuaaaaaccaagguaaaaaugaucaaacauauaugaaauugagucuuagauuuaaugaauuuca

SEQ ID NO: 146598 - RNA, 64 nt, Human
uuuuaaaaaucagguaccacuugauuucauaugggaaauugaagcaggaaauauugagggcuuc

SEQ ID NO: 146599 - RNA, 64 nt, Human
gauaaaacaggccacuagagggugcaguuauaaagaaauugaugagguuuuuaccuuuuuaaaa

SEQ ID NO: 146600 - RNA, 64 nt, Human
aguauuuuggaaauagcauaucugagacugaagagaaauugacaauucacuuauuugugguuuu

SEQ ID NO: 146601 - RNA, 64 nt, Human
cccucugucuggucuuccucuagaagguaccgcagaaauugaugugugcucccugcccucguca

SEQ ID NO: 146602 - RNA, 64 nt, Human
aagcaaggaauaauccuguguuguuucacucuuagaaauugaauuagcauaauugggccaugga

SEQ ID NO: 146603 - RNA, 64 nt, Human
gugacuuugcaucuaucuugcucuugagguggaugaaauugagaagcuggaguguguaagccau

SEQ ID NO: 146604 - RNA, 64 nt, Human
ugcaugcuaguguuguauuucuauacaguagcuugaaauugauuaacuuauacuguagguguua

SEQ ID NO: 146605 - RNA, 64 nt, Human
agaaaaguauaguuaaugguuucaaauaugcuaagaaauugacucugcggaggggaucuuaaaa

SEQ ID NO: 146606 - RNA, 64 nt, Human
caccgugacugagggaaacauugcuugucuuugagaaauugacugacauacuggaagagaacac

SEQ ID NO: 146607 - RNA, 64 nt, Human
caguaaugcaagcaaaguaucaaagaaaaacaaugaaauugaccuaguucagauacagggugcu

SEQ ID NO: 146608 - RNA, 64 nt, Human
aaaccuucaaauuagaauacauuguacaguuaaagaaauugacuugguacuuaaaagaaagauu

SEQ ID NO: 146609 - RNA, 64 nt, Human
uuugaguauggaagccagugccuguguacucacugaaauugaagaugaggaaaguagcuguaca

SEQ ID NO: 146610 - RNA, 64 nt, Human
gaaacauugcaguggcuacuguguuggcccaguagaaauugacaguauuuuguauauaugugcc

SEQ ID NO: 146611 - RNA, 64 nt, Human
agaaguagagaaugaaggaaaaggugaaugcuaugaaauugauauuuuuucuggaacugaauuc

SEQ ID NO: 146612 - RNA, 64 nt, Human
aacacugacuuuguuuuuauaaguuauuaaaugugaaauugaucugcaucagcuuauuuauaaa

SEQ ID NO: 146613 - RNA, 64 nt, Human
gccuacucacacccucacuggagaagucaggguagaaauugagccuucagagcccaacucaagg

SEQ ID NO: 146614 - RNA, 64 nt, Human
aucaaccaaccaguccccuuauuuaguaaauaaggaaauugaggcuacacacagaaaauugugc

SEQ ID NO: 146615 - RNA, 64 nt, Human
ucuugccccuucuaggggcaggugaaaggaauaggaaauugaaccugggguuuugacuugccac

SEQ ID NO: 146616 - RNA, 64 nt, Human
uucuggaggcauggaguuagguaaggcuacaugagaaauugagcuuuuccacuggguuuugaaa

SEQ ID NO: 146617 - RNA, 64 nt, Human
ggaugcuuuuuaacagccuuuagaagccgcugcugaaauugauacugggggaaggguuccccuu

SEQ ID NO: 146618 - RNA, 64 nt, Human
caacuuaaaugcugcgcaugaaaccucuaaguuggaaauugaagcuagccacucagagaaacuu

SEQ ID NO: 146619 - RNA, 64 nt, Human
gggauaauuuauuuccuguggcaucuagccagaagaaauugaggauguuuccuuucacagcugc

SEQ ID NO: 146620 - RNA, 64 nt, Human
uaagcuuaccuguagggcaguuaccacagaaacagaaauugaccuccgguauauauaaauauuu

SEQ ID NO: 146621 - RNA, 53 nt, Human
aacaagaaugccucgacuagagugaaauugaacuccaucaggcaaaauuuaaa

SEQ ID NO: 146622 - RNA, 64 nt, Human
agggaaagccauccaaauuugaaagcuguugauagaaauugagauucuugcugucuuuugugcc

SEQ ID NO: 146623 - RNA, 64 nt, Human
cagucuaacaaauuccaaauucucacagaagaaggaaauugaauuuccaugaguuacacuggau

SEQ ID NO: 146624 - RNA, 64 nt, Human
uauuaauguugauaugaguaaaaacaaauaggaagaaauugaaauuucuuuucaucaacaugua

SEQ ID NO: 146625 - RNA, 64 nt, Human
auauuuggaaaacauuuaaugcacuaacuuuaaagaaauugaaaauucagguggauaaauaguc

SEQ ID NO: 146626 - RNA, 64 nt, Human
ucgucuucugggaggaagcuggagagagcacagugaaauugaaauacccauucccagauaguca

SEQ ID NO: 146627 - RNA, 64 nt, Human
auauucuuugaaaauucuugaaguucuuuaauuugaaauugaaacauuaauuuuugagguuuuu

SEQ ID NO: 146628 - RNA, 64 nt, Human
uuauaaugaucaugaaacccuaggcagaggaggagaaauugaagguccagggcaaugaaagaaa

SEQ ID NO: 146629 - RNA, 64 nt, Human
gaaauauaaauuaucugaauauuagaugcucugagaaauugaauguaccuuauuuaaaagauuu

SEQ ID NO: 146630 - RNA, 64 nt, Human
ucaauuuacuuguuuuuaauacaugauucucuaugaaauugaugggcucaaacuagcugugaau

SEQ ID NO: 146631 - RNA, 64 nt, Human
caagcaaaccacaaugguaaagugguuaauucaggaaauugacagaauccaguuuugagaaaag

SEQ ID NO: 146632 - RNA, 64 nt, Human
aagcugaguauuaaaauguaugcauguugucuaagaaauugaauacuuugaauguguuucacag

SEQ ID NO: 146633 - RNA, 64 nt, Human
uguugugcuuugccuucuuuggcgaugaaugucagaaauugaaugccacaugcuuucauaauau

SEQ ID NO: 146634 - RNA, 64 nt, Human
aguagucuuaacacauuacuaacuuuuucuaagagaaauugauuccuguuuugucaucugaugc

SEQ ID NO: 146635 - RNA, 64 nt, Human
caugacaauguaauuuguguaacuguugaaucuggaaauugaucagcauuaaagggcacaugaa

SEQ ID NO: 146636 - RNA, 64 nt, Human
gcaguguucuuucacacuguuuuaauuuucuugggaaauugaguccaguggauguuaauggagu

SEQ ID NO: 146637 - RNA, 64 nt, Human
agcugauuucuuugauucccuagcugcaaaaccugaaauugaccacuaggugacagaauguuug

SEQ ID NO: 146638 - RNA, 64 nt, Human
aguuuccugaaggaguucuuuguuccugaucaaagaaauugauaccuguuagcauucacugcca

SEQ ID NO: 146639 - RNA, 64 nt, Human
gagaauuguggaaaagacauccuuucaauguaaugaaauugauaguaccaccugauacagggcu

SEQ ID NO: 146640 - RNA, 64 nt, Human
cucaauuauuauaaaugaucuacauguucagauugaaauugaaagcuuuaaaaauugugaauua

SEQ ID NO: 146641 - RNA, 64 nt, Human
aagacuccgucucaaaaaaaaaaaaaaaaaaaaagaaauugaauugggggagucauggucaggg

SEQ ID NO: 146642 - RNA, 64 nt, Human
uggcauggguggguggggagucagucaugucacugaaauugaaugggggaggcccaaugaggug

SEQ ID NO: 146643 - RNA, 64 nt, Human
ggcuucugugaggaaugugaggcacauuauuggggaaauugaggagacagccuagacacuggcu

SEQ ID NO: 146644 - RNA, 64 nt, Human
cuguauuuuuaaauuaaggaguuuuaguuauaaugaaauugauuuguagucuguuuugccguaa

SEQ ID NO: 146645 - RNA, 64 nt, Human
uucauucaauucuguuaucucuguuuuacucuuugaaauugaucaagccacugaaucacuuugc

SEQ ID NO: 146646 - RNA, 64 nt, Human
gugacccuuaagaauccaguuuggauuaguguuugaaauugaauugggaauguuguuccaggau

SEQ ID NO: 146647 - RNA, 64 nt, Human
cccuuauuuuauaccguuuuucuucaacaauggcgaaauugacuguagugcugaaccaaaagua

SEQ ID NO: 146648 - RNA, 64 nt, Human
aguaaccugaaaaaacauuagaguaaaaaucauugaaauugaaaagagaaaaucgauaaaaccc

SEQ ID NO: 146649 - RNA, 64 nt, Human
aaguguaauacauaaauugucacaaauuauacaugaaauugauuacaaauacauuugaaaaaca

SEQ ID NO: 146650 - RNA, 64 nt, Human
aaaaaauauaauuauuuucaucagacuuaaacuggaaauugaugauuucugaacugaagccuuc

SEQ ID NO: 146651 - RNA, 64 nt, Human
uucuagguguuucaacagagggaguuuaauacaggaaauugacuuacauagaugauaaaagaga

SEQ ID NO: 146652 - RNA, 64 nt, Human
ccauuccaaagaagaauaaaagcacaacucaagugaaauugaaguagucgauaaucagaaaaga

SEQ ID NO: 146653 - RNA, 64 nt, Human
guagcuuggacuuagugggaguguuuacaccauggaaauugacaaacuauaaaucaggguuuua

SEQ ID NO: 146654 - RNA, 64 nt, Human
aguaaccuggaaaaaaauuagaguaaaaaucagugaaauugaaaagagaaaaucaauaaaaccc

SEQ ID NO: 146655 - RNA, 64 nt, Human
gcagggcauguuucccuuuguucacauucucugagaaauugaaacucugguuucucuucaaauu

SEQ ID NO: 146656 - RNA, 64 nt, Human
gaaaaaauguuuaauacaaagagcugaaaauguagaaauugaguuaucuucccuuugcaaaauu

SEQ ID NO: 146657 - RNA, 64 nt, Human
uuggguaaaaugauuuccuuuucuuucuuacugggaaauugaaguagcauguccucugaguugc

SEQ ID NO: 146658 - RNA, 64 nt, Human
aguaugguucaaguacugcucuucuuuuuauggggaaauugauuuuuaaggagcgauucuuuuc

SEQ ID NO: 146659 - RNA, 64 nt, Human
ugacuuaacugaucaugcaugaucccucaucccugaaauugaguuuauguagucauuuuacuua

SEQ ID NO: 146660 - RNA, 64 nt, Human
uuccacaagaggaaauguaaaacaguuaagacuugaaauugaaaauucuuuuaauauuuaaaau

SEQ ID NO: 146661 - RNA, 64 nt, Human
aaaaaacugguauguugcacguaugcuuuugguugaaauugaacauacucuagugaaugugccu

SEQ ID NO: 146662 - RNA, 64 nt, Human
guagcugugaaguucugguacaguuguaaaaagagaaauugaguuguuucucuauguucuucag

SEQ ID NO: 146663 - RNA, 64 nt, Human
ccaggccguggccagagcagauacguaggcccaugaaauugaugaacugagaguugcuuccagu

SEQ ID NO: 146664 - RNA, 64 nt, Human
ucugggcuuauauguacuuuuauuuuuugguggugaaauugacugaugauuuuccuuuuucuuc

SEQ ID NO: 146665 - RNA, 64 nt, Human
uguugccuauugcugugcuuauaaaaugaaaaaggaaauugaggacacuuuugcaaaugccaga

SEQ ID NO: 146666 - RNA, 64 nt, Human
aagaauacuuuggggggaaaaaaguuuuaaaaaagaaauugaaaauugccuugcagauauuuag

SEQ ID NO: 146667 - RNA, 64 nt, Human
aaaagaggacauagcccagaguuucuguuauugggaaauugaggcaauagaaaugacagaccug

SEQ ID NO: 146668 - RNA, 64 nt, Human
aaaaaagaguggaucaguuugcuaaaugaacauugaaauugaaaugcuuuaucuguguuuucug

SEQ ID NO: 146669 - RNA, 64 nt, Human
acacaaagggcacgugucucagccugguaucagggaaauugagacuuauuuuugcccuaaaacg

SEQ ID NO: 146670 - RNA, 64 nt, Human
caaguguagggguagagauggaaggaugagaggugaaauugaccuuuugaaagcaaagcucugg

SEQ ID NO: 146671 - RNA, 64 nt, Human
ccaaccaucacugccauuacacucacauucaauggaaauugauuaggccugagagaaggagcaa

SEQ ID NO: 146672 - RNA, 64 nt, Human
agcccaaagucagugagaugaaacccaacaucaagaaauugaagcaaaguuacuuauggauaaa

SEQ ID NO: 146673 - RNA, 64 nt, Human
gacuugauuuacacaauagucagaaaacauuuuagaaauugaugacuuuauaaugcaaccagga

SEQ ID NO: 146674 - RNA, 64 nt, Human
gccacacaugaagaaauggucauucuacuucaaagaaauugagccagcacuaucuguacuccaa

SEQ ID NO: 146675 - RNA, 64 nt, Human
ucaguuugauacucaaggaaaggggguuauucaagaaauugaaaauuucaucuuggaccucagu

SEQ ID NO: 146676 - RNA, 64 nt, Human
cccaaccacggaagacuacuuuaaaugaaaaaaagaaauugaauaauaaaaucaggagucaaaa

SEQ ID NO: 146677 - RNA, 64 nt, Human
uccagcuuuuuauauacuauauuucauuuaugaagaaauugauuuucuuuugggagucacuuuu

SEQ ID NO: 146678 - RNA, 64 nt, Human
guauauuuugaauuguguguaugaccucagaacugaaauugauaaugaaguugcaaguuuugau

SEQ ID NO: 146679 - RNA, 64 nt, Human
auguagacaacauuauauuuuauagaauuuguuugaaauugaggaagcaguuaaauugugcgcu

SEQ ID NO: 146680 - RNA, 64 nt, Human
gaguggacucaguguugauucucuaucgugaugcgaaauugaugccugcugcucuacagaaaau

SEQ ID NO: 146681 - RNA, 64 nt, Human
aagccaauaggcugagacauccaauugcugcauggaaauugauguacauucaggggacggcaaa

SEQ ID NO: 146682 - RNA, 64 nt, Human
uucucaaacuuuuuggucucagaccccacucuuagaaauugaggaucucaaagagcuuugcuua

SEQ ID NO: 146683 - RNA, 64 nt, Human
cccugagaacugccugccgaaugaccugaaggcugaaauugacaaguuggccacugaguauaug

SEQ ID NO: 146684 - RNA, 64 nt, Human
uaagcguaauuuugccaaauaauaaaaacagaaggaaauugagauuagagggagguguuuaaag

SEQ ID NO: 146685 - RNA, 64 nt, Human
uuuagagagcuuggccaacuguaaucuuaaccaagaaauugaagggagaggcugugauuucugu

SEQ ID NO: 146686 - RNA, 64 nt, Human
acaauggaguuuauucucugccuaaaaaguggaagaaauugagugaaugacaauuuuguaauuu

SEQ ID NO: 146687 - RNA, 64 nt, Human
acaauccaccauugucauuuaaguaauaagacaggaaauugaccuugacgcuuucuuguuaaau

SEQ ID NO: 146688 - RNA, 64 nt, Human
aucauuccuaguacauuugcuaacacuuuauugagaaauugaccaugaauuaauggacucaucu

SEQ ID NO: 146689 - RNA, 64 nt, Human
uuagauuacagaguaugcaugacuguaagaaaaagaaauugagaggaagugaucauagcaaauu

SEQ ID NO: 146690 - RNA, 64 nt, Human
uuacucagcuuaccuuuuugagaaacgauuguuagaaauugacgauguguuuguuccagugaua

SEQ ID NO: 146691 - RNA, 64 nt, Human
uuagaaaggguucagggcauggggagaggagugggaaauugauuaaaggggcugucucccaaug

SEQ ID NO: 146692 - RNA, 64 nt, Human
acaagaaacuuuauauucguaaaaaaaaaaagaggaaauugaauugguuucuacuuuuuuauug

SEQ ID NO: 146693 - RNA, 64 nt, Human
cuugacagucaccuugaaggauuucgcaaguccagaaauugaggacucuggauuuuugucaacu

SEQ ID NO: 146694 - RNA, 64 nt, Human
uugacacaaugcugcacgugucuggucacacuuagaaauugagcucuuacucucuucuguaaua

SEQ ID NO: 146695 - RNA, 64 nt, Human
ugaaaggaaauguuugaguuuucaaagaucccgugaaauugaugccaguggaauacagugaguc

SEQ ID NO: 146696 - RNA, 64 nt, Human
acaccaaagcucugaguuccauuuuacagcugaagaaauugaagcuuagagaaauuaagaagcu

SEQ ID NO: 146697 - RNA, 64 nt, Human
cagagagucuguggaugcagaggaaguugugagagaaauugauaagcuuuugcaagacugccgg

SEQ ID NO: 146698 - RNA, 64 nt, Human
agaagacaaauuagugaagaaaagacggaguuucgaaauugaauggcagggugguuuuugcuua

SEQ ID NO: 146699 - RNA, 64 nt, Human
uuauguaaacucuauuuuguuuuuggcaagaagugaaauugagacuuaugugcagguugccauu

SEQ ID NO: 146700 - RNA, 64 nt, Human
ugacauaagcugucuggccucucugugacaugaugaaauugaaaucaauccacaguccaugaaa

SEQ ID NO: 146701 - RNA, 64 nt, Human
gggagguugaggcagcaggauugcuggagcccaggaaauugaggcugcagugagccaugauuga

SEQ ID NO: 146702 - RNA, 64 nt, Human
ucagagccagcuaagagaaaagaaauauuuggaggaaauugaaaguguggaaaaaaagaaugau

SEQ ID NO: 146703 - RNA, 64 nt, Human
uuuauagauuucagguauauuuauauguguaaaagaaauugacaaagaaauauuucaucuggcc

SEQ ID NO: 146704 - RNA, 64 nt, Human
aacacugaaaaguacacuuucuacuaaagaugcagaaauugaugaucuuggaauucaucauaac

SEQ ID NO: 146705 - RNA, 64 nt, Human
aacaaaugcauaaaugcaaauguaaaguaaagcugaaauugaucucaaaguuacugucuuggag

SEQ ID NO: 146706 - RNA, 64 nt, Human
ugugaauucuuuugagaaaguaugaaguuuugcagaaauugacugugaaaugucagagaaaaau

SEQ ID NO: 146707 - RNA, 64 nt, Human
uguuugugcacugcuguugugaggaucagcauaugaaauugacaucaugguuagucaugguacu

SEQ ID NO: 146708 - RNA, 64 nt, Human
auggggagguuugcuuucuaaacaagugcauucugaaauugacuuaaaaauuuuuagugugggu

SEQ ID NO: 146709 - RNA, 64 nt, Human; identical to SEQ ID NO: 146702

SEQ ID NO: 146710 - RNA, 64 nt, Human
auuuauucccuucuguuuuaaaggagguauuuuggaaauugaaaaacuuaauuuacaagugcug

SEQ ID NO: 146711 - RNA, 64 nt, Human
aauaagaaagacaaacacuaaacaauacaaccaugaaauugaucaccgggauugcaaaucuaau

SEQ ID NO: 146712 - RNA, 64 nt, Human
ucuaggcagguggagagagugguaaaaaagaaaugaaauugacaagcuaggaaagaggaggcag

SEQ ID NO: 146713 - RNA, 64 nt, Human
aagauguauuucagcccaugcccccucccaaaaagaaauugauaaguaaaagcuucguuauaca

SEQ ID NO: 146714 - RNA, 64 nt, Human
uaaaaaaaaaacugcugaaaaucugugcuauuuugaaauugauuuggcuuuuugugccuaaugg

SEQ ID NO: 146715 - RNA, 64 nt, Human
uuuuggcagaugagcuuucagcugaggccugauggaaauugagauaaccugcaaagacauaaca

SEQ ID NO: 146716 - RNA, 64 nt, Human
gggccuccaucccucuuacucauuuguagucuaggaaauugagauuuugauacaccuaagguca

SEQ ID NO: 146717 - RNA, 64 nt, Human
ucucaguuuucugcauuaaauggaagggagacaugaaauugauaaucucaaacuuaauucauau

SEQ ID NO: 146718 - RNA, 64 nt, Human
uuguacauacuugcagauuuaacaaaauuuuagggaaauugaaaaagacauguagaauuuguug

SEQ ID NO: 146719 - RNA, 64 nt, Human
caccuuuauuagauaaaucaugaagugucccugugaaauugaagugaaacuaucucuguaggac

SEQ ID NO: 146720 - RNA, 64 nt, Human
ggccuuggaauuuucauuuugaugcagaaauuuugaaauugaaaaugugcauguuuuggugcac

SEQ ID NO: 146721 - RNA, 64 nt, Human
acgggaacgcuuacagagagagagagagcgccuagaaauugaaaggcaaaaacuagagagagag

SEQ ID NO: 146722 - RNA, 64 nt, Human
caucaaaggauguacuaaguuguggauuauuugugaaauugaauuacaaccuuuuccuuaaggu

SEQ ID NO: 146723 - RNA, 64 nt, Human
gggaaugacuugggcggccuugggaaaucgaugagaaauugaacuucagggaggguggucauug

SEQ ID NO: 146724 - RNA, 64 nt, Human
ccaggcuccuccucgccccggccuccgggucugggaaauugaggggacggcaggcccggcugcc

SEQ ID NO: 146725 - RNA, 64 nt, Human
agcaccaguucccucuucauucuugaagcagggagaaauugaccuuugccuugucgcccaggaa

SEQ ID NO: 146726 - RNA, 64 nt, Human
gguuguuuggaaaaucacaucaugccuagaaucugaaauugaauuagcaagaaccgacuguuug

SEQ ID NO: 146727 - RNA, 64 nt, Human
auaaccuacaaacaaccucuucaaaguacccuuggaaauugaaguucaaucuuaaguuuuuugc

SEQ ID NO: 146728 - RNA, 64 nt, Human
cuagcacgugcccaguugcucagugcugcuaguagaaauugauuugcauaguccaauggaugug

SEQ ID NO: 146729 - RNA, 64 nt, Human
cuuuuuagaaaggacccauauguuaucaaacuuugaaauugaguugcuggaaugaaguagaggu

SEQ ID NO: 146730 - RNA, 64 nt, Human
caggucuuauaauuucagauguuguuuuuuaagggaaauugaccauuucacuagaggaguugug

SEQ ID NO: 146731 - RNA, 64 nt, Human
aggguguauuaggaauaacgcucaaaauccuaaggaaauugaauacucugagagaagagagaca

SEQ ID NO: 146732 - RNA, 64 nt, Human
guuuuucuugcccuuucaggaacuucacccugaugaaauugacaccgacucugccuacauucuu

SEQ ID NO: 146733 - RNA, 64 nt, Human
gaugacuccaaagggguucauuucacuauagggagaaauugauucgucugacuuccuauuuauc

SEQ ID NO: 146734 - RNA, 64 nt, Human
uggggagggaaaauuggaaugguucccuuuuuuagaaauugaaguggucuucauaugucaacua

SEQ ID NO: 146735 - RNA, 64 nt, Human
cuucauaugucaacuacagaaaaggaaaaaaauagaaauugaaggauuuuuaugaaauuauauu

SEQ ID NO: 146736 - RNA, 64 nt, Human
ugcacuacugaaauuuacacaaaaagaaagcugugaaauugaagucccaauuuaagaguccuga

SEQ ID NO: 146737 - RNA, 64 nt, Human
guaagucaaaugugugcuuuguacugcuguuguugaaauugauguuacuguauauaacuaugga

SEQ ID NO: 146738 - RNA, 64 nt, Human
cuuuaaucuuaguuuaugcaucauauuucauuuugaaauugauuucuauuguugagcugcauua

SEQ ID NO: 146739 - RNA, 64 nt, Human
gaagcccaugucuucugcuguucuucacuucugggaaauugaagugucuucuguucccaaggaa

SEQ ID NO: 146740 - RNA, 64 nt, Human
gggccauuuuaugaugcauugcacacccucuggggaaauugaucuuuaaauuuugagacaguau

SEQ ID NO: 146741 - RNA, 64 nt, Human
gagccgucagccagaucccaaaugagugccuuccgaaauugacccaccugggagcuauuuacaa

SEQ ID NO: 146742 - RNA, 64 nt, Human
gcaccgacuucaauuucccacccaucuccaguaggaaauugauuuugaaaaaguaggcugccgc

SEQ ID NO: 146743 - RNA, 64 nt, Human
gaucuuggaacugaaacgcacagccagugcucuggaaauugagcuccaagcacagcaaagccug

SEQ ID NO: 146744 - RNA, 64 nt, Human
uucauaaguuaccaaaguugccauuuuggagauggaaauugacgaggagggaaggucuuuuauu

SEQ ID NO: 146745 - RNA, 64 nt, Human
ugggugggguggggagggaaucacuggugcuauagaaauugagaugcccccccaggccagcaaa

SEQ ID NO: 146746 - RNA, 64 nt, Human
uucuaaagaacaggaaguaggaaauuuugaugaagaaauugauacaacaaugagauggaaacuc

SEQ ID NO: 146747 - RNA, 64 nt, Human
ugaguuucccagccugcucccccauccacacuuggaaauugagggagcaugaccgcucucugac

SEQ ID NO: 146748 - RNA, 64 nt, Human
uagucauggaugcuuuuauuuuccuuggggugcugaaauugagcugaaaaaaaaaggcucuuug

SEQ ID NO: 146749 - RNA, 64 nt, Human
aggagauuagaaaucuuuggaaaacauaugugaugaaauugagcuauaugauuuaucagagauc

SEQ ID NO: 146750 - RNA, 64 nt, Human
cugauauacagagacuagcaccuugaauaugccagaaauugaauuaccaucuguauuagaacuu

SEQ ID NO: 146751 - RNA, 50 nt, Human
ugaauguugugaaaguuuaagaaauugaaaaaaaaaaaagaaucagcacu

SEQ ID NO: 146752 - RNA, 64 nt, Human
cuuucgaccgacuuuccccaagagaaaauuccuagaaauugaacaaaaauguuuccacuggcuu

SEQ ID NO: 146753 - RNA, 64 nt, Human
aacucugcuuagcugcuaauaauccugaggcauagaaauugaagaauuuguaaaaauagaauug

SEQ ID NO: 146754 - RNA, 64 nt, Human
uaaaaacagaaauuacccaguaaaaaggaugucagaaauugacauacaaauauuuacaauuuuu

SEQ ID NO: 146755 - RNA, 64 nt, Human
acacggauggaagguggagcaaaggaaaauacaugaaauugagaguggcagcugccugccaaaa

SEQ ID NO: 146756 - RNA, 64 nt, Human
cuugacauuucaaagacugccuugaaaggucgcagaaauugauuucuauuuuuaauuucaguua

SEQ ID NO: 146757 - RNA, 64 nt, Human
acaggagaaaaguuguaugaauguggaaacuuuagaaauugaaggaauuuuucaguuccaagug

SEQ ID NO: 146758 - RNA, 64 nt, Human
uaacuagagacaggcaaacugcaaaccauggugagaaauugacgacuucacacuauggacagcu

SEQ ID NO: 146759 - RNA, 64 nt, Human
ggugucuccacuuuggccauaugacgguaucuaagaaauugaaaauacauacaugcuugucuca

SEQ ID NO: 146760 - RNA, 64 nt, Human
aaaaaaaaaucacuaauguuuaacugaagaaagagaaauugaauaauauaguucuauuucaaca

SEQ ID NO: 146761 - RNA, 64 nt, Human
uuauuuacaaaacagucuuguucagauuuuuacagaaauugaguuaagucuguggauuaaucug

SEQ ID NO: 146762 - RNA, 64 nt, Human
uagaucaucauuugucaucuaaacaauuauguuagaaauugacacagccaagagucuuauucua

SEQ ID NO: 146763 - RNA, 64 nt, Human
uagaugaucauuugucgucuaaacaaucaaguuagaaauugaaccagccuggagucuuauucuc

SEQ ID NO: 146764 - RNA, 64 nt, Human
gacuuacccaguccggcaucggacuugaaaaaucgaaauugacaucacucagcuguuacauuuc

SEQ ID NO: 146765 - RNA, 64 nt, Human
uuauaccuauuuauguauuuauuuauugaagugugaaauugagcaauaggcaggcaccaccguc

SEQ ID NO: 146766 - RNA, 64 nt, Human
cacugcaccuagccucuauuuguuuuacaaaagagaaauugagauccugaauguuaagugacuu

SEQ ID NO: 146767 - RNA, 64 nt, Human
uauaugguagucacuagcaaccuguugagcacuugaaauugaguuauugagcacugaaaugugg

SEQ ID NO: 146768 - RNA, 64 nt, Human
uguugaaauugucaccccacagcugcccgccguggaaauugaggaagggcggcuggagaugaua

SEQ ID NO: 146769 - RNA, 64 nt, Human
ccaggccaguuaacucuggggacugggaacccaugaaauugacccccaaauacauccugcggaa

SEQ ID NO: 146770 - RNA, 64 nt, Human
gugcuggguuugaauccuggcggagaccuggggggaaauugagggagggucuggauaccuuuag

SEQ ID NO: 146771 - RNA, 64 nt, Human
uuagcaaagagugaugaaaaauugaucuuguuuugaaauugaagagagaggccaggcgcggugg

SEQ ID NO: 146772 - RNA, 64 nt, Human
gcugcauuuuuauaaacaaaauuacagacugucugaaauugaagaagaaugaacuaauaauagc

SEQ ID NO: 146773 - RNA, 64 nt, Human
gcccagccugcuuauugaagauacauuucuaguggaaauugaugaaacaauuuagguuuuggaa

SEQ ID NO: 146774 - RNA, 64 nt, Human
ucauguggaaauggaaguagccucuuuuuguucugaaauugaguuuauucaaaguguaaaagca

SEQ ID NO: 146775 - RNA, 64 nt, Human
gauaagaaccacagaacacuggguaguagcuaaugaaauugagaagggaaaucuuagcaugccu

SEQ ID NO: 146776 - RNA, 64 nt, Human
aauuagcugcuacuguauguugauucuuuucggagaaauugaaauaagcucuuugcaggcgucc

SEQ ID NO: 146777 - RNA, 64 nt, Human
aaucaugucuuucugaaauguguauuugagauuagaaauugagguugagaggaacucaggagau

SEQ ID NO: 146778 - RNA, 64 nt, Human
gacuccuggaaguucuuauauauuucaccaguaagaaauugauugguaucuuugauggcuacuu

SEQ ID NO: 146779 - RNA, 64 nt, Human
uguagaaaugagacaaggguacaaauuggaacuagaaauugacauugucauugacaaacauggc

SEQ ID NO: 146780 - RNA, 64 nt, Human
cagugaauaggucuuaggccagugcacacaggaagaaauugaggcuuauggauggggaugacuu

SEQ ID NO: 146781 - RNA, 64 nt, Human
uuuaaauccugaagaaauugagaaguauguugcugaaauugaaaaagaaaaagaagaaaacgaa

SEQ ID NO: 146782 - RNA, 64 nt, Human
augaaguuuuuuucuauagauuuuaaauccugaagaaauugagaaguauguugcugaaauugaa

SEQ ID NO: 146783 - RNA, 64 nt, Human
aauaucuaccugcaaugguuuacaggcagacaaugaaauugaucuuuugacugugccaccuuuu

SEQ ID NO: 146784 - RNA, 64 nt, Human
gccugugauuccagucacccuguaguuacugacagaaauugacuggacugucauugugugaagu

SEQ ID NO: 146785 - RNA, 64 nt, Human
uuaccuuucuucaguggacugaauuguauggaaggaaauugaucagaucuguaauucacaacug

SEQ ID NO: 146786 - RNA, 64 nt, Human
uccagugacugcuuucaaucucgguuuacguuuagaaauugaguucuacugaguagggcuuccu

SEQ ID NO: 146787 - RNA, 64 nt, Human
gauuaaaaugaaggcuuuaaucagcauuguaaaggaaauugaauggcuuucugauaugcuguuu

SEQ ID NO: 146788 - RNA, 64 nt, Human
uguuugcauuaaaugcuuugauuguucauaucaagaaauugauugaacguucucaaacccuguu

SEQ ID NO: 146789 - RNA, 64 nt, Human
accauguuggccucuucaggccugcuagucacuggaaauugagguccaugggggaaaucaagga

SEQ ID NO: 146790 - RNA, 64 nt, Human
agaccaugaccuguagguucaccuauaaaacagggaaauugaauaaccaucuaccccauuaguc

SEQ ID NO: 146791 - RNA, 64 nt, Human
uugggaggccaaggcagguagaucacaaggucaggaaauugagaccauccuggcuaauacagug

SEQ ID NO: 146792 - RNA, 64 nt, Human
ugcauucagacaccccgcaaagcaggacucuguggaaauugacacgugccaccgccuggcguuc

SEQ ID NO: 146793 - RNA, 64 nt, Human
uagagauuccugccccucuuuugucacagauuaggaaauugagaacuaggguuaaccuugacua

SEQ ID NO: 146794 - RNA, 64 nt, Human
uaggcugugguuaguggccauugucccaugccuugaaauugacccagaacccacuuuccacuga

SEQ ID NO: 146795 - RNA, 64 nt, Human
cuggcucucauuauuuuuauguuaaaacuuugaagaaauugaacaugaccuguugaagaaauug

SEQ ID NO: 146796 - RNA, 64 nt, Human
aaugcuugguuggaagacugugacaauagcucaugaaauugaguguuauuuuuuucuuucuuuu

SEQ ID NO: 146797 - RNA, 64 nt, Human
uucucuguuuauauccuacacucccucccucccugaaauugauuguuaguccuccugacucugu

SEQ ID NO: 146798 - RNA, 64 nt, Human
guuacugaaaaauaaccauuuuagugucaggcuagaaauugaauugcugaguuuuguguauccu

SEQ ID NO: 146799 - RNA, 64 nt, Human
ugaaaauaaacugcuagaauaaagaaaugcuggagaaauugauuauaagagacuauagcuauuu

SEQ ID NO: 146800 - RNA, 64 nt, Human
ugauuagagugauagaacauaccaauguuaccaagaaauugacaagcugcuggcuuuaagcuua

SEQ ID NO: 146801 - RNA, 64 nt, Human
aucuacuuagacuuuuuaaaugccugccauaaaugaaauugaaaugguagaauggcugaccaca

SEQ ID NO: 146802 - RNA, 64 nt, Human
acuugcuuuaguuguuaaguuuuauaaaagacaugaaauugagucauuuuauauaugaaaacua

SEQ ID NO: 146803 - RNA, 64 nt, Human
cuuaaacuaaaggcuaagaauauaggcuugaugggaaauugaagguaggcugaguauugggaau

SEQ ID NO: 146804 - RNA, 64 nt, Human
ugugugugaccugacugugaugauggaaguguaagaaauugaagaguucuaaggcuuucaaaaa

SEQ ID NO: 146805 - RNA, 64 nt, Human
aacagaggcaucagccugcuguugaucacagagagaaauugaguagaaagaccaaaagaaugug

SEQ ID NO: 146806 - RNA, 64 nt, Human
ggggugguuacauagaccagcagcuacagcucuggaaauugaaaucauaaucugucaaugaaua

SEQ ID NO: 146807 - RNA, 64 nt, Human
acaaacaguucuuuuacagugguuauauggaaaagaaauugauugcuauuuuggggggcuggag

SEQ ID NO: 146808 - RNA, 64 nt, Human
auaaauugaaaauauuuuaauguguuguauuuuugaaauugaaaacacuguaaaauagauugau

SEQ ID NO: 146809 - RNA, 64 nt, Human
uauguaccugaauuugcuuggcuucuuugagaaugaaauugaauuaaauaugaauaaauaaguc

SEQ ID NO: 146810 - RNA, 64 nt, Human
uagcaguauugaauuuguaagcuuaguaguugcagaaauugaacacuagguggcacucaguuau

SEQ ID NO: 146811 - RNA, 64 nt, Human
aaggucccagagauauauagacacuggaguacuggaaauugaaaaacgaaaaucguguguguuu

SEQ ID NO: 146812 - RNA, 64 nt, Human
auuuauuguguacuauucauugauucagugaugugaaauugagcccccaaaagguuguuucuga

SEQ ID NO: 146813 - RNA, 64 nt, Human
uuaggaagaguugggaguugccaagaguaaccaugaaauugaacgaaaggaugagguucauggg

SEQ ID NO: 146814 - RNA, 64 nt, Human
aacaccaaaaaauaucuaguaauauauuuaaagggaaauugagcugcuuuuuuugaaacuuuga

SEQ ID NO: 146815 - RNA, 64 nt, Human
cuuuaacuuaguuuugcauaguucuagugcagcugaaauugaaaaguuauuucccuuuagcugu

SEQ ID NO: 146816 - RNA, 64 nt, Human
gaaaagugagaugaugguaguacugguuucuggugaaauugaagaaccccaaaugaugaggauc

SEQ ID NO: 146817 - RNA, 64 nt, Human
uuuaugggucagcaugaccauuaauuacugaguagaaauugacuaaacuuugauuuccuuuuuu

SEQ ID NO: 146818 - RNA, 64 nt, Human
aauuaacauguucugaagguuacaauugauauuugaaauugacuguagagcauuuaguugaaga

SEQ ID NO: 146819 - RNA, 64 nt, Human
caagagaaauuuggccagauggggaaggucacuggaaauugaggccaaagggcugaucagaauu

SEQ ID NO: 146820 - RNA, 64 nt, Human
ucuggucaaguuauugugcuguacuuugugcguagaaauugaguuguauugucaaccccaguca

SEQ ID NO: 146821 - RNA, 64 nt, Human
acauuuaccaguguucuuguuuguguggugccaggaaauugauuuuggaaaaagugaaauaaca

SEQ ID NO: 146822 - RNA, 64 nt, Human
uuuagaauucccaagaaggcuuuauuacaccucagaaauugaaagcaccaugacuuuguccauu

SEQ ID NO: 146823 - RNA, 64 nt, Human; identical to SEQ ID NO: 146822

SEQ ID NO: 146824 - RNA, 64 nt, Human
aguguguuucuaaauggccuuacacuugguagaagaaauugaaggguuacucaaauacaguugc

SEQ ID NO: 146825 - RNA, 60 nt, Human
agacauuccagagagccugauccacauccagcagcagagcccacuuguggcugcagcuuu

SEQ ID NO: 146826 - RNA, 64 nt, Human
gcagccuuucauccggcagagccuuccugcguuugcagcagagaggaggccccacagcuugccc

SEQ ID NO: 146827 - RNA, 64 nt, Human
ugcagguggcaaaauggcacugaauauccccuuggcagcagagaaaacccacugaaagaucgua

SEQ ID NO: 146828 - RNA, 64 nt, Human
guuguuuacauuucuugaaaaaauaggaacucgggcagcagaaucagauuggcagaaucuuuag

SEQ ID NO: 146829 - RNA, 64 nt, Human
uugggcccagaucuuuaaaccuuugugucguguugcagcagagugacgauggggguuggggggu

SEQ ID NO: 146830 - RNA, 64 nt, Human
ucauuuaucuccuauaauuggcaaacuuaaaaaugcagcagaaacuuacauuccaaccuuagag

SEQ ID NO: 146831 - RNA, 64 nt, Human
cuuacaggaagaccgucucuuucgaaugaaucaagcagcagaauuguacuugauucaaauuauu

SEQ ID NO: 146832 - RNA, 64 nt, Human
agaccacagacucaagauuggcucuucccagagggcagcagacagucaccccaaggcaggugua

SEQ ID NO: 146833 - RNA, 64 nt, Human
gauacugauuaugaaauguccccucaaacucauugcagcagauaacuuuuuugagucauugacu

SEQ ID NO: 146834 - RNA, 64 nt, Human
augcggcuauagcagauggccauggcagucaguggcagcagaaagaggcagcagaaggugaaga

SEQ ID NO: 146835 - RNA, 64 nt, Human; identical to SEQ ID NO: 84557

SEQ ID NO: 146836 - RNA, 64 nt, Human
agauggccauggcagucaguggcagcagaaagaggcagcagaaggugaagagguuauagguggu

SEQ ID NO: 146837 - RNA, 64 nt, Human
caccagcagaacaaacucagaucucaucaggguagcagcagaggcaggaccagaaggcaaucaa

SEQ ID NO: 146838 - RNA, 64 nt, Human
caucucuuugcagguagcagcaacaguuguagcagcagcagacgaagccauugcagaggcagaa

SEQ ID NO: 146839 - RNA, 64 nt, Human
aacguucccuugcagauggagacugaaucugagggcagcagacuuuuaucagcuugaguuuaug

SEQ ID NO: 146840 - RNA, 64 nt, Human
ucuauuuauuugugagacuguaaguuacaugaaggcagcagaauauugugccccaugcuucuuu

SEQ ID NO: 146841 - RNA, 64 nt, Human
gagagcugucuuccuguguaccucuagaaucccagcagcagagaaccaucaaggcgggagggcc

SEQ ID NO: 146842 - RNA, 64 nt, Human
gcuguuccccucgggaacaugagguggugguggcgcagcagacugcgaucaauucugcaugguc

SEQ ID NO: 146843 - RNA, 64 nt, Human
ccaguuaaagccacagauggcuuucagggcaguagcagcagaggccaguggacucugaggacuc

SEQ ID NO: 146844 - RNA, 64 nt, Human
cauuuucgugaguagaaggaaagauaagaaugaggcagcagauuuucccuccuggaauuacaca

SEQ ID NO: 146845 - RNA, 64 nt, Human
agaauuuuauuugucccacuuuuacuaaacaguggcagcagauuuuaaguuaaagaauauggaa

SEQ ID NO: 146846 - RNA, 64 nt, Human
acuccaguguugauaauuaaaaugaaaugguaaagcagcagacuguaaggucuuuagagauuuu

SEQ ID NO: 146847 - RNA, 64 nt, Human
agcaauuuacuaauuuauucuucgacuacauacugcagcagaaccagcaauacacuugauuuuu

SEQ ID NO: 146848 - RNA, 64 nt, Human
uggggaaggggguuaguagacuauguggauugcggcagcagaggcugcagccuaacgugugguu

SEQ ID NO: 146849 - RNA, 64 nt, Human
ugcguucugcucugggccgggcccugcuccccuggcagcagaagugggugcaggaagguggcag

SEQ ID NO: 146850 - RNA, 64 nt, Human
ggaaaccuuccuucgaaggguagugccuuggggagcagcagaccugcucugaguccagcuuagc

SEQ ID NO: 146851 - RNA, 64 nt, Human
gcacuugucauggguuuggaagacccagccaucugcagcagaggcagccuaucccauugcaagg

SEQ ID NO: 146852 - RNA, 64 nt, Human
aggaggccugugagcgggagcucgcccugcgccugcagcagacgcagagcuugcauucucuccg

SEQ ID NO: 146853 - RNA, 64 nt, Human
ccaccuaucccaagaccucacuggucuguggacagcagcagaaauguuugcaagauaggccaaa

SEQ ID NO: 146854 - RNA, 64 nt, Human
aauggcgugagcccauaauggauacacagagguugcagcagaugguguggguaccucacccaga

SEQ ID NO: 146855 - RNA, 64 nt, Human
ugagccaagauggcaccauugcacucuagccugggcagcagagcgagacccugucucaaaaaau

SEQ ID NO: 146856 - RNA, 64 nt, Human
gccccaccccauccccgcgguugaggcugugggggcagcagaucaggagcccacugauaagggg

SEQ ID NO: 146857 - RNA, 64 nt, Human
gggcccagcagagccugcucccacccuccucccagcagcagacacccacccucucacugacuaa

SEQ ID NO: 146858 - RNA, 64 nt, Human
uagauggguacaauaaaaagaacaugggcuuucagcagcagacaaaucccacuuccaccacuga

SEQ ID NO: 146859 - RNA, 64 nt, Human
ccaagaguuuucacuagccccaaacuuuuuauuggcagcagauauccuaggagggguguuuggg

SEQ ID NO: 146860 - RNA, 64 nt, Human
uccaaauggacuggccagcguaaaugaccccacugcagcagaaaacaaacacacgaggagcaug

SEQ ID NO: 146861 - RNA, 64 nt, Human
ggcaauauuuuuaacuuggggcaggaagaagggagcagcagagaauugacuagauauagcaccu

SEQ ID NO: 146862 - RNA, 64 nt, Human
gguagcagcaacagcagcagcagcagcagcagcagcagcagagaccucuccacuuucccuuagc

SEQ ID NO: 146863 - RNA, 64 nt, Human
ggagggcugaagacaaggggccggcauucagugggcagcagaaaggagaggcuccuugaagcug

SEQ ID NO: 146864 - RNA, 64 nt, Human
agggaagcagagagcagagcacacacuggcucaagcagcagagguaagaggaagaggcagcagc

SEQ ID NO: 146865 - RNA, 57 nt, Human
cggaccaccucgaccagugacaggccagcagcagagggcggcggaggaaggguuagg

SEQ ID NO: 146866 - RNA, 64 nt, Human
uugacuccaucaacuucaaggggacagagccuaggcagcagauucuccuaauuuuuaacacuaa

SEQ ID NO: 146867 - RNA, 64 nt, Human
uuuaccuuuuuaaaaaucuguuagaagaaaaaaagcagcagacgaaagagaaaaacccuccucu

SEQ ID NO: 146868 - RNA, 64 nt, Human
uuacaugcugaaaaguaauuaucaguucugcacagcagcagaugcaggguuuuuuuuuaaagau

SEQ ID NO: 146869 - RNA, 64 nt, Human
aggccucugccccuggccuuugaggcaaaggccagcagcagauaacaaccccggacaaaucagc

SEQ ID NO: 146870 - RNA, 64 nt, Human
ggaaaaccucaagucagacucaguggcagaacaugcagcagaaaagcugugaaggaaggaaauu

SEQ ID NO: 146871 - RNA, 64 nt, Human
cagggaugccuggggugaucagcuccaaccaguggcagcagagugguggcucuuccuaguuuag

SEQ ID NO: 146872 - RNA, 64 nt, Human
agaugccauccggaucccugugcucuaucucagugcagcagaugaccccuucucccccgucugu

SEQ ID NO: 146873 - RNA, 64 nt, Human
gggcaguuggguuucuggcuugagaugaauccaagcagcagaaugagccaggaguagcaggaga

SEQ ID NO: 146874 - RNA, 64 nt, Human
ccguuaauuuuuuacccuauguuuacaucuugaggcagcagagucugucugcagcuauguggug

SEQ ID NO: 146875 - RNA, 64 nt, Human
cuguuugguaagaauacaucauuagcuuaaauaagcagcagaagguuaguuuuaauuauguagc

SEQ ID NO: 146876 - RNA, 64 nt, Human
gaaggaguuuuuuuuaaccuguuuauauaauuuugcagcagaagccaaauuuuuuguauauuaa

SEQ ID NO: 146877 - RNA, 64 nt, Human
gaaggaagccacacacuggucagucauuucagaggcagcagaugcccagggagacccaagaaag

SEQ ID NO: 146878 - RNA, 64 nt, Human
uggugugcccuuggcuucugggggagagcuuggggcagcagaggccccugggcagcccagccag

SEQ ID NO: 146879 - RNA, 64 nt, Human
aaagccgcugaccccugaugugaaacuuuguagagcagcagaguggcugcgugaaacgggaggc

SEQ ID NO: 146880 - RNA, 64 nt, Human
cucuagccugaacccuggccugggccgagcaguggcagcagagaguggccucggagggaagcca

SEQ ID NO: 146881 - RNA, 64 nt, Human
ggcgccuguaaucccagcuacucaggagguugaggcagcagaauugcuugaacccaggaggcag

SEQ ID NO: 146882 - RNA, 64 nt, Human
ccauuugaaacucguaggggauuugcacacaaaugcagcagagucuggcuccccagugccuugc

SEQ ID NO: 146883 - RNA, 64 nt, Human
acuccauauggaggccucacacccagaggguagggcagcagaucuucuuuauaacuauuuauug

SEQ ID NO: 146884 - RNA, 64 nt, Human
agcgccuccaggcccagcugaggagcugugagaagcagcagaggggacuccccaucccgggcac

SEQ ID NO: 146885 - RNA, 64 nt, Human
ccugcccaguguuucugggccucacggugcuccggcagcagagcgcauggugcuagccauggcc

SEQ ID NO: 146886 - RNA, 64 nt, Human
ugugaaucuuuauaguauuugaaaaugagaagaagcagcagauuguaauuugguuuauuggaug

SEQ ID NO: 146887 - RNA, 64 nt, Human
guucccucccagggcuggagcagaggaccacaaggcagcagaaagcgcggguccagaugagggc

SEQ ID NO: 146888 - RNA, 64 nt, Human
uuguugaaggguucauagcagcccugccaucccugcagcagaaugagagagggugaacagggaa

SEQ ID NO: 146889 - RNA, 64 nt, Human
cauucaaacuucaugcuccugaaaaccauucucugcagcagaauuggcugguuucgcgccugag

SEQ ID NO: 146890 - RNA, 64 nt, Human
cuugugaccggaagagugaccuguuaaaagccacgcagcagacucauggggucucacaaauccg

SEQ ID NO: 146891 - RNA, 64 nt, Human
agguugacacugggaggggcuagaagauuggugggcagcagacuaaagaguuauguuggauagu

SEQ ID NO: 146892 - RNA, 64 nt, Human
ccagagaagagaggcucugaaagaaaggaggggagcagcagaagccacggcagggaggaaagga

SEQ ID NO: 146893 - RNA, 64 nt, Human
agcaugccugggcuuucaccuugaagcauggucagcagcagagagagcaacgggaaggacaaag

SEQ ID NO: 146894 - RNA, 64 nt, Human
uuucaaccccacauguauuccaugcucagcagcagcagcagaaauaguaggauauagaucacaa

SEQ ID NO: 146895 - RNA, 64 nt, Human
cccauucgacgcaaagaagugacacuuucuuaaugcagcagaggggaagcuuagguuuauguug

SEQ ID NO: 146896 - RNA, 64 nt, Human
ucuaugcuuagaguuuuggcaccaaugcuguagggcagcagaaucuauucucaguaaaauaacu

SEQ ID NO: 146897 - RNA, 64 nt, Human
cccugaugaagaaaaaaaucuagcuaugucagaugcagcagaguuuccaaaucagauuccucaa

SEQ ID NO: 146898 - RNA, 64 nt, Human
ggggcugacuguuccauucuagcuuuggcacaaagcagcagaaagggggaaaagccaauagaaa

SEQ ID NO: 146899 - RNA, 64 nt, Human
gccuugguuucccuagcugagccacgcugcccaugcagcagagggcagaaggcuugcacuuggg

SEQ ID NO: 146900 - RNA, 64 nt, Human
guccagaccccacaacuucaggagcucuuucccggcagcagagaucugcaggcugccucuucug

SEQ ID NO: 146901 - RNA, 64 nt, Human
ugacauaagaaauguuuuaaugccuuuugaugaagcagcagauuuuggaacaaucuuuuaacuc

SEQ ID NO: 146902 - RNA, 64 nt, Human
aaaucaaaguggagaguucucucaggucaggucugcagcagagcucgagacagggaucugaaug

SEQ ID NO: 146903 - RNA, 64 nt, Human
acuccccuccaggugaggggggugcugggggucugcagcagaaagaaaggggccugggcagcag

SEQ ID NO: 146904 - RNA, 64 nt, Human
ggcuguguccuuaaaaguuauaguuuucaggaaugcagcagaagacacaagaaaagcauuucag

SEQ ID NO: 146905 - RNA, 64 nt, Human
cauagauuucgaagccacagagucucucccuggagcagcagacuaugggcagcccagugcugcc

SEQ ID NO: 146906 - RNA, 56 nt, Human
ucaaaacccacagagaauaagggaaggcagcagagggucuccaagggcaucacugg

SEQ ID NO: 146907 - RNA, 64 nt, Human
ggguccagugcaguggcuugccacucaaaagaaggcagcagacaaagucgucuuccuucuuucc

SEQ ID NO: 146908 - RNA, 64 nt, Human
aaaccagaacucuugguggaacagaccagccacugcagcagacagaccaggaacacaaugagac

SEQ ID NO: 146909 - RNA, 64 nt, Human
gaaggaauaaacauaacuuaccugagcuaggguugcagcagaaauugaguugcagcuugcccuu

SEQ ID NO: 146910 - RNA, 64 nt, Human
ggcaaagaggagcaagucacaucuuacauggauggcagcagacaaggagagagagcuugugcag

SEQ ID NO: 146911 - RNA, 64 nt, Human
ccccucuuaggacaggcacugcccagcagcaagggcagcagaguugggugcuaagauccugagg

SEQ ID NO: 146912 - RNA, 64 nt, Human
agaagggacuugccuaaagccacccagcaacucagcagcagaaccaagaugggccccaggcucc

SEQ ID NO: 146913 - RNA, 64 nt, Human
uuucccugcauaauuuuaguacuugaauaaguaugcagcagaacuccaacuaucuuuuuuccug

SEQ ID NO: 146914 - RNA, 64 nt, Human
guaaaggcauauuguacucgaaaucugaagaccugcagcagauuuaaauuacaacucuuguuau

SEQ ID NO: 146915 - RNA, 64 nt, Human
ccuaacagcagagcugaaaagucuugaggacaaagcagcagaggucguaaagaauacaaaugcu

SEQ ID NO: 146916 - RNA, 64 nt, Human
ugugagccucauccgugauucugccuucacacacgcagcagagguuucccuugaagugcaagag

SEQ ID NO: 146917 - RNA, 64 nt, Human
uuuuccacuuaaaggagaaaaauauuugggacuagcagcagaggcaguaagagaugugaaccuu

SEQ ID NO: 146918 - RNA, 64 nt, Human
aacaaucaucuguuugacuucuuugguuccucaugcagcagaaggaagacagaaagauagaaau

SEQ ID NO: 146919 - RNA, 64 nt, Human
gcaguacccuggaggggggccuggggcagaggaggcagcagaaaaccaaacauuucacugagaa

SEQ ID NO: 146920 - RNA, 64 nt, Human
uucaggaagacugacugaggccacuuccaggugggcagcagaggcaggccccagugugaccacc

SEQ ID NO: 146921 - RNA, 64 nt, Human
ggugcaguuacugccuguguggccagcuucacaggcagcagauaauuuguggaaauaaacauua

SEQ ID NO: 146922 - RNA, 64 nt, Human
gggggaguggcauggggcaggggcccaguucucagcagcagacacucuguacaguuuuuucaau

SEQ ID NO: 146923 - RNA, 64 nt, Human
cuguggagcagcaggaccuggcccuucugccugggcagcagaauauauauuuuaccuaucagag

SEQ ID NO: 146924 - RNA, 64 nt, Human
uuaaaaucugaguccugauuggcuuaaugauuuugcagcagacaugucuccacauauucucaaa

SEQ ID NO: 146925 - RNA, 64 nt, Human
aguguuguaaauuugcuaaacugauucacuuuuagcagcagacuuugaacugcaguccugccaa

SEQ ID NO: 146926 - RNA, 64 nt, Human
ugaucccugaugacagagccaacuucuacccauugcagcagaccaauguguacacgacuacuua

SEQ ID NO: 146927 - RNA, 64 nt, Human
aaguuaaguuugaauccccuauuuuugcacaggggcagcagauacacacaacaaugagaacuca

SEQ ID NO: 146928 - RNA, 64 nt, Human
gguucuucccggucauccuggggcucugcacagagcagcagagcuagagccaugagacccacag

SEQ ID NO: 146929 - RNA, 64 nt, Human
gaaggcauuguucccuacccucuggcgagugcaugcagcagagaguuagacagcaacuuaccua

SEQ ID NO: 146930 - RNA, 64 nt, Human
cucagaaauuaaucugaaauggcaggcaguaagugcagcagaaucuggcaggacugauauuugu

SEQ ID NO: 146931 - RNA, 64 nt, Human
cagaguaaugggaagaaccucccacaucucccuggcagcagaugagguggcuucacaugcacuu

SEQ ID NO: 146932 - RNA, 64 nt, Human
guaggauucugcagccuguguugcucucuaccuggcagcagacugugcaggagccccaaccugu

SEQ ID NO: 146933 - RNA, 64 nt, Human
ucaucagaaacaugguuaaaguuuaaaacuagaagcagcagaaaacuagcuuguaaaauuuauc

SEQ ID NO: 146934 - RNA, 64 nt, Human
auguacacuggacaugaaaacaaagacugguuuagcagcagacauugguuuacucugcagccug

SEQ ID NO: 146935 - RNA, 64 nt, Human
aagagggaauguuugacagucacagaagguuccugcagcagaugccucuuuuagccauuucuca

SEQ ID NO: 146936 - RNA, 64 nt, Human
gcuuuuguaaccgcguuaaccugacaaaaccucagcagcagaagucccuauuuuucuaggaguu

SEQ ID NO: 146937 - RNA, 64 nt, Human
cguuugauccaguugaguugaaaggguugccuuggcagcagaggcuccucugauggcugacauc

SEQ ID NO: 146938 - RNA, 64 nt, Human
gcaccccauccaacuggcccgaaagcccagaccugcagcagaacucuccaacucucuaucagcu

SEQ ID NO: 146939 - RNA, 64 nt, Human
ugagccuagaucaugccacugcacuccaaccugggcagcagagcaagacucugucucaaaaggg

SEQ ID NO: 146940 - RNA, 64 nt, Human
gcccuuuuaaauauaaggaucagugcuuuguucugcagcagaguuugcugauaaaugucuguug

SEQ ID NO: 146941 - RNA, 64 nt, Human
uaaggcucagcugcuuuauaguucucuggcuaaugcagcagauacucuuccugccagugguaau

SEQ ID NO: 146942 - RNA, 64 nt, Human
uaguuagacucuuuagaauacuccaagaguuagggcagcagaguggagcgauuuagaaagaaca

SEQ ID NO: 146943 - RNA, 64 nt, Human
cccaccccucugagucgucuuugcucauggacuugcagcagagccacguaguuuggcauuuuga

SEQ ID NO: 146944 - RNA, 64 nt, Human
uccgagaacaacaguugggcugucaacauucaaagcagcagagagggaacuuugcacuauuggg

SEQ ID NO: 146945 - RNA, 64 nt, Human
gucguaagccacuaaaucacaguaauuuguuauagcagcagauagaaaacuaauauacucccuu

SEQ ID NO: 146946 - RNA, 64 nt, Human
cgcgguuugcuauuuucauuuccuguucgucaaagcagcagaggagaucaaaccccguucgugu

SEQ ID NO: 146947 - RNA, 64 nt, Human
caaacauuuuugugggagcucccuucgcuguugugcagcagaaacagauucucaguucauuuuu

SEQ ID NO: 146948 - RNA, 64 nt, Human
gcugcauguguccgcccccgauggaggacuccaggcagcagacacaugccagggccaugucaga

SEQ ID NO: 146949 - RNA, 64 nt, Human
uucuaauaacugcaguguuucccgccuugggcuugcagcagaaaaaccugacaacauaguguuu

SEQ ID NO: 146950 - RNA, 64 nt, Human
ccuuugaagcuaauggcauuuguauauacacacugcagcagagcuuguagcuggacagagucaa

SEQ ID NO: 146951 - RNA, 64 nt, Human
uuggggcagcuuuuaguaucgaugccacucaucugcagcagaagagaaagaaguccucuugggg

SEQ ID NO: 146952 - RNA, 64 nt, Human
guaugucucaccaggaaauucuguuuauguucuugcagcagagagaaauaaaacuccuugaaac

SEQ ID NO: 146953 - RNA, 53 nt, Human
guggagcuaagcagccuuagauagcagcagaaggcuuuuuggauucuccuccu

SEQ ID NO: 146954 - RNA, 64 nt, Human
aucugggcaaaugaaaauguuucaggaaguuucugcagcagaugcuuuugguccagguacugag

SEQ ID NO: 146955 - RNA, 64 nt, Human
ccagccugugaccuuugggaccaacuccaccuacgcagcagacaaggcggugagccuggggguc

SEQ ID NO: 146956 - RNA, 64 nt, Human
caugcucuuauagugaggcacaucucacuguuuugcagcagaauuugaauugugcaacuccugu

SEQ ID NO: 146957 - RNA, 64 nt, Human
ugugaaaugcccgccaguguuacagcuuucuguugcagcagauaaaugccauguugggcaacua

SEQ ID NO: 146958 - RNA, 64 nt, Human
caucccuggccccaaggcuaggaucaaaguggcugcagcagaguuagcugucuagcgccuagca

SEQ ID NO: 146959 - RNA, 64 nt, Human
cauucuucuggugcuacuccaugcaggggucagugcagcagaggacagucuggagaagguauua

SEQ ID NO: 146960 - RNA, 64 nt, Human
cauuaccacgccuugaccuucccaagguuacucagcagcagagagcccugggugacuucaggug

SEQ ID NO: 146961 - RNA, 64 nt, Human
cuggcagagagugagaucucccucucugagaggagcagcagaugcucacagaccacacucagcu

SEQ ID NO: 146962 - RNA, 52 nt, Human
ucucuccaguccccaugugagagcagcagaggcggucuucaacauccugcca

SEQ ID NO: 146963 - RNA, 64 nt, Human
auuucauuagccaugcaacauggauauguauugggcagcagacuguguuucgugaacugcagug

SEQ ID NO: 146964 - RNA, 64 nt, Human
cuccuuaauguauccugagguaaguuuccuacuggcagcagauuuuguaagaauuacuuuuaag

SEQ ID NO: 146965 - RNA, 64 nt, Human
agcagaacuuguggcagcaacaggaguugucaaggcagcagaaaggagucacccagccaaagga

SEQ ID NO: 146966 - RNA, 64 nt, Human
cccagggaagguggggcccugccccuaggaugcugcagcagagugagcaagggggcccaaaucg

SEQ ID NO: 146967 - RNA, 64 nt, Human
gccgcgcuccuccccuccuagaguucguggaggcgcagcagagggccgucccucuuccggaugu

SEQ ID NO: 146968 - RNA, 64 nt, Human
auucuggagccgagaaggagaacaccucuguccugcagcagaaccccuccuugucggguagccg

SEQ ID NO: 146969 - RNA, 64 nt, Human
agaggcuuagcucgccucuuuaggguccaugguggcagcagagaggcagaagugggaguccaga

SEQ ID NO: 146970 - RNA, 64 nt, Human
uucuccaugaaggauuuucauuucagugaaagucgcagcagaagagggaacuuucuggaguuuu

SEQ ID NO: 146971 - RNA, 64 nt, Human
acaagaaaagagcacaggcugcaccaaagcaggggcagcagagaauaaaauaucccuuugaacu

SEQ ID NO: 146972 - RNA, 64 nt, Human
gcccuuuccagugcuuucggccaugauccggggagcagcagauggcucucgguuccaggugugg

SEQ ID NO: 146973 - RNA, 64 nt, Human
gccaagaugcauggccaaaaaacuaaguaucaaagcagcagaagguuuuugauuauaguaacug

SEQ ID NO: 146974 - RNA, 64 nt, Human
ugacucaauaugucagguuuaacucugcccaaaagcagcagacauguaagcagaugugcaauaa

SEQ ID NO: 146975 - RNA, 64 nt, Human
aaugcaaaaaacaacuagaggucaucagaagucagcagcagaaacgacaaggcacuucaugauu

SEQ ID NO: 146976 - RNA, 64 nt, Human
acaugcaacuugaugugcuuuugaguaaauuuaugcagcagaaacuauacaaugaaggaagaau

SEQ ID NO: 146977 - RNA, 64 nt, Human
aagucucagucugaauauuuagcaagagaaacaggcagcagaggaacccaaaggcaguaaauca

SEQ ID NO: 146978 - RNA, 53 nt, Human
cccugacuaaugugaucuaaagugcagcagaguggcugaugcugcaaguuaug

SEQ ID NO: 146979 - RNA, 64 nt, Human
ggcucuuccaguggucacuacuuuuugguugcaagcagcagagauucccuggagggcuuguuga

SEQ ID NO: 146980 - RNA, 64 nt, Human
aaaagaucuuucagacaauauaagccugcaaagugcagcagaguauuuauuuugaagagaaaca

SEQ ID NO: 146981 - RNA, 64 nt, Human
uguccacagugcacugcugcaaugaagagaagaggcagcagacacaaauaaaggugguccuuuu

SEQ ID NO: 146982 - RNA, 64 nt, Human
aauucggaaaagugggcuaacaccaauucacucagcagcagauggacaaaaugcacagugucua

SEQ ID NO: 146983 - RNA, 50 nt, Human
ucacaagccccacccagugagcagcagaagacaagcacucugagaccaca

SEQ ID NO: 146984 - RNA, 64 nt, Human
ucaaagggaucaaggagaguuggggauuugagcugcagcagagagggaugagggauuuagcccu

SEQ ID NO: 146985 - RNA, 64 nt, Human
ucuccuccccucuuacaccuacucagaugaggcagcagcagacccaucucgcggcggggguuuu

SEQ ID NO: 146986 - RNA, 64 nt, Human
gggacaagaugaaaccugcuuccaggcuacuuuggcagcagaacugaaaaaggcuuuuuuucca

SEQ ID NO: 146987 - RNA, 64 nt, Human
gucccuuccuccccgagucagggcgacuuccacagcagcagaacaagugccuccuggacuguuc

SEQ ID NO: 146988 - RNA, 64 nt, Human
aggccauagcugcuccagccggggcuccggggcggcagcagagcuggcacaccgauucugggaa

SEQ ID NO: 146989 - RNA, 64 nt, Human
acaaagacaacgcugagggguagugacuccuguagcagcagagacgccuuggaguuuaaccccc

SEQ ID NO: 146990 - RNA, 64 nt, Human
cugcaacauuuaugugugaagccaaaaucacccugcagcagagccaauacugaucaacugaaag

SEQ ID NO: 146991 - RNA, 64 nt, Human
aagaaagaacggagugaagccauuuaugccuacggcagcagaaagagaugaaaucuugagagca

SEQ ID NO: 146992 - RNA, 64 nt, Human
uugucuaaguaucaucccuucuguggcccaucacgcagcagaguugcccuacaaauuucauuug

SEQ ID NO: 146993 - RNA, 64 nt, Human
ugaaccgagaucacaccacugcauucccgccugggcagcagagcgagacuccgucucaaacaga

SEQ ID NO: 146994 - RNA, 55 nt, Human
uaaagaaaggcccaaagugacagaggcagcagagggaugguccaccgccccuugg

SEQ ID NO: 146995 - RNA, 64 nt, Human
gggcaaagccccucugcccgaagcaauaacaacagcagcagaagcaaucccggggagcugccag

SEQ ID NO: 146996 - RNA, 64 nt, Human
ccaguaacgugcugcucaaggaccaagagcaauugcagcagacccagcagcagcagcagcagca

SEQ ID NO: 146997 - RNA, 64 nt, Human
uagcccaauuuucuugagucauucucucucugcagcagcagaggaagggccuguaccucccuac

SEQ ID NO: 146998 - RNA, 64 nt, Human
uucuuuguaucucccuccuucccagcccacccgggcagcagacucugauggaaggaaggugccg

SEQ ID NO: 146999 - RNA, 64 nt, Human
agaaggcucacuucugccccgggcacugcguccagcagcagaggggacagggggcaggugugug

SEQ ID NO: 147000 - RNA, 64 nt, Human
cuccaucuuauuccaguguguucaccucaucaaggcagcagaguggaugaaggaguaagucugc

SEQ ID NO: 147001 - RNA, 64 nt, Human
ucuggccacaugcauagcccaucuucauaaugucgcagcagaagguucuuugugguuaaaaguu

SEQ ID NO: 147002 - RNA, 64 nt, Human
aacuuugaagacccgcuacaaaacgcgcagaugugcagcagauuggaaggagacacagauguuc

SEQ ID NO: 147003 - RNA, 64 nt, Human
caagacuugauggacaaacaccaaucucucaaaggcagcagauuguugauggcuuuaacaguca

SEQ ID NO: 147004 - RNA, 64 nt, Human
gguuuuuauauaugacuugagucugcuguaauuggcagcagaaauccaaauuuguaugguagac

SEQ ID NO: 147005 - RNA, 64 nt, Human
ugagccgagaucgcaccacugcacuccagccugggcagcagagcaaguaguaauaaccaccgug

SEQ ID NO: 147006 - RNA, 64 nt, Human
cgcagggcuggugaauccaugacaagguccgggagcagcagaccaaaaccacagcagccuccua

SEQ ID NO: 147007 - RNA, 64 nt, Human
cagcccagaggggggcuacagagaggagucggcugcagcagagggcaggagccccagcuuagcc

SEQ ID NO: 147008 - RNA, 64 nt, Human
ccccuccucccaggggagaguagaagucgcacacgcagcagagcagaccugaugucccggugcu

SEQ ID NO: 147009 - RNA, 64 nt, Human
caaaagacucuucacugagcccuguggcuucauggcagcagaucagagcugugacauuuucuac

SEQ ID NO: 147010 - RNA, 64 nt, Human
cugauaaacccggggugaccucaugaaaugaguugcagcagaaguuuauuuuuuucagaacaag

SEQ ID NO: 147011 - RNA, 64 nt, Human
cagcucugagacccuuuucucaggaccucuguaggcagcagagagagaggacagagggguaaga

SEQ ID NO: 147012 - RNA, 64 nt, Human
ugaccgaaagugaccaagaccaaggcccaccaaggcagcagacuguuaaucagacaaacagauc

SEQ ID NO: 147013 - RNA, 64 nt, Human
cauuuacuucagccuuugauucaguaaauguuaagcagcagaagacuucgaaugguugaaauuc

SEQ ID NO: 147014 - RNA, 64 nt, Human
guccuuagcuacuagcucuagaaaagucccaaaagcagcagaaggugaagcaggaagcacuugg

SEQ ID NO: 147015 - RNA, 64 nt, Human
guguggggggguggggccuucaccuaagaccucugcagcagaccuggacagacaggccccuccc

SEQ ID NO: 147016 - RNA, 64 nt, Human
gaggcagcgugcagcccuacugucccuuacuggggcagcagagggcuucggaggcagaagugag

SEQ ID NO: 147017 - RNA, 64 nt, Human
gcagacaugguggccauugcccacccagguaccagcagcagaagacuaucugacuuggaaagaa

SEQ ID NO: 147018 - RNA, 64 nt, Human
ggcgugcaaaaacuaacauugaaauuuugaaacagcagcagagugaguggauuuuauuuuucgu

SEQ ID NO: 147019 - RNA, 64 nt, Human
ggggucagagguggggauagagcugcacauucuugcagcagaugugugaugaaagcaucuucua

SEQ ID NO: 147020 - RNA, 64 nt, Human
gggaggggaugugguaagcggaaacagaagacaggcagcagaggcauuaaaaaugcauaccaug

SEQ ID NO: 147021 - RNA, 64 nt, Human
aagaaagcgaaagcuuggacuucuauucaaaguggcagcagagugggagggcgguacccuucua

SEQ ID NO: 147022 - RNA, 64 nt, Human
aucuuggggccugagaagccuuggaacgcuucuggcagcagagcugggugugggaaugaggccu

SEQ ID NO: 147023 - RNA, 64 nt, Human
ggccccagggugacauguguccagcuuuucuauggcagcagaggccuuucccucagacaagcua

SEQ ID NO: 147024 - RNA, 64 nt, Human
gggggugccagggguccugaaaaccaaaggaggagcagcagaagccauaggcuccccagcuuuc

SEQ ID NO: 147025 - RNA, 64 nt, Human
cuugaccuuccacccacuccccuccagggagagagcagcagagaccucaucagcagaccaagga

SEQ ID NO: 147026 - RNA, 64 nt, Human
cgccucuuguucaugucagcuuauaugugacacugcagcagaaaggcucugaagguccaaagag

SEQ ID NO: 147027 - RNA, 64 nt, Human
ggggcagggagagagggaaccugcucacggcccugcagcagagcagggcgcaaacccaggacau

SEQ ID NO: 147028 - RNA, 64 nt, Human
gucucgugcccagaugaaaccauuuggaaacucggcagcagaguuuguccaaaugacccuuuuc

SEQ ID NO: 147029 - RNA, 64 nt, Human
gcaguuuucaaaguuaggaacaaguuuguaacaugcagcagauuagaaaaccuuaaugacucag

SEQ ID NO: 147030 - RNA, 64 nt, Human
aaucagucagacuuugugggcugaaggacacggugcagcagagggugucccugugagaguucug

SEQ ID NO: 147031 - RNA, 64 nt, Human
aaagcugcacaggauucccaucuacccugaugaugcagcagacaucauucaauccaaccaggug

SEQ ID NO: 147032 - RNA, 64 nt, Human
auauacuuugcuauuggguaagguauaguaguuggcagcagaauggacccauugaggauaacua

SEQ ID NO: 147033 - RNA, 64 nt, Human
ucaaagccaccagcguucuugccuaguguccagagcagcagagauuugcagcccucgccccucc

SEQ ID NO: 147034 - RNA, 64 nt, Human
ggcgccuguaaucccagcuacucaggaggcugaggcagcagaaucguuugaacccgggaggcgg

SEQ ID NO: 147035 - RNA, 64 nt, Human
gcuuucugugaaagccuuaagaagauaaaugagcgcagcagagauggagaaauagacuuugccu

SEQ ID NO: 147036 - RNA, 64 nt, Human
auuuucuauguguguuucaguggaugacaaucgagcagcagaagaauggugugccuacccuuua

SEQ ID NO: 147037 - RNA, 64 nt, Human
acagucgauuucguuucgcagcugucuccccuccgcagcagauaccucgguccagaucuccgga

SEQ ID NO: 147038 - RNA, 64 nt, Human
ggaguuauuagugcuaaaaaggggaccgugcaaggcagcagaguuacaugguucuucaaaucau

SEQ ID NO: 147039 - RNA, 64 nt, Human
aauauucauauuggaaaaaucacaauuuuuaauggcagcagaaaacuugugugaaauuuucuug

SEQ ID NO: 147040 - RNA, 64 nt, Human
ucaugggccgggcacgugcacugacucacuggcugcagcagaacacguugagggagucuuggug

SEQ ID NO: 147041 - RNA, 64 nt, Human
ggugucagugaccuguugcggcccagcggcuggagcagcagacguuugccauuucucacgccug

SEQ ID NO: 147042 - RNA, 64 nt, Human
acaggcacacacagacacagaccagagacucccagcagcagagcccaagcacuggcuucgcccc

SEQ ID NO: 147043 - RNA, 64 nt, Human
gaagaaguauauauauccauucuguauuuuacgugcagcagaauuaucuuccguaggauuuuuu

SEQ ID NO: 147044 - RNA, 64 nt, Human
ccuggcugcugcuguguggagagggaggcggcccgcagcagaacagccaccgcacuuccuccuc

SEQ ID NO: 147045 - RNA, 64 nt, Human
ugcugggggagguggaugucagaucugguagguugcagcagagaaaauaaaugugccuugagag

SEQ ID NO: 147046 - RNA, 64 nt, Human
gaaaccauggcaacgaaaguagaauguaaaacucgcagcagauaucagugggaagggcuggggg

SEQ ID NO: 147047 - RNA, 64 nt, Human
gacgucacaacuccaggugcucagacugccuguggcagcagaaccagugccuuuggcauuuucc

SEQ ID NO: 147048 - RNA, 64 nt, Human
gacugagccuggaaugaugcagcucagucaaggagcagcagaccuggcacuggaacaggguuga

SEQ ID NO: 147049 - RNA, 64 nt, Human
ggcccucaauacccagcugcuucuggcuaagagugcagcagagacugaggcauagccagcuuca

SEQ ID NO: 147050 - RNA, 64 nt, Human
agucaccccagcugcugggcuccucugccucucugcagcagaauguccguccucuguugauuga

SEQ ID NO: 147051 - RNA, 64 nt, Human
cuuuguucccauuuauccaaauaacuuggacagagcagcagagaaaagcugaugggagugagag

SEQ ID NO: 147052 - RNA, 64 nt, Human
uugcagacacggcacagcaaacauuuugcaaacugcagcagaaaucgaauuuaaaacaaaaagg

SEQ ID NO: 147053 - RNA, 64 nt, Human
cuaacuucaggcugaugagugugugggguauggggcagcagaggcagccagccagcaaagaggg

SEQ ID NO: 147054 - RNA, 64 nt, Human
agaauauuuaaaaauauauccaggugcuaaauaggcagcagaucucaauucacacaugacuacc

SEQ ID NO: 147055 - RNA, 64 nt, Human
gagcaauaaagcagaaggagucuuucaucuucuggcagcagaaauccaugaagcccgggcccag

SEQ ID NO: 147056 - RNA, 64 nt, Human
ugagcaaagccugggugcccaagcagccaccgcagcagcagaguacaaccugcagagaagcuga

SEQ ID NO: 147057 - RNA, 64 nt, Human
uugccgggguucuggggcagggcgcucccuggccgcagcagaugcccucccaggaguggagggg

SEQ ID NO: 147058 - RNA, 64 nt, Human
cgaagcacaugccccaucgagccuacugggcagagcagcagagcaggguuggaggggcugggga

SEQ ID NO: 147059 - RNA, 64 nt, Human
aggguaccccugcaaacaacuguggugggggcuggcagcagaccccccaccuggcagggcuucu

SEQ ID NO: 147060 - RNA, 64 nt, Human
ccucaugacccauccuggucucucuguccagauugcagcagaggagugggcguggcucuguguc

SEQ ID NO: 147061 - RNA, 64 nt, Human
auugaacggccuguccaaagauccucucucuagggcagcagagagcuuuuugcacuuuaaaaaa

SEQ ID NO: 147062 - RNA, 64 nt, Human
uaaauuggucagcagaaaagggagcccagaaaaggcagcagauggaccaugcccuugcuggguu

SEQ ID NO: 147063 - RNA, 64 nt, Human
aaagugugucagaccauggcgugguauuuauugugcagcagauccagagacagaggcagccugu

SEQ ID NO: 147064 - RNA, 64 nt, Human
ccaccccaccucgcugggaccuacugcucgggaggcagcagacagggagccaccagcaguggcu

SEQ ID NO: 147065 - RNA, 64 nt, Human
gagaucccucuucagaaggggccuggccuucugagcagcagauuaguuccaaagcagguggccc

SEQ ID NO: 147066 - RNA, 64 nt, Human
ugcuccuagagagaaagccugagcaggagaugaugcagcagaggggaagggcccuguggugccg

SEQ ID NO: 147067 - RNA, 64 nt, Human
ugaguggagguuaaggcugaggaaaggccagcuggcagcagaguguggccuucggacaacucag

SEQ ID NO: 147068 - RNA, 64 nt, Human
uuucucuuuauccuguccccucuccuuucuccuggcagcagaaaaggaagaacacaagagcaaa

SEQ ID NO: 147069 - RNA, 64 nt, Human
agauguuguucgggggacaacuuguaucuuucuagcagcagaucuguaguuuguauagccucaa

SEQ ID NO: 147070 - RNA, 64 nt, Human
cgaggcuaggacguggccggcgcucuccagcccugcagcagaagaacuucccgugcgcgcggau

SEQ ID NO: 147071 - RNA, 64 nt, Human
ucccucccaucaggacuaccagcuugcucaguuagcagcagagggcaguuccccagcuugaugg

SEQ ID NO: 147072 - RNA, 64 nt, Human
aaguucuagagagcugccugugggacagcccagggcagcagagcugggauguggugcaugccuu

SEQ ID NO: 147073 - RNA, 64 nt, Human
cauuauucuugcccuaagagacacugccuuuucagcagcagauacuggugagauggggguggcu

SEQ ID NO: 147074 - RNA, 64 nt, Human
cugcagggggggaggugggcagaggggccuuacagcagcagaggcuggaagagaagcucugucu

SEQ ID NO: 147075 - RNA, 64 nt, Human
ccgcacugaagaacucuuguccucacuggcugaugcagcagaacucuugggaaaugucuuaguc

SEQ ID NO: 147076 - RNA, 64 nt, Human
cuccauccaccucaucacuggacugcauggggaggcagcagagcgggguccccucugugcuucg

SEQ ID NO: 147077 - RNA, 64 nt, Human
gacgcgaagggauugccuggucuaagggcacccagcagcagagcuaggacuuccgcccuaaggc

SEQ ID NO: 147078 - RNA, 64 nt, Human
acugacccucaggucacaggcagagagagucacagcagcagacugcucugggucagugacaacu

SEQ ID NO: 147079 - RNA, 64 nt, Human
gccuuugcuucucugccuacguccccuuagaugggcagcagaggcaacucccgcauccuuugcu

SEQ ID NO: 147080 - RNA, 64 nt, Human
gccaaugcgggugggcuaagccgccaggaugccugcagcagauggacgcugcccauccuugagc

SEQ ID NO: 147081 - RNA, 64 nt, Human
acaaccaaaaggcacacaaaaccguuuccaguuggcagcagagaucagggguuaccucugcuuc

SEQ ID NO: 147082 - RNA, 64 nt, Human
gugcucugcacuugccuugcuccaggaugggguggcagcagaggaaugucacaggucagcagcc

SEQ ID NO: 147083 - RNA, 64 nt, Human
cuuuaccccugcugaccucccaccuauccgcccugcagcagaaccuuggcgguuuauagguaau

SEQ ID NO: 147084 - RNA, 64 nt, Human
cacuucugucaauuuuuucaggaccuuaguuccagcagcagaauggaaaaauccuugaagccca

SEQ ID NO: 147085 - RNA, 64 nt, Human
agggcccugacccagaguuguggucuccaaggaggcagcagaacuaagucugaaccgccaagau

SEQ ID NO: 147086 - RNA, 64 nt, Human
auccaauuuucugucaaucacacuguuguauaaagcagcagaacugaaggggaaaaaugauugu

SEQ ID NO: 147087 - RNA, 64 nt, Human
ccucagggaacccaugcaucugccuggcauuuaggcagcagagccccugaccgucccccacagg

SEQ ID NO: 147088 - RNA, 64 nt, Human
guugagccagcagacauugucagcaaauuaauuggcagcagauuuuaggaaaugaaugugugug

SEQ ID NO: 147089 - RNA, 64 nt, Human
cacauauccaagagcucagggccaguucuggugggcagcagagaccugcucugccaaguugucc

SEQ ID NO: 147090 - RNA, 64 nt, Human
ugggcagcagagaccugcucugccaaguuguccagcagcagaguggcccuggccugggcaucac

SEQ ID NO: 147091 - RNA, 64 nt, Human
accucagcucagaaaagguagcagcaaucccaaagcagcagaaggcagggguuaaaucaggaua

SEQ ID NO: 147092 - RNA, 64 nt, Human
gcaguucuuuguucaagcguuccucuggggaccggcagcagaggcaccguguucucucagcccu

SEQ ID NO: 147093 - RNA, 64 nt, Human
uggguacuaucauuagucccauguuauagaaacugcagcagaguugaaaauugccuccaaauua

SEQ ID NO: 147094 - RNA, 64 nt, Human
guagaacccaaggacuucuggguacugagaagcagcagcagaaugaggccaaaugcagagauga

SEQ ID NO: 147095 - RNA, 64 nt, Human
uggagugcgggcccugccagaagguauuuguggugcagcagauucccaacaguaaccuccuccu

SEQ ID NO: 147096 - RNA, 64 nt, Human
gugagcaguucagccugcagcagaggagggcacggcagcagagacacgcacaugcacguaagca

SEQ ID NO: 147097 - RNA, 62 nt, Human
cucagcacaccaaugugugagcaguucagccugcagcagaggagggcacggcagcagagaca

SEQ ID NO: 147098 - RNA, 64 nt, Human
acgagggccugcuggcugagauauggggcugugggcagcagacgaugccgacuggaagggaggg

SEQ ID NO: 147099 - RNA, 64 nt, Human
gcucucagucccacagcucucaggccccucucuggcagcagagcccucuccucagguugcuugu

SEQ ID NO: 147100 - RNA, 64 nt, Human
ccugaccuccccgcuguggggguuggggcuucaggcagcagacugaccaucucccagaccgcca

SEQ ID NO: 147101 - RNA, 64 nt, Human
agggaaucagagcagucaggccuguugacucuaagcagcagacauccugaagaaaugguaaggg

SEQ ID NO: 147102 - RNA, 64 nt, Human
uucauuuacuucauaccccaggaccccuuccccagcagcagagacccuggagcacaggagagua

SEQ ID NO: 147103 - RNA, 64 nt, Human
gaccugcucuggacacuugcucaugcccugccaagcagcagauggggagggugcccuccuaucc

SEQ ID NO: 147104 - RNA, 64 nt, Human
gcuucccuuaagaauuuuugaagugacugggcaggcagcagaaauuaaaugaauuuuucuuccu

SEQ ID NO: 147105 - RNA, 64 nt, Human
cuguuuugggaaacacuuugaggacauuuaugaugcagcagauguugacuaaaggcuugguugg

SEQ ID NO: 147106 - RNA, 64 nt, Human
ccaucaaccccaacagcuucauccugggucugaagcagcagauugaagaccagcaggggcuucc

SEQ ID NO: 147107 - RNA, 64 nt, Human
uggugagcgcugggcagggcucgugguggcaucagcagcagagacgaagccuuucuguaacaug

SEQ ID NO: 147108 - RNA, 64 nt, Human
aguuggaaaggacacgugagagugagcucaaguggcagcagaggcaguuuggaauaagcugcgg

SEQ ID NO: 147109 - RNA, 64 nt, Human
aucugagaggcaguaaagcagugaugaagacagugcagcagaacauugaaguccugauugcagc

SEQ ID NO: 147110 - RNA, 64 nt, Human
gucacagccccagaccacccgcuuggcccacgcagcagcagagccgccguuugcuggguuguuu

SEQ ID NO: 147111 - RNA, 64 nt, Human
uuggaaaagcaggacuuuggugccugugcuauaagcagcagauuuugugggaggaaacacuuga

SEQ ID NO: 147112 - RNA, 64 nt, Human
ugccgacagucagcagcugauccccgacagaaacgcagcagaugcagacggugagugcagcagg

SEQ ID NO: 147113 - RNA, 64 nt, Human
gggagcaucuguuuaccuggcaguggcucucagagcagcagaacggguucaguuuuagacucug

SEQ ID NO: 147114 - RNA, 64 nt, Human
uuggauuaaauccaacaguuuauuuguaagcccugcagcagauuucuuugauaauuuagcuuuu

SEQ ID NO: 147115 - RNA, 64 nt, Human
gaacagcaaggaauuauuuuccagaaugacacccgcagcagaauguuggaguggaaaugauggc

SEQ ID NO: 147116 - RNA, 64 nt, Human
aaauggacgcuggauuacaagcauggcagcucaggcagcagaaguugcaggaagaacaaaggaa

SEQ ID NO: 147117 - RNA, 64 nt, Human
aauggaagaagccaggcuuucuuagccauucuuugcagcagaagauuucuugauaaaaaaggau

SEQ ID NO: 147118 - RNA, 64 nt, Human
aguuaugauugugaaguuaaugcuccuauacaaggcagcagaaaccuacugcagggugaagaau

SEQ ID NO: 147119 - RNA, 64 nt, Human
uuuggaauccuuaaacuuggccuucucaaacucagcagcagaucuccgggauucugcuguuauu

SEQ ID NO: 147120 - RNA, 64 nt, Human
uuucaggagguacugugaggaagagcaggcaccagcagcagaauggggaauggagaggugggca

SEQ ID NO: 147121 - RNA, 64 nt, Human
ggacuuuauuguuaguauuauaggcuaauaaccugcagcagaaauucauacucuauuauaauaa

SEQ ID NO: 147122 - RNA, 64 nt, Human
ccucuggcugcgcacucccgaccgcgacguccacgcagcagagggacaugggccauuccaugac

SEQ ID NO: 147123 - RNA, 64 nt, Human
uucccuuuucuagaaccuuuuguaaaaguugguggcagcagaggcagccccaggccgggcugca

SEQ ID NO: 147124 - RNA, 64 nt, Human
accacccagucagaaagcucuuccagaaguucaagcagcagaaggagcugcggaaucagggcuc

SEQ ID NO: 147125 - RNA, 64 nt, Human
aacaggcagugccaguuggacccaagagaagacugcagcagacuacacaguacuucuugucaaa

SEQ ID NO: 147126 - RNA, 64 nt, Human
ccaguacucaggcagcuggagagaagagaaggcagcagcagaggcccccgcccucaccccagcc

SEQ ID NO: 147127 - RNA, 64 nt, Human
gucugcuccucugcaaaggccagccagcuugggagcagcagagaaauaaacagcauuucugaug

SEQ ID NO: 147128 - RNA, 64 nt, Human
cuuuugugcuggacccaggaauccuuaccauggagcagcagauagucccaguauacucacuuau

SEQ ID NO: 147129 - RNA, 64 nt, Human
gccaccucgugguagacuaugacggugacucuuggcagcagaccagugggggauggcugggucc

SEQ ID NO: 147130 - RNA, 64 nt, Human
gguagccuccgcagaggcugggggccuccacccagcagcagaccaaccaggaagcagcuugaac

SEQ ID NO: 147131 - RNA, 64 nt, Human
ucugcaccccaagcccuugccccagcccaguccagcagcagauguuacaaucugagugaggaca

SEQ ID NO: 147132 - RNA, 64 nt, Human
acuucaaccgggcaaaggagcacaaggaaaccaagcagcagaggccccaucagcacagagggcc

SEQ ID NO: 147133 - RNA, 64 nt, Human
ugcgcagcaugaaggagcgaaagcuggagaagaagcagcagaaggagcaggagcaaggugagcg

SEQ ID NO: 147134 - RNA, 64 nt, Human
ggaaacguccucgugagaugagagccugagccaggcagcagagcgcucgcugcuguguagacug

SEQ ID NO: 147135 - RNA, 64 nt, Human
ccugagcaggauagauuugaagugcaagccggaggcagcagaucaggaguagggacaggaagga

SEQ ID NO: 147136 - RNA, 64 nt, Human
uucucuccgggccaccuucuccccaccaggcacugcagcagacggagcuguacugccgggcccg

SEQ ID NO: 147137 - RNA, 64 nt, Human
aaguguaauuaacacugauguuuguguuaaauuugcagcagagcuugagaaaaguacauuguuc

SEQ ID NO: 147138 - RNA, 64 nt, Human
caguugcucguggccacucaguggagcugggccugcagcagacucaaggcuccgagugcccugg

SEQ ID NO: 147139 - RNA, 64 nt, Human
ucccuaaagacccuaaaucugaggaaucaacagggcagcagaucuguauauuuuuuucuaagag

SEQ ID NO: 147140 - RNA, 64 nt, Human
augaguagaggggcucugggucgggguuucauaugcagcagagcagcucccuugcugccgucca

SEQ ID NO: 147141 - RNA, 64 nt, Human
agacuugccgcuucgagggccugaaggaguuucugcagcagacggaugaccgcuuccacgagau

SEQ ID NO: 147142 - RNA, 64 nt, Human
gguaaugggggcucauugugagggaggugcagaggcagcagaggauuggcauaaaacugaaaag

SEQ ID NO: 147143 - RNA, 64 nt, Human
acagccauggcaaggcagaccuacaggcgaggccgcagcagaggguggggcagagcagccucgg

SEQ ID NO: 147144 - RNA, 64 nt, Human
ccgucaccccaggaggaaaagcccagggucuggggcagcagagccaucgcaucauguuucccag

SEQ ID NO: 147145 - RNA, 64 nt, Human
uguguuguucuuguguugguucccauguaaagaagcagcagagaaaugcgaugguucaacagcu

SEQ ID NO: 147146 - RNA, 64 nt, Human
ugacacuggagaaagguguccuccaugcccucaggcagcagagaacuggcccagagcccuugga

SEQ ID NO: 147147 - RNA, 64 nt, Human
gaacgaguuguuggcugcucccuccacagcuucugcagcagacugucccuguuguaacugccca

SEQ ID NO: 147148 - RNA, 64 nt, Human
gacugucuccugacuuagccgagguaaggucagugcagcagacagggccagacugggguguggg

SEQ ID NO: 147149 - RNA, 64 nt, Human
ccugaggaauguggucacagcaagaaggcggggagcagcagagccuugccuuugaaugaggcag

SEQ ID NO: 147150 - RNA, 64 nt, Human
ucuguuugaaaaaaaugaggggaucuuagaugcugcagcagaacagucuccagguguuuuaagg

SEQ ID NO: 147151 - RNA, 64 nt, Human
ccuuaccaccaggagcauucaagcucuggauugggcagcagaugugcccccagucccgcaggcu

SEQ ID NO: 147152 - RNA, 64 nt, Human
gagccccaccgcugugcaucgaaugagggaaguggcagcagagaggccagagcugcccccucuc

SEQ ID NO: 147153 - RNA, 64 nt, Human
gagaagcucuuuuucgggcaccgagguauuaacugcagcagaaaaagacgagcuuuuguuauca

SEQ ID NO: 147154 - RNA, 64 nt, Human
ugcuugccucugcucucccuuuguggggacucaggcagcagaggcaucugggaagucucugagu

SEQ ID NO: 147155 - RNA, 64 nt, Human
gaggucccucacuccacgggacagaggccccugggcagcagaggaaaccuacagcucuggguga

SEQ ID NO: 147156 - RNA, 64 nt, Human
acuggcucugcccagguggggugggguggcccaggcagcagaagguucccugaggucccagagc

SEQ ID NO: 147157 - RNA, 64 nt, Human
guccugugcuugugggagacuuugcagggaggaggcagcagacacuggagaugacauucuucca

SEQ ID NO: 147158 - RNA, 64 nt, Human
uuuugacacaauuacuggguaauuucuaauauaggcagcagacuguuuuacggguugcuguuuu

SEQ ID NO: 147159 - RNA, 64 nt, Human
ccccagacgugugauuuucagacuuuucuuucgagcagcagaacuucguuuacggagcacaguc

SEQ ID NO: 147160 - RNA, 64 nt, Human
cugaacacggagauugucuuucugccacagaacagcagcagacgugucgggagguuagcugcgg

SEQ ID NO: 147161 - RNA, 64 nt, Human
ugugccuguaaucccaccuacucgagaggcugaggcagcagaauugcuugaacccgggaggugg

SEQ ID NO: 147162 - RNA, 64 nt, Human
agagaagccagauucugcauuugcgauguuacuagcagcagaagucagauuguagagguccugg

SEQ ID NO: 147163 - RNA, 64 nt, Human
ugcuggcugccgccgcggaacggaggcuucagaagcagcagaccuccuagcgcucccuugccuu

SEQ ID NO: 147164 - RNA, 64 nt, Human
gggagaucugacagcccagaccuuucuacggcuggcagcagagaaacaaagucuggacccacuc

SEQ ID NO: 147165 - RNA, 64 nt, Human
ucacccagcacugugggggccuucagacucuggggcagcagacaugcugcuucccaucagccag

SEQ ID NO: 147166 - RNA, 64 nt, Human
cccacaaacgagacacacgcuggcggggagagacgcagcagagcuccuuccugucuguggacuc

SEQ ID NO: 147167 - RNA, 64 nt, Human
gggaggaagaagacaagccccacuagggccaagggcagcagagcccugccgagugagaggcugu

SEQ ID NO: 147168 - RNA, 64 nt, Human
ggggcccugaaaguucauaugguggguaugucccgcagcagagugaggagaugaagcuuacgug

SEQ ID NO: 147169 - RNA, 64 nt, Human
guacucuaaaccuuuaaaaaaaaaucugauuuaugcagcagagaugggacagccacuuuuucuu

SEQ ID NO: 147170 - RNA, 64 nt, Human
cuggggucaucccuccacucugacucugacuauggcagcagaacaccagggccuggcccagugg

SEQ ID NO: 147171 - RNA, 64 nt, Human
ucugaauauuuuaaaucuuaacaucauauaaaaagcagcagaggugagaacucagaagagaaau

SEQ ID NO: 147172 - RNA, 64 nt, Human
agauuuuuaaucauuagguuuuagauuuccuuuagcagcagagacugacuugcuguauagaggg

SEQ ID NO: 147173 - RNA, 64 nt, Human
aaaucaaauuaucuaagaaaacaagaaaacaaaggcagcagacuauugguacacauuauagucc

SEQ ID NO: 147174 - RNA, 64 nt, Human
gccaacagcccaggagcuuuucagaauagcgucugcagcagaaccaguuuccauucagagcgcg

SEQ ID NO: 147175 - RNA, 64 nt, Human
gaacaccgucccuccuaugcacccuccaagacgugcagcagaugcaaaggguucuagcugcagu

SEQ ID NO: 147176 - RNA, 64 nt, Human
ccacgauaaggacaugcaacacguguuucugugugcagcagaggccguguuuuucaugccaaac

SEQ ID NO: 147177 - RNA, 64 nt, Human
acuaccaucuuggccagugacaaguguucggagggcagcagagaggaccaagccugugucaccu

SEQ ID NO: 147178 - RNA, 64 nt, Human
acaacagaguauucagaucgccacacucugugaggcagcagagccugggcagguguuuggcuua

SEQ ID NO: 147179 - RNA, 64 nt, Human
ggacacaaggcuuuuaugcuccuagaucuucaacgcagcagaggaaccauaaguagaaucacag

SEQ ID NO: 147180 - RNA, 64 nt, Human
uuucccuuuucuuuuguucaugaccugaccugaagcagcagauuugauagacuggcaaagauga

SEQ ID NO: 147181 - RNA, 64 nt, Human
gagggcuaaacaagggcagugagaagacuggcaggcagcagaaaucauuuucuuuuugaucuca

SEQ ID NO: 147182 - RNA, 64 nt, Human
aggcaucuggaacuuucucugccugcaggggcuagcagcagaggcuucaccgcaucaccacccc

SEQ ID NO: 147183 - RNA, 64 nt, Human
agugagucgagacuuagaagaauggggccacauagcagcagaggacugguguaagggagggagg

SEQ ID NO: 147184 - RNA, 64 nt, Human
agucuguggauggacaugaucagugcuaaggaaagcagcagagagagacgcuccggcgccccag

SEQ ID NO: 147185 - RNA, 64 nt, Human
agucacccacccagccuuggagcuggaugccugugcagcagaacagaggcaacgguggcaggca

SEQ ID NO: 147186 - RNA, 64 nt, Human
guuugugcugaugagaauacugaguauguggaaggcagcagagcggacuggugaggagcacagc

SEQ ID NO: 147187 - RNA, 64 nt, Human
aauagcuuauuugcccuauaagaaccuucccagagcagcagaggcccuucuacucccucuugac

SEQ ID NO: 147188 - RNA, 64 nt, Human
uuaaagaagcgagagaggaggccccacccuccuggcagcagaugccuggggcaaggccagggga

SEQ ID NO: 147189 - RNA, 64 nt, Human
uugagguccagcccuggcugaaggacugugacaggcagcagagacuugggacauugccuuuucu

SEQ ID NO: 147190 - RNA, 51 nt, Human
caguugcugaucuuaucugaagcagcagaucagugggaugagggagacugu

SEQ ID NO: 147191 - RNA, 64 nt, Human
gccacaccccucacccugcuguccucccacggcugcagcagaguuugaagggcccagccgugcc

SEQ ID NO: 147192 - RNA, 64 nt, Human
ggcugagaggguggacgaguucagguuuguuuuugcagcagauuccgucguucuuacugagucu

SEQ ID NO: 147193 - RNA, 64 nt, Human
cacccccaaaccaccgacucucauugccgacacugcagcagaaucucuccgggugggagcccca

SEQ ID NO: 147194 - RNA, 64 nt, Human
ccuggccucugaggguucagcggaggugaggaaggcagcagagcuccagcaggugaagggagag

SEQ ID NO: 147195 - RNA, 64 nt, Human
auauuuaacgucgguaguucugcuuuauuaaaaugcagcagagguacucuucugucccuuccgu

SEQ ID NO: 147196 - RNA, 64 nt, Human
gauagauuuuuauuguuuggaguaacguugguaugcagcagaggaacguaaacauuuggucuug

SEQ ID NO: 147197 - RNA, 64 nt, Human
uauuuuaucuauaguuauuuagacauguuuacaugcagcagauaauuguucauaguggacugaa

SEQ ID NO: 147198 - RNA, 64 nt, Human
uggauuuggagcauccacuugaggagcagagguggcagcagaggauucugagccaccaacugca

SEQ ID NO: 147199 - RNA, 64 nt, Human
aaccaagggucugugagugucagcgugggaucaggcagcagagcuuuuuuccccuuugccuuga

SEQ ID NO: 147200 - RNA, 61 nt, Human
ucucucuucaggaacgcugaggcccuucccagcagcagaaucuguugaguugcugccacaa

SEQ ID NO: 147201 - RNA, 64 nt, Human
gacaccaguaugaaugcugggcucuccggacccugcagcagagaggccagagguagcuggugau

SEQ ID NO: 147202 - RNA, 64 nt, Human
gcugagauggcauaggccuuagcaguaacggguagcagcagauguaguuucagacuuggaguaa

SEQ ID NO: 147203 - RNA, 64 nt, Human
uucaucugcucuccuuccuggagcccagaggagggcagcagaaggggguggugucuccaacccc

SEQ ID NO: 147204 - RNA, 64 nt, Human
gaguuuuuaucuauuagcagaaagggccucucuggcagcagagauuaaaaacuggcccaacuuc

SEQ ID NO: 147205 - RNA, 64 nt, Human
ucuggugugucuacuggagggucccacaggagaggcagcagaggggucaggggaggucuccugc

SEQ ID NO: 147206 - RNA, 63 nt, Human
augugauccucaaacauugacacuggaugggcugcagcagaggcacugggggcagcgggggcc

SEQ ID NO: 147207 - RNA, 64 nt, Human
uaugauuaaaacccuguguccaacagagaaaccugcagcagagauaauggugaaaguuuaggca

SEQ ID NO: 147208 - RNA, 64 nt, Human
gccaggagauggccccaacaagcaccccgcuuuugcagcagaggagcugaguuggcagaccggg

SEQ ID NO: 147209 - RNA, 64 nt, Human
ccugccugagcaccgcagcgggagccagcagggggcagcagaggccaacagggagcucgcaggc

SEQ ID NO: 147210 - RNA, 64 nt, Human
cagcaguuagaaguuucuaucccuccagcuuucugcagcagaaagacccucauugucaguuucc

SEQ ID NO: 147211 - RNA, 60 nt, Human
agcagcaauacugccuguagccauuggguggcagcagagucccagaauaugagaccguua

SEQ ID NO: 147212 - RNA, 64 nt, Human
uuuggauauuggagcccacgugggcccaccccgggcagcagagaaggcccagcugacagggggu

SEQ ID NO: 147213 - RNA, 64 nt, Human
ugugcagagcgcuggggacuccagacuccccacagcagcagagacucgggacugaggcauccuc

SEQ ID NO: 147214 - RNA, 64 nt, Human
auuuacaccuugauugugcugcuuccaggcuguagcagcagaguugagcaguugugacaggaga

SEQ ID NO: 147215 - RNA, 64 nt, Human
agaaagccuuuagccaacggugucaacuuacuaggcagcagagaauucauacuggagagaagcc

SEQ ID NO: 147216 - RNA, 64 nt, Human
aaguggcuucuccguggaaacacagccuucugcugcagcagaggcucacccagcgugaacugcc

SEQ ID NO: 147217 - RNA, 64 nt, Human
cguuucuuucaauauuuauuuccagaguccggaggcagcagacacgcccucuuaguagggacuu

SEQ ID NO: 147218 - RNA, 64 nt, Human
cccagaccccguggauucuagauagauuuuagaggcagcagacagaauuacugaggaauugagu

SEQ ID NO: 147219 - RNA, 64 nt, Human
gcccaccccgccugcccucccacccccuccccgggcagcagagagagagagagagaaagagaga

SEQ ID NO: 147220 - RNA, 64 nt, Human
cccagaagaagcagcugaaggagcagcaggagaugcagcagauguacgacaugaucaugcagca

SEQ ID NO: 147221 - RNA, 64 nt, Human
guggacaccccaucuaccugagucugauucuuuagcagcagagacugaggggugcagaguguga

SEQ ID NO: 147222 - RNA, 64 nt, Human
aggguugggucugauuguacacuguugcacgcaugcagcagaaaaauauguauauuauuguaaa

SEQ ID NO: 147223 - RNA, 64 nt, Human; identical to SEQ ID NO: 147222

SEQ ID NO: 147224 - RNA, 64 nt, Human
ccccaaguuuggggucagaggccgggacacugaggcagcagaacuagugccagggguggcugag

SEQ ID NO: 147225 - RNA, 64 nt, Human
ugagccgagauugugccacggcacuccagccugggcagcagagugagacucucucucaaaaaaa

SEQ ID NO: 147226 - RNA, 64 nt, Human
gucaccaucuuugcaccaaacugucaccaucuuugcagcagaaggucacuacucacauuauagu

SEQ ID NO: 147227 - RNA, 64 nt, Human
ugggaaaagggggugacagacaacuuuugagagggcagcagacucccucagccaugagaaccag

SEQ ID NO: 147228 - RNA, 64 nt, Human
ugagccgagauugcgccacugcacuccagccugggcagcagagcaacacucugucucaaaaaaa

SEQ ID NO: 147229 - RNA, 64 nt, Human
acuuauuaauuacaaaaggaaaaucaguaauuuugcagcagagaaauauggccaacuccaccuu

SEQ ID NO: 147230 - RNA, 64 nt, Human
uugugagaaaaucuucagccaagucaaacuucaugcagcagaauccccauaccagaaaaauuac

SEQ ID NO: 147231 - RNA, 64 nt, Human
uccuuuguccuuuuguucagacagaguuguaccugcagcagacaacucugaauuaaagcaugaa

SEQ ID NO: 147232 - RNA, 64 nt, Human
auagcaugaacaaguaauauuaagccaagaauaagcagcagaacccuguuccauauggaaaaaa

SEQ ID NO: 147233 - RNA, 64 nt, Human
uuugcuucucugggcaaaugggaaguucagcggggcagcagaaucaguggcauucccccuggug

SEQ ID NO: 147234 - RNA, 64 nt, Human
agccuaggauacguacaguaaauuaacaaugauagcagcagaugccuagcucauccuggguuug

SEQ ID NO: 147235 - RNA, 64 nt, Human
cauguccaucuuguaauaaaugcaaaaugcccgugcagcagaagcaugcgacuuucauauccuu

SEQ ID NO: 147236 - RNA, 64 nt, Human
ucccuuucucggcacccccuuguuggagauggaggcagcagacgugcagugccauaaggugccc

SEQ ID NO: 147237 - RNA, 64 nt, Human
uagacacaguguuucugcccaggugaccuguucagcagcagaacaagccagggccauggggacg

SEQ ID NO: 147238 - RNA, 64 nt, Human
gaagaggacuuugggggacaggcuucuccugugagcagcagagcagcacaauaaaugaggccac

SEQ ID NO: 147239 - RNA, 64 nt, Human
agggaaaggaaagcugagaugaugucuuaccguagcagcagaucuuggaugguccaggcucuau

SEQ ID NO: 147240 - RNA, 64 nt, Human
ggcgccuguagucccagcuacgugggaggcugaggcagcagacuggugugaacccgggaggugg

SEQ ID NO: 147241 - RNA, 64 nt, Human
agccaggugggcgggggcuagggggagccugggugcagcagagacagaggaagcagagccaggu

SEQ ID NO: 147242 - RNA, 64 nt, Human
ucugugguuuucagugaacaagcgcugagcaccagcagcagaaaacaacaacaaaaaaacaccu

SEQ ID NO: 147243 - RNA, 53 nt, Human
gggcuauggauuucuucugaggagcagcagagucccuuguaaaagacugcuuu

SEQ ID NO: 147244 - RNA, 64 nt, Human
ccuacaagccuaagugccccgagagcgacgcgacgcagcagaggccggccuucccugaguggcu

SEQ ID NO: 147245 - RNA, 56 nt, Human
gcagcccugucccaccauagccacaggcagcagaagucugggcagaguucaucuuc

SEQ ID NO: 147246 - RNA, 64 nt, Human
ugaggcgcaugcaggagaugcugcagaggaugaagcagcagaugcaggaccagugacgcucgcc

SEQ ID NO: 147247 - RNA, 64 nt, Human
gaaggggacucugggggacuggcuuccccugugagcagcagagcagcacaauaaaugaggccac

SEQ ID NO: 147248 - RNA, 64 nt, Human
gaaggggacucugggggaccggcuuccccugugagcagcagagcagcacaauaaaugaggccac

SEQ ID NO: 147249 - RNA, 64 nt, Human
ugagcuaugaucacaccaccacacuccagccugagcagcagagcgggaccucgucucuaagaau

SEQ ID NO: 147250 - RNA, 64 nt, Human
ugccaauugaaacagaagaagaaaaaaaaaaaaagcagcagacaacacacuguagagucuugca

SEQ ID NO: 147251 - RNA, 64 nt, Human
ggaucagcccugcccuucagcauccucaguuccugcagcagagccuggaagacacccuaaugug

SEQ ID NO: 147252 - RNA, 64 nt, Human
cuggcccagcgccuggccuggggggcggggagaggcagcagaaggggcugggcaggggcggugg

SEQ ID NO: 147253 - RNA, 64 nt, Human
ucucuggaggucugcaagcacugguagugauauugcagcagacaaggucuggguugggcgucug

SEQ ID NO: 147254 - RNA, 64 nt, Human
cucagucucuaaggaaggcagagaccuggguugagcagcagaauaaaagaucuucuuccaagaa

SEQ ID NO: 147255 - RNA, 64 nt, Human; identical to SEQ ID NO: 147254

SEQ ID NO: 147256 - RNA, 64 nt, Human
ccgcccccucccaaggauggucccuuugggugcagcagcagaggucaccuccugacaugcgcuc

SEQ ID NO: 147257 - RNA, 64 nt, Human
gcacagccugggauggggcuuggggcuggggccugcagcagaagugugcccagcguuucucggc

SEQ ID NO: 147258 - RNA, 64 nt, Human
cucuggccagcuggcuuccgcccuugguggggaagcagcagaacuagguucugagccacggguc

SEQ ID NO: 147259 - RNA, 64 nt, Human
gagggucgccaugaucaccccaacucuagaggccgcagcagagcucaggacauucccccacaga

SEQ ID NO: 147260 - RNA, 64 nt, Human
ggugccagguggccagugagggcccgaggaccacgcagcagagucccccacgggccugagccug

SEQ ID NO: 147261 - RNA, 56 nt, Human; identical to SEQ ID NO: 147245

SEQ ID NO: 147262 - RNA, 64 nt, Human
gaagaggacuuugggggacgggcuuccccugugagcagcagagcagcauaauaaaugaggccac

SEQ ID NO: 147263 - RNA, 64 nt, Human
ucucagggcagagggcaggcagggggaccgaggggcagcagauaggagagcacugagcccggau

SEQ ID NO: 147264 - RNA, 64 nt, Human
uggucggccacaccagugucccaaagaggagagcgcagcagagccaggggucuguucuguagca

SEQ ID NO: 147265 - RNA, 64 nt, Human
cgcccuccagucugagagcaggggagggaaggaggcagcagaguuggggcagcugcucagagca

SEQ ID NO: 147266 - RNA, 64 nt, Human
cugcccggucacucagcgagaaacucaacuccuggcagcagaugacgggcacucugguuaaaug

SEQ ID NO: 147267 - RNA, 64 nt, Human
uucagagcuggcaauggcagcgacagcagcaacagcagcagauccaagaagcgggucccugaga

SEQ ID NO: 147268 - RNA, 64 nt, Human
caaauuuguagacuucuaaauagaauaaacacuugcagcagauggcauugccuacauuuuuccc

SEQ ID NO: 147269 - RNA, 64 nt, Human
uccacuccucaccuucccugccuuggugcugccagcagcagacauagacgggugcagaagcggg

SEQ ID NO: 147270 - RNA, 64 nt, Human
ugaaaugauuuacccaaaaucacacagcucagaagcagcagaacugacauugggacccaggucc

SEQ ID NO: 147271 - RNA, 64 nt, Human
aaccugagaggaaaaagaauucuuuuuacaggaggcagcagaaaacugucugaaaggucaauug

SEQ ID NO: 147272 - RNA, 64 nt, Human
ggaggagagagaggagaagggaggcaggggaggggcagcagaaccaaggcaaauauuucagcug

SEQ ID NO: 147273 - RNA, 64 nt, Human
aggucagcucacugagcuggguguaggaggggcugcagcagaggccugaggaguggcaggaaag

SEQ ID NO: 147274 - RNA, 64 nt, Human
gugcuugcucccccugccuugucccaccagggaggcagcagacucaggcccuccaugguccucu

SEQ ID NO: 147275 - RNA, 64 nt, Human
auugugguggaaggugaaaggcaugucucacauggcagcagacaagagaagaaaacuugugcag

SEQ ID NO: 147276 - RNA, 64 nt, Human
ucugcccagcuuugcuuauuuuggggauuucaaggcagcagaggguagugaggggagagcagga

SEQ ID NO: 147277 - RNA, 64 nt, Human
cugagacccuaaagcauuuaguccugcaauuccugcagcagagcaacuugugcaaguacuucaa

SEQ ID NO: 147278 - RNA, 64 nt, Human
aguaugcagugaaauugccuuucaagggcagcgugcagcagaauuugcauuugcuugaaguaug

SEQ ID NO: 147279 - RNA, 64 nt, Human
cucgaaggcggaccagccugccucugugaugacugcagcagaccuccuuggguguaccaaugcc

SEQ ID NO: 147280 - RNA, 64 nt, Human
acaaaaacccagauuggugagauaggacacuugugcagcagauaugccaaugggccauguuuau

SEQ ID NO: 147281 - RNA, 64 nt, Human
acuggccugacccaugagaccguuuggagaccaagcagcagaugcagguguggaccccaggaac

SEQ ID NO: 147282 - RNA, 64 nt, Human
gggaacugccaacgcuucugcuugggaauugcgugcagcagagccuagaggagcuguuccuucc

SEQ ID NO: 147283 - RNA, 64 nt, Human; identical to SEQ ID NO: 84563

SEQ ID NO: 147284 - RNA, 64 nt, Human
uccuccagggacuugccuggcccuccucccccuccgcccccaauggguucggucuccuuugcgc

SEQ ID NO: 147285 - RNA, 64 nt, Human
gggaagagcacagcugcagaucccaggccucuggcgcccccacucaagacuaccaaagccagga

SEQ ID NO: 147286 - RNA, 64 nt, Human
ccagccucucauuucuucucccuccacuugugagcgcccccagcuuugcggcgccccccacccc

SEQ ID NO: 147287 - RNA, 64 nt, Human
gcugccagcaaugcuguccucacagaggcauagucgcccccagcuggguugugcuccacuguga

SEQ ID NO: 147288 - RNA, 64 nt, Human
aacacaauguuucaaguuaaaccuuuugugucaccgcccccaccaaccaccaccuccuaaaucc

SEQ ID NO: 147289 - RNA, 64 nt, Human
ccacuacaccuggcugagguuccucugccugccccgcccccaguccccaccccugcccccagcc

SEQ ID NO: 147290 - RNA, 64 nt, Human
cugggcuuuggacaaucuagagguaauuuauauccgcccccagguggagcaacaugcgauucug

SEQ ID NO: 147291 - RNA, 64 nt, Human
uggacaaguguuugcauggggguucagcugugcccgcccccaggcugugccccaccacagauuc

SEQ ID NO: 147292 - RNA, 64 nt, Human
gguauccaaguuggacuggguugcguccugacggcgcccccagugugcacgagugggaaggacu

SEQ ID NO: 147293 - RNA, 64 nt, Human
cucaauuaggcuguugggaauccgccucuuuacccgcccccacucccgccccacacgcgcccug

SEQ ID NO: 147294 - RNA, 64 nt, Human
cuguacaaauaguugcuucccacugccccccgcccgcccccagaaugauauuaauuuugccuuu

SEQ ID NO: 147295 - RNA, 64 nt, Human
cuggaaacgagccgugucagaucgcacaucccugcgcccccaugccccucugagucacacagga

SEQ ID NO: 147296 - RNA, 64 nt, Human
gugggaugugacaagaagcagauccuggcccucccgcccccaccccucagggauauuuaaaacu

SEQ ID NO: 147297 - RNA, 64 nt, Human
uucaggaguucugacgacacgacucucagauccacgcccccagccuaacagcaacaacaaagac

SEQ ID NO: 147298 - RNA, 64 nt, Human
gcuggugcugcccccucaccuugguacugaucagcgcccccacccaggacauaccuuccccagg

SEQ ID NO: 147299 - RNA, 64 nt, Human
cuggcuugcgccaggacuuggcgugggcaccgggcgcccccaucccagugucugugugcgucca

SEQ ID NO: 147300 - RNA, 64 nt, Human
caccccccaaaaagauguccauugccugcacugccgcccccauuuuugugccacuugcuugggg

SEQ ID NO: 147301 - RNA, 64 nt, Human
gcuucuacuugagcccucucucucugccacccaccgcccccaaucuaucuuggcucacucgcuc

SEQ ID NO: 147302 - RNA, 59 nt, Human
auaugcacaagagcaagugaugcccccagcgcccccagcccagcccacuccccgcaugg

SEQ ID NO: 147303 - RNA, 64 nt, Human
aaggcacuccaaccucacucuucccgucugucugcgcccccauuucuccauuucugccgggguc

SEQ ID NO: 147304 - RNA, 64 nt, Human
gggucuuccuucuuaaucccauggcugguggccacgcccccaccaucaucagcugggaggaaag

SEQ ID NO: 147305 - RNA, 64 nt, Human
acagccgccuaaggcccgcggcucaugugcugcccgcccccauauuuauucacugauagagaau

SEQ ID NO: 147306 - RNA, 64 nt, Human
ccuugggcgcacucuucagcgucuccuccuccugcgcccccacugcgucugcccaggaacagca

SEQ ID NO: 147307 - RNA, 64 nt, Human
acagucuaagaugagagccugugacagguggcagcgcccccaggugggguacuggcaucagagc

SEQ ID NO: 147308 - RNA, 64 nt, Human
uguuccguguggugagccuggcugcccgccugcacgcccccacugcccccgcacgaaucaccuc

SEQ ID NO: 147309 - RNA, 64 nt, Human
gguuagagcuuuucagugcaucccaccucccugucgcccccaugcucggcuuccucacauucag

SEQ ID NO: 147310 - RNA, 64 nt, Human
acugcccacuccuccacaaaccgugacccauagccgcccccaccccauaccuugaucuaccauc

SEQ ID NO: 147311 - RNA, 64 nt, Human
gauagauccagaugagauacagcucagagugccacgcccccagaaagaggaaucaggcaaguac

SEQ ID NO: 147312 - RNA, 64 nt, Human
agaccccaacacaugcuucuucgaggggcagcagcgcccccacggggcucgcugggcgcccaac

SEQ ID NO: 147313 - RNA, 64 nt, Human
auccguggucccgacaaccucccugucccuugcccgcccccaggaagggggaaauggggcauuu

SEQ ID NO: 147314 - RNA, 64 nt, Human
ucguuuguaaggcgcucgucggcaccugcugaaacgcccccaccugacagccccauccucaaag

SEQ ID NO: 147315 - RNA, 64 nt, Human
ucaccuuaacuaucuuucaauuccauacuucccccgcccccauuuuaaaggcuuauuguuguau

SEQ ID NO: 147316 - RNA, 64 nt, Human
aggugccaggaaugcgccaccccauccuccaccccgcccccaaaucgugacaaucaaaaaugcc

SEQ ID NO: 147317 - RNA, 64 nt, Human
uaauuuccuuugcuucaaauucaaggccuuccaacgcccccauccccuuuacuaucauucucag

SEQ ID NO: 147318 - RNA, 64 nt, Human
aacuaguauuguccauaucagaccucugaucccucgcccccacaccccaucucucuucccuaau

SEQ ID NO: 147319 - RNA, 64 nt, Human
ucugagaaggcccugugcccuaaaggacaccccucgcccccaucuucauggagggggucauuuc

SEQ ID NO: 147320 - RNA, 64 nt, Human
gcagcagacacacugagggccuggcagggcucaucgcccccaccuucuaagaagcccuguggaa

SEQ ID NO: 147321 - RNA, 64 nt, Human
aauuuauaaaauugaaggcaacccccgcuccugccgcccccaaucuccccauugccuagagcgc

SEQ ID NO: 147322 - RNA, 64 nt, Human
cgcccgccgccucccucacccggcaaggggcgcgcgcccccaggacccccccaguccgccccgu

SEQ ID NO: 147323 - RNA, 64 nt, Human
uggagacccagcuccugcagcccuccugcucccacgcccccagacagcuugguggaggguccug

SEQ ID NO: 147324 - RNA, 64 nt, Human
ccagaggcagcugggcugggccaaggcaggaaggcgcccccauguguguggccucagucucagc

SEQ ID NO: 147325 - RNA, 64 nt, Human
cagcggaacaugucauuucucuauuucugugacgcgcccccaugcccccaccccaccacaagag

SEQ ID NO: 147326 - RNA, 64 nt, Human
caaaugaagauuuucaugagucagcccccccgcccgcccccaccccacacccacauccucucuu

SEQ ID NO: 147327 - RNA, 64 nt, Human
gcuauggacagcaucuaagucugcccaggccggccgcccccaccccucggggcuccugaauauc

SEQ ID NO: 147328 - RNA, 64 nt, Human
gagcccaccagcgcgcaccgucgccacggaucgccgcccccacccagccgggcgccccggaccc

SEQ ID NO: 147329 - RNA, 64 nt, Human
ccagcucccuugaccuaccuuccuccccgcaccccgcccccaccuugugccccuguguccagcc

SEQ ID NO: 147330 - RNA, 64 nt, Human
ggagcacccugggauccuggagggagaggccccacgcccccacucucccuccacacuuccaggg

SEQ ID NO: 147331 - RNA, 64 nt, Human
gcuucacuuaaugcagccgcgccccggcccgcuccgcccccagcaccgccccgggggccgcccc

SEQ ID NO: 147332 - RNA, 64 nt, Human
cuucccaggauuucaucucaccauaucugugugccgcccccagcaccccccacccaccucuggg

SEQ ID NO: 147333 - RNA, 64 nt, Human
caucuacaccccaggagcccuggccuggcccuaccgcccccagcccuaccagccgcccgcccug

SEQ ID NO: 147334 - RNA, 64 nt, Human
agugggcgcgggagugagcugaggaacuggggugcgcccccaugagauucccaaugccaugggc

SEQ ID NO: 147335 - RNA, 64 nt, Human
gcagcugaugacagagagaggcucuacaaagaagcgcccccaaagagugcagcugcuaauuuua

SEQ ID NO: 147336 - RNA, 64 nt, Human
ucugggugcuuuauucucuucuuuuucuuuauuucgcccccacccccauccccugccuuuuuuu

SEQ ID NO: 147337 - RNA, 64 nt, Human
cacuggacaacacugauuccuggagagguggcugcgcccccagcuucucucucccugucacaca

SEQ ID NO: 147338 - RNA, 64 nt, Human
gauucuucuauauuguacagaguggggcaaaacacgcccccaucugcugccuuuucuauugccc

SEQ ID NO: 147339 - RNA, 64 nt, Human
cuucugggacuggacagcuuugcuccgcucccaccgcccccaccccuuccccaggcccaccauc

SEQ ID NO: 147340 - RNA, 64 nt, Human
gguccgugugagcaggcccaccuggcuccagacccgcccccaaccugagacagaaccaggcuga

SEQ ID NO: 147341 - RNA, 64 nt, Human
acccccacccccguuugcugggggcuccuccagccgcccccaugggaagaggccugguaccgcc

SEQ ID NO: 147342 - RNA, 64 nt, Human
cgucccucuuccggaugucggacuaagcgaacagcgcccccacugccggccgguagcagccgga

SEQ ID NO: 147343 - RNA, 64 nt, Human
agucgcuccaggcccccucacccucaaaguguagcgcccccaaccgagcaaccucgguuugguc

SEQ ID NO: 147344 - RNA, 64 nt, Human
ggggacaugacuucuggacagaggacaugggccacgcccccaugcauccccacccccgccccuc

SEQ ID NO: 147345 - RNA, 64 nt, Human
agcuggccugcgagugaccccagcagccccucagcgcccccagagcccgucagcgugggggaaa

SEQ ID NO: 147346 - RNA, 64 nt, Human
cagauuacagagggguauugauuugccuugcccccgcccccaccaucacagugugucccugucc

SEQ ID NO: 147347 - RNA, 64 nt, Human
cuuugaggagcauggaacucgaggggagaagucgcgcccccagggaagccagguaaggaggccc

SEQ ID NO: 147348 - RNA, 60 nt, Human
accgcuuccacaugagcuaaagcccucccgcgcccccaccccagaccccgagccacccca

SEQ ID NO: 147349 - RNA, 64 nt, Human
aucaaacaugcagcccccacaccccucgucugcccgcccccagaucuucccucugugcucccug

SEQ ID NO: 147350 - RNA, 64 nt, Human
ccaggccuguguagugucucuccccugcugcgggcgcccccaccccgauuccucuccccagaag

SEQ ID NO: 147351 - RNA, 64 nt, Human
ugaaucuguacccuucgggagggcacucacaugccgcccccagcagcuccccugggggcuagca

SEQ ID NO: 147352 - RNA, 64 nt, Human
gccccugccacagggcacuggaauggacagcaggcgcccccagaugcagguaccucccuugguc

SEQ ID NO: 147353 - RNA, 64 nt, Human
aggaccagggcgagcccuggagcgccggagcggacgcccccagggagcuggggacacccccaug

SEQ ID NO: 147354 - RNA, 64 nt, Human
gcauacuuggcucucacauacuaaaugcuaguagcgcccccacccccacgcccagucacgguga

SEQ ID NO: 147355 - RNA, 64 nt, Human
agaaaagaggccagcucugcagcccccucggggacgcccccaccagcucaaauuccgagugcag

SEQ ID NO: 147356 - RNA, 64 nt, Human
ggccgccgccaggacuguguuuccaaagguuccccgcccccaaccccagcaucagccuguagcu

SEQ ID NO: 147357 - RNA, 64 nt, Human
gugccaacgggcucagagcuggaguugccgccgccgcccccacugcuguguccuuuccagacuc

SEQ ID NO: 147358 - RNA, 64 nt, Human
cuggagggaaggggauuuggagggaggcugucgucgcccccaggaaagacgggccugggggagg

SEQ ID NO: 147359 - RNA, 64 nt, Human
gaaguguguugugccugcugaagugaucaccccccgcccccagcccugcaucaggccacagguc

SEQ ID NO: 147360 - RNA, 64 nt, Human
cgucucgucuuuagaaagcuguuugaauuccccccgcccccaguuuggaccguguagauauaac

SEQ ID NO: 147361 - RNA, 64 nt, Human
gugcugguuagucuccagacccucacagcagccacgcccccaggcccaccgugcaugguguggg

SEQ ID NO: 147362 - RNA, 64 nt, Human
aucagcacaaucccggccccgcccucgcggcgggcgcccccagggccaggagagagagacaggg

SEQ ID NO: 147363 - RNA, 64 nt, Human
acuaaccugaccgugggcggggccuugcgguauccgcccccaauaaaagcaauuccaaccuucc

SEQ ID NO: 147364 - RNA, 64 nt, Human
gcgggggcgcccggggacaggagggauguccugccgcccccagccaggccgaacuccgcacucg

SEQ ID NO: 147365 - RNA, 64 nt, Human
gccucuaacagguaaugccaggggcccuucacuccgcccccaugacugggaagaggccuguggc

SEQ ID NO: 147366 - RNA, 64 nt, Human
agcaguuaaaaaaauaagucgccccuccaaaacacgcccccaucccacagcgcuccgcagcuuc

SEQ ID NO: 147367 - RNA, 64 nt, Human
ccgccagcuggccuccccuuuggcccacgccggccgcccccauucucugcugcguagaugcccu

SEQ ID NO: 147368 - RNA, 64 nt, Human
accccagcccggagagaacagagggaaggagccgcgcccccaccuggagcugaaucacaugacc

SEQ ID NO: 147369 - RNA, 64 nt, Human
cugcccgcggauaccuuggacuacggugccuucccgcccccaccaguggacacuuccggguggc

SEQ ID NO: 147370 - RNA, 64 nt, Human
agcucaaauagugccccuccuuaagcccaucccucgcccccagccugaggugaucuuucccucc

SEQ ID NO: 147371 - RNA, 64 nt, Human
ucagcaaagccuggagaaguggggccggaggcuccgcccccaucaugugccugccaccccuucc

SEQ ID NO: 147372 - RNA, 64 nt, Human
cccgcggcuccgcccaggcaugguagccugagcgcgcccccaggguaguagggggcaccugagg

SEQ ID NO: 147373 - RNA, 64 nt, Human
cacuggugcuuuucucuuuuguuuuagugccccccgcccccaucccuauaauaucuguaacuac

SEQ ID NO: 147374 - RNA, 64 nt, Human
gagccgugggcgggacccucaggcccgggcccgccgcccccagccccgccugccgccccucccc

SEQ ID NO: 147375 - RNA, 64 nt, Human
ccucugagagcauuuuccuguucccccuaucaaccgcccccagugauaacaucugugaagccag

SEQ ID NO: 147376 - RNA, 64 nt, Human
aagaaacacucaacaauaaagacugagacccguucgcccccaugugacuuuuaucuguagcaga

SEQ ID NO: 147377 - RNA, 64 nt, Human
gucccgugagucauccagcccugccuuuccccugcgcccccauccucucacgucccgccccgcc

SEQ ID NO: 147378 - RNA, 64 nt, Human
accuggggaagccacaucccacuggauccacacccgcccccacuucuccaucuuagaaaccccu

SEQ ID NO: 147379 - RNA, 64 nt, Human
uuuauaaggacuccaacccuguucaugaggguuccgcccccaugacccaaucagcuccaaaggc

SEQ ID NO: 147380 - RNA, 64 nt, Human
cucccaaagugcugggauuauaggcgugagccaccgcccccagcugauuccaggcgaauucuuc

SEQ ID NO: 147381 - RNA, 64 nt, Human
agacggcagcaggacuggggcugauagcccaccccgcccccacugcagcucccacaaagcacuc

SEQ ID NO: 147382 - RNA, 64 nt, Human
gguaggagaaaugggcccaugaucuccucacagucgcccccaguccuuggcccugcuucccugu

SEQ ID NO: 147383 - RNA, 64 nt, Human
ugcaggcuggagacuggaccgcugacugcaccagcgcccccagaacauacacugugaacucaau

SEQ ID NO: 147384 - RNA, 64 nt, Human
ucguacacacgcacauucauuacacaccuacauacgcccccaacacacgcgcacggugaagagg

SEQ ID NO: 147385 - RNA, 64 nt, Human
ccggggagcccgccagguggaccggcccgcgcuccgcccccagcgagccggggacccacccacc

SEQ ID NO: 147386 - RNA, 64 nt, Human
ucucuaaccucugcccucgcugcucuuggaauugcgcccccaagaugcucucucccuucuccaa

SEQ ID NO: 147387 - RNA, 64 nt, Human
aaggaaaaacaucuggccagggguagcuugauuucgcccccaaaaauacugaagacuaauccau

SEQ ID NO: 147388 - RNA, 64 nt, Human
cuccuucguaucccgagucugggacacaaaacuccgcccccagccuaugagcauccugagcccc

SEQ ID NO: 147389 - RNA, 64 nt, Human
gcacaggaagccuucacacuggaagggggaccugcgcccccacaucugaaaccuguaggucccc

SEQ ID NO: 147390 - RNA, 64 nt, Human
uugacauaagggucccacaggcuuccccaccccccgcccccacucacugccccagggaccaacu

SEQ ID NO: 147391 - RNA, 64 nt, Human
acugcacgagugucugugaggcgcugcgcggacucgcccccaggaacgcucuccucgagcccuc

SEQ ID NO: 147392 - RNA, 64 nt, Human
guauuuccuuccacuguagcuauuagcggcuccucgcccccaccaguguagcaucuuccucugc

SEQ ID NO: 147393 - RNA, 64 nt, Human
aaguaacaugugggucauaccuugaaccccccuccgcccccaugcucucuguggccuccaugcc

SEQ ID NO: 147394 - RNA, 64 nt, Human
ugggcaucaggccugggacacugcucuccuuccccgcccccagccugcuaaguuaaguggacag

SEQ ID NO: 147395 - RNA, 64 nt, Human
agcguuucuuuccaccuggagggaaagggggggacgcccccagugagauucaaaucacgcaucu

SEQ ID NO: 147396 - RNA, 64 nt, Human
uccaagugaggacuuggcucccccacuccuucgacgcccccacccccgccccccgugcagagag

SEQ ID NO: 147397 - RNA, 64 nt, Human
aggguggggaagggagggucucuugauuccuaaccgcccccacauacugcuccaccgcugaacu

SEQ ID NO: 147398 - RNA, 64 nt, Human
accgccccaccaccuccugggaccacaccacuaccgcccccaaccacagcagagacuagcagcg

SEQ ID NO: 147399 - RNA, 64 nt, Human
cacugacaugggaugcagcuaacugcaguugggucgcccccaggccaacgcuccucucaauccu

SEQ ID NO: 147400 - RNA, 64 nt, Human
guauauucucuugucuggcugcaccccuuuuucccgcccccagauugauaaguaaugaaagugc

SEQ ID NO: 147401 - RNA, 64 nt, Human
ugucuagguuugugcuucuagccaugcccauucccgcccccaccaugccucuuugcauugccca

SEQ ID NO: 147402 - RNA, 64 nt, Human
cgcagccacuccagcgccuccccuccgcuccccacgcccccauauuggcaacacccccagcgcc

SEQ ID NO: 147403 - RNA, 64 nt, Human
gagcaggcaagagaccgagccgcccuccucucaccgcccccacucccugccgugcuacacccag

SEQ ID NO: 147404 - RNA, 64 nt, Human
ucaucucaggauugagauucuauccccccuuccccgcccccagcagugucgcuccaauucaaau

SEQ ID NO: 147405 - RNA, 64 nt, Human
cucccaaagugcugggauuacaggcgugagccaccgcccccagccugagccuuuuuuuuuuucu

SEQ ID NO: 147406 - RNA, 64 nt, Human
cccgccccccggagguggcagcagccccgagggacgcccccagaggaccgggaggcaccccacc

SEQ ID NO: 147407 - RNA, 64 nt, Human
cggcucacuaucacaggaacagcauggaggaaaccgcccccaugauccaguuaccuccaccugg

SEQ ID NO: 147408 - RNA, 64 nt, Human
uagcuuuuuacccuuuaaguagcuccucuucccucgcccccacccucuaccccacccccaccuu

SEQ ID NO: 147409 - RNA, 64 nt, Human
gcuggagacggccacugagcgcuaccugcacguacgcccccagccuuuggcuggagaggauccc

SEQ ID NO: 147410 - RNA, 54 nt, Human
ccaucgucaucgaggacuaggggccgcccccaccugcggccgccccccgccccu

SEQ ID NO: 147411 - RNA, 64 nt, Human
cacucccagcacacccgcacacagccagcaccaccgcccccaccgugcacuucuccucucuggg

SEQ ID NO: 147412 - RNA, 64 nt, Human
gccccaacacaguacccaccaggacggggcacuccgcccccacccgucggcagagcaaccccac

SEQ ID NO: 147413 - RNA, 64 nt, Human
gaccuacaagaugggguacuaacaccacccccaccgcccccaccaccacccccagcuccugagg

SEQ ID NO: 147414 - RNA, 64 nt, Human
ccacaccccaaggcgguugccggagcuuaagccccgcccccagcagcgagaacaucccaccccu

SEQ ID NO: 147415 - RNA, 64 nt, Human
aggcaaggagcccggguuaaaauaucccccuauucgcccccaaaaugcaauaaaagaagauaaa

SEQ ID NO: 147416 - RNA, 64 nt, Human
ccacccacccgcaagccuaccagccuuguggccacgcccccacccggcugccacaagaauccaa

SEQ ID NO: 147417 - RNA, 64 nt, Human
uccuggccccucacucccggcagcgggccggccucgcccccacucccccuccuaccccggcagg

SEQ ID NO: 147418 - RNA, 64 nt, Human
accaagcagaggcccguggggcugaggauggagccgcccccagccgacuccaagcccgcagagg

SEQ ID NO: 147419 - RNA, 64 nt, Human
gaacgaacagccugacacauacgcacggggccgccgcccccaguaguuggucuuguacaugcgc

SEQ ID NO: 147420 - RNA, 64 nt, Human
acaacacacacagcccccugcaccgcccgccccccgcccccaccaaggccccagccucuggcca

SEQ ID NO: 147421 - RNA, 64 nt, Human
gccccuggugcccugagacagacacacagccucacgcccccaggaaugcaagugguuuccuggu

SEQ ID NO: 147422 - RNA, 64 nt, Human
uugaggaggccgcuccuucccagacacacccccacgcccccacuggacggcauuggaggaaggg

SEQ ID NO: 147423 - RNA, 64 nt, Human
aucucccccagccccauccucuguacagagcccacgcccccacuggugacaugucuuuucuugc

SEQ ID NO: 147424 - RNA, 64 nt, Human
gggacuaccugggaccuccaccguugguguucaccgcccccacccugagcgccuggguccaggg

SEQ ID NO: 147425 - RNA, 64 nt, Human
cugugguucugagauggcucccaggggcucccuccgcccccagguaggggccccucucagcccu

SEQ ID NO: 147426 - RNA, 64 nt, Human
ugcgucuacccagacucagagaccgugagcgccccgcccccaccccuacagccugcacacaccu

SEQ ID NO: 147427 - RNA, 64 nt, Human
ugaccgucccccccgcccgaccccaccgcccucccgcccccaccuggcguguaguacuguauaa

SEQ ID NO: 147428 - RNA, 64 nt, Human
acagcauccuaucaacugaaagagcagccgccgccgcccccagccggagaccccuuucguuuga

SEQ ID NO: 147429 - RNA, 64 nt, Human
aggcaucaggccccgcccaacggccucauguccccgcccccacgacuuccggccccgccccggg

SEQ ID NO: 147430 - RNA, 64 nt, Human
ccccccagggccaggucccagcuauguagacccccgcccccaccuccaacacugcacccuucug

SEQ ID NO: 147431 - RNA, 64 nt, Human
cagaugucucuuuuguguuuuggccaccuggggccgcccccaaccuccccaccccaagaggggu

SEQ ID NO: 147432 - RNA, 64 nt, Human
ggccagguuuccugaaaggcgggagucagaccuccgcccccagccagagcaagcuuggggcacc

SEQ ID NO: 147433 - RNA, 64 nt, Human
cuggaccuucaaagggcuuuguauuuuacaccugcgcccccaggcugcucacagucggcuugcu

SEQ ID NO: 147434 - RNA, 64 nt, Human
gggaagagugugggggaggcgcacagugugagcccgcccccacgucgugggguaacaucuguua

SEQ ID NO: 147435 - RNA, 64 nt, Human
cugcgaggaccgccucggcagguggcgguaaaagcgcccccaucaagucacauaacauccugcc

SEQ ID NO: 147436 - RNA, 64 nt, Human
ccgcaagggccagguguugacaccuuaaagcuggcgcccccagccccacucuuggcugugcugg

SEQ ID NO: 147437 - RNA, 58 nt, Human
acuacguggaggccaucugaacccgcagcgcccccaucugucuucagcacauuccacg

SEQ ID NO: 147438 - RNA, 54 nt, Human
acggugagaccaccgugugagggacgcccccaggccggaaccgcgcggcgcuuu

SEQ ID NO: 147439 - RNA, 64 nt, Human
aguuugcucgcuuuccuccccugccggcccccuccgcccccacacacacucgggacgucuucau

SEQ ID NO: 147440 - RNA, 64 nt, Human
cgcccucuccugacuuguauuguggcagucugaacgcccccagaaaauugugccaaagaguuua

SEQ ID NO: 147441 - RNA, 64 nt, Human
gguuuuguuguuccccuucccucacacccugccucgcccccacuuuucuaguuaacuuuuucca

SEQ ID NO: 147442 - RNA, 64 nt, Human
cccaccuucucucccuccucccgacccgcccccucgcccccaccccuguguguuucgccaguua

SEQ ID NO: 147443 - RNA, 64 nt, Human
ucaucucccugccaucccccucucacgccacccccgcccccaccgggcugcaggugcugcugau

SEQ ID NO: 147444 - RNA, 64 nt, Human
gggcgaggucccgcccucccguggucacuggcuccgcccccagcaccaggcgcccaguggagcc

SEQ ID NO: 147445 - RNA, 64 nt, Human
gugcaguggcaccaucuuggcucacuucaaccuccgcccccaagguucaagugauucuccugcc

SEQ ID NO: 147446 - RNA, 64 nt, Human
cuaccacuccgaucgcaauagauaacauugccaucgcccccaccaguccccucaugccucuggg

SEQ ID NO: 147447 - RNA, 64 nt, Human
cuccuuguuccgagcccuugcuccuuaggauccccgcccccaccugcccccaaugcacacacag

SEQ ID NO: 147448 - RNA, 64 nt, Human
cgcgcgcggacuggcgucuccccucccggcgauccgcccccagcacuggggaggcgccacugaa

SEQ ID NO: 147449 - RNA, 64 nt, Human
ucccugccggggccugcuggccccuguaaggucccgcccccaaagacccuggggccagcggggc

SEQ ID NO: 147450 - RNA, 64 nt, Human
ccccaggugggccuuguacccccagcucuggcagcgcccccaggauugaacguggggagcccca

SEQ ID NO: 147451 - RNA, 64 nt, Human
caggguggcuuaauccagaggcccugucauggcccgcccccagccaugggaaagcaaacuucau

SEQ ID NO: 147452 - RNA, 64 nt, Human
aauucuagacauacguggucugcggacagggcagcgcccccagcccaugacaagggagucuugu

SEQ ID NO: 147453 - RNA, 64 nt, Human
gcaccugcagccugaaacgcaccgcuccugcgugcgcccccaccugguccccggaugcccccac

SEQ ID NO: 147454 - RNA, 64 nt, Human
ggagcccggccccccaugcagccaugacuggaugcgcccccaucucgggggcuugcugcacugc

SEQ ID NO: 147455 - RNA, 64 nt, Human
gaaggugggucuuaaaacagaccaaaccccgccccgcccccaacaacucugcuuuuagggaggc

SEQ ID NO: 147456 - RNA, 64 nt, Human
gaaccccccucccacccaccgccacaauaaagaucgcccccaccuccacccucacccucuccug

SEQ ID NO: 147457 - RNA, 64 nt, Human
gggaccgagugagccacuccuugucccgagcucccgcccccacugggcccuccuuccuccuggu

SEQ ID NO: 147458 - RNA, 64 nt, Human
ccucuaaucaagucacgugauucucccuucaccccgcccccagggccuucccuucugcccccag

SEQ ID NO: 147459 - RNA, 64 nt, Human
aggaaggucccauggccugcugggcuuggcucggcgcccccaccccuggcuaccuugugggaau

SEQ ID NO: 147460 - RNA, 64 nt, Human
ccccgccccagccggcggacugugcuguuuccuccgcccccacucccguguuuucugaccuccu

SEQ ID NO: 147461 - RNA, 64 nt, Human
uggguccuguggaggccagcagcgguguggcccccgcccccaggcugccugugucuucaccugu

SEQ ID NO: 147462 - RNA, 64 nt, Human
agggcaggggaagcggagaccagggugcaggcuccgcccccacccaaggccgggcccagccaga

SEQ ID NO: 147463 - RNA, 64 nt, Human
gagaggcagccccggccugaccggccccccgccccgcccccaccccgcccccaggccuaaaugu

SEQ ID NO: 147464 - RNA, 64 nt, Human
ccggccugaccggccccccgccccgcccccaccccgcccccaggccuaaaugugcacagcaugc

SEQ ID NO: 147465 - RNA, 64 nt, Human
cacaguuaacaugucagcuggcccuccaggcccccgcccccaucccguccacguugcugugucg

SEQ ID NO: 147466 - RNA, 64 nt, Human
cacgagggaggggagucgggccccaggucgcccccgcccccagcccugcaugcaggugcccucg

SEQ ID NO: 147467 - RNA, 64 nt, Human
gguaguuuccuccccccuuucccggcgccccucccgcccccauucaacaucucucauccuaucc

SEQ ID NO: 147468 - RNA, 64 nt, Human
ggcgcgccccugcggcucccgaggguccaggccccgcccccaaaggaccaggacucgccccaaa

SEQ ID NO: 147469 - RNA, 64 nt, Human
ccagggucgacccugcccccuugggcucaggccccgcccccaggauccuacggauugagguccu

SEQ ID NO: 147470 - RNA, 64 nt, Human
ccacacucuccacccuguggucuuguuccguccccgcccccaucuagccccaccuuugagaacu

SEQ ID NO: 147471 - RNA, 64 nt, Human
ccgccccugcagacccucccugcacuggcucccucgcccccagccccggggccugagccguccc

SEQ ID NO: 147472 - RNA, 64 nt, Human
uggcuccccagaguaucuucccacugagacacgccgcccccacagaggcacaguccccagccac

SEQ ID NO: 147473 - RNA, 64 nt, Human
gggagcugaguaguggggauccagagaggacccccgcccccagagacuugguuuuggcuccagc

SEQ ID NO: 147474 - RNA, 64 nt, Human
acagagcccccagacccaccagaacuuccacagacgcccccacuagcuacuccacgaagccccc

SEQ ID NO: 147475 - RNA, 64 nt, Human
gcucugacugccccuugcgcucugggcuuccugccgcccccagcuuugccuggacacugacuuc

SEQ ID NO: 147476 - RNA, 64 nt, Human
aggguccuuccagacagucucagccucuccccgccgcccccaacaggcugucaaacaaaaccgg

SEQ ID NO: 147477 - RNA, 64 nt, Human
agaaacugcugcugauggagaccaggacagagcccgcccccacccggcccgcagccccuccugc

SEQ ID NO: 147478 - RNA, 64 nt, Human
gugcugggggcacagccccuccccacuccggccacgcccccacccaccccgcguguuucugccc

SEQ ID NO: 147479 - RNA, 64 nt, Human
ucuucccauucucuuuggcaagaaguccccuucucgcccccaaaccagcaagggacucccccac

SEQ ID NO: 147480 - RNA, 64 nt, Human
gcugcugcuuuguccgucuauccacccgcccacccgcccccaccccaccggcagcguccaggug

SEQ ID NO: 147481 - RNA, 64 nt, Human
aaccaggauuuuguguuuuuucguuccccccacccgcccccagcagauggaaagaaagcaccug

SEQ ID NO: 147482 - RNA, 64 nt, Human
ccccgguguccccacguuuggugucuggcuauggcgcccccaucugacuguccagcucucucuc

SEQ ID NO: 147483 - RNA, 64 nt, Human
uguccccccaaccuaaccagaccuggugccuugacgcccccaccccagcugggacgguacagag

SEQ ID NO: 147484 - RNA, 64 nt, Human
uggggcuggacaucacugcaguccagugcaaagccgcccccagagcccagguguccccccaacc

SEQ ID NO: 147485 - RNA, 64 nt, Human
uaugcucacagcgcccgacacaacccccucccgccgcccccaaccacccagggccaccaucaga

SEQ ID NO: 147486 - RNA, 64 nt, Human
gcugcucagagccaagggggcagagggcuuucagcgcccccaggccugcccugcuauuucaggc

SEQ ID NO: 147487 - RNA, 64 nt, Human
caccuuggcccccacccccuccacuaucuccugccgcccccacucuggcuggcuucucuccccu

SEQ ID NO: 147488 - RNA, 64 nt, Human
auaaaaggccagcgggcggcgucugggucucuggcgcccccaugugguugcgacacucccaaag

SEQ ID NO: 147489 - RNA, 64 nt, Human
ggggcccuggacugccccuuccucccccaucgcccgcccccagaaccccugaugcugguuagga

SEQ ID NO: 147490 - RNA, 64 nt, Human
ucaccuacugagcccaccgucagcggggcgcgcacgcccccaaaccagcuguuuacauacagga

SEQ ID NO: 147491 - RNA, 64 nt, Human
uggcccuggccgucuauccuaccccuuuagugaccgcccccaucccggcuuucugagcugaucc

SEQ ID NO: 147492 - RNA, 64 nt, Human
cgaacccgaguccgcgcugggggagccucgcccccgcccccaccgggugaaagugucgucuccg

SEQ ID NO: 147493 - RNA, 64 nt, Human
ggcugugccaggcugggaggcucggggcuccccacgcccccaugcagugaccgcuuccccgaug

SEQ ID NO: 147494 - RNA, 51 nt, Human
ugcucagccucaacugcugagcgcccccacucccggccgcgagcaggcagg

SEQ ID NO: 147495 - RNA, 64 nt, Human
gcgcuucugcgcucucucccuucuccccucaccccgcccccaccagcccagugcgcccugccgc

SEQ ID NO: 147496 - RNA, 64 nt, Human
agaaaaguugugucucccuuagaugagaucuagacgcccccaaauccuugagauguggguauag

SEQ ID NO: 147497 - RNA, 64 nt, Human
uggggugcagauccugaugggugccugccucccccgcccccagccggugcucagguggcccagg

SEQ ID NO: 147498 - RNA, 64 nt, Human
cuagaugcaacuuuuguuccuccucccccacccccgcccccagcuucaugcuucucuuccgcac

SEQ ID NO: 147499 - RNA, 52 nt, Human
aguccuccuccgaggccuaggccgcccccagcagcacagaccccgccgccuc

SEQ ID NO: 147500 - RNA, 64 nt, Human
uccagaggaagggacugucgggcacccccuuccccgcccccaccccugggacguuaaagugacc

SEQ ID NO: 147501 - RNA, 64 nt, Human
cccccagccucgcacuguguccuuggggaaggcccgcccccauccuggccggugucacuguggc

SEQ ID NO: 147502 - RNA, 64 nt, Human
aacgaaggcaaugcugcucccugaguccaguccccgcccccaaacccagcccaggugccuucag

SEQ ID NO: 147503 - RNA, 64 nt, Human
cuccucacaccaggcccggcuggccacccacccucgcccccacuggccaccccucccucgcccc

SEQ ID NO: 147504 - RNA, 64 nt, Human
uguggccaccuggggcugccacuguccuccagcccgcccccagccuguggacgccuggcccacc

SEQ ID NO: 147505 - RNA, 64 nt, Human
ugcccgcccgcauggccagccaguggcaagcugccgcccccacucuccgggcaccgucuccugc

SEQ ID NO: 147506 - RNA, 64 nt, Human
ucaauaaaaauugaugucagugcaggcccaggcccgcccccagauacacuaguuucuaggucug

SEQ ID NO: 147507 - RNA, 64 nt, Human
gcuggcuggugggguggcccgaguuccccuucaccgcccccagggaggguuucccaccucagag

SEQ ID NO: 147508 - RNA, 64 nt, Human
cauccccaaccucuguccgcaugccuggggccuucgcccccacgugcucgacaggggaacccgc

SEQ ID NO: 147509 - RNA, 64 nt, Human
cgugcccugcuggaggacagaggggcaccucagccgcccccaagcccagagcacagcaauaagg

SEQ ID NO: 147510 - RNA, 64 nt, Human
cagaggggcugagcaggacgccgcuggugcuggccgcccccagcccccuccuggugccaccuca

SEQ ID NO: 147511 - RNA, 64 nt, Human
cgcagucgucagccucccugacgucugccaccagcgcccccacuccuccuccuuucuuugcugu

SEQ ID NO: 147512 - RNA, 64 nt, Human
gccuugcucacagcugauugggcaccugaccacacgcccccacaggcucugaccagcagccuau

SEQ ID NO: 147513 - RNA, 64 nt, Human
gagggacagucggccuggaccggaccucuccuuucgcccccacacccccuccccuugccagcug

SEQ ID NO: 147514 - RNA, 64 nt, Human
uuucuggucaacccauuuuugucccucaucaccccgcccccaccuuucgcuccugcccucugcc

SEQ ID NO: 147515 - RNA, 64 nt, Human
cuccaccugacacaaccguccccggccccugccccgcccccaagcucggaucacaugaaggaga

SEQ ID NO: 147516 - RNA, 57 nt, Human
uuggagaagcugagcagugauuguggccgcccccagccccugcugccccagccugug

SEQ ID NO: 147517 - RNA, 64 nt, Human
ccuccuaugagugagagggagggccucagucuuccgcccccagcccacucucaugguccacacu

SEQ ID NO: 147518 - RNA, 64 nt, Human
agcaguccacgcccucaccagaggaugccaccuccgcccccacccccgccgccagaggaguaca

SEQ ID NO: 147519 - RNA, 64 nt, Human
uggucggugcccagaaagucucuucugccacugacgcccccaucagggauugggccuucuuucc

SEQ ID NO: 147520 - RNA, 64 nt, Human
ucgggugaggccagcuggagaacugcaacgccuacgcccccagucgugucgcgucuguuuuccu

SEQ ID NO: 147521 - RNA, 64 nt, Human
uccaccccaagucauacacuggacccagugccugcggggacaggacuguggguuucuuggucac

SEQ ID NO: 147522 - RNA, 64 nt, Human
gcccccccuccccauagccagcacagcuaucccgcggggacaccagcacugagcccccucuccc

SEQ ID NO: 147523 - RNA, 61 nt, Human
agugccugucagagcccugagggguguccaccggggacagacccaggggcgggcagagagg

SEQ ID NO: 147524 - RNA, 64 nt, Human
aagcagggccagucucagggcccggagacgaacacggggacaauugucaaaggagcgggggagg

SEQ ID NO: 147525 - RNA, 64 nt, Human
gagggacgagggccagacugaagcagcacaaggccggggacacccaugccaagcagugggagca

SEQ ID NO: 147526 - RNA, 64 nt, Human
uccccccacguagggcacuguaguggaccaagcacggggacagccaugggucccgggcggccuu

SEQ ID NO: 147527 - RNA, 64 nt, Human
guugcauuggcaguuaaguuuccacguaaacuuucggggacacauucaaaccacaggagaaacu

SEQ ID NO: 147528 - RNA, 64 nt, Human
gccacauaccaaaucugggugaaaggaaaggggccggggacaggaggguguccacauauguuaa

SEQ ID NO: 147529 - RNA, 64 nt, Human
gccauccgaccaaggucuccugugcugaaguugccggggacaggcagggaaaagggguuggggc

SEQ ID NO: 147530 - RNA, 64 nt, Human
gccaggaccgucgagaccaccagagcuaccuccccggggacagcccacuaagguucugccucag

SEQ ID NO: 147531 - RNA, 53 nt, Human
ccggcugcuugccccgaugaagccggggacacuccucugcccagcaaggagcc

SEQ ID NO: 147532 - RNA, 64 nt, Human
guuuuuguuuuuguuuucuuuccaaagcucaccucggggacaauuccuugggcuucuccugagg

SEQ ID NO: 147533 - RNA, 64 nt, Human
cauauccugagguggaucaggcaggcucucuccccggggacaugaggcacccauaccuaggacc

SEQ ID NO: 147534 - RNA, 64 nt, Human
gcgugagcucgggcugcccggccgggcgugcgggcggggacaugguaaccugguccacggaggg

SEQ ID NO: 147535 - RNA, 64 nt, Human
uagcauaguacaaucagaaccucguggagaccaccggggacaggcuugcggacgccggcuguuc

SEQ ID NO: 147536 - RNA, 64 nt, Human
uuuuguaucuacauuuuuccccuccugggguuugcggggacagggacagaacuacaggagucau

SEQ ID NO: 147537 - RNA, 64 nt, Human
ccaccaaucuuguuuguccaucuacaugguuugucggggacauuuaacucauggaggugcuuua

SEQ ID NO: 147538 - RNA, 64 nt, Human
guagugaaagaaugagcuagcaaaugaguuuuagcggggacaaaaaaucaaacaaaaaagugaa

SEQ ID NO: 147539 - RNA, 64 nt, Human
ccucccgccccuucccacucaccccggcagacgccggggacagaggccugcccgggcgcggcca

SEQ ID NO: 147540 - RNA, 64 nt, Human
gaaaggcagcccauuuuaccauugccagccaggccggggacacaggagccggugugugcacucu

SEQ ID NO: 147541 - RNA, 64 nt, Human
gcuuauguccacaggccagggccugugcugcagucggggacaaggagcuuccgucuggcaaggc

SEQ ID NO: 147542 - RNA, 64 nt, Human
ccucaggaguccuggaaccaaccccccacagauacggggacaacuuuaugacauuguuuuucaa

SEQ ID NO: 147543 - RNA, 64 nt, Human
agaggacccaccugggccaaggacuccaaagccgcggggacaccgggaagugcagcgggccagg

SEQ ID NO: 147544 - RNA, 64 nt, Human
cccccaguucaagacuuagcuccuguugucaugacggggacagagugagggaaugguaguuaag

SEQ ID NO: 147545 - RNA, 64 nt, Human
gaagcuauauuuuucacagaagaagaagcagugacggggacacaaauucuguugccugguggaa

SEQ ID NO: 147546 - RNA, 64 nt, Human
cugauggagaacacagaggacuggcggccgcggccggggacaggccagucgcguuccuuccgca

SEQ ID NO: 147547 - RNA, 64 nt, Human
caggccucccucagggccaggggcgauggcaccccggggacaggcagaccuccuuccugccguc

SEQ ID NO: 147548 - RNA, 64 nt, Human
cuaagaacaggauaauccaaccuacgugaccucccggggacaguggcugugcuuuuaaaaagag

SEQ ID NO: 147549 - RNA, 64 nt, Human
ugagaaugggaagcauccauucauugggaaaucacggggacagaggaggaauucacgggaucag

SEQ ID NO: 147550 - RNA, 64 nt, Human
ggcaccugagcacgcugugagcccagcgggccugcggggacaggccaggccugaucccaccuca

SEQ ID NO: 147551 - RNA, 64 nt, Human
agaacaacugauccuguguuuaccccaagcccggcggggacacgcucacagaugucaccacagc

SEQ ID NO: 147552 - RNA, 64 nt, Human
cagggucaggagacggggcugacggcacggguggcggggacagacguuugggacuuggccgcga

SEQ ID NO: 147553 - RNA, 64 nt, Human
gcaacaugauauuuggguagcugaugucauaauucggggacaauuaucucaaucaucaagaaaa

SEQ ID NO: 147554 - RNA, 64 nt, Human
cugucucuagagccuucaucgucuggcuggccaacggggacacccuccgugucuucaagaugac

SEQ ID NO: 147555 - RNA, 64 nt, Human
cgcggagggaggcugagagggccgggccgggcggcggggacacggcgguaccguccugcgcucg

SEQ ID NO: 147556 - RNA, 64 nt, Human
ucacucuugaccuuacucccgguuggccugggggcggggacagagacggagaccucugccuaug

SEQ ID NO: 147557 - RNA, 64 nt, Human
gggacggcacggccgcucaccggaaggcugugugcggggacauccgagguggugguggacagga

SEQ ID NO: 147558 - RNA, 64 nt, Human
uaguucacuuacucuuacacccgacgcuuaccagcggggacaccaauggcugcaucaaaugcau

SEQ ID NO: 147559 - RNA, 60 nt, Human
ucauggagggugugcuguagcgggggcgcccggggacaggagggauguccugccgccccc

SEQ ID NO: 147560 - RNA, 64 nt, Human
guggcccagagccauacugcguccacccugagcucggggacaggugacaguggcugcucuggga

SEQ ID NO: 147561 - RNA, 64 nt, Human
gagaacacacucuggaauucucuauucuccuggucggggacagucagagaugaugggggagaug

SEQ ID NO: 147562 - RNA, 64 nt, Human
ugcaaaugaaaagucuugauggcauggacuggagcggggacaguggggauggagaaaggggaau

SEQ ID NO: 147563 - RNA, 64 nt, Human
uggccuugccugucgaggcaagaggcugcagaggcggggacacaccuguguccuccgggagagg

SEQ ID NO: 147564 - RNA, 64 nt, Human
gcuccaggcugccaaguguuuuccuuuagccgggcggggacagacagagccggaagcgcagucg

SEQ ID NO: 147565 - RNA, 64 nt, Human
gaacagcuagaggacaacucuguuggcacagagacggggacagcccagucugcugaccucacag

SEQ ID NO: 147566 - RNA, 64 nt, Human
auaaacaccccaaagcgcugcggucggucaagggcggggacagccacacugcgcgcggggcccg

SEQ ID NO: 147567 - RNA, 64 nt, Human
ggaggcucccgaggggaaggggcggugcccacaccggggacaggccgcagcuccauuuucuuau

SEQ ID NO: 147568 - RNA, 64 nt, Human
ggacaguaggcggaggaccaggugaggucagcaucggggacacagguggggccacucacuggua

SEQ ID NO: 147569 - RNA, 64 nt, Human
ccagcugcucucaauggcuuccagguguguuguucggggacagccaccgccuugagucuggcca

SEQ ID NO: 147570 - RNA, 64 nt, Human
acccuggacagggccccccccaccaucuguaaaacggggacaguaugauguaccuugaagggcu

SEQ ID NO: 147571 - RNA, 64 nt, Human
uaaaaaauaaauaaauacauaaaaagcaaacaagcggggacaccugcagucuuagucacugaca

SEQ ID NO: 147572 - RNA, 64 nt, Human
uccgcugcguggaggugucggacgaucaggacaccggggacacucugggcagcguccuccgggg

SEQ ID NO: 147573 - RNA, 64 nt, Human
caaaugaaccccccugaccuuuccuggugggaaacggggacaguacgauguuaccaagugaauu

SEQ ID NO: 147574 - RNA, 63 nt, Human
cccagaaagagccagccugagagacagugggcacggggacagugaucaggcugacagugacca

SEQ ID NO: 147575 - RNA, 64 nt, Human
ggauaaaaucagagugguccucacaccuagaggacggggacaaccagcuuucagaguagccuca

SEQ ID NO: 147576 - RNA, 64 nt, Human
agauggagaccccccugugacugacucuucuucucggggacacaggccagcuccacaguguugc

SEQ ID NO: 147577 - RNA, 64 nt, Human
acagcccccgaucugcauagccugugaaagcccacggggacaucaguaaccuucugcagccacc

SEQ ID NO: 147578 - RNA, 64 nt, Human
cuaugacaaaaccuuuaaucugcaccuuacaacucggggacaaauggggacaggaaggaucaag

SEQ ID NO: 147579 - RNA, 64 nt, Human
cugaagcugagcccagcccagacccagcugcucccggggacaugugcuagaugauacuguacau

SEQ ID NO: 147580 - RNA, 64 nt, Human
uuacacgagagcacacucgaucccccuaggccagcggggacaccccagccacacagggaggcau

SEQ ID NO: 147581 - RNA, 64 nt, Human
ggaugagaaccuuccugcugugaugugacaccuucggggacauugaccacucaaaacucagauc

SEQ ID NO: 147582 - RNA, 64 nt, Human
cgccccgguguuggcccucgccauggagcagaggcggggacagcuggccaccgugucccaggac

SEQ ID NO: 147583 - RNA, 64 nt, Human
cgagugaccaccaagaggaagacccaccccacggcggggacagaugcgggguacguuaaaggga

SEQ ID NO: 147584 - RNA, 64 nt, Human
cugcucacauaucugucauuugagcagggcucagcggggacagcuccuucuguccuacucugug

SEQ ID NO: 147585 - RNA, 64 nt, Human
cuucaucugaacuucagauauuucacaugugaagcggggacaaaaccaugcagcucagaggucc

SEQ ID NO: 147586 - RNA, 64 nt, Human
gccaguggggucgugaggcaagauccccgccacccggggacaucuucaaucuaggcgaggcgaa

SEQ ID NO: 147587 - RNA, 64 nt, Human
agaggugaaagcauuguuacuuacuuguggaagucggggacauaagaugauuuucacaucccag

SEQ ID NO: 147588 - RNA, 64 nt, Human
uaucucagccauccgcagacugcuuggccagaugcggggacaggcuggaaugagggaggcgucu

SEQ ID NO: 147589 - RNA, 64 nt, Human
uuucccuccgaagggcugcucuuccccacaggcgcggggacagcagcccgaccuguggucucca

SEQ ID NO: 147590 - RNA, 64 nt, Human
accaauuucuaagaggacuggauugcagaagacucggggacaacauuugauccaagaucuuaaa

SEQ ID NO: 147591 - RNA, 64 nt, Human
guuggggugggacacccguaccgcggcuggcuggcggggacaggcuagaggagacagcaagucc

SEQ ID NO: 147592 - RNA, 64 nt, Human
cuguguuggcuggagagggauggggugggcccaacggggacacaaggaggcagaggagcuaacc

SEQ ID NO: 147593 - RNA, 64 nt, Human
augucccacccacccgccgccucccacggcaccucggggacaccagagcugccgacuuggagac

SEQ ID NO: 147594 - RNA, 64 nt, Human
guggggguggggcugggacgcuguuugugcucagcggggacagccaggguugaucuggccccga

SEQ ID NO: 147595 - RNA, 64 nt, Human
caguggacaauggagucugggggagggggaaccccggggacaugcccccacccgggaggggccg

SEQ ID NO: 147596 - RNA, 64 nt, Human
gcugaauacagugaacagggacauucccgccacucggggacagaugggcacaagggaggggaaa

SEQ ID NO: 147597 - RNA, 64 nt, Human
ucccaggccagggaaagcccgugucaaugaaugccggggacagagaggggcagguugaccggga

SEQ ID NO: 147598 - RNA, 64 nt, Human
ccacuucugagcacagagcagagacagacgcaggcggggacaaaggcagaggauguagccccau

SEQ ID NO: 147599 - RNA, 64 nt, Human
cggagcuggccccgccgccugguacucaagcccgcggggacauugggaaggggacccccgcccc

SEQ ID NO: 147600 - RNA, 64 nt, Human
cucaugguuuuuaaaacucugauggggagggugucggggacaccggggcaaaacaagaaagucc

SEQ ID NO: 147601 - RNA, 64 nt, Human
ccccccccccggaagccacugcacacagacagaacggggacaggcggcgggucuuuuguuuuuu

SEQ ID NO: 147602 - RNA, 64 nt, Human
caccgccucccgggccugcugucagcuugcagcccggggacagaggccagcugggaucugccug

SEQ ID NO: 147603 - RNA, 64 nt, Human
ggaguuugaaccccccccacucugcagagggaagcggggacaaugccgggguuucaggcaggag

SEQ ID NO: 147604 - RNA, 64 nt, Human
gacagccgugcccagacugugcguuugcuuagcucggggacagcacuuggcccggggucuccug

SEQ ID NO: 147605 - RNA, 64 nt, Human
agagcauggacagguggauaguaaaucaccaccacggggacagccgugcccagacugugcguuu

SEQ ID NO: 147606 - RNA, 64 nt, Human
acacagagaaacaaccacgcagacagucacaccacggggacacacggacagacgcagacggaca

SEQ ID NO: 147607 - RNA, 64 nt, Human
uucccggccacgccccccaggaccccugccccuccggggacaccggccccgcccucagcccacu

SEQ ID NO: 147608 - RNA, 64 nt, Human
gcucuguaaaauggaccaaucagcaggacaugggcggggacaauaagggaauaaaagcuggcga

SEQ ID NO: 147609 - RNA, 64 nt, Human
accucugugugccucaacuuccuccucuguaaaacggggacagucccugccccucccuaccuca

SEQ ID NO: 147610 - RNA, 64 nt, Human
cagggguaccuucuggccccaacccuugacucaacggggacaacuccagaaggucauuccagau

SEQ ID NO: 147611 - RNA, 64 nt, Human
uccuguucugugucugcuguaagacggccuuggacggggacacggccucuggggagaccgagug

SEQ ID NO: 147612 - RNA, 64 nt, Human
cugggagcccauucccagugcuucccaaggcccucggggacaucuaccgccaacccagcugcuu

SEQ ID NO: 147613 - RNA, 64 nt, Human
accuaugcaugccaaaacuguucuaggucgacugcggggacagaacaaaaaucaaaacaaagaa

SEQ ID NO: 147614 - RNA, 64 nt, Human
gauuuuacuaaaaaaaaaaaaaaaaaagagagggcggggacaaauaucaaauuaagcaaguaaa

SEQ ID NO: 147615 - RNA, 64 nt, Human
agcugcccccccauccccgcucccgccgcuacuccggggacagugacuccucagccuccuccgc

SEQ ID NO: 147616 - RNA, 64 nt, Human
uaucaggaacgcaggccuggggagcccccaguggcggggacagggccagauuucauguugaccc

SEQ ID NO: 147617 - RNA, 55 nt, Human
auguggaggcgauccagugaugagucggggacaggccagcggggggacggaggcg

SEQ ID NO: 147618 - RNA, 64 nt, Human
uguccacuuguguccacacaggcccugggaggagcggggacacugaggaccucucuccaaauug

SEQ ID NO: 147619 - RNA, 64 nt, Human; identical to SEQ ID NO: 147532

SEQ ID NO: 147620 - RNA, 64 nt, Human
gcagggcuggggcugggugaggguggcgggccugcggggacauucuacugugcuaaaaagccac

SEQ ID NO: 147621 - RNA, 64 nt, Human
auucugaggaugacaauuccacaugagauuugggcggggacacacauccaaacuauauugucaa

SEQ ID NO: 147622 - RNA, 64 nt, Human
uauuuuucaauuuguuuuuucaaaaaucucuucucggggacaacaucugaaggguauguugcau

SEQ ID NO: 147623 - RNA, 64 nt, Human
ggagccguagauuccgugccugccgccgcagcgccgccgacaacgcgggugcaggggggcgcgg

SEQ ID NO: 147624 - RNA, 64 nt, Human
gcauccuucggaccucaccacgcgaaacuacgcccgccgacagaaacaucugcaaagauacagu

SEQ ID NO: 147625 - RNA, 64 nt, Human
cuugcgcaggcacagaggacgaggagcaagcuggcgccgacauggcgaaggcaaggucuucccc

SEQ ID NO: 147626 - RNA, 64 nt, Human
uacuggaugacauggugccugaauucuuucuuuucgccgacacgauggcagccaaacugcagcu

SEQ ID NO: 147627 - RNA, 64 nt, Human
gacucuuggccacguguuuccaguggcuggaccacgccgacaccugggaucuugagauacccag

SEQ ID NO: 147628 - RNA, 64 nt, Human
accuugaccgugaggagcugcuauccgcaaccagcgccgacaccaugcccccucuuccugguga

SEQ ID NO: 147629 - RNA, 64 nt, Human
caccacacguggccucugcgcccagcacggugcucgccgacaguggugucugaacccuugggga

SEQ ID NO: 147630 - RNA, 64 nt, Human
cgauguacauagcuuuucucagcugccugcgcgccgccgacagucagcgcugugcgcgcggaga

SEQ ID NO: 147631 - RNA, 64 nt, Human
caccccagcaccagagcacaaugagaaacggcagcgccgacaggagcggcggcagaugaagcgg

SEQ ID NO: 147632 - RNA, 64 nt, Human
aggggucucagucgugcuaggcaucgggcggcagcgccgacagcccuucccucgccagugcccc

SEQ ID NO: 147633 - RNA, 56 nt, Human; identical to SEQ ID NO: 93996

SEQ ID NO: 147634 - RNA, 64 nt, Human; identical to SEQ ID NO: 84569

SEQ ID NO: 147635 - RNA, 64 nt, Human
cuuugggccgcagcagugcuggguguucucagaccugacugaggaaguuagcugcgggcugccc

SEQ ID NO: 147636 - RNA, 64 nt, Human
aacaaaccucgggaacuggagccagagcugcggccugacugacgccuuuugaugcucacgggaa

SEQ ID NO: 147637 - RNA, 64 nt, Human
gaguguggcuucccacuuuuccugcauuguggagcugacugaguacaccggugaggcugggguc

SEQ ID NO: 147638 - RNA, 64 nt, Human
ucuuggagauuucagacaggcagcaccagggcuccugacugaaaggggaguuggugggccuuua

SEQ ID NO: 147639 - RNA, 64 nt, Human
guuucuuggaaagguaucuauuacauccugcuagcugacugacaaaacuaagcagggagaauaa

SEQ ID NO: 147640 - RNA, 64 nt, Human
gaggggugucuuuuuuaaaaauucuucuucauugcugacugaaacuggcagaugauugaccagu

SEQ ID NO: 147641 - RNA, 64 nt, Human
uccuuaaccugaaggcaaauugcuacuugcaagacugacugacuucaaggaaucagaaauuacc

SEQ ID NO: 147642 - RNA, 64 nt, Human
cuuaaguacuaguagccuguuauugacugggagccugacugauguauuauauauauuguauacu

SEQ ID NO: 147643 - RNA, 64 nt, Human
gcuccugagccucugcguaaggcugaacgucucacugacugagcuagucuucuuguugcucggg

SEQ ID NO: 147644 - RNA, 64 nt, Human
cugugacgucacuccugucucucuuugcuuucuucugacugacauuuauucagccuucucuaca

SEQ ID NO: 147645 - RNA, 64 nt, Human
cccucacacugcuguucccagugauauuugggaucugacugaagccagaggcucuguaaaauca

SEQ ID NO: 147646 - RNA, 64 nt, Human
ccccuccaggagagagccaggaugcccagaugaacugacugaaggaaaagcaagaaacaguuuc

SEQ ID NO: 147647 - RNA, 64 nt, Human
aaauacuaugugggacaccucaaauacauaccuacugacugaugacaaacccaggaguuugugu

SEQ ID NO: 147648 - RNA, 64 nt, Human
auaaaguguuggaaagcacugcagaugcggucaccugacugaccaccuggguuuucuauuacca

SEQ ID NO: 147649 - RNA, 64 nt, Human
ggaauaaaauaggaauccauuaaugauugcuuugcugacugagaauguaguugaaauuauucuu

SEQ ID NO: 147650 - RNA, 64 nt, Human
aguuuggccuuucacugcacuauucugauggugccugacugaauccaaauauccuagcuggcuc

SEQ ID NO: 147651 - RNA, 64 nt, Human
acauagagagccuccuguucuuucuaugcuuggucugacugagccuaaaguugagaaaaugggu

SEQ ID NO: 147652 - RNA, 64 nt, Human
agugauugaggauuugugggcagccagagggagucugacugaaguuuacuuggaaagaaagggc

SEQ ID NO: 147653 - RNA, 64 nt, Human
uaacuuuucaccccaucauuauaccagugcucaucugacugaugaaaaagaggaaagaauaauc

SEQ ID NO: 147654 - RNA, 64 nt, Human
guaucugccagccacagcaugaggccugugaaggcugacugagaaauccucugcugaagacccc

SEQ ID NO: 147655 - RNA, 64 nt, Human
acacucugggccuguggcaccaucugugccucagcugacugagcaguucugagauguggugacu

SEQ ID NO: 147656 - RNA, 64 nt, Human
ugaaguugguuuuguuggauggcuccugagcugacugacugaugucugaaguuugagacgaggg

SEQ ID NO: 147657 - RNA, 64 nt, Human
aauaugaaguugguuuuguuggauggcuccugagcugacugacugaugucugaaguuugagacg

SEQ ID NO: 147658 - RNA, 64 nt, Human
uuaagcaaauucuagauuggaacaauuagaagaucugacugauguuaagaguggccagaggaaa

SEQ ID NO: 147659 - RNA, 64 nt, Human
gacaccccuuccagcggaaguuacuaauucggaccugacugaugcaguuuccauagcaacccau

SEQ ID NO: 147660 - RNA, 64 nt, Human
uagauguuauucaacuccuucaguuuaucuuggacugacugacucaugccagcccuacagaagu

SEQ ID NO: 147661 - RNA, 64 nt, Human
cccaccccuccagacuacuuuaaaugucucugcucugacugaauugaaggaauuguaaguuuca

SEQ ID NO: 147662 - RNA, 64 nt, Human
ugacgacaaccagggguccaaguccccaaagauucugacugaugagaugcugcuccaagccugu

SEQ ID NO: 147663 - RNA, 64 nt, Human
gaacacaggaggugcucaauuacuauuugacugacugacugaaugaaugaaugaaugaggaaga

SEQ ID NO: 147664 - RNA, 64 nt, Human
acuggaacacaggaggugcucaauuacuauuugacugacugacugaaugaaugaaugaaugagg

SEQ ID NO: 147665 - RNA, 64 nt, Human
ugggaucccucugcccuguccuccugaauacaagcugacugacauugacugugucuguggaaaa

SEQ ID NO: 147666 - RNA, 64 nt, Human
auguguucauucuuuuauuguccguuguuuuaaccugacugaauacaagaucaacaagagcacu

SEQ ID NO: 147667 - RNA, 64 nt, Human
gccaaugagcccccuccccaggaggagggauggccugacugaaacaggugagaguuugcuuccc

SEQ ID NO: 147668 - RNA, 64 nt, Human
ccuuucucguuccuaacuuuuccuucacuuacaccugacugacccuccugaacugcacuacaag

SEQ ID NO: 147669 - RNA, 64 nt, Human
uuucuugguucagagcaggaaaaccuucaaggagcugacugaccacguagcaugggggcaagag

SEQ ID NO: 147670 - RNA, 64 nt, Human
uuuaaauuacugacaaguagaaucaaaggugcagcugacugagacgacaugcauguaagaucca

SEQ ID NO: 147671 - RNA, 64 nt, Human
ccaggcccagcagaagagccuccuucagcagcuacugacugaauaaccacuuuuaaaggaaugu

SEQ ID NO: 147672 - RNA, 64 nt, Human
ucauuuaguaaaaguugucuaauugauaugaagccugacugauuuuuuuuuuccuuacagugag

SEQ ID NO: 147673 - RNA, 64 nt, Human
gauauaauacuauauuuauacuguauauauaauacugacugagaauauaauacuguauuugaga

SEQ ID NO: 147674 - RNA, 64 nt, Human
gaagacuguuguggccucucaguucucuuugagucugacugacuguggccagucccuggacugg

SEQ ID NO: 147675 - RNA, 64 nt, Human
ucaccucccagagaguccccagagccccaaagggcugacugagaacuccaggcaccggcugacc

SEQ ID NO: 147676 - RNA, 64 nt, Human
guuaguccagaaaggauacggauagauagccugucugacugaacagccagauggcccccagccu

SEQ ID NO: 147677 - RNA, 64 nt, Human
cagaacaaagacuaaauaaugacauaauccucagcugacugacugaaaaugugacuggacgcau

SEQ ID NO: 147678 - RNA, 64 nt, Human
acaaagacuaaauaaugacauaauccucagcugacugacugaaaaugugacuggacgcauuccc

SEQ ID NO: 147679 - RNA, 64 nt, Human
gauguauuucagaggcgaugauauucucaccauccugacugaagugaacuaugaaguaagcaac

SEQ ID NO: 147680 - RNA, 64 nt, Human
aaauuuuacuguugaauaauacaaguauucauugcugacugaauucuuaaaacuuugggaauag

SEQ ID NO: 147681 - RNA, 64 nt, Human
uggaucagagacccugccucuguuugaccccgcacugacugaauaaagcuccucuggccguuua

SEQ ID NO: 147682 - RNA, 64 nt, Human
uccuccacuugugucagcuugcauuuuuuuauuccugacugagucaccacaccccucuccccug

SEQ ID NO: 147683 - RNA, 64 nt, Human
auguaaaagauuuuguuuuucuauauaaaaagagcugacugacauaucuuuaaauacuuuguac

SEQ ID NO: 147684 - RNA, 64 nt, Human
ugugacauuguggagguucugaguaaggacauuucugacugaagguaggauggacauuucuuug

SEQ ID NO: 147685 - RNA, 64 nt, Human
ugguguggugggccaaaauauugaaaugauggaacugacugauaaagcuguacaaauaagcagu

SEQ ID NO: 147686 - RNA, 64 nt, Human
gcauagcuccacucugcugcuaaauaugcauguucugacugacaccaucuugaugccaguacug

SEQ ID NO: 147687 - RNA, 64 nt, Human
aaggcagucuguaacaaacucuaucaaagcaggccugacugaccaggugucucaucaugccaga

SEQ ID NO: 147688 - RNA, 64 nt, Human
caaacacggaacgaauucagacuuccagcacgagcugacugacaucacuguuuguaccaaagcc

SEQ ID NO: 147689 - RNA, 64 nt, Human
ccuucagacuucuacauuaaugauguauguguugcugacugaaaagcuauacugauuagaaaug

SEQ ID NO: 147690 - RNA, 64 nt, Human
cacaggagauucacagagagacgagcccaggaggcugacugagcucaaaggaacaggauggcac

SEQ ID NO: 147691 - RNA, 64 nt, Human
ugaugcuagcuuccguugccaagucugccucccgcugacugagggaggguaggguuaccuugaa

SEQ ID NO: 147692 - RNA, 64 nt, Human
aagagcucgguaaagcauucugaauaaauucagccugacugaauuuucaguauguacuugaagg

SEQ ID NO: 147693 - RNA, 64 nt, Human
acuaaggaaacacuguucuauaugugguccauuacugacugaaguauacugucuagaagucuga

SEQ ID NO: 147694 - RNA, 64 nt, Human
cagcccuguaauguauccagucagcugcaugguacugacugagcugaggagucaaacucuucuu

SEQ ID NO: 147695 - RNA, 64 nt, Human
uaaaaggguucaucucugacaugaucccauaacacugacugaaauuccaccaaauuacuguucu

SEQ ID NO: 147696 - RNA, 64 nt, Human
cacaaaucaguauauggcuuuuuauguggguccucugacugaugcuuucagauuaaaauuguuu

SEQ ID NO: 147697 - RNA, 64 nt, Human
augaauaugcuuuaaccuaggauuucaguccacucugacugacuuucuaaacuuuaacuugggu

SEQ ID NO: 147698 - RNA, 64 nt, Human
aaugaaaaagcuacaagcauauaugagaagagaacugacugaacuugggaaauaauuugaacaa

SEQ ID NO: 147699 - RNA, 52 nt, Human
ugaugcucuucucaaggugacacugacugagauguucucuuacugacugaga

SEQ ID NO: 147700 - RNA, 64 nt, Human
uucucaaggugacacugacugagauguucucuuacugacugagauguucucuuggcaugcuaaa

SEQ ID NO: 147701 - RNA, 64 nt, Human
cuuaaauauagcaguagucuuuuuuggacuagcacugacugaacuguaauguaggggaaaguuu

SEQ ID NO: 147702 - RNA, 64 nt, Human
acgguaucuuaguaugccaaaacgcagaaaauuucugacugauagaguagaugccuguucugau

SEQ ID NO: 147703 - RNA, 64 nt, Human
aauuggaugcagugugggccauccuggaaugauacugacugauuaauuauuccugauaacaucu

SEQ ID NO: 147704 - RNA, 64 nt, Human
uuccaauguaggaaauccacacugauuuguacgucugacugagagaaagauggucgucuccagc

SEQ ID NO: 147705 - RNA, 64 nt, Human
aaaaaauaaacugaacuaaaacaacuuuugcccccugacugauagcauuucagaaugugucuuu

SEQ ID NO: 147706 - RNA, 64 nt, Human
cuauuaaguguucaauaugaagaauucaaguauucugacugagugauugguugaccuaaaccac

SEQ ID NO: 147707 - RNA, 64 nt, Human
gaugauacuuacaaggagugucauuaccugugagcugacugaauguugguaggugcuccauuac

SEQ ID NO: 147708 - RNA, 64 nt, Human
cucccaugucugcugguuucaguuccccacccaacugacugaagucuugaccuugauaccaccu

SEQ ID NO: 147709 - RNA, 64 nt, Human
gucaugcugggaauucccucugcagggaacuggccugacugacaugcaguuccauaaaugcaga

SEQ ID NO: 147710 - RNA, 64 nt, Human
uucaaaauuaugucuccauauuacuguuucaugacugacugacuaaaugacacccaaaaugguu

SEQ ID NO: 147711 - RNA, 64 nt, Human
cagauuaugccucacaugcuagcaucagguaaugcugacugaauuucagugaaauuaaaucaaa

SEQ ID NO: 147712 - RNA, 64 nt, Human
uagcugguggcagaauuggcaccauuacccaggucugacugaccaccagucagaggcacuuuau

SEQ ID NO: 147713 - RNA, 64 nt, Human
gcaaaucugcccugcucagcagucaccauagcagcugacugaaaaucagcacugccugaguagu

SEQ ID NO: 147714 - RNA, 64 nt, Human
gaguaguuuugaucaguuuaacuugaaucacuaacugacugaaaauugaaugggcaaauaagug

SEQ ID NO: 147715 - RNA, 64 nt, Human
cacugagcacaaagaguuguuggggcuuuagcaucugacugauuuuguuacgggguugauucug

SEQ ID NO: 147716 - RNA, 64 nt, Human
auuaggacuuucugcaguugacauuugcauaaagcugacugacugaaggaacagaaagugagac

SEQ ID NO: 147717 - RNA, 64 nt, Human
ggacuuucugcaguugacauuugcauaaagcugacugacugaaggaacagaaagugagacagac

SEQ ID NO: 147718 - RNA, 64 nt, Human
gcaccguguaggcuuuuucugcaaugagcagcagcugacugaauuuucauaagaaacuuggacu

SEQ ID NO: 147719 - RNA, 64 nt, Human
caaaacaccguuauaaacacaucaaagguucauucugacugagguaagacuuuccaagcccuug

SEQ ID NO: 147720 - RNA, 64 nt, Human
ggugguagcauuugggucugagaucggcccagcucugacugaaggggcuuggcuuccacucagc

SEQ ID NO: 147721 - RNA, 64 nt, Human
ucugugagugcgucugaggggacaucgccaaggacugacugagacacgaugccgagaccucaag

SEQ ID NO: 147722 - RNA, 64 nt, Human
uuuuucacacagaggaagagauggcgggaaaacacugacugacuccuuggguuucccccagaca

SEQ ID NO: 147723 - RNA, 64 nt, Human
uaggcccaccucagauugugauaaaucugugugacugacugaugcacacuuuuucuggacuaua

SEQ ID NO: 147724 - RNA, 64 nt, Human
ugaugacauucaauguuuacuacagugucaccaccugacugauguccuaacaauggucagugug

SEQ ID NO: 147725 - RNA, 64 nt, Human
guaugcagcaugagaauuugcuagaucguuuauccugacugaaauagacaaaguaagagggaaa

SEQ ID NO: 147726 - RNA, 64 nt, Human
cuaauacaaauauuucugauaagacuacaaauaucugacugagcuggggauuaaaguagaggua

SEQ ID NO: 147727 - RNA, 64 nt, Human
uccuuccaugcaaaggcuuccugaaauagggagacugacugaguagcucauucuugugacuuac

SEQ ID NO: 147728 - RNA, 64 nt, Human
caaccauagaacuuuauaauaggacaguuauaaccugacugaaccaaauccaucagcauaauga

SEQ ID NO: 147729 - RNA, 64 nt, Human
gauauucucaucaucaucuucaucaucccaggcucugacugaguuucuuucaguuuuacugaug

SEQ ID NO: 147730 - RNA, 64 nt, Human
cccacagaggaggcaagagccccaggacuaacagcugacugaccaaagcagccccuuguaagca

SEQ ID NO: 147731 - RNA, 64 nt, Human
gaacccucaggugcucuccgggagccugaaccuccugacugaggaacaugggcagaacauguuu

SEQ ID NO: 147732 - RNA, 64 nt, Human
guagaaugguuuugaagaagaaaaaaccugcuuucugacugauuuugccuugaaggaaaaaaga

SEQ ID NO: 147733 - RNA, 64 nt, Human
agccagcugcaucucgugggaccuccaagcuccucugacugaaccuacugugggaggagaagca

SEQ ID NO: 147734 - RNA, 64 nt, Human
guguaugugugugggucuuuugaugguuucuauucugacugacaucaauuugucuaaucuugua

SEQ ID NO: 147735 - RNA, 64 nt, Human
aucuaugucaaauuuuuccaucuuucauccagggcugacugaaacuauggcuaauaauuggggu

SEQ ID NO: 147736 - RNA, 64 nt, Human
cucuauugaauuuuucccaucuuucaucucagggcugacugagagcauaacuuagaaugggcga

SEQ ID NO: 147737 - RNA, 64 nt, Human
aauggaaggaaaaaaaaacugugaauggggaaugcugacugacaaaccaacacaacuuucagag

SEQ ID NO: 147738 - RNA, 64 nt, Human
cgaggacugguacaggaaccaccaggaggaagaccugacugaauuccucugcgccaaccacgug

SEQ ID NO: 147739 - RNA, 64 nt, Human
uggaugcuucugaggcaagcugaagcuuuggguucugacugacccacccuacaggacugcugaa

SEQ ID NO: 147740 - RNA, 64 nt, Human
cucggcauuugcuugaguuucuccacucuuggcucugacugaucccugcuugugcaggccagug

SEQ ID NO: 147741 - RNA, 64 nt, Human
aaauauauuccuuauggcauaauuuauugcauuucugacugaaaucaaaauucugauuugaugg

SEQ ID NO: 147742 - RNA, 64 nt, Human
caucaguaugucugaauuggggaaguaaaaugcccugacugaauucucuugagacuagauggga

SEQ ID NO: 147743 - RNA, 64 nt, Human
gaagcgcaggcagcucccacgacacacggagagacugacugauacgagauuuggaaagcuaugu

SEQ ID NO: 147744 - RNA, 64 nt, Human
uucuguuuuucacaucuauacucccugcacccuucugacugacaguucauccccacaaaacaca

SEQ ID NO: 147745 - RNA, 64 nt, Human
uacuuggaaacauguuuuuauuugcaauauaugccugacugaauuaagcuugcuuguuuuaaac

SEQ ID NO: 147746 - RNA, 64 nt, Human
uucuucucacuucaugugaaaacuacuccaguggcugacugaauugcugacccuucaagcucug

SEQ ID NO: 147747 - RNA, 64 nt, Human
agggacucccaggacccugugcccagcuuccaugcugacugaugguuaaauaaugugauugucu

SEQ ID NO: 147748 - RNA, 64 nt, Human
caacuacagcauuuuagacugcaugaaaccaugacugacugagagucacucucuggguagauga

SEQ ID NO: 147749 - RNA, 64 nt, Human
uaguaaccauuucuuuugucucucuguuucuguucugacugagaaccugcagccauuucuuguu

SEQ ID NO: 147750 - RNA, 64 nt, Human
cuugacagccuucugucuuaaagguuuuauaaugcugacugaauaucuguuaugcauuuuuaaa

SEQ ID NO: 147751 - RNA, 64 nt, Human
aauuauuuugauaaauuacuaauuaucuuaucuacugacugaaaucagugguguuacauuuucu

SEQ ID NO: 147752 - RNA, 64 nt, Human
cuaacaagacuaacuuacagaaaaauaauuauaucugacugauuuaaaauguucagguuucuua

SEQ ID NO: 147753 - RNA, 64 nt, Human
gaaacaacaucauuuaagccaaaauaucucccaacugacugauagacucugagcacuaauauca

SEQ ID NO: 147754 - RNA, 64 nt, Human
uaaaggggauaggugccauuugguggugagaaugcugacugaaaaauagaaugaucaauuuaau

SEQ ID NO: 147755 - RNA, 64 nt, Human
auuuuugguauuuuuguguauaagcuuuuaaggucugacugacaaauucuguauuaagguguca

SEQ ID NO: 147756 - RNA, 64 nt, Human
uaacuuaguaagugcuuuucuuauagaaccccuucugacugagcaauaugccuccuuguauuau

SEQ ID NO: 147757 - RNA, 64 nt, Human
gagucgauuuuccgucuuuuggauugcagcuccacugacugacaguaaagcugcagugauugag

SEQ ID NO: 147758 - RNA, 64 nt, Human
ucaaucuaugccagcucucuggcaucugggguuccugacugauaccagcaguugaaggaagaga

SEQ ID NO: 147759 - RNA, 64 nt, Human
ugcauccaagacuuucccucccuuccagaaggcacugacugaagacaggauggaucaugcggag

SEQ ID NO: 147760 - RNA, 64 nt, Human
cagugugucugucaugaaaccacuaacugcauuccugacugaagagccaucugucauuuauugg

SEQ ID NO: 147761 - RNA, 64 nt, Human
aggacccccaagccuaugcccugagccauggcugcugacugacuccagccaaggugcaaagacg

SEQ ID NO: 147762 - RNA, 63 nt, Human
uggccccgguggccaguuagagcagagacuucacugacugacuuacaggugcccuauucugag

SEQ ID NO: 147763 - RNA, 60 nt, Human
cagguaaaugguaucccugaagaaagaaaacugacugaagcaaugaauuuauaaucagac

SEQ ID NO: 147764 - RNA, 64 nt, Human
ucgagggucauggcuugucccuggucaguccugucugacugaccucagggccucaccucucugc

SEQ ID NO: 147765 - RNA, 64 nt, Human
gcugccacccacaaauauaaauacaguacucaugcugacugaaauaauaagacaucuacaaauu

SEQ ID NO: 147766 - RNA, 64 nt, Human
gagaugagguccgcuucuguaguacugagcauuucugacugaucaaaaaggccuagucuguuga

SEQ ID NO: 147767 - RNA, 64 nt, Human
ugggcggaguccccgggguuccccacacagggcacugacugauagcuuacacugaggacugugg

SEQ ID NO: 147768 - RNA, 64 nt, Human
aauuuggacaguagcgguuuuuaaaaaccauauacugacugaaacaugagccagagccgauugc

SEQ ID NO: 147769 - RNA, 64 nt, Human
aaacauucauauuuuuacuucauuuuuaaaacaacugacugauaguucuauauuuucaaaauau

SEQ ID NO: 147770 - RNA, 64 nt, Human
cgcaguugugauggguuuugcugagccauccacucugacugauuuccucugaaguaaacauauu

SEQ ID NO: 147771 - RNA, 64 nt, Human
ucuugcuagcagguggacauucugguauuuuagacugacugaacgaaacccagaggcugguucc

SEQ ID NO: 147772 - RNA, 64 nt, Human
gacacguuuucccaccuguuggcucccgugucugcugacugagggcauucaggaguaaaugcac

SEQ ID NO: 147773 - RNA, 64 nt, Human
ucacuuaaaauacugauuaagccaugggcagguacugacugaagaugcaauccaaccaaagcca

SEQ ID NO: 147774 - RNA, 64 nt, Human
gagaaagccacgcccucccugcuagcacagaggccugacugacuuuuuugcuuaacuuccaugu

SEQ ID NO: 147775 - RNA, 64 nt, Human
cuguggcacagcacagguggugggaggugguuuucugacugagauguugccugauggauggaaa

SEQ ID NO: 147776 - RNA, 64 nt, Human
cucuuaaggcacuagucccuuacagaggaccaugcugacugauccauuaucuauuuaaauauuu

SEQ ID NO: 147777 - RNA, 64 nt, Human
gaaggagcacggcugacaccaugagccaccaccgcugacugacuuugggugccggggcugcggg

SEQ ID NO: 147778 - RNA, 64 nt, Human
ugguucacccuugaggaccaggagccuccauauccugacugaaaaccuuuucugagacuuagag

SEQ ID NO: 147779 - RNA, 64 nt, Human
accugcuuccucucccuuccaaagacagugacagcugacugagggcaaagagcaggcaccacuc

SEQ ID NO: 147780 - RNA, 64 nt, Human
gaauugaguaggggcuucaugcucacaacucgaacugacugacaauguggcaauagucuuaguc

SEQ ID NO: 147781 - RNA, 64 nt, Human
guccugcagaguccccauggcauggagcuuacaccugacugacuggagcccccuccccgacucc

SEQ ID NO: 147782 - RNA, 64 nt, Human
auguguggaaaugggacggagguccuuuggacagcugacugaaugcagaacgguuuuuggaucu

SEQ ID NO: 147783 - RNA, 64 nt, Human
gagaggcagccagaggccagguaucugcuggccgcugacugaccagguccgcagugaacagagg

SEQ ID NO: 147784 - RNA, 64 nt, Human
ccuuuucuccccucacaguuucuuguuucgagugcugacugacccguuucugaaaugggcaccg

SEQ ID NO: 147785 - RNA, 64 nt, Human
cugaagucucuaggccuauaugggacaaucaauucugacugagcucccccauuccccucgggug

SEQ ID NO: 147786 - RNA, 64 nt, Human
uguggaaaauggagccaugacaagaacaaagccacugacugagauggagugagcugagacagau

SEQ ID NO: 147787 - RNA, 64 nt, Human
acuaauccuguugcucagagcuccuguacccuuacugacugacuuaagccugguuucucaguua

SEQ ID NO: 147788 - RNA, 64 nt, Human
ucuccugucuccgcauucccucccccuugaaaaccugacugaggagacauucuggaagguuccg

SEQ ID NO: 147789 - RNA, 64 nt, Human
uuuuuuuuuguuuuuaaggaaaaaggcaugcuuucugacugacaugaucuuuugcaauaccuca

SEQ ID NO: 147790 - RNA, 64 nt, Human
uuugcacacuaaaaacaucagacaaugggacauacugacugaccagucuagguugaaagauagg

SEQ ID NO: 147791 - RNA, 64 nt, Human
agaaaaugggagcucugucuaguuguccuuaagucugacugacuucaguggcucauaaccguga

SEQ ID NO: 147792 - RNA, 64 nt, Human
ggggcuugugguacuuaacacuuguagccaucaacugacugagaccuugggcuaaauaaucaau

SEQ ID NO: 147793 - RNA, 64 nt, Human
cucccacuucacugcgaagacccucuugcccauccugacugaaaguagggggcuuucuggggcc

SEQ ID NO: 147794 - RNA, 64 nt, Human
gcaaggcccugucccagcagaagagggaggcuuccugacugacacaggccagccccaucuuggu

SEQ ID NO: 147795 - RNA, 64 nt, Human
aauggcccuguaugacgggugacgucugcugcugcugacugaggacugcagaccgccaccacuc

SEQ ID NO: 147796 - RNA, 64 nt, Human
cuuggguguggaccaucuucuucuucucccucggcugacugagaugcaaggucugaccccacaa

SEQ ID NO: 147797 - RNA, 64 nt, Human
ugugccuugaagggcagcaggcccaagugcugcucugacugaaaacugaguuaacaagaugaaa

SEQ ID NO: 147798 - RNA, 64 nt, Human
guacacugguaucccuccuaaagaagugacucaccugacugaucagcaagaagccuagauugca

SEQ ID NO: 147799 - RNA, 64 nt, Human
cuuggguguggaccaucuucuucuucucccugggcugacugagaugcaaggucugaccccacaa

SEQ ID NO: 147800 - RNA, 64 nt, Human
accugcuccucugugccuaggccuuacgcauuugcugacugacucagcccccaugcuucugggg

SEQ ID NO: 147801 - RNA, 64 nt, Human
ucuugaugggcugagcagcuggcuggagcuaguacugacugacauucauugugaugagggcagc

SEQ ID NO: 147802 - RNA, 64 nt, Human
cuuggguguggaccaucuucuucuucucccugggcugacugagaugcuaggucugaccccacaa

SEQ ID NO: 147803 - RNA, 64 nt, Human
ggagaacaggggucgccaacacuuguguugcuuucugacugauccugaacaagaaagaguaaca

SEQ ID NO: 147804 - RNA, 64 nt, Human
auaccuuuuuuguuccacuuguuugcacugugugcugacugaacauuaguugcacuaacugcug

SEQ ID NO: 147805 - RNA, 64 nt, Human
ucaagacuguucugacacccuguccccaucaucccugacugaguacucugacaucacggaaagu

SEQ ID NO: 147806 - RNA, 64 nt, Human
uagugggaccugcauauguugaaaauuaccaauacugacugacaugugaugcugaccuaugaua

SEQ ID NO: 147807 - RNA, 64 nt, Human
caaccaugcagagugacugaaacacaauucauuucugacugacauuccuuucugcaacugcggu

SEQ ID NO: 147808 - RNA, 64 nt, Human
ugcucacaccaugagaauggaggcaggaauugagcugacugagggaagaugcaccuugaucuca

SEQ ID NO: 147809 - RNA, 64 nt, Human
ucugucccagguuuuuagaucccacugagcccagcugacugaaaacaaggacagucagggugaa

SEQ ID NO: 147810 - RNA, 64 nt, Human
uaucuugcuucauucugaaccuuaucaagaggaucugacugagagcccacugcaguuagagcug

SEQ ID NO: 147811 - RNA, 64 nt, Human
cugccugccugccugccuggggaguggggcugcucugacugagguauggagaccgcugcuaugg

SEQ ID NO: 147812 - RNA, 64 nt, Human
ugguuuuccaguccucaagggaauacugaagaugcugacugaaggggauuggauguugauuuua

SEQ ID NO: 147813 - RNA, 64 nt, Human
cauagcucugauucccaccccacauaggaguagccugacugagggggaaggggugggagagaag

SEQ ID NO: 147814 - RNA, 64 nt, Human
cccagagaugccuccaccgcugccuaaguggcugcugacugauguugagggaacagacaggaga

SEQ ID NO: 147815 - RNA, 64 nt, Human
cuugucccuccacugccaacagaaaacaaagcagcugacugagauggucaaaggacuuuggacc

SEQ ID NO: 147816 - RNA, 64 nt, Human
uuuucugacuaaauaagcaauaagaggcucuaagcugacugaguugcaaggacccuuuccgccc

SEQ ID NO: 147817 - RNA, 64 nt, Human
acuuuccaaguuuaauuauucaaaacuuuuugaacugacugaauuaacuugguauuuuuaaguu

SEQ ID NO: 147818 - RNA, 64 nt, Human
cuagauguuaaaacuauaugauuauuggcauauacugacugacugcaauauuuguaguaaauag

SEQ ID NO: 147819 - RNA, 64 nt, Human
cuccuggcuguguucccagcgccccagccugcagcugacugaggaccacgagugagccagcgag

SEQ ID NO: 147820 - RNA, 64 nt, Human
gccugggucucugaauucagccugucaccgauggcugacugaugaaauggacacgucucaucug

SEQ ID NO: 147821 - RNA, 63 nt, Human
agaaauccaggaagaaauaagacaugaauuuuccugacugaucuuaggaaagagauucaguuu

SEQ ID NO: 147822 - RNA, 64 nt, Human
ucguguucucaaagcauacagucaagaggugggacugacugaugcuuuauagguguguguaggg

SEQ ID NO: 147823 - RNA, 64 nt, Human
uaguaaugaagucaggucuugaaccccgguucugcugacugaauuggaugcacuauaguacagg

SEQ ID NO: 147824 - RNA, 64 nt, Human
guuuguuaauugaacauuuucaauuauaugcagacugacugauucuaagauaaauucuaaggag

SEQ ID NO: 147825 - RNA, 64 nt, Human
ggcuagaaauggggcacagagccacuggaggccucugacugaccucuacucccuggcccuguag

SEQ ID NO: 147826 - RNA, 64 nt, Human
auuguuccagcacggaggugaugugucacgggcccugacugagcuacagcgccaacgccuagag

SEQ ID NO: 147827 - RNA, 64 nt, Human
cuucauaugucaugguuuucagauccauuccaaccugacugaauguuaacagacagaauucuuc

SEQ ID NO: 147828 - RNA, 64 nt, Human
cauggucuggguacuauacuaccauguuuauuugcugacugaauuaagauuuaagaaugauuaa

SEQ ID NO: 147829 - RNA, 64 nt, Human
gcagagagcagcagcagcagguaccagcacggcccugacugaaucagcccagugucccugagca

SEQ ID NO: 147830 - RNA, 64 nt, Human
auaagggugcaauucccagaccaucccugcgcaucugacugacuccgguggaggcacugcugug

SEQ ID NO: 147831 - RNA, 64 nt, Human
auggaugaaucuggacauuuguuccacccgaccucugacugaugguuuggaaaauaacuuuaau

SEQ ID NO: 147832 - RNA, 64 nt, Human
cugucuggcucaacggcaaguuucccucccuuuucugacugacacuaagucuagcacacagcac

SEQ ID NO: 147833 - RNA, 64 nt, Human
gcugucugcuuucaaaaggacuuuucucuccuagcugacugacuccuuccuuaguucaaggaac

SEQ ID NO: 147834 - RNA, 64 nt, Human
gcagcugaggaaagggagacaagguauuuuauuucugacugauuuuagaaaaaacuuguguaca

SEQ ID NO: 147835 - RNA, 64 nt, Human
aaaaagaaaccaucucucuggauaggcugucacacugacugaccuaaggguucauggaagcaug

SEQ ID NO: 147836 - RNA, 64 nt, Human
caaugcaacaagaacacaaaugugaaaucaugggcugacugagacaauucuguccauguaaaga

SEQ ID NO: 147837 - RNA, 64 nt, Human
ggacacuccauauugugaaaccggccuaauuuuucugacugauauggaaacgauugccaacaca

SEQ ID NO: 147838 - RNA, 64 nt, Human
cuccaccccugcccuccccuucaucccagggggucugacugagaauggagaaggagaagcuaca

SEQ ID NO: 147839 - RNA, 64 nt, Human
ucagcccugugguccaguguccaucacagccaugcugacugagugacuggagacagggaugaug

SEQ ID NO: 147840 - RNA, 64 nt, Human
uccgcccccggauuugcucaggccugggaauccgcugacugaaggccucuuguugagugccagc

SEQ ID NO: 147841 - RNA, 64 nt, Human
uugccacaccccccaccccuaggacuuauucccgcugacugagucucugaggggcuaccaggaa

SEQ ID NO: 147842 - RNA, 64 nt, Human
aagaaggcugaccagccacgcccaccuccucugucugacugaguuccuuccuguggccacaggg

SEQ ID NO: 147843 - RNA, 64 nt, Human
cagucuagaggucucacugcaccgaguucauaaacugacugaagaauccuuucagcucuuccug

SEQ ID NO: 147844 - RNA, 64 nt, Human
ugaggagggguugggguuuuuaaauuuuuuucuccugacugagccaccaguauuuaucucugga

SEQ ID NO: 147845 - RNA, 64 nt, Human
cugcuccaugugucucagagaacuggaccccauccugacugaggucacccugaugaaugcccgc

SEQ ID NO: 147846 - RNA, 64 nt, Human
ccacuucagaagguaggggccgugucccgcggugcugacugaggccugcuucccccucccccuc

SEQ ID NO: 147847 - RNA, 64 nt, Human
uaaaucagggugggcaauucacagccuuucugaacugacugaacuagagcuugcagugaagugu

SEQ ID NO: 147848 - RNA, 64 nt, Human
uucuucaugugugcgugcauaucagcccguguggcugacugauguauaggucccuggcauccug

SEQ ID NO: 147849 - RNA, 64 nt, Human
agcacaguagucugggacugggcauuuaucuucucugacugaaaaucucuccuuggucuuaagg

SEQ ID NO: 147850 - RNA, 64 nt, Human
cagugauggauaacagcuccuauucucagcugaccugacugagccaacccaugaacucuucacu

SEQ ID NO: 147851 - RNA, 64 nt, Human
acccuccaccgagccacgcagugccuggaguugacugacugagcaggcugugggguggagcacu

SEQ ID NO: 147852 - RNA, 64 nt, Human
uuaaguccugccuguacugaaguucacagcccaccugacugagcagacucuuccuguuccuuuc

SEQ ID NO: 147853 - RNA, 64 nt, Human
ccucaucugccuuacugguuggcccaagcccugccugacugaccacccccucagagcacagauc

SEQ ID NO: 147854 - RNA, 64 nt, Human
cguugaguccuuuugagggugauuugucuuacaacugacugacuuagcaggaauuuaauuaggu

SEQ ID NO: 147855 - RNA, 64 nt, Human
ucuuugaaacacauaaccaaaaugguuugauucacugacugacuuugaagcugcaucugccagu

SEQ ID NO: 147856 - RNA, 64 nt, Human
gccaaacucgauacccacaagcugucagcugaaccugacugaguguucuuccugaguucacgag

SEQ ID NO: 147857 - RNA, 64 nt, Human
ugaggcacagcugccuguauuguccucaucuguucugacugaaggauggaggugcugaauaaau

SEQ ID NO: 147858 - RNA, 50 nt, Human
ggcgagagucggagauaugacugacugauuccuucucuggaauaguuacu

SEQ ID NO: 147859 - RNA, 64 nt, Human
ucacaacugaucauuaucuccuucucuuugagaccugacugaaaaaauuaggugugcacaccug

SEQ ID NO: 147860 - RNA, 64 nt, Human
ccgcgcagacauuaaaagucauguaaaagaacaucugacugaaagaaaaaugcuccuugaauau

SEQ ID NO: 147861 - RNA, 64 nt, Human
aucccagagcauucaugaagucuucccgccugggcugacugaugaggcagagccucucagcgua

SEQ ID NO: 147862 - RNA, 64 nt, Human
caccuuggugggugcccggggucacacucucugccugacugaccccugccagggcacagauagg

SEQ ID NO: 147863 - RNA, 64 nt, Human
ccagcggugguacuucggagacaccugucugcaucugacugagcagaacaaaucgucaggugcc

SEQ ID NO: 147864 - RNA, 64 nt, Human
gguagaaaggacauucuuccaggaaaguugacugcugacugauugggaaagaaaauccuggaga

SEQ ID NO: 147865 - RNA, 64 nt, Human
ucaaggauuuacccaggacucuauuuauacaacccugacugacagccuccuuucagcagaguuu

SEQ ID NO: 147866 - RNA, 64 nt, Human
gggagguugauuuucaugauucaugagcuggguacugacugagauaagaaaagccugaacuauu

SEQ ID NO: 147867 - RNA, 64 nt, Human
caguuucuaaagugaaacaugcaauauuuaugcucugacugacuccugaauuggaagaggaaga

SEQ ID NO: 147868 - RNA, 64 nt, Human
uagcugcaagagagaggcaccagcugaaguuccccugacugaagagagccuguggccauguaaa

SEQ ID NO: 147869 - RNA, 64 nt, Human
ugaacucacaccugguaccacucagaaccuccaacugacugaaugccaggagcugaacauuaau

SEQ ID NO: 147870 - RNA, 64 nt, Human
ugguuauuuuuccagauuggagaguugaaagucccugacugauuucagccauuuuccuagugcu

SEQ ID NO: 147871 - RNA, 64 nt, Human
aauugucaccgaagccuuaaauccuucugucuuccugacugaaugaaacuugaauuggcagagc

SEQ ID NO: 147872 - RNA, 64 nt, Human
ggcuucuaaauuucuagcccucucgcagggcauccugacugaacugugucuaagggucggucgg

SEQ ID NO: 147873 - RNA, 64 nt, Human
ccugaguuugggguauuuauagacuauuaauuuucugacugagccaauagugguuggggaacuc

SEQ ID NO: 147874 - RNA, 64 nt, Human
cuuccuuccuggacaggucgucaugauggaugcacugacugaccgucuggggcucaggcuggug

SEQ ID NO: 147875 - RNA, 64 nt, Human
ggggaggcacagcucauagccacacacccagggccugacugaggcccacgcaggaaccgacacu

SEQ ID NO: 147876 - RNA, 64 nt, Human
ucuccuuuaccuuuaccuuuaccacagugcagggcugacugaacugucacugugagauauuuuu

SEQ ID NO: 147877 - RNA, 64 nt, Human
cagagaaccucucaauaaaugauuugucgccugucugacugauuuacccuaggauaaagacucu

SEQ ID NO: 147878 - RNA, 64 nt, Human
ugugugacauagauuugaacauaauugcuggacacugacugauguacuguggcagacagaacua

SEQ ID NO: 147879 - RNA, 64 nt, Human
gccccuggcagggacggccggcccgcccccgugacugacugacagaugcagggauggccgaggc

SEQ ID NO: 147880 - RNA, 64 nt, Human
uuuccucucacccuuuauuuaugaagcugcagcccugacugagacauagggcugaguuuauugu

SEQ ID NO: 147881 - RNA, 64 nt, Human
uggagaguguuaccacagccuaaccuagucuauccugacugacagaaaggacuuguucauuucg

SEQ ID NO: 147882 - RNA, 64 nt, Human
caggagcccggugcuaggggaagcauccccaggccugacugagcggcaggggagcacggcccgu

SEQ ID NO: 147883 - RNA, 64 nt, Human
ugucauagucccagaggauaagcaauaccuauuucugacugagucucccagcccagacccaggg

SEQ ID NO: 147884 - RNA, 64 nt, Human
ggacucugcucccugucugagaccacccccggcucugacugagaguaaggggacugucagggcc

SEQ ID NO: 147885 - RNA, 64 nt, Human
agucuaagccuuuagagaaaauucauucuuuuuucugacugaucacagcauacgugugacccag

SEQ ID NO: 147886 - RNA, 64 nt, Human
cucaguaucuacaacacacaagacucaguaggcccugacugaugucucuuacaugaaugugacu

SEQ ID NO: 147887 - RNA, 64 nt, Human
ugugggugcuccuggcucaacccaaccaacaggacugacugacuggcaggacaaggucuggcau

SEQ ID NO: 147888 - RNA, 64 nt, Human
cucgugaugauucauuucaaaauccugagugagucugacugaaaaauacgagagaaaagagagu

SEQ ID NO: 147889 - RNA, 64 nt, Human
aggaacugacuauucuagccuaucuccugugccccugacugagcagaagcccccacagcuggcc

SEQ ID NO: 147890 - RNA, 64 nt, Human
agucugagccuuuaaggggaauuccuucccuuuucugacugauuacagcauacaucugaccagu

SEQ ID NO: 147891 - RNA, 64 nt, Human
cugcuguauaauacuuuccauuuucuagaauuuucugacugauguaauaaaguguuuccucuua

SEQ ID NO: 147892 - RNA, 64 nt, Human
uuuguuauauaaaaaaauuguaaauguuuaauaucugacugaaauuaaacgagcgaagaugagc

SEQ ID NO: 147893 - RNA, 64 nt, Human
agaugauaucugaaaccagagagacuuggaaugucugacugacuucuauuuaacagcuugagua

SEQ ID NO: 147894 - RNA, 64 nt, Human
ugauguuccacuccacuuuguauagacaucugcccugacugaauguguucugucacucagcuuu

SEQ ID NO: 147895 - RNA, 64 nt, Human
cuucuauagcaucacuuaaaacacguuuuaaggacugacugaggcaguuugaggauuaguuuag

SEQ ID NO: 147896 - RNA, 64 nt, Human
uuuauuuauugggaaagugagggagggagacagacugacugacagccauggguggucagauggu

SEQ ID NO: 147897 - RNA, 64 nt, Human
gucacaagucucugguaccaaaagggacccauggcugacugacagcaaggccuauggggaagaa

SEQ ID NO: 147898 - RNA, 64 nt, Human
gugguuuuucagacaccugcagcaagaagaaauacugacugacuaggcauuauuuucuauacau

SEQ ID NO: 147899 - RNA, 64 nt, Human
agggagacucagcucuccuugggggcuggcccagcugacugaggguacacaggauugggucuag

SEQ ID NO: 147900 - RNA, 64 nt, Human
uggcuucaccucacccuaaucccccgggagggagcugacugaugcaaaaagcugagggggccug

SEQ ID NO: 147901 - RNA, 58 nt, Human
cuuuugcuuuccaguuuuagaagccaaacugacugaggagugggacgguucguuugaa

SEQ ID NO: 147902 - RNA, 64 nt, Human
uacuuucaaauaccuauauuagaaagauauugaucugacugaaauauaaccuaccugccaguaa

SEQ ID NO: 147903 - RNA, 64 nt, Human
ccugugcccacccugacagacacccuggcuggcccugacugacuguauucucuggccacauuca

SEQ ID NO: 147904 - RNA, 64 nt, Human
ucugagugucccgcggugcccgccaacccgcuuccugacugaccugagcaaggucuuacuaagc

SEQ ID NO: 147905 - RNA, 64 nt, Human
uucucucccugggucugcguucccuccccugggccugacugagccugcucauuguuuuucccuu

SEQ ID NO: 147906 - RNA, 64 nt, Human
aaaucuguaaauaggagguggagggcaagccauccugacugagcaguuuuuaaccgcagguucu

SEQ ID NO: 147907 - RNA, 64 nt, Human
aguagguacaguggacaaaaauagcccagggugacugacugaauuuaaacccauaauggcuuua

SEQ ID NO: 147908 - RNA, 64 nt, Human
augucccccccacauaaagagagcuucucagagccugacugaagagcugacguuuugcuuuuuc

SEQ ID NO: 147909 - RNA, 64 nt, Human
uugcuuguuggggacacacucauaacuauuucaccugacugacaagcauaaaaggcuaacuugu

SEQ ID NO: 147910 - RNA, 64 nt, Human
uaccucuucuagcccuuagaagucugaggccagacugacugagggggccugaagcuacaugcac

SEQ ID NO: 147911 - RNA, 64 nt, Human
cuccuucugcacgauccaauaggagacaccaguucugacugaaccaugcccccaccuaagucac

SEQ ID NO: 147912 - RNA, 64 nt, Human
ugauaucuuuuucaucacauuacaaguuauuucucugacugaauagacagugguauagguugac

SEQ ID NO: 147913 - RNA, 64 nt, Human
ggacuccauccccaaacccacuaaucacaucccacugacugacccucugugaucaaagacccuc

SEQ ID NO: 147914 - RNA, 64 nt, Human
caacucuauaaaauggaauggaacuagaagugcacugacugacagcauguugcaaucacagaua

SEQ ID NO: 147915 - RNA, 64 nt, Human
ugcauuugccaguuuauucuuuuguuucuuuuaucugacugacucugucaaacaagugucaaag

SEQ ID NO: 147916 - RNA, 64 nt, Human
aaggucacucgaagauaagggauggggaugggggcugacugacaaaaaauuuuagccccagguc

SEQ ID NO: 147917 - RNA, 64 nt, Human
guaaauguuucuggacuuuauguuauuuaauuuacugacugaaauccaauuuggaauuugguag

SEQ ID NO: 147918 - RNA, 64 nt, Human
aguaucaucuugauaguguuacuucagcauaugacugacugauuuuaugaagggaguuuagcug

SEQ ID NO: 147919 - RNA, 64 nt, Human
gagcugaaggcccagaaucccgcuagaauauauccugacugaucagaggauaugacagcuuacc

SEQ ID NO: 147920 - RNA, 64 nt, Human
aaggccaagcuggucuagccugacauccuagcuccugacugaacacuauagacuucccagcagc

SEQ ID NO: 147921 - RNA, 64 nt, Human
uuaaaaaaauaauuggaagcacaagugcauggcacugacugaaugcuguuaauauuucuaaaag

SEQ ID NO: 147922 - RNA, 64 nt, Human
cagaaaucagaucuuggggagagucccuuccuaccugacugaccucccauaaggcugaugcuga

SEQ ID NO: 147923 - RNA, 64 nt, Human
cagcuggaaacuaagcagauacugguccugcauucugacugagauugugucuucuuuaugagga

SEQ ID NO: 147924 - RNA, 64 nt, Human
cuaugacaugagcacacccaacgcaccccugcacuacuaugagaccguucgcauggcagccauc

SEQ ID NO: 147925 - RNA, 64 nt, Human
auacuaucuguauacaugugcacaugcggcauuuuacuaugaaauuuaauaugcuggguuuuuu

SEQ ID NO: 147926 - RNA, 64 nt, Human
acccccugcugcacacgcuagcauaucuggaaccuacuaugaaaaugaaaggacccuuauaggu

SEQ ID NO: 147927 - RNA, 64 nt, Human
caaagagccuguuguauugcuuaccauguccccauacuaugaggagaaguuuuguggugccgcu

SEQ ID NO: 147928 - RNA, 64 nt, Human
caccuucauagcauacuccuucccccucaggugauacuaugaccaugaguagcaucagccagaa

SEQ ID NO: 147929 - RNA, 64 nt, Human
auaguuuuaagguuucucaagauguggcucuaccuacuaugaugaaaauugaagugggucaaaa

SEQ ID NO: 147930 - RNA, 64 nt, Human
ggucaguguaaaguuuuauccuugauagucuaguuacuaugacccuccccacuuuuuuaaaacc

SEQ ID NO: 147931 - RNA, 64 nt, Human
guaggcucuauaguaggcuuaagagugagucuuauacuaugaagccagccacaagauacuaaca

SEQ ID NO: 147932 - RNA, 64 nt, Human
uguaaaugcuuauuuuaucauagucuuuagccucuacuaugaguaaaauguucucuucggccgg

SEQ ID NO: 147933 - RNA, 64 nt, Human
ucuguggcuuuccggauuugcacauuuccugggguacuaugaacgugagugggguauuuuguuc

SEQ ID NO: 147934 - RNA, 64 nt, Human
aguuggaugaauuacuagagguaauaacaaaucuuacuaugaaaucaagagguuuaagaacaua

SEQ ID NO: 147935 - RNA, 64 nt, Human
agcaccaggcccacggaaaguggcuaauguuagcuacuaugaauggugccagugaagacacuga

SEQ ID NO: 147936 - RNA, 64 nt, Human
gcaccaguuuguagucccucuguuucgcacagaguacuaugacaaggaaacaucagaauuacua

SEQ ID NO: 147937 - RNA, 64 nt, Human
gugaauuaguuuuaaaaugauauuguuauauacauacuaugaaauauguauaacuuuaacuucu

SEQ ID NO: 147938 - RNA, 64 nt, Human
uuauaaaaaggccauguagaaaauuuauuaaaacuacuaugacugcuacauucaggaauaugcc

SEQ ID NO: 147939 - RNA, 64 nt, Human
aucacugcuuccauagauuggcauuuuuagcuauuacuaugacuuauauaacuuauacauauaa

SEQ ID NO: 147940 - RNA, 64 nt, Human
aaaauaauggaaagugucuguuuugugguguauauacuaugaauaaaaucacagcauuuucuaa

SEQ ID NO: 147941 - RNA, 64 nt, Human
aaguuuucuuauggcaaaaauaauguaaauaaguuacuaugaucugcauuuugccagaaacuca

SEQ ID NO: 147942 - RNA, 64 nt, Human
agaaacccauguccucucuccauagggccuguuuuacuaugauguaaaaauuaggucauguaca

SEQ ID NO: 147943 - RNA, 64 nt, Human
gaccugaaaaagccuaucaaauacuaucaaaauguacuaugacauugaguccuucacugcuucc

SEQ ID NO: 147944 - RNA, 64 nt, Human
cuaaaucucaauguaaaauucuuuuuuuucuuauuacuaugaaauggauggaauaaggaggggg

SEQ ID NO: 147945 - RNA, 64 nt, Human
cugaaaaauggaugucuagaacugguccugcaauuacuaugaagucaaaaauuaaacuagacua

SEQ ID NO: 147946 - RNA, 64 nt, Human
aaccugagagaaugcuagucauaacuguacuaguuacuaugaaaauggaaauaauuaucuuaga

SEQ ID NO: 147947 - RNA, 64 nt, Human
uuguaaauugggauuuuguuaaucaaauuuauuguacuaugacuaaaugaaauuauuucuuaca

SEQ ID NO: 147948 - RNA, 64 nt, Human
uuuuuaccaaauuuaaaagauccuuuuuaguuaauacuaugacaguacuaaaaauauaugaaua

SEQ ID NO: 147949 - RNA, 64 nt, Human
ucaagacaacaaagaucauucauuugguucuuuauacuaugaaacuugaguaaguauuaccucc

SEQ ID NO: 147950 - RNA, 64 nt, Human
ucaggugcuaaauaaacaacaaaaugguaaccucuacuaugaaguguuuccaaugaugggauau

SEQ ID NO: 147951 - RNA, 64 nt, Human
caaacuuauagaaauaaaaauuauuagaaagaaauacuaugaacaauugaaugccaacaaauua

SEQ ID NO: 147952 - RNA, 64 nt, Human
uugugaauaacaucaauuaauguaacuaguuaauuacuaugauuaucaccuccugauagugaac

SEQ ID NO: 147953 - RNA, 64 nt, Human
ccaguugagacaaucaccacaguuauuacccaaauacuaugaacauauuuuuguaaaccaguca

SEQ ID NO: 147954 - RNA, 64 nt, Human
uguagacuauaugaaucaauuauuacaucuguuuuacuaugaaaaaaaaauuaauacuacuagc

SEQ ID NO: 147955 - RNA, 64 nt, Human
caaauuucuauuucugccucugacaaaaagaacuuacuaugaaagaaauaguuguuuuaucaau

SEQ ID NO: 147956 - RNA, 64 nt, Human
cauccaagaaaugaugagagagagagaaauuauauacuaugaaaagugcacccccacacucugc

SEQ ID NO: 147957 - RNA, 64 nt, Human
gaccacuuaccaaguaucugaagagaugaguucauacuaugauuuagaaagugguucaauuccc

SEQ ID NO: 147958 - RNA, 64 nt, Human
uguugacuggacccucaguucccacacugcuaauuacuaugaaagcugcucuggccucgucuuc

SEQ ID NO: 147959 - RNA, 64 nt, Human
aguugugagcauucuuuuuuuccuucucaaaaccuacuaugauuuguuuuacugaacaaagguu

SEQ ID NO: 147960 - RNA, 64 nt, Human
aggggaauuuugcagugacaggauuuuagucucuuacuaugaauacuaauuucgaaccauagcu

SEQ ID NO: 147961 - RNA, 64 nt, Human
caucacaacuuacaaugcugcucauuguugugaguacuaugagauucaaauuuuucuaacauau

SEQ ID NO: 147962 - RNA, 64 nt, Human
uacugaauucuguaauaugaacuaggaacgcauuuacuaugagaaaauauggcucuuaagcagu

SEQ ID NO: 147963 - RNA, 64 nt, Human
aauagucccugcuuuaagggacuacgauaauguguacuaugacaaacgugcuuuauucuucuaa

SEQ ID NO: 147964 - RNA, 64 nt, Human
uuugacaauguggaauuaccaaauuaaaagagaauacuaugaauguauucauauuuuuucuaua

SEQ ID NO: 147965 - RNA, 64 nt, Human
ccaagauauauccuuauuuucauuuccaaacaacuacuaugauaaaugugaagaagauucuguu

SEQ ID NO: 147966 - RNA, 64 nt, Human
auuuggauugccugcucucuuuaaagcgaauucauacuaugacagcagaaacaaaacuucagau

SEQ ID NO: 147967 - RNA, 64 nt, Human
uuaagauuucauugagggcaaggcugguggcagguacuaugaauguaauucauaauuuaaaagg

SEQ ID NO: 147968 - RNA, 64 nt, Human
agaguccaaaaugcacuggucacgaaacgucuaauacuaugacuguuaaaaugucagacuauaa

SEQ ID NO: 147969 - RNA, 64 nt, Human
gggucuuaugcaaauuuucuauuucuaaaacuacuacuaugauauacaagugcuguugagcaua

SEQ ID NO: 147970 - RNA, 64 nt, Human
uucuuauuucuaaguagauagaaagcaauaaaaauacuaugaaaugaaagaacuuguucacagg

SEQ ID NO: 147971 - RNA, 64 nt, Human
ugcaagguacaaggcccacacccucucugagagauacuaugauuaaaaaagcuuuauaucuugg

SEQ ID NO: 147972 - RNA, 64 nt, Human
gauguagguauuaacaaucuuuucugccuccaacuacuaugaaguuggcagcaacagaggggcc

SEQ ID NO: 147973 - RNA, 64 nt, Human
uauaaccaauucauuaaauguaauucauaaaauguacuaugaaaaaaauuauacgcuaugggau

SEQ ID NO: 147974 - RNA, 64 nt, Human
aaaauggggaaauuaucacuuacaaguauuuguuuacuaugaaauuuuaaauacacauuuaugc

SEQ ID NO: 147975 - RNA, 64 nt, Human
uuucugccuguuacaaauaucaaggaagaccugcuacuaugaaauagaugacauuaaucugucu

SEQ ID NO: 147976 - RNA, 64 nt, Human
cugcuacucauaaguuggaccagaggaagccccuuacuaugaucucaggagcuugcaagaagca

SEQ ID NO: 147977 - RNA, 64 nt, Human
aauuuagaaaacaggugcuuaauugcaauaaaauuacuaugaaguauauuaaaaaucacgacau

SEQ ID NO: 147978 - RNA, 62 nt, Human
gaggaagaagagacgaacauuaaagaugucuauuuacuaugagcucacuguguuguuucaua

SEQ ID NO: 147979 - RNA, 64 nt, Human
cauauuuuaacuuauuaaaucuucuauuauuauguacuaugauuuauuccuacuaaaacauaaa

SEQ ID NO: 147980 - RNA, 60 nt, Human
uacuauuuucuuucagcuaaccccugcaucuacuaugaugaauacuucgacugugacaua

SEQ ID NO: 147981 - RNA, 64 nt, Human
ccuagugagaauauccaguagguuauccuauaguuacuaugaaguuaacacagcccaaaaaccu

SEQ ID NO: 147982 - RNA, 64 nt, Human
gaacucacaggaaguuacuucaagcacuugccaguacuaugauauucaaguaccuugcagcauu

SEQ ID NO: 147983 - RNA, 64 nt, Human
gcucaagguaagguagcuuuggcagcagggcugauacuaugaggcugaaacaauccuugugaug

SEQ ID NO: 147984 - RNA, 64 nt, Human
auacauaaaggugcuucaaaauauguagaaacauuacuaugaaaucaguuuuuaaaagauauac

SEQ ID NO: 147985 - RNA, 64 nt, Human
auuuucaaaauaagaaaauaaccuuuauaugauauacuaugacuaggcuguguauuucuuuuca

SEQ ID NO: 147986 - RNA, 64 nt, Human
gaucacuugagcccaggagauuaagacuguaguauacuaugaucgugccuguggcuagccacug

SEQ ID NO: 147987 - RNA, 64 nt, Human
caaaggauggucugugggaaaauauauuagaaguuacuaugaagaaugccccaaagacaaguua

SEQ ID NO: 147988 - RNA, 64 nt, Human
cucuaaaaucucacugagugauuucaccuucgccuacuaugaaaugucucaucagaccugacau

SEQ ID NO: 147989 - RNA, 64 nt, Human
uguaauuuccugacuuuuccuagaugucagccacuacuaugaauucaagcuuguguagucagau

SEQ ID NO: 147990 - RNA, 64 nt, Human
aagggagaaauacacuguaugaaguauauguugauacuaugacauguugccaacaccuugagaa

SEQ ID NO: 147991 - RNA, 64 nt, Human
guuuauccuaagcacuuguuugucagcccucucauacuaugaacauauggguagagaguauauu

SEQ ID NO: 147992 - RNA, 64 nt, Human
auugguguuagaaccacuaaacaucuucaaaugguacuaugaggaaaaaaagaaaaacauuuuu

SEQ ID NO: 147993 - RNA, 64 nt, Human
accuaauuuuuaguuuuuaaacuauuuuaaaauauacuaugauuuuauauguauauuuccuaua

SEQ ID NO: 147994 - RNA, 64 nt, Human
agagagagagagagagcgagagagagagacauguuacuaugaaagacuuguauuuuuuauuguc

SEQ ID NO: 147995 - RNA, 64 nt, Human
acugccuuggucugugcaggcugcuguaaugaaauacuaugaacuuggcagcuuauaaacaaca

SEQ ID NO: 147996 - RNA, 64 nt, Human
agauaauuucuuuauugaaacuaucaggaaguuuuacuaugaaauuuuacauacaugauggaaa

SEQ ID NO: 147997 - RNA, 64 nt, Human
cuauugcuauuacuaguacuauuacuaguacuaguacuaugacacuguuaauaguacuauuaac

SEQ ID NO: 147998 - RNA, 64 nt, Human
aguuucucuaguucuauaguuuauuuguugaagguacuaugaccaaagaaucagcugcucuaca

SEQ ID NO: 147999 - RNA, 64 nt, Human
ugguauaaggaaauaucauaauguaaugaggugguacuaugauuaaaagccacuguuacauuuc

SEQ ID NO: 148000 - RNA, 64 nt, Human
uucaauacuuguaaacuggaaaucagaaaauauuuacuaugaacaggaaaaucugacauauagc

SEQ ID NO: 148001 - RNA, 64 nt, Human
uuuaaauggaacuaucuccaaauuuuucuaagacuacuaugaacaguuuucuuuuaaaauuuug

SEQ ID NO: 148002 - RNA, 64 nt, Human
ucuauggcugucccgauuugcgcauuuccugggguacuaugaacgugagugggguauuuuguuc

SEQ ID NO: 148003 - RNA, 64 nt, Human
ucccuuuuguauguuucuacuguuaaugccauauuacuaugagauaauuuguugcauagugucc

SEQ ID NO: 148004 - RNA, 64 nt, Human
ucugccuucuagagagagaucagaauuaaacuaguacuaugaaauguccuuuugaauguuaggu

SEQ ID NO: 148005 - RNA, 64 nt, Human
ggauuugaugcuuuucucucagcauagguaugcuuacuaugaccuuccaaguuugacuuguaua

SEQ ID NO: 148006 - RNA, 64 nt, Human
ucuguggcuuucccgauuugcacauguccugggguacuaugaacgugagugggguauuuuguuc

SEQ ID NO: 148007 - RNA, 64 nt, Human
augcacaaacuguaggaaacuauaggaaagcauuuacuaugagguuauauuuuauggaguauau

SEQ ID NO: 148008 - RNA, 64 nt, Human
aucacucaguuuggugcuuuaaauuaagucuguuuacuaugaaacaagagucauuuuuagagga

SEQ ID NO: 148009 - RNA, 64 nt, Human
caaauuggaaggaaauaugaaugaagcccuggaguacuaugagcgggcccugagacuggcugcu

SEQ ID NO: 148010 - RNA, 64 nt, Human
uguuuaguguuuucucagaaucagcaacucaagguacuaugaggauuuuucucacugacauaau

SEQ ID NO: 148011 - RNA, 64 nt, Human
guagucaugcuaauuauauaauauuuuuaauauauacuaugaggcccuaucuuuugcauccuac

SEQ ID NO: 148012 - RNA, 64 nt, Human
aacgacuaagucuugcucaaauguuauuaugagguacuaugagugacuuacauguguuuuaaaa

SEQ ID NO: 148013 - RNA, 64 nt, Human
uggaagaaauggcuaugaacagaaacuacauuucuacuaugaucagaagaacaugauuuuacaa

SEQ ID NO: 148014 - RNA, 64 nt, Human
augcauuuuuuuaaggcaaaauuucucccuuaucuacuaugaugacuucagaagauacaauggu

SEQ ID NO: 148015 - RNA, 64 nt, Human
aaaucacacauaugcacacauacauauuuaugguuacuaugauuguuauuauuuguccaaucaa

SEQ ID NO: 148016 - RNA, 64 nt, Human
cuaaaaaaaaaaaagcuuuuguuuuguauuuguuuacuaugagucguuauuuaauuucucuuga

SEQ ID NO: 148017 - RNA, 64 nt, Human
aaacaccauuuaauaguuauaacgucguuacuuguacuaugaaggaaaauacucagugucagcu

SEQ ID NO: 148018 - RNA, 64 nt, Human
cauuuuugaauacagcugcauuauaaaccaaauuuacuaugaaguccuuugcuguggaggcaau

SEQ ID NO: 148019 - RNA, 64 nt, Human
ugucuuuuuuaaauaugaaguacuuaaauguacuuacuaugauaggaaauauaaugugugccuu

SEQ ID NO: 148020 - RNA, 64 nt, Human
cagacuaggcaaauuuuuuuaguuuauaauguuuuacuaugauuuagggcuuuuuuuucaaaga

SEQ ID NO: 148021 - RNA, 64 nt, Human
ucuaggauguauuuuucuuguaucuuuuucuuccuacuaugauacuaguaauucauaagggauc

SEQ ID NO: 148022 - RNA, 64 nt, Human
guguugcuacuagacugaggguuuccaggaguaguacuaugacaucauguaaacacauucaguu

SEQ ID NO: 148023 - RNA, 64 nt, Human
aucuaguucaugugcauuaggcugccguauauacuacuaugauauuuagcugcaguaucaaugu

SEQ ID NO: 148024 - RNA, 64 nt, Human
aagucuuguguucagcaauaucuaaagauaauguuacuaugacaacauuuuuacuguccuuuaa

SEQ ID NO: 148025 - RNA, 64 nt, Human
ugagcagggccuagucuuagccaauauuaaaacauacuaugaagccucugauacuuaaacagca

SEQ ID NO: 148026 - RNA, 64 nt, Human
gaagcccaguauuugcuacuguuuuuccuuuuuuuacuaugacaggaaaauaaaugcaauuuua

SEQ ID NO: 148027 - RNA, 64 nt, Human
gccaggaaucuauuguguuuuucuucugccaauuuacuaugauuguguaugugccgcuaccacc

SEQ ID NO: 148028 - RNA, 64 nt, Human
aguccaucugaugccaguguugaguaaacucaacuacuaugaaauuucaccuaauguuuucagu

SEQ ID NO: 148029 - RNA, 64 nt, Human
ugagaagcgucaggucccacuucugccaugcagcuacuaugagcccucggggccuccuccuggg

SEQ ID NO: 148030 - RNA, 64 nt, Human
ucuauucugacuacucgcuauuuuguaguaguuguacuaugauaaucuguuuauuggauggacc

SEQ ID NO: 148031 - RNA, 64 nt, Human
uuuuuagacuucugaacaucaguauguucgaggguacuaugauauuuugguuuggaauugcccu

SEQ ID NO: 148032 - RNA, 64 nt, Human
uuguuguuguaaaauugaaaucaggcauuuaacauacuaugaaaacaccaggagucaaugauua

SEQ ID NO: 148033 - RNA, 64 nt, Human
gcuuaguggucaaauauguugaaaaccuuuccaauacuaugaaugaaugcaaaucuuaaugcac

SEQ ID NO: 148034 - RNA, 64 nt, Human
guuuaauuuguaaagcuuagcaaauaaaaucuuguacuaugaauagcuucuugcuuuaugacuu

SEQ ID NO: 148035 - RNA, 64 nt, Human
guaaccccaagcaaauauagaagacuguauuuuuuacuaugauauccauuuuccagaauuguga

SEQ ID NO: 148036 - RNA, 64 nt, Human
gaguggaagccuuuauugggauaaucuuccuaaauacuaugacaauuguccauuuuucuucugg

SEQ ID NO: 148037 - RNA, 64 nt, Human
ucagauuguaauauguaaaugguaugucauucgcuacuaugauuuaauuugaaauauggucuuu

SEQ ID NO: 148038 - RNA, 64 nt, Human
ucauaugcccguguuugucacuuacaaaaauguuuacuaugaacacacagaaauaaaaaauagg

SEQ ID NO: 148039 - RNA, 63 nt, Human
cacaacuuggacaaaaguaacacagaagaaccuuacuaugauaaucuacuuggaauguggaua

SEQ ID NO: 148040 - RNA, 63 nt, Human
gaauaaucuauaucacuuuaacaaauaaauguuuuacuaugacagaauuugcacauugccuga

SEQ ID NO: 148041 - RNA, 64 nt, Human
aaaaguauuaaugugcuugacaccaugacugaaauacuaugaucuuguuugucaauaaaaagca

SEQ ID NO: 148042 - RNA, 64 nt, Human
gugguuuuaacauuggguguuuuuguuuuguuuuuacuaugaaaagacagcuuaaggaagagcu

SEQ ID NO: 148043 - RNA, 64 nt, Human
aaggugggaguauauuuuuauuuccuaaaugccauacuaugaagaucaaagucuuaaguguguu

SEQ ID NO: 148044 - RNA, 64 nt, Human
acaauguuuggaaaaacaugggacuguaugucauuacuaugacugauagcagaauaauaaugca

SEQ ID NO: 148045 - RNA, 64 nt, Human
uuaaaaucucaggcuauucuguuaauguuccugcuacuaugaacccaaacuuuuuuuuuccccc

SEQ ID NO: 148046 - RNA, 64 nt, Human
uggccuuuucacauuucuaaaucccaucuugauauacuaugaauacucuagaaugauguaaagc

SEQ ID NO: 148047 - RNA, 64 nt, Human
guuuaacaaaucuaaucucuuauucuaauaaauauacuaugaaauaaaaaaaaaaggaugaaag

SEQ ID NO: 148048 - RNA, 64 nt, Human
uauuacuauuucuuaugccuuuuaaaauacuguuuacuaugaagacaauguuuuuaauuacaaa

SEQ ID NO: 148049 - RNA, 64 nt, Human
aggccccacccacuggagagccccgccccuaagguacuaugaguccucaggggucaaguucaga

SEQ ID NO: 148050 - RNA, 64 nt, Human
aaaccuuugcuggguuuucuguucaauaaaguuuuacuaugaaugacccuggcagagacuccug

SEQ ID NO: 148051 - RNA, 64 nt, Human
auuaaaggccaugcugaucuugcauaacuauaaguacuaugaaugaauuugguugguuuuggug

SEQ ID NO: 148052 - RNA, 64 nt, Human
cuuucucuuucuuuucccuuugggcccuuggccuuacuaugaugauaugagauucuuuaugaaa

SEQ ID NO: 148053 - RNA, 64 nt, Human
auuacaauaacagagauauauguaaaauugccaauacuaugagagcuucuuuguucaaauguau

SEQ ID NO: 148054 - RNA, 64 nt, Human
agaggggagagagccgcgggguccugcccgugguuacuaugaauguauugcuguuggaggacau

SEQ ID NO: 148055 - RNA, 64 nt, Human
cugggagguagauagguaaauaccaaguauuuauuacuaugacugcuccccagcccuggcucug

SEQ ID NO: 148056 - RNA, 64 nt, Human
gguuuuuaggagucugagcauccaucaauaccuguacuaugaugggcuucuguucucugcugag

SEQ ID NO: 148057 - RNA, 64 nt, Human
aucgucacacagcugugauaagaguagauuauuuuacuaugaaauaauucugaauagaugaaag

SEQ ID NO: 148058 - RNA, 64 nt, Human
uuuauugagaacuuguuucauaaauggauaucccuacuaugacugugaaaacaugucaaguguc

SEQ ID NO: 148059 - RNA, 64 nt, Human
uaccuacaagaucccgcgucagcggauuauggauuacuaugagaccaacagccagugcuccaag

SEQ ID NO: 148060 - RNA, 64 nt, Human
ucuugcugcuaaugucuccuugugauauuugucauacuaugaaugucuucauuagucauuuaaa

SEQ ID NO: 148061 - RNA, 64 nt, Human
auaaacacaguugcaggaaaguauguuagcuauauacuaugaaguacucuuaguuuacuuaugu

SEQ ID NO: 148062 - RNA, 64 nt, Human
uuaaagagauucuguuauuagcaccaugaacucguacuaugaaauuuuuaagccuuuuauuuuu

SEQ ID NO: 148063 - RNA, 64 nt, Human
cguaugcuguucccuucaaugugauaucagagauuacuaugaauguuaguuucauuccgugaaa

SEQ ID NO: 148064 - RNA, 64 nt, Human
agaugggaagcauagauaucuauauuuuuauuucuacuaugagggccuuguaauaaauuucuaa

SEQ ID NO: 148065 - RNA, 64 nt, Human
uacucugaaagaaaaaugacguaaccacagcguguacuaugaaagcuguuauuuuaauaaagaa

SEQ ID NO: 148066 - RNA, 64 nt, Human
ccugaggcaagcaccacacuuaccacuguauguguacuaugaucccaacaggcuugugacauag

SEQ ID NO: 148067 - RNA, 64 nt, Human
ggaguagaugggaauuugagggagaauacagagauacuaugaacguauuugacauuuuuaauac

SEQ ID NO: 148068 - RNA, 64 nt, Human
cauuuaucuaugaccaauaggaagagcaaccaguuacuaugagugaaagggagccagaagacug

SEQ ID NO: 148069 - RNA, 64 nt, Human
uguccccuccccggucccccgcccugcucaccucuacuaugaaggugcccccaggucaccugug

SEQ ID NO: 148070 - RNA, 64 nt, Human
aaguaugcaugaaagaauucacacuggggagaaauacuaugaauguaaggauaugaguguuguu

SEQ ID NO: 148071 - RNA, 64 nt, Human
auaaaaaauaaaagaucguaugauaugagauacauacuaugaaaugaagauagacacauuugga

SEQ ID NO: 148072 - RNA, 64 nt, Human
ugggaaguccuucagcagcaauucaaaacuuaaauacuaugauguuuaauaaguauuauagugu

SEQ ID NO: 148073 - RNA, 64 nt, Human
ucaaaagugugcucaaaaaugaaacccaugcucuuacuaugaaagaacguuaguacccagguuu

SEQ ID NO: 148074 - RNA, 64 nt, Human
uacagucuucacugaaguguuugguacaaggaucuacuaugaacuugcugcugugauaggcaag

SEQ ID NO: 148075 - RNA, 64 nt, Human
ggaaaaagaugccaacauacccguauuuaccaaguacuaugauaauggcuagaguauaaaaaug

SEQ ID NO: 148076 - RNA, 64 nt, Human
aaagaaauaagaugguauuaggcaaaucuuacuauacuaugaaaagcauuaccuugccuauuuu

SEQ ID NO: 148077 - RNA, 64 nt, Human
ggaauguuaaauaacgcuuuuauacuguauuuuguacuaugauguaacuccccuuccuuauggc

SEQ ID NO: 148078 - RNA, 64 nt, Human
gggcucuuugagguggguggcuucuuuuggaaaguacuaugaacgucucgaagcaguauucuag

SEQ ID NO: 148079 - RNA, 64 nt, Human
acuuugacacugcagguauuccauuuucaugguuuacuaugaaaagucauuuuucauauuaugu

SEQ ID NO: 148080 - RNA, 64 nt, Human
acuggccaguugaauauauucuauuccauguccauacuaugacaaucuuauugucaacacuaua

SEQ ID NO: 148081 - RNA, 64 nt, Human
aauucaucuauucaacagauauuuauuguguuauuacuaugagucaggcucuguuuauuguuuc

SEQ ID NO: 148082 - RNA, 64 nt, Human
cagcauaggugaaaaucauauuugggcuauuguauacuaugaacaauuuguaaaugucuuaauu

SEQ ID NO: 148083 - RNA, 64 nt, Human
ucuuuuuuuggcaaacauacauaauguuacaucauacuaugaugaacauccauguacuuuucac

SEQ ID NO: 148084 - RNA, 64 nt, Human
uugaccaaccuucuucuaacaaggugcucauuccuacuaugaauccagaauaaacacgccaaga

SEQ ID NO: 148085 - RNA, 64 nt, Human
aguuucaugacuuacugcuuaacgaauaacuaacuacuaugauauucuggacauuuuaggaaau

SEQ ID NO: 148086 - RNA, 64 nt, Human
uuaaggaaaucuuacaaguauuacauuaaaaagauacuaugacugccaccugccauuuaccuuc

SEQ ID NO: 148087 - RNA, 64 nt, Human
acgacaaagcaugguuuguggcuuuuugcaaaauuacuaugaaccaaaaguugacaaauguucc

SEQ ID NO: 148088 - RNA, 62 nt, Human
ccacucugguguagacagaggacuuuguccaagucucacacuaaacaugcccgggcuucgau

SEQ ID NO: 148089 - RNA, 62 nt, Human
uguaacagccaccuggagaacuucauaaagaugucucacagcccuggggacaccugcccagu

SEQ ID NO: 148090 - RNA, 62 nt, Human
accugauacuguaaacauacuguaauaauaaugucucacauggaaacagaaaacgcuggguc

SEQ ID NO: 148091 - RNA, 62 nt, Human
auguucagguggucaguguucuacucagaaaugucucacagcccagcuggguugcaauucca

SEQ ID NO: 148092 - RNA, 62 nt, Human
accauuuuaagccucuaaaagaccucgggcaagucucacagaaacugagcugcagacgggga

SEQ ID NO: 148093 - RNA, 62 nt, Human
cccuucucugggugugggcccuuauugcagcugucucacagccugagcugugguacagagaa

SEQ ID NO: 148094 - RNA, 62 nt, Human
cacuggugugaaugaaagagagacccagccgcgucucacacagguggaauugcacuucuuaa

SEQ ID NO: 148095 - RNA, 62 nt, Human
uaaaagaaaguuagguuauaagaaacagaggcgucucacauuuuuacuugguguaauuaaua

SEQ ID NO: 148096 - RNA, 62 nt, Human
uauuguuuggaauuguuuuaaagucaguuugagucucacaagaagguaaguagaguuucuua

SEQ ID NO: 148097 - RNA, 62 nt, Human
ccccaguuuccuggcgaugagccauuuauugugucucacaccagccucauuuccaacuccga

SEQ ID NO: 148098 - RNA, 62 nt, Human
uuggccuuugggaacuuugcuccaacuggugugucucacacaaugccucccaaaacacugcu

SEQ ID NO: 148099 - RNA, 62 nt, Human
uuccuguacauuuuacagucgcacagcaagcagucucacagaaggcaggcuaguccauucac

SEQ ID NO: 148100 - RNA, 62 nt, Human
uccucugaauuauaauaacauagccagauguagucucacacuguuuuucauacucuuaagug

SEQ ID NO: 148101 - RNA, 61 nt, Human
gacgcuggaaccuguauacacaauaaaggacagucucacagacuucuggaggccgccugcc

SEQ ID NO: 148102 - RNA, 62 nt, Human
auggcugggggagggacugcugacccaccaaggucucacacuccuccugccagcucugucac

SEQ ID NO: 148103 - RNA, 62 nt, Human
cagcuaggccaauaggaacagaccgggaccuugucucacacugaugauaccucacauguuga

SEQ ID NO: 148104 - RNA, 62 nt, Human
cuggaggagaaguauuccuguugcugucuucagucucacagagaagcuccugcuacuucccc

SEQ ID NO: 148105 - RNA, 62 nt, Human
auuugcucucuaaacuucccucuaguuggcaagucucacauauucaucagcaggaguggagg

SEQ ID NO: 148106 - RNA, 62 nt, Human
uuuccccuccugucuucccgguaucccuuggagucucacaagguuuacuuugguaugguucu

SEQ ID NO: 148107 - RNA, 62 nt, Human
ucagauggagcuuccuacucacguugauuuaugucucacaauccuggguauuguuaauucaa

SEQ ID NO: 148108 - RNA, 62 nt, Human
ggcuucuaaugcuucagauagaauacaguugggucucacauaacccuuuacauugugaaaua

SEQ ID NO: 148109 - RNA, 62 nt, Human
ucucugucuagaaauaccauagaccauauauagucucacauugauaauugaaacuagaaggg

SEQ ID NO: 148110 - RNA, 62 nt, Human
cuaauuucauuuuacaguguauguaacgcuuagucucacagugucuuuaacucaucuuugca

SEQ ID NO: 148111 - RNA, 62 nt, Human
cacuuccuguuugggccccucucccauccagugucucacagcccugcuuaccagauaaugcu

SEQ ID NO: 148112 - RNA, 62 nt, Human
gaaaacucuaugcuggccacugauuccuuugagucucacaaaacccuacuuaggucaucagg

SEQ ID NO: 148113 - RNA, 62 nt, Human
uaauacuaggagaagacugaaucauuaaugaugucucacaaauuacuguguaccuaaguggu

SEQ ID NO: 148114 - RNA, 62 nt, Human
ugugucuccuuucccccgaaguagaugaaacagucucacauacccaacugcucaucaacaga

SEQ ID NO: 148115 - RNA, 62 nt, Human
uacaauaucuuuaaaugaacacacgaguguaugucucacaauauauauacacaagugugcau

SEQ ID NO: 148116 - RNA, 62 nt, Human
auauagcaguguagcuguucucucuagauggugucucacaauggauuucuguugcuugacua

SEQ ID NO: 148117 - RNA, 62 nt, Human
accuuuuuccuccguuuuuuuuuugagauggagucucacacagucacccgggauuggaaugc

SEQ ID NO: 148118 - RNA, 62 nt, Human
uaaaguuccagaauaaucuccuuugacuccaggucucacauccaggucauacugaugcaaga

SEQ ID NO: 148119 - RNA, 62 nt, Human
aacuaaucaggcaggaaaaaagcccagccacugucucacagauuguuuuuuguauauuguag

SEQ ID NO: 148120 - RNA, 62 nt, Human
accuguuaaaagccacgcagcagacucauggggucucacaaauccguguccgggugcgcucc

SEQ ID NO: 148121 - RNA, 62 nt, Human
agaaugcuccaugcuauuuuauggaaacuuuggucucacauccguagcugauuauccucuuu

SEQ ID NO: 148122 - RNA, 62 nt, Human
aauaaugcaaaaauugcacaguggaagaaggggucucacaaaaagcaauccauccuguagua

SEQ ID NO: 148123 - RNA, 62 nt, Human
uuuugugaaugguguucagccuauaagacgaagucucacaagaccuauaggaaaguuuacca

SEQ ID NO: 148124 - RNA, 62 nt, Human
uugcauauugcccaauaagcagaagccauaaggucucacacuuuucuuauaaugcaauagaa

SEQ ID NO: 148125 - RNA, 62 nt, Human
ccucuucugauaguuggggaaacugaggccuugucucacaguuggaugcuuuucccaguugu

SEQ ID NO: 148126 - RNA, 62 nt, Human
gcugauacacagcacacagggaaaggaagacagucucacagaggaagggcagguguccuacg

SEQ ID NO: 148127 - RNA, 62 nt, Human
caacaaguagcuaaagucuggcuaugcucacagucucacaucugguuggggugggcuccuua

SEQ ID NO: 148128 - RNA, 62 nt, Human
guuuucuagcauguuuccuuuuacuugguucugucucacaaagcugggagguagaugauucu

SEQ ID NO: 148129 - RNA, 62 nt, Human
uuuauggauauacaagcaaaugggaauguagagucucacauucucucuuuauacacaaaagu

SEQ ID NO: 148130 - RNA, 62 nt, Human
agacacaggaaucacuguuuuccuugaccagggucucacacccuggaggaauguuaaguaag

SEQ ID NO: 148131 - RNA, 62 nt, Human
ucugcaacuuuaagcagcucuugcuaaucagugucucacacuggcguagaaguuuuuguacu

SEQ ID NO: 148132 - RNA, 62 nt, Human
uaguagacccauuuuacaggugagagaaccaagucucacagaggccuggguucaagucccac

SEQ ID NO: 148133 - RNA, 62 nt, Human
caaaugucugaguaaacagauaucccuuccaagucucacaccucccuuagucccacucuugc

SEQ ID NO: 148134 - RNA, 62 nt, Human
acgucccaucaacaaagcaucgaugauggacagucucacacuauuuuuaucauauguuucuu

SEQ ID NO: 148135 - RNA, 62 nt, Human
aggacaagaagucuauuguuuggacuguguuugucucacaaucaccacaaaauaaaagugua

SEQ ID NO: 148136 - RNA, 62 nt, Human
uaacucauaggugcauucuuuuuuucuuuggugucucacaaauuacccaauuguugaauaaa

SEQ ID NO: 148137 - RNA, 62 nt, Human
gugagaguucccucaucugaaaucauguaucugucucacaaauacaagcauaaguagaagau

SEQ ID NO: 148138 - RNA, 62 nt, Human
aaagaauaauuuggaaucagcuaugcaaaucagucucacaauagcgugagcuaacugagaga

SEQ ID NO: 148139 - RNA, 62 nt, Human
cauuuuuagaaaggggcaguuuaaagcacaaugucucacaugggacaaaguuccaaaaugcc

SEQ ID NO: 148140 - RNA, 62 nt, Human
uaagcuaugaguugaaauguucugucaaaugugucucacaucuacacguggcuuggaggcuu

SEQ ID NO: 148141 - RNA, 62 nt, Human
aguuggggugaugggcuucuuucugcacuggagucucacaucuguuagcuuugacacucaag

SEQ ID NO: 148142 - RNA, 62 nt, Human
acuuuacugccgagaaacuuucaguagaugaagucucacaguuggugauuucuccgcucugu

SEQ ID NO: 148143 - RNA, 62 nt, Human
ucugccuaauagggucccccagggccccaccugucucacaagaacuucacucaaccccgugc

SEQ ID NO: 148144 - RNA, 62 nt, Human
caaaguuguguuucuuuuguguccuuaagcuugucucacaagaaagaugccaggccucuaaa

SEQ ID NO: 148145 - RNA, 62 nt, Human
augaauaaauggacaaaugaguaaaugagaaagucucacaccaugaaagaugcuaguccaau

SEQ ID NO: 148146 - RNA, 62 nt, Human
auauacugagguuugaguuucacuuucuuuaagucucacauugcuaacaugacauuagcugu

SEQ ID NO: 148147 - RNA, 62 nt, Human
uucccagcuuaaauuaacaauuguuaguauuagucucacacauaagugccauacauuuuauc

SEQ ID NO: 148148 - RNA, 62 nt, Human
agacuuacuuuuaaauauacucuuuggaguuagucucacaauguccauuccccuagcuccug

SEQ ID NO: 148149 - RNA, 62 nt, Human
ucucagccacucuucuuaaugaggcucccccugucucacauugaguugggcccauugguuau

SEQ ID NO: 148150 - RNA, 62 nt, Human
gacccaccagagccuauagaaucaauuccuuggucucacagccauguagacaagcccugguc

SEQ ID NO: 148151 - RNA, 62 nt, Human
auuuaccuuccuucccuuccugcucccagacagucucacaaguaaacaccagcagcucauag

SEQ ID NO: 148152 - RNA, 62 nt, Human
uuuuauccauagccauugcucccuugucaagugucucacaaggacauggaagaauguguuau

SEQ ID NO: 148153 - RNA, 62 nt, Human
aaaacucaaaggcucuuuucagagccacucaagucucacauaaagagcuuuaauauugaauu

SEQ ID NO: 148154 - RNA, 62 nt, Human
uucagacaucuccaaacucauccuuguguauagucucacacccuuccccauaaguauaaaug

SEQ ID NO: 148155 - RNA, 62 nt, Human
aaauugcagcacuacuuuaaauauuagauuaugucucacauagcacugcucauuuuacuuuu

SEQ ID NO: 148156 - RNA, 62 nt, Human
gucaagaugggcaacucagauggagcagcuuagucucacaguuugcuugucuauuuauuuua

SEQ ID NO: 148157 - RNA, 62 nt, Human
agccuuguccacacacacaucucacgccccuggucucacagccucacaccuuguccuuccac

SEQ ID NO: 148158 - RNA, 62 nt, Human
aggaguggccaugugagggcauggagucauuagucucacaaacacacuuuggacugaagagg

SEQ ID NO: 148159 - RNA, 62 nt, Human
cggguaugcaagccuaaaucuuuguacacuuugucucacagaauaguucugaggcuccauga

SEQ ID NO: 148160 - RNA, 62 nt, Human
gaucuucuuggagcgagcagaugcaaucucuugucucacaugcuagcaacauaccagguaac

SEQ ID NO: 148161 - RNA, 62 nt, Human
uugccauuuauuuaguaccagacauagugcuggucucacagcuuaauauuugguaaugaaua

SEQ ID NO: 148162 - RNA, 62 nt, Human
aagagaagagcucugcacuucccuuuguuguagucucacaguauaacagauauucuaauucu

SEQ ID NO: 148163 - RNA, 62 nt, Human
uguuuacauaagagaaagaggccagacauggugucucacacguuuaaucccagcacuuuggg

SEQ ID NO: 148164 - RNA, 62 nt, Human
auccacagcauucaaggucaggucuacucaaagucucacauggaaaagugaguucugccuuu

SEQ ID NO: 148165 - RNA, 62 nt, Human
cccuaucuucagguuaccauugcgcccucagggucucacaccuugggguugucagguucccg

SEQ ID NO: 148166 - RNA, 62 nt, Human
ucuuauuauacauguuaacaccuuuuacaguugucucacaggucuuggauauuucauucuau

SEQ ID NO: 148167 - RNA, 62 nt, Human
ggugcuaacuguaugugucuuuaucagugauggucucacagagccaacucacucuuaugaaa

SEQ ID NO: 148168 - RNA, 62 nt, Human
ccugccagggaggcagcuaccucgggaggaaggucucacaucugucucugggcacccaugcu

SEQ ID NO: 148169 - RNA, 62 nt, Human
uucuaggcccuuuucuaugucuuuacaucucugucucacacacacacacguauacacacaca

SEQ ID NO: 148170 - RNA, 62 nt, Human
gcagcggguagggcacagggaagagggagggugucucacaaccaaccaguucagaaugauac

SEQ ID NO: 148171 - RNA, 62 nt, Human
ggcaaaagucacuaucaaaugguugcuuauuugucucacacagccauauaguuuuuccugga

SEQ ID NO: 148172 - RNA, 62 nt, Human
ugcugugguuuugucccuugccuuccugccuagucucacaugucccuguuccucuuccccug

SEQ ID NO: 148173 - RNA, 62 nt, Human
ugcugugauuuugucccuugccuuccugccuagucucacaugucccugucccucucgcccug

SEQ ID NO: 148174 - RNA, 62 nt, Human
augcccguuccccucugccuggcagaaucacagucucacauacugucuuguacugacacauc

SEQ ID NO: 148175 - RNA, 62 nt, Human
aaccacucagagauggaucccauucccuaaaggucucacagcaaaggagcaggacucccagg

SEQ ID NO: 148176 - RNA, 62 nt, Human
cauccggagaauugccucuaccuggaccuuuugucucacacagcaguacccugaccugcugu

SEQ ID NO: 148177 - RNA, 62 nt, Human
uuuauauugagauucuuuguggcuauuggugugucucacaggcaaaauuugauuuggcuaaa

SEQ ID NO: 148178 - RNA, 62 nt, Human
aaaaauuuuuuuagaugauucuauauaacuucgucucacaaauaguguagguaucuggguuu

SEQ ID NO: 148179 - RNA, 62 nt, Human
uaaaccuccaaaaugaucaccuuugacuccacgucucacaaucaucucucucaaguucgaag

SEQ ID NO: 148180 - RNA, 62 nt, Human
gauucuugccucuagcaaugacaaccugugaugucucacaguagagcacuuagcgcagaauc

SEQ ID NO: 148181 - RNA, 62 nt, Human
augacgaugccgugugucucgucuccugacaugucucacagacgcuccugaaguuaggucau

SEQ ID NO: 148182 - RNA, 62 nt, Human
augugucacuggauuaauuuaucugauaaugugucucacaagaaucuguuagaucguuuauu

SEQ ID NO: 148183 - RNA, 62 nt, Human
uucccccauauuguucuugugguagugaauaagucucacaagaucugaugguuuuaucaggg

SEQ ID NO: 148184 - RNA, 62 nt, Human
ucuagcgcauuugauuucuccagguuugcugugucucacagaggcaguaggaacccagcucu

SEQ ID NO: 148185 - RNA, 62 nt, Human
cugucccucuucaggaagaaagagcucauucugucucacaagccaccggcauccuguaucag

SEQ ID NO: 148186 - RNA, 62 nt, Human
cagcccugggacccuccgaggugggugugcgggucucacaggugcuuccugggacuuccugu

SEQ ID NO: 148187 - RNA, 62 nt, Human
cugcggaaggggucaggcucaacugcugaugugucucacacguagcagacaaggggugucug

SEQ ID NO: 148188 - RNA, 62 nt, Human
acugcaccagccuggcaacagagcaagacuccgucucacaaaaaugaauaaauaaaauaaaa

SEQ ID NO: 148189 - RNA, 62 nt, Human
cucuccaugcccugggucacuuccuuuuuugggucucacagaccccuccaggggcugacacc

SEQ ID NO: 148190 - RNA, 62 nt, Human
aggugaaacauuuucucccuggauuuuuaccagucucacaugauuccagccaucaccuuaga

SEQ ID NO: 148191 - RNA, 62 nt, Human
uucuuuuacaaugaaaggggugaagagugagggucucacaguuccuuaccucaaagucccuu

SEQ ID NO: 148192 - RNA, 62 nt, Human
gacacagccccauguacacggccucaagggaugucucacauccucugucuauuugagacuua

SEQ ID NO: 148193 - RNA, 62 nt, Human
ugcauugcugcauccugggaaggggguauauggucucacaaguuguugucauuguuuuuuug

SEQ ID NO: 148194 - RNA, 62 nt, Human
uaauugaugcauuguggccccugaucuucccugucucacacuucuuuucucccaucccgguu

SEQ ID NO: 148195 - RNA, 62 nt, Human
uucagaaaccaaggcuaagggacuggucuaaagucucacagguaguauaugguggagccaac

SEQ ID NO: 148196 - RNA, 62 nt, Human
guugguucaaggacaacaccagaaugaagagggucucacaagacaccuguuauccucuucuu

SEQ ID NO: 148197 - RNA, 62 nt, Human
agaggccgguagggcaggggcugcuaguggcugucucacauacaccaguaauccuguuaaag

SEQ ID NO: 148198 - RNA, 62 nt, Human
gagggugaauguuucuucuuucucaucuacucgucucacacugagugguguuagucacugag

SEQ ID NO: 148199 - RNA, 62 nt, Human
cugcuuugcucuguaucuggcuggacugaucugucucacaagaagccaugaggccauaggga

SEQ ID NO: 148200 - RNA, 62 nt, Human
uuuuuguuuauguguuuguuuuuugagacagagucucacacuguggcccaggcuggacucca

SEQ ID NO: 148201 - RNA, 62 nt, Human
ccagguauaaauguuucucuuuuuuuaaacaugucucacauagaguaucuccgaaugcagcu

SEQ ID NO: 148202 - RNA, 62 nt, Human
uuguacaauugagaucaagugaauuggccccggucucacauuuucagugaagucagacucag

SEQ ID NO: 148203 - RNA, 62 nt, Human
gcaaaauuagaccucaagucugccucuacugugucucacaucaccauguagaagaaugggcg

SEQ ID NO: 148204 - RNA, 62 nt, Human
uacucuucauugaauuuaguuugucuaaaauagucucacagguaaaaaacauaacaacaaug

SEQ ID NO: 148205 - RNA, 62 nt, Human
agaagaagcagagcucuaguuuagccuuucuugucucacagaugugcuguaucccaggcaua

SEQ ID NO: 148206 - RNA, 62 nt, Human
ggugacaguuugugacauucugucuucaugaggucucacagucgacgcuccuguaaucauuc

SEQ ID NO: 148207 - RNA, 62 nt, Human
gaaaauuacgacaguuaagggcugggugcggugucucacaccuguaaucccagcacuuuggg

SEQ ID NO: 148208 - RNA, 62 nt, Human
ccugucucagcaccuccucccccaauucccaggucucacaucccaccccuccugcccuccaa

SEQ ID NO: 148209 - RNA, 62 nt, Human
cuuuuuuucugaaucugcuguucuacccaugugucucacauucauuuguauuauuucaagaa

SEQ ID NO: 148210 - RNA, 62 nt, Human
ucugugaaaaacuuguauacacaagcguccaugucucacacaaauauugaugugauuauucu

SEQ ID NO: 148211 - RNA, 62 nt, Human
uugagccugcagcacacacuaggccaccugcagucucacaggccaugcccuggguagacagg

SEQ ID NO: 148212 - RNA, 62 nt, Human
aaagauaauuauaguuacauguauugauuuaagucucacacacugugcuaauaaguccuuug

SEQ ID NO: 148213 - RNA, 62 nt, Human
cugagcaggaccucugaaacccuggaccaguggucucacauggugcuacgccugcauguaaa

SEQ ID NO: 148214 - RNA, 62 nt, Human
ggcuuugcucuuucagugagcuaggcaaucaagucucacagauugcugccucagagcaaugg

SEQ ID NO: 148215 - RNA, 62 nt, Human
uuauuuagcaagcccagaccuuccggucuaacgucucacaccacgacggacuccccuuccua

SEQ ID NO: 148216 - RNA, 62 nt, Human
aaaagagcauuugccuucuuuaaugaaugauggucucacaauucaguugacuuugaccuaau

SEQ ID NO: 148217 - RNA, 62 nt, Human
augaaauaauacuucagccaccagguuuuucugucucacauacauaagcagcauuucauugc

SEQ ID NO: 148218 - RNA, 62 nt, Human
aauaagagccugaagcaaugcuuacaauagaugucucacacagaacaauacaaauauguaaa

SEQ ID NO: 148219 - RNA, 62 nt, Human
uuuuguugaguuuucacucuucuaaugcaagggucucacacugugaaccacuuaggauguga

SEQ ID NO: 148220 - RNA, 62 nt, Human
cgaggccuacaacuuaggggcuggaaucacaggucucacauagagaaauagccagcuugaau

SEQ ID NO: 148221 - RNA, 62 nt, Human
cucauuacaccuauauuagcuugcuugaaguugucucacagcucacuuguauucuguugacu

SEQ ID NO: 148222 - RNA, 62 nt, Human
gcacacuggaucaaaaugcugcuuuccucugugucucacagcuuggcugagcucugucucug

SEQ ID NO: 148223 - RNA, 62 nt, Human
ucaaacagcuuccugaauuuuaauuuuguguugucucacagaaagccuuaucauaaauucca

SEQ ID NO: 148224 - RNA, 62 nt, Human
cuuuaaaaacuacaucuuuccuaugcaagagugucucacaugugcuuaaccgaggugcuucu

SEQ ID NO: 148225 - RNA, 62 nt, Human
ccucaggcuucugcagcccagggcacuagaacgucucacacucagagccggcuggcccggga

SEQ ID NO: 148226 - RNA, 62 nt, Human
aaggcauuuacucuaugucggggggucccugugucucacagcgguaaucguguguugcaucg

SEQ ID NO: 148227 - RNA, 62 nt, Human
ugcacauggccacucuuggccuaauaaaggaggucucacagucuucugucugggaugugcgc

SEQ ID NO: 148228 - RNA, 62 nt, Human
ccuagccauggugaaugaccagggcgaaguuagucucacagaauaccagggcuagaagacau

SEQ ID NO: 148229 - RNA, 62 nt, Human
aguccuggcagugccguggauggcggcaggaagucucacaucauagaggaccccuccuccuc

SEQ ID NO: 148230 - RNA, 62 nt, Human
aguugcauuuguugagacuuuaauggagauuugucucacaagugggaaagacugaagaaaca

SEQ ID NO: 148231 - RNA, 62 nt, Human
agagacagggucucaccauguuggccaggcuggucucacacugaccucaggugauccacccg

SEQ ID NO: 148232 - RNA, 62 nt, Human
aggccgaccuucucggaaaauucacccuaaaagucucacaaaagaaugaguucauggggaga

SEQ ID NO: 148233 - RNA, 62 nt, Human
cgucugcucuucagugaagaagcugguuuagagucucacagaaaacuuuugacuguauuuau

SEQ ID NO: 148234 - RNA, 62 nt, Human
gccuuacucauuucuaagugcaauaagggagugucucacaggauugcaccugugacauccug

SEQ ID NO: 148235 - RNA, 62 nt, Human
cccucagcucccacaagcuacccugggugacagucucacaucacgacccggagguccccuuc

SEQ ID NO: 148236 - RNA, 62 nt, Human
cagccaacuuuugcauguuuuguagagauggggucucacaguguugcccaggcuggucucaa

SEQ ID NO: 148237 - RNA, 62 nt, Human
gcagggcaugguggacaguaaugcugaguucugucucacacugaucaggcucagggccagag

SEQ ID NO: 148238 - RNA, 62 nt, Human
auuuugcuugccuggaauuuuaaaguucuuccgucucacaacucacaagaaacuuucugggu

SEQ ID NO: 148239 - RNA, 62 nt, Human
aauucuuggucuaugauaaauaaaguucaguagucucacauuccccaucuauuacccuaggu

SEQ ID NO: 148240 - RNA, 62 nt, Human
cucaguaaccccaucaacuugguggcccuggugucucacacuuguauccuucugcccucgag

SEQ ID NO: 148241 - RNA, 62 nt, Human
uuguaaggaagcgguggcggcuggugaagcaagucucacaugucggcguucuuggccaaugg

SEQ ID NO: 148242 - RNA, 62 nt, Human
ggccuuacgaagguuaagagaacuuuccccgugucucacagguagguagaggcagagcugga

SEQ ID NO: 148243 - RNA, 62 nt, Human
gaaugaguuaaauaucauugauagucuugugugucucacauaucagcuuuuucauaaggaaa

SEQ ID NO: 148244 - RNA, 62 nt, Human
caaggaaaaauacugaauuaguaauuuuaaaagucucacaaagaaaaucccaggccuagaug

SEQ ID NO: 148245 - RNA, 62 nt, Human
cacugucacauagacagcccugcaugcccccugucucacacaguuuguaaugaagacagcuc

SEQ ID NO: 148246 - RNA, 62 nt, Human
ccuuaauuucuuaguccucaccagaagaacaggucucacaaguauauauuugaugucuguaa

SEQ ID NO: 148247 - RNA, 62 nt, Human
gaggcacauucgugcacauucucacagacaccgucucacacguuggcuuuggacaaccaggc

SEQ ID NO: 148248 - RNA, 62 nt, Human
ugccaggagcccccuuucaggacacagcgggggucucacacuugcuguccccauccauggcc

SEQ ID NO: 148249 - RNA, 62 nt, Human
uuacagguuuucuugcagcugguaccauccaugucucacagcccuggccacugacagaucag

SEQ ID NO: 148250 - RNA, 62 nt, Human
uauauauauauguucuuguuuuuugagacagagucucacacuguugcccaggcuggagugca

SEQ ID NO: 148251 - RNA, 62 nt, Human
augagucacugaaaggccuucauggucucucggucucacaaggaccucuuaaccccucaaua

SEQ ID NO: 148252 - RNA, 62 nt, Human
augugcaaggauucccuucauguaaauucuuggucucacaugacacuuggucauucuuccag

SEQ ID NO: 148253 - RNA, 62 nt, Human
caaaaaguuuacuuucuucauggauauucuuggucucacauacuuguaaucaaguuuuucca

SEQ ID NO: 148254 - RNA, 62 nt, Human
ucuaaggauuacuuuuuuaaggaacauugucggucucacaugaugcuuguaaugaauuuuuc

SEQ ID NO: 148255 - RNA, 62 nt, Human
gaagagcccaggggcuggucccagaacaggcagucucacaagcacgcagcacacuggagugg

SEQ ID NO: 148256 - RNA, 62 nt, Human
augccgggcccucacucucucgccuguucugugucucacaugcuuuuucuuucaaaauuggg

SEQ ID NO: 148257 - RNA, 62 nt, Human
ugcuaagcuuucacuuauuuccuauuguguuggucucacaacacaccaauccugauacaaug

SEQ ID NO: 148258 - RNA, 62 nt, Human
aaguucucuuggcagaucuggguaaugugugugucucacauuuuuaucauguuuuuaugacu

SEQ ID NO: 148259 - RNA, 62 nt, Human
ugagucucagagcaggggaguggcuucccaaggucucacagcuuguccccaggggccaggca

SEQ ID NO: 148260 - RNA, 62 nt, Human
auuuucaaggagcuaaaagaagauuuuaaauggucucacaaaaacagauaaauauuugcaca

SEQ ID NO: 148261 - RNA, 62 nt, Human
guuuauguuaagaggauugggccaggcguggugucucacaccuguaaucccagcacuuugag

SEQ ID NO: 148262 - RNA, 62 nt, Human
acaccuaacuguguggcagaggcuucauuuaggucucacaacucacuagacaucaaaaugug

SEQ ID NO: 148263 - RNA, 62 nt, Human
gcuccucugauggggaacacccugaaguagucgucucacaaaggcuuuccuuggccacagug

SEQ ID NO: 148264 - RNA, 62 nt, Human
aaagagggacuacauauuucaggauauuguuggucucacaugacucuugauagaguuugcca

SEQ ID NO: 148265 - RNA, 62 nt, Human
guuuucuuuucuuuuuucuuuuuugagacagggucucacacugucacccaggcuggagugca

SEQ ID NO: 148266 - RNA, 62 nt, Human
ccaauuccagagcugucuggugaucacuuuaugucucacagggacccacauccaaacaugua

SEQ ID NO: 148267 - RNA, 62 nt, Human
cggacagggccacauuugcaugagacauggcugucucacaggucacagagccauuacaacag

SEQ ID NO: 148268 - RNA, 62 nt, Human
cucauuccccaccuucaacucccaccuuacaugucucacacuaucccaugguuggcauuaca

SEQ ID NO: 148269 - RNA, 62 nt, Human
guggggagaauugagaauagucaggccuaucagucucacagaaucaccccucuaccuuugau

SEQ ID NO: 148270 - RNA, 62 nt, Human
cuuagggaugugcuugcaaacccuucucaagggucucacaaccccaacaucuucagacuggc

SEQ ID NO: 148271 - RNA, 62 nt, Human
uguucccgauuuacuaaaauagguaaccaggcgucucacagucgccguccugucaagagcgc

SEQ ID NO: 148272 - RNA, 62 nt, Human
gcacccccucuaguucuaauaaagccgccucugucucacaccaaccucuguccugucugugg

SEQ ID NO: 148273 - RNA, 62 nt, Human
uugcugcuguaucuccuggccucugcuuuugugucucacaaaaacagagcuugucucaccau

SEQ ID NO: 148274 - RNA, 62 nt, Human
gcugccagagaaaguuggugcugcucauacuggucucacagucuaaguaagugucugugaug

SEQ ID NO: 148275 - RNA, 62 nt, Human
uucuucuucccauggugcuuuccuguuucucagucucacauuucucaacaaggcaaaaacaa

SEQ ID NO: 148276 - RNA, 62 nt, Human
cgggguguguguguggcguugaucuuuagccugucucacaccaguucagaaaacacuagacc

SEQ ID NO: 148277 - RNA, 62 nt, Human
cuaauaauuucugccaucuuuauaauuucuuugucucacagaagacuaggagaaagaucuuu

SEQ ID NO: 148278 - RNA, 62 nt, Human
ucauuaauuucaccuuuuuggagguguacagggucucacacauaaauuauugugcauggcau

SEQ ID NO: 148279 - RNA, 62 nt, Human
agaauacaagaaauguuucuggagcuaguuaugucucacaauuuuguagaaucuuacagcau

SEQ ID NO: 148280 - RNA, 62 nt, Human
ucaacggguuuccuaccuguagaauucuggcagucucacaaucuucuuucauuuuuuucugu

SEQ ID NO: 148281 - RNA, 62 nt, Human
gccucacaauugugguggaaggugaaaggcaugucucacauggcagcagacaagagaagaaa

SEQ ID NO: 148282 - RNA, 62 nt, Human
uauuagaguauauuagggaaaguguguauuuggucucacaggcuguucagggauaaucuaaa

SEQ ID NO: 148283 - RNA, 62 nt, Human
ucucagaggaccagagugacugaggguaaagugucucacagcccaugcugaauuuucugcau

SEQ ID NO: 148284 - RNA, 62 nt, Human
uuuugcuuauauguacuuuuuaaugaacacgugucucacacacaaaaagaauuaaggauuuu

SEQ ID NO: 148285 - RNA, 62 nt, Human
auaaaguacuaagggaucaugcuuauccuagggucucacagaagagaggacauauuuaauua

SEQ ID NO: 148286 - RNA, 62 nt, Human
gggccacucaccgaccugagucaguguccucugucucacagggccccucucccuucuguuca

SEQ ID NO: 148287 - RNA, 64 nt, Human
agcuugcucccaccugcccccuccacuucccucagaugaugaggagccagggcuaagggggcag

SEQ ID NO: 148288 - RNA, 64 nt, Human
ccacaggcccgcuaagccccaaaggcaggaucuagaugaugaugaacaugauuaugaagaaaua

SEQ ID NO: 148289 - RNA, 64 nt, Human
caggcccgcuaagccccaaaggcaggaucuagaugaugaugaacaugauuaugaagaaauacuu

SEQ ID NO: 148290 - RNA, 64 nt, Human
cugccugccugccugccugccugucugccuaugugaugaugaaaucucugcauggcugcaauga

SEQ ID NO: 148291 - RNA, 64 nt, Human
agucaagaucaacauuccaggguugguaauguuggaugaugaaacauucauuuuuaccuugugg

SEQ ID NO: 148292 - RNA, 64 nt, Human
auuuugagaaugguaaagaaauacacagggaggggaugaugacuauuaguggacucuuguuuuu

SEQ ID NO: 148293 - RNA, 64 nt, Human
uuuuugauaauuuaaauauugcugcugcuuuguagaugaugagaagaaauguuaaagugcuuuc

SEQ ID NO: 148294 - RNA, 64 nt, Human
gcccaagggcuccagacacaccugaacacaucgugaugaugacguccucucaacucucuuugua

SEQ ID NO: 148295 - RNA, 64 nt, Human
gugaaaugguuacagcuauuauagucauuucacagaugaugaaacuaagauucagagcagcuga

SEQ ID NO: 148296 - RNA, 64 nt, Human
uuuaaugauguuauucuagaauguuuucuuuccagaugaugauucagaagcuaauuuuaaaaaa

SEQ ID NO: 148297 - RNA, 64 nt, Human
acguggugucucacucugaaaagcaggaauguaagaugaugaaagagacaauguaauacuguug

SEQ ID NO: 148298 - RNA, 64 nt, Human
auucuuggaaaaguggcaagaccaaaaugacaaugaugaugauaaugaugaugacgacgacaac

SEQ ID NO: 148299 - RNA, 64 nt, Human
guggcaagaccaaaaugacaaugaugaugauaaugaugaugacgacgacaacgaugaugcuugu

SEQ ID NO: 148300 - RNA, 64 nt, Human
gaugucugggaugugaagaggcaaggcagaaauggaugaugaacaucaaaaacugucagaggac

SEQ ID NO: 148301 - RNA, 64 nt, Human
uauauuugaaaugaaaaucuccaacacauuagaagaugaugauguuagaugcccaucgugugcc

SEQ ID NO: 148302 - RNA, 64 nt, Human
gacaguagagaaugugagaggaucucaugguucugaugaugauuauccaacaaacaucuggccc

SEQ ID NO: 148303 - RNA, 64 nt, Human
cagucucauacugagugauuugaguagaaccacugaugaugauuuuauaaauugugugaagcga

SEQ ID NO: 148304 - RNA, 64 nt, Human
auuucaccucuccagacuuccauuucuucacaaggaugaugauggaaauaaaaugacuggcgug

SEQ ID NO: 148305 - RNA, 54 nt, Human
auaugaaguucauuuuuuagacuugaugaugaaugaagaaugcauggaggacug

SEQ ID NO: 148306 - RNA, 64 nt, Human
gugugagaugguaugcauuucuguagugauuagugaugaugagugauuuuuauaugcuuuuuaa

SEQ ID NO: 148307 - RNA, 64 nt, Human
aguaauucucuauaccaagauaugcuaggaguaggaugaugauucaaagugguaacccaaauuc

SEQ ID NO: 148308 - RNA, 64 nt, Human
auaaucugucuguucccuggagaugggaauagaggaugaugacaguuuauuuucuacacuuccc

SEQ ID NO: 148309 - RNA, 64 nt, Human
uaaugugauaugaaaauaucuggguuuuucuuuugaugaugaaguauugcuaauauuaccgugg

SEQ ID NO: 148310 - RNA, 64 nt, Human
auucuccagaaggaacuugggagaugauggugcagaugaugaaacuggguucaucccaguucca

SEQ ID NO: 148311 - RNA, 64 nt, Human
ccuacuagauggacaggcugagguguuuggcagugaugaugaccacauucaguuugugcaggua

SEQ ID NO: 148312 - RNA, 64 nt, Human
uucuccuaagaaaaauccgcugugggcagagaacgaugaugauuuaaugguguuuacuccuuua

SEQ ID NO: 148313 - RNA, 64 nt, Human
gaauaaaugaaaccaaucucaauuuagagguauggaugaugacagaaagcccaauagaagcuua

SEQ ID NO: 148314 - RNA, 64 nt, Human
ccaccuugacacaguaacuuccucuuauagucaagaugaugauuaaguguuuaauuuuuauucc

SEQ ID NO: 148315 - RNA, 64 nt, Human
ugagcgugaccuugcaauguucaacauuaacauugaugaugacuacgucccgugucuccagggg

SEQ ID NO: 148316 - RNA, 64 nt, Human
agagcuggguuccuugggaggaaguuguaguggugaugaugaugaugauaaugaugaugaugau

SEQ ID NO: 148317 - RNA, 64 nt, Human
gcuggguuccuugggaggaaguuguaguggugaugaugaugaugauaaugaugaugaugauggu

SEQ ID NO: 148318 - RNA, 64 nt, Human
ggguuccuugggaggaaguuguaguggugaugaugaugaugauaaugaugaugaugaugguggu

SEQ ID NO: 148319 - RNA, 64 nt, Human
aggaaguuguaguggugaugaugaugaugauaaugaugaugaugauggugguguugaugguggc

SEQ ID NO: 148320 - RNA, 64 nt, Human
aaguuguaguggugaugaugaugaugauaaugaugaugaugauggugguguugaugguggcggu

SEQ ID NO: 148321 - RNA, 64 nt, Human
auacaguuuuuuauguaaaauauuaaaagacuaugaugaugacauuuauaaaauggcucuugug

SEQ ID NO: 148322 - RNA, 64 nt, Human
ucaguaguggggaauucugugacagcugauugaagaugaugaugaagaaccucugcauucuagu

SEQ ID NO: 148323 - RNA, 64 nt, Human
guaguggggaauucugugacagcugauugaagaugaugaugaagaaccucugcauucuaguuac

SEQ ID NO: 148324 - RNA, 64 nt, Human
agguuagugacaaaauuggccagagagugggggugaugaugaccaagaauuacaaguagaaugg

SEQ ID NO: 148325 - RNA, 64 nt, Human
uuguauauacuucugcaauuauaagauguuuuuugaugaugaaagcuuuccuaagguaauucuu

SEQ ID NO: 148326 - RNA, 64 nt, Human
uuuaaaggcucuacaauugaaugagcucaccauggaugaugauaccgccgugcucgucauugac

SEQ ID NO: 148327 - RNA, 64 nt, Human
gggagguguacccaacagcucauugagagcgggcgaugaugacaguggcggcuuuguggagugg

SEQ ID NO: 148328 - RNA, 64 nt, Human
uauaugauuuauucacaguuccucaaggccuggggaugaugaucaguuauaccuauuuuugugc

SEQ ID NO: 148329 - RNA, 64 nt, Human
agaguagaaauaaaagugaaugaaagauuaaacagaugaugagaauuucuaaaaagauuagcaa

SEQ ID NO: 148330 - RNA, 64 nt, Human
ggaugaaaagauuucaggcaaagacuugcaggaagaugaugauaacggcgaugugaaucgucaa

SEQ ID NO: 148331 - RNA, 64 nt, Human
aaauuuucuuuguagguuugauccagaucgguuugaugaugaauuaguaaugaaaacuuuuucc

SEQ ID NO: 148332 - RNA, 64 nt, Human
ugcuacuggugcaauuggaucaguguaugauauggaugaugaugaaauggaccccaauuaugcc

SEQ ID NO: 148333 - RNA, 64 nt, Human
uacuggugcaauuggaucaguguaugauauggaugaugaugaaauggaccccaauuaugccaga

SEQ ID NO: 148334 - RNA, 64 nt, Human
caccuuucuacauuuugcugacagauaacuaaccgaugaugaggccgagguaaaagagacaucu

SEQ ID NO: 148335 - RNA, 64 nt, Human
auccuguggugcccccuucccccugccuugugaugaugaugagugagucuccccuuaauuagac

SEQ ID NO: 148336 - RNA, 64 nt, Human
gaaauccuguggugcccccuucccccugccuugugaugaugaugagugagucuccccuuaauua

SEQ ID NO: 148337 - RNA, 64 nt, Human
uagaaguucuaagcgggagaugacucccuacugggaugaugaaggauggcauccuagugaagaa

SEQ ID NO: 148338 - RNA, 64 nt, Human
uguuuucauuaucucaaaacugcacugucaagaugaugaugaucuuuaaaauacacacucaaau

SEQ ID NO: 148339 - RNA, 64 nt, Human
uuuuguuuucauuaucucaaaacugcacugucaagaugaugaugaucuuuaaaauacacacuca

SEQ ID NO: 148340 - RNA, 64 nt, Human
gcacaucagagaaagaaacugcauguuuguuguugaugaugaaauaaaaaugcuagcgacaguc

SEQ ID NO: 148341 - RNA, 64 nt, Human
ccagaagcccucgggcaugcccagugcaccaugggaugaugaaauuaaggagaacagcugaguc

SEQ ID NO: 148342 - RNA, 64 nt, Human
acuggcaguugucaucaaacauaaugaugaguaagaugaugaaugagauguaaaugugccaaga

SEQ ID NO: 148343 - RNA, 64 nt, Human
aaaggaugcuuucggaaaacacgcuguauaccuagaugaugacuaaaugcaaaauccuugggcu

SEQ ID NO: 148344 - RNA, 64 nt, Human
cacaccuccaagaucaagauccuguucugagucagaugaugaugacagcagugaaacuccuccu

SEQ ID NO: 148345 - RNA, 64 nt, Human
accuccaagaucaagauccuguucugagucagaugaugaugacagcagugaaacuccuccucac

SEQ ID NO: 148346 - RNA, 64 nt, Human
ggagaguucaagugaugagcagacgccuagucgggaugaugauagccaguccaggaguccaagu

SEQ ID NO: 148347 - RNA, 64 nt, Human
cuuuauccaaaagcacaucuugugcuccaugcaggaugaugacagaauugaucugauguuacug

SEQ ID NO: 148348 - RNA, 64 nt, Human
aaagaaaugucagacacucuuuggauuugauucagaugaugaaaguaagucuucugucuucuua

SEQ ID NO: 148349 - RNA, 64 nt, Human
uucauggaaaccccacaccaaggcaagaggcagagaugaugauuccauuucauauauacacuca

SEQ ID NO: 148350 - RNA, 64 nt, Human
cuuguuuugugacuggaccacugcccaggugcuugaugaugaccaggagugugcucugggaaug

SEQ ID NO: 148351 - RNA, 64 nt, Human
uaugagcugacuccaaauggacagcccagaagcugaugaugagaauucuuaucacucaccuuua

SEQ ID NO: 148352 - RNA, 64 nt, Human
uuccuugagccuguuuccacaccuguaaaguggggaugaugauccuaucucacugcuuuuguga

SEQ ID NO: 148353 - RNA, 64 nt, Human
auguagguguugagcuccugguuuucuguguuuggaugaugaagauuuggacccuuccauucau

SEQ ID NO: 148354 - RNA, 64 nt, Human
cuccuagaguuuugacuugggacucuaguguuaagaugaugagcccgugcaucagguccuucug

SEQ ID NO: 148355 - RNA, 64 nt, Human
cuuccccuucacaguguacuugcggaagcuguuggaugaugagcagccccugcggcugcggcuc

SEQ ID NO: 148356 - RNA, 64 nt, Human
gcuagaagcuaaauuugccgaguuagaagguggagaugaugauauugaagagaugggagaagaa

SEQ ID NO: 148357 - RNA, 64 nt, Human
auugaagagguuuucacucucugcuaaagugguagaugaugaaauuuacuacuucagguaaagc

SEQ ID NO: 148358 - RNA, 64 nt, Human
cguggccucuguauuugcaaaugcagauaaaggugaugaugagaagaauacagacaacucagag

SEQ ID NO: 148359 - RNA, 64 nt, Human
auggugaaagagagaugccguguuuugaaaguaagaugaugaaaugaauuuuuaauucaagaaa

SEQ ID NO: 148360 - RNA, 64 nt, Human
aaucacaaacucauuuucugguuuuuagaaaguagaugaugauuucagaggaguaaggcaugcc

SEQ ID NO: 148361 - RNA, 64 nt, Human
cuccucucccuacugugacccuggaggcucuuaagaugaugaugguuuuuuuuauugggcugag

SEQ ID NO: 148362 - RNA, 64 nt, Human
caugacagcuaacagggacgggcuuucuuuggaagaugaugaaauuguggaaugaugguugcac

SEQ ID NO: 148363 - RNA, 64 nt, Human
ggcucagaggauagcgguuuccaucauaaaccaagaugaugaguucagccuuuaucccucgugg

SEQ ID NO: 148364 - RNA, 64 nt, Human
gggucagaggauagcgguuuccaucauaaaccaagaugaugaguucagccuuuaucccucgugg

SEQ ID NO: 148365 - RNA, 64 nt, Human
gaggcaagccgccucuucucggccaucgacugcagaugaugaaagagcgggauucaacuuuguu

SEQ ID NO: 148366 - RNA, 64 nt, Human
gaaguaguugagggagagauugggggaauggggagaugaugaugauggucaaagggugcaaaau

SEQ ID NO: 148367 - RNA, 64 nt, Human
guaguugagggagagauugggggaauggggagaugaugaugauggucaaagggugcaaaaucuc

SEQ ID NO: 148368 - RNA, 64 nt, Human
ucuguuuguuuuuuaaacuaugcaccagguuucugaugaugaaauaaagcaccuguuuguuuua

SEQ ID NO: 148369 - RNA, 64 nt, Human
gccucacuggucccagaucagggcuccagggacagaugaugagucucaaacgagccagccaggg

SEQ ID NO: 148370 - RNA, 64 nt, Human
caguugcagauagccuauuuauuauaaauuaugagaugaugaaaauaauaaagccaguggaaau

SEQ ID NO: 148371 - RNA, 64 nt, Human
aauguaauuucguugcuauaguaguuugcuaaaagaugaugaaaaugcagaaugucuuuuuaaa

SEQ ID NO: 148372 - RNA, 64 nt, Human
gaaaaaaacaaaauaaauuuugugugauaauuuugaugaugaaagguggaaguucuaccuagau

SEQ ID NO: 148373 - RNA, 64 nt, Human
guaaaauuacugaauaucagaaaaaauguuaauugaugaugaagcuuauucccaaaaugccuuu

SEQ ID NO: 148374 - RNA, 64 nt, Human
acaguauuaguuuguggcuauaaaugauuauuuagaugaugacugaaaauguguauaaaguaau

SEQ ID NO: 148375 - RNA, 64 nt, Human
ucauugaguauauugcuucaagguacaaacccaggaugaugauguugucaccacugucucuuaa

SEQ ID NO: 148376 - RNA, 64 nt, Human
cugaaguuuuuuaaauuuauggcuauuuuuacacgaugaugaauuuugacaguuugugcauuuu

SEQ ID NO: 148377 - RNA, 64 nt, Human
gauuuaaaaauguauuuuuaaaaauguuuacauugaugaugaguaauauugcauguguuuucag

SEQ ID NO: 148378 - RNA, 64 nt, Human
gcuuuccacaaaaugucaccucgcugcacuaaaggaugaugaauccuaaucauuaaaggaauug

SEQ ID NO: 148379 - RNA, 64 nt, Human
aaauggauuacacauguauacaaagauacgauuugaugaugacacuggcacauuauucuaaacu

SEQ ID NO: 148380 - RNA, 64 nt, Human
acuccauuuugagcaggcugcuuaaagugguggugaugaugaugaugaugauggcagcuuuaua

SEQ ID NO: 148381 - RNA, 64 nt, Human
ccauuuugagcaggcugcuuaaagugguggugaugaugaugaugaugauggcagcuuuauaucg

SEQ ID NO: 148382 - RNA, 64 nt, Human
uuuugagcaggcugcuuaaagugguggugaugaugaugaugaugauggcagcuuuauaucgagu

SEQ ID NO: 148383 - RNA, 64 nt, Human
ugagcaggcugcuuaaagugguggugaugaugaugaugaugauggcagcuuuauaucgagugcc

SEQ ID NO: 148384 - RNA, 64 nt, Human
ucuuggaagagcacccggagcugaagcugucccugaugaugaaggugaaacgucagcccuggcc

SEQ ID NO: 148385 - RNA, 64 nt, Human
cauuagguauuaauugcaugggucuaacuacauugaugaugagaguuuaauuccaacuagagua

SEQ ID NO: 148386 - RNA, 64 nt, Human
cauaaauuucagugccucuuguaagcauuaaacugaugaugaagaaaguuccugauuugagaaa

SEQ ID NO: 148387 - RNA, 64 nt, Human
ucuuuuuacaugggaugaauugugcacuucuacugaugaugacuacagcagaagugauguuaua

SEQ ID NO: 148388 - RNA, 64 nt, Human
uauuucccauaagccccucagaaaggcuaacugugaugaugacacuuugguacaauuuagaugu

SEQ ID NO: 148389 - RNA, 64 nt, Human
cauuuuugugcccccucugcuuacugugacagucgaugaugaaucuugcguugccauuuucugc

SEQ ID NO: 148390 - RNA, 64 nt, Human
agugaugugucuguaucuuuaauguaaauagagagaugaugaaaaaagagucuauuuuaguguu

SEQ ID NO: 148391 - RNA, 64 nt, Human
acuaaacuuauucucucauccgaaguccaaagaggaugaugaagcccugggcuuugccugguuu

SEQ ID NO: 148392 - RNA, 64 nt, Human
uaaacuugauguaauugguuugggagggggcagugaugaugacuucugaaacaaaauuuggauu

SEQ ID NO: 148393 - RNA, 64 nt, Human
uuguucuuuguguuuuaggugcagcucaguggaagaugaugacaaccagaagacaugagcuaag

SEQ ID NO: 148394 - RNA, 64 nt, Human
ugcuugaacauguauuuaggggcaaguuucucaugaugaugaaaaaguaucaagucauauugcu

SEQ ID NO: 148395 - RNA, 64 nt, Human
uauuacugauuggguagagggggaaaaggagaaugaugaugauaguuuccuucugucuauugac

SEQ ID NO: 148396 - RNA, 64 nt, Human
uacacauggagagaugccccauggugggcaggcagaugaugaaguacuggcagguaggcagccu

SEQ ID NO: 148397 - RNA, 64 nt, Human
caaaaggaaauugcaucuugugacuuaguagacugaugaugauauccauuuuguagacucauca

SEQ ID NO: 148398 - RNA, 64 nt, Human
ugaccuuaagagggaagggaaaaaagugugaaaggaugaugaagaaaauaauuuuacuauuucu

SEQ ID NO: 148399 - RNA, 64 nt, Human
cuucaaucaggaagcuauuugccuggcuccagcagaugaugagauaaugagguaguggguuuuu

SEQ ID NO: 148400 - RNA, 64 nt, Human
caucaucaaaacaccaaagacucaagacacagaagaugaugagggagcucaguggaauuguacc

SEQ ID NO: 148401 - RNA, 64 nt, Human
cuuucaggcaaugauuuacaaaaguagcauaguagaugaugacaacugugaacucugacauaaa

SEQ ID NO: 148402 - RNA, 64 nt, Human
aaaucugcugaucucuguagaaucuuagaggcuugaugaugaugguguuggugaaaauaagaaa

SEQ ID NO: 148403 - RNA, 64 nt, Human
aacucuaaaagguuaauuucugucaaaugcaguagaugaugaaagaaagguugguauuaucagg

SEQ ID NO: 148404 - RNA, 64 nt, Human
gaccuuccaaaacauuggcuuugacaucugccaagaugaugauuccauccaccuggaguccauc

SEQ ID NO: 148405 - RNA, 64 nt, Human
gggcaauagagcgagacccugucucuuaaaaaacgaugaugaugaacacagaggacggggcacu

SEQ ID NO: 148406 - RNA, 64 nt, Human
caauagagcgagacccugucucuuaaaaaacgaugaugaugaacacagaggacggggcacugug

SEQ ID NO: 148407 - RNA, 64 nt, Human
agcauauccugagucauuugaccaagacacagaagaugaugaaugggaaaaaaaacauagagau

SEQ ID NO: 148408 - RNA, 64 nt, Human
gauaaguuuucaguaauaauaaccuauuuaaucagaugaugauguguuugaaaauaguguucaa

SEQ ID NO: 148409 - RNA, 64 nt, Human
cugccuuucccaaagugguuagguuuggaaaagagaugaugaugguaauauuuuauuugugcuu

SEQ ID NO: 148410 - RNA, 64 nt, Human
gaauuuuaaaagaugcaauguagaggggaaaagagaugaugaaaauauuuaaaggcccuaucug

SEQ ID NO: 148411 - RNA, 64 nt, Human
auucaagcucucagcuacuccugaaacgggcagagaugaugaacagaaguguauguaaauacag

SEQ ID NO: 148412 - RNA, 64 nt, Human
augauacagccaugcugacauucaucaccgcaaagaugaugauuccagucucugguuccuuucc

SEQ ID NO: 148413 - RNA, 64 nt, Human
gccauggcucuucccagcagccugugcaaauucugaugaugaccccacccccgcacacgcacac

SEQ ID NO: 148414 - RNA, 64 nt, Human
uaucaaaaccugagcuaaaaccaaugcaucagcugaugaugacagcagagaguggcagggcuga

SEQ ID NO: 148415 - RNA, 64 nt, Human
cacagugggcgacagaucugaagugaagacaggagaugaugagaaaagcucaccgcaucagcug

SEQ ID NO: 148416 - RNA, 64 nt, Human
ucaaaggcugcaacccuauggccucuuggagacagaugaugacuggcaaggacuagagagcagg

SEQ ID NO: 148417 - RNA, 64 nt, Human
aauaacccacuagugccugagcucagugcugcuggaugaugagggagaucaagaaaaagccacg

SEQ ID NO: 148418 - RNA, 64 nt, Human
ugguccugcagcagccccuggcaaugagcugccugaugaugagucccaagguacauuguucuac

SEQ ID NO: 148419 - RNA, 64 nt, Human
aauauuaccauucuucuauggaaagaaaacuuuugaugaugaaacaauaaagauuuuaaauauc

SEQ ID NO: 148420 - RNA, 64 nt, Human
cagcaggaagcccaagugaaauuaauauuaugcagaugaugaaagggaccucugaacaggauuu

SEQ ID NO: 148421 - RNA, 64 nt, Human
ugacgaaaugcuuauagagaguagcuccgaccuagaugaugauucuuccuguagcaucuggccc

SEQ ID NO: 148422 - RNA, 64 nt, Human
ggacuguaaaucucucgcagacccugggagcucagaugaugaugauguuaguaguuuggaagaa

SEQ ID NO: 148423 - RNA, 64 nt, Human
cuguaaaucucucgcagacccugggagcucagaugaugaugauguuaguaguuuggaagaagaa

SEQ ID NO: 148424 - RNA, 64 nt, Human
gccuucaggacccagagggcuuccuauucaaggagaugaugaccuggguccagggcccagaccu

SEQ ID NO: 148425 - RNA, 64 nt, Human
cucaaucaagaaugagaagcuugaaugggcaguagaugaugaagagaaaaaaaagucucccuca

SEQ ID NO: 148426 - RNA, 64 nt, Human
uucguuuacuugccuacagugcuguacgcaauaagaugaugaucccaaaauaugguaaagugaa

SEQ ID NO: 148427 - RNA, 64 nt, Human
cgugcaugcaaacagcgauuugcaaagaccguaugaugaugaucaugaucuuacuggugaauua

SEQ ID NO: 148428 - RNA, 64 nt, Human
aggucaaaaaucagauuauuuucauucaaaugaggaugaugagucacuguaauaucaaaaaauc

SEQ ID NO: 148429 - RNA, 64 nt, Human
aaugauaaagcagugauguggauuucuguauucugaugaugagucucuucagaguacugcucau

SEQ ID NO: 148430 - RNA, 64 nt, Human
uaagauguuuguguaaagaaauuucuaauguaaagaugaugauuuugaaaaauuuuauauauuc

SEQ ID NO: 148431 - RNA, 64 nt, Human
gcagcccaguggaaccacaaaaaggccaauuucagaugaugacuguccaagugccuccaaagug

SEQ ID NO: 148432 - RNA, 64 nt, Human
ccauagaagaagcugcagaagaaaugaagaaagugaugaugauuuagauuuugauauugauuua

SEQ ID NO: 148433 - RNA, 64 nt, Human
gagcaagaggaacaugcuuguuuugaaaacucgagaugaugagggugguacaugcaguguguuc

SEQ ID NO: 148434 - RNA, 64 nt, Human
gcauaauuucucaauaucuuuagcacaguauggugaugaugacuuuuaagcauuuacaucacgu

SEQ ID NO: 148435 - RNA, 64 nt, Human
cauuggggcgaaugaaccaaguuucgccaugcuggaugaugaaauggauucccaucccaaaguc

SEQ ID NO: 148436 - RNA, 64 nt, Human
augggaaauuugcugagcccccaccagggaaccggaugaugaaacagggauaccucacagcuug

SEQ ID NO: 148437 - RNA, 64 nt, Human
aaccaccugcguggcuaggaugauuaauuaugaggaugaugauuuuuuuugugauaacaguauu

SEQ ID NO: 148438 - RNA, 64 nt, Human
gaauauagcaauuaccuaugacggauuagaggaagaugaugaggucuuugaaguaauucugaac

SEQ ID NO: 148439 - RNA, 64 nt, Human
auuccuaccuccucuagugcagggacccaaguuagaugaugagaaaaugccaaacaaagggagg

SEQ ID NO: 148440 - RNA, 63 nt, Human
acaaugauggcauuuuaacuuauucaugauuagagaugaugauaugguuuggauauuuguugu

SEQ ID NO: 148441 - RNA, 64 nt, Human
uugccaacaaaucuaguucuauacaguuucuugggaugaugauaauaaacauuuauugagcaau

SEQ ID NO: 148442 - RNA, 64 nt, Human
ugauuaauauuauuaauauaauaaugaugaugaugaugaugaaaacuaaggauuuuucaagaga

SEQ ID NO: 148443 - RNA, 64 nt, Human
auaugauuaauauuauuaauauaauaaugaugaugaugaugaugaaaacuaaggauuuuucaag

SEQ ID NO: 148444 - RNA, 64 nt, Human
aggauaugauuaauauuauuaauauaauaaugaugaugaugaugaugaaaacuaaggauuuuuc

SEQ ID NO: 148445 - RNA, 64 nt, Human
uuaaggauaugauuaauauuauuaauauaauaaugaugaugaugaugaugaaaacuaaggauuu

SEQ ID NO: 148446 - RNA, 64 nt, Human
ccuuggccagggcugacuccuuaaauuucuggaugaugaugauuguuauuuaauagccagaggc

SEQ ID NO: 148447 - RNA, 64 nt, Human
ccaccuuggccagggcugacuccuuaaauuucuggaugaugaugauuguuauuuaauagccaga

SEQ ID NO: 148448 - RNA, 64 nt, Human
ugucuuccgcuagaacaacgucuacaaaugugaagaugaugacuucuggcacgcggucaugagg

SEQ ID NO: 148449 - RNA, 64 nt, Human
agguaaaucagacuaugaaguuuuuuuuauacaggaugaugacuauggaaagaguacucuuguu

SEQ ID NO: 148450 - RNA, 64 nt, Human
guacauucuagugugguguauacugguggcuguugaugaugauuuuuuuuuuuuuacacaauuc

SEQ ID NO: 148451 - RNA, 64 nt, Human
ucguuuguauucuaccuuuguaaaacagccuauagaugaugauguguuugggauacugcuuauu

SEQ ID NO: 148452 - RNA, 64 nt, Human
auuaacuacugaauaaugcuaccaggaugcuaaagaugaugauguuaacccauuccaguacagu

SEQ ID NO: 148453 - RNA, 64 nt, Human
caggguaaggcaggaggaagugggugagcuccgagaugaugagcacaugaagccuguggccccu

SEQ ID NO: 148454 - RNA, 64 nt, Human
gcauaugaagucuuucuucccccaacucuugaacgaugaugauauucagacgaagcauugaugu

SEQ ID NO: 148455 - RNA, 64 nt, Human
uuuaaaauauauaucuuuauaaaguaauauucaggaugaugauaaaaauuguuuauauuguuau

SEQ ID NO: 148456 - RNA, 64 nt, Human
agguauuccguuuaucacaguccacuuaaaaaaugaugaugaugauaaaaaccacgacccaacc

SEQ ID NO: 148457 - RNA, 64 nt, Human
uauuccguuuaucacaguccacuuaaaaaaugaugaugaugauaaaaaccacgacccaaccagg

SEQ ID NO: 148458 - RNA, 64 nt, Human
aagagauaaagcuuacuugacuuucaaauggagagaugaugaaaacccacucauucacucuuuc

SEQ ID NO: 148459 - RNA, 64 nt, Human
aaaauaaucauucuuauuucaugaaaauuguggggaugaugaaauaaguuaacaccuuuaaagu

SEQ ID NO: 148460 - RNA, 64 nt, Human
cauuuagugugaauauuccuuuauuuugcugcuugaugaugagagggagggcugcugccacaga

SEQ ID NO: 148461 - RNA, 64 nt, Human
gaagcaaacauuuuuuucuaagaauugcuucucagaugaugauaucaaauguauaugcuuuugc

SEQ ID NO: 148462 - RNA, 64 nt, Human
gggcuguguuuucgaugaugaugaugaucaugaugaugaugauuuuaacaguuuuacuucuggc

SEQ ID NO: 148463 - RNA, 64 nt, Human
cuggggcuguguuuucgaugaugaugaugaucaugaugaugaugauuuuaacaguuuuacuucu

SEQ ID NO: 148464 - RNA, 64 nt, Human
cuguaaagcaaacuggggcuguguuuucgaugaugaugaugaucaugaugaugaucaucaugau

SEQ ID NO: 148465 - RNA, 64 nt, Human
gggcuguaaagcaaacuggggcuguguuuucgaugaugaugaugaucaugaugaugaucaucau

SEQ ID NO: 148466 - RNA, 64 nt, Human
cuugggcuguaaagcaaacuggggcuguguuuucgaugaugaugaugaucaugaugaugaucau

SEQ ID NO: 148467 - RNA, 64 nt, Human
ugggagcacuuuguaggcauugcaugaaccaugggaugaugauucuguggagguauugccuugu

SEQ ID NO: 148468 - RNA, 64 nt, Human
ugcauuacaacuuguuuucuuauguaauaauaaugaugaugaugaugauaauaauaaauauuuu

SEQ ID NO: 148469 - RNA, 64 nt, Human
auuacaacuuguuuucuuauguaauaauaaugaugaugaugaugauaauaauaaauauuuuuga

SEQ ID NO: 148470 - RNA, 64 nt, Human
acaacuuguuuucuuauguaauaauaaugaugaugaugaugauaauaauaaauauuuuugagug

SEQ ID NO: 148471 - RNA, 64 nt, Human
uuggaaucuagccgauggaaaauaccuaauuguggaugaugauugcgcagggagggguacgugg

SEQ ID NO: 148472 - RNA, 64 nt, Human
cccagcacacaaggaagaccagauguagcuacaggaugaugaaacaugguuucaaacgaguucu

SEQ ID NO: 148473 - RNA, 64 nt, Human
uugcuaccaaacagucauguauuaacucucuuuggaugaugaaguuuaaagagucaauaaauag

SEQ ID NO: 148474 - RNA, 64 nt, Human
aauuuuauucagauaaucuguaccucaucaaucagaugaugacaauuuacuucccaggucucau

SEQ ID NO: 148475 - RNA, 64 nt, Human
ccacgcaaggcugcaccucuguguguugggagacgaugaugauguccauugcugugugauggcu

SEQ ID NO: 148476 - RNA, 64 nt, Human
gauucccguccggugucacaguucagucagugaggaugaugaaguagauacagucuucaggaca

SEQ ID NO: 148477 - RNA, 64 nt, Human
agauaguucaccugugaacgaacaucagcuuacagaugaugaggacuuaagguugcaagaauga

SEQ ID NO: 148478 - RNA, 64 nt, Human
uuuggccagucuuguuuuuuaggcaccuuugcaugaugaugacucuugaacagagcaaaaaaca

SEQ ID NO: 148479 - RNA, 64 nt, Human
uaaauauauauuauauuuaaacauucauggcauagaugaugauuuacagacaauuuaaaaguuc

SEQ ID NO: 148480 - RNA, 64 nt, Human
uucgggcugagcagcugcagggagcccccuuucugaugaugaaacugaugcuugagccccgacc

SEQ ID NO: 148481 - RNA, 64 nt, Human
guauugccuguuaauugcugcuaauucuaauucugaugaugacuccuacuccauuguuuacccc

SEQ ID NO: 148482 - RNA, 64 nt, Human
cacccugcuagaugucaucucuggauugcacauggaugaugaaggaacucagcauugaaaguug

SEQ ID NO: 148483 - RNA, 64 nt, Human
ugggcagaaaaaaguaaaacuugcugcugcugcugaugaugaugaugaugaagaugaugaugau

SEQ ID NO: 148484 - RNA, 64 nt, Human
gcagaaaaaaguaaaacuugcugcugcugcugaugaugaugaugaugaagaugaugaugaugau

SEQ ID NO: 148485 - RNA, 64 nt, Human
gaaaaaaguaaaacuugcugcugcugcugaugaugaugaugaugaagaugaugaugaugaugau

SEQ ID NO: 148486 - RNA, 64 nt, Human
aaaaguaaaacuugcugcugcugcugaugaugaugaugaugaagaugaugaugaugaugaugac

SEQ ID NO: 148487 - RNA, 64 nt, Human
acuugcugcugcugcugaugaugaugaugaugaagaugaugaugaugaugaugacgaggaagcu

SEQ ID NO: 148488 - RNA, 64 nt, Human
ugcugcugcugcugaugaugaugaugaugaagaugaugaugaugaugaugacgaggaagcugaa

SEQ ID NO: 148489 - RNA, 64 nt, Human
ugcugcugcugaugaugaugaugaugaagaugaugaugaugaugaugacgaggaagcugaagaa

SEQ ID NO: 148490 - RNA, 64 nt, Human
ugcugcugaugaugaugaugaugaagaugaugaugaugaugaugacgaggaagcugaagaaaaa

SEQ ID NO: 148491 - RNA, 64 nt, Human
ugcugaugaugaugaugaugaagaugaugaugaugaugaugacgaggaagcugaagaaaaagcg

SEQ ID NO: 148492 - RNA, 64 nt, Human
gcuaaugaauuaggcaggggagcuauuuuuugaagaugaugaacuaaauguugaagacaaguuu

SEQ ID NO: 148493 - RNA, 64 nt, Human
ucuggaugcccgggauggcaaugagguggagccugaugaugaccacuucuccauugugaguggc

SEQ ID NO: 148494 - RNA, 64 nt, Human
cagccagcccaggauccguccucauuuuauuggugaugaugaaugggaaugaaaucagggggcu

SEQ ID NO: 148495 - RNA, 64 nt, Human
uaaauugaauugguuuuuuuacugaagcuauugugaugaugauuauuuauuaguaacugguuau

SEQ ID NO: 148496 - RNA, 64 nt, Human
auauucacaucuaauagguuaauauguacauuuggaugaugauuuuucuugauaacauuaacau

SEQ ID NO: 148497 - RNA, 64 nt, Human
caacaguggcccgugccaaagcacuuaccaaagugaugaugacuaagguuggucaugccaagua

SEQ ID NO: 148498 - RNA, 64 nt, Human
aaccaguuuaauuuuuuuuuuccucauuguuggggaugaugagaagaaaugauuugggaaaauu

SEQ ID NO: 148499 - RNA, 64 nt, Human
aauugucacagugucccuucuacuucccucuauugaugaugaugaugaugaugaugaugaugau

SEQ ID NO: 148500 - RNA, 64 nt, Human
ugucacagugucccuucuacuucccucuauugaugaugaugaugaugaugaugaugaugaugau

SEQ ID NO: 148501 - RNA, 64 nt, Human
cacagugucccuucuacuucccucuauugaugaugaugaugaugaugaugaugaugaugaugau

SEQ ID NO: 148502 - RNA, 64 nt, Human
agugucccuucuacuucccucuauugaugaugaugaugaugaugaugaugaugaugaugaugau

SEQ ID NO: 148503 - RNA, 64 nt, Human
gucccuucuacuucccucuauugaugaugaugaugaugaugaugaugaugaugaugaugaugau

SEQ ID NO: 148504 - RNA, 64 nt, Human
ccuucuacuucccucuauugaugaugaugaugaugaugaugaugaugaugaugaugaugaugau

SEQ ID NO: 148505 - RNA, 64 nt, Human
ucuacuucccucuauugaugaugaugaugaugaugaugaugaugaugaugaugaugaugauggu

SEQ ID NO: 148506 - RNA, 64 nt, Human
acuucccucuauugaugaugaugaugaugaugaugaugaugaugaugaugaugaugaugguuuu

SEQ ID NO: 148507 - RNA, 64 nt, Human
ucccucuauugaugaugaugaugaugaugaugaugaugaugaugaugaugaugaugguuuuuuc

SEQ ID NO: 148508 - RNA, 64 nt, Human
cucuauugaugaugaugaugaugaugaugaugaugaugaugaugaugaugaugguuuuuucuaa

SEQ ID NO: 148509 - RNA, 64 nt, Human
uauugaugaugaugaugaugaugaugaugaugaugaugaugaugaugaugguuuuuucuaauca

SEQ ID NO: 148510 - RNA, 64 nt, Human
ugaugaugaugaugaugaugaugaugaugaugaugaugaugaugaugguuuuuucuaaucagaa

SEQ ID NO: 148511 - RNA, 64 nt, Human
ugaugaugaugaugaugaugaugaugaugaugaugaugaugaugguuuuuucuaaucagaagaa

SEQ ID NO: 148512 - RNA, 64 nt, Human
ugcccagaagcuuggggcagagguccuagcaggagaugaugaauucucguggcucucggccuuc

SEQ ID NO: 148513 - RNA, 64 nt, Human
uauuuuuguacauuugagccaugucacacaaacugaugaugacaggucagcaguauucuauuug

SEQ ID NO: 148514 - RNA, 64 nt, Human
gauuucagaaucaggagucagcucugacaaugaagaugaugaugaugaagaagaugggaauuac

SEQ ID NO: 148515 - RNA, 64 nt, Human
uucagaaucaggagucagcucugacaaugaagaugaugaugaugaagaagaugggaauuaccuu

SEQ ID NO: 148516 - RNA, 64 nt, Human
agaaucaggagucagcucugacaaugaagaugaugaugaugaagaagaugggaauuaccuucau

SEQ ID NO: 148517 - RNA, 64 nt, Human
ucugcuuccccuggaaaaaaaucguguuaagcuagaugaugacagugaugaugaugaagaaagc

SEQ ID NO: 148518 - RNA, 64 nt, Human
ggaaaaaaaucguguuaagcuagaugaugacagugaugaugaugaagaaagcaaagaaggccaa

SEQ ID NO: 148519 - RNA, 64 nt, Human
aaaaaaucguguuaagcuagaugaugacagugaugaugaugaagaaagcaaagaaggccaagaa

SEQ ID NO: 148520 - RNA, 64 nt, Human
gcuucugccaaaaaaaaaaagagaagaagaugacgaugaugaccagucguacuaucuuacugag

SEQ ID NO: 148521 - RNA, 64 nt, Human
ucuauguacagggguauuauauauauacauauaagaugaugauauauauaaugaugauauguau

SEQ ID NO: 148522 - RNA, 64 nt, Human
uugcugcuucucaauaucauagacacagugaauagaugaugacuauauggcuuauauacaaaca

SEQ ID NO: 148523 - RNA, 64 nt, Human
uaaauacaaaaauacauaaaaauacauaaaaucugaugaugaauauaaaaaaguaaccaaccuc

SEQ ID NO: 148524 - RNA, 64 nt, Human
aaacauugagggaacacaaauuuaugggcuuccugaugaugauucuucuaggcaucauguccua

SEQ ID NO: 148525 - RNA, 64 nt, Human
acauuucuacccagguuuugcuagagcagugugagaugaugaagguguauuuuugcugcuuuac

SEQ ID NO: 148526 - RNA, 64 nt, Human
uccaccuauaugaccaaucccuaauugcuguccugaugaugagucauuccaauuuacuggauuu

SEQ ID NO: 148527 - RNA, 64 nt, Human
ucccagggccauggagguccugcugcuggucugggaugaugaugccccuggaaaccuuccugca

SEQ ID NO: 148528 - RNA, 64 nt, Human
ugcauuugagauaggguuggaauauaguacucuagaugaugaauguguuugcuuuguguuuggu

SEQ ID NO: 148529 - RNA, 64 nt, Human
aauaugaaagauuuuaaaugaaaaaaauuuguuggaugaugauuuuugaaaaauagucaccaac

SEQ ID NO: 148530 - RNA, 64 nt, Human
guuccauccauagcauauuuccagaauaucccuagaugaugaauuuaaacaugccuucucagaa

SEQ ID NO: 148531 - RNA, 64 nt, Human
ucagguuaagauauagucuguggauggaucaucugaugaugauggauaaauuugauuuuugcuu

SEQ ID NO: 148532 - RNA, 64 nt, Human
gggggugacuuuuugaacuguuuauuauaugguggaugaugauuucaucucacgugcuggacgc

SEQ ID NO: 148533 - RNA, 64 nt, Human
agagaugauguuugcauuucuguuaugacagagagaugaugaaaguaggcagggcuguguuccu

SEQ ID NO: 148534 - RNA, 64 nt, Human
gagugauuaggcagcagcugaagccaccccugcugaugaugagcaagugccugcugcaggucca

SEQ ID NO: 148535 - RNA, 64 nt, Human
uugugaaugguaugaacuuuuaaaccauauuauugaugaugaaaauuauuuccugggaacucag

SEQ ID NO: 148536 - RNA, 64 nt, Human
agggacugaauuuaaauauuuguaagaacuuugugaugaugaguaauugucagacgugggauag

SEQ ID NO: 148537 - RNA, 64 nt, Human
aucauguuguuaaaauuaugaaucugauuuuuaugaugaugaaaauuuuaccagcagaaggauu

SEQ ID NO: 148538 - RNA, 64 nt, Human
gugagccgagauugcaccacugcaguucagccuggaugaugagagugagacuccaucgcaaaaa

SEQ ID NO: 148539 - RNA, 64 nt, Human
aguugaagaucuuugacauagguucuucuauagugaugaugaucucauucagaagaugcuuagc

SEQ ID NO: 148540 - RNA, 64 nt, Human
uuuaaagggucuacaacugaaugagcucaccauggaugaugauacugccgugcucgucauugac

SEQ ID NO: 148541 - RNA, 64 nt, Human
uaaggcuugcauuucccucccuguuucaguaaaagaugaugaaagccacuaucaauccucacug

SEQ ID NO: 148542 - RNA, 64 nt, Human
ucauuuuuaccagggcuuggggacccaaugcaaagaugaugacuauuuaauaaaauggaaaauu

SEQ ID NO: 148543 - RNA, 64 nt, Human; identical to SEQ ID NO: 148540

SEQ ID NO: 148544 - RNA, 64 nt, Human
guugucuuaaugcauuuauugagaacagcauugagaugaugaacaagggguuagcaauagcaaa

SEQ ID NO: 148545 - RNA, 64 nt, Human
ugcauguccagcuggauucuggccugccaaagaagaugaugauuaaaaacauagauauugcuug

SEQ ID NO: 148546 - RNA, 64 nt, Human
guauauacauauauauauuuucacuugcuuucaagaugaugaccacacauggauuuugauaugu

SEQ ID NO: 148547 - RNA, 64 nt, Human
ccugaaggaggucuaccccgacucagguucugccgaugaugagaggaucuugagguucuuggaa

SEQ ID NO: 148548 - RNA, 64 nt, Human
uagccagagagucaugccacguggucauuaaaccgaugaugauugaggcguggcagcguccuug

SEQ ID NO: 148549 - RNA, 64 nt, Human
gggucugguagauuauccugaugaugaugaagaugaugaugaggaugaagauaaggaagauacg

SEQ ID NO: 148550 - RNA, 64 nt, Human
cgugggucugguagauuauccugaugaugaugaagaugaugaugaggaugaagauaaggaagau

SEQ ID NO: 148551 - RNA, 64 nt, Human
gggaggccucgugggucugguagauuauccugaugaugaugaagaugaugaugaggaugaagau

SEQ ID NO: 148552 - RNA, 64 nt, Human
acagggaggccucgugggucugguagauuauccugaugaugaugaagaugaugaugaggaugaa

SEQ ID NO: 148553 - RNA, 64 nt, Human
agcuguagugucuccaucugacaaaacuaaaaaugaugaugauauuauggauccaauaaguaaa

SEQ ID NO: 148554 - RNA, 64 nt, Human
uuccucaaaguuguaguugucuguugaugauggugaugaugaugaugaugacgauagugaugcc

SEQ ID NO: 148555 - RNA, 64 nt, Human
cucaaaguuguaguugucuguugaugauggugaugaugaugaugaugacgauagugaugccaca

SEQ ID NO: 148556 - RNA, 64 nt, Human
aaaguuguaguugucuguugaugauggugaugaugaugaugaugacgauagugaugccacacau

SEQ ID NO: 148557 - RNA, 64 nt, Human
guuguaguugucuguugaugauggugaugaugaugaugaugacgauagugaugccacacauucu

SEQ ID NO: 148558 - RNA, 64 nt, Human
gaaaaacguacgcaagaggacauggauccaaaaugaugaugaagcaucucccauggggagguga

SEQ ID NO: 148559 - RNA, 64 nt, Human
aguauacucacuuaucucauccauggauguaaaugaugaugaaucaacauaguaacugaaauga

SEQ ID NO: 148560 - RNA, 64 nt, Human
ugcagaauaguguaaaaugcgcuucaagaauguugaugaugaugauauagaauuguggcuuuag

SEQ ID NO: 148561 - RNA, 64 nt, Human
agaauaguguaaaaugcgcuucaagaauguugaugaugaugauauagaauuguggcuuuaguag

SEQ ID NO: 148562 - RNA, 64 nt, Human
uuaccuuaccuacaaaaguggcuccuguuuguuugaugaugauugguuuuauuuuugaaauauu

SEQ ID NO: 148563 - RNA, 64 nt, Human
ugccuaaaaaggacaggugguuugacucauggaugaugaugaugucacugugccacuuggacag

SEQ ID NO: 148564 - RNA, 64 nt, Human
aaaugccuaaaaaggacaggugguuugacucauggaugaugaugaugucacugugccacuugga

SEQ ID NO: 148565 - RNA, 64 nt, Human
ugugggggacacugcugaugauucccaagauugagaugaugacggugaugacgacugggugaac

SEQ ID NO: 148566 - RNA, 64 nt, Human
ucccacaugaguacauauuggccagcggcuccgagaugaugaacuccggggucugagagugggc

SEQ ID NO: 148567 - RNA, 64 nt, Human
guuuuuggucugacccacugcuuuuggucugugugaugaugaaaugaggucagagccugcaguu

SEQ ID NO: 148568 - RNA, 64 nt, Human
uuuuauacugcuaagugcuugguugggguggugagaugaugauuagaucaggggugaggcugag

SEQ ID NO: 148569 - RNA, 64 nt, Human
acauggcaaugaugaguuuuuaaaaaacaguguggaugaugauaugcuuuugugagcaagcaaa

SEQ ID NO: 148570 - RNA, 64 nt, Human
ucauuaacugaaaaguagcagcuucucuauccaggaugaugagucaacagguuucacuaauauu

SEQ ID NO: 148571 - RNA, 64 nt, Human
ggaagaagauguccgugagaacaucauuacuuaugaugaugaaggggguggggaagaagacaca

SEQ ID NO: 148572 - RNA, 64 nt, Human
gaagcagagcucgccaccuucuggaggccacugugaugaugagccaagcaauuuggagccaagu

SEQ ID NO: 148573 - RNA, 64 nt, Human
cuggccacgcacaggcucuggcucuggaaggagggaugaugagugggcguuuucccggcaggcc

SEQ ID NO: 148574 - RNA, 64 nt, Human
aaaacuaccuaucugguacuaugcuuuuuaucuggaugaugaaauaaucuguacaacaaacccu

SEQ ID NO: 148575 - RNA, 64 nt, Human
auaggaagaaaauaugggaauuugauuacacauagaugaugauguuuauuuaaaaaaaaaacaa

SEQ ID NO: 148576 - RNA, 64 nt, Human
guuauacaacuuggcuuguuuaccuccacaugcugaugaugacuauuuuuuuuuuuugaguuca

SEQ ID NO: 148577 - RNA, 64 nt, Human
uucuauggagaacguugccuuauacucuacuucagaugaugaacacuguguacugugugugcuu

SEQ ID NO: 148578 - RNA, 64 nt, Human
ucuuuugauggguuuagucuugcccuggagugccgaugaugauucucccuccagagccacgcuu

SEQ ID NO: 148579 - RNA, 64 nt, Human
auucccugagacuuuucaggagagccagcccacagaugaugaagaaaugauggaaguucauuug

SEQ ID NO: 148580 - RNA, 64 nt, Human
aagagaguggcauccacuugugguaaccccuuacgaugaugacaucccacacacuaagagguac

SEQ ID NO: 148581 - RNA, 64 nt, Human
agaccugaaagauaacacuccuucaggaaaaagugaugaugauuuugcugacuuccacuccagu

SEQ ID NO: 148582 - RNA, 64 nt, Human
ccaucaucgaaacuccagaaauuuauccacuguggaugaugacaucgcuuuccuuuggucaagg

SEQ ID NO: 148583 - RNA, 64 nt, Human
ccucuggcucugagcccuguucugaccaaaucaugaugaugaguauuuggggguggguggguaa

SEQ ID NO: 148584 - RNA, 64 nt, Human
gggaguuggucugagugacaaggaauugguuucagaugaugaagaaagaggaacgggcuuggaa

SEQ ID NO: 148585 - RNA, 64 nt, Human
ggacgugaaauacuucgaugaugaugaugaugaugaugaugauaauaauaauaauaauaacaac

SEQ ID NO: 148586 - RNA, 64 nt, Human
ucuggacgugaaauacuucgaugaugaugaugaugaugaugaugauaauaauaauaauaauaac

SEQ ID NO: 148587 - RNA, 64 nt, Human
agcucuggacgugaaauacuucgaugaugaugaugaugaugaugaugauaauaauaauaauaau

SEQ ID NO: 148588 - RNA, 64 nt, Human
cuuagcucuggacgugaaauacuucgaugaugaugaugaugaugaugaugauaauaauaauaau

SEQ ID NO: 148589 - RNA, 64 nt, Human
ugucuuagcucuggacgugaaauacuucgaugaugaugaugaugaugaugaugauaauaauaau

SEQ ID NO: 148590 - RNA, 64 nt, Human
ucuugucuuagcucuggacgugaaauacuucgaugaugaugaugaugaugaugaugauaauaau

SEQ ID NO: 148591 - RNA, 64 nt, Human
uagucuugucuuagcucuggacgugaaauacuucgaugaugaugaugaugaugaugaugauaau

SEQ ID NO: 148592 - RNA, 64 nt, Human
ggugugcuccugaaugaagguuucuauguaagcagaugaugauuuuaccugucaauaccagcac

SEQ ID NO: 148593 - RNA, 64 nt, Human
ggugacuccagccucuuucuccuggaggucacaagaugaugauugcguagauguugccuggugc

SEQ ID NO: 148594 - RNA, 64 nt, Human
ugcuauuuuucauugacucuauugaacucuuuaggaugaugacugaucauacaaaacguauuau

SEQ ID NO: 148595 - RNA, 64 nt, Human
cauuccuuauucccaggcaagcuauagucagacagaugaugaaaguaacaugaaaacuggugau

SEQ ID NO: 148596 - RNA, 64 nt, Human
gcaguggucccuaguagccucucaagcuaauggggaugaugauccugguuuagccagaguucaa

SEQ ID NO: 148597 - RNA, 64 nt, Human
uuguuuuuauuuuuuuaucaugaacauuaaaugugaugaugauuucuuuucccugcacacaucu

SEQ ID NO: 148598 - RNA, 64 nt, Human
gaacuuugggcagagaucauguuagaaucaaguggaugaugagaccaauuacaggccgucucuc

SEQ ID NO: 148599 - RNA, 64 nt, Human
ucuugugggugccaacuuagggguugagcagguugaugaugagaucccagugagaagauggggg

SEQ ID NO: 148600 - RNA, 64 nt, Human
ucucuuggcucauauuucuuuucuaucucaucuugaugaugauagucaucaucaagaauuuaau

SEQ ID NO: 148601 - RNA, 64 nt, Human
ucucuuggcucauauuucuuuucuuucucaucuugaugaugaucgucaucaucaagaauuuaau

SEQ ID NO: 148602 - RNA, 64 nt, Human
gaaaauaccagcagugucauuuagggguuccuuugaugaugacuacugcuguuaacugaccuca

SEQ ID NO: 148603 - RNA, 64 nt, Human
aggagcuggggcaggccccauccugggcauuggagaugaugaaaccgagcagaccuggcccaug

SEQ ID NO: 148604 - RNA, 64 nt, Human
gagggguugcgggggagcuggaaauaaaccuggagaugaugaugaugaugaugaugaugaugau

SEQ ID NO: 148605 - RNA, 64 nt, Human
ggguugcgggggagcuggaaauaaaccuggagaugaugaugaugaugaugaugaugaugaugga

SEQ ID NO: 148606 - RNA, 64 nt, Human
uugcgggggagcuggaaauaaaccuggagaugaugaugaugaugaugaugaugaugauggagcg

SEQ ID NO: 148607 - RNA, 64 nt, Human
cgggggagcuggaaauaaaccuggagaugaugaugaugaugaugaugaugaugauggagcggau

SEQ ID NO: 148608 - RNA, 64 nt, Human
gggagcuggaaauaaaccuggagaugaugaugaugaugaugaugaugaugauggagcggaucug

SEQ ID NO: 148609 - RNA, 64 nt, Human
cccucgaagagccuggccagagagggaagacacagaugaugaagcuggagccagggcugccggu

SEQ ID NO: 148610 - RNA, 64 nt, Human
ccggcaagggguggagcuggaggagucucagcuggaugaugagaagggcugaaauguugccaag

SEQ ID NO: 148611 - RNA, 64 nt, Human
acccaggguucaggcguguuuucugugaauguuggaugaugaauuuuugucucuucugguggag

SEQ ID NO: 148612 - RNA, 64 nt, Human
caccguuuccagauguaauacugcaaagaaaaccgaugaugaggccgggugcgguggcucacac

SEQ ID NO: 148613 - RNA, 64 nt, Human
cuuuggacugaacaaugacccccaaaauucguaugaugaugaagcucucucuaaauauuuucuu

SEQ ID NO: 148614 - RNA, 64 nt, Human
uuuaacucaaggccuggggcaggggcguuuaauugaugaugacagaggacacagguuuuugcca

SEQ ID NO: 148615 - RNA, 64 nt, Human
gucggccgcuacuaggacugcccccggacccugcgaugaugacccgggcgcaaccugguggggg

SEQ ID NO: 148616 - RNA, 64 nt, Human
gucuugugauccuccuuauugauuuuucccucacgaugaugaacaauuaucucccguuacucac

SEQ ID NO: 148617 - RNA, 64 nt, Human
aggaguucuccuggagcaacuugaggguaauaaugaugaugauauaauaauaauagccacuauu

SEQ ID NO: 148618 - RNA, 64 nt, Human
agucugaauuagagagcacuuggaaagggcagaggaugaugaacuaugaugucacucaucaucc

SEQ ID NO: 148619 - RNA, 64 nt, Human
aucacucuugccauuaccuacaucuauuagcauagaugaugaaaagcuguuacuggugauuaua

SEQ ID NO: 148620 - RNA, 64 nt, Human
aagauucaugcagucccaaaaggcacuguccugggaugaugagagauuauaaggugauuucaua

SEQ ID NO: 148621 - RNA, 64 nt, Human
ucugcacgggaccuauuagaguauuuuccacaaugaugaugauuucagcagggaugacgucauc

SEQ ID NO: 148622 - RNA, 64 nt, Human
cacugguuuuguugccccagggcugcuuugcugugaugaugauugcauuucaacacaugccaga

SEQ ID NO: 148623 - RNA, 64 nt, Human
uagcaagaauugaggaagaauggugugggagagggaugaugaagagagagagggccugcuggag

SEQ ID NO: 148624 - RNA, 64 nt, Human
gcugcugcugaccgaaccucagccucucagacuugaugaugaaguaggugguccugaaaguuaa

SEQ ID NO: 148625 - RNA, 64 nt, Human
gggauuguuaggauggagcccaggccacauggaugaugaugauucucccccacagguucgaacc

SEQ ID NO: 148626 - RNA, 64 nt, Human
auggggauuguuaggauggagcccaggccacauggaugaugaugauucucccccacagguucga

SEQ ID NO: 148627 - RNA, 64 nt, Human
uacucuguggcucucagggccaauaaagccaugugaugaugagggucagcuugccugauggcug

SEQ ID NO: 148628 - RNA, 64 nt, Human
aguuugaguucgagccaaccaccucuguugguuagaugaugaauaaaaagguucugaagaaaag

SEQ ID NO: 148629 - RNA, 64 nt, Human
cucuggaccuuauccuugaaagaugaucaaaagcgaugaugagggaggcagucaucacgcaggu

SEQ ID NO: 148630 - RNA, 64 nt, Human
aaagaaauguaaacagaucgcacagaguaaagaagaugaugauguaauagugaauaaaccucau

SEQ ID NO: 148631 - RNA, 64 nt, Human
gguuccuguggagaaaaauggugaagaaaacaaagaugaugauaauguuuucagcagcaauuug

SEQ ID NO: 148632 - RNA, 64 nt, Human
gccaacagggaauucuaaacaacuaaaaacuccagaugaugaaugcacaacauaaugaugguua

SEQ ID NO: 148633 - RNA, 64 nt, Human
cucccacgugcugccucccuuaggaggggacacugaugaugaggucucggagccggcauccuuc

SEQ ID NO: 148634 - RNA, 64 nt, Human
aaaaaagcuauuuuuauaaauucguuaugaauuggaugaugacuauauugaggauaaaauuucu

SEQ ID NO: 148635 - RNA, 64 nt, Human
agacgcuggggcccaagaucaucauugugaagcggaugaugaaggacgucuucuucuuccucuu

SEQ ID NO: 148636 - RNA, 64 nt, Human
auaggugucuacugcagauauuucaucaaauaaggaugaugaagaaaacucuaugcacacuacg

SEQ ID NO: 148637 - RNA, 64 nt, Human
aaaggcacuuuuauugagaaugagaagaacuuuagaugaugauguauuuaugcccuuauauccc

SEQ ID NO: 148638 - RNA, 64 nt, Human
uaagauggcagaucaccuugaaggccuuuccagugaugaugaagaaacuucuacagauauuacu

SEQ ID NO: 148639 - RNA, 64 nt, Human
aacuauucccuugcaagugagauuauauaguaaagaugaugaaccagcuguaaaacuacaacua

SEQ ID NO: 148640 - RNA, 64 nt, Human
uaauucacugaagacacaggucccacagggagcggaugaugaagcagacccccuccugucauca

SEQ ID NO: 148641 - RNA, 64 nt, Human
ccgcugagcuucccuuggacacuaacucuucccagaugaugacaaugaaauuagugccuguuuu

SEQ ID NO: 148642 - RNA, 64 nt, Human
ugcguuugaagccucgcgucacucagucgcgugggaugaugaguccguuguugucugccuuggc

SEQ ID NO: 148643 - RNA, 64 nt, Human
ccgccgggcacccccccccaggcuccuggugccagaugaugacgaccuggguggaaaccuaccc

SEQ ID NO: 148644 - RNA, 64 nt, Human
uggacaguaccuagagucugugcgccccuuguuggaugaugaggaauauuaccgcauggaguug

SEQ ID NO: 148645 - RNA, 64 nt, Human
ugauguucucugacccagcagaaaucaucaucaugaugaugauaauuuauuaacuuuuuggaag

SEQ ID NO: 148646 - RNA, 64 nt, Human
ggugauuuaugaagagaucagagacccugaggaagaugaugaguaacuccguaagugaaccuuu

SEQ ID NO: 148647 - RNA, 64 nt, Human
ucugaacccuccaaaggaacucuagagggcgagggaugaugagggaagcaauagguagcugggg

SEQ ID NO: 148648 - RNA, 64 nt, Human
caucugaccaguuuucucuuaaagccauuuccaugaugaugaugaugggacucaauuguauuuu

SEQ ID NO: 148649 - RNA, 64 nt, Human
cugaccaguuuucucuuaaagccauuuccaugaugaugaugaugggacucaauuguauuuuuua

SEQ ID NO: 148650 - RNA, 64 nt, Human
auccacacccugcuugcuccuguguaacagcucagaugaugaauaauaauaaaacuguacuuuu

SEQ ID NO: 148651 - RNA, 64 nt, Human
gucucagcuucagguucuucaccucuaagauggggaugaugaaaacaguaccugucaugcagaa

SEQ ID NO: 148652 - RNA, 64 nt, Human
guccuggagggggcuccauucuccagucagaguagaugaugaggcccaugccccucacccccac

SEQ ID NO: 148653 - RNA, 64 nt, Human
aguuuucuaggugagcuucauucccugaaaggaggaugaugauaucuaggcauaaccuagccug

SEQ ID NO: 148654 - RNA, 64 nt, Human
gggagucaacucaacauggcagaaccauuuuugagaugaugauacaacagguagugaaacagcu

SEQ ID NO: 148655 - RNA, 64 nt, Human
gaaaugaauuaaaaaugugaaaucggguuaaagugaugaugauaaaauagcaugcaagaaacaa

SEQ ID NO: 148656 - RNA, 64 nt, Human
cuucuugaaauuugugauggccaagaaagaaaaugaugaugacauuaggcuucuaaaggacaua

SEQ ID NO: 148657 - RNA, 64 nt, Human
ugccccuuucagagacggagcaccugagaugugggaggugcagcauguuccccugggccccuca

SEQ ID NO: 148658 - RNA, 64 nt, Human
ggaugguggaagguggggacguugguggcuggcugaggugcaugggccccacacaggacagcug

SEQ ID NO: 148659 - RNA, 64 nt, Human
uguccauucacuguguauagauggcagaacuuuugaggugcaauguuuaauuguuaaaaauagu

SEQ ID NO: 148660 - RNA, 64 nt, Human
gcugccaaccucacagaguguuugcuaggcgagagaggugcagggaagaggcagagguaugcac

SEQ ID NO: 148661 - RNA, 64 nt, Human
aaguuauucuugcaccacaugcucaaaucuucuugaggugcauuaacucuuuuagguaacuaga

SEQ ID NO: 148662 - RNA, 64 nt, Human
uuuacaaagggcuuaggcugcauuuccuucuauagaggugcauucuuguagaaauuuguagcau

SEQ ID NO: 148663 - RNA, 64 nt, Human
ggacugguucuguguagauagagauggugucaaggaggugcaggauggagaugggagauuucau

SEQ ID NO: 148664 - RNA, 64 nt, Human
aucagagacugagaugggagaggccugagacggagaggugcauuucugcuggugacuggaggag

SEQ ID NO: 148665 - RNA, 64 nt, Human
gggauaaucugccuuguauuuagucagagggcuagaggugcagauuucauauuuucuuaaugaa

SEQ ID NO: 148666 - RNA, 64 nt, Human
gggcugcgugaaaaacccagcugggccugggguggaggugcacacgggcuggggcucagcuccu

SEQ ID NO: 148667 - RNA, 64 nt, Human
uuuggugcuaauaugacauaugacaauaagccacgaggugcaguaaguacccgacuaaaguuuc

SEQ ID NO: 148668 - RNA, 64 nt, Human
ccagcucucucugcucaccuuccaaaggcaccuggaggugcaagccucaugcaucuccuuuccu

SEQ ID NO: 148669 - RNA, 64 nt, Human
agucagggucugguuggcuccccauugccugcccgaggugcaaggugggguauaaaacuggaua

SEQ ID NO: 148670 - RNA, 64 nt, Human
uucugugggcccuggccagacaggguuaccuggugaggugcagagagucccucuaguggccauu

SEQ ID NO: 148671 - RNA, 64 nt, Human
auggaauagguaggcaagccaggacuccgggaaggaggugcagccaggaugcucugguggagcu

SEQ ID NO: 148672 - RNA, 64 nt, Human
ucuuacuuggucagaagugcuaaaucugcuaguagaggugcaugccuuucauugcuuuucaaaa

SEQ ID NO: 148673 - RNA, 64 nt, Human
gagcccacagcuuugaccacugugauccagaagagaggugcacuacgugggaagugcugauucc

SEQ ID NO: 148674 - RNA, 64 nt, Human
augcaggacaauugcauuuuaguuuuauuuuguggaggugcagaauauuuacucuuucugucca

SEQ ID NO: 148675 - RNA, 64 nt, Human
caugaaggggguuggggucugugugaguaguggggaggugcauguguauccacaugugugcaua

SEQ ID NO: 148676 - RNA, 64 nt, Human
auucugcuccuuccccaucguugcccccauuucugaggugcacugggaggcuccccuucuauuu

SEQ ID NO: 148677 - RNA, 64 nt, Human
augggaguugagcccuggaauggggcucuauggagaggugcauaggacucggcagaaauggccu

SEQ ID NO: 148678 - RNA, 64 nt, Human
cagcauaguggaggggagaggcagaacuggaggagaggugcagugaagguucucuacagcuaag

SEQ ID NO: 148679 - RNA, 64 nt, Human
gacuugauguugcuguaccagggcuuccuccccagaggugcagcuugcguuuugagggugauug

SEQ ID NO: 148680 - RNA, 64 nt, Human
gucugugagcuuggugguuauuuguacauaaucggaggugcagaaucuuggaauugucugaaca

SEQ ID NO: 148681 - RNA, 64 nt, Human
acgcagguggacuuggggcaaguucagaucagaagaggugcaggcuggcaccugcggcagguac

SEQ ID NO: 148682 - RNA, 64 nt, Human
gugcucaggccaggugugaauccugagguccauggaggugcagagaugagauuacuccuauuca

SEQ ID NO: 148683 - RNA, 64 nt, Human
uuuguggacugguucagggaaggaggggaaaagggaggugcagagagcucuaagccagugugcu

SEQ ID NO: 148684 - RNA, 64 nt, Human
uggaguuauuucaccacaaaucaacaaugugccugaggugcaugggaaauauaguuagcuauac

SEQ ID NO: 148685 - RNA, 64 nt, Human
aucuuugauuagacaagccugggaagagaauguugaggugcagagcucaccagccaaguucaug

SEQ ID NO: 148686 - RNA, 64 nt, Human
caugaccaccacugagggcccggagcaggguggggaggugcaguggcacccccagagccaacag
